United States Patent 11,640,849 (METHODS FOR HISTOLOGICAL DIAGNOSIS AND TREATMENT OF DISEASES) - sequence listing, part 2

SEQ ID NO: 38929 - protein, 5 aa, Mycobacterium avium
LEKMG

SEQ ID NO: 38930 - protein, 7 aa, Mycobacterium avium
LELGPSG

SEQ ID NO: 38931 - protein, 9 aa, Mycobacterium avium
LENDPSHPK

SEQ ID NO: 38932 - protein, 4 aa, Mycobacterium avium
LENG

SEQ ID NO: 38933 - protein, 9 aa, Mycobacterium avium
LENPGPDDM

SEQ ID NO: 38934 - protein, 10 aa, Mycobacterium avium
LENQPGAEDE

SEQ ID NO: 38935 - protein, 10 aa, Mycobacterium avium
LENRNDDEAV

SEQ ID NO: 38936 - protein, 15 aa, Mycobacterium avium
LENRTAKGKVVLRVR

SEQ ID NO: 38937 - protein, 4 aa, Mycobacterium avium
LEPG

SEQ ID NO: 38938 - protein, 8 aa, Mycobacterium avium
LEPGAYSR

SEQ ID NO: 38939 - protein, 15 aa, Mycobacterium avium
LEPGGRPDAPEPGPA

SEQ ID NO: 38940 - protein, 10 aa, Mycobacterium avium
LEPGSPDQRR

SEQ ID NO: 38941 - protein, 5 aa, Mycobacterium avium
LEPHD

SEQ ID NO: 38942 - protein, 10 aa, Mycobacterium avium
LEPSDKSQVR

SEQ ID NO: 38943 - protein, 6 aa, Mycobacterium avium
LEPTAQ

SEQ ID NO: 38944 - protein, 7 aa, Mycobacterium avium
LEPYRRN

SEQ ID NO: 38945 - protein, 13 aa, Mycobacterium avium
LERARAKAGAAGA

SEQ ID NO: 38946 - protein, 6 aa, Mycobacterium avium
LEREPG

SEQ ID NO: 38947 - protein, 12 aa, Mycobacterium avium
LERSRPVGVSPV

SEQ ID NO: 38948 - protein, 15 aa, Mycobacterium avium
LERTRDRAAQAGTAE

SEQ ID NO: 38949 - protein, 4 aa, Mycobacterium avium
LESA

SEQ ID NO: 38950 - protein, 11 aa, Mycobacterium avium
LESAPRPATMP

SEQ ID NO: 38951 - protein, 9 aa, Mycobacterium avium
LESGSPVRG

SEQ ID NO: 38952 - protein, 17 aa, Mycobacterium avium
LESGSWADATGLSVEDG

SEQ ID NO: 38953 - protein, 13 aa, Mycobacterium avium
LESNRDKAIEVTS

SEQ ID NO: 38954 - protein, 7 aa, Mycobacterium avium
LESPPRD

SEQ ID NO: 38955 - protein, 5 aa, Mycobacterium avium
LESRG

SEQ ID NO: 38956 - protein, 9 aa, Mycobacterium avium
LETENPEAV

SEQ ID NO: 38957 - protein, 8 aa, Mycobacterium avium
LETKSGKT

SEQ ID NO: 38958 - protein, 9 aa, Mycobacterium avium
LETQDRTNR

SEQ ID NO: 38959 - protein, 4 aa, Mycobacterium avium
LEVP

SEQ ID NO: 38960 - protein, 7 aa, Mycobacterium avium
LFDPESK

SEQ ID NO: 38961 - protein, 9 aa, Mycobacterium avium
LFPSERPAF

SEQ ID NO: 38962 - protein, 5 aa, Mycobacterium avium
LGAAS

SEQ ID NO: 38963 - protein, 4 aa, Mycobacterium avium
LGAD

SEQ ID NO: 38964 - protein, 12 aa, Mycobacterium avium
LGAPGPAPDESV

SEQ ID NO: 38965 - protein, 4 aa, Mycobacterium avium
LGAQ

SEQ ID NO: 38966 - protein, 8 aa, Mycobacterium avium
LGARQGAG

SEQ ID NO: 38967 - protein, 5 aa, Mycobacterium avium
LGASG

SEQ ID NO: 38968 - protein, 11 aa, Mycobacterium avium
LGASYDGAGTN

SEQ ID NO: 38969 - protein, 5 aa, Mycobacterium avium
LGATE

SEQ ID NO: 38970 - protein, 5 aa, Mycobacterium avium
LGATG

SEQ ID NO: 38971 - protein, 6 aa, Mycobacterium avium
LGATGV

SEQ ID NO: 38972 - protein, 10 aa, Mycobacterium avium
LGDDGRPTRV

SEQ ID NO: 38973 - protein, 7 aa, Mycobacterium avium
LGDDKTR

SEQ ID NO: 38974 - protein, 4 aa, Mycobacterium avium
LGDE

SEQ ID NO: 38975 - protein, 6 aa, Mycobacterium avium
LGDGGL

SEQ ID NO: 38976 - protein, 5 aa, Mycobacterium avium
LGDGP

SEQ ID NO: 38977 - protein, 10 aa, Mycobacterium avium
LGDPAATAAL

SEQ ID NO: 38978 - protein, 5 aa, Mycobacterium avium
LGDPH

SEQ ID NO: 38979 - protein, 5 aa, Mycobacterium avium
LGDPK

SEQ ID NO: 38980 - protein, 12 aa, Mycobacterium avium
LGDPPGGWPEPL

SEQ ID NO: 38981 - protein, 11 aa, Mycobacterium avium
LGDRGERTTRV

SEQ ID NO: 38982 - protein, 14 aa, Mycobacterium avium
LGDRQRKALLEKFG

SEQ ID NO: 38983 - protein, 9 aa, Mycobacterium avium
LGDTAEPAY

SEQ ID NO: 38984 - protein, 6 aa, Mycobacterium avium
LGDTDA

SEQ ID NO: 38985 - protein, 13 aa, Mycobacterium avium
LGEDEATDDDYSE

SEQ ID NO: 38986 - protein, 8 aa, Mycobacterium avium
LGEDGDPL

SEQ ID NO: 38987 - protein, 10 aa, Mycobacterium avium
LGEDGPTHQP

SEQ ID NO: 38988 - protein, 6 aa, Mycobacterium avium
LGEDVS

SEQ ID NO: 38989 - protein, 6 aa, Mycobacterium avium
LGEEDK

SEQ ID NO: 38990 - protein, 6 aa, Mycobacterium avium
LGEGGH

SEQ ID NO: 38991 - protein, 5 aa, Mycobacterium avium
LGEKD

SEQ ID NO: 38992 - protein, 4 aa, Mycobacterium avium
LGEL

SEQ ID NO: 38993 - protein, 13 aa, Mycobacterium avium
LGEPLSAEQTARA

SEQ ID NO: 38994 - protein, 4 aa, Mycobacterium avium
LGER

SEQ ID NO: 38995 - protein, 8 aa, Mycobacterium avium
LGERPDIQ

SEQ ID NO: 38996 - protein, 11 aa, Mycobacterium avium
LGETAPSLKGL

SEQ ID NO: 38997 - protein, 5 aa, Mycobacterium avium
LGETR

SEQ ID NO: 38998 - protein, 34 aa, Mycobacterium avium
LGETRQTVRASGAPHPLAARPNPDAPPAAPRVNR

SEQ ID NO: 38999 - protein, 10 aa, Mycobacterium avium
LGGAGGELAD

SEQ ID NO: 39000 - protein, 8 aa, Mycobacterium avium
LGGAPKNP

SEQ ID NO: 39001 - protein, 9 aa, Mycobacterium avium
LGGAPVGTQ

SEQ ID NO: 39002 - protein, 7 aa, Mycobacterium avium
LGGASSA

SEQ ID NO: 39003 - protein, 5 aa, Mycobacterium avium
LGGDA

SEQ ID NO: 39004 - protein, 6 aa, Mycobacterium avium
LGGDDD

SEQ ID NO: 39005 - protein, 6 aa, Mycobacterium avium
LGGDDF

SEQ ID NO: 39006 - protein, 7 aa, Mycobacterium avium
LGGDGPH

SEQ ID NO: 39007 - protein, 5 aa, Mycobacterium avium
LGGDS

SEQ ID NO: 39008 - protein, 7 aa, Mycobacterium avium
LGGEPYV

SEQ ID NO: 39009 - protein, 9 aa, Mycobacterium avium
LGGERTRGA

SEQ ID NO: 39010 - protein, 4 aa, Mycobacterium avium
LGGG

SEQ ID NO: 39011 - protein, 8 aa, Mycobacterium avium
LGGGQAAL

SEQ ID NO: 39012 - protein, 6 aa, Mycobacterium avium
LGGHGS

SEQ ID NO: 39013 - protein, 5 aa, Mycobacterium avium
LGGKS

SEQ ID NO: 39014 - protein, 9 aa, Mycobacterium avium
LGGLGRGEE

SEQ ID NO: 39015 - protein, 10 aa, Mycobacterium avium
LGGNPDGSLP

SEQ ID NO: 39016 - protein, 12 aa, Mycobacterium avium
LGGNPEKVNPLA

SEQ ID NO: 39017 - protein, 7 aa, Mycobacterium avium
LGGPGYG

SEQ ID NO: 39018 - protein, 21 aa, Mycobacterium avium
LGGPPAALRAETDDTVREAAR

SEQ ID NO: 39019 - protein, 5 aa, Mycobacterium avium
LGGPR

SEQ ID NO: 39020 - protein, 22 aa, Mycobacterium avium
LGGPSGDADAWPDNPEEPDQPV

SEQ ID NO: 39021 - protein, 8 aa, Mycobacterium avium
LGGRAGYY

SEQ ID NO: 39022 - protein, 7 aa, Mycobacterium avium
LGGRRGR

SEQ ID NO: 39023 - protein, 17 aa, Mycobacterium avium
LGGRTAAQAIEDGVDPR

SEQ ID NO: 39024 - protein, 7 aa, Mycobacterium avium
LGGSNPS

SEQ ID NO: 39025 - protein, 14 aa, Mycobacterium avium
LGGSSSRRADGSYR

SEQ ID NO: 39026 - protein, 4 aa, Mycobacterium avium
LGGT

SEQ ID NO: 39027 - protein, 7 aa, Mycobacterium avium
LGGTPGQ

SEQ ID NO: 39028 - protein, 9 aa, Mycobacterium avium
LGHPPPSCG

SEQ ID NO: 39029 - protein, 6 aa, Mycobacterium avium
LGKGEA

SEQ ID NO: 39030 - protein, 4 aa, Mycobacterium avium
LGKT

SEQ ID NO: 39031 - protein, 17 aa, Mycobacterium avium
LGLRGTRKAEEAAESAR

SEQ ID NO: 39032 - protein, 8 aa, Mycobacterium avium
LGNDGNTA

SEQ ID NO: 39033 - protein, 7 aa, Mycobacterium avium
LGNGGTA

SEQ ID NO: 39034 - protein, 8 aa, Mycobacterium avium
LGNPAAAR

SEQ ID NO: 39035 - protein, 6 aa, Mycobacterium avium
LGNSPA

SEQ ID NO: 39036 - protein, 8 aa, Mycobacterium avium
LGNTPQRV

SEQ ID NO: 39037 - protein, 9 aa, Mycobacterium avium
LGPAAARDS

SEQ ID NO: 39038 - protein, 8 aa, Mycobacterium avium
LGPAATLA

SEQ ID NO: 39039 - protein, 7 aa, Mycobacterium avium
LGPAEQR

SEQ ID NO: 39040 - protein, 7 aa, Mycobacterium avium
LGPDATQ

SEQ ID NO: 39041 - protein, 6 aa, Mycobacterium avium
LGPDEH

SEQ ID NO: 39042 - protein, 5 aa, Mycobacterium avium
LGPDL

SEQ ID NO: 39043 - protein, 9 aa, Mycobacterium avium
LGPDRVKPG

SEQ ID NO: 39044 - protein, 4 aa, Mycobacterium avium
LGPE

SEQ ID NO: 39045 - protein, 7 aa, Mycobacterium avium
LGPEEPA

SEQ ID NO: 39046 - protein, 5 aa, Mycobacterium avium
LGPEY

SEQ ID NO: 39047 - protein, 8 aa, Mycobacterium avium
LGPGESRH

SEQ ID NO: 39048 - protein, 5 aa, Mycobacterium avium
LGPGH

SEQ ID NO: 39049 - protein, 6 aa, Mycobacterium avium
LGPGPS

SEQ ID NO: 39050 - protein, 9 aa, Mycobacterium avium
LGPHSGADP

SEQ ID NO: 39051 - protein, 4 aa, Mycobacterium avium
LGPK

SEQ ID NO: 39052 - protein, 22 aa, Mycobacterium avium
LGPPERAPKGAGTRSGGRRRSS

SEQ ID NO: 39053 - protein, 17 aa, Mycobacterium avium
LGPPETTPLQGPNFQQQ

SEQ ID NO: 39054 - protein, 8 aa, Mycobacterium avium
LGPPPPDL

SEQ ID NO: 39055 - protein, 6 aa, Mycobacterium avium
LGPQDC

SEQ ID NO: 39056 - protein, 7 aa, Mycobacterium avium
LGPQPPI

SEQ ID NO: 39057 - protein, 5 aa, Mycobacterium avium
LGPQR

SEQ ID NO: 39058 - protein, 6 aa, Mycobacterium avium
LGPRDA

SEQ ID NO: 39059 - protein, 15 aa, Mycobacterium avium
LGPSARTEAPDPPGP

SEQ ID NO: 39060 - protein, 10 aa, Mycobacterium avium
LGPSGSGKST

SEQ ID NO: 39061 - protein, 23 aa, Mycobacterium avium
LGPTSRTASISPDVNDPGARNVT

SEQ ID NO: 39062 - protein, 5 aa, Mycobacterium avium
LGPVA

SEQ ID NO: 39063 - protein, 10 aa, Mycobacterium avium
LGQASPMGIP

SEQ ID NO: 39064 - protein, 6 aa, Mycobacterium avium
LGQGEF

SEQ ID NO: 39065 - protein, 10 aa, Mycobacterium avium
LGQNGPYGQV

SEQ ID NO: 39066 - protein, 4 aa, Mycobacterium avium
LGRA

SEQ ID NO: 39067 - protein, 10 aa, Mycobacterium avium
LGRAGQPAEL

SEQ ID NO: 39068 - protein, 10 aa, Mycobacterium avium
LGRAPNAGEL

SEQ ID NO: 39069 - protein, 5 aa, Mycobacterium avium
LGREG

SEQ ID NO: 39070 - protein, 9 aa, Mycobacterium avium
LGREGGGIG

SEQ ID NO: 39071 - protein, 4 aa, Mycobacterium avium
LGRG

SEQ ID NO: 39072 - protein, 10 aa, Mycobacterium avium
LGRNGKTKLS

SEQ ID NO: 39073 - protein, 5 aa, Mycobacterium avium
LGRPE

SEQ ID NO: 39074 - protein, 25 aa, Mycobacterium avium
LGRPGPHRRYAAQTSDISYGPGGRD

SEQ ID NO: 39075 - protein, 11 aa, Mycobacterium avium
LGRPGTPADCA

SEQ ID NO: 39076 - protein, 20 aa, Mycobacterium avium
LGRPRRRRAAGRPAGPPIHA

SEQ ID NO: 39077 - protein, 7 aa, Mycobacterium avium
LGRPVGD

SEQ ID NO: 39078 - protein, 6 aa, Mycobacterium avium
LGRQRD

SEQ ID NO: 39079 - protein, 7 aa, Mycobacterium avium
LGRRRPD

SEQ ID NO: 39080 - protein, 6 aa, Mycobacterium avium
LGRSGG

SEQ ID NO: 39081 - protein, 14 aa, Mycobacterium avium
LGRTQNGNNNGYCQ

SEQ ID NO: 39082 - protein, 10 aa, Mycobacterium avium
LGSDGGGSIR

SEQ ID NO: 39083 - protein, 6 aa, Mycobacterium avium
LGSETK

SEQ ID NO: 39084 - protein, 7 aa, Mycobacterium avium
LGSGEPV

SEQ ID NO: 39085 - protein, 6 aa, Mycobacterium avium
LGSGGL

SEQ ID NO: 39086 - protein, 8 aa, Mycobacterium avium
LGSGQTTK

SEQ ID NO: 39087 - protein, 8 aa, Mycobacterium avium
LGSGRSDR

SEQ ID NO: 39088 - protein, 5 aa, Mycobacterium avium
LGSGV

SEQ ID NO: 39089 - protein, 8 aa, Mycobacterium avium
LGSKGTKR

SEQ ID NO: 39090 - protein, 6 aa, Mycobacterium avium
LGSPKQ

SEQ ID NO: 39091 - protein, 7 aa, Mycobacterium avium
LGSPLTA

SEQ ID NO: 39092 - protein, 12 aa, Mycobacterium avium
LGSQITDSDTGF

SEQ ID NO: 39093 - protein, 7 aa, Mycobacterium avium
LGSRDAK

SEQ ID NO: 39094 - protein, 9 aa, Mycobacterium avium
LGSSDVDRD

SEQ ID NO: 39095 - protein, 5 aa, Mycobacterium avium
LGSSV

SEQ ID NO: 39096 - protein, 9 aa, Mycobacterium avium
LGSTGLGRD

SEQ ID NO: 39097 - protein, 7 aa, Mycobacterium avium
LGTDGRQ

SEQ ID NO: 39098 - protein, 32 aa, Mycobacterium avium
LGTEPPTSDAPVSPPAPPPPSGPASALGADNA

SEQ ID NO: 39099 - protein, 7 aa, Mycobacterium avium
LGTERSA

SEQ ID NO: 39100 - protein, 8 aa, Mycobacterium avium
LGTETSEY

SEQ ID NO: 39101 - protein, 5 aa, Mycobacterium avium
LGTGS

SEQ ID NO: 39102 - protein, 17 aa, Mycobacterium avium
LGTNPRKSTKTGAGERD

SEQ ID NO: 39103 - protein, 7 aa, Mycobacterium avium
LGTPKQR

SEQ ID NO: 39104 - protein, 6 aa, Mycobacterium avium
LGTPPA

SEQ ID NO: 39105 - protein, 5 aa, Mycobacterium avium
LGTRH

SEQ ID NO: 39106 - protein, 6 aa, Mycobacterium avium
LGTSGE

SEQ ID NO: 39107 - protein, 11 aa, Mycobacterium avium
LGTSGGLRTDE

SEQ ID NO: 39108 - protein, 6 aa, Mycobacterium avium
LGTSPA

SEQ ID NO: 39109 - protein, 19 aa, Mycobacterium avium
LGTSRQGFHSAQESCKESL

SEQ ID NO: 39110 - protein, 4 aa, Mycobacterium avium
LGTT

SEQ ID NO: 39111 - protein, 10 aa, Mycobacterium avium
LGVNPTNDGT

SEQ ID NO: 39112 - protein, 19 aa, Mycobacterium avium
LGVTNPGYRPGDTATALPA

SEQ ID NO: 39113 - protein, 4 aa, Mycobacterium avium
LHGG

SEQ ID NO: 39114 - protein, 4 aa, Mycobacterium avium
LHPD

SEQ ID NO: 39115 - protein, 15 aa, Mycobacterium avium
LHPDANPDNPAAGER

SEQ ID NO: 39116 - protein, 5 aa, Mycobacterium avium
LHPPA

SEQ ID NO: 39117 - protein, 6 aa, Mycobacterium avium
LHQGGT

SEQ ID NO: 39118 - protein, 6 aa, Mycobacterium avium
LHTNRG

SEQ ID NO: 39119 - protein, 7 aa, Mycobacterium avium
LIGGQED

SEQ ID NO: 39120 - protein, 9 aa, Mycobacterium avium
LKAAREGKI

SEQ ID NO: 39121 - protein, 5 aa, Mycobacterium avium
LKAGQ

SEQ ID NO: 39122 - protein, 14 aa, Mycobacterium avium
LKASQLEWSAYAEK

SEQ ID NO: 39123 - protein, 4 aa, Mycobacterium avium
LKDP

SEQ ID NO: 39124 - protein, 10 aa, Mycobacterium avium
LKDQTYNTPA

SEQ ID NO: 39125 - protein, 11 aa, Mycobacterium avium
LKDSGERNDVA

SEQ ID NO: 39126 - protein, 6 aa, Mycobacterium avium
LKEGRG

SEQ ID NO: 39127 - protein, 17 aa, Mycobacterium avium
LKEGSKSRAKVSEQGLD

SEQ ID NO: 39128 - protein, 12 aa, Mycobacterium avium
LKGEGGSSWGNQ

SEQ ID NO: 39129 - protein, 9 aa, Mycobacterium avium
LKKPASVED

SEQ ID NO: 39130 - protein, 10 aa, Mycobacterium avium
LKKSERGEYE

SEQ ID NO: 39131 - protein, 9 aa, Mycobacterium avium
LKNPGPDDL

SEQ ID NO: 39132 - protein, 4 aa, Mycobacterium avium
LKPA

SEQ ID NO: 39133 - protein, 7 aa, Mycobacterium avium
LKPAPAT

SEQ ID NO: 39134 - protein, 7 aa, Mycobacterium avium
LKPEKDG

SEQ ID NO: 39135 - protein, 5 aa, Mycobacterium avium
LKPES

SEQ ID NO: 39136 - protein, 12 aa, Mycobacterium avium
LKPGSPAYRYLL

SEQ ID NO: 39137 - protein, 4 aa, Mycobacterium avium
LKQK

SEQ ID NO: 39138 - protein, 7 aa, Mycobacterium avium
LKQSGGK

SEQ ID NO: 39139 - protein, 8 aa, Mycobacterium avium
LKRGGTNL

SEQ ID NO: 39140 - protein, 8 aa, Mycobacterium avium
LKSAKAEA

SEQ ID NO: 39141 - protein, 7 aa, Mycobacterium avium
LKSASDL

SEQ ID NO: 39142 - protein, 7 aa, Mycobacterium avium
LKSDQGR

SEQ ID NO: 39143 - protein, 6 aa, Mycobacterium avium
LKTEPA

SEQ ID NO: 39144 - protein, 15 aa, Mycobacterium avium
LKVDTRDGSYLGRVN

SEQ ID NO: 39145 - protein, 5 aa, Mycobacterium avium
LLGPP

SEQ ID NO: 39146 - protein, 13 aa, Mycobacterium avium
LLGSPGQANYSTA

SEQ ID NO: 39147 - protein, 6 aa, Mycobacterium avium
LLPGNG

SEQ ID NO: 39148 - protein, 25 aa, Mycobacterium avium
LLPPPQQPPGREPTHRRAVSRSSPG

SEQ ID NO: 39149 - protein, 10 aa, Mycobacterium avium
LNADKTVEQV

SEQ ID NO: 39150 - protein, 9 aa, Mycobacterium avium
LNADPAVAQ

SEQ ID NO: 39151 - protein, 4 aa, Mycobacterium avium
LNAS

SEQ ID NO: 39152 - protein, 12 aa, Mycobacterium avium
LNASGRSPAAWT

SEQ ID NO: 39153 - protein, 10 aa, Mycobacterium avium
LNASTPGDGV

SEQ ID NO: 39154 - protein, 6 aa, Mycobacterium avium
LNDNRR

SEQ ID NO: 39155 - protein, 7 aa, Mycobacterium avium
LNDPEST

SEQ ID NO: 39156 - protein, 10 aa, Mycobacterium avium
LNDPPPAKLY

SEQ ID NO: 39157 - protein, 13 aa, Mycobacterium avium
LNEAETKAGAAGG

SEQ ID NO: 39158 - protein, 7 aa, Mycobacterium avium
LNEDPDL

SEQ ID NO: 39159 - protein, 9 aa, Mycobacterium avium
LNEKKHPNS

SEQ ID NO: 39160 - protein, 6 aa, Mycobacterium avium
LNGEGI

SEQ ID NO: 39161 - protein, 18 aa, Mycobacterium avium
LNGGPAKPTDKPPRPFEA

SEQ ID NO: 39162 - protein, 17 aa, Mycobacterium avium
LNGSQRDIAGVSSADGR

SEQ ID NO: 39163 - protein, 7 aa, Mycobacterium avium
LNHTGSH

SEQ ID NO: 39164 - protein, 10 aa, Mycobacterium avium
LNKGKTPKTV

SEQ ID NO: 39165 - protein, 6 aa, Mycobacterium avium
LNLPST

SEQ ID NO: 39166 - protein, 4 aa, Mycobacterium avium
LNNP

SEQ ID NO: 39167 - protein, 9 aa, Mycobacterium avium
LNNPEYANL

SEQ ID NO: 39168 - protein, 6 aa, Mycobacterium avium
LNNTRE

SEQ ID NO: 39169 - protein, 8 aa, Mycobacterium avium
LNPAPTRD

SEQ ID NO: 39170 - protein, 6 aa, Mycobacterium avium
LNPEGD

SEQ ID NO: 39171 - protein, 14 aa, Mycobacterium avium
LNPGAVATPMGTGR

SEQ ID NO: 39172 - protein, 10 aa, Mycobacterium avium
LNPGGSSKDR

SEQ ID NO: 39173 - protein, 7 aa, Mycobacterium avium
LNPRTRE

SEQ ID NO: 39174 - protein, 6 aa, Mycobacterium avium
LNPSTG

SEQ ID NO: 39175 - protein, 5 aa, Mycobacterium avium
LNQAE

SEQ ID NO: 39176 - protein, 6 aa, Mycobacterium avium
LNRGPQ

SEQ ID NO: 39177 - protein, 9 aa, Mycobacterium avium
LNSDPDEAF

SEQ ID NO: 39178 - protein, 9 aa, Mycobacterium avium
LNTAGGQLG

SEQ ID NO: 39179 - protein, 9 aa, Mycobacterium avium
LNTAGGQLS

SEQ ID NO: 39180 - protein, 11 aa, Mycobacterium avium
LNTDRRQATAA

SEQ ID NO: 39181 - protein, 14 aa, Mycobacterium avium
LNTHGGQLSHGRTH

SEQ ID NO: 39182 - protein, 6 aa, Mycobacterium avium
LNTPKA

SEQ ID NO: 39183 - protein, 11 aa, Mycobacterium avium
LNVNGSSLAAG

SEQ ID NO: 39184 - protein, 6 aa, Mycobacterium avium
LNVSGG

SEQ ID NO: 39185 - protein, 22 aa, Mycobacterium avium
LPAARRQSLRSAPAADRSGPAP

SEQ ID NO: 39186 - protein, 8 aa, Mycobacterium avium
LPADGQTP

SEQ ID NO: 39187 - protein, 7 aa, Mycobacterium avium
LPADGTR

SEQ ID NO: 39188 - protein, 5 aa, Mycobacterium avium
LPADL

SEQ ID NO: 39189 - protein, 12 aa, Mycobacterium avium
LPADPAATDRTS

SEQ ID NO: 39190 - protein, 13 aa, Mycobacterium avium
LPADTALATGPQA

SEQ ID NO: 39191 - protein, 12 aa, Mycobacterium avium
LPAEAAAVPTRG

SEQ ID NO: 39192 - protein, 11 aa, Mycobacterium avium
LPAEKKPSVRT

SEQ ID NO: 39193 - protein, 10 aa, Mycobacterium avium
LPAESRDALT

SEQ ID NO: 39194 - protein, 5 aa, Mycobacterium avium
LPAGE

SEQ ID NO: 39195 - protein, 14 aa, Mycobacterium avium
LPAGGRRLDQTADG

SEQ ID NO: 39196 - protein, 15 aa, Mycobacterium avium
LPAGPDERIRRGPDP

SEQ ID NO: 39197 - protein, 5 aa, Mycobacterium avium
LPAGR

SEQ ID NO: 39198 - protein, 10 aa, Mycobacterium avium
LPAGRPELAG

SEQ ID NO: 39199 - protein, 5 aa, Mycobacterium avium
LPAGT

SEQ ID NO: 39200 - protein, 6 aa, Mycobacterium avium
LPAGTP

SEQ ID NO: 39201 - protein, 4 aa, Mycobacterium avium
LPAP

SEQ ID NO: 39202 - protein, 6 aa, Mycobacterium avium
LPAPDR

SEQ ID NO: 39203 - protein, 7 aa, Mycobacterium avium
LPAPGDV

SEQ ID NO: 39204 - protein, 7 aa, Mycobacterium avium
LPAPGTY

SEQ ID NO: 39205 - protein, 8 aa, Mycobacterium avium
LPAPPLPT

SEQ ID NO: 39206 - protein, 28 aa, Mycobacterium avium
LPAPQPPGKRATPAARKQYNQQLTEQQG

SEQ ID NO: 39207 - protein, 15 aa, Mycobacterium avium
LPAPREAMTCAAADA

SEQ ID NO: 39208 - protein, 12 aa, Mycobacterium avium
LPAPVKPTAVPL

SEQ ID NO: 39209 - protein, 9 aa, Mycobacterium avium
LPARDPGPL

SEQ ID NO: 39210 - protein, 23 aa, Mycobacterium avium
LPARPGRVRDRGTQLQRARAGEI

SEQ ID NO: 39211 - protein, 5 aa, Mycobacterium avium
LPARQ

SEQ ID NO: 39212 - protein, 11 aa, Mycobacterium avium
LPASPAKAVQE

SEQ ID NO: 39213 - protein, 5 aa, Mycobacterium avium
LPASY

SEQ ID NO: 39214 - protein, 5 aa, Mycobacterium avium
LPATG

SEQ ID NO: 39215 - protein, 5 aa, Mycobacterium avium
LPATS

SEQ ID NO: 39216 - protein, 7 aa, Mycobacterium avium
LPDAATR

SEQ ID NO: 39217 - protein, 6 aa, Mycobacterium avium
LPDADD

SEQ ID NO: 39218 - protein, 13 aa, Mycobacterium avium
LPDDGPQRGKAPA

SEQ ID NO: 39219 - protein, 5 aa, Mycobacterium avium
LPDDY

SEQ ID NO: 39220 - protein, 10 aa, Mycobacterium avium
LPDELGEGTQ

SEQ ID NO: 39221 - protein, 8 aa, Mycobacterium avium
LPDEPDGL

SEQ ID NO: 39222 - protein, 6 aa, Mycobacterium avium
LPDETV

SEQ ID NO: 39223 - protein, 10 aa, Mycobacterium avium
LPDGAVRSTD

SEQ ID NO: 39224 - protein, 5 aa, Mycobacterium avium
LPDGG

SEQ ID NO: 39225 - protein, 6 aa, Mycobacterium avium
LPDGGT

SEQ ID NO: 39226 - protein, 14 aa, Mycobacterium avium
LPDGTAVSSGEHGG

SEQ ID NO: 39227 - protein, 20 aa, Mycobacterium avium
LPDGTTVSTDDGPRPGTTYE

SEQ ID NO: 39228 - protein, 10 aa, Mycobacterium avium
LPDIDEPDTY

SEQ ID NO: 39229 - protein, 9 aa, Mycobacterium avium
LPDPERPHR

SEQ ID NO: 39230 - protein, 6 aa, Mycobacterium avium
LPDPGA

SEQ ID NO: 39231 - protein, 10 aa, Mycobacterium avium
LPDPGAADAV

SEQ ID NO: 39232 - protein, 8 aa, Mycobacterium avium
LPDPGRPI

SEQ ID NO: 39233 - protein, 5 aa, Mycobacterium avium
LPDPR

SEQ ID NO: 39234 - protein, 9 aa, Mycobacterium avium
LPDPSETIS

SEQ ID NO: 39235 - protein, 7 aa, Mycobacterium avium
LPDPTDP

SEQ ID NO: 39236 - protein, 17 aa, Mycobacterium avium
LPDPVSGNIPSDPETVA

SEQ ID NO: 39237 - protein, 5 aa, Mycobacterium avium
LPDRA

SEQ ID NO: 39238 - protein, 7 aa, Mycobacterium avium
LPDRQRQ

SEQ ID NO: 39239 - protein, 9 aa, Mycobacterium avium
LPDRSTRYR

SEQ ID NO: 39240 - protein, 5 aa, Mycobacterium avium
LPDSA

SEQ ID NO: 39241 - protein, 5 aa, Mycobacterium avium
LPEAA

SEQ ID NO: 39242 - protein, 11 aa, Mycobacterium avium
LPEAAKTAADV

SEQ ID NO: 39243 - protein, 11 aa, Mycobacterium avium
LPEAPSPAQLR

SEQ ID NO: 39244 - protein, 5 aa, Mycobacterium avium
LPEAQ

SEQ ID NO: 39245 - protein, 7 aa, Mycobacterium avium
LPEDEQQ

SEQ ID NO: 39246 - protein, 5 aa, Mycobacterium avium
LPEDL

SEQ ID NO: 39247 - protein, 5 aa, Mycobacterium avium
LPEDQ

SEQ ID NO: 39248 - protein, 14 aa, Mycobacterium avium
LPEDVNAPSDSGEA

SEQ ID NO: 39249 - protein, 13 aa, Mycobacterium avium
LPEDYKATELTPG

SEQ ID NO: 39250 - protein, 9 aa, Mycobacterium avium
LPEEAKSMA

SEQ ID NO: 39251 - protein, 26 aa, Mycobacterium avium
LPEEAQASLGKQVPHPARLGDPDEYG

SEQ ID NO: 39252 - protein, 6 aa, Mycobacterium avium
LPEEIG

SEQ ID NO: 39253 - protein, 4 aa, Mycobacterium avium
LPEG

SEQ ID NO: 39254 - protein, 18 aa, Mycobacterium avium
LPEGASTQNLSLDGQGRV

SEQ ID NO: 39255 - protein, 4 aa, Mycobacterium avium
LPEP

SEQ ID NO: 39256 - protein, 9 aa, Mycobacterium avium
LPEPGEPKR

SEQ ID NO: 39257 - protein, 13 aa, Mycobacterium avium
LPEPHDAENRRAA

SEQ ID NO: 39258 - protein, 6 aa, Mycobacterium avium
LPEPKS

SEQ ID NO: 39259 - protein, 8 aa, Mycobacterium avium
LPEPPLPG

SEQ ID NO: 39260 - protein, 5 aa, Mycobacterium avium
LPERA

SEQ ID NO: 39261 - protein, 11 aa, Mycobacterium avium
LPERAHTNQNY

SEQ ID NO: 39262 - protein, 10 aa, Mycobacterium avium
LPESGGAAAK

SEQ ID NO: 39263 - protein, 7 aa, Mycobacterium avium
LPETDDT

SEQ ID NO: 39264 - protein, 8 aa, Mycobacterium avium
LPETTGGV

SEQ ID NO: 39265 - protein, 8 aa, Mycobacterium avium
LPGAAQRA

SEQ ID NO: 39266 - protein, 10 aa, Mycobacterium avium
LPGAASTNIE

SEQ ID NO: 39267 - protein, 18 aa, Mycobacterium avium
LPGADPDSLPAPPQSADE

SEQ ID NO: 39268 - protein, 10 aa, Mycobacterium avium
LPGAHEDEFS

SEQ ID NO: 39269 - protein, 20 aa, Mycobacterium avium
LPGAPISPRRGGKPNPAPST

SEQ ID NO: 39270 - protein, 7 aa, Mycobacterium avium
LPGAQGK

SEQ ID NO: 39271 - protein, 9 aa, Mycobacterium avium
LPGARERLR

SEQ ID NO: 39272 - protein, 27 aa, Mycobacterium avium
LPGDASAGKPTPPEPMAPDDPRWPPIP

SEQ ID NO: 39273 - protein, 18 aa, Mycobacterium avium
LPGDGPVRSPDGPAPKAF

SEQ ID NO: 39274 - protein, 8 aa, Mycobacterium avium
LPGDPRKV

SEQ ID NO: 39275 - protein, 6 aa, Mycobacterium avium
LPGDPT

SEQ ID NO: 39276 - protein, 8 aa, Mycobacterium avium
LPGEGVAS

SEQ ID NO: 39277 - protein, 6 aa, Mycobacterium avium
LPGGAG

SEQ ID NO: 39278 - protein, 7 aa, Mycobacterium avium
LPGGDGY

SEQ ID NO: 39279 - protein, 9 aa, Mycobacterium avium
LPGGETGSE

SEQ ID NO: 39280 - protein, 9 aa, Mycobacterium avium
LPGGGGRGR

SEQ ID NO: 39281 - protein, 10 aa, Mycobacterium avium
LPGHPESGEE

SEQ ID NO: 39282 - protein, 8 aa, Mycobacterium avium
LPGHPGHD

SEQ ID NO: 39283 - protein, 5 aa, Mycobacterium avium
LPGHT

SEQ ID NO: 39284 - protein, 12 aa, Mycobacterium avium
LPGLDSAHREEV

SEQ ID NO: 39285 - protein, 4 aa, Mycobacterium avium
LPGN

SEQ ID NO: 39286 - protein, 10 aa, Mycobacterium avium
LPGPAGDIPA

SEQ ID NO: 39287 - protein, 8 aa, Mycobacterium avium
LPGPNAAV

SEQ ID NO: 39288 - protein, 5 aa, Mycobacterium avium
LPGPR

SEQ ID NO: 39289 - protein, 5 aa, Mycobacterium avium
LPGPT

SEQ ID NO: 39290 - protein, 4 aa, Mycobacterium avium
LPGQ

SEQ ID NO: 39291 - protein, 16 aa, Mycobacterium avium
LPGQGEAGLRGAPSGD

SEQ ID NO: 39292 - protein, 21 aa, Mycobacterium avium
LPGRDAPLGSPGGAAKLGPLG

SEQ ID NO: 39293 - protein, 6 aa, Mycobacterium avium
LPGRER

SEQ ID NO: 39294 - protein, 11 aa, Mycobacterium avium
LPGSESEKMGP

SEQ ID NO: 39295 - protein, 9 aa, Mycobacterium avium
LPGSNPFGE

SEQ ID NO: 39296 - protein, 11 aa, Mycobacterium avium
LPGSSPRPYGS

SEQ ID NO: 39297 - protein, 4 aa, Mycobacterium avium
LPGT

SEQ ID NO: 39298 - protein, 10 aa, Mycobacterium avium
LPGTTGVQAP

SEQ ID NO: 39299 - protein, 9 aa, Mycobacterium avium
LPHGTGKTA

SEQ ID NO: 39300 - protein, 21 aa, Mycobacterium avium
LPHTAKGSLDRRAVAEQFGES

SEQ ID NO: 39301 - protein, 8 aa, Mycobacterium avium
LPKPQTQI

SEQ ID NO: 39302 - protein, 6 aa, Mycobacterium avium
LPKRRL

SEQ ID NO: 39303 - protein, 10 aa, Mycobacterium avium
LPKSGTKRPW

SEQ ID NO: 39304 - protein, 13 aa, Mycobacterium avium
LPLPSRAHEGDAG

SEQ ID NO: 39305 - protein, 14 aa, Mycobacterium avium
LPMETDPETGDGRI

SEQ ID NO: 39306 - protein, 4 aa, Mycobacterium avium
LPMQ

SEQ ID NO: 39307 - protein, 13 aa, Mycobacterium avium
LPNEDADVSKEIE

SEQ ID NO: 39308 - protein, 5 aa, Mycobacterium avium
LPNGA

SEQ ID NO: 39309 - protein, 9 aa, Mycobacterium avium
LPNPADPDH

SEQ ID NO: 39310 - protein, 6 aa, Mycobacterium avium
LPNPKA

SEQ ID NO: 39311 - protein, 6 aa, Mycobacterium avium
LPPAGK

SEQ ID NO: 39312 - protein, 5 aa, Mycobacterium avium
LPPDH

SEQ ID NO: 39313 - protein, 9 aa, Mycobacterium avium
LPPDKLTGK

SEQ ID NO: 39314 - protein, 10 aa, Mycobacterium avium
LPPDRGTGLG

SEQ ID NO: 39315 - protein, 6 aa, Mycobacterium avium
LPPDVE

SEQ ID NO: 39316 - protein, 16 aa, Mycobacterium avium
LPPEEAANIPQAPTQL

SEQ ID NO: 39317 - protein, 6 aa, Mycobacterium avium
LPPEGA

SEQ ID NO: 39318 - protein, 9 aa, Mycobacterium avium
LPPEGRFGS

SEQ ID NO: 39319 - protein, 8 aa, Mycobacterium avium
LPPEGSYA

SEQ ID NO: 39320 - protein, 6 aa, Mycobacterium avium
LPPEQI

SEQ ID NO: 39321 - protein, 13 aa, Mycobacterium avium
LPPGAGVDATSAS

SEQ ID NO: 39322 - protein, 7 aa, Mycobacterium avium
LPPGASE

SEQ ID NO: 39323 - protein, 6 aa, Mycobacterium avium
LPPGGR

SEQ ID NO: 39324 - protein, 7 aa, Mycobacterium avium
LPPGHPE

SEQ ID NO: 39325 - protein, 18 aa, Mycobacterium avium
LPPGPAYYPDGELTDEPE

SEQ ID NO: 39326 - protein, 52 aa, Mycobacterium avium
LPPGPNPPTPGGAVPPNANQLRPNAAPMPQPQPQPQPAPGPPPPSIAGAPTS

SEQ ID NO: 39327 - protein, 9 aa, Mycobacterium avium
LPPGSAGKP

SEQ ID NO: 39328 - protein, 8 aa, Mycobacterium avium
LPPGSLQD

SEQ ID NO: 39329 - protein, 11 aa, Mycobacterium avium
LPPHERPGPDY

SEQ ID NO: 39330 - protein, 4 aa, Mycobacterium avium
LPPK

SEQ ID NO: 39331 - protein, 4 aa, Mycobacterium avium
LPPP

SEQ ID NO: 39332 - protein, 7 aa, Mycobacterium avium
LPPPAAL

SEQ ID NO: 39333 - protein, 10 aa, Mycobacterium avium
LPPPASETEA

SEQ ID NO: 39334 - protein, 6 aa, Mycobacterium avium
LPPPID

SEQ ID NO: 39335 - protein, 5 aa, Mycobacterium avium
LPPQA

SEQ ID NO: 39336 - protein, 5 aa, Mycobacterium avium
LPPRD

SEQ ID NO: 39337 - protein, 5 aa, Mycobacterium avium
LPPRE

SEQ ID NO: 39338 - protein, 5 aa, Mycobacterium avium
LPPRY

SEQ ID NO: 39339 - protein, 6 aa, Mycobacterium avium
LPPSAV

SEQ ID NO: 39340 - protein, 16 aa, Mycobacterium avium
LPPSPGGGPSRPPQHI

SEQ ID NO: 39341 - protein, 6 aa, Mycobacterium avium
LPPSVS

SEQ ID NO: 39342 - protein, 6 aa, Mycobacterium avium
LPPTAE

SEQ ID NO: 39343 - protein, 12 aa, Mycobacterium avium
LPQEQSQRPGHI

SEQ ID NO: 39344 - protein, 7 aa, Mycobacterium avium
LPQGDYK

SEQ ID NO: 39345 - protein, 8 aa, Mycobacterium avium
LPQSAGKS

SEQ ID NO: 39346 - protein, 4 aa, Mycobacterium avium
LPRA

SEQ ID NO: 39347 - protein, 8 aa, Mycobacterium avium
LPRDPDEL

SEQ ID NO: 39348 - protein, 11 aa, Mycobacterium avium
LPRGARLPTER

SEQ ID NO: 39349 - protein, 9 aa, Mycobacterium avium
LPRGRQPIT

SEQ ID NO: 39350 - protein, 6 aa, Mycobacterium avium
LPRKSD

SEQ ID NO: 39351 - protein, 7 aa, Mycobacterium avium
LPRPGET

SEQ ID NO: 39352 - protein, 15 aa, Mycobacterium avium
LPRPQTQVPVPGADG

SEQ ID NO: 39353 - protein, 6 aa, Mycobacterium avium
LPRQPQ

SEQ ID NO: 39354 - protein, 5 aa, Mycobacterium avium
LPRRP

SEQ ID NO: 39355 - protein, 6 aa, Mycobacterium avium
LPRSGA

SEQ ID NO: 39356 - protein, 8 aa, Mycobacterium avium
LPRSSTGK

SEQ ID NO: 39357 - protein, 7 aa, Mycobacterium avium
LPRTDTG

SEQ ID NO: 39358 - protein, 7 aa, Mycobacterium avium
LPRTPPL

SEQ ID NO: 39359 - protein, 5 aa, Mycobacterium avium
LPRVA

SEQ ID NO: 39360 - protein, 12 aa, Mycobacterium avium
LPSADGSGRDVD

SEQ ID NO: 39361 - protein, 9 aa, Mycobacterium avium
LPSAGKGTS

SEQ ID NO: 39362 - protein, 6 aa, Mycobacterium avium
LPSAVD

SEQ ID NO: 39363 - protein, 21 aa, Mycobacterium avium
LPSEQARRQAAAAAQTDGAAT

SEQ ID NO: 39364 - protein, 6 aa, Mycobacterium avium
LPSGAP

SEQ ID NO: 39365 - protein, 8 aa, Mycobacterium avium
LPSPETPQ

SEQ ID NO: 39366 - protein, 11 aa, Mycobacterium avium
LPSPSNPLDNP

SEQ ID NO: 39367 - protein, 4 aa, Mycobacterium avium
LPSR

SEQ ID NO: 39368 - protein, 9 aa, Mycobacterium avium
LPSRPSSWR

SEQ ID NO: 39369 - protein, 6 aa, Mycobacterium avium
LPSTPR

SEQ ID NO: 39370 - protein, 13 aa, Mycobacterium avium
LPSVGSKAPAFSL

SEQ ID NO: 39371 - protein, 6 aa, Mycobacterium avium
LPSVTG

SEQ ID NO: 39372 - protein, 6 aa, Mycobacterium avium
LPTADT

SEQ ID NO: 39373 - protein, 8 aa, Mycobacterium avium
LPTDAEEW

SEQ ID NO: 39374 - protein, 8 aa, Mycobacterium avium
LPTDPAAQ

SEQ ID NO: 39375 - protein, 6 aa, Mycobacterium avium
LPTGVR

SEQ ID NO: 39376 - protein, 4 aa, Mycobacterium avium
LPTH

SEQ ID NO: 39377 - protein, 7 aa, Mycobacterium avium
LPTPGAS

SEQ ID NO: 39378 - protein, 6 aa, Mycobacterium avium
LPTPYH

SEQ ID NO: 39379 - protein, 6 aa, Mycobacterium avium
LPTRED

SEQ ID NO: 39380 - protein, 5 aa, Mycobacterium avium
LPTSG

SEQ ID NO: 39381 - protein, 21 aa, Mycobacterium avium
LPTTDADSDAGDSRLVGPATN

SEQ ID NO: 39382 - protein, 15 aa, Mycobacterium avium
LPTTTIGSYPQTSAI

SEQ ID NO: 39383 - protein, 7 aa, Mycobacterium avium
LPYATTE

SEQ ID NO: 39384 - protein, 6 aa, Mycobacterium avium
LPYDEP

SEQ ID NO: 39385 - protein, 7 aa, Mycobacterium avium
LPYSPPE

SEQ ID NO: 39386 - protein, 4 aa, Mycobacterium avium
LPYT

SEQ ID NO: 39387 - protein, 10 aa, Mycobacterium avium
LQAADDAQIR

SEQ ID NO: 39388 - protein, 10 aa, Mycobacterium avium
LQAKSKEMSE

SEQ ID NO: 39389 - protein, 8 aa, Mycobacterium avium
LQDPPSDD

SEQ ID NO: 39390 - protein, 5 aa, Mycobacterium avium
LQDPV

SEQ ID NO: 39391 - protein, 8 aa, Mycobacterium avium
LQDTDAGA

SEQ ID NO: 39392 - protein, 9 aa, Mycobacterium avium
LQEKAEEYR

SEQ ID NO: 39393 - protein, 11 aa, Mycobacterium avium
LQESNEQTAAL

SEQ ID NO: 39394 - protein, 12 aa, Mycobacterium avium
LQGATDEDRQRV

SEQ ID NO: 39395 - protein, 11 aa, Mycobacterium avium
LQGDPASALPD

SEQ ID NO: 39396 - protein, 5 aa, Mycobacterium avium
LQGQP

SEQ ID NO: 39397 - protein, 10 aa, Mycobacterium avium
LQGTTGGERD

SEQ ID NO: 39398 - protein, 7 aa, Mycobacterium avium
LQKGSEP

SEQ ID NO: 39399 - protein, 8 aa, Mycobacterium avium
LQKRSTGR

SEQ ID NO: 39400 - protein, 6 aa, Mycobacterium avium
LQNESS

SEQ ID NO: 39401 - protein, 10 aa, Mycobacterium avium
LQPAPEQIST

SEQ ID NO: 39402 - protein, 14 aa, Mycobacterium avium
LQPDSAAVAQTARA

SEQ ID NO: 39403 - protein, 5 aa, Mycobacterium avium
LQPGD

SEQ ID NO: 39404 - protein, 22 aa, Mycobacterium avium
LQQETEAAVRTRSDLDTPAGAR

SEQ ID NO: 39405 - protein, 11 aa, Mycobacterium avium
LQRAQETAAPI

SEQ ID NO: 39406 - protein, 4 aa, Mycobacterium avium
LQRD

SEQ ID NO: 39407 - protein, 7 aa, Mycobacterium avium
LQRGRDA

SEQ ID NO: 39408 - protein, 6 aa, Mycobacterium avium
LQRPPD

SEQ ID NO: 39409 - protein, 9 aa, Mycobacterium avium
LQRSSGPRR

SEQ ID NO: 39410 - protein, 4 aa, Mycobacterium avium
LQRT

SEQ ID NO: 39411 - protein, 4 aa, Mycobacterium avium
LQSA

SEQ ID NO: 39412 - protein, 7 aa, Mycobacterium avium
LQTDPPD

SEQ ID NO: 39413 - protein, 7 aa, Mycobacterium avium
LQTGSQV

SEQ ID NO: 39414 - protein, 6 aa, Mycobacterium avium
LQTPKA

SEQ ID NO: 39415 - protein, 10 aa, Mycobacterium avium
LQTTEACGDC

SEQ ID NO: 39416 - protein, 5 aa, Mycobacterium avium
LQVPD

SEQ ID NO: 39417 - protein, 6 aa, Mycobacterium avium
LQYSGD

SEQ ID NO: 39418 - protein, 4 aa, Mycobacterium avium
LRAA

SEQ ID NO: 39419 - protein, 8 aa, Mycobacterium avium
LRAEGRDA

SEQ ID NO: 39420 - protein, 9 aa, Mycobacterium avium
LRAGGAGIP

SEQ ID NO: 39421 - protein, 11 aa, Mycobacterium avium
LRAGRSRNDQV

SEQ ID NO: 39422 - protein, 8 aa, Mycobacterium avium
LRAQAESA

SEQ ID NO: 39423 - protein, 5 aa, Mycobacterium avium
LRATG

SEQ ID NO: 39424 - protein, 9 aa, Mycobacterium avium
LRDASSDPA

SEQ ID NO: 39425 - protein, 6 aa, Mycobacterium avium
LRDDGS

SEQ ID NO: 39426 - protein, 5 aa, Mycobacterium avium
LRDEP

SEQ ID NO: 39427 - protein, 13 aa, Mycobacterium avium
LRDQQAAADRAKA

SEQ ID NO: 39428 - protein, 6 aa, Mycobacterium avium
LRDRAG

SEQ ID NO: 39429 - protein, 7 aa, Mycobacterium avium
LRDSQPS

SEQ ID NO: 39430 - protein, 11 aa, Mycobacterium avium
LRDSRDQSAVD

SEQ ID NO: 39431 - protein, 7 aa, Mycobacterium avium
LREAGAG

SEQ ID NO: 39432 - protein, 5 aa, Mycobacterium avium
LREQA

SEQ ID NO: 39433 - protein, 23 aa, Mycobacterium avium
LRESGGDPREAQVRPPDEVEGYL

SEQ ID NO: 39434 - protein, 6 aa, Mycobacterium avium
LRESHP

SEQ ID NO: 39435 - protein, 40 aa, Mycobacterium avium
LRETDEATEAADEAAETTEDAAESAETQGEPAEEVDPAAA

SEQ ID NO: 39436 - protein, 6 aa, Mycobacterium avium
LRETGT

SEQ ID NO: 39437 - protein, 7 aa, Mycobacterium avium
LRGDARE

SEQ ID NO: 39438 - protein, 11 aa, Mycobacterium avium
LRGDGKTLRPF

SEQ ID NO: 39439 - protein, 12 aa, Mycobacterium avium
LRGEAGDRQVAD

SEQ ID NO: 39440 - protein, 15 aa, Mycobacterium avium
LRGGPTRLKSSGKDY

SEQ ID NO: 39441 - protein, 6 aa, Mycobacterium avium
LRGGSG

SEQ ID NO: 39442 - protein, 11 aa, Mycobacterium avium
LRGKSPYGAPQ

SEQ ID NO: 39443 - protein, 11 aa, Mycobacterium avium
LRGPGDTRPTL

SEQ ID NO: 39444 - protein, 6 aa, Mycobacterium avium
LRGPGL

SEQ ID NO: 39445 - protein, 10 aa, Mycobacterium avium
LRGPGSDRAA

SEQ ID NO: 39446 - protein, 5 aa, Mycobacterium avium
LRGPR

SEQ ID NO: 39447 - protein, 8 aa, Mycobacterium avium
LRGTPGAS

SEQ ID NO: 39448 - protein, 8 aa, Mycobacterium avium
LRGYPEDP

SEQ ID NO: 39449 - protein, 4 aa, Mycobacterium avium
LRKN

SEQ ID NO: 39450 - protein, 9 aa, Mycobacterium avium
LRKTNAEHN

SEQ ID NO: 39451 - protein, 7 aa, Mycobacterium avium
LRKTSEG

SEQ ID NO: 39452 - protein, 5 aa, Mycobacterium avium
LRLTP

SEQ ID NO: 39453 - protein, 5 aa, Mycobacterium avium
LRNDG

SEQ ID NO: 39454 - protein, 6 aa, Mycobacterium avium
LRNRSD

SEQ ID NO: 39455 - protein, 6 aa, Mycobacterium avium
LRNYPD

SEQ ID NO: 39456 - protein, 27 aa, Mycobacterium avium
LRPAYSNADAAQQVAEGRADAAVTSPL

SEQ ID NO: 39457 - protein, 4 aa, Mycobacterium avium
LRPD

SEQ ID NO: 39458 - protein, 11 aa, Mycobacterium avium
LRPDDDDWGQA

SEQ ID NO: 39459 - protein, 6 aa, Mycobacterium avium
LRPDPE

SEQ ID NO: 39460 - protein, 6 aa, Mycobacterium avium
LRPEGG

SEQ ID NO: 39461 - protein, 9 aa, Mycobacterium avium
LRPEGRNGP

SEQ ID NO: 39462 - protein, 9 aa, Mycobacterium avium
LRPEGRSGE

SEQ ID NO: 39463 - protein, 7 aa, Mycobacterium avium
LRPGEPI

SEQ ID NO: 39464 - protein, 8 aa, Mycobacterium avium
LRPGVSEQ

SEQ ID NO: 39465 - protein, 12 aa, Mycobacterium avium
LRPKDYSEARTI

SEQ ID NO: 39466 - protein, 4 aa, Mycobacterium avium
LRPL

SEQ ID NO: 39467 - protein, 15 aa, Mycobacterium avium
LRPPANANPNILPAG

SEQ ID NO: 39468 - protein, 6 aa, Mycobacterium avium
LRPPPV

SEQ ID NO: 39469 - protein, 14 aa, Mycobacterium avium
LRPRPLGAEQGRHP

SEQ ID NO: 39470 - protein, 8 aa, Mycobacterium avium
LRPRPPVA

SEQ ID NO: 39471 - protein, 7 aa, Mycobacterium avium
LRPRSGA

SEQ ID NO: 39472 - protein, 6 aa, Mycobacterium avium
LRPSDA

SEQ ID NO: 39473 - protein, 6 aa, Mycobacterium avium
LRPSDV

SEQ ID NO: 39474 - protein, 4 aa, Mycobacterium avium
LRPT

SEQ ID NO: 39475 - protein, 6 aa, Mycobacterium avium
LRPTPG

SEQ ID NO: 39476 - protein, 5 aa, Mycobacterium avium
LRPTR

SEQ ID NO: 39477 - protein, 21 aa, Mycobacterium avium
LRQAPGGKGGNQAVAAARAGA

SEQ ID NO: 39478 - protein, 6 aa, Mycobacterium avium
LRQEDP

SEQ ID NO: 39479 - protein, 8 aa, Mycobacterium avium
LRRDTVGD

SEQ ID NO: 39480 - protein, 4 aa, Mycobacterium avium
LRRR

SEQ ID NO: 39481 - protein, 10 aa, Mycobacterium avium
LRRRGENISS

SEQ ID NO: 39482 - protein, 26 aa, Mycobacterium avium
LRSAAAGLSIPAKRRRGDSDEGFHDP

SEQ ID NO: 39483 - protein, 5 aa, Mycobacterium avium
LRSGG

SEQ ID NO: 39484 - protein, 8 aa, Mycobacterium avium
LRSGGPVQ

SEQ ID NO: 39485 - protein, 15 aa, Mycobacterium avium
LRSGVGSPTAFANST

SEQ ID NO: 39486 - protein, 8 aa, Mycobacterium avium
LRSNPSDN

SEQ ID NO: 39487 - protein, 4 aa, Mycobacterium avium
LRSP

SEQ ID NO: 39488 - protein, 7 aa, Mycobacterium avium
LRSPSGV

SEQ ID NO: 39489 - protein, 7 aa, Mycobacterium avium
LRSQTSG

SEQ ID NO: 39490 - protein, 11 aa, Mycobacterium avium
LRSTATPTDGG

SEQ ID NO: 39491 - protein, 5 aa, Mycobacterium avium
LRSYP

SEQ ID NO: 39492 - protein, 10 aa, Mycobacterium avium
LRTAGDPVTR

SEQ ID NO: 39493 - protein, 12 aa, Mycobacterium avium
LRTEARAAKMSS

SEQ ID NO: 39494 - protein, 9 aa, Mycobacterium avium
LRTEEDAAA

SEQ ID NO: 39495 - protein, 4 aa, Mycobacterium avium
LRTG

SEQ ID NO: 39496 - protein, 10 aa, Mycobacterium avium
LRTGDRVDRN

SEQ ID NO: 39497 - protein, 6 aa, Mycobacterium avium
LRTPRP

SEQ ID NO: 39498 - protein, 6 aa, Mycobacterium avium
LRTQPA

SEQ ID NO: 39499 - protein, 9 aa, Mycobacterium avium
LSAAADSDE

SEQ ID NO: 39500 - protein, 11 aa, Mycobacterium avium
LSAARSTEFTD

SEQ ID NO: 39501 - protein, 12 aa, Mycobacterium avium
LSAATAAGASHA

SEQ ID NO: 39502 - protein, 4 aa, Mycobacterium avium
LSAD

SEQ ID NO: 39503 - protein, 7 aa, Mycobacterium avium
LSADGSQ

SEQ ID NO: 39504 - protein, 7 aa, Mycobacterium avium
LSADGSR

SEQ ID NO: 39505 - protein, 10 aa, Mycobacterium avium
LSAEGDRAAA

SEQ ID NO: 39506 - protein, 5 aa, Mycobacterium avium
LSAEQ

SEQ ID NO: 39507 - protein, 7 aa, Mycobacterium avium
LSAEQAK

SEQ ID NO: 39508 - protein, 8 aa, Mycobacterium avium
LSAEQRAE

SEQ ID NO: 39509 - protein, 6 aa, Mycobacterium avium
LSAGEL

SEQ ID NO: 39510 - protein, 8 aa, Mycobacterium avium
LSAGERAD

SEQ ID NO: 39511 - protein, 10 aa, Mycobacterium avium
LSAGTKVPGW

SEQ ID NO: 39512 - protein, 7 aa, Mycobacterium avium
LSAPERL

SEQ ID NO: 39513 - protein, 8 aa, Mycobacterium avium
LSAPGSRL

SEQ ID NO: 39514 - protein, 9 aa, Mycobacterium avium
LSAPGSRLA

SEQ ID NO: 39515 - protein, 12 aa, Mycobacterium avium
LSAPGSRLATEN

SEQ ID NO: 39516 - protein, 25 aa, Mycobacterium avium
LSAPGSRLATESAPNPAPGEEEKLK

SEQ ID NO: 39517 - protein, 8 aa, Mycobacterium avium
LSAPGSTI

SEQ ID NO: 39518 - protein, 9 aa, Mycobacterium avium
LSAPPAVTG

SEQ ID NO: 39519 - protein, 4 aa, Mycobacterium avium
LSAQ

SEQ ID NO: 39520 - protein, 4 aa, Mycobacterium avium
LSAS

SEQ ID NO: 39521 - protein, 8 aa, Mycobacterium avium
LSASAGKA

SEQ ID NO: 39522 - protein, 9 aa, Mycobacterium avium
LSASRQAQR

SEQ ID NO: 39523 - protein, 14 aa, Mycobacterium avium
LSATANPKVAGGAP

SEQ ID NO: 39524 - protein, 4 aa, Mycobacterium avium
LSAY

SEQ ID NO: 39525 - protein, 4 aa, Mycobacterium avium
LSDA

SEQ ID NO: 39526 - protein, 8 aa, Mycobacterium avium
LSDASGPV

SEQ ID NO: 39527 - protein, 7 aa, Mycobacterium avium
LSDASRT

SEQ ID NO: 39528 - protein, 9 aa, Mycobacterium avium
LSDATAGAG

SEQ ID NO: 39529 - protein, 4 aa, Mycobacterium avium
LSDD

SEQ ID NO: 39530 - protein, 14 aa, Mycobacterium avium
LSDDDHRDAARPQL

SEQ ID NO: 39531 - protein, 6 aa, Mycobacterium avium
LSDEAR

SEQ ID NO: 39532 - protein, 8 aa, Mycobacterium avium
LSDGPPVS

SEQ ID NO: 39533 - protein, 6 aa, Mycobacterium avium
LSDGSD

SEQ ID NO: 39534 - protein, 8 aa, Mycobacterium avium
LSDGSERE

SEQ ID NO: 39535 - protein, 22 aa, Mycobacterium avium
LSDHTVSGRGRHPLPSGPSLQA

SEQ ID NO: 39536 - protein, 5 aa, Mycobacterium avium
LSDPA

SEQ ID NO: 39537 - protein, 21 aa, Mycobacterium avium
LSDPPADMAPGRATDLSNLPP

SEQ ID NO: 39538 - protein, 8 aa, Mycobacterium avium
LSDPSGYG

SEQ ID NO: 39539 - protein, 5 aa, Mycobacterium avium
LSDRA

SEQ ID NO: 39540 - protein, 14 aa, Mycobacterium avium
LSEAGSGGSPSSAY

SEQ ID NO: 39541 - protein, 9 aa, Mycobacterium avium
LSEAPKIKP

SEQ ID NO: 39542 - protein, 8 aa, Mycobacterium avium
LSEAPPAV

SEQ ID NO: 39543 - protein, 8 aa, Mycobacterium avium
LSEASEGR

SEQ ID NO: 39544 - protein, 10 aa, Mycobacterium avium
LSEDAEGPGA

SEQ ID NO: 39545 - protein, 5 aa, Mycobacterium avium
LSEDK

SEQ ID NO: 39546 - protein, 7 aa, Mycobacterium avium
LSEEDKQ

SEQ ID NO: 39547 - protein, 12 aa, Mycobacterium avium
LSEEGADDPVRL

SEQ ID NO: 39548 - protein, 6 aa, Mycobacterium avium
LSEEQY

SEQ ID NO: 39549 - protein, 9 aa, Mycobacterium avium
LSEGPGESW

SEQ ID NO: 39550 - protein, 9 aa, Mycobacterium avium
LSEGTIKGD

SEQ ID NO: 39551 - protein, 11 aa, Mycobacterium avium
LSEHDSPGEAT

SEQ ID NO: 39552 - protein, 16 aa, Mycobacterium avium
LSEPDAERNWNSARRN

SEQ ID NO: 39553 - protein, 11 aa, Mycobacterium avium
LSERSTRDERH

SEQ ID NO: 39554 - protein, 6 aa, Mycobacterium avium
LSESAD

SEQ ID NO: 39555 - protein, 6 aa, Mycobacterium avium
LSESER

SEQ ID NO: 39556 - protein, 15 aa, Mycobacterium avium
LSETAREAGAADPEL

SEQ ID NO: 39557 - protein, 5 aa, Mycobacterium avium
LSEYT

SEQ ID NO: 39558 - protein, 8 aa, Mycobacterium avium
LSGAATYS

SEQ ID NO: 39559 - protein, 5 aa, Mycobacterium avium
LSGDA

SEQ ID NO: 39560 - protein, 9 aa, Mycobacterium avium
LSGDEDRTG

SEQ ID NO: 39561 - protein, 4 aa, Mycobacterium avium
LSGG

SEQ ID NO: 39562 - protein, 8 aa, Mycobacterium avium
LSGGEQQR

SEQ ID NO: 39563 - protein, 7 aa, Mycobacterium avium
LSGGERQ

SEQ ID NO: 39564 - protein, 8 aa, Mycobacterium avium
LSGGQQQR

SEQ ID NO: 39565 - protein, 8 aa, Mycobacterium avium
LSGGQRRR

SEQ ID NO: 39566 - protein, 8 aa, Mycobacterium avium
LSGGQRTR

SEQ ID NO: 39567 - protein, 7 aa, Mycobacterium avium
LSGGTRR

SEQ ID NO: 39568 - protein, 13 aa, Mycobacterium avium
LSGHGDSDPRDSY

SEQ ID NO: 39569 - protein, 11 aa, Mycobacterium avium
LSGKANRLPHE

SEQ ID NO: 39570 - protein, 11 aa, Mycobacterium avium
LSGLDDEGRAT

SEQ ID NO: 39571 - protein, 4 aa, Mycobacterium avium
LSGP

SEQ ID NO: 39572 - protein, 18 aa, Mycobacterium avium
LSGQAADPFKIPPGTASG

SEQ ID NO: 39573 - protein, 11 aa, Mycobacterium avium
LSGQDEDTLQR

SEQ ID NO: 39574 - protein, 7 aa, Mycobacterium avium
LSGREGA

SEQ ID NO: 39575 - protein, 8 aa, Mycobacterium avium
LSGRGAPV

SEQ ID NO: 39576 - protein, 7 aa, Mycobacterium avium
LSGRPDT

SEQ ID NO: 39577 - protein, 7 aa, Mycobacterium avium
LSGRRGR

SEQ ID NO: 39578 - protein, 11 aa, Mycobacterium avium
LSGSANVTTGQ

SEQ ID NO: 39579 - protein, 18 aa, Mycobacterium avium
LSGSDGKVTVGGACDPST

SEQ ID NO: 39580 - protein, 11 aa, Mycobacterium avium
LSGSPLTTRSV

SEQ ID NO: 39581 - protein, 28 aa, Mycobacterium avium
LSGTGSDDSNDLDTDGSDQPWDDQDGWR

SEQ ID NO: 39582 - protein, 4 aa, Mycobacterium avium
LSGV

SEQ ID NO: 39583 - protein, 8 aa, Mycobacterium avium
LSHERAGA

SEQ ID NO: 39584 - protein, 12 aa, Mycobacterium avium
LSNGGSADPAGV

SEQ ID NO: 39585 - protein, 15 aa, Mycobacterium avium
LSNQKHTDLTARYGR

SEQ ID NO: 39586 - protein, 6 aa, Mycobacterium avium
LSNSEI

SEQ ID NO: 39587 - protein, 7 aa, Mycobacterium avium
LSPAEQA

SEQ ID NO: 39588 - protein, 6 aa, Mycobacterium avium
LSPAQL

SEQ ID NO: 39589 - protein, 9 aa, Mycobacterium avium
LSPASGRPL

SEQ ID NO: 39590 - protein, 4 aa, Mycobacterium avium
LSPD

SEQ ID NO: 39591 - protein, 5 aa, Mycobacterium avium
LSPDE

SEQ ID NO: 39592 - protein, 9 aa, Mycobacterium avium
LSPDGARAR

SEQ ID NO: 39593 - protein, 6 aa, Mycobacterium avium
LSPERL

SEQ ID NO: 39594 - protein, 5 aa, Mycobacterium avium
LSPGI

SEQ ID NO: 39595 - protein, 7 aa, Mycobacterium avium
LSPGTLA

SEQ ID NO: 39596 - protein, 7 aa, Mycobacterium avium
LSPPVDP

SEQ ID NO: 39597 - protein, 7 aa, Mycobacterium avium
LSPQGGV

SEQ ID NO: 39598 - protein, 6 aa, Mycobacterium avium
LSPRQV

SEQ ID NO: 39599 - protein, 8 aa, Mycobacterium avium
LSPSKPIL

SEQ ID NO: 39600 - protein, 6 aa, Mycobacterium avium
LSPTRD

SEQ ID NO: 39601 - protein, 7 aa, Mycobacterium avium
LSQDEGV

SEQ ID NO: 39602 - protein, 8 aa, Mycobacterium avium
LSQSGQLD

SEQ ID NO: 39603 - protein, 10 aa, Mycobacterium avium
LSQSYPGATM

SEQ ID NO: 39604 - protein, 6 aa, Mycobacterium avium
LSRGAP

SEQ ID NO: 39605 - protein, 9 aa, Mycobacterium avium
LSRGEVKGN

SEQ ID NO: 39606 - protein, 8 aa, Mycobacterium avium
LSRGQYSG

SEQ ID NO: 39607 - protein, 5 aa, Mycobacterium avium
LSRKE

SEQ ID NO: 39608 - protein, 5 aa, Mycobacterium avium
LSRPG

SEQ ID NO: 39609 - protein, 5 aa, Mycobacterium avium
LSRQI

SEQ ID NO: 39610 - protein, 6 aa, Mycobacterium avium
LSRRGR

SEQ ID NO: 39611 - protein, 9 aa, Mycobacterium avium
LSSAPEPMR

SEQ ID NO: 39612 - protein, 9 aa, Mycobacterium avium
LSSDGPDRV

SEQ ID NO: 39613 - protein, 9 aa, Mycobacterium avium
LSSDPRASR

SEQ ID NO: 39614 - protein, 4 aa, Mycobacterium avium
LSSE

SEQ ID NO: 39615 - protein, 20 aa, Mycobacterium avium
LSSEDDAQFTASEGIPMPKT

SEQ ID NO: 39616 - protein, 8 aa, Mycobacterium avium
LSSGKEAD

SEQ ID NO: 39617 - protein, 5 aa, Mycobacterium avium
LSSPS

SEQ ID NO: 39618 - protein, 9 aa, Mycobacterium avium
LSSQGNVAG

SEQ ID NO: 39619 - protein, 6 aa, Mycobacterium avium
LSTAEV

SEQ ID NO: 39620 - protein, 6 aa, Mycobacterium avium
LSTDEK

SEQ ID NO: 39621 - protein, 5 aa, Mycobacterium avium
LSTGS

SEQ ID NO: 39622 - protein, 6 aa, Mycobacterium avium
LSTHPG

SEQ ID NO: 39623 - protein, 6 aa, Mycobacterium avium
LSTPAA

SEQ ID NO: 39624 - protein, 7 aa, Mycobacterium avium
LSTPEIP

SEQ ID NO: 39625 - protein, 12 aa, Mycobacterium avium
LSTRATKVDGGW

SEQ ID NO: 39626 - protein, 15 aa, Mycobacterium avium
LSTSTGELAQAAESA

SEQ ID NO: 39627 - protein, 6 aa, Mycobacterium avium
LSTYPG

SEQ ID NO: 39628 - protein, 7 aa, Mycobacterium avium
LSVDPER

SEQ ID NO: 39629 - protein, 14 aa, Mycobacterium avium
LSYGPQSDGSLGPE

SEQ ID NO: 39630 - protein, 8 aa, Mycobacterium avium
LTADGNRR

SEQ ID NO: 39631 - protein, 8 aa, Mycobacterium avium
LTAGADDY

SEQ ID NO: 39632 - protein, 12 aa, Mycobacterium avium
LTAGAGPGTGKC

SEQ ID NO: 39633 - protein, 7 aa, Mycobacterium avium
LTAGGAH

SEQ ID NO: 39634 - protein, 8 aa, Mycobacterium avium
LTAGGDDY

SEQ ID NO: 39635 - protein, 6 aa, Mycobacterium avium
LTAPDG

SEQ ID NO: 39636 - protein, 6 aa, Mycobacterium avium
LTAPPA

SEQ ID NO: 39637 - protein, 9 aa, Mycobacterium avium
LTARDSGID

SEQ ID NO: 39638 - protein, 7 aa, Mycobacterium avium
LTDAPRY

SEQ ID NO: 39639 - protein, 5 aa, Mycobacterium avium
LTDDE

SEQ ID NO: 39640 - protein, 4 aa, Mycobacterium avium
LTDE

SEQ ID NO: 39641 - protein, 8 aa, Mycobacterium avium
LTDEQGEV

SEQ ID NO: 39642 - protein, 11 aa, Mycobacterium avium
LTDFDSNRSGG

SEQ ID NO: 39643 - protein, 9 aa, Mycobacterium avium
LTDGRGADS

SEQ ID NO: 39644 - protein, 9 aa, Mycobacterium avium
LTDGTELTP

SEQ ID NO: 39645 - protein, 6 aa, Mycobacterium avium
LTDPRT

SEQ ID NO: 39646 - protein, 7 aa, Mycobacterium avium
LTDPSSD

SEQ ID NO: 39647 - protein, 6 aa, Mycobacterium avium
LTDRDD

SEQ ID NO: 39648 - protein, 19 aa, Mycobacterium avium
LTDRQAARQGVGGEVLAYV

SEQ ID NO: 39649 - protein, 7 aa, Mycobacterium avium
LTDTNNG

SEQ ID NO: 39650 - protein, 11 aa, Mycobacterium avium
LTDTSPAPHAV

SEQ ID NO: 39651 - protein, 9 aa, Mycobacterium avium
LTEADGPTV

SEQ ID NO: 39652 - protein, 6 aa, Mycobacterium avium
LTEAQK

SEQ ID NO: 39653 - protein, 9 aa, Mycobacterium avium
LTEDATADR

SEQ ID NO: 39654 - protein, 6 aa, Mycobacterium avium
LTEDDA

SEQ ID NO: 39655 - protein, 5 aa, Mycobacterium avium
LTEDE

SEQ ID NO: 39656 - protein, 7 aa, Mycobacterium avium
LTEEEPG

SEQ ID NO: 39657 - protein, 7 aa, Mycobacterium avium
LTEEQTS

SEQ ID NO: 39658 - protein, 7 aa, Mycobacterium avium
LTEERRR

SEQ ID NO: 39659 - protein, 11 aa, Mycobacterium avium
LTEERVADSRT

SEQ ID NO: 39660 - protein, 8 aa, Mycobacterium avium
LTEQDPVS

SEQ ID NO: 39661 - protein, 26 aa, Mycobacterium avium
LTERGATRADDRISEAGMEDRKRQGY

SEQ ID NO: 39662 - protein, 8 aa, Mycobacterium avium
LTERPARR

SEQ ID NO: 39663 - protein, 6 aa, Mycobacterium avium
LTERPR

SEQ ID NO: 39664 - protein, 7 aa, Mycobacterium avium
LTESESL

SEQ ID NO: 39665 - protein, 7 aa, Mycobacterium avium
LTETRAQ

SEQ ID NO: 39666 - protein, 6 aa, Mycobacterium avium
LTGDED

SEQ ID NO: 39667 - protein, 6 aa, Mycobacterium avium
LTGDPE

SEQ ID NO: 39668 - protein, 5 aa, Mycobacterium avium
LTGDR

SEQ ID NO: 39669 - protein, 11 aa, Mycobacterium avium
LTGEPLPPRYA

SEQ ID NO: 39670 - protein, 8 aa, Mycobacterium avium
LTGESDDR

SEQ ID NO: 39671 - protein, 4 aa, Mycobacterium avium
LTGG

SEQ ID NO: 39672 - protein, 9 aa, Mycobacterium avium
LTGGASRTT

SEQ ID NO: 39673 - protein, 5 aa, Mycobacterium avium
LTGGG

SEQ ID NO: 39674 - protein, 15 aa, Mycobacterium avium
LTGGKEPNKGVNPDE

SEQ ID NO: 39675 - protein, 6 aa, Mycobacterium avium
LTGGTQ

SEQ ID NO: 39676 - protein, 5 aa, Mycobacterium avium
LTGKQ

SEQ ID NO: 39677 - protein, 10 aa, Mycobacterium avium
LTGKSRDEVQ

SEQ ID NO: 39678 - protein, 8 aa, Mycobacterium avium
LTGLDGPA

SEQ ID NO: 39679 - protein, 4 aa, Mycobacterium avium
LTGP

SEQ ID NO: 39680 - protein, 8 aa, Mycobacterium avium
LTGPAARR

SEQ ID NO: 39681 - protein, 5 aa, Mycobacterium avium
LTGPD

SEQ ID NO: 39682 - protein, 9 aa, Mycobacterium avium
LTGPPPPVA

SEQ ID NO: 39683 - protein, 9 aa, Mycobacterium avium
LTGPQALSN

SEQ ID NO: 39684 - protein, 8 aa, Mycobacterium avium
LTGPSDDG

SEQ ID NO: 39685 - protein, 15 aa, Mycobacterium avium
LTGQPSKQAPFAPLP

SEQ ID NO: 39686 - protein, 12 aa, Mycobacterium avium
LTGSQTLDASTP

SEQ ID NO: 39687 - protein, 5 aa, Mycobacterium avium
LTGVT

SEQ ID NO: 39688 - protein, 8 aa, Mycobacterium avium
LTHPDGRS

SEQ ID NO: 39689 - protein, 7 aa, Mycobacterium avium
LTKEQAE

SEQ ID NO: 39690 - protein, 23 aa, Mycobacterium avium
LTKNDGVPTTDQPQKAKDFTSDQ

SEQ ID NO: 39691 - protein, 4 aa, Mycobacterium avium
LTNR

SEQ ID NO: 39692 - protein, 5 aa, Mycobacterium avium
LTPAE

SEQ ID NO: 39693 - protein, 6 aa, Mycobacterium avium
LTPDHP

SEQ ID NO: 39694 - protein, 5 aa, Mycobacterium avium
LTPDI

SEQ ID NO: 39695 - protein, 7 aa, Mycobacterium avium
LTPDNTH

SEQ ID NO: 39696 - protein, 7 aa, Mycobacterium avium
LTPEDLR

SEQ ID NO: 39697 - protein, 4 aa, Mycobacterium avium
LTPG

SEQ ID NO: 39698 - protein, 15 aa, Mycobacterium avium
LTPGGLATQYSSAGH

SEQ ID NO: 39699 - protein, 10 aa, Mycobacterium avium
LTPGGTAPGQ

SEQ ID NO: 39700 - protein, 9 aa, Mycobacterium avium
LTPGKASQQ

SEQ ID NO: 39701 - protein, 4 aa, Mycobacterium avium
LTPH

SEQ ID NO: 39702 - protein, 19 aa, Mycobacterium avium
LTPNDPAFQPGFENADTAV

SEQ ID NO: 39703 - protein, 9 aa, Mycobacterium avium
LTPNGKLDA

SEQ ID NO: 39704 - protein, 12 aa, Mycobacterium avium
LTPNTTQPGTAG

SEQ ID NO: 39705 - protein, 6 aa, Mycobacterium avium
LTPPAE

SEQ ID NO: 39706 - protein, 7 aa, Mycobacterium avium
LTPQQYP

SEQ ID NO: 39707 - protein, 5 aa, Mycobacterium avium
LTPQR

SEQ ID NO: 39708 - protein, 4 aa, Mycobacterium avium
LTPR

SEQ ID NO: 39709 - protein, 9 aa, Mycobacterium avium
LTPRGRRRY

SEQ ID NO: 39710 - protein, 4 aa, Mycobacterium avium
LTQP

SEQ ID NO: 39711 - protein, 9 aa, Mycobacterium avium
LTRRGSPDA

SEQ ID NO: 39712 - protein, 5 aa, Mycobacterium avium
LTRTG

SEQ ID NO: 39713 - protein, 9 aa, Mycobacterium avium
LTSAGRAKL

SEQ ID NO: 39714 - protein, 11 aa, Mycobacterium avium
LTSEAADKAQH

SEQ ID NO: 39715 - protein, 11 aa, Mycobacterium avium
LTSESERIGRP

SEQ ID NO: 39716 - protein, 6 aa, Mycobacterium avium
LTSGSK

SEQ ID NO: 39717 - protein, 9 aa, Mycobacterium avium
LTSPRGKRQ

SEQ ID NO: 39718 - protein, 14 aa, Mycobacterium avium
LTSSPATSASARTV

SEQ ID NO: 39719 - protein, 7 aa, Mycobacterium avium
LTSTSSV

SEQ ID NO: 39720 - protein, 13 aa, Mycobacterium avium
LTTGAGRAVTGGG

SEQ ID NO: 39721 - protein, 5 aa, Mycobacterium avium
LTTND

SEQ ID NO: 39722 - protein, 4 aa, Mycobacterium avium
LTTP

SEQ ID NO: 39723 - protein, 5 aa, Mycobacterium avium
LTTPE

SEQ ID NO: 39724 - protein, 7 aa, Mycobacterium avium
LTTPRGS

SEQ ID NO: 39725 - protein, 5 aa, Mycobacterium avium
LTTQQ

SEQ ID NO: 39726 - protein, 6 aa, Mycobacterium avium
LTTSPD

SEQ ID NO: 39727 - protein, 10 aa, Mycobacterium avium
LTTVAPNENV

SEQ ID NO: 39728 - protein, 12 aa, Mycobacterium avium
LVGGPDAPTGFD

SEQ ID NO: 39729 - protein, 9 aa, Mycobacterium avium
LVGGSTGLS

SEQ ID NO: 39730 - protein, 8 aa, Mycobacterium avium
LVPEPGDP

SEQ ID NO: 39731 - protein, 7 aa, Mycobacterium avium
LVPGEGD

SEQ ID NO: 39732 - protein, 10 aa, Mycobacterium avium
LVRDGTADEF

SEQ ID NO: 39733 - protein, 12 aa, Mycobacterium avium
LVSGSDAKESRG

SEQ ID NO: 39734 - protein, 4 aa, Mycobacterium avium
LWSS

SEQ ID NO: 39735 - protein, 28 aa, Mycobacterium avium
LYAESGGQIADEGTISGTGAGESARAAV

SEQ ID NO: 39736 - protein, 7 aa, Mycobacterium avium
LYPANSV

SEQ ID NO: 39737 - protein, 11 aa, Mycobacterium avium
LYSDPGAWPGL

SEQ ID NO: 39738 - protein, 8 aa, Mycobacterium avium
MADARGTT

SEQ ID NO: 39739 - protein, 6 aa, Mycobacterium avium
MADDNR

SEQ ID NO: 39740 - protein, 8 aa, Mycobacterium avium
MADEGRND

SEQ ID NO: 39741 - protein, 5 aa, Mycobacterium avium
MADPS

SEQ ID NO: 39742 - protein, 9 aa, Mycobacterium avium
MADSYDEQG

SEQ ID NO: 39743 - protein, 7 aa, Mycobacterium avium
MAEQRDS

SEQ ID NO: 39744 - protein, 10 aa, Mycobacterium avium
MAGGPGTPAL

SEQ ID NO: 39745 - protein, 9 aa, Mycobacterium avium
MAGKAGTFN

SEQ ID NO: 39746 - protein, 8 aa, Mycobacterium avium
MAGNNPDP

SEQ ID NO: 39747 - protein, 17 aa, Mycobacterium avium
MAGRGSGAGKSYSKDRY

SEQ ID NO: 39748 - protein, 34 aa, Mycobacterium avium
MAKSTGGSEHKDGAGKQSRAHGPVESRREFRRKS

SEQ ID NO: 39749 - protein, 5 aa, Mycobacterium avium
MAPGS

SEQ ID NO: 39750 - protein, 6 aa, Mycobacterium avium
MAREDE

SEQ ID NO: 39751 - protein, 5 aa, Mycobacterium avium
MASAA

SEQ ID NO: 39752 - protein, 6 aa, Mycobacterium avium
MASGGT

SEQ ID NO: 39753 - protein, 10 aa, Mycobacterium avium
MASPGSRAGC

SEQ ID NO: 39754 - protein, 4 aa, Mycobacterium avium
MASS

SEQ ID NO: 39755 - protein, 8 aa, Mycobacterium avium
MAYPDGAE

SEQ ID NO: 39756 - protein, 5 aa, Mycobacterium avium
MDGPS

SEQ ID NO: 39757 - protein, 11 aa, Mycobacterium avium
MDGSTTGGVAR

SEQ ID NO: 39758 - protein, 12 aa, Mycobacterium avium
MDGTAQREAGMT

SEQ ID NO: 39759 - protein, 4 aa, Mycobacterium avium
MDKE

SEQ ID NO: 39760 - protein, 7 aa, Mycobacterium avium
MDPDDAA

SEQ ID NO: 39761 - protein, 7 aa, Mycobacterium avium
MDQSGAN

SEQ ID NO: 39762 - protein, 8 aa, Mycobacterium avium
MDRGGTLE

SEQ ID NO: 39763 - protein, 7 aa, Mycobacterium avium
MDRGGTR

SEQ ID NO: 39764 - protein, 7 aa, Mycobacterium avium
MDSPDFA

SEQ ID NO: 39765 - protein, 8 aa, Mycobacterium avium
MDSPRRKE

SEQ ID NO: 39766 - protein, 6 aa, Mycobacterium avium
MDTPRT

SEQ ID NO: 39767 - protein, 7 aa, Mycobacterium avium
MEEDTGK

SEQ ID NO: 39768 - protein, 8 aa, Mycobacterium avium
MENDGAGA

SEQ ID NO: 39769 - protein, 11 aa, Mycobacterium avium
MENPAEDAVSD

SEQ ID NO: 39770 - protein, 9 aa, Mycobacterium avium
MEQDRHNEA

SEQ ID NO: 39771 - protein, 6 aa, Mycobacterium avium
METNPQ

SEQ ID NO: 39772 - protein, 5 aa, Mycobacterium avium
MGEAS

SEQ ID NO: 39773 - protein, 7 aa, Mycobacterium avium
MGEGGVT

SEQ ID NO: 39774 - protein, 6 aa, Mycobacterium avium
MGGAQA

SEQ ID NO: 39775 - protein, 4 aa, Mycobacterium avium
MGGG

SEQ ID NO: 39776 - protein, 5 aa, Mycobacterium avium
MGPEQ

SEQ ID NO: 39777 - protein, 9 aa, Mycobacterium avium
MGPPADPEC

SEQ ID NO: 39778 - protein, 6 aa, Mycobacterium avium
MGPSYP

SEQ ID NO: 39779 - protein, 4 aa, Mycobacterium avium
MGRG

SEQ ID NO: 39780 - protein, 7 aa, Mycobacterium avium
MGRNGGG

SEQ ID NO: 39781 - protein, 8 aa, Mycobacterium avium
MGSDRGAM

SEQ ID NO: 39782 - protein, 10 aa, Mycobacterium avium
MGSKRSTERM

SEQ ID NO: 39783 - protein, 9 aa, Mycobacterium avium
MGSTDMGNV

SEQ ID NO: 39784 - protein, 11 aa, Mycobacterium avium
MGTGMGGGTSM

SEQ ID NO: 39785 - protein, 12 aa, Mycobacterium avium
MGTKGGPRTDRD

SEQ ID NO: 39786 - protein, 11 aa, Mycobacterium avium
MGTRPDNSVVD

SEQ ID NO: 39787 - protein, 10 aa, Mycobacterium avium
MGVDGDPRAV

SEQ ID NO: 39788 - protein, 11 aa, Mycobacterium avium
MGVSKQAAQKR

SEQ ID NO: 39789 - protein, 14 aa, Mycobacterium avium
MGYAPAEDDEADQM

SEQ ID NO: 39790 - protein, 5 aa, Mycobacterium avium
MHGPD

SEQ ID NO: 39791 - protein, 7 aa, Mycobacterium avium
MKDDPEM

SEQ ID NO: 39792 - protein, 12 aa, Mycobacterium avium
MKEAEDALRDYQ

SEQ ID NO: 39793 - protein, 7 aa, Mycobacterium avium
MKKTPKK

SEQ ID NO: 39794 - protein, 9 aa, Mycobacterium avium
MKTGEGKTL

SEQ ID NO: 39795 - protein, 7 aa, Mycobacterium avium
MNAGGQL

SEQ ID NO: 39796 - protein, 11 aa, Mycobacterium avium
MNLGETDDTVT

SEQ ID NO: 39797 - protein, 4 aa, Mycobacterium avium
MNPG

SEQ ID NO: 39798 - protein, 6 aa, Mycobacterium avium
MNPRTS

SEQ ID NO: 39799 - protein, 19 aa, Mycobacterium avium
MNSEGGPEATSSGSPVVTV

SEQ ID NO: 39800 - protein, 13 aa, Mycobacterium avium
MPAAPPPDGLPGL

SEQ ID NO: 39801 - protein, 7 aa, Mycobacterium avium
MPADAEN

SEQ ID NO: 39802 - protein, 14 aa, Mycobacterium avium
MPAEGPVNAVTEDE

SEQ ID NO: 39803 - protein, 4 aa, Mycobacterium avium
MPAP

SEQ ID NO: 39804 - protein, 4 aa, Mycobacterium avium
MPAR

SEQ ID NO: 39805 - protein, 6 aa, Mycobacterium avium
MPASRR

SEQ ID NO: 39806 - protein, 9 aa, Mycobacterium avium
MPDDHPNSI

SEQ ID NO: 39807 - protein, 7 aa, Mycobacterium avium
MPDNATD

SEQ ID NO: 39808 - protein, 10 aa, Mycobacterium avium
MPGLTQGKPF

SEQ ID NO: 39809 - protein, 14 aa, Mycobacterium avium
MPGPNRHRPIPWPA

SEQ ID NO: 39810 - protein, 8 aa, Mycobacterium avium
MPGPTGLT

SEQ ID NO: 39811 - protein, 12 aa, Mycobacterium avium
MPGTAGHGSGAY

SEQ ID NO: 39812 - protein, 12 aa, Mycobacterium avium
MPLPGSGPPAYL

SEQ ID NO: 39813 - protein, 13 aa, Mycobacterium avium
MPNPKTGTVTPDV

SEQ ID NO: 39814 - protein, 14 aa, Mycobacterium avium
MPPANLEPGAPRKM

SEQ ID NO: 39815 - protein, 9 aa, Mycobacterium avium
MPPEADHDV

SEQ ID NO: 39816 - protein, 14 aa, Mycobacterium avium
MPPGAPRTKPTDVR

SEQ ID NO: 39817 - protein, 6 aa, Mycobacterium avium
MPPGPH

SEQ ID NO: 39818 - protein, 4 aa, Mycobacterium avium
MPPS

SEQ ID NO: 39819 - protein, 5 aa, Mycobacterium avium
MPSRS

SEQ ID NO: 39820 - protein, 14 aa, Mycobacterium avium
MPTSMGKDSTPTAN

SEQ ID NO: 39821 - protein, 6 aa, Mycobacterium avium
MPTTGA

SEQ ID NO: 39822 - protein, 5 aa, Mycobacterium avium
MPTWG

SEQ ID NO: 39823 - protein, 28 aa, Mycobacterium avium
MPYPPNYPKMPGEPKRVQPSRDTEHKKK

SEQ ID NO: 39824 - protein, 6 aa, Mycobacterium avium
MQPADQ

SEQ ID NO: 39825 - protein, 10 aa, Mycobacterium avium
MQPSADGRPP

SEQ ID NO: 39826 - protein, 6 aa, Mycobacterium avium
MQRAKR

SEQ ID NO: 39827 - protein, 7 aa, Mycobacterium avium
MQSPSED

SEQ ID NO: 39828 - protein, 5 aa, Mycobacterium avium
MRGAR

SEQ ID NO: 39829 - protein, 7 aa, Mycobacterium avium
MRGATAP

SEQ ID NO: 39830 - protein, 5 aa, Mycobacterium avium
MRGPS

SEQ ID NO: 39831 - protein, 7 aa, Mycobacterium avium
MRGTGSH

SEQ ID NO: 39832 - protein, 7 aa, Mycobacterium avium
MRPDTTM

SEQ ID NO: 39833 - protein, 4 aa, Mycobacterium avium
MRPG

SEQ ID NO: 39834 - protein, 9 aa, Mycobacterium avium
MRPPPYTVG

SEQ ID NO: 39835 - protein, 8 aa, Mycobacterium avium
MRPQTTRH

SEQ ID NO: 39836 - protein, 5 aa, Mycobacterium avium
MRQPN

SEQ ID NO: 39837 - protein, 7 aa, Mycobacterium avium
MRTAGDD

SEQ ID NO: 39838 - protein, 11 aa, Mycobacterium avium
MRTSDTEDPDL

SEQ ID NO: 39839 - protein, 10 aa, Mycobacterium avium
MRVEGTSAAL

SEQ ID NO: 39840 - protein, 4 aa, Mycobacterium avium
MSAG

SEQ ID NO: 39841 - protein, 18 aa, Mycobacterium avium
MSAGNAGTFPTVNPATEE

SEQ ID NO: 39842 - protein, 4 aa, Mycobacterium avium
MSDD

SEQ ID NO: 39843 - protein, 12 aa, Mycobacterium avium
MSEPGAGSDLAS

SEQ ID NO: 39844 - protein, 11 aa, Mycobacterium avium
MSEPSAGSDLA

SEQ ID NO: 39845 - protein, 6 aa, Mycobacterium avium
MSETAG

SEQ ID NO: 39846 - protein, 6 aa, Mycobacterium avium
MSGAEA

SEQ ID NO: 39847 - protein, 17 aa, Mycobacterium avium
MSGAPTRPRPGRGSTRR

SEQ ID NO: 39848 - protein, 9 aa, Mycobacterium avium
MSGTPGPAY

SEQ ID NO: 39849 - protein, 7 aa, Mycobacterium avium
MSGYAGT

SEQ ID NO: 39850 - protein, 6 aa, Mycobacterium avium
MSKKKH

SEQ ID NO: 39851 - protein, 4 aa, Mycobacterium avium
MSKS

SEQ ID NO: 39852 - protein, 6 aa, Mycobacterium avium
MSKSRG

SEQ ID NO: 39853 - protein, 6 aa, Mycobacterium avium
MSPARK

SEQ ID NO: 39854 - protein, 6 aa, Mycobacterium avium
MSPPSV

SEQ ID NO: 39855 - protein, 5 aa, Mycobacterium avium
MSPQG

SEQ ID NO: 39856 - protein, 4 aa, Mycobacterium avium
MSRN

SEQ ID NO: 39857 - protein, 9 aa, Mycobacterium avium
MSSRDGGFD

SEQ ID NO: 39858 - protein, 6 aa, Mycobacterium avium
MSSTYE

SEQ ID NO: 39859 - protein, 11 aa, Mycobacterium avium
MSTSSNERGMS

SEQ ID NO: 39860 - protein, 17 aa, Mycobacterium avium
MTAAQKKQVRDEVAGGQ

SEQ ID NO: 39861 - protein, 8 aa, Mycobacterium avium
MTAEDEDL

SEQ ID NO: 39862 - protein, 7 aa, Mycobacterium avium
MTAGSGA

SEQ ID NO: 39863 - protein, 7 aa, Mycobacterium avium
MTAPRGL

SEQ ID NO: 39864 - protein, 6 aa, Mycobacterium avium
MTDEER

SEQ ID NO: 39865 - protein, 4 aa, Mycobacterium avium
MTDP

SEQ ID NO: 39866 - protein, 5 aa, Mycobacterium avium
MTGGG

SEQ ID NO: 39867 - protein, 9 aa, Mycobacterium avium
MTGNEDPEY

SEQ ID NO: 39868 - protein, 8 aa, Mycobacterium avium
MTGPRDAP

SEQ ID NO: 39869 - protein, 15 aa, Mycobacterium avium
MTGYASASNAATQQL

SEQ ID NO: 39870 - protein, 9 aa, Mycobacterium avium
MTKRGGGAI

SEQ ID NO: 39871 - protein, 6 aa, Mycobacterium avium
MTPAQA

SEQ ID NO: 39872 - protein, 5 aa, Mycobacterium avium
MTPEA

SEQ ID NO: 39873 - protein, 10 aa, Mycobacterium avium
MTPEDARQAE

SEQ ID NO: 39874 - protein, 5 aa, Mycobacterium avium
MTPTE

SEQ ID NO: 39875 - protein, 8 aa, Mycobacterium avium
MTQRRDEP

SEQ ID NO: 39876 - protein, 12 aa, Mycobacterium avium
MTQTHPSVPEQL

SEQ ID NO: 39877 - protein, 7 aa, Mycobacterium avium
MTSGYSP

SEQ ID NO: 39878 - protein, 4 aa, Mycobacterium avium
MTTQ

SEQ ID NO: 39879 - protein, 19 aa, Mycobacterium avium
MYGADGRQKDTKAVNPEST

SEQ ID NO: 39880 - protein, 10 aa, Mycobacterium avium
MYSGPGSESM

SEQ ID NO: 39881 - protein, 12 aa, Mycobacterium avium
NAAAQAKKAVEQ

SEQ ID NO: 39882 - protein, 5 aa, Mycobacterium avium
NAAAR

SEQ ID NO: 39883 - protein, 15 aa, Mycobacterium avium
NAAERAAGKPLPGAR

SEQ ID NO: 39884 - protein, 8 aa, Mycobacterium avium
NAAGSKAV

SEQ ID NO: 39885 - protein, 12 aa, Mycobacterium avium
NAAHQAGNREIT

SEQ ID NO: 39886 - protein, 9 aa, Mycobacterium avium
NAAPGQPVP

SEQ ID NO: 39887 - protein, 6 aa, Mycobacterium avium
NAAPLT

SEQ ID NO: 39888 - protein, 14 aa, Mycobacterium avium
NAASRAEALDLILR

SEQ ID NO: 39889 - protein, 19 aa, Mycobacterium avium
NAATAEKDAELRANAAAKE

SEQ ID NO: 39890 - protein, 5 aa, Mycobacterium avium
NAAYT

SEQ ID NO: 39891 - protein, 8 aa, Mycobacterium avium
NADAADMD

SEQ ID NO: 39892 - protein, 9 aa, Mycobacterium avium
NADAAPIGR

SEQ ID NO: 39893 - protein, 5 aa, Mycobacterium avium
NADAK

SEQ ID NO: 39894 - protein, 5 aa, Mycobacterium avium
NADEL

SEQ ID NO: 39895 - protein, 8 aa, Mycobacterium avium
NADGAGDL

SEQ ID NO: 39896 - protein, 7 aa, Mycobacterium avium
NADGGEA

SEQ ID NO: 39897 - protein, 8 aa, Mycobacterium avium
NADGKEIA

SEQ ID NO: 39898 - protein, 33 aa, Mycobacterium avium
NADPPSQAAFNADPSKFSTSVQAPLSGGTPVTY

SEQ ID NO: 39899 - protein, 6 aa, Mycobacterium avium
NAEEGR

SEQ ID NO: 39900 - protein, 16 aa, Mycobacterium avium
NAELPGVGPSESEVGP

SEQ ID NO: 39901 - protein, 4 aa, Mycobacterium avium
NAEN

SEQ ID NO: 39902 - protein, 9 aa, Mycobacterium avium
NAERARTAS

SEQ ID NO: 39903 - protein, 14 aa, Mycobacterium avium
NAERATDWRGNNNI

SEQ ID NO: 39904 - protein, 6 aa, Mycobacterium avium
NAESRS

SEQ ID NO: 39905 - protein, 5 aa, Mycobacterium avium
NAEST

SEQ ID NO: 39906 - protein, 7 aa, Mycobacterium avium
NAEVSGP

SEQ ID NO: 39907 - protein, 8 aa, Mycobacterium avium
NAFQDPAE

SEQ ID NO: 39908 - protein, 8 aa, Mycobacterium avium
NAFSTDAR

SEQ ID NO: 39909 - protein, 12 aa, Mycobacterium avium
NAGDGTHEHPTQ

SEQ ID NO: 39910 - protein, 8 aa, Mycobacterium avium
NAGDTGEV

SEQ ID NO: 39911 - protein, 9 aa, Mycobacterium avium
NAGEGLPPL

SEQ ID NO: 39912 - protein, 11 aa, Mycobacterium avium
NAGGARGLEPV

SEQ ID NO: 39913 - protein, 11 aa, Mycobacterium avium
NAGGGETKGIT

SEQ ID NO: 39914 - protein, 12 aa, Mycobacterium avium
NAGGSIPPPPGY

SEQ ID NO: 39915 - protein, 7 aa, Mycobacterium avium
NAGGSPY

SEQ ID NO: 39916 - protein, 10 aa, Mycobacterium avium
NAGHGGVSGR

SEQ ID NO: 39917 - protein, 7 aa, Mycobacterium avium
NAGKSLR

SEQ ID NO: 39918 - protein, 4 aa, Mycobacterium avium
NAGL

SEQ ID NO: 39919 - protein, 7 aa, Mycobacterium avium
NAGLRDG

SEQ ID NO: 39920 - protein, 9 aa, Mycobacterium avium
NAGPGTNGS

SEQ ID NO: 39921 - protein, 16 aa, Mycobacterium avium
NAGSPAAADRPLPSTR

SEQ ID NO: 39922 - protein, 8 aa, Mycobacterium avium
NAGTGAVS

SEQ ID NO: 39923 - protein, 5 aa, Mycobacterium avium
NAGVD

SEQ ID NO: 39924 - protein, 4 aa, Mycobacterium avium
NAGY

SEQ ID NO: 39925 - protein, 4 aa, Mycobacterium avium
NAIN

SEQ ID NO: 39926 - protein, 6 aa, Mycobacterium avium
NAIPQT

SEQ ID NO: 39927 - protein, 6 aa, Mycobacterium avium
NAISRD

SEQ ID NO: 39928 - protein, 9 aa, Mycobacterium avium
NAKDRTVAS

SEQ ID NO: 39929 - protein, 4 aa, Mycobacterium avium
NAKG

SEQ ID NO: 39930 - protein, 12 aa, Mycobacterium avium
NAKPTRLARRDT

SEQ ID NO: 39931 - protein, 16 aa, Mycobacterium avium
NAKRGDASAWAGVGTP

SEQ ID NO: 39932 - protein, 9 aa, Mycobacterium avium
NAKSPEELR

SEQ ID NO: 39933 - protein, 18 aa, Mycobacterium avium
NALGGEDEERDKNHNGAN

SEQ ID NO: 39934 - protein, 9 aa, Mycobacterium avium
NANGSGAGV

SEQ ID NO: 39935 - protein, 7 aa, Mycobacterium avium
NANHTDG

SEQ ID NO: 39936 - protein, 6 aa, Mycobacterium avium
NANPAA

SEQ ID NO: 39937 - protein, 4 aa, Mycobacterium avium
NAPH

SEQ ID NO: 39938 - protein, 6 aa, Mycobacterium avium
NAPPAV

SEQ ID NO: 39939 - protein, 6 aa, Mycobacterium avium
NAQART

SEQ ID NO: 39940 - protein, 8 aa, Mycobacterium avium
NARDRTMA

SEQ ID NO: 39941 - protein, 11 aa, Mycobacterium avium
NAREKTGTDPV

SEQ ID NO: 39942 - protein, 7 aa, Mycobacterium avium
NARETSL

SEQ ID NO: 39943 - protein, 10 aa, Mycobacterium avium
NARKAGTTVS

SEQ ID NO: 39944 - protein, 8 aa, Mycobacterium avium
NARPRSVD

SEQ ID NO: 39945 - protein, 20 aa, Mycobacterium avium
NARRSRTSTVRGWDSMPAIV

SEQ ID NO: 39946 - protein, 5 aa, Mycobacterium avium
NARRT

SEQ ID NO: 39947 - protein, 8 aa, Mycobacterium avium
NARTAADY

SEQ ID NO: 39948 - protein, 4 aa, Mycobacterium avium
NARW

SEQ ID NO: 39949 - protein, 4 aa, Mycobacterium avium
NASA

SEQ ID NO: 39950 - protein, 7 aa, Mycobacterium avium
NASADEK

SEQ ID NO: 39951 - protein, 6 aa, Mycobacterium avium
NASDAL

SEQ ID NO: 39952 - protein, 7 aa, Mycobacterium avium
NASDRPL

SEQ ID NO: 39953 - protein, 8 aa, Mycobacterium avium
NASDTHPL

SEQ ID NO: 39954 - protein, 5 aa, Mycobacterium avium
NASGF

SEQ ID NO: 39955 - protein, 18 aa, Mycobacterium avium
NASSLTGGAGGSNTVRGP

SEQ ID NO: 39956 - protein, 5 aa, Mycobacterium avium
NASTS

SEQ ID NO: 39957 - protein, 9 aa, Mycobacterium avium
NATGDRPYR

SEQ ID NO: 39958 - protein, 6 aa, Mycobacterium avium
NATGHP

SEQ ID NO: 39959 - protein, 20 aa, Mycobacterium avium
NATKADPEAHRRPQYNVPTQ

SEQ ID NO: 39960 - protein, 4 aa, Mycobacterium avium
NATP

SEQ ID NO: 39961 - protein, 8 aa, Mycobacterium avium
NATPGPDG

SEQ ID NO: 39962 - protein, 8 aa, Mycobacterium avium
NATRELSE

SEQ ID NO: 39963 - protein, 12 aa, Mycobacterium avium
NAVPNDPRPPMV

SEQ ID NO: 39964 - protein, 12 aa, Mycobacterium avium
NAVQAGSLNRPG

SEQ ID NO: 39965 - protein, 5 aa, Mycobacterium avium
NAVRG

SEQ ID NO: 39966 - protein, 5 aa, Mycobacterium avium
NAVYP

SEQ ID NO: 39967 - protein, 4 aa, Mycobacterium avium
NAYA

SEQ ID NO: 39968 - protein, 6 aa, Mycobacterium avium
NAYGEA

SEQ ID NO: 39969 - protein, 8 aa, Mycobacterium avium
NAYGPRGF

SEQ ID NO: 39970 - protein, 7 aa, Mycobacterium avium
NCDPDEV

SEQ ID NO: 39971 - protein, 7 aa, Mycobacterium avium
NCSTGST

SEQ ID NO: 39972 - protein, 8 aa, Mycobacterium avium
NDAAPALR

SEQ ID NO: 39973 - protein, 8 aa, Mycobacterium avium
NDADPYSA

SEQ ID NO: 39974 - protein, 5 aa, Mycobacterium avium
NDAEL

SEQ ID NO: 39975 - protein, 7 aa, Mycobacterium avium
NDAGGTD

SEQ ID NO: 39976 - protein, 6 aa, Mycobacterium avium
NDAPIR

SEQ ID NO: 39977 - protein, 8 aa, Mycobacterium avium
NDARPARE

SEQ ID NO: 39978 - protein, 6 aa, Mycobacterium avium
NDDGAI

SEQ ID NO: 39979 - protein, 4 aa, Mycobacterium avium
NDDP

SEQ ID NO: 39980 - protein, 7 aa, Mycobacterium avium
NDDRNDR

SEQ ID NO: 39981 - protein, 5 aa, Mycobacterium avium
NDDVA

SEQ ID NO: 39982 - protein, 10 aa, Mycobacterium avium
NDEAKRKAAG

SEQ ID NO: 39983 - protein, 5 aa, Mycobacterium avium
NDEET

SEQ ID NO: 39984 - protein, 13 aa, Mycobacterium avium
NDEFGGSLQNRAK

SEQ ID NO: 39985 - protein, 8 aa, Mycobacterium avium
NDELRAPM

SEQ ID NO: 39986 - protein, 7 aa, Mycobacterium avium
NDEVGGT

SEQ ID NO: 39987 - protein, 4 aa, Mycobacterium avium
NDEY

SEQ ID NO: 39988 - protein, 7 aa, Mycobacterium avium
NDEYDNE

SEQ ID NO: 39989 - protein, 9 aa, Mycobacterium avium
NDGEALARQ

SEQ ID NO: 39990 - protein, 5 aa, Mycobacterium avium
NDGGT

SEQ ID NO: 39991 - protein, 8 aa, Mycobacterium avium
NDGGTETV

SEQ ID NO: 39992 - protein, 15 aa, Mycobacterium avium
NDGTRLRPDPDTYEG

SEQ ID NO: 39993 - protein, 8 aa, Mycobacterium avium
NDHAGTEQ

SEQ ID NO: 39994 - protein, 4 aa, Mycobacterium avium
NDHE

SEQ ID NO: 39995 - protein, 12 aa, Mycobacterium avium
NDHGAQRDSQRL

SEQ ID NO: 39996 - protein, 9 aa, Mycobacterium avium
NDIDEGAAP

SEQ ID NO: 39997 - protein, 8 aa, Mycobacterium avium
NDKDGVNA

SEQ ID NO: 39998 - protein, 8 aa, Mycobacterium avium
NDKNPRSA

SEQ ID NO: 39999 - protein, 6 aa, Mycobacterium avium
NDNGGG

SEQ ID NO: 40000 - protein, 5 aa, Mycobacterium avium
NDNTN

SEQ ID NO: 40001 - protein, 6 aa, Mycobacterium avium
NDPAGL

SEQ ID NO: 40002 - protein, 9 aa, Mycobacterium avium
NDPDANAER

SEQ ID NO: 40003 - protein, 6 aa, Mycobacterium avium
NDPDLA

SEQ ID NO: 40004 - protein, 4 aa, Mycobacterium avium
NDPE

SEQ ID NO: 40005 - protein, 5 aa, Mycobacterium avium
NDPEL

SEQ ID NO: 40006 - protein, 11 aa, Mycobacterium avium
NDPGGPRPRAG

SEQ ID NO: 40007 - protein, 5 aa, Mycobacterium avium
NDPRN

SEQ ID NO: 40008 - protein, 5 aa, Mycobacterium avium
NDPRV

SEQ ID NO: 40009 - protein, 7 aa, Mycobacterium avium
NDQTPEL

SEQ ID NO: 40010 - protein, 9 aa, Mycobacterium avium
NDRAQREAR

SEQ ID NO: 40011 - protein, 6 aa, Mycobacterium avium
NDRGMV

SEQ ID NO: 40012 - protein, 8 aa, Mycobacterium avium
NDRPPDHH

SEQ ID NO: 40013 - protein, 28 aa, Mycobacterium avium
NDRREEGDLRENGGYHAAREEQGQQEAR

SEQ ID NO: 40014 - protein, 6 aa, Mycobacterium avium
NDSANN

SEQ ID NO: 40015 - protein, 7 aa, Mycobacterium avium
NDSDYGL

SEQ ID NO: 40016 - protein, 5 aa, Mycobacterium avium
NDSMS

SEQ ID NO: 40017 - protein, 8 aa, Mycobacterium avium
NDSPYGLS

SEQ ID NO: 40018 - protein, 6 aa, Mycobacterium avium
NDSQAD

SEQ ID NO: 40019 - protein, 5 aa, Mycobacterium avium
NDTDV

SEQ ID NO: 40020 - protein, 6 aa, Mycobacterium avium
NDTDYG

SEQ ID NO: 40021 - protein, 6 aa, Mycobacterium avium
NDTGGV

SEQ ID NO: 40022 - protein, 7 aa, Mycobacterium avium
NDTSYGL

SEQ ID NO: 40023 - protein, 6 aa, Mycobacterium avium
NDTVAT

SEQ ID NO: 40024 - protein, 14 aa, Mycobacterium avium
NDYADRKNGRQPIK

SEQ ID NO: 40025 - protein, 6 aa, Mycobacterium avium
NDYGDD

SEQ ID NO: 40026 - protein, 7 aa, Mycobacterium avium
NEADDPA

SEQ ID NO: 40027 - protein, 6 aa, Mycobacterium avium
NEAELR

SEQ ID NO: 40028 - protein, 9 aa, Mycobacterium avium
NEAETTTAS

SEQ ID NO: 40029 - protein, 6 aa, Mycobacterium avium
NEAGSV

SEQ ID NO: 40030 - protein, 14 aa, Mycobacterium avium
NEANTEPITGSGFD

SEQ ID NO: 40031 - protein, 9 aa, Mycobacterium avium
NEARNEGKR

SEQ ID NO: 40032 - protein, 8 aa, Mycobacterium avium
NEATDRDI

SEQ ID NO: 40033 - protein, 9 aa, Mycobacterium avium
NEDGSNITK

SEQ ID NO: 40034 - protein, 5 aa, Mycobacterium avium
NEDNR

SEQ ID NO: 40035 - protein, 6 aa, Mycobacterium avium
NEEAEA

SEQ ID NO: 40036 - protein, 8 aa, Mycobacterium avium
NEEATEDA

SEQ ID NO: 40037 - protein, 6 aa, Mycobacterium avium
NEEQGI

SEQ ID NO: 40038 - protein, 6 aa, Mycobacterium avium
NEEQKR

SEQ ID NO: 40039 - protein, 4 aa, Mycobacterium avium
NEES

SEQ ID NO: 40040 - protein, 7 aa, Mycobacterium avium
NEESVRK

SEQ ID NO: 40041 - protein, 11 aa, Mycobacterium avium
NEGADSTHSPE

SEQ ID NO: 40042 - protein, 7 aa, Mycobacterium avium
NEGAVSR

SEQ ID NO: 40043 - protein, 12 aa, Mycobacterium avium
NEGFSGGEKKRH

SEQ ID NO: 40044 - protein, 6 aa, Mycobacterium avium
NEGGLH

SEQ ID NO: 40045 - protein, 9 aa, Mycobacterium avium
NEGGPRKVS

SEQ ID NO: 40046 - protein, 6 aa, Mycobacterium avium
NEGQGD

SEQ ID NO: 40047 - protein, 10 aa, Mycobacterium avium
NEGTEGAQRA

SEQ ID NO: 40048 - protein, 6 aa, Mycobacterium avium
NEHEAK

SEQ ID NO: 40049 - protein, 8 aa, Mycobacterium avium
NEHGGPVR

SEQ ID NO: 40050 - protein, 5 aa, Mycobacterium avium
NEHPG

SEQ ID NO: 40051 - protein, 7 aa, Mycobacterium avium
NEIGGGS

SEQ ID NO: 40052 - protein, 6 aa, Mycobacterium avium
NEISVP

SEQ ID NO: 40053 - protein, 4 aa, Mycobacterium avium
NEIT

SEQ ID NO: 40054 - protein, 21 aa, Mycobacterium avium
NEKHNEANGEDNNDGESHNRS

SEQ ID NO: 40055 - protein, 4 aa, Mycobacterium avium
NEKM

SEQ ID NO: 40056 - protein, 9 aa, Mycobacterium avium
NEKSQLQNK

SEQ ID NO: 40057 - protein, 7 aa, Mycobacterium avium
NELGPQG

SEQ ID NO: 40058 - protein, 14 aa, Mycobacterium avium
NELNAGYAADGYGR

SEQ ID NO: 40059 - protein, 5 aa, Mycobacterium avium
NEPGL

SEQ ID NO: 40060 - protein, 9 aa, Mycobacterium avium
NEPGLSGAE

SEQ ID NO: 40061 - protein, 8 aa, Mycobacterium avium
NEPGRRGR

SEQ ID NO: 40062 - protein, 7 aa, Mycobacterium avium
NEPNLGD

SEQ ID NO: 40063 - protein, 6 aa, Mycobacterium avium
NEPSLG

SEQ ID NO: 40064 - protein, 15 aa, Mycobacterium avium
NERPGLANHEPQPTA

SEQ ID NO: 40065 - protein, 10 aa, Mycobacterium avium
NERSQLQNKA

SEQ ID NO: 40066 - protein, 8 aa, Mycobacterium avium
NESPPEDF

SEQ ID NO: 40067 - protein, 6 aa, Mycobacterium avium
NETFSS

SEQ ID NO: 40068 - protein, 6 aa, Mycobacterium avium
NETIEG

SEQ ID NO: 40069 - protein, 8 aa, Mycobacterium avium
NETRPGDR

SEQ ID NO: 40070 - protein, 7 aa, Mycobacterium avium
NETSTGV

SEQ ID NO: 40071 - protein, 7 aa, Mycobacterium avium
NETTRNA

SEQ ID NO: 40072 - protein, 7 aa, Mycobacterium avium
NEVGGQY

SEQ ID NO: 40073 - protein, 4 aa, Mycobacterium avium
NEVP

SEQ ID NO: 40074 - protein, 7 aa, Mycobacterium avium
NFDNDEA

SEQ ID NO: 40075 - protein, 7 aa, Mycobacterium avium
NFESPSY

SEQ ID NO: 40076 - protein, 18 aa, Mycobacterium avium
NFHTRGGQDWEPGQTRLP

SEQ ID NO: 40077 - protein, 10 aa, Mycobacterium avium
NFKTRGGLTT

SEQ ID NO: 40078 - protein, 4 aa, Mycobacterium avium
NFPD

SEQ ID NO: 40079 - protein, 14 aa, Mycobacterium avium
NGAAPVSVPAAGAV

SEQ ID NO: 40080 - protein, 8 aa, Mycobacterium avium
NGAGKTTT

SEQ ID NO: 40081 - protein, 15 aa, Mycobacterium avium
NGAGVIGTPERAREQ

SEQ ID NO: 40082 - protein, 5 aa, Mycobacterium avium
NGAIN

SEQ ID NO: 40083 - protein, 9 aa, Mycobacterium avium
NGARDPLRL

SEQ ID NO: 40084 - protein, 15 aa, Mycobacterium avium
NGASGEGGPNGSVNE

SEQ ID NO: 40085 - protein, 5 aa, Mycobacterium avium
NGAYD

SEQ ID NO: 40086 - protein, 15 aa, Mycobacterium avium
NGDELGERARANPDA

SEQ ID NO: 40087 - protein, 5 aa, Mycobacterium avium
NGDEV

SEQ ID NO: 40088 - protein, 8 aa, Mycobacterium avium
NGDEVTVE

SEQ ID NO: 40089 - protein, 12 aa, Mycobacterium avium
NGDIPQGQRERT

SEQ ID NO: 40090 - protein, 9 aa, Mycobacterium avium
NGDKSDTET

SEQ ID NO: 40091 - protein, 7 aa, Mycobacterium avium
NGDPANR

SEQ ID NO: 40092 - protein, 7 aa, Mycobacterium avium
NGDQSAK

SEQ ID NO: 40093 - protein, 5 aa, Mycobacterium avium
NGDVD

SEQ ID NO: 40094 - protein, 9 aa, Mycobacterium avium
NGDVGAKAR

SEQ ID NO: 40095 - protein, 27 aa, Mycobacterium avium
NGECRDTTDHRTDGSTSPVDVSKEIQP

SEQ ID NO: 40096 - protein, 10 aa, Mycobacterium avium
NGEEGEPASI

SEQ ID NO: 40097 - protein, 5 aa, Mycobacterium avium
NGEGE

SEQ ID NO: 40098 - protein, 7 aa, Mycobacterium avium
NGEPEAT

SEQ ID NO: 40099 - protein, 5 aa, Mycobacterium avium
NGERN

SEQ ID NO: 40100 - protein, 6 aa, Mycobacterium avium
NGERTG

SEQ ID NO: 40101 - protein, 20 aa, Mycobacterium avium
NGEYLSKTGGEFGVTTGRRR

SEQ ID NO: 40102 - protein, 5 aa, Mycobacterium avium
NGFPA

SEQ ID NO: 40103 - protein, 6 aa, Mycobacterium avium
NGFSEK

SEQ ID NO: 40104 - protein, 5 aa, Mycobacterium avium
NGGAG

SEQ ID NO: 40105 - protein, 11 aa, Mycobacterium avium
NGGGSRPEGIE

SEQ ID NO: 40106 - protein, 15 aa, Mycobacterium avium
NGGILSEQTTLILEG

SEQ ID NO: 40107 - protein, 7 aa, Mycobacterium avium
NGGKSSW

SEQ ID NO: 40108 - protein, 5 aa, Mycobacterium avium
NGGRA

SEQ ID NO: 40109 - protein, 10 aa, Mycobacterium avium
NGGSAQDAGH

SEQ ID NO: 40110 - protein, 10 aa, Mycobacterium avium
NGGSAQESVV

SEQ ID NO: 40111 - protein, 4 aa, Mycobacterium avium
NGGY

SEQ ID NO: 40112 - protein, 7 aa, Mycobacterium avium
NGGYRRK

SEQ ID NO: 40113 - protein, 11 aa, Mycobacterium avium
NGHNVSTRGRI

SEQ ID NO: 40114 - protein, 4 aa, Mycobacterium avium
NGIG

SEQ ID NO: 40115 - protein, 13 aa, Mycobacterium avium
NGINDAKGRVAEP

SEQ ID NO: 40116 - protein, 10 aa, Mycobacterium avium
NGKVNGKTVV

SEQ ID NO: 40117 - protein, 8 aa, Mycobacterium avium
NGLARGGL

SEQ ID NO: 40118 - protein, 6 aa, Mycobacterium avium
NGLPAD

SEQ ID NO: 40119 - protein, 5 aa, Mycobacterium avium
NGLRP

SEQ ID NO: 40120 - protein, 11 aa, Mycobacterium avium
NGNELPPGQAG

SEQ ID NO: 40121 - protein, 6 aa, Mycobacterium avium
NGPAIG

SEQ ID NO: 40122 - protein, 9 aa, Mycobacterium avium
NGPGDPATA

SEQ ID NO: 40123 - protein, 6 aa, Mycobacterium avium
NGPGRS

SEQ ID NO: 40124 - protein, 14 aa, Mycobacterium avium
NGPIEGTSNFGVFR

SEQ ID NO: 40125 - protein, 7 aa, Mycobacterium avium
NGPNGGG

SEQ ID NO: 40126 - protein, 6 aa, Mycobacterium avium
NGPNPR

SEQ ID NO: 40127 - protein, 5 aa, Mycobacterium avium
NGPRS

SEQ ID NO: 40128 - protein, 9 aa, Mycobacterium avium
NGPSDDPFG

SEQ ID NO: 40129 - protein, 4 aa, Mycobacterium avium
NGPV

SEQ ID NO: 40130 - protein, 18 aa, Mycobacterium avium
NGQAPLLPDEPEDGDDRL

SEQ ID NO: 40131 - protein, 4 aa, Mycobacterium avium
NGQE

SEQ ID NO: 40132 - protein, 6 aa, Mycobacterium avium
NGQPAA

SEQ ID NO: 40133 - protein, 9 aa, Mycobacterium avium
NGRDSAAQR

SEQ ID NO: 40134 - protein, 5 aa, Mycobacterium avium
NGREA

SEQ ID NO: 40135 - protein, 6 aa, Mycobacterium avium
NGRFGR

SEQ ID NO: 40136 - protein, 5 aa, Mycobacterium avium
NGRGA

SEQ ID NO: 40137 - protein, 6 aa, Mycobacterium avium
NGRPDR

SEQ ID NO: 40138 - protein, 13 aa, Mycobacterium avium
NGRPTSEAVEGTA

SEQ ID NO: 40139 - protein, 17 aa, Mycobacterium avium
NGRRGRPVTGPGNRPLK

SEQ ID NO: 40140 - protein, 7 aa, Mycobacterium avium
NGRRPQA

SEQ ID NO: 40141 - protein, 8 aa, Mycobacterium avium
NGRRSAES

SEQ ID NO: 40142 - protein, 10 aa, Mycobacterium avium
NGRSYAPTIG

SEQ ID NO: 40143 - protein, 10 aa, Mycobacterium avium
NGSEPVSPSS

SEQ ID NO: 40144 - protein, 6 aa, Mycobacterium avium
NGSGGI

SEQ ID NO: 40145 - protein, 16 aa, Mycobacterium avium
NGSGNPKQRDGAPGVR

SEQ ID NO: 40146 - protein, 7 aa, Mycobacterium avium
NGSGVTV

SEQ ID NO: 40147 - protein, 8 aa, Mycobacterium avium
NGSIGEGG

SEQ ID NO: 40148 - protein, 8 aa, Mycobacterium avium
NGSPRAAG

SEQ ID NO: 40149 - protein, 12 aa, Mycobacterium avium
NGSTDGTPQAAV

SEQ ID NO: 40150 - protein, 12 aa, Mycobacterium avium
NGVPTAARPGKL

SEQ ID NO: 40151 - protein, 13 aa, Mycobacterium avium
NGVRRGAEAPLRG

SEQ ID NO: 40152 - protein, 6 aa, Mycobacterium avium
NGWEIP

SEQ ID NO: 40153 - protein, 9 aa, Mycobacterium avium
NGYADGLQK

SEQ ID NO: 40154 - protein, 5 aa, Mycobacterium avium
NGYRR

SEQ ID NO: 40155 - protein, 7 aa, Mycobacterium avium
NGYTRDY

SEQ ID NO: 40156 - protein, 7 aa, Mycobacterium avium
NHDERNE

SEQ ID NO: 40157 - protein, 10 aa, Mycobacterium avium
NHDPLDASSV

SEQ ID NO: 40158 - protein, 8 aa, Mycobacterium avium
NHHSAGSF

SEQ ID NO: 40159 - protein, 14 aa, Mycobacterium avium
NHLAGPPDDPRIPD

SEQ ID NO: 40160 - protein, 4 aa, Mycobacterium avium
NHPE

SEQ ID NO: 40161 - protein, 8 aa, Mycobacterium avium
NHPNGEAE

SEQ ID NO: 40162 - protein, 4 aa, Mycobacterium avium
NHRG

SEQ ID NO: 40163 - protein, 4 aa, Mycobacterium avium
NHRP

SEQ ID NO: 40164 - protein, 6 aa, Mycobacterium avium
NHRPKQ

SEQ ID NO: 40165 - protein, 8 aa, Mycobacterium avium
NHSPDDIE

SEQ ID NO: 40166 - protein, 6 aa, Mycobacterium avium
NIDTVP

SEQ ID NO: 40167 - protein, 10 aa, Mycobacterium avium
NIEDQSSDRV

SEQ ID NO: 40168 - protein, 7 aa, Mycobacterium avium
NIEEGGS

SEQ ID NO: 40169 - protein, 9 aa, Mycobacterium avium
NIENNGEIA

SEQ ID NO: 40170 - protein, 8 aa, Mycobacterium avium
NIENQSSG

SEQ ID NO: 40171 - protein, 11 aa, Mycobacterium avium
NIGHTSAAAGV

SEQ ID NO: 40172 - protein, 4 aa, Mycobacterium avium
NIGR

SEQ ID NO: 40173 - protein, 5 aa, Mycobacterium avium
NIPDE

SEQ ID NO: 40174 - protein, 10 aa, Mycobacterium avium
NIPPSGIETP

SEQ ID NO: 40175 - protein, 5 aa, Mycobacterium avium
NISGQ

SEQ ID NO: 40176 - protein, 6 aa, Mycobacterium avium
NKASTN

SEQ ID NO: 40177 - protein, 11 aa, Mycobacterium avium
NKENPVETASA

SEQ ID NO: 40178 - protein, 6 aa, Mycobacterium avium
NKFPTS

SEQ ID NO: 40179 - protein, 10 aa, Mycobacterium avium
NKIEPQAPVD

SEQ ID NO: 40180 - protein, 5 aa, Mycobacterium avium
NKRSV

SEQ ID NO: 40181 - protein, 14 aa, Mycobacterium avium
NKSADASEDSAAAE

SEQ ID NO: 40182 - protein, 4 aa, Mycobacterium avium
NKSV

SEQ ID NO: 40183 - protein, 10 aa, Mycobacterium avium
NKTAGDAEKL

SEQ ID NO: 40184 - protein, 23 aa, Mycobacterium avium
NKTGYHKRQGHRQQLTVLKVTGI

SEQ ID NO: 40185 - protein, 7 aa, Mycobacterium avium
NKTPIDK

SEQ ID NO: 40186 - protein, 4 aa, Mycobacterium avium
NLDP

SEQ ID NO: 40187 - protein, 9 aa, Mycobacterium avium
NLDPDAAKA

SEQ ID NO: 40188 - protein, 7 aa, Mycobacterium avium
NLESGAR

SEQ ID NO: 40189 - protein, 5 aa, Mycobacterium avium
NLGDA

SEQ ID NO: 40190 - protein, 19 aa, Mycobacterium avium
NLGGAGSIDAKLGDGDTDV

SEQ ID NO: 40191 - protein, 8 aa, Mycobacterium avium
NLGTERHH

SEQ ID NO: 40192 - protein, 14 aa, Mycobacterium avium
NLKAKESEDVPAEQ

SEQ ID NO: 40193 - protein, 4 aa, Mycobacterium avium
NLKE

SEQ ID NO: 40194 - protein, 6 aa, Mycobacterium avium
NLPAEG

SEQ ID NO: 40195 - protein, 23 aa, Mycobacterium avium
NLPDGHPDALNDDTRPRKLRPGD

SEQ ID NO: 40196 - protein, 11 aa, Mycobacterium avium
NLPDRSGDGLR

SEQ ID NO: 40197 - protein, 7 aa, Mycobacterium avium
NLPDTPA

SEQ ID NO: 40198 - protein, 5 aa, Mycobacterium avium
NLPET

SEQ ID NO: 40199 - protein, 10 aa, Mycobacterium avium
NLPRQQKGLH

SEQ ID NO: 40200 - protein, 11 aa, Mycobacterium avium
NLPSRREDGDL

SEQ ID NO: 40201 - protein, 11 aa, Mycobacterium avium
NLQGASGRKLG

SEQ ID NO: 40202 - protein, 8 aa, Mycobacterium avium
NLQGNSLD

SEQ ID NO: 40203 - protein, 9 aa, Mycobacterium avium
NLQRDPDEL

SEQ ID NO: 40204 - protein, 6 aa, Mycobacterium avium
NLRKGA

SEQ ID NO: 40205 - protein, 11 aa, Mycobacterium avium
NLRPDSSPEKL

SEQ ID NO: 40206 - protein, 9 aa, Mycobacterium avium
NLRRSARAA

SEQ ID NO: 40207 - protein, 8 aa, Mycobacterium avium
NLTPGPRA

SEQ ID NO: 40208 - protein, 17 aa, Mycobacterium avium
NMADGDKLAESSRSPEI

SEQ ID NO: 40209 - protein, 13 aa, Mycobacterium avium
NMPSGTAQRPGDV

SEQ ID NO: 40210 - protein, 6 aa, Mycobacterium avium
NNDESR

SEQ ID NO: 40211 - protein, 5 aa, Mycobacterium avium
NNGIA

SEQ ID NO: 40212 - protein, 8 aa, Mycobacterium avium
NNGLTASE

SEQ ID NO: 40213 - protein, 5 aa, Mycobacterium avium
NNGPL

SEQ ID NO: 40214 - protein, 6 aa, Mycobacterium avium
NNGRPG

SEQ ID NO: 40215 - protein, 17 aa, Mycobacterium avium
NNKSPSRKTGELDNRGS

SEQ ID NO: 40216 - protein, 8 aa, Mycobacterium avium
NNKSVAEL

SEQ ID NO: 40217 - protein, 7 aa, Mycobacterium avium
NNNGSFP

SEQ ID NO: 40218 - protein, 9 aa, Mycobacterium avium
NNPAKRVGL

SEQ ID NO: 40219 - protein, 9 aa, Mycobacterium avium
NNPGAATPI

SEQ ID NO: 40220 - protein, 8 aa, Mycobacterium avium
NNPGAGQA

SEQ ID NO: 40221 - protein, 7 aa, Mycobacterium avium
NNPLSGL

SEQ ID NO: 40222 - protein, 25 aa, Mycobacterium avium
NNQNRYAEYQKRTSRPIPVVVLTPK

SEQ ID NO: 40223 - protein, 7 aa, Mycobacterium avium
NNRETGE

SEQ ID NO: 40224 - protein, 7 aa, Mycobacterium avium
NNSSRSF

SEQ ID NO: 40225 - protein, 13 aa, Mycobacterium avium
NNSTDDTAGVARR

SEQ ID NO: 40226 - protein, 8 aa, Mycobacterium avium
NNTGEIKS

SEQ ID NO: 40227 - protein, 7 aa, Mycobacterium avium
NNVDQGR

SEQ ID NO: 40228 - protein, 7 aa, Mycobacterium avium
NNVSGTD

SEQ ID NO: 40229 - protein, 4 aa, Mycobacterium avium
NPAA

SEQ ID NO: 40230 - protein, 11 aa, Mycobacterium avium
NPAAGTQPAGI

SEQ ID NO: 40231 - protein, 5 aa, Mycobacterium avium
NPAAH

SEQ ID NO: 40232 - protein, 5 aa, Mycobacterium avium
NPAAM

SEQ ID NO: 40233 - protein, 19 aa, Mycobacterium avium
NPAAMGDGIRAGQNVGAAT

SEQ ID NO: 40234 - protein, 9 aa, Mycobacterium avium
NPAATKRSA

SEQ ID NO: 40235 - protein, 5 aa, Mycobacterium avium
NPADA

SEQ ID NO: 40236 - protein, 8 aa, Mycobacterium avium
NPALGTVS

SEQ ID NO: 40237 - protein, 6 aa, Mycobacterium avium
NPAPFG

SEQ ID NO: 40238 - protein, 10 aa, Mycobacterium avium
NPASLSDPAA

SEQ ID NO: 40239 - protein, 19 aa, Mycobacterium avium
NPATEEPLGEVADASKEDM

SEQ ID NO: 40240 - protein, 9 aa, Mycobacterium avium
NPATSGVDM

SEQ ID NO: 40241 - protein, 8 aa, Mycobacterium avium
NPAVGSAH

SEQ ID NO: 40242 - protein, 5 aa, Mycobacterium avium
NPAVS

SEQ ID NO: 40243 - protein, 5 aa, Mycobacterium avium
NPDAV

SEQ ID NO: 40244 - protein, 13 aa, Mycobacterium avium
NPDDEVNGRPHGM

SEQ ID NO: 40245 - protein, 14 aa, Mycobacterium avium
NPDGEFSDVDRARR

SEQ ID NO: 40246 - protein, 15 aa, Mycobacterium avium
NPDGKFSDADRARQR

SEQ ID NO: 40247 - protein, 4 aa, Mycobacterium avium
NPDH

SEQ ID NO: 40248 - protein, 7 aa, Mycobacterium avium
NPDMADE

SEQ ID NO: 40249 - protein, 7 aa, Mycobacterium avium
NPDPEIH

SEQ ID NO: 40250 - protein, 4 aa, Mycobacterium avium
NPDQ

SEQ ID NO: 40251 - protein, 7 aa, Mycobacterium avium
NPDQLTP

SEQ ID NO: 40252 - protein, 6 aa, Mycobacterium avium
NPDRLA

SEQ ID NO: 40253 - protein, 5 aa, Mycobacterium avium
NPDRV

SEQ ID NO: 40254 - protein, 8 aa, Mycobacterium avium
NPDSVADQ

SEQ ID NO: 40255 - protein, 8 aa, Mycobacterium avium
NPEEGELR

SEQ ID NO: 40256 - protein, 8 aa, Mycobacterium avium
NPEPTGDS

SEQ ID NO: 40257 - protein, 9 aa, Mycobacterium avium
NPERRQVGA

SEQ ID NO: 40258 - protein, 6 aa, Mycobacterium avium
NPFPPL

SEQ ID NO: 40259 - protein, 4 aa, Mycobacterium avium
NPFV

SEQ ID NO: 40260 - protein, 6 aa, Mycobacterium avium
NPGDAV

SEQ ID NO: 40261 - protein, 9 aa, Mycobacterium avium
NPGDNYART

SEQ ID NO: 40262 - protein, 5 aa, Mycobacterium avium
NPGEI

SEQ ID NO: 40263 - protein, 9 aa, Mycobacterium avium
NPGGPGGSA

SEQ ID NO: 40264 - protein, 11 aa, Mycobacterium avium
NPGGWAPTART

SEQ ID NO: 40265 - protein, 10 aa, Mycobacterium avium
NPGKDDDGNM

SEQ ID NO: 40266 - protein, 4 aa, Mycobacterium avium
NPGL

SEQ ID NO: 40267 - protein, 4 aa, Mycobacterium avium
NPGN

SEQ ID NO: 40268 - protein, 17 aa, Mycobacterium avium
NPGNRFNTPLSTTGAFA

SEQ ID NO: 40269 - protein, 8 aa, Mycobacterium avium
NPGPSGMQ

SEQ ID NO: 40270 - protein, 6 aa, Mycobacterium avium
NPGRRG

SEQ ID NO: 40271 - protein, 8 aa, Mycobacterium avium
NPGSALDP

SEQ ID NO: 40272 - protein, 11 aa, Mycobacterium avium
NPGSPTDRRRQ

SEQ ID NO: 40273 - protein, 6 aa, Mycobacterium avium
NPGVEK

SEQ ID NO: 40274 - protein, 5 aa, Mycobacterium avium
NPGVR

SEQ ID NO: 40275 - protein, 5 aa, Mycobacterium avium
NPGYQ

SEQ ID NO: 40276 - protein, 7 aa, Mycobacterium avium
NPHADTE

SEQ ID NO: 40277 - protein, 9 aa, Mycobacterium avium
NPHASSDAL

SEQ ID NO: 40278 - protein, 6 aa, Mycobacterium avium
NPHDDG

SEQ ID NO: 40279 - protein, 8 aa, Mycobacterium avium
NPHQPGAA

SEQ ID NO: 40280 - protein, 5 aa, Mycobacterium avium
NPHTG

SEQ ID NO: 40281 - protein, 7 aa, Mycobacterium avium
NPHTKPP

SEQ ID NO: 40282 - protein, 4 aa, Mycobacterium avium
NPIE

SEQ ID NO: 40283 - protein, 6 aa, Mycobacterium avium
NPIPKL

SEQ ID NO: 40284 - protein, 10 aa, Mycobacterium avium
NPITGDDEPF

SEQ ID NO: 40285 - protein, 5 aa, Mycobacterium avium
NPKDG

SEQ ID NO: 40286 - protein, 14 aa, Mycobacterium avium
NPKSAAEAAAPAVD

SEQ ID NO: 40287 - protein, 4 aa, Mycobacterium avium
NPLA

SEQ ID NO: 40288 - protein, 8 aa, Mycobacterium avium
NPLETDEL

SEQ ID NO: 40289 - protein, 21 aa, Mycobacterium avium
NPLGADAPDHELHDHRIPTGE

SEQ ID NO: 40290 - protein, 6 aa, Mycobacterium avium
NPLGTA

SEQ ID NO: 40291 - protein, 8 aa, Mycobacterium avium
NPLPGRPA

SEQ ID NO: 40292 - protein, 17 aa, Mycobacterium avium
NPLSDDTLSTLSLPGVF

SEQ ID NO: 40293 - protein, 7 aa, Mycobacterium avium
NPNPALS

SEQ ID NO: 40294 - protein, 7 aa, Mycobacterium avium
NPPERLT

SEQ ID NO: 40295 - protein, 7 aa, Mycobacterium avium
NPQLPTV

SEQ ID NO: 40296 - protein, 14 aa, Mycobacterium avium
NPQNWTKTYPGSAH

SEQ ID NO: 40297 - protein, 7 aa, Mycobacterium avium
NPRASRT

SEQ ID NO: 40298 - protein, 8 aa, Mycobacterium avium
NPREDRDD

SEQ ID NO: 40299 - protein, 6 aa, Mycobacterium avium
NPRMSD

SEQ ID NO: 40300 - protein, 8 aa, Mycobacterium avium
NPSGTRKD

SEQ ID NO: 40301 - protein, 6 aa, Mycobacterium avium
NPSMTG

SEQ ID NO: 40302 - protein, 4 aa, Mycobacterium avium
NPSP

SEQ ID NO: 40303 - protein, 8 aa, Mycobacterium avium
NPSPAAAL

SEQ ID NO: 40304 - protein, 17 aa, Mycobacterium avium
NPSPPEVAVSVREARER

SEQ ID NO: 40305 - protein, 7 aa, Mycobacterium avium
NPSRSLQ

SEQ ID NO: 40306 - protein, 4 aa, Mycobacterium avium
NPTF

SEQ ID NO: 40307 - protein, 12 aa, Mycobacterium avium
NPTGIVPKGPDL

SEQ ID NO: 40308 - protein, 12 aa, Mycobacterium avium
NPTGQRPAETAL

SEQ ID NO: 40309 - protein, 6 aa, Mycobacterium avium
NPTGVT

SEQ ID NO: 40310 - protein, 7 aa, Mycobacterium avium
NPTNPTA

SEQ ID NO: 40311 - protein, 8 aa, Mycobacterium avium
NPTPVTGQ

SEQ ID NO: 40312 - protein, 6 aa, Mycobacterium avium
NPTTGG

SEQ ID NO: 40313 - protein, 7 aa, Mycobacterium avium
NPTTNSY

SEQ ID NO: 40314 - protein, 11 aa, Mycobacterium avium
NPTTSPFGNPI

SEQ ID NO: 40315 - protein, 6 aa, Mycobacterium avium
NPTYND

SEQ ID NO: 40316 - protein, 5 aa, Mycobacterium avium
NPVAG

SEQ ID NO: 40317 - protein, 12 aa, Mycobacterium avium
NPVRSARPADRA

SEQ ID NO: 40318 - protein, 6 aa, Mycobacterium avium
NPVTAH

SEQ ID NO: 40319 - protein, 6 aa, Mycobacterium avium
NPYRGN

SEQ ID NO: 40320 - protein, 11 aa, Mycobacterium avium
NPYSAAKAIGT

SEQ ID NO: 40321 - protein, 16 aa, Mycobacterium avium
NQAANKKSALAQALNK

SEQ ID NO: 40322 - protein, 7 aa, Mycobacterium avium
NQAGAYG

SEQ ID NO: 40323 - protein, 6 aa, Mycobacterium avium
NQDNAY

SEQ ID NO: 40324 - protein, 10 aa, Mycobacterium avium
NQGGGTPPEM

SEQ ID NO: 40325 - protein, 4 aa, Mycobacterium avium
NQGV

SEQ ID NO: 40326 - protein, 5 aa, Mycobacterium avium
NQHAR

SEQ ID NO: 40327 - protein, 6 aa, Mycobacterium avium
NQIESN

SEQ ID NO: 40328 - protein, 12 aa, Mycobacterium avium
NQKGGVGKTTTA

SEQ ID NO: 40329 - protein, 6 aa, Mycobacterium avium
NQLPSG

SEQ ID NO: 40330 - protein, 13 aa, Mycobacterium avium
NQPTSVDAADGLR

SEQ ID NO: 40331 - protein, 8 aa, Mycobacterium avium
NQQADGMS

SEQ ID NO: 40332 - protein, 14 aa, Mycobacterium avium
NQQAGRPPTPPDWP

SEQ ID NO: 40333 - protein, 14 aa, Mycobacterium avium
NQRAEQRRTGGRHH

SEQ ID NO: 40334 - protein, 6 aa, Mycobacterium avium
NQSGVA

SEQ ID NO: 40335 - protein, 6 aa, Mycobacterium avium
NQSLGT

SEQ ID NO: 40336 - protein, 16 aa, Mycobacterium avium
NQSPTAYSKAAAEAGF

SEQ ID NO: 40337 - protein, 5 aa, Mycobacterium avium
NQTGS

SEQ ID NO: 40338 - protein, 9 aa, Mycobacterium avium
NQTPESARE

SEQ ID NO: 40339 - protein, 5 aa, Mycobacterium avium
NQVGR

SEQ ID NO: 40340 - protein, 5 aa, Mycobacterium avium
NQVSR

SEQ ID NO: 40341 - protein, 6 aa, Mycobacterium avium
NQYPPG

SEQ ID NO: 40342 - protein, 7 aa, Mycobacterium avium
NRAAAEQ

SEQ ID NO: 40343 - protein, 6 aa, Mycobacterium avium
NRAGSA

SEQ ID NO: 40344 - protein, 15 aa, Mycobacterium avium
NRAGTTTPTPPRRKP

SEQ ID NO: 40345 - protein, 9 aa, Mycobacterium avium
NRANPIDGK

SEQ ID NO: 40346 - protein, 7 aa, Mycobacterium avium
NRAPAKV

SEQ ID NO: 40347 - protein, 17 aa, Mycobacterium avium
NRARDRLRRESARPGKE

SEQ ID NO: 40348 - protein, 12 aa, Mycobacterium avium
NRDAQRGRLKTA

SEQ ID NO: 40349 - protein, 9 aa, Mycobacterium avium
NRDGPSRAY

SEQ ID NO: 40350 - protein, 5 aa, Mycobacterium avium
NRDKR

SEQ ID NO: 40351 - protein, 11 aa, Mycobacterium avium
NRDPRRYTDPD

SEQ ID NO: 40352 - protein, 10 aa, Mycobacterium avium
NRDPTHFKDP

SEQ ID NO: 40353 - protein, 5 aa, Mycobacterium avium
NREDM

SEQ ID NO: 40354 - protein, 8 aa, Mycobacterium avium
NREPADTR

SEQ ID NO: 40355 - protein, 6 aa, Mycobacterium avium
NREPVD

SEQ ID NO: 40356 - protein, 5 aa, Mycobacterium avium
NRFDP

SEQ ID NO: 40357 - protein, 10 aa, Mycobacterium avium
NRGGENVSSV

SEQ ID NO: 40358 - protein, 7 aa, Mycobacterium avium
NRGKSAR

SEQ ID NO: 40359 - protein, 6 aa, Mycobacterium avium
NRGNRL

SEQ ID NO: 40360 - protein, 13 aa, Mycobacterium avium
NRGPEQRTDKKPM

SEQ ID NO: 40361 - protein, 5 aa, Mycobacterium avium
NRGPN

SEQ ID NO: 40362 - protein, 8 aa, Mycobacterium avium
NRGRPVRG

SEQ ID NO: 40363 - protein, 13 aa, Mycobacterium avium
NRGTGKADDARKL

SEQ ID NO: 40364 - protein, 14 aa, Mycobacterium avium
NRGVAGIDGTVSTA

SEQ ID NO: 40365 - protein, 7 aa, Mycobacterium avium
NRIPPGS

SEQ ID NO: 40366 - protein, 7 aa, Mycobacterium avium
NRISPDA

SEQ ID NO: 40367 - protein, 19 aa, Mycobacterium avium
NRKESRGGHAREDYPNRDD

SEQ ID NO: 40368 - protein, 10 aa, Mycobacterium avium
NRKPLNGTYP

SEQ ID NO: 40369 - protein, 6 aa, Mycobacterium avium
NRLGTN

SEQ ID NO: 40370 - protein, 6 aa, Mycobacterium avium
NRLPEA

SEQ ID NO: 40371 - protein, 7 aa, Mycobacterium avium
NRNAAGQ

SEQ ID NO: 40372 - protein, 10 aa, Mycobacterium avium
NRNKDYSQKG

SEQ ID NO: 40373 - protein, 8 aa, Mycobacterium avium
NRNRAASE

SEQ ID NO: 40374 - protein, 6 aa, Mycobacterium avium
NRNRQP

SEQ ID NO: 40375 - protein, 15 aa, Mycobacterium avium
NRPALSRPATGPSLP

SEQ ID NO: 40376 - protein, 9 aa, Mycobacterium avium
NRPEARNAI

SEQ ID NO: 40377 - protein, 8 aa, Mycobacterium avium
NRPEKGNA

SEQ ID NO: 40378 - protein, 6 aa, Mycobacterium avium
NRPGGT

SEQ ID NO: 40379 - protein, 12 aa, Mycobacterium avium
NRPGSVADGSTV

SEQ ID NO: 40380 - protein, 13 aa, Mycobacterium avium
NRPKVGPRRAEAQ

SEQ ID NO: 40381 - protein, 10 aa, Mycobacterium avium
NRQDGAASYE

SEQ ID NO: 40382 - protein, 8 aa, Mycobacterium avium
NRQPEAEA

SEQ ID NO: 40383 - protein, 4 aa, Mycobacterium avium
NRQQ

SEQ ID NO: 40384 - protein, 8 aa, Mycobacterium avium
NRRGRPAR

SEQ ID NO: 40385 - protein, 8 aa, Mycobacterium avium
NRRPPEPN

SEQ ID NO: 40386 - protein, 11 aa, Mycobacterium avium
NRRRAKARADE

SEQ ID NO: 40387 - protein, 12 aa, Mycobacterium avium
NRRRERGLPSPT

SEQ ID NO: 40388 - protein, 6 aa, Mycobacterium avium
NRSKRS

SEQ ID NO: 40389 - protein, 13 aa, Mycobacterium avium
NRSLGEAPKIPSR

SEQ ID NO: 40390 - protein, 4 aa, Mycobacterium avium
NRSN

SEQ ID NO: 40391 - protein, 9 aa, Mycobacterium avium
NRSSGKQGY

SEQ ID NO: 40392 - protein, 11 aa, Mycobacterium avium
NRTARDRPTAP

SEQ ID NO: 40393 - protein, 5 aa, Mycobacterium avium
NRTGT

SEQ ID NO: 40394 - protein, 16 aa, Mycobacterium avium
NRYAPPPPYPSPDPFE

SEQ ID NO: 40395 - protein, 7 aa, Mycobacterium avium
NRYNEIS

SEQ ID NO: 40396 - protein, 10 aa, Mycobacterium avium
NSAATNEADP

SEQ ID NO: 40397 - protein, 7 aa, Mycobacterium avium
NSAEEDV

SEQ ID NO: 40398 - protein, 15 aa, Mycobacterium avium
NSALPGPAFSGQPAV

SEQ ID NO: 40399 - protein, 7 aa, Mycobacterium avium
NSARDAV

SEQ ID NO: 40400 - protein, 8 aa, Mycobacterium avium
NSDDQAVT

SEQ ID NO: 40401 - protein, 5 aa, Mycobacterium avium
NSDGR

SEQ ID NO: 40402 - protein, 7 aa, Mycobacterium avium
NSDPYGA

SEQ ID NO: 40403 - protein, 7 aa, Mycobacterium avium
NSDTTAQ

SEQ ID NO: 40404 - protein, 10 aa, Mycobacterium avium
NSEGSRTTPS

SEQ ID NO: 40405 - protein, 8 aa, Mycobacterium avium
NSEPRTGL

SEQ ID NO: 40406 - protein, 9 aa, Mycobacterium avium
NSESAEKAA

SEQ ID NO: 40407 - protein, 13 aa, Mycobacterium avium
NSFQRDKAKGLEQ

SEQ ID NO: 40408 - protein, 8 aa, Mycobacterium avium
NSGAQRAT

SEQ ID NO: 40409 - protein, 7 aa, Mycobacterium avium
NSGHPIA

SEQ ID NO: 40410 - protein, 7 aa, Mycobacterium avium
NSGMRAN

SEQ ID NO: 40411 - protein, 7 aa, Mycobacterium avium
NSGPGSF

SEQ ID NO: 40412 - protein, 9 aa, Mycobacterium avium
NSGPLPEEI

SEQ ID NO: 40413 - protein, 8 aa, Mycobacterium avium
NSGSPAEL

SEQ ID NO: 40414 - protein, 5 aa, Mycobacterium avium
NSHGR

SEQ ID NO: 40415 - protein, 9 aa, Mycobacterium avium
NSLDPATVR

SEQ ID NO: 40416 - protein, 6 aa, Mycobacterium avium
NSLPPG

SEQ ID NO: 40417 - protein, 16 aa, Mycobacterium avium
NSNPARFDQKKADALN

SEQ ID NO: 40418 - protein, 10 aa, Mycobacterium avium
NSPDEVGPPE

SEQ ID NO: 40419 - protein, 10 aa, Mycobacterium avium
NSPGGSVTAS

SEQ ID NO: 40420 - protein, 12 aa, Mycobacterium avium
NSPGTIDAGYRG

SEQ ID NO: 40421 - protein, 22 aa, Mycobacterium avium
NSPHPDAATNDPDANARRRAAA

SEQ ID NO: 40422 - protein, 6 aa, Mycobacterium avium
NSPINA

SEQ ID NO: 40423 - protein, 6 aa, Mycobacterium avium
NSPLRA

SEQ ID NO: 40424 - protein, 7 aa, Mycobacterium avium
NSPRARA

SEQ ID NO: 40425 - protein, 7 aa, Mycobacterium avium
NSPRPDL

SEQ ID NO: 40426 - protein, 6 aa, Mycobacterium avium
NSPRVP

SEQ ID NO: 40427 - protein, 9 aa, Mycobacterium avium
NSQSGKGGV

SEQ ID NO: 40428 - protein, 4 aa, Mycobacterium avium
NSRE

SEQ ID NO: 40429 - protein, 12 aa, Mycobacterium avium
NSRPERRDPPTR

SEQ ID NO: 40430 - protein, 13 aa, Mycobacterium avium
NSRPTRAEASDVA

SEQ ID NO: 40431 - protein, 7 aa, Mycobacterium avium
NSRRGQI

SEQ ID NO: 40432 - protein, 7 aa, Mycobacterium avium
NSRVRAE

SEQ ID NO: 40433 - protein, 6 aa, Mycobacterium avium
NSRYGL

SEQ ID NO: 40434 - protein, 12 aa, Mycobacterium avium
NSSASKSKVIAD

SEQ ID NO: 40435 - protein, 9 aa, Mycobacterium avium
NSSDRGRLA

SEQ ID NO: 40436 - protein, 9 aa, Mycobacterium avium
NSTAGGAYV

SEQ ID NO: 40437 - protein, 5 aa, Mycobacterium avium
NSTDR

SEQ ID NO: 40438 - protein, 6 aa, Mycobacterium avium
NSTRGA

SEQ ID NO: 40439 - protein, 6 aa, Mycobacterium avium
NSTRTR

SEQ ID NO: 40440 - protein, 8 aa, Mycobacterium avium
NSTTLSNK

SEQ ID NO: 40441 - protein, 5 aa, Mycobacterium avium
NSTWG

SEQ ID NO: 40442 - protein, 6 aa, Mycobacterium avium
NSVGPG

SEQ ID NO: 40443 - protein, 9 aa, Mycobacterium avium
NSVSSYAST

SEQ ID NO: 40444 - protein, 8 aa, Mycobacterium avium
NSVTPPGQ

SEQ ID NO: 40445 - protein, 4 aa, Mycobacterium avium
NSYM

SEQ ID NO: 40446 - protein, 4 aa, Mycobacterium avium
NSYV

SEQ ID NO: 40447 - protein, 11 aa, Mycobacterium avium
NTAAIGEAEGA

SEQ ID NO: 40448 - protein, 18 aa, Mycobacterium avium
NTAANAFGTTYPGAGATI

SEQ ID NO: 40449 - protein, 10 aa, Mycobacterium avium
NTAAQKVRSG

SEQ ID NO: 40450 - protein, 13 aa, Mycobacterium avium
NTAEQNAANDGKG

SEQ ID NO: 40451 - protein, 7 aa, Mycobacterium avium
NTAGGDH

SEQ ID NO: 40452 - protein, 7 aa, Mycobacterium avium
NTASEVS

SEQ ID NO: 40453 - protein, 5 aa, Mycobacterium avium
NTAST

SEQ ID NO: 40454 - protein, 4 aa, Mycobacterium avium
NTCE

SEQ ID NO: 40455 - protein, 10 aa, Mycobacterium avium
NTDSAGNSYG

SEQ ID NO: 40456 - protein, 7 aa, Mycobacterium avium
NTDTGDV

SEQ ID NO: 40457 - protein, 4 aa, Mycobacterium avium
NTFD

SEQ ID NO: 40458 - protein, 6 aa, Mycobacterium avium
NTGEEF

SEQ ID NO: 40459 - protein, 6 aa, Mycobacterium avium
NTGFTG

SEQ ID NO: 40460 - protein, 6 aa, Mycobacterium avium
NTGIGY

SEQ ID NO: 40461 - protein, 6 aa, Mycobacterium avium
NTGLGH

SEQ ID NO: 40462 - protein, 15 aa, Mycobacterium avium
NTGNNTYKAVQRSAG

SEQ ID NO: 40463 - protein, 8 aa, Mycobacterium avium
NTGQTLAD

SEQ ID NO: 40464 - protein, 14 aa, Mycobacterium avium
NTGRGTAKARAIAR

SEQ ID NO: 40465 - protein, 12 aa, Mycobacterium avium
NTHEGGTHEEGF

SEQ ID NO: 40466 - protein, 6 aa, Mycobacterium avium
NTIRAH

SEQ ID NO: 40467 - protein, 5 aa, Mycobacterium avium
NTKPV

SEQ ID NO: 40468 - protein, 6 aa, Mycobacterium avium
NTLGQD

SEQ ID NO: 40469 - protein, 21 aa, Mycobacterium avium
NTLQRGQAALTGPVARGDAAA

SEQ ID NO: 40470 - protein, 6 aa, Mycobacterium avium
NTLSQD

SEQ ID NO: 40471 - protein, 5 aa, Mycobacterium avium
NTLTA

SEQ ID NO: 40472 - protein, 19 aa, Mycobacterium avium
NTMAAPSGTTYPGGGNPIG

SEQ ID NO: 40473 - protein, 6 aa, Mycobacterium avium
NTNVGS

SEQ ID NO: 40474 - protein, 6 aa, Mycobacterium avium
NTPADG

SEQ ID NO: 40475 - protein, 4 aa, Mycobacterium avium
NTPD

SEQ ID NO: 40476 - protein, 4 aa, Mycobacterium avium
NTPE

SEQ ID NO: 40477 - protein, 9 aa, Mycobacterium avium
NTPGRNADA

SEQ ID NO: 40478 - protein, 6 aa, Mycobacterium avium
NTPPET

SEQ ID NO: 40479 - protein, 4 aa, Mycobacterium avium
NTPW

SEQ ID NO: 40480 - protein, 6 aa, Mycobacterium avium
NTPYTA

SEQ ID NO: 40481 - protein, 7 aa, Mycobacterium avium
NTQGAGP

SEQ ID NO: 40482 - protein, 4 aa, Mycobacterium avium
NTRD

SEQ ID NO: 40483 - protein, 5 aa, Mycobacterium avium
NTRDR

SEQ ID NO: 40484 - protein, 8 aa, Mycobacterium avium
NTRSAQPE

SEQ ID NO: 40485 - protein, 15 aa, Mycobacterium avium
NTRSRRAQWKAEKTE

SEQ ID NO: 40486 - protein, 7 aa, Mycobacterium avium
NTRSYGG

SEQ ID NO: 40487 - protein, 10 aa, Mycobacterium avium
NTSAADTQPY

SEQ ID NO: 40488 - protein, 7 aa, Mycobacterium avium
NTSAPVM

SEQ ID NO: 40489 - protein, 9 aa, Mycobacterium avium
NTSAVDSRR

SEQ ID NO: 40490 - protein, 6 aa, Mycobacterium avium
NTSEDR

SEQ ID NO: 40491 - protein, 7 aa, Mycobacterium avium
NTSEEEF

SEQ ID NO: 40492 - protein, 17 aa, Mycobacterium avium
NTSGAGSGIGGPGGAGY

SEQ ID NO: 40493 - protein, 7 aa, Mycobacterium avium
NTSGALQ

SEQ ID NO: 40494 - protein, 10 aa, Mycobacterium avium
NTSGDDRARV

SEQ ID NO: 40495 - protein, 24 aa, Mycobacterium avium
NTSSGAGLQGSVGQGNYSAAKAGI

SEQ ID NO: 40496 - protein, 22 aa, Mycobacterium avium
NTTIPTKRSETFTTADDNQPSV

SEQ ID NO: 40497 - protein, 6 aa, Mycobacterium avium
NTTRPH

SEQ ID NO: 40498 - protein, 9 aa, Mycobacterium avium
NTVNTMPEK

SEQ ID NO: 40499 - protein, 5 aa, Mycobacterium avium
NVAAA

SEQ ID NO: 40500 - protein, 8 aa, Mycobacterium avium
NVAEGGRP

SEQ ID NO: 40501 - protein, 5 aa, Mycobacterium avium
NVAGT

SEQ ID NO: 40502 - protein, 7 aa, Mycobacterium avium
NVATTQV

SEQ ID NO: 40503 - protein, 12 aa, Mycobacterium avium
NVDGKGASYGAH

SEQ ID NO: 40504 - protein, 4 aa, Mycobacterium avium
NVGA

SEQ ID NO: 40505 - protein, 8 aa, Mycobacterium avium
NVGKPQVA

SEQ ID NO: 40506 - protein, 4 aa, Mycobacterium avium
NVNG

SEQ ID NO: 40507 - protein, 7 aa, Mycobacterium avium
NVPDDEI

SEQ ID NO: 40508 - protein, 12 aa, Mycobacterium avium
NVPGPRERGRVG

SEQ ID NO: 40509 - protein, 6 aa, Mycobacterium avium
NVQGKP

SEQ ID NO: 40510 - protein, 5 aa, Mycobacterium avium
NVRRA

SEQ ID NO: 40511 - protein, 5 aa, Mycobacterium avium
NVRTR

SEQ ID NO: 40512 - protein, 9 aa, Mycobacterium avium
NVRVTGRTK

SEQ ID NO: 40513 - protein, 4 aa, Mycobacterium avium
NVSA

SEQ ID NO: 40514 - protein, 6 aa, Mycobacterium avium
NVYGPE

SEQ ID NO: 40515 - protein, 4 aa, Mycobacterium avium
NWDT

SEQ ID NO: 40516 - protein, 13 aa, Mycobacterium avium
NWQSDPKQLGRLG

SEQ ID NO: 40517 - protein, 5 aa, Mycobacterium avium
NWRDD

SEQ ID NO: 40518 - protein, 6 aa, Mycobacterium avium
NWTTGQ

SEQ ID NO: 40519 - protein, 4 aa, Mycobacterium avium
NYAA

SEQ ID NO: 40520 - protein, 7 aa, Mycobacterium avium
NYDTAQV

SEQ ID NO: 40521 - protein, 11 aa, Mycobacterium avium
NYGETTEAFGT

SEQ ID NO: 40522 - protein, 4 aa, Mycobacterium avium
NYGK

SEQ ID NO: 40523 - protein, 19 aa, Mycobacterium avium
NYNGSTPAAVVTPTSAADV

SEQ ID NO: 40524 - protein, 5 aa, Mycobacterium avium
NYPDG

SEQ ID NO: 40525 - protein, 13 aa, Mycobacterium avium
NYPEAWGDEEQRV

SEQ ID NO: 40526 - protein, 4 aa, Mycobacterium avium
NYPG

SEQ ID NO: 40527 - protein, 8 aa, Mycobacterium avium
NYPGRPRV

SEQ ID NO: 40528 - protein, 6 aa, Mycobacterium avium
NYQPGT

SEQ ID NO: 40529 - protein, 9 aa, Mycobacterium avium
NYQRPPREL

SEQ ID NO: 40530 - protein, 12 aa, Mycobacterium avium
NYTDGLDANGQL

SEQ ID NO: 40531 - protein, 10 aa, Mycobacterium avium
NYTTPGGRHG

SEQ ID NO: 40532 - protein, 7 aa, Mycobacterium avium
PAAAPAA

SEQ ID NO: 40533 - protein, 14 aa, Mycobacterium avium
PAAARAAAGADEGN

SEQ ID NO: 40534 - protein, 5 aa, Mycobacterium avium
PAAAT

SEQ ID NO: 40535 - protein, 7 aa, Mycobacterium avium
PAADPVS

SEQ ID NO: 40536 - protein, 6 aa, Mycobacterium avium
PAADYT

SEQ ID NO: 40537 - protein, 8 aa, Mycobacterium avium
PAAEHGKG

SEQ ID NO: 40538 - protein, 5 aa, Mycobacterium avium
PAAEP

SEQ ID NO: 40539 - protein, 7 aa, Mycobacterium avium
PAAFATA

SEQ ID NO: 40540 - protein, 7 aa, Mycobacterium avium
PAAGGEE

SEQ ID NO: 40541 - protein, 5 aa, Mycobacterium avium
PAAGL

SEQ ID NO: 40542 - protein, 8 aa, Mycobacterium avium
PAAGPGGL

SEQ ID NO: 40543 - protein, 7 aa, Mycobacterium avium
PAAGTPA

SEQ ID NO: 40544 - protein, 7 aa, Mycobacterium avium
PAAGYDD

SEQ ID NO: 40545 - protein, 4 aa, Mycobacterium avium
PAAI

SEQ ID NO: 40546 - protein, 10 aa, Mycobacterium avium
PAAISSGTYS

SEQ ID NO: 40547 - protein, 11 aa, Mycobacterium avium
PAAKPAATGLE

SEQ ID NO: 40548 - protein, 5 aa, Mycobacterium avium
PAALG

SEQ ID NO: 40549 - protein, 12 aa, Mycobacterium avium
PAALSDADRDRD

SEQ ID NO: 40550 - protein, 8 aa, Mycobacterium avium
PAAMAGEE

SEQ ID NO: 40551 - protein, 13 aa, Mycobacterium avium
PAAPAGPLASGQR

SEQ ID NO: 40552 - protein, 7 aa, Mycobacterium avium
PAAPSEL

SEQ ID NO: 40553 - protein, 7 aa, Mycobacterium avium
PAAQASI

SEQ ID NO: 40554 - protein, 4 aa, Mycobacterium avium
PAAR

SEQ ID NO: 40555 - protein, 13 aa, Mycobacterium avium
PAARNAVNGPTAA

SEQ ID NO: 40556 - protein, 14 aa, Mycobacterium avium
PAARSPQSQDSATT

SEQ ID NO: 40557 - protein, 4 aa, Mycobacterium avium
PAAT

SEQ ID NO: 40558 - protein, 5 aa, Mycobacterium avium
PAATP

SEQ ID NO: 40559 - protein, 12 aa, Mycobacterium avium
PAATRALGTGRR

SEQ ID NO: 40560 - protein, 17 aa, Mycobacterium avium
PAATRGHDGTAAGAGPL

SEQ ID NO: 40561 - protein, 8 aa, Mycobacterium avium
PAATTDRR

SEQ ID NO: 40562 - protein, 18 aa, Mycobacterium avium
PAAVPGDANAIGDHRPLT

SEQ ID NO: 40563 - protein, 8 aa, Mycobacterium avium
PADANETA

SEQ ID NO: 40564 - protein, 8 aa, Mycobacterium avium
PADARDYG

SEQ ID NO: 40565 - protein, 13 aa, Mycobacterium avium
PADASSAGTGGSK

SEQ ID NO: 40566 - protein, 17 aa, Mycobacterium avium
PADDATAAGDVAVGSGA

SEQ ID NO: 40567 - protein, 10 aa, Mycobacterium avium
PADDPAGFGP

SEQ ID NO: 40568 - protein, 5 aa, Mycobacterium avium
PADEH

SEQ ID NO: 40569 - protein, 9 aa, Mycobacterium avium
PADEHRRAS

SEQ ID NO: 40570 - protein, 6 aa, Mycobacterium avium
PADGEV

SEQ ID NO: 40571 - protein, 8 aa, Mycobacterium avium
PADGPIGD

SEQ ID NO: 40572 - protein, 7 aa, Mycobacterium avium
PADISTA

SEQ ID NO: 40573 - protein, 9 aa, Mycobacterium avium
PADKTRRTI

SEQ ID NO: 40574 - protein, 16 aa, Mycobacterium avium
PADPAGPAPGPTARPD

SEQ ID NO: 40575 - protein, 8 aa, Mycobacterium avium
PADPDRPL

SEQ ID NO: 40576 - protein, 8 aa, Mycobacterium avium
PADPGDAR

SEQ ID NO: 40577 - protein, 10 aa, Mycobacterium avium
PADPPDTPRF

SEQ ID NO: 40578 - protein, 13 aa, Mycobacterium avium
PADPRTLDQRRAD

SEQ ID NO: 40579 - protein, 7 aa, Mycobacterium avium
PADRAAG

SEQ ID NO: 40580 - protein, 25 aa, Mycobacterium avium
PADRPLTPIRKPNRRPFTEVVHRGR

SEQ ID NO: 40581 - protein, 13 aa, Mycobacterium avium
PADTEVAQGANDM

SEQ ID NO: 40582 - protein, 7 aa, Mycobacterium avium
PADTRTD

SEQ ID NO: 40583 - protein, 5 aa, Mycobacterium avium
PADVE

SEQ ID NO: 40584 - protein, 4 aa, Mycobacterium avium
PAEA

SEQ ID NO: 40585 - protein, 5 aa, Mycobacterium avium
PAEAE

SEQ ID NO: 40586 - protein, 10 aa, Mycobacterium avium
PAEDGGSRLR

SEQ ID NO: 40587 - protein, 7 aa, Mycobacterium avium
PAEETPL

SEQ ID NO: 40588 - protein, 7 aa, Mycobacterium avium
PAEGAGD

SEQ ID NO: 40589 - protein, 7 aa, Mycobacterium avium
PAEGTSA

SEQ ID NO: 40590 - protein, 33 aa, Mycobacterium avium
PAEHPYGSTRVGSKYQGQRGPTPSRSYQNFITS

SEQ ID NO: 40591 - protein, 9 aa, Mycobacterium avium
PAEIGKNRH

SEQ ID NO: 40592 - protein, 7 aa, Mycobacterium avium
PAELSTN

SEQ ID NO: 40593 - protein, 10 aa, Mycobacterium avium
PAEPEPVADI

SEQ ID NO: 40594 - protein, 7 aa, Mycobacterium avium
PAEPVAS

SEQ ID NO: 40595 - protein, 5 aa, Mycobacterium avium
PAEQN

SEQ ID NO: 40596 - protein, 7 aa, Mycobacterium avium
PAEQRQA

SEQ ID NO: 40597 - protein, 7 aa, Mycobacterium avium
PAEQTPV

SEQ ID NO: 40598 - protein, 12 aa, Mycobacterium avium
PAERRPTGPPRF

SEQ ID NO: 40599 - protein, 10 aa, Mycobacterium avium
PAESKAAIGQ

SEQ ID NO: 40600 - protein, 8 aa, Mycobacterium avium
PAETGAWG

SEQ ID NO: 40601 - protein, 13 aa, Mycobacterium avium
PAEVTLEPGEAAD

SEQ ID NO: 40602 - protein, 4 aa, Mycobacterium avium
PAFK

SEQ ID NO: 40603 - protein, 7 aa, Mycobacterium avium
PAFPRAK

SEQ ID NO: 40604 - protein, 6 aa, Mycobacterium avium
PAFTGD

SEQ ID NO: 40605 - protein, 4 aa, Mycobacterium avium
PAGA

SEQ ID NO: 40606 - protein, 5 aa, Mycobacterium avium
PAGAY

SEQ ID NO: 40607 - protein, 4 aa, Mycobacterium avium
PAGG

SEQ ID NO: 40608 - protein, 7 aa, Mycobacterium avium
PAGGFGT

SEQ ID NO: 40609 - protein, 6 aa, Mycobacterium avium
PAGGNR

SEQ ID NO: 40610 - protein, 11 aa, Mycobacterium avium
PAGHGDPQTAA

SEQ ID NO: 40611 - protein, 8 aa, Mycobacterium avium
PAGHGIND

SEQ ID NO: 40612 - protein, 8 aa, Mycobacterium avium
PAGHPDAG

SEQ ID NO: 40613 - protein, 6 aa, Mycobacterium avium
PAGHQT

SEQ ID NO: 40614 - protein, 7 aa, Mycobacterium avium
PAGMPAT

SEQ ID NO: 40615 - protein, 5 aa, Mycobacterium avium
PAGMT

SEQ ID NO: 40616 - protein, 6 aa, Mycobacterium avium
PAGMTS

SEQ ID NO: 40617 - protein, 8 aa, Mycobacterium avium
PAGPEGGE

SEQ ID NO: 40618 - protein, 10 aa, Mycobacterium avium
PAGPSGSPLR

SEQ ID NO: 40619 - protein, 20 aa, Mycobacterium avium
PAGPTRRTTAPRKRGDDTRA

SEQ ID NO: 40620 - protein, 6 aa, Mycobacterium avium
PAGPVA

SEQ ID NO: 40621 - protein, 15 aa, Mycobacterium avium
PAGQSWAATAGSGDV

SEQ ID NO: 40622 - protein, 7 aa, Mycobacterium avium
PAGRTAG

SEQ ID NO: 40623 - protein, 10 aa, Mycobacterium avium
PAGSAPDPAL

SEQ ID NO: 40624 - protein, 12 aa, Mycobacterium avium
PAGSGNSAAAAI

SEQ ID NO: 40625 - protein, 6 aa, Mycobacterium avium
PAGSGP

SEQ ID NO: 40626 - protein, 11 aa, Mycobacterium avium
PAGSTLDATEA

SEQ ID NO: 40627 - protein, 10 aa, Mycobacterium avium
PAGTGNDHAR

SEQ ID NO: 40628 - protein, 9 aa, Mycobacterium avium
PAGTPESRI

SEQ ID NO: 40629 - protein, 4 aa, Mycobacterium avium
PAGV

SEQ ID NO: 40630 - protein, 4 aa, Mycobacterium avium
PAGW

SEQ ID NO: 40631 - protein, 6 aa, Mycobacterium avium
PAHPSR

SEQ ID NO: 40632 - protein, 28 aa, Mycobacterium avium
PAHPTPTTGGPLLSPNGGYRDDTRLASR

SEQ ID NO: 40633 - protein, 6 aa, Mycobacterium avium
PAHTAA

SEQ ID NO: 40634 - protein, 8 aa, Mycobacterium avium
PAHTPVDG

SEQ ID NO: 40635 - protein, 4 aa, Mycobacterium avium
PAIR

SEQ ID NO: 40636 - protein, 5 aa, Mycobacterium avium
PAKAR

SEQ ID NO: 40637 - protein, 8 aa, Mycobacterium avium
PAKDAPPL

SEQ ID NO: 40638 - protein, 8 aa, Mycobacterium avium
PAKFPGQG

SEQ ID NO: 40639 - protein, 7 aa, Mycobacterium avium
PAKGPWQ

SEQ ID NO: 40640 - protein, 7 aa, Mycobacterium avium
PAKLSAA

SEQ ID NO: 40641 - protein, 8 aa, Mycobacterium avium
PAKPTDRA

SEQ ID NO: 40642 - protein, 4 aa, Mycobacterium avium
PALA

SEQ ID NO: 40643 - protein, 5 aa, Mycobacterium avium
PALAA

SEQ ID NO: 40644 - protein, 7 aa, Mycobacterium avium
PALDPQG

SEQ ID NO: 40645 - protein, 4 aa, Mycobacterium avium
PALG

SEQ ID NO: 40646 - protein, 8 aa, Mycobacterium avium
PALGPSGQ

SEQ ID NO: 40647 - protein, 5 aa, Mycobacterium avium
PALKD

SEQ ID NO: 40648 - protein, 14 aa, Mycobacterium avium
PALPHSDSSYSPLA

SEQ ID NO: 40649 - protein, 9 aa, Mycobacterium avium
PALPPGAAG

SEQ ID NO: 40650 - protein, 7 aa, Mycobacterium avium
PALQSQE

SEQ ID NO: 40651 - protein, 5 aa, Mycobacterium avium
PALRE

SEQ ID NO: 40652 - protein, 8 aa, Mycobacterium avium
PALSAKKI

SEQ ID NO: 40653 - protein, 11 aa, Mycobacterium avium
PALTGGGSRLP

SEQ ID NO: 40654 - protein, 6 aa, Mycobacterium avium
PALTGR

SEQ ID NO: 40655 - protein, 6 aa, Mycobacterium avium
PALTPQ

SEQ ID NO: 40656 - protein, 4 aa, Mycobacterium avium
PANA

SEQ ID NO: 40657 - protein, 8 aa, Mycobacterium avium
PANAPDAV

SEQ ID NO: 40658 - protein, 22 aa, Mycobacterium avium
PANDDYHNSANAGADDASAHVQ

SEQ ID NO: 40659 - protein, 8 aa, Mycobacterium avium
PANRADPY

SEQ ID NO: 40660 - protein, 5 aa, Mycobacterium avium
PANSE

SEQ ID NO: 40661 - protein, 4 aa, Mycobacterium avium
PANT

SEQ ID NO: 40662 - protein, 18 aa, Mycobacterium avium
PANVSRRAKTDVLIVHTT

SEQ ID NO: 40663 - protein, 4 aa, Mycobacterium avium
PAPA

SEQ ID NO: 40664 - protein, 12 aa, Mycobacterium avium
PAPADPEERDRL

SEQ ID NO: 40665 - protein, 6 aa, Mycobacterium avium
PAPAPY

SEQ ID NO: 40666 - protein, 9 aa, Mycobacterium avium
PAPDGDGAG

SEQ ID NO: 40667 - protein, 7 aa, Mycobacterium avium
PAPDTAR

SEQ ID NO: 40668 - protein, 6 aa, Mycobacterium avium
PAPDTP

SEQ ID NO: 40669 - protein, 5 aa, Mycobacterium avium
PAPED

SEQ ID NO: 40670 - protein, 7 aa, Mycobacterium avium
PAPESPL

SEQ ID NO: 40671 - protein, 7 aa, Mycobacterium avium
PAPETPL

SEQ ID NO: 40672 - protein, 13 aa, Mycobacterium avium
PAPFAGDVGSGAH

SEQ ID NO: 40673 - protein, 9 aa, Mycobacterium avium
PAPGDARTI

SEQ ID NO: 40674 - protein, 10 aa, Mycobacterium avium
PAPGDGRTFS

SEQ ID NO: 40675 - protein, 8 aa, Mycobacterium avium
PAPGLGED

SEQ ID NO: 40676 - protein, 7 aa, Mycobacterium avium
PAPGPVT

SEQ ID NO: 40677 - protein, 9 aa, Mycobacterium avium
PAPGSSTAH

SEQ ID NO: 40678 - protein, 5 aa, Mycobacterium avium
PAPLA

SEQ ID NO: 40679 - protein, 12 aa, Mycobacterium avium
PAPLGRKREGRD

SEQ ID NO: 40680 - protein, 12 aa, Mycobacterium avium
PAPLPPSGSARA

SEQ ID NO: 40681 - protein, 6 aa, Mycobacterium avium
PAPLRA

SEQ ID NO: 40682 - protein, 21 aa, Mycobacterium avium
PAPNAMNTGKAHGAALGEEEV

SEQ ID NO: 40683 - protein, 7 aa, Mycobacterium avium
PAPNLDP

SEQ ID NO: 40684 - protein, 8 aa, Mycobacterium avium
PAPNTPFN

SEQ ID NO: 40685 - protein, 4 aa, Mycobacterium avium
PAPP

SEQ ID NO: 40686 - protein, 6 aa, Mycobacterium avium
PAPPGV

SEQ ID NO: 40687 - protein, 7 aa, Mycobacterium avium
PAPPPRE

SEQ ID NO: 40688 - protein, 13 aa, Mycobacterium avium
PAPPQLARTAGTA

SEQ ID NO: 40689 - protein, 13 aa, Mycobacterium avium
PAPQSDSQSVETA

SEQ ID NO: 40690 - protein, 24 aa, Mycobacterium avium
PAPRSRPADASEIPSATAESTAMA

SEQ ID NO: 40691 - protein, 11 aa, Mycobacterium avium
PAPSGDPEAPL

SEQ ID NO: 40692 - protein, 6 aa, Mycobacterium avium
PAPSGT

SEQ ID NO: 40693 - protein, 15 aa, Mycobacterium avium
PAPTIKDADGGRQAR

SEQ ID NO: 40694 - protein, 12 aa, Mycobacterium avium
PAPYGRGASPAE

SEQ ID NO: 40695 - protein, 4 aa, Mycobacterium avium
PAQG

SEQ ID NO: 40696 - protein, 10 aa, Mycobacterium avium
PAQIGSGGDA

SEQ ID NO: 40697 - protein, 12 aa, Mycobacterium avium
PAQIKGPVAGTD

SEQ ID NO: 40698 - protein, 4 aa, Mycobacterium avium
PAQP

SEQ ID NO: 40699 - protein, 10 aa, Mycobacterium avium
PAQPAELYPG

SEQ ID NO: 40700 - protein, 6 aa, Mycobacterium avium
PAQQRL

SEQ ID NO: 40701 - protein, 5 aa, Mycobacterium avium
PAQVG

SEQ ID NO: 40702 - protein, 5 aa, Mycobacterium avium
PARAA

SEQ ID NO: 40703 - protein, 16 aa, Mycobacterium avium
PARAKPVSAGAPAGGT

SEQ ID NO: 40704 - protein, 9 aa, Mycobacterium avium
PARDGPGAP

SEQ ID NO: 40705 - protein, 9 aa, Mycobacterium avium
PARDGPPDI

SEQ ID NO: 40706 - protein, 9 aa, Mycobacterium avium
PARGGSSIG

SEQ ID NO: 40707 - protein, 5 aa, Mycobacterium avium
PARGL

SEQ ID NO: 40708 - protein, 4 aa, Mycobacterium avium
PARI

SEQ ID NO: 40709 - protein, 7 aa, Mycobacterium avium
PARIDTP

SEQ ID NO: 40710 - protein, 9 aa, Mycobacterium avium
PARNDPRDA

SEQ ID NO: 40711 - protein, 23 aa, Mycobacterium avium
PARNPWDTERTPGGSSGGSGAAV

SEQ ID NO: 40712 - protein, 8 aa, Mycobacterium avium
PARPASDL

SEQ ID NO: 40713 - protein, 8 aa, Mycobacterium avium
PARPNSPE

SEQ ID NO: 40714 - protein, 13 aa, Mycobacterium avium
PARQAPAPLPGQD

SEQ ID NO: 40715 - protein, 10 aa, Mycobacterium avium
PARRADYDRE

SEQ ID NO: 40716 - protein, 6 aa, Mycobacterium avium
PARRDY

SEQ ID NO: 40717 - protein, 6 aa, Mycobacterium avium
PARSGL

SEQ ID NO: 40718 - protein, 5 aa, Mycobacterium avium
PARSL

SEQ ID NO: 40719 - protein, 5 aa, Mycobacterium avium
PARTW

SEQ ID NO: 40720 - protein, 7 aa, Mycobacterium avium
PARYGQA

SEQ ID NO: 40721 - protein, 20 aa, Mycobacterium avium
PASATAAAKHATHPPAPQVA

SEQ ID NO: 40722 - protein, 5 aa, Mycobacterium avium
PASES

SEQ ID NO: 40723 - protein, 8 aa, Mycobacterium avium
PASGKTTL

SEQ ID NO: 40724 - protein, 9 aa, Mycobacterium avium
PASGRTAER

SEQ ID NO: 40725 - protein, 11 aa, Mycobacterium avium
PASGSGKTTVA

SEQ ID NO: 40726 - protein, 8 aa, Mycobacterium avium
PASPGTGV

SEQ ID NO: 40727 - protein, 5 aa, Mycobacterium avium
PASPH

SEQ ID NO: 40728 - protein, 13 aa, Mycobacterium avium
PASPTPPAEGSLR

SEQ ID NO: 40729 - protein, 10 aa, Mycobacterium avium
PASSGGGTAL

SEQ ID NO: 40730 - protein, 6 aa, Mycobacterium avium
PASSRD

SEQ ID NO: 40731 - protein, 5 aa, Mycobacterium avium
PASVE

SEQ ID NO: 40732 - protein, 10 aa, Mycobacterium avium
PATAAGERLE

SEQ ID NO: 40733 - protein, 5 aa, Mycobacterium avium
PATAE

SEQ ID NO: 40734 - protein, 7 aa, Mycobacterium avium
PATDPRV

SEQ ID NO: 40735 - protein, 4 aa, Mycobacterium avium
PATE

SEQ ID NO: 40736 - protein, 7 aa, Mycobacterium avium
PATEEKI

SEQ ID NO: 40737 - protein, 8 aa, Mycobacterium avium
PATGTTKA

SEQ ID NO: 40738 - protein, 4 aa, Mycobacterium avium
PATH

SEQ ID NO: 40739 - protein, 11 aa, Mycobacterium avium
PATPPPAQADA

SEQ ID NO: 40740 - protein, 8 aa, Mycobacterium avium
PATSPAAA

SEQ ID NO: 40741 - protein, 7 aa, Mycobacterium avium
PATSWNA

SEQ ID NO: 40742 - protein, 8 aa, Mycobacterium avium
PATTDLDT

SEQ ID NO: 40743 - protein, 8 aa, Mycobacterium avium
PATTNSAI

SEQ ID NO: 40744 - protein, 22 aa, Mycobacterium avium
PATTVTAAAETAATAAPAGTGS

SEQ ID NO: 40745 - protein, 5 aa, Mycobacterium avium
PATTY

SEQ ID NO: 40746 - protein, 10 aa, Mycobacterium avium
PAVAAPGGAM

SEQ ID NO: 40747 - protein, 10 aa, Mycobacterium avium
PAVADADADY

SEQ ID NO: 40748 - protein, 7 aa, Mycobacterium avium
PAVAEEA

SEQ ID NO: 40749 - protein, 12 aa, Mycobacterium avium
PAVASSDARNIE

SEQ ID NO: 40750 - protein, 6 aa, Mycobacterium avium
PAVRDH

SEQ ID NO: 40751 - protein, 8 aa, Mycobacterium avium
PAVTGKPC

SEQ ID NO: 40752 - protein, 17 aa, Mycobacterium avium
PAVTGKPSGDDLRSGKR

SEQ ID NO: 40753 - protein, 4 aa, Mycobacterium avium
PAYD

SEQ ID NO: 40754 - protein, 7 aa, Mycobacterium avium
PAYGGRG

SEQ ID NO: 40755 - protein, 5 aa, Mycobacterium avium
PAYPG

SEQ ID NO: 40756 - protein, 7 aa, Mycobacterium avium
PAYQGRG

SEQ ID NO: 40757 - protein, 6 aa, Mycobacterium avium
PAYRSS

SEQ ID NO: 40758 - protein, 8 aa, Mycobacterium avium
PAYTPAAL

SEQ ID NO: 40759 - protein, 9 aa, Mycobacterium avium
PCDASRPAI

SEQ ID NO: 40760 - protein, 7 aa, Mycobacterium avium
PCGPGRD

SEQ ID NO: 40761 - protein, 4 aa, Mycobacterium avium
PCPA

SEQ ID NO: 40762 - protein, 6 aa, Mycobacterium avium
PCTGTG

SEQ ID NO: 40763 - protein, 25 aa, Mycobacterium avium
PCVEGTPSQHAIDGDARSAAQRNHD

SEQ ID NO: 40764 - protein, 5 aa, Mycobacterium avium
PCYDG

SEQ ID NO: 40765 - protein, 4 aa, Mycobacterium avium
PDAA

SEQ ID NO: 40766 - protein, 9 aa, Mycobacterium avium
PDAAAGTSP

SEQ ID NO: 40767 - protein, 8 aa, Mycobacterium avium
PDAARSLG

SEQ ID NO: 40768 - protein, 13 aa, Mycobacterium avium
PDAASRGVVDAPE

SEQ ID NO: 40769 - protein, 7 aa, Mycobacterium avium
PDADAET

SEQ ID NO: 40770 - protein, 9 aa, Mycobacterium avium
PDAEDGKDL

SEQ ID NO: 40771 - protein, 8 aa, Mycobacterium avium
PDAETQAA

SEQ ID NO: 40772 - protein, 7 aa, Mycobacterium avium
PDAGDAH

SEQ ID NO: 40773 - protein, 8 aa, Mycobacterium avium
PDAGGPRD

SEQ ID NO: 40774 - protein, 5 aa, Mycobacterium avium
PDAGT

SEQ ID NO: 40775 - protein, 7 aa, Mycobacterium avium
PDAHRES

SEQ ID NO: 40776 - protein, 7 aa, Mycobacterium avium
PDARPGL

SEQ ID NO: 40777 - protein, 5 aa, Mycobacterium avium
PDART

SEQ ID NO: 40778 - protein, 6 aa, Mycobacterium avium
PDAVDS

SEQ ID NO: 40779 - protein, 14 aa, Mycobacterium avium
PDDADSEPSPPLAK

SEQ ID NO: 40780 - protein, 4 aa, Mycobacterium avium
PDDD

SEQ ID NO: 40781 - protein, 12 aa, Mycobacterium avium
PDDDGDPDIPPE

SEQ ID NO: 40782 - protein, 7 aa, Mycobacterium avium
PDDELGS

SEQ ID NO: 40783 - protein, 10 aa, Mycobacterium avium
PDDESLGTGA

SEQ ID NO: 40784 - protein, 8 aa, Mycobacterium avium
PDDGSEEV

SEQ ID NO: 40785 - protein, 10 aa, Mycobacterium avium
PDDGTGEESK

SEQ ID NO: 40786 - protein, 6 aa, Mycobacterium avium
PDDGTK

SEQ ID NO: 40787 - protein, 7 aa, Mycobacterium avium
PDDIGSR

SEQ ID NO: 40788 - protein, 9 aa, Mycobacterium avium
PDDKAKQRA

SEQ ID NO: 40789 - protein, 4 aa, Mycobacterium avium
PDDN

SEQ ID NO: 40790 - protein, 8 aa, Mycobacterium avium
PDDPEEQA

SEQ ID NO: 40791 - protein, 8 aa, Mycobacterium avium
PDDPPGRR

SEQ ID NO: 40792 - protein, 4 aa, Mycobacterium avium
PDDQ

SEQ ID NO: 40793 - protein, 4 aa, Mycobacterium avium
PDDR

SEQ ID NO: 40794 - protein, 7 aa, Mycobacterium avium
PDDSVSD

SEQ ID NO: 40795 - protein, 4 aa, Mycobacterium avium
PDEA

SEQ ID NO: 40796 - protein, 13 aa, Mycobacterium avium
PDEAAAAAAAGLG

SEQ ID NO: 40797 - protein, 6 aa, Mycobacterium avium
PDEDLG

SEQ ID NO: 40798 - protein, 9 aa, Mycobacterium avium
PDEDRPQIR

SEQ ID NO: 40799 - protein, 7 aa, Mycobacterium avium
PDEDSAR

SEQ ID NO: 40800 - protein, 4 aa, Mycobacterium avium
PDEG

SEQ ID NO: 40801 - protein, 5 aa, Mycobacterium avium
PDEGE

SEQ ID NO: 40802 - protein, 4 aa, Mycobacterium avium
PDEH

SEQ ID NO: 40803 - protein, 7 aa, Mycobacterium avium
PDELPGA

SEQ ID NO: 40804 - protein, 7 aa, Mycobacterium avium
PDENHEG

SEQ ID NO: 40805 - protein, 13 aa, Mycobacterium avium
PDEPDATSTLADG

SEQ ID NO: 40806 - protein, 5 aa, Mycobacterium avium
PDEPH

SEQ ID NO: 40807 - protein, 7 aa, Mycobacterium avium
PDEQLDN

SEQ ID NO: 40808 - protein, 17 aa, Mycobacterium avium
PDERPDQGQGGAGAATL

SEQ ID NO: 40809 - protein, 8 aa, Mycobacterium avium
PDERTGER

SEQ ID NO: 40810 - protein, 7 aa, Mycobacterium avium
PDERTRA

SEQ ID NO: 40811 - protein, 6 aa, Mycobacterium avium
PDESGS

SEQ ID NO: 40812 - protein, 8 aa, Mycobacterium avium
PDETASNR

SEQ ID NO: 40813 - protein, 7 aa, Mycobacterium avium
PDEVAAG

SEQ ID NO: 40814 - protein, 5 aa, Mycobacterium avium
PDFAP

SEQ ID NO: 40815 - protein, 10 aa, Mycobacterium avium
PDFGTGSSRE

SEQ ID NO: 40816 - protein, 7 aa, Mycobacterium avium
PDFPKPG

SEQ ID NO: 40817 - protein, 4 aa, Mycobacterium avium
PDFQ

SEQ ID NO: 40818 - protein, 9 aa, Mycobacterium avium
PDGAASKAE

SEQ ID NO: 40819 - protein, 9 aa, Mycobacterium avium
PDGASASID

SEQ ID NO: 40820 - protein, 6 aa, Mycobacterium avium
PDGDTM

SEQ ID NO: 40821 - protein, 4 aa, Mycobacterium avium
PDGE

SEQ ID NO: 40822 - protein, 8 aa, Mycobacterium avium
PDGFTPAP

SEQ ID NO: 40823 - protein, 7 aa, Mycobacterium avium
PDGHTED

SEQ ID NO: 40824 - protein, 12 aa, Mycobacterium avium
PDGKSAKDLGLD

SEQ ID NO: 40825 - protein, 5 aa, Mycobacterium avium
PDGMD

SEQ ID NO: 40826 - protein, 4 aa, Mycobacterium avium
PDGN

SEQ ID NO: 40827 - protein, 5 aa, Mycobacterium avium
PDGNG

SEQ ID NO: 40828 - protein, 12 aa, Mycobacterium avium
PDGPDLRVQPGD

SEQ ID NO: 40829 - protein, 15 aa, Mycobacterium avium
PDGQWTPSPQEGHTV

SEQ ID NO: 40830 - protein, 9 aa, Mycobacterium avium
PDGRPFRDS

SEQ ID NO: 40831 - protein, 13 aa, Mycobacterium avium
PDGRYSDEDRARA

SEQ ID NO: 40832 - protein, 6 aa, Mycobacterium avium
PDGSAL

SEQ ID NO: 40833 - protein, 8 aa, Mycobacterium avium
PDGSGITD

SEQ ID NO: 40834 - protein, 10 aa, Mycobacterium avium
PDGSPGARKD

SEQ ID NO: 40835 - protein, 10 aa, Mycobacterium avium
PDGSPSWADP

SEQ ID NO: 40836 - protein, 9 aa, Mycobacterium avium
PDGTPAEAV

SEQ ID NO: 40837 - protein, 6 aa, Mycobacterium avium
PDGTPV

SEQ ID NO: 40838 - protein, 8 aa, Mycobacterium avium
PDGTQEPR

SEQ ID NO: 40839 - protein, 5 aa, Mycobacterium avium
PDGTR

SEQ ID NO: 40840 - protein, 8 aa, Mycobacterium avium
PDGTYSAF

SEQ ID NO: 40841 - protein, 5 aa, Mycobacterium avium
PDGVG

SEQ ID NO: 40842 - protein, 5 aa, Mycobacterium avium
PDGVS

SEQ ID NO: 40843 - protein, 15 aa, Mycobacterium avium
PDHADDVAATGAKPV

SEQ ID NO: 40844 - protein, 8 aa, Mycobacterium avium
PDHQRAAD

SEQ ID NO: 40845 - protein, 4 aa, Mycobacterium avium
PDHT

SEQ ID NO: 40846 - protein, 5 aa, Mycobacterium avium
PDHTR

SEQ ID NO: 40847 - protein, 5 aa, Mycobacterium avium
PDIGA

SEQ ID NO: 40848 - protein, 4 aa, Mycobacterium avium
PDKA

SEQ ID NO: 40849 - protein, 8 aa, Mycobacterium avium
PDKFDPER

SEQ ID NO: 40850 - protein, 7 aa, Mycobacterium avium
PDKGTVT

SEQ ID NO: 40851 - protein, 13 aa, Mycobacterium avium
PDKLTGASTPVSG

SEQ ID NO: 40852 - protein, 10 aa, Mycobacterium avium
PDKPNNYNPI

SEQ ID NO: 40853 - protein, 8 aa, Mycobacterium avium
PDKSEDEV

SEQ ID NO: 40854 - protein, 8 aa, Mycobacterium avium
PDKSKLAT

SEQ ID NO: 40855 - protein, 6 aa, Mycobacterium avium
PDLAER

SEQ ID NO: 40856 - protein, 16 aa, Mycobacterium avium
PDLGPMPDGLNPAKCD

SEQ ID NO: 40857 - protein, 16 aa, Mycobacterium avium
PDLRDDERFADQRSRA

SEQ ID NO: 40858 - protein, 8 aa, Mycobacterium avium
PDMEPANE

SEQ ID NO: 40859 - protein, 8 aa, Mycobacterium avium
PDMPPIPP

SEQ ID NO: 40860 - protein, 9 aa, Mycobacterium avium
PDNDPRGTR

SEQ ID NO: 40861 - protein, 5 aa, Mycobacterium avium
PDNPE

SEQ ID NO: 40862 - protein, 7 aa, Mycobacterium avium
PDNTEVS

SEQ ID NO: 40863 - protein, 11 aa, Mycobacterium avium
PDPAPRGSAPA

SEQ ID NO: 40864 - protein, 4 aa, Mycobacterium avium
PDPD

SEQ ID NO: 40865 - protein, 21 aa, Mycobacterium avium
PDPEPHGAPTPAGRPGGRPWT

SEQ ID NO: 40866 - protein, 8 aa, Mycobacterium avium
PDPERTLA

SEQ ID NO: 40867 - protein, 5 aa, Mycobacterium avium
PDPGM

SEQ ID NO: 40868 - protein, 9 aa, Mycobacterium avium
PDPGNPRHR

SEQ ID NO: 40869 - protein, 8 aa, Mycobacterium avium
PDPGPGEA

SEQ ID NO: 40870 - protein, 8 aa, Mycobacterium avium
PDPGTDPV

SEQ ID NO: 40871 - protein, 9 aa, Mycobacterium avium
PDPIEGQPL

SEQ ID NO: 40872 - protein, 10 aa, Mycobacterium avium
PDPPGRTRFG

SEQ ID NO: 40873 - protein, 9 aa, Mycobacterium avium
PDPPPESLP

SEQ ID NO: 40874 - protein, 7 aa, Mycobacterium avium
PDPQGRA

SEQ ID NO: 40875 - protein, 8 aa, Mycobacterium avium
PDPQYAPG

SEQ ID NO: 40876 - protein, 10 aa, Mycobacterium avium
PDPRDGGRPP

SEQ ID NO: 40877 - protein, 7 aa, Mycobacterium avium
PDPRTGE

SEQ ID NO: 40878 - protein, 5 aa, Mycobacterium avium
PDPRV

SEQ ID NO: 40879 - protein, 7 aa, Mycobacterium avium
PDPRYGQ

SEQ ID NO: 40880 - protein, 8 aa, Mycobacterium avium
PDPTEGVK

SEQ ID NO: 40881 - protein, 10 aa, Mycobacterium avium
PDPTTPEAQQ

SEQ ID NO: 40882 - protein, 8 aa, Mycobacterium avium
PDPVPGPG

SEQ ID NO: 40883 - protein, 7 aa, Mycobacterium avium
PDQLASV

SEQ ID NO: 40884 - protein, 5 aa, Mycobacterium avium
PDQLQ

SEQ ID NO: 40885 - protein, 4 aa, Mycobacterium avium
PDQP

SEQ ID NO: 40886 - protein, 6 aa, Mycobacterium avium
PDQRGL

SEQ ID NO: 40887 - protein, 4 aa, Mycobacterium avium
PDQT

SEQ ID NO: 40888 - protein, 10 aa, Mycobacterium avium
PDQTGTPRKL

SEQ ID NO: 40889 - protein, 4 aa, Mycobacterium avium
PDRA

SEQ ID NO: 40890 - protein, 21 aa, Mycobacterium avium
PDRAAAKARGRDGGKPRRKYG

SEQ ID NO: 40891 - protein, 7 aa, Mycobacterium avium
PDRDTAE

SEQ ID NO: 40892 - protein, 4 aa, Mycobacterium avium
PDRG

SEQ ID NO: 40893 - protein, 8 aa, Mycobacterium avium
PDRGPDGI

SEQ ID NO: 40894 - protein, 4 aa, Mycobacterium avium
PDRI

SEQ ID NO: 40895 - protein, 14 aa, Mycobacterium avium
PDRNAGFSKANPGR

SEQ ID NO: 40896 - protein, 6 aa, Mycobacterium avium
PDRPYT

SEQ ID NO: 40897 - protein, 4 aa, Mycobacterium avium
PDRQ

SEQ ID NO: 40898 - protein, 5 aa, Mycobacterium avium
PDRRR

SEQ ID NO: 40899 - protein, 8 aa, Mycobacterium avium
PDRSPAEA

SEQ ID NO: 40900 - protein, 5 aa, Mycobacterium avium
PDRSY

SEQ ID NO: 40901 - protein, 4 aa, Mycobacterium avium
PDRT

SEQ ID NO: 40902 - protein, 10 aa, Mycobacterium avium
PDRTPYDPYS

SEQ ID NO: 40903 - protein, 16 aa, Mycobacterium avium
PDRYDGVKGAHRIDLS

SEQ ID NO: 40904 - protein, 6 aa, Mycobacterium avium
PDSDNM

SEQ ID NO: 40905 - protein, 6 aa, Mycobacterium avium
PDSGRV

SEQ ID NO: 40906 - protein, 8 aa, Mycobacterium avium
PDSHTRDL

SEQ ID NO: 40907 - protein, 12 aa, Mycobacterium avium
PDSLPAAEQIGA

SEQ ID NO: 40908 - protein, 7 aa, Mycobacterium avium
PDSPDDD

SEQ ID NO: 40909 - protein, 7 aa, Mycobacterium avium
PDSPGRV

SEQ ID NO: 40910 - protein, 5 aa, Mycobacterium avium
PDSPV

SEQ ID NO: 40911 - protein, 4 aa, Mycobacterium avium
PDSS

SEQ ID NO: 40912 - protein, 8 aa, Mycobacterium avium
PDSSGNPY

SEQ ID NO: 40913 - protein, 8 aa, Mycobacterium avium
PDSTIAGR

SEQ ID NO: 40914 - protein, 14 aa, Mycobacterium avium
PDSTTEATTEEDEV

SEQ ID NO: 40915 - protein, 5 aa, Mycobacterium avium
PDTGE

SEQ ID NO: 40916 - protein, 13 aa, Mycobacterium avium
PDTGERVRYGQPG

SEQ ID NO: 40917 - protein, 4 aa, Mycobacterium avium
PDTP

SEQ ID NO: 40918 - protein, 5 aa, Mycobacterium avium
PDTPN

SEQ ID NO: 40919 - protein, 11 aa, Mycobacterium avium
PDTPPGQPRAE

SEQ ID NO: 40920 - protein, 6 aa, Mycobacterium avium
PDTTLT

SEQ ID NO: 40921 - protein, 5 aa, Mycobacterium avium
PDTVA

SEQ ID NO: 40922 - protein, 6 aa, Mycobacterium avium
PDVAQD

SEQ ID NO: 40923 - protein, 25 aa, Mycobacterium avium
PDVGSDPARLASTATPVDDGKAYEL

SEQ ID NO: 40924 - protein, 4 aa, Mycobacterium avium
PDVN

SEQ ID NO: 40925 - protein, 12 aa, Mycobacterium avium
PDVNPDEAAQAK

SEQ ID NO: 40926 - protein, 7 aa, Mycobacterium avium
PDVPGRR

SEQ ID NO: 40927 - protein, 7 aa, Mycobacterium avium
PDVTPPR

SEQ ID NO: 40928 - protein, 9 aa, Mycobacterium avium
PDWAPGSTV

SEQ ID NO: 40929 - protein, 11 aa, Mycobacterium avium
PDYPPERVRAD

SEQ ID NO: 40930 - protein, 4 aa, Mycobacterium avium
PEAA

SEQ ID NO: 40931 - protein, 10 aa, Mycobacterium avium
PEAAAGPHDA

SEQ ID NO: 40932 - protein, 12 aa, Mycobacterium avium
PEAAELGEVDRS

SEQ ID NO: 40933 - protein, 8 aa, Mycobacterium avium
PEAERTRR

SEQ ID NO: 40934 - protein, 8 aa, Mycobacterium avium
PEAFPSDP

SEQ ID NO: 40935 - protein, 4 aa, Mycobacterium avium
PEAG

SEQ ID NO: 40936 - protein, 12 aa, Mycobacterium avium
PEAHTEYRKPYD

SEQ ID NO: 40937 - protein, 5 aa, Mycobacterium avium
PEAIN

SEQ ID NO: 40938 - protein, 7 aa, Mycobacterium avium
PEALSGS

SEQ ID NO: 40939 - protein, 9 aa, Mycobacterium avium
PEAPAEGPL

SEQ ID NO: 40940 - protein, 23 aa, Mycobacterium avium
PEAPLADNKDRQKLALGEEGMPG

SEQ ID NO: 40941 - protein, 6 aa, Mycobacterium avium
PEAPSV

SEQ ID NO: 40942 - protein, 4 aa, Mycobacterium avium
PEAS

SEQ ID NO: 40943 - protein, 9 aa, Mycobacterium avium
PEASDKELA

SEQ ID NO: 40944 - protein, 7 aa, Mycobacterium avium
PEATAAD

SEQ ID NO: 40945 - protein, 4 aa, Mycobacterium avium
PEDE

SEQ ID NO: 40946 - protein, 5 aa, Mycobacterium avium
PEDEE

SEQ ID NO: 40947 - protein, 5 aa, Mycobacterium avium
PEDEQ

SEQ ID NO: 40948 - protein, 22 aa, Mycobacterium avium
PEDFPDPDAFKPDRYNKPEQAD

SEQ ID NO: 40949 - protein, 8 aa, Mycobacterium avium
PEDFQDPK

SEQ ID NO: 40950 - protein, 4 aa, Mycobacterium avium
PEDG

SEQ ID NO: 40951 - protein, 6 aa, Mycobacterium avium
PEDGSA

SEQ ID NO: 40952 - protein, 4 aa, Mycobacterium avium
PEDI

SEQ ID NO: 40953 - protein, 5 aa, Mycobacterium avium
PEDMG

SEQ ID NO: 40954 - protein, 4 aa, Mycobacterium avium
PEDQ

SEQ ID NO: 40955 - protein, 8 aa, Mycobacterium avium
PEDSAEQP

SEQ ID NO: 40956 - protein, 6 aa, Mycobacterium avium
PEDTDR

SEQ ID NO: 40957 - protein, 8 aa, Mycobacterium avium
PEDTEDEL

SEQ ID NO: 40958 - protein, 11 aa, Mycobacterium avium
PEEAGGAGGSV

SEQ ID NO: 40959 - protein, 6 aa, Mycobacterium avium
PEEDHT

SEQ ID NO: 40960 - protein, 4 aa, Mycobacterium avium
PEEI

SEQ ID NO: 40961 - protein, 8 aa, Mycobacterium avium
PEELGGAL

SEQ ID NO: 40962 - protein, 9 aa, Mycobacterium avium
PEELQGRNP

SEQ ID NO: 40963 - protein, 7 aa, Mycobacterium avium
PEEMPDD

SEQ ID NO: 40964 - protein, 14 aa, Mycobacterium avium
PEESDPPADSSKDE

SEQ ID NO: 40965 - protein, 5 aa, Mycobacterium avium
PEEYR

SEQ ID NO: 40966 - protein, 4 aa, Mycobacterium avium
PEFA

SEQ ID NO: 40967 - protein, 5 aa, Mycobacterium avium
PEFDD

SEQ ID NO: 40968 - protein, 7 aa, Mycobacterium avium
PEFPDRP

SEQ ID NO: 40969 - protein, 8 aa, Mycobacterium avium
PEGAATRL

SEQ ID NO: 40970 - protein, 8 aa, Mycobacterium avium
PEGADAWD

SEQ ID NO: 40971 - protein, 11 aa, Mycobacterium avium
PEGAPDNSRGV

SEQ ID NO: 40972 - protein, 4 aa, Mycobacterium avium
PEGD

SEQ ID NO: 40973 - protein, 10 aa, Mycobacterium avium
PEGDEPLTYE

SEQ ID NO: 40974 - protein, 5 aa, Mycobacterium avium
PEGFT

SEQ ID NO: 40975 - protein, 4 aa, Mycobacterium avium
PEGI

SEQ ID NO: 40976 - protein, 10 aa, Mycobacterium avium
PEGKGWRQPE

SEQ ID NO: 40977 - protein, 10 aa, Mycobacterium avium
PEGNPPPPEV

SEQ ID NO: 40978 - protein, 12 aa, Mycobacterium avium
PEGPEGKPDPIA

SEQ ID NO: 40979 - protein, 11 aa, Mycobacterium avium
PEGPPVTPRGA

SEQ ID NO: 40980 - protein, 5 aa, Mycobacterium avium
PEGRR

SEQ ID NO: 40981 - protein, 5 aa, Mycobacterium avium
PEHGS

SEQ ID NO: 40982 - protein, 4 aa, Mycobacterium avium
PEHL

SEQ ID NO: 40983 - protein, 6 aa, Mycobacterium avium
PEHPAG

SEQ ID NO: 40984 - protein, 10 aa, Mycobacterium avium
PEHPAPAAID

SEQ ID NO: 40985 - protein, 10 aa, Mycobacterium avium
PEHSVAEQDK

SEQ ID NO: 40986 - protein, 4 aa, Mycobacterium avium
PEHT

SEQ ID NO: 40987 - protein, 4 aa, Mycobacterium avium
PEIS

SEQ ID NO: 40988 - protein, 5 aa, Mycobacterium avium
PEKEG

SEQ ID NO: 40989 - protein, 10 aa, Mycobacterium avium
PEKGGSTREA

SEQ ID NO: 40990 - protein, 11 aa, Mycobacterium avium
PEKIGKDTGQF

SEQ ID NO: 40991 - protein, 11 aa, Mycobacterium avium
PEKQARKARET

SEQ ID NO: 40992 - protein, 7 aa, Mycobacterium avium
PEKTPEL

SEQ ID NO: 40993 - protein, 9 aa, Mycobacterium avium
PELAEADAR

SEQ ID NO: 40994 - protein, 12 aa, Mycobacterium avium
PELPGGSELGST

SEQ ID NO: 40995 - protein, 8 aa, Mycobacterium avium
PELREARP

SEQ ID NO: 40996 - protein, 6 aa, Mycobacterium avium
PELRSS

SEQ ID NO: 40997 - protein, 4 aa, Mycobacterium avium
PELT

SEQ ID NO: 40998 - protein, 25 aa, Mycobacterium avium
PEMGEGPVQAVSAGAGYRLTGTRTQ

SEQ ID NO: 40999 - protein, 9 aa, Mycobacterium avium
PEMKSTGEV

SEQ ID NO: 41000 - protein, 8 aa, Mycobacterium avium
PENAWPAA

SEQ ID NO: 41001 - protein, 4 aa, Mycobacterium avium
PENK

SEQ ID NO: 41002 - protein, 7 aa, Mycobacterium avium
PENPARL

SEQ ID NO: 41003 - protein, 7 aa, Mycobacterium avium
PENPCPA

SEQ ID NO: 41004 - protein, 6 aa, Mycobacterium avium
PEPDGL

SEQ ID NO: 41005 - protein, 6 aa, Mycobacterium avium
PEPDPG

SEQ ID NO: 41006 - protein, 7 aa, Mycobacterium avium
PEPGPLG

SEQ ID NO: 41007 - protein, 7 aa, Mycobacterium avium
PEPIPET

SEQ ID NO: 41008 - protein, 12 aa, Mycobacterium avium
PEPKKGKPGKPL

SEQ ID NO: 41009 - protein, 5 aa, Mycobacterium avium
PEPLP

SEQ ID NO: 41010 - protein, 8 aa, Mycobacterium avium
PEPLPAPV

SEQ ID NO: 41011 - protein, 30 aa, Mycobacterium avium
PEPPPDDDDGSGAPAKKGKKPTGPKPRTAS

SEQ ID NO: 41012 - protein, 27 aa, Mycobacterium avium
PEPPRERRERHTERRERTEKPRSTRPL

SEQ ID NO: 41013 - protein, 13 aa, Mycobacterium avium
PEPRLADRARAAA

SEQ ID NO: 41014 - protein, 5 aa, Mycobacterium avium
PEPTG

SEQ ID NO: 41015 - protein, 4 aa, Mycobacterium avium
PEPV

SEQ ID NO: 41016 - protein, 7 aa, Mycobacterium avium
PEPYPTR

SEQ ID NO: 41017 - protein, 11 aa, Mycobacterium avium
PEQAKIAEGAG

SEQ ID NO: 41018 - protein, 6 aa, Mycobacterium avium
PEQDRS

SEQ ID NO: 41019 - protein, 6 aa, Mycobacterium avium
PEQGGW

SEQ ID NO: 41020 - protein, 4 aa, Mycobacterium avium
PEQI

SEQ ID NO: 41021 - protein, 5 aa, Mycobacterium avium
PEQLG

SEQ ID NO: 41022 - protein, 9 aa, Mycobacterium avium
PEQQRDDAR

SEQ ID NO: 41023 - protein, 4 aa, Mycobacterium avium
PEQR

SEQ ID NO: 41024 - protein, 5 aa, Mycobacterium avium
PEQRD

SEQ ID NO: 41025 - protein, 24 aa, Mycobacterium avium
PEQSSNGIQHRDSAARPIPEPAAR

SEQ ID NO: 41026 - protein, 10 aa, Mycobacterium avium
PERAARDAEA

SEQ ID NO: 41027 - protein, 11 aa, Mycobacterium avium
PERAASGPFGT

SEQ ID NO: 41028 - protein, 11 aa, Mycobacterium avium
PERADDADNPL

SEQ ID NO: 41029 - protein, 5 aa, Mycobacterium avium
PERDR

SEQ ID NO: 41030 - protein, 12 aa, Mycobacterium avium
PERERAAKRLGP

SEQ ID NO: 41031 - protein, 7 aa, Mycobacterium avium
PERISGN

SEQ ID NO: 41032 - protein, 7 aa, Mycobacterium avium
PERPRER

SEQ ID NO: 41033 - protein, 9 aa, Mycobacterium avium
PERPSAPDI

SEQ ID NO: 41034 - protein, 15 aa, Mycobacterium avium
PERREALSSTQGEYG

SEQ ID NO: 41035 - protein, 7 aa, Mycobacterium avium
PERRSGD

SEQ ID NO: 41036 - protein, 4 aa, Mycobacterium avium
PERV

SEQ ID NO: 41037 - protein, 9 aa, Mycobacterium avium
PESAELAKY

SEQ ID NO: 41038 - protein, 6 aa, Mycobacterium avium
PESAGG

SEQ ID NO: 41039 - protein, 5 aa, Mycobacterium avium
PESAH

SEQ ID NO: 41040 - protein, 20 aa, Mycobacterium avium
PESGTPAAVGYAQESGIPYG

SEQ ID NO: 41041 - protein, 9 aa, Mycobacterium avium
PESIPGTTV

SEQ ID NO: 41042 - protein, 4 aa, Mycobacterium avium
PESP

SEQ ID NO: 41043 - protein, 7 aa, Mycobacterium avium
PESPRNV

SEQ ID NO: 41044 - protein, 12 aa, Mycobacterium avium
PESRYDDAAAFF

SEQ ID NO: 41045 - protein, 13 aa, Mycobacterium avium
PESVGGGGGDGAD

SEQ ID NO: 41046 - protein, 5 aa, Mycobacterium avium
PESVP

SEQ ID NO: 41047 - protein, 6 aa, Mycobacterium avium
PETDPG

SEQ ID NO: 41048 - protein, 31 aa, Mycobacterium avium
PETIEARTDPWDPDSAPTRAEAEAARHAEEA

SEQ ID NO: 41049 - protein, 12 aa, Mycobacterium avium
PETQGLSVIGVA

SEQ ID NO: 41050 - protein, 5 aa, Mycobacterium avium
PETSL

SEQ ID NO: 41051 - protein, 13 aa, Mycobacterium avium
PETSQTDPTGVGD

SEQ ID NO: 41052 - protein, 5 aa, Mycobacterium avium
PETVP

SEQ ID NO: 41053 - protein, 11 aa, Mycobacterium avium
PETVSTDYDTA

SEQ ID NO: 41054 - protein, 4 aa, Mycobacterium avium
PEVE

SEQ ID NO: 41055 - protein, 6 aa, Mycobacterium avium
PFAATG

SEQ ID NO: 41056 - protein, 5 aa, Mycobacterium avium
PFEPG

SEQ ID NO: 41057 - protein, 23 aa, Mycobacterium avium
PFEPTERDGRLYGRGSADDKAGI

SEQ ID NO: 41058 - protein, 8 aa, Mycobacterium avium
PFGTPNFT

SEQ ID NO: 41059 - protein, 12 aa, Mycobacterium avium
PFPEGVQTAENL

SEQ ID NO: 41060 - protein, 21 aa, Mycobacterium avium
PFPTGPRPDVTRADDHEYAQQ

SEQ ID NO: 41061 - protein, 12 aa, Mycobacterium avium
PFQERPPDRTIA

SEQ ID NO: 41062 - protein, 7 aa, Mycobacterium avium
PFRPKRP

SEQ ID NO: 41063 - protein, 17 aa, Mycobacterium avium
PFSPSSRGWQKTTYQQG

SEQ ID NO: 41064 - protein, 4 aa, Mycobacterium avium
PFSR

SEQ ID NO: 41065 - protein, 17 aa, Mycobacterium avium
PFTDTDPARKLKHRNAR

SEQ ID NO: 41066 - protein, 13 aa, Mycobacterium avium
PFTPEQRAHREAE

SEQ ID NO: 41067 - protein, 8 aa, Mycobacterium avium
PGAADDGV

SEQ ID NO: 41068 - protein, 5 aa, Mycobacterium avium
PGAAG

SEQ ID NO: 41069 - protein, 4 aa, Mycobacterium avium
PGAC

SEQ ID NO: 41070 - protein, 9 aa, Mycobacterium avium
PGADGMPGA

SEQ ID NO: 41071 - protein, 10 aa, Mycobacterium avium
PGADPTLTTT

SEQ ID NO: 41072 - protein, 10 aa, Mycobacterium avium
PGAEEEKRGI

SEQ ID NO: 41073 - protein, 8 aa, Mycobacterium avium
PGAGCTED

SEQ ID NO: 41074 - protein, 12 aa, Mycobacterium avium
PGAGDAVQAAKA

SEQ ID NO: 41075 - protein, 8 aa, Mycobacterium avium
PGAGGTVS

SEQ ID NO: 41076 - protein, 9 aa, Mycobacterium avium
PGAGPDTDP

SEQ ID NO: 41077 - protein, 11 aa, Mycobacterium avium
PGAGRPRDPRI

SEQ ID NO: 41078 - protein, 7 aa, Mycobacterium avium
PGALPTR

SEQ ID NO: 41079 - protein, 6 aa, Mycobacterium avium
PGALSR

SEQ ID NO: 41080 - protein, 7 aa, Mycobacterium avium
PGANGRF

SEQ ID NO: 41081 - protein, 7 aa, Mycobacterium avium
PGAPIDT

SEQ ID NO: 41082 - protein, 10 aa, Mycobacterium avium
PGAPLARAET

SEQ ID NO: 41083 - protein, 10 aa, Mycobacterium avium
PGAPPSLAGL

SEQ ID NO: 41084 - protein, 11 aa, Mycobacterium avium
PGAPVPTGRKI

SEQ ID NO: 41085 - protein, 24 aa, Mycobacterium avium
PGAQEAGITVTSRQNEVSTPSVTD

SEQ ID NO: 41086 - protein, 7 aa, Mycobacterium avium
PGAQVGP

SEQ ID NO: 41087 - protein, 7 aa, Mycobacterium avium
PGARRQI

SEQ ID NO: 41088 - protein, 6 aa, Mycobacterium avium
PGARTA

SEQ ID NO: 41089 - protein, 9 aa, Mycobacterium avium
PGASAGRGL

SEQ ID NO: 41090 - protein, 9 aa, Mycobacterium avium
PGASDTARF

SEQ ID NO: 41091 - protein, 7 aa, Mycobacterium avium
PGASGAI

SEQ ID NO: 41092 - protein, 4 aa, Mycobacterium avium
PGAT

SEQ ID NO: 41093 - protein, 5 aa, Mycobacterium avium
PGATL

SEQ ID NO: 41094 - protein, 10 aa, Mycobacterium avium
PGATTHGARH

SEQ ID NO: 41095 - protein, 4 aa, Mycobacterium avium
PGDA

SEQ ID NO: 41096 - protein, 10 aa, Mycobacterium avium
PGDADPDTGI

SEQ ID NO: 41097 - protein, 10 aa, Mycobacterium avium
PGDAGRAFPA

SEQ ID NO: 41098 - protein, 24 aa, Mycobacterium avium
PGDAVGEVSEAGESGAEQPDPGPD

SEQ ID NO: 41099 - protein, 7 aa, Mycobacterium avium
PGDDESV

SEQ ID NO: 41100 - protein, 14 aa, Mycobacterium avium
PGDDTSEADAPDRF

SEQ ID NO: 41101 - protein, 16 aa, Mycobacterium avium
PGDGDQALRQSAERGW

SEQ ID NO: 41102 - protein, 5 aa, Mycobacterium avium
PGDGI

SEQ ID NO: 41103 - protein, 4 aa, Mycobacterium avium
PGDL

SEQ ID NO: 41104 - protein, 12 aa, Mycobacterium avium
PGDLGTKGGIRT

SEQ ID NO: 41105 - protein, 10 aa, Mycobacterium avium
PGDLRSEGAQ

SEQ ID NO: 41106 - protein, 6 aa, Mycobacterium avium
PGDPAW

SEQ ID NO: 41107 - protein, 10 aa, Mycobacterium avium
PGDPGPLGGD

SEQ ID NO: 41108 - protein, 10 aa, Mycobacterium avium
PGDPGRDAAV

SEQ ID NO: 41109 - protein, 5 aa, Mycobacterium avium
PGDPL

SEQ ID NO: 41110 - protein, 5 aa, Mycobacterium avium
PGDPR

SEQ ID NO: 41111 - protein, 10 aa, Mycobacterium avium
PGDREVDDKR

SEQ ID NO: 41112 - protein, 9 aa, Mycobacterium avium
PGDRRAARA

SEQ ID NO: 41113 - protein, 8 aa, Mycobacterium avium
PGDSERTV

SEQ ID NO: 41114 - protein, 11 aa, Mycobacterium avium
PGDTADVPEGK

SEQ ID NO: 41115 - protein, 9 aa, Mycobacterium avium
PGEAGPQAT

SEQ ID NO: 41116 - protein, 4 aa, Mycobacterium avium
PGED

SEQ ID NO: 41117 - protein, 9 aa, Mycobacterium avium
PGEETRGTC

SEQ ID NO: 41118 - protein, 7 aa, Mycobacterium avium
PGEGHNL

SEQ ID NO: 41119 - protein, 5 aa, Mycobacterium avium
PGEGV

SEQ ID NO: 41120 - protein, 6 aa, Mycobacterium avium
PGEKVT

SEQ ID NO: 41121 - protein, 7 aa, Mycobacterium avium
PGEPIPA

SEQ ID NO: 41122 - protein, 5 aa, Mycobacterium avium
PGEPP

SEQ ID NO: 41123 - protein, 4 aa, Mycobacterium avium
PGEQ

SEQ ID NO: 41124 - protein, 29 aa, Mycobacterium avium
PGERADGGESIAEPEDELASRRKHRDRKI

SEQ ID NO: 41125 - protein, 7 aa, Mycobacterium avium
PGERTGI

SEQ ID NO: 41126 - protein, 6 aa, Mycobacterium avium
PGETAL

SEQ ID NO: 41127 - protein, 8 aa, Mycobacterium avium
PGETLPAG

SEQ ID NO: 41128 - protein, 4 aa, Mycobacterium avium
PGEV

SEQ ID NO: 41129 - protein, 4 aa, Mycobacterium avium
PGFE

SEQ ID NO: 41130 - protein, 6 aa, Mycobacterium avium
PGFGEQ

SEQ ID NO: 41131 - protein, 5 aa, Mycobacterium avium
PGFGG

SEQ ID NO: 41132 - protein, 7 aa, Mycobacterium avium
PGFGPTE

SEQ ID NO: 41133 - protein, 5 aa, Mycobacterium avium
PGFQA

SEQ ID NO: 41134 - protein, 11 aa, Mycobacterium avium
PGGASQPRRTL

SEQ ID NO: 41135 - protein, 4 aa, Mycobacterium avium
PGGC

SEQ ID NO: 41136 - protein, 6 aa, Mycobacterium avium
PGGCTT

SEQ ID NO: 41137 - protein, 5 aa, Mycobacterium avium
PGGDE

SEQ ID NO: 41138 - protein, 5 aa, Mycobacterium avium
PGGES

SEQ ID NO: 41139 - protein, 8 aa, Mycobacterium avium
PGGESTTM

SEQ ID NO: 41140 - protein, 7 aa, Mycobacterium avium
PGGGDQW

SEQ ID NO: 41141 - protein, 7 aa, Mycobacterium avium
PGGGGVT

SEQ ID NO: 41142 - protein, 6 aa, Mycobacterium avium
PGGGQQ

SEQ ID NO: 41143 - protein, 5 aa, Mycobacterium avium
PGGKL

SEQ ID NO: 41144 - protein, 7 aa, Mycobacterium avium
PGGPGQT

SEQ ID NO: 41145 - protein, 11 aa, Mycobacterium avium
PGGPLTAEQVG

SEQ ID NO: 41146 - protein, 7 aa, Mycobacterium avium
PGGPRRL

SEQ ID NO: 41147 - protein, 12 aa, Mycobacterium avium
PGGQGDDVVSGS

SEQ ID NO: 41148 - protein, 5 aa, Mycobacterium avium
PGGQL

SEQ ID NO: 41149 - protein, 6 aa, Mycobacterium avium
PGGQTQ

SEQ ID NO: 41150 - protein, 6 aa, Mycobacterium avium
PGGRIT

SEQ ID NO: 41151 - protein, 14 aa, Mycobacterium avium
PGGRLRNDEDMTTS

SEQ ID NO: 41152 - protein, 5 aa, Mycobacterium avium
PGGRT

SEQ ID NO: 41153 - protein, 5 aa, Mycobacterium avium
PGGRW

SEQ ID NO: 41154 - protein, 4 aa, Mycobacterium avium
PGGS

SEQ ID NO: 41155 - protein, 6 aa, Mycobacterium avium
PGGSAN

SEQ ID NO: 41156 - protein, 9 aa, Mycobacterium avium
PGGSSTPLL

SEQ ID NO: 41157 - protein, 17 aa, Mycobacterium avium
PGGSVRDDEVTAAAANA

SEQ ID NO: 41158 - protein, 7 aa, Mycobacterium avium
PGGTDVG

SEQ ID NO: 41159 - protein, 12 aa, Mycobacterium avium
PGGTFAGSDGVP

SEQ ID NO: 41160 - protein, 6 aa, Mycobacterium avium
PGGTPI

SEQ ID NO: 41161 - protein, 8 aa, Mycobacterium avium
PGHAEAGS

SEQ ID NO: 41162 - protein, 4 aa, Mycobacterium avium
PGHI

SEQ ID NO: 41163 - protein, 6 aa, Mycobacterium avium
PGHPLA

SEQ ID NO: 41164 - protein, 7 aa, Mycobacterium avium
PGHTPGS

SEQ ID NO: 41165 - protein, 4 aa, Mycobacterium avium
PGIA

SEQ ID NO: 41166 - protein, 5 aa, Mycobacterium avium
PGIAS

SEQ ID NO: 41167 - protein, 9 aa, Mycobacterium avium
PGIDHADEQ

SEQ ID NO: 41168 - protein, 8 aa, Mycobacterium avium
PGIDSGRT

SEQ ID NO: 41169 - protein, 12 aa, Mycobacterium avium
PGIGATSTGTLR

SEQ ID NO: 41170 - protein, 9 aa, Mycobacterium avium
PGIGPKSAQ

SEQ ID NO: 41171 - protein, 8 aa, Mycobacterium avium
PGIGPKTA

SEQ ID NO: 41172 - protein, 5 aa, Mycobacterium avium
PGIGT

SEQ ID NO: 41173 - protein, 4 aa, Mycobacterium avium
PGIP

SEQ ID NO: 41174 - protein, 4 aa, Mycobacterium avium
PGIS

SEQ ID NO: 41175 - protein, 8 aa, Mycobacterium avium
PGISPAEA

SEQ ID NO: 41176 - protein, 12 aa, Mycobacterium avium
PGKDAARIEGSK

SEQ ID NO: 41177 - protein, 7 aa, Mycobacterium avium
PGKPPRH

SEQ ID NO: 41178 - protein, 9 aa, Mycobacterium avium
PGLDDDPEL

SEQ ID NO: 41179 - protein, 7 aa, Mycobacterium avium
PGLGEHR

SEQ ID NO: 41180 - protein, 10 aa, Mycobacterium avium
PGLGVRPSKQ

SEQ ID NO: 41181 - protein, 9 aa, Mycobacterium avium
PGLNSVGPQ

SEQ ID NO: 41182 - protein, 4 aa, Mycobacterium avium
PGLP

SEQ ID NO: 41183 - protein, 4 aa, Mycobacterium avium
PGLR

SEQ ID NO: 41184 - protein, 7 aa, Mycobacterium avium
PGLSRRD

SEQ ID NO: 41185 - protein, 14 aa, Mycobacterium avium
PGMLPGSRSERSGV

SEQ ID NO: 41186 - protein, 9 aa, Mycobacterium avium
PGMNTPDYR

SEQ ID NO: 41187 - protein, 22 aa, Mycobacterium avium
PGMPGAAAAAKGAGAYGSGPRY

SEQ ID NO: 41188 - protein, 7 aa, Mycobacterium avium
PGMPQGV

SEQ ID NO: 41189 - protein, 7 aa, Mycobacterium avium
PGMTMPD

SEQ ID NO: 41190 - protein, 9 aa, Mycobacterium avium
PGNAAVARE

SEQ ID NO: 41191 - protein, 7 aa, Mycobacterium avium
PGNARIS

SEQ ID NO: 41192 - protein, 9 aa, Mycobacterium avium
PGNDGRVTG

SEQ ID NO: 41193 - protein, 10 aa, Mycobacterium avium
PGNDYQGDPQ

SEQ ID NO: 41194 - protein, 4 aa, Mycobacterium avium
PGNP

SEQ ID NO: 41195 - protein, 6 aa, Mycobacterium avium
PGNPDY

SEQ ID NO: 41196 - protein, 5 aa, Mycobacterium avium
PGNPL

SEQ ID NO: 41197 - protein, 5 aa, Mycobacterium avium
PGNPV

SEQ ID NO: 41198 - protein, 8 aa, Mycobacterium avium
PGNRPSTS

SEQ ID NO: 41199 - protein, 10 aa, Mycobacterium avium
PGNSNDPHAV

SEQ ID NO: 41200 - protein, 7 aa, Mycobacterium avium
PGNSVKD

SEQ ID NO: 41201 - protein, 9 aa, Mycobacterium avium
PGPAGLPGH

SEQ ID NO: 41202 - protein, 18 aa, Mycobacterium avium
PGPAHTRGTPPNVVETEP

SEQ ID NO: 41203 - protein, 12 aa, Mycobacterium avium
PGPDDGTPPVPV

SEQ ID NO: 41204 - protein, 5 aa, Mycobacterium avium
PGPEG

SEQ ID NO: 41205 - protein, 4 aa, Mycobacterium avium
PGPF

SEQ ID NO: 41206 - protein, 5 aa, Mycobacterium avium
PGPGG

SEQ ID NO: 41207 - protein, 6 aa, Mycobacterium avium
PGPGTV

SEQ ID NO: 41208 - protein, 6 aa, Mycobacterium avium
PGPGWG

SEQ ID NO: 41209 - protein, 16 aa, Mycobacterium avium
PGPIDTEANRTTTPKE

SEQ ID NO: 41210 - protein, 8 aa, Mycobacterium avium
PGPIQGGS

SEQ ID NO: 41211 - protein, 5 aa, Mycobacterium avium
PGPKP

SEQ ID NO: 41212 - protein, 4 aa, Mycobacterium avium
PGPM

SEQ ID NO: 41213 - protein, 5 aa, Mycobacterium avium
PGPNQ

SEQ ID NO: 41214 - protein, 6 aa, Mycobacterium avium
PGPPTI

SEQ ID NO: 41215 - protein, 10 aa, Mycobacterium avium
PGPQPAPTDF

SEQ ID NO: 41216 - protein, 7 aa, Mycobacterium avium
PGPRAAA

SEQ ID NO: 41217 - protein, 5 aa, Mycobacterium avium
PGPRD

SEQ ID NO: 41218 - protein, 9 aa, Mycobacterium avium
PGPRLPETT

SEQ ID NO: 41219 - protein, 17 aa, Mycobacterium avium
PGPRRHHRTAPPTLGQH

SEQ ID NO: 41220 - protein, 6 aa, Mycobacterium avium
PGPSAV

SEQ ID NO: 41221 - protein, 17 aa, Mycobacterium avium
PGPSFPSTGSAVARTEL

SEQ ID NO: 41222 - protein, 9 aa, Mycobacterium avium
PGPSNKTLA

SEQ ID NO: 41223 - protein, 5 aa, Mycobacterium avium
PGPTD

SEQ ID NO: 41224 - protein, 11 aa, Mycobacterium avium
PGPTDTPLAQA

SEQ ID NO: 41225 - protein, 15 aa, Mycobacterium avium
PGPTGEQHVAYLKRP

SEQ ID NO: 41226 - protein, 4 aa, Mycobacterium avium
PGPV

SEQ ID NO: 41227 - protein, 5 aa, Mycobacterium avium
PGPVA

SEQ ID NO: 41228 - protein, 7 aa, Mycobacterium avium
PGPVSAQ

SEQ ID NO: 41229 - protein, 6 aa, Mycobacterium avium
PGPYPW

SEQ ID NO: 41230 - protein, 8 aa, Mycobacterium avium
PGQAGATA

SEQ ID NO: 41231 - protein, 5 aa, Mycobacterium avium
PGQRI

SEQ ID NO: 41232 - protein, 10 aa, Mycobacterium avium
PGRDPYHPNQ

SEQ ID NO: 41233 - protein, 7 aa, Mycobacterium avium
PGREGFP

SEQ ID NO: 41234 - protein, 7 aa, Mycobacterium avium
PGRGGGF

SEQ ID NO: 41235 - protein, 10 aa, Mycobacterium avium
PGRGSTYSAS

SEQ ID NO: 41236 - protein, 9 aa, Mycobacterium avium
PGRGTQPTA

SEQ ID NO: 41237 - protein, 12 aa, Mycobacterium avium
PGRHEDADRGAD

SEQ ID NO: 41238 - protein, 15 aa, Mycobacterium avium
PGRKSGAARSTPVTP

SEQ ID NO: 41239 - protein, 7 aa, Mycobacterium avium
PGRPAPR

SEQ ID NO: 41240 - protein, 5 aa, Mycobacterium avium
PGRPP

SEQ ID NO: 41241 - protein, 10 aa, Mycobacterium avium
PGRPPRTGAE

SEQ ID NO: 41242 - protein, 13 aa, Mycobacterium avium
PGRTDASQESTDV

SEQ ID NO: 41243 - protein, 5 aa, Mycobacterium avium
PGRTI

SEQ ID NO: 41244 - protein, 7 aa, Mycobacterium avium
PGRTITE

SEQ ID NO: 41245 - protein, 7 aa, Mycobacterium avium
PGRVTGR

SEQ ID NO: 41246 - protein, 12 aa, Mycobacterium avium
PGRWDDDGAKRI

SEQ ID NO: 41247 - protein, 22 aa, Mycobacterium avium
PGSAAPPATDRRRDGFARRSGQ

SEQ ID NO: 41248 - protein, 9 aa, Mycobacterium avium
PGSAPDLDG

SEQ ID NO: 41249 - protein, 7 aa, Mycobacterium avium
PGSDAPE

SEQ ID NO: 41250 - protein, 7 aa, Mycobacterium avium
PGSIASE

SEQ ID NO: 41251 - protein, 8 aa, Mycobacterium avium
PGSKEARI

SEQ ID NO: 41252 - protein, 4 aa, Mycobacterium avium
PGSP

SEQ ID NO: 41253 - protein, 9 aa, Mycobacterium avium
PGSPGGVRD

SEQ ID NO: 41254 - protein, 5 aa, Mycobacterium avium
PGSQG

SEQ ID NO: 41255 - protein, 11 aa, Mycobacterium avium
PGSQYLTPTAK

SEQ ID NO: 41256 - protein, 5 aa, Mycobacterium avium
PGSRF

SEQ ID NO: 41257 - protein, 12 aa, Mycobacterium avium
PGSVAKPSPPYA

SEQ ID NO: 41258 - protein, 7 aa, Mycobacterium avium
PGSVGKP

SEQ ID NO: 41259 - protein, 9 aa, Mycobacterium avium
PGSVGRGFR

SEQ ID NO: 41260 - protein, 6 aa, Mycobacterium avium
PGSVQP

SEQ ID NO: 41261 - protein, 23 aa, Mycobacterium avium
PGTAAPDPEAGAVPLEEKIVALL

SEQ ID NO: 41262 - protein, 11 aa, Mycobacterium avium
PGTAEPGADGA

SEQ ID NO: 41263 - protein, 7 aa, Mycobacterium avium
PGTAKRT

SEQ ID NO: 41264 - protein, 15 aa, Mycobacterium avium
PGTALPNAYPRAPHV

SEQ ID NO: 41265 - protein, 6 aa, Mycobacterium avium
PGTAQG

SEQ ID NO: 41266 - protein, 9 aa, Mycobacterium avium
PGTDSAPIQ

SEQ ID NO: 41267 - protein, 7 aa, Mycobacterium avium
PGTEAPA

SEQ ID NO: 41268 - protein, 11 aa, Mycobacterium avium
PGTGGSVSGTA

SEQ ID NO: 41269 - protein, 6 aa, Mycobacterium avium
PGTIGS

SEQ ID NO: 41270 - protein, 5 aa, Mycobacterium avium
PGTIN

SEQ ID NO: 41271 - protein, 16 aa, Mycobacterium avium
PGTLKQGEATKRTGTT

SEQ ID NO: 41272 - protein, 5 aa, Mycobacterium avium
PGTMN

SEQ ID NO: 41273 - protein, 8 aa, Mycobacterium avium
PGTNGQVS

SEQ ID NO: 41274 - protein, 12 aa, Mycobacterium avium
PGTNWKSNPNAM

SEQ ID NO: 41275 - protein, 6 aa, Mycobacterium avium
PGTPAG

SEQ ID NO: 41276 - protein, 5 aa, Mycobacterium avium
PGTPM

SEQ ID NO: 41277 - protein, 16 aa, Mycobacterium avium
PGTRPAPAFTPARPDE

SEQ ID NO: 41278 - protein, 4 aa, Mycobacterium avium
PGTT

SEQ ID NO: 41279 - protein, 6 aa, Mycobacterium avium
PGTTMT

SEQ ID NO: 41280 - protein, 11 aa, Mycobacterium avium
PGTTSVHSSGL

SEQ ID NO: 41281 - protein, 5 aa, Mycobacterium avium
PGTTV

SEQ ID NO: 41282 - protein, 4 aa, Mycobacterium avium
PGVD

SEQ ID NO: 41283 - protein, 21 aa, Mycobacterium avium
PGVDAAPRTPGRDGEVTRSEQ

SEQ ID NO: 41284 - protein, 9 aa, Mycobacterium avium
PGVDPGPTH

SEQ ID NO: 41285 - protein, 5 aa, Mycobacterium avium
PGVGK

SEQ ID NO: 41286 - protein, 5 aa, Mycobacterium avium
PGVKP

SEQ ID NO: 41287 - protein, 5 aa, Mycobacterium avium
PGVQQ

SEQ ID NO: 41288 - protein, 7 aa, Mycobacterium avium
PGVRNYD

SEQ ID NO: 41289 - protein, 6 aa, Mycobacterium avium
PGVSGE

SEQ ID NO: 41290 - protein, 11 aa, Mycobacterium avium
PGVSPQDVREA

SEQ ID NO: 41291 - protein, 12 aa, Mycobacterium avium
PGVTETAASRTY

SEQ ID NO: 41292 - protein, 7 aa, Mycobacterium avium
PGVTRDR

SEQ ID NO: 41293 - protein, 6 aa, Mycobacterium avium
PGYKPS

SEQ ID NO: 41294 - protein, 11 aa, Mycobacterium avium
PGYPGGTDKVG

SEQ ID NO: 41295 - protein, 8 aa, Mycobacterium avium
PGYTDPSK

SEQ ID NO: 41296 - protein, 6 aa, Mycobacterium avium
PGYTSA

SEQ ID NO: 41297 - protein, 5 aa, Mycobacterium avium
PHAFT

SEQ ID NO: 41298 - protein, 10 aa, Mycobacterium avium
PHAPDTHSPL

SEQ ID NO: 41299 - protein, 4 aa, Mycobacterium avium
PHDA

SEQ ID NO: 41300 - protein, 7 aa, Mycobacterium avium
PHDDKQV

SEQ ID NO: 41301 - protein, 4 aa, Mycobacterium avium
PHDI

SEQ ID NO: 41302 - protein, 4 aa, Mycobacterium avium
PHDP

SEQ ID NO: 41303 - protein, 5 aa, Mycobacterium avium
PHEPI

SEQ ID NO: 41304 - protein, 6 aa, Mycobacterium avium
PHETGR

SEQ ID NO: 41305 - protein, 7 aa, Mycobacterium avium
PHGEGLA

SEQ ID NO: 41306 - protein, 7 aa, Mycobacterium avium
PHGNGET

SEQ ID NO: 41307 - protein, 10 aa, Mycobacterium avium
PHGTPEEPRG

SEQ ID NO: 41308 - protein, 15 aa, Mycobacterium avium
PHKKARTYSKGNRQK

SEQ ID NO: 41309 - protein, 19 aa, Mycobacterium avium
PHKTSSRRVEVRSPDSACN

SEQ ID NO: 41310 - protein, 4 aa, Mycobacterium avium
PHPD

SEQ ID NO: 41311 - protein, 13 aa, Mycobacterium avium
PHPDDPRAAGPSR

SEQ ID NO: 41312 - protein, 6 aa, Mycobacterium avium
PHPEGL

SEQ ID NO: 41313 - protein, 8 aa, Mycobacterium avium
PHPEGTWP

SEQ ID NO: 41314 - protein, 5 aa, Mycobacterium avium
PHPPY

SEQ ID NO: 41315 - protein, 4 aa, Mycobacterium avium
PHPR

SEQ ID NO: 41316 - protein, 8 aa, Mycobacterium avium
PHPTDGRT

SEQ ID NO: 41317 - protein, 7 aa, Mycobacterium avium
PHPTSRR

SEQ ID NO: 41318 - protein, 7 aa, Mycobacterium avium
PHQPSEH

SEQ ID NO: 41319 - protein, 14 aa, Mycobacterium avium
PHRGNEPMTEKPSW

SEQ ID NO: 41320 - protein, 6 aa, Mycobacterium avium
PHRQSE

SEQ ID NO: 41321 - protein, 7 aa, Mycobacterium avium
PHRYPQR

SEQ ID NO: 41322 - protein, 5 aa, Mycobacterium avium
PHSAD

SEQ ID NO: 41323 - protein, 4 aa, Mycobacterium avium
PHSD

SEQ ID NO: 41324 - protein, 5 aa, Mycobacterium avium
PHSDS

SEQ ID NO: 41325 - protein, 17 aa, Mycobacterium avium
PHSLQSTWGGQAPPPDM

SEQ ID NO: 41326 - protein, 10 aa, Mycobacterium avium
PHTEEPTNWS

SEQ ID NO: 41327 - protein, 16 aa, Mycobacterium avium
PHTTSDDPTRYRTQDE

SEQ ID NO: 41328 - protein, 15 aa, Mycobacterium avium
PHVADPGRIDAAGRR

SEQ ID NO: 41329 - protein, 11 aa, Mycobacterium avium
PHYEGTAPYTR

SEQ ID NO: 41330 - protein, 5 aa, Mycobacterium avium
PIADG

SEQ ID NO: 41331 - protein, 11 aa, Mycobacterium avium
PIADPVSRTQV

SEQ ID NO: 41332 - protein, 5 aa, Mycobacterium avium
PIAKP

SEQ ID NO: 41333 - protein, 7 aa, Mycobacterium avium
PIEQGDE

SEQ ID NO: 41334 - protein, 8 aa, Mycobacterium avium
PIESDEEL

SEQ ID NO: 41335 - protein, 4 aa, Mycobacterium avium
PIGE

SEQ ID NO: 41336 - protein, 5 aa, Mycobacterium avium
PIGEE

SEQ ID NO: 41337 - protein, 5 aa, Mycobacterium avium
PIGEH

SEQ ID NO: 41338 - protein, 10 aa, Mycobacterium avium
PIGGPGEAAA

SEQ ID NO: 41339 - protein, 5 aa, Mycobacterium avium
PIGRG

SEQ ID NO: 41340 - protein, 5 aa, Mycobacterium avium
PIGTA

SEQ ID NO: 41341 - protein, 4 aa, Mycobacterium avium
PING

SEQ ID NO: 41342 - protein, 10 aa, Mycobacterium avium
PIPADQEQLA

SEQ ID NO: 41343 - protein, 13 aa, Mycobacterium avium
PIPDPNRAGPSTL

SEQ ID NO: 41344 - protein, 7 aa, Mycobacterium avium
PIPPGSY

SEQ ID NO: 41345 - protein, 4 aa, Mycobacterium avium
PIPR

SEQ ID NO: 41346 - protein, 5 aa, Mycobacterium avium
PIPTT

SEQ ID NO: 41347 - protein, 10 aa, Mycobacterium avium
PIPVGTQGGS

SEQ ID NO: 41348 - protein, 8 aa, Mycobacterium avium
PIRPPQRL

SEQ ID NO: 41349 - protein, 10 aa, Mycobacterium avium
PISDTTVSVD

SEQ ID NO: 41350 - protein, 15 aa, Mycobacterium avium
PISHPDTAILAMLLA

SEQ ID NO: 41351 - protein, 5 aa, Mycobacterium avium
PITAT

SEQ ID NO: 41352 - protein, 5 aa, Mycobacterium avium
PITDG

SEQ ID NO: 41353 - protein, 7 aa, Mycobacterium avium
PITKASD

SEQ ID NO: 41354 - protein, 5 aa, Mycobacterium avium
PITPA

SEQ ID NO: 41355 - protein, 6 aa, Mycobacterium avium
PITRTP

SEQ ID NO: 41356 - protein, 6 aa, Mycobacterium avium
PKADGV

SEQ ID NO: 41357 - protein, 5 aa, Mycobacterium avium
PKAIN

SEQ ID NO: 41358 - protein, 6 aa, Mycobacterium avium
PKAPQP

SEQ ID NO: 41359 - protein, 11 aa, Mycobacterium avium
PKAQKRKDGAT

SEQ ID NO: 41360 - protein, 10 aa, Mycobacterium avium
PKATPAQTQA

SEQ ID NO: 41361 - protein, 8 aa, Mycobacterium avium
PKDALGAG

SEQ ID NO: 41362 - protein, 6 aa, Mycobacterium avium
PKDREL

SEQ ID NO: 41363 - protein, 10 aa, Mycobacterium avium
PKDRPETESA

SEQ ID NO: 41364 - protein, 4 aa, Mycobacterium avium
PKDT

SEQ ID NO: 41365 - protein, 7 aa, Mycobacterium avium
PKDVGRT

SEQ ID NO: 41366 - protein, 7 aa, Mycobacterium avium
PKDVQAV

SEQ ID NO: 41367 - protein, 5 aa, Mycobacterium avium
PKEFG

SEQ ID NO: 41368 - protein, 7 aa, Mycobacterium avium
PKEVGAD

SEQ ID NO: 41369 - protein, 6 aa, Mycobacterium avium
PKGEAE

SEQ ID NO: 41370 - protein, 7 aa, Mycobacterium avium
PKGEYGA

SEQ ID NO: 41371 - protein, 13 aa, Mycobacterium avium
PKGKVDPGETAPV

SEQ ID NO: 41372 - protein, 7 aa, Mycobacterium avium
PKGLTGV

SEQ ID NO: 41373 - protein, 6 aa, Mycobacterium avium
PKGPGH

SEQ ID NO: 41374 - protein, 8 aa, Mycobacterium avium
PKGSGTLR

SEQ ID NO: 41375 - protein, 16 aa, Mycobacterium avium
PKGTRLARPIDAVREI

SEQ ID NO: 41376 - protein, 8 aa, Mycobacterium avium
PKGWTGPK

SEQ ID NO: 41377 - protein, 4 aa, Mycobacterium avium
PKLR

SEQ ID NO: 41378 - protein, 9 aa, Mycobacterium avium
PKLSAGRVQ

SEQ ID NO: 41379 - protein, 8 aa, Mycobacterium avium
PKNKPSDT

SEQ ID NO: 41380 - protein, 4 aa, Mycobacterium avium
PKNV

SEQ ID NO: 41381 - protein, 13 aa, Mycobacterium avium
PKPAERQVRKAQR

SEQ ID NO: 41382 - protein, 7 aa, Mycobacterium avium
PKPLQDN

SEQ ID NO: 41383 - protein, 5 aa, Mycobacterium avium
PKQEY

SEQ ID NO: 41384 - protein, 14 aa, Mycobacterium avium
PKRPAGQKLPPTSK

SEQ ID NO: 41385 - protein, 7 aa, Mycobacterium avium
PKRRPLD

SEQ ID NO: 41386 - protein, 13 aa, Mycobacterium avium
PKRSRKAGPSSRL

SEQ ID NO: 41387 - protein, 8 aa, Mycobacterium avium
PKSDGGGA

SEQ ID NO: 41388 - protein, 9 aa, Mycobacterium avium
PKSEGHRGG

SEQ ID NO: 41389 - protein, 10 aa, Mycobacterium avium
PKSGPSKEEL

SEQ ID NO: 41390 - protein, 10 aa, Mycobacterium avium
PKSGYPGHPA

SEQ ID NO: 41391 - protein, 15 aa, Mycobacterium avium
PKSLRDKLATGRGFD

SEQ ID NO: 41392 - protein, 14 aa, Mycobacterium avium
PKSQGAQTIRPDSV

SEQ ID NO: 41393 - protein, 7 aa, Mycobacterium avium
PKTASEQ

SEQ ID NO: 41394 - protein, 4 aa, Mycobacterium avium
PKTH

SEQ ID NO: 41395 - protein, 15 aa, Mycobacterium avium
PKTKRTKTGYTTDAD

SEQ ID NO: 41396 - protein, 7 aa, Mycobacterium avium
PKTRSGK

SEQ ID NO: 41397 - protein, 9 aa, Mycobacterium avium
PKTTAPVGP

SEQ ID NO: 41398 - protein, 13 aa, Mycobacterium avium
PKYTVTSGSITLD

SEQ ID NO: 41399 - protein, 4 aa, Mycobacterium avium
PLAA

SEQ ID NO: 41400 - protein, 16 aa, Mycobacterium avium
PLAAGAGAPPLGSPVA

SEQ ID NO: 41401 - protein, 9 aa, Mycobacterium avium
PLAAPDGPL

SEQ ID NO: 41402 - protein, 8 aa, Mycobacterium avium
PLADTGAE

SEQ ID NO: 41403 - protein, 13 aa, Mycobacterium avium
PLAGPSTPLRWVS

SEQ ID NO: 41404 - protein, 10 aa, Mycobacterium avium
PLAGRGRTGQ

SEQ ID NO: 41405 - protein, 12 aa, Mycobacterium avium
PLAQPGTGDAGG

SEQ ID NO: 41406 - protein, 10 aa, Mycobacterium avium
PLASGGNAVK

SEQ ID NO: 41407 - protein, 4 aa, Mycobacterium avium
PLDA

SEQ ID NO: 41408 - protein, 6 aa, Mycobacterium avium
PLDDKA

SEQ ID NO: 41409 - protein, 5 aa, Mycobacterium avium
PLDEP

SEQ ID NO: 41410 - protein, 5 aa, Mycobacterium avium
PLDPE

SEQ ID NO: 41411 - protein, 6 aa, Mycobacterium avium
PLDPGD

SEQ ID NO: 41412 - protein, 14 aa, Mycobacterium avium
PLDPPGTPDDPETT

SEQ ID NO: 41413 - protein, 21 aa, Mycobacterium avium
PLDTGAEPAALAAAGPPVAGG

SEQ ID NO: 41414 - protein, 12 aa, Mycobacterium avium
PLDYPEDKTELT

SEQ ID NO: 41415 - protein, 9 aa, Mycobacterium avium
PLFGTEPDA

SEQ ID NO: 41416 - protein, 6 aa, Mycobacterium avium
PLGAGK

SEQ ID NO: 41417 - protein, 5 aa, Mycobacterium avium
PLGAQ

SEQ ID NO: 41418 - protein, 7 aa, Mycobacterium avium
PLGGSGA

SEQ ID NO: 41419 - protein, 5 aa, Mycobacterium avium
PLGPN

SEQ ID NO: 41420 - protein, 7 aa, Mycobacterium avium
PLGSTGE

SEQ ID NO: 41421 - protein, 7 aa, Mycobacterium avium
PLGTGGQ

SEQ ID NO: 41422 - protein, 6 aa, Mycobacterium avium
PLHPTG

SEQ ID NO: 41423 - protein, 10 aa, Mycobacterium avium
PLPAETGPAP

SEQ ID NO: 41424 - protein, 6 aa, Mycobacterium avium
PLPAEY

SEQ ID NO: 41425 - protein, 7 aa, Mycobacterium avium
PLPAPDD

SEQ ID NO: 41426 - protein, 16 aa, Mycobacterium avium
PLPAPQTEPASRTPGL

SEQ ID NO: 41427 - protein, 5 aa, Mycobacterium avium
PLPDD

SEQ ID NO: 41428 - protein, 14 aa, Mycobacterium avium
PLPDPAPARAGTPT

SEQ ID NO: 41429 - protein, 6 aa, Mycobacterium avium
PLPDSS

SEQ ID NO: 41430 - protein, 7 aa, Mycobacterium avium
PLPEGSG

SEQ ID NO: 41431 - protein, 7 aa, Mycobacterium avium
PLPGDHP

SEQ ID NO: 41432 - protein, 7 aa, Mycobacterium avium
PLPGKAP

SEQ ID NO: 41433 - protein, 9 aa, Mycobacterium avium
PLPGNPDPV

SEQ ID NO: 41434 - protein, 5 aa, Mycobacterium avium
PLPGS

SEQ ID NO: 41435 - protein, 11 aa, Mycobacterium avium
PLPKVEPAAPQ

SEQ ID NO: 41436 - protein, 12 aa, Mycobacterium avium
PLPNTAGCRGAA

SEQ ID NO: 41437 - protein, 7 aa, Mycobacterium avium
PLPPLPG

SEQ ID NO: 41438 - protein, 8 aa, Mycobacterium avium
PLPPPPPA

SEQ ID NO: 41439 - protein, 8 aa, Mycobacterium avium
PLPPPRDP

SEQ ID NO: 41440 - protein, 9 aa, Mycobacterium avium
PLPQETADA

SEQ ID NO: 41441 - protein, 7 aa, Mycobacterium avium
PLPRPEC

SEQ ID NO: 41442 - protein, 7 aa, Mycobacterium avium
PLQKPHP

SEQ ID NO: 41443 - protein, 8 aa, Mycobacterium avium
PLQPRGDR

SEQ ID NO: 41444 - protein, 7 aa, Mycobacterium avium
PLQQPTR

SEQ ID NO: 41445 - protein, 11 aa, Mycobacterium avium
PLQSTEPGAPF

SEQ ID NO: 41446 - protein, 6 aa, Mycobacterium avium
PLQTEQ

SEQ ID NO: 41447 - protein, 11 aa, Mycobacterium avium
PLRDEGQSYAE

SEQ ID NO: 41448 - protein, 7 aa, Mycobacterium avium
PLRDGGY

SEQ ID NO: 41449 - protein, 7 aa, Mycobacterium avium
PLRGDRE

SEQ ID NO: 41450 - protein, 13 aa, Mycobacterium avium
PLRPPQRINPGAR

SEQ ID NO: 41451 - protein, 14 aa, Mycobacterium avium
PLRPRERARRRATV

SEQ ID NO: 41452 - protein, 14 aa, Mycobacterium avium
PLRRDTRGERQAKP

SEQ ID NO: 41453 - protein, 10 aa, Mycobacterium avium
PLSGRSGGNL

SEQ ID NO: 41454 - protein, 9 aa, Mycobacterium avium
PLSGVGPDQ

SEQ ID NO: 41455 - protein, 8 aa, Mycobacterium avium
PLSPERAR

SEQ ID NO: 41456 - protein, 6 aa, Mycobacterium avium
PLTAEQ

SEQ ID NO: 41457 - protein, 8 aa, Mycobacterium avium
PLTAETEA

SEQ ID NO: 41458 - protein, 7 aa, Mycobacterium avium
PLTAGSG

SEQ ID NO: 41459 - protein, 12 aa, Mycobacterium avium
PLTEEQRTQIEE

SEQ ID NO: 41460 - protein, 6 aa, Mycobacterium avium
PLTGQI

SEQ ID NO: 41461 - protein, 5 aa, Mycobacterium avium
PLTPG

SEQ ID NO: 41462 - protein, 17 aa, Mycobacterium avium
PLTSTTNPGAAAAVDNG

SEQ ID NO: 41463 - protein, 11 aa, Mycobacterium avium
PMKDPGDGSVI

SEQ ID NO: 41464 - protein, 17 aa, Mycobacterium avium
PMKRGPNSSGKSEQPFT

SEQ ID NO: 41465 - protein, 5 aa, Mycobacterium avium
PMPGA

SEQ ID NO: 41466 - protein, 16 aa, Mycobacterium avium
PMPVGGSTAPAVLGTD

SEQ ID NO: 41467 - protein, 11 aa, Mycobacterium avium
PMSTPDDLAET

SEQ ID NO: 41468 - protein, 9 aa, Mycobacterium avium
PNAAESERE

SEQ ID NO: 41469 - protein, 4 aa, Mycobacterium avium
PNAP

SEQ ID NO: 41470 - protein, 7 aa, Mycobacterium avium
PNAPGSI

SEQ ID NO: 41471 - protein, 5 aa, Mycobacterium avium
PNAPS

SEQ ID NO: 41472 - protein, 6 aa, Mycobacterium avium
PNARPP

SEQ ID NO: 41473 - protein, 5 aa, Mycobacterium avium
PNATE

SEQ ID NO: 41474 - protein, 11 aa, Mycobacterium avium
PNDFTGIPPED

SEQ ID NO: 41475 - protein, 5 aa, Mycobacterium avium
PNDYA

SEQ ID NO: 41476 - protein, 4 aa, Mycobacterium avium
PNEV

SEQ ID NO: 41477 - protein, 8 aa, Mycobacterium avium
PNGAGKTS

SEQ ID NO: 41478 - protein, 7 aa, Mycobacterium avium
PNGAPAL

SEQ ID NO: 41479 - protein, 23 aa, Mycobacterium avium
PNGEQRCVGPDETPPEGWEQDPD

SEQ ID NO: 41480 - protein, 5 aa, Mycobacterium avium
PNGHH

SEQ ID NO: 41481 - protein, 5 aa, Mycobacterium avium
PNGPV

SEQ ID NO: 41482 - protein, 10 aa, Mycobacterium avium
PNGQGAAVDG

SEQ ID NO: 41483 - protein, 10 aa, Mycobacterium avium
PNGTVTAGNA

SEQ ID NO: 41484 - protein, 7 aa, Mycobacterium avium
PNGVGKT

SEQ ID NO: 41485 - protein, 13 aa, Mycobacterium avium
PNHKGGNASGRAV

SEQ ID NO: 41486 - protein, 26 aa, Mycobacterium avium
PNHPAAKRAQSPPRRPAKRTEETETV

SEQ ID NO: 41487 - protein, 10 aa, Mycobacterium avium
PNHRPDAPAT

SEQ ID NO: 41488 - protein, 5 aa, Mycobacterium avium
PNIGG

SEQ ID NO: 41489 - protein, 7 aa, Mycobacterium avium
PNKPGVN

SEQ ID NO: 41490 - protein, 9 aa, Mycobacterium avium
PNLAPEEAH

SEQ ID NO: 41491 - protein, 5 aa, Mycobacterium avium
PNLPP

SEQ ID NO: 41492 - protein, 8 aa, Mycobacterium avium
PNNPTGAV

SEQ ID NO: 41493 - protein, 10 aa, Mycobacterium avium
PNNPTSTVVD

SEQ ID NO: 41494 - protein, 4 aa, Mycobacterium avium
PNPA

SEQ ID NO: 41495 - protein, 7 aa, Mycobacterium avium
PNPAAAA

SEQ ID NO: 41496 - protein, 9 aa, Mycobacterium avium
PNPAGGTDI

SEQ ID NO: 41497 - protein, 11 aa, Mycobacterium avium
PNPDAAASWEE

SEQ ID NO: 41498 - protein, 6 aa, Mycobacterium avium
PNPGLA

SEQ ID NO: 41499 - protein, 8 aa, Mycobacterium avium
PNPTPEQL

SEQ ID NO: 41500 - protein, 21 aa, Mycobacterium avium
PNPVEPPTGIAPDPSAAKPWL

SEQ ID NO: 41501 - protein, 18 aa, Mycobacterium avium
PNPVGSLAPTDGTPVPED

SEQ ID NO: 41502 - protein, 9 aa, Mycobacterium avium
PNPVPRAGG

SEQ ID NO: 41503 - protein, 4 aa, Mycobacterium avium
PNRD

SEQ ID NO: 41504 - protein, 5 aa, Mycobacterium avium
PNRDG

SEQ ID NO: 41505 - protein, 6 aa, Mycobacterium avium
PNRESA

SEQ ID NO: 41506 - protein, 8 aa, Mycobacterium avium
PNRGKRSV

SEQ ID NO: 41507 - protein, 10 aa, Mycobacterium avium
PNSGQSCNAP

SEQ ID NO: 41508 - protein, 11 aa, Mycobacterium avium
PNTGAPASTTV

SEQ ID NO: 41509 - protein, 12 aa, Mycobacterium avium
PNTGAVTGEPDV

SEQ ID NO: 41510 - protein, 11 aa, Mycobacterium avium
PNTNGPGQPGL

SEQ ID NO: 41511 - protein, 7 aa, Mycobacterium avium
PNTSSNI

SEQ ID NO: 41512 - protein, 7 aa, Mycobacterium avium
PNVQQAT

SEQ ID NO: 41513 - protein, 5 aa, Mycobacterium avium
PNYPA

SEQ ID NO: 41514 - protein, 20 aa, Mycobacterium avium
PNYSVPAGNRPLSDSDRAEV

SEQ ID NO: 41515 - protein, 27 aa, Mycobacterium avium
PPAAAASVTAPAKPDPPTPTRPASSST

SEQ ID NO: 41516 - protein, 8 aa, Mycobacterium avium
PPAADPVS

SEQ ID NO: 41517 - protein, 8 aa, Mycobacterium avium
PPADADDT

SEQ ID NO: 41518 - protein, 5 aa, Mycobacterium avium
PPAER

SEQ ID NO: 41519 - protein, 14 aa, Mycobacterium avium
PPAGAAGLGQPGLF

SEQ ID NO: 41520 - protein, 8 aa, Mycobacterium avium
PPAKPGEE

SEQ ID NO: 41521 - protein, 13 aa, Mycobacterium avium
PPALPDGVSQATI

SEQ ID NO: 41522 - protein, 9 aa, Mycobacterium avium
PPALSAEQR

SEQ ID NO: 41523 - protein, 4 aa, Mycobacterium avium
PPAP

SEQ ID NO: 41524 - protein, 15 aa, Mycobacterium avium
PPAPAEGHYIAQSLF

SEQ ID NO: 41525 - protein, 6 aa, Mycobacterium avium
PPAPGF

SEQ ID NO: 41526 - protein, 14 aa, Mycobacterium avium
PPAPPPARTGADRT

SEQ ID NO: 41527 - protein, 8 aa, Mycobacterium avium
PPAPSDDV

SEQ ID NO: 41528 - protein, 5 aa, Mycobacterium avium
PPAPT

SEQ ID NO: 41529 - protein, 7 aa, Mycobacterium avium
PPAPTLA

SEQ ID NO: 41530 - protein, 9 aa, Mycobacterium avium
PPAQPEPVA

SEQ ID NO: 41531 - protein, 7 aa, Mycobacterium avium
PPARASA

SEQ ID NO: 41532 - protein, 13 aa, Mycobacterium avium
PPASVTGTPKHRA

SEQ ID NO: 41533 - protein, 7 aa, Mycobacterium avium
PPATTDY

SEQ ID NO: 41534 - protein, 13 aa, Mycobacterium avium
PPAVPPGPDPAAL

SEQ ID NO: 41535 - protein, 7 aa, Mycobacterium avium
PPDAAAR

SEQ ID NO: 41536 - protein, 7 aa, Mycobacterium avium
PPDADPG

SEQ ID NO: 41537 - protein, 6 aa, Mycobacterium avium
PPDASS

SEQ ID NO: 41538 - protein, 8 aa, Mycobacterium avium
PPDDPRVR

SEQ ID NO: 41539 - protein, 6 aa, Mycobacterium avium
PPDGNT

SEQ ID NO: 41540 - protein, 11 aa, Mycobacterium avium
PPDGPPRTGRF

SEQ ID NO: 41541 - protein, 7 aa, Mycobacterium avium
PPDGYGG

SEQ ID NO: 41542 - protein, 5 aa, Mycobacterium avium
PPDID

SEQ ID NO: 41543 - protein, 5 aa, Mycobacterium avium
PPDPA

SEQ ID NO: 41544 - protein, 9 aa, Mycobacterium avium
PPDPEWPAQ

SEQ ID NO: 41545 - protein, 7 aa, Mycobacterium avium
PPDPRVP

SEQ ID NO: 41546 - protein, 6 aa, Mycobacterium avium
PPDPSS

SEQ ID NO: 41547 - protein, 5 aa, Mycobacterium avium
PPDRE

SEQ ID NO: 41548 - protein, 6 aa, Mycobacterium avium
PPDRGR

SEQ ID NO: 41549 - protein, 5 aa, Mycobacterium avium
PPDRK

SEQ ID NO: 41550 - protein, 9 aa, Mycobacterium avium
PPDRRSVRD

SEQ ID NO: 41551 - protein, 13 aa, Mycobacterium avium
PPDSRPGQPPVGP

SEQ ID NO: 41552 - protein, 5 aa, Mycobacterium avium
PPDSY

SEQ ID NO: 41553 - protein, 10 aa, Mycobacterium avium
PPDTPPRAQT

SEQ ID NO: 41554 - protein, 5 aa, Mycobacterium avium
PPDTR

SEQ ID NO: 41555 - protein, 8 aa, Mycobacterium avium
PPDVDGVS

SEQ ID NO: 41556 - protein, 7 aa, Mycobacterium avium
PPEALGP

SEQ ID NO: 41557 - protein, 6 aa, Mycobacterium avium
PPEDGP

SEQ ID NO: 41558 - protein, 5 aa, Mycobacterium avium
PPEGL

SEQ ID NO: 41559 - protein, 4 aa, Mycobacterium avium
PPEH

SEQ ID NO: 41560 - protein, 8 aa, Mycobacterium avium
PPEHDKAR

SEQ ID NO: 41561 - protein, 14 aa, Mycobacterium avium
PPEHGGETGPPAHD

SEQ ID NO: 41562 - protein, 8 aa, Mycobacterium avium
PPEHTRYR

SEQ ID NO: 41563 - protein, 4 aa, Mycobacterium avium
PPEI

SEQ ID NO: 41564 - protein, 5 aa, Mycobacterium avium
PPEKL

SEQ ID NO: 41565 - protein, 6 aa, Mycobacterium avium
PPELNK

SEQ ID NO: 41566 - protein, 16 aa, Mycobacterium avium
PPEPPDDIEPIGPGHP

SEQ ID NO: 41567 - protein, 4 aa, Mycobacterium avium
PPER

SEQ ID NO: 41568 - protein, 11 aa, Mycobacterium avium
PPETAGKPPEL

SEQ ID NO: 41569 - protein, 5 aa, Mycobacterium avium
PPFAN

SEQ ID NO: 41570 - protein, 6 aa, Mycobacterium avium
PPGEFP

SEQ ID NO: 41571 - protein, 6 aa, Mycobacterium avium
PPGEIG

SEQ ID NO: 41572 - protein, 7 aa, Mycobacterium avium
PPGQTHA

SEQ ID NO: 41573 - protein, 6 aa, Mycobacterium avium
PPGRVA

SEQ ID NO: 41574 - protein, 5 aa, Mycobacterium avium
PPGTG

SEQ ID NO: 41575 - protein, 6 aa, Mycobacterium avium
PPGTGD

SEQ ID NO: 41576 - protein, 12 aa, Mycobacterium avium
PPGTGKTTTAEA

SEQ ID NO: 41577 - protein, 9 aa, Mycobacterium avium
PPGTPSARR

SEQ ID NO: 41578 - protein, 8 aa, Mycobacterium avium
PPGVEDGQ

SEQ ID NO: 41579 - protein, 8 aa, Mycobacterium avium
PPGVSTRA

SEQ ID NO: 41580 - protein, 5 aa, Mycobacterium avium
PPHDP

SEQ ID NO: 41581 - protein, 6 aa, Mycobacterium avium
PPHEEL

SEQ ID NO: 41582 - protein, 5 aa, Mycobacterium avium
PPHVT

SEQ ID NO: 41583 - protein, 5 aa, Mycobacterium avium
PPIAG

SEQ ID NO: 41584 - protein, 7 aa, Mycobacterium avium
PPIGRSG

SEQ ID NO: 41585 - protein, 16 aa, Mycobacterium avium
PPKLHDKKPGGNRPWR

SEQ ID NO: 41586 - protein, 5 aa, Mycobacterium avium
PPKPL

SEQ ID NO: 41587 - protein, 5 aa, Mycobacterium avium
PPKPS

SEQ ID NO: 41588 - protein, 4 aa, Mycobacterium avium
PPKV

SEQ ID NO: 41589 - protein, 12 aa, Mycobacterium avium
PPLNGDNLDPRL

SEQ ID NO: 41590 - protein, 7 aa, Mycobacterium avium
PPLPPEL

SEQ ID NO: 41591 - protein, 8 aa, Mycobacterium avium
PPLPPVPD

SEQ ID NO: 41592 - protein, 19 aa, Mycobacterium avium
PPLPSGDGAADRDATRAEG

SEQ ID NO: 41593 - protein, 11 aa, Mycobacterium avium
PPLPTSSEGFP

SEQ ID NO: 41594 - protein, 4 aa, Mycobacterium avium
PPMD

SEQ ID NO: 41595 - protein, 4 aa, Mycobacterium avium
PPMG

SEQ ID NO: 41596 - protein, 4 aa, Mycobacterium avium
PPMT

SEQ ID NO: 41597 - protein, 12 aa, Mycobacterium avium
PPNADEGRERAL

SEQ ID NO: 41598 - protein, 11 aa, Mycobacterium avium
PPNELPRRPGY

SEQ ID NO: 41599 - protein, 12 aa, Mycobacterium avium
PPNLDGAAQEAL

SEQ ID NO: 41600 - protein, 4 aa, Mycobacterium avium
PPNP

SEQ ID NO: 41601 - protein, 9 aa, Mycobacterium avium
PPNRYTQSE

SEQ ID NO: 41602 - protein, 5 aa, Mycobacterium avium
PPNVT

SEQ ID NO: 41603 - protein, 4 aa, Mycobacterium avium
PPPD

SEQ ID NO: 41604 - protein, 9 aa, Mycobacterium avium
PPPEPDSTV

SEQ ID NO: 41605 - protein, 9 aa, Mycobacterium avium
PPPGTPEDQ

SEQ ID NO: 41606 - protein, 7 aa, Mycobacterium avium
PPPKLGR

SEQ ID NO: 41607 - protein, 11 aa, Mycobacterium avium
PPPLGPDAPPL

SEQ ID NO: 41608 - protein, 4 aa, Mycobacterium avium
PPPP

SEQ ID NO: 41609 - protein, 5 aa, Mycobacterium avium
PPPRL

SEQ ID NO: 41610 - protein, 7 aa, Mycobacterium avium
PPQSRPN

SEQ ID NO: 41611 - protein, 5 aa, Mycobacterium avium
PPQVP

SEQ ID NO: 41612 - protein, 10 aa, Mycobacterium avium
PPRDNPYSGA

SEQ ID NO: 41613 - protein, 5 aa, Mycobacterium avium
PPRFT

SEQ ID NO: 41614 - protein, 5 aa, Mycobacterium avium
PPRGL

SEQ ID NO: 41615 - protein, 5 aa, Mycobacterium avium
PPRHT

SEQ ID NO: 41616 - protein, 8 aa, Mycobacterium avium
PPRPGERE

SEQ ID NO: 41617 - protein, 4 aa, Mycobacterium avium
PPRQ

SEQ ID NO: 41618 - protein, 7 aa, Mycobacterium avium
PPRQVPG

SEQ ID NO: 41619 - protein, 8 aa, Mycobacterium avium
PPRRPGAP

SEQ ID NO: 41620 - protein, 5 aa, Mycobacterium avium
PPRTV

SEQ ID NO: 41621 - protein, 11 aa, Mycobacterium avium
PPSAEPRATGH

SEQ ID NO: 41622 - protein, 10 aa, Mycobacterium avium
PPSAQAALAG

SEQ ID NO: 41623 - protein, 8 aa, Mycobacterium avium
PPSQDPVY

SEQ ID NO: 41624 - protein, 4 aa, Mycobacterium avium
PPST

SEQ ID NO: 41625 - protein, 10 aa, Mycobacterium avium
PPSTPDDLDH

SEQ ID NO: 41626 - protein, 9 aa, Mycobacterium avium
PPTANPGWS

SEQ ID NO: 41627 - protein, 9 aa, Mycobacterium avium
PPTATPTGR

SEQ ID NO: 41628 - protein, 6 aa, Mycobacterium avium
PPTDRR

SEQ ID NO: 41629 - protein, 10 aa, Mycobacterium avium
PPTGRGLPPR

SEQ ID NO: 41630 - protein, 5 aa, Mycobacterium avium
PPTPD

SEQ ID NO: 41631 - protein, 5 aa, Mycobacterium avium
PPTSG

SEQ ID NO: 41632 - protein, 20 aa, Mycobacterium avium
PPTTSAGTGWRKRKQQKYED

SEQ ID NO: 41633 - protein, 4 aa, Mycobacterium avium
PPTW

SEQ ID NO: 41634 - protein, 11 aa, Mycobacterium avium
PPTWASATPAI

SEQ ID NO: 41635 - protein, 8 aa, Mycobacterium avium
PPTWGATG

SEQ ID NO: 41636 - protein, 6 aa, Mycobacterium avium
PPVDAA

SEQ ID NO: 41637 - protein, 15 aa, Mycobacterium avium
PPVGAGADDLNDKKA

SEQ ID NO: 41638 - protein, 5 aa, Mycobacterium avium
PPVGQ

SEQ ID NO: 41639 - protein, 5 aa, Mycobacterium avium
PPVTV

SEQ ID NO: 41640 - protein, 6 aa, Mycobacterium avium
PPYVPD

SEQ ID NO: 41641 - protein, 10 aa, Mycobacterium avium
PPYVPTPPGA

SEQ ID NO: 41642 - protein, 7 aa, Mycobacterium avium
PQAGPST

SEQ ID NO: 41643 - protein, 5 aa, Mycobacterium avium
PQAQD

SEQ ID NO: 41644 - protein, 5 aa, Mycobacterium avium
PQARD

SEQ ID NO: 41645 - protein, 8 aa, Mycobacterium avium
PQASLDDK

SEQ ID NO: 41646 - protein, 6 aa, Mycobacterium avium
PQATEL

SEQ ID NO: 41647 - protein, 11 aa, Mycobacterium avium
PQATSYPHRGR

SEQ ID NO: 41648 - protein, 5 aa, Mycobacterium avium
PQAYR

SEQ ID NO: 41649 - protein, 4 aa, Mycobacterium avium
PQDD

SEQ ID NO: 41650 - protein, 10 aa, Mycobacterium avium
PQDPATSLNP

SEQ ID NO: 41651 - protein, 8 aa, Mycobacterium avium
PQDRRNYS

SEQ ID NO: 41652 - protein, 4 aa, Mycobacterium avium
PQEL

SEQ ID NO: 41653 - protein, 12 aa, Mycobacterium avium
PQFAAAQPDPAI

SEQ ID NO: 41654 - protein, 13 aa, Mycobacterium avium
PQGAAGEDIIGPK

SEQ ID NO: 41655 - protein, 5 aa, Mycobacterium avium
PQGDA

SEQ ID NO: 41656 - protein, 10 aa, Mycobacterium avium
PQGDEQPTDL

SEQ ID NO: 41657 - protein, 10 aa, Mycobacterium avium
PQGEHRAAYN

SEQ ID NO: 41658 - protein, 23 aa, Mycobacterium avium
PQGQRADGQNTESDRAGWTTPEA

SEQ ID NO: 41659 - protein, 5 aa, Mycobacterium avium
PQGSA

SEQ ID NO: 41660 - protein, 4 aa, Mycobacterium avium
PQGT

SEQ ID NO: 41661 - protein, 5 aa, Mycobacterium avium
PQGTL

SEQ ID NO: 41662 - protein, 8 aa, Mycobacterium avium
PQGTRKTL

SEQ ID NO: 41663 - protein, 7 aa, Mycobacterium avium
PQGVDGM

SEQ ID NO: 41664 - protein, 8 aa, Mycobacterium avium
PQHDALGT

SEQ ID NO: 41665 - protein, 23 aa, Mycobacterium avium
PQHEDARAADALREESYKVSGTA

SEQ ID NO: 41666 - protein, 7 aa, Mycobacterium avium
PQHPSTH

SEQ ID NO: 41667 - protein, 4 aa, Mycobacterium avium
PQHR

SEQ ID NO: 41668 - protein, 7 aa, Mycobacterium avium
PQLAPEP

SEQ ID NO: 41669 - protein, 12 aa, Mycobacterium avium
PQLDSTRTGSTA

SEQ ID NO: 41670 - protein, 7 aa, Mycobacterium avium
PQLETDS

SEQ ID NO: 41671 - protein, 6 aa, Mycobacterium avium
PQLPDG

SEQ ID NO: 41672 - protein, 10 aa, Mycobacterium avium
PQPAQHGGSY

SEQ ID NO: 41673 - protein, 4 aa, Mycobacterium avium
PQPD

SEQ ID NO: 41674 - protein, 6 aa, Mycobacterium avium
PQPDNR

SEQ ID NO: 41675 - protein, 5 aa, Mycobacterium avium
PQPGR

SEQ ID NO: 41676 - protein, 7 aa, Mycobacterium avium
PQPPVAA

SEQ ID NO: 41677 - protein, 4 aa, Mycobacterium avium
PQPQ

SEQ ID NO: 41678 - protein, 11 aa, Mycobacterium avium
PQPRPPRETWE

SEQ ID NO: 41679 - protein, 6 aa, Mycobacterium avium
PQPRQS

SEQ ID NO: 41680 - protein, 11 aa, Mycobacterium avium
PQPSDADEART

SEQ ID NO: 41681 - protein, 6 aa, Mycobacterium avium
PQPTPL

SEQ ID NO: 41682 - protein, 18 aa, Mycobacterium avium
PQQLPQVSQGTHPEPVDT

SEQ ID NO: 41683 - protein, 5 aa, Mycobacterium avium
PQRDR

SEQ ID NO: 41684 - protein, 5 aa, Mycobacterium avium
PQRGR

SEQ ID NO: 41685 - protein, 4 aa, Mycobacterium avium
PQRH

SEQ ID NO: 41686 - protein, 10 aa, Mycobacterium avium
PQRKGDPLQF

SEQ ID NO: 41687 - protein, 7 aa, Mycobacterium avium
PQRSIPP

SEQ ID NO: 41688 - protein, 8 aa, Mycobacterium avium
PQSDGGPG

SEQ ID NO: 41689 - protein, 5 aa, Mycobacterium avium
PQSGS

SEQ ID NO: 41690 - protein, 13 aa, Mycobacterium avium
PQSPVGKTDRAGI

SEQ ID NO: 41691 - protein, 8 aa, Mycobacterium avium
PQSRRELA

SEQ ID NO: 41692 - protein, 11 aa, Mycobacterium avium
PQSSINSGEGL

SEQ ID NO: 41693 - protein, 7 aa, Mycobacterium avium
PQTPAGQ

SEQ ID NO: 41694 - protein, 11 aa, Mycobacterium avium
PQTRQALGEGR

SEQ ID NO: 41695 - protein, 4 aa, Mycobacterium avium
PQWG

SEQ ID NO: 41696 - protein, 5 aa, Mycobacterium avium
PQYQP

SEQ ID NO: 41697 - protein, 11 aa, Mycobacterium avium
PRAAANSADDE

SEQ ID NO: 41698 - protein, 7 aa, Mycobacterium avium
PRAAEES

SEQ ID NO: 41699 - protein, 5 aa, Mycobacterium avium
PRAED

SEQ ID NO: 41700 - protein, 11 aa, Mycobacterium avium
PRAGAEGENRG

SEQ ID NO: 41701 - protein, 8 aa, Mycobacterium avium
PRAGEHGG

SEQ ID NO: 41702 - protein, 8 aa, Mycobacterium avium
PRAPDPLR

SEQ ID NO: 41703 - protein, 11 aa, Mycobacterium avium
PRAPKRMAGGE

SEQ ID NO: 41704 - protein, 4 aa, Mycobacterium avium
PRAR

SEQ ID NO: 41705 - protein, 11 aa, Mycobacterium avium
PRASSQPAAVS

SEQ ID NO: 41706 - protein, 6 aa, Mycobacterium avium
PRAVPR

SEQ ID NO: 41707 - protein, 8 aa, Mycobacterium avium
PRDGEDAD

SEQ ID NO: 41708 - protein, 8 aa, Mycobacterium avium
PRDGGNDE

SEQ ID NO: 41709 - protein, 7 aa, Mycobacterium avium
PRDGRGP

SEQ ID NO: 41710 - protein, 6 aa, Mycobacterium avium
PRDLGE

SEQ ID NO: 41711 - protein, 13 aa, Mycobacterium avium
PRDQASASRFNRR

SEQ ID NO: 41712 - protein, 7 aa, Mycobacterium avium
PRDRAAL

SEQ ID NO: 41713 - protein, 4 aa, Mycobacterium avium
PRDV

SEQ ID NO: 41714 - protein, 5 aa, Mycobacterium avium
PRDWE

SEQ ID NO: 41715 - protein, 4 aa, Mycobacterium avium
PRED

SEQ ID NO: 41716 - protein, 10 aa, Mycobacterium avium
PREDPDLRGK

SEQ ID NO: 41717 - protein, 4 aa, Mycobacterium avium
PREQ

SEQ ID NO: 41718 - protein, 5 aa, Mycobacterium avium
PREQP

SEQ ID NO: 41719 - protein, 16 aa, Mycobacterium avium
PRESDAAASPVPDDLD

SEQ ID NO: 41720 - protein, 16 aa, Mycobacterium avium
PRFGSDSSARHRSSGA

SEQ ID NO: 41721 - protein, 11 aa, Mycobacterium avium
PRGCGKTSSAR

SEQ ID NO: 41722 - protein, 7 aa, Mycobacterium avium
PRGFGDN

SEQ ID NO: 41723 - protein, 10 aa, Mycobacterium avium
PRGKAPIADV

SEQ ID NO: 41724 - protein, 7 aa, Mycobacterium avium
PRGNLSQ

SEQ ID NO: 41725 - protein, 5 aa, Mycobacterium avium
PRGRR

SEQ ID NO: 41726 - protein, 15 aa, Mycobacterium avium
PRGVHSTMSDDRGRP

SEQ ID NO: 41727 - protein, 5 aa, Mycobacterium avium
PRHDR

SEQ ID NO: 41728 - protein, 5 aa, Mycobacterium avium
PRHEY

SEQ ID NO: 41729 - protein, 12 aa, Mycobacterium avium
PRHGASYQRQRR

SEQ ID NO: 41730 - protein, 4 aa, Mycobacterium avium
PRHQ

SEQ ID NO: 41731 - protein, 13 aa, Mycobacterium avium
PRHQQTQAGQRER

SEQ ID NO: 41732 - protein, 5 aa, Mycobacterium avium
PRHSQ

SEQ ID NO: 41733 - protein, 10 aa, Mycobacterium avium
PRHTAPATPG

SEQ ID NO: 41734 - protein, 4 aa, Mycobacterium avium
PRKA

SEQ ID NO: 41735 - protein, 4 aa, Mycobacterium avium
PRKG

SEQ ID NO: 41736 - protein, 4 aa, Mycobacterium avium
PRKI

SEQ ID NO: 41737 - protein, 13 aa, Mycobacterium avium
PRKPSRTERRDKS

SEQ ID NO: 41738 - protein, 9 aa, Mycobacterium avium
PRKSVSGSL

SEQ ID NO: 41739 - protein, 5 aa, Mycobacterium avium
PRLGG

SEQ ID NO: 41740 - protein, 7 aa, Mycobacterium avium
PRLNTQQ

SEQ ID NO: 41741 - protein, 6 aa, Mycobacterium avium
PRLPGV

SEQ ID NO: 41742 - protein, 12 aa, Mycobacterium avium
PRLSGASPMTNL

SEQ ID NO: 41743 - protein, 4 aa, Mycobacterium avium
PRLT

SEQ ID NO: 41744 - protein, 11 aa, Mycobacterium avium
PRMPPRSPDAH

SEQ ID NO: 41745 - protein, 7 aa, Mycobacterium avium
PRNASGK

SEQ ID NO: 41746 - protein, 16 aa, Mycobacterium avium
PRNSGGKVVKPQLREL

SEQ ID NO: 41747 - protein, 7 aa, Mycobacterium avium
PRPAQAR

SEQ ID NO: 41748 - protein, 7 aa, Mycobacterium avium
PRPDWPD

SEQ ID NO: 41749 - protein, 7 aa, Mycobacterium avium
PRPGTPF

SEQ ID NO: 41750 - protein, 10 aa, Mycobacterium avium
PRPLTPGGPG

SEQ ID NO: 41751 - protein, 10 aa, Mycobacterium avium
PRPNWSPRRR

SEQ ID NO: 41752 - protein, 6 aa, Mycobacterium avium
PRPPSI

SEQ ID NO: 41753 - protein, 7 aa, Mycobacterium avium
PRPQDTV

SEQ ID NO: 41754 - protein, 14 aa, Mycobacterium avium
PRPRRGGDRLSSCD

SEQ ID NO: 41755 - protein, 5 aa, Mycobacterium avium
PRPVE

SEQ ID NO: 41756 - protein, 8 aa, Mycobacterium avium
PRPVEESI

SEQ ID NO: 41757 - protein, 6 aa, Mycobacterium avium
PRPVPT

SEQ ID NO: 41758 - protein, 15 aa, Mycobacterium avium
PRPWPEHGGPRRAGV

SEQ ID NO: 41759 - protein, 8 aa, Mycobacterium avium
PRQEDADA

SEQ ID NO: 41760 - protein, 11 aa, Mycobacterium avium
PRQPGESPEQF

SEQ ID NO: 41761 - protein, 13 aa, Mycobacterium avium
PRQVSGGMAQRAG

SEQ ID NO: 41762 - protein, 7 aa, Mycobacterium avium
PRRAGSD

SEQ ID NO: 41763 - protein, 9 aa, Mycobacterium avium
PRRASSPFG

SEQ ID NO: 41764 - protein, 8 aa, Mycobacterium avium
PRRDGGER

SEQ ID NO: 41765 - protein, 10 aa, Mycobacterium avium
PRRGDDGSIE

SEQ ID NO: 41766 - protein, 22 aa, Mycobacterium avium
PRRGDKRALAETVQRNAKEALQ

SEQ ID NO: 41767 - protein, 8 aa, Mycobacterium avium
PRRGTANS

SEQ ID NO: 41768 - protein, 9 aa, Mycobacterium avium
PRRPRTGPA

SEQ ID NO: 41769 - protein, 9 aa, Mycobacterium avium
PRRRTDRRH

SEQ ID NO: 41770 - protein, 7 aa, Mycobacterium avium
PRRSPGG

SEQ ID NO: 41771 - protein, 6 aa, Mycobacterium avium
PRRSQR

SEQ ID NO: 41772 - protein, 6 aa, Mycobacterium avium
PRSEAT

SEQ ID NO: 41773 - protein, 7 aa, Mycobacterium avium
PRSFTTA

SEQ ID NO: 41774 - protein, 4 aa, Mycobacterium avium
PRSG

SEQ ID NO: 41775 - protein, 7 aa, Mycobacterium avium
PRSGGLR

SEQ ID NO: 41776 - protein, 7 aa, Mycobacterium avium
PRSGLAD

SEQ ID NO: 41777 - protein, 17 aa, Mycobacterium avium
PRSIPKTTSGKIRRAST

SEQ ID NO: 41778 - protein, 21 aa, Mycobacterium avium
PRSTAEAFPGLARTAALVRLV

SEQ ID NO: 41779 - protein, 4 aa, Mycobacterium avium
PRSV

SEQ ID NO: 41780 - protein, 11 aa, Mycobacterium avium
PRSVSTLSDDG

SEQ ID NO: 41781 - protein, 15 aa, Mycobacterium avium
PRSYVGAEADPDAAN

SEQ ID NO: 41782 - protein, 16 aa, Mycobacterium avium
PRTAAPEAAAPRPAPQ

SEQ ID NO: 41783 - protein, 18 aa, Mycobacterium avium
PRTAATKVNRSAMIAARG

SEQ ID NO: 41784 - protein, 15 aa, Mycobacterium avium
PRTATEWDARRDGPP

SEQ ID NO: 41785 - protein, 5 aa, Mycobacterium avium
PRTEY

SEQ ID NO: 41786 - protein, 8 aa, Mycobacterium avium
PRTGGRAG

SEQ ID NO: 41787 - protein, 7 aa, Mycobacterium avium
PRTGRTH

SEQ ID NO: 41788 - protein, 5 aa, Mycobacterium avium
PRTKR

SEQ ID NO: 41789 - protein, 4 aa, Mycobacterium avium
PRTL

SEQ ID NO: 41790 - protein, 5 aa, Mycobacterium avium
PRTLG

SEQ ID NO: 41791 - protein, 28 aa, Mycobacterium avium
PRTSVGKYDKKAVRSRYADGGYRVIEAR

SEQ ID NO: 41792 - protein, 5 aa, Mycobacterium avium
PRTTR

SEQ ID NO: 41793 - protein, 10 aa, Mycobacterium avium
PRVDNPAGSG

SEQ ID NO: 41794 - protein, 6 aa, Mycobacterium avium
PRVNAR

SEQ ID NO: 41795 - protein, 7 aa, Mycobacterium avium
PRVPDSG

SEQ ID NO: 41796 - protein, 18 aa, Mycobacterium avium
PRVPDSGASTLDCVSEPV

SEQ ID NO: 41797 - protein, 9 aa, Mycobacterium avium
PRVPSTAEI

SEQ ID NO: 41798 - protein, 13 aa, Mycobacterium avium
PRVTRAKAAADLG

SEQ ID NO: 41799 - protein, 19 aa, Mycobacterium avium
PRWPHGSKRDRGHPSREPD

SEQ ID NO: 41800 - protein, 7 aa, Mycobacterium avium
PSAAGGI

SEQ ID NO: 41801 - protein, 9 aa, Mycobacterium avium
PSAGGGGKG

SEQ ID NO: 41802 - protein, 8 aa, Mycobacterium avium
PSAGKSSL

SEQ ID NO: 41803 - protein, 7 aa, Mycobacterium avium
PSANPYL

SEQ ID NO: 41804 - protein, 4 aa, Mycobacterium avium
PSAQ

SEQ ID NO: 41805 - protein, 9 aa, Mycobacterium avium
PSAQPDGER

SEQ ID NO: 41806 - protein, 7 aa, Mycobacterium avium
PSASQTD

SEQ ID NO: 41807 - protein, 9 aa, Mycobacterium avium
PSATGSAQQ

SEQ ID NO: 41808 - protein, 8 aa, Mycobacterium avium
PSATPESA

SEQ ID NO: 41809 - protein, 5 aa, Mycobacterium avium
PSAVT

SEQ ID NO: 41810 - protein, 9 aa, Mycobacterium avium
PSAYQQASG

SEQ ID NO: 41811 - protein, 5 aa, Mycobacterium avium
PSCGD

SEQ ID NO: 41812 - protein, 5 aa, Mycobacterium avium
PSDAQ

SEQ ID NO: 41813 - protein, 13 aa, Mycobacterium avium
PSDDLASSRRRAR

SEQ ID NO: 41814 - protein, 8 aa, Mycobacterium avium
PSDEEFAE

SEQ ID NO: 41815 - protein, 5 aa, Mycobacterium avium
PSDEQ

SEQ ID NO: 41816 - protein, 14 aa, Mycobacterium avium
PSDIEPPERPIPGP

SEQ ID NO: 41817 - protein, 5 aa, Mycobacterium avium
PSDLS

SEQ ID NO: 41818 - protein, 7 aa, Mycobacterium avium
PSDPAAA

SEQ ID NO: 41819 - protein, 17 aa, Mycobacterium avium
PSDTDLDVPGPQRSSAY

SEQ ID NO: 41820 - protein, 8 aa, Mycobacterium avium
PSDWPEGK

SEQ ID NO: 41821 - protein, 5 aa, Mycobacterium avium
PSEER

SEQ ID NO: 41822 - protein, 10 aa, Mycobacterium avium
PSEFDSNQQI

SEQ ID NO: 41823 - protein, 5 aa, Mycobacterium avium
PSEGR

SEQ ID NO: 41824 - protein, 5 aa, Mycobacterium avium
PSELD

SEQ ID NO: 41825 - protein, 7 aa, Mycobacterium avium
PSEPGHV

SEQ ID NO: 41826 - protein, 7 aa, Mycobacterium avium
PSERGRV

SEQ ID NO: 41827 - protein, 6 aa, Mycobacterium avium
PSETMP

SEQ ID NO: 41828 - protein, 4 aa, Mycobacterium avium
PSEY

SEQ ID NO: 41829 - protein, 28 aa, Mycobacterium avium
PSFGGGSLPGLGATPASMSGWETPGGLP

SEQ ID NO: 41830 - protein, 4 aa, Mycobacterium avium
PSGA

SEQ ID NO: 41831 - protein, 11 aa, Mycobacterium avium
PSGADAASGHH

SEQ ID NO: 41832 - protein, 6 aa, Mycobacterium avium
PSGDVT

SEQ ID NO: 41833 - protein, 13 aa, Mycobacterium avium
PSGERVRAGADGI

SEQ ID NO: 41834 - protein, 14 aa, Mycobacterium avium
PSGIIGNGGASGAL

SEQ ID NO: 41835 - protein, 10 aa, Mycobacterium avium
PSGPPTDAAT

SEQ ID NO: 41836 - protein, 8 aa, Mycobacterium avium
PSGPSAQA

SEQ ID NO: 41837 - protein, 10 aa, Mycobacterium avium
PSGRRSAKEI

SEQ ID NO: 41838 - protein, 8 aa, Mycobacterium avium
PSGRSGGV

SEQ ID NO: 41839 - protein, 7 aa, Mycobacterium avium
PSGRTAD

SEQ ID NO: 41840 - protein, 8 aa, Mycobacterium avium
PSGSGKST

SEQ ID NO: 41841 - protein, 10 aa, Mycobacterium avium
PSGSSAAEDN

SEQ ID NO: 41842 - protein, 7 aa, Mycobacterium avium
PSGTEPK

SEQ ID NO: 41843 - protein, 5 aa, Mycobacterium avium
PSGTS

SEQ ID NO: 41844 - protein, 10 aa, Mycobacterium avium
PSGVGKTELS

SEQ ID NO: 41845 - protein, 4 aa, Mycobacterium avium
PSGW

SEQ ID NO: 41846 - protein, 8 aa, Mycobacterium avium
PSHHTPGL

SEQ ID NO: 41847 - protein, 28 aa, Mycobacterium avium
PSHNPPSDGGFKYNPPNGGPADSDVTNA

SEQ ID NO: 41848 - protein, 4 aa, Mycobacterium avium
PSIT

SEQ ID NO: 41849 - protein, 6 aa, Mycobacterium avium
PSITTA

SEQ ID NO: 41850 - protein, 7 aa, Mycobacterium avium
PSKAEGV

SEQ ID NO: 41851 - protein, 10 aa, Mycobacterium avium
PSKQGKLPAT

SEQ ID NO: 41852 - protein, 13 aa, Mycobacterium avium
PSKTFNEALAASQ

SEQ ID NO: 41853 - protein, 9 aa, Mycobacterium avium
PSKVPSMAD

SEQ ID NO: 41854 - protein, 13 aa, Mycobacterium avium
PSLARESGRGTGE

SEQ ID NO: 41855 - protein, 14 aa, Mycobacterium avium
PSLPAALGGGLPGV

SEQ ID NO: 41856 - protein, 11 aa, Mycobacterium avium
PSLSPRGRRSV

SEQ ID NO: 41857 - protein, 7 aa, Mycobacterium avium
PSLTERQ

SEQ ID NO: 41858 - protein, 4 aa, Mycobacterium avium
PSLY

SEQ ID NO: 41859 - protein, 6 aa, Mycobacterium avium
PSNPAD

SEQ ID NO: 41860 - protein, 6 aa, Mycobacterium avium
PSNPMQ

SEQ ID NO: 41861 - protein, 4 aa, Mycobacterium avium
PSPA

SEQ ID NO: 41862 - protein, 6 aa, Mycobacterium avium
PSPAKA

SEQ ID NO: 41863 - protein, 5 aa, Mycobacterium avium
PSPHI

SEQ ID NO: 41864 - protein, 5 aa, Mycobacterium avium
PSPHL

SEQ ID NO: 41865 - protein, 5 aa, Mycobacterium avium
PSPHT

SEQ ID NO: 41866 - protein, 6 aa, Mycobacterium avium
PSPPAL

SEQ ID NO: 41867 - protein, 7 aa, Mycobacterium avium
PSPPGRW

SEQ ID NO: 41868 - protein, 21 aa, Mycobacterium avium
PSPPPGLAGPDDDRRARADAD

SEQ ID NO: 41869 - protein, 4 aa, Mycobacterium avium
PSPS

SEQ ID NO: 41870 - protein, 6 aa, Mycobacterium avium
PSPTAA

SEQ ID NO: 41871 - protein, 5 aa, Mycobacterium avium
PSPVK

SEQ ID NO: 41872 - protein, 6 aa, Mycobacterium avium
PSPYGT

SEQ ID NO: 41873 - protein, 10 aa, Mycobacterium avium
PSQKDVSDTI

SEQ ID NO: 41874 - protein, 16 aa, Mycobacterium avium
PSQNDPGLAPEGKHAA

SEQ ID NO: 41875 - protein, 6 aa, Mycobacterium avium
PSQSAY

SEQ ID NO: 41876 - protein, 5 aa, Mycobacterium avium
PSRAM

SEQ ID NO: 41877 - protein, 4 aa, Mycobacterium avium
PSRI

SEQ ID NO: 41878 - protein, 7 aa, Mycobacterium avium
PSRIEGA

SEQ ID NO: 41879 - protein, 7 aa, Mycobacterium avium
PSRLKQN

SEQ ID NO: 41880 - protein, 5 aa, Mycobacterium avium
PSRPQ

SEQ ID NO: 41881 - protein, 7 aa, Mycobacterium avium
PSRRITG

SEQ ID NO: 41882 - protein, 10 aa, Mycobacterium avium
PSRSLDEGTA

SEQ ID NO: 41883 - protein, 5 aa, Mycobacterium avium
PSRST

SEQ ID NO: 41884 - protein, 8 aa, Mycobacterium avium
PSSEAPAI

SEQ ID NO: 41885 - protein, 5 aa, Mycobacterium avium
PSSMS

SEQ ID NO: 41886 - protein, 6 aa, Mycobacterium avium
PSSPTS

SEQ ID NO: 41887 - protein, 10 aa, Mycobacterium avium
PSSRKGDHNH

SEQ ID NO: 41888 - protein, 7 aa, Mycobacterium avium
PSSTPQR

SEQ ID NO: 41889 - protein, 11 aa, Mycobacterium avium
PSTAVRTPGAA

SEQ ID NO: 41890 - protein, 13 aa, Mycobacterium avium
PSTDGQGQPTATA

SEQ ID NO: 41891 - protein, 4 aa, Mycobacterium avium
PSTG

SEQ ID NO: 41892 - protein, 10 aa, Mycobacterium avium
PSTGGSWDAG

SEQ ID NO: 41893 - protein, 10 aa, Mycobacterium avium
PSTLSPADRE

SEQ ID NO: 41894 - protein, 5 aa, Mycobacterium avium
PSTPS

SEQ ID NO: 41895 - protein, 9 aa, Mycobacterium avium
PSTRQPVGA

SEQ ID NO: 41896 - protein, 6 aa, Mycobacterium avium
PSTSPA

SEQ ID NO: 41897 - protein, 5 aa, Mycobacterium avium
PSVAE

SEQ ID NO: 41898 - protein, 4 aa, Mycobacterium avium
PSVD

SEQ ID NO: 41899 - protein, 12 aa, Mycobacterium avium
PSWEAGDPRTYS

SEQ ID NO: 41900 - protein, 7 aa, Mycobacterium avium
PSWGSAR

SEQ ID NO: 41901 - protein, 7 aa, Mycobacterium avium
PSYDPLD

SEQ ID NO: 41902 - protein, 4 aa, Mycobacterium avium
PSYG

SEQ ID NO: 41903 - protein, 6 aa, Mycobacterium avium
PTADQQ

SEQ ID NO: 41904 - protein, 5 aa, Mycobacterium avium
PTAEH

SEQ ID NO: 41905 - protein, 18 aa, Mycobacterium avium
PTAEHKFSAQGPAWDPAE

SEQ ID NO: 41906 - protein, 7 aa, Mycobacterium avium
PTAESAR

SEQ ID NO: 41907 - protein, 6 aa, Mycobacterium avium
PTAGMD

SEQ ID NO: 41908 - protein, 12 aa, Mycobacterium avium
PTAGSARHSSGL

SEQ ID NO: 41909 - protein, 14 aa, Mycobacterium avium
PTAPTALEAPAGDI

SEQ ID NO: 41910 - protein, 8 aa, Mycobacterium avium
PTAVPTDP

SEQ ID NO: 41911 - protein, 4 aa, Mycobacterium avium
PTDA

SEQ ID NO: 41912 - protein, 7 aa, Mycobacterium avium
PTDADNK

SEQ ID NO: 41913 - protein, 10 aa, Mycobacterium avium
PTDAGVSTTG

SEQ ID NO: 41914 - protein, 14 aa, Mycobacterium avium
PTDAPEADGTLSWS

SEQ ID NO: 41915 - protein, 7 aa, Mycobacterium avium
PTDARRT

SEQ ID NO: 41916 - protein, 8 aa, Mycobacterium avium
PTDHRPVA

SEQ ID NO: 41917 - protein, 10 aa, Mycobacterium avium
PTDNTPDGEG

SEQ ID NO: 41918 - protein, 4 aa, Mycobacterium avium
PTDP

SEQ ID NO: 41919 - protein, 6 aa, Mycobacterium avium
PTDPGV

SEQ ID NO: 41920 - protein, 4 aa, Mycobacterium avium
PTDV

SEQ ID NO: 41921 - protein, 6 aa, Mycobacterium avium
PTEADD

SEQ ID NO: 41922 - protein, 5 aa, Mycobacterium avium
PTEEE

SEQ ID NO: 41923 - protein, 7 aa, Mycobacterium avium
PTEETTT

SEQ ID NO: 41924 - protein, 6 aa, Mycobacterium avium
PTEGRS

SEQ ID NO: 41925 - protein, 6 aa, Mycobacterium avium
PTERGA

SEQ ID NO: 41926 - protein, 6 aa, Mycobacterium avium
PTERID

SEQ ID NO: 41927 - protein, 8 aa, Mycobacterium avium
PTESETLT

SEQ ID NO: 41928 - protein, 5 aa, Mycobacterium avium
PTEVT

SEQ ID NO: 41929 - protein, 12 aa, Mycobacterium avium
PTFQASSEKHPD

SEQ ID NO: 41930 - protein, 10 aa, Mycobacterium avium
PTGAAPVAQA

SEQ ID NO: 41931 - protein, 8 aa, Mycobacterium avium
PTGAGKTV

SEQ ID NO: 41932 - protein, 12 aa, Mycobacterium avium
PTGPAADRPGPT

SEQ ID NO: 41933 - protein, 21 aa, Mycobacterium avium
PTGPAEGDAGPATLGPRMGDA

SEQ ID NO: 41934 - protein, 7 aa, Mycobacterium avium
PTGSGKT

SEQ ID NO: 41935 - protein, 7 aa, Mycobacterium avium
PTGSTPI

SEQ ID NO: 41936 - protein, 5 aa, Mycobacterium avium
PTGSV

SEQ ID NO: 41937 - protein, 5 aa, Mycobacterium avium
PTGTP

SEQ ID NO: 41938 - protein, 4 aa, Mycobacterium avium
PTID

SEQ ID NO: 41939 - protein, 12 aa, Mycobacterium avium
PTITRSTPEGAR

SEQ ID NO: 41940 - protein, 9 aa, Mycobacterium avium
PTKDPEAAA

SEQ ID NO: 41941 - protein, 4 aa, Mycobacterium avium
PTKE

SEQ ID NO: 41942 - protein, 5 aa, Mycobacterium avium
PTLDA

SEQ ID NO: 41943 - protein, 8 aa, Mycobacterium avium
PTLPGRGL

SEQ ID NO: 41944 - protein, 9 aa, Mycobacterium avium
PTLPGTEGL

SEQ ID NO: 41945 - protein, 6 aa, Mycobacterium avium
PTLPPV

SEQ ID NO: 41946 - protein, 4 aa, Mycobacterium avium
PTME

SEQ ID NO: 41947 - protein, 5 aa, Mycobacterium avium
PTNDL

SEQ ID NO: 41948 - protein, 9 aa, Mycobacterium avium
PTNDVDTDT

SEQ ID NO: 41949 - protein, 5 aa, Mycobacterium avium
PTNHL

SEQ ID NO: 41950 - protein, 4 aa, Mycobacterium avium
PTNN

SEQ ID NO: 41951 - protein, 12 aa, Mycobacterium avium
PTNNLDPASREQ

SEQ ID NO: 41952 - protein, 4 aa, Mycobacterium avium
PTNP

SEQ ID NO: 41953 - protein, 11 aa, Mycobacterium avium
PTNPNDSGGLA

SEQ ID NO: 41954 - protein, 5 aa, Mycobacterium avium
PTPAA

SEQ ID NO: 41955 - protein, 12 aa, Mycobacterium avium
PTPAAKAAKPVH

SEQ ID NO: 41956 - protein, 8 aa, Mycobacterium avium
PTPAGGEF

SEQ ID NO: 41957 - protein, 12 aa, Mycobacterium avium
PTPAVGGVPTDA

SEQ ID NO: 41958 - protein, 6 aa, Mycobacterium avium
PTPDPF

SEQ ID NO: 41959 - protein, 4 aa, Mycobacterium avium
PTPE

SEQ ID NO: 41960 - protein, 7 aa, Mycobacterium avium
PTPGPVD

SEQ ID NO: 41961 - protein, 6 aa, Mycobacterium avium
PTPKTV

SEQ ID NO: 41962 - protein, 9 aa, Mycobacterium avium
PTPQTVGEY

SEQ ID NO: 41963 - protein, 5 aa, Mycobacterium avium
PTPRT

SEQ ID NO: 41964 - protein, 4 aa, Mycobacterium avium
PTPS

SEQ ID NO: 41965 - protein, 5 aa, Mycobacterium avium
PTPSG

SEQ ID NO: 41966 - protein, 6 aa, Mycobacterium avium
PTPTGN

SEQ ID NO: 41967 - protein, 5 aa, Mycobacterium avium
PTPTH

SEQ ID NO: 41968 - protein, 6 aa, Mycobacterium avium
PTPTKW

SEQ ID NO: 41969 - protein, 4 aa, Mycobacterium avium
PTPY

SEQ ID NO: 41970 - protein, 10 aa, Mycobacterium avium
PTQVGSSLAP

SEQ ID NO: 41971 - protein, 6 aa, Mycobacterium avium
PTRAYG

SEQ ID NO: 41972 - protein, 9 aa, Mycobacterium avium
PTRDAAEAD

SEQ ID NO: 41973 - protein, 9 aa, Mycobacterium avium
PTRFGSPAA

SEQ ID NO: 41974 - protein, 10 aa, Mycobacterium avium
PTRGEQGKGI

SEQ ID NO: 41975 - protein, 5 aa, Mycobacterium avium
PTRGT

SEQ ID NO: 41976 - protein, 4 aa, Mycobacterium avium
PTRH

SEQ ID NO: 41977 - protein, 5 aa, Mycobacterium avium
PTRLP

SEQ ID NO: 41978 - protein, 10 aa, Mycobacterium avium
PTRNAKSNYE

SEQ ID NO: 41979 - protein, 6 aa, Mycobacterium avium
PTRNGR

SEQ ID NO: 41980 - protein, 16 aa, Mycobacterium avium
PTRPAPVGPDVRSARR

SEQ ID NO: 41981 - protein, 5 aa, Mycobacterium avium
PTRPL

SEQ ID NO: 41982 - protein, 10 aa, Mycobacterium avium
PTRPPSRRTV

SEQ ID NO: 41983 - protein, 5 aa, Mycobacterium avium
PTRPR

SEQ ID NO: 41984 - protein, 10 aa, Mycobacterium avium
PTRRAEAQAR

SEQ ID NO: 41985 - protein, 7 aa, Mycobacterium avium
PTRRQVD

SEQ ID NO: 41986 - protein, 12 aa, Mycobacterium avium
PTRSHTGAAQGG

SEQ ID NO: 41987 - protein, 4 aa, Mycobacterium avium
PTRT

SEQ ID NO: 41988 - protein, 5 aa, Mycobacterium avium
PTRVD

SEQ ID NO: 41989 - protein, 9 aa, Mycobacterium avium
PTSAVDAEA

SEQ ID NO: 41990 - protein, 8 aa, Mycobacterium avium
PTSDIEQA

SEQ ID NO: 41991 - protein, 12 aa, Mycobacterium avium
PTSEARLPEAVG

SEQ ID NO: 41992 - protein, 5 aa, Mycobacterium avium
PTSGN

SEQ ID NO: 41993 - protein, 7 aa, Mycobacterium avium
PTSGNTG

SEQ ID NO: 41994 - protein, 4 aa, Mycobacterium avium
PTSI

SEQ ID NO: 41995 - protein, 4 aa, Mycobacterium avium
PTSL

SEQ ID NO: 41996 - protein, 5 aa, Mycobacterium avium
PTSNG

SEQ ID NO: 41997 - protein, 13 aa, Mycobacterium avium
PTSPADPAIPANR

SEQ ID NO: 41998 - protein, 15 aa, Mycobacterium avium
PTSPEDPAAAANKAA

SEQ ID NO: 41999 - protein, 18 aa, Mycobacterium avium
PTSSDVGQLRRAADVAAR

SEQ ID NO: 42000 - protein, 8 aa, Mycobacterium avium
PTSTGAAK

SEQ ID NO: 42001 - protein, 13 aa, Mycobacterium avium
PTSVTPAPAPTPS

SEQ ID NO: 42002 - protein, 4 aa, Mycobacterium avium
PTTA

SEQ ID NO: 42003 - protein, 7 aa, Mycobacterium avium
PTTADRD

SEQ ID NO: 42004 - protein, 10 aa, Mycobacterium avium
PTTAQPPPLA

SEQ ID NO: 42005 - protein, 6 aa, Mycobacterium avium
PTTDSG

SEQ ID NO: 42006 - protein, 10 aa, Mycobacterium avium
PTTEDQLRPR

SEQ ID NO: 42007 - protein, 4 aa, Mycobacterium avium
PTTG

SEQ ID NO: 42008 - protein, 11 aa, Mycobacterium avium
PTTGLDPRSRR

SEQ ID NO: 42009 - protein, 15 aa, Mycobacterium avium
PTTGVSRGRDGIPRY

SEQ ID NO: 42010 - protein, 5 aa, Mycobacterium avium
PTTGY

SEQ ID NO: 42011 - protein, 16 aa, Mycobacterium avium
PTTKDRQGNDRGPSYR

SEQ ID NO: 42012 - protein, 7 aa, Mycobacterium avium
PTTPESR

SEQ ID NO: 42013 - protein, 7 aa, Mycobacterium avium
PTTQKAG

SEQ ID NO: 42014 - protein, 9 aa, Mycobacterium avium
PTVPAGTSR

SEQ ID NO: 42015 - protein, 11 aa, Mycobacterium avium
PVADSTASQAR

SEQ ID NO: 42016 - protein, 4 aa, Mycobacterium avium
PVAH

SEQ ID NO: 42017 - protein, 4 aa, Mycobacterium avium
PVAP

SEQ ID NO: 42018 - protein, 6 aa, Mycobacterium avium
PVAPEY

SEQ ID NO: 42019 - protein, 10 aa, Mycobacterium avium
PVDAGRAQAQ

SEQ ID NO: 42020 - protein, 10 aa, Mycobacterium avium
PVDEAAPYAA

SEQ ID NO: 42021 - protein, 8 aa, Mycobacterium avium
PVDERTSD

SEQ ID NO: 42022 - protein, 5 aa, Mycobacterium avium
PVDPP

SEQ ID NO: 42023 - protein, 10 aa, Mycobacterium avium
PVDPSRPPHL

SEQ ID NO: 42024 - protein, 30 aa, Mycobacterium avium
PVDSAPSNGRKSESGGRRGRRKKSKAEEPV

SEQ ID NO: 42025 - protein, 8 aa, Mycobacterium avium
PVEASRSR

SEQ ID NO: 42026 - protein, 6 aa, Mycobacterium avium
PVEGQT

SEQ ID NO: 42027 - protein, 7 aa, Mycobacterium avium
PVELSEE

SEQ ID NO: 42028 - protein, 12 aa, Mycobacterium avium
PVEPRDRGKPAF

SEQ ID NO: 42029 - protein, 5 aa, Mycobacterium avium
PVGDP

SEQ ID NO: 42030 - protein, 9 aa, Mycobacterium avium
PVGDPGWFG

SEQ ID NO: 42031 - protein, 10 aa, Mycobacterium avium
PVGDQGGDIA

SEQ ID NO: 42032 - protein, 9 aa, Mycobacterium avium
PVGEATATL

SEQ ID NO: 42033 - protein, 35 aa, Mycobacterium avium
PVGGDGGVRNPNLPPPSRPQDNDLDVTPQHRPGIP

SEQ ID NO: 42034 - protein, 12 aa, Mycobacterium avium
PVGGTAQIAPDP

SEQ ID NO: 42035 - protein, 8 aa, Mycobacterium avium
PVGNEEGE

SEQ ID NO: 42036 - protein, 27 aa, Mycobacterium avium
PVGPPPGVNPKPLKGMPPFSGPQGPFA

SEQ ID NO: 42037 - protein, 6 aa, Mycobacterium avium
PVGPTG

SEQ ID NO: 42038 - protein, 15 aa, Mycobacterium avium
PVGRSTKKSKGTSEG

SEQ ID NO: 42039 - protein, 6 aa, Mycobacterium avium
PVGTAP

SEQ ID NO: 42040 - protein, 8 aa, Mycobacterium avium
PVKNPETI

SEQ ID NO: 42041 - protein, 12 aa, Mycobacterium avium
PVKQEPNAAAPP

SEQ ID NO: 42042 - protein, 6 aa, Mycobacterium avium
PVNDLS

SEQ ID NO: 42043 - protein, 8 aa, Mycobacterium avium
PVNGPARL

SEQ ID NO: 42044 - protein, 7 aa, Mycobacterium avium
PVNPSGG

SEQ ID NO: 42045 - protein, 6 aa, Mycobacterium avium
PVNTDG

SEQ ID NO: 42046 - protein, 11 aa, Mycobacterium avium
PVPADLGQDDA

SEQ ID NO: 42047 - protein, 8 aa, Mycobacterium avium
PVPDDDPD

SEQ ID NO: 42048 - protein, 11 aa, Mycobacterium avium
PVPDTIGEGTR

SEQ ID NO: 42049 - protein, 7 aa, Mycobacterium avium
PVPGELG

SEQ ID NO: 42050 - protein, 8 aa, Mycobacterium avium
PVPGFRGP

SEQ ID NO: 42051 - protein, 5 aa, Mycobacterium avium
PVPGP

SEQ ID NO: 42052 - protein, 16 aa, Mycobacterium avium
PVPGYHAPPERTVAAG

SEQ ID NO: 42053 - protein, 6 aa, Mycobacterium avium
PVPPLD

SEQ ID NO: 42054 - protein, 7 aa, Mycobacterium avium
PVPPSQA

SEQ ID NO: 42055 - protein, 10 aa, Mycobacterium avium
PVPTTNREPH

SEQ ID NO: 42056 - protein, 4 aa, Mycobacterium avium
PVPV

SEQ ID NO: 42057 - protein, 7 aa, Mycobacterium avium
PVQGEAA

SEQ ID NO: 42058 - protein, 9 aa, Mycobacterium avium
PVQGRGGKG

SEQ ID NO: 42059 - protein, 7 aa, Mycobacterium avium
PVQPPPG

SEQ ID NO: 42060 - protein, 6 aa, Mycobacterium avium
PVQSTA

SEQ ID NO: 42061 - protein, 8 aa, Mycobacterium avium
PVRGDTQR

SEQ ID NO: 42062 - protein, 8 aa, Mycobacterium avium
PVRQGTRT

SEQ ID NO: 42063 - protein, 9 aa, Mycobacterium avium
PVRRPNTES

SEQ ID NO: 42064 - protein, 8 aa, Mycobacterium avium
PVRSTDGR

SEQ ID NO: 42065 - protein, 5 aa, Mycobacterium avium
PVSEI

SEQ ID NO: 42066 - protein, 8 aa, Mycobacterium avium
PVSERRRE

SEQ ID NO: 42067 - protein, 13 aa, Mycobacterium avium
PVSGGAAAAARGE

SEQ ID NO: 42068 - protein, 10 aa, Mycobacterium avium
PVSGSARTAE

SEQ ID NO: 42069 - protein, 9 aa, Mycobacterium avium
PVSGTPGDV

SEQ ID NO: 42070 - protein, 12 aa, Mycobacterium avium
PVSKGSGQTLTG

SEQ ID NO: 42071 - protein, 9 aa, Mycobacterium avium
PVSPGDSQV

SEQ ID NO: 42072 - protein, 12 aa, Mycobacterium avium
PVSPPATPEDGY

SEQ ID NO: 42073 - protein, 4 aa, Mycobacterium avium
PVTA

SEQ ID NO: 42074 - protein, 9 aa, Mycobacterium avium
PVTGTSGDR

SEQ ID NO: 42075 - protein, 13 aa, Mycobacterium avium
PVTRSSLPTAQRA

SEQ ID NO: 42076 - protein, 19 aa, Mycobacterium avium
PWAAPTGWRAGGSPAPVRT

SEQ ID NO: 42077 - protein, 11 aa, Mycobacterium avium
PWADGASAAAR

SEQ ID NO: 42078 - protein, 5 aa, Mycobacterium avium
PWAPD

SEQ ID NO: 42079 - protein, 6 aa, Mycobacterium avium
PWDTAA

SEQ ID NO: 42080 - protein, 21 aa, Mycobacterium avium
PWGPDKITDEGREQLRALGFT

SEQ ID NO: 42081 - protein, 5 aa, Mycobacterium avium
PWPSA

SEQ ID NO: 42082 - protein, 4 aa, Mycobacterium avium
PWPT

SEQ ID NO: 42083 - protein, 4 aa, Mycobacterium avium
PWQE

SEQ ID NO: 42084 - protein, 13 aa, Mycobacterium avium
PWQTNGRPRRAGV

SEQ ID NO: 42085 - protein, 5 aa, Mycobacterium avium
PWRDN

SEQ ID NO: 42086 - protein, 5 aa, Mycobacterium avium
PWSTA

SEQ ID NO: 42087 - protein, 10 aa, Mycobacterium avium
PYASGDPELN

SEQ ID NO: 42088 - protein, 7 aa, Mycobacterium avium
PYDKKNA

SEQ ID NO: 42089 - protein, 12 aa, Mycobacterium avium
PYDPAAGQRCNP

SEQ ID NO: 42090 - protein, 5 aa, Mycobacterium avium
PYEPG

SEQ ID NO: 42091 - protein, 5 aa, Mycobacterium avium
PYGAC

SEQ ID NO: 42092 - protein, 8 aa, Mycobacterium avium
PYGEDGTI

SEQ ID NO: 42093 - protein, 10 aa, Mycobacterium avium
PYGETRSYGE

SEQ ID NO: 42094 - protein, 10 aa, Mycobacterium avium
PYGNSGPRID

SEQ ID NO: 42095 - protein, 7 aa, Mycobacterium avium
PYHPEAR

SEQ ID NO: 42096 - protein, 6 aa, Mycobacterium avium
PYKATG

SEQ ID NO: 42097 - protein, 4 aa, Mycobacterium avium
PYQN

SEQ ID NO: 42098 - protein, 9 aa, Mycobacterium avium
PYQPEISQG

SEQ ID NO: 42099 - protein, 12 aa, Mycobacterium avium
PYRAGRDVGEAE

SEQ ID NO: 42100 - protein, 8 aa, Mycobacterium avium
PYSGPTAA

SEQ ID NO: 42101 - protein, 12 aa, Mycobacterium avium
PYSRDPRNIARK

SEQ ID NO: 42102 - protein, 10 aa, Mycobacterium avium
PYSRRTPRLA

SEQ ID NO: 42103 - protein, 6 aa, Mycobacterium avium
PYTGGS

SEQ ID NO: 42104 - protein, 7 aa, Mycobacterium avium
PYTSHNS

SEQ ID NO: 42105 - protein, 8 aa, Mycobacterium avium
QAADDRDA

SEQ ID NO: 42106 - protein, 7 aa, Mycobacterium avium
QAAEPTG

SEQ ID NO: 42107 - protein, 4 aa, Mycobacterium avium
QAAG

SEQ ID NO: 42108 - protein, 7 aa, Mycobacterium avium
QAAGAAP

SEQ ID NO: 42109 - protein, 8 aa, Mycobacterium avium
QAAGGPGC

SEQ ID NO: 42110 - protein, 6 aa, Mycobacterium avium
QAAGRD

SEQ ID NO: 42111 - protein, 13 aa, Mycobacterium avium
QAAGTTSAGVEYD

SEQ ID NO: 42112 - protein, 13 aa, Mycobacterium avium
QAAHEGTSAEQVR

SEQ ID NO: 42113 - protein, 14 aa, Mycobacterium avium
QAAKAGRDEPDRGD

SEQ ID NO: 42114 - protein, 6 aa, Mycobacterium avium
QAALPE

SEQ ID NO: 42115 - protein, 9 aa, Mycobacterium avium
QAAQTARKA

SEQ ID NO: 42116 - protein, 12 aa, Mycobacterium avium
QAARDTGIDPEL

SEQ ID NO: 42117 - protein, 5 aa, Mycobacterium avium
QAARP

SEQ ID NO: 42118 - protein, 14 aa, Mycobacterium avium
QAARTAQKSFDDAQ

SEQ ID NO: 42119 - protein, 7 aa, Mycobacterium avium
QAASEPV

SEQ ID NO: 42120 - protein, 8 aa, Mycobacterium avium
QAASSLGA

SEQ ID NO: 42121 - protein, 8 aa, Mycobacterium avium
QAATGGSW

SEQ ID NO: 42122 - protein, 9 aa, Mycobacterium avium
QAAVPGDGA

SEQ ID NO: 42123 - protein, 11 aa, Mycobacterium avium
QAAYSASKGGV

SEQ ID NO: 42124 - protein, 8 aa, Mycobacterium avium
QADHRSDE

SEQ ID NO: 42125 - protein, 12 aa, Mycobacterium avium
QADPASAQPGRV

SEQ ID NO: 42126 - protein, 18 aa, Mycobacterium avium
QADPERRRRYQRARGKGG

SEQ ID NO: 42127 - protein, 9 aa, Mycobacterium avium
QADTLDPDH

SEQ ID NO: 42128 - protein, 7 aa, Mycobacterium avium
QAEADRA

SEQ ID NO: 42129 - protein, 7 aa, Mycobacterium avium
QAEAEGL

SEQ ID NO: 42130 - protein, 10 aa, Mycobacterium avium
QAEDSGSRQA

SEQ ID NO: 42131 - protein, 16 aa, Mycobacterium avium
QAELGGAADESVNPVP

SEQ ID NO: 42132 - protein, 8 aa, Mycobacterium avium
QAERGNKI

SEQ ID NO: 42133 - protein, 7 aa, Mycobacterium avium
QAESGAH

SEQ ID NO: 42134 - protein, 6 aa, Mycobacterium avium
QAFGSP

SEQ ID NO: 42135 - protein, 4 aa, Mycobacterium avium
QAGA

SEQ ID NO: 42136 - protein, 6 aa, Mycobacterium avium
QAGDDA

SEQ ID NO: 42137 - protein, 6 aa, Mycobacterium avium
QAGDRE

SEQ ID NO: 42138 - protein, 22 aa, Mycobacterium avium
QAGEAYASNEAGAAQAERAVRG

SEQ ID NO: 42139 - protein, 14 aa, Mycobacterium avium
QAGEKGRDSRHEPV

SEQ ID NO: 42140 - protein, 7 aa, Mycobacterium avium
QAGEPTY

SEQ ID NO: 42141 - protein, 11 aa, Mycobacterium avium
QAGERTPRKNE

SEQ ID NO: 42142 - protein, 5 aa, Mycobacterium avium
QAGGI

SEQ ID NO: 42143 - protein, 12 aa, Mycobacterium avium
QAGGQGAPLPLD

SEQ ID NO: 42144 - protein, 6 aa, Mycobacterium avium
QAGHGD

SEQ ID NO: 42145 - protein, 7 aa, Mycobacterium avium
QAGKEAS

SEQ ID NO: 42146 - protein, 11 aa, Mycobacterium avium
QAGKPTSTNPI

SEQ ID NO: 42147 - protein, 6 aa, Mycobacterium avium
QAGKQD

SEQ ID NO: 42148 - protein, 4 aa, Mycobacterium avium
QAGL

SEQ ID NO: 42149 - protein, 13 aa, Mycobacterium avium
QAGMGGGLAGAPL

SEQ ID NO: 42150 - protein, 13 aa, Mycobacterium avium
QAGNLDAAKAAYA

SEQ ID NO: 42151 - protein, 18 aa, Mycobacterium avium
QAGQTRTRRVTRSAAPPG

SEQ ID NO: 42152 - protein, 7 aa, Mycobacterium avium
QAGSAEY

SEQ ID NO: 42153 - protein, 7 aa, Mycobacterium avium
QAGVSRS

SEQ ID NO: 42154 - protein, 6 aa, Mycobacterium avium
QAKPRD

SEQ ID NO: 42155 - protein, 11 aa, Mycobacterium avium
QAKSKGEDAKV

SEQ ID NO: 42156 - protein, 6 aa, Mycobacterium avium
QAKYGA

SEQ ID NO: 42157 - protein, 14 aa, Mycobacterium avium
QALAPTRAAQDRFN

SEQ ID NO: 42158 - protein, 10 aa, Mycobacterium avium
QALGDKRGIR

SEQ ID NO: 42159 - protein, 7 aa, Mycobacterium avium
QALGTGN

SEQ ID NO: 42160 - protein, 9 aa, Mycobacterium avium
QALKSTPKI

SEQ ID NO: 42161 - protein, 15 aa, Mycobacterium avium
QALNAGNRRGRDTEI

SEQ ID NO: 42162 - protein, 15 aa, Mycobacterium avium
QALRRGAAEHLREAT

SEQ ID NO: 42163 - protein, 12 aa, Mycobacterium avium
QANAAALADFNK

SEQ ID NO: 42164 - protein, 12 aa, Mycobacterium avium
QANEDYTEEFDP

SEQ ID NO: 42165 - protein, 6 aa, Mycobacterium avium
QAPAGS

SEQ ID NO: 42166 - protein, 14 aa, Mycobacterium avium
QAPAPDQRLAAPKD

SEQ ID NO: 42167 - protein, 26 aa, Mycobacterium avium
QAPATTNDAGPATQAAAAAAAESTSL

SEQ ID NO: 42168 - protein, 7 aa, Mycobacterium avium
QAPAVQG

SEQ ID NO: 42169 - protein, 6 aa, Mycobacterium avium
QAPDPR

SEQ ID NO: 42170 - protein, 8 aa, Mycobacterium avium
QAPDSGNA

SEQ ID NO: 42171 - protein, 8 aa, Mycobacterium avium
QAPDTGNA

SEQ ID NO: 42172 - protein, 18 aa, Mycobacterium avium
QAPGLNPAPPADADGAER

SEQ ID NO: 42173 - protein, 5 aa, Mycobacterium avium
QAPPA

SEQ ID NO: 42174 - protein, 9 aa, Mycobacterium avium
QAPTGSNAQ

SEQ ID NO: 42175 - protein, 5 aa, Mycobacterium avium
QAPVQ

SEQ ID NO: 42176 - protein, 13 aa, Mycobacterium avium
QAQAAAAAAGAPV

SEQ ID NO: 42177 - protein, 4 aa, Mycobacterium avium
QAQI

SEQ ID NO: 42178 - protein, 18 aa, Mycobacterium avium
QAQNPTITSSPSGDGPDL

SEQ ID NO: 42179 - protein, 29 aa, Mycobacterium avium
QAQPDDVSADELRASAPEARAEILEPVPL

SEQ ID NO: 42180 - protein, 4 aa, Mycobacterium avium
QARA

SEQ ID NO: 42181 - protein, 11 aa, Mycobacterium avium
QARAAAAGDDE

SEQ ID NO: 42182 - protein, 7 aa, Mycobacterium avium
QARAEAA

SEQ ID NO: 42183 - protein, 19 aa, Mycobacterium avium
QARGYDVDKPRNLAKSVTV

SEQ ID NO: 42184 - protein, 7 aa, Mycobacterium avium
QARQAAA

SEQ ID NO: 42185 - protein, 9 aa, Mycobacterium avium
QASAQAPVT

SEQ ID NO: 42186 - protein, 8 aa, Mycobacterium avium
QASATTVD

SEQ ID NO: 42187 - protein, 7 aa, Mycobacterium avium
QASDEVE

SEQ ID NO: 42188 - protein, 5 aa, Mycobacterium avium
QASKE

SEQ ID NO: 42189 - protein, 6 aa, Mycobacterium avium
QASYRS

SEQ ID NO: 42190 - protein, 9 aa, Mycobacterium avium
QATAADGAT

SEQ ID NO: 42191 - protein, 6 aa, Mycobacterium avium
QATDSR

SEQ ID NO: 42192 - protein, 4 aa, Mycobacterium avium
QATE

SEQ ID NO: 42193 - protein, 6 aa, Mycobacterium avium
QATGGN

SEQ ID NO: 42194 - protein, 9 aa, Mycobacterium avium
QATQFRPDQ

SEQ ID NO: 42195 - protein, 8 aa, Mycobacterium avium
QATRIGPA

SEQ ID NO: 42196 - protein, 4 aa, Mycobacterium avium
QATT

SEQ ID NO: 42197 - protein, 6 aa, Mycobacterium avium
QATYDI

SEQ ID NO: 42198 - protein, 7 aa, Mycobacterium avium
QAVESTK

SEQ ID NO: 42199 - protein, 4 aa, Mycobacterium avium
QAVP

SEQ ID NO: 42200 - protein, 9 aa, Mycobacterium avium
QAVSGSGIA

SEQ ID NO: 42201 - protein, 8 aa, Mycobacterium avium
QCGSSQQA

SEQ ID NO: 42202 - protein, 9 aa, Mycobacterium avium
QCGSSQQAI

SEQ ID NO: 42203 - protein, 8 aa, Mycobacterium avium
QCGSSQQS

SEQ ID NO: 42204 - protein, 5 aa, Mycobacterium avium
QDAAV

SEQ ID NO: 42205 - protein, 7 aa, Mycobacterium avium
QDADGPA

SEQ ID NO: 42206 - protein, 6 aa, Mycobacterium avium
QDADTR

SEQ ID NO: 42207 - protein, 9 aa, Mycobacterium avium
QDAERNPEL

SEQ ID NO: 42208 - protein, 9 aa, Mycobacterium avium
QDAGEDTVD

SEQ ID NO: 42209 - protein, 15 aa, Mycobacterium avium
QDAKSQATAGYSIAS

SEQ ID NO: 42210 - protein, 10 aa, Mycobacterium avium
QDAPTGGDPL

SEQ ID NO: 42211 - protein, 14 aa, Mycobacterium avium
QDASEKFEESKQRY

SEQ ID NO: 42212 - protein, 6 aa, Mycobacterium avium
QDDELK

SEQ ID NO: 42213 - protein, 8 aa, Mycobacterium avium
QDDPAYRT

SEQ ID NO: 42214 - protein, 7 aa, Mycobacterium avium
QDDVDAV

SEQ ID NO: 42215 - protein, 7 aa, Mycobacterium avium
QDFDPAP

SEQ ID NO: 42216 - protein, 8 aa, Mycobacterium avium
QDGGLSRR

SEQ ID NO: 42217 - protein, 9 aa, Mycobacterium avium
QDGPASPPG

SEQ ID NO: 42218 - protein, 8 aa, Mycobacterium avium
QDGPPETV

SEQ ID NO: 42219 - protein, 5 aa, Mycobacterium avium
QDKAA

SEQ ID NO: 42220 - protein, 8 aa, Mycobacterium avium
QDKHGTAY

SEQ ID NO: 42221 - protein, 6 aa, Mycobacterium avium
QDKLRT

SEQ ID NO: 42222 - protein, 11 aa, Mycobacterium avium
QDLPPNAKTEI

SEQ ID NO: 42223 - protein, 7 aa, Mycobacterium avium
QDLSPND

SEQ ID NO: 42224 - protein, 15 aa, Mycobacterium avium
QDLSQHDSGAYTGDI

SEQ ID NO: 42225 - protein, 5 aa, Mycobacterium avium
QDNEV

SEQ ID NO: 42226 - protein, 8 aa, Mycobacterium avium
QDPAHSRR

SEQ ID NO: 42227 - protein, 6 aa, Mycobacterium avium
QDPARR

SEQ ID NO: 42228 - protein, 5 aa, Mycobacterium avium
QDPHE

SEQ ID NO: 42229 - protein, 4 aa, Mycobacterium avium
QDPM

SEQ ID NO: 42230 - protein, 5 aa, Mycobacterium avium
QDPRA

SEQ ID NO: 42231 - protein, 17 aa, Mycobacterium avium
QDPRRAAQIRRDDDTMD

SEQ ID NO: 42232 - protein, 6 aa, Mycobacterium avium
QDPRSR

SEQ ID NO: 42233 - protein, 4 aa, Mycobacterium avium
QDPT

SEQ ID NO: 42234 - protein, 9 aa, Mycobacterium avium
QDPTGKGEA

SEQ ID NO: 42235 - protein, 4 aa, Mycobacterium avium
QDPY

SEQ ID NO: 42236 - protein, 4 aa, Mycobacterium avium
QDQD

SEQ ID NO: 42237 - protein, 17 aa, Mycobacterium avium
QDQNLQDGPHKDLRRAR

SEQ ID NO: 42238 - protein, 9 aa, Mycobacterium avium
QDREALESA

SEQ ID NO: 42239 - protein, 4 aa, Mycobacterium avium
QDRP

SEQ ID NO: 42240 - protein, 7 aa, Mycobacterium avium
QDRTGGF

SEQ ID NO: 42241 - protein, 7 aa, Mycobacterium avium
QDSERAR

SEQ ID NO: 42242 - protein, 20 aa, Mycobacterium avium
QDSSATTQAAGEGAAMIASL

SEQ ID NO: 42243 - protein, 4 aa, Mycobacterium avium
QDSV

SEQ ID NO: 42244 - protein, 8 aa, Mycobacterium avium
QDTAAGGD

SEQ ID NO: 42245 - protein, 17 aa, Mycobacterium avium
QDTADRLTSTAQAESEK

SEQ ID NO: 42246 - protein, 7 aa, Mycobacterium avium
QDTAKRT

SEQ ID NO: 42247 - protein, 7 aa, Mycobacterium avium
QDTELTP

SEQ ID NO: 42248 - protein, 12 aa, Mycobacterium avium
QDTERARQLLSA

SEQ ID NO: 42249 - protein, 7 aa, Mycobacterium avium
QDTGSLA

SEQ ID NO: 42250 - protein, 5 aa, Mycobacterium avium
QDTNH

SEQ ID NO: 42251 - protein, 13 aa, Mycobacterium avium
QDVEDSRGERDAR

SEQ ID NO: 42252 - protein, 12 aa, Mycobacterium avium
QDWEPGQSKLSD

SEQ ID NO: 42253 - protein, 5 aa, Mycobacterium avium
QEAGA

SEQ ID NO: 42254 - protein, 8 aa, Mycobacterium avium
QEAGNLPP

SEQ ID NO: 42255 - protein, 9 aa, Mycobacterium avium
QEAPPPAEG

SEQ ID NO: 42256 - protein, 5 aa, Mycobacterium avium
QEAST

SEQ ID NO: 42257 - protein, 5 aa, Mycobacterium avium
QECGA

SEQ ID NO: 42258 - protein, 8 aa, Mycobacterium avium
QEDDGRRV

SEQ ID NO: 42259 - protein, 7 aa, Mycobacterium avium
QEDGEDV

SEQ ID NO: 42260 - protein, 5 aa, Mycobacterium avium
QEEHD

SEQ ID NO: 42261 - protein, 5 aa, Mycobacterium avium
QEERG

SEQ ID NO: 42262 - protein, 12 aa, Mycobacterium avium
QEFEEQKKRLLP

SEQ ID NO: 42263 - protein, 7 aa, Mycobacterium avium
QEGIKEQ

SEQ ID NO: 42264 - protein, 4 aa, Mycobacterium avium
QEGM

SEQ ID NO: 42265 - protein, 4 aa, Mycobacterium avium
QEGN

SEQ ID NO: 42266 - protein, 12 aa, Mycobacterium avium
QEGVADEGGRRV

SEQ ID NO: 42267 - protein, 7 aa, Mycobacterium avium
QEGVNDG

SEQ ID NO: 42268 - protein, 8 aa, Mycobacterium avium
QEGVSADA

SEQ ID NO: 42269 - protein, 4 aa, Mycobacterium avium
QEHG

SEQ ID NO: 42270 - protein, 20 aa, Mycobacterium avium
QELADKAARPTSDYPTFPDY

SEQ ID NO: 42271 - protein, 10 aa, Mycobacterium avium
QELGGKSPNI

SEQ ID NO: 42272 - protein, 10 aa, Mycobacterium avium
QELPPELPAT

SEQ ID NO: 42273 - protein, 10 aa, Mycobacterium avium
QELSGDELER

SEQ ID NO: 42274 - protein, 10 aa, Mycobacterium avium
QENEDVITDE

SEQ ID NO: 42275 - protein, 12 aa, Mycobacterium avium
QEPDDVGSSGRV

SEQ ID NO: 42276 - protein, 5 aa, Mycobacterium avium
QEPGA

SEQ ID NO: 42277 - protein, 5 aa, Mycobacterium avium
QEPGV

SEQ ID NO: 42278 - protein, 5 aa, Mycobacterium avium
QEQQT

SEQ ID NO: 42279 - protein, 8 aa, Mycobacterium avium
QERHAADP

SEQ ID NO: 42280 - protein, 7 aa, Mycobacterium avium
QERPDGL

SEQ ID NO: 42281 - protein, 14 aa, Mycobacterium avium
QERPRTAAALGERA

SEQ ID NO: 42282 - protein, 14 aa, Mycobacterium avium
QERQSAQQQHAPAA

SEQ ID NO: 42283 - protein, 7 aa, Mycobacterium avium
QERSNGH

SEQ ID NO: 42284 - protein, 12 aa, Mycobacterium avium
QESGTTRPIDPW

SEQ ID NO: 42285 - protein, 4 aa, Mycobacterium avium
QESI

SEQ ID NO: 42286 - protein, 12 aa, Mycobacterium avium
QETAREVVNKVI

SEQ ID NO: 42287 - protein, 7 aa, Mycobacterium avium
QETGQTV

SEQ ID NO: 42288 - protein, 4 aa, Mycobacterium avium
QETR

SEQ ID NO: 42289 - protein, 6 aa, Mycobacterium avium
QETTDF

SEQ ID NO: 42290 - protein, 4 aa, Mycobacterium avium
QETV

SEQ ID NO: 42291 - protein, 8 aa, Mycobacterium avium
QETYPDGP

SEQ ID NO: 42292 - protein, 4 aa, Mycobacterium avium
QEWG

SEQ ID NO: 42293 - protein, 5 aa, Mycobacterium avium
QEYRG

SEQ ID NO: 42294 - protein, 5 aa, Mycobacterium avium
QFETE

SEQ ID NO: 42295 - protein, 6 aa, Mycobacterium avium
QFPNPD

SEQ ID NO: 42296 - protein, 7 aa, Mycobacterium avium
QFPNPNN

SEQ ID NO: 42297 - protein, 5 aa, Mycobacterium avium
QFPTS

SEQ ID NO: 42298 - protein, 7 aa, Mycobacterium avium
QFSASSR

SEQ ID NO: 42299 - protein, 4 aa, Mycobacterium avium
QGAD

SEQ ID NO: 42300 - protein, 7 aa, Mycobacterium avium
QGADQPY

SEQ ID NO: 42301 - protein, 4 aa, Mycobacterium avium
QGAG

SEQ ID NO: 42302 - protein, 9 aa, Mycobacterium avium
QGAITERGR

SEQ ID NO: 42303 - protein, 13 aa, Mycobacterium avium
QGAKPGEGGQLPG

SEQ ID NO: 42304 - protein, 4 aa, Mycobacterium avium
QGAP

SEQ ID NO: 42305 - protein, 19 aa, Mycobacterium avium
QGARELAGASQRVAPAKLA

SEQ ID NO: 42306 - protein, 17 aa, Mycobacterium avium
QGARLAKQHSSSHGPPV

SEQ ID NO: 42307 - protein, 9 aa, Mycobacterium avium
QGASAAVQG

SEQ ID NO: 42308 - protein, 8 aa, Mycobacterium avium
QGASEERI

SEQ ID NO: 42309 - protein, 9 aa, Mycobacterium avium
QGASGSAYA

SEQ ID NO: 42310 - protein, 8 aa, Mycobacterium avium
QGATAQEA

SEQ ID NO: 42311 - protein, 7 aa, Mycobacterium avium
QGAYSTS

SEQ ID NO: 42312 - protein, 10 aa, Mycobacterium avium
QGDTGAAAKP

SEQ ID NO: 42313 - protein, 13 aa, Mycobacterium avium
QGEVGPGGGPAGD

SEQ ID NO: 42314 - protein, 11 aa, Mycobacterium avium
QGFPDEDGPAE

SEQ ID NO: 42315 - protein, 15 aa, Mycobacterium avium
QGFPPGAPYAGPTGK

SEQ ID NO: 42316 - protein, 4 aa, Mycobacterium avium
QGFS

SEQ ID NO: 42317 - protein, 5 aa, Mycobacterium avium
QGGDL

SEQ ID NO: 42318 - protein, 4 aa, Mycobacterium avium
QGGG

SEQ ID NO: 42319 - protein, 6 aa, Mycobacterium avium
QGGIEE

SEQ ID NO: 42320 - protein, 9 aa, Mycobacterium avium
QGGQGAGTV

SEQ ID NO: 42321 - protein, 5 aa, Mycobacterium avium
QGGRD

SEQ ID NO: 42322 - protein, 6 aa, Mycobacterium avium
QGGSVG

SEQ ID NO: 42323 - protein, 6 aa, Mycobacterium avium
QGHAPN

SEQ ID NO: 42324 - protein, 6 aa, Mycobacterium avium
QGIEAQ

SEQ ID NO: 42325 - protein, 4 aa, Mycobacterium avium
QGIP

SEQ ID NO: 42326 - protein, 5 aa, Mycobacterium avium
QGIPD

SEQ ID NO: 42327 - protein, 41 aa, Mycobacterium avium
QGKAQQDKADAQRSAGKKEAAAEKARGKAKAYEQRERAEQQ

SEQ ID NO: 42328 - protein, 8 aa, Mycobacterium avium
QGKDGKRS

SEQ ID NO: 42329 - protein, 9 aa, Mycobacterium avium
QGKEEFDTE

SEQ ID NO: 42330 - protein, 5 aa, Mycobacterium avium
QGKNL

SEQ ID NO: 42331 - protein, 9 aa, Mycobacterium avium
QGKPVGTVQ

SEQ ID NO: 42332 - protein, 5 aa, Mycobacterium avium
QGKTP

SEQ ID NO: 42333 - protein, 4 aa, Mycobacterium avium
QGLG

SEQ ID NO: 42334 - protein, 15 aa, Mycobacterium avium
QGNFGSPGNDPPAAM

SEQ ID NO: 42335 - protein, 9 aa, Mycobacterium avium
QGNPAQRRY

SEQ ID NO: 42336 - protein, 5 aa, Mycobacterium avium
QGNVT

SEQ ID NO: 42337 - protein, 12 aa, Mycobacterium avium
QGPDADHDADPD

SEQ ID NO: 42338 - protein, 8 aa, Mycobacterium avium
QGPGEVTA

SEQ ID NO: 42339 - protein, 10 aa, Mycobacterium avium
QGPGSPSAAT

SEQ ID NO: 42340 - protein, 4 aa, Mycobacterium avium
QGPK

SEQ ID NO: 42341 - protein, 10 aa, Mycobacterium avium
QGPLTQAGQS

SEQ ID NO: 42342 - protein, 10 aa, Mycobacterium avium
QGPPATGGPA

SEQ ID NO: 42343 - protein, 8 aa, Mycobacterium avium
QGPRPAGE

SEQ ID NO: 42344 - protein, 6 aa, Mycobacterium avium
QGPSPV

SEQ ID NO: 42345 - protein, 8 aa, Mycobacterium avium
QGPTAPWG

SEQ ID NO: 42346 - protein, 8 aa, Mycobacterium avium
QGPTATPC

SEQ ID NO: 42347 - protein, 7 aa, Mycobacterium avium
QGQAGDN

SEQ ID NO: 42348 - protein, 7 aa, Mycobacterium avium
QGQDRRA

SEQ ID NO: 42349 - protein, 9 aa, Mycobacterium avium
QGQKCSAAS

SEQ ID NO: 42350 - protein, 9 aa, Mycobacterium avium
QGQQAPSGH

SEQ ID NO: 42351 - protein, 4 aa, Mycobacterium avium
QGRG

SEQ ID NO: 42352 - protein, 11 aa, Mycobacterium avium
QGRGDAAEQTI

SEQ ID NO: 42353 - protein, 8 aa, Mycobacterium avium
QGRGEEAD

SEQ ID NO: 42354 - protein, 6 aa, Mycobacterium avium
QGRGGA

SEQ ID NO: 42355 - protein, 5 aa, Mycobacterium avium
QGRPV

SEQ ID NO: 42356 - protein, 7 aa, Mycobacterium avium
QGRRTAT

SEQ ID NO: 42357 - protein, 4 aa, Mycobacterium avium
QGRS

SEQ ID NO: 42358 - protein, 14 aa, Mycobacterium avium
QGRSSLRRPLDRPS

SEQ ID NO: 42359 - protein, 7 aa, Mycobacterium avium
QGSGGPA

SEQ ID NO: 42360 - protein, 13 aa, Mycobacterium avium
QGSGKDSDKEAAH

SEQ ID NO: 42361 - protein, 10 aa, Mycobacterium avium
QGSGKTSLAG

SEQ ID NO: 42362 - protein, 13 aa, Mycobacterium avium
QGSGYRSLDENQR

SEQ ID NO: 42363 - protein, 6 aa, Mycobacterium avium
QGSMTD

SEQ ID NO: 42364 - protein, 12 aa, Mycobacterium avium
QGSNKANEGLRS

SEQ ID NO: 42365 - protein, 11 aa, Mycobacterium avium
QGSPAADDDYA

SEQ ID NO: 42366 - protein, 6 aa, Mycobacterium avium
QGSPIN

SEQ ID NO: 42367 - protein, 7 aa, Mycobacterium avium
QGSQWSQ

SEQ ID NO: 42368 - protein, 7 aa, Mycobacterium avium
QGSQYAG

SEQ ID NO: 42369 - protein, 8 aa, Mycobacterium avium
QGSQYPGM

SEQ ID NO: 42370 - protein, 10 aa, Mycobacterium avium
QGSTRTKERE

SEQ ID NO: 42371 - protein, 9 aa, Mycobacterium avium
QGSWGPEAA

SEQ ID NO: 42372 - protein, 9 aa, Mycobacterium avium
QGTARTERA

SEQ ID NO: 42373 - protein, 4 aa, Mycobacterium avium
QGTD

SEQ ID NO: 42374 - protein, 4 aa, Mycobacterium avium
QGTG

SEQ ID NO: 42375 - protein, 12 aa, Mycobacterium avium
QGTGEGATFPRS

SEQ ID NO: 42376 - protein, 5 aa, Mycobacterium avium
QGTGG

SEQ ID NO: 42377 - protein, 20 aa, Mycobacterium avium
QGTKEYSTQNASGGSSGPFY

SEQ ID NO: 42378 - protein, 13 aa, Mycobacterium avium
QGTRPPTRTVRGL

SEQ ID NO: 42379 - protein, 4 aa, Mycobacterium avium
QGTS

SEQ ID NO: 42380 - protein, 7 aa, Mycobacterium avium
QGTTDGV

SEQ ID NO: 42381 - protein, 6 aa, Mycobacterium avium
QGVEEL

SEQ ID NO: 42382 - protein, 6 aa, Mycobacterium avium
QGWRGS

SEQ ID NO: 42383 - protein, 12 aa, Mycobacterium avium
QGYGRQKGHTEV

SEQ ID NO: 42384 - protein, 9 aa, Mycobacterium avium
QGYNSGIRD

SEQ ID NO: 42385 - protein, 6 aa, Mycobacterium avium
QHAQDT

SEQ ID NO: 42386 - protein, 7 aa, Mycobacterium avium
QHDTGQP

SEQ ID NO: 42387 - protein, 10 aa, Mycobacterium avium
QHEGDGSKPV

SEQ ID NO: 42388 - protein, 16 aa, Mycobacterium avium
QHEPSAHAAAADVDAA

SEQ ID NO: 42389 - protein, 6 aa, Mycobacterium avium
QHGEAQ

SEQ ID NO: 42390 - protein, 6 aa, Mycobacterium avium
QHGGAG

SEQ ID NO: 42391 - protein, 6 aa, Mycobacterium avium
QHGGPV

SEQ ID NO: 42392 - protein, 6 aa, Mycobacterium avium
QHGNKA

SEQ ID NO: 42393 - protein, 7 aa, Mycobacterium avium
QHGQTTS

SEQ ID NO: 42394 - protein, 5 aa, Mycobacterium avium
QHGRA

SEQ ID NO: 42395 - protein, 7 aa, Mycobacterium avium
QHKPGAE

SEQ ID NO: 42396 - protein, 14 aa, Mycobacterium avium
QHNQQRKSRSIAED

SEQ ID NO: 42397 - protein, 16 aa, Mycobacterium avium
QHSGGGVGGTGEETLA

SEQ ID NO: 42398 - protein, 4 aa, Mycobacterium avium
QHSM

SEQ ID NO: 42399 - protein, 6 aa, Mycobacterium avium
QIGEEV

SEQ ID NO: 42400 - protein, 11 aa, Mycobacterium avium
QIGPDPDAAEV

SEQ ID NO: 42401 - protein, 13 aa, Mycobacterium avium
QIGTATAAAAGPI

SEQ ID NO: 42402 - protein, 10 aa, Mycobacterium avium
QINGVPRDSA

SEQ ID NO: 42403 - protein, 10 aa, Mycobacterium avium
QIQAQAGRLP

SEQ ID NO: 42404 - protein, 10 aa, Mycobacterium avium
QIRSAGPEHA

SEQ ID NO: 42405 - protein, 7 aa, Mycobacterium avium
QISDGAS

SEQ ID NO: 42406 - protein, 5 aa, Mycobacterium avium
QITNP

SEQ ID NO: 42407 - protein, 4 aa, Mycobacterium avium
QKAQ

SEQ ID NO: 42408 - protein, 11 aa, Mycobacterium avium
QKDEGSMAQTD

SEQ ID NO: 42409 - protein, 7 aa, Mycobacterium avium
QKGEITY

SEQ ID NO: 42410 - protein, 4 aa, Mycobacterium avium
QKGG

SEQ ID NO: 42411 - protein, 7 aa, Mycobacterium avium
QKGTTIA

SEQ ID NO: 42412 - protein, 5 aa, Mycobacterium avium
QKIRQ

SEQ ID NO: 42413 - protein, 8 aa, Mycobacterium avium
QKNQRAQR

SEQ ID NO: 42414 - protein, 8 aa, Mycobacterium avium
QKPAGPAK

SEQ ID NO: 42415 - protein, 10 aa, Mycobacterium avium
QKPPRPLEAT

SEQ ID NO: 42416 - protein, 8 aa, Mycobacterium avium
QKPTGEAE

SEQ ID NO: 42417 - protein, 8 aa, Mycobacterium avium
QKQAQGGS

SEQ ID NO: 42418 - protein, 8 aa, Mycobacterium avium
QKQQHERG

SEQ ID NO: 42419 - protein, 7 aa, Mycobacterium avium
QKRADDL

SEQ ID NO: 42420 - protein, 9 aa, Mycobacterium avium
QKRAGQPVT

SEQ ID NO: 42421 - protein, 5 aa, Mycobacterium avium
QKSID

SEQ ID NO: 42422 - protein, 6 aa, Mycobacterium avium
QKSTNG

SEQ ID NO: 42423 - protein, 11 aa, Mycobacterium avium
QKVGNGHPGTA

SEQ ID NO: 42424 - protein, 7 aa, Mycobacterium avium
QKWQQSE

SEQ ID NO: 42425 - protein, 14 aa, Mycobacterium avium
QKYDPGRVMFSGLN

SEQ ID NO: 42426 - protein, 10 aa, Mycobacterium avium
QLAGPGYGTP

SEQ ID NO: 42427 - protein, 18 aa, Mycobacterium avium
QLASTSTVRGWERLRIVV

SEQ ID NO: 42428 - protein, 6 aa, Mycobacterium avium
QLDENA

SEQ ID NO: 42429 - protein, 7 aa, Mycobacterium avium
QLDENPY

SEQ ID NO: 42430 - protein, 16 aa, Mycobacterium avium
QLDQPAGTLSGGEKTR

SEQ ID NO: 42431 - protein, 6 aa, Mycobacterium avium
QLEGPV

SEQ ID NO: 42432 - protein, 5 aa, Mycobacterium avium
QLGEH

SEQ ID NO: 42433 - protein, 9 aa, Mycobacterium avium
QLGGADNAT

SEQ ID NO: 42434 - protein, 10 aa, Mycobacterium avium
QLGGEAATTA

SEQ ID NO: 42435 - protein, 5 aa, Mycobacterium avium
QLGGG

SEQ ID NO: 42436 - protein, 4 aa, Mycobacterium avium
QLGS

SEQ ID NO: 42437 - protein, 9 aa, Mycobacterium avium
QLGTKGPSL

SEQ ID NO: 42438 - protein, 4 aa, Mycobacterium avium
QLHD

SEQ ID NO: 42439 - protein, 5 aa, Mycobacterium avium
QLKSK

SEQ ID NO: 42440 - protein, 6 aa, Mycobacterium avium
QLKTGR

SEQ ID NO: 42441 - protein, 6 aa, Mycobacterium avium
QLPEEL

SEQ ID NO: 42442 - protein, 13 aa, Mycobacterium avium
QLPEVTSASGTEL

SEQ ID NO: 42443 - protein, 11 aa, Mycobacterium avium
QLPGGAALATG

SEQ ID NO: 42444 - protein, 14 aa, Mycobacterium avium
QLPPSALTGTTGLG

SEQ ID NO: 42445 - protein, 9 aa, Mycobacterium avium
QLPRKGSYL

SEQ ID NO: 42446 - protein, 6 aa, Mycobacterium avium
QLPRTG

SEQ ID NO: 42447 - protein, 7 aa, Mycobacterium avium
QLPSPQD

SEQ ID NO: 42448 - protein, 11 aa, Mycobacterium avium
QLPTAGGKQAE

SEQ ID NO: 42449 - protein, 6 aa, Mycobacterium avium
QLPTGF

SEQ ID NO: 42450 - protein, 6 aa, Mycobacterium avium
QLRDEG

SEQ ID NO: 42451 - protein, 6 aa, Mycobacterium avium
QLRERA

SEQ ID NO: 42452 - protein, 15 aa, Mycobacterium avium
QLRGRAGRQGDPGSS

SEQ ID NO: 42453 - protein, 15 aa, Mycobacterium avium
QLRGRSGRQGDPGES

SEQ ID NO: 42454 - protein, 5 aa, Mycobacterium avium
QLSAG

SEQ ID NO: 42455 - protein, 7 aa, Mycobacterium avium
QLSERAQ

SEQ ID NO: 42456 - protein, 26 aa, Mycobacterium avium
QLSGRRGERDHRRAGAAGELTGATRP

SEQ ID NO: 42457 - protein, 7 aa, Mycobacterium avium
QLSPTDK

SEQ ID NO: 42458 - protein, 8 aa, Mycobacterium avium
QLTAEGRP

SEQ ID NO: 42459 - protein, 9 aa, Mycobacterium avium
QLTGDEAHE

SEQ ID NO: 42460 - protein, 6 aa, Mycobacterium avium
QLTNNR

SEQ ID NO: 42461 - protein, 6 aa, Mycobacterium avium
QLTRAG

SEQ ID NO: 42462 - protein, 8 aa, Mycobacterium avium
QMAGRGTD

SEQ ID NO: 42463 - protein, 6 aa, Mycobacterium avium
QMRPGD

SEQ ID NO: 42464 - protein, 10 aa, Mycobacterium avium
QMTDKTAPRV

SEQ ID NO: 42465 - protein, 20 aa, Mycobacterium avium
QNAAAGEDPDFGRGRSAYDR

SEQ ID NO: 42466 - protein, 30 aa, Mycobacterium avium
QNADAGRQPHISGGGISQPSEGSTSSLYCG

SEQ ID NO: 42467 - protein, 10 aa, Mycobacterium avium
QNADGSAVKL

SEQ ID NO: 42468 - protein, 11 aa, Mycobacterium avium
QNAKDAAYQPM

SEQ ID NO: 42469 - protein, 15 aa, Mycobacterium avium
QNATPQDLSDESVAA

SEQ ID NO: 42470 - protein, 5 aa, Mycobacterium avium
QNDAT

SEQ ID NO: 42471 - protein, 5 aa, Mycobacterium avium
QNIKS

SEQ ID NO: 42472 - protein, 10 aa, Mycobacterium avium
QNKKQGEASA

SEQ ID NO: 42473 - protein, 19 aa, Mycobacterium avium
QNLPGYSGSGDGSASTLGG

SEQ ID NO: 42474 - protein, 5 aa, Mycobacterium avium
QNMSG

SEQ ID NO: 42475 - protein, 19 aa, Mycobacterium avium
QNMSNNSAVTVEGGEIGRA

SEQ ID NO: 42476 - protein, 6 aa, Mycobacterium avium
QNNELG

SEQ ID NO: 42477 - protein, 11 aa, Mycobacterium avium
QNNGSKTTIAP

SEQ ID NO: 42478 - protein, 6 aa, Mycobacterium avium
QNPGVT

SEQ ID NO: 42479 - protein, 5 aa, Mycobacterium avium
QNPRS

SEQ ID NO: 42480 - protein, 8 aa, Mycobacterium avium
QNPVARDS

SEQ ID NO: 42481 - protein, 6 aa, Mycobacterium avium
QNPVEY

SEQ ID NO: 42482 - protein, 5 aa, Mycobacterium avium
QNQET

SEQ ID NO: 42483 - protein, 10 aa, Mycobacterium avium
QNRASGAEIG

SEQ ID NO: 42484 - protein, 11 aa, Mycobacterium avium
QNREKAREQRN

SEQ ID NO: 42485 - protein, 16 aa, Mycobacterium avium
QNRRSHPLQGDQTLAE

SEQ ID NO: 42486 - protein, 6 aa, Mycobacterium avium
QNSDVH

SEQ ID NO: 42487 - protein, 8 aa, Mycobacterium avium
QNTEGSIT

SEQ ID NO: 42488 - protein, 5 aa, Mycobacterium avium
QNTFA

SEQ ID NO: 42489 - protein, 12 aa, Mycobacterium avium
QNTPAIATTEAE

SEQ ID NO: 42490 - protein, 11 aa, Mycobacterium avium
QNWESGDEKKQ

SEQ ID NO: 42491 - protein, 9 aa, Mycobacterium avium
QPAATAEEI

SEQ ID NO: 42492 - protein, 16 aa, Mycobacterium avium
QPAATALEAAQRARQR

SEQ ID NO: 42493 - protein, 12 aa, Mycobacterium avium
QPADGVPPGPDL

SEQ ID NO: 42494 - protein, 10 aa, Mycobacterium avium
QPADSYRNDH

SEQ ID NO: 42495 - protein, 10 aa, Mycobacterium avium
QPAKNQAVTN

SEQ ID NO: 42496 - protein, 4 aa, Mycobacterium avium
QPAN

SEQ ID NO: 42497 - protein, 13 aa, Mycobacterium avium
QPAPESSGAVAGP

SEQ ID NO: 42498 - protein, 13 aa, Mycobacterium avium
QPAPTLSGGEAQR

SEQ ID NO: 42499 - protein, 16 aa, Mycobacterium avium
QPAQAPDPRVRGSAHT

SEQ ID NO: 42500 - protein, 6 aa, Mycobacterium avium
QPATPT

SEQ ID NO: 42501 - protein, 9 aa, Mycobacterium avium
QPAVDDAGQ

SEQ ID NO: 42502 - protein, 10 aa, Mycobacterium avium
QPDAQGNRPD

SEQ ID NO: 42503 - protein, 7 aa, Mycobacterium avium
QPDDYRD

SEQ ID NO: 42504 - protein, 6 aa, Mycobacterium avium
QPDGFR

SEQ ID NO: 42505 - protein, 8 aa, Mycobacterium avium
QPDLSPKA

SEQ ID NO: 42506 - protein, 6 aa, Mycobacterium avium
QPDNPR

SEQ ID NO: 42507 - protein, 8 aa, Mycobacterium avium
QPDPGDVA

SEQ ID NO: 42508 - protein, 19 aa, Mycobacterium avium
QPDPRRPGRRAWSAAALLT

SEQ ID NO: 42509 - protein, 8 aa, Mycobacterium avium
QPDRPNRG

SEQ ID NO: 42510 - protein, 6 aa, Mycobacterium avium
QPDTGV

SEQ ID NO: 42511 - protein, 4 aa, Mycobacterium avium
QPDV

SEQ ID NO: 42512 - protein, 4 aa, Mycobacterium avium
QPEI

SEQ ID NO: 42513 - protein, 6 aa, Mycobacterium avium
QPEKPD

SEQ ID NO: 42514 - protein, 5 aa, Mycobacterium avium
QPEQT

SEQ ID NO: 42515 - protein, 5 aa, Mycobacterium avium
QPETI

SEQ ID NO: 42516 - protein, 19 aa, Mycobacterium avium
QPFGGSRGSGTNDKAGSPL

SEQ ID NO: 42517 - protein, 7 aa, Mycobacterium avium
QPFPGPG

SEQ ID NO: 42518 - protein, 5 aa, Mycobacterium avium
QPGAA

SEQ ID NO: 42519 - protein, 6 aa, Mycobacterium avium
QPGAGM

SEQ ID NO: 42520 - protein, 6 aa, Mycobacterium avium
QPGALG

SEQ ID NO: 42521 - protein, 24 aa, Mycobacterium avium
QPGFRDADKAAAANLAAAAKDAGV

SEQ ID NO: 42522 - protein, 14 aa, Mycobacterium avium
QPGLDGSVTAPDAA

SEQ ID NO: 42523 - protein, 9 aa, Mycobacterium avium
QPGRSFGPA

SEQ ID NO: 42524 - protein, 17 aa, Mycobacterium avium
QPGSLGGGAQDRESPMG

SEQ ID NO: 42525 - protein, 11 aa, Mycobacterium avium
QPGTEVERDQY

SEQ ID NO: 42526 - protein, 10 aa, Mycobacterium avium
QPGTSNSAWD

SEQ ID NO: 42527 - protein, 9 aa, Mycobacterium avium
QPGTVTPTT

SEQ ID NO: 42528 - protein, 7 aa, Mycobacterium avium
QPGTWGP

SEQ ID NO: 42529 - protein, 13 aa, Mycobacterium avium
QPHQGGIDTPPQR

SEQ ID NO: 42530 - protein, 12 aa, Mycobacterium avium
QPHRSGRYQPNG

SEQ ID NO: 42531 - protein, 16 aa, Mycobacterium avium
QPIAPRKGAGRVNGRP

SEQ ID NO: 42532 - protein, 16 aa, Mycobacterium avium
QPISGPGEWNRSDYRP

SEQ ID NO: 42533 - protein, 8 aa, Mycobacterium avium
QPKADGSV

SEQ ID NO: 42534 - protein, 8 aa, Mycobacterium avium
QPKSAGYV

SEQ ID NO: 42535 - protein, 4 aa, Mycobacterium avium
QPKW

SEQ ID NO: 42536 - protein, 4 aa, Mycobacterium avium
QPLA

SEQ ID NO: 42537 - protein, 6 aa, Mycobacterium avium
QPLAAQ

SEQ ID NO: 42538 - protein, 9 aa, Mycobacterium avium
QPLPANPGA

SEQ ID NO: 42539 - protein, 13 aa, Mycobacterium avium
QPLRHGKGEKLPV

SEQ ID NO: 42540 - protein, 7 aa, Mycobacterium avium
QPPAATS

SEQ ID NO: 42541 - protein, 11 aa, Mycobacterium avium
QPPADASDDTV

SEQ ID NO: 42542 - protein, 8 aa, Mycobacterium avium
QPPEGAGR

SEQ ID NO: 42543 - protein, 6 aa, Mycobacterium avium
QPPELE

SEQ ID NO: 42544 - protein, 8 aa, Mycobacterium avium
QPPGAVNG

SEQ ID NO: 42545 - protein, 8 aa, Mycobacterium avium
QPQPETLD

SEQ ID NO: 42546 - protein, 6 aa, Mycobacterium avium
QPQRRA

SEQ ID NO: 42547 - protein, 15 aa, Mycobacterium avium
QPRDVSAAKAAASDA

SEQ ID NO: 42548 - protein, 8 aa, Mycobacterium avium
QPRFDPAR

SEQ ID NO: 42549 - protein, 10 aa, Mycobacterium avium
QPRPGTRPSL

SEQ ID NO: 42550 - protein, 7 aa, Mycobacterium avium
QPRSAGR

SEQ ID NO: 42551 - protein, 11 aa, Mycobacterium avium
QPRSPTTTGKI

SEQ ID NO: 42552 - protein, 5 aa, Mycobacterium avium
QPSAA

SEQ ID NO: 42553 - protein, 7 aa, Mycobacterium avium
QPSATGR

SEQ ID NO: 42554 - protein, 8 aa, Mycobacterium avium
QPSETRLD

SEQ ID NO: 42555 - protein, 11 aa, Mycobacterium avium
QPSVSDSKKTV

SEQ ID NO: 42556 - protein, 7 aa, Mycobacterium avium
QPTAETR

SEQ ID NO: 42557 - protein, 18 aa, Mycobacterium avium
QPTFGGGARTAADPDSAG

SEQ ID NO: 42558 - protein, 10 aa, Mycobacterium avium
QPTPADEESL

SEQ ID NO: 42559 - protein, 7 aa, Mycobacterium avium
QPTPPPI

SEQ ID NO: 42560 - protein, 4 aa, Mycobacterium avium
QPVE

SEQ ID NO: 42561 - protein, 4 aa, Mycobacterium avium
QPVL

SEQ ID NO: 42562 - protein, 5 aa, Mycobacterium avium
QPVPS

SEQ ID NO: 42563 - protein, 5 aa, Mycobacterium avium
QPVPT

SEQ ID NO: 42564 - protein, 5 aa, Mycobacterium avium
QPVRS

SEQ ID NO: 42565 - protein, 8 aa, Mycobacterium avium
QPVSPQGY

SEQ ID NO: 42566 - protein, 11 aa, Mycobacterium avium
QPWDTSDQREL

SEQ ID NO: 42567 - protein, 14 aa, Mycobacterium avium
QPWPGTGAVPPSPF

SEQ ID NO: 42568 - protein, 5 aa, Mycobacterium avium
QPWSD

SEQ ID NO: 42569 - protein, 6 aa, Mycobacterium avium
QQAASA

SEQ ID NO: 42570 - protein, 7 aa, Mycobacterium avium
QQAGDAH

SEQ ID NO: 42571 - protein, 10 aa, Mycobacterium avium
QQAKTTPQRA

SEQ ID NO: 42572 - protein, 9 aa, Mycobacterium avium
QQAQAAGTS

SEQ ID NO: 42573 - protein, 8 aa, Mycobacterium avium
QQDGAQQV

SEQ ID NO: 42574 - protein, 4 aa, Mycobacterium avium
QQDL

SEQ ID NO: 42575 - protein, 8 aa, Mycobacterium avium
QQDQGAQM

SEQ ID NO: 42576 - protein, 6 aa, Mycobacterium avium
QQEAGK

SEQ ID NO: 42577 - protein, 6 aa, Mycobacterium avium
QQEAGR

SEQ ID NO: 42578 - protein, 8 aa, Mycobacterium avium
QQEQGTAD

SEQ ID NO: 42579 - protein, 21 aa, Mycobacterium avium
QQGKSREEFENETRTAAETDV

SEQ ID NO: 42580 - protein, 6 aa, Mycobacterium avium
QQGTEA

SEQ ID NO: 42581 - protein, 6 aa, Mycobacterium avium
QQGTRL

SEQ ID NO: 42582 - protein, 12 aa, Mycobacterium avium
QQIGTPDELYEN

SEQ ID NO: 42583 - protein, 7 aa, Mycobacterium avium
QQLDPQA

SEQ ID NO: 42584 - protein, 6 aa, Mycobacterium avium
QQLPPR

SEQ ID NO: 42585 - protein, 5 aa, Mycobacterium avium
QQPPE

SEQ ID NO: 42586 - protein, 7 aa, Mycobacterium avium
QQRAGTT

SEQ ID NO: 42587 - protein, 5 aa, Mycobacterium avium
QQRDL

SEQ ID NO: 42588 - protein, 11 aa, Mycobacterium avium
QQRDPQPQRRA

SEQ ID NO: 42589 - protein, 11 aa, Mycobacterium avium
QQRGMERTRSD

SEQ ID NO: 42590 - protein, 9 aa, Mycobacterium avium
QQRPDRLAG

SEQ ID NO: 42591 - protein, 7 aa, Mycobacterium avium
QQRPHDA

SEQ ID NO: 42592 - protein, 12 aa, Mycobacterium avium
QQRPLGPGEDGD

SEQ ID NO: 42593 - protein, 7 aa, Mycobacterium avium
QQRRPNK

SEQ ID NO: 42594 - protein, 8 aa, Mycobacterium avium
QQSGNSPM

SEQ ID NO: 42595 - protein, 6 aa, Mycobacterium avium
QQSMDN

SEQ ID NO: 42596 - protein, 6 aa, Mycobacterium avium
QQSPND

SEQ ID NO: 42597 - protein, 11 aa, Mycobacterium avium
QQSQAAGGPAM

SEQ ID NO: 42598 - protein, 11 aa, Mycobacterium avium
QQTAHAQRQPG

SEQ ID NO: 42599 - protein, 23 aa, Mycobacterium avium
QQTDYPSVGPDRPEYEPRGCPRG

SEQ ID NO: 42600 - protein, 9 aa, Mycobacterium avium
QQTGGKPYG

SEQ ID NO: 42601 - protein, 9 aa, Mycobacterium avium
QQVPPEVRD

SEQ ID NO: 42602 - protein, 5 aa, Mycobacterium avium
QQVRD

SEQ ID NO: 42603 - protein, 7 aa, Mycobacterium avium
QQVSGPT

SEQ ID NO: 42604 - protein, 8 aa, Mycobacterium avium
QQWEGSPE

SEQ ID NO: 42605 - protein, 7 aa, Mycobacterium avium
QQYPPDE

SEQ ID NO: 42606 - protein, 8 aa, Mycobacterium avium
QRAAARAE

SEQ ID NO: 42607 - protein, 46 aa, Mycobacterium avium
QRAAARQGTHSTKTRGDVSGGGRKPYRQKGTGRARQGSTRAPQFTG

SEQ ID NO: 42608 - protein, 11 aa, Mycobacterium avium
QRADHAEHAQR

SEQ ID NO: 42609 - protein, 5 aa, Mycobacterium avium
QRAEA

SEQ ID NO: 42610 - protein, 15 aa, Mycobacterium avium
QRAEPDLKSGRGGLR

SEQ ID NO: 42611 - protein, 12 aa, Mycobacterium avium
QRAEREKQWRSG

SEQ ID NO: 42612 - protein, 5 aa, Mycobacterium avium
QRAEW

SEQ ID NO: 42613 - protein, 9 aa, Mycobacterium avium
QRAEWSEER

SEQ ID NO: 42614 - protein, 8 aa, Mycobacterium avium
QRAHDRND

SEQ ID NO: 42615 - protein, 8 aa, Mycobacterium avium
QRAHGSSV

SEQ ID NO: 42616 - protein, 9 aa, Mycobacterium avium
QRAKRRLPK

SEQ ID NO: 42617 - protein, 6 aa, Mycobacterium avium
QRAPAS

SEQ ID NO: 42618 - protein, 8 aa, Mycobacterium avium
QRAQGNRP

SEQ ID NO: 42619 - protein, 4 aa, Mycobacterium avium
QRAR

SEQ ID NO: 42620 - protein, 11 aa, Mycobacterium avium
QRARGGPGAGQ

SEQ ID NO: 42621 - protein, 7 aa, Mycobacterium avium
QRARQVT

SEQ ID NO: 42622 - protein, 20 aa, Mycobacterium avium
QRAYEQRSSLNRHGAAAVPE

SEQ ID NO: 42623 - protein, 5 aa, Mycobacterium avium
QRCES

SEQ ID NO: 42624 - protein, 4 aa, Mycobacterium avium
QRDD

SEQ ID NO: 42625 - protein, 9 aa, Mycobacterium avium
QRDGAGGRS

SEQ ID NO: 42626 - protein, 24 aa, Mycobacterium avium
QRDPTAAGKRHAAQAAAARPQLPV

SEQ ID NO: 42627 - protein, 8 aa, Mycobacterium avium
QRDRERIS

SEQ ID NO: 42628 - protein, 13 aa, Mycobacterium avium
QRDRPDEAGYRGE

SEQ ID NO: 42629 - protein, 6 aa, Mycobacterium avium
QRDTDH

SEQ ID NO: 42630 - protein, 7 aa, Mycobacterium avium
QREPERK

SEQ ID NO: 42631 - protein, 20 aa, Mycobacterium avium
QREQGYDGSWTGDDNTDKIE

SEQ ID NO: 42632 - protein, 7 aa, Mycobacterium avium
QRESMGN

SEQ ID NO: 42633 - protein, 8 aa, Mycobacterium avium
QRETFGKP

SEQ ID NO: 42634 - protein, 5 aa, Mycobacterium avium
QRETT

SEQ ID NO: 42635 - protein, 4 aa, Mycobacterium avium
QRGD

SEQ ID NO: 42636 - protein, 5 aa, Mycobacterium avium
QRGDA

SEQ ID NO: 42637 - protein, 8 aa, Mycobacterium avium
QRGDPIEQ

SEQ ID NO: 42638 - protein, 16 aa, Mycobacterium avium
QRGGPSTGLPTKTEQA

SEQ ID NO: 42639 - protein, 16 aa, Mycobacterium avium
QRGGPTEAEPGSTRPR

SEQ ID NO: 42640 - protein, 9 aa, Mycobacterium avium
QRGGTPTAY

SEQ ID NO: 42641 - protein, 7 aa, Mycobacterium avium
QRGPTLD

SEQ ID NO: 42642 - protein, 11 aa, Mycobacterium avium
QRGQIDDPKLS

SEQ ID NO: 42643 - protein, 7 aa, Mycobacterium avium
QRGTSRD

SEQ ID NO: 42644 - protein, 14 aa, Mycobacterium avium
QRHASQLRHSGDPY

SEQ ID NO: 42645 - protein, 4 aa, Mycobacterium avium
QRHK

SEQ ID NO: 42646 - protein, 6 aa, Mycobacterium avium
QRHQTP

SEQ ID NO: 42647 - protein, 7 aa, Mycobacterium avium
QRIAKGE

SEQ ID NO: 42648 - protein, 13 aa, Mycobacterium avium
QRKSELRRAEDPV

SEQ ID NO: 42649 - protein, 6 aa, Mycobacterium avium
QRNGER

SEQ ID NO: 42650 - protein, 19 aa, Mycobacterium avium
QRNHKGAGASVADLTTDPD

SEQ ID NO: 42651 - protein, 11 aa, Mycobacterium avium
QRNPDLPVEGP

SEQ ID NO: 42652 - protein, 5 aa, Mycobacterium avium
QRNRS

SEQ ID NO: 42653 - protein, 12 aa, Mycobacterium avium
QRPADLAAARSG

SEQ ID NO: 42654 - protein, 7 aa, Mycobacterium avium
QRPEIRR

SEQ ID NO: 42655 - protein, 5 aa, Mycobacterium avium
QRPGA

SEQ ID NO: 42656 - protein, 6 aa, Mycobacterium avium
QRPGVG

SEQ ID NO: 42657 - protein, 6 aa, Mycobacterium avium
QRPNAR

SEQ ID NO: 42658 - protein, 4 aa, Mycobacterium avium
QRPP

SEQ ID NO: 42659 - protein, 5 aa, Mycobacterium avium
QRPPE

SEQ ID NO: 42660 - protein, 8 aa, Mycobacterium avium
QRPPGPVP

SEQ ID NO: 42661 - protein, 10 aa, Mycobacterium avium
QRPQTGEWAS

SEQ ID NO: 42662 - protein, 6 aa, Mycobacterium avium
QRPRGA

SEQ ID NO: 42663 - protein, 17 aa, Mycobacterium avium
QRPRRGHTGGCGRTPSA

SEQ ID NO: 42664 - protein, 6 aa, Mycobacterium avium
QRQMDR

SEQ ID NO: 42665 - protein, 6 aa, Mycobacterium avium
QRQPEA

SEQ ID NO: 42666 - protein, 7 aa, Mycobacterium avium
QRRADDP

SEQ ID NO: 42667 - protein, 6 aa, Mycobacterium avium
QRRAGR

SEQ ID NO: 42668 - protein, 4 aa, Mycobacterium avium
QRRD

SEQ ID NO: 42669 - protein, 5 aa, Mycobacterium avium
QRRGM

SEQ ID NO: 42670 - protein, 16 aa, Mycobacterium avium
QRRGRGAGAPTADQRV

SEQ ID NO: 42671 - protein, 6 aa, Mycobacterium avium
QRRPGC

SEQ ID NO: 42672 - protein, 9 aa, Mycobacterium avium
QRRRAARTA

SEQ ID NO: 42673 - protein, 15 aa, Mycobacterium avium
QRRRAKADAAARKHA

SEQ ID NO: 42674 - protein, 6 aa, Mycobacterium avium
QRRSPD

SEQ ID NO: 42675 - protein, 6 aa, Mycobacterium avium
QRRTRE

SEQ ID NO: 42676 - protein, 6 aa, Mycobacterium avium
QRSAGA

SEQ ID NO: 42677 - protein, 4 aa, Mycobacterium avium
QRSP

SEQ ID NO: 42678 - protein, 7 aa, Mycobacterium avium
QRSRGIA

SEQ ID NO: 42679 - protein, 5 aa, Mycobacterium avium
QRSRV

SEQ ID NO: 42680 - protein, 7 aa, Mycobacterium avium
QRSSGNP

SEQ ID NO: 42681 - protein, 11 aa, Mycobacterium avium
QRTAAGVVPTD

SEQ ID NO: 42682 - protein, 11 aa, Mycobacterium avium
QRTAGQSTRTA

SEQ ID NO: 42683 - protein, 4 aa, Mycobacterium avium
QRTE

SEQ ID NO: 42684 - protein, 6 aa, Mycobacterium avium
QRTERA

SEQ ID NO: 42685 - protein, 14 aa, Mycobacterium avium
QRTGLSEIDSDSWR

SEQ ID NO: 42686 - protein, 6 aa, Mycobacterium avium
QRTSAR

SEQ ID NO: 42687 - protein, 12 aa, Mycobacterium avium
QRTSHGLPAATP

SEQ ID NO: 42688 - protein, 7 aa, Mycobacterium avium
QRVGENG

SEQ ID NO: 42689 - protein, 10 aa, Mycobacterium avium
QRYSRRRAEH

SEQ ID NO: 42690 - protein, 4 aa, Mycobacterium avium
QSAG

SEQ ID NO: 42691 - protein, 6 aa, Mycobacterium avium
QSAGEA

SEQ ID NO: 42692 - protein, 8 aa, Mycobacterium avium
QSAQPEIV

SEQ ID NO: 42693 - protein, 17 aa, Mycobacterium avium
QSAQTWRAETAGLDSTA

SEQ ID NO: 42694 - protein, 5 aa, Mycobacterium avium
QSARP

SEQ ID NO: 42695 - protein, 6 aa, Mycobacterium avium
QSDAYT

SEQ ID NO: 42696 - protein, 48 aa, Mycobacterium avium
QSDGPAALPPLPPSSPRRRPQTHSRTRHSETRHSDKPATGRKNGHGPG

SEQ ID NO: 42697 - protein, 8 aa, Mycobacterium avium
QSDGTPAG

SEQ ID NO: 42698 - protein, 13 aa, Mycobacterium avium
QSDQQRATGELRL

SEQ ID NO: 42699 - protein, 5 aa, Mycobacterium avium
QSEPL

SEQ ID NO: 42700 - protein, 7 aa, Mycobacterium avium
QSERYGV

SEQ ID NO: 42701 - protein, 12 aa, Mycobacterium avium
QSGAAPGAGETR

SEQ ID NO: 42702 - protein, 7 aa, Mycobacterium avium
QSGDTVK

SEQ ID NO: 42703 - protein, 9 aa, Mycobacterium avium
QSGETADTL

SEQ ID NO: 42704 - protein, 6 aa, Mycobacterium avium
QSGGRL

SEQ ID NO: 42705 - protein, 9 aa, Mycobacterium avium
QSGGSTPKA

SEQ ID NO: 42706 - protein, 7 aa, Mycobacterium avium
QSGHQPI

SEQ ID NO: 42707 - protein, 11 aa, Mycobacterium avium
QSGIGREFGPE

SEQ ID NO: 42708 - protein, 4 aa, Mycobacterium avium
QSGK

SEQ ID NO: 42709 - protein, 18 aa, Mycobacterium avium
QSGLGRELGPDAPAQFTE

SEQ ID NO: 42710 - protein, 9 aa, Mycobacterium avium
QSGPDITNP

SEQ ID NO: 42711 - protein, 8 aa, Mycobacterium avium
QSGQGADE

SEQ ID NO: 42712 - protein, 8 aa, Mycobacterium avium
QSGRRGRV

SEQ ID NO: 42713 - protein, 7 aa, Mycobacterium avium
QSGVGRE

SEQ ID NO: 42714 - protein, 5 aa, Mycobacterium avium
QSIPA

SEQ ID NO: 42715 - protein, 5 aa, Mycobacterium avium
QSKNP

SEQ ID NO: 42716 - protein, 5 aa, Mycobacterium avium
QSKRR

SEQ ID NO: 42717 - protein, 4 aa, Mycobacterium avium
QSLD

SEQ ID NO: 42718 - protein, 4 aa, Mycobacterium avium
QSLE

SEQ ID NO: 42719 - protein, 9 aa, Mycobacterium avium
QSLPGKAIQ

SEQ ID NO: 42720 - protein, 10 aa, Mycobacterium avium
QSLSTEGATA

SEQ ID NO: 42721 - protein, 15 aa, Mycobacterium avium
QSLTDGGTLAKPQVS

SEQ ID NO: 42722 - protein, 15 aa, Mycobacterium avium
QSNQVKGNTYPNPPV

SEQ ID NO: 42723 - protein, 9 aa, Mycobacterium avium
QSPDAVDAG

SEQ ID NO: 42724 - protein, 11 aa, Mycobacterium avium
QSPDPSGPGSG

SEQ ID NO: 42725 - protein, 6 aa, Mycobacterium avium
QSPEIS

SEQ ID NO: 42726 - protein, 5 aa, Mycobacterium avium
QSPGL

SEQ ID NO: 42727 - protein, 16 aa, Mycobacterium avium
QSPIGRTPRSNPATYT

SEQ ID NO: 42728 - protein, 4 aa, Mycobacterium avium
QSPQ

SEQ ID NO: 42729 - protein, 7 aa, Mycobacterium avium
QSPRGGT

SEQ ID NO: 42730 - protein, 7 aa, Mycobacterium avium
QSPRGRD

SEQ ID NO: 42731 - protein, 15 aa, Mycobacterium avium
QSPSEAQLRWELAGC

SEQ ID NO: 42732 - protein, 5 aa, Mycobacterium avium
QSPTK

SEQ ID NO: 42733 - protein, 5 aa, Mycobacterium avium
QSPTV

SEQ ID NO: 42734 - protein, 13 aa, Mycobacterium avium
QSQPADPSDPPTV

SEQ ID NO: 42735 - protein, 6 aa, Mycobacterium avium
QSQPSH

SEQ ID NO: 42736 - protein, 6 aa, Mycobacterium avium
QSRDGE

SEQ ID NO: 42737 - protein, 5 aa, Mycobacterium avium
QSRDT

SEQ ID NO: 42738 - protein, 4 aa, Mycobacterium avium
QSRR

SEQ ID NO: 42739 - protein, 12 aa, Mycobacterium avium
QSRSGEDETAWR

SEQ ID NO: 42740 - protein, 11 aa, Mycobacterium avium
QSRTDSETEAL

SEQ ID NO: 42741 - protein, 10 aa, Mycobacterium avium
QSRVGATAEA

SEQ ID NO: 42742 - protein, 9 aa, Mycobacterium avium
QSSKDAATA

SEQ ID NO: 42743 - protein, 8 aa, Mycobacterium avium
QSSPPGPA

SEQ ID NO: 42744 - protein, 12 aa, Mycobacterium avium
QSSPSANGGRSL

SEQ ID NO: 42745 - protein, 5 aa, Mycobacterium avium
QSTFG

SEQ ID NO: 42746 - protein, 8 aa, Mycobacterium avium
QSTHGTWN

SEQ ID NO: 42747 - protein, 7 aa, Mycobacterium avium
QSTLTHE

SEQ ID NO: 42748 - protein, 9 aa, Mycobacterium avium
QSTNTVNYS

SEQ ID NO: 42749 - protein, 9 aa, Mycobacterium avium
QSTPPGPGI

SEQ ID NO: 42750 - protein, 6 aa, Mycobacterium avium
QSTPVP

SEQ ID NO: 42751 - protein, 9 aa, Mycobacterium avium
QSVEEGRRR

SEQ ID NO: 42752 - protein, 5 aa, Mycobacterium avium
QTAAT

SEQ ID NO: 42753 - protein, 6 aa, Mycobacterium avium
QTADGT

SEQ ID NO: 42754 - protein, 7 aa, Mycobacterium avium
QTAEGIS

SEQ ID NO: 42755 - protein, 14 aa, Mycobacterium avium
QTAFEDASARAEGY

SEQ ID NO: 42756 - protein, 8 aa, Mycobacterium avium
QTAGEREV

SEQ ID NO: 42757 - protein, 19 aa, Mycobacterium avium
QTAGRGRHGRGWSATPRAQ

SEQ ID NO: 42758 - protein, 19 aa, Mycobacterium avium
QTAKAPSPRRHTTSNKGAS

SEQ ID NO: 42759 - protein, 9 aa, Mycobacterium avium
QTAQAAAHG

SEQ ID NO: 42760 - protein, 6 aa, Mycobacterium avium
QTARRG

SEQ ID NO: 42761 - protein, 8 aa, Mycobacterium avium
QTARSREI

SEQ ID NO: 42762 - protein, 11 aa, Mycobacterium avium
QTCTRAAESIG

SEQ ID NO: 42763 - protein, 9 aa, Mycobacterium avium
QTDAKTGKP

SEQ ID NO: 42764 - protein, 9 aa, Mycobacterium avium
QTDARAAVG

SEQ ID NO: 42765 - protein, 10 aa, Mycobacterium avium
QTDETGATKR

SEQ ID NO: 42766 - protein, 6 aa, Mycobacterium avium
QTDHRP

SEQ ID NO: 42767 - protein, 4 aa, Mycobacterium avium
QTDK

SEQ ID NO: 42768 - protein, 4 aa, Mycobacterium avium
QTDV

SEQ ID NO: 42769 - protein, 5 aa, Mycobacterium avium
QTEAM

SEQ ID NO: 42770 - protein, 8 aa, Mycobacterium avium
QTEDGGQH

SEQ ID NO: 42771 - protein, 9 aa, Mycobacterium avium
QTEQGMTEP

SEQ ID NO: 42772 - protein, 5 aa, Mycobacterium avium
QTESD

SEQ ID NO: 42773 - protein, 8 aa, Mycobacterium avium
QTGAPLPT

SEQ ID NO: 42774 - protein, 11 aa, Mycobacterium avium
QTGEPQSGTEW

SEQ ID NO: 42775 - protein, 4 aa, Mycobacterium avium
QTGG

SEQ ID NO: 42776 - protein, 5 aa, Mycobacterium avium
QTGGD

SEQ ID NO: 42777 - protein, 8 aa, Mycobacterium avium
QTGNAEEL

SEQ ID NO: 42778 - protein, 12 aa, Mycobacterium avium
QTGTHPRTRTEA

SEQ ID NO: 42779 - protein, 30 aa, Mycobacterium avium
QTIDSRTDRWDASSAKSRDELDDDAAAERR

SEQ ID NO: 42780 - protein, 4 aa, Mycobacterium avium
QTKR

SEQ ID NO: 42781 - protein, 4 aa, Mycobacterium avium
QTLD

SEQ ID NO: 42782 - protein, 6 aa, Mycobacterium avium
QTLDDN

SEQ ID NO: 42783 - protein, 6 aa, Mycobacterium avium
QTLDRA

SEQ ID NO: 42784 - protein, 13 aa, Mycobacterium avium
QTNRTAMGGNYQQ

SEQ ID NO: 42785 - protein, 6 aa, Mycobacterium avium
QTNYGA

SEQ ID NO: 42786 - protein, 8 aa, Mycobacterium avium
QTNYSAAK

SEQ ID NO: 42787 - protein, 23 aa, Mycobacterium avium
QTPARNLPPEDERGNPKHYCPMV

SEQ ID NO: 42788 - protein, 5 aa, Mycobacterium avium
QTPAV

SEQ ID NO: 42789 - protein, 6 aa, Mycobacterium avium
QTPERV

SEQ ID NO: 42790 - protein, 10 aa, Mycobacterium avium
QTPRPQLPGA

SEQ ID NO: 42791 - protein, 9 aa, Mycobacterium avium
QTPSGPVAS

SEQ ID NO: 42792 - protein, 11 aa, Mycobacterium avium
QTPSGSDVSEG

SEQ ID NO: 42793 - protein, 7 aa, Mycobacterium avium
QTPTEGR

SEQ ID NO: 42794 - protein, 12 aa, Mycobacterium avium
QTPTSNGSDEYT

SEQ ID NO: 42795 - protein, 5 aa, Mycobacterium avium
QTQRA

SEQ ID NO: 42796 - protein, 7 aa, Mycobacterium avium
QTQSEVR

SEQ ID NO: 42797 - protein, 6 aa, Mycobacterium avium
QTQTPD

SEQ ID NO: 42798 - protein, 8 aa, Mycobacterium avium
QTREPNAQ

SEQ ID NO: 42799 - protein, 11 aa, Mycobacterium avium
QTRPQTEDGRD

SEQ ID NO: 42800 - protein, 8 aa, Mycobacterium avium
QTRQAIEQ

SEQ ID NO: 42801 - protein, 12 aa, Mycobacterium avium
QTSTAKAPNENL

SEQ ID NO: 42802 - protein, 16 aa, Mycobacterium avium
QTSTKRVQGRSETSSI

SEQ ID NO: 42803 - protein, 4 aa, Mycobacterium avium
QTTA

SEQ ID NO: 42804 - protein, 12 aa, Mycobacterium avium
QTTAGMGPDATR

SEQ ID NO: 42805 - protein, 10 aa, Mycobacterium avium
QTVDEQPGGI

SEQ ID NO: 42806 - protein, 6 aa, Mycobacterium avium
QTVRDG

SEQ ID NO: 42807 - protein, 4 aa, Mycobacterium avium
QTVS

SEQ ID NO: 42808 - protein, 4 aa, Mycobacterium avium
QTVT

SEQ ID NO: 42809 - protein, 4 aa, Mycobacterium avium
QTYG

SEQ ID NO: 42810 - protein, 6 aa, Mycobacterium avium
QVASDA

SEQ ID NO: 42811 - protein, 11 aa, Mycobacterium avium
QVDEAKERANR

SEQ ID NO: 42812 - protein, 9 aa, Mycobacterium avium
QVDGRSAAD

SEQ ID NO: 42813 - protein, 7 aa, Mycobacterium avium
QVDPRSD

SEQ ID NO: 42814 - protein, 7 aa, Mycobacterium avium
QVDSESL

SEQ ID NO: 42815 - protein, 9 aa, Mycobacterium avium
QVEASHREH

SEQ ID NO: 42816 - protein, 7 aa, Mycobacterium avium
QVEEDQE

SEQ ID NO: 42817 - protein, 11 aa, Mycobacterium avium
QVEGAGSPTMT

SEQ ID NO: 42818 - protein, 4 aa, Mycobacterium avium
QVGD

SEQ ID NO: 42819 - protein, 15 aa, Mycobacterium avium
QVGDPDDATAIGPVA

SEQ ID NO: 42820 - protein, 7 aa, Mycobacterium avium
QVGEDSE

SEQ ID NO: 42821 - protein, 12 aa, Mycobacterium avium
QVGGGPDDGAVP

SEQ ID NO: 42822 - protein, 7 aa, Mycobacterium avium
QVGGTSA

SEQ ID NO: 42823 - protein, 11 aa, Mycobacterium avium
QVGPNRPGPRG

SEQ ID NO: 42824 - protein, 11 aa, Mycobacterium avium
QVNDEQGHDAG

SEQ ID NO: 42825 - protein, 7 aa, Mycobacterium avium
QVNPKRC

SEQ ID NO: 42826 - protein, 6 aa, Mycobacterium avium
QVNQGA

SEQ ID NO: 42827 - protein, 5 aa, Mycobacterium avium
QVPPN

SEQ ID NO: 42828 - protein, 12 aa, Mycobacterium avium
QVRARSADAAAA

SEQ ID NO: 42829 - protein, 6 aa, Mycobacterium avium
QVRDGK

SEQ ID NO: 42830 - protein, 10 aa, Mycobacterium avium
QVRDNSRRAI

SEQ ID NO: 42831 - protein, 10 aa, Mycobacterium avium
QVRDTQRSRR

SEQ ID NO: 42832 - protein, 7 aa, Mycobacterium avium
QVRSQSE

SEQ ID NO: 42833 - protein, 14 aa, Mycobacterium avium
QVRSRAEVERSFQS

SEQ ID NO: 42834 - protein, 6 aa, Mycobacterium avium
QVSARR

SEQ ID NO: 42835 - protein, 6 aa, Mycobacterium avium
QVTEDG

SEQ ID NO: 42836 - protein, 7 aa, Mycobacterium avium
QVTEPGD

SEQ ID NO: 42837 - protein, 15 aa, Mycobacterium avium
QVVGPREGDTPRTRL

SEQ ID NO: 42838 - protein, 15 aa, Mycobacterium avium
QWADESSSRGTYPSL

SEQ ID NO: 42839 - protein, 16 aa, Mycobacterium avium
QWTGGGSAAAAAAAQP

SEQ ID NO: 42840 - protein, 10 aa, Mycobacterium avium
QYAKPRSADI

SEQ ID NO: 42841 - protein, 5 aa, Mycobacterium avium
QYEKA

SEQ ID NO: 42842 - protein, 9 aa, Mycobacterium avium
QYGDRDGDG

SEQ ID NO: 42843 - protein, 6 aa, Mycobacterium avium
QYGPGH

SEQ ID NO: 42844 - protein, 7 aa, Mycobacterium avium
QYGPGQL

SEQ ID NO: 42845 - protein, 4 aa, Mycobacterium avium
QYGT

SEQ ID NO: 42846 - protein, 6 aa, Mycobacterium avium
QYKSPR

SEQ ID NO: 42847 - protein, 4 aa, Mycobacterium avium
QYPQ

SEQ ID NO: 42848 - protein, 6 aa, Mycobacterium avium
QYQSSV

SEQ ID NO: 42849 - protein, 4 aa, Mycobacterium avium
QYSE

SEQ ID NO: 42850 - protein, 9 aa, Mycobacterium avium
QYTKEEAAK

SEQ ID NO: 42851 - protein, 10 aa, Mycobacterium avium
RAAAAAGRHI

SEQ ID NO: 42852 - protein, 15 aa, Mycobacterium avium
RAAAAQGRAGEDGLG

SEQ ID NO: 42853 - protein, 5 aa, Mycobacterium avium
RAAAD

SEQ ID NO: 42854 - protein, 18 aa, Mycobacterium avium
RAAADGQTVTTAEEPKDV

SEQ ID NO: 42855 - protein, 15 aa, Mycobacterium avium
RAAADVPAKYKSEPW

SEQ ID NO: 42856 - protein, 7 aa, Mycobacterium avium
RAAAPGS

SEQ ID NO: 42857 - protein, 14 aa, Mycobacterium avium
RAAAQATVREDIGG

SEQ ID NO: 42858 - protein, 11 aa, Mycobacterium avium
RAAASGTGNPV

SEQ ID NO: 42859 - protein, 10 aa, Mycobacterium avium
RAAATAPAGV

SEQ ID NO: 42860 - protein, 6 aa, Mycobacterium avium
RAADAD

SEQ ID NO: 42861 - protein, 8 aa, Mycobacterium avium
RAADDAEA

SEQ ID NO: 42862 - protein, 6 aa, Mycobacterium avium
RAADET

SEQ ID NO: 42863 - protein, 9 aa, Mycobacterium avium
RAADGYAAL

SEQ ID NO: 42864 - protein, 8 aa, Mycobacterium avium
RAADRSGA

SEQ ID NO: 42865 - protein, 8 aa, Mycobacterium avium
RAAEPKEV

SEQ ID NO: 42866 - protein, 5 aa, Mycobacterium avium
RAAEQ

SEQ ID NO: 42867 - protein, 7 aa, Mycobacterium avium
RAAERGA

SEQ ID NO: 42868 - protein, 8 aa, Mycobacterium avium
RAAERLSE

SEQ ID NO: 42869 - protein, 8 aa, Mycobacterium avium
RAAESGLR

SEQ ID NO: 42870 - protein, 11 aa, Mycobacterium avium
RAAETAGPDPL

SEQ ID NO: 42871 - protein, 8 aa, Mycobacterium avium
RAAETKGI

SEQ ID NO: 42872 - protein, 18 aa, Mycobacterium avium
RAAGAKAGISVKPGTPLE

SEQ ID NO: 42873 - protein, 6 aa, Mycobacterium avium
RAAGAS

SEQ ID NO: 42874 - protein, 5 aa, Mycobacterium avium
RAAGD

SEQ ID NO: 42875 - protein, 8 aa, Mycobacterium avium
RAAGEDED

SEQ ID NO: 42876 - protein, 9 aa, Mycobacterium avium
RAAGESEAA

SEQ ID NO: 42877 - protein, 7 aa, Mycobacterium avium
RAAGHTG

SEQ ID NO: 42878 - protein, 7 aa, Mycobacterium avium
RAAGPDN

SEQ ID NO: 42879 - protein, 6 aa, Mycobacterium avium
RAAGRP

SEQ ID NO: 42880 - protein, 8 aa, Mycobacterium avium
RAAGRTAG

SEQ ID NO: 42881 - protein, 6 aa, Mycobacterium avium
RAAGTK

SEQ ID NO: 42882 - protein, 6 aa, Mycobacterium avium
RAAHNY

SEQ ID NO: 42883 - protein, 6 aa, Mycobacterium avium
RAAHRD

SEQ ID NO: 42884 - protein, 8 aa, Mycobacterium avium
RAAKELRD

SEQ ID NO: 42885 - protein, 6 aa, Mycobacterium avium
RAALGR

SEQ ID NO: 42886 - protein, 7 aa, Mycobacterium avium
RAAPDAE

SEQ ID NO: 42887 - protein, 6 aa, Mycobacterium avium
RAAPGA

SEQ ID NO: 42888 - protein, 9 aa, Mycobacterium avium
RAAPGYAAY

SEQ ID NO: 42889 - protein, 7 aa, Mycobacterium avium
RAAQDGA

SEQ ID NO: 42890 - protein, 6 aa, Mycobacterium avium
RAAQRG

SEQ ID NO: 42891 - protein, 10 aa, Mycobacterium avium
RAARAGARRR

SEQ ID NO: 42892 - protein, 17 aa, Mycobacterium avium
RAARAPSAGAITPGSRT

SEQ ID NO: 42893 - protein, 14 aa, Mycobacterium avium
RAARASSVLDGGPV

SEQ ID NO: 42894 - protein, 15 aa, Mycobacterium avium
RAARGDDRSAAEPAR

SEQ ID NO: 42895 - protein, 27 aa, Mycobacterium avium
RAARPDQPDDKAAPAHVPRRDGAADLA

SEQ ID NO: 42896 - protein, 5 aa, Mycobacterium avium
RAARQ

SEQ ID NO: 42897 - protein, 10 aa, Mycobacterium avium
RAASAAEAQG

SEQ ID NO: 42898 - protein, 5 aa, Mycobacterium avium
RAATD

SEQ ID NO: 42899 - protein, 7 aa, Mycobacterium avium
RAATEGQ

SEQ ID NO: 42900 - protein, 10 aa, Mycobacterium avium
RAATPQGRAE

SEQ ID NO: 42901 - protein, 9 aa, Mycobacterium avium
RADAPDKVN

SEQ ID NO: 42902 - protein, 6 aa, Mycobacterium avium
RADARR

SEQ ID NO: 42903 - protein, 7 aa, Mycobacterium avium
RADASGV

SEQ ID NO: 42904 - protein, 8 aa, Mycobacterium avium
RADAVNPR

SEQ ID NO: 42905 - protein, 6 aa, Mycobacterium avium
RADDTA

SEQ ID NO: 42906 - protein, 12 aa, Mycobacterium avium
RADEFGRRNAVP

SEQ ID NO: 42907 - protein, 8 aa, Mycobacterium avium
RADGDPPA

SEQ ID NO: 42908 - protein, 11 aa, Mycobacterium avium
RADGDYSPQLN

SEQ ID NO: 42909 - protein, 8 aa, Mycobacterium avium
RADGSTAA

SEQ ID NO: 42910 - protein, 5 aa, Mycobacterium avium
RADPA

SEQ ID NO: 42911 - protein, 15 aa, Mycobacterium avium
RADPEGQLGPGSRAR

SEQ ID NO: 42912 - protein, 7 aa, Mycobacterium avium
RADPELA

SEQ ID NO: 42913 - protein, 7 aa, Mycobacterium avium
RADPQHN

SEQ ID NO: 42914 - protein, 4 aa, Mycobacterium avium
RADR

SEQ ID NO: 42915 - protein, 8 aa, Mycobacterium avium
RADRQPEF

SEQ ID NO: 42916 - protein, 7 aa, Mycobacterium avium
RAEADRV

SEQ ID NO: 42917 - protein, 6 aa, Mycobacterium avium
RAEAED

SEQ ID NO: 42918 - protein, 4 aa, Mycobacterium avium
RAED

SEQ ID NO: 42919 - protein, 5 aa, Mycobacterium avium
RAEEA

SEQ ID NO: 42920 - protein, 11 aa, Mycobacterium avium
RAEESGSQTEI

SEQ ID NO: 42921 - protein, 5 aa, Mycobacterium avium
RAEGE

SEQ ID NO: 42922 - protein, 7 aa, Mycobacterium avium
RAEGLTD

SEQ ID NO: 42923 - protein, 7 aa, Mycobacterium avium
RAEGTEF

SEQ ID NO: 42924 - protein, 8 aa, Mycobacterium avium
RAEHGAKE

SEQ ID NO: 42925 - protein, 10 aa, Mycobacterium avium
RAEIAEATKE

SEQ ID NO: 42926 - protein, 5 aa, Mycobacterium avium
RAEKA

SEQ ID NO: 42927 - protein, 9 aa, Mycobacterium avium
RAEKAGLPA

SEQ ID NO: 42928 - protein, 9 aa, Mycobacterium avium
RAENPQQQQ

SEQ ID NO: 42929 - protein, 8 aa, Mycobacterium avium
RAEPGPAV

SEQ ID NO: 42930 - protein, 7 aa, Mycobacterium avium
RAEPLGD

SEQ ID NO: 42931 - protein, 7 aa, Mycobacterium avium
RAEQLGG

SEQ ID NO: 42932 - protein, 30 aa, Mycobacterium avium
RAEQYEQQARKAAAAGRTKEAEEARANAEQ

SEQ ID NO: 42933 - protein, 8 aa, Mycobacterium avium
RAERDGDG

SEQ ID NO: 42934 - protein, 7 aa, Mycobacterium avium
RAEREQG

SEQ ID NO: 42935 - protein, 7 aa, Mycobacterium avium
RAERGES

SEQ ID NO: 42936 - protein, 12 aa, Mycobacterium avium
RAESAYDGRRSE

SEQ ID NO: 42937 - protein, 8 aa, Mycobacterium avium
RAESGGML

SEQ ID NO: 42938 - protein, 5 aa, Mycobacterium avium
RAESS

SEQ ID NO: 42939 - protein, 7 aa, Mycobacterium avium
RAETAYI

SEQ ID NO: 42940 - protein, 7 aa, Mycobacterium avium
RAETSAP

SEQ ID NO: 42941 - protein, 7 aa, Mycobacterium avium
RAETTAG

SEQ ID NO: 42942 - protein, 6 aa, Mycobacterium avium
RAEVSP

SEQ ID NO: 42943 - protein, 10 aa, Mycobacterium avium
RAFDPSAGKP

SEQ ID NO: 42944 - protein, 5 aa, Mycobacterium avium
RAFPD

SEQ ID NO: 42945 - protein, 13 aa, Mycobacterium avium
RAFTGAAADQVDE

SEQ ID NO: 42946 - protein, 6 aa, Mycobacterium avium
RAGAAA

SEQ ID NO: 42947 - protein, 19 aa, Mycobacterium avium
RAGATTTYPWGDEPTSDGR

SEQ ID NO: 42948 - protein, 4 aa, Mycobacterium avium
RAGD

SEQ ID NO: 42949 - protein, 6 aa, Mycobacterium avium
RAGDAD

SEQ ID NO: 42950 - protein, 19 aa, Mycobacterium avium
RAGDDRARAALARWSLVRT

SEQ ID NO: 42951 - protein, 9 aa, Mycobacterium avium
RAGDFNARS

SEQ ID NO: 42952 - protein, 5 aa, Mycobacterium avium
RAGDG

SEQ ID NO: 42953 - protein, 5 aa, Mycobacterium avium
RAGDI

SEQ ID NO: 42954 - protein, 8 aa, Mycobacterium avium
RAGDPREI

SEQ ID NO: 42955 - protein, 10 aa, Mycobacterium avium
RAGEGSDEHY

SEQ ID NO: 42956 - protein, 8 aa, Mycobacterium avium
RAGEPAEV

SEQ ID NO: 42957 - protein, 7 aa, Mycobacterium avium
RAGERAF

SEQ ID NO: 42958 - protein, 7 aa, Mycobacterium avium
RAGESRA

SEQ ID NO: 42959 - protein, 9 aa, Mycobacterium avium
RAGGDTGAS

SEQ ID NO: 42960 - protein, 5 aa, Mycobacterium avium
RAGGE

SEQ ID NO: 42961 - protein, 9 aa, Mycobacterium avium
RAGGVGAPR

SEQ ID NO: 42962 - protein, 8 aa, Mycobacterium avium
RAGIDPKK

SEQ ID NO: 42963 - protein, 7 aa, Mycobacterium avium
RAGLEPP

SEQ ID NO: 42964 - protein, 8 aa, Mycobacterium avium
RAGLSGDD

SEQ ID NO: 42965 - protein, 8 aa, Mycobacterium avium
RAGNEQAR

SEQ ID NO: 42966 - protein, 6 aa, Mycobacterium avium
RAGNPH

SEQ ID NO: 42967 - protein, 7 aa, Mycobacterium avium
RAGPAKV

SEQ ID NO: 42968 - protein, 6 aa, Mycobacterium avium
RAGPAY

SEQ ID NO: 42969 - protein, 6 aa, Mycobacterium avium
RAGQRR

SEQ ID NO: 42970 - protein, 13 aa, Mycobacterium avium
RAGRGRPKRPVRA

SEQ ID NO: 42971 - protein, 5 aa, Mycobacterium avium
RAGRI

SEQ ID NO: 42972 - protein, 4 aa, Mycobacterium avium
RAGS

SEQ ID NO: 42973 - protein, 12 aa, Mycobacterium avium
RAGSADSAIEPN

SEQ ID NO: 42974 - protein, 15 aa, Mycobacterium avium
RAGSESSNGDQSALD

SEQ ID NO: 42975 - protein, 10 aa, Mycobacterium avium
RAGSGGNGCA

SEQ ID NO: 42976 - protein, 8 aa, Mycobacterium avium
RAGSLTSD

SEQ ID NO: 42977 - protein, 7 aa, Mycobacterium avium
RAGSNPE

SEQ ID NO: 42978 - protein, 5 aa, Mycobacterium avium
RAGTG

SEQ ID NO: 42979 - protein, 15 aa, Mycobacterium avium
RAGTIKPSRDPRARA

SEQ ID NO: 42980 - protein, 5 aa, Mycobacterium avium
RAGVG

SEQ ID NO: 42981 - protein, 7 aa, Mycobacterium avium
RAGVGER

SEQ ID NO: 42982 - protein, 6 aa, Mycobacterium avium
RAGVGK

SEQ ID NO: 42983 - protein, 5 aa, Mycobacterium avium
RAGVT

SEQ ID NO: 42984 - protein, 13 aa, Mycobacterium avium
RAGYSPAALRGSR

SEQ ID NO: 42985 - protein, 12 aa, Mycobacterium avium
RAHAATKLRARA

SEQ ID NO: 42986 - protein, 6 aa, Mycobacterium avium
RAHEEA

SEQ ID NO: 42987 - protein, 11 aa, Mycobacterium avium
RAHHGRAATAA

SEQ ID NO: 42988 - protein, 4 aa, Mycobacterium avium
RAHN

SEQ ID NO: 42989 - protein, 5 aa, Mycobacterium avium
RAHPI

SEQ ID NO: 42990 - protein, 6 aa, Mycobacterium avium
RAHTGK

SEQ ID NO: 42991 - protein, 8 aa, Mycobacterium avium
RAIAGPGT

SEQ ID NO: 42992 - protein, 5 aa, Mycobacterium avium
RAIDG

SEQ ID NO: 42993 - protein, 16 aa, Mycobacterium avium
RAINDSYANGYGNSKW

SEQ ID NO: 42994 - protein, 9 aa, Mycobacterium avium
RAITDPGAL

SEQ ID NO: 42995 - protein, 4 aa, Mycobacterium avium
RAKA

SEQ ID NO: 42996 - protein, 4 aa, Mycobacterium avium
RAKD

SEQ ID NO: 42997 - protein, 8 aa, Mycobacterium avium
RAKEAGGR

SEQ ID NO: 42998 - protein, 9 aa, Mycobacterium avium
RAKRNDNAL

SEQ ID NO: 42999 - protein, 8 aa, Mycobacterium avium
RAKRTGET

SEQ ID NO: 43000 - protein, 5 aa, Mycobacterium avium
RAKVT

SEQ ID NO: 43001 - protein, 7 aa, Mycobacterium avium
RALEDPD

SEQ ID NO: 43002 - protein, 13 aa, Mycobacterium avium
RALGDSGTAGTNA

SEQ ID NO: 43003 - protein, 7 aa, Mycobacterium avium
RALGTTR

SEQ ID NO: 43004 - protein, 6 aa, Mycobacterium avium
RALPRG

SEQ ID NO: 43005 - protein, 6 aa, Mycobacterium avium
RALTPP

SEQ ID NO: 43006 - protein, 5 aa, Mycobacterium avium
RANDK

SEQ ID NO: 43007 - protein, 7 aa, Mycobacterium avium
RANGGAA

SEQ ID NO: 43008 - protein, 7 aa, Mycobacterium avium
RANGIKP

SEQ ID NO: 43009 - protein, 7 aa, Mycobacterium avium
RANGVSS

SEQ ID NO: 43010 - protein, 11 aa, Mycobacterium avium
RANKDNVDPKR

SEQ ID NO: 43011 - protein, 5 aa, Mycobacterium avium
RANQW

SEQ ID NO: 43012 - protein, 12 aa, Mycobacterium avium
RANTSDRDTRRR

SEQ ID NO: 43013 - protein, 4 aa, Mycobacterium avium
RANY

SEQ ID NO: 43014 - protein, 9 aa, Mycobacterium avium
RAPAGAPDT

SEQ ID NO: 43015 - protein, 6 aa, Mycobacterium avium
RAPAGF

SEQ ID NO: 43016 - protein, 9 aa, Mycobacterium avium
RAPAGTLPG

SEQ ID NO: 43017 - protein, 8 aa, Mycobacterium avium
RAPANRPD

SEQ ID NO: 43018 - protein, 7 aa, Mycobacterium avium
RAPAPDL

SEQ ID NO: 43019 - protein, 6 aa, Mycobacterium avium
RAPAQR

SEQ ID NO: 43020 - protein, 7 aa, Mycobacterium avium
RAPDDVR

SEQ ID NO: 43021 - protein, 5 aa, Mycobacterium avium
RAPDL

SEQ ID NO: 43022 - protein, 7 aa, Mycobacterium avium
RAPDPDA

SEQ ID NO: 43023 - protein, 9 aa, Mycobacterium avium
RAPEEGRLR

SEQ ID NO: 43024 - protein, 9 aa, Mycobacterium avium
RAPERYRGE

SEQ ID NO: 43025 - protein, 4 aa, Mycobacterium avium
RAPG

SEQ ID NO: 43026 - protein, 10 aa, Mycobacterium avium
RAPGAGLPAR

SEQ ID NO: 43027 - protein, 7 aa, Mycobacterium avium
RAPGPLP

SEQ ID NO: 43028 - protein, 7 aa, Mycobacterium avium
RAPGTHK

SEQ ID NO: 43029 - protein, 5 aa, Mycobacterium avium
RAPRE

SEQ ID NO: 43030 - protein, 10 aa, Mycobacterium avium
RAPSAKNRQP

SEQ ID NO: 43031 - protein, 6 aa, Mycobacterium avium
RAPSAS

SEQ ID NO: 43032 - protein, 8 aa, Mycobacterium avium
RAPSDLPQ

SEQ ID NO: 43033 - protein, 8 aa, Mycobacterium avium
RAPSPLPA

SEQ ID NO: 43034 - protein, 7 aa, Mycobacterium avium
RAPSSCE

SEQ ID NO: 43035 - protein, 6 aa, Mycobacterium avium
RAPVSG

SEQ ID NO: 43036 - protein, 7 aa, Mycobacterium avium
RAQAARV

SEQ ID NO: 43037 - protein, 8 aa, Mycobacterium avium
RAQATEDL

SEQ ID NO: 43038 - protein, 6 aa, Mycobacterium avium
RAQDPA

SEQ ID NO: 43039 - protein, 13 aa, Mycobacterium avium
RAQEGSLSQIDDD

SEQ ID NO: 43040 - protein, 6 aa, Mycobacterium avium
RAQGIP

SEQ ID NO: 43041 - protein, 10 aa, Mycobacterium avium
RAQRNESGDQ

SEQ ID NO: 43042 - protein, 15 aa, Mycobacterium avium
RAQRTLAASGAGEAQ

SEQ ID NO: 43043 - protein, 7 aa, Mycobacterium avium
RAQTAKR

SEQ ID NO: 43044 - protein, 6 aa, Mycobacterium avium
RAQYER

SEQ ID NO: 43045 - protein, 8 aa, Mycobacterium avium
RARAAGAR

SEQ ID NO: 43046 - protein, 8 aa, Mycobacterium avium
RARAEAGA

SEQ ID NO: 43047 - protein, 10 aa, Mycobacterium avium
RARAGRNGAS

SEQ ID NO: 43048 - protein, 9 aa, Mycobacterium avium
RARAGSGPT

SEQ ID NO: 43049 - protein, 8 aa, Mycobacterium avium
RARATRDG

SEQ ID NO: 43050 - protein, 6 aa, Mycobacterium avium
RARDAG

SEQ ID NO: 43051 - protein, 6 aa, Mycobacterium avium
RARDAL

SEQ ID NO: 43052 - protein, 9 aa, Mycobacterium avium
RARDLKQRP

SEQ ID NO: 43053 - protein, 9 aa, Mycobacterium avium
RARDPDLTA

SEQ ID NO: 43054 - protein, 8 aa, Mycobacterium avium
RARDPGAL

SEQ ID NO: 43055 - protein, 9 aa, Mycobacterium avium
RARERGKPV

SEQ ID NO: 43056 - protein, 5 aa, Mycobacterium avium
RARGT

SEQ ID NO: 43057 - protein, 7 aa, Mycobacterium avium
RARIEQT

SEQ ID NO: 43058 - protein, 16 aa, Mycobacterium avium
RARKHGDLESGPLKSV

SEQ ID NO: 43059 - protein, 12 aa, Mycobacterium avium
RARPHARRNGGR

SEQ ID NO: 43060 - protein, 7 aa, Mycobacterium avium
RARPPEL

SEQ ID NO: 43061 - protein, 6 aa, Mycobacterium avium
RARPRA

SEQ ID NO: 43062 - protein, 5 aa, Mycobacterium avium
RARQI

SEQ ID NO: 43063 - protein, 7 aa, Mycobacterium avium
RARRAAG

SEQ ID NO: 43064 - protein, 12 aa, Mycobacterium avium
RARRAALAAAGA

SEQ ID NO: 43065 - protein, 5 aa, Mycobacterium avium
RARRK

SEQ ID NO: 43066 - protein, 5 aa, Mycobacterium avium
RARRR

SEQ ID NO: 43067 - protein, 8 aa, Mycobacterium avium
RARSPEVA

SEQ ID NO: 43068 - protein, 7 aa, Mycobacterium avium
RARTTGT

SEQ ID NO: 43069 - protein, 10 aa, Mycobacterium avium
RASAAERDVK

SEQ ID NO: 43070 - protein, 9 aa, Mycobacterium avium
RASGDDELP

SEQ ID NO: 43071 - protein, 20 aa, Mycobacterium avium
RASGGRPSRPRRGNDLETET

SEQ ID NO: 43072 - protein, 6 aa, Mycobacterium avium
RASGRR

SEQ ID NO: 43073 - protein, 8 aa, Mycobacterium avium
RASISGAV

SEQ ID NO: 43074 - protein, 16 aa, Mycobacterium avium
RASPGGTGAAKFGGNY

SEQ ID NO: 43075 - protein, 9 aa, Mycobacterium avium
RASQRDRDA

SEQ ID NO: 43076 - protein, 10 aa, Mycobacterium avium
RASSGDHELG

SEQ ID NO: 43077 - protein, 7 aa, Mycobacterium avium
RASSTQE

SEQ ID NO: 43078 - protein, 8 aa, Mycobacterium avium
RASTSAQR

SEQ ID NO: 43079 - protein, 6 aa, Mycobacterium avium
RASVRD

SEQ ID NO: 43080 - protein, 8 aa, Mycobacterium avium
RASYERRA

SEQ ID NO: 43081 - protein, 10 aa, Mycobacterium avium
RATADQIGTQ

SEQ ID NO: 43082 - protein, 5 aa, Mycobacterium avium
RATAE

SEQ ID NO: 43083 - protein, 6 aa, Mycobacterium avium
RATAEG

SEQ ID NO: 43084 - protein, 11 aa, Mycobacterium avium
RATAEGRKTEF

SEQ ID NO: 43085 - protein, 7 aa, Mycobacterium avium
RATAPKK

SEQ ID NO: 43086 - protein, 15 aa, Mycobacterium avium
RATATGASGGPPGSR

SEQ ID NO: 43087 - protein, 4 aa, Mycobacterium avium
RATE

SEQ ID NO: 43088 - protein, 6 aa, Mycobacterium avium
RATEEA

SEQ ID NO: 43089 - protein, 9 aa, Mycobacterium avium
RATEERPSW

SEQ ID NO: 43090 - protein, 4 aa, Mycobacterium avium
RATF

SEQ ID NO: 43091 - protein, 10 aa, Mycobacterium avium
RATGAAEAIE

SEQ ID NO: 43092 - protein, 8 aa, Mycobacterium avium
RATGDAAY

SEQ ID NO: 43093 - protein, 5 aa, Mycobacterium avium
RATKG

SEQ ID NO: 43094 - protein, 11 aa, Mycobacterium avium
RATKQPDAHPT

SEQ ID NO: 43095 - protein, 8 aa, Mycobacterium avium
RATPVTPT

SEQ ID NO: 43096 - protein, 8 aa, Mycobacterium avium
RATQGTEI

SEQ ID NO: 43097 - protein, 9 aa, Mycobacterium avium
RATRGGDRK

SEQ ID NO: 43098 - protein, 13 aa, Mycobacterium avium
RATRKDVRPSAAE

SEQ ID NO: 43099 - protein, 12 aa, Mycobacterium avium
RAVAAGKAARDF

SEQ ID NO: 43100 - protein, 11 aa, Mycobacterium avium
RAVDARGARRA

SEQ ID NO: 43101 - protein, 6 aa, Mycobacterium avium
RAVKQG

SEQ ID NO: 43102 - protein, 8 aa, Mycobacterium avium
RAYEDGGA

SEQ ID NO: 43103 - protein, 20 aa, Mycobacterium avium
RAYGAADARRALTEARRRGT

SEQ ID NO: 43104 - protein, 8 aa, Mycobacterium avium
RAYPYEGN

SEQ ID NO: 43105 - protein, 6 aa, Mycobacterium avium
RAYRAD

SEQ ID NO: 43106 - protein, 5 aa, Mycobacterium avium
RCESG

SEQ ID NO: 43107 - protein, 10 aa, Mycobacterium avium
RCPDGELTAA

SEQ ID NO: 43108 - protein, 6 aa, Mycobacterium avium
RCPPVG

SEQ ID NO: 43109 - protein, 7 aa, Mycobacterium avium
RCSTSRK

SEQ ID NO: 43110 - protein, 6 aa, Mycobacterium avium
RCTAEA

SEQ ID NO: 43111 - protein, 15 aa, Mycobacterium avium
RCTQEADNAFQQARS

SEQ ID NO: 43112 - protein, 10 aa, Mycobacterium avium
RDAAGKGGAI

SEQ ID NO: 43113 - protein, 9 aa, Mycobacterium avium
RDAAPEGDL

SEQ ID NO: 43114 - protein, 5 aa, Mycobacterium avium
RDADA

SEQ ID NO: 43115 - protein, 7 aa, Mycobacterium avium
RDAEQTH

SEQ ID NO: 43116 - protein, 4 aa, Mycobacterium avium
RDAF

SEQ ID NO: 43117 - protein, 4 aa, Mycobacterium avium
RDAG

SEQ ID NO: 43118 - protein, 5 aa, Mycobacterium avium
RDAGA

SEQ ID NO: 43119 - protein, 8 aa, Mycobacterium avium
RDAGATDL

SEQ ID NO: 43120 - protein, 6 aa, Mycobacterium avium
RDAGLS

SEQ ID NO: 43121 - protein, 9 aa, Mycobacterium avium
RDAGTSSRA

SEQ ID NO: 43122 - protein, 8 aa, Mycobacterium avium
RDAGYDDV

SEQ ID NO: 43123 - protein, 6 aa, Mycobacterium avium
RDAPQR

SEQ ID NO: 43124 - protein, 14 aa, Mycobacterium avium
RDAPTGRLASLIWM

SEQ ID NO: 43125 - protein, 13 aa, Mycobacterium avium
RDARAGKLDPNRV

SEQ ID NO: 43126 - protein, 9 aa, Mycobacterium avium
RDATGHQGR

SEQ ID NO: 43127 - protein, 10 aa, Mycobacterium avium
RDATPAELGG

SEQ ID NO: 43128 - protein, 10 aa, Mycobacterium avium
RDATPEEREQ

SEQ ID NO: 43129 - protein, 7 aa, Mycobacterium avium
RDAVSRE

SEQ ID NO: 43130 - protein, 4 aa, Mycobacterium avium
RDCR

SEQ ID NO: 43131 - protein, 5 aa, Mycobacterium avium
RDDAA

SEQ ID NO: 43132 - protein, 7 aa, Mycobacterium avium
RDDAADD

SEQ ID NO: 43133 - protein, 13 aa, Mycobacterium avium
RDDADNAPETRSE

SEQ ID NO: 43134 - protein, 7 aa, Mycobacterium avium
RDDARKL

SEQ ID NO: 43135 - protein, 5 aa, Mycobacterium avium
RDDDA

SEQ ID NO: 43136 - protein, 6 aa, Mycobacterium avium
RDDDDA

SEQ ID NO: 43137 - protein, 10 aa, Mycobacterium avium
RDDDDALAPA

SEQ ID NO: 43138 - protein, 6 aa, Mycobacterium avium
RDDDEA

SEQ ID NO: 43139 - protein, 7 aa, Mycobacterium avium
RDDEAKQ

SEQ ID NO: 43140 - protein, 8 aa, Mycobacterium avium
RDDLPDGG

SEQ ID NO: 43141 - protein, 6 aa, Mycobacterium avium
RDDMND

SEQ ID NO: 43142 - protein, 10 aa, Mycobacterium avium
RDDPSSVDPS

SEQ ID NO: 43143 - protein, 8 aa, Mycobacterium avium
RDDSKFDS

SEQ ID NO: 43144 - protein, 6 aa, Mycobacterium avium
RDDSPI

SEQ ID NO: 43145 - protein, 6 aa, Mycobacterium avium
RDDVPG

SEQ ID NO: 43146 - protein, 6 aa, Mycobacterium avium
RDEADL

SEQ ID NO: 43147 - protein, 13 aa, Mycobacterium avium
RDEAGKATNIATA

SEQ ID NO: 43148 - protein, 15 aa, Mycobacterium avium
RDEDAIGTPPPGPTL

SEQ ID NO: 43149 - protein, 12 aa, Mycobacterium avium
RDEDGPAAGVDE

SEQ ID NO: 43150 - protein, 9 aa, Mycobacterium avium
RDEENHPIR

SEQ ID NO: 43151 - protein, 7 aa, Mycobacterium avium
RDEGAAE

SEQ ID NO: 43152 - protein, 6 aa, Mycobacterium avium
RDELDA

SEQ ID NO: 43153 - protein, 13 aa, Mycobacterium avium
RDEPAARRDPEEA

SEQ ID NO: 43154 - protein, 14 aa, Mycobacterium avium
RDEPFGDHGRQASQ

SEQ ID NO: 43155 - protein, 5 aa, Mycobacterium avium
RDEPV

SEQ ID NO: 43156 - protein, 7 aa, Mycobacterium avium
RDEQQRA

SEQ ID NO: 43157 - protein, 8 aa, Mycobacterium avium
RDERGVPP

SEQ ID NO: 43158 - protein, 6 aa, Mycobacterium avium
RDESGE

SEQ ID NO: 43159 - protein, 7 aa, Mycobacterium avium
RDETLQH

SEQ ID NO: 43160 - protein, 21 aa, Mycobacterium avium
RDETQSLRSGDTIDVLPPFSG

SEQ ID NO: 43161 - protein, 9 aa, Mycobacterium avium
RDGAPAPYA

SEQ ID NO: 43162 - protein, 8 aa, Mycobacterium avium
RDGAPELY

SEQ ID NO: 43163 - protein, 6 aa, Mycobacterium avium
RDGAYR

SEQ ID NO: 43164 - protein, 8 aa, Mycobacterium avium
RDGDAARD

SEQ ID NO: 43165 - protein, 10 aa, Mycobacterium avium
RDGDKAPVEG

SEQ ID NO: 43166 - protein, 6 aa, Mycobacterium avium
RDGEAD

SEQ ID NO: 43167 - protein, 9 aa, Mycobacterium avium
RDGEIDPSV

SEQ ID NO: 43168 - protein, 7 aa, Mycobacterium avium
RDGEQGR

SEQ ID NO: 43169 - protein, 6 aa, Mycobacterium avium
RDGEQP

SEQ ID NO: 43170 - protein, 8 aa, Mycobacterium avium
RDGEWSTN

SEQ ID NO: 43171 - protein, 5 aa, Mycobacterium avium
RDGGA

SEQ ID NO: 43172 - protein, 7 aa, Mycobacterium avium
RDGGAEI

SEQ ID NO: 43173 - protein, 15 aa, Mycobacterium avium
RDGGEIRNGSDLPRI

SEQ ID NO: 43174 - protein, 15 aa, Mycobacterium avium
RDGGERYGGKGVQKA

SEQ ID NO: 43175 - protein, 5 aa, Mycobacterium avium
RDGGV

SEQ ID NO: 43176 - protein, 8 aa, Mycobacterium avium
RDGITESE

SEQ ID NO: 43177 - protein, 12 aa, Mycobacterium avium
RDGKPEPPGESR

SEQ ID NO: 43178 - protein, 7 aa, Mycobacterium avium
RDGLPDG

SEQ ID NO: 43179 - protein, 11 aa, Mycobacterium avium
RDGNGGPLPAE

SEQ ID NO: 43180 - protein, 5 aa, Mycobacterium avium
RDGNQ

SEQ ID NO: 43181 - protein, 8 aa, Mycobacterium avium
RDGPDAGL

SEQ ID NO: 43182 - protein, 7 aa, Mycobacterium avium
RDGPDVE

SEQ ID NO: 43183 - protein, 8 aa, Mycobacterium avium
RDGPGGEL

SEQ ID NO: 43184 - protein, 18 aa, Mycobacterium avium
RDGQAGGAGAQGSLDWSA

SEQ ID NO: 43185 - protein, 8 aa, Mycobacterium avium
RDGRARSI

SEQ ID NO: 43186 - protein, 9 aa, Mycobacterium avium
RDGRDGNGC

SEQ ID NO: 43187 - protein, 7 aa, Mycobacterium avium
RDGREAV

SEQ ID NO: 43188 - protein, 10 aa, Mycobacterium avium
RDGRHSTTEV

SEQ ID NO: 43189 - protein, 5 aa, Mycobacterium avium
RDGRR

SEQ ID NO: 43190 - protein, 16 aa, Mycobacterium avium
RDGRRLSDDWSGGPRT

SEQ ID NO: 43191 - protein, 9 aa, Mycobacterium avium
RDGSAGRRT

SEQ ID NO: 43192 - protein, 6 aa, Mycobacterium avium
RDGTER

SEQ ID NO: 43193 - protein, 4 aa, Mycobacterium avium
RDGW

SEQ ID NO: 43194 - protein, 10 aa, Mycobacterium avium
RDIEGKPSTT

SEQ ID NO: 43195 - protein, 5 aa, Mycobacterium avium
RDITG

SEQ ID NO: 43196 - protein, 8 aa, Mycobacterium avium
RDKIAESG

SEQ ID NO: 43197 - protein, 7 aa, Mycobacterium avium
RDKTATA

SEQ ID NO: 43198 - protein, 9 aa, Mycobacterium avium
RDLAKPGDT

SEQ ID NO: 43199 - protein, 7 aa, Mycobacterium avium
RDLRRPP

SEQ ID NO: 43200 - protein, 8 aa, Mycobacterium avium
RDNGSGRV

SEQ ID NO: 43201 - protein, 7 aa, Mycobacterium avium
RDNPGYT

SEQ ID NO: 43202 - protein, 14 aa, Mycobacterium avium
RDNPQRSVRLSFLE

SEQ ID NO: 43203 - protein, 10 aa, Mycobacterium avium
RDPDGSVYPS

SEQ ID NO: 43204 - protein, 10 aa, Mycobacterium avium
RDPDSAPRIA

SEQ ID NO: 43205 - protein, 14 aa, Mycobacterium avium
RDPDTGEPGRWTEP

SEQ ID NO: 43206 - protein, 6 aa, Mycobacterium avium
RDPEGN

SEQ ID NO: 43207 - protein, 16 aa, Mycobacterium avium
RDPEKAARIREEDDAM

SEQ ID NO: 43208 - protein, 7 aa, Mycobacterium avium
RDPESVE

SEQ ID NO: 43209 - protein, 4 aa, Mycobacterium avium
RDPG

SEQ ID NO: 43210 - protein, 5 aa, Mycobacterium avium
RDPGG

SEQ ID NO: 43211 - protein, 8 aa, Mycobacterium avium
RDPGLAET

SEQ ID NO: 43212 - protein, 9 aa, Mycobacterium avium
RDPGVPDGR

SEQ ID NO: 43213 - protein, 16 aa, Mycobacterium avium
RDPKFTPAREALDNPT

SEQ ID NO: 43214 - protein, 9 aa, Mycobacterium avium
RDPQQPPFG

SEQ ID NO: 43215 - protein, 5 aa, Mycobacterium avium
RDPQV

SEQ ID NO: 43216 - protein, 24 aa, Mycobacterium avium
RDPRATERKKYGLKKARKAPQYSK

SEQ ID NO: 43217 - protein, 5 aa, Mycobacterium avium
RDPRG

SEQ ID NO: 43218 - protein, 8 aa, Mycobacterium avium
RDPRNGRN

SEQ ID NO: 43219 - protein, 6 aa, Mycobacterium avium
RDPRTK

SEQ ID NO: 43220 - protein, 7 aa, Mycobacterium avium
RDPRVPN

SEQ ID NO: 43221 - protein, 6 aa, Mycobacterium avium
RDPSLR

SEQ ID NO: 43222 - protein, 12 aa, Mycobacterium avium
RDPSPGTPGGPW

SEQ ID NO: 43223 - protein, 9 aa, Mycobacterium avium
RDPSPRQQA

SEQ ID NO: 43224 - protein, 8 aa, Mycobacterium avium
RDPSPRVS

SEQ ID NO: 43225 - protein, 7 aa, Mycobacterium avium
RDPSRED

SEQ ID NO: 43226 - protein, 7 aa, Mycobacterium avium
RDQDPDY

SEQ ID NO: 43227 - protein, 5 aa, Mycobacterium avium
RDQMS

SEQ ID NO: 43228 - protein, 4 aa, Mycobacterium avium
RDQQ

SEQ ID NO: 43229 - protein, 6 aa, Mycobacterium avium
RDQRDK

SEQ ID NO: 43230 - protein, 11 aa, Mycobacterium avium
RDRDDLGRQPV

SEQ ID NO: 43231 - protein, 8 aa, Mycobacterium avium
RDRGPTYP

SEQ ID NO: 43232 - protein, 7 aa, Mycobacterium avium
RDRGYGH

SEQ ID NO: 43233 - protein, 4 aa, Mycobacterium avium
RDRL

SEQ ID NO: 43234 - protein, 9 aa, Mycobacterium avium
RDRRARKGE

SEQ ID NO: 43235 - protein, 6 aa, Mycobacterium avium
RDRRQG

SEQ ID NO: 43236 - protein, 8 aa, Mycobacterium avium
RDRRSATD

SEQ ID NO: 43237 - protein, 5 aa, Mycobacterium avium
RDRSD

SEQ ID NO: 43238 - protein, 7 aa, Mycobacterium avium
RDRSGAS

SEQ ID NO: 43239 - protein, 13 aa, Mycobacterium avium
RDRTGPNEGPPTL

SEQ ID NO: 43240 - protein, 8 aa, Mycobacterium avium
RDRTRHQV

SEQ ID NO: 43241 - protein, 9 aa, Mycobacterium avium
RDRTTDLAP

SEQ ID NO: 43242 - protein, 5 aa, Mycobacterium avium
RDSAA

SEQ ID NO: 43243 - protein, 6 aa, Mycobacterium avium
RDSAAA

SEQ ID NO: 43244 - protein, 5 aa, Mycobacterium avium
RDSAP

SEQ ID NO: 43245 - protein, 10 aa, Mycobacterium avium
RDSEDGSVTE

SEQ ID NO: 43246 - protein, 6 aa, Mycobacterium avium
RDSGDE

SEQ ID NO: 43247 - protein, 9 aa, Mycobacterium avium
RDSNGNPVS

SEQ ID NO: 43248 - protein, 5 aa, Mycobacterium avium
RDSQK

SEQ ID NO: 43249 - protein, 10 aa, Mycobacterium avium
RDTADISDRE

SEQ ID NO: 43250 - protein, 6 aa, Mycobacterium avium
RDTDGK

SEQ ID NO: 43251 - protein, 6 aa, Mycobacterium avium
RDTEDL

SEQ ID NO: 43252 - protein, 7 aa, Mycobacterium avium
RDTGTRL

SEQ ID NO: 43253 - protein, 5 aa, Mycobacterium avium
RDTKS

SEQ ID NO: 43254 - protein, 11 aa, Mycobacterium avium
RDTPRKPSPDL

SEQ ID NO: 43255 - protein, 9 aa, Mycobacterium avium
RDTTSDSVA

SEQ ID NO: 43256 - protein, 6 aa, Mycobacterium avium
RDTVSD

SEQ ID NO: 43257 - protein, 5 aa, Mycobacterium avium
RDVAA

SEQ ID NO: 43258 - protein, 8 aa, Mycobacterium avium
RDVDDEEH

SEQ ID NO: 43259 - protein, 6 aa, Mycobacterium avium
RDVEDP

SEQ ID NO: 43260 - protein, 11 aa, Mycobacterium avium
RDVRDRPGMSA

SEQ ID NO: 43261 - protein, 16 aa, Mycobacterium avium
RDVSAEPGAGAAGGIG

SEQ ID NO: 43262 - protein, 8 aa, Mycobacterium avium
RDVSSPRL

SEQ ID NO: 43263 - protein, 6 aa, Mycobacterium avium
RDVTGR

SEQ ID NO: 43264 - protein, 11 aa, Mycobacterium avium
RDWGSPKIPEE

SEQ ID NO: 43265 - protein, 6 aa, Mycobacterium avium
RDYPDA

SEQ ID NO: 43266 - protein, 5 aa, Mycobacterium avium
REAAP

SEQ ID NO: 43267 - protein, 5 aa, Mycobacterium avium
READR

SEQ ID NO: 43268 - protein, 14 aa, Mycobacterium avium
READTRGDGRPRGQ

SEQ ID NO: 43269 - protein, 4 aa, Mycobacterium avium
REAE

SEQ ID NO: 43270 - protein, 6 aa, Mycobacterium avium
REAEDT

SEQ ID NO: 43271 - protein, 16 aa, Mycobacterium avium
REAEPADEALAPSNRP

SEQ ID NO: 43272 - protein, 11 aa, Mycobacterium avium
REAESNGRGAV

SEQ ID NO: 43273 - protein, 7 aa, Mycobacterium avium
REAFNRR

SEQ ID NO: 43274 - protein, 4 aa, Mycobacterium avium
REAG

SEQ ID NO: 43275 - protein, 14 aa, Mycobacterium avium
REAGGGDKPVQGGT

SEQ ID NO: 43276 - protein, 8 aa, Mycobacterium avium
REAGPTAV

SEQ ID NO: 43277 - protein, 10 aa, Mycobacterium avium
REALGDPTAH

SEQ ID NO: 43278 - protein, 10 aa, Mycobacterium avium
REARRTEKIT

SEQ ID NO: 43279 - protein, 7 aa, Mycobacterium avium
REARSRG

SEQ ID NO: 43280 - protein, 4 aa, Mycobacterium avium
REAT

SEQ ID NO: 43281 - protein, 8 aa, Mycobacterium avium
REATAVDP

SEQ ID NO: 43282 - protein, 8 aa, Mycobacterium avium
REATEPMR

SEQ ID NO: 43283 - protein, 9 aa, Mycobacterium avium
REAVTARDK

SEQ ID NO: 43284 - protein, 6 aa, Mycobacterium avium
REDAAE

SEQ ID NO: 43285 - protein, 5 aa, Mycobacterium avium
REDAR

SEQ ID NO: 43286 - protein, 10 aa, Mycobacterium avium
REDDDELPAG

SEQ ID NO: 43287 - protein, 5 aa, Mycobacterium avium
REDEA

SEQ ID NO: 43288 - protein, 8 aa, Mycobacterium avium
REDGREGD

SEQ ID NO: 43289 - protein, 4 aa, Mycobacterium avium
REDL

SEQ ID NO: 43290 - protein, 8 aa, Mycobacterium avium
REDPDEAR

SEQ ID NO: 43291 - protein, 9 aa, Mycobacterium avium
REDPRPQAT

SEQ ID NO: 43292 - protein, 8 aa, Mycobacterium avium
REDRPGDK

SEQ ID NO: 43293 - protein, 9 aa, Mycobacterium avium
REDRPGEKR

SEQ ID NO: 43294 - protein, 11 aa, Mycobacterium avium
REDSREFAGAR

SEQ ID NO: 43295 - protein, 9 aa, Mycobacterium avium
REEAGKTGP

SEQ ID NO: 43296 - protein, 7 aa, Mycobacterium avium
REEAPSV

SEQ ID NO: 43297 - protein, 6 aa, Mycobacterium avium
REEERI

SEQ ID NO: 43298 - protein, 6 aa, Mycobacterium avium
REEHGP

SEQ ID NO: 43299 - protein, 4 aa, Mycobacterium avium
REEP

SEQ ID NO: 43300 - protein, 16 aa, Mycobacterium avium
REEPHPSPIVPPREAA

SEQ ID NO: 43301 - protein, 6 aa, Mycobacterium avium
REERPD

SEQ ID NO: 43302 - protein, 4 aa, Mycobacterium avium
REEW

SEQ ID NO: 43303 - protein, 4 aa, Mycobacterium avium
REGD

SEQ ID NO: 43304 - protein, 7 aa, Mycobacterium avium
REGGIND

SEQ ID NO: 43305 - protein, 9 aa, Mycobacterium avium
REGGTAPCG

SEQ ID NO: 43306 - protein, 14 aa, Mycobacterium avium
REGLTDRAIGDDDP

SEQ ID NO: 43307 - protein, 7 aa, Mycobacterium avium
REGPGRR

SEQ ID NO: 43308 - protein, 4 aa, Mycobacterium avium
REGR

SEQ ID NO: 43309 - protein, 8 aa, Mycobacterium avium
REGRPAQR

SEQ ID NO: 43310 - protein, 14 aa, Mycobacterium avium
REGSALDAGGSETL

SEQ ID NO: 43311 - protein, 9 aa, Mycobacterium avium
REGSEEYLN

SEQ ID NO: 43312 - protein, 5 aa, Mycobacterium avium
REGTD

SEQ ID NO: 43313 - protein, 8 aa, Mycobacterium avium
REGVDPRK

SEQ ID NO: 43314 - protein, 5 aa, Mycobacterium avium
REHHD

SEQ ID NO: 43315 - protein, 5 aa, Mycobacterium avium
REHNA

SEQ ID NO: 43316 - protein, 12 aa, Mycobacterium avium
REHSPGARVASA

SEQ ID NO: 43317 - protein, 10 aa, Mycobacterium avium
REIRDTAEAL

SEQ ID NO: 43318 - protein, 13 aa, Mycobacterium avium
REKAQRYGRAGRQ

SEQ ID NO: 43319 - protein, 9 aa, Mycobacterium avium
REKASEGTP

SEQ ID NO: 43320 - protein, 7 aa, Mycobacterium avium
REKSYSD

SEQ ID NO: 43321 - protein, 5 aa, Mycobacterium avium
RELDE

SEQ ID NO: 43322 - protein, 6 aa, Mycobacterium avium
RELGGR

SEQ ID NO: 43323 - protein, 6 aa, Mycobacterium avium
RELPAE

SEQ ID NO: 43324 - protein, 10 aa, Mycobacterium avium
RELSGGQRQR

SEQ ID NO: 43325 - protein, 22 aa, Mycobacterium avium
RELTRQAGKTLVTTGSAPRLAQ

SEQ ID NO: 43326 - protein, 23 aa, Mycobacterium avium
RENNCPNPGCDGDALESTPLSRR

SEQ ID NO: 43327 - protein, 16 aa, Mycobacterium avium
RENSVPSAELVKVSSG

SEQ ID NO: 43328 - protein, 5 aa, Mycobacterium avium
REPAD

SEQ ID NO: 43329 - protein, 4 aa, Mycobacterium avium
REPD

SEQ ID NO: 43330 - protein, 11 aa, Mycobacterium avium
REPESPGREAD

SEQ ID NO: 43331 - protein, 6 aa, Mycobacterium avium
REPEYS

SEQ ID NO: 43332 - protein, 4 aa, Mycobacterium avium
REPF

SEQ ID NO: 43333 - protein, 4 aa, Mycobacterium avium
REPG

SEQ ID NO: 43334 - protein, 6 aa, Mycobacterium avium
REPGPA

SEQ ID NO: 43335 - protein, 22 aa, Mycobacterium avium
REPGREYAEDIETGSAAAALGG

SEQ ID NO: 43336 - protein, 8 aa, Mycobacterium avium
REPGTAGG

SEQ ID NO: 43337 - protein, 6 aa, Mycobacterium avium
REPGTP

SEQ ID NO: 43338 - protein, 6 aa, Mycobacterium avium
REPKKE

SEQ ID NO: 43339 - protein, 4 aa, Mycobacterium avium
REPP

SEQ ID NO: 43340 - protein, 7 aa, Mycobacterium avium
REPPDRA

SEQ ID NO: 43341 - protein, 8 aa, Mycobacterium avium
REQAPGRA

SEQ ID NO: 43342 - protein, 8 aa, Mycobacterium avium
REQGPGAF

SEQ ID NO: 43343 - protein, 16 aa, Mycobacterium avium
REQGYDGSWTGDENIE

SEQ ID NO: 43344 - protein, 7 aa, Mycobacterium avium
REQKRPG

SEQ ID NO: 43345 - protein, 8 aa, Mycobacterium avium
REQSRPEL

SEQ ID NO: 43346 - protein, 12 aa, Mycobacterium avium
RERAALTEDEVT

SEQ ID NO: 43347 - protein, 9 aa, Mycobacterium avium
RERAARRLN

SEQ ID NO: 43348 - protein, 9 aa, Mycobacterium avium
RERALRQGS

SEQ ID NO: 43349 - protein, 16 aa, Mycobacterium avium
RERESAKWTKASREIT

SEQ ID NO: 43350 - protein, 8 aa, Mycobacterium avium
RERETGVP

SEQ ID NO: 43351 - protein, 5 aa, Mycobacterium avium
RERIG

SEQ ID NO: 43352 - protein, 6 aa, Mycobacterium avium
RERPRM

SEQ ID NO: 43353 - protein, 5 aa, Mycobacterium avium
RERPV

SEQ ID NO: 43354 - protein, 16 aa, Mycobacterium avium
RERRGEVEEASDRIAG

SEQ ID NO: 43355 - protein, 9 aa, Mycobacterium avium
RERRPDRAI

SEQ ID NO: 43356 - protein, 9 aa, Mycobacterium avium
RERSSIRQA

SEQ ID NO: 43357 - protein, 9 aa, Mycobacterium avium
RESDEKMAP

SEQ ID NO: 43358 - protein, 6 aa, Mycobacterium avium
RESEEV

SEQ ID NO: 43359 - protein, 9 aa, Mycobacterium avium
RESGGAIGG

SEQ ID NO: 43360 - protein, 5 aa, Mycobacterium avium
RESGR

SEQ ID NO: 43361 - protein, 9 aa, Mycobacterium avium
RESNYNAGA

SEQ ID NO: 43362 - protein, 8 aa, Mycobacterium avium
RESPAAGE

SEQ ID NO: 43363 - protein, 4 aa, Mycobacterium avium
REST

SEQ ID NO: 43364 - protein, 7 aa, Mycobacterium avium
RESTGGF

SEQ ID NO: 43365 - protein, 4 aa, Mycobacterium avium
RETD

SEQ ID NO: 43366 - protein, 6 aa, Mycobacterium avium
RETGEC

SEQ ID NO: 43367 - protein, 9 aa, Mycobacterium avium
RETGETHTI

SEQ ID NO: 43368 - protein, 7 aa, Mycobacterium avium
RETGPTQ

SEQ ID NO: 43369 - protein, 4 aa, Mycobacterium avium
RETQ

SEQ ID NO: 43370 - protein, 4 aa, Mycobacterium avium
RETR

SEQ ID NO: 43371 - protein, 17 aa, Mycobacterium avium
RETTLDVPTKTSTGYPV

SEQ ID NO: 43372 - protein, 9 aa, Mycobacterium avium
REVGGGDAR

SEQ ID NO: 43373 - protein, 8 aa, Mycobacterium avium
REVSPEEM

SEQ ID NO: 43374 - protein, 5 aa, Mycobacterium avium
REYDP

SEQ ID NO: 43375 - protein, 7 aa, Mycobacterium avium
REYGGQE

SEQ ID NO: 43376 - protein, 9 aa, Mycobacterium avium
REYGGRGAT

SEQ ID NO: 43377 - protein, 6 aa, Mycobacterium avium
REYKTS

SEQ ID NO: 43378 - protein, 8 aa, Mycobacterium avium
RFANPTPK

SEQ ID NO: 43379 - protein, 8 aa, Mycobacterium avium
RFEGKSSV

SEQ ID NO: 43380 - protein, 4 aa, Mycobacterium avium
RFEP

SEQ ID NO: 43381 - protein, 13 aa, Mycobacterium avium
RFEPTGGSAPALP

SEQ ID NO: 43382 - protein, 4 aa, Mycobacterium avium
RFGN

SEQ ID NO: 43383 - protein, 6 aa, Mycobacterium avium
RFGTNT

SEQ ID NO: 43384 - protein, 6 aa, Mycobacterium avium
RFPAAP

SEQ ID NO: 43385 - protein, 17 aa, Mycobacterium avium
RFPKGSADSWPDTKNPL

SEQ ID NO: 43386 - protein, 8 aa, Mycobacterium avium
RFPTGPVS

SEQ ID NO: 43387 - protein, 12 aa, Mycobacterium avium
RFRDGPGRGVRR

SEQ ID NO: 43388 - protein, 5 aa, Mycobacterium avium
RFRSH

SEQ ID NO: 43389 - protein, 7 aa, Mycobacterium avium
RFSGGTT

SEQ ID NO: 43390 - protein, 11 aa, Mycobacterium avium
RFSNSNPRIAP

SEQ ID NO: 43391 - protein, 15 aa, Mycobacterium avium
RFSSPKSAARQGDQE

SEQ ID NO: 43392 - protein, 5 aa, Mycobacterium avium
RFTDG

SEQ ID NO: 43393 - protein, 15 aa, Mycobacterium avium
RFTPESAERTAVPGV

SEQ ID NO: 43394 - protein, 5 aa, Mycobacterium avium
RGAAA

SEQ ID NO: 43395 - protein, 12 aa, Mycobacterium avium
RGAAELEGASAS

SEQ ID NO: 43396 - protein, 14 aa, Mycobacterium avium
RGAATVEPSDEAQQ

SEQ ID NO: 43397 - protein, 6 aa, Mycobacterium avium
RGADGG

SEQ ID NO: 43398 - protein, 12 aa, Mycobacterium avium
RGADREPATAED

SEQ ID NO: 43399 - protein, 10 aa, Mycobacterium avium
RGADYGVGTG

SEQ ID NO: 43400 - protein, 13 aa, Mycobacterium avium
RGAEAPAVNERIP

SEQ ID NO: 43401 - protein, 14 aa, Mycobacterium avium
RGAEATVDYDREDL

SEQ ID NO: 43402 - protein, 7 aa, Mycobacterium avium
RGAETRI

SEQ ID NO: 43403 - protein, 5 aa, Mycobacterium avium
RGAGA

SEQ ID NO: 43404 - protein, 15 aa, Mycobacterium avium
RGAGESSCPATRSGY

SEQ ID NO: 43405 - protein, 5 aa, Mycobacterium avium
RGAGL

SEQ ID NO: 43406 - protein, 7 aa, Mycobacterium avium
RGAGPAQ

SEQ ID NO: 43407 - protein, 15 aa, Mycobacterium avium
RGAGQSSTPPERSGY

SEQ ID NO: 43408 - protein, 14 aa, Mycobacterium avium
RGAGSGLSGGATAL

SEQ ID NO: 43409 - protein, 6 aa, Mycobacterium avium
RGAKAT

SEQ ID NO: 43410 - protein, 8 aa, Mycobacterium avium
RGALTESA

SEQ ID NO: 43411 - protein, 4 aa, Mycobacterium avium
RGAP

SEQ ID NO: 43412 - protein, 7 aa, Mycobacterium avium
RGAPATA

SEQ ID NO: 43413 - protein, 6 aa, Mycobacterium avium
RGAPER

SEQ ID NO: 43414 - protein, 9 aa, Mycobacterium avium
RGAPGAAGM

SEQ ID NO: 43415 - protein, 6 aa, Mycobacterium avium
RGAQEC

SEQ ID NO: 43416 - protein, 14 aa, Mycobacterium avium
RGAQGAEPRSGDGA

SEQ ID NO: 43417 - protein, 6 aa, Mycobacterium avium
RGASDG

SEQ ID NO: 43418 - protein, 13 aa, Mycobacterium avium
RGATATSSSETIT

SEQ ID NO: 43419 - protein, 7 aa, Mycobacterium avium
RGATDAE

SEQ ID NO: 43420 - protein, 9 aa, Mycobacterium avium
RGATTSKEI

SEQ ID NO: 43421 - protein, 5 aa, Mycobacterium avium
RGATY

SEQ ID NO: 43422 - protein, 9 aa, Mycobacterium avium
RGCTHPGCD

SEQ ID NO: 43423 - protein, 6 aa, Mycobacterium avium
RGCTRP

SEQ ID NO: 43424 - protein, 7 aa, Mycobacterium avium
RGDARDV

SEQ ID NO: 43425 - protein, 9 aa, Mycobacterium avium
RGDDQRKLA

SEQ ID NO: 43426 - protein, 12 aa, Mycobacterium avium
RGDEDQLRTQAG

SEQ ID NO: 43427 - protein, 15 aa, Mycobacterium avium
RGDETLTEDSDRGDG

SEQ ID NO: 43428 - protein, 4 aa, Mycobacterium avium
RGDG

SEQ ID NO: 43429 - protein, 9 aa, Mycobacterium avium
RGDGSTGVD

SEQ ID NO: 43430 - protein, 12 aa, Mycobacterium avium
RGDIDTSEEHDR

SEQ ID NO: 43431 - protein, 10 aa, Mycobacterium avium
RGDPDTGAAA

SEQ ID NO: 43432 - protein, 20 aa, Mycobacterium avium
RGDPSDNLPGIPGVGEKTAS

SEQ ID NO: 43433 - protein, 9 aa, Mycobacterium avium
RGDPSERRR

SEQ ID NO: 43434 - protein, 9 aa, Mycobacterium avium
RGDQNNASL

SEQ ID NO: 43435 - protein, 8 aa, Mycobacterium avium
RGDTGPEL

SEQ ID NO: 43436 - protein, 8 aa, Mycobacterium avium
RGDTRGDH

SEQ ID NO: 43437 - protein, 4 aa, Mycobacterium avium
RGEA

SEQ ID NO: 43438 - protein, 14 aa, Mycobacterium avium
RGEAGDRQVAGEPR

SEQ ID NO: 43439 - protein, 7 aa, Mycobacterium avium
RGEAKDF

SEQ ID NO: 43440 - protein, 6 aa, Mycobacterium avium
RGEDVP

SEQ ID NO: 43441 - protein, 6 aa, Mycobacterium avium
RGEEIT

SEQ ID NO: 43442 - protein, 5 aa, Mycobacterium avium
RGEGI

SEQ ID NO: 43443 - protein, 9 aa, Mycobacterium avium
RGEGPGTSK

SEQ ID NO: 43444 - protein, 5 aa, Mycobacterium avium
RGEGY

SEQ ID NO: 43445 - protein, 6 aa, Mycobacterium avium
RGEIDG

SEQ ID NO: 43446 - protein, 9 aa, Mycobacterium avium
RGEISADAI

SEQ ID NO: 43447 - protein, 4 aa, Mycobacterium avium
RGEL

SEQ ID NO: 43448 - protein, 5 aa, Mycobacterium avium
RGELA

SEQ ID NO: 43449 - protein, 7 aa, Mycobacterium avium
RGELPAK

SEQ ID NO: 43450 - protein, 7 aa, Mycobacterium avium
RGELRGS

SEQ ID NO: 43451 - protein, 6 aa, Mycobacterium avium
RGELSS

SEQ ID NO: 43452 - protein, 16 aa, Mycobacterium avium
RGEPERPPSGREPPAE

SEQ ID NO: 43453 - protein, 8 aa, Mycobacterium avium
RGEPGTPV

SEQ ID NO: 43454 - protein, 7 aa, Mycobacterium avium
RGEQHRP

SEQ ID NO: 43455 - protein, 5 aa, Mycobacterium avium
RGEQM

SEQ ID NO: 43456 - protein, 9 aa, Mycobacterium avium
RGEQPRADS

SEQ ID NO: 43457 - protein, 6 aa, Mycobacterium avium
RGESLK

SEQ ID NO: 43458 - protein, 17 aa, Mycobacterium avium
RGESPEMGEGARPPWSI

SEQ ID NO: 43459 - protein, 6 aa, Mycobacterium avium
RGESSG

SEQ ID NO: 43460 - protein, 11 aa, Mycobacterium avium
RGFADGTPEGV

SEQ ID NO: 43461 - protein, 7 aa, Mycobacterium avium
RGFATQE

SEQ ID NO: 43462 - protein, 13 aa, Mycobacterium avium
RGFGRSDKPLTGY

SEQ ID NO: 43463 - protein, 6 aa, Mycobacterium avium
RGFPSP

SEQ ID NO: 43464 - protein, 6 aa, Mycobacterium avium
RGFTGD

SEQ ID NO: 43465 - protein, 19 aa, Mycobacterium avium
RGGAAAGAPRRSSRRRKAT

SEQ ID NO: 43466 - protein, 13 aa, Mycobacterium avium
RGGAYSAAKGGLT

SEQ ID NO: 43467 - protein, 4 aa, Mycobacterium avium
RGGD

SEQ ID NO: 43468 - protein, 12 aa, Mycobacterium avium
RGGDDDSEISDG

SEQ ID NO: 43469 - protein, 13 aa, Mycobacterium avium
RGGDPQRPGKTDA

SEQ ID NO: 43470 - protein, 11 aa, Mycobacterium avium
RGGEKISPERV

SEQ ID NO: 43471 - protein, 5 aa, Mycobacterium avium
RGGFA

SEQ ID NO: 43472 - protein, 4 aa, Mycobacterium avium
RGGG

SEQ ID NO: 43473 - protein, 5 aa, Mycobacterium avium
RGGGE

SEQ ID NO: 43474 - protein, 10 aa, Mycobacterium avium
RGGGEYGPGW

SEQ ID NO: 43475 - protein, 6 aa, Mycobacterium avium
RGGGGS

SEQ ID NO: 43476 - protein, 5 aa, Mycobacterium avium
RGGGI

SEQ ID NO: 43477 - protein, 6 aa, Mycobacterium avium
RGGGNV

SEQ ID NO: 43478 - protein, 14 aa, Mycobacterium avium
RGGGTTYKLPPGGF

SEQ ID NO: 43479 - protein, 12 aa, Mycobacterium avium
RGGHGSMPQTTV

SEQ ID NO: 43480 - protein, 14 aa, Mycobacterium avium
RGGHPTPMSSTKAT

SEQ ID NO: 43481 - protein, 4 aa, Mycobacterium avium
RGGP

SEQ ID NO: 43482 - protein, 8 aa, Mycobacterium avium
RGGPAPAA

SEQ ID NO: 43483 - protein, 6 aa, Mycobacterium avium
RGGPAT

SEQ ID NO: 43484 - protein, 7 aa, Mycobacterium avium
RGGPDAR

SEQ ID NO: 43485 - protein, 8 aa, Mycobacterium avium
RGGQDPDW

SEQ ID NO: 43486 - protein, 7 aa, Mycobacterium avium
RGGRQAA

SEQ ID NO: 43487 - protein, 9 aa, Mycobacterium avium
RGGSPPQEI

SEQ ID NO: 43488 - protein, 9 aa, Mycobacterium avium
RGGSVSGRL

SEQ ID NO: 43489 - protein, 6 aa, Mycobacterium avium
RGGTAG

SEQ ID NO: 43490 - protein, 6 aa, Mycobacterium avium
RGGTTW

SEQ ID NO: 43491 - protein, 7 aa, Mycobacterium avium
RGGTYSH

SEQ ID NO: 43492 - protein, 5 aa, Mycobacterium avium
RGGYA

SEQ ID NO: 43493 - protein, 8 aa, Mycobacterium avium
RGGYDGRG

SEQ ID NO: 43494 - protein, 5 aa, Mycobacterium avium
RGGYV

SEQ ID NO: 43495 - protein, 14 aa, Mycobacterium avium
RGHGRSGEAAPESY

SEQ ID NO: 43496 - protein, 10 aa, Mycobacterium avium
RGHGRSGGKR

SEQ ID NO: 43497 - protein, 14 aa, Mycobacterium avium
RGHGRSGVPKATGY

SEQ ID NO: 43498 - protein, 4 aa, Mycobacterium avium
RGHL

SEQ ID NO: 43499 - protein, 14 aa, Mycobacterium avium
RGHNEGDDPSMTNP

SEQ ID NO: 43500 - protein, 4 aa, Mycobacterium avium
RGHP

SEQ ID NO: 43501 - protein, 7 aa, Mycobacterium avium
RGHPSRE

SEQ ID NO: 43502 - protein, 6 aa, Mycobacterium avium
RGIAND

SEQ ID NO: 43503 - protein, 4 aa, Mycobacterium avium
RGIT

SEQ ID NO: 43504 - protein, 6 aa, Mycobacterium avium
RGITRE

SEQ ID NO: 43505 - protein, 12 aa, Mycobacterium avium
RGKARLKSDDHE

SEQ ID NO: 43506 - protein, 4 aa, Mycobacterium avium
RGKI

SEQ ID NO: 43507 - protein, 6 aa, Mycobacterium avium
RGKKSV

SEQ ID NO: 43508 - protein, 4 aa, Mycobacterium avium
RGKP

SEQ ID NO: 43509 - protein, 16 aa, Mycobacterium avium
RGKRASVARRTGGELA

SEQ ID NO: 43510 - protein, 13 aa, Mycobacterium avium
RGKTIRPKTLNQK

SEQ ID NO: 43511 - protein, 8 aa, Mycobacterium avium
RGLANGEW

SEQ ID NO: 43512 - protein, 4 aa, Mycobacterium avium
RGLE

SEQ ID NO: 43513 - protein, 6 aa, Mycobacterium avium
RGLERT

SEQ ID NO: 43514 - protein, 4 aa, Mycobacterium avium
RGLG

SEQ ID NO: 43515 - protein, 13 aa, Mycobacterium avium
RGLGPADIAPRPG

SEQ ID NO: 43516 - protein, 8 aa, Mycobacterium avium
RGLGRPER

SEQ ID NO: 43517 - protein, 16 aa, Mycobacterium avium
RGLGRSTLGSDGVRPD

SEQ ID NO: 43518 - protein, 4 aa, Mycobacterium avium
RGLP

SEQ ID NO: 43519 - protein, 8 aa, Mycobacterium avium
RGLPPAQL

SEQ ID NO: 43520 - protein, 8 aa, Mycobacterium avium
RGLPPKRR

SEQ ID NO: 43521 - protein, 12 aa, Mycobacterium avium
RGLSGSPRRFGE

SEQ ID NO: 43522 - protein, 6 aa, Mycobacterium avium
RGLSPA

SEQ ID NO: 43523 - protein, 4 aa, Mycobacterium avium
RGLT

SEQ ID NO: 43524 - protein, 5 aa, Mycobacterium avium
RGMGR

SEQ ID NO: 43525 - protein, 6 aa, Mycobacterium avium
RGNATR

SEQ ID NO: 43526 - protein, 17 aa, Mycobacterium avium
RGNEGTVGGALLLMDVV

SEQ ID NO: 43527 - protein, 8 aa, Mycobacterium avium
RGNGSGPV

SEQ ID NO: 43528 - protein, 9 aa, Mycobacterium avium
RGNPGPAGY

SEQ ID NO: 43529 - protein, 7 aa, Mycobacterium avium
RGPARMP

SEQ ID NO: 43530 - protein, 8 aa, Mycobacterium avium
RGPASADV

SEQ ID NO: 43531 - protein, 10 aa, Mycobacterium avium
RGPATPGSAA

SEQ ID NO: 43532 - protein, 7 aa, Mycobacterium avium
RGPATRR

SEQ ID NO: 43533 - protein, 6 aa, Mycobacterium avium
RGPAVG

SEQ ID NO: 43534 - protein, 7 aa, Mycobacterium avium
RGPDAVP

SEQ ID NO: 43535 - protein, 5 aa, Mycobacterium avium
RGPDE

SEQ ID NO: 43536 - protein, 9 aa, Mycobacterium avium
RGPDGARDK

SEQ ID NO: 43537 - protein, 15 aa, Mycobacterium avium
RGPEAAELSGDDADE

SEQ ID NO: 43538 - protein, 19 aa, Mycobacterium avium
RGPGRVGPSPRRCRRAYWR

SEQ ID NO: 43539 - protein, 10 aa, Mycobacterium avium
RGPKATGALR

SEQ ID NO: 43540 - protein, 11 aa, Mycobacterium avium
RGPLDPDEATA

SEQ ID NO: 43541 - protein, 7 aa, Mycobacterium avium
RGPNAGS

SEQ ID NO: 43542 - protein, 11 aa, Mycobacterium avium
RGPNGQDLVSN

SEQ ID NO: 43543 - protein, 15 aa, Mycobacterium avium
RGPRLASREDEDVSA

SEQ ID NO: 43544 - protein, 5 aa, Mycobacterium avium
RGPSA

SEQ ID NO: 43545 - protein, 8 aa, Mycobacterium avium
RGPSGFIG

SEQ ID NO: 43546 - protein, 7 aa, Mycobacterium avium
RGPSRIA

SEQ ID NO: 43547 - protein, 6 aa, Mycobacterium avium
RGPTGD

SEQ ID NO: 43548 - protein, 4 aa, Mycobacterium avium
RGQA

SEQ ID NO: 43549 - protein, 10 aa, Mycobacterium avium
RGQADGRYRA

SEQ ID NO: 43550 - protein, 8 aa, Mycobacterium avium
RGQAGELQ

SEQ ID NO: 43551 - protein, 9 aa, Mycobacterium avium
RGQAGFDDP

SEQ ID NO: 43552 - protein, 5 aa, Mycobacterium avium
RGQEA

SEQ ID NO: 43553 - protein, 6 aa, Mycobacterium avium
RGQEAA

SEQ ID NO: 43554 - protein, 14 aa, Mycobacterium avium
RGQEAIEGDRVPGA

SEQ ID NO: 43555 - protein, 4 aa, Mycobacterium avium
RGQG

SEQ ID NO: 43556 - protein, 6 aa, Mycobacterium avium
RGQGKI

SEQ ID NO: 43557 - protein, 14 aa, Mycobacterium avium
RGQGPLPATGRGLR

SEQ ID NO: 43558 - protein, 15 aa, Mycobacterium avium
RGQLPPEIENQLPPN

SEQ ID NO: 43559 - protein, 15 aa, Mycobacterium avium
RGQPAASDPAPPQTL

SEQ ID NO: 43560 - protein, 24 aa, Mycobacterium avium
RGQPDAKPAPPAGTPAPAGRTDEP

SEQ ID NO: 43561 - protein, 7 aa, Mycobacterium avium
RGQRPAD

SEQ ID NO: 43562 - protein, 6 aa, Mycobacterium avium
RGQSQS

SEQ ID NO: 43563 - protein, 6 aa, Mycobacterium avium
RGRGPV

SEQ ID NO: 43564 - protein, 9 aa, Mycobacterium avium
RGRGVPPER

SEQ ID NO: 43565 - protein, 8 aa, Mycobacterium avium
RGRKTGKL

SEQ ID NO: 43566 - protein, 15 aa, Mycobacterium avium
RGRKTVNIVAAGQAA

SEQ ID NO: 43567 - protein, 18 aa, Mycobacterium avium
RGRLPGDDGRSGPEKDGF

SEQ ID NO: 43568 - protein, 4 aa, Mycobacterium avium
RGRN

SEQ ID NO: 43569 - protein, 8 aa, Mycobacterium avium
RGRPGGAT

SEQ ID NO: 43570 - protein, 8 aa, Mycobacterium avium
RGRPRPAA

SEQ ID NO: 43571 - protein, 4 aa, Mycobacterium avium
RGRR

SEQ ID NO: 43572 - protein, 13 aa, Mycobacterium avium
RGRRISPDTRDAV

SEQ ID NO: 43573 - protein, 4 aa, Mycobacterium avium
RGRS

SEQ ID NO: 43574 - protein, 6 aa, Mycobacterium avium
RGRSYR

SEQ ID NO: 43575 - protein, 7 aa, Mycobacterium avium
RGRTEAL

SEQ ID NO: 43576 - protein, 6 aa, Mycobacterium avium
RGRVAG

SEQ ID NO: 43577 - protein, 9 aa, Mycobacterium avium
RGRVDNDAT

SEQ ID NO: 43578 - protein, 5 aa, Mycobacterium avium
RGRVG

SEQ ID NO: 43579 - protein, 7 aa, Mycobacterium avium
RGRWQSP

SEQ ID NO: 43580 - protein, 5 aa, Mycobacterium avium
RGSAA

SEQ ID NO: 43581 - protein, 11 aa, Mycobacterium avium
RGSADAEGETL

SEQ ID NO: 43582 - protein, 6 aa, Mycobacterium avium
RGSAKR

SEQ ID NO: 43583 - protein, 5 aa, Mycobacterium avium
RGSDV

SEQ ID NO: 43584 - protein, 7 aa, Mycobacterium avium
RGSGARI

SEQ ID NO: 43585 - protein, 5 aa, Mycobacterium avium
RGSGL

SEQ ID NO: 43586 - protein, 6 aa, Mycobacterium avium
RGSGQW

SEQ ID NO: 43587 - protein, 7 aa, Mycobacterium avium
RGSGTLA

SEQ ID NO: 43588 - protein, 6 aa, Mycobacterium avium
RGSGVR

SEQ ID NO: 43589 - protein, 34 aa, Mycobacterium avium
RGSKTPRTRVGRGEGSKGKTAGRGTKGTKARKNV

SEQ ID NO: 43590 - protein, 8 aa, Mycobacterium avium
RGSPAEFA

SEQ ID NO: 43591 - protein, 11 aa, Mycobacterium avium
RGSVPASTQLA

SEQ ID NO: 43592 - protein, 4 aa, Mycobacterium avium
RGSY

SEQ ID NO: 43593 - protein, 7 aa, Mycobacterium avium
RGTAETA

SEQ ID NO: 43594 - protein, 12 aa, Mycobacterium avium
RGTAPSSPLNAT

SEQ ID NO: 43595 - protein, 4 aa, Mycobacterium avium
RGTD

SEQ ID NO: 43596 - protein, 6 aa, Mycobacterium avium
RGTDAG

SEQ ID NO: 43597 - protein, 9 aa, Mycobacterium avium
RGTDDDAHG

SEQ ID NO: 43598 - protein, 10 aa, Mycobacterium avium
RGTDDGRLEQ

SEQ ID NO: 43599 - protein, 7 aa, Mycobacterium avium
RGTDSLN

SEQ ID NO: 43600 - protein, 8 aa, Mycobacterium avium
RGTEADRI

SEQ ID NO: 43601 - protein, 9 aa, Mycobacterium avium
RGTEPDSGQ

SEQ ID NO: 43602 - protein, 7 aa, Mycobacterium avium
RGTETPE

SEQ ID NO: 43603 - protein, 5 aa, Mycobacterium avium
RGTGA

SEQ ID NO: 43604 - protein, 6 aa, Mycobacterium avium
RGTGPV

SEQ ID NO: 43605 - protein, 10 aa, Mycobacterium avium
RGTGRPVAPP

SEQ ID NO: 43606 - protein, 7 aa, Mycobacterium avium
RGTGSKD

SEQ ID NO: 43607 - protein, 11 aa, Mycobacterium avium
RGTGVSSDVET

SEQ ID NO: 43608 - protein, 6 aa, Mycobacterium avium
RGTNLL

SEQ ID NO: 43609 - protein, 8 aa, Mycobacterium avium
RGTPLDEA

SEQ ID NO: 43610 - protein, 8 aa, Mycobacterium avium
RGTPPRLE

SEQ ID NO: 43611 - protein, 8 aa, Mycobacterium avium
RGTQGQPV

SEQ ID NO: 43612 - protein, 9 aa, Mycobacterium avium
RGTSVNPVP

SEQ ID NO: 43613 - protein, 5 aa, Mycobacterium avium
RGVAP

SEQ ID NO: 43614 - protein, 4 aa, Mycobacterium avium
RGVG

SEQ ID NO: 43615 - protein, 7 aa, Mycobacterium avium
RGVGPDA

SEQ ID NO: 43616 - protein, 11 aa, Mycobacterium avium
RGVPKRSGGHG

SEQ ID NO: 43617 - protein, 6 aa, Mycobacterium avium
RGVPPT

SEQ ID NO: 43618 - protein, 13 aa, Mycobacterium avium
RGVPTGTCPSVGA

SEQ ID NO: 43619 - protein, 16 aa, Mycobacterium avium
RGVSAGKVTERERDRA

SEQ ID NO: 43620 - protein, 7 aa, Mycobacterium avium
RGVTATQ

SEQ ID NO: 43621 - protein, 6 aa, Mycobacterium avium
RGVTDE

SEQ ID NO: 43622 - protein, 8 aa, Mycobacterium avium
RGWETDGG

SEQ ID NO: 43623 - protein, 4 aa, Mycobacterium avium
RGWG

SEQ ID NO: 43624 - protein, 5 aa, Mycobacterium avium
RGYAY

SEQ ID NO: 43625 - protein, 7 aa, Mycobacterium avium
RGYDQTT

SEQ ID NO: 43626 - protein, 12 aa, Mycobacterium avium
RGYDSDHPRVQG

SEQ ID NO: 43627 - protein, 8 aa, Mycobacterium avium
RGYEGTSI

SEQ ID NO: 43628 - protein, 8 aa, Mycobacterium avium
RGYGYGPA

SEQ ID NO: 43629 - protein, 7 aa, Mycobacterium avium
RGYPAQD

SEQ ID NO: 43630 - protein, 7 aa, Mycobacterium avium
RHAENGV

SEQ ID NO: 43631 - protein, 4 aa, Mycobacterium avium
RHAP

SEQ ID NO: 43632 - protein, 6 aa, Mycobacterium avium
RHAQRK

SEQ ID NO: 43633 - protein, 7 aa, Mycobacterium avium
RHARSGG

SEQ ID NO: 43634 - protein, 6 aa, Mycobacterium avium
RHASGA

SEQ ID NO: 43635 - protein, 4 aa, Mycobacterium avium
RHDA

SEQ ID NO: 43636 - protein, 10 aa, Mycobacterium avium
RHDDTPAVAY

SEQ ID NO: 43637 - protein, 7 aa, Mycobacterium avium
RHDPDDV

SEQ ID NO: 43638 - protein, 9 aa, Mycobacterium avium
RHDPDGPYG

SEQ ID NO: 43639 - protein, 13 aa, Mycobacterium avium
RHEAAGTTHDPEY

SEQ ID NO: 43640 - protein, 9 aa, Mycobacterium avium
RHEAGPADL

SEQ ID NO: 43641 - protein, 10 aa, Mycobacterium avium
RHEAGPHDHT

SEQ ID NO: 43642 - protein, 4 aa, Mycobacterium avium
RHER

SEQ ID NO: 43643 - protein, 11 aa, Mycobacterium avium
RHESSTAPGAW

SEQ ID NO: 43644 - protein, 10 aa, Mycobacterium avium
RHGDPKTVAE

SEQ ID NO: 43645 - protein, 5 aa, Mycobacterium avium
RHGGS

SEQ ID NO: 43646 - protein, 6 aa, Mycobacterium avium
RHGNDT

SEQ ID NO: 43647 - protein, 5 aa, Mycobacterium avium
RHGNP

SEQ ID NO: 43648 - protein, 5 aa, Mycobacterium avium
RHGPE

SEQ ID NO: 43649 - protein, 6 aa, Mycobacterium avium
RHGPSS

SEQ ID NO: 43650 - protein, 13 aa, Mycobacterium avium
RHGQVDSAELETR

SEQ ID NO: 43651 - protein, 16 aa, Mycobacterium avium
RHGRPLDTSAQTGIPA

SEQ ID NO: 43652 - protein, 6 aa, Mycobacterium avium
RHGRSI

SEQ ID NO: 43653 - protein, 5 aa, Mycobacterium avium
RHGTQ

SEQ ID NO: 43654 - protein, 6 aa, Mycobacterium avium
RHHTER

SEQ ID NO: 43655 - protein, 9 aa, Mycobacterium avium
RHKATGERF

SEQ ID NO: 43656 - protein, 12 aa, Mycobacterium avium
RHNERRGVDPAL

SEQ ID NO: 43657 - protein, 10 aa, Mycobacterium avium
RHPDRPAGVP

SEQ ID NO: 43658 - protein, 6 aa, Mycobacterium avium
RHPEEP

SEQ ID NO: 43659 - protein, 5 aa, Mycobacterium avium
RHPGN

SEQ ID NO: 43660 - protein, 7 aa, Mycobacterium avium
RHPGRRS

SEQ ID NO: 43661 - protein, 7 aa, Mycobacterium avium
RHPGTSQ

SEQ ID NO: 43662 - protein, 5 aa, Mycobacterium avium
RHPRG

SEQ ID NO: 43663 - protein, 13 aa, Mycobacterium avium
RHPSRSQVLRDYL

SEQ ID NO: 43664 - protein, 4 aa, Mycobacterium avium
RHPV

SEQ ID NO: 43665 - protein, 5 aa, Mycobacterium avium
RHPYG

SEQ ID NO: 43666 - protein, 7 aa, Mycobacterium avium
RHRGARG

SEQ ID NO: 43667 - protein, 7 aa, Mycobacterium avium
RHRGGQK

SEQ ID NO: 43668 - protein, 5 aa, Mycobacterium avium
RHRGT

SEQ ID NO: 43669 - protein, 11 aa, Mycobacterium avium
RHSEPEDEPTR

SEQ ID NO: 43670 - protein, 6 aa, Mycobacterium avium
RHSGHD

SEQ ID NO: 43671 - protein, 18 aa, Mycobacterium avium
RHTGKDAATIRKDTDRDK

SEQ ID NO: 43672 - protein, 6 aa, Mycobacterium avium
RHTPEG

SEQ ID NO: 43673 - protein, 6 aa, Mycobacterium avium
RHTPEI

SEQ ID NO: 43674 - protein, 4 aa, Mycobacterium avium
RIAG

SEQ ID NO: 43675 - protein, 7 aa, Mycobacterium avium
RIARDGE

SEQ ID NO: 43676 - protein, 8 aa, Mycobacterium avium
RIDEDPDK

SEQ ID NO: 43677 - protein, 9 aa, Mycobacterium avium
RIDGSPYRY

SEQ ID NO: 43678 - protein, 8 aa, Mycobacterium avium
RIDPASTG

SEQ ID NO: 43679 - protein, 8 aa, Mycobacterium avium
RIEDQESL

SEQ ID NO: 43680 - protein, 5 aa, Mycobacterium avium
RIEPE

SEQ ID NO: 43681 - protein, 8 aa, Mycobacterium avium
RIGEEGKG

SEQ ID NO: 43682 - protein, 8 aa, Mycobacterium avium
RIGPGKAQ

SEQ ID NO: 43683 - protein, 4 aa, Mycobacterium avium
RIGT

SEQ ID NO: 43684 - protein, 10 aa, Mycobacterium avium
RIPASYATTE

SEQ ID NO: 43685 - protein, 9 aa, Mycobacterium avium
RIPDHAPSR

SEQ ID NO: 43686 - protein, 5 aa, Mycobacterium avium
RIRAQ

SEQ ID NO: 43687 - protein, 10 aa, Mycobacterium avium
RISPGDGAWR

SEQ ID NO: 43688 - protein, 12 aa, Mycobacterium avium
RITSPDEPKYDA

SEQ ID NO: 43689 - protein, 19 aa, Mycobacterium avium
RKAAKAAARVDREHPGDRH

SEQ ID NO: 43690 - protein, 5 aa, Mycobacterium avium
RKAGH

SEQ ID NO: 43691 - protein, 17 aa, Mycobacterium avium
RKAGSDDDHAAAAADGW

SEQ ID NO: 43692 - protein, 31 aa, Mycobacterium avium
RKAGTKKGPTVGSGGQRRRGLEGRGPTPPAH

SEQ ID NO: 43693 - protein, 6 aa, Mycobacterium avium
RKAHGD

SEQ ID NO: 43694 - protein, 4 aa, Mycobacterium avium
RKAM

SEQ ID NO: 43695 - protein, 13 aa, Mycobacterium avium
RKAPEKTAEAIDS

SEQ ID NO: 43696 - protein, 6 aa, Mycobacterium avium
RKDDPR

SEQ ID NO: 43697 - protein, 16 aa, Mycobacterium avium
RKDGKRRIHQKPGRTE

SEQ ID NO: 43698 - protein, 8 aa, Mycobacterium avium
RKDRPEPV

SEQ ID NO: 43699 - protein, 12 aa, Mycobacterium avium
RKEGGKTGMWTR

SEQ ID NO: 43700 - protein, 5 aa, Mycobacterium avium
RKEGK

SEQ ID NO: 43701 - protein, 7 aa, Mycobacterium avium
RKEIHES

SEQ ID NO: 43702 - protein, 8 aa, Mycobacterium avium
RKELSGNQ

SEQ ID NO: 43703 - protein, 12 aa, Mycobacterium avium
RKEPAKTAEAID

SEQ ID NO: 43704 - protein, 9 aa, Mycobacterium avium
RKGAAALAE

SEQ ID NO: 43705 - protein, 12 aa, Mycobacterium avium
RKGARATLEELV

SEQ ID NO: 43706 - protein, 16 aa, Mycobacterium avium
RKGDADAYSLSTEEVA

SEQ ID NO: 43707 - protein, 13 aa, Mycobacterium avium
RKGHDDDFNRGDS

SEQ ID NO: 43708 - protein, 17 aa, Mycobacterium avium
RKGIEDAGGTYEPHPAE

SEQ ID NO: 43709 - protein, 4 aa, Mycobacterium avium
RKGL

SEQ ID NO: 43710 - protein, 8 aa, Mycobacterium avium
RKGPGRPP

SEQ ID NO: 43711 - protein, 18 aa, Mycobacterium avium
RKGRNNSPTAGPTDVGSP

SEQ ID NO: 43712 - protein, 10 aa, Mycobacterium avium
RKHAAKNPKA

SEQ ID NO: 43713 - protein, 8 aa, Mycobacterium avium
RKIAGGAG

SEQ ID NO: 43714 - protein, 17 aa, Mycobacterium avium
RKISDGDKLAGRHGNKG

SEQ ID NO: 43715 - protein, 37 aa, Mycobacterium avium
RKKGESKEKAARISNAAAGQGKSSVGRRGGKSGSYQD

SEQ ID NO: 43716 - protein, 14 aa, Mycobacterium avium
RKKQRQPAEYPTEE

SEQ ID NO: 43717 - protein, 11 aa, Mycobacterium avium
RKLDKAASKGV

SEQ ID NO: 43718 - protein, 7 aa, Mycobacterium avium
RKLDNGK

SEQ ID NO: 43719 - protein, 4 aa, Mycobacterium avium
RKND

SEQ ID NO: 43720 - protein, 7 aa, Mycobacterium avium
RKNGQRF

SEQ ID NO: 43721 - protein, 8 aa, Mycobacterium avium
RKNIDTGM

SEQ ID NO: 43722 - protein, 8 aa, Mycobacterium avium
RKPANPQQ

SEQ ID NO: 43723 - protein, 8 aa, Mycobacterium avium
RKPDDAPD

SEQ ID NO: 43724 - protein, 10 aa, Mycobacterium avium
RKPDDDRGGN

SEQ ID NO: 43725 - protein, 7 aa, Mycobacterium avium
RKPEHAA

SEQ ID NO: 43726 - protein, 11 aa, Mycobacterium avium
RKPGAVTTTSA

SEQ ID NO: 43727 - protein, 6 aa, Mycobacterium avium
RKPGPL

SEQ ID NO: 43728 - protein, 7 aa, Mycobacterium avium
RKPIPED

SEQ ID NO: 43729 - protein, 13 aa, Mycobacterium avium
RKPKDLSGGQRQR

SEQ ID NO: 43730 - protein, 5 aa, Mycobacterium avium
RKPKF

SEQ ID NO: 43731 - protein, 13 aa, Mycobacterium avium
RKPSQLSGGQRQR

SEQ ID NO: 43732 - protein, 17 aa, Mycobacterium avium
RKQEAADEAAAQVGPQA

SEQ ID NO: 43733 - protein, 7 aa, Mycobacterium avium
RKQFGKP

SEQ ID NO: 43734 - protein, 5 aa, Mycobacterium avium
RKQQA

SEQ ID NO: 43735 - protein, 7 aa, Mycobacterium avium
RKQSPYP

SEQ ID NO: 43736 - protein, 19 aa, Mycobacterium avium
RKRHPGAGQAIDPKRNAEL

SEQ ID NO: 43737 - protein, 4 aa, Mycobacterium avium
RKRI

SEQ ID NO: 43738 - protein, 7 aa, Mycobacterium avium
RKSGELP

SEQ ID NO: 43739 - protein, 5 aa, Mycobacterium avium
RKSIR

SEQ ID NO: 43740 - protein, 5 aa, Mycobacterium avium
RKSRT

SEQ ID NO: 43741 - protein, 8 aa, Mycobacterium avium
RKSTGLDV

SEQ ID NO: 43742 - protein, 7 aa, Mycobacterium avium
RKTGKTA

SEQ ID NO: 43743 - protein, 4 aa, Mycobacterium avium
RKTK

SEQ ID NO: 43744 - protein, 9 aa, Mycobacterium avium
RKTSGEDMA

SEQ ID NO: 43745 - protein, 9 aa, Mycobacterium avium
RKTTDGDLA

SEQ ID NO: 43746 - protein, 7 aa, Mycobacterium avium
RKTVDGQ

SEQ ID NO: 43747 - protein, 9 aa, Mycobacterium avium
RKVGQASGH

SEQ ID NO: 43748 - protein, 4 aa, Mycobacterium avium
RKYK

SEQ ID NO: 43749 - protein, 5 aa, Mycobacterium avium
RLAAG

SEQ ID NO: 43750 - protein, 8 aa, Mycobacterium avium
RLADEGIG

SEQ ID NO: 43751 - protein, 13 aa, Mycobacterium avium
RLADPGTAPGDAW

SEQ ID NO: 43752 - protein, 7 aa, Mycobacterium avium
RLADTTG

SEQ ID NO: 43753 - protein, 11 aa, Mycobacterium avium
RLAGDTDKTIA

SEQ ID NO: 43754 - protein, 12 aa, Mycobacterium avium
RLAGEERAPAPA

SEQ ID NO: 43755 - protein, 5 aa, Mycobacterium avium
RLAGP

SEQ ID NO: 43756 - protein, 9 aa, Mycobacterium avium
RLAGPDQEI

SEQ ID NO: 43757 - protein, 12 aa, Mycobacterium avium
RLAKKSKQAKKV

SEQ ID NO: 43758 - protein, 5 aa, Mycobacterium avium
RLAPG

SEQ ID NO: 43759 - protein, 10 aa, Mycobacterium avium
RLAPYKAPKT

SEQ ID NO: 43760 - protein, 16 aa, Mycobacterium avium
RLASEKNGVMICTDCA

SEQ ID NO: 43761 - protein, 6 aa, Mycobacterium avium
RLDGGA

SEQ ID NO: 43762 - protein, 15 aa, Mycobacterium avium
RLDRPGGGLSGGQQQ

SEQ ID NO: 43763 - protein, 9 aa, Mycobacterium avium
RLEDGSDLD

SEQ ID NO: 43764 - protein, 5 aa, Mycobacterium avium
RLEPG

SEQ ID NO: 43765 - protein, 7 aa, Mycobacterium avium
RLESGKR

SEQ ID NO: 43766 - protein, 16 aa, Mycobacterium avium
RLESKKISKTQAVTSN

SEQ ID NO: 43767 - protein, 6 aa, Mycobacterium avium
RLGEDS

SEQ ID NO: 43768 - protein, 8 aa, Mycobacterium avium
RLGGAEMS

SEQ ID NO: 43769 - protein, 5 aa, Mycobacterium avium
RLGGG

SEQ ID NO: 43770 - protein, 13 aa, Mycobacterium avium
RLGGSDEADHDRV

SEQ ID NO: 43771 - protein, 4 aa, Mycobacterium avium
RLGP

SEQ ID NO: 43772 - protein, 9 aa, Mycobacterium avium
RLGQPPSGY

SEQ ID NO: 43773 - protein, 5 aa, Mycobacterium avium
RLGRR

SEQ ID NO: 43774 - protein, 12 aa, Mycobacterium avium
RLGSTLGGGADV

SEQ ID NO: 43775 - protein, 6 aa, Mycobacterium avium
RLKENE

SEQ ID NO: 43776 - protein, 6 aa, Mycobacterium avium
RLPADN

SEQ ID NO: 43777 - protein, 5 aa, Mycobacterium avium
RLPAT

SEQ ID NO: 43778 - protein, 8 aa, Mycobacterium avium
RLPDGAAR

SEQ ID NO: 43779 - protein, 4 aa, Mycobacterium avium
RLPM

SEQ ID NO: 43780 - protein, 9 aa, Mycobacterium avium
RLPRPDGKL

SEQ ID NO: 43781 - protein, 7 aa, Mycobacterium avium
RLPRTGS

SEQ ID NO: 43782 - protein, 7 aa, Mycobacterium avium
RLPTDPR

SEQ ID NO: 43783 - protein, 6 aa, Mycobacterium avium
RLPTEA

SEQ ID NO: 43784 - protein, 8 aa, Mycobacterium avium
RLPTTATN

SEQ ID NO: 43785 - protein, 5 aa, Mycobacterium avium
RLQEN

SEQ ID NO: 43786 - protein, 5 aa, Mycobacterium avium
RLQTR

SEQ ID NO: 43787 - protein, 12 aa, Mycobacterium avium
RLRDNRNGMTIP

SEQ ID NO: 43788 - protein, 20 aa, Mycobacterium avium
RLSDPDLHSNPDEARKAGRR

SEQ ID NO: 43789 - protein, 8 aa, Mycobacterium avium
RLSDQELR

SEQ ID NO: 43790 - protein, 9 aa, Mycobacterium avium
RLSEPDAAN

SEQ ID NO: 43791 - protein, 7 aa, Mycobacterium avium
RLSEQAG

SEQ ID NO: 43792 - protein, 5 aa, Mycobacterium avium
RLSGE

SEQ ID NO: 43793 - protein, 9 aa, Mycobacterium avium
RLSRPGQPV

SEQ ID NO: 43794 - protein, 8 aa, Mycobacterium avium
RLSRREAR

SEQ ID NO: 43795 - protein, 5 aa, Mycobacterium avium
RLTDS

SEQ ID NO: 43796 - protein, 9 aa, Mycobacterium avium
RLTGKDAEL

SEQ ID NO: 43797 - protein, 19 aa, Mycobacterium avium
RLTGSSDLYEATGRRPSAS

SEQ ID NO: 43798 - protein, 5 aa, Mycobacterium avium
RLTPK

SEQ ID NO: 43799 - protein, 6 aa, Mycobacterium avium
RMGDGE

SEQ ID NO: 43800 - protein, 4 aa, Mycobacterium avium
RMGQ

SEQ ID NO: 43801 - protein, 7 aa, Mycobacterium avium
RMGTPDD

SEQ ID NO: 43802 - protein, 10 aa, Mycobacterium avium
RMPAAETAGA

SEQ ID NO: 43803 - protein, 7 aa, Mycobacterium avium
RMPAGPA

SEQ ID NO: 43804 - protein, 6 aa, Mycobacterium avium
RMPTPA

SEQ ID NO: 43805 - protein, 9 aa, Mycobacterium avium
RMSAEDRET

SEQ ID NO: 43806 - protein, 5 aa, Mycobacterium avium
RMSAQ

SEQ ID NO: 43807 - protein, 4 aa, Mycobacterium avium
RMTV

SEQ ID NO: 43808 - protein, 7 aa, Mycobacterium avium
RNAADNG

SEQ ID NO: 43809 - protein, 7 aa, Mycobacterium avium
RNAAGTT

SEQ ID NO: 43810 - protein, 8 aa, Mycobacterium avium
RNAAPTVK

SEQ ID NO: 43811 - protein, 5 aa, Mycobacterium avium
RNADG

SEQ ID NO: 43812 - protein, 9 aa, Mycobacterium avium
RNADNSIGA

SEQ ID NO: 43813 - protein, 19 aa, Mycobacterium avium
RNAGGQVVDRNQNRSRGDK

SEQ ID NO: 43814 - protein, 6 aa, Mycobacterium avium
RNAQTN

SEQ ID NO: 43815 - protein, 7 aa, Mycobacterium avium
RNARERL

SEQ ID NO: 43816 - protein, 12 aa, Mycobacterium avium
RNASTGPGGTAA

SEQ ID NO: 43817 - protein, 8 aa, Mycobacterium avium
RNATGVEG

SEQ ID NO: 43818 - protein, 6 aa, Mycobacterium avium
RNATHQ

SEQ ID NO: 43819 - protein, 6 aa, Mycobacterium avium
RNAVSS

SEQ ID NO: 43820 - protein, 6 aa, Mycobacterium avium
RNCSPA

SEQ ID NO: 43821 - protein, 6 aa, Mycobacterium avium
RNDDTV

SEQ ID NO: 43822 - protein, 10 aa, Mycobacterium avium
RNDSGKPGLP

SEQ ID NO: 43823 - protein, 5 aa, Mycobacterium avium
RNEAG

SEQ ID NO: 43824 - protein, 8 aa, Mycobacterium avium
RNEPDLDD

SEQ ID NO: 43825 - protein, 6 aa, Mycobacterium avium
RNEPTL

SEQ ID NO: 43826 - protein, 11 aa, Mycobacterium avium
RNFTGRMGSTE

SEQ ID NO: 43827 - protein, 9 aa, Mycobacterium avium
RNGAGKTTT

SEQ ID NO: 43828 - protein, 13 aa, Mycobacterium avium
RNGERADRLRSYA

SEQ ID NO: 43829 - protein, 7 aa, Mycobacterium avium
RNGESPV

SEQ ID NO: 43830 - protein, 13 aa, Mycobacterium avium
RNGGRRRSTVVPS

SEQ ID NO: 43831 - protein, 11 aa, Mycobacterium avium
RNGGTMADPGS

SEQ ID NO: 43832 - protein, 10 aa, Mycobacterium avium
RNGKGQKKLR

SEQ ID NO: 43833 - protein, 11 aa, Mycobacterium avium
RNGPGPQDAPD

SEQ ID NO: 43834 - protein, 10 aa, Mycobacterium avium
RNGPNPVAEV

SEQ ID NO: 43835 - protein, 8 aa, Mycobacterium avium
RNGPTKTV

SEQ ID NO: 43836 - protein, 11 aa, Mycobacterium avium
RNGQTDAAVGA

SEQ ID NO: 43837 - protein, 10 aa, Mycobacterium avium
RNGSGGKSYR

SEQ ID NO: 43838 - protein, 5 aa, Mycobacterium avium
RNGYR

SEQ ID NO: 43839 - protein, 6 aa, Mycobacterium avium
RNKPND

SEQ ID NO: 43840 - protein, 4 aa, Mycobacterium avium
RNKS

SEQ ID NO: 43841 - protein, 7 aa, Mycobacterium avium
RNLGGAG

SEQ ID NO: 43842 - protein, 5 aa, Mycobacterium avium
RNLGP

SEQ ID NO: 43843 - protein, 7 aa, Mycobacterium avium
RNNGPEL

SEQ ID NO: 43844 - protein, 6 aa, Mycobacterium avium
RNNIER

SEQ ID NO: 43845 - protein, 7 aa, Mycobacterium avium
RNPDNGY

SEQ ID NO: 43846 - protein, 8 aa, Mycobacterium avium
RNPESQAQ

SEQ ID NO: 43847 - protein, 9 aa, Mycobacterium avium
RNPLHSDPE

SEQ ID NO: 43848 - protein, 14 aa, Mycobacterium avium
RNPPPKPPPPLPVP

SEQ ID NO: 43849 - protein, 6 aa, Mycobacterium avium
RNPPVF

SEQ ID NO: 43850 - protein, 4 aa, Mycobacterium avium
RNPQ

SEQ ID NO: 43851 - protein, 5 aa, Mycobacterium avium
RNPRD

SEQ ID NO: 43852 - protein, 4 aa, Mycobacterium avium
RNPV

SEQ ID NO: 43853 - protein, 17 aa, Mycobacterium avium
RNQVRTKPFWSPGRTGM

SEQ ID NO: 43854 - protein, 10 aa, Mycobacterium avium
RNRDRATELR

SEQ ID NO: 43855 - protein, 6 aa, Mycobacterium avium
RNRISG

SEQ ID NO: 43856 - protein, 4 aa, Mycobacterium avium
RNRP

SEQ ID NO: 43857 - protein, 8 aa, Mycobacterium avium
RNRTGAGQ

SEQ ID NO: 43858 - protein, 5 aa, Mycobacterium avium
RNSDE

SEQ ID NO: 43859 - protein, 9 aa, Mycobacterium avium
RNTADHRQI

SEQ ID NO: 43860 - protein, 15 aa, Mycobacterium avium
RNTDPTASGPREQSM

SEQ ID NO: 43861 - protein, 12 aa, Mycobacterium avium
RNTKPRPAAGGA

SEQ ID NO: 43862 - protein, 7 aa, Mycobacterium avium
RNTPGVT

SEQ ID NO: 43863 - protein, 10 aa, Mycobacterium avium
RNVERSDKEQ

SEQ ID NO: 43864 - protein, 11 aa, Mycobacterium avium
RNWEANEPSEL

SEQ ID NO: 43865 - protein, 4 aa, Mycobacterium avium
RPAA

SEQ ID NO: 43866 - protein, 17 aa, Mycobacterium avium
RPAAASRDGLRGAGRQR

SEQ ID NO: 43867 - protein, 9 aa, Mycobacterium avium
RPAAQARAA

SEQ ID NO: 43868 - protein, 5 aa, Mycobacterium avium
RPAAT

SEQ ID NO: 43869 - protein, 11 aa, Mycobacterium avium
RPADPSRIRSR

SEQ ID NO: 43870 - protein, 13 aa, Mycobacterium avium
RPAEHGPQDPGGV

SEQ ID NO: 43871 - protein, 8 aa, Mycobacterium avium
RPAGESPD

SEQ ID NO: 43872 - protein, 5 aa, Mycobacterium avium
RPAHY

SEQ ID NO: 43873 - protein, 13 aa, Mycobacterium avium
RPAPDPAAAPDKG

SEQ ID NO: 43874 - protein, 7 aa, Mycobacterium avium
RPAPLPG

SEQ ID NO: 43875 - protein, 10 aa, Mycobacterium avium
RPAPRPENVT

SEQ ID NO: 43876 - protein, 7 aa, Mycobacterium avium
RPAQTGA

SEQ ID NO: 43877 - protein, 9 aa, Mycobacterium avium
RPAREATGD

SEQ ID NO: 43878 - protein, 19 aa, Mycobacterium avium
RPARRAALSTDGDGQFGPA

SEQ ID NO: 43879 - protein, 5 aa, Mycobacterium avium
RPASR

SEQ ID NO: 43880 - protein, 11 aa, Mycobacterium avium
RPASRNAIDPA

SEQ ID NO: 43881 - protein, 4 aa, Mycobacterium avium
RPCT

SEQ ID NO: 43882 - protein, 4 aa, Mycobacterium avium
RPDA

SEQ ID NO: 43883 - protein, 14 aa, Mycobacterium avium
RPDAAGRRPIDDES

SEQ ID NO: 43884 - protein, 19 aa, Mycobacterium avium
RPDAASGRRGKPEPSPVAR

SEQ ID NO: 43885 - protein, 11 aa, Mycobacterium avium
RPDAPSPRQVE

SEQ ID NO: 43886 - protein, 9 aa, Mycobacterium avium
RPDATAEAF

SEQ ID NO: 43887 - protein, 17 aa, Mycobacterium avium
RPDDNGDESPDAAESLN

SEQ ID NO: 43888 - protein, 13 aa, Mycobacterium avium
RPDGATLVRPDPE

SEQ ID NO: 43889 - protein, 7 aa, Mycobacterium avium
RPDGDRY

SEQ ID NO: 43890 - protein, 7 aa, Mycobacterium avium
RPDGESR

SEQ ID NO: 43891 - protein, 9 aa, Mycobacterium avium
RPDGLGSNH

SEQ ID NO: 43892 - protein, 9 aa, Mycobacterium avium
RPDGQPQWP

SEQ ID NO: 43893 - protein, 11 aa, Mycobacterium avium
RPDGSPHAAGV

SEQ ID NO: 43894 - protein, 10 aa, Mycobacterium avium
RPDIPGAQDF

SEQ ID NO: 43895 - protein, 6 aa, Mycobacterium avium
RPDLDG

SEQ ID NO: 43896 - protein, 14 aa, Mycobacterium avium
RPDLPQPAAGDGSY

SEQ ID NO: 43897 - protein, 9 aa, Mycobacterium avium
RPDPDAAPV

SEQ ID NO: 43898 - protein, 25 aa, Mycobacterium avium
RPDPYKGKGVRYEGEQIRRKVGKTG

SEQ ID NO: 43899 - protein, 7 aa, Mycobacterium avium
RPDQRQR

SEQ ID NO: 43900 - protein, 10 aa, Mycobacterium avium
RPDRDPRSCT

SEQ ID NO: 43901 - protein, 7 aa, Mycobacterium avium
RPDRSTT

SEQ ID NO: 43902 - protein, 8 aa, Mycobacterium avium
RPDSLNSV

SEQ ID NO: 43903 - protein, 6 aa, Mycobacterium avium
RPDSPA

SEQ ID NO: 43904 - protein, 16 aa, Mycobacterium avium
RPDVAGPADANPSPMP

SEQ ID NO: 43905 - protein, 5 aa, Mycobacterium avium
RPEDA

SEQ ID NO: 43906 - protein, 5 aa, Mycobacterium avium
RPEEV

SEQ ID NO: 43907 - protein, 7 aa, Mycobacterium avium
RPEEVAA

SEQ ID NO: 43908 - protein, 7 aa, Mycobacterium avium
RPEEVTD

SEQ ID NO: 43909 - protein, 6 aa, Mycobacterium avium
RPEEYS

SEQ ID NO: 43910 - protein, 12 aa, Mycobacterium avium
RPEGNANPEIAT

SEQ ID NO: 43911 - protein, 7 aa, Mycobacterium avium
RPEMGRP

SEQ ID NO: 43912 - protein, 7 aa, Mycobacterium avium
RPEPKRA

SEQ ID NO: 43913 - protein, 5 aa, Mycobacterium avium
RPEQH

SEQ ID NO: 43914 - protein, 19 aa, Mycobacterium avium
RPEQYKPPADAKLNQPEDV

SEQ ID NO: 43915 - protein, 6 aa, Mycobacterium avium
RPERFA

SEQ ID NO: 43916 - protein, 7 aa, Mycobacterium avium
RPEVSGD

SEQ ID NO: 43917 - protein, 19 aa, Mycobacterium avium
RPEWRDDPRFADARARAAN

SEQ ID NO: 43918 - protein, 8 aa, Mycobacterium avium
RPFEPPPT

SEQ ID NO: 43919 - protein, 4 aa, Mycobacterium avium
RPFG

SEQ ID NO: 43920 - protein, 7 aa, Mycobacterium avium
RPGAQEE

SEQ ID NO: 43921 - protein, 8 aa, Mycobacterium avium
RPGASTGD

SEQ ID NO: 43922 - protein, 4 aa, Mycobacterium avium
RPGD

SEQ ID NO: 43923 - protein, 6 aa, Mycobacterium avium
RPGDEQ

SEQ ID NO: 43924 - protein, 9 aa, Mycobacterium avium
RPGDLSPGD

SEQ ID NO: 43925 - protein, 19 aa, Mycobacterium avium
RPGDTPPFQRGGMGDHSAG

SEQ ID NO: 43926 - protein, 13 aa, Mycobacterium avium
RPGEPPTKESAQT

SEQ ID NO: 43927 - protein, 17 aa, Mycobacterium avium
RPGEPSWPSPFGNGRPG

SEQ ID NO: 43928 - protein, 18 aa, Mycobacterium avium
RPGESDGSCGKGDPPAGN

SEQ ID NO: 43929 - protein, 17 aa, Mycobacterium avium
RPGGNGTRRRNGRDYDD

SEQ ID NO: 43930 - protein, 9 aa, Mycobacterium avium
RPGGTAEDD

SEQ ID NO: 43931 - protein, 5 aa, Mycobacterium avium
RPGGV

SEQ ID NO: 43932 - protein, 4 aa, Mycobacterium avium
RPGH

SEQ ID NO: 43933 - protein, 12 aa, Mycobacterium avium
RPGIGSSTPHRY

SEQ ID NO: 43934 - protein, 8 aa, Mycobacterium avium
RPGKFGGD

SEQ ID NO: 43935 - protein, 5 aa, Mycobacterium avium
RPGNQ

SEQ ID NO: 43936 - protein, 9 aa, Mycobacterium avium
RPGPEFRPS

SEQ ID NO: 43937 - protein, 13 aa, Mycobacterium avium
RPGPLRPADRRTT

SEQ ID NO: 43938 - protein, 4 aa, Mycobacterium avium
RPGQ

SEQ ID NO: 43939 - protein, 4 aa, Mycobacterium avium
RPGR

SEQ ID NO: 43940 - protein, 7 aa, Mycobacterium avium
RPGRFGS

SEQ ID NO: 43941 - protein, 6 aa, Mycobacterium avium
RPGTEG

SEQ ID NO: 43942 - protein, 7 aa, Mycobacterium avium
RPGTLTT

SEQ ID NO: 43943 - protein, 7 aa, Mycobacterium avium
RPGTRNG

SEQ ID NO: 43944 - protein, 7 aa, Mycobacterium avium
RPGTRYD

SEQ ID NO: 43945 - protein, 17 aa, Mycobacterium avium
RPGTVSRNGSPVSRLGR

SEQ ID NO: 43946 - protein, 7 aa, Mycobacterium avium
RPGYQPR

SEQ ID NO: 43947 - protein, 10 aa, Mycobacterium avium
RPHAPKGAQW

SEQ ID NO: 43948 - protein, 5 aa, Mycobacterium avium
RPHDI

SEQ ID NO: 43949 - protein, 4 aa, Mycobacterium avium
RPHE

SEQ ID NO: 43950 - protein, 8 aa, Mycobacterium avium
RPHPSYNP

SEQ ID NO: 43951 - protein, 6 aa, Mycobacterium avium
RPHSGT

SEQ ID NO: 43952 - protein, 9 aa, Mycobacterium avium
RPKAKNAVN

SEQ ID NO: 43953 - protein, 11 aa, Mycobacterium avium
RPKDEVSEEEY

SEQ ID NO: 43954 - protein, 30 aa, Mycobacterium avium
RPKDRPAVGRLTDGSKIAEANTGRYPTTEE

SEQ ID NO: 43955 - protein, 4 aa, Mycobacterium avium
RPLA

SEQ ID NO: 43956 - protein, 6 aa, Mycobacterium avium
RPLDKT

SEQ ID NO: 43957 - protein, 6 aa, Mycobacterium avium
RPLPGR

SEQ ID NO: 43958 - protein, 5 aa, Mycobacterium avium
RPLPL

SEQ ID NO: 43959 - protein, 12 aa, Mycobacterium avium
RPLPPRGTPEQL

SEQ ID NO: 43960 - protein, 5 aa, Mycobacterium avium
RPLRG

SEQ ID NO: 43961 - protein, 5 aa, Mycobacterium avium
RPLTG

SEQ ID NO: 43962 - protein, 20 aa, Mycobacterium avium
RPLTKKPAETRMGSGKGSPE

SEQ ID NO: 43963 - protein, 5 aa, Mycobacterium avium
RPMTR

SEQ ID NO: 43964 - protein, 5 aa, Mycobacterium avium
RPNAG

SEQ ID NO: 43965 - protein, 7 aa, Mycobacterium avium
RPNERAH

SEQ ID NO: 43966 - protein, 8 aa, Mycobacterium avium
RPNTAPTV

SEQ ID NO: 43967 - protein, 4 aa, Mycobacterium avium
RPNV

SEQ ID NO: 43968 - protein, 7 aa, Mycobacterium avium
RPNVGKS

SEQ ID NO: 43969 - protein, 5 aa, Mycobacterium avium
RPPAE

SEQ ID NO: 43970 - protein, 6 aa, Mycobacterium avium
RPPAGA

SEQ ID NO: 43971 - protein, 8 aa, Mycobacterium avium
RPPAPVPA

SEQ ID NO: 43972 - protein, 13 aa, Mycobacterium avium
RPPDTRAPSTPWP

SEQ ID NO: 43973 - protein, 8 aa, Mycobacterium avium
RPPEPKQI

SEQ ID NO: 43974 - protein, 9 aa, Mycobacterium avium
RPPGREAYP

SEQ ID NO: 43975 - protein, 7 aa, Mycobacterium avium
RPPGSDR

SEQ ID NO: 43976 - protein, 4 aa, Mycobacterium avium
RPPK

SEQ ID NO: 43977 - protein, 6 aa, Mycobacterium avium
RPPPTF

SEQ ID NO: 43978 - protein, 18 aa, Mycobacterium avium
RPPRYAPTQQRRTPEQTL

SEQ ID NO: 43979 - protein, 7 aa, Mycobacterium avium
RPPTNAL

SEQ ID NO: 43980 - protein, 4 aa, Mycobacterium avium
RPPV

SEQ ID NO: 43981 - protein, 5 aa, Mycobacterium avium
RPPVL

SEQ ID NO: 43982 - protein, 13 aa, Mycobacterium avium
RPQAELDESSRAA

SEQ ID NO: 43983 - protein, 7 aa, Mycobacterium avium
RPQAGRY

SEQ ID NO: 43984 - protein, 9 aa, Mycobacterium avium
RPQATASTF

SEQ ID NO: 43985 - protein, 18 aa, Mycobacterium avium
RPQEGRTATLSRTSRPDA

SEQ ID NO: 43986 - protein, 7 aa, Mycobacterium avium
RPQGVSG

SEQ ID NO: 43987 - protein, 4 aa, Mycobacterium avium
RPQH

SEQ ID NO: 43988 - protein, 6 aa, Mycobacterium avium
RPQVQE

SEQ ID NO: 43989 - protein, 16 aa, Mycobacterium avium
RPRAQSRGTATQLPQG

SEQ ID NO: 43990 - protein, 5 aa, Mycobacterium avium
RPRDE

SEQ ID NO: 43991 - protein, 4 aa, Mycobacterium avium
RPRE

SEQ ID NO: 43992 - protein, 9 aa, Mycobacterium avium
RPREGNRRR

SEQ ID NO: 43993 - protein, 6 aa, Mycobacterium avium
RPRGDG

SEQ ID NO: 43994 - protein, 9 aa, Mycobacterium avium
RPRGPGMER

SEQ ID NO: 43995 - protein, 6 aa, Mycobacterium avium
RPRGRP

SEQ ID NO: 43996 - protein, 16 aa, Mycobacterium avium
RPRGRPRKDGRRAGAA

SEQ ID NO: 43997 - protein, 7 aa, Mycobacterium avium
RPRGSTV

SEQ ID NO: 43998 - protein, 11 aa, Mycobacterium avium
RPRNPEHGDYA

SEQ ID NO: 43999 - protein, 15 aa, Mycobacterium avium
RPRRSLTGPPLDPEL

SEQ ID NO: 44000 - protein, 9 aa, Mycobacterium avium
RPRSSDDVG

SEQ ID NO: 44001 - protein, 4 aa, Mycobacterium avium
RPRT

SEQ ID NO: 44002 - protein, 10 aa, Mycobacterium avium
RPRTGQDPAV

SEQ ID NO: 44003 - protein, 7 aa, Mycobacterium avium
RPRTQSS

SEQ ID NO: 44004 - protein, 8 aa, Mycobacterium avium
RPRWSPRR

SEQ ID NO: 44005 - protein, 4 aa, Mycobacterium avium
RPSA

SEQ ID NO: 44006 - protein, 9 aa, Mycobacterium avium
RPSAGAAAA

SEQ ID NO: 44007 - protein, 6 aa, Mycobacterium avium
RPSDTA

SEQ ID NO: 44008 - protein, 8 aa, Mycobacterium avium
RPSGRGAD

SEQ ID NO: 44009 - protein, 7 aa, Mycobacterium avium
RPSGTED

SEQ ID NO: 44010 - protein, 4 aa, Mycobacterium avium
RPSM

SEQ ID NO: 44011 - protein, 15 aa, Mycobacterium avium
RPSNPASHRGKGWEP

SEQ ID NO: 44012 - protein, 11 aa, Mycobacterium avium
RPSPTSGTLGG

SEQ ID NO: 44013 - protein, 7 aa, Mycobacterium avium
RPSRLKG

SEQ ID NO: 44014 - protein, 9 aa, Mycobacterium avium
RPSRREPLT

SEQ ID NO: 44015 - protein, 10 aa, Mycobacterium avium
RPSSTKTTVT

SEQ ID NO: 44016 - protein, 8 aa, Mycobacterium avium
RPSWGEPY

SEQ ID NO: 44017 - protein, 5 aa, Mycobacterium avium
RPTAW

SEQ ID NO: 44018 - protein, 4 aa, Mycobacterium avium
RPTG

SEQ ID NO: 44019 - protein, 9 aa, Mycobacterium avium
RPTGDGSTL

SEQ ID NO: 44020 - protein, 7 aa, Mycobacterium avium
RPTGPRP

SEQ ID NO: 44021 - protein, 8 aa, Mycobacterium avium
RPTNVEGT

SEQ ID NO: 44022 - protein, 6 aa, Mycobacterium avium
RPTPGR

SEQ ID NO: 44023 - protein, 11 aa, Mycobacterium avium
RPTPNPAPADD

SEQ ID NO: 44024 - protein, 24 aa, Mycobacterium avium
RPTTKYETKAQDAGSAVTEFIWLR

SEQ ID NO: 44025 - protein, 24 aa, Mycobacterium avium
RPTYDDAARAQVQAAQSAKAFDSA

SEQ ID NO: 44026 - protein, 8 aa, Mycobacterium avium
RPVDGDGP

SEQ ID NO: 44027 - protein, 9 aa, Mycobacterium avium
RPVEPPPVA

SEQ ID NO: 44028 - protein, 13 aa, Mycobacterium avium
RPVPEDLSDEAVR

SEQ ID NO: 44029 - protein, 10 aa, Mycobacterium avium
RPVPSDPYTQ

SEQ ID NO: 44030 - protein, 6 aa, Mycobacterium avium
RPVRRP

SEQ ID NO: 44031 - protein, 13 aa, Mycobacterium avium
RPVTGDDRGELRA

SEQ ID NO: 44032 - protein, 5 aa, Mycobacterium avium
RPVTR

SEQ ID NO: 44033 - protein, 15 aa, Mycobacterium avium
RPWTERDRANLAGRT

SEQ ID NO: 44034 - protein, 18 aa, Mycobacterium avium
RPWTPASDSALAAGPGAH

SEQ ID NO: 44035 - protein, 4 aa, Mycobacterium avium
RPYA

SEQ ID NO: 44036 - protein, 5 aa, Mycobacterium avium
RPYDE

SEQ ID NO: 44037 - protein, 11 aa, Mycobacterium avium
RPYGAQGARLG

SEQ ID NO: 44038 - protein, 6 aa, Mycobacterium avium
RPYGVP

SEQ ID NO: 44039 - protein, 29 aa, Mycobacterium avium
RPYPEDRYPPADSAEVQPPDYLPDTPEVR

SEQ ID NO: 44040 - protein, 13 aa, Mycobacterium avium
RPYREPGQRSRDE

SEQ ID NO: 44041 - protein, 6 aa, Mycobacterium avium
RQADPG

SEQ ID NO: 44042 - protein, 4 aa, Mycobacterium avium
RQAL

SEQ ID NO: 44043 - protein, 23 aa, Mycobacterium avium
RQASGDLDEADMDADGQPPITAK

SEQ ID NO: 44044 - protein, 7 aa, Mycobacterium avium
RQASGQL

SEQ ID NO: 44045 - protein, 8 aa, Mycobacterium avium
RQASPGVK

SEQ ID NO: 44046 - protein, 5 aa, Mycobacterium avium
RQDAA

SEQ ID NO: 44047 - protein, 6 aa, Mycobacterium avium
RQDEIG

SEQ ID NO: 44048 - protein, 10 aa, Mycobacterium avium
RQDSEEEGSL

SEQ ID NO: 44049 - protein, 7 aa, Mycobacterium avium
RQFSGAA

SEQ ID NO: 44050 - protein, 6 aa, Mycobacterium avium
RQGATE

SEQ ID NO: 44051 - protein, 4 aa, Mycobacterium avium
RQGD

SEQ ID NO: 44052 - protein, 5 aa, Mycobacterium avium
RQGGG

SEQ ID NO: 44053 - protein, 8 aa, Mycobacterium avium
RQGGGVRE

SEQ ID NO: 44054 - protein, 16 aa, Mycobacterium avium
RQGNSDRRAPKAVKEY

SEQ ID NO: 44055 - protein, 7 aa, Mycobacterium avium
RQGPAGG

SEQ ID NO: 44056 - protein, 7 aa, Mycobacterium avium
RQGSMRD

SEQ ID NO: 44057 - protein, 8 aa, Mycobacterium avium
RQHGAAPQ

SEQ ID NO: 44058 - protein, 13 aa, Mycobacterium avium
RQISEAAGQGNNA

SEQ ID NO: 44059 - protein, 6 aa, Mycobacterium avium
RQKTNR

SEQ ID NO: 44060 - protein, 14 aa, Mycobacterium avium
RQLEREARTGKRTT

SEQ ID NO: 44061 - protein, 4 aa, Mycobacterium avium
RQLP

SEQ ID NO: 44062 - protein, 9 aa, Mycobacterium avium
RQLQPGERV

SEQ ID NO: 44063 - protein, 7 aa, Mycobacterium avium
RQMSGGG

SEQ ID NO: 44064 - protein, 5 aa, Mycobacterium avium
RQNPL

SEQ ID NO: 44065 - protein, 7 aa, Mycobacterium avium
RQPDGSA

SEQ ID NO: 44066 - protein, 7 aa, Mycobacterium avium
RQPGAGH

SEQ ID NO: 44067 - protein, 6 aa, Mycobacterium avium
RQPNPH

SEQ ID NO: 44068 - protein, 7 aa, Mycobacterium avium
RQPRSGE

SEQ ID NO: 44069 - protein, 5 aa, Mycobacterium avium
RQQAL

SEQ ID NO: 44070 - protein, 11 aa, Mycobacterium avium
RQQEVSSSVPV

SEQ ID NO: 44071 - protein, 8 aa, Mycobacterium avium
RQQLEAGD

SEQ ID NO: 44072 - protein, 5 aa, Mycobacterium avium
RQQRR

SEQ ID NO: 44073 - protein, 10 aa, Mycobacterium avium
RQRAEPTGPV

SEQ ID NO: 44074 - protein, 10 aa, Mycobacterium avium
RQRAGAESVR

SEQ ID NO: 44075 - protein, 6 aa, Mycobacterium avium
RQRDRV

SEQ ID NO: 44076 - protein, 9 aa, Mycobacterium avium
RQREATEEV

SEQ ID NO: 44077 - protein, 9 aa, Mycobacterium avium
RQREDRDRS

SEQ ID NO: 44078 - protein, 6 aa, Mycobacterium avium
RQREIA

SEQ ID NO: 44079 - protein, 6 aa, Mycobacterium avium
RQRQLA

SEQ ID NO: 44080 - protein, 7 aa, Mycobacterium avium
RQRREKT

SEQ ID NO: 44081 - protein, 8 aa, Mycobacterium avium
RQRRGQAG

SEQ ID NO: 44082 - protein, 12 aa, Mycobacterium avium
RQSAGGVELRGP

SEQ ID NO: 44083 - protein, 4 aa, Mycobacterium avium
RQSD

SEQ ID NO: 44084 - protein, 8 aa, Mycobacterium avium
RQSDDDVS

SEQ ID NO: 44085 - protein, 9 aa, Mycobacterium avium
RQSGEWKDG

SEQ ID NO: 44086 - protein, 6 aa, Mycobacterium avium
RQSPHN

SEQ ID NO: 44087 - protein, 9 aa, Mycobacterium avium
RQSSGKGQV

SEQ ID NO: 44088 - protein, 4 aa, Mycobacterium avium
RQSW

SEQ ID NO: 44089 - protein, 5 aa, Mycobacterium avium
RQTGD

SEQ ID NO: 44090 - protein, 6 aa, Mycobacterium avium
RQTIDE

SEQ ID NO: 44091 - protein, 7 aa, Mycobacterium avium
RQTPIED

SEQ ID NO: 44092 - protein, 12 aa, Mycobacterium avium
RQTSESVLPRLF

SEQ ID NO: 44093 - protein, 14 aa, Mycobacterium avium
RQVSEAAGQGNNAA

SEQ ID NO: 44094 - protein, 10 aa, Mycobacterium avium
RQWQGSPERF

SEQ ID NO: 44095 - protein, 6 aa, Mycobacterium avium
RRAAGA

SEQ ID NO: 44096 - protein, 6 aa, Mycobacterium avium
RRAAQR

SEQ ID NO: 44097 - protein, 6 aa, Mycobacterium avium
RRADPD

SEQ ID NO: 44098 - protein, 5 aa, Mycobacterium avium
RRAEP

SEQ ID NO: 44099 - protein, 13 aa, Mycobacterium avium
RRAEPRTAVPAGS

SEQ ID NO: 44100 - protein, 7 aa, Mycobacterium avium
RRAEPTD

SEQ ID NO: 44101 - protein, 8 aa, Mycobacterium avium
RRAEREPV

SEQ ID NO: 44102 - protein, 6 aa, Mycobacterium avium
RRAGGD

SEQ ID NO: 44103 - protein, 6 aa, Mycobacterium avium
RRAGVG

SEQ ID NO: 44104 - protein, 7 aa, Mycobacterium avium
RRAHPEI

SEQ ID NO: 44105 - protein, 4 aa, Mycobacterium avium
RRAL

SEQ ID NO: 44106 - protein, 11 aa, Mycobacterium avium
RRAPGEAAQRR

SEQ ID NO: 44107 - protein, 26 aa, Mycobacterium avium
RRARGPAKRTAKKTSRKAPAKKAAKR

SEQ ID NO: 44108 - protein, 14 aa, Mycobacterium avium
RRASKASKSNPDAR

SEQ ID NO: 44109 - protein, 6 aa, Mycobacterium avium
RRASRE

SEQ ID NO: 44110 - protein, 5 aa, Mycobacterium avium
RRATE

SEQ ID NO: 44111 - protein, 9 aa, Mycobacterium avium
RRATEQGVV

SEQ ID NO: 44112 - protein, 5 aa, Mycobacterium avium
RRATN

SEQ ID NO: 44113 - protein, 6 aa, Mycobacterium avium
RRATQD

SEQ ID NO: 44114 - protein, 7 aa, Mycobacterium avium
RRDARAP

SEQ ID NO: 44115 - protein, 11 aa, Mycobacterium avium
RRDDDDWGQAG

SEQ ID NO: 44116 - protein, 8 aa, Mycobacterium avium
RRDDGTPG

SEQ ID NO: 44117 - protein, 16 aa, Mycobacterium avium
RRDDKADGVLNGPTTE

SEQ ID NO: 44118 - protein, 5 aa, Mycobacterium avium
RRDEA

SEQ ID NO: 44119 - protein, 6 aa, Mycobacterium avium
RRDGDD

SEQ ID NO: 44120 - protein, 12 aa, Mycobacterium avium
RRDGDPRVTDDG

SEQ ID NO: 44121 - protein, 9 aa, Mycobacterium avium
RRDGSRNGV

SEQ ID NO: 44122 - protein, 5 aa, Mycobacterium avium
RRDGT

SEQ ID NO: 44123 - protein, 9 aa, Mycobacterium avium
RRDKATSNI

SEQ ID NO: 44124 - protein, 19 aa, Mycobacterium avium
RRDKPDPSTYIGSGKAAEL

SEQ ID NO: 44125 - protein, 10 aa, Mycobacterium avium
RRDPANPAEV

SEQ ID NO: 44126 - protein, 9 aa, Mycobacterium avium
RRDPNRPRA

SEQ ID NO: 44127 - protein, 16 aa, Mycobacterium avium
RRDPRSSVRGCSPSRP

SEQ ID NO: 44128 - protein, 5 aa, Mycobacterium avium
RRDRD

SEQ ID NO: 44129 - protein, 15 aa, Mycobacterium avium
RRDSTYQPGRRSSSW

SEQ ID NO: 44130 - protein, 7 aa, Mycobacterium avium
RRDTRQA

SEQ ID NO: 44131 - protein, 15 aa, Mycobacterium avium
RREEALEAGKDAMAR

SEQ ID NO: 44132 - protein, 6 aa, Mycobacterium avium
RREEDV

SEQ ID NO: 44133 - protein, 11 aa, Mycobacterium avium
RREKDDVTEVR

SEQ ID NO: 44134 - protein, 11 aa, Mycobacterium avium
RREPDPQDRRK

SEQ ID NO: 44135 - protein, 5 aa, Mycobacterium avium
RREPY

SEQ ID NO: 44136 - protein, 12 aa, Mycobacterium avium
RREQGRLPSDAP

SEQ ID NO: 44137 - protein, 10 aa, Mycobacterium avium
RREQSGAGAR

SEQ ID NO: 44138 - protein, 8 aa, Mycobacterium avium
RRERPRDD

SEQ ID NO: 44139 - protein, 18 aa, Mycobacterium avium
RRESDALASAAAAREAAA

SEQ ID NO: 44140 - protein, 8 aa, Mycobacterium avium
RRETEDSA

SEQ ID NO: 44141 - protein, 13 aa, Mycobacterium avium
RRFRGDDGRITEG

SEQ ID NO: 44142 - protein, 5 aa, Mycobacterium avium
RRGAI

SEQ ID NO: 44143 - protein, 5 aa, Mycobacterium avium
RRGAR

SEQ ID NO: 44144 - protein, 16 aa, Mycobacterium avium
RRGDERLGQGGIPTDR

SEQ ID NO: 44145 - protein, 5 aa, Mycobacterium avium
RRGEA

SEQ ID NO: 44146 - protein, 6 aa, Mycobacterium avium
RRGELG

SEQ ID NO: 44147 - protein, 6 aa, Mycobacterium avium
RRGGGI

SEQ ID NO: 44148 - protein, 10 aa, Mycobacterium avium
RRGGGPGPAI

SEQ ID NO: 44149 - protein, 9 aa, Mycobacterium avium
RRGGGPSLR

SEQ ID NO: 44150 - protein, 7 aa, Mycobacterium avium
RRGGLDG

SEQ ID NO: 44151 - protein, 16 aa, Mycobacterium avium
RRGGQHRKQPTSAARG

SEQ ID NO: 44152 - protein, 5 aa, Mycobacterium avium
RRGLD

SEQ ID NO: 44153 - protein, 5 aa, Mycobacterium avium
RRGLE

SEQ ID NO: 44154 - protein, 8 aa, Mycobacterium avium
RRGNRGGA

SEQ ID NO: 44155 - protein, 9 aa, Mycobacterium avium
RRGNRGHGA

SEQ ID NO: 44156 - protein, 7 aa, Mycobacterium avium
RRGPAGA

SEQ ID NO: 44157 - protein, 8 aa, Mycobacterium avium
RRGPAQSA

SEQ ID NO: 44158 - protein, 7 aa, Mycobacterium avium
RRGPGGG

SEQ ID NO: 44159 - protein, 9 aa, Mycobacterium avium
RRGPGGTDT

SEQ ID NO: 44160 - protein, 6 aa, Mycobacterium avium
RRGPNG

SEQ ID NO: 44161 - protein, 8 aa, Mycobacterium avium
RRGRDERR

SEQ ID NO: 44162 - protein, 9 aa, Mycobacterium avium
RRGRPEEQA

SEQ ID NO: 44163 - protein, 7 aa, Mycobacterium avium
RRGTREA

SEQ ID NO: 44164 - protein, 7 aa, Mycobacterium avium
RRGVGRR

SEQ ID NO: 44165 - protein, 9 aa, Mycobacterium avium
RRGWGSGGA

SEQ ID NO: 44166 - protein, 11 aa, Mycobacterium avium
RRHEAADQRRV

SEQ ID NO: 44167 - protein, 16 aa, Mycobacterium avium
RRHTPGGSSGGSAAAV

SEQ ID NO: 44168 - protein, 18 aa, Mycobacterium avium
RRIAEETAKAEGKPEQAL

SEQ ID NO: 44169 - protein, 18 aa, Mycobacterium avium
RRKAAAKGAGEDKKANVD

SEQ ID NO: 44170 - protein, 7 aa, Mycobacterium avium
RRKHGPA

SEQ ID NO: 44171 - protein, 9 aa, Mycobacterium avium
RRKPEPGLD

SEQ ID NO: 44172 - protein, 4 aa, Mycobacterium avium
RRKQ

SEQ ID NO: 44173 - protein, 9 aa, Mycobacterium avium
RRKSGNYTV

SEQ ID NO: 44174 - protein, 8 aa, Mycobacterium avium
RRKTAGTV

SEQ ID NO: 44175 - protein, 5 aa, Mycobacterium avium
RRLRQ

SEQ ID NO: 44176 - protein, 7 aa, Mycobacterium avium
RRLSRAG

SEQ ID NO: 44177 - protein, 8 aa, Mycobacterium avium
RRLTGAEP

SEQ ID NO: 44178 - protein, 16 aa, Mycobacterium avium
RRLTPSAEVLAHDLGQ

SEQ ID NO: 44179 - protein, 6 aa, Mycobacterium avium
RRMGSK

SEQ ID NO: 44180 - protein, 9 aa, Mycobacterium avium
RRNDDEPAE

SEQ ID NO: 44181 - protein, 8 aa, Mycobacterium avium
RRNGAQAP

SEQ ID NO: 44182 - protein, 6 aa, Mycobacterium avium
RRNPNS

SEQ ID NO: 44183 - protein, 11 aa, Mycobacterium avium
RRNRGASPARI

SEQ ID NO: 44184 - protein, 11 aa, Mycobacterium avium
RRNTAASEMEQ

SEQ ID NO: 44185 - protein, 9 aa, Mycobacterium avium
RRPAPSPPT

SEQ ID NO: 44186 - protein, 7 aa, Mycobacterium avium
RRPDAID

SEQ ID NO: 44187 - protein, 15 aa, Mycobacterium avium
RRPDAVTSYGDPGTG

SEQ ID NO: 44188 - protein, 7 aa, Mycobacterium avium
RRPDELA

SEQ ID NO: 44189 - protein, 11 aa, Mycobacterium avium
RRPDGSLQHPP

SEQ ID NO: 44190 - protein, 5 aa, Mycobacterium avium
RRPDM

SEQ ID NO: 44191 - protein, 5 aa, Mycobacterium avium
RRPEE

SEQ ID NO: 44192 - protein, 7 aa, Mycobacterium avium
RRPENAG

SEQ ID NO: 44193 - protein, 5 aa, Mycobacterium avium
RRPEQ

SEQ ID NO: 44194 - protein, 7 aa, Mycobacterium avium
RRPERRR

SEQ ID NO: 44195 - protein, 17 aa, Mycobacterium avium
RRPGATPSPTPSSARAY

SEQ ID NO: 44196 - protein, 8 aa, Mycobacterium avium
RRPGHTEA

SEQ ID NO: 44197 - protein, 16 aa, Mycobacterium avium
RRPGPAGELSDSLSEV

SEQ ID NO: 44198 - protein, 13 aa, Mycobacterium avium
RRPLPQDGNGSWA

SEQ ID NO: 44199 - protein, 8 aa, Mycobacterium avium
RRPPDGIQ

SEQ ID NO: 44200 - protein, 11 aa, Mycobacterium avium
RRPPGSVPPLT

SEQ ID NO: 44201 - protein, 8 aa, Mycobacterium avium
RRPPRPTP

SEQ ID NO: 44202 - protein, 16 aa, Mycobacterium avium
RRPRDLATKQAAASVG

SEQ ID NO: 44203 - protein, 8 aa, Mycobacterium avium
RRPSPDAE

SEQ ID NO: 44204 - protein, 8 aa, Mycobacterium avium
RRPTALER

SEQ ID NO: 44205 - protein, 7 aa, Mycobacterium avium
RRPTDAE

SEQ ID NO: 44206 - protein, 7 aa, Mycobacterium avium
RRPTDTE

SEQ ID NO: 44207 - protein, 17 aa, Mycobacterium avium
RRPTGPPSGSGAADRAG

SEQ ID NO: 44208 - protein, 9 aa, Mycobacterium avium
RRPTGPPWA

SEQ ID NO: 44209 - protein, 10 aa, Mycobacterium avium
RRQAKPGDFD

SEQ ID NO: 44210 - protein, 5 aa, Mycobacterium avium
RRQLG

SEQ ID NO: 44211 - protein, 7 aa, Mycobacterium avium
RRQTSLE

SEQ ID NO: 44212 - protein, 11 aa, Mycobacterium avium
RRRADPSGPPL

SEQ ID NO: 44213 - protein, 6 aa, Mycobacterium avium
RRRAER

SEQ ID NO: 44214 - protein, 12 aa, Mycobacterium avium
RRRAESTGATVT

SEQ ID NO: 44215 - protein, 7 aa, Mycobacterium avium
RRRAGNR

SEQ ID NO: 44216 - protein, 12 aa, Mycobacterium avium
RRRASGGPAEQT

SEQ ID NO: 44217 - protein, 7 aa, Mycobacterium avium
RRRDAAT

SEQ ID NO: 44218 - protein, 16 aa, Mycobacterium avium
RRRDPFDDPGIDREQL

SEQ ID NO: 44219 - protein, 8 aa, Mycobacterium avium
RRREAAAR

SEQ ID NO: 44220 - protein, 22 aa, Mycobacterium avium
RRRELTPPQRFGADPGDDEPPV

SEQ ID NO: 44221 - protein, 7 aa, Mycobacterium avium
RRREPRA

SEQ ID NO: 44222 - protein, 6 aa, Mycobacterium avium
RRRGEN

SEQ ID NO: 44223 - protein, 6 aa, Mycobacterium avium
RRRGIG

SEQ ID NO: 44224 - protein, 19 aa, Mycobacterium avium
RRRHSSVTNRGVRPDADGR

SEQ ID NO: 44225 - protein, 8 aa, Mycobacterium avium
RRRNPRDD

SEQ ID NO: 44226 - protein, 10 aa, Mycobacterium avium
RRRRDGATVR

SEQ ID NO: 44227 - protein, 10 aa, Mycobacterium avium
RRRRRGIAAP

SEQ ID NO: 44228 - protein, 6 aa, Mycobacterium avium
RRRRRP

SEQ ID NO: 44229 - protein, 7 aa, Mycobacterium avium
RRRRTTV

SEQ ID NO: 44230 - protein, 6 aa, Mycobacterium avium
RRRSGV

SEQ ID NO: 44231 - protein, 7 aa, Mycobacterium avium
RRRSPLD

SEQ ID NO: 44232 - protein, 10 aa, Mycobacterium avium
RRRSSPRAEL

SEQ ID NO: 44233 - protein, 13 aa, Mycobacterium avium
RRRTGARDNDFEA

SEQ ID NO: 44234 - protein, 7 aa, Mycobacterium avium
RRRTGEG

SEQ ID NO: 44235 - protein, 13 aa, Mycobacterium avium
RRRTPEITHLQGI

SEQ ID NO: 44236 - protein, 12 aa, Mycobacterium avium
RRRTRGQNRAAR

SEQ ID NO: 44237 - protein, 7 aa, Mycobacterium avium
RRRTRPV

SEQ ID NO: 44238 - protein, 7 aa, Mycobacterium avium
RRRTTDI

SEQ ID NO: 44239 - protein, 30 aa, Mycobacterium avium
RRRVSTGVRRRSVGAQRALGRAGNTMSDSE

SEQ ID NO: 44240 - protein, 14 aa, Mycobacterium avium
RRRYSGDQPNEGQW

SEQ ID NO: 44241 - protein, 7 aa, Mycobacterium avium
RRSAAAE

SEQ ID NO: 44242 - protein, 5 aa, Mycobacterium avium
RRSAQ

SEQ ID NO: 44243 - protein, 6 aa, Mycobacterium avium
RRSASV

SEQ ID NO: 44244 - protein, 9 aa, Mycobacterium avium
RRSDTGSMT

SEQ ID NO: 44245 - protein, 5 aa, Mycobacterium avium
RRSEP

SEQ ID NO: 44246 - protein, 7 aa, Mycobacterium avium
RRSGHDA

SEQ ID NO: 44247 - protein, 16 aa, Mycobacterium avium
RRSGLPDDSRQTPDDV

SEQ ID NO: 44248 - protein, 18 aa, Mycobacterium avium
RRSGPTTVGAHPSAQRSA

SEQ ID NO: 44249 - protein, 8 aa, Mycobacterium avium
RRSGQGRV

SEQ ID NO: 44250 - protein, 9 aa, Mycobacterium avium
RRSGQPAAA

SEQ ID NO: 44251 - protein, 7 aa, Mycobacterium avium
RRSGVGR

SEQ ID NO: 44252 - protein, 5 aa, Mycobacterium avium
RRSKS

SEQ ID NO: 44253 - protein, 5 aa, Mycobacterium avium
RRSRD

SEQ ID NO: 44254 - protein, 8 aa, Mycobacterium avium
RRSRPGDD

SEQ ID NO: 44255 - protein, 10 aa, Mycobacterium avium
RRSRTHRRTP

SEQ ID NO: 44256 - protein, 7 aa, Mycobacterium avium
RRSTAES

SEQ ID NO: 44257 - protein, 8 aa, Mycobacterium avium
RRTATAEK

SEQ ID NO: 44258 - protein, 6 aa, Mycobacterium avium
RRTERE

SEQ ID NO: 44259 - protein, 7 aa, Mycobacterium avium
RRTEVSQ

SEQ ID NO: 44260 - protein, 5 aa, Mycobacterium avium
RRTGA

SEQ ID NO: 44261 - protein, 14 aa, Mycobacterium avium
RRTGDPAGQIRMGE

SEQ ID NO: 44262 - protein, 6 aa, Mycobacterium avium
RRTGLN

SEQ ID NO: 44263 - protein, 7 aa, Mycobacterium avium
RRTHEQA

SEQ ID NO: 44264 - protein, 7 aa, Mycobacterium avium
RRTKNNP

SEQ ID NO: 44265 - protein, 16 aa, Mycobacterium avium
RRTPATEEGGEETVTR

SEQ ID NO: 44266 - protein, 9 aa, Mycobacterium avium
RRTPKSLPP

SEQ ID NO: 44267 - protein, 8 aa, Mycobacterium avium
RRTPPPPL

SEQ ID NO: 44268 - protein, 4 aa, Mycobacterium avium
RRTQ

SEQ ID NO: 44269 - protein, 5 aa, Mycobacterium avium
RRTRR

SEQ ID NO: 44270 - protein, 5 aa, Mycobacterium avium
RRTSI

SEQ ID NO: 44271 - protein, 10 aa, Mycobacterium avium
RRTTNPEGRE

SEQ ID NO: 44272 - protein, 5 aa, Mycobacterium avium
RRTVT

SEQ ID NO: 44273 - protein, 23 aa, Mycobacterium avium
RRVAEAPKTAGLPGTEGQHRTDF

SEQ ID NO: 44274 - protein, 12 aa, Mycobacterium avium
RRVAGDSADTEA

SEQ ID NO: 44275 - protein, 6 aa, Mycobacterium avium
RRVDGR

SEQ ID NO: 44276 - protein, 7 aa, Mycobacterium avium
RRVGGAT

SEQ ID NO: 44277 - protein, 9 aa, Mycobacterium avium
RRVGTDGAA

SEQ ID NO: 44278 - protein, 8 aa, Mycobacterium avium
RRVPPTRA

SEQ ID NO: 44279 - protein, 18 aa, Mycobacterium avium
RRYAEQRARAEGLADRDK

SEQ ID NO: 44280 - protein, 7 aa, Mycobacterium avium
RRYASDG

SEQ ID NO: 44281 - protein, 5 aa, Mycobacterium avium
RRYGD

SEQ ID NO: 44282 - protein, 6 aa, Mycobacterium avium
RRYQGR

SEQ ID NO: 44283 - protein, 4 aa, Mycobacterium avium
RRYR

SEQ ID NO: 44284 - protein, 12 aa, Mycobacterium avium
RRYRISGNKGDS

SEQ ID NO: 44285 - protein, 5 aa, Mycobacterium avium
RSAAE

SEQ ID NO: 44286 - protein, 8 aa, Mycobacterium avium
RSAAEEVS

SEQ ID NO: 44287 - protein, 9 aa, Mycobacterium avium
RSAEESGGR

SEQ ID NO: 44288 - protein, 11 aa, Mycobacterium avium
RSAEPPTAFTD

SEQ ID NO: 44289 - protein, 7 aa, Mycobacterium avium
RSAGAAG

SEQ ID NO: 44290 - protein, 14 aa, Mycobacterium avium
RSAGDTTAAAREVS

SEQ ID NO: 44291 - protein, 7 aa, Mycobacterium avium
RSAGEVR

SEQ ID NO: 44292 - protein, 9 aa, Mycobacterium avium
RSAGPPPVV

SEQ ID NO: 44293 - protein, 17 aa, Mycobacterium avium
RSAGRAFDPARLSESQS

SEQ ID NO: 44294 - protein, 10 aa, Mycobacterium avium
RSAGSIKKIT

SEQ ID NO: 44295 - protein, 8 aa, Mycobacterium avium
RSALQNAA

SEQ ID NO: 44296 - protein, 5 aa, Mycobacterium avium
RSANP

SEQ ID NO: 44297 - protein, 17 aa, Mycobacterium avium
RSAPKLPNIAGPNVAAP

SEQ ID NO: 44298 - protein, 6 aa, Mycobacterium avium
RSAREA

SEQ ID NO: 44299 - protein, 10 aa, Mycobacterium avium
RSAVTDSERE

SEQ ID NO: 44300 - protein, 4 aa, Mycobacterium avium
RSCE

SEQ ID NO: 44301 - protein, 6 aa, Mycobacterium avium
RSCPAQ

SEQ ID NO: 44302 - protein, 8 aa, Mycobacterium avium
RSCTGPDR

SEQ ID NO: 44303 - protein, 9 aa, Mycobacterium avium
RSDASRRIA

SEQ ID NO: 44304 - protein, 6 aa, Mycobacterium avium
RSDEDA

SEQ ID NO: 44305 - protein, 9 aa, Mycobacterium avium
RSDEEARAR

SEQ ID NO: 44306 - protein, 5 aa, Mycobacterium avium
RSDES

SEQ ID NO: 44307 - protein, 8 aa, Mycobacterium avium
RSDGASGV

SEQ ID NO: 44308 - protein, 10 aa, Mycobacterium avium
RSDKPSRIED

SEQ ID NO: 44309 - protein, 12 aa, Mycobacterium avium
RSDKPTRREDHS

SEQ ID NO: 44310 - protein, 15 aa, Mycobacterium avium
RSDPEFAYSDRERDG

SEQ ID NO: 44311 - protein, 9 aa, Mycobacterium avium
RSDSGASPF

SEQ ID NO: 44312 - protein, 10 aa, Mycobacterium avium
RSEAATRANA

SEQ ID NO: 44313 - protein, 6 aa, Mycobacterium avium
RSENAT

SEQ ID NO: 44314 - protein, 7 aa, Mycobacterium avium
RSETTSY

SEQ ID NO: 44315 - protein, 4 aa, Mycobacterium avium
RSFE

SEQ ID NO: 44316 - protein, 12 aa, Mycobacterium avium
RSFETREGEKRT

SEQ ID NO: 44317 - protein, 7 aa, Mycobacterium avium
RSGAKDQ

SEQ ID NO: 44318 - protein, 8 aa, Mycobacterium avium
RSGAPRGS

SEQ ID NO: 44319 - protein, 8 aa, Mycobacterium avium
RSGDDDEL

SEQ ID NO: 44320 - protein, 7 aa, Mycobacterium avium
RSGEPFP

SEQ ID NO: 44321 - protein, 10 aa, Mycobacterium avium
RSGETEDTTI

SEQ ID NO: 44322 - protein, 8 aa, Mycobacterium avium
RSGETVGR

SEQ ID NO: 44323 - protein, 15 aa, Mycobacterium avium
RSGGEQYAEENESYG

SEQ ID NO: 44324 - protein, 5 aa, Mycobacterium avium
RSGGF

SEQ ID NO: 44325 - protein, 9 aa, Mycobacterium avium
RSGGGSPHV

SEQ ID NO: 44326 - protein, 10 aa, Mycobacterium avium
RSGGNAARMD

SEQ ID NO: 44327 - protein, 13 aa, Mycobacterium avium
RSGNRTNPSSATM

SEQ ID NO: 44328 - protein, 4 aa, Mycobacterium avium
RSGQ

SEQ ID NO: 44329 - protein, 9 aa, Mycobacterium avium
RSGRMSDED

SEQ ID NO: 44330 - protein, 7 aa, Mycobacterium avium
RSGSGAL

SEQ ID NO: 44331 - protein, 8 aa, Mycobacterium avium
RSGSGKST

SEQ ID NO: 44332 - protein, 6 aa, Mycobacterium avium
RSGSPV

SEQ ID NO: 44333 - protein, 7 aa, Mycobacterium avium
RSHEGTM

SEQ ID NO: 44334 - protein, 5 aa, Mycobacterium avium
RSHPA

SEQ ID NO: 44335 - protein, 13 aa, Mycobacterium avium
RSHSEPHWDPDRG

SEQ ID NO: 44336 - protein, 7 aa, Mycobacterium avium
RSKENLD

SEQ ID NO: 44337 - protein, 16 aa, Mycobacterium avium
RSKGVARSPVQGGYGT

SEQ ID NO: 44338 - protein, 9 aa, Mycobacterium avium
RSKTQGRAN

SEQ ID NO: 44339 - protein, 6 aa, Mycobacterium avium
RSKTSL

SEQ ID NO: 44340 - protein, 7 aa, Mycobacterium avium
RSKYASG

SEQ ID NO: 44341 - protein, 4 aa, Mycobacterium avium
RSLG

SEQ ID NO: 44342 - protein, 5 aa, Mycobacterium avium
RSLNA

SEQ ID NO: 44343 - protein, 9 aa, Mycobacterium avium
RSLNPSGKA

SEQ ID NO: 44344 - protein, 5 aa, Mycobacterium avium
RSLPE

SEQ ID NO: 44345 - protein, 7 aa, Mycobacterium avium
RSLPEDE

SEQ ID NO: 44346 - protein, 10 aa, Mycobacterium avium
RSLPNSPTSA

SEQ ID NO: 44347 - protein, 4 aa, Mycobacterium avium
RSLQ

SEQ ID NO: 44348 - protein, 13 aa, Mycobacterium avium
RSLQGDKKARSVR

SEQ ID NO: 44349 - protein, 4 aa, Mycobacterium avium
RSLR

SEQ ID NO: 44350 - protein, 12 aa, Mycobacterium avium
RSMKESGTPIAD

SEQ ID NO: 44351 - protein, 8 aa, Mycobacterium avium
RSNDPDGE

SEQ ID NO: 44352 - protein, 15 aa, Mycobacterium avium
RSNHGTCANQSPIVD

SEQ ID NO: 44353 - protein, 4 aa, Mycobacterium avium
RSNT

SEQ ID NO: 44354 - protein, 7 aa, Mycobacterium avium
RSPAGKE

SEQ ID NO: 44355 - protein, 17 aa, Mycobacterium avium
RSPATSKALGQPAPPGH

SEQ ID NO: 44356 - protein, 7 aa, Mycobacterium avium
RSPDEFS

SEQ ID NO: 44357 - protein, 6 aa, Mycobacterium avium
RSPDGD

SEQ ID NO: 44358 - protein, 7 aa, Mycobacterium avium
RSPDGVR

SEQ ID NO: 44359 - protein, 5 aa, Mycobacterium avium
RSPFS

SEQ ID NO: 44360 - protein, 13 aa, Mycobacterium avium
RSPGGRQSRKPSR

SEQ ID NO: 44361 - protein, 12 aa, Mycobacterium avium
RSPGREQRREQL

SEQ ID NO: 44362 - protein, 7 aa, Mycobacterium avium
RSPRGAT

SEQ ID NO: 44363 - protein, 12 aa, Mycobacterium avium
RSPTSVPVLFDP

SEQ ID NO: 44364 - protein, 4 aa, Mycobacterium avium
RSQC

SEQ ID NO: 44365 - protein, 10 aa, Mycobacterium avium
RSQGERGITS

SEQ ID NO: 44366 - protein, 12 aa, Mycobacterium avium
RSQQKAAAAWSG

SEQ ID NO: 44367 - protein, 9 aa, Mycobacterium avium
RSQRENPDA

SEQ ID NO: 44368 - protein, 8 aa, Mycobacterium avium
RSQTKTAA

SEQ ID NO: 44369 - protein, 4 aa, Mycobacterium avium
RSRA

SEQ ID NO: 44370 - protein, 13 aa, Mycobacterium avium
RSRAEELKPGPAT

SEQ ID NO: 44371 - protein, 12 aa, Mycobacterium avium
RSREQAAQIGGY

SEQ ID NO: 44372 - protein, 21 aa, Mycobacterium avium
RSRGITGETVRPDGGFGLGTP

SEQ ID NO: 44373 - protein, 4 aa, Mycobacterium avium
RSRI

SEQ ID NO: 44374 - protein, 4 aa, Mycobacterium avium
RSRL

SEQ ID NO: 44375 - protein, 7 aa, Mycobacterium avium
RSRPALR

SEQ ID NO: 44376 - protein, 7 aa, Mycobacterium avium
RSRPPRY

SEQ ID NO: 44377 - protein, 9 aa, Mycobacterium avium
RSRPTRGEV

SEQ ID NO: 44378 - protein, 5 aa, Mycobacterium avium
RSRQS

SEQ ID NO: 44379 - protein, 11 aa, Mycobacterium avium
RSRRGGGHPMP

SEQ ID NO: 44380 - protein, 13 aa, Mycobacterium avium
RSRRRRRQPDLSP

SEQ ID NO: 44381 - protein, 4 aa, Mycobacterium avium
RSRS

SEQ ID NO: 44382 - protein, 17 aa, Mycobacterium avium
RSRSFAARAADVDVLCD

SEQ ID NO: 44383 - protein, 18 aa, Mycobacterium avium
RSSAERYADAELYAAARI

SEQ ID NO: 44384 - protein, 6 aa, Mycobacterium avium
RSSDEY

SEQ ID NO: 44385 - protein, 9 aa, Mycobacterium avium
RSSDTAELS

SEQ ID NO: 44386 - protein, 10 aa, Mycobacterium avium
RSSEAREKYD

SEQ ID NO: 44387 - protein, 6 aa, Mycobacterium avium
RSSEVA

SEQ ID NO: 44388 - protein, 16 aa, Mycobacterium avium
RSSGPGGQSVNTTDSA

SEQ ID NO: 44389 - protein, 6 aa, Mycobacterium avium
RSSGYA

SEQ ID NO: 44390 - protein, 9 aa, Mycobacterium avium
RSSKPERVA

SEQ ID NO: 44391 - protein, 6 aa, Mycobacterium avium
RSSPDI

SEQ ID NO: 44392 - protein, 7 aa, Mycobacterium avium
RSSVDDR

SEQ ID NO: 44393 - protein, 7 aa, Mycobacterium avium
RSTDELA

SEQ ID NO: 44394 - protein, 9 aa, Mycobacterium avium
RSTDLDRSH

SEQ ID NO: 44395 - protein, 12 aa, Mycobacterium avium
RSTEQVRELATL

SEQ ID NO: 44396 - protein, 5 aa, Mycobacterium avium
RSTGA

SEQ ID NO: 44397 - protein, 6 aa, Mycobacterium avium
RSTGDD

SEQ ID NO: 44398 - protein, 5 aa, Mycobacterium avium
RSTQE

SEQ ID NO: 44399 - protein, 14 aa, Mycobacterium avium
RSTQLGRDETLEDT

SEQ ID NO: 44400 - protein, 9 aa, Mycobacterium avium
RSVGPEPAE

SEQ ID NO: 44401 - protein, 4 aa, Mycobacterium avium
RSVT

SEQ ID NO: 44402 - protein, 7 aa, Mycobacterium avium
RSWTNPK

SEQ ID NO: 44403 - protein, 9 aa, Mycobacterium avium
RSYASGKPA

SEQ ID NO: 44404 - protein, 4 aa, Mycobacterium avium
RSYE

SEQ ID NO: 44405 - protein, 12 aa, Mycobacterium avium
RSYGTLSEGERK

SEQ ID NO: 44406 - protein, 9 aa, Mycobacterium avium
RSYSPELTD

SEQ ID NO: 44407 - protein, 9 aa, Mycobacterium avium
RTAATDGSL

SEQ ID NO: 44408 - protein, 7 aa, Mycobacterium avium
RTADGYA

SEQ ID NO: 44409 - protein, 5 aa, Mycobacterium avium
RTADS

SEQ ID NO: 44410 - protein, 8 aa, Mycobacterium avium
RTADSAGR

SEQ ID NO: 44411 - protein, 5 aa, Mycobacterium avium
RTAER

SEQ ID NO: 44412 - protein, 4 aa, Mycobacterium avium
RTAG

SEQ ID NO: 44413 - protein, 6 aa, Mycobacterium avium
RTAGGR

SEQ ID NO: 44414 - protein, 9 aa, Mycobacterium avium
RTAKDSRAF

SEQ ID NO: 44415 - protein, 6 aa, Mycobacterium avium
RTAPDD

SEQ ID NO: 44416 - protein, 13 aa, Mycobacterium avium
RTAPGHPERPDRY

SEQ ID NO: 44417 - protein, 9 aa, Mycobacterium avium
RTAPPEPSS

SEQ ID NO: 44418 - protein, 7 aa, Mycobacterium avium
RTAPPYV

SEQ ID NO: 44419 - protein, 15 aa, Mycobacterium avium
RTAPTPQGPWSPEQP

SEQ ID NO: 44420 - protein, 4 aa, Mycobacterium avium
RTAQ

SEQ ID NO: 44421 - protein, 11 aa, Mycobacterium avium
RTAQQHGQHGE

SEQ ID NO: 44422 - protein, 6 aa, Mycobacterium avium
RTARGG

SEQ ID NO: 44423 - protein, 19 aa, Mycobacterium avium
RTASPDAIPGAGFTPGNEN

SEQ ID NO: 44424 - protein, 6 aa, Mycobacterium avium
RTASSV

SEQ ID NO: 44425 - protein, 7 aa, Mycobacterium avium
RTATAGR

SEQ ID NO: 44426 - protein, 5 aa, Mycobacterium avium
RTATQ

SEQ ID NO: 44427 - protein, 20 aa, Mycobacterium avium
RTATVTTAQPLTGWTGDTEA

SEQ ID NO: 44428 - protein, 4 aa, Mycobacterium avium
RTAV

SEQ ID NO: 44429 - protein, 8 aa, Mycobacterium avium
RTDDGGTV

SEQ ID NO: 44430 - protein, 9 aa, Mycobacterium avium
RTDGDKAAG

SEQ ID NO: 44431 - protein, 6 aa, Mycobacterium avium
RTDGPV

SEQ ID NO: 44432 - protein, 10 aa, Mycobacterium avium
RTDPQAGKHR

SEQ ID NO: 44433 - protein, 6 aa, Mycobacterium avium
RTDPRV

SEQ ID NO: 44434 - protein, 6 aa, Mycobacterium avium
RTDRGD

SEQ ID NO: 44435 - protein, 9 aa, Mycobacterium avium
RTDSRWPKY

SEQ ID NO: 44436 - protein, 18 aa, Mycobacterium avium
RTDSSDKVEALDAGADDY

SEQ ID NO: 44437 - protein, 8 aa, Mycobacterium avium
RTDTGESV

SEQ ID NO: 44438 - protein, 6 aa, Mycobacterium avium
RTEAGE

SEQ ID NO: 44439 - protein, 8 aa, Mycobacterium avium
RTEAPRGT

SEQ ID NO: 44440 - protein, 11 aa, Mycobacterium avium
RTEEEADAGGN

SEQ ID NO: 44441 - protein, 6 aa, Mycobacterium avium
RTEESR

SEQ ID NO: 44442 - protein, 15 aa, Mycobacterium avium
RTEETGDADRPDSWR

SEQ ID NO: 44443 - protein, 13 aa, Mycobacterium avium
RTEGFSPKTQHEA

SEQ ID NO: 44444 - protein, 7 aa, Mycobacterium avium
RTEPHRR

SEQ ID NO: 44445 - protein, 11 aa, Mycobacterium avium
RTEPPHQGSRY

SEQ ID NO: 44446 - protein, 9 aa, Mycobacterium avium
RTEQQPPLS

SEQ ID NO: 44447 - protein, 6 aa, Mycobacterium avium
RTESQL

SEQ ID NO: 44448 - protein, 4 aa, Mycobacterium avium
RTET

SEQ ID NO: 44449 - protein, 10 aa, Mycobacterium avium
RTFRPARRRP

SEQ ID NO: 44450 - protein, 7 aa, Mycobacterium avium
RTGDEIH

SEQ ID NO: 44451 - protein, 8 aa, Mycobacterium avium
RTGEAPEQ

SEQ ID NO: 44452 - protein, 4 aa, Mycobacterium avium
RTGF

SEQ ID NO: 44453 - protein, 7 aa, Mycobacterium avium
RTGGNPL

SEQ ID NO: 44454 - protein, 9 aa, Mycobacterium avium
RTGGPGAAG

SEQ ID NO: 44455 - protein, 4 aa, Mycobacterium avium
RTGI

SEQ ID NO: 44456 - protein, 7 aa, Mycobacterium avium
RTGKIGD

SEQ ID NO: 44457 - protein, 5 aa, Mycobacterium avium
RTGKP

SEQ ID NO: 44458 - protein, 5 aa, Mycobacterium avium
RTGLP

SEQ ID NO: 44459 - protein, 4 aa, Mycobacterium avium
RTGP

SEQ ID NO: 44460 - protein, 13 aa, Mycobacterium avium
RTGPETSTGPLGT

SEQ ID NO: 44461 - protein, 10 aa, Mycobacterium avium
RTGRAGKAGV

SEQ ID NO: 44462 - protein, 10 aa, Mycobacterium avium
RTGRAGRSGT

SEQ ID NO: 44463 - protein, 7 aa, Mycobacterium avium
RTGRSYG

SEQ ID NO: 44464 - protein, 10 aa, Mycobacterium avium
RTGRTTSPHL

SEQ ID NO: 44465 - protein, 18 aa, Mycobacterium avium
RTGSLNKAQSVANEDGSY

SEQ ID NO: 44466 - protein, 7 aa, Mycobacterium avium
RTGTARV

SEQ ID NO: 44467 - protein, 12 aa, Mycobacterium avium
RTGVDRGAQAPP

SEQ ID NO: 44468 - protein, 4 aa, Mycobacterium avium
RTHA

SEQ ID NO: 44469 - protein, 15 aa, Mycobacterium avium
RTHGTGSSVGAGATV

SEQ ID NO: 44470 - protein, 16 aa, Mycobacterium avium
RTHPGQGGLPVGSSGR

SEQ ID NO: 44471 - protein, 7 aa, Mycobacterium avium
RTHPGTT

SEQ ID NO: 44472 - protein, 12 aa, Mycobacterium avium
RTHQAPPVPGAV

SEQ ID NO: 44473 - protein, 8 aa, Mycobacterium avium
RTIKGEQK

SEQ ID NO: 44474 - protein, 13 aa, Mycobacterium avium
RTITPDGPDASDA

SEQ ID NO: 44475 - protein, 10 aa, Mycobacterium avium
RTKAEAGDTD

SEQ ID NO: 44476 - protein, 12 aa, Mycobacterium avium
RTKEEGAPLSGR

SEQ ID NO: 44477 - protein, 6 aa, Mycobacterium avium
RTKNPI

SEQ ID NO: 44478 - protein, 10 aa, Mycobacterium avium
RTKPEDDAES

SEQ ID NO: 44479 - protein, 9 aa, Mycobacterium avium
RTKRPPAFP

SEQ ID NO: 44480 - protein, 8 aa, Mycobacterium avium
RTLSEETT

SEQ ID NO: 44481 - protein, 8 aa, Mycobacterium avium
RTNDQGQG

SEQ ID NO: 44482 - protein, 4 aa, Mycobacterium avium
RTNN

SEQ ID NO: 44483 - protein, 5 aa, Mycobacterium avium
RTNNN

SEQ ID NO: 44484 - protein, 5 aa, Mycobacterium avium
RTNPV

SEQ ID NO: 44485 - protein, 12 aa, Mycobacterium avium
RTPAESASAAAD

SEQ ID NO: 44486 - protein, 7 aa, Mycobacterium avium
RTPAPVR

SEQ ID NO: 44487 - protein, 9 aa, Mycobacterium avium
RTPAQPPEI

SEQ ID NO: 44488 - protein, 5 aa, Mycobacterium avium
RTPDG

SEQ ID NO: 44489 - protein, 7 aa, Mycobacterium avium
RTPEGKT

SEQ ID NO: 44490 - protein, 8 aa, Mycobacterium avium
RTPEGRID

SEQ ID NO: 44491 - protein, 14 aa, Mycobacterium avium
RTPEKPINGSIAPT

SEQ ID NO: 44492 - protein, 9 aa, Mycobacterium avium
RTPEQDGYS

SEQ ID NO: 44493 - protein, 7 aa, Mycobacterium avium
RTPGAVP

SEQ ID NO: 44494 - protein, 6 aa, Mycobacterium avium
RTPGGA

SEQ ID NO: 44495 - protein, 6 aa, Mycobacterium avium
RTPGRG

SEQ ID NO: 44496 - protein, 7 aa, Mycobacterium avium
RTPGRPD

SEQ ID NO: 44497 - protein, 7 aa, Mycobacterium avium
RTPGSDF

SEQ ID NO: 44498 - protein, 6 aa, Mycobacterium avium
RTPNPH

SEQ ID NO: 44499 - protein, 8 aa, Mycobacterium avium
RTPPGAAD

SEQ ID NO: 44500 - protein, 8 aa, Mycobacterium avium
RTPRGRVA

SEQ ID NO: 44501 - protein, 12 aa, Mycobacterium avium
RTPRRADAVPAD

SEQ ID NO: 44502 - protein, 6 aa, Mycobacterium avium
RTPRVT

SEQ ID NO: 44503 - protein, 4 aa, Mycobacterium avium
RTPS

SEQ ID NO: 44504 - protein, 5 aa, Mycobacterium avium
RTPSE

SEQ ID NO: 44505 - protein, 7 aa, Mycobacterium avium
RTPSGVE

SEQ ID NO: 44506 - protein, 12 aa, Mycobacterium avium
RTPVPDTGYRAP

SEQ ID NO: 44507 - protein, 14 aa, Mycobacterium avium
RTPYSSAPDVRGHR

SEQ ID NO: 44508 - protein, 9 aa, Mycobacterium avium
RTQRPDGSW

SEQ ID NO: 44509 - protein, 5 aa, Mycobacterium avium
RTQTA

SEQ ID NO: 44510 - protein, 4 aa, Mycobacterium avium
RTRA

SEQ ID NO: 44511 - protein, 5 aa, Mycobacterium avium
RTRAE

SEQ ID NO: 44512 - protein, 5 aa, Mycobacterium avium
RTRDG

SEQ ID NO: 44513 - protein, 4 aa, Mycobacterium avium
RTRE

SEQ ID NO: 44514 - protein, 5 aa, Mycobacterium avium
RTREA

SEQ ID NO: 44515 - protein, 6 aa, Mycobacterium avium
RTREAL

SEQ ID NO: 44516 - protein, 19 aa, Mycobacterium avium
RTREANDDHMAEEEREGLS

SEQ ID NO: 44517 - protein, 9 aa, Mycobacterium avium
RTRPAHESA

SEQ ID NO: 44518 - protein, 5 aa, Mycobacterium avium
RTRPD

SEQ ID NO: 44519 - protein, 5 aa, Mycobacterium avium
RTRQP

SEQ ID NO: 44520 - protein, 7 aa, Mycobacterium avium
RTRSEDI

SEQ ID NO: 44521 - protein, 6 aa, Mycobacterium avium
RTRSNE

SEQ ID NO: 44522 - protein, 13 aa, Mycobacterium avium
RTRTDGRRVGGRS

SEQ ID NO: 44523 - protein, 7 aa, Mycobacterium avium
RTRTPVR

SEQ ID NO: 44524 - protein, 6 aa, Mycobacterium avium
RTRTRG

SEQ ID NO: 44525 - protein, 8 aa, Mycobacterium avium
RTSDGSVK

SEQ ID NO: 44526 - protein, 6 aa, Mycobacterium avium
RTSDPD

SEQ ID NO: 44527 - protein, 5 aa, Mycobacterium avium
RTSGR

SEQ ID NO: 44528 - protein, 6 aa, Mycobacterium avium
RTTADL

SEQ ID NO: 44529 - protein, 7 aa, Mycobacterium avium
RTTATSI

SEQ ID NO: 44530 - protein, 7 aa, Mycobacterium avium
RTTEACG

SEQ ID NO: 44531 - protein, 5 aa, Mycobacterium avium
RTTHP

SEQ ID NO: 44532 - protein, 17 aa, Mycobacterium avium
RTTSGGAALKNDSPIRE

SEQ ID NO: 44533 - protein, 8 aa, Mycobacterium avium
RTTTEEVE

SEQ ID NO: 44534 - protein, 4 aa, Mycobacterium avium
RTVA

SEQ ID NO: 44535 - protein, 8 aa, Mycobacterium avium
RTVADPDS

SEQ ID NO: 44536 - protein, 8 aa, Mycobacterium avium
RTVAPGRE

SEQ ID NO: 44537 - protein, 13 aa, Mycobacterium avium
RTVKSADKSGREA

SEQ ID NO: 44538 - protein, 14 aa, Mycobacterium avium
RTVPPGAVPTPSGW

SEQ ID NO: 44539 - protein, 13 aa, Mycobacterium avium
RTVYADGAEPGYL

SEQ ID NO: 44540 - protein, 4 aa, Mycobacterium avium
RTWP

SEQ ID NO: 44541 - protein, 5 aa, Mycobacterium avium
RTYTA

SEQ ID NO: 44542 - protein, 5 aa, Mycobacterium avium
RVAGS

SEQ ID NO: 44543 - protein, 10 aa, Mycobacterium avium
RVASASDAQE

SEQ ID NO: 44544 - protein, 7 aa, Mycobacterium avium
RVASPDQ

SEQ ID NO: 44545 - protein, 6 aa, Mycobacterium avium
RVATAD

SEQ ID NO: 44546 - protein, 4 aa, Mycobacterium avium
RVDD

SEQ ID NO: 44547 - protein, 9 aa, Mycobacterium avium
RVDGEPLSD

SEQ ID NO: 44548 - protein, 6 aa, Mycobacterium avium
RVEPGE

SEQ ID NO: 44549 - protein, 4 aa, Mycobacterium avium
RVGG

SEQ ID NO: 44550 - protein, 6 aa, Mycobacterium avium
RVGGAA

SEQ ID NO: 44551 - protein, 13 aa, Mycobacterium avium
RVGGGDPAGNPTL

SEQ ID NO: 44552 - protein, 9 aa, Mycobacterium avium
RVGPSTGTN

SEQ ID NO: 44553 - protein, 10 aa, Mycobacterium avium
RVKEKEPSIG

SEQ ID NO: 44554 - protein, 20 aa, Mycobacterium avium
RVKRRDRQSGVGLQPHKRTG

SEQ ID NO: 44555 - protein, 12 aa, Mycobacterium avium
RVLPNDGTAVGE

SEQ ID NO: 44556 - protein, 8 aa, Mycobacterium avium
RVNKNGMP

SEQ ID NO: 44557 - protein, 5 aa, Mycobacterium avium
RVNPD

SEQ ID NO: 44558 - protein, 7 aa, Mycobacterium avium
RVNPGGR

SEQ ID NO: 44559 - protein, 5 aa, Mycobacterium avium
RVNPL

SEQ ID NO: 44560 - protein, 12 aa, Mycobacterium avium
RVPARSGRQHEQ

SEQ ID NO: 44561 - protein, 8 aa, Mycobacterium avium
RVPDRKGF

SEQ ID NO: 44562 - protein, 22 aa, Mycobacterium avium
RVPEEQARAEAAEGYDRNYYPQ

SEQ ID NO: 44563 - protein, 6 aa, Mycobacterium avium
RVPEPG

SEQ ID NO: 44564 - protein, 16 aa, Mycobacterium avium
RVPERQPHAKGAGAYG

SEQ ID NO: 44565 - protein, 16 aa, Mycobacterium avium
RVPGGRVGASYGPGHE

SEQ ID NO: 44566 - protein, 14 aa, Mycobacterium avium
RVPPGSQQTSTQTT

SEQ ID NO: 44567 - protein, 8 aa, Mycobacterium avium
RVPPPGPL

SEQ ID NO: 44568 - protein, 7 aa, Mycobacterium avium
RVPPQRR

SEQ ID NO: 44569 - protein, 6 aa, Mycobacterium avium
RVPSAR

SEQ ID NO: 44570 - protein, 12 aa, Mycobacterium avium
RVPSEREREQLR

SEQ ID NO: 44571 - protein, 4 aa, Mycobacterium avium
RVPY

SEQ ID NO: 44572 - protein, 6 aa, Mycobacterium avium
RVQGAD

SEQ ID NO: 44573 - protein, 16 aa, Mycobacterium avium
RVQGSDSFRDLIEPRH

SEQ ID NO: 44574 - protein, 9 aa, Mycobacterium avium
RVQNNGQSC

SEQ ID NO: 44575 - protein, 5 aa, Mycobacterium avium
RVRGQ

SEQ ID NO: 44576 - protein, 5 aa, Mycobacterium avium
RVRPG

SEQ ID NO: 44577 - protein, 10 aa, Mycobacterium avium
RVRRDNTGYD

SEQ ID NO: 44578 - protein, 7 aa, Mycobacterium avium
RVSGTTL

SEQ ID NO: 44579 - protein, 8 aa, Mycobacterium avium
RVSKNDPR

SEQ ID NO: 44580 - protein, 15 aa, Mycobacterium avium
RVSRSSALASKATGF

SEQ ID NO: 44581 - protein, 5 aa, Mycobacterium avium
RVSRT

SEQ ID NO: 44582 - protein, 6 aa, Mycobacterium avium
RVSSGD

SEQ ID NO: 44583 - protein, 5 aa, Mycobacterium avium
RVSTA

SEQ ID NO: 44584 - protein, 8 aa, Mycobacterium avium
RVSTAEEF

SEQ ID NO: 44585 - protein, 15 aa, Mycobacterium avium
RVTDPATNGSSAGTV

SEQ ID NO: 44586 - protein, 6 aa, Mycobacterium avium
RVTPDA

SEQ ID NO: 44587 - protein, 4 aa, Mycobacterium avium
RVTR

SEQ ID NO: 44588 - protein, 6 aa, Mycobacterium avium
RVVPPD

SEQ ID NO: 44589 - protein, 4 aa, Mycobacterium avium
RWAG

SEQ ID NO: 44590 - protein, 6 aa, Mycobacterium avium
RWDPGK

SEQ ID NO: 44591 - protein, 12 aa, Mycobacterium avium
RWDSESGQVVRT

SEQ ID NO: 44592 - protein, 8 aa, Mycobacterium avium
RWGGDNTD

SEQ ID NO: 44593 - protein, 4 aa, Mycobacterium avium
RWGS

SEQ ID NO: 44594 - protein, 7 aa, Mycobacterium avium
RWPNGVD

SEQ ID NO: 44595 - protein, 12 aa, Mycobacterium avium
RWPQDPASHAYD

SEQ ID NO: 44596 - protein, 5 aa, Mycobacterium avium
RWPRA

SEQ ID NO: 44597 - protein, 8 aa, Mycobacterium avium
RYANPDVT

SEQ ID NO: 44598 - protein, 6 aa, Mycobacterium avium
RYARAN

SEQ ID NO: 44599 - protein, 5 aa, Mycobacterium avium
RYDAP

SEQ ID NO: 44600 - protein, 5 aa, Mycobacterium avium
RYDEM

SEQ ID NO: 44601 - protein, 9 aa, Mycobacterium avium
RYDRDGDQH

SEQ ID NO: 44602 - protein, 8 aa, Mycobacterium avium
RYGGTPSA

SEQ ID NO: 44603 - protein, 7 aa, Mycobacterium avium
RYGRTRS

SEQ ID NO: 44604 - protein, 9 aa, Mycobacterium avium
RYGSDKPDL

SEQ ID NO: 44605 - protein, 7 aa, Mycobacterium avium
RYPDERD

SEQ ID NO: 44606 - protein, 5 aa, Mycobacterium avium
RYPDG

SEQ ID NO: 44607 - protein, 7 aa, Mycobacterium avium
RYPDKRS

SEQ ID NO: 44608 - protein, 5 aa, Mycobacterium avium
RYPDR

SEQ ID NO: 44609 - protein, 4 aa, Mycobacterium avium
RYPE

SEQ ID NO: 44610 - protein, 23 aa, Mycobacterium avium
RYPGDDDVHRAQDAAAERHGRRR

SEQ ID NO: 44611 - protein, 6 aa, Mycobacterium avium
RYPPRQ

SEQ ID NO: 44612 - protein, 6 aa, Mycobacterium avium
RYQKGQ

SEQ ID NO: 44613 - protein, 8 aa, Mycobacterium avium
RYRQGSSA

SEQ ID NO: 44614 - protein, 8 aa, Mycobacterium avium
RYSNTGEG

SEQ ID NO: 44615 - protein, 5 aa, Mycobacterium avium
RYSQG

SEQ ID NO: 44616 - protein, 4 aa, Mycobacterium avium
RYTE

SEQ ID NO: 44617 - protein, 5 aa, Mycobacterium avium
RYTGR

SEQ ID NO: 44618 - protein, 6 aa, Mycobacterium avium
RYTGRG

SEQ ID NO: 44619 - protein, 11 aa, Mycobacterium avium
RYTKDQPETSA

SEQ ID NO: 44620 - protein, 5 aa, Mycobacterium avium
RYTQG

SEQ ID NO: 44621 - protein, 10 aa, Mycobacterium avium
RYTSKGPSGL

SEQ ID NO: 44622 - protein, 6 aa, Mycobacterium avium
SAAAAF

SEQ ID NO: 44623 - protein, 7 aa, Mycobacterium avium
SAAADGA

SEQ ID NO: 44624 - protein, 16 aa, Mycobacterium avium
SAAAEGARQSRSAKQQ

SEQ ID NO: 44625 - protein, 5 aa, Mycobacterium avium
SAAAL

SEQ ID NO: 44626 - protein, 5 aa, Mycobacterium avium
SAAAP

SEQ ID NO: 44627 - protein, 20 aa, Mycobacterium avium
SAAAPADNAPRIGEMPDDPR

SEQ ID NO: 44628 - protein, 7 aa, Mycobacterium avium
SAAATAA

SEQ ID NO: 44629 - protein, 8 aa, Mycobacterium avium
SAADDLTA

SEQ ID NO: 44630 - protein, 8 aa, Mycobacterium avium
SAADPDNF

SEQ ID NO: 44631 - protein, 8 aa, Mycobacterium avium
SAADRQSD

SEQ ID NO: 44632 - protein, 4 aa, Mycobacterium avium
SAAE

SEQ ID NO: 44633 - protein, 12 aa, Mycobacterium avium
SAAEGVSRSPLG

SEQ ID NO: 44634 - protein, 9 aa, Mycobacterium avium
SAAETGSHD

SEQ ID NO: 44635 - protein, 15 aa, Mycobacterium avium
SAAETLAETASRVGG

SEQ ID NO: 44636 - protein, 5 aa, Mycobacterium avium
SAAGD

SEQ ID NO: 44637 - protein, 12 aa, Mycobacterium avium
SAAGEPDESSLG

SEQ ID NO: 44638 - protein, 12 aa, Mycobacterium avium
SAAGGEKADPAT

SEQ ID NO: 44639 - protein, 13 aa, Mycobacterium avium
SAAGGVSTPSNQD

SEQ ID NO: 44640 - protein, 24 aa, Mycobacterium avium
SAAGNGNAVVTPSGAGIHEVDVKI

SEQ ID NO: 44641 - protein, 6 aa, Mycobacterium avium
SAAGSQ

SEQ ID NO: 44642 - protein, 19 aa, Mycobacterium avium
SAAGSYRNTDKRGGANGGR

SEQ ID NO: 44643 - protein, 5 aa, Mycobacterium avium
SAAGW

SEQ ID NO: 44644 - protein, 6 aa, Mycobacterium avium
SAANPR

SEQ ID NO: 44645 - protein, 12 aa, Mycobacterium avium
SAAPALPGPGAE

SEQ ID NO: 44646 - protein, 10 aa, Mycobacterium avium
SAARARGGRT

SEQ ID NO: 44647 - protein, 13 aa, Mycobacterium avium
SAARVTRANDEGL

SEQ ID NO: 44648 - protein, 8 aa, Mycobacterium avium
SAASEVDQ

SEQ ID NO: 44649 - protein, 15 aa, Mycobacterium avium
SAASPLATGAGQPPM

SEQ ID NO: 44650 - protein, 12 aa, Mycobacterium avium
SAASPLPAAESG

SEQ ID NO: 44651 - protein, 9 aa, Mycobacterium avium
SAATGGPFT

SEQ ID NO: 44652 - protein, 6 aa, Mycobacterium avium
SAATRD

SEQ ID NO: 44653 - protein, 5 aa, Mycobacterium avium
SACGK

SEQ ID NO: 44654 - protein, 9 aa, Mycobacterium avium
SACTDGGQG

SEQ ID NO: 44655 - protein, 9 aa, Mycobacterium avium
SADAARQPE

SEQ ID NO: 44656 - protein, 14 aa, Mycobacterium avium
SADAPDADGPGNVR

SEQ ID NO: 44657 - protein, 6 aa, Mycobacterium avium
SADDFE

SEQ ID NO: 44658 - protein, 10 aa, Mycobacterium avium
SADDMETGDG

SEQ ID NO: 44659 - protein, 9 aa, Mycobacterium avium
SADDTAADR

SEQ ID NO: 44660 - protein, 9 aa, Mycobacterium avium
SADGHTETM

SEQ ID NO: 44661 - protein, 9 aa, Mycobacterium avium
SADGLTPRK

SEQ ID NO: 44662 - protein, 16 aa, Mycobacterium avium
SADGVADEQRRDDLES

SEQ ID NO: 44663 - protein, 18 aa, Mycobacterium avium
SADGYPDGQPSAGIRPGD

SEQ ID NO: 44664 - protein, 8 aa, Mycobacterium avium
SADNAQQE

SEQ ID NO: 44665 - protein, 9 aa, Mycobacterium avium
SADPARLGE

SEQ ID NO: 44666 - protein, 9 aa, Mycobacterium avium
SADPERAAN

SEQ ID NO: 44667 - protein, 8 aa, Mycobacterium avium
SADPGDDV

SEQ ID NO: 44668 - protein, 11 aa, Mycobacterium avium
SADPGDSGEEQ

SEQ ID NO: 44669 - protein, 7 aa, Mycobacterium avium
SADPRRG

SEQ ID NO: 44670 - protein, 10 aa, Mycobacterium avium
SADPVDKQAK

SEQ ID NO: 44671 - protein, 4 aa, Mycobacterium avium
SADQ

SEQ ID NO: 44672 - protein, 6 aa, Mycobacterium avium
SADRPT

SEQ ID NO: 44673 - protein, 14 aa, Mycobacterium avium
SADRRSALARAGGG

SEQ ID NO: 44674 - protein, 17 aa, Mycobacterium avium
SADSRWKPQHNASAPEM

SEQ ID NO: 44675 - protein, 14 aa, Mycobacterium avium
SADTPPAPGQPAPT

SEQ ID NO: 44676 - protein, 5 aa, Mycobacterium avium
SAEEA

SEQ ID NO: 44677 - protein, 6 aa, Mycobacterium avium
SAEEKD

SEQ ID NO: 44678 - protein, 4 aa, Mycobacterium avium
SAEG

SEQ ID NO: 44679 - protein, 6 aa, Mycobacterium avium
SAEGQR

SEQ ID NO: 44680 - protein, 8 aa, Mycobacterium avium
SAELQERN

SEQ ID NO: 44681 - protein, 8 aa, Mycobacterium avium
SAEPMSGA

SEQ ID NO: 44682 - protein, 8 aa, Mycobacterium avium
SAEPTREN

SEQ ID NO: 44683 - protein, 5 aa, Mycobacterium avium
SAEQD

SEQ ID NO: 44684 - protein, 6 aa, Mycobacterium avium
SAEQGW

SEQ ID NO: 44685 - protein, 7 aa, Mycobacterium avium
SAEQQAT

SEQ ID NO: 44686 - protein, 9 aa, Mycobacterium avium
SAEQVTATE

SEQ ID NO: 44687 - protein, 4 aa, Mycobacterium avium
SAER

SEQ ID NO: 44688 - protein, 12 aa, Mycobacterium avium
SAERDPAGCTDS

SEQ ID NO: 44689 - protein, 8 aa, Mycobacterium avium
SAESGLDG

SEQ ID NO: 44690 - protein, 7 aa, Mycobacterium avium
SAESQSF

SEQ ID NO: 44691 - protein, 7 aa, Mycobacterium avium
SAESTAW

SEQ ID NO: 44692 - protein, 4 aa, Mycobacterium avium
SAGA

SEQ ID NO: 44693 - protein, 13 aa, Mycobacterium avium
SAGADFRPELDTT

SEQ ID NO: 44694 - protein, 6 aa, Mycobacterium avium
SAGADG

SEQ ID NO: 44695 - protein, 5 aa, Mycobacterium avium
SAGAG

SEQ ID NO: 44696 - protein, 9 aa, Mycobacterium avium
SAGAGPAVR

SEQ ID NO: 44697 - protein, 6 aa, Mycobacterium avium
SAGAKV

SEQ ID NO: 44698 - protein, 7 aa, Mycobacterium avium
SAGAQPQ

SEQ ID NO: 44699 - protein, 6 aa, Mycobacterium avium
SAGDDE

SEQ ID NO: 44700 - protein, 7 aa, Mycobacterium avium
SAGDLAA

SEQ ID NO: 44701 - protein, 8 aa, Mycobacterium avium
SAGEAEPG

SEQ ID NO: 44702 - protein, 5 aa, Mycobacterium avium
SAGFD

SEQ ID NO: 44703 - protein, 8 aa, Mycobacterium avium
SAGGATKH

SEQ ID NO: 44704 - protein, 7 aa, Mycobacterium avium
SAGGDPW

SEQ ID NO: 44705 - protein, 8 aa, Mycobacterium avium
SAGGGGRG

SEQ ID NO: 44706 - protein, 7 aa, Mycobacterium avium
SAGGMPD

SEQ ID NO: 44707 - protein, 10 aa, Mycobacterium avium
SAGGVKGDEF

SEQ ID NO: 44708 - protein, 7 aa, Mycobacterium avium
SAGHPPP

SEQ ID NO: 44709 - protein, 5 aa, Mycobacterium avium
SAGLD

SEQ ID NO: 44710 - protein, 20 aa, Mycobacterium avium
SAGLKATPGNGHYSASKHGL

SEQ ID NO: 44711 - protein, 18 aa, Mycobacterium avium
SAGPDAVPITKESVEKTI

SEQ ID NO: 44712 - protein, 8 aa, Mycobacterium avium
SAGPQRNI

SEQ ID NO: 44713 - protein, 14 aa, Mycobacterium avium
SAGPVDLPSGSVSP

SEQ ID NO: 44714 - protein, 7 aa, Mycobacterium avium
SAGQETT

SEQ ID NO: 44715 - protein, 10 aa, Mycobacterium avium
SAGQGRPDAG

SEQ ID NO: 44716 - protein, 7 aa, Mycobacterium avium
SAGRPCD

SEQ ID NO: 44717 - protein, 7 aa, Mycobacterium avium
SAGRPPC

SEQ ID NO: 44718 - protein, 16 aa, Mycobacterium avium
SAGSASAGGSDSGPVN

SEQ ID NO: 44719 - protein, 7 aa, Mycobacterium avium
SAGTDTS

SEQ ID NO: 44720 - protein, 4 aa, Mycobacterium avium
SAGV

SEQ ID NO: 44721 - protein, 18 aa, Mycobacterium avium
SAGVQARNPKYSSYLPTK

SEQ ID NO: 44722 - protein, 4 aa, Mycobacterium avium
SAGW

SEQ ID NO: 44723 - protein, 12 aa, Mycobacterium avium
SAHGTNAASAAL

SEQ ID NO: 44724 - protein, 7 aa, Mycobacterium avium
SAKERPR

SEQ ID NO: 44725 - protein, 9 aa, Mycobacterium avium
SAKHDEEHS

SEQ ID NO: 44726 - protein, 8 aa, Mycobacterium avium
SAKQVRGG

SEQ ID NO: 44727 - protein, 7 aa, Mycobacterium avium
SAKSYDQ

SEQ ID NO: 44728 - protein, 7 aa, Mycobacterium avium
SAKTGRA

SEQ ID NO: 44729 - protein, 6 aa, Mycobacterium avium
SAKTHG

SEQ ID NO: 44730 - protein, 16 aa, Mycobacterium avium
SALGPRGAESEKGGYD

SEQ ID NO: 44731 - protein, 27 aa, Mycobacterium avium
SALPNGPKVSHGGALSPRGDWRAPSDM

SEQ ID NO: 44732 - protein, 6 aa, Mycobacterium avium
SANRAE

SEQ ID NO: 44733 - protein, 13 aa, Mycobacterium avium
SANRDPRRFTDPD

SEQ ID NO: 44734 - protein, 5 aa, Mycobacterium avium
SANYD

SEQ ID NO: 44735 - protein, 8 aa, Mycobacterium avium
SAPDDPNY

SEQ ID NO: 44736 - protein, 8 aa, Mycobacterium avium
SAPDLDNP

SEQ ID NO: 44737 - protein, 12 aa, Mycobacterium avium
SAPEGAHVRSGD

SEQ ID NO: 44738 - protein, 5 aa, Mycobacterium avium
SAPFT

SEQ ID NO: 44739 - protein, 12 aa, Mycobacterium avium
SAPGGDARFGEA

SEQ ID NO: 44740 - protein, 7 aa, Mycobacterium avium
SAPISPE

SEQ ID NO: 44741 - protein, 4 aa, Mycobacterium avium
SAPL

SEQ ID NO: 44742 - protein, 7 aa, Mycobacterium avium
SAPLGAV

SEQ ID NO: 44743 - protein, 5 aa, Mycobacterium avium
SAPLP

SEQ ID NO: 44744 - protein, 4 aa, Mycobacterium avium
SAPP

SEQ ID NO: 44745 - protein, 12 aa, Mycobacterium avium
SAPQERFEGFVE

SEQ ID NO: 44746 - protein, 12 aa, Mycobacterium avium
SAPQTVTGQDRV

SEQ ID NO: 44747 - protein, 6 aa, Mycobacterium avium
SAPRAV

SEQ ID NO: 44748 - protein, 20 aa, Mycobacterium avium
SAPSGKQGMGNNRDGAAGAD

SEQ ID NO: 44749 - protein, 6 aa, Mycobacterium avium
SAPSSL

SEQ ID NO: 44750 - protein, 4 aa, Mycobacterium avium
SAPV

SEQ ID NO: 44751 - protein, 7 aa, Mycobacterium avium
SAPVPGT

SEQ ID NO: 44752 - protein, 9 aa, Mycobacterium avium
SAPVRDSRG

SEQ ID NO: 44753 - protein, 9 aa, Mycobacterium avium
SAQAGSRAD

SEQ ID NO: 44754 - protein, 10 aa, Mycobacterium avium
SAQGQEHSAV

SEQ ID NO: 44755 - protein, 4 aa, Mycobacterium avium
SAQI

SEQ ID NO: 44756 - protein, 4 aa, Mycobacterium avium
SAQK

SEQ ID NO: 44757 - protein, 4 aa, Mycobacterium avium
SAQL

SEQ ID NO: 44758 - protein, 14 aa, Mycobacterium avium
SAQPPPEPDPSHDE

SEQ ID NO: 44759 - protein, 30 aa, Mycobacterium avium
SAQQALRENRARRAARENASADETNGVLAS

SEQ ID NO: 44760 - protein, 5 aa, Mycobacterium avium
SAQQI

SEQ ID NO: 44761 - protein, 9 aa, Mycobacterium avium
SAQQPAPDD

SEQ ID NO: 44762 - protein, 8 aa, Mycobacterium avium
SAQRPAEL

SEQ ID NO: 44763 - protein, 6 aa, Mycobacterium avium
SAQSLN

SEQ ID NO: 44764 - protein, 9 aa, Mycobacterium avium
SAQTLPPGA

SEQ ID NO: 44765 - protein, 9 aa, Mycobacterium avium
SAQTQVEQQ

SEQ ID NO: 44766 - protein, 9 aa, Mycobacterium avium
SARAADVTL

SEQ ID NO: 44767 - protein, 8 aa, Mycobacterium avium
SARAAETA

SEQ ID NO: 44768 - protein, 12 aa, Mycobacterium avium
SARAATSPTPRI

SEQ ID NO: 44769 - protein, 15 aa, Mycobacterium avium
SARADGGEVIDGDRR

SEQ ID NO: 44770 - protein, 5 aa, Mycobacterium avium
SARDL

SEQ ID NO: 44771 - protein, 5 aa, Mycobacterium avium
SARDV

SEQ ID NO: 44772 - protein, 8 aa, Mycobacterium avium
SARELTGC

SEQ ID NO: 44773 - protein, 9 aa, Mycobacterium avium
SARGEGRSL

SEQ ID NO: 44774 - protein, 5 aa, Mycobacterium avium
SARGI

SEQ ID NO: 44775 - protein, 7 aa, Mycobacterium avium
SARGRPL

SEQ ID NO: 44776 - protein, 6 aa, Mycobacterium avium
SARKSL

SEQ ID NO: 44777 - protein, 6 aa, Mycobacterium avium
SARLDN

SEQ ID NO: 44778 - protein, 8 aa, Mycobacterium avium
SARPDQLD

SEQ ID NO: 44779 - protein, 6 aa, Mycobacterium avium
SARPDV

SEQ ID NO: 44780 - protein, 9 aa, Mycobacterium avium
SARPGGGTL

SEQ ID NO: 44781 - protein, 8 aa, Mycobacterium avium
SARPPAAG

SEQ ID NO: 44782 - protein, 5 aa, Mycobacterium avium
SARPQ

SEQ ID NO: 44783 - protein, 7 aa, Mycobacterium avium
SARPSDS

SEQ ID NO: 44784 - protein, 8 aa, Mycobacterium avium
SARPTEHG

SEQ ID NO: 44785 - protein, 6 aa, Mycobacterium avium
SARRAE

SEQ ID NO: 44786 - protein, 6 aa, Mycobacterium avium
SARRDP

SEQ ID NO: 44787 - protein, 10 aa, Mycobacterium avium
SARSSGKNYR

SEQ ID NO: 44788 - protein, 9 aa, Mycobacterium avium
SARTHSEPS

SEQ ID NO: 44789 - protein, 5 aa, Mycobacterium avium
SARTN

SEQ ID NO: 44790 - protein, 8 aa, Mycobacterium avium
SARVASPG

SEQ ID NO: 44791 - protein, 13 aa, Mycobacterium avium
SASAIAGTRPLDT

SEQ ID NO: 44792 - protein, 8 aa, Mycobacterium avium
SASAKPRV

SEQ ID NO: 44793 - protein, 12 aa, Mycobacterium avium
SASDARGKDPDF

SEQ ID NO: 44794 - protein, 8 aa, Mycobacterium avium
SASDLQSI

SEQ ID NO: 44795 - protein, 8 aa, Mycobacterium avium
SASEAISG

SEQ ID NO: 44796 - protein, 6 aa, Mycobacterium avium
SASGPL

SEQ ID NO: 44797 - protein, 6 aa, Mycobacterium avium
SASGRL

SEQ ID NO: 44798 - protein, 13 aa, Mycobacterium avium
SASGSPVAPGADA

SEQ ID NO: 44799 - protein, 17 aa, Mycobacterium avium
SASGVGDYGTHAGPLDV

SEQ ID NO: 44800 - protein, 5 aa, Mycobacterium avium
SASLR

SEQ ID NO: 44801 - protein, 4 aa, Mycobacterium avium
SASN

SEQ ID NO: 44802 - protein, 8 aa, Mycobacterium avium
SASNPWGE

SEQ ID NO: 44803 - protein, 17 aa, Mycobacterium avium
SASRSPQVSTDAPPSVQ

SEQ ID NO: 44804 - protein, 15 aa, Mycobacterium avium
SASTPAGDDTYDGAA

SEQ ID NO: 44805 - protein, 8 aa, Mycobacterium avium
SATAANKL

SEQ ID NO: 44806 - protein, 8 aa, Mycobacterium avium
SATARTRR

SEQ ID NO: 44807 - protein, 8 aa, Mycobacterium avium
SATDGVQT

SEQ ID NO: 44808 - protein, 12 aa, Mycobacterium avium
SATDTQTGRAME

SEQ ID NO: 44809 - protein, 8 aa, Mycobacterium avium
SATEADDV

SEQ ID NO: 44810 - protein, 6 aa, Mycobacterium avium
SATEDR

SEQ ID NO: 44811 - protein, 11 aa, Mycobacterium avium
SATEPDRTGLP

SEQ ID NO: 44812 - protein, 8 aa, Mycobacterium avium
SATEPGSV

SEQ ID NO: 44813 - protein, 7 aa, Mycobacterium avium
SATEQEA

SEQ ID NO: 44814 - protein, 4 aa, Mycobacterium avium
SATF

SEQ ID NO: 44815 - protein, 8 aa, Mycobacterium avium
SATGGGVA

SEQ ID NO: 44816 - protein, 8 aa, Mycobacterium avium
SATGYGPE

SEQ ID NO: 44817 - protein, 10 aa, Mycobacterium avium
SATHRRETYT

SEQ ID NO: 44818 - protein, 6 aa, Mycobacterium avium
SATPDA

SEQ ID NO: 44819 - protein, 7 aa, Mycobacterium avium
SATPLYD

SEQ ID NO: 44820 - protein, 6 aa, Mycobacterium avium
SATPRQ

SEQ ID NO: 44821 - protein, 5 aa, Mycobacterium avium
SATQY

SEQ ID NO: 44822 - protein, 5 aa, Mycobacterium avium
SATRA

SEQ ID NO: 44823 - protein, 7 aa, Mycobacterium avium
SATRSVE

SEQ ID NO: 44824 - protein, 8 aa, Mycobacterium avium
SATSMRTG

SEQ ID NO: 44825 - protein, 9 aa, Mycobacterium avium
SATTDDEGR

SEQ ID NO: 44826 - protein, 5 aa, Mycobacterium avium
SATVR

SEQ ID NO: 44827 - protein, 6 aa, Mycobacterium avium
SATYPG

SEQ ID NO: 44828 - protein, 6 aa, Mycobacterium avium
SAVNGL

SEQ ID NO: 44829 - protein, 5 aa, Mycobacterium avium
SAVNT

SEQ ID NO: 44830 - protein, 9 aa, Mycobacterium avium
SAVPKTSTV

SEQ ID NO: 44831 - protein, 13 aa, Mycobacterium avium
SAWPGSDDSGFEA

SEQ ID NO: 44832 - protein, 8 aa, Mycobacterium avium
SAWRKDPD

SEQ ID NO: 44833 - protein, 10 aa, Mycobacterium avium
SAYRPAPPVR

SEQ ID NO: 44834 - protein, 5 aa, Mycobacterium avium
SAYSG

SEQ ID NO: 44835 - protein, 4 aa, Mycobacterium avium
SAYV

SEQ ID NO: 44836 - protein, 15 aa, Mycobacterium avium
SCAQSRAAADGTDVS

SEQ ID NO: 44837 - protein, 6 aa, Mycobacterium avium
SCPGGP

SEQ ID NO: 44838 - protein, 8 aa, Mycobacterium avium
SCRPGDGL

SEQ ID NO: 44839 - protein, 8 aa, Mycobacterium avium
SDAAAATD

SEQ ID NO: 44840 - protein, 12 aa, Mycobacterium avium
SDAAARDGFGPF

SEQ ID NO: 44841 - protein, 7 aa, Mycobacterium avium
SDADEER

SEQ ID NO: 44842 - protein, 5 aa, Mycobacterium avium
SDADS

SEQ ID NO: 44843 - protein, 4 aa, Mycobacterium avium
SDAE

SEQ ID NO: 44844 - protein, 7 aa, Mycobacterium avium
SDAEEHT

SEQ ID NO: 44845 - protein, 5 aa, Mycobacterium avium
SDAEG

SEQ ID NO: 44846 - protein, 8 aa, Mycobacterium avium
SDAEPQGL

SEQ ID NO: 44847 - protein, 6 aa, Mycobacterium avium
SDAEPV

SEQ ID NO: 44848 - protein, 9 aa, Mycobacterium avium
SDAEQSNTS

SEQ ID NO: 44849 - protein, 8 aa, Mycobacterium avium
SDAFTGEN

SEQ ID NO: 44850 - protein, 6 aa, Mycobacterium avium
SDAGKS

SEQ ID NO: 44851 - protein, 8 aa, Mycobacterium avium
SDAGQRRL

SEQ ID NO: 44852 - protein, 18 aa, Mycobacterium avium
SDAGRVGSAGESIYAGAK

SEQ ID NO: 44853 - protein, 15 aa, Mycobacterium avium
SDAGSAPEPQSDPSV

SEQ ID NO: 44854 - protein, 7 aa, Mycobacterium avium
SDAHNRT

SEQ ID NO: 44855 - protein, 7 aa, Mycobacterium avium
SDAHRSA

SEQ ID NO: 44856 - protein, 12 aa, Mycobacterium avium
SDAKAGKDAAEL

SEQ ID NO: 44857 - protein, 10 aa, Mycobacterium avium
SDAKAQADRM

SEQ ID NO: 44858 - protein, 7 aa, Mycobacterium avium
SDALPDD

SEQ ID NO: 44859 - protein, 14 aa, Mycobacterium avium
SDAPAPDAPAGDEH

SEQ ID NO: 44860 - protein, 14 aa, Mycobacterium avium
SDASHAKASGLTAR

SEQ ID NO: 44861 - protein, 9 aa, Mycobacterium avium
SDASNTPAV

SEQ ID NO: 44862 - protein, 5 aa, Mycobacterium avium
SDATA

SEQ ID NO: 44863 - protein, 7 aa, Mycobacterium avium
SDATGRA

SEQ ID NO: 44864 - protein, 21 aa, Mycobacterium avium
SDATPSRREFQRTPGLNGPAV

SEQ ID NO: 44865 - protein, 9 aa, Mycobacterium avium
SDATPTEKL

SEQ ID NO: 44866 - protein, 5 aa, Mycobacterium avium
SDAVR

SEQ ID NO: 44867 - protein, 9 aa, Mycobacterium avium
SDDDAADLT

SEQ ID NO: 44868 - protein, 10 aa, Mycobacterium avium
SDDDDRARLD

SEQ ID NO: 44869 - protein, 7 aa, Mycobacterium avium
SDDDGGA

SEQ ID NO: 44870 - protein, 8 aa, Mycobacterium avium
SDDDREHG

SEQ ID NO: 44871 - protein, 13 aa, Mycobacterium avium
SDDEVRELLATPT

SEQ ID NO: 44872 - protein, 8 aa, Mycobacterium avium
SDDGETVA

SEQ ID NO: 44873 - protein, 15 aa, Mycobacterium avium
SDDGGPGAGRMARHR

SEQ ID NO: 44874 - protein, 5 aa, Mycobacterium avium
SDDLD

SEQ ID NO: 44875 - protein, 5 aa, Mycobacterium avium
SDDPR

SEQ ID NO: 44876 - protein, 12 aa, Mycobacterium avium
SDDSDADPGDKA

SEQ ID NO: 44877 - protein, 7 aa, Mycobacterium avium
SDDTDRA

SEQ ID NO: 44878 - protein, 8 aa, Mycobacterium avium
SDDTGRIQ

SEQ ID NO: 44879 - protein, 7 aa, Mycobacterium avium
SDDTVGR

SEQ ID NO: 44880 - protein, 12 aa, Mycobacterium avium
SDEAGAKSVRNL

SEQ ID NO: 44881 - protein, 7 aa, Mycobacterium avium
SDEAGSH

SEQ ID NO: 44882 - protein, 10 aa, Mycobacterium avium
SDEDNDLTDH

SEQ ID NO: 44883 - protein, 5 aa, Mycobacterium avium
SDEFT

SEQ ID NO: 44884 - protein, 8 aa, Mycobacterium avium
SDEGYEGR

SEQ ID NO: 44885 - protein, 5 aa, Mycobacterium avium
SDEID

SEQ ID NO: 44886 - protein, 9 aa, Mycobacterium avium
SDELGGGSM

SEQ ID NO: 44887 - protein, 5 aa, Mycobacterium avium
SDELK

SEQ ID NO: 44888 - protein, 5 aa, Mycobacterium avium
SDELP

SEQ ID NO: 44889 - protein, 6 aa, Mycobacterium avium
SDEPGT

SEQ ID NO: 44890 - protein, 4 aa, Mycobacterium avium
SDEQ

SEQ ID NO: 44891 - protein, 7 aa, Mycobacterium avium
SDEQRPQ

SEQ ID NO: 44892 - protein, 6 aa, Mycobacterium avium
SDEQRR

SEQ ID NO: 44893 - protein, 13 aa, Mycobacterium avium
SDERGRAGSEDAE

SEQ ID NO: 44894 - protein, 6 aa, Mycobacterium avium
SDESAV

SEQ ID NO: 44895 - protein, 6 aa, Mycobacterium avium
SDESED

SEQ ID NO: 44896 - protein, 7 aa, Mycobacterium avium
SDESGRI

SEQ ID NO: 44897 - protein, 8 aa, Mycobacterium avium
SDETPAQV

SEQ ID NO: 44898 - protein, 5 aa, Mycobacterium avium
SDGAA

SEQ ID NO: 44899 - protein, 12 aa, Mycobacterium avium
SDGAYAEASNQD

SEQ ID NO: 44900 - protein, 4 aa, Mycobacterium avium
SDGD

SEQ ID NO: 44901 - protein, 10 aa, Mycobacterium avium
SDGEEAGQEP

SEQ ID NO: 44902 - protein, 5 aa, Mycobacterium avium
SDGGA

SEQ ID NO: 44903 - protein, 9 aa, Mycobacterium avium
SDGGEESQC

SEQ ID NO: 44904 - protein, 7 aa, Mycobacterium avium
SDGGETF

SEQ ID NO: 44905 - protein, 5 aa, Mycobacterium avium
SDGGF

SEQ ID NO: 44906 - protein, 6 aa, Mycobacterium avium
SDGGPG

SEQ ID NO: 44907 - protein, 8 aa, Mycobacterium avium
SDGIGAAA

SEQ ID NO: 44908 - protein, 9 aa, Mycobacterium avium
SDGKPARVG

SEQ ID NO: 44909 - protein, 8 aa, Mycobacterium avium
SDGKPAYI

SEQ ID NO: 44910 - protein, 4 aa, Mycobacterium avium
SDGL

SEQ ID NO: 44911 - protein, 8 aa, Mycobacterium avium
SDGNFGNP

SEQ ID NO: 44912 - protein, 8 aa, Mycobacterium avium
SDGPCART

SEQ ID NO: 44913 - protein, 9 aa, Mycobacterium avium
SDGQKMSKS

SEQ ID NO: 44914 - protein, 9 aa, Mycobacterium avium
SDGRHNPDF

SEQ ID NO: 44915 - protein, 8 aa, Mycobacterium avium
SDGRPHAL

SEQ ID NO: 44916 - protein, 7 aa, Mycobacterium avium
SDGRTLR

SEQ ID NO: 44917 - protein, 6 aa, Mycobacterium avium
SDGSDV

SEQ ID NO: 44918 - protein, 8 aa, Mycobacterium avium
SDGSEQAV

SEQ ID NO: 44919 - protein, 8 aa, Mycobacterium avium
SDGSRDAG

SEQ ID NO: 44920 - protein, 8 aa, Mycobacterium avium
SDGSRHGN

SEQ ID NO: 44921 - protein, 6 aa, Mycobacterium avium
SDGSTT

SEQ ID NO: 44922 - protein, 4 aa, Mycobacterium avium
SDGT

SEQ ID NO: 44923 - protein, 9 aa, Mycobacterium avium
SDHPDLPAH

SEQ ID NO: 44924 - protein, 14 aa, Mycobacterium avium
SDKDGPDSEFEREL

SEQ ID NO: 44925 - protein, 11 aa, Mycobacterium avium
SDKPATTEQQA

SEQ ID NO: 44926 - protein, 13 aa, Mycobacterium avium
SDKPMRRTDPRGR

SEQ ID NO: 44927 - protein, 14 aa, Mycobacterium avium
SDLAKGGPVHSQAD

SEQ ID NO: 44928 - protein, 13 aa, Mycobacterium avium
SDLASRSANTPYE

SEQ ID NO: 44929 - protein, 30 aa, Mycobacterium avium
SDLGGDDAAHPRPSGSIRQVRSSRKVARRV

SEQ ID NO: 44930 - protein, 8 aa, Mycobacterium avium
SDLGGYKD

SEQ ID NO: 44931 - protein, 13 aa, Mycobacterium avium
SDLPAPPEPLPPG

SEQ ID NO: 44932 - protein, 7 aa, Mycobacterium avium
SDMEKPI

SEQ ID NO: 44933 - protein, 6 aa, Mycobacterium avium
SDNGAW

SEQ ID NO: 44934 - protein, 8 aa, Mycobacterium avium
SDNPVPLT

SEQ ID NO: 44935 - protein, 14 aa, Mycobacterium avium
SDNVTPVTAELGGK

SEQ ID NO: 44936 - protein, 7 aa, Mycobacterium avium
SDPAAER

SEQ ID NO: 44937 - protein, 7 aa, Mycobacterium avium
SDPAEGD

SEQ ID NO: 44938 - protein, 12 aa, Mycobacterium avium
SDPAKRKEYDET

SEQ ID NO: 44939 - protein, 5 aa, Mycobacterium avium
SDPDA

SEQ ID NO: 44940 - protein, 8 aa, Mycobacterium avium
SDPDEAVA

SEQ ID NO: 44941 - protein, 8 aa, Mycobacterium avium
SDPDERGM

SEQ ID NO: 44942 - protein, 12 aa, Mycobacterium avium
SDPDRAAAMGAA

SEQ ID NO: 44943 - protein, 6 aa, Mycobacterium avium
SDPEKR

SEQ ID NO: 44944 - protein, 5 aa, Mycobacterium avium
SDPEL

SEQ ID NO: 44945 - protein, 7 aa, Mycobacterium avium
SDPEPAR

SEQ ID NO: 44946 - protein, 21 aa, Mycobacterium avium
SDPEQGNWPPGFPEDKRPSYS

SEQ ID NO: 44947 - protein, 5 aa, Mycobacterium avium
SDPGL

SEQ ID NO: 44948 - protein, 9 aa, Mycobacterium avium
SDPIDPVEV

SEQ ID NO: 44949 - protein, 6 aa, Mycobacterium avium
SDPIHP

SEQ ID NO: 44950 - protein, 7 aa, Mycobacterium avium
SDPITGP

SEQ ID NO: 44951 - protein, 20 aa, Mycobacterium avium
SDPNWQGGDYHDTGRTPDAG

SEQ ID NO: 44952 - protein, 9 aa, Mycobacterium avium
SDPPTPEEV

SEQ ID NO: 44953 - protein, 9 aa, Mycobacterium avium
SDPQTDYTG

SEQ ID NO: 44954 - protein, 6 aa, Mycobacterium avium
SDPRAA

SEQ ID NO: 44955 - protein, 7 aa, Mycobacterium avium
SDPRTGA

SEQ ID NO: 44956 - protein, 8 aa, Mycobacterium avium
SDPSAERH

SEQ ID NO: 44957 - protein, 9 aa, Mycobacterium avium
SDPSDVARV

SEQ ID NO: 44958 - protein, 4 aa, Mycobacterium avium
SDPT

SEQ ID NO: 44959 - protein, 12 aa, Mycobacterium avium
SDPVAKAQKRQQ

SEQ ID NO: 44960 - protein, 13 aa, Mycobacterium avium
SDQGLADRQKVPA

SEQ ID NO: 44961 - protein, 5 aa, Mycobacterium avium
SDQTH

SEQ ID NO: 44962 - protein, 4 aa, Mycobacterium avium
SDRA

SEQ ID NO: 44963 - protein, 14 aa, Mycobacterium avium
SDRGGQDDTQAARD

SEQ ID NO: 44964 - protein, 5 aa, Mycobacterium avium
SDRGI

SEQ ID NO: 44965 - protein, 5 aa, Mycobacterium avium
SDRNR

SEQ ID NO: 44966 - protein, 5 aa, Mycobacterium avium
SDRPD

SEQ ID NO: 44967 - protein, 6 aa, Mycobacterium avium
SDRPGF

SEQ ID NO: 44968 - protein, 8 aa, Mycobacterium avium
SDRPPKQL

SEQ ID NO: 44969 - protein, 4 aa, Mycobacterium avium
SDRT

SEQ ID NO: 44970 - protein, 6 aa, Mycobacterium avium
SDRTAR

SEQ ID NO: 44971 - protein, 9 aa, Mycobacterium avium
SDSFQGRSS

SEQ ID NO: 44972 - protein, 25 aa, Mycobacterium avium
SDSGGSKPGATTSSAPQNGQGNHGP

SEQ ID NO: 44973 - protein, 6 aa, Mycobacterium avium
SDSGYS

SEQ ID NO: 44974 - protein, 15 aa, Mycobacterium avium
SDSHESGKLPGTDVR

SEQ ID NO: 44975 - protein, 6 aa, Mycobacterium avium
SDSLRE

SEQ ID NO: 44976 - protein, 10 aa, Mycobacterium avium
SDSNKDGGYL

SEQ ID NO: 44977 - protein, 22 aa, Mycobacterium avium
SDTADAPKSAQEKAAESAAPHK

SEQ ID NO: 44978 - protein, 6 aa, Mycobacterium avium
SDTAEF

SEQ ID NO: 44979 - protein, 6 aa, Mycobacterium avium
SDTARR

SEQ ID NO: 44980 - protein, 7 aa, Mycobacterium avium
SDTDDGV

SEQ ID NO: 44981 - protein, 5 aa, Mycobacterium avium
SDTDL

SEQ ID NO: 44982 - protein, 9 aa, Mycobacterium avium
SDTELSPVN

SEQ ID NO: 44983 - protein, 5 aa, Mycobacterium avium
SDTEY

SEQ ID NO: 44984 - protein, 7 aa, Mycobacterium avium
SDTGDLG

SEQ ID NO: 44985 - protein, 8 aa, Mycobacterium avium
SDTRPAAR

SEQ ID NO: 44986 - protein, 9 aa, Mycobacterium avium
SDTSEAGGA

SEQ ID NO: 44987 - protein, 8 aa, Mycobacterium avium
SDTSPTPY

SEQ ID NO: 44988 - protein, 8 aa, Mycobacterium avium
SDTVDRET

SEQ ID NO: 44989 - protein, 13 aa, Mycobacterium avium
SDVAGASAQRGLS

SEQ ID NO: 44990 - protein, 4 aa, Mycobacterium avium
SDVE

SEQ ID NO: 44991 - protein, 5 aa, Mycobacterium avium
SDVQA

SEQ ID NO: 44992 - protein, 6 aa, Mycobacterium avium
SDVTAA

SEQ ID NO: 44993 - protein, 4 aa, Mycobacterium avium
SDYL

SEQ ID NO: 44994 - protein, 6 aa, Mycobacterium avium
SEAADK

SEQ ID NO: 44995 - protein, 7 aa, Mycobacterium avium
SEAARQG

SEQ ID NO: 44996 - protein, 13 aa, Mycobacterium avium
SEAARRYERGVDP

SEQ ID NO: 44997 - protein, 6 aa, Mycobacterium avium
SEADDP

SEQ ID NO: 44998 - protein, 8 aa, Mycobacterium avium
SEADDRRV

SEQ ID NO: 44999 - protein, 4 aa, Mycobacterium avium
SEAQ

SEQ ID NO: 45000 - protein, 26 aa, Mycobacterium avium
SEAQERSAAAAEGAEEWHDPRADGKL

SEQ ID NO: 45001 - protein, 11 aa, Mycobacterium avium
SEAQKSGAAEI

SEQ ID NO: 45002 - protein, 9 aa, Mycobacterium avium
SEASERGTD

SEQ ID NO: 45003 - protein, 7 aa, Mycobacterium avium
SECTEPD

SEQ ID NO: 45004 - protein, 21 aa, Mycobacterium avium
SEDAKEGPRAFAEKREPVWQA

SEQ ID NO: 45005 - protein, 20 aa, Mycobacterium avium
SEDERRALKRRNARTKARSG

SEQ ID NO: 45006 - protein, 7 aa, Mycobacterium avium
SEDPGVA

SEQ ID NO: 45007 - protein, 8 aa, Mycobacterium avium
SEDRRRTL

SEQ ID NO: 45008 - protein, 11 aa, Mycobacterium avium
SEEDKARARAE

SEQ ID NO: 45009 - protein, 5 aa, Mycobacterium avium
SEEGL

SEQ ID NO: 45010 - protein, 13 aa, Mycobacterium avium
SEEKDEATMAEEQ

SEQ ID NO: 45011 - protein, 6 aa, Mycobacterium avium
SEEQKR

SEQ ID NO: 45012 - protein, 5 aa, Mycobacterium avium
SEEQL

SEQ ID NO: 45013 - protein, 6 aa, Mycobacterium avium
SEEQQD

SEQ ID NO: 45014 - protein, 7 aa, Mycobacterium avium
SEEQRDG

SEQ ID NO: 45015 - protein, 8 aa, Mycobacterium avium
SEESGGSD

SEQ ID NO: 45016 - protein, 6 aa, Mycobacterium avium
SEETGL

SEQ ID NO: 45017 - protein, 5 aa, Mycobacterium avium
SEGAA

SEQ ID NO: 45018 - protein, 7 aa, Mycobacterium avium
SEGGAPA

SEQ ID NO: 45019 - protein, 5 aa, Mycobacterium avium
SEGGG

SEQ ID NO: 45020 - protein, 8 aa, Mycobacterium avium
SEGGITQN

SEQ ID NO: 45021 - protein, 6 aa, Mycobacterium avium
SEGGTG

SEQ ID NO: 45022 - protein, 6 aa, Mycobacterium avium
SEGKDG

SEQ ID NO: 45023 - protein, 6 aa, Mycobacterium avium
SEGKGL

SEQ ID NO: 45024 - protein, 7 aa, Mycobacterium avium
SEGPLPQ

SEQ ID NO: 45025 - protein, 4 aa, Mycobacterium avium
SEHG

SEQ ID NO: 45026 - protein, 15 aa, Mycobacterium avium
SEHGQGSDPDLSADG

SEQ ID NO: 45027 - protein, 11 aa, Mycobacterium avium
SEHTTKESSRI

SEQ ID NO: 45028 - protein, 6 aa, Mycobacterium avium
SEIAGR

SEQ ID NO: 45029 - protein, 9 aa, Mycobacterium avium
SEILGDPSA

SEQ ID NO: 45030 - protein, 17 aa, Mycobacterium avium
SEIPETMPDPDTDDEGC

SEQ ID NO: 45031 - protein, 7 aa, Mycobacterium avium
SEIPHDG

SEQ ID NO: 45032 - protein, 13 aa, Mycobacterium avium
SEKAGKSQGLTPR

SEQ ID NO: 45033 - protein, 5 aa, Mycobacterium avium
SEKDF

SEQ ID NO: 45034 - protein, 8 aa, Mycobacterium avium
SEKGITVS

SEQ ID NO: 45035 - protein, 10 aa, Mycobacterium avium
SEKPTEESVT

SEQ ID NO: 45036 - protein, 5 aa, Mycobacterium avium
SEKTG

SEQ ID NO: 45037 - protein, 11 aa, Mycobacterium avium
SELASAGDGGM

SEQ ID NO: 45038 - protein, 12 aa, Mycobacterium avium
SELDEPAAPPEP

SEQ ID NO: 45039 - protein, 9 aa, Mycobacterium avium
SELDGQAAE

SEQ ID NO: 45040 - protein, 4 aa, Mycobacterium avium
SELG

SEQ ID NO: 45041 - protein, 10 aa, Mycobacterium avium
SELGTGRGGP

SEQ ID NO: 45042 - protein, 8 aa, Mycobacterium avium
SELPGESP

SEQ ID NO: 45043 - protein, 11 aa, Mycobacterium avium
SELPPPRYQSK

SEQ ID NO: 45044 - protein, 9 aa, Mycobacterium avium
SELRTEAGQ

SEQ ID NO: 45045 - protein, 10 aa, Mycobacterium avium
SEMTKEQQGT

SEQ ID NO: 45046 - protein, 6 aa, Mycobacterium avium
SENETE

SEQ ID NO: 45047 - protein, 6 aa, Mycobacterium avium
SENPAR

SEQ ID NO: 45048 - protein, 6 aa, Mycobacterium avium
SENPEA

SEQ ID NO: 45049 - protein, 5 aa, Mycobacterium avium
SENTH

SEQ ID NO: 45050 - protein, 4 aa, Mycobacterium avium
SEPD

SEQ ID NO: 45051 - protein, 10 aa, Mycobacterium avium
SEPDAGSDLA

SEQ ID NO: 45052 - protein, 9 aa, Mycobacterium avium
SEPDAGTDL

SEQ ID NO: 45053 - protein, 9 aa, Mycobacterium avium
SEPEAGSDF

SEQ ID NO: 45054 - protein, 8 aa, Mycobacterium avium
SEPEAGTD

SEQ ID NO: 45055 - protein, 7 aa, Mycobacterium avium
SEPELGS

SEQ ID NO: 45056 - protein, 7 aa, Mycobacterium avium
SEPERYA

SEQ ID NO: 45057 - protein, 10 aa, Mycobacterium avium
SEPESGSDLA

SEQ ID NO: 45058 - protein, 9 aa, Mycobacterium avium
SEPGAGSDL

SEQ ID NO: 45059 - protein, 20 aa, Mycobacterium avium
SEPGAGSDLASLTTTARLEG

SEQ ID NO: 45060 - protein, 9 aa, Mycobacterium avium
SEPGAGTDL

SEQ ID NO: 45061 - protein, 7 aa, Mycobacterium avium
SEPGGGG

SEQ ID NO: 45062 - protein, 8 aa, Mycobacterium avium
SEPGNAGT

SEQ ID NO: 45063 - protein, 20 aa, Mycobacterium avium
SEPGSGSDLASLTTRATQDG

SEQ ID NO: 45064 - protein, 5 aa, Mycobacterium avium
SEPHA

SEQ ID NO: 45065 - protein, 9 aa, Mycobacterium avium
SEPTAAPAD

SEQ ID NO: 45066 - protein, 13 aa, Mycobacterium avium
SEPYDDDSDWEDV

SEQ ID NO: 45067 - protein, 13 aa, Mycobacterium avium
SEQAGAASGLTPR

SEQ ID NO: 45068 - protein, 7 aa, Mycobacterium avium
SEQDRDV

SEQ ID NO: 45069 - protein, 19 aa, Mycobacterium avium
SEQNDPNMLSPEGKSRRFA

SEQ ID NO: 45070 - protein, 5 aa, Mycobacterium avium
SEREA

SEQ ID NO: 45071 - protein, 21 aa, Mycobacterium avium
SEREAGSDAASMRTRARADGD

SEQ ID NO: 45072 - protein, 15 aa, Mycobacterium avium
SERGSQHSAAATKGV

SEQ ID NO: 45073 - protein, 7 aa, Mycobacterium avium
SERPADR

SEQ ID NO: 45074 - protein, 7 aa, Mycobacterium avium
SERTGSV

SEQ ID NO: 45075 - protein, 15 aa, Mycobacterium avium
SERYTEKLATPDTSV

SEQ ID NO: 45076 - protein, 4 aa, Mycobacterium avium
SESA

SEQ ID NO: 45077 - protein, 11 aa, Mycobacterium avium
SESAPLTLQGP

SEQ ID NO: 45078 - protein, 9 aa, Mycobacterium avium
SESEADQTR

SEQ ID NO: 45079 - protein, 4 aa, Mycobacterium avium
SESH

SEQ ID NO: 45080 - protein, 4 aa, Mycobacterium avium
SESI

SEQ ID NO: 45081 - protein, 7 aa, Mycobacterium avium
SESNPLE

SEQ ID NO: 45082 - protein, 9 aa, Mycobacterium avium
SESPASGLV

SEQ ID NO: 45083 - protein, 5 aa, Mycobacterium avium
SESTV

SEQ ID NO: 45084 - protein, 7 aa, Mycobacterium avium
SETAELA

SEQ ID NO: 45085 - protein, 10 aa, Mycobacterium avium
SETDPAVSEA

SEQ ID NO: 45086 - protein, 8 aa, Mycobacterium avium
SETEPAGG

SEQ ID NO: 45087 - protein, 4 aa, Mycobacterium avium
SETI

SEQ ID NO: 45088 - protein, 13 aa, Mycobacterium avium
SETVTAPRGGTMG

SEQ ID NO: 45089 - protein, 5 aa, Mycobacterium avium
SEVAG

SEQ ID NO: 45090 - protein, 5 aa, Mycobacterium avium
SEVAP

SEQ ID NO: 45091 - protein, 11 aa, Mycobacterium avium
SEVGKRGEAGA

SEQ ID NO: 45092 - protein, 12 aa, Mycobacterium avium
SEVKAGRGSPHG

SEQ ID NO: 45093 - protein, 6 aa, Mycobacterium avium
SEVPSR

SEQ ID NO: 45094 - protein, 5 aa, Mycobacterium avium
SEVTA

SEQ ID NO: 45095 - protein, 14 aa, Mycobacterium avium
SEYEDRDGNRRSSL

SEQ ID NO: 45096 - protein, 9 aa, Mycobacterium avium
SFAENATAP

SEQ ID NO: 45097 - protein, 5 aa, Mycobacterium avium
SFDEK

SEQ ID NO: 45098 - protein, 10 aa, Mycobacterium avium
SFEPADTEEW

SEQ ID NO: 45099 - protein, 5 aa, Mycobacterium avium
SFLSP

SEQ ID NO: 45100 - protein, 6 aa, Mycobacterium avium
SFPPGG

SEQ ID NO: 45101 - protein, 9 aa, Mycobacterium avium
SFRRPGPPF

SEQ ID NO: 45102 - protein, 7 aa, Mycobacterium avium
SFSPSGK

SEQ ID NO: 45103 - protein, 12 aa, Mycobacterium avium
SFTSGDNRLDGQ

SEQ ID NO: 45104 - protein, 6 aa, Mycobacterium avium
SFYTGR

SEQ ID NO: 45105 - protein, 7 aa, Mycobacterium avium
SGAADPR

SEQ ID NO: 45106 - protein, 8 aa, Mycobacterium avium
SGAAPRAG

SEQ ID NO: 45107 - protein, 5 aa, Mycobacterium avium
SGADD

SEQ ID NO: 45108 - protein, 6 aa, Mycobacterium avium
SGADRN

SEQ ID NO: 45109 - protein, 6 aa, Mycobacterium avium
SGAGAS

SEQ ID NO: 45110 - protein, 7 aa, Mycobacterium avium
SGAGERA

SEQ ID NO: 45111 - protein, 10 aa, Mycobacterium avium
SGAGGGRDAE

SEQ ID NO: 45112 - protein, 8 aa, Mycobacterium avium
SGAGGVDA

SEQ ID NO: 45113 - protein, 9 aa, Mycobacterium avium
SGAGRGTAA

SEQ ID NO: 45114 - protein, 7 aa, Mycobacterium avium
SGAGRPP

SEQ ID NO: 45115 - protein, 8 aa, Mycobacterium avium
SGAGRTEL

SEQ ID NO: 45116 - protein, 10 aa, Mycobacterium avium
SGAGSISGSD

SEQ ID NO: 45117 - protein, 19 aa, Mycobacterium avium
SGAGSSGSSSSSSGSSALS

SEQ ID NO: 45118 - protein, 7 aa, Mycobacterium avium
SGAHPGM

SEQ ID NO: 45119 - protein, 16 aa, Mycobacterium avium
SGAKVGSKGRPLPGAG

SEQ ID NO: 45120 - protein, 6 aa, Mycobacterium avium
SGALEA

SEQ ID NO: 45121 - protein, 9 aa, Mycobacterium avium
SGANNNERH

SEQ ID NO: 45122 - protein, 6 aa, Mycobacterium avium
SGAPTH

SEQ ID NO: 45123 - protein, 4 aa, Mycobacterium avium
SGAR

SEQ ID NO: 45124 - protein, 12 aa, Mycobacterium avium
SGARHRGDRGAL

SEQ ID NO: 45125 - protein, 11 aa, Mycobacterium avium
SGATALANDQP

SEQ ID NO: 45126 - protein, 8 aa, Mycobacterium avium
SGATEFAA

SEQ ID NO: 45127 - protein, 10 aa, Mycobacterium avium
SGATGNFTQT

SEQ ID NO: 45128 - protein, 8 aa, Mycobacterium avium
SGATQSMP

SEQ ID NO: 45129 - protein, 8 aa, Mycobacterium avium
SGATSQRP

SEQ ID NO: 45130 - protein, 7 aa, Mycobacterium avium
SGCGKTT

SEQ ID NO: 45131 - protein, 8 aa, Mycobacterium avium
SGCGKTTS

SEQ ID NO: 45132 - protein, 9 aa, Mycobacterium avium
SGCGQWPGS

SEQ ID NO: 45133 - protein, 5 aa, Mycobacterium avium
SGDAA

SEQ ID NO: 45134 - protein, 8 aa, Mycobacterium avium
SGDAEAQA

SEQ ID NO: 45135 - protein, 6 aa, Mycobacterium avium
SGDARE

SEQ ID NO: 45136 - protein, 7 aa, Mycobacterium avium
SGDHAST

SEQ ID NO: 45137 - protein, 8 aa, Mycobacterium avium
SGDIATAR

SEQ ID NO: 45138 - protein, 8 aa, Mycobacterium avium
SGDPQTGP

SEQ ID NO: 45139 - protein, 7 aa, Mycobacterium avium
SGDPTVG

SEQ ID NO: 45140 - protein, 7 aa, Mycobacterium avium
SGDPTWP

SEQ ID NO: 45141 - protein, 6 aa, Mycobacterium avium
SGDPYL

SEQ ID NO: 45142 - protein, 8 aa, Mycobacterium avium
SGDQRQER

SEQ ID NO: 45143 - protein, 6 aa, Mycobacterium avium
SGDSVD

SEQ ID NO: 45144 - protein, 7 aa, Mycobacterium avium
SGDTGAC

SEQ ID NO: 45145 - protein, 5 aa, Mycobacterium avium
SGDVS

SEQ ID NO: 45146 - protein, 8 aa, Mycobacterium avium
SGEAKWGQ

SEQ ID NO: 45147 - protein, 5 aa, Mycobacterium avium
SGEAL

SEQ ID NO: 45148 - protein, 4 aa, Mycobacterium avium
SGED

SEQ ID NO: 45149 - protein, 4 aa, Mycobacterium avium
SGEF

SEQ ID NO: 45150 - protein, 7 aa, Mycobacterium avium
SGEGAAL

SEQ ID NO: 45151 - protein, 7 aa, Mycobacterium avium
SGEINGT

SEQ ID NO: 45152 - protein, 12 aa, Mycobacterium avium
SGEINSRQLPEN

SEQ ID NO: 45153 - protein, 4 aa, Mycobacterium avium
SGEP

SEQ ID NO: 45154 - protein, 7 aa, Mycobacterium avium
SGEPFDA

SEQ ID NO: 45155 - protein, 9 aa, Mycobacterium avium
SGEPIGPKA

SEQ ID NO: 45156 - protein, 11 aa, Mycobacterium avium
SGEQPVPLPPG

SEQ ID NO: 45157 - protein, 7 aa, Mycobacterium avium
SGEQRSS

SEQ ID NO: 45158 - protein, 9 aa, Mycobacterium avium
SGESENTVP

SEQ ID NO: 45159 - protein, 12 aa, Mycobacterium avium
SGEWTGATGKRI

SEQ ID NO: 45160 - protein, 8 aa, Mycobacterium avium
SGFGGGGH

SEQ ID NO: 45161 - protein, 7 aa, Mycobacterium avium
SGFRPGQ

SEQ ID NO: 45162 - protein, 9 aa, Mycobacterium avium
SGGADLPTQ

SEQ ID NO: 45163 - protein, 12 aa, Mycobacterium avium
SGGADPAVRAAR

SEQ ID NO: 45164 - protein, 8 aa, Mycobacterium avium
SGGAGAAE

SEQ ID NO: 45165 - protein, 7 aa, Mycobacterium avium
SGGAGLT

SEQ ID NO: 45166 - protein, 16 aa, Mycobacterium avium
SGGAGTAGMTPAGENA

SEQ ID NO: 45167 - protein, 22 aa, Mycobacterium avium
SGGANACTGPGGFQDAHATAEA

SEQ ID NO: 45168 - protein, 6 aa, Mycobacterium avium
SGGEAQ

SEQ ID NO: 45169 - protein, 8 aa, Mycobacterium avium
SGGEDAGK

SEQ ID NO: 45170 - protein, 8 aa, Mycobacterium avium
SGGENSYP

SEQ ID NO: 45171 - protein, 13 aa, Mycobacterium avium
SGGEPGGNGHRPL

SEQ ID NO: 45172 - protein, 15 aa, Mycobacterium avium
SGGGAQAVTGPAPTR

SEQ ID NO: 45173 - protein, 7 aa, Mycobacterium avium
SGGGGMT

SEQ ID NO: 45174 - protein, 5 aa, Mycobacterium avium
SGGGN

SEQ ID NO: 45175 - protein, 7 aa, Mycobacterium avium
SGGGNRL

SEQ ID NO: 45176 - protein, 8 aa, Mycobacterium avium
SGGGPYAL

SEQ ID NO: 45177 - protein, 5 aa, Mycobacterium avium
SGGGR

SEQ ID NO: 45178 - protein, 6 aa, Mycobacterium avium
SGGGRR

SEQ ID NO: 45179 - protein, 5 aa, Mycobacterium avium
SGGGV

SEQ ID NO: 45180 - protein, 6 aa, Mycobacterium avium
SGGHAE

SEQ ID NO: 45181 - protein, 8 aa, Mycobacterium avium
SGGHASRD

SEQ ID NO: 45182 - protein, 6 aa, Mycobacterium avium
SGGKAI

SEQ ID NO: 45183 - protein, 4 aa, Mycobacterium avium
SGGL

SEQ ID NO: 45184 - protein, 7 aa, Mycobacterium avium
SGGLSLE

SEQ ID NO: 45185 - protein, 15 aa, Mycobacterium avium
SGGLTPSGVILLRAD

SEQ ID NO: 45186 - protein, 5 aa, Mycobacterium avium
SGGMT

SEQ ID NO: 45187 - protein, 18 aa, Mycobacterium avium
SGGNVSSEHGVGSRKRPY

SEQ ID NO: 45188 - protein, 4 aa, Mycobacterium avium
SGGP

SEQ ID NO: 45189 - protein, 13 aa, Mycobacterium avium
SGGPGATGRSYSD

SEQ ID NO: 45190 - protein, 8 aa, Mycobacterium avium
SGGQAQRV

SEQ ID NO: 45191 - protein, 5 aa, Mycobacterium avium
SGGQT

SEQ ID NO: 45192 - protein, 8 aa, Mycobacterium avium
SGGRITQE

SEQ ID NO: 45193 - protein, 8 aa, Mycobacterium avium
SGGSEASA

SEQ ID NO: 45194 - protein, 8 aa, Mycobacterium avium
SGGTADPV

SEQ ID NO: 45195 - protein, 9 aa, Mycobacterium avium
SGGTAPAAV

SEQ ID NO: 45196 - protein, 16 aa, Mycobacterium avium
SGGTGIAPTDSTPDQT

SEQ ID NO: 45197 - protein, 11 aa, Mycobacterium avium
SGGVGVTDTTF

SEQ ID NO: 45198 - protein, 7 aa, Mycobacterium avium
SGGVSSL

SEQ ID NO: 45199 - protein, 9 aa, Mycobacterium avium
SGGYAKRTA

SEQ ID NO: 45200 - protein, 4 aa, Mycobacterium avium
SGHA

SEQ ID NO: 45201 - protein, 6 aa, Mycobacterium avium
SGHAFG

SEQ ID NO: 45202 - protein, 6 aa, Mycobacterium avium
SGHGAQ

SEQ ID NO: 45203 - protein, 5 aa, Mycobacterium avium
SGHGR

SEQ ID NO: 45204 - protein, 5 aa, Mycobacterium avium
SGHLN

SEQ ID NO: 45205 - protein, 5 aa, Mycobacterium avium
SGHPG

SEQ ID NO: 45206 - protein, 6 aa, Mycobacterium avium
SGHRDE

SEQ ID NO: 45207 - protein, 11 aa, Mycobacterium avium
SGHSVQSDQPR

SEQ ID NO: 45208 - protein, 14 aa, Mycobacterium avium
SGIDAATGATSGPA

SEQ ID NO: 45209 - protein, 12 aa, Mycobacterium avium
SGIENTPPTDRI

SEQ ID NO: 45210 - protein, 5 aa, Mycobacterium avium
SGIGE

SEQ ID NO: 45211 - protein, 6 aa, Mycobacterium avium
SGINPD

SEQ ID NO: 45212 - protein, 5 aa, Mycobacterium avium
SGIPR

SEQ ID NO: 45213 - protein, 15 aa, Mycobacterium avium
SGIRGTPGAAPYSAS

SEQ ID NO: 45214 - protein, 4 aa, Mycobacterium avium
SGIT

SEQ ID NO: 45215 - protein, 16 aa, Mycobacterium avium
SGITDPSHERYKEAAE

SEQ ID NO: 45216 - protein, 6 aa, Mycobacterium avium
SGITPN

SEQ ID NO: 45217 - protein, 8 aa, Mycobacterium avium
SGKGEELY

SEQ ID NO: 45218 - protein, 11 aa, Mycobacterium avium
SGKGGVGKSTV

SEQ ID NO: 45219 - protein, 5 aa, Mycobacterium avium
SGKGT

SEQ ID NO: 45220 - protein, 9 aa, Mycobacterium avium
SGKKQRGEP

SEQ ID NO: 45221 - protein, 6 aa, Mycobacterium avium
SGKNFS

SEQ ID NO: 45222 - protein, 7 aa, Mycobacterium avium
SGKPIER

SEQ ID NO: 45223 - protein, 9 aa, Mycobacterium avium
SGKPSKDDL

SEQ ID NO: 45224 - protein, 7 aa, Mycobacterium avium
SGKQIPA

SEQ ID NO: 45225 - protein, 6 aa, Mycobacterium avium
SGLAET

SEQ ID NO: 45226 - protein, 7 aa, Mycobacterium avium
SGLARTG

SEQ ID NO: 45227 - protein, 6 aa, Mycobacterium avium
SGLEAD

SEQ ID NO: 45228 - protein, 8 aa, Mycobacterium avium
SGLHSNGY

SEQ ID NO: 45229 - protein, 4 aa, Mycobacterium avium
SGLN

SEQ ID NO: 45230 - protein, 14 aa, Mycobacterium avium
SGLRGRGGAGFSTG

SEQ ID NO: 45231 - protein, 6 aa, Mycobacterium avium
SGLSTE

SEQ ID NO: 45232 - protein, 5 aa, Mycobacterium avium
SGLTN

SEQ ID NO: 45233 - protein, 10 aa, Mycobacterium avium
SGLVRPDDTE

SEQ ID NO: 45234 - protein, 5 aa, Mycobacterium avium
SGMAR

SEQ ID NO: 45235 - protein, 15 aa, Mycobacterium avium
SGMTTGMPTPTGKPQ

SEQ ID NO: 45236 - protein, 9 aa, Mycobacterium avium
SGNLRSAQR

SEQ ID NO: 45237 - protein, 7 aa, Mycobacterium avium
SGNSVGS

SEQ ID NO: 45238 - protein, 6 aa, Mycobacterium avium
SGNVGS

SEQ ID NO: 45239 - protein, 6 aa, Mycobacterium avium
SGNVSA

SEQ ID NO: 45240 - protein, 6 aa, Mycobacterium avium
SGPAAM

SEQ ID NO: 45241 - protein, 7 aa, Mycobacterium avium
SGPAGYT

SEQ ID NO: 45242 - protein, 6 aa, Mycobacterium avium
SGPELR

SEQ ID NO: 45243 - protein, 6 aa, Mycobacterium avium
SGPEPL

SEQ ID NO: 45244 - protein, 9 aa, Mycobacterium avium
SGPGAARPA

SEQ ID NO: 45245 - protein, 7 aa, Mycobacterium avium
SGPGRAQ

SEQ ID NO: 45246 - protein, 8 aa, Mycobacterium avium
SGPGSPSV

SEQ ID NO: 45247 - protein, 7 aa, Mycobacterium avium
SGPGVTG

SEQ ID NO: 45248 - protein, 6 aa, Mycobacterium avium
SGPGYA

SEQ ID NO: 45249 - protein, 4 aa, Mycobacterium avium
SGPQ

SEQ ID NO: 45250 - protein, 6 aa, Mycobacterium avium
SGQATV

SEQ ID NO: 45251 - protein, 7 aa, Mycobacterium avium
SGQDIPV

SEQ ID NO: 45252 - protein, 11 aa, Mycobacterium avium
SGQDTRRGTFS

SEQ ID NO: 45253 - protein, 11 aa, Mycobacterium avium
SGQGAIPYPDP

SEQ ID NO: 45254 - protein, 4 aa, Mycobacterium avium
SGQK

SEQ ID NO: 45255 - protein, 7 aa, Mycobacterium avium
SGQPDQR

SEQ ID NO: 45256 - protein, 5 aa, Mycobacterium avium
SGQTL

SEQ ID NO: 45257 - protein, 12 aa, Mycobacterium avium
SGQTPSTKSAKA

SEQ ID NO: 45258 - protein, 7 aa, Mycobacterium avium
SGRAGDK

SEQ ID NO: 45259 - protein, 23 aa, Mycobacterium avium
SGRAGVASTEQPADGEVPAGENL

SEQ ID NO: 45260 - protein, 18 aa, Mycobacterium avium
SGRALGTPPTAATAGAHA

SEQ ID NO: 45261 - protein, 5 aa, Mycobacterium avium
SGRDV

SEQ ID NO: 45262 - protein, 5 aa, Mycobacterium avium
SGRDY

SEQ ID NO: 45263 - protein, 5 aa, Mycobacterium avium
SGREP

SEQ ID NO: 45264 - protein, 11 aa, Mycobacterium avium
SGRGDKDVETA

SEQ ID NO: 45265 - protein, 43 aa, Mycobacterium avium
SGRGTDARLERTERVGAAERKAARRQRRTGDDAERGTTERGEN

SEQ ID NO: 45266 - protein, 11 aa, Mycobacterium avium
SGRHGDDAANT

SEQ ID NO: 45267 - protein, 4 aa, Mycobacterium avium
SGRK

SEQ ID NO: 45268 - protein, 9 aa, Mycobacterium avium
SGRKDEAAK

SEQ ID NO: 45269 - protein, 5 aa, Mycobacterium avium
SGRLA

SEQ ID NO: 45270 - protein, 6 aa, Mycobacterium avium
SGRNAG

SEQ ID NO: 45271 - protein, 9 aa, Mycobacterium avium
SGRPPELTG

SEQ ID NO: 45272 - protein, 9 aa, Mycobacterium avium
SGRPTRANF

SEQ ID NO: 45273 - protein, 18 aa, Mycobacterium avium
SGRPYRDVETEIALAFSR

SEQ ID NO: 45274 - protein, 6 aa, Mycobacterium avium
SGRQVG

SEQ ID NO: 45275 - protein, 7 aa, Mycobacterium avium
SGRREPN

SEQ ID NO: 45276 - protein, 8 aa, Mycobacterium avium
SGRRGPQA

SEQ ID NO: 45277 - protein, 5 aa, Mycobacterium avium
SGRRR

SEQ ID NO: 45278 - protein, 13 aa, Mycobacterium avium
SGRSKSEITEEEI

SEQ ID NO: 45279 - protein, 4 aa, Mycobacterium avium
SGRT

SEQ ID NO: 45280 - protein, 5 aa, Mycobacterium avium
SGRTA

SEQ ID NO: 45281 - protein, 7 aa, Mycobacterium avium
SGRTGVS

SEQ ID NO: 45282 - protein, 5 aa, Mycobacterium avium
SGRVP

SEQ ID NO: 45283 - protein, 12 aa, Mycobacterium avium
SGRVSDSGEGRW

SEQ ID NO: 45284 - protein, 7 aa, Mycobacterium avium
SGSAPLE

SEQ ID NO: 45285 - protein, 4 aa, Mycobacterium avium
SGSD

SEQ ID NO: 45286 - protein, 10 aa, Mycobacterium avium
SGSDDGTAHE

SEQ ID NO: 45287 - protein, 9 aa, Mycobacterium avium
SGSGALRPA

SEQ ID NO: 45288 - protein, 7 aa, Mycobacterium avium
SGSGKSS

SEQ ID NO: 45289 - protein, 8 aa, Mycobacterium avium
SGSGKSSL

SEQ ID NO: 45290 - protein, 9 aa, Mycobacterium avium
SGSGKSTVA

SEQ ID NO: 45291 - protein, 17 aa, Mycobacterium avium
SGSHRGDPAQRRASQDA

SEQ ID NO: 45292 - protein, 17 aa, Mycobacterium avium
SGSITEAARRLMAHDDL

SEQ ID NO: 45293 - protein, 7 aa, Mycobacterium avium
SGSMSGL

SEQ ID NO: 45294 - protein, 8 aa, Mycobacterium avium
SGSPITIG

SEQ ID NO: 45295 - protein, 8 aa, Mycobacterium avium
SGSPRDIA

SEQ ID NO: 45296 - protein, 9 aa, Mycobacterium avium
SGSSLSAQA

SEQ ID NO: 45297 - protein, 5 aa, Mycobacterium avium
SGSSR

SEQ ID NO: 45298 - protein, 9 aa, Mycobacterium avium
SGSTAQQNA

SEQ ID NO: 45299 - protein, 9 aa, Mycobacterium avium
SGSTDDTEI

SEQ ID NO: 45300 - protein, 6 aa, Mycobacterium avium
SGSTEF

SEQ ID NO: 45301 - protein, 16 aa, Mycobacterium avium
SGSTGAPKGAMYPQSN

SEQ ID NO: 45302 - protein, 12 aa, Mycobacterium avium
SGSTGEPKGVEV

SEQ ID NO: 45303 - protein, 10 aa, Mycobacterium avium
SGSTGSPKAV

SEQ ID NO: 45304 - protein, 9 aa, Mycobacterium avium
SGSTSDPKG

SEQ ID NO: 45305 - protein, 5 aa, Mycobacterium avium
SGSVS

SEQ ID NO: 45306 - protein, 12 aa, Mycobacterium avium
SGTAEPDKDLTQ

SEQ ID NO: 45307 - protein, 6 aa, Mycobacterium avium
SGTALD

SEQ ID NO: 45308 - protein, 9 aa, Mycobacterium avium
SGTAPSGPF

SEQ ID NO: 45309 - protein, 4 aa, Mycobacterium avium
SGTC

SEQ ID NO: 45310 - protein, 7 aa, Mycobacterium avium
SGTDTDW

SEQ ID NO: 45311 - protein, 7 aa, Mycobacterium avium
SGTEATM

SEQ ID NO: 45312 - protein, 5 aa, Mycobacterium avium
SGTEL

SEQ ID NO: 45313 - protein, 8 aa, Mycobacterium avium
SGTGGQVD

SEQ ID NO: 45314 - protein, 5 aa, Mycobacterium avium
SGTGM

SEQ ID NO: 45315 - protein, 15 aa, Mycobacterium avium
SGTGVPTSGLILAPA

SEQ ID NO: 45316 - protein, 9 aa, Mycobacterium avium
SGTGYDRTY

SEQ ID NO: 45317 - protein, 7 aa, Mycobacterium avium
SGTPASE

SEQ ID NO: 45318 - protein, 6 aa, Mycobacterium avium
SGTPGA

SEQ ID NO: 45319 - protein, 6 aa, Mycobacterium avium
SGTPGF

SEQ ID NO: 45320 - protein, 7 aa, Mycobacterium avium
SGTREVT

SEQ ID NO: 45321 - protein, 14 aa, Mycobacterium avium
SGTSGAGRAAKTDL

SEQ ID NO: 45322 - protein, 8 aa, Mycobacterium avium
SGTTGEDR

SEQ ID NO: 45323 - protein, 9 aa, Mycobacterium avium
SGTTGNPKG

SEQ ID NO: 45324 - protein, 11 aa, Mycobacterium avium
SGTTGNPKGVE

SEQ ID NO: 45325 - protein, 11 aa, Mycobacterium avium
SGTTGPSKAVA

SEQ ID NO: 45326 - protein, 10 aa, Mycobacterium avium
SGTTGRPKAV

SEQ ID NO: 45327 - protein, 11 aa, Mycobacterium avium
SGTTGRPKGCQ

SEQ ID NO: 45328 - protein, 8 aa, Mycobacterium avium
SGTTGRSK

SEQ ID NO: 45329 - protein, 19 aa, Mycobacterium avium
SGTTMRSRGGPNRTAKAAR

SEQ ID NO: 45330 - protein, 8 aa, Mycobacterium avium
SGVADSTQ

SEQ ID NO: 45331 - protein, 12 aa, Mycobacterium avium
SGVAEAEIREHL

SEQ ID NO: 45332 - protein, 5 aa, Mycobacterium avium
SGVAG

SEQ ID NO: 45333 - protein, 11 aa, Mycobacterium avium
SGVAPDQVADS

SEQ ID NO: 45334 - protein, 17 aa, Mycobacterium avium
SGVDTDRFRPDPAGRAR

SEQ ID NO: 45335 - protein, 7 aa, Mycobacterium avium
SGVEAGS

SEQ ID NO: 45336 - protein, 12 aa, Mycobacterium avium
SGVEPQRRPHGA

SEQ ID NO: 45337 - protein, 9 aa, Mycobacterium avium
SGVGRQNGV

SEQ ID NO: 45338 - protein, 12 aa, Mycobacterium avium
SGVGSWPGTVAR

SEQ ID NO: 45339 - protein, 7 aa, Mycobacterium avium
SGVRGTG

SEQ ID NO: 45340 - protein, 8 aa, Mycobacterium avium
SGVTEPFS

SEQ ID NO: 45341 - protein, 6 aa, Mycobacterium avium
SGYDRE

SEQ ID NO: 45342 - protein, 4 aa, Mycobacterium avium
SGYG

SEQ ID NO: 45343 - protein, 12 aa, Mycobacterium avium
SGYQETLTDPSY

SEQ ID NO: 45344 - protein, 4 aa, Mycobacterium avium
SGYS

SEQ ID NO: 45345 - protein, 10 aa, Mycobacterium avium
SHAADGGRAD

SEQ ID NO: 45346 - protein, 6 aa, Mycobacterium avium
SHASAA

SEQ ID NO: 45347 - protein, 9 aa, Mycobacterium avium
SHATGRTLP

SEQ ID NO: 45348 - protein, 9 aa, Mycobacterium avium
SHDTHDAEA

SEQ ID NO: 45349 - protein, 7 aa, Mycobacterium avium
SHEGGIA

SEQ ID NO: 45350 - protein, 14 aa, Mycobacterium avium
SHERAAAAQDAGAF

SEQ ID NO: 45351 - protein, 4 aa, Mycobacterium avium
SHET

SEQ ID NO: 45352 - protein, 12 aa, Mycobacterium avium
SHFGGSTALSGG

SEQ ID NO: 45353 - protein, 8 aa, Mycobacterium avium
SHGRGGLA

SEQ ID NO: 45354 - protein, 9 aa, Mycobacterium avium
SHGTSTRGF

SEQ ID NO: 45355 - protein, 4 aa, Mycobacterium avium
SHGW

SEQ ID NO: 45356 - protein, 10 aa, Mycobacterium avium
SHNPPTDNGY

SEQ ID NO: 45357 - protein, 13 aa, Mycobacterium avium
SHPESDSVEVTYD

SEQ ID NO: 45358 - protein, 7 aa, Mycobacterium avium
SHPEYAT

SEQ ID NO: 45359 - protein, 10 aa, Mycobacterium avium
SHPPSPQQVE

SEQ ID NO: 45360 - protein, 11 aa, Mycobacterium avium
SHPVTTDGGTM

SEQ ID NO: 45361 - protein, 11 aa, Mycobacterium avium
SHQGGEQARHA

SEQ ID NO: 45362 - protein, 7 aa, Mycobacterium avium
SHRGTGA

SEQ ID NO: 45363 - protein, 12 aa, Mycobacterium avium
SHRNTGKACNET

SEQ ID NO: 45364 - protein, 8 aa, Mycobacterium avium
SHRNTGKV

SEQ ID NO: 45365 - protein, 4 aa, Mycobacterium avium
SHSE

SEQ ID NO: 45366 - protein, 6 aa, Mycobacterium avium
SHSGSL

SEQ ID NO: 45367 - protein, 6 aa, Mycobacterium avium
SHSPQV

SEQ ID NO: 45368 - protein, 6 aa, Mycobacterium avium
SHTFSA

SEQ ID NO: 45369 - protein, 13 aa, Mycobacterium avium
SHTSATETAFGPP

SEQ ID NO: 45370 - protein, 8 aa, Mycobacterium avium
SHTSTHGA

SEQ ID NO: 45371 - protein, 5 aa, Mycobacterium avium
SHYSD

SEQ ID NO: 45372 - protein, 5 aa, Mycobacterium avium
SIADE

SEQ ID NO: 45373 - protein, 4 aa, Mycobacterium avium
SIAG

SEQ ID NO: 45374 - protein, 5 aa, Mycobacterium avium
SIDRA

SEQ ID NO: 45375 - protein, 5 aa, Mycobacterium avium
SIEDD

SEQ ID NO: 45376 - protein, 11 aa, Mycobacterium avium
SIEQGNNDSHA

SEQ ID NO: 45377 - protein, 13 aa, Mycobacterium avium
SIGASKKDGQRAK

SEQ ID NO: 45378 - protein, 8 aa, Mycobacterium avium
SIGEPGTQ

SEQ ID NO: 45379 - protein, 11 aa, Mycobacterium avium
SIGPGGNSKRY

SEQ ID NO: 45380 - protein, 6 aa, Mycobacterium avium
SIGSSE

SEQ ID NO: 45381 - protein, 12 aa, Mycobacterium avium
SIGSSETGFGGT

SEQ ID NO: 45382 - protein, 6 aa, Mycobacterium avium
SIKANA

SEQ ID NO: 45383 - protein, 7 aa, Mycobacterium avium
SIKEAAA

SEQ ID NO: 45384 - protein, 7 aa, Mycobacterium avium
SIPAGGI

SEQ ID NO: 45385 - protein, 8 aa, Mycobacterium avium
SIPAPGLG

SEQ ID NO: 45386 - protein, 12 aa, Mycobacterium avium
SIPGNVADSNVD

SEQ ID NO: 45387 - protein, 5 aa, Mycobacterium avium
SIQPE

SEQ ID NO: 45388 - protein, 7 aa, Mycobacterium avium
SIRKTSA

SEQ ID NO: 45389 - protein, 12 aa, Mycobacterium avium
SIRSKGDSADGV

SEQ ID NO: 45390 - protein, 6 aa, Mycobacterium avium
SISPAA

SEQ ID NO: 45391 - protein, 7 aa, Mycobacterium avium
SITAGEI

SEQ ID NO: 45392 - protein, 6 aa, Mycobacterium avium
SITPED

SEQ ID NO: 45393 - protein, 13 aa, Mycobacterium avium
SITTFGPYSPGQA

SEQ ID NO: 45394 - protein, 20 aa, Mycobacterium avium
SIYGGSSEVQRNIIASTILG

SEQ ID NO: 45395 - protein, 7 aa, Mycobacterium avium
SKAALST

SEQ ID NO: 45396 - protein, 6 aa, Mycobacterium avium
SKADAD

SEQ ID NO: 45397 - protein, 10 aa, Mycobacterium avium
SKAEAASHLR

SEQ ID NO: 45398 - protein, 8 aa, Mycobacterium avium
SKAEIDTT

SEQ ID NO: 45399 - protein, 15 aa, Mycobacterium avium
SKAGAAAVRAKAEAA

SEQ ID NO: 45400 - protein, 7 aa, Mycobacterium avium
SKAGLNA

SEQ ID NO: 45401 - protein, 8 aa, Mycobacterium avium
SKAPRHQR

SEQ ID NO: 45402 - protein, 4 aa, Mycobacterium avium
SKAR

SEQ ID NO: 45403 - protein, 13 aa, Mycobacterium avium
SKASASTKAAATA

SEQ ID NO: 45404 - protein, 18 aa, Mycobacterium avium
SKASPGMQRQVDHALLTL

SEQ ID NO: 45405 - protein, 5 aa, Mycobacterium avium
SKATF

SEQ ID NO: 45406 - protein, 6 aa, Mycobacterium avium
SKATVA

SEQ ID NO: 45407 - protein, 5 aa, Mycobacterium avium
SKDAR

SEQ ID NO: 45408 - protein, 12 aa, Mycobacterium avium
SKDKPRKTVPAT

SEQ ID NO: 45409 - protein, 7 aa, Mycobacterium avium
SKESRRS

SEQ ID NO: 45410 - protein, 15 aa, Mycobacterium avium
SKGEAGTGDVSNATT

SEQ ID NO: 45411 - protein, 7 aa, Mycobacterium avium
SKGGYEA

SEQ ID NO: 45412 - protein, 4 aa, Mycobacterium avium
SKGV

SEQ ID NO: 45413 - protein, 9 aa, Mycobacterium avium
SKGYRGQRS

SEQ ID NO: 45414 - protein, 7 aa, Mycobacterium avium
SKITERT

SEQ ID NO: 45415 - protein, 7 aa, Mycobacterium avium
SKLEPTA

SEQ ID NO: 45416 - protein, 18 aa, Mycobacterium avium
SKLRQRTEGRLDRSRDPA

SEQ ID NO: 45417 - protein, 9 aa, Mycobacterium avium
SKNDQLKAD

SEQ ID NO: 45418 - protein, 8 aa, Mycobacterium avium
SKNIDQGV

SEQ ID NO: 45419 - protein, 8 aa, Mycobacterium avium
SKNPSDDL

SEQ ID NO: 45420 - protein, 5 aa, Mycobacterium avium
SKPGL

SEQ ID NO: 45421 - protein, 8 aa, Mycobacterium avium
SKPGTYGA

SEQ ID NO: 45422 - protein, 7 aa, Mycobacterium avium
SKPNLAA

SEQ ID NO: 45423 - protein, 6 aa, Mycobacterium avium
SKQGRF

SEQ ID NO: 45424 - protein, 7 aa, Mycobacterium avium
SKQKPYT

SEQ ID NO: 45425 - protein, 20 aa, Mycobacterium avium
SKQQRAQQGRYTLTPEGDAT

SEQ ID NO: 45426 - protein, 7 aa, Mycobacterium avium
SKQRGRF

SEQ ID NO: 45427 - protein, 6 aa, Mycobacterium avium
SKRGGG

SEQ ID NO: 45428 - protein, 8 aa, Mycobacterium avium
SKRSKRMT

SEQ ID NO: 45429 - protein, 14 aa, Mycobacterium avium
SKRTARSARILRFS

SEQ ID NO: 45430 - protein, 6 aa, Mycobacterium avium
SKSIRG

SEQ ID NO: 45431 - protein, 8 aa, Mycobacterium avium
SKSPRSTF

SEQ ID NO: 45432 - protein, 9 aa, Mycobacterium avium
SKSSSLAGY

SEQ ID NO: 45433 - protein, 4 aa, Mycobacterium avium
SKTF

SEQ ID NO: 45434 - protein, 7 aa, Mycobacterium avium
SKTPEQE

SEQ ID NO: 45435 - protein, 8 aa, Mycobacterium avium
SKTPESLM

SEQ ID NO: 45436 - protein, 8 aa, Mycobacterium avium
SKTPVPQG

SEQ ID NO: 45437 - protein, 7 aa, Mycobacterium avium
SKTPVTE

SEQ ID NO: 45438 - protein, 7 aa, Mycobacterium avium
SKTQQDA

SEQ ID NO: 45439 - protein, 8 aa, Mycobacterium avium
SKTTGIDE

SEQ ID NO: 45440 - protein, 7 aa, Mycobacterium avium
SKVPTTD

SEQ ID NO: 45441 - protein, 6 aa, Mycobacterium avium
SKVSDK

SEQ ID NO: 45442 - protein, 8 aa, Mycobacterium avium
SLAAANKG

SEQ ID NO: 45443 - protein, 6 aa, Mycobacterium avium
SLAGTQ

SEQ ID NO: 45444 - protein, 6 aa, Mycobacterium avium
SLAPGG

SEQ ID NO: 45445 - protein, 6 aa, Mycobacterium avium
SLATDS

SEQ ID NO: 45446 - protein, 6 aa, Mycobacterium avium
SLDAEY

SEQ ID NO: 45447 - protein, 7 aa, Mycobacterium avium
SLDPRDP

SEQ ID NO: 45448 - protein, 8 aa, Mycobacterium avium
SLDQGGPC

SEQ ID NO: 45449 - protein, 7 aa, Mycobacterium avium
SLDRPAL

SEQ ID NO: 45450 - protein, 12 aa, Mycobacterium avium
SLGAQSEQLPKI

SEQ ID NO: 45451 - protein, 5 aa, Mycobacterium avium
SLGDE

SEQ ID NO: 45452 - protein, 5 aa, Mycobacterium avium
SLGEG

SEQ ID NO: 45453 - protein, 8 aa, Mycobacterium avium
SLGENEQR

SEQ ID NO: 45454 - protein, 8 aa, Mycobacterium avium
SLGEPGGH

SEQ ID NO: 45455 - protein, 9 aa, Mycobacterium avium
SLGGGESDL

SEQ ID NO: 45456 - protein, 7 aa, Mycobacterium avium
SLGGGTA

SEQ ID NO: 45457 - protein, 11 aa, Mycobacterium avium
SLGGPETHHKK

SEQ ID NO: 45458 - protein, 4 aa, Mycobacterium avium
SLGH

SEQ ID NO: 45459 - protein, 12 aa, Mycobacterium avium
SLGHGSAKEYKH

SEQ ID NO: 45460 - protein, 8 aa, Mycobacterium avium
SLGPETTK

SEQ ID NO: 45461 - protein, 7 aa, Mycobacterium avium
SLGRGGG

SEQ ID NO: 45462 - protein, 8 aa, Mycobacterium avium
SLGRSEGA

SEQ ID NO: 45463 - protein, 7 aa, Mycobacterium avium
SLGSDNA

SEQ ID NO: 45464 - protein, 7 aa, Mycobacterium avium
SLHGGAN

SEQ ID NO: 45465 - protein, 8 aa, Mycobacterium avium
SLLGPDRP

SEQ ID NO: 45466 - protein, 7 aa, Mycobacterium avium
SLNDEEK

SEQ ID NO: 45467 - protein, 10 aa, Mycobacterium avium
SLPADQRRRD

SEQ ID NO: 45468 - protein, 9 aa, Mycobacterium avium
SLPAGPQGH

SEQ ID NO: 45469 - protein, 7 aa, Mycobacterium avium
SLPAGQS

SEQ ID NO: 45470 - protein, 11 aa, Mycobacterium avium
SLPAPEDPVRS

SEQ ID NO: 45471 - protein, 6 aa, Mycobacterium avium
SLPDQG

SEQ ID NO: 45472 - protein, 7 aa, Mycobacterium avium
SLPDSEI

SEQ ID NO: 45473 - protein, 5 aa, Mycobacterium avium
SLPEA

SEQ ID NO: 45474 - protein, 6 aa, Mycobacterium avium
SLPETR

SEQ ID NO: 45475 - protein, 6 aa, Mycobacterium avium
SLPGTG

SEQ ID NO: 45476 - protein, 6 aa, Mycobacterium avium
SLPNDS

SEQ ID NO: 45477 - protein, 5 aa, Mycobacterium avium
SLPPE

SEQ ID NO: 45478 - protein, 8 aa, Mycobacterium avium
SLPRRAAA

SEQ ID NO: 45479 - protein, 8 aa, Mycobacterium avium
SLPSGQDE

SEQ ID NO: 45480 - protein, 8 aa, Mycobacterium avium
SLPSRPAV

SEQ ID NO: 45481 - protein, 4 aa, Mycobacterium avium
SLPT

SEQ ID NO: 45482 - protein, 7 aa, Mycobacterium avium
SLQPNDT

SEQ ID NO: 45483 - protein, 4 aa, Mycobacterium avium
SLQT

SEQ ID NO: 45484 - protein, 13 aa, Mycobacterium avium
SLRPDGSSGAVSG

SEQ ID NO: 45485 - protein, 6 aa, Mycobacterium avium
SLRSGE

SEQ ID NO: 45486 - protein, 18 aa, Mycobacterium avium
SLSASASWAANGKITSDD

SEQ ID NO: 45487 - protein, 10 aa, Mycobacterium avium
SLSDGETRQS

SEQ ID NO: 45488 - protein, 9 aa, Mycobacterium avium
SLSGGAKEQ

SEQ ID NO: 45489 - protein, 13 aa, Mycobacterium avium
SLSGRGGDGPIAA

SEQ ID NO: 45490 - protein, 7 aa, Mycobacterium avium
SLSPGAT

SEQ ID NO: 45491 - protein, 13 aa, Mycobacterium avium
SLSSPVSPEAPLR

SEQ ID NO: 45492 - protein, 9 aa, Mycobacterium avium
SLSSRRRGL

SEQ ID NO: 45493 - protein, 10 aa, Mycobacterium avium
SLTGHAKGGA

SEQ ID NO: 45494 - protein, 6 aa, Mycobacterium avium
SLTSTD

SEQ ID NO: 45495 - protein, 19 aa, Mycobacterium avium
SLTVTRDGSRDAISNARPV

SEQ ID NO: 45496 - protein, 12 aa, Mycobacterium avium
SMGQEDDGLDRR

SEQ ID NO: 45497 - protein, 8 aa, Mycobacterium avium
SMHTSGRV

SEQ ID NO: 45498 - protein, 5 aa, Mycobacterium avium
SMNTP

SEQ ID NO: 45499 - protein, 9 aa, Mycobacterium avium
SMPPETSGF

SEQ ID NO: 45500 - protein, 6 aa, Mycobacterium avium
SMPYKG

SEQ ID NO: 45501 - protein, 5 aa, Mycobacterium avium
SMRSN

SEQ ID NO: 45502 - protein, 10 aa, Mycobacterium avium
SMTQAGQSDH

SEQ ID NO: 45503 - protein, 7 aa, Mycobacterium avium
SNAAGLG

SEQ ID NO: 45504 - protein, 9 aa, Mycobacterium avium
SNAASDMAS

SEQ ID NO: 45505 - protein, 13 aa, Mycobacterium avium
SNAEHSSTGLRSA

SEQ ID NO: 45506 - protein, 6 aa, Mycobacterium avium
SNAGNL

SEQ ID NO: 45507 - protein, 7 aa, Mycobacterium avium
SNAQTRE

SEQ ID NO: 45508 - protein, 8 aa, Mycobacterium avium
SNDAKEGA

SEQ ID NO: 45509 - protein, 6 aa, Mycobacterium avium
SNEAKA

SEQ ID NO: 45510 - protein, 8 aa, Mycobacterium avium
SNETVYGP

SEQ ID NO: 45511 - protein, 6 aa, Mycobacterium avium
SNFNNR

SEQ ID NO: 45512 - protein, 6 aa, Mycobacterium avium
SNGDGL

SEQ ID NO: 45513 - protein, 10 aa, Mycobacterium avium
SNGGHPRRAA

SEQ ID NO: 45514 - protein, 28 aa, Mycobacterium avium
SNGLGASVKRREDTHKMAEANRAFAHYR

SEQ ID NO: 45515 - protein, 12 aa, Mycobacterium avium
SNGPIDPSASVK

SEQ ID NO: 45516 - protein, 15 aa, Mycobacterium avium
SNHGGNNLDGTPASI

SEQ ID NO: 45517 - protein, 7 aa, Mycobacterium avium
SNITPAE

SEQ ID NO: 45518 - protein, 5 aa, Mycobacterium avium
SNPAD

SEQ ID NO: 45519 - protein, 9 aa, Mycobacterium avium
SNPAKVGRD

SEQ ID NO: 45520 - protein, 6 aa, Mycobacterium avium
SNPATI

SEQ ID NO: 45521 - protein, 7 aa, Mycobacterium avium
SNPAYSA

SEQ ID NO: 45522 - protein, 8 aa, Mycobacterium avium
SNPEIPPA

SEQ ID NO: 45523 - protein, 6 aa, Mycobacterium avium
SNPGRL

SEQ ID NO: 45524 - protein, 4 aa, Mycobacterium avium
SNPQ

SEQ ID NO: 45525 - protein, 15 aa, Mycobacterium avium
SNPSLGDQDDVHPHA

SEQ ID NO: 45526 - protein, 6 aa, Mycobacterium avium
SNPVRD

SEQ ID NO: 45527 - protein, 8 aa, Mycobacterium avium
SNQDKLRP

SEQ ID NO: 45528 - protein, 12 aa, Mycobacterium avium
SNRDGKPVASAA

SEQ ID NO: 45529 - protein, 5 aa, Mycobacterium avium
SNRHT

SEQ ID NO: 45530 - protein, 15 aa, Mycobacterium avium
SNRSDFAQVGRAESV

SEQ ID NO: 45531 - protein, 9 aa, Mycobacterium avium
SNSERIRGA

SEQ ID NO: 45532 - protein, 7 aa, Mycobacterium avium
SNSGPDR

SEQ ID NO: 45533 - protein, 15 aa, Mycobacterium avium
SNSRRRTADGGWEPG

SEQ ID NO: 45534 - protein, 5 aa, Mycobacterium avium
SNTTM

SEQ ID NO: 45535 - protein, 6 aa, Mycobacterium avium
SNVDTD

SEQ ID NO: 45536 - protein, 12 aa, Mycobacterium avium
SNVETDAQPDWV

SEQ ID NO: 45537 - protein, 6 aa, Mycobacterium avium
SNVPQS

SEQ ID NO: 45538 - protein, 8 aa, Mycobacterium avium
SNVQTGAV

SEQ ID NO: 45539 - protein, 5 aa, Mycobacterium avium
SNYGL

SEQ ID NO: 45540 - protein, 6 aa, Mycobacterium avium
SNYGSE

SEQ ID NO: 45541 - protein, 4 aa, Mycobacterium avium
SPAA

SEQ ID NO: 45542 - protein, 5 aa, Mycobacterium avium
SPAAA

SEQ ID NO: 45543 - protein, 8 aa, Mycobacterium avium
SPAAAEVN

SEQ ID NO: 45544 - protein, 5 aa, Mycobacterium avium
SPAAL

SEQ ID NO: 45545 - protein, 13 aa, Mycobacterium avium
SPAARAVAQASQQ

SEQ ID NO: 45546 - protein, 7 aa, Mycobacterium avium
SPADAAR

SEQ ID NO: 45547 - protein, 5 aa, Mycobacterium avium
SPADQ

SEQ ID NO: 45548 - protein, 4 aa, Mycobacterium avium
SPAG

SEQ ID NO: 45549 - protein, 23 aa, Mycobacterium avium
SPAGSRVAAETAPNHADERRQQM

SEQ ID NO: 45550 - protein, 5 aa, Mycobacterium avium
SPALQ

SEQ ID NO: 45551 - protein, 9 aa, Mycobacterium avium
SPANPTGTV

SEQ ID NO: 45552 - protein, 5 aa, Mycobacterium avium
SPAPC

SEQ ID NO: 45553 - protein, 5 aa, Mycobacterium avium
SPAPI

SEQ ID NO: 45554 - protein, 4 aa, Mycobacterium avium
SPAQ

SEQ ID NO: 45555 - protein, 7 aa, Mycobacterium avium
SPARSLR

SEQ ID NO: 45556 - protein, 9 aa, Mycobacterium avium
SPASNAVTG

SEQ ID NO: 45557 - protein, 6 aa, Mycobacterium avium
SPASRT

SEQ ID NO: 45558 - protein, 8 aa, Mycobacterium avium
SPATPTTA

SEQ ID NO: 45559 - protein, 5 aa, Mycobacterium avium
SPAVE

SEQ ID NO: 45560 - protein, 6 aa, Mycobacterium avium
SPAYAD

SEQ ID NO: 45561 - protein, 11 aa, Mycobacterium avium
SPDAQGARYYG

SEQ ID NO: 45562 - protein, 9 aa, Mycobacterium avium
SPDDRPALK

SEQ ID NO: 45563 - protein, 4 aa, Mycobacterium avium
SPDE

SEQ ID NO: 45564 - protein, 19 aa, Mycobacterium avium
SPDEYTGKRTHMPEYPEEG

SEQ ID NO: 45565 - protein, 10 aa, Mycobacterium avium
SPDGDPHAAR

SEQ ID NO: 45566 - protein, 12 aa, Mycobacterium avium
SPDGGDKPTGEL

SEQ ID NO: 45567 - protein, 6 aa, Mycobacterium avium
SPDISP

SEQ ID NO: 45568 - protein, 8 aa, Mycobacterium avium
SPDKPEKL

SEQ ID NO: 45569 - protein, 4 aa, Mycobacterium avium
SPDL

SEQ ID NO: 45570 - protein, 7 aa, Mycobacterium avium
SPDPGPV

SEQ ID NO: 45571 - protein, 8 aa, Mycobacterium avium
SPDPRAEA

SEQ ID NO: 45572 - protein, 8 aa, Mycobacterium avium
SPDPTRSA

SEQ ID NO: 45573 - protein, 4 aa, Mycobacterium avium
SPDQ

SEQ ID NO: 45574 - protein, 8 aa, Mycobacterium avium
SPDQAAAA

SEQ ID NO: 45575 - protein, 8 aa, Mycobacterium avium
SPDQGADP

SEQ ID NO: 45576 - protein, 6 aa, Mycobacterium avium
SPDQPM

SEQ ID NO: 45577 - protein, 5 aa, Mycobacterium avium
SPDSG

SEQ ID NO: 45578 - protein, 8 aa, Mycobacterium avium
SPDSTYVR

SEQ ID NO: 45579 - protein, 9 aa, Mycobacterium avium
SPDYADNTK

SEQ ID NO: 45580 - protein, 8 aa, Mycobacterium avium
SPEDEDRE

SEQ ID NO: 45581 - protein, 6 aa, Mycobacterium avium
SPEFGS

SEQ ID NO: 45582 - protein, 6 aa, Mycobacterium avium
SPEGDR

SEQ ID NO: 45583 - protein, 4 aa, Mycobacterium avium
SPEP

SEQ ID NO: 45584 - protein, 12 aa, Mycobacterium avium
SPEPKASDGLGV

SEQ ID NO: 45585 - protein, 5 aa, Mycobacterium avium
SPEPM

SEQ ID NO: 45586 - protein, 7 aa, Mycobacterium avium
SPERRAG

SEQ ID NO: 45587 - protein, 18 aa, Mycobacterium avium
SPESGWDRHGTEPPPPLP

SEQ ID NO: 45588 - protein, 9 aa, Mycobacterium avium
SPETTTGGK

SEQ ID NO: 45589 - protein, 14 aa, Mycobacterium avium
SPEWSGSETGGRRY

SEQ ID NO: 45590 - protein, 6 aa, Mycobacterium avium
SPEYEK

SEQ ID NO: 45591 - protein, 6 aa, Mycobacterium avium
SPFGQG

SEQ ID NO: 45592 - protein, 5 aa, Mycobacterium avium
SPFTD

SEQ ID NO: 45593 - protein, 6 aa, Mycobacterium avium
SPGARV

SEQ ID NO: 45594 - protein, 6 aa, Mycobacterium avium
SPGGGF

SEQ ID NO: 45595 - protein, 10 aa, Mycobacterium avium
SPGGHTSRPH

SEQ ID NO: 45596 - protein, 9 aa, Mycobacterium avium
SPGGRTEGN

SEQ ID NO: 45597 - protein, 7 aa, Mycobacterium avium
SPGGSIS

SEQ ID NO: 45598 - protein, 7 aa, Mycobacterium avium
SPGHTNG

SEQ ID NO: 45599 - protein, 13 aa, Mycobacterium avium
SPGMAKAKQSLRE

SEQ ID NO: 45600 - protein, 11 aa, Mycobacterium avium
SPGSRSDIGGA

SEQ ID NO: 45601 - protein, 4 aa, Mycobacterium avium
SPGV

SEQ ID NO: 45602 - protein, 6 aa, Mycobacterium avium
SPGVDT

SEQ ID NO: 45603 - protein, 5 aa, Mycobacterium avium
SPHAD

SEQ ID NO: 45604 - protein, 6 aa, Mycobacterium avium
SPHGGL

SEQ ID NO: 45605 - protein, 8 aa, Mycobacterium avium
SPHNPTGT

SEQ ID NO: 45606 - protein, 8 aa, Mycobacterium avium
SPHNRNAL

SEQ ID NO: 45607 - protein, 7 aa, Mycobacterium avium
SPHPAAL

SEQ ID NO: 45608 - protein, 10 aa, Mycobacterium avium
SPHPSPLSAS

SEQ ID NO: 45609 - protein, 6 aa, Mycobacterium avium
SPIGKR

SEQ ID NO: 45610 - protein, 16 aa, Mycobacterium avium
SPIGRERKTEELSRAS

SEQ ID NO: 45611 - protein, 6 aa, Mycobacterium avium
SPIGTG

SEQ ID NO: 45612 - protein, 15 aa, Mycobacterium avium
SPIPPNKPNIREDEA

SEQ ID NO: 45613 - protein, 11 aa, Mycobacterium avium
SPKAARLGAQE

SEQ ID NO: 45614 - protein, 6 aa, Mycobacterium avium
SPKGSA

SEQ ID NO: 45615 - protein, 6 aa, Mycobacterium avium
SPKRLP

SEQ ID NO: 45616 - protein, 7 aa, Mycobacterium avium
SPLPPGV

SEQ ID NO: 45617 - protein, 6 aa, Mycobacterium avium
SPLRDA

SEQ ID NO: 45618 - protein, 14 aa, Mycobacterium avium
SPLTPDHVNPERPW

SEQ ID NO: 45619 - protein, 10 aa, Mycobacterium avium
SPNALGDPSV

SEQ ID NO: 45620 - protein, 11 aa, Mycobacterium avium
SPNNPSGQSVS

SEQ ID NO: 45621 - protein, 4 aa, Mycobacterium avium
SPNT

SEQ ID NO: 45622 - protein, 10 aa, Mycobacterium avium
SPPARLPQTS

SEQ ID NO: 45623 - protein, 8 aa, Mycobacterium avium
SPPETVKG

SEQ ID NO: 45624 - protein, 4 aa, Mycobacterium avium
SPPF

SEQ ID NO: 45625 - protein, 9 aa, Mycobacterium avium
SPPGGRREL

SEQ ID NO: 45626 - protein, 9 aa, Mycobacterium avium
SPPKAGKTT

SEQ ID NO: 45627 - protein, 9 aa, Mycobacterium avium
SPPPETVDD

SEQ ID NO: 45628 - protein, 5 aa, Mycobacterium avium
SPPPH

SEQ ID NO: 45629 - protein, 7 aa, Mycobacterium avium
SPPQAQF

SEQ ID NO: 45630 - protein, 21 aa, Mycobacterium avium
SPPQQLPDDVARTQLEEFIIG

SEQ ID NO: 45631 - protein, 5 aa, Mycobacterium avium
SPPSV

SEQ ID NO: 45632 - protein, 6 aa, Mycobacterium avium
SPQACT

SEQ ID NO: 45633 - protein, 5 aa, Mycobacterium avium
SPQAF

SEQ ID NO: 45634 - protein, 4 aa, Mycobacterium avium
SPQL

SEQ ID NO: 45635 - protein, 6 aa, Mycobacterium avium
SPQPPS

SEQ ID NO: 45636 - protein, 6 aa, Mycobacterium avium
SPQRAY

SEQ ID NO: 45637 - protein, 7 aa, Mycobacterium avium
SPQRSRA

SEQ ID NO: 45638 - protein, 7 aa, Mycobacterium avium
SPQSIRD

SEQ ID NO: 45639 - protein, 6 aa, Mycobacterium avium
SPQSTV

SEQ ID NO: 45640 - protein, 4 aa, Mycobacterium avium
SPQY

SEQ ID NO: 45641 - protein, 6 aa, Mycobacterium avium
SPRDVA

SEQ ID NO: 45642 - protein, 8 aa, Mycobacterium avium
SPRGDTQW

SEQ ID NO: 45643 - protein, 17 aa, Mycobacterium avium
SPRIGPKRELKRATEGY

SEQ ID NO: 45644 - protein, 8 aa, Mycobacterium avium
SPRQRSLA

SEQ ID NO: 45645 - protein, 4 aa, Mycobacterium avium
SPSD

SEQ ID NO: 45646 - protein, 8 aa, Mycobacterium avium
SPSGPRLA

SEQ ID NO: 45647 - protein, 7 aa, Mycobacterium avium
SPSKPVG

SEQ ID NO: 45648 - protein, 4 aa, Mycobacterium avium
SPSL

SEQ ID NO: 45649 - protein, 5 aa, Mycobacterium avium
SPSNA

SEQ ID NO: 45650 - protein, 8 aa, Mycobacterium avium
SPSNPTGR

SEQ ID NO: 45651 - protein, 7 aa, Mycobacterium avium
SPSPSEG

SEQ ID NO: 45652 - protein, 25 aa, Mycobacterium avium
SPSPSKRRTATRDATLGGQSIKAGQ

SEQ ID NO: 45653 - protein, 11 aa, Mycobacterium avium
SPSRKFDGIPE

SEQ ID NO: 45654 - protein, 5 aa, Mycobacterium avium
SPSRS

SEQ ID NO: 45655 - protein, 5 aa, Mycobacterium avium
SPSSG

SEQ ID NO: 45656 - protein, 8 aa, Mycobacterium avium
SPTEVRTR

SEQ ID NO: 45657 - protein, 4 aa, Mycobacterium avium
SPTF

SEQ ID NO: 45658 - protein, 5 aa, Mycobacterium avium
SPTFG

SEQ ID NO: 45659 - protein, 5 aa, Mycobacterium avium
SPTKF

SEQ ID NO: 45660 - protein, 10 aa, Mycobacterium avium
SPTPASAGRV

SEQ ID NO: 45661 - protein, 19 aa, Mycobacterium avium
SPTPSARKDYIGGAAETAT

SEQ ID NO: 45662 - protein, 5 aa, Mycobacterium avium
SPTQR

SEQ ID NO: 45663 - protein, 11 aa, Mycobacterium avium
SPTRSGFGSQD

SEQ ID NO: 45664 - protein, 7 aa, Mycobacterium avium
SPVDSGN

SEQ ID NO: 45665 - protein, 6 aa, Mycobacterium avium
SPVGDL

SEQ ID NO: 45666 - protein, 6 aa, Mycobacterium avium
SPVGED

SEQ ID NO: 45667 - protein, 9 aa, Mycobacterium avium
SPVGGGGAL

SEQ ID NO: 45668 - protein, 14 aa, Mycobacterium avium
SPVSGGVGGAEQGT

SEQ ID NO: 45669 - protein, 7 aa, Mycobacterium avium
SPYATGV

SEQ ID NO: 45670 - protein, 7 aa, Mycobacterium avium
SPYDATV

SEQ ID NO: 45671 - protein, 6 aa, Mycobacterium avium
SPYENV

SEQ ID NO: 45672 - protein, 8 aa, Mycobacterium avium
SPYRTPQT

SEQ ID NO: 45673 - protein, 6 aa, Mycobacterium avium
SQAADR

SEQ ID NO: 45674 - protein, 5 aa, Mycobacterium avium
SQAAT

SEQ ID NO: 45675 - protein, 4 aa, Mycobacterium avium
SQAG

SEQ ID NO: 45676 - protein, 12 aa, Mycobacterium avium
SQAKAKQAWDEG

SEQ ID NO: 45677 - protein, 12 aa, Mycobacterium avium
SQASAAQRAGRC

SEQ ID NO: 45678 - protein, 8 aa, Mycobacterium avium
SQAYQGEE

SEQ ID NO: 45679 - protein, 6 aa, Mycobacterium avium
SQDEAS

SEQ ID NO: 45680 - protein, 6 aa, Mycobacterium avium
SQDEGL

SEQ ID NO: 45681 - protein, 5 aa, Mycobacterium avium
SQDHS

SEQ ID NO: 45682 - protein, 11 aa, Mycobacterium avium
SQDPDTPGLAE

SEQ ID NO: 45683 - protein, 5 aa, Mycobacterium avium
SQGAA

SEQ ID NO: 45684 - protein, 6 aa, Mycobacterium avium
SQGARV

SEQ ID NO: 45685 - protein, 8 aa, Mycobacterium avium
SQGETRPM

SEQ ID NO: 45686 - protein, 8 aa, Mycobacterium avium
SQGGRDKH

SEQ ID NO: 45687 - protein, 5 aa, Mycobacterium avium
SQGLA

SEQ ID NO: 45688 - protein, 13 aa, Mycobacterium avium
SQGLTGRGGDGSA

SEQ ID NO: 45689 - protein, 14 aa, Mycobacterium avium
SQGMSGGNHSELSR

SEQ ID NO: 45690 - protein, 7 aa, Mycobacterium avium
SQGRGGS

SEQ ID NO: 45691 - protein, 7 aa, Mycobacterium avium
SQGTKDY

SEQ ID NO: 45692 - protein, 4 aa, Mycobacterium avium
SQHG

SEQ ID NO: 45693 - protein, 4 aa, Mycobacterium avium
SQIG

SEQ ID NO: 45694 - protein, 10 aa, Mycobacterium avium
SQIGRSGPAA

SEQ ID NO: 45695 - protein, 6 aa, Mycobacterium avium
SQKAAL

SEQ ID NO: 45696 - protein, 7 aa, Mycobacterium avium
SQLGGRS

SEQ ID NO: 45697 - protein, 6 aa, Mycobacterium avium
SQLGGV

SEQ ID NO: 45698 - protein, 4 aa, Mycobacterium avium
SQLP

SEQ ID NO: 45699 - protein, 6 aa, Mycobacterium avium
SQLPTE

SEQ ID NO: 45700 - protein, 4 aa, Mycobacterium avium
SQLR

SEQ ID NO: 45701 - protein, 13 aa, Mycobacterium avium
SQLSSDTAQSEGL

SEQ ID NO: 45702 - protein, 8 aa, Mycobacterium avium
SQLSWEDP

SEQ ID NO: 45703 - protein, 6 aa, Mycobacterium avium
SQNADK

SEQ ID NO: 45704 - protein, 9 aa, Mycobacterium avium
SQNRAEEAI

SEQ ID NO: 45705 - protein, 9 aa, Mycobacterium avium
SQPDTGEQA

SEQ ID NO: 45706 - protein, 10 aa, Mycobacterium avium
SQPPEYGGRN

SEQ ID NO: 45707 - protein, 9 aa, Mycobacterium avium
SQPPNPKAT

SEQ ID NO: 45708 - protein, 6 aa, Mycobacterium avium
SQPPTL

SEQ ID NO: 45709 - protein, 6 aa, Mycobacterium avium
SQPTMT

SEQ ID NO: 45710 - protein, 13 aa, Mycobacterium avium
SQQPESSTQDSLN

SEQ ID NO: 45711 - protein, 6 aa, Mycobacterium avium
SQQPRR

SEQ ID NO: 45712 - protein, 7 aa, Mycobacterium avium
SQQSNTR

SEQ ID NO: 45713 - protein, 7 aa, Mycobacterium avium
SQQSPER

SEQ ID NO: 45714 - protein, 12 aa, Mycobacterium avium
SQRRVYPDPSPE

SEQ ID NO: 45715 - protein, 13 aa, Mycobacterium avium
SQSREERKEATRR

SEQ ID NO: 45716 - protein, 8 aa, Mycobacterium avium
SQSSREDR

SEQ ID NO: 45717 - protein, 8 aa, Mycobacterium avium
SQTASGAV

SEQ ID NO: 45718 - protein, 7 aa, Mycobacterium avium
SQTPSAL

SEQ ID NO: 45719 - protein, 6 aa, Mycobacterium avium
SQTTPD

SEQ ID NO: 45720 - protein, 8 aa, Mycobacterium avium
SQVGTQAT

SEQ ID NO: 45721 - protein, 6 aa, Mycobacterium avium
SQVPDD

SEQ ID NO: 45722 - protein, 12 aa, Mycobacterium avium
SQVTDGGDTIAS

SEQ ID NO: 45723 - protein, 6 aa, Mycobacterium avium
SQYENP

SEQ ID NO: 45724 - protein, 12 aa, Mycobacterium avium
SRAAAHGRDPEQ

SEQ ID NO: 45725 - protein, 9 aa, Mycobacterium avium
SRAAEGDDN

SEQ ID NO: 45726 - protein, 6 aa, Mycobacterium avium
SRAAHR

SEQ ID NO: 45727 - protein, 8 aa, Mycobacterium avium
SRADERDQ

SEQ ID NO: 45728 - protein, 4 aa, Mycobacterium avium
SRAE

SEQ ID NO: 45729 - protein, 8 aa, Mycobacterium avium
SRAEQHGW

SEQ ID NO: 45730 - protein, 15 aa, Mycobacterium avium
SRAETGDTLSDKSEP

SEQ ID NO: 45731 - protein, 4 aa, Mycobacterium avium
SRAF

SEQ ID NO: 45732 - protein, 9 aa, Mycobacterium avium
SRAGDHGVR

SEQ ID NO: 45733 - protein, 6 aa, Mycobacterium avium
SRAGGL

SEQ ID NO: 45734 - protein, 5 aa, Mycobacterium avium
SRAKD

SEQ ID NO: 45735 - protein, 5 aa, Mycobacterium avium
SRAPL

SEQ ID NO: 45736 - protein, 9 aa, Mycobacterium avium
SRAPSVHNT

SEQ ID NO: 45737 - protein, 8 aa, Mycobacterium avium
SRASGSDL

SEQ ID NO: 45738 - protein, 8 aa, Mycobacterium avium
SRATGTSV

SEQ ID NO: 45739 - protein, 8 aa, Mycobacterium avium
SRDALDSA

SEQ ID NO: 45740 - protein, 4 aa, Mycobacterium avium
SRDD

SEQ ID NO: 45741 - protein, 7 aa, Mycobacterium avium
SRDDATA

SEQ ID NO: 45742 - protein, 7 aa, Mycobacterium avium
SRDDGRA

SEQ ID NO: 45743 - protein, 6 aa, Mycobacterium avium
SRDEAS

SEQ ID NO: 45744 - protein, 6 aa, Mycobacterium avium
SRDERR

SEQ ID NO: 45745 - protein, 6 aa, Mycobacterium avium
SRDGER

SEQ ID NO: 45746 - protein, 10 aa, Mycobacterium avium
SRDGHDGEDL

SEQ ID NO: 45747 - protein, 9 aa, Mycobacterium avium
SRDKRESAE

SEQ ID NO: 45748 - protein, 5 aa, Mycobacterium avium
SRDLG

SEQ ID NO: 45749 - protein, 4 aa, Mycobacterium avium
SRDP

SEQ ID NO: 45750 - protein, 8 aa, Mycobacterium avium
SRDPVAAT

SEQ ID NO: 45751 - protein, 11 aa, Mycobacterium avium
SRDQGLRETTL

SEQ ID NO: 45752 - protein, 9 aa, Mycobacterium avium
SRDSDPAAV

SEQ ID NO: 45753 - protein, 4 aa, Mycobacterium avium
SRED

SEQ ID NO: 45754 - protein, 7 aa, Mycobacterium avium
SREDQDH

SEQ ID NO: 45755 - protein, 6 aa, Mycobacterium avium
SREEFD

SEQ ID NO: 45756 - protein, 6 aa, Mycobacterium avium
SREFPA

SEQ ID NO: 45757 - protein, 9 aa, Mycobacterium avium
SREGGRAAA

SEQ ID NO: 45758 - protein, 4 aa, Mycobacterium avium
SREL

SEQ ID NO: 45759 - protein, 10 aa, Mycobacterium avium
SRELSKAGVT

SEQ ID NO: 45760 - protein, 6 aa, Mycobacterium avium
SREQAI

SEQ ID NO: 45761 - protein, 6 aa, Mycobacterium avium
SREQVP

SEQ ID NO: 45762 - protein, 9 aa, Mycobacterium avium
SREREAFGR

SEQ ID NO: 45763 - protein, 5 aa, Mycobacterium avium
SRGAA

SEQ ID NO: 45764 - protein, 6 aa, Mycobacterium avium
SRGADL

SEQ ID NO: 45765 - protein, 20 aa, Mycobacterium avium
SRGAQKQADDIRRARETKAV

SEQ ID NO: 45766 - protein, 10 aa, Mycobacterium avium
SRGEDPTEAA

SEQ ID NO: 45767 - protein, 10 aa, Mycobacterium avium
SRGEREQLNG

SEQ ID NO: 45768 - protein, 5 aa, Mycobacterium avium
SRGFP

SEQ ID NO: 45769 - protein, 6 aa, Mycobacterium avium
SRGGDI

SEQ ID NO: 45770 - protein, 6 aa, Mycobacterium avium
SRGGSD

SEQ ID NO: 45771 - protein, 15 aa, Mycobacterium avium
SRGHGDSDRSPQADY

SEQ ID NO: 45772 - protein, 9 aa, Mycobacterium avium
SRGNGHARS

SEQ ID NO: 45773 - protein, 11 aa, Mycobacterium avium
SRHDLGNPGGY

SEQ ID NO: 45774 - protein, 13 aa, Mycobacterium avium
SRIANSPSAAHSR

SEQ ID NO: 45775 - protein, 22 aa, Mycobacterium avium
SRIDKTTAELADERNAVTQLGL

SEQ ID NO: 45776 - protein, 11 aa, Mycobacterium avium
SRKDQDGNDLP

SEQ ID NO: 45777 - protein, 8 aa, Mycobacterium avium
SRKETVGT

SEQ ID NO: 45778 - protein, 8 aa, Mycobacterium avium
SRKGDHNH

SEQ ID NO: 45779 - protein, 5 aa, Mycobacterium avium
SRKLA

SEQ ID NO: 45780 - protein, 22 aa, Mycobacterium avium
SRKLAGEPGLDGAPAPAEPMTE

SEQ ID NO: 45781 - protein, 8 aa, Mycobacterium avium
SRKTRHGR

SEQ ID NO: 45782 - protein, 10 aa, Mycobacterium avium
SRLRGATPEE

SEQ ID NO: 45783 - protein, 7 aa, Mycobacterium avium
SRMTGKP

SEQ ID NO: 45784 - protein, 5 aa, Mycobacterium avium
SRNPD

SEQ ID NO: 45785 - protein, 8 aa, Mycobacterium avium
SRNSSNSV

SEQ ID NO: 45786 - protein, 15 aa, Mycobacterium avium
SRPAPDDHSRRARTY

SEQ ID NO: 45787 - protein, 6 aa, Mycobacterium avium
SRPATD

SEQ ID NO: 45788 - protein, 9 aa, Mycobacterium avium
SRPDPTAKR

SEQ ID NO: 45789 - protein, 8 aa, Mycobacterium avium
SRPDSDSP

SEQ ID NO: 45790 - protein, 12 aa, Mycobacterium avium
SRPGNEHGFGKT

SEQ ID NO: 45791 - protein, 6 aa, Mycobacterium avium
SRPKPL

SEQ ID NO: 45792 - protein, 11 aa, Mycobacterium avium
SRPSGDEPGVR

SEQ ID NO: 45793 - protein, 5 aa, Mycobacterium avium
SRPVI

SEQ ID NO: 45794 - protein, 7 aa, Mycobacterium avium
SRQDGIA

SEQ ID NO: 45795 - protein, 8 aa, Mycobacterium avium
SRQDHGLD

SEQ ID NO: 45796 - protein, 4 aa, Mycobacterium avium
SRRA

SEQ ID NO: 45797 - protein, 10 aa, Mycobacterium avium
SRRDDDKARA

SEQ ID NO: 45798 - protein, 7 aa, Mycobacterium avium
SRREPGA

SEQ ID NO: 45799 - protein, 15 aa, Mycobacterium avium
SRRGGRGSVVPAGGA

SEQ ID NO: 45800 - protein, 17 aa, Mycobacterium avium
SRRGRPAPETAGEAGDG

SEQ ID NO: 45801 - protein, 6 aa, Mycobacterium avium
SRRGRT

SEQ ID NO: 45802 - protein, 7 aa, Mycobacterium avium
SRRGSGY

SEQ ID NO: 45803 - protein, 4 aa, Mycobacterium avium
SRRL

SEQ ID NO: 45804 - protein, 9 aa, Mycobacterium avium
SRRNSWQDI

SEQ ID NO: 45805 - protein, 8 aa, Mycobacterium avium
SRRPDGGF

SEQ ID NO: 45806 - protein, 8 aa, Mycobacterium avium
SRRPDRPG

SEQ ID NO: 45807 - protein, 5 aa, Mycobacterium avium
SRRPI

SEQ ID NO: 45808 - protein, 9 aa, Mycobacterium avium
SRRRRGPET

SEQ ID NO: 45809 - protein, 12 aa, Mycobacterium avium
SRRTRSSQDVST

SEQ ID NO: 45810 - protein, 6 aa, Mycobacterium avium
SRRYPD

SEQ ID NO: 45811 - protein, 7 aa, Mycobacterium avium
SRSAARM

SEQ ID NO: 45812 - protein, 18 aa, Mycobacterium avium
SRSADQIRAATESHTDPL

SEQ ID NO: 45813 - protein, 6 aa, Mycobacterium avium
SRSDTY

SEQ ID NO: 45814 - protein, 8 aa, Mycobacterium avium
SRSGEAGA

SEQ ID NO: 45815 - protein, 8 aa, Mycobacterium avium
SRSGPPQV

SEQ ID NO: 45816 - protein, 23 aa, Mycobacterium avium
SRSGPTTGTPVLPPDGIASATAA

SEQ ID NO: 45817 - protein, 17 aa, Mycobacterium avium
SRSHPWRRADGDGRIQD

SEQ ID NO: 45818 - protein, 6 aa, Mycobacterium avium
SRSNAQ

SEQ ID NO: 45819 - protein, 7 aa, Mycobacterium avium
SRSQGRK

SEQ ID NO: 45820 - protein, 11 aa, Mycobacterium avium
SRSQPGEQARR

SEQ ID NO: 45821 - protein, 6 aa, Mycobacterium avium
SRSRRR

SEQ ID NO: 45822 - protein, 8 aa, Mycobacterium avium
SRSSGNSF

SEQ ID NO: 45823 - protein, 6 aa, Mycobacterium avium
SRSTDF

SEQ ID NO: 45824 - protein, 9 aa, Mycobacterium avium
SRSTPRAGD

SEQ ID NO: 45825 - protein, 7 aa, Mycobacterium avium
SRSVGQG

SEQ ID NO: 45826 - protein, 5 aa, Mycobacterium avium
SRSVP

SEQ ID NO: 45827 - protein, 5 aa, Mycobacterium avium
SRTED

SEQ ID NO: 45828 - protein, 11 aa, Mycobacterium avium
SRTLGAAGRAQ

SEQ ID NO: 45829 - protein, 9 aa, Mycobacterium avium
SRTPGNGQV

SEQ ID NO: 45830 - protein, 6 aa, Mycobacterium avium
SRTPVE

SEQ ID NO: 45831 - protein, 6 aa, Mycobacterium avium
SRTSVP

SEQ ID NO: 45832 - protein, 6 aa, Mycobacterium avium
SRTTAA

SEQ ID NO: 45833 - protein, 5 aa, Mycobacterium avium
SRTTV

SEQ ID NO: 45834 - protein, 6 aa, Mycobacterium avium
SRVERA

SEQ ID NO: 45835 - protein, 13 aa, Mycobacterium avium
SRVGATGTAIKDD

SEQ ID NO: 45836 - protein, 5 aa, Mycobacterium avium
SRVGD

SEQ ID NO: 45837 - protein, 10 aa, Mycobacterium avium
SRVGGRQPAH

SEQ ID NO: 45838 - protein, 5 aa, Mycobacterium avium
SRVPL

SEQ ID NO: 45839 - protein, 17 aa, Mycobacterium avium
SRVTTDSANGQPNPASS

SEQ ID NO: 45840 - protein, 5 aa, Mycobacterium avium
SRYDE

SEQ ID NO: 45841 - protein, 8 aa, Mycobacterium avium
SRYPLDRG

SEQ ID NO: 45842 - protein, 7 aa, Mycobacterium avium
SRYRGDF

SEQ ID NO: 45843 - protein, 5 aa, Mycobacterium avium
SSADL

SEQ ID NO: 45844 - protein, 9 aa, Mycobacterium avium
SSADVERSE

SEQ ID NO: 45845 - protein, 6 aa, Mycobacterium avium
SSADVS

SEQ ID NO: 45846 - protein, 15 aa, Mycobacterium avium
SSADYSGNSAPVGSM

SEQ ID NO: 45847 - protein, 5 aa, Mycobacterium avium
SSAEE

SEQ ID NO: 45848 - protein, 6 aa, Mycobacterium avium
SSAFQR

SEQ ID NO: 45849 - protein, 8 aa, Mycobacterium avium
SSAGIKGT

SEQ ID NO: 45850 - protein, 6 aa, Mycobacterium avium
SSAKGD

SEQ ID NO: 45851 - protein, 8 aa, Mycobacterium avium
SSAPEDEL

SEQ ID NO: 45852 - protein, 13 aa, Mycobacterium avium
SSAPPGSGLGSSS

SEQ ID NO: 45853 - protein, 9 aa, Mycobacterium avium
SSAQRGSPF

SEQ ID NO: 45854 - protein, 6 aa, Mycobacterium avium
SSARAI

SEQ ID NO: 45855 - protein, 13 aa, Mycobacterium avium
SSASATSLGGDGF

SEQ ID NO: 45856 - protein, 7 aa, Mycobacterium avium
SSASSYR

SEQ ID NO: 45857 - protein, 9 aa, Mycobacterium avium
SSATTESES

SEQ ID NO: 45858 - protein, 9 aa, Mycobacterium avium
SSATTRSRP

SEQ ID NO: 45859 - protein, 11 aa, Mycobacterium avium
SSDAAAARSAA

SEQ ID NO: 45860 - protein, 5 aa, Mycobacterium avium
SSDEF

SEQ ID NO: 45861 - protein, 18 aa, Mycobacterium avium
SSDGHALGPADASAAKVY

SEQ ID NO: 45862 - protein, 4 aa, Mycobacterium avium
SSDH

SEQ ID NO: 45863 - protein, 7 aa, Mycobacterium avium
SSDISRA

SEQ ID NO: 45864 - protein, 4 aa, Mycobacterium avium
SSDL

SEQ ID NO: 45865 - protein, 15 aa, Mycobacterium avium
SSDPEQLSETEDKSM

SEQ ID NO: 45866 - protein, 17 aa, Mycobacterium avium
SSDSGYSRYTSEWDGAD

SEQ ID NO: 45867 - protein, 8 aa, Mycobacterium avium
SSDTTTDP

SEQ ID NO: 45868 - protein, 8 aa, Mycobacterium avium
SSEAATEV

SEQ ID NO: 45869 - protein, 7 aa, Mycobacterium avium
SSEAIGS

SEQ ID NO: 45870 - protein, 8 aa, Mycobacterium avium
SSEEDEPV

SEQ ID NO: 45871 - protein, 6 aa, Mycobacterium avium
SSEGNA

SEQ ID NO: 45872 - protein, 12 aa, Mycobacterium avium
SSEPDAGSDVGA

SEQ ID NO: 45873 - protein, 7 aa, Mycobacterium avium
SSETAAR

SEQ ID NO: 45874 - protein, 12 aa, Mycobacterium avium
SSETGKPRVHPD

SEQ ID NO: 45875 - protein, 5 aa, Mycobacterium avium
SSFRE

SEQ ID NO: 45876 - protein, 7 aa, Mycobacterium avium
SSFSGTE

SEQ ID NO: 45877 - protein, 7 aa, Mycobacterium avium
SSFYPGR

SEQ ID NO: 45878 - protein, 6 aa, Mycobacterium avium
SSGDPG

SEQ ID NO: 45879 - protein, 6 aa, Mycobacterium avium
SSGDVE

SEQ ID NO: 45880 - protein, 5 aa, Mycobacterium avium
SSGEM

SEQ ID NO: 45881 - protein, 14 aa, Mycobacterium avium
SSGGPDDATTHPIT

SEQ ID NO: 45882 - protein, 14 aa, Mycobacterium avium
SSGGPGLPAGGWTR

SEQ ID NO: 45883 - protein, 6 aa, Mycobacterium avium
SSGGTC

SEQ ID NO: 45884 - protein, 7 aa, Mycobacterium avium
SSGHAET

SEQ ID NO: 45885 - protein, 8 aa, Mycobacterium avium
SSGIGNPP

SEQ ID NO: 45886 - protein, 17 aa, Mycobacterium avium
SSGITGQTLDVNCGEYH

SEQ ID NO: 45887 - protein, 15 aa, Mycobacterium avium
SSGKGGQGVNTTDSA

SEQ ID NO: 45888 - protein, 13 aa, Mycobacterium avium
SSGKPGRDPEARR

SEQ ID NO: 45889 - protein, 5 aa, Mycobacterium avium
SSGKR

SEQ ID NO: 45890 - protein, 12 aa, Mycobacterium avium
SSGKRDPRELST

SEQ ID NO: 45891 - protein, 9 aa, Mycobacterium avium
SSGLDEEPE

SEQ ID NO: 45892 - protein, 19 aa, Mycobacterium avium
SSGNSGERGSADTARDNRG

SEQ ID NO: 45893 - protein, 7 aa, Mycobacterium avium
SSGQGRT

SEQ ID NO: 45894 - protein, 9 aa, Mycobacterium avium
SSGSGKTTA

SEQ ID NO: 45895 - protein, 10 aa, Mycobacterium avium
SSGSTRQPTG

SEQ ID NO: 45896 - protein, 5 aa, Mycobacterium avium
SSGTD

SEQ ID NO: 45897 - protein, 12 aa, Mycobacterium avium
SSGTTGRPKGIK

SEQ ID NO: 45898 - protein, 6 aa, Mycobacterium avium
SSGVDY

SEQ ID NO: 45899 - protein, 7 aa, Mycobacterium avium
SSHATHT

SEQ ID NO: 45900 - protein, 12 aa, Mycobacterium avium
SSITAPDGRPVN

SEQ ID NO: 45901 - protein, 5 aa, Mycobacterium avium
SSITQ

SEQ ID NO: 45902 - protein, 7 aa, Mycobacterium avium
SSKPYDK

SEQ ID NO: 45903 - protein, 10 aa, Mycobacterium avium
SSKRGGGSDK

SEQ ID NO: 45904 - protein, 9 aa, Mycobacterium avium
SSLTNNRSR

SEQ ID NO: 45905 - protein, 4 aa, Mycobacterium avium
SSNA

SEQ ID NO: 45906 - protein, 12 aa, Mycobacterium avium
SSNFRPPSDPDT

SEQ ID NO: 45907 - protein, 5 aa, Mycobacterium avium
SSNGV

SEQ ID NO: 45908 - protein, 10 aa, Mycobacterium avium
SSNQYGSPQA

SEQ ID NO: 45909 - protein, 17 aa, Mycobacterium avium
SSNSQIPPSTPDDLAET

SEQ ID NO: 45910 - protein, 6 aa, Mycobacterium avium
SSNTEP

SEQ ID NO: 45911 - protein, 11 aa, Mycobacterium avium
SSNTLHGGQET

SEQ ID NO: 45912 - protein, 9 aa, Mycobacterium avium
SSNTPVQQA

SEQ ID NO: 45913 - protein, 9 aa, Mycobacterium avium
SSNTVSTAH

SEQ ID NO: 45914 - protein, 6 aa, Mycobacterium avium
SSPDAM

SEQ ID NO: 45915 - protein, 8 aa, Mycobacterium avium
SSPEGCQT

SEQ ID NO: 45916 - protein, 5 aa, Mycobacterium avium
SSPGA

SEQ ID NO: 45917 - protein, 9 aa, Mycobacterium avium
SSPGAFGES

SEQ ID NO: 45918 - protein, 15 aa, Mycobacterium avium
SSPGYRAAAQRAAAG

SEQ ID NO: 45919 - protein, 6 aa, Mycobacterium avium
SSPHAW

SEQ ID NO: 45920 - protein, 5 aa, Mycobacterium avium
SSPHP

SEQ ID NO: 45921 - protein, 20 aa, Mycobacterium avium
SSPHSRNRSLGERLGRGATI

SEQ ID NO: 45922 - protein, 9 aa, Mycobacterium avium
SSPLAGNPD

SEQ ID NO: 45923 - protein, 5 aa, Mycobacterium avium
SSPNK

SEQ ID NO: 45924 - protein, 8 aa, Mycobacterium avium
SSPPSTSV

SEQ ID NO: 45925 - protein, 9 aa, Mycobacterium avium
SSPQRRAVQ

SEQ ID NO: 45926 - protein, 5 aa, Mycobacterium avium
SSPTG

SEQ ID NO: 45927 - protein, 6 aa, Mycobacterium avium
SSPTSM

SEQ ID NO: 45928 - protein, 4 aa, Mycobacterium avium
SSPW

SEQ ID NO: 45929 - protein, 5 aa, Mycobacterium avium
SSPWT

SEQ ID NO: 45930 - protein, 5 aa, Mycobacterium avium
SSPYQ

SEQ ID NO: 45931 - protein, 7 aa, Mycobacterium avium
SSQDDTR

SEQ ID NO: 45932 - protein, 11 aa, Mycobacterium avium
SSQQKAQDGKY

SEQ ID NO: 45933 - protein, 8 aa, Mycobacterium avium
SSQSTFGA

SEQ ID NO: 45934 - protein, 9 aa, Mycobacterium avium
SSRAAGGAS

SEQ ID NO: 45935 - protein, 11 aa, Mycobacterium avium
SSRDPQRPPVQ

SEQ ID NO: 45936 - protein, 5 aa, Mycobacterium avium
SSREA

SEQ ID NO: 45937 - protein, 6 aa, Mycobacterium avium
SSREPY

SEQ ID NO: 45938 - protein, 7 aa, Mycobacterium avium
SSRETVN

SEQ ID NO: 45939 - protein, 4 aa, Mycobacterium avium
SSRP

SEQ ID NO: 45940 - protein, 8 aa, Mycobacterium avium
SSRPEEVE

SEQ ID NO: 45941 - protein, 8 aa, Mycobacterium avium
SSRPGECE

SEQ ID NO: 45942 - protein, 9 aa, Mycobacterium avium
SSSAGDATL

SEQ ID NO: 45943 - protein, 5 aa, Mycobacterium avium
SSSAL

SEQ ID NO: 45944 - protein, 10 aa, Mycobacterium avium
SSSGRDDSYR

SEQ ID NO: 45945 - protein, 6 aa, Mycobacterium avium
SSSLGV

SEQ ID NO: 45946 - protein, 21 aa, Mycobacterium avium
SSSLSGDRRTYQQETGNSREA

SEQ ID NO: 45947 - protein, 9 aa, Mycobacterium avium
SSSPKACPG

SEQ ID NO: 45948 - protein, 7 aa, Mycobacterium avium
SSSSAAD

SEQ ID NO: 45949 - protein, 10 aa, Mycobacterium avium
SSSSTHSGAP

SEQ ID NO: 45950 - protein, 7 aa, Mycobacterium avium
SSTSASF

SEQ ID NO: 45951 - protein, 4 aa, Mycobacterium avium
SSVA

SEQ ID NO: 45952 - protein, 16 aa, Mycobacterium avium
SSVDGRSAAADGSSRW

SEQ ID NO: 45953 - protein, 9 aa, Mycobacterium avium
SSVDPDQAS

SEQ ID NO: 45954 - protein, 4 aa, Mycobacterium avium
SSVG

SEQ ID NO: 45955 - protein, 8 aa, Mycobacterium avium
SSVGSGVR

SEQ ID NO: 45956 - protein, 6 aa, Mycobacterium avium
SSVGTT

SEQ ID NO: 45957 - protein, 6 aa, Mycobacterium avium
SSWDDY

SEQ ID NO: 45958 - protein, 24 aa, Mycobacterium avium
SSYDGREPKRPRLQGVGSASGILD

SEQ ID NO: 45959 - protein, 8 aa, Mycobacterium avium
SSYGMSGT

SEQ ID NO: 45960 - protein, 4 aa, Mycobacterium avium
SSYR

SEQ ID NO: 45961 - protein, 5 aa, Mycobacterium avium
SSYTP

SEQ ID NO: 45962 - protein, 11 aa, Mycobacterium avium
SSYVGTQDPPV

SEQ ID NO: 45963 - protein, 8 aa, Mycobacterium avium
STAAESNA

SEQ ID NO: 45964 - protein, 20 aa, Mycobacterium avium
STAAQTGSPRQGHYSASKGG

SEQ ID NO: 45965 - protein, 4 aa, Mycobacterium avium
STAD

SEQ ID NO: 45966 - protein, 10 aa, Mycobacterium avium
STADDTTKTV

SEQ ID NO: 45967 - protein, 9 aa, Mycobacterium avium
STADFSGST

SEQ ID NO: 45968 - protein, 7 aa, Mycobacterium avium
STAEAVG

SEQ ID NO: 45969 - protein, 9 aa, Mycobacterium avium
STAEDPAEA

SEQ ID NO: 45970 - protein, 6 aa, Mycobacterium avium
STAESH

SEQ ID NO: 45971 - protein, 14 aa, Mycobacterium avium
STAGFAEGHPLPLG

SEQ ID NO: 45972 - protein, 9 aa, Mycobacterium avium
STAGPSAIR

SEQ ID NO: 45973 - protein, 7 aa, Mycobacterium avium
STAGTGY

SEQ ID NO: 45974 - protein, 7 aa, Mycobacterium avium
STAGVTA

SEQ ID NO: 45975 - protein, 12 aa, Mycobacterium avium
STAIGDEDPDFA

SEQ ID NO: 45976 - protein, 5 aa, Mycobacterium avium
STAIK

SEQ ID NO: 45977 - protein, 4 aa, Mycobacterium avium
STAK

SEQ ID NO: 45978 - protein, 11 aa, Mycobacterium avium
STALASPHPET

SEQ ID NO: 45979 - protein, 4 aa, Mycobacterium avium
STAM

SEQ ID NO: 45980 - protein, 7 aa, Mycobacterium avium
STAPGSW

SEQ ID NO: 45981 - protein, 6 aa, Mycobacterium avium
STASPP

SEQ ID NO: 45982 - protein, 5 aa, Mycobacterium avium
STASS

SEQ ID NO: 45983 - protein, 10 aa, Mycobacterium avium
STDDEGVPEE

SEQ ID NO: 45984 - protein, 10 aa, Mycobacterium avium
STDDPDEGEA

SEQ ID NO: 45985 - protein, 7 aa, Mycobacterium avium
STDGTPI

SEQ ID NO: 45986 - protein, 7 aa, Mycobacterium avium
STDGVGT

SEQ ID NO: 45987 - protein, 26 aa, Mycobacterium avium
STDRANAAALDESLDAADDEDVPDTG

SEQ ID NO: 45988 - protein, 6 aa, Mycobacterium avium
STDSND

SEQ ID NO: 45989 - protein, 15 aa, Mycobacterium avium
STDTRPEELKTQGVR

SEQ ID NO: 45990 - protein, 9 aa, Mycobacterium avium
STEKNRSRS

SEQ ID NO: 45991 - protein, 8 aa, Mycobacterium avium
STEQHGPH

SEQ ID NO: 45992 - protein, 17 aa, Mycobacterium avium
STEQSVTGGRETFGEPK

SEQ ID NO: 45993 - protein, 7 aa, Mycobacterium avium
STETHYE

SEQ ID NO: 45994 - protein, 7 aa, Mycobacterium avium
STFGGNP

SEQ ID NO: 45995 - protein, 9 aa, Mycobacterium avium
STGAATSRQ

SEQ ID NO: 45996 - protein, 6 aa, Mycobacterium avium
STGADV

SEQ ID NO: 45997 - protein, 5 aa, Mycobacterium avium
STGAQ

SEQ ID NO: 45998 - protein, 8 aa, Mycobacterium avium
STGAQGGC

SEQ ID NO: 45999 - protein, 5 aa, Mycobacterium avium
STGAR

SEQ ID NO: 46000 - protein, 9 aa, Mycobacterium avium
STGATHSQS

SEQ ID NO: 46001 - protein, 13 aa, Mycobacterium avium
STGAVSVTTPAGT

SEQ ID NO: 46002 - protein, 8 aa, Mycobacterium avium
STGDGRRG

SEQ ID NO: 46003 - protein, 10 aa, Mycobacterium avium
STGDGSGTTI

SEQ ID NO: 46004 - protein, 17 aa, Mycobacterium avium
STGDSGTGADVEKVRTA

SEQ ID NO: 46005 - protein, 6 aa, Mycobacterium avium
STGERG

SEQ ID NO: 46006 - protein, 5 aa, Mycobacterium avium
STGGH

SEQ ID NO: 46007 - protein, 11 aa, Mycobacterium avium
STGGIRPDQPG

SEQ ID NO: 46008 - protein, 7 aa, Mycobacterium avium
STGGRFA

SEQ ID NO: 46009 - protein, 13 aa, Mycobacterium avium
STGGWDDDGNPVH

SEQ ID NO: 46010 - protein, 16 aa, Mycobacterium avium
STGNTSASAAAYAARA

SEQ ID NO: 46011 - protein, 5 aa, Mycobacterium avium
STGPD

SEQ ID NO: 46012 - protein, 4 aa, Mycobacterium avium
STGQ

SEQ ID NO: 46013 - protein, 8 aa, Mycobacterium avium
STGQALPT

SEQ ID NO: 46014 - protein, 6 aa, Mycobacterium avium
STGRGA

SEQ ID NO: 46015 - protein, 5 aa, Mycobacterium avium
STGRR

SEQ ID NO: 46016 - protein, 7 aa, Mycobacterium avium
STGSTAK

SEQ ID NO: 46017 - protein, 6 aa, Mycobacterium avium
STGTQE

SEQ ID NO: 46018 - protein, 5 aa, Mycobacterium avium
STGVG

SEQ ID NO: 46019 - protein, 7 aa, Mycobacterium avium
STHPGTF

SEQ ID NO: 46020 - protein, 6 aa, Mycobacterium avium
STHQGK

SEQ ID NO: 46021 - protein, 6 aa, Mycobacterium avium
STIGSS

SEQ ID NO: 46022 - protein, 6 aa, Mycobacterium avium
STIPDY

SEQ ID NO: 46023 - protein, 11 aa, Mycobacterium avium
STIRTGRANPG

SEQ ID NO: 46024 - protein, 6 aa, Mycobacterium avium
STKAGL

SEQ ID NO: 46025 - protein, 12 aa, Mycobacterium avium
STKAKTTTAENI

SEQ ID NO: 46026 - protein, 14 aa, Mycobacterium avium
STKGLTVKADPSMG

SEQ ID NO: 46027 - protein, 4 aa, Mycobacterium avium
STKH

SEQ ID NO: 46028 - protein, 4 aa, Mycobacterium avium
STKM

SEQ ID NO: 46029 - protein, 5 aa, Mycobacterium avium
STLGH

SEQ ID NO: 46030 - protein, 10 aa, Mycobacterium avium
STLSGGQRRR

SEQ ID NO: 46031 - protein, 5 aa, Mycobacterium avium
STNLP

SEQ ID NO: 46032 - protein, 8 aa, Mycobacterium avium
STNRGDDI

SEQ ID NO: 46033 - protein, 5 aa, Mycobacterium avium
STPDS

SEQ ID NO: 46034 - protein, 13 aa, Mycobacterium avium
STPEEVARQAADN

SEQ ID NO: 46035 - protein, 5 aa, Mycobacterium avium
STPEG

SEQ ID NO: 46036 - protein, 8 aa, Mycobacterium avium
STPGFSDE

SEQ ID NO: 46037 - protein, 5 aa, Mycobacterium avium
STPGM

SEQ ID NO: 46038 - protein, 6 aa, Mycobacterium avium
STPHAA

SEQ ID NO: 46039 - protein, 6 aa, Mycobacterium avium
STPSHH

SEQ ID NO: 46040 - protein, 6 aa, Mycobacterium avium
STPTDN

SEQ ID NO: 46041 - protein, 9 aa, Mycobacterium avium
STPTGSTAY

SEQ ID NO: 46042 - protein, 7 aa, Mycobacterium avium
STPTRTA

SEQ ID NO: 46043 - protein, 10 aa, Mycobacterium avium
STPVSSPAET

SEQ ID NO: 46044 - protein, 5 aa, Mycobacterium avium
STQRV

SEQ ID NO: 46045 - protein, 5 aa, Mycobacterium avium
STQTL

SEQ ID NO: 46046 - protein, 6 aa, Mycobacterium avium
STQVGA

SEQ ID NO: 46047 - protein, 12 aa, Mycobacterium avium
STRDRAHPYATP

SEQ ID NO: 46048 - protein, 7 aa, Mycobacterium avium
STRGDGV

SEQ ID NO: 46049 - protein, 6 aa, Mycobacterium avium
STRGRP

SEQ ID NO: 46050 - protein, 5 aa, Mycobacterium avium
STRMP

SEQ ID NO: 46051 - protein, 8 aa, Mycobacterium avium
STRNAGPL

SEQ ID NO: 46052 - protein, 9 aa, Mycobacterium avium
STRRPDGTR

SEQ ID NO: 46053 - protein, 5 aa, Mycobacterium avium
STRSE

SEQ ID NO: 46054 - protein, 15 aa, Mycobacterium avium
STRTDENKDDIGNKV

SEQ ID NO: 46055 - protein, 5 aa, Mycobacterium avium
STRTR

SEQ ID NO: 46056 - protein, 12 aa, Mycobacterium avium
STSADELRRTAG

SEQ ID NO: 46057 - protein, 7 aa, Mycobacterium avium
STSAEQL

SEQ ID NO: 46058 - protein, 9 aa, Mycobacterium avium
STSELPGEL

SEQ ID NO: 46059 - protein, 8 aa, Mycobacterium avium
STSGASRN

SEQ ID NO: 46060 - protein, 9 aa, Mycobacterium avium
STSQAPQPR

SEQ ID NO: 46061 - protein, 8 aa, Mycobacterium avium
STSRRPAE

SEQ ID NO: 46062 - protein, 6 aa, Mycobacterium avium
STSRTM

SEQ ID NO: 46063 - protein, 6 aa, Mycobacterium avium
STSRVR

SEQ ID NO: 46064 - protein, 18 aa, Mycobacterium avium
STSSGSYAMTEAANAAAA

SEQ ID NO: 46065 - protein, 10 aa, Mycobacterium avium
STTADRGRAG

SEQ ID NO: 46066 - protein, 5 aa, Mycobacterium avium
STTAE

SEQ ID NO: 46067 - protein, 5 aa, Mycobacterium avium
STTAV

SEQ ID NO: 46068 - protein, 14 aa, Mycobacterium avium
STTGDGDAPDNGSG

SEQ ID NO: 46069 - protein, 10 aa, Mycobacterium avium
STTGDTTWEN

SEQ ID NO: 46070 - protein, 20 aa, Mycobacterium avium
STTHAQLSPAEQLSTGVSPG

SEQ ID NO: 46071 - protein, 4 aa, Mycobacterium avium
STVD

SEQ ID NO: 46072 - protein, 9 aa, Mycobacterium avium
STVPGPEAE

SEQ ID NO: 46073 - protein, 9 aa, Mycobacterium avium
STVPGPEGE

SEQ ID NO: 46074 - protein, 14 aa, Mycobacterium avium
STVSGRLGTSNDRM

SEQ ID NO: 46075 - protein, 4 aa, Mycobacterium avium
STWD

SEQ ID NO: 46076 - protein, 11 aa, Mycobacterium avium
STYESAETQTA

SEQ ID NO: 46077 - protein, 6 aa, Mycobacterium avium
STYKRA

SEQ ID NO: 46078 - protein, 4 aa, Mycobacterium avium
STYP

SEQ ID NO: 46079 - protein, 8 aa, Mycobacterium avium
SVADDSGL

SEQ ID NO: 46080 - protein, 9 aa, Mycobacterium avium
SVADSSQSA

SEQ ID NO: 46081 - protein, 9 aa, Mycobacterium avium
SVAEPAGAE

SEQ ID NO: 46082 - protein, 7 aa, Mycobacterium avium
SVANADR

SEQ ID NO: 46083 - protein, 7 aa, Mycobacterium avium
SVAPQNI

SEQ ID NO: 46084 - protein, 12 aa, Mycobacterium avium
SVAQDAHGVSAA

SEQ ID NO: 46085 - protein, 9 aa, Mycobacterium avium
SVATPEGGR

SEQ ID NO: 46086 - protein, 4 aa, Mycobacterium avium
SVDK

SEQ ID NO: 46087 - protein, 11 aa, Mycobacterium avium
SVDSSGSSVGS

SEQ ID NO: 46088 - protein, 8 aa, Mycobacterium avium
SVENDTDL

SEQ ID NO: 46089 - protein, 8 aa, Mycobacterium avium
SVEPQRVP

SEQ ID NO: 46090 - protein, 10 aa, Mycobacterium avium
SVEQGGYGLD

SEQ ID NO: 46091 - protein, 6 aa, Mycobacterium avium
SVERSE

SEQ ID NO: 46092 - protein, 11 aa, Mycobacterium avium
SVEVADNGRGI

SEQ ID NO: 46093 - protein, 9 aa, Mycobacterium avium
SVGAEVTGL

SEQ ID NO: 46094 - protein, 7 aa, Mycobacterium avium
SVGDGAS

SEQ ID NO: 46095 - protein, 10 aa, Mycobacterium avium
SVGNKEHPAN

SEQ ID NO: 46096 - protein, 6 aa, Mycobacterium avium
SVGPYA

SEQ ID NO: 46097 - protein, 5 aa, Mycobacterium avium
SVGQV

SEQ ID NO: 46098 - protein, 7 aa, Mycobacterium avium
SVGRGRH

SEQ ID NO: 46099 - protein, 6 aa, Mycobacterium avium
SVHGGP

SEQ ID NO: 46100 - protein, 8 aa, Mycobacterium avium
SVKEPLQT

SEQ ID NO: 46101 - protein, 6 aa, Mycobacterium avium
SVLTDP

SEQ ID NO: 46102 - protein, 5 aa, Mycobacterium avium
SVNRS

SEQ ID NO: 46103 - protein, 8 aa, Mycobacterium avium
SVPDPSKF

SEQ ID NO: 46104 - protein, 20 aa, Mycobacterium avium
SVPFPDEATGPRGRQGSPAR

SEQ ID NO: 46105 - protein, 6 aa, Mycobacterium avium
SVPGAA

SEQ ID NO: 46106 - protein, 7 aa, Mycobacterium avium
SVPPGRL

SEQ ID NO: 46107 - protein, 4 aa, Mycobacterium avium
SVQA

SEQ ID NO: 46108 - protein, 8 aa, Mycobacterium avium
SVQPGEPG

SEQ ID NO: 46109 - protein, 6 aa, Mycobacterium avium
SVQTAT

SEQ ID NO: 46110 - protein, 6 aa, Mycobacterium avium
SVRDPD

SEQ ID NO: 46111 - protein, 5 aa, Mycobacterium avium
SVRRE

SEQ ID NO: 46112 - protein, 11 aa, Mycobacterium avium
SVRRSGDGDGA

SEQ ID NO: 46113 - protein, 4 aa, Mycobacterium avium
SVSR

SEQ ID NO: 46114 - protein, 4 aa, Mycobacterium avium
SVTE

SEQ ID NO: 46115 - protein, 7 aa, Mycobacterium avium
SVTEEYR

SEQ ID NO: 46116 - protein, 11 aa, Mycobacterium avium
SVTGAADPADI

SEQ ID NO: 46117 - protein, 7 aa, Mycobacterium avium
SVTGGAL

SEQ ID NO: 46118 - protein, 6 aa, Mycobacterium avium
SVTGGN

SEQ ID NO: 46119 - protein, 8 aa, Mycobacterium avium
SVTGPTVG

SEQ ID NO: 46120 - protein, 8 aa, Mycobacterium avium
SVTQGMET

SEQ ID NO: 46121 - protein, 10 aa, Mycobacterium avium
SVTSNTRADA

SEQ ID NO: 46122 - protein, 8 aa, Mycobacterium avium
SVTSSPDE

SEQ ID NO: 46123 - protein, 9 aa, Mycobacterium avium
SVVDPSDVE

SEQ ID NO: 46124 - protein, 12 aa, Mycobacterium avium
SVVPSPAGRLGD

SEQ ID NO: 46125 - protein, 8 aa, Mycobacterium avium
SWDDTSEL

SEQ ID NO: 46126 - protein, 8 aa, Mycobacterium avium
SWDYEGRP

SEQ ID NO: 46127 - protein, 16 aa, Mycobacterium avium
SWGSADKGAVNVPDAE

SEQ ID NO: 46128 - protein, 9 aa, Mycobacterium avium
SWKESPPAE

SEQ ID NO: 46129 - protein, 15 aa, Mycobacterium avium
SWKTPAANPVNSGRG

SEQ ID NO: 46130 - protein, 4 aa, Mycobacterium avium
SWND

SEQ ID NO: 46131 - protein, 5 aa, Mycobacterium avium
SWPLG

SEQ ID NO: 46132 - protein, 15 aa, Mycobacterium avium
SWRNDTTGASGTVPK

SEQ ID NO: 46133 - protein, 22 aa, Mycobacterium avium
SWSDTEARPPGTPPPERLPSVD

SEQ ID NO: 46134 - protein, 6 aa, Mycobacterium avium
SYAGRG

SEQ ID NO: 46135 - protein, 4 aa, Mycobacterium avium
SYAP

SEQ ID NO: 46136 - protein, 6 aa, Mycobacterium avium
SYAPMG

SEQ ID NO: 46137 - protein, 16 aa, Mycobacterium avium
SYDGQGCSISQAATSV

SEQ ID NO: 46138 - protein, 10 aa, Mycobacterium avium
SYDPESRNKV

SEQ ID NO: 46139 - protein, 10 aa, Mycobacterium avium
SYEAGPAAAL

SEQ ID NO: 46140 - protein, 6 aa, Mycobacterium avium
SYETGF

SEQ ID NO: 46141 - protein, 6 aa, Mycobacterium avium
SYGAGN

SEQ ID NO: 46142 - protein, 5 aa, Mycobacterium avium
SYGGE

SEQ ID NO: 46143 - protein, 8 aa, Mycobacterium avium
SYGHDDTP

SEQ ID NO: 46144 - protein, 7 aa, Mycobacterium avium
SYGLSGT

SEQ ID NO: 46145 - protein, 6 aa, Mycobacterium avium
SYGPIG

SEQ ID NO: 46146 - protein, 7 aa, Mycobacterium avium
SYGPPAS

SEQ ID NO: 46147 - protein, 7 aa, Mycobacterium avium
SYGPPKL

SEQ ID NO: 46148 - protein, 4 aa, Mycobacterium avium
SYGQ

SEQ ID NO: 46149 - protein, 11 aa, Mycobacterium avium
SYGSSTSSSGV

SEQ ID NO: 46150 - protein, 12 aa, Mycobacterium avium
SYGYGRDRVSTG

SEQ ID NO: 46151 - protein, 6 aa, Mycobacterium avium
SYHSRT

SEQ ID NO: 46152 - protein, 9 aa, Mycobacterium avium
SYPDGATAV

SEQ ID NO: 46153 - protein, 13 aa, Mycobacterium avium
SYPDGSSLPTPSK

SEQ ID NO: 46154 - protein, 7 aa, Mycobacterium avium
SYPEAQP

SEQ ID NO: 46155 - protein, 5 aa, Mycobacterium avium
SYPEQ

SEQ ID NO: 46156 - protein, 6 aa, Mycobacterium avium
SYPGAR

SEQ ID NO: 46157 - protein, 7 aa, Mycobacterium avium
SYQRGAP

SEQ ID NO: 46158 - protein, 8 aa, Mycobacterium avium
SYRATTST

SEQ ID NO: 46159 - protein, 8 aa, Mycobacterium avium
SYRGKPAD

SEQ ID NO: 46160 - protein, 13 aa, Mycobacterium avium
SYRPGGERDSICG

SEQ ID NO: 46161 - protein, 10 aa, Mycobacterium avium
SYRRRTAGKV

SEQ ID NO: 46162 - protein, 4 aa, Mycobacterium avium
SYSE

SEQ ID NO: 46163 - protein, 7 aa, Mycobacterium avium
SYSEDGD

SEQ ID NO: 46164 - protein, 6 aa, Mycobacterium avium
SYSGTE

SEQ ID NO: 46165 - protein, 16 aa, Mycobacterium avium
SYTEGRLERIDARQAG

SEQ ID NO: 46166 - protein, 5 aa, Mycobacterium avium
SYTES

SEQ ID NO: 46167 - protein, 4 aa, Mycobacterium avium
SYTG

SEQ ID NO: 46168 - protein, 4 aa, Mycobacterium avium
SYTM

SEQ ID NO: 46169 - protein, 4 aa, Mycobacterium avium
SYTP

SEQ ID NO: 46170 - protein, 12 aa, Mycobacterium avium
SYVGGSTARSGG

SEQ ID NO: 46171 - protein, 9 aa, Mycobacterium avium
TAAAELAPA

SEQ ID NO: 46172 - protein, 11 aa, Mycobacterium avium
TAAARQRVADY

SEQ ID NO: 46173 - protein, 6 aa, Mycobacterium avium
TAADGT

SEQ ID NO: 46174 - protein, 5 aa, Mycobacterium avium
TAADL

SEQ ID NO: 46175 - protein, 8 aa, Mycobacterium avium
TAADPAAA

SEQ ID NO: 46176 - protein, 7 aa, Mycobacterium avium
TAAGAEP

SEQ ID NO: 46177 - protein, 10 aa, Mycobacterium avium
TAAGANEVGR

SEQ ID NO: 46178 - protein, 9 aa, Mycobacterium avium
TAAGELPMP

SEQ ID NO: 46179 - protein, 5 aa, Mycobacterium avium
TAAGG

SEQ ID NO: 46180 - protein, 7 aa, Mycobacterium avium
TAAGGDA

SEQ ID NO: 46181 - protein, 17 aa, Mycobacterium avium
TAAGGEAVADGSNVADW

SEQ ID NO: 46182 - protein, 16 aa, Mycobacterium avium
TAAGGEPDVHLDAEID

SEQ ID NO: 46183 - protein, 8 aa, Mycobacterium avium
TAAGGNAA

SEQ ID NO: 46184 - protein, 5 aa, Mycobacterium avium
TAAGR

SEQ ID NO: 46185 - protein, 8 aa, Mycobacterium avium
TAAGSGCA

SEQ ID NO: 46186 - protein, 7 aa, Mycobacterium avium
TAAGTGV

SEQ ID NO: 46187 - protein, 6 aa, Mycobacterium avium
TAAGTR

SEQ ID NO: 46188 - protein, 9 aa, Mycobacterium avium
TAAGTVRDN

SEQ ID NO: 46189 - protein, 7 aa, Mycobacterium avium
TAAGVSP

SEQ ID NO: 46190 - protein, 12 aa, Mycobacterium avium
TAALKGSPQRRG

SEQ ID NO: 46191 - protein, 9 aa, Mycobacterium avium
TAANQDGHT

SEQ ID NO: 46192 - protein, 10 aa, Mycobacterium avium
TAANQDGRTV

SEQ ID NO: 46193 - protein, 16 aa, Mycobacterium avium
TAANSDLKRLPTEDEV

SEQ ID NO: 46194 - protein, 4 aa, Mycobacterium avium
TAAP

SEQ ID NO: 46195 - protein, 5 aa, Mycobacterium avium
TAAPL

SEQ ID NO: 46196 - protein, 8 aa, Mycobacterium avium
TAAPRRMR

SEQ ID NO: 46197 - protein, 9 aa, Mycobacterium avium
TAAPVAADR

SEQ ID NO: 46198 - protein, 5 aa, Mycobacterium avium
TAAQH

SEQ ID NO: 46199 - protein, 6 aa, Mycobacterium avium
TAARGD

SEQ ID NO: 46200 - protein, 6 aa, Mycobacterium avium
TAARQG

SEQ ID NO: 46201 - protein, 10 aa, Mycobacterium avium
TAARRAREHR

SEQ ID NO: 46202 - protein, 21 aa, Mycobacterium avium
TAARTSRGEVRNKQALRTNAP

SEQ ID NO: 46203 - protein, 8 aa, Mycobacterium avium
TAASARDA

SEQ ID NO: 46204 - protein, 5 aa, Mycobacterium avium
TAASE

SEQ ID NO: 46205 - protein, 11 aa, Mycobacterium avium
TAASEATRRAV

SEQ ID NO: 46206 - protein, 6 aa, Mycobacterium avium
TAASSA

SEQ ID NO: 46207 - protein, 4 aa, Mycobacterium avium
TAAT

SEQ ID NO: 46208 - protein, 6 aa, Mycobacterium avium
TAATAD

SEQ ID NO: 46209 - protein, 9 aa, Mycobacterium avium
TAATITPAG

SEQ ID NO: 46210 - protein, 12 aa, Mycobacterium avium
TAATPLGQQPLS

SEQ ID NO: 46211 - protein, 12 aa, Mycobacterium avium
TAATTPSEEQLR

SEQ ID NO: 46212 - protein, 4 aa, Mycobacterium avium
TADA

SEQ ID NO: 46213 - protein, 5 aa, Mycobacterium avium
TADAA

SEQ ID NO: 46214 - protein, 8 aa, Mycobacterium avium
TADADRDA

SEQ ID NO: 46215 - protein, 9 aa, Mycobacterium avium
TADDTDPTE

SEQ ID NO: 46216 - protein, 12 aa, Mycobacterium avium
TADDVATSAQSA

SEQ ID NO: 46217 - protein, 12 aa, Mycobacterium avium
TADELTAGGTGG

SEQ ID NO: 46218 - protein, 7 aa, Mycobacterium avium
TADEPKL

SEQ ID NO: 46219 - protein, 4 aa, Mycobacterium avium
TADF

SEQ ID NO: 46220 - protein, 5 aa, Mycobacterium avium
TADGK

SEQ ID NO: 46221 - protein, 7 aa, Mycobacterium avium
TADGPAL

SEQ ID NO: 46222 - protein, 13 aa, Mycobacterium avium
TADGRDGYPVEPG

SEQ ID NO: 46223 - protein, 5 aa, Mycobacterium avium
TADGV

SEQ ID NO: 46224 - protein, 8 aa, Mycobacterium avium
TADKPEGM

SEQ ID NO: 46225 - protein, 7 aa, Mycobacterium avium
TADLADA

SEQ ID NO: 46226 - protein, 6 aa, Mycobacterium avium
TADNGA

SEQ ID NO: 46227 - protein, 4 aa, Mycobacterium avium
TADP

SEQ ID NO: 46228 - protein, 6 aa, Mycobacterium avium
TADPAH

SEQ ID NO: 46229 - protein, 6 aa, Mycobacterium avium
TADPAS

SEQ ID NO: 46230 - protein, 10 aa, Mycobacterium avium
TADPGRDPIS

SEQ ID NO: 46231 - protein, 4 aa, Mycobacterium avium
TADR

SEQ ID NO: 46232 - protein, 17 aa, Mycobacterium avium
TADRAELEGVSAERAPQ

SEQ ID NO: 46233 - protein, 5 aa, Mycobacterium avium
TADRI

SEQ ID NO: 46234 - protein, 10 aa, Mycobacterium avium
TADSGSSANW

SEQ ID NO: 46235 - protein, 9 aa, Mycobacterium avium
TADSPTRRA

SEQ ID NO: 46236 - protein, 8 aa, Mycobacterium avium
TADTAAPD

SEQ ID NO: 46237 - protein, 4 aa, Mycobacterium avium
TADV

SEQ ID NO: 46238 - protein, 9 aa, Mycobacterium avium
TADYGPSIG

SEQ ID NO: 46239 - protein, 7 aa, Mycobacterium avium
TAEAESA

SEQ ID NO: 46240 - protein, 8 aa, Mycobacterium avium
TAEDARSA

SEQ ID NO: 46241 - protein, 12 aa, Mycobacterium avium
TAEDRPLPGGNA

SEQ ID NO: 46242 - protein, 8 aa, Mycobacterium avium
TAEEAKDY

SEQ ID NO: 46243 - protein, 6 aa, Mycobacterium avium
TAEEGA

SEQ ID NO: 46244 - protein, 13 aa, Mycobacterium avium
TAEEIAAEGTPAD

SEQ ID NO: 46245 - protein, 13 aa, Mycobacterium avium
TAEELEELRAQEV

SEQ ID NO: 46246 - protein, 23 aa, Mycobacterium avium
TAEETERALSAGAAIADEEVDAG

SEQ ID NO: 46247 - protein, 10 aa, Mycobacterium avium
TAEGDEMQAA

SEQ ID NO: 46248 - protein, 8 aa, Mycobacterium avium
TAEGNHLG

SEQ ID NO: 46249 - protein, 9 aa, Mycobacterium avium
TAEGNHLGP

SEQ ID NO: 46250 - protein, 5 aa, Mycobacterium avium
TAEGW

SEQ ID NO: 46251 - protein, 4 aa, Mycobacterium avium
TAEH

SEQ ID NO: 46252 - protein, 8 aa, Mycobacterium avium
TAEHSTAA

SEQ ID NO: 46253 - protein, 10 aa, Mycobacterium avium
TAENGPDDLS

SEQ ID NO: 46254 - protein, 12 aa, Mycobacterium avium
TAEPHPKLPGTV

SEQ ID NO: 46255 - protein, 5 aa, Mycobacterium avium
TAEPV

SEQ ID NO: 46256 - protein, 13 aa, Mycobacterium avium
TAEQRLGDEKGVI

SEQ ID NO: 46257 - protein, 9 aa, Mycobacterium avium
TAERAVSGS

SEQ ID NO: 46258 - protein, 8 aa, Mycobacterium avium
TAERGGQV

SEQ ID NO: 46259 - protein, 5 aa, Mycobacterium avium
TAERL

SEQ ID NO: 46260 - protein, 8 aa, Mycobacterium avium
TAERRAAT

SEQ ID NO: 46261 - protein, 6 aa, Mycobacterium avium
TAESCT

SEQ ID NO: 46262 - protein, 11 aa, Mycobacterium avium
TAESGSAETYL

SEQ ID NO: 46263 - protein, 6 aa, Mycobacterium avium
TAESGY

SEQ ID NO: 46264 - protein, 9 aa, Mycobacterium avium
TAETDPSAA

SEQ ID NO: 46265 - protein, 6 aa, Mycobacterium avium
TAEVGE

SEQ ID NO: 46266 - protein, 5 aa, Mycobacterium avium
TAFEP

SEQ ID NO: 46267 - protein, 7 aa, Mycobacterium avium
TAFGANE

SEQ ID NO: 46268 - protein, 15 aa, Mycobacterium avium
TAFGTEGSVPPATHD

SEQ ID NO: 46269 - protein, 5 aa, Mycobacterium avium
TAGAD

SEQ ID NO: 46270 - protein, 14 aa, Mycobacterium avium
TAGDPARAKTLSER

SEQ ID NO: 46271 - protein, 12 aa, Mycobacterium avium
TAGDRSSGPIES

SEQ ID NO: 46272 - protein, 7 aa, Mycobacterium avium
TAGEPLS

SEQ ID NO: 46273 - protein, 5 aa, Mycobacterium avium
TAGGA

SEQ ID NO: 46274 - protein, 5 aa, Mycobacterium avium
TAGGF

SEQ ID NO: 46275 - protein, 9 aa, Mycobacterium avium
TAGGSQADP

SEQ ID NO: 46276 - protein, 10 aa, Mycobacterium avium
TAGHRGEPIG

SEQ ID NO: 46277 - protein, 4 aa, Mycobacterium avium
TAGL

SEQ ID NO: 46278 - protein, 9 aa, Mycobacterium avium
TAGLAQTAE

SEQ ID NO: 46279 - protein, 11 aa, Mycobacterium avium
TAGLDSSKPTA

SEQ ID NO: 46280 - protein, 7 aa, Mycobacterium avium
TAGLSPA

SEQ ID NO: 46281 - protein, 9 aa, Mycobacterium avium
TAGNSQAMA

SEQ ID NO: 46282 - protein, 13 aa, Mycobacterium avium
TAGNSSGTNDAAA

SEQ ID NO: 46283 - protein, 9 aa, Mycobacterium avium
TAGPGVTNG

SEQ ID NO: 46284 - protein, 8 aa, Mycobacterium avium
TAGRARRT

SEQ ID NO: 46285 - protein, 16 aa, Mycobacterium avium
TAGRTTLTGEGLQHAD

SEQ ID NO: 46286 - protein, 6 aa, Mycobacterium avium
TAGRYA

SEQ ID NO: 46287 - protein, 4 aa, Mycobacterium avium
TAGS

SEQ ID NO: 46288 - protein, 7 aa, Mycobacterium avium
TAGSAEK

SEQ ID NO: 46289 - protein, 7 aa, Mycobacterium avium
TAGSRLD

SEQ ID NO: 46290 - protein, 26 aa, Mycobacterium avium
TAGSSHGYDVTDPTTVSAELGGRDGL

SEQ ID NO: 46291 - protein, 4 aa, Mycobacterium avium
TAGT

SEQ ID NO: 46292 - protein, 6 aa, Mycobacterium avium
TAGTRR

SEQ ID NO: 46293 - protein, 13 aa, Mycobacterium avium
TAGTTTEADAGAA

SEQ ID NO: 46294 - protein, 15 aa, Mycobacterium avium
TAGVQAAASGRFEQA

SEQ ID NO: 46295 - protein, 10 aa, Mycobacterium avium
TAHDAPADAG

SEQ ID NO: 46296 - protein, 12 aa, Mycobacterium avium
TAHPRPVSSPHP

SEQ ID NO: 46297 - protein, 23 aa, Mycobacterium avium
TAIAEAEQAALSARPTIEMRGLL

SEQ ID NO: 46298 - protein, 14 aa, Mycobacterium avium
TAITPGLESPTIAP

SEQ ID NO: 46299 - protein, 9 aa, Mycobacterium avium
TAKDGSPKV

SEQ ID NO: 46300 - protein, 9 aa, Mycobacterium avium
TAKDGTPRV

SEQ ID NO: 46301 - protein, 10 aa, Mycobacterium avium
TAKDSRTNAE

SEQ ID NO: 46302 - protein, 8 aa, Mycobacterium avium
TAKFGQPE

SEQ ID NO: 46303 - protein, 5 aa, Mycobacterium avium
TAKNA

SEQ ID NO: 46304 - protein, 27 aa, Mycobacterium avium
TAKPAPGEDPRSGRWRGRNKVECGLHA

SEQ ID NO: 46305 - protein, 6 aa, Mycobacterium avium
TALAED

SEQ ID NO: 46306 - protein, 12 aa, Mycobacterium avium
TALDAGSGAPLH

SEQ ID NO: 46307 - protein, 10 aa, Mycobacterium avium
TALGTGRGEE

SEQ ID NO: 46308 - protein, 10 aa, Mycobacterium avium
TALPAGTAKA

SEQ ID NO: 46309 - protein, 4 aa, Mycobacterium avium
TAMP

SEQ ID NO: 46310 - protein, 8 aa, Mycobacterium avium
TAMPPGED

SEQ ID NO: 46311 - protein, 14 aa, Mycobacterium avium
TANGKAHGVGDPSG

SEQ ID NO: 46312 - protein, 5 aa, Mycobacterium avium
TANPT

SEQ ID NO: 46313 - protein, 8 aa, Mycobacterium avium
TAPAADIR

SEQ ID NO: 46314 - protein, 8 aa, Mycobacterium avium
TAPAGRAG

SEQ ID NO: 46315 - protein, 9 aa, Mycobacterium avium
TAPAPHHTR

SEQ ID NO: 46316 - protein, 16 aa, Mycobacterium avium
TAPARAGLAAADAGLS

SEQ ID NO: 46317 - protein, 9 aa, Mycobacterium avium
TAPDASVAQ

SEQ ID NO: 46318 - protein, 15 aa, Mycobacterium avium
TAPDGSHHQNDDAAA

SEQ ID NO: 46319 - protein, 7 aa, Mycobacterium avium
TAPDRHK

SEQ ID NO: 46320 - protein, 9 aa, Mycobacterium avium
TAPEGKTMG

SEQ ID NO: 46321 - protein, 12 aa, Mycobacterium avium
TAPEHSRSSEYC

SEQ ID NO: 46322 - protein, 6 aa, Mycobacterium avium
TAPFTD

SEQ ID NO: 46323 - protein, 4 aa, Mycobacterium avium
TAPG

SEQ ID NO: 46324 - protein, 9 aa, Mycobacterium avium
TAPGAEASA

SEQ ID NO: 46325 - protein, 6 aa, Mycobacterium avium
TAPGDA

SEQ ID NO: 46326 - protein, 6 aa, Mycobacterium avium
TAPGEL

SEQ ID NO: 46327 - protein, 24 aa, Mycobacterium avium
TAPGTLRTGSRGCCSKEDASDARR

SEQ ID NO: 46328 - protein, 5 aa, Mycobacterium avium
TAPGV

SEQ ID NO: 46329 - protein, 6 aa, Mycobacterium avium
TAPGYD

SEQ ID NO: 46330 - protein, 4 aa, Mycobacterium avium
TAPH

SEQ ID NO: 46331 - protein, 5 aa, Mycobacterium avium
TAPHP

SEQ ID NO: 46332 - protein, 8 aa, Mycobacterium avium
TAPQGLTD

SEQ ID NO: 46333 - protein, 6 aa, Mycobacterium avium
TAPRAR

SEQ ID NO: 46334 - protein, 5 aa, Mycobacterium avium
TAPVA

SEQ ID NO: 46335 - protein, 5 aa, Mycobacterium avium
TAQAG

SEQ ID NO: 46336 - protein, 6 aa, Mycobacterium avium
TAQEKA

SEQ ID NO: 46337 - protein, 7 aa, Mycobacterium avium
TAQQDDQ

SEQ ID NO: 46338 - protein, 19 aa, Mycobacterium avium
TAQQSAQLANSAEAAATAF

SEQ ID NO: 46339 - protein, 16 aa, Mycobacterium avium
TAQRAHAPQEVVEVLA

SEQ ID NO: 46340 - protein, 7 aa, Mycobacterium avium
TAQRPDA

SEQ ID NO: 46341 - protein, 9 aa, Mycobacterium avium
TAQRRTPPA

SEQ ID NO: 46342 - protein, 7 aa, Mycobacterium avium
TAQSDRI

SEQ ID NO: 46343 - protein, 13 aa, Mycobacterium avium
TAQVEGGDLLMVI

SEQ ID NO: 46344 - protein, 5 aa, Mycobacterium avium
TAQVT

SEQ ID NO: 46345 - protein, 5 aa, Mycobacterium avium
TARAA

SEQ ID NO: 46346 - protein, 11 aa, Mycobacterium avium
TARAEADGTYY

SEQ ID NO: 46347 - protein, 5 aa, Mycobacterium avium
TARAT

SEQ ID NO: 46348 - protein, 6 aa, Mycobacterium avium
TAREPH

SEQ ID NO: 46349 - protein, 4 aa, Mycobacterium avium
TARG

SEQ ID NO: 46350 - protein, 12 aa, Mycobacterium avium
TARGAGFDTSPG

SEQ ID NO: 46351 - protein, 15 aa, Mycobacterium avium
TARGHDGERGTERQR

SEQ ID NO: 46352 - protein, 4 aa, Mycobacterium avium
TARI

SEQ ID NO: 46353 - protein, 8 aa, Mycobacterium avium
TARLDDEE

SEQ ID NO: 46354 - protein, 4 aa, Mycobacterium avium
TARR

SEQ ID NO: 46355 - protein, 10 aa, Mycobacterium avium
TARRRGSQAH

SEQ ID NO: 46356 - protein, 9 aa, Mycobacterium avium
TARSARRRQ

SEQ ID NO: 46357 - protein, 4 aa, Mycobacterium avium
TART

SEQ ID NO: 46358 - protein, 9 aa, Mycobacterium avium
TARTGGVAG

SEQ ID NO: 46359 - protein, 11 aa, Mycobacterium avium
TARTPQPPHVG

SEQ ID NO: 46360 - protein, 7 aa, Mycobacterium avium
TARVPTR

SEQ ID NO: 46361 - protein, 20 aa, Mycobacterium avium
TARYVEPSGAGPLGSGTGFP

SEQ ID NO: 46362 - protein, 10 aa, Mycobacterium avium
TASAFRDSFG

SEQ ID NO: 46363 - protein, 5 aa, Mycobacterium avium
TASAW

SEQ ID NO: 46364 - protein, 10 aa, Mycobacterium avium
TASDGASAIA

SEQ ID NO: 46365 - protein, 9 aa, Mycobacterium avium
TASDGTRQR

SEQ ID NO: 46366 - protein, 6 aa, Mycobacterium avium
TASESR

SEQ ID NO: 46367 - protein, 7 aa, Mycobacterium avium
TASGFQS

SEQ ID NO: 46368 - protein, 6 aa, Mycobacterium avium
TASGHR

SEQ ID NO: 46369 - protein, 4 aa, Mycobacterium avium
TASL

SEQ ID NO: 46370 - protein, 9 aa, Mycobacterium avium
TASQDGRVA

SEQ ID NO: 46371 - protein, 5 aa, Mycobacterium avium
TASRI

SEQ ID NO: 46372 - protein, 6 aa, Mycobacterium avium
TASYQA

SEQ ID NO: 46373 - protein, 14 aa, Mycobacterium avium
TATAAADVIFVRDS

SEQ ID NO: 46374 - protein, 9 aa, Mycobacterium avium
TATAGTDSL

SEQ ID NO: 46375 - protein, 6 aa, Mycobacterium avium
TATDIP

SEQ ID NO: 46376 - protein, 5 aa, Mycobacterium avium
TATER

SEQ ID NO: 46377 - protein, 18 aa, Mycobacterium avium
TATNGAQALDRAREARPD

SEQ ID NO: 46378 - protein, 4 aa, Mycobacterium avium
TATQ

SEQ ID NO: 46379 - protein, 8 aa, Mycobacterium avium
TATSGSDP

SEQ ID NO: 46380 - protein, 8 aa, Mycobacterium avium
TATSPAVG

SEQ ID NO: 46381 - protein, 7 aa, Mycobacterium avium
TATTGGK

SEQ ID NO: 46382 - protein, 8 aa, Mycobacterium avium
TATTRDVN

SEQ ID NO: 46383 - protein, 9 aa, Mycobacterium avium
TATTVETDH

SEQ ID NO: 46384 - protein, 12 aa, Mycobacterium avium
TATYPDGSIPEV

SEQ ID NO: 46385 - protein, 11 aa, Mycobacterium avium
TATYPDGSTPP

SEQ ID NO: 46386 - protein, 8 aa, Mycobacterium avium
TAVAGNTS

SEQ ID NO: 46387 - protein, 5 aa, Mycobacterium avium
TAVEA

SEQ ID NO: 46388 - protein, 5 aa, Mycobacterium avium
TAVQP

SEQ ID NO: 46389 - protein, 15 aa, Mycobacterium avium
TAVQQATGHDDSAEE

SEQ ID NO: 46390 - protein, 8 aa, Mycobacterium avium
TAVRDGDD

SEQ ID NO: 46391 - protein, 9 aa, Mycobacterium avium
TAVRGEAPK

SEQ ID NO: 46392 - protein, 5 aa, Mycobacterium avium
TAVSG

SEQ ID NO: 46393 - protein, 12 aa, Mycobacterium avium
TAWQRNGRPRVA

SEQ ID NO: 46394 - protein, 9 aa, Mycobacterium avium
TAYEKERVN

SEQ ID NO: 46395 - protein, 9 aa, Mycobacterium avium
TCDAGQTRK

SEQ ID NO: 46396 - protein, 8 aa, Mycobacterium avium
TCRPDNTL

SEQ ID NO: 46397 - protein, 9 aa, Mycobacterium avium
TDAAAESTE

SEQ ID NO: 46398 - protein, 7 aa, Mycobacterium avium
TDAAESR

SEQ ID NO: 46399 - protein, 7 aa, Mycobacterium avium
TDADGNH

SEQ ID NO: 46400 - protein, 8 aa, Mycobacterium avium
TDADPSMA

SEQ ID NO: 46401 - protein, 5 aa, Mycobacterium avium
TDAEA

SEQ ID NO: 46402 - protein, 5 aa, Mycobacterium avium
TDAEQ

SEQ ID NO: 46403 - protein, 6 aa, Mycobacterium avium
TDAESQ

SEQ ID NO: 46404 - protein, 11 aa, Mycobacterium avium
TDAGDDRAAER

SEQ ID NO: 46405 - protein, 6 aa, Mycobacterium avium
TDAGNR

SEQ ID NO: 46406 - protein, 5 aa, Mycobacterium avium
TDAGR

SEQ ID NO: 46407 - protein, 9 aa, Mycobacterium avium
TDAHDTASI

SEQ ID NO: 46408 - protein, 8 aa, Mycobacterium avium
TDAKPGVS

SEQ ID NO: 46409 - protein, 15 aa, Mycobacterium avium
TDAPAIPHGQNAKEL

SEQ ID NO: 46410 - protein, 7 aa, Mycobacterium avium
TDAPDGV

SEQ ID NO: 46411 - protein, 7 aa, Mycobacterium avium
TDAPGEL

SEQ ID NO: 46412 - protein, 9 aa, Mycobacterium avium
TDAPGVTPG

SEQ ID NO: 46413 - protein, 8 aa, Mycobacterium avium
TDASARGR

SEQ ID NO: 46414 - protein, 6 aa, Mycobacterium avium
TDASLT

SEQ ID NO: 46415 - protein, 6 aa, Mycobacterium avium
TDAYPQ

SEQ ID NO: 46416 - protein, 4 aa, Mycobacterium avium
TDDA

SEQ ID NO: 46417 - protein, 9 aa, Mycobacterium avium
TDDAGAAVE

SEQ ID NO: 46418 - protein, 8 aa, Mycobacterium avium
TDDDAPRR

SEQ ID NO: 46419 - protein, 5 aa, Mycobacterium avium
TDDDQ

SEQ ID NO: 46420 - protein, 6 aa, Mycobacterium avium
TDDEAR

SEQ ID NO: 46421 - protein, 8 aa, Mycobacterium avium
TDDERSYA

SEQ ID NO: 46422 - protein, 6 aa, Mycobacterium avium
TDDETV

SEQ ID NO: 46423 - protein, 5 aa, Mycobacterium avium
TDDGI

SEQ ID NO: 46424 - protein, 8 aa, Mycobacterium avium
TDDGPAPA

SEQ ID NO: 46425 - protein, 8 aa, Mycobacterium avium
TDDGSGTW

SEQ ID NO: 46426 - protein, 6 aa, Mycobacterium avium
TDDHPG

SEQ ID NO: 46427 - protein, 5 aa, Mycobacterium avium
TDDNA

SEQ ID NO: 46428 - protein, 16 aa, Mycobacterium avium
TDDPAAKPVDVSEDNR

SEQ ID NO: 46429 - protein, 7 aa, Mycobacterium avium
TDDPEHH

SEQ ID NO: 46430 - protein, 6 aa, Mycobacterium avium
TDDPKV

SEQ ID NO: 46431 - protein, 7 aa, Mycobacterium avium
TDDPRVN

SEQ ID NO: 46432 - protein, 7 aa, Mycobacterium avium
TDDPTAR

SEQ ID NO: 46433 - protein, 7 aa, Mycobacterium avium
TDDRGDS

SEQ ID NO: 46434 - protein, 6 aa, Mycobacterium avium
TDDTKL

SEQ ID NO: 46435 - protein, 6 aa, Mycobacterium avium
TDDTPI

SEQ ID NO: 46436 - protein, 4 aa, Mycobacterium avium
TDEA

SEQ ID NO: 46437 - protein, 6 aa, Mycobacterium avium
TDEAAV

SEQ ID NO: 46438 - protein, 7 aa, Mycobacterium avium
TDEEALQ

SEQ ID NO: 46439 - protein, 11 aa, Mycobacterium avium
TDEGSDKPHRN

SEQ ID NO: 46440 - protein, 10 aa, Mycobacterium avium
TDEHGTRALT

SEQ ID NO: 46441 - protein, 14 aa, Mycobacterium avium
TDEHPRADTSVESL

SEQ ID NO: 46442 - protein, 13 aa, Mycobacterium avium
TDEKPGGHGDRAA

SEQ ID NO: 46443 - protein, 6 aa, Mycobacterium avium
TDENLA

SEQ ID NO: 46444 - protein, 7 aa, Mycobacterium avium
TDEQKAR

SEQ ID NO: 46445 - protein, 6 aa, Mycobacterium avium
TDEQKR

SEQ ID NO: 46446 - protein, 8 aa, Mycobacterium avium
TDEQRREW

SEQ ID NO: 46447 - protein, 4 aa, Mycobacterium avium
TDET

SEQ ID NO: 46448 - protein, 8 aa, Mycobacterium avium
TDETGVTG

SEQ ID NO: 46449 - protein, 6 aa, Mycobacterium avium
TDEVPE

SEQ ID NO: 46450 - protein, 11 aa, Mycobacterium avium
TDFPGGDSDEM

SEQ ID NO: 46451 - protein, 10 aa, Mycobacterium avium
TDGADDGRVP

SEQ ID NO: 46452 - protein, 5 aa, Mycobacterium avium
TDGAG

SEQ ID NO: 46453 - protein, 9 aa, Mycobacterium avium
TDGDREGEA

SEQ ID NO: 46454 - protein, 14 aa, Mycobacterium avium
TDGETNASLRKGDD

SEQ ID NO: 46455 - protein, 15 aa, Mycobacterium avium
TDGGCDVTESTWDRR

SEQ ID NO: 46456 - protein, 6 aa, Mycobacterium avium
TDGGTE

SEQ ID NO: 46457 - protein, 5 aa, Mycobacterium avium
TDGLR

SEQ ID NO: 46458 - protein, 4 aa, Mycobacterium avium
TDGP

SEQ ID NO: 46459 - protein, 8 aa, Mycobacterium avium
TDGPGALS

SEQ ID NO: 46460 - protein, 8 aa, Mycobacterium avium
TDGPMPQT

SEQ ID NO: 46461 - protein, 4 aa, Mycobacterium avium
TDGQ

SEQ ID NO: 46462 - protein, 13 aa, Mycobacterium avium
TDGRVHNEDTDHR

SEQ ID NO: 46463 - protein, 4 aa, Mycobacterium avium
TDGS

SEQ ID NO: 46464 - protein, 6 aa, Mycobacterium avium
TDGSAA

SEQ ID NO: 46465 - protein, 10 aa, Mycobacterium avium
TDGSGRDAAA

SEQ ID NO: 46466 - protein, 6 aa, Mycobacterium avium
TDGSIR

SEQ ID NO: 46467 - protein, 9 aa, Mycobacterium avium
TDGSPASEA

SEQ ID NO: 46468 - protein, 6 aa, Mycobacterium avium
TDGSRI

SEQ ID NO: 46469 - protein, 6 aa, Mycobacterium avium
TDGTPY

SEQ ID NO: 46470 - protein, 7 aa, Mycobacterium avium
TDGTVTV

SEQ ID NO: 46471 - protein, 5 aa, Mycobacterium avium
TDGVG

SEQ ID NO: 46472 - protein, 11 aa, Mycobacterium avium
TDIEGANAAGL

SEQ ID NO: 46473 - protein, 4 aa, Mycobacterium avium
TDIP

SEQ ID NO: 46474 - protein, 6 aa, Mycobacterium avium
TDKADI

SEQ ID NO: 46475 - protein, 12 aa, Mycobacterium avium
TDKDPTEVIRET

SEQ ID NO: 46476 - protein, 11 aa, Mycobacterium avium
TDKGRAEAVRS

SEQ ID NO: 46477 - protein, 8 aa, Mycobacterium avium
TDKSQIDD

SEQ ID NO: 46478 - protein, 14 aa, Mycobacterium avium
TDKVDTEIPSPAAG

SEQ ID NO: 46479 - protein, 6 aa, Mycobacterium avium
TDLAPQ

SEQ ID NO: 46480 - protein, 4 aa, Mycobacterium avium
TDLD

SEQ ID NO: 46481 - protein, 9 aa, Mycobacterium avium
TDLEGSPQL

SEQ ID NO: 46482 - protein, 8 aa, Mycobacterium avium
TDLGDTEA

SEQ ID NO: 46483 - protein, 6 aa, Mycobacterium avium
TDLSSA

SEQ ID NO: 46484 - protein, 6 aa, Mycobacterium avium
TDNDAV

SEQ ID NO: 46485 - protein, 7 aa, Mycobacterium avium
TDNEPAI

SEQ ID NO: 46486 - protein, 5 aa, Mycobacterium avium
TDNGE

SEQ ID NO: 46487 - protein, 4 aa, Mycobacterium avium
TDNP

SEQ ID NO: 46488 - protein, 9 aa, Mycobacterium avium
TDNPDGPLT

SEQ ID NO: 46489 - protein, 8 aa, Mycobacterium avium
TDNPDSIV

SEQ ID NO: 46490 - protein, 6 aa, Mycobacterium avium
TDPAAN

SEQ ID NO: 46491 - protein, 8 aa, Mycobacterium avium
TDPANAGV

SEQ ID NO: 46492 - protein, 7 aa, Mycobacterium avium
TDPAQLA

SEQ ID NO: 46493 - protein, 4 aa, Mycobacterium avium
TDPD

SEQ ID NO: 46494 - protein, 10 aa, Mycobacterium avium
TDPDAKKHKG

SEQ ID NO: 46495 - protein, 10 aa, Mycobacterium avium
TDPDAPKHKG

SEQ ID NO: 46496 - protein, 9 aa, Mycobacterium avium
TDPDFTPGK

SEQ ID NO: 46497 - protein, 9 aa, Mycobacterium avium
TDPDHHEAS

SEQ ID NO: 46498 - protein, 10 aa, Mycobacterium avium
TDPDKGANGI

SEQ ID NO: 46499 - protein, 5 aa, Mycobacterium avium
TDPDS

SEQ ID NO: 46500 - protein, 6 aa, Mycobacterium avium
TDPDSR

SEQ ID NO: 46501 - protein, 7 aa, Mycobacterium avium
TDPDTLA

SEQ ID NO: 46502 - protein, 9 aa, Mycobacterium avium
TDPDVARAS

SEQ ID NO: 46503 - protein, 7 aa, Mycobacterium avium
TDPEAVK

SEQ ID NO: 46504 - protein, 5 aa, Mycobacterium avium
TDPGA

SEQ ID NO: 46505 - protein, 6 aa, Mycobacterium avium
TDPGAL

SEQ ID NO: 46506 - protein, 9 aa, Mycobacterium avium
TDPGLGDAG

SEQ ID NO: 46507 - protein, 7 aa, Mycobacterium avium
TDPHNSE

SEQ ID NO: 46508 - protein, 10 aa, Mycobacterium avium
TDPKAREEPF

SEQ ID NO: 46509 - protein, 10 aa, Mycobacterium avium
TDPKATPRHK

SEQ ID NO: 46510 - protein, 6 aa, Mycobacterium avium
TDPNSV

SEQ ID NO: 46511 - protein, 11 aa, Mycobacterium avium
TDPNTEGEATA

SEQ ID NO: 46512 - protein, 13 aa, Mycobacterium avium
TDPPKLKKQEKHD

SEQ ID NO: 46513 - protein, 9 aa, Mycobacterium avium
TDPQAKRHR

SEQ ID NO: 46514 - protein, 5 aa, Mycobacterium avium
TDPQG

SEQ ID NO: 46515 - protein, 8 aa, Mycobacterium avium
TDPQPVAA

SEQ ID NO: 46516 - protein, 9 aa, Mycobacterium avium
TDPQTGRRH

SEQ ID NO: 46517 - protein, 6 aa, Mycobacterium avium
TDPRSR

SEQ ID NO: 46518 - protein, 9 aa, Mycobacterium avium
TDPSKGAAG

SEQ ID NO: 46519 - protein, 5 aa, Mycobacterium avium
TDPSN

SEQ ID NO: 46520 - protein, 9 aa, Mycobacterium avium
TDPSNYRDR

SEQ ID NO: 46521 - protein, 9 aa, Mycobacterium avium
TDPTGTRHR

SEQ ID NO: 46522 - protein, 6 aa, Mycobacterium avium
TDPTNL

SEQ ID NO: 46523 - protein, 6 aa, Mycobacterium avium
TDQIRD

SEQ ID NO: 46524 - protein, 9 aa, Mycobacterium avium
TDRDAADAL

SEQ ID NO: 46525 - protein, 13 aa, Mycobacterium avium
TDRDRARAAGRQA

SEQ ID NO: 46526 - protein, 10 aa, Mycobacterium avium
TDRFDEDRTG

SEQ ID NO: 46527 - protein, 4 aa, Mycobacterium avium
TDRI

SEQ ID NO: 46528 - protein, 7 aa, Mycobacterium avium
TDRPDAR

SEQ ID NO: 46529 - protein, 10 aa, Mycobacterium avium
TDRPGSSDYV

SEQ ID NO: 46530 - protein, 7 aa, Mycobacterium avium
TDRPLAG

SEQ ID NO: 46531 - protein, 11 aa, Mycobacterium avium
TDRQSGTPSSY

SEQ ID NO: 46532 - protein, 8 aa, Mycobacterium avium
TDSAAGWE

SEQ ID NO: 46533 - protein, 9 aa, Mycobacterium avium
TDSASVAAA

SEQ ID NO: 46534 - protein, 9 aa, Mycobacterium avium
TDSDDPAQR

SEQ ID NO: 46535 - protein, 15 aa, Mycobacterium avium
TDSNASAVPPEDGVR

SEQ ID NO: 46536 - protein, 13 aa, Mycobacterium avium
TDSPAVEATSTRC

SEQ ID NO: 46537 - protein, 4 aa, Mycobacterium avium
TDSQ

SEQ ID NO: 46538 - protein, 8 aa, Mycobacterium avium
TDSQEGAV

SEQ ID NO: 46539 - protein, 9 aa, Mycobacterium avium
TDSRGSYVP

SEQ ID NO: 46540 - protein, 13 aa, Mycobacterium avium
TDSWSTATAPQVS

SEQ ID NO: 46541 - protein, 7 aa, Mycobacterium avium
TDTARGC

SEQ ID NO: 46542 - protein, 7 aa, Mycobacterium avium
TDTDEEL

SEQ ID NO: 46543 - protein, 14 aa, Mycobacterium avium
TDTDGDGLADGASA

SEQ ID NO: 46544 - protein, 13 aa, Mycobacterium avium
TDTDGRRVTGLEP

SEQ ID NO: 46545 - protein, 5 aa, Mycobacterium avium
TDTGT

SEQ ID NO: 46546 - protein, 5 aa, Mycobacterium avium
TDTPG

SEQ ID NO: 46547 - protein, 8 aa, Mycobacterium avium
TDTPGFTA

SEQ ID NO: 46548 - protein, 6 aa, Mycobacterium avium
TDTPGV

SEQ ID NO: 46549 - protein, 9 aa, Mycobacterium avium
TDTPHPRLP

SEQ ID NO: 46550 - protein, 8 aa, Mycobacterium avium
TDTTAAQR

SEQ ID NO: 46551 - protein, 9 aa, Mycobacterium avium
TDTVPGDRR

SEQ ID NO: 46552 - protein, 6 aa, Mycobacterium avium
TDVRAP

SEQ ID NO: 46553 - protein, 8 aa, Mycobacterium avium
TDVTNASR

SEQ ID NO: 46554 - protein, 4 aa, Mycobacterium avium
TDWP

SEQ ID NO: 46555 - protein, 7 aa, Mycobacterium avium
TDYPAAA

SEQ ID NO: 46556 - protein, 5 aa, Mycobacterium avium
TEAAE

SEQ ID NO: 46557 - protein, 5 aa, Mycobacterium avium
TEAAG

SEQ ID NO: 46558 - protein, 18 aa, Mycobacterium avium
TEADERLTESVSRAADSG

SEQ ID NO: 46559 - protein, 12 aa, Mycobacterium avium
TEADLRALAQAR

SEQ ID NO: 46560 - protein, 6 aa, Mycobacterium avium
TEAEKR

SEQ ID NO: 46561 - protein, 7 aa, Mycobacterium avium
TEAESEP

SEQ ID NO: 46562 - protein, 6 aa, Mycobacterium avium
TEAGAD

SEQ ID NO: 46563 - protein, 11 aa, Mycobacterium avium
TEAGETKIGGR

SEQ ID NO: 46564 - protein, 15 aa, Mycobacterium avium
TEAGRTQAERAGRAL

SEQ ID NO: 46565 - protein, 13 aa, Mycobacterium avium
TEAGVSEKTLPRE

SEQ ID NO: 46566 - protein, 11 aa, Mycobacterium avium
TEAKVRGYQPG

SEQ ID NO: 46567 - protein, 7 aa, Mycobacterium avium
TEAPDDQ

SEQ ID NO: 46568 - protein, 5 aa, Mycobacterium avium
TEAQK

SEQ ID NO: 46569 - protein, 6 aa, Mycobacterium avium
TEAQKQ

SEQ ID NO: 46570 - protein, 10 aa, Mycobacterium avium
TEARRDGERL

SEQ ID NO: 46571 - protein, 22 aa, Mycobacterium avium
TEASNPDGSNTRVVLDDGAVEY

SEQ ID NO: 46572 - protein, 12 aa, Mycobacterium avium
TEAYGAAKRPED

SEQ ID NO: 46573 - protein, 6 aa, Mycobacterium avium
TEDARV

SEQ ID NO: 46574 - protein, 8 aa, Mycobacterium avium
TEDGKPVN

SEQ ID NO: 46575 - protein, 5 aa, Mycobacterium avium
TEDGR

SEQ ID NO: 46576 - protein, 8 aa, Mycobacterium avium
TEDGTERE

SEQ ID NO: 46577 - protein, 5 aa, Mycobacterium avium
TEDKY

SEQ ID NO: 46578 - protein, 7 aa, Mycobacterium avium
TEDPPSR

SEQ ID NO: 46579 - protein, 11 aa, Mycobacterium avium
TEDPTLNWSTP

SEQ ID NO: 46580 - protein, 6 aa, Mycobacterium avium
TEDPVL

SEQ ID NO: 46581 - protein, 6 aa, Mycobacterium avium
TEDQTE

SEQ ID NO: 46582 - protein, 4 aa, Mycobacterium avium
TEDR

SEQ ID NO: 46583 - protein, 9 aa, Mycobacterium avium
TEEAKTGKL

SEQ ID NO: 46584 - protein, 6 aa, Mycobacterium avium
TEEDLN

SEQ ID NO: 46585 - protein, 11 aa, Mycobacterium avium
TEEEADRALRA

SEQ ID NO: 46586 - protein, 4 aa, Mycobacterium avium
TEEF

SEQ ID NO: 46587 - protein, 5 aa, Mycobacterium avium
TEEPA

SEQ ID NO: 46588 - protein, 5 aa, Mycobacterium avium
TEEPE

SEQ ID NO: 46589 - protein, 4 aa, Mycobacterium avium
TEEQ

SEQ ID NO: 46590 - protein, 5 aa, Mycobacterium avium
TEEQC

SEQ ID NO: 46591 - protein, 5 aa, Mycobacterium avium
TEEQI

SEQ ID NO: 46592 - protein, 6 aa, Mycobacterium avium
TEEQKQ

SEQ ID NO: 46593 - protein, 13 aa, Mycobacterium avium
TEETGAQISIEDD

SEQ ID NO: 46594 - protein, 4 aa, Mycobacterium avium
TEEV

SEQ ID NO: 46595 - protein, 14 aa, Mycobacterium avium
TEEYPEKPGPVAPR

SEQ ID NO: 46596 - protein, 4 aa, Mycobacterium avium
TEFH

SEQ ID NO: 46597 - protein, 13 aa, Mycobacterium avium
TEFNAGSRMQGQL

SEQ ID NO: 46598 - protein, 11 aa, Mycobacterium avium
TEFSKESGRSE

SEQ ID NO: 46599 - protein, 4 aa, Mycobacterium avium
TEGA

SEQ ID NO: 46600 - protein, 15 aa, Mycobacterium avium
TEGARRAGAEHTGPR

SEQ ID NO: 46601 - protein, 5 aa, Mycobacterium avium
TEGVA

SEQ ID NO: 46602 - protein, 5 aa, Mycobacterium avium
TEGVP

SEQ ID NO: 46603 - protein, 12 aa, Mycobacterium avium
TEGVRRTGGNTV

SEQ ID NO: 46604 - protein, 5 aa, Mycobacterium avium
TEHQH

SEQ ID NO: 46605 - protein, 4 aa, Mycobacterium avium
TEID

SEQ ID NO: 46606 - protein, 12 aa, Mycobacterium avium
TEIKNGQRKQVN

SEQ ID NO: 46607 - protein, 37 aa, Mycobacterium avium
TEISRAAGKLATSSTSETTSPSPAQPAGPPPPPPPVS

SEQ ID NO: 46608 - protein, 8 aa, Mycobacterium avium
TEKDYASL

SEQ ID NO: 46609 - protein, 9 aa, Mycobacterium avium
TEKGSKRHA

SEQ ID NO: 46610 - protein, 14 aa, Mycobacterium avium
TEKPTATVEPISGT

SEQ ID NO: 46611 - protein, 8 aa, Mycobacterium avium
TEKQAASW

SEQ ID NO: 46612 - protein, 8 aa, Mycobacterium avium
TEKQAREE

SEQ ID NO: 46613 - protein, 10 aa, Mycobacterium avium
TEKVPGGEQE

SEQ ID NO: 46614 - protein, 6 aa, Mycobacterium avium
TELAEK

SEQ ID NO: 46615 - protein, 17 aa, Mycobacterium avium
TELGKQRAAQMGGSTAV

SEQ ID NO: 46616 - protein, 9 aa, Mycobacterium avium
TELPEPDLP

SEQ ID NO: 46617 - protein, 17 aa, Mycobacterium avium
TELRDGNFGTAGQVTSP

SEQ ID NO: 46618 - protein, 17 aa, Mycobacterium avium
TELSEGARLEVVTAVQG

SEQ ID NO: 46619 - protein, 7 aa, Mycobacterium avium
TELSPEH

SEQ ID NO: 46620 - protein, 10 aa, Mycobacterium avium
TENPQDLATT

SEQ ID NO: 46621 - protein, 8 aa, Mycobacterium avium
TENSHGID

SEQ ID NO: 46622 - protein, 9 aa, Mycobacterium avium
TEPAPGTAN

SEQ ID NO: 46623 - protein, 5 aa, Mycobacterium avium
TEPAR

SEQ ID NO: 46624 - protein, 13 aa, Mycobacterium avium
TEPDSGSDAFGGM

SEQ ID NO: 46625 - protein, 4 aa, Mycobacterium avium
TEPE

SEQ ID NO: 46626 - protein, 9 aa, Mycobacterium avium
TEPEAGTDL

SEQ ID NO: 46627 - protein, 5 aa, Mycobacterium avium
TEPEK

SEQ ID NO: 46628 - protein, 19 aa, Mycobacterium avium
TEPGAGSDAGATRTTARLE

SEQ ID NO: 46629 - protein, 14 aa, Mycobacterium avium
TEPGAGSNPAGLRT

SEQ ID NO: 46630 - protein, 12 aa, Mycobacterium avium
TEPGGGSDLQNM

SEQ ID NO: 46631 - protein, 10 aa, Mycobacterium avium
TEPGGGSDVG

SEQ ID NO: 46632 - protein, 9 aa, Mycobacterium avium
TEPGTGSDL

SEQ ID NO: 46633 - protein, 12 aa, Mycobacterium avium
TEPGTGSDLQGI

SEQ ID NO: 46634 - protein, 20 aa, Mycobacterium avium
TEPGTGSDLQSVKTTARRDG

SEQ ID NO: 46635 - protein, 12 aa, Mycobacterium avium
TEPHGATRWAFS

SEQ ID NO: 46636 - protein, 5 aa, Mycobacterium avium
TEPHI

SEQ ID NO: 46637 - protein, 6 aa, Mycobacterium avium
TEPNAD

SEQ ID NO: 46638 - protein, 15 aa, Mycobacterium avium
TEPPQVANPSGVSTQ

SEQ ID NO: 46639 - protein, 12 aa, Mycobacterium avium
TEPQGGSDPGQF

SEQ ID NO: 46640 - protein, 15 aa, Mycobacterium avium
TEPRAKTRNLRRDPR

SEQ ID NO: 46641 - protein, 4 aa, Mycobacterium avium
TEPT

SEQ ID NO: 46642 - protein, 6 aa, Mycobacterium avium
TEPTGT

SEQ ID NO: 46643 - protein, 7 aa, Mycobacterium avium
TEPTTMP

SEQ ID NO: 46644 - protein, 10 aa, Mycobacterium avium
TEPVSSKGAT

SEQ ID NO: 46645 - protein, 4 aa, Mycobacterium avium
TEPW

SEQ ID NO: 46646 - protein, 5 aa, Mycobacterium avium
TEQEN

SEQ ID NO: 46647 - protein, 14 aa, Mycobacterium avium
TEQGKRSAGHSAAS

SEQ ID NO: 46648 - protein, 5 aa, Mycobacterium avium
TEQGN

SEQ ID NO: 46649 - protein, 4 aa, Mycobacterium avium
TEQR

SEQ ID NO: 46650 - protein, 8 aa, Mycobacterium avium
TEQRANKA

SEQ ID NO: 46651 - protein, 7 aa, Mycobacterium avium
TEQRNDV

SEQ ID NO: 46652 - protein, 4 aa, Mycobacterium avium
TERA

SEQ ID NO: 46653 - protein, 11 aa, Mycobacterium avium
TERAKAVTRGI

SEQ ID NO: 46654 - protein, 8 aa, Mycobacterium avium
TERARAEA

SEQ ID NO: 46655 - protein, 6 aa, Mycobacterium avium
TERATA

SEQ ID NO: 46656 - protein, 4 aa, Mycobacterium avium
TERD

SEQ ID NO: 46657 - protein, 5 aa, Mycobacterium avium
TERDG

SEQ ID NO: 46658 - protein, 6 aa, Mycobacterium avium
TERNKT

SEQ ID NO: 46659 - protein, 9 aa, Mycobacterium avium
TERPEEDSF

SEQ ID NO: 46660 - protein, 10 aa, Mycobacterium avium
TERPNDADSV

SEQ ID NO: 46661 - protein, 8 aa, Mycobacterium avium
TERPPAKP

SEQ ID NO: 46662 - protein, 6 aa, Mycobacterium avium
TERPRG

SEQ ID NO: 46663 - protein, 5 aa, Mycobacterium avium
TERQA

SEQ ID NO: 46664 - protein, 5 aa, Mycobacterium avium
TERQR

SEQ ID NO: 46665 - protein, 20 aa, Mycobacterium avium
TERTGGSDLGALETTATRHG

SEQ ID NO: 46666 - protein, 10 aa, Mycobacterium avium
TERTRARAGA

SEQ ID NO: 46667 - protein, 9 aa, Mycobacterium avium
TESAPGPTY

SEQ ID NO: 46668 - protein, 9 aa, Mycobacterium avium
TESARNPSR

SEQ ID NO: 46669 - protein, 12 aa, Mycobacterium avium
TESAVSARSASG

SEQ ID NO: 46670 - protein, 7 aa, Mycobacterium avium
TESGPFR

SEQ ID NO: 46671 - protein, 7 aa, Mycobacterium avium
TESLQSN

SEQ ID NO: 46672 - protein, 5 aa, Mycobacterium avium
TESMA

SEQ ID NO: 46673 - protein, 8 aa, Mycobacterium avium
TESMTDED

SEQ ID NO: 46674 - protein, 9 aa, Mycobacterium avium
TESTEPQAV

SEQ ID NO: 46675 - protein, 12 aa, Mycobacterium avium
TESYQREPAPED

SEQ ID NO: 46676 - protein, 7 aa, Mycobacterium avium
TETADEW

SEQ ID NO: 46677 - protein, 5 aa, Mycobacterium avium
TETNA

SEQ ID NO: 46678 - protein, 7 aa, Mycobacterium avium
TETRDEV

SEQ ID NO: 46679 - protein, 4 aa, Mycobacterium avium
TEVP

SEQ ID NO: 46680 - protein, 5 aa, Mycobacterium avium
TEVPR

SEQ ID NO: 46681 - protein, 12 aa, Mycobacterium avium
TEVPSDRYAAAV

SEQ ID NO: 46682 - protein, 14 aa, Mycobacterium avium
TEVSSTATVTGPGR

SEQ ID NO: 46683 - protein, 4 aa, Mycobacterium avium
TEWA

SEQ ID NO: 46684 - protein, 22 aa, Mycobacterium avium
TEYGTGVGRSKKEAEQKAAAAT

SEQ ID NO: 46685 - protein, 4 aa, Mycobacterium avium
TFAP

SEQ ID NO: 46686 - protein, 7 aa, Mycobacterium avium
TFAQDGV

SEQ ID NO: 46687 - protein, 14 aa, Mycobacterium avium
TFDAENSRKKLPSV

SEQ ID NO: 46688 - protein, 7 aa, Mycobacterium avium
TFDGSAK

SEQ ID NO: 46689 - protein, 7 aa, Mycobacterium avium
TFDSGDP

SEQ ID NO: 46690 - protein, 8 aa, Mycobacterium avium
TFDSGDPK

SEQ ID NO: 46691 - protein, 4 aa, Mycobacterium avium
TFEP

SEQ ID NO: 46692 - protein, 4 aa, Mycobacterium avium
TFGI

SEQ ID NO: 46693 - protein, 7 aa, Mycobacterium avium
TFGPGGS

SEQ ID NO: 46694 - protein, 6 aa, Mycobacterium avium
TFGSTA

SEQ ID NO: 46695 - protein, 10 aa, Mycobacterium avium
TFNSGSTSIP

SEQ ID NO: 46696 - protein, 5 aa, Mycobacterium avium
TFPDV

SEQ ID NO: 46697 - protein, 10 aa, Mycobacterium avium
TFPSGEGSDL

SEQ ID NO: 46698 - protein, 10 aa, Mycobacterium avium
TFPSINPATG

SEQ ID NO: 46699 - protein, 9 aa, Mycobacterium avium
TFPSSSPDE

SEQ ID NO: 46700 - protein, 7 aa, Mycobacterium avium
TFQGQGN

SEQ ID NO: 46701 - protein, 11 aa, Mycobacterium avium
TFSGGSPGAFQ

SEQ ID NO: 46702 - protein, 5 aa, Mycobacterium avium
TFTET

SEQ ID NO: 46703 - protein, 11 aa, Mycobacterium avium
TFTPASDAEVD

SEQ ID NO: 46704 - protein, 4 aa, Mycobacterium avium
TFTS

SEQ ID NO: 46705 - protein, 6 aa, Mycobacterium avium
TGAAAG

SEQ ID NO: 46706 - protein, 10 aa, Mycobacterium avium
TGAAAGREAR

SEQ ID NO: 46707 - protein, 13 aa, Mycobacterium avium
TGAAPSGAGPRVK

SEQ ID NO: 46708 - protein, 7 aa, Mycobacterium avium
TGAAQRA

SEQ ID NO: 46709 - protein, 9 aa, Mycobacterium avium
TGAASDDDA

SEQ ID NO: 46710 - protein, 12 aa, Mycobacterium avium
TGADAARTNPLG

SEQ ID NO: 46711 - protein, 10 aa, Mycobacterium avium
TGADADPTVD

SEQ ID NO: 46712 - protein, 8 aa, Mycobacterium avium
TGADEAEL

SEQ ID NO: 46713 - protein, 6 aa, Mycobacterium avium
TGADGV

SEQ ID NO: 46714 - protein, 5 aa, Mycobacterium avium
TGADV

SEQ ID NO: 46715 - protein, 10 aa, Mycobacterium avium
TGAEHEPGTR

SEQ ID NO: 46716 - protein, 17 aa, Mycobacterium avium
TGAGASAAVGEASAVGG

SEQ ID NO: 46717 - protein, 9 aa, Mycobacterium avium
TGAGGGKVA

SEQ ID NO: 46718 - protein, 9 aa, Mycobacterium avium
TGAGSGIGQ

SEQ ID NO: 46719 - protein, 5 aa, Mycobacterium avium
TGAHA

SEQ ID NO: 46720 - protein, 6 aa, Mycobacterium avium
TGAKND

SEQ ID NO: 46721 - protein, 11 aa, Mycobacterium avium
TGAKSGQPRVS

SEQ ID NO: 46722 - protein, 7 aa, Mycobacterium avium
TGALRDR

SEQ ID NO: 46723 - protein, 13 aa, Mycobacterium avium
TGANSAIPHHRPT

SEQ ID NO: 46724 - protein, 9 aa, Mycobacterium avium
TGANSGIGL

SEQ ID NO: 46725 - protein, 10 aa, Mycobacterium avium
TGAPADPATL

SEQ ID NO: 46726 - protein, 5 aa, Mycobacterium avium
TGAPT

SEQ ID NO: 46727 - protein, 20 aa, Mycobacterium avium
TGAQAAPPVQPSAAPMERPG

SEQ ID NO: 46728 - protein, 14 aa, Mycobacterium avium
TGAQAEQAGAQAKL

SEQ ID NO: 46729 - protein, 5 aa, Mycobacterium avium
TGARP

SEQ ID NO: 46730 - protein, 5 aa, Mycobacterium avium
TGAST

SEQ ID NO: 46731 - protein, 8 aa, Mycobacterium avium
TGCPSGEV

SEQ ID NO: 46732 - protein, 10 aa, Mycobacterium avium
TGDASQSEDV

SEQ ID NO: 46733 - protein, 11 aa, Mycobacterium avium
TGDDDKPGAVV

SEQ ID NO: 46734 - protein, 10 aa, Mycobacterium avium
TGDDGQERVS

SEQ ID NO: 46735 - protein, 6 aa, Mycobacterium avium
TGDDGV

SEQ ID NO: 46736 - protein, 10 aa, Mycobacterium avium
TGDEAGVDAA

SEQ ID NO: 46737 - protein, 10 aa, Mycobacterium avium
TGDEQPGTAA

SEQ ID NO: 46738 - protein, 10 aa, Mycobacterium avium
TGDGQLTGKG

SEQ ID NO: 46739 - protein, 6 aa, Mycobacterium avium
TGDHQA

SEQ ID NO: 46740 - protein, 10 aa, Mycobacterium avium
TGDKSRAIAA

SEQ ID NO: 46741 - protein, 6 aa, Mycobacterium avium
TGDPDV

SEQ ID NO: 46742 - protein, 9 aa, Mycobacterium avium
TGDRAGADV

SEQ ID NO: 46743 - protein, 8 aa, Mycobacterium avium
TGDRSGDQ

SEQ ID NO: 46744 - protein, 14 aa, Mycobacterium avium
TGDSLGQVASQTLP

SEQ ID NO: 46745 - protein, 12 aa, Mycobacterium avium
TGDTETSDPAAN

SEQ ID NO: 46746 - protein, 4 aa, Mycobacterium avium
TGDV

SEQ ID NO: 46747 - protein, 8 aa, Mycobacterium avium
TGDYGTYT

SEQ ID NO: 46748 - protein, 8 aa, Mycobacterium avium
TGEAKEPR

SEQ ID NO: 46749 - protein, 4 aa, Mycobacterium avium
TGED

SEQ ID NO: 46750 - protein, 8 aa, Mycobacterium avium
TGEDGEEF

SEQ ID NO: 46751 - protein, 13 aa, Mycobacterium avium
TGEESDDESLGGA

SEQ ID NO: 46752 - protein, 8 aa, Mycobacterium avium
TGEGKTLA

SEQ ID NO: 46753 - protein, 9 aa, Mycobacterium avium
TGEGRKVAE

SEQ ID NO: 46754 - protein, 11 aa, Mycobacterium avium
TGEGRTADVSR

SEQ ID NO: 46755 - protein, 5 aa, Mycobacterium avium
TGEHS

SEQ ID NO: 46756 - protein, 5 aa, Mycobacterium avium
TGEKL

SEQ ID NO: 46757 - protein, 15 aa, Mycobacterium avium
TGELETASPKGGDIV

SEQ ID NO: 46758 - protein, 5 aa, Mycobacterium avium
TGEPA

SEQ ID NO: 46759 - protein, 18 aa, Mycobacterium avium
TGEPARPVAAGSQPCGER

SEQ ID NO: 46760 - protein, 4 aa, Mycobacterium avium
TGEQ

SEQ ID NO: 46761 - protein, 7 aa, Mycobacterium avium
TGERGSG

SEQ ID NO: 46762 - protein, 8 aa, Mycobacterium avium
TGERTKEG

SEQ ID NO: 46763 - protein, 9 aa, Mycobacterium avium
TGETGTGKT

SEQ ID NO: 46764 - protein, 7 aa, Mycobacterium avium
TGETSPY

SEQ ID NO: 46765 - protein, 7 aa, Mycobacterium avium
TGETTTG

SEQ ID NO: 46766 - protein, 4 aa, Mycobacterium avium
TGFA

SEQ ID NO: 46767 - protein, 7 aa, Mycobacterium avium
TGFGEPL

SEQ ID NO: 46768 - protein, 6 aa, Mycobacterium avium
TGGAAL

SEQ ID NO: 46769 - protein, 6 aa, Mycobacterium avium
TGGAGN

SEQ ID NO: 46770 - protein, 8 aa, Mycobacterium avium
TGGASGIG

SEQ ID NO: 46771 - protein, 5 aa, Mycobacterium avium
TGGCP

SEQ ID NO: 46772 - protein, 9 aa, Mycobacterium avium
TGGEGPRGI

SEQ ID NO: 46773 - protein, 8 aa, Mycobacterium avium
TGGEGTKH

SEQ ID NO: 46774 - protein, 7 aa, Mycobacterium avium
TGGERGD

SEQ ID NO: 46775 - protein, 6 aa, Mycobacterium avium
TGGFRA

SEQ ID NO: 46776 - protein, 6 aa, Mycobacterium avium
TGGGAG

SEQ ID NO: 46777 - protein, 10 aa, Mycobacterium avium
TGGGGGIGAA

SEQ ID NO: 46778 - protein, 4 aa, Mycobacterium avium
TGGH

SEQ ID NO: 46779 - protein, 7 aa, Mycobacterium avium
TGGKHRS

SEQ ID NO: 46780 - protein, 5 aa, Mycobacterium avium
TGGLT

SEQ ID NO: 46781 - protein, 5 aa, Mycobacterium avium
TGGPG

SEQ ID NO: 46782 - protein, 4 aa, Mycobacterium avium
TGGQ

SEQ ID NO: 46783 - protein, 4 aa, Mycobacterium avium
TGGR

SEQ ID NO: 46784 - protein, 6 aa, Mycobacterium avium
TGGRRR

SEQ ID NO: 46785 - protein, 19 aa, Mycobacterium avium
TGGSGRMYKTTSNAHTLTG

SEQ ID NO: 46786 - protein, 6 aa, Mycobacterium avium
TGGTIA

SEQ ID NO: 46787 - protein, 5 aa, Mycobacterium avium
TGGTL

SEQ ID NO: 46788 - protein, 5 aa, Mycobacterium avium
TGGTR

SEQ ID NO: 46789 - protein, 10 aa, Mycobacterium avium
TGGWEPDAKG

SEQ ID NO: 46790 - protein, 10 aa, Mycobacterium avium
TGHGDSTTIG

SEQ ID NO: 46791 - protein, 7 aa, Mycobacterium avium
TGHGGQA

SEQ ID NO: 46792 - protein, 7 aa, Mycobacterium avium
TGHGTTM

SEQ ID NO: 46793 - protein, 12 aa, Mycobacterium avium
TGHQPVERYGAS

SEQ ID NO: 46794 - protein, 13 aa, Mycobacterium avium
TGIEPDKTTPAQW

SEQ ID NO: 46795 - protein, 6 aa, Mycobacterium avium
TGIETA

SEQ ID NO: 46796 - protein, 5 aa, Mycobacterium avium
TGIGP

SEQ ID NO: 46797 - protein, 6 aa, Mycobacterium avium
TGIKPA

SEQ ID NO: 46798 - protein, 9 aa, Mycobacterium avium
TGINTTDAH

SEQ ID NO: 46799 - protein, 10 aa, Mycobacterium avium
TGKAPPAARA

SEQ ID NO: 46800 - protein, 5 aa, Mycobacterium avium
TGKEI

SEQ ID NO: 46801 - protein, 6 aa, Mycobacterium avium
TGKLER

SEQ ID NO: 46802 - protein, 5 aa, Mycobacterium avium
TGKNL

SEQ ID NO: 46803 - protein, 8 aa, Mycobacterium avium
TGKPGKHK

SEQ ID NO: 46804 - protein, 16 aa, Mycobacterium avium
TGKPTPAGYAQARTDF

SEQ ID NO: 46805 - protein, 13 aa, Mycobacterium avium
TGKRESKSRPGEG

SEQ ID NO: 46806 - protein, 17 aa, Mycobacterium avium
TGKSDQPYGVPSPRFEG

SEQ ID NO: 46807 - protein, 4 aa, Mycobacterium avium
TGLA

SEQ ID NO: 46808 - protein, 7 aa, Mycobacterium avium
TGLAEEN

SEQ ID NO: 46809 - protein, 4 aa, Mycobacterium avium
TGLE

SEQ ID NO: 46810 - protein, 5 aa, Mycobacterium avium
TGLNN

SEQ ID NO: 46811 - protein, 4 aa, Mycobacterium avium
TGLP

SEQ ID NO: 46812 - protein, 6 aa, Mycobacterium avium
TGLPAA

SEQ ID NO: 46813 - protein, 10 aa, Mycobacterium avium
TGLPNGDQPM

SEQ ID NO: 46814 - protein, 7 aa, Mycobacterium avium
TGLPPEA

SEQ ID NO: 46815 - protein, 5 aa, Mycobacterium avium
TGLRE

SEQ ID NO: 46816 - protein, 14 aa, Mycobacterium avium
TGLRTAENALPRRG

SEQ ID NO: 46817 - protein, 4 aa, Mycobacterium avium
TGLT

SEQ ID NO: 46818 - protein, 6 aa, Mycobacterium avium
TGLTDD

SEQ ID NO: 46819 - protein, 6 aa, Mycobacterium avium
TGMAGS

SEQ ID NO: 46820 - protein, 17 aa, Mycobacterium avium
TGMRTPDPGKVEATSEP

SEQ ID NO: 46821 - protein, 6 aa, Mycobacterium avium
TGMTDE

SEQ ID NO: 46822 - protein, 4 aa, Mycobacterium avium
TGNG

SEQ ID NO: 46823 - protein, 17 aa, Mycobacterium avium
TGNGNGHAHPDHDEDER

SEQ ID NO: 46824 - protein, 10 aa, Mycobacterium avium
TGNKTEPYSG

SEQ ID NO: 46825 - protein, 8 aa, Mycobacterium avium
TGNPANTN

SEQ ID NO: 46826 - protein, 22 aa, Mycobacterium avium
TGNPPTRERIQSPADRARYDDT

SEQ ID NO: 46827 - protein, 7 aa, Mycobacterium avium
TGNQGAD

SEQ ID NO: 46828 - protein, 10 aa, Mycobacterium avium
TGNYNSKTAR

SEQ ID NO: 46829 - protein, 24 aa, Mycobacterium avium
TGPAAPSWRKGPRHIAGRGPRDTY

SEQ ID NO: 46830 - protein, 5 aa, Mycobacterium avium
TGPAR

SEQ ID NO: 46831 - protein, 7 aa, Mycobacterium avium
TGPDGRP

SEQ ID NO: 46832 - protein, 6 aa, Mycobacterium avium
TGPDQF

SEQ ID NO: 46833 - protein, 6 aa, Mycobacterium avium
TGPFGD

SEQ ID NO: 46834 - protein, 8 aa, Mycobacterium avium
TGPGAGSL

SEQ ID NO: 46835 - protein, 9 aa, Mycobacterium avium
TGPGPLTER

SEQ ID NO: 46836 - protein, 9 aa, Mycobacterium avium
TGPGVTETP

SEQ ID NO: 46837 - protein, 7 aa, Mycobacterium avium
TGPHGTY

SEQ ID NO: 46838 - protein, 9 aa, Mycobacterium avium
TGPKDHAGS

SEQ ID NO: 46839 - protein, 7 aa, Mycobacterium avium
TGPPDDV

SEQ ID NO: 46840 - protein, 12 aa, Mycobacterium avium
TGPPGAGKSTTV

SEQ ID NO: 46841 - protein, 5 aa, Mycobacterium avium
TGPTY

SEQ ID NO: 46842 - protein, 6 aa, Mycobacterium avium
TGPYTD

SEQ ID NO: 46843 - protein, 7 aa, Mycobacterium avium
TGQDSGV

SEQ ID NO: 46844 - protein, 5 aa, Mycobacterium avium
TGQGY

SEQ ID NO: 46845 - protein, 4 aa, Mycobacterium avium
TGQP

SEQ ID NO: 46846 - protein, 4 aa, Mycobacterium avium
TGQS

SEQ ID NO: 46847 - protein, 6 aa, Mycobacterium avium
TGQTLR

SEQ ID NO: 46848 - protein, 9 aa, Mycobacterium avium
TGQTPVDED

SEQ ID NO: 46849 - protein, 6 aa, Mycobacterium avium
TGRAAR

SEQ ID NO: 46850 - protein, 12 aa, Mycobacterium avium
TGRDGLDSSPAN

SEQ ID NO: 46851 - protein, 8 aa, Mycobacterium avium
TGRDPKRL

SEQ ID NO: 46852 - protein, 9 aa, Mycobacterium avium
TGREADDLT

SEQ ID NO: 46853 - protein, 6 aa, Mycobacterium avium
TGRGVE

SEQ ID NO: 46854 - protein, 5 aa, Mycobacterium avium
TGRHY

SEQ ID NO: 46855 - protein, 8 aa, Mycobacterium avium
TGRNQHGD

SEQ ID NO: 46856 - protein, 20 aa, Mycobacterium avium
TGRPPRAIPEPQPRTSHGPA

SEQ ID NO: 46857 - protein, 7 aa, Mycobacterium avium
TGRPQRL

SEQ ID NO: 46858 - protein, 5 aa, Mycobacterium avium
TGRPT

SEQ ID NO: 46859 - protein, 9 aa, Mycobacterium avium
TGRSDFPNQ

SEQ ID NO: 46860 - protein, 9 aa, Mycobacterium avium
TGRSGKTRS

SEQ ID NO: 46861 - protein, 5 aa, Mycobacterium avium
TGRTA

SEQ ID NO: 46862 - protein, 10 aa, Mycobacterium avium
TGSDEDISRL

SEQ ID NO: 46863 - protein, 6 aa, Mycobacterium avium
TGSEAE

SEQ ID NO: 46864 - protein, 4 aa, Mycobacterium avium
TGSF

SEQ ID NO: 46865 - protein, 5 aa, Mycobacterium avium
TGSGK

SEQ ID NO: 46866 - protein, 10 aa, Mycobacterium avium
TGSGKGGTKY

SEQ ID NO: 46867 - protein, 12 aa, Mycobacterium avium
TGSGTSSNMNTN

SEQ ID NO: 46868 - protein, 7 aa, Mycobacterium avium
TGSPAEL

SEQ ID NO: 46869 - protein, 10 aa, Mycobacterium avium
TGSPLAGTTW

SEQ ID NO: 46870 - protein, 22 aa, Mycobacterium avium
TGSPNELDGSPNRGYKVRPKGG

SEQ ID NO: 46871 - protein, 8 aa, Mycobacterium avium
TGSPPAHQ

SEQ ID NO: 46872 - protein, 8 aa, Mycobacterium avium
TGSRRQRT

SEQ ID NO: 46873 - protein, 6 aa, Mycobacterium avium
TGSRYA

SEQ ID NO: 46874 - protein, 11 aa, Mycobacterium avium
TGSSGKTSTKD

SEQ ID NO: 46875 - protein, 8 aa, Mycobacterium avium
TGSTEVGK

SEQ ID NO: 46876 - protein, 7 aa, Mycobacterium avium
TGSTKRP

SEQ ID NO: 46877 - protein, 8 aa, Mycobacterium avium
TGSTRAGV

SEQ ID NO: 46878 - protein, 13 aa, Mycobacterium avium
TGSTVTADGGFNQ

SEQ ID NO: 46879 - protein, 5 aa, Mycobacterium avium
TGSVR

SEQ ID NO: 46880 - protein, 8 aa, Mycobacterium avium
TGSWGGAA

SEQ ID NO: 46881 - protein, 5 aa, Mycobacterium avium
TGTAD

SEQ ID NO: 46882 - protein, 6 aa, Mycobacterium avium
TGTAQI

SEQ ID NO: 46883 - protein, 6 aa, Mycobacterium avium
TGTFEH

SEQ ID NO: 46884 - protein, 7 aa, Mycobacterium avium
TGTGAAV

SEQ ID NO: 46885 - protein, 19 aa, Mycobacterium avium
TGTGEPDDKEAITEEQCAS

SEQ ID NO: 46886 - protein, 6 aa, Mycobacterium avium
TGTGQR

SEQ ID NO: 46887 - protein, 5 aa, Mycobacterium avium
TGTGR

SEQ ID NO: 46888 - protein, 9 aa, Mycobacterium avium
TGTGTTGLG

SEQ ID NO: 46889 - protein, 4 aa, Mycobacterium avium
TGTI

SEQ ID NO: 46890 - protein, 6 aa, Mycobacterium avium
TGTLPD

SEQ ID NO: 46891 - protein, 9 aa, Mycobacterium avium
TGTNPKAKR

SEQ ID NO: 46892 - protein, 5 aa, Mycobacterium avium
TGTPW

SEQ ID NO: 46893 - protein, 9 aa, Mycobacterium avium
TGTQGEPMS

SEQ ID NO: 46894 - protein, 7 aa, Mycobacterium avium
TGTRISA

SEQ ID NO: 46895 - protein, 10 aa, Mycobacterium avium
TGTSGKTTTT

SEQ ID NO: 46896 - protein, 8 aa, Mycobacterium avium
TGTSGYQA

SEQ ID NO: 46897 - protein, 8 aa, Mycobacterium avium
TGTSRGVG

SEQ ID NO: 46898 - protein, 4 aa, Mycobacterium avium
TGTT

SEQ ID NO: 46899 - protein, 8 aa, Mycobacterium avium
TGTTAVKP

SEQ ID NO: 46900 - protein, 11 aa, Mycobacterium avium
TGTVGADKKEI

SEQ ID NO: 46901 - protein, 20 aa, Mycobacterium avium
TGTWSTEAAYDDQDYAETEQ

SEQ ID NO: 46902 - protein, 8 aa, Mycobacterium avium
TGVAGEPQ

SEQ ID NO: 46903 - protein, 10 aa, Mycobacterium avium
TGVKNPDYSD

SEQ ID NO: 46904 - protein, 7 aa, Mycobacterium avium
TGVPRPG

SEQ ID NO: 46905 - protein, 5 aa, Mycobacterium avium
TGVRE

SEQ ID NO: 46906 - protein, 11 aa, Mycobacterium avium
TGVSGSGKSTL

SEQ ID NO: 46907 - protein, 10 aa, Mycobacterium avium
TGWDADGGYA

SEQ ID NO: 46908 - protein, 17 aa, Mycobacterium avium
TGWGSATVSAGTEPGDT

SEQ ID NO: 46909 - protein, 9 aa, Mycobacterium avium
TGWSEADVQ

SEQ ID NO: 46910 - protein, 6 aa, Mycobacterium avium
TGYASN

SEQ ID NO: 46911 - protein, 11 aa, Mycobacterium avium
TGYDNSRLRGP

SEQ ID NO: 46912 - protein, 14 aa, Mycobacterium avium
TGYGTTLAEGKDTR

SEQ ID NO: 46913 - protein, 7 aa, Mycobacterium avium
TGYQGEW

SEQ ID NO: 46914 - protein, 16 aa, Mycobacterium avium
TGYRRELESSTDPQEL

SEQ ID NO: 46915 - protein, 6 aa, Mycobacterium avium
TGYSDD

SEQ ID NO: 46916 - protein, 8 aa, Mycobacterium avium
TGYSRPRG

SEQ ID NO: 46917 - protein, 5 aa, Mycobacterium avium
THAEY

SEQ ID NO: 46918 - protein, 5 aa, Mycobacterium avium
THDER

SEQ ID NO: 46919 - protein, 10 aa, Mycobacterium avium
THDGTARQHA

SEQ ID NO: 46920 - protein, 8 aa, Mycobacterium avium
THDNSASI

SEQ ID NO: 46921 - protein, 10 aa, Mycobacterium avium
THDPATPYQA

SEQ ID NO: 46922 - protein, 11 aa, Mycobacterium avium
THDTKRGEDVR

SEQ ID NO: 46923 - protein, 5 aa, Mycobacterium avium
THEST

SEQ ID NO: 46924 - protein, 4 aa, Mycobacterium avium
THET

SEQ ID NO: 46925 - protein, 5 aa, Mycobacterium avium
THGAD

SEQ ID NO: 46926 - protein, 7 aa, Mycobacterium avium
THGGQLG

SEQ ID NO: 46927 - protein, 10 aa, Mycobacterium avium
THGGRRGTGI

SEQ ID NO: 46928 - protein, 8 aa, Mycobacterium avium
THGKTTTT

SEQ ID NO: 46929 - protein, 13 aa, Mycobacterium avium
THHGPAGDRRYTY

SEQ ID NO: 46930 - protein, 4 aa, Mycobacterium avium
THNS

SEQ ID NO: 46931 - protein, 17 aa, Mycobacterium avium
THPATTTHRAMGPEGRA

SEQ ID NO: 46932 - protein, 19 aa, Mycobacterium avium
THPCNTGKPEFADGPRAAR

SEQ ID NO: 46933 - protein, 4 aa, Mycobacterium avium
THPD

SEQ ID NO: 46934 - protein, 6 aa, Mycobacterium avium
THPDRF

SEQ ID NO: 46935 - protein, 11 aa, Mycobacterium avium
THPDRPDAPNM

SEQ ID NO: 46936 - protein, 12 aa, Mycobacterium avium
THPGPGGPDDSL

SEQ ID NO: 46937 - protein, 8 aa, Mycobacterium avium
THQEPGLG

SEQ ID NO: 46938 - protein, 10 aa, Mycobacterium avium
THQPGPQPGA

SEQ ID NO: 46939 - protein, 4 aa, Mycobacterium avium
THRD

SEQ ID NO: 46940 - protein, 4 aa, Mycobacterium avium
THRG

SEQ ID NO: 46941 - protein, 7 aa, Mycobacterium avium
THSKHSG

SEQ ID NO: 46942 - protein, 9 aa, Mycobacterium avium
THSPDRPPA

SEQ ID NO: 46943 - protein, 9 aa, Mycobacterium avium
THSQTSGWS

SEQ ID NO: 46944 - protein, 9 aa, Mycobacterium avium
THTDSEAWR

SEQ ID NO: 46945 - protein, 5 aa, Mycobacterium avium
TIAPE

SEQ ID NO: 46946 - protein, 6 aa, Mycobacterium avium
TIEDPI

SEQ ID NO: 46947 - protein, 4 aa, Mycobacterium avium
TIER

SEQ ID NO: 46948 - protein, 10 aa, Mycobacterium avium
TIGDEGDSQL

SEQ ID NO: 46949 - protein, 6 aa, Mycobacterium avium
TIGDPL

SEQ ID NO: 46950 - protein, 4 aa, Mycobacterium avium
TIGG

SEQ ID NO: 46951 - protein, 9 aa, Mycobacterium avium
TIGGSGAIN

SEQ ID NO: 46952 - protein, 10 aa, Mycobacterium avium
TIGRSSSEDT

SEQ ID NO: 46953 - protein, 5 aa, Mycobacterium avium
TIPDA

SEQ ID NO: 46954 - protein, 6 aa, Mycobacterium avium
TIPDKG

SEQ ID NO: 46955 - protein, 13 aa, Mycobacterium avium
TIPDPQLPNPVQQ

SEQ ID NO: 46956 - protein, 4 aa, Mycobacterium avium
TIPE

SEQ ID NO: 46957 - protein, 12 aa, Mycobacterium avium
TIPRARSADVQQ

SEQ ID NO: 46958 - protein, 12 aa, Mycobacterium avium
TIPRTSSGKIGH

SEQ ID NO: 46959 - protein, 8 aa, Mycobacterium avium
TIQGSTDI

SEQ ID NO: 46960 - protein, 5 aa, Mycobacterium avium
TIRAG

SEQ ID NO: 46961 - protein, 11 aa, Mycobacterium avium
TISTGTGADGV

SEQ ID NO: 46962 - protein, 13 aa, Mycobacterium avium
TKAAADAGRPAPR

SEQ ID NO: 46963 - protein, 7 aa, Mycobacterium avium
TKAHPTV

SEQ ID NO: 46964 - protein, 8 aa, Mycobacterium avium
TKATGVTV

SEQ ID NO: 46965 - protein, 7 aa, Mycobacterium avium
TKAYQGV

SEQ ID NO: 46966 - protein, 9 aa, Mycobacterium avium
TKDGSPAIA

SEQ ID NO: 46967 - protein, 10 aa, Mycobacterium avium
TKDGTLGGPN

SEQ ID NO: 46968 - protein, 8 aa, Mycobacterium avium
TKDPDKFV

SEQ ID NO: 46969 - protein, 10 aa, Mycobacterium avium
TKDWKKRTPN

SEQ ID NO: 46970 - protein, 10 aa, Mycobacterium avium
TKEHSAEYQS

SEQ ID NO: 46971 - protein, 16 aa, Mycobacterium avium
TKERKQFGRPVSDNQG

SEQ ID NO: 46972 - protein, 6 aa, Mycobacterium avium
TKETPA

SEQ ID NO: 46973 - protein, 16 aa, Mycobacterium avium
TKFHPGTGVGRGGDDT

SEQ ID NO: 46974 - protein, 5 aa, Mycobacterium avium
TKGAV

SEQ ID NO: 46975 - protein, 4 aa, Mycobacterium avium
TKGG

SEQ ID NO: 46976 - protein, 5 aa, Mycobacterium avium
TKGVD

SEQ ID NO: 46977 - protein, 5 aa, Mycobacterium avium
TKHAR

SEQ ID NO: 46978 - protein, 9 aa, Mycobacterium avium
TKITGEEEA

SEQ ID NO: 46979 - protein, 5 aa, Mycobacterium avium
TKKPQ

SEQ ID NO: 46980 - protein, 7 aa, Mycobacterium avium
TKKQGND

SEQ ID NO: 46981 - protein, 8 aa, Mycobacterium avium
TKLADQVA

SEQ ID NO: 46982 - protein, 6 aa, Mycobacterium avium
TKLDGF

SEQ ID NO: 46983 - protein, 11 aa, Mycobacterium avium
TKLRDSPVAGR

SEQ ID NO: 46984 - protein, 10 aa, Mycobacterium avium
TKPDPDGGLD

SEQ ID NO: 46985 - protein, 9 aa, Mycobacterium avium
TKPDQGDRS

SEQ ID NO: 46986 - protein, 17 aa, Mycobacterium avium
TKPGDDPELRTESFEQA

SEQ ID NO: 46987 - protein, 6 aa, Mycobacterium avium
TKPGRN

SEQ ID NO: 46988 - protein, 9 aa, Mycobacterium avium
TKPGRQDDY

SEQ ID NO: 46989 - protein, 12 aa, Mycobacterium avium
TKPGTTTPHTEF

SEQ ID NO: 46990 - protein, 8 aa, Mycobacterium avium
TKPTRPDL

SEQ ID NO: 46991 - protein, 7 aa, Mycobacterium avium
TKQCPPS

SEQ ID NO: 46992 - protein, 7 aa, Mycobacterium avium
TKSSEVE

SEQ ID NO: 46993 - protein, 14 aa, Mycobacterium avium
TKTAAGAGEEQNRP

SEQ ID NO: 46994 - protein, 6 aa, Mycobacterium avium
TKTADW

SEQ ID NO: 46995 - protein, 13 aa, Mycobacterium avium
TKTARAQQLQDAA

SEQ ID NO: 46996 - protein, 7 aa, Mycobacterium avium
TKTDTVD

SEQ ID NO: 46997 - protein, 6 aa, Mycobacterium avium
TKTVPK

SEQ ID NO: 46998 - protein, 11 aa, Mycobacterium avium
TKVDPAADPAV

SEQ ID NO: 46999 - protein, 4 aa, Mycobacterium avium
TLAG

SEQ ID NO: 47000 - protein, 5 aa, Mycobacterium avium
TLAGR

SEQ ID NO: 47001 - protein, 9 aa, Mycobacterium avium
TLAPAAAQR

SEQ ID NO: 47002 - protein, 7 aa, Mycobacterium avium
TLAPSTV

SEQ ID NO: 47003 - protein, 6 aa, Mycobacterium avium
TLARRG

SEQ ID NO: 47004 - protein, 4 aa, Mycobacterium avium
TLDD

SEQ ID NO: 47005 - protein, 11 aa, Mycobacterium avium
TLDDAAAPALS

SEQ ID NO: 47006 - protein, 11 aa, Mycobacterium avium
TLDEGRPDAVA

SEQ ID NO: 47007 - protein, 4 aa, Mycobacterium avium
TLDP

SEQ ID NO: 47008 - protein, 12 aa, Mycobacterium avium
TLDPAQGSPFDS

SEQ ID NO: 47009 - protein, 10 aa, Mycobacterium avium
TLDPPTHTNH

SEQ ID NO: 47010 - protein, 6 aa, Mycobacterium avium
TLDPTA

SEQ ID NO: 47011 - protein, 8 aa, Mycobacterium avium
TLDTGTEA

SEQ ID NO: 47012 - protein, 7 aa, Mycobacterium avium
TLDTSST

SEQ ID NO: 47013 - protein, 9 aa, Mycobacterium avium
TLEERGKTA

SEQ ID NO: 47014 - protein, 4 aa, Mycobacterium avium
TLEP

SEQ ID NO: 47015 - protein, 17 aa, Mycobacterium avium
TLETREATYYSRSRGQQ

SEQ ID NO: 47016 - protein, 9 aa, Mycobacterium avium
TLGGAEDRR

SEQ ID NO: 47017 - protein, 8 aa, Mycobacterium avium
TLGGPRSG

SEQ ID NO: 47018 - protein, 5 aa, Mycobacterium avium
TLGGS

SEQ ID NO: 47019 - protein, 5 aa, Mycobacterium avium
TLGKA

SEQ ID NO: 47020 - protein, 5 aa, Mycobacterium avium
TLGNE

SEQ ID NO: 47021 - protein, 7 aa, Mycobacterium avium
TLGPASA

SEQ ID NO: 47022 - protein, 5 aa, Mycobacterium avium
TLGPG

SEQ ID NO: 47023 - protein, 8 aa, Mycobacterium avium
TLGPGDDA

SEQ ID NO: 47024 - protein, 9 aa, Mycobacterium avium
TLGPGDSAY

SEQ ID NO: 47025 - protein, 5 aa, Mycobacterium avium
TLGQG

SEQ ID NO: 47026 - protein, 13 aa, Mycobacterium avium
TLGTPERTPYAAA

SEQ ID NO: 47027 - protein, 8 aa, Mycobacterium avium
TLGTSQAA

SEQ ID NO: 47028 - protein, 8 aa, Mycobacterium avium
TLPETPQW

SEQ ID NO: 47029 - protein, 12 aa, Mycobacterium avium
TLPKSGVRASGL

SEQ ID NO: 47030 - protein, 7 aa, Mycobacterium avium
TLPNAGH

SEQ ID NO: 47031 - protein, 4 aa, Mycobacterium avium
TLPP

SEQ ID NO: 47032 - protein, 7 aa, Mycobacterium avium
TLPPAAG

SEQ ID NO: 47033 - protein, 7 aa, Mycobacterium avium
TLPQNSP

SEQ ID NO: 47034 - protein, 11 aa, Mycobacterium avium
TLPSTYAAPRE

SEQ ID NO: 47035 - protein, 7 aa, Mycobacterium avium
TLQPGGL

SEQ ID NO: 47036 - protein, 6 aa, Mycobacterium avium
TLQPGT

SEQ ID NO: 47037 - protein, 9 aa, Mycobacterium avium
TLRDGPGEC

SEQ ID NO: 47038 - protein, 12 aa, Mycobacterium avium
TLREHGAQPKAE

SEQ ID NO: 47039 - protein, 4 aa, Mycobacterium avium
TLRG

SEQ ID NO: 47040 - protein, 7 aa, Mycobacterium avium
TLRPGDR

SEQ ID NO: 47041 - protein, 8 aa, Mycobacterium avium
TLSGAPKV

SEQ ID NO: 47042 - protein, 6 aa, Mycobacterium avium
TLSGPQ

SEQ ID NO: 47043 - protein, 9 aa, Mycobacterium avium
TLSKDGPFP

SEQ ID NO: 47044 - protein, 8 aa, Mycobacterium avium
TLSPADAL

SEQ ID NO: 47045 - protein, 5 aa, Mycobacterium avium
TLSQA

SEQ ID NO: 47046 - protein, 11 aa, Mycobacterium avium
TLSRPGDSFED

SEQ ID NO: 47047 - protein, 5 aa, Mycobacterium avium
TLTGA

SEQ ID NO: 47048 - protein, 6 aa, Mycobacterium avium
TLTGAQ

SEQ ID NO: 47049 - protein, 14 aa, Mycobacterium avium
TMDSGADKAAELAN

SEQ ID NO: 47050 - protein, 11 aa, Mycobacterium avium
TMGNRGNSTGP

SEQ ID NO: 47051 - protein, 16 aa, Mycobacterium avium
TMGPEPQDSLLYAKIL

SEQ ID NO: 47052 - protein, 5 aa, Mycobacterium avium
TMHGR

SEQ ID NO: 47053 - protein, 15 aa, Mycobacterium avium
TMNDGEGSGVAPTDA

SEQ ID NO: 47054 - protein, 4 aa, Mycobacterium avium
TMPG

SEQ ID NO: 47055 - protein, 10 aa, Mycobacterium avium
TMPPDSVESF

SEQ ID NO: 47056 - protein, 9 aa, Mycobacterium avium
TMPQRAPAL

SEQ ID NO: 47057 - protein, 4 aa, Mycobacterium avium
TMST

SEQ ID NO: 47058 - protein, 8 aa, Mycobacterium avium
TNADYRQT

SEQ ID NO: 47059 - protein, 4 aa, Mycobacterium avium
TNAG

SEQ ID NO: 47060 - protein, 8 aa, Mycobacterium avium
TNAGKSSL

SEQ ID NO: 47061 - protein, 5 aa, Mycobacterium avium
TNAGV

SEQ ID NO: 47062 - protein, 19 aa, Mycobacterium avium
TNAPAPPADPLSIGSSARN

SEQ ID NO: 47063 - protein, 7 aa, Mycobacterium avium
TNAPGIS

SEQ ID NO: 47064 - protein, 7 aa, Mycobacterium avium
TNAQRSG

SEQ ID NO: 47065 - protein, 5 aa, Mycobacterium avium
TNATA

SEQ ID NO: 47066 - protein, 11 aa, Mycobacterium avium
TNDPAPQPMSS

SEQ ID NO: 47067 - protein, 4 aa, Mycobacterium avium
TNED

SEQ ID NO: 47068 - protein, 14 aa, Mycobacterium avium
TNEDQPQTSGDPRV

SEQ ID NO: 47069 - protein, 6 aa, Mycobacterium avium
TNEGLR

SEQ ID NO: 47070 - protein, 10 aa, Mycobacterium avium
TNENPHPPSR

SEQ ID NO: 47071 - protein, 7 aa, Mycobacterium avium
TNEQTDD

SEQ ID NO: 47072 - protein, 7 aa, Mycobacterium avium
TNESSRA

SEQ ID NO: 47073 - protein, 5 aa, Mycobacterium avium
TNEYP

SEQ ID NO: 47074 - protein, 4 aa, Mycobacterium avium
TNGP

SEQ ID NO: 47075 - protein, 5 aa, Mycobacterium avium
TNGRI

SEQ ID NO: 47076 - protein, 9 aa, Mycobacterium avium
TNGSQIPRE

SEQ ID NO: 47077 - protein, 22 aa, Mycobacterium avium
TNGSTLNIGGEDDDVDVPPFMR

SEQ ID NO: 47078 - protein, 7 aa, Mycobacterium avium
TNGVTRE

SEQ ID NO: 47079 - protein, 5 aa, Mycobacterium avium
TNHLD

SEQ ID NO: 47080 - protein, 8 aa, Mycobacterium avium
TNHVDGNT

SEQ ID NO: 47081 - protein, 6 aa, Mycobacterium avium
TNKKGL

SEQ ID NO: 47082 - protein, 6 aa, Mycobacterium avium
TNKQRP

SEQ ID NO: 47083 - protein, 8 aa, Mycobacterium avium
TNKYPNES

SEQ ID NO: 47084 - protein, 6 aa, Mycobacterium avium
TNNADN

SEQ ID NO: 47085 - protein, 7 aa, Mycobacterium avium
TNNETAV

SEQ ID NO: 47086 - protein, 8 aa, Mycobacterium avium
TNNPAEAA

SEQ ID NO: 47087 - protein, 5 aa, Mycobacterium avium
TNNWP

SEQ ID NO: 47088 - protein, 11 aa, Mycobacterium avium
TNPDAASHQQQ

SEQ ID NO: 47089 - protein, 10 aa, Mycobacterium avium
TNPDGTPTGG

SEQ ID NO: 47090 - protein, 9 aa, Mycobacterium avium
TNPEAKKHR

SEQ ID NO: 47091 - protein, 8 aa, Mycobacterium avium
TNPGQGVP

SEQ ID NO: 47092 - protein, 7 aa, Mycobacterium avium
TNPGTIG

SEQ ID NO: 47093 - protein, 5 aa, Mycobacterium avium
TNPPE

SEQ ID NO: 47094 - protein, 5 aa, Mycobacterium avium
TNPPI

SEQ ID NO: 47095 - protein, 6 aa, Mycobacterium avium
TNPPLD

SEQ ID NO: 47096 - protein, 4 aa, Mycobacterium avium
TNPR

SEQ ID NO: 47097 - protein, 4 aa, Mycobacterium avium
TNPS

SEQ ID NO: 47098 - protein, 9 aa, Mycobacterium avium
TNPVADSPV

SEQ ID NO: 47099 - protein, 5 aa, Mycobacterium avium
TNQRE

SEQ ID NO: 47100 - protein, 5 aa, Mycobacterium avium
TNRET

SEQ ID NO: 47101 - protein, 6 aa, Mycobacterium avium
TNRPAV

SEQ ID NO: 47102 - protein, 6 aa, Mycobacterium avium
TNRPDL

SEQ ID NO: 47103 - protein, 4 aa, Mycobacterium avium
TNRQ

SEQ ID NO: 47104 - protein, 8 aa, Mycobacterium avium
TNRVGEGH

SEQ ID NO: 47105 - protein, 4 aa, Mycobacterium avium
TNRY

SEQ ID NO: 47106 - protein, 10 aa, Mycobacterium avium
TNSAGKDGCA

SEQ ID NO: 47107 - protein, 5 aa, Mycobacterium avium
TNSPV

SEQ ID NO: 47108 - protein, 6 aa, Mycobacterium avium
TNTERA

SEQ ID NO: 47109 - protein, 5 aa, Mycobacterium avium
TNTTI

SEQ ID NO: 47110 - protein, 5 aa, Mycobacterium avium
TNTTP

SEQ ID NO: 47111 - protein, 5 aa, Mycobacterium avium
TPAAA

SEQ ID NO: 47112 - protein, 14 aa, Mycobacterium avium
TPAAPPARLCNESP

SEQ ID NO: 47113 - protein, 5 aa, Mycobacterium avium
TPAAQ

SEQ ID NO: 47114 - protein, 9 aa, Mycobacterium avium
TPAAQQAIA

SEQ ID NO: 47115 - protein, 11 aa, Mycobacterium avium
TPADEKNLDRW

SEQ ID NO: 47116 - protein, 5 aa, Mycobacterium avium
TPADF

SEQ ID NO: 47117 - protein, 8 aa, Mycobacterium avium
TPADGSEP

SEQ ID NO: 47118 - protein, 10 aa, Mycobacterium avium
TPAEEAGGGK

SEQ ID NO: 47119 - protein, 10 aa, Mycobacterium avium
TPAELGGVNP

SEQ ID NO: 47120 - protein, 20 aa, Mycobacterium avium
TPAGTAGPDGDRQYAQSPWR

SEQ ID NO: 47121 - protein, 17 aa, Mycobacterium avium
TPAKDAARAQRKAAEFG

SEQ ID NO: 47122 - protein, 8 aa, Mycobacterium avium
TPALGAAG

SEQ ID NO: 47123 - protein, 12 aa, Mycobacterium avium
TPALGQPRRTKH

SEQ ID NO: 47124 - protein, 12 aa, Mycobacterium avium
TPANISGPGPVG

SEQ ID NO: 47125 - protein, 4 aa, Mycobacterium avium
TPAP

SEQ ID NO: 47126 - protein, 11 aa, Mycobacterium avium
TPAPGGGWTAA

SEQ ID NO: 47127 - protein, 21 aa, Mycobacterium avium
TPAPGRDGSTGPGDSERASQH

SEQ ID NO: 47128 - protein, 11 aa, Mycobacterium avium
TPARARKPQRR

SEQ ID NO: 47129 - protein, 16 aa, Mycobacterium avium
TPARSDGGTRRYSDDD

SEQ ID NO: 47130 - protein, 12 aa, Mycobacterium avium
TPATPEESFGDD

SEQ ID NO: 47131 - protein, 5 aa, Mycobacterium avium
TPAVT

SEQ ID NO: 47132 - protein, 6 aa, Mycobacterium avium
TPDDEQ

SEQ ID NO: 47133 - protein, 4 aa, Mycobacterium avium
TPDE

SEQ ID NO: 47134 - protein, 6 aa, Mycobacterium avium
TPDEIE

SEQ ID NO: 47135 - protein, 8 aa, Mycobacterium avium
TPDEKWGE

SEQ ID NO: 47136 - protein, 6 aa, Mycobacterium avium
TPDERR

SEQ ID NO: 47137 - protein, 6 aa, Mycobacterium avium
TPDGGR

SEQ ID NO: 47138 - protein, 15 aa, Mycobacterium avium
TPDGHATNPPPRYTE

SEQ ID NO: 47139 - protein, 7 aa, Mycobacterium avium
TPDGPGE

SEQ ID NO: 47140 - protein, 9 aa, Mycobacterium avium
TPDGRPASR

SEQ ID NO: 47141 - protein, 5 aa, Mycobacterium avium
TPDGV

SEQ ID NO: 47142 - protein, 7 aa, Mycobacterium avium
TPDRMAT

SEQ ID NO: 47143 - protein, 5 aa, Mycobacterium avium
TPDRV

SEQ ID NO: 47144 - protein, 6 aa, Mycobacterium avium
TPDSFY

SEQ ID NO: 47145 - protein, 15 aa, Mycobacterium avium
TPDSGASAANDPAAI

SEQ ID NO: 47146 - protein, 8 aa, Mycobacterium avium
TPDSRWRN

SEQ ID NO: 47147 - protein, 9 aa, Mycobacterium avium
TPDSSRYWP

SEQ ID NO: 47148 - protein, 4 aa, Mycobacterium avium
TPDW

SEQ ID NO: 47149 - protein, 9 aa, Mycobacterium avium
TPEAIGGPA

SEQ ID NO: 47150 - protein, 9 aa, Mycobacterium avium
TPEATAEAD

SEQ ID NO: 47151 - protein, 4 aa, Mycobacterium avium
TPED

SEQ ID NO: 47152 - protein, 8 aa, Mycobacterium avium
TPEDTRAD

SEQ ID NO: 47153 - protein, 4 aa, Mycobacterium avium
TPEE

SEQ ID NO: 47154 - protein, 10 aa, Mycobacterium avium
TPEERADPKI

SEQ ID NO: 47155 - protein, 5 aa, Mycobacterium avium
TPEEV

SEQ ID NO: 47156 - protein, 4 aa, Mycobacterium avium
TPEF

SEQ ID NO: 47157 - protein, 12 aa, Mycobacterium avium
TPEGEPKPAVGA

SEQ ID NO: 47158 - protein, 7 aa, Mycobacterium avium
TPEGPNI

SEQ ID NO: 47159 - protein, 5 aa, Mycobacterium avium
TPEHQ

SEQ ID NO: 47160 - protein, 8 aa, Mycobacterium avium
TPEHSPDI

SEQ ID NO: 47161 - protein, 9 aa, Mycobacterium avium
TPEHTAKAR

SEQ ID NO: 47162 - protein, 7 aa, Mycobacterium avium
TPEHTAR

SEQ ID NO: 47163 - protein, 9 aa, Mycobacterium avium
TPEKADEHG

SEQ ID NO: 47164 - protein, 11 aa, Mycobacterium avium
TPEKVGKDAGE

SEQ ID NO: 47165 - protein, 7 aa, Mycobacterium avium
TPEPHGA

SEQ ID NO: 47166 - protein, 12 aa, Mycobacterium avium
TPEPRPPQQETV

SEQ ID NO: 47167 - protein, 6 aa, Mycobacterium avium
TPEQCA

SEQ ID NO: 47168 - protein, 6 aa, Mycobacterium avium
TPEQQQ

SEQ ID NO: 47169 - protein, 11 aa, Mycobacterium avium
TPERPDDADNT

SEQ ID NO: 47170 - protein, 5 aa, Mycobacterium avium
TPERR

SEQ ID NO: 47171 - protein, 12 aa, Mycobacterium avium
TPESVAQRLREL

SEQ ID NO: 47172 - protein, 10 aa, Mycobacterium avium
TPETNGEPNR

SEQ ID NO: 47173 - protein, 14 aa, Mycobacterium avium
TPEVASPPVAPGKP

SEQ ID NO: 47174 - protein, 9 aa, Mycobacterium avium
TPEYPLGQA

SEQ ID NO: 47175 - protein, 5 aa, Mycobacterium avium
TPFAS

SEQ ID NO: 47176 - protein, 6 aa, Mycobacterium avium
TPFPGT

SEQ ID NO: 47177 - protein, 7 aa, Mycobacterium avium
TPGAPEI

SEQ ID NO: 47178 - protein, 6 aa, Mycobacterium avium
TPGDRS

SEQ ID NO: 47179 - protein, 17 aa, Mycobacterium avium
TPGEYTQLTGRAGRRGI

SEQ ID NO: 47180 - protein, 5 aa, Mycobacterium avium
TPGFG

SEQ ID NO: 47181 - protein, 4 aa, Mycobacterium avium
TPGG

SEQ ID NO: 47182 - protein, 12 aa, Mycobacterium avium
TPGHADFGGEVE

SEQ ID NO: 47183 - protein, 7 aa, Mycobacterium avium
TPGHSPG

SEQ ID NO: 47184 - protein, 6 aa, Mycobacterium avium
TPGHTA

SEQ ID NO: 47185 - protein, 9 aa, Mycobacterium avium
TPGPPIPTT

SEQ ID NO: 47186 - protein, 9 aa, Mycobacterium avium
TPGPPRPGY

SEQ ID NO: 47187 - protein, 5 aa, Mycobacterium avium
TPGRL

SEQ ID NO: 47188 - protein, 19 aa, Mycobacterium avium
TPGTAAGPSRVGAYQRRGA

SEQ ID NO: 47189 - protein, 5 aa, Mycobacterium avium
TPHLN

SEQ ID NO: 47190 - protein, 5 aa, Mycobacterium avium
TPHPA

SEQ ID NO: 47191 - protein, 12 aa, Mycobacterium avium
TPIGKGKASGAL

SEQ ID NO: 47192 - protein, 15 aa, Mycobacterium avium
TPIGTARKGTLRDTS

SEQ ID NO: 47193 - protein, 5 aa, Mycobacterium avium
TPIPR

SEQ ID NO: 47194 - protein, 6 aa, Mycobacterium avium
TPIRTS

SEQ ID NO: 47195 - protein, 4 aa, Mycobacterium avium
TPLA

SEQ ID NO: 47196 - protein, 5 aa, Mycobacterium avium
TPLED

SEQ ID NO: 47197 - protein, 5 aa, Mycobacterium avium
TPLGT

SEQ ID NO: 47198 - protein, 9 aa, Mycobacterium avium
TPLPTPTGW

SEQ ID NO: 47199 - protein, 5 aa, Mycobacterium avium
TPLTE

SEQ ID NO: 47200 - protein, 6 aa, Mycobacterium avium
TPLTEE

SEQ ID NO: 47201 - protein, 6 aa, Mycobacterium avium
TPMASR

SEQ ID NO: 47202 - protein, 6 aa, Mycobacterium avium
TPMDQA

SEQ ID NO: 47203 - protein, 4 aa, Mycobacterium avium
TPPA

SEQ ID NO: 47204 - protein, 5 aa, Mycobacterium avium
TPPAA

SEQ ID NO: 47205 - protein, 10 aa, Mycobacterium avium
TPPATREQEN

SEQ ID NO: 47206 - protein, 8 aa, Mycobacterium avium
TPPDDAGR

SEQ ID NO: 47207 - protein, 6 aa, Mycobacterium avium
TPPEER

SEQ ID NO: 47208 - protein, 5 aa, Mycobacterium avium
TPPFP

SEQ ID NO: 47209 - protein, 6 aa, Mycobacterium avium
TPPGFE

SEQ ID NO: 47210 - protein, 19 aa, Mycobacterium avium
TPPGYPPYAENDWAGSEIT

SEQ ID NO: 47211 - protein, 5 aa, Mycobacterium avium
TPPLT

SEQ ID NO: 47212 - protein, 9 aa, Mycobacterium avium
TPPRDAQPQ

SEQ ID NO: 47213 - protein, 6 aa, Mycobacterium avium
TPPSRN

SEQ ID NO: 47214 - protein, 6 aa, Mycobacterium avium
TPPVGF

SEQ ID NO: 47215 - protein, 17 aa, Mycobacterium avium
TPPVGGHHADAQLAWID

SEQ ID NO: 47216 - protein, 4 aa, Mycobacterium avium
TPPY

SEQ ID NO: 47217 - protein, 6 aa, Mycobacterium avium
TPQAAR

SEQ ID NO: 47218 - protein, 5 aa, Mycobacterium avium
TPQEG

SEQ ID NO: 47219 - protein, 5 aa, Mycobacterium avium
TPQIP

SEQ ID NO: 47220 - protein, 11 aa, Mycobacterium avium
TPQPATPSAVA

SEQ ID NO: 47221 - protein, 30 aa, Mycobacterium avium
TPQQPGHDPRQLEAANRAARSGTPNYPAIK

SEQ ID NO: 47222 - protein, 11 aa, Mycobacterium avium
TPQSAPNYEDE

SEQ ID NO: 47223 - protein, 6 aa, Mycobacterium avium
TPQSYL

SEQ ID NO: 47224 - protein, 10 aa, Mycobacterium avium
TPQTSDSERE

SEQ ID NO: 47225 - protein, 5 aa, Mycobacterium avium
TPRAE

SEQ ID NO: 47226 - protein, 5 aa, Mycobacterium avium
TPRAG

SEQ ID NO: 47227 - protein, 9 aa, Mycobacterium avium
TPRAIQSQR

SEQ ID NO: 47228 - protein, 13 aa, Mycobacterium avium
TPRGGDPQSGTGS

SEQ ID NO: 47229 - protein, 13 aa, Mycobacterium avium
TPRGKQKNGSLTE

SEQ ID NO: 47230 - protein, 5 aa, Mycobacterium avium
TPRGR

SEQ ID NO: 47231 - protein, 5 aa, Mycobacterium avium
TPRIY

SEQ ID NO: 47232 - protein, 6 aa, Mycobacterium avium
TPRPAD

SEQ ID NO: 47233 - protein, 8 aa, Mycobacterium avium
TPRRPGSD

SEQ ID NO: 47234 - protein, 4 aa, Mycobacterium avium
TPRT

SEQ ID NO: 47235 - protein, 13 aa, Mycobacterium avium
TPSAAGTLSPQGL

SEQ ID NO: 47236 - protein, 9 aa, Mycobacterium avium
TPSAPDGHA

SEQ ID NO: 47237 - protein, 9 aa, Mycobacterium avium
TPSGDGRVK

SEQ ID NO: 47238 - protein, 8 aa, Mycobacterium avium
TPSGRGGA

SEQ ID NO: 47239 - protein, 6 aa, Mycobacterium avium
TPSGVE

SEQ ID NO: 47240 - protein, 12 aa, Mycobacterium avium
TPSKYGGEGAGT

SEQ ID NO: 47241 - protein, 4 aa, Mycobacterium avium
TPSN

SEQ ID NO: 47242 - protein, 6 aa, Mycobacterium avium
TPSPHI

SEQ ID NO: 47243 - protein, 9 aa, Mycobacterium avium
TPSPSGRTD

SEQ ID NO: 47244 - protein, 8 aa, Mycobacterium avium
TPSPTLNL

SEQ ID NO: 47245 - protein, 7 aa, Mycobacterium avium
TPSQRAD

SEQ ID NO: 47246 - protein, 9 aa, Mycobacterium avium
TPSRERVDS

SEQ ID NO: 47247 - protein, 6 aa, Mycobacterium avium
TPSSKV

SEQ ID NO: 47248 - protein, 9 aa, Mycobacterium avium
TPSTRPEQL

SEQ ID NO: 47249 - protein, 9 aa, Mycobacterium avium
TPSVDPPLD

SEQ ID NO: 47250 - protein, 5 aa, Mycobacterium avium
TPTAA

SEQ ID NO: 47251 - protein, 7 aa, Mycobacterium avium
TPTDTRE

SEQ ID NO: 47252 - protein, 10 aa, Mycobacterium avium
TPTERTTAKG

SEQ ID NO: 47253 - protein, 17 aa, Mycobacterium avium
TPTGQTYRSTAPPRAPA

SEQ ID NO: 47254 - protein, 10 aa, Mycobacterium avium
TPTGRPTGEW

SEQ ID NO: 47255 - protein, 10 aa, Mycobacterium avium
TPTPTAGPGQ

SEQ ID NO: 47256 - protein, 15 aa, Mycobacterium avium
TPTRAPTPVGASAYN

SEQ ID NO: 47257 - protein, 6 aa, Mycobacterium avium
TPTTAP

SEQ ID NO: 47258 - protein, 10 aa, Mycobacterium avium
TPTVADETPR

SEQ ID NO: 47259 - protein, 4 aa, Mycobacterium avium
TPTY

SEQ ID NO: 47260 - protein, 10 aa, Mycobacterium avium
TPVAGRTEAE

SEQ ID NO: 47261 - protein, 11 aa, Mycobacterium avium
TPVGKRNGALS

SEQ ID NO: 47262 - protein, 17 aa, Mycobacterium avium
TPVGREGETLTARSPLA

SEQ ID NO: 47263 - protein, 15 aa, Mycobacterium avium
TPVGVTTSGTFSPTL

SEQ ID NO: 47264 - protein, 5 aa, Mycobacterium avium
TPVKT

SEQ ID NO: 47265 - protein, 5 aa, Mycobacterium avium
TPVPG

SEQ ID NO: 47266 - protein, 23 aa, Mycobacterium avium
TPVPQPRPAPLSGASRTTWTGDG

SEQ ID NO: 47267 - protein, 4 aa, Mycobacterium avium
TPVR

SEQ ID NO: 47268 - protein, 6 aa, Mycobacterium avium
TPWKPQ

SEQ ID NO: 47269 - protein, 7 aa, Mycobacterium avium
TPYPPAR

SEQ ID NO: 47270 - protein, 12 aa, Mycobacterium avium
TPYPYTRDGQRR

SEQ ID NO: 47271 - protein, 5 aa, Mycobacterium avium
TPYQS

SEQ ID NO: 47272 - protein, 6 aa, Mycobacterium avium
TQAAAR

SEQ ID NO: 47273 - protein, 14 aa, Mycobacterium avium
TQAASGAGGQNRPE

SEQ ID NO: 47274 - protein, 7 aa, Mycobacterium avium
TQAENEG

SEQ ID NO: 47275 - protein, 5 aa, Mycobacterium avium
TQAGI

SEQ ID NO: 47276 - protein, 6 aa, Mycobacterium avium
TQALAR

SEQ ID NO: 47277 - protein, 7 aa, Mycobacterium avium
TQAQKDR

SEQ ID NO: 47278 - protein, 15 aa, Mycobacterium avium
TQASVPPQGGRKHPH

SEQ ID NO: 47279 - protein, 18 aa, Mycobacterium avium
TQDKTPVDRLPADGDGAD

SEQ ID NO: 47280 - protein, 23 aa, Mycobacterium avium
TQDMGSAGDGSGGPAGDLDDEIR

SEQ ID NO: 47281 - protein, 5 aa, Mycobacterium avium
TQDPA

SEQ ID NO: 47282 - protein, 9 aa, Mycobacterium avium
TQDPPTDQI

SEQ ID NO: 47283 - protein, 9 aa, Mycobacterium avium
TQDYPELDQ

SEQ ID NO: 47284 - protein, 6 aa, Mycobacterium avium
TQEHVT

SEQ ID NO: 47285 - protein, 14 aa, Mycobacterium avium
TQFDGYTSGSSKDF

SEQ ID NO: 47286 - protein, 10 aa, Mycobacterium avium
TQGADGEVTE

SEQ ID NO: 47287 - protein, 5 aa, Mycobacterium avium
TQGAG

SEQ ID NO: 47288 - protein, 4 aa, Mycobacterium avium
TQGE

SEQ ID NO: 47289 - protein, 6 aa, Mycobacterium avium
TQGERT

SEQ ID NO: 47290 - protein, 11 aa, Mycobacterium avium
TQGGGENNYER

SEQ ID NO: 47291 - protein, 11 aa, Mycobacterium avium
TQGMRNHAKTD

SEQ ID NO: 47292 - protein, 5 aa, Mycobacterium avium
TQGNT

SEQ ID NO: 47293 - protein, 4 aa, Mycobacterium avium
TQGS

SEQ ID NO: 47294 - protein, 5 aa, Mycobacterium avium
TQGYT

SEQ ID NO: 47295 - protein, 5 aa, Mycobacterium avium
TQHVD

SEQ ID NO: 47296 - protein, 6 aa, Mycobacterium avium
TQIGRN

SEQ ID NO: 47297 - protein, 6 aa, Mycobacterium avium
TQPAGF

SEQ ID NO: 47298 - protein, 7 aa, Mycobacterium avium
TQPDEVS

SEQ ID NO: 47299 - protein, 6 aa, Mycobacterium avium
TQPDQW

SEQ ID NO: 47300 - protein, 7 aa, Mycobacterium avium
TQPEYAT

SEQ ID NO: 47301 - protein, 16 aa, Mycobacterium avium
TQPHTSSGRVPTEKGY

SEQ ID NO: 47302 - protein, 6 aa, Mycobacterium avium
TQPTGA

SEQ ID NO: 47303 - protein, 7 aa, Mycobacterium avium
TQPTHRA

SEQ ID NO: 47304 - protein, 15 aa, Mycobacterium avium
TQPVGRSRRAKDAGM

SEQ ID NO: 47305 - protein, 17 aa, Mycobacterium avium
TQQNEATHEECPTQPDS

SEQ ID NO: 47306 - protein, 15 aa, Mycobacterium avium
TQQTYRELTSTSNCT

SEQ ID NO: 47307 - protein, 4 aa, Mycobacterium avium
TQRN

SEQ ID NO: 47308 - protein, 7 aa, Mycobacterium avium
TQRPSPF

SEQ ID NO: 47309 - protein, 10 aa, Mycobacterium avium
TQRRERPGDD

SEQ ID NO: 47310 - protein, 4 aa, Mycobacterium avium
TQSA

SEQ ID NO: 47311 - protein, 14 aa, Mycobacterium avium
TQSADEIDGPGATS

SEQ ID NO: 47312 - protein, 8 aa, Mycobacterium avium
TQSVGDET

SEQ ID NO: 47313 - protein, 4 aa, Mycobacterium avium
TQTA

SEQ ID NO: 47314 - protein, 8 aa, Mycobacterium avium
TQVGPQSP

SEQ ID NO: 47315 - protein, 10 aa, Mycobacterium avium
TQVRGPGQDR

SEQ ID NO: 47316 - protein, 8 aa, Mycobacterium avium
TQYPDDAT

SEQ ID NO: 47317 - protein, 7 aa, Mycobacterium avium
TRAADTV

SEQ ID NO: 47318 - protein, 10 aa, Mycobacterium avium
TRAAGSTDLR

SEQ ID NO: 47319 - protein, 6 aa, Mycobacterium avium
TRADGA

SEQ ID NO: 47320 - protein, 10 aa, Mycobacterium avium
TRADGERRPG

SEQ ID NO: 47321 - protein, 9 aa, Mycobacterium avium
TRADHQEQA

SEQ ID NO: 47322 - protein, 9 aa, Mycobacterium avium
TRAGDPAAM

SEQ ID NO: 47323 - protein, 6 aa, Mycobacterium avium
TRAPDG

SEQ ID NO: 47324 - protein, 13 aa, Mycobacterium avium
TRARRDPDGGYTI

SEQ ID NO: 47325 - protein, 11 aa, Mycobacterium avium
TRASSGEYEDR

SEQ ID NO: 47326 - protein, 7 aa, Mycobacterium avium
TRAVTTT

SEQ ID NO: 47327 - protein, 9 aa, Mycobacterium avium
TRDAQAAGA

SEQ ID NO: 47328 - protein, 7 aa, Mycobacterium avium
TRDDEES

SEQ ID NO: 47329 - protein, 6 aa, Mycobacterium avium
TRDEFD

SEQ ID NO: 47330 - protein, 11 aa, Mycobacterium avium
TRDEPHADADR

SEQ ID NO: 47331 - protein, 16 aa, Mycobacterium avium
TRDGAGKCTPHDGPAD

SEQ ID NO: 47332 - protein, 9 aa, Mycobacterium avium
TRDGGSFAT

SEQ ID NO: 47333 - protein, 10 aa, Mycobacterium avium
TRDGSPPEVV

SEQ ID NO: 47334 - protein, 8 aa, Mycobacterium avium
TRDLTDDQ

SEQ ID NO: 47335 - protein, 16 aa, Mycobacterium avium
TRDSLRAAAASAVAAG

SEQ ID NO: 47336 - protein, 7 aa, Mycobacterium avium
TRDTELG

SEQ ID NO: 47337 - protein, 7 aa, Mycobacterium avium
TRDTSPV

SEQ ID NO: 47338 - protein, 8 aa, Mycobacterium avium
TRDYDEAS

SEQ ID NO: 47339 - protein, 8 aa, Mycobacterium avium
TREEGNAM

SEQ ID NO: 47340 - protein, 5 aa, Mycobacterium avium
TREQL

SEQ ID NO: 47341 - protein, 7 aa, Mycobacterium avium
TRETRER

SEQ ID NO: 47342 - protein, 11 aa, Mycobacterium avium
TRFKPDKAKEI

SEQ ID NO: 47343 - protein, 5 aa, Mycobacterium avium
TRFQP

SEQ ID NO: 47344 - protein, 9 aa, Mycobacterium avium
TRGAKESLP

SEQ ID NO: 47345 - protein, 6 aa, Mycobacterium avium
TRGDDR

SEQ ID NO: 47346 - protein, 9 aa, Mycobacterium avium
TRGDIGEPY

SEQ ID NO: 47347 - protein, 8 aa, Mycobacterium avium
TRGEGDAT

SEQ ID NO: 47348 - protein, 10 aa, Mycobacterium avium
TRGKPAPAQL

SEQ ID NO: 47349 - protein, 19 aa, Mycobacterium avium
TRGNERPATTEVGERIAAA

SEQ ID NO: 47350 - protein, 5 aa, Mycobacterium avium
TRGPW

SEQ ID NO: 47351 - protein, 11 aa, Mycobacterium avium
TRGQSAEVAGA

SEQ ID NO: 47352 - protein, 4 aa, Mycobacterium avium
TRGV

SEQ ID NO: 47353 - protein, 4 aa, Mycobacterium avium
TRHG

SEQ ID NO: 47354 - protein, 6 aa, Mycobacterium avium
TRHPEQ

SEQ ID NO: 47355 - protein, 5 aa, Mycobacterium avium
TRHPR

SEQ ID NO: 47356 - protein, 4 aa, Mycobacterium avium
TRHS

SEQ ID NO: 47357 - protein, 4 aa, Mycobacterium avium
TRIG

SEQ ID NO: 47358 - protein, 18 aa, Mycobacterium avium
TRIPRGKDIESSAPARKI

SEQ ID NO: 47359 - protein, 5 aa, Mycobacterium avium
TRKGE

SEQ ID NO: 47360 - protein, 7 aa, Mycobacterium avium
TRKLGGD

SEQ ID NO: 47361 - protein, 20 aa, Mycobacterium avium
TRKPPAEPDLAKAGAHSADP

SEQ ID NO: 47362 - protein, 10 aa, Mycobacterium avium
TRKPSTDEPF

SEQ ID NO: 47363 - protein, 15 aa, Mycobacterium avium
TRLGLSGTRAVLDGL

SEQ ID NO: 47364 - protein, 8 aa, Mycobacterium avium
TRLTADGQ

SEQ ID NO: 47365 - protein, 17 aa, Mycobacterium avium
TRNDEPERASRPFDKDR

SEQ ID NO: 47366 - protein, 7 aa, Mycobacterium avium
TRNGQSL

SEQ ID NO: 47367 - protein, 9 aa, Mycobacterium avium
TRNPADAED

SEQ ID NO: 47368 - protein, 7 aa, Mycobacterium avium
TRNPSTG

SEQ ID NO: 47369 - protein, 22 aa, Mycobacterium avium
TRNPWDPRRTPGGSSGGSAAAV

SEQ ID NO: 47370 - protein, 4 aa, Mycobacterium avium
TRPA

SEQ ID NO: 47371 - protein, 10 aa, Mycobacterium avium
TRPADDQGPG

SEQ ID NO: 47372 - protein, 16 aa, Mycobacterium avium
TRPAPRLQNAASQADQ

SEQ ID NO: 47373 - protein, 5 aa, Mycobacterium avium
TRPAT

SEQ ID NO: 47374 - protein, 7 aa, Mycobacterium avium
TRPDGTE

SEQ ID NO: 47375 - protein, 4 aa, Mycobacterium avium
TRPE

SEQ ID NO: 47376 - protein, 12 aa, Mycobacterium avium
TRPEPRLENGAS

SEQ ID NO: 47377 - protein, 5 aa, Mycobacterium avium
TRPGG

SEQ ID NO: 47378 - protein, 13 aa, Mycobacterium avium
TRPGRTADPRGLS

SEQ ID NO: 47379 - protein, 5 aa, Mycobacterium avium
TRPLQ

SEQ ID NO: 47380 - protein, 6 aa, Mycobacterium avium
TRPNAR

SEQ ID NO: 47381 - protein, 14 aa, Mycobacterium avium
TRPNPDDPSGRSTM

SEQ ID NO: 47382 - protein, 5 aa, Mycobacterium avium
TRPPA

SEQ ID NO: 47383 - protein, 5 aa, Mycobacterium avium
TRPPD

SEQ ID NO: 47384 - protein, 4 aa, Mycobacterium avium
TRPS

SEQ ID NO: 47385 - protein, 4 aa, Mycobacterium avium
TRPT

SEQ ID NO: 47386 - protein, 6 aa, Mycobacterium avium
TRPTIG

SEQ ID NO: 47387 - protein, 6 aa, Mycobacterium avium
TRPTLR

SEQ ID NO: 47388 - protein, 8 aa, Mycobacterium avium
TRPTSATK

SEQ ID NO: 47389 - protein, 4 aa, Mycobacterium avium
TRPV

SEQ ID NO: 47390 - protein, 8 aa, Mycobacterium avium
TRRAAGAG

SEQ ID NO: 47391 - protein, 8 aa, Mycobacterium avium
TRRAEARA

SEQ ID NO: 47392 - protein, 4 aa, Mycobacterium avium
TRRE

SEQ ID NO: 47393 - protein, 6 aa, Mycobacterium avium
TRREGT

SEQ ID NO: 47394 - protein, 8 aa, Mycobacterium avium
TRRGERVS

SEQ ID NO: 47395 - protein, 5 aa, Mycobacterium avium
TRRPP

SEQ ID NO: 47396 - protein, 6 aa, Mycobacterium avium
TRRQAR

SEQ ID NO: 47397 - protein, 14 aa, Mycobacterium avium
TRRSTLSDAQRQTW

SEQ ID NO: 47398 - protein, 14 aa, Mycobacterium avium
TRSAGGDLSGRFGP

SEQ ID NO: 47399 - protein, 13 aa, Mycobacterium avium
TRSDLNDPKTIER

SEQ ID NO: 47400 - protein, 6 aa, Mycobacterium avium
TRSGDE

SEQ ID NO: 47401 - protein, 9 aa, Mycobacterium avium
TRSGDIDPS

SEQ ID NO: 47402 - protein, 7 aa, Mycobacterium avium
TRSRPGD

SEQ ID NO: 47403 - protein, 7 aa, Mycobacterium avium
TRSTAPP

SEQ ID NO: 47404 - protein, 6 aa, Mycobacterium avium
TRTDRI

SEQ ID NO: 47405 - protein, 6 aa, Mycobacterium avium
TRTGAR

SEQ ID NO: 47406 - protein, 12 aa, Mycobacterium avium
TRTGSRPRLTDD

SEQ ID NO: 47407 - protein, 7 aa, Mycobacterium avium
TRTSAVS

SEQ ID NO: 47408 - protein, 8 aa, Mycobacterium avium
TRTTELNE

SEQ ID NO: 47409 - protein, 6 aa, Mycobacterium avium
TRTTHA

SEQ ID NO: 47410 - protein, 9 aa, Mycobacterium avium
TRVAQETRR

SEQ ID NO: 47411 - protein, 6 aa, Mycobacterium avium
TRVDPD

SEQ ID NO: 47412 - protein, 10 aa, Mycobacterium avium
TRVGSGPFPT

SEQ ID NO: 47413 - protein, 6 aa, Mycobacterium avium
TRVKPG

SEQ ID NO: 47414 - protein, 6 aa, Mycobacterium avium
TRYGSD

SEQ ID NO: 47415 - protein, 8 aa, Mycobacterium avium
TRYPPAGV

SEQ ID NO: 47416 - protein, 16 aa, Mycobacterium avium
TRYRDGGDAKGKPQIA

SEQ ID NO: 47417 - protein, 9 aa, Mycobacterium avium
TSAAATVPQ

SEQ ID NO: 47418 - protein, 9 aa, Mycobacterium avium
TSAAGKSPA

SEQ ID NO: 47419 - protein, 7 aa, Mycobacterium avium
TSADSDD

SEQ ID NO: 47420 - protein, 6 aa, Mycobacterium avium
TSAEEL

SEQ ID NO: 47421 - protein, 7 aa, Mycobacterium avium
TSAEGTI

SEQ ID NO: 47422 - protein, 8 aa, Mycobacterium avium
TSAGAAAR

SEQ ID NO: 47423 - protein, 8 aa, Mycobacterium avium
TSAGERVD

SEQ ID NO: 47424 - protein, 10 aa, Mycobacterium avium
TSAKAHRRTE

SEQ ID NO: 47425 - protein, 9 aa, Mycobacterium avium
TSAKQDGRN

SEQ ID NO: 47426 - protein, 8 aa, Mycobacterium avium
TSAPAGAA

SEQ ID NO: 47427 - protein, 14 aa, Mycobacterium avium
TSAPLDEDASPTVY

SEQ ID NO: 47428 - protein, 5 aa, Mycobacterium avium
TSAPQ

SEQ ID NO: 47429 - protein, 12 aa, Mycobacterium avium
TSARQAVADLTP

SEQ ID NO: 47430 - protein, 16 aa, Mycobacterium avium
TSATGTVADITFRRPA

SEQ ID NO: 47431 - protein, 9 aa, Mycobacterium avium
TSATTPREA

SEQ ID NO: 47432 - protein, 13 aa, Mycobacterium avium
TSDASQVSADAVE

SEQ ID NO: 47433 - protein, 5 aa, Mycobacterium avium
TSDFK

SEQ ID NO: 47434 - protein, 5 aa, Mycobacterium avium
TSDGA

SEQ ID NO: 47435 - protein, 7 aa, Mycobacterium avium
TSDGKPF

SEQ ID NO: 47436 - protein, 5 aa, Mycobacterium avium
TSDGR

SEQ ID NO: 47437 - protein, 8 aa, Mycobacterium avium
TSDIPTAQ

SEQ ID NO: 47438 - protein, 4 aa, Mycobacterium avium
TSDP

SEQ ID NO: 47439 - protein, 11 aa, Mycobacterium avium
TSDPFGTPEEL

SEQ ID NO: 47440 - protein, 12 aa, Mycobacterium avium
TSDQSIVVTAAP

SEQ ID NO: 47441 - protein, 6 aa, Mycobacterium avium
TSDRYA

SEQ ID NO: 47442 - protein, 5 aa, Mycobacterium avium
TSDTA

SEQ ID NO: 47443 - protein, 8 aa, Mycobacterium avium
TSEAAERQ

SEQ ID NO: 47444 - protein, 6 aa, Mycobacterium avium
TSEDAM

SEQ ID NO: 47445 - protein, 6 aa, Mycobacterium avium
TSEHGL

SEQ ID NO: 47446 - protein, 8 aa, Mycobacterium avium
TSEPSPHD

SEQ ID NO: 47447 - protein, 6 aa, Mycobacterium avium
TSEQQW

SEQ ID NO: 47448 - protein, 9 aa, Mycobacterium avium
TSESARHGG

SEQ ID NO: 47449 - protein, 8 aa, Mycobacterium avium
TSETARRV

SEQ ID NO: 47450 - protein, 9 aa, Mycobacterium avium
TSETATPTI

SEQ ID NO: 47451 - protein, 6 aa, Mycobacterium avium
TSETPT

SEQ ID NO: 47452 - protein, 10 aa, Mycobacterium avium
TSEVYGSSAH

SEQ ID NO: 47453 - protein, 9 aa, Mycobacterium avium
TSGDPAAAT

SEQ ID NO: 47454 - protein, 6 aa, Mycobacterium avium
TSGEAY

SEQ ID NO: 47455 - protein, 7 aa, Mycobacterium avium
TSGEQRL

SEQ ID NO: 47456 - protein, 4 aa, Mycobacterium avium
TSGG

SEQ ID NO: 47457 - protein, 9 aa, Mycobacterium avium
TSGGAIPDR

SEQ ID NO: 47458 - protein, 7 aa, Mycobacterium avium
TSGGTSF

SEQ ID NO: 47459 - protein, 4 aa, Mycobacterium avium
TSGL

SEQ ID NO: 47460 - protein, 9 aa, Mycobacterium avium
TSGLGGQES

SEQ ID NO: 47461 - protein, 9 aa, Mycobacterium avium
TSGMPHEES

SEQ ID NO: 47462 - protein, 17 aa, Mycobacterium avium
TSGPALQQNLVAVMEGK

SEQ ID NO: 47463 - protein, 5 aa, Mycobacterium avium
TSGPG

SEQ ID NO: 47464 - protein, 13 aa, Mycobacterium avium
TSGPGFGHTRNPW

SEQ ID NO: 47465 - protein, 5 aa, Mycobacterium avium
TSGPV

SEQ ID NO: 47466 - protein, 11 aa, Mycobacterium avium
TSGPYTDPDAT

SEQ ID NO: 47467 - protein, 9 aa, Mycobacterium avium
TSGRTDTTV

SEQ ID NO: 47468 - protein, 6 aa, Mycobacterium avium
TSGSID

SEQ ID NO: 47469 - protein, 11 aa, Mycobacterium avium
TSGSTRTPTGV

SEQ ID NO: 47470 - protein, 8 aa, Mycobacterium avium
TSGVSRSD

SEQ ID NO: 47471 - protein, 4 aa, Mycobacterium avium
TSIP

SEQ ID NO: 47472 - protein, 4 aa, Mycobacterium avium
TSIQ

SEQ ID NO: 47473 - protein, 7 aa, Mycobacterium avium
TSLAGGT

SEQ ID NO: 47474 - protein, 4 aa, Mycobacterium avium
TSLE

SEQ ID NO: 47475 - protein, 5 aa, Mycobacterium avium
TSLED

SEQ ID NO: 47476 - protein, 6 aa, Mycobacterium avium
TSLPGV

SEQ ID NO: 47477 - protein, 11 aa, Mycobacterium avium
TSLRDGSHHKR

SEQ ID NO: 47478 - protein, 6 aa, Mycobacterium avium
TSMEQG

SEQ ID NO: 47479 - protein, 7 aa, Mycobacterium avium
TSNAQNA

SEQ ID NO: 47480 - protein, 6 aa, Mycobacterium avium
TSNGPA

SEQ ID NO: 47481 - protein, 8 aa, Mycobacterium avium
TSNLDDPE

SEQ ID NO: 47482 - protein, 6 aa, Mycobacterium avium
TSNTAG

SEQ ID NO: 47483 - protein, 8 aa, Mycobacterium avium
TSPAGARY

SEQ ID NO: 47484 - protein, 5 aa, Mycobacterium avium
TSPAN

SEQ ID NO: 47485 - protein, 7 aa, Mycobacterium avium
TSPDEAA

SEQ ID NO: 47486 - protein, 6 aa, Mycobacterium avium
TSPEAT

SEQ ID NO: 47487 - protein, 10 aa, Mycobacterium avium
TSPEPRGVGT

SEQ ID NO: 47488 - protein, 7 aa, Mycobacterium avium
TSPGTRT

SEQ ID NO: 47489 - protein, 4 aa, Mycobacterium avium
TSPL

SEQ ID NO: 47490 - protein, 7 aa, Mycobacterium avium
TSPLDTQ

SEQ ID NO: 47491 - protein, 7 aa, Mycobacterium avium
TSPPETL

SEQ ID NO: 47492 - protein, 6 aa, Mycobacterium avium
TSPRGL

SEQ ID NO: 47493 - protein, 9 aa, Mycobacterium avium
TSPSLTAAP

SEQ ID NO: 47494 - protein, 8 aa, Mycobacterium avium
TSPTNESK

SEQ ID NO: 47495 - protein, 4 aa, Mycobacterium avium
TSPV

SEQ ID NO: 47496 - protein, 6 aa, Mycobacterium avium
TSPWPE

SEQ ID NO: 47497 - protein, 8 aa, Mycobacterium avium
TSRDLTEN

SEQ ID NO: 47498 - protein, 6 aa, Mycobacterium avium
TSRGGR

SEQ ID NO: 47499 - protein, 6 aa, Mycobacterium avium
TSRGPH

SEQ ID NO: 47500 - protein, 15 aa, Mycobacterium avium
TSRPWRDGPSDSERD

SEQ ID NO: 47501 - protein, 9 aa, Mycobacterium avium
TSRSPKDLP

SEQ ID NO: 47502 - protein, 8 aa, Mycobacterium avium
TSSAEEDI

SEQ ID NO: 47503 - protein, 6 aa, Mycobacterium avium
TSSAEQ

SEQ ID NO: 47504 - protein, 11 aa, Mycobacterium avium
TSSARSATERE

SEQ ID NO: 47505 - protein, 9 aa, Mycobacterium avium
TSSIREGSR

SEQ ID NO: 47506 - protein, 20 aa, Mycobacterium avium
TSSNPTAGGAAVGSGIGPTR

SEQ ID NO: 47507 - protein, 6 aa, Mycobacterium avium
TSSPGF

SEQ ID NO: 47508 - protein, 6 aa, Mycobacterium avium
TSSPGS

SEQ ID NO: 47509 - protein, 6 aa, Mycobacterium avium
TSSPVA

SEQ ID NO: 47510 - protein, 14 aa, Mycobacterium avium
TSSPVAADSRGLGT

SEQ ID NO: 47511 - protein, 10 aa, Mycobacterium avium
TSSTGPAGEE

SEQ ID NO: 47512 - protein, 11 aa, Mycobacterium avium
TSSVTRDAATD

SEQ ID NO: 47513 - protein, 5 aa, Mycobacterium avium
TSTAA

SEQ ID NO: 47514 - protein, 8 aa, Mycobacterium avium
TSTADANI

SEQ ID NO: 47515 - protein, 5 aa, Mycobacterium avium
TSTAW

SEQ ID NO: 47516 - protein, 8 aa, Mycobacterium avium
TSTDISEQ

SEQ ID NO: 47517 - protein, 8 aa, Mycobacterium avium
TSTERADV

SEQ ID NO: 47518 - protein, 8 aa, Mycobacterium avium
TSTGRRDD

SEQ ID NO: 47519 - protein, 6 aa, Mycobacterium avium
TSTGRS

SEQ ID NO: 47520 - protein, 7 aa, Mycobacterium avium
TSTKDLK

SEQ ID NO: 47521 - protein, 7 aa, Mycobacterium avium
TSTQSDI

SEQ ID NO: 47522 - protein, 12 aa, Mycobacterium avium
TSTRDDRVHPGH

SEQ ID NO: 47523 - protein, 9 aa, Mycobacterium avium
TSTRQSRKG

SEQ ID NO: 47524 - protein, 8 aa, Mycobacterium avium
TSTTAAGR

SEQ ID NO: 47525 - protein, 6 aa, Mycobacterium avium
TSTTKS

SEQ ID NO: 47526 - protein, 7 aa, Mycobacterium avium
TSTTWPK

SEQ ID NO: 47527 - protein, 11 aa, Mycobacterium avium
TSVAERVAGAG

SEQ ID NO: 47528 - protein, 7 aa, Mycobacterium avium
TSVGPDV

SEQ ID NO: 47529 - protein, 4 aa, Mycobacterium avium
TSVP

SEQ ID NO: 47530 - protein, 7 aa, Mycobacterium avium
TSYATHN

SEQ ID NO: 47531 - protein, 5 aa, Mycobacterium avium
TSYLR

SEQ ID NO: 47532 - protein, 4 aa, Mycobacterium avium
TTAD

SEQ ID NO: 47533 - protein, 7 aa, Mycobacterium avium
TTAGGSM

SEQ ID NO: 47534 - protein, 5 aa, Mycobacterium avium
TTAGL

SEQ ID NO: 47535 - protein, 5 aa, Mycobacterium avium
TTAPA

SEQ ID NO: 47536 - protein, 21 aa, Mycobacterium avium
TTAPAGDTFPTAAPKSLISGE

SEQ ID NO: 47537 - protein, 10 aa, Mycobacterium avium
TTASKSPKEH

SEQ ID NO: 47538 - protein, 9 aa, Mycobacterium avium
TTASSTVTE

SEQ ID NO: 47539 - protein, 12 aa, Mycobacterium avium
TTASTEEITDTA

SEQ ID NO: 47540 - protein, 6 aa, Mycobacterium avium
TTATTL

SEQ ID NO: 47541 - protein, 4 aa, Mycobacterium avium
TTDA

SEQ ID NO: 47542 - protein, 16 aa, Mycobacterium avium
TTDDDGNEVLTFAFQP

SEQ ID NO: 47543 - protein, 7 aa, Mycobacterium avium
TTDEDAG

SEQ ID NO: 47544 - protein, 14 aa, Mycobacterium avium
TTDKADIATAAGAT

SEQ ID NO: 47545 - protein, 10 aa, Mycobacterium avium
TTDNEQQALD

SEQ ID NO: 47546 - protein, 4 aa, Mycobacterium avium
TTDP

SEQ ID NO: 47547 - protein, 8 aa, Mycobacterium avium
TTDPAALE

SEQ ID NO: 47548 - protein, 8 aa, Mycobacterium avium
TTDRPTQV

SEQ ID NO: 47549 - protein, 6 aa, Mycobacterium avium
TTDTGS

SEQ ID NO: 47550 - protein, 7 aa, Mycobacterium avium
TTEAAEG

SEQ ID NO: 47551 - protein, 5 aa, Mycobacterium avium
TTEAG

SEQ ID NO: 47552 - protein, 7 aa, Mycobacterium avium
TTEDGTG

SEQ ID NO: 47553 - protein, 15 aa, Mycobacterium avium
TTEDPANGFRPDTGR

SEQ ID NO: 47554 - protein, 6 aa, Mycobacterium avium
TTEEQK

SEQ ID NO: 47555 - protein, 7 aa, Mycobacterium avium
TTEGERQ

SEQ ID NO: 47556 - protein, 9 aa, Mycobacterium avium
TTEKPETMS

SEQ ID NO: 47557 - protein, 5 aa, Mycobacterium avium
TTELS

SEQ ID NO: 47558 - protein, 7 aa, Mycobacterium avium
TTENPSF

SEQ ID NO: 47559 - protein, 7 aa, Mycobacterium avium
TTEPITT

SEQ ID NO: 47560 - protein, 6 aa, Mycobacterium avium
TTEQLG

SEQ ID NO: 47561 - protein, 8 aa, Mycobacterium avium
TTESDQIR

SEQ ID NO: 47562 - protein, 6 aa, Mycobacterium avium
TTETPL

SEQ ID NO: 47563 - protein, 16 aa, Mycobacterium avium
TTFGSGGHGPAVSSDA

SEQ ID NO: 47564 - protein, 5 aa, Mycobacterium avium
TTFPN

SEQ ID NO: 47565 - protein, 9 aa, Mycobacterium avium
TTGATARES

SEQ ID NO: 47566 - protein, 5 aa, Mycobacterium avium
TTGDH

SEQ ID NO: 47567 - protein, 9 aa, Mycobacterium avium
TTGDTRNGR

SEQ ID NO: 47568 - protein, 5 aa, Mycobacterium avium
TTGDV

SEQ ID NO: 47569 - protein, 6 aa, Mycobacterium avium
TTGDYV

SEQ ID NO: 47570 - protein, 12 aa, Mycobacterium avium
TTGGDAWEGRAG

SEQ ID NO: 47571 - protein, 15 aa, Mycobacterium avium
TTGGSQKAINADRGG

SEQ ID NO: 47572 - protein, 18 aa, Mycobacterium avium
TTGIPTRAITGERRQGPV

SEQ ID NO: 47573 - protein, 8 aa, Mycobacterium avium
TTGPAEVD

SEQ ID NO: 47574 - protein, 10 aa, Mycobacterium avium
TTGPWTGPSS

SEQ ID NO: 47575 - protein, 15 aa, Mycobacterium avium
TTGRKSGKPRRTAVG

SEQ ID NO: 47576 - protein, 11 aa, Mycobacterium avium
TTGRKTGQPRV

SEQ ID NO: 47577 - protein, 6 aa, Mycobacterium avium
TTGSSG

SEQ ID NO: 47578 - protein, 4 aa, Mycobacterium avium
TTGT

SEQ ID NO: 47579 - protein, 7 aa, Mycobacterium avium
TTGTHGN

SEQ ID NO: 47580 - protein, 6 aa, Mycobacterium avium
TTGVSD

SEQ ID NO: 47581 - protein, 8 aa, Mycobacterium avium
TTGYGSAV

SEQ ID NO: 47582 - protein, 4 aa, Mycobacterium avium
TTHA

SEQ ID NO: 47583 - protein, 21 aa, Mycobacterium avium
TTHPATPGPAPPPDPDDEPPP

SEQ ID NO: 47584 - protein, 5 aa, Mycobacterium avium
TTHPD

SEQ ID NO: 47585 - protein, 7 aa, Mycobacterium avium
TTHRETP

SEQ ID NO: 47586 - protein, 7 aa, Mycobacterium avium
TTHTGTA

SEQ ID NO: 47587 - protein, 6 aa, Mycobacterium avium
TTIPAG

SEQ ID NO: 47588 - protein, 9 aa, Mycobacterium avium
TTIYGGTSE

SEQ ID NO: 47589 - protein, 10 aa, Mycobacterium avium
TTKAAADELP

SEQ ID NO: 47590 - protein, 8 aa, Mycobacterium avium
TTKPGITA

SEQ ID NO: 47591 - protein, 6 aa, Mycobacterium avium
TTKRPA

SEQ ID NO: 47592 - protein, 8 aa, Mycobacterium avium
TTKTHQGA

SEQ ID NO: 47593 - protein, 4 aa, Mycobacterium avium
TTKV

SEQ ID NO: 47594 - protein, 16 aa, Mycobacterium avium
TTLAENGVTPSADRRE

SEQ ID NO: 47595 - protein, 7 aa, Mycobacterium avium
TTLEPGR

SEQ ID NO: 47596 - protein, 12 aa, Mycobacterium avium
TTLNGPKSTKDV

SEQ ID NO: 47597 - protein, 4 aa, Mycobacterium avium
TTLR

SEQ ID NO: 47598 - protein, 12 aa, Mycobacterium avium
TTMSAASGAKLD

SEQ ID NO: 47599 - protein, 7 aa, Mycobacterium avium
TTNPPVE

SEQ ID NO: 47600 - protein, 15 aa, Mycobacterium avium
TTNTGEPETTKGEAE

SEQ ID NO: 47601 - protein, 5 aa, Mycobacterium avium
TTPDG

SEQ ID NO: 47602 - protein, 17 aa, Mycobacterium avium
TTPDGDYQTYKANDGAY

SEQ ID NO: 47603 - protein, 6 aa, Mycobacterium avium
TTPEDY

SEQ ID NO: 47604 - protein, 7 aa, Mycobacterium avium
TTPEQQR

SEQ ID NO: 47605 - protein, 6 aa, Mycobacterium avium
TTPERT

SEQ ID NO: 47606 - protein, 4 aa, Mycobacterium avium
TTPF

SEQ ID NO: 47607 - protein, 8 aa, Mycobacterium avium
TTPGPQSC

SEQ ID NO: 47608 - protein, 6 aa, Mycobacterium avium
TTPGQS

SEQ ID NO: 47609 - protein, 5 aa, Mycobacterium avium
TTPGV

SEQ ID NO: 47610 - protein, 5 aa, Mycobacterium avium
TTPHH

SEQ ID NO: 47611 - protein, 18 aa, Mycobacterium avium
TTPLHTHPDDPVSGSLAG

SEQ ID NO: 47612 - protein, 7 aa, Mycobacterium avium
TTPLTRQ

SEQ ID NO: 47613 - protein, 15 aa, Mycobacterium avium
TTPNRLREDTGCTSL

SEQ ID NO: 47614 - protein, 9 aa, Mycobacterium avium
TTPRAPVGV

SEQ ID NO: 47615 - protein, 5 aa, Mycobacterium avium
TTPRM

SEQ ID NO: 47616 - protein, 13 aa, Mycobacterium avium
TTQASPETEAGDT

SEQ ID NO: 47617 - protein, 6 aa, Mycobacterium avium
TTQEER

SEQ ID NO: 47618 - protein, 6 aa, Mycobacterium avium
TTQIDP

SEQ ID NO: 47619 - protein, 11 aa, Mycobacterium avium
TTQKRRPRPYS

SEQ ID NO: 47620 - protein, 6 aa, Mycobacterium avium
TTQPQG

SEQ ID NO: 47621 - protein, 6 aa, Mycobacterium avium
TTQQAE

SEQ ID NO: 47622 - protein, 6 aa, Mycobacterium avium
TTRANE

SEQ ID NO: 47623 - protein, 4 aa, Mycobacterium avium
TTRE

SEQ ID NO: 47624 - protein, 7 aa, Mycobacterium avium
TTREGTV

SEQ ID NO: 47625 - protein, 17 aa, Mycobacterium avium
TTRGGAGGSRKSGAADW

SEQ ID NO: 47626 - protein, 5 aa, Mycobacterium avium
TTRGR

SEQ ID NO: 47627 - protein, 4 aa, Mycobacterium avium
TTRI

SEQ ID NO: 47628 - protein, 8 aa, Mycobacterium avium
TTRLPGQS

SEQ ID NO: 47629 - protein, 9 aa, Mycobacterium avium
TTRPPRVAE

SEQ ID NO: 47630 - protein, 6 aa, Mycobacterium avium
TTRRGS

SEQ ID NO: 47631 - protein, 4 aa, Mycobacterium avium
TTRS

SEQ ID NO: 47632 - protein, 12 aa, Mycobacterium avium
TTRSPEDAEDAL

SEQ ID NO: 47633 - protein, 7 aa, Mycobacterium avium
TTRTDFS

SEQ ID NO: 47634 - protein, 7 aa, Mycobacterium avium
TTSDPYV

SEQ ID NO: 47635 - protein, 6 aa, Mycobacterium avium
TTSEGG

SEQ ID NO: 47636 - protein, 5 aa, Mycobacterium avium
TTSGE

SEQ ID NO: 47637 - protein, 11 aa, Mycobacterium avium
TTSGGPSRYLG

SEQ ID NO: 47638 - protein, 8 aa, Mycobacterium avium
TTSGNSAN

SEQ ID NO: 47639 - protein, 15 aa, Mycobacterium avium
TTSGVDDEITTTAGP

SEQ ID NO: 47640 - protein, 16 aa, Mycobacterium avium
TTSSGSEQARRAAAPW

SEQ ID NO: 47641 - protein, 7 aa, Mycobacterium avium
TTTAKEA

SEQ ID NO: 47642 - protein, 7 aa, Mycobacterium avium
TTTERRE

SEQ ID NO: 47643 - protein, 4 aa, Mycobacterium avium
TTTM

SEQ ID NO: 47644 - protein, 15 aa, Mycobacterium avium
TTTNHSNDGAAPMTA

SEQ ID NO: 47645 - protein, 8 aa, Mycobacterium avium
TTTPDYRI

SEQ ID NO: 47646 - protein, 11 aa, Mycobacterium avium
TTTPKKPNSAL

SEQ ID NO: 47647 - protein, 4 aa, Mycobacterium avium
TTTT

SEQ ID NO: 47648 - protein, 4 aa, Mycobacterium avium
TTVD

SEQ ID NO: 47649 - protein, 9 aa, Mycobacterium avium
TTVQPGPLA

SEQ ID NO: 47650 - protein, 10 aa, Mycobacterium avium
TTWPSRPGRV

SEQ ID NO: 47651 - protein, 6 aa, Mycobacterium avium
TTWQGP

SEQ ID NO: 47652 - protein, 10 aa, Mycobacterium avium
TTYDQAAEAA

SEQ ID NO: 47653 - protein, 5 aa, Mycobacterium avium
TTYPG

SEQ ID NO: 47654 - protein, 6 aa, Mycobacterium avium
TVAPAA

SEQ ID NO: 47655 - protein, 13 aa, Mycobacterium avium
TVASQTRAVGERA

SEQ ID NO: 47656 - protein, 11 aa, Mycobacterium avium
TVDDAAGEAYD

SEQ ID NO: 47657 - protein, 8 aa, Mycobacterium avium
TVDPGDAR

SEQ ID NO: 47658 - protein, 11 aa, Mycobacterium avium
TVDPGDATDEF

SEQ ID NO: 47659 - protein, 20 aa, Mycobacterium avium
TVDPTSSTTALTGSTEEGQF

SEQ ID NO: 47660 - protein, 9 aa, Mycobacterium avium
TVDRDGVGG

SEQ ID NO: 47661 - protein, 19 aa, Mycobacterium avium
TVDTPRTETNDKRGGNHNA

SEQ ID NO: 47662 - protein, 8 aa, Mycobacterium avium
TVDTTGAE

SEQ ID NO: 47663 - protein, 14 aa, Mycobacterium avium
TVESSGTGMAEPTA

SEQ ID NO: 47664 - protein, 5 aa, Mycobacterium avium
TVGAA

SEQ ID NO: 47665 - protein, 6 aa, Mycobacterium avium
TVGDER

SEQ ID NO: 47666 - protein, 5 aa, Mycobacterium avium
TVGDI

SEQ ID NO: 47667 - protein, 8 aa, Mycobacterium avium
TVGERGPT

SEQ ID NO: 47668 - protein, 5 aa, Mycobacterium avium
TVGGA

SEQ ID NO: 47669 - protein, 6 aa, Mycobacterium avium
TVGGKT

SEQ ID NO: 47670 - protein, 13 aa, Mycobacterium avium
TVGRNGGSGVSSR

SEQ ID NO: 47671 - protein, 5 aa, Mycobacterium avium
TVGRR

SEQ ID NO: 47672 - protein, 15 aa, Mycobacterium avium
TVGSAAAVPARRPEL

SEQ ID NO: 47673 - protein, 8 aa, Mycobacterium avium
TVGSDTIA

SEQ ID NO: 47674 - protein, 6 aa, Mycobacterium avium
TVGSRT

SEQ ID NO: 47675 - protein, 5 aa, Mycobacterium avium
TVGTA

SEQ ID NO: 47676 - protein, 11 aa, Mycobacterium avium
TVKPEAQAAKD

SEQ ID NO: 47677 - protein, 5 aa, Mycobacterium avium
TVPAG

SEQ ID NO: 47678 - protein, 5 aa, Mycobacterium avium
TVPEH

SEQ ID NO: 47679 - protein, 5 aa, Mycobacterium avium
TVPPF

SEQ ID NO: 47680 - protein, 8 aa, Mycobacterium avium
TVQESTAQ

SEQ ID NO: 47681 - protein, 7 aa, Mycobacterium avium
TVQQSGE

SEQ ID NO: 47682 - protein, 15 aa, Mycobacterium avium
TVRPDSGRVKRGKTV

SEQ ID NO: 47683 - protein, 8 aa, Mycobacterium avium
TVRQSDYG

SEQ ID NO: 47684 - protein, 11 aa, Mycobacterium avium
TVRSATLNGRD

SEQ ID NO: 47685 - protein, 8 aa, Mycobacterium avium
TVRTASRQ

SEQ ID NO: 47686 - protein, 5 aa, Mycobacterium avium
TVSEA

SEQ ID NO: 47687 - protein, 11 aa, Mycobacterium avium
TVTASAARVGV

SEQ ID NO: 47688 - protein, 8 aa, Mycobacterium avium
TVTATTSV

SEQ ID NO: 47689 - protein, 4 aa, Mycobacterium avium
TVTE

SEQ ID NO: 47690 - protein, 9 aa, Mycobacterium avium
TVTGETSTL

SEQ ID NO: 47691 - protein, 7 aa, Mycobacterium avium
TVTGTPD

SEQ ID NO: 47692 - protein, 4 aa, Mycobacterium avium
TVTP

SEQ ID NO: 47693 - protein, 6 aa, Mycobacterium avium
TVTPRY

SEQ ID NO: 47694 - protein, 21 aa, Mycobacterium avium
TVTRRNDVDTGARPGRLVRGA

SEQ ID NO: 47695 - protein, 6 aa, Mycobacterium avium
TVTTDV

SEQ ID NO: 47696 - protein, 6 aa, Mycobacterium avium
TVTTTA

SEQ ID NO: 47697 - protein, 15 aa, Mycobacterium avium
TVVPGHGPVTDPDGI

SEQ ID NO: 47698 - protein, 11 aa, Mycobacterium avium
TWPAGDTVGGQ

SEQ ID NO: 47699 - protein, 4 aa, Mycobacterium avium
TWPG

SEQ ID NO: 47700 - protein, 5 aa, Mycobacterium avium
TWRTR

SEQ ID NO: 47701 - protein, 6 aa, Mycobacterium avium
TWSGDA

SEQ ID NO: 47702 - protein, 7 aa, Mycobacterium avium
TWTGAGG

SEQ ID NO: 47703 - protein, 4 aa, Mycobacterium avium
TYAG

SEQ ID NO: 47704 - protein, 5 aa, Mycobacterium avium
TYASS

SEQ ID NO: 47705 - protein, 9 aa, Mycobacterium avium
TYDKPPTVQ

SEQ ID NO: 47706 - protein, 11 aa, Mycobacterium avium
TYDQVSRNPQV

SEQ ID NO: 47707 - protein, 10 aa, Mycobacterium avium
TYEGREKEVS

SEQ ID NO: 47708 - protein, 7 aa, Mycobacterium avium
TYEPETS

SEQ ID NO: 47709 - protein, 15 aa, Mycobacterium avium
TYEPSRTGWTENPRA

SEQ ID NO: 47710 - protein, 8 aa, Mycobacterium avium
TYESPGDL

SEQ ID NO: 47711 - protein, 7 aa, Mycobacterium avium
TYGDGGN

SEQ ID NO: 47712 - protein, 5 aa, Mycobacterium avium
TYGRP

SEQ ID NO: 47713 - protein, 12 aa, Mycobacterium avium
TYGSGDWGRTPH

SEQ ID NO: 47714 - protein, 6 aa, Mycobacterium avium
TYGTNN

SEQ ID NO: 47715 - protein, 4 aa, Mycobacterium avium
TYPA

SEQ ID NO: 47716 - protein, 9 aa, Mycobacterium avium
TYPGAGASI

SEQ ID NO: 47717 - protein, 11 aa, Mycobacterium avium
TYPGPGGTIGP

SEQ ID NO: 47718 - protein, 5 aa, Mycobacterium avium
TYPGT

SEQ ID NO: 47719 - protein, 5 aa, Mycobacterium avium
TYQGK

SEQ ID NO: 47720 - protein, 11 aa, Mycobacterium avium
TYRDANAAANR

SEQ ID NO: 47721 - protein, 11 aa, Mycobacterium avium
TYRITGTRGTS

SEQ ID NO: 47722 - protein, 6 aa, Mycobacterium avium
TYSPTG

SEQ ID NO: 47723 - protein, 6 aa, Mycobacterium avium
TYSTDN

SEQ ID NO: 47724 - protein, 10 aa, Mycobacterium avium
TYTPGDTLRR

SEQ ID NO: 47725 - protein, 10 aa, Mycobacterium avium
TYTSPGDVTA

SEQ ID NO: 47726 - protein, 15 aa, Mycobacterium avium
VAAAESRWLELSELL

SEQ ID NO: 47727 - protein, 8 aa, Mycobacterium avium
VAAAGGAQ

SEQ ID NO: 47728 - protein, 6 aa, Mycobacterium avium
VAADTR

SEQ ID NO: 47729 - protein, 42 aa, Mycobacterium avium
VAAERSRREEHRAAQTARKEALAAEAEELAANSTQWKAAGDR

SEQ ID NO: 47730 - protein, 14 aa, Mycobacterium avium
VAAGGDDADPGIPP

SEQ ID NO: 47731 - protein, 10 aa, Mycobacterium avium
VAAGNAKLSR

SEQ ID NO: 47732 - protein, 5 aa, Mycobacterium avium
VAAGR

SEQ ID NO: 47733 - protein, 8 aa, Mycobacterium avium
VAAGRAGN

SEQ ID NO: 47734 - protein, 9 aa, Mycobacterium avium
VAAGRDPAA

SEQ ID NO: 47735 - protein, 10 aa, Mycobacterium avium
VAAGRPAITT

SEQ ID NO: 47736 - protein, 6 aa, Mycobacterium avium
VAAGRQ

SEQ ID NO: 47737 - protein, 8 aa, Mycobacterium avium
VAAGTPAE

SEQ ID NO: 47738 - protein, 8 aa, Mycobacterium avium
VAAGTSLN

SEQ ID NO: 47739 - protein, 6 aa, Mycobacterium avium
VAAPDR

SEQ ID NO: 47740 - protein, 5 aa, Mycobacterium avium
VAAPQ

SEQ ID NO: 47741 - protein, 6 aa, Mycobacterium avium
VAAPQA

SEQ ID NO: 47742 - protein, 8 aa, Mycobacterium avium
VAASGDDR

SEQ ID NO: 47743 - protein, 13 aa, Mycobacterium avium
VAASLGSGRQRPG

SEQ ID NO: 47744 - protein, 9 aa, Mycobacterium avium
VAASTPKGA

SEQ ID NO: 47745 - protein, 9 aa, Mycobacterium avium
VADDDEATR

SEQ ID NO: 47746 - protein, 6 aa, Mycobacterium avium
VADGSR

SEQ ID NO: 47747 - protein, 7 aa, Mycobacterium avium
VADPARV

SEQ ID NO: 47748 - protein, 7 aa, Mycobacterium avium
VADPLGG

SEQ ID NO: 47749 - protein, 11 aa, Mycobacterium avium
VADSGHSKSRG

SEQ ID NO: 47750 - protein, 8 aa, Mycobacterium avium
VADSHQDG

SEQ ID NO: 47751 - protein, 7 aa, Mycobacterium avium
VAEDSGA

SEQ ID NO: 47752 - protein, 5 aa, Mycobacterium avium
VAEGL

SEQ ID NO: 47753 - protein, 8 aa, Mycobacterium avium
VAEGRTDA

SEQ ID NO: 47754 - protein, 7 aa, Mycobacterium avium
VAENHEQ

SEQ ID NO: 47755 - protein, 13 aa, Mycobacterium avium
VAEPTAPAPDNPL

SEQ ID NO: 47756 - protein, 9 aa, Mycobacterium avium
VAEQRGTIR

SEQ ID NO: 47757 - protein, 6 aa, Mycobacterium avium
VAERAG

SEQ ID NO: 47758 - protein, 9 aa, Mycobacterium avium
VAEREPGVA

SEQ ID NO: 47759 - protein, 7 aa, Mycobacterium avium
VAERTDD

SEQ ID NO: 47760 - protein, 9 aa, Mycobacterium avium
VAGDIEGAA

SEQ ID NO: 47761 - protein, 5 aa, Mycobacterium avium
VAGEE

SEQ ID NO: 47762 - protein, 10 aa, Mycobacterium avium
VAGESAKFGI

SEQ ID NO: 47763 - protein, 4 aa, Mycobacterium avium
VAGG

SEQ ID NO: 47764 - protein, 24 aa, Mycobacterium avium
VAGGGDDADEKLAEASAAIARLVR

SEQ ID NO: 47765 - protein, 5 aa, Mycobacterium avium
VAGIP

SEQ ID NO: 47766 - protein, 4 aa, Mycobacterium avium
VAGK

SEQ ID NO: 47767 - protein, 15 aa, Mycobacterium avium
VAGPSVSGGLGRAAT

SEQ ID NO: 47768 - protein, 9 aa, Mycobacterium avium
VAGQPTMHG

SEQ ID NO: 47769 - protein, 4 aa, Mycobacterium avium
VAGR

SEQ ID NO: 47770 - protein, 15 aa, Mycobacterium avium
VAGRPKEEYGIEPTG

SEQ ID NO: 47771 - protein, 6 aa, Mycobacterium avium
VAGRQD

SEQ ID NO: 47772 - protein, 8 aa, Mycobacterium avium
VAGSAADG

SEQ ID NO: 47773 - protein, 16 aa, Mycobacterium avium
VAGSPVSGEESLRERE

SEQ ID NO: 47774 - protein, 5 aa, Mycobacterium avium
VAGTR

SEQ ID NO: 47775 - protein, 12 aa, Mycobacterium avium
VAHTGTSEYGRT

SEQ ID NO: 47776 - protein, 11 aa, Mycobacterium avium
VAKPDARSTVE

SEQ ID NO: 47777 - protein, 18 aa, Mycobacterium avium
VAKPEDTQAISTARAAGH

SEQ ID NO: 47778 - protein, 12 aa, Mycobacterium avium
VAKRRDTSVDPP

SEQ ID NO: 47779 - protein, 10 aa, Mycobacterium avium
VANEAGPLAE

SEQ ID NO: 47780 - protein, 6 aa, Mycobacterium avium
VANEIE

SEQ ID NO: 47781 - protein, 10 aa, Mycobacterium avium
VAPAAGAAIT

SEQ ID NO: 47782 - protein, 14 aa, Mycobacterium avium
VAPADDGLAARAGE

SEQ ID NO: 47783 - protein, 7 aa, Mycobacterium avium
VAPDGPL

SEQ ID NO: 47784 - protein, 5 aa, Mycobacterium avium
VAPEQ

SEQ ID NO: 47785 - protein, 12 aa, Mycobacterium avium
VAPERKHPRPVE

SEQ ID NO: 47786 - protein, 8 aa, Mycobacterium avium
VAPGGGTR

SEQ ID NO: 47787 - protein, 10 aa, Mycobacterium avium
VAPGGTLGTD

SEQ ID NO: 47788 - protein, 5 aa, Mycobacterium avium
VAPGP

SEQ ID NO: 47789 - protein, 5 aa, Mycobacterium avium
VAPGR

SEQ ID NO: 47790 - protein, 12 aa, Mycobacterium avium
VAPKDKNAARDN

SEQ ID NO: 47791 - protein, 7 aa, Mycobacterium avium
VAPLTQE

SEQ ID NO: 47792 - protein, 8 aa, Mycobacterium avium
VAPPKPSK

SEQ ID NO: 47793 - protein, 6 aa, Mycobacterium avium
VAPPPQ

SEQ ID NO: 47794 - protein, 9 aa, Mycobacterium avium
VAPPSAKTV

SEQ ID NO: 47795 - protein, 9 aa, Mycobacterium avium
VAPQPGETV

SEQ ID NO: 47796 - protein, 4 aa, Mycobacterium avium
VAPR

SEQ ID NO: 47797 - protein, 10 aa, Mycobacterium avium
VAPRPGGPRR

SEQ ID NO: 47798 - protein, 10 aa, Mycobacterium avium
VAPSRVRTPN

SEQ ID NO: 47799 - protein, 4 aa, Mycobacterium avium
VAPT

SEQ ID NO: 47800 - protein, 6 aa, Mycobacterium avium
VAPTET

SEQ ID NO: 47801 - protein, 5 aa, Mycobacterium avium
VAQAP

SEQ ID NO: 47802 - protein, 6 aa, Mycobacterium avium
VAQDPY

SEQ ID NO: 47803 - protein, 4 aa, Mycobacterium avium
VAQP

SEQ ID NO: 47804 - protein, 14 aa, Mycobacterium avium
VAQSATAPVIVVRG

SEQ ID NO: 47805 - protein, 6 aa, Mycobacterium avium
VARAGS

SEQ ID NO: 47806 - protein, 4 aa, Mycobacterium avium
VARE

SEQ ID NO: 47807 - protein, 11 aa, Mycobacterium avium
VARNPRTGETV

SEQ ID NO: 47808 - protein, 5 aa, Mycobacterium avium
VARPG

SEQ ID NO: 47809 - protein, 14 aa, Mycobacterium avium
VARPSSVSSGRSLP

SEQ ID NO: 47810 - protein, 12 aa, Mycobacterium avium
VARRGPGRVPDG

SEQ ID NO: 47811 - protein, 12 aa, Mycobacterium avium
VARRGSVTDLSP

SEQ ID NO: 47812 - protein, 7 aa, Mycobacterium avium
VARRGTT

SEQ ID NO: 47813 - protein, 6 aa, Mycobacterium avium
VARRPQ

SEQ ID NO: 47814 - protein, 7 aa, Mycobacterium avium
VARSRAD

SEQ ID NO: 47815 - protein, 7 aa, Mycobacterium avium
VASASDR

SEQ ID NO: 47816 - protein, 4 aa, Mycobacterium avium
VASD

SEQ ID NO: 47817 - protein, 4 aa, Mycobacterium avium
VASE

SEQ ID NO: 47818 - protein, 9 aa, Mycobacterium avium
VASGNGKGQ

SEQ ID NO: 47819 - protein, 10 aa, Mycobacterium avium
VASGTAVSRA

SEQ ID NO: 47820 - protein, 12 aa, Mycobacterium avium
VASQPSAAHSDG

SEQ ID NO: 47821 - protein, 7 aa, Mycobacterium avium
VASRAGQ

SEQ ID NO: 47822 - protein, 17 aa, Mycobacterium avium
VASRSSRIEGIGRPRVE

SEQ ID NO: 47823 - protein, 9 aa, Mycobacterium avium
VASSSQSVT

SEQ ID NO: 47824 - protein, 8 aa, Mycobacterium avium
VATATNSL

SEQ ID NO: 47825 - protein, 6 aa, Mycobacterium avium
VATEGE

SEQ ID NO: 47826 - protein, 11 aa, Mycobacterium avium
VATESGEPVDP

SEQ ID NO: 47827 - protein, 12 aa, Mycobacterium avium
VATGGKPPSGPG

SEQ ID NO: 47828 - protein, 7 aa, Mycobacterium avium
VATGSLP

SEQ ID NO: 47829 - protein, 7 aa, Mycobacterium avium
VATGTAG

SEQ ID NO: 47830 - protein, 8 aa, Mycobacterium avium
VATNPRAQ

SEQ ID NO: 47831 - protein, 11 aa, Mycobacterium avium
VATQAGKPRMG

SEQ ID NO: 47832 - protein, 6 aa, Mycobacterium avium
VATRAA

SEQ ID NO: 47833 - protein, 5 aa, Mycobacterium avium
VATTI

SEQ ID NO: 47834 - protein, 10 aa, Mycobacterium avium
VATTTQVGGP

SEQ ID NO: 47835 - protein, 7 aa, Mycobacterium avium
VAVPAET

SEQ ID NO: 47836 - protein, 11 aa, Mycobacterium avium
VCPTQGSANPA

SEQ ID NO: 47837 - protein, 7 aa, Mycobacterium avium
VDADADP

SEQ ID NO: 47838 - protein, 6 aa, Mycobacterium avium
VDADGG

SEQ ID NO: 47839 - protein, 10 aa, Mycobacterium avium
VDADTGAATV

SEQ ID NO: 47840 - protein, 5 aa, Mycobacterium avium
VDAEE

SEQ ID NO: 47841 - protein, 7 aa, Mycobacterium avium
VDAESAL

SEQ ID NO: 47842 - protein, 6 aa, Mycobacterium avium
VDAGDP

SEQ ID NO: 47843 - protein, 6 aa, Mycobacterium avium
VDAGQG

SEQ ID NO: 47844 - protein, 7 aa, Mycobacterium avium
VDAKPAQ

SEQ ID NO: 47845 - protein, 4 aa, Mycobacterium avium
VDAR

SEQ ID NO: 47846 - protein, 16 aa, Mycobacterium avium
VDARGDDDLPLRPWWS

SEQ ID NO: 47847 - protein, 10 aa, Mycobacterium avium
VDDATDPGHV

SEQ ID NO: 47848 - protein, 6 aa, Mycobacterium avium
VDDEIA

SEQ ID NO: 47849 - protein, 10 aa, Mycobacterium avium
VDDGEGGSVE

SEQ ID NO: 47850 - protein, 8 aa, Mycobacterium avium
VDDGPTAL

SEQ ID NO: 47851 - protein, 17 aa, Mycobacterium avium
VDDGSGETDEDQKLRHE

SEQ ID NO: 47852 - protein, 7 aa, Mycobacterium avium
VDDHDSG

SEQ ID NO: 47853 - protein, 5 aa, Mycobacterium avium
VDDPK

SEQ ID NO: 47854 - protein, 8 aa, Mycobacterium avium
VDDPTGDA

SEQ ID NO: 47855 - protein, 5 aa, Mycobacterium avium
VDDPY

SEQ ID NO: 47856 - protein, 11 aa, Mycobacterium avium
VDDTALKPRQW

SEQ ID NO: 47857 - protein, 4 aa, Mycobacterium avium
VDEA

SEQ ID NO: 47858 - protein, 7 aa, Mycobacterium avium
VDEDAAR

SEQ ID NO: 47859 - protein, 8 aa, Mycobacterium avium
VDEDTEEL

SEQ ID NO: 47860 - protein, 11 aa, Mycobacterium avium
VDEGPRESSLE

SEQ ID NO: 47861 - protein, 8 aa, Mycobacterium avium
VDEPKLER

SEQ ID NO: 47862 - protein, 7 aa, Mycobacterium avium
VDEPNAR

SEQ ID NO: 47863 - protein, 11 aa, Mycobacterium avium
VDESESAESFE

SEQ ID NO: 47864 - protein, 10 aa, Mycobacterium avium
VDESPGAPHD

SEQ ID NO: 47865 - protein, 9 aa, Mycobacterium avium
VDESRAARR

SEQ ID NO: 47866 - protein, 5 aa, Mycobacterium avium
VDETG

SEQ ID NO: 47867 - protein, 12 aa, Mycobacterium avium
VDGAAEEGTPYV

SEQ ID NO: 47868 - protein, 9 aa, Mycobacterium avium
VDGDRLEDA

SEQ ID NO: 47869 - protein, 10 aa, Mycobacterium avium
VDGEGTTVAR

SEQ ID NO: 47870 - protein, 9 aa, Mycobacterium avium
VDGERLTSS

SEQ ID NO: 47871 - protein, 5 aa, Mycobacterium avium
VDGGG

SEQ ID NO: 47872 - protein, 5 aa, Mycobacterium avium
VDGGT

SEQ ID NO: 47873 - protein, 16 aa, Mycobacterium avium
VDGGTSAGKAMRSKRQ

SEQ ID NO: 47874 - protein, 8 aa, Mycobacterium avium
VDGHDERA

SEQ ID NO: 47875 - protein, 6 aa, Mycobacterium avium
VDGKPG

SEQ ID NO: 47876 - protein, 10 aa, Mycobacterium avium
VDGKTKEDFG

SEQ ID NO: 47877 - protein, 4 aa, Mycobacterium avium
VDGN

SEQ ID NO: 47878 - protein, 5 aa, Mycobacterium avium
VDGNE

SEQ ID NO: 47879 - protein, 7 aa, Mycobacterium avium
VDGNPLN

SEQ ID NO: 47880 - protein, 4 aa, Mycobacterium avium
VDGP

SEQ ID NO: 47881 - protein, 5 aa, Mycobacterium avium
VDGPL

SEQ ID NO: 47882 - protein, 8 aa, Mycobacterium avium
VDGPTSAA

SEQ ID NO: 47883 - protein, 5 aa, Mycobacterium avium
VDGQH

SEQ ID NO: 47884 - protein, 8 aa, Mycobacterium avium
VDGQTMRK

SEQ ID NO: 47885 - protein, 6 aa, Mycobacterium avium
VDGREA

SEQ ID NO: 47886 - protein, 7 aa, Mycobacterium avium
VDGRGGP

SEQ ID NO: 47887 - protein, 9 aa, Mycobacterium avium
VDGSDYPDL

SEQ ID NO: 47888 - protein, 9 aa, Mycobacterium avium
VDGSPPRQL

SEQ ID NO: 47889 - protein, 5 aa, Mycobacterium avium
VDGTD

SEQ ID NO: 47890 - protein, 5 aa, Mycobacterium avium
VDGTG

SEQ ID NO: 47891 - protein, 10 aa, Mycobacterium avium
VDGTGAQRYR

SEQ ID NO: 47892 - protein, 5 aa, Mycobacterium avium
VDGTS

SEQ ID NO: 47893 - protein, 15 aa, Mycobacterium avium
VDHATGKVSPPPEVV

SEQ ID NO: 47894 - protein, 8 aa, Mycobacterium avium
VDHEDDPI

SEQ ID NO: 47895 - protein, 12 aa, Mycobacterium avium
VDHPDNPGKSRG

SEQ ID NO: 47896 - protein, 11 aa, Mycobacterium avium
VDHSSDGHHPV

SEQ ID NO: 47897 - protein, 8 aa, Mycobacterium avium
VDKDKDQS

SEQ ID NO: 47898 - protein, 6 aa, Mycobacterium avium
VDKPGT

SEQ ID NO: 47899 - protein, 8 aa, Mycobacterium avium
VDKTEYDL

SEQ ID NO: 47900 - protein, 9 aa, Mycobacterium avium
VDLSNPDNF

SEQ ID NO: 47901 - protein, 6 aa, Mycobacterium avium
VDNDDD

SEQ ID NO: 47902 - protein, 7 aa, Mycobacterium avium
VDNQRSA

SEQ ID NO: 47903 - protein, 8 aa, Mycobacterium avium
VDPAGTGF

SEQ ID NO: 47904 - protein, 12 aa, Mycobacterium avium
VDPARLAADLAA

SEQ ID NO: 47905 - protein, 12 aa, Mycobacterium avium
VDPDGPVSVQPN

SEQ ID NO: 47906 - protein, 9 aa, Mycobacterium avium
VDPDRPLPE

SEQ ID NO: 47907 - protein, 6 aa, Mycobacterium avium
VDPDRS

SEQ ID NO: 47908 - protein, 8 aa, Mycobacterium avium
VDPDSEIA

SEQ ID NO: 47909 - protein, 8 aa, Mycobacterium avium
VDPEAARS

SEQ ID NO: 47910 - protein, 18 aa, Mycobacterium avium
VDPETGEEITAQNGRYGP

SEQ ID NO: 47911 - protein, 5 aa, Mycobacterium avium
VDPNE

SEQ ID NO: 47912 - protein, 10 aa, Mycobacterium avium
VDPNERTPGT

SEQ ID NO: 47913 - protein, 7 aa, Mycobacterium avium
VDPRRAQ

SEQ ID NO: 47914 - protein, 8 aa, Mycobacterium avium
VDPSGDGG

SEQ ID NO: 47915 - protein, 6 aa, Mycobacterium avium
VDPSVG

SEQ ID NO: 47916 - protein, 10 aa, Mycobacterium avium
VDPTANEEAR

SEQ ID NO: 47917 - protein, 6 aa, Mycobacterium avium
VDPTEV

SEQ ID NO: 47918 - protein, 5 aa, Mycobacterium avium
VDPTG

SEQ ID NO: 47919 - protein, 8 aa, Mycobacterium avium
VDPTGAGD

SEQ ID NO: 47920 - protein, 5 aa, Mycobacterium avium
VDPYN

SEQ ID NO: 47921 - protein, 5 aa, Mycobacterium avium
VDQEN

SEQ ID NO: 47922 - protein, 7 aa, Mycobacterium avium
VDQPGTV

SEQ ID NO: 47923 - protein, 7 aa, Mycobacterium avium
VDQPGVT

SEQ ID NO: 47924 - protein, 10 aa, Mycobacterium avium
VDQSDEQFNA

SEQ ID NO: 47925 - protein, 5 aa, Mycobacterium avium
VDRAK

SEQ ID NO: 47926 - protein, 8 aa, Mycobacterium avium
VDRDDPDV

SEQ ID NO: 47927 - protein, 12 aa, Mycobacterium avium
VDRPEAHDEEAD

SEQ ID NO: 47928 - protein, 5 aa, Mycobacterium avium
VDRPW

SEQ ID NO: 47929 - protein, 4 aa, Mycobacterium avium
VDRR

SEQ ID NO: 47930 - protein, 13 aa, Mycobacterium avium
VDRRKDAPGEGRP

SEQ ID NO: 47931 - protein, 11 aa, Mycobacterium avium
VDRRPDLPSGK

SEQ ID NO: 47932 - protein, 8 aa, Mycobacterium avium
VDRSGDDW

SEQ ID NO: 47933 - protein, 7 aa, Mycobacterium avium
VDSDNPA

SEQ ID NO: 47934 - protein, 7 aa, Mycobacterium avium
VDSEEFT

SEQ ID NO: 47935 - protein, 7 aa, Mycobacterium avium
VDSGAGI

SEQ ID NO: 47936 - protein, 9 aa, Mycobacterium avium
VDSKGLTEA

SEQ ID NO: 47937 - protein, 5 aa, Mycobacterium avium
VDSSP

SEQ ID NO: 47938 - protein, 7 aa, Mycobacterium avium
VDSSRDI

SEQ ID NO: 47939 - protein, 6 aa, Mycobacterium avium
VDTASQ

SEQ ID NO: 47940 - protein, 8 aa, Mycobacterium avium
VDTDGDGK

SEQ ID NO: 47941 - protein, 5 aa, Mycobacterium avium
VDTDH

SEQ ID NO: 47942 - protein, 8 aa, Mycobacterium avium
VDTEPYRK

SEQ ID NO: 47943 - protein, 6 aa, Mycobacterium avium
VDTPGG

SEQ ID NO: 47944 - protein, 5 aa, Mycobacterium avium
VDTQA

SEQ ID NO: 47945 - protein, 9 aa, Mycobacterium avium
VDTQAPGAR

SEQ ID NO: 47946 - protein, 14 aa, Mycobacterium avium
VDTRPDPVLPGPDG

SEQ ID NO: 47947 - protein, 7 aa, Mycobacterium avium
VDTRREH

SEQ ID NO: 47948 - protein, 4 aa, Mycobacterium avium
VDTS

SEQ ID NO: 47949 - protein, 13 aa, Mycobacterium avium
VDTVSTSAAAERI

SEQ ID NO: 47950 - protein, 5 aa, Mycobacterium avium
VDVPG

SEQ ID NO: 47951 - protein, 19 aa, Mycobacterium avium
VDVSPEERRRIAETGFYAY

SEQ ID NO: 47952 - protein, 4 aa, Mycobacterium avium
VDYG

SEQ ID NO: 47953 - protein, 5 aa, Mycobacterium avium
VDYSG

SEQ ID NO: 47954 - protein, 7 aa, Mycobacterium avium
VEAARAG

SEQ ID NO: 47955 - protein, 6 aa, Mycobacterium avium
VEADSD

SEQ ID NO: 47956 - protein, 5 aa, Mycobacterium avium
VEAEG

SEQ ID NO: 47957 - protein, 4 aa, Mycobacterium avium
VEAG

SEQ ID NO: 47958 - protein, 10 aa, Mycobacterium avium
VEAGDGTKSL

SEQ ID NO: 47959 - protein, 5 aa, Mycobacterium avium
VEAGE

SEQ ID NO: 47960 - protein, 5 aa, Mycobacterium avium
VEAGN

SEQ ID NO: 47961 - protein, 16 aa, Mycobacterium avium
VEANRDNHFSAPDRDD

SEQ ID NO: 47962 - protein, 11 aa, Mycobacterium avium
VEASSGSTAVS

SEQ ID NO: 47963 - protein, 9 aa, Mycobacterium avium
VEATTDAVD

SEQ ID NO: 47964 - protein, 4 aa, Mycobacterium avium
VEDE

SEQ ID NO: 47965 - protein, 5 aa, Mycobacterium avium
VEDPG

SEQ ID NO: 47966 - protein, 6 aa, Mycobacterium avium
VEDPGS

SEQ ID NO: 47967 - protein, 10 aa, Mycobacterium avium
VEDPSRREKI

SEQ ID NO: 47968 - protein, 6 aa, Mycobacterium avium
VEDTGY

SEQ ID NO: 47969 - protein, 12 aa, Mycobacterium avium
VEDTSAEQIAAD

SEQ ID NO: 47970 - protein, 4 aa, Mycobacterium avium
VEEG

SEQ ID NO: 47971 - protein, 10 aa, Mycobacterium avium
VEEKPYTRRP

SEQ ID NO: 47972 - protein, 5 aa, Mycobacterium avium
VEETD

SEQ ID NO: 47973 - protein, 12 aa, Mycobacterium avium
VEGADPQKIRGQ

SEQ ID NO: 47974 - protein, 10 aa, Mycobacterium avium
VEGARAAAAQ

SEQ ID NO: 47975 - protein, 10 aa, Mycobacterium avium
VEGDPESQQA

SEQ ID NO: 47976 - protein, 5 aa, Mycobacterium avium
VEGEA

SEQ ID NO: 47977 - protein, 8 aa, Mycobacterium avium
VEGNTEAG

SEQ ID NO: 47978 - protein, 7 aa, Mycobacterium avium
VEGPGGP

SEQ ID NO: 47979 - protein, 11 aa, Mycobacterium avium
VEGPTDDPDIT

SEQ ID NO: 47980 - protein, 8 aa, Mycobacterium avium
VEGQRMSD

SEQ ID NO: 47981 - protein, 4 aa, Mycobacterium avium
VEGS

SEQ ID NO: 47982 - protein, 6 aa, Mycobacterium avium
VEGSGG

SEQ ID NO: 47983 - protein, 8 aa, Mycobacterium avium
VEGTQTPH

SEQ ID NO: 47984 - protein, 10 aa, Mycobacterium avium
VEKAGSFTQT

SEQ ID NO: 47985 - protein, 9 aa, Mycobacterium avium
VEKDPENPT

SEQ ID NO: 47986 - protein, 9 aa, Mycobacterium avium
VEKEGTPIA

SEQ ID NO: 47987 - protein, 8 aa, Mycobacterium avium
VEKGETQG

SEQ ID NO: 47988 - protein, 4 aa, Mycobacterium avium
VEKL

SEQ ID NO: 47989 - protein, 8 aa, Mycobacterium avium
VELGGDPA

SEQ ID NO: 47990 - protein, 4 aa, Mycobacterium avium
VELP

SEQ ID NO: 47991 - protein, 5 aa, Mycobacterium avium
VENDK

SEQ ID NO: 47992 - protein, 4 aa, Mycobacterium avium
VEPD

SEQ ID NO: 47993 - protein, 5 aa, Mycobacterium avium
VEPDE

SEQ ID NO: 47994 - protein, 7 aa, Mycobacterium avium
VEPDPAW

SEQ ID NO: 47995 - protein, 6 aa, Mycobacterium avium
VEPEAS

SEQ ID NO: 47996 - protein, 14 aa, Mycobacterium avium
VEPGHRGDDTVDGW

SEQ ID NO: 47997 - protein, 11 aa, Mycobacterium avium
VEPKQGRNPIQ

SEQ ID NO: 47998 - protein, 7 aa, Mycobacterium avium
VEPPGGC

SEQ ID NO: 47999 - protein, 8 aa, Mycobacterium avium
VEPPGQCQ

SEQ ID NO: 48000 - protein, 9 aa, Mycobacterium avium
VEPPPGELA

SEQ ID NO: 48001 - protein, 5 aa, Mycobacterium avium
VEPSR

SEQ ID NO: 48002 - protein, 8 aa, Mycobacterium avium
VEPTAELS

SEQ ID NO: 48003 - protein, 5 aa, Mycobacterium avium
VEPTG

SEQ ID NO: 48004 - protein, 4 aa, Mycobacterium avium
VEPW

SEQ ID NO: 48005 - protein, 7 aa, Mycobacterium avium
VEQDDQE

SEQ ID NO: 48006 - protein, 14 aa, Mycobacterium avium
VEQEIEAGASGTVR

SEQ ID NO: 48007 - protein, 4 aa, Mycobacterium avium
VEQG

SEQ ID NO: 48008 - protein, 17 aa, Mycobacterium avium
VEQGDSSQVFGNPQHEY

SEQ ID NO: 48009 - protein, 9 aa, Mycobacterium avium
VEQPGQDNV

SEQ ID NO: 48010 - protein, 12 aa, Mycobacterium avium
VEQTSKDRGHDY

SEQ ID NO: 48011 - protein, 10 aa, Mycobacterium avium
VERDEGTRSR

SEQ ID NO: 48012 - protein, 16 aa, Mycobacterium avium
VERGANDSDWDPVKEA

SEQ ID NO: 48013 - protein, 9 aa, Mycobacterium avium
VERGGPGEH

SEQ ID NO: 48014 - protein, 31 aa, Mycobacterium avium
VERRDGPFGDYSQAPPELRPDPSHVIVPDRD

SEQ ID NO: 48015 - protein, 8 aa, Mycobacterium avium
VERSDPPH

SEQ ID NO: 48016 - protein, 5 aa, Mycobacterium avium
VERTA

SEQ ID NO: 48017 - protein, 5 aa, Mycobacterium avium
VESAG

SEQ ID NO: 48018 - protein, 4 aa, Mycobacterium avium
VESG

SEQ ID NO: 48019 - protein, 9 aa, Mycobacterium avium
VESGAAQSI

SEQ ID NO: 48020 - protein, 8 aa, Mycobacterium avium
VESGPPEQ

SEQ ID NO: 48021 - protein, 5 aa, Mycobacterium avium
VESGR

SEQ ID NO: 48022 - protein, 10 aa, Mycobacterium avium
VESGSGDAKV

SEQ ID NO: 48023 - protein, 11 aa, Mycobacterium avium
VESISDDGSQV

SEQ ID NO: 48024 - protein, 7 aa, Mycobacterium avium
VESPRGE

SEQ ID NO: 48025 - protein, 7 aa, Mycobacterium avium
VESPSAW

SEQ ID NO: 48026 - protein, 7 aa, Mycobacterium avium
VESTPVE

SEQ ID NO: 48027 - protein, 5 aa, Mycobacterium avium
VESVP

SEQ ID NO: 48028 - protein, 4 aa, Mycobacterium avium
VETD

SEQ ID NO: 48029 - protein, 5 aa, Mycobacterium avium
VETDS

SEQ ID NO: 48030 - protein, 12 aa, Mycobacterium avium
VETERAERPATE

SEQ ID NO: 48031 - protein, 6 aa, Mycobacterium avium
VETGDT

SEQ ID NO: 48032 - protein, 7 aa, Mycobacterium avium
VETGPAG

SEQ ID NO: 48033 - protein, 7 aa, Mycobacterium avium
VETRNGS

SEQ ID NO: 48034 - protein, 9 aa, Mycobacterium avium
VEVPADADA

SEQ ID NO: 48035 - protein, 6 aa, Mycobacterium avium
VFGTKE

SEQ ID NO: 48036 - protein, 5 aa, Mycobacterium avium
VGAAE

SEQ ID NO: 48037 - protein, 5 aa, Mycobacterium avium
VGAAP

SEQ ID NO: 48038 - protein, 7 aa, Mycobacterium avium
VGAGIAG

SEQ ID NO: 48039 - protein, 16 aa, Mycobacterium avium
VGAGPGPFRAAPGELT

SEQ ID NO: 48040 - protein, 11 aa, Mycobacterium avium
VGAGQVSGSMG

SEQ ID NO: 48041 - protein, 9 aa, Mycobacterium avium
VGAGSGKQI

SEQ ID NO: 48042 - protein, 7 aa, Mycobacterium avium
VGANPRE

SEQ ID NO: 48043 - protein, 15 aa, Mycobacterium avium
VGARADERLRAGAPL

SEQ ID NO: 48044 - protein, 7 aa, Mycobacterium avium
VGATPAQ

SEQ ID NO: 48045 - protein, 14 aa, Mycobacterium avium
VGDADSGPNTGGMG

SEQ ID NO: 48046 - protein, 9 aa, Mycobacterium avium
VGDDKDKAA

SEQ ID NO: 48047 - protein, 5 aa, Mycobacterium avium
VGDDP

SEQ ID NO: 48048 - protein, 7 aa, Mycobacterium avium
VGDGAND

SEQ ID NO: 48049 - protein, 17 aa, Mycobacterium avium
VGDGAPAPRPLIIDRIV

SEQ ID NO: 48050 - protein, 6 aa, Mycobacterium avium
VGDKSY

SEQ ID NO: 48051 - protein, 9 aa, Mycobacterium avium
VGDKTADRL

SEQ ID NO: 48052 - protein, 6 aa, Mycobacterium avium
VGDPGD

SEQ ID NO: 48053 - protein, 26 aa, Mycobacterium avium
VGDPTDPATDVGPLATESGRDEIAKQ

SEQ ID NO: 48054 - protein, 5 aa, Mycobacterium avium
VGDQG

SEQ ID NO: 48055 - protein, 9 aa, Mycobacterium avium
VGDQSSNIG

SEQ ID NO: 48056 - protein, 7 aa, Mycobacterium avium
VGDRPTL

SEQ ID NO: 48057 - protein, 17 aa, Mycobacterium avium
VGDRRTQNQPGTTDEYP

SEQ ID NO: 48058 - protein, 9 aa, Mycobacterium avium
VGDSDAPVR

SEQ ID NO: 48059 - protein, 10 aa, Mycobacterium avium
VGEASGDSEL

SEQ ID NO: 48060 - protein, 6 aa, Mycobacterium avium
VGEDKR

SEQ ID NO: 48061 - protein, 7 aa, Mycobacterium avium
VGEDQRQ

SEQ ID NO: 48062 - protein, 5 aa, Mycobacterium avium
VGEDR

SEQ ID NO: 48063 - protein, 8 aa, Mycobacterium avium
VGEENQGW

SEQ ID NO: 48064 - protein, 6 aa, Mycobacterium avium
VGEEWD

SEQ ID NO: 48065 - protein, 10 aa, Mycobacterium avium
VGEPADPLAS

SEQ ID NO: 48066 - protein, 8 aa, Mycobacterium avium
VGEPDAGA

SEQ ID NO: 48067 - protein, 11 aa, Mycobacterium avium
VGEPESETEAA

SEQ ID NO: 48068 - protein, 5 aa, Mycobacterium avium
VGEPN

SEQ ID NO: 48069 - protein, 5 aa, Mycobacterium avium
VGEQD

SEQ ID NO: 48070 - protein, 13 aa, Mycobacterium avium
VGESRDQEATAKV

SEQ ID NO: 48071 - protein, 7 aa, Mycobacterium avium
VGESTDV

SEQ ID NO: 48072 - protein, 8 aa, Mycobacterium avium
VGETAPDA

SEQ ID NO: 48073 - protein, 8 aa, Mycobacterium avium
VGETEPDL

SEQ ID NO: 48074 - protein, 15 aa, Mycobacterium avium
VGETRSYTVPNGSTV

SEQ ID NO: 48075 - protein, 105 aa, Mycobacterium avium
VGGAAKKTAAKKAPAKKAAAKKAPAKKAAAKKAPAKKAAVKKAPARKAATKAPVRKAATKAPAKKVAAKKAPAKKAATKAPAKKAASKAPARKAAAKKTTARRGR

SEQ ID NO: 48076 - protein, 7 aa, Mycobacterium avium
VGGAASH

SEQ ID NO: 48077 - protein, 6 aa, Mycobacterium avium
VGGAKN

SEQ ID NO: 48078 - protein, 8 aa, Mycobacterium avium
VGGASAGG

SEQ ID NO: 48079 - protein, 10 aa, Mycobacterium avium
VGGDETLPYT

SEQ ID NO: 48080 - protein, 7 aa, Mycobacterium avium
VGGDGAE

SEQ ID NO: 48081 - protein, 7 aa, Mycobacterium avium
VGGDPSV

SEQ ID NO: 48082 - protein, 7 aa, Mycobacterium avium
VGGDRTR

SEQ ID NO: 48083 - protein, 6 aa, Mycobacterium avium
VGGEPH

SEQ ID NO: 48084 - protein, 8 aa, Mycobacterium avium
VGGESARS

SEQ ID NO: 48085 - protein, 9 aa, Mycobacterium avium
VGGGDSAAA

SEQ ID NO: 48086 - protein, 11 aa, Mycobacterium avium
VGGGGAPGVEL

SEQ ID NO: 48087 - protein, 6 aa, Mycobacterium avium
VGGGTD

SEQ ID NO: 48088 - protein, 14 aa, Mycobacterium avium
VGGKTGINTDAGKN

SEQ ID NO: 48089 - protein, 4 aa, Mycobacterium avium
VGGL

SEQ ID NO: 48090 - protein, 6 aa, Mycobacterium avium
VGGLPG

SEQ ID NO: 48091 - protein, 8 aa, Mycobacterium avium
VGGNVPQS

SEQ ID NO: 48092 - protein, 6 aa, Mycobacterium avium
VGGPAT

SEQ ID NO: 48093 - protein, 8 aa, Mycobacterium avium
VGGPGPSI

SEQ ID NO: 48094 - protein, 9 aa, Mycobacterium avium
VGGPNPDGN

SEQ ID NO: 48095 - protein, 30 aa, Mycobacterium avium
VGGPRSDAALAASSGRTATTKAMGEGSTQH

SEQ ID NO: 48096 - protein, 8 aa, Mycobacterium avium
VGGQPLSR

SEQ ID NO: 48097 - protein, 7 aa, Mycobacterium avium
VGGRDAA

SEQ ID NO: 48098 - protein, 6 aa, Mycobacterium avium
VGGREA

SEQ ID NO: 48099 - protein, 8 aa, Mycobacterium avium
VGGRQEDY

SEQ ID NO: 48100 - protein, 8 aa, Mycobacterium avium
VGGSGIKG

SEQ ID NO: 48101 - protein, 7 aa, Mycobacterium avium
VGGSSRE

SEQ ID NO: 48102 - protein, 6 aa, Mycobacterium avium
VGGSSY

SEQ ID NO: 48103 - protein, 4 aa, Mycobacterium avium
VGGT

SEQ ID NO: 48104 - protein, 11 aa, Mycobacterium avium
VGGTEPAGGDH

SEQ ID NO: 48105 - protein, 7 aa, Mycobacterium avium
VGGTVEG

SEQ ID NO: 48106 - protein, 5 aa, Mycobacterium avium
VGHAK

SEQ ID NO: 48107 - protein, 12 aa, Mycobacterium avium
VGHGASHGLPPD

SEQ ID NO: 48108 - protein, 8 aa, Mycobacterium avium
VGKAPGPL

SEQ ID NO: 48109 - protein, 7 aa, Mycobacterium avium
VGKGDRR

SEQ ID NO: 48110 - protein, 18 aa, Mycobacterium avium
VGKTPSETAALAREILQS

SEQ ID NO: 48111 - protein, 4 aa, Mycobacterium avium
VGNP

SEQ ID NO: 48112 - protein, 4 aa, Mycobacterium avium
VGNS

SEQ ID NO: 48113 - protein, 7 aa, Mycobacterium avium
VGPANAA

SEQ ID NO: 48114 - protein, 5 aa, Mycobacterium avium
VGPAR

SEQ ID NO: 48115 - protein, 7 aa, Mycobacterium avium
VGPDAGL

SEQ ID NO: 48116 - protein, 10 aa, Mycobacterium avium
VGPDGKVRPA

SEQ ID NO: 48117 - protein, 12 aa, Mycobacterium avium
VGPDGLGNSPEH

SEQ ID NO: 48118 - protein, 9 aa, Mycobacterium avium
VGPDGTRDV

SEQ ID NO: 48119 - protein, 5 aa, Mycobacterium avium
VGPDV

SEQ ID NO: 48120 - protein, 4 aa, Mycobacterium avium
VGPE

SEQ ID NO: 48121 - protein, 8 aa, Mycobacterium avium
VGPEGKPL

SEQ ID NO: 48122 - protein, 6 aa, Mycobacterium avium
VGPESA

SEQ ID NO: 48123 - protein, 10 aa, Mycobacterium avium
VGPESGAEEA

SEQ ID NO: 48124 - protein, 6 aa, Mycobacterium avium
VGPGGY

SEQ ID NO: 48125 - protein, 11 aa, Mycobacterium avium
VGPGRGSAAGS

SEQ ID NO: 48126 - protein, 11 aa, Mycobacterium avium
VGPGVEDIAPG

SEQ ID NO: 48127 - protein, 6 aa, Mycobacterium avium
VGPMDN

SEQ ID NO: 48128 - protein, 10 aa, Mycobacterium avium
VGPNGAGKSS

SEQ ID NO: 48129 - protein, 7 aa, Mycobacterium avium
VGPNNSG

SEQ ID NO: 48130 - protein, 6 aa, Mycobacterium avium
VGPPAR

SEQ ID NO: 48131 - protein, 6 aa, Mycobacterium avium
VGPPDS

SEQ ID NO: 48132 - protein, 7 aa, Mycobacterium avium
VGPPPTH

SEQ ID NO: 48133 - protein, 7 aa, Mycobacterium avium
VGPPVPG

SEQ ID NO: 48134 - protein, 5 aa, Mycobacterium avium
VGPTQ

SEQ ID NO: 48135 - protein, 6 aa, Mycobacterium avium
VGPYGA

SEQ ID NO: 48136 - protein, 12 aa, Mycobacterium avium
VGQAEDLRRNGA

SEQ ID NO: 48137 - protein, 13 aa, Mycobacterium avium
VGQGASGNNGTSA

SEQ ID NO: 48138 - protein, 5 aa, Mycobacterium avium
VGQGY

SEQ ID NO: 48139 - protein, 9 aa, Mycobacterium avium
VGQNAPYAQ

SEQ ID NO: 48140 - protein, 29 aa, Mycobacterium avium
VGRDSTRGLGAGADPEVGRKAAEDAKDEI

SEQ ID NO: 48141 - protein, 6 aa, Mycobacterium avium
VGRDTV

SEQ ID NO: 48142 - protein, 5 aa, Mycobacterium avium
VGRGD

SEQ ID NO: 48143 - protein, 19 aa, Mycobacterium avium
VGRGEAPRAVTETAREVVN

SEQ ID NO: 48144 - protein, 4 aa, Mycobacterium avium
VGRP

SEQ ID NO: 48145 - protein, 10 aa, Mycobacterium avium
VGRPGAGGDA

SEQ ID NO: 48146 - protein, 7 aa, Mycobacterium avium
VGRPGSG

SEQ ID NO: 48147 - protein, 5 aa, Mycobacterium avium
VGRRK

SEQ ID NO: 48148 - protein, 7 aa, Mycobacterium avium
VGRRKGV

SEQ ID NO: 48149 - protein, 13 aa, Mycobacterium avium
VGRSKAASARDSI

SEQ ID NO: 48150 - protein, 8 aa, Mycobacterium avium
VGRSRERG

SEQ ID NO: 48151 - protein, 15 aa, Mycobacterium avium
VGSAAGHDYAVTGGH

SEQ ID NO: 48152 - protein, 10 aa, Mycobacterium avium
VGSAGTVTTL

SEQ ID NO: 48153 - protein, 8 aa, Mycobacterium avium
VGSDRARW

SEQ ID NO: 48154 - protein, 8 aa, Mycobacterium avium
VGSEEADK

SEQ ID NO: 48155 - protein, 7 aa, Mycobacterium avium
VGSEQAY

SEQ ID NO: 48156 - protein, 5 aa, Mycobacterium avium
VGSGA

SEQ ID NO: 48157 - protein, 7 aa, Mycobacterium avium
VGSGGGI

SEQ ID NO: 48158 - protein, 9 aa, Mycobacterium avium
VGSGGPPRW

SEQ ID NO: 48159 - protein, 10 aa, Mycobacterium avium
VGSGPAGLAA

SEQ ID NO: 48160 - protein, 5 aa, Mycobacterium avium
VGSID

SEQ ID NO: 48161 - protein, 9 aa, Mycobacterium avium
VGSKKQKGF

SEQ ID NO: 48162 - protein, 10 aa, Mycobacterium avium
VGSQSPGVGQ

SEQ ID NO: 48163 - protein, 7 aa, Mycobacterium avium
VGSRAST

SEQ ID NO: 48164 - protein, 7 aa, Mycobacterium avium
VGTAAEV

SEQ ID NO: 48165 - protein, 5 aa, Mycobacterium avium
VGTDA

SEQ ID NO: 48166 - protein, 6 aa, Mycobacterium avium
VGTEPR

SEQ ID NO: 48167 - protein, 9 aa, Mycobacterium avium
VGTETGDLR

SEQ ID NO: 48168 - protein, 6 aa, Mycobacterium avium
VGTLDA

SEQ ID NO: 48169 - protein, 16 aa, Mycobacterium avium
VGTPNEVATEVSQNTA

SEQ ID NO: 48170 - protein, 8 aa, Mycobacterium avium
VGTPNSGW

SEQ ID NO: 48171 - protein, 6 aa, Mycobacterium avium
VGTQGS

SEQ ID NO: 48172 - protein, 4 aa, Mycobacterium avium
VGTS

SEQ ID NO: 48173 - protein, 5 aa, Mycobacterium avium
VGTVQ

SEQ ID NO: 48174 - protein, 9 aa, Mycobacterium avium
VGVEGGESL

SEQ ID NO: 48175 - protein, 10 aa, Mycobacterium avium
VGYTPYPETV

SEQ ID NO: 48176 - protein, 6 aa, Mycobacterium avium
VHDEPG

SEQ ID NO: 48177 - protein, 22 aa, Mycobacterium avium
VHDSGRPHAIGRPAGDSAAQAA

SEQ ID NO: 48178 - protein, 19 aa, Mycobacterium avium
VHGGGEPPHYLATTNASAI

SEQ ID NO: 48179 - protein, 9 aa, Mycobacterium avium
VHGKSGSLR

SEQ ID NO: 48180 - protein, 6 aa, Mycobacterium avium
VHGPRG

SEQ ID NO: 48181 - protein, 8 aa, Mycobacterium avium
VHGQAGGG

SEQ ID NO: 48182 - protein, 5 aa, Mycobacterium avium
VHNPD

SEQ ID NO: 48183 - protein, 6 aa, Mycobacterium avium
VHSPGE

SEQ ID NO: 48184 - protein, 4 aa, Mycobacterium avium
VIGP

SEQ ID NO: 48185 - protein, 9 aa, Mycobacterium avium
VIGSGSTAQ

SEQ ID NO: 48186 - protein, 4 aa, Mycobacterium avium
VIPA

SEQ ID NO: 48187 - protein, 7 aa, Mycobacterium avium
VKAARKD

SEQ ID NO: 48188 - protein, 14 aa, Mycobacterium avium
VKAERDSAAVKSSL

SEQ ID NO: 48189 - protein, 7 aa, Mycobacterium avium
VKAGELS

SEQ ID NO: 48190 - protein, 14 aa, Mycobacterium avium
VKAGPGQDVDADTE

SEQ ID NO: 48191 - protein, 12 aa, Mycobacterium avium
VKAHDENSIAGI

SEQ ID NO: 48192 - protein, 7 aa, Mycobacterium avium
VKDGDDA

SEQ ID NO: 48193 - protein, 8 aa, Mycobacterium avium
VKDGRSVI

SEQ ID NO: 48194 - protein, 6 aa, Mycobacterium avium
VKDGYG

SEQ ID NO: 48195 - protein, 11 aa, Mycobacterium avium
VKDSGSDRDAY

SEQ ID NO: 48196 - protein, 8 aa, Mycobacterium avium
VKEAGSPA

SEQ ID NO: 48197 - protein, 4 aa, Mycobacterium avium
VKEP

SEQ ID NO: 48198 - protein, 7 aa, Mycobacterium avium
VKESGAA

SEQ ID NO: 48199 - protein, 10 aa, Mycobacterium avium
VKETGKRLGA

SEQ ID NO: 48200 - protein, 6 aa, Mycobacterium avium
VKGDPT

SEQ ID NO: 48201 - protein, 5 aa, Mycobacterium avium
VKGGR

SEQ ID NO: 48202 - protein, 59 aa, Mycobacterium avium
VKGKAKEAVGAVAGRDDLTREGQAQQDKAEAQRDAAKKEAEAEAARGGAEAAEERQRAN

SEQ ID NO: 48203 - protein, 6 aa, Mycobacterium avium
VKHPDR

SEQ ID NO: 48204 - protein, 7 aa, Mycobacterium avium
VKIPDED

SEQ ID NO: 48205 - protein, 6 aa, Mycobacterium avium
VKKDDK

SEQ ID NO: 48206 - protein, 14 aa, Mycobacterium avium
VKKPAPEKKAKKEQ

SEQ ID NO: 48207 - protein, 8 aa, Mycobacterium avium
VKKPETIN

SEQ ID NO: 48208 - protein, 14 aa, Mycobacterium avium
VKPEDEQATRDGVA

SEQ ID NO: 48209 - protein, 6 aa, Mycobacterium avium
VKPGRA

SEQ ID NO: 48210 - protein, 6 aa, Mycobacterium avium
VKPTVA

SEQ ID NO: 48211 - protein, 6 aa, Mycobacterium avium
VKRAET

SEQ ID NO: 48212 - protein, 4 aa, Mycobacterium avium
VKRR

SEQ ID NO: 48213 - protein, 26 aa, Mycobacterium avium
VKRTRARANREQAEVDREIAESERDD

SEQ ID NO: 48214 - protein, 7 aa, Mycobacterium avium
VKSGETH

SEQ ID NO: 48215 - protein, 4 aa, Mycobacterium avium
VKTA

SEQ ID NO: 48216 - protein, 10 aa, Mycobacterium avium
VLGEPGKGWD

SEQ ID NO: 48217 - protein, 10 aa, Mycobacterium avium
VLGTKKAEAM

SEQ ID NO: 48218 - protein, 7 aa, Mycobacterium avium
VLPPAQT

SEQ ID NO: 48219 - protein, 7 aa, Mycobacterium avium
VLPPPTG

SEQ ID NO: 48220 - protein, 10 aa, Mycobacterium avium
VLSGPGQELE

SEQ ID NO: 48221 - protein, 5 aa, Mycobacterium avium
VLTER

SEQ ID NO: 48222 - protein, 12 aa, Mycobacterium avium
VLTGPDSDRDRR

SEQ ID NO: 48223 - protein, 8 aa, Mycobacterium avium
VMGGTSQI

SEQ ID NO: 48224 - protein, 7 aa, Mycobacterium avium
VNAASDA

SEQ ID NO: 48225 - protein, 10 aa, Mycobacterium avium
VNADPESRPA

SEQ ID NO: 48226 - protein, 6 aa, Mycobacterium avium
VNAKNV

SEQ ID NO: 48227 - protein, 5 aa, Mycobacterium avium
VNARQ

SEQ ID NO: 48228 - protein, 4 aa, Mycobacterium avium
VNDR

SEQ ID NO: 48229 - protein, 20 aa, Mycobacterium avium
VNEAADTTFYDSPETEKPVG

SEQ ID NO: 48230 - protein, 10 aa, Mycobacterium avium
VNETAQRRVS

SEQ ID NO: 48231 - protein, 13 aa, Mycobacterium avium
VNGATANREIDAT

SEQ ID NO: 48232 - protein, 16 aa, Mycobacterium avium
VNGGSVEDAKKRPEFG

SEQ ID NO: 48233 - protein, 4 aa, Mycobacterium avium
VNGP

SEQ ID NO: 48234 - protein, 5 aa, Mycobacterium avium
VNGPD

SEQ ID NO: 48235 - protein, 4 aa, Mycobacterium avium
VNGR

SEQ ID NO: 48236 - protein, 6 aa, Mycobacterium avium
VNKPHA

SEQ ID NO: 48237 - protein, 13 aa, Mycobacterium avium
VNMSQSSNDTFPT

SEQ ID NO: 48238 - protein, 5 aa, Mycobacterium avium
VNPDE

SEQ ID NO: 48239 - protein, 6 aa, Mycobacterium avium
VNPDRM

SEQ ID NO: 48240 - protein, 7 aa, Mycobacterium avium
VNQSSTA

SEQ ID NO: 48241 - protein, 12 aa, Mycobacterium avium
VNSASTSPRSRM

SEQ ID NO: 48242 - protein, 5 aa, Mycobacterium avium
VNSHS

SEQ ID NO: 48243 - protein, 11 aa, Mycobacterium avium
VNSSQGGGSKD

SEQ ID NO: 48244 - protein, 25 aa, Mycobacterium avium
VNTANRQGKRKRTRTGFGKRKSTKR

SEQ ID NO: 48245 - protein, 8 aa, Mycobacterium avium
VNTDAASL

SEQ ID NO: 48246 - protein, 6 aa, Mycobacterium avium
VNTPPS

SEQ ID NO: 48247 - protein, 8 aa, Mycobacterium avium
VNTTSSSH

SEQ ID NO: 48248 - protein, 5 aa, Mycobacterium avium
VPAAA

SEQ ID NO: 48249 - protein, 8 aa, Mycobacterium avium
VPAAPDLS

SEQ ID NO: 48250 - protein, 5 aa, Mycobacterium avium
VPAAR

SEQ ID NO: 48251 - protein, 9 aa, Mycobacterium avium
VPAARKPRF

SEQ ID NO: 48252 - protein, 17 aa, Mycobacterium avium
VPADASSTVFEPDPIRT

SEQ ID NO: 48253 - protein, 8 aa, Mycobacterium avium
VPAEGSAR

SEQ ID NO: 48254 - protein, 12 aa, Mycobacterium avium
VPAGDPGKGQLR

SEQ ID NO: 48255 - protein, 8 aa, Mycobacterium avium
VPAGGEDD

SEQ ID NO: 48256 - protein, 9 aa, Mycobacterium avium
VPAGSVTSL

SEQ ID NO: 48257 - protein, 9 aa, Mycobacterium avium
VPANASSAQ

SEQ ID NO: 48258 - protein, 7 aa, Mycobacterium avium
VPANGTE

SEQ ID NO: 48259 - protein, 15 aa, Mycobacterium avium
VPANVSKEIIAKATG

SEQ ID NO: 48260 - protein, 9 aa, Mycobacterium avium
VPAPGGRRE

SEQ ID NO: 48261 - protein, 12 aa, Mycobacterium avium
VPAPPVPALPQP

SEQ ID NO: 48262 - protein, 15 aa, Mycobacterium avium
VPAPQVAPVQTPEGL

SEQ ID NO: 48263 - protein, 16 aa, Mycobacterium avium
VPARNTPKSDPGAKIP

SEQ ID NO: 48264 - protein, 6 aa, Mycobacterium avium
VPARPE

SEQ ID NO: 48265 - protein, 8 aa, Mycobacterium avium
VPASNDNM

SEQ ID NO: 48266 - protein, 4 aa, Mycobacterium avium
VPAT

SEQ ID NO: 48267 - protein, 11 aa, Mycobacterium avium
VPATKGNTRRL

SEQ ID NO: 48268 - protein, 6 aa, Mycobacterium avium
VPDEEL

SEQ ID NO: 48269 - protein, 8 aa, Mycobacterium avium
VPDERRAA

SEQ ID NO: 48270 - protein, 4 aa, Mycobacterium avium
VPDG

SEQ ID NO: 48271 - protein, 5 aa, Mycobacterium avium
VPDGA

SEQ ID NO: 48272 - protein, 5 aa, Mycobacterium avium
VPDGP

SEQ ID NO: 48273 - protein, 6 aa, Mycobacterium avium
VPDPEL

SEQ ID NO: 48274 - protein, 9 aa, Mycobacterium avium
VPDPGGAAF

SEQ ID NO: 48275 - protein, 6 aa, Mycobacterium avium
VPDPGY

SEQ ID NO: 48276 - protein, 5 aa, Mycobacterium avium
VPDPH

SEQ ID NO: 48277 - protein, 9 aa, Mycobacterium avium
VPDPLPEPL

SEQ ID NO: 48278 - protein, 17 aa, Mycobacterium avium
VPDPPEQAGVTDPETAA

SEQ ID NO: 48279 - protein, 5 aa, Mycobacterium avium
VPDQW

SEQ ID NO: 48280 - protein, 20 aa, Mycobacterium avium
VPDSPPPLPPEQPPPPPLAS

SEQ ID NO: 48281 - protein, 8 aa, Mycobacterium avium
VPDSSDWQ

SEQ ID NO: 48282 - protein, 4 aa, Mycobacterium avium
VPEA

SEQ ID NO: 48283 - protein, 11 aa, Mycobacterium avium
VPEDEATGSAA

SEQ ID NO: 48284 - protein, 8 aa, Mycobacterium avium
VPEEDRDK

SEQ ID NO: 48285 - protein, 4 aa, Mycobacterium avium
VPEG

SEQ ID NO: 48286 - protein, 8 aa, Mycobacterium avium
VPEGGYPD

SEQ ID NO: 48287 - protein, 12 aa, Mycobacterium avium
VPEGTTLEVWDL

SEQ ID NO: 48288 - protein, 7 aa, Mycobacterium avium
VPEKRQE

SEQ ID NO: 48289 - protein, 13 aa, Mycobacterium avium
VPEPAETYSNSPH

SEQ ID NO: 48290 - protein, 12 aa, Mycobacterium avium
VPEPGDFTGDDR

SEQ ID NO: 48291 - protein, 5 aa, Mycobacterium avium
VPEPV

SEQ ID NO: 48292 - protein, 5 aa, Mycobacterium avium
VPEQA

SEQ ID NO: 48293 - protein, 4 aa, Mycobacterium avium
VPES

SEQ ID NO: 48294 - protein, 6 aa, Mycobacterium avium
VPESYT

SEQ ID NO: 48295 - protein, 6 aa, Mycobacterium avium
VPETLK

SEQ ID NO: 48296 - protein, 6 aa, Mycobacterium avium
VPETNS

SEQ ID NO: 48297 - protein, 6 aa, Mycobacterium avium
VPGAAR

SEQ ID NO: 48298 - protein, 5 aa, Mycobacterium avium
VPGAD

SEQ ID NO: 48299 - protein, 16 aa, Mycobacterium avium
VPGAGGTRWMVVALHI

SEQ ID NO: 48300 - protein, 7 aa, Mycobacterium avium
VPGFGGD

SEQ ID NO: 48301 - protein, 6 aa, Mycobacterium avium
VPGGPR

SEQ ID NO: 48302 - protein, 12 aa, Mycobacterium avium
VPGGSGGGSAAA

SEQ ID NO: 48303 - protein, 4 aa, Mycobacterium avium
VPGH

SEQ ID NO: 48304 - protein, 5 aa, Mycobacterium avium
VPGKP

SEQ ID NO: 48305 - protein, 6 aa, Mycobacterium avium
VPGLET

SEQ ID NO: 48306 - protein, 7 aa, Mycobacterium avium
VPGLRDA

SEQ ID NO: 48307 - protein, 5 aa, Mycobacterium avium
VPGNP

SEQ ID NO: 48308 - protein, 16 aa, Mycobacterium avium
VPGPDGAGKEPAPVSS

SEQ ID NO: 48309 - protein, 13 aa, Mycobacterium avium
VPGPHDDKYTQGV

SEQ ID NO: 48310 - protein, 6 aa, Mycobacterium avium
VPGPPF

SEQ ID NO: 48311 - protein, 7 aa, Mycobacterium avium
VPGPTAP

SEQ ID NO: 48312 - protein, 7 aa, Mycobacterium avium
VPGPVAG

SEQ ID NO: 48313 - protein, 21 aa, Mycobacterium avium
VPGQGADGVRPTPVDGTPAAL

SEQ ID NO: 48314 - protein, 4 aa, Mycobacterium avium
VPGR

SEQ ID NO: 48315 - protein, 11 aa, Mycobacterium avium
VPGRGGETEYV

SEQ ID NO: 48316 - protein, 6 aa, Mycobacterium avium
VPGRTG

SEQ ID NO: 48317 - protein, 6 aa, Mycobacterium avium
VPGSAS

SEQ ID NO: 48318 - protein, 8 aa, Mycobacterium avium
VPGSSSAT

SEQ ID NO: 48319 - protein, 7 aa, Mycobacterium avium
VPGTPGL

SEQ ID NO: 48320 - protein, 5 aa, Mycobacterium avium
VPGVP

SEQ ID NO: 48321 - protein, 8 aa, Mycobacterium avium
VPHGESGK

SEQ ID NO: 48322 - protein, 13 aa, Mycobacterium avium
VPKDGEQPNQRQK

SEQ ID NO: 48323 - protein, 13 aa, Mycobacterium avium
VPKGQSRRAAEEL

SEQ ID NO: 48324 - protein, 8 aa, Mycobacterium avium
VPKGTADG

SEQ ID NO: 48325 - protein, 8 aa, Mycobacterium avium
VPLPPDPW

SEQ ID NO: 48326 - protein, 6 aa, Mycobacterium avium
VPLPTE

SEQ ID NO: 48327 - protein, 7 aa, Mycobacterium avium
VPLPTRS

SEQ ID NO: 48328 - protein, 12 aa, Mycobacterium avium
VPMGSGLSSSAA

SEQ ID NO: 48329 - protein, 8 aa, Mycobacterium avium
VPNDGKGA

SEQ ID NO: 48330 - protein, 11 aa, Mycobacterium avium
VPNDRYSGSPV

SEQ ID NO: 48331 - protein, 4 aa, Mycobacterium avium
VPNG

SEQ ID NO: 48332 - protein, 7 aa, Mycobacterium avium
VPNLGQA

SEQ ID NO: 48333 - protein, 8 aa, Mycobacterium avium
VPNPLRGQ

SEQ ID NO: 48334 - protein, 7 aa, Mycobacterium avium
VPNTAGL

SEQ ID NO: 48335 - protein, 6 aa, Mycobacterium avium
VPPAAW

SEQ ID NO: 48336 - protein, 8 aa, Mycobacterium avium
VPPADPDE

SEQ ID NO: 48337 - protein, 14 aa, Mycobacterium avium
VPPAFKEESRGKAI

SEQ ID NO: 48338 - protein, 5 aa, Mycobacterium avium
VPPAV

SEQ ID NO: 48339 - protein, 7 aa, Mycobacterium avium
VPPDDPL

SEQ ID NO: 48340 - protein, 6 aa, Mycobacterium avium
VPPDDY

SEQ ID NO: 48341 - protein, 6 aa, Mycobacterium avium
VPPDSV

SEQ ID NO: 48342 - protein, 9 aa, Mycobacterium avium
VPPEADENT

SEQ ID NO: 48343 - protein, 9 aa, Mycobacterium avium
VPPEHPDSY

SEQ ID NO: 48344 - protein, 5 aa, Mycobacterium avium
VPPER

SEQ ID NO: 48345 - protein, 5 aa, Mycobacterium avium
VPPGD

SEQ ID NO: 48346 - protein, 7 aa, Mycobacterium avium
VPPGDAD

SEQ ID NO: 48347 - protein, 5 aa, Mycobacterium avium
VPPGL

SEQ ID NO: 48348 - protein, 7 aa, Mycobacterium avium
VPPGPGE

SEQ ID NO: 48349 - protein, 5 aa, Mycobacterium avium
VPPGQ

SEQ ID NO: 48350 - protein, 13 aa, Mycobacterium avium
VPPGTEGLSYTGN

SEQ ID NO: 48351 - protein, 5 aa, Mycobacterium avium
VPPIN

SEQ ID NO: 48352 - protein, 4 aa, Mycobacterium avium
VPPN

SEQ ID NO: 48353 - protein, 9 aa, Mycobacterium avium
VPPNTGTLR

SEQ ID NO: 48354 - protein, 8 aa, Mycobacterium avium
VPPPEYDP

SEQ ID NO: 48355 - protein, 11 aa, Mycobacterium avium
VPPPQGQADAP

SEQ ID NO: 48356 - protein, 4 aa, Mycobacterium avium
VPPQ

SEQ ID NO: 48357 - protein, 5 aa, Mycobacterium avium
VPPQG

SEQ ID NO: 48358 - protein, 5 aa, Mycobacterium avium
VPPRA

SEQ ID NO: 48359 - protein, 13 aa, Mycobacterium avium
VPPRGTRPTTDRV

SEQ ID NO: 48360 - protein, 17 aa, Mycobacterium avium
VPPRQGHTPLGHEPAGE

SEQ ID NO: 48361 - protein, 7 aa, Mycobacterium avium
VPPRREH

SEQ ID NO: 48362 - protein, 12 aa, Mycobacterium avium
VPPRRPSAEQVA

SEQ ID NO: 48363 - protein, 7 aa, Mycobacterium avium
VPPSAQA

SEQ ID NO: 48364 - protein, 6 aa, Mycobacterium avium
VPPTNV

SEQ ID NO: 48365 - protein, 5 aa, Mycobacterium avium
VPQGL

SEQ ID NO: 48366 - protein, 10 aa, Mycobacterium avium
VPQPPYGQGA

SEQ ID NO: 48367 - protein, 8 aa, Mycobacterium avium
VPQQGHSV

SEQ ID NO: 48368 - protein, 6 aa, Mycobacterium avium
VPQSPT

SEQ ID NO: 48369 - protein, 6 aa, Mycobacterium avium
VPQTSF

SEQ ID NO: 48370 - protein, 13 aa, Mycobacterium avium
VPRPASSSYAQDA

SEQ ID NO: 48371 - protein, 8 aa, Mycobacterium avium
VPRPRAPL

SEQ ID NO: 48372 - protein, 8 aa, Mycobacterium avium
VPRPSEIR

SEQ ID NO: 48373 - protein, 14 aa, Mycobacterium avium
VPSAPTPPRSPSVE

SEQ ID NO: 48374 - protein, 4 aa, Mycobacterium avium
VPSG

SEQ ID NO: 48375 - protein, 18 aa, Mycobacterium avium
VPSGEEEELQSSEAKVGP

SEQ ID NO: 48376 - protein, 11 aa, Mycobacterium avium
VPSPNAMEVGP

SEQ ID NO: 48377 - protein, 11 aa, Mycobacterium avium
VPSVPAGETVT

SEQ ID NO: 48378 - protein, 8 aa, Mycobacterium avium
VPTAANAG

SEQ ID NO: 48379 - protein, 8 aa, Mycobacterium avium
VPTASTTA

SEQ ID NO: 48380 - protein, 11 aa, Mycobacterium avium
VPTDDSSLGAL

SEQ ID NO: 48381 - protein, 5 aa, Mycobacterium avium
VPTDG

SEQ ID NO: 48382 - protein, 8 aa, Mycobacterium avium
VPTDRERG

SEQ ID NO: 48383 - protein, 8 aa, Mycobacterium avium
VPTGEATH

SEQ ID NO: 48384 - protein, 6 aa, Mycobacterium avium
VPTIET

SEQ ID NO: 48385 - protein, 10 aa, Mycobacterium avium
VPTKTAAGRI

SEQ ID NO: 48386 - protein, 4 aa, Mycobacterium avium
VPTP

SEQ ID NO: 48387 - protein, 6 aa, Mycobacterium avium
VPTPDN

SEQ ID NO: 48388 - protein, 5 aa, Mycobacterium avium
VPTRD

SEQ ID NO: 48389 - protein, 8 aa, Mycobacterium avium
VPTSSPER

SEQ ID NO: 48390 - protein, 17 aa, Mycobacterium avium
VPTTPGRVTDTAEGARD

SEQ ID NO: 48391 - protein, 10 aa, Mycobacterium avium
VPTTPTHHEG

SEQ ID NO: 48392 - protein, 5 aa, Mycobacterium avium
VPTYD

SEQ ID NO: 48393 - protein, 6 aa, Mycobacterium avium
VPVAPE

SEQ ID NO: 48394 - protein, 4 aa, Mycobacterium avium
VPVG

SEQ ID NO: 48395 - protein, 9 aa, Mycobacterium avium
VPVGTTSTM

SEQ ID NO: 48396 - protein, 9 aa, Mycobacterium avium
VPVTPGADV

SEQ ID NO: 48397 - protein, 4 aa, Mycobacterium avium
VPWP

SEQ ID NO: 48398 - protein, 11 aa, Mycobacterium avium
VQAATERGARR

SEQ ID NO: 48399 - protein, 4 aa, Mycobacterium avium
VQAG

SEQ ID NO: 48400 - protein, 6 aa, Mycobacterium avium
VQASSE

SEQ ID NO: 48401 - protein, 14 aa, Mycobacterium avium
VQDGDLDPKSITPL

SEQ ID NO: 48402 - protein, 5 aa, Mycobacterium avium
VQDGK

SEQ ID NO: 48403 - protein, 4 aa, Mycobacterium avium
VQDH

SEQ ID NO: 48404 - protein, 10 aa, Mycobacterium avium
VQEAGAGTVS

SEQ ID NO: 48405 - protein, 4 aa, Mycobacterium avium
VQGE

SEQ ID NO: 48406 - protein, 7 aa, Mycobacterium avium
VQGGRTS

SEQ ID NO: 48407 - protein, 6 aa, Mycobacterium avium
VQGPDP

SEQ ID NO: 48408 - protein, 17 aa, Mycobacterium avium
VQKRSSHKESRGGRKEA

SEQ ID NO: 48409 - protein, 7 aa, Mycobacterium avium
VQNASGA

SEQ ID NO: 48410 - protein, 9 aa, Mycobacterium avium
VQPEGDRGQ

SEQ ID NO: 48411 - protein, 11 aa, Mycobacterium avium
VQPHSGAQANA

SEQ ID NO: 48412 - protein, 17 aa, Mycobacterium avium
VQPPADTGEADGLSPAS

SEQ ID NO: 48413 - protein, 8 aa, Mycobacterium avium
VQPPPSEG

SEQ ID NO: 48414 - protein, 10 aa, Mycobacterium avium
VQPTEEARAA

SEQ ID NO: 48415 - protein, 7 aa, Mycobacterium avium
VQPTSDS

SEQ ID NO: 48416 - protein, 6 aa, Mycobacterium avium
VQREGR

SEQ ID NO: 48417 - protein, 7 aa, Mycobacterium avium
VQRPGKQ

SEQ ID NO: 48418 - protein, 6 aa, Mycobacterium avium
VQRPND

SEQ ID NO: 48419 - protein, 11 aa, Mycobacterium avium
VQSGSKTLKDA

SEQ ID NO: 48420 - protein, 12 aa, Mycobacterium avium
VQSMGGNGLTKE

SEQ ID NO: 48421 - protein, 10 aa, Mycobacterium avium
VQSPGAARLD

SEQ ID NO: 48422 - protein, 12 aa, Mycobacterium avium
VQSPGAERLGDP

SEQ ID NO: 48423 - protein, 13 aa, Mycobacterium avium
VQTGTDDGDDDLA

SEQ ID NO: 48424 - protein, 6 aa, Mycobacterium avium
VQTKTG

SEQ ID NO: 48425 - protein, 7 aa, Mycobacterium avium
VQTPQGF

SEQ ID NO: 48426 - protein, 7 aa, Mycobacterium avium
VQWGPGS

SEQ ID NO: 48427 - protein, 16 aa, Mycobacterium avium
VRAAASAAEIAATGAD

SEQ ID NO: 48428 - protein, 8 aa, Mycobacterium avium
VRAAEQLG

SEQ ID NO: 48429 - protein, 6 aa, Mycobacterium avium
VRAAGR

SEQ ID NO: 48430 - protein, 6 aa, Mycobacterium avium
VRAGDL

SEQ ID NO: 48431 - protein, 6 aa, Mycobacterium avium
VRAGDT

SEQ ID NO: 48432 - protein, 5 aa, Mycobacterium avium
VRANT

SEQ ID NO: 48433 - protein, 4 aa, Mycobacterium avium
VRAR

SEQ ID NO: 48434 - protein, 11 aa, Mycobacterium avium
VRATARAYRTD

SEQ ID NO: 48435 - protein, 12 aa, Mycobacterium avium
VRATPDARVSTP

SEQ ID NO: 48436 - protein, 4 aa, Mycobacterium avium
VRDE

SEQ ID NO: 48437 - protein, 4 aa, Mycobacterium avium
VRDG

SEQ ID NO: 48438 - protein, 6 aa, Mycobacterium avium
VRDGAA

SEQ ID NO: 48439 - protein, 20 aa, Mycobacterium avium
VRDGAEEVADADRRAAGVWA

SEQ ID NO: 48440 - protein, 9 aa, Mycobacterium avium
VRDGRDDET

SEQ ID NO: 48441 - protein, 7 aa, Mycobacterium avium
VRDPAAV

SEQ ID NO: 48442 - protein, 12 aa, Mycobacterium avium
VRDRTGDPNAWQ

SEQ ID NO: 48443 - protein, 9 aa, Mycobacterium avium
VRDTGGRTR

SEQ ID NO: 48444 - protein, 10 aa, Mycobacterium avium
VREAGNSEEV

SEQ ID NO: 48445 - protein, 7 aa, Mycobacterium avium
VREETGQ

SEQ ID NO: 48446 - protein, 12 aa, Mycobacterium avium
VREGGSAERTLP

SEQ ID NO: 48447 - protein, 7 aa, Mycobacterium avium
VREGPAA

SEQ ID NO: 48448 - protein, 11 aa, Mycobacterium avium
VREGPAPQPVL

SEQ ID NO: 48449 - protein, 7 aa, Mycobacterium avium
VREGREG

SEQ ID NO: 48450 - protein, 7 aa, Mycobacterium avium
VREHDPS

SEQ ID NO: 48451 - protein, 7 aa, Mycobacterium avium
VREKETQ

SEQ ID NO: 48452 - protein, 15 aa, Mycobacterium avium
VREPGDTGDVPTGRA

SEQ ID NO: 48453 - protein, 8 aa, Mycobacterium avium
VREPIPDE

SEQ ID NO: 48454 - protein, 7 aa, Mycobacterium avium
VREQNGQ

SEQ ID NO: 48455 - protein, 5 aa, Mycobacterium avium
VRERA

SEQ ID NO: 48456 - protein, 7 aa, Mycobacterium avium
VRGEGGR

SEQ ID NO: 48457 - protein, 8 aa, Mycobacterium avium
VRGGGSFD

SEQ ID NO: 48458 - protein, 7 aa, Mycobacterium avium
VRGGPVQ

SEQ ID NO: 48459 - protein, 5 aa, Mycobacterium avium
VRGID

SEQ ID NO: 48460 - protein, 6 aa, Mycobacterium avium
VRGNTQ

SEQ ID NO: 48461 - protein, 10 aa, Mycobacterium avium
VRGPSGTRLE

SEQ ID NO: 48462 - protein, 26 aa, Mycobacterium avium
VRGQRTKTNARTRKGPKRTIAGKKKA

SEQ ID NO: 48463 - protein, 7 aa, Mycobacterium avium
VRGREDS

SEQ ID NO: 48464 - protein, 13 aa, Mycobacterium avium
VRGRGAESAAPLG

SEQ ID NO: 48465 - protein, 9 aa, Mycobacterium avium
VRGSTSGAV

SEQ ID NO: 48466 - protein, 14 aa, Mycobacterium avium
VRGTGKGAFSDTRY

SEQ ID NO: 48467 - protein, 9 aa, Mycobacterium avium
VRGTSHNQV

SEQ ID NO: 48468 - protein, 8 aa, Mycobacterium avium
VRHSGASR

SEQ ID NO: 48469 - protein, 4 aa, Mycobacterium avium
VRIG

SEQ ID NO: 48470 - protein, 8 aa, Mycobacterium avium
VRKGSGAG

SEQ ID NO: 48471 - protein, 5 aa, Mycobacterium avium
VRKSY

SEQ ID NO: 48472 - protein, 5 aa, Mycobacterium avium
VRNPG

SEQ ID NO: 48473 - protein, 18 aa, Mycobacterium avium
VRNSPAGTGLNAATGEYE

SEQ ID NO: 48474 - protein, 11 aa, Mycobacterium avium
VRNYRDTSHKP

SEQ ID NO: 48475 - protein, 4 aa, Mycobacterium avium
VRPD

SEQ ID NO: 48476 - protein, 7 aa, Mycobacterium avium
VRPDPAA

SEQ ID NO: 48477 - protein, 5 aa, Mycobacterium avium
VRPEE

SEQ ID NO: 48478 - protein, 9 aa, Mycobacterium avium
VRPENAASR

SEQ ID NO: 48479 - protein, 7 aa, Mycobacterium avium
VRPGGTV

SEQ ID NO: 48480 - protein, 8 aa, Mycobacterium avium
VRPGSAEQ

SEQ ID NO: 48481 - protein, 6 aa, Mycobacterium avium
VRPGTE

SEQ ID NO: 48482 - protein, 14 aa, Mycobacterium avium
VRPHEPAYDPEPDA

SEQ ID NO: 48483 - protein, 5 aa, Mycobacterium avium
VRPHT

SEQ ID NO: 48484 - protein, 5 aa, Mycobacterium avium
VRPNT

SEQ ID NO: 48485 - protein, 10 aa, Mycobacterium avium
VRPPTPGRRL

SEQ ID NO: 48486 - protein, 8 aa, Mycobacterium avium
VRPRPGKV

SEQ ID NO: 48487 - protein, 10 aa, Mycobacterium avium
VRQPGKTGEE

SEQ ID NO: 48488 - protein, 8 aa, Mycobacterium avium
VRQRSRTT

SEQ ID NO: 48489 - protein, 29 aa, Mycobacterium avium
VRQSKVGDTVTSARHGAQEALTGYREPKP

SEQ ID NO: 48490 - protein, 6 aa, Mycobacterium avium
VRRAGD

SEQ ID NO: 48491 - protein, 9 aa, Mycobacterium avium
VRRDRSGKH

SEQ ID NO: 48492 - protein, 11 aa, Mycobacterium avium
VRRGSAEVNRD

SEQ ID NO: 48493 - protein, 6 aa, Mycobacterium avium
VRRGSD

SEQ ID NO: 48494 - protein, 7 aa, Mycobacterium avium
VRRPPGQ

SEQ ID NO: 48495 - protein, 4 aa, Mycobacterium avium
VRSA

SEQ ID NO: 48496 - protein, 17 aa, Mycobacterium avium
VRSAPRSKSAGYQACTP

SEQ ID NO: 48497 - protein, 5 aa, Mycobacterium avium
VRSDS

SEQ ID NO: 48498 - protein, 6 aa, Mycobacterium avium
VRSGAD

SEQ ID NO: 48499 - protein, 36 aa, Mycobacterium avium
VRSGAKPAGEADPYRESGSGVEPGRDGSIGDDDQPE

SEQ ID NO: 48500 - protein, 10 aa, Mycobacterium avium
VRSGDTPPAV

SEQ ID NO: 48501 - protein, 5 aa, Mycobacterium avium
VRSGH

SEQ ID NO: 48502 - protein, 11 aa, Mycobacterium avium
VRSRPSSPVSY

SEQ ID NO: 48503 - protein, 4 aa, Mycobacterium avium
VRTA

SEQ ID NO: 48504 - protein, 5 aa, Mycobacterium avium
VRTAA

SEQ ID NO: 48505 - protein, 20 aa, Mycobacterium avium
VRTADPDAARERRLAAEEDR

SEQ ID NO: 48506 - protein, 12 aa, Mycobacterium avium
VRTDPDAPKHAG

SEQ ID NO: 48507 - protein, 18 aa, Mycobacterium avium
VRTETGKGASRRARRAGK

SEQ ID NO: 48508 - protein, 8 aa, Mycobacterium avium
VRTGGYGQ

SEQ ID NO: 48509 - protein, 10 aa, Mycobacterium avium
VSAAEADRRG

SEQ ID NO: 48510 - protein, 8 aa, Mycobacterium avium
VSAAQAAE

SEQ ID NO: 48511 - protein, 5 aa, Mycobacterium avium
VSAAT

SEQ ID NO: 48512 - protein, 8 aa, Mycobacterium avium
VSAEAAAT

SEQ ID NO: 48513 - protein, 7 aa, Mycobacterium avium
VSAEPKV

SEQ ID NO: 48514 - protein, 12 aa, Mycobacterium avium
VSAESSHENRSA

SEQ ID NO: 48515 - protein, 12 aa, Mycobacterium avium
VSAGDREANEAD

SEQ ID NO: 48516 - protein, 7 aa, Mycobacterium avium
VSAGPGE

SEQ ID NO: 48517 - protein, 10 aa, Mycobacterium avium
VSAGPGTRAN

SEQ ID NO: 48518 - protein, 8 aa, Mycobacterium avium
VSAPPDAE

SEQ ID NO: 48519 - protein, 10 aa, Mycobacterium avium
VSASTASESI

SEQ ID NO: 48520 - protein, 5 aa, Mycobacterium avium
VSATA

SEQ ID NO: 48521 - protein, 6 aa, Mycobacterium avium
VSATGS

SEQ ID NO: 48522 - protein, 6 aa, Mycobacterium avium
VSDDER

SEQ ID NO: 48523 - protein, 5 aa, Mycobacterium avium
VSDEA

SEQ ID NO: 48524 - protein, 16 aa, Mycobacterium avium
VSDEHRDAFAGTQKGK

SEQ ID NO: 48525 - protein, 10 aa, Mycobacterium avium
VSDGAGRQPL

SEQ ID NO: 48526 - protein, 13 aa, Mycobacterium avium
VSDNDTPDKSSLR

SEQ ID NO: 48527 - protein, 12 aa, Mycobacterium avium
VSDPESAKAMAD

SEQ ID NO: 48528 - protein, 7 aa, Mycobacterium avium
VSDPKNP

SEQ ID NO: 48529 - protein, 5 aa, Mycobacterium avium
VSDRA

SEQ ID NO: 48530 - protein, 7 aa, Mycobacterium avium
VSEAPGY

SEQ ID NO: 48531 - protein, 7 aa, Mycobacterium avium
VSEDPAE

SEQ ID NO: 48532 - protein, 15 aa, Mycobacterium avium
VSEPGGPAAAAVSTG

SEQ ID NO: 48533 - protein, 14 aa, Mycobacterium avium
VSESDTVANPDPST

SEQ ID NO: 48534 - protein, 10 aa, Mycobacterium avium
VSETETRTQA

SEQ ID NO: 48535 - protein, 11 aa, Mycobacterium avium
VSETSGDGSVL

SEQ ID NO: 48536 - protein, 5 aa, Mycobacterium avium
VSEYT

SEQ ID NO: 48537 - protein, 12 aa, Mycobacterium avium
VSGAKSDAGDAK

SEQ ID NO: 48538 - protein, 9 aa, Mycobacterium avium
VSGDGSPGL

SEQ ID NO: 48539 - protein, 7 aa, Mycobacterium avium
VSGDRGH

SEQ ID NO: 48540 - protein, 10 aa, Mycobacterium avium
VSGDVRDPYT

SEQ ID NO: 48541 - protein, 8 aa, Mycobacterium avium
VSGERQGY

SEQ ID NO: 48542 - protein, 7 aa, Mycobacterium avium
VSGGAAD

SEQ ID NO: 48543 - protein, 5 aa, Mycobacterium avium
VSGGR

SEQ ID NO: 48544 - protein, 10 aa, Mycobacterium avium
VSGGRADPAM

SEQ ID NO: 48545 - protein, 5 aa, Mycobacterium avium
VSGGT

SEQ ID NO: 48546 - protein, 7 aa, Mycobacterium avium
VSGPDED

SEQ ID NO: 48547 - protein, 7 aa, Mycobacterium avium
VSGPDGR

SEQ ID NO: 48548 - protein, 7 aa, Mycobacterium avium
VSGPGLT

SEQ ID NO: 48549 - protein, 4 aa, Mycobacterium avium
VSGQ

SEQ ID NO: 48550 - protein, 5 aa, Mycobacterium avium
VSGRD

SEQ ID NO: 48551 - protein, 12 aa, Mycobacterium avium
VSGRPAELPGAE

SEQ ID NO: 48552 - protein, 5 aa, Mycobacterium avium
VSGSE

SEQ ID NO: 48553 - protein, 8 aa, Mycobacterium avium
VSGSSGHV

SEQ ID NO: 48554 - protein, 5 aa, Mycobacterium avium
VSGSV

SEQ ID NO: 48555 - protein, 4 aa, Mycobacterium avium
VSGT

SEQ ID NO: 48556 - protein, 5 aa, Mycobacterium avium
VSGTP

SEQ ID NO: 48557 - protein, 9 aa, Mycobacterium avium
VSHGPEGSL

SEQ ID NO: 48558 - protein, 6 aa, Mycobacterium avium
VSHGPS

SEQ ID NO: 48559 - protein, 9 aa, Mycobacterium avium
VSIGGSGSF

SEQ ID NO: 48560 - protein, 15 aa, Mycobacterium avium
VSINSGGEKIYPEEV

SEQ ID NO: 48561 - protein, 4 aa, Mycobacterium avium
VSKA

SEQ ID NO: 48562 - protein, 5 aa, Mycobacterium avium
VSKCE

SEQ ID NO: 48563 - protein, 6 aa, Mycobacterium avium
VSKVSE

SEQ ID NO: 48564 - protein, 6 aa, Mycobacterium avium
VSNAGG

SEQ ID NO: 48565 - protein, 5 aa, Mycobacterium avium
VSPAN

SEQ ID NO: 48566 - protein, 7 aa, Mycobacterium avium
VSPARAA

SEQ ID NO: 48567 - protein, 4 aa, Mycobacterium avium
VSPD

SEQ ID NO: 48568 - protein, 6 aa, Mycobacterium avium
VSPDGR

SEQ ID NO: 48569 - protein, 9 aa, Mycobacterium avium
VSPDTEPPR

SEQ ID NO: 48570 - protein, 7 aa, Mycobacterium avium
VSPEEAI

SEQ ID NO: 48571 - protein, 8 aa, Mycobacterium avium
VSPEKAAD

SEQ ID NO: 48572 - protein, 8 aa, Mycobacterium avium
VSPEKRTR

SEQ ID NO: 48573 - protein, 9 aa, Mycobacterium avium
VSPEQAAPG

SEQ ID NO: 48574 - protein, 4 aa, Mycobacterium avium
VSPG

SEQ ID NO: 48575 - protein, 5 aa, Mycobacterium avium
VSPGY

SEQ ID NO: 48576 - protein, 4 aa, Mycobacterium avium
VSPH

SEQ ID NO: 48577 - protein, 6 aa, Mycobacterium avium
VSPKAA

SEQ ID NO: 48578 - protein, 6 aa, Mycobacterium avium
VSPNPD

SEQ ID NO: 48579 - protein, 10 aa, Mycobacterium avium
VSPNPGGVGP

SEQ ID NO: 48580 - protein, 7 aa, Mycobacterium avium
VSPPFKQ

SEQ ID NO: 48581 - protein, 10 aa, Mycobacterium avium
VSPPNNTGDG

SEQ ID NO: 48582 - protein, 8 aa, Mycobacterium avium
VSPQNAQA

SEQ ID NO: 48583 - protein, 13 aa, Mycobacterium avium
VSPQQRAAELAQR

SEQ ID NO: 48584 - protein, 7 aa, Mycobacterium avium
VSPRGAT

SEQ ID NO: 48585 - protein, 6 aa, Mycobacterium avium
VSPRRP

SEQ ID NO: 48586 - protein, 10 aa, Mycobacterium avium
VSPSPRQYTR

SEQ ID NO: 48587 - protein, 18 aa, Mycobacterium avium
VSQAGGQPAGLGARDTLR

SEQ ID NO: 48588 - protein, 5 aa, Mycobacterium avium
VSQDG

SEQ ID NO: 48589 - protein, 5 aa, Mycobacterium avium
VSQTQ

SEQ ID NO: 48590 - protein, 8 aa, Mycobacterium avium
VSRGDVDT

SEQ ID NO: 48591 - protein, 7 aa, Mycobacterium avium
VSRNDDG

SEQ ID NO: 48592 - protein, 6 aa, Mycobacterium avium
VSRPTG

SEQ ID NO: 48593 - protein, 21 aa, Mycobacterium avium
VSRRPQAAAPAGYLTHLRFCE

SEQ ID NO: 48594 - protein, 5 aa, Mycobacterium avium
VSRTQ

SEQ ID NO: 48595 - protein, 35 aa, Mycobacterium avium
VSSAASTPAANVAQTAASAASTTLPYSGPFSGPAN

SEQ ID NO: 48596 - protein, 8 aa, Mycobacterium avium
VSSAGTGN

SEQ ID NO: 48597 - protein, 7 aa, Mycobacterium avium
VSSAPEL

SEQ ID NO: 48598 - protein, 9 aa, Mycobacterium avium
VSSAQARIA

SEQ ID NO: 48599 - protein, 11 aa, Mycobacterium avium
VSSDASPEEIK

SEQ ID NO: 48600 - protein, 6 aa, Mycobacterium avium
VSSEEH

SEQ ID NO: 48601 - protein, 6 aa, Mycobacterium avium
VSSERA

SEQ ID NO: 48602 - protein, 12 aa, Mycobacterium avium
VSSQHTASRRRV

SEQ ID NO: 48603 - protein, 6 aa, Mycobacterium avium
VSSRDQ

SEQ ID NO: 48604 - protein, 4 aa, Mycobacterium avium
VSSS

SEQ ID NO: 48605 - protein, 8 aa, Mycobacterium avium
VSTAPDED

SEQ ID NO: 48606 - protein, 9 aa, Mycobacterium avium
VSTDASGRY

SEQ ID NO: 48607 - protein, 10 aa, Mycobacterium avium
VSTDSRADLA

SEQ ID NO: 48608 - protein, 7 aa, Mycobacterium avium
VSTGRSE

SEQ ID NO: 48609 - protein, 8 aa, Mycobacterium avium
VSTPGGQE

SEQ ID NO: 48610 - protein, 9 aa, Mycobacterium avium
VSTQPHSHE

SEQ ID NO: 48611 - protein, 21 aa, Mycobacterium avium
VSTTTGPGIPVDPSITRNFAE

SEQ ID NO: 48612 - protein, 10 aa, Mycobacterium avium
VSVKGPKGTL

SEQ ID NO: 48613 - protein, 9 aa, Mycobacterium avium
VSVPGAPGV

SEQ ID NO: 48614 - protein, 6 aa, Mycobacterium avium
VSYEAG

SEQ ID NO: 48615 - protein, 11 aa, Mycobacterium avium
VSYSSTGSRDE

SEQ ID NO: 48616 - protein, 10 aa, Mycobacterium avium
VTAAGQDPET

SEQ ID NO: 48617 - protein, 12 aa, Mycobacterium avium
VTADADAAAAAD

SEQ ID NO: 48618 - protein, 4 aa, Mycobacterium avium
VTAG

SEQ ID NO: 48619 - protein, 8 aa, Mycobacterium avium
VTAPPSVA

SEQ ID NO: 48620 - protein, 5 aa, Mycobacterium avium
VTASG

SEQ ID NO: 48621 - protein, 7 aa, Mycobacterium avium
VTASTSV

SEQ ID NO: 48622 - protein, 9 aa, Mycobacterium avium
VTDAEPGRR

SEQ ID NO: 48623 - protein, 9 aa, Mycobacterium avium
VTDDGSTAR

SEQ ID NO: 48624 - protein, 9 aa, Mycobacterium avium
VTDEDVDAE

SEQ ID NO: 48625 - protein, 8 aa, Mycobacterium avium
VTDETTGM

SEQ ID NO: 48626 - protein, 5 aa, Mycobacterium avium
VTDGD

SEQ ID NO: 48627 - protein, 14 aa, Mycobacterium avium
VTDGNGYPPPAYPP

SEQ ID NO: 48628 - protein, 9 aa, Mycobacterium avium
VTDGRPEEF

SEQ ID NO: 48629 - protein, 8 aa, Mycobacterium avium
VTDPAERQ

SEQ ID NO: 48630 - protein, 15 aa, Mycobacterium avium
VTDPAKLEQVGTPWR

SEQ ID NO: 48631 - protein, 9 aa, Mycobacterium avium
VTDPDNPVN

SEQ ID NO: 48632 - protein, 12 aa, Mycobacterium avium
VTDPGGTANQQA

SEQ ID NO: 48633 - protein, 8 aa, Mycobacterium avium
VTDRSQVD

SEQ ID NO: 48634 - protein, 9 aa, Mycobacterium avium
VTDSDDSPH

SEQ ID NO: 48635 - protein, 11 aa, Mycobacterium avium
VTDTAGNTIDT

SEQ ID NO: 48636 - protein, 7 aa, Mycobacterium avium
VTEARSN

SEQ ID NO: 48637 - protein, 5 aa, Mycobacterium avium
VTEAT

SEQ ID NO: 48638 - protein, 6 aa, Mycobacterium avium
VTEETA

SEQ ID NO: 48639 - protein, 7 aa, Mycobacterium avium
VTEETTG

SEQ ID NO: 48640 - protein, 5 aa, Mycobacterium avium
VTEPG

SEQ ID NO: 48641 - protein, 6 aa, Mycobacterium avium
VTEPQR

SEQ ID NO: 48642 - protein, 7 aa, Mycobacterium avium
VTEQTTG

SEQ ID NO: 48643 - protein, 5 aa, Mycobacterium avium
VTERA

SEQ ID NO: 48644 - protein, 6 aa, Mycobacterium avium
VTERTP

SEQ ID NO: 48645 - protein, 11 aa, Mycobacterium avium
VTESDLDTQVS

SEQ ID NO: 48646 - protein, 11 aa, Mycobacterium avium
VTESQGRVHTS

SEQ ID NO: 48647 - protein, 8 aa, Mycobacterium avium
VTESSQLR

SEQ ID NO: 48648 - protein, 9 aa, Mycobacterium avium
VTETAKRLP

SEQ ID NO: 48649 - protein, 5 aa, Mycobacterium avium
VTGAA

SEQ ID NO: 48650 - protein, 5 aa, Mycobacterium avium
VTGAD

SEQ ID NO: 48651 - protein, 7 aa, Mycobacterium avium
VTGAQTG

SEQ ID NO: 48652 - protein, 7 aa, Mycobacterium avium
VTGDERV

SEQ ID NO: 48653 - protein, 10 aa, Mycobacterium avium
VTGDPQRGLR

SEQ ID NO: 48654 - protein, 5 aa, Mycobacterium avium
VTGDQ

SEQ ID NO: 48655 - protein, 10 aa, Mycobacterium avium
VTGESSADVD

SEQ ID NO: 48656 - protein, 7 aa, Mycobacterium avium
VTGGRIP

SEQ ID NO: 48657 - protein, 15 aa, Mycobacterium avium
VTGKTRGPAGPPPAE

SEQ ID NO: 48658 - protein, 7 aa, Mycobacterium avium
VTGPDEY

SEQ ID NO: 48659 - protein, 7 aa, Mycobacterium avium
VTGPEQR

SEQ ID NO: 48660 - protein, 8 aa, Mycobacterium avium
VTGPGEGA

SEQ ID NO: 48661 - protein, 6 aa, Mycobacterium avium
VTGRGQ

SEQ ID NO: 48662 - protein, 19 aa, Mycobacterium avium
VTGSGRVGIGPSGDEPGFQ

SEQ ID NO: 48663 - protein, 16 aa, Mycobacterium avium
VTGTAERCESPTGTPL

SEQ ID NO: 48664 - protein, 5 aa, Mycobacterium avium
VTGTD

SEQ ID NO: 48665 - protein, 12 aa, Mycobacterium avium
VTGTEDRLTPPA

SEQ ID NO: 48666 - protein, 8 aa, Mycobacterium avium
VTGTEGRK

SEQ ID NO: 48667 - protein, 5 aa, Mycobacterium avium
VTKGD

SEQ ID NO: 48668 - protein, 5 aa, Mycobacterium avium
VTKPP

SEQ ID NO: 48669 - protein, 7 aa, Mycobacterium avium
VTKPYSA

SEQ ID NO: 48670 - protein, 11 aa, Mycobacterium avium
VTKRGGGSALP

SEQ ID NO: 48671 - protein, 6 aa, Mycobacterium avium
VTNATS

SEQ ID NO: 48672 - protein, 9 aa, Mycobacterium avium
VTNPEGKRK

SEQ ID NO: 48673 - protein, 9 aa, Mycobacterium avium
VTNVDPKQR

SEQ ID NO: 48674 - protein, 9 aa, Mycobacterium avium
VTPAHDPND

SEQ ID NO: 48675 - protein, 7 aa, Mycobacterium avium
VTPATGL

SEQ ID NO: 48676 - protein, 9 aa, Mycobacterium avium
VTPDSDAAY

SEQ ID NO: 48677 - protein, 7 aa, Mycobacterium avium
VTPELEA

SEQ ID NO: 48678 - protein, 6 aa, Mycobacterium avium
VTPETA

SEQ ID NO: 48679 - protein, 4 aa, Mycobacterium avium
VTPG

SEQ ID NO: 48680 - protein, 13 aa, Mycobacterium avium
VTPKGETELTPEE

SEQ ID NO: 48681 - protein, 7 aa, Mycobacterium avium
VTPNPGA

SEQ ID NO: 48682 - protein, 10 aa, Mycobacterium avium
VTPQRAASGY

SEQ ID NO: 48683 - protein, 6 aa, Mycobacterium avium
VTPSPA

SEQ ID NO: 48684 - protein, 5 aa, Mycobacterium avium
VTPTP

SEQ ID NO: 48685 - protein, 6 aa, Mycobacterium avium
VTPYGG

SEQ ID NO: 48686 - protein, 9 aa, Mycobacterium avium
VTRKPNPHL

SEQ ID NO: 48687 - protein, 7 aa, Mycobacterium avium
VTRNGEQ

SEQ ID NO: 48688 - protein, 5 aa, Mycobacterium avium
VTRPD

SEQ ID NO: 48689 - protein, 9 aa, Mycobacterium avium
VTRPGQYEA

SEQ ID NO: 48690 - protein, 9 aa, Mycobacterium avium
VTRQGGREA

SEQ ID NO: 48691 - protein, 7 aa, Mycobacterium avium
VTRTDGD

SEQ ID NO: 48692 - protein, 10 aa, Mycobacterium avium
VTSGPALERA

SEQ ID NO: 48693 - protein, 7 aa, Mycobacterium avium
VTSPGRL

SEQ ID NO: 48694 - protein, 10 aa, Mycobacterium avium
VTSPKSGKVA

SEQ ID NO: 48695 - protein, 9 aa, Mycobacterium avium
VTSPNNVTA

SEQ ID NO: 48696 - protein, 12 aa, Mycobacterium avium
VTSPPAEQPAAT

SEQ ID NO: 48697 - protein, 11 aa, Mycobacterium avium
VTSPYPTDGAH

SEQ ID NO: 48698 - protein, 9 aa, Mycobacterium avium
VTSRGRAAA

SEQ ID NO: 48699 - protein, 10 aa, Mycobacterium avium
VTSRGYPPSI

SEQ ID NO: 48700 - protein, 20 aa, Mycobacterium avium
VTSRWPSGIKDGAEFVIPTM

SEQ ID NO: 48701 - protein, 9 aa, Mycobacterium avium
VTSSPIKGT

SEQ ID NO: 48702 - protein, 5 aa, Mycobacterium avium
VTTAD

SEQ ID NO: 48703 - protein, 7 aa, Mycobacterium avium
VTTAKTI

SEQ ID NO: 48704 - protein, 5 aa, Mycobacterium avium
VTTAQ

SEQ ID NO: 48705 - protein, 20 aa, Mycobacterium avium
VTTDHISPAGSIKPGTPAAQ

SEQ ID NO: 48706 - protein, 6 aa, Mycobacterium avium
VTTGDG

SEQ ID NO: 48707 - protein, 7 aa, Mycobacterium avium
VTTKDGD

SEQ ID NO: 48708 - protein, 4 aa, Mycobacterium avium
VTTP

SEQ ID NO: 48709 - protein, 12 aa, Mycobacterium avium
VTTPAPEPAEGE

SEQ ID NO: 48710 - protein, 7 aa, Mycobacterium avium
VTTSGDR

SEQ ID NO: 48711 - protein, 4 aa, Mycobacterium avium
VTTT

SEQ ID NO: 48712 - protein, 7 aa, Mycobacterium avium
VTTVDSG

SEQ ID NO: 48713 - protein, 5 aa, Mycobacterium avium
VVGTG

SEQ ID NO: 48714 - protein, 7 aa, Mycobacterium avium
VVKSSNG

SEQ ID NO: 48715 - protein, 6 aa, Mycobacterium avium
VVPAGG

SEQ ID NO: 48716 - protein, 11 aa, Mycobacterium avium
VVPAGSGSDDA

SEQ ID NO: 48717 - protein, 13 aa, Mycobacterium avium
VVPATADTSSQLT

SEQ ID NO: 48718 - protein, 5 aa, Mycobacterium avium
VVSPE

SEQ ID NO: 48719 - protein, 6 aa, Mycobacterium avium
VVTDTS

SEQ ID NO: 48720 - protein, 7 aa, Mycobacterium avium
VWSGRSG

SEQ ID NO: 48721 - protein, 5 aa, Mycobacterium avium
VWTTD

SEQ ID NO: 48722 - protein, 8 aa, Mycobacterium avium
WADDRPGA

SEQ ID NO: 48723 - protein, 11 aa, Mycobacterium avium
WAEPDESGDLG

SEQ ID NO: 48724 - protein, 4 aa, Mycobacterium avium
WAGD

SEQ ID NO: 48725 - protein, 7 aa, Mycobacterium avium
WAGPPPQ

SEQ ID NO: 48726 - protein, 4 aa, Mycobacterium avium
WANA

SEQ ID NO: 48727 - protein, 6 aa, Mycobacterium avium
WAPRIP

SEQ ID NO: 48728 - protein, 9 aa, Mycobacterium avium
WAPSGANAQ

SEQ ID NO: 48729 - protein, 8 aa, Mycobacterium avium
WAPTTAAD

SEQ ID NO: 48730 - protein, 18 aa, Mycobacterium avium
WAQGGMASSEAARANIGA

SEQ ID NO: 48731 - protein, 12 aa, Mycobacterium avium
WAQRHPAPVTPP

SEQ ID NO: 48732 - protein, 9 aa, Mycobacterium avium
WASKQPQPW

SEQ ID NO: 48733 - protein, 8 aa, Mycobacterium avium
WDDPQGVP

SEQ ID NO: 48734 - protein, 5 aa, Mycobacterium avium
WDGDG

SEQ ID NO: 48735 - protein, 9 aa, Mycobacterium avium
WDGESAGED

SEQ ID NO: 48736 - protein, 4 aa, Mycobacterium avium
WDGP

SEQ ID NO: 48737 - protein, 5 aa, Mycobacterium avium
WDGPS

SEQ ID NO: 48738 - protein, 7 aa, Mycobacterium avium
WDPARAA

SEQ ID NO: 48739 - protein, 9 aa, Mycobacterium avium
WDPKAQRPE

SEQ ID NO: 48740 - protein, 7 aa, Mycobacterium avium
WDPPVTA

SEQ ID NO: 48741 - protein, 11 aa, Mycobacterium avium
WDRPENPDPLG

SEQ ID NO: 48742 - protein, 6 aa, Mycobacterium avium
WDTNDV

SEQ ID NO: 48743 - protein, 7 aa, Mycobacterium avium
WDTNPRW

SEQ ID NO: 48744 - protein, 6 aa, Mycobacterium avium
WEAPDP

SEQ ID NO: 48745 - protein, 7 aa, Mycobacterium avium
WERDGQW

SEQ ID NO: 48746 - protein, 13 aa, Mycobacterium avium
WERPGDGPLPDPV

SEQ ID NO: 48747 - protein, 8 aa, Mycobacterium avium
WETDQHRE

SEQ ID NO: 48748 - protein, 16 aa, Mycobacterium avium
WGEPARPNAIDTDGPT

SEQ ID NO: 48749 - protein, 6 aa, Mycobacterium avium
WGGGDR

SEQ ID NO: 48750 - protein, 10 aa, Mycobacterium avium
WGPARDVRDR

SEQ ID NO: 48751 - protein, 11 aa, Mycobacterium avium
WGPDENPYPDF

SEQ ID NO: 48752 - protein, 6 aa, Mycobacterium avium
WGPPPG

SEQ ID NO: 48753 - protein, 13 aa, Mycobacterium avium
WGPVTGGTATGSV

SEQ ID NO: 48754 - protein, 10 aa, Mycobacterium avium
WGQPQGRSAI

SEQ ID NO: 48755 - protein, 13 aa, Mycobacterium avium
WGQTGPRSQQAGH

SEQ ID NO: 48756 - protein, 4 aa, Mycobacterium avium
WGRA

SEQ ID NO: 48757 - protein, 4 aa, Mycobacterium avium
WGRR

SEQ ID NO: 48758 - protein, 10 aa, Mycobacterium avium
WGSTPTASGK

SEQ ID NO: 48759 - protein, 9 aa, Mycobacterium avium
WKPDNSAAL

SEQ ID NO: 48760 - protein, 9 aa, Mycobacterium avium
WKPKPDTDV

SEQ ID NO: 48761 - protein, 9 aa, Mycobacterium avium
WKQKDYDEY

SEQ ID NO: 48762 - protein, 7 aa, Mycobacterium avium
WKRSPEE

SEQ ID NO: 48763 - protein, 9 aa, Mycobacterium avium
WNEEESGAY

SEQ ID NO: 48764 - protein, 4 aa, Mycobacterium avium
WNGT

SEQ ID NO: 48765 - protein, 8 aa, Mycobacterium avium
WNIDGNPE

SEQ ID NO: 48766 - protein, 11 aa, Mycobacterium avium
WNRGSDGAGRP

SEQ ID NO: 48767 - protein, 4 aa, Mycobacterium avium
WNRP

SEQ ID NO: 48768 - protein, 7 aa, Mycobacterium avium
WNTEARQ

SEQ ID NO: 48769 - protein, 10 aa, Mycobacterium avium
WPDPATAPRA

SEQ ID NO: 48770 - protein, 6 aa, Mycobacterium avium
WPEGSG

SEQ ID NO: 48771 - protein, 6 aa, Mycobacterium avium
WPGRSR

SEQ ID NO: 48772 - protein, 7 aa, Mycobacterium avium
WPGSPKY

SEQ ID NO: 48773 - protein, 9 aa, Mycobacterium avium
WPGSSDRNF

SEQ ID NO: 48774 - protein, 7 aa, Mycobacterium avium
WPPATTE

SEQ ID NO: 48775 - protein, 8 aa, Mycobacterium avium
WPPGDARG

SEQ ID NO: 48776 - protein, 6 aa, Mycobacterium avium
WPPNAA

SEQ ID NO: 48777 - protein, 9 aa, Mycobacterium avium
WPQPRADDS

SEQ ID NO: 48778 - protein, 5 aa, Mycobacterium avium
WPRPE

SEQ ID NO: 48779 - protein, 11 aa, Mycobacterium avium
WPSGDGDPAVQ

SEQ ID NO: 48780 - protein, 8 aa, Mycobacterium avium
WPSNERAN

SEQ ID NO: 48781 - protein, 16 aa, Mycobacterium avium
WPTGTPAGALPPSTEE

SEQ ID NO: 48782 - protein, 8 aa, Mycobacterium avium
WPTPSGEH

SEQ ID NO: 48783 - protein, 8 aa, Mycobacterium avium
WQGRGEEA

SEQ ID NO: 48784 - protein, 10 aa, Mycobacterium avium
WQPDGRPSAS

SEQ ID NO: 48785 - protein, 20 aa, Mycobacterium avium
WQPRRGAGRGRPPARAGRPR

SEQ ID NO: 48786 - protein, 9 aa, Mycobacterium avium
WQQSGGRGE

SEQ ID NO: 48787 - protein, 7 aa, Mycobacterium avium
WRGAPRP

SEQ ID NO: 48788 - protein, 7 aa, Mycobacterium avium
WRGEPAC

SEQ ID NO: 48789 - protein, 12 aa, Mycobacterium avium
WRRDGDGQVRGQ

SEQ ID NO: 48790 - protein, 12 aa, Mycobacterium avium
WRRGATQGHSGT

SEQ ID NO: 48791 - protein, 8 aa, Mycobacterium avium
WRRGPSAA

SEQ ID NO: 48792 - protein, 8 aa, Mycobacterium avium
WSDGSAPI

SEQ ID NO: 48793 - protein, 10 aa, Mycobacterium avium
WSDPSAGSQI

SEQ ID NO: 48794 - protein, 9 aa, Mycobacterium avium
WSENDTPEL

SEQ ID NO: 48795 - protein, 6 aa, Mycobacterium avium
WSGGGS

SEQ ID NO: 48796 - protein, 9 aa, Mycobacterium avium
WSGRPGPVL

SEQ ID NO: 48797 - protein, 4 aa, Mycobacterium avium
WSPA

SEQ ID NO: 48798 - protein, 11 aa, Mycobacterium avium
WSPEGAPQKVS

SEQ ID NO: 48799 - protein, 13 aa, Mycobacterium avium
WSPGPIDAPDPKV

SEQ ID NO: 48800 - protein, 7 aa, Mycobacterium avium
WSPQGKP

SEQ ID NO: 48801 - protein, 9 aa, Mycobacterium avium
WSQPPWRPD

SEQ ID NO: 48802 - protein, 8 aa, Mycobacterium avium
WSRASGEI

SEQ ID NO: 48803 - protein, 8 aa, Mycobacterium avium
WSRPGGQC

SEQ ID NO: 48804 - protein, 5 aa, Mycobacterium avium
WSSSS

SEQ ID NO: 48805 - protein, 5 aa, Mycobacterium avium
WSSTK

SEQ ID NO: 48806 - protein, 7 aa, Mycobacterium avium
WSSVPPE

SEQ ID NO: 48807 - protein, 18 aa, Mycobacterium avium
WSTGSSIMPQKKNPDIAE

SEQ ID NO: 48808 - protein, 4 aa, Mycobacterium avium
WSTP

SEQ ID NO: 48809 - protein, 5 aa, Mycobacterium avium
WSTQD

SEQ ID NO: 48810 - protein, 34 aa, Mycobacterium avium
WSTRRGAVESQVAQRRREAARRAESDSDADAPDA

SEQ ID NO: 48811 - protein, 8 aa, Mycobacterium avium
WTDEVSPG

SEQ ID NO: 48812 - protein, 18 aa, Mycobacterium avium
WTENYPELGTGPVDYTDS

SEQ ID NO: 48813 - protein, 8 aa, Mycobacterium avium
WTEPSTSE

SEQ ID NO: 48814 - protein, 4 aa, Mycobacterium avium
WTEY

SEQ ID NO: 48815 - protein, 11 aa, Mycobacterium avium
WTGEGAAAHAE

SEQ ID NO: 48816 - protein, 6 aa, Mycobacterium avium
WTGTEA

SEQ ID NO: 48817 - protein, 7 aa, Mycobacterium avium
WTNRSGT

SEQ ID NO: 48818 - protein, 5 aa, Mycobacterium avium
WTPPQ

SEQ ID NO: 48819 - protein, 9 aa, Mycobacterium avium
WTSHDRPLD

SEQ ID NO: 48820 - protein, 7 aa, Mycobacterium avium
WTSPRER

SEQ ID NO: 48821 - protein, 13 aa, Mycobacterium avium
YAAATSKAQGLIF

SEQ ID NO: 48822 - protein, 15 aa, Mycobacterium avium
YAAATSRRVAAEAGV

SEQ ID NO: 48823 - protein, 5 aa, Mycobacterium avium
YAAGS

SEQ ID NO: 48824 - protein, 17 aa, Mycobacterium avium
YAAGYSGFEGVDDNGTP

SEQ ID NO: 48825 - protein, 10 aa, Mycobacterium avium
YAANRNSSVA

SEQ ID NO: 48826 - protein, 12 aa, Mycobacterium avium
YAARGGGPDQLR

SEQ ID NO: 48827 - protein, 4 aa, Mycobacterium avium
YAAY

SEQ ID NO: 48828 - protein, 12 aa, Mycobacterium avium
YADAPDGADIPR

SEQ ID NO: 48829 - protein, 10 aa, Mycobacterium avium
YADGRLPKDR

SEQ ID NO: 48830 - protein, 8 aa, Mycobacterium avium
YADGSRDR

SEQ ID NO: 48831 - protein, 6 aa, Mycobacterium avium
YADPSS

SEQ ID NO: 48832 - protein, 6 aa, Mycobacterium avium
YADQTD

SEQ ID NO: 48833 - protein, 16 aa, Mycobacterium avium
YADRTGSAGGTGAYAG

SEQ ID NO: 48834 - protein, 4 aa, Mycobacterium avium
YAEA

SEQ ID NO: 48835 - protein, 8 aa, Mycobacterium avium
YAEEAGIK

SEQ ID NO: 48836 - protein, 8 aa, Mycobacterium avium
YAEEPEVV

SEQ ID NO: 48837 - protein, 4 aa, Mycobacterium avium
YAEG

SEQ ID NO: 48838 - protein, 10 aa, Mycobacterium avium
YAEGGPTHAS

SEQ ID NO: 48839 - protein, 7 aa, Mycobacterium avium
YAEPQVA

SEQ ID NO: 48840 - protein, 9 aa, Mycobacterium avium
YAETEQEAD

SEQ ID NO: 48841 - protein, 10 aa, Mycobacterium avium
YAGAGATIGP

SEQ ID NO: 48842 - protein, 8 aa, Mycobacterium avium
YAGPAGRD

SEQ ID NO: 48843 - protein, 20 aa, Mycobacterium avium
YAGPDAPPTQIQGPPPRQEH

SEQ ID NO: 48844 - protein, 10 aa, Mycobacterium avium
YAGPDQRDAL

SEQ ID NO: 48845 - protein, 9 aa, Mycobacterium avium
YAGPGSAPL

SEQ ID NO: 48846 - protein, 14 aa, Mycobacterium avium
YAGQTDAAARAALA

SEQ ID NO: 48847 - protein, 16 aa, Mycobacterium avium
YAGRGYGDLKKDTADA

SEQ ID NO: 48848 - protein, 9 aa, Mycobacterium avium
YAGRPSPLY

SEQ ID NO: 48849 - protein, 17 aa, Mycobacterium avium
YAHEREKRLRKEGSKQY

SEQ ID NO: 48850 - protein, 5 aa, Mycobacterium avium
YAKDG

SEQ ID NO: 48851 - protein, 22 aa, Mycobacterium avium
YAKDKKLLKDKDPNLTGDDIRE

SEQ ID NO: 48852 - protein, 13 aa, Mycobacterium avium
YAKERQSFGQPIG

SEQ ID NO: 48853 - protein, 10 aa, Mycobacterium avium
YAKPARRPTY

SEQ ID NO: 48854 - protein, 8 aa, Mycobacterium avium
YAPAARRS

SEQ ID NO: 48855 - protein, 9 aa, Mycobacterium avium
YAPGARERG

SEQ ID NO: 48856 - protein, 9 aa, Mycobacterium avium
YAPNDGAAV

SEQ ID NO: 48857 - protein, 5 aa, Mycobacterium avium
YAPQA

SEQ ID NO: 48858 - protein, 7 aa, Mycobacterium avium
YAPRRQK

SEQ ID NO: 48859 - protein, 9 aa, Mycobacterium avium
YAPTAKERG

SEQ ID NO: 48860 - protein, 12 aa, Mycobacterium avium
YAPTSRFGTPDE

SEQ ID NO: 48861 - protein, 10 aa, Mycobacterium avium
YAQGGPTHPS

SEQ ID NO: 48862 - protein, 7 aa, Mycobacterium avium
YAQRAGA

SEQ ID NO: 48863 - protein, 7 aa, Mycobacterium avium
YARAERD

SEQ ID NO: 48864 - protein, 9 aa, Mycobacterium avium
YARAQGNPT

SEQ ID NO: 48865 - protein, 6 aa, Mycobacterium avium
YARDGE

SEQ ID NO: 48866 - protein, 10 aa, Mycobacterium avium
YARNGKESEA

SEQ ID NO: 48867 - protein, 11 aa, Mycobacterium avium
YARTGNPTRAA

SEQ ID NO: 48868 - protein, 5 aa, Mycobacterium avium
YARTK

SEQ ID NO: 48869 - protein, 4 aa, Mycobacterium avium
YASP

SEQ ID NO: 48870 - protein, 4 aa, Mycobacterium avium
YASR

SEQ ID NO: 48871 - protein, 10 aa, Mycobacterium avium
YATAETNRTV

SEQ ID NO: 48872 - protein, 6 aa, Mycobacterium avium
YATDAG

SEQ ID NO: 48873 - protein, 9 aa, Mycobacterium avium
YATDPGDLP

SEQ ID NO: 48874 - protein, 7 aa, Mycobacterium avium
YATEVPD

SEQ ID NO: 48875 - protein, 10 aa, Mycobacterium avium
YATGSRRVAP

SEQ ID NO: 48876 - protein, 12 aa, Mycobacterium avium
YATSPAFTDDER

SEQ ID NO: 48877 - protein, 14 aa, Mycobacterium avium
YDAGNDMGAAEAAN

SEQ ID NO: 48878 - protein, 7 aa, Mycobacterium avium
YDATLAS

SEQ ID NO: 48879 - protein, 8 aa, Mycobacterium avium
YDDEGVAA

SEQ ID NO: 48880 - protein, 6 aa, Mycobacterium avium
YDDGDD

SEQ ID NO: 48881 - protein, 5 aa, Mycobacterium avium
YDDGP

SEQ ID NO: 48882 - protein, 8 aa, Mycobacterium avium
YDEDNRIG

SEQ ID NO: 48883 - protein, 12 aa, Mycobacterium avium
YDEGDSFDQSAA

SEQ ID NO: 48884 - protein, 9 aa, Mycobacterium avium
YDEGYTPDF

SEQ ID NO: 48885 - protein, 14 aa, Mycobacterium avium
YDGDVQSDAIAQGY

SEQ ID NO: 48886 - protein, 9 aa, Mycobacterium avium
YDGEQHRRD

SEQ ID NO: 48887 - protein, 15 aa, Mycobacterium avium
YDGRQDPVTLARLAD

SEQ ID NO: 48888 - protein, 12 aa, Mycobacterium avium
YDGSTAGSEDAE

SEQ ID NO: 48889 - protein, 9 aa, Mycobacterium avium
YDHRGNTTA

SEQ ID NO: 48890 - protein, 14 aa, Mycobacterium avium
YDPDPDAKGKMYTR

SEQ ID NO: 48891 - protein, 7 aa, Mycobacterium avium
YDPDPEL

SEQ ID NO: 48892 - protein, 5 aa, Mycobacterium avium
YDPDT

SEQ ID NO: 48893 - protein, 25 aa, Mycobacterium avium
YDPDTGAPLRGDDGRVRRVPPGQPG

SEQ ID NO: 48894 - protein, 7 aa, Mycobacterium avium
YDPNRTA

SEQ ID NO: 48895 - protein, 5 aa, Mycobacterium avium
YDPPR

SEQ ID NO: 48896 - protein, 4 aa, Mycobacterium avium
YDPR

SEQ ID NO: 48897 - protein, 7 aa, Mycobacterium avium
YDPTDAA

SEQ ID NO: 48898 - protein, 4 aa, Mycobacterium avium
YDRS

SEQ ID NO: 48899 - protein, 11 aa, Mycobacterium avium
YDSDPRKTKGA

SEQ ID NO: 48900 - protein, 8 aa, Mycobacterium avium
YDSEPGDV

SEQ ID NO: 48901 - protein, 5 aa, Mycobacterium avium
YDSRF

SEQ ID NO: 48902 - protein, 4 aa, Mycobacterium avium
YDTE

SEQ ID NO: 48903 - protein, 30 aa, Mycobacterium avium
YDTPPPPIERGSTYSQDADPRYADIGGGPL

SEQ ID NO: 48904 - protein, 4 aa, Mycobacterium avium
YDTS

SEQ ID NO: 48905 - protein, 17 aa, Mycobacterium avium
YEAAGDYRRFPDAGEPW

SEQ ID NO: 48906 - protein, 9 aa, Mycobacterium avium
YEAGGIAKH

SEQ ID NO: 48907 - protein, 6 aa, Mycobacterium avium
YEDRNS

SEQ ID NO: 48908 - protein, 10 aa, Mycobacterium avium
YEEAGEQEAQ

SEQ ID NO: 48909 - protein, 14 aa, Mycobacterium avium
YEEATEVYKDPETF

SEQ ID NO: 48910 - protein, 8 aa, Mycobacterium avium
YEEDARAE

SEQ ID NO: 48911 - protein, 43 aa, Mycobacterium avium
YEEEDDGRSGGEIESPGGGHTHGATATHSAAGDEHGSGGPPLA

SEQ ID NO: 48912 - protein, 4 aa, Mycobacterium avium
YEGD

SEQ ID NO: 48913 - protein, 8 aa, Mycobacterium avium
YEGEDAAR

SEQ ID NO: 48914 - protein, 5 aa, Mycobacterium avium
YEGKQ

SEQ ID NO: 48915 - protein, 9 aa, Mycobacterium avium
YEGNGRART

SEQ ID NO: 48916 - protein, 7 aa, Mycobacterium avium
YEGPQSA

SEQ ID NO: 48917 - protein, 7 aa, Mycobacterium avium
YEPAANR

SEQ ID NO: 48918 - protein, 5 aa, Mycobacterium avium
YEPDR

SEQ ID NO: 48919 - protein, 5 aa, Mycobacterium avium
YEPPE

SEQ ID NO: 48920 - protein, 9 aa, Mycobacterium avium
YEPQSDPAE

SEQ ID NO: 48921 - protein, 6 aa, Mycobacterium avium
YEQHPL

SEQ ID NO: 48922 - protein, 6 aa, Mycobacterium avium
YERPKA

SEQ ID NO: 48923 - protein, 7 aa, Mycobacterium avium
YERTGSA

SEQ ID NO: 48924 - protein, 7 aa, Mycobacterium avium
YESGASI

SEQ ID NO: 48925 - protein, 10 aa, Mycobacterium avium
YETDSSRGFA

SEQ ID NO: 48926 - protein, 8 aa, Mycobacterium avium
YETPDPEI

SEQ ID NO: 48927 - protein, 8 aa, Mycobacterium avium
YETSDGGT

SEQ ID NO: 48928 - protein, 9 aa, Mycobacterium avium
YETYSSARG

SEQ ID NO: 48929 - protein, 5 aa, Mycobacterium avium
YGADI

SEQ ID NO: 48930 - protein, 5 aa, Mycobacterium avium
YGAEA

SEQ ID NO: 48931 - protein, 9 aa, Mycobacterium avium
YGAESEASR

SEQ ID NO: 48932 - protein, 12 aa, Mycobacterium avium
YGAPDHSGGPFP

SEQ ID NO: 48933 - protein, 13 aa, Mycobacterium avium
YGAPGTASATILS

SEQ ID NO: 48934 - protein, 9 aa, Mycobacterium avium
YGAQGGDWG

SEQ ID NO: 48935 - protein, 6 aa, Mycobacterium avium
YGASTP

SEQ ID NO: 48936 - protein, 9 aa, Mycobacterium avium
YGATRDTDR

SEQ ID NO: 48937 - protein, 7 aa, Mycobacterium avium
YGATTAK

SEQ ID NO: 48938 - protein, 8 aa, Mycobacterium avium
YGDAPNRN

SEQ ID NO: 48939 - protein, 8 aa, Mycobacterium avium
YGDGETVD

SEQ ID NO: 48940 - protein, 10 aa, Mycobacterium avium
YGDGPSGPRL

SEQ ID NO: 48941 - protein, 8 aa, Mycobacterium avium
YGDGRSSD

SEQ ID NO: 48942 - protein, 7 aa, Mycobacterium avium
YGDPTLP

SEQ ID NO: 48943 - protein, 12 aa, Mycobacterium avium
YGDPTVKPNPNL

SEQ ID NO: 48944 - protein, 6 aa, Mycobacterium avium
YGDYKA

SEQ ID NO: 48945 - protein, 16 aa, Mycobacterium avium
YGEDEGTEEDLQTRPP

SEQ ID NO: 48946 - protein, 9 aa, Mycobacterium avium
YGETKPPEL

SEQ ID NO: 48947 - protein, 8 aa, Mycobacterium avium
YGETTGAA

SEQ ID NO: 48948 - protein, 4 aa, Mycobacterium avium
YGEY

SEQ ID NO: 48949 - protein, 8 aa, Mycobacterium avium
YGGDQEHR

SEQ ID NO: 48950 - protein, 25 aa, Mycobacterium avium
YGGEVKGELEGYGLTGSTLSVTSGR

SEQ ID NO: 48951 - protein, 5 aa, Mycobacterium avium
YGGGA

SEQ ID NO: 48952 - protein, 16 aa, Mycobacterium avium
YGGGRATPDLNAGGYV

SEQ ID NO: 48953 - protein, 10 aa, Mycobacterium avium
YGGHDTAAPR

SEQ ID NO: 48954 - protein, 5 aa, Mycobacterium avium
YGGPE

SEQ ID NO: 48955 - protein, 6 aa, Mycobacterium avium
YGGQLS

SEQ ID NO: 48956 - protein, 4 aa, Mycobacterium avium
YGGR

SEQ ID NO: 48957 - protein, 4 aa, Mycobacterium avium
YGGT

SEQ ID NO: 48958 - protein, 5 aa, Mycobacterium avium
YGGTA

SEQ ID NO: 48959 - protein, 9 aa, Mycobacterium avium
YGGTEIKYN

SEQ ID NO: 48960 - protein, 15 aa, Mycobacterium avium
YGGTTVEVQNTDAEG

SEQ ID NO: 48961 - protein, 15 aa, Mycobacterium avium
YGKRKAGAEKAESAD

SEQ ID NO: 48962 - protein, 4 aa, Mycobacterium avium
YGKT

SEQ ID NO: 48963 - protein, 10 aa, Mycobacterium avium
YGNEREVAQG

SEQ ID NO: 48964 - protein, 5 aa, Mycobacterium avium
YGPER

SEQ ID NO: 48965 - protein, 4 aa, Mycobacterium avium
YGPG

SEQ ID NO: 48966 - protein, 6 aa, Mycobacterium avium
YGPHPA

SEQ ID NO: 48967 - protein, 5 aa, Mycobacterium avium
YGPKG

SEQ ID NO: 48968 - protein, 6 aa, Mycobacterium avium
YGPPEA

SEQ ID NO: 48969 - protein, 5 aa, Mycobacterium avium
YGPPT

SEQ ID NO: 48970 - protein, 11 aa, Mycobacterium avium
YGPQGGAPADR

SEQ ID NO: 48971 - protein, 7 aa, Mycobacterium avium
YGPTEAT

SEQ ID NO: 48972 - protein, 7 aa, Mycobacterium avium
YGPTETT

SEQ ID NO: 48973 - protein, 5 aa, Mycobacterium avium
YGPTG

SEQ ID NO: 48974 - protein, 9 aa, Mycobacterium avium
YGQDRPADR

SEQ ID NO: 48975 - protein, 14 aa, Mycobacterium avium
YGQSPHTTLRQQTA

SEQ ID NO: 48976 - protein, 8 aa, Mycobacterium avium
YGQVGDGR

SEQ ID NO: 48977 - protein, 9 aa, Mycobacterium avium
YGRDGRSTQ

SEQ ID NO: 48978 - protein, 6 aa, Mycobacterium avium
YGRTPA

SEQ ID NO: 48979 - protein, 6 aa, Mycobacterium avium
YGSDAL

SEQ ID NO: 48980 - protein, 6 aa, Mycobacterium avium
YGSTEA

SEQ ID NO: 48981 - protein, 6 aa, Mycobacterium avium
YGSTTV

SEQ ID NO: 48982 - protein, 6 aa, Mycobacterium avium
YGTAKA

SEQ ID NO: 48983 - protein, 5 aa, Mycobacterium avium
YGTAP

SEQ ID NO: 48984 - protein, 6 aa, Mycobacterium avium
YGTAPN

SEQ ID NO: 48985 - protein, 5 aa, Mycobacterium avium
YGTDG

SEQ ID NO: 48986 - protein, 16 aa, Mycobacterium avium
YGTDGVTRPGQRQSGL

SEQ ID NO: 48987 - protein, 6 aa, Mycobacterium avium
YGTGHT

SEQ ID NO: 48988 - protein, 12 aa, Mycobacterium avium
YGTPAPGPAPER

SEQ ID NO: 48989 - protein, 8 aa, Mycobacterium avium
YGTSTRGV

SEQ ID NO: 48990 - protein, 4 aa, Mycobacterium avium
YGTT

SEQ ID NO: 48991 - protein, 7 aa, Mycobacterium avium
YGTYDDS

SEQ ID NO: 48992 - protein, 11 aa, Mycobacterium avium
YGVDNRPGGVR

SEQ ID NO: 48993 - protein, 13 aa, Mycobacterium avium
YGVPVNSPNGYRT

SEQ ID NO: 48994 - protein, 9 aa, Mycobacterium avium
YGYGPQADR

SEQ ID NO: 48995 - protein, 4 aa, Mycobacterium avium
YGYT

SEQ ID NO: 48996 - protein, 5 aa, Mycobacterium avium
YHEQE

SEQ ID NO: 48997 - protein, 13 aa, Mycobacterium avium
YHRAREAGGLGWR

SEQ ID NO: 48998 - protein, 7 aa, Mycobacterium avium
YHSNEGG

SEQ ID NO: 48999 - protein, 4 aa, Mycobacterium avium
YIGG

SEQ ID NO: 49000 - protein, 4 aa, Mycobacterium avium
YITG

SEQ ID NO: 49001 - protein, 5 aa, Mycobacterium avium
YKQGL

SEQ ID NO: 49002 - protein, 4 aa, Mycobacterium avium
YKSS

SEQ ID NO: 49003 - protein, 9 aa, Mycobacterium avium
YLPPHTKPR

SEQ ID NO: 49004 - protein, 10 aa, Mycobacterium avium
YNANPDSMRA

SEQ ID NO: 49005 - protein, 10 aa, Mycobacterium avium
YNDPHTPERW

SEQ ID NO: 49006 - protein, 4 aa, Mycobacterium avium
YNGA

SEQ ID NO: 49007 - protein, 14 aa, Mycobacterium avium
YNGPNTVLSGPGAD

SEQ ID NO: 49008 - protein, 7 aa, Mycobacterium avium
YNKASGD

SEQ ID NO: 49009 - protein, 11 aa, Mycobacterium avium
YNNASPASGRI

SEQ ID NO: 49010 - protein, 4 aa, Mycobacterium avium
YNPA

SEQ ID NO: 49011 - protein, 6 aa, Mycobacterium avium
YNPEIP

SEQ ID NO: 49012 - protein, 12 aa, Mycobacterium avium
YNPIAPKDLPGR

SEQ ID NO: 49013 - protein, 6 aa, Mycobacterium avium
YNPTTG

SEQ ID NO: 49014 - protein, 4 aa, Mycobacterium avium
YNRE

SEQ ID NO: 49015 - protein, 8 aa, Mycobacterium avium
YNRRTTAP

SEQ ID NO: 49016 - protein, 13 aa, Mycobacterium avium
YPAQLSGGEQQRV

SEQ ID NO: 49017 - protein, 9 aa, Mycobacterium avium
YPDAATGSA

SEQ ID NO: 49018 - protein, 5 aa, Mycobacterium avium
YPDAS

SEQ ID NO: 49019 - protein, 19 aa, Mycobacterium avium
YPDGGADAKPNRIPEAAGG

SEQ ID NO: 49020 - protein, 8 aa, Mycobacterium avium
YPDGRPHH

SEQ ID NO: 49021 - protein, 7 aa, Mycobacterium avium
YPDRRSA

SEQ ID NO: 49022 - protein, 4 aa, Mycobacterium avium
YPDS

SEQ ID NO: 49023 - protein, 7 aa, Mycobacterium avium
YPDSEPY

SEQ ID NO: 49024 - protein, 9 aa, Mycobacterium avium
YPEDDETAQ

SEQ ID NO: 49025 - protein, 7 aa, Mycobacterium avium
YPEEVPG

SEQ ID NO: 49026 - protein, 4 aa, Mycobacterium avium
YPEH

SEQ ID NO: 49027 - protein, 4 aa, Mycobacterium avium
YPEL

SEQ ID NO: 49028 - protein, 5 aa, Mycobacterium avium
YPEPI

SEQ ID NO: 49029 - protein, 16 aa, Mycobacterium avium
YPEPPPPGAVPSCAEG

SEQ ID NO: 49030 - protein, 9 aa, Mycobacterium avium
YPEPSPDAT

SEQ ID NO: 49031 - protein, 8 aa, Mycobacterium avium
YPGADEAL

SEQ ID NO: 49032 - protein, 8 aa, Mycobacterium avium
YPGADHAT

SEQ ID NO: 49033 - protein, 11 aa, Mycobacterium avium
YPGADPSQLQP

SEQ ID NO: 49034 - protein, 7 aa, Mycobacterium avium
YPGAPGQ

SEQ ID NO: 49035 - protein, 7 aa, Mycobacterium avium
YPGGETD

SEQ ID NO: 49036 - protein, 24 aa, Mycobacterium avium
YPGHGDDTVLGNERPHLSEWRERG

SEQ ID NO: 49037 - protein, 4 aa, Mycobacterium avium
YPGL

SEQ ID NO: 49038 - protein, 10 aa, Mycobacterium avium
YPGRTDTGMQ

SEQ ID NO: 49039 - protein, 4 aa, Mycobacterium avium
YPGT

SEQ ID NO: 49040 - protein, 10 aa, Mycobacterium avium
YPHEEGFAPH

SEQ ID NO: 49041 - protein, 14 aa, Mycobacterium avium
YPHNESTYGYSEKS

SEQ ID NO: 49042 - protein, 11 aa, Mycobacterium avium
YPIPGNDDAIR

SEQ ID NO: 49043 - protein, 9 aa, Mycobacterium avium
YPKTSGGRG

SEQ ID NO: 49044 - protein, 8 aa, Mycobacterium avium
YPNGDPHV

SEQ ID NO: 49045 - protein, 7 aa, Mycobacterium avium
YPPDDQL

SEQ ID NO: 49046 - protein, 4 aa, Mycobacterium avium
YPPE

SEQ ID NO: 49047 - protein, 5 aa, Mycobacterium avium
YPPEA

SEQ ID NO: 49048 - protein, 6 aa, Mycobacterium avium
YPPPPQ

SEQ ID NO: 49049 - protein, 6 aa, Mycobacterium avium
YPPPVT

SEQ ID NO: 49050 - protein, 8 aa, Mycobacterium avium
YPPQEAQT

SEQ ID NO: 49051 - protein, 8 aa, Mycobacterium avium
YPPRADGT

SEQ ID NO: 49052 - protein, 9 aa, Mycobacterium avium
YPSEDTVDP

SEQ ID NO: 49053 - protein, 11 aa, Mycobacterium avium
YPSLKDLTPDA

SEQ ID NO: 49054 - protein, 8 aa, Mycobacterium avium
YPSPEEER

SEQ ID NO: 49055 - protein, 4 aa, Mycobacterium avium
YPTA

SEQ ID NO: 49056 - protein, 12 aa, Mycobacterium avium
YPTDLTDESAVS

SEQ ID NO: 49057 - protein, 5 aa, Mycobacterium avium
YPTRA

SEQ ID NO: 49058 - protein, 15 aa, Mycobacterium avium
YPTRKDLTPDTLRRV

SEQ ID NO: 49059 - protein, 17 aa, Mycobacterium avium
YPTTTEAQDSAVSPRGY

SEQ ID NO: 49060 - protein, 9 aa, Mycobacterium avium
YPVEGAQGT

SEQ ID NO: 49061 - protein, 10 aa, Mycobacterium avium
YPYDSSGRVG

SEQ ID NO: 49062 - protein, 12 aa, Mycobacterium avium
YQDDAKGPSASV

SEQ ID NO: 49063 - protein, 8 aa, Mycobacterium avium
YQGFGPGG

SEQ ID NO: 49064 - protein, 24 aa, Mycobacterium avium
YQGKEAAEAGTGGRGGESGSPSTS

SEQ ID NO: 49065 - protein, 15 aa, Mycobacterium avium
YQGPPTKFEAGTGNI

SEQ ID NO: 49066 - protein, 5 aa, Mycobacterium avium
YQGRG

SEQ ID NO: 49067 - protein, 4 aa, Mycobacterium avium
YQNH

SEQ ID NO: 49068 - protein, 11 aa, Mycobacterium avium
YQPDSEKTTAV

SEQ ID NO: 49069 - protein, 13 aa, Mycobacterium avium
YQPEYRPPPQLPQ

SEQ ID NO: 49070 - protein, 20 aa, Mycobacterium avium
YQQTHEENFSAASDEALGDI

SEQ ID NO: 49071 - protein, 9 aa, Mycobacterium avium
YQRYESSGE

SEQ ID NO: 49072 - protein, 11 aa, Mycobacterium avium
YQVGRKGQSFL

SEQ ID NO: 49073 - protein, 11 aa, Mycobacterium avium
YRADDGGAGQP

SEQ ID NO: 49074 - protein, 8 aa, Mycobacterium avium
YRAEDELS

SEQ ID NO: 49075 - protein, 9 aa, Mycobacterium avium
YRDDEGHEH

SEQ ID NO: 49076 - protein, 9 aa, Mycobacterium avium
YRDEARPRA

SEQ ID NO: 49077 - protein, 10 aa, Mycobacterium avium
YRDESVQRGG

SEQ ID NO: 49078 - protein, 22 aa, Mycobacterium avium
YRDKNRYGFAPPGHRQGRGTDD

SEQ ID NO: 49079 - protein, 5 aa, Mycobacterium avium
YRDKY

SEQ ID NO: 49080 - protein, 4 aa, Mycobacterium avium
YRDP

SEQ ID NO: 49081 - protein, 8 aa, Mycobacterium avium
YRDPAAVT

SEQ ID NO: 49082 - protein, 10 aa, Mycobacterium avium
YRDPEERSHS

SEQ ID NO: 49083 - protein, 6 aa, Mycobacterium avium
YRGQET

SEQ ID NO: 49084 - protein, 4 aa, Mycobacterium avium
YRGT

SEQ ID NO: 49085 - protein, 4 aa, Mycobacterium avium
YRNE

SEQ ID NO: 49086 - protein, 4 aa, Mycobacterium avium
YRNP

SEQ ID NO: 49087 - protein, 10 aa, Mycobacterium avium
YRPAGGETQA

SEQ ID NO: 49088 - protein, 9 aa, Mycobacterium avium
YRPGDPPLA

SEQ ID NO: 49089 - protein, 7 aa, Mycobacterium avium
YRPPEEK

SEQ ID NO: 49090 - protein, 8 aa, Mycobacterium avium
YRPTQQGA

SEQ ID NO: 49091 - protein, 12 aa, Mycobacterium avium
YRRQDGTVVATS

SEQ ID NO: 49092 - protein, 8 aa, Mycobacterium avium
YRRTDEAM

SEQ ID NO: 49093 - protein, 7 aa, Mycobacterium avium
YRRTERG

SEQ ID NO: 49094 - protein, 5 aa, Mycobacterium avium
YRSAD

SEQ ID NO: 49095 - protein, 6 aa, Mycobacterium avium
YRSTPQ

SEQ ID NO: 49096 - protein, 6 aa, Mycobacterium avium
YRSTQN

SEQ ID NO: 49097 - protein, 8 aa, Mycobacterium avium
YRTPGGAG

SEQ ID NO: 49098 - protein, 9 aa, Mycobacterium avium
YRTPRPNPR

SEQ ID NO: 49099 - protein, 9 aa, Mycobacterium avium
YRTSGDSPI

SEQ ID NO: 49100 - protein, 8 aa, Mycobacterium avium
YSAGGAQV

SEQ ID NO: 49101 - protein, 12 aa, Mycobacterium avium
YSAQEASKALRT

SEQ ID NO: 49102 - protein, 10 aa, Mycobacterium avium
YSDPPALAAD

SEQ ID NO: 49103 - protein, 5 aa, Mycobacterium avium
YSELG

SEQ ID NO: 49104 - protein, 21 aa, Mycobacterium avium
YSEPGAGSDLANVSTTAELDG

SEQ ID NO: 49105 - protein, 5 aa, Mycobacterium avium
YSGDD

SEQ ID NO: 49106 - protein, 5 aa, Mycobacterium avium
YSGDS

SEQ ID NO: 49107 - protein, 17 aa, Mycobacterium avium
YSGPATSVQRDRGSRSR

SEQ ID NO: 49108 - protein, 11 aa, Mycobacterium avium
YSGPGSGPLTA

SEQ ID NO: 49109 - protein, 6 aa, Mycobacterium avium
YSGTAT

SEQ ID NO: 49110 - protein, 7 aa, Mycobacterium avium
YSHEPNR

SEQ ID NO: 49111 - protein, 8 aa, Mycobacterium avium
YSHPGDNI

SEQ ID NO: 49112 - protein, 6 aa, Mycobacterium avium
YSKDGQ

SEQ ID NO: 49113 - protein, 8 aa, Mycobacterium avium
YSKPPQRG

SEQ ID NO: 49114 - protein, 4 aa, Mycobacterium avium
YSLS

SEQ ID NO: 49115 - protein, 9 aa, Mycobacterium avium
YSPNSPLGG

SEQ ID NO: 49116 - protein, 14 aa, Mycobacterium avium
YSPRDRIPNSSSAY

SEQ ID NO: 49117 - protein, 6 aa, Mycobacterium avium
YSQGST

SEQ ID NO: 49118 - protein, 6 aa, Mycobacterium avium
YSQTDL

SEQ ID NO: 49119 - protein, 14 aa, Mycobacterium avium
YSQYDGYPGPQIPG

SEQ ID NO: 49120 - protein, 9 aa, Mycobacterium avium
YSRSKGQPL

SEQ ID NO: 49121 - protein, 6 aa, Mycobacterium avium
YSRTNR

SEQ ID NO: 49122 - protein, 8 aa, Mycobacterium avium
YSSPHDQI

SEQ ID NO: 49123 - protein, 9 aa, Mycobacterium avium
YSTPESPVS

SEQ ID NO: 49124 - protein, 7 aa, Mycobacterium avium
YTAAEAG

SEQ ID NO: 49125 - protein, 13 aa, Mycobacterium avium
YTADGEPDPAAAK

SEQ ID NO: 49126 - protein, 8 aa, Mycobacterium avium
YTDKPGHP

SEQ ID NO: 49127 - protein, 10 aa, Mycobacterium avium
YTDPDGGTAV

SEQ ID NO: 49128 - protein, 15 aa, Mycobacterium avium
YTEVPGVAKDSTTET

SEQ ID NO: 49129 - protein, 5 aa, Mycobacterium avium
YTGEL

SEQ ID NO: 49130 - protein, 10 aa, Mycobacterium avium
YTGGDSGGNL

SEQ ID NO: 49131 - protein, 15 aa, Mycobacterium avium
YTGGTTGKPKGVLGT

SEQ ID NO: 49132 - protein, 11 aa, Mycobacterium avium
YTKERKAFGKS

SEQ ID NO: 49133 - protein, 5 aa, Mycobacterium avium
YTLPE

SEQ ID NO: 49134 - protein, 13 aa, Mycobacterium avium
YTPALKASDAPKL

SEQ ID NO: 49135 - protein, 12 aa, Mycobacterium avium
YTPSRTTVDGDG

SEQ ID NO: 49136 - protein, 6 aa, Mycobacterium avium
YTPTLQ

SEQ ID NO: 49137 - protein, 11 aa, Mycobacterium avium
YTPVTPREPIR

SEQ ID NO: 49138 - protein, 16 aa, Mycobacterium avium
YTQNGRGDLAANEHAE

SEQ ID NO: 49139 - protein, 10 aa, Mycobacterium avium
YTQRDSESIG

SEQ ID NO: 49140 - protein, 20 aa, Mycobacterium avium
YTRGRHSDGEPGAPDHQTRR

SEQ ID NO: 49141 - protein, 9 aa, Mycobacterium avium
YTSGQPDPD

SEQ ID NO: 49142 - protein, 11 aa, Mycobacterium avium
YTSGSTRPPVG

SEQ ID NO: 49143 - protein, 7 aa, Mycobacterium avium
YTSHDAD

SEQ ID NO: 49144 - protein, 9 aa, Mycobacterium avium
YTSPKGKRL

SEQ ID NO: 49145 - protein, 9 aa, Mycobacterium avium
YTSTGGDAE

SEQ ID NO: 49146 - protein, 11 aa, Mycobacterium avium
YTTGREQFGRP

SEQ ID NO: 49147 - protein, 9 aa, Mycobacterium avium
YTTSDGEVA

SEQ ID NO: 49148 - protein, 5 aa, Mycobacterium avium
YTTTE

SEQ ID NO: 49149 - protein, 13 aa, Mycobacterium avium
YVGDGDGQQGYSK

SEQ ID NO: 49150 - protein, 6 aa, Mycobacterium avium
YVGGSP

SEQ ID NO: 49151 - protein, 6 aa, Mycobacterium avium
YVPDGA

SEQ ID NO: 49152 - protein, 16 aa, Mycobacterium avium
YVPEDDDERNEKQARE

SEQ ID NO: 49153 - protein, 6 aa, Mycobacterium avium
YVPEND

SEQ ID NO: 49154 - protein, 13 aa, Mycobacterium avium
YVQPPEPENFDPE

SEQ ID NO: 49155 - protein, 9 aa, Mycobacterium avium
YVSTSPELS

SEQ ID NO: 49156 - protein, 6 aa, Mycobacterium avium
YVTPDD

SEQ ID NO: 49157 - protein, 4 aa, Mycobacterium avium
YYGP

SEQ ID NO: 49158 - protein, 13 aa, Mycobacterium avium
YYGPTGGLPADDP

SEQ ID NO: 49159 - protein, 6 aa, Mycobacterium avium
YYPDGA

SEQ ID NO: 49160 - protein, 21 aa, Mycobacterium avium
YYPESPGGRAEGRSIEPKPFN

SEQ ID NO: 49161 - protein, 8 aa, Mycobacterium avium
YYRSGGGR

SEQ ID NO: 49162 - protein, 8 aa, Mycobacterium avium
AAAAAGAG

SEQ ID NO: 49163 - protein, 17 aa, Mycobacterium avium
AAAAATARHAARTGRGE

SEQ ID NO: 49164 - protein, 7 aa, Mycobacterium avium
AAAAEGV

SEQ ID NO: 49165 - protein, 8 aa, Mycobacterium avium
AAAAERGG

SEQ ID NO: 49166 - protein, 9 aa, Mycobacterium avium
AAAAGTPTY

SEQ ID NO: 49167 - protein, 65 aa, Mycobacterium avium
AAAAPAGAERPRRERPSGTRPRRSGASGTTATGTEAGRAAASADESTAAGQPAEAAPAAEPQSTE

SEQ ID NO: 49168 - protein, 7 aa, Mycobacterium avium
AAAAQGG

SEQ ID NO: 49169 - protein, 41 aa, Mycobacterium avium
AAAAQQAAAQQAQSQQSPGNEPAARRSADGSAMQQLRTTTG

SEQ ID NO: 49170 - protein, 5 aa, Mycobacterium avium
AAAAS

SEQ ID NO: 49171 - protein, 6 aa, Mycobacterium avium
AAAATT

SEQ ID NO: 49172 - protein, 10 aa, Mycobacterium avium
AAADAGLQPA

SEQ ID NO: 49173 - protein, 7 aa, Mycobacterium avium
AAADGCP

SEQ ID NO: 49174 - protein, 25 aa, Mycobacterium avium
AAADPDRSFPPPTEPPRVTSRRASP

SEQ ID NO: 49175 - protein, 11 aa, Mycobacterium avium
AAAEAGRPAPR

SEQ ID NO: 49176 - protein, 6 aa, Mycobacterium avium
AAAEMR

SEQ ID NO: 49177 - protein, 14 aa, Mycobacterium avium
AAAFGGRAGPLSCR

SEQ ID NO: 49178 - protein, 12 aa, Mycobacterium avium
AAAGAGDFPGEP

SEQ ID NO: 49179 - protein, 9 aa, Mycobacterium avium
AAAGERDRM

SEQ ID NO: 49180 - protein, 17 aa, Mycobacterium avium
AAAGGALRDGAATTEDV

SEQ ID NO: 49181 - protein, 8 aa, Mycobacterium avium
AAAGGVAR

SEQ ID NO: 49182 - protein, 6 aa, Mycobacterium avium
AAAGNA

SEQ ID NO: 49183 - protein, 8 aa, Mycobacterium avium
AAAGQAAL

SEQ ID NO: 49184 - protein, 6 aa, Mycobacterium avium
AAAGRP

SEQ ID NO: 49185 - protein, 8 aa, Mycobacterium avium
AAAGSPPA

SEQ ID NO: 49186 - protein, 5 aa, Mycobacterium avium
AAAGT

SEQ ID NO: 49187 - protein, 11 aa, Mycobacterium avium
AAAGTDAAVGS

SEQ ID NO: 49188 - protein, 7 aa, Mycobacterium avium
AAAGTPL

SEQ ID NO: 49189 - protein, 8 aa, Mycobacterium avium
AAAGVGKG

SEQ ID NO: 49190 - protein, 5 aa, Mycobacterium avium
AAAGW

SEQ ID NO: 49191 - protein, 12 aa, Mycobacterium avium
AAAKAAGKVRME

SEQ ID NO: 49192 - protein, 27 aa, Mycobacterium avium
AAAKAAVAASEKTGRPVDPRVKKLAEN

SEQ ID NO: 49193 - protein, 9 aa, Mycobacterium avium
AAAKPKADK

SEQ ID NO: 49194 - protein, 13 aa, Mycobacterium avium
AAAPAPEPAQPTL

SEQ ID NO: 49195 - protein, 15 aa, Mycobacterium avium
AAAPASIRRPRGAPR

SEQ ID NO: 49196 - protein, 11 aa, Mycobacterium avium
AAAPATAGVGA

SEQ ID NO: 49197 - protein, 15 aa, Mycobacterium avium
AAAPAWGKTAPPERA

SEQ ID NO: 49198 - protein, 13 aa, Mycobacterium avium
AAAPNLPKPATEV

SEQ ID NO: 49199 - protein, 9 aa, Mycobacterium avium
AAAQARAAA

SEQ ID NO: 49200 - protein, 11 aa, Mycobacterium avium
AAAQPVSSPTG

SEQ ID NO: 49201 - protein, 5 aa, Mycobacterium avium
AAAQR

SEQ ID NO: 49202 - protein, 6 aa, Mycobacterium avium
AAAQRA

SEQ ID NO: 49203 - protein, 9 aa, Mycobacterium avium
AAAQREGSL

SEQ ID NO: 49204 - protein, 15 aa, Mycobacterium avium
AAAQSDAWQGPSAER

SEQ ID NO: 49205 - protein, 4 aa, Mycobacterium avium
AAAR

SEQ ID NO: 49206 - protein, 10 aa, Mycobacterium avium
AAAREQHGRR

SEQ ID NO: 49207 - protein, 8 aa, Mycobacterium avium
AAARPVQR

SEQ ID NO: 49208 - protein, 11 aa, Mycobacterium avium
AAARQSRRPHI

SEQ ID NO: 49209 - protein, 24 aa, Mycobacterium avium
AAASARGDDAAAQRISAARKPTAA

SEQ ID NO: 49210 - protein, 7 aa, Mycobacterium avium
AAASDAG

SEQ ID NO: 49211 - protein, 7 aa, Mycobacterium avium
AAASDDS

SEQ ID NO: 49212 - protein, 22 aa, Mycobacterium avium
AAASGVVEREQDPLTAAAADQW

SEQ ID NO: 49213 - protein, 10 aa, Mycobacterium avium
AAASPDSVAA

SEQ ID NO: 49214 - protein, 13 aa, Mycobacterium avium
AAASRVNSTPAGR

SEQ ID NO: 49215 - protein, 8 aa, Mycobacterium avium
AAASYGSA

SEQ ID NO: 49216 - protein, 8 aa, Mycobacterium avium
AAATDTGV

SEQ ID NO: 49217 - protein, 18 aa, Mycobacterium avium
AAATQRPDRLPGVGSSSH

SEQ ID NO: 49218 - protein, 5 aa, Mycobacterium avium
AAAVT

SEQ ID NO: 49219 - protein, 4 aa, Mycobacterium avium
AAAY

SEQ ID NO: 49220 - protein, 17 aa, Mycobacterium avium
AADAAAQARRGAAAQPL

SEQ ID NO: 49221 - protein, 6 aa, Mycobacterium avium
AADAAE

SEQ ID NO: 49222 - protein, 7 aa, Mycobacterium avium
AADADGR

SEQ ID NO: 49223 - protein, 6 aa, Mycobacterium avium
AADAGR

SEQ ID NO: 49224 - protein, 9 aa, Mycobacterium avium
AADATAGPQ

SEQ ID NO: 49225 - protein, 8 aa, Mycobacterium avium
AADDPAAS

SEQ ID NO: 49226 - protein, 14 aa, Mycobacterium avium
AADEPESLDNERPA

SEQ ID NO: 49227 - protein, 7 aa, Mycobacterium avium
AADGHAA

SEQ ID NO: 49228 - protein, 10 aa, Mycobacterium avium
AADGSVSPAA

SEQ ID NO: 49229 - protein, 4 aa, Mycobacterium avium
AADL

SEQ ID NO: 49230 - protein, 5 aa, Mycobacterium avium
AADLP

SEQ ID NO: 49231 - protein, 18 aa, Mycobacterium avium
AADLSASSLRAAADRGCT

SEQ ID NO: 49232 - protein, 9 aa, Mycobacterium avium
AADPDAPAI

SEQ ID NO: 49233 - protein, 6 aa, Mycobacterium avium
AADPHA

SEQ ID NO: 49234 - protein, 9 aa, Mycobacterium avium
AADPQLAPA

SEQ ID NO: 49235 - protein, 15 aa, Mycobacterium avium
AADPTASAATGSNPI

SEQ ID NO: 49236 - protein, 4 aa, Mycobacterium avium
AADR

SEQ ID NO: 49237 - protein, 7 aa, Mycobacterium avium
AADRGEL

SEQ ID NO: 49238 - protein, 11 aa, Mycobacterium avium
AADRGRPRGCG

SEQ ID NO: 49239 - protein, 5 aa, Mycobacterium avium
AADRR

SEQ ID NO: 49240 - protein, 7 aa, Mycobacterium avium
AADTGEL

SEQ ID NO: 49241 - protein, 12 aa, Mycobacterium avium
AADTGLPDASGD

SEQ ID NO: 49242 - protein, 8 aa, Mycobacterium avium
AAEAAASR

SEQ ID NO: 49243 - protein, 12 aa, Mycobacterium avium
AAEDLGGGDIRS

SEQ ID NO: 49244 - protein, 9 aa, Mycobacterium avium
AAEDSAARA

SEQ ID NO: 49245 - protein, 11 aa, Mycobacterium avium
AAEEPDVPDAI

SEQ ID NO: 49246 - protein, 9 aa, Mycobacterium avium
AAEGEYIRS

SEQ ID NO: 49247 - protein, 7 aa, Mycobacterium avium
AAEGIGT

SEQ ID NO: 49248 - protein, 5 aa, Mycobacterium avium
AAEHG

SEQ ID NO: 49249 - protein, 6 aa, Mycobacterium avium
AAEHKP

SEQ ID NO: 49250 - protein, 20 aa, Mycobacterium avium
AAEIERTQPSSALPGPSPDD

SEQ ID NO: 49251 - protein, 4 aa, Mycobacterium avium
AAEP

SEQ ID NO: 49252 - protein, 11 aa, Mycobacterium avium
AAEPAHADAPA

SEQ ID NO: 49253 - protein, 7 aa, Mycobacterium avium
AAEPEDT

SEQ ID NO: 49254 - protein, 15 aa, Mycobacterium avium
AAEPQQRPRRRASKA

SEQ ID NO: 49255 - protein, 4 aa, Mycobacterium avium
AAEQ

SEQ ID NO: 49256 - protein, 10 aa, Mycobacterium avium
AAERDAERKV

SEQ ID NO: 49257 - protein, 7 aa, Mycobacterium avium
AAERGVR

SEQ ID NO: 49258 - protein, 4 aa, Mycobacterium avium
AAET

SEQ ID NO: 49259 - protein, 8 aa, Mycobacterium avium
AAETGSDH

SEQ ID NO: 49260 - protein, 7 aa, Mycobacterium avium
AAFDPDR

SEQ ID NO: 49261 - protein, 20 aa, Mycobacterium avium
AAFQGEPARPAYATAKAGIG

SEQ ID NO: 49262 - protein, 9 aa, Mycobacterium avium
AAGADTGTL

SEQ ID NO: 49263 - protein, 29 aa, Mycobacterium avium
AAGAETAGYGDPQLRTEEAARKNVRAAAD

SEQ ID NO: 49264 - protein, 7 aa, Mycobacterium avium
AAGAGAT

SEQ ID NO: 49265 - protein, 6 aa, Mycobacterium avium
AAGARA

SEQ ID NO: 49266 - protein, 5 aa, Mycobacterium avium
AAGDE

SEQ ID NO: 49267 - protein, 9 aa, Mycobacterium avium
AAGDENREV

SEQ ID NO: 49268 - protein, 7 aa, Mycobacterium avium
AAGDPSF

SEQ ID NO: 49269 - protein, 14 aa, Mycobacterium avium
AAGETAGARAAAGR

SEQ ID NO: 49270 - protein, 11 aa, Mycobacterium avium
AAGGDAEPGGA

SEQ ID NO: 49271 - protein, 8 aa, Mycobacterium avium
AAGGDEPS

SEQ ID NO: 49272 - protein, 6 aa, Mycobacterium avium
AAGGGD

SEQ ID NO: 49273 - protein, 6 aa, Mycobacterium avium
AAGGGH

SEQ ID NO: 49274 - protein, 7 aa, Mycobacterium avium
AAGGLRP

SEQ ID NO: 49275 - protein, 9 aa, Mycobacterium avium
AAGGPQLDR

SEQ ID NO: 49276 - protein, 6 aa, Mycobacterium avium
AAGGVG

SEQ ID NO: 49277 - protein, 8 aa, Mycobacterium avium
AAGGYPGT

SEQ ID NO: 49278 - protein, 17 aa, Mycobacterium avium
AAGHPGPADYPVPPPRD

SEQ ID NO: 49279 - protein, 6 aa, Mycobacterium avium
AAGISR

SEQ ID NO: 49280 - protein, 10 aa, Mycobacterium avium
AAGPGSDARQ

SEQ ID NO: 49281 - protein, 21 aa, Mycobacterium avium
AAGPTAQTTAPATGQTDHRGA

SEQ ID NO: 49282 - protein, 8 aa, Mycobacterium avium
AAGQELTP

SEQ ID NO: 49283 - protein, 18 aa, Mycobacterium avium
AAGRLEKEARTSKERRPV

SEQ ID NO: 49284 - protein, 9 aa, Mycobacterium avium
AAGRPPEAI

SEQ ID NO: 49285 - protein, 12 aa, Mycobacterium avium
AAGRTLTSYPSI

SEQ ID NO: 49286 - protein, 5 aa, Mycobacterium avium
AAGSG

SEQ ID NO: 49287 - protein, 5 aa, Mycobacterium avium
AAGSP

SEQ ID NO: 49288 - protein, 7 aa, Mycobacterium avium
AAGVDAR

SEQ ID NO: 49289 - protein, 8 aa, Mycobacterium avium
AAGVEPAE

SEQ ID NO: 49290 - protein, 10 aa, Mycobacterium avium
AAHDEPVDTA

SEQ ID NO: 49291 - protein, 7 aa, Mycobacterium avium
AAHGEPP

SEQ ID NO: 49292 - protein, 4 aa, Mycobacterium avium
AAHN

SEQ ID NO: 49293 - protein, 7 aa, Mycobacterium avium
AAHPGRP

SEQ ID NO: 49294 - protein, 8 aa, Mycobacterium avium
AAHPGRPE

SEQ ID NO: 49295 - protein, 5 aa, Mycobacterium avium
AAHPN

SEQ ID NO: 49296 - protein, 9 aa, Mycobacterium avium
AAKAENDRT

SEQ ID NO: 49297 - protein, 7 aa, Mycobacterium avium
AAKAGRT

SEQ ID NO: 49298 - protein, 15 aa, Mycobacterium avium
AAKGGYGKPRPTPGY

SEQ ID NO: 49299 - protein, 13 aa, Mycobacterium avium
AAKIRSEQLRITS

SEQ ID NO: 49300 - protein, 5 aa, Mycobacterium avium
AAKPA

SEQ ID NO: 49301 - protein, 13 aa, Mycobacterium avium
AAKPVPGEVSSDA

SEQ ID NO: 49302 - protein, 5 aa, Mycobacterium avium
AAKRR

SEQ ID NO: 49303 - protein, 5 aa, Mycobacterium avium
AAKSD

SEQ ID NO: 49304 - protein, 4 aa, Mycobacterium avium
AAKT

SEQ ID NO: 49305 - protein, 7 aa, Mycobacterium avium
AAKTRES

SEQ ID NO: 49306 - protein, 12 aa, Mycobacterium avium
AALDAGRSVAES

SEQ ID NO: 49307 - protein, 7 aa, Mycobacterium avium
AALDDSA

SEQ ID NO: 49308 - protein, 7 aa, Mycobacterium avium
AALEPDG

SEQ ID NO: 49309 - protein, 10 aa, Mycobacterium avium
AALESTDDPK

SEQ ID NO: 49310 - protein, 18 aa, Mycobacterium avium
AALPGSRTTTAAGTPGLD

SEQ ID NO: 49311 - protein, 6 aa, Mycobacterium avium
AALRSQ

SEQ ID NO: 49312 - protein, 10 aa, Mycobacterium avium
AALTGPPPRF

SEQ ID NO: 49313 - protein, 10 aa, Mycobacterium avium
AANAAQPGTE

SEQ ID NO: 49314 - protein, 8 aa, Mycobacterium avium
AANAGTRL

SEQ ID NO: 49315 - protein, 7 aa, Mycobacterium avium
AANAPQI

SEQ ID NO: 49316 - protein, 7 aa, Mycobacterium avium
AANEAQY

SEQ ID NO: 49317 - protein, 16 aa, Mycobacterium avium
AANGPPPLSSVAPPGV

SEQ ID NO: 49318 - protein, 4 aa, Mycobacterium avium
AANP

SEQ ID NO: 49319 - protein, 10 aa, Mycobacterium avium
AANPATTASF

SEQ ID NO: 49320 - protein, 7 aa, Mycobacterium avium
AANQPDG

SEQ ID NO: 49321 - protein, 6 aa, Mycobacterium avium
AANRTQ

SEQ ID NO: 49322 - protein, 14 aa, Mycobacterium avium
AANTDPAEFPDPET

SEQ ID NO: 49323 - protein, 9 aa, Mycobacterium avium
AANTGDYGP

SEQ ID NO: 49324 - protein, 9 aa, Mycobacterium avium
AAPAGPPRP

SEQ ID NO: 49325 - protein, 13 aa, Mycobacterium avium
AAPAGPPRRDGHR

SEQ ID NO: 49326 - protein, 11 aa, Mycobacterium avium
AAPAHYKQDSY

SEQ ID NO: 49327 - protein, 34 aa, Mycobacterium avium
AAPAPASAGAPAPASATVTASGAAPPPPSGIGGT

SEQ ID NO: 49328 - protein, 7 aa, Mycobacterium avium
AAPAPDA

SEQ ID NO: 49329 - protein, 10 aa, Mycobacterium avium
AAPARPASGR

SEQ ID NO: 49330 - protein, 9 aa, Mycobacterium avium
AAPATSMES

SEQ ID NO: 49331 - protein, 10 aa, Mycobacterium avium
AAPDSGEQDL

SEQ ID NO: 49332 - protein, 6 aa, Mycobacterium avium
AAPGAH

SEQ ID NO: 49333 - protein, 6 aa, Mycobacterium avium
AAPGFA

SEQ ID NO: 49334 - protein, 7 aa, Mycobacterium avium
AAPGGFD

SEQ ID NO: 49335 - protein, 5 aa, Mycobacterium avium
AAPGP

SEQ ID NO: 49336 - protein, 6 aa, Mycobacterium avium
AAPGRI

SEQ ID NO: 49337 - protein, 9 aa, Mycobacterium avium
AAPLNSPGA

SEQ ID NO: 49338 - protein, 6 aa, Mycobacterium avium
AAPLRA

SEQ ID NO: 49339 - protein, 9 aa, Mycobacterium avium
AAPPPAETR

SEQ ID NO: 49340 - protein, 7 aa, Mycobacterium avium
AAPQAGV

SEQ ID NO: 49341 - protein, 7 aa, Mycobacterium avium
AAPQNRL

SEQ ID NO: 49342 - protein, 7 aa, Mycobacterium avium
AAPRIPA

SEQ ID NO: 49343 - protein, 8 aa, Mycobacterium avium
AAPSETAQ

SEQ ID NO: 49344 - protein, 9 aa, Mycobacterium avium
AAPSEVQDE

SEQ ID NO: 49345 - protein, 9 aa, Mycobacterium avium
AAPSFAPGR

SEQ ID NO: 49346 - protein, 4 aa, Mycobacterium avium
AAPT

SEQ ID NO: 49347 - protein, 9 aa, Mycobacterium avium
AAPTEDGET

SEQ ID NO: 49348 - protein, 44 aa, Mycobacterium avium
AAPTGVARPPADAGPAPDRESGAAADAIASAEAALAQQNSVSSQ

SEQ ID NO: 49349 - protein, 7 aa, Mycobacterium avium
AAPVTPA

SEQ ID NO: 49350 - protein, 19 aa, Mycobacterium avium
AAQAAETAAQATAAATAYE

SEQ ID NO: 49351 - protein, 12 aa, Mycobacterium avium
AAQAEEVSHQAS

SEQ ID NO: 49352 - protein, 8 aa, Mycobacterium avium
AAQAPPAP

SEQ ID NO: 49353 - protein, 17 aa, Mycobacterium avium
AAQDRYRPSDSGGSIQG

SEQ ID NO: 49354 - protein, 6 aa, Mycobacterium avium
AAQLDG

SEQ ID NO: 49355 - protein, 10 aa, Mycobacterium avium
AAQLGSTGAT

SEQ ID NO: 49356 - protein, 8 aa, Mycobacterium avium
AAQPPDAA

SEQ ID NO: 49357 - protein, 4 aa, Mycobacterium avium
AAQR

SEQ ID NO: 49358 - protein, 19 aa, Mycobacterium avium
AAQRAAEKKHDDDQAAVDA

SEQ ID NO: 49359 - protein, 6 aa, Mycobacterium avium
AAQSGD

SEQ ID NO: 49360 - protein, 6 aa, Mycobacterium avium
AAQTEF

SEQ ID NO: 49361 - protein, 12 aa, Mycobacterium avium
AAQTRLGELVYV

SEQ ID NO: 49362 - protein, 15 aa, Mycobacterium avium
AARAGQARDSLAQSQ

SEQ ID NO: 49363 - protein, 5 aa, Mycobacterium avium
AARAQ

SEQ ID NO: 49364 - protein, 13 aa, Mycobacterium avium
AARAQQAKAEFET

SEQ ID NO: 49365 - protein, 8 aa, Mycobacterium avium
AARARSSR

SEQ ID NO: 49366 - protein, 11 aa, Mycobacterium avium
AARATGTPYGP

SEQ ID NO: 49367 - protein, 8 aa, Mycobacterium avium
AARESGRC

SEQ ID NO: 49368 - protein, 4 aa, Mycobacterium avium
AARG

SEQ ID NO: 49369 - protein, 5 aa, Mycobacterium avium
AARGA

SEQ ID NO: 49370 - protein, 20 aa, Mycobacterium avium
AARGDDERRWDPEDPDPGLC

SEQ ID NO: 49371 - protein, 10 aa, Mycobacterium avium
AARGDHEGAA

SEQ ID NO: 49372 - protein, 12 aa, Mycobacterium avium
AARGEARPDVTA

SEQ ID NO: 49373 - protein, 6 aa, Mycobacterium avium
AARGGV

SEQ ID NO: 49374 - protein, 8 aa, Mycobacterium avium
AARGVADG

SEQ ID NO: 49375 - protein, 13 aa, Mycobacterium avium
AARKGKAYSENLE

SEQ ID NO: 49376 - protein, 5 aa, Mycobacterium avium
AARNG

SEQ ID NO: 49377 - protein, 9 aa, Mycobacterium avium
AARPPEGDA

SEQ ID NO: 49378 - protein, 6 aa, Mycobacterium avium
AARPQH

SEQ ID NO: 49379 - protein, 7 aa, Mycobacterium avium
AARQEAD

SEQ ID NO: 49380 - protein, 14 aa, Mycobacterium avium
AARQLASGSAPGRR

SEQ ID NO: 49381 - protein, 9 aa, Mycobacterium avium
AARQQGDEV

SEQ ID NO: 49382 - protein, 24 aa, Mycobacterium avium
AARQSENPPVDSEPPNGPPPPARW

SEQ ID NO: 49383 - protein, 10 aa, Mycobacterium avium
AARQTNTAQA

SEQ ID NO: 49384 - protein, 4 aa, Mycobacterium avium
AARR

SEQ ID NO: 49385 - protein, 22 aa, Mycobacterium avium
AARRAAEAAAGVPAARRGRGVA

SEQ ID NO: 49386 - protein, 7 aa, Mycobacterium avium
AARRDPD

SEQ ID NO: 49387 - protein, 20 aa, Mycobacterium avium
AARSADQRRRELQGTRDQLG

SEQ ID NO: 49388 - protein, 12 aa, Mycobacterium avium
AARTDGPARQRH

SEQ ID NO: 49389 - protein, 14 aa, Mycobacterium avium
AARTERRPERPRGA

SEQ ID NO: 49390 - protein, 17 aa, Mycobacterium avium
AARTPTSTGLEYQDDSG

SEQ ID NO: 49391 - protein, 6 aa, Mycobacterium avium
AARVGT

SEQ ID NO: 49392 - protein, 16 aa, Mycobacterium avium
AASAGSEPLELPDAGS

SEQ ID NO: 49393 - protein, 14 aa, Mycobacterium avium
AASALTSVRGAARE

SEQ ID NO: 49394 - protein, 8 aa, Mycobacterium avium
AASATAAA

SEQ ID NO: 49395 - protein, 8 aa, Mycobacterium avium
AASEAGIE

SEQ ID NO: 49396 - protein, 10 aa, Mycobacterium avium
AASEGERPLD

SEQ ID NO: 49397 - protein, 5 aa, Mycobacterium avium
AASEM

SEQ ID NO: 49398 - protein, 12 aa, Mycobacterium avium
AASESAGELTPF

SEQ ID NO: 49399 - protein, 7 aa, Mycobacterium avium
AASGPGE

SEQ ID NO: 49400 - protein, 5 aa, Mycobacterium avium
AASQA

SEQ ID NO: 49401 - protein, 6 aa, Mycobacterium avium
AASREH

SEQ ID NO: 49402 - protein, 8 aa, Mycobacterium avium
AASRLETT

SEQ ID NO: 49403 - protein, 10 aa, Mycobacterium avium
AASSKAADVD

SEQ ID NO: 49404 - protein, 10 aa, Mycobacterium avium
AASTPPAERH

SEQ ID NO: 49405 - protein, 5 aa, Mycobacterium avium
AASVA

SEQ ID NO: 49406 - protein, 7 aa, Mycobacterium avium
AATAPSW

SEQ ID NO: 49407 - protein, 11 aa, Mycobacterium avium
AATDAARSAEV

SEQ ID NO: 49408 - protein, 10 aa, Mycobacterium avium
AATDEQPAAH

SEQ ID NO: 49409 - protein, 15 aa, Mycobacterium avium
AATDPAVQGAQYYGP

SEQ ID NO: 49410 - protein, 6 aa, Mycobacterium avium
AATEAA

SEQ ID NO: 49411 - protein, 12 aa, Mycobacterium avium
AATEALATSSEL

SEQ ID NO: 49412 - protein, 7 aa, Mycobacterium avium
AATEAQY

SEQ ID NO: 49413 - protein, 7 aa, Mycobacterium avium
AATEAVE

SEQ ID NO: 49414 - protein, 21 aa, Mycobacterium avium
AATGAPTAANEIDADPLPVKP

SEQ ID NO: 49415 - protein, 5 aa, Mycobacterium avium
AATGR

SEQ ID NO: 49416 - protein, 6 aa, Mycobacterium avium
AATGTA

SEQ ID NO: 49417 - protein, 8 aa, Mycobacterium avium
AATPGEAV

SEQ ID NO: 49418 - protein, 6 aa, Mycobacterium avium
AATPIS

SEQ ID NO: 49419 - protein, 8 aa, Mycobacterium avium
AATRGGQR

SEQ ID NO: 49420 - protein, 7 aa, Mycobacterium avium
AATRGGW

SEQ ID NO: 49421 - protein, 37 aa, Mycobacterium avium
AATRPVGGAASAASSLGGVAAEADPAAATIIVIPCIE

SEQ ID NO: 49422 - protein, 9 aa, Mycobacterium avium
AATRTGAQA

SEQ ID NO: 49423 - protein, 6 aa, Mycobacterium avium
AATVGE

SEQ ID NO: 49424 - protein, 6 aa, Mycobacterium avium
AAVAAS

SEQ ID NO: 49425 - protein, 16 aa, Mycobacterium avium
AAVGASRAAVDSGYYP

SEQ ID NO: 49426 - protein, 10 aa, Mycobacterium avium
AAVGTAAETA

SEQ ID NO: 49427 - protein, 5 aa, Mycobacterium avium
AAVTG

SEQ ID NO: 49428 - protein, 9 aa, Mycobacterium avium
AAYAQADNE

SEQ ID NO: 49429 - protein, 16 aa, Mycobacterium avium
AAYQERQTRALTSDRP

SEQ ID NO: 49430 - protein, 10 aa, Mycobacterium avium
AAYSPESAKR

SEQ ID NO: 49431 - protein, 4 aa, Mycobacterium avium
ACGP

SEQ ID NO: 49432 - protein, 4 aa, Mycobacterium avium
ACPP

SEQ ID NO: 49433 - protein, 4 aa, Mycobacterium avium
ACPT

SEQ ID NO: 49434 - protein, 12 aa, Mycobacterium avium
ACTGSEKPARNS

SEQ ID NO: 49435 - protein, 4 aa, Mycobacterium avium
ADAA

SEQ ID NO: 49436 - protein, 10 aa, Mycobacterium avium
ADAAAGAERL

SEQ ID NO: 49437 - protein, 7 aa, Mycobacterium avium
ADAADTA

SEQ ID NO: 49438 - protein, 8 aa, Mycobacterium avium
ADAADTDV

SEQ ID NO: 49439 - protein, 9 aa, Mycobacterium avium
ADAAGRSAR

SEQ ID NO: 49440 - protein, 14 aa, Mycobacterium avium
ADAARAAAQRTPER

SEQ ID NO: 49441 - protein, 18 aa, Mycobacterium avium
ADAARYPAEFSGGQKQRI

SEQ ID NO: 49442 - protein, 6 aa, Mycobacterium avium
ADADEK

SEQ ID NO: 49443 - protein, 7 aa, Mycobacterium avium
ADADQVE

SEQ ID NO: 49444 - protein, 24 aa, Mycobacterium avium
ADAEGAATADLAASTGGSAPVAAG

SEQ ID NO: 49445 - protein, 7 aa, Mycobacterium avium
ADAEPRP

SEQ ID NO: 49446 - protein, 10 aa, Mycobacterium avium
ADAGAAAADE

SEQ ID NO: 49447 - protein, 6 aa, Mycobacterium avium
ADAGDM

SEQ ID NO: 49448 - protein, 6 aa, Mycobacterium avium
ADAKEV

SEQ ID NO: 49449 - protein, 17 aa, Mycobacterium avium
ADALAADGLGAARSALG

SEQ ID NO: 49450 - protein, 8 aa, Mycobacterium avium
ADAPDTRR

SEQ ID NO: 49451 - protein, 18 aa, Mycobacterium avium
ADAPPADEIRRTPVPPAH

SEQ ID NO: 49452 - protein, 13 aa, Mycobacterium avium
ADAPPENRYTPSA

SEQ ID NO: 49453 - protein, 8 aa, Mycobacterium avium
ADAQASPL

SEQ ID NO: 49454 - protein, 12 aa, Mycobacterium avium
ADAQRAAQTAHA

SEQ ID NO: 49455 - protein, 8 aa, Mycobacterium avium
ADASNLAD

SEQ ID NO: 49456 - protein, 34 aa, Mycobacterium avium
ADASQQAALPEPPQPAAQQPPAAPAGATPAPERA

SEQ ID NO: 49457 - protein, 8 aa, Mycobacterium avium
ADASRGYQ

SEQ ID NO: 49458 - protein, 10 aa, Mycobacterium avium
ADATKVADDT

SEQ ID NO: 49459 - protein, 5 aa, Mycobacterium avium
ADAVR

SEQ ID NO: 49460 - protein, 9 aa, Mycobacterium avium
ADDAANYGG

SEQ ID NO: 49461 - protein, 18 aa, Mycobacterium avium
ADDAWDAPGPAALPEAQR

SEQ ID NO: 49462 - protein, 9 aa, Mycobacterium avium
ADDEADTVS

SEQ ID NO: 49463 - protein, 6 aa, Mycobacterium avium
ADDEEA

SEQ ID NO: 49464 - protein, 9 aa, Mycobacterium avium
ADDGGPLSR

SEQ ID NO: 49465 - protein, 12 aa, Mycobacterium avium
ADDGTRADADAV

SEQ ID NO: 49466 - protein, 9 aa, Mycobacterium avium
ADDPPPMGE

SEQ ID NO: 49467 - protein, 5 aa, Mycobacterium avium
ADDST

SEQ ID NO: 49468 - protein, 6 aa, Mycobacterium avium
ADEAEA

SEQ ID NO: 49469 - protein, 5 aa, Mycobacterium avium
ADEAR

SEQ ID NO: 49470 - protein, 6 aa, Mycobacterium avium
ADEARP

SEQ ID NO: 49471 - protein, 9 aa, Mycobacterium avium
ADEDLSTGR

SEQ ID NO: 49472 - protein, 7 aa, Mycobacterium avium
ADEEERD

SEQ ID NO: 49473 - protein, 7 aa, Mycobacterium avium
ADEGRYS

SEQ ID NO: 49474 - protein, 5 aa, Mycobacterium avium
ADENL

SEQ ID NO: 49475 - protein, 11 aa, Mycobacterium avium
ADEPVGTRARE

SEQ ID NO: 49476 - protein, 7 aa, Mycobacterium avium
ADESDGS

SEQ ID NO: 49477 - protein, 6 aa, Mycobacterium avium
ADESDP

SEQ ID NO: 49478 - protein, 13 aa, Mycobacterium avium
ADFHGPSYQHPPA

SEQ ID NO: 49479 - protein, 8 aa, Mycobacterium avium
ADFTASDR

SEQ ID NO: 49480 - protein, 9 aa, Mycobacterium avium
ADGAGLGTA

SEQ ID NO: 49481 - protein, 7 aa, Mycobacterium avium
ADGARAA

SEQ ID NO: 49482 - protein, 5 aa, Mycobacterium avium
ADGAT

SEQ ID NO: 49483 - protein, 7 aa, Mycobacterium avium
ADGEEHT

SEQ ID NO: 49484 - protein, 16 aa, Mycobacterium avium
ADGEGSVLALRPTRDG

SEQ ID NO: 49485 - protein, 9 aa, Mycobacterium avium
ADGGDEPTG

SEQ ID NO: 49486 - protein, 6 aa, Mycobacterium avium
ADGGTV

SEQ ID NO: 49487 - protein, 6 aa, Mycobacterium avium
ADGIDD

SEQ ID NO: 49488 - protein, 4 aa, Mycobacterium avium
ADGM

SEQ ID NO: 49489 - protein, 9 aa, Mycobacterium avium
ADGNRQRAH

SEQ ID NO: 49490 - protein, 8 aa, Mycobacterium avium
ADGNRQRS

SEQ ID NO: 49491 - protein, 9 aa, Mycobacterium avium
ADGQPADDP

SEQ ID NO: 49492 - protein, 8 aa, Mycobacterium avium
ADGRGRPY

SEQ ID NO: 49493 - protein, 4 aa, Mycobacterium avium
ADGS

SEQ ID NO: 49494 - protein, 9 aa, Mycobacterium avium
ADGSPVGEA

SEQ ID NO: 49495 - protein, 8 aa, Mycobacterium avium
ADGTDPGL

SEQ ID NO: 49496 - protein, 5 aa, Mycobacterium avium
ADGTL

SEQ ID NO: 49497 - protein, 9 aa, Mycobacterium avium
ADGTLTAGP

SEQ ID NO: 49498 - protein, 7 aa, Mycobacterium avium
ADGTPQQ

SEQ ID NO: 49499 - protein, 11 aa, Mycobacterium avium
ADGTPTPEHRY

SEQ ID NO: 49500 - protein, 10 aa, Mycobacterium avium
ADGVRAGRAM

SEQ ID NO: 49501 - protein, 12 aa, Mycobacterium avium
ADHAHGRAATGT

SEQ ID NO: 49502 - protein, 4 aa, Mycobacterium avium
ADIE

SEQ ID NO: 49503 - protein, 5 aa, Mycobacterium avium
ADIKG

SEQ ID NO: 49504 - protein, 6 aa, Mycobacterium avium
ADIPEG

SEQ ID NO: 49505 - protein, 5 aa, Mycobacterium avium
ADKAL

SEQ ID NO: 49506 - protein, 7 aa, Mycobacterium avium
ADKKKAI

SEQ ID NO: 49507 - protein, 5 aa, Mycobacterium avium
ADLER

SEQ ID NO: 49508 - protein, 12 aa, Mycobacterium avium
ADLGEADTTPDN

SEQ ID NO: 49509 - protein, 15 aa, Mycobacterium avium
ADLGPRRALTGEPLP

SEQ ID NO: 49510 - protein, 7 aa, Mycobacterium avium
ADLPEKV

SEQ ID NO: 49511 - protein, 13 aa, Mycobacterium avium
ADLPERAEAPGYR

SEQ ID NO: 49512 - protein, 19 aa, Mycobacterium avium
ADLPGGKHVEGTASGIDDQ

SEQ ID NO: 49513 - protein, 10 aa, Mycobacterium avium
ADLPGRDDNQ

SEQ ID NO: 49514 - protein, 5 aa, Mycobacterium avium
ADLTR

SEQ ID NO: 49515 - protein, 7 aa, Mycobacterium avium
ADNAADA

SEQ ID NO: 49516 - protein, 14 aa, Mycobacterium avium
ADNAAQGARQDPDP

SEQ ID NO: 49517 - protein, 4 aa, Mycobacterium avium
ADNG

SEQ ID NO: 49518 - protein, 6 aa, Mycobacterium avium
ADNPRG

SEQ ID NO: 49519 - protein, 6 aa, Mycobacterium avium
ADPAAR

SEQ ID NO: 49520 - protein, 10 aa, Mycobacterium avium
ADPANEDDTA

SEQ ID NO: 49521 - protein, 8 aa, Mycobacterium avium
ADPANPYG

SEQ ID NO: 49522 - protein, 7 aa, Mycobacterium avium
ADPDAAG

SEQ ID NO: 49523 - protein, 13 aa, Mycobacterium avium
ADPDADPGALATP

SEQ ID NO: 49524 - protein, 18 aa, Mycobacterium avium
ADPDEAAPARRKDLSGLP

SEQ ID NO: 49525 - protein, 5 aa, Mycobacterium avium
ADPDF

SEQ ID NO: 49526 - protein, 6 aa, Mycobacterium avium
ADPDGG

SEQ ID NO: 49527 - protein, 11 aa, Mycobacterium avium
ADPEQPGNPEV

SEQ ID NO: 49528 - protein, 7 aa, Mycobacterium avium
ADPEQSW

SEQ ID NO: 49529 - protein, 12 aa, Mycobacterium avium
ADPERHCKVLVT

SEQ ID NO: 49530 - protein, 7 aa, Mycobacterium avium
ADPGPLY

SEQ ID NO: 49531 - protein, 7 aa, Mycobacterium avium
ADPGRRL

SEQ ID NO: 49532 - protein, 9 aa, Mycobacterium avium
ADPHTAART

SEQ ID NO: 49533 - protein, 7 aa, Mycobacterium avium
ADPLGGA

SEQ ID NO: 49534 - protein, 7 aa, Mycobacterium avium
ADPLTGR

SEQ ID NO: 49535 - protein, 7 aa, Mycobacterium avium
ADPNGLN

SEQ ID NO: 49536 - protein, 9 aa, Mycobacterium avium
ADPNGRTGD

SEQ ID NO: 49537 - protein, 7 aa, Mycobacterium avium
ADPPDGV

SEQ ID NO: 49538 - protein, 18 aa, Mycobacterium avium
ADPPPPEVHEPAAAAVQP

SEQ ID NO: 49539 - protein, 5 aa, Mycobacterium avium
ADPSL

SEQ ID NO: 49540 - protein, 4 aa, Mycobacterium avium
ADPY

SEQ ID NO: 49541 - protein, 5 aa, Mycobacterium avium
ADQEE

SEQ ID NO: 49542 - protein, 12 aa, Mycobacterium avium
ADQPAEHTDSGV

SEQ ID NO: 49543 - protein, 9 aa, Mycobacterium avium
ADQPRDRAE

SEQ ID NO: 49544 - protein, 5 aa, Mycobacterium avium
ADQPY

SEQ ID NO: 49545 - protein, 5 aa, Mycobacterium avium
ADRAA

SEQ ID NO: 49546 - protein, 7 aa, Mycobacterium avium
ADRAEGT

SEQ ID NO: 49547 - protein, 9 aa, Mycobacterium avium
ADRGTGLGK

SEQ ID NO: 49548 - protein, 4 aa, Mycobacterium avium
ADRP

SEQ ID NO: 49549 - protein, 9 aa, Mycobacterium avium
ADRTGTSAL

SEQ ID NO: 49550 - protein, 4 aa, Mycobacterium avium
ADSA

SEQ ID NO: 49551 - protein, 9 aa, Mycobacterium avium
ADSETPLSA

SEQ ID NO: 49552 - protein, 11 aa, Mycobacterium avium
ADSHPDGVTRA

SEQ ID NO: 49553 - protein, 7 aa, Mycobacterium avium
ADSQDAA

SEQ ID NO: 49554 - protein, 5 aa, Mycobacterium avium
ADTER

SEQ ID NO: 49555 - protein, 7 aa, Mycobacterium avium
ADTGSGS

SEQ ID NO: 49556 - protein, 5 aa, Mycobacterium avium
ADTLA

SEQ ID NO: 49557 - protein, 9 aa, Mycobacterium avium
ADTMPEEPF

SEQ ID NO: 49558 - protein, 14 aa, Mycobacterium avium
ADTRTYRDAKSGIE

SEQ ID NO: 49559 - protein, 6 aa, Mycobacterium avium
ADTSPS

SEQ ID NO: 49560 - protein, 9 aa, Mycobacterium avium
ADVRDGQEV

SEQ ID NO: 49561 - protein, 10 aa, Mycobacterium avium
ADWDSTSDTW

SEQ ID NO: 49562 - protein, 10 aa, Mycobacterium avium
ADYRRAEDAG

SEQ ID NO: 49563 - protein, 16 aa, Mycobacterium avium
AEAARPHRVTHRKLTR

SEQ ID NO: 49564 - protein, 11 aa, Mycobacterium avium
AEAARTGIDGS

SEQ ID NO: 49565 - protein, 9 aa, Mycobacterium avium
AEADRREGL

SEQ ID NO: 49566 - protein, 11 aa, Mycobacterium avium
AEADTAGGNRF

SEQ ID NO: 49567 - protein, 7 aa, Mycobacterium avium
AEAEGRF

SEQ ID NO: 49568 - protein, 13 aa, Mycobacterium avium
AEAELRRTRRYEA

SEQ ID NO: 49569 - protein, 20 aa, Mycobacterium avium
AEAEPAGEPDVEEVPDDLTP

SEQ ID NO: 49570 - protein, 7 aa, Mycobacterium avium
AEAEPGR

SEQ ID NO: 49571 - protein, 8 aa, Mycobacterium avium
AEAEQRNL

SEQ ID NO: 49572 - protein, 8 aa, Mycobacterium avium
AEAERGYD

SEQ ID NO: 49573 - protein, 4 aa, Mycobacterium avium
AEAG

SEQ ID NO: 49574 - protein, 6 aa, Mycobacterium avium
AEAHRP

SEQ ID NO: 49575 - protein, 4 aa, Mycobacterium avium
AEAI

SEQ ID NO: 49576 - protein, 6 aa, Mycobacterium avium
AEALGR

SEQ ID NO: 49577 - protein, 16 aa, Mycobacterium avium
AEAMRPASAERADPIA

SEQ ID NO: 49578 - protein, 6 aa, Mycobacterium avium
AEAPED

SEQ ID NO: 49579 - protein, 8 aa, Mycobacterium avium
AEAPTQPL

SEQ ID NO: 49580 - protein, 4 aa, Mycobacterium avium
AEAT

SEQ ID NO: 49581 - protein, 5 aa, Mycobacterium avium
AEATL

SEQ ID NO: 49582 - protein, 16 aa, Mycobacterium avium
AEAVDEAAARAKASFE

SEQ ID NO: 49583 - protein, 10 aa, Mycobacterium avium
AEDATRNGRK

SEQ ID NO: 49584 - protein, 8 aa, Mycobacterium avium
AEDDPDRL

SEQ ID NO: 49585 - protein, 5 aa, Mycobacterium avium
AEDEV

SEQ ID NO: 49586 - protein, 6 aa, Mycobacterium avium
AEDNGF

SEQ ID NO: 49587 - protein, 8 aa, Mycobacterium avium
AEDPARGF

SEQ ID NO: 49588 - protein, 8 aa, Mycobacterium avium
AEDRGGPV

SEQ ID NO: 49589 - protein, 12 aa, Mycobacterium avium
AEDTAGATPERP

SEQ ID NO: 49590 - protein, 6 aa, Mycobacterium avium
AEEAGY

SEQ ID NO: 49591 - protein, 10 aa, Mycobacterium avium
AEEDSTVPVG

SEQ ID NO: 49592 - protein, 16 aa, Mycobacterium avium
AEEERFSRRKHGKPAV

SEQ ID NO: 49593 - protein, 4 aa, Mycobacterium avium
AEEG

SEQ ID NO: 49594 - protein, 17 aa, Mycobacterium avium
AEEGEGAAEALAEADAE

SEQ ID NO: 49595 - protein, 5 aa, Mycobacterium avium
AEEIG

SEQ ID NO: 49596 - protein, 4 aa, Mycobacterium avium
AEEL

SEQ ID NO: 49597 - protein, 8 aa, Mycobacterium avium
AEEPHPVT

SEQ ID NO: 49598 - protein, 4 aa, Mycobacterium avium
AEEQ

SEQ ID NO: 49599 - protein, 7 aa, Mycobacterium avium
AEEQRRG

SEQ ID NO: 49600 - protein, 5 aa, Mycobacterium avium
AEETR

SEQ ID NO: 49601 - protein, 5 aa, Mycobacterium avium
AEEVH

SEQ ID NO: 49602 - protein, 7 aa, Mycobacterium avium
AEGAVGH

SEQ ID NO: 49603 - protein, 13 aa, Mycobacterium avium
AEGDPVGESYRRT

SEQ ID NO: 49604 - protein, 6 aa, Mycobacterium avium
AEGEGT

SEQ ID NO: 49605 - protein, 5 aa, Mycobacterium avium
AEGGA

SEQ ID NO: 49606 - protein, 12 aa, Mycobacterium avium
AEGKATELANRE

SEQ ID NO: 49607 - protein, 10 aa, Mycobacterium avium
AEGKQRPNVF

SEQ ID NO: 49608 - protein, 22 aa, Mycobacterium avium
AEGLRHAGEEAQRSPAATVPAA

SEQ ID NO: 49609 - protein, 11 aa, Mycobacterium avium
AEGRAGVEHTQ

SEQ ID NO: 49610 - protein, 6 aa, Mycobacterium avium
AEGVAG

SEQ ID NO: 49611 - protein, 7 aa, Mycobacterium avium
AEHGARP

SEQ ID NO: 49612 - protein, 6 aa, Mycobacterium avium
AEHQRV

SEQ ID NO: 49613 - protein, 7 aa, Mycobacterium avium
AEHSGAR

SEQ ID NO: 49614 - protein, 4 aa, Mycobacterium avium
AEIE

SEQ ID NO: 49615 - protein, 9 aa, Mycobacterium avium
AEIGEGNKL

SEQ ID NO: 49616 - protein, 5 aa, Mycobacterium avium
AEKEQ

SEQ ID NO: 49617 - protein, 5 aa, Mycobacterium avium
AEKPP

SEQ ID NO: 49618 - protein, 4 aa, Mycobacterium avium
AELD

SEQ ID NO: 49619 - protein, 11 aa, Mycobacterium avium
AELGDKPPPEA

SEQ ID NO: 49620 - protein, 4 aa, Mycobacterium avium
AELP

SEQ ID NO: 49621 - protein, 8 aa, Mycobacterium avium
AELPATAP

SEQ ID NO: 49622 - protein, 7 aa, Mycobacterium avium
AELPDGQ

SEQ ID NO: 49623 - protein, 6 aa, Mycobacterium avium
AELSRQ

SEQ ID NO: 49624 - protein, 11 aa, Mycobacterium avium
AELTPAGKARA

SEQ ID NO: 49625 - protein, 16 aa, Mycobacterium avium
AENERTYGEFSTREGE

SEQ ID NO: 49626 - protein, 6 aa, Mycobacterium avium
AEPARF

SEQ ID NO: 49627 - protein, 7 aa, Mycobacterium avium
AEPATTT

SEQ ID NO: 49628 - protein, 5 aa, Mycobacterium avium
AEPAV

SEQ ID NO: 49629 - protein, 10 aa, Mycobacterium avium
AEPEAGTSGA

SEQ ID NO: 49630 - protein, 5 aa, Mycobacterium avium
AEPGA

SEQ ID NO: 49631 - protein, 5 aa, Mycobacterium avium
AEPGD

SEQ ID NO: 49632 - protein, 8 aa, Mycobacterium avium
AEPGDQQR

SEQ ID NO: 49633 - protein, 6 aa, Mycobacterium avium
AEPGEI

SEQ ID NO: 49634 - protein, 19 aa, Mycobacterium avium
AEPLADRKPRQLSGGQAQR

SEQ ID NO: 49635 - protein, 8 aa, Mycobacterium avium
AEPQLSRT

SEQ ID NO: 49636 - protein, 7 aa, Mycobacterium avium
AEPRRRK

SEQ ID NO: 49637 - protein, 13 aa, Mycobacterium avium
AEQAARQDSAEQA

SEQ ID NO: 49638 - protein, 8 aa, Mycobacterium avium
AEQEPSGA

SEQ ID NO: 49639 - protein, 5 aa, Mycobacterium avium
AEQFA

SEQ ID NO: 49640 - protein, 7 aa, Mycobacterium avium
AEQHGPE

SEQ ID NO: 49641 - protein, 4 aa, Mycobacterium avium
AEQK

SEQ ID NO: 49642 - protein, 36 aa, Mycobacterium avium
AEQKQRQQQAAAQPSAAPAPAAAEARKPAAPTPAPA

SEQ ID NO: 49643 - protein, 7 aa, Mycobacterium avium
AEQLGNA

SEQ ID NO: 49644 - protein, 9 aa, Mycobacterium avium
AEQSNNISR

SEQ ID NO: 49645 - protein, 11 aa, Mycobacterium avium
AERAANEQGEQ

SEQ ID NO: 49646 - protein, 10 aa, Mycobacterium avium
AERAGEPRPR

SEQ ID NO: 49647 - protein, 9 aa, Mycobacterium avium
AERAGVAEP

SEQ ID NO: 49648 - protein, 28 aa, Mycobacterium avium
AERASVGDEELAASADAALRAEQAAERR

SEQ ID NO: 49649 - protein, 11 aa, Mycobacterium avium
AERAYAAREAE

SEQ ID NO: 49650 - protein, 6 aa, Mycobacterium avium
AERGAT

SEQ ID NO: 49651 - protein, 13 aa, Mycobacterium avium
AERGGSGSTETLT

SEQ ID NO: 49652 - protein, 7 aa, Mycobacterium avium
AERGGTV

SEQ ID NO: 49653 - protein, 6 aa, Mycobacterium avium
AERGVR

SEQ ID NO: 49654 - protein, 4 aa, Mycobacterium avium
AERH

SEQ ID NO: 49655 - protein, 8 aa, Mycobacterium avium
AERPDDAV

SEQ ID NO: 49656 - protein, 8 aa, Mycobacterium avium
AERQPDAP

SEQ ID NO: 49657 - protein, 9 aa, Mycobacterium avium
AERQQRATA

SEQ ID NO: 49658 - protein, 10 aa, Mycobacterium avium
AERSAGAHPY

SEQ ID NO: 49659 - protein, 14 aa, Mycobacterium avium
AERSGELDPSFADG

SEQ ID NO: 49660 - protein, 16 aa, Mycobacterium avium
AERTQEQQRLAEAERG

SEQ ID NO: 49661 - protein, 5 aa, Mycobacterium avium
AESEP

SEQ ID NO: 49662 - protein, 6 aa, Mycobacterium avium
AESGTP

SEQ ID NO: 49663 - protein, 10 aa, Mycobacterium avium
AESPGEGGGG

SEQ ID NO: 49664 - protein, 4 aa, Mycobacterium avium
AESQ

SEQ ID NO: 49665 - protein, 6 aa, Mycobacterium avium
AESQGA

SEQ ID NO: 49666 - protein, 16 aa, Mycobacterium avium
AETAGQKKTLDTNWRS

SEQ ID NO: 49667 - protein, 7 aa, Mycobacterium avium
AETAKEA

SEQ ID NO: 49668 - protein, 4 aa, Mycobacterium avium
AETC

SEQ ID NO: 49669 - protein, 5 aa, Mycobacterium avium
AETDE

SEQ ID NO: 49670 - protein, 8 aa, Mycobacterium avium
AETDTVPA

SEQ ID NO: 49671 - protein, 11 aa, Mycobacterium avium
AETGAGQHGVA

SEQ ID NO: 49672 - protein, 8 aa, Mycobacterium avium
AETGDANG

SEQ ID NO: 49673 - protein, 6 aa, Mycobacterium avium
AETGLH

SEQ ID NO: 49674 - protein, 4 aa, Mycobacterium avium
AETS

SEQ ID NO: 49675 - protein, 9 aa, Mycobacterium avium
AEVSAERPG

SEQ ID NO: 49676 - protein, 12 aa, Mycobacterium avium
AEYDGDQHRASR

SEQ ID NO: 49677 - protein, 7 aa, Mycobacterium avium
AFDGTGW

SEQ ID NO: 49678 - protein, 8 aa, Mycobacterium avium
AFDSGPWG

SEQ ID NO: 49679 - protein, 6 aa, Mycobacterium avium
AFGDSY

SEQ ID NO: 49680 - protein, 7 aa, Mycobacterium avium
AFGGGNN

SEQ ID NO: 49681 - protein, 17 aa, Mycobacterium avium
AFPGSASDNHHHGESET

SEQ ID NO: 49682 - protein, 5 aa, Mycobacterium avium
AFSAG

SEQ ID NO: 49683 - protein, 10 aa, Mycobacterium avium
AGAAAGLAGL

SEQ ID NO: 49684 - protein, 8 aa, Mycobacterium avium
AGAADETV

SEQ ID NO: 49685 - protein, 5 aa, Mycobacterium avium
AGAAG

SEQ ID NO: 49686 - protein, 6 aa, Mycobacterium avium
AGAAMA

SEQ ID NO: 49687 - protein, 52 aa, Mycobacterium avium
AGADPDETHGPAPGPAATPSPAPSASPSPAASPSPSASPAPAPAAPKTTIDK

SEQ ID NO: 49688 - protein, 5 aa, Mycobacterium avium
AGADR

SEQ ID NO: 49689 - protein, 5 aa, Mycobacterium avium
AGADV

SEQ ID NO: 49690 - protein, 12 aa, Mycobacterium avium
AGAENPDPGRYS

SEQ ID NO: 49691 - protein, 9 aa, Mycobacterium avium
AGAETLSEA

SEQ ID NO: 49692 - protein, 9 aa, Mycobacterium avium
AGAGGGDGG

SEQ ID NO: 49693 - protein, 9 aa, Mycobacterium avium
AGAGGTSWS

SEQ ID NO: 49694 - protein, 8 aa, Mycobacterium avium
AGAGPGQT

SEQ ID NO: 49695 - protein, 7 aa, Mycobacterium avium
AGAGRRG

SEQ ID NO: 49696 - protein, 11 aa, Mycobacterium avium
AGAGTDDAESI

SEQ ID NO: 49697 - protein, 5 aa, Mycobacterium avium
AGAIN

SEQ ID NO: 49698 - protein, 10 aa, Mycobacterium avium
AGAPEEAPAA

SEQ ID NO: 49699 - protein, 23 aa, Mycobacterium avium
AGAPFGAGLGQSGDLDPGRAMAG

SEQ ID NO: 49700 - protein, 18 aa, Mycobacterium avium
AGAPLAESDQVAPPASAP

SEQ ID NO: 49701 - protein, 8 aa, Mycobacterium avium
AGAPPADL

SEQ ID NO: 49702 - protein, 5 aa, Mycobacterium avium
AGAPS

SEQ ID NO: 49703 - protein, 9 aa, Mycobacterium avium
AGAPSLLPG

SEQ ID NO: 49704 - protein, 9 aa, Mycobacterium avium
AGARPSALA

SEQ ID NO: 49705 - protein, 13 aa, Mycobacterium avium
AGARSGDKGGSAN

SEQ ID NO: 49706 - protein, 5 aa, Mycobacterium avium
AGATG

SEQ ID NO: 49707 - protein, 11 aa, Mycobacterium avium
AGDAEAVAERR

SEQ ID NO: 49708 - protein, 10 aa, Mycobacterium avium
AGDDPEAGAD

SEQ ID NO: 49709 - protein, 5 aa, Mycobacterium avium
AGDDV

SEQ ID NO: 49710 - protein, 9 aa, Mycobacterium avium
AGDEGDRLD

SEQ ID NO: 49711 - protein, 8 aa, Mycobacterium avium
AGDESLDQ

SEQ ID NO: 49712 - protein, 7 aa, Mycobacterium avium
AGDGSTR

SEQ ID NO: 49713 - protein, 19 aa, Mycobacterium avium
AGDLAKGHPHAQERDNALS

SEQ ID NO: 49714 - protein, 13 aa, Mycobacterium avium
AGDLSEAGSRSEM

SEQ ID NO: 49715 - protein, 7 aa, Mycobacterium avium
AGDPALG

SEQ ID NO: 49716 - protein, 10 aa, Mycobacterium avium
AGDPSNAADT

SEQ ID NO: 49717 - protein, 5 aa, Mycobacterium avium
AGDRF

SEQ ID NO: 49718 - protein, 15 aa, Mycobacterium avium
AGDSPLAADAVTASP

SEQ ID NO: 49719 - protein, 5 aa, Mycobacterium avium
AGDSR

SEQ ID NO: 49720 - protein, 7 aa, Mycobacterium avium
AGDTAAG

SEQ ID NO: 49721 - protein, 6 aa, Mycobacterium avium
AGDTDE

SEQ ID NO: 49722 - protein, 22 aa, Mycobacterium avium
AGDTDPEPAPAEQLTDDAGGDE

SEQ ID NO: 49723 - protein, 8 aa, Mycobacterium avium
AGDTITGA

SEQ ID NO: 49724 - protein, 4 aa, Mycobacterium avium
AGDV

SEQ ID NO: 49725 - protein, 9 aa, Mycobacterium avium
AGEAAARNQ

SEQ ID NO: 49726 - protein, 5 aa, Mycobacterium avium
AGEAT

SEQ ID NO: 49727 - protein, 7 aa, Mycobacterium avium
AGEFDPE

SEQ ID NO: 49728 - protein, 4 aa, Mycobacterium avium
AGEG

SEQ ID NO: 49729 - protein, 5 aa, Mycobacterium avium
AGEGD

SEQ ID NO: 49730 - protein, 6 aa, Mycobacterium avium
AGEGKL

SEQ ID NO: 49731 - protein, 5 aa, Mycobacterium avium
AGEGP

SEQ ID NO: 49732 - protein, 6 aa, Mycobacterium avium
AGELAS

SEQ ID NO: 49733 - protein, 15 aa, Mycobacterium avium
AGENADGPAASVIAR

SEQ ID NO: 49734 - protein, 4 aa, Mycobacterium avium
AGEP

SEQ ID NO: 49735 - protein, 11 aa, Mycobacterium avium
AGEPDTPIDDE

SEQ ID NO: 49736 - protein, 7 aa, Mycobacterium avium
AGEPGTA

SEQ ID NO: 49737 - protein, 28 aa, Mycobacterium avium
AGEPQASGKTYKVNGTLKQGISSENAKK

SEQ ID NO: 49738 - protein, 28 aa, Mycobacterium avium
AGEQAAKAERESAKSAADAKSAAEQAAA

SEQ ID NO: 49739 - protein, 8 aa, Mycobacterium avium
AGEQATAT

SEQ ID NO: 49740 - protein, 5 aa, Mycobacterium avium
AGEQQ

SEQ ID NO: 49741 - protein, 18 aa, Mycobacterium avium
AGEQRRTAAATIQRYLGL

SEQ ID NO: 49742 - protein, 7 aa, Mycobacterium avium
AGERGTD

SEQ ID NO: 49743 - protein, 7 aa, Mycobacterium avium
AGERSGR

SEQ ID NO: 49744 - protein, 4 aa, Mycobacterium avium
AGES

SEQ ID NO: 49745 - protein, 8 aa, Mycobacterium avium
AGESTASL

SEQ ID NO: 49746 - protein, 4 aa, Mycobacterium avium
AGET

SEQ ID NO: 49747 - protein, 10 aa, Mycobacterium avium
AGETASRIGE

SEQ ID NO: 49748 - protein, 6 aa, Mycobacterium avium
AGETGF

SEQ ID NO: 49749 - protein, 17 aa, Mycobacterium avium
AGEYRDHEATAPWTRPE

SEQ ID NO: 49750 - protein, 6 aa, Mycobacterium avium
AGFGSS

SEQ ID NO: 49751 - protein, 14 aa, Mycobacterium avium
AGFNRNAPGDPARA

SEQ ID NO: 49752 - protein, 9 aa, Mycobacterium avium
AGGAGSGPL

SEQ ID NO: 49753 - protein, 9 aa, Mycobacterium avium
AGGAGTASW

SEQ ID NO: 49754 - protein, 6 aa, Mycobacterium avium
AGGANL

SEQ ID NO: 49755 - protein, 9 aa, Mycobacterium avium
AGGAPSPTY

SEQ ID NO: 49756 - protein, 6 aa, Mycobacterium avium
AGGATD

SEQ ID NO: 49757 - protein, 7 aa, Mycobacterium avium
AGGAWSQ

SEQ ID NO: 49758 - protein, 6 aa, Mycobacterium avium
AGGDEV

SEQ ID NO: 49759 - protein, 7 aa, Mycobacterium avium
AGGDPWS

SEQ ID NO: 49760 - protein, 5 aa, Mycobacterium avium
AGGDR

SEQ ID NO: 49761 - protein, 15 aa, Mycobacterium avium
AGGDTTLDDLDGSDP

SEQ ID NO: 49762 - protein, 8 aa, Mycobacterium avium
AGGEGPAT

SEQ ID NO: 49763 - protein, 4 aa, Mycobacterium avium
AGGF

SEQ ID NO: 49764 - protein, 11 aa, Mycobacterium avium
AGGFDPAAAGI

SEQ ID NO: 49765 - protein, 15 aa, Mycobacterium avium
AGGGAGTGPGLPPAG

SEQ ID NO: 49766 - protein, 8 aa, Mycobacterium avium
AGGGALGY

SEQ ID NO: 49767 - protein, 9 aa, Mycobacterium avium
AGGGATPAD

SEQ ID NO: 49768 - protein, 10 aa, Mycobacterium avium
AGGGGLTPSD

SEQ ID NO: 49769 - protein, 4 aa, Mycobacterium avium
AGGL

SEQ ID NO: 49770 - protein, 5 aa, Mycobacterium avium
AGGLD

SEQ ID NO: 49771 - protein, 10 aa, Mycobacterium avium
AGGMASADDY

SEQ ID NO: 49772 - protein, 4 aa, Mycobacterium avium
AGGP

SEQ ID NO: 49773 - protein, 7 aa, Mycobacterium avium
AGGPGTE

SEQ ID NO: 49774 - protein, 19 aa, Mycobacterium avium
AGGPVGAPLANTGAGERRW

SEQ ID NO: 49775 - protein, 7 aa, Mycobacterium avium
AGGQSQF

SEQ ID NO: 49776 - protein, 8 aa, Mycobacterium avium
AGGTREPV

SEQ ID NO: 49777 - protein, 12 aa, Mycobacterium avium
AGGTVPAPHAET

SEQ ID NO: 49778 - protein, 7 aa, Mycobacterium avium
AGGTVSE

SEQ ID NO: 49779 - protein, 19 aa, Mycobacterium avium
AGGVDPDAATDAAAAEAHR

SEQ ID NO: 49780 - protein, 7 aa, Mycobacterium avium
AGGVEPS

SEQ ID NO: 49781 - protein, 6 aa, Mycobacterium avium
AGGYTR

SEQ ID NO: 49782 - protein, 7 aa, Mycobacterium avium
AGHDPRR

SEQ ID NO: 49783 - protein, 25 aa, Mycobacterium avium
AGHSGPNLAAKGPVGAGARRAPPQI

SEQ ID NO: 49784 - protein, 10 aa, Mycobacterium avium
AGIDPSYQQH

SEQ ID NO: 49785 - protein, 6 aa, Mycobacterium avium
AGIEPE

SEQ ID NO: 49786 - protein, 10 aa, Mycobacterium avium
AGIQRAKRTR

SEQ ID NO: 49787 - protein, 6 aa, Mycobacterium avium
AGISSG

SEQ ID NO: 49788 - protein, 8 aa, Mycobacterium avium
AGKPPEEW

SEQ ID NO: 49789 - protein, 14 aa, Mycobacterium avium
AGKTDTPAAHPNSR

SEQ ID NO: 49790 - protein, 20 aa, Mycobacterium avium
AGLAEQTAAQARAAAAAYES

SEQ ID NO: 49791 - protein, 8 aa, Mycobacterium avium
AGLAGGPN

SEQ ID NO: 49792 - protein, 21 aa, Mycobacterium avium
AGLAGTSRGDGGHGSSGGHAS

SEQ ID NO: 49793 - protein, 8 aa, Mycobacterium avium
AGLAPADC

SEQ ID NO: 49794 - protein, 12 aa, Mycobacterium avium
AGLDNETYLVAH

SEQ ID NO: 49795 - protein, 7 aa, Mycobacterium avium
AGLDVSD

SEQ ID NO: 49796 - protein, 8 aa, Mycobacterium avium
AGLGGQTP

SEQ ID NO: 49797 - protein, 9 aa, Mycobacterium avium
AGLGPGDRV

SEQ ID NO: 49798 - protein, 11 aa, Mycobacterium avium
AGLGTDPAHAG

SEQ ID NO: 49799 - protein, 6 aa, Mycobacterium avium
AGLNGD

SEQ ID NO: 49800 - protein, 7 aa, Mycobacterium avium
AGLPGPS

SEQ ID NO: 49801 - protein, 7 aa, Mycobacterium avium
AGLPPGN

SEQ ID NO: 49802 - protein, 7 aa, Mycobacterium avium
AGLPPLR

SEQ ID NO: 49803 - protein, 7 aa, Mycobacterium avium
AGLPSPG

SEQ ID NO: 49804 - protein, 6 aa, Mycobacterium avium
AGLRPQ

SEQ ID NO: 49805 - protein, 6 aa, Mycobacterium avium
AGLSPD

SEQ ID NO: 49806 - protein, 7 aa, Mycobacterium avium
AGLSPDD

SEQ ID NO: 49807 - protein, 5 aa, Mycobacterium avium
AGMDQ

SEQ ID NO: 49808 - protein, 7 aa, Mycobacterium avium
AGNAEEL

SEQ ID NO: 49809 - protein, 6 aa, Mycobacterium avium
AGNDNR

SEQ ID NO: 49810 - protein, 7 aa, Mycobacterium avium
AGNLPGR

SEQ ID NO: 49811 - protein, 8 aa, Mycobacterium avium
AGNPNWSA

SEQ ID NO: 49812 - protein, 6 aa, Mycobacterium avium
AGNSAA

SEQ ID NO: 49813 - protein, 6 aa, Mycobacterium avium
AGPADV

SEQ ID NO: 49814 - protein, 6 aa, Mycobacterium avium
AGPAGR

SEQ ID NO: 49815 - protein, 10 aa, Mycobacterium avium
AGPAGSAAAA

SEQ ID NO: 49816 - protein, 10 aa, Mycobacterium avium
AGPAGSPGKL

SEQ ID NO: 49817 - protein, 16 aa, Mycobacterium avium
AGPAKIPAPGPGPGQT

SEQ ID NO: 49818 - protein, 16 aa, Mycobacterium avium
AGPALSAEAEQGGLAG

SEQ ID NO: 49819 - protein, 7 aa, Mycobacterium avium
AGPARVL

SEQ ID NO: 49820 - protein, 7 aa, Mycobacterium avium
AGPASGP

SEQ ID NO: 49821 - protein, 12 aa, Mycobacterium avium
AGPDGQSLPADT

SEQ ID NO: 49822 - protein, 18 aa, Mycobacterium avium
AGPDGVRRSQADHTYGYP

SEQ ID NO: 49823 - protein, 5 aa, Mycobacterium avium
AGPDV

SEQ ID NO: 49824 - protein, 9 aa, Mycobacterium avium
AGPEAQEEL

SEQ ID NO: 49825 - protein, 6 aa, Mycobacterium avium
AGPELE

SEQ ID NO: 49826 - protein, 7 aa, Mycobacterium avium
AGPFPPT

SEQ ID NO: 49827 - protein, 5 aa, Mycobacterium avium
AGPGD

SEQ ID NO: 49828 - protein, 7 aa, Mycobacterium avium
AGPGDGF

SEQ ID NO: 49829 - protein, 6 aa, Mycobacterium avium
AGPGER

SEQ ID NO: 49830 - protein, 6 aa, Mycobacterium avium
AGPGGL

SEQ ID NO: 49831 - protein, 6 aa, Mycobacterium avium
AGPGGY

SEQ ID NO: 49832 - protein, 8 aa, Mycobacterium avium
AGPGPALA

SEQ ID NO: 49833 - protein, 15 aa, Mycobacterium avium
AGPGSDLGTGGMTSK

SEQ ID NO: 49834 - protein, 7 aa, Mycobacterium avium
AGPIGTG

SEQ ID NO: 49835 - protein, 4 aa, Mycobacterium avium
AGPK

SEQ ID NO: 49836 - protein, 4 aa, Mycobacterium avium
AGPL

SEQ ID NO: 49837 - protein, 5 aa, Mycobacterium avium
AGPNY

SEQ ID NO: 49838 - protein, 6 aa, Mycobacterium avium
AGPNYE

SEQ ID NO: 49839 - protein, 23 aa, Mycobacterium avium
AGPPEGRRAAEAADDSDDNATRR

SEQ ID NO: 49840 - protein, 8 aa, Mycobacterium avium
AGPPENHG

SEQ ID NO: 49841 - protein, 5 aa, Mycobacterium avium
AGPPL

SEQ ID NO: 49842 - protein, 6 aa, Mycobacterium avium
AGPPPC

SEQ ID NO: 49843 - protein, 19 aa, Mycobacterium avium
AGPPTSVASRRSIDRARVL

SEQ ID NO: 49844 - protein, 20 aa, Mycobacterium avium
AGPPVPAPDLDPAVPLPGYL

SEQ ID NO: 49845 - protein, 7 aa, Mycobacterium avium
AGPTAAL

SEQ ID NO: 49846 - protein, 7 aa, Mycobacterium avium
AGPVDTG

SEQ ID NO: 49847 - protein, 9 aa, Mycobacterium avium
AGQADPGEI

SEQ ID NO: 49848 - protein, 10 aa, Mycobacterium avium
AGQAERAPGT

SEQ ID NO: 49849 - protein, 9 aa, Mycobacterium avium
AGQAGVDVE

SEQ ID NO: 49850 - protein, 6 aa, Mycobacterium avium
AGQANE

SEQ ID NO: 49851 - protein, 11 aa, Mycobacterium avium
AGQDTGPAAGL

SEQ ID NO: 49852 - protein, 5 aa, Mycobacterium avium
AGQKG

SEQ ID NO: 49853 - protein, 7 aa, Mycobacterium avium
AGQPLAE

SEQ ID NO: 49854 - protein, 7 aa, Mycobacterium avium
AGQRAEA

SEQ ID NO: 49855 - protein, 5 aa, Mycobacterium avium
AGQRS

SEQ ID NO: 49856 - protein, 14 aa, Mycobacterium avium
AGQSASASKVTPFQ

SEQ ID NO: 49857 - protein, 9 aa, Mycobacterium avium
AGRAAPRLG

SEQ ID NO: 49858 - protein, 6 aa, Mycobacterium avium
AGRAEW

SEQ ID NO: 49859 - protein, 6 aa, Mycobacterium avium
AGRDHS

SEQ ID NO: 49860 - protein, 6 aa, Mycobacterium avium
AGRDTG

SEQ ID NO: 49861 - protein, 10 aa, Mycobacterium avium
AGREASASNM

SEQ ID NO: 49862 - protein, 8 aa, Mycobacterium avium
AGREEADR

SEQ ID NO: 49863 - protein, 9 aa, Mycobacterium avium
AGREQATGY

SEQ ID NO: 49864 - protein, 7 aa, Mycobacterium avium
AGRGATR

SEQ ID NO: 49865 - protein, 6 aa, Mycobacterium avium
AGRGKA

SEQ ID NO: 49866 - protein, 5 aa, Mycobacterium avium
AGRGL

SEQ ID NO: 49867 - protein, 6 aa, Mycobacterium avium
AGRGTR

SEQ ID NO: 49868 - protein, 5 aa, Mycobacterium avium
AGRKD

SEQ ID NO: 49869 - protein, 9 aa, Mycobacterium avium
AGRKRTGGM

SEQ ID NO: 49870 - protein, 8 aa, Mycobacterium avium
AGRPGRNL

SEQ ID NO: 49871 - protein, 7 aa, Mycobacterium avium
AGRPIPG

SEQ ID NO: 49872 - protein, 7 aa, Mycobacterium avium
AGRPPDW

SEQ ID NO: 49873 - protein, 8 aa, Mycobacterium avium
AGRPPYTP

SEQ ID NO: 49874 - protein, 8 aa, Mycobacterium avium
AGRQGQTD

SEQ ID NO: 49875 - protein, 6 aa, Mycobacterium avium
AGRRGA

SEQ ID NO: 49876 - protein, 9 aa, Mycobacterium avium
AGRRGGDVN

SEQ ID NO: 49877 - protein, 18 aa, Mycobacterium avium
AGRSEGVDLDDKGREQAA

SEQ ID NO: 49878 - protein, 5 aa, Mycobacterium avium
AGRSL

SEQ ID NO: 49879 - protein, 13 aa, Mycobacterium avium
AGRSRPGERVQAG

SEQ ID NO: 49880 - protein, 6 aa, Mycobacterium avium
AGRVSR

SEQ ID NO: 49881 - protein, 4 aa, Mycobacterium avium
AGRW

SEQ ID NO: 49882 - protein, 6 aa, Mycobacterium avium
AGRYSE

SEQ ID NO: 49883 - protein, 9 aa, Mycobacterium avium
AGSAASAAN

SEQ ID NO: 49884 - protein, 8 aa, Mycobacterium avium
AGSALGDD

SEQ ID NO: 49885 - protein, 10 aa, Mycobacterium avium
AGSEEDETAW

SEQ ID NO: 49886 - protein, 24 aa, Mycobacterium avium
AGSGDRAVAAAAERAKLTAGRNIP

SEQ ID NO: 49887 - protein, 8 aa, Mycobacterium avium
AGSGKTAV

SEQ ID NO: 49888 - protein, 10 aa, Mycobacterium avium
AGSGTDRDAA

SEQ ID NO: 49889 - protein, 15 aa, Mycobacterium avium
AGSKEPGPAARRDRW

SEQ ID NO: 49890 - protein, 14 aa, Mycobacterium avium
AGSPATASYTNHGP

SEQ ID NO: 49891 - protein, 10 aa, Mycobacterium avium
AGSPDGGDGH

SEQ ID NO: 49892 - protein, 7 aa, Mycobacterium avium
AGSPQGL

SEQ ID NO: 49893 - protein, 9 aa, Mycobacterium avium
AGSPSGSGW

SEQ ID NO: 49894 - protein, 4 aa, Mycobacterium avium
AGSR

SEQ ID NO: 49895 - protein, 85 aa, Mycobacterium avium
AGSSTQAASDEDESAAEEAGDELERKKAARAEELEAAEDTEDLEDTEDDDEDSDDSDDSDDEDLDDEDIDDEEDLGDDDEDLELD

SEQ ID NO: 49896 - protein, 10 aa, Mycobacterium avium
AGSSTVPGVG

SEQ ID NO: 49897 - protein, 7 aa, Mycobacterium avium
AGSTSTI

SEQ ID NO: 49898 - protein, 7 aa, Mycobacterium avium
AGSVPDE

SEQ ID NO: 49899 - protein, 4 aa, Mycobacterium avium
AGSW

SEQ ID NO: 49900 - protein, 6 aa, Mycobacterium avium
AGTAGS

SEQ ID NO: 49901 - protein, 12 aa, Mycobacterium avium
AGTAPRALNGTP

SEQ ID NO: 49902 - protein, 14 aa, Mycobacterium avium
AGTAPSAPAQATGL

SEQ ID NO: 49903 - protein, 6 aa, Mycobacterium avium
AGTAPW

SEQ ID NO: 49904 - protein, 9 aa, Mycobacterium avium
AGTDPRSYY

SEQ ID NO: 49905 - protein, 8 aa, Mycobacterium avium
AGTDTGPI

SEQ ID NO: 49906 - protein, 6 aa, Mycobacterium avium
AGTDVQ

SEQ ID NO: 49907 - protein, 8 aa, Mycobacterium avium
AGTEPAPL

SEQ ID NO: 49908 - protein, 8 aa, Mycobacterium avium
AGTGAAAD

SEQ ID NO: 49909 - protein, 9 aa, Mycobacterium avium
AGTGGQARR

SEQ ID NO: 49910 - protein, 17 aa, Mycobacterium avium
AGTGIGSATAKRALAEG

SEQ ID NO: 49911 - protein, 6 aa, Mycobacterium avium
AGTLST

SEQ ID NO: 49912 - protein, 11 aa, Mycobacterium avium
AGTMDTEDGPH

SEQ ID NO: 49913 - protein, 8 aa, Mycobacterium avium
AGTNPAYG

SEQ ID NO: 49914 - protein, 6 aa, Mycobacterium avium
AGTPDA

SEQ ID NO: 49915 - protein, 7 aa, Mycobacterium avium
AGTPDLT

SEQ ID NO: 49916 - protein, 8 aa, Mycobacterium avium
AGTPLTPA

SEQ ID NO: 49917 - protein, 10 aa, Mycobacterium avium
AGTSFATPDK

SEQ ID NO: 49918 - protein, 18 aa, Mycobacterium avium
AGTSGAKGVRNAEPSDIA

SEQ ID NO: 49919 - protein, 4 aa, Mycobacterium avium
AGTT

SEQ ID NO: 49920 - protein, 26 aa, Mycobacterium avium
AGTTGGLPGFGDSLDNEGDTRSGALP

SEQ ID NO: 49921 - protein, 11 aa, Mycobacterium avium
AGTTLARSAAG

SEQ ID NO: 49922 - protein, 6 aa, Mycobacterium avium
AGTTTR

SEQ ID NO: 49923 - protein, 9 aa, Mycobacterium avium
AGTVTGPPL

SEQ ID NO: 49924 - protein, 8 aa, Mycobacterium avium
AGTYPPAE

SEQ ID NO: 49925 - protein, 11 aa, Mycobacterium avium
AGTYRTDGKSG

SEQ ID NO: 49926 - protein, 4 aa, Mycobacterium avium
AGVG

SEQ ID NO: 49927 - protein, 25 aa, Mycobacterium avium
AGVGARAGALKGGVGTASRSLPSGV

SEQ ID NO: 49928 - protein, 5 aa, Mycobacterium avium
AGVGV

SEQ ID NO: 49929 - protein, 16 aa, Mycobacterium avium
AGVPAAPLSAADADLG

SEQ ID NO: 49930 - protein, 6 aa, Mycobacterium avium
AGVQTT

SEQ ID NO: 49931 - protein, 17 aa, Mycobacterium avium
AGVQVGAKDAKMGQEGA

SEQ ID NO: 49932 - protein, 17 aa, Mycobacterium avium
AGVRGGSRNEGVDPKIT

SEQ ID NO: 49933 - protein, 8 aa, Mycobacterium avium
AGVRGRPE

SEQ ID NO: 49934 - protein, 6 aa, Mycobacterium avium
AGVRPG

SEQ ID NO: 49935 - protein, 7 aa, Mycobacterium avium
AGVSDDT

SEQ ID NO: 49936 - protein, 9 aa, Mycobacterium avium
AGVTTYSTD

SEQ ID NO: 49937 - protein, 18 aa, Mycobacterium avium
AGYANSAPVEEVSDDDFR

SEQ ID NO: 49938 - protein, 9 aa, Mycobacterium avium
AGYPLGPAN

SEQ ID NO: 49939 - protein, 8 aa, Mycobacterium avium
AHADAADG

SEQ ID NO: 49940 - protein, 6 aa, Mycobacterium avium
AHADPA

SEQ ID NO: 49941 - protein, 6 aa, Mycobacterium avium
AHAEAA

SEQ ID NO: 49942 - protein, 5 aa, Mycobacterium avium
AHASE

SEQ ID NO: 49943 - protein, 5 aa, Mycobacterium avium
AHASS

SEQ ID NO: 49944 - protein, 10 aa, Mycobacterium avium
AHDGPAPTVE

SEQ ID NO: 49945 - protein, 9 aa, Mycobacterium avium
AHGAAQGHE

SEQ ID NO: 49946 - protein, 8 aa, Mycobacterium avium
AHGMDSAT

SEQ ID NO: 49947 - protein, 17 aa, Mycobacterium avium
AHGRLAKAGNETADSVS

SEQ ID NO: 49948 - protein, 4 aa, Mycobacterium avium
AHKE

SEQ ID NO: 49949 - protein, 7 aa, Mycobacterium avium
AHLQPGQ

SEQ ID NO: 49950 - protein, 4 aa, Mycobacterium avium
AHNA

SEQ ID NO: 49951 - protein, 4 aa, Mycobacterium avium
AHPA

SEQ ID NO: 49952 - protein, 11 aa, Mycobacterium avium
AHPESTAELAG

SEQ ID NO: 49953 - protein, 4 aa, Mycobacterium avium
AHPG

SEQ ID NO: 49954 - protein, 6 aa, Mycobacterium avium
AHPGDS

SEQ ID NO: 49955 - protein, 8 aa, Mycobacterium avium
AHPRAERR

SEQ ID NO: 49956 - protein, 8 aa, Mycobacterium avium
AHRRPHGH

SEQ ID NO: 49957 - protein, 6 aa, Mycobacterium avium
AHSAYS

SEQ ID NO: 49958 - protein, 7 aa, Mycobacterium avium
AHSTQGS

SEQ ID NO: 49959 - protein, 9 aa, Mycobacterium avium
AHTDGGTGL

SEQ ID NO: 49960 - protein, 9 aa, Mycobacterium avium
AHTRAGQPL

SEQ ID NO: 49961 - protein, 7 aa, Mycobacterium avium
AIADEAR

SEQ ID NO: 49962 - protein, 9 aa, Mycobacterium avium
AIAETENEY

SEQ ID NO: 49963 - protein, 11 aa, Mycobacterium avium
AIATERAGKPV

SEQ ID NO: 49964 - protein, 11 aa, Mycobacterium avium
AIDETERRRAK

SEQ ID NO: 49965 - protein, 4 aa, Mycobacterium avium
AIDP

SEQ ID NO: 49966 - protein, 5 aa, Mycobacterium avium
AIEPR

SEQ ID NO: 49967 - protein, 8 aa, Mycobacterium avium
AIGSGGPS

SEQ ID NO: 49968 - protein, 5 aa, Mycobacterium avium
AIPDD

SEQ ID NO: 49969 - protein, 6 aa, Mycobacterium avium
AIPGDG

SEQ ID NO: 49970 - protein, 9 aa, Mycobacterium avium
AIPQGRSSY

SEQ ID NO: 49971 - protein, 14 aa, Mycobacterium avium
AIRPAGETFATPDA

SEQ ID NO: 49972 - protein, 9 aa, Mycobacterium avium
AISAGDQSI

SEQ ID NO: 49973 - protein, 10 aa, Mycobacterium avium
AISPGGRTRM

SEQ ID NO: 49974 - protein, 9 aa, Mycobacterium avium
AITGSESDQ

SEQ ID NO: 49975 - protein, 18 aa, Mycobacterium avium
AITTRPPSEPPALGADNG

SEQ ID NO: 49976 - protein, 6 aa, Mycobacterium avium
AKATRE

SEQ ID NO: 49977 - protein, 10 aa, Mycobacterium avium
AKAVADKATR

SEQ ID NO: 49978 - protein, 7 aa, Mycobacterium avium
AKDRREH

SEQ ID NO: 49979 - protein, 14 aa, Mycobacterium avium
AKDVGKRAERATAE

SEQ ID NO: 49980 - protein, 7 aa, Mycobacterium avium
AKEALAD

SEQ ID NO: 49981 - protein, 8 aa, Mycobacterium avium
AKEPFTST

SEQ ID NO: 49982 - protein, 22 aa, Mycobacterium avium
AKEPGGEKAAAKRDKKGIPSAR

SEQ ID NO: 49983 - protein, 5 aa, Mycobacterium avium
AKEQD

SEQ ID NO: 49984 - protein, 10 aa, Mycobacterium avium
AKFPGLTASQ

SEQ ID NO: 49985 - protein, 16 aa, Mycobacterium avium
AKGAPREGFPAGTPFA

SEQ ID NO: 49986 - protein, 7 aa, Mycobacterium avium
AKGGTSF

SEQ ID NO: 49987 - protein, 15 aa, Mycobacterium avium
AKGPQDYANIPPTRF

SEQ ID NO: 49988 - protein, 5 aa, Mycobacterium avium
AKGSI

SEQ ID NO: 49989 - protein, 5 aa, Mycobacterium avium
AKGVG

SEQ ID NO: 49990 - protein, 15 aa, Mycobacterium avium
AKGYRNPVDPDPFAD

SEQ ID NO: 49991 - protein, 6 aa, Mycobacterium avium
AKKNAI

SEQ ID NO: 49992 - protein, 10 aa, Mycobacterium avium
AKKTGAKVTD

SEQ ID NO: 49993 - protein, 8 aa, Mycobacterium avium
AKLEADDA

SEQ ID NO: 49994 - protein, 8 aa, Mycobacterium avium
AKLEERRD

SEQ ID NO: 49995 - protein, 6 aa, Mycobacterium avium
AKLTNT

SEQ ID NO: 49996 - protein, 5 aa, Mycobacterium avium
AKNHT

SEQ ID NO: 49997 - protein, 6 aa, Mycobacterium avium
AKPAAV

SEQ ID NO: 49998 - protein, 8 aa, Mycobacterium avium
AKPAEPVK

SEQ ID NO: 49999 - protein, 13 aa, Mycobacterium avium
AKPAGLPDSPDLE

SEQ ID NO: 50000 - protein, 9 aa, Mycobacterium avium
AKPPPAGSP

SEQ ID NO: 50001 - protein, 4 aa, Mycobacterium avium
AKPQ

SEQ ID NO: 50002 - protein, 7 aa, Mycobacterium avium
AKRAGTA

SEQ ID NO: 50003 - protein, 6 aa, Mycobacterium avium
AKRARH

SEQ ID NO: 50004 - protein, 17 aa, Mycobacterium avium
AKREYEASVSRAQAEAD

SEQ ID NO: 50005 - protein, 7 aa, Mycobacterium avium
AKRGGQH

SEQ ID NO: 50006 - protein, 7 aa, Mycobacterium avium
AKRQELK

SEQ ID NO: 50007 - protein, 16 aa, Mycobacterium avium
AKRTPKTARTRSWTTD

SEQ ID NO: 50008 - protein, 10 aa, Mycobacterium avium
AKSGDDSIGE

SEQ ID NO: 50009 - protein, 7 aa, Mycobacterium avium
AKSHQQL

SEQ ID NO: 50010 - protein, 10 aa, Mycobacterium avium
AKTAPKDKGL

SEQ ID NO: 50011 - protein, 7 aa, Mycobacterium avium
AKTDTED

SEQ ID NO: 50012 - protein, 13 aa, Mycobacterium avium
AKTGIDADGLTRT

SEQ ID NO: 50013 - protein, 6 aa, Mycobacterium avium
AKTGNL

SEQ ID NO: 50014 - protein, 12 aa, Mycobacterium avium
AKVQSQVTAQND

SEQ ID NO: 50015 - protein, 7 aa, Mycobacterium avium
ALAGGAL

SEQ ID NO: 50016 - protein, 6 aa, Mycobacterium avium
ALAPDG

SEQ ID NO: 50017 - protein, 15 aa, Mycobacterium avium
ALAPRGDGAAGNDAL

SEQ ID NO: 50018 - protein, 37 aa, Mycobacterium avium
ALASGQAPGAPAAPAAPAAPAPAASPAGPVAPLLAAL

SEQ ID NO: 50019 - protein, 10 aa, Mycobacterium avium
ALASRGPDPL

SEQ ID NO: 50020 - protein, 12 aa, Mycobacterium avium
ALDDSKKLTESV

SEQ ID NO: 50021 - protein, 7 aa, Mycobacterium avium
ALDGGAD

SEQ ID NO: 50022 - protein, 8 aa, Mycobacterium avium
ALDQTARH

SEQ ID NO: 50023 - protein, 13 aa, Mycobacterium avium
ALEDGDDDRPAVE

SEQ ID NO: 50024 - protein, 10 aa, Mycobacterium avium
ALESQDNGMN

SEQ ID NO: 50025 - protein, 5 aa, Mycobacterium avium
ALGAP

SEQ ID NO: 50026 - protein, 6 aa, Mycobacterium avium
ALGGRQ

SEQ ID NO: 50027 - protein, 9 aa, Mycobacterium avium
ALGSQGGAV

SEQ ID NO: 50028 - protein, 10 aa, Mycobacterium avium
ALPAARAGAG

SEQ ID NO: 50029 - protein, 21 aa, Mycobacterium avium
ALPAPEYAGGAYRAPSTPTEE

SEQ ID NO: 50030 - protein, 8 aa, Mycobacterium avium
ALPDDPDA

SEQ ID NO: 50031 - protein, 26 aa, Mycobacterium avium
ALPDDVPTSSAADVTGCRDDDGAEGH

SEQ ID NO: 50032 - protein, 8 aa, Mycobacterium avium
ALPENSNQ

SEQ ID NO: 50033 - protein, 10 aa, Mycobacterium avium
ALPEYQPPGC

SEQ ID NO: 50034 - protein, 5 aa, Mycobacterium avium
ALPGE

SEQ ID NO: 50035 - protein, 9 aa, Mycobacterium avium
ALPPATGAP

SEQ ID NO: 50036 - protein, 11 aa, Mycobacterium avium
ALQGERGFDPR

SEQ ID NO: 50037 - protein, 8 aa, Mycobacterium avium
ALQKGGYG

SEQ ID NO: 50038 - protein, 7 aa, Mycobacterium avium
ALQSGDI

SEQ ID NO: 50039 - protein, 4 aa, Mycobacterium avium
ALRG

SEQ ID NO: 50040 - protein, 6 aa, Mycobacterium avium
ALRPGD

SEQ ID NO: 50041 - protein, 16 aa, Mycobacterium avium
ALRPQTTTMSGAPMGG

SEQ ID NO: 50042 - protein, 15 aa, Mycobacterium avium
ALRSGEIDQAEYERR

SEQ ID NO: 50043 - protein, 8 aa, Mycobacterium avium
ALSEGSGQ

SEQ ID NO: 50044 - protein, 10 aa, Mycobacterium avium
ALSSYAEPEW

SEQ ID NO: 50045 - protein, 13 aa, Mycobacterium avium
ALSTSLNDPSPWA

SEQ ID NO: 50046 - protein, 10 aa, Mycobacterium avium
ALTDDEKRRF

SEQ ID NO: 50047 - protein, 6 aa, Mycobacterium avium
ALTNPE

SEQ ID NO: 50048 - protein, 23 aa, Mycobacterium avium
ALTVSGGARTGPRQPDRTQPEPA

SEQ ID NO: 50049 - protein, 11 aa, Mycobacterium avium
AMDNARDATQI

SEQ ID NO: 50050 - protein, 8 aa, Mycobacterium avium
AMQAGQSA

SEQ ID NO: 50051 - protein, 6 aa, Mycobacterium avium
AMTGGL

SEQ ID NO: 50052 - protein, 7 aa, Mycobacterium avium
ANADEQL

SEQ ID NO: 50053 - protein, 8 aa, Mycobacterium avium
ANAELNPT

SEQ ID NO: 50054 - protein, 4 aa, Mycobacterium avium
ANAG

SEQ ID NO: 50055 - protein, 18 aa, Mycobacterium avium
ANARAAGTGTLRRGRRSR

SEQ ID NO: 50056 - protein, 10 aa, Mycobacterium avium
ANARGSKELA

SEQ ID NO: 50057 - protein, 7 aa, Mycobacterium avium
ANASDAM

SEQ ID NO: 50058 - protein, 7 aa, Mycobacterium avium
ANASGIE

SEQ ID NO: 50059 - protein, 9 aa, Mycobacterium avium
ANDDNQATA

SEQ ID NO: 50060 - protein, 6 aa, Mycobacterium avium
ANEEAA

SEQ ID NO: 50061 - protein, 4 aa, Mycobacterium avium
ANEF

SEQ ID NO: 50062 - protein, 10 aa, Mycobacterium avium
ANGEPVGASG

SEQ ID NO: 50063 - protein, 12 aa, Mycobacterium avium
ANGFDKDHTNAR

SEQ ID NO: 50064 - protein, 6 aa, Mycobacterium avium
ANGRRA

SEQ ID NO: 50065 - protein, 7 aa, Mycobacterium avium
ANGRSVT

SEQ ID NO: 50066 - protein, 7 aa, Mycobacterium avium
ANLGPVA

SEQ ID NO: 50067 - protein, 5 aa, Mycobacterium avium
ANPAA

SEQ ID NO: 50068 - protein, 12 aa, Mycobacterium avium
ANPASAEAKGAI

SEQ ID NO: 50069 - protein, 5 aa, Mycobacterium avium
ANPNQ

SEQ ID NO: 50070 - protein, 8 aa, Mycobacterium avium
ANRDESTF

SEQ ID NO: 50071 - protein, 12 aa, Mycobacterium avium
ANRDPRKFENPN

SEQ ID NO: 50072 - protein, 12 aa, Mycobacterium avium
ANRENAAAALRS

SEQ ID NO: 50073 - protein, 6 aa, Mycobacterium avium
ANRGAR

SEQ ID NO: 50074 - protein, 12 aa, Mycobacterium avium
ANRGRDEQRRAM

SEQ ID NO: 50075 - protein, 17 aa, Mycobacterium avium
ANRNPASAASPAAVSAG

SEQ ID NO: 50076 - protein, 5 aa, Mycobacterium avium
ANRPA

SEQ ID NO: 50077 - protein, 12 aa, Mycobacterium avium
ANRQEDRYPDPD

SEQ ID NO: 50078 - protein, 6 aa, Mycobacterium avium
ANSARA

SEQ ID NO: 50079 - protein, 4 aa, Mycobacterium avium
ANSD

SEQ ID NO: 50080 - protein, 9 aa, Mycobacterium avium
ANSDLTPQH

SEQ ID NO: 50081 - protein, 7 aa, Mycobacterium avium
ANSGLGA

SEQ ID NO: 50082 - protein, 8 aa, Mycobacterium avium
ANSGQFGS

SEQ ID NO: 50083 - protein, 11 aa, Mycobacterium avium
ANSPIDDKGRF

SEQ ID NO: 50084 - protein, 15 aa, Mycobacterium avium
ANTLGSGGKAFEATV

SEQ ID NO: 50085 - protein, 8 aa, Mycobacterium avium
ANTSRGAV

SEQ ID NO: 50086 - protein, 7 aa, Mycobacterium avium
ANTTSAR

SEQ ID NO: 50087 - protein, 5 aa, Mycobacterium avium
ANYAA

SEQ ID NO: 50088 - protein, 4 aa, Mycobacterium avium
ANYS

SEQ ID NO: 50089 - protein, 9 aa, Mycobacterium avium
APAAAGTRI

SEQ ID NO: 50090 - protein, 9 aa, Mycobacterium avium
APAANDPRL

SEQ ID NO: 50091 - protein, 6 aa, Mycobacterium avium
APADIG

SEQ ID NO: 50092 - protein, 15 aa, Mycobacterium avium
APADPSGGRVTFSDS

SEQ ID NO: 50093 - protein, 11 aa, Mycobacterium avium
APAERQRELQD

SEQ ID NO: 50094 - protein, 6 aa, Mycobacterium avium
APAETA

SEQ ID NO: 50095 - protein, 4 aa, Mycobacterium avium
APAG

SEQ ID NO: 50096 - protein, 8 aa, Mycobacterium avium
APAGDVES

SEQ ID NO: 50097 - protein, 7 aa, Mycobacterium avium
APAGPNR

SEQ ID NO: 50098 - protein, 5 aa, Mycobacterium avium
APAHF

SEQ ID NO: 50099 - protein, 8 aa, Mycobacterium avium
APAKRELA

SEQ ID NO: 50100 - protein, 7 aa, Mycobacterium avium
APAKTSA

SEQ ID NO: 50101 - protein, 12 aa, Mycobacterium avium
APANPGITGAPQ

SEQ ID NO: 50102 - protein, 8 aa, Mycobacterium avium
APAPSDEL

SEQ ID NO: 50103 - protein, 21 aa, Mycobacterium avium
APAQAGTESAVSGVEGLPAGS

SEQ ID NO: 50104 - protein, 13 aa, Mycobacterium avium
APAQAPGTAASRA

SEQ ID NO: 50105 - protein, 20 aa, Mycobacterium avium
APASIEHAGSQAGYPSPPLQ

SEQ ID NO: 50106 - protein, 6 aa, Mycobacterium avium
APATED

SEQ ID NO: 50107 - protein, 9 aa, Mycobacterium avium
APATPTEEA

SEQ ID NO: 50108 - protein, 6 aa, Mycobacterium avium
APAVRK

SEQ ID NO: 50109 - protein, 5 aa, Mycobacterium avium
APDAE

SEQ ID NO: 50110 - protein, 11 aa, Mycobacterium avium
APDAGTAEAEA

SEQ ID NO: 50111 - protein, 9 aa, Mycobacterium avium
APDAHPRGG

SEQ ID NO: 50112 - protein, 8 aa, Mycobacterium avium
APDESPRS

SEQ ID NO: 50113 - protein, 5 aa, Mycobacterium avium
APDNL

SEQ ID NO: 50114 - protein, 9 aa, Mycobacterium avium
APDPARDPI

SEQ ID NO: 50115 - protein, 20 aa, Mycobacterium avium
APDPVVSTTTAEDADAAAAG

SEQ ID NO: 50116 - protein, 6 aa, Mycobacterium avium
APDRTA

SEQ ID NO: 50117 - protein, 9 aa, Mycobacterium avium
APDTQRGLA

SEQ ID NO: 50118 - protein, 12 aa, Mycobacterium avium
APEGRAPRPGER

SEQ ID NO: 50119 - protein, 17 aa, Mycobacterium avium
APEPAPETVAPEGISAE

SEQ ID NO: 50120 - protein, 6 aa, Mycobacterium avium
APEPDD

SEQ ID NO: 50121 - protein, 10 aa, Mycobacterium avium
APEPGRAKTR

SEQ ID NO: 50122 - protein, 9 aa, Mycobacterium avium
APEQARSGL

SEQ ID NO: 50123 - protein, 16 aa, Mycobacterium avium
APERPATEQVAKNMST

SEQ ID NO: 50124 - protein, 6 aa, Mycobacterium avium
APESLN

SEQ ID NO: 50125 - protein, 5 aa, Mycobacterium avium
APFGG

SEQ ID NO: 50126 - protein, 64 aa, Mycobacterium avium
APGAPGGPAIEPPPGAPKPGDNASIHEPTGPGAVSPGSKQGLSDTATPGADVQQPGTGQGALPG

SEQ ID NO: 50127 - protein, 25 aa, Mycobacterium avium
APGGEVTDQPEPPPQQQAPAQQPQN

SEQ ID NO: 50128 - protein, 8 aa, Mycobacterium avium
APGGIETA

SEQ ID NO: 50129 - protein, 5 aa, Mycobacterium avium
APGHA

SEQ ID NO: 50130 - protein, 8 aa, Mycobacterium avium
APGPPGVH

SEQ ID NO: 50131 - protein, 8 aa, Mycobacterium avium
APGPTETD

SEQ ID NO: 50132 - protein, 5 aa, Mycobacterium avium
APGQI

SEQ ID NO: 50133 - protein, 5 aa, Mycobacterium avium
APGQP

SEQ ID NO: 50134 - protein, 9 aa, Mycobacterium avium
APGQTAAAQ

SEQ ID NO: 50135 - protein, 11 aa, Mycobacterium avium
APGRDSTERTV

SEQ ID NO: 50136 - protein, 23 aa, Mycobacterium avium
APGRMDSAHARAGRGEPLEPIDT

SEQ ID NO: 50137 - protein, 40 aa, Mycobacterium avium
APGSGSTSAGQTPPGTTTLPNTAGQAGYQGPCPPAGTGTH

SEQ ID NO: 50138 - protein, 5 aa, Mycobacterium avium
APGSP

SEQ ID NO: 50139 - protein, 5 aa, Mycobacterium avium
APGTM

SEQ ID NO: 50140 - protein, 13 aa, Mycobacterium avium
APGTQGQGNQCAP

SEQ ID NO: 50141 - protein, 14 aa, Mycobacterium avium
APGVYSSGGPVGNG

SEQ ID NO: 50142 - protein, 9 aa, Mycobacterium avium
APHAEAAQP

SEQ ID NO: 50143 - protein, 32 aa, Mycobacterium avium
APHPAPRLGEHTEGYRGAELTPRPAPDGGRTA

SEQ ID NO: 50144 - protein, 8 aa, Mycobacterium avium
APHSAERA

SEQ ID NO: 50145 - protein, 14 aa, Mycobacterium avium
APKAPVVPAEAPGA

SEQ ID NO: 50146 - protein, 5 aa, Mycobacterium avium
APKDP

SEQ ID NO: 50147 - protein, 9 aa, Mycobacterium avium
APKETGHRD

SEQ ID NO: 50148 - protein, 11 aa, Mycobacterium avium
APKFAESQNLP

SEQ ID NO: 50149 - protein, 9 aa, Mycobacterium avium
APKSNAVTT

SEQ ID NO: 50150 - protein, 8 aa, Mycobacterium avium
APKTAAAV

SEQ ID NO: 50151 - protein, 17 aa, Mycobacterium avium
APLAPTGRATPADGGVR

SEQ ID NO: 50152 - protein, 11 aa, Mycobacterium avium
APLDDASRNRL

SEQ ID NO: 50153 - protein, 5 aa, Mycobacterium avium
APLED

SEQ ID NO: 50154 - protein, 17 aa, Mycobacterium avium
APLPALPAAPPPQPSSM

SEQ ID NO: 50155 - protein, 11 aa, Mycobacterium avium
APLQPGSPAGV

SEQ ID NO: 50156 - protein, 19 aa, Mycobacterium avium
APLTPGPEAPPIGAPVPGT

SEQ ID NO: 50157 - protein, 14 aa, Mycobacterium avium
APLVPGTPDPVKDA

SEQ ID NO: 50158 - protein, 6 aa, Mycobacterium avium
APNAGH

SEQ ID NO: 50159 - protein, 11 aa, Mycobacterium avium
APNALTSTQWR

SEQ ID NO: 50160 - protein, 8 aa, Mycobacterium avium
APNLESGG

SEQ ID NO: 50161 - protein, 9 aa, Mycobacterium avium
APNRGKRSV

SEQ ID NO: 50162 - protein, 8 aa, Mycobacterium avium
APNYDRGS

SEQ ID NO: 50163 - protein, 6 aa, Mycobacterium avium
APPGST

SEQ ID NO: 50164 - protein, 14 aa, Mycobacterium avium
APPHPRAPGATDKD

SEQ ID NO: 50165 - protein, 11 aa, Mycobacterium avium
APPHTAVRRGG

SEQ ID NO: 50166 - protein, 8 aa, Mycobacterium avium
APPKTAAK

SEQ ID NO: 50167 - protein, 7 aa, Mycobacterium avium
APPNPPV

SEQ ID NO: 50168 - protein, 7 aa, Mycobacterium avium
APPPDDV

SEQ ID NO: 50169 - protein, 5 aa, Mycobacterium avium
APPRF

SEQ ID NO: 50170 - protein, 9 aa, Mycobacterium avium
APPSDRRDD

SEQ ID NO: 50171 - protein, 4 aa, Mycobacterium avium
APQA

SEQ ID NO: 50172 - protein, 12 aa, Mycobacterium avium
APQLSTSDGRGP

SEQ ID NO: 50173 - protein, 8 aa, Mycobacterium avium
APQPAGTP

SEQ ID NO: 50174 - protein, 11 aa, Mycobacterium avium
APQPVRNREYT

SEQ ID NO: 50175 - protein, 20 aa, Mycobacterium avium
APQPVTTQDATPAAESDARP

SEQ ID NO: 50176 - protein, 25 aa, Mycobacterium avium
APQPVVQPPTGRRPTHTNDQAPLPK

SEQ ID NO: 50177 - protein, 5 aa, Mycobacterium avium
APRAA

SEQ ID NO: 50178 - protein, 13 aa, Mycobacterium avium
APRAKDAEAAARE

SEQ ID NO: 50179 - protein, 12 aa, Mycobacterium avium
APRGADAPGRRG

SEQ ID NO: 50180 - protein, 10 aa, Mycobacterium avium
APRKRGNPEM

SEQ ID NO: 50181 - protein, 10 aa, Mycobacterium avium
APRNTYQTAD

SEQ ID NO: 50182 - protein, 4 aa, Mycobacterium avium
APRP

SEQ ID NO: 50183 - protein, 7 aa, Mycobacterium avium
APRPPWH

SEQ ID NO: 50184 - protein, 10 aa, Mycobacterium avium
APRSAAAAGR

SEQ ID NO: 50185 - protein, 18 aa, Mycobacterium avium
APRSGGHSYTGASTANGT

SEQ ID NO: 50186 - protein, 9 aa, Mycobacterium avium
APRTPRERV

SEQ ID NO: 50187 - protein, 6 aa, Mycobacterium avium
APRVDS

SEQ ID NO: 50188 - protein, 11 aa, Mycobacterium avium
APSAGESAGRR

SEQ ID NO: 50189 - protein, 6 aa, Mycobacterium avium
APSAVI

SEQ ID NO: 50190 - protein, 5 aa, Mycobacterium avium
APSET

SEQ ID NO: 50191 - protein, 7 aa, Mycobacterium avium
APSGGYQ

SEQ ID NO: 50192 - protein, 9 aa, Mycobacterium avium
APSPDPATG

SEQ ID NO: 50193 - protein, 6 aa, Mycobacterium avium
APSTSP

SEQ ID NO: 50194 - protein, 5 aa, Mycobacterium avium
APTAE

SEQ ID NO: 50195 - protein, 27 aa, Mycobacterium avium
APTDALRRGGYRRAHPGRPAATRFSIR

SEQ ID NO: 50196 - protein, 8 aa, Mycobacterium avium
APTNAVPT

SEQ ID NO: 50197 - protein, 6 aa, Mycobacterium avium
APTNHQ

SEQ ID NO: 50198 - protein, 34 aa, Mycobacterium avium
APTPAGPEAPPQSAPPAPRGQVPDTTAAATAYGA

SEQ ID NO: 50199 - protein, 8 aa, Mycobacterium avium
APTRRRVD

SEQ ID NO: 50200 - protein, 6 aa, Mycobacterium avium
APVDEC

SEQ ID NO: 50201 - protein, 7 aa, Mycobacterium avium
APVEPGD

SEQ ID NO: 50202 - protein, 11 aa, Mycobacterium avium
APVGGDGQDTV

SEQ ID NO: 50203 - protein, 4 aa, Mycobacterium avium
APVK

SEQ ID NO: 50204 - protein, 10 aa, Mycobacterium avium
APVSDPTRQR

SEQ ID NO: 50205 - protein, 10 aa, Mycobacterium avium
APVSGEAASL

SEQ ID NO: 50206 - protein, 12 aa, Mycobacterium avium
APVTPVDSNGRF

SEQ ID NO: 50207 - protein, 8 aa, Mycobacterium avium
APYSDGGI

SEQ ID NO: 50208 - protein, 4 aa, Mycobacterium avium
AQAA

SEQ ID NO: 50209 - protein, 6 aa, Mycobacterium avium
AQAALG

SEQ ID NO: 50210 - protein, 8 aa, Mycobacterium avium
AQADPGLR

SEQ ID NO: 50211 - protein, 5 aa, Mycobacterium avium
AQAGA

SEQ ID NO: 50212 - protein, 5 aa, Mycobacterium avium
AQAGN

SEQ ID NO: 50213 - protein, 53 aa, Mycobacterium avium
AQAGSEPDPDPDPPGGGQAGETEQQPPQRDSAQDAKPRPPTTKPSAPPSKTFR

SEQ ID NO: 50214 - protein, 7 aa, Mycobacterium avium
AQAGSFD

SEQ ID NO: 50215 - protein, 5 aa, Mycobacterium avium
AQAMA

SEQ ID NO: 50216 - protein, 9 aa, Mycobacterium avium
AQANGDTPV

SEQ ID NO: 50217 - protein, 12 aa, Mycobacterium avium
AQARSRTDLTGA

SEQ ID NO: 50218 - protein, 13 aa, Mycobacterium avium
AQDAGQVASDVDA

SEQ ID NO: 50219 - protein, 14 aa, Mycobacterium avium
AQDAQPQPRRDADR

SEQ ID NO: 50220 - protein, 6 aa, Mycobacterium avium
AQDDKY

SEQ ID NO: 50221 - protein, 6 aa, Mycobacterium avium
AQDDYN

SEQ ID NO: 50222 - protein, 14 aa, Mycobacterium avium
AQDFAEDPSRYDIP

SEQ ID NO: 50223 - protein, 8 aa, Mycobacterium avium
AQDPGDDV

SEQ ID NO: 50224 - protein, 7 aa, Mycobacterium avium
AQEEVWG

SEQ ID NO: 50225 - protein, 5 aa, Mycobacterium avium
AQENP

SEQ ID NO: 50226 - protein, 19 aa, Mycobacterium avium
AQGASTPIRPGEFGDRGGL

SEQ ID NO: 50227 - protein, 5 aa, Mycobacterium avium
AQGER

SEQ ID NO: 50228 - protein, 5 aa, Mycobacterium avium
AQGHD

SEQ ID NO: 50229 - protein, 14 aa, Mycobacterium avium
AQGHDKDSRGGSSF

SEQ ID NO: 50230 - protein, 9 aa, Mycobacterium avium
AQGHTNTSH

SEQ ID NO: 50231 - protein, 8 aa, Mycobacterium avium
AQGREAGG

SEQ ID NO: 50232 - protein, 7 aa, Mycobacterium avium
AQIGNRD

SEQ ID NO: 50233 - protein, 10 aa, Mycobacterium avium
AQKSPAANGV

SEQ ID NO: 50234 - protein, 10 aa, Mycobacterium avium
AQLDGEQQTL

SEQ ID NO: 50235 - protein, 6 aa, Mycobacterium avium
AQLERA

SEQ ID NO: 50236 - protein, 8 aa, Mycobacterium avium
AQLGRDPR

SEQ ID NO: 50237 - protein, 8 aa, Mycobacterium avium
AQLPNTND

SEQ ID NO: 50238 - protein, 7 aa, Mycobacterium avium
AQMTDDE

SEQ ID NO: 50239 - protein, 5 aa, Mycobacterium avium
AQNQK

SEQ ID NO: 50240 - protein, 7 aa, Mycobacterium avium
AQPQLGA

SEQ ID NO: 50241 - protein, 5 aa, Mycobacterium avium
AQPQS

SEQ ID NO: 50242 - protein, 14 aa, Mycobacterium avium
AQPVGDGNTVDDRD

SEQ ID NO: 50243 - protein, 5 aa, Mycobacterium avium
AQQAA

SEQ ID NO: 50244 - protein, 17 aa, Mycobacterium avium
AQQAPRLRTETRFDSAP

SEQ ID NO: 50245 - protein, 10 aa, Mycobacterium avium
AQQESEPTKP

SEQ ID NO: 50246 - protein, 8 aa, Mycobacterium avium
AQQGGSHP

SEQ ID NO: 50247 - protein, 8 aa, Mycobacterium avium
AQQPDGMS

SEQ ID NO: 50248 - protein, 7 aa, Mycobacterium avium
AQQRDPG

SEQ ID NO: 50249 - protein, 8 aa, Mycobacterium avium
AQRADPHH

SEQ ID NO: 50250 - protein, 11 aa, Mycobacterium avium
AQRAGREALRA

SEQ ID NO: 50251 - protein, 8 aa, Mycobacterium avium
AQRAPRAP

SEQ ID NO: 50252 - protein, 12 aa, Mycobacterium avium
AQRARDRGGPPV

SEQ ID NO: 50253 - protein, 14 aa, Mycobacterium avium
AQRCPDRPGLVDER

SEQ ID NO: 50254 - protein, 5 aa, Mycobacterium avium
AQRDT

SEQ ID NO: 50255 - protein, 10 aa, Mycobacterium avium
AQRRDHRKLG

SEQ ID NO: 50256 - protein, 10 aa, Mycobacterium avium
AQRRGPDAGT

SEQ ID NO: 50257 - protein, 6 aa, Mycobacterium avium
AQRRPD

SEQ ID NO: 50258 - protein, 6 aa, Mycobacterium avium
AQRSTL

SEQ ID NO: 50259 - protein, 14 aa, Mycobacterium avium
AQSAAQSGSNTAAH

SEQ ID NO: 50260 - protein, 19 aa, Mycobacterium avium
AQSDSRKGAQMAEQLLAKR

SEQ ID NO: 50261 - protein, 17 aa, Mycobacterium avium
AQSKDDGPTRPRLTDRE

SEQ ID NO: 50262 - protein, 7 aa, Mycobacterium avium
AQTFRGP

SEQ ID NO: 50263 - protein, 4 aa, Mycobacterium avium
AQTL

SEQ ID NO: 50264 - protein, 10 aa, Mycobacterium avium
AQTPDAPAVS

SEQ ID NO: 50265 - protein, 11 aa, Mycobacterium avium
ARAAAGPGAPE

SEQ ID NO: 50266 - protein, 12 aa, Mycobacterium avium
ARAAAGQVPNPL

SEQ ID NO: 50267 - protein, 9 aa, Mycobacterium avium
ARAAGPDGL

SEQ ID NO: 50268 - protein, 5 aa, Mycobacterium avium
ARAAI

SEQ ID NO: 50269 - protein, 14 aa, Mycobacterium avium
ARADATRVRSGADR

SEQ ID NO: 50270 - protein, 8 aa, Mycobacterium avium
ARADDPGV

SEQ ID NO: 50271 - protein, 9 aa, Mycobacterium avium
ARAGAAGDL

SEQ ID NO: 50272 - protein, 9 aa, Mycobacterium avium
ARAGAQGVG

SEQ ID NO: 50273 - protein, 15 aa, Mycobacterium avium
ARAGATDLSAARSRM

SEQ ID NO: 50274 - protein, 8 aa, Mycobacterium avium
ARAGVSRS

SEQ ID NO: 50275 - protein, 10 aa, Mycobacterium avium
ARAKATVGEI

SEQ ID NO: 50276 - protein, 4 aa, Mycobacterium avium
ARAM

SEQ ID NO: 50277 - protein, 4 aa, Mycobacterium avium
ARAN

SEQ ID NO: 50278 - protein, 8 aa, Mycobacterium avium
ARAPGAAG

SEQ ID NO: 50279 - protein, 6 aa, Mycobacterium avium
ARAPQD

SEQ ID NO: 50280 - protein, 6 aa, Mycobacterium avium
ARAPRV

SEQ ID NO: 50281 - protein, 4 aa, Mycobacterium avium
ARAR

SEQ ID NO: 50282 - protein, 13 aa, Mycobacterium avium
ARASAAKADWGAA

SEQ ID NO: 50283 - protein, 10 aa, Mycobacterium avium
ARASADPDSR

SEQ ID NO: 50284 - protein, 26 aa, Mycobacterium avium
ARATRPAPAASQSWPAGHGPDADPPP

SEQ ID NO: 50285 - protein, 8 aa, Mycobacterium avium
ARDAAADV

SEQ ID NO: 50286 - protein, 5 aa, Mycobacterium avium
ARDAE

SEQ ID NO: 50287 - protein, 4 aa, Mycobacterium avium
ARDG

SEQ ID NO: 50288 - protein, 6 aa, Mycobacterium avium
ARDGVQ

SEQ ID NO: 50289 - protein, 7 aa, Mycobacterium avium
ARDNELE

SEQ ID NO: 50290 - protein, 7 aa, Mycobacterium avium
ARDPATG

SEQ ID NO: 50291 - protein, 9 aa, Mycobacterium avium
ARDRGENER

SEQ ID NO: 50292 - protein, 8 aa, Mycobacterium avium
ARDRTTSG

SEQ ID NO: 50293 - protein, 8 aa, Mycobacterium avium
ARDTDAGA

SEQ ID NO: 50294 - protein, 22 aa, Mycobacterium avium
AREADRAADSPAPRLSADHPGV

SEQ ID NO: 50295 - protein, 4 aa, Mycobacterium avium
AREE

SEQ ID NO: 50296 - protein, 9 aa, Mycobacterium avium
AREEGPEAD

SEQ ID NO: 50297 - protein, 10 aa, Mycobacterium avium
AREPRGDGGF

SEQ ID NO: 50298 - protein, 8 aa, Mycobacterium avium
ARESLDSA

SEQ ID NO: 50299 - protein, 4 aa, Mycobacterium avium
ARFE

SEQ ID NO: 50300 - protein, 6 aa, Mycobacterium avium
ARGAGI

SEQ ID NO: 50301 - protein, 7 aa, Mycobacterium avium
ARGAGYG

SEQ ID NO: 50302 - protein, 9 aa, Mycobacterium avium
ARGDTPWGD

SEQ ID NO: 50303 - protein, 4 aa, Mycobacterium avium
ARGE

SEQ ID NO: 50304 - protein, 10 aa, Mycobacterium avium
ARGGAGSDEH

SEQ ID NO: 50305 - protein, 6 aa, Mycobacterium avium
ARGGAV

SEQ ID NO: 50306 - protein, 5 aa, Mycobacterium avium
ARGGT

SEQ ID NO: 50307 - protein, 6 aa, Mycobacterium avium
ARGITP

SEQ ID NO: 50308 - protein, 5 aa, Mycobacterium avium
ARGLP

SEQ ID NO: 50309 - protein, 7 aa, Mycobacterium avium
ARGQGRS

SEQ ID NO: 50310 - protein, 8 aa, Mycobacterium avium
ARGQGRSH

SEQ ID NO: 50311 - protein, 9 aa, Mycobacterium avium
ARGQHGKAE

SEQ ID NO: 50312 - protein, 4 aa, Mycobacterium avium
ARGR

SEQ ID NO: 50313 - protein, 10 aa, Mycobacterium avium
ARGSPESVDP

SEQ ID NO: 50314 - protein, 9 aa, Mycobacterium avium
ARHPDAERW

SEQ ID NO: 50315 - protein, 9 aa, Mycobacterium avium
ARIPAARPD

SEQ ID NO: 50316 - protein, 10 aa, Mycobacterium avium
ARKEADAGDA

SEQ ID NO: 50317 - protein, 7 aa, Mycobacterium avium
ARKNRYV

SEQ ID NO: 50318 - protein, 12 aa, Mycobacterium avium
ARKTNEVQSRPW

SEQ ID NO: 50319 - protein, 8 aa, Mycobacterium avium
ARLGPDTS

SEQ ID NO: 50320 - protein, 10 aa, Mycobacterium avium
ARMQREQRAK

SEQ ID NO: 50321 - protein, 14 aa, Mycobacterium avium
ARNEAAAALADLLR

SEQ ID NO: 50322 - protein, 19 aa, Mycobacterium avium
ARPAGQVSRPALSPSRAAD

SEQ ID NO: 50323 - protein, 9 aa, Mycobacterium avium
ARPAGRRGA

SEQ ID NO: 50324 - protein, 7 aa, Mycobacterium avium
ARPDGAG

SEQ ID NO: 50325 - protein, 26 aa, Mycobacterium avium
ARPDTQDALNADSSARLPRPATGAEL

SEQ ID NO: 50326 - protein, 8 aa, Mycobacterium avium
ARPEGSTK

SEQ ID NO: 50327 - protein, 6 aa, Mycobacterium avium
ARPEPP

SEQ ID NO: 50328 - protein, 10 aa, Mycobacterium avium
ARPETPAQAA

SEQ ID NO: 50329 - protein, 10 aa, Mycobacterium avium
ARPGIPPTHP

SEQ ID NO: 50330 - protein, 6 aa, Mycobacterium avium
ARPGWR

SEQ ID NO: 50331 - protein, 5 aa, Mycobacterium avium
ARPPR

SEQ ID NO: 50332 - protein, 4 aa, Mycobacterium avium
ARPQ

SEQ ID NO: 50333 - protein, 5 aa, Mycobacterium avium
ARPRL

SEQ ID NO: 50334 - protein, 12 aa, Mycobacterium avium
ARPVSSRVPEEV

SEQ ID NO: 50335 - protein, 5 aa, Mycobacterium avium
ARQAG

SEQ ID NO: 50336 - protein, 5 aa, Mycobacterium avium
ARQGA

SEQ ID NO: 50337 - protein, 12 aa, Mycobacterium avium
ARQGDPAPGGVG

SEQ ID NO: 50338 - protein, 6 aa, Mycobacterium avium
ARQRGY

SEQ ID NO: 50339 - protein, 7 aa, Mycobacterium avium
ARRADGQ

SEQ ID NO: 50340 - protein, 7 aa, Mycobacterium avium
ARRAQTI

SEQ ID NO: 50341 - protein, 11 aa, Mycobacterium avium
ARREAASSFGD

SEQ ID NO: 50342 - protein, 11 aa, Mycobacterium avium
ARREGHDVGRD

SEQ ID NO: 50343 - protein, 7 aa, Mycobacterium avium
ARRGEEL

SEQ ID NO: 50344 - protein, 15 aa, Mycobacterium avium
ARRGRDAAAAGDNGR

SEQ ID NO: 50345 - protein, 7 aa, Mycobacterium avium
ARRGRHA

SEQ ID NO: 50346 - protein, 12 aa, Mycobacterium avium
ARRGRVDDPHGP

SEQ ID NO: 50347 - protein, 7 aa, Mycobacterium avium
ARRGSTK

SEQ ID NO: 50348 - protein, 5 aa, Mycobacterium avium
ARRHD

SEQ ID NO: 50349 - protein, 18 aa, Mycobacterium avium
ARRPATTRPLIERCDWIA

SEQ ID NO: 50350 - protein, 6 aa, Mycobacterium avium
ARRPEV

SEQ ID NO: 50351 - protein, 16 aa, Mycobacterium avium
ARRPGLPGAEEQAPVT

SEQ ID NO: 50352 - protein, 43 aa, Mycobacterium avium
ARRPGRGPAGAAGPGRAGTGLATPRHPGPRGRAAPVRAGGRVS

SEQ ID NO: 50353 - protein, 5 aa, Mycobacterium avium
ARRPT

SEQ ID NO: 50354 - protein, 8 aa, Mycobacterium avium
ARRQARRD

SEQ ID NO: 50355 - protein, 4 aa, Mycobacterium avium
ARRR

SEQ ID NO: 50356 - protein, 10 aa, Mycobacterium avium
ARRRGDKQRQ

SEQ ID NO: 50357 - protein, 17 aa, Mycobacterium avium
ARRSALADQHGAASEAD

SEQ ID NO: 50358 - protein, 7 aa, Mycobacterium avium
ARRSMTQ

SEQ ID NO: 50359 - protein, 4 aa, Mycobacterium avium
ARSA

SEQ ID NO: 50360 - protein, 5 aa, Mycobacterium avium
ARSAE

SEQ ID NO: 50361 - protein, 12 aa, Mycobacterium avium
ARSARLASEQAL

SEQ ID NO: 50362 - protein, 5 aa, Mycobacterium avium
ARSDG

SEQ ID NO: 50363 - protein, 7 aa, Mycobacterium avium
ARSDQIS

SEQ ID NO: 50364 - protein, 11 aa, Mycobacterium avium
ARSEHDTASAK

SEQ ID NO: 50365 - protein, 4 aa, Mycobacterium avium
ARSF

SEQ ID NO: 50366 - protein, 9 aa, Mycobacterium avium
ARSKAARKV

SEQ ID NO: 50367 - protein, 7 aa, Mycobacterium avium
ARSPRIP

SEQ ID NO: 50368 - protein, 10 aa, Mycobacterium avium
ARSSHTRTES

SEQ ID NO: 50369 - protein, 22 aa, Mycobacterium avium
ARSTATRPKQWDASGHSRRASR

SEQ ID NO: 50370 - protein, 6 aa, Mycobacterium avium
ARTAEA

SEQ ID NO: 50371 - protein, 16 aa, Mycobacterium avium
ARTAKTGMVTGEPHNP

SEQ ID NO: 50372 - protein, 8 aa, Mycobacterium avium
ARTDPARA

SEQ ID NO: 50373 - protein, 9 aa, Mycobacterium avium
ARTGLEPGT

SEQ ID NO: 50374 - protein, 5 aa, Mycobacterium avium
ARTGR

SEQ ID NO: 50375 - protein, 8 aa, Mycobacterium avium
ARTGSRPQ

SEQ ID NO: 50376 - protein, 7 aa, Mycobacterium avium
ARTPDAA

SEQ ID NO: 50377 - protein, 6 aa, Mycobacterium avium
ARTPRA

SEQ ID NO: 50378 - protein, 15 aa, Mycobacterium avium
ARTSGQVTAFVCQPS

SEQ ID NO: 50379 - protein, 7 aa, Mycobacterium avium
ARTTAPL

SEQ ID NO: 50380 - protein, 8 aa, Mycobacterium avium
ARTTESQV

SEQ ID NO: 50381 - protein, 4 aa, Mycobacterium avium
ARVD

SEQ ID NO: 50382 - protein, 19 aa, Mycobacterium avium
ARVGSDRSAAAFPATLKSV

SEQ ID NO: 50383 - protein, 13 aa, Mycobacterium avium
ARVSSGEALSDTE

SEQ ID NO: 50384 - protein, 5 aa, Mycobacterium avium
ARYAR

SEQ ID NO: 50385 - protein, 5 aa, Mycobacterium avium
ARYDA

SEQ ID NO: 50386 - protein, 4 aa, Mycobacterium avium
ASAA

SEQ ID NO: 50387 - protein, 5 aa, Mycobacterium avium
ASAAA

SEQ ID NO: 50388 - protein, 8 aa, Mycobacterium avium
ASAAASIA

SEQ ID NO: 50389 - protein, 9 aa, Mycobacterium avium
ASADLERQV

SEQ ID NO: 50390 - protein, 6 aa, Mycobacterium avium
ASADQV

SEQ ID NO: 50391 - protein, 7 aa, Mycobacterium avium
ASADRLT

SEQ ID NO: 50392 - protein, 9 aa, Mycobacterium avium
ASAIQQTAD

SEQ ID NO: 50393 - protein, 11 aa, Mycobacterium avium
ASAITPAQADL

SEQ ID NO: 50394 - protein, 19 aa, Mycobacterium avium
ASANSAAVAAQQETAAAAY

SEQ ID NO: 50395 - protein, 25 aa, Mycobacterium avium
ASAPDSPAGPGIPPALRTADRSAGV

SEQ ID NO: 50396 - protein, 6 aa, Mycobacterium avium
ASAPIT

SEQ ID NO: 50397 - protein, 22 aa, Mycobacterium avium
ASARITAGSPPGRHRGVGTGSA

SEQ ID NO: 50398 - protein, 7 aa, Mycobacterium avium
ASASMAS

SEQ ID NO: 50399 - protein, 8 aa, Mycobacterium avium
ASASTQLG

SEQ ID NO: 50400 - protein, 5 aa, Mycobacterium avium
ASATS

SEQ ID NO: 50401 - protein, 4 aa, Mycobacterium avium
ASAV

SEQ ID NO: 50402 - protein, 5 aa, Mycobacterium avium
ASAYP

SEQ ID NO: 50403 - protein, 8 aa, Mycobacterium avium
ASDCTDAT

SEQ ID NO: 50404 - protein, 8 aa, Mycobacterium avium
ASDEGKGI

SEQ ID NO: 50405 - protein, 10 aa, Mycobacterium avium
ASDGADEEQV

SEQ ID NO: 50406 - protein, 19 aa, Mycobacterium avium
ASDGGLAAAEAAAGAELSR

SEQ ID NO: 50407 - protein, 5 aa, Mycobacterium avium
ASDGL

SEQ ID NO: 50408 - protein, 22 aa, Mycobacterium avium
ASDIDDNGLAETQASCGPGQVT

SEQ ID NO: 50409 - protein, 7 aa, Mycobacterium avium
ASDIGGA

SEQ ID NO: 50410 - protein, 8 aa, Mycobacterium avium
ASDLAAGQ

SEQ ID NO: 50411 - protein, 6 aa, Mycobacterium avium
ASDPVR

SEQ ID NO: 50412 - protein, 5 aa, Mycobacterium avium
ASDTA

SEQ ID NO: 50413 - protein, 15 aa, Mycobacterium avium
ASEADHPAAPRRGRD

SEQ ID NO: 50414 - protein, 8 aa, Mycobacterium avium
ASEGTLEP

SEQ ID NO: 50415 - protein, 8 aa, Mycobacterium avium
ASENGTAD

SEQ ID NO: 50416 - protein, 16 aa, Mycobacterium avium
ASEQGAAAGGDDAQRI

SEQ ID NO: 50417 - protein, 8 aa, Mycobacterium avium
ASEYEING

SEQ ID NO: 50418 - protein, 10 aa, Mycobacterium avium
ASGAPTGVGG

SEQ ID NO: 50419 - protein, 5 aa, Mycobacterium avium
ASGAS

SEQ ID NO: 50420 - protein, 8 aa, Mycobacterium avium
ASGAVGED

SEQ ID NO: 50421 - protein, 18 aa, Mycobacterium avium
ASGDPTSGPAGVPPARKE

SEQ ID NO: 50422 - protein, 6 aa, Mycobacterium avium
ASGEPT

SEQ ID NO: 50423 - protein, 8 aa, Mycobacterium avium
ASGGPFRG

SEQ ID NO: 50424 - protein, 7 aa, Mycobacterium avium
ASGIGQA

SEQ ID NO: 50425 - protein, 7 aa, Mycobacterium avium
ASGMGRA

SEQ ID NO: 50426 - protein, 5 aa, Mycobacterium avium
ASGRG

SEQ ID NO: 50427 - protein, 4 aa, Mycobacterium avium
ASGY

SEQ ID NO: 50428 - protein, 4 aa, Mycobacterium avium
ASKA

SEQ ID NO: 50429 - protein, 6 aa, Mycobacterium avium
ASKAAL

SEQ ID NO: 50430 - protein, 8 aa, Mycobacterium avium
ASKAELAQ

SEQ ID NO: 50431 - protein, 12 aa, Mycobacterium avium
ASKGVERATEKG

SEQ ID NO: 50432 - protein, 6 aa, Mycobacterium avium
ASKYGL

SEQ ID NO: 50433 - protein, 11 aa, Mycobacterium avium
ASLKDGRATLA

SEQ ID NO: 50434 - protein, 16 aa, Mycobacterium avium
ASLNEATSDADGFHRR

SEQ ID NO: 50435 - protein, 4 aa, Mycobacterium avium
ASLP

SEQ ID NO: 50436 - protein, 7 aa, Mycobacterium avium
ASLPEEA

SEQ ID NO: 50437 - protein, 10 aa, Mycobacterium avium
ASLQSKQSQL

SEQ ID NO: 50438 - protein, 8 aa, Mycobacterium avium
ASLREARR

SEQ ID NO: 50439 - protein, 9 aa, Mycobacterium avium
ASLSDTVGR

SEQ ID NO: 50440 - protein, 8 aa, Mycobacterium avium
ASLSNSGQ

SEQ ID NO: 50441 - protein, 14 aa, Mycobacterium avium
ASMGNSDRQGPLRS

SEQ ID NO: 50442 - protein, 5 aa, Mycobacterium avium
ASMRE

SEQ ID NO: 50443 - protein, 11 aa, Mycobacterium avium
ASPAPRGHVPQ

SEQ ID NO: 50444 - protein, 9 aa, Mycobacterium avium
ASPEPLSEA

SEQ ID NO: 50445 - protein, 7 aa, Mycobacterium avium
ASPGSSV

SEQ ID NO: 50446 - protein, 20 aa, Mycobacterium avium
ASPPPQNESTPFYPRSPYGA

SEQ ID NO: 50447 - protein, 7 aa, Mycobacterium avium
ASPVDYQ

SEQ ID NO: 50448 - protein, 6 aa, Mycobacterium avium
ASQDIA

SEQ ID NO: 50449 - protein, 8 aa, Mycobacterium avium
ASRADVDD

SEQ ID NO: 50450 - protein, 6 aa, Mycobacterium avium
ASRDAA

SEQ ID NO: 50451 - protein, 15 aa, Mycobacterium avium
ASRDDSVAAASRIAA

SEQ ID NO: 50452 - protein, 9 aa, Mycobacterium avium
ASRDGDVGA

SEQ ID NO: 50453 - protein, 7 aa, Mycobacterium avium
ASRDPVD

SEQ ID NO: 50454 - protein, 7 aa, Mycobacterium avium
ASRDTLT

SEQ ID NO: 50455 - protein, 21 aa, Mycobacterium avium
ASREPGKHIRRAGEDVSPGTT

SEQ ID NO: 50456 - protein, 6 aa, Mycobacterium avium
ASRGEA

SEQ ID NO: 50457 - protein, 5 aa, Mycobacterium avium
ASRPI

SEQ ID NO: 50458 - protein, 12 aa, Mycobacterium avium
ASRPPSDAALDR

SEQ ID NO: 50459 - protein, 8 aa, Mycobacterium avium
ASRRGDGH

SEQ ID NO: 50460 - protein, 50 aa, Mycobacterium avium
ASRSASNVKLASRSAADGEPAADGEPAEDGEQAEDREQAAHETTAAQEEA

SEQ ID NO: 50461 - protein, 6 aa, Mycobacterium avium
ASRTQH

SEQ ID NO: 50462 - protein, 12 aa, Mycobacterium avium
ASRYGPTGELGA

SEQ ID NO: 50463 - protein, 12 aa, Mycobacterium avium
ASSAAADPTVRP

SEQ ID NO: 50464 - protein, 28 aa, Mycobacterium avium
ASSASAAQLTPFTEPPRTTNESAGPLQS

SEQ ID NO: 50465 - protein, 47 aa, Mycobacterium avium
ASSATAGKLSPLTSPAPTNQPGGLGAQAAAVSGATATSAQTSGLQGT

SEQ ID NO: 50466 - protein, 10 aa, Mycobacterium avium
ASSDTKVRPE

SEQ ID NO: 50467 - protein, 11 aa, Mycobacterium avium
ASSGDRAPART

SEQ ID NO: 50468 - protein, 8 aa, Mycobacterium avium
ASSGEPRQ

SEQ ID NO: 50469 - protein, 9 aa, Mycobacterium avium
ASSGIGEAA

SEQ ID NO: 50470 - protein, 17 aa, Mycobacterium avium
ASSGIGEAAAKKIAEAG

SEQ ID NO: 50471 - protein, 9 aa, Mycobacterium avium
ASSGNAPIA

SEQ ID NO: 50472 - protein, 10 aa, Mycobacterium avium
ASSLPGTTPA

SEQ ID NO: 50473 - protein, 8 aa, Mycobacterium avium
ASSMTSAE

SEQ ID NO: 50474 - protein, 10 aa, Mycobacterium avium
ASSNEALRQA

SEQ ID NO: 50475 - protein, 11 aa, Mycobacterium avium
ASSNNYGSPQA

SEQ ID NO: 50476 - protein, 10 aa, Mycobacterium avium
ASSSQSSTPL

SEQ ID NO: 50477 - protein, 7 aa, Mycobacterium avium
ASSYCSG

SEQ ID NO: 50478 - protein, 5 aa, Mycobacterium avium
ASTAT

SEQ ID NO: 50479 - protein, 5 aa, Mycobacterium avium
ASTGL

SEQ ID NO: 50480 - protein, 9 aa, Mycobacterium avium
ASTPESLAA

SEQ ID NO: 50481 - protein, 8 aa, Mycobacterium avium
ASTPGCTK

SEQ ID NO: 50482 - protein, 6 aa, Mycobacterium avium
ASTVDE

SEQ ID NO: 50483 - protein, 14 aa, Mycobacterium avium
ASVEGTGGGPAVEV

SEQ ID NO: 50484 - protein, 7 aa, Mycobacterium avium
ASVNVTP

SEQ ID NO: 50485 - protein, 14 aa, Mycobacterium avium
ASVRALKGSGRPVM

SEQ ID NO: 50486 - protein, 7 aa, Mycobacterium avium
ASWPDPD

SEQ ID NO: 50487 - protein, 8 aa, Mycobacterium avium
ASWTEPKG

SEQ ID NO: 50488 - protein, 6 aa, Mycobacterium avium
ASWTSL

SEQ ID NO: 50489 - protein, 12 aa, Mycobacterium avium
ATAAAQRDGRIG

SEQ ID NO: 50490 - protein, 17 aa, Mycobacterium avium
ATAADSRAALDAGADGV

SEQ ID NO: 50491 - protein, 14 aa, Mycobacterium avium
ATADGSVGLAEPEK

SEQ ID NO: 50492 - protein, 8 aa, Mycobacterium avium
ATADPGYR

SEQ ID NO: 50493 - protein, 8 aa, Mycobacterium avium
ATAEPEDV

SEQ ID NO: 50494 - protein, 10 aa, Mycobacterium avium
ATAEVTGSDG

SEQ ID NO: 50495 - protein, 11 aa, Mycobacterium avium
ATAFTDAASAA

SEQ ID NO: 50496 - protein, 7 aa, Mycobacterium avium
ATAGAPA

SEQ ID NO: 50497 - protein, 9 aa, Mycobacterium avium
ATAGCDPQQ

SEQ ID NO: 50498 - protein, 12 aa, Mycobacterium avium
ATAGEDPDFHKQ

SEQ ID NO: 50499 - protein, 9 aa, Mycobacterium avium
ATAGGGDHR

SEQ ID NO: 50500 - protein, 10 aa, Mycobacterium avium
ATAGPAPNVK

SEQ ID NO: 50501 - protein, 6 aa, Mycobacterium avium
ATAGRF

SEQ ID NO: 50502 - protein, 4 aa, Mycobacterium avium
ATAH

SEQ ID NO: 50503 - protein, 6 aa, Mycobacterium avium
ATAISN

SEQ ID NO: 50504 - protein, 9 aa, Mycobacterium avium
ATAKEPAGN

SEQ ID NO: 50505 - protein, 6 aa, Mycobacterium avium
ATAPEP

SEQ ID NO: 50506 - protein, 11 aa, Mycobacterium avium
ATAQSAADAGR

SEQ ID NO: 50507 - protein, 17 aa, Mycobacterium avium
ATARDGNKMTAVGDFAA

SEQ ID NO: 50508 - protein, 11 aa, Mycobacterium avium
ATASAAADTDM

SEQ ID NO: 50509 - protein, 10 aa, Mycobacterium avium
ATASASPHRH

SEQ ID NO: 50510 - protein, 10 aa, Mycobacterium avium
ATASGAPAGT

SEQ ID NO: 50511 - protein, 4 aa, Mycobacterium avium
ATAV

SEQ ID NO: 50512 - protein, 5 aa, Mycobacterium avium
ATDAF

SEQ ID NO: 50513 - protein, 10 aa, Mycobacterium avium
ATDAGDWESY

SEQ ID NO: 50514 - protein, 6 aa, Mycobacterium avium
ATDDDP

SEQ ID NO: 50515 - protein, 11 aa, Mycobacterium avium
ATDEPSGEGVG

SEQ ID NO: 50516 - protein, 11 aa, Mycobacterium avium
ATDGETAQGRH

SEQ ID NO: 50517 - protein, 5 aa, Mycobacterium avium
ATDGG

SEQ ID NO: 50518 - protein, 11 aa, Mycobacterium avium
ATDKAVRGDQR

SEQ ID NO: 50519 - protein, 6 aa, Mycobacterium avium
ATDPNG

SEQ ID NO: 50520 - protein, 10 aa, Mycobacterium avium
ATDPPPGKDR

SEQ ID NO: 50521 - protein, 8 aa, Mycobacterium avium
ATDSRTAA

SEQ ID NO: 50522 - protein, 6 aa, Mycobacterium avium
ATEAAV

SEQ ID NO: 50523 - protein, 5 aa, Mycobacterium avium
ATEAD

SEQ ID NO: 50524 - protein, 8 aa, Mycobacterium avium
ATEASGEI

SEQ ID NO: 50525 - protein, 6 aa, Mycobacterium avium
ATEAVR

SEQ ID NO: 50526 - protein, 7 aa, Mycobacterium avium
ATEHSPA

SEQ ID NO: 50527 - protein, 6 aa, Mycobacterium avium
ATELDA

SEQ ID NO: 50528 - protein, 12 aa, Mycobacterium avium
ATEREPSSHADP

SEQ ID NO: 50529 - protein, 8 aa, Mycobacterium avium
ATETDGSK

SEQ ID NO: 50530 - protein, 5 aa, Mycobacterium avium
ATETG

SEQ ID NO: 50531 - protein, 5 aa, Mycobacterium avium
ATETL

SEQ ID NO: 50532 - protein, 17 aa, Mycobacterium avium
ATGAQPGGPLPPPAPDN

SEQ ID NO: 50533 - protein, 7 aa, Mycobacterium avium
ATGDGID

SEQ ID NO: 50534 - protein, 9 aa, Mycobacterium avium
ATGDPPLGE

SEQ ID NO: 50535 - protein, 9 aa, Mycobacterium avium
ATGDRTKRN

SEQ ID NO: 50536 - protein, 7 aa, Mycobacterium avium
ATGESVE

SEQ ID NO: 50537 - protein, 4 aa, Mycobacterium avium
ATGF

SEQ ID NO: 50538 - protein, 7 aa, Mycobacterium avium
ATGGPPE

SEQ ID NO: 50539 - protein, 15 aa, Mycobacterium avium
ATGIGAATAARLAGE

SEQ ID NO: 50540 - protein, 13 aa, Mycobacterium avium
ATGNDHGGGDTLA

SEQ ID NO: 50541 - protein, 8 aa, Mycobacterium avium
ATGPADGR

SEQ ID NO: 50542 - protein, 5 aa, Mycobacterium avium
ATGQR

SEQ ID NO: 50543 - protein, 12 aa, Mycobacterium avium
ATGRLSSTEPNL

SEQ ID NO: 50544 - protein, 7 aa, Mycobacterium avium
ATGTEIT

SEQ ID NO: 50545 - protein, 9 aa, Mycobacterium avium
ATGTRAHSA

SEQ ID NO: 50546 - protein, 11 aa, Mycobacterium avium
ATGYARRSGLT

SEQ ID NO: 50547 - protein, 41 aa, Mycobacterium avium
ATINPGQAAVPATGVTGLTDAASAAGGPGGVAGPVGGTGRR

SEQ ID NO: 50548 - protein, 6 aa, Mycobacterium avium
ATINPK

SEQ ID NO: 50549 - protein, 6 aa, Mycobacterium avium
ATISDN

SEQ ID NO: 50550 - protein, 7 aa, Mycobacterium avium
ATKPERL

SEQ ID NO: 50551 - protein, 6 aa, Mycobacterium avium
ATKPGA

SEQ ID NO: 50552 - protein, 4 aa, Mycobacterium avium
ATKY

SEQ ID NO: 50553 - protein, 6 aa, Mycobacterium avium
ATLEPD

SEQ ID NO: 50554 - protein, 7 aa, Mycobacterium avium
ATLERTG

SEQ ID NO: 50555 - protein, 5 aa, Mycobacterium avium
ATLGN

SEQ ID NO: 50556 - protein, 5 aa, Mycobacterium avium
ATLPK

SEQ ID NO: 50557 - protein, 12 aa, Mycobacterium avium
ATLQNDTGGPMP

SEQ ID NO: 50558 - protein, 8 aa, Mycobacterium avium
ATLSRSAS

SEQ ID NO: 50559 - protein, 7 aa, Mycobacterium avium
ATMQRTN

SEQ ID NO: 50560 - protein, 19 aa, Mycobacterium avium
ATNAADSGTQTGVAGTLQA

SEQ ID NO: 50561 - protein, 10 aa, Mycobacterium avium
ATNAEGANMD

SEQ ID NO: 50562 - protein, 9 aa, Mycobacterium avium
ATNLPTTKN

SEQ ID NO: 50563 - protein, 11 aa, Mycobacterium avium
ATNPAAGTAAE

SEQ ID NO: 50564 - protein, 8 aa, Mycobacterium avium
ATNYTGPQ

SEQ ID NO: 50565 - protein, 9 aa, Mycobacterium avium
ATPAAAGEP

SEQ ID NO: 50566 - protein, 11 aa, Mycobacterium avium
ATPAGSPENHV

SEQ ID NO: 50567 - protein, 9 aa, Mycobacterium avium
ATPDAVQQK

SEQ ID NO: 50568 - protein, 8 aa, Mycobacterium avium
ATPGAGTL

SEQ ID NO: 50569 - protein, 6 aa, Mycobacterium avium
ATPGPH

SEQ ID NO: 50570 - protein, 7 aa, Mycobacterium avium
ATPNDGQ

SEQ ID NO: 50571 - protein, 5 aa, Mycobacterium avium
ATPPR

SEQ ID NO: 50572 - protein, 5 aa, Mycobacterium avium
ATPPV

SEQ ID NO: 50573 - protein, 6 aa, Mycobacterium avium
ATPQPD

SEQ ID NO: 50574 - protein, 10 aa, Mycobacterium avium
ATPSKTAQTA

SEQ ID NO: 50575 - protein, 10 aa, Mycobacterium avium
ATPSPAAPFT

SEQ ID NO: 50576 - protein, 15 aa, Mycobacterium avium
ATPVGGPYPEMHQKA

SEQ ID NO: 50577 - protein, 9 aa, Mycobacterium avium
ATPVSGKDA

SEQ ID NO: 50578 - protein, 6 aa, Mycobacterium avium
ATQEST

SEQ ID NO: 50579 - protein, 4 aa, Mycobacterium avium
ATQF

SEQ ID NO: 50580 - protein, 7 aa, Mycobacterium avium
ATRAEEG

SEQ ID NO: 50581 - protein, 10 aa, Mycobacterium avium
ATRDGYSSSF

SEQ ID NO: 50582 - protein, 20 aa, Mycobacterium avium
ATRERAEADLANQGTRYRPE

SEQ ID NO: 50583 - protein, 20 aa, Mycobacterium avium
ATRERAEADLAREATRYRPE

SEQ ID NO: 50584 - protein, 20 aa, Mycobacterium avium
ATRERAEADLAREGTRYRPE

SEQ ID NO: 50585 - protein, 21 aa, Mycobacterium avium
ATRERAETDLANQGGQYRPEQ

SEQ ID NO: 50586 - protein, 20 aa, Mycobacterium avium
ATRERAETDLAREGTRYRPE

SEQ ID NO: 50587 - protein, 11 aa, Mycobacterium avium
ATRGLESALGN

SEQ ID NO: 50588 - protein, 19 aa, Mycobacterium avium
ATRPEASVARAADQLRRRG

SEQ ID NO: 50589 - protein, 5 aa, Mycobacterium avium
ATRQG

SEQ ID NO: 50590 - protein, 16 aa, Mycobacterium avium
ATRRAGRARDPDAAQE

SEQ ID NO: 50591 - protein, 11 aa, Mycobacterium avium
ATRRAKPEEDL

SEQ ID NO: 50592 - protein, 10 aa, Mycobacterium avium
ATRRLGGRPP

SEQ ID NO: 50593 - protein, 8 aa, Mycobacterium avium
ATSGAGGL

SEQ ID NO: 50594 - protein, 12 aa, Mycobacterium avium
ATSQISYTAAKG

SEQ ID NO: 50595 - protein, 10 aa, Mycobacterium avium
ATSREGKAQV

SEQ ID NO: 50596 - protein, 7 aa, Mycobacterium avium
ATSSDVD

SEQ ID NO: 50597 - protein, 6 aa, Mycobacterium avium
ATSTDE

SEQ ID NO: 50598 - protein, 6 aa, Mycobacterium avium
ATSTTC

SEQ ID NO: 50599 - protein, 13 aa, Mycobacterium avium
ATTPSAAAATPAA

SEQ ID NO: 50600 - protein, 7 aa, Mycobacterium avium
ATTPSQL

SEQ ID NO: 50601 - protein, 6 aa, Mycobacterium avium
ATTQAA

SEQ ID NO: 50602 - protein, 16 aa, Mycobacterium avium
ATTSSRDVDTAKPEPG

SEQ ID NO: 50603 - protein, 5 aa, Mycobacterium avium
ATTST

SEQ ID NO: 50604 - protein, 10 aa, Mycobacterium avium
ATTTAPYQAG

SEQ ID NO: 50605 - protein, 5 aa, Mycobacterium avium
ATVPP

SEQ ID NO: 50606 - protein, 12 aa, Mycobacterium avium
ATYHDDHGTFSP

SEQ ID NO: 50607 - protein, 7 aa, Mycobacterium avium
AVAGTRR

SEQ ID NO: 50608 - protein, 4 aa, Mycobacterium avium
AVAP

SEQ ID NO: 50609 - protein, 6 aa, Mycobacterium avium
AVAPDD

SEQ ID NO: 50610 - protein, 10 aa, Mycobacterium avium
AVAPGVTTDE

SEQ ID NO: 50611 - protein, 5 aa, Mycobacterium avium
AVATR

SEQ ID NO: 50612 - protein, 5 aa, Mycobacterium avium
AVDAD

SEQ ID NO: 50613 - protein, 7 aa, Mycobacterium avium
AVDRDQI

SEQ ID NO: 50614 - protein, 6 aa, Mycobacterium avium
AVDSPE

SEQ ID NO: 50615 - protein, 5 aa, Mycobacterium avium
AVDSR

SEQ ID NO: 50616 - protein, 12 aa, Mycobacterium avium
AVDTPPQTTRAR

SEQ ID NO: 50617 - protein, 9 aa, Mycobacterium avium
AVEAQPGTA

SEQ ID NO: 50618 - protein, 5 aa, Mycobacterium avium
AVEGR

SEQ ID NO: 50619 - protein, 12 aa, Mycobacterium avium
AVEPGQPLDQQE

SEQ ID NO: 50620 - protein, 13 aa, Mycobacterium avium
AVEPPAKTAAGTW

SEQ ID NO: 50621 - protein, 7 aa, Mycobacterium avium
AVGERAS

SEQ ID NO: 50622 - protein, 13 aa, Mycobacterium avium
AVGGMASSRSQLG

SEQ ID NO: 50623 - protein, 9 aa, Mycobacterium avium
AVGGTVGRH

SEQ ID NO: 50624 - protein, 12 aa, Mycobacterium avium
AVGPDAKAESRA

SEQ ID NO: 50625 - protein, 15 aa, Mycobacterium avium
AVGPDDTYASAGQLS

SEQ ID NO: 50626 - protein, 9 aa, Mycobacterium avium
AVGPRDNDS

SEQ ID NO: 50627 - protein, 6 aa, Mycobacterium avium
AVKPEE

SEQ ID NO: 50628 - protein, 31 aa, Mycobacterium avium
AVKSADRGRPTDGAAASNRRGNRLPRDERRG

SEQ ID NO: 50629 - protein, 11 aa, Mycobacterium avium
AVNPGTVDAAG

SEQ ID NO: 50630 - protein, 10 aa, Mycobacterium avium
AVNRGNAAQA

SEQ ID NO: 50631 - protein, 4 aa, Mycobacterium avium
AVPA

SEQ ID NO: 50632 - protein, 9 aa, Mycobacterium avium
AVPAGHGSK

SEQ ID NO: 50633 - protein, 6 aa, Mycobacterium avium
AVPAGI

SEQ ID NO: 50634 - protein, 15 aa, Mycobacterium avium
AVPGAAAAAGTSTAA

SEQ ID NO: 50635 - protein, 14 aa, Mycobacterium avium
AVPHGPDQVKQNED

SEQ ID NO: 50636 - protein, 6 aa, Mycobacterium avium
AVPIPY

SEQ ID NO: 50637 - protein, 8 aa, Mycobacterium avium
AVPRTDRG

SEQ ID NO: 50638 - protein, 7 aa, Mycobacterium avium
AVPSRDI

SEQ ID NO: 50639 - protein, 7 aa, Mycobacterium avium
AVPTASA

SEQ ID NO: 50640 - protein, 5 aa, Mycobacterium avium
AVPTP

SEQ ID NO: 50641 - protein, 18 aa, Mycobacterium avium
AVQAEQTAAQATAAAAAY

SEQ ID NO: 50642 - protein, 4 aa, Mycobacterium avium
AVQD

SEQ ID NO: 50643 - protein, 10 aa, Mycobacterium avium
AVQGDAANLD

SEQ ID NO: 50644 - protein, 10 aa, Mycobacterium avium
AVQTAEPTAT

SEQ ID NO: 50645 - protein, 8 aa, Mycobacterium avium
AVRGRGGL

SEQ ID NO: 50646 - protein, 12 aa, Mycobacterium avium
AVTADEPAWSTW

SEQ ID NO: 50647 - protein, 13 aa, Mycobacterium avium
AVTATDGQARPPA

SEQ ID NO: 50648 - protein, 12 aa, Mycobacterium avium
AVTEASEKAPMS

SEQ ID NO: 50649 - protein, 9 aa, Mycobacterium avium
AVTSPQGRF

SEQ ID NO: 50650 - protein, 9 aa, Mycobacterium avium
AVTSTGRPL

SEQ ID NO: 50651 - protein, 6 aa, Mycobacterium avium
AVTTAE

SEQ ID NO: 50652 - protein, 13 aa, Mycobacterium avium
AVVTGAGGDGLGQ

SEQ ID NO: 50653 - protein, 5 aa, Mycobacterium avium
AVYGE

SEQ ID NO: 50654 - protein, 29 aa, Mycobacterium avium
AVYGSRNPYRQPERITPDTPVNPIDQYGQ

SEQ ID NO: 50655 - protein, 10 aa, Mycobacterium avium
AWAAGDPEGY

SEQ ID NO: 50656 - protein, 9 aa, Mycobacterium avium
AWAGPSAAA

SEQ ID NO: 50657 - protein, 7 aa, Mycobacterium avium
AWGPRSS

SEQ ID NO: 50658 - protein, 5 aa, Mycobacterium avium
AWPAA

SEQ ID NO: 50659 - protein, 13 aa, Mycobacterium avium
AWPGGRAGRRDID

SEQ ID NO: 50660 - protein, 9 aa, Mycobacterium avium
AWPPEHRPA

SEQ ID NO: 50661 - protein, 4 aa, Mycobacterium avium
AWRE

SEQ ID NO: 50662 - protein, 13 aa, Mycobacterium avium
AYADAAEARGTWD

SEQ ID NO: 50663 - protein, 10 aa, Mycobacterium avium
AYAEGDDDEL

SEQ ID NO: 50664 - protein, 13 aa, Mycobacterium avium
AYARGGEKTPEGV

SEQ ID NO: 50665 - protein, 15 aa, Mycobacterium avium
AYDGGEVTLNSTDPF

SEQ ID NO: 50666 - protein, 4 aa, Mycobacterium avium
AYDS

SEQ ID NO: 50667 - protein, 11 aa, Mycobacterium avium
AYGAQKAGVDK

SEQ ID NO: 50668 - protein, 5 aa, Mycobacterium avium
AYGDE

SEQ ID NO: 50669 - protein, 9 aa, Mycobacterium avium
AYGTSDTVY

SEQ ID NO: 50670 - protein, 7 aa, Mycobacterium avium
AYPDGLP

SEQ ID NO: 50671 - protein, 9 aa, Mycobacterium avium
AYPPGLAEP

SEQ ID NO: 50672 - protein, 14 aa, Mycobacterium avium
AYRRSPRAPAPGTS

SEQ ID NO: 50673 - protein, 12 aa, Mycobacterium avium
AYSARSPHEPRL

SEQ ID NO: 50674 - protein, 14 aa, Mycobacterium avium
AYSDDDGIVVVAAG

SEQ ID NO: 50675 - protein, 4 aa, Mycobacterium avium
AYSP

SEQ ID NO: 50676 - protein, 5 aa, Mycobacterium avium
AYSPR

SEQ ID NO: 50677 - protein, 10 aa, Mycobacterium avium
CAAGTRPAAG

SEQ ID NO: 50678 - protein, 6 aa, Mycobacterium avium
CAEHDA

SEQ ID NO: 50679 - protein, 6 aa, Mycobacterium avium
CCDGSS

SEQ ID NO: 50680 - protein, 7 aa, Mycobacterium avium
CDDDDAG

SEQ ID NO: 50681 - protein, 4 aa, Mycobacterium avium
CDPQ

SEQ ID NO: 50682 - protein, 5 aa, Mycobacterium avium
CEAGG

SEQ ID NO: 50683 - protein, 5 aa, Mycobacterium avium
CEPAE

SEQ ID NO: 50684 - protein, 5 aa, Mycobacterium avium
CGATR

SEQ ID NO: 50685 - protein, 8 aa, Mycobacterium avium
CGDGLTPR

SEQ ID NO: 50686 - protein, 10 aa, Mycobacterium avium
CGDPQDPGTL

SEQ ID NO: 50687 - protein, 6 aa, Mycobacterium avium
CGGAGA

SEQ ID NO: 50688 - protein, 7 aa, Mycobacterium avium
CGPDDYG

SEQ ID NO: 50689 - protein, 4 aa, Mycobacterium avium
CGPE

SEQ ID NO: 50690 - protein, 6 aa, Mycobacterium avium
CGPHSG

SEQ ID NO: 50691 - protein, 5 aa, Mycobacterium avium
CGPQS

SEQ ID NO: 50692 - protein, 10 aa, Mycobacterium avium
CGPTQTPDDI

SEQ ID NO: 50693 - protein, 17 aa, Mycobacterium avium
CGRTPLTATGLSKSYGS

SEQ ID NO: 50694 - protein, 4 aa, Mycobacterium avium
CGSD

SEQ ID NO: 50695 - protein, 4 aa, Mycobacterium avium
CGSG

SEQ ID NO: 50696 - protein, 8 aa, Mycobacterium avium
CGSGFGTG

SEQ ID NO: 50697 - protein, 5 aa, Mycobacterium avium
CGSPL

SEQ ID NO: 50698 - protein, 7 aa, Mycobacterium avium
CGTPGAP

SEQ ID NO: 50699 - protein, 5 aa, Mycobacterium avium
CGTPV

SEQ ID NO: 50700 - protein, 9 aa, Mycobacterium avium
CHRDGQDPR

SEQ ID NO: 50701 - protein, 11 aa, Mycobacterium avium
CPDQPSRRPRR

SEQ ID NO: 50702 - protein, 4 aa, Mycobacterium avium
CPGE

SEQ ID NO: 50703 - protein, 18 aa, Mycobacterium avium
CPGGESVAQVSGRADAAV

SEQ ID NO: 50704 - protein, 6 aa, Mycobacterium avium
CPLNDG

SEQ ID NO: 50705 - protein, 11 aa, Mycobacterium avium
CPPQSTADRNP

SEQ ID NO: 50706 - protein, 14 aa, Mycobacterium avium
CPRARSSPPVSRAS

SEQ ID NO: 50707 - protein, 22 aa, Mycobacterium avium
CQDGRGGSSHHSSIGPRRQCLH

SEQ ID NO: 50708 - protein, 8 aa, Mycobacterium avium
CQGRQVDD

SEQ ID NO: 50709 - protein, 7 aa, Mycobacterium avium
CQRGGSS

SEQ ID NO: 50710 - protein, 6 aa, Mycobacterium avium
CQSPDD

SEQ ID NO: 50711 - protein, 8 aa, Mycobacterium avium
CREDADGV

SEQ ID NO: 50712 - protein, 7 aa, Mycobacterium avium
CRNGDGG

SEQ ID NO: 50713 - protein, 9 aa, Mycobacterium avium
CRSTDPRKS

SEQ ID NO: 50714 - protein, 4 aa, Mycobacterium avium
CRTT

SEQ ID NO: 50715 - protein, 7 aa, Mycobacterium avium
CSASGDW

SEQ ID NO: 50716 - protein, 8 aa, Mycobacterium avium
CSGAETHR

SEQ ID NO: 50717 - protein, 6 aa, Mycobacterium avium
CSHDGP

SEQ ID NO: 50718 - protein, 5 aa, Mycobacterium avium
CSNDD

SEQ ID NO: 50719 - protein, 4 aa, Mycobacterium avium
CTAA

SEQ ID NO: 50720 - protein, 9 aa, Mycobacterium avium
CTGKGNDQV

SEQ ID NO: 50721 - protein, 4 aa, Mycobacterium avium
CTST

SEQ ID NO: 50722 - protein, 5 aa, Mycobacterium avium
CTVTE

SEQ ID NO: 50723 - protein, 11 aa, Mycobacterium avium
DAAAAAARTPD

SEQ ID NO: 50724 - protein, 5 aa, Mycobacterium avium
DAAAN

SEQ ID NO: 50725 - protein, 8 aa, Mycobacterium avium
DAAATRVD

SEQ ID NO: 50726 - protein, 26 aa, Mycobacterium avium
DAAAVPDLTQPGKITPPTAQHATRQG

SEQ ID NO: 50727 - protein, 9 aa, Mycobacterium avium
DAAAVSRKT

SEQ ID NO: 50728 - protein, 6 aa, Mycobacterium avium
DAAERN

SEQ ID NO: 50729 - protein, 8 aa, Mycobacterium avium
DAAFQQST

SEQ ID NO: 50730 - protein, 7 aa, Mycobacterium avium
DAAGGVT

SEQ ID NO: 50731 - protein, 6 aa, Mycobacterium avium
DAAGRG

SEQ ID NO: 50732 - protein, 7 aa, Mycobacterium avium
DAAPGAG

SEQ ID NO: 50733 - protein, 7 aa, Mycobacterium avium
DAAPVTQ

SEQ ID NO: 50734 - protein, 10 aa, Mycobacterium avium
DAAQASESGQ

SEQ ID NO: 50735 - protein, 12 aa, Mycobacterium avium
DAARAARRVGAQ

SEQ ID NO: 50736 - protein, 9 aa, Mycobacterium avium
DAARAAVSR

SEQ ID NO: 50737 - protein, 9 aa, Mycobacterium avium
DAARHDPGD

SEQ ID NO: 50738 - protein, 5 aa, Mycobacterium avium
DAARR

SEQ ID NO: 50739 - protein, 8 aa, Mycobacterium avium
DAARRGPI

SEQ ID NO: 50740 - protein, 9 aa, Mycobacterium avium
DAATEPAYT

SEQ ID NO: 50741 - protein, 9 aa, Mycobacterium avium
DAATPSDVD

SEQ ID NO: 50742 - protein, 9 aa, Mycobacterium avium
DACGAAGSQ

SEQ ID NO: 50743 - protein, 7 aa, Mycobacterium avium
DADFGAR

SEQ ID NO: 50744 - protein, 9 aa, Mycobacterium avium
DADPAYADE

SEQ ID NO: 50745 - protein, 11 aa, Mycobacterium avium
DADPPDDRIGA

SEQ ID NO: 50746 - protein, 13 aa, Mycobacterium avium
DADQRPDQVAGNT

SEQ ID NO: 50747 - protein, 8 aa, Mycobacterium avium
DADRNGTM

SEQ ID NO: 50748 - protein, 12 aa, Mycobacterium avium
DAEAARRPHGQH

SEQ ID NO: 50749 - protein, 4 aa, Mycobacterium avium
DAED

SEQ ID NO: 50750 - protein, 9 aa, Mycobacterium avium
DAEDPTTSD

SEQ ID NO: 50751 - protein, 7 aa, Mycobacterium avium
DAEPRQR

SEQ ID NO: 50752 - protein, 5 aa, Mycobacterium avium
DAEPS

SEQ ID NO: 50753 - protein, 7 aa, Mycobacterium avium
DAESEFR

SEQ ID NO: 50754 - protein, 18 aa, Mycobacterium avium
DAESTPAAGEVDDGTGPM

SEQ ID NO: 50755 - protein, 7 aa, Mycobacterium avium
DAESVGY

SEQ ID NO: 50756 - protein, 4 aa, Mycobacterium avium
DAET

SEQ ID NO: 50757 - protein, 8 aa, Mycobacterium avium
DAETRPDE

SEQ ID NO: 50758 - protein, 6 aa, Mycobacterium avium
DAFPPA

SEQ ID NO: 50759 - protein, 7 aa, Mycobacterium avium
DAGAQDA

SEQ ID NO: 50760 - protein, 4 aa, Mycobacterium avium
DAGG

SEQ ID NO: 50761 - protein, 20 aa, Mycobacterium avium
DAGGGDEQLRQAREQTYAGT

SEQ ID NO: 50762 - protein, 14 aa, Mycobacterium avium
DAGGQESAVAGAQR

SEQ ID NO: 50763 - protein, 7 aa, Mycobacterium avium
DAGGYKA

SEQ ID NO: 50764 - protein, 8 aa, Mycobacterium avium
DAGIDPRT

SEQ ID NO: 50765 - protein, 20 aa, Mycobacterium avium
DAGIDTSRRTARPLAAPPVR

SEQ ID NO: 50766 - protein, 14 aa, Mycobacterium avium
DAGLTSSSWARGPH

SEQ ID NO: 50767 - protein, 6 aa, Mycobacterium avium
DAGWTE

SEQ ID NO: 50768 - protein, 14 aa, Mycobacterium avium
DAIDGEVRRVEIPP

SEQ ID NO: 50769 - protein, 7 aa, Mycobacterium avium
DAIRDTA

SEQ ID NO: 50770 - protein, 9 aa, Mycobacterium avium
DAKAGRDAG

SEQ ID NO: 50771 - protein, 11 aa, Mycobacterium avium
DAKTALGGTDI

SEQ ID NO: 50772 - protein, 15 aa, Mycobacterium avium
DAKTDRAALTGGTPF

SEQ ID NO: 50773 - protein, 13 aa, Mycobacterium avium
DAKVAGSPAELAA

SEQ ID NO: 50774 - protein, 4 aa, Mycobacterium avium
DALG

SEQ ID NO: 50775 - protein, 13 aa, Mycobacterium avium
DALPAVGRRGQQR

SEQ ID NO: 50776 - protein, 6 aa, Mycobacterium avium
DALPGA

SEQ ID NO: 50777 - protein, 18 aa, Mycobacterium avium
DALPPTMTYGSRSDSRAC

SEQ ID NO: 50778 - protein, 8 aa, Mycobacterium avium
DALRDAAT

SEQ ID NO: 50779 - protein, 6 aa, Mycobacterium avium
DANNPL

SEQ ID NO: 50780 - protein, 32 aa, Mycobacterium avium
DAPAESPPNPVIETPEPPTESLKTSSSASRRV

SEQ ID NO: 50781 - protein, 5 aa, Mycobacterium avium
DAPDF

SEQ ID NO: 50782 - protein, 9 aa, Mycobacterium avium
DAPDPEGAG

SEQ ID NO: 50783 - protein, 5 aa, Mycobacterium avium
DAPGF

SEQ ID NO: 50784 - protein, 7 aa, Mycobacterium avium
DAPQEIG

SEQ ID NO: 50785 - protein, 16 aa, Mycobacterium avium
DAPRAPMMPATWDGSK

SEQ ID NO: 50786 - protein, 10 aa, Mycobacterium avium
DAPRVENGTQ

SEQ ID NO: 50787 - protein, 7 aa, Mycobacterium avium
DAPTTDR

SEQ ID NO: 50788 - protein, 9 aa, Mycobacterium avium
DAQGNSAGL

SEQ ID NO: 50789 - protein, 4 aa, Mycobacterium avium
DAQQ

SEQ ID NO: 50790 - protein, 5 aa, Mycobacterium avium
DAQTP

SEQ ID NO: 50791 - protein, 6 aa, Mycobacterium avium
DARDGT

SEQ ID NO: 50792 - protein, 5 aa, Mycobacterium avium
DARTL

SEQ ID NO: 50793 - protein, 4 aa, Mycobacterium avium
DASD

SEQ ID NO: 50794 - protein, 12 aa, Mycobacterium avium
DASDNQTPVPDR

SEQ ID NO: 50795 - protein, 8 aa, Mycobacterium avium
DASGERFR

SEQ ID NO: 50796 - protein, 9 aa, Mycobacterium avium
DASGGTGFS

SEQ ID NO: 50797 - protein, 18 aa, Mycobacterium avium
DASKKGEIPDPQDPQTFA

SEQ ID NO: 50798 - protein, 9 aa, Mycobacterium avium
DATESQREI

SEQ ID NO: 50799 - protein, 7 aa, Mycobacterium avium
DATGDPA

SEQ ID NO: 50800 - protein, 8 aa, Mycobacterium avium
DATNGVDP

SEQ ID NO: 50801 - protein, 6 aa, Mycobacterium avium
DATPHV

SEQ ID NO: 50802 - protein, 4 aa, Mycobacterium avium
DATS

SEQ ID NO: 50803 - protein, 11 aa, Mycobacterium avium
DAVDRQRVGER

SEQ ID NO: 50804 - protein, 5 aa, Mycobacterium avium
DAVRN

SEQ ID NO: 50805 - protein, 16 aa, Mycobacterium avium
DAVRRSQQSRGEDPSL

SEQ ID NO: 50806 - protein, 6 aa, Mycobacterium avium
DAYRPT

SEQ ID NO: 50807 - protein, 7 aa, Mycobacterium avium
DDAAAVR

SEQ ID NO: 50808 - protein, 7 aa, Mycobacterium avium
DDAADLS

SEQ ID NO: 50809 - protein, 11 aa, Mycobacterium avium
DDAAGEATAHT

SEQ ID NO: 50810 - protein, 6 aa, Mycobacterium avium
DDAEFT

SEQ ID NO: 50811 - protein, 23 aa, Mycobacterium avium
DDAGGRTAAQLSPAEKDAVSHRG

SEQ ID NO: 50812 - protein, 10 aa, Mycobacterium avium
DDAGLTPADV

SEQ ID NO: 50813 - protein, 15 aa, Mycobacterium avium
DDAHERTQRQRYERR

SEQ ID NO: 50814 - protein, 7 aa, Mycobacterium avium
DDALGAA

SEQ ID NO: 50815 - protein, 7 aa, Mycobacterium avium
DDAQDAV

SEQ ID NO: 50816 - protein, 7 aa, Mycobacterium avium
DDARGDA

SEQ ID NO: 50817 - protein, 5 aa, Mycobacterium avium
DDAVT

SEQ ID NO: 50818 - protein, 9 aa, Mycobacterium avium
DDDADERSL

SEQ ID NO: 50819 - protein, 7 aa, Mycobacterium avium
DDDAGRA

SEQ ID NO: 50820 - protein, 7 aa, Mycobacterium avium
DDDAPVA

SEQ ID NO: 50821 - protein, 9 aa, Mycobacterium avium
DDDDGSQDY

SEQ ID NO: 50822 - protein, 4 aa, Mycobacterium avium
DDDE

SEQ ID NO: 50823 - protein, 8 aa, Mycobacterium avium
DDDGNVVP

SEQ ID NO: 50824 - protein, 5 aa, Mycobacterium avium
DDDGS

SEQ ID NO: 50825 - protein, 8 aa, Mycobacterium avium
DDDPATLR

SEQ ID NO: 50826 - protein, 8 aa, Mycobacterium avium
DDDPEDAL

SEQ ID NO: 50827 - protein, 9 aa, Mycobacterium avium
DDDPRRVSD

SEQ ID NO: 50828 - protein, 4 aa, Mycobacterium avium
DDDQ

SEQ ID NO: 50829 - protein, 26 aa, Mycobacterium avium
DDDRTRAAAAGPICPDPSAHRADRVA

SEQ ID NO: 50830 - protein, 16 aa, Mycobacterium avium
DDEDTPVGAEIPEPDP

SEQ ID NO: 50831 - protein, 13 aa, Mycobacterium avium
DDELTERLRESKE

SEQ ID NO: 50832 - protein, 5 aa, Mycobacterium avium
DDFGD

SEQ ID NO: 50833 - protein, 6 aa, Mycobacterium avium
DDGADG

SEQ ID NO: 50834 - protein, 6 aa, Mycobacterium avium
DDGAGG

SEQ ID NO: 50835 - protein, 7 aa, Mycobacterium avium
DDGALSG

SEQ ID NO: 50836 - protein, 15 aa, Mycobacterium avium
DDGRAAAEKIETPPW

SEQ ID NO: 50837 - protein, 10 aa, Mycobacterium avium
DDGSGDGGEA

SEQ ID NO: 50838 - protein, 10 aa, Mycobacterium avium
DDGSGRTYQL

SEQ ID NO: 50839 - protein, 6 aa, Mycobacterium avium
DDGVTQ

SEQ ID NO: 50840 - protein, 7 aa, Mycobacterium avium
DDGYAEA

SEQ ID NO: 50841 - protein, 11 aa, Mycobacterium avium
DDIPPPARPSV

SEQ ID NO: 50842 - protein, 17 aa, Mycobacterium avium
DDKGPAEADTIDAVRAL

SEQ ID NO: 50843 - protein, 6 aa, Mycobacterium avium
DDLAPE

SEQ ID NO: 50844 - protein, 4 aa, Mycobacterium avium
DDLN

SEQ ID NO: 50845 - protein, 23 aa, Mycobacterium avium
DDNGQQRTSTFGEGELVRRYAKA

SEQ ID NO: 50846 - protein, 10 aa, Mycobacterium avium
DDNPGRRKQP

SEQ ID NO: 50847 - protein, 9 aa, Mycobacterium avium
DDPAAQHAA

SEQ ID NO: 50848 - protein, 9 aa, Mycobacterium avium
DDPADAEVP

SEQ ID NO: 50849 - protein, 8 aa, Mycobacterium avium
DDPAERGL

SEQ ID NO: 50850 - protein, 17 aa, Mycobacterium avium
DDPALPEPLPDGPVRRA

SEQ ID NO: 50851 - protein, 5 aa, Mycobacterium avium
DDPAR

SEQ ID NO: 50852 - protein, 10 aa, Mycobacterium avium
DDPDDAPPRL

SEQ ID NO: 50853 - protein, 7 aa, Mycobacterium avium
DDPDHDM

SEQ ID NO: 50854 - protein, 7 aa, Mycobacterium avium
DDPGRQG

SEQ ID NO: 50855 - protein, 4 aa, Mycobacterium avium
DDPL

SEQ ID NO: 50856 - protein, 4 aa, Mycobacterium avium
DDPN

SEQ ID NO: 50857 - protein, 6 aa, Mycobacterium avium
DDPSLT

SEQ ID NO: 50858 - protein, 12 aa, Mycobacterium avium
DDPTGRSLYDSG

SEQ ID NO: 50859 - protein, 7 aa, Mycobacterium avium
DDQPDPW

SEQ ID NO: 50860 - protein, 6 aa, Mycobacterium avium
DDREAA

SEQ ID NO: 50861 - protein, 9 aa, Mycobacterium avium
DDRNTGIER

SEQ ID NO: 50862 - protein, 20 aa, Mycobacterium avium
DDRPVAERAEAKQISSESTF

SEQ ID NO: 50863 - protein, 17 aa, Mycobacterium avium
DDSATTQAGKTLGPIDT

SEQ ID NO: 50864 - protein, 7 aa, Mycobacterium avium
DDSGYVD

SEQ ID NO: 50865 - protein, 13 aa, Mycobacterium avium
DDSLAEPRAPYPH

SEQ ID NO: 50866 - protein, 7 aa, Mycobacterium avium
DDTARAS

SEQ ID NO: 50867 - protein, 7 aa, Mycobacterium avium
DDTPEGF

SEQ ID NO: 50868 - protein, 5 aa, Mycobacterium avium
DDTRS

SEQ ID NO: 50869 - protein, 4 aa, Mycobacterium avium
DDVG

SEQ ID NO: 50870 - protein, 11 aa, Mycobacterium avium
DDVPDAARRRL

SEQ ID NO: 50871 - protein, 4 aa, Mycobacterium avium
DDYP

SEQ ID NO: 50872 - protein, 10 aa, Mycobacterium avium
DEAAAARTEE

SEQ ID NO: 50873 - protein, 7 aa, Mycobacterium avium
DEAAREK

SEQ ID NO: 50874 - protein, 6 aa, Mycobacterium avium
DEAERT

SEQ ID NO: 50875 - protein, 12 aa, Mycobacterium avium
DEAKAAADEAAV

SEQ ID NO: 50876 - protein, 5 aa, Mycobacterium avium
DEANK

SEQ ID NO: 50877 - protein, 9 aa, Mycobacterium avium
DEANSPVSE

SEQ ID NO: 50878 - protein, 6 aa, Mycobacterium avium
DEASVP

SEQ ID NO: 50879 - protein, 15 aa, Mycobacterium avium
DEAWARSEQEHRDRD

SEQ ID NO: 50880 - protein, 16 aa, Mycobacterium avium
DEDALTEARGASYDAR

SEQ ID NO: 50881 - protein, 10 aa, Mycobacterium avium
DEDYTGRPFR

SEQ ID NO: 50882 - protein, 6 aa, Mycobacterium avium
DEEATR

SEQ ID NO: 50883 - protein, 7 aa, Mycobacterium avium
DEESASE

SEQ ID NO: 50884 - protein, 18 aa, Mycobacterium avium
DEFGTGPSMPMVPGNWTG

SEQ ID NO: 50885 - protein, 5 aa, Mycobacterium avium
DEGAG

SEQ ID NO: 50886 - protein, 11 aa, Mycobacterium avium
DEGDPSVDKRN

SEQ ID NO: 50887 - protein, 11 aa, Mycobacterium avium
DEGDSKIGRPR

SEQ ID NO: 50888 - protein, 28 aa, Mycobacterium avium
DEGLAPGVTTAESKRVQELEQENRELKR

SEQ ID NO: 50889 - protein, 4 aa, Mycobacterium avium
DEGR

SEQ ID NO: 50890 - protein, 5 aa, Mycobacterium avium
DEGSQ

SEQ ID NO: 50891 - protein, 6 aa, Mycobacterium avium
DEHGQP

SEQ ID NO: 50892 - protein, 12 aa, Mycobacterium avium
DEHPRRGSSMES

SEQ ID NO: 50893 - protein, 6 aa, Mycobacterium avium
DEIDGP

SEQ ID NO: 50894 - protein, 4 aa, Mycobacterium avium
DEIP

SEQ ID NO: 50895 - protein, 9 aa, Mycobacterium avium
DEKKTAETF

SEQ ID NO: 50896 - protein, 14 aa, Mycobacterium avium
DELADRAGLPDADP

SEQ ID NO: 50897 - protein, 11 aa, Mycobacterium avium
DELDRAGIGAA

SEQ ID NO: 50898 - protein, 5 aa, Mycobacterium avium
DELDT

SEQ ID NO: 50899 - protein, 7 aa, Mycobacterium avium
DELGRSN

SEQ ID NO: 50900 - protein, 4 aa, Mycobacterium avium
DELR

SEQ ID NO: 50901 - protein, 17 aa, Mycobacterium avium
DELSAGRARRCPAGSGT

SEQ ID NO: 50902 - protein, 5 aa, Mycobacterium avium
DELTA

SEQ ID NO: 50903 - protein, 8 aa, Mycobacterium avium
DELTDGEH

SEQ ID NO: 50904 - protein, 7 aa, Mycobacterium avium
DELTGAP

SEQ ID NO: 50905 - protein, 10 aa, Mycobacterium avium
DENDPVATDA

SEQ ID NO: 50906 - protein, 10 aa, Mycobacterium avium
DENKQPTAER

SEQ ID NO: 50907 - protein, 5 aa, Mycobacterium avium
DENSA

SEQ ID NO: 50908 - protein, 7 aa, Mycobacterium avium
DEPAADN

SEQ ID NO: 50909 - protein, 15 aa, Mycobacterium avium
DEPAGAAAASAATDA

SEQ ID NO: 50910 - protein, 30 aa, Mycobacterium avium
DEPAKPPTAEAPAAEPAEPEEKPVHTRRGK

SEQ ID NO: 50911 - protein, 7 aa, Mycobacterium avium
DEPDSAS

SEQ ID NO: 50912 - protein, 5 aa, Mycobacterium avium
DEPGF

SEQ ID NO: 50913 - protein, 6 aa, Mycobacterium avium
DEPLDE

SEQ ID NO: 50914 - protein, 6 aa, Mycobacterium avium
DEPLPL

SEQ ID NO: 50915 - protein, 9 aa, Mycobacterium avium
DEPVPEPPV

SEQ ID NO: 50916 - protein, 5 aa, Mycobacterium avium
DERAA

SEQ ID NO: 50917 - protein, 5 aa, Mycobacterium avium
DERSL

SEQ ID NO: 50918 - protein, 8 aa, Mycobacterium avium
DERTDTAG

SEQ ID NO: 50919 - protein, 14 aa, Mycobacterium avium
DERTERARRVGSAN

SEQ ID NO: 50920 - protein, 6 aa, Mycobacterium avium
DERVGP

SEQ ID NO: 50921 - protein, 10 aa, Mycobacterium avium
DESEAESRAA

SEQ ID NO: 50922 - protein, 22 aa, Mycobacterium avium
DESEALRQARKDAELTASADSV

SEQ ID NO: 50923 - protein, 6 aa, Mycobacterium avium
DESMPV

SEQ ID NO: 50924 - protein, 7 aa, Mycobacterium avium
DESPTMS

SEQ ID NO: 50925 - protein, 6 aa, Mycobacterium avium
DESRHR

SEQ ID NO: 50926 - protein, 8 aa, Mycobacterium avium
DESSATRL

SEQ ID NO: 50927 - protein, 7 aa, Mycobacterium avium
DESSITE

SEQ ID NO: 50928 - protein, 12 aa, Mycobacterium avium
DESYQIGEEGHP

SEQ ID NO: 50929 - protein, 9 aa, Mycobacterium avium
DETDWSRNT

SEQ ID NO: 50930 - protein, 5 aa, Mycobacterium avium
DETEA

SEQ ID NO: 50931 - protein, 15 aa, Mycobacterium avium
DETGAAHQPVDIPND

SEQ ID NO: 50932 - protein, 6 aa, Mycobacterium avium
DETGGA

SEQ ID NO: 50933 - protein, 8 aa, Mycobacterium avium
DETTNSVA

SEQ ID NO: 50934 - protein, 10 aa, Mycobacterium avium
DEVAGAGPRP

SEQ ID NO: 50935 - protein, 7 aa, Mycobacterium avium
DEVANAQ

SEQ ID NO: 50936 - protein, 5 aa, Mycobacterium avium
DFGRR

SEQ ID NO: 50937 - protein, 6 aa, Mycobacterium avium
DFKRPS

SEQ ID NO: 50938 - protein, 13 aa, Mycobacterium avium
DFPDHADSADSVE

SEQ ID NO: 50939 - protein, 5 aa, Mycobacterium avium
DFTET

SEQ ID NO: 50940 - protein, 7 aa, Mycobacterium avium
DFTSRDG

SEQ ID NO: 50941 - protein, 8 aa, Mycobacterium avium
DGAAEADL

SEQ ID NO: 50942 - protein, 5 aa, Mycobacterium avium
DGAAH

SEQ ID NO: 50943 - protein, 10 aa, Mycobacterium avium
DGAASTASGT

SEQ ID NO: 50944 - protein, 6 aa, Mycobacterium avium
DGADDA

SEQ ID NO: 50945 - protein, 5 aa, Mycobacterium avium
DGADE

SEQ ID NO: 50946 - protein, 7 aa, Mycobacterium avium
DGAEKFT

SEQ ID NO: 50947 - protein, 4 aa, Mycobacterium avium
DGAG

SEQ ID NO: 50948 - protein, 11 aa, Mycobacterium avium
DGAGPQGTDVP

SEQ ID NO: 50949 - protein, 4 aa, Mycobacterium avium
DGAI

SEQ ID NO: 50950 - protein, 21 aa, Mycobacterium avium
DGANLKPAYTVTGGAVPGEET

SEQ ID NO: 50951 - protein, 13 aa, Mycobacterium avium
DGAPNRHDDAEYD

SEQ ID NO: 50952 - protein, 17 aa, Mycobacterium avium
DGAQPQQGTVRTAPMGR

SEQ ID NO: 50953 - protein, 7 aa, Mycobacterium avium
DGASDRA

SEQ ID NO: 50954 - protein, 18 aa, Mycobacterium avium
DGATGRLVPPKDPDALGE

SEQ ID NO: 50955 - protein, 6 aa, Mycobacterium avium
DGAVDE

SEQ ID NO: 50956 - protein, 20 aa, Mycobacterium avium
DGAWSIPKGEYDEGEEPWPA

SEQ ID NO: 50957 - protein, 10 aa, Mycobacterium avium
DGAYGEAKSA

SEQ ID NO: 50958 - protein, 10 aa, Mycobacterium avium
DGDDADRHYR

SEQ ID NO: 50959 - protein, 8 aa, Mycobacterium avium
DGDDEQTL

SEQ ID NO: 50960 - protein, 8 aa, Mycobacterium avium
DGDDSTGL

SEQ ID NO: 50961 - protein, 7 aa, Mycobacterium avium
DGDEEKE

SEQ ID NO: 50962 - protein, 8 aa, Mycobacterium avium
DGDELPAG

SEQ ID NO: 50963 - protein, 15 aa, Mycobacterium avium
DGDGPLHRGGVDKER

SEQ ID NO: 50964 - protein, 7 aa, Mycobacterium avium
DGDPAVR

SEQ ID NO: 50965 - protein, 6 aa, Mycobacterium avium
DGDPHI

SEQ ID NO: 50966 - protein, 6 aa, Mycobacterium avium
DGDPTG

SEQ ID NO: 50967 - protein, 9 aa, Mycobacterium avium
DGDQAAEPL

SEQ ID NO: 50968 - protein, 9 aa, Mycobacterium avium
DGDRDRTNT

SEQ ID NO: 50969 - protein, 8 aa, Mycobacterium avium
DGDRLTDD

SEQ ID NO: 50970 - protein, 12 aa, Mycobacterium avium
DGDTEPLRASGK

SEQ ID NO: 50971 - protein, 5 aa, Mycobacterium avium
DGDVR

SEQ ID NO: 50972 - protein, 8 aa, Mycobacterium avium
DGEDGSAQ

SEQ ID NO: 50973 - protein, 14 aa, Mycobacterium avium
DGEGGPEAAARRAR

SEQ ID NO: 50974 - protein, 6 aa, Mycobacterium avium
DGEIQA

SEQ ID NO: 50975 - protein, 7 aa, Mycobacterium avium
DGEKLTD

SEQ ID NO: 50976 - protein, 6 aa, Mycobacterium avium
DGEPLG

SEQ ID NO: 50977 - protein, 17 aa, Mycobacterium avium
DGEQIPGQGQPNWSPSE

SEQ ID NO: 50978 - protein, 5 aa, Mycobacterium avium
DGERA

SEQ ID NO: 50979 - protein, 9 aa, Mycobacterium avium
DGERKRPAR

SEQ ID NO: 50980 - protein, 5 aa, Mycobacterium avium
DGFGP

SEQ ID NO: 50981 - protein, 18 aa, Mycobacterium avium
DGGATADGSSGAMGGPGD

SEQ ID NO: 50982 - protein, 4 aa, Mycobacterium avium
DGGC

SEQ ID NO: 50983 - protein, 6 aa, Mycobacterium avium
DGGGSY

SEQ ID NO: 50984 - protein, 7 aa, Mycobacterium avium
DGGTTLG

SEQ ID NO: 50985 - protein, 8 aa, Mycobacterium avium
DGGVGKST

SEQ ID NO: 50986 - protein, 9 aa, Mycobacterium avium
DGGVTPEQA

SEQ ID NO: 50987 - protein, 19 aa, Mycobacterium avium
DGGYTAGRDHGVVELFGFP

SEQ ID NO: 50988 - protein, 10 aa, Mycobacterium avium
DGHPENALSR

SEQ ID NO: 50989 - protein, 19 aa, Mycobacterium avium
DGHTGPGGTLPTNTGGGQL

SEQ ID NO: 50990 - protein, 11 aa, Mycobacterium avium
DGIDGAAPTRE

SEQ ID NO: 50991 - protein, 8 aa, Mycobacterium avium
DGIPEPQR

SEQ ID NO: 50992 - protein, 10 aa, Mycobacterium avium
DGIRTSTTTY

SEQ ID NO: 50993 - protein, 5 aa, Mycobacterium avium
DGKAG

SEQ ID NO: 50994 - protein, 9 aa, Mycobacterium avium
DGKARALPA

SEQ ID NO: 50995 - protein, 4 aa, Mycobacterium avium
DGKT

SEQ ID NO: 50996 - protein, 5 aa, Mycobacterium avium
DGLDG

SEQ ID NO: 50997 - protein, 7 aa, Mycobacterium avium
DGLDGQR

SEQ ID NO: 50998 - protein, 10 aa, Mycobacterium avium
DGLGAEAGTA

SEQ ID NO: 50999 - protein, 7 aa, Mycobacterium avium
DGLPAGR

SEQ ID NO: 51000 - protein, 12 aa, Mycobacterium avium
DGMPARKPGTAV

SEQ ID NO: 51001 - protein, 7 aa, Mycobacterium avium
DGNDPLA

SEQ ID NO: 51002 - protein, 4 aa, Mycobacterium avium
DGNL

SEQ ID NO: 51003 - protein, 7 aa, Mycobacterium avium
DGNPLAG

SEQ ID NO: 51004 - protein, 7 aa, Mycobacterium avium
DGPALDT

SEQ ID NO: 51005 - protein, 8 aa, Mycobacterium avium
DGPATRYE

SEQ ID NO: 51006 - protein, 16 aa, Mycobacterium avium
DGPDRQRLEAGTPAAL

SEQ ID NO: 51007 - protein, 17 aa, Mycobacterium avium
DGPDSRRATHSSTGARL

SEQ ID NO: 51008 - protein, 7 aa, Mycobacterium avium
DGPDYDL

SEQ ID NO: 51009 - protein, 7 aa, Mycobacterium avium
DGPGPPV

SEQ ID NO: 51010 - protein, 16 aa, Mycobacterium avium
DGPLPTHYEPQESPVA

SEQ ID NO: 51011 - protein, 14 aa, Mycobacterium avium
DGPPPRPRLATRLC

SEQ ID NO: 51012 - protein, 8 aa, Mycobacterium avium
DGPPRDMS

SEQ ID NO: 51013 - protein, 7 aa, Mycobacterium avium
DGPSPVN

SEQ ID NO: 51014 - protein, 7 aa, Mycobacterium avium
DGPVPPR

SEQ ID NO: 51015 - protein, 10 aa, Mycobacterium avium
DGQADGSIRP

SEQ ID NO: 51016 - protein, 5 aa, Mycobacterium avium
DGQHR

SEQ ID NO: 51017 - protein, 4 aa, Mycobacterium avium
DGQL

SEQ ID NO: 51018 - protein, 7 aa, Mycobacterium avium
DGQPGAR

SEQ ID NO: 51019 - protein, 9 aa, Mycobacterium avium
DGQRTAAAS

SEQ ID NO: 51020 - protein, 10 aa, Mycobacterium avium
DGRAESPMES

SEQ ID NO: 51021 - protein, 13 aa, Mycobacterium avium
DGRARGRGRIPDR

SEQ ID NO: 51022 - protein, 9 aa, Mycobacterium avium
DGRATIRTT

SEQ ID NO: 51023 - protein, 10 aa, Mycobacterium avium
DGRDVTTSIG

SEQ ID NO: 51024 - protein, 10 aa, Mycobacterium avium
DGREVPVGQT

SEQ ID NO: 51025 - protein, 7 aa, Mycobacterium avium
DGRGLPE

SEQ ID NO: 51026 - protein, 14 aa, Mycobacterium avium
DGRIPLPEVRHRFG

SEQ ID NO: 51027 - protein, 7 aa, Mycobacterium avium
DGRRATT

SEQ ID NO: 51028 - protein, 19 aa, Mycobacterium avium
DGRRGRTLGEAGRERARAR

SEQ ID NO: 51029 - protein, 8 aa, Mycobacterium avium
DGRRVPGS

SEQ ID NO: 51030 - protein, 14 aa, Mycobacterium avium
DGRYRTQAAEQAPD

SEQ ID NO: 51031 - protein, 6 aa, Mycobacterium avium
DGSAGI

SEQ ID NO: 51032 - protein, 4 aa, Mycobacterium avium
DGSD

SEQ ID NO: 51033 - protein, 4 aa, Mycobacterium avium
DGSP

SEQ ID NO: 51034 - protein, 7 aa, Mycobacterium avium
DGSPASN

SEQ ID NO: 51035 - protein, 4 aa, Mycobacterium avium
DGSQ

SEQ ID NO: 51036 - protein, 9 aa, Mycobacterium avium
DGSSYPSGV

SEQ ID NO: 51037 - protein, 12 aa, Mycobacterium avium
DGSTDDTGEIAR

SEQ ID NO: 51038 - protein, 21 aa, Mycobacterium avium
DGSTLTNPSAAQVKAKLAEAG

SEQ ID NO: 51039 - protein, 8 aa, Mycobacterium avium
DGSTSPTA

SEQ ID NO: 51040 - protein, 4 aa, Mycobacterium avium
DGSV

SEQ ID NO: 51041 - protein, 12 aa, Mycobacterium avium
DGTAVRQLIRFD

SEQ ID NO: 51042 - protein, 10 aa, Mycobacterium avium
DGTGTVATTD

SEQ ID NO: 51043 - protein, 19 aa, Mycobacterium avium
DGTLAPAPEKPVAAARTGW

SEQ ID NO: 51044 - protein, 6 aa, Mycobacterium avium
DGTPAA

SEQ ID NO: 51045 - protein, 18 aa, Mycobacterium avium
DGTPESARKLASRARRRI

SEQ ID NO: 51046 - protein, 13 aa, Mycobacterium avium
DGTQTARRVGTDA

SEQ ID NO: 51047 - protein, 4 aa, Mycobacterium avium
DGTR

SEQ ID NO: 51048 - protein, 6 aa, Mycobacterium avium
DGTRAG

SEQ ID NO: 51049 - protein, 11 aa, Mycobacterium avium
DGTRFTNDQTK

SEQ ID NO: 51050 - protein, 11 aa, Mycobacterium avium
DGTRNIASQAE

SEQ ID NO: 51051 - protein, 6 aa, Mycobacterium avium
DGTRVT

SEQ ID NO: 51052 - protein, 6 aa, Mycobacterium avium
DGTTLG

SEQ ID NO: 51053 - protein, 13 aa, Mycobacterium avium
DGTVAASGTVRGE

SEQ ID NO: 51054 - protein, 8 aa, Mycobacterium avium
DGVADGEA

SEQ ID NO: 51055 - protein, 19 aa, Mycobacterium avium
DGVAEAAAGRQHASVDPSR

SEQ ID NO: 51056 - protein, 10 aa, Mycobacterium avium
DGVGKSPAQL

SEQ ID NO: 51057 - protein, 11 aa, Mycobacterium avium
DGVKDTPEAAR

SEQ ID NO: 51058 - protein, 4 aa, Mycobacterium avium
DGVQ

SEQ ID NO: 51059 - protein, 5 aa, Mycobacterium avium
DGVRT

SEQ ID NO: 51060 - protein, 7 aa, Mycobacterium avium
DGVSDAE

SEQ ID NO: 51061 - protein, 14 aa, Mycobacterium avium
DGVVEPGGTALTRG

SEQ ID NO: 51062 - protein, 7 aa, Mycobacterium avium
DGYGHGA

SEQ ID NO: 51063 - protein, 38 aa, Mycobacterium avium
DGYGRYDGDDYDDPRREPADYPPPAGYRGGYAEESRYG

SEQ ID NO: 51064 - protein, 5 aa, Mycobacterium avium
DGYSE

SEQ ID NO: 51065 - protein, 6 aa, Mycobacterium avium
DHAGAD

SEQ ID NO: 51066 - protein, 10 aa, Mycobacterium avium
DHDSASKHGN

SEQ ID NO: 51067 - protein, 12 aa, Mycobacterium avium
DHDVNNERRGYR

SEQ ID NO: 51068 - protein, 6 aa, Mycobacterium avium
DHEDRS

SEQ ID NO: 51069 - protein, 12 aa, Mycobacterium avium
DHETFSSAKGLT

SEQ ID NO: 51070 - protein, 19 aa, Mycobacterium avium
DHGAVSRGEWRTSVGDDGR

SEQ ID NO: 51071 - protein, 11 aa, Mycobacterium avium
DHKTSSELRRN

SEQ ID NO: 51072 - protein, 4 aa, Mycobacterium avium
DHNV

SEQ ID NO: 51073 - protein, 5 aa, Mycobacterium avium
DHPAH

SEQ ID NO: 51074 - protein, 12 aa, Mycobacterium avium
DHPDQRKELAED

SEQ ID NO: 51075 - protein, 7 aa, Mycobacterium avium
DHPDRAA

SEQ ID NO: 51076 - protein, 9 aa, Mycobacterium avium
DHPGATTGG

SEQ ID NO: 51077 - protein, 9 aa, Mycobacterium avium
DHPGRNTEE

SEQ ID NO: 51078 - protein, 7 aa, Mycobacterium avium
DHPSPDA

SEQ ID NO: 51079 - protein, 8 aa, Mycobacterium avium
DHPSRDGA

SEQ ID NO: 51080 - protein, 5 aa, Mycobacterium avium
DHPTV

SEQ ID NO: 51081 - protein, 4 aa, Mycobacterium avium
DHTG

SEQ ID NO: 51082 - protein, 9 aa, Mycobacterium avium
DHTGRYRGR

SEQ ID NO: 51083 - protein, 6 aa, Mycobacterium avium
DHTPLT

SEQ ID NO: 51084 - protein, 14 aa, Mycobacterium avium
DHTRNSLRENGNLS

SEQ ID NO: 51085 - protein, 11 aa, Mycobacterium avium
DIAERDVKEGA

SEQ ID NO: 51086 - protein, 8 aa, Mycobacterium avium
DIATATDS

SEQ ID NO: 51087 - protein, 5 aa, Mycobacterium avium
DIDAT

SEQ ID NO: 51088 - protein, 6 aa, Mycobacterium avium
DIDPTQ

SEQ ID NO: 51089 - protein, 7 aa, Mycobacterium avium
DIEAGDR

SEQ ID NO: 51090 - protein, 10 aa, Mycobacterium avium
DIEGRDEFAG

SEQ ID NO: 51091 - protein, 5 aa, Mycobacterium avium
DIEIG

SEQ ID NO: 51092 - protein, 10 aa, Mycobacterium avium
DIGEHSNIGA

SEQ ID NO: 51093 - protein, 15 aa, Mycobacterium avium
DIGRKVEEGVRANLN

SEQ ID NO: 51094 - protein, 4 aa, Mycobacterium avium
DIPG

SEQ ID NO: 51095 - protein, 6 aa, Mycobacterium avium
DIPGPA

SEQ ID NO: 51096 - protein, 6 aa, Mycobacterium avium
DIPRED

SEQ ID NO: 51097 - protein, 21 aa, Mycobacterium avium
DIRDEDNGRKSVGAWLLSAHL

SEQ ID NO: 51098 - protein, 21 aa, Mycobacterium avium
DISEEAREKIGGLNAQRFYNL

SEQ ID NO: 51099 - protein, 10 aa, Mycobacterium avium
DISGPDTTSY

SEQ ID NO: 51100 - protein, 11 aa, Mycobacterium avium
DITEDPEPRGH

SEQ ID NO: 51101 - protein, 6 aa, Mycobacterium avium
DITPTG

SEQ ID NO: 51102 - protein, 5 aa, Mycobacterium avium
DIYGD

SEQ ID NO: 51103 - protein, 7 aa, Mycobacterium avium
DKAALDG

SEQ ID NO: 51104 - protein, 15 aa, Mycobacterium avium
DKADLDAAGFTDEER

SEQ ID NO: 51105 - protein, 8 aa, Mycobacterium avium
DKAKAEGI

SEQ ID NO: 51106 - protein, 25 aa, Mycobacterium avium
DKATAATAPSVQTAVGQAAAELGDT

SEQ ID NO: 51107 - protein, 4 aa, Mycobacterium avium
DKDI

SEQ ID NO: 51108 - protein, 4 aa, Mycobacterium avium
DKDT

SEQ ID NO: 51109 - protein, 13 aa, Mycobacterium avium
DKDTGGEAGKTLR

SEQ ID NO: 51110 - protein, 6 aa, Mycobacterium avium
DKFTRD

SEQ ID NO: 51111 - protein, 7 aa, Mycobacterium avium
DKGEQLA

SEQ ID NO: 51112 - protein, 8 aa, Mycobacterium avium
DKGQKTRI

SEQ ID NO: 51113 - protein, 8 aa, Mycobacterium avium
DKHPDAAG

SEQ ID NO: 51114 - protein, 5 aa, Mycobacterium avium
DKLAG

SEQ ID NO: 51115 - protein, 5 aa, Mycobacterium avium
DKQAT

SEQ ID NO: 51116 - protein, 25 aa, Mycobacterium avium
DKRALPAPEYHKRAGQYRAPSNHTE

SEQ ID NO: 51117 - protein, 27 aa, Mycobacterium avium
DKRALPAPEYRKRGGEYIAPTNPTEET

SEQ ID NO: 51118 - protein, 5 aa, Mycobacterium avium
DKRGK

SEQ ID NO: 51119 - protein, 4 aa, Mycobacterium avium
DKRI

SEQ ID NO: 51120 - protein, 11 aa, Mycobacterium avium
DKRVKRSPHPF

SEQ ID NO: 51121 - protein, 11 aa, Mycobacterium avium
DKRYQDEASDV

SEQ ID NO: 51122 - protein, 6 aa, Mycobacterium avium
DKRYRD

SEQ ID NO: 51123 - protein, 9 aa, Mycobacterium avium
DKVSGAAGA

SEQ ID NO: 51124 - protein, 16 aa, Mycobacterium avium
DKVTSSPAFRASAKSK

SEQ ID NO: 51125 - protein, 15 aa, Mycobacterium avium
DLADPGPAVAQATER

SEQ ID NO: 51126 - protein, 5 aa, Mycobacterium avium
DLARA

SEQ ID NO: 51127 - protein, 8 aa, Mycobacterium avium
DLATREEQ

SEQ ID NO: 51128 - protein, 11 aa, Mycobacterium avium
DLDGAARGAEI

SEQ ID NO: 51129 - protein, 8 aa, Mycobacterium avium
DLDGDGRF

SEQ ID NO: 51130 - protein, 14 aa, Mycobacterium avium
DLDNPTADDAAEAL

SEQ ID NO: 51131 - protein, 7 aa, Mycobacterium avium
DLDPQPE

SEQ ID NO: 51132 - protein, 8 aa, Mycobacterium avium
DLDPTQHG

SEQ ID NO: 51133 - protein, 10 aa, Mycobacterium avium
DLEDPDSPIA

SEQ ID NO: 51134 - protein, 4 aa, Mycobacterium avium
DLEP

SEQ ID NO: 51135 - protein, 4 aa, Mycobacterium avium
DLGG

SEQ ID NO: 51136 - protein, 7 aa, Mycobacterium avium
DLGGSDP

SEQ ID NO: 51137 - protein, 9 aa, Mycobacterium avium
DLGGTDPEL

SEQ ID NO: 51138 - protein, 7 aa, Mycobacterium avium
DLGRSAA

SEQ ID NO: 51139 - protein, 5 aa, Mycobacterium avium
DLPAE

SEQ ID NO: 51140 - protein, 12 aa, Mycobacterium avium
DLPAPTREDAEP

SEQ ID NO: 51141 - protein, 6 aa, Mycobacterium avium
DLPDDE

SEQ ID NO: 51142 - protein, 6 aa, Mycobacterium avium
DLPEDA

SEQ ID NO: 51143 - protein, 13 aa, Mycobacterium avium
DLPGASGSSRPER

SEQ ID NO: 51144 - protein, 6 aa, Mycobacterium avium
DLPSPY

SEQ ID NO: 51145 - protein, 5 aa, Mycobacterium avium
DLQAS

SEQ ID NO: 51146 - protein, 5 aa, Mycobacterium avium
DLQPG

SEQ ID NO: 51147 - protein, 9 aa, Mycobacterium avium
DLRDGVDEV

SEQ ID NO: 51148 - protein, 6 aa, Mycobacterium avium
DLRSAA

SEQ ID NO: 51149 - protein, 9 aa, Mycobacterium avium
DLSTGNPHP

SEQ ID NO: 51150 - protein, 4 aa, Mycobacterium avium
DLTA

SEQ ID NO: 51151 - protein, 43 aa, Mycobacterium avium
DLTEEGQAQQDKADAQRDAGKKEAEAESARAGAEAAEERQKKN

SEQ ID NO: 51152 - protein, 10 aa, Mycobacterium avium
DLTPGPDHSL

SEQ ID NO: 51153 - protein, 4 aa, Mycobacterium avium
DLYP

SEQ ID NO: 51154 - protein, 13 aa, Mycobacterium avium
DMDGAEPATPNIA

SEQ ID NO: 51155 - protein, 7 aa, Mycobacterium avium
DMPDDRD

SEQ ID NO: 51156 - protein, 6 aa, Mycobacterium avium
DMPDGL

SEQ ID NO: 51157 - protein, 7 aa, Mycobacterium avium
DMPRPTP

SEQ ID NO: 51158 - protein, 16 aa, Mycobacterium avium
DNANHAAQSKPGGGNA

SEQ ID NO: 51159 - protein, 7 aa, Mycobacterium avium
DNAPAEL

SEQ ID NO: 51160 - protein, 8 aa, Mycobacterium avium
DNERAAGA

SEQ ID NO: 51161 - protein, 5 aa, Mycobacterium avium
DNGAN

SEQ ID NO: 51162 - protein, 6 aa, Mycobacterium avium
DNGASG

SEQ ID NO: 51163 - protein, 7 aa, Mycobacterium avium
DNGIDTQ

SEQ ID NO: 51164 - protein, 4 aa, Mycobacterium avium
DNGV

SEQ ID NO: 51165 - protein, 9 aa, Mycobacterium avium
DNHPSPRSK

SEQ ID NO: 51166 - protein, 7 aa, Mycobacterium avium
DNNSGVN

SEQ ID NO: 51167 - protein, 9 aa, Mycobacterium avium
DNPAPAYDE

SEQ ID NO: 51168 - protein, 21 aa, Mycobacterium avium
DNPDAETAAAEVTEAPVEAVP

SEQ ID NO: 51169 - protein, 9 aa, Mycobacterium avium
DNPLRGAPH

SEQ ID NO: 51170 - protein, 8 aa, Mycobacterium avium
DNPPTDTR

SEQ ID NO: 51171 - protein, 6 aa, Mycobacterium avium
DNRDEL

SEQ ID NO: 51172 - protein, 10 aa, Mycobacterium avium
DNRLAEDTDV

SEQ ID NO: 51173 - protein, 10 aa, Mycobacterium avium
DNRRDPAHAT

SEQ ID NO: 51174 - protein, 17 aa, Mycobacterium avium
DNSAPADTPAAAPADAT

SEQ ID NO: 51175 - protein, 7 aa, Mycobacterium avium
DNSASRC

SEQ ID NO: 51176 - protein, 8 aa, Mycobacterium avium
DNSDNALP

SEQ ID NO: 51177 - protein, 14 aa, Mycobacterium avium
DNSPAPQSDSSTDA

SEQ ID NO: 51178 - protein, 5 aa, Mycobacterium avium
DNYAK

SEQ ID NO: 51179 - protein, 14 aa, Mycobacterium avium
DPAASRAWITRLSG

SEQ ID NO: 51180 - protein, 8 aa, Mycobacterium avium
DPAEADYD

SEQ ID NO: 51181 - protein, 9 aa, Mycobacterium avium
DPAGPAARG

SEQ ID NO: 51182 - protein, 6 aa, Mycobacterium avium
DPAGTT

SEQ ID NO: 51183 - protein, 14 aa, Mycobacterium avium
DPAPADSSTSTDCY

SEQ ID NO: 51184 - protein, 15 aa, Mycobacterium avium
DPAPARGTVPLTPDA

SEQ ID NO: 51185 - protein, 5 aa, Mycobacterium avium
DPAQD

SEQ ID NO: 51186 - protein, 7 aa, Mycobacterium avium
DPASLTP

SEQ ID NO: 51187 - protein, 10 aa, Mycobacterium avium
DPASRDTQMG

SEQ ID NO: 51188 - protein, 5 aa, Mycobacterium avium
DPASV

SEQ ID NO: 51189 - protein, 8 aa, Mycobacterium avium
DPATAEAL

SEQ ID NO: 51190 - protein, 5 aa, Mycobacterium avium
DPAVA

SEQ ID NO: 51191 - protein, 7 aa, Mycobacterium avium
DPAVADE

SEQ ID NO: 51192 - protein, 7 aa, Mycobacterium avium
DPAVPPR

SEQ ID NO: 51193 - protein, 8 aa, Mycobacterium avium
DPDADYQQ

SEQ ID NO: 51194 - protein, 8 aa, Mycobacterium avium
DPDAPAGP

SEQ ID NO: 51195 - protein, 7 aa, Mycobacterium avium
DPDARAD

SEQ ID NO: 51196 - protein, 8 aa, Mycobacterium avium
DPDATRKT

SEQ ID NO: 51197 - protein, 7 aa, Mycobacterium avium
DPDAVDQ

SEQ ID NO: 51198 - protein, 4 aa, Mycobacterium avium
DPDD

SEQ ID NO: 51199 - protein, 17 aa, Mycobacterium avium
DPDDCTVPAGADVMHSG

SEQ ID NO: 51200 - protein, 19 aa, Mycobacterium avium
DPDDWNPPNLDEDTDIPGE

SEQ ID NO: 51201 - protein, 4 aa, Mycobacterium avium
DPDE

SEQ ID NO: 51202 - protein, 5 aa, Mycobacterium avium
DPDER

SEQ ID NO: 51203 - protein, 15 aa, Mycobacterium avium
DPDFGRGSSAYDGYW

SEQ ID NO: 51204 - protein, 7 aa, Mycobacterium avium
DPDFQAG

SEQ ID NO: 51205 - protein, 11 aa, Mycobacterium avium
DPDHAPKAGSL

SEQ ID NO: 51206 - protein, 9 aa, Mycobacterium avium
DPDNRRPVD

SEQ ID NO: 51207 - protein, 10 aa, Mycobacterium avium
DPDPANVGRQ

SEQ ID NO: 51208 - protein, 7 aa, Mycobacterium avium
DPDPDAR

SEQ ID NO: 51209 - protein, 5 aa, Mycobacterium avium
DPDPI

SEQ ID NO: 51210 - protein, 5 aa, Mycobacterium avium
DPDPL

SEQ ID NO: 51211 - protein, 11 aa, Mycobacterium avium
DPDQDPGRGRR

SEQ ID NO: 51212 - protein, 8 aa, Mycobacterium avium
DPDRDATG

SEQ ID NO: 51213 - protein, 5 aa, Mycobacterium avium
DPDRK

SEQ ID NO: 51214 - protein, 8 aa, Mycobacterium avium
DPEAAHSV

SEQ ID NO: 51215 - protein, 6 aa, Mycobacterium avium
DPEFGT

SEQ ID NO: 51216 - protein, 5 aa, Mycobacterium avium
DPEGT

SEQ ID NO: 51217 - protein, 5 aa, Mycobacterium avium
DPEHA

SEQ ID NO: 51218 - protein, 6 aa, Mycobacterium avium
DPEQPP

SEQ ID NO: 51219 - protein, 8 aa, Mycobacterium avium
DPESAQGI

SEQ ID NO: 51220 - protein, 6 aa, Mycobacterium avium
DPESVD

SEQ ID NO: 51221 - protein, 4 aa, Mycobacterium avium
DPET

SEQ ID NO: 51222 - protein, 8 aa, Mycobacterium avium
DPETRTAD

SEQ ID NO: 51223 - protein, 4 aa, Mycobacterium avium
DPFA

SEQ ID NO: 51224 - protein, 13 aa, Mycobacterium avium
DPFADDPCDPSAA

SEQ ID NO: 51225 - protein, 4 aa, Mycobacterium avium
DPFS

SEQ ID NO: 51226 - protein, 10 aa, Mycobacterium avium
DPGAQRGSMP

SEQ ID NO: 51227 - protein, 8 aa, Mycobacterium avium
DPGIDTLP

SEQ ID NO: 51228 - protein, 13 aa, Mycobacterium avium
DPGRRSEVQRSAR

SEQ ID NO: 51229 - protein, 8 aa, Mycobacterium avium
DPGTGRED

SEQ ID NO: 51230 - protein, 9 aa, Mycobacterium avium
DPHGPLDRT

SEQ ID NO: 51231 - protein, 7 aa, Mycobacterium avium
DPHKKAV

SEQ ID NO: 51232 - protein, 15 aa, Mycobacterium avium
DPHLRTGERPPGYPA

SEQ ID NO: 51233 - protein, 7 aa, Mycobacterium avium
DPHSPPE

SEQ ID NO: 51234 - protein, 8 aa, Mycobacterium avium
DPICSGGG

SEQ ID NO: 51235 - protein, 6 aa, Mycobacterium avium
DPIDAD

SEQ ID NO: 51236 - protein, 16 aa, Mycobacterium avium
DPIELGKNNSGRGVGG

SEQ ID NO: 51237 - protein, 5 aa, Mycobacterium avium
DPIGE

SEQ ID NO: 51238 - protein, 7 aa, Mycobacterium avium
DPIPERP

SEQ ID NO: 51239 - protein, 8 aa, Mycobacterium avium
DPLPATPR

SEQ ID NO: 51240 - protein, 5 aa, Mycobacterium avium
DPLPS

SEQ ID NO: 51241 - protein, 6 aa, Mycobacterium avium
DPLRDD

SEQ ID NO: 51242 - protein, 8 aa, Mycobacterium avium
DPMNDTQR

SEQ ID NO: 51243 - protein, 11 aa, Mycobacterium avium
DPNAQFGQSAQ

SEQ ID NO: 51244 - protein, 8 aa, Mycobacterium avium
DPNRVPGT

SEQ ID NO: 51245 - protein, 11 aa, Mycobacterium avium
DPPDDASPCAS

SEQ ID NO: 51246 - protein, 8 aa, Mycobacterium avium
DPPEGWSE

SEQ ID NO: 51247 - protein, 6 aa, Mycobacterium avium
DPPEHA

SEQ ID NO: 51248 - protein, 8 aa, Mycobacterium avium
DPPGNTDR

SEQ ID NO: 51249 - protein, 6 aa, Mycobacterium avium
DPPPDM

SEQ ID NO: 51250 - protein, 6 aa, Mycobacterium avium
DPPRSG

SEQ ID NO: 51251 - protein, 10 aa, Mycobacterium avium
DPQDPCRRPG

SEQ ID NO: 51252 - protein, 11 aa, Mycobacterium avium
DPQGNASTALG

SEQ ID NO: 51253 - protein, 4 aa, Mycobacterium avium
DPQN

SEQ ID NO: 51254 - protein, 5 aa, Mycobacterium avium
DPQTQ

SEQ ID NO: 51255 - protein, 8 aa, Mycobacterium avium
DPRDPSTV

SEQ ID NO: 51256 - protein, 4 aa, Mycobacterium avium
DPRP

SEQ ID NO: 51257 - protein, 8 aa, Mycobacterium avium
DPRSAELA

SEQ ID NO: 51258 - protein, 8 aa, Mycobacterium avium
DPRSGEQQ

SEQ ID NO: 51259 - protein, 9 aa, Mycobacterium avium
DPRYPANAE

SEQ ID NO: 51260 - protein, 8 aa, Mycobacterium avium
DPSAPQTR

SEQ ID NO: 51261 - protein, 8 aa, Mycobacterium avium
DPSPAAQV

SEQ ID NO: 51262 - protein, 8 aa, Mycobacterium avium
DPSQGMGP

SEQ ID NO: 51263 - protein, 6 aa, Mycobacterium avium
DPSRAA

SEQ ID NO: 51264 - protein, 15 aa, Mycobacterium avium
DPSTARATAAATTPE

SEQ ID NO: 51265 - protein, 4 aa, Mycobacterium avium
DPTE

SEQ ID NO: 51266 - protein, 8 aa, Mycobacterium avium
DPTEFSDD

SEQ ID NO: 51267 - protein, 16 aa, Mycobacterium avium
DPTWERSGHTERGRDK

SEQ ID NO: 51268 - protein, 7 aa, Mycobacterium avium
DPTYGQG

SEQ ID NO: 51269 - protein, 7 aa, Mycobacterium avium
DPVATAQ

SEQ ID NO: 51270 - protein, 6 aa, Mycobacterium avium
DPVDAR

SEQ ID NO: 51271 - protein, 11 aa, Mycobacterium avium
DPVEARAATAA

SEQ ID NO: 51272 - protein, 4 aa, Mycobacterium avium
DPVS

SEQ ID NO: 51273 - protein, 20 aa, Mycobacterium avium
DPVYAPNSYGGPKADPDRAS

SEQ ID NO: 51274 - protein, 7 aa, Mycobacterium avium
DPYAGTP

SEQ ID NO: 51275 - protein, 7 aa, Mycobacterium avium
DPYATAA

SEQ ID NO: 51276 - protein, 4 aa, Mycobacterium avium
DQDE

SEQ ID NO: 51277 - protein, 6 aa, Mycobacterium avium
DQEPAR

SEQ ID NO: 51278 - protein, 11 aa, Mycobacterium avium
DQHPESDAARD

SEQ ID NO: 51279 - protein, 5 aa, Mycobacterium avium
DQLTA

SEQ ID NO: 51280 - protein, 4 aa, Mycobacterium avium
DQPW

SEQ ID NO: 51281 - protein, 9 aa, Mycobacterium avium
DQQRASAVA

SEQ ID NO: 51282 - protein, 6 aa, Mycobacterium avium
DQRDDD

SEQ ID NO: 51283 - protein, 17 aa, Mycobacterium avium
DQREAEGGSKVPEETLS

SEQ ID NO: 51284 - protein, 65 aa, Mycobacterium avium
DQRTALANPGPAVPAAATAPGAPAPEAAPPGTPPGGPGPGEAPPPGGAPGMAPGGGGVGGGDRAT

SEQ ID NO: 51285 - protein, 9 aa, Mycobacterium avium
DQRVGDAAA

SEQ ID NO: 51286 - protein, 10 aa, Mycobacterium avium
DQTDVPESGD

SEQ ID NO: 51287 - protein, 7 aa, Mycobacterium avium
DRAAARR

SEQ ID NO: 51288 - protein, 9 aa, Mycobacterium avium
DRAAGRRTQ

SEQ ID NO: 51289 - protein, 6 aa, Mycobacterium avium
DRAGAG

SEQ ID NO: 51290 - protein, 9 aa, Mycobacterium avium
DRAGAPASQ

SEQ ID NO: 51291 - protein, 4 aa, Mycobacterium avium
DRAH

SEQ ID NO: 51292 - protein, 9 aa, Mycobacterium avium
DRAKPAVPF

SEQ ID NO: 51293 - protein, 7 aa, Mycobacterium avium
DRALDTA

SEQ ID NO: 51294 - protein, 5 aa, Mycobacterium avium
DRAPF

SEQ ID NO: 51295 - protein, 8 aa, Mycobacterium avium
DRARRAQR

SEQ ID NO: 51296 - protein, 7 aa, Mycobacterium avium
DRATADA

SEQ ID NO: 51297 - protein, 18 aa, Mycobacterium avium
DRDGQGPHGVKHPPAGDT

SEQ ID NO: 51298 - protein, 6 aa, Mycobacterium avium
DRDNPY

SEQ ID NO: 51299 - protein, 7 aa, Mycobacterium avium
DRDVTRS

SEQ ID NO: 51300 - protein, 5 aa, Mycobacterium avium
DREGL

SEQ ID NO: 51301 - protein, 5 aa, Mycobacterium avium
DREQR

SEQ ID NO: 51302 - protein, 28 aa, Mycobacterium avium
DRERSGADENGDSSGAANEFSGGGAQGS

SEQ ID NO: 51303 - protein, 15 aa, Mycobacterium avium
DRESPPPAPRDDERA

SEQ ID NO: 51304 - protein, 16 aa, Mycobacterium avium
DRFDPSAGGPGAYDTP

SEQ ID NO: 51305 - protein, 6 aa, Mycobacterium avium
DRFGDA

SEQ ID NO: 51306 - protein, 14 aa, Mycobacterium avium
DRFPNGLGNNDDQV

SEQ ID NO: 51307 - protein, 5 aa, Mycobacterium avium
DRFTS

SEQ ID NO: 51308 - protein, 9 aa, Mycobacterium avium
DRGAASLTD

SEQ ID NO: 51309 - protein, 8 aa, Mycobacterium avium
DRGAGAGA

SEQ ID NO: 51310 - protein, 11 aa, Mycobacterium avium
DRGCPEPEPLS

SEQ ID NO: 51311 - protein, 10 aa, Mycobacterium avium
DRGLSPQPAA

SEQ ID NO: 51312 - protein, 7 aa, Mycobacterium avium
DRHGDRH

SEQ ID NO: 51313 - protein, 5 aa, Mycobacterium avium
DRHGR

SEQ ID NO: 51314 - protein, 6 aa, Mycobacterium avium
DRHRAT

SEQ ID NO: 51315 - protein, 6 aa, Mycobacterium avium
DRHYSN

SEQ ID NO: 51316 - protein, 5 aa, Mycobacterium avium
DRIDE

SEQ ID NO: 51317 - protein, 4 aa, Mycobacterium avium
DRLQ

SEQ ID NO: 51318 - protein, 9 aa, Mycobacterium avium
DRLTRTDTR

SEQ ID NO: 51319 - protein, 11 aa, Mycobacterium avium
DRNGKQGGAGF

SEQ ID NO: 51320 - protein, 23 aa, Mycobacterium avium
DRNPSPESLDEAQAKIKAALAQL

SEQ ID NO: 51321 - protein, 5 aa, Mycobacterium avium
DRNTP

SEQ ID NO: 51322 - protein, 8 aa, Mycobacterium avium
DRPEDRWP

SEQ ID NO: 51323 - protein, 6 aa, Mycobacterium avium
DRPERG

SEQ ID NO: 51324 - protein, 13 aa, Mycobacterium avium
DRPHDPDELTPAY

SEQ ID NO: 51325 - protein, 5 aa, Mycobacterium avium
DRPPM

SEQ ID NO: 51326 - protein, 5 aa, Mycobacterium avium
DRPTA

SEQ ID NO: 51327 - protein, 4 aa, Mycobacterium avium
DRQG

SEQ ID NO: 51328 - protein, 6 aa, Mycobacterium avium
DRQSDA

SEQ ID NO: 51329 - protein, 15 aa, Mycobacterium avium
DRRAERLGATGPDIL

SEQ ID NO: 51330 - protein, 7 aa, Mycobacterium avium
DRREDGY

SEQ ID NO: 51331 - protein, 4 aa, Mycobacterium avium
DRRG

SEQ ID NO: 51332 - protein, 20 aa, Mycobacterium avium
DRRGGPTRPHQPGSAHPSAF

SEQ ID NO: 51333 - protein, 12 aa, Mycobacterium avium
DRRLGEAETPGM

SEQ ID NO: 51334 - protein, 9 aa, Mycobacterium avium
DRRRQPRED

SEQ ID NO: 51335 - protein, 6 aa, Mycobacterium avium
DRRSGY

SEQ ID NO: 51336 - protein, 6 aa, Mycobacterium avium
DRRTYT

SEQ ID NO: 51337 - protein, 7 aa, Mycobacterium avium
DRSERHD

SEQ ID NO: 51338 - protein, 9 aa, Mycobacterium avium
DRSGSPTLE

SEQ ID NO: 51339 - protein, 15 aa, Mycobacterium avium
DRSTDSTRAPASRDE

SEQ ID NO: 51340 - protein, 8 aa, Mycobacterium avium
DRTEFASR

SEQ ID NO: 51341 - protein, 4 aa, Mycobacterium avium
DRTG

SEQ ID NO: 51342 - protein, 6 aa, Mycobacterium avium
DRVRPG

SEQ ID NO: 51343 - protein, 11 aa, Mycobacterium avium
DRVTEAAPRPR

SEQ ID NO: 51344 - protein, 6 aa, Mycobacterium avium
DRYPSH

SEQ ID NO: 51345 - protein, 11 aa, Mycobacterium avium
DSADPGDRAAL

SEQ ID NO: 51346 - protein, 7 aa, Mycobacterium avium
DSDDLKR

SEQ ID NO: 51347 - protein, 13 aa, Mycobacterium avium
DSDEERDQQREAV

SEQ ID NO: 51348 - protein, 9 aa, Mycobacterium avium
DSDLPDRSV

SEQ ID NO: 51349 - protein, 12 aa, Mycobacterium avium
DSDNPNQPPYSQ

SEQ ID NO: 51350 - protein, 9 aa, Mycobacterium avium
DSEAKGEEL

SEQ ID NO: 51351 - protein, 5 aa, Mycobacterium avium
DSEED

SEQ ID NO: 51352 - protein, 4 aa, Mycobacterium avium
DSEI

SEQ ID NO: 51353 - protein, 5 aa, Mycobacterium avium
DSEQP

SEQ ID NO: 51354 - protein, 9 aa, Mycobacterium avium
DSEYGKATR

SEQ ID NO: 51355 - protein, 19 aa, Mycobacterium avium
DSEYRGDGRFRTSAGADHT

SEQ ID NO: 51356 - protein, 13 aa, Mycobacterium avium
DSGARSLDDGRNW

SEQ ID NO: 51357 - protein, 22 aa, Mycobacterium avium
DSGDARAVPKTAADRRPRVGAG

SEQ ID NO: 51358 - protein, 5 aa, Mycobacterium avium
DSGEL

SEQ ID NO: 51359 - protein, 12 aa, Mycobacterium avium
DSGFDPDKPSAW

SEQ ID NO: 51360 - protein, 5 aa, Mycobacterium avium
DSGIG

SEQ ID NO: 51361 - protein, 7 aa, Mycobacterium avium
DSGLPRE

SEQ ID NO: 51362 - protein, 7 aa, Mycobacterium avium
DSGNGPA

SEQ ID NO: 51363 - protein, 9 aa, Mycobacterium avium
DSGSATLQG

SEQ ID NO: 51364 - protein, 12 aa, Mycobacterium avium
DSIKRKDPSGVT

SEQ ID NO: 51365 - protein, 7 aa, Mycobacterium avium
DSIRPQD

SEQ ID NO: 51366 - protein, 4 aa, Mycobacterium avium
DSIS

SEQ ID NO: 51367 - protein, 16 aa, Mycobacterium avium
DSLAEQSRRNPDGTGL

SEQ ID NO: 51368 - protein, 7 aa, Mycobacterium avium
DSLAHPE

SEQ ID NO: 51369 - protein, 4 aa, Mycobacterium avium
DSLD

SEQ ID NO: 51370 - protein, 13 aa, Mycobacterium avium
DSLPVPTSKPDPA

SEQ ID NO: 51371 - protein, 7 aa, Mycobacterium avium
DSPDSGS

SEQ ID NO: 51372 - protein, 6 aa, Mycobacterium avium
DSPGTS

SEQ ID NO: 51373 - protein, 16 aa, Mycobacterium avium
DSPKRVSQSMRSAMLG

SEQ ID NO: 51374 - protein, 14 aa, Mycobacterium avium
DSPTGQPDRSEQRY

SEQ ID NO: 51375 - protein, 13 aa, Mycobacterium avium
DSPYQPPAKPDLR

SEQ ID NO: 51376 - protein, 8 aa, Mycobacterium avium
DSRARIEQ

SEQ ID NO: 51377 - protein, 5 aa, Mycobacterium avium
DSREL

SEQ ID NO: 51378 - protein, 12 aa, Mycobacterium avium
DSRETDEGQAIR

SEQ ID NO: 51379 - protein, 6 aa, Mycobacterium avium
DSRIDT

SEQ ID NO: 51380 - protein, 8 aa, Mycobacterium avium
DSRPAAAG

SEQ ID NO: 51381 - protein, 5 aa, Mycobacterium avium
DSRQR

SEQ ID NO: 51382 - protein, 7 aa, Mycobacterium avium
DSRTNGS

SEQ ID NO: 51383 - protein, 6 aa, Mycobacterium avium
DSRYGL

SEQ ID NO: 51384 - protein, 6 aa, Mycobacterium avium
DSSDRV

SEQ ID NO: 51385 - protein, 14 aa, Mycobacterium avium
DSSNRQVREAAERA

SEQ ID NO: 51386 - protein, 18 aa, Mycobacterium avium
DSSSPSEDFGRQPPQDLA

SEQ ID NO: 51387 - protein, 8 aa, Mycobacterium avium
DSSTGALR

SEQ ID NO: 51388 - protein, 7 aa, Mycobacterium avium
DSSTYRT

SEQ ID NO: 51389 - protein, 9 aa, Mycobacterium avium
DSTGLRPEQ

SEQ ID NO: 51390 - protein, 5 aa, Mycobacterium avium
DSTSM

SEQ ID NO: 51391 - protein, 6 aa, Mycobacterium avium
DSVGQA

SEQ ID NO: 51392 - protein, 7 aa, Mycobacterium avium
DSVPDGQ

SEQ ID NO: 51393 - protein, 13 aa, Mycobacterium avium
DSVPDPKIEQPTD

SEQ ID NO: 51394 - protein, 4 aa, Mycobacterium avium
DSVS

SEQ ID NO: 51395 - protein, 10 aa, Mycobacterium avium
DSYAAGAAGD

SEQ ID NO: 51396 - protein, 9 aa, Mycobacterium avium
DSYQPTGDG

SEQ ID NO: 51397 - protein, 20 aa, Mycobacterium avium
DTAAPAEPEPADGDEADDLE

SEQ ID NO: 51398 - protein, 5 aa, Mycobacterium avium
DTADA

SEQ ID NO: 51399 - protein, 13 aa, Mycobacterium avium
DTAPAAANRGSRV

SEQ ID NO: 51400 - protein, 8 aa, Mycobacterium avium
DTDGNGLA

SEQ ID NO: 51401 - protein, 7 aa, Mycobacterium avium
DTDHPDE

SEQ ID NO: 51402 - protein, 48 aa, Mycobacterium avium
DTDPEPEPEADEASDSAVPASSDGAPMSDVAPAPAAAPSGAPRPEDIP

SEQ ID NO: 51403 - protein, 7 aa, Mycobacterium avium
DTEEEQR

SEQ ID NO: 51404 - protein, 15 aa, Mycobacterium avium
DTFPPDGEFPGSDPD

SEQ ID NO: 51405 - protein, 20 aa, Mycobacterium avium
DTGDPSQTTVPNDNVNPPNN

SEQ ID NO: 51406 - protein, 7 aa, Mycobacterium avium
DTGGDCP

SEQ ID NO: 51407 - protein, 9 aa, Mycobacterium avium
DTGGKTPLA

SEQ ID NO: 51408 - protein, 6 aa, Mycobacterium avium
DTGLDA

SEQ ID NO: 51409 - protein, 9 aa, Mycobacterium avium
DTGLDAGAV

SEQ ID NO: 51410 - protein, 9 aa, Mycobacterium avium
DTGVRLPPD

SEQ ID NO: 51411 - protein, 8 aa, Mycobacterium avium
DTHRECPP

SEQ ID NO: 51412 - protein, 12 aa, Mycobacterium avium
DTKQANRAAENT

SEQ ID NO: 51413 - protein, 15 aa, Mycobacterium avium
DTLDPAGILNPGKLI

SEQ ID NO: 51414 - protein, 18 aa, Mycobacterium avium
DTLGAQDNSTLSDPVDLA

SEQ ID NO: 51415 - protein, 9 aa, Mycobacterium avium
DTPARGATI

SEQ ID NO: 51416 - protein, 15 aa, Mycobacterium avium
DTPDFTAKGADGNPL

SEQ ID NO: 51417 - protein, 4 aa, Mycobacterium avium
DTPE

SEQ ID NO: 51418 - protein, 6 aa, Mycobacterium avium
DTPHGP

SEQ ID NO: 51419 - protein, 6 aa, Mycobacterium avium
DTPLGA

SEQ ID NO: 51420 - protein, 6 aa, Mycobacterium avium
DTPRFD

SEQ ID NO: 51421 - protein, 18 aa, Mycobacterium avium
DTPTRDDEAAAAPAGKPL

SEQ ID NO: 51422 - protein, 4 aa, Mycobacterium avium
DTQY

SEQ ID NO: 51423 - protein, 5 aa, Mycobacterium avium
DTRGG

SEQ ID NO: 51424 - protein, 4 aa, Mycobacterium avium
DTRI

SEQ ID NO: 51425 - protein, 10 aa, Mycobacterium avium
DTRLPDGRRV

SEQ ID NO: 51426 - protein, 4 aa, Mycobacterium avium
DTRP

SEQ ID NO: 51427 - protein, 8 aa, Mycobacterium avium
DTRPEDRA

SEQ ID NO: 51428 - protein, 28 aa, Mycobacterium avium
DTRPPGAELTPLGRDQAREFARRSGRPA

SEQ ID NO: 51429 - protein, 6 aa, Mycobacterium avium
DTRPSD

SEQ ID NO: 51430 - protein, 5 aa, Mycobacterium avium
DTRTK

SEQ ID NO: 51431 - protein, 11 aa, Mycobacterium avium
DTSEQAWRDAE

SEQ ID NO: 51432 - protein, 6 aa, Mycobacterium avium
DTTSEV

SEQ ID NO: 51433 - protein, 4 aa, Mycobacterium avium
DTVP

SEQ ID NO: 51434 - protein, 6 aa, Mycobacterium avium
DTVPDG

SEQ ID NO: 51435 - protein, 6 aa, Mycobacterium avium
DTVQRR

SEQ ID NO: 51436 - protein, 8 aa, Mycobacterium avium
DTYADDGA

SEQ ID NO: 51437 - protein, 4 aa, Mycobacterium avium
DTYR

SEQ ID NO: 51438 - protein, 8 aa, Mycobacterium avium
DTYVTTPG

SEQ ID NO: 51439 - protein, 9 aa, Mycobacterium avium
DVDDPGSRI

SEQ ID NO: 51440 - protein, 10 aa, Mycobacterium avium
DVDESTDAQA

SEQ ID NO: 51441 - protein, 6 aa, Mycobacterium avium
DVEADA

SEQ ID NO: 51442 - protein, 9 aa, Mycobacterium avium
DVEDPHPIS

SEQ ID NO: 51443 - protein, 4 aa, Mycobacterium avium
DVGE

SEQ ID NO: 51444 - protein, 6 aa, Mycobacterium avium
DVGSAV

SEQ ID NO: 51445 - protein, 7 aa, Mycobacterium avium
DVGTEVS

SEQ ID NO: 51446 - protein, 6 aa, Mycobacterium avium
DVMPPR

SEQ ID NO: 51447 - protein, 11 aa, Mycobacterium avium
DVPARGSAEHY

SEQ ID NO: 51448 - protein, 6 aa, Mycobacterium avium
DVPGSG

SEQ ID NO: 51449 - protein, 9 aa, Mycobacterium avium
DVRAGPTNC

SEQ ID NO: 51450 - protein, 5 aa, Mycobacterium avium
DVRPG

SEQ ID NO: 51451 - protein, 16 aa, Mycobacterium avium
DVRRPAPRSQTERTDR

SEQ ID NO: 51452 - protein, 16 aa, Mycobacterium avium
DVRTPSAAVREDLTGT

SEQ ID NO: 51453 - protein, 7 aa, Mycobacterium avium
DVSPLPR

SEQ ID NO: 51454 - protein, 5 aa, Mycobacterium avium
DVSSA

SEQ ID NO: 51455 - protein, 11 aa, Mycobacterium avium
DVSTEIRGDKV

SEQ ID NO: 51456 - protein, 7 aa, Mycobacterium avium
DVTDTGL

SEQ ID NO: 51457 - protein, 4 aa, Mycobacterium avium
DVTP

SEQ ID NO: 51458 - protein, 10 aa, Mycobacterium avium
DWADGGRTDA

SEQ ID NO: 51459 - protein, 6 aa, Mycobacterium avium
DWPADR

SEQ ID NO: 51460 - protein, 5 aa, Mycobacterium avium
DWSPD

SEQ ID NO: 51461 - protein, 5 aa, Mycobacterium avium
DWSRA

SEQ ID NO: 51462 - protein, 7 aa, Mycobacterium avium
DYARGGA

SEQ ID NO: 51463 - protein, 15 aa, Mycobacterium avium
DYHPEEPGGSAAGRT

SEQ ID NO: 51464 - protein, 6 aa, Mycobacterium avium
DYKAPD

SEQ ID NO: 51465 - protein, 9 aa, Mycobacterium avium
DYPATAPTE

SEQ ID NO: 51466 - protein, 5 aa, Mycobacterium avium
DYPGA

SEQ ID NO: 51467 - protein, 9 aa, Mycobacterium avium
DYRAPASPV

SEQ ID NO: 51468 - protein, 17 aa, Mycobacterium avium
DYRPELPGGRPRGGRSL

SEQ ID NO: 51469 - protein, 9 aa, Mycobacterium avium
DYRSEHGVT

SEQ ID NO: 51470 - protein, 10 aa, Mycobacterium avium
DYSLGGEQSG

SEQ ID NO: 51471 - protein, 6 aa, Mycobacterium avium
EAAAPL

SEQ ID NO: 51472 - protein, 5 aa, Mycobacterium avium
EAAAR

SEQ ID NO: 51473 - protein, 7 aa, Mycobacterium avium
EAAARAL

SEQ ID NO: 51474 - protein, 13 aa, Mycobacterium avium
EAAARARAGGGPT

SEQ ID NO: 51475 - protein, 8 aa, Mycobacterium avium
EAAERGLA

SEQ ID NO: 51476 - protein, 14 aa, Mycobacterium avium
EAAESSRDDGQRGH

SEQ ID NO: 51477 - protein, 7 aa, Mycobacterium avium
EAAGGKG

SEQ ID NO: 51478 - protein, 4 aa, Mycobacterium avium
EAAK

SEQ ID NO: 51479 - protein, 12 aa, Mycobacterium avium
EAAKQAAAKIDA

SEQ ID NO: 51480 - protein, 6 aa, Mycobacterium avium
EAAPYA

SEQ ID NO: 51481 - protein, 7 aa, Mycobacterium avium
EAAPYAR

SEQ ID NO: 51482 - protein, 8 aa, Mycobacterium avium
EAAQQTFE

SEQ ID NO: 51483 - protein, 19 aa, Mycobacterium avium
EAARPSAAQEAARPSASQP

SEQ ID NO: 51484 - protein, 18 aa, Mycobacterium avium
EAARREADTVKKRVSSEA

SEQ ID NO: 51485 - protein, 9 aa, Mycobacterium avium
EAASGWAPL

SEQ ID NO: 51486 - protein, 8 aa, Mycobacterium avium
EAATAYQA

SEQ ID NO: 51487 - protein, 6 aa, Mycobacterium avium
EADARR

SEQ ID NO: 51488 - protein, 30 aa, Mycobacterium avium
EADDTDTVEIGSGRSMSRGRRAQGEPGRAV

SEQ ID NO: 51489 - protein, 10 aa, Mycobacterium avium
EADNGGNELR

SEQ ID NO: 51490 - protein, 9 aa, Mycobacterium avium
EADPDGFAE

SEQ ID NO: 51491 - protein, 9 aa, Mycobacterium avium
EADPRRPVS

SEQ ID NO: 51492 - protein, 7 aa, Mycobacterium avium
EADRERF

SEQ ID NO: 51493 - protein, 9 aa, Mycobacterium avium
EADVGDQSG

SEQ ID NO: 51494 - protein, 7 aa, Mycobacterium avium
EAEAEAS

SEQ ID NO: 51495 - protein, 9 aa, Mycobacterium avium
EAEAKLGPN

SEQ ID NO: 51496 - protein, 8 aa, Mycobacterium avium
EAEEPSAI

SEQ ID NO: 51497 - protein, 58 aa, Mycobacterium avium
EAEGGPTTEAAKPKKKAATSGAKKAAKAAEPEAAAPEAAEPEAAAPAEGGEQAESSTE

SEQ ID NO: 51498 - protein, 7 aa, Mycobacterium avium
EAEPPGD

SEQ ID NO: 51499 - protein, 5 aa, Mycobacterium avium
EAGAD

SEQ ID NO: 51500 - protein, 8 aa, Mycobacterium avium
EAGADIGD

SEQ ID NO: 51501 - protein, 8 aa, Mycobacterium avium
EAGDTRHD

SEQ ID NO: 51502 - protein, 9 aa, Mycobacterium avium
EAGGWDAEY

SEQ ID NO: 51503 - protein, 7 aa, Mycobacterium avium
EAGHRSK

SEQ ID NO: 51504 - protein, 7 aa, Mycobacterium avium
EAGQTMP

SEQ ID NO: 51505 - protein, 7 aa, Mycobacterium avium
EAGRPVA

SEQ ID NO: 51506 - protein, 10 aa, Mycobacterium avium
EAGSGVYDGE

SEQ ID NO: 51507 - protein, 5 aa, Mycobacterium avium
EAGSM

SEQ ID NO: 51508 - protein, 8 aa, Mycobacterium avium
EAGSSNKA

SEQ ID NO: 51509 - protein, 7 aa, Mycobacterium avium
EAGSVQA

SEQ ID NO: 51510 - protein, 5 aa, Mycobacterium avium
EAHRA

SEQ ID NO: 51511 - protein, 11 aa, Mycobacterium avium
EAHTKTDGPPR

SEQ ID NO: 51512 - protein, 4 aa, Mycobacterium avium
EAIA

SEQ ID NO: 51513 - protein, 13 aa, Mycobacterium avium
EAKARRESLDSRP

SEQ ID NO: 51514 - protein, 7 aa, Mycobacterium avium
EAKEQLR

SEQ ID NO: 51515 - protein, 12 aa, Mycobacterium avium
EAKGRNGVPHPH

SEQ ID NO: 51516 - protein, 11 aa, Mycobacterium avium
EAKVGSDNDIP

SEQ ID NO: 51517 - protein, 6 aa, Mycobacterium avium
EALAAG

SEQ ID NO: 51518 - protein, 7 aa, Mycobacterium avium
EALRPTA

SEQ ID NO: 51519 - protein, 5 aa, Mycobacterium avium
EAMDS

SEQ ID NO: 51520 - protein, 10 aa, Mycobacterium avium
EAMETDAETL

SEQ ID NO: 51521 - protein, 8 aa, Mycobacterium avium
EANAANAR

SEQ ID NO: 51522 - protein, 8 aa, Mycobacterium avium
EANERAEV

SEQ ID NO: 51523 - protein, 8 aa, Mycobacterium avium
EANKDKAI

SEQ ID NO: 51524 - protein, 7 aa, Mycobacterium avium
EANPGIQ

SEQ ID NO: 51525 - protein, 23 aa, Mycobacterium avium
EANQRARSATRHGLSDRDRAYTA

SEQ ID NO: 51526 - protein, 16 aa, Mycobacterium avium
EANQRNNPASAGAGPE

SEQ ID NO: 51527 - protein, 12 aa, Mycobacterium avium
EAPAGGTAENPY

SEQ ID NO: 51528 - protein, 15 aa, Mycobacterium avium
EAPEAYRQAVESFLA

SEQ ID NO: 51529 - protein, 7 aa, Mycobacterium avium
EAPLASE

SEQ ID NO: 51530 - protein, 15 aa, Mycobacterium avium
EAPSPLLDPETRARI

SEQ ID NO: 51531 - protein, 6 aa, Mycobacterium avium
EAPTNG

SEQ ID NO: 51532 - protein, 8 aa, Mycobacterium avium
EAPTRADA

SEQ ID NO: 51533 - protein, 7 aa, Mycobacterium avium
EAQPHPH

SEQ ID NO: 51534 - protein, 12 aa, Mycobacterium avium
EARANSEQTSVS

SEQ ID NO: 51535 - protein, 9 aa, Mycobacterium avium
EARATPEAL

SEQ ID NO: 51536 - protein, 7 aa, Mycobacterium avium
EARGQQR

SEQ ID NO: 51537 - protein, 11 aa, Mycobacterium avium
EARNGRPPRER

SEQ ID NO: 51538 - protein, 5 aa, Mycobacterium avium
EARTT

SEQ ID NO: 51539 - protein, 7 aa, Mycobacterium avium
EASVSKR

SEQ ID NO: 51540 - protein, 7 aa, Mycobacterium avium
EASWGDV

SEQ ID NO: 51541 - protein, 9 aa, Mycobacterium avium
EATAAHSPD

SEQ ID NO: 51542 - protein, 10 aa, Mycobacterium avium
EATEGGRGLD

SEQ ID NO: 51543 - protein, 6 aa, Mycobacterium avium
EATESA

SEQ ID NO: 51544 - protein, 4 aa, Mycobacterium avium
EATG

SEQ ID NO: 51545 - protein, 8 aa, Mycobacterium avium
EATGDRGK

SEQ ID NO: 51546 - protein, 6 aa, Mycobacterium avium
EATKGR

SEQ ID NO: 51547 - protein, 5 aa, Mycobacterium avium
EATNR

SEQ ID NO: 51548 - protein, 4 aa, Mycobacterium avium
EATP

SEQ ID NO: 51549 - protein, 7 aa, Mycobacterium avium
EATPKVE

SEQ ID NO: 51550 - protein, 8 aa, Mycobacterium avium
EATQTDAE

SEQ ID NO: 51551 - protein, 12 aa, Mycobacterium avium
EATRTIGVTPGS

SEQ ID NO: 51552 - protein, 11 aa, Mycobacterium avium
EATSRAAARGA

SEQ ID NO: 51553 - protein, 6 aa, Mycobacterium avium
EAVDAG

SEQ ID NO: 51554 - protein, 5 aa, Mycobacterium avium
EAVEH

SEQ ID NO: 51555 - protein, 9 aa, Mycobacterium avium
ECGPDTREQ

SEQ ID NO: 51556 - protein, 10 aa, Mycobacterium avium
ECTDPAQPLA

SEQ ID NO: 51557 - protein, 5 aa, Mycobacterium avium
EDAAD

SEQ ID NO: 51558 - protein, 7 aa, Mycobacterium avium
EDAGDTA

SEQ ID NO: 51559 - protein, 8 aa, Mycobacterium avium
EDAGQVPS

SEQ ID NO: 51560 - protein, 7 aa, Mycobacterium avium
EDAPQSA

SEQ ID NO: 51561 - protein, 15 aa, Mycobacterium avium
EDDAIRDTKAALGQL

SEQ ID NO: 51562 - protein, 8 aa, Mycobacterium avium
EDDGRPGA

SEQ ID NO: 51563 - protein, 8 aa, Mycobacterium avium
EDDTVEVG

SEQ ID NO: 51564 - protein, 6 aa, Mycobacterium avium
EDGGRA

SEQ ID NO: 51565 - protein, 13 aa, Mycobacterium avium
EDGTPKTKHNTTN

SEQ ID NO: 51566 - protein, 14 aa, Mycobacterium avium
EDGTPPGSIGRPYP

SEQ ID NO: 51567 - protein, 6 aa, Mycobacterium avium
EDHSGP

SEQ ID NO: 51568 - protein, 9 aa, Mycobacterium avium
EDKPDDVVR

SEQ ID NO: 51569 - protein, 7 aa, Mycobacterium avium
EDNPPKS

SEQ ID NO: 51570 - protein, 21 aa, Mycobacterium avium
EDPDKPGKKDPDSGSNPSDPF

SEQ ID NO: 51571 - protein, 6 aa, Mycobacterium avium
EDPDNL

SEQ ID NO: 51572 - protein, 8 aa, Mycobacterium avium
EDPERSAA

SEQ ID NO: 51573 - protein, 7 aa, Mycobacterium avium
EDPEYPP

SEQ ID NO: 51574 - protein, 6 aa, Mycobacterium avium
EDPNVR

SEQ ID NO: 51575 - protein, 4 aa, Mycobacterium avium
EDPV

SEQ ID NO: 51576 - protein, 10 aa, Mycobacterium avium
EDPVPSNKHL

SEQ ID NO: 51577 - protein, 4 aa, Mycobacterium avium
EDQH

SEQ ID NO: 51578 - protein, 9 aa, Mycobacterium avium
EDQSGTVRR

SEQ ID NO: 51579 - protein, 14 aa, Mycobacterium avium
EDRDTVTAVREESE

SEQ ID NO: 51580 - protein, 6 aa, Mycobacterium avium
EDRPDE

SEQ ID NO: 51581 - protein, 5 aa, Mycobacterium avium
EDRRG

SEQ ID NO: 51582 - protein, 9 aa, Mycobacterium avium
EDSGAGVGT

SEQ ID NO: 51583 - protein, 14 aa, Mycobacterium avium
EDTAGTAPPPLTRE

SEQ ID NO: 51584 - protein, 52 aa, Mycobacterium avium
EDVAADDADIEPGDAEEGEDEEAAAPKAAGATAADEDDEIAEPSEKDKASGD

SEQ ID NO: 51585 - protein, 7 aa, Mycobacterium avium
EDVTDLS

SEQ ID NO: 51586 - protein, 5 aa, Mycobacterium avium
EDYAA

SEQ ID NO: 51587 - protein, 27 aa, Mycobacterium avium
EDYHRGESAYDRYYGDPTNKPNPNLGE

SEQ ID NO: 51588 - protein, 7 aa, Mycobacterium avium
EEAAEKV

SEQ ID NO: 51589 - protein, 13 aa, Mycobacterium avium
EEAGSDDFGAEGW

SEQ ID NO: 51590 - protein, 12 aa, Mycobacterium avium
EEALKTHSTAPA

SEQ ID NO: 51591 - protein, 13 aa, Mycobacterium avium
EEALTETPPWQGG

SEQ ID NO: 51592 - protein, 7 aa, Mycobacterium avium
EEASYDG

SEQ ID NO: 51593 - protein, 7 aa, Mycobacterium avium
EEATGAS

SEQ ID NO: 51594 - protein, 8 aa, Mycobacterium avium
EEAVSAED

SEQ ID NO: 51595 - protein, 5 aa, Mycobacterium avium
EEAYD

SEQ ID NO: 51596 - protein, 13 aa, Mycobacterium avium
EEDGVAKDSDTET

SEQ ID NO: 51597 - protein, 8 aa, Mycobacterium avium
EEGATGDV

SEQ ID NO: 51598 - protein, 7 aa, Mycobacterium avium
EEGDEGT

SEQ ID NO: 51599 - protein, 9 aa, Mycobacterium avium
EEGGAATVA

SEQ ID NO: 51600 - protein, 18 aa, Mycobacterium avium
EEIGGVGGAYASATLPGD

SEQ ID NO: 51601 - protein, 9 aa, Mycobacterium avium
EEKKRQRAE

SEQ ID NO: 51602 - protein, 4 aa, Mycobacterium avium
EEKN

SEQ ID NO: 51603 - protein, 11 aa, Mycobacterium avium
EELEAGRTQTV

SEQ ID NO: 51604 - protein, 19 aa, Mycobacterium avium
EELETTNEELQSTNEELET

SEQ ID NO: 51605 - protein, 8 aa, Mycobacterium avium
EELGDGAR

SEQ ID NO: 51606 - protein, 14 aa, Mycobacterium avium
EELGNTPAVARGSY

SEQ ID NO: 51607 - protein, 11 aa, Mycobacterium avium
EELRQTDPTRL

SEQ ID NO: 51608 - protein, 8 aa, Mycobacterium avium
EENAGAGA

SEQ ID NO: 51609 - protein, 8 aa, Mycobacterium avium
EENPNLQR

SEQ ID NO: 51610 - protein, 7 aa, Mycobacterium avium
EEPDGPV

SEQ ID NO: 51611 - protein, 7 aa, Mycobacterium avium
EEPDPRP

SEQ ID NO: 51612 - protein, 10 aa, Mycobacterium avium
EEPRHGDPIR

SEQ ID NO: 51613 - protein, 20 aa, Mycobacterium avium
EERFGGDDAVRPEFGSPPIP

SEQ ID NO: 51614 - protein, 17 aa, Mycobacterium avium
EESGDPAIDADSDVTAW

SEQ ID NO: 51615 - protein, 5 aa, Mycobacterium avium
EETAS

SEQ ID NO: 51616 - protein, 11 aa, Mycobacterium avium
EETDRNPPRLE

SEQ ID NO: 51617 - protein, 4 aa, Mycobacterium avium
EETE

SEQ ID NO: 51618 - protein, 6 aa, Mycobacterium avium
EETGIR

SEQ ID NO: 51619 - protein, 6 aa, Mycobacterium avium
EETPLE

SEQ ID NO: 51620 - protein, 13 aa, Mycobacterium avium
EEVERRREITGGK

SEQ ID NO: 51621 - protein, 9 aa, Mycobacterium avium
EEYGGGGAG

SEQ ID NO: 51622 - protein, 11 aa, Mycobacterium avium
EEYGGGGNPDF

SEQ ID NO: 51623 - protein, 17 aa, Mycobacterium avium
EFDSRRTGFTPPPPRYK

SEQ ID NO: 51624 - protein, 13 aa, Mycobacterium avium
EFGVGGGPIANED

SEQ ID NO: 51625 - protein, 9 aa, Mycobacterium avium
EFPENPSAA

SEQ ID NO: 51626 - protein, 6 aa, Mycobacterium avium
EGAAEG

SEQ ID NO: 51627 - protein, 16 aa, Mycobacterium avium
EGAAESIADRVRSGGV

SEQ ID NO: 51628 - protein, 30 aa, Mycobacterium avium
EGAAGAVGHDTTQAATAVDEPAPAESRAAA

SEQ ID NO: 51629 - protein, 33 aa, Mycobacterium avium
EGAAPREAGRRAAAAAGATVQRLGGRPDLTGLR

SEQ ID NO: 51630 - protein, 11 aa, Mycobacterium avium
EGAARALAGAA

SEQ ID NO: 51631 - protein, 8 aa, Mycobacterium avium
EGAATGMP

SEQ ID NO: 51632 - protein, 10 aa, Mycobacterium avium
EGAATQAAAM

SEQ ID NO: 51633 - protein, 7 aa, Mycobacterium avium
EGADPGH

SEQ ID NO: 51634 - protein, 5 aa, Mycobacterium avium
EGAEL

SEQ ID NO: 51635 - protein, 15 aa, Mycobacterium avium
EGAESARRVGTDALT

SEQ ID NO: 51636 - protein, 13 aa, Mycobacterium avium
EGALPPPRKKSRR

SEQ ID NO: 51637 - protein, 17 aa, Mycobacterium avium
EGANATVGRITQSGGRA

SEQ ID NO: 51638 - protein, 6 aa, Mycobacterium avium
EGARTR

SEQ ID NO: 51639 - protein, 10 aa, Mycobacterium avium
EGASPAVGSV

SEQ ID NO: 51640 - protein, 12 aa, Mycobacterium avium
EGDATTREANER

SEQ ID NO: 51641 - protein, 9 aa, Mycobacterium avium
EGDEATGAN

SEQ ID NO: 51642 - protein, 20 aa, Mycobacterium avium
EGDESVPLAGSARRTHRAIP

SEQ ID NO: 51643 - protein, 5 aa, Mycobacterium avium
EGDID

SEQ ID NO: 51644 - protein, 5 aa, Mycobacterium avium
EGDPH

SEQ ID NO: 51645 - protein, 15 aa, Mycobacterium avium
EGEPATQPSGIPGDR

SEQ ID NO: 51646 - protein, 13 aa, Mycobacterium avium
EGEPEAVDAGDDM

SEQ ID NO: 51647 - protein, 10 aa, Mycobacterium avium
EGEPKPIAGV

SEQ ID NO: 51648 - protein, 4 aa, Mycobacterium avium
EGFR

SEQ ID NO: 51649 - protein, 7 aa, Mycobacterium avium
EGFRDDG

SEQ ID NO: 51650 - protein, 4 aa, Mycobacterium avium
EGGE

SEQ ID NO: 51651 - protein, 14 aa, Mycobacterium avium
EGGGTANATLVELV

SEQ ID NO: 51652 - protein, 7 aa, Mycobacterium avium
EGGIADD

SEQ ID NO: 51653 - protein, 11 aa, Mycobacterium avium
EGGSPADDEFN

SEQ ID NO: 51654 - protein, 7 aa, Mycobacterium avium
EGHKSTH

SEQ ID NO: 51655 - protein, 9 aa, Mycobacterium avium
EGHTATDST

SEQ ID NO: 51656 - protein, 10 aa, Mycobacterium avium
EGHVRDGHGD

SEQ ID NO: 51657 - protein, 11 aa, Mycobacterium avium
EGIASGDPVSA

SEQ ID NO: 51658 - protein, 6 aa, Mycobacterium avium
EGIGGA

SEQ ID NO: 51659 - protein, 8 aa, Mycobacterium avium
EGKGPDES

SEQ ID NO: 51660 - protein, 6 aa, Mycobacterium avium
EGKNAL

SEQ ID NO: 51661 - protein, 8 aa, Mycobacterium avium
EGKNDGVE

SEQ ID NO: 51662 - protein, 19 aa, Mycobacterium avium
EGLARTRAAADDAGTGKRL

SEQ ID NO: 51663 - protein, 18 aa, Mycobacterium avium
EGNADKAVTSAAAIFEVV

SEQ ID NO: 51664 - protein, 7 aa, Mycobacterium avium
EGNPDAA

SEQ ID NO: 51665 - protein, 6 aa, Mycobacterium avium
EGPKNV

SEQ ID NO: 51666 - protein, 6 aa, Mycobacterium avium
EGPPPW

SEQ ID NO: 51667 - protein, 15 aa, Mycobacterium avium
EGPSTEVNLARRFLT

SEQ ID NO: 51668 - protein, 5 aa, Mycobacterium avium
EGQPE

SEQ ID NO: 51669 - protein, 8 aa, Mycobacterium avium
EGQTGDTA

SEQ ID NO: 51670 - protein, 9 aa, Mycobacterium avium
EGRAAPPPI

SEQ ID NO: 51671 - protein, 11 aa, Mycobacterium avium
EGRDPAQSLTA

SEQ ID NO: 51672 - protein, 8 aa, Mycobacterium avium
EGRGPYAD

SEQ ID NO: 51673 - protein, 6 aa, Mycobacterium avium
EGRLPR

SEQ ID NO: 51674 - protein, 13 aa, Mycobacterium avium
EGRNIRGVIDFAG

SEQ ID NO: 51675 - protein, 8 aa, Mycobacterium avium
EGRNLTTD

SEQ ID NO: 51676 - protein, 6 aa, Mycobacterium avium
EGRRTL

SEQ ID NO: 51677 - protein, 17 aa, Mycobacterium avium
EGRVQAAQRAKEQQQQK

SEQ ID NO: 51678 - protein, 4 aa, Mycobacterium avium
EGSD

SEQ ID NO: 51679 - protein, 10 aa, Mycobacterium avium
EGTDADGVAR

SEQ ID NO: 51680 - protein, 5 aa, Mycobacterium avium
EGTGA

SEQ ID NO: 51681 - protein, 4 aa, Mycobacterium avium
EGTV

SEQ ID NO: 51682 - protein, 13 aa, Mycobacterium avium
EGYSGRGTQRLGE

SEQ ID NO: 51683 - protein, 14 aa, Mycobacterium avium
EGYSPTFPGAEDFG

SEQ ID NO: 51684 - protein, 8 aa, Mycobacterium avium
EHAARRAG

SEQ ID NO: 51685 - protein, 5 aa, Mycobacterium avium
EHADQ

SEQ ID NO: 51686 - protein, 4 aa, Mycobacterium avium
EHAE

SEQ ID NO: 51687 - protein, 11 aa, Mycobacterium avium
EHAESKDHHPD

SEQ ID NO: 51688 - protein, 4 aa, Mycobacterium avium
EHAG

SEQ ID NO: 51689 - protein, 32 aa, Mycobacterium avium
EHAGPGVPGHHRGEGGLKSVAASSRHRPRGAA

SEQ ID NO: 51690 - protein, 8 aa, Mycobacterium avium
EHAKARGA

SEQ ID NO: 51691 - protein, 7 aa, Mycobacterium avium
EHDPSCT

SEQ ID NO: 51692 - protein, 11 aa, Mycobacterium avium
EHDSSHDLGVD

SEQ ID NO: 51693 - protein, 7 aa, Mycobacterium avium
EHGDEGE

SEQ ID NO: 51694 - protein, 8 aa, Mycobacterium avium
EHGEDDPA

SEQ ID NO: 51695 - protein, 4 aa, Mycobacterium avium
EHNL

SEQ ID NO: 51696 - protein, 4 aa, Mycobacterium avium
EHPR

SEQ ID NO: 51697 - protein, 9 aa, Mycobacterium avium
EHPRRDTSM

SEQ ID NO: 51698 - protein, 9 aa, Mycobacterium avium
EHPRRDTTV

SEQ ID NO: 51699 - protein, 6 aa, Mycobacterium avium
EHPSDD

SEQ ID NO: 51700 - protein, 7 aa, Mycobacterium avium
EHRDSAG

SEQ ID NO: 51701 - protein, 11 aa, Mycobacterium avium
EHVPDPNAFSD

SEQ ID NO: 51702 - protein, 12 aa, Mycobacterium avium
EIAGARAAARAG

SEQ ID NO: 51703 - protein, 8 aa, Mycobacterium avium
EIARTERS

SEQ ID NO: 51704 - protein, 19 aa, Mycobacterium avium
EIDGSAKPACVAESIVRYI

SEQ ID NO: 51705 - protein, 8 aa, Mycobacterium avium
EIDSARGP

SEQ ID NO: 51706 - protein, 13 aa, Mycobacterium avium
EIEDPDMQRDPGM

SEQ ID NO: 51707 - protein, 9 aa, Mycobacterium avium
EIEPDQRAT

SEQ ID NO: 51708 - protein, 5 aa, Mycobacterium avium
EIGMR

SEQ ID NO: 51709 - protein, 10 aa, Mycobacterium avium
EIGPSPAEAD

SEQ ID NO: 51710 - protein, 8 aa, Mycobacterium avium
EINRTDAY

SEQ ID NO: 51711 - protein, 9 aa, Mycobacterium avium
EIPAADASL

SEQ ID NO: 51712 - protein, 6 aa, Mycobacterium avium
EIPADQ

SEQ ID NO: 51713 - protein, 10 aa, Mycobacterium avium
EIPARSAQFG

SEQ ID NO: 51714 - protein, 6 aa, Mycobacterium avium
EIPPGT

SEQ ID NO: 51715 - protein, 5 aa, Mycobacterium avium
EIQKD

SEQ ID NO: 51716 - protein, 11 aa, Mycobacterium avium
EIQPGTSEFDP

SEQ ID NO: 51717 - protein, 6 aa, Mycobacterium avium
EIRQQR

SEQ ID NO: 51718 - protein, 14 aa, Mycobacterium avium
EKAEQAQAAGADIV

SEQ ID NO: 51719 - protein, 13 aa, Mycobacterium avium
EKANAQDQKLAEE

SEQ ID NO: 51720 - protein, 9 aa, Mycobacterium avium
EKASGRDLS

SEQ ID NO: 51721 - protein, 9 aa, Mycobacterium avium
EKDADGYPK

SEQ ID NO: 51722 - protein, 11 aa, Mycobacterium avium
EKDPKLTAEDR

SEQ ID NO: 51723 - protein, 4 aa, Mycobacterium avium
EKGA

SEQ ID NO: 51724 - protein, 8 aa, Mycobacterium avium
EKGEPPRV

SEQ ID NO: 51725 - protein, 9 aa, Mycobacterium avium
EKKGIPRAN

SEQ ID NO: 51726 - protein, 11 aa, Mycobacterium avium
EKLARQPLSGA

SEQ ID NO: 51727 - protein, 10 aa, Mycobacterium avium
EKLGQESQAL

SEQ ID NO: 51728 - protein, 6 aa, Mycobacterium avium
EKNGVD

SEQ ID NO: 51729 - protein, 8 aa, Mycobacterium avium
EKPSRQVN

SEQ ID NO: 51730 - protein, 11 aa, Mycobacterium avium
EKPVTSDGPHY

SEQ ID NO: 51731 - protein, 13 aa, Mycobacterium avium
EKRPPDYSRFPRY

SEQ ID NO: 51732 - protein, 17 aa, Mycobacterium avium
EKRPYPPGQHGRARIKE

SEQ ID NO: 51733 - protein, 9 aa, Mycobacterium avium
EKSKSVNSV

SEQ ID NO: 51734 - protein, 6 aa, Mycobacterium avium
EKSPSF

SEQ ID NO: 51735 - protein, 4 aa, Mycobacterium avium
EKTG

SEQ ID NO: 51736 - protein, 7 aa, Mycobacterium avium
EKTGGRV

SEQ ID NO: 51737 - protein, 9 aa, Mycobacterium avium
ELADSGSRI

SEQ ID NO: 51738 - protein, 15 aa, Mycobacterium avium
ELAEREREAAEADRA

SEQ ID NO: 51739 - protein, 12 aa, Mycobacterium avium
ELAPGDDAVDDA

SEQ ID NO: 51740 - protein, 7 aa, Mycobacterium avium
ELAPPDG

SEQ ID NO: 51741 - protein, 6 aa, Mycobacterium avium
ELAPPH

SEQ ID NO: 51742 - protein, 9 aa, Mycobacterium avium
ELARPGKDI

SEQ ID NO: 51743 - protein, 10 aa, Mycobacterium avium
ELARRGRGTP

SEQ ID NO: 51744 - protein, 17 aa, Mycobacterium avium
ELDGRSPVRRAGAEPGS

SEQ ID NO: 51745 - protein, 15 aa, Mycobacterium avium
ELGEGEPDGSDEYRA

SEQ ID NO: 51746 - protein, 5 aa, Mycobacterium avium
ELGNP

SEQ ID NO: 51747 - protein, 6 aa, Mycobacterium avium
ELGPDE

SEQ ID NO: 51748 - protein, 12 aa, Mycobacterium avium
ELGPQAHSIQSP

SEQ ID NO: 51749 - protein, 11 aa, Mycobacterium avium
ELGPYGSSRTR

SEQ ID NO: 51750 - protein, 17 aa, Mycobacterium avium
ELGTGPVSFKDSTSPEF

SEQ ID NO: 51751 - protein, 7 aa, Mycobacterium avium
ELGYGSD

SEQ ID NO: 51752 - protein, 6 aa, Mycobacterium avium
ELHGGS

SEQ ID NO: 51753 - protein, 5 aa, Mycobacterium avium
ELNPD

SEQ ID NO: 51754 - protein, 4 aa, Mycobacterium avium
ELPA

SEQ ID NO: 51755 - protein, 8 aa, Mycobacterium avium
ELPAGRSG

SEQ ID NO: 51756 - protein, 6 aa, Mycobacterium avium
ELPDGS

SEQ ID NO: 51757 - protein, 9 aa, Mycobacterium avium
ELPDPPALP

SEQ ID NO: 51758 - protein, 11 aa, Mycobacterium avium
ELPEAPQGEPG

SEQ ID NO: 51759 - protein, 9 aa, Mycobacterium avium
ELPEPEHAD

SEQ ID NO: 51760 - protein, 6 aa, Mycobacterium avium
ELPNGP

SEQ ID NO: 51761 - protein, 6 aa, Mycobacterium avium
ELPRAT

SEQ ID NO: 51762 - protein, 19 aa, Mycobacterium avium
ELQSTNEELETTNEELQST

SEQ ID NO: 51763 - protein, 9 aa, Mycobacterium avium
ELSGPPADG

SEQ ID NO: 51764 - protein, 9 aa, Mycobacterium avium
ELSSSASSF

SEQ ID NO: 51765 - protein, 12 aa, Mycobacterium avium
ELSTASGRRTHQ

SEQ ID NO: 51766 - protein, 12 aa, Mycobacterium avium
ELSTTAAATQSA

SEQ ID NO: 51767 - protein, 8 aa, Mycobacterium avium
ELTGKTTY

SEQ ID NO: 51768 - protein, 5 aa, Mycobacterium avium
ELTPQ

SEQ ID NO: 51769 - protein, 10 aa, Mycobacterium avium
ELTSSTEERV

SEQ ID NO: 51770 - protein, 4 aa, Mycobacterium avium
ELVA

SEQ ID NO: 51771 - protein, 6 aa, Mycobacterium avium
EMAPAT

SEQ ID NO: 51772 - protein, 48 aa, Mycobacterium avium
EMQSENKTETSALGAQSESSAANPTPVQSQRVDPPAPSEQGHSEARPA

SEQ ID NO: 51773 - protein, 6 aa, Mycobacterium avium
ENAGTE

SEQ ID NO: 51774 - protein, 5 aa, Mycobacterium avium
ENDEA

SEQ ID NO: 51775 - protein, 4 aa, Mycobacterium avium
ENGS

SEQ ID NO: 51776 - protein, 8 aa, Mycobacterium avium
ENNPPDPA

SEQ ID NO: 51777 - protein, 4 aa, Mycobacterium avium
ENNT

SEQ ID NO: 51778 - protein, 7 aa, Mycobacterium avium
ENPATEQ

SEQ ID NO: 51779 - protein, 15 aa, Mycobacterium avium
ENPDRHGLAETPARV

SEQ ID NO: 51780 - protein, 6 aa, Mycobacterium avium
ENQAPI

SEQ ID NO: 51781 - protein, 23 aa, Mycobacterium avium
ENRAPAKPNSSAVSVKPEPGARC

SEQ ID NO: 51782 - protein, 4 aa, Mycobacterium avium
ENRY

SEQ ID NO: 51783 - protein, 4 aa, Mycobacterium avium
ENSQ

SEQ ID NO: 51784 - protein, 6 aa, Mycobacterium avium
ENTEPL

SEQ ID NO: 51785 - protein, 5 aa, Mycobacterium avium
ENTSS

SEQ ID NO: 51786 - protein, 4 aa, Mycobacterium avium
EPAA

SEQ ID NO: 51787 - protein, 19 aa, Mycobacterium avium
EPADEQPPLRAGPVRWHRR

SEQ ID NO: 51788 - protein, 8 aa, Mycobacterium avium
EPANQGAW

SEQ ID NO: 51789 - protein, 6 aa, Mycobacterium avium
EPAPRR

SEQ ID NO: 51790 - protein, 8 aa, Mycobacterium avium
EPARATAA

SEQ ID NO: 51791 - protein, 5 aa, Mycobacterium avium
EPASP

SEQ ID NO: 51792 - protein, 6 aa, Mycobacterium avium
EPASTV

SEQ ID NO: 51793 - protein, 11 aa, Mycobacterium avium
EPATSGRPVGL

SEQ ID NO: 51794 - protein, 4 aa, Mycobacterium avium
EPCP

SEQ ID NO: 51795 - protein, 5 aa, Mycobacterium avium
EPCPA

SEQ ID NO: 51796 - protein, 5 aa, Mycobacterium avium
EPDAG

SEQ ID NO: 51797 - protein, 5 aa, Mycobacterium avium
EPDDI

SEQ ID NO: 51798 - protein, 8 aa, Mycobacterium avium
EPDGNPGQ

SEQ ID NO: 51799 - protein, 7 aa, Mycobacterium avium
EPDYEQA

SEQ ID NO: 51800 - protein, 16 aa, Mycobacterium avium
EPEESAAAQSASRRTA

SEQ ID NO: 51801 - protein, 14 aa, Mycobacterium avium
EPEPSFEPTPRPAD

SEQ ID NO: 51802 - protein, 5 aa, Mycobacterium avium
EPETP

SEQ ID NO: 51803 - protein, 18 aa, Mycobacterium avium
EPFTGGEPLDDEDARPRQ

SEQ ID NO: 51804 - protein, 10 aa, Mycobacterium avium
EPGAGLDTSR

SEQ ID NO: 51805 - protein, 20 aa, Mycobacterium avium
EPGAGSDAAALSTRAVRQGG

SEQ ID NO: 51806 - protein, 6 aa, Mycobacterium avium
EPGAPI

SEQ ID NO: 51807 - protein, 8 aa, Mycobacterium avium
EPGLPAHD

SEQ ID NO: 51808 - protein, 8 aa, Mycobacterium avium
EPGPDGRE

SEQ ID NO: 51809 - protein, 4 aa, Mycobacterium avium
EPGQ

SEQ ID NO: 51810 - protein, 8 aa, Mycobacterium avium
EPGQGWAP

SEQ ID NO: 51811 - protein, 32 aa, Mycobacterium avium
EPGQRKPTAEVGTKAARQGDPWTLSGQKNPVL

SEQ ID NO: 51812 - protein, 6 aa, Mycobacterium avium
EPGSAL

SEQ ID NO: 51813 - protein, 7 aa, Mycobacterium avium
EPGSRGL

SEQ ID NO: 51814 - protein, 30 aa, Mycobacterium avium
EPGTEQVGPGTQPAEVGDDAQGGAATGRLQ

SEQ ID NO: 51815 - protein, 4 aa, Mycobacterium avium
EPIP

SEQ ID NO: 51816 - protein, 16 aa, Mycobacterium avium
EPKRRGRQGAAAPPLR

SEQ ID NO: 51817 - protein, 18 aa, Mycobacterium avium
EPKYVASGETSAKPVEYP

SEQ ID NO: 51818 - protein, 4 aa, Mycobacterium avium
EPMG

SEQ ID NO: 51819 - protein, 9 aa, Mycobacterium avium
EPPGGPALG

SEQ ID NO: 51820 - protein, 5 aa, Mycobacterium avium
EPPGP

SEQ ID NO: 51821 - protein, 7 aa, Mycobacterium avium
EPPGPSV

SEQ ID NO: 51822 - protein, 5 aa, Mycobacterium avium
EPPVA

SEQ ID NO: 51823 - protein, 12 aa, Mycobacterium avium
EPQDGRYDDLSP

SEQ ID NO: 51824 - protein, 17 aa, Mycobacterium avium
EPQFEGQTKTKLGNTEV

SEQ ID NO: 51825 - protein, 8 aa, Mycobacterium avium
EPQTQDVP

SEQ ID NO: 51826 - protein, 5 aa, Mycobacterium avium
EPQVA

SEQ ID NO: 51827 - protein, 4 aa, Mycobacterium avium
EPRA

SEQ ID NO: 51828 - protein, 9 aa, Mycobacterium avium
EPRKGDNAP

SEQ ID NO: 51829 - protein, 25 aa, Mycobacterium avium
EPRPEPEPQREPERAFTRTSTEQGS

SEQ ID NO: 51830 - protein, 8 aa, Mycobacterium avium
EPRPSWGH

SEQ ID NO: 51831 - protein, 12 aa, Mycobacterium avium
EPSEAVDKYGPG

SEQ ID NO: 51832 - protein, 7 aa, Mycobacterium avium
EPSSGLD

SEQ ID NO: 51833 - protein, 4 aa, Mycobacterium avium
EPSV

SEQ ID NO: 51834 - protein, 8 aa, Mycobacterium avium
EPTAPEVP

SEQ ID NO: 51835 - protein, 7 aa, Mycobacterium avium
EPTGDRW

SEQ ID NO: 51836 - protein, 5 aa, Mycobacterium avium
EPTNH

SEQ ID NO: 51837 - protein, 5 aa, Mycobacterium avium
EPTVE

SEQ ID NO: 51838 - protein, 13 aa, Mycobacterium avium
EPVADGGAANRTT

SEQ ID NO: 51839 - protein, 6 aa, Mycobacterium avium
EPVDAA

SEQ ID NO: 51840 - protein, 10 aa, Mycobacterium avium
EPVEGTGPSY

SEQ ID NO: 51841 - protein, 5 aa, Mycobacterium avium
EPVPA

SEQ ID NO: 51842 - protein, 5 aa, Mycobacterium avium
EPVPP

SEQ ID NO: 51843 - protein, 7 aa, Mycobacterium avium
EPYGGPD

SEQ ID NO: 51844 - protein, 11 aa, Mycobacterium avium
EQAAQAPGDYA

SEQ ID NO: 51845 - protein, 10 aa, Mycobacterium avium
EQADPNFAER

SEQ ID NO: 51846 - protein, 6 aa, Mycobacterium avium
EQAHGA

SEQ ID NO: 51847 - protein, 6 aa, Mycobacterium avium
EQDRDR

SEQ ID NO: 51848 - protein, 8 aa, Mycobacterium avium
EQDRPLSE

SEQ ID NO: 51849 - protein, 14 aa, Mycobacterium avium
EQEGPDSPGSGGGD

SEQ ID NO: 51850 - protein, 7 aa, Mycobacterium avium
EQEIGQG

SEQ ID NO: 51851 - protein, 9 aa, Mycobacterium avium
EQGAVPKAR

SEQ ID NO: 51852 - protein, 6 aa, Mycobacterium avium
EQGGGY

SEQ ID NO: 51853 - protein, 9 aa, Mycobacterium avium
EQGKEADPR

SEQ ID NO: 51854 - protein, 8 aa, Mycobacterium avium
EQGKTDWA

SEQ ID NO: 51855 - protein, 14 aa, Mycobacterium avium
EQGSQNTDKQLAAR

SEQ ID NO: 51856 - protein, 6 aa, Mycobacterium avium
EQGTVQ

SEQ ID NO: 51857 - protein, 7 aa, Mycobacterium avium
EQLRGRA

SEQ ID NO: 51858 - protein, 5 aa, Mycobacterium avium
EQNGH

SEQ ID NO: 51859 - protein, 5 aa, Mycobacterium avium
EQPGL

SEQ ID NO: 51860 - protein, 6 aa, Mycobacterium avium
EQPQNQ

SEQ ID NO: 51861 - protein, 4 aa, Mycobacterium avium
EQQN

SEQ ID NO: 51862 - protein, 10 aa, Mycobacterium avium
EQRAVPGPGA

SEQ ID NO: 51863 - protein, 4 aa, Mycobacterium avium
EQRG

SEQ ID NO: 51864 - protein, 17 aa, Mycobacterium avium
EQRGPWGPGRRAEAADA

SEQ ID NO: 51865 - protein, 5 aa, Mycobacterium avium
EQRPD

SEQ ID NO: 51866 - protein, 5 aa, Mycobacterium avium
EQRRR

SEQ ID NO: 51867 - protein, 10 aa, Mycobacterium avium
EQRRRKPTDD

SEQ ID NO: 51868 - protein, 10 aa, Mycobacterium avium
EQSASSYTAE

SEQ ID NO: 51869 - protein, 19 aa, Mycobacterium avium
EQTDAAAGALPGLSQPAAK

SEQ ID NO: 51870 - protein, 10 aa, Mycobacterium avium
EQTESLGPQS

SEQ ID NO: 51871 - protein, 12 aa, Mycobacterium avium
EQTGGFEGRTKK

SEQ ID NO: 51872 - protein, 7 aa, Mycobacterium avium
EQTTEAM

SEQ ID NO: 51873 - protein, 4 aa, Mycobacterium avium
EQVD

SEQ ID NO: 51874 - protein, 12 aa, Mycobacterium avium
EQVPGESYEHGN

SEQ ID NO: 51875 - protein, 6 aa, Mycobacterium avium
ERAARE

SEQ ID NO: 51876 - protein, 7 aa, Mycobacterium avium
ERADGAL

SEQ ID NO: 51877 - protein, 11 aa, Mycobacterium avium
ERADPVPDGDL

SEQ ID NO: 51878 - protein, 18 aa, Mycobacterium avium
ERAEETRAETRTRVEERR

SEQ ID NO: 51879 - protein, 10 aa, Mycobacterium avium
ERAGGATDQF

SEQ ID NO: 51880 - protein, 8 aa, Mycobacterium avium
ERAGRPSL

SEQ ID NO: 51881 - protein, 7 aa, Mycobacterium avium
ERAPAEL

SEQ ID NO: 51882 - protein, 10 aa, Mycobacterium avium
ERAQSRASRL

SEQ ID NO: 51883 - protein, 4 aa, Mycobacterium avium
ERAR

SEQ ID NO: 51884 - protein, 11 aa, Mycobacterium avium
ERASDQSPESG

SEQ ID NO: 51885 - protein, 9 aa, Mycobacterium avium
ERDAQRRHN

SEQ ID NO: 51886 - protein, 7 aa, Mycobacterium avium
ERDGDGV

SEQ ID NO: 51887 - protein, 8 aa, Mycobacterium avium
ERDGKVSR

SEQ ID NO: 51888 - protein, 7 aa, Mycobacterium avium
ERDPGNT

SEQ ID NO: 51889 - protein, 7 aa, Mycobacterium avium
ERDYTTP

SEQ ID NO: 51890 - protein, 10 aa, Mycobacterium avium
EREGKPQRIG

SEQ ID NO: 51891 - protein, 10 aa, Mycobacterium avium
ERENSDTAAG

SEQ ID NO: 51892 - protein, 14 aa, Mycobacterium avium
ERERGAAPDTIPAA

SEQ ID NO: 51893 - protein, 5 aa, Mycobacterium avium
EREYT

SEQ ID NO: 51894 - protein, 4 aa, Mycobacterium avium
ERFS

SEQ ID NO: 51895 - protein, 6 aa, Mycobacterium avium
ERGADA

SEQ ID NO: 51896 - protein, 5 aa, Mycobacterium avium
ERGDE

SEQ ID NO: 51897 - protein, 5 aa, Mycobacterium avium
ERGDH

SEQ ID NO: 51898 - protein, 11 aa, Mycobacterium avium
ERGEPTPDPEP

SEQ ID NO: 51899 - protein, 9 aa, Mycobacterium avium
ERGPAATSI

SEQ ID NO: 51900 - protein, 7 aa, Mycobacterium avium
ERGQGGT

SEQ ID NO: 51901 - protein, 6 aa, Mycobacterium avium
ERGQPR

SEQ ID NO: 51902 - protein, 5 aa, Mycobacterium avium
ERGVD

SEQ ID NO: 51903 - protein, 11 aa, Mycobacterium avium
ERHTHAGGDYA

SEQ ID NO: 51904 - protein, 8 aa, Mycobacterium avium
ERIAPADG

SEQ ID NO: 51905 - protein, 8 aa, Mycobacterium avium
ERITPRTR

SEQ ID NO: 51906 - protein, 12 aa, Mycobacterium avium
ERKAAEKPRKSV

SEQ ID NO: 51907 - protein, 8 aa, Mycobacterium avium
ERKANGPF

SEQ ID NO: 51908 - protein, 4 aa, Mycobacterium avium
ERKD

SEQ ID NO: 51909 - protein, 7 aa, Mycobacterium avium
ERKDGTA

SEQ ID NO: 51910 - protein, 6 aa, Mycobacterium avium
ERLATR

SEQ ID NO: 51911 - protein, 5 aa, Mycobacterium avium
ERNPQ

SEQ ID NO: 51912 - protein, 5 aa, Mycobacterium avium
ERNSG

SEQ ID NO: 51913 - protein, 9 aa, Mycobacterium avium
ERPALDPNR

SEQ ID NO: 51914 - protein, 13 aa, Mycobacterium avium
ERPGRPLGASTAE

SEQ ID NO: 51915 - protein, 51 aa, Mycobacterium avium
ERPPRNGKNGGDDGNGSSSSEIKGIDGSTRLEAKRQRRRDGRDAGRRRPPV

SEQ ID NO: 51916 - protein, 9 aa, Mycobacterium avium
ERPVPAAHP

SEQ ID NO: 51917 - protein, 11 aa, Mycobacterium avium
ERPVRSARGWS

SEQ ID NO: 51918 - protein, 5 aa, Mycobacterium avium
ERPYR

SEQ ID NO: 51919 - protein, 7 aa, Mycobacterium avium
ERQAQIT

SEQ ID NO: 51920 - protein, 5 aa, Mycobacterium avium
ERQRH

SEQ ID NO: 51921 - protein, 8 aa, Mycobacterium avium
ERQSDALG

SEQ ID NO: 51922 - protein, 10 aa, Mycobacterium avium
ERRAPEAATS

SEQ ID NO: 51923 - protein, 6 aa, Mycobacterium avium
ERRGID

SEQ ID NO: 51924 - protein, 6 aa, Mycobacterium avium
ERRGVG

SEQ ID NO: 51925 - protein, 7 aa, Mycobacterium avium
ERSPNTV

SEQ ID NO: 51926 - protein, 10 aa, Mycobacterium avium
ERSPVGSERE

SEQ ID NO: 51927 - protein, 5 aa, Mycobacterium avium
ERTAA

SEQ ID NO: 51928 - protein, 4 aa, Mycobacterium avium
ERTG

SEQ ID NO: 51929 - protein, 5 aa, Mycobacterium avium
ESAGA

SEQ ID NO: 51930 - protein, 9 aa, Mycobacterium avium
ESARQFATR

SEQ ID NO: 51931 - protein, 7 aa, Mycobacterium avium
ESASGAR

SEQ ID NO: 51932 - protein, 6 aa, Mycobacterium avium
ESATGA

SEQ ID NO: 51933 - protein, 6 aa, Mycobacterium avium
ESDLPI

SEQ ID NO: 51934 - protein, 7 aa, Mycobacterium avium
ESDYADR

SEQ ID NO: 51935 - protein, 11 aa, Mycobacterium avium
ESEARRQRARE

SEQ ID NO: 51936 - protein, 24 aa, Mycobacterium avium
ESEQVSVRDANDANLRTKPGAPLR

SEQ ID NO: 51937 - protein, 7 aa, Mycobacterium avium
ESERERM

SEQ ID NO: 51938 - protein, 11 aa, Mycobacterium avium
ESGGGSGTANI

SEQ ID NO: 51939 - protein, 6 aa, Mycobacterium avium
ESGMST

SEQ ID NO: 51940 - protein, 6 aa, Mycobacterium avium
ESGPGS

SEQ ID NO: 51941 - protein, 21 aa, Mycobacterium avium
ESGSGLPNGLNETLGGPLGPL

SEQ ID NO: 51942 - protein, 7 aa, Mycobacterium avium
ESGYDER

SEQ ID NO: 51943 - protein, 6 aa, Mycobacterium avium
ESHVGP

SEQ ID NO: 51944 - protein, 8 aa, Mycobacterium avium
ESLDSEPR

SEQ ID NO: 51945 - protein, 5 aa, Mycobacterium avium
ESLGA

SEQ ID NO: 51946 - protein, 7 aa, Mycobacterium avium
ESPATAL

SEQ ID NO: 51947 - protein, 5 aa, Mycobacterium avium
ESPAY

SEQ ID NO: 51948 - protein, 27 aa, Mycobacterium avium
ESPCVEGTPSQHAIDGDARSAAQRNHD

SEQ ID NO: 51949 - protein, 13 aa, Mycobacterium avium
ESPEGQASSLESI

SEQ ID NO: 51950 - protein, 5 aa, Mycobacterium avium
ESPGQ

SEQ ID NO: 51951 - protein, 20 aa, Mycobacterium avium
ESPGRVRNAGPARPGQHNDE

SEQ ID NO: 51952 - protein, 4 aa, Mycobacterium avium
ESPL

SEQ ID NO: 51953 - protein, 8 aa, Mycobacterium avium
ESPRRGET

SEQ ID NO: 51954 - protein, 17 aa, Mycobacterium avium
ESPVKSDSRLARRATTI

SEQ ID NO: 51955 - protein, 5 aa, Mycobacterium avium
ESRAA

SEQ ID NO: 51956 - protein, 9 aa, Mycobacterium avium
ESREHTEAR

SEQ ID NO: 51957 - protein, 5 aa, Mycobacterium avium
ESRYV

SEQ ID NO: 51958 - protein, 6 aa, Mycobacterium avium
ESSPRV

SEQ ID NO: 51959 - protein, 10 aa, Mycobacterium avium
ESSRDAGRPI

SEQ ID NO: 51960 - protein, 11 aa, Mycobacterium avium
ESTDGTELARG

SEQ ID NO: 51961 - protein, 4 aa, Mycobacterium avium
ESTG

SEQ ID NO: 51962 - protein, 6 aa, Mycobacterium avium
ESTVNR

SEQ ID NO: 51963 - protein, 7 aa, Mycobacterium avium
ESVGGQG

SEQ ID NO: 51964 - protein, 9 aa, Mycobacterium avium
ESVQTGQAL

SEQ ID NO: 51965 - protein, 10 aa, Mycobacterium avium
ESVSAAGKAL

SEQ ID NO: 51966 - protein, 8 aa, Mycobacterium avium
ESVTEGTV

SEQ ID NO: 51967 - protein, 13 aa, Mycobacterium avium
ETAAGKGLTGGGT

SEQ ID NO: 51968 - protein, 12 aa, Mycobacterium avium
ETAAGRGLTGGG

SEQ ID NO: 51969 - protein, 7 aa, Mycobacterium avium
ETAASQA

SEQ ID NO: 51970 - protein, 8 aa, Mycobacterium avium
ETAEPAEL

SEQ ID NO: 51971 - protein, 6 aa, Mycobacterium avium
ETATKV

SEQ ID NO: 51972 - protein, 7 aa, Mycobacterium avium
ETDEVPA

SEQ ID NO: 51973 - protein, 10 aa, Mycobacterium avium
ETDKTKWTKI

SEQ ID NO: 51974 - protein, 13 aa, Mycobacterium avium
ETDPGGDGHDGAR

SEQ ID NO: 51975 - protein, 9 aa, Mycobacterium avium
ETDWSTNRE

SEQ ID NO: 51976 - protein, 5 aa, Mycobacterium avium
ETDYG

SEQ ID NO: 51977 - protein, 8 aa, Mycobacterium avium
ETEKPDDV

SEQ ID NO: 51978 - protein, 7 aa, Mycobacterium avium
ETEKQPT

SEQ ID NO: 51979 - protein, 14 aa, Mycobacterium avium
ETEPYAGTIARSGE

SEQ ID NO: 51980 - protein, 5 aa, Mycobacterium avium
ETGAV

SEQ ID NO: 51981 - protein, 11 aa, Mycobacterium avium
ETGDYQERGLR

SEQ ID NO: 51982 - protein, 8 aa, Mycobacterium avium
ETGERADW

SEQ ID NO: 51983 - protein, 21 aa, Mycobacterium avium
ETGHGSDVQSLETTATYDPAT

SEQ ID NO: 51984 - protein, 6 aa, Mycobacterium avium
ETGSAI

SEQ ID NO: 51985 - protein, 16 aa, Mycobacterium avium
ETGTAQSLSEATRHGS

SEQ ID NO: 51986 - protein, 11 aa, Mycobacterium avium
ETGTVASPSQI

SEQ ID NO: 51987 - protein, 9 aa, Mycobacterium avium
ETHAGAPFD

SEQ ID NO: 51988 - protein, 8 aa, Mycobacterium avium
ETKIEPSL

SEQ ID NO: 51989 - protein, 7 aa, Mycobacterium avium
ETLEATA

SEQ ID NO: 51990 - protein, 5 aa, Mycobacterium avium
ETPEY

SEQ ID NO: 51991 - protein, 5 aa, Mycobacterium avium
ETPFD

SEQ ID NO: 51992 - protein, 5 aa, Mycobacterium avium
ETPPG

SEQ ID NO: 51993 - protein, 5 aa, Mycobacterium avium
ETPTI

SEQ ID NO: 51994 - protein, 9 aa, Mycobacterium avium
ETQKQQNDI

SEQ ID NO: 51995 - protein, 6 aa, Mycobacterium avium
ETQMPS

SEQ ID NO: 51996 - protein, 7 aa, Mycobacterium avium
ETRAGYG

SEQ ID NO: 51997 - protein, 6 aa, Mycobacterium avium
ETRDEA

SEQ ID NO: 51998 - protein, 10 aa, Mycobacterium avium
ETRDESSAAL

SEQ ID NO: 51999 - protein, 5 aa, Mycobacterium avium
ETRER

SEQ ID NO: 52000 - protein, 5 aa, Mycobacterium avium
ETRGA

SEQ ID NO: 52001 - protein, 17 aa, Mycobacterium avium
ETRPGQGYPRTYEDQER

SEQ ID NO: 52002 - protein, 4 aa, Mycobacterium avium
ETTA

SEQ ID NO: 52003 - protein, 5 aa, Mycobacterium avium
ETTAN

SEQ ID NO: 52004 - protein, 6 aa, Mycobacterium avium
ETTGLG

SEQ ID NO: 52005 - protein, 6 aa, Mycobacterium avium
ETTHVT

SEQ ID NO: 52006 - protein, 8 aa, Mycobacterium avium
ETTPELDG

SEQ ID NO: 52007 - protein, 6 aa, Mycobacterium avium
ETTPRA

SEQ ID NO: 52008 - protein, 7 aa, Mycobacterium avium
ETTSAVS

SEQ ID NO: 52009 - protein, 4 aa, Mycobacterium avium
ETVD

SEQ ID NO: 52010 - protein, 4 aa, Mycobacterium avium
ETVP

SEQ ID NO: 52011 - protein, 5 aa, Mycobacterium avium
ETVTE

SEQ ID NO: 52012 - protein, 4 aa, Mycobacterium avium
ETYG

SEQ ID NO: 52013 - protein, 8 aa, Mycobacterium avium
EVDDGELP

SEQ ID NO: 52014 - protein, 21 aa, Mycobacterium avium
EVDLSAEGEESQAEREEQQKE

SEQ ID NO: 52015 - protein, 16 aa, Mycobacterium avium
EVDYSGQDWTTRSPAG

SEQ ID NO: 52016 - protein, 20 aa, Mycobacterium avium
EVEGDKGEYRPAAKDTPEVG

SEQ ID NO: 52017 - protein, 6 aa, Mycobacterium avium
EVGEPA

SEQ ID NO: 52018 - protein, 17 aa, Mycobacterium avium
EVPPEADTPAAFSPETR

SEQ ID NO: 52019 - protein, 7 aa, Mycobacterium avium
EVPTATS

SEQ ID NO: 52020 - protein, 8 aa, Mycobacterium avium
EVQRAGAG

SEQ ID NO: 52021 - protein, 5 aa, Mycobacterium avium
EVRDR

SEQ ID NO: 52022 - protein, 12 aa, Mycobacterium avium
EVREETGVSARA

SEQ ID NO: 52023 - protein, 6 aa, Mycobacterium avium
EVRPAD

SEQ ID NO: 52024 - protein, 16 aa, Mycobacterium avium
EVRTGQWQAGNRAPLP

SEQ ID NO: 52025 - protein, 7 aa, Mycobacterium avium
EVSDTAR

SEQ ID NO: 52026 - protein, 8 aa, Mycobacterium avium
EVSEEANA

SEQ ID NO: 52027 - protein, 8 aa, Mycobacterium avium
EVSNPDAV

SEQ ID NO: 52028 - protein, 10 aa, Mycobacterium avium
EVTDADGKPI

SEQ ID NO: 52029 - protein, 17 aa, Mycobacterium avium
EVTDTADGPQWTLGGDG

SEQ ID NO: 52030 - protein, 10 aa, Mycobacterium avium
EVTPLSASAT

SEQ ID NO: 52031 - protein, 10 aa, Mycobacterium avium
EVTRSTPEKS

SEQ ID NO: 52032 - protein, 6 aa, Mycobacterium avium
EVTTAA

SEQ ID NO: 52033 - protein, 9 aa, Mycobacterium avium
EWGDKGVHS

SEQ ID NO: 52034 - protein, 5 aa, Mycobacterium avium
EYAKS

SEQ ID NO: 52035 - protein, 9 aa, Mycobacterium avium
EYDAAGDRL

SEQ ID NO: 52036 - protein, 4 aa, Mycobacterium avium
EYGG

SEQ ID NO: 52037 - protein, 5 aa, Mycobacterium avium
EYGIE

SEQ ID NO: 52038 - protein, 12 aa, Mycobacterium avium
EYGQGPGPGENI

SEQ ID NO: 52039 - protein, 5 aa, Mycobacterium avium
FADAE

SEQ ID NO: 52040 - protein, 5 aa, Mycobacterium avium
FAERE

SEQ ID NO: 52041 - protein, 6 aa, Mycobacterium avium
FAGREA

SEQ ID NO: 52042 - protein, 11 aa, Mycobacterium avium
FAPGATGNIAT

SEQ ID NO: 52043 - protein, 15 aa, Mycobacterium avium
FAPGGDMGGGGGEDN

SEQ ID NO: 52044 - protein, 4 aa, Mycobacterium avium
FARD

SEQ ID NO: 52045 - protein, 7 aa, Mycobacterium avium
FASHGES

SEQ ID NO: 52046 - protein, 6 aa, Mycobacterium avium
FASPTT

SEQ ID NO: 52047 - protein, 8 aa, Mycobacterium avium
FASSGDDY

SEQ ID NO: 52048 - protein, 9 aa, Mycobacterium avium
FATDRGAGA

SEQ ID NO: 52049 - protein, 8 aa, Mycobacterium avium
FDAAEGSM

SEQ ID NO: 52050 - protein, 13 aa, Mycobacterium avium
FDDQGAKYDGDGN

SEQ ID NO: 52051 - protein, 19 aa, Mycobacterium avium
FDEPPRTTNADGPGAQAAA

SEQ ID NO: 52052 - protein, 24 aa, Mycobacterium avium
FDGPAADGALAAPAPSSGPLRDTY

SEQ ID NO: 52053 - protein, 4 aa, Mycobacterium avium
FDGR

SEQ ID NO: 52054 - protein, 8 aa, Mycobacterium avium
FDKGQPTA

SEQ ID NO: 52055 - protein, 11 aa, Mycobacterium avium
FDNRGRRADEQ

SEQ ID NO: 52056 - protein, 11 aa, Mycobacterium avium
FDPGPNPYGAP

SEQ ID NO: 52057 - protein, 5 aa, Mycobacterium avium
FDRSR

SEQ ID NO: 52058 - protein, 21 aa, Mycobacterium avium
FDSSGDPEESLQETEARQAEG

SEQ ID NO: 52059 - protein, 7 aa, Mycobacterium avium
FEANPDL

SEQ ID NO: 52060 - protein, 9 aa, Mycobacterium avium
FEEAPETGA

SEQ ID NO: 52061 - protein, 6 aa, Mycobacterium avium
FEGEGT

SEQ ID NO: 52062 - protein, 5 aa, Mycobacterium avium
FENDD

SEQ ID NO: 52063 - protein, 4 aa, Mycobacterium avium
FEQA

SEQ ID NO: 52064 - protein, 9 aa, Mycobacterium avium
FERSGPERI

SEQ ID NO: 52065 - protein, 4 aa, Mycobacterium avium
FESA

SEQ ID NO: 52066 - protein, 8 aa, Mycobacterium avium
FGAGEGSP

SEQ ID NO: 52067 - protein, 36 aa, Mycobacterium avium
FGAPPQTADANAAADQSAAAASALQSSTASSVESAL

SEQ ID NO: 52068 - protein, 5 aa, Mycobacterium avium
FGARP

SEQ ID NO: 52069 - protein, 6 aa, Mycobacterium avium
FGDDPA

SEQ ID NO: 52070 - protein, 8 aa, Mycobacterium avium
FGDKSVRS

SEQ ID NO: 52071 - protein, 8 aa, Mycobacterium avium
FGDTPQAN

SEQ ID NO: 52072 - protein, 4 aa, Mycobacterium avium
FGEP

SEQ ID NO: 52073 - protein, 5 aa, Mycobacterium avium
FGGGA

SEQ ID NO: 52074 - protein, 9 aa, Mycobacterium avium
FGGGASATI

SEQ ID NO: 52075 - protein, 5 aa, Mycobacterium avium
FGGGR

SEQ ID NO: 52076 - protein, 20 aa, Mycobacterium avium
FGGGTTSRGPIGRVRPGSDS

SEQ ID NO: 52077 - protein, 7 aa, Mycobacterium avium
FGGNPPN

SEQ ID NO: 52078 - protein, 7 aa, Mycobacterium avium
FGGQGYG

SEQ ID NO: 52079 - protein, 12 aa, Mycobacterium avium
FGNEPTHSGYDT

SEQ ID NO: 52080 - protein, 6 aa, Mycobacterium avium
FGPATA

SEQ ID NO: 52081 - protein, 13 aa, Mycobacterium avium
FGPDSDVADRADH

SEQ ID NO: 52082 - protein, 10 aa, Mycobacterium avium
FGPGGPRGAW

SEQ ID NO: 52083 - protein, 12 aa, Mycobacterium avium
FGPGTLTESGYP

SEQ ID NO: 52084 - protein, 4 aa, Mycobacterium avium
FGPR

SEQ ID NO: 52085 - protein, 4 aa, Mycobacterium avium
FGRR

SEQ ID NO: 52086 - protein, 15 aa, Mycobacterium avium
FGSETPAVQGPGFGD

SEQ ID NO: 52087 - protein, 14 aa, Mycobacterium avium
FGSGRAAPQLGKQR

SEQ ID NO: 52088 - protein, 4 aa, Mycobacterium avium
FGSY

SEQ ID NO: 52089 - protein, 10 aa, Mycobacterium avium
FGTAEESNRR

SEQ ID NO: 52090 - protein, 8 aa, Mycobacterium avium
FGTTGPYV

SEQ ID NO: 52091 - protein, 8 aa, Mycobacterium avium
FHGGRDRT

SEQ ID NO: 52092 - protein, 4 aa, Mycobacterium avium
FKAP

SEQ ID NO: 52093 - protein, 6 aa, Mycobacterium avium
FKGTGR

SEQ ID NO: 52094 - protein, 17 aa, Mycobacterium avium
FKQTDADVGSFDGGYGS

SEQ ID NO: 52095 - protein, 5 aa, Mycobacterium avium
FNGPQ

SEQ ID NO: 52096 - protein, 6 aa, Mycobacterium avium
FPAPQT

SEQ ID NO: 52097 - protein, 11 aa, Mycobacterium avium
FPDGTTPEPID

SEQ ID NO: 52098 - protein, 11 aa, Mycobacterium avium
FPEPGSTVEKG

SEQ ID NO: 52099 - protein, 7 aa, Mycobacterium avium
FPGAADA

SEQ ID NO: 52100 - protein, 6 aa, Mycobacterium avium
FPGDPE

SEQ ID NO: 52101 - protein, 7 aa, Mycobacterium avium
FPPAGTL

SEQ ID NO: 52102 - protein, 8 aa, Mycobacterium avium
FPPGAKAR

SEQ ID NO: 52103 - protein, 13 aa, Mycobacterium avium
FPPGSGVGTQGPD

SEQ ID NO: 52104 - protein, 6 aa, Mycobacterium avium
FPRDKA

SEQ ID NO: 52105 - protein, 5 aa, Mycobacterium avium
FPTDR

SEQ ID NO: 52106 - protein, 5 aa, Mycobacterium avium
FPTEP

SEQ ID NO: 52107 - protein, 9 aa, Mycobacterium avium
FPTRNGAQR

SEQ ID NO: 52108 - protein, 6 aa, Mycobacterium avium
FQPGTK

SEQ ID NO: 52109 - protein, 11 aa, Mycobacterium avium
FQTRSTKDGGR

SEQ ID NO: 52110 - protein, 20 aa, Mycobacterium avium
FRGAGDAPTQVSGYKGSDGK

SEQ ID NO: 52111 - protein, 11 aa, Mycobacterium avium
FRGQGASHGAQ

SEQ ID NO: 52112 - protein, 4 aa, Mycobacterium avium
FRGS

SEQ ID NO: 52113 - protein, 13 aa, Mycobacterium avium
FRRRGGSAAERGR

SEQ ID NO: 52114 - protein, 9 aa, Mycobacterium avium
FRTNEEPPF

SEQ ID NO: 52115 - protein, 14 aa, Mycobacterium avium
FSADADGYTRSEGG

SEQ ID NO: 52116 - protein, 9 aa, Mycobacterium avium
FSDGRPPLD

SEQ ID NO: 52117 - protein, 14 aa, Mycobacterium avium
FSDRPDAGGSTNQR

SEQ ID NO: 52118 - protein, 6 aa, Mycobacterium avium
FSEAND

SEQ ID NO: 52119 - protein, 11 aa, Mycobacterium avium
FSEPESGSDLA

SEQ ID NO: 52120 - protein, 4 aa, Mycobacterium avium
FSGR

SEQ ID NO: 52121 - protein, 6 aa, Mycobacterium avium
FSRGGR

SEQ ID NO: 52122 - protein, 9 aa, Mycobacterium avium
FSSPNISPQ

SEQ ID NO: 52123 - protein, 9 aa, Mycobacterium avium
FSTADAPDR

SEQ ID NO: 52124 - protein, 13 aa, Mycobacterium avium
FSTAEKSQRYATE

SEQ ID NO: 52125 - protein, 4 aa, Mycobacterium avium
FTAA

SEQ ID NO: 52126 - protein, 8 aa, Mycobacterium avium
FTDPRNGR

SEQ ID NO: 52127 - protein, 9 aa, Mycobacterium avium
FTESGQRAG

SEQ ID NO: 52128 - protein, 9 aa, Mycobacterium avium
FTGSSAVGR

SEQ ID NO: 52129 - protein, 8 aa, Mycobacterium avium
FTGSTAVG

SEQ ID NO: 52130 - protein, 8 aa, Mycobacterium avium
FTPADDDA

SEQ ID NO: 52131 - protein, 15 aa, Mycobacterium avium
FTPDGPVAARGARPR

SEQ ID NO: 52132 - protein, 5 aa, Mycobacterium avium
FTPPY

SEQ ID NO: 52133 - protein, 5 aa, Mycobacterium avium
FTTAG

SEQ ID NO: 52134 - protein, 13 aa, Mycobacterium avium
FVDEKTQGKYSDT

SEQ ID NO: 52135 - protein, 21 aa, Mycobacterium avium
GAAAAAAHTATSHADTPKTDA

SEQ ID NO: 52136 - protein, 21 aa, Mycobacterium avium
GAAAAARARQDTLTKPRGALG

SEQ ID NO: 52137 - protein, 8 aa, Mycobacterium avium
GAAADLSD

SEQ ID NO: 52138 - protein, 9 aa, Mycobacterium avium
GAAADLSTI

SEQ ID NO: 52139 - protein, 14 aa, Mycobacterium avium
GAAAPGAFDGPDDF

SEQ ID NO: 52140 - protein, 27 aa, Mycobacterium avium
GAAARALGEQARTRWQTATKQSLSPVT

SEQ ID NO: 52141 - protein, 16 aa, Mycobacterium avium
GAADEDAGVPRNTGPI

SEQ ID NO: 52142 - protein, 8 aa, Mycobacterium avium
GAADPSAQ

SEQ ID NO: 52143 - protein, 8 aa, Mycobacterium avium
GAADQARA

SEQ ID NO: 52144 - protein, 11 aa, Mycobacterium avium
GAADQELGDDA

SEQ ID NO: 52145 - protein, 5 aa, Mycobacterium avium
GAAEA

SEQ ID NO: 52146 - protein, 7 aa, Mycobacterium avium
GAAEDRH

SEQ ID NO: 52147 - protein, 11 aa, Mycobacterium avium
GAAEEAQRQRG

SEQ ID NO: 52148 - protein, 5 aa, Mycobacterium avium
GAAEL

SEQ ID NO: 52149 - protein, 9 aa, Mycobacterium avium
GAAGGGRPV

SEQ ID NO: 52150 - protein, 16 aa, Mycobacterium avium
GAAGNTGDGIRAGQEI

SEQ ID NO: 52151 - protein, 5 aa, Mycobacterium avium
GAAGR

SEQ ID NO: 52152 - protein, 10 aa, Mycobacterium avium
GAAGRSRAQS

SEQ ID NO: 52153 - protein, 10 aa, Mycobacterium avium
GAAINDRNVD

SEQ ID NO: 52154 - protein, 8 aa, Mycobacterium avium
GAAPAGVT

SEQ ID NO: 52155 - protein, 10 aa, Mycobacterium avium
GAARGGGEVQ

SEQ ID NO: 52156 - protein, 8 aa, Mycobacterium avium
GAASATRM

SEQ ID NO: 52157 - protein, 7 aa, Mycobacterium avium
GAATGGV

SEQ ID NO: 52158 - protein, 8 aa, Mycobacterium avium
GADAAEGV

SEQ ID NO: 52159 - protein, 8 aa, Mycobacterium avium
GADAERAN

SEQ ID NO: 52160 - protein, 20 aa, Mycobacterium avium
GADAPTSAPTSTSVAPDPST

SEQ ID NO: 52161 - protein, 6 aa, Mycobacterium avium
GADATA

SEQ ID NO: 52162 - protein, 8 aa, Mycobacterium avium
GADDDFST

SEQ ID NO: 52163 - protein, 18 aa, Mycobacterium avium
GADGGNVGDGGGDGHPAR

SEQ ID NO: 52164 - protein, 5 aa, Mycobacterium avium
GADGQ

SEQ ID NO: 52165 - protein, 4 aa, Mycobacterium avium
GADI

SEQ ID NO: 52166 - protein, 5 aa, Mycobacterium avium
GADIN

SEQ ID NO: 52167 - protein, 7 aa, Mycobacterium avium
GADLDEQ

SEQ ID NO: 52168 - protein, 6 aa, Mycobacterium avium
GADPAA

SEQ ID NO: 52169 - protein, 8 aa, Mycobacterium avium
GADPAAAV

SEQ ID NO: 52170 - protein, 7 aa, Mycobacterium avium
GADPATA

SEQ ID NO: 52171 - protein, 17 aa, Mycobacterium avium
GADPDARAAYHRRLAEE

SEQ ID NO: 52172 - protein, 16 aa, Mycobacterium avium
GADPGAYRRAEAAGRL

SEQ ID NO: 52173 - protein, 6 aa, Mycobacterium avium
GADPVA

SEQ ID NO: 52174 - protein, 12 aa, Mycobacterium avium
GADRADQLRTDV

SEQ ID NO: 52175 - protein, 5 aa, Mycobacterium avium
GADVA

SEQ ID NO: 52176 - protein, 10 aa, Mycobacterium avium
GAEAETAARV

SEQ ID NO: 52177 - protein, 7 aa, Mycobacterium avium
GAEDPKL

SEQ ID NO: 52178 - protein, 14 aa, Mycobacterium avium
GAENELAAGQEGEL

SEQ ID NO: 52179 - protein, 4 aa, Mycobacterium avium
GAEP

SEQ ID NO: 52180 - protein, 7 aa, Mycobacterium avium
GAEPNTQ

SEQ ID NO: 52181 - protein, 8 aa, Mycobacterium avium
GAEPPSRE

SEQ ID NO: 52182 - protein, 5 aa, Mycobacterium avium
GAERA

SEQ ID NO: 52183 - protein, 8 aa, Mycobacterium avium
GAERGSQL

SEQ ID NO: 52184 - protein, 10 aa, Mycobacterium avium
GAESPQETRT

SEQ ID NO: 52185 - protein, 5 aa, Mycobacterium avium
GAETT

SEQ ID NO: 52186 - protein, 5 aa, Mycobacterium avium
GAFPA

SEQ ID NO: 52187 - protein, 4 aa, Mycobacterium avium
GAGA

SEQ ID NO: 52188 - protein, 15 aa, Mycobacterium avium
GAGAGGHGAAGPKYG

SEQ ID NO: 52189 - protein, 6 aa, Mycobacterium avium
GAGATV

SEQ ID NO: 52190 - protein, 17 aa, Mycobacterium avium
GAGEPRLRPADPDSPLP

SEQ ID NO: 52191 - protein, 6 aa, Mycobacterium avium
GAGESD

SEQ ID NO: 52192 - protein, 8 aa, Mycobacterium avium
GAGGDPWE

SEQ ID NO: 52193 - protein, 39 aa, Mycobacterium avium
GAGGFGGMGGGIPPGATPGTGPGGQPGYYTANPQRVAAA

SEQ ID NO: 52194 - protein, 7 aa, Mycobacterium avium
GAGGGIG

SEQ ID NO: 52195 - protein, 6 aa, Mycobacterium avium
GAGGHA

SEQ ID NO: 52196 - protein, 14 aa, Mycobacterium avium
GAGHSSVGDQDKAR

SEQ ID NO: 52197 - protein, 9 aa, Mycobacterium avium
GAGKGVGAG

SEQ ID NO: 52198 - protein, 6 aa, Mycobacterium avium
GAGPGE

SEQ ID NO: 52199 - protein, 7 aa, Mycobacterium avium
GAGPGES

SEQ ID NO: 52200 - protein, 6 aa, Mycobacterium avium
GAGPGH

SEQ ID NO: 52201 - protein, 7 aa, Mycobacterium avium
GAGPGQS

SEQ ID NO: 52202 - protein, 9 aa, Mycobacterium avium
GAGQQTPSF

SEQ ID NO: 52203 - protein, 18 aa, Mycobacterium avium
GAGRADAAEIERNPRSAA

SEQ ID NO: 52204 - protein, 13 aa, Mycobacterium avium
GAGRGGKDSPLAR

SEQ ID NO: 52205 - protein, 20 aa, Mycobacterium avium
GAGSDSQNGASPNGSSRQRL

SEQ ID NO: 52206 - protein, 6 aa, Mycobacterium avium
GAGTAV

SEQ ID NO: 52207 - protein, 10 aa, Mycobacterium avium
GAHGAASLAD

SEQ ID NO: 52208 - protein, 5 aa, Mycobacterium avium
GAHGI

SEQ ID NO: 52209 - protein, 5 aa, Mycobacterium avium
GAHGV

SEQ ID NO: 52210 - protein, 7 aa, Mycobacterium avium
GAIEPAA

SEQ ID NO: 52211 - protein, 18 aa, Mycobacterium avium
GAIGGAAPAAAKALPGLG

SEQ ID NO: 52212 - protein, 5 aa, Mycobacterium avium
GAIPG

SEQ ID NO: 52213 - protein, 7 aa, Mycobacterium avium
GAKLGRD

SEQ ID NO: 52214 - protein, 9 aa, Mycobacterium avium
GAKTLRGGK

SEQ ID NO: 52215 - protein, 29 aa, Mycobacterium avium
GAKVGSADVAVDGKTYTITGQAQGADMKN

SEQ ID NO: 52216 - protein, 11 aa, Mycobacterium avium
GAKYDSSTTRS

SEQ ID NO: 52217 - protein, 5 aa, Mycobacterium avium
GALGG

SEQ ID NO: 52218 - protein, 5 aa, Mycobacterium avium
GALHN

SEQ ID NO: 52219 - protein, 5 aa, Mycobacterium avium
GANAR

SEQ ID NO: 52220 - protein, 6 aa, Mycobacterium avium
GANPDV

SEQ ID NO: 52221 - protein, 10 aa, Mycobacterium avium
GANPIGDVDP

SEQ ID NO: 52222 - protein, 10 aa, Mycobacterium avium
GANTPAARAE

SEQ ID NO: 52223 - protein, 8 aa, Mycobacterium avium
GANTRGID

SEQ ID NO: 52224 - protein, 4 aa, Mycobacterium avium
GAPA

SEQ ID NO: 52225 - protein, 5 aa, Mycobacterium avium
GAPAG

SEQ ID NO: 52226 - protein, 8 aa, Mycobacterium avium
GAPAGTAQ

SEQ ID NO: 52227 - protein, 6 aa, Mycobacterium avium
GAPAMS

SEQ ID NO: 52228 - protein, 8 aa, Mycobacterium avium
GAPARVEG

SEQ ID NO: 52229 - protein, 8 aa, Mycobacterium avium
GAPATPAL

SEQ ID NO: 52230 - protein, 7 aa, Mycobacterium avium
GAPCPSC

SEQ ID NO: 52231 - protein, 5 aa, Mycobacterium avium
GAPES

SEQ ID NO: 52232 - protein, 7 aa, Mycobacterium avium
GAPGALK

SEQ ID NO: 52233 - protein, 12 aa, Mycobacterium avium
GAPGTAAVAILS

SEQ ID NO: 52234 - protein, 14 aa, Mycobacterium avium
GAPPSPGPSFEATT

SEQ ID NO: 52235 - protein, 9 aa, Mycobacterium avium
GAPQATPLT

SEQ ID NO: 52236 - protein, 4 aa, Mycobacterium avium
GAPR

SEQ ID NO: 52237 - protein, 20 aa, Mycobacterium avium
GAPRPQEADYAADTDGRPGI

SEQ ID NO: 52238 - protein, 6 aa, Mycobacterium avium
GAPSSE

SEQ ID NO: 52239 - protein, 18 aa, Mycobacterium avium
GAPVGAPAEAARSDYGPV

SEQ ID NO: 52240 - protein, 8 aa, Mycobacterium avium
GAPVPPGD

SEQ ID NO: 52241 - protein, 8 aa, Mycobacterium avium
GAQARAER

SEQ ID NO: 52242 - protein, 9 aa, Mycobacterium avium
GAQSAAQAL

SEQ ID NO: 52243 - protein, 7 aa, Mycobacterium avium
GAQSRDE

SEQ ID NO: 52244 - protein, 9 aa, Mycobacterium avium
GARADASAP

SEQ ID NO: 52245 - protein, 12 aa, Mycobacterium avium
GARAPKQAHEGG

SEQ ID NO: 52246 - protein, 15 aa, Mycobacterium avium
GARDRYGSPEHAPRA

SEQ ID NO: 52247 - protein, 5 aa, Mycobacterium avium
GARET

SEQ ID NO: 52248 - protein, 8 aa, Mycobacterium avium
GARGAHQE

SEQ ID NO: 52249 - protein, 14 aa, Mycobacterium avium
GARGGIDVPKSDID

SEQ ID NO: 52250 - protein, 4 aa, Mycobacterium avium
GARI

SEQ ID NO: 52251 - protein, 5 aa, Mycobacterium avium
GARIS

SEQ ID NO: 52252 - protein, 15 aa, Mycobacterium avium
GARLDAEPPAAQGYS

SEQ ID NO: 52253 - protein, 5 aa, Mycobacterium avium
GARNP

SEQ ID NO: 52254 - protein, 13 aa, Mycobacterium avium
GARPVGADSGLRT

SEQ ID NO: 52255 - protein, 5 aa, Mycobacterium avium
GARQR

SEQ ID NO: 52256 - protein, 14 aa, Mycobacterium avium
GARRGGAVSGIGGH

SEQ ID NO: 52257 - protein, 6 aa, Mycobacterium avium
GARRGT

SEQ ID NO: 52258 - protein, 12 aa, Mycobacterium avium
GARSPSETRWCR

SEQ ID NO: 52259 - protein, 8 aa, Mycobacterium avium
GARSSDIA

SEQ ID NO: 52260 - protein, 9 aa, Mycobacterium avium
GARSSLGRT

SEQ ID NO: 52261 - protein, 15 aa, Mycobacterium avium
GARTDGHDHAESAVA

SEQ ID NO: 52262 - protein, 8 aa, Mycobacterium avium
GARTRGGY

SEQ ID NO: 52263 - protein, 4 aa, Mycobacterium avium
GARV

SEQ ID NO: 52264 - protein, 8 aa, Mycobacterium avium
GASADQHT

SEQ ID NO: 52265 - protein, 10 aa, Mycobacterium avium
GASAGYTEKM

SEQ ID NO: 52266 - protein, 9 aa, Mycobacterium avium
GASGEHQSF

SEQ ID NO: 52267 - protein, 11 aa, Mycobacterium avium
GASPDGSRKAK

SEQ ID NO: 52268 - protein, 7 aa, Mycobacterium avium
GASPRGI

SEQ ID NO: 52269 - protein, 8 aa, Mycobacterium avium
GASQNIGE

SEQ ID NO: 52270 - protein, 5 aa, Mycobacterium avium
GASSD

SEQ ID NO: 52271 - protein, 14 aa, Mycobacterium avium
GASSGIGEATARTL

SEQ ID NO: 52272 - protein, 9 aa, Mycobacterium avium
GASSGIGKQ

SEQ ID NO: 52273 - protein, 8 aa, Mycobacterium avium
GASTPEEM

SEQ ID NO: 52274 - protein, 12 aa, Mycobacterium avium
GASYGSSAPTLQ

SEQ ID NO: 52275 - protein, 7 aa, Mycobacterium avium
GATADGA

SEQ ID NO: 52276 - protein, 7 aa, Mycobacterium avium
GATESGC

SEQ ID NO: 52277 - protein, 30 aa, Mycobacterium avium
GATGPAAAREPYETRGATDEDPVQVVQNGE

SEQ ID NO: 52278 - protein, 8 aa, Mycobacterium avium
GATGPALG

SEQ ID NO: 52279 - protein, 4 aa, Mycobacterium avium
GATL

SEQ ID NO: 52280 - protein, 5 aa, Mycobacterium avium
GATLA

SEQ ID NO: 52281 - protein, 6 aa, Mycobacterium avium
GATPDA

SEQ ID NO: 52282 - protein, 21 aa, Mycobacterium avium
GATPTQYARRRSSMPGHVELA

SEQ ID NO: 52283 - protein, 4 aa, Mycobacterium avium
GATQ

SEQ ID NO: 52284 - protein, 15 aa, Mycobacterium avium
GATTAGAAEHAASAV

SEQ ID NO: 52285 - protein, 12 aa, Mycobacterium avium
GATVRQDSPGAL

SEQ ID NO: 52286 - protein, 8 aa, Mycobacterium avium
GAVDAGGR

SEQ ID NO: 52287 - protein, 8 aa, Mycobacterium avium
GAVDPDRL

SEQ ID NO: 52288 - protein, 16 aa, Mycobacterium avium
GAVEGVKGKAKEVGGT

SEQ ID NO: 52289 - protein, 16 aa, Mycobacterium avium
GAVGSELRDDRPQEFP

SEQ ID NO: 52290 - protein, 5 aa, Mycobacterium avium
GAVHG

SEQ ID NO: 52291 - protein, 6 aa, Mycobacterium avium
GAVPPG

SEQ ID NO: 52292 - protein, 10 aa, Mycobacterium avium
GAWADGPEAI

SEQ ID NO: 52293 - protein, 9 aa, Mycobacterium avium
GAWATAAGE

SEQ ID NO: 52294 - protein, 6 aa, Mycobacterium avium
GAYAPY

SEQ ID NO: 52295 - protein, 8 aa, Mycobacterium avium
GAYGIDGA

SEQ ID NO: 52296 - protein, 20 aa, Mycobacterium avium
GAYTSEWTEDPPGRARQTNG

SEQ ID NO: 52297 - protein, 4 aa, Mycobacterium avium
GCAG

SEQ ID NO: 52298 - protein, 9 aa, Mycobacterium avium
GCERPSEPV

SEQ ID NO: 52299 - protein, 7 aa, Mycobacterium avium
GCHGGPG

SEQ ID NO: 52300 - protein, 7 aa, Mycobacterium avium
GCPGTDL

SEQ ID NO: 52301 - protein, 7 aa, Mycobacterium avium
GCSPANA

SEQ ID NO: 52302 - protein, 10 aa, Mycobacterium avium
GCSPGNAETI

SEQ ID NO: 52303 - protein, 8 aa, Mycobacterium avium
GDAAEKRV

SEQ ID NO: 52304 - protein, 9 aa, Mycobacterium avium
GDAAPRLGN

SEQ ID NO: 52305 - protein, 17 aa, Mycobacterium avium
GDADAEAELAAGENPGI

SEQ ID NO: 52306 - protein, 11 aa, Mycobacterium avium
GDADEAGRGAR

SEQ ID NO: 52307 - protein, 5 aa, Mycobacterium avium
GDAEL

SEQ ID NO: 52308 - protein, 9 aa, Mycobacterium avium
GDAGARDAV

SEQ ID NO: 52309 - protein, 7 aa, Mycobacterium avium
GDAGAVA

SEQ ID NO: 52310 - protein, 9 aa, Mycobacterium avium
GDALDDGPR

SEQ ID NO: 52311 - protein, 10 aa, Mycobacterium avium
GDAPPVSDGS

SEQ ID NO: 52312 - protein, 16 aa, Mycobacterium avium
GDATQGPEASIAAQTA

SEQ ID NO: 52313 - protein, 5 aa, Mycobacterium avium
GDCGE

SEQ ID NO: 52314 - protein, 5 aa, Mycobacterium avium
GDDAL

SEQ ID NO: 52315 - protein, 27 aa, Mycobacterium avium
GDDEDDFASSTAAGQERREKLAEDTDD

SEQ ID NO: 52316 - protein, 12 aa, Mycobacterium avium
GDDGEPTPQRAN

SEQ ID NO: 52317 - protein, 6 aa, Mycobacterium avium
GDDGLD

SEQ ID NO: 52318 - protein, 8 aa, Mycobacterium avium
GDDGRTVV

SEQ ID NO: 52319 - protein, 7 aa, Mycobacterium avium
GDDHRRR

SEQ ID NO: 52320 - protein, 12 aa, Mycobacterium avium
GDDSAPNPSETA

SEQ ID NO: 52321 - protein, 5 aa, Mycobacterium avium
GDDVH

SEQ ID NO: 52322 - protein, 5 aa, Mycobacterium avium
GDEHR

SEQ ID NO: 52323 - protein, 4 aa, Mycobacterium avium
GDEP

SEQ ID NO: 52324 - protein, 8 aa, Mycobacterium avium
GDEPGWDR

SEQ ID NO: 52325 - protein, 7 aa, Mycobacterium avium
GDEPLKR

SEQ ID NO: 52326 - protein, 15 aa, Mycobacterium avium
GDGAEQSAESVDEAA

SEQ ID NO: 52327 - protein, 14 aa, Mycobacterium avium
GDGARAAADPRAPD

SEQ ID NO: 52328 - protein, 11 aa, Mycobacterium avium
GDGDLHAGAGD

SEQ ID NO: 52329 - protein, 16 aa, Mycobacterium avium
GDGDSTADTASPGSPW

SEQ ID NO: 52330 - protein, 7 aa, Mycobacterium avium
GDGEKKT

SEQ ID NO: 52331 - protein, 9 aa, Mycobacterium avium
GDGKPHPIN

SEQ ID NO: 52332 - protein, 10 aa, Mycobacterium avium
GDGLRQAPNR

SEQ ID NO: 52333 - protein, 6 aa, Mycobacterium avium
GDGLTG

SEQ ID NO: 52334 - protein, 10 aa, Mycobacterium avium
GDGSALKSGN

SEQ ID NO: 52335 - protein, 9 aa, Mycobacterium avium
GDIEPSAAV

SEQ ID NO: 52336 - protein, 6 aa, Mycobacterium avium
GDIERA

SEQ ID NO: 52337 - protein, 4 aa, Mycobacterium avium
GDIS

SEQ ID NO: 52338 - protein, 12 aa, Mycobacterium avium
GDKAHPASQGYT

SEQ ID NO: 52339 - protein, 9 aa, Mycobacterium avium
GDKGQANLG

SEQ ID NO: 52340 - protein, 15 aa, Mycobacterium avium
GDLAAATGAPATPLG

SEQ ID NO: 52341 - protein, 9 aa, Mycobacterium avium
GDLDDATVE

SEQ ID NO: 52342 - protein, 4 aa, Mycobacterium avium
GDLG

SEQ ID NO: 52343 - protein, 31 aa, Mycobacterium avium
GDLSGLSKEGERSDRTDARAKDTGDDWQPSG

SEQ ID NO: 52344 - protein, 5 aa, Mycobacterium avium
GDMAR

SEQ ID NO: 52345 - protein, 6 aa, Mycobacterium avium
GDNAGS

SEQ ID NO: 52346 - protein, 5 aa, Mycobacterium avium
GDPAD

SEQ ID NO: 52347 - protein, 11 aa, Mycobacterium avium
GDPADESTDIG

SEQ ID NO: 52348 - protein, 7 aa, Mycobacterium avium
GDPAKLA

SEQ ID NO: 52349 - protein, 6 aa, Mycobacterium avium
GDPAVP

SEQ ID NO: 52350 - protein, 16 aa, Mycobacterium avium
GDPDSRNDDDSAPSMP

SEQ ID NO: 52351 - protein, 27 aa, Mycobacterium avium
GDPEDDPPTTPGASLKSRRRPSEADTC

SEQ ID NO: 52352 - protein, 7 aa, Mycobacterium avium
GDPERIR

SEQ ID NO: 52353 - protein, 6 aa, Mycobacterium avium
GDPGPF

SEQ ID NO: 52354 - protein, 17 aa, Mycobacterium avium
GDPLEGAAAAGGGFGGF

SEQ ID NO: 52355 - protein, 16 aa, Mycobacterium avium
GDPLTAGLSGRPAPEL

SEQ ID NO: 52356 - protein, 6 aa, Mycobacterium avium
GDPPRL

SEQ ID NO: 52357 - protein, 5 aa, Mycobacterium avium
GDPSF

SEQ ID NO: 52358 - protein, 7 aa, Mycobacterium avium
GDPSFTE

SEQ ID NO: 52359 - protein, 9 aa, Mycobacterium avium
GDQADSLGA

SEQ ID NO: 52360 - protein, 28 aa, Mycobacterium avium
GDQRIRGRSGYQYASGETADTVDPARAG

SEQ ID NO: 52361 - protein, 9 aa, Mycobacterium avium
GDQSTPALA

SEQ ID NO: 52362 - protein, 4 aa, Mycobacterium avium
GDRA

SEQ ID NO: 52363 - protein, 7 aa, Mycobacterium avium
GDRETEL

SEQ ID NO: 52364 - protein, 5 aa, Mycobacterium avium
GDRGF

SEQ ID NO: 52365 - protein, 6 aa, Mycobacterium avium
GDRPAD

SEQ ID NO: 52366 - protein, 5 aa, Mycobacterium avium
GDRPG

SEQ ID NO: 52367 - protein, 6 aa, Mycobacterium avium
GDRPPF

SEQ ID NO: 52368 - protein, 10 aa, Mycobacterium avium
GDRVSRSVRA

SEQ ID NO: 52369 - protein, 16 aa, Mycobacterium avium
GDSAVGAPPAATPAAM

SEQ ID NO: 52370 - protein, 10 aa, Mycobacterium avium
GDSGDDDENA

SEQ ID NO: 52371 - protein, 9 aa, Mycobacterium avium
GDSGDGMQL

SEQ ID NO: 52372 - protein, 17 aa, Mycobacterium avium
GDSGPLRAAKRAAQPAF

SEQ ID NO: 52373 - protein, 10 aa, Mycobacterium avium
GDSPGSKYDK

SEQ ID NO: 52374 - protein, 4 aa, Mycobacterium avium
GDSR

SEQ ID NO: 52375 - protein, 12 aa, Mycobacterium avium
GDSSDGRDFGAK

SEQ ID NO: 52376 - protein, 5 aa, Mycobacterium avium
GDSVQ

SEQ ID NO: 52377 - protein, 7 aa, Mycobacterium avium
GDTAFPD

SEQ ID NO: 52378 - protein, 8 aa, Mycobacterium avium
GDTAPGRK

SEQ ID NO: 52379 - protein, 15 aa, Mycobacterium avium
GDTIGLESTAAAATV

SEQ ID NO: 52380 - protein, 7 aa, Mycobacterium avium
GDTNTEV

SEQ ID NO: 52381 - protein, 8 aa, Mycobacterium avium
GDTRAAEP

SEQ ID NO: 52382 - protein, 5 aa, Mycobacterium avium
GDVEP

SEQ ID NO: 52383 - protein, 5 aa, Mycobacterium avium
GDVST

SEQ ID NO: 52384 - protein, 9 aa, Mycobacterium avium
GDWSSDSES

SEQ ID NO: 52385 - protein, 22 aa, Mycobacterium avium
GDYESPGDASPGTHWPPSEGPQ

SEQ ID NO: 52386 - protein, 4 aa, Mycobacterium avium
GDYP

SEQ ID NO: 52387 - protein, 4 aa, Mycobacterium avium
GDYQ

SEQ ID NO: 52388 - protein, 8 aa, Mycobacterium avium
GDYQTTAE

SEQ ID NO: 52389 - protein, 4 aa, Mycobacterium avium
GEAD

SEQ ID NO: 52390 - protein, 10 aa, Mycobacterium avium
GEAGQAFDTP

SEQ ID NO: 52391 - protein, 7 aa, Mycobacterium avium
GEAGVTP

SEQ ID NO: 52392 - protein, 4 aa, Mycobacterium avium
GEAI

SEQ ID NO: 52393 - protein, 7 aa, Mycobacterium avium
GEAPGGT

SEQ ID NO: 52394 - protein, 10 aa, Mycobacterium avium
GEARARDGVP

SEQ ID NO: 52395 - protein, 8 aa, Mycobacterium avium
GEASAHSR

SEQ ID NO: 52396 - protein, 6 aa, Mycobacterium avium
GEAYNT

SEQ ID NO: 52397 - protein, 11 aa, Mycobacterium avium
GEDELDDGRTH

SEQ ID NO: 52398 - protein, 11 aa, Mycobacterium avium
GEEESGSPSLG

SEQ ID NO: 52399 - protein, 17 aa, Mycobacterium avium
GEEGGGPAEPSAPGDGT

SEQ ID NO: 52400 - protein, 6 aa, Mycobacterium avium
GEERGS

SEQ ID NO: 52401 - protein, 4 aa, Mycobacterium avium
GEET

SEQ ID NO: 52402 - protein, 4 aa, Mycobacterium avium
GEEV

SEQ ID NO: 52403 - protein, 7 aa, Mycobacterium avium
GEEYRRS

SEQ ID NO: 52404 - protein, 8 aa, Mycobacterium avium
GEFEARRR

SEQ ID NO: 52405 - protein, 7 aa, Mycobacterium avium
GEGADEV

SEQ ID NO: 52406 - protein, 24 aa, Mycobacterium avium
GEGGFGGERGPSGGDAAPERAPDL

SEQ ID NO: 52407 - protein, 13 aa, Mycobacterium avium
GEGGVKGLSTAEK

SEQ ID NO: 52408 - protein, 7 aa, Mycobacterium avium
GEGIAPP

SEQ ID NO: 52409 - protein, 9 aa, Mycobacterium avium
GEGSGQPLD

SEQ ID NO: 52410 - protein, 7 aa, Mycobacterium avium
GEHAGAR

SEQ ID NO: 52411 - protein, 6 aa, Mycobacterium avium
GEHGDL

SEQ ID NO: 52412 - protein, 9 aa, Mycobacterium avium
GELDPDTLG

SEQ ID NO: 52413 - protein, 14 aa, Mycobacterium avium
GELGRDPADVRAEA

SEQ ID NO: 52414 - protein, 7 aa, Mycobacterium avium
GELPPPA

SEQ ID NO: 52415 - protein, 17 aa, Mycobacterium avium
GELSESGPPAPPRPDGL

SEQ ID NO: 52416 - protein, 11 aa, Mycobacterium avium
GELSGRAESVQ

SEQ ID NO: 52417 - protein, 4 aa, Mycobacterium avium
GELY

SEQ ID NO: 52418 - protein, 8 aa, Mycobacterium avium
GEMDGRAD

SEQ ID NO: 52419 - protein, 8 aa, Mycobacterium avium
GENISAKE

SEQ ID NO: 52420 - protein, 5 aa, Mycobacterium avium
GENPY

SEQ ID NO: 52421 - protein, 7 aa, Mycobacterium avium
GENTPGL

SEQ ID NO: 52422 - protein, 8 aa, Mycobacterium avium
GEPAARDA

SEQ ID NO: 52423 - protein, 22 aa, Mycobacterium avium
GEPADYPAAADQLRRRADAEPA

SEQ ID NO: 52424 - protein, 6 aa, Mycobacterium avium
GEPATL

SEQ ID NO: 52425 - protein, 6 aa, Mycobacterium avium
GEPGTR

SEQ ID NO: 52426 - protein, 5 aa, Mycobacterium avium
GEPQR

SEQ ID NO: 52427 - protein, 17 aa, Mycobacterium avium
GEPVATRGFEEREGPLR

SEQ ID NO: 52428 - protein, 6 aa, Mycobacterium avium
GEPVST

SEQ ID NO: 52429 - protein, 8 aa, Mycobacterium avium
GEPYSKTN

SEQ ID NO: 52430 - protein, 7 aa, Mycobacterium avium
GEQAEEA

SEQ ID NO: 52431 - protein, 5 aa, Mycobacterium avium
GEQEA

SEQ ID NO: 52432 - protein, 6 aa, Mycobacterium avium
GEQPVP

SEQ ID NO: 52433 - protein, 6 aa, Mycobacterium avium
GEQRAE

SEQ ID NO: 52434 - protein, 6 aa, Mycobacterium avium
GEQRDE

SEQ ID NO: 52435 - protein, 6 aa, Mycobacterium avium
GERAAA

SEQ ID NO: 52436 - protein, 5 aa, Mycobacterium avium
GERAR

SEQ ID NO: 52437 - protein, 8 aa, Mycobacterium avium
GERGTGLD

SEQ ID NO: 52438 - protein, 6 aa, Mycobacterium avium
GERHPT

SEQ ID NO: 52439 - protein, 5 aa, Mycobacterium avium
GERMY

SEQ ID NO: 52440 - protein, 16 aa, Mycobacterium avium
GERRAQIGAGTSGPGA

SEQ ID NO: 52441 - protein, 19 aa, Mycobacterium avium
GESEQHTEGDGRDSARANF

SEQ ID NO: 52442 - protein, 10 aa, Mycobacterium avium
GESGSGKSVS

SEQ ID NO: 52443 - protein, 5 aa, Mycobacterium avium
GESGV

SEQ ID NO: 52444 - protein, 9 aa, Mycobacterium avium
GESGVKPAE

SEQ ID NO: 52445 - protein, 8 aa, Mycobacterium avium
GESLANRR

SEQ ID NO: 52446 - protein, 7 aa, Mycobacterium avium
GESTADR

SEQ ID NO: 52447 - protein, 10 aa, Mycobacterium avium
GESTEATGAV

SEQ ID NO: 52448 - protein, 5 aa, Mycobacterium avium
GETDP

SEQ ID NO: 52449 - protein, 7 aa, Mycobacterium avium
GETISAA

SEQ ID NO: 52450 - protein, 6 aa, Mycobacterium avium
GETLTP

SEQ ID NO: 52451 - protein, 15 aa, Mycobacterium avium
GEVAGEAAPGDPSGH

SEQ ID NO: 52452 - protein, 9 aa, Mycobacterium avium
GEVTAPAAG

SEQ ID NO: 52453 - protein, 7 aa, Mycobacterium avium
GEWAGET

SEQ ID NO: 52454 - protein, 6 aa, Mycobacterium avium
GEWPVE

SEQ ID NO: 52455 - protein, 5 aa, Mycobacterium avium
GEYPS

SEQ ID NO: 52456 - protein, 5 aa, Mycobacterium avium
GFAGT

SEQ ID NO: 52457 - protein, 5 aa, Mycobacterium avium
GFATS

SEQ ID NO: 52458 - protein, 10 aa, Mycobacterium avium
GFDPTRPTAW

SEQ ID NO: 52459 - protein, 5 aa, Mycobacterium avium
GFDSI

SEQ ID NO: 52460 - protein, 4 aa, Mycobacterium avium
GFEP

SEQ ID NO: 52461 - protein, 7 aa, Mycobacterium avium
GFGDPGQ

SEQ ID NO: 52462 - protein, 4 aa, Mycobacterium avium
GFGG

SEQ ID NO: 52463 - protein, 5 aa, Mycobacterium avium
GFGKT

SEQ ID NO: 52464 - protein, 4 aa, Mycobacterium avium
GFGR

SEQ ID NO: 52465 - protein, 16 aa, Mycobacterium avium
GFNPPEPTTKGGPDYG

SEQ ID NO: 52466 - protein, 4 aa, Mycobacterium avium
GFPP

SEQ ID NO: 52467 - protein, 13 aa, Mycobacterium avium
GFPQLPPAPDDYP

SEQ ID NO: 52468 - protein, 10 aa, Mycobacterium avium
GFQPSQPVLP

SEQ ID NO: 52469 - protein, 11 aa, Mycobacterium avium
GFRPPTAVGHT

SEQ ID NO: 52470 - protein, 17 aa, Mycobacterium avium
GFSGPANRMEPSPYLPT

SEQ ID NO: 52471 - protein, 9 aa, Mycobacterium avium
GFTEDPGAY

SEQ ID NO: 52472 - protein, 11 aa, Mycobacterium avium
GFTEPRPAGAV

SEQ ID NO: 52473 - protein, 5 aa, Mycobacterium avium
GFTRG

SEQ ID NO: 52474 - protein, 4 aa, Mycobacterium avium
GGAA

SEQ ID NO: 52475 - protein, 8 aa, Mycobacterium avium
GGAAAAHP

SEQ ID NO: 52476 - protein, 5 aa, Mycobacterium avium
GGAAT

SEQ ID NO: 52477 - protein, 6 aa, Mycobacterium avium
GGAERQ

SEQ ID NO: 52478 - protein, 8 aa, Mycobacterium avium
GGAESLNV

SEQ ID NO: 52479 - protein, 23 aa, Mycobacterium avium
GGAFRAPTPAAGPSGDAAPTERL

SEQ ID NO: 52480 - protein, 5 aa, Mycobacterium avium
GGAGD

SEQ ID NO: 52481 - protein, 12 aa, Mycobacterium avium
GGAGDEHTQRAN

SEQ ID NO: 52482 - protein, 5 aa, Mycobacterium avium
GGAGG

SEQ ID NO: 52483 - protein, 5 aa, Mycobacterium avium
GGAGM

SEQ ID NO: 52484 - protein, 9 aa, Mycobacterium avium
GGAGPERTG

SEQ ID NO: 52485 - protein, 34 aa, Mycobacterium avium
GGAGQQAPSAPSAPAAPPSGAQPPAAAPAPQAAH

SEQ ID NO: 52486 - protein, 9 aa, Mycobacterium avium
GGAGSIGGK

SEQ ID NO: 52487 - protein, 8 aa, Mycobacterium avium
GGAHTDDP

SEQ ID NO: 52488 - protein, 4 aa, Mycobacterium avium
GGAK

SEQ ID NO: 52489 - protein, 4 aa, Mycobacterium avium
GGAM

SEQ ID NO: 52490 - protein, 7 aa, Mycobacterium avium
GGANEPD

SEQ ID NO: 52491 - protein, 6 aa, Mycobacterium avium
GGAPAD

SEQ ID NO: 52492 - protein, 8 aa, Mycobacterium avium
GGAPADAE

SEQ ID NO: 52493 - protein, 13 aa, Mycobacterium avium
GGAPYGADTPFGG

SEQ ID NO: 52494 - protein, 9 aa, Mycobacterium avium
GGAQSPKES

SEQ ID NO: 52495 - protein, 9 aa, Mycobacterium avium
GGARATARR

SEQ ID NO: 52496 - protein, 6 aa, Mycobacterium avium
GGARGG

SEQ ID NO: 52497 - protein, 6 aa, Mycobacterium avium
GGARGI

SEQ ID NO: 52498 - protein, 4 aa, Mycobacterium avium
GGAS

SEQ ID NO: 52499 - protein, 9 aa, Mycobacterium avium
GGASGDEDV

SEQ ID NO: 52500 - protein, 8 aa, Mycobacterium avium
GGASGGAG

SEQ ID NO: 52501 - protein, 6 aa, Mycobacterium avium
GGATGD

SEQ ID NO: 52502 - protein, 6 aa, Mycobacterium avium
GGATTV

SEQ ID NO: 52503 - protein, 5 aa, Mycobacterium avium
GGDGL

SEQ ID NO: 52504 - protein, 5 aa, Mycobacterium avium
GGDHR

SEQ ID NO: 52505 - protein, 4 aa, Mycobacterium avium
GGDL

SEQ ID NO: 52506 - protein, 8 aa, Mycobacterium avium
GGDPAGWR

SEQ ID NO: 52507 - protein, 9 aa, Mycobacterium avium
GGDPGRLAP

SEQ ID NO: 52508 - protein, 7 aa, Mycobacterium avium
GGEEEHG

SEQ ID NO: 52509 - protein, 7 aa, Mycobacterium avium
GGEEIPG

SEQ ID NO: 52510 - protein, 5 aa, Mycobacterium avium
GGEGA

SEQ ID NO: 52511 - protein, 11 aa, Mycobacterium avium
GGEGGGHTGPV

SEQ ID NO: 52512 - protein, 7 aa, Mycobacterium avium
GGEHDRL

SEQ ID NO: 52513 - protein, 9 aa, Mycobacterium avium
GGELDPAEL

SEQ ID NO: 52514 - protein, 9 aa, Mycobacterium avium
GGEPHEQRA

SEQ ID NO: 52515 - protein, 6 aa, Mycobacterium avium
GGEPVD

SEQ ID NO: 52516 - protein, 23 aa, Mycobacterium avium
GGFGGMPGQRPIAPEFPDREPDA

SEQ ID NO: 52517 - protein, 8 aa, Mycobacterium avium
GGFPPSGG

SEQ ID NO: 52518 - protein, 8 aa, Mycobacterium avium
GGGAAELS

SEQ ID NO: 52519 - protein, 9 aa, Mycobacterium avium
GGGAKDAVA

SEQ ID NO: 52520 - protein, 8 aa, Mycobacterium avium
GGGAPAGI

SEQ ID NO: 52521 - protein, 5 aa, Mycobacterium avium
GGGDK

SEQ ID NO: 52522 - protein, 10 aa, Mycobacterium avium
GGGEGGHNGL

SEQ ID NO: 52523 - protein, 7 aa, Mycobacterium avium
GGGEMPA

SEQ ID NO: 52524 - protein, 12 aa, Mycobacterium avium
GGGEQPIPDLFL

SEQ ID NO: 52525 - protein, 14 aa, Mycobacterium avium
GGGGASYTDPDGIA

SEQ ID NO: 52526 - protein, 16 aa, Mycobacterium avium
GGGGRPGDTDVGGAAG

SEQ ID NO: 52527 - protein, 10 aa, Mycobacterium avium
GGGGTGIAQR

SEQ ID NO: 52528 - protein, 9 aa, Mycobacterium avium
GGGPHPQDW

SEQ ID NO: 52529 - protein, 12 aa, Mycobacterium avium
GGGQGNHLGGAY

SEQ ID NO: 52530 - protein, 6 aa, Mycobacterium avium
GGGQVT

SEQ ID NO: 52531 - protein, 9 aa, Mycobacterium avium
GGGSGIGKG

SEQ ID NO: 52532 - protein, 14 aa, Mycobacterium avium
GGGTDVPPFPTTEG

SEQ ID NO: 52533 - protein, 8 aa, Mycobacterium avium
GGGTGIGR

SEQ ID NO: 52534 - protein, 5 aa, Mycobacterium avium
GGGTS

SEQ ID NO: 52535 - protein, 9 aa, Mycobacterium avium
GGGTSAPSN

SEQ ID NO: 52536 - protein, 12 aa, Mycobacterium avium
GGGYPTGDEVYL

SEQ ID NO: 52537 - protein, 14 aa, Mycobacterium avium
GGHGTPMSGDRPAT

SEQ ID NO: 52538 - protein, 8 aa, Mycobacterium avium
GGHTRGEF

SEQ ID NO: 52539 - protein, 7 aa, Mycobacterium avium
GGKALRP

SEQ ID NO: 52540 - protein, 7 aa, Mycobacterium avium
GGKATIR

SEQ ID NO: 52541 - protein, 6 aa, Mycobacterium avium
GGKFPT

SEQ ID NO: 52542 - protein, 9 aa, Mycobacterium avium
GGKGGSKQI

SEQ ID NO: 52543 - protein, 10 aa, Mycobacterium avium
GGKPPPDPAD

SEQ ID NO: 52544 - protein, 5 aa, Mycobacterium avium
GGKSV

SEQ ID NO: 52545 - protein, 7 aa, Mycobacterium avium
GGKWRSE

SEQ ID NO: 52546 - protein, 4 aa, Mycobacterium avium
GGLP

SEQ ID NO: 52547 - protein, 11 aa, Mycobacterium avium
GGLRATDSGLV

SEQ ID NO: 52548 - protein, 5 aa, Mycobacterium avium
GGLTP

SEQ ID NO: 52549 - protein, 8 aa, Mycobacterium avium
GGNGGRAE

SEQ ID NO: 52550 - protein, 7 aa, Mycobacterium avium
GGNGSPA

SEQ ID NO: 52551 - protein, 5 aa, Mycobacterium avium
GGNWG

SEQ ID NO: 52552 - protein, 12 aa, Mycobacterium avium
GGPAAPHAGPDA

SEQ ID NO: 52553 - protein, 9 aa, Mycobacterium avium
GGPAEAAEQ

SEQ ID NO: 52554 - protein, 6 aa, Mycobacterium avium
GGPAVA

SEQ ID NO: 52555 - protein, 6 aa, Mycobacterium avium
GGPAYP

SEQ ID NO: 52556 - protein, 7 aa, Mycobacterium avium
GGPEVPP

SEQ ID NO: 52557 - protein, 7 aa, Mycobacterium avium
GGPGGLA

SEQ ID NO: 52558 - protein, 7 aa, Mycobacterium avium
GGPGSYT

SEQ ID NO: 52559 - protein, 9 aa, Mycobacterium avium
GGPGTAVHA

SEQ ID NO: 52560 - protein, 7 aa, Mycobacterium avium
GGPGTTF

SEQ ID NO: 52561 - protein, 18 aa, Mycobacterium avium
GGPPATPARTLDEQAEAT

SEQ ID NO: 52562 - protein, 4 aa, Mycobacterium avium
GGPR

SEQ ID NO: 52563 - protein, 20 aa, Mycobacterium avium
GGPRDSSELLSGRDRVAGAD

SEQ ID NO: 52564 - protein, 6 aa, Mycobacterium avium
GGPREL

SEQ ID NO: 52565 - protein, 7 aa, Mycobacterium avium
GGPRRNA

SEQ ID NO: 52566 - protein, 7 aa, Mycobacterium avium
GGPRTAS

SEQ ID NO: 52567 - protein, 14 aa, Mycobacterium avium
GGPSGTGLASPDGL

SEQ ID NO: 52568 - protein, 9 aa, Mycobacterium avium
GGPVPIPED

SEQ ID NO: 52569 - protein, 4 aa, Mycobacterium avium
GGPY

SEQ ID NO: 52570 - protein, 6 aa, Mycobacterium avium
GGRGSG

SEQ ID NO: 52571 - protein, 19 aa, Mycobacterium avium
GGRGYETAESLAARGERAV

SEQ ID NO: 52572 - protein, 17 aa, Mycobacterium avium
GGRINTDAMDNSAGVDC

SEQ ID NO: 52573 - protein, 5 aa, Mycobacterium avium
GGRIQ

SEQ ID NO: 52574 - protein, 14 aa, Mycobacterium avium
GGRPVADDDARAQI

SEQ ID NO: 52575 - protein, 4 aa, Mycobacterium avium
GGRS

SEQ ID NO: 52576 - protein, 6 aa, Mycobacterium avium
GGRTSF

SEQ ID NO: 52577 - protein, 12 aa, Mycobacterium avium
GGRVGGSPGIAA

SEQ ID NO: 52578 - protein, 5 aa, Mycobacterium avium
GGSGA

SEQ ID NO: 52579 - protein, 5 aa, Mycobacterium avium
GGSGF

SEQ ID NO: 52580 - protein, 8 aa, Mycobacterium avium
GGSLTTKT

SEQ ID NO: 52581 - protein, 8 aa, Mycobacterium avium
GGSSDDAV

SEQ ID NO: 52582 - protein, 4 aa, Mycobacterium avium
GGST

SEQ ID NO: 52583 - protein, 6 aa, Mycobacterium avium
GGSTEL

SEQ ID NO: 52584 - protein, 14 aa, Mycobacterium avium
GGSTQSRCLGPQKA

SEQ ID NO: 52585 - protein, 7 aa, Mycobacterium avium
GGTAGNV

SEQ ID NO: 52586 - protein, 7 aa, Mycobacterium avium
GGTAGTM

SEQ ID NO: 52587 - protein, 38 aa, Mycobacterium avium
GGTAPTPAEAARMEADEAAARAAAAAAKKAANRAGRPG

SEQ ID NO: 52588 - protein, 5 aa, Mycobacterium avium
GGTDG

SEQ ID NO: 52589 - protein, 9 aa, Mycobacterium avium
GGTGAGKTT

SEQ ID NO: 52590 - protein, 6 aa, Mycobacterium avium
GGTGDW

SEQ ID NO: 52591 - protein, 5 aa, Mycobacterium avium
GGTGL

SEQ ID NO: 52592 - protein, 7 aa, Mycobacterium avium
GGTGTRM

SEQ ID NO: 52593 - protein, 4 aa, Mycobacterium avium
GGTL

SEQ ID NO: 52594 - protein, 5 aa, Mycobacterium avium
GGTLT

SEQ ID NO: 52595 - protein, 15 aa, Mycobacterium avium
GGTRPASLDTGSGHY

SEQ ID NO: 52596 - protein, 5 aa, Mycobacterium avium
GGTSE

SEQ ID NO: 52597 - protein, 6 aa, Mycobacterium avium
GGTSEI

SEQ ID NO: 52598 - protein, 5 aa, Mycobacterium avium
GGTTE

SEQ ID NO: 52599 - protein, 8 aa, Mycobacterium avium
GGTTGTPK

SEQ ID NO: 52600 - protein, 7 aa, Mycobacterium avium
GGVDTGR

SEQ ID NO: 52601 - protein, 7 aa, Mycobacterium avium
GGVDTRI

SEQ ID NO: 52602 - protein, 7 aa, Mycobacterium avium
GGVEPDG

SEQ ID NO: 52603 - protein, 5 aa, Mycobacterium avium
GGVGK

SEQ ID NO: 52604 - protein, 7 aa, Mycobacterium avium
GGVNSPV

SEQ ID NO: 52605 - protein, 4 aa, Mycobacterium avium
GGVR

SEQ ID NO: 52606 - protein, 29 aa, Mycobacterium avium
GGYSGPGGQSGPGAHEAPTGGAGAGNGLA

SEQ ID NO: 52607 - protein, 17 aa, Mycobacterium avium
GHAGPVANARSNKAQAL

SEQ ID NO: 52608 - protein, 7 aa, Mycobacterium avium
GHAKPGT

SEQ ID NO: 52609 - protein, 6 aa, Mycobacterium avium
GHATAQ

SEQ ID NO: 52610 - protein, 4 aa, Mycobacterium avium
GHAY

SEQ ID NO: 52611 - protein, 4 aa, Mycobacterium avium
GHDA

SEQ ID NO: 52612 - protein, 10 aa, Mycobacterium avium
GHDATPASDV

SEQ ID NO: 52613 - protein, 8 aa, Mycobacterium avium
GHDDPAAA

SEQ ID NO: 52614 - protein, 5 aa, Mycobacterium avium
GHDYR

SEQ ID NO: 52615 - protein, 6 aa, Mycobacterium avium
GHEGSG

SEQ ID NO: 52616 - protein, 4 aa, Mycobacterium avium
GHEP

SEQ ID NO: 52617 - protein, 17 aa, Mycobacterium avium
GHEPAGHESGGTESAGT

SEQ ID NO: 52618 - protein, 4 aa, Mycobacterium avium
GHER

SEQ ID NO: 52619 - protein, 7 aa, Mycobacterium avium
GHGAEAV

SEQ ID NO: 52620 - protein, 4 aa, Mycobacterium avium
GHGH

SEQ ID NO: 52621 - protein, 9 aa, Mycobacterium avium
GHGRHEELG

SEQ ID NO: 52622 - protein, 11 aa, Mycobacterium avium
GHGRSEELGPQ

SEQ ID NO: 52623 - protein, 14 aa, Mycobacterium avium
GHIGSDGSSPQARI

SEQ ID NO: 52624 - protein, 11 aa, Mycobacterium avium
GHPDGDAIDPH

SEQ ID NO: 52625 - protein, 31 aa, Mycobacterium avium
GHPGGAGQRRRQGRDHRTQRLTGGHHGGAGV

SEQ ID NO: 52626 - protein, 4 aa, Mycobacterium avium
GHPH

SEQ ID NO: 52627 - protein, 8 aa, Mycobacterium avium
GHPVPGGA

SEQ ID NO: 52628 - protein, 10 aa, Mycobacterium avium
GHRDRPITES

SEQ ID NO: 52629 - protein, 13 aa, Mycobacterium avium
GHSDDGNGCGSCG

SEQ ID NO: 52630 - protein, 6 aa, Mycobacterium avium
GHSSPY

SEQ ID NO: 52631 - protein, 5 aa, Mycobacterium avium
GHTAS

SEQ ID NO: 52632 - protein, 5 aa, Mycobacterium avium
GHTDR

SEQ ID NO: 52633 - protein, 11 aa, Mycobacterium avium
GHTETDDGRNI

SEQ ID NO: 52634 - protein, 6 aa, Mycobacterium avium
GHTQDT

SEQ ID NO: 52635 - protein, 7 aa, Mycobacterium avium
GHTQPRR

SEQ ID NO: 52636 - protein, 5 aa, Mycobacterium avium
GHTSA

SEQ ID NO: 52637 - protein, 16 aa, Mycobacterium avium
GHTSTRSQRRDTRRSL

SEQ ID NO: 52638 - protein, 6 aa, Mycobacterium avium
GHYGPP

SEQ ID NO: 52639 - protein, 7 aa, Mycobacterium avium
GIASRRA

SEQ ID NO: 52640 - protein, 10 aa, Mycobacterium avium
GIDERTPQQT

SEQ ID NO: 52641 - protein, 8 aa, Mycobacterium avium
GIDKKRRA

SEQ ID NO: 52642 - protein, 9 aa, Mycobacterium avium
GIDPGLTYQ

SEQ ID NO: 52643 - protein, 4 aa, Mycobacterium avium
GIGA

SEQ ID NO: 52644 - protein, 13 aa, Mycobacterium avium
GIGATENAQGFTT

SEQ ID NO: 52645 - protein, 6 aa, Mycobacterium avium
GIGDTG

SEQ ID NO: 52646 - protein, 7 aa, Mycobacterium avium
GIGGHPD

SEQ ID NO: 52647 - protein, 5 aa, Mycobacterium avium
GIGKG

SEQ ID NO: 52648 - protein, 7 aa, Mycobacterium avium
GIGLPDE

SEQ ID NO: 52649 - protein, 7 aa, Mycobacterium avium
GIGTGAI

SEQ ID NO: 52650 - protein, 9 aa, Mycobacterium avium
GIGTPERAA

SEQ ID NO: 52651 - protein, 10 aa, Mycobacterium avium
GIGTPGRARE

SEQ ID NO: 52652 - protein, 9 aa, Mycobacterium avium
GIPDNDPVL

SEQ ID NO: 52653 - protein, 7 aa, Mycobacterium avium
GIPEQDI

SEQ ID NO: 52654 - protein, 5 aa, Mycobacterium avium
GIPGP

SEQ ID NO: 52655 - protein, 8 aa, Mycobacterium avium
GIPGSDRW

SEQ ID NO: 52656 - protein, 5 aa, Mycobacterium avium
GIPQG

SEQ ID NO: 52657 - protein, 8 aa, Mycobacterium avium
GIPSGGGA

SEQ ID NO: 52658 - protein, 13 aa, Mycobacterium avium
GIQPTDEPALKQG

SEQ ID NO: 52659 - protein, 6 aa, Mycobacterium avium
GIRAPA

SEQ ID NO: 52660 - protein, 19 aa, Mycobacterium avium
GIRPRAAGAPRWSGRSARN

SEQ ID NO: 52661 - protein, 6 aa, Mycobacterium avium
GIRSDS

SEQ ID NO: 52662 - protein, 8 aa, Mycobacterium avium
GISGEPLS

SEQ ID NO: 52663 - protein, 11 aa, Mycobacterium avium
GITGPSAANAD

SEQ ID NO: 52664 - protein, 11 aa, Mycobacterium avium
GITRKRRGKGF

SEQ ID NO: 52665 - protein, 8 aa, Mycobacterium avium
GKAAPDDV

SEQ ID NO: 52666 - protein, 12 aa, Mycobacterium avium
GKAGGTIGRNNS

SEQ ID NO: 52667 - protein, 8 aa, Mycobacterium avium
GKAIAGGL

SEQ ID NO: 52668 - protein, 10 aa, Mycobacterium avium
GKATGDQGQA

SEQ ID NO: 52669 - protein, 9 aa, Mycobacterium avium
GKEATYENE

SEQ ID NO: 52670 - protein, 9 aa, Mycobacterium avium
GKEGQNARL

SEQ ID NO: 52671 - protein, 5 aa, Mycobacterium avium
GKEGR

SEQ ID NO: 52672 - protein, 10 aa, Mycobacterium avium
GKEGVEPQSE

SEQ ID NO: 52673 - protein, 5 aa, Mycobacterium avium
GKEMA

SEQ ID NO: 52674 - protein, 4 aa, Mycobacterium avium
GKEQ

SEQ ID NO: 52675 - protein, 10 aa, Mycobacterium avium
GKEVDRSPDD

SEQ ID NO: 52676 - protein, 22 aa, Mycobacterium avium
GKFTGSGGNLEQTVTKNNLEAA

SEQ ID NO: 52677 - protein, 7 aa, Mycobacterium avium
GKGEAKD

SEQ ID NO: 52678 - protein, 13 aa, Mycobacterium avium
GKGGVGKTSVAAS

SEQ ID NO: 52679 - protein, 12 aa, Mycobacterium avium
GKGLPDDVSEAG

SEQ ID NO: 52680 - protein, 7 aa, Mycobacterium avium
GKGTEEA

SEQ ID NO: 52681 - protein, 13 aa, Mycobacterium avium
GKGTNGDSAPVPC

SEQ ID NO: 52682 - protein, 6 aa, Mycobacterium avium
GKHGAT

SEQ ID NO: 52683 - protein, 4 aa, Mycobacterium avium
GKIQ

SEQ ID NO: 52684 - protein, 9 aa, Mycobacterium avium
GKISQRNFG

SEQ ID NO: 52685 - protein, 9 aa, Mycobacterium avium
GKPAGSAEL

SEQ ID NO: 52686 - protein, 7 aa, Mycobacterium avium
GKPFKKE

SEQ ID NO: 52687 - protein, 9 aa, Mycobacterium avium
GKPRPGNYQ

SEQ ID NO: 52688 - protein, 10 aa, Mycobacterium avium
GKPVEDGALP

SEQ ID NO: 52689 - protein, 11 aa, Mycobacterium avium
GKQTITSLPGS

SEQ ID NO: 52690 - protein, 10 aa, Mycobacterium avium
GKRLDESGSG

SEQ ID NO: 52691 - protein, 9 aa, Mycobacterium avium
GKRPFSGDG

SEQ ID NO: 52692 - protein, 8 aa, Mycobacterium avium
GKRQSAAD

SEQ ID NO: 52693 - protein, 16 aa, Mycobacterium avium
GKRSVTFGSGGDDAAR

SEQ ID NO: 52694 - protein, 4 aa, Mycobacterium avium
GKSA

SEQ ID NO: 52695 - protein, 7 aa, Mycobacterium avium
GKSAGGI

SEQ ID NO: 52696 - protein, 8 aa, Mycobacterium avium
GKSQWAEE

SEQ ID NO: 52697 - protein, 19 aa, Mycobacterium avium
GKSSSASRAIDTESNLGQY

SEQ ID NO: 52698 - protein, 5 aa, Mycobacterium avium
GKSTL

SEQ ID NO: 52699 - protein, 7 aa, Mycobacterium avium
GKYGTTV

SEQ ID NO: 52700 - protein, 15 aa, Mycobacterium avium
GLAAKGGWGPGGRGE

SEQ ID NO: 52701 - protein, 13 aa, Mycobacterium avium
GLADSPDVEGIPP

SEQ ID NO: 52702 - protein, 11 aa, Mycobacterium avium
GLATDDPRGLT

SEQ ID NO: 52703 - protein, 6 aa, Mycobacterium avium
GLATTS

SEQ ID NO: 52704 - protein, 8 aa, Mycobacterium avium
GLDAPGAA

SEQ ID NO: 52705 - protein, 6 aa, Mycobacterium avium
GLDEDT

SEQ ID NO: 52706 - protein, 6 aa, Mycobacterium avium
GLDGEE

SEQ ID NO: 52707 - protein, 20 aa, Mycobacterium avium
GLDPAGPAAALAEFERSCAW

SEQ ID NO: 52708 - protein, 9 aa, Mycobacterium avium
GLDRREKTT

SEQ ID NO: 52709 - protein, 16 aa, Mycobacterium avium
GLEGTAGGSSYNAAKG

SEQ ID NO: 52710 - protein, 7 aa, Mycobacterium avium
GLERPRS

SEQ ID NO: 52711 - protein, 17 aa, Mycobacterium avium
GLGASRADHKPGKQIGA

SEQ ID NO: 52712 - protein, 7 aa, Mycobacterium avium
GLGEAER

SEQ ID NO: 52713 - protein, 10 aa, Mycobacterium avium
GLGGAEPGQL

SEQ ID NO: 52714 - protein, 18 aa, Mycobacterium avium
GLGGPGAASVASGHGNFG

SEQ ID NO: 52715 - protein, 4 aa, Mycobacterium avium
GLGN

SEQ ID NO: 52716 - protein, 6 aa, Mycobacterium avium
GLGPAA

SEQ ID NO: 52717 - protein, 10 aa, Mycobacterium avium
GLGPSPARDR

SEQ ID NO: 52718 - protein, 6 aa, Mycobacterium avium
GLGQQE

SEQ ID NO: 52719 - protein, 47 aa, Mycobacterium avium
GLGRKSATRKAKGAKGKAKKGKKGARGPTPPKVRSPLGPGMPAGYPD

SEQ ID NO: 52720 - protein, 9 aa, Mycobacterium avium
GLGTDDAGA

SEQ ID NO: 52721 - protein, 15 aa, Mycobacterium avium
GLGVRGPDRDRGGFD

SEQ ID NO: 52722 - protein, 10 aa, Mycobacterium avium
GLNPTGSFKD

SEQ ID NO: 52723 - protein, 4 aa, Mycobacterium avium
GLPA

SEQ ID NO: 52724 - protein, 5 aa, Mycobacterium avium
GLPAP

SEQ ID NO: 52725 - protein, 12 aa, Mycobacterium avium
GLPAPKYGTATT

SEQ ID NO: 52726 - protein, 19 aa, Mycobacterium avium
GLPASLESAYQERTSPSEA

SEQ ID NO: 52727 - protein, 5 aa, Mycobacterium avium
GLPDE

SEQ ID NO: 52728 - protein, 7 aa, Mycobacterium avium
GLPEDER

SEQ ID NO: 52729 - protein, 9 aa, Mycobacterium avium
GLPERQRQN

SEQ ID NO: 52730 - protein, 6 aa, Mycobacterium avium
GLPGPR

SEQ ID NO: 52731 - protein, 15 aa, Mycobacterium avium
GLPGQRSVASAADRE

SEQ ID NO: 52732 - protein, 6 aa, Mycobacterium avium
GLPGSA

SEQ ID NO: 52733 - protein, 4 aa, Mycobacterium avium
GLPK

SEQ ID NO: 52734 - protein, 9 aa, Mycobacterium avium
GLPPGVGTV

SEQ ID NO: 52735 - protein, 16 aa, Mycobacterium avium
GLPPIGSGLAPGTGLR

SEQ ID NO: 52736 - protein, 6 aa, Mycobacterium avium
GLPPVD

SEQ ID NO: 52737 - protein, 5 aa, Mycobacterium avium
GLPRG

SEQ ID NO: 52738 - protein, 7 aa, Mycobacterium avium
GLPRQGR

SEQ ID NO: 52739 - protein, 4 aa, Mycobacterium avium
GLPT

SEQ ID NO: 52740 - protein, 21 aa, Mycobacterium avium
GLQARAGVGRGDGKPEVEAAE

SEQ ID NO: 52741 - protein, 6 aa, Mycobacterium avium
GLQEKP

SEQ ID NO: 52742 - protein, 10 aa, Mycobacterium avium
GLRPQAPPEA

SEQ ID NO: 52743 - protein, 4 aa, Mycobacterium avium
GLSA

SEQ ID NO: 52744 - protein, 7 aa, Mycobacterium avium
GLSDNEL

SEQ ID NO: 52745 - protein, 14 aa, Mycobacterium avium
GLSGPKSERPGFGT

SEQ ID NO: 52746 - protein, 10 aa, Mycobacterium avium
GLSHSPPSLE

SEQ ID NO: 52747 - protein, 11 aa, Mycobacterium avium
GLSHSPPVPTL

SEQ ID NO: 52748 - protein, 18 aa, Mycobacterium avium
GLSPRSPLPGDDGLSPVT

SEQ ID NO: 52749 - protein, 6 aa, Mycobacterium avium
GLSTHD

SEQ ID NO: 52750 - protein, 8 aa, Mycobacterium avium
GLSTRGYT

SEQ ID NO: 52751 - protein, 6 aa, Mycobacterium avium
GLTEQA

SEQ ID NO: 52752 - protein, 6 aa, Mycobacterium avium
GLTPAD

SEQ ID NO: 52753 - protein, 17 aa, Mycobacterium avium
GLTPCEPGSAANGAGTL

SEQ ID NO: 52754 - protein, 13 aa, Mycobacterium avium
GLTPDSSDEQFRA

SEQ ID NO: 52755 - protein, 7 aa, Mycobacterium avium
GLTPDTD

SEQ ID NO: 52756 - protein, 9 aa, Mycobacterium avium
GLTPERAGF

SEQ ID NO: 52757 - protein, 5 aa, Mycobacterium avium
GLTPQ

SEQ ID NO: 52758 - protein, 15 aa, Mycobacterium avium
GMGRETAQRLRDGGH

SEQ ID NO: 52759 - protein, 8 aa, Mycobacterium avium
GMNAGKDV

SEQ ID NO: 52760 - protein, 5 aa, Mycobacterium avium
GMTEA

SEQ ID NO: 52761 - protein, 6 aa, Mycobacterium avium
GNAAKA

SEQ ID NO: 52762 - protein, 8 aa, Mycobacterium avium
GNAGASSS

SEQ ID NO: 52763 - protein, 8 aa, Mycobacterium avium
GNAGLAEQ

SEQ ID NO: 52764 - protein, 12 aa, Mycobacterium avium
GNAPTAKSPGEI

SEQ ID NO: 52765 - protein, 18 aa, Mycobacterium avium
GNAPTDPPDAEKIPVTPD

SEQ ID NO: 52766 - protein, 11 aa, Mycobacterium avium
GNDETTPDGSV

SEQ ID NO: 52767 - protein, 9 aa, Mycobacterium avium
GNDSPVTRA

SEQ ID NO: 52768 - protein, 5 aa, Mycobacterium avium
GNEIP

SEQ ID NO: 52769 - protein, 8 aa, Mycobacterium avium
GNETTRNA

SEQ ID NO: 52770 - protein, 5 aa, Mycobacterium avium
GNGAG

SEQ ID NO: 52771 - protein, 6 aa, Mycobacterium avium
GNGEQR

SEQ ID NO: 52772 - protein, 15 aa, Mycobacterium avium
GNGHSEIDYSDEYRK

SEQ ID NO: 52773 - protein, 9 aa, Mycobacterium avium
GNGPSFCSG

SEQ ID NO: 52774 - protein, 10 aa, Mycobacterium avium
GNGPSPKDGG

SEQ ID NO: 52775 - protein, 4 aa, Mycobacterium avium
GNGT

SEQ ID NO: 52776 - protein, 14 aa, Mycobacterium avium
GNHENELGNGPIGY

SEQ ID NO: 52777 - protein, 4 aa, Mycobacterium avium
GNLV

SEQ ID NO: 52778 - protein, 5 aa, Mycobacterium avium
GNPAA

SEQ ID NO: 52779 - protein, 5 aa, Mycobacterium avium
GNPAF

SEQ ID NO: 52780 - protein, 4 aa, Mycobacterium avium
GNPD

SEQ ID NO: 52781 - protein, 11 aa, Mycobacterium avium
GNPIATRDESY

SEQ ID NO: 52782 - protein, 6 aa, Mycobacterium avium
GNPKHI

SEQ ID NO: 52783 - protein, 6 aa, Mycobacterium avium
GNPSAR

SEQ ID NO: 52784 - protein, 8 aa, Mycobacterium avium
GNPVPNRA

SEQ ID NO: 52785 - protein, 4 aa, Mycobacterium avium
GNPW

SEQ ID NO: 52786 - protein, 5 aa, Mycobacterium avium
GNRPR

SEQ ID NO: 52787 - protein, 19 aa, Mycobacterium avium
GNRRPAVRGPRLMSKGVER

SEQ ID NO: 52788 - protein, 6 aa, Mycobacterium avium
GNTAGR

SEQ ID NO: 52789 - protein, 6 aa, Mycobacterium avium
GPAAAP

SEQ ID NO: 52790 - protein, 5 aa, Mycobacterium avium
GPAIE

SEQ ID NO: 52791 - protein, 6 aa, Mycobacterium avium
GPAPGM

SEQ ID NO: 52792 - protein, 7 aa, Mycobacterium avium
GPAPLGG

SEQ ID NO: 52793 - protein, 7 aa, Mycobacterium avium
GPAPNEL

SEQ ID NO: 52794 - protein, 10 aa, Mycobacterium avium
GPAPQEASPV

SEQ ID NO: 52795 - protein, 13 aa, Mycobacterium avium
GPAPSAPGENPIQ

SEQ ID NO: 52796 - protein, 6 aa, Mycobacterium avium
GPAPTP

SEQ ID NO: 52797 - protein, 11 aa, Mycobacterium avium
GPAPVQPGGPP

SEQ ID NO: 52798 - protein, 6 aa, Mycobacterium avium
GPARAV

SEQ ID NO: 52799 - protein, 7 aa, Mycobacterium avium
GPDADAM

SEQ ID NO: 52800 - protein, 5 aa, Mycobacterium avium
GPDAL

SEQ ID NO: 52801 - protein, 9 aa, Mycobacterium avium
GPDALQTRK

SEQ ID NO: 52802 - protein, 7 aa, Mycobacterium avium
GPDASPS

SEQ ID NO: 52803 - protein, 6 aa, Mycobacterium avium
GPDDYR

SEQ ID NO: 52804 - protein, 16 aa, Mycobacterium avium
GPDGAPRPPDGRETAT

SEQ ID NO: 52805 - protein, 15 aa, Mycobacterium avium
GPDPAANYAGSYSDD

SEQ ID NO: 52806 - protein, 7 aa, Mycobacterium avium
GPDPYDV

SEQ ID NO: 52807 - protein, 5 aa, Mycobacterium avium
GPDRT

SEQ ID NO: 52808 - protein, 6 aa, Mycobacterium avium
GPDSAA

SEQ ID NO: 52809 - protein, 11 aa, Mycobacterium avium
GPDTGRTGRHT

SEQ ID NO: 52810 - protein, 5 aa, Mycobacterium avium
GPEGR

SEQ ID NO: 52811 - protein, 6 aa, Mycobacterium avium
GPEGYR

SEQ ID NO: 52812 - protein, 6 aa, Mycobacterium avium
GPEHEP

SEQ ID NO: 52813 - protein, 5 aa, Mycobacterium avium
GPEIG

SEQ ID NO: 52814 - protein, 6 aa, Mycobacterium avium
GPELAA

SEQ ID NO: 52815 - protein, 21 aa, Mycobacterium avium
GPEQPAGARRSGKTEGTVRTR

SEQ ID NO: 52816 - protein, 21 aa, Mycobacterium avium
GPERELDGAEKTPARYYLFQR

SEQ ID NO: 52817 - protein, 5 aa, Mycobacterium avium
GPEVT

SEQ ID NO: 52818 - protein, 6 aa, Mycobacterium avium
GPFAET

SEQ ID NO: 52819 - protein, 8 aa, Mycobacterium avium
GPGADADR

SEQ ID NO: 52820 - protein, 13 aa, Mycobacterium avium
GPGDPNLAHRRDE

SEQ ID NO: 52821 - protein, 5 aa, Mycobacterium avium
GPGDR

SEQ ID NO: 52822 - protein, 6 aa, Mycobacterium avium
GPGEPR

SEQ ID NO: 52823 - protein, 14 aa, Mycobacterium avium
GPGESMFPGKAGTD

SEQ ID NO: 52824 - protein, 9 aa, Mycobacterium avium
GPGFGDESA

SEQ ID NO: 52825 - protein, 14 aa, Mycobacterium avium
GPGGHKLDDGTEDR

SEQ ID NO: 52826 - protein, 7 aa, Mycobacterium avium
GPGGKTA

SEQ ID NO: 52827 - protein, 8 aa, Mycobacterium avium
GPGHDNPL

SEQ ID NO: 52828 - protein, 6 aa, Mycobacterium avium
GPGITP

SEQ ID NO: 52829 - protein, 4 aa, Mycobacterium avium
GPGP

SEQ ID NO: 52830 - protein, 6 aa, Mycobacterium avium
GPGPFT

SEQ ID NO: 52831 - protein, 44 aa, Mycobacterium avium
GPGQQQQNQHRRGRDVADGPHPRAEPVRPATHRDPAERTEQLGE

SEQ ID NO: 52832 - protein, 17 aa, Mycobacterium avium
GPGREQTIVRRDILAAR

SEQ ID NO: 52833 - protein, 11 aa, Mycobacterium avium
GPGRPDVAEGD

SEQ ID NO: 52834 - protein, 5 aa, Mycobacterium avium
GPGSD

SEQ ID NO: 52835 - protein, 5 aa, Mycobacterium avium
GPGTI

SEQ ID NO: 52836 - protein, 4 aa, Mycobacterium avium
GPGV

SEQ ID NO: 52837 - protein, 13 aa, Mycobacterium avium
GPHGADPHHGYSD

SEQ ID NO: 52838 - protein, 8 aa, Mycobacterium avium
GPIAGSSK

SEQ ID NO: 52839 - protein, 10 aa, Mycobacterium avium
GPIAPPSPKC

SEQ ID NO: 52840 - protein, 4 aa, Mycobacterium avium
GPIS

SEQ ID NO: 52841 - protein, 6 aa, Mycobacterium avium
GPKNTL

SEQ ID NO: 52842 - protein, 8 aa, Mycobacterium avium
GPKSAEQI

SEQ ID NO: 52843 - protein, 5 aa, Mycobacterium avium
GPLDA

SEQ ID NO: 52844 - protein, 7 aa, Mycobacterium avium
GPLDTEA

SEQ ID NO: 52845 - protein, 9 aa, Mycobacterium avium
GPLEPTNDA

SEQ ID NO: 52846 - protein, 8 aa, Mycobacterium avium
GPLGPDEV

SEQ ID NO: 52847 - protein, 7 aa, Mycobacterium avium
GPLGTSS

SEQ ID NO: 52848 - protein, 20 aa, Mycobacterium avium
GPLPPSVPYDSSTPEDLAET

SEQ ID NO: 52849 - protein, 4 aa, Mycobacterium avium
GPLT

SEQ ID NO: 52850 - protein, 5 aa, Mycobacterium avium
GPLTG

SEQ ID NO: 52851 - protein, 6 aa, Mycobacterium avium
GPMQTG

SEQ ID NO: 52852 - protein, 10 aa, Mycobacterium avium
GPNGAGKSTT

SEQ ID NO: 52853 - protein, 5 aa, Mycobacterium avium
GPNLA

SEQ ID NO: 52854 - protein, 7 aa, Mycobacterium avium
GPNRIGQ

SEQ ID NO: 52855 - protein, 15 aa, Mycobacterium avium
GPPAAELAGDEQARR

SEQ ID NO: 52856 - protein, 11 aa, Mycobacterium avium
GPPGDRESATL

SEQ ID NO: 52857 - protein, 12 aa, Mycobacterium avium
GPPGGLPALDPD

SEQ ID NO: 52858 - protein, 9 aa, Mycobacterium avium
GPPGSGKTT

SEQ ID NO: 52859 - protein, 11 aa, Mycobacterium avium
GPPGTGKTSVA

SEQ ID NO: 52860 - protein, 5 aa, Mycobacterium avium
GPPGV

SEQ ID NO: 52861 - protein, 14 aa, Mycobacterium avium
GPPGVGKTSLGESV

SEQ ID NO: 52862 - protein, 8 aa, Mycobacterium avium
GPQSGPGQ

SEQ ID NO: 52863 - protein, 10 aa, Mycobacterium avium
GPRDGAVDAT

SEQ ID NO: 52864 - protein, 6 aa, Mycobacterium avium
GPRGDT

SEQ ID NO: 52865 - protein, 5 aa, Mycobacterium avium
GPRNV

SEQ ID NO: 52866 - protein, 6 aa, Mycobacterium avium
GPRPAE

SEQ ID NO: 52867 - protein, 12 aa, Mycobacterium avium
GPSAAAGGSYDA

SEQ ID NO: 52868 - protein, 9 aa, Mycobacterium avium
GPSGGGKTT

SEQ ID NO: 52869 - protein, 11 aa, Mycobacterium avium
GPSPAQRREAQ

SEQ ID NO: 52870 - protein, 8 aa, Mycobacterium avium
GPSPGGLR

SEQ ID NO: 52871 - protein, 5 aa, Mycobacterium avium
GPSPM

SEQ ID NO: 52872 - protein, 5 aa, Mycobacterium avium
GPSPY

SEQ ID NO: 52873 - protein, 5 aa, Mycobacterium avium
GPTAQ

SEQ ID NO: 52874 - protein, 17 aa, Mycobacterium avium
GPTEREYTTSVAGGPIV

SEQ ID NO: 52875 - protein, 20 aa, Mycobacterium avium
GPTKELEEHREQYGDTSGLS

SEQ ID NO: 52876 - protein, 9 aa, Mycobacterium avium
GPTLPDGLR

SEQ ID NO: 52877 - protein, 9 aa, Mycobacterium avium
GPTSGIGAG

SEQ ID NO: 52878 - protein, 5 aa, Mycobacterium avium
GPTTV

SEQ ID NO: 52879 - protein, 15 aa, Mycobacterium avium
GPVAGTGGVPGIPGI

SEQ ID NO: 52880 - protein, 5 aa, Mycobacterium avium
GPVDP

SEQ ID NO: 52881 - protein, 13 aa, Mycobacterium avium
GPVGGQRQPLGHA

SEQ ID NO: 52882 - protein, 4 aa, Mycobacterium avium
GPVN

SEQ ID NO: 52883 - protein, 7 aa, Mycobacterium avium
GPVQSDG

SEQ ID NO: 52884 - protein, 6 aa, Mycobacterium avium
GPVTAA

SEQ ID NO: 52885 - protein, 17 aa, Mycobacterium avium
GPYGTKRSLPQQLRAMV

SEQ ID NO: 52886 - protein, 14 aa, Mycobacterium avium
GQAAVQSAAASVRA

SEQ ID NO: 52887 - protein, 4 aa, Mycobacterium avium
GQAI

SEQ ID NO: 52888 - protein, 8 aa, Mycobacterium avium
GQAPPFGF

SEQ ID NO: 52889 - protein, 10 aa, Mycobacterium avium
GQASGPASSI

SEQ ID NO: 52890 - protein, 7 aa, Mycobacterium avium
GQDLSGK

SEQ ID NO: 52891 - protein, 11 aa, Mycobacterium avium
GQDPEKVREVS

SEQ ID NO: 52892 - protein, 11 aa, Mycobacterium avium
GQDVPPPPPRP

SEQ ID NO: 52893 - protein, 10 aa, Mycobacterium avium
GQEARTSEDE

SEQ ID NO: 52894 - protein, 4 aa, Mycobacterium avium
GQFP

SEQ ID NO: 52895 - protein, 9 aa, Mycobacterium avium
GQGANEVEN

SEQ ID NO: 52896 - protein, 4 aa, Mycobacterium avium
GQGR

SEQ ID NO: 52897 - protein, 4 aa, Mycobacterium avium
GQGS

SEQ ID NO: 52898 - protein, 4 aa, Mycobacterium avium
GQGT

SEQ ID NO: 52899 - protein, 4 aa, Mycobacterium avium
GQIG

SEQ ID NO: 52900 - protein, 6 aa, Mycobacterium avium
GQLQQA

SEQ ID NO: 52901 - protein, 10 aa, Mycobacterium avium
GQPIGAGRTT

SEQ ID NO: 52902 - protein, 6 aa, Mycobacterium avium
GQPLPE

SEQ ID NO: 52903 - protein, 9 aa, Mycobacterium avium
GQPPLDARG

SEQ ID NO: 52904 - protein, 17 aa, Mycobacterium avium
GQPTAENTRECGADGDL

SEQ ID NO: 52905 - protein, 12 aa, Mycobacterium avium
GQPVELAPAGTS

SEQ ID NO: 52906 - protein, 5 aa, Mycobacterium avium
GQPVR

SEQ ID NO: 52907 - protein, 13 aa, Mycobacterium avium
GQQRARRSVAAGA

SEQ ID NO: 52908 - protein, 10 aa, Mycobacterium avium
GQREPDGAGF

SEQ ID NO: 52909 - protein, 6 aa, Mycobacterium avium
GQRLGS

SEQ ID NO: 52910 - protein, 7 aa, Mycobacterium avium
GQRPTLS

SEQ ID NO: 52911 - protein, 14 aa, Mycobacterium avium
GQRRPARAGAGEAE

SEQ ID NO: 52912 - protein, 6 aa, Mycobacterium avium
GQRRYD

SEQ ID NO: 52913 - protein, 8 aa, Mycobacterium avium
GQRRYNPG

SEQ ID NO: 52914 - protein, 7 aa, Mycobacterium avium
GQRSAPA

SEQ ID NO: 52915 - protein, 4 aa, Mycobacterium avium
GQSI

SEQ ID NO: 52916 - protein, 8 aa, Mycobacterium avium
GQSSGGLG

SEQ ID NO: 52917 - protein, 7 aa, Mycobacterium avium
GQTDDSA

SEQ ID NO: 52918 - protein, 4 aa, Mycobacterium avium
GQTG

SEQ ID NO: 52919 - protein, 5 aa, Mycobacterium avium
GQTHR

SEQ ID NO: 52920 - protein, 4 aa, Mycobacterium avium
GQTP

SEQ ID NO: 52921 - protein, 31 aa, Mycobacterium avium
GQTSVTTIGADGRAQQALRAGRGATTMAADA

SEQ ID NO: 52922 - protein, 9 aa, Mycobacterium avium
GQVSPGGAT

SEQ ID NO: 52923 - protein, 6 aa, Mycobacterium avium
GRAAAK

SEQ ID NO: 52924 - protein, 16 aa, Mycobacterium avium
GRAAGDIGDHISSEDV

SEQ ID NO: 52925 - protein, 8 aa, Mycobacterium avium
GRADVSGL

SEQ ID NO: 52926 - protein, 9 aa, Mycobacterium avium
GRAEERPVR

SEQ ID NO: 52927 - protein, 18 aa, Mycobacterium avium
GRAETGPDIEAYGSPSSV

SEQ ID NO: 52928 - protein, 8 aa, Mycobacterium avium
GRAGEPQW

SEQ ID NO: 52929 - protein, 9 aa, Mycobacterium avium
GRAGETASR

SEQ ID NO: 52930 - protein, 8 aa, Mycobacterium avium
GRAGGHHS

SEQ ID NO: 52931 - protein, 10 aa, Mycobacterium avium
GRAKRTAPPL

SEQ ID NO: 52932 - protein, 11 aa, Mycobacterium avium
GRAPGSDPVTS

SEQ ID NO: 52933 - protein, 9 aa, Mycobacterium avium
GRAPSRDTY

SEQ ID NO: 52934 - protein, 13 aa, Mycobacterium avium
GRATAGPDPLGRS

SEQ ID NO: 52935 - protein, 8 aa, Mycobacterium avium
GRATTSIE

SEQ ID NO: 52936 - protein, 7 aa, Mycobacterium avium
GRATYGG

SEQ ID NO: 52937 - protein, 7 aa, Mycobacterium avium
GRAVTPG

SEQ ID NO: 52938 - protein, 8 aa, Mycobacterium avium
GRDADPAI

SEQ ID NO: 52939 - protein, 8 aa, Mycobacterium avium
GRDEFGGA

SEQ ID NO: 52940 - protein, 6 aa, Mycobacterium avium
GRDERS

SEQ ID NO: 52941 - protein, 12 aa, Mycobacterium avium
GRDFDSQGQLRK

SEQ ID NO: 52942 - protein, 14 aa, Mycobacterium avium
GRDLTGKGAPEKLR

SEQ ID NO: 52943 - protein, 8 aa, Mycobacterium avium
GRDPRDIR

SEQ ID NO: 52944 - protein, 4 aa, Mycobacterium avium
GRED

SEQ ID NO: 52945 - protein, 8 aa, Mycobacterium avium
GREGGSVP

SEQ ID NO: 52946 - protein, 9 aa, Mycobacterium avium
GREPTPEEL

SEQ ID NO: 52947 - protein, 6 aa, Mycobacterium avium
GRESGL

SEQ ID NO: 52948 - protein, 12 aa, Mycobacterium avium
GRETESGRGPTD

SEQ ID NO: 52949 - protein, 9 aa, Mycobacterium avium
GREVNTAGD

SEQ ID NO: 52950 - protein, 7 aa, Mycobacterium avium
GREVTPA

SEQ ID NO: 52951 - protein, 7 aa, Mycobacterium avium
GRGDPAL

SEQ ID NO: 52952 - protein, 10 aa, Mycobacterium avium
GRGEDGANSY

SEQ ID NO: 52953 - protein, 10 aa, Mycobacterium avium
GRGKTGSGKT

SEQ ID NO: 52954 - protein, 7 aa, Mycobacterium avium
GRGNELA

SEQ ID NO: 52955 - protein, 15 aa, Mycobacterium avium
GRGRYGPGGMPRSTE

SEQ ID NO: 52956 - protein, 12 aa, Mycobacterium avium
GRGTDGELPPNN

SEQ ID NO: 52957 - protein, 15 aa, Mycobacterium avium
GRGWPGDEPVQAGGR

SEQ ID NO: 52958 - protein, 7 aa, Mycobacterium avium
GRHTAEA

SEQ ID NO: 52959 - protein, 9 aa, Mycobacterium avium
GRHTAESDH

SEQ ID NO: 52960 - protein, 10 aa, Mycobacterium avium
GRIADTGTQF

SEQ ID NO: 52961 - protein, 11 aa, Mycobacterium avium
GRIAESARRHG

SEQ ID NO: 52962 - protein, 6 aa, Mycobacterium avium
GRIDPT

SEQ ID NO: 52963 - protein, 10 aa, Mycobacterium avium
GRIGQPGEVA

SEQ ID NO: 52964 - protein, 11 aa, Mycobacterium avium
GRISGVTEPGE

SEQ ID NO: 52965 - protein, 12 aa, Mycobacterium avium
GRKSGQPRSTPM

SEQ ID NO: 52966 - protein, 5 aa, Mycobacterium avium
GRLDP

SEQ ID NO: 52967 - protein, 10 aa, Mycobacterium avium
GRLEGKSSLG

SEQ ID NO: 52968 - protein, 22 aa, Mycobacterium avium
GRLPGSSAGRRIEGAGPGEGSV

SEQ ID NO: 52969 - protein, 4 aa, Mycobacterium avium
GRLS

SEQ ID NO: 52970 - protein, 8 aa, Mycobacterium avium
GRLSGQEL

SEQ ID NO: 52971 - protein, 4 aa, Mycobacterium avium
GRMD

SEQ ID NO: 52972 - protein, 5 aa, Mycobacterium avium
GRNAE

SEQ ID NO: 52973 - protein, 10 aa, Mycobacterium avium
GRNKTTSVGQ

SEQ ID NO: 52974 - protein, 6 aa, Mycobacterium avium
GRNPTG

SEQ ID NO: 52975 - protein, 8 aa, Mycobacterium avium
GRNQRRSA

SEQ ID NO: 52976 - protein, 16 aa, Mycobacterium avium
GRPAALPTHRGRRTRA

SEQ ID NO: 52977 - protein, 12 aa, Mycobacterium avium
GRPAGSSGSRER

SEQ ID NO: 52978 - protein, 13 aa, Mycobacterium avium
GRPALANAESGPA

SEQ ID NO: 52979 - protein, 7 aa, Mycobacterium avium
GRPDPEL

SEQ ID NO: 52980 - protein, 17 aa, Mycobacterium avium
GRPDVNDLGTSYGEAHL

SEQ ID NO: 52981 - protein, 5 aa, Mycobacterium avium
GRPEE

SEQ ID NO: 52982 - protein, 5 aa, Mycobacterium avium
GRPEP

SEQ ID NO: 52983 - protein, 8 aa, Mycobacterium avium
GRPGAGRL

SEQ ID NO: 52984 - protein, 17 aa, Mycobacterium avium
GRPGQEALTNPTEQERA

SEQ ID NO: 52985 - protein, 16 aa, Mycobacterium avium
GRPQANEKTTHRGAQS

SEQ ID NO: 52986 - protein, 10 aa, Mycobacterium avium
GRPQVGDPLP

SEQ ID NO: 52987 - protein, 9 aa, Mycobacterium avium
GRPSKAVSD

SEQ ID NO: 52988 - protein, 6 aa, Mycobacterium avium
GRPSLT

SEQ ID NO: 52989 - protein, 10 aa, Mycobacterium avium
GRPSPDTPVG

SEQ ID NO: 52990 - protein, 14 aa, Mycobacterium avium
GRPTWSTAPGLPHD

SEQ ID NO: 52991 - protein, 54 aa, Mycobacterium avium
GRPVASPGAGPTEPSFPTPRSTPPSATAAPAPTALPPPSPSAPAGAIPLPPDQN

SEQ ID NO: 52992 - protein, 12 aa, Mycobacterium avium
GRPVSGPNSKTE

SEQ ID NO: 52993 - protein, 7 aa, Mycobacterium avium
GRPYEPQ

SEQ ID NO: 52994 - protein, 5 aa, Mycobacterium avium
GRQAR

SEQ ID NO: 52995 - protein, 7 aa, Mycobacterium avium
GRQGEAL

SEQ ID NO: 52996 - protein, 9 aa, Mycobacterium avium
GRQNSNEAL

SEQ ID NO: 52997 - protein, 4 aa, Mycobacterium avium
GRQR

SEQ ID NO: 52998 - protein, 6 aa, Mycobacterium avium
GRQVED

SEQ ID NO: 52999 - protein, 4 aa, Mycobacterium avium
GRRA

SEQ ID NO: 53000 - protein, 10 aa, Mycobacterium avium
GRRARRGRGA

SEQ ID NO: 53001 - protein, 8 aa, Mycobacterium avium
GRRDQQAV

SEQ ID NO: 53002 - protein, 8 aa, Mycobacterium avium
GRRGASVS

SEQ ID NO: 53003 - protein, 15 aa, Mycobacterium avium
GRRGPDRDRPAYDDT

SEQ ID NO: 53004 - protein, 4 aa, Mycobacterium avium
GRRM

SEQ ID NO: 53005 - protein, 6 aa, Mycobacterium avium
GRRNAA

SEQ ID NO: 53006 - protein, 7 aa, Mycobacterium avium
GRRPNGD

SEQ ID NO: 53007 - protein, 7 aa, Mycobacterium avium
GRRRPGV

SEQ ID NO: 53008 - protein, 17 aa, Mycobacterium avium
GRRSGARRARPTRADNR

SEQ ID NO: 53009 - protein, 11 aa, Mycobacterium avium
GRRSGKPYRTP

SEQ ID NO: 53010 - protein, 9 aa, Mycobacterium avium
GRRTSAPAA

SEQ ID NO: 53011 - protein, 8 aa, Mycobacterium avium
GRSARTPA

SEQ ID NO: 53012 - protein, 6 aa, Mycobacterium avium
GRSFTG

SEQ ID NO: 53013 - protein, 13 aa, Mycobacterium avium
GRSGDPHAATPHP

SEQ ID NO: 53014 - protein, 6 aa, Mycobacterium avium
GRSGLT

SEQ ID NO: 53015 - protein, 5 aa, Mycobacterium avium
GRSIR

SEQ ID NO: 53016 - protein, 6 aa, Mycobacterium avium
GRSPLV

SEQ ID NO: 53017 - protein, 6 aa, Mycobacterium avium
GRSRPD

SEQ ID NO: 53018 - protein, 9 aa, Mycobacterium avium
GRSSDYPQQ

SEQ ID NO: 53019 - protein, 6 aa, Mycobacterium avium
GRTAED

SEQ ID NO: 53020 - protein, 5 aa, Mycobacterium avium
GRTAL

SEQ ID NO: 53021 - protein, 6 aa, Mycobacterium avium
GRTCES

SEQ ID NO: 53022 - protein, 5 aa, Mycobacterium avium
GRTGA

SEQ ID NO: 53023 - protein, 7 aa, Mycobacterium avium
GRTLEEA

SEQ ID NO: 53024 - protein, 8 aa, Mycobacterium avium
GRTPVTGA

SEQ ID NO: 53025 - protein, 5 aa, Mycobacterium avium
GRTVA

SEQ ID NO: 53026 - protein, 8 aa, Mycobacterium avium
GRVPDGED

SEQ ID NO: 53027 - protein, 12 aa, Mycobacterium avium
GRVRPGATTLAG

SEQ ID NO: 53028 - protein, 6 aa, Mycobacterium avium
GRVTDR

SEQ ID NO: 53029 - protein, 7 aa, Mycobacterium avium
GRYGDVE

SEQ ID NO: 53030 - protein, 9 aa, Mycobacterium avium
GRYLDPDKA

SEQ ID NO: 53031 - protein, 18 aa, Mycobacterium avium
GSAADVLDGKDPDHQLKT

SEQ ID NO: 53032 - protein, 8 aa, Mycobacterium avium
GSAASDAA

SEQ ID NO: 53033 - protein, 6 aa, Mycobacterium avium
GSAATI

SEQ ID NO: 53034 - protein, 9 aa, Mycobacterium avium
GSAEVKHVG

SEQ ID NO: 53035 - protein, 4 aa, Mycobacterium avium
GSAL

SEQ ID NO: 53036 - protein, 7 aa, Mycobacterium avium
GSALGRS

SEQ ID NO: 53037 - protein, 4 aa, Mycobacterium avium
GSAM

SEQ ID NO: 53038 - protein, 16 aa, Mycobacterium avium
GSAPDIAGQGVADPTA

SEQ ID NO: 53039 - protein, 10 aa, Mycobacterium avium
GSAPVPPGLA

SEQ ID NO: 53040 - protein, 15 aa, Mycobacterium avium
GSARPPRASITPPAW

SEQ ID NO: 53041 - protein, 6 aa, Mycobacterium avium
GSATAV

SEQ ID NO: 53042 - protein, 11 aa, Mycobacterium avium
GSCDSTTTSLR

SEQ ID NO: 53043 - protein, 4 aa, Mycobacterium avium
GSCR

SEQ ID NO: 53044 - protein, 8 aa, Mycobacterium avium
GSDDPNSV

SEQ ID NO: 53045 - protein, 5 aa, Mycobacterium avium
GSDGA

SEQ ID NO: 53046 - protein, 9 aa, Mycobacterium avium
GSDGDGRTH

SEQ ID NO: 53047 - protein, 7 aa, Mycobacterium avium
GSDGDIT

SEQ ID NO: 53048 - protein, 11 aa, Mycobacterium avium
GSDSGGGAGIQ

SEQ ID NO: 53049 - protein, 10 aa, Mycobacterium avium
GSEADRPEPL

SEQ ID NO: 53050 - protein, 10 aa, Mycobacterium avium
GSEAQRERRK

SEQ ID NO: 53051 - protein, 17 aa, Mycobacterium avium
GSEQTAAAEGKVGTVRR

SEQ ID NO: 53052 - protein, 16 aa, Mycobacterium avium
GSGAGGVTGAYTAARE

SEQ ID NO: 53053 - protein, 15 aa, Mycobacterium avium
GSGAGVQVIDHAAGK

SEQ ID NO: 53054 - protein, 5 aa, Mycobacterium avium
GSGDL

SEQ ID NO: 53055 - protein, 7 aa, Mycobacterium avium
GSGGGGM

SEQ ID NO: 53056 - protein, 14 aa, Mycobacterium avium
GSGGYGDLDEETAR

SEQ ID NO: 53057 - protein, 9 aa, Mycobacterium avium
GSGKSTIGR

SEQ ID NO: 53058 - protein, 14 aa, Mycobacterium avium
GSGMASTKRPESTQ

SEQ ID NO: 53059 - protein, 9 aa, Mycobacterium avium
GSGNPRADI

SEQ ID NO: 53060 - protein, 4 aa, Mycobacterium avium
GSGP

SEQ ID NO: 53061 - protein, 9 aa, Mycobacterium avium
GSGPKALDQ

SEQ ID NO: 53062 - protein, 6 aa, Mycobacterium avium
GSGPWP

SEQ ID NO: 53063 - protein, 10 aa, Mycobacterium avium
GSGRDGAAGT

SEQ ID NO: 53064 - protein, 8 aa, Mycobacterium avium
GSGRRRGK

SEQ ID NO: 53065 - protein, 7 aa, Mycobacterium avium
GSGTLVP

SEQ ID NO: 53066 - protein, 4 aa, Mycobacterium avium
GSGV

SEQ ID NO: 53067 - protein, 9 aa, Mycobacterium avium
GSGVTGQDI

SEQ ID NO: 53068 - protein, 7 aa, Mycobacterium avium
GSHAEGD

SEQ ID NO: 53069 - protein, 9 aa, Mycobacterium avium
GSHQDAINK

SEQ ID NO: 53070 - protein, 7 aa, Mycobacterium avium
GSIPRGL

SEQ ID NO: 53071 - protein, 9 aa, Mycobacterium avium
GSKSGAAQS

SEQ ID NO: 53072 - protein, 14 aa, Mycobacterium avium
GSKSLMDTATEGLR

SEQ ID NO: 53073 - protein, 7 aa, Mycobacterium avium
GSKTGTE

SEQ ID NO: 53074 - protein, 14 aa, Mycobacterium avium
GSLAGGALGSPAAR

SEQ ID NO: 53075 - protein, 9 aa, Mycobacterium avium
GSLAGGPFN

SEQ ID NO: 53076 - protein, 4 aa, Mycobacterium avium
GSLD

SEQ ID NO: 53077 - protein, 10 aa, Mycobacterium avium
GSLPRTSSGK

SEQ ID NO: 53078 - protein, 4 aa, Mycobacterium avium
GSLR

SEQ ID NO: 53079 - protein, 6 aa, Mycobacterium avium
GSMAAR

SEQ ID NO: 53080 - protein, 5 aa, Mycobacterium avium
GSPAD

SEQ ID NO: 53081 - protein, 9 aa, Mycobacterium avium
GSPGAAPGF

SEQ ID NO: 53082 - protein, 28 aa, Mycobacterium avium
GSPGGAAKVGLTENDPAPVKNLESRVDA

SEQ ID NO: 53083 - protein, 28 aa, Mycobacterium avium
GSPGGAAKVGLTENDPQVVKDLPPQGEG

SEQ ID NO: 53084 - protein, 7 aa, Mycobacterium avium
GSPNRGM

SEQ ID NO: 53085 - protein, 13 aa, Mycobacterium avium
GSPTAEAIDPDKA

SEQ ID NO: 53086 - protein, 14 aa, Mycobacterium avium
GSPTDTRSLDDRDD

SEQ ID NO: 53087 - protein, 8 aa, Mycobacterium avium
GSQDPVQE

SEQ ID NO: 53088 - protein, 10 aa, Mycobacterium avium
GSQTSDKVDK

SEQ ID NO: 53089 - protein, 4 aa, Mycobacterium avium
GSRA

SEQ ID NO: 53090 - protein, 8 aa, Mycobacterium avium
GSRAAARY

SEQ ID NO: 53091 - protein, 5 aa, Mycobacterium avium
GSRGM

SEQ ID NO: 53092 - protein, 6 aa, Mycobacterium avium
GSRPVR

SEQ ID NO: 53093 - protein, 9 aa, Mycobacterium avium
GSRWEPPAA

SEQ ID NO: 53094 - protein, 6 aa, Mycobacterium avium
GSSETW

SEQ ID NO: 53095 - protein, 5 aa, Mycobacterium avium
GSSPA

SEQ ID NO: 53096 - protein, 19 aa, Mycobacterium avium
GSTALSSAGTVSASAGRAG

SEQ ID NO: 53097 - protein, 9 aa, Mycobacterium avium
GSTATGRSV

SEQ ID NO: 53098 - protein, 8 aa, Mycobacterium avium
GSTEDGAR

SEQ ID NO: 53099 - protein, 7 aa, Mycobacterium avium
GSTGDGI

SEQ ID NO: 53100 - protein, 8 aa, Mycobacterium avium
GSTGGGPV

SEQ ID NO: 53101 - protein, 8 aa, Mycobacterium avium
GSTGVPKG

SEQ ID NO: 53102 - protein, 28 aa, Mycobacterium avium
GSTISSANTAALGPTSGVLAPGADEVSA

SEQ ID NO: 53103 - protein, 8 aa, Mycobacterium avium
GSTNGTYL

SEQ ID NO: 53104 - protein, 4 aa, Mycobacterium avium
GSTW

SEQ ID NO: 53105 - protein, 9 aa, Mycobacterium avium
GSVQERAAQ

SEQ ID NO: 53106 - protein, 17 aa, Mycobacterium avium
GSVSSRDARGGTAPARV

SEQ ID NO: 53107 - protein, 6 aa, Mycobacterium avium
GSVSVH

SEQ ID NO: 53108 - protein, 6 aa, Mycobacterium avium
GSVTGH

SEQ ID NO: 53109 - protein, 13 aa, Mycobacterium avium
GSWANDSVSCPRS

SEQ ID NO: 53110 - protein, 6 aa, Mycobacterium avium
GSWGTT

SEQ ID NO: 53111 - protein, 24 aa, Mycobacterium avium
GSYEPGYHSDSTRTYSIGEPSHEV

SEQ ID NO: 53112 - protein, 7 aa, Mycobacterium avium
GSYGPRG

SEQ ID NO: 53113 - protein, 4 aa, Mycobacterium avium
GSYR

SEQ ID NO: 53114 - protein, 9 aa, Mycobacterium avium
GTAAERERS

SEQ ID NO: 53115 - protein, 11 aa, Mycobacterium avium
GTAAQTVGISS

SEQ ID NO: 53116 - protein, 5 aa, Mycobacterium avium
GTADP

SEQ ID NO: 53117 - protein, 12 aa, Mycobacterium avium
GTADPAEARARL

SEQ ID NO: 53118 - protein, 11 aa, Mycobacterium avium
GTADPAEARTA

SEQ ID NO: 53119 - protein, 9 aa, Mycobacterium avium
GTADPAELR

SEQ ID NO: 53120 - protein, 8 aa, Mycobacterium avium
GTADPAQL

SEQ ID NO: 53121 - protein, 6 aa, Mycobacterium avium
GTADTN

SEQ ID NO: 53122 - protein, 9 aa, Mycobacterium avium
GTAGRAELA

SEQ ID NO: 53123 - protein, 12 aa, Mycobacterium avium
GTAGSTGNPRTA

SEQ ID NO: 53124 - protein, 11 aa, Mycobacterium avium
GTAHPGASGRV

SEQ ID NO: 53125 - protein, 8 aa, Mycobacterium avium
GTAKSGRE

SEQ ID NO: 53126 - protein, 7 aa, Mycobacterium avium
GTALGNP

SEQ ID NO: 53127 - protein, 9 aa, Mycobacterium avium
GTAPDDDSP

SEQ ID NO: 53128 - protein, 6 aa, Mycobacterium avium
GTAPPH

SEQ ID NO: 53129 - protein, 10 aa, Mycobacterium avium
GTARAENYGP

SEQ ID NO: 53130 - protein, 5 aa, Mycobacterium avium
GTAVA

SEQ ID NO: 53131 - protein, 18 aa, Mycobacterium avium
GTDAGANAGLGSDTSAVA

SEQ ID NO: 53132 - protein, 7 aa, Mycobacterium avium
GTDDTIE

SEQ ID NO: 53133 - protein, 7 aa, Mycobacterium avium
GTDEQKQ

SEQ ID NO: 53134 - protein, 20 aa, Mycobacterium avium
GTDFRPAKRLPAEQVTHWDS

SEQ ID NO: 53135 - protein, 16 aa, Mycobacterium avium
GTDGGYLSDGASEMST

SEQ ID NO: 53136 - protein, 5 aa, Mycobacterium avium
GTDNF

SEQ ID NO: 53137 - protein, 8 aa, Mycobacterium avium
GTDTAARA

SEQ ID NO: 53138 - protein, 7 aa, Mycobacterium avium
GTEAGRS

SEQ ID NO: 53139 - protein, 5 aa, Mycobacterium avium
GTEAT

SEQ ID NO: 53140 - protein, 8 aa, Mycobacterium avium
GTEEQKAK

SEQ ID NO: 53141 - protein, 5 aa, Mycobacterium avium
GTEIG

SEQ ID NO: 53142 - protein, 9 aa, Mycobacterium avium
GTEQPPFDE

SEQ ID NO: 53143 - protein, 10 aa, Mycobacterium avium
GTETTPSQER

SEQ ID NO: 53144 - protein, 7 aa, Mycobacterium avium
GTGMAGS

SEQ ID NO: 53145 - protein, 19 aa, Mycobacterium avium
GTGPPPRPADREFPDGTAV

SEQ ID NO: 53146 - protein, 9 aa, Mycobacterium avium
GTGQGEAAT

SEQ ID NO: 53147 - protein, 6 aa, Mycobacterium avium
GTGQPL

SEQ ID NO: 53148 - protein, 6 aa, Mycobacterium avium
GTGRVD

SEQ ID NO: 53149 - protein, 5 aa, Mycobacterium avium
GTGTV

SEQ ID NO: 53150 - protein, 7 aa, Mycobacterium avium
GTHAAST

SEQ ID NO: 53151 - protein, 10 aa, Mycobacterium avium
GTIAGGTSEI

SEQ ID NO: 53152 - protein, 10 aa, Mycobacterium avium
GTIDTGAGPH

SEQ ID NO: 53153 - protein, 9 aa, Mycobacterium avium
GTISDGSRY

SEQ ID NO: 53154 - protein, 6 aa, Mycobacterium avium
GTKGLS

SEQ ID NO: 53155 - protein, 14 aa, Mycobacterium avium
GTKPGTEVPPISDG

SEQ ID NO: 53156 - protein, 7 aa, Mycobacterium avium
GTLEPVR

SEQ ID NO: 53157 - protein, 17 aa, Mycobacterium avium
GTLGGTTGGTVGGTVGG

SEQ ID NO: 53158 - protein, 11 aa, Mycobacterium avium
GTLSTGDGREV

SEQ ID NO: 53159 - protein, 11 aa, Mycobacterium avium
GTMDTEDGPHL

SEQ ID NO: 53160 - protein, 11 aa, Mycobacterium avium
GTNGKSTTTRM

SEQ ID NO: 53161 - protein, 10 aa, Mycobacterium avium
GTPALATRGF

SEQ ID NO: 53162 - protein, 6 aa, Mycobacterium avium
GTPDRA

SEQ ID NO: 53163 - protein, 6 aa, Mycobacterium avium
GTPEQL

SEQ ID NO: 53164 - protein, 6 aa, Mycobacterium avium
GTPGFE

SEQ ID NO: 53165 - protein, 10 aa, Mycobacterium avium
GTPGPAEEQK

SEQ ID NO: 53166 - protein, 16 aa, Mycobacterium avium
GTPHTPIDSAPARPVR

SEQ ID NO: 53167 - protein, 7 aa, Mycobacterium avium
GTPPEAI

SEQ ID NO: 53168 - protein, 6 aa, Mycobacterium avium
GTPQQV

SEQ ID NO: 53169 - protein, 15 aa, Mycobacterium avium
GTQDAAGWASPLRSA

SEQ ID NO: 53170 - protein, 13 aa, Mycobacterium avium
GTQVDGTRQVGGA

SEQ ID NO: 53171 - protein, 5 aa, Mycobacterium avium
GTRDA

SEQ ID NO: 53172 - protein, 11 aa, Mycobacterium avium
GTREGTSVRGG

SEQ ID NO: 53173 - protein, 5 aa, Mycobacterium avium
GTRGW

SEQ ID NO: 53174 - protein, 19 aa, Mycobacterium avium
GTRIPTGATIDASAPDGTP

SEQ ID NO: 53175 - protein, 6 aa, Mycobacterium avium
GTRPYG

SEQ ID NO: 53176 - protein, 12 aa, Mycobacterium avium
GTSASESGTRDR

SEQ ID NO: 53177 - protein, 14 aa, Mycobacterium avium
GTSEAAARQLASRA

SEQ ID NO: 53178 - protein, 14 aa, Mycobacterium avium
GTSGVDSATGTTEQ

SEQ ID NO: 53179 - protein, 7 aa, Mycobacterium avium
GTSHDGF

SEQ ID NO: 53180 - protein, 10 aa, Mycobacterium avium
GTTCQQRSIE

SEQ ID NO: 53181 - protein, 12 aa, Mycobacterium avium
GTTGATGSAPVG

SEQ ID NO: 53182 - protein, 7 aa, Mycobacterium avium
GTTGRPK

SEQ ID NO: 53183 - protein, 5 aa, Mycobacterium avium
GTTLP

SEQ ID NO: 53184 - protein, 8 aa, Mycobacterium avium
GTTQVSER

SEQ ID NO: 53185 - protein, 11 aa, Mycobacterium avium
GTTTIAGSTAT

SEQ ID NO: 53186 - protein, 23 aa, Mycobacterium avium
GTTTTYPTPDQGKPIDGGGVPCV

SEQ ID NO: 53187 - protein, 11 aa, Mycobacterium avium
GTVAGRPDDGC

SEQ ID NO: 53188 - protein, 5 aa, Mycobacterium avium
GTVNV

SEQ ID NO: 53189 - protein, 5 aa, Mycobacterium avium
GTVSD

SEQ ID NO: 53190 - protein, 6 aa, Mycobacterium avium
GTWERN

SEQ ID NO: 53191 - protein, 9 aa, Mycobacterium avium
GTWRTDSTQ

SEQ ID NO: 53192 - protein, 5 aa, Mycobacterium avium
GTWTP

SEQ ID NO: 53193 - protein, 10 aa, Mycobacterium avium
GTYQRGGKTR

SEQ ID NO: 53194 - protein, 11 aa, Mycobacterium avium
GVAENAAGDQV

SEQ ID NO: 53195 - protein, 6 aa, Mycobacterium avium
GVAGGT

SEQ ID NO: 53196 - protein, 4 aa, Mycobacterium avium
GVAK

SEQ ID NO: 53197 - protein, 8 aa, Mycobacterium avium
GVAPPDTT

SEQ ID NO: 53198 - protein, 22 aa, Mycobacterium avium
GVDGGTGAGQPVLPGRQPFGAA

SEQ ID NO: 53199 - protein, 12 aa, Mycobacterium avium
GVDGLAEATENP

SEQ ID NO: 53200 - protein, 6 aa, Mycobacterium avium
GVDPAQ

SEQ ID NO: 53201 - protein, 5 aa, Mycobacterium avium
GVDPD

SEQ ID NO: 53202 - protein, 16 aa, Mycobacterium avium
GVDPPRVADPETQPTI

SEQ ID NO: 53203 - protein, 8 aa, Mycobacterium avium
GVDPQRPE

SEQ ID NO: 53204 - protein, 12 aa, Mycobacterium avium
GVDPRRLHNRAA

SEQ ID NO: 53205 - protein, 8 aa, Mycobacterium avium
GVDPTGPY

SEQ ID NO: 53206 - protein, 17 aa, Mycobacterium avium
GVDRKDYNSFGSRRGNH

SEQ ID NO: 53207 - protein, 18 aa, Mycobacterium avium
GVEAADTATALPAARPTP

SEQ ID NO: 53208 - protein, 4 aa, Mycobacterium avium
GVES

SEQ ID NO: 53209 - protein, 10 aa, Mycobacterium avium
GVGADGDIAG

SEQ ID NO: 53210 - protein, 5 aa, Mycobacterium avium
GVGED

SEQ ID NO: 53211 - protein, 13 aa, Mycobacterium avium
GVGETRSCGTGTV

SEQ ID NO: 53212 - protein, 8 aa, Mycobacterium avium
GVGGGSLN

SEQ ID NO: 53213 - protein, 12 aa, Mycobacterium avium
GVGGTDKTEERR

SEQ ID NO: 53214 - protein, 6 aa, Mycobacterium avium
GVGGTG

SEQ ID NO: 53215 - protein, 9 aa, Mycobacterium avium
GVGKTTTAA

SEQ ID NO: 53216 - protein, 4 aa, Mycobacterium avium
GVGP

SEQ ID NO: 53217 - protein, 6 aa, Mycobacterium avium
GVGPGS

SEQ ID NO: 53218 - protein, 6 aa, Mycobacterium avium
GVGPGT

SEQ ID NO: 53219 - protein, 8 aa, Mycobacterium avium
GVGPPAGV

SEQ ID NO: 53220 - protein, 8 aa, Mycobacterium avium
GVGRPAEL

SEQ ID NO: 53221 - protein, 15 aa, Mycobacterium avium
GVGSPKPLHETDDET

SEQ ID NO: 53222 - protein, 5 aa, Mycobacterium avium
GVPAS

SEQ ID NO: 53223 - protein, 7 aa, Mycobacterium avium
GVPGPDR

SEQ ID NO: 53224 - protein, 13 aa, Mycobacterium avium
GVPPPDTAHYQAD

SEQ ID NO: 53225 - protein, 15 aa, Mycobacterium avium
GVPPPDTVNYKADKG

SEQ ID NO: 53226 - protein, 9 aa, Mycobacterium avium
GVPTFRDDK

SEQ ID NO: 53227 - protein, 19 aa, Mycobacterium avium
GVQPAAVTSRRTGRADVTG

SEQ ID NO: 53228 - protein, 10 aa, Mycobacterium avium
GVQPDPRRTR

SEQ ID NO: 53229 - protein, 10 aa, Mycobacterium avium
GVQRDSSAAV

SEQ ID NO: 53230 - protein, 8 aa, Mycobacterium avium
GVRAKEQR

SEQ ID NO: 53231 - protein, 8 aa, Mycobacterium avium
GVRRGTGS

SEQ ID NO: 53232 - protein, 5 aa, Mycobacterium avium
GVRRQ

SEQ ID NO: 53233 - protein, 7 aa, Mycobacterium avium
GVSGLSP

SEQ ID NO: 53234 - protein, 16 aa, Mycobacterium avium
GVSKRTPARIDMKAGS

SEQ ID NO: 53235 - protein, 8 aa, Mycobacterium avium
GVSPRKPR

SEQ ID NO: 53236 - protein, 10 aa, Mycobacterium avium
GVSSGDPGRA

SEQ ID NO: 53237 - protein, 6 aa, Mycobacterium avium
GVSTGY

SEQ ID NO: 53238 - protein, 6 aa, Mycobacterium avium
GVTPAD

SEQ ID NO: 53239 - protein, 9 aa, Mycobacterium avium
GVTPQQAKD

SEQ ID NO: 53240 - protein, 4 aa, Mycobacterium avium
GVTV

SEQ ID NO: 53241 - protein, 8 aa, Mycobacterium avium
GWAPEQGQ

SEQ ID NO: 53242 - protein, 8 aa, Mycobacterium avium
GWGNQRDG

SEQ ID NO: 53243 - protein, 15 aa, Mycobacterium avium
GWKPGGDGVREKDGK

SEQ ID NO: 53244 - protein, 13 aa, Mycobacterium avium
GWRPPAKTGAASA

SEQ ID NO: 53245 - protein, 13 aa, Mycobacterium avium
GWSAAPGAGARDL

SEQ ID NO: 53246 - protein, 6 aa, Mycobacterium avium
GWSTDQ

SEQ ID NO: 53247 - protein, 7 aa, Mycobacterium avium
GWSTDSD

SEQ ID NO: 53248 - protein, 13 aa, Mycobacterium avium
GYEAPPAPLGPDS

SEQ ID NO: 53249 - protein, 15 aa, Mycobacterium avium
GYEGQIGQTAYAAAK

SEQ ID NO: 53250 - protein, 18 aa, Mycobacterium avium
GYEKSWADGRGASPADRH

SEQ ID NO: 53251 - protein, 5 aa, Mycobacterium avium
GYEPE

SEQ ID NO: 53252 - protein, 14 aa, Mycobacterium avium
GYGADKLASPVGRG

SEQ ID NO: 53253 - protein, 7 aa, Mycobacterium avium
GYGPSET

SEQ ID NO: 53254 - protein, 8 aa, Mycobacterium avium
GYGRAGKP

SEQ ID NO: 53255 - protein, 8 aa, Mycobacterium avium
GYGSARGG

SEQ ID NO: 53256 - protein, 4 aa, Mycobacterium avium
GYGT

SEQ ID NO: 53257 - protein, 10 aa, Mycobacterium avium
GYKQSGIGRE

SEQ ID NO: 53258 - protein, 7 aa, Mycobacterium avium
GYPAGQL

SEQ ID NO: 53259 - protein, 4 aa, Mycobacterium avium
GYPR

SEQ ID NO: 53260 - protein, 5 aa, Mycobacterium avium
GYPRR

SEQ ID NO: 53261 - protein, 7 aa, Mycobacterium avium
GYRAEED

SEQ ID NO: 53262 - protein, 7 aa, Mycobacterium avium
GYRSRYS

SEQ ID NO: 53263 - protein, 7 aa, Mycobacterium avium
GYRSTSV

SEQ ID NO: 53264 - protein, 11 aa, Mycobacterium avium
GYSQGQQDAWS

SEQ ID NO: 53265 - protein, 5 aa, Mycobacterium avium
GYSTE

SEQ ID NO: 53266 - protein, 11 aa, Mycobacterium avium
GYTDPESSEKK

SEQ ID NO: 53267 - protein, 10 aa, Mycobacterium avium
GYTGQLGSPD

SEQ ID NO: 53268 - protein, 6 aa, Mycobacterium avium
GYTKEH

SEQ ID NO: 53269 - protein, 12 aa, Mycobacterium avium
GYTRVPPDPLPD

SEQ ID NO: 53270 - protein, 5 aa, Mycobacterium avium
GYVPD

SEQ ID NO: 53271 - protein, 11 aa, Mycobacterium avium
HAAANGGAMTA

SEQ ID NO: 53272 - protein, 10 aa, Mycobacterium avium
HAAAQESARR

SEQ ID NO: 53273 - protein, 5 aa, Mycobacterium avium
HAAGH

SEQ ID NO: 53274 - protein, 9 aa, Mycobacterium avium
HAAPTTFGA

SEQ ID NO: 53275 - protein, 11 aa, Mycobacterium avium
HADPVAEAREM

SEQ ID NO: 53276 - protein, 14 aa, Mycobacterium avium
HAEPSIGRPTRHTR

SEQ ID NO: 53277 - protein, 6 aa, Mycobacterium avium
HAGAGS

SEQ ID NO: 53278 - protein, 10 aa, Mycobacterium avium
HAGGHDGPLG

SEQ ID NO: 53279 - protein, 7 aa, Mycobacterium avium
HAGQAGG

SEQ ID NO: 53280 - protein, 7 aa, Mycobacterium avium
HAGRDGL

SEQ ID NO: 53281 - protein, 19 aa, Mycobacterium avium
HAHDPSADGWAEPSDGLQG

SEQ ID NO: 53282 - protein, 10 aa, Mycobacterium avium
HAHTDGTEHT

SEQ ID NO: 53283 - protein, 9 aa, Mycobacterium avium
HAKTRRQFG

SEQ ID NO: 53284 - protein, 20 aa, Mycobacterium avium
HALSDDGHCRPYSAQASGTV

SEQ ID NO: 53285 - protein, 18 aa, Mycobacterium avium
HANGGSGSPAGASREEQI

SEQ ID NO: 53286 - protein, 4 aa, Mycobacterium avium
HAPD

SEQ ID NO: 53287 - protein, 5 aa, Mycobacterium avium
HAPKT

SEQ ID NO: 53288 - protein, 6 aa, Mycobacterium avium
HAPPDA

SEQ ID NO: 53289 - protein, 10 aa, Mycobacterium avium
HAQASADTGL

SEQ ID NO: 53290 - protein, 70 aa, Mycobacterium avium
HAQGATYAPPGGGYPEAPGSEYEYGQPADYGQQPEYAQPAEYGQPADYGQQAGGYGGYGQGGYGSTGTTV

SEQ ID NO: 53291 - protein, 23 aa, Mycobacterium avium
HAQSSAANVRATEDELMRLCGDG

SEQ ID NO: 53292 - protein, 7 aa, Mycobacterium avium
HARDPEV

SEQ ID NO: 53293 - protein, 6 aa, Mycobacterium avium
HARRGE

SEQ ID NO: 53294 - protein, 10 aa, Mycobacterium avium
HASAGDGPSL

SEQ ID NO: 53295 - protein, 17 aa, Mycobacterium avium
HASAGPAADIIAGLAAT

SEQ ID NO: 53296 - protein, 4 aa, Mycobacterium avium
HASG

SEQ ID NO: 53297 - protein, 24 aa, Mycobacterium avium
HASRQRAQRRLPDTPVATPPEVAA

SEQ ID NO: 53298 - protein, 12 aa, Mycobacterium avium
HATANPGAEPEG

SEQ ID NO: 53299 - protein, 7 aa, Mycobacterium avium
HATGSAA

SEQ ID NO: 53300 - protein, 17 aa, Mycobacterium avium
HATGTSVGDVAESKAIN

SEQ ID NO: 53301 - protein, 7 aa, Mycobacterium avium
HDDDSYS

SEQ ID NO: 53302 - protein, 10 aa, Mycobacterium avium
HDDRQGKLTP

SEQ ID NO: 53303 - protein, 9 aa, Mycobacterium avium
HDENEFDRP

SEQ ID NO: 53304 - protein, 10 aa, Mycobacterium avium
HDENKKAFAG

SEQ ID NO: 53305 - protein, 5 aa, Mycobacterium avium
HDESS

SEQ ID NO: 53306 - protein, 4 aa, Mycobacterium avium
HDGD

SEQ ID NO: 53307 - protein, 6 aa, Mycobacterium avium
HDGDAD

SEQ ID NO: 53308 - protein, 8 aa, Mycobacterium avium
HDGDDRDI

SEQ ID NO: 53309 - protein, 7 aa, Mycobacterium avium
HDGQRSE

SEQ ID NO: 53310 - protein, 6 aa, Mycobacterium avium
HDHTGR

SEQ ID NO: 53311 - protein, 8 aa, Mycobacterium avium
HDLEPAGT

SEQ ID NO: 53312 - protein, 5 aa, Mycobacterium avium
HDPAA

SEQ ID NO: 53313 - protein, 8 aa, Mycobacterium avium
HDPAAHES

SEQ ID NO: 53314 - protein, 10 aa, Mycobacterium avium
HDPERPPGQR

SEQ ID NO: 53315 - protein, 6 aa, Mycobacterium avium
HDPFES

SEQ ID NO: 53316 - protein, 10 aa, Mycobacterium avium
HDPKSKMAKG

SEQ ID NO: 53317 - protein, 7 aa, Mycobacterium avium
HDPTARR

SEQ ID NO: 53318 - protein, 5 aa, Mycobacterium avium
HDPYP

SEQ ID NO: 53319 - protein, 12 aa, Mycobacterium avium
HDRAYSDGDRDG

SEQ ID NO: 53320 - protein, 8 aa, Mycobacterium avium
HDSGLAGQ

SEQ ID NO: 53321 - protein, 13 aa, Mycobacterium avium
HDSPGDEPTKDDR

SEQ ID NO: 53322 - protein, 20 aa, Mycobacterium avium
HDTSPDHRAGHRLSRMPALS

SEQ ID NO: 53323 - protein, 8 aa, Mycobacterium avium
HEEAPEEV

SEQ ID NO: 53324 - protein, 6 aa, Mycobacterium avium
HEGGGD

SEQ ID NO: 53325 - protein, 4 aa, Mycobacterium avium
HEQE

SEQ ID NO: 53326 - protein, 8 aa, Mycobacterium avium
HERAGSRP

SEQ ID NO: 53327 - protein, 17 aa, Mycobacterium avium
HERDHHSPAGHRGQQTG

SEQ ID NO: 53328 - protein, 6 aa, Mycobacterium avium
HETSAG

SEQ ID NO: 53329 - protein, 6 aa, Mycobacterium avium
HETTAS

SEQ ID NO: 53330 - protein, 25 aa, Mycobacterium avium
HGAGGQRGSRDKAEEPATVRVVDDR

SEQ ID NO: 53331 - protein, 9 aa, Mycobacterium avium
HGAGPAHDA

SEQ ID NO: 53332 - protein, 13 aa, Mycobacterium avium
HGAPGGHGPDTRL

SEQ ID NO: 53333 - protein, 11 aa, Mycobacterium avium
HGAPNDPVTND

SEQ ID NO: 53334 - protein, 20 aa, Mycobacterium avium
HGARNDKHSRTSAQRTGRAL

SEQ ID NO: 53335 - protein, 6 aa, Mycobacterium avium
HGDAAR

SEQ ID NO: 53336 - protein, 13 aa, Mycobacterium avium
HGDDVEEALPSRP

SEQ ID NO: 53337 - protein, 7 aa, Mycobacterium avium
HGDPPPE

SEQ ID NO: 53338 - protein, 8 aa, Mycobacterium avium
HGDTGYPC

SEQ ID NO: 53339 - protein, 12 aa, Mycobacterium avium
HGESAKPRTDYS

SEQ ID NO: 53340 - protein, 9 aa, Mycobacterium avium
HGGDRPVEL

SEQ ID NO: 53341 - protein, 7 aa, Mycobacterium avium
HGGDSGK

SEQ ID NO: 53342 - protein, 18 aa, Mycobacterium avium
HGGELTAGAEVTKPPGGV

SEQ ID NO: 53343 - protein, 13 aa, Mycobacterium avium
HGGFGGAPKFPPS

SEQ ID NO: 53344 - protein, 6 aa, Mycobacterium avium
HGGPGQ

SEQ ID NO: 53345 - protein, 10 aa, Mycobacterium avium
HGGRQANGGL

SEQ ID NO: 53346 - protein, 10 aa, Mycobacterium avium
HGGTDPRDLR

SEQ ID NO: 53347 - protein, 6 aa, Mycobacterium avium
HGIGGA

SEQ ID NO: 53348 - protein, 10 aa, Mycobacterium avium
HGITDPQDHG

SEQ ID NO: 53349 - protein, 7 aa, Mycobacterium avium
HGLGGSL

SEQ ID NO: 53350 - protein, 9 aa, Mycobacterium avium
HGPANDRRY

SEQ ID NO: 53351 - protein, 6 aa, Mycobacterium avium
HGPGCT

SEQ ID NO: 53352 - protein, 5 aa, Mycobacterium avium
HGPIG

SEQ ID NO: 53353 - protein, 10 aa, Mycobacterium avium
HGPNPNDGHA

SEQ ID NO: 53354 - protein, 14 aa, Mycobacterium avium
HGPQIDKGARWDPA

SEQ ID NO: 53355 - protein, 16 aa, Mycobacterium avium
HGQADAGAPSAGRDHA

SEQ ID NO: 53356 - protein, 21 aa, Mycobacterium avium
HGRADSLVDGPGAHTIDTGDT

SEQ ID NO: 53357 - protein, 7 aa, Mycobacterium avium
HGRHEEL

SEQ ID NO: 53358 - protein, 5 aa, Mycobacterium avium
HGRRA

SEQ ID NO: 53359 - protein, 6 aa, Mycobacterium avium
HGRWPQ

SEQ ID NO: 53360 - protein, 5 aa, Mycobacterium avium
HGSGG

SEQ ID NO: 53361 - protein, 24 aa, Mycobacterium avium
HGSIAGADYDPVADRYQPGARDET

SEQ ID NO: 53362 - protein, 5 aa, Mycobacterium avium
HGSRR

SEQ ID NO: 53363 - protein, 8 aa, Mycobacterium avium
HGSVSTIG

SEQ ID NO: 53364 - protein, 6 aa, Mycobacterium avium
HHATGH

SEQ ID NO: 53365 - protein, 6 aa, Mycobacterium avium
HHDGTD

SEQ ID NO: 53366 - protein, 5 aa, Mycobacterium avium
HHDPA

SEQ ID NO: 53367 - protein, 10 aa, Mycobacterium avium
HHGDPGPNVD

SEQ ID NO: 53368 - protein, 4 aa, Mycobacterium avium
HHGV

SEQ ID NO: 53369 - protein, 9 aa, Mycobacterium avium
HHRTPGSAI

SEQ ID NO: 53370 - protein, 6 aa, Mycobacterium avium
HISETP

SEQ ID NO: 53371 - protein, 8 aa, Mycobacterium avium
HITPDEGR

SEQ ID NO: 53372 - protein, 15 aa, Mycobacterium avium
HKERRAVTGTSRGGS

SEQ ID NO: 53373 - protein, 7 aa, Mycobacterium avium
HKGRKAI

SEQ ID NO: 53374 - protein, 9 aa, Mycobacterium avium
HKNARGETQ

SEQ ID NO: 53375 - protein, 8 aa, Mycobacterium avium
HKRTGVPI

SEQ ID NO: 53376 - protein, 14 aa, Mycobacterium avium
HLDSTRRVSPLRAA

SEQ ID NO: 53377 - protein, 7 aa, Mycobacterium avium
HLRSGEE

SEQ ID NO: 53378 - protein, 9 aa, Mycobacterium avium
HMRPDSTVE

SEQ ID NO: 53379 - protein, 11 aa, Mycobacterium avium
HNDGPVDDPPL

SEQ ID NO: 53380 - protein, 10 aa, Mycobacterium avium
HNGDTDFSGS

SEQ ID NO: 53381 - protein, 5 aa, Mycobacterium avium
HNHPS

SEQ ID NO: 53382 - protein, 11 aa, Mycobacterium avium
HNITPQEQEKL

SEQ ID NO: 53383 - protein, 6 aa, Mycobacterium avium
HNPAAY

SEQ ID NO: 53384 - protein, 6 aa, Mycobacterium avium
HNPDRV

SEQ ID NO: 53385 - protein, 6 aa, Mycobacterium avium
HNPIHT

SEQ ID NO: 53386 - protein, 7 aa, Mycobacterium avium
HNPMPDN

SEQ ID NO: 53387 - protein, 6 aa, Mycobacterium avium
HNPPAL

SEQ ID NO: 53388 - protein, 9 aa, Mycobacterium avium
HNPTGTVEP

SEQ ID NO: 53389 - protein, 13 aa, Mycobacterium avium
HNQERRALGSEEL

SEQ ID NO: 53390 - protein, 9 aa, Mycobacterium avium
HNQNGGRRW

SEQ ID NO: 53391 - protein, 4 aa, Mycobacterium avium
HPAH

SEQ ID NO: 53392 - protein, 5 aa, Mycobacterium avium
HPARP

SEQ ID NO: 53393 - protein, 4 aa, Mycobacterium avium
HPDA

SEQ ID NO: 53394 - protein, 7 aa, Mycobacterium avium
HPDAQGS

SEQ ID NO: 53395 - protein, 13 aa, Mycobacterium avium
HPDDESSKGAATL

SEQ ID NO: 53396 - protein, 7 aa, Mycobacterium avium
HPDDRER

SEQ ID NO: 53397 - protein, 10 aa, Mycobacterium avium
HPDEPAEAAA

SEQ ID NO: 53398 - protein, 10 aa, Mycobacterium avium
HPDGPPQPQV

SEQ ID NO: 53399 - protein, 6 aa, Mycobacterium avium
HPDQRA

SEQ ID NO: 53400 - protein, 17 aa, Mycobacterium avium
HPDTSPPDSATESSERL

SEQ ID NO: 53401 - protein, 6 aa, Mycobacterium avium
HPDVTG

SEQ ID NO: 53402 - protein, 8 aa, Mycobacterium avium
HPEAEDFD

SEQ ID NO: 53403 - protein, 6 aa, Mycobacterium avium
HPEATV

SEQ ID NO: 53404 - protein, 14 aa, Mycobacterium avium
HPENEQVEQALSDT

SEQ ID NO: 53405 - protein, 11 aa, Mycobacterium avium
HPETGDPQRGL

SEQ ID NO: 53406 - protein, 7 aa, Mycobacterium avium
HPEVAEQ

SEQ ID NO: 53407 - protein, 5 aa, Mycobacterium avium
HPGDP

SEQ ID NO: 53408 - protein, 36 aa, Mycobacterium avium
HPGGAQATAPSSSLIAPPEQRSGRRRGHLRVLPDPS

SEQ ID NO: 53409 - protein, 8 aa, Mycobacterium avium
HPGLPELG

SEQ ID NO: 53410 - protein, 4 aa, Mycobacterium avium
HPGN

SEQ ID NO: 53411 - protein, 4 aa, Mycobacterium avium
HPGV

SEQ ID NO: 53412 - protein, 4 aa, Mycobacterium avium
HPGW

SEQ ID NO: 53413 - protein, 12 aa, Mycobacterium avium
HPHDDDGDEVRR

SEQ ID NO: 53414 - protein, 6 aa, Mycobacterium avium
HPHGDA

SEQ ID NO: 53415 - protein, 10 aa, Mycobacterium avium
HPHRDPETGE

SEQ ID NO: 53416 - protein, 7 aa, Mycobacterium avium
HPKEDPS

SEQ ID NO: 53417 - protein, 9 aa, Mycobacterium avium
HPMTEPTAE

SEQ ID NO: 53418 - protein, 4 aa, Mycobacterium avium
HPNV

SEQ ID NO: 53419 - protein, 8 aa, Mycobacterium avium
HPQAPAHA

SEQ ID NO: 53420 - protein, 12 aa, Mycobacterium avium
HPQARPADTTVA

SEQ ID NO: 53421 - protein, 6 aa, Mycobacterium avium
HPQEYN

SEQ ID NO: 53422 - protein, 9 aa, Mycobacterium avium
HPRGAPPVP

SEQ ID NO: 53423 - protein, 12 aa, Mycobacterium avium
HPSGTAKDVEDT

SEQ ID NO: 53424 - protein, 4 aa, Mycobacterium avium
HPTM

SEQ ID NO: 53425 - protein, 13 aa, Mycobacterium avium
HPTQQPHESHTRR

SEQ ID NO: 53426 - protein, 4 aa, Mycobacterium avium
HQAH

SEQ ID NO: 53427 - protein, 4 aa, Mycobacterium avium
HQDA

SEQ ID NO: 53428 - protein, 16 aa, Mycobacterium avium
HQDGDHPINDSAEVQR

SEQ ID NO: 53429 - protein, 19 aa, Mycobacterium avium
HQDPANAGSRQDGWTGRGP

SEQ ID NO: 53430 - protein, 11 aa, Mycobacterium avium
HQDSHGGGGLI

SEQ ID NO: 53431 - protein, 9 aa, Mycobacterium avium
HQGESSAAF

SEQ ID NO: 53432 - protein, 13 aa, Mycobacterium avium
HQNGDHPINDSAE

SEQ ID NO: 53433 - protein, 16 aa, Mycobacterium avium
HQPDPRLQGANPALST

SEQ ID NO: 53434 - protein, 5 aa, Mycobacterium avium
HQPPQ

SEQ ID NO: 53435 - protein, 7 aa, Mycobacterium avium
HQQGYAD

SEQ ID NO: 53436 - protein, 10 aa, Mycobacterium avium
HQRPDGSVRV

SEQ ID NO: 53437 - protein, 9 aa, Mycobacterium avium
HQSSPTSVQ

SEQ ID NO: 53438 - protein, 16 aa, Mycobacterium avium
HRFGDRGETALKGVPG

SEQ ID NO: 53439 - protein, 4 aa, Mycobacterium avium
HRGA

SEQ ID NO: 53440 - protein, 7 aa, Mycobacterium avium
HRGAGGR

SEQ ID NO: 53441 - protein, 8 aa, Mycobacterium avium
HRGREGGY

SEQ ID NO: 53442 - protein, 10 aa, Mycobacterium avium
HRGRTSGKQY

SEQ ID NO: 53443 - protein, 19 aa, Mycobacterium avium
HRKRGTGYSKQQSTRPQTL

SEQ ID NO: 53444 - protein, 9 aa, Mycobacterium avium
HRPATTPRS

SEQ ID NO: 53445 - protein, 21 aa, Mycobacterium avium
HRPEPSTPLPARQRASDDSLR

SEQ ID NO: 53446 - protein, 8 aa, Mycobacterium avium
HRPPYGAS

SEQ ID NO: 53447 - protein, 6 aa, Mycobacterium avium
HRQPRV

SEQ ID NO: 53448 - protein, 15 aa, Mycobacterium avium
HRRAAGASSPEAPLN

SEQ ID NO: 53449 - protein, 7 aa, Mycobacterium avium
HRSRLGN

SEQ ID NO: 53450 - protein, 12 aa, Mycobacterium avium
HRTGEAQTYCPP

SEQ ID NO: 53451 - protein, 7 aa, Mycobacterium avium
HRTTPSG

SEQ ID NO: 53452 - protein, 27 aa, Mycobacterium avium
HRVSEGDPLDGDPATRTQNEKSELDNG

SEQ ID NO: 53453 - protein, 4 aa, Mycobacterium avium
HSAS

SEQ ID NO: 53454 - protein, 10 aa, Mycobacterium avium
HSDPKRGEQL

SEQ ID NO: 53455 - protein, 6 aa, Mycobacterium avium
HSEESE

SEQ ID NO: 53456 - protein, 11 aa, Mycobacterium avium
HSETAIDAAGA

SEQ ID NO: 53457 - protein, 17 aa, Mycobacterium avium
HSETLTGVGTKAHHAAN

SEQ ID NO: 53458 - protein, 8 aa, Mycobacterium avium
HSFEQARD

SEQ ID NO: 53459 - protein, 8 aa, Mycobacterium avium
HSGDETGT

SEQ ID NO: 53460 - protein, 17 aa, Mycobacterium avium
HSGNRPTVTTEQVAAGA

SEQ ID NO: 53461 - protein, 15 aa, Mycobacterium avium
HSGQPVALPAGGTSF

SEQ ID NO: 53462 - protein, 11 aa, Mycobacterium avium
HSGQPVALPTG

SEQ ID NO: 53463 - protein, 14 aa, Mycobacterium avium
HSGTAPTDLANTNT

SEQ ID NO: 53464 - protein, 5 aa, Mycobacterium avium
HSLDE

SEQ ID NO: 53465 - protein, 22 aa, Mycobacterium avium
HSLPPTGGARGDRGKPPETARK

SEQ ID NO: 53466 - protein, 6 aa, Mycobacterium avium
HSPRLA

SEQ ID NO: 53467 - protein, 5 aa, Mycobacterium avium
HSQGE

SEQ ID NO: 53468 - protein, 8 aa, Mycobacterium avium
HSQSHYAA

SEQ ID NO: 53469 - protein, 12 aa, Mycobacterium avium
HSRAAARRAGRF

SEQ ID NO: 53470 - protein, 5 aa, Mycobacterium avium
HSRPP

SEQ ID NO: 53471 - protein, 13 aa, Mycobacterium avium
HSSQPHAAVSGDD

SEQ ID NO: 53472 - protein, 12 aa, Mycobacterium avium
HSTAPGAQQYSD

SEQ ID NO: 53473 - protein, 11 aa, Mycobacterium avium
HSTDPNDKAFG

SEQ ID NO: 53474 - protein, 8 aa, Mycobacterium avium
HSYGGRQT

SEQ ID NO: 53475 - protein, 4 aa, Mycobacterium avium
HTAA

SEQ ID NO: 53476 - protein, 6 aa, Mycobacterium avium
HTARAE

SEQ ID NO: 53477 - protein, 6 aa, Mycobacterium avium
HTDNSA

SEQ ID NO: 53478 - protein, 9 aa, Mycobacterium avium
HTDPGETLR

SEQ ID NO: 53479 - protein, 7 aa, Mycobacterium avium
HTDSPNL

SEQ ID NO: 53480 - protein, 11 aa, Mycobacterium avium
HTEGYDPPTTV

SEQ ID NO: 53481 - protein, 6 aa, Mycobacterium avium
HTEQPV

SEQ ID NO: 53482 - protein, 6 aa, Mycobacterium avium
HTEVPS

SEQ ID NO: 53483 - protein, 7 aa, Mycobacterium avium
HTGAADA

SEQ ID NO: 53484 - protein, 7 aa, Mycobacterium avium
HTGDGYR

SEQ ID NO: 53485 - protein, 8 aa, Mycobacterium avium
HTGGSGSA

SEQ ID NO: 53486 - protein, 7 aa, Mycobacterium avium
HTGRRPV

SEQ ID NO: 53487 - protein, 9 aa, Mycobacterium avium
HTPFSTAEA

SEQ ID NO: 53488 - protein, 8 aa, Mycobacterium avium
HTSRTGAA

SEQ ID NO: 53489 - protein, 9 aa, Mycobacterium avium
HTTPPPPDL

SEQ ID NO: 53490 - protein, 11 aa, Mycobacterium avium
HTTSPTTPTAA

SEQ ID NO: 53491 - protein, 12 aa, Mycobacterium avium
HVARQARDANFG

SEQ ID NO: 53492 - protein, 9 aa, Mycobacterium avium
HVDGDDDQA

SEQ ID NO: 53493 - protein, 9 aa, Mycobacterium avium
HVERGRPLG

SEQ ID NO: 53494 - protein, 11 aa, Mycobacterium avium
HVPPADPARGC

SEQ ID NO: 53495 - protein, 17 aa, Mycobacterium avium
HWEPGSDAIATRKASGA

SEQ ID NO: 53496 - protein, 37 aa, Mycobacterium avium
HWEPKAKKGPSDQRARSGGPRASGASAEGVDANASKK

SEQ ID NO: 53497 - protein, 8 aa, Mycobacterium avium
HWPSQPGR

SEQ ID NO: 53498 - protein, 7 aa, Mycobacterium avium
IADAEAA

SEQ ID NO: 53499 - protein, 20 aa, Mycobacterium avium
IADPGASGPTAGLSTKYGRD

SEQ ID NO: 53500 - protein, 7 aa, Mycobacterium avium
IADYDPD

SEQ ID NO: 53501 - protein, 6 aa, Mycobacterium avium
IAGEGA

SEQ ID NO: 53502 - protein, 7 aa, Mycobacterium avium
IAGGGTA

SEQ ID NO: 53503 - protein, 7 aa, Mycobacterium avium
IAGGSSE

SEQ ID NO: 53504 - protein, 6 aa, Mycobacterium avium
IAGPLT

SEQ ID NO: 53505 - protein, 6 aa, Mycobacterium avium
IAGSSV

SEQ ID NO: 53506 - protein, 9 aa, Mycobacterium avium
IAKTGNGFE

SEQ ID NO: 53507 - protein, 7 aa, Mycobacterium avium
IANGYAG

SEQ ID NO: 53508 - protein, 11 aa, Mycobacterium avium
IANTGDRGGDF

SEQ ID NO: 53509 - protein, 9 aa, Mycobacterium avium
IAPESACTS

SEQ ID NO: 53510 - protein, 10 aa, Mycobacterium avium
IAPKPVQRPH

SEQ ID NO: 53511 - protein, 9 aa, Mycobacterium avium
IAPNQDAQA

SEQ ID NO: 53512 - protein, 18 aa, Mycobacterium avium
IAPPATPPVPPAPVTGAE

SEQ ID NO: 53513 - protein, 41 aa, Mycobacterium avium
IAPPKPPAAAGVPSHPAGPHRPAAAGQRRRRSGRSARTTAA

SEQ ID NO: 53514 - protein, 7 aa, Mycobacterium avium
IAPTPDE

SEQ ID NO: 53515 - protein, 11 aa, Mycobacterium avium
IAPTRPHAGVE

SEQ ID NO: 53516 - protein, 8 aa, Mycobacterium avium
IAQPDTAE

SEQ ID NO: 53517 - protein, 10 aa, Mycobacterium avium
IAQSRAAGDG

SEQ ID NO: 53518 - protein, 14 aa, Mycobacterium avium
IARGSADGRPRNKF

SEQ ID NO: 53519 - protein, 6 aa, Mycobacterium avium
IARPDQ

SEQ ID NO: 53520 - protein, 6 aa, Mycobacterium avium
IARSGG

SEQ ID NO: 53521 - protein, 17 aa, Mycobacterium avium
IASEQATLSNAWQGDTG

SEQ ID NO: 53522 - protein, 4 aa, Mycobacterium avium
IASY

SEQ ID NO: 53523 - protein, 8 aa, Mycobacterium avium
IATEAEQA

SEQ ID NO: 53524 - protein, 5 aa, Mycobacterium avium
IATRT

SEQ ID NO: 53525 - protein, 7 aa, Mycobacterium avium
IDAERAA

SEQ ID NO: 53526 - protein, 8 aa, Mycobacterium avium
IDAPHSQA

SEQ ID NO: 53527 - protein, 6 aa, Mycobacterium avium
IDARSY

SEQ ID NO: 53528 - protein, 23 aa, Mycobacterium avium
IDDAADGYANPADGSEGERRAEG

SEQ ID NO: 53529 - protein, 9 aa, Mycobacterium avium
IDDDAAAAV

SEQ ID NO: 53530 - protein, 7 aa, Mycobacterium avium
IDDEGLG

SEQ ID NO: 53531 - protein, 9 aa, Mycobacterium avium
IDDGADPPK

SEQ ID NO: 53532 - protein, 9 aa, Mycobacterium avium
IDDKTPECL

SEQ ID NO: 53533 - protein, 4 aa, Mycobacterium avium
IDDN

SEQ ID NO: 53534 - protein, 10 aa, Mycobacterium avium
IDDPSASPLA

SEQ ID NO: 53535 - protein, 6 aa, Mycobacterium avium
IDEAGG

SEQ ID NO: 53536 - protein, 12 aa, Mycobacterium avium
IDEPDGTRRPLS

SEQ ID NO: 53537 - protein, 6 aa, Mycobacterium avium
IDEPDY

SEQ ID NO: 53538 - protein, 6 aa, Mycobacterium avium
IDGGRE

SEQ ID NO: 53539 - protein, 5 aa, Mycobacterium avium
IDGKP

SEQ ID NO: 53540 - protein, 7 aa, Mycobacterium avium
IDGNVSP

SEQ ID NO: 53541 - protein, 24 aa, Mycobacterium avium
IDNAEKRRSELKATAKQSERDRLD

SEQ ID NO: 53542 - protein, 8 aa, Mycobacterium avium
IDNDTGSV

SEQ ID NO: 53543 - protein, 13 aa, Mycobacterium avium
IDPADADAVGRAA

SEQ ID NO: 53544 - protein, 8 aa, Mycobacterium avium
IDPDTGKA

SEQ ID NO: 53545 - protein, 8 aa, Mycobacterium avium
IDPEETSE

SEQ ID NO: 53546 - protein, 8 aa, Mycobacterium avium
IDPGPTVK

SEQ ID NO: 53547 - protein, 6 aa, Mycobacterium avium
IDPRNG

SEQ ID NO: 53548 - protein, 16 aa, Mycobacterium avium
IDQAEEDLAERSTPTT

SEQ ID NO: 53549 - protein, 10 aa, Mycobacterium avium
IDRAEADNAG

SEQ ID NO: 53550 - protein, 4 aa, Mycobacterium avium
IDSA

SEQ ID NO: 53551 - protein, 5 aa, Mycobacterium avium
IDSGP

SEQ ID NO: 53552 - protein, 15 aa, Mycobacterium avium
IDTQGRNSETRSDID

SEQ ID NO: 53553 - protein, 10 aa, Mycobacterium avium
IDTSAYPPMG

SEQ ID NO: 53554 - protein, 15 aa, Mycobacterium avium
IEAAPSSALPPPGAD

SEQ ID NO: 53555 - protein, 8 aa, Mycobacterium avium
IEADSDRD

SEQ ID NO: 53556 - protein, 15 aa, Mycobacterium avium
IEAQKGWAATNPQRR

SEQ ID NO: 53557 - protein, 19 aa, Mycobacterium avium
IEARTDPWDPATEPSAEDF

SEQ ID NO: 53558 - protein, 9 aa, Mycobacterium avium
IEDSDSDSL

SEQ ID NO: 53559 - protein, 7 aa, Mycobacterium avium
IEEESNR

SEQ ID NO: 53560 - protein, 13 aa, Mycobacterium avium
IEGSRAAEPRPEQ

SEQ ID NO: 53561 - protein, 8 aa, Mycobacterium avium
IEHETGRR

SEQ ID NO: 53562 - protein, 9 aa, Mycobacterium avium
IENTEPPAW

SEQ ID NO: 53563 - protein, 7 aa, Mycobacterium avium
IEPATSQ

SEQ ID NO: 53564 - protein, 6 aa, Mycobacterium avium
IEQTRA

SEQ ID NO: 53565 - protein, 4 aa, Mycobacterium avium
IERN

SEQ ID NO: 53566 - protein, 9 aa, Mycobacterium avium
IESTNKRYG

SEQ ID NO: 53567 - protein, 6 aa, Mycobacterium avium
IETETG

SEQ ID NO: 53568 - protein, 20 aa, Mycobacterium avium
IGAAGAAGAPAGAARNGHAV

SEQ ID NO: 53569 - protein, 10 aa, Mycobacterium avium
IGAEDHSEID

SEQ ID NO: 53570 - protein, 6 aa, Mycobacterium avium
IGAERD

SEQ ID NO: 53571 - protein, 8 aa, Mycobacterium avium
IGAGGPLP

SEQ ID NO: 53572 - protein, 8 aa, Mycobacterium avium
IGAPGAAR

SEQ ID NO: 53573 - protein, 11 aa, Mycobacterium avium
IGAREDAGLPD

SEQ ID NO: 53574 - protein, 5 aa, Mycobacterium avium
IGDGT

SEQ ID NO: 53575 - protein, 11 aa, Mycobacterium avium
IGDNTRPDAIR

SEQ ID NO: 53576 - protein, 14 aa, Mycobacterium avium
IGDNYRDAAAETGQ

SEQ ID NO: 53577 - protein, 8 aa, Mycobacterium avium
IGDTERQC

SEQ ID NO: 53578 - protein, 11 aa, Mycobacterium avium
IGEGPGRMPAH

SEQ ID NO: 53579 - protein, 23 aa, Mycobacterium avium
IGELGEPATATRGGSSSMPHKRN

SEQ ID NO: 53580 - protein, 9 aa, Mycobacterium avium
IGGGTSEIQ

SEQ ID NO: 53581 - protein, 6 aa, Mycobacterium avium
IGGPTA

SEQ ID NO: 53582 - protein, 8 aa, Mycobacterium avium
IGGSEDIG

SEQ ID NO: 53583 - protein, 9 aa, Mycobacterium avium
IGHPAASAL

SEQ ID NO: 53584 - protein, 7 aa, Mycobacterium avium
IGKPERL

SEQ ID NO: 53585 - protein, 11 aa, Mycobacterium avium
IGLTPSAKEVT

SEQ ID NO: 53586 - protein, 10 aa, Mycobacterium avium
IGNPDKSRNT

SEQ ID NO: 53587 - protein, 6 aa, Mycobacterium avium
IGNPTE

SEQ ID NO: 53588 - protein, 4 aa, Mycobacterium avium
IGPG

SEQ ID NO: 53589 - protein, 7 aa, Mycobacterium avium
IGPGYGA

SEQ ID NO: 53590 - protein, 6 aa, Mycobacterium avium
IGPPNH

SEQ ID NO: 53591 - protein, 14 aa, Mycobacterium avium
IGPSGASPAAGSTA

SEQ ID NO: 53592 - protein, 5 aa, Mycobacterium avium
IGRGQ

SEQ ID NO: 53593 - protein, 10 aa, Mycobacterium avium
IGSETGRIHG

SEQ ID NO: 53594 - protein, 7 aa, Mycobacterium avium
IHPTPDT

SEQ ID NO: 53595 - protein, 7 aa, Mycobacterium avium
IHQSKQS

SEQ ID NO: 53596 - protein, 11 aa, Mycobacterium avium
IKAQRDSDRNA

SEQ ID NO: 53597 - protein, 8 aa, Mycobacterium avium
IKDDSAAD

SEQ ID NO: 53598 - protein, 7 aa, Mycobacterium avium
IKPGTQL

SEQ ID NO: 53599 - protein, 7 aa, Mycobacterium avium
IKRPGTD

SEQ ID NO: 53600 - protein, 8 aa, Mycobacterium avium
IKTPDEIT

SEQ ID NO: 53601 - protein, 10 aa, Mycobacterium avium
IKTTARDEGD

SEQ ID NO: 53602 - protein, 9 aa, Mycobacterium avium
INGAPPPRV

SEQ ID NO: 53603 - protein, 4 aa, Mycobacterium avium
INNT

SEQ ID NO: 53604 - protein, 9 aa, Mycobacterium avium
INTAATSAS

SEQ ID NO: 53605 - protein, 10 aa, Mycobacterium avium
INTGNGYAGG

SEQ ID NO: 53606 - protein, 9 aa, Mycobacterium avium
IPDNTQAAR

SEQ ID NO: 53607 - protein, 9 aa, Mycobacterium avium
IPDYTGIDP

SEQ ID NO: 53608 - protein, 11 aa, Mycobacterium avium
IPGAENLPSGD

SEQ ID NO: 53609 - protein, 11 aa, Mycobacterium avium
IPGGGPATSAF

SEQ ID NO: 53610 - protein, 10 aa, Mycobacterium avium
IPGKAEPEDY

SEQ ID NO: 53611 - protein, 10 aa, Mycobacterium avium
IPGPPIPGEV

SEQ ID NO: 53612 - protein, 4 aa, Mycobacterium avium
IPHD

SEQ ID NO: 53613 - protein, 8 aa, Mycobacterium avium
IPLESPTA

SEQ ID NO: 53614 - protein, 5 aa, Mycobacterium avium
IPNAA

SEQ ID NO: 53615 - protein, 10 aa, Mycobacterium avium
IPPADTGPEQ

SEQ ID NO: 53616 - protein, 6 aa, Mycobacterium avium
IPPATE

SEQ ID NO: 53617 - protein, 12 aa, Mycobacterium avium
IPPATGLDPANY

SEQ ID NO: 53618 - protein, 5 aa, Mycobacterium avium
IPPGD

SEQ ID NO: 53619 - protein, 6 aa, Mycobacterium avium
IPPGLY

SEQ ID NO: 53620 - protein, 9 aa, Mycobacterium avium
IPPGTQPGS

SEQ ID NO: 53621 - protein, 5 aa, Mycobacterium avium
IPPNG

SEQ ID NO: 53622 - protein, 8 aa, Mycobacterium avium
IPPPGRGR

SEQ ID NO: 53623 - protein, 23 aa, Mycobacterium avium
IPSAHRRRGGKNAQNLRDARRRA

SEQ ID NO: 53624 - protein, 11 aa, Mycobacterium avium
IPSESRDEARL

SEQ ID NO: 53625 - protein, 8 aa, Mycobacterium avium
IPTAQPLT

SEQ ID NO: 53626 - protein, 12 aa, Mycobacterium avium
IPTDGGTTAAGG

SEQ ID NO: 53627 - protein, 4 aa, Mycobacterium avium
IPTG

SEQ ID NO: 53628 - protein, 6 aa, Mycobacterium avium
IPTRAP

SEQ ID NO: 53629 - protein, 7 aa, Mycobacterium avium
IQPSGVE

SEQ ID NO: 53630 - protein, 7 aa, Mycobacterium avium
IQSASTG

SEQ ID NO: 53631 - protein, 14 aa, Mycobacterium avium
IRETTRRRKERQRL

SEQ ID NO: 53632 - protein, 4 aa, Mycobacterium avium
IREV

SEQ ID NO: 53633 - protein, 7 aa, Mycobacterium avium
IRKRGSV

SEQ ID NO: 53634 - protein, 5 aa, Mycobacterium avium
IRNTS

SEQ ID NO: 53635 - protein, 7 aa, Mycobacterium avium
IRPAPDT

SEQ ID NO: 53636 - protein, 4 aa, Mycobacterium avium
IRPP

SEQ ID NO: 53637 - protein, 27 aa, Mycobacterium avium
IRQPGGPRVPSGPPANQAGRTQRTRRT

SEQ ID NO: 53638 - protein, 9 aa, Mycobacterium avium
IRSGDRAAL

SEQ ID NO: 53639 - protein, 5 aa, Mycobacterium avium
IRTGT

SEQ ID NO: 53640 - protein, 11 aa, Mycobacterium avium
ISADPAADHSV

SEQ ID NO: 53641 - protein, 15 aa, Mycobacterium avium
ISAETEAAASAASPA

SEQ ID NO: 53642 - protein, 7 aa, Mycobacterium avium
ISAGEAG

SEQ ID NO: 53643 - protein, 11 aa, Mycobacterium avium
ISAKDPDSVQW

SEQ ID NO: 53644 - protein, 7 aa, Mycobacterium avium
ISAKESH

SEQ ID NO: 53645 - protein, 9 aa, Mycobacterium avium
ISDDGRRTE

SEQ ID NO: 53646 - protein, 9 aa, Mycobacterium avium
ISDPQHPAR

SEQ ID NO: 53647 - protein, 5 aa, Mycobacterium avium
ISDQT

SEQ ID NO: 53648 - protein, 11 aa, Mycobacterium avium
ISGESADVARA

SEQ ID NO: 53649 - protein, 4 aa, Mycobacterium avium
ISGP

SEQ ID NO: 53650 - protein, 5 aa, Mycobacterium avium
ISGPF

SEQ ID NO: 53651 - protein, 5 aa, Mycobacterium avium
ISGPY

SEQ ID NO: 53652 - protein, 4 aa, Mycobacterium avium
ISLG

SEQ ID NO: 53653 - protein, 19 aa, Mycobacterium avium
ISSNSYGDTEAVNASQTAM

SEQ ID NO: 53654 - protein, 13 aa, Mycobacterium avium
ISSPSDPTANPIL

SEQ ID NO: 53655 - protein, 9 aa, Mycobacterium avium
ISTEPVAGA

SEQ ID NO: 53656 - protein, 6 aa, Mycobacterium avium
ITAAGE

SEQ ID NO: 53657 - protein, 12 aa, Mycobacterium avium
ITAGRGANRSTR

SEQ ID NO: 53658 - protein, 12 aa, Mycobacterium avium
ITAPDAARRRVT

SEQ ID NO: 53659 - protein, 7 aa, Mycobacterium avium
ITDPTEA

SEQ ID NO: 53660 - protein, 13 aa, Mycobacterium avium
ITEASGGSDPARA

SEQ ID NO: 53661 - protein, 5 aa, Mycobacterium avium
ITEIE

SEQ ID NO: 53662 - protein, 9 aa, Mycobacterium avium
ITGEDEDDY

SEQ ID NO: 53663 - protein, 10 aa, Mycobacterium avium
ITGGDSGIGR

SEQ ID NO: 53664 - protein, 11 aa, Mycobacterium avium
ITGGPDAPVVT

SEQ ID NO: 53665 - protein, 14 aa, Mycobacterium avium
ITGQATKVAGPGWT

SEQ ID NO: 53666 - protein, 5 aa, Mycobacterium avium
ITGRR

SEQ ID NO: 53667 - protein, 10 aa, Mycobacterium avium
ITGTAPSERQ

SEQ ID NO: 53668 - protein, 6 aa, Mycobacterium avium
ITKNNP

SEQ ID NO: 53669 - protein, 4 aa, Mycobacterium avium
ITLP

SEQ ID NO: 53670 - protein, 8 aa, Mycobacterium avium
ITPAGSAR

SEQ ID NO: 53671 - protein, 9 aa, Mycobacterium avium
ITPGAGEKR

SEQ ID NO: 53672 - protein, 6 aa, Mycobacterium avium
ITPTEG

SEQ ID NO: 53673 - protein, 8 aa, Mycobacterium avium
ITRPPGPL

SEQ ID NO: 53674 - protein, 5 aa, Mycobacterium avium
ITSAP

SEQ ID NO: 53675 - protein, 4 aa, Mycobacterium avium
ITSD

SEQ ID NO: 53676 - protein, 9 aa, Mycobacterium avium
ITSPPGSAR

SEQ ID NO: 53677 - protein, 14 aa, Mycobacterium avium
ITSRDNASDESRRQ

SEQ ID NO: 53678 - protein, 8 aa, Mycobacterium avium
ITSSGDAV

SEQ ID NO: 53679 - protein, 10 aa, Mycobacterium avium
ITSVAGRKGY

SEQ ID NO: 53680 - protein, 10 aa, Mycobacterium avium
ITTGPLGQGL

SEQ ID NO: 53681 - protein, 4 aa, Mycobacterium avium
IYGD

SEQ ID NO: 53682 - protein, 7 aa, Mycobacterium avium
IYGGTRS

SEQ ID NO: 53683 - protein, 10 aa, Mycobacterium avium
IYSGPGSAPL

SEQ ID NO: 53684 - protein, 8 aa, Mycobacterium avium
KAAGATPL

SEQ ID NO: 53685 - protein, 7 aa, Mycobacterium avium
KAAGSGA

SEQ ID NO: 53686 - protein, 10 aa, Mycobacterium avium
KAAPGPRGAA

SEQ ID NO: 53687 - protein, 31 aa, Mycobacterium avium
KAATAASKDADAKGPKHTPPNPKVRGRRKTR

SEQ ID NO: 53688 - protein, 5 aa, Mycobacterium avium
KAAVN

SEQ ID NO: 53689 - protein, 9 aa, Mycobacterium avium
KAEDRQRRE

SEQ ID NO: 53690 - protein, 8 aa, Mycobacterium avium
KAERPGRK

SEQ ID NO: 53691 - protein, 6 aa, Mycobacterium avium
KAFAAG

SEQ ID NO: 53692 - protein, 5 aa, Mycobacterium avium
KAGAA

SEQ ID NO: 53693 - protein, 6 aa, Mycobacterium avium
KAGCST

SEQ ID NO: 53694 - protein, 7 aa, Mycobacterium avium
KAGEGVV

SEQ ID NO: 53695 - protein, 7 aa, Mycobacterium avium
KAGKAVD

SEQ ID NO: 53696 - protein, 11 aa, Mycobacterium avium
KAGKKKSARAA

SEQ ID NO: 53697 - protein, 5 aa, Mycobacterium avium
KAGRH

SEQ ID NO: 53698 - protein, 6 aa, Mycobacterium avium
KAGYLT

SEQ ID NO: 53699 - protein, 7 aa, Mycobacterium avium
KAIEEAV

SEQ ID NO: 53700 - protein, 10 aa, Mycobacterium avium
KAKAESPYGA

SEQ ID NO: 53701 - protein, 8 aa, Mycobacterium avium
KAKEVPAA

SEQ ID NO: 53702 - protein, 28 aa, Mycobacterium avium
KAKKSSVPNENIERARKRGAGEEAGGAD

SEQ ID NO: 53703 - protein, 9 aa, Mycobacterium avium
KAKPGRSLE

SEQ ID NO: 53704 - protein, 10 aa, Mycobacterium avium
KALDTAESMG

SEQ ID NO: 53705 - protein, 5 aa, Mycobacterium avium
KALGE

SEQ ID NO: 53706 - protein, 6 aa, Mycobacterium avium
KANVPA

SEQ ID NO: 53707 - protein, 5 aa, Mycobacterium avium
KAPAY

SEQ ID NO: 53708 - protein, 9 aa, Mycobacterium avium
KAPDGTQVA

SEQ ID NO: 53709 - protein, 14 aa, Mycobacterium avium
KAPGAPYQAGRRGA

SEQ ID NO: 53710 - protein, 34 aa, Mycobacterium avium
KAPQVTNPSGQAAQSAAVSTATANSTSTNTTKAL

SEQ ID NO: 53711 - protein, 10 aa, Mycobacterium avium
KAPTVVPGPT

SEQ ID NO: 53712 - protein, 6 aa, Mycobacterium avium
KAQRGP

SEQ ID NO: 53713 - protein, 8 aa, Mycobacterium avium
KARDAFAA

SEQ ID NO: 53714 - protein, 7 aa, Mycobacterium avium
KARDRAR

SEQ ID NO: 53715 - protein, 8 aa, Mycobacterium avium
KARQSGAA

SEQ ID NO: 53716 - protein, 7 aa, Mycobacterium avium
KASAGEC

SEQ ID NO: 53717 - protein, 9 aa, Mycobacterium avium
KASARPALE

SEQ ID NO: 53718 - protein, 4 aa, Mycobacterium avium
KATG

SEQ ID NO: 53719 - protein, 9 aa, Mycobacterium avium
KATGGRSSF

SEQ ID NO: 53720 - protein, 7 aa, Mycobacterium avium
KATREDI

SEQ ID NO: 53721 - protein, 9 aa, Mycobacterium avium
KATVEGRPK

SEQ ID NO: 53722 - protein, 17 aa, Mycobacterium avium
KCEPSSVAPTGGAPGDF

SEQ ID NO: 53723 - protein, 8 aa, Mycobacterium avium
KDAKETDD

SEQ ID NO: 53724 - protein, 5 aa, Mycobacterium avium
KDAPI

SEQ ID NO: 53725 - protein, 9 aa, Mycobacterium avium
KDCEKAGDW

SEQ ID NO: 53726 - protein, 8 aa, Mycobacterium avium
KDEGATII

SEQ ID NO: 53727 - protein, 11 aa, Mycobacterium avium
KDEVSDQLPPL

SEQ ID NO: 53728 - protein, 12 aa, Mycobacterium avium
KDHDEKRLTSCG

SEQ ID NO: 53729 - protein, 11 aa, Mycobacterium avium
KDHGVYQDTAR

SEQ ID NO: 53730 - protein, 6 aa, Mycobacterium avium
KDKDMT

SEQ ID NO: 53731 - protein, 15 aa, Mycobacterium avium
KDKHEELAAHDQSDH

SEQ ID NO: 53732 - protein, 15 aa, Mycobacterium avium
KDLPAVAEPPADEDS

SEQ ID NO: 53733 - protein, 7 aa, Mycobacterium avium
KDPAARE

SEQ ID NO: 53734 - protein, 5 aa, Mycobacterium avium
KDPAR

SEQ ID NO: 53735 - protein, 7 aa, Mycobacterium avium
KDPQRAA

SEQ ID NO: 53736 - protein, 12 aa, Mycobacterium avium
KDPVGHKGARLT

SEQ ID NO: 53737 - protein, 23 aa, Mycobacterium avium
KDRSTKKEVKQVKPTHSDVGAEV

SEQ ID NO: 53738 - protein, 4 aa, Mycobacterium avium
KDSP

SEQ ID NO: 53739 - protein, 8 aa, Mycobacterium avium
KDTEPLDT

SEQ ID NO: 53740 - protein, 5 aa, Mycobacterium avium
KEAGL

SEQ ID NO: 53741 - protein, 4 aa, Mycobacterium avium
KEAI

SEQ ID NO: 53742 - protein, 13 aa, Mycobacterium avium
KEATDAALALATG

SEQ ID NO: 53743 - protein, 5 aa, Mycobacterium avium
KEGAK

SEQ ID NO: 53744 - protein, 10 aa, Mycobacterium avium
KEGAVPPVKA

SEQ ID NO: 53745 - protein, 8 aa, Mycobacterium avium
KEHRDAVP

SEQ ID NO: 53746 - protein, 5 aa, Mycobacterium avium
KEKRF

SEQ ID NO: 53747 - protein, 11 aa, Mycobacterium avium
KELASGDSVYT

SEQ ID NO: 53748 - protein, 10 aa, Mycobacterium avium
KEPKQAHPNI

SEQ ID NO: 53749 - protein, 6 aa, Mycobacterium avium
KEQLRT

SEQ ID NO: 53750 - protein, 11 aa, Mycobacterium avium
KERELPEPDDE

SEQ ID NO: 53751 - protein, 9 aa, Mycobacterium avium
KEVNDGGHR

SEQ ID NO: 53752 - protein, 7 aa, Mycobacterium avium
KGAGARD

SEQ ID NO: 53753 - protein, 10 aa, Mycobacterium avium
KGAHGSRSSV

SEQ ID NO: 53754 - protein, 13 aa, Mycobacterium avium
KGAPAPHDNETAA

SEQ ID NO: 53755 - protein, 7 aa, Mycobacterium avium
KGAPRSR

SEQ ID NO: 53756 - protein, 9 aa, Mycobacterium avium
KGAQAHDEA

SEQ ID NO: 53757 - protein, 5 aa, Mycobacterium avium
KGDDG

SEQ ID NO: 53758 - protein, 14 aa, Mycobacterium avium
KGDKSKVLPADAQL

SEQ ID NO: 53759 - protein, 11 aa, Mycobacterium avium
KGEKGEPRWPD

SEQ ID NO: 53760 - protein, 7 aa, Mycobacterium avium
KGFGASA

SEQ ID NO: 53761 - protein, 5 aa, Mycobacterium avium
KGGAP

SEQ ID NO: 53762 - protein, 9 aa, Mycobacterium avium
KGGAPEAPG

SEQ ID NO: 53763 - protein, 7 aa, Mycobacterium avium
KGGDYLA

SEQ ID NO: 53764 - protein, 14 aa, Mycobacterium avium
KGGGSVKCCTLEVF

SEQ ID NO: 53765 - protein, 6 aa, Mycobacterium avium
KGKTGL

SEQ ID NO: 53766 - protein, 24 aa, Mycobacterium avium
KGLPPNPDATSTSLPGARGADVDG

SEQ ID NO: 53767 - protein, 16 aa, Mycobacterium avium
KGNKQRSVPFGAPAGE

SEQ ID NO: 53768 - protein, 8 aa, Mycobacterium avium
KGQPRDEM

SEQ ID NO: 53769 - protein, 9 aa, Mycobacterium avium
KGQVGPGGV

SEQ ID NO: 53770 - protein, 13 aa, Mycobacterium avium
KGRYPDRKTARRV

SEQ ID NO: 53771 - protein, 4 aa, Mycobacterium avium
KGSA

SEQ ID NO: 53772 - protein, 5 aa, Mycobacterium avium
KGTRL

SEQ ID NO: 53773 - protein, 15 aa, Mycobacterium avium
KGTRPDGARYDADDP

SEQ ID NO: 53774 - protein, 6 aa, Mycobacterium avium
KGVTVE

SEQ ID NO: 53775 - protein, 6 aa, Mycobacterium avium
KHESTT

SEQ ID NO: 53776 - protein, 16 aa, Mycobacterium avium
KHPRGAFGADPSVSGL

SEQ ID NO: 53777 - protein, 8 aa, Mycobacterium avium
KHPRSPLE

SEQ ID NO: 53778 - protein, 11 aa, Mycobacterium avium
KHTEARREIDR

SEQ ID NO: 53779 - protein, 8 aa, Mycobacterium avium
KHTKNDHL

SEQ ID NO: 53780 - protein, 16 aa, Mycobacterium avium
KHVQEGDAETAPLSNP

SEQ ID NO: 53781 - protein, 14 aa, Mycobacterium avium
KIAEDVREGMEKTQ

SEQ ID NO: 53782 - protein, 5 aa, Mycobacterium avium
KIDGD

SEQ ID NO: 53783 - protein, 14 aa, Mycobacterium avium
KIDIGSGSTGGAQQ

SEQ ID NO: 53784 - protein, 15 aa, Mycobacterium avium
KIDTAAGRRSKAAAR

SEQ ID NO: 53785 - protein, 13 aa, Mycobacterium avium
KIGKTTRLADDPR

SEQ ID NO: 53786 - protein, 8 aa, Mycobacterium avium
KIGQYSAD

SEQ ID NO: 53787 - protein, 8 aa, Mycobacterium avium
KKATGNVE

SEQ ID NO: 53788 - protein, 6 aa, Mycobacterium avium
KKDNFT

SEQ ID NO: 53789 - protein, 8 aa, Mycobacterium avium
KKDQTPMR

SEQ ID NO: 53790 - protein, 7 aa, Mycobacterium avium
KKFGGST

SEQ ID NO: 53791 - protein, 4 aa, Mycobacterium avium
KKGH

SEQ ID NO: 53792 - protein, 7 aa, Mycobacterium avium
KKGVEAP

SEQ ID NO: 53793 - protein, 6 aa, Mycobacterium avium
KKHTVS

SEQ ID NO: 53794 - protein, 7 aa, Mycobacterium avium
KKLDPRS

SEQ ID NO: 53795 - protein, 7 aa, Mycobacterium avium
KKQDDVE

SEQ ID NO: 53796 - protein, 8 aa, Mycobacterium avium
KKTYDPDS

SEQ ID NO: 53797 - protein, 10 aa, Mycobacterium avium
KKVDNAQRRQ

SEQ ID NO: 53798 - protein, 10 aa, Mycobacterium avium
KLAARTGVPE

SEQ ID NO: 53799 - protein, 8 aa, Mycobacterium avium
KLAATGKV

SEQ ID NO: 53800 - protein, 21 aa, Mycobacterium avium
KLADDLGPATVQDLDDQGRIS

SEQ ID NO: 53801 - protein, 8 aa, Mycobacterium avium
KLADGRLD

SEQ ID NO: 53802 - protein, 5 aa, Mycobacterium avium
KLDRR

SEQ ID NO: 53803 - protein, 6 aa, Mycobacterium avium
KLPPSI

SEQ ID NO: 53804 - protein, 9 aa, Mycobacterium avium
KLPSGPGQV

SEQ ID NO: 53805 - protein, 8 aa, Mycobacterium avium
KLSSLSAP

SEQ ID NO: 53806 - protein, 5 aa, Mycobacterium avium
KLTPK

SEQ ID NO: 53807 - protein, 12 aa, Mycobacterium avium
KLTTTPGPLDRA

SEQ ID NO: 53808 - protein, 6 aa, Mycobacterium avium
KMGRPE

SEQ ID NO: 53809 - protein, 7 aa, Mycobacterium avium
KMSGSNI

SEQ ID NO: 53810 - protein, 6 aa, Mycobacterium avium
KNAGTE

SEQ ID NO: 53811 - protein, 8 aa, Mycobacterium avium
KNAQEAHE

SEQ ID NO: 53812 - protein, 7 aa, Mycobacterium avium
KNEHGEY

SEQ ID NO: 53813 - protein, 9 aa, Mycobacterium avium
KNEPEDEER

SEQ ID NO: 53814 - protein, 11 aa, Mycobacterium avium
KNGSGAAAANA

SEQ ID NO: 53815 - protein, 6 aa, Mycobacterium avium
KNGSYS

SEQ ID NO: 53816 - protein, 9 aa, Mycobacterium avium
KNGTAEQKS

SEQ ID NO: 53817 - protein, 9 aa, Mycobacterium avium
KNPGAGPHL

SEQ ID NO: 53818 - protein, 4 aa, Mycobacterium avium
KNQR

SEQ ID NO: 53819 - protein, 14 aa, Mycobacterium avium
KNTGSITKIYTQAT

SEQ ID NO: 53820 - protein, 9 aa, Mycobacterium avium
KNYDGSWTE

SEQ ID NO: 53821 - protein, 22 aa, Mycobacterium avium
KPAGPPGPGQPAWNPQRGSSMP

SEQ ID NO: 53822 - protein, 5 aa, Mycobacterium avium
KPDAP

SEQ ID NO: 53823 - protein, 15 aa, Mycobacterium avium
KPDLQGTLGASPGGG

SEQ ID NO: 53824 - protein, 11 aa, Mycobacterium avium
KPDRRGARRPV

SEQ ID NO: 53825 - protein, 6 aa, Mycobacterium avium
KPEDAA

SEQ ID NO: 53826 - protein, 4 aa, Mycobacterium avium
KPEG

SEQ ID NO: 53827 - protein, 5 aa, Mycobacterium avium
KPFSS

SEQ ID NO: 53828 - protein, 9 aa, Mycobacterium avium
KPGAGSLSI

SEQ ID NO: 53829 - protein, 8 aa, Mycobacterium avium
KPGAGTDA

SEQ ID NO: 53830 - protein, 4 aa, Mycobacterium avium
KPGQ

SEQ ID NO: 53831 - protein, 44 aa, Mycobacterium avium
KPGYTGPSTDEAAPAAAEAADAAGEDADRGDTVEPVDTGPVPLS

SEQ ID NO: 53832 - protein, 5 aa, Mycobacterium avium
KPIDP

SEQ ID NO: 53833 - protein, 5 aa, Mycobacterium avium
KPIPD

SEQ ID NO: 53834 - protein, 4 aa, Mycobacterium avium
KPLD

SEQ ID NO: 53835 - protein, 8 aa, Mycobacterium avium
KPLSAAER

SEQ ID NO: 53836 - protein, 7 aa, Mycobacterium avium
KPPAADV

SEQ ID NO: 53837 - protein, 6 aa, Mycobacterium avium
KPPHEQ

SEQ ID NO: 53838 - protein, 13 aa, Mycobacterium avium
KPPIGKRGYNEDE

SEQ ID NO: 53839 - protein, 9 aa, Mycobacterium avium
KPPPGDHDA

SEQ ID NO: 53840 - protein, 9 aa, Mycobacterium avium
KPQETERTF

SEQ ID NO: 53841 - protein, 11 aa, Mycobacterium avium
KPSAPGRQYSA

SEQ ID NO: 53842 - protein, 7 aa, Mycobacterium avium
KPSRGRL

SEQ ID NO: 53843 - protein, 5 aa, Mycobacterium avium
KPVAA

SEQ ID NO: 53844 - protein, 7 aa, Mycobacterium avium
KPVDDDT

SEQ ID NO: 53845 - protein, 12 aa, Mycobacterium avium
KPVGQSVSATRR

SEQ ID NO: 53846 - protein, 7 aa, Mycobacterium avium
KPVPGAQ

SEQ ID NO: 53847 - protein, 13 aa, Mycobacterium avium
KPVTESLHPSSPE

SEQ ID NO: 53848 - protein, 7 aa, Mycobacterium avium
KPYTGEL

SEQ ID NO: 53849 - protein, 5 aa, Mycobacterium avium
KQAAR

SEQ ID NO: 53850 - protein, 8 aa, Mycobacterium avium
KQADGGRA

SEQ ID NO: 53851 - protein, 8 aa, Mycobacterium avium
KQATEEVA

SEQ ID NO: 53852 - protein, 6 aa, Mycobacterium avium
KQEPGV

SEQ ID NO: 53853 - protein, 10 aa, Mycobacterium avium
KQGHGEPNPT

SEQ ID NO: 53854 - protein, 6 aa, Mycobacterium avium
KQGTGG

SEQ ID NO: 53855 - protein, 7 aa, Mycobacterium avium
KQNPSDD

SEQ ID NO: 53856 - protein, 9 aa, Mycobacterium avium
KQRDDPDST

SEQ ID NO: 53857 - protein, 4 aa, Mycobacterium avium
KQRR

SEQ ID NO: 53858 - protein, 11 aa, Mycobacterium avium
KQSTVRSESAA

SEQ ID NO: 53859 - protein, 6 aa, Mycobacterium avium
KQSVTA

SEQ ID NO: 53860 - protein, 8 aa, Mycobacterium avium
KQTAAPSL

SEQ ID NO: 53861 - protein, 17 aa, Mycobacterium avium
KQVAQRKAELKGADKPV

SEQ ID NO: 53862 - protein, 4 aa, Mycobacterium avium
KRAA

SEQ ID NO: 53863 - protein, 7 aa, Mycobacterium avium
KRAKELG

SEQ ID NO: 53864 - protein, 6 aa, Mycobacterium avium
KREKGS

SEQ ID NO: 53865 - protein, 16 aa, Mycobacterium avium
KREYSTPGKGMQQAKN

SEQ ID NO: 53866 - protein, 8 aa, Mycobacterium avium
KRGDIGTT

SEQ ID NO: 53867 - protein, 15 aa, Mycobacterium avium
KRGIQEETGIKPPWA

SEQ ID NO: 53868 - protein, 7 aa, Mycobacterium avium
KRGLEKN

SEQ ID NO: 53869 - protein, 12 aa, Mycobacterium avium
KRGNDSRSLATE

SEQ ID NO: 53870 - protein, 4 aa, Mycobacterium avium
KRLA

SEQ ID NO: 53871 - protein, 4 aa, Mycobacterium avium
KRLG

SEQ ID NO: 53872 - protein, 6 aa, Mycobacterium avium
KRPDYG

SEQ ID NO: 53873 - protein, 7 aa, Mycobacterium avium
KRPGPGM

SEQ ID NO: 53874 - protein, 26 aa, Mycobacterium avium
KRPGSAAARAAEAAEKAAGGRPAGEA

SEQ ID NO: 53875 - protein, 14 aa, Mycobacterium avium
KRPGTPAAELDGQI

SEQ ID NO: 53876 - protein, 5 aa, Mycobacterium avium
KRPPA

SEQ ID NO: 53877 - protein, 25 aa, Mycobacterium avium
KRPSGDGAADEDADQADESTTADAG

SEQ ID NO: 53878 - protein, 4 aa, Mycobacterium avium
KRRN

SEQ ID NO: 53879 - protein, 6 aa, Mycobacterium avium
KSAAMG

SEQ ID NO: 53880 - protein, 10 aa, Mycobacterium avium
KSANSDTSGR

SEQ ID NO: 53881 - protein, 8 aa, Mycobacterium avium
KSDMSTLT

SEQ ID NO: 53882 - protein, 7 aa, Mycobacterium avium
KSETGRE

SEQ ID NO: 53883 - protein, 6 aa, Mycobacterium avium
KSGSDY

SEQ ID NO: 53884 - protein, 8 aa, Mycobacterium avium
KSGSRAPW

SEQ ID NO: 53885 - protein, 8 aa, Mycobacterium avium
KSIPVSPQ

SEQ ID NO: 53886 - protein, 7 aa, Mycobacterium avium
KSLKSGE

SEQ ID NO: 53887 - protein, 9 aa, Mycobacterium avium
KSLPGQAHY

SEQ ID NO: 53888 - protein, 10 aa, Mycobacterium avium
KSLREGQASL

SEQ ID NO: 53889 - protein, 10 aa, Mycobacterium avium
KSQAALPPEV

SEQ ID NO: 53890 - protein, 6 aa, Mycobacterium avium
KSQTAA

SEQ ID NO: 53891 - protein, 7 aa, Mycobacterium avium
KSREAEA

SEQ ID NO: 53892 - protein, 6 aa, Mycobacterium avium
KSRLPG

SEQ ID NO: 53893 - protein, 7 aa, Mycobacterium avium
KSRTRGY

SEQ ID NO: 53894 - protein, 6 aa, Mycobacterium avium
KSRVEI

SEQ ID NO: 53895 - protein, 15 aa, Mycobacterium avium
KSTRKDPEQLGDAPE

SEQ ID NO: 53896 - protein, 16 aa, Mycobacterium avium
KSVTNPDGTGVRGKEA

SEQ ID NO: 53897 - protein, 17 aa, Mycobacterium avium
KTAGVQAASRGRFEEAS

SEQ ID NO: 53898 - protein, 5 aa, Mycobacterium avium
KTATG

SEQ ID NO: 53899 - protein, 5 aa, Mycobacterium avium
KTDPD

SEQ ID NO: 53900 - protein, 9 aa, Mycobacterium avium
KTDPSARHK

SEQ ID NO: 53901 - protein, 8 aa, Mycobacterium avium
KTESAAQV

SEQ ID NO: 53902 - protein, 10 aa, Mycobacterium avium
KTETPGPRGS

SEQ ID NO: 53903 - protein, 15 aa, Mycobacterium avium
KTGEANGPLQNSRTG

SEQ ID NO: 53904 - protein, 35 aa, Mycobacterium avium
KTGGGVDPLTDAPAPITEQQRKESGIDVKPEPSKP

SEQ ID NO: 53905 - protein, 6 aa, Mycobacterium avium
KTGQQV

SEQ ID NO: 53906 - protein, 4 aa, Mycobacterium avium
KTHR

SEQ ID NO: 53907 - protein, 8 aa, Mycobacterium avium
KTLNDDTA

SEQ ID NO: 53908 - protein, 12 aa, Mycobacterium avium
KTLTPEEIAKEQ

SEQ ID NO: 53909 - protein, 5 aa, Mycobacterium avium
KTPEQ

SEQ ID NO: 53910 - protein, 7 aa, Mycobacterium avium
KTPETAG

SEQ ID NO: 53911 - protein, 7 aa, Mycobacterium avium
KTPKAQI

SEQ ID NO: 53912 - protein, 14 aa, Mycobacterium avium
KTPRQRNRRNARVN

SEQ ID NO: 53913 - protein, 14 aa, Mycobacterium avium
KTRAAADGKPLHAE

SEQ ID NO: 53914 - protein, 6 aa, Mycobacterium avium
KTRRGL

SEQ ID NO: 53915 - protein, 7 aa, Mycobacterium avium
KTSIETN

SEQ ID NO: 53916 - protein, 6 aa, Mycobacterium avium
KTSSAD

SEQ ID NO: 53917 - protein, 67 aa, Mycobacterium avium
KTVTSEADRARRVKASKKAPEAAAAAPQAAVEPEAVEAAPAPDAPEAAPEAEAAAPQPADEAEGSSE

SEQ ID NO: 53918 - protein, 7 aa, Mycobacterium avium
KTWQPGD

SEQ ID NO: 53919 - protein, 6 aa, Mycobacterium avium
KTYDRQ

SEQ ID NO: 53920 - protein, 13 aa, Mycobacterium avium
KTYGTTDPRHPGV

SEQ ID NO: 53921 - protein, 11 aa, Mycobacterium avium
KVAADSGVENP

SEQ ID NO: 53922 - protein, 31 aa, Mycobacterium avium
KVADDREAEGVPGKPSDREDAAVRGSDDEPP

SEQ ID NO: 53923 - protein, 15 aa, Mycobacterium avium
KVAKDWNTDATKGIP

SEQ ID NO: 53924 - protein, 6 aa, Mycobacterium avium
KVAPAT

SEQ ID NO: 53925 - protein, 9 aa, Mycobacterium avium
KVEKGGYRA

SEQ ID NO: 53926 - protein, 6 aa, Mycobacterium avium
KVKPSE

SEQ ID NO: 53927 - protein, 17 aa, Mycobacterium avium
KVLDDGTRVAAETGAPL

SEQ ID NO: 53928 - protein, 8 aa, Mycobacterium avium
KVPPTGSR

SEQ ID NO: 53929 - protein, 10 aa, Mycobacterium avium
KVRETSSNTT

SEQ ID NO: 53930 - protein, 8 aa, Mycobacterium avium
KYAGRAGD

SEQ ID NO: 53931 - protein, 4 aa, Mycobacterium avium
KYDG

SEQ ID NO: 53932 - protein, 9 aa, Mycobacterium avium
KYDPDDTSE

SEQ ID NO: 53933 - protein, 6 aa, Mycobacterium avium
LAAAGG

SEQ ID NO: 53934 - protein, 9 aa, Mycobacterium avium
LAADRDAVA

SEQ ID NO: 53935 - protein, 4 aa, Mycobacterium avium
LAAE

SEQ ID NO: 53936 - protein, 10 aa, Mycobacterium avium
LAAETRSRGI

SEQ ID NO: 53937 - protein, 29 aa, Mycobacterium avium
LAAGRPAASSAGAAAVEQEQGRTRRRPRS

SEQ ID NO: 53938 - protein, 22 aa, Mycobacterium avium
LAAKNEARRAKSALRAQDKALK

SEQ ID NO: 53939 - protein, 4 aa, Mycobacterium avium
LAAP

SEQ ID NO: 53940 - protein, 26 aa, Mycobacterium avium
LAAQNAGAASATTAIAPAAADPVSAQ

SEQ ID NO: 53941 - protein, 9 aa, Mycobacterium avium
LAAQRADHT

SEQ ID NO: 53942 - protein, 20 aa, Mycobacterium avium
LADDDDEAVELPGAATDVPK

SEQ ID NO: 53943 - protein, 7 aa, Mycobacterium avium
LADEGIE

SEQ ID NO: 53944 - protein, 20 aa, Mycobacterium avium
LADETASAIAASGGSAHPIT

SEQ ID NO: 53945 - protein, 9 aa, Mycobacterium avium
LADGGRTDP

SEQ ID NO: 53946 - protein, 9 aa, Mycobacterium avium
LADPPGGLG

SEQ ID NO: 53947 - protein, 7 aa, Mycobacterium avium
LADTGKP

SEQ ID NO: 53948 - protein, 10 aa, Mycobacterium avium
LADTNPEVAP

SEQ ID NO: 53949 - protein, 17 aa, Mycobacterium avium
LADTVDRARETAGEQWS

SEQ ID NO: 53950 - protein, 8 aa, Mycobacterium avium
LAEGGHEP

SEQ ID NO: 53951 - protein, 23 aa, Mycobacterium avium
LAEPGRSDPARPATTARRDGPNW

SEQ ID NO: 53952 - protein, 6 aa, Mycobacterium avium
LAEQRE

SEQ ID NO: 53953 - protein, 5 aa, Mycobacterium avium
LAERA

SEQ ID NO: 53954 - protein, 4 aa, Mycobacterium avium
LAET

SEQ ID NO: 53955 - protein, 10 aa, Mycobacterium avium
LAGDERPDGA

SEQ ID NO: 53956 - protein, 12 aa, Mycobacterium avium
LAGDTTEDLGPI

SEQ ID NO: 53957 - protein, 4 aa, Mycobacterium avium
LAGG

SEQ ID NO: 53958 - protein, 8 aa, Mycobacterium avium
LAGGDVDT

SEQ ID NO: 53959 - protein, 8 aa, Mycobacterium avium
LAGGGPKY

SEQ ID NO: 53960 - protein, 23 aa, Mycobacterium avium
LAGGPDSRRAFAASPDDNEMPGG

SEQ ID NO: 53961 - protein, 9 aa, Mycobacterium avium
LAGGTTDAA

SEQ ID NO: 53962 - protein, 17 aa, Mycobacterium avium
LAGHPGRGPRTDPGTES

SEQ ID NO: 53963 - protein, 10 aa, Mycobacterium avium
LAGPDKAEGI

SEQ ID NO: 53964 - protein, 6 aa, Mycobacterium avium
LAGPGE

SEQ ID NO: 53965 - protein, 6 aa, Mycobacterium avium
LAGPRG

SEQ ID NO: 53966 - protein, 10 aa, Mycobacterium avium
LAGQRGDDTA

SEQ ID NO: 53967 - protein, 9 aa, Mycobacterium avium
LAHGGQPVS

SEQ ID NO: 53968 - protein, 12 aa, Mycobacterium avium
LAKGRTTEAKSQ

SEQ ID NO: 53969 - protein, 11 aa, Mycobacterium avium
LANATKTVPQL

SEQ ID NO: 53970 - protein, 9 aa, Mycobacterium avium
LANGGRPYP

SEQ ID NO: 53971 - protein, 16 aa, Mycobacterium avium
LAPATAAAAAPAAGIP

SEQ ID NO: 53972 - protein, 4 aa, Mycobacterium avium
LAPD

SEQ ID NO: 53973 - protein, 5 aa, Mycobacterium avium
LAPGQ

SEQ ID NO: 53974 - protein, 4 aa, Mycobacterium avium
LAPL

SEQ ID NO: 53975 - protein, 7 aa, Mycobacterium avium
LAPPGRD

SEQ ID NO: 53976 - protein, 6 aa, Mycobacterium avium
LAPTRT

SEQ ID NO: 53977 - protein, 10 aa, Mycobacterium avium
LAPYNASKAG

SEQ ID NO: 53978 - protein, 11 aa, Mycobacterium avium
LAQDQDADMQA

SEQ ID NO: 53979 - protein, 15 aa, Mycobacterium avium
LAQGDTGHPVPGSPD

SEQ ID NO: 53980 - protein, 9 aa, Mycobacterium avium
LAQPPPGSI

SEQ ID NO: 53981 - protein, 14 aa, Mycobacterium avium
LAQRGGAPSPQTRD

SEQ ID NO: 53982 - protein, 5 aa, Mycobacterium avium
LARGQ

SEQ ID NO: 53983 - protein, 6 aa, Mycobacterium avium
LARPER

SEQ ID NO: 53984 - protein, 9 aa, Mycobacterium avium
LARPRGGLT

SEQ ID NO: 53985 - protein, 9 aa, Mycobacterium avium
LARQKTPER

SEQ ID NO: 53986 - protein, 12 aa, Mycobacterium avium
LARQPRPDRAGE

SEQ ID NO: 53987 - protein, 4 aa, Mycobacterium avium
LARR

SEQ ID NO: 53988 - protein, 13 aa, Mycobacterium avium
LARRTNPAGLTGS

SEQ ID NO: 53989 - protein, 7 aa, Mycobacterium avium
LARRTSA

SEQ ID NO: 53990 - protein, 11 aa, Mycobacterium avium
LARSESEGQRR

SEQ ID NO: 53991 - protein, 8 aa, Mycobacterium avium
LASEGTRL

SEQ ID NO: 53992 - protein, 6 aa, Mycobacterium avium
LASHGP

SEQ ID NO: 53993 - protein, 10 aa, Mycobacterium avium
LASRARKAPG

SEQ ID NO: 53994 - protein, 21 aa, Mycobacterium avium
LASRPDQLAGSRFGRRRKESD

SEQ ID NO: 53995 - protein, 9 aa, Mycobacterium avium
LASTGERPI

SEQ ID NO: 53996 - protein, 6 aa, Mycobacterium avium
LASTRP

SEQ ID NO: 53997 - protein, 6 aa, Mycobacterium avium
LATEGS

SEQ ID NO: 53998 - protein, 10 aa, Mycobacterium avium
LATEQSADIT

SEQ ID NO: 53999 - protein, 6 aa, Mycobacterium avium
LATGEP

SEQ ID NO: 54000 - protein, 11 aa, Mycobacterium avium
LATLDSAEGVP

SEQ ID NO: 54001 - protein, 8 aa, Mycobacterium avium
LATPDERD

SEQ ID NO: 54002 - protein, 7 aa, Mycobacterium avium
LATQGNT

SEQ ID NO: 54003 - protein, 7 aa, Mycobacterium avium
LATRTDR

SEQ ID NO: 54004 - protein, 10 aa, Mycobacterium avium
LDADGNPVSI

SEQ ID NO: 54005 - protein, 11 aa, Mycobacterium avium
LDADGSDAHAG

SEQ ID NO: 54006 - protein, 8 aa, Mycobacterium avium
LDADTAAK

SEQ ID NO: 54007 - protein, 7 aa, Mycobacterium avium
LDADTAR

SEQ ID NO: 54008 - protein, 12 aa, Mycobacterium avium
LDAPDPDFNIVT

SEQ ID NO: 54009 - protein, 9 aa, Mycobacterium avium
LDAPSAPLH

SEQ ID NO: 54010 - protein, 8 aa, Mycobacterium avium
LDAQSPAA

SEQ ID NO: 54011 - protein, 6 aa, Mycobacterium avium
LDDEGQ

SEQ ID NO: 54012 - protein, 13 aa, Mycobacterium avium
LDDGYARVNPPDT

SEQ ID NO: 54013 - protein, 7 aa, Mycobacterium avium
LDDKQIG

SEQ ID NO: 54014 - protein, 5 aa, Mycobacterium avium
LDDPA

SEQ ID NO: 54015 - protein, 6 aa, Mycobacterium avium
LDDPAK

SEQ ID NO: 54016 - protein, 6 aa, Mycobacterium avium
LDDPSV

SEQ ID NO: 54017 - protein, 4 aa, Mycobacterium avium
LDEA

SEQ ID NO: 54018 - protein, 14 aa, Mycobacterium avium
LDEAREKDWDTAGS

SEQ ID NO: 54019 - protein, 16 aa, Mycobacterium avium
LDEASAAATAAEQPDL

SEQ ID NO: 54020 - protein, 8 aa, Mycobacterium avium
LDEDPEAA

SEQ ID NO: 54021 - protein, 6 aa, Mycobacterium avium
LDEDRE

SEQ ID NO: 54022 - protein, 11 aa, Mycobacterium avium
LDEGEPYGLPG

SEQ ID NO: 54023 - protein, 5 aa, Mycobacterium avium
LDERA

SEQ ID NO: 54024 - protein, 7 aa, Mycobacterium avium
LDGNPTL

SEQ ID NO: 54025 - protein, 5 aa, Mycobacterium avium
LDGRS

SEQ ID NO: 54026 - protein, 8 aa, Mycobacterium avium
LDGSGGGV

SEQ ID NO: 54027 - protein, 10 aa, Mycobacterium avium
LDGSGTVRDN

SEQ ID NO: 54028 - protein, 12 aa, Mycobacterium avium
LDGTGAEPVPSA

SEQ ID NO: 54029 - protein, 12 aa, Mycobacterium avium
LDKAETKARYGE

SEQ ID NO: 54030 - protein, 5 aa, Mycobacterium avium
LDKPG

SEQ ID NO: 54031 - protein, 16 aa, Mycobacterium avium
LDPAAETEVAPQPQRP

SEQ ID NO: 54032 - protein, 6 aa, Mycobacterium avium
LDPDEP

SEQ ID NO: 54033 - protein, 8 aa, Mycobacterium avium
LDPDTEKL

SEQ ID NO: 54034 - protein, 5 aa, Mycobacterium avium
LDPEA

SEQ ID NO: 54035 - protein, 10 aa, Mycobacterium avium
LDPEDLPAPR

SEQ ID NO: 54036 - protein, 5 aa, Mycobacterium avium
LDPER

SEQ ID NO: 54037 - protein, 6 aa, Mycobacterium avium
LDPGTF

SEQ ID NO: 54038 - protein, 5 aa, Mycobacterium avium
LDPRT

SEQ ID NO: 54039 - protein, 13 aa, Mycobacterium avium
LDPTRTGSGPIKA

SEQ ID NO: 54040 - protein, 5 aa, Mycobacterium avium
LDQTP

SEQ ID NO: 54041 - protein, 7 aa, Mycobacterium avium
LDRDPRT

SEQ ID NO: 54042 - protein, 4 aa, Mycobacterium avium
LDRH

SEQ ID NO: 54043 - protein, 7 aa, Mycobacterium avium
LDSEPGL

SEQ ID NO: 54044 - protein, 10 aa, Mycobacterium avium
LDTADPAAVR

SEQ ID NO: 54045 - protein, 14 aa, Mycobacterium avium
LDTDRLGAEPPSDY

SEQ ID NO: 54046 - protein, 32 aa, Mycobacterium avium
LDTSGADAAAGADLATSTAPVETGVGGAGVGG

SEQ ID NO: 54047 - protein, 11 aa, Mycobacterium avium
LDYRGRADEQV

SEQ ID NO: 54048 - protein, 18 aa, Mycobacterium avium
LEAARAARRSDLPPSYQQ

SEQ ID NO: 54049 - protein, 8 aa, Mycobacterium avium
LEAGGGRP

SEQ ID NO: 54050 - protein, 11 aa, Mycobacterium avium
LEAQKPDPLAV

SEQ ID NO: 54051 - protein, 6 aa, Mycobacterium avium
LEASRS

SEQ ID NO: 54052 - protein, 6 aa, Mycobacterium avium
LEDKGV

SEQ ID NO: 54053 - protein, 5 aa, Mycobacterium avium
LEGDN

SEQ ID NO: 54054 - protein, 10 aa, Mycobacterium avium
LEGRNDGETF

SEQ ID NO: 54055 - protein, 4 aa, Mycobacterium avium
LEPS

SEQ ID NO: 54056 - protein, 6 aa, Mycobacterium avium
LEQGTN

SEQ ID NO: 54057 - protein, 6 aa, Mycobacterium avium
LEQPAA

SEQ ID NO: 54058 - protein, 20 aa, Mycobacterium avium
LEQPVGAASTPANALKTAPP

SEQ ID NO: 54059 - protein, 6 aa, Mycobacterium avium
LERDAA

SEQ ID NO: 54060 - protein, 10 aa, Mycobacterium avium
LERDSDKCDR

SEQ ID NO: 54061 - protein, 20 aa, Mycobacterium avium
LERTESRGGHTRDDHPSMDS

SEQ ID NO: 54062 - protein, 7 aa, Mycobacterium avium
LESDRPH

SEQ ID NO: 54063 - protein, 4 aa, Mycobacterium avium
LESG

SEQ ID NO: 54064 - protein, 4 aa, Mycobacterium avium
LESP

SEQ ID NO: 54065 - protein, 9 aa, Mycobacterium avium
LESTTSPSV

SEQ ID NO: 54066 - protein, 7 aa, Mycobacterium avium
LGAEPGE

SEQ ID NO: 54067 - protein, 8 aa, Mycobacterium avium
LGAGPASR

SEQ ID NO: 54068 - protein, 7 aa, Mycobacterium avium
LGAPKQR

SEQ ID NO: 54069 - protein, 20 aa, Mycobacterium avium
LGAQRKAAPLPPADRRAALS

SEQ ID NO: 54070 - protein, 6 aa, Mycobacterium avium
LGARPS

SEQ ID NO: 54071 - protein, 7 aa, Mycobacterium avium
LGARRGD

SEQ ID NO: 54072 - protein, 4 aa, Mycobacterium avium
LGAS

SEQ ID NO: 54073 - protein, 15 aa, Mycobacterium avium
LGATPPAPPATPGIS

SEQ ID NO: 54074 - protein, 8 aa, Mycobacterium avium
LGATPQAT

SEQ ID NO: 54075 - protein, 5 aa, Mycobacterium avium
LGDDA

SEQ ID NO: 54076 - protein, 6 aa, Mycobacterium avium
LGDDGK

SEQ ID NO: 54077 - protein, 6 aa, Mycobacterium avium
LGDPDH

SEQ ID NO: 54078 - protein, 10 aa, Mycobacterium avium
LGDPDPGVRR

SEQ ID NO: 54079 - protein, 9 aa, Mycobacterium avium
LGDQAAVDA

SEQ ID NO: 54080 - protein, 8 aa, Mycobacterium avium
LGDRDPRA

SEQ ID NO: 54081 - protein, 15 aa, Mycobacterium avium
LGDRPDGAVLVDGGA

SEQ ID NO: 54082 - protein, 21 aa, Mycobacterium avium
LGDTAATAKALSRAETRHGTK

SEQ ID NO: 54083 - protein, 9 aa, Mycobacterium avium
LGDTPAADV

SEQ ID NO: 54084 - protein, 10 aa, Mycobacterium avium
LGEARPAAER

SEQ ID NO: 54085 - protein, 4 aa, Mycobacterium avium
LGED

SEQ ID NO: 54086 - protein, 10 aa, Mycobacterium avium
LGEGGADGEA

SEQ ID NO: 54087 - protein, 8 aa, Mycobacterium avium
LGEPARDL

SEQ ID NO: 54088 - protein, 6 aa, Mycobacterium avium
LGEPGQ

SEQ ID NO: 54089 - protein, 7 aa, Mycobacterium avium
LGERAAD

SEQ ID NO: 54090 - protein, 8 aa, Mycobacterium avium
LGESEFSR

SEQ ID NO: 54091 - protein, 7 aa, Mycobacterium avium
LGGDPTF

SEQ ID NO: 54092 - protein, 12 aa, Mycobacterium avium
LGGHPSGSADQH

SEQ ID NO: 54093 - protein, 6 aa, Mycobacterium avium
LGGPVD

SEQ ID NO: 54094 - protein, 13 aa, Mycobacterium avium
LGGRAGDPAARDA

SEQ ID NO: 54095 - protein, 5 aa, Mycobacterium avium
LGGSA

SEQ ID NO: 54096 - protein, 24 aa, Mycobacterium avium
LGGTANLASAAAPGAAAAAEVGQA

SEQ ID NO: 54097 - protein, 21 aa, Mycobacterium avium
LGGTDRKASVGPRRRTPADDS

SEQ ID NO: 54098 - protein, 10 aa, Mycobacterium avium
LGGTDTSGRS

SEQ ID NO: 54099 - protein, 29 aa, Mycobacterium avium
LGGVPKDQRADAGKRVNAARAQAQQAYDE

SEQ ID NO: 54100 - protein, 4 aa, Mycobacterium avium
LGHR

SEQ ID NO: 54101 - protein, 19 aa, Mycobacterium avium
LGLPAEPDKLGSLAPQANA

SEQ ID NO: 54102 - protein, 11 aa, Mycobacterium avium
LGNGAVQATVS

SEQ ID NO: 54103 - protein, 8 aa, Mycobacterium avium
LGNGKADY

SEQ ID NO: 54104 - protein, 6 aa, Mycobacterium avium
LGNGPT

SEQ ID NO: 54105 - protein, 14 aa, Mycobacterium avium
LGNHANASSEVEYD

SEQ ID NO: 54106 - protein, 7 aa, Mycobacterium avium
LGPAPSD

SEQ ID NO: 54107 - protein, 6 aa, Mycobacterium avium
LGPART

SEQ ID NO: 54108 - protein, 5 aa, Mycobacterium avium
LGPDS

SEQ ID NO: 54109 - protein, 8 aa, Mycobacterium avium
LGPFPTDR

SEQ ID NO: 54110 - protein, 6 aa, Mycobacterium avium
LGPGDA

SEQ ID NO: 54111 - protein, 8 aa, Mycobacterium avium
LGPGDPEL

SEQ ID NO: 54112 - protein, 12 aa, Mycobacterium avium
LGPSGKRPGAIA

SEQ ID NO: 54113 - protein, 9 aa, Mycobacterium avium
LGPSTAGQI

SEQ ID NO: 54114 - protein, 6 aa, Mycobacterium avium
LGRADG

SEQ ID NO: 54115 - protein, 10 aa, Mycobacterium avium
LGRAPTATEL

SEQ ID NO: 54116 - protein, 8 aa, Mycobacterium avium
LGRATSPY

SEQ ID NO: 54117 - protein, 5 aa, Mycobacterium avium
LGRGW

SEQ ID NO: 54118 - protein, 6 aa, Mycobacterium avium
LGRHTN

SEQ ID NO: 54119 - protein, 9 aa, Mycobacterium avium
LGSASNRPA

SEQ ID NO: 54120 - protein, 12 aa, Mycobacterium avium
LGSGKNVGAGED

SEQ ID NO: 54121 - protein, 5 aa, Mycobacterium avium
LGSMD

SEQ ID NO: 54122 - protein, 10 aa, Mycobacterium avium
LGSPAADDQA

SEQ ID NO: 54123 - protein, 8 aa, Mycobacterium avium
LGSPDDDP

SEQ ID NO: 54124 - protein, 8 aa, Mycobacterium avium
LGSPLGET

SEQ ID NO: 54125 - protein, 7 aa, Mycobacterium avium
LGTDEVE

SEQ ID NO: 54126 - protein, 5 aa, Mycobacterium avium
LGTLD

SEQ ID NO: 54127 - protein, 4 aa, Mycobacterium avium
LGTP

SEQ ID NO: 54128 - protein, 4 aa, Mycobacterium avium
LGTR

SEQ ID NO: 54129 - protein, 7 aa, Mycobacterium avium
LGTTPAR

SEQ ID NO: 54130 - protein, 6 aa, Mycobacterium avium
LGTTRT

SEQ ID NO: 54131 - protein, 7 aa, Mycobacterium avium
LGVGTEA

SEQ ID NO: 54132 - protein, 4 aa, Mycobacterium avium
LGVP

SEQ ID NO: 54133 - protein, 6 aa, Mycobacterium avium
LGVPES

SEQ ID NO: 54134 - protein, 9 aa, Mycobacterium avium
LGVSQSTLS

SEQ ID NO: 54135 - protein, 11 aa, Mycobacterium avium
LGYPGPDPVAR

SEQ ID NO: 54136 - protein, 9 aa, Mycobacterium avium
LHPEPGSRA

SEQ ID NO: 54137 - protein, 4 aa, Mycobacterium avium
LHPG

SEQ ID NO: 54138 - protein, 7 aa, Mycobacterium avium
LHSGRTR

SEQ ID NO: 54139 - protein, 4 aa, Mycobacterium avium
LKAA

SEQ ID NO: 54140 - protein, 15 aa, Mycobacterium avium
LKARAEQLSRADGAH

SEQ ID NO: 54141 - protein, 15 aa, Mycobacterium avium
LKDDELGRGGFTGRT

SEQ ID NO: 54142 - protein, 12 aa, Mycobacterium avium
LKDGTNAVGNRT

SEQ ID NO: 54143 - protein, 4 aa, Mycobacterium avium
LKEL

SEQ ID NO: 54144 - protein, 9 aa, Mycobacterium avium
LKGSRMPAP

SEQ ID NO: 54145 - protein, 21 aa, Mycobacterium avium
LKKGGAEAPGDEAARIPETAA

SEQ ID NO: 54146 - protein, 7 aa, Mycobacterium avium
LKNHGAQ

SEQ ID NO: 54147 - protein, 7 aa, Mycobacterium avium
LKPGEVR

SEQ ID NO: 54148 - protein, 6 aa, Mycobacterium avium
LNASTQ

SEQ ID NO: 54149 - protein, 6 aa, Mycobacterium avium
LNDDSR

SEQ ID NO: 54150 - protein, 9 aa, Mycobacterium avium
LNDSLTPDE

SEQ ID NO: 54151 - protein, 16 aa, Mycobacterium avium
LNEPGTPLPDRPATTF

SEQ ID NO: 54152 - protein, 9 aa, Mycobacterium avium
LNESDSAIS

SEQ ID NO: 54153 - protein, 4 aa, Mycobacterium avium
LNGT

SEQ ID NO: 54154 - protein, 9 aa, Mycobacterium avium
LNKPSNSDV

SEQ ID NO: 54155 - protein, 6 aa, Mycobacterium avium
LNPQPL

SEQ ID NO: 54156 - protein, 16 aa, Mycobacterium avium
LNPSVTATETDSGYRI

SEQ ID NO: 54157 - protein, 8 aa, Mycobacterium avium
LNRRPRQT

SEQ ID NO: 54158 - protein, 11 aa, Mycobacterium avium
LNSAGRSFDSN

SEQ ID NO: 54159 - protein, 4 aa, Mycobacterium avium
LNTD

SEQ ID NO: 54160 - protein, 14 aa, Mycobacterium avium
LNTGNRHSQTPPSV

SEQ ID NO: 54161 - protein, 6 aa, Mycobacterium avium
LPAAGS

SEQ ID NO: 54162 - protein, 27 aa, Mycobacterium avium
LPAASAPEPLRPSPEDELAHDPTTEPL

SEQ ID NO: 54163 - protein, 12 aa, Mycobacterium avium
LPADAGQSDRAA

SEQ ID NO: 54164 - protein, 14 aa, Mycobacterium avium
LPADTANLREGANL

SEQ ID NO: 54165 - protein, 8 aa, Mycobacterium avium
LPAGDDGA

SEQ ID NO: 54166 - protein, 9 aa, Mycobacterium avium
LPAGLNPGR

SEQ ID NO: 54167 - protein, 6 aa, Mycobacterium avium
LPAGSR

SEQ ID NO: 54168 - protein, 17 aa, Mycobacterium avium
LPAGTGKWSPDSGETVA

SEQ ID NO: 54169 - protein, 6 aa, Mycobacterium avium
LPAGVE

SEQ ID NO: 54170 - protein, 13 aa, Mycobacterium avium
LPANSTAKLGQTS

SEQ ID NO: 54171 - protein, 7 aa, Mycobacterium avium
LPAPATY

SEQ ID NO: 54172 - protein, 5 aa, Mycobacterium avium
LPARA

SEQ ID NO: 54173 - protein, 8 aa, Mycobacterium avium
LPATASSL

SEQ ID NO: 54174 - protein, 15 aa, Mycobacterium avium
LPDAADPSLQTIRVL

SEQ ID NO: 54175 - protein, 37 aa, Mycobacterium avium
LPDAESEPGAAVAANPNPGSETGTGEAEPEREAAPEP

SEQ ID NO: 54176 - protein, 6 aa, Mycobacterium avium
LPDATA

SEQ ID NO: 54177 - protein, 6 aa, Mycobacterium avium
LPDGTD

SEQ ID NO: 54178 - protein, 7 aa, Mycobacterium avium
LPDKPPH

SEQ ID NO: 54179 - protein, 6 aa, Mycobacterium avium
LPDPAQ

SEQ ID NO: 54180 - protein, 7 aa, Mycobacterium avium
LPDPEPE

SEQ ID NO: 54181 - protein, 5 aa, Mycobacterium avium
LPDPV

SEQ ID NO: 54182 - protein, 8 aa, Mycobacterium avium
LPDQIDKG

SEQ ID NO: 54183 - protein, 6 aa, Mycobacterium avium
LPDSRR

SEQ ID NO: 54184 - protein, 5 aa, Mycobacterium avium
LPDTL

SEQ ID NO: 54185 - protein, 6 aa, Mycobacterium avium
LPDTVG

SEQ ID NO: 54186 - protein, 5 aa, Mycobacterium avium
LPEAE

SEQ ID NO: 54187 - protein, 24 aa, Mycobacterium avium
LPEDTGLRPDFPRQPVPSGDGESV

SEQ ID NO: 54188 - protein, 12 aa, Mycobacterium avium
LPEGPPPPKAFG

SEQ ID NO: 54189 - protein, 8 aa, Mycobacterium avium
LPEGTPAD

SEQ ID NO: 54190 - protein, 5 aa, Mycobacterium avium
LPEGY

SEQ ID NO: 54191 - protein, 31 aa, Mycobacterium avium
LPEPADAEKEASEARAAGRASRFREETRSER

SEQ ID NO: 54192 - protein, 14 aa, Mycobacterium avium
LPEPPEDGLNEAGH

SEQ ID NO: 54193 - protein, 10 aa, Mycobacterium avium
LPEPTASAAF

SEQ ID NO: 54194 - protein, 4 aa, Mycobacterium avium
LPEQ

SEQ ID NO: 54195 - protein, 4 aa, Mycobacterium avium
LPGA

SEQ ID NO: 54196 - protein, 20 aa, Mycobacterium avium
LPGDANYDAATGQVTVTPAT

SEQ ID NO: 54197 - protein, 10 aa, Mycobacterium avium
LPGGQYRKRE

SEQ ID NO: 54198 - protein, 9 aa, Mycobacterium avium
LPGGYSDSE

SEQ ID NO: 54199 - protein, 5 aa, Mycobacterium avium
LPGPE

SEQ ID NO: 54200 - protein, 9 aa, Mycobacterium avium
LPGPHYETP

SEQ ID NO: 54201 - protein, 7 aa, Mycobacterium avium
LPGPTVP

SEQ ID NO: 54202 - protein, 9 aa, Mycobacterium avium
LPGRGAATV

SEQ ID NO: 54203 - protein, 9 aa, Mycobacterium avium
LPGRGQTMS

SEQ ID NO: 54204 - protein, 12 aa, Mycobacterium avium
LPGRPAPLHPNA

SEQ ID NO: 54205 - protein, 21 aa, Mycobacterium avium
LPGRRRPSSRAVRSARVIDTD

SEQ ID NO: 54206 - protein, 4 aa, Mycobacterium avium
LPGS

SEQ ID NO: 54207 - protein, 8 aa, Mycobacterium avium
LPGTDRRA

SEQ ID NO: 54208 - protein, 5 aa, Mycobacterium avium
LPHSS

SEQ ID NO: 54209 - protein, 11 aa, Mycobacterium avium
LPINDSAEVQR

SEQ ID NO: 54210 - protein, 13 aa, Mycobacterium avium
LPINTSGGQLSGG

SEQ ID NO: 54211 - protein, 8 aa, Mycobacterium avium
LPKPQRYP

SEQ ID NO: 54212 - protein, 8 aa, Mycobacterium avium
LPKPSTQI

SEQ ID NO: 54213 - protein, 6 aa, Mycobacterium avium
LPKRRP

SEQ ID NO: 54214 - protein, 6 aa, Mycobacterium avium
LPNPNG

SEQ ID NO: 54215 - protein, 12 aa, Mycobacterium avium
LPPATSDRIAEA

SEQ ID NO: 54216 - protein, 6 aa, Mycobacterium avium
LPPDTP

SEQ ID NO: 54217 - protein, 5 aa, Mycobacterium avium
LPPES

SEQ ID NO: 54218 - protein, 33 aa, Mycobacterium avium
LPPESGPVDRLPDAEGERDHYSPSASVQLDPSV

SEQ ID NO: 54219 - protein, 17 aa, Mycobacterium avium
LPPGARRPAGTPPGAPV

SEQ ID NO: 54220 - protein, 10 aa, Mycobacterium avium
LPPGAVDTEE

SEQ ID NO: 54221 - protein, 14 aa, Mycobacterium avium
LPPGRWADPTPAAG

SEQ ID NO: 54222 - protein, 7 aa, Mycobacterium avium
LPPPDAR

SEQ ID NO: 54223 - protein, 4 aa, Mycobacterium avium
LPPS

SEQ ID NO: 54224 - protein, 6 aa, Mycobacterium avium
LPPSRT

SEQ ID NO: 54225 - protein, 18 aa, Mycobacterium avium
LPQPGDTEDPDKAPSLDE

SEQ ID NO: 54226 - protein, 13 aa, Mycobacterium avium
LPQSSEPPQPEQH

SEQ ID NO: 54227 - protein, 8 aa, Mycobacterium avium
LPRDPNGK

SEQ ID NO: 54228 - protein, 9 aa, Mycobacterium avium
LPRKPTGDL

SEQ ID NO: 54229 - protein, 9 aa, Mycobacterium avium
LPSESEPGY

SEQ ID NO: 54230 - protein, 23 aa, Mycobacterium avium
LPSGTAPAAPCSGADEDDDATTG

SEQ ID NO: 54231 - protein, 16 aa, Mycobacterium avium
LPSPPRGFTPAPPPEW

SEQ ID NO: 54232 - protein, 5 aa, Mycobacterium avium
LPSRR

SEQ ID NO: 54233 - protein, 6 aa, Mycobacterium avium
LPSTAT

SEQ ID NO: 54234 - protein, 7 aa, Mycobacterium avium
LPTEKGR

SEQ ID NO: 54235 - protein, 8 aa, Mycobacterium avium
LPTPSGNT

SEQ ID NO: 54236 - protein, 23 aa, Mycobacterium avium
LPTQRGRGAEPARAPTLTSAAGS

SEQ ID NO: 54237 - protein, 4 aa, Mycobacterium avium
LPTV

SEQ ID NO: 54238 - protein, 4 aa, Mycobacterium avium
LPVD

SEQ ID NO: 54239 - protein, 7 aa, Mycobacterium avium
LPVGPPA

SEQ ID NO: 54240 - protein, 9 aa, Mycobacterium avium
LQAGRPAQI

SEQ ID NO: 54241 - protein, 7 aa, Mycobacterium avium
LQAGSPF

SEQ ID NO: 54242 - protein, 10 aa, Mycobacterium avium
LQAGSPSQIS

SEQ ID NO: 54243 - protein, 11 aa, Mycobacterium avium
LQAGSPSQISS

SEQ ID NO: 54244 - protein, 4 aa, Mycobacterium avium
LQDG

SEQ ID NO: 54245 - protein, 9 aa, Mycobacterium avium
LQDTDSGSE

SEQ ID NO: 54246 - protein, 14 aa, Mycobacterium avium
LQESSAPPAEDVGG

SEQ ID NO: 54247 - protein, 7 aa, Mycobacterium avium
LQETDYA

SEQ ID NO: 54248 - protein, 5 aa, Mycobacterium avium
LQGKG

SEQ ID NO: 54249 - protein, 6 aa, Mycobacterium avium
LQGRGH

SEQ ID NO: 54250 - protein, 5 aa, Mycobacterium avium
LQGTE

SEQ ID NO: 54251 - protein, 6 aa, Mycobacterium avium
LQPDPR

SEQ ID NO: 54252 - protein, 6 aa, Mycobacterium avium
LQPEPV

SEQ ID NO: 54253 - protein, 9 aa, Mycobacterium avium
LQPGPEAGP

SEQ ID NO: 54254 - protein, 9 aa, Mycobacterium avium
LQPLPAPRF

SEQ ID NO: 54255 - protein, 11 aa, Mycobacterium avium
LQPNAGSQGEY

SEQ ID NO: 54256 - protein, 12 aa, Mycobacterium avium
LQPTKGKNADLR

SEQ ID NO: 54257 - protein, 15 aa, Mycobacterium avium
LQQHSNATVAPGEPI

SEQ ID NO: 54258 - protein, 11 aa, Mycobacterium avium
LQRGEAEPASI

SEQ ID NO: 54259 - protein, 10 aa, Mycobacterium avium
LQRSSRDVTT

SEQ ID NO: 54260 - protein, 8 aa, Mycobacterium avium
LQSAASSY

SEQ ID NO: 54261 - protein, 9 aa, Mycobacterium avium
LQSERPDDY

SEQ ID NO: 54262 - protein, 8 aa, Mycobacterium avium
LQSGPAEL

SEQ ID NO: 54263 - protein, 5 aa, Mycobacterium avium
LQTHG

SEQ ID NO: 54264 - protein, 12 aa, Mycobacterium avium
LRAAGADPVFAD

SEQ ID NO: 54265 - protein, 5 aa, Mycobacterium avium
LRARG

SEQ ID NO: 54266 - protein, 4 aa, Mycobacterium avium
LRDA

SEQ ID NO: 54267 - protein, 5 aa, Mycobacterium avium
LRDDG

SEQ ID NO: 54268 - protein, 4 aa, Mycobacterium avium
LRDG

SEQ ID NO: 54269 - protein, 11 aa, Mycobacterium avium
LRDGTGPAGGA

SEQ ID NO: 54270 - protein, 7 aa, Mycobacterium avium
LRDRTAT

SEQ ID NO: 54271 - protein, 4 aa, Mycobacterium avium
LRDV

SEQ ID NO: 54272 - protein, 4 aa, Mycobacterium avium
LRER

SEQ ID NO: 54273 - protein, 7 aa, Mycobacterium avium
LRESGTD

SEQ ID NO: 54274 - protein, 15 aa, Mycobacterium avium
LRETAGWPEGESFPT

SEQ ID NO: 54275 - protein, 17 aa, Mycobacterium avium
LRGKGRLTDADIEATTR

SEQ ID NO: 54276 - protein, 5 aa, Mycobacterium avium
LRGKT

SEQ ID NO: 54277 - protein, 11 aa, Mycobacterium avium
LRGPVRAGPDA

SEQ ID NO: 54278 - protein, 4 aa, Mycobacterium avium
LRGV

SEQ ID NO: 54279 - protein, 8 aa, Mycobacterium avium
LRNDEPEL

SEQ ID NO: 54280 - protein, 4 aa, Mycobacterium avium
LRNK

SEQ ID NO: 54281 - protein, 19 aa, Mycobacterium avium
LRPAPVGAYPAGASACGAE

SEQ ID NO: 54282 - protein, 20 aa, Mycobacterium avium
LRPASDDDSPPSGSGPFSAL

SEQ ID NO: 54283 - protein, 6 aa, Mycobacterium avium
LRPDEN

SEQ ID NO: 54284 - protein, 6 aa, Mycobacterium avium
LRPDSK

SEQ ID NO: 54285 - protein, 5 aa, Mycobacterium avium
LRPPE

SEQ ID NO: 54286 - protein, 6 aa, Mycobacterium avium
LRPSRG

SEQ ID NO: 54287 - protein, 14 aa, Mycobacterium avium
LRRSAAGLPVCADC

SEQ ID NO: 54288 - protein, 10 aa, Mycobacterium avium
LRSAATDYES

SEQ ID NO: 54289 - protein, 14 aa, Mycobacterium avium
LRSDESLTLSEDPP

SEQ ID NO: 54290 - protein, 12 aa, Mycobacterium avium
LRSETVDGAGYP

SEQ ID NO: 54291 - protein, 5 aa, Mycobacterium avium
LRSRP

SEQ ID NO: 54292 - protein, 8 aa, Mycobacterium avium
LRSRREGA

SEQ ID NO: 54293 - protein, 8 aa, Mycobacterium avium
LRTRKAGA

SEQ ID NO: 54294 - protein, 4 aa, Mycobacterium avium
LSAA

SEQ ID NO: 54295 - protein, 17 aa, Mycobacterium avium
LSAADPGPGEAPTSSSR

SEQ ID NO: 54296 - protein, 15 aa, Mycobacterium avium
LSADEAEAAGNGRAL

SEQ ID NO: 54297 - protein, 8 aa, Mycobacterium avium
LSADGVPA

SEQ ID NO: 54298 - protein, 6 aa, Mycobacterium avium
LSAGRA

SEQ ID NO: 54299 - protein, 6 aa, Mycobacterium avium
LSAPAV

SEQ ID NO: 54300 - protein, 9 aa, Mycobacterium avium
LSARKGELA

SEQ ID NO: 54301 - protein, 13 aa, Mycobacterium avium
LSASDDTDETKPQ

SEQ ID NO: 54302 - protein, 6 aa, Mycobacterium avium
LSDAEA

SEQ ID NO: 54303 - protein, 16 aa, Mycobacterium avium
LSDAERAGYDAPFPSD

SEQ ID NO: 54304 - protein, 9 aa, Mycobacterium avium
LSDDPADPS

SEQ ID NO: 54305 - protein, 8 aa, Mycobacterium avium
LSDERDSL

SEQ ID NO: 54306 - protein, 11 aa, Mycobacterium avium
LSDGGPDAAAR

SEQ ID NO: 54307 - protein, 5 aa, Mycobacterium avium
LSDKD

SEQ ID NO: 54308 - protein, 9 aa, Mycobacterium avium
LSDKPPEPY

SEQ ID NO: 54309 - protein, 7 aa, Mycobacterium avium
LSDPAAE

SEQ ID NO: 54310 - protein, 9 aa, Mycobacterium avium
LSDRARNGR

SEQ ID NO: 54311 - protein, 13 aa, Mycobacterium avium
LSEAGDAGERRAV

SEQ ID NO: 54312 - protein, 14 aa, Mycobacterium avium
LSEQGAAPARTLRA

SEQ ID NO: 54313 - protein, 10 aa, Mycobacterium avium
LSERADGPIT

SEQ ID NO: 54314 - protein, 12 aa, Mycobacterium avium
LSGDDDEHDVNR

SEQ ID NO: 54315 - protein, 12 aa, Mycobacterium avium
LSGPTAPAARRP

SEQ ID NO: 54316 - protein, 7 aa, Mycobacterium avium
LSMPEGS

SEQ ID NO: 54317 - protein, 9 aa, Mycobacterium avium
LSPASRRSL

SEQ ID NO: 54318 - protein, 17 aa, Mycobacterium avium
LSPEEVPGQLDRDSYPR

SEQ ID NO: 54319 - protein, 6 aa, Mycobacterium avium
LSPTTR

SEQ ID NO: 54320 - protein, 18 aa, Mycobacterium avium
LSQAGSQPAALDGPVPRD

SEQ ID NO: 54321 - protein, 7 aa, Mycobacterium avium
LSQAKDA

SEQ ID NO: 54322 - protein, 6 aa, Mycobacterium avium
LSQDAE

SEQ ID NO: 54323 - protein, 15 aa, Mycobacterium avium
LSQEAQAAHAAGEDT

SEQ ID NO: 54324 - protein, 8 aa, Mycobacterium avium
LSQPARER

SEQ ID NO: 54325 - protein, 10 aa, Mycobacterium avium
LSQPATGTSI

SEQ ID NO: 54326 - protein, 7 aa, Mycobacterium avium
LSQYTRG

SEQ ID NO: 54327 - protein, 15 aa, Mycobacterium avium
LSRASHAGEDLSTKL

SEQ ID NO: 54328 - protein, 10 aa, Mycobacterium avium
LSRGVSGEAA

SEQ ID NO: 54329 - protein, 7 aa, Mycobacterium avium
LSSASQG

SEQ ID NO: 54330 - protein, 11 aa, Mycobacterium avium
LSSDPDDPEIR

SEQ ID NO: 54331 - protein, 8 aa, Mycobacterium avium
LSSEAVTK

SEQ ID NO: 54332 - protein, 10 aa, Mycobacterium avium
LSSGPPRLTT

SEQ ID NO: 54333 - protein, 8 aa, Mycobacterium avium
LSSNPIGA

SEQ ID NO: 54334 - protein, 5 aa, Mycobacterium avium
LSSPE

SEQ ID NO: 54335 - protein, 15 aa, Mycobacterium avium
LSSRMSKPAESAGRA

SEQ ID NO: 54336 - protein, 5 aa, Mycobacterium avium
LSSST

SEQ ID NO: 54337 - protein, 7 aa, Mycobacterium avium
LSSVEAT

SEQ ID NO: 54338 - protein, 14 aa, Mycobacterium avium
LSTAPTLPGPSPEV

SEQ ID NO: 54339 - protein, 9 aa, Mycobacterium avium
LSTDDPAAS

SEQ ID NO: 54340 - protein, 24 aa, Mycobacterium avium
LSTPGSRLGSEAVPNTADMDPHAA

SEQ ID NO: 54341 - protein, 8 aa, Mycobacterium avium
LSTPRQAR

SEQ ID NO: 54342 - protein, 18 aa, Mycobacterium avium
LSTPVRDSQHALPDTRRA

SEQ ID NO: 54343 - protein, 8 aa, Mycobacterium avium
LSTSGPAV

SEQ ID NO: 54344 - protein, 6 aa, Mycobacterium avium
LSTTAA

SEQ ID NO: 54345 - protein, 17 aa, Mycobacterium avium
LTAGESFGEVESTKSVS

SEQ ID NO: 54346 - protein, 6 aa, Mycobacterium avium
LTDADG

SEQ ID NO: 54347 - protein, 7 aa, Mycobacterium avium
LTDAESA

SEQ ID NO: 54348 - protein, 14 aa, Mycobacterium avium
LTDDAAAAVGARRV

SEQ ID NO: 54349 - protein, 13 aa, Mycobacterium avium
LTDEQARSAPSVS

SEQ ID NO: 54350 - protein, 6 aa, Mycobacterium avium
LTDKPV

SEQ ID NO: 54351 - protein, 9 aa, Mycobacterium avium
LTDTPPETL

SEQ ID NO: 54352 - protein, 5 aa, Mycobacterium avium
LTEDS

SEQ ID NO: 54353 - protein, 5 aa, Mycobacterium avium
LTEGA

SEQ ID NO: 54354 - protein, 8 aa, Mycobacterium avium
LTENDPAK

SEQ ID NO: 54355 - protein, 10 aa, Mycobacterium avium
LTENTPEGYA

SEQ ID NO: 54356 - protein, 9 aa, Mycobacterium avium
LTEPGRSSA

SEQ ID NO: 54357 - protein, 12 aa, Mycobacterium avium
LTGDGGPGMYES

SEQ ID NO: 54358 - protein, 7 aa, Mycobacterium avium
LTGDRGA

SEQ ID NO: 54359 - protein, 28 aa, Mycobacterium avium
LTGNGKLDKRALPSPEYAAGEYRAPGDA

SEQ ID NO: 54360 - protein, 9 aa, Mycobacterium avium
LTGPEGSGH

SEQ ID NO: 54361 - protein, 13 aa, Mycobacterium avium
LTGPPGAQHYSDE

SEQ ID NO: 54362 - protein, 8 aa, Mycobacterium avium
LTGQRNAI

SEQ ID NO: 54363 - protein, 17 aa, Mycobacterium avium
LTGRAATDTVPPDRSGT

SEQ ID NO: 54364 - protein, 6 aa, Mycobacterium avium
LTGTSD

SEQ ID NO: 54365 - protein, 4 aa, Mycobacterium avium
LTHG

SEQ ID NO: 54366 - protein, 7 aa, Mycobacterium avium
LTHSGTP

SEQ ID NO: 54367 - protein, 10 aa, Mycobacterium avium
LTNMRSSTAD

SEQ ID NO: 54368 - protein, 11 aa, Mycobacterium avium
LTNPASGRAED

SEQ ID NO: 54369 - protein, 21 aa, Mycobacterium avium
LTPDGTVEEQAQRVIDLLESR

SEQ ID NO: 54370 - protein, 5 aa, Mycobacterium avium
LTPDQ

SEQ ID NO: 54371 - protein, 6 aa, Mycobacterium avium
LTPGDI

SEQ ID NO: 54372 - protein, 10 aa, Mycobacterium avium
LTPNGKLDET

SEQ ID NO: 54373 - protein, 32 aa, Mycobacterium avium
LTPNGKLDTRALPTPEYTGSRYRAPSNAVEET

SEQ ID NO: 54374 - protein, 14 aa, Mycobacterium avium
LTPPAGSSADSGAG

SEQ ID NO: 54375 - protein, 5 aa, Mycobacterium avium
LTPQN

SEQ ID NO: 54376 - protein, 5 aa, Mycobacterium avium
LTPQQ

SEQ ID NO: 54377 - protein, 9 aa, Mycobacterium avium
LTPQSAFRD

SEQ ID NO: 54378 - protein, 12 aa, Mycobacterium avium
LTPRDGAPPIRG

SEQ ID NO: 54379 - protein, 23 aa, Mycobacterium avium
LTPSGKLDTGALPAPDYQGPEGY

SEQ ID NO: 54380 - protein, 9 aa, Mycobacterium avium
LTPSSAHGV

SEQ ID NO: 54381 - protein, 7 aa, Mycobacterium avium
LTRDPNA

SEQ ID NO: 54382 - protein, 11 aa, Mycobacterium avium
LTRPQHPPTSI

SEQ ID NO: 54383 - protein, 4 aa, Mycobacterium avium
LTRR

SEQ ID NO: 54384 - protein, 12 aa, Mycobacterium avium
LTRRDADGGFDD

SEQ ID NO: 54385 - protein, 10 aa, Mycobacterium avium
LTSDPGAARE

SEQ ID NO: 54386 - protein, 12 aa, Mycobacterium avium
LTSGGGGSAGAI

SEQ ID NO: 54387 - protein, 6 aa, Mycobacterium avium
LTSGTT

SEQ ID NO: 54388 - protein, 5 aa, Mycobacterium avium
LTSID

SEQ ID NO: 54389 - protein, 4 aa, Mycobacterium avium
LTSR

SEQ ID NO: 54390 - protein, 4 aa, Mycobacterium avium
LTSS

SEQ ID NO: 54391 - protein, 6 aa, Mycobacterium avium
LTTDEA

SEQ ID NO: 54392 - protein, 5 aa, Mycobacterium avium
LTTGD

SEQ ID NO: 54393 - protein, 11 aa, Mycobacterium avium
LTTPARQAVAD

SEQ ID NO: 54394 - protein, 5 aa, Mycobacterium avium
LTTRE

SEQ ID NO: 54395 - protein, 7 aa, Mycobacterium avium
LYGNQGV

SEQ ID NO: 54396 - protein, 13 aa, Mycobacterium avium
LYGPGDNFSPSGS

SEQ ID NO: 54397 - protein, 9 aa, Mycobacterium avium
LYPTTEQTL

SEQ ID NO: 54398 - protein, 12 aa, Mycobacterium avium
MAGEEKTTAVSS

SEQ ID NO: 54399 - protein, 6 aa, Mycobacterium avium
MAGRGT

SEQ ID NO: 54400 - protein, 10 aa, Mycobacterium avium
MAKPGAPQAY

SEQ ID NO: 54401 - protein, 5 aa, Mycobacterium avium
MAPGP

SEQ ID NO: 54402 - protein, 8 aa, Mycobacterium avium
MAPPSDNT

SEQ ID NO: 54403 - protein, 9 aa, Mycobacterium avium
MASDAPLAR

SEQ ID NO: 54404 - protein, 7 aa, Mycobacterium avium
MASGPGS

SEQ ID NO: 54405 - protein, 9 aa, Mycobacterium avium
MATRADNPL

SEQ ID NO: 54406 - protein, 10 aa, Mycobacterium avium
MCNPDDEAPC

SEQ ID NO: 54407 - protein, 8 aa, Mycobacterium avium
MDAPPGSG

SEQ ID NO: 54408 - protein, 6 aa, Mycobacterium avium
MDGESK

SEQ ID NO: 54409 - protein, 19 aa, Mycobacterium avium
MDQTRAGQKPKDDPAEVAR

SEQ ID NO: 54410 - protein, 30 aa, Mycobacterium avium
MGAGGEGGNKDKPVEKRVTAPGVPNGQPVK

SEQ ID NO: 54411 - protein, 10 aa, Mycobacterium avium
MGDPAAATLD

SEQ ID NO: 54412 - protein, 7 aa, Mycobacterium avium
MGQGAAA

SEQ ID NO: 54413 - protein, 9 aa, Mycobacterium avium
MGTGPESVV

SEQ ID NO: 54414 - protein, 6 aa, Mycobacterium avium
MGTPQD

SEQ ID NO: 54415 - protein, 5 aa, Mycobacterium avium
MGVPP

SEQ ID NO: 54416 - protein, 8 aa, Mycobacterium avium
MKEAGRGS

SEQ ID NO: 54417 - protein, 7 aa, Mycobacterium avium
MKERSTA

SEQ ID NO: 54418 - protein, 15 aa, Mycobacterium avium
MNDGTAGGYQTNTAP

SEQ ID NO: 54419 - protein, 8 aa, Mycobacterium avium
MNSAGPAV

SEQ ID NO: 54420 - protein, 7 aa, Mycobacterium avium
MPAKPAA

SEQ ID NO: 54421 - protein, 5 aa, Mycobacterium avium
MPAPR

SEQ ID NO: 54422 - protein, 4 aa, Mycobacterium avium
MPDG

SEQ ID NO: 54423 - protein, 6 aa, Mycobacterium avium
MPDSPF

SEQ ID NO: 54424 - protein, 5 aa, Mycobacterium avium
MPEER

SEQ ID NO: 54425 - protein, 20 aa, Mycobacterium avium
MPNGRYATDNIGSPAAADTT

SEQ ID NO: 54426 - protein, 4 aa, Mycobacterium avium
MPPL

SEQ ID NO: 54427 - protein, 16 aa, Mycobacterium avium
MPPTGGMPAMPGQTGM

SEQ ID NO: 54428 - protein, 5 aa, Mycobacterium avium
MPTDG

SEQ ID NO: 54429 - protein, 29 aa, Mycobacterium avium
MPTTDDTQLDDTTSTSSTTTSSKAKTYYY

SEQ ID NO: 54430 - protein, 9 aa, Mycobacterium avium
MQGGGDSAR

SEQ ID NO: 54431 - protein, 16 aa, Mycobacterium avium
MQHQGQAAGYLPSNEQ

SEQ ID NO: 54432 - protein, 9 aa, Mycobacterium avium
MQPNPDEPV

SEQ ID NO: 54433 - protein, 5 aa, Mycobacterium avium
MQTQD

SEQ ID NO: 54434 - protein, 17 aa, Mycobacterium avium
MREDRPLKREGTPDDVA

SEQ ID NO: 54435 - protein, 14 aa, Mycobacterium avium
MRETRGRKEGSDPI

SEQ ID NO: 54436 - protein, 10 aa, Mycobacterium avium
MRKEGAPAPI

SEQ ID NO: 54437 - protein, 4 aa, Mycobacterium avium
MRPA

SEQ ID NO: 54438 - protein, 10 aa, Mycobacterium avium
MRSSAGPDRF

SEQ ID NO: 54439 - protein, 6 aa, Mycobacterium avium
MSAPNE

SEQ ID NO: 54440 - protein, 11 aa, Mycobacterium avium
MSAPSSGSSKV

SEQ ID NO: 54441 - protein, 8 aa, Mycobacterium avium
MSDPETGH

SEQ ID NO: 54442 - protein, 12 aa, Mycobacterium avium
MSGQPLGDEARP

SEQ ID NO: 54443 - protein, 4 aa, Mycobacterium avium
MSGS

SEQ ID NO: 54444 - protein, 7 aa, Mycobacterium avium
MSRGEHR

SEQ ID NO: 54445 - protein, 8 aa, Mycobacterium avium
MSRPDGER

SEQ ID NO: 54446 - protein, 6 aa, Mycobacterium avium
MSTAEA

SEQ ID NO: 54447 - protein, 17 aa, Mycobacterium avium
MSTGDAGKRVACGVIGA

SEQ ID NO: 54448 - protein, 10 aa, Mycobacterium avium
MTAEQRQARQ

SEQ ID NO: 54449 - protein, 40 aa, Mycobacterium avium
MTAPRSNTSPEGVAAQATSVTNAAQAPAGTVQSTVSSSGL

SEQ ID NO: 54450 - protein, 5 aa, Mycobacterium avium
MTGYS

SEQ ID NO: 54451 - protein, 11 aa, Mycobacterium avium
MTKPAESIETT

SEQ ID NO: 54452 - protein, 9 aa, Mycobacterium avium
MTKPGESVA

SEQ ID NO: 54453 - protein, 4 aa, Mycobacterium avium
MTPP

SEQ ID NO: 54454 - protein, 8 aa, Mycobacterium avium
MTPPEDRP

SEQ ID NO: 54455 - protein, 9 aa, Mycobacterium avium
MTPRNADGE

SEQ ID NO: 54456 - protein, 9 aa, Mycobacterium avium
MTPTGPDSY

SEQ ID NO: 54457 - protein, 5 aa, Mycobacterium avium
MTSRE

SEQ ID NO: 54458 - protein, 9 aa, Mycobacterium avium
MYSGPGAGS

SEQ ID NO: 54459 - protein, 14 aa, Mycobacterium avium
NAAARAGAPGAAGV

SEQ ID NO: 54460 - protein, 21 aa, Mycobacterium avium
NAARGEQAAEGLTAAADAHRS

SEQ ID NO: 54461 - protein, 8 aa, Mycobacterium avium
NACGANDG

SEQ ID NO: 54462 - protein, 6 aa, Mycobacterium avium
NADGSV

SEQ ID NO: 54463 - protein, 6 aa, Mycobacterium avium
NADGTL

SEQ ID NO: 54464 - protein, 19 aa, Mycobacterium avium
NADPAVQQRRIESEKVTRV

SEQ ID NO: 54465 - protein, 6 aa, Mycobacterium avium
NADPDL

SEQ ID NO: 54466 - protein, 7 aa, Mycobacterium avium
NADPERI

SEQ ID NO: 54467 - protein, 7 aa, Mycobacterium avium
NADRKGG

SEQ ID NO: 54468 - protein, 7 aa, Mycobacterium avium
NADRRGV

SEQ ID NO: 54469 - protein, 20 aa, Mycobacterium avium
NAEEAADEAVEESDGAAGSD

SEQ ID NO: 54470 - protein, 9 aa, Mycobacterium avium
NAEKGNANS

SEQ ID NO: 54471 - protein, 13 aa, Mycobacterium avium
NAEQAGVSGPLPE

SEQ ID NO: 54472 - protein, 11 aa, Mycobacterium avium
NAGAARGEDPL

SEQ ID NO: 54473 - protein, 8 aa, Mycobacterium avium
NAGDTPGR

SEQ ID NO: 54474 - protein, 6 aa, Mycobacterium avium
NAGGGD

SEQ ID NO: 54475 - protein, 9 aa, Mycobacterium avium
NAGSPEVDS

SEQ ID NO: 54476 - protein, 10 aa, Mycobacterium avium
NAGVGGGGSF

SEQ ID NO: 54477 - protein, 8 aa, Mycobacterium avium
NAKAAVEE

SEQ ID NO: 54478 - protein, 8 aa, Mycobacterium avium
NAKSPQAQ

SEQ ID NO: 54479 - protein, 7 aa, Mycobacterium avium
NALGSKD

SEQ ID NO: 54480 - protein, 7 aa, Mycobacterium avium
NALTTPA

SEQ ID NO: 54481 - protein, 6 aa, Mycobacterium avium
NANPEC

SEQ ID NO: 54482 - protein, 8 aa, Mycobacterium avium
NAPQAKRW

SEQ ID NO: 54483 - protein, 7 aa, Mycobacterium avium
NAPTVGE

SEQ ID NO: 54484 - protein, 9 aa, Mycobacterium avium
NAQRMAGDG

SEQ ID NO: 54485 - protein, 6 aa, Mycobacterium avium
NARTTL

SEQ ID NO: 54486 - protein, 16 aa, Mycobacterium avium
NASAGLANRVGARTAQ

SEQ ID NO: 54487 - protein, 10 aa, Mycobacterium avium
NASASGGKKI

SEQ ID NO: 54488 - protein, 10 aa, Mycobacterium avium
NASGASGEEV

SEQ ID NO: 54489 - protein, 9 aa, Mycobacterium avium
NASRSAGEV

SEQ ID NO: 54490 - protein, 9 aa, Mycobacterium avium
NATGGGQFS

SEQ ID NO: 54491 - protein, 5 aa, Mycobacterium avium
NATGV

SEQ ID NO: 54492 - protein, 9 aa, Mycobacterium avium
NATIGTGTK

SEQ ID NO: 54493 - protein, 16 aa, Mycobacterium avium
NATPSTLSTLRTGTQA

SEQ ID NO: 54494 - protein, 20 aa, Mycobacterium avium
NATRSNPDYLPGTSLPPGIH

SEQ ID NO: 54495 - protein, 5 aa, Mycobacterium avium
NATTI

SEQ ID NO: 54496 - protein, 5 aa, Mycobacterium avium
NAYAP

SEQ ID NO: 54497 - protein, 6 aa, Mycobacterium avium
NCGSTH

SEQ ID NO: 54498 - protein, 11 aa, Mycobacterium avium
NDAGDAASDAL

SEQ ID NO: 54499 - protein, 21 aa, Mycobacterium avium
NDAPGSGEETRLTPLQGGSQN

SEQ ID NO: 54500 - protein, 23 aa, Mycobacterium avium
NDARERAESRRRTHEFLSAVCPA

SEQ ID NO: 54501 - protein, 8 aa, Mycobacterium avium
NDDGDRAT

SEQ ID NO: 54502 - protein, 8 aa, Mycobacterium avium
NDDSRLAD

SEQ ID NO: 54503 - protein, 7 aa, Mycobacterium avium
NDEYAGP

SEQ ID NO: 54504 - protein, 13 aa, Mycobacterium avium
NDFPETRLTPETD

SEQ ID NO: 54505 - protein, 19 aa, Mycobacterium avium
NDFRNARSAGQTSTSPTAL

SEQ ID NO: 54506 - protein, 12 aa, Mycobacterium avium
NDGIYPASDSLS

SEQ ID NO: 54507 - protein, 6 aa, Mycobacterium avium
NDGSAA

SEQ ID NO: 54508 - protein, 5 aa, Mycobacterium avium
NDGYA

SEQ ID NO: 54509 - protein, 7 aa, Mycobacterium avium
NDLDTAQ

SEQ ID NO: 54510 - protein, 8 aa, Mycobacterium avium
NDNTAAVA

SEQ ID NO: 54511 - protein, 11 aa, Mycobacterium avium
NDPARVQDDEY

SEQ ID NO: 54512 - protein, 10 aa, Mycobacterium avium
NDPDRRNAVT

SEQ ID NO: 54513 - protein, 7 aa, Mycobacterium avium
NDRPTGT

SEQ ID NO: 54514 - protein, 18 aa, Mycobacterium avium
NDSAATALAEPDQPDAHR

SEQ ID NO: 54515 - protein, 10 aa, Mycobacterium avium
NDSPDTDRSG

SEQ ID NO: 54516 - protein, 5 aa, Mycobacterium avium
NDSRY

SEQ ID NO: 54517 - protein, 5 aa, Mycobacterium avium
NDTHY

SEQ ID NO: 54518 - protein, 4 aa, Mycobacterium avium
NDWP

SEQ ID NO: 54519 - protein, 6 aa, Mycobacterium avium
NEAAPY

SEQ ID NO: 54520 - protein, 5 aa, Mycobacterium avium
NEAED

SEQ ID NO: 54521 - protein, 5 aa, Mycobacterium avium
NEAGS

SEQ ID NO: 54522 - protein, 10 aa, Mycobacterium avium
NEANDKDIEE

SEQ ID NO: 54523 - protein, 9 aa, Mycobacterium avium
NEDQPVDSL

SEQ ID NO: 54524 - protein, 8 aa, Mycobacterium avium
NEEEASEW

SEQ ID NO: 54525 - protein, 7 aa, Mycobacterium avium
NEHAGAP

SEQ ID NO: 54526 - protein, 10 aa, Mycobacterium avium
NEPDTDRRTP

SEQ ID NO: 54527 - protein, 7 aa, Mycobacterium avium
NEPRRSK

SEQ ID NO: 54528 - protein, 9 aa, Mycobacterium avium
NEQATADAF

SEQ ID NO: 54529 - protein, 9 aa, Mycobacterium avium
NEQDEATRA

SEQ ID NO: 54530 - protein, 4 aa, Mycobacterium avium
NESI

SEQ ID NO: 54531 - protein, 19 aa, Mycobacterium avium
NESTGTAQSATPAVTTEKD

SEQ ID NO: 54532 - protein, 6 aa, Mycobacterium avium
NETTTK

SEQ ID NO: 54533 - protein, 4 aa, Mycobacterium avium
NFES

SEQ ID NO: 54534 - protein, 7 aa, Mycobacterium avium
NFTPESA

SEQ ID NO: 54535 - protein, 4 aa, Mycobacterium avium
NGAL

SEQ ID NO: 54536 - protein, 5 aa, Mycobacterium avium
NGDKL

SEQ ID NO: 54537 - protein, 8 aa, Mycobacterium avium
NGDPGKGW

SEQ ID NO: 54538 - protein, 8 aa, Mycobacterium avium
NGEFSGSF

SEQ ID NO: 54539 - protein, 13 aa, Mycobacterium avium
NGFHEPDAARRAF

SEQ ID NO: 54540 - protein, 5 aa, Mycobacterium avium
NGGYT

SEQ ID NO: 54541 - protein, 6 aa, Mycobacterium avium
NGHPGA

SEQ ID NO: 54542 - protein, 5 aa, Mycobacterium avium
NGIPY

SEQ ID NO: 54543 - protein, 8 aa, Mycobacterium avium
NGPIHPRQ

SEQ ID NO: 54544 - protein, 5 aa, Mycobacterium avium
NGPNQ

SEQ ID NO: 54545 - protein, 7 aa, Mycobacterium avium
NGQPAPV

SEQ ID NO: 54546 - protein, 15 aa, Mycobacterium avium
NGRGIASGNTRRSGL

SEQ ID NO: 54547 - protein, 5 aa, Mycobacterium avium
NGRPD

SEQ ID NO: 54548 - protein, 8 aa, Mycobacterium avium
NGRQSQTP

SEQ ID NO: 54549 - protein, 5 aa, Mycobacterium avium
NGRRT

SEQ ID NO: 54550 - protein, 6 aa, Mycobacterium avium
NGRSGY

SEQ ID NO: 54551 - protein, 11 aa, Mycobacterium avium
NGRTAPPSGEA

SEQ ID NO: 54552 - protein, 6 aa, Mycobacterium avium
NGSGRW

SEQ ID NO: 54553 - protein, 13 aa, Mycobacterium avium
NGTDERVDEAYDD

SEQ ID NO: 54554 - protein, 6 aa, Mycobacterium avium
NGTGPA

SEQ ID NO: 54555 - protein, 4 aa, Mycobacterium avium
NGTH

SEQ ID NO: 54556 - protein, 5 aa, Mycobacterium avium
NGTLE

SEQ ID NO: 54557 - protein, 11 aa, Mycobacterium avium
NGTPSELGGAN

SEQ ID NO: 54558 - protein, 7 aa, Mycobacterium avium
NGTPVDA

SEQ ID NO: 54559 - protein, 7 aa, Mycobacterium avium
NGVETGR

SEQ ID NO: 54560 - protein, 5 aa, Mycobacterium avium
NGYPM

SEQ ID NO: 54561 - protein, 8 aa, Mycobacterium avium
NGYSETLR

SEQ ID NO: 54562 - protein, 7 aa, Mycobacterium avium
NHPPAQA

SEQ ID NO: 54563 - protein, 7 aa, Mycobacterium avium
NHRGGTV

SEQ ID NO: 54564 - protein, 9 aa, Mycobacterium avium
NHRGHGTEL

SEQ ID NO: 54565 - protein, 6 aa, Mycobacterium avium
NHSGAG

SEQ ID NO: 54566 - protein, 6 aa, Mycobacterium avium
NHSPGA

SEQ ID NO: 54567 - protein, 6 aa, Mycobacterium avium
NHTSSA

SEQ ID NO: 54568 - protein, 6 aa, Mycobacterium avium
NIATNA

SEQ ID NO: 54569 - protein, 6 aa, Mycobacterium avium
NKARSV

SEQ ID NO: 54570 - protein, 5 aa, Mycobacterium avium
NKDVP

SEQ ID NO: 54571 - protein, 20 aa, Mycobacterium avium
NKIPNSKEASMSKAKAGRMA

SEQ ID NO: 54572 - protein, 11 aa, Mycobacterium avium
NKPHGERPSAV

SEQ ID NO: 54573 - protein, 5 aa, Mycobacterium avium
NKPSA

SEQ ID NO: 54574 - protein, 11 aa, Mycobacterium avium
NKRRGSTQTSN

SEQ ID NO: 54575 - protein, 6 aa, Mycobacterium avium
NKVPGA

SEQ ID NO: 54576 - protein, 7 aa, Mycobacterium avium
NKVPNAS

SEQ ID NO: 54577 - protein, 11 aa, Mycobacterium avium
NKVRRGSGDIT

SEQ ID NO: 54578 - protein, 7 aa, Mycobacterium avium
NKYGEGP

SEQ ID NO: 54579 - protein, 7 aa, Mycobacterium avium
NLAGSPE

SEQ ID NO: 54580 - protein, 9 aa, Mycobacterium avium
NLGDAAGTY

SEQ ID NO: 54581 - protein, 12 aa, Mycobacterium avium
NLNPAQAHGSGD

SEQ ID NO: 54582 - protein, 6 aa, Mycobacterium avium
NLPESS

SEQ ID NO: 54583 - protein, 7 aa, Mycobacterium avium
NLPKSGG

SEQ ID NO: 54584 - protein, 14 aa, Mycobacterium avium
NLPPASETLERPRS

SEQ ID NO: 54585 - protein, 12 aa, Mycobacterium avium
NLQGNSGRKLGD

SEQ ID NO: 54586 - protein, 49 aa, Mycobacterium avium
NLSGAVSAGSARAGRPAATRAPGGPAAADIQPALSPARQWAGRQGSAGD

SEQ ID NO: 54587 - protein, 12 aa, Mycobacterium avium
NLTDDSDELSRT

SEQ ID NO: 54588 - protein, 4 aa, Mycobacterium avium
NLTF

SEQ ID NO: 54589 - protein, 7 aa, Mycobacterium avium
NNDGPAL

SEQ ID NO: 54590 - protein, 5 aa, Mycobacterium avium
NNEAA

SEQ ID NO: 54591 - protein, 6 aa, Mycobacterium avium
NNKRGI

SEQ ID NO: 54592 - protein, 6 aa, Mycobacterium avium
NNPGNH

SEQ ID NO: 54593 - protein, 11 aa, Mycobacterium avium
NNPKQRNSYDA

SEQ ID NO: 54594 - protein, 6 aa, Mycobacterium avium
NNPSAQ

SEQ ID NO: 54595 - protein, 5 aa, Mycobacterium avium
NNSPH

SEQ ID NO: 54596 - protein, 7 aa, Mycobacterium avium
NNSRSAR

SEQ ID NO: 54597 - protein, 4 aa, Mycobacterium avium
NPAE

SEQ ID NO: 54598 - protein, 4 aa, Mycobacterium avium
NPAF

SEQ ID NO: 54599 - protein, 12 aa, Mycobacterium avium
NPAGGQDGAEDD

SEQ ID NO: 54600 - protein, 6 aa, Mycobacterium avium
NPAGWQ

SEQ ID NO: 54601 - protein, 6 aa, Mycobacterium avium
NPAKKG

SEQ ID NO: 54602 - protein, 9 aa, Mycobacterium avium
NPASGHGAA

SEQ ID NO: 54603 - protein, 9 aa, Mycobacterium avium
NPATGEAAR

SEQ ID NO: 54604 - protein, 4 aa, Mycobacterium avium
NPDA

SEQ ID NO: 54605 - protein, 7 aa, Mycobacterium avium
NPEARTY

SEQ ID NO: 54606 - protein, 8 aa, Mycobacterium avium
NPEATAEA

SEQ ID NO: 54607 - protein, 4 aa, Mycobacterium avium
NPEL

SEQ ID NO: 54608 - protein, 14 aa, Mycobacterium avium
NPESFDADRNTRGH

SEQ ID NO: 54609 - protein, 9 aa, Mycobacterium avium
NPGDETTAG

SEQ ID NO: 54610 - protein, 8 aa, Mycobacterium avium
NPGQVERY

SEQ ID NO: 54611 - protein, 5 aa, Mycobacterium avium
NPGTS

SEQ ID NO: 54612 - protein, 7 aa, Mycobacterium avium
NPITPEE

SEQ ID NO: 54613 - protein, 5 aa, Mycobacterium avium
NPKAQ

SEQ ID NO: 54614 - protein, 6 aa, Mycobacterium avium
NPLGED

SEQ ID NO: 54615 - protein, 8 aa, Mycobacterium avium
NPPNAYYS

SEQ ID NO: 54616 - protein, 8 aa, Mycobacterium avium
NPQCPAPR

SEQ ID NO: 54617 - protein, 5 aa, Mycobacterium avium
NPRAD

SEQ ID NO: 54618 - protein, 19 aa, Mycobacterium avium
NPRHPAPVTKDRPKAENAL

SEQ ID NO: 54619 - protein, 10 aa, Mycobacterium avium
NPRLAGPAPW

SEQ ID NO: 54620 - protein, 8 aa, Mycobacterium avium
NPRSDPVA

SEQ ID NO: 54621 - protein, 11 aa, Mycobacterium avium
NPSDPPRDADQ

SEQ ID NO: 54622 - protein, 5 aa, Mycobacterium avium
NPSGV

SEQ ID NO: 54623 - protein, 10 aa, Mycobacterium avium
NPSRLSDDEL

SEQ ID NO: 54624 - protein, 5 aa, Mycobacterium avium
NPSRP

SEQ ID NO: 54625 - protein, 4 aa, Mycobacterium avium
NPTD

SEQ ID NO: 54626 - protein, 16 aa, Mycobacterium avium
NPTPGSQWDASPKPVE

SEQ ID NO: 54627 - protein, 6 aa, Mycobacterium avium
NPTRSM

SEQ ID NO: 54628 - protein, 4 aa, Mycobacterium avium
NPTT

SEQ ID NO: 54629 - protein, 5 aa, Mycobacterium avium
NPTTI

SEQ ID NO: 54630 - protein, 18 aa, Mycobacterium avium
NPWDTDYTAGASSSGSGA

SEQ ID NO: 54631 - protein, 10 aa, Mycobacterium avium
NQDPSREAAD

SEQ ID NO: 54632 - protein, 7 aa, Mycobacterium avium
NQGPDRE

SEQ ID NO: 54633 - protein, 4 aa, Mycobacterium avium
NQKI

SEQ ID NO: 54634 - protein, 6 aa, Mycobacterium avium
NQNGNL

SEQ ID NO: 54635 - protein, 10 aa, Mycobacterium avium
NQNSGTSYGG

SEQ ID NO: 54636 - protein, 13 aa, Mycobacterium avium
NQYPPGDMSVWNW

SEQ ID NO: 54637 - protein, 8 aa, Mycobacterium avium
NRADAEDL

SEQ ID NO: 54638 - protein, 4 aa, Mycobacterium avium
NRAG

SEQ ID NO: 54639 - protein, 10 aa, Mycobacterium avium
NREALTQPAA

SEQ ID NO: 54640 - protein, 18 aa, Mycobacterium avium
NREPLNPNEEMKQAGAPL

SEQ ID NO: 54641 - protein, 6 aa, Mycobacterium avium
NRGKRS

SEQ ID NO: 54642 - protein, 12 aa, Mycobacterium avium
NRGQAATATTRS

SEQ ID NO: 54643 - protein, 6 aa, Mycobacterium avium
NRGYTE

SEQ ID NO: 54644 - protein, 4 aa, Mycobacterium avium
NRLG

SEQ ID NO: 54645 - protein, 10 aa, Mycobacterium avium
NRLSTGDIDV

SEQ ID NO: 54646 - protein, 7 aa, Mycobacterium avium
NRPNIPA

SEQ ID NO: 54647 - protein, 6 aa, Mycobacterium avium
NRRGER

SEQ ID NO: 54648 - protein, 17 aa, Mycobacterium avium
NRRSRPAATTPFAVASA

SEQ ID NO: 54649 - protein, 6 aa, Mycobacterium avium
NRSRYP

SEQ ID NO: 54650 - protein, 11 aa, Mycobacterium avium
NRSTNPAGPGY

SEQ ID NO: 54651 - protein, 9 aa, Mycobacterium avium
NRTETATDY

SEQ ID NO: 54652 - protein, 14 aa, Mycobacterium avium
NRTTEAGPGEPGTV

SEQ ID NO: 54653 - protein, 7 aa, Mycobacterium avium
NRVRDGG

SEQ ID NO: 54654 - protein, 5 aa, Mycobacterium avium
NSDLR

SEQ ID NO: 54655 - protein, 11 aa, Mycobacterium avium
NSDVPPRDAAE

SEQ ID NO: 54656 - protein, 7 aa, Mycobacterium avium
NSDYTEA

SEQ ID NO: 54657 - protein, 17 aa, Mycobacterium avium
NSEAPGQPSAGREPRVN

SEQ ID NO: 54658 - protein, 9 aa, Mycobacterium avium
NSEIDDARA

SEQ ID NO: 54659 - protein, 7 aa, Mycobacterium avium
NSGEELP

SEQ ID NO: 54660 - protein, 7 aa, Mycobacterium avium
NSGGGSL

SEQ ID NO: 54661 - protein, 12 aa, Mycobacterium avium
NSGINPDDLAGE

SEQ ID NO: 54662 - protein, 7 aa, Mycobacterium avium
NSGPALA

SEQ ID NO: 54663 - protein, 6 aa, Mycobacterium avium
NSGVRD

SEQ ID NO: 54664 - protein, 7 aa, Mycobacterium avium
NSHNDTL

SEQ ID NO: 54665 - protein, 9 aa, Mycobacterium avium
NSMTTNGVS

SEQ ID NO: 54666 - protein, 7 aa, Mycobacterium avium
NSPAALG

SEQ ID NO: 54667 - protein, 10 aa, Mycobacterium avium
NSPSAQAVAG

SEQ ID NO: 54668 - protein, 13 aa, Mycobacterium avium
NSTNGTTVNNAPV

SEQ ID NO: 54669 - protein, 4 aa, Mycobacterium avium
NSTV

SEQ ID NO: 54670 - protein, 15 aa, Mycobacterium avium
NSTVTGRVGETGDDT

SEQ ID NO: 54671 - protein, 9 aa, Mycobacterium avium
NSWEYTGDG

SEQ ID NO: 54672 - protein, 10 aa, Mycobacterium avium
NSYAVATDDG

SEQ ID NO: 54673 - protein, 18 aa, Mycobacterium avium
NTADGGVAGALGSAGDAV

SEQ ID NO: 54674 - protein, 11 aa, Mycobacterium avium
NTDKGRAAADR

SEQ ID NO: 54675 - protein, 6 aa, Mycobacterium avium
NTDRRR

SEQ ID NO: 54676 - protein, 5 aa, Mycobacterium avium
NTEEA

SEQ ID NO: 54677 - protein, 15 aa, Mycobacterium avium
NTGASGDALNAAGEK

SEQ ID NO: 54678 - protein, 9 aa, Mycobacterium avium
NTGAVTRDD

SEQ ID NO: 54679 - protein, 6 aa, Mycobacterium avium
NTGPAH

SEQ ID NO: 54680 - protein, 8 aa, Mycobacterium avium
NTGSAGVA

SEQ ID NO: 54681 - protein, 12 aa, Mycobacterium avium
NTGTLTARPGAQ

SEQ ID NO: 54682 - protein, 7 aa, Mycobacterium avium
NTHAETT

SEQ ID NO: 54683 - protein, 6 aa, Mycobacterium avium
NTLGRR

SEQ ID NO: 54684 - protein, 9 aa, Mycobacterium avium
NTPNSAGRY

SEQ ID NO: 54685 - protein, 15 aa, Mycobacterium avium
NTPRPSAAQTRHPLA

SEQ ID NO: 54686 - protein, 6 aa, Mycobacterium avium
NTRGAL

SEQ ID NO: 54687 - protein, 15 aa, Mycobacterium avium
NTRQGRRLDGETSRS

SEQ ID NO: 54688 - protein, 8 aa, Mycobacterium avium
NTSRPSTI

SEQ ID NO: 54689 - protein, 10 aa, Mycobacterium avium
NTTNDPQRAK

SEQ ID NO: 54690 - protein, 5 aa, Mycobacterium avium
NTTTM

SEQ ID NO: 54691 - protein, 6 aa, Mycobacterium avium
NVGDGA

SEQ ID NO: 54692 - protein, 14 aa, Mycobacterium avium
NVGDQIEPSAFTED

SEQ ID NO: 54693 - protein, 6 aa, Mycobacterium avium
NVGGTA

SEQ ID NO: 54694 - protein, 13 aa, Mycobacterium avium
NVGRTSAEATEQI

SEQ ID NO: 54695 - protein, 7 aa, Mycobacterium avium
NVPGPRR

SEQ ID NO: 54696 - protein, 9 aa, Mycobacterium avium
NVPGSRQGD

SEQ ID NO: 54697 - protein, 11 aa, Mycobacterium avium
NVREAEAGGIT

SEQ ID NO: 54698 - protein, 6 aa, Mycobacterium avium
NWSVDT

SEQ ID NO: 54699 - protein, 25 aa, Mycobacterium avium
NYPEDRGPGAGCPPEHGISDAPDIN

SEQ ID NO: 54700 - protein, 9 aa, Mycobacterium avium
PAAAAGASV

SEQ ID NO: 54701 - protein, 16 aa, Mycobacterium avium
PAAAPAPMPPAPADYS

SEQ ID NO: 54702 - protein, 6 aa, Mycobacterium avium
PAAAPL

SEQ ID NO: 54703 - protein, 8 aa, Mycobacterium avium
PAAATTTL

SEQ ID NO: 54704 - protein, 10 aa, Mycobacterium avium
PAAAYPNENY

SEQ ID NO: 54705 - protein, 9 aa, Mycobacterium avium
PAADPDRYA

SEQ ID NO: 54706 - protein, 5 aa, Mycobacterium avium
PAAGG

SEQ ID NO: 54707 - protein, 10 aa, Mycobacterium avium
PAAGSGERLA

SEQ ID NO: 54708 - protein, 8 aa, Mycobacterium avium
PAAGVGPW

SEQ ID NO: 54709 - protein, 9 aa, Mycobacterium avium
PAAPAGAAA

SEQ ID NO: 54710 - protein, 7 aa, Mycobacterium avium
PAAPETR

SEQ ID NO: 54711 - protein, 14 aa, Mycobacterium avium
PAAPPAHAPLLRDA

SEQ ID NO: 54712 - protein, 6 aa, Mycobacterium avium
PAAPPL

SEQ ID NO: 54713 - protein, 8 aa, Mycobacterium avium
PAAPTGDG

SEQ ID NO: 54714 - protein, 16 aa, Mycobacterium avium
PAASSATAAAMPASGG

SEQ ID NO: 54715 - protein, 13 aa, Mycobacterium avium
PAATRNREDSISA

SEQ ID NO: 54716 - protein, 8 aa, Mycobacterium avium
PAATSMSA

SEQ ID NO: 54717 - protein, 7 aa, Mycobacterium avium
PAAVGAA

SEQ ID NO: 54718 - protein, 9 aa, Mycobacterium avium
PADAGAAKA

SEQ ID NO: 54719 - protein, 5 aa, Mycobacterium avium
PADEP

SEQ ID NO: 54720 - protein, 5 aa, Mycobacterium avium
PADGL

SEQ ID NO: 54721 - protein, 9 aa, Mycobacterium avium
PADPGRSGQ

SEQ ID NO: 54722 - protein, 13 aa, Mycobacterium avium
PADPPAPQPAPAG

SEQ ID NO: 54723 - protein, 9 aa, Mycobacterium avium
PADRATDGA

SEQ ID NO: 54724 - protein, 10 aa, Mycobacterium avium
PADTGEPPTD

SEQ ID NO: 54725 - protein, 5 aa, Mycobacterium avium
PADVP

SEQ ID NO: 54726 - protein, 17 aa, Mycobacterium avium
PAEMQPKPNEVDEDELR

SEQ ID NO: 54727 - protein, 6 aa, Mycobacterium avium
PAEPHD

SEQ ID NO: 54728 - protein, 4 aa, Mycobacterium avium
PAER

SEQ ID NO: 54729 - protein, 13 aa, Mycobacterium avium
PAEVASERQQAGT

SEQ ID NO: 54730 - protein, 6 aa, Mycobacterium avium
PAFGPE

SEQ ID NO: 54731 - protein, 100 aa, Mycobacterium avium
PAGAGGRVGAARKPQGPRRSAERATAKPDQKSETATRRSGTRRRRTRGGQPVSGHPSGNGAASSNGEAAADAPAGSPPGNPGSSRRRRRRRKPADATAQS

SEQ ID NO: 54732 - protein, 6 aa, Mycobacterium avium
PAGALG

SEQ ID NO: 54733 - protein, 11 aa, Mycobacterium avium
PAGATEGATNR

SEQ ID NO: 54734 - protein, 6 aa, Mycobacterium avium
PAGGYQ

SEQ ID NO: 54735 - protein, 6 aa, Mycobacterium avium
PAGHGL

SEQ ID NO: 54736 - protein, 7 aa, Mycobacterium avium
PAGIRTD

SEQ ID NO: 54737 - protein, 11 aa, Mycobacterium avium
PAGLGAGGLGS

SEQ ID NO: 54738 - protein, 24 aa, Mycobacterium avium
PAGPDARTEVRAPLDASDADTVPT

SEQ ID NO: 54739 - protein, 7 aa, Mycobacterium avium
PAGPDDP

SEQ ID NO: 54740 - protein, 8 aa, Mycobacterium avium
PAGSDGAG

SEQ ID NO: 54741 - protein, 9 aa, Mycobacterium avium
PAGSEGQRR

SEQ ID NO: 54742 - protein, 12 aa, Mycobacterium avium
PAGSTDQFGPEL

SEQ ID NO: 54743 - protein, 11 aa, Mycobacterium avium
PAGSTPAEPVE

SEQ ID NO: 54744 - protein, 11 aa, Mycobacterium avium
PAGSTTPPPGV

SEQ ID NO: 54745 - protein, 13 aa, Mycobacterium avium
PAGTGKSSVSKGL

SEQ ID NO: 54746 - protein, 11 aa, Mycobacterium avium
PAGTTAAAAVR

SEQ ID NO: 54747 - protein, 7 aa, Mycobacterium avium
PAGVTET

SEQ ID NO: 54748 - protein, 8 aa, Mycobacterium avium
PAGVTPDD

SEQ ID NO: 54749 - protein, 4 aa, Mycobacterium avium
PAGY

SEQ ID NO: 54750 - protein, 5 aa, Mycobacterium avium
PAGYE

SEQ ID NO: 54751 - protein, 9 aa, Mycobacterium avium
PAHEQTRAG

SEQ ID NO: 54752 - protein, 8 aa, Mycobacterium avium
PAHPATGP

SEQ ID NO: 54753 - protein, 5 aa, Mycobacterium avium
PAHPT

SEQ ID NO: 54754 - protein, 10 aa, Mycobacterium avium
PAKANRSAHG

SEQ ID NO: 54755 - protein, 12 aa, Mycobacterium avium
PAKDTGEGGGSE

SEQ ID NO: 54756 - protein, 94 aa, Mycobacterium avium
PAKRPAAKAANGSAPAKRATKTASRSAKSEAGAAAEPAKKTRSSAKGADAKAPSGRGTKAAKGGPADPDALDTDGAVEDLDTEPDLEGEPGEDL

SEQ ID NO: 54757 - protein, 4 aa, Mycobacterium avium
PALL

SEQ ID NO: 54758 - protein, 16 aa, Mycobacterium avium
PALPAADQLSRSRAVG

SEQ ID NO: 54759 - protein, 8 aa, Mycobacterium avium
PALPGGSR

SEQ ID NO: 54760 - protein, 8 aa, Mycobacterium avium
PALPRDRG

SEQ ID NO: 54761 - protein, 5 aa, Mycobacterium avium
PALQS

SEQ ID NO: 54762 - protein, 4 aa, Mycobacterium avium
PALS

SEQ ID NO: 54763 - protein, 7 aa, Mycobacterium avium
PALSSRQ

SEQ ID NO: 54764 - protein, 4 aa, Mycobacterium avium
PAMG

SEQ ID NO: 54765 - protein, 5 aa, Mycobacterium avium
PANPV

SEQ ID NO: 54766 - protein, 8 aa, Mycobacterium avium
PANTANTS

SEQ ID NO: 54767 - protein, 15 aa, Mycobacterium avium
PAPARRTGGHPAKRT

SEQ ID NO: 54768 - protein, 7 aa, Mycobacterium avium
PAPDAPL

SEQ ID NO: 54769 - protein, 5 aa, Mycobacterium avium
PAPEG

SEQ ID NO: 54770 - protein, 8 aa, Mycobacterium avium
PAPEHDDP

SEQ ID NO: 54771 - protein, 6 aa, Mycobacterium avium
PAPEPL

SEQ ID NO: 54772 - protein, 12 aa, Mycobacterium avium
PAPLSAPPDRLT

SEQ ID NO: 54773 - protein, 12 aa, Mycobacterium avium
PAPRQLPAPEAL

SEQ ID NO: 54774 - protein, 7 aa, Mycobacterium avium
PAPSDWT

SEQ ID NO: 54775 - protein, 17 aa, Mycobacterium avium
PAPTGLPDAGALPSRPR

SEQ ID NO: 54776 - protein, 6 aa, Mycobacterium avium
PAPVRS

SEQ ID NO: 54777 - protein, 6 aa, Mycobacterium avium
PAPYIP

SEQ ID NO: 54778 - protein, 6 aa, Mycobacterium avium
PAQAAA

SEQ ID NO: 54779 - protein, 6 aa, Mycobacterium avium
PAQELD

SEQ ID NO: 54780 - protein, 10 aa, Mycobacterium avium
PAQGAGTETV

SEQ ID NO: 54781 - protein, 13 aa, Mycobacterium avium
PAQPAQPAQPRTR

SEQ ID NO: 54782 - protein, 5 aa, Mycobacterium avium
PAQQR

SEQ ID NO: 54783 - protein, 12 aa, Mycobacterium avium
PAQWGKPAPGFG

SEQ ID NO: 54784 - protein, 7 aa, Mycobacterium avium
PARAAPG

SEQ ID NO: 54785 - protein, 13 aa, Mycobacterium avium
PARRGVGTPSTRS

SEQ ID NO: 54786 - protein, 4 aa, Mycobacterium avium
PARS

SEQ ID NO: 54787 - protein, 8 aa, Mycobacterium avium
PARTGPWK

SEQ ID NO: 54788 - protein, 23 aa, Mycobacterium avium
PARVTGRNVPSEGKAPYDPDRAD

SEQ ID NO: 54789 - protein, 15 aa, Mycobacterium avium
PASEREPYESSAPIE

SEQ ID NO: 54790 - protein, 8 aa, Mycobacterium avium
PASKTRTW

SEQ ID NO: 54791 - protein, 5 aa, Mycobacterium avium
PASQD

SEQ ID NO: 54792 - protein, 8 aa, Mycobacterium avium
PASSLRGE

SEQ ID NO: 54793 - protein, 10 aa, Mycobacterium avium
PASSPADEDT

SEQ ID NO: 54794 - protein, 12 aa, Mycobacterium avium
PATCTGAGSRVD

SEQ ID NO: 54795 - protein, 6 aa, Mycobacterium avium
PATITG

SEQ ID NO: 54796 - protein, 20 aa, Mycobacterium avium
PATVTAPESGGTDTAGPGGR

SEQ ID NO: 54797 - protein, 18 aa, Mycobacterium avium
PAVATQPATAPPVPDPDD

SEQ ID NO: 54798 - protein, 19 aa, Mycobacterium avium
PAVPDGIDPATVPKPLTPD

SEQ ID NO: 54799 - protein, 9 aa, Mycobacterium avium
PAVSGANYE

SEQ ID NO: 54800 - protein, 6 aa, Mycobacterium avium
PCERDG

SEQ ID NO: 54801 - protein, 4 aa, Mycobacterium avium
PCSV

SEQ ID NO: 54802 - protein, 4 aa, Mycobacterium avium
PDAD

SEQ ID NO: 54803 - protein, 23 aa, Mycobacterium avium
PDAGPEPETDSVTASDRGAGPLG

SEQ ID NO: 54804 - protein, 5 aa, Mycobacterium avium
PDANQ

SEQ ID NO: 54805 - protein, 10 aa, Mycobacterium avium
PDANSDDPEA

SEQ ID NO: 54806 - protein, 7 aa, Mycobacterium avium
PDDDAAA

SEQ ID NO: 54807 - protein, 9 aa, Mycobacterium avium
PDDDPRRVT

SEQ ID NO: 54808 - protein, 8 aa, Mycobacterium avium
PDDDPRTT

SEQ ID NO: 54809 - protein, 8 aa, Mycobacterium avium
PDDDPVQR

SEQ ID NO: 54810 - protein, 5 aa, Mycobacterium avium
PDDIT

SEQ ID NO: 54811 - protein, 8 aa, Mycobacterium avium
PDDQGHRY

SEQ ID NO: 54812 - protein, 7 aa, Mycobacterium avium
PDDRATV

SEQ ID NO: 54813 - protein, 17 aa, Mycobacterium avium
PDEAAALRDELKGVTSS

SEQ ID NO: 54814 - protein, 7 aa, Mycobacterium avium
PDEDPHI

SEQ ID NO: 54815 - protein, 4 aa, Mycobacterium avium
PDEL

SEQ ID NO: 54816 - protein, 8 aa, Mycobacterium avium
PDEPGAVV

SEQ ID NO: 54817 - protein, 5 aa, Mycobacterium avium
PDEPW

SEQ ID NO: 54818 - protein, 11 aa, Mycobacterium avium
PDEQSWTRPEI

SEQ ID NO: 54819 - protein, 16 aa, Mycobacterium avium
PDFPQSPKTDEDREIR

SEQ ID NO: 54820 - protein, 5 aa, Mycobacterium avium
PDFRT

SEQ ID NO: 54821 - protein, 5 aa, Mycobacterium avium
PDGAE

SEQ ID NO: 54822 - protein, 6 aa, Mycobacterium avium
PDGAGR

SEQ ID NO: 54823 - protein, 10 aa, Mycobacterium avium
PDGDGAQATA

SEQ ID NO: 54824 - protein, 14 aa, Mycobacterium avium
PDGGPSMWAMWRPP

SEQ ID NO: 54825 - protein, 6 aa, Mycobacterium avium
PDGHAG

SEQ ID NO: 54826 - protein, 5 aa, Mycobacterium avium
PDGHG

SEQ ID NO: 54827 - protein, 8 aa, Mycobacterium avium
PDGKTQVT

SEQ ID NO: 54828 - protein, 4 aa, Mycobacterium avium
PDGS

SEQ ID NO: 54829 - protein, 16 aa, Mycobacterium avium
PDGTKAPGKTVPDPYF

SEQ ID NO: 54830 - protein, 6 aa, Mycobacterium avium
PDGVAG

SEQ ID NO: 54831 - protein, 7 aa, Mycobacterium avium
PDGVDPA

SEQ ID NO: 54832 - protein, 8 aa, Mycobacterium avium
PDGYDPPR

SEQ ID NO: 54833 - protein, 7 aa, Mycobacterium avium
PDHGRPL

SEQ ID NO: 54834 - protein, 34 aa, Mycobacterium avium
PDHRPTQVRAQAQRHAAETRAAMQERRNGQRGGL

SEQ ID NO: 54835 - protein, 4 aa, Mycobacterium avium
PDIG

SEQ ID NO: 54836 - protein, 4 aa, Mycobacterium avium
PDIP

SEQ ID NO: 54837 - protein, 6 aa, Mycobacterium avium
PDKDQL

SEQ ID NO: 54838 - protein, 19 aa, Mycobacterium avium
PDKEVRAPRARMTGSERRQ

SEQ ID NO: 54839 - protein, 14 aa, Mycobacterium avium
PDKLESEAAADAKR

SEQ ID NO: 54840 - protein, 4 aa, Mycobacterium avium
PDLA

SEQ ID NO: 54841 - protein, 7 aa, Mycobacterium avium
PDLARPG

SEQ ID NO: 54842 - protein, 15 aa, Mycobacterium avium
PDPEAPEEEEHELPG

SEQ ID NO: 54843 - protein, 8 aa, Mycobacterium avium
PDPEWGET

SEQ ID NO: 54844 - protein, 5 aa, Mycobacterium avium
PDPFT

SEQ ID NO: 54845 - protein, 6 aa, Mycobacterium avium
PDPGPM

SEQ ID NO: 54846 - protein, 12 aa, Mycobacterium avium
PDPKRSDRADYR

SEQ ID NO: 54847 - protein, 5 aa, Mycobacterium avium
PDPPR

SEQ ID NO: 54848 - protein, 7 aa, Mycobacterium avium
PDPTVPG

SEQ ID NO: 54849 - protein, 7 aa, Mycobacterium avium
PDQRPPV

SEQ ID NO: 54850 - protein, 4 aa, Mycobacterium avium
PDRS

SEQ ID NO: 54851 - protein, 17 aa, Mycobacterium avium
PDRTLTEDDATAARDAA

SEQ ID NO: 54852 - protein, 16 aa, Mycobacterium avium
PDRVPGISSPGAIPGI

SEQ ID NO: 54853 - protein, 31 aa, Mycobacterium avium
PDSAAARGVATEPRPAERIERTAPRKPRRPV

SEQ ID NO: 54854 - protein, 5 aa, Mycobacterium avium
PDSAR

SEQ ID NO: 54855 - protein, 12 aa, Mycobacterium avium
PDSEHPHGLPDR

SEQ ID NO: 54856 - protein, 9 aa, Mycobacterium avium
PDSGGRAVG

SEQ ID NO: 54857 - protein, 13 aa, Mycobacterium avium
PDSPPTDELDGAE

SEQ ID NO: 54858 - protein, 5 aa, Mycobacterium avium
PDSRF

SEQ ID NO: 54859 - protein, 6 aa, Mycobacterium avium
PDSVTE

SEQ ID NO: 54860 - protein, 6 aa, Mycobacterium avium
PDTGVS

SEQ ID NO: 54861 - protein, 11 aa, Mycobacterium avium
PDTVSAEVSTD

SEQ ID NO: 54862 - protein, 5 aa, Mycobacterium avium
PDVPE

SEQ ID NO: 54863 - protein, 13 aa, Mycobacterium avium
PEAGGAKVLQGKE

SEQ ID NO: 54864 - protein, 7 aa, Mycobacterium avium
PEAGSVQ

SEQ ID NO: 54865 - protein, 6 aa, Mycobacterium avium
PEAQDG

SEQ ID NO: 54866 - protein, 10 aa, Mycobacterium avium
PEDQRPPQEE

SEQ ID NO: 54867 - protein, 4 aa, Mycobacterium avium
PEDS

SEQ ID NO: 54868 - protein, 10 aa, Mycobacterium avium
PEDVDPEQKV

SEQ ID NO: 54869 - protein, 5 aa, Mycobacterium avium
PEECR

SEQ ID NO: 54870 - protein, 8 aa, Mycobacterium avium
PEEDRAQF

SEQ ID NO: 54871 - protein, 5 aa, Mycobacterium avium
PEEFG

SEQ ID NO: 54872 - protein, 8 aa, Mycobacterium avium
PEEGSHVQ

SEQ ID NO: 54873 - protein, 36 aa, Mycobacterium avium
PEEQTTQIPPAAAAGDDKKDAAEPQPEPGGDAPTKA

SEQ ID NO: 54874 - protein, 8 aa, Mycobacterium avium
PEFDGPPE

SEQ ID NO: 54875 - protein, 4 aa, Mycobacterium avium
PEFG

SEQ ID NO: 54876 - protein, 6 aa, Mycobacterium avium
PEFTGA

SEQ ID NO: 54877 - protein, 13 aa, Mycobacterium avium
PEGGPEPGYTPSA

SEQ ID NO: 54878 - protein, 7 aa, Mycobacterium avium
PEGKDVK

SEQ ID NO: 54879 - protein, 6 aa, Mycobacterium avium
PEGLES

SEQ ID NO: 54880 - protein, 7 aa, Mycobacterium avium
PEGPPRF

SEQ ID NO: 54881 - protein, 4 aa, Mycobacterium avium
PEGR

SEQ ID NO: 54882 - protein, 12 aa, Mycobacterium avium
PEGRLGQGRRGF

SEQ ID NO: 54883 - protein, 7 aa, Mycobacterium avium
PEGRPQQ

SEQ ID NO: 54884 - protein, 16 aa, Mycobacterium avium
PEHFPADGSAASAKPL

SEQ ID NO: 54885 - protein, 17 aa, Mycobacterium avium
PEHRSRAERAAAALEGP

SEQ ID NO: 54886 - protein, 6 aa, Mycobacterium avium
PEKDIA

SEQ ID NO: 54887 - protein, 11 aa, Mycobacterium avium
PELRSGRSARE

SEQ ID NO: 54888 - protein, 9 aa, Mycobacterium avium
PEPETGKST

SEQ ID NO: 54889 - protein, 13 aa, Mycobacterium avium
PEPLRRGADRTIT

SEQ ID NO: 54890 - protein, 8 aa, Mycobacterium avium
PEPPDERR

SEQ ID NO: 54891 - protein, 8 aa, Mycobacterium avium
PEPTGLDA

SEQ ID NO: 54892 - protein, 9 aa, Mycobacterium avium
PEPVSGGAA

SEQ ID NO: 54893 - protein, 9 aa, Mycobacterium avium
PEQTDEEEL

SEQ ID NO: 54894 - protein, 4 aa, Mycobacterium avium
PERC

SEQ ID NO: 54895 - protein, 4 aa, Mycobacterium avium
PERE

SEQ ID NO: 54896 - protein, 13 aa, Mycobacterium avium
PERGSGGAPRFAP

SEQ ID NO: 54897 - protein, 7 aa, Mycobacterium avium
PERSGNR

SEQ ID NO: 54898 - protein, 10 aa, Mycobacterium avium
PESGVAASTG

SEQ ID NO: 54899 - protein, 4 aa, Mycobacterium avium
PESV

SEQ ID NO: 54900 - protein, 21 aa, Mycobacterium avium
PETATTDPKISDADIDSLSPD

SEQ ID NO: 54901 - protein, 6 aa, Mycobacterium avium
PETGER

SEQ ID NO: 54902 - protein, 4 aa, Mycobacterium avium
PETR

SEQ ID NO: 54903 - protein, 6 aa, Mycobacterium avium
PETTPV

SEQ ID NO: 54904 - protein, 4 aa, Mycobacterium avium
PEVA

SEQ ID NO: 54905 - protein, 4 aa, Mycobacterium avium
PEVD

SEQ ID NO: 54906 - protein, 5 aa, Mycobacterium avium
PEVDD

SEQ ID NO: 54907 - protein, 11 aa, Mycobacterium avium
PEVDTYQSAEQ

SEQ ID NO: 54908 - protein, 4 aa, Mycobacterium avium
PEVG

SEQ ID NO: 54909 - protein, 11 aa, Mycobacterium avium
PEVGPQSAKHG

SEQ ID NO: 54910 - protein, 5 aa, Mycobacterium avium
PEYAG

SEQ ID NO: 54911 - protein, 12 aa, Mycobacterium avium
PFATAGKLSDKQ

SEQ ID NO: 54912 - protein, 10 aa, Mycobacterium avium
PFEGPTPPQR

SEQ ID NO: 54913 - protein, 10 aa, Mycobacterium avium
PFGAPGSRMY

SEQ ID NO: 54914 - protein, 8 aa, Mycobacterium avium
PFGGPGER

SEQ ID NO: 54915 - protein, 10 aa, Mycobacterium avium
PFGKRRDARV

SEQ ID NO: 54916 - protein, 18 aa, Mycobacterium avium
PFPGRPSRPTDPGRAVAG

SEQ ID NO: 54917 - protein, 4 aa, Mycobacterium avium
PFST

SEQ ID NO: 54918 - protein, 7 aa, Mycobacterium avium
PFTPADI

SEQ ID NO: 54919 - protein, 36 aa, Mycobacterium avium
PFTPPRPDTTANGIAAQANTVAQAANDAGSGDPSGG

SEQ ID NO: 54920 - protein, 4 aa, Mycobacterium avium
PGAD

SEQ ID NO: 54921 - protein, 6 aa, Mycobacterium avium
PGAPAS

SEQ ID NO: 54922 - protein, 16 aa, Mycobacterium avium
PGAQPGDTYATAGQLS

SEQ ID NO: 54923 - protein, 6 aa, Mycobacterium avium
PGASSV

SEQ ID NO: 54924 - protein, 12 aa, Mycobacterium avium
PGATTGGFGGAG

SEQ ID NO: 54925 - protein, 12 aa, Mycobacterium avium
PGAVDTPMGTGR

SEQ ID NO: 54926 - protein, 6 aa, Mycobacterium avium
PGAVTR

SEQ ID NO: 54927 - protein, 11 aa, Mycobacterium avium
PGDAEPDGGDV

SEQ ID NO: 54928 - protein, 7 aa, Mycobacterium avium
PGDAKER

SEQ ID NO: 54929 - protein, 17 aa, Mycobacterium avium
PGDDYRDSEGTDTRNYG

SEQ ID NO: 54930 - protein, 9 aa, Mycobacterium avium
PGDGSAPEF

SEQ ID NO: 54931 - protein, 24 aa, Mycobacterium avium
PGDPDFGDPLSTAGDGGPRAAARA

SEQ ID NO: 54932 - protein, 13 aa, Mycobacterium avium
PGDPLPDGKPYVT

SEQ ID NO: 54933 - protein, 20 aa, Mycobacterium avium
PGDTGEPAADSAPRPTLDPQ

SEQ ID NO: 54934 - protein, 21 aa, Mycobacterium avium
PGDTLNASEGTDSDEVRNDDG

SEQ ID NO: 54935 - protein, 5 aa, Mycobacterium avium
PGEPW

SEQ ID NO: 54936 - protein, 8 aa, Mycobacterium avium
PGETEEDF

SEQ ID NO: 54937 - protein, 9 aa, Mycobacterium avium
PGFAPTAPL

SEQ ID NO: 54938 - protein, 8 aa, Mycobacterium avium
PGFDPSGK

SEQ ID NO: 54939 - protein, 5 aa, Mycobacterium avium
PGFPE

SEQ ID NO: 54940 - protein, 5 aa, Mycobacterium avium
PGFTA

SEQ ID NO: 54941 - protein, 5 aa, Mycobacterium avium
PGGAT

SEQ ID NO: 54942 - protein, 6 aa, Mycobacterium avium
PGGELT

SEQ ID NO: 54943 - protein, 7 aa, Mycobacterium avium
PGGGRPA

SEQ ID NO: 54944 - protein, 11 aa, Mycobacterium avium
PGGHDAEARAG

SEQ ID NO: 54945 - protein, 6 aa, Mycobacterium avium
PGGPTA

SEQ ID NO: 54946 - protein, 14 aa, Mycobacterium avium
PGGQRARRAPGAGT

SEQ ID NO: 54947 - protein, 5 aa, Mycobacterium avium
PGGRS

SEQ ID NO: 54948 - protein, 9 aa, Mycobacterium avium
PGGVDGPAA

SEQ ID NO: 54949 - protein, 7 aa, Mycobacterium avium
PGHGEHT

SEQ ID NO: 54950 - protein, 8 aa, Mycobacterium avium
PGHGPDLT

SEQ ID NO: 54951 - protein, 9 aa, Mycobacterium avium
PGHHAETER

SEQ ID NO: 54952 - protein, 4 aa, Mycobacterium avium
PGID

SEQ ID NO: 54953 - protein, 9 aa, Mycobacterium avium
PGIGGPGSI

SEQ ID NO: 54954 - protein, 9 aa, Mycobacterium avium
PGIGKRGAE

SEQ ID NO: 54955 - protein, 4 aa, Mycobacterium avium
PGKL

SEQ ID NO: 54956 - protein, 5 aa, Mycobacterium avium
PGKSM

SEQ ID NO: 54957 - protein, 19 aa, Mycobacterium avium
PGLSAPAAPATPPAPQLPQ

SEQ ID NO: 54958 - protein, 10 aa, Mycobacterium avium
PGMPRDTPYS

SEQ ID NO: 54959 - protein, 8 aa, Mycobacterium avium
PGNEDDYQ

SEQ ID NO: 54960 - protein, 5 aa, Mycobacterium avium
PGNPF

SEQ ID NO: 54961 - protein, 6 aa, Mycobacterium avium
PGNRAP

SEQ ID NO: 54962 - protein, 5 aa, Mycobacterium avium
PGPGE

SEQ ID NO: 54963 - protein, 19 aa, Mycobacterium avium
PGPGSEPGESREYQPGDDV

SEQ ID NO: 54964 - protein, 6 aa, Mycobacterium avium
PGPTDT

SEQ ID NO: 54965 - protein, 11 aa, Mycobacterium avium
PGPVTSSASAG

SEQ ID NO: 54966 - protein, 4 aa, Mycobacterium avium
PGQD

SEQ ID NO: 54967 - protein, 5 aa, Mycobacterium avium
PGQPG

SEQ ID NO: 54968 - protein, 6 aa, Mycobacterium avium
PGQPID

SEQ ID NO: 54969 - protein, 28 aa, Mycobacterium avium
PGQRRYQRTLGEGSTLSSSSHGRGGRGY

SEQ ID NO: 54970 - protein, 8 aa, Mycobacterium avium
PGQVATPI

SEQ ID NO: 54971 - protein, 16 aa, Mycobacterium avium
PGRAADCRAPDARELA

SEQ ID NO: 54972 - protein, 7 aa, Mycobacterium avium
PGRARDL

SEQ ID NO: 54973 - protein, 7 aa, Mycobacterium avium
PGRGGAD

SEQ ID NO: 54974 - protein, 13 aa, Mycobacterium avium
PGRHHAAPRTVAI

SEQ ID NO: 54975 - protein, 4 aa, Mycobacterium avium
PGRR

SEQ ID NO: 54976 - protein, 6 aa, Mycobacterium avium
PGRRAR

SEQ ID NO: 54977 - protein, 5 aa, Mycobacterium avium
PGRVD

SEQ ID NO: 54978 - protein, 19 aa, Mycobacterium avium
PGSASVPHSARRPPPEPNW

SEQ ID NO: 54979 - protein, 7 aa, Mycobacterium avium
PGSDRTS

SEQ ID NO: 54980 - protein, 11 aa, Mycobacterium avium
PGSNGEPTAQD

SEQ ID NO: 54981 - protein, 7 aa, Mycobacterium avium
PGSPLTA

SEQ ID NO: 54982 - protein, 8 aa, Mycobacterium avium
PGSPSEAR

SEQ ID NO: 54983 - protein, 7 aa, Mycobacterium avium
PGTGLSP

SEQ ID NO: 54984 - protein, 9 aa, Mycobacterium avium
PGTGSDDDY

SEQ ID NO: 54985 - protein, 7 aa, Mycobacterium avium
PGTLPEP

SEQ ID NO: 54986 - protein, 9 aa, Mycobacterium avium
PGTNSSVRG

SEQ ID NO: 54987 - protein, 6 aa, Mycobacterium avium
PGTQPL

SEQ ID NO: 54988 - protein, 9 aa, Mycobacterium avium
PGTSLDPHG

SEQ ID NO: 54989 - protein, 6 aa, Mycobacterium avium
PGVDPA

SEQ ID NO: 54990 - protein, 4 aa, Mycobacterium avium
PGVP

SEQ ID NO: 54991 - protein, 6 aa, Mycobacterium avium
PGVPDE

SEQ ID NO: 54992 - protein, 5 aa, Mycobacterium avium
PGVRP

SEQ ID NO: 54993 - protein, 8 aa, Mycobacterium avium
PGWQRERQ

SEQ ID NO: 54994 - protein, 7 aa, Mycobacterium avium
PGYPSAR

SEQ ID NO: 54995 - protein, 7 aa, Mycobacterium avium
PHARNAL

SEQ ID NO: 54996 - protein, 4 aa, Mycobacterium avium
PHEP

SEQ ID NO: 54997 - protein, 13 aa, Mycobacterium avium
PHFGGSTARSGGG

SEQ ID NO: 54998 - protein, 13 aa, Mycobacterium avium
PHGADPATGQPTT

SEQ ID NO: 54999 - protein, 11 aa, Mycobacterium avium
PHPAPVAPPDH

SEQ ID NO: 55000 - protein, 10 aa, Mycobacterium avium
PHPEGLAEPK

SEQ ID NO: 55001 - protein, 7 aa, Mycobacterium avium
PHPPAGV

SEQ ID NO: 55002 - protein, 5 aa, Mycobacterium avium
PHQPG

SEQ ID NO: 55003 - protein, 10 aa, Mycobacterium avium
PHRGSSHERV

SEQ ID NO: 55004 - protein, 8 aa, Mycobacterium avium
PHRGTANE

SEQ ID NO: 55005 - protein, 6 aa, Mycobacterium avium
PHRSPA

SEQ ID NO: 55006 - protein, 10 aa, Mycobacterium avium
PHRYSQREIT

SEQ ID NO: 55007 - protein, 10 aa, Mycobacterium avium
PHSEQPIGHA

SEQ ID NO: 55008 - protein, 7 aa, Mycobacterium avium
PHTDPSW

SEQ ID NO: 55009 - protein, 11 aa, Mycobacterium avium
PHYPPPGYADA

SEQ ID NO: 55010 - protein, 17 aa, Mycobacterium avium
PIAEDPRLTEAAQQHAD

SEQ ID NO: 55011 - protein, 13 aa, Mycobacterium avium
PIAPGGAPRSPRG

SEQ ID NO: 55012 - protein, 6 aa, Mycobacterium avium
PIDESQ

SEQ ID NO: 55013 - protein, 5 aa, Mycobacterium avium
PIDQP

SEQ ID NO: 55014 - protein, 16 aa, Mycobacterium avium
PIDRTDADSAQAALTT

SEQ ID NO: 55015 - protein, 7 aa, Mycobacterium avium
PIEGEDD

SEQ ID NO: 55016 - protein, 5 aa, Mycobacterium avium
PIPDC

SEQ ID NO: 55017 - protein, 6 aa, Mycobacterium avium
PIPGTK

SEQ ID NO: 55018 - protein, 11 aa, Mycobacterium avium
PISDPSHGSGI

SEQ ID NO: 55019 - protein, 5 aa, Mycobacterium avium
PITAA

SEQ ID NO: 55020 - protein, 4 aa, Mycobacterium avium
PITT

SEQ ID NO: 55021 - protein, 14 aa, Mycobacterium avium
PKATGPSPRRIAER

SEQ ID NO: 55022 - protein, 6 aa, Mycobacterium avium
PKAVPS

SEQ ID NO: 55023 - protein, 10 aa, Mycobacterium avium
PKFSETPANV

SEQ ID NO: 55024 - protein, 7 aa, Mycobacterium avium
PKGSTWR

SEQ ID NO: 55025 - protein, 5 aa, Mycobacterium avium
PKHAE

SEQ ID NO: 55026 - protein, 5 aa, Mycobacterium avium
PKKLP

SEQ ID NO: 55027 - protein, 7 aa, Mycobacterium avium
PKLNTVG

SEQ ID NO: 55028 - protein, 7 aa, Mycobacterium avium
PKNDAGK

SEQ ID NO: 55029 - protein, 5 aa, Mycobacterium avium
PKPPF

SEQ ID NO: 55030 - protein, 11 aa, Mycobacterium avium
PKPRDRGDPRI

SEQ ID NO: 55031 - protein, 8 aa, Mycobacterium avium
PKQRDLES

SEQ ID NO: 55032 - protein, 6 aa, Mycobacterium avium
PKRPEH

SEQ ID NO: 55033 - protein, 4 aa, Mycobacterium avium
PKRY

SEQ ID NO: 55034 - protein, 7 aa, Mycobacterium avium
PKRYGAG

SEQ ID NO: 55035 - protein, 7 aa, Mycobacterium avium
PKSERSE

SEQ ID NO: 55036 - protein, 14 aa, Mycobacterium avium
PKSLTSLSAAETEL

SEQ ID NO: 55037 - protein, 9 aa, Mycobacterium avium
PKSWDPAAA

SEQ ID NO: 55038 - protein, 8 aa, Mycobacterium avium
PKTAETAA

SEQ ID NO: 55039 - protein, 6 aa, Mycobacterium avium
PKTDAV

SEQ ID NO: 55040 - protein, 4 aa, Mycobacterium avium
PKVS

SEQ ID NO: 55041 - protein, 7 aa, Mycobacterium avium
PKVTTTA

SEQ ID NO: 55042 - protein, 8 aa, Mycobacterium avium
PLADADAY

SEQ ID NO: 55043 - protein, 11 aa, Mycobacterium avium
PLAPGDGGAEL

SEQ ID NO: 55044 - protein, 4 aa, Mycobacterium avium
PLDD

SEQ ID NO: 55045 - protein, 8 aa, Mycobacterium avium
PLDDGGRI

SEQ ID NO: 55046 - protein, 8 aa, Mycobacterium avium
PLDDGSAG

SEQ ID NO: 55047 - protein, 7 aa, Mycobacterium avium
PLDDGTT

SEQ ID NO: 55048 - protein, 6 aa, Mycobacterium avium
PLDPER

SEQ ID NO: 55049 - protein, 8 aa, Mycobacterium avium
PLDPGRPP

SEQ ID NO: 55050 - protein, 6 aa, Mycobacterium avium
PLDPRF

SEQ ID NO: 55051 - protein, 17 aa, Mycobacterium avium
PLDSDGEQGRITDPGRI

SEQ ID NO: 55052 - protein, 4 aa, Mycobacterium avium
PLDT

SEQ ID NO: 55053 - protein, 11 aa, Mycobacterium avium
PLEGQETPERG

SEQ ID NO: 55054 - protein, 13 aa, Mycobacterium avium
PLGPGQPGKAARR

SEQ ID NO: 55055 - protein, 18 aa, Mycobacterium avium
PLGQQGSGRLQPGATIPL

SEQ ID NO: 55056 - protein, 8 aa, Mycobacterium avium
PLGRQAEV

SEQ ID NO: 55057 - protein, 13 aa, Mycobacterium avium
PLGTGESSQPASD

SEQ ID NO: 55058 - protein, 7 aa, Mycobacterium avium
PLPADDE

SEQ ID NO: 55059 - protein, 6 aa, Mycobacterium avium
PLPDPD

SEQ ID NO: 55060 - protein, 51 aa, Mycobacterium avium
PLPGPPPGAAPLPGPPPGAAPLPGPPPGAASLPDAGLGQTPPAATAPTEGG

SEQ ID NO: 55061 - protein, 7 aa, Mycobacterium avium
PLPMPPS

SEQ ID NO: 55062 - protein, 13 aa, Mycobacterium avium
PLPPNARRIEDPD

SEQ ID NO: 55063 - protein, 14 aa, Mycobacterium avium
PLPQGDSRSAEETF

SEQ ID NO: 55064 - protein, 8 aa, Mycobacterium avium
PLPRNAGG

SEQ ID NO: 55065 - protein, 9 aa, Mycobacterium avium
PLPTHPDED

SEQ ID NO: 55066 - protein, 8 aa, Mycobacterium avium
PLQEATRA

SEQ ID NO: 55067 - protein, 7 aa, Mycobacterium avium
PLSPRGV

SEQ ID NO: 55068 - protein, 16 aa, Mycobacterium avium
PLTAESGAPPIGSPVP

SEQ ID NO: 55069 - protein, 10 aa, Mycobacterium avium
PLTAETAQAL

SEQ ID NO: 55070 - protein, 16 aa, Mycobacterium avium
PLTAGSGIPPIGSPVD

SEQ ID NO: 55071 - protein, 19 aa, Mycobacterium avium
PLTTGSTGSDAVPIGSPVP

SEQ ID NO: 55072 - protein, 11 aa, Mycobacterium avium
PMAATREGETT

SEQ ID NO: 55073 - protein, 22 aa, Mycobacterium avium
PMAPTSPVAPATSAVSTPAPVA

SEQ ID NO: 55074 - protein, 13 aa, Mycobacterium avium
PMDAGRKGQKGIE

SEQ ID NO: 55075 - protein, 17 aa, Mycobacterium avium
PMGSDGGAWATDPETNY

SEQ ID NO: 55076 - protein, 11 aa, Mycobacterium avium
PMPGAGAPSVN

SEQ ID NO: 55077 - protein, 6 aa, Mycobacterium avium
PMRGGL

SEQ ID NO: 55078 - protein, 15 aa, Mycobacterium avium
PMTTARPAKARNEGQ

SEQ ID NO: 55079 - protein, 4 aa, Mycobacterium avium
PNDT

SEQ ID NO: 55080 - protein, 9 aa, Mycobacterium avium
PNEETSGTC

SEQ ID NO: 55081 - protein, 5 aa, Mycobacterium avium
PNEGA

SEQ ID NO: 55082 - protein, 8 aa, Mycobacterium avium
PNEQTARA

SEQ ID NO: 55083 - protein, 6 aa, Mycobacterium avium
PNHEEA

SEQ ID NO: 55084 - protein, 4 aa, Mycobacterium avium
PNLA

SEQ ID NO: 55085 - protein, 5 aa, Mycobacterium avium
PNLTT

SEQ ID NO: 55086 - protein, 16 aa, Mycobacterium avium
PNNGENDQRPAQGEPY

SEQ ID NO: 55087 - protein, 4 aa, Mycobacterium avium
PNNT

SEQ ID NO: 55088 - protein, 10 aa, Mycobacterium avium
PNPEEPGATD

SEQ ID NO: 55089 - protein, 5 aa, Mycobacterium avium
PNPGT

SEQ ID NO: 55090 - protein, 15 aa, Mycobacterium avium
PNPPAGGFSPGGHNP

SEQ ID NO: 55091 - protein, 4 aa, Mycobacterium avium
PNPV

SEQ ID NO: 55092 - protein, 14 aa, Mycobacterium avium
PNSDATGADWSKTI

SEQ ID NO: 55093 - protein, 19 aa, Mycobacterium avium
PNTIDGGTPVVSTDDAATA

SEQ ID NO: 55094 - protein, 16 aa, Mycobacterium avium
PPAAAAARSAAEKQGA

SEQ ID NO: 55095 - protein, 12 aa, Mycobacterium avium
PPAAKADETRQR

SEQ ID NO: 55096 - protein, 9 aa, Mycobacterium avium
PPADPDVSK

SEQ ID NO: 55097 - protein, 38 aa, Mycobacterium avium
PPAEPFPDTDAALSADDGADGEPVENGEPVTDTQPGWP

SEQ ID NO: 55098 - protein, 7 aa, Mycobacterium avium
PPAFTDE

SEQ ID NO: 55099 - protein, 16 aa, Mycobacterium avium
PPAGLGGGAASAGLGG

SEQ ID NO: 55100 - protein, 4 aa, Mycobacterium avium
PPAK

SEQ ID NO: 55101 - protein, 11 aa, Mycobacterium avium
PPANAPTPVER

SEQ ID NO: 55102 - protein, 20 aa, Mycobacterium avium
PPAPPGMTDNPDRRGAGRAT

SEQ ID NO: 55103 - protein, 4 aa, Mycobacterium avium
PPAQ

SEQ ID NO: 55104 - protein, 11 aa, Mycobacterium avium
PPASTETLRTD

SEQ ID NO: 55105 - protein, 5 aa, Mycobacterium avium
PPAVS

SEQ ID NO: 55106 - protein, 13 aa, Mycobacterium avium
PPAWPAANPVAPL

SEQ ID NO: 55107 - protein, 7 aa, Mycobacterium avium
PPDDRTA

SEQ ID NO: 55108 - protein, 13 aa, Mycobacterium avium
PPDELGMRLAKKS

SEQ ID NO: 55109 - protein, 15 aa, Mycobacterium avium
PPDVPWSTDADGGPA

SEQ ID NO: 55110 - protein, 5 aa, Mycobacterium avium
PPEAP

SEQ ID NO: 55111 - protein, 35 aa, Mycobacterium avium
PPEDGGAPPPPDAPPPPPDAPAPPPDAPPAPPEAP

SEQ ID NO: 55112 - protein, 8 aa, Mycobacterium avium
PPEDTDKL

SEQ ID NO: 55113 - protein, 23 aa, Mycobacterium avium
PPEGDVAEQQRPVDTDDETGLDT

SEQ ID NO: 55114 - protein, 6 aa, Mycobacterium avium
PPEITD

SEQ ID NO: 55115 - protein, 11 aa, Mycobacterium avium
PPELRRRGAAR

SEQ ID NO: 55116 - protein, 12 aa, Mycobacterium avium
PPERLSKASPAP

SEQ ID NO: 55117 - protein, 24 aa, Mycobacterium avium
PPFGGEEEKSIQANFPADKQTAET

SEQ ID NO: 55118 - protein, 15 aa, Mycobacterium avium
PPGEPAGPHAAGESG

SEQ ID NO: 55119 - protein, 15 aa, Mycobacterium avium
PPGLADDQAAAVTTA

SEQ ID NO: 55120 - protein, 6 aa, Mycobacterium avium
PPGLSP

SEQ ID NO: 55121 - protein, 5 aa, Mycobacterium avium
PPGPA

SEQ ID NO: 55122 - protein, 15 aa, Mycobacterium avium
PPGSLVGTSSPRRAA

SEQ ID NO: 55123 - protein, 8 aa, Mycobacterium avium
PPGSTARG

SEQ ID NO: 55124 - protein, 7 aa, Mycobacterium avium
PPGTTPR

SEQ ID NO: 55125 - protein, 5 aa, Mycobacterium avium
PPGTV

SEQ ID NO: 55126 - protein, 5 aa, Mycobacterium avium
PPGVA

SEQ ID NO: 55127 - protein, 9 aa, Mycobacterium avium
PPGYSGPTD

SEQ ID NO: 55128 - protein, 4 aa, Mycobacterium avium
PPHG

SEQ ID NO: 55129 - protein, 7 aa, Mycobacterium avium
PPHPHTG

SEQ ID NO: 55130 - protein, 24 aa, Mycobacterium avium
PPHRPAPGDQRNRGGGPSAPLPDL

SEQ ID NO: 55131 - protein, 8 aa, Mycobacterium avium
PPIAPAPI

SEQ ID NO: 55132 - protein, 5 aa, Mycobacterium avium
PPKAA

SEQ ID NO: 55133 - protein, 10 aa, Mycobacterium avium
PPKDEKPEWA

SEQ ID NO: 55134 - protein, 12 aa, Mycobacterium avium
PPLDNYNPAGSP

SEQ ID NO: 55135 - protein, 4 aa, Mycobacterium avium
PPLG

SEQ ID NO: 55136 - protein, 11 aa, Mycobacterium avium
PPLKSATREEQ

SEQ ID NO: 55137 - protein, 12 aa, Mycobacterium avium
PPLPGSHRADEA

SEQ ID NO: 55138 - protein, 9 aa, Mycobacterium avium
PPLPPDQTY

SEQ ID NO: 55139 - protein, 6 aa, Mycobacterium avium
PPLRRP

SEQ ID NO: 55140 - protein, 6 aa, Mycobacterium avium
PPNQLP

SEQ ID NO: 55141 - protein, 42 aa, Mycobacterium avium
PPPASPAPEAPPQAAPPAPRGSAPDATAATSAGRAAAGTSDV

SEQ ID NO: 55142 - protein, 8 aa, Mycobacterium avium
PPPGDAGL

SEQ ID NO: 55143 - protein, 7 aa, Mycobacterium avium
PPPGDHG

SEQ ID NO: 55144 - protein, 9 aa, Mycobacterium avium
PPPKLGEHN

SEQ ID NO: 55145 - protein, 9 aa, Mycobacterium avium
PPPPSDPHR

SEQ ID NO: 55146 - protein, 5 aa, Mycobacterium avium
PPPQW

SEQ ID NO: 55147 - protein, 9 aa, Mycobacterium avium
PPPYAPSFA

SEQ ID NO: 55148 - protein, 4 aa, Mycobacterium avium
PPQG

SEQ ID NO: 55149 - protein, 9 aa, Mycobacterium avium
PPQPTPIPR

SEQ ID NO: 55150 - protein, 4 aa, Mycobacterium avium
PPRG

SEQ ID NO: 55151 - protein, 4 aa, Mycobacterium avium
PPRK

SEQ ID NO: 55152 - protein, 7 aa, Mycobacterium avium
PPRPGGI

SEQ ID NO: 55153 - protein, 22 aa, Mycobacterium avium
PPRQQDNGGRTWRTAPRAVVKQ

SEQ ID NO: 55154 - protein, 13 aa, Mycobacterium avium
PPRRQPPKTVPPL

SEQ ID NO: 55155 - protein, 17 aa, Mycobacterium avium
PPRRRGPRGSRCSRAGA

SEQ ID NO: 55156 - protein, 6 aa, Mycobacterium avium
PPSEHK

SEQ ID NO: 55157 - protein, 7 aa, Mycobacterium avium
PPSGRGV

SEQ ID NO: 55158 - protein, 4 aa, Mycobacterium avium
PPTF

SEQ ID NO: 55159 - protein, 6 aa, Mycobacterium avium
PPTPWS

SEQ ID NO: 55160 - protein, 5 aa, Mycobacterium avium
PPTRR

SEQ ID NO: 55161 - protein, 7 aa, Mycobacterium avium
PPTSSAH

SEQ ID NO: 55162 - protein, 11 aa, Mycobacterium avium
PPVDASPARRW

SEQ ID NO: 55163 - protein, 4 aa, Mycobacterium avium
PPVE

SEQ ID NO: 55164 - protein, 6 aa, Mycobacterium avium
PPYDVG

SEQ ID NO: 55165 - protein, 6 aa, Mycobacterium avium
PQAAER

SEQ ID NO: 55166 - protein, 5 aa, Mycobacterium avium
PQDGA

SEQ ID NO: 55167 - protein, 9 aa, Mycobacterium avium
PQDPKEGDL

SEQ ID NO: 55168 - protein, 6 aa, Mycobacterium avium
PQEQRE

SEQ ID NO: 55169 - protein, 13 aa, Mycobacterium avium
PQFDDPSLNSGGQ

SEQ ID NO: 55170 - protein, 5 aa, Mycobacterium avium
PQFPG

SEQ ID NO: 55171 - protein, 6 aa, Mycobacterium avium
PQGALS

SEQ ID NO: 55172 - protein, 8 aa, Mycobacterium avium
PQGDPLPA

SEQ ID NO: 55173 - protein, 4 aa, Mycobacterium avium
PQGG

SEQ ID NO: 55174 - protein, 5 aa, Mycobacterium avium
PQGHP

SEQ ID NO: 55175 - protein, 8 aa, Mycobacterium avium
PQHAPQYN

SEQ ID NO: 55176 - protein, 6 aa, Mycobacterium avium
PQHTST

SEQ ID NO: 55177 - protein, 10 aa, Mycobacterium avium
PQKMSPAAMD

SEQ ID NO: 55178 - protein, 7 aa, Mycobacterium avium
PQLGEHR

SEQ ID NO: 55179 - protein, 7 aa, Mycobacterium avium
PQPDGTP

SEQ ID NO: 55180 - protein, 10 aa, Mycobacterium avium
PQPFKQPAAG

SEQ ID NO: 55181 - protein, 5 aa, Mycobacterium avium
PQPIH

SEQ ID NO: 55182 - protein, 6 aa, Mycobacterium avium
PQPVDT

SEQ ID NO: 55183 - protein, 7 aa, Mycobacterium avium
PQQRNPA

SEQ ID NO: 55184 - protein, 7 aa, Mycobacterium avium
PQSEGLA

SEQ ID NO: 55185 - protein, 5 aa, Mycobacterium avium
PQSVN

SEQ ID NO: 55186 - protein, 4 aa, Mycobacterium avium
PQTT

SEQ ID NO: 55187 - protein, 5 aa, Mycobacterium avium
PRAEA

SEQ ID NO: 55188 - protein, 5 aa, Mycobacterium avium
PRAPA

SEQ ID NO: 55189 - protein, 7 aa, Mycobacterium avium
PRDDDSL

SEQ ID NO: 55190 - protein, 6 aa, Mycobacterium avium
PRDEQQ

SEQ ID NO: 55191 - protein, 7 aa, Mycobacterium avium
PRDKDPD

SEQ ID NO: 55192 - protein, 8 aa, Mycobacterium avium
PRDPHDAD

SEQ ID NO: 55193 - protein, 5 aa, Mycobacterium avium
PRDSL

SEQ ID NO: 55194 - protein, 10 aa, Mycobacterium avium
PRDTRRTTDN

SEQ ID NO: 55195 - protein, 4 aa, Mycobacterium avium
PREA

SEQ ID NO: 55196 - protein, 7 aa, Mycobacterium avium
PREAPID

SEQ ID NO: 55197 - protein, 7 aa, Mycobacterium avium
PREESPF

SEQ ID NO: 55198 - protein, 9 aa, Mycobacterium avium
PREPADPAL

SEQ ID NO: 55199 - protein, 7 aa, Mycobacterium avium
PREPAEG

SEQ ID NO: 55200 - protein, 13 aa, Mycobacterium avium
PREPEPDGAALGR

SEQ ID NO: 55201 - protein, 9 aa, Mycobacterium avium
PRERPSFGG

SEQ ID NO: 55202 - protein, 11 aa, Mycobacterium avium
PRFSSASGTVE

SEQ ID NO: 55203 - protein, 15 aa, Mycobacterium avium
PRGARVATPQQRRAY

SEQ ID NO: 55204 - protein, 5 aa, Mycobacterium avium
PRGHR

SEQ ID NO: 55205 - protein, 6 aa, Mycobacterium avium
PRGPRD

SEQ ID NO: 55206 - protein, 6 aa, Mycobacterium avium
PRGRAA

SEQ ID NO: 55207 - protein, 11 aa, Mycobacterium avium
PRGTERPERTA

SEQ ID NO: 55208 - protein, 11 aa, Mycobacterium avium
PRGVGHSTPPL

SEQ ID NO: 55209 - protein, 5 aa, Mycobacterium avium
PRKAR

SEQ ID NO: 55210 - protein, 5 aa, Mycobacterium avium
PRKSL

SEQ ID NO: 55211 - protein, 6 aa, Mycobacterium avium
PRLDNQ

SEQ ID NO: 55212 - protein, 14 aa, Mycobacterium avium
PRNDTGYGHTPEDV

SEQ ID NO: 55213 - protein, 7 aa, Mycobacterium avium
PRNGETD

SEQ ID NO: 55214 - protein, 17 aa, Mycobacterium avium
PRNGSAVQSGGVGVIDA

SEQ ID NO: 55215 - protein, 7 aa, Mycobacterium avium
PRNPAGK

SEQ ID NO: 55216 - protein, 14 aa, Mycobacterium avium
PRPIPERKGSTNDN

SEQ ID NO: 55217 - protein, 6 aa, Mycobacterium avium
PRPTAL

SEQ ID NO: 55218 - protein, 10 aa, Mycobacterium avium
PRQRGPRRRP

SEQ ID NO: 55219 - protein, 8 aa, Mycobacterium avium
PRRAATAA

SEQ ID NO: 55220 - protein, 24 aa, Mycobacterium avium
PRRAHRGQVDGTPEDGDSLYDVVD

SEQ ID NO: 55221 - protein, 20 aa, Mycobacterium avium
PRRANDDESPGPLLQLVTKP

SEQ ID NO: 55222 - protein, 8 aa, Mycobacterium avium
PRREPKRT

SEQ ID NO: 55223 - protein, 8 aa, Mycobacterium avium
PRRGIGDR

SEQ ID NO: 55224 - protein, 13 aa, Mycobacterium avium
PRRGYAIEQEAKT

SEQ ID NO: 55225 - protein, 10 aa, Mycobacterium avium
PRRITPGAKR

SEQ ID NO: 55226 - protein, 27 aa, Mycobacterium avium
PRRPAPAAAARTASGSVAVPGARARVA

SEQ ID NO: 55227 - protein, 5 aa, Mycobacterium avium
PRRRA

SEQ ID NO: 55228 - protein, 10 aa, Mycobacterium avium
PRRSAPDGSN

SEQ ID NO: 55229 - protein, 11 aa, Mycobacterium avium
PRSGELPADPG

SEQ ID NO: 55230 - protein, 7 aa, Mycobacterium avium
PRSSGVG

SEQ ID NO: 55231 - protein, 19 aa, Mycobacterium avium
PRTEPDAPEVISAIEAVLP

SEQ ID NO: 55232 - protein, 5 aa, Mycobacterium avium
PRTGT

SEQ ID NO: 55233 - protein, 15 aa, Mycobacterium avium
PRTPTGRASRSNLGS

SEQ ID NO: 55234 - protein, 14 aa, Mycobacterium avium
PRTPTSEHSRPSSI

SEQ ID NO: 55235 - protein, 15 aa, Mycobacterium avium
PRTSPQASRWSPERA

SEQ ID NO: 55236 - protein, 4 aa, Mycobacterium avium
PRVA

SEQ ID NO: 55237 - protein, 9 aa, Mycobacterium avium
PRVPPTRPG

SEQ ID NO: 55238 - protein, 6 aa, Mycobacterium avium
PRVRGG

SEQ ID NO: 55239 - protein, 8 aa, Mycobacterium avium
PRWGKPEE

SEQ ID NO: 55240 - protein, 6 aa, Mycobacterium avium
PRYGEH

SEQ ID NO: 55241 - protein, 4 aa, Mycobacterium avium
PSAA

SEQ ID NO: 55242 - protein, 7 aa, Mycobacterium avium
PSAAKMS

SEQ ID NO: 55243 - protein, 18 aa, Mycobacterium avium
PSAPAGRGLSAAQRRRRA

SEQ ID NO: 55244 - protein, 31 aa, Mycobacterium avium
PSAPYEGPPPGPGDLPAIDASPVRAYDEAAE

SEQ ID NO: 55245 - protein, 7 aa, Mycobacterium avium
PSARSEA

SEQ ID NO: 55246 - protein, 7 aa, Mycobacterium avium
PSCSTGH

SEQ ID NO: 55247 - protein, 4 aa, Mycobacterium avium
PSDN

SEQ ID NO: 55248 - protein, 9 aa, Mycobacterium avium
PSDNAPADY

SEQ ID NO: 55249 - protein, 4 aa, Mycobacterium avium
PSER

SEQ ID NO: 55250 - protein, 7 aa, Mycobacterium avium
PSGDGVR

SEQ ID NO: 55251 - protein, 4 aa, Mycobacterium avium
PSGG

SEQ ID NO: 55252 - protein, 18 aa, Mycobacterium avium
PSGGAAQLTQEAESAQRR

SEQ ID NO: 55253 - protein, 4 aa, Mycobacterium avium
PSGK

SEQ ID NO: 55254 - protein, 10 aa, Mycobacterium avium
PSGLSPDDDL

SEQ ID NO: 55255 - protein, 7 aa, Mycobacterium avium
PSGPISE

SEQ ID NO: 55256 - protein, 4 aa, Mycobacterium avium
PSGQ

SEQ ID NO: 55257 - protein, 6 aa, Mycobacterium avium
PSGTEP

SEQ ID NO: 55258 - protein, 7 aa, Mycobacterium avium
PSGVTAD

SEQ ID NO: 55259 - protein, 5 aa, Mycobacterium avium
PSHEP

SEQ ID NO: 55260 - protein, 4 aa, Mycobacterium avium
PSIP

SEQ ID NO: 55261 - protein, 5 aa, Mycobacterium avium
PSLPP

SEQ ID NO: 55262 - protein, 9 aa, Mycobacterium avium
PSLSGTRVQ

SEQ ID NO: 55263 - protein, 6 aa, Mycobacterium avium
PSLTTV

SEQ ID NO: 55264 - protein, 4 aa, Mycobacterium avium
PSNR

SEQ ID NO: 55265 - protein, 4 aa, Mycobacterium avium
PSNV

SEQ ID NO: 55266 - protein, 13 aa, Mycobacterium avium
PSPASPELPPDTR

SEQ ID NO: 55267 - protein, 8 aa, Mycobacterium avium
PSPGGPKE

SEQ ID NO: 55268 - protein, 10 aa, Mycobacterium avium
PSPLSSGSAK

SEQ ID NO: 55269 - protein, 7 aa, Mycobacterium avium
PSPLTPL

SEQ ID NO: 55270 - protein, 6 aa, Mycobacterium avium
PSPQRT

SEQ ID NO: 55271 - protein, 21 aa, Mycobacterium avium
PSQATIPEPQALDDDPARDEY

SEQ ID NO: 55272 - protein, 9 aa, Mycobacterium avium
PSQEESDGA

SEQ ID NO: 55273 - protein, 13 aa, Mycobacterium avium
PSQIRSASRAQRA

SEQ ID NO: 55274 - protein, 5 aa, Mycobacterium avium
PSQPV

SEQ ID NO: 55275 - protein, 6 aa, Mycobacterium avium
PSRLRD

SEQ ID NO: 55276 - protein, 7 aa, Mycobacterium avium
PSRQRRH

SEQ ID NO: 55277 - protein, 11 aa, Mycobacterium avium
PSSLPSARESA

SEQ ID NO: 55278 - protein, 10 aa, Mycobacterium avium
PSSPEREQEY

SEQ ID NO: 55279 - protein, 8 aa, Mycobacterium avium
PSSPFSGG

SEQ ID NO: 55280 - protein, 22 aa, Mycobacterium avium
PSSSRPQERQGPVEHETETDAQ

SEQ ID NO: 55281 - protein, 7 aa, Mycobacterium avium
PSSTAMA

SEQ ID NO: 55282 - protein, 4 aa, Mycobacterium avium
PSTM

SEQ ID NO: 55283 - protein, 6 aa, Mycobacterium avium
PSYGGS

SEQ ID NO: 55284 - protein, 5 aa, Mycobacterium avium
PSYLP

SEQ ID NO: 55285 - protein, 18 aa, Mycobacterium avium
PTAAAAEKVRQAPASPVP

SEQ ID NO: 55286 - protein, 8 aa, Mycobacterium avium
PTAADDVR

SEQ ID NO: 55287 - protein, 5 aa, Mycobacterium avium
PTAEQ

SEQ ID NO: 55288 - protein, 5 aa, Mycobacterium avium
PTAFP

SEQ ID NO: 55289 - protein, 7 aa, Mycobacterium avium
PTAGETF

SEQ ID NO: 55290 - protein, 6 aa, Mycobacterium avium
PTALRG

SEQ ID NO: 55291 - protein, 4 aa, Mycobacterium avium
PTAP

SEQ ID NO: 55292 - protein, 18 aa, Mycobacterium avium
PTARDEESRDDPSKNPDY

SEQ ID NO: 55293 - protein, 8 aa, Mycobacterium avium
PTATQAEI

SEQ ID NO: 55294 - protein, 4 aa, Mycobacterium avium
PTAV

SEQ ID NO: 55295 - protein, 12 aa, Mycobacterium avium
PTDEHGDPDGEA

SEQ ID NO: 55296 - protein, 4 aa, Mycobacterium avium
PTDR

SEQ ID NO: 55297 - protein, 8 aa, Mycobacterium avium
PTDRPYPA

SEQ ID NO: 55298 - protein, 7 aa, Mycobacterium avium
PTEEPAA

SEQ ID NO: 55299 - protein, 4 aa, Mycobacterium avium
PTEI

SEQ ID NO: 55300 - protein, 6 aa, Mycobacterium avium
PTEPGG

SEQ ID NO: 55301 - protein, 8 aa, Mycobacterium avium
PTEPTPRR

SEQ ID NO: 55302 - protein, 8 aa, Mycobacterium avium
PTESDDDV

SEQ ID NO: 55303 - protein, 5 aa, Mycobacterium avium
PTETT

SEQ ID NO: 55304 - protein, 15 aa, Mycobacterium avium
PTFRPRGKVGVLFPS

SEQ ID NO: 55305 - protein, 5 aa, Mycobacterium avium
PTFTD

SEQ ID NO: 55306 - protein, 6 aa, Mycobacterium avium
PTGAFS

SEQ ID NO: 55307 - protein, 17 aa, Mycobacterium avium
PTGAVSPAKPDTEHRCG

SEQ ID NO: 55308 - protein, 15 aa, Mycobacterium avium
PTGEPDADYDTYKHH

SEQ ID NO: 55309 - protein, 10 aa, Mycobacterium avium
PTGGNSEQAT

SEQ ID NO: 55310 - protein, 5 aa, Mycobacterium avium
PTGVD

SEQ ID NO: 55311 - protein, 45 aa, Mycobacterium avium
PTIGSGTGMGSGAQRKASEPDPAAAAAPAGASASERARARRRRRA

SEQ ID NO: 55312 - protein, 15 aa, Mycobacterium avium
PTKNIDGTHPIASPT

SEQ ID NO: 55313 - protein, 7 aa, Mycobacterium avium
PTLAQST

SEQ ID NO: 55314 - protein, 11 aa, Mycobacterium avium
PTLPEETGTLP

SEQ ID NO: 55315 - protein, 5 aa, Mycobacterium avium
PTNDQ

SEQ ID NO: 55316 - protein, 9 aa, Mycobacterium avium
PTNGGSVNA

SEQ ID NO: 55317 - protein, 8 aa, Mycobacterium avium
PTNRRVAG

SEQ ID NO: 55318 - protein, 7 aa, Mycobacterium avium
PTPAEAC

SEQ ID NO: 55319 - protein, 18 aa, Mycobacterium avium
PTPHATAEQVEAARHDSK

SEQ ID NO: 55320 - protein, 5 aa, Mycobacterium avium
PTPLS

SEQ ID NO: 55321 - protein, 7 aa, Mycobacterium avium
PTPPEGD

SEQ ID NO: 55322 - protein, 15 aa, Mycobacterium avium
PTPRRPSDDQRRTAR

SEQ ID NO: 55323 - protein, 12 aa, Mycobacterium avium
PTPSATAAASAA

SEQ ID NO: 55324 - protein, 4 aa, Mycobacterium avium
PTQD

SEQ ID NO: 55325 - protein, 4 aa, Mycobacterium avium
PTRA

SEQ ID NO: 55326 - protein, 19 aa, Mycobacterium avium
PTRTLDGEGDFSGPRQAPN

SEQ ID NO: 55327 - protein, 7 aa, Mycobacterium avium
PTRYGSA

SEQ ID NO: 55328 - protein, 7 aa, Mycobacterium avium
PTSGTIS

SEQ ID NO: 55329 - protein, 6 aa, Mycobacterium avium
PTSNIH

SEQ ID NO: 55330 - protein, 6 aa, Mycobacterium avium
PTSPQY

SEQ ID NO: 55331 - protein, 15 aa, Mycobacterium avium
PTSPRRWGPRGPAPH

SEQ ID NO: 55332 - protein, 11 aa, Mycobacterium avium
PTSQASVQRPY

SEQ ID NO: 55333 - protein, 6 aa, Mycobacterium avium
PTTADG

SEQ ID NO: 55334 - protein, 19 aa, Mycobacterium avium
PTTAIDPRLSPAKRDAGDL

SEQ ID NO: 55335 - protein, 10 aa, Mycobacterium avium
PTTHTLDGSE

SEQ ID NO: 55336 - protein, 10 aa, Mycobacterium avium
PTTPDQAEHA

SEQ ID NO: 55337 - protein, 4 aa, Mycobacterium avium
PTTR

SEQ ID NO: 55338 - protein, 9 aa, Mycobacterium avium
PTVDADTTV

SEQ ID NO: 55339 - protein, 8 aa, Mycobacterium avium
PTVQQPNS

SEQ ID NO: 55340 - protein, 5 aa, Mycobacterium avium
PTVSP

SEQ ID NO: 55341 - protein, 6 aa, Mycobacterium avium
PTYPQD

SEQ ID NO: 55342 - protein, 18 aa, Mycobacterium avium
PVAGPAITPPNTRTGAPR

SEQ ID NO: 55343 - protein, 12 aa, Mycobacterium avium
PVETPHAAANPL

SEQ ID NO: 55344 - protein, 10 aa, Mycobacterium avium
PVGPRDAAAP

SEQ ID NO: 55345 - protein, 18 aa, Mycobacterium avium
PVHPRAEGPGPDPSAPMY

SEQ ID NO: 55346 - protein, 9 aa, Mycobacterium avium
PVNEPSAAV

SEQ ID NO: 55347 - protein, 8 aa, Mycobacterium avium
PVNPSGGV

SEQ ID NO: 55348 - protein, 6 aa, Mycobacterium avium
PVNSRV

SEQ ID NO: 55349 - protein, 12 aa, Mycobacterium avium
PVPAAGQDEPYW

SEQ ID NO: 55350 - protein, 9 aa, Mycobacterium avium
PVPAARTSI

SEQ ID NO: 55351 - protein, 8 aa, Mycobacterium avium
PVPANEPV

SEQ ID NO: 55352 - protein, 6 aa, Mycobacterium avium
PVPDAA

SEQ ID NO: 55353 - protein, 6 aa, Mycobacterium avium
PVPDPD

SEQ ID NO: 55354 - protein, 5 aa, Mycobacterium avium
PVPEV

SEQ ID NO: 55355 - protein, 8 aa, Mycobacterium avium
PVPHASSP

SEQ ID NO: 55356 - protein, 13 aa, Mycobacterium avium
PVPNPDAALQPGQ

SEQ ID NO: 55357 - protein, 4 aa, Mycobacterium avium
PVRV

SEQ ID NO: 55358 - protein, 13 aa, Mycobacterium avium
PVRVDDDGPLPED

SEQ ID NO: 55359 - protein, 5 aa, Mycobacterium avium
PVSEY

SEQ ID NO: 55360 - protein, 7 aa, Mycobacterium avium
PVSTPFP

SEQ ID NO: 55361 - protein, 7 aa, Mycobacterium avium
PVYGGES

SEQ ID NO: 55362 - protein, 14 aa, Mycobacterium avium
PWAPRSAAPELGQH

SEQ ID NO: 55363 - protein, 9 aa, Mycobacterium avium
PWGRGAGPV

SEQ ID NO: 55364 - protein, 7 aa, Mycobacterium avium
PWGTPST

SEQ ID NO: 55365 - protein, 10 aa, Mycobacterium avium
PWPKTSGSRG

SEQ ID NO: 55366 - protein, 13 aa, Mycobacterium avium
PWQGYGGRQKPSW

SEQ ID NO: 55367 - protein, 12 aa, Mycobacterium avium
PWQRGTNENTNG

SEQ ID NO: 55368 - protein, 12 aa, Mycobacterium avium
PWRGPGDIATNT

SEQ ID NO: 55369 - protein, 4 aa, Mycobacterium avium
PWVG

SEQ ID NO: 55370 - protein, 13 aa, Mycobacterium avium
PYAPQGVAKPVNG

SEQ ID NO: 55371 - protein, 10 aa, Mycobacterium avium
PYKEATAAQL

SEQ ID NO: 55372 - protein, 4 aa, Mycobacterium avium
PYNG

SEQ ID NO: 55373 - protein, 5 aa, Mycobacterium avium
PYPDQ

SEQ ID NO: 55374 - protein, 11 aa, Mycobacterium avium
PYPQTAPPQRP

SEQ ID NO: 55375 - protein, 4 aa, Mycobacterium avium
PYPT

SEQ ID NO: 55376 - protein, 5 aa, Mycobacterium avium
PYRGV

SEQ ID NO: 55377 - protein, 11 aa, Mycobacterium avium
PYSAQSAGPPP

SEQ ID NO: 55378 - protein, 10 aa, Mycobacterium avium
PYSREQAAYP

SEQ ID NO: 55379 - protein, 10 aa, Mycobacterium avium
QAAAADGLPL

SEQ ID NO: 55380 - protein, 10 aa, Mycobacterium avium
QAADESANTA

SEQ ID NO: 55381 - protein, 14 aa, Mycobacterium avium
QAAEDAWNTRDPEH

SEQ ID NO: 55382 - protein, 5 aa, Mycobacterium avium
QAAGD

SEQ ID NO: 55383 - protein, 7 aa, Mycobacterium avium
QAAGMDG

SEQ ID NO: 55384 - protein, 9 aa, Mycobacterium avium
QAAGPEDVD

SEQ ID NO: 55385 - protein, 14 aa, Mycobacterium avium
QAAIDEARQEAERE

SEQ ID NO: 55386 - protein, 5 aa, Mycobacterium avium
QAAKL

SEQ ID NO: 55387 - protein, 17 aa, Mycobacterium avium
QAARRVPNGGASPSQSE

SEQ ID NO: 55388 - protein, 8 aa, Mycobacterium avium
QAARTPDA

SEQ ID NO: 55389 - protein, 8 aa, Mycobacterium avium
QAASDGAA

SEQ ID NO: 55390 - protein, 9 aa, Mycobacterium avium
QADARGPES

SEQ ID NO: 55391 - protein, 12 aa, Mycobacterium avium
QADDHRKRHGGN

SEQ ID NO: 55392 - protein, 7 aa, Mycobacterium avium
QADGSVT

SEQ ID NO: 55393 - protein, 9 aa, Mycobacterium avium
QADHTAHAE

SEQ ID NO: 55394 - protein, 4 aa, Mycobacterium avium
QAEA

SEQ ID NO: 55395 - protein, 12 aa, Mycobacterium avium
QAGDALAGPTGW

SEQ ID NO: 55396 - protein, 12 aa, Mycobacterium avium
QAGDASDPALQD

SEQ ID NO: 55397 - protein, 7 aa, Mycobacterium avium
QAGDRLD

SEQ ID NO: 55398 - protein, 13 aa, Mycobacterium avium
QAGNHDVSDRGAA

SEQ ID NO: 55399 - protein, 6 aa, Mycobacterium avium
QAGPDE

SEQ ID NO: 55400 - protein, 5 aa, Mycobacterium avium
QAGPE

SEQ ID NO: 55401 - protein, 4 aa, Mycobacterium avium
QAGR

SEQ ID NO: 55402 - protein, 8 aa, Mycobacterium avium
QAGRPAQI

SEQ ID NO: 55403 - protein, 17 aa, Mycobacterium avium
QAGTTRMSASPKDGVVD

SEQ ID NO: 55404 - protein, 4 aa, Mycobacterium avium
QAGV

SEQ ID NO: 55405 - protein, 4 aa, Mycobacterium avium
QAHG

SEQ ID NO: 55406 - protein, 15 aa, Mycobacterium avium
QAKTSRVIPLFELIR

SEQ ID NO: 55407 - protein, 15 aa, Mycobacterium avium
QAKVSQSVAQEELGR

SEQ ID NO: 55408 - protein, 7 aa, Mycobacterium avium
QAPDRTI

SEQ ID NO: 55409 - protein, 9 aa, Mycobacterium avium
QAPDSGNSE

SEQ ID NO: 55410 - protein, 9 aa, Mycobacterium avium
QAPEPGSVR

SEQ ID NO: 55411 - protein, 6 aa, Mycobacterium avium
QAPIPQ

SEQ ID NO: 55412 - protein, 7 aa, Mycobacterium avium
QAPPQLR

SEQ ID NO: 55413 - protein, 6 aa, Mycobacterium avium
QAQKLS

SEQ ID NO: 55414 - protein, 5 aa, Mycobacterium avium
QAQPA

SEQ ID NO: 55415 - protein, 8 aa, Mycobacterium avium
QAQPTLDA

SEQ ID NO: 55416 - protein, 10 aa, Mycobacterium avium
QAQRFREGEV

SEQ ID NO: 55417 - protein, 9 aa, Mycobacterium avium
QARAETDAE

SEQ ID NO: 55418 - protein, 6 aa, Mycobacterium avium
QARDAL

SEQ ID NO: 55419 - protein, 7 aa, Mycobacterium avium
QAREDPR

SEQ ID NO: 55420 - protein, 9 aa, Mycobacterium avium
QARGLPATG

SEQ ID NO: 55421 - protein, 22 aa, Mycobacterium avium
QARHDSALAGAAAAALGNPPQV

SEQ ID NO: 55422 - protein, 7 aa, Mycobacterium avium
QARTGMG

SEQ ID NO: 55423 - protein, 9 aa, Mycobacterium avium
QASPAELGG

SEQ ID NO: 55424 - protein, 9 aa, Mycobacterium avium
QATKGRAPF

SEQ ID NO: 55425 - protein, 12 aa, Mycobacterium avium
QATSTDDAEGDV

SEQ ID NO: 55426 - protein, 7 aa, Mycobacterium avium
QATSWSA

SEQ ID NO: 55427 - protein, 8 aa, Mycobacterium avium
QATTPALD

SEQ ID NO: 55428 - protein, 9 aa, Mycobacterium avium
QAVDPDGEV

SEQ ID NO: 55429 - protein, 6 aa, Mycobacterium avium
QAWAQG

SEQ ID NO: 55430 - protein, 6 aa, Mycobacterium avium
QAYEAG

SEQ ID NO: 55431 - protein, 6 aa, Mycobacterium avium
QAYSSA

SEQ ID NO: 55432 - protein, 10 aa, Mycobacterium avium
QCGSRTPALD

SEQ ID NO: 55433 - protein, 14 aa, Mycobacterium avium
QCGYDSDDPEFGEE

SEQ ID NO: 55434 - protein, 8 aa, Mycobacterium avium
QDAGLPGE

SEQ ID NO: 55435 - protein, 4 aa, Mycobacterium avium
QDAP

SEQ ID NO: 55436 - protein, 7 aa, Mycobacterium avium
QDDKDAE

SEQ ID NO: 55437 - protein, 22 aa, Mycobacterium avium
QDDPAAGAAASAARIATTTCDQ

SEQ ID NO: 55438 - protein, 10 aa, Mycobacterium avium
QDDRDKIPGA

SEQ ID NO: 55439 - protein, 9 aa, Mycobacterium avium
QDERPTEQK

SEQ ID NO: 55440 - protein, 9 aa, Mycobacterium avium
QDGGHSLGS

SEQ ID NO: 55441 - protein, 11 aa, Mycobacterium avium
QDGGNLYGPGG

SEQ ID NO: 55442 - protein, 4 aa, Mycobacterium avium
QDGS

SEQ ID NO: 55443 - protein, 11 aa, Mycobacterium avium
QDKKHRGREPI

SEQ ID NO: 55444 - protein, 21 aa, Mycobacterium avium
QDNPSSTTATPGRYGNPAAAA

SEQ ID NO: 55445 - protein, 8 aa, Mycobacterium avium
QDNQQLGG

SEQ ID NO: 55446 - protein, 19 aa, Mycobacterium avium
QDPEATVTAGNASGQNDAA

SEQ ID NO: 55447 - protein, 10 aa, Mycobacterium avium
QDPHNSDRRF

SEQ ID NO: 55448 - protein, 22 aa, Mycobacterium avium
QDQQLQRRAGQPSAGDAPPATV

SEQ ID NO: 55449 - protein, 8 aa, Mycobacterium avium
QDRAAAQA

SEQ ID NO: 55450 - protein, 8 aa, Mycobacterium avium
QDRSAAQA

SEQ ID NO: 55451 - protein, 7 aa, Mycobacterium avium
QDSITGA

SEQ ID NO: 55452 - protein, 5 aa, Mycobacterium avium
QDTDP

SEQ ID NO: 55453 - protein, 11 aa, Mycobacterium avium
QDYRSTTTREI

SEQ ID NO: 55454 - protein, 7 aa, Mycobacterium avium
QEAQRTV

SEQ ID NO: 55455 - protein, 6 aa, Mycobacterium avium
QEARAA

SEQ ID NO: 55456 - protein, 7 aa, Mycobacterium avium
QEDPVRA

SEQ ID NO: 55457 - protein, 10 aa, Mycobacterium avium
QEGSGLSKEE

SEQ ID NO: 55458 - protein, 7 aa, Mycobacterium avium
QEHEPEA

SEQ ID NO: 55459 - protein, 5 aa, Mycobacterium avium
QEHRT

SEQ ID NO: 55460 - protein, 4 aa, Mycobacterium avium
QELG

SEQ ID NO: 55461 - protein, 9 aa, Mycobacterium avium
QELPTTTPD

SEQ ID NO: 55462 - protein, 6 aa, Mycobacterium avium
QENRSL

SEQ ID NO: 55463 - protein, 8 aa, Mycobacterium avium
QEPGTPEE

SEQ ID NO: 55464 - protein, 12 aa, Mycobacterium avium
QEPIPARGQGPD

SEQ ID NO: 55465 - protein, 6 aa, Mycobacterium avium
QERGSR

SEQ ID NO: 55466 - protein, 10 aa, Mycobacterium avium
QERKPDDAAA

SEQ ID NO: 55467 - protein, 10 aa, Mycobacterium avium
QERYGDLDPA

SEQ ID NO: 55468 - protein, 10 aa, Mycobacterium avium
QESGHRDGAV

SEQ ID NO: 55469 - protein, 7 aa, Mycobacterium avium
QFSAEGQ

SEQ ID NO: 55470 - protein, 9 aa, Mycobacterium avium
QFTTPDGDS

SEQ ID NO: 55471 - protein, 7 aa, Mycobacterium avium
QGAAPGE

SEQ ID NO: 55472 - protein, 15 aa, Mycobacterium avium
QGAGHAASGYAHATG

SEQ ID NO: 55473 - protein, 6 aa, Mycobacterium avium
QGERNY

SEQ ID NO: 55474 - protein, 7 aa, Mycobacterium avium
QGGEVSH

SEQ ID NO: 55475 - protein, 11 aa, Mycobacterium avium
QGGGATASAAE

SEQ ID NO: 55476 - protein, 14 aa, Mycobacterium avium
QGGTSRPADVPERT

SEQ ID NO: 55477 - protein, 8 aa, Mycobacterium avium
QGITGTAR

SEQ ID NO: 55478 - protein, 23 aa, Mycobacterium avium
QGKPQTDVGTGAPVAAMASEEGR

SEQ ID NO: 55479 - protein, 6 aa, Mycobacterium avium
QGLDTS

SEQ ID NO: 55480 - protein, 5 aa, Mycobacterium avium
QGLGG

SEQ ID NO: 55481 - protein, 15 aa, Mycobacterium avium
QGNGAEALRSRTYAD

SEQ ID NO: 55482 - protein, 7 aa, Mycobacterium avium
QGNPIRV

SEQ ID NO: 55483 - protein, 5 aa, Mycobacterium avium
QGNQW

SEQ ID NO: 55484 - protein, 7 aa, Mycobacterium avium
QGPASGY

SEQ ID NO: 55485 - protein, 15 aa, Mycobacterium avium
QGPGETVFLAYRTDE

SEQ ID NO: 55486 - protein, 7 aa, Mycobacterium avium
QGPRSAD

SEQ ID NO: 55487 - protein, 9 aa, Mycobacterium avium
QGPSRPSEW

SEQ ID NO: 55488 - protein, 10 aa, Mycobacterium avium
QGPTENGHRP

SEQ ID NO: 55489 - protein, 10 aa, Mycobacterium avium
QGPTPKPVTE

SEQ ID NO: 55490 - protein, 6 aa, Mycobacterium avium
QGQGGS

SEQ ID NO: 55491 - protein, 6 aa, Mycobacterium avium
QGRAAA

SEQ ID NO: 55492 - protein, 13 aa, Mycobacterium avium
QGRDAAESPLTTR

SEQ ID NO: 55493 - protein, 4 aa, Mycobacterium avium
QGRF

SEQ ID NO: 55494 - protein, 4 aa, Mycobacterium avium
QGRK

SEQ ID NO: 55495 - protein, 15 aa, Mycobacterium avium
QGRYPNQLSGGQRQR

SEQ ID NO: 55496 - protein, 4 aa, Mycobacterium avium
QGSA

SEQ ID NO: 55497 - protein, 18 aa, Mycobacterium avium
QGSGSIVNTSSGGSLGTD

SEQ ID NO: 55498 - protein, 7 aa, Mycobacterium avium
QGSQTLG

SEQ ID NO: 55499 - protein, 15 aa, Mycobacterium avium
QGTRLDDAPDRAAEV

SEQ ID NO: 55500 - protein, 9 aa, Mycobacterium avium
QGVEPPRPL

SEQ ID NO: 55501 - protein, 14 aa, Mycobacterium avium
QGVPLASGSVNARL

SEQ ID NO: 55502 - protein, 5 aa, Mycobacterium avium
QGWQP

SEQ ID NO: 55503 - protein, 12 aa, Mycobacterium avium
QGYPRAADISGG

SEQ ID NO: 55504 - protein, 15 aa, Mycobacterium avium
QHATASGKPNADCDP

SEQ ID NO: 55505 - protein, 6 aa, Mycobacterium avium
QHDDYA

SEQ ID NO: 55506 - protein, 7 aa, Mycobacterium avium
QHPDRTV

SEQ ID NO: 55507 - protein, 5 aa, Mycobacterium avium
QHPHG

SEQ ID NO: 55508 - protein, 18 aa, Mycobacterium avium
QHRPPPPRRGRATGWQNT

SEQ ID NO: 55509 - protein, 4 aa, Mycobacterium avium
QHTG

SEQ ID NO: 55510 - protein, 13 aa, Mycobacterium avium
QIGSPTEVYDAPT

SEQ ID NO: 55511 - protein, 8 aa, Mycobacterium avium
QIGTGAAR

SEQ ID NO: 55512 - protein, 6 aa, Mycobacterium avium
QITGRD

SEQ ID NO: 55513 - protein, 63 aa, Mycobacterium avium
QKARKRSEELAEEAAERGKPLAKKARKRSEKLAKKARKRSEKLAGTARVRGEELAETARQRGS

SEQ ID NO: 55514 - protein, 6 aa, Mycobacterium avium
QKDREA

SEQ ID NO: 55515 - protein, 12 aa, Mycobacterium avium
QKGGVAKTTTVA

SEQ ID NO: 55516 - protein, 8 aa, Mycobacterium avium
QKQVTETA

SEQ ID NO: 55517 - protein, 29 aa, Mycobacterium avium
QLAPGTAAPVAAASRPALPTGPLTSASAA

SEQ ID NO: 55518 - protein, 17 aa, Mycobacterium avium
QLAPRDDEERQKAIDAG

SEQ ID NO: 55519 - protein, 7 aa, Mycobacterium avium
QLASTSA

SEQ ID NO: 55520 - protein, 12 aa, Mycobacterium avium
QLDYRGRADEQV

SEQ ID NO: 55521 - protein, 13 aa, Mycobacterium avium
QLGGRRTTSTTIP

SEQ ID NO: 55522 - protein, 12 aa, Mycobacterium avium
QLGKGDPAKKMP

SEQ ID NO: 55523 - protein, 7 aa, Mycobacterium avium
QLGSGHT

SEQ ID NO: 55524 - protein, 5 aa, Mycobacterium avium
QLKNN

SEQ ID NO: 55525 - protein, 9 aa, Mycobacterium avium
QLNNPPDPI

SEQ ID NO: 55526 - protein, 5 aa, Mycobacterium avium
QLPEG

SEQ ID NO: 55527 - protein, 8 aa, Mycobacterium avium
QLPGPTAT

SEQ ID NO: 55528 - protein, 15 aa, Mycobacterium avium
QLPRGSTAELRTATP

SEQ ID NO: 55529 - protein, 15 aa, Mycobacterium avium
QLRSPDGLGDAVGRS

SEQ ID NO: 55530 - protein, 12 aa, Mycobacterium avium
QLSSGELTGTRP

SEQ ID NO: 55531 - protein, 8 aa, Mycobacterium avium
QLSSRGAA

SEQ ID NO: 55532 - protein, 9 aa, Mycobacterium avium
QLTESGVPS

SEQ ID NO: 55533 - protein, 5 aa, Mycobacterium avium
QNAAS

SEQ ID NO: 55534 - protein, 6 aa, Mycobacterium avium
QNAPGV

SEQ ID NO: 55535 - protein, 20 aa, Mycobacterium avium
QNAQPPKPAEFSLRIGSLKG

SEQ ID NO: 55536 - protein, 7 aa, Mycobacterium avium
QNEVPSR

SEQ ID NO: 55537 - protein, 5 aa, Mycobacterium avium
QNFPE

SEQ ID NO: 55538 - protein, 7 aa, Mycobacterium avium
QNRGANF

SEQ ID NO: 55539 - protein, 21 aa, Mycobacterium avium
QNSRARLTSPLRRRPDGSYEE

SEQ ID NO: 55540 - protein, 10 aa, Mycobacterium avium
QNTKDASGAR

SEQ ID NO: 55541 - protein, 13 aa, Mycobacterium avium
QNTPAIAATEAEY

SEQ ID NO: 55542 - protein, 11 aa, Mycobacterium avium
QPAAATQSAFD

SEQ ID NO: 55543 - protein, 4 aa, Mycobacterium avium
QPAE

SEQ ID NO: 55544 - protein, 5 aa, Mycobacterium avium
QPAEA

SEQ ID NO: 55545 - protein, 4 aa, Mycobacterium avium
QPAM

SEQ ID NO: 55546 - protein, 8 aa, Mycobacterium avium
QPANPVND

SEQ ID NO: 55547 - protein, 8 aa, Mycobacterium avium
QPAPDNVD

SEQ ID NO: 55548 - protein, 11 aa, Mycobacterium avium
QPDLSPKARPR

SEQ ID NO: 55549 - protein, 9 aa, Mycobacterium avium
QPDNFGPYS

SEQ ID NO: 55550 - protein, 4 aa, Mycobacterium avium
QPEQ

SEQ ID NO: 55551 - protein, 5 aa, Mycobacterium avium
QPERQ

SEQ ID NO: 55552 - protein, 7 aa, Mycobacterium avium
QPETAAV

SEQ ID NO: 55553 - protein, 5 aa, Mycobacterium avium
QPGQA

SEQ ID NO: 55554 - protein, 15 aa, Mycobacterium avium
QPGYGLSDKRAEHGQ

SEQ ID NO: 55555 - protein, 4 aa, Mycobacterium avium
QPID

SEQ ID NO: 55556 - protein, 9 aa, Mycobacterium avium
QPLGGGREG

SEQ ID NO: 55557 - protein, 12 aa, Mycobacterium avium
QPLGGKAQFGGQ

SEQ ID NO: 55558 - protein, 12 aa, Mycobacterium avium
QPLGKDKDGNDV

SEQ ID NO: 55559 - protein, 7 aa, Mycobacterium avium
QPLTDAP

SEQ ID NO: 55560 - protein, 8 aa, Mycobacterium avium
QPNITRGN

SEQ ID NO: 55561 - protein, 4 aa, Mycobacterium avium
QPNR

SEQ ID NO: 55562 - protein, 9 aa, Mycobacterium avium
QPNRGKRSI

SEQ ID NO: 55563 - protein, 8 aa, Mycobacterium avium
QPPDHPAF

SEQ ID NO: 55564 - protein, 8 aa, Mycobacterium avium
QPPDLSAL

SEQ ID NO: 55565 - protein, 5 aa, Mycobacterium avium
QPPLQ

SEQ ID NO: 55566 - protein, 5 aa, Mycobacterium avium
QPPTH

SEQ ID NO: 55567 - protein, 10 aa, Mycobacterium avium
QPPTNPRAPG

SEQ ID NO: 55568 - protein, 8 aa, Mycobacterium avium
QPQRADRP

SEQ ID NO: 55569 - protein, 24 aa, Mycobacterium avium
QPRGPACAAPTPNRRSRSKQRNGR

SEQ ID NO: 55570 - protein, 6 aa, Mycobacterium avium
QPRRLA

SEQ ID NO: 55571 - protein, 8 aa, Mycobacterium avium
QPSIESGS

SEQ ID NO: 55572 - protein, 19 aa, Mycobacterium avium
QPSPVTGGNPLTYPYHFGG

SEQ ID NO: 55573 - protein, 4 aa, Mycobacterium avium
QPSS

SEQ ID NO: 55574 - protein, 7 aa, Mycobacterium avium
QPSTAVQ

SEQ ID NO: 55575 - protein, 5 aa, Mycobacterium avium
QPTDG

SEQ ID NO: 55576 - protein, 17 aa, Mycobacterium avium
QPTDPSSLPPDAPDDRK

SEQ ID NO: 55577 - protein, 4 aa, Mycobacterium avium
QPTL

SEQ ID NO: 55578 - protein, 23 aa, Mycobacterium avium
QPTTVGQAPPTTALSGVGSGGGL

SEQ ID NO: 55579 - protein, 6 aa, Mycobacterium avium
QPVPPG

SEQ ID NO: 55580 - protein, 4 aa, Mycobacterium avium
QPWT

SEQ ID NO: 55581 - protein, 5 aa, Mycobacterium avium
QQAAL

SEQ ID NO: 55582 - protein, 6 aa, Mycobacterium avium
QQAGGQ

SEQ ID NO: 55583 - protein, 7 aa, Mycobacterium avium
QQAPNST

SEQ ID NO: 55584 - protein, 6 aa, Mycobacterium avium
QQATAA

SEQ ID NO: 55585 - protein, 4 aa, Mycobacterium avium
QQEA

SEQ ID NO: 55586 - protein, 4 aa, Mycobacterium avium
QQEG

SEQ ID NO: 55587 - protein, 13 aa, Mycobacterium avium
QQGEHRDGIPNRS

SEQ ID NO: 55588 - protein, 7 aa, Mycobacterium avium
QQHGARG

SEQ ID NO: 55589 - protein, 5 aa, Mycobacterium avium
QQLGP

SEQ ID NO: 55590 - protein, 6 aa, Mycobacterium avium
QQPGRA

SEQ ID NO: 55591 - protein, 19 aa, Mycobacterium avium
QQPRRHQRHRRQGEQRAQQ

SEQ ID NO: 55592 - protein, 4 aa, Mycobacterium avium
QQQG

SEQ ID NO: 55593 - protein, 5 aa, Mycobacterium avium
QQRQQ

SEQ ID NO: 55594 - protein, 7 aa, Mycobacterium avium
QQVGDTS

SEQ ID NO: 55595 - protein, 14 aa, Mycobacterium avium
QRAAPAAGDVCGAG

SEQ ID NO: 55596 - protein, 5 aa, Mycobacterium avium
QRADG

SEQ ID NO: 55597 - protein, 7 aa, Mycobacterium avium
QRADRDV

SEQ ID NO: 55598 - protein, 19 aa, Mycobacterium avium
QRAGNGAHSAAPEGVEGEF

SEQ ID NO: 55599 - protein, 9 aa, Mycobacterium avium
QRAGTSKPA

SEQ ID NO: 55600 - protein, 7 aa, Mycobacterium avium
QRARPRD

SEQ ID NO: 55601 - protein, 8 aa, Mycobacterium avium
QREGEEPA

SEQ ID NO: 55602 - protein, 5 aa, Mycobacterium avium
QREHT

SEQ ID NO: 55603 - protein, 5 aa, Mycobacterium avium
QRGAT

SEQ ID NO: 55604 - protein, 6 aa, Mycobacterium avium
QRGDLG

SEQ ID NO: 55605 - protein, 8 aa, Mycobacterium avium
QRGEDRQR

SEQ ID NO: 55606 - protein, 7 aa, Mycobacterium avium
QRGPSDY

SEQ ID NO: 55607 - protein, 8 aa, Mycobacterium avium
QRHEHTRA

SEQ ID NO: 55608 - protein, 10 aa, Mycobacterium avium
QRHSGSVTNR

SEQ ID NO: 55609 - protein, 14 aa, Mycobacterium avium
QRIEAAAKDAGPGA

SEQ ID NO: 55610 - protein, 11 aa, Mycobacterium avium
QRITRAKNKVR

SEQ ID NO: 55611 - protein, 4 aa, Mycobacterium avium
QRKG

SEQ ID NO: 55612 - protein, 10 aa, Mycobacterium avium
QRKSKPTEDI

SEQ ID NO: 55613 - protein, 13 aa, Mycobacterium avium
QRLASTSDTDAAV

SEQ ID NO: 55614 - protein, 7 aa, Mycobacterium avium
QRLEPDE

SEQ ID NO: 55615 - protein, 4 aa, Mycobacterium avium
QRLP

SEQ ID NO: 55616 - protein, 5 aa, Mycobacterium avium
QRNAI

SEQ ID NO: 55617 - protein, 13 aa, Mycobacterium avium
QRNKYEVDHETGR

SEQ ID NO: 55618 - protein, 9 aa, Mycobacterium avium
QRPGGPRAN

SEQ ID NO: 55619 - protein, 4 aa, Mycobacterium avium
QRPS

SEQ ID NO: 55620 - protein, 15 aa, Mycobacterium avium
QRQQRQARGQSEVPP

SEQ ID NO: 55621 - protein, 6 aa, Mycobacterium avium
QRRAAQ

SEQ ID NO: 55622 - protein, 8 aa, Mycobacterium avium
QRRADCDE

SEQ ID NO: 55623 - protein, 8 aa, Mycobacterium avium
QRRARRGR

SEQ ID NO: 55624 - protein, 35 aa, Mycobacterium avium
QRRDAAPPAGPTSVAPQAMSGAQRRAAEKELAAAD

SEQ ID NO: 55625 - protein, 8 aa, Mycobacterium avium
QRRGTTPQ

SEQ ID NO: 55626 - protein, 6 aa, Mycobacterium avium
QRSREA

SEQ ID NO: 55627 - protein, 9 aa, Mycobacterium avium
QRSRRSEED

SEQ ID NO: 55628 - protein, 7 aa, Mycobacterium avium
QRTLPDE

SEQ ID NO: 55629 - protein, 5 aa, Mycobacterium avium
QRTPD

SEQ ID NO: 55630 - protein, 8 aa, Mycobacterium avium
QRTRERRP

SEQ ID NO: 55631 - protein, 9 aa, Mycobacterium avium
QSAAASYSS

SEQ ID NO: 55632 - protein, 7 aa, Mycobacterium avium
QSAARRE

SEQ ID NO: 55633 - protein, 21 aa, Mycobacterium avium
QSADDPDADEQRELEARAAGL

SEQ ID NO: 55634 - protein, 8 aa, Mycobacterium avium
QSAGSDAL

SEQ ID NO: 55635 - protein, 12 aa, Mycobacterium avium
QSAHTASPEQQQ

SEQ ID NO: 55636 - protein, 6 aa, Mycobacterium avium
QSAQAL

SEQ ID NO: 55637 - protein, 8 aa, Mycobacterium avium
QSATVDSA

SEQ ID NO: 55638 - protein, 4 aa, Mycobacterium avium
QSEP

SEQ ID NO: 55639 - protein, 8 aa, Mycobacterium avium
QSEPQRQA

SEQ ID NO: 55640 - protein, 7 aa, Mycobacterium avium
QSGELPE

SEQ ID NO: 55641 - protein, 4 aa, Mycobacterium avium
QSGG

SEQ ID NO: 55642 - protein, 10 aa, Mycobacterium avium
QSGLPKVPTS

SEQ ID NO: 55643 - protein, 6 aa, Mycobacterium avium
QSGSDR

SEQ ID NO: 55644 - protein, 5 aa, Mycobacterium avium
QSHQS

SEQ ID NO: 55645 - protein, 13 aa, Mycobacterium avium
QSKSAYQAEIDSP

SEQ ID NO: 55646 - protein, 7 aa, Mycobacterium avium
QSNYAAA

SEQ ID NO: 55647 - protein, 5 aa, Mycobacterium avium
QSPAL

SEQ ID NO: 55648 - protein, 5 aa, Mycobacterium avium
QSPTE

SEQ ID NO: 55649 - protein, 8 aa, Mycobacterium avium
QSQAERFN

SEQ ID NO: 55650 - protein, 7 aa, Mycobacterium avium
QSRPEDR

SEQ ID NO: 55651 - protein, 23 aa, Mycobacterium avium
QSRSGVTAETGNVRVDDAVWERG

SEQ ID NO: 55652 - protein, 6 aa, Mycobacterium avium
QSSGGV

SEQ ID NO: 55653 - protein, 17 aa, Mycobacterium avium
QSTAPAAAPAATPAPAL

SEQ ID NO: 55654 - protein, 6 aa, Mycobacterium avium
QSYGNV

SEQ ID NO: 55655 - protein, 10 aa, Mycobacterium avium
QTADIPDYPM

SEQ ID NO: 55656 - protein, 6 aa, Mycobacterium avium
QTANEL

SEQ ID NO: 55657 - protein, 5 aa, Mycobacterium avium
QTDPY

SEQ ID NO: 55658 - protein, 4 aa, Mycobacterium avium
QTFR

SEQ ID NO: 55659 - protein, 6 aa, Mycobacterium avium
QTGPFR

SEQ ID NO: 55660 - protein, 9 aa, Mycobacterium avium
QTGSPLSDL

SEQ ID NO: 55661 - protein, 7 aa, Mycobacterium avium
QTGTGDA

SEQ ID NO: 55662 - protein, 11 aa, Mycobacterium avium
QTKGAGHTSQM

SEQ ID NO: 55663 - protein, 7 aa, Mycobacterium avium
QTNYSAA

SEQ ID NO: 55664 - protein, 7 aa, Mycobacterium avium
QTPAERD

SEQ ID NO: 55665 - protein, 17 aa, Mycobacterium avium
QTPAPNPPAAAAPQGWG

SEQ ID NO: 55666 - protein, 16 aa, Mycobacterium avium
QTPGRVAGPAPELGAH

SEQ ID NO: 55667 - protein, 4 aa, Mycobacterium avium
QTPS

SEQ ID NO: 55668 - protein, 5 aa, Mycobacterium avium
QTPSA

SEQ ID NO: 55669 - protein, 6 aa, Mycobacterium avium
QTPSEV

SEQ ID NO: 55670 - protein, 24 aa, Mycobacterium avium
QTPVEPTPPPETPQAEPEPETETP

SEQ ID NO: 55671 - protein, 6 aa, Mycobacterium avium
QTRAEP

SEQ ID NO: 55672 - protein, 10 aa, Mycobacterium avium
QTRDLSNEAT

SEQ ID NO: 55673 - protein, 6 aa, Mycobacterium avium
QTRQRA

SEQ ID NO: 55674 - protein, 8 aa, Mycobacterium avium
QTRREITT

SEQ ID NO: 55675 - protein, 5 aa, Mycobacterium avium
QTTPW

SEQ ID NO: 55676 - protein, 6 aa, Mycobacterium avium
QTVPEG

SEQ ID NO: 55677 - protein, 7 aa, Mycobacterium avium
QTVPSGS

SEQ ID NO: 55678 - protein, 5 aa, Mycobacterium avium
QTYAA

SEQ ID NO: 55679 - protein, 11 aa, Mycobacterium avium
QTYAGTDRQVR

SEQ ID NO: 55680 - protein, 12 aa, Mycobacterium avium
QTYGDTEPGAGA

SEQ ID NO: 55681 - protein, 5 aa, Mycobacterium avium
QVDPD

SEQ ID NO: 55682 - protein, 8 aa, Mycobacterium avium
QVDRPGPA

SEQ ID NO: 55683 - protein, 11 aa, Mycobacterium avium
QVEPAPAGQER

SEQ ID NO: 55684 - protein, 12 aa, Mycobacterium avium
QVGRDPATLETS

SEQ ID NO: 55685 - protein, 4 aa, Mycobacterium avium
QVGT

SEQ ID NO: 55686 - protein, 13 aa, Mycobacterium avium
QVGTDDPALTGEQ

SEQ ID NO: 55687 - protein, 5 aa, Mycobacterium avium
QVPDA

SEQ ID NO: 55688 - protein, 10 aa, Mycobacterium avium
QVPEGVSPAG

SEQ ID NO: 55689 - protein, 4 aa, Mycobacterium avium
QVPG

SEQ ID NO: 55690 - protein, 16 aa, Mycobacterium avium
QVQNPDPDWPQTDGPK

SEQ ID NO: 55691 - protein, 4 aa, Mycobacterium avium
QVSE

SEQ ID NO: 55692 - protein, 13 aa, Mycobacterium avium
QVSGPAELPPDQM

SEQ ID NO: 55693 - protein, 5 aa, Mycobacterium avium
QVTRA

SEQ ID NO: 55694 - protein, 4 aa, Mycobacterium avium
QVYA

SEQ ID NO: 55695 - protein, 12 aa, Mycobacterium avium
QVYDQSGLGPQD

SEQ ID NO: 55696 - protein, 5 aa, Mycobacterium avium
QWATA

SEQ ID NO: 55697 - protein, 7 aa, Mycobacterium avium
QYPPNEG

SEQ ID NO: 55698 - protein, 4 aa, Mycobacterium avium
QYPS

SEQ ID NO: 55699 - protein, 6 aa, Mycobacterium avium
QYRSGD

SEQ ID NO: 55700 - protein, 4 aa, Mycobacterium avium
QYSD

SEQ ID NO: 55701 - protein, 9 aa, Mycobacterium avium
RAAAAGAQL

SEQ ID NO: 55702 - protein, 9 aa, Mycobacterium avium
RAAAAKYDA

SEQ ID NO: 55703 - protein, 18 aa, Mycobacterium avium
RAAADQTADAVRAAGAGA

SEQ ID NO: 55704 - protein, 23 aa, Mycobacterium avium
RAAARAPNTELGQTPLIGGTFGP

SEQ ID NO: 55705 - protein, 45 aa, Mycobacterium avium
RAAARAQGKDAGRGRAAAPTPRRVAGQRRSWSGPGPDARDPQPLG

SEQ ID NO: 55706 - protein, 7 aa, Mycobacterium avium
RAAATNS

SEQ ID NO: 55707 - protein, 9 aa, Mycobacterium avium
RAAEAGART

SEQ ID NO: 55708 - protein, 5 aa, Mycobacterium avium
RAAGA

SEQ ID NO: 55709 - protein, 8 aa, Mycobacterium avium
RAAGADAL

SEQ ID NO: 55710 - protein, 14 aa, Mycobacterium avium
RAAGTSRQDPRPAI

SEQ ID NO: 55711 - protein, 5 aa, Mycobacterium avium
RAAHA

SEQ ID NO: 55712 - protein, 13 aa, Mycobacterium avium
RAARQKPNGEDDK

SEQ ID NO: 55713 - protein, 10 aa, Mycobacterium avium
RAARSTELAD

SEQ ID NO: 55714 - protein, 8 aa, Mycobacterium avium
RAARTPDA

SEQ ID NO: 55715 - protein, 7 aa, Mycobacterium avium
RAASDAG

SEQ ID NO: 55716 - protein, 8 aa, Mycobacterium avium
RAASRATV

SEQ ID NO: 55717 - protein, 10 aa, Mycobacterium avium
RAATGEHCEP

SEQ ID NO: 55718 - protein, 5 aa, Mycobacterium avium
RAATI

SEQ ID NO: 55719 - protein, 8 aa, Mycobacterium avium
RAATQAGF

SEQ ID NO: 55720 - protein, 13 aa, Mycobacterium avium
RAATTAAATPAEL

SEQ ID NO: 55721 - protein, 6 aa, Mycobacterium avium
RADAPV

SEQ ID NO: 55722 - protein, 22 aa, Mycobacterium avium
RADATTVGAPETLGEVGSDVAG

SEQ ID NO: 55723 - protein, 10 aa, Mycobacterium avium
RADDDRQTMN

SEQ ID NO: 55724 - protein, 7 aa, Mycobacterium avium
RADPARP

SEQ ID NO: 55725 - protein, 10 aa, Mycobacterium avium
RADSARRLNP

SEQ ID NO: 55726 - protein, 4 aa, Mycobacterium avium
RAEA

SEQ ID NO: 55727 - protein, 7 aa, Mycobacterium avium
RAEEERE

SEQ ID NO: 55728 - protein, 4 aa, Mycobacterium avium
RAEL

SEQ ID NO: 55729 - protein, 15 aa, Mycobacterium avium
RAEPGDTGWDEHADD

SEQ ID NO: 55730 - protein, 7 aa, Mycobacterium avium
RAEQHPD

SEQ ID NO: 55731 - protein, 9 aa, Mycobacterium avium
RAERAERVD

SEQ ID NO: 55732 - protein, 5 aa, Mycobacterium avium
RAERD

SEQ ID NO: 55733 - protein, 6 aa, Mycobacterium avium
RAERRG

SEQ ID NO: 55734 - protein, 8 aa, Mycobacterium avium
RAERVGGT

SEQ ID NO: 55735 - protein, 7 aa, Mycobacterium avium
RAETGVT

SEQ ID NO: 55736 - protein, 8 aa, Mycobacterium avium
RAFSAGGD

SEQ ID NO: 55737 - protein, 9 aa, Mycobacterium avium
RAGAGSDAH

SEQ ID NO: 55738 - protein, 10 aa, Mycobacterium avium
RAGAKQIDGS

SEQ ID NO: 55739 - protein, 6 aa, Mycobacterium avium
RAGARL

SEQ ID NO: 55740 - protein, 8 aa, Mycobacterium avium
RAGASGEQ

SEQ ID NO: 55741 - protein, 8 aa, Mycobacterium avium
RAGDAARY

SEQ ID NO: 55742 - protein, 13 aa, Mycobacterium avium
RAGDPPRLPGPGP

SEQ ID NO: 55743 - protein, 9 aa, Mycobacterium avium
RAGDRGALE

SEQ ID NO: 55744 - protein, 6 aa, Mycobacterium avium
RAGDTT

SEQ ID NO: 55745 - protein, 6 aa, Mycobacterium avium
RAGEGV

SEQ ID NO: 55746 - protein, 11 aa, Mycobacterium avium
RAGEPRHPTRG

SEQ ID NO: 55747 - protein, 8 aa, Mycobacterium avium
RAGEPSEV

SEQ ID NO: 55748 - protein, 9 aa, Mycobacterium avium
RAGERGAPV

SEQ ID NO: 55749 - protein, 7 aa, Mycobacterium avium
RAGESVS

SEQ ID NO: 55750 - protein, 16 aa, Mycobacterium avium
RAGGGETTGSAAGPYT

SEQ ID NO: 55751 - protein, 11 aa, Mycobacterium avium
RAGGVSKPPFD

SEQ ID NO: 55752 - protein, 4 aa, Mycobacterium avium
RAGH

SEQ ID NO: 55753 - protein, 8 aa, Mycobacterium avium
RAGHADGN

SEQ ID NO: 55754 - protein, 13 aa, Mycobacterium avium
RAGLGRTVTAADT

SEQ ID NO: 55755 - protein, 20 aa, Mycobacterium avium
RAGLPDSAEDKGAQAAGAAL

SEQ ID NO: 55756 - protein, 7 aa, Mycobacterium avium
RAGNTAK

SEQ ID NO: 55757 - protein, 18 aa, Mycobacterium avium
RAGPPDADTSATLPGGTE

SEQ ID NO: 55758 - protein, 9 aa, Mycobacterium avium
RAGPTYTRD

SEQ ID NO: 55759 - protein, 5 aa, Mycobacterium avium
RAGQN

SEQ ID NO: 55760 - protein, 6 aa, Mycobacterium avium
RAGRKR

SEQ ID NO: 55761 - protein, 4 aa, Mycobacterium avium
RAGV

SEQ ID NO: 55762 - protein, 9 aa, Mycobacterium avium
RAGVSPASA

SEQ ID NO: 55763 - protein, 11 aa, Mycobacterium avium
RAHAGKSKRAL

SEQ ID NO: 55764 - protein, 6 aa, Mycobacterium avium
RAHGEL

SEQ ID NO: 55765 - protein, 9 aa, Mycobacterium avium
RAKARPGVT

SEQ ID NO: 55766 - protein, 14 aa, Mycobacterium avium
RALAAGTSTSHRSW

SEQ ID NO: 55767 - protein, 7 aa, Mycobacterium avium
RALSSDA

SEQ ID NO: 55768 - protein, 50 aa, Mycobacterium avium
RAMAGTTGLGRERARAEAAKAPREPGQEPGKAPKQEPAAPAVSAGGPITS

SEQ ID NO: 55769 - protein, 11 aa, Mycobacterium avium
RANAGRPPGDF

SEQ ID NO: 55770 - protein, 11 aa, Mycobacterium avium
RANRGEPDAGR

SEQ ID NO: 55771 - protein, 16 aa, Mycobacterium avium
RAPAGRPATPVDPGSP

SEQ ID NO: 55772 - protein, 11 aa, Mycobacterium avium
RAPAPATTDSD

SEQ ID NO: 55773 - protein, 8 aa, Mycobacterium avium
RAPGRPLM

SEQ ID NO: 55774 - protein, 9 aa, Mycobacterium avium
RAPSGGNVQ

SEQ ID NO: 55775 - protein, 15 aa, Mycobacterium avium
RAPSPNGARPPEDPL

SEQ ID NO: 55776 - protein, 11 aa, Mycobacterium avium
RAPSRGFPRPR

SEQ ID NO: 55777 - protein, 7 aa, Mycobacterium avium
RAQAASA

SEQ ID NO: 55778 - protein, 10 aa, Mycobacterium avium
RAQASAAIAD

SEQ ID NO: 55779 - protein, 4 aa, Mycobacterium avium
RAQE

SEQ ID NO: 55780 - protein, 4 aa, Mycobacterium avium
RAQG

SEQ ID NO: 55781 - protein, 9 aa, Mycobacterium avium
RAQGSEKIR

SEQ ID NO: 55782 - protein, 9 aa, Mycobacterium avium
RAQLDSATV

SEQ ID NO: 55783 - protein, 16 aa, Mycobacterium avium
RAQNPTGAALSAERAA

SEQ ID NO: 55784 - protein, 6 aa, Mycobacterium avium
RAQPGA

SEQ ID NO: 55785 - protein, 8 aa, Mycobacterium avium
RARASARR

SEQ ID NO: 55786 - protein, 7 aa, Mycobacterium avium
RARATGK

SEQ ID NO: 55787 - protein, 8 aa, Mycobacterium avium
RARATTPE

SEQ ID NO: 55788 - protein, 12 aa, Mycobacterium avium
RARAVSDGRPVG

SEQ ID NO: 55789 - protein, 6 aa, Mycobacterium avium
RARDRG

SEQ ID NO: 55790 - protein, 7 aa, Mycobacterium avium
RARESAR

SEQ ID NO: 55791 - protein, 5 aa, Mycobacterium avium
RARGR

SEQ ID NO: 55792 - protein, 4 aa, Mycobacterium avium
RARN

SEQ ID NO: 55793 - protein, 17 aa, Mycobacterium avium
RARREAAAAQSRLDAGE

SEQ ID NO: 55794 - protein, 7 aa, Mycobacterium avium
RARSRTS

SEQ ID NO: 55795 - protein, 12 aa, Mycobacterium avium
RASAGPGQHTPR

SEQ ID NO: 55796 - protein, 40 aa, Mycobacterium avium
RASGPTPGPPPDGPPGGAPDTPDTGQAPRTRYQPIPVTFE

SEQ ID NO: 55797 - protein, 12 aa, Mycobacterium avium
RASGTISDRPAG

SEQ ID NO: 55798 - protein, 9 aa, Mycobacterium avium
RASPTGHGR

SEQ ID NO: 55799 - protein, 9 aa, Mycobacterium avium
RASQSGVQS

SEQ ID NO: 55800 - protein, 15 aa, Mycobacterium avium
RASTQPALLSELRAG

SEQ ID NO: 55801 - protein, 14 aa, Mycobacterium avium
RATAERPQQRAAQR

SEQ ID NO: 55802 - protein, 6 aa, Mycobacterium avium
RATARR

SEQ ID NO: 55803 - protein, 14 aa, Mycobacterium avium
RATDATVRPTDAEL

SEQ ID NO: 55804 - protein, 8 aa, Mycobacterium avium
RATDEQKS

SEQ ID NO: 55805 - protein, 15 aa, Mycobacterium avium
RATEIPAQTGSEDFS

SEQ ID NO: 55806 - protein, 5 aa, Mycobacterium avium
RATGF

SEQ ID NO: 55807 - protein, 7 aa, Mycobacterium avium
RATPERL

SEQ ID NO: 55808 - protein, 7 aa, Mycobacterium avium
RATQHRM

SEQ ID NO: 55809 - protein, 5 aa, Mycobacterium avium
RATRS

SEQ ID NO: 55810 - protein, 14 aa, Mycobacterium avium
RATSGDNHLGGDDW

SEQ ID NO: 55811 - protein, 6 aa, Mycobacterium avium
RATTAR

SEQ ID NO: 55812 - protein, 6 aa, Mycobacterium avium
RATTRA

SEQ ID NO: 55813 - protein, 7 aa, Mycobacterium avium
RAYRPDG

SEQ ID NO: 55814 - protein, 10 aa, Mycobacterium avium
RCEACTGDGT

SEQ ID NO: 55815 - protein, 7 aa, Mycobacterium avium
RCTAEAN

SEQ ID NO: 55816 - protein, 16 aa, Mycobacterium avium
RDADDELSMEDDNTSA

SEQ ID NO: 55817 - protein, 6 aa, Mycobacterium avium
RDAPAA

SEQ ID NO: 55818 - protein, 19 aa, Mycobacterium avium
RDAPGDDRAREVNAATARR

SEQ ID NO: 55819 - protein, 21 aa, Mycobacterium avium
RDCPKTDDPRKCQAGRNQAYY

SEQ ID NO: 55820 - protein, 4 aa, Mycobacterium avium
RDDD

SEQ ID NO: 55821 - protein, 4 aa, Mycobacterium avium
RDDG

SEQ ID NO: 55822 - protein, 10 aa, Mycobacterium avium
RDDGKPPHPS

SEQ ID NO: 55823 - protein, 8 aa, Mycobacterium avium
RDDMSQER

SEQ ID NO: 55824 - protein, 4 aa, Mycobacterium avium
RDDP

SEQ ID NO: 55825 - protein, 7 aa, Mycobacterium avium
RDEAAAQ

SEQ ID NO: 55826 - protein, 6 aa, Mycobacterium avium
RDEGAG

SEQ ID NO: 55827 - protein, 8 aa, Mycobacterium avium
RDEPQGSI

SEQ ID NO: 55828 - protein, 6 aa, Mycobacterium avium
RDEREL

SEQ ID NO: 55829 - protein, 8 aa, Mycobacterium avium
RDESARVN

SEQ ID NO: 55830 - protein, 8 aa, Mycobacterium avium
RDETDVNP

SEQ ID NO: 55831 - protein, 5 aa, Mycobacterium avium
RDGAD

SEQ ID NO: 55832 - protein, 5 aa, Mycobacterium avium
RDGAG

SEQ ID NO: 55833 - protein, 11 aa, Mycobacterium avium
RDGDAGSAHVN

SEQ ID NO: 55834 - protein, 5 aa, Mycobacterium avium
RDGDL

SEQ ID NO: 55835 - protein, 4 aa, Mycobacterium avium
RDGG

SEQ ID NO: 55836 - protein, 16 aa, Mycobacterium avium
RDGGDAGEVTWLSRGV

SEQ ID NO: 55837 - protein, 4 aa, Mycobacterium avium
RDGL

SEQ ID NO: 55838 - protein, 18 aa, Mycobacterium avium
RDGQRRHPSDNRDEPERA

SEQ ID NO: 55839 - protein, 8 aa, Mycobacterium avium
RDGRPQLS

SEQ ID NO: 55840 - protein, 5 aa, Mycobacterium avium
RDGTF

SEQ ID NO: 55841 - protein, 12 aa, Mycobacterium avium
RDGTGQDPDDDR

SEQ ID NO: 55842 - protein, 7 aa, Mycobacterium avium
RDGTTTR

SEQ ID NO: 55843 - protein, 12 aa, Mycobacterium avium
RDHSGDGPGEPL

SEQ ID NO: 55844 - protein, 5 aa, Mycobacterium avium
RDIQG

SEQ ID NO: 55845 - protein, 10 aa, Mycobacterium avium
RDKRDKRLPR

SEQ ID NO: 55846 - protein, 7 aa, Mycobacterium avium
RDLGEAE

SEQ ID NO: 55847 - protein, 8 aa, Mycobacterium avium
RDLPGERT

SEQ ID NO: 55848 - protein, 12 aa, Mycobacterium avium
RDLSGGNYPQVP

SEQ ID NO: 55849 - protein, 8 aa, Mycobacterium avium
RDLSTDGG

SEQ ID NO: 55850 - protein, 7 aa, Mycobacterium avium
RDLTGRP

SEQ ID NO: 55851 - protein, 6 aa, Mycobacterium avium
RDNGRG

SEQ ID NO: 55852 - protein, 5 aa, Mycobacterium avium
RDPDG

SEQ ID NO: 55853 - protein, 18 aa, Mycobacterium avium
RDPDGDEVLGSATIAGTS

SEQ ID NO: 55854 - protein, 5 aa, Mycobacterium avium
RDPEL

SEQ ID NO: 55855 - protein, 6 aa, Mycobacterium avium
RDPEVR

SEQ ID NO: 55856 - protein, 13 aa, Mycobacterium avium
RDPHARADPGGAE

SEQ ID NO: 55857 - protein, 5 aa, Mycobacterium avium
RDPQL

SEQ ID NO: 55858 - protein, 8 aa, Mycobacterium avium
RDPRASGE

SEQ ID NO: 55859 - protein, 5 aa, Mycobacterium avium
RDPSA

SEQ ID NO: 55860 - protein, 7 aa, Mycobacterium avium
RDPSLFD

SEQ ID NO: 55861 - protein, 8 aa, Mycobacterium avium
RDPTTPYS

SEQ ID NO: 55862 - protein, 11 aa, Mycobacterium avium
RDQAAEAEQLG

SEQ ID NO: 55863 - protein, 16 aa, Mycobacterium avium
RDQAVEASRARFSVAS

SEQ ID NO: 55864 - protein, 6 aa, Mycobacterium avium
RDQGEG

SEQ ID NO: 55865 - protein, 7 aa, Mycobacterium avium
RDRDGEA

SEQ ID NO: 55866 - protein, 6 aa, Mycobacterium avium
RDRDRT

SEQ ID NO: 55867 - protein, 8 aa, Mycobacterium avium
RDREGTGM

SEQ ID NO: 55868 - protein, 8 aa, Mycobacterium avium
RDRRGPPI

SEQ ID NO: 55869 - protein, 9 aa, Mycobacterium avium
RDRSAELTG

SEQ ID NO: 55870 - protein, 7 aa, Mycobacterium avium
RDRTDPG

SEQ ID NO: 55871 - protein, 39 aa, Mycobacterium avium
RDRVADQREQIADERERLADEREQLADEREGTVAERERA

SEQ ID NO: 55872 - protein, 14 aa, Mycobacterium avium
RDSEPDDESAGPRV

SEQ ID NO: 55873 - protein, 20 aa, Mycobacterium avium
RDSEPDWGPYAAPTAPPNAP

SEQ ID NO: 55874 - protein, 8 aa, Mycobacterium avium
RDSGQVDT

SEQ ID NO: 55875 - protein, 5 aa, Mycobacterium avium
RDSIR

SEQ ID NO: 55876 - protein, 8 aa, Mycobacterium avium
RDSRANAR

SEQ ID NO: 55877 - protein, 7 aa, Mycobacterium avium
RDSSPTL

SEQ ID NO: 55878 - protein, 6 aa, Mycobacterium avium
RDSYGG

SEQ ID NO: 55879 - protein, 12 aa, Mycobacterium avium
RDTDEDAGAPSL

SEQ ID NO: 55880 - protein, 4 aa, Mycobacterium avium
RDTG

SEQ ID NO: 55881 - protein, 8 aa, Mycobacterium avium
RDTGDDLG

SEQ ID NO: 55882 - protein, 17 aa, Mycobacterium avium
RDTRRPTVPGVAQAKDG

SEQ ID NO: 55883 - protein, 9 aa, Mycobacterium avium
RDTRTPGVD

SEQ ID NO: 55884 - protein, 7 aa, Mycobacterium avium
RDYADVP

SEQ ID NO: 55885 - protein, 5 aa, Mycobacterium avium
RDYPD

SEQ ID NO: 55886 - protein, 14 aa, Mycobacterium avium
REAAAAALAAYEAL

SEQ ID NO: 55887 - protein, 8 aa, Mycobacterium avium
REAAPDGI

SEQ ID NO: 55888 - protein, 8 aa, Mycobacterium avium
REAARPDA

SEQ ID NO: 55889 - protein, 5 aa, Mycobacterium avium
REAER

SEQ ID NO: 55890 - protein, 8 aa, Mycobacterium avium
REATAMDP

SEQ ID NO: 55891 - protein, 8 aa, Mycobacterium avium
RECEPGHV

SEQ ID NO: 55892 - protein, 9 aa, Mycobacterium avium
REDGPDDPW

SEQ ID NO: 55893 - protein, 8 aa, Mycobacterium avium
REDGVPAG

SEQ ID NO: 55894 - protein, 4 aa, Mycobacterium avium
REDV

SEQ ID NO: 55895 - protein, 12 aa, Mycobacterium avium
REEGDQNSSSLR

SEQ ID NO: 55896 - protein, 10 aa, Mycobacterium avium
REENPDPHTT

SEQ ID NO: 55897 - protein, 11 aa, Mycobacterium avium
REGEDEDLERA

SEQ ID NO: 55898 - protein, 17 aa, Mycobacterium avium
REHARTDWDNDGIPTRE

SEQ ID NO: 55899 - protein, 8 aa, Mycobacterium avium
REHGGRSL

SEQ ID NO: 55900 - protein, 6 aa, Mycobacterium avium
REHGGS

SEQ ID NO: 55901 - protein, 18 aa, Mycobacterium avium
REKPDHSETVEGSLEDRG

SEQ ID NO: 55902 - protein, 9 aa, Mycobacterium avium
RENADNKLY

SEQ ID NO: 55903 - protein, 4 aa, Mycobacterium avium
RENL

SEQ ID NO: 55904 - protein, 10 aa, Mycobacterium avium
REPQPGDPPY

SEQ ID NO: 55905 - protein, 11 aa, Mycobacterium avium
REPQSAGACGS

SEQ ID NO: 55906 - protein, 7 aa, Mycobacterium avium
REPRPYP

SEQ ID NO: 55907 - protein, 9 aa, Mycobacterium avium
REPTPRQQD

SEQ ID NO: 55908 - protein, 20 aa, Mycobacterium avium
REQADKYVASGGAEAADMKG

SEQ ID NO: 55909 - protein, 10 aa, Mycobacterium avium
REQGYGPDVK

SEQ ID NO: 55910 - protein, 9 aa, Mycobacterium avium
RERADDRGV

SEQ ID NO: 55911 - protein, 7 aa, Mycobacterium avium
RERGGYG

SEQ ID NO: 55912 - protein, 20 aa, Mycobacterium avium
RERIGEEAPTPSIADTHDHE

SEQ ID NO: 55913 - protein, 14 aa, Mycobacterium avium
RERIRPDPATRAAN

SEQ ID NO: 55914 - protein, 16 aa, Mycobacterium avium
RERPWRRAGSGEVRPG

SEQ ID NO: 55915 - protein, 4 aa, Mycobacterium avium
RESI

SEQ ID NO: 55916 - protein, 4 aa, Mycobacterium avium
RESL

SEQ ID NO: 55917 - protein, 12 aa, Mycobacterium avium
RESSDGKAVAEG

SEQ ID NO: 55918 - protein, 12 aa, Mycobacterium avium
RESTPDANGISR

SEQ ID NO: 55919 - protein, 8 aa, Mycobacterium avium
RETASQAL

SEQ ID NO: 55920 - protein, 9 aa, Mycobacterium avium
RETDEDGNV

SEQ ID NO: 55921 - protein, 5 aa, Mycobacterium avium
RETGA

SEQ ID NO: 55922 - protein, 6 aa, Mycobacterium avium
RETKRI

SEQ ID NO: 55923 - protein, 6 aa, Mycobacterium avium
RETPRA

SEQ ID NO: 55924 - protein, 5 aa, Mycobacterium avium
RFATS

SEQ ID NO: 55925 - protein, 10 aa, Mycobacterium avium
RFGSKEPDKF

SEQ ID NO: 55926 - protein, 8 aa, Mycobacterium avium
RGAAPDKL

SEQ ID NO: 55927 - protein, 6 aa, Mycobacterium avium
RGAATE

SEQ ID NO: 55928 - protein, 9 aa, Mycobacterium avium
RGADAQSAR

SEQ ID NO: 55929 - protein, 6 aa, Mycobacterium avium
RGADAV

SEQ ID NO: 55930 - protein, 8 aa, Mycobacterium avium
RGAEIGPG

SEQ ID NO: 55931 - protein, 5 aa, Mycobacterium avium
RGAER

SEQ ID NO: 55932 - protein, 32 aa, Mycobacterium avium
RGAKTRARARHPEGPGGAASDSDAAADAEPSS

SEQ ID NO: 55933 - protein, 18 aa, Mycobacterium avium
RGAPAGDGLLHPAHGEAP

SEQ ID NO: 55934 - protein, 5 aa, Mycobacterium avium
RGAPV

SEQ ID NO: 55935 - protein, 12 aa, Mycobacterium avium
RGAQPPRDRPRT

SEQ ID NO: 55936 - protein, 5 aa, Mycobacterium avium
RGARE

SEQ ID NO: 55937 - protein, 6 aa, Mycobacterium avium
RGARGV

SEQ ID NO: 55938 - protein, 8 aa, Mycobacterium avium
RGARSLGK

SEQ ID NO: 55939 - protein, 9 aa, Mycobacterium avium
RGASDAEIK

SEQ ID NO: 55940 - protein, 10 aa, Mycobacterium avium
RGAVEGDEDV

SEQ ID NO: 55941 - protein, 6 aa, Mycobacterium avium
RGCSHP

SEQ ID NO: 55942 - protein, 17 aa, Mycobacterium avium
RGCTAPGCTAPGCTAPG

SEQ ID NO: 55943 - protein, 8 aa, Mycobacterium avium
RGDENLCP

SEQ ID NO: 55944 - protein, 5 aa, Mycobacterium avium
RGDGE

SEQ ID NO: 55945 - protein, 5 aa, Mycobacterium avium
RGDGG

SEQ ID NO: 55946 - protein, 7 aa, Mycobacterium avium
RGDHPSW

SEQ ID NO: 55947 - protein, 8 aa, Mycobacterium avium
RGDTPLPV

SEQ ID NO: 55948 - protein, 7 aa, Mycobacterium avium
RGDVPED

SEQ ID NO: 55949 - protein, 9 aa, Mycobacterium avium
RGDYDEARR

SEQ ID NO: 55950 - protein, 15 aa, Mycobacterium avium
RGEAGERQVPGNPRV

SEQ ID NO: 55951 - protein, 8 aa, Mycobacterium avium
RGEASEQL

SEQ ID NO: 55952 - protein, 16 aa, Mycobacterium avium
RGEDGGEDDDGDDDEA

SEQ ID NO: 55953 - protein, 4 aa, Mycobacterium avium
RGEG

SEQ ID NO: 55954 - protein, 6 aa, Mycobacterium avium
RGEGER

SEQ ID NO: 55955 - protein, 7 aa, Mycobacterium avium
RGEGYQP

SEQ ID NO: 55956 - protein, 5 aa, Mycobacterium avium
RGELD

SEQ ID NO: 55957 - protein, 7 aa, Mycobacterium avium
RGEPADA

SEQ ID NO: 55958 - protein, 29 aa, Mycobacterium avium
RGEPGRHQSAAGRVAAGRRHAAEKQVHRD

SEQ ID NO: 55959 - protein, 15 aa, Mycobacterium avium
RGEQITDTDPDDCPV

SEQ ID NO: 55960 - protein, 5 aa, Mycobacterium avium
RGEQL

SEQ ID NO: 55961 - protein, 9 aa, Mycobacterium avium
RGEQPGPLQ

SEQ ID NO: 55962 - protein, 9 aa, Mycobacterium avium
RGEQSPRRH

SEQ ID NO: 55963 - protein, 4 aa, Mycobacterium avium
RGFP

SEQ ID NO: 55964 - protein, 7 aa, Mycobacterium avium
RGGAGTA

SEQ ID NO: 55965 - protein, 8 aa, Mycobacterium avium
RGGDPSAP

SEQ ID NO: 55966 - protein, 6 aa, Mycobacterium avium
RGGELG

SEQ ID NO: 55967 - protein, 10 aa, Mycobacterium avium
RGGGADAAEI

SEQ ID NO: 55968 - protein, 11 aa, Mycobacterium avium
RGGISTEESLT

SEQ ID NO: 55969 - protein, 6 aa, Mycobacterium avium
RGGNVT

SEQ ID NO: 55970 - protein, 9 aa, Mycobacterium avium
RGGRGDEDI

SEQ ID NO: 55971 - protein, 7 aa, Mycobacterium avium
RGGSEAE

SEQ ID NO: 55972 - protein, 8 aa, Mycobacterium avium
RGGTGDEV

SEQ ID NO: 55973 - protein, 7 aa, Mycobacterium avium
RGGTRTK

SEQ ID NO: 55974 - protein, 8 aa, Mycobacterium avium
RGIGGSST

SEQ ID NO: 55975 - protein, 5 aa, Mycobacterium avium
RGIGR

SEQ ID NO: 55976 - protein, 5 aa, Mycobacterium avium
RGIRG

SEQ ID NO: 55977 - protein, 5 aa, Mycobacterium avium
RGLAA

SEQ ID NO: 55978 - protein, 5 aa, Mycobacterium avium
RGLEQ

SEQ ID NO: 55979 - protein, 5 aa, Mycobacterium avium
RGLGA

SEQ ID NO: 55980 - protein, 5 aa, Mycobacterium avium
RGLGR

SEQ ID NO: 55981 - protein, 10 aa, Mycobacterium avium
RGLPGGGEDI

SEQ ID NO: 55982 - protein, 4 aa, Mycobacterium avium
RGLQ

SEQ ID NO: 55983 - protein, 4 aa, Mycobacterium avium
RGLV

SEQ ID NO: 55984 - protein, 6 aa, Mycobacterium avium
RGNDFG

SEQ ID NO: 55985 - protein, 10 aa, Mycobacterium avium
RGNPVSPSTV

SEQ ID NO: 55986 - protein, 4 aa, Mycobacterium avium
RGNY

SEQ ID NO: 55987 - protein, 7 aa, Mycobacterium avium
RGPALPP

SEQ ID NO: 55988 - protein, 5 aa, Mycobacterium avium
RGPFA

SEQ ID NO: 55989 - protein, 10 aa, Mycobacterium avium
RGPGTAEDTL

SEQ ID NO: 55990 - protein, 4 aa, Mycobacterium avium
RGPL

SEQ ID NO: 55991 - protein, 11 aa, Mycobacterium avium
RGPRVGDPADV

SEQ ID NO: 55992 - protein, 6 aa, Mycobacterium avium
RGPVPE

SEQ ID NO: 55993 - protein, 17 aa, Mycobacterium avium
RGQIASPDQAPSDAAAV

SEQ ID NO: 55994 - protein, 10 aa, Mycobacterium avium
RGQTDEEDQL

SEQ ID NO: 55995 - protein, 12 aa, Mycobacterium avium
RGQTGDWDAAGR

SEQ ID NO: 55996 - protein, 4 aa, Mycobacterium avium
RGRA

SEQ ID NO: 55997 - protein, 6 aa, Mycobacterium avium
RGRDEG

SEQ ID NO: 55998 - protein, 5 aa, Mycobacterium avium
RGREV

SEQ ID NO: 55999 - protein, 6 aa, Mycobacterium avium
RGRKAP

SEQ ID NO: 56000 - protein, 8 aa, Mycobacterium avium
RGRNQDEL

SEQ ID NO: 56001 - protein, 5 aa, Mycobacterium avium
RGRPC

SEQ ID NO: 56002 - protein, 5 aa, Mycobacterium avium
RGRPD

SEQ ID NO: 56003 - protein, 11 aa, Mycobacterium avium
RGRRRGRGARE

SEQ ID NO: 56004 - protein, 21 aa, Mycobacterium avium
RGRVAARRRADQRAESARQHP

SEQ ID NO: 56005 - protein, 10 aa, Mycobacterium avium
RGSARAESSW

SEQ ID NO: 56006 - protein, 5 aa, Mycobacterium avium
RGSAT

SEQ ID NO: 56007 - protein, 10 aa, Mycobacterium avium
RGSEGGGHGE

SEQ ID NO: 56008 - protein, 12 aa, Mycobacterium avium
RGSELSRRGRDL

SEQ ID NO: 56009 - protein, 8 aa, Mycobacterium avium
RGSGERPY

SEQ ID NO: 56010 - protein, 7 aa, Mycobacterium avium
RGSGMPD

SEQ ID NO: 56011 - protein, 9 aa, Mycobacterium avium
RGSLSGDQA

SEQ ID NO: 56012 - protein, 5 aa, Mycobacterium avium
RGSYD

SEQ ID NO: 56013 - protein, 5 aa, Mycobacterium avium
RGTAR

SEQ ID NO: 56014 - protein, 10 aa, Mycobacterium avium
RGTGGAQPGC

SEQ ID NO: 56015 - protein, 11 aa, Mycobacterium avium
RGTTQKASRIR

SEQ ID NO: 56016 - protein, 10 aa, Mycobacterium avium
RGVDAHGRSG

SEQ ID NO: 56017 - protein, 14 aa, Mycobacterium avium
RGVEHTATGPQRLT

SEQ ID NO: 56018 - protein, 7 aa, Mycobacterium avium
RGVPAPV

SEQ ID NO: 56019 - protein, 13 aa, Mycobacterium avium
RGVSSFAGDGTQR

SEQ ID NO: 56020 - protein, 6 aa, Mycobacterium avium
RGWPED

SEQ ID NO: 56021 - protein, 4 aa, Mycobacterium avium
RGYA

SEQ ID NO: 56022 - protein, 14 aa, Mycobacterium avium
RGYATNREESEEGV

SEQ ID NO: 56023 - protein, 7 aa, Mycobacterium avium
RGYGEDE

SEQ ID NO: 56024 - protein, 10 aa, Mycobacterium avium
RHGADAAEVD

SEQ ID NO: 56025 - protein, 7 aa, Mycobacterium avium
RHGDRHG

SEQ ID NO: 56026 - protein, 9 aa, Mycobacterium avium
RHGPTAGDF

SEQ ID NO: 56027 - protein, 7 aa, Mycobacterium avium
RHNKAAQ

SEQ ID NO: 56028 - protein, 9 aa, Mycobacterium avium
RHPDGNDAD

SEQ ID NO: 56029 - protein, 11 aa, Mycobacterium avium
RHPEAAARLQP

SEQ ID NO: 56030 - protein, 7 aa, Mycobacterium avium
RHPGGAS

SEQ ID NO: 56031 - protein, 5 aa, Mycobacterium avium
RHPPR

SEQ ID NO: 56032 - protein, 4 aa, Mycobacterium avium
RHPR

SEQ ID NO: 56033 - protein, 6 aa, Mycobacterium avium
RHPRDD

SEQ ID NO: 56034 - protein, 4 aa, Mycobacterium avium
RHSQ

SEQ ID NO: 56035 - protein, 6 aa, Mycobacterium avium
RHTGLQ

SEQ ID NO: 56036 - protein, 5 aa, Mycobacterium avium
RHTGS

SEQ ID NO: 56037 - protein, 15 aa, Mycobacterium avium
RHTHGRPDTAAGSHE

SEQ ID NO: 56038 - protein, 8 aa, Mycobacterium avium
RIAPAGNG

SEQ ID NO: 56039 - protein, 5 aa, Mycobacterium avium
RIDSY

SEQ ID NO: 56040 - protein, 6 aa, Mycobacterium avium
RIGPEE

SEQ ID NO: 56041 - protein, 19 aa, Mycobacterium avium
RIGRTAQARLDEPDSRPVP

SEQ ID NO: 56042 - protein, 5 aa, Mycobacterium avium
RIGTA

SEQ ID NO: 56043 - protein, 8 aa, Mycobacterium avium
RINDGGAV

SEQ ID NO: 56044 - protein, 9 aa, Mycobacterium avium
RIRQRSGEL

SEQ ID NO: 56045 - protein, 6 aa, Mycobacterium avium
RISPGS

SEQ ID NO: 56046 - protein, 9 aa, Mycobacterium avium
RITGETTLD

SEQ ID NO: 56047 - protein, 16 aa, Mycobacterium avium
RITSGADAENAAGPGF

SEQ ID NO: 56048 - protein, 8 aa, Mycobacterium avium
RKAGTEIR

SEQ ID NO: 56049 - protein, 16 aa, Mycobacterium avium
RKAGYKPARREGAREG

SEQ ID NO: 56050 - protein, 15 aa, Mycobacterium avium
RKAMEDAEGAEAEPA

SEQ ID NO: 56051 - protein, 6 aa, Mycobacterium avium
RKARHN

SEQ ID NO: 56052 - protein, 9 aa, Mycobacterium avium
RKDGSGTLV

SEQ ID NO: 56053 - protein, 7 aa, Mycobacterium avium
RKDGVEA

SEQ ID NO: 56054 - protein, 4 aa, Mycobacterium avium
RKEQ

SEQ ID NO: 56055 - protein, 5 aa, Mycobacterium avium
RKGAA

SEQ ID NO: 56056 - protein, 4 aa, Mycobacterium avium
RKGN

SEQ ID NO: 56057 - protein, 7 aa, Mycobacterium avium
RKGRGGS

SEQ ID NO: 56058 - protein, 8 aa, Mycobacterium avium
RKKAAAAE

SEQ ID NO: 56059 - protein, 5 aa, Mycobacterium avium
RKKNR

SEQ ID NO: 56060 - protein, 9 aa, Mycobacterium avium
RKNGRGETE

SEQ ID NO: 56061 - protein, 7 aa, Mycobacterium avium
RKPEVAE

SEQ ID NO: 56062 - protein, 10 aa, Mycobacterium avium
RKPKDGETKQ

SEQ ID NO: 56063 - protein, 19 aa, Mycobacterium avium
RKPQRNTESRTATPKADTS

SEQ ID NO: 56064 - protein, 7 aa, Mycobacterium avium
RKPSEYV

SEQ ID NO: 56065 - protein, 5 aa, Mycobacterium avium
RKPSL

SEQ ID NO: 56066 - protein, 6 aa, Mycobacterium avium
RKPTAT

SEQ ID NO: 56067 - protein, 9 aa, Mycobacterium avium
RKPTKSPNQ

SEQ ID NO: 56068 - protein, 13 aa, Mycobacterium avium
RKRAGASGDADVP

SEQ ID NO: 56069 - protein, 8 aa, Mycobacterium avium
RKRDAEGA

SEQ ID NO: 56070 - protein, 8 aa, Mycobacterium avium
RKRDPQHA

SEQ ID NO: 56071 - protein, 6 aa, Mycobacterium avium
RKRGWS

SEQ ID NO: 56072 - protein, 8 aa, Mycobacterium avium
RKRKEKAL

SEQ ID NO: 56073 - protein, 7 aa, Mycobacterium avium
RKRPPPL

SEQ ID NO: 56074 - protein, 6 aa, Mycobacterium avium
RKRRQP

SEQ ID NO: 56075 - protein, 9 aa, Mycobacterium avium
RKRSEERAE

SEQ ID NO: 56076 - protein, 8 aa, Mycobacterium avium
RKSGAPRY

SEQ ID NO: 56077 - protein, 9 aa, Mycobacterium avium
RKSMDADAA

SEQ ID NO: 56078 - protein, 9 aa, Mycobacterium avium
RKSVTLDPQ

SEQ ID NO: 56079 - protein, 4 aa, Mycobacterium avium
RKTC

SEQ ID NO: 56080 - protein, 9 aa, Mycobacterium avium
RKTYGRNSD

SEQ ID NO: 56081 - protein, 4 aa, Mycobacterium avium
RLAA

SEQ ID NO: 56082 - protein, 8 aa, Mycobacterium avium
RLADQGAD

SEQ ID NO: 56083 - protein, 4 aa, Mycobacterium avium
RLDG

SEQ ID NO: 56084 - protein, 5 aa, Mycobacterium avium
RLDPA

SEQ ID NO: 56085 - protein, 8 aa, Mycobacterium avium
RLEGDRSG

SEQ ID NO: 56086 - protein, 8 aa, Mycobacterium avium
RLEPAGPG

SEQ ID NO: 56087 - protein, 4 aa, Mycobacterium avium
RLGE

SEQ ID NO: 56088 - protein, 8 aa, Mycobacterium avium
RLGGPGVD

SEQ ID NO: 56089 - protein, 12 aa, Mycobacterium avium
RLGKKTGQGFYT

SEQ ID NO: 56090 - protein, 17 aa, Mycobacterium avium
RLGPSASLPGNPADDRG

SEQ ID NO: 56091 - protein, 7 aa, Mycobacterium avium
RLGPTDA

SEQ ID NO: 56092 - protein, 11 aa, Mycobacterium avium
RLGRATQALPN

SEQ ID NO: 56093 - protein, 5 aa, Mycobacterium avium
RLGRP

SEQ ID NO: 56094 - protein, 7 aa, Mycobacterium avium
RLNPAAG

SEQ ID NO: 56095 - protein, 4 aa, Mycobacterium avium
RLPA

SEQ ID NO: 56096 - protein, 15 aa, Mycobacterium avium
RLPDAVERSLRMLES

SEQ ID NO: 56097 - protein, 17 aa, Mycobacterium avium
RLPDGSHAAGADPDGSW

SEQ ID NO: 56098 - protein, 16 aa, Mycobacterium avium
RLPDGSTAWKRSPGGL

SEQ ID NO: 56099 - protein, 8 aa, Mycobacterium avium
RLPEPSPA

SEQ ID NO: 56100 - protein, 12 aa, Mycobacterium avium
RLPGDMNSPDET

SEQ ID NO: 56101 - protein, 11 aa, Mycobacterium avium
RLPGYTAGDTD

SEQ ID NO: 56102 - protein, 6 aa, Mycobacterium avium
RLPNTT

SEQ ID NO: 56103 - protein, 9 aa, Mycobacterium avium
RLPPPDPHA

SEQ ID NO: 56104 - protein, 4 aa, Mycobacterium avium
RLPR

SEQ ID NO: 56105 - protein, 4 aa, Mycobacterium avium
RLPS

SEQ ID NO: 56106 - protein, 5 aa, Mycobacterium avium
RLQPG

SEQ ID NO: 56107 - protein, 10 aa, Mycobacterium avium
RLSPETNKAL

SEQ ID NO: 56108 - protein, 6 aa, Mycobacterium avium
RLTAAT

SEQ ID NO: 56109 - protein, 10 aa, Mycobacterium avium
RLTDGQGRTV

SEQ ID NO: 56110 - protein, 7 aa, Mycobacterium avium
RLTQRGS

SEQ ID NO: 56111 - protein, 9 aa, Mycobacterium avium
RLVTPDDDE

SEQ ID NO: 56112 - protein, 6 aa, Mycobacterium avium
RMAPPE

SEQ ID NO: 56113 - protein, 4 aa, Mycobacterium avium
RMPG

SEQ ID NO: 56114 - protein, 15 aa, Mycobacterium avium
RMQDGEPHLAGTARK

SEQ ID NO: 56115 - protein, 13 aa, Mycobacterium avium
RNADGTVKEPRYY

SEQ ID NO: 56116 - protein, 9 aa, Mycobacterium avium
RNAGAAARN

SEQ ID NO: 56117 - protein, 17 aa, Mycobacterium avium
RNAQETPQEPAAEPVNR

SEQ ID NO: 56118 - protein, 6 aa, Mycobacterium avium
RNDPAF

SEQ ID NO: 56119 - protein, 21 aa, Mycobacterium avium
RNDQPGRQGDYPEFETGPQRT

SEQ ID NO: 56120 - protein, 7 aa, Mycobacterium avium
RNEAGPQ

SEQ ID NO: 56121 - protein, 8 aa, Mycobacterium avium
RNGDGKSS

SEQ ID NO: 56122 - protein, 11 aa, Mycobacterium avium
RNGSVRPGDPV

SEQ ID NO: 56123 - protein, 12 aa, Mycobacterium avium
RNHELADENRRL

SEQ ID NO: 56124 - protein, 11 aa, Mycobacterium avium
RNHTSQRWPAG

SEQ ID NO: 56125 - protein, 7 aa, Mycobacterium avium
RNPDKAA

SEQ ID NO: 56126 - protein, 15 aa, Mycobacterium avium
RNPNRGDDLAHRPPA

SEQ ID NO: 56127 - protein, 6 aa, Mycobacterium avium
RNQQAH

SEQ ID NO: 56128 - protein, 10 aa, Mycobacterium avium
RNSAGFGAPR

SEQ ID NO: 56129 - protein, 4 aa, Mycobacterium avium
RNTA

SEQ ID NO: 56130 - protein, 9 aa, Mycobacterium avium
RNTAPPAQY

SEQ ID NO: 56131 - protein, 8 aa, Mycobacterium avium
RNTDPESF

SEQ ID NO: 56132 - protein, 6 aa, Mycobacterium avium
RNTRGM

SEQ ID NO: 56133 - protein, 11 aa, Mycobacterium avium
RPAAEAAARRV

SEQ ID NO: 56134 - protein, 5 aa, Mycobacterium avium
RPAAG

SEQ ID NO: 56135 - protein, 5 aa, Mycobacterium avium
RPADR

SEQ ID NO: 56136 - protein, 4 aa, Mycobacterium avium
RPAE

SEQ ID NO: 56137 - protein, 10 aa, Mycobacterium avium
RPAGGDPAAE

SEQ ID NO: 56138 - protein, 13 aa, Mycobacterium avium
RPALTEPAPAPVS

SEQ ID NO: 56139 - protein, 40 aa, Mycobacterium avium
RPARGRPPVAEADDAESESDSASESDAEDVHDPLVDPLHT

SEQ ID NO: 56140 - protein, 8 aa, Mycobacterium avium
RPASGRVS

SEQ ID NO: 56141 - protein, 8 aa, Mycobacterium avium
RPASPQRR

SEQ ID NO: 56142 - protein, 5 aa, Mycobacterium avium
RPDAQ

SEQ ID NO: 56143 - protein, 6 aa, Mycobacterium avium
RPDATP

SEQ ID NO: 56144 - protein, 6 aa, Mycobacterium avium
RPDGAS

SEQ ID NO: 56145 - protein, 8 aa, Mycobacterium avium
RPDGTPEG

SEQ ID NO: 56146 - protein, 6 aa, Mycobacterium avium
RPDGTS

SEQ ID NO: 56147 - protein, 9 aa, Mycobacterium avium
RPDQQRPGF

SEQ ID NO: 56148 - protein, 5 aa, Mycobacterium avium
RPDRT

SEQ ID NO: 56149 - protein, 7 aa, Mycobacterium avium
RPDSPSV

SEQ ID NO: 56150 - protein, 8 aa, Mycobacterium avium
RPDVRQRD

SEQ ID NO: 56151 - protein, 8 aa, Mycobacterium avium
RPEARNAV

SEQ ID NO: 56152 - protein, 4 aa, Mycobacterium avium
RPED

SEQ ID NO: 56153 - protein, 9 aa, Mycobacterium avium
RPEPRLAQG

SEQ ID NO: 56154 - protein, 8 aa, Mycobacterium avium
RPERRNAL

SEQ ID NO: 56155 - protein, 5 aa, Mycobacterium avium
RPESV

SEQ ID NO: 56156 - protein, 4 aa, Mycobacterium avium
RPET

SEQ ID NO: 56157 - protein, 4 aa, Mycobacterium avium
RPFH

SEQ ID NO: 56158 - protein, 34 aa, Mycobacterium avium
RPFSAEEQQRIQEQYPERRRRSAYATSGTPHGTY

SEQ ID NO: 56159 - protein, 29 aa, Mycobacterium avium
RPGDGTAGHPPRPADDGRDPYSPSPPVQL

SEQ ID NO: 56160 - protein, 6 aa, Mycobacterium avium
RPGEPL

SEQ ID NO: 56161 - protein, 9 aa, Mycobacterium avium
RPGEPVAAG

SEQ ID NO: 56162 - protein, 15 aa, Mycobacterium avium
RPGGGAKLARSAGSS

SEQ ID NO: 56163 - protein, 17 aa, Mycobacterium avium
RPGGWQQAQQPDASDAA

SEQ ID NO: 56164 - protein, 23 aa, Mycobacterium avium
RPGLPGEWPTGYDDATQQNTPAW

SEQ ID NO: 56165 - protein, 23 aa, Mycobacterium avium
RPGPKHDSAVADYQKDHQGPLGS

SEQ ID NO: 56166 - protein, 7 aa, Mycobacterium avium
RPGPMDT

SEQ ID NO: 56167 - protein, 9 aa, Mycobacterium avium
RPGQVQPST

SEQ ID NO: 56168 - protein, 9 aa, Mycobacterium avium
RPGSGREAT

SEQ ID NO: 56169 - protein, 6 aa, Mycobacterium avium
RPGSLG

SEQ ID NO: 56170 - protein, 7 aa, Mycobacterium avium
RPGVGPR

SEQ ID NO: 56171 - protein, 5 aa, Mycobacterium avium
RPGYE

SEQ ID NO: 56172 - protein, 19 aa, Mycobacterium avium
RPGYGSSAPYPGAMTRPEQ

SEQ ID NO: 56173 - protein, 4 aa, Mycobacterium avium
RPKR

SEQ ID NO: 56174 - protein, 4 aa, Mycobacterium avium
RPKT

SEQ ID NO: 56175 - protein, 6 aa, Mycobacterium avium
RPLADG

SEQ ID NO: 56176 - protein, 5 aa, Mycobacterium avium
RPLGY

SEQ ID NO: 56177 - protein, 7 aa, Mycobacterium avium
RPLPRSA

SEQ ID NO: 56178 - protein, 10 aa, Mycobacterium avium
RPNDERRNRS

SEQ ID NO: 56179 - protein, 9 aa, Mycobacterium avium
RPNRRRTEL

SEQ ID NO: 56180 - protein, 10 aa, Mycobacterium avium
RPNTGKSTLT

SEQ ID NO: 56181 - protein, 15 aa, Mycobacterium avium
RPPADTRPVLHGKHA

SEQ ID NO: 56182 - protein, 6 aa, Mycobacterium avium
RPPEGD

SEQ ID NO: 56183 - protein, 6 aa, Mycobacterium avium
RPPERF

SEQ ID NO: 56184 - protein, 7 aa, Mycobacterium avium
RPPLPDS

SEQ ID NO: 56185 - protein, 6 aa, Mycobacterium avium
RPPPVE

SEQ ID NO: 56186 - protein, 4 aa, Mycobacterium avium
RPPR

SEQ ID NO: 56187 - protein, 7 aa, Mycobacterium avium
RPPSADP

SEQ ID NO: 56188 - protein, 15 aa, Mycobacterium avium
RPPVVPTEARRRAQR

SEQ ID NO: 56189 - protein, 4 aa, Mycobacterium avium
RPQL

SEQ ID NO: 56190 - protein, 6 aa, Mycobacterium avium
RPQRPI

SEQ ID NO: 56191 - protein, 5 aa, Mycobacterium avium
RPRAA

SEQ ID NO: 56192 - protein, 6 aa, Mycobacterium avium
RPRARG

SEQ ID NO: 56193 - protein, 12 aa, Mycobacterium avium
RPRRGADPSEWA

SEQ ID NO: 56194 - protein, 4 aa, Mycobacterium avium
RPRS

SEQ ID NO: 56195 - protein, 9 aa, Mycobacterium avium
RPSALDSET

SEQ ID NO: 56196 - protein, 7 aa, Mycobacterium avium
RPSGRWG

SEQ ID NO: 56197 - protein, 8 aa, Mycobacterium avium
RPSLTRGG

SEQ ID NO: 56198 - protein, 9 aa, Mycobacterium avium
RPSQSTLSL

SEQ ID NO: 56199 - protein, 7 aa, Mycobacterium avium
RPSRRNA

SEQ ID NO: 56200 - protein, 7 aa, Mycobacterium avium
RPSWPGG

SEQ ID NO: 56201 - protein, 5 aa, Mycobacterium avium
RPTAQ

SEQ ID NO: 56202 - protein, 13 aa, Mycobacterium avium
RPTASDPTLAPRG

SEQ ID NO: 56203 - protein, 5 aa, Mycobacterium avium
RPTEL

SEQ ID NO: 56204 - protein, 12 aa, Mycobacterium avium
RPTGRGAEREMA

SEQ ID NO: 56205 - protein, 4 aa, Mycobacterium avium
RPTL

SEQ ID NO: 56206 - protein, 5 aa, Mycobacterium avium
RPTLE

SEQ ID NO: 56207 - protein, 10 aa, Mycobacterium avium
RPTNGRREIT

SEQ ID NO: 56208 - protein, 6 aa, Mycobacterium avium
RPTPEN

SEQ ID NO: 56209 - protein, 6 aa, Mycobacterium avium
RPTPRR

SEQ ID NO: 56210 - protein, 4 aa, Mycobacterium avium
RPTS

SEQ ID NO: 56211 - protein, 10 aa, Mycobacterium avium
RPTSGRASVA

SEQ ID NO: 56212 - protein, 5 aa, Mycobacterium avium
RPTTL

SEQ ID NO: 56213 - protein, 13 aa, Mycobacterium avium
RPVHSGDPDDPAP

SEQ ID NO: 56214 - protein, 8 aa, Mycobacterium avium
RPVPAGRY

SEQ ID NO: 56215 - protein, 12 aa, Mycobacterium avium
RPVPGPDTEAGP

SEQ ID NO: 56216 - protein, 6 aa, Mycobacterium avium
RPVSTP

SEQ ID NO: 56217 - protein, 4 aa, Mycobacterium avium
RPVV

SEQ ID NO: 56218 - protein, 6 aa, Mycobacterium avium
RQAAAA

SEQ ID NO: 56219 - protein, 8 aa, Mycobacterium avium
RQADGAPV

SEQ ID NO: 56220 - protein, 8 aa, Mycobacterium avium
RQADPTLA

SEQ ID NO: 56221 - protein, 5 aa, Mycobacterium avium
RQAEL

SEQ ID NO: 56222 - protein, 9 aa, Mycobacterium avium
RQAGRRTAA

SEQ ID NO: 56223 - protein, 7 aa, Mycobacterium avium
RQATADA

SEQ ID NO: 56224 - protein, 5 aa, Mycobacterium avium
RQEPR

SEQ ID NO: 56225 - protein, 13 aa, Mycobacterium avium
RQGAASDSAADGW

SEQ ID NO: 56226 - protein, 9 aa, Mycobacterium avium
RQGGGPARQ

SEQ ID NO: 56227 - protein, 4 aa, Mycobacterium avium
RQGI

SEQ ID NO: 56228 - protein, 4 aa, Mycobacterium avium
RQGQ

SEQ ID NO: 56229 - protein, 8 aa, Mycobacterium avium
RQPDGGWG

SEQ ID NO: 56230 - protein, 6 aa, Mycobacterium avium
RQPGGD

SEQ ID NO: 56231 - protein, 12 aa, Mycobacterium avium
RQPLPKTARCRP

SEQ ID NO: 56232 - protein, 5 aa, Mycobacterium avium
RQPNL

SEQ ID NO: 56233 - protein, 9 aa, Mycobacterium avium
RQQAGKPLT

SEQ ID NO: 56234 - protein, 5 aa, Mycobacterium avium
RQQQR

SEQ ID NO: 56235 - protein, 28 aa, Mycobacterium avium
RQRELEDAARQLGPRATAVRGDVGAPRD

SEQ ID NO: 56236 - protein, 8 aa, Mycobacterium avium
RQRPRGEA

SEQ ID NO: 56237 - protein, 8 aa, Mycobacterium avium
RQSGRPVG

SEQ ID NO: 56238 - protein, 16 aa, Mycobacterium avium
RQTHEPARVQIDPLHI

SEQ ID NO: 56239 - protein, 7 aa, Mycobacterium avium
RQTPEPL

SEQ ID NO: 56240 - protein, 6 aa, Mycobacterium avium
RQYGIE

SEQ ID NO: 56241 - protein, 10 aa, Mycobacterium avium
RRAAAERTSV

SEQ ID NO: 56242 - protein, 9 aa, Mycobacterium avium
RRAARGAAR

SEQ ID NO: 56243 - protein, 7 aa, Mycobacterium avium
RRAEKAT

SEQ ID NO: 56244 - protein, 8 aa, Mycobacterium avium
RRAEPKDD

SEQ ID NO: 56245 - protein, 9 aa, Mycobacterium avium
RRAGGRDDA

SEQ ID NO: 56246 - protein, 14 aa, Mycobacterium avium
RRAGRPGTATARPS

SEQ ID NO: 56247 - protein, 18 aa, Mycobacterium avium
RRAKPPHPKSARTGKAGT

SEQ ID NO: 56248 - protein, 10 aa, Mycobacterium avium
RRAPDAAARR

SEQ ID NO: 56249 - protein, 10 aa, Mycobacterium avium
RRAQEQGYGA

SEQ ID NO: 56250 - protein, 10 aa, Mycobacterium avium
RRAQPDWTPR

SEQ ID NO: 56251 - protein, 6 aa, Mycobacterium avium
RRAQRG

SEQ ID NO: 56252 - protein, 9 aa, Mycobacterium avium
RRASDDVPA

SEQ ID NO: 56253 - protein, 6 aa, Mycobacterium avium
RRATRV

SEQ ID NO: 56254 - protein, 7 aa, Mycobacterium avium
RRCTPDD

SEQ ID NO: 56255 - protein, 7 aa, Mycobacterium avium
RRDEQQE

SEQ ID NO: 56256 - protein, 13 aa, Mycobacterium avium
RRDGIDAASEIAS

SEQ ID NO: 56257 - protein, 6 aa, Mycobacterium avium
RRDGLP

SEQ ID NO: 56258 - protein, 19 aa, Mycobacterium avium
RRDIGRGDTVRTPGAWRDT

SEQ ID NO: 56259 - protein, 9 aa, Mycobacterium avium
RRDKIGKVK

SEQ ID NO: 56260 - protein, 17 aa, Mycobacterium avium
RRDNANGARAKSQTVRT

SEQ ID NO: 56261 - protein, 12 aa, Mycobacterium avium
RRDQRASTSAIT

SEQ ID NO: 56262 - protein, 10 aa, Mycobacterium avium
RRDSPARGGR

SEQ ID NO: 56263 - protein, 7 aa, Mycobacterium avium
RRDTDGY

SEQ ID NO: 56264 - protein, 8 aa, Mycobacterium avium
RRDTDGYG

SEQ ID NO: 56265 - protein, 6 aa, Mycobacterium avium
RRELDG

SEQ ID NO: 56266 - protein, 9 aa, Mycobacterium avium
RREPAPRPI

SEQ ID NO: 56267 - protein, 5 aa, Mycobacterium avium
RREPE

SEQ ID NO: 56268 - protein, 11 aa, Mycobacterium avium
RRERGSINPDD

SEQ ID NO: 56269 - protein, 5 aa, Mycobacterium avium
RREVA

SEQ ID NO: 56270 - protein, 6 aa, Mycobacterium avium
RRGEGL

SEQ ID NO: 56271 - protein, 14 aa, Mycobacterium avium
RRGGPGRGKRGDVR

SEQ ID NO: 56272 - protein, 8 aa, Mycobacterium avium
RRGGQTTI

SEQ ID NO: 56273 - protein, 22 aa, Mycobacterium avium
RRGRGLSTAEAEPYSLGREAED

SEQ ID NO: 56274 - protein, 9 aa, Mycobacterium avium
RRGRLGNVE

SEQ ID NO: 56275 - protein, 6 aa, Mycobacterium avium
RRGRPV

SEQ ID NO: 56276 - protein, 5 aa, Mycobacterium avium
RRHAR

SEQ ID NO: 56277 - protein, 8 aa, Mycobacterium avium
RRHPDGSG

SEQ ID NO: 56278 - protein, 11 aa, Mycobacterium avium
RRHPDSAVPAE

SEQ ID NO: 56279 - protein, 9 aa, Mycobacterium avium
RRHRKQPPL

SEQ ID NO: 56280 - protein, 8 aa, Mycobacterium avium
RRLDDAQP

SEQ ID NO: 56281 - protein, 10 aa, Mycobacterium avium
RRLDRGRGPF

SEQ ID NO: 56282 - protein, 8 aa, Mycobacterium avium
RRLEGDGI

SEQ ID NO: 56283 - protein, 9 aa, Mycobacterium avium
RRLGETADQ

SEQ ID NO: 56284 - protein, 6 aa, Mycobacterium avium
RRLSTY

SEQ ID NO: 56285 - protein, 10 aa, Mycobacterium avium
RRMRDPDPHE

SEQ ID NO: 56286 - protein, 7 aa, Mycobacterium avium
RRNDGPA

SEQ ID NO: 56287 - protein, 4 aa, Mycobacterium avium
RRNE

SEQ ID NO: 56288 - protein, 8 aa, Mycobacterium avium
RRNGDKLS

SEQ ID NO: 56289 - protein, 6 aa, Mycobacterium avium
RRPAAQ

SEQ ID NO: 56290 - protein, 9 aa, Mycobacterium avium
RRPADSGDA

SEQ ID NO: 56291 - protein, 7 aa, Mycobacterium avium
RRPAGDH

SEQ ID NO: 56292 - protein, 16 aa, Mycobacterium avium
RRPDPLQATAKEVEAL

SEQ ID NO: 56293 - protein, 13 aa, Mycobacterium avium
RRPDRSADRHPPQ

SEQ ID NO: 56294 - protein, 5 aa, Mycobacterium avium
RRPEA

SEQ ID NO: 56295 - protein, 7 aa, Mycobacterium avium
RRPGETA

SEQ ID NO: 56296 - protein, 4 aa, Mycobacterium avium
RRPI

SEQ ID NO: 56297 - protein, 7 aa, Mycobacterium avium
RRPNTDD

SEQ ID NO: 56298 - protein, 14 aa, Mycobacterium avium
RRPPHDIEDATPQT

SEQ ID NO: 56299 - protein, 5 aa, Mycobacterium avium
RRPRP

SEQ ID NO: 56300 - protein, 13 aa, Mycobacterium avium
RRPRRDRTVPADD

SEQ ID NO: 56301 - protein, 19 aa, Mycobacterium avium
RRPTGTDPRTHPSTDQISE

SEQ ID NO: 56302 - protein, 8 aa, Mycobacterium avium
RRQAASDA

SEQ ID NO: 56303 - protein, 5 aa, Mycobacterium avium
RRQGR

SEQ ID NO: 56304 - protein, 8 aa, Mycobacterium avium
RRQNPQDD

SEQ ID NO: 56305 - protein, 6 aa, Mycobacterium avium
RRQPTG

SEQ ID NO: 56306 - protein, 10 aa, Mycobacterium avium
RRQRIRTGNA

SEQ ID NO: 56307 - protein, 9 aa, Mycobacterium avium
RRQTSADIR

SEQ ID NO: 56308 - protein, 5 aa, Mycobacterium avium
RRREL

SEQ ID NO: 56309 - protein, 5 aa, Mycobacterium avium
RRRIK

SEQ ID NO: 56310 - protein, 9 aa, Mycobacterium avium
RRRPDLDPD

SEQ ID NO: 56311 - protein, 12 aa, Mycobacterium avium
RRRPRRRSRGRR

SEQ ID NO: 56312 - protein, 11 aa, Mycobacterium avium
RRRRDVGNRTV

SEQ ID NO: 56313 - protein, 10 aa, Mycobacterium avium
RRRSEKSRTA

SEQ ID NO: 56314 - protein, 22 aa, Mycobacterium avium
RRRSGADVSRRDDAERSDEEER

SEQ ID NO: 56315 - protein, 10 aa, Mycobacterium avium
RRRTAEDSAG

SEQ ID NO: 56316 - protein, 10 aa, Mycobacterium avium
RRRTGGSDAG

SEQ ID NO: 56317 - protein, 15 aa, Mycobacterium avium
RRSDAVSAPDRWSAA

SEQ ID NO: 56318 - protein, 17 aa, Mycobacterium avium
RRSDGPPRIIVHPNGDT

SEQ ID NO: 56319 - protein, 14 aa, Mycobacterium avium
RRSKVRGARRGERV

SEQ ID NO: 56320 - protein, 22 aa, Mycobacterium avium
RRSLPSRDSTRPRRPRASVKGG

SEQ ID NO: 56321 - protein, 4 aa, Mycobacterium avium
RRSY

SEQ ID NO: 56322 - protein, 7 aa, Mycobacterium avium
RRTAEEL

SEQ ID NO: 56323 - protein, 9 aa, Mycobacterium avium
RRTDGTTNG

SEQ ID NO: 56324 - protein, 9 aa, Mycobacterium avium
RRTDPEDDT

SEQ ID NO: 56325 - protein, 6 aa, Mycobacterium avium
RRTEEV

SEQ ID NO: 56326 - protein, 8 aa, Mycobacterium avium
RRTGGADC

SEQ ID NO: 56327 - protein, 5 aa, Mycobacterium avium
RRTHE

SEQ ID NO: 56328 - protein, 8 aa, Mycobacterium avium
RRTPDDDI

SEQ ID NO: 56329 - protein, 8 aa, Mycobacterium avium
RRTRATRN

SEQ ID NO: 56330 - protein, 12 aa, Mycobacterium avium
RRTRDGAEPAAH

SEQ ID NO: 56331 - protein, 27 aa, Mycobacterium avium
RRVGGRRRGRSGSGRGRGAIDREQSAA

SEQ ID NO: 56332 - protein, 30 aa, Mycobacterium avium
RRVPEREPAPPTAPRPGGMPPWDSTPVTGI

SEQ ID NO: 56333 - protein, 6 aa, Mycobacterium avium
RRWPDR

SEQ ID NO: 56334 - protein, 11 aa, Mycobacterium avium
RRYANTPRGAR

SEQ ID NO: 56335 - protein, 7 aa, Mycobacterium avium
RRYDGDE

SEQ ID NO: 56336 - protein, 14 aa, Mycobacterium avium
RSAAAGSAVRPETK

SEQ ID NO: 56337 - protein, 9 aa, Mycobacterium avium
RSAAEPNLD

SEQ ID NO: 56338 - protein, 6 aa, Mycobacterium avium
RSAAET

SEQ ID NO: 56339 - protein, 11 aa, Mycobacterium avium
RSAEQRADGDI

SEQ ID NO: 56340 - protein, 13 aa, Mycobacterium avium
RSAGGNSETQGEN

SEQ ID NO: 56341 - protein, 7 aa, Mycobacterium avium
RSAHTRR

SEQ ID NO: 56342 - protein, 6 aa, Mycobacterium avium
RSAKDT

SEQ ID NO: 56343 - protein, 10 aa, Mycobacterium avium
RSALGIGPGQ

SEQ ID NO: 56344 - protein, 12 aa, Mycobacterium avium
RSALNPRPDREA

SEQ ID NO: 56345 - protein, 9 aa, Mycobacterium avium
RSAPKDFPG

SEQ ID NO: 56346 - protein, 8 aa, Mycobacterium avium
RSATGGAG

SEQ ID NO: 56347 - protein, 5 aa, Mycobacterium avium
RSCPE

SEQ ID NO: 56348 - protein, 9 aa, Mycobacterium avium
RSDEADVDK

SEQ ID NO: 56349 - protein, 7 aa, Mycobacterium avium
RSDEEAW

SEQ ID NO: 56350 - protein, 15 aa, Mycobacterium avium
RSDTGGTTVQLSARI

SEQ ID NO: 56351 - protein, 8 aa, Mycobacterium avium
RSEAERSL

SEQ ID NO: 56352 - protein, 7 aa, Mycobacterium avium
RSEERKA

SEQ ID NO: 56353 - protein, 10 aa, Mycobacterium avium
RSEPVTPAPV

SEQ ID NO: 56354 - protein, 9 aa, Mycobacterium avium
RSGAANTAA

SEQ ID NO: 56355 - protein, 7 aa, Mycobacterium avium
RSGDDTV

SEQ ID NO: 56356 - protein, 6 aa, Mycobacterium avium
RSGELP

SEQ ID NO: 56357 - protein, 7 aa, Mycobacterium avium
RSGGADI

SEQ ID NO: 56358 - protein, 8 aa, Mycobacterium avium
RSGPKLSG

SEQ ID NO: 56359 - protein, 10 aa, Mycobacterium avium
RSGPTGATPR

SEQ ID NO: 56360 - protein, 9 aa, Mycobacterium avium
RSGRIGGPA

SEQ ID NO: 56361 - protein, 13 aa, Mycobacterium avium
RSGRTARAGSAGD

SEQ ID NO: 56362 - protein, 5 aa, Mycobacterium avium
RSGTL

SEQ ID NO: 56363 - protein, 5 aa, Mycobacterium avium
RSGTT

SEQ ID NO: 56364 - protein, 6 aa, Mycobacterium avium
RSGVTG

SEQ ID NO: 56365 - protein, 7 aa, Mycobacterium avium
RSHPDVA

SEQ ID NO: 56366 - protein, 4 aa, Mycobacterium avium
RSIP

SEQ ID NO: 56367 - protein, 10 aa, Mycobacterium avium
RSKPRSPEGL

SEQ ID NO: 56368 - protein, 9 aa, Mycobacterium avium
RSLGDRSHD

SEQ ID NO: 56369 - protein, 6 aa, Mycobacterium avium
RSLRTR

SEQ ID NO: 56370 - protein, 13 aa, Mycobacterium avium
RSLSGSNIGGIAE

SEQ ID NO: 56371 - protein, 5 aa, Mycobacterium avium
RSNRI

SEQ ID NO: 56372 - protein, 4 aa, Mycobacterium avium
RSPA

SEQ ID NO: 56373 - protein, 4 aa, Mycobacterium avium
RSPD

SEQ ID NO: 56374 - protein, 14 aa, Mycobacterium avium
RSPDAAKKLASRAR

SEQ ID NO: 56375 - protein, 11 aa, Mycobacterium avium
RSPDPNDKRRQ

SEQ ID NO: 56376 - protein, 4 aa, Mycobacterium avium
RSPE

SEQ ID NO: 56377 - protein, 5 aa, Mycobacterium avium
RSPHD

SEQ ID NO: 56378 - protein, 7 aa, Mycobacterium avium
RSPRPTI

SEQ ID NO: 56379 - protein, 10 aa, Mycobacterium avium
RSQQAAYGAH

SEQ ID NO: 56380 - protein, 11 aa, Mycobacterium avium
RSQRRAAEAWS

SEQ ID NO: 56381 - protein, 43 aa, Mycobacterium avium
RSQSKHSAGAGRGGSGGRVSRRAEQSAAPAGPAASRPDPRDPT

SEQ ID NO: 56382 - protein, 8 aa, Mycobacterium avium
RSRDPSDL

SEQ ID NO: 56383 - protein, 8 aa, Mycobacterium avium
RSRDRAAG

SEQ ID NO: 56384 - protein, 8 aa, Mycobacterium avium
RSRLETAR

SEQ ID NO: 56385 - protein, 6 aa, Mycobacterium avium
RSRRAY

SEQ ID NO: 56386 - protein, 10 aa, Mycobacterium avium
RSSAAARGLT

SEQ ID NO: 56387 - protein, 9 aa, Mycobacterium avium
RSSADRGTK

SEQ ID NO: 56388 - protein, 5 aa, Mycobacterium avium
RSSEP

SEQ ID NO: 56389 - protein, 9 aa, Mycobacterium avium
RSSGEDSGA

SEQ ID NO: 56390 - protein, 8 aa, Mycobacterium avium
RSSRGEHV

SEQ ID NO: 56391 - protein, 8 aa, Mycobacterium avium
RSTHAGGG

SEQ ID NO: 56392 - protein, 15 aa, Mycobacterium avium
RSTPTRYRERARYDR

SEQ ID NO: 56393 - protein, 12 aa, Mycobacterium avium
RSTRPATDAERE

SEQ ID NO: 56394 - protein, 10 aa, Mycobacterium avium
RSTRPLRETG

SEQ ID NO: 56395 - protein, 6 aa, Mycobacterium avium
RSTTIA

SEQ ID NO: 56396 - protein, 4 aa, Mycobacterium avium
RSWG

SEQ ID NO: 56397 - protein, 10 aa, Mycobacterium avium
RSYAGPEREA

SEQ ID NO: 56398 - protein, 6 aa, Mycobacterium avium
RTAATA

SEQ ID NO: 56399 - protein, 16 aa, Mycobacterium avium
RTACAGGPESAQQPVA

SEQ ID NO: 56400 - protein, 11 aa, Mycobacterium avium
RTANGAGPGHD

SEQ ID NO: 56401 - protein, 10 aa, Mycobacterium avium
RTDPAAQPGR

SEQ ID NO: 56402 - protein, 10 aa, Mycobacterium avium
RTDPEAPKHR

SEQ ID NO: 56403 - protein, 10 aa, Mycobacterium avium
RTDPNAPKHN

SEQ ID NO: 56404 - protein, 9 aa, Mycobacterium avium
RTDRGRPSR

SEQ ID NO: 56405 - protein, 8 aa, Mycobacterium avium
RTDTARPL

SEQ ID NO: 56406 - protein, 11 aa, Mycobacterium avium
RTDTGDEAGRR

SEQ ID NO: 56407 - protein, 4 aa, Mycobacterium avium
RTEA

SEQ ID NO: 56408 - protein, 6 aa, Mycobacterium avium
RTEADV

SEQ ID NO: 56409 - protein, 7 aa, Mycobacterium avium
RTEGSGF

SEQ ID NO: 56410 - protein, 7 aa, Mycobacterium avium
RTENGEE

SEQ ID NO: 56411 - protein, 4 aa, Mycobacterium avium
RTEP

SEQ ID NO: 56412 - protein, 10 aa, Mycobacterium avium
RTGAQRDGPR

SEQ ID NO: 56413 - protein, 12 aa, Mycobacterium avium
RTGATVRSAGSG

SEQ ID NO: 56414 - protein, 4 aa, Mycobacterium avium
RTGD

SEQ ID NO: 56415 - protein, 7 aa, Mycobacterium avium
RTGDPLA

SEQ ID NO: 56416 - protein, 27 aa, Mycobacterium avium
RTGDRRMSQLPDASQALTGGADGLAGR

SEQ ID NO: 56417 - protein, 5 aa, Mycobacterium avium
RTGFT

SEQ ID NO: 56418 - protein, 6 aa, Mycobacterium avium
RTGGDR

SEQ ID NO: 56419 - protein, 6 aa, Mycobacterium avium
RTGIPT

SEQ ID NO: 56420 - protein, 30 aa, Mycobacterium avium
RTGPAELTDPARAGGAVSENATDTPRRRRR

SEQ ID NO: 56421 - protein, 10 aa, Mycobacterium avium
RTGPDAPGAA

SEQ ID NO: 56422 - protein, 7 aa, Mycobacterium avium
RTGQGQE

SEQ ID NO: 56423 - protein, 10 aa, Mycobacterium avium
RTGSAGIDPI

SEQ ID NO: 56424 - protein, 6 aa, Mycobacterium avium
RTGSRR

SEQ ID NO: 56425 - protein, 5 aa, Mycobacterium avium
RTGTD

SEQ ID NO: 56426 - protein, 6 aa, Mycobacterium avium
RTGVGG

SEQ ID NO: 56427 - protein, 14 aa, Mycobacterium avium
RTGVPGEDWPRYTA

SEQ ID NO: 56428 - protein, 10 aa, Mycobacterium avium
RTIGDTPSGV

SEQ ID NO: 56429 - protein, 4 aa, Mycobacterium avium
RTIP

SEQ ID NO: 56430 - protein, 9 aa, Mycobacterium avium
RTIPGPQGA

SEQ ID NO: 56431 - protein, 5 aa, Mycobacterium avium
RTKDG

SEQ ID NO: 56432 - protein, 11 aa, Mycobacterium avium
RTKDQAGEMSE

SEQ ID NO: 56433 - protein, 6 aa, Mycobacterium avium
RTKGEY

SEQ ID NO: 56434 - protein, 4 aa, Mycobacterium avium
RTKI

SEQ ID NO: 56435 - protein, 4 aa, Mycobacterium avium
RTLA

SEQ ID NO: 56436 - protein, 24 aa, Mycobacterium avium
RTLSSDPVSRPATSYTAAAPDNSI

SEQ ID NO: 56437 - protein, 20 aa, Mycobacterium avium
RTMGDGSEYTSGPGIAEAQD

SEQ ID NO: 56438 - protein, 7 aa, Mycobacterium avium
RTNITGS

SEQ ID NO: 56439 - protein, 10 aa, Mycobacterium avium
RTNQHDGYGQ

SEQ ID NO: 56440 - protein, 8 aa, Mycobacterium avium
RTNSESIV

SEQ ID NO: 56441 - protein, 4 aa, Mycobacterium avium
RTPD

SEQ ID NO: 56442 - protein, 10 aa, Mycobacterium avium
RTPDGSGGGL

SEQ ID NO: 56443 - protein, 7 aa, Mycobacterium avium
RTPDGSR

SEQ ID NO: 56444 - protein, 6 aa, Mycobacterium avium
RTPDGV

SEQ ID NO: 56445 - protein, 6 aa, Mycobacterium avium
RTPDQG

SEQ ID NO: 56446 - protein, 10 aa, Mycobacterium avium
RTPGPLAPNA

SEQ ID NO: 56447 - protein, 13 aa, Mycobacterium avium
RTPIGTARKGTLA

SEQ ID NO: 56448 - protein, 5 aa, Mycobacterium avium
RTPKA

SEQ ID NO: 56449 - protein, 9 aa, Mycobacterium avium
RTPPYPTAT

SEQ ID NO: 56450 - protein, 5 aa, Mycobacterium avium
RTPRR

SEQ ID NO: 56451 - protein, 9 aa, Mycobacterium avium
RTPSDAPLA

SEQ ID NO: 56452 - protein, 36 aa, Mycobacterium avium
RTPTAVGGDGGATVSARTSPVAAPSRPNTPAPHTYS

SEQ ID NO: 56453 - protein, 5 aa, Mycobacterium avium
RTPTI

SEQ ID NO: 56454 - protein, 4 aa, Mycobacterium avium
RTPV

SEQ ID NO: 56455 - protein, 8 aa, Mycobacterium avium
RTQDGAPT

SEQ ID NO: 56456 - protein, 5 aa, Mycobacterium avium
RTQPT

SEQ ID NO: 56457 - protein, 4 aa, Mycobacterium avium
RTRD

SEQ ID NO: 56458 - protein, 5 aa, Mycobacterium avium
RTRQT

SEQ ID NO: 56459 - protein, 7 aa, Mycobacterium avium
RTRSGDT

SEQ ID NO: 56460 - protein, 5 aa, Mycobacterium avium
RTRTR

SEQ ID NO: 56461 - protein, 6 aa, Mycobacterium avium
RTRYSS

SEQ ID NO: 56462 - protein, 4 aa, Mycobacterium avium
RTSG

SEQ ID NO: 56463 - protein, 26 aa, Mycobacterium avium
RTSNAVKSTQPGLRPPRRTRAPRDRT

SEQ ID NO: 56464 - protein, 8 aa, Mycobacterium avium
RTSSAPAA

SEQ ID NO: 56465 - protein, 6 aa, Mycobacterium avium
RTSSDL

SEQ ID NO: 56466 - protein, 11 aa, Mycobacterium avium
RTTEEIEEAER

SEQ ID NO: 56467 - protein, 15 aa, Mycobacterium avium
RTTEVPSIEPAKDGY

SEQ ID NO: 56468 - protein, 8 aa, Mycobacterium avium
RTTGGRRV

SEQ ID NO: 56469 - protein, 6 aa, Mycobacterium avium
RTTGVG

SEQ ID NO: 56470 - protein, 16 aa, Mycobacterium avium
RTTPHPRKARHPGRPM

SEQ ID NO: 56471 - protein, 12 aa, Mycobacterium avium
RTTTPGPVSDYT

SEQ ID NO: 56472 - protein, 5 aa, Mycobacterium avium
RTTVP

SEQ ID NO: 56473 - protein, 7 aa, Mycobacterium avium
RTVGGAR

SEQ ID NO: 56474 - protein, 14 aa, Mycobacterium avium
RTVPGPGAGIVERS

SEQ ID NO: 56475 - protein, 16 aa, Mycobacterium avium
RTVTGTQLTVDMGATK

SEQ ID NO: 56476 - protein, 15 aa, Mycobacterium avium
RTWPADKKHAPSGAE

SEQ ID NO: 56477 - protein, 5 aa, Mycobacterium avium
RTYAA

SEQ ID NO: 56478 - protein, 8 aa, Mycobacterium avium
RVAPGQVT

SEQ ID NO: 56479 - protein, 8 aa, Mycobacterium avium
RVARQTGG

SEQ ID NO: 56480 - protein, 9 aa, Mycobacterium avium
RVASDGEPL

SEQ ID NO: 56481 - protein, 14 aa, Mycobacterium avium
RVDASDEDSGVTSI

SEQ ID NO: 56482 - protein, 14 aa, Mycobacterium avium
RVDPDKDADGLHPT

SEQ ID NO: 56483 - protein, 11 aa, Mycobacterium avium
RVDPKSKTHPG

SEQ ID NO: 56484 - protein, 9 aa, Mycobacterium avium
RVESGAGEV

SEQ ID NO: 56485 - protein, 5 aa, Mycobacterium avium
RVGAQ

SEQ ID NO: 56486 - protein, 11 aa, Mycobacterium avium
RVGHPDAARRV

SEQ ID NO: 56487 - protein, 18 aa, Mycobacterium avium
RVGLSGPTIQEPPAIDPN

SEQ ID NO: 56488 - protein, 6 aa, Mycobacterium avium
RVPDPT

SEQ ID NO: 56489 - protein, 5 aa, Mycobacterium avium
RVPRG

SEQ ID NO: 56490 - protein, 12 aa, Mycobacterium avium
RVRAKGGAPRVT

SEQ ID NO: 56491 - protein, 8 aa, Mycobacterium avium
RVRTPTTT

SEQ ID NO: 56492 - protein, 7 aa, Mycobacterium avium
RVSEADR

SEQ ID NO: 56493 - protein, 10 aa, Mycobacterium avium
RVSGDRGRRQ

SEQ ID NO: 56494 - protein, 5 aa, Mycobacterium avium
RVSKK

SEQ ID NO: 56495 - protein, 12 aa, Mycobacterium avium
RVSRKSAQAAAV

SEQ ID NO: 56496 - protein, 10 aa, Mycobacterium avium
RVTKPDGSPY

SEQ ID NO: 56497 - protein, 10 aa, Mycobacterium avium
RVTQRDNGST

SEQ ID NO: 56498 - protein, 13 aa, Mycobacterium avium
RWDPTKPDGTPRK

SEQ ID NO: 56499 - protein, 7 aa, Mycobacterium avium
RWRGRPG

SEQ ID NO: 56500 - protein, 5 aa, Mycobacterium avium
RYADP

SEQ ID NO: 56501 - protein, 8 aa, Mycobacterium avium
RYAGTRPD

SEQ ID NO: 56502 - protein, 9 aa, Mycobacterium avium
RYARAKAEH

SEQ ID NO: 56503 - protein, 4 aa, Mycobacterium avium
RYAS

SEQ ID NO: 56504 - protein, 8 aa, Mycobacterium avium
RYDHTDDP

SEQ ID NO: 56505 - protein, 10 aa, Mycobacterium avium
RYGGDDPVAE

SEQ ID NO: 56506 - protein, 7 aa, Mycobacterium avium
RYGIPGP

SEQ ID NO: 56507 - protein, 13 aa, Mycobacterium avium
RYHPGGLGNTGGH

SEQ ID NO: 56508 - protein, 6 aa, Mycobacterium avium
RYKPNA

SEQ ID NO: 56509 - protein, 7 aa, Mycobacterium avium
RYPQTNG

SEQ ID NO: 56510 - protein, 21 aa, Mycobacterium avium
RYSGRGNPALTETGRRQADAA

SEQ ID NO: 56511 - protein, 6 aa, Mycobacterium avium
RYTEAE

SEQ ID NO: 56512 - protein, 6 aa, Mycobacterium avium
SAAAED

SEQ ID NO: 56513 - protein, 6 aa, Mycobacterium avium
SAAASY

SEQ ID NO: 56514 - protein, 6 aa, Mycobacterium avium
SAAATR

SEQ ID NO: 56515 - protein, 7 aa, Mycobacterium avium
SAAATYP

SEQ ID NO: 56516 - protein, 15 aa, Mycobacterium avium
SAADNSIDATASRDF

SEQ ID NO: 56517 - protein, 6 aa, Mycobacterium avium
SAAEHG

SEQ ID NO: 56518 - protein, 8 aa, Mycobacterium avium
SAAGAASL

SEQ ID NO: 56519 - protein, 16 aa, Mycobacterium avium
SAAGAEAVPAAALGEG

SEQ ID NO: 56520 - protein, 7 aa, Mycobacterium avium
SAAGPDR

SEQ ID NO: 56521 - protein, 9 aa, Mycobacterium avium
SAAGSGSQR

SEQ ID NO: 56522 - protein, 17 aa, Mycobacterium avium
SAAMRAAQSADPPSPEL

SEQ ID NO: 56523 - protein, 33 aa, Mycobacterium avium
SAAPASSTAPSASTGTNAQVKVGGADLPGVNPA

SEQ ID NO: 56524 - protein, 13 aa, Mycobacterium avium
SAAPEAAGGPGNL

SEQ ID NO: 56525 - protein, 6 aa, Mycobacterium avium
SAAPSF

SEQ ID NO: 56526 - protein, 4 aa, Mycobacterium avium
SAAT

SEQ ID NO: 56527 - protein, 8 aa, Mycobacterium avium
SAATPGEA

SEQ ID NO: 56528 - protein, 28 aa, Mycobacterium avium
SAATVGELSTPATWSAPTPEPAATTVGA

SEQ ID NO: 56529 - protein, 9 aa, Mycobacterium avium
SADDHAETA

SEQ ID NO: 56530 - protein, 7 aa, Mycobacterium avium
SADERAA

SEQ ID NO: 56531 - protein, 8 aa, Mycobacterium avium
SADGTRDL

SEQ ID NO: 56532 - protein, 9 aa, Mycobacterium avium
SADPDLTSS

SEQ ID NO: 56533 - protein, 23 aa, Mycobacterium avium
SADRGGTDREGTSPPTAGQGAPA

SEQ ID NO: 56534 - protein, 8 aa, Mycobacterium avium
SADTPDGF

SEQ ID NO: 56535 - protein, 9 aa, Mycobacterium avium
SADTPTADP

SEQ ID NO: 56536 - protein, 9 aa, Mycobacterium avium
SAEALAGQA

SEQ ID NO: 56537 - protein, 8 aa, Mycobacterium avium
SAEEARRI

SEQ ID NO: 56538 - protein, 7 aa, Mycobacterium avium
SAEETAK

SEQ ID NO: 56539 - protein, 11 aa, Mycobacterium avium
SAFGDTGPWST

SEQ ID NO: 56540 - protein, 5 aa, Mycobacterium avium
SAFSA

SEQ ID NO: 56541 - protein, 6 aa, Mycobacterium avium
SAGAAL

SEQ ID NO: 56542 - protein, 12 aa, Mycobacterium avium
SAGADDVGRAEE

SEQ ID NO: 56543 - protein, 8 aa, Mycobacterium avium
SAGAGLTG

SEQ ID NO: 56544 - protein, 7 aa, Mycobacterium avium
SAGARGR

SEQ ID NO: 56545 - protein, 7 aa, Mycobacterium avium
SAGDKKI

SEQ ID NO: 56546 - protein, 12 aa, Mycobacterium avium
SAGDMDPEQRER

SEQ ID NO: 56547 - protein, 6 aa, Mycobacterium avium
SAGEPM

SEQ ID NO: 56548 - protein, 19 aa, Mycobacterium avium
SAGGFPEIKPAESAPPGLG

SEQ ID NO: 56549 - protein, 6 aa, Mycobacterium avium
SAGGGA

SEQ ID NO: 56550 - protein, 8 aa, Mycobacterium avium
SAGGPPGA

SEQ ID NO: 56551 - protein, 4 aa, Mycobacterium avium
SAGI

SEQ ID NO: 56552 - protein, 12 aa, Mycobacterium avium
SAGLGQAKTVGT

SEQ ID NO: 56553 - protein, 7 aa, Mycobacterium avium
SAGNHAQ

SEQ ID NO: 56554 - protein, 6 aa, Mycobacterium avium
SAGPAW

SEQ ID NO: 56555 - protein, 5 aa, Mycobacterium avium
SAGRA

SEQ ID NO: 56556 - protein, 12 aa, Mycobacterium avium
SAGRPDIGGEGA

SEQ ID NO: 56557 - protein, 13 aa, Mycobacterium avium
SAGRTGDFRPTQS

SEQ ID NO: 56558 - protein, 5 aa, Mycobacterium avium
SAGTF

SEQ ID NO: 56559 - protein, 7 aa, Mycobacterium avium
SAGVSAG

SEQ ID NO: 56560 - protein, 7 aa, Mycobacterium avium
SAHGINA

SEQ ID NO: 56561 - protein, 12 aa, Mycobacterium avium
SAIHRRDPEAAR

SEQ ID NO: 56562 - protein, 8 aa, Mycobacterium avium
SAISNSHG

SEQ ID NO: 56563 - protein, 9 aa, Mycobacterium avium
SAKAGLDGF

SEQ ID NO: 56564 - protein, 6 aa, Mycobacterium avium
SAKGIP

SEQ ID NO: 56565 - protein, 8 aa, Mycobacterium avium
SAKKNEPG

SEQ ID NO: 56566 - protein, 5 aa, Mycobacterium avium
SAKQI

SEQ ID NO: 56567 - protein, 6 aa, Mycobacterium avium
SALDPE

SEQ ID NO: 56568 - protein, 14 aa, Mycobacterium avium
SALPTDTPGSPDDG

SEQ ID NO: 56569 - protein, 6 aa, Mycobacterium avium
SALTPE

SEQ ID NO: 56570 - protein, 8 aa, Mycobacterium avium
SANDDERT

SEQ ID NO: 56571 - protein, 5 aa, Mycobacterium avium
SAPAA

SEQ ID NO: 56572 - protein, 10 aa, Mycobacterium avium
SAPEGTVPGA

SEQ ID NO: 56573 - protein, 5 aa, Mycobacterium avium
SAPKL

SEQ ID NO: 56574 - protein, 10 aa, Mycobacterium avium
SAPRDPAVGE

SEQ ID NO: 56575 - protein, 6 aa, Mycobacterium avium
SAPTGA

SEQ ID NO: 56576 - protein, 8 aa, Mycobacterium avium
SAPTTPET

SEQ ID NO: 56577 - protein, 6 aa, Mycobacterium avium
SAPTVA

SEQ ID NO: 56578 - protein, 5 aa, Mycobacterium avium
SAQGK

SEQ ID NO: 56579 - protein, 5 aa, Mycobacterium avium
SAQMT

SEQ ID NO: 56580 - protein, 14 aa, Mycobacterium avium
SAQSKQELVDNPRG

SEQ ID NO: 56581 - protein, 6 aa, Mycobacterium avium
SAREAQ

SEQ ID NO: 56582 - protein, 5 aa, Mycobacterium avium
SARER

SEQ ID NO: 56583 - protein, 5 aa, Mycobacterium avium
SARGP

SEQ ID NO: 56584 - protein, 8 aa, Mycobacterium avium
SARGPEDI

SEQ ID NO: 56585 - protein, 5 aa, Mycobacterium avium
SARHE

SEQ ID NO: 56586 - protein, 29 aa, Mycobacterium avium
SARKTGTGGGPPGADSPTHRTDSGKRGAY

SEQ ID NO: 56587 - protein, 10 aa, Mycobacterium avium
SARPAGAVPD

SEQ ID NO: 56588 - protein, 5 aa, Mycobacterium avium
SARRA

SEQ ID NO: 56589 - protein, 14 aa, Mycobacterium avium
SARRGTDPATAPAR

SEQ ID NO: 56590 - protein, 7 aa, Mycobacterium avium
SARRRAE

SEQ ID NO: 56591 - protein, 4 aa, Mycobacterium avium
SARS

SEQ ID NO: 56592 - protein, 10 aa, Mycobacterium avium
SARSGEPDDQ

SEQ ID NO: 56593 - protein, 6 aa, Mycobacterium avium
SARTAA

SEQ ID NO: 56594 - protein, 14 aa, Mycobacterium avium
SARTTGFGKNSAIL

SEQ ID NO: 56595 - protein, 8 aa, Mycobacterium avium
SARTTPPR

SEQ ID NO: 56596 - protein, 6 aa, Mycobacterium avium
SARVTP

SEQ ID NO: 56597 - protein, 4 aa, Mycobacterium avium
SASD

SEQ ID NO: 56598 - protein, 7 aa, Mycobacterium avium
SASGDPI

SEQ ID NO: 56599 - protein, 7 aa, Mycobacterium avium
SASNENP

SEQ ID NO: 56600 - protein, 5 aa, Mycobacterium avium
SASTR

SEQ ID NO: 56601 - protein, 8 aa, Mycobacterium avium
SATAAGAR

SEQ ID NO: 56602 - protein, 12 aa, Mycobacterium avium
SATADDPDDPDH

SEQ ID NO: 56603 - protein, 26 aa, Mycobacterium avium
SATAQPAAQAAGNAASTTAASTQLTT

SEQ ID NO: 56604 - protein, 6 aa, Mycobacterium avium
SATDRL

SEQ ID NO: 56605 - protein, 7 aa, Mycobacterium avium
SATETRS

SEQ ID NO: 56606 - protein, 7 aa, Mycobacterium avium
SATGALS

SEQ ID NO: 56607 - protein, 6 aa, Mycobacterium avium
SATHER

SEQ ID NO: 56608 - protein, 9 aa, Mycobacterium avium
SATKALSGH

SEQ ID NO: 56609 - protein, 11 aa, Mycobacterium avium
SATLKSVAEGA

SEQ ID NO: 56610 - protein, 5 aa, Mycobacterium avium
SATLT

SEQ ID NO: 56611 - protein, 6 aa, Mycobacterium avium
SATRAR

SEQ ID NO: 56612 - protein, 8 aa, Mycobacterium avium
SATTARGT

SEQ ID NO: 56613 - protein, 22 aa, Mycobacterium avium
SAVNQDGASNGLTAPNGPSQQR

SEQ ID NO: 56614 - protein, 5 aa, Mycobacterium avium
SAVPD

SEQ ID NO: 56615 - protein, 6 aa, Mycobacterium avium
SAVPDG

SEQ ID NO: 56616 - protein, 10 aa, Mycobacterium avium
SAVRSASGAE

SEQ ID NO: 56617 - protein, 16 aa, Mycobacterium avium
SAWGPPQVHRRRVLEA

SEQ ID NO: 56618 - protein, 6 aa, Mycobacterium avium
SAYGES

SEQ ID NO: 56619 - protein, 4 aa, Mycobacterium avium
SCPE

SEQ ID NO: 56620 - protein, 6 aa, Mycobacterium avium
SCPPGR

SEQ ID NO: 56621 - protein, 9 aa, Mycobacterium avium
SCTSAGTSC

SEQ ID NO: 56622 - protein, 12 aa, Mycobacterium avium
SDAAAGKKPRKT

SEQ ID NO: 56623 - protein, 4 aa, Mycobacterium avium
SDAK

SEQ ID NO: 56624 - protein, 16 aa, Mycobacterium avium
SDAKGVTDTLPSGTIT

SEQ ID NO: 56625 - protein, 5 aa, Mycobacterium avium
SDALD

SEQ ID NO: 56626 - protein, 5 aa, Mycobacterium avium
SDALN

SEQ ID NO: 56627 - protein, 5 aa, Mycobacterium avium
SDANE

SEQ ID NO: 56628 - protein, 6 aa, Mycobacterium avium
SDAPAE

SEQ ID NO: 56629 - protein, 8 aa, Mycobacterium avium
SDAPVTGL

SEQ ID NO: 56630 - protein, 9 aa, Mycobacterium avium
SDDDPRFNH

SEQ ID NO: 56631 - protein, 7 aa, Mycobacterium avium
SDDERPQ

SEQ ID NO: 56632 - protein, 9 aa, Mycobacterium avium
SDDETERAV

SEQ ID NO: 56633 - protein, 6 aa, Mycobacterium avium
SDDHGV

SEQ ID NO: 56634 - protein, 8 aa, Mycobacterium avium
SDDPAEQF

SEQ ID NO: 56635 - protein, 8 aa, Mycobacterium avium
SDDPQEWG

SEQ ID NO: 56636 - protein, 5 aa, Mycobacterium avium
SDDSN

SEQ ID NO: 56637 - protein, 6 aa, Mycobacterium avium
SDEFEG

SEQ ID NO: 56638 - protein, 8 aa, Mycobacterium avium
SDELKART

SEQ ID NO: 56639 - protein, 7 aa, Mycobacterium avium
SDERDDV

SEQ ID NO: 56640 - protein, 10 aa, Mycobacterium avium
SDFSGVPAPD

SEQ ID NO: 56641 - protein, 12 aa, Mycobacterium avium
SDGCGCRKPRPG

SEQ ID NO: 56642 - protein, 18 aa, Mycobacterium avium
SDGDGLAPYDPALSPAQA

SEQ ID NO: 56643 - protein, 6 aa, Mycobacterium avium
SDGPDV

SEQ ID NO: 56644 - protein, 7 aa, Mycobacterium avium
SDGQPPL

SEQ ID NO: 56645 - protein, 5 aa, Mycobacterium avium
SDGVD

SEQ ID NO: 56646 - protein, 8 aa, Mycobacterium avium
SDIDDNPY

SEQ ID NO: 56647 - protein, 23 aa, Mycobacterium avium
SDKGLDAAEADPNYADQEHAVSD

SEQ ID NO: 56648 - protein, 9 aa, Mycobacterium avium
SDKLGREHP

SEQ ID NO: 56649 - protein, 5 aa, Mycobacterium avium
SDMTE

SEQ ID NO: 56650 - protein, 9 aa, Mycobacterium avium
SDNLPRRPI

SEQ ID NO: 56651 - protein, 12 aa, Mycobacterium avium
SDPAGRFSPPIP

SEQ ID NO: 56652 - protein, 5 aa, Mycobacterium avium
SDPAS

SEQ ID NO: 56653 - protein, 4 aa, Mycobacterium avium
SDPD

SEQ ID NO: 56654 - protein, 7 aa, Mycobacterium avium
SDPDAAA

SEQ ID NO: 56655 - protein, 7 aa, Mycobacterium avium
SDPDATL

SEQ ID NO: 56656 - protein, 9 aa, Mycobacterium avium
SDPGVRGQG

SEQ ID NO: 56657 - protein, 7 aa, Mycobacterium avium
SDPLPPH

SEQ ID NO: 56658 - protein, 4 aa, Mycobacterium avium
SDPR

SEQ ID NO: 56659 - protein, 11 aa, Mycobacterium avium
SDPSGRASAEQ

SEQ ID NO: 56660 - protein, 8 aa, Mycobacterium avium
SDQAAGQY

SEQ ID NO: 56661 - protein, 9 aa, Mycobacterium avium
SDQDSAPLR

SEQ ID NO: 56662 - protein, 9 aa, Mycobacterium avium
SDRGQPQTY

SEQ ID NO: 56663 - protein, 18 aa, Mycobacterium avium
SDRYPEYKANRSATPDEF

SEQ ID NO: 56664 - protein, 12 aa, Mycobacterium avium
SDRYPGEDQAPA

SEQ ID NO: 56665 - protein, 6 aa, Mycobacterium avium
SDSGRA

SEQ ID NO: 56666 - protein, 11 aa, Mycobacterium avium
SDSIGAQRRGT

SEQ ID NO: 56667 - protein, 13 aa, Mycobacterium avium
SDSNWPNSRKRAA

SEQ ID NO: 56668 - protein, 17 aa, Mycobacterium avium
SDSVESAKREIGLWFPD

SEQ ID NO: 56669 - protein, 10 aa, Mycobacterium avium
SDTESQQLAS

SEQ ID NO: 56670 - protein, 9 aa, Mycobacterium avium
SDTKAKELG

SEQ ID NO: 56671 - protein, 4 aa, Mycobacterium avium
SDTP

SEQ ID NO: 56672 - protein, 9 aa, Mycobacterium avium
SDTPDERDR

SEQ ID NO: 56673 - protein, 7 aa, Mycobacterium avium
SDVDEQL

SEQ ID NO: 56674 - protein, 15 aa, Mycobacterium avium
SDVGRQIEPSAFTED

SEQ ID NO: 56675 - protein, 21 aa, Mycobacterium avium
SDVGRRAGGVPTLPPSAPFDS

SEQ ID NO: 56676 - protein, 6 aa, Mycobacterium avium
SDVNPL

SEQ ID NO: 56677 - protein, 6 aa, Mycobacterium avium
SDVQAR

SEQ ID NO: 56678 - protein, 8 aa, Mycobacterium avium
SEADSARL

SEQ ID NO: 56679 - protein, 7 aa, Mycobacterium avium
SEAEPVT

SEQ ID NO: 56680 - protein, 4 aa, Mycobacterium avium
SEAS

SEQ ID NO: 56681 - protein, 18 aa, Mycobacterium avium
SEASAATVSGLGAEPLRG

SEQ ID NO: 56682 - protein, 10 aa, Mycobacterium avium
SEDRAAGLAE

SEQ ID NO: 56683 - protein, 11 aa, Mycobacterium avium
SEDYAGLRNNT

SEQ ID NO: 56684 - protein, 4 aa, Mycobacterium avium
SEEI

SEQ ID NO: 56685 - protein, 8 aa, Mycobacterium avium
SEEKARAQ

SEQ ID NO: 56686 - protein, 13 aa, Mycobacterium avium
SEEVDSGGVGAVT

SEQ ID NO: 56687 - protein, 6 aa, Mycobacterium avium
SEFGTQ

SEQ ID NO: 56688 - protein, 8 aa, Mycobacterium avium
SEGAAGPA

SEQ ID NO: 56689 - protein, 7 aa, Mycobacterium avium
SEGEAAV

SEQ ID NO: 56690 - protein, 5 aa, Mycobacterium avium
SEGGK

SEQ ID NO: 56691 - protein, 8 aa, Mycobacterium avium
SEGTLAEE

SEQ ID NO: 56692 - protein, 8 aa, Mycobacterium avium
SEGYQKAA

SEQ ID NO: 56693 - protein, 11 aa, Mycobacterium avium
SEHAGTGEFTD

SEQ ID NO: 56694 - protein, 7 aa, Mycobacterium avium
SEHEYGN

SEQ ID NO: 56695 - protein, 4 aa, Mycobacterium avium
SEHS

SEQ ID NO: 56696 - protein, 10 aa, Mycobacterium avium
SEIRENGGSA

SEQ ID NO: 56697 - protein, 15 aa, Mycobacterium avium
SEKEEAERKNKLRGG

SEQ ID NO: 56698 - protein, 5 aa, Mycobacterium avium
SELAP

SEQ ID NO: 56699 - protein, 6 aa, Mycobacterium avium
SELDGH

SEQ ID NO: 56700 - protein, 5 aa, Mycobacterium avium
SELSD

SEQ ID NO: 56701 - protein, 5 aa, Mycobacterium avium
SELSG

SEQ ID NO: 56702 - protein, 7 aa, Mycobacterium avium
SENAPLA

SEQ ID NO: 56703 - protein, 7 aa, Mycobacterium avium
SENKAAA

SEQ ID NO: 56704 - protein, 10 aa, Mycobacterium avium
SEPAAGSDLA

SEQ ID NO: 56705 - protein, 4 aa, Mycobacterium avium
SEPL

SEQ ID NO: 56706 - protein, 14 aa, Mycobacterium avium
SEPVTKGRHRAKPQ

SEQ ID NO: 56707 - protein, 5 aa, Mycobacterium avium
SEQAR

SEQ ID NO: 56708 - protein, 7 aa, Mycobacterium avium
SEQPESV

SEQ ID NO: 56709 - protein, 6 aa, Mycobacterium avium
SEQPLT

SEQ ID NO: 56710 - protein, 5 aa, Mycobacterium avium
SEQQA

SEQ ID NO: 56711 - protein, 5 aa, Mycobacterium avium
SEQRI

SEQ ID NO: 56712 - protein, 16 aa, Mycobacterium avium
SERGGPAAAQAGRDLD

SEQ ID NO: 56713 - protein, 9 aa, Mycobacterium avium
SERNDSPSL

SEQ ID NO: 56714 - protein, 7 aa, Mycobacterium avium
SERTGTG

SEQ ID NO: 56715 - protein, 6 aa, Mycobacterium avium
SESADV

SEQ ID NO: 56716 - protein, 7 aa, Mycobacterium avium
SETTPDS

SEQ ID NO: 56717 - protein, 12 aa, Mycobacterium avium
SETYASAAAELS

SEQ ID NO: 56718 - protein, 4 aa, Mycobacterium avium
SEVD

SEQ ID NO: 56719 - protein, 5 aa, Mycobacterium avium
SEVSG

SEQ ID NO: 56720 - protein, 13 aa, Mycobacterium avium
SEVYDNGSATYAF

SEQ ID NO: 56721 - protein, 15 aa, Mycobacterium avium
SEVYGDPESHPQRES

SEQ ID NO: 56722 - protein, 10 aa, Mycobacterium avium
SEYRADPPWA

SEQ ID NO: 56723 - protein, 13 aa, Mycobacterium avium
SFAAGDSALQPLN

SEQ ID NO: 56724 - protein, 8 aa, Mycobacterium avium
SFGGGPVG

SEQ ID NO: 56725 - protein, 4 aa, Mycobacterium avium
SFGT

SEQ ID NO: 56726 - protein, 15 aa, Mycobacterium avium
SFGTAAPAGSEEEAD

SEQ ID NO: 56727 - protein, 7 aa, Mycobacterium avium
SFPGDGA

SEQ ID NO: 56728 - protein, 8 aa, Mycobacterium avium
SGAFADPD

SEQ ID NO: 56729 - protein, 4 aa, Mycobacterium avium
SGAG

SEQ ID NO: 56730 - protein, 26 aa, Mycobacterium avium
SGAGEGSSIPDSEFKAAGAQLADTAE

SEQ ID NO: 56731 - protein, 10 aa, Mycobacterium avium
SGAGGTGKEA

SEQ ID NO: 56732 - protein, 11 aa, Mycobacterium avium
SGAGHPAGAPT

SEQ ID NO: 56733 - protein, 5 aa, Mycobacterium avium
SGAGN

SEQ ID NO: 56734 - protein, 9 aa, Mycobacterium avium
SGAGVSAPI

SEQ ID NO: 56735 - protein, 8 aa, Mycobacterium avium
SGALAGTS

SEQ ID NO: 56736 - protein, 8 aa, Mycobacterium avium
SGAPDMGP

SEQ ID NO: 56737 - protein, 8 aa, Mycobacterium avium
SGAPIPPA

SEQ ID NO: 56738 - protein, 8 aa, Mycobacterium avium
SGAPRNDP

SEQ ID NO: 56739 - protein, 8 aa, Mycobacterium avium
SGATALSE

SEQ ID NO: 56740 - protein, 7 aa, Mycobacterium avium
SGCATGN

SEQ ID NO: 56741 - protein, 8 aa, Mycobacterium avium
SGDAGRVD

SEQ ID NO: 56742 - protein, 7 aa, Mycobacterium avium
SGDPSLY

SEQ ID NO: 56743 - protein, 6 aa, Mycobacterium avium
SGDPTV

SEQ ID NO: 56744 - protein, 6 aa, Mycobacterium avium
SGDQER

SEQ ID NO: 56745 - protein, 7 aa, Mycobacterium avium
SGEGRYV

SEQ ID NO: 56746 - protein, 5 aa, Mycobacterium avium
SGEHW

SEQ ID NO: 56747 - protein, 8 aa, Mycobacterium avium
SGEPIDAQ

SEQ ID NO: 56748 - protein, 8 aa, Mycobacterium avium
SGERGSNG

SEQ ID NO: 56749 - protein, 5 aa, Mycobacterium avium
SGGAG

SEQ ID NO: 56750 - protein, 4 aa, Mycobacterium avium
SGGE

SEQ ID NO: 56751 - protein, 7 aa, Mycobacterium avium
SGGERPP

SEQ ID NO: 56752 - protein, 14 aa, Mycobacterium avium
SGGLDDRRTSNGYL

SEQ ID NO: 56753 - protein, 16 aa, Mycobacterium avium
SGGQASDAALSFDVDQ

SEQ ID NO: 56754 - protein, 11 aa, Mycobacterium avium
SGGRGPAAARN

SEQ ID NO: 56755 - protein, 9 aa, Mycobacterium avium
SGGSDRKLS

SEQ ID NO: 56756 - protein, 21 aa, Mycobacterium avium
SGHSTEPITDADRRSPLRADD

SEQ ID NO: 56757 - protein, 9 aa, Mycobacterium avium
SGIDPDLQP

SEQ ID NO: 56758 - protein, 4 aa, Mycobacterium avium
SGIP

SEQ ID NO: 56759 - protein, 12 aa, Mycobacterium avium
SGIPANTGTDDI

SEQ ID NO: 56760 - protein, 8 aa, Mycobacterium avium
SGKTGEGV

SEQ ID NO: 56761 - protein, 14 aa, Mycobacterium avium
SGLDRTDPRVSPAL

SEQ ID NO: 56762 - protein, 9 aa, Mycobacterium avium
SGLPAGGAD

SEQ ID NO: 56763 - protein, 8 aa, Mycobacterium avium
SGLPNKTD

SEQ ID NO: 56764 - protein, 7 aa, Mycobacterium avium
SGLRPED

SEQ ID NO: 56765 - protein, 16 aa, Mycobacterium avium
SGPATLKSRNLAANPA

SEQ ID NO: 56766 - protein, 8 aa, Mycobacterium avium
SGPGAGPL

SEQ ID NO: 56767 - protein, 6 aa, Mycobacterium avium
SGPGDW

SEQ ID NO: 56768 - protein, 17 aa, Mycobacterium avium
SGPGGQKAAIASAKLGK

SEQ ID NO: 56769 - protein, 14 aa, Mycobacterium avium
SGPGQGRGRAVRNA

SEQ ID NO: 56770 - protein, 6 aa, Mycobacterium avium
SGPIAE

SEQ ID NO: 56771 - protein, 17 aa, Mycobacterium avium
SGPLPASAAQDGAPLQP

SEQ ID NO: 56772 - protein, 15 aa, Mycobacterium avium
SGPVAGARVVPAPTE

SEQ ID NO: 56773 - protein, 6 aa, Mycobacterium avium
SGPYTP

SEQ ID NO: 56774 - protein, 13 aa, Mycobacterium avium
SGQAVTASTASNP

SEQ ID NO: 56775 - protein, 8 aa, Mycobacterium avium
SGQERDAA

SEQ ID NO: 56776 - protein, 6 aa, Mycobacterium avium
SGQYPE

SEQ ID NO: 56777 - protein, 5 aa, Mycobacterium avium
SGRAT

SEQ ID NO: 56778 - protein, 10 aa, Mycobacterium avium
SGRKTGLARS

SEQ ID NO: 56779 - protein, 13 aa, Mycobacterium avium
SGRMYGGAGSGPL

SEQ ID NO: 56780 - protein, 6 aa, Mycobacterium avium
SGRPGA

SEQ ID NO: 56781 - protein, 5 aa, Mycobacterium avium
SGRRE

SEQ ID NO: 56782 - protein, 14 aa, Mycobacterium avium
SGRRPSETFGLSGF

SEQ ID NO: 56783 - protein, 13 aa, Mycobacterium avium
SGRSVDADAATSL

SEQ ID NO: 56784 - protein, 6 aa, Mycobacterium avium
SGRTRD

SEQ ID NO: 56785 - protein, 5 aa, Mycobacterium avium
SGRVD

SEQ ID NO: 56786 - protein, 5 aa, Mycobacterium avium
SGSAR

SEQ ID NO: 56787 - protein, 10 aa, Mycobacterium avium
SGSDNSAFGT

SEQ ID NO: 56788 - protein, 5 aa, Mycobacterium avium
SGSGF

SEQ ID NO: 56789 - protein, 9 aa, Mycobacterium avium
SGSGKSTVG

SEQ ID NO: 56790 - protein, 6 aa, Mycobacterium avium
SGSGPT

SEQ ID NO: 56791 - protein, 6 aa, Mycobacterium avium
SGSGSE

SEQ ID NO: 56792 - protein, 7 aa, Mycobacterium avium
SGSGSSY

SEQ ID NO: 56793 - protein, 7 aa, Mycobacterium avium
SGSKTEA

SEQ ID NO: 56794 - protein, 8 aa, Mycobacterium avium
SGSQGITY

SEQ ID NO: 56795 - protein, 17 aa, Mycobacterium avium
SGSRAGEIEHCLPLFDV

SEQ ID NO: 56796 - protein, 16 aa, Mycobacterium avium
SGSSGTAAAKKEALEA

SEQ ID NO: 56797 - protein, 6 aa, Mycobacterium avium
SGSSSL

SEQ ID NO: 56798 - protein, 14 aa, Mycobacterium avium
SGSTGKPKGAVGTH

SEQ ID NO: 56799 - protein, 10 aa, Mycobacterium avium
SGSTGLPKGV

SEQ ID NO: 56800 - protein, 15 aa, Mycobacterium avium
SGTCRAAERTAADLD

SEQ ID NO: 56801 - protein, 5 aa, Mycobacterium avium
SGTGR

SEQ ID NO: 56802 - protein, 10 aa, Mycobacterium avium
SGTGSHDPRD

SEQ ID NO: 56803 - protein, 6 aa, Mycobacterium avium
SGTGSL

SEQ ID NO: 56804 - protein, 17 aa, Mycobacterium avium
SGTPARPGSVSTEDDPF

SEQ ID NO: 56805 - protein, 6 aa, Mycobacterium avium
SGTRGD

SEQ ID NO: 56806 - protein, 12 aa, Mycobacterium avium
SGTRRGHEVDAG

SEQ ID NO: 56807 - protein, 8 aa, Mycobacterium avium
SGTSPDGH

SEQ ID NO: 56808 - protein, 14 aa, Mycobacterium avium
SGTTAAPKGIRHTD

SEQ ID NO: 56809 - protein, 10 aa, Mycobacterium avium
SGTTGAPKGV

SEQ ID NO: 56810 - protein, 13 aa, Mycobacterium avium
SGTTGHPKGVPTT

SEQ ID NO: 56811 - protein, 10 aa, Mycobacterium avium
SGTTGKPKGI

SEQ ID NO: 56812 - protein, 11 aa, Mycobacterium avium
SGTTGPPKGVE

SEQ ID NO: 56813 - protein, 8 aa, Mycobacterium avium
SGTTGRAK

SEQ ID NO: 56814 - protein, 6 aa, Mycobacterium avium
SGTTSI

SEQ ID NO: 56815 - protein, 6 aa, Mycobacterium avium
SGVGAS

SEQ ID NO: 56816 - protein, 7 aa, Mycobacterium avium
SGWSADQ

SEQ ID NO: 56817 - protein, 6 aa, Mycobacterium avium
SGWSEV

SEQ ID NO: 56818 - protein, 10 aa, Mycobacterium avium
SGYDESTGIP

SEQ ID NO: 56819 - protein, 4 aa, Mycobacterium avium
SGYE

SEQ ID NO: 56820 - protein, 13 aa, Mycobacterium avium
SGYEASPDYAEDK

SEQ ID NO: 56821 - protein, 6 aa, Mycobacterium avium
SHAGPT

SEQ ID NO: 56822 - protein, 6 aa, Mycobacterium avium
SHAQGE

SEQ ID NO: 56823 - protein, 9 aa, Mycobacterium avium
SHETSREGF

SEQ ID NO: 56824 - protein, 8 aa, Mycobacterium avium
SHGLPSEV

SEQ ID NO: 56825 - protein, 11 aa, Mycobacterium avium
SHGPEGTTASV

SEQ ID NO: 56826 - protein, 9 aa, Mycobacterium avium
SHGPGSPIA

SEQ ID NO: 56827 - protein, 9 aa, Mycobacterium avium
SHGTDLRGP

SEQ ID NO: 56828 - protein, 8 aa, Mycobacterium avium
SHPAGQVT

SEQ ID NO: 56829 - protein, 25 aa, Mycobacterium avium
SHPDSAIGTGPSAGHDTPESAPTEV

SEQ ID NO: 56830 - protein, 5 aa, Mycobacterium avium
SHPGV

SEQ ID NO: 56831 - protein, 10 aa, Mycobacterium avium
SHPPTAEAPA

SEQ ID NO: 56832 - protein, 10 aa, Mycobacterium avium
SHPSKNPMRT

SEQ ID NO: 56833 - protein, 7 aa, Mycobacterium avium
SHQGTPR

SEQ ID NO: 56834 - protein, 6 aa, Mycobacterium avium
SHQQIA

SEQ ID NO: 56835 - protein, 18 aa, Mycobacterium avium
SHRKGEFRDGYGHTVKSG

SEQ ID NO: 56836 - protein, 8 aa, Mycobacterium avium
SHRVGTDA

SEQ ID NO: 56837 - protein, 4 aa, Mycobacterium avium
SHVP

SEQ ID NO: 56838 - protein, 12 aa, Mycobacterium avium
SHYGTAGVAAGA

SEQ ID NO: 56839 - protein, 6 aa, Mycobacterium avium
SIDPSA

SEQ ID NO: 56840 - protein, 5 aa, Mycobacterium avium
SIGPA

SEQ ID NO: 56841 - protein, 6 aa, Mycobacterium avium
SIGPAN

SEQ ID NO: 56842 - protein, 24 aa, Mycobacterium avium
SIIGSSSVNSDTPNPTLAPYAATK

SEQ ID NO: 56843 - protein, 6 aa, Mycobacterium avium
SINAGG

SEQ ID NO: 56844 - protein, 5 aa, Mycobacterium avium
SIPGP

SEQ ID NO: 56845 - protein, 11 aa, Mycobacterium avium
SITDGASSRRN

SEQ ID NO: 56846 - protein, 8 aa, Mycobacterium avium
SKAAADAH

SEQ ID NO: 56847 - protein, 13 aa, Mycobacterium avium
SKAGAQPIRTGRK

SEQ ID NO: 56848 - protein, 8 aa, Mycobacterium avium
SKAGRRRY

SEQ ID NO: 56849 - protein, 10 aa, Mycobacterium avium
SKAQTRARSA

SEQ ID NO: 56850 - protein, 7 aa, Mycobacterium avium
SKAYGPD

SEQ ID NO: 56851 - protein, 9 aa, Mycobacterium avium
SKDDDAGAF

SEQ ID NO: 56852 - protein, 13 aa, Mycobacterium avium
SKFGGTTAYSGGG

SEQ ID NO: 56853 - protein, 7 aa, Mycobacterium avium
SKGADEI

SEQ ID NO: 56854 - protein, 8 aa, Mycobacterium avium
SKGGAPEH

SEQ ID NO: 56855 - protein, 17 aa, Mycobacterium avium
SKGLDQKSSDEEKGKAF

SEQ ID NO: 56856 - protein, 9 aa, Mycobacterium avium
SKHRRTAPL

SEQ ID NO: 56857 - protein, 6 aa, Mycobacterium avium
SKMTPR

SEQ ID NO: 56858 - protein, 12 aa, Mycobacterium avium
SKPNPKTATNAG

SEQ ID NO: 56859 - protein, 5 aa, Mycobacterium avium
SKRPP

SEQ ID NO: 56860 - protein, 7 aa, Mycobacterium avium
SKTLSEK

SEQ ID NO: 56861 - protein, 4 aa, Mycobacterium avium
SLAD

SEQ ID NO: 56862 - protein, 7 aa, Mycobacterium avium
SLADSAR

SEQ ID NO: 56863 - protein, 8 aa, Mycobacterium avium
SLAEAQDA

SEQ ID NO: 56864 - protein, 16 aa, Mycobacterium avium
SLAGTPYSQGARDDCS

SEQ ID NO: 56865 - protein, 28 aa, Mycobacterium avium
SLAQPASSSTTATKAATTAASTTSTDPL

SEQ ID NO: 56866 - protein, 5 aa, Mycobacterium avium
SLATG

SEQ ID NO: 56867 - protein, 16 aa, Mycobacterium avium
SLDPARHTVQRGSTPI

SEQ ID NO: 56868 - protein, 8 aa, Mycobacterium avium
SLGEPASA

SEQ ID NO: 56869 - protein, 6 aa, Mycobacterium avium
SLHGDT

SEQ ID NO: 56870 - protein, 14 aa, Mycobacterium avium
SLNNTQAQADPDGK

SEQ ID NO: 56871 - protein, 5 aa, Mycobacterium avium
SLPAR

SEQ ID NO: 56872 - protein, 4 aa, Mycobacterium avium
SLPE

SEQ ID NO: 56873 - protein, 6 aa, Mycobacterium avium
SLPEPQ

SEQ ID NO: 56874 - protein, 5 aa, Mycobacterium avium
SLPET

SEQ ID NO: 56875 - protein, 7 aa, Mycobacterium avium
SLPPRER

SEQ ID NO: 56876 - protein, 11 aa, Mycobacterium avium
SLPQGPSPQGH

SEQ ID NO: 56877 - protein, 9 aa, Mycobacterium avium
SLPSNNTAA

SEQ ID NO: 56878 - protein, 11 aa, Mycobacterium avium
SLSARASLSTR

SEQ ID NO: 56879 - protein, 16 aa, Mycobacterium avium
SLSGAAPGLPAAGADG

SEQ ID NO: 56880 - protein, 8 aa, Mycobacterium avium
SLSLSGAA

SEQ ID NO: 56881 - protein, 8 aa, Mycobacterium avium
SLSPPDRD

SEQ ID NO: 56882 - protein, 7 aa, Mycobacterium avium
SLTAPSD

SEQ ID NO: 56883 - protein, 23 aa, Mycobacterium avium
SLTATLSRAADRAPAEDRGDAGE

SEQ ID NO: 56884 - protein, 5 aa, Mycobacterium avium
SLTSR

SEQ ID NO: 56885 - protein, 6 aa, Mycobacterium avium
SMGGGE

SEQ ID NO: 56886 - protein, 8 aa, Mycobacterium avium
SMGPQPPE

SEQ ID NO: 56887 - protein, 23 aa, Mycobacterium avium
SMRDASKTPEPVPAAKPAAGRGN

SEQ ID NO: 56888 - protein, 5 aa, Mycobacterium avium
SNDGD

SEQ ID NO: 56889 - protein, 5 aa, Mycobacterium avium
SNERL

SEQ ID NO: 56890 - protein, 7 aa, Mycobacterium avium
SNGANIG

SEQ ID NO: 56891 - protein, 13 aa, Mycobacterium avium
SNGENAEAGGSHG

SEQ ID NO: 56892 - protein, 6 aa, Mycobacterium avium
SNGHPV

SEQ ID NO: 56893 - protein, 6 aa, Mycobacterium avium
SNGMGS

SEQ ID NO: 56894 - protein, 11 aa, Mycobacterium avium
SNKAARPTTAD

SEQ ID NO: 56895 - protein, 12 aa, Mycobacterium avium
SNKGVKRTGSAA

SEQ ID NO: 56896 - protein, 18 aa, Mycobacterium avium
SNLAQDGKGYASGTQLGE

SEQ ID NO: 56897 - protein, 5 aa, Mycobacterium avium
SNLGH

SEQ ID NO: 56898 - protein, 7 aa, Mycobacterium avium
SNLPGLN

SEQ ID NO: 56899 - protein, 5 aa, Mycobacterium avium
SNNPE

SEQ ID NO: 56900 - protein, 16 aa, Mycobacterium avium
SNPQLRTDATPGEGDD

SEQ ID NO: 56901 - protein, 6 aa, Mycobacterium avium
SNPRER

SEQ ID NO: 56902 - protein, 4 aa, Mycobacterium avium
SNRC

SEQ ID NO: 56903 - protein, 4 aa, Mycobacterium avium
SNRQ

SEQ ID NO: 56904 - protein, 8 aa, Mycobacterium avium
SNRTWSTA

SEQ ID NO: 56905 - protein, 10 aa, Mycobacterium avium
SNSSATMSRP

SEQ ID NO: 56906 - protein, 6 aa, Mycobacterium avium
SPAEAD

SEQ ID NO: 56907 - protein, 11 aa, Mycobacterium avium
SPAETTSGPLA

SEQ ID NO: 56908 - protein, 13 aa, Mycobacterium avium
SPAGQTYVTTPGS

SEQ ID NO: 56909 - protein, 6 aa, Mycobacterium avium
SPAHDD

SEQ ID NO: 56910 - protein, 13 aa, Mycobacterium avium
SPAPLNPALGSTK

SEQ ID NO: 56911 - protein, 7 aa, Mycobacterium avium
SPARAAE

SEQ ID NO: 56912 - protein, 6 aa, Mycobacterium avium
SPATKE

SEQ ID NO: 56913 - protein, 8 aa, Mycobacterium avium
SPDGLEST

SEQ ID NO: 56914 - protein, 11 aa, Mycobacterium avium
SPDGRNKGTRS

SEQ ID NO: 56915 - protein, 10 aa, Mycobacterium avium
SPDSPSVSAA

SEQ ID NO: 56916 - protein, 9 aa, Mycobacterium avium
SPDTAEDTV

SEQ ID NO: 56917 - protein, 8 aa, Mycobacterium avium
SPDTARQP

SEQ ID NO: 56918 - protein, 9 aa, Mycobacterium avium
SPDTHASIN

SEQ ID NO: 56919 - protein, 5 aa, Mycobacterium avium
SPDYR

SEQ ID NO: 56920 - protein, 16 aa, Mycobacterium avium
SPEFTAEAGSVPHDDL

SEQ ID NO: 56921 - protein, 5 aa, Mycobacterium avium
SPEQA

SEQ ID NO: 56922 - protein, 9 aa, Mycobacterium avium
SPESYTGTE

SEQ ID NO: 56923 - protein, 5 aa, Mycobacterium avium
SPGAP

SEQ ID NO: 56924 - protein, 6 aa, Mycobacterium avium
SPGEPQ

SEQ ID NO: 56925 - protein, 12 aa, Mycobacterium avium
SPGPGTPERAGA

SEQ ID NO: 56926 - protein, 8 aa, Mycobacterium avium
SPGSIDTE

SEQ ID NO: 56927 - protein, 11 aa, Mycobacterium avium
SPHGDPRTQSR

SEQ ID NO: 56928 - protein, 7 aa, Mycobacterium avium
SPHPAEF

SEQ ID NO: 56929 - protein, 7 aa, Mycobacterium avium
SPHPDGP

SEQ ID NO: 56930 - protein, 12 aa, Mycobacterium avium
SPIGKRNGGLSG

SEQ ID NO: 56931 - protein, 14 aa, Mycobacterium avium
SPKAYRDRFRTAAR

SEQ ID NO: 56932 - protein, 7 aa, Mycobacterium avium
SPKQFDG

SEQ ID NO: 56933 - protein, 5 aa, Mycobacterium avium
SPLDT

SEQ ID NO: 56934 - protein, 7 aa, Mycobacterium avium
SPLDTRV

SEQ ID NO: 56935 - protein, 13 aa, Mycobacterium avium
SPLETAKADYESR

SEQ ID NO: 56936 - protein, 4 aa, Mycobacterium avium
SPLQ

SEQ ID NO: 56937 - protein, 4 aa, Mycobacterium avium
SPMD

SEQ ID NO: 56938 - protein, 4 aa, Mycobacterium avium
SPMT

SEQ ID NO: 56939 - protein, 7 aa, Mycobacterium avium
SPNADEN

SEQ ID NO: 56940 - protein, 14 aa, Mycobacterium avium
SPPADGRAETAPAA

SEQ ID NO: 56941 - protein, 7 aa, Mycobacterium avium
SPPAQAE

SEQ ID NO: 56942 - protein, 15 aa, Mycobacterium avium
SPPEGRKKYSKSKPM

SEQ ID NO: 56943 - protein, 4 aa, Mycobacterium avium
SPPL

SEQ ID NO: 56944 - protein, 5 aa, Mycobacterium avium
SPQPV

SEQ ID NO: 56945 - protein, 6 aa, Mycobacterium avium
SPQRPE

SEQ ID NO: 56946 - protein, 14 aa, Mycobacterium avium
SPQRTSGGGRRYSE

SEQ ID NO: 56947 - protein, 17 aa, Mycobacterium avium
SPRGRITRTYREAHTVE

SEQ ID NO: 56948 - protein, 5 aa, Mycobacterium avium
SPRHR

SEQ ID NO: 56949 - protein, 4 aa, Mycobacterium avium
SPSE

SEQ ID NO: 56950 - protein, 14 aa, Mycobacterium avium
SPSGRTYRTSPAGA

SEQ ID NO: 56951 - protein, 4 aa, Mycobacterium avium
SPSI

SEQ ID NO: 56952 - protein, 7 aa, Mycobacterium avium
SPSKERV

SEQ ID NO: 56953 - protein, 4 aa, Mycobacterium avium
SPSS

SEQ ID NO: 56954 - protein, 16 aa, Mycobacterium avium
SPTANGICSSGSTGVP

SEQ ID NO: 56955 - protein, 8 aa, Mycobacterium avium
SPTDWPRY

SEQ ID NO: 56956 - protein, 6 aa, Mycobacterium avium
SPTEVA

SEQ ID NO: 56957 - protein, 6 aa, Mycobacterium avium
SPTQQA

SEQ ID NO: 56958 - protein, 7 aa, Mycobacterium avium
SPTRTRV

SEQ ID NO: 56959 - protein, 13 aa, Mycobacterium avium
SPTSTVVGGDAEA

SEQ ID NO: 56960 - protein, 5 aa, Mycobacterium avium
SPVRS

SEQ ID NO: 56961 - protein, 7 aa, Mycobacterium avium
SPWSPRE

SEQ ID NO: 56962 - protein, 9 aa, Mycobacterium avium
SQAEQEAVS

SEQ ID NO: 56963 - protein, 8 aa, Mycobacterium avium
SQAGQSVP

SEQ ID NO: 56964 - protein, 10 aa, Mycobacterium avium
SQATFTAGPN

SEQ ID NO: 56965 - protein, 9 aa, Mycobacterium avium
SQAVEPNVT

SEQ ID NO: 56966 - protein, 5 aa, Mycobacterium avium
SQERA

SEQ ID NO: 56967 - protein, 7 aa, Mycobacterium avium
SQFEKPE

SEQ ID NO: 56968 - protein, 20 aa, Mycobacterium avium
SQGAASLNRAVSGAAAQLAA

SEQ ID NO: 56969 - protein, 5 aa, Mycobacterium avium
SQGGR

SEQ ID NO: 56970 - protein, 6 aa, Mycobacterium avium
SQGRSR

SEQ ID NO: 56971 - protein, 4 aa, Mycobacterium avium
SQGT

SEQ ID NO: 56972 - protein, 7 aa, Mycobacterium avium
SQPGFDD

SEQ ID NO: 56973 - protein, 16 aa, Mycobacterium avium
SQQAAASAPEAGDAAP

SEQ ID NO: 56974 - protein, 5 aa, Mycobacterium avium
SQQPV

SEQ ID NO: 56975 - protein, 4 aa, Mycobacterium avium
SQRD

SEQ ID NO: 56976 - protein, 6 aa, Mycobacterium avium
SQREAV

SEQ ID NO: 56977 - protein, 15 aa, Mycobacterium avium
SQRHPEWNTAENDSV

SEQ ID NO: 56978 - protein, 19 aa, Mycobacterium avium
SQRSRNRHVGEQLGAGKPI

SEQ ID NO: 56979 - protein, 6 aa, Mycobacterium avium
SQRTKN

SEQ ID NO: 56980 - protein, 4 aa, Mycobacterium avium
SQTA

SEQ ID NO: 56981 - protein, 21 aa, Mycobacterium avium
SQTQWYSDDSADRVFTPRRYE

SEQ ID NO: 56982 - protein, 8 aa, Mycobacterium avium
SRAERAMS

SEQ ID NO: 56983 - protein, 7 aa, Mycobacterium avium
SRASDGG

SEQ ID NO: 56984 - protein, 7 aa, Mycobacterium avium
SRATLTR

SEQ ID NO: 56985 - protein, 9 aa, Mycobacterium avium
SRDAPRKSV

SEQ ID NO: 56986 - protein, 15 aa, Mycobacterium avium
SRDGNTAYRAGRDIQ

SEQ ID NO: 56987 - protein, 6 aa, Mycobacterium avium
SRFGAD

SEQ ID NO: 56988 - protein, 4 aa, Mycobacterium avium
SRGE

SEQ ID NO: 56989 - protein, 11 aa, Mycobacterium avium
SRGGEGPGAAF

SEQ ID NO: 56990 - protein, 4 aa, Mycobacterium avium
SRGI

SEQ ID NO: 56991 - protein, 6 aa, Mycobacterium avium
SRGIGR

SEQ ID NO: 56992 - protein, 4 aa, Mycobacterium avium
SRIG

SEQ ID NO: 56993 - protein, 10 aa, Mycobacterium avium
SRIQPGRDDK

SEQ ID NO: 56994 - protein, 8 aa, Mycobacterium avium
SRKLDTDA

SEQ ID NO: 56995 - protein, 19 aa, Mycobacterium avium
SRLAGAYGEDAAAEIAAVL

SEQ ID NO: 56996 - protein, 7 aa, Mycobacterium avium
SRLNPGA

SEQ ID NO: 56997 - protein, 26 aa, Mycobacterium avium
SRLPGDGPYADRSGGVLPGYGGSKAA

SEQ ID NO: 56998 - protein, 7 aa, Mycobacterium avium
SRNKKSI

SEQ ID NO: 56999 - protein, 8 aa, Mycobacterium avium
SRNQNATR

SEQ ID NO: 57000 - protein, 65 aa, Mycobacterium avium
SRPAKDQRSAKSSRTRRAEASKAAAKAPAKKAPAKKAPAKKAPAKTAAKKTPAKTSETSDAKGGS

SEQ ID NO: 57001 - protein, 9 aa, Mycobacterium avium
SRPASTPAH

SEQ ID NO: 57002 - protein, 9 aa, Mycobacterium avium
SRPERQRRI

SEQ ID NO: 57003 - protein, 6 aa, Mycobacterium avium
SRPGDV

SEQ ID NO: 57004 - protein, 8 aa, Mycobacterium avium
SRPPGPHK

SEQ ID NO: 57005 - protein, 15 aa, Mycobacterium avium
SRPTISPDAVEAAAK

SEQ ID NO: 57006 - protein, 18 aa, Mycobacterium avium
SRPVGGHRAAAGGGDGQS

SEQ ID NO: 57007 - protein, 16 aa, Mycobacterium avium
SRRAQTDTARGGQAEE

SEQ ID NO: 57008 - protein, 5 aa, Mycobacterium avium
SRRGE

SEQ ID NO: 57009 - protein, 11 aa, Mycobacterium avium
SRRGREVTGEY

SEQ ID NO: 57010 - protein, 10 aa, Mycobacterium avium
SRRKPEAAAR

SEQ ID NO: 57011 - protein, 14 aa, Mycobacterium avium
SRRPGREWTNRPAD

SEQ ID NO: 57012 - protein, 6 aa, Mycobacterium avium
SRRRGE

SEQ ID NO: 57013 - protein, 10 aa, Mycobacterium avium
SRSDARDEAS

SEQ ID NO: 57014 - protein, 10 aa, Mycobacterium avium
SRSGAADRRA

SEQ ID NO: 57015 - protein, 16 aa, Mycobacterium avium
SRSRADTFGPDAAGGD

SEQ ID NO: 57016 - protein, 14 aa, Mycobacterium avium
SRSSAYPSTEQTLS

SEQ ID NO: 57017 - protein, 7 aa, Mycobacterium avium
SRSTPEA

SEQ ID NO: 57018 - protein, 5 aa, Mycobacterium avium
SRTES

SEQ ID NO: 57019 - protein, 7 aa, Mycobacterium avium
SRTGTLA

SEQ ID NO: 57020 - protein, 9 aa, Mycobacterium avium
SRTGTRTDT

SEQ ID NO: 57021 - protein, 12 aa, Mycobacterium avium
SRTPGAAGKYAD

SEQ ID NO: 57022 - protein, 5 aa, Mycobacterium avium
SRTPV

SEQ ID NO: 57023 - protein, 8 aa, Mycobacterium avium
SRTRADAG

SEQ ID NO: 57024 - protein, 6 aa, Mycobacterium avium
SRTTHT

SEQ ID NO: 57025 - protein, 12 aa, Mycobacterium avium
SRVPGNDRTGSR

SEQ ID NO: 57026 - protein, 5 aa, Mycobacterium avium
SRVSR

SEQ ID NO: 57027 - protein, 17 aa, Mycobacterium avium
SRYRSNALAQEKTGESW

SEQ ID NO: 57028 - protein, 8 aa, Mycobacterium avium
SSAAETVA

SEQ ID NO: 57029 - protein, 19 aa, Mycobacterium avium
SSAAKGDESATDATEFDAR

SEQ ID NO: 57030 - protein, 5 aa, Mycobacterium avium
SSAGI

SEQ ID NO: 57031 - protein, 7 aa, Mycobacterium avium
SSANTRD

SEQ ID NO: 57032 - protein, 46 aa, Mycobacterium avium
SSAPSRPEAPAGRGRAAAKTPGRRSARSESPSSTSPSARSRKAAPP

SEQ ID NO: 57033 - protein, 11 aa, Mycobacterium avium
SSASAGPVAAK

SEQ ID NO: 57034 - protein, 10 aa, Mycobacterium avium
SSAVGREIGR

SEQ ID NO: 57035 - protein, 8 aa, Mycobacterium avium
SSDAGQQV

SEQ ID NO: 57036 - protein, 10 aa, Mycobacterium avium
SSDGAVTDGL

SEQ ID NO: 57037 - protein, 10 aa, Mycobacterium avium
SSDSDESRPF

SEQ ID NO: 57038 - protein, 4 aa, Mycobacterium avium
SSEM

SEQ ID NO: 57039 - protein, 6 aa, Mycobacterium avium
SSEMPT

SEQ ID NO: 57040 - protein, 7 aa, Mycobacterium avium
SSEPDRR

SEQ ID NO: 57041 - protein, 8 aa, Mycobacterium avium
SSFPPGGL

SEQ ID NO: 57042 - protein, 9 aa, Mycobacterium avium
SSGANIRQT

SEQ ID NO: 57043 - protein, 6 aa, Mycobacterium avium
SSGDVG

SEQ ID NO: 57044 - protein, 17 aa, Mycobacterium avium
SSGFSGNRVCALPDTPR

SEQ ID NO: 57045 - protein, 18 aa, Mycobacterium avium
SSGGKPTVTLPDAGPAGS

SEQ ID NO: 57046 - protein, 5 aa, Mycobacterium avium
SSGPC

SEQ ID NO: 57047 - protein, 9 aa, Mycobacterium avium
SSGPGPAGL

SEQ ID NO: 57048 - protein, 9 aa, Mycobacterium avium
SSGPGPGPL

SEQ ID NO: 57049 - protein, 6 aa, Mycobacterium avium
SSGSAV

SEQ ID NO: 57050 - protein, 14 aa, Mycobacterium avium
SSGSPFSRPVNGTD

SEQ ID NO: 57051 - protein, 9 aa, Mycobacterium avium
SSKNAAKLR

SEQ ID NO: 57052 - protein, 21 aa, Mycobacterium avium
SSKPSGGAGSSKSDDDTKRRF

SEQ ID NO: 57053 - protein, 13 aa, Mycobacterium avium
SSKSGDAGGGSKV

SEQ ID NO: 57054 - protein, 22 aa, Mycobacterium avium
SSLAGRAVGGTATRAVAGSTVR

SEQ ID NO: 57055 - protein, 18 aa, Mycobacterium avium
SSLGAAASAEVNAGDRDY

SEQ ID NO: 57056 - protein, 6 aa, Mycobacterium avium
SSLGTP

SEQ ID NO: 57057 - protein, 9 aa, Mycobacterium avium
SSNPAHSLA

SEQ ID NO: 57058 - protein, 4 aa, Mycobacterium avium
SSPA

SEQ ID NO: 57059 - protein, 12 aa, Mycobacterium avium
SSPDYPDAEEAR

SEQ ID NO: 57060 - protein, 7 aa, Mycobacterium avium
SSPDYRP

SEQ ID NO: 57061 - protein, 12 aa, Mycobacterium avium
SSPGVDRPLRTP

SEQ ID NO: 57062 - protein, 12 aa, Mycobacterium avium
SSPPDSEWTSGA

SEQ ID NO: 57063 - protein, 7 aa, Mycobacterium avium
SSPSAAI

SEQ ID NO: 57064 - protein, 9 aa, Mycobacterium avium
SSPTAAEDE

SEQ ID NO: 57065 - protein, 5 aa, Mycobacterium avium
SSRRS

SEQ ID NO: 57066 - protein, 4 aa, Mycobacterium avium
SSRV

SEQ ID NO: 57067 - protein, 7 aa, Mycobacterium avium
SSSAAAL

SEQ ID NO: 57068 - protein, 9 aa, Mycobacterium avium
SSSDPAAGV

SEQ ID NO: 57069 - protein, 9 aa, Mycobacterium avium
SSSLRTGQY

SEQ ID NO: 57070 - protein, 8 aa, Mycobacterium avium
SSSQTLYD

SEQ ID NO: 57071 - protein, 7 aa, Mycobacterium avium
SSSSETV

SEQ ID NO: 57072 - protein, 9 aa, Mycobacterium avium
SSSYAPVPQ

SEQ ID NO: 57073 - protein, 11 aa, Mycobacterium avium
SSTQGWRDNPQ

SEQ ID NO: 57074 - protein, 4 aa, Mycobacterium avium
SSTV

SEQ ID NO: 57075 - protein, 7 aa, Mycobacterium avium
SSVASGR

SEQ ID NO: 57076 - protein, 14 aa, Mycobacterium avium
SSVDGSPTRPARAG

SEQ ID NO: 57077 - protein, 4 aa, Mycobacterium avium
SSYA

SEQ ID NO: 57078 - protein, 14 aa, Mycobacterium avium
SSYGTGVGKDAITS

SEQ ID NO: 57079 - protein, 9 aa, Mycobacterium avium
SSYSDKEGT

SEQ ID NO: 57080 - protein, 8 aa, Mycobacterium avium
SSYTGEPI

SEQ ID NO: 57081 - protein, 13 aa, Mycobacterium avium
SSYTPDPATGGAR

SEQ ID NO: 57082 - protein, 4 aa, Mycobacterium avium
STAA

SEQ ID NO: 57083 - protein, 11 aa, Mycobacterium avium
STAAGSAEATV

SEQ ID NO: 57084 - protein, 12 aa, Mycobacterium avium
STAAQQAGGGRA

SEQ ID NO: 57085 - protein, 8 aa, Mycobacterium avium
STAATRLT

SEQ ID NO: 57086 - protein, 11 aa, Mycobacterium avium
STADRTNGADL

SEQ ID NO: 57087 - protein, 7 aa, Mycobacterium avium
STAGNSI

SEQ ID NO: 57088 - protein, 11 aa, Mycobacterium avium
STALPGDPDFA

SEQ ID NO: 57089 - protein, 9 aa, Mycobacterium avium
STALTGARG

SEQ ID NO: 57090 - protein, 4 aa, Mycobacterium avium
STAQ

SEQ ID NO: 57091 - protein, 10 aa, Mycobacterium avium
STAQGNDGMD

SEQ ID NO: 57092 - protein, 9 aa, Mycobacterium avium
STASGSAIG

SEQ ID NO: 57093 - protein, 17 aa, Mycobacterium avium
STATPGSDRLAAQTDPY

SEQ ID NO: 57094 - protein, 5 aa, Mycobacterium avium
STAVG

SEQ ID NO: 57095 - protein, 10 aa, Mycobacterium avium
STDCRQRAAH

SEQ ID NO: 57096 - protein, 28 aa, Mycobacterium avium
STDKLGRGSAVTSKHTRALAPRTATADR

SEQ ID NO: 57097 - protein, 9 aa, Mycobacterium avium
STDSPFDNE

SEQ ID NO: 57098 - protein, 9 aa, Mycobacterium avium
STEPAAYDQ

SEQ ID NO: 57099 - protein, 7 aa, Mycobacterium avium
STERAAA

SEQ ID NO: 57100 - protein, 10 aa, Mycobacterium avium
STESPPGTLD

SEQ ID NO: 57101 - protein, 4 aa, Mycobacterium avium
STEW

SEQ ID NO: 57102 - protein, 6 aa, Mycobacterium avium
STFNTS

SEQ ID NO: 57103 - protein, 5 aa, Mycobacterium avium
STFPS

SEQ ID NO: 57104 - protein, 7 aa, Mycobacterium avium
STGADGP

SEQ ID NO: 57105 - protein, 6 aa, Mycobacterium avium
STGAVA

SEQ ID NO: 57106 - protein, 8 aa, Mycobacterium avium
STGGGASL

SEQ ID NO: 57107 - protein, 6 aa, Mycobacterium avium
STGGPV

SEQ ID NO: 57108 - protein, 9 aa, Mycobacterium avium
STGLDPLTT

SEQ ID NO: 57109 - protein, 11 aa, Mycobacterium avium
STGNRRPARPT

SEQ ID NO: 57110 - protein, 9 aa, Mycobacterium avium
STGPDHDKE

SEQ ID NO: 57111 - protein, 7 aa, Mycobacterium avium
STGSAGE

SEQ ID NO: 57112 - protein, 7 aa, Mycobacterium avium
STGTRAR

SEQ ID NO: 57113 - protein, 6 aa, Mycobacterium avium
STGTRE

SEQ ID NO: 57114 - protein, 10 aa, Mycobacterium avium
STHSEEEATT

SEQ ID NO: 57115 - protein, 8 aa, Mycobacterium avium
STKPENVP

SEQ ID NO: 57116 - protein, 6 aa, Mycobacterium avium
STLGAK

SEQ ID NO: 57117 - protein, 5 aa, Mycobacterium avium
STLPG

SEQ ID NO: 57118 - protein, 9 aa, Mycobacterium avium
STLTRRDQA

SEQ ID NO: 57119 - protein, 7 aa, Mycobacterium avium
STNGVQV

SEQ ID NO: 57120 - protein, 6 aa, Mycobacterium avium
STNPTV

SEQ ID NO: 57121 - protein, 10 aa, Mycobacterium avium
STPAGRADAA

SEQ ID NO: 57122 - protein, 15 aa, Mycobacterium avium
STPPQPSGHPEFPED

SEQ ID NO: 57123 - protein, 5 aa, Mycobacterium avium
STPQT

SEQ ID NO: 57124 - protein, 16 aa, Mycobacterium avium
STQRGQPLKLPASPEV

SEQ ID NO: 57125 - protein, 9 aa, Mycobacterium avium
STQSPTTVA

SEQ ID NO: 57126 - protein, 8 aa, Mycobacterium avium
STQTPDEV

SEQ ID NO: 57127 - protein, 4 aa, Mycobacterium avium
STSG

SEQ ID NO: 57128 - protein, 4 aa, Mycobacterium avium
STTA

SEQ ID NO: 57129 - protein, 10 aa, Mycobacterium avium
STTAANDGRE

SEQ ID NO: 57130 - protein, 7 aa, Mycobacterium avium
STTIGRL

SEQ ID NO: 57131 - protein, 15 aa, Mycobacterium avium
STTKATGAKSISGSD

SEQ ID NO: 57132 - protein, 5 aa, Mycobacterium avium
STTVE

SEQ ID NO: 57133 - protein, 6 aa, Mycobacterium avium
STVEQA

SEQ ID NO: 57134 - protein, 5 aa, Mycobacterium avium
SVAGD

SEQ ID NO: 57135 - protein, 11 aa, Mycobacterium avium
SVAPAKARAAL

SEQ ID NO: 57136 - protein, 17 aa, Mycobacterium avium
SVDPHRSTDLPYPPAIT

SEQ ID NO: 57137 - protein, 8 aa, Mycobacterium avium
SVDPPRSF

SEQ ID NO: 57138 - protein, 18 aa, Mycobacterium avium
SVDRPATGDPVQAGGRAV

SEQ ID NO: 57139 - protein, 8 aa, Mycobacterium avium
SVGATSPP

SEQ ID NO: 57140 - protein, 6 aa, Mycobacterium avium
SVGTGI

SEQ ID NO: 57141 - protein, 11 aa, Mycobacterium avium
SVIGGANPAGI

SEQ ID NO: 57142 - protein, 11 aa, Mycobacterium avium
SVNGGNKTVPT

SEQ ID NO: 57143 - protein, 5 aa, Mycobacterium avium
SVPPP

SEQ ID NO: 57144 - protein, 18 aa, Mycobacterium avium
SVPSPASPNSPAAPLDRS

SEQ ID NO: 57145 - protein, 10 aa, Mycobacterium avium
SVQETPDPAS

SEQ ID NO: 57146 - protein, 5 aa, Mycobacterium avium
SVQNT

SEQ ID NO: 57147 - protein, 8 aa, Mycobacterium avium
SVRGKVGD

SEQ ID NO: 57148 - protein, 7 aa, Mycobacterium avium
SVSADTG

SEQ ID NO: 57149 - protein, 8 aa, Mycobacterium avium
SVTEGHPD

SEQ ID NO: 57150 - protein, 6 aa, Mycobacterium avium
SVTGED

SEQ ID NO: 57151 - protein, 14 aa, Mycobacterium avium
SVTVDGSERRFSGS

SEQ ID NO: 57152 - protein, 6 aa, Mycobacterium avium
SVTVPT

SEQ ID NO: 57153 - protein, 4 aa, Mycobacterium avium
SVVT

SEQ ID NO: 57154 - protein, 13 aa, Mycobacterium avium
SWQGSSSESMAAA

SEQ ID NO: 57155 - protein, 22 aa, Mycobacterium avium
SWSAAAPATSLASSAAPLEGSG

SEQ ID NO: 57156 - protein, 11 aa, Mycobacterium avium
SYANGYGNSKW

SEQ ID NO: 57157 - protein, 12 aa, Mycobacterium avium
SYAPERAHRPDT

SEQ ID NO: 57158 - protein, 13 aa, Mycobacterium avium
SYERPHDLPSAVG

SEQ ID NO: 57159 - protein, 6 aa, Mycobacterium avium
SYGTLG

SEQ ID NO: 57160 - protein, 6 aa, Mycobacterium avium
SYIPGT

SEQ ID NO: 57161 - protein, 9 aa, Mycobacterium avium
SYNEETKEI

SEQ ID NO: 57162 - protein, 4 aa, Mycobacterium avium
SYNG

SEQ ID NO: 57163 - protein, 11 aa, Mycobacterium avium
SYPDDADEFGS

SEQ ID NO: 57164 - protein, 18 aa, Mycobacterium avium
SYPPSLPAGDAAMPRPTP

SEQ ID NO: 57165 - protein, 7 aa, Mycobacterium avium
SYPRANR

SEQ ID NO: 57166 - protein, 8 aa, Mycobacterium avium
SYQEPAAN

SEQ ID NO: 57167 - protein, 18 aa, Mycobacterium avium
SYRGPHSDESGGAEAGPI

SEQ ID NO: 57168 - protein, 10 aa, Mycobacterium avium
SYRPAGNKPG

SEQ ID NO: 57169 - protein, 6 aa, Mycobacterium avium
SYRPQR

SEQ ID NO: 57170 - protein, 22 aa, Mycobacterium avium
SYTANEADSAEKMSAIGRQPAR

SEQ ID NO: 57171 - protein, 20 aa, Mycobacterium avium
SYTEGASRWGADDERPPAGE

SEQ ID NO: 57172 - protein, 12 aa, Mycobacterium avium
TAAAAGSADPLR

SEQ ID NO: 57173 - protein, 18 aa, Mycobacterium avium
TAAAAGVAGEVGGAVGGG

SEQ ID NO: 57174 - protein, 12 aa, Mycobacterium avium
TAAAQRDGAIGT

SEQ ID NO: 57175 - protein, 7 aa, Mycobacterium avium
TAADDGA

SEQ ID NO: 57176 - protein, 7 aa, Mycobacterium avium
TAADDTP

SEQ ID NO: 57177 - protein, 24 aa, Mycobacterium avium
TAADSGTRPLSADDEPGTRSAAAN

SEQ ID NO: 57178 - protein, 7 aa, Mycobacterium avium
TAAERDE

SEQ ID NO: 57179 - protein, 15 aa, Mycobacterium avium
TAAGGGRIRSRGKTF

SEQ ID NO: 57180 - protein, 5 aa, Mycobacterium avium
TAAGI

SEQ ID NO: 57181 - protein, 16 aa, Mycobacterium avium
TAAGSTPDPQFQPGEL

SEQ ID NO: 57182 - protein, 4 aa, Mycobacterium avium
TAAK

SEQ ID NO: 57183 - protein, 11 aa, Mycobacterium avium
TAAPGNGAPLG

SEQ ID NO: 57184 - protein, 19 aa, Mycobacterium avium
TAAQAEEAASQARAAAAAY

SEQ ID NO: 57185 - protein, 8 aa, Mycobacterium avium
TAAQREGA

SEQ ID NO: 57186 - protein, 11 aa, Mycobacterium avium
TAARHGAEAAR

SEQ ID NO: 57187 - protein, 8 aa, Mycobacterium avium
TAARPDLD

SEQ ID NO: 57188 - protein, 9 aa, Mycobacterium avium
TAASAAKAC

SEQ ID NO: 57189 - protein, 5 aa, Mycobacterium avium
TAAST

SEQ ID NO: 57190 - protein, 11 aa, Mycobacterium avium
TAATDFDADPG

SEQ ID NO: 57191 - protein, 9 aa, Mycobacterium avium
TAATGLAER

SEQ ID NO: 57192 - protein, 40 aa, Mycobacterium avium
TAATGNPVAAAPVTGWSEPSAADARPGVTAPGLPGIPGAT

SEQ ID NO: 57193 - protein, 13 aa, Mycobacterium avium
TAATRSATTTGRE

SEQ ID NO: 57194 - protein, 7 aa, Mycobacterium avium
TAATRVG

SEQ ID NO: 57195 - protein, 10 aa, Mycobacterium avium
TADAGEALRD

SEQ ID NO: 57196 - protein, 7 aa, Mycobacterium avium
TADANKE

SEQ ID NO: 57197 - protein, 8 aa, Mycobacterium avium
TADGGRPL

SEQ ID NO: 57198 - protein, 8 aa, Mycobacterium avium
TADPGQRL

SEQ ID NO: 57199 - protein, 6 aa, Mycobacterium avium
TADPGR

SEQ ID NO: 57200 - protein, 7 aa, Mycobacterium avium
TADPQRR

SEQ ID NO: 57201 - protein, 9 aa, Mycobacterium avium
TADPTQSVS

SEQ ID NO: 57202 - protein, 8 aa, Mycobacterium avium
TADPTRRL

SEQ ID NO: 57203 - protein, 8 aa, Mycobacterium avium
TADQSEGM

SEQ ID NO: 57204 - protein, 9 aa, Mycobacterium avium
TADRPEPEY

SEQ ID NO: 57205 - protein, 5 aa, Mycobacterium avium
TADVS

SEQ ID NO: 57206 - protein, 4 aa, Mycobacterium avium
TAEA

SEQ ID NO: 57207 - protein, 37 aa, Mycobacterium avium
TAEERANAVRGRADSLRRAAAAEREARVRAQQAREAR

SEQ ID NO: 57208 - protein, 10 aa, Mycobacterium avium
TAEIGSPRSW

SEQ ID NO: 57209 - protein, 9 aa, Mycobacterium avium
TAEPLRGGG

SEQ ID NO: 57210 - protein, 9 aa, Mycobacterium avium
TAEPPGLGA

SEQ ID NO: 57211 - protein, 5 aa, Mycobacterium avium
TAEQA

SEQ ID NO: 57212 - protein, 13 aa, Mycobacterium avium
TAEQLRRSEYSGP

SEQ ID NO: 57213 - protein, 16 aa, Mycobacterium avium
TAETAARAAEQAELAD

SEQ ID NO: 57214 - protein, 7 aa, Mycobacterium avium
TAFTDGE

SEQ ID NO: 57215 - protein, 4 aa, Mycobacterium avium
TAGA

SEQ ID NO: 57216 - protein, 8 aa, Mycobacterium avium
TAGAGTRV

SEQ ID NO: 57217 - protein, 5 aa, Mycobacterium avium
TAGAS

SEQ ID NO: 57218 - protein, 12 aa, Mycobacterium avium
TAGEEREGESLD

SEQ ID NO: 57219 - protein, 16 aa, Mycobacterium avium
TAGGELSAGGATFRPS

SEQ ID NO: 57220 - protein, 7 aa, Mycobacterium avium
TAGGGNL

SEQ ID NO: 57221 - protein, 11 aa, Mycobacterium avium
TAGGSAPSSTV

SEQ ID NO: 57222 - protein, 6 aa, Mycobacterium avium
TAGHAT

SEQ ID NO: 57223 - protein, 6 aa, Mycobacterium avium
TAGIKG

SEQ ID NO: 57224 - protein, 6 aa, Mycobacterium avium
TAGLKG

SEQ ID NO: 57225 - protein, 11 aa, Mycobacterium avium
TAGNSSGINDA

SEQ ID NO: 57226 - protein, 8 aa, Mycobacterium avium
TAGPGQPF

SEQ ID NO: 57227 - protein, 13 aa, Mycobacterium avium
TAGPWESEQTHES

SEQ ID NO: 57228 - protein, 9 aa, Mycobacterium avium
TAGRGPAVT

SEQ ID NO: 57229 - protein, 8 aa, Mycobacterium avium
TAHKSAPG

SEQ ID NO: 57230 - protein, 13 aa, Mycobacterium avium
TAIPDTGSTADDL

SEQ ID NO: 57231 - protein, 6 aa, Mycobacterium avium
TAKPYF

SEQ ID NO: 57232 - protein, 4 aa, Mycobacterium avium
TAKT

SEQ ID NO: 57233 - protein, 10 aa, Mycobacterium avium
TALQDATPTW

SEQ ID NO: 57234 - protein, 24 aa, Mycobacterium avium
TALTSSRDDGPRLDAHERLTSQAG

SEQ ID NO: 57235 - protein, 8 aa, Mycobacterium avium
TAPAAGQY

SEQ ID NO: 57236 - protein, 29 aa, Mycobacterium avium
TAPAPSFSAPVSGAGRFGTPRAAPTRAAM

SEQ ID NO: 57237 - protein, 6 aa, Mycobacterium avium
TAPDAP

SEQ ID NO: 57238 - protein, 17 aa, Mycobacterium avium
TAPDAPPPEPAPRTGTV

SEQ ID NO: 57239 - protein, 20 aa, Mycobacterium avium
TAPDRHDTSGRTGRQTTSHP

SEQ ID NO: 57240 - protein, 16 aa, Mycobacterium avium
TAPESGEPPAAETAPT

SEQ ID NO: 57241 - protein, 7 aa, Mycobacterium avium
TAPESTV

SEQ ID NO: 57242 - protein, 15 aa, Mycobacterium avium
TAPEVAAARERAGQV

SEQ ID NO: 57243 - protein, 7 aa, Mycobacterium avium
TAPGGRT

SEQ ID NO: 57244 - protein, 11 aa, Mycobacterium avium
TAPKLPDGTPF

SEQ ID NO: 57245 - protein, 11 aa, Mycobacterium avium
TAPPGDCGAAT

SEQ ID NO: 57246 - protein, 7 aa, Mycobacterium avium
TAPSRAE

SEQ ID NO: 57247 - protein, 7 aa, Mycobacterium avium
TAPSWEE

SEQ ID NO: 57248 - protein, 5 aa, Mycobacterium avium
TAPTD

SEQ ID NO: 57249 - protein, 12 aa, Mycobacterium avium
TAPVSYEDSISP

SEQ ID NO: 57250 - protein, 7 aa, Mycobacterium avium
TAQAERA

SEQ ID NO: 57251 - protein, 6 aa, Mycobacterium avium
TAQRDR

SEQ ID NO: 57252 - protein, 5 aa, Mycobacterium avium
TAQVE

SEQ ID NO: 57253 - protein, 5 aa, Mycobacterium avium
TARDA

SEQ ID NO: 57254 - protein, 6 aa, Mycobacterium avium
TAREEL

SEQ ID NO: 57255 - protein, 5 aa, Mycobacterium avium
TAREF

SEQ ID NO: 57256 - protein, 18 aa, Mycobacterium avium
TARERVGGQVGTGRRKLS

SEQ ID NO: 57257 - protein, 6 aa, Mycobacterium avium
TARGDD

SEQ ID NO: 57258 - protein, 9 aa, Mycobacterium avium
TARKKPPFG

SEQ ID NO: 57259 - protein, 30 aa, Mycobacterium avium
TARRDLDAARGEISESRALHSSRREALSAE

SEQ ID NO: 57260 - protein, 10 aa, Mycobacterium avium
TASADPPVQR

SEQ ID NO: 57261 - protein, 7 aa, Mycobacterium avium
TASEAGL

SEQ ID NO: 57262 - protein, 5 aa, Mycobacterium avium
TASER

SEQ ID NO: 57263 - protein, 16 aa, Mycobacterium avium
TASHPELDATDSRRQL

SEQ ID NO: 57264 - protein, 6 aa, Mycobacterium avium
TASRIQ

SEQ ID NO: 57265 - protein, 9 aa, Mycobacterium avium
TASTPEAEP

SEQ ID NO: 57266 - protein, 11 aa, Mycobacterium avium
TATAAARAGGQ

SEQ ID NO: 57267 - protein, 9 aa, Mycobacterium avium
TATAEDGTV

SEQ ID NO: 57268 - protein, 16 aa, Mycobacterium avium
TATATGAARVAERAKA

SEQ ID NO: 57269 - protein, 5 aa, Mycobacterium avium
TATED

SEQ ID NO: 57270 - protein, 7 aa, Mycobacterium avium
TATGIAG

SEQ ID NO: 57271 - protein, 12 aa, Mycobacterium avium
TATPKRDETADT

SEQ ID NO: 57272 - protein, 6 aa, Mycobacterium avium
TATPRV

SEQ ID NO: 57273 - protein, 5 aa, Mycobacterium avium
TATQL

SEQ ID NO: 57274 - protein, 19 aa, Mycobacterium avium
TATRAEEAAAQANSAATAY

SEQ ID NO: 57275 - protein, 10 aa, Mycobacterium avium
TATRTRETLR

SEQ ID NO: 57276 - protein, 19 aa, Mycobacterium avium
TATSKQKPEPQTTASSARV

SEQ ID NO: 57277 - protein, 7 aa, Mycobacterium avium
TATSTGM

SEQ ID NO: 57278 - protein, 7 aa, Mycobacterium avium
TATTTTA

SEQ ID NO: 57279 - protein, 4 aa, Mycobacterium avium
TATV

SEQ ID NO: 57280 - protein, 13 aa, Mycobacterium avium
TATVASPRRIAER

SEQ ID NO: 57281 - protein, 9 aa, Mycobacterium avium
TATVDRRDT

SEQ ID NO: 57282 - protein, 6 aa, Mycobacterium avium
TAVGAG

SEQ ID NO: 57283 - protein, 34 aa, Mycobacterium avium
TAVPPRAPLPSEPQPAADHDGVEPDTELDREPGR

SEQ ID NO: 57284 - protein, 6 aa, Mycobacterium avium
TAVRDG

SEQ ID NO: 57285 - protein, 6 aa, Mycobacterium avium
TAVRQG

SEQ ID NO: 57286 - protein, 11 aa, Mycobacterium avium
TCSAADGPRYG

SEQ ID NO: 57287 - protein, 7 aa, Mycobacterium avium
TDAAGDV

SEQ ID NO: 57288 - protein, 10 aa, Mycobacterium avium
TDAARDSEES

SEQ ID NO: 57289 - protein, 5 aa, Mycobacterium avium
TDADL

SEQ ID NO: 57290 - protein, 7 aa, Mycobacterium avium
TDAGARA

SEQ ID NO: 57291 - protein, 7 aa, Mycobacterium avium
TDAKGRH

SEQ ID NO: 57292 - protein, 7 aa, Mycobacterium avium
TDAKNSA

SEQ ID NO: 57293 - protein, 9 aa, Mycobacterium avium
TDALPGPLT

SEQ ID NO: 57294 - protein, 12 aa, Mycobacterium avium
TDAPGVRIEPQQ

SEQ ID NO: 57295 - protein, 8 aa, Mycobacterium avium
TDARPEQV

SEQ ID NO: 57296 - protein, 16 aa, Mycobacterium avium
TDDNPDIGANDMPALT

SEQ ID NO: 57297 - protein, 25 aa, Mycobacterium avium
TDDPAARFAPGNTLRAKPSRGGPER

SEQ ID NO: 57298 - protein, 17 aa, Mycobacterium avium
TDDPASEATLRQTSYAQ

SEQ ID NO: 57299 - protein, 8 aa, Mycobacterium avium
TDDPVPGS

SEQ ID NO: 57300 - protein, 6 aa, Mycobacterium avium
TDDQRE

SEQ ID NO: 57301 - protein, 8 aa, Mycobacterium avium
TDDRRAAL

SEQ ID NO: 57302 - protein, 9 aa, Mycobacterium avium
TDDSTDLKA

SEQ ID NO: 57303 - protein, 12 aa, Mycobacterium avium
TDEAAARRQKWS

SEQ ID NO: 57304 - protein, 20 aa, Mycobacterium avium
TDETTALSRSRPASGAVDAA

SEQ ID NO: 57305 - protein, 5 aa, Mycobacterium avium
TDFAP

SEQ ID NO: 57306 - protein, 15 aa, Mycobacterium avium
TDFPTAADGISDAGA

SEQ ID NO: 57307 - protein, 11 aa, Mycobacterium avium
TDGADGDASDR

SEQ ID NO: 57308 - protein, 6 aa, Mycobacterium avium
TDGAQC

SEQ ID NO: 57309 - protein, 18 aa, Mycobacterium avium
TDGLTDEVSGYRPTPDAN

SEQ ID NO: 57310 - protein, 11 aa, Mycobacterium avium
TDGNGAPGERT

SEQ ID NO: 57311 - protein, 16 aa, Mycobacterium avium
TDGNGPPQTNRAHHPD

SEQ ID NO: 57312 - protein, 8 aa, Mycobacterium avium
TDGPVTNG

SEQ ID NO: 57313 - protein, 7 aa, Mycobacterium avium
TDGRPIT

SEQ ID NO: 57314 - protein, 6 aa, Mycobacterium avium
TDIGQA

SEQ ID NO: 57315 - protein, 6 aa, Mycobacterium avium
TDIPPG

SEQ ID NO: 57316 - protein, 4 aa, Mycobacterium avium
TDKI

SEQ ID NO: 57317 - protein, 11 aa, Mycobacterium avium
TDKVDTEIPSP

SEQ ID NO: 57318 - protein, 28 aa, Mycobacterium avium
TDLAGSDIPLDPTTGQTDRAAARCNSPA

SEQ ID NO: 57319 - protein, 6 aa, Mycobacterium avium
TDLDDA

SEQ ID NO: 57320 - protein, 4 aa, Mycobacterium avium
TDLP

SEQ ID NO: 57321 - protein, 6 aa, Mycobacterium avium
TDLPEG

SEQ ID NO: 57322 - protein, 4 aa, Mycobacterium avium
TDNF

SEQ ID NO: 57323 - protein, 9 aa, Mycobacterium avium
TDNTGSKHK

SEQ ID NO: 57324 - protein, 6 aa, Mycobacterium avium
TDPAAA

SEQ ID NO: 57325 - protein, 9 aa, Mycobacterium avium
TDPDKGAQG

SEQ ID NO: 57326 - protein, 7 aa, Mycobacterium avium
TDPGGTV

SEQ ID NO: 57327 - protein, 7 aa, Mycobacterium avium
TDPGHGL

SEQ ID NO: 57328 - protein, 12 aa, Mycobacterium avium
TDPHTVTDEQVD

SEQ ID NO: 57329 - protein, 4 aa, Mycobacterium avium
TDPI

SEQ ID NO: 57330 - protein, 9 aa, Mycobacterium avium
TDPRRPKHK

SEQ ID NO: 57331 - protein, 14 aa, Mycobacterium avium
TDPSALADTSGYAS

SEQ ID NO: 57332 - protein, 6 aa, Mycobacterium avium
TDPTRL

SEQ ID NO: 57333 - protein, 5 aa, Mycobacterium avium
TDPVD

SEQ ID NO: 57334 - protein, 13 aa, Mycobacterium avium
TDPVTPEITRWVH

SEQ ID NO: 57335 - protein, 7 aa, Mycobacterium avium
TDQNGEV

SEQ ID NO: 57336 - protein, 9 aa, Mycobacterium avium
TDQTTGDAL

SEQ ID NO: 57337 - protein, 7 aa, Mycobacterium avium
TDRPYPA

SEQ ID NO: 57338 - protein, 15 aa, Mycobacterium avium
TDSPTGYTGVDGDAQ

SEQ ID NO: 57339 - protein, 18 aa, Mycobacterium avium
TDTGHVGRGAAPTGTSVG

SEQ ID NO: 57340 - protein, 7 aa, Mycobacterium avium
TDTPAEV

SEQ ID NO: 57341 - protein, 6 aa, Mycobacterium avium
TDTPAL

SEQ ID NO: 57342 - protein, 9 aa, Mycobacterium avium
TDTRGNPIA

SEQ ID NO: 57343 - protein, 9 aa, Mycobacterium avium
TDVNGDDRH

SEQ ID NO: 57344 - protein, 4 aa, Mycobacterium avium
TEAA

SEQ ID NO: 57345 - protein, 14 aa, Mycobacterium avium
TEAARRQLQETDDT

SEQ ID NO: 57346 - protein, 5 aa, Mycobacterium avium
TEADD

SEQ ID NO: 57347 - protein, 10 aa, Mycobacterium avium
TEADNIDPQQ

SEQ ID NO: 57348 - protein, 8 aa, Mycobacterium avium
TEAGRHSG

SEQ ID NO: 57349 - protein, 6 aa, Mycobacterium avium
TEAGRR

SEQ ID NO: 57350 - protein, 7 aa, Mycobacterium avium
TEAGRRI

SEQ ID NO: 57351 - protein, 9 aa, Mycobacterium avium
TEAIGESRI

SEQ ID NO: 57352 - protein, 5 aa, Mycobacterium avium
TEAPG

SEQ ID NO: 57353 - protein, 7 aa, Mycobacterium avium
TEASGAS

SEQ ID NO: 57354 - protein, 8 aa, Mycobacterium avium
TEDGIDAA

SEQ ID NO: 57355 - protein, 21 aa, Mycobacterium avium
TEDGVDEHGPTVKAAADYGDW

SEQ ID NO: 57356 - protein, 9 aa, Mycobacterium avium
TEDPDRPLS

SEQ ID NO: 57357 - protein, 10 aa, Mycobacterium avium
TEDPSPGVDG

SEQ ID NO: 57358 - protein, 7 aa, Mycobacterium avium
TEDQKRA

SEQ ID NO: 57359 - protein, 20 aa, Mycobacterium avium
TEDQQDQQDQQDQADEEDGA

SEQ ID NO: 57360 - protein, 69 aa, Mycobacterium avium
TEEITKAAKRSELQAKYGQTVQQPAQPPPGPQAPTGSRSPQAQSDYPPVPPNGPVPPMPEPAEPKGPGL

SEQ ID NO: 57361 - protein, 5 aa, Mycobacterium avium
TEELE

SEQ ID NO: 57362 - protein, 10 aa, Mycobacterium avium
TEETTEPSAV

SEQ ID NO: 57363 - protein, 15 aa, Mycobacterium avium
TEEVSGKQAKDLTDD

SEQ ID NO: 57364 - protein, 5 aa, Mycobacterium avium
TEGGL

SEQ ID NO: 57365 - protein, 8 aa, Mycobacterium avium
TEGHQNDA

SEQ ID NO: 57366 - protein, 4 aa, Mycobacterium avium
TEGI

SEQ ID NO: 57367 - protein, 5 aa, Mycobacterium avium
TEGMH

SEQ ID NO: 57368 - protein, 5 aa, Mycobacterium avium
TEHPA

SEQ ID NO: 57369 - protein, 12 aa, Mycobacterium avium
TEKLGPPSGYTC

SEQ ID NO: 57370 - protein, 26 aa, Mycobacterium avium
TEKQGGSDVRAGTTQAVPNGDGSYRL

SEQ ID NO: 57371 - protein, 5 aa, Mycobacterium avium
TENRE

SEQ ID NO: 57372 - protein, 4 aa, Mycobacterium avium
TEPD

SEQ ID NO: 57373 - protein, 6 aa, Mycobacterium avium
TEPERY

SEQ ID NO: 57374 - protein, 5 aa, Mycobacterium avium
TEPEV

SEQ ID NO: 57375 - protein, 11 aa, Mycobacterium avium
TEPGAGSDLAG

SEQ ID NO: 57376 - protein, 9 aa, Mycobacterium avium
TEPGGGSDL

SEQ ID NO: 57377 - protein, 9 aa, Mycobacterium avium
TEPSDPDLR

SEQ ID NO: 57378 - protein, 7 aa, Mycobacterium avium
TEPSGPL

SEQ ID NO: 57379 - protein, 12 aa, Mycobacterium avium
TERAEALRRYRS

SEQ ID NO: 57380 - protein, 11 aa, Mycobacterium avium
TERDSDYSGAL

SEQ ID NO: 57381 - protein, 7 aa, Mycobacterium avium
TERPRGV

SEQ ID NO: 57382 - protein, 8 aa, Mycobacterium avium
TERPTRGT

SEQ ID NO: 57383 - protein, 5 aa, Mycobacterium avium
TERTT

SEQ ID NO: 57384 - protein, 5 aa, Mycobacterium avium
TESAR

SEQ ID NO: 57385 - protein, 4 aa, Mycobacterium avium
TESE

SEQ ID NO: 57386 - protein, 20 aa, Mycobacterium avium
TESPSTKAAAEIATGGRTDN

SEQ ID NO: 57387 - protein, 26 aa, Mycobacterium avium
TESPTTSPATGSGAAAPDSDAPPYRY

SEQ ID NO: 57388 - protein, 4 aa, Mycobacterium avium
TETE

SEQ ID NO: 57389 - protein, 7 aa, Mycobacterium avium
TETGERV

SEQ ID NO: 57390 - protein, 10 aa, Mycobacterium avium
TETKASEGVI

SEQ ID NO: 57391 - protein, 6 aa, Mycobacterium avium
TETQQR

SEQ ID NO: 57392 - protein, 6 aa, Mycobacterium avium
TEVGTG

SEQ ID NO: 57393 - protein, 10 aa, Mycobacterium avium
TEVPRPGPSD

SEQ ID NO: 57394 - protein, 12 aa, Mycobacterium avium
TEWASPAEEPHT

SEQ ID NO: 57395 - protein, 9 aa, Mycobacterium avium
TEWGRPPPR

SEQ ID NO: 57396 - protein, 8 aa, Mycobacterium avium
TEWTDGHQ

SEQ ID NO: 57397 - protein, 7 aa, Mycobacterium avium
TFAQSSK

SEQ ID NO: 57398 - protein, 4 aa, Mycobacterium avium
TFDA

SEQ ID NO: 57399 - protein, 6 aa, Mycobacterium avium
TFDDAY

SEQ ID NO: 57400 - protein, 4 aa, Mycobacterium avium
TFGG

SEQ ID NO: 57401 - protein, 11 aa, Mycobacterium avium
TFGGAGGAVSS

SEQ ID NO: 57402 - protein, 7 aa, Mycobacterium avium
TFNTGDP

SEQ ID NO: 57403 - protein, 39 aa, Mycobacterium avium
TFPASDPGAPSNGHADDLPAVQSAAAHANGRPSNPVTVR

SEQ ID NO: 57404 - protein, 8 aa, Mycobacterium avium
TGAADGYA

SEQ ID NO: 57405 - protein, 8 aa, Mycobacterium avium
TGAAKAGD

SEQ ID NO: 57406 - protein, 7 aa, Mycobacterium avium
TGAAQGC

SEQ ID NO: 57407 - protein, 5 aa, Mycobacterium avium
TGADM

SEQ ID NO: 57408 - protein, 4 aa, Mycobacterium avium
TGAG

SEQ ID NO: 57409 - protein, 18 aa, Mycobacterium avium
TGAGDPQKFDPDASRETL

SEQ ID NO: 57410 - protein, 11 aa, Mycobacterium avium
TGAGKGKSTAA

SEQ ID NO: 57411 - protein, 9 aa, Mycobacterium avium
TGAGSDDDL

SEQ ID NO: 57412 - protein, 14 aa, Mycobacterium avium
TGAQAEETANNARA

SEQ ID NO: 57413 - protein, 22 aa, Mycobacterium avium
TGAQPSAAAPAAPASSSIPGLP

SEQ ID NO: 57414 - protein, 6 aa, Mycobacterium avium
TGARGL

SEQ ID NO: 57415 - protein, 12 aa, Mycobacterium avium
TGATNHRQPRGM

SEQ ID NO: 57416 - protein, 24 aa, Mycobacterium avium
TGAYPHSRPPQAELPAEAKAQIEN

SEQ ID NO: 57417 - protein, 4 aa, Mycobacterium avium
TGDM

SEQ ID NO: 57418 - protein, 13 aa, Mycobacterium avium
TGDPAPRRRADGA

SEQ ID NO: 57419 - protein, 7 aa, Mycobacterium avium
TGDPAVA

SEQ ID NO: 57420 - protein, 8 aa, Mycobacterium avium
TGDPGRPL

SEQ ID NO: 57421 - protein, 8 aa, Mycobacterium avium
TGDPSDRN

SEQ ID NO: 57422 - protein, 8 aa, Mycobacterium avium
TGDPSTSV

SEQ ID NO: 57423 - protein, 5 aa, Mycobacterium avium
TGDQG

SEQ ID NO: 57424 - protein, 11 aa, Mycobacterium avium
TGDSDSGGAFQ

SEQ ID NO: 57425 - protein, 20 aa, Mycobacterium avium
TGEGRKDSATARMSGRARDG

SEQ ID NO: 57426 - protein, 4 aa, Mycobacterium avium
TGEH

SEQ ID NO: 57427 - protein, 12 aa, Mycobacterium avium
TGELDGRKAATE

SEQ ID NO: 57428 - protein, 12 aa, Mycobacterium avium
TGERRDATSPQP

SEQ ID NO: 57429 - protein, 11 aa, Mycobacterium avium
TGFHPTGGASV

SEQ ID NO: 57430 - protein, 11 aa, Mycobacterium avium
TGGAATNAKYQ

SEQ ID NO: 57431 - protein, 12 aa, Mycobacterium avium
TGGDKPTGIDPM

SEQ ID NO: 57432 - protein, 4 aa, Mycobacterium avium
TGGE

SEQ ID NO: 57433 - protein, 12 aa, Mycobacterium avium
TGGERAELGGDL

SEQ ID NO: 57434 - protein, 7 aa, Mycobacterium avium
TGGGTRV

SEQ ID NO: 57435 - protein, 9 aa, Mycobacterium avium
TGGHAGTPV

SEQ ID NO: 57436 - protein, 7 aa, Mycobacterium avium
TGGHLGP

SEQ ID NO: 57437 - protein, 11 aa, Mycobacterium avium
TGGLPKGDALA

SEQ ID NO: 57438 - protein, 12 aa, Mycobacterium avium
TGGPGTGKTTTV

SEQ ID NO: 57439 - protein, 9 aa, Mycobacterium avium
TGGPTFTGC

SEQ ID NO: 57440 - protein, 11 aa, Mycobacterium avium
TGGSRSASLRD

SEQ ID NO: 57441 - protein, 8 aa, Mycobacterium avium
TGGSSGLA

SEQ ID NO: 57442 - protein, 6 aa, Mycobacterium avium
TGGTGK

SEQ ID NO: 57443 - protein, 4 aa, Mycobacterium avium
TGGY

SEQ ID NO: 57444 - protein, 20 aa, Mycobacterium avium
TGHDGGAGTVHANNPGEVPA

SEQ ID NO: 57445 - protein, 8 aa, Mycobacterium avium
TGHGPYGP

SEQ ID NO: 57446 - protein, 5 aa, Mycobacterium avium
TGHNG

SEQ ID NO: 57447 - protein, 11 aa, Mycobacterium avium
TGHVPASKRVA

SEQ ID NO: 57448 - protein, 4 aa, Mycobacterium avium
TGID

SEQ ID NO: 57449 - protein, 5 aa, Mycobacterium avium
TGIGA

SEQ ID NO: 57450 - protein, 15 aa, Mycobacterium avium
TGKPAELDRDEPRRV

SEQ ID NO: 57451 - protein, 15 aa, Mycobacterium avium
TGKTPVSKDDAQQHA

SEQ ID NO: 57452 - protein, 13 aa, Mycobacterium avium
TGLNRNGVPPAQY

SEQ ID NO: 57453 - protein, 6 aa, Mycobacterium avium
TGMGRT

SEQ ID NO: 57454 - protein, 20 aa, Mycobacterium avium
TGMIGDPRDVGERTLNEADT

SEQ ID NO: 57455 - protein, 12 aa, Mycobacterium avium
TGNAQQTTHEPY

SEQ ID NO: 57456 - protein, 6 aa, Mycobacterium avium
TGNDED

SEQ ID NO: 57457 - protein, 6 aa, Mycobacterium avium
TGNGYY

SEQ ID NO: 57458 - protein, 9 aa, Mycobacterium avium
TGPDLAAAR

SEQ ID NO: 57459 - protein, 11 aa, Mycobacterium avium
TGPERDGIDAQ

SEQ ID NO: 57460 - protein, 8 aa, Mycobacterium avium
TGPGGRSL

SEQ ID NO: 57461 - protein, 9 aa, Mycobacterium avium
TGPGTPGGK

SEQ ID NO: 57462 - protein, 28 aa, Mycobacterium avium
TGPRWPDVSGNSQATGTRAVTTGAPSPA

SEQ ID NO: 57463 - protein, 9 aa, Mycobacterium avium
TGPSGEPWP

SEQ ID NO: 57464 - protein, 5 aa, Mycobacterium avium
TGPTV

SEQ ID NO: 57465 - protein, 30 aa, Mycobacterium avium
TGQAFDSPVPAGSGWPGDPATPQTPVAADA

SEQ ID NO: 57466 - protein, 8 aa, Mycobacterium avium
TGQAPAAY

SEQ ID NO: 57467 - protein, 6 aa, Mycobacterium avium
TGQPLG

SEQ ID NO: 57468 - protein, 7 aa, Mycobacterium avium
TGQPPQW

SEQ ID NO: 57469 - protein, 11 aa, Mycobacterium avium
TGQQVAPASLP

SEQ ID NO: 57470 - protein, 11 aa, Mycobacterium avium
TGQSSSVASGR

SEQ ID NO: 57471 - protein, 4 aa, Mycobacterium avium
TGQT

SEQ ID NO: 57472 - protein, 6 aa, Mycobacterium avium
TGQTKY

SEQ ID NO: 57473 - protein, 18 aa, Mycobacterium avium
TGRAPAQGRPRGEAPDRN

SEQ ID NO: 57474 - protein, 5 aa, Mycobacterium avium
TGRGE

SEQ ID NO: 57475 - protein, 11 aa, Mycobacterium avium
TGRGSGKYPTI

SEQ ID NO: 57476 - protein, 5 aa, Mycobacterium avium
TGRGV

SEQ ID NO: 57477 - protein, 5 aa, Mycobacterium avium
TGRPA

SEQ ID NO: 57478 - protein, 9 aa, Mycobacterium avium
TGRQGPDAL

SEQ ID NO: 57479 - protein, 4 aa, Mycobacterium avium
TGRS

SEQ ID NO: 57480 - protein, 7 aa, Mycobacterium avium
TGRTGPS

SEQ ID NO: 57481 - protein, 5 aa, Mycobacterium avium
TGRTK

SEQ ID NO: 57482 - protein, 10 aa, Mycobacterium avium
TGSEQQKKQH

SEQ ID NO: 57483 - protein, 8 aa, Mycobacterium avium
TGSGEERH

SEQ ID NO: 57484 - protein, 11 aa, Mycobacterium avium
TGSHDARVSAP

SEQ ID NO: 57485 - protein, 8 aa, Mycobacterium avium
TGSHQPDA

SEQ ID NO: 57486 - protein, 7 aa, Mycobacterium avium
TGSIGTQ

SEQ ID NO: 57487 - protein, 9 aa, Mycobacterium avium
TGSPDEAAL

SEQ ID NO: 57488 - protein, 8 aa, Mycobacterium avium
TGSPDTSA

SEQ ID NO: 57489 - protein, 23 aa, Mycobacterium avium
TGSPSPSGAGAAEAAPAAAPSIT

SEQ ID NO: 57490 - protein, 7 aa, Mycobacterium avium
TGSSGLV

SEQ ID NO: 57491 - protein, 9 aa, Mycobacterium avium
TGSTPSQRY

SEQ ID NO: 57492 - protein, 12 aa, Mycobacterium avium
TGTAEDDPWSPD

SEQ ID NO: 57493 - protein, 5 aa, Mycobacterium avium
TGTAK

SEQ ID NO: 57494 - protein, 7 aa, Mycobacterium avium
TGTAPKS

SEQ ID NO: 57495 - protein, 6 aa, Mycobacterium avium
TGTDET

SEQ ID NO: 57496 - protein, 7 aa, Mycobacterium avium
TGTDRRG

SEQ ID NO: 57497 - protein, 6 aa, Mycobacterium avium
TGTGKT

SEQ ID NO: 57498 - protein, 7 aa, Mycobacterium avium
TGTGNSL

SEQ ID NO: 57499 - protein, 8 aa, Mycobacterium avium
TGTIPSKT

SEQ ID NO: 57500 - protein, 8 aa, Mycobacterium avium
TGTPAAAA

SEQ ID NO: 57501 - protein, 7 aa, Mycobacterium avium
TGTTSGR

SEQ ID NO: 57502 - protein, 4 aa, Mycobacterium avium
TGTV

SEQ ID NO: 57503 - protein, 7 aa, Mycobacterium avium
TGTVDPA

SEQ ID NO: 57504 - protein, 9 aa, Mycobacterium avium
TGVPRTRRE

SEQ ID NO: 57505 - protein, 17 aa, Mycobacterium avium
TGWDPDAAGRLTDNADA

SEQ ID NO: 57506 - protein, 16 aa, Mycobacterium avium
TGYADERDPAARTARI

SEQ ID NO: 57507 - protein, 30 aa, Mycobacterium avium
TGYAKRTKTDLYRSQKRGGKGVQGAGLKQD

SEQ ID NO: 57508 - protein, 8 aa, Mycobacterium avium
TGYERDAR

SEQ ID NO: 57509 - protein, 13 aa, Mycobacterium avium
TGYGSAANRAGVC

SEQ ID NO: 57510 - protein, 4 aa, Mycobacterium avium
TGYP

SEQ ID NO: 57511 - protein, 10 aa, Mycobacterium avium
TGYPGGADAF

SEQ ID NO: 57512 - protein, 7 aa, Mycobacterium avium
THDVNST

SEQ ID NO: 57513 - protein, 10 aa, Mycobacterium avium
THEDGERIRR

SEQ ID NO: 57514 - protein, 8 aa, Mycobacterium avium
THEHQHGG

SEQ ID NO: 57515 - protein, 4 aa, Mycobacterium avium
THGA

SEQ ID NO: 57516 - protein, 17 aa, Mycobacterium avium
THGRPTDRNAHPHRDAA

SEQ ID NO: 57517 - protein, 15 aa, Mycobacterium avium
THGSPSSRDQYSGLD

SEQ ID NO: 57518 - protein, 8 aa, Mycobacterium avium
THGYDTTD

SEQ ID NO: 57519 - protein, 4 aa, Mycobacterium avium
THPG

SEQ ID NO: 57520 - protein, 14 aa, Mycobacterium avium
THPNYPERHEPGHP

SEQ ID NO: 57521 - protein, 19 aa, Mycobacterium avium
THPPRTTTAHGRAAQAAAV

SEQ ID NO: 57522 - protein, 33 aa, Mycobacterium avium
THQVSTTAIDGAGHSENPGATPGLVGRSTGPDI

SEQ ID NO: 57523 - protein, 5 aa, Mycobacterium avium
THREE

SEQ ID NO: 57524 - protein, 9 aa, Mycobacterium avium
THRSGTTTY

SEQ ID NO: 57525 - protein, 16 aa, Mycobacterium avium
THTAAPVSEAVAAGSP

SEQ ID NO: 57526 - protein, 12 aa, Mycobacterium avium
TIADDGLTREGP

SEQ ID NO: 57527 - protein, 11 aa, Mycobacterium avium
TIAEGNVDRAR

SEQ ID NO: 57528 - protein, 5 aa, Mycobacterium avium
TIDPG

SEQ ID NO: 57529 - protein, 9 aa, Mycobacterium avium
TIEDPYADE

SEQ ID NO: 57530 - protein, 9 aa, Mycobacterium avium
TIGRDGQPH

SEQ ID NO: 57531 - protein, 6 aa, Mycobacterium avium
TIIGDG

SEQ ID NO: 57532 - protein, 8 aa, Mycobacterium avium
TINDTRSR

SEQ ID NO: 57533 - protein, 10 aa, Mycobacterium avium
TITGQAPART

SEQ ID NO: 57534 - protein, 8 aa, Mycobacterium avium
TKAGARFS

SEQ ID NO: 57535 - protein, 7 aa, Mycobacterium avium
TKAKTQL

SEQ ID NO: 57536 - protein, 7 aa, Mycobacterium avium
TKDDLKP

SEQ ID NO: 57537 - protein, 9 aa, Mycobacterium avium
TKHPGTGGL

SEQ ID NO: 57538 - protein, 10 aa, Mycobacterium avium
TKMTPAPTKP

SEQ ID NO: 57539 - protein, 7 aa, Mycobacterium avium
TKPADSV

SEQ ID NO: 57540 - protein, 22 aa, Mycobacterium avium
TKPCCAPSGPADPSVNQTLKGG

SEQ ID NO: 57541 - protein, 10 aa, Mycobacterium avium
TKRDGGRLSD

SEQ ID NO: 57542 - protein, 10 aa, Mycobacterium avium
TKSDQTPWYE

SEQ ID NO: 57543 - protein, 7 aa, Mycobacterium avium
TKTRDEA

SEQ ID NO: 57544 - protein, 17 aa, Mycobacterium avium
TKTTSRGVETIGGAKRG

SEQ ID NO: 57545 - protein, 18 aa, Mycobacterium avium
TKVGEEIAKETLSVAGGT

SEQ ID NO: 57546 - protein, 22 aa, Mycobacterium avium
TLAGNESGDGARIPMLPESWDG

SEQ ID NO: 57547 - protein, 10 aa, Mycobacterium avium
TLAQASPPDM

SEQ ID NO: 57548 - protein, 9 aa, Mycobacterium avium
TLDDGAGHL

SEQ ID NO: 57549 - protein, 5 aa, Mycobacterium avium
TLDGA

SEQ ID NO: 57550 - protein, 16 aa, Mycobacterium avium
TLDPDPKYQGSLRQTR

SEQ ID NO: 57551 - protein, 6 aa, Mycobacterium avium
TLGGPV

SEQ ID NO: 57552 - protein, 5 aa, Mycobacterium avium
TLGPA

SEQ ID NO: 57553 - protein, 8 aa, Mycobacterium avium
TLGPKGRN

SEQ ID NO: 57554 - protein, 6 aa, Mycobacterium avium
TLGPNT

SEQ ID NO: 57555 - protein, 4 aa, Mycobacterium avium
TLKK

SEQ ID NO: 57556 - protein, 18 aa, Mycobacterium avium
TLKKTQPSSVQHKGDRDL

SEQ ID NO: 57557 - protein, 6 aa, Mycobacterium avium
TLNPGQ

SEQ ID NO: 57558 - protein, 6 aa, Mycobacterium avium
TLPDGS

SEQ ID NO: 57559 - protein, 7 aa, Mycobacterium avium
TLPDPHG

SEQ ID NO: 57560 - protein, 9 aa, Mycobacterium avium
TLPGEDVTD

SEQ ID NO: 57561 - protein, 17 aa, Mycobacterium avium
TLPGERPVELPVEREDP

SEQ ID NO: 57562 - protein, 6 aa, Mycobacterium avium
TLRPPQ

SEQ ID NO: 57563 - protein, 16 aa, Mycobacterium avium
TLRSTATVELTARTFG

SEQ ID NO: 57564 - protein, 4 aa, Mycobacterium avium
TLSA

SEQ ID NO: 57565 - protein, 16 aa, Mycobacterium avium
TLTPGRNGVRADPNGL

SEQ ID NO: 57566 - protein, 7 aa, Mycobacterium avium
TLVGPSG

SEQ ID NO: 57567 - protein, 6 aa, Mycobacterium avium
TLYDAG

SEQ ID NO: 57568 - protein, 4 aa, Mycobacterium avium
TMGN

SEQ ID NO: 57569 - protein, 14 aa, Mycobacterium avium
TMSTTEADGVAGGV

SEQ ID NO: 57570 - protein, 13 aa, Mycobacterium avium
TNADSASPGVSDA

SEQ ID NO: 57571 - protein, 9 aa, Mycobacterium avium
TNARPAGVR

SEQ ID NO: 57572 - protein, 4 aa, Mycobacterium avium
TNGD

SEQ ID NO: 57573 - protein, 5 aa, Mycobacterium avium
TNGDR

SEQ ID NO: 57574 - protein, 19 aa, Mycobacterium avium
TNGRGTEQLSHSFGLIDIL

SEQ ID NO: 57575 - protein, 5 aa, Mycobacterium avium
TNGTV

SEQ ID NO: 57576 - protein, 8 aa, Mycobacterium avium
TNHDPRRN

SEQ ID NO: 57577 - protein, 5 aa, Mycobacterium avium
TNKGD

SEQ ID NO: 57578 - protein, 10 aa, Mycobacterium avium
TNMDEQNATE

SEQ ID NO: 57579 - protein, 4 aa, Mycobacterium avium
TNPH

SEQ ID NO: 57580 - protein, 6 aa, Mycobacterium avium
TNPKGE

SEQ ID NO: 57581 - protein, 11 aa, Mycobacterium avium
TNPTGPAEPDR

SEQ ID NO: 57582 - protein, 12 aa, Mycobacterium avium
TNRHHGKPEAID

SEQ ID NO: 57583 - protein, 14 aa, Mycobacterium avium
TNSPLQDGEHANGV

SEQ ID NO: 57584 - protein, 12 aa, Mycobacterium avium
TNTAAPDPRIDR

SEQ ID NO: 57585 - protein, 16 aa, Mycobacterium avium
TNTPEFGAKGVTEPDY

SEQ ID NO: 57586 - protein, 7 aa, Mycobacterium avium
TNVPAGP

SEQ ID NO: 57587 - protein, 5 aa, Mycobacterium avium
TPAEA

SEQ ID NO: 57588 - protein, 9 aa, Mycobacterium avium
TPANPADLP

SEQ ID NO: 57589 - protein, 4 aa, Mycobacterium avium
TPAR

SEQ ID NO: 57590 - protein, 15 aa, Mycobacterium avium
TPARSQGGTRRYSAD

SEQ ID NO: 57591 - protein, 13 aa, Mycobacterium avium
TPASTLPRSQRVS

SEQ ID NO: 57592 - protein, 8 aa, Mycobacterium avium
TPDATERP

SEQ ID NO: 57593 - protein, 7 aa, Mycobacterium avium
TPDEYSR

SEQ ID NO: 57594 - protein, 9 aa, Mycobacterium avium
TPDRIPKQR

SEQ ID NO: 57595 - protein, 11 aa, Mycobacterium avium
TPEDRRATQRD

SEQ ID NO: 57596 - protein, 6 aa, Mycobacterium avium
TPEEGL

SEQ ID NO: 57597 - protein, 4 aa, Mycobacterium avium
TPEG

SEQ ID NO: 57598 - protein, 9 aa, Mycobacterium avium
TPEGDDISA

SEQ ID NO: 57599 - protein, 13 aa, Mycobacterium avium
TPEGPVGSDAVKG

SEQ ID NO: 57600 - protein, 5 aa, Mycobacterium avium
TPELT

SEQ ID NO: 57601 - protein, 7 aa, Mycobacterium avium
TPEPQTV

SEQ ID NO: 57602 - protein, 4 aa, Mycobacterium avium
TPER

SEQ ID NO: 57603 - protein, 5 aa, Mycobacterium avium
TPERF

SEQ ID NO: 57604 - protein, 4 aa, Mycobacterium avium
TPFS

SEQ ID NO: 57605 - protein, 13 aa, Mycobacterium avium
TPGAEPRARGDYG

SEQ ID NO: 57606 - protein, 9 aa, Mycobacterium avium
TPGARSEQA

SEQ ID NO: 57607 - protein, 8 aa, Mycobacterium avium
TPGASPDV

SEQ ID NO: 57608 - protein, 7 aa, Mycobacterium avium
TPGATQT

SEQ ID NO: 57609 - protein, 5 aa, Mycobacterium avium
TPGKP

SEQ ID NO: 57610 - protein, 11 aa, Mycobacterium avium
TPHDREGEPEK

SEQ ID NO: 57611 - protein, 5 aa, Mycobacterium avium
TPHEE

SEQ ID NO: 57612 - protein, 21 aa, Mycobacterium avium
TPHSMKSQDSGRGKPARAARS

SEQ ID NO: 57613 - protein, 6 aa, Mycobacterium avium
TPIERA

SEQ ID NO: 57614 - protein, 8 aa, Mycobacterium avium
TPIPGEDD

SEQ ID NO: 57615 - protein, 12 aa, Mycobacterium avium
TPKHGGRIVVHR

SEQ ID NO: 57616 - protein, 9 aa, Mycobacterium avium
TPLENPPPY

SEQ ID NO: 57617 - protein, 6 aa, Mycobacterium avium
TPLPGN

SEQ ID NO: 57618 - protein, 17 aa, Mycobacterium avium
TPLQPGTGSAPIGSPVP

SEQ ID NO: 57619 - protein, 11 aa, Mycobacterium avium
TPLQSAPAGEF

SEQ ID NO: 57620 - protein, 9 aa, Mycobacterium avium
TPLSGGASG

SEQ ID NO: 57621 - protein, 8 aa, Mycobacterium avium
TPLTAGDP

SEQ ID NO: 57622 - protein, 4 aa, Mycobacterium avium
TPNA

SEQ ID NO: 57623 - protein, 10 aa, Mycobacterium avium
TPNGAQTSRL

SEQ ID NO: 57624 - protein, 12 aa, Mycobacterium avium
TPNRSADAAREA

SEQ ID NO: 57625 - protein, 6 aa, Mycobacterium avium
TPPAEL

SEQ ID NO: 57626 - protein, 7 aa, Mycobacterium avium
TPPAELV

SEQ ID NO: 57627 - protein, 13 aa, Mycobacterium avium
TPPDPLPPGRPGD

SEQ ID NO: 57628 - protein, 9 aa, Mycobacterium avium
TPPDSPEAA

SEQ ID NO: 57629 - protein, 13 aa, Mycobacterium avium
TPPHPIPQSPAQR

SEQ ID NO: 57630 - protein, 6 aa, Mycobacterium avium
TPPHST

SEQ ID NO: 57631 - protein, 6 aa, Mycobacterium avium
TPPPGL

SEQ ID NO: 57632 - protein, 6 aa, Mycobacterium avium
TPPSRA

SEQ ID NO: 57633 - protein, 7 aa, Mycobacterium avium
TPPTTVP

SEQ ID NO: 57634 - protein, 4 aa, Mycobacterium avium
TPPV

SEQ ID NO: 57635 - protein, 4 aa, Mycobacterium avium
TPQD

SEQ ID NO: 57636 - protein, 9 aa, Mycobacterium avium
TPQPAMPGQ

SEQ ID NO: 57637 - protein, 8 aa, Mycobacterium avium
TPQSDGAA

SEQ ID NO: 57638 - protein, 4 aa, Mycobacterium avium
TPQV

SEQ ID NO: 57639 - protein, 4 aa, Mycobacterium avium
TPRA

SEQ ID NO: 57640 - protein, 6 aa, Mycobacterium avium
TPRAGH

SEQ ID NO: 57641 - protein, 4 aa, Mycobacterium avium
TPRD

SEQ ID NO: 57642 - protein, 14 aa, Mycobacterium avium
TPRETLNDPQVEPN

SEQ ID NO: 57643 - protein, 12 aa, Mycobacterium avium
TPRGKGRASGAL

SEQ ID NO: 57644 - protein, 10 aa, Mycobacterium avium
TPRPRLAPTQ

SEQ ID NO: 57645 - protein, 7 aa, Mycobacterium avium
TPRRPGP

SEQ ID NO: 57646 - protein, 6 aa, Mycobacterium avium
TPRSRV

SEQ ID NO: 57647 - protein, 9 aa, Mycobacterium avium
TPSPPVPTM

SEQ ID NO: 57648 - protein, 7 aa, Mycobacterium avium
TPSRTDR

SEQ ID NO: 57649 - protein, 16 aa, Mycobacterium avium
TPSTVDARNNTPTDPE

SEQ ID NO: 57650 - protein, 8 aa, Mycobacterium avium
TPTADAAD

SEQ ID NO: 57651 - protein, 5 aa, Mycobacterium avium
TPTTV

SEQ ID NO: 57652 - protein, 7 aa, Mycobacterium avium
TPVAGGY

SEQ ID NO: 57653 - protein, 5 aa, Mycobacterium avium
TPVGY

SEQ ID NO: 57654 - protein, 11 aa, Mycobacterium avium
TPVPPKAAQNE

SEQ ID NO: 57655 - protein, 7 aa, Mycobacterium avium
TPYPPGI

SEQ ID NO: 57656 - protein, 8 aa, Mycobacterium avium
TQADVDAG

SEQ ID NO: 57657 - protein, 6 aa, Mycobacterium avium
TQCGGR

SEQ ID NO: 57658 - protein, 6 aa, Mycobacterium avium
TQDEDA

SEQ ID NO: 57659 - protein, 16 aa, Mycobacterium avium
TQGAPAGDADTVAAAR

SEQ ID NO: 57660 - protein, 5 aa, Mycobacterium avium
TQIAE

SEQ ID NO: 57661 - protein, 7 aa, Mycobacterium avium
TQIPTGD

SEQ ID NO: 57662 - protein, 18 aa, Mycobacterium avium
TQKAYDDGVISSDPDANV

SEQ ID NO: 57663 - protein, 4 aa, Mycobacterium avium
TQLS

SEQ ID NO: 57664 - protein, 8 aa, Mycobacterium avium
TQNGTGPT

SEQ ID NO: 57665 - protein, 12 aa, Mycobacterium avium
TQPHPGEPANSP

SEQ ID NO: 57666 - protein, 6 aa, Mycobacterium avium
TQPQAD

SEQ ID NO: 57667 - protein, 13 aa, Mycobacterium avium
TQSGGQESSAESV

SEQ ID NO: 57668 - protein, 7 aa, Mycobacterium avium
TQSGVRR

SEQ ID NO: 57669 - protein, 13 aa, Mycobacterium avium
TQTADGRFALAGE

SEQ ID NO: 57670 - protein, 8 aa, Mycobacterium avium
TQTGSAVP

SEQ ID NO: 57671 - protein, 11 aa, Mycobacterium avium
TQTHPDIPEQM

SEQ ID NO: 57672 - protein, 6 aa, Mycobacterium avium
TQTKEQ

SEQ ID NO: 57673 - protein, 7 aa, Mycobacterium avium
TQTPSAV

SEQ ID NO: 57674 - protein, 5 aa, Mycobacterium avium
TQWPS

SEQ ID NO: 57675 - protein, 11 aa, Mycobacterium avium
TRAATAYGEQV

SEQ ID NO: 57676 - protein, 17 aa, Mycobacterium avium
TRAGRLAPGAGPRPLLP

SEQ ID NO: 57677 - protein, 14 aa, Mycobacterium avium
TRAGTATALPGTIG

SEQ ID NO: 57678 - protein, 8 aa, Mycobacterium avium
TRASQTAA

SEQ ID NO: 57679 - protein, 5 aa, Mycobacterium avium
TRDAA

SEQ ID NO: 57680 - protein, 12 aa, Mycobacterium avium
TRDALTRRGYRD

SEQ ID NO: 57681 - protein, 5 aa, Mycobacterium avium
TRDAN

SEQ ID NO: 57682 - protein, 11 aa, Mycobacterium avium
TRDEPHADAEK

SEQ ID NO: 57683 - protein, 6 aa, Mycobacterium avium
TRDGAV

SEQ ID NO: 57684 - protein, 8 aa, Mycobacterium avium
TRDGQDRD

SEQ ID NO: 57685 - protein, 13 aa, Mycobacterium avium
TRDRRNDAQDEHG

SEQ ID NO: 57686 - protein, 59 aa, Mycobacterium avium
TRDSYSSSLRKAQTNLANDGYDPTSTFGADGHEAETPDQARQDVTDALAGDKGAASRVN

SEQ ID NO: 57687 - protein, 4 aa, Mycobacterium avium
TRDT

SEQ ID NO: 57688 - protein, 4 aa, Mycobacterium avium
TREL

SEQ ID NO: 57689 - protein, 6 aa, Mycobacterium avium
TREPDA

SEQ ID NO: 57690 - protein, 6 aa, Mycobacterium avium
TRERQG

SEQ ID NO: 57691 - protein, 5 aa, Mycobacterium avium
TRFNA

SEQ ID NO: 57692 - protein, 12 aa, Mycobacterium avium
TRGAEVAATTDY

SEQ ID NO: 57693 - protein, 5 aa, Mycobacterium avium
TRKGG

SEQ ID NO: 57694 - protein, 4 aa, Mycobacterium avium
TRKR

SEQ ID NO: 57695 - protein, 8 aa, Mycobacterium avium
TRKSASDP

SEQ ID NO: 57696 - protein, 22 aa, Mycobacterium avium
TRLAPGDKAPAFSLPDADGKTV

SEQ ID NO: 57697 - protein, 8 aa, Mycobacterium avium
TRLGEPRD

SEQ ID NO: 57698 - protein, 5 aa, Mycobacterium avium
TRLPE

SEQ ID NO: 57699 - protein, 9 aa, Mycobacterium avium
TRNEKGKFT

SEQ ID NO: 57700 - protein, 4 aa, Mycobacterium avium
TRNP

SEQ ID NO: 57701 - protein, 8 aa, Mycobacterium avium
TRNVPHTG

SEQ ID NO: 57702 - protein, 4 aa, Mycobacterium avium
TRPD

SEQ ID NO: 57703 - protein, 4 aa, Mycobacterium avium
TRPY

SEQ ID NO: 57704 - protein, 4 aa, Mycobacterium avium
TRQL

SEQ ID NO: 57705 - protein, 12 aa, Mycobacterium avium
TRRFSATDRDSL

SEQ ID NO: 57706 - protein, 5 aa, Mycobacterium avium
TRRNT

SEQ ID NO: 57707 - protein, 6 aa, Mycobacterium avium
TRRPTE

SEQ ID NO: 57708 - protein, 12 aa, Mycobacterium avium
TRRRDPGVSEAE

SEQ ID NO: 57709 - protein, 10 aa, Mycobacterium avium
TRRSGPAGFP

SEQ ID NO: 57710 - protein, 12 aa, Mycobacterium avium
TRRYPGADRPAL

SEQ ID NO: 57711 - protein, 8 aa, Mycobacterium avium
TRSGNRQL

SEQ ID NO: 57712 - protein, 15 aa, Mycobacterium avium
TRSPNRHRAFGGGPH

SEQ ID NO: 57713 - protein, 6 aa, Mycobacterium avium
TRSTRD

SEQ ID NO: 57714 - protein, 4 aa, Mycobacterium avium
TRTA

SEQ ID NO: 57715 - protein, 18 aa, Mycobacterium avium
TRTGDGYGGLPQAVTPRK

SEQ ID NO: 57716 - protein, 14 aa, Mycobacterium avium
TRTPELAAALGAPA

SEQ ID NO: 57717 - protein, 9 aa, Mycobacterium avium
TRTPGPAVS

SEQ ID NO: 57718 - protein, 8 aa, Mycobacterium avium
TRYGGGEV

SEQ ID NO: 57719 - protein, 12 aa, Mycobacterium avium
TRYPADGVSPEA

SEQ ID NO: 57720 - protein, 17 aa, Mycobacterium avium
TSAAESATGDAFPENGR

SEQ ID NO: 57721 - protein, 6 aa, Mycobacterium avium
TSAARE

SEQ ID NO: 57722 - protein, 11 aa, Mycobacterium avium
TSAGEPAGIGG

SEQ ID NO: 57723 - protein, 17 aa, Mycobacterium avium
TSAGSYAGTEAANAAAA

SEQ ID NO: 57724 - protein, 6 aa, Mycobacterium avium
TSAKPI

SEQ ID NO: 57725 - protein, 19 aa, Mycobacterium avium
TSAQARTAAEQATAAASAF

SEQ ID NO: 57726 - protein, 5 aa, Mycobacterium avium
TSAQK

SEQ ID NO: 57727 - protein, 5 aa, Mycobacterium avium
TSATA

SEQ ID NO: 57728 - protein, 6 aa, Mycobacterium avium
TSCAAS

SEQ ID NO: 57729 - protein, 20 aa, Mycobacterium avium
TSDEGKEDLKSLGGVSATTA

SEQ ID NO: 57730 - protein, 5 aa, Mycobacterium avium
TSDVD

SEQ ID NO: 57731 - protein, 26 aa, Mycobacterium avium
TSDVTGSDAAGRTEQSISARPADAGA

SEQ ID NO: 57732 - protein, 7 aa, Mycobacterium avium
TSEDHAG

SEQ ID NO: 57733 - protein, 15 aa, Mycobacterium avium
TSEQPTAAAAPGEAE

SEQ ID NO: 57734 - protein, 6 aa, Mycobacterium avium
TSFSPG

SEQ ID NO: 57735 - protein, 6 aa, Mycobacterium avium
TSGANG

SEQ ID NO: 57736 - protein, 6 aa, Mycobacterium avium
TSGEGI

SEQ ID NO: 57737 - protein, 9 aa, Mycobacterium avium
TSGEPGTAV

SEQ ID NO: 57738 - protein, 5 aa, Mycobacterium avium
TSGGV

SEQ ID NO: 57739 - protein, 6 aa, Mycobacterium avium
TSGHEA

SEQ ID NO: 57740 - protein, 8 aa, Mycobacterium avium
TSGPGATN

SEQ ID NO: 57741 - protein, 10 aa, Mycobacterium avium
TSGSDTGPTS

SEQ ID NO: 57742 - protein, 11 aa, Mycobacterium avium
TSGSEAQKDAF

SEQ ID NO: 57743 - protein, 10 aa, Mycobacterium avium
TSGSTRQPAG

SEQ ID NO: 57744 - protein, 4 aa, Mycobacterium avium
TSIG

SEQ ID NO: 57745 - protein, 12 aa, Mycobacterium avium
TSIGERGYRAST

SEQ ID NO: 57746 - protein, 10 aa, Mycobacterium avium
TSIRPAPAGA

SEQ ID NO: 57747 - protein, 8 aa, Mycobacterium avium
TSITPKRD

SEQ ID NO: 57748 - protein, 7 aa, Mycobacterium avium
TSKLDDE

SEQ ID NO: 57749 - protein, 5 aa, Mycobacterium avium
TSKRT

SEQ ID NO: 57750 - protein, 12 aa, Mycobacterium avium
TSLSGEGTGKVA

SEQ ID NO: 57751 - protein, 18 aa, Mycobacterium avium
TSLTEDEIGEYSGERKEI

SEQ ID NO: 57752 - protein, 7 aa, Mycobacterium avium
TSMSDEE

SEQ ID NO: 57753 - protein, 6 aa, Mycobacterium avium
TSNAIQ

SEQ ID NO: 57754 - protein, 9 aa, Mycobacterium avium
TSNPEGATV

SEQ ID NO: 57755 - protein, 7 aa, Mycobacterium avium
TSPPTDG

SEQ ID NO: 57756 - protein, 6 aa, Mycobacterium avium
TSPRLT

SEQ ID NO: 57757 - protein, 5 aa, Mycobacterium avium
TSQGV

SEQ ID NO: 57758 - protein, 6 aa, Mycobacterium avium
TSRAES

SEQ ID NO: 57759 - protein, 13 aa, Mycobacterium avium
TSRNGAGPAPDSD

SEQ ID NO: 57760 - protein, 5 aa, Mycobacterium avium
TSRPE

SEQ ID NO: 57761 - protein, 20 aa, Mycobacterium avium
TSRPGPRHAPERKRRNTMTA

SEQ ID NO: 57762 - protein, 7 aa, Mycobacterium avium
TSRTPVR

SEQ ID NO: 57763 - protein, 9 aa, Mycobacterium avium
TSSLPPLPA

SEQ ID NO: 57764 - protein, 9 aa, Mycobacterium avium
TSSRAPLGR

SEQ ID NO: 57765 - protein, 9 aa, Mycobacterium avium
TSSSSATYG

SEQ ID NO: 57766 - protein, 10 aa, Mycobacterium avium
TSSVDTAVGE

SEQ ID NO: 57767 - protein, 7 aa, Mycobacterium avium
TSSVHHT

SEQ ID NO: 57768 - protein, 4 aa, Mycobacterium avium
TSSY

SEQ ID NO: 57769 - protein, 4 aa, Mycobacterium avium
TSTA

SEQ ID NO: 57770 - protein, 12 aa, Mycobacterium avium
TSTAPPGGESFD

SEQ ID NO: 57771 - protein, 8 aa, Mycobacterium avium
TSTTPARA

SEQ ID NO: 57772 - protein, 4 aa, Mycobacterium avium
TSVG

SEQ ID NO: 57773 - protein, 7 aa, Mycobacterium avium
TSVGATA

SEQ ID NO: 57774 - protein, 6 aa, Mycobacterium avium
TSYPKR

SEQ ID NO: 57775 - protein, 6 aa, Mycobacterium avium
TTAAQH

SEQ ID NO: 57776 - protein, 5 aa, Mycobacterium avium
TTADA

SEQ ID NO: 57777 - protein, 11 aa, Mycobacterium avium
TTALPDPDSDG

SEQ ID NO: 57778 - protein, 7 aa, Mycobacterium avium
TTATRQG

SEQ ID NO: 57779 - protein, 11 aa, Mycobacterium avium
TTAVRTPSGYR

SEQ ID NO: 57780 - protein, 10 aa, Mycobacterium avium
TTDARAAARG

SEQ ID NO: 57781 - protein, 4 aa, Mycobacterium avium
TTEA

SEQ ID NO: 57782 - protein, 7 aa, Mycobacterium avium
TTEDTEL

SEQ ID NO: 57783 - protein, 7 aa, Mycobacterium avium
TTEEQKE

SEQ ID NO: 57784 - protein, 4 aa, Mycobacterium avium
TTEL

SEQ ID NO: 57785 - protein, 6 aa, Mycobacterium avium
TTERDT

SEQ ID NO: 57786 - protein, 4 aa, Mycobacterium avium
TTES

SEQ ID NO: 57787 - protein, 5 aa, Mycobacterium avium
TTETG

SEQ ID NO: 57788 - protein, 7 aa, Mycobacterium avium
TTFSGQR

SEQ ID NO: 57789 - protein, 16 aa, Mycobacterium avium
TTGAGPAGDIAAQARD

SEQ ID NO: 57790 - protein, 6 aa, Mycobacterium avium
TTGFPK

SEQ ID NO: 57791 - protein, 15 aa, Mycobacterium avium
TTGGDDGESETAATD

SEQ ID NO: 57792 - protein, 17 aa, Mycobacterium avium
TTGGRSTSTGETAPDAI

SEQ ID NO: 57793 - protein, 5 aa, Mycobacterium avium
TTGPA

SEQ ID NO: 57794 - protein, 5 aa, Mycobacterium avium
TTGPL

SEQ ID NO: 57795 - protein, 4 aa, Mycobacterium avium
TTHE

SEQ ID NO: 57796 - protein, 13 aa, Mycobacterium avium
TTIGAGTAEIQRN

SEQ ID NO: 57797 - protein, 5 aa, Mycobacterium avium
TTIPG

SEQ ID NO: 57798 - protein, 5 aa, Mycobacterium avium
TTKER

SEQ ID NO: 57799 - protein, 8 aa, Mycobacterium avium
TTKPPGGL

SEQ ID NO: 57800 - protein, 15 aa, Mycobacterium avium
TTLPTSLGSAVNGYS

SEQ ID NO: 57801 - protein, 7 aa, Mycobacterium avium
TTLTGGQ

SEQ ID NO: 57802 - protein, 5 aa, Mycobacterium avium
TTNGR

SEQ ID NO: 57803 - protein, 8 aa, Mycobacterium avium
TTPGKPAL

SEQ ID NO: 57804 - protein, 6 aa, Mycobacterium avium
TTPGRL

SEQ ID NO: 57805 - protein, 10 aa, Mycobacterium avium
TTPHPSAPDW

SEQ ID NO: 57806 - protein, 9 aa, Mycobacterium avium
TTPRAAPPG

SEQ ID NO: 57807 - protein, 7 aa, Mycobacterium avium
TTQAGGV

SEQ ID NO: 57808 - protein, 7 aa, Mycobacterium avium
TTRRGEA

SEQ ID NO: 57809 - protein, 11 aa, Mycobacterium avium
TTRSGALTGPL

SEQ ID NO: 57810 - protein, 14 aa, Mycobacterium avium
TTSANGTASADIAG

SEQ ID NO: 57811 - protein, 6 aa, Mycobacterium avium
TTSGAG

SEQ ID NO: 57812 - protein, 4 aa, Mycobacterium avium
TTSL

SEQ ID NO: 57813 - protein, 5 aa, Mycobacterium avium
TTTDD

SEQ ID NO: 57814 - protein, 5 aa, Mycobacterium avium
TTTDL

SEQ ID NO: 57815 - protein, 6 aa, Mycobacterium avium
TTTPLP

SEQ ID NO: 57816 - protein, 7 aa, Mycobacterium avium
TTTTADL

SEQ ID NO: 57817 - protein, 6 aa, Mycobacterium avium
TTTTTY

SEQ ID NO: 57818 - protein, 15 aa, Mycobacterium avium
TTVSQSSLHKGRRAG

SEQ ID NO: 57819 - protein, 4 aa, Mycobacterium avium
TTYG

SEQ ID NO: 57820 - protein, 19 aa, Mycobacterium avium
TVAPAKATQKYAAQAPRGE

SEQ ID NO: 57821 - protein, 4 aa, Mycobacterium avium
TVAQ

SEQ ID NO: 57822 - protein, 10 aa, Mycobacterium avium
TVELGGDKGL

SEQ ID NO: 57823 - protein, 13 aa, Mycobacterium avium
TVERGGLSADDVA

SEQ ID NO: 57824 - protein, 29 aa, Mycobacterium avium
TVGNGTTGAATAAAADGAATTATIIVVPA

SEQ ID NO: 57825 - protein, 6 aa, Mycobacterium avium
TVHPND

SEQ ID NO: 57826 - protein, 11 aa, Mycobacterium avium
TVKPDTRFAPQ

SEQ ID NO: 57827 - protein, 15 aa, Mycobacterium avium
TVKSAAEKAGRDPDS

SEQ ID NO: 57828 - protein, 7 aa, Mycobacterium avium
TVPDPAQ

SEQ ID NO: 57829 - protein, 4 aa, Mycobacterium avium
TVPP

SEQ ID NO: 57830 - protein, 7 aa, Mycobacterium avium
TVPPPVV

SEQ ID NO: 57831 - protein, 7 aa, Mycobacterium avium
TVPRGGV

SEQ ID NO: 57832 - protein, 7 aa, Mycobacterium avium
TVPSPAR

SEQ ID NO: 57833 - protein, 4 aa, Mycobacterium avium
TVRA

SEQ ID NO: 57834 - protein, 5 aa, Mycobacterium avium
TVRDE

SEQ ID NO: 57835 - protein, 7 aa, Mycobacterium avium
TVRPPEE

SEQ ID NO: 57836 - protein, 5 aa, Mycobacterium avium
TVSAR

SEQ ID NO: 57837 - protein, 15 aa, Mycobacterium avium
TVSGDGRDDGSGDGL

SEQ ID NO: 57838 - protein, 7 aa, Mycobacterium avium
TVSNAEE

SEQ ID NO: 57839 - protein, 9 aa, Mycobacterium avium
TVSPGGQPH

SEQ ID NO: 57840 - protein, 5 aa, Mycobacterium avium
TVSPQ

SEQ ID NO: 57841 - protein, 11 aa, Mycobacterium avium
TVTGTGPDAQR

SEQ ID NO: 57842 - protein, 12 aa, Mycobacterium avium
TVTSPGGTTAAG

SEQ ID NO: 57843 - protein, 10 aa, Mycobacterium avium
TVTSSQLSGT

SEQ ID NO: 57844 - protein, 11 aa, Mycobacterium avium
TVTTEREPLPG

SEQ ID NO: 57845 - protein, 26 aa, Mycobacterium avium
TVYNGSGIGNMGGVDATEDPWHGRPA

SEQ ID NO: 57846 - protein, 9 aa, Mycobacterium avium
TWNESSGAV

SEQ ID NO: 57847 - protein, 13 aa, Mycobacterium avium
TYAPASPEDLDET

SEQ ID NO: 57848 - protein, 7 aa, Mycobacterium avium
TYAPGRE

SEQ ID NO: 57849 - protein, 8 aa, Mycobacterium avium
TYDDGAAM

SEQ ID NO: 57850 - protein, 6 aa, Mycobacterium avium
TYGPDR

SEQ ID NO: 57851 - protein, 7 aa, Mycobacterium avium
TYKPYGP

SEQ ID NO: 57852 - protein, 5 aa, Mycobacterium avium
TYPAE

SEQ ID NO: 57853 - protein, 9 aa, Mycobacterium avium
TYPPGTAAK

SEQ ID NO: 57854 - protein, 6 aa, Mycobacterium avium
TYRPTV

SEQ ID NO: 57855 - protein, 18 aa, Mycobacterium avium
VAAARDAARMAERGGQRA

SEQ ID NO: 57856 - protein, 11 aa, Mycobacterium avium
VAAASAPIKAD

SEQ ID NO: 57857 - protein, 5 aa, Mycobacterium avium
VAAAT

SEQ ID NO: 57858 - protein, 4 aa, Mycobacterium avium
VAAS

SEQ ID NO: 57859 - protein, 7 aa, Mycobacterium avium
VAASPDD

SEQ ID NO: 57860 - protein, 7 aa, Mycobacterium avium
VAASPDE

SEQ ID NO: 57861 - protein, 6 aa, Mycobacterium avium
VADEDA

SEQ ID NO: 57862 - protein, 8 aa, Mycobacterium avium
VADGPADV

SEQ ID NO: 57863 - protein, 10 aa, Mycobacterium avium
VADPGPRTTL

SEQ ID NO: 57864 - protein, 7 aa, Mycobacterium avium
VADPRDI

SEQ ID NO: 57865 - protein, 6 aa, Mycobacterium avium
VADPVK

SEQ ID NO: 57866 - protein, 6 aa, Mycobacterium avium
VADRTR

SEQ ID NO: 57867 - protein, 5 aa, Mycobacterium avium
VADSG

SEQ ID NO: 57868 - protein, 8 aa, Mycobacterium avium
VAEEHDGD

SEQ ID NO: 57869 - protein, 26 aa, Mycobacterium avium
VAEPGSDEPTLSGDRPARSAAPQIDE

SEQ ID NO: 57870 - protein, 4 aa, Mycobacterium avium
VAER

SEQ ID NO: 57871 - protein, 9 aa, Mycobacterium avium
VAGAAGTST

SEQ ID NO: 57872 - protein, 10 aa, Mycobacterium avium
VAGDTRANAV

SEQ ID NO: 57873 - protein, 23 aa, Mycobacterium avium
VAGEPDEESATKDSRTPAQRQHD

SEQ ID NO: 57874 - protein, 7 aa, Mycobacterium avium
VAGGAAG

SEQ ID NO: 57875 - protein, 6 aa, Mycobacterium avium
VAGGGP

SEQ ID NO: 57876 - protein, 14 aa, Mycobacterium avium
VAGPADLAAGRDAV

SEQ ID NO: 57877 - protein, 8 aa, Mycobacterium avium
VAGTPGAA

SEQ ID NO: 57878 - protein, 6 aa, Mycobacterium avium
VAGTPI

SEQ ID NO: 57879 - protein, 6 aa, Mycobacterium avium
VAGTTG

SEQ ID NO: 57880 - protein, 8 aa, Mycobacterium avium
VAHGRGRD

SEQ ID NO: 57881 - protein, 19 aa, Mycobacterium avium
VANPARVSDPDRLRGAVGG

SEQ ID NO: 57882 - protein, 6 aa, Mycobacterium avium
VAPAPT

SEQ ID NO: 57883 - protein, 13 aa, Mycobacterium avium
VAPNRRPYRTSDG

SEQ ID NO: 57884 - protein, 7 aa, Mycobacterium avium
VAPPREI

SEQ ID NO: 57885 - protein, 5 aa, Mycobacterium avium
VAPRD

SEQ ID NO: 57886 - protein, 9 aa, Mycobacterium avium
VAPSRDELA

SEQ ID NO: 57887 - protein, 11 aa, Mycobacterium avium
VARGGGRTSYR

SEQ ID NO: 57888 - protein, 17 aa, Mycobacterium avium
VARSATGSAANQSHASL

SEQ ID NO: 57889 - protein, 7 aa, Mycobacterium avium
VASGGNR

SEQ ID NO: 57890 - protein, 13 aa, Mycobacterium avium
VASSLGKGLTASS

SEQ ID NO: 57891 - protein, 7 aa, Mycobacterium avium
VASSPED

SEQ ID NO: 57892 - protein, 9 aa, Mycobacterium avium
VATGCGTAS

SEQ ID NO: 57893 - protein, 15 aa, Mycobacterium avium
VATGDDDVVDEGTGR

SEQ ID NO: 57894 - protein, 12 aa, Mycobacterium avium
VATGYARRAGLT

SEQ ID NO: 57895 - protein, 10 aa, Mycobacterium avium
VATQAGVSRP

SEQ ID NO: 57896 - protein, 8 aa, Mycobacterium avium
VAVTKGTD

SEQ ID NO: 57897 - protein, 6 aa, Mycobacterium avium
VDADGV

SEQ ID NO: 57898 - protein, 13 aa, Mycobacterium avium
VDAEPAAGAGEQV

SEQ ID NO: 57899 - protein, 7 aa, Mycobacterium avium
VDAGGQN

SEQ ID NO: 57900 - protein, 5 aa, Mycobacterium avium
VDAPS

SEQ ID NO: 57901 - protein, 6 aa, Mycobacterium avium
VDAPTV

SEQ ID NO: 57902 - protein, 9 aa, Mycobacterium avium
VDARPDSEA

SEQ ID NO: 57903 - protein, 5 aa, Mycobacterium avium
VDARR

SEQ ID NO: 57904 - protein, 8 aa, Mycobacterium avium
VDDAAKPQ

SEQ ID NO: 57905 - protein, 11 aa, Mycobacterium avium
VDDAPYGGGPG

SEQ ID NO: 57906 - protein, 7 aa, Mycobacterium avium
VDDDEAI

SEQ ID NO: 57907 - protein, 5 aa, Mycobacterium avium
VDDGT

SEQ ID NO: 57908 - protein, 11 aa, Mycobacterium avium
VDDPAEKSRAL

SEQ ID NO: 57909 - protein, 7 aa, Mycobacterium avium
VDDPEAG

SEQ ID NO: 57910 - protein, 11 aa, Mycobacterium avium
VDDPYRAAKAA

SEQ ID NO: 57911 - protein, 17 aa, Mycobacterium avium
VDDQSRARAALRDSRPI

SEQ ID NO: 57912 - protein, 10 aa, Mycobacterium avium
VDDSGTPITP

SEQ ID NO: 57913 - protein, 23 aa, Mycobacterium avium
VDDTDHAGDRAEHACQRGEAQSR

SEQ ID NO: 57914 - protein, 6 aa, Mycobacterium avium
VDETHT

SEQ ID NO: 57915 - protein, 8 aa, Mycobacterium avium
VDGAGAPI

SEQ ID NO: 57916 - protein, 5 aa, Mycobacterium avium
VDGPE

SEQ ID NO: 57917 - protein, 8 aa, Mycobacterium avium
VDGPGLRG

SEQ ID NO: 57918 - protein, 5 aa, Mycobacterium avium
VDGSD

SEQ ID NO: 57919 - protein, 15 aa, Mycobacterium avium
VDKPAAVAELIARFV

SEQ ID NO: 57920 - protein, 4 aa, Mycobacterium avium
VDPA

SEQ ID NO: 57921 - protein, 6 aa, Mycobacterium avium
VDPKAL

SEQ ID NO: 57922 - protein, 9 aa, Mycobacterium avium
VDPQPGEDD

SEQ ID NO: 57923 - protein, 6 aa, Mycobacterium avium
VDPRSA

SEQ ID NO: 57924 - protein, 5 aa, Mycobacterium avium
VDSAD

SEQ ID NO: 57925 - protein, 5 aa, Mycobacterium avium
VDSGH

SEQ ID NO: 57926 - protein, 5 aa, Mycobacterium avium
VDTGR

SEQ ID NO: 57927 - protein, 6 aa, Mycobacterium avium
VDTPAA

SEQ ID NO: 57928 - protein, 6 aa, Mycobacterium avium
VEADPG

SEQ ID NO: 57929 - protein, 12 aa, Mycobacterium avium
VEAQTSQTSEVG

SEQ ID NO: 57930 - protein, 9 aa, Mycobacterium avium
VEDAQRREL

SEQ ID NO: 57931 - protein, 6 aa, Mycobacterium avium
VEDPEW

SEQ ID NO: 57932 - protein, 11 aa, Mycobacterium avium
VEDPGSPGTQD

SEQ ID NO: 57933 - protein, 7 aa, Mycobacterium avium
VEDPVSG

SEQ ID NO: 57934 - protein, 7 aa, Mycobacterium avium
VEEGATA

SEQ ID NO: 57935 - protein, 11 aa, Mycobacterium avium
VEGGNKQLEQL

SEQ ID NO: 57936 - protein, 10 aa, Mycobacterium avium
VEPAHADAPA

SEQ ID NO: 57937 - protein, 6 aa, Mycobacterium avium
VEPDGS

SEQ ID NO: 57938 - protein, 10 aa, Mycobacterium avium
VEPGEPTPRF

SEQ ID NO: 57939 - protein, 50 aa, Mycobacterium avium
VEPNPARALQRRDQECDAVDEQKGTRRRQQRNDHDRPAGAGADVGRGDGV

SEQ ID NO: 57940 - protein, 9 aa, Mycobacterium avium
VEPNSTVAQ

SEQ ID NO: 57941 - protein, 10 aa, Mycobacterium avium
VEPPQGDNTR

SEQ ID NO: 57942 - protein, 10 aa, Mycobacterium avium
VEPPRSPAQM

SEQ ID NO: 57943 - protein, 4 aa, Mycobacterium avium
VEPR

SEQ ID NO: 57944 - protein, 8 aa, Mycobacterium avium
VEPRQPVD

SEQ ID NO: 57945 - protein, 13 aa, Mycobacterium avium
VEQAAATAARAGV

SEQ ID NO: 57946 - protein, 7 aa, Mycobacterium avium
VEQQPTA

SEQ ID NO: 57947 - protein, 7 aa, Mycobacterium avium
VEQSPTQ

SEQ ID NO: 57948 - protein, 11 aa, Mycobacterium avium
VEREARAAAGI

SEQ ID NO: 57949 - protein, 12 aa, Mycobacterium avium
VERGGAPAANSA

SEQ ID NO: 57950 - protein, 11 aa, Mycobacterium avium
VESAPADTFGP

SEQ ID NO: 57951 - protein, 7 aa, Mycobacterium avium
VESPADT

SEQ ID NO: 57952 - protein, 7 aa, Mycobacterium avium
VESPDGN

SEQ ID NO: 57953 - protein, 9 aa, Mycobacterium avium
VESPQGDSM

SEQ ID NO: 57954 - protein, 5 aa, Mycobacterium avium
VESQD

SEQ ID NO: 57955 - protein, 11 aa, Mycobacterium avium
VETAGRRGTRV

SEQ ID NO: 57956 - protein, 5 aa, Mycobacterium avium
VETGR

SEQ ID NO: 57957 - protein, 18 aa, Mycobacterium avium
VETPQSHGAQIQKGPSVR

SEQ ID NO: 57958 - protein, 15 aa, Mycobacterium avium
VETPTPRNPAGPALA

SEQ ID NO: 57959 - protein, 5 aa, Mycobacterium avium
VETSA

SEQ ID NO: 57960 - protein, 9 aa, Mycobacterium avium
VEVPPDVPA

SEQ ID NO: 57961 - protein, 12 aa, Mycobacterium avium
VGAESSSRASHG

SEQ ID NO: 57962 - protein, 8 aa, Mycobacterium avium
VGAGERLS

SEQ ID NO: 57963 - protein, 5 aa, Mycobacterium avium
VGAGP

SEQ ID NO: 57964 - protein, 8 aa, Mycobacterium avium
VGAPDELK

SEQ ID NO: 57965 - protein, 12 aa, Mycobacterium avium
VGASYGSTVETL

SEQ ID NO: 57966 - protein, 6 aa, Mycobacterium avium
VGATGG

SEQ ID NO: 57967 - protein, 4 aa, Mycobacterium avium
VGDD

SEQ ID NO: 57968 - protein, 12 aa, Mycobacterium avium
VGDDPAAVAANR

SEQ ID NO: 57969 - protein, 9 aa, Mycobacterium avium
VGDPTDPDV

SEQ ID NO: 57970 - protein, 15 aa, Mycobacterium avium
VGDRDPADTLRDGTA

SEQ ID NO: 57971 - protein, 6 aa, Mycobacterium avium
VGDRDV

SEQ ID NO: 57972 - protein, 8 aa, Mycobacterium avium
VGEANTVG

SEQ ID NO: 57973 - protein, 9 aa, Mycobacterium avium
VGEDPEQLG

SEQ ID NO: 57974 - protein, 9 aa, Mycobacterium avium
VGELDQGEV

SEQ ID NO: 57975 - protein, 16 aa, Mycobacterium avium
VGEPPDSPEASAHWPR

SEQ ID NO: 57976 - protein, 6 aa, Mycobacterium avium
VGFGGT

SEQ ID NO: 57977 - protein, 5 aa, Mycobacterium avium
VGGAA

SEQ ID NO: 57978 - protein, 50 aa, Mycobacterium avium
VGGAGSGLGGGAGAGGGGAGLGGGGTVPTSSLGPPPVPTSSPPTTPAGAK

SEQ ID NO: 57979 - protein, 10 aa, Mycobacterium avium
VGGDSAGGNL

SEQ ID NO: 57980 - protein, 10 aa, Mycobacterium avium
VGGEAGSGEP

SEQ ID NO: 57981 - protein, 10 aa, Mycobacterium avium
VGGEGQPPVA

SEQ ID NO: 57982 - protein, 20 aa, Mycobacterium avium
VGGETPSPRPVIPPRPAGHT

SEQ ID NO: 57983 - protein, 6 aa, Mycobacterium avium
VGGKRE

SEQ ID NO: 57984 - protein, 7 aa, Mycobacterium avium
VGGLGGP

SEQ ID NO: 57985 - protein, 7 aa, Mycobacterium avium
VGGLSGN

SEQ ID NO: 57986 - protein, 10 aa, Mycobacterium avium
VGGPGDPRLQ

SEQ ID NO: 57987 - protein, 27 aa, Mycobacterium avium
VGGPGPADTERPVRSITTGPRGYEGEG

SEQ ID NO: 57988 - protein, 10 aa, Mycobacterium avium
VGGPYSEPAL

SEQ ID NO: 57989 - protein, 10 aa, Mycobacterium avium
VGGSAGAAGR

SEQ ID NO: 57990 - protein, 5 aa, Mycobacterium avium
VGGTE

SEQ ID NO: 57991 - protein, 5 aa, Mycobacterium avium
VGGYT

SEQ ID NO: 57992 - protein, 11 aa, Mycobacterium avium
VGHGTDGEHAV

SEQ ID NO: 57993 - protein, 9 aa, Mycobacterium avium
VGKPAPTVR

SEQ ID NO: 57994 - protein, 8 aa, Mycobacterium avium
VGNSDGEL

SEQ ID NO: 57995 - protein, 15 aa, Mycobacterium avium
VGPAEDPDRPGPPLD

SEQ ID NO: 57996 - protein, 4 aa, Mycobacterium avium
VGPD

SEQ ID NO: 57997 - protein, 10 aa, Mycobacterium avium
VGPDDGAPTV

SEQ ID NO: 57998 - protein, 5 aa, Mycobacterium avium
VGPGE

SEQ ID NO: 57999 - protein, 11 aa, Mycobacterium avium
VGPGSLPSDSS

SEQ ID NO: 58000 - protein, 9 aa, Mycobacterium avium
VGPGYRPGR

SEQ ID NO: 58001 - protein, 9 aa, Mycobacterium avium
VGPHGRATL

SEQ ID NO: 58002 - protein, 7 aa, Mycobacterium avium
VGPKTRR

SEQ ID NO: 58003 - protein, 11 aa, Mycobacterium avium
VGPNGSGKSNV

SEQ ID NO: 58004 - protein, 14 aa, Mycobacterium avium
VGPPAGPAQPVGCA

SEQ ID NO: 58005 - protein, 6 aa, Mycobacterium avium
VGPRQS

SEQ ID NO: 58006 - protein, 7 aa, Mycobacterium avium
VGQPGNR

SEQ ID NO: 58007 - protein, 11 aa, Mycobacterium avium
VGRDARAPEPL

SEQ ID NO: 58008 - protein, 18 aa, Mycobacterium avium
VGRDPDRIERSAAVKGGA

SEQ ID NO: 58009 - protein, 4 aa, Mycobacterium avium
VGRE

SEQ ID NO: 58010 - protein, 7 aa, Mycobacterium avium
VGREGDG

SEQ ID NO: 58011 - protein, 17 aa, Mycobacterium avium
VGRGSPQGLAASKALTT

SEQ ID NO: 58012 - protein, 10 aa, Mycobacterium avium
VGRKAARDRA

SEQ ID NO: 58013 - protein, 5 aa, Mycobacterium avium
VGRPV

SEQ ID NO: 58014 - protein, 5 aa, Mycobacterium avium
VGRTV

SEQ ID NO: 58015 - protein, 11 aa, Mycobacterium avium
VGSDYRGDPSA

SEQ ID NO: 58016 - protein, 10 aa, Mycobacterium avium
VGSGPGNVTA

SEQ ID NO: 58017 - protein, 7 aa, Mycobacterium avium
VGSPGGW

SEQ ID NO: 58018 - protein, 11 aa, Mycobacterium avium
VGSSGQGNYAA

SEQ ID NO: 58019 - protein, 4 aa, Mycobacterium avium
VGST

SEQ ID NO: 58020 - protein, 9 aa, Mycobacterium avium
VGTARTEAD

SEQ ID NO: 58021 - protein, 5 aa, Mycobacterium avium
VGTED

SEQ ID NO: 58022 - protein, 7 aa, Mycobacterium avium
VGTGAKL

SEQ ID NO: 58023 - protein, 6 aa, Mycobacterium avium
VGTGFD

SEQ ID NO: 58024 - protein, 12 aa, Mycobacterium avium
VGTNPTFSGRTR

SEQ ID NO: 58025 - protein, 8 aa, Mycobacterium avium
VGTPEYRR

SEQ ID NO: 58026 - protein, 10 aa, Mycobacterium avium
VGTPVPGTEV

SEQ ID NO: 58027 - protein, 4 aa, Mycobacterium avium
VGTT

SEQ ID NO: 58028 - protein, 25 aa, Mycobacterium avium
VGVGEAGASYLAGDTAAAATFGIAG

SEQ ID NO: 58029 - protein, 6 aa, Mycobacterium avium
VHPSGV

SEQ ID NO: 58030 - protein, 8 aa, Mycobacterium avium
VHRDPDRM

SEQ ID NO: 58031 - protein, 11 aa, Mycobacterium avium
VHTDPGRVSGP

SEQ ID NO: 58032 - protein, 10 aa, Mycobacterium avium
VHTGDTTGMG

SEQ ID NO: 58033 - protein, 5 aa, Mycobacterium avium
VIGRG

SEQ ID NO: 58034 - protein, 8 aa, Mycobacterium avium
VKAPASIP

SEQ ID NO: 58035 - protein, 9 aa, Mycobacterium avium
VKEEGGGAL

SEQ ID NO: 58036 - protein, 12 aa, Mycobacterium avium
VKERKGSVQSPK

SEQ ID NO: 58037 - protein, 4 aa, Mycobacterium avium
VKET

SEQ ID NO: 58038 - protein, 6 aa, Mycobacterium avium
VKPNGI

SEQ ID NO: 58039 - protein, 12 aa, Mycobacterium avium
VKPTSVPAFRPG

SEQ ID NO: 58040 - protein, 7 aa, Mycobacterium avium
VKRPQTG

SEQ ID NO: 58041 - protein, 12 aa, Mycobacterium avium
VKSEGGAHGDAG

SEQ ID NO: 58042 - protein, 13 aa, Mycobacterium avium
VKTGGRGKAGGVK

SEQ ID NO: 58043 - protein, 4 aa, Mycobacterium avium
VKTT

SEQ ID NO: 58044 - protein, 13 aa, Mycobacterium avium
VKYGDDSSRTAAA

SEQ ID NO: 58045 - protein, 10 aa, Mycobacterium avium
VLDPGTGPGH

SEQ ID NO: 58046 - protein, 7 aa, Mycobacterium avium
VLPGGTG

SEQ ID NO: 58047 - protein, 11 aa, Mycobacterium avium
VLPTSSQANPT

SEQ ID NO: 58048 - protein, 8 aa, Mycobacterium avium
VNALGPTM

SEQ ID NO: 58049 - protein, 5 aa, Mycobacterium avium
VNDDV

SEQ ID NO: 58050 - protein, 4 aa, Mycobacterium avium
VNEP

SEQ ID NO: 58051 - protein, 7 aa, Mycobacterium avium
VNFSGSG

SEQ ID NO: 58052 - protein, 8 aa, Mycobacterium avium
VNGPASTV

SEQ ID NO: 58053 - protein, 10 aa, Mycobacterium avium
VNHDGRSNGL

SEQ ID NO: 58054 - protein, 7 aa, Mycobacterium avium
VNPPGSN

SEQ ID NO: 58055 - protein, 8 aa, Mycobacterium avium
VNRGPADL

SEQ ID NO: 58056 - protein, 18 aa, Mycobacterium avium
VNRSPLDAERAATANNVG

SEQ ID NO: 58057 - protein, 11 aa, Mycobacterium avium
VNSPQRQRPSI

SEQ ID NO: 58058 - protein, 4 aa, Mycobacterium avium
VNSR

SEQ ID NO: 58059 - protein, 7 aa, Mycobacterium avium
VNTPGTA

SEQ ID NO: 58060 - protein, 4 aa, Mycobacterium avium
VPAA

SEQ ID NO: 58061 - protein, 6 aa, Mycobacterium avium
VPAAAQ

SEQ ID NO: 58062 - protein, 9 aa, Mycobacterium avium
VPADPATAT

SEQ ID NO: 58063 - protein, 5 aa, Mycobacterium avium
VPAEL

SEQ ID NO: 58064 - protein, 12 aa, Mycobacterium avium
VPAGAAAGHPRR

SEQ ID NO: 58065 - protein, 9 aa, Mycobacterium avium
VPAGEQSSL

SEQ ID NO: 58066 - protein, 11 aa, Mycobacterium avium
VPAGPMNRPPD

SEQ ID NO: 58067 - protein, 9 aa, Mycobacterium avium
VPAGRDAAH

SEQ ID NO: 58068 - protein, 12 aa, Mycobacterium avium
VPAPERGDAARN

SEQ ID NO: 58069 - protein, 7 aa, Mycobacterium avium
VPAPPAA

SEQ ID NO: 58070 - protein, 5 aa, Mycobacterium avium
VPAQA

SEQ ID NO: 58071 - protein, 12 aa, Mycobacterium avium
VPARRPSPSRSA

SEQ ID NO: 58072 - protein, 8 aa, Mycobacterium avium
VPASSART

SEQ ID NO: 58073 - protein, 9 aa, Mycobacterium avium
VPATATYTS

SEQ ID NO: 58074 - protein, 4 aa, Mycobacterium avium
VPDD

SEQ ID NO: 58075 - protein, 8 aa, Mycobacterium avium
VPDDGGRF

SEQ ID NO: 58076 - protein, 7 aa, Mycobacterium avium
VPDIEDA

SEQ ID NO: 58077 - protein, 7 aa, Mycobacterium avium
VPEAGRP

SEQ ID NO: 58078 - protein, 6 aa, Mycobacterium avium
VPEPGW

SEQ ID NO: 58079 - protein, 9 aa, Mycobacterium avium
VPEQTTRAL

SEQ ID NO: 58080 - protein, 12 aa, Mycobacterium avium
VPERLSPSDDFP

SEQ ID NO: 58081 - protein, 11 aa, Mycobacterium avium
VPESAGGDGAT

SEQ ID NO: 58082 - protein, 11 aa, Mycobacterium avium
VPESTSPAEDF

SEQ ID NO: 58083 - protein, 16 aa, Mycobacterium avium
VPGAASAADDDIEAAA

SEQ ID NO: 58084 - protein, 6 aa, Mycobacterium avium
VPGAGD

SEQ ID NO: 58085 - protein, 27 aa, Mycobacterium avium
VPGAGLGSLGSLGSIGGSVGKAASIGG

SEQ ID NO: 58086 - protein, 13 aa, Mycobacterium avium
VPGDTDVAARRDA

SEQ ID NO: 58087 - protein, 5 aa, Mycobacterium avium
VPGGA

SEQ ID NO: 58088 - protein, 6 aa, Mycobacterium avium
VPGGAN

SEQ ID NO: 58089 - protein, 7 aa, Mycobacterium avium
VPGGDIK

SEQ ID NO: 58090 - protein, 4 aa, Mycobacterium avium
VPGP

SEQ ID NO: 58091 - protein, 16 aa, Mycobacterium avium
VPGPAVAGAGTATTVG

SEQ ID NO: 58092 - protein, 10 aa, Mycobacterium avium
VPGQRPDSAL

SEQ ID NO: 58093 - protein, 27 aa, Mycobacterium avium
VPGSRLASNVPDSGFTDPDRLARQRED

SEQ ID NO: 58094 - protein, 4 aa, Mycobacterium avium
VPGT

SEQ ID NO: 58095 - protein, 5 aa, Mycobacterium avium
VPGTS

SEQ ID NO: 58096 - protein, 6 aa, Mycobacterium avium
VPIPAG

SEQ ID NO: 58097 - protein, 13 aa, Mycobacterium avium
VPNQGRRGEPGPP

SEQ ID NO: 58098 - protein, 8 aa, Mycobacterium avium
VPNTEKLP

SEQ ID NO: 58099 - protein, 4 aa, Mycobacterium avium
VPPA

SEQ ID NO: 58100 - protein, 5 aa, Mycobacterium avium
VPPDE

SEQ ID NO: 58101 - protein, 9 aa, Mycobacterium avium
VPPGADGAL

SEQ ID NO: 58102 - protein, 6 aa, Mycobacterium avium
VPPGER

SEQ ID NO: 58103 - protein, 6 aa, Mycobacterium avium
VPPGWT

SEQ ID NO: 58104 - protein, 5 aa, Mycobacterium avium
VPPGY

SEQ ID NO: 58105 - protein, 4 aa, Mycobacterium avium
VPPH

SEQ ID NO: 58106 - protein, 5 aa, Mycobacterium avium
VPPHA

SEQ ID NO: 58107 - protein, 15 aa, Mycobacterium avium
VPPHTASRVTRSSYT

SEQ ID NO: 58108 - protein, 26 aa, Mycobacterium avium
VPPITAGATTVPAVSRDGADEATLTS

SEQ ID NO: 58109 - protein, 6 aa, Mycobacterium avium
VPPPVV

SEQ ID NO: 58110 - protein, 15 aa, Mycobacterium avium
VPPQPSNDGVANPSG

SEQ ID NO: 58111 - protein, 6 aa, Mycobacterium avium
VPPSQA

SEQ ID NO: 58112 - protein, 21 aa, Mycobacterium avium
VPPSWAGATPVVGSSSAPLQT

SEQ ID NO: 58113 - protein, 7 aa, Mycobacterium avium
VPPTATQ

SEQ ID NO: 58114 - protein, 8 aa, Mycobacterium avium
VPPTDDPV

SEQ ID NO: 58115 - protein, 10 aa, Mycobacterium avium
VPQAPYGLAG

SEQ ID NO: 58116 - protein, 10 aa, Mycobacterium avium
VPRDYDPAYS

SEQ ID NO: 58117 - protein, 10 aa, Mycobacterium avium
VPRPEGQPAL

SEQ ID NO: 58118 - protein, 11 aa, Mycobacterium avium
VPSGSGTTAAG

SEQ ID NO: 58119 - protein, 7 aa, Mycobacterium avium
VPSHDDG

SEQ ID NO: 58120 - protein, 4 aa, Mycobacterium avium
VPSS

SEQ ID NO: 58121 - protein, 15 aa, Mycobacterium avium
VPTPPQPEWIVGHQK

SEQ ID NO: 58122 - protein, 9 aa, Mycobacterium avium
VPTSGPGTI

SEQ ID NO: 58123 - protein, 7 aa, Mycobacterium avium
VPVEDGK

SEQ ID NO: 58124 - protein, 17 aa, Mycobacterium avium
VPVTAPAASGPLAEQPA

SEQ ID NO: 58125 - protein, 7 aa, Mycobacterium avium
VQDANGP

SEQ ID NO: 58126 - protein, 9 aa, Mycobacterium avium
VQDSAAGSQ

SEQ ID NO: 58127 - protein, 9 aa, Mycobacterium avium
VQGGRPEAL

SEQ ID NO: 58128 - protein, 10 aa, Mycobacterium avium
VQKSSRYPGG

SEQ ID NO: 58129 - protein, 5 aa, Mycobacterium avium
VQPEL

SEQ ID NO: 58130 - protein, 15 aa, Mycobacterium avium
VQPGDGLREFAFAPL

SEQ ID NO: 58131 - protein, 5 aa, Mycobacterium avium
VQPPR

SEQ ID NO: 58132 - protein, 4 aa, Mycobacterium avium
VQQS

SEQ ID NO: 58133 - protein, 5 aa, Mycobacterium avium
VQRDP

SEQ ID NO: 58134 - protein, 8 aa, Mycobacterium avium
VQRPGGAG

SEQ ID NO: 58135 - protein, 10 aa, Mycobacterium avium
VQRRGREVEE

SEQ ID NO: 58136 - protein, 7 aa, Mycobacterium avium
VQTRAPR

SEQ ID NO: 58137 - protein, 5 aa, Mycobacterium avium
VRAGL

SEQ ID NO: 58138 - protein, 5 aa, Mycobacterium avium
VRASG

SEQ ID NO: 58139 - protein, 5 aa, Mycobacterium avium
VRATY

SEQ ID NO: 58140 - protein, 10 aa, Mycobacterium avium
VRDEAEIRGH

SEQ ID NO: 58141 - protein, 6 aa, Mycobacterium avium
VRDGMT

SEQ ID NO: 58142 - protein, 7 aa, Mycobacterium avium
VRDGSGL

SEQ ID NO: 58143 - protein, 14 aa, Mycobacterium avium
VRDRTAALERANEE

SEQ ID NO: 58144 - protein, 9 aa, Mycobacterium avium
VREDTGLPY

SEQ ID NO: 58145 - protein, 7 aa, Mycobacterium avium
VRETGSA

SEQ ID NO: 58146 - protein, 10 aa, Mycobacterium avium
VRGEPPPPTY

SEQ ID NO: 58147 - protein, 8 aa, Mycobacterium avium
VRGPAAAA

SEQ ID NO: 58148 - protein, 142 aa, Mycobacterium avium
VRGQANGAAPAEQANGAEPAEDSGKPDAKDAKDDTTPDTKDANDHTGAQSAAEAPAQNGATAEAPRRERRSASRDAGAAGRGNDDADRETDGREQNKQDSREQSKQDGGDQDQQSSGGQQGRGSNQQDDDGEGRQGRRGRRF

SEQ ID NO: 58149 - protein, 12 aa, Mycobacterium avium
VRKAPGQRIPRT

SEQ ID NO: 58150 - protein, 5 aa, Mycobacterium avium
VRPDP

SEQ ID NO: 58151 - protein, 7 aa, Mycobacterium avium
VRPDSLT

SEQ ID NO: 58152 - protein, 8 aa, Mycobacterium avium
VRPEAQTV

SEQ ID NO: 58153 - protein, 8 aa, Mycobacterium avium
VRPESKTL

SEQ ID NO: 58154 - protein, 5 aa, Mycobacterium avium
VRRGD

SEQ ID NO: 58155 - protein, 6 aa, Mycobacterium avium
VRRPDG

SEQ ID NO: 58156 - protein, 7 aa, Mycobacterium avium
VRRQSRE

SEQ ID NO: 58157 - protein, 12 aa, Mycobacterium avium
VRRSARKLSPEL

SEQ ID NO: 58158 - protein, 10 aa, Mycobacterium avium
VRSGGRGPAE

SEQ ID NO: 58159 - protein, 5 aa, Mycobacterium avium
VRSPE

SEQ ID NO: 58160 - protein, 6 aa, Mycobacterium avium
VRSPKD

SEQ ID NO: 58161 - protein, 5 aa, Mycobacterium avium
VRSTR

SEQ ID NO: 58162 - protein, 8 aa, Mycobacterium avium
VRSTRQRA

SEQ ID NO: 58163 - protein, 7 aa, Mycobacterium avium
VRTAGDS

SEQ ID NO: 58164 - protein, 5 aa, Mycobacterium avium
VRTDA

SEQ ID NO: 58165 - protein, 6 aa, Mycobacterium avium
VRTRAL

SEQ ID NO: 58166 - protein, 8 aa, Mycobacterium avium
VSAAQATR

SEQ ID NO: 58167 - protein, 8 aa, Mycobacterium avium
VSAASAAI

SEQ ID NO: 58168 - protein, 8 aa, Mycobacterium avium
VSAGSDHE

SEQ ID NO: 58169 - protein, 13 aa, Mycobacterium avium
VSASGGLGSGRAE

SEQ ID NO: 58170 - protein, 6 aa, Mycobacterium avium
VSDERV

SEQ ID NO: 58171 - protein, 6 aa, Mycobacterium avium
VSDETR

SEQ ID NO: 58172 - protein, 6 aa, Mycobacterium avium
VSDPAL

SEQ ID NO: 58173 - protein, 9 aa, Mycobacterium avium
VSDPARPTV

SEQ ID NO: 58174 - protein, 14 aa, Mycobacterium avium
VSDPTLSRADLPGL

SEQ ID NO: 58175 - protein, 21 aa, Mycobacterium avium
VSDTGSDPLTSRSRPADASAV

SEQ ID NO: 58176 - protein, 5 aa, Mycobacterium avium
VSERQ

SEQ ID NO: 58177 - protein, 6 aa, Mycobacterium avium
VSGDEI

SEQ ID NO: 58178 - protein, 11 aa, Mycobacterium avium
VSGRPADLAGA

SEQ ID NO: 58179 - protein, 12 aa, Mycobacterium avium
VSGRPTELAGSE

SEQ ID NO: 58180 - protein, 9 aa, Mycobacterium avium
VSIGGGSVT

SEQ ID NO: 58181 - protein, 9 aa, Mycobacterium avium
VSKDNYRVE

SEQ ID NO: 58182 - protein, 15 aa, Mycobacterium avium
VSKRSTPCRIYRRRV

SEQ ID NO: 58183 - protein, 5 aa, Mycobacterium avium
VSKRT

SEQ ID NO: 58184 - protein, 4 aa, Mycobacterium avium
VSND

SEQ ID NO: 58185 - protein, 8 aa, Mycobacterium avium
VSPATRAE

SEQ ID NO: 58186 - protein, 19 aa, Mycobacterium avium
VSPDNAYPPATEADLKETA

SEQ ID NO: 58187 - protein, 9 aa, Mycobacterium avium
VSPDYESTV

SEQ ID NO: 58188 - protein, 6 aa, Mycobacterium avium
VSPEDD

SEQ ID NO: 58189 - protein, 5 aa, Mycobacterium avium
VSPQD

SEQ ID NO: 58190 - protein, 7 aa, Mycobacterium avium
VSPSMGP

SEQ ID NO: 58191 - protein, 6 aa, Mycobacterium avium
VSPTAT

SEQ ID NO: 58192 - protein, 5 aa, Mycobacterium avium
VSPTT

SEQ ID NO: 58193 - protein, 32 aa, Mycobacterium avium
VSQGGQAPVAGSGTRAGKRPGTRLRSANHGVR

SEQ ID NO: 58194 - protein, 7 aa, Mycobacterium avium
VSQQQLD

SEQ ID NO: 58195 - protein, 4 aa, Mycobacterium avium
VSRA

SEQ ID NO: 58196 - protein, 8 aa, Mycobacterium avium
VSRGTADL

SEQ ID NO: 58197 - protein, 7 aa, Mycobacterium avium
VSRSPNE

SEQ ID NO: 58198 - protein, 9 aa, Mycobacterium avium
VSRTSGASL

SEQ ID NO: 58199 - protein, 6 aa, Mycobacterium avium
VSSDDL

SEQ ID NO: 58200 - protein, 9 aa, Mycobacterium avium
VSSKKRDDL

SEQ ID NO: 58201 - protein, 6 aa, Mycobacterium avium
VSSNTH

SEQ ID NO: 58202 - protein, 7 aa, Mycobacterium avium
VSTARAK

SEQ ID NO: 58203 - protein, 9 aa, Mycobacterium avium
VSTENAAAR

SEQ ID NO: 58204 - protein, 17 aa, Mycobacterium avium
VSTPEKARRSAQAGADE

SEQ ID NO: 58205 - protein, 6 aa, Mycobacterium avium
VSTSLD

SEQ ID NO: 58206 - protein, 12 aa, Mycobacterium avium
VSVEGEAQPLPE

SEQ ID NO: 58207 - protein, 12 aa, Mycobacterium avium
VSVSDGPPDWPA

SEQ ID NO: 58208 - protein, 15 aa, Mycobacterium avium
VSYASTATQGGTPIG

SEQ ID NO: 58209 - protein, 8 aa, Mycobacterium avium
VTAAGTGL

SEQ ID NO: 58210 - protein, 7 aa, Mycobacterium avium
VTADGGT

SEQ ID NO: 58211 - protein, 8 aa, Mycobacterium avium
VTADKNIT

SEQ ID NO: 58212 - protein, 12 aa, Mycobacterium avium
VTATDPRGDERP

SEQ ID NO: 58213 - protein, 8 aa, Mycobacterium avium
VTATGDTA

SEQ ID NO: 58214 - protein, 5 aa, Mycobacterium avium
VTDAG

SEQ ID NO: 58215 - protein, 6 aa, Mycobacterium avium
VTDESA

SEQ ID NO: 58216 - protein, 9 aa, Mycobacterium avium
VTDHPGGYA

SEQ ID NO: 58217 - protein, 7 aa, Mycobacterium avium
VTDHRDR

SEQ ID NO: 58218 - protein, 12 aa, Mycobacterium avium
VTDPPRPRRRKP

SEQ ID NO: 58219 - protein, 13 aa, Mycobacterium avium
VTDPTVTEGYRQD

SEQ ID NO: 58220 - protein, 7 aa, Mycobacterium avium
VTDTAAG

SEQ ID NO: 58221 - protein, 7 aa, Mycobacterium avium
VTEANRS

SEQ ID NO: 58222 - protein, 35 aa, Mycobacterium avium
VTEEGDGEAAATDEPTAAAAETRPPESDDNAGASG

SEQ ID NO: 58223 - protein, 5 aa, Mycobacterium avium
VTETK

SEQ ID NO: 58224 - protein, 6 aa, Mycobacterium avium
VTETQQ

SEQ ID NO: 58225 - protein, 5 aa, Mycobacterium avium
VTGGA

SEQ ID NO: 58226 - protein, 7 aa, Mycobacterium avium
VTGGKRL

SEQ ID NO: 58227 - protein, 8 aa, Mycobacterium avium
VTGGSKGM

SEQ ID NO: 58228 - protein, 9 aa, Mycobacterium avium
VTGGSPHAL

SEQ ID NO: 58229 - protein, 18 aa, Mycobacterium avium
VTGPARSGAAIRGAGRTV

SEQ ID NO: 58230 - protein, 10 aa, Mycobacterium avium
VTGSGAPTAN

SEQ ID NO: 58231 - protein, 4 aa, Mycobacterium avium
VTGV

SEQ ID NO: 58232 - protein, 4 aa, Mycobacterium avium
VTNG

SEQ ID NO: 58233 - protein, 4 aa, Mycobacterium avium
VTPA

SEQ ID NO: 58234 - protein, 7 aa, Mycobacterium avium
VTPAPGW

SEQ ID NO: 58235 - protein, 8 aa, Mycobacterium avium
VTPAQRRK

SEQ ID NO: 58236 - protein, 7 aa, Mycobacterium avium
VTPDGGL

SEQ ID NO: 58237 - protein, 11 aa, Mycobacterium avium
VTPEQAGAHPT

SEQ ID NO: 58238 - protein, 5 aa, Mycobacterium avium
VTPGH

SEQ ID NO: 58239 - protein, 8 aa, Mycobacterium avium
VTRPATDR

SEQ ID NO: 58240 - protein, 7 aa, Mycobacterium avium
VTRPDEP

SEQ ID NO: 58241 - protein, 10 aa, Mycobacterium avium
VTRPGSVTHE

SEQ ID NO: 58242 - protein, 9 aa, Mycobacterium avium
VTSTDRTGV

SEQ ID NO: 58243 - protein, 23 aa, Mycobacterium avium
VTSTPAALPAPRPDVDTYASAGR

SEQ ID NO: 58244 - protein, 7 aa, Mycobacterium avium
VTTDDVR

SEQ ID NO: 58245 - protein, 8 aa, Mycobacterium avium
VTTPARTA

SEQ ID NO: 58246 - protein, 9 aa, Mycobacterium avium
VTTSAGDTV

SEQ ID NO: 58247 - protein, 10 aa, Mycobacterium avium
VTTTSGPGIS

SEQ ID NO: 58248 - protein, 8 aa, Mycobacterium avium
VTVEPGGA

SEQ ID NO: 58249 - protein, 17 aa, Mycobacterium avium
VTYHTSGRHAAAEEQGL

SEQ ID NO: 58250 - protein, 9 aa, Mycobacterium avium
VVEGDGDLS

SEQ ID NO: 58251 - protein, 11 aa, Mycobacterium avium
VVGGSNRGSGV

SEQ ID NO: 58252 - protein, 4 aa, Mycobacterium avium
VVPE

SEQ ID NO: 58253 - protein, 20 aa, Mycobacterium avium
VVPNDGGRVVDPASRRPVPG

SEQ ID NO: 58254 - protein, 8 aa, Mycobacterium avium
VVSGDAAN

SEQ ID NO: 58255 - protein, 6 aa, Mycobacterium avium
VVTTPG

SEQ ID NO: 58256 - protein, 11 aa, Mycobacterium avium
VYGADDPAAAV

SEQ ID NO: 58257 - protein, 17 aa, Mycobacterium avium
VYRGDEAPHGDDPAPTV

SEQ ID NO: 58258 - protein, 10 aa, Mycobacterium avium
WAPHGGESRV

SEQ ID NO: 58259 - protein, 10 aa, Mycobacterium avium
WAPPYAEAGA

SEQ ID NO: 58260 - protein, 7 aa, Mycobacterium avium
WASSKGD

SEQ ID NO: 58261 - protein, 8 aa, Mycobacterium avium
WDDGDGTW

SEQ ID NO: 58262 - protein, 28 aa, Mycobacterium avium
WDPQGPAGEQAVPLPSRADRTEPRPTNV

SEQ ID NO: 58263 - protein, 10 aa, Mycobacterium avium
WDPSTGTRRR

SEQ ID NO: 58264 - protein, 10 aa, Mycobacterium avium
WEEAGPDGDR

SEQ ID NO: 58265 - protein, 11 aa, Mycobacterium avium
WEPSAEGDWTT

SEQ ID NO: 58266 - protein, 13 aa, Mycobacterium avium
WERPARSVTNEHG

SEQ ID NO: 58267 - protein, 14 aa, Mycobacterium avium
WGPATGDGSDGGVE

SEQ ID NO: 58268 - protein, 8 aa, Mycobacterium avium
WGPPADRD

SEQ ID NO: 58269 - protein, 14 aa, Mycobacterium avium
WGPSSDPAWQRNDP

SEQ ID NO: 58270 - protein, 11 aa, Mycobacterium avium
WGSPDAGTLPI

SEQ ID NO: 58271 - protein, 9 aa, Mycobacterium avium
WKPSPGSVY

SEQ ID NO: 58272 - protein, 7 aa, Mycobacterium avium
WKSYGGT

SEQ ID NO: 58273 - protein, 16 aa, Mycobacterium avium
WNDGSEAGSPMRGRSC

SEQ ID NO: 58274 - protein, 7 aa, Mycobacterium avium
WNDPDAA

SEQ ID NO: 58275 - protein, 7 aa, Mycobacterium avium
WNPDGEF

SEQ ID NO: 58276 - protein, 15 aa, Mycobacterium avium
WPASSADGARPGRKA

SEQ ID NO: 58277 - protein, 8 aa, Mycobacterium avium
WPDESPQL

SEQ ID NO: 58278 - protein, 7 aa, Mycobacterium avium
WPDGTEP

SEQ ID NO: 58279 - protein, 5 aa, Mycobacterium avium
WPEAA

SEQ ID NO: 58280 - protein, 6 aa, Mycobacterium avium
WPEQSM

SEQ ID NO: 58281 - protein, 6 aa, Mycobacterium avium
WPHPEG

SEQ ID NO: 58282 - protein, 8 aa, Mycobacterium avium
WPPAGATK

SEQ ID NO: 58283 - protein, 4 aa, Mycobacterium avium
WPTN

SEQ ID NO: 58284 - protein, 9 aa, Mycobacterium avium
WRENAKRPI

SEQ ID NO: 58285 - protein, 9 aa, Mycobacterium avium
WRENGQQSI

SEQ ID NO: 58286 - protein, 9 aa, Mycobacterium avium
WRRRQPNQR

SEQ ID NO: 58287 - protein, 8 aa, Mycobacterium avium
WSAADPQL

SEQ ID NO: 58288 - protein, 8 aa, Mycobacterium avium
WSADPAEL

SEQ ID NO: 58289 - protein, 15 aa, Mycobacterium avium
WSAETEDPENGQVGG

SEQ ID NO: 58290 - protein, 7 aa, Mycobacterium avium
WSDADNR

SEQ ID NO: 58291 - protein, 6 aa, Mycobacterium avium
WSDPGV

SEQ ID NO: 58292 - protein, 8 aa, Mycobacterium avium
WSDSPSGA

SEQ ID NO: 58293 - protein, 8 aa, Mycobacterium avium
WSEPHQSA

SEQ ID NO: 58294 - protein, 9 aa, Mycobacterium avium
WSRSGPAER

SEQ ID NO: 58295 - protein, 4 aa, Mycobacterium avium
WTED

SEQ ID NO: 58296 - protein, 15 aa, Mycobacterium avium
WTPAWSDEQRAAGYA

SEQ ID NO: 58297 - protein, 12 aa, Mycobacterium avium
WTPDGSPAGIGG

SEQ ID NO: 58298 - protein, 10 aa, Mycobacterium avium
WTPSEDPADP

SEQ ID NO: 58299 - protein, 9 aa, Mycobacterium avium
WTPTPGPVT

SEQ ID NO: 58300 - protein, 8 aa, Mycobacterium avium
WVGPGPRQ

SEQ ID NO: 58301 - protein, 16 aa, Mycobacterium avium
YAAATSRRVAAEAGVK

SEQ ID NO: 58302 - protein, 12 aa, Mycobacterium avium
YAASGSPDVGAN

SEQ ID NO: 58303 - protein, 10 aa, Mycobacterium avium
YAATPEDAYT

SEQ ID NO: 58304 - protein, 10 aa, Mycobacterium avium
YADAPDRTGT

SEQ ID NO: 58305 - protein, 8 aa, Mycobacterium avium
YADDPQRF

SEQ ID NO: 58306 - protein, 11 aa, Mycobacterium avium
YADPQTTAQLG

SEQ ID NO: 58307 - protein, 16 aa, Mycobacterium avium
YADRGDAFAAAVRAAI

SEQ ID NO: 58308 - protein, 13 aa, Mycobacterium avium
YAGAADGVGWSEG

SEQ ID NO: 58309 - protein, 8 aa, Mycobacterium avium
YAGPADDA

SEQ ID NO: 58310 - protein, 9 aa, Mycobacterium avium
YAGPGSAPM

SEQ ID NO: 58311 - protein, 9 aa, Mycobacterium avium
YAGPGSGPM

SEQ ID NO: 58312 - protein, 8 aa, Mycobacterium avium
YAGSDPAP

SEQ ID NO: 58313 - protein, 12 aa, Mycobacterium avium
YAPTADEIARAE

SEQ ID NO: 58314 - protein, 5 aa, Mycobacterium avium
YASAR

SEQ ID NO: 58315 - protein, 8 aa, Mycobacterium avium
YASCGDTD

SEQ ID NO: 58316 - protein, 17 aa, Mycobacterium avium
YATAGSRSGDDVKILLK

SEQ ID NO: 58317 - protein, 13 aa, Mycobacterium avium
YATEEDTAQGAAS

SEQ ID NO: 58318 - protein, 5 aa, Mycobacterium avium
YATQP

SEQ ID NO: 58319 - protein, 6 aa, Mycobacterium avium
YATRAR

SEQ ID NO: 58320 - protein, 15 aa, Mycobacterium avium
YAWPPSSWPNQGPAY

SEQ ID NO: 58321 - protein, 25 aa, Mycobacterium avium
YAYADGKRAVRPPDPADAAQIEAAR

SEQ ID NO: 58322 - protein, 8 aa, Mycobacterium avium
YDDQGRPQ

SEQ ID NO: 58323 - protein, 4 aa, Mycobacterium avium
YDEA

SEQ ID NO: 58324 - protein, 17 aa, Mycobacterium avium
YDGDHHRTNRRQYARDQ

SEQ ID NO: 58325 - protein, 5 aa, Mycobacterium avium
YDGDR

SEQ ID NO: 58326 - protein, 15 aa, Mycobacterium avium
YDGPRARISARSEWA

SEQ ID NO: 58327 - protein, 16 aa, Mycobacterium avium
YDQPKSIELQGRGRGG

SEQ ID NO: 58328 - protein, 11 aa, Mycobacterium avium
YDSSDKGFDGA

SEQ ID NO: 58329 - protein, 12 aa, Mycobacterium avium
YDTTDEGDPRPV

SEQ ID NO: 58330 - protein, 11 aa, Mycobacterium avium
YEGLTTEQIRQ

SEQ ID NO: 58331 - protein, 7 aa, Mycobacterium avium
YEKTYDA

SEQ ID NO: 58332 - protein, 11 aa, Mycobacterium avium
YENPTNAGDGY

SEQ ID NO: 58333 - protein, 12 aa, Mycobacterium avium
YEPNAADGVDYQ

SEQ ID NO: 58334 - protein, 4 aa, Mycobacterium avium
YEPQ

SEQ ID NO: 58335 - protein, 11 aa, Mycobacterium avium
YEPTDVTNEDE

SEQ ID NO: 58336 - protein, 21 aa, Mycobacterium avium
YESPDTPDRLADRDARDRRRR

SEQ ID NO: 58337 - protein, 10 aa, Mycobacterium avium
YESRTAPVEG

SEQ ID NO: 58338 - protein, 4 aa, Mycobacterium avium
YETP

SEQ ID NO: 58339 - protein, 8 aa, Mycobacterium avium
YETPTGIQ

SEQ ID NO: 58340 - protein, 4 aa, Mycobacterium avium
YFTG

SEQ ID NO: 58341 - protein, 9 aa, Mycobacterium avium
YGAGQGPRL

SEQ ID NO: 58342 - protein, 18 aa, Mycobacterium avium
YGASGDQSRGVVDGKPAD

SEQ ID NO: 58343 - protein, 4 aa, Mycobacterium avium
YGDE

SEQ ID NO: 58344 - protein, 4 aa, Mycobacterium avium
YGDL

SEQ ID NO: 58345 - protein, 14 aa, Mycobacterium avium
YGDPAESADAAAEL

SEQ ID NO: 58346 - protein, 9 aa, Mycobacterium avium
YGDPDNPDD

SEQ ID NO: 58347 - protein, 12 aa, Mycobacterium avium
YGESGPDADRAA

SEQ ID NO: 58348 - protein, 12 aa, Mycobacterium avium
YGESQLDGEGRT

SEQ ID NO: 58349 - protein, 12 aa, Mycobacterium avium
YGFSGKPTRAGW

SEQ ID NO: 58350 - protein, 5 aa, Mycobacterium avium
YGGDA

SEQ ID NO: 58351 - protein, 9 aa, Mycobacterium avium
YGGKAAPNL

SEQ ID NO: 58352 - protein, 4 aa, Mycobacterium avium
YGGL

SEQ ID NO: 58353 - protein, 10 aa, Mycobacterium avium
YGIGEATARR

SEQ ID NO: 58354 - protein, 13 aa, Mycobacterium avium
YGKDSLPKRRGNR

SEQ ID NO: 58355 - protein, 7 aa, Mycobacterium avium
YGKGSNA

SEQ ID NO: 58356 - protein, 11 aa, Mycobacterium avium
YGNNPNTASGL

SEQ ID NO: 58357 - protein, 16 aa, Mycobacterium avium
YGPADRSAEPPQPGEF

SEQ ID NO: 58358 - protein, 11 aa, Mycobacterium avium
YGPGQSLTNSY

SEQ ID NO: 58359 - protein, 6 aa, Mycobacterium avium
YGPGRD

SEQ ID NO: 58360 - protein, 17 aa, Mycobacterium avium
YGPRTGGKSKVSGSLRG

SEQ ID NO: 58361 - protein, 6 aa, Mycobacterium avium
YGPSGI

SEQ ID NO: 58362 - protein, 7 aa, Mycobacterium avium
YGPTETS

SEQ ID NO: 58363 - protein, 12 aa, Mycobacterium avium
YGQPRPQAESSL

SEQ ID NO: 58364 - protein, 16 aa, Mycobacterium avium
YGRRAGASAAGCRLPR

SEQ ID NO: 58365 - protein, 8 aa, Mycobacterium avium
YGRSGGPL

SEQ ID NO: 58366 - protein, 7 aa, Mycobacterium avium
YGSDPSD

SEQ ID NO: 58367 - protein, 9 aa, Mycobacterium avium
YGSSETGNM

SEQ ID NO: 58368 - protein, 10 aa, Mycobacterium avium
YGSTETAERL

SEQ ID NO: 58369 - protein, 6 aa, Mycobacterium avium
YGTGAE

SEQ ID NO: 58370 - protein, 8 aa, Mycobacterium avium
YGTPEQRK

SEQ ID NO: 58371 - protein, 6 aa, Mycobacterium avium
YHPDGD

SEQ ID NO: 58372 - protein, 9 aa, Mycobacterium avium
YIKPGSEPV

SEQ ID NO: 58373 - protein, 4 aa, Mycobacterium avium
YITS

SEQ ID NO: 58374 - protein, 12 aa, Mycobacterium avium
YKKQMKAAAKAA

SEQ ID NO: 58375 - protein, 13 aa, Mycobacterium avium
YKPTTKPHSRQIR

SEQ ID NO: 58376 - protein, 19 aa, Mycobacterium avium
YLDPEAAAAGAAAVASQGR

SEQ ID NO: 58377 - protein, 5 aa, Mycobacterium avium
YNGPA

SEQ ID NO: 58378 - protein, 11 aa, Mycobacterium avium
YNPDPDVPGTC

SEQ ID NO: 58379 - protein, 12 aa, Mycobacterium avium
YNPHRPRPTDLE

SEQ ID NO: 58380 - protein, 6 aa, Mycobacterium avium
YPADDD

SEQ ID NO: 58381 - protein, 8 aa, Mycobacterium avium
YPARGGTA

SEQ ID NO: 58382 - protein, 8 aa, Mycobacterium avium
YPDLNESR

SEQ ID NO: 58383 - protein, 5 aa, Mycobacterium avium
YPDRV

SEQ ID NO: 58384 - protein, 9 aa, Mycobacterium avium
YPDSAMAPE

SEQ ID NO: 58385 - protein, 4 aa, Mycobacterium avium
YPGG

SEQ ID NO: 58386 - protein, 7 aa, Mycobacterium avium
YPGVGPE

SEQ ID NO: 58387 - protein, 4 aa, Mycobacterium avium
YPHT

SEQ ID NO: 58388 - protein, 9 aa, Mycobacterium avium
YPKRDERLP

SEQ ID NO: 58389 - protein, 12 aa, Mycobacterium avium
YPLGASYDGAGT

SEQ ID NO: 58390 - protein, 7 aa, Mycobacterium avium
YPNYPDR

SEQ ID NO: 58391 - protein, 6 aa, Mycobacterium avium
YPPEVY

SEQ ID NO: 58392 - protein, 11 aa, Mycobacterium avium
YPPGRGPHTSA

SEQ ID NO: 58393 - protein, 8 aa, Mycobacterium avium
YPPKYARD

SEQ ID NO: 58394 - protein, 20 aa, Mycobacterium avium
YPPYAEYQTKTARQIPVFVL

SEQ ID NO: 58395 - protein, 5 aa, Mycobacterium avium
YPQYQ

SEQ ID NO: 58396 - protein, 9 aa, Mycobacterium avium
YPRGTENQR

SEQ ID NO: 58397 - protein, 8 aa, Mycobacterium avium
YPRQAPAV

SEQ ID NO: 58398 - protein, 5 aa, Mycobacterium avium
YPSGE

SEQ ID NO: 58399 - protein, 5 aa, Mycobacterium avium
YPSGH

SEQ ID NO: 58400 - protein, 11 aa, Mycobacterium avium
YPSHPSQGEGP

SEQ ID NO: 58401 - protein, 6 aa, Mycobacterium avium
YPSPER

SEQ ID NO: 58402 - protein, 12 aa, Mycobacterium avium
YPTHPPSAAGAA

SEQ ID NO: 58403 - protein, 6 aa, Mycobacterium avium
YPTNEK

SEQ ID NO: 58404 - protein, 4 aa, Mycobacterium avium
YPTP

SEQ ID NO: 58405 - protein, 11 aa, Mycobacterium avium
YPTSPWPTDPA

SEQ ID NO: 58406 - protein, 4 aa, Mycobacterium avium
YPVT

SEQ ID NO: 58407 - protein, 13 aa, Mycobacterium avium
YQATKDLPAATGD

SEQ ID NO: 58408 - protein, 9 aa, Mycobacterium avium
YQGAATGVG

SEQ ID NO: 58409 - protein, 8 aa, Mycobacterium avium
YQGERNDV

SEQ ID NO: 58410 - protein, 11 aa, Mycobacterium avium
YQHGERPAARG

SEQ ID NO: 58411 - protein, 5 aa, Mycobacterium avium
YQPAM

SEQ ID NO: 58412 - protein, 12 aa, Mycobacterium avium
YQPDPAEPTQAA

SEQ ID NO: 58413 - protein, 6 aa, Mycobacterium avium
YQPGLS

SEQ ID NO: 58414 - protein, 7 aa, Mycobacterium avium
YQPQEDS

SEQ ID NO: 58415 - protein, 9 aa, Mycobacterium avium
YQRPTEERA

SEQ ID NO: 58416 - protein, 5 aa, Mycobacterium avium
YQRRD

SEQ ID NO: 58417 - protein, 9 aa, Mycobacterium avium
YQSGRGTTA

SEQ ID NO: 58418 - protein, 10 aa, Mycobacterium avium
YQSPVTASYN

SEQ ID NO: 58419 - protein, 9 aa, Mycobacterium avium
YQSRQDPAL

SEQ ID NO: 58420 - protein, 14 aa, Mycobacterium avium
YRDETGSKVHTPEQ

SEQ ID NO: 58421 - protein, 5 aa, Mycobacterium avium
YRDRG

SEQ ID NO: 58422 - protein, 5 aa, Mycobacterium avium
YREDS

SEQ ID NO: 58423 - protein, 9 aa, Mycobacterium avium
YRGRRGITR

SEQ ID NO: 58424 - protein, 4 aa, Mycobacterium avium
YRGS

SEQ ID NO: 58425 - protein, 4 aa, Mycobacterium avium
YRPD

SEQ ID NO: 58426 - protein, 10 aa, Mycobacterium avium
YRRAAEGAEV

SEQ ID NO: 58427 - protein, 7 aa, Mycobacterium avium
YRREGKR

SEQ ID NO: 58428 - protein, 55 aa, Mycobacterium avium
YRTDSRESGKKPAGSTNGSSSSDSSSSTSDSSGSSAKSGSGEKAASSPAPAAAAA

SEQ ID NO: 58429 - protein, 6 aa, Mycobacterium avium
YRTQHG

SEQ ID NO: 58430 - protein, 19 aa, Mycobacterium avium
YSAADVSKGLGVNDSRVRQ

SEQ ID NO: 58431 - protein, 12 aa, Mycobacterium avium
YSAKAKAKELGF

SEQ ID NO: 58432 - protein, 15 aa, Mycobacterium avium
YSDPGMDGPTIARAT

SEQ ID NO: 58433 - protein, 9 aa, Mycobacterium avium
YSEAAGGNF

SEQ ID NO: 58434 - protein, 9 aa, Mycobacterium avium
YSEGAPEGW

SEQ ID NO: 58435 - protein, 16 aa, Mycobacterium avium
YSGADFPAGRQRLDAS

SEQ ID NO: 58436 - protein, 8 aa, Mycobacterium avium
YSGKGATD

SEQ ID NO: 58437 - protein, 9 aa, Mycobacterium avium
YSGPGSGSL

SEQ ID NO: 58438 - protein, 4 aa, Mycobacterium avium
YSGT

SEQ ID NO: 58439 - protein, 7 aa, Mycobacterium avium
YSIGGTQ

SEQ ID NO: 58440 - protein, 6 aa, Mycobacterium avium
YSPQSW

SEQ ID NO: 58441 - protein, 14 aa, Mycobacterium avium
YSRREVTDERNHRA

SEQ ID NO: 58442 - protein, 6 aa, Mycobacterium avium
YSSPAE

SEQ ID NO: 58443 - protein, 4 aa, Mycobacterium avium
YSSV

SEQ ID NO: 58444 - protein, 7 aa, Mycobacterium avium
YTASGLS

SEQ ID NO: 58445 - protein, 5 aa, Mycobacterium avium
YTDEE

SEQ ID NO: 58446 - protein, 9 aa, Mycobacterium avium
YTGPGAGPM

SEQ ID NO: 58447 - protein, 8 aa, Mycobacterium avium
YTGTGAQA

SEQ ID NO: 58448 - protein, 7 aa, Mycobacterium avium
YTPPVPA

SEQ ID NO: 58449 - protein, 9 aa, Mycobacterium avium
YTPRGLPSG

SEQ ID NO: 58450 - protein, 11 aa, Mycobacterium avium
YTTAEGRQVTA

SEQ ID NO: 58451 - protein, 4 aa, Mycobacterium avium
YTTE

SEQ ID NO: 58452 - protein, 7 aa, Mycobacterium avium
YYPQGAE

SEQ ID NO: 58453 - protein, 7 aa, Mycobacterium avium
YYRPAGG

SEQ ID NO: 58454 - protein, 6 aa, Mycobacterium avium
AAAAAA

SEQ ID NO: 58455 - protein, 16 aa, Mycobacterium avium
AAAAAAPAEPAAPATL

SEQ ID NO: 58456 - protein, 10 aa, Mycobacterium avium
AAAAAARTPD

SEQ ID NO: 58457 - protein, 18 aa, Mycobacterium avium
AAAAAATEHAKTREQFGK

SEQ ID NO: 58458 - protein, 16 aa, Mycobacterium avium
AAAAALAASTGPPPVE

SEQ ID NO: 58459 - protein, 6 aa, Mycobacterium avium
AAAAEE

SEQ ID NO: 58460 - protein, 18 aa, Mycobacterium avium
AAAAETGSSGGELSGDLG

SEQ ID NO: 58461 - protein, 5 aa, Mycobacterium avium
AAAAG

SEQ ID NO: 58462 - protein, 10 aa, Mycobacterium avium
AAAAGNGRAL

SEQ ID NO: 58463 - protein, 14 aa, Mycobacterium avium
AAAAGQGDAGLEGA

SEQ ID NO: 58464 - protein, 14 aa, Mycobacterium avium
AAAAPAEPAAPATL

SEQ ID NO: 58465 - protein, 21 aa, Mycobacterium avium
AAAAPPPPSMPPNPPRPGNAL

SEQ ID NO: 58466 - protein, 14 aa, Mycobacterium avium
AAAAPRAGRCGGGA

SEQ ID NO: 58467 - protein, 10 aa, Mycobacterium avium
AAAAQGVEAR

SEQ ID NO: 58468 - protein, 12 aa, Mycobacterium avium
AAAASATEHAKT

SEQ ID NO: 58469 - protein, 16 aa, Mycobacterium avium
AAAATARTRARQQAER

SEQ ID NO: 58470 - protein, 6 aa, Mycobacterium avium
AAAATD

SEQ ID NO: 58471 - protein, 52 aa, Mycobacterium avium
AAAATGTAEKPEPAEKLGRAEQSDPTAVDAGKTAAAPSPAAPGWTGARGTPT

SEQ ID NO: 58472 - protein, 52 aa, Mycobacterium avium
AAAATGTAEKPEPAEKPGRAEQSDPTAVDAGKTAAAPSPAAPGWTGARGTPT

SEQ ID NO: 58473 - protein, 46 aa, Mycobacterium avium
AAAATGTAEKPGPAEQSDPTAADAGKTAAAPSPAAPGWTGARGTPT

SEQ ID NO: 58474 - protein, 6 aa, Mycobacterium avium
AAADAD

SEQ ID NO: 58475 - protein, 9 aa, Mycobacterium avium
AAADAGPGA

SEQ ID NO: 58476 - protein, 18 aa, Mycobacterium avium
AAADPDRSFPPPTEPPRV

SEQ ID NO: 58477 - protein, 11 aa, Mycobacterium avium
AAADQGAGATV

SEQ ID NO: 58478 - protein, 8 aa, Mycobacterium avium
AAADRGHG

SEQ ID NO: 58479 - protein, 9 aa, Mycobacterium avium
AAADTPAAA

SEQ ID NO: 58480 - protein, 6 aa, Mycobacterium avium
AAAEAA

SEQ ID NO: 58481 - protein, 7 aa, Mycobacterium avium
AAAEAAQ

SEQ ID NO: 58482 - protein, 10 aa, Mycobacterium avium
AAAEAAQRQA

SEQ ID NO: 58483 - protein, 11 aa, Mycobacterium avium
AAAEAARPAPR

SEQ ID NO: 58484 - protein, 6 aa, Mycobacterium avium
AAAEAG

SEQ ID NO: 58485 - protein, 72 aa, Mycobacterium avium
AAAEDAKARADAELSERRARRDAARQRRDAAARELRDAERELRGAEGDCDTAEKASHAAAETLQQASARLRQ

SEQ ID NO: 58486 - protein, 7 aa, Mycobacterium avium
AAAEHKP

SEQ ID NO: 58487 - protein, 10 aa, Mycobacterium avium
AAAELGGGTQ

SEQ ID NO: 58488 - protein, 10 aa, Mycobacterium avium
AAAELPATAP

SEQ ID NO: 58489 - protein, 9 aa, Mycobacterium avium
AAAEPPTRE

SEQ ID NO: 58490 - protein, 9 aa, Mycobacterium avium
AAAEPQTRE

SEQ ID NO: 58491 - protein, 26 aa, Mycobacterium avium
AAAETGSTGTDSGAQVIPPTAGASEI

SEQ ID NO: 58492 - protein, 26 aa, Mycobacterium avium
AAAETGSTGTDSGAQVIPPTAGGSEI

SEQ ID NO: 58493 - protein, 5 aa, Mycobacterium avium
AAAEY

SEQ ID NO: 58494 - protein, 11 aa, Mycobacterium avium
AAAGAAPPMAP

SEQ ID NO: 58495 - protein, 8 aa, Mycobacterium avium
AAAGAESE

SEQ ID NO: 58496 - protein, 9 aa, Mycobacterium avium
AAAGAESET

SEQ ID NO: 58497 - protein, 7 aa, Mycobacterium avium
AAAGAGA

SEQ ID NO: 58498 - protein, 12 aa, Mycobacterium avium
AAAGAGNFPGEP

SEQ ID NO: 58499 - protein, 7 aa, Mycobacterium avium
AAAGDTS

SEQ ID NO: 58500 - protein, 12 aa, Mycobacterium avium
AAAGEPDLSPGA

SEQ ID NO: 58501 - protein, 17 aa, Mycobacterium avium
AAAGGALRDGAATTEGV

SEQ ID NO: 58502 - protein, 10 aa, Mycobacterium avium
AAAGGPQLDR

SEQ ID NO: 58503 - protein, 9 aa, Mycobacterium avium
AAAGGTATQ

SEQ ID NO: 58504 - protein, 9 aa, Mycobacterium avium
AAAGGTDND

SEQ ID NO: 58505 - protein, 9 aa, Mycobacterium avium
AAAGGTEND

SEQ ID NO: 58506 - protein, 18 aa, Mycobacterium avium
AAAGHPGPADYPVPPPRD

SEQ ID NO: 58507 - protein, 10 aa, Mycobacterium avium
AAAGLGNLPP

SEQ ID NO: 58508 - protein, 12 aa, Mycobacterium avium
AAAGPASSTSVV

SEQ ID NO: 58509 - protein, 9 aa, Mycobacterium avium
AAAGQAALT

SEQ ID NO: 58510 - protein, 17 aa, Mycobacterium avium
AAAGQTSVDEAAQEGMQ

SEQ ID NO: 58511 - protein, 11 aa, Mycobacterium avium
AAAGRGLTGGG

SEQ ID NO: 58512 - protein, 11 aa, Mycobacterium avium
AAAGSDPAAAV

SEQ ID NO: 58513 - protein, 8 aa, Mycobacterium avium
AAAGSDRR

SEQ ID NO: 58514 - protein, 11 aa, Mycobacterium avium
AAAGSDTAAAV

SEQ ID NO: 58515 - protein, 9 aa, Mycobacterium avium
AAAHGRGRD

SEQ ID NO: 58516 - protein, 7 aa, Mycobacterium avium
AAAISSD

SEQ ID NO: 58517 - protein, 7 aa, Mycobacterium avium
AAAKDSS

SEQ ID NO: 58518 - protein, 5 aa, Mycobacterium avium
AAAKE

SEQ ID NO: 58519 - protein, 9 aa, Mycobacterium avium
AAAKPQADK

SEQ ID NO: 58520 - protein, 26 aa, Mycobacterium avium
AAALGEATGLGAGTAAADATAPPSGI

SEQ ID NO: 58521 - protein, 6 aa, Mycobacterium avium
AAALGP

SEQ ID NO: 58522 - protein, 23 aa, Mycobacterium avium
AAANEGNSRQWRNTTTASWPRCS

SEQ ID NO: 58523 - protein, 10 aa, Mycobacterium avium
AAANGGAMTA

SEQ ID NO: 58524 - protein, 13 aa, Mycobacterium avium
AAANGQVAVRLGE

SEQ ID NO: 58525 - protein, 6 aa, Mycobacterium avium
AAANPS

SEQ ID NO: 58526 - protein, 15 aa, Mycobacterium avium
AAAPAWGKTAPAERA

SEQ ID NO: 58527 - protein, 23 aa, Mycobacterium avium
AAAPDCSPSGVNSTVSAVEGSAQ

SEQ ID NO: 58528 - protein, 9 aa, Mycobacterium avium
AAAPETATT

SEQ ID NO: 58529 - protein, 8 aa, Mycobacterium avium
AAAPGRPA

SEQ ID NO: 58530 - protein, 41 aa, Mycobacterium avium
AAAPQTDPAPPIVNSTSSDGSDSDDSGDDGGIVDNDGGNPY

SEQ ID NO: 58531 - protein, 41 aa, Mycobacterium avium
AAAPQTDPAPSIVNSTSSDGSDSDDSGDDGGIVDNDGGNPY

SEQ ID NO: 58532 - protein, 11 aa, Mycobacterium avium
AAAPSPGPTVS

SEQ ID NO: 58533 - protein, 29 aa, Mycobacterium avium
AAAPTVAAPEQPAQAPVEEDTNAETLSDS

SEQ ID NO: 58534 - protein, 29 aa, Mycobacterium avium
AAAPTVAAPEQPAQTPVEEDTNAETLSDS

SEQ ID NO: 58535 - protein, 10 aa, Mycobacterium avium
AAAQDSAARA

SEQ ID NO: 58536 - protein, 12 aa, Mycobacterium avium
AAAQFSASPESV

SEQ ID NO: 58537 - protein, 7 aa, Mycobacterium avium
AAAQPDR

SEQ ID NO: 58538 - protein, 11 aa, Mycobacterium avium
AAAQPVSPSTG

SEQ ID NO: 58539 - protein, 11 aa, Mycobacterium avium
AAAQRRGQPGA

SEQ ID NO: 58540 - protein, 9 aa, Mycobacterium avium
AAAQTVRAG

SEQ ID NO: 58541 - protein, 9 aa, Mycobacterium avium
AAAQTVRTG

SEQ ID NO: 58542 - protein, 9 aa, Mycobacterium avium
AAARESGRC

SEQ ID NO: 58543 - protein, 7 aa, Mycobacterium avium
AAAREVG

SEQ ID NO: 58544 - protein, 18 aa, Mycobacterium avium
AAARGDARDRRERQKNAR

SEQ ID NO: 58545 - protein, 6 aa, Mycobacterium avium
AAARPE

SEQ ID NO: 58546 - protein, 9 aa, Mycobacterium avium
AAARPPRPW

SEQ ID NO: 58547 - protein, 17 aa, Mycobacterium avium
AAARTAEQLRRSEYSGP

SEQ ID NO: 58548 - protein, 6 aa, Mycobacterium avium
AAARTE

SEQ ID NO: 58549 - protein, 7 aa, Mycobacterium avium
AAARYPA

SEQ ID NO: 58550 - protein, 24 aa, Mycobacterium avium
AAASARGDDAGAQRISAARKPTAA

SEQ ID NO: 58551 - protein, 11 aa, Mycobacterium avium
AAASGKTLGPR

SEQ ID NO: 58552 - protein, 9 aa, Mycobacterium avium
AAASPDAVA

SEQ ID NO: 58553 - protein, 7 aa, Mycobacterium avium
AAASREH

SEQ ID NO: 58554 - protein, 9 aa, Mycobacterium avium
AAASRPARP

SEQ ID NO: 58555 - protein, 20 aa, Mycobacterium avium
AAASSAADPGPGEAPTSSSR

SEQ ID NO: 58556 - protein, 51 aa, Mycobacterium avium
AAASTLPPFEPAKPATDPAGLARQAAATAQAAGTGAGDRAQGLGAAPQSMS

SEQ ID NO: 58557 - protein, 51 aa, Mycobacterium avium
AAASTLPPFEPAKPATDPAGLARQAAATAQAAGTGAGDSAQGLGAAPQPMS

SEQ ID NO: 58558 - protein, 51 aa, Mycobacterium avium
AAASTLPPFEPAKPATDPAGLARQAAATAQAAGTGAGDSAQGLGAAPQSMS

SEQ ID NO: 58559 - protein, 4 aa, Mycobacterium avium
AAAT

SEQ ID NO: 58560 - protein, 7 aa, Mycobacterium avium
AAATAYE

SEQ ID NO: 58561 - protein, 12 aa, Mycobacterium avium
AAATGHSPAAVR

SEQ ID NO: 58562 - protein, 15 aa, Mycobacterium avium
AAATGHSPAAVREHT

SEQ ID NO: 58563 - protein, 8 aa, Mycobacterium avium
AAATGKRA

SEQ ID NO: 58564 - protein, 8 aa, Mycobacterium avium
AAATKNNV

SEQ ID NO: 58565 - protein, 19 aa, Mycobacterium avium
AAATQRPDRLPGVGSSSHI

SEQ ID NO: 58566 - protein, 5 aa, Mycobacterium avium
AAATV

SEQ ID NO: 58567 - protein, 15 aa, Mycobacterium avium
AAAVGDPGGCGGERA

SEQ ID NO: 58568 - protein, 10 aa, Mycobacterium avium
AAAVTGDGGL

SEQ ID NO: 58569 - protein, 8 aa, Mycobacterium avium
AAAVTSDD

SEQ ID NO: 58570 - protein, 6 aa, Mycobacterium avium
AACPPE

SEQ ID NO: 58571 - protein, 7 aa, Mycobacterium avium
AADAEAV

SEQ ID NO: 58572 - protein, 7 aa, Mycobacterium avium
AADAGRT

SEQ ID NO: 58573 - protein, 9 aa, Mycobacterium avium
AADAPDTRR

SEQ ID NO: 58574 - protein, 6 aa, Mycobacterium avium
AADASA

SEQ ID NO: 58575 - protein, 9 aa, Mycobacterium avium
AADASTVAS

SEQ ID NO: 58576 - protein, 12 aa, Mycobacterium avium
AADDDEKRQRRD

SEQ ID NO: 58577 - protein, 8 aa, Mycobacterium avium
AADDERIA

SEQ ID NO: 58578 - protein, 10 aa, Mycobacterium avium
AADDPAAAAD

SEQ ID NO: 58579 - protein, 8 aa, Mycobacterium avium
AADEETHE

SEQ ID NO: 58580 - protein, 5 aa, Mycobacterium avium
AADEL

SEQ ID NO: 58581 - protein, 13 aa, Mycobacterium avium
AADEPESLDNERR

SEQ ID NO: 58582 - protein, 5 aa, Mycobacterium avium
AADER

SEQ ID NO: 58583 - protein, 60 aa, Mycobacterium avium
AADGAAGGGAQAPSQPSQPQAPAQPEPQAQEPAQAQPEAPAQPQAPAQPAPQESGGGAAT

SEQ ID NO: 58584 - protein, 10 aa, Mycobacterium avium
AADGPAAAAD

SEQ ID NO: 58585 - protein, 7 aa, Mycobacterium avium
AADGPME

SEQ ID NO: 58586 - protein, 11 aa, Mycobacterium avium
AADGSVSPPAL

SEQ ID NO: 58587 - protein, 10 aa, Mycobacterium avium
AADGVAAAAA

SEQ ID NO: 58588 - protein, 11 aa, Mycobacterium avium
AADKAAPELRA

SEQ ID NO: 58589 - protein, 7 aa, Mycobacterium avium
AADKGEL

SEQ ID NO: 58590 - protein, 16 aa, Mycobacterium avium
AADLDAPRTSPQGEVP

SEQ ID NO: 58591 - protein, 13 aa, Mycobacterium avium
AADLGEADTTPDN

SEQ ID NO: 58592 - protein, 18 aa, Mycobacterium avium
AADLSASSLREAADRGCT

SEQ ID NO: 58593 - protein, 6 aa, Mycobacterium avium
AADNAN

SEQ ID NO: 58594 - protein, 7 aa, Mycobacterium avium
AADPEDT

SEQ ID NO: 58595 - protein, 6 aa, Mycobacterium avium
AADPGC

SEQ ID NO: 58596 - protein, 11 aa, Mycobacterium avium
AADPGGAGSPL

SEQ ID NO: 58597 - protein, 17 aa, Mycobacterium avium
AADPQLAPAVRKAPGQC

SEQ ID NO: 58598 - protein, 5 aa, Mycobacterium avium
AADPR

SEQ ID NO: 58599 - protein, 12 aa, Mycobacterium avium
AADQASDPQTRR

SEQ ID NO: 58600 - protein, 10 aa, Mycobacterium avium
AADQELGDDA

SEQ ID NO: 58601 - protein, 7 aa, Mycobacterium avium
AADQGRD

SEQ ID NO: 58602 - protein, 6 aa, Mycobacterium avium
AADRET

SEQ ID NO: 58603 - protein, 8 aa, Mycobacterium avium
AADRNAHG

SEQ ID NO: 58604 - protein, 28 aa, Mycobacterium avium
AADSDVSNAHYGKRYRSSVGKRRPAPPL

SEQ ID NO: 58605 - protein, 7 aa, Mycobacterium avium
AADTGDL

SEQ ID NO: 58606 - protein, 16 aa, Mycobacterium avium
AADTPRCPGDQNPSRR

SEQ ID NO: 58607 - protein, 13 aa, Mycobacterium avium
AADTVHDADTETG

SEQ ID NO: 58608 - protein, 5 aa, Mycobacterium avium
AAEAA

SEQ ID NO: 58609 - protein, 9 aa, Mycobacterium avium
AAEAAQRQA

SEQ ID NO: 58610 - protein, 5 aa, Mycobacterium avium
AAEAI

SEQ ID NO: 58611 - protein, 5 aa, Mycobacterium avium
AAEAK

SEQ ID NO: 58612 - protein, 7 aa, Mycobacterium avium
AAEASRI

SEQ ID NO: 58613 - protein, 23 aa, Mycobacterium avium
AAEAVPGGTIAQKDHPRRRGEDA

SEQ ID NO: 58614 - protein, 71 aa, Mycobacterium avium
AAEDAKARADAELSEGKARRDAARQRRDAAARELRDAERELRGAEGDYDTAEKASRAAAETLQQARARLRQ

SEQ ID NO: 58615 - protein, 6 aa, Mycobacterium avium
AAEDEA

SEQ ID NO: 58616 - protein, 15 aa, Mycobacterium avium
AAEDKPVESHTTDHG

SEQ ID NO: 58617 - protein, 13 aa, Mycobacterium avium
AAEDLDGGDIRSA

SEQ ID NO: 58618 - protein, 7 aa, Mycobacterium avium
AAEEERL

SEQ ID NO: 58619 - protein, 41 aa, Mycobacterium avium
AAEEPDVPDDIEPVDDGPRRAHRGQIDGTPEDGDSLYDVVD

SEQ ID NO: 58620 - protein, 10 aa, Mycobacterium avium
AAEETTRARE

SEQ ID NO: 58621 - protein, 13 aa, Mycobacterium avium
AAEEVAAAGAASA

SEQ ID NO: 58622 - protein, 8 aa, Mycobacterium avium
AAEGAVGH

SEQ ID NO: 58623 - protein, 9 aa, Mycobacterium avium
AAEGEYIKS

SEQ ID NO: 58624 - protein, 5 aa, Mycobacterium avium
AAEGH

SEQ ID NO: 58625 - protein, 7 aa, Mycobacterium avium
AAEGIDT

SEQ ID NO: 58626 - protein, 9 aa, Mycobacterium avium
AAEGKGYER

SEQ ID NO: 58627 - protein, 7 aa, Mycobacterium avium
AAEGPGG

SEQ ID NO: 58628 - protein, 7 aa, Mycobacterium avium
AAEGVAG

SEQ ID NO: 58629 - protein, 7 aa, Mycobacterium avium
AAEHGAT

SEQ ID NO: 58630 - protein, 20 aa, Mycobacterium avium
AAEKEQAGDKPKESAESLNR

SEQ ID NO: 58631 - protein, 6 aa, Mycobacterium avium
AAEKSW

SEQ ID NO: 58632 - protein, 19 aa, Mycobacterium avium
AAELPGRRPHRRRHRADAR

SEQ ID NO: 58633 - protein, 52 aa, Mycobacterium avium
AAEPAAAPVVEPATEPGMAPAATEPAAQPAAEPVAADDPAGRTQAVKDRARE

SEQ ID NO: 58634 - protein, 9 aa, Mycobacterium avium
AAEPAEAPM

SEQ ID NO: 58635 - protein, 5 aa, Mycobacterium avium
AAEPD

SEQ ID NO: 58636 - protein, 11 aa, Mycobacterium avium
AAEPEAGTSGA

SEQ ID NO: 58637 - protein, 8 aa, Mycobacterium avium
AAEPGSDH

SEQ ID NO: 58638 - protein, 15 aa, Mycobacterium avium
AAEPGVAGRHSSNPV

SEQ ID NO: 58639 - protein, 5 aa, Mycobacterium avium
AAEPK

SEQ ID NO: 58640 - protein, 8 aa, Mycobacterium avium
AAEPKADL

SEQ ID NO: 58641 - protein, 11 aa, Mycobacterium avium
AAEPREDGERG

SEQ ID NO: 58642 - protein, 11 aa, Mycobacterium avium
AAEPRENGERG

SEQ ID NO: 58643 - protein, 6 aa, Mycobacterium avium
AAEPVA

SEQ ID NO: 58644 - protein, 8 aa, Mycobacterium avium
AAEQAGAG

SEQ ID NO: 58645 - protein, 28 aa, Mycobacterium avium
AAEQRQGAAADQRPAPGAAARHSRGAAV

SEQ ID NO: 58646 - protein, 6 aa, Mycobacterium avium
AAEQTE

SEQ ID NO: 58647 - protein, 6 aa, Mycobacterium avium
AAEREE

SEQ ID NO: 58648 - protein, 14 aa, Mycobacterium avium
AAEREGEDARAEPL

SEQ ID NO: 58649 - protein, 14 aa, Mycobacterium avium
AAEREGEDAREEPL

SEQ ID NO: 58650 - protein, 14 aa, Mycobacterium avium
AAEREGEGAREEPL

SEQ ID NO: 58651 - protein, 11 aa, Mycobacterium avium
AAERGRPRGCG

SEQ ID NO: 58652 - protein, 13 aa, Mycobacterium avium
AAERRHGEAVSRP

SEQ ID NO: 58653 - protein, 5 aa, Mycobacterium avium
AAERT

SEQ ID NO: 58654 - protein, 4 aa, Mycobacterium avium
AAES

SEQ ID NO: 58655 - protein, 9 aa, Mycobacterium avium
AAESGPPAI

SEQ ID NO: 58656 - protein, 9 aa, Mycobacterium avium
AAESGPPAV

SEQ ID NO: 58657 - protein, 9 aa, Mycobacterium avium
AAESNPTDK

SEQ ID NO: 58658 - protein, 14 aa, Mycobacterium avium
AAESTRGGTHDPNR

SEQ ID NO: 58659 - protein, 9 aa, Mycobacterium avium
AAETDVAPD

SEQ ID NO: 58660 - protein, 13 aa, Mycobacterium avium
AAETGDARYAADT

SEQ ID NO: 58661 - protein, 9 aa, Mycobacterium avium
AAEVTGSDG

SEQ ID NO: 58662 - protein, 5 aa, Mycobacterium avium
AAFGA

SEQ ID NO: 58663 - protein, 6 aa, Mycobacterium avium
AAFGPA

SEQ ID NO: 58664 - protein, 7 aa, Mycobacterium avium
AAGAAAA

SEQ ID NO: 58665 - protein, 9 aa, Mycobacterium avium
AAGAAASGV

SEQ ID NO: 58666 - protein, 38 aa, Mycobacterium avium
AAGAAGGHQSAAGGSGAGEAVGAAARRAAAGQRPGVRH

SEQ ID NO: 58667 - protein, 7 aa, Mycobacterium avium
AAGAAMA

SEQ ID NO: 58668 - protein, 9 aa, Mycobacterium avium
AAGAARSLD

SEQ ID NO: 58669 - protein, 9 aa, Mycobacterium avium
AAGAARSLE

SEQ ID NO: 58670 - protein, 5 aa, Mycobacterium avium
AAGAD

SEQ ID NO: 58671 - protein, 9 aa, Mycobacterium avium
AAGADPDDV

SEQ ID NO: 58672 - protein, 15 aa, Mycobacterium avium
AAGADPGQQLGEAGI

SEQ ID NO: 58673 - protein, 24 aa, Mycobacterium avium
AAGAETAGYGDPQLRTEEAARKNV

SEQ ID NO: 58674 - protein, 5 aa, Mycobacterium avium
AAGAF

SEQ ID NO: 58675 - protein, 9 aa, Mycobacterium avium
AAGAGAGDT

SEQ ID NO: 58676 - protein, 6 aa, Mycobacterium avium
AAGAGR

SEQ ID NO: 58677 - protein, 15 aa, Mycobacterium avium
AAGAPAADSLAPQYP

SEQ ID NO: 58678 - protein, 8 aa, Mycobacterium avium
AAGAPPHP

SEQ ID NO: 58679 - protein, 5 aa, Mycobacterium avium
AAGAT

SEQ ID NO: 58680 - protein, 7 aa, Mycobacterium avium
AAGATNE

SEQ ID NO: 58681 - protein, 8 aa, Mycobacterium avium
AAGATSID

SEQ ID NO: 58682 - protein, 9 aa, Mycobacterium avium
AAGATSTDT

SEQ ID NO: 58683 - protein, 4 aa, Mycobacterium avium
AAGD

SEQ ID NO: 58684 - protein, 12 aa, Mycobacterium avium
AAGDAPPVSDGS

SEQ ID NO: 58685 - protein, 8 aa, Mycobacterium avium
AAGDGDVR

SEQ ID NO: 58686 - protein, 11 aa, Mycobacterium avium
AAGEDPDFHKQ

SEQ ID NO: 58687 - protein, 5 aa, Mycobacterium avium
AAGEI

SEQ ID NO: 58688 - protein, 6 aa, Mycobacterium avium
AAGERG

SEQ ID NO: 58689 - protein, 9 aa, Mycobacterium avium
AAGESTASL

SEQ ID NO: 58690 - protein, 8 aa, Mycobacterium avium
AAGETGEM

SEQ ID NO: 58691 - protein, 6 aa, Mycobacterium avium
AAGFED

SEQ ID NO: 58692 - protein, 16 aa, Mycobacterium avium
AAGGDEGSGWAPYGGV

SEQ ID NO: 58693 - protein, 6 aa, Mycobacterium avium
AAGGDT

SEQ ID NO: 58694 - protein, 6 aa, Mycobacterium avium
AAGGGG

SEQ ID NO: 58695 - protein, 7 aa, Mycobacterium avium
AAGGHHD

SEQ ID NO: 58696 - protein, 6 aa, Mycobacterium avium
AAGGLD

SEQ ID NO: 58697 - protein, 8 aa, Mycobacterium avium
AAGGPDSA

SEQ ID NO: 58698 - protein, 5 aa, Mycobacterium avium
AAGGR

SEQ ID NO: 58699 - protein, 8 aa, Mycobacterium avium
AAGGRAND

SEQ ID NO: 58700 - protein, 6 aa, Mycobacterium avium
AAGGTE

SEQ ID NO: 58701 - protein, 7 aa, Mycobacterium avium
AAGGTEI

SEQ ID NO: 58702 - protein, 8 aa, Mycobacterium avium
AAGGVGAA

SEQ ID NO: 58703 - protein, 8 aa, Mycobacterium avium
AAGGWGAP

SEQ ID NO: 58704 - protein, 7 aa, Mycobacterium avium
AAGHGDP

SEQ ID NO: 58705 - protein, 7 aa, Mycobacterium avium
AAGIPAA

SEQ ID NO: 58706 - protein, 7 aa, Mycobacterium avium
AAGKGKM

SEQ ID NO: 58707 - protein, 7 aa, Mycobacterium avium
AAGLAAP

SEQ ID NO: 58708 - protein, 8 aa, Mycobacterium avium
AAGLGRTE

SEQ ID NO: 58709 - protein, 8 aa, Mycobacterium avium
AAGLPPLR

SEQ ID NO: 58710 - protein, 18 aa, Mycobacterium avium
AAGLQGAARDVEAGGGKA

SEQ ID NO: 58711 - protein, 7 aa, Mycobacterium avium
AAGNETA

SEQ ID NO: 58712 - protein, 18 aa, Mycobacterium avium
AAGNPLASGSAARPDPTA

SEQ ID NO: 58713 - protein, 6 aa, Mycobacterium avium
AAGPAA

SEQ ID NO: 58714 - protein, 9 aa, Mycobacterium avium
AAGPADDAA

SEQ ID NO: 58715 - protein, 9 aa, Mycobacterium avium
AAGPAPNVK

SEQ ID NO: 58716 - protein, 9 aa, Mycobacterium avium
AAGPDQPAL

SEQ ID NO: 58717 - protein, 10 aa, Mycobacterium avium
AAGPETGAAD

SEQ ID NO: 58718 - protein, 10 aa, Mycobacterium avium
AAGPETGAAG

SEQ ID NO: 58719 - protein, 12 aa, Mycobacterium avium
AAGPGERPPAYD

SEQ ID NO: 58720 - protein, 23 aa, Mycobacterium avium
AAGPGIRPRAAGAPRWSGRSARN

SEQ ID NO: 58721 - protein, 13 aa, Mycobacterium avium
AAGPPKGPAAPPV

SEQ ID NO: 58722 - protein, 12 aa, Mycobacterium avium
AAGPSASSSTSI

SEQ ID NO: 58723 - protein, 8 aa, Mycobacterium avium
AAGPTAAL

SEQ ID NO: 58724 - protein, 8 aa, Mycobacterium avium
AAGPTAVE

SEQ ID NO: 58725 - protein, 21 aa, Mycobacterium avium
AAGPTGQTTAPATGQTDHRGA

SEQ ID NO: 58726 - protein, 9 aa, Mycobacterium avium
AAGPTSTDT

SEQ ID NO: 58727 - protein, 7 aa, Mycobacterium avium
AAGQGRD

SEQ ID NO: 58728 - protein, 6 aa, Mycobacterium avium
AAGQKG

SEQ ID NO: 58729 - protein, 9 aa, Mycobacterium avium
AAGQPGSRS

SEQ ID NO: 58730 - protein, 10 aa, Mycobacterium avium
AAGRDPEQTK

SEQ ID NO: 58731 - protein, 7 aa, Mycobacterium avium
AAGRGTR

SEQ ID NO: 58732 - protein, 5 aa, Mycobacterium avium
AAGRP

SEQ ID NO: 58733 - protein, 28 aa, Mycobacterium avium
AAGRPAASSAGAATAEQEQGRSRRRPRS

SEQ ID NO: 58734 - protein, 8 aa, Mycobacterium avium
AAGRPDRP

SEQ ID NO: 58735 - protein, 19 aa, Mycobacterium avium
AAGRRRRAGHGAAGGPRRR

SEQ ID NO: 58736 - protein, 9 aa, Mycobacterium avium
AAGRSRAQS

SEQ ID NO: 58737 - protein, 5 aa, Mycobacterium avium
AAGRV

SEQ ID NO: 58738 - protein, 9 aa, Mycobacterium avium
AAGSAAFGR

SEQ ID NO: 58739 - protein, 7 aa, Mycobacterium avium
AAGSDQR

SEQ ID NO: 58740 - protein, 7 aa, Mycobacterium avium
AAGSDRR

SEQ ID NO: 58741 - protein, 6 aa, Mycobacterium avium
AAGSGL

SEQ ID NO: 58742 - protein, 5 aa, Mycobacterium avium
AAGSL

SEQ ID NO: 58743 - protein, 10 aa, Mycobacterium avium
AAGTDAAVGS

SEQ ID NO: 58744 - protein, 8 aa, Mycobacterium avium
AAGTDMDG

SEQ ID NO: 58745 - protein, 5 aa, Mycobacterium avium
AAGTL

SEQ ID NO: 58746 - protein, 15 aa, Mycobacterium avium
AAGTNNPPAANPGFS

SEQ ID NO: 58747 - protein, 14 aa, Mycobacterium avium
AAGTNNPPPANPGF

SEQ ID NO: 58748 - protein, 4 aa, Mycobacterium avium
AAGY

SEQ ID NO: 58749 - protein, 5 aa, Mycobacterium avium
AAGYD

SEQ ID NO: 58750 - protein, 8 aa, Mycobacterium avium
AAGYTQTT

SEQ ID NO: 58751 - protein, 19 aa, Mycobacterium avium
AAHGGGEYAPSAELATREQ

SEQ ID NO: 58752 - protein, 7 aa, Mycobacterium avium
AAHPENA

SEQ ID NO: 58753 - protein, 25 aa, Mycobacterium avium
AAHRGESEDQNPYSKTGARPGSTEW

SEQ ID NO: 58754 - protein, 11 aa, Mycobacterium avium
AAHRPLPADTE

SEQ ID NO: 58755 - protein, 11 aa, Mycobacterium avium
AAHRRNRDLAR

SEQ ID NO: 58756 - protein, 12 aa, Mycobacterium avium
AAHRRNRDLARA

SEQ ID NO: 58757 - protein, 5 aa, Mycobacterium avium
AAIAS

SEQ ID NO: 58758 - protein, 5 aa, Mycobacterium avium
AAIDP

SEQ ID NO: 58759 - protein, 5 aa, Mycobacterium avium
AAIGQ

SEQ ID NO: 58760 - protein, 6 aa, Mycobacterium avium
AAIGQP

SEQ ID NO: 58761 - protein, 11 aa, Mycobacterium avium
AAINPGNSGGA

SEQ ID NO: 58762 - protein, 6 aa, Mycobacterium avium
AAISSD

SEQ ID NO: 58763 - protein, 26 aa, Mycobacterium avium
AAKAAVAASEKTGRPVDPRVKKLAEN

SEQ ID NO: 58764 - protein, 10 aa, Mycobacterium avium
AAKAENDRTV

SEQ ID NO: 58765 - protein, 17 aa, Mycobacterium avium
AAKDGNGALRPKTDEAG

SEQ ID NO: 58766 - protein, 5 aa, Mycobacterium avium
AAKDT

SEQ ID NO: 58767 - protein, 9 aa, Mycobacterium avium
AAKEAGLTP

SEQ ID NO: 58768 - protein, 6 aa, Mycobacterium avium
AAKEQD

SEQ ID NO: 58769 - protein, 6 aa, Mycobacterium avium
AAKEQL

SEQ ID NO: 58770 - protein, 7 aa, Mycobacterium avium
AAKGGRT

SEQ ID NO: 58771 - protein, 10 aa, Mycobacterium avium
AAKKTFAETG

SEQ ID NO: 58772 - protein, 9 aa, Mycobacterium avium
AAKKYTDTP

SEQ ID NO: 58773 - protein, 13 aa, Mycobacterium avium
AAKMRSEQLRITS

SEQ ID NO: 58774 - protein, 14 aa, Mycobacterium avium
AAKNPSASAPVERS

SEQ ID NO: 58775 - protein, 9 aa, Mycobacterium avium
AAKPAEPVK

SEQ ID NO: 58776 - protein, 18 aa, Mycobacterium avium
AAKREYEASVSRAQAEAD

SEQ ID NO: 58777 - protein, 9 aa, Mycobacterium avium
AAKRSAQAA

SEQ ID NO: 58778 - protein, 9 aa, Mycobacterium avium
AAKRSPQAA

SEQ ID NO: 58779 - protein, 4 aa, Mycobacterium avium
AAKS

SEQ ID NO: 58780 - protein, 35 aa, Mycobacterium avium
AAKSDRPGDHASSAGAAADAAAAGTSDQPDEDLDD

SEQ ID NO: 58781 - protein, 6 aa, Mycobacterium avium
AAKSVT

SEQ ID NO: 58782 - protein, 6 aa, Mycobacterium avium
AAKTTG

SEQ ID NO: 58783 - protein, 5 aa, Mycobacterium avium
AALAG

SEQ ID NO: 58784 - protein, 13 aa, Mycobacterium avium
AALAGPPPAPPSI

SEQ ID NO: 58785 - protein, 13 aa, Mycobacterium avium
AALDAGAAATEGA

SEQ ID NO: 58786 - protein, 8 aa, Mycobacterium avium
AALDPSRP

SEQ ID NO: 58787 - protein, 17 aa, Mycobacterium avium
AALDSAARQIRSAGAPE

SEQ ID NO: 58788 - protein, 9 aa, Mycobacterium avium
AALEGAAEG

SEQ ID NO: 58789 - protein, 11 aa, Mycobacterium avium
AALESQDNGMN

SEQ ID NO: 58790 - protein, 5 aa, Mycobacterium avium
AALET

SEQ ID NO: 58791 - protein, 25 aa, Mycobacterium avium
AALGEATGRGAGTAAADATAPPSGI

SEQ ID NO: 58792 - protein, 25 aa, Mycobacterium avium
AALGEATGRGAGTVAADATAPPSGI

SEQ ID NO: 58793 - protein, 13 aa, Mycobacterium avium
AALGSRASDAIDK

SEQ ID NO: 58794 - protein, 8 aa, Mycobacterium avium
AALPDHRR

SEQ ID NO: 58795 - protein, 17 aa, Mycobacterium avium
AALPGSRTTTAAGTPGL

SEQ ID NO: 58796 - protein, 6 aa, Mycobacterium avium
AALQAG

SEQ ID NO: 58797 - protein, 16 aa, Mycobacterium avium
AALRSGEIDQAEYERR

SEQ ID NO: 58798 - protein, 8 aa, Mycobacterium avium
AALTRPAT

SEQ ID NO: 58799 - protein, 7 aa, Mycobacterium avium
AAMATGG

SEQ ID NO: 58800 - protein, 4 aa, Mycobacterium avium
AAMG

SEQ ID NO: 58801 - protein, 4 aa, Mycobacterium avium
AAMR

SEQ ID NO: 58802 - protein, 6 aa, Mycobacterium avium
AANNAL

SEQ ID NO: 58803 - protein, 8 aa, Mycobacterium avium
AANNPAAR

SEQ ID NO: 58804 - protein, 9 aa, Mycobacterium avium
AANPATTAS

SEQ ID NO: 58805 - protein, 6 aa, Mycobacterium avium
AANPRI

SEQ ID NO: 58806 - protein, 12 aa, Mycobacterium avium
AANRNSAQPIND

SEQ ID NO: 58807 - protein, 12 aa, Mycobacterium avium
AANTDPAEFPDP

SEQ ID NO: 58808 - protein, 8 aa, Mycobacterium avium
AANTTSAR

SEQ ID NO: 58809 - protein, 4 aa, Mycobacterium avium
AAPA

SEQ ID NO: 58810 - protein, 10 aa, Mycobacterium avium
AAPAGPPRPC

SEQ ID NO: 58811 - protein, 23 aa, Mycobacterium avium
AAPALDGGTGALAGEAAGFGADG

SEQ ID NO: 58812 - protein, 6 aa, Mycobacterium avium
AAPAPD

SEQ ID NO: 58813 - protein, 12 aa, Mycobacterium avium
AAPAPEPAQPTL

SEQ ID NO: 58814 - protein, 11 aa, Mycobacterium avium
AAPAPPGTPLP

SEQ ID NO: 58815 - protein, 11 aa, Mycobacterium avium
AAPAQYKQDSY

SEQ ID NO: 58816 - protein, 73 aa, Mycobacterium avium
AAPASTDGPSAPAPAAPQTAQPALPAQTAPPAQTAQPARPAPQPAAAPGNGASTRPAKPATPPPAEGDELQTL

SEQ ID NO: 58817 - protein, 73 aa, Mycobacterium avium
AAPASTDGPSAPAPAAPQTAQPAPPAQTAQPAQTAQPARPAPQPAAAPGNGASTRPAKPATPPPAEGDELQTL

SEQ ID NO: 58818 - protein, 7 aa, Mycobacterium avium
AAPATED

SEQ ID NO: 58819 - protein, 6 aa, Mycobacterium avium
AAPAVT

SEQ ID NO: 58820 - protein, 7 aa, Mycobacterium avium
AAPAVTL

SEQ ID NO: 58821 - protein, 5 aa, Mycobacterium avium
AAPDA

SEQ ID NO: 58822 - protein, 9 aa, Mycobacterium avium
AAPDAATTV

SEQ ID NO: 58823 - protein, 6 aa, Mycobacterium avium
AAPDAF

SEQ ID NO: 58824 - protein, 8 aa, Mycobacterium avium
AAPDSRYG

SEQ ID NO: 58825 - protein, 10 aa, Mycobacterium avium
AAPDTQRGLA

SEQ ID NO: 58826 - protein, 15 aa, Mycobacterium avium
AAPEVAKAAGGNGYS

SEQ ID NO: 58827 - protein, 5 aa, Mycobacterium avium
AAPGA

SEQ ID NO: 58828 - protein, 11 aa, Mycobacterium avium
AAPGASGPHHP

SEQ ID NO: 58829 - protein, 8 aa, Mycobacterium avium
AAPGEPPR

SEQ ID NO: 58830 - protein, 9 aa, Mycobacterium avium
AAPGLGKTK

SEQ ID NO: 58831 - protein, 6 aa, Mycobacterium avium
AAPKNG

SEQ ID NO: 58832 - protein, 7 aa, Mycobacterium avium
AAPPAPD

SEQ ID NO: 58833 - protein, 8 aa, Mycobacterium avium
AAPPENHG

SEQ ID NO: 58834 - protein, 10 aa, Mycobacterium avium
AAPPMPADTT

SEQ ID NO: 58835 - protein, 8 aa, Mycobacterium avium
AAPPNSEL

SEQ ID NO: 58836 - protein, 13 aa, Mycobacterium avium
AAPPPAPTPSIPP

SEQ ID NO: 58837 - protein, 6 aa, Mycobacterium avium
AAPPRF

SEQ ID NO: 58838 - protein, 9 aa, Mycobacterium avium
AAPPRRAHA

SEQ ID NO: 58839 - protein, 10 aa, Mycobacterium avium
AAPQQLPADQ

SEQ ID NO: 58840 - protein, 5 aa, Mycobacterium avium
AAPQV

SEQ ID NO: 58841 - protein, 4 aa, Mycobacterium avium
AAPR

SEQ ID NO: 58842 - protein, 10 aa, Mycobacterium avium
AAPRPPGTAP

SEQ ID NO: 58843 - protein, 45 aa, Mycobacterium avium
AAPRQRQRGGGQQAQYGARSSETHATPPAPDGRGHQKLINREYTN

SEQ ID NO: 58844 - protein, 40 aa, Mycobacterium avium
AAPRQRQRGGGQQAQYSARSSETHATPPAPDGPGPPKVNQ

SEQ ID NO: 58845 - protein, 6 aa, Mycobacterium avium
AAPRRP

SEQ ID NO: 58846 - protein, 9 aa, Mycobacterium avium
AAPSGGGAA

SEQ ID NO: 58847 - protein, 5 aa, Mycobacterium avium
AAPTA

SEQ ID NO: 58848 - protein, 11 aa, Mycobacterium avium
AAPTASPGPAV

SEQ ID NO: 58849 - protein, 9 aa, Mycobacterium avium
AAPTEDGDT

SEQ ID NO: 58850 - protein, 8 aa, Mycobacterium avium
AAPTLGQH

SEQ ID NO: 58851 - protein, 5 aa, Mycobacterium avium
AAPTT

SEQ ID NO: 58852 - protein, 9 aa, Mycobacterium avium
AAPTTFGGK

SEQ ID NO: 58853 - protein, 6 aa, Mycobacterium avium
AAPTVK

SEQ ID NO: 58854 - protein, 4 aa, Mycobacterium avium
AAQA

SEQ ID NO: 58855 - protein, 18 aa, Mycobacterium avium
AAQAAETAAQATAAATAY

SEQ ID NO: 58856 - protein, 8 aa, Mycobacterium avium
AAQAAPTL

SEQ ID NO: 58857 - protein, 9 aa, Mycobacterium avium
AAQADLSGR

SEQ ID NO: 58858 - protein, 14 aa, Mycobacterium avium
AAQAEAEKDSGVDS

SEQ ID NO: 58859 - protein, 9 aa, Mycobacterium avium
AAQAGQRRA

SEQ ID NO: 58860 - protein, 5 aa, Mycobacterium avium
AAQAQ

SEQ ID NO: 58861 - protein, 8 aa, Mycobacterium avium
AAQEPSGA

SEQ ID NO: 58862 - protein, 11 aa, Mycobacterium avium
AAQGAGSEQAD

SEQ ID NO: 58863 - protein, 9 aa, Mycobacterium avium
AAQGARRGD

SEQ ID NO: 58864 - protein, 16 aa, Mycobacterium avium
AAQGGESQFASGPAAH

SEQ ID NO: 58865 - protein, 8 aa, Mycobacterium avium
AAQGRDKQ

SEQ ID NO: 58866 - protein, 8 aa, Mycobacterium avium
AAQGRDRQ

SEQ ID NO: 58867 - protein, 6 aa, Mycobacterium avium
AAQHPD

SEQ ID NO: 58868 - protein, 4 aa, Mycobacterium avium
AAQL

SEQ ID NO: 58869 - protein, 15 aa, Mycobacterium avium
AAQLGDAVSKRAPEA

SEQ ID NO: 58870 - protein, 6 aa, Mycobacterium avium
AAQNQK

SEQ ID NO: 58871 - protein, 19 aa, Mycobacterium avium
AAQPGAAGRHADDLVGAQC

SEQ ID NO: 58872 - protein, 8 aa, Mycobacterium avium
AAQPGVRS

SEQ ID NO: 58873 - protein, 30 aa, Mycobacterium avium
AAQPSTGRRNPSRRKRLGARGSRQCPNTEA

SEQ ID NO: 58874 - protein, 41 aa, Mycobacterium avium
AAQPSTGRRNRSRRKRLGARGSRQCPNTEAPPLPRREPKRT

SEQ ID NO: 58875 - protein, 8 aa, Mycobacterium avium
AAQRHTQD

SEQ ID NO: 58876 - protein, 16 aa, Mycobacterium avium
AAQRVTDDLRTDGATA

SEQ ID NO: 58877 - protein, 17 aa, Mycobacterium avium
AAQRVTDDLRTGGATAL

SEQ ID NO: 58878 - protein, 18 aa, Mycobacterium avium
AAQRVTDDLRTGGATALG

SEQ ID NO: 58879 - protein, 4 aa, Mycobacterium avium
AAQT

SEQ ID NO: 58880 - protein, 7 aa, Mycobacterium avium
AAQTARN

SEQ ID NO: 58881 - protein, 20 aa, Mycobacterium avium
AAQTIGAAATAQAQLTGTFG

SEQ ID NO: 58882 - protein, 20 aa, Mycobacterium avium
AAQTIGAAATAQAQLTGVFG

SEQ ID NO: 58883 - protein, 7 aa, Mycobacterium avium
AAQTPDA

SEQ ID NO: 58884 - protein, 6 aa, Mycobacterium avium
AARAAL

SEQ ID NO: 58885 - protein, 6 aa, Mycobacterium avium
AARAAW

SEQ ID NO: 58886 - protein, 15 aa, Mycobacterium avium
AARADHAHGRAATGA

SEQ ID NO: 58887 - protein, 13 aa, Mycobacterium avium
AARADQAVAGRRE

SEQ ID NO: 58888 - protein, 7 aa, Mycobacterium avium
AARAGAD

SEQ ID NO: 58889 - protein, 8 aa, Mycobacterium avium
AARAGARA

SEQ ID NO: 58890 - protein, 8 aa, Mycobacterium avium
AARAGDDW

SEQ ID NO: 58891 - protein, 7 aa, Mycobacterium avium
AARAGGP

SEQ ID NO: 58892 - protein, 11 aa, Mycobacterium avium
AARAKATVGEI

SEQ ID NO: 58893 - protein, 13 aa, Mycobacterium avium
AARAPQPLDTSST

SEQ ID NO: 58894 - protein, 6 aa, Mycobacterium avium
AARARG

SEQ ID NO: 58895 - protein, 10 aa, Mycobacterium avium
AARATGMPYG

SEQ ID NO: 58896 - protein, 13 aa, Mycobacterium avium
AARDDDAPAVGTV

SEQ ID NO: 58897 - protein, 7 aa, Mycobacterium avium
AARDEER

SEQ ID NO: 58898 - protein, 5 aa, Mycobacterium avium
AARDK

SEQ ID NO: 58899 - protein, 27 aa, Mycobacterium avium
AARDRKAHGHIGTGADLGEQGGERGLD

SEQ ID NO: 58900 - protein, 6 aa, Mycobacterium avium
AARDRV

SEQ ID NO: 58901 - protein, 10 aa, Mycobacterium avium
AAREAGDNIA

SEQ ID NO: 58902 - protein, 7 aa, Mycobacterium avium
AAREDRA

SEQ ID NO: 58903 - protein, 16 aa, Mycobacterium avium
AAREDVPALETGERRR

SEQ ID NO: 58904 - protein, 10 aa, Mycobacterium avium
AARELAEETG

SEQ ID NO: 58905 - protein, 5 aa, Mycobacterium avium
AARET

SEQ ID NO: 58906 - protein, 6 aa, Mycobacterium avium
AARGAL

SEQ ID NO: 58907 - protein, 6 aa, Mycobacterium avium
AARGAT

SEQ ID NO: 58908 - protein, 14 aa, Mycobacterium avium
AARGDRPRQPRTPL

SEQ ID NO: 58909 - protein, 19 aa, Mycobacterium avium
AARGGDERRWDPEDPDPGL

SEQ ID NO: 58910 - protein, 23 aa, Mycobacterium avium
AARGIPRPPGGSGYYQPTGIEPY

SEQ ID NO: 58911 - protein, 7 aa, Mycobacterium avium
AARGPGC

SEQ ID NO: 58912 - protein, 18 aa, Mycobacterium avium
AARGRGDRTRWPAAGGRR

SEQ ID NO: 58913 - protein, 10 aa, Mycobacterium avium
AARGRSGRPW

SEQ ID NO: 58914 - protein, 9 aa, Mycobacterium avium
AARHRRREA

SEQ ID NO: 58915 - protein, 10 aa, Mycobacterium avium
AARHRRRESR

SEQ ID NO: 58916 - protein, 11 aa, Mycobacterium avium
AARHRRRESRI

SEQ ID NO: 58917 - protein, 10 aa, Mycobacterium avium
AARMGKPSEI

SEQ ID NO: 58918 - protein, 7 aa, Mycobacterium avium
AARPDKL

SEQ ID NO: 58919 - protein, 5 aa, Mycobacterium avium
AARPE

SEQ ID NO: 58920 - protein, 11 aa, Mycobacterium avium
AARPPAAPRPA

SEQ ID NO: 58921 - protein, 10 aa, Mycobacterium avium
AARPPEGDAA

SEQ ID NO: 58922 - protein, 8 aa, Mycobacterium avium
AARPPHST

SEQ ID NO: 58923 - protein, 8 aa, Mycobacterium avium
AARPQRPI

SEQ ID NO: 58924 - protein, 5 aa, Mycobacterium avium
AARPR

SEQ ID NO: 58925 - protein, 7 aa, Mycobacterium avium
AARPSQL

SEQ ID NO: 58926 - protein, 6 aa, Mycobacterium avium
AARPTP

SEQ ID NO: 58927 - protein, 9 aa, Mycobacterium avium
AARQDGVTY

SEQ ID NO: 58928 - protein, 6 aa, Mycobacterium avium
AARQRE

SEQ ID NO: 58929 - protein, 34 aa, Mycobacterium avium
AARQSENPPVDSEPPNGPPPPARWSRRKPEAAAR

SEQ ID NO: 58930 - protein, 8 aa, Mycobacterium avium
AARQTADR

SEQ ID NO: 58931 - protein, 18 aa, Mycobacterium avium
AARQTADRIGAAGGTATQ

SEQ ID NO: 58932 - protein, 11 aa, Mycobacterium avium
AARQTNTAQAR

SEQ ID NO: 58933 - protein, 5 aa, Mycobacterium avium
AARRA

SEQ ID NO: 58934 - protein, 17 aa, Mycobacterium avium
AARRAAREDHRRGRGRL

SEQ ID NO: 58935 - protein, 8 aa, Mycobacterium avium
AARRDGDR

SEQ ID NO: 58936 - protein, 8 aa, Mycobacterium avium
AARRNGVG

SEQ ID NO: 58937 - protein, 13 aa, Mycobacterium avium
AARSARLASEQAL

SEQ ID NO: 58938 - protein, 9 aa, Mycobacterium avium
AARSGHGLS

SEQ ID NO: 58939 - protein, 12 aa, Mycobacterium avium
AARSGKPTKVPR

SEQ ID NO: 58940 - protein, 13 aa, Mycobacterium avium
AARSGRAPTRGPV

SEQ ID NO: 58941 - protein, 14 aa, Mycobacterium avium
AARSGRAPTRGPVA

SEQ ID NO: 58942 - protein, 6 aa, Mycobacterium avium
AARSTT

SEQ ID NO: 58943 - protein, 5 aa, Mycobacterium avium
AARSY

SEQ ID NO: 58944 - protein, 8 aa, Mycobacterium avium
AARTAEEL

SEQ ID NO: 58945 - protein, 10 aa, Mycobacterium avium
AARTGLEPGT

SEQ ID NO: 58946 - protein, 6 aa, Mycobacterium avium
AARTTG

SEQ ID NO: 58947 - protein, 30 aa, Mycobacterium avium
AARVTSAAADYANQEATGAGEMAAVTRVAV

SEQ ID NO: 58948 - protein, 9 aa, Mycobacterium avium
AARYAGSGA

SEQ ID NO: 58949 - protein, 9 aa, Mycobacterium avium
AASAAAGVA

SEQ ID NO: 58950 - protein, 10 aa, Mycobacterium avium
AASAASGAPV

SEQ ID NO: 58951 - protein, 16 aa, Mycobacterium avium
AASAGGEPLELPDAGS

SEQ ID NO: 58952 - protein, 12 aa, Mycobacterium avium
AASAKAAPRAVP

SEQ ID NO: 58953 - protein, 9 aa, Mycobacterium avium
AASAPTAVP

SEQ ID NO: 58954 - protein, 5 aa, Mycobacterium avium
AASAS

SEQ ID NO: 58955 - protein, 9 aa, Mycobacterium avium
AASASTQLG

SEQ ID NO: 58956 - protein, 13 aa, Mycobacterium avium
AASAVAPRAYRAA

SEQ ID NO: 58957 - protein, 7 aa, Mycobacterium avium
AASDDSL

SEQ ID NO: 58958 - protein, 10 aa, Mycobacterium avium
AASEGQRPLD

SEQ ID NO: 58959 - protein, 9 aa, Mycobacterium avium
AASEHPQTL

SEQ ID NO: 58960 - protein, 12 aa, Mycobacterium avium
AASEIQNSGGGS

SEQ ID NO: 58961 - protein, 11 aa, Mycobacterium avium
AASESAGELTP

SEQ ID NO: 58962 - protein, 9 aa, Mycobacterium avium
AASFPAPQT

SEQ ID NO: 58963 - protein, 10 aa, Mycobacterium avium
AASGEEYRRS

SEQ ID NO: 58964 - protein, 16 aa, Mycobacterium avium
AASGGHRAGDRLGGRP

SEQ ID NO: 58965 - protein, 7 aa, Mycobacterium avium
AASGPDE

SEQ ID NO: 58966 - protein, 11 aa, Mycobacterium avium
AASGQPATSLG

SEQ ID NO: 58967 - protein, 27 aa, Mycobacterium avium
AASIDGRSRIQTGSSKSSAGGSQAHSG

SEQ ID NO: 58968 - protein, 9 aa, Mycobacterium avium
AASKTAQEH

SEQ ID NO: 58969 - protein, 4 aa, Mycobacterium avium
AASL

SEQ ID NO: 58970 - protein, 16 aa, Mycobacterium avium
AASLAADEARRLNLGD

SEQ ID NO: 58971 - protein, 12 aa, Mycobacterium avium
AASLSNSGQICM

SEQ ID NO: 58972 - protein, 17 aa, Mycobacterium avium
AASNRAGRTSIPDPEAA

SEQ ID NO: 58973 - protein, 4 aa, Mycobacterium avium
AASR

SEQ ID NO: 58974 - protein, 7 aa, Mycobacterium avium
AASRGEA

SEQ ID NO: 58975 - protein, 8 aa, Mycobacterium avium
AASRTAEI

SEQ ID NO: 58976 - protein, 10 aa, Mycobacterium avium
AASSKATDVD

SEQ ID NO: 58977 - protein, 10 aa, Mycobacterium avium
AASSPEIDSG

SEQ ID NO: 58978 - protein, 8 aa, Mycobacterium avium
AASSVARD

SEQ ID NO: 58979 - protein, 7 aa, Mycobacterium avium
AASTATQ

SEQ ID NO: 58980 - protein, 23 aa, Mycobacterium avium
AASTSTTSGATLTTRAGCGGAPR

SEQ ID NO: 58981 - protein, 4 aa, Mycobacterium avium
AASV

SEQ ID NO: 58982 - protein, 6 aa, Mycobacterium avium
AASVKG

SEQ ID NO: 58983 - protein, 4 aa, Mycobacterium avium
AATA

SEQ ID NO: 58984 - protein, 5 aa, Mycobacterium avium
AATAA

SEQ ID NO: 58985 - protein, 30 aa, Mycobacterium avium
AATAASKDADAKGPKHTPPNPKVRGRRKTR

SEQ ID NO: 58986 - protein, 8 aa, Mycobacterium avium
AATAERGG

SEQ ID NO: 58987 - protein, 9 aa, Mycobacterium avium
AATAGDDVR

SEQ ID NO: 58988 - protein, 22 aa, Mycobacterium avium
AATAGPRNTRPRRQFGGRPGYT

SEQ ID NO: 58989 - protein, 10 aa, Mycobacterium avium
AATANAMGRP

SEQ ID NO: 58990 - protein, 6 aa, Mycobacterium avium
AATARA

SEQ ID NO: 58991 - protein, 8 aa, Mycobacterium avium
AATASQRE

SEQ ID NO: 58992 - protein, 12 aa, Mycobacterium avium
AATATQGGTPIG

SEQ ID NO: 58993 - protein, 5 aa, Mycobacterium avium
AATAV

SEQ ID NO: 58994 - protein, 6 aa, Mycobacterium avium
AATDAH

SEQ ID NO: 58995 - protein, 8 aa, Mycobacterium avium
AATDETGM

SEQ ID NO: 58996 - protein, 10 aa, Mycobacterium avium
AATDFDADPG

SEQ ID NO: 58997 - protein, 17 aa, Mycobacterium avium
AATDGDMGPEPGLPAHD

SEQ ID NO: 58998 - protein, 15 aa, Mycobacterium avium
AATDPAVQGGQYYGP

SEQ ID NO: 58999 - protein, 6 aa, Mycobacterium avium
AATDPE

SEQ ID NO: 59000 - protein, 9 aa, Mycobacterium avium
AATDPQQAT

SEQ ID NO: 59001 - protein, 11 aa, Mycobacterium avium
AATEALATSSE

SEQ ID NO: 59002 - protein, 7 aa, Mycobacterium avium
AATEAVK

SEQ ID NO: 59003 - protein, 6 aa, Mycobacterium avium
AATEGT

SEQ ID NO: 59004 - protein, 5 aa, Mycobacterium avium
AATEN

SEQ ID NO: 59005 - protein, 4 aa, Mycobacterium avium
AATG

SEQ ID NO: 59006 - protein, 20 aa, Mycobacterium avium
AATGAPTAANEIDAGPLPVK

SEQ ID NO: 59007 - protein, 9 aa, Mycobacterium avium
AATGEHCEP

SEQ ID NO: 59008 - protein, 5 aa, Mycobacterium avium
AATGL

SEQ ID NO: 59009 - protein, 13 aa, Mycobacterium avium
AATGRLSSTEPNL

SEQ ID NO: 59010 - protein, 12 aa, Mycobacterium avium
AATGSRAFDAPA

SEQ ID NO: 59011 - protein, 8 aa, Mycobacterium avium
AATGVRPR

SEQ ID NO: 59012 - protein, 4 aa, Mycobacterium avium
AATL

SEQ ID NO: 59013 - protein, 10 aa, Mycobacterium avium
AATNPAAGTV

SEQ ID NO: 59014 - protein, 16 aa, Mycobacterium avium
AATPAAVEASGSPIPQ

SEQ ID NO: 59015 - protein, 15 aa, Mycobacterium avium
AATPAETAIPLMLFR

SEQ ID NO: 59016 - protein, 6 aa, Mycobacterium avium
AATPAL

SEQ ID NO: 59017 - protein, 7 aa, Mycobacterium avium
AATPAYG

SEQ ID NO: 59018 - protein, 27 aa, Mycobacterium avium
AATPDGRSDTVAATTSLPQFPAGEQDT

SEQ ID NO: 59019 - protein, 28 aa, Mycobacterium avium
AATPDGRSDTVAATTSLPQFPAGEQDTR

SEQ ID NO: 59020 - protein, 8 aa, Mycobacterium avium
AATPGESV

SEQ ID NO: 59021 - protein, 6 aa, Mycobacterium avium
AATPQP

SEQ ID NO: 59022 - protein, 11 aa, Mycobacterium avium
AATPRPPGTAP

SEQ ID NO: 59023 - protein, 19 aa, Mycobacterium avium
AATPSPAAPFTPPAAPFTP

SEQ ID NO: 59024 - protein, 9 aa, Mycobacterium avium
AATPSRAYA

SEQ ID NO: 59025 - protein, 7 aa, Mycobacterium avium
AATQAGF

SEQ ID NO: 59026 - protein, 7 aa, Mycobacterium avium
AATQATL

SEQ ID NO: 59027 - protein, 14 aa, Mycobacterium avium
AATQPALLSELRAG

SEQ ID NO: 59028 - protein, 9 aa, Mycobacterium avium
AATREQFGR

SEQ ID NO: 59029 - protein, 37 aa, Mycobacterium avium
AATRPVGGAAAAANSLGGVAAEADPAAATIIVIPCIE

SEQ ID NO: 59030 - protein, 9 aa, Mycobacterium avium
AATRTQRAR

SEQ ID NO: 59031 - protein, 6 aa, Mycobacterium avium
AATRVG

SEQ ID NO: 59032 - protein, 7 aa, Mycobacterium avium
AATSAED

SEQ ID NO: 59033 - protein, 16 aa, Mycobacterium avium
AATSYRAATAALGDAA

SEQ ID NO: 59034 - protein, 7 aa, Mycobacterium avium
AATTAAG

SEQ ID NO: 59035 - protein, 9 aa, Mycobacterium avium
AATTAAGTA

SEQ ID NO: 59036 - protein, 5 aa, Mycobacterium avium
AATTD

SEQ ID NO: 59037 - protein, 6 aa, Mycobacterium avium
AATTST

SEQ ID NO: 59038 - protein, 7 aa, Mycobacterium avium
AATTTTD

SEQ ID NO: 59039 - protein, 14 aa, Mycobacterium avium
AAVDDAVDRARAAQ

SEQ ID NO: 59040 - protein, 17 aa, Mycobacterium avium
AAVGASRAAVDSGYYPG

SEQ ID NO: 59041 - protein, 9 aa, Mycobacterium avium
AAVGRRRRK

SEQ ID NO: 59042 - protein, 9 aa, Mycobacterium avium
AAVGTAAET

SEQ ID NO: 59043 - protein, 11 aa, Mycobacterium avium
AAVQTAEPTAT

SEQ ID NO: 59044 - protein, 11 aa, Mycobacterium avium
AAVRRNAKGVG

SEQ ID NO: 59045 - protein, 8 aa, Mycobacterium avium
AAVSPTAT

SEQ ID NO: 59046 - protein, 6 aa, Mycobacterium avium
AAVTEA

SEQ ID NO: 59047 - protein, 6 aa, Mycobacterium avium
AAVTGG

SEQ ID NO: 59048 - protein, 8 aa, Mycobacterium avium
AAVTPDDV

SEQ ID NO: 59049 - protein, 6 aa, Mycobacterium avium
AAVTQA

SEQ ID NO: 59050 - protein, 8 aa, Mycobacterium avium
AAYAQADN

SEQ ID NO: 59051 - protein, 6 aa, Mycobacterium avium
AAYGAQ

SEQ ID NO: 59052 - protein, 7 aa, Mycobacterium avium
AAYGAQD

SEQ ID NO: 59053 - protein, 4 aa, Mycobacterium avium
AAYP

SEQ ID NO: 59054 - protein, 15 aa, Mycobacterium avium
AAYQERQTRALTSER

SEQ ID NO: 59055 - protein, 5 aa, Mycobacterium avium
AAYSP

SEQ ID NO: 59056 - protein, 9 aa, Mycobacterium avium
ACADPGDEE

SEQ ID NO: 59057 - protein, 11 aa, Mycobacterium avium
ACATGNDAIRN

SEQ ID NO: 59058 - protein, 12 aa, Mycobacterium avium
ACATGNDAIRNG

SEQ ID NO: 59059 - protein, 4 aa, Mycobacterium avium
ACDP

SEQ ID NO: 59060 - protein, 5 aa, Mycobacterium avium
ACGPA

SEQ ID NO: 59061 - protein, 7 aa, Mycobacterium avium
ACGSGNA

SEQ ID NO: 59062 - protein, 7 aa, Mycobacterium avium
ACGSGNT

SEQ ID NO: 59063 - protein, 6 aa, Mycobacterium avium
ACGTPV

SEQ ID NO: 59064 - protein, 4 aa, Mycobacterium avium
ACNE

SEQ ID NO: 59065 - protein, 11 aa, Mycobacterium avium
ACQEGGTSFHG

SEQ ID NO: 59066 - protein, 7 aa, Mycobacterium avium
ACQGRNR

SEQ ID NO: 59067 - protein, 8 aa, Mycobacterium avium
ACRTGGSS

SEQ ID NO: 59068 - protein, 6 aa, Mycobacterium avium
ACSPPR

SEQ ID NO: 59069 - protein, 7 aa, Mycobacterium avium
ACSPPRL

SEQ ID NO: 59070 - protein, 8 aa, Mycobacterium avium
ACTDPEED

SEQ ID NO: 59071 - protein, 17 aa, Mycobacterium avium
ADAAAVDDAVDRARAAQ

SEQ ID NO: 59072 - protein, 17 aa, Mycobacterium avium
ADAAEADRRRAAGDTAP

SEQ ID NO: 59073 - protein, 14 aa, Mycobacterium avium
ADADAAADEGVGEI

SEQ ID NO: 59074 - protein, 15 aa, Mycobacterium avium
ADADAVRRAEKQAAS

SEQ ID NO: 59075 - protein, 15 aa, Mycobacterium avium
ADADAVRRAEKQAAT

SEQ ID NO: 59076 - protein, 15 aa, Mycobacterium avium
ADADAVRRTEKQAAS

SEQ ID NO: 59077 - protein, 9 aa, Mycobacterium avium
ADADDDRSE

SEQ ID NO: 59078 - protein, 7 aa, Mycobacterium avium
ADADESV

SEQ ID NO: 59079 - protein, 8 aa, Mycobacterium avium
ADADQVER

SEQ ID NO: 59080 - protein, 11 aa, Mycobacterium avium
ADADRTTPGEA

SEQ ID NO: 59081 - protein, 20 aa, Mycobacterium avium
ADAEGAATADLAASTGGSVP

SEQ ID NO: 59082 - protein, 8 aa, Mycobacterium avium
ADAESPMA

SEQ ID NO: 59083 - protein, 7 aa, Mycobacterium avium
ADAGAAQ

SEQ ID NO: 59084 - protein, 7 aa, Mycobacterium avium
ADAGDMR

SEQ ID NO: 59085 - protein, 10 aa, Mycobacterium avium
ADAGPSLTRG

SEQ ID NO: 59086 - protein, 15 aa, Mycobacterium avium
ADAGTPESAISGAGT

SEQ ID NO: 59087 - protein, 15 aa, Mycobacterium avium
ADAIDGEVRRVEIPP

SEQ ID NO: 59088 - protein, 8 aa, Mycobacterium avium
ADAKDPQM

SEQ ID NO: 59089 - protein, 4 aa, Mycobacterium avium
ADAL

SEQ ID NO: 59090 - protein, 5 aa, Mycobacterium avium
ADAPA

SEQ ID NO: 59091 - protein, 15 aa, Mycobacterium avium
ADAPATDAIVNGFRV

SEQ ID NO: 59092 - protein, 9 aa, Mycobacterium avium
ADAPKPYGD

SEQ ID NO: 59093 - protein, 19 aa, Mycobacterium avium
ADAPPADEIRRTPVPPAHT

SEQ ID NO: 59094 - protein, 11 aa, Mycobacterium avium
ADAPRVENGTQ

SEQ ID NO: 59095 - protein, 9 aa, Mycobacterium avium
ADAPVSGPV

SEQ ID NO: 59096 - protein, 4 aa, Mycobacterium avium
ADAQ

SEQ ID NO: 59097 - protein, 13 aa, Mycobacterium avium
ADAQRAAQTDHAR

SEQ ID NO: 59098 - protein, 8 aa, Mycobacterium avium
ADARDTVR

SEQ ID NO: 59099 - protein, 8 aa, Mycobacterium avium
ADARGPES

SEQ ID NO: 59100 - protein, 10 aa, Mycobacterium avium
ADARNKIRPD

SEQ ID NO: 59101 - protein, 37 aa, Mycobacterium avium
ADARRAADRPGGQTARRQPDHRRGHRRRPVGRRRPGL

SEQ ID NO: 59102 - protein, 50 aa, Mycobacterium avium
ADARRAASAGARRREAAAPENVEAPAVAQPEEESTQRRRHRAAAKQLGRG

SEQ ID NO: 59103 - protein, 8 aa, Mycobacterium avium
ADASDAMR

SEQ ID NO: 59104 - protein, 9 aa, Mycobacterium avium
ADASNLADR

SEQ ID NO: 59105 - protein, 34 aa, Mycobacterium avium
ADASQQAALPEPPQPAVQQPPAAPAGATPAPERA

SEQ ID NO: 59106 - protein, 4 aa, Mycobacterium avium
ADAT

SEQ ID NO: 59107 - protein, 5 aa, Mycobacterium avium
ADATA

SEQ ID NO: 59108 - protein, 34 aa, Mycobacterium avium
ADATGGPVVPPTIQRTGAVSGAHPSKLAMLERLD

SEQ ID NO: 59109 - protein, 34 aa, Mycobacterium avium
ADATGGPVVPPTVQRTGAVSGAHPSTLAMLERLD

SEQ ID NO: 59110 - protein, 5 aa, Mycobacterium avium
ADATI

SEQ ID NO: 59111 - protein, 13 aa, Mycobacterium avium
ADAVATSKSSTVA

SEQ ID NO: 59112 - protein, 6 aa, Mycobacterium avium
ADAVDD

SEQ ID NO: 59113 - protein, 10 aa, Mycobacterium avium
ADAVGKAAPV

SEQ ID NO: 59114 - protein, 5 aa, Mycobacterium avium
ADCNS

SEQ ID NO: 59115 - protein, 8 aa, Mycobacterium avium
ADDARPSR

SEQ ID NO: 59116 - protein, 20 aa, Mycobacterium avium
ADDDFSRQPSRFRGDRNREV

SEQ ID NO: 59117 - protein, 20 aa, Mycobacterium avium
ADDDFSRQPSRFRGDRNRQV

SEQ ID NO: 59118 - protein, 10 aa, Mycobacterium avium
ADDEADSVSG

SEQ ID NO: 59119 - protein, 8 aa, Mycobacterium avium
ADDEPYRA

SEQ ID NO: 59120 - protein, 10 aa, Mycobacterium avium
ADDGREHRNR

SEQ ID NO: 59121 - protein, 8 aa, Mycobacterium avium
ADDGRPGA

SEQ ID NO: 59122 - protein, 12 aa, Mycobacterium avium
ADDGTATEIATA

SEQ ID NO: 59123 - protein, 11 aa, Mycobacterium avium
ADDGTRTDADA

SEQ ID NO: 59124 - protein, 6 aa, Mycobacterium avium
ADDLPT

SEQ ID NO: 59125 - protein, 5 aa, Mycobacterium avium
ADDNR

SEQ ID NO: 59126 - protein, 101 aa, Mycobacterium avium
ADDPADAKDAGDDADETAADEPAAPDRPAPAGEAEPNGEPAPSGEAPPTGEPAQPVAATPPAAPPPGAPPPGAPPPAEPPADPGPAPGAAQPAPEPGSTPC

SEQ ID NO: 59127 - protein, 96 aa, Mycobacterium avium
ADDPADAKDAGDDADETAADEPGAPDRPAPAGEAEPSGEPAPSGEAAPTGEPAQPVEATPPAAPPPAAPPPGAPPADPGPAPAAAQPTPEPGSTPC

SEQ ID NO: 59128 - protein, 6 aa, Mycobacterium avium
ADDPVA

SEQ ID NO: 59129 - protein, 8 aa, Mycobacterium avium
ADDPWPPQ

SEQ ID NO: 59130 - protein, 5 aa, Mycobacterium avium
ADDQP

SEQ ID NO: 59131 - protein, 6 aa, Mycobacterium avium
ADDRGV

SEQ ID NO: 59132 - protein, 6 aa, Mycobacterium avium
ADDSQL

SEQ ID NO: 59133 - protein, 4 aa, Mycobacterium avium
ADDT

SEQ ID NO: 59134 - protein, 4 aa, Mycobacterium avium
ADDV

SEQ ID NO: 59135 - protein, 5 aa, Mycobacterium avium
ADDVL

SEQ ID NO: 59136 - protein, 18 aa, Mycobacterium avium
ADDVTVDTPYGPPSAPVT

SEQ ID NO: 59137 - protein, 9 aa, Mycobacterium avium
ADDYGTTAH

SEQ ID NO: 59138 - protein, 6 aa, Mycobacterium avium
ADEADL

SEQ ID NO: 59139 - protein, 14 aa, Mycobacterium avium
ADEAEAAAALDGGA

SEQ ID NO: 59140 - protein, 6 aa, Mycobacterium avium
ADEARG

SEQ ID NO: 59141 - protein, 8 aa, Mycobacterium avium
ADEASTAR

SEQ ID NO: 59142 - protein, 9 aa, Mycobacterium avium
ADEATRVRS

SEQ ID NO: 59143 - protein, 4 aa, Mycobacterium avium
ADEE

SEQ ID NO: 59144 - protein, 6 aa, Mycobacterium avium
ADEFTR

SEQ ID NO: 59145 - protein, 9 aa, Mycobacterium avium
ADELESDRA

SEQ ID NO: 59146 - protein, 10 aa, Mycobacterium avium
ADELESDRAD

SEQ ID NO: 59147 - protein, 8 aa, Mycobacterium avium
ADELSRRG

SEQ ID NO: 59148 - protein, 4 aa, Mycobacterium avium
ADEM

SEQ ID NO: 59149 - protein, 12 aa, Mycobacterium avium
ADEQRPAGGQQL

SEQ ID NO: 59150 - protein, 4 aa, Mycobacterium avium
ADER

SEQ ID NO: 59151 - protein, 6 aa, Mycobacterium avium
ADERAA

SEQ ID NO: 59152 - protein, 9 aa, Mycobacterium avium
ADERDASEA

SEQ ID NO: 59153 - protein, 24 aa, Mycobacterium avium
ADERRDRRDGRPQPARADARGGGV

SEQ ID NO: 59154 - protein, 8 aa, Mycobacterium avium
ADESDGSL

SEQ ID NO: 59155 - protein, 6 aa, Mycobacterium avium
ADESPA

SEQ ID NO: 59156 - protein, 9 aa, Mycobacterium avium
ADESTPVPT

SEQ ID NO: 59157 - protein, 13 aa, Mycobacterium avium
ADESYQIGEEGHP

SEQ ID NO: 59158 - protein, 4 aa, Mycobacterium avium
ADET

SEQ ID NO: 59159 - protein, 8 aa, Mycobacterium avium
ADETEAAF

SEQ ID NO: 59160 - protein, 6 aa, Mycobacterium avium
ADFDPH

SEQ ID NO: 59161 - protein, 12 aa, Mycobacterium avium
ADFHGPSYQHPP

SEQ ID NO: 59162 - protein, 14 aa, Mycobacterium avium
ADFPAGPQRLSGPE

SEQ ID NO: 59163 - protein, 6 aa, Mycobacterium avium
ADFRDA

SEQ ID NO: 59164 - protein, 14 aa, Mycobacterium avium
ADFTPGKRLGPGLD

SEQ ID NO: 59165 - protein, 15 aa, Mycobacterium avium
ADFTPGKRRGPGLDE

SEQ ID NO: 59166 - protein, 5 aa, Mycobacterium avium
ADGAE

SEQ ID NO: 59167 - protein, 11 aa, Mycobacterium avium
ADGANDASNHI

SEQ ID NO: 59168 - protein, 9 aa, Mycobacterium avium
ADGCQGDPS

SEQ ID NO: 59169 - protein, 4 aa, Mycobacterium avium
ADGD

SEQ ID NO: 59170 - protein, 8 aa, Mycobacterium avium
ADGDEVPA

SEQ ID NO: 59171 - protein, 4 aa, Mycobacterium avium
ADGE

SEQ ID NO: 59172 - protein, 9 aa, Mycobacterium avium
ADGEAADDP

SEQ ID NO: 59173 - protein, 16 aa, Mycobacterium avium
ADGEGSVLAVRPTRDG

SEQ ID NO: 59174 - protein, 5 aa, Mycobacterium avium
ADGEI

SEQ ID NO: 59175 - protein, 18 aa, Mycobacterium avium
ADGELGAADEGIGPVQPT

SEQ ID NO: 59176 - protein, 8 aa, Mycobacterium avium
ADGGAARR

SEQ ID NO: 59177 - protein, 20 aa, Mycobacterium avium
ADGGNVAVSPDRTDVDTPPN

SEQ ID NO: 59178 - protein, 8 aa, Mycobacterium avium
ADGGVPSS

SEQ ID NO: 59179 - protein, 5 aa, Mycobacterium avium
ADGIG

SEQ ID NO: 59180 - protein, 10 aa, Mycobacterium avium
ADGNRQRAHY

SEQ ID NO: 59181 - protein, 4 aa, Mycobacterium avium
ADGP

SEQ ID NO: 59182 - protein, 10 aa, Mycobacterium avium
ADGPAVPGTA

SEQ ID NO: 59183 - protein, 9 aa, Mycobacterium avium
ADGPPVGEA

SEQ ID NO: 59184 - protein, 6 aa, Mycobacterium avium
ADGQHR

SEQ ID NO: 59185 - protein, 10 aa, Mycobacterium avium
ADGQRHRHET

SEQ ID NO: 59186 - protein, 4 aa, Mycobacterium avium
ADGR

SEQ ID NO: 59187 - protein, 9 aa, Mycobacterium avium
ADGRGRPYV

SEQ ID NO: 59188 - protein, 5 aa, Mycobacterium avium
ADGRI

SEQ ID NO: 59189 - protein, 10 aa, Mycobacterium avium
ADGSLDTAAA

SEQ ID NO: 59190 - protein, 8 aa, Mycobacterium avium
ADGSSAIA

SEQ ID NO: 59191 - protein, 6 aa, Mycobacterium avium
ADGSSL

SEQ ID NO: 59192 - protein, 7 aa, Mycobacterium avium
ADGSSLN

SEQ ID NO: 59193 - protein, 12 aa, Mycobacterium avium
ADGSTRNGPSIG

SEQ ID NO: 59194 - protein, 6 aa, Mycobacterium avium
ADGTDV

SEQ ID NO: 59195 - protein, 5 aa, Mycobacterium avium
ADGTI

SEQ ID NO: 59196 - protein, 11 aa, Mycobacterium avium
ADGTPTSEHRY

SEQ ID NO: 59197 - protein, 7 aa, Mycobacterium avium
ADGTTMG

SEQ ID NO: 59198 - protein, 4 aa, Mycobacterium avium
ADGV

SEQ ID NO: 59199 - protein, 10 aa, Mycobacterium avium
ADGVDPADVR

SEQ ID NO: 59200 - protein, 10 aa, Mycobacterium avium
ADGVDPANVR

SEQ ID NO: 59201 - protein, 7 aa, Mycobacterium avium
ADGVESA

SEQ ID NO: 59202 - protein, 11 aa, Mycobacterium avium
ADGVGGDARSW

SEQ ID NO: 59203 - protein, 7 aa, Mycobacterium avium
ADGYSET

SEQ ID NO: 59204 - protein, 10 aa, Mycobacterium avium
ADGYSRSGAG

SEQ ID NO: 59205 - protein, 6 aa, Mycobacterium avium
ADIDAT

SEQ ID NO: 59206 - protein, 6 aa, Mycobacterium avium
ADIKGG

SEQ ID NO: 59207 - protein, 7 aa, Mycobacterium avium
ADKKKTI

SEQ ID NO: 59208 - protein, 9 aa, Mycobacterium avium
ADKPKAEGI

SEQ ID NO: 59209 - protein, 4 aa, Mycobacterium avium
ADKR

SEQ ID NO: 59210 - protein, 6 aa, Mycobacterium avium
ADKRAA

SEQ ID NO: 59211 - protein, 16 aa, Mycobacterium avium
ADKRQRRERGSINPDD

SEQ ID NO: 59212 - protein, 10 aa, Mycobacterium avium
ADKSLQPGDV

SEQ ID NO: 59213 - protein, 7 aa, Mycobacterium avium
ADKSVRS

SEQ ID NO: 59214 - protein, 6 aa, Mycobacterium avium
ADKVAP

SEQ ID NO: 59215 - protein, 7 aa, Mycobacterium avium
ADLDDTA

SEQ ID NO: 59216 - protein, 14 aa, Mycobacterium avium
ADLGPRRALTGEPL

SEQ ID NO: 59217 - protein, 7 aa, Mycobacterium avium
ADLGPVA

SEQ ID NO: 59218 - protein, 19 aa, Mycobacterium avium
ADLPGGKHIEGTAGGIDDQ

SEQ ID NO: 59219 - protein, 8 aa, Mycobacterium avium
ADLQRSAD

SEQ ID NO: 59220 - protein, 4 aa, Mycobacterium avium
ADLS

SEQ ID NO: 59221 - protein, 12 aa, Mycobacterium avium
ADLTPGSPGASV

SEQ ID NO: 59222 - protein, 7 aa, Mycobacterium avium
ADMPDGL

SEQ ID NO: 59223 - protein, 5 aa, Mycobacterium avium
ADNAP

SEQ ID NO: 59224 - protein, 8 aa, Mycobacterium avium
ADNAVRPD

SEQ ID NO: 59225 - protein, 17 aa, Mycobacterium avium
ADNDNNTLIPNNKRLND

SEQ ID NO: 59226 - protein, 7 aa, Mycobacterium avium
ADNGVSG

SEQ ID NO: 59227 - protein, 11 aa, Mycobacterium avium
ADNNQAAETGY

SEQ ID NO: 59228 - protein, 12 aa, Mycobacterium avium
ADNPEPGAPPID

SEQ ID NO: 59229 - protein, 14 aa, Mycobacterium avium
ADNSPNDHGDPDYD

SEQ ID NO: 59230 - protein, 15 aa, Mycobacterium avium
ADNTEAERFSPGERY

SEQ ID NO: 59231 - protein, 9 aa, Mycobacterium avium
ADPANEDDT

SEQ ID NO: 59232 - protein, 12 aa, Mycobacterium avium
ADPAPPGASQLP

SEQ ID NO: 59233 - protein, 6 aa, Mycobacterium avium
ADPARF

SEQ ID NO: 59234 - protein, 6 aa, Mycobacterium avium
ADPARP

SEQ ID NO: 59235 - protein, 8 aa, Mycobacterium avium
ADPARPLS

SEQ ID NO: 59236 - protein, 8 aa, Mycobacterium avium
ADPARPVS

SEQ ID NO: 59237 - protein, 12 aa, Mycobacterium avium
ADPARVDGDRPM

SEQ ID NO: 59238 - protein, 8 aa, Mycobacterium avium
ADPASVRR

SEQ ID NO: 59239 - protein, 14 aa, Mycobacterium avium
ADPDADPGALATPM

SEQ ID NO: 59240 - protein, 8 aa, Mycobacterium avium
ADPDARAD

SEQ ID NO: 59241 - protein, 16 aa, Mycobacterium avium
ADPDEAAPARRKDLSG

SEQ ID NO: 59242 - protein, 11 aa, Mycobacterium avium
ADPELGPVRQP

SEQ ID NO: 59243 - protein, 6 aa, Mycobacterium avium
ADPERC

SEQ ID NO: 59244 - protein, 13 aa, Mycobacterium avium
ADPEVAGSLTTAQ

SEQ ID NO: 59245 - protein, 5 aa, Mycobacterium avium
ADPGE

SEQ ID NO: 59246 - protein, 11 aa, Mycobacterium avium
ADPGEPGNPEV

SEQ ID NO: 59247 - protein, 7 aa, Mycobacterium avium
ADPGLSD

SEQ ID NO: 59248 - protein, 6 aa, Mycobacterium avium
ADPGRH

SEQ ID NO: 59249 - protein, 7 aa, Mycobacterium avium
ADPKLAK

SEQ ID NO: 59250 - protein, 8 aa, Mycobacterium avium
ADPLGGAS

SEQ ID NO: 59251 - protein, 6 aa, Mycobacterium avium
ADPNTA

SEQ ID NO: 59252 - protein, 18 aa, Mycobacterium avium
ADPPPPEVHEPAATAVQP

SEQ ID NO: 59253 - protein, 4 aa, Mycobacterium avium
ADPQ

SEQ ID NO: 59254 - protein, 7 aa, Mycobacterium avium
ADPQAIK

SEQ ID NO: 59255 - protein, 6 aa, Mycobacterium avium
ADPQFD

SEQ ID NO: 59256 - protein, 7 aa, Mycobacterium avium
ADPQHPG

SEQ ID NO: 59257 - protein, 8 aa, Mycobacterium avium
ADPQRTAE

SEQ ID NO: 59258 - protein, 7 aa, Mycobacterium avium
ADPQTRL

SEQ ID NO: 59259 - protein, 4 aa, Mycobacterium avium
ADPR

SEQ ID NO: 59260 - protein, 8 aa, Mycobacterium avium
ADPRESLD

SEQ ID NO: 59261 - protein, 6 aa, Mycobacterium avium
ADPRRV

SEQ ID NO: 59262 - protein, 9 aa, Mycobacterium avium
ADPRTAART

SEQ ID NO: 59263 - protein, 10 aa, Mycobacterium avium
ADPSRAGDNE

SEQ ID NO: 59264 - protein, 4 aa, Mycobacterium avium
ADPT

SEQ ID NO: 59265 - protein, 6 aa, Mycobacterium avium
ADPTSD

SEQ ID NO: 59266 - protein, 7 aa, Mycobacterium avium
ADPVDTE

SEQ ID NO: 59267 - protein, 12 aa, Mycobacterium avium
ADPVKVNPNGGA

SEQ ID NO: 59268 - protein, 5 aa, Mycobacterium avium
ADPYP

SEQ ID NO: 59269 - protein, 12 aa, Mycobacterium avium
ADQARKSDPQLA

SEQ ID NO: 59270 - protein, 5 aa, Mycobacterium avium
ADQDE

SEQ ID NO: 59271 - protein, 17 aa, Mycobacterium avium
ADQESPVRARRLLTAGV

SEQ ID NO: 59272 - protein, 6 aa, Mycobacterium avium
ADQLGG

SEQ ID NO: 59273 - protein, 6 aa, Mycobacterium avium
ADQLTA

SEQ ID NO: 59274 - protein, 5 aa, Mycobacterium avium
ADQLV

SEQ ID NO: 59275 - protein, 18 aa, Mycobacterium avium
ADQPGNRPWSPPRPAIHP

SEQ ID NO: 59276 - protein, 7 aa, Mycobacterium avium
ADQRNPA

SEQ ID NO: 59277 - protein, 9 aa, Mycobacterium avium
ADRAAATNS

SEQ ID NO: 59278 - protein, 6 aa, Mycobacterium avium
ADRAAR

SEQ ID NO: 59279 - protein, 5 aa, Mycobacterium avium
ADRAG

SEQ ID NO: 59280 - protein, 5 aa, Mycobacterium avium
ADRAH

SEQ ID NO: 59281 - protein, 10 aa, Mycobacterium avium
ADRAKPAVPF

SEQ ID NO: 59282 - protein, 12 aa, Mycobacterium avium
ADRARDLRQKPA

SEQ ID NO: 59283 - protein, 52 aa, Mycobacterium avium
ADRARGSGRRLGGPDRPGGGPGAHADPTGVTVRDSGDRRSPAADRRRRTDHG

SEQ ID NO: 59284 - protein, 8 aa, Mycobacterium avium
ADRDGTKQ

SEQ ID NO: 59285 - protein, 7 aa, Mycobacterium avium
ADRDKAI

SEQ ID NO: 59286 - protein, 13 aa, Mycobacterium avium
ADRGDLALALRAV

SEQ ID NO: 59287 - protein, 13 aa, Mycobacterium avium
ADRGDLAPALRAV

SEQ ID NO: 59288 - protein, 6 aa, Mycobacterium avium
ADRKGG

SEQ ID NO: 59289 - protein, 4 aa, Mycobacterium avium
ADRM

SEQ ID NO: 59290 - protein, 5 aa, Mycobacterium avium
ADRPH

SEQ ID NO: 59291 - protein, 4 aa, Mycobacterium avium
ADRR

SEQ ID NO: 59292 - protein, 22 aa, Mycobacterium avium
ADRRAAGAAKLRARQRERDQQD

SEQ ID NO: 59293 - protein, 9 aa, Mycobacterium avium
ADRRGAGYR

SEQ ID NO: 59294 - protein, 8 aa, Mycobacterium avium
ADRSAGLA

SEQ ID NO: 59295 - protein, 21 aa, Mycobacterium avium
ADRSTGGSAAQRAARQAQAQA

SEQ ID NO: 59296 - protein, 4 aa, Mycobacterium avium
ADRT

SEQ ID NO: 59297 - protein, 6 aa, Mycobacterium avium
ADRTAG

SEQ ID NO: 59298 - protein, 22 aa, Mycobacterium avium
ADSDNDTADDTSDAPDDPQPPI

SEQ ID NO: 59299 - protein, 22 aa, Mycobacterium avium
ADSDNDTGDDTSDAPDDPQPPI

SEQ ID NO: 59300 - protein, 22 aa, Mycobacterium avium
ADSDNDTGDNTSDAPDDPQPPI

SEQ ID NO: 59301 - protein, 8 aa, Mycobacterium avium
ADSEGTTI

SEQ ID NO: 59302 - protein, 23 aa, Mycobacterium avium
ADSGATVTVTGTRAAATDYPDTD

SEQ ID NO: 59303 - protein, 5 aa, Mycobacterium avium
ADSGN

SEQ ID NO: 59304 - protein, 9 aa, Mycobacterium avium
ADSHPDGVT

SEQ ID NO: 59305 - protein, 22 aa, Mycobacterium avium
ADSPGGPTPPPIERTGAATGAH

SEQ ID NO: 59306 - protein, 5 aa, Mycobacterium avium
ADSPV

SEQ ID NO: 59307 - protein, 8 aa, Mycobacterium avium
ADSQDAAD

SEQ ID NO: 59308 - protein, 6 aa, Mycobacterium avium
ADSRTS

SEQ ID NO: 59309 - protein, 9 aa, Mycobacterium avium
ADSSGEAIR

SEQ ID NO: 59310 - protein, 13 aa, Mycobacterium avium
ADSSGPGPSPSRL

SEQ ID NO: 59311 - protein, 13 aa, Mycobacterium avium
ADSSPENRYTPSA

SEQ ID NO: 59312 - protein, 19 aa, Mycobacterium avium
ADSTSYQKQTPSDAQAITN

SEQ ID NO: 59313 - protein, 5 aa, Mycobacterium avium
ADSYI

SEQ ID NO: 59314 - protein, 6 aa, Mycobacterium avium
ADTASF

SEQ ID NO: 59315 - protein, 7 aa, Mycobacterium avium
ADTATVR

SEQ ID NO: 59316 - protein, 8 aa, Mycobacterium avium
ADTATVRV

SEQ ID NO: 59317 - protein, 13 aa, Mycobacterium avium
ADTATVRVGEASD

SEQ ID NO: 59318 - protein, 4 aa, Mycobacterium avium
ADTD

SEQ ID NO: 59319 - protein, 12 aa, Mycobacterium avium
ADTDLPPQTSAE

SEQ ID NO: 59320 - protein, 5 aa, Mycobacterium avium
ADTDV

SEQ ID NO: 59321 - protein, 4 aa, Mycobacterium avium
ADTG

SEQ ID NO: 59322 - protein, 6 aa, Mycobacterium avium
ADTGAA

SEQ ID NO: 59323 - protein, 7 aa, Mycobacterium avium
ADTGLDA

SEQ ID NO: 59324 - protein, 6 aa, Mycobacterium avium
ADTGTV

SEQ ID NO: 59325 - protein, 9 aa, Mycobacterium avium
ADTGVFPSD

SEQ ID NO: 59326 - protein, 8 aa, Mycobacterium avium
ADTGYGGP

SEQ ID NO: 59327 - protein, 5 aa, Mycobacterium avium
ADTLG

SEQ ID NO: 59328 - protein, 5 aa, Mycobacterium avium
ADTPV

SEQ ID NO: 59329 - protein, 4 aa, Mycobacterium avium
ADTR

SEQ ID NO: 59330 - protein, 5 aa, Mycobacterium avium
ADTSA

SEQ ID NO: 59331 - protein, 5 aa, Mycobacterium avium
ADTSS

SEQ ID NO: 59332 - protein, 7 aa, Mycobacterium avium
ADTTQRV

SEQ ID NO: 59333 - protein, 12 aa, Mycobacterium avium
ADTTQTTADPAS

SEQ ID NO: 59334 - protein, 6 aa, Mycobacterium avium
ADTTSF

SEQ ID NO: 59335 - protein, 8 aa, Mycobacterium avium
ADVGDQSG

SEQ ID NO: 59336 - protein, 14 aa, Mycobacterium avium
ADVPDHADSGDSVE

SEQ ID NO: 59337 - protein, 10 aa, Mycobacterium avium
ADVPGLGGAD

SEQ ID NO: 59338 - protein, 9 aa, Mycobacterium avium
ADVRDGQKV

SEQ ID NO: 59339 - protein, 9 aa, Mycobacterium avium
ADVRDKTAL

SEQ ID NO: 59340 - protein, 16 aa, Mycobacterium avium
ADVSKGLGVNDSRVRQ

SEQ ID NO: 59341 - protein, 18 aa, Mycobacterium avium
ADVSPNPYAEPANYTASA

SEQ ID NO: 59342 - protein, 5 aa, Mycobacterium avium
ADVSR

SEQ ID NO: 59343 - protein, 15 aa, Mycobacterium avium
ADVSRASCTGTSAPR

SEQ ID NO: 59344 - protein, 7 aa, Mycobacterium avium
ADVTPGS

SEQ ID NO: 59345 - protein, 9 aa, Mycobacterium avium
ADWDSTRDT

SEQ ID NO: 59346 - protein, 6 aa, Mycobacterium avium
ADYDPD

SEQ ID NO: 59347 - protein, 11 aa, Mycobacterium avium
ADYRRAEDAGI

SEQ ID NO: 59348 - protein, 4 aa, Mycobacterium avium
ADYT

SEQ ID NO: 59349 - protein, 4 aa, Mycobacterium avium
AEAA

SEQ ID NO: 59350 - protein, 9 aa, Mycobacterium avium
AEAAASKAL

SEQ ID NO: 59351 - protein, 7 aa, Mycobacterium avium
AEAAPVD

SEQ ID NO: 59352 - protein, 19 aa, Mycobacterium avium
AEAARREADTVKKRVSSEA

SEQ ID NO: 59353 - protein, 12 aa, Mycobacterium avium
AEAARTGIDGSD

SEQ ID NO: 59354 - protein, 7 aa, Mycobacterium avium
AEADESV

SEQ ID NO: 59355 - protein, 8 aa, Mycobacterium avium
AEADGATV

SEQ ID NO: 59356 - protein, 20 aa, Mycobacterium avium
AEADPDTAPTVRTPGMVGPD

SEQ ID NO: 59357 - protein, 7 aa, Mycobacterium avium
AEADPRG

SEQ ID NO: 59358 - protein, 8 aa, Mycobacterium avium
AEADPRGI

SEQ ID NO: 59359 - protein, 14 aa, Mycobacterium avium
AEADRRRAAGDTAP

SEQ ID NO: 59360 - protein, 6 aa, Mycobacterium avium
AEADRV

SEQ ID NO: 59361 - protein, 18 aa, Mycobacterium avium
AEAEAEVQRSIERFKAQE

SEQ ID NO: 59362 - protein, 18 aa, Mycobacterium avium
AEAEAEVQRSIERFKAQG

SEQ ID NO: 59363 - protein, 5 aa, Mycobacterium avium
AEAEI

SEQ ID NO: 59364 - protein, 7 aa, Mycobacterium avium
AEAEQLG

SEQ ID NO: 59365 - protein, 22 aa, Mycobacterium avium
AEAERVAAKGARTVSFPDSPVP

SEQ ID NO: 59366 - protein, 7 aa, Mycobacterium avium
AEAESGV

SEQ ID NO: 59367 - protein, 8 aa, Mycobacterium avium
AEAGATLA

SEQ ID NO: 59368 - protein, 9 aa, Mycobacterium avium
AEAGATLAD

SEQ ID NO: 59369 - protein, 10 aa, Mycobacterium avium
AEAGATLADS

SEQ ID NO: 59370 - protein, 13 aa, Mycobacterium avium
AEAGDAGLTEGEA

SEQ ID NO: 59371 - protein, 10 aa, Mycobacterium avium
AEAGGPDKPH

SEQ ID NO: 59372 - protein, 9 aa, Mycobacterium avium
AEAGSSNKA

SEQ ID NO: 59373 - protein, 35 aa, Mycobacterium avium
AEAGTGIAGTAGLGSLEPPAGLGQGASASVGQAGA

SEQ ID NO: 59374 - protein, 5 aa, Mycobacterium avium
AEAHR

SEQ ID NO: 59375 - protein, 10 aa, Mycobacterium avium
AEAKAAQTAA

SEQ ID NO: 59376 - protein, 15 aa, Mycobacterium avium
AEALRRQATAEGRSM

SEQ ID NO: 59377 - protein, 5 aa, Mycobacterium avium
AEAPE

SEQ ID NO: 59378 - protein, 16 aa, Mycobacterium avium
AEAPGQPGAGREPRVN

SEQ ID NO: 59379 - protein, 5 aa, Mycobacterium avium
AEAQE

SEQ ID NO: 59380 - protein, 12 aa, Mycobacterium avium
AEAQKAAAGQIG

SEQ ID NO: 59381 - protein, 11 aa, Mycobacterium avium
AEAQKAGAQRI

SEQ ID NO: 59382 - protein, 10 aa, Mycobacterium avium
AEAQKAGTQR

SEQ ID NO: 59383 - protein, 10 aa, Mycobacterium avium
AEAQKTAAGQ

SEQ ID NO: 59384 - protein, 11 aa, Mycobacterium avium
AEAQKTAAGQI

SEQ ID NO: 59385 - protein, 8 aa, Mycobacterium avium
AEAQRAAS

SEQ ID NO: 59386 - protein, 13 aa, Mycobacterium avium
AEAQRSGRGEIST

SEQ ID NO: 59387 - protein, 4 aa, Mycobacterium avium
AEAR

SEQ ID NO: 59388 - protein, 5 aa, Mycobacterium avium
AEARE

SEQ ID NO: 59389 - protein, 10 aa, Mycobacterium avium
AEASGRDPAE

SEQ ID NO: 59390 - protein, 6 aa, Mycobacterium avium
AEATLQ

SEQ ID NO: 59391 - protein, 12 aa, Mycobacterium avium
AEATSRAAARGA

SEQ ID NO: 59392 - protein, 17 aa, Mycobacterium avium
AEAVDEAAARAKASFES

SEQ ID NO: 59393 - protein, 70 aa, Mycobacterium avium
AEDAIARADAELSEGRARRDAARQRRDAAARELRDAERELRGAEGDYDTAEKASRAAAETLQQARARLRQ

SEQ ID NO: 59394 - protein, 10 aa, Mycobacterium avium
AEDATRNGRN

SEQ ID NO: 59395 - protein, 10 aa, Mycobacterium avium
AEDDDEPYYP

SEQ ID NO: 59396 - protein, 5 aa, Mycobacterium avium
AEDEL

SEQ ID NO: 59397 - protein, 4 aa, Mycobacterium avium
AEDF

SEQ ID NO: 59398 - protein, 17 aa, Mycobacterium avium
AEDGEGAAEALAEADAE

SEQ ID NO: 59399 - protein, 5 aa, Mycobacterium avium
AEDIT

SEQ ID NO: 59400 - protein, 10 aa, Mycobacterium avium
AEDPARGFLP

SEQ ID NO: 59401 - protein, 8 aa, Mycobacterium avium
AEDRGGRV

SEQ ID NO: 59402 - protein, 7 aa, Mycobacterium avium
AEDTRRV

SEQ ID NO: 59403 - protein, 10 aa, Mycobacterium avium
AEEAGTAKPK

SEQ ID NO: 59404 - protein, 7 aa, Mycobacterium avium
AEEAGYD

SEQ ID NO: 59405 - protein, 4 aa, Mycobacterium avium
AEEI

SEQ ID NO: 59406 - protein, 7 aa, Mycobacterium avium
AEEIQKD

SEQ ID NO: 59407 - protein, 11 aa, Mycobacterium avium
AEEPVGTRARE

SEQ ID NO: 59408 - protein, 8 aa, Mycobacterium avium
AEEQRSLR

SEQ ID NO: 59409 - protein, 8 aa, Mycobacterium avium
AEESPANL

SEQ ID NO: 59410 - protein, 12 aa, Mycobacterium avium
AEETDRNPPRLE

SEQ ID NO: 59411 - protein, 7 aa, Mycobacterium avium
AEETGIR

SEQ ID NO: 59412 - protein, 4 aa, Mycobacterium avium
AEEV

SEQ ID NO: 59413 - protein, 6 aa, Mycobacterium avium
AEEVHR

SEQ ID NO: 59414 - protein, 14 aa, Mycobacterium avium
AEFTPGKRLGPGLD

SEQ ID NO: 59415 - protein, 14 aa, Mycobacterium avium
AEGDKTVTRKSYEA

SEQ ID NO: 59416 - protein, 10 aa, Mycobacterium avium
AEGDPVRAAG

SEQ ID NO: 59417 - protein, 5 aa, Mycobacterium avium
AEGFR

SEQ ID NO: 59418 - protein, 6 aa, Mycobacterium avium
AEGGTS

SEQ ID NO: 59419 - protein, 7 aa, Mycobacterium avium
AEGHPQK

SEQ ID NO: 59420 - protein, 13 aa, Mycobacterium avium
AEGKATELANREG

SEQ ID NO: 59421 - protein, 10 aa, Mycobacterium avium
AEGNDAPVDE

SEQ ID NO: 59422 - protein, 7 aa, Mycobacterium avium
AEGPRSV

SEQ ID NO: 59423 - protein, 10 aa, Mycobacterium avium
AEGQPRGRAG

SEQ ID NO: 59424 - protein, 16 aa, Mycobacterium avium
AEGTPFPAADHRPGQT

SEQ ID NO: 59425 - protein, 16 aa, Mycobacterium avium
AEGTPFPAADRRPGQT

SEQ ID NO: 59426 - protein, 17 aa, Mycobacterium avium
AEGTPFPAADRRPGQTV

SEQ ID NO: 59427 - protein, 5 aa, Mycobacterium avium
AEGTV

SEQ ID NO: 59428 - protein, 5 aa, Mycobacterium avium
AEGVG

SEQ ID NO: 59429 - protein, 5 aa, Mycobacterium avium
AEGYR

SEQ ID NO: 59430 - protein, 23 aa, Mycobacterium avium
AEHPEQPAAPTGGAADLAAARTE

SEQ ID NO: 59431 - protein, 17 aa, Mycobacterium avium
AEHPEQPAEPTGGAADL

SEQ ID NO: 59432 - protein, 24 aa, Mycobacterium avium
AEHPEQPAEPTGGAADLAAARTEL

SEQ ID NO: 59433 - protein, 8 aa, Mycobacterium avium
AEHPKPID

SEQ ID NO: 59434 - protein, 8 aa, Mycobacterium avium
AEHPPGDR

SEQ ID NO: 59435 - protein, 8 aa, Mycobacterium avium
AEHRDPEA

SEQ ID NO: 59436 - protein, 5 aa, Mycobacterium avium
AEHTG

SEQ ID NO: 59437 - protein, 13 aa, Mycobacterium avium
AEIDTADAQNLEE

SEQ ID NO: 59438 - protein, 9 aa, Mycobacterium avium
AEIGEGNRL

SEQ ID NO: 59439 - protein, 5 aa, Mycobacterium avium
AEIPD

SEQ ID NO: 59440 - protein, 6 aa, Mycobacterium avium
AEITAE

SEQ ID NO: 59441 - protein, 13 aa, Mycobacterium avium
AEKGKALADELGN

SEQ ID NO: 59442 - protein, 9 aa, Mycobacterium avium
AEKLDDDAS

SEQ ID NO: 59443 - protein, 5 aa, Mycobacterium avium
AEKRR

SEQ ID NO: 59444 - protein, 19 aa, Mycobacterium avium
AEKSGGAPDPAFSDGNAMG

SEQ ID NO: 59445 - protein, 6 aa, Mycobacterium avium
AELDTA

SEQ ID NO: 59446 - protein, 13 aa, Mycobacterium avium
AELEQREQAAQEH

SEQ ID NO: 59447 - protein, 8 aa, Mycobacterium avium
AELGYGSD

SEQ ID NO: 59448 - protein, 11 aa, Mycobacterium avium
AELKPGSDTVD

SEQ ID NO: 59449 - protein, 6 aa, Mycobacterium avium
AELTAE

SEQ ID NO: 59450 - protein, 6 aa, Mycobacterium avium
AEMPTD

SEQ ID NO: 59451 - protein, 4 aa, Mycobacterium avium
AEMR

SEQ ID NO: 59452 - protein, 6 aa, Mycobacterium avium
AENARA

SEQ ID NO: 59453 - protein, 16 aa, Mycobacterium avium
AENDGLPPRFHLANLN

SEQ ID NO: 59454 - protein, 10 aa, Mycobacterium avium
AENGSGFRPL

SEQ ID NO: 59455 - protein, 7 aa, Mycobacterium avium
AENLSGA

SEQ ID NO: 59456 - protein, 5 aa, Mycobacterium avium
AENNA

SEQ ID NO: 59457 - protein, 10 aa, Mycobacterium avium
AENPDKRQEI

SEQ ID NO: 59458 - protein, 7 aa, Mycobacterium avium
AENPDLS

SEQ ID NO: 59459 - protein, 5 aa, Mycobacterium avium
AENPN

SEQ ID NO: 59460 - protein, 8 aa, Mycobacterium avium
AENSRYGG

SEQ ID NO: 59461 - protein, 13 aa, Mycobacterium avium
AENTAAPHAGAHG

SEQ ID NO: 59462 - protein, 13 aa, Mycobacterium avium
AENVPADDPHPTA

SEQ ID NO: 59463 - protein, 18 aa, Mycobacterium avium
AEPAGPRDPADPGDLLIR

SEQ ID NO: 59464 - protein, 18 aa, Mycobacterium avium
AEPAGPRDPAGPGDLLIR

SEQ ID NO: 59465 - protein, 18 aa, Mycobacterium avium
AEPAGPRGPADPGDLLIR

SEQ ID NO: 59466 - protein, 7 aa, Mycobacterium avium
AEPAGSS

SEQ ID NO: 59467 - protein, 5 aa, Mycobacterium avium
AEPAK

SEQ ID NO: 59468 - protein, 6 aa, Mycobacterium avium
AEPAPA

SEQ ID NO: 59469 - protein, 8 aa, Mycobacterium avium
AEPDPRRR

SEQ ID NO: 59470 - protein, 6 aa, Mycobacterium avium
AEPDTQ

SEQ ID NO: 59471 - protein, 7 aa, Mycobacterium avium
AEPDTQL

SEQ ID NO: 59472 - protein, 16 aa, Mycobacterium avium
AEPGAAALQDAGLPGE

SEQ ID NO: 59473 - protein, 8 aa, Mycobacterium avium
AEPGDQER

SEQ ID NO: 59474 - protein, 6 aa, Mycobacterium avium
AEPGDV

SEQ ID NO: 59475 - protein, 8 aa, Mycobacterium avium
AEPGLGDD

SEQ ID NO: 59476 - protein, 20 aa, Mycobacterium avium
AEPGSSDPAAPRTTARPDGD

SEQ ID NO: 59477 - protein, 4 aa, Mycobacterium avium
AEPH

SEQ ID NO: 59478 - protein, 7 aa, Mycobacterium avium
AEPPCPG

SEQ ID NO: 59479 - protein, 9 aa, Mycobacterium avium
AEPPPQSPL

SEQ ID NO: 59480 - protein, 9 aa, Mycobacterium avium
AEPPPRSPL

SEQ ID NO: 59481 - protein, 5 aa, Mycobacterium avium
AEPPS

SEQ ID NO: 59482 - protein, 6 aa, Mycobacterium avium
AEPQTV

SEQ ID NO: 59483 - protein, 9 aa, Mycobacterium avium
AEPRPSWGH

SEQ ID NO: 59484 - protein, 5 aa, Mycobacterium avium
AEPSE

SEQ ID NO: 59485 - protein, 4 aa, Mycobacterium avium
AEPT

SEQ ID NO: 59486 - protein, 16 aa, Mycobacterium avium
AEPTADAISTAATSEA

SEQ ID NO: 59487 - protein, 7 aa, Mycobacterium avium
AEPTPVR

SEQ ID NO: 59488 - protein, 4 aa, Mycobacterium avium
AEPY

SEQ ID NO: 59489 - protein, 11 aa, Mycobacterium avium
AEQAAQTGAQL

SEQ ID NO: 59490 - protein, 9 aa, Mycobacterium avium
AEQAEPDLD

SEQ ID NO: 59491 - protein, 12 aa, Mycobacterium avium
AEQAPLDTRGAE

SEQ ID NO: 59492 - protein, 16 aa, Mycobacterium avium
AEQCQQAAAQATAAAA

SEQ ID NO: 59493 - protein, 9 aa, Mycobacterium avium
AEQEPGGGR

SEQ ID NO: 59494 - protein, 5 aa, Mycobacterium avium
AEQGL

SEQ ID NO: 59495 - protein, 6 aa, Mycobacterium avium
AEQHGP

SEQ ID NO: 59496 - protein, 4 aa, Mycobacterium avium
AEQI

SEQ ID NO: 59497 - protein, 5 aa, Mycobacterium avium
AEQKQ

SEQ ID NO: 59498 - protein, 8 aa, Mycobacterium avium
AEQNRTPI

SEQ ID NO: 59499 - protein, 8 aa, Mycobacterium avium
AEQPARQG

SEQ ID NO: 59500 - protein, 5 aa, Mycobacterium avium
AEQRE

SEQ ID NO: 59501 - protein, 8 aa, Mycobacterium avium
AEQRPDAP

SEQ ID NO: 59502 - protein, 8 aa, Mycobacterium avium
AEQTRTPI

SEQ ID NO: 59503 - protein, 4 aa, Mycobacterium avium
AERA

SEQ ID NO: 59504 - protein, 5 aa, Mycobacterium avium
AERAG

SEQ ID NO: 59505 - protein, 9 aa, Mycobacterium avium
AERAKIDEA

SEQ ID NO: 59506 - protein, 16 aa, Mycobacterium avium
AERAQQTATQARAAAA

SEQ ID NO: 59507 - protein, 13 aa, Mycobacterium avium
AERASLAASRAAI

SEQ ID NO: 59508 - protein, 11 aa, Mycobacterium avium
AERAYATREAE

SEQ ID NO: 59509 - protein, 4 aa, Mycobacterium avium
AERE

SEQ ID NO: 59510 - protein, 6 aa, Mycobacterium avium
AERERV

SEQ ID NO: 59511 - protein, 4 aa, Mycobacterium avium
AERG

SEQ ID NO: 59512 - protein, 7 aa, Mycobacterium avium
AERGADA

SEQ ID NO: 59513 - protein, 12 aa, Mycobacterium avium
AERGEPAPDPEP

SEQ ID NO: 59514 - protein, 7 aa, Mycobacterium avium
AERGGEA

SEQ ID NO: 59515 - protein, 6 aa, Mycobacterium avium
AERGLS

SEQ ID NO: 59516 - protein, 8 aa, Mycobacterium avium
AERGRGVG

SEQ ID NO: 59517 - protein, 8 aa, Mycobacterium avium
AERGVRPG

SEQ ID NO: 59518 - protein, 14 aa, Mycobacterium avium
AERHGSKKSGKLAG

SEQ ID NO: 59519 - protein, 13 aa, Mycobacterium avium
AERLTGPAQIETG

SEQ ID NO: 59520 - protein, 4 aa, Mycobacterium avium
AERN

SEQ ID NO: 59521 - protein, 10 aa, Mycobacterium avium
AERPDVDPGR

SEQ ID NO: 59522 - protein, 5 aa, Mycobacterium avium
AERPL

SEQ ID NO: 59523 - protein, 6 aa, Mycobacterium avium
AERPNW

SEQ ID NO: 59524 - protein, 7 aa, Mycobacterium avium
AERPRVA

SEQ ID NO: 59525 - protein, 8 aa, Mycobacterium avium
AERQQRAT

SEQ ID NO: 59526 - protein, 12 aa, Mycobacterium avium
AERRGEPPSGHR

SEQ ID NO: 59527 - protein, 7 aa, Mycobacterium avium
AERRNAV

SEQ ID NO: 59528 - protein, 22 aa, Mycobacterium avium
AERRRALGKPYTKVEYQAEHPD

SEQ ID NO: 59529 - protein, 9 aa, Mycobacterium avium
AERSAGAHP

SEQ ID NO: 59530 - protein, 11 aa, Mycobacterium avium
AERSEIPSALP

SEQ ID NO: 59531 - protein, 12 aa, Mycobacterium avium
AERTAAVTSDDV

SEQ ID NO: 59532 - protein, 6 aa, Mycobacterium avium
AERTAG

SEQ ID NO: 59533 - protein, 12 aa, Mycobacterium avium
AERTKAVNEPTW

SEQ ID NO: 59534 - protein, 7 aa, Mycobacterium avium
AERTPVR

SEQ ID NO: 59535 - protein, 7 aa, Mycobacterium avium
AERVQPA

SEQ ID NO: 59536 - protein, 16 aa, Mycobacterium avium
AERYNQTNGTPGPDEM

SEQ ID NO: 59537 - protein, 17 aa, Mycobacterium avium
AERYNQTNGTPGPDEMT

SEQ ID NO: 59538 - protein, 6 aa, Mycobacterium avium
AESADR

SEQ ID NO: 59539 - protein, 13 aa, Mycobacterium avium
AESAGANSPYAGM

SEQ ID NO: 59540 - protein, 10 aa, Mycobacterium avium
AESAGDYSVA

SEQ ID NO: 59541 - protein, 8 aa, Mycobacterium avium
AESAGRPG

SEQ ID NO: 59542 - protein, 20 aa, Mycobacterium avium
AESARVPGEPVDRSGLPADV

SEQ ID NO: 59543 - protein, 8 aa, Mycobacterium avium
AESEEHGT

SEQ ID NO: 59544 - protein, 16 aa, Mycobacterium avium
AESGPAIASGAGMAEQ

SEQ ID NO: 59545 - protein, 6 aa, Mycobacterium avium
AESGTR

SEQ ID NO: 59546 - protein, 9 aa, Mycobacterium avium
AESHEYRRQ

SEQ ID NO: 59547 - protein, 6 aa, Mycobacterium avium
AESIAD

SEQ ID NO: 59548 - protein, 4 aa, Mycobacterium avium
AESL

SEQ ID NO: 59549 - protein, 6 aa, Mycobacterium avium
AESLPT

SEQ ID NO: 59550 - protein, 6 aa, Mycobacterium avium
AESPEK

SEQ ID NO: 59551 - protein, 10 aa, Mycobacterium avium
AESTGDYSVA

SEQ ID NO: 59552 - protein, 7 aa, Mycobacterium avium
AETAKDA

SEQ ID NO: 59553 - protein, 6 aa, Mycobacterium avium
AETDEA

SEQ ID NO: 59554 - protein, 5 aa, Mycobacterium avium
AETDT

SEQ ID NO: 59555 - protein, 5 aa, Mycobacterium avium
AETEL

SEQ ID NO: 59556 - protein, 12 aa, Mycobacterium avium
AETGAGQHGVAT

SEQ ID NO: 59557 - protein, 8 aa, Mycobacterium avium
AETGDASG

SEQ ID NO: 59558 - protein, 5 aa, Mycobacterium avium
AETGI

SEQ ID NO: 59559 - protein, 6 aa, Mycobacterium avium
AETHRP

SEQ ID NO: 59560 - protein, 11 aa, Mycobacterium avium
AETHSGAPFDP

SEQ ID NO: 59561 - protein, 6 aa, Mycobacterium avium
AETKRQ

SEQ ID NO: 59562 - protein, 12 aa, Mycobacterium avium
AETKRRTAEQLG

SEQ ID NO: 59563 - protein, 16 aa, Mycobacterium avium
AETPEPQGTSRNSVTA

SEQ ID NO: 59564 - protein, 8 aa, Mycobacterium avium
AETPIERK

SEQ ID NO: 59565 - protein, 6 aa, Mycobacterium avium
AETPTV

SEQ ID NO: 59566 - protein, 16 aa, Mycobacterium avium
AETRARRRNDQNVAAG

SEQ ID NO: 59567 - protein, 19 aa, Mycobacterium avium
AETRARRRNDQNVAGGLAD

SEQ ID NO: 59568 - protein, 8 aa, Mycobacterium avium
AETRRGRD

SEQ ID NO: 59569 - protein, 8 aa, Mycobacterium avium
AETTSAVS

SEQ ID NO: 59570 - protein, 6 aa, Mycobacterium avium
AETVGD

SEQ ID NO: 59571 - protein, 5 aa, Mycobacterium avium
AETYG

SEQ ID NO: 59572 - protein, 38 aa, Mycobacterium avium
AEVAAEGRVTAAAGEANAALSGGRTGGAGLAAAAGPLG

SEQ ID NO: 59573 - protein, 10 aa, Mycobacterium avium
AEVAEVSEQD

SEQ ID NO: 59574 - protein, 15 aa, Mycobacterium avium
AEVDDDDQMPSAEEL

SEQ ID NO: 59575 - protein, 6 aa, Mycobacterium avium
AEVESD

SEQ ID NO: 59576 - protein, 7 aa, Mycobacterium avium
AEVGSKP

SEQ ID NO: 59577 - protein, 4 aa, Mycobacterium avium
AEVP

SEQ ID NO: 59578 - protein, 4 aa, Mycobacterium avium
AEVQ

SEQ ID NO: 59579 - protein, 19 aa, Mycobacterium avium
AEVTAPANQATFGGGADPL

SEQ ID NO: 59580 - protein, 9 aa, Mycobacterium avium
AEYASTAEE

SEQ ID NO: 59581 - protein, 7 aa, Mycobacterium avium
AEYDGTE

SEQ ID NO: 59582 - protein, 4 aa, Mycobacterium avium
AEYG

SEQ ID NO: 59583 - protein, 6 aa, Mycobacterium avium
AEYGAR

SEQ ID NO: 59584 - protein, 6 aa, Mycobacterium avium
AEYPEA

SEQ ID NO: 59585 - protein, 6 aa, Mycobacterium avium
AEYPQA

SEQ ID NO: 59586 - protein, 41 aa, Mycobacterium avium
AEYPRGIGGEAVPSTHPLEPPPVEHTPPADAPVEHAPGGPH

SEQ ID NO: 59587 - protein, 42 aa, Mycobacterium avium
AEYPRGIGGEPVPGTHPLEPPPVEHTPPSADAPVEHAPGGPH

SEQ ID NO: 59588 - protein, 42 aa, Mycobacterium avium
AEYPRGIGGEPVPSTHPLEPPPVEHTPPPADAPVEHAPGGPH

SEQ ID NO: 59589 - protein, 4 aa, Mycobacterium avium
AFAG

SEQ ID NO: 59590 - protein, 6 aa, Mycobacterium avium
AFDGTD

SEQ ID NO: 59591 - protein, 10 aa, Mycobacterium avium
AFDSTDWSTN

SEQ ID NO: 59592 - protein, 5 aa, Mycobacterium avium
AFERA

SEQ ID NO: 59593 - protein, 6 aa, Mycobacterium avium
AFGGGA

SEQ ID NO: 59594 - protein, 8 aa, Mycobacterium avium
AFGGGNNV

SEQ ID NO: 59595 - protein, 9 aa, Mycobacterium avium
AFGQPGGGT

SEQ ID NO: 59596 - protein, 20 aa, Mycobacterium avium
AFPEGQPSQRQVLGWDLLIY

SEQ ID NO: 59597 - protein, 17 aa, Mycobacterium avium
AFPGSEVQAPKDRGYSY

SEQ ID NO: 59598 - protein, 5 aa, Mycobacterium avium
AFQDG

SEQ ID NO: 59599 - protein, 8 aa, Mycobacterium avium
AFQPQNAE

SEQ ID NO: 59600 - protein, 8 aa, Mycobacterium avium
AFQPQNAG

SEQ ID NO: 59601 - protein, 4 aa, Mycobacterium avium
AFRG

SEQ ID NO: 59602 - protein, 5 aa, Mycobacterium avium
AFSEP

SEQ ID NO: 59603 - protein, 5 aa, Mycobacterium avium
AFTDR

SEQ ID NO: 59604 - protein, 5 aa, Mycobacterium avium
AFTEP

SEQ ID NO: 59605 - protein, 10 aa, Mycobacterium avium
AFTPPPPRYK

SEQ ID NO: 59606 - protein, 5 aa, Mycobacterium avium
AGAAA

SEQ ID NO: 59607 - protein, 10 aa, Mycobacterium avium
AGAAADLSTI

SEQ ID NO: 59608 - protein, 9 aa, Mycobacterium avium
AGAAAPGVT

SEQ ID NO: 59609 - protein, 11 aa, Mycobacterium avium
AGAAGPDPYDV

SEQ ID NO: 59610 - protein, 10 aa, Mycobacterium avium
AGAAPAAASR

SEQ ID NO: 59611 - protein, 21 aa, Mycobacterium avium
AGAAPAAASRASVEEARPQTV

SEQ ID NO: 59612 - protein, 41 aa, Mycobacterium avium
AGAAVDGTSRAPEAARPQGGRAPAVGRTSTEAPGLNPAAAG

SEQ ID NO: 59613 - protein, 4 aa, Mycobacterium avium
AGAD

SEQ ID NO: 59614 - protein, 9 aa, Mycobacterium avium
AGADAPGVT

SEQ ID NO: 59615 - protein, 11 aa, Mycobacterium avium
AGADGVAAAAA

SEQ ID NO: 59616 - protein, 6 aa, Mycobacterium avium
AGADLS

SEQ ID NO: 59617 - protein, 7 aa, Mycobacterium avium
AGADPPI

SEQ ID NO: 59618 - protein, 6 aa, Mycobacterium avium
AGADPS

SEQ ID NO: 59619 - protein, 8 aa, Mycobacterium avium
AGADRQEE

SEQ ID NO: 59620 - protein, 6 aa, Mycobacterium avium
AGADSL

SEQ ID NO: 59621 - protein, 8 aa, Mycobacterium avium
AGADVADN

SEQ ID NO: 59622 - protein, 6 aa, Mycobacterium avium
AGADVG

SEQ ID NO: 59623 - protein, 6 aa, Mycobacterium avium
AGADVV

SEQ ID NO: 59624 - protein, 7 aa, Mycobacterium avium
AGAEPGA

SEQ ID NO: 59625 - protein, 21 aa, Mycobacterium avium
AGAESAISAETEAAASAASPA

SEQ ID NO: 59626 - protein, 8 aa, Mycobacterium avium
AGAETLAE

SEQ ID NO: 59627 - protein, 12 aa, Mycobacterium avium
AGAETTSRSTAS

SEQ ID NO: 59628 - protein, 5 aa, Mycobacterium avium
AGAEY

SEQ ID NO: 59629 - protein, 8 aa, Mycobacterium avium
AGAGAGDT

SEQ ID NO: 59630 - protein, 7 aa, Mycobacterium avium
AGAGDHD

SEQ ID NO: 59631 - protein, 5 aa, Mycobacterium avium
AGAGE

SEQ ID NO: 59632 - protein, 6 aa, Mycobacterium avium
AGAGRL

SEQ ID NO: 59633 - protein, 13 aa, Mycobacterium avium
AGAGSLSVGGKPL

SEQ ID NO: 59634 - protein, 8 aa, Mycobacterium avium
AGAGTLSI

SEQ ID NO: 59635 - protein, 20 aa, Mycobacterium avium
AGAGTTERAGDKPRRRQGRA

SEQ ID NO: 59636 - protein, 30 aa, Mycobacterium avium
AGAGTTERAGDKPRRRQGRAAEIAGGHTAA

SEQ ID NO: 59637 - protein, 5 aa, Mycobacterium avium
AGAGV

SEQ ID NO: 59638 - protein, 9 aa, Mycobacterium avium
AGAGVEPAE

SEQ ID NO: 59639 - protein, 8 aa, Mycobacterium avium
AGAGVGQA

SEQ ID NO: 59640 - protein, 18 aa, Mycobacterium avium
AGAHRTDPVGDRAQLSGH

SEQ ID NO: 59641 - protein, 12 aa, Mycobacterium avium
AGAISPHKSTLG

SEQ ID NO: 59642 - protein, 4 aa, Mycobacterium avium
AGAL

SEQ ID NO: 59643 - protein, 5 aa, Mycobacterium avium
AGALK

SEQ ID NO: 59644 - protein, 7 aa, Mycobacterium avium
AGALQAD

SEQ ID NO: 59645 - protein, 40 aa, Mycobacterium avium
AGALRGDGRRPVAPPRGRPDDRRDHAHRRNPGGRIARPGR

SEQ ID NO: 59646 - protein, 7 aa, Mycobacterium avium
AGAPDAV

SEQ ID NO: 59647 - protein, 8 aa, Mycobacterium avium
AGAPGALK

SEQ ID NO: 59648 - protein, 11 aa, Mycobacterium avium
AGAPGDETTSD

SEQ ID NO: 59649 - protein, 8 aa, Mycobacterium avium
AGAPGVAG

SEQ ID NO: 59650 - protein, 7 aa, Mycobacterium avium
AGAPQEI

SEQ ID NO: 59651 - protein, 10 aa, Mycobacterium avium
AGAPQETTHA

SEQ ID NO: 59652 - protein, 6 aa, Mycobacterium avium
AGAPRL

SEQ ID NO: 59653 - protein, 13 aa, Mycobacterium avium
AGAPSGDKGGSAN

SEQ ID NO: 59654 - protein, 7 aa, Mycobacterium avium
AGAPTSA

SEQ ID NO: 59655 - protein, 5 aa, Mycobacterium avium
AGAPV

SEQ ID NO: 59656 - protein, 5 aa, Mycobacterium avium
AGAPY

SEQ ID NO: 59657 - protein, 12 aa, Mycobacterium avium
AGAQAAGRDVAT

SEQ ID NO: 59658 - protein, 4 aa, Mycobacterium avium
AGAR

SEQ ID NO: 59659 - protein, 6 aa, Mycobacterium avium
AGARRH

SEQ ID NO: 59660 - protein, 7 aa, Mycobacterium avium
AGARRHA

SEQ ID NO: 59661 - protein, 4 aa, Mycobacterium avium
AGAS

SEQ ID NO: 59662 - protein, 5 aa, Mycobacterium avium
AGASR

SEQ ID NO: 59663 - protein, 74 aa, Mycobacterium avium
AGASSGSAQQPTAPPTAPPTMPPTMPPPPPPPSTPSTGGQAFGAAPPGQPGTSGDPTPGGSTPVSATAKGSTLT

SEQ ID NO: 59664 - protein, 74 aa, Mycobacterium avium
AGASSGSAQQPTAPTTMPPTMPPPTPPTAPPPSMPSTGGQAFGAAPPGQPGTSGDPTPGGSTPVSATAKGSTLT

SEQ ID NO: 59665 - protein, 75 aa, Mycobacterium avium
AGASSGSAQQPTAPTTMPPTMPPPTPPTAPPPSMPSTGGQAFGAAPPGQPGTSGDPTPGGSTPVSATAKGSTLTW

SEQ ID NO: 59666 - protein, 11 aa, Mycobacterium avium
AGASSPEAPLN

SEQ ID NO: 59667 - protein, 22 aa, Mycobacterium avium
AGATAAAAHTATSHADTPKTDA

SEQ ID NO: 59668 - protein, 8 aa, Mycobacterium avium
AGATPTGD

SEQ ID NO: 59669 - protein, 5 aa, Mycobacterium avium
AGATT

SEQ ID NO: 59670 - protein, 7 aa, Mycobacterium avium
AGATTGI

SEQ ID NO: 59671 - protein, 5 aa, Mycobacterium avium
AGATV

SEQ ID NO: 59672 - protein, 6 aa, Mycobacterium avium
AGAVGE

SEQ ID NO: 59673 - protein, 7 aa, Mycobacterium avium
AGAVTDR

SEQ ID NO: 59674 - protein, 4 aa, Mycobacterium avium
AGCG

SEQ ID NO: 59675 - protein, 8 aa, Mycobacterium avium
AGCGPGGR

SEQ ID NO: 59676 - protein, 7 aa, Mycobacterium avium
AGDDAGR

SEQ ID NO: 59677 - protein, 7 aa, Mycobacterium avium
AGDEDEL

SEQ ID NO: 59678 - protein, 7 aa, Mycobacterium avium
AGDESLE

SEQ ID NO: 59679 - protein, 14 aa, Mycobacterium avium
AGDETATELGSATL

SEQ ID NO: 59680 - protein, 9 aa, Mycobacterium avium
AGDEVPAPA

SEQ ID NO: 59681 - protein, 11 aa, Mycobacterium avium
AGDGAVAEAQR

SEQ ID NO: 59682 - protein, 11 aa, Mycobacterium avium
AGDGDGAGTAD

SEQ ID NO: 59683 - protein, 6 aa, Mycobacterium avium
AGDGGA

SEQ ID NO: 59684 - protein, 11 aa, Mycobacterium avium
AGDGPAVPGTA

SEQ ID NO: 59685 - protein, 15 aa, Mycobacterium avium
AGDGPRAAADPRAPD

SEQ ID NO: 59686 - protein, 11 aa, Mycobacterium avium
AGDGVRAGRAM

SEQ ID NO: 59687 - protein, 6 aa, Mycobacterium avium
AGDGYR

SEQ ID NO: 59688 - protein, 18 aa, Mycobacterium avium
AGDIGDGHPPVDPEVTSP

SEQ ID NO: 59689 - protein, 6 aa, Mycobacterium avium
AGDIGG

SEQ ID NO: 59690 - protein, 6 aa, Mycobacterium avium
AGDKKI

SEQ ID NO: 59691 - protein, 6 aa, Mycobacterium avium
AGDKSF

SEQ ID NO: 59692 - protein, 4 aa, Mycobacterium avium
AGDL

SEQ ID NO: 59693 - protein, 11 aa, Mycobacterium avium
AGDPNVGVTQP

SEQ ID NO: 59694 - protein, 14 aa, Mycobacterium avium
AGDPRSRAQRRADA

SEQ ID NO: 59695 - protein, 4 aa, Mycobacterium avium
AGDR

SEQ ID NO: 59696 - protein, 11 aa, Mycobacterium avium
AGDRAAPNDVG

SEQ ID NO: 59697 - protein, 5 aa, Mycobacterium avium
AGDRD

SEQ ID NO: 59698 - protein, 8 aa, Mycobacterium avium
AGDSAAHP

SEQ ID NO: 59699 - protein, 11 aa, Mycobacterium avium
AGDSPGSKYDK

SEQ ID NO: 59700 - protein, 13 aa, Mycobacterium avium
AGDSSDGRDFGAK

SEQ ID NO: 59701 - protein, 9 aa, Mycobacterium avium
AGDTAPGRK

SEQ ID NO: 59702 - protein, 8 aa, Mycobacterium avium
AGDTDAYR

SEQ ID NO: 59703 - protein, 7 aa, Mycobacterium avium
AGDTDVD

SEQ ID NO: 59704 - protein, 8 aa, Mycobacterium avium
AGDYLPPY

SEQ ID NO: 59705 - protein, 4 aa, Mycobacterium avium
AGEA

SEQ ID NO: 59706 - protein, 7 aa, Mycobacterium avium
AGEAARA

SEQ ID NO: 59707 - protein, 9 aa, Mycobacterium avium
AGEAEKAGE

SEQ ID NO: 59708 - protein, 7 aa, Mycobacterium avium
AGEAGKL

SEQ ID NO: 59709 - protein, 14 aa, Mycobacterium avium
AGEAGKLRTTINPK

SEQ ID NO: 59710 - protein, 10 aa, Mycobacterium avium
AGEASETEGG

SEQ ID NO: 59711 - protein, 6 aa, Mycobacterium avium
AGEATS

SEQ ID NO: 59712 - protein, 22 aa, Mycobacterium avium
AGEAVEAAAATAAGAAGAAARH

SEQ ID NO: 59713 - protein, 23 aa, Mycobacterium avium
AGEAVEAAAATALGAAGAAARHQ

SEQ ID NO: 59714 - protein, 23 aa, Mycobacterium avium
AGEAVEAAAATASGAAGAAARHQ

SEQ ID NO: 59715 - protein, 11 aa, Mycobacterium avium
AGEDEAEPGEI

SEQ ID NO: 59716 - protein, 9 aa, Mycobacterium avium
AGEEAARNK

SEQ ID NO: 59717 - protein, 15 aa, Mycobacterium avium
AGEEIPQTKEETRKR

SEQ ID NO: 59718 - protein, 15 aa, Mycobacterium avium
AGEEVPQTKEETRKR

SEQ ID NO: 59719 - protein, 9 aa, Mycobacterium avium
AGEFEARRR

SEQ ID NO: 59720 - protein, 5 aa, Mycobacterium avium
AGEGA

SEQ ID NO: 59721 - protein, 5 aa, Mycobacterium avium
AGEGG

SEQ ID NO: 59722 - protein, 11 aa, Mycobacterium avium
AGEGPANVGGP

SEQ ID NO: 59723 - protein, 11 aa, Mycobacterium avium
AGEGPGDVGGP

SEQ ID NO: 59724 - protein, 11 aa, Mycobacterium avium
AGEGPGNVGGP

SEQ ID NO: 59725 - protein, 4 aa, Mycobacterium avium
AGEL

SEQ ID NO: 59726 - protein, 15 aa, Mycobacterium avium
AGENADGPAASVIAG

SEQ ID NO: 59727 - protein, 9 aa, Mycobacterium avium
AGEPDARDA

SEQ ID NO: 59728 - protein, 8 aa, Mycobacterium avium
AGEPGTAA

SEQ ID NO: 59729 - protein, 29 aa, Mycobacterium avium
AGEPQASGKTYKVNGTLKQGISSESAKKI

SEQ ID NO: 59730 - protein, 10 aa, Mycobacterium avium
AGEPVGPESS

SEQ ID NO: 59731 - protein, 11 aa, Mycobacterium avium
AGEPVPPGEEG

SEQ ID NO: 59732 - protein, 8 aa, Mycobacterium avium
AGEQPTAT

SEQ ID NO: 59733 - protein, 7 aa, Mycobacterium avium
AGEQTVA

SEQ ID NO: 59734 - protein, 9 aa, Mycobacterium avium
AGERDPGRL

SEQ ID NO: 59735 - protein, 5 aa, Mycobacterium avium
AGERF

SEQ ID NO: 59736 - protein, 5 aa, Mycobacterium avium
AGESA

SEQ ID NO: 59737 - protein, 34 aa, Mycobacterium avium
AGESAAPEPDGPLSRGRATYRPPDEGRAARSSVP

SEQ ID NO: 59738 - protein, 8 aa, Mycobacterium avium
AGESAGRR

SEQ ID NO: 59739 - protein, 16 aa, Mycobacterium avium
AGESDGTDEDTAIEAD

SEQ ID NO: 59740 - protein, 5 aa, Mycobacterium avium
AGESM

SEQ ID NO: 59741 - protein, 8 aa, Mycobacterium avium
AGESQVGP

SEQ ID NO: 59742 - protein, 11 aa, Mycobacterium avium
AGETASRIGEL

SEQ ID NO: 59743 - protein, 10 aa, Mycobacterium avium
AGETDLPADE

SEQ ID NO: 59744 - protein, 11 aa, Mycobacterium avium
AGETDLPADEL

SEQ ID NO: 59745 - protein, 5 aa, Mycobacterium avium
AGETG

SEQ ID NO: 59746 - protein, 5 aa, Mycobacterium avium
AGETN

SEQ ID NO: 59747 - protein, 14 aa, Mycobacterium avium
AGETPGGGARSGEL

SEQ ID NO: 59748 - protein, 15 aa, Mycobacterium avium
AGETPGGGARSGELT

SEQ ID NO: 59749 - protein, 15 aa, Mycobacterium avium
AGETPGGGARSSELT

SEQ ID NO: 59750 - protein, 5 aa, Mycobacterium avium
AGFAT

SEQ ID NO: 59751 - protein, 13 aa, Mycobacterium avium
AGFDASAPTAWSA

SEQ ID NO: 59752 - protein, 7 aa, Mycobacterium avium
AGFGSST

SEQ ID NO: 59753 - protein, 5 aa, Mycobacterium avium
AGFPN

SEQ ID NO: 59754 - protein, 18 aa, Mycobacterium avium
AGFSGPANRMEPSPYLPT

SEQ ID NO: 59755 - protein, 9 aa, Mycobacterium avium
AGGAGLGTA

SEQ ID NO: 59756 - protein, 21 aa, Mycobacterium avium
AGGAGQHQPGDQGHGQRGQEA

SEQ ID NO: 59757 - protein, 9 aa, Mycobacterium avium
AGGARGVDE

SEQ ID NO: 59758 - protein, 10 aa, Mycobacterium avium
AGGARPKDLN

SEQ ID NO: 59759 - protein, 5 aa, Mycobacterium avium
AGGAT

SEQ ID NO: 59760 - protein, 10 aa, Mycobacterium avium
AGGDAAGTVR

SEQ ID NO: 59761 - protein, 16 aa, Mycobacterium avium
AGGDPSALPAAPRPYR

SEQ ID NO: 59762 - protein, 11 aa, Mycobacterium avium
AGGDRQHRAHR

SEQ ID NO: 59763 - protein, 16 aa, Mycobacterium avium
AGGDRSALPAAPRPYR

SEQ ID NO: 59764 - protein, 16 aa, Mycobacterium avium
AGGDSFASYNQTSRAN

SEQ ID NO: 59765 - protein, 6 aa, Mycobacterium avium
AGGDTM

SEQ ID NO: 59766 - protein, 5 aa, Mycobacterium avium
AGGEY

SEQ ID NO: 59767 - protein, 12 aa, Mycobacterium avium
AGGFDPAAAGIA

SEQ ID NO: 59768 - protein, 4 aa, Mycobacterium avium
AGGG

SEQ ID NO: 59769 - protein, 5 aa, Mycobacterium avium
AGGGA

SEQ ID NO: 59770 - protein, 6 aa, Mycobacterium avium
AGGGAD

SEQ ID NO: 59771 - protein, 12 aa, Mycobacterium avium
AGGGGLTPSDIA

SEQ ID NO: 59772 - protein, 17 aa, Mycobacterium avium
AGGGGLTPSDIAPARLD

SEQ ID NO: 59773 - protein, 17 aa, Mycobacterium avium
AGGGGLTPSDIAPARLT

SEQ ID NO: 59774 - protein, 21 aa, Mycobacterium avium
AGGGGLTPSDIAPARLTPPQI

SEQ ID NO: 59775 - protein, 17 aa, Mycobacterium avium
AGGGGLTPSDIAPTRLD

SEQ ID NO: 59776 - protein, 11 aa, Mycobacterium avium
AGGGGLTPSDV

SEQ ID NO: 59777 - protein, 17 aa, Mycobacterium avium
AGGGGLTPSDVAPARLT

SEQ ID NO: 59778 - protein, 70 aa, Mycobacterium avium
AGGGGTSGPGAGGASGAGGGASGAGGGGASGAGGASGAGAGGASGAGGGGASGAGPAAGTFGSKPTCSAS

SEQ ID NO: 59779 - protein, 71 aa, Mycobacterium avium
AGGGGTSGPGAGGASGAGGGGASGAGGGGASGAGGASGAGAGGASGAGGGGASGAGPAAGTFGSKPTCSAS

SEQ ID NO: 59780 - protein, 7 aa, Mycobacterium avium
AGGGLGR

SEQ ID NO: 59781 - protein, 16 aa, Mycobacterium avium
AGGGPFGGANVYSKEH

SEQ ID NO: 59782 - protein, 16 aa, Mycobacterium avium
AGGGPFGGANVYSREK

SEQ ID NO: 59783 - protein, 8 aa, Mycobacterium avium
AGGGPPDV

SEQ ID NO: 59784 - protein, 5 aa, Mycobacterium avium
AGGGT

SEQ ID NO: 59785 - protein, 7 aa, Mycobacterium avium
AGGGTIP

SEQ ID NO: 59786 - protein, 7 aa, Mycobacterium avium
AGGLPGD

SEQ ID NO: 59787 - protein, 5 aa, Mycobacterium avium
AGGLR

SEQ ID NO: 59788 - protein, 19 aa, Mycobacterium avium
AGGPAGAPLANTGAGERRW

SEQ ID NO: 59789 - protein, 5 aa, Mycobacterium avium
AGGPV

SEQ ID NO: 59790 - protein, 17 aa, Mycobacterium avium
AGGRAAETRSADPLISD

SEQ ID NO: 59791 - protein, 9 aa, Mycobacterium avium
AGGRATPAD

SEQ ID NO: 59792 - protein, 8 aa, Mycobacterium avium
AGGSESGL

SEQ ID NO: 59793 - protein, 5 aa, Mycobacterium avium
AGGSR

SEQ ID NO: 59794 - protein, 28 aa, Mycobacterium avium
AGGTASADPLPPAPAPVPAPAPANLGPE

SEQ ID NO: 59795 - protein, 6 aa, Mycobacterium avium
AGGTNG

SEQ ID NO: 59796 - protein, 12 aa, Mycobacterium avium
AGGTVPAPHAES

SEQ ID NO: 59797 - protein, 19 aa, Mycobacterium avium
AGGVDPDAASDAAAAEAHR

SEQ ID NO: 59798 - protein, 7 aa, Mycobacterium avium
AGGYTRD

SEQ ID NO: 59799 - protein, 8 aa, Mycobacterium avium
AGHDPRRF

SEQ ID NO: 59800 - protein, 4 aa, Mycobacterium avium
AGHE

SEQ ID NO: 59801 - protein, 6 aa, Mycobacterium avium
AGHGNG

SEQ ID NO: 59802 - protein, 6 aa, Mycobacterium avium
AGHGYD

SEQ ID NO: 59803 - protein, 11 aa, Mycobacterium avium
AGHHDPSSMTP

SEQ ID NO: 59804 - protein, 6 aa, Mycobacterium avium
AGHPDS

SEQ ID NO: 59805 - protein, 7 aa, Mycobacterium avium
AGHPGVK

SEQ ID NO: 59806 - protein, 13 aa, Mycobacterium avium
AGHPPATGPARRV

SEQ ID NO: 59807 - protein, 12 aa, Mycobacterium avium
AGHPPPTGPARR

SEQ ID NO: 59808 - protein, 7 aa, Mycobacterium avium
AGHTTQA

SEQ ID NO: 59809 - protein, 6 aa, Mycobacterium avium
AGIADP

SEQ ID NO: 59810 - protein, 6 aa, Mycobacterium avium
AGIAPG

SEQ ID NO: 59811 - protein, 10 aa, Mycobacterium avium
AGIDPGLTYQ

SEQ ID NO: 59812 - protein, 14 aa, Mycobacterium avium
AGIDPSGLRGSATG

SEQ ID NO: 59813 - protein, 11 aa, Mycobacterium avium
AGIDPSYQQHE

SEQ ID NO: 59814 - protein, 5 aa, Mycobacterium avium
AGIEG

SEQ ID NO: 59815 - protein, 7 aa, Mycobacterium avium
AGIKPAE

SEQ ID NO: 59816 - protein, 8 aa, Mycobacterium avium
AGIPGGTA

SEQ ID NO: 59817 - protein, 4 aa, Mycobacterium avium
AGIT

SEQ ID NO: 59818 - protein, 13 aa, Mycobacterium avium
AGITGKDVDGYSS

SEQ ID NO: 59819 - protein, 6 aa, Mycobacterium avium
AGKAGV

SEQ ID NO: 59820 - protein, 8 aa, Mycobacterium avium
AGKAGVDA

SEQ ID NO: 59821 - protein, 12 aa, Mycobacterium avium
AGKANSGKGAGR

SEQ ID NO: 59822 - protein, 10 aa, Mycobacterium avium
AGKAPAEHAE

SEQ ID NO: 59823 - protein, 4 aa, Mycobacterium avium
AGKE

SEQ ID NO: 59824 - protein, 10 aa, Mycobacterium avium
AGKGAQARRA

SEQ ID NO: 59825 - protein, 4 aa, Mycobacterium avium
AGKL

SEQ ID NO: 59826 - protein, 10 aa, Mycobacterium avium
AGKPRHPTRG

SEQ ID NO: 59827 - protein, 10 aa, Mycobacterium avium
AGKSDKPFTY

SEQ ID NO: 59828 - protein, 8 aa, Mycobacterium avium
AGKSPEDY

SEQ ID NO: 59829 - protein, 9 aa, Mycobacterium avium
AGKSYGATE

SEQ ID NO: 59830 - protein, 13 aa, Mycobacterium avium
AGKTDGNPETDAD

SEQ ID NO: 59831 - protein, 6 aa, Mycobacterium avium
AGKTDR

SEQ ID NO: 59832 - protein, 14 aa, Mycobacterium avium
AGKTETPAAHPNSR

SEQ ID NO: 59833 - protein, 8 aa, Mycobacterium avium
AGKYGTTV

SEQ ID NO: 59834 - protein, 18 aa, Mycobacterium avium
AGLAEQTAAQARAAAAAY

SEQ ID NO: 59835 - protein, 10 aa, Mycobacterium avium
AGLAPADYAA

SEQ ID NO: 59836 - protein, 13 aa, Mycobacterium avium
AGLATRPGRQPEV

SEQ ID NO: 59837 - protein, 7 aa, Mycobacterium avium
AGLDTSR

SEQ ID NO: 59838 - protein, 4 aa, Mycobacterium avium
AGLG

SEQ ID NO: 59839 - protein, 6 aa, Mycobacterium avium
AGLGGA

SEQ ID NO: 59840 - protein, 26 aa, Mycobacterium avium
AGLGGTRPARRDQRRRNRQSQHPRET

SEQ ID NO: 59841 - protein, 9 aa, Mycobacterium avium
AGLNGSTCA

SEQ ID NO: 59842 - protein, 8 aa, Mycobacterium avium
AGLNPGGI

SEQ ID NO: 59843 - protein, 5 aa, Mycobacterium avium
AGLPD

SEQ ID NO: 59844 - protein, 7 aa, Mycobacterium avium
AGLPDDR

SEQ ID NO: 59845 - protein, 6 aa, Mycobacterium avium
AGLPEE

SEQ ID NO: 59846 - protein, 7 aa, Mycobacterium avium
AGLPEEV

SEQ ID NO: 59847 - protein, 19 aa, Mycobacterium avium
AGLPESAEDKGSQAAGAAL

SEQ ID NO: 59848 - protein, 25 aa, Mycobacterium avium
AGLPGHPGPPRRRAGGADRVPGAVP

SEQ ID NO: 59849 - protein, 6 aa, Mycobacterium avium
AGLPPA

SEQ ID NO: 59850 - protein, 6 aa, Mycobacterium avium
AGLPSA

SEQ ID NO: 59851 - protein, 8 aa, Mycobacterium avium
AGLPSPGV

SEQ ID NO: 59852 - protein, 5 aa, Mycobacterium avium
AGLPV

SEQ ID NO: 59853 - protein, 6 aa, Mycobacterium avium
AGLQPA

SEQ ID NO: 59854 - protein, 12 aa, Mycobacterium avium
AGLRGADLDDTH

SEQ ID NO: 59855 - protein, 8 aa, Mycobacterium avium
AGLRPQDI

SEQ ID NO: 59856 - protein, 4 aa, Mycobacterium avium
AGLS

SEQ ID NO: 59857 - protein, 7 aa, Mycobacterium avium
AGLSPGD

SEQ ID NO: 59858 - protein, 7 aa, Mycobacterium avium
AGLTPAD

SEQ ID NO: 59859 - protein, 8 aa, Mycobacterium avium
AGLTPADI

SEQ ID NO: 59860 - protein, 8 aa, Mycobacterium avium
AGLTREGP

SEQ ID NO: 59861 - protein, 7 aa, Mycobacterium avium
AGLTTAD

SEQ ID NO: 59862 - protein, 7 aa, Mycobacterium avium
AGMAPSQ

SEQ ID NO: 59863 - protein, 7 aa, Mycobacterium avium
AGMQPND

SEQ ID NO: 59864 - protein, 4 aa, Mycobacterium avium
AGMS

SEQ ID NO: 59865 - protein, 25 aa, Mycobacterium avium
AGNADGVTPSDSEVPTGIPAGAFGD

SEQ ID NO: 59866 - protein, 9 aa, Mycobacterium avium
AGNASPEID

SEQ ID NO: 59867 - protein, 6 aa, Mycobacterium avium
AGNDAV

SEQ ID NO: 59868 - protein, 5 aa, Mycobacterium avium
AGNDV

SEQ ID NO: 59869 - protein, 5 aa, Mycobacterium avium
AGNGD

SEQ ID NO: 59870 - protein, 9 aa, Mycobacterium avium
AGNGETRDH

SEQ ID NO: 59871 - protein, 10 aa, Mycobacterium avium
AGNGTHSPDA

SEQ ID NO: 59872 - protein, 18 aa, Mycobacterium avium
AGNPFAPSITADTNGPFA

SEQ ID NO: 59873 - protein, 5 aa, Mycobacterium avium
AGNPI

SEQ ID NO: 59874 - protein, 11 aa, Mycobacterium avium
AGNPVAPGQEG

SEQ ID NO: 59875 - protein, 5 aa, Mycobacterium avium
AGNQI

SEQ ID NO: 59876 - protein, 10 aa, Mycobacterium avium
AGNRAASPSM

SEQ ID NO: 59877 - protein, 8 aa, Mycobacterium avium
AGNRAPLP

SEQ ID NO: 59878 - protein, 13 aa, Mycobacterium avium
AGNRQVKDARTAV

SEQ ID NO: 59879 - protein, 6 aa, Mycobacterium avium
AGNRVT

SEQ ID NO: 59880 - protein, 7 aa, Mycobacterium avium
AGNTGAA

SEQ ID NO: 59881 - protein, 5 aa, Mycobacterium avium
AGPAA

SEQ ID NO: 59882 - protein, 13 aa, Mycobacterium avium
AGPADLAAGRDAV

SEQ ID NO: 59883 - protein, 5 aa, Mycobacterium avium
AGPAG

SEQ ID NO: 59884 - protein, 10 aa, Mycobacterium avium
AGPAGTPGKL

SEQ ID NO: 59885 - protein, 12 aa, Mycobacterium avium
AGPAKPVGSEPG

SEQ ID NO: 59886 - protein, 6 aa, Mycobacterium avium
AGPASF

SEQ ID NO: 59887 - protein, 6 aa, Mycobacterium avium
AGPASI

SEQ ID NO: 59888 - protein, 13 aa, Mycobacterium avium
AGPATDPATDPAT

SEQ ID NO: 59889 - protein, 17 aa, Mycobacterium avium
AGPATSALADNTGELSE

SEQ ID NO: 59890 - protein, 17 aa, Mycobacterium avium
AGPATSALADNTSELSE

SEQ ID NO: 59891 - protein, 8 aa, Mycobacterium avium
AGPDDVGA

SEQ ID NO: 59892 - protein, 5 aa, Mycobacterium avium
AGPDE

SEQ ID NO: 59893 - protein, 12 aa, Mycobacterium avium
AGPDGQPLPADT

SEQ ID NO: 59894 - protein, 17 aa, Mycobacterium avium
AGPDGVRRSQANHTYGY

SEQ ID NO: 59895 - protein, 5 aa, Mycobacterium avium
AGPDR

SEQ ID NO: 59896 - protein, 5 aa, Mycobacterium avium
AGPEG

SEQ ID NO: 59897 - protein, 5 aa, Mycobacterium avium
AGPGA

SEQ ID NO: 59898 - protein, 7 aa, Mycobacterium avium
AGPGGDG

SEQ ID NO: 59899 - protein, 14 aa, Mycobacterium avium
AGPGGQLTITIVSQ

SEQ ID NO: 59900 - protein, 5 aa, Mycobacterium avium
AGPGR

SEQ ID NO: 59901 - protein, 21 aa, Mycobacterium avium
AGPGRTPGTPAGRPGGAAGAV

SEQ ID NO: 59902 - protein, 16 aa, Mycobacterium avium
AGPGSDLGTGGMTSKM

SEQ ID NO: 59903 - protein, 15 aa, Mycobacterium avium
AGPGSGDRAAQAVAA

SEQ ID NO: 59904 - protein, 24 aa, Mycobacterium avium
AGPHSDAGAAARQQGACRSVIGLG

SEQ ID NO: 59905 - protein, 7 aa, Mycobacterium avium
AGPIGSG

SEQ ID NO: 59906 - protein, 6 aa, Mycobacterium avium
AGPLRG

SEQ ID NO: 59907 - protein, 12 aa, Mycobacterium avium
AGPLSADAQVRS

SEQ ID NO: 59908 - protein, 5 aa, Mycobacterium avium
AGPNR

SEQ ID NO: 59909 - protein, 9 aa, Mycobacterium avium
AGPPHGKAD

SEQ ID NO: 59910 - protein, 14 aa, Mycobacterium avium
AGPQGGWGKPPTPL

SEQ ID NO: 59911 - protein, 7 aa, Mycobacterium avium
AGPSADH

SEQ ID NO: 59912 - protein, 8 aa, Mycobacterium avium
AGPSLDDP

SEQ ID NO: 59913 - protein, 4 aa, Mycobacterium avium
AGPT

SEQ ID NO: 59914 - protein, 5 aa, Mycobacterium avium
AGPVP

SEQ ID NO: 59915 - protein, 12 aa, Mycobacterium avium
AGPWESEQTHES

SEQ ID NO: 59916 - protein, 11 aa, Mycobacterium avium
AGPWSRGGPSH

SEQ ID NO: 59917 - protein, 18 aa, Mycobacterium avium
AGPYAALGSRAPDAVDKG

SEQ ID NO: 59918 - protein, 6 aa, Mycobacterium avium
AGQADE

SEQ ID NO: 59919 - protein, 21 aa, Mycobacterium avium
AGQADPGGSLSASGAPTGVGG

SEQ ID NO: 59920 - protein, 10 aa, Mycobacterium avium
AGQAGVDVEN

SEQ ID NO: 59921 - protein, 5 aa, Mycobacterium avium
AGQAR

SEQ ID NO: 59922 - protein, 9 aa, Mycobacterium avium
AGQATTRPE

SEQ ID NO: 59923 - protein, 12 aa, Mycobacterium avium
AGQDPEKVREVS

SEQ ID NO: 59924 - protein, 12 aa, Mycobacterium avium
AGQGDPAPGGVG

SEQ ID NO: 59925 - protein, 9 aa, Mycobacterium avium
AGQGKTDWA

SEQ ID NO: 59926 - protein, 16 aa, Mycobacterium avium
AGQGLAKGSPKRDAVG

SEQ ID NO: 59927 - protein, 6 aa, Mycobacterium avium
AGQLAT

SEQ ID NO: 59928 - protein, 30 aa, Mycobacterium avium
AGQLGDAQAAGVRHPDRRGDDPAGHPAGQP

SEQ ID NO: 59929 - protein, 14 aa, Mycobacterium avium
AGQLGGPGNPQLRG

SEQ ID NO: 59930 - protein, 5 aa, Mycobacterium avium
AGQPV

SEQ ID NO: 59931 - protein, 7 aa, Mycobacterium avium
AGQPVGQ

SEQ ID NO: 59932 - protein, 4 aa, Mycobacterium avium
AGQR

SEQ ID NO: 59933 - protein, 8 aa, Mycobacterium avium
AGQRAGAA

SEQ ID NO: 59934 - protein, 10 aa, Mycobacterium avium
AGQSAELPQP

SEQ ID NO: 59935 - protein, 5 aa, Mycobacterium avium
AGQSE

SEQ ID NO: 59936 - protein, 10 aa, Mycobacterium avium
AGQSERAPGT

SEQ ID NO: 59937 - protein, 19 aa, Mycobacterium avium
AGQTPAPNPPAAAAPQGWG

SEQ ID NO: 59938 - protein, 14 aa, Mycobacterium avium
AGQTVTVTNKSKTY

SEQ ID NO: 59939 - protein, 7 aa, Mycobacterium avium
AGQVGGK

SEQ ID NO: 59940 - protein, 13 aa, Mycobacterium avium
AGQVSSSDHDRDY

SEQ ID NO: 59941 - protein, 4 aa, Mycobacterium avium
AGQW

SEQ ID NO: 59942 - protein, 11 aa, Mycobacterium avium
AGRAAETAGQA

SEQ ID NO: 59943 - protein, 15 aa, Mycobacterium avium
AGRADAAAIPTTPLA

SEQ ID NO: 59944 - protein, 16 aa, Mycobacterium avium
AGRADAAANPTTPLAQ

SEQ ID NO: 59945 - protein, 15 aa, Mycobacterium avium
AGRADAANPTTPLAQ

SEQ ID NO: 59946 - protein, 28 aa, Mycobacterium avium
AGRAVGGARRPGVPGRGAPGPARSRPPA

SEQ ID NO: 59947 - protein, 6 aa, Mycobacterium avium
AGRDGL

SEQ ID NO: 59948 - protein, 10 aa, Mycobacterium avium
AGREAGSAGM

SEQ ID NO: 59949 - protein, 6 aa, Mycobacterium avium
AGREPL

SEQ ID NO: 59950 - protein, 9 aa, Mycobacterium avium
AGRFSPPIP

SEQ ID NO: 59951 - protein, 21 aa, Mycobacterium avium
AGRGAGSTYAHSGGNAGVRGL

SEQ ID NO: 59952 - protein, 17 aa, Mycobacterium avium
AGRGAGSTYAQSGGNVG

SEQ ID NO: 59953 - protein, 7 aa, Mycobacterium avium
AGRGIGR

SEQ ID NO: 59954 - protein, 10 aa, Mycobacterium avium
AGRHTAESDH

SEQ ID NO: 59955 - protein, 6 aa, Mycobacterium avium
AGRKGY

SEQ ID NO: 59956 - protein, 5 aa, Mycobacterium avium
AGRLA

SEQ ID NO: 59957 - protein, 11 aa, Mycobacterium avium
AGRLEGKSSLG

SEQ ID NO: 59958 - protein, 13 aa, Mycobacterium avium
AGRLPRSAVSGTR

SEQ ID NO: 59959 - protein, 7 aa, Mycobacterium avium
AGRLSDE

SEQ ID NO: 59960 - protein, 6 aa, Mycobacterium avium
AGRNIP

SEQ ID NO: 59961 - protein, 22 aa, Mycobacterium avium
AGRNPRRRPSRRRSRRRGRRRP

SEQ ID NO: 59962 - protein, 8 aa, Mycobacterium avium
AGRNTDDL

SEQ ID NO: 59963 - protein, 17 aa, Mycobacterium avium
AGRPAAEDQNPRRGRGR

SEQ ID NO: 59964 - protein, 27 aa, Mycobacterium avium
AGRPAPAGPRRAGRHHPRPPGRRRPGH

SEQ ID NO: 59965 - protein, 6 aa, Mycobacterium avium
AGRPAR

SEQ ID NO: 59966 - protein, 9 aa, Mycobacterium avium
AGRPGEGDR

SEQ ID NO: 59967 - protein, 8 aa, Mycobacterium avium
AGRPHDDF

SEQ ID NO: 59968 - protein, 6 aa, Mycobacterium avium
AGRPIP

SEQ ID NO: 59969 - protein, 18 aa, Mycobacterium avium
AGRPPAQGRPRGEAPDRN

SEQ ID NO: 59970 - protein, 9 aa, Mycobacterium avium
AGRPPVPSR

SEQ ID NO: 59971 - protein, 10 aa, Mycobacterium avium
AGRPREEYGI

SEQ ID NO: 59972 - protein, 58 aa, Mycobacterium avium
AGRPRSAGAAGRAGARRGTARRATGRAARRPDDPRADAAARVGHPRRPLTSRSSRSSR

SEQ ID NO: 59973 - protein, 28 aa, Mycobacterium avium
AGRPSADRPAEPADAPADAARSREDEPF

SEQ ID NO: 59974 - protein, 6 aa, Mycobacterium avium
AGRPVQ

SEQ ID NO: 59975 - protein, 20 aa, Mycobacterium avium
AGRPVSPALPAVNGSPRGAF

SEQ ID NO: 59976 - protein, 25 aa, Mycobacterium avium
AGRQDTDSAAPPADSPGDPSGENEP

SEQ ID NO: 59977 - protein, 25 aa, Mycobacterium avium
AGRQDTDSAAPPADSSGDPSGETEP

SEQ ID NO: 59978 - protein, 9 aa, Mycobacterium avium
AGRQGQTDH

SEQ ID NO: 59979 - protein, 5 aa, Mycobacterium avium
AGRRD

SEQ ID NO: 59980 - protein, 5 aa, Mycobacterium avium
AGRRG

SEQ ID NO: 59981 - protein, 8 aa, Mycobacterium avium
AGRRRDDI

SEQ ID NO: 59982 - protein, 6 aa, Mycobacterium avium
AGRRRH

SEQ ID NO: 59983 - protein, 6 aa, Mycobacterium avium
AGRRTQ

SEQ ID NO: 59984 - protein, 5 aa, Mycobacterium avium
AGRRV

SEQ ID NO: 59985 - protein, 18 aa, Mycobacterium avium
AGRSDGVDLDDKGREQAA

SEQ ID NO: 59986 - protein, 7 aa, Mycobacterium avium
AGRSGGF

SEQ ID NO: 59987 - protein, 5 aa, Mycobacterium avium
AGRSQ

SEQ ID NO: 59988 - protein, 14 aa, Mycobacterium avium
AGRSRPGERVQAGA

SEQ ID NO: 59989 - protein, 13 aa, Mycobacterium avium
AGRSTAEADTTFA

SEQ ID NO: 59990 - protein, 8 aa, Mycobacterium avium
AGRTAGSA

SEQ ID NO: 59991 - protein, 19 aa, Mycobacterium avium
AGRTGESAQQLVATTDRRT

SEQ ID NO: 59992 - protein, 19 aa, Mycobacterium avium
AGRTGESTQQLVATTDRRT

SEQ ID NO: 59993 - protein, 4 aa, Mycobacterium avium
AGRV

SEQ ID NO: 59994 - protein, 7 aa, Mycobacterium avium
AGRYRHQ

SEQ ID NO: 59995 - protein, 21 aa, Mycobacterium avium
AGRYRHQRDRHPAPLDPNFTG

SEQ ID NO: 59996 - protein, 21 aa, Mycobacterium avium
AGRYRHQRDRHSAPLDPNFTG

SEQ ID NO: 59997 - protein, 14 aa, Mycobacterium avium
AGSAPITRASGKKT

SEQ ID NO: 59998 - protein, 5 aa, Mycobacterium avium
AGSAR

SEQ ID NO: 59999 - protein, 6 aa, Mycobacterium avium
AGSARR

SEQ ID NO: 60000 - protein, 6 aa, Mycobacterium avium
AGSASI

SEQ ID NO: 60001 - protein, 24 aa, Mycobacterium avium
AGSATTGSTPATTHNVSRSAPNPA

SEQ ID NO: 60002 - protein, 7 aa, Mycobacterium avium
AGSDDDL

SEQ ID NO: 60003 - protein, 7 aa, Mycobacterium avium
AGSETTT

SEQ ID NO: 60004 - protein, 32 aa, Mycobacterium avium
AGSGAGRAAAGRPDRAPGAAAAADRRPGPGQR

SEQ ID NO: 60005 - protein, 10 aa, Mycobacterium avium
AGSGLNGLDP

SEQ ID NO: 60006 - protein, 10 aa, Mycobacterium avium
AGSGLQGLDP

SEQ ID NO: 60007 - protein, 10 aa, Mycobacterium avium
AGSGNGARTV

SEQ ID NO: 60008 - protein, 9 aa, Mycobacterium avium
AGSGTLGDR

SEQ ID NO: 60009 - protein, 23 aa, Mycobacterium avium
AGSGTRAGKRPGTRLRSANHGVR

SEQ ID NO: 60010 - protein, 7 aa, Mycobacterium avium
AGSGVGR

SEQ ID NO: 60011 - protein, 4 aa, Mycobacterium avium
AGSH

SEQ ID NO: 60012 - protein, 7 aa, Mycobacterium avium
AGSHDEA

SEQ ID NO: 60013 - protein, 16 aa, Mycobacterium avium
AGSKEPGPAARRDRWR

SEQ ID NO: 60014 - protein, 9 aa, Mycobacterium avium
AGSKSTLNE

SEQ ID NO: 60015 - protein, 32 aa, Mycobacterium avium
AGSPAPATAGPPHPKPEQPVHEPDSARRDEEE

SEQ ID NO: 60016 - protein, 32 aa, Mycobacterium avium
AGSPAPATAGPPHPKPEQPVPEPDSARRDEEE

SEQ ID NO: 60017 - protein, 32 aa, Mycobacterium avium
AGSPASATAGPPHPKPEQPVPEPDSARRDEEE

SEQ ID NO: 60018 - protein, 8 aa, Mycobacterium avium
AGSPEQRA

SEQ ID NO: 60019 - protein, 9 aa, Mycobacterium avium
AGSQNAQGP

SEQ ID NO: 60020 - protein, 7 aa, Mycobacterium avium
AGSRPVR

SEQ ID NO: 60021 - protein, 82 aa, Mycobacterium avium
AGSSTQAASDEDESAAEEAGDELERKKAARAEELEAAEDTEDLEDTEDDDEDSDDSDDEDLDDEDIDDEEDLGDDDEDLELD

SEQ ID NO: 60022 - protein, 5 aa, Mycobacterium avium
AGSSV

SEQ ID NO: 60023 - protein, 15 aa, Mycobacterium avium
AGSTTSATVSNNAQA

SEQ ID NO: 60024 - protein, 14 aa, Mycobacterium avium
AGSTTSRQTDTAAD

SEQ ID NO: 60025 - protein, 6 aa, Mycobacterium avium
AGSVAD

SEQ ID NO: 60026 - protein, 10 aa, Mycobacterium avium
AGSVDDGKST

SEQ ID NO: 60027 - protein, 5 aa, Mycobacterium avium
AGSWD

SEQ ID NO: 60028 - protein, 7 aa, Mycobacterium avium
AGTAPLD

SEQ ID NO: 60029 - protein, 10 aa, Mycobacterium avium
AGTAPRETVA

SEQ ID NO: 60030 - protein, 27 aa, Mycobacterium avium
AGTARKDAAGAAAGLTTLPGAELGGPT

SEQ ID NO: 60031 - protein, 7 aa, Mycobacterium avium
AGTARYG

SEQ ID NO: 60032 - protein, 6 aa, Mycobacterium avium
AGTDES

SEQ ID NO: 60033 - protein, 10 aa, Mycobacterium avium
AGTDPRSYYE

SEQ ID NO: 60034 - protein, 5 aa, Mycobacterium avium
AGTDV

SEQ ID NO: 60035 - protein, 4 aa, Mycobacterium avium
AGTF

SEQ ID NO: 60036 - protein, 11 aa, Mycobacterium avium
AGTGTDDAESI

SEQ ID NO: 60037 - protein, 4 aa, Mycobacterium avium
AGTH

SEQ ID NO: 60038 - protein, 8 aa, Mycobacterium avium
AGTITGPP

SEQ ID NO: 60039 - protein, 21 aa, Mycobacterium avium
AGTLQEAGQNHADHIAAAGGS

SEQ ID NO: 60040 - protein, 7 aa, Mycobacterium avium
AGTLSTG

SEQ ID NO: 60041 - protein, 11 aa, Mycobacterium avium
AGTMDTEHGPQ

SEQ ID NO: 60042 - protein, 19 aa, Mycobacterium avium
AGTNLPDAADPSLQTIRVL

SEQ ID NO: 60043 - protein, 13 aa, Mycobacterium avium
AGTNNPPPANPGF

SEQ ID NO: 60044 - protein, 9 aa, Mycobacterium avium
AGTNPAYGP

SEQ ID NO: 60045 - protein, 5 aa, Mycobacterium avium
AGTNV

SEQ ID NO: 60046 - protein, 25 aa, Mycobacterium avium
AGTPAAAAQPEAAPQTSAGPALPVS

SEQ ID NO: 60047 - protein, 10 aa, Mycobacterium avium
AGTPDGGDGH

SEQ ID NO: 60048 - protein, 9 aa, Mycobacterium avium
AGTPEPRHD

SEQ ID NO: 60049 - protein, 10 aa, Mycobacterium avium
AGTPEPRHDE

SEQ ID NO: 60050 - protein, 6 aa, Mycobacterium avium
AGTPMA

SEQ ID NO: 60051 - protein, 6 aa, Mycobacterium avium
AGTPMT

SEQ ID NO: 60052 - protein, 7 aa, Mycobacterium avium
AGTPMTS

SEQ ID NO: 60053 - protein, 7 aa, Mycobacterium avium
AGTPSAT

SEQ ID NO: 60054 - protein, 9 aa, Mycobacterium avium
AGTQQRRKA

SEQ ID NO: 60055 - protein, 6 aa, Mycobacterium avium
AGTRAF

SEQ ID NO: 60056 - protein, 8 aa, Mycobacterium avium
AGTRAHSA

SEQ ID NO: 60057 - protein, 9 aa, Mycobacterium avium
AGTRPGDAL

SEQ ID NO: 60058 - protein, 11 aa, Mycobacterium avium
AGTSFATPDKL

SEQ ID NO: 60059 - protein, 15 aa, Mycobacterium avium
AGTSGADSATGTTER

SEQ ID NO: 60060 - protein, 17 aa, Mycobacterium avium
AGTSGAKGVRNAEPSDI

SEQ ID NO: 60061 - protein, 8 aa, Mycobacterium avium
AGTSPVDP

SEQ ID NO: 60062 - protein, 8 aa, Mycobacterium avium
AGTTAGQR

SEQ ID NO: 60063 - protein, 5 aa, Mycobacterium avium
AGTTG

SEQ ID NO: 60064 - protein, 7 aa, Mycobacterium avium
AGTTGAA

SEQ ID NO: 60065 - protein, 10 aa, Mycobacterium avium
AGTTLARSAA

SEQ ID NO: 60066 - protein, 5 aa, Mycobacterium avium
AGTTT

SEQ ID NO: 60067 - protein, 6 aa, Mycobacterium avium
AGTVDS

SEQ ID NO: 60068 - protein, 7 aa, Mycobacterium avium
AGTYPSA

SEQ ID NO: 60069 - protein, 17 aa, Mycobacterium avium
AGVAPRDPEYRRPGRSL

SEQ ID NO: 60070 - protein, 7 aa, Mycobacterium avium
AGVARSG

SEQ ID NO: 60071 - protein, 6 aa, Mycobacterium avium
AGVDAR

SEQ ID NO: 60072 - protein, 12 aa, Mycobacterium avium
AGVDNETYLVAH

SEQ ID NO: 60073 - protein, 6 aa, Mycobacterium avium
AGVEEQ

SEQ ID NO: 60074 - protein, 9 aa, Mycobacterium avium
AGVEPNPAA

SEQ ID NO: 60075 - protein, 6 aa, Mycobacterium avium
AGVETT

SEQ ID NO: 60076 - protein, 25 aa, Mycobacterium avium
AGVGARAGALKGGVGTASRTLPSGV

SEQ ID NO: 60077 - protein, 7 aa, Mycobacterium avium
AGVGGTS

SEQ ID NO: 60078 - protein, 7 aa, Mycobacterium avium
AGVGPAD

SEQ ID NO: 60079 - protein, 11 aa, Mycobacterium avium
AGVGQASSLST

SEQ ID NO: 60080 - protein, 4 aa, Mycobacterium avium
AGVP

SEQ ID NO: 60081 - protein, 16 aa, Mycobacterium avium
AGVPAAPLSPADADLG

SEQ ID NO: 60082 - protein, 8 aa, Mycobacterium avium
AGVPAQEE

SEQ ID NO: 60083 - protein, 10 aa, Mycobacterium avium
AGVPGADPAS

SEQ ID NO: 60084 - protein, 7 aa, Mycobacterium avium
AGVPPHP

SEQ ID NO: 60085 - protein, 4 aa, Mycobacterium avium
AGVR

SEQ ID NO: 60086 - protein, 5 aa, Mycobacterium avium
AGVRA

SEQ ID NO: 60087 - protein, 5 aa, Mycobacterium avium
AGVRD

SEQ ID NO: 60088 - protein, 17 aa, Mycobacterium avium
AGVRGGSRHEGVDPKIT

SEQ ID NO: 60089 - protein, 7 aa, Mycobacterium avium
AGVRGHP

SEQ ID NO: 60090 - protein, 16 aa, Mycobacterium avium
AGVRKDSAAPLKGELE

SEQ ID NO: 60091 - protein, 8 aa, Mycobacterium avium
AGVRNAAS

SEQ ID NO: 60092 - protein, 6 aa, Mycobacterium avium
AGVSDD

SEQ ID NO: 60093 - protein, 16 aa, Mycobacterium avium
AGVSTKDARAERNQTP

SEQ ID NO: 60094 - protein, 7 aa, Mycobacterium avium
AGVTAGD

SEQ ID NO: 60095 - protein, 5 aa, Mycobacterium avium
AGVTE

SEQ ID NO: 60096 - protein, 20 aa, Mycobacterium avium
AGWPSPRATSPSNGLGPQSL

SEQ ID NO: 60097 - protein, 19 aa, Mycobacterium avium
AGWPSPRATSPSNRIGPQS

SEQ ID NO: 60098 - protein, 8 aa, Mycobacterium avium
AGWSDDGM

SEQ ID NO: 60099 - protein, 4 aa, Mycobacterium avium
AGYE

SEQ ID NO: 60100 - protein, 14 aa, Mycobacterium avium
AGYGQGGDIHSPRD

SEQ ID NO: 60101 - protein, 10 aa, Mycobacterium avium
AGYPLGPANI

SEQ ID NO: 60102 - protein, 6 aa, Mycobacterium avium
AGYRSG

SEQ ID NO: 60103 - protein, 15 aa, Mycobacterium avium
AGYSRNDDPATAPVQ

SEQ ID NO: 60104 - protein, 7 aa, Mycobacterium avium
AGYTEQD

SEQ ID NO: 60105 - protein, 11 aa, Mycobacterium avium
AGYTGQLGSPD

SEQ ID NO: 60106 - protein, 8 aa, Mycobacterium avium
AHAGPNEH

SEQ ID NO: 60107 - protein, 6 aa, Mycobacterium avium
AHAGTL

SEQ ID NO: 60108 - protein, 7 aa, Mycobacterium avium
AHAPPAP

SEQ ID NO: 60109 - protein, 6 aa, Mycobacterium avium
AHAPPE

SEQ ID NO: 60110 - protein, 4 aa, Mycobacterium avium
AHAR

SEQ ID NO: 60111 - protein, 6 aa, Mycobacterium avium
AHASEL

SEQ ID NO: 60112 - protein, 8 aa, Mycobacterium avium
AHATSTTA

SEQ ID NO: 60113 - protein, 7 aa, Mycobacterium avium
AHAVETN

SEQ ID NO: 60114 - protein, 28 aa, Mycobacterium avium
AHDDASALTRSARPSAKPAAEASVPTPA

SEQ ID NO: 60115 - protein, 11 aa, Mycobacterium avium
AHDDPDALPRD

SEQ ID NO: 60116 - protein, 10 aa, Mycobacterium avium
AHDDTERGVP

SEQ ID NO: 60117 - protein, 11 aa, Mycobacterium avium
AHDGPAPTVES

SEQ ID NO: 60118 - protein, 6 aa, Mycobacterium avium
AHDPDA

SEQ ID NO: 60119 - protein, 7 aa, Mycobacterium avium
AHDPDAK

SEQ ID NO: 60120 - protein, 17 aa, Mycobacterium avium
AHDPDAKALAGLASGAE

SEQ ID NO: 60121 - protein, 8 aa, Mycobacterium avium
AHDSKEGV

SEQ ID NO: 60122 - protein, 29 aa, Mycobacterium avium
AHEAETPDQARQDVTDALAGDKGAASRVN

SEQ ID NO: 60123 - protein, 8 aa, Mycobacterium avium
AHEDGGNG

SEQ ID NO: 60124 - protein, 8 aa, Mycobacterium avium
AHEPPETA

SEQ ID NO: 60125 - protein, 6 aa, Mycobacterium avium
AHEQAE

SEQ ID NO: 60126 - protein, 10 aa, Mycobacterium avium
AHGGPGGRPG

SEQ ID NO: 60127 - protein, 4 aa, Mycobacterium avium
AHGI

SEQ ID NO: 60128 - protein, 14 aa, Mycobacterium avium
AHHRQQRTFAQSSK

SEQ ID NO: 60129 - protein, 5 aa, Mycobacterium avium
AHKEE

SEQ ID NO: 60130 - protein, 9 aa, Mycobacterium avium
AHKRTGVPI

SEQ ID NO: 60131 - protein, 9 aa, Mycobacterium avium
AHPDDRHGA

SEQ ID NO: 60132 - protein, 9 aa, Mycobacterium avium
AHPESTAEL

SEQ ID NO: 60133 - protein, 5 aa, Mycobacterium avium
AHPGT

SEQ ID NO: 60134 - protein, 6 aa, Mycobacterium avium
AHPHPT

SEQ ID NO: 60135 - protein, 11 aa, Mycobacterium avium
AHPHRDPETGE

SEQ ID NO: 60136 - protein, 13 aa, Mycobacterium avium
AHPPADREVEHDA

SEQ ID NO: 60137 - protein, 4 aa, Mycobacterium avium
AHPR

SEQ ID NO: 60138 - protein, 4 aa, Mycobacterium avium
AHPY

SEQ ID NO: 60139 - protein, 9 aa, Mycobacterium avium
AHQAAADMA

SEQ ID NO: 60140 - protein, 19 aa, Mycobacterium avium
AHQRHPEGRRLGETGAHGG

SEQ ID NO: 60141 - protein, 15 aa, Mycobacterium avium
AHRAGDTARGRRRAG

SEQ ID NO: 60142 - protein, 10 aa, Mycobacterium avium
AHRPAPQTQL

SEQ ID NO: 60143 - protein, 5 aa, Mycobacterium avium
AHRPV

SEQ ID NO: 60144 - protein, 5 aa, Mycobacterium avium
AHSAA

SEQ ID NO: 60145 - protein, 6 aa, Mycobacterium avium
AHSAYP

SEQ ID NO: 60146 - protein, 8 aa, Mycobacterium avium
AHSETAQQ

SEQ ID NO: 60147 - protein, 5 aa, Mycobacterium avium
AHSGR

SEQ ID NO: 60148 - protein, 4 aa, Mycobacterium avium
AHSI

SEQ ID NO: 60149 - protein, 14 aa, Mycobacterium avium
AHSSQPHAAVSGDD

SEQ ID NO: 60150 - protein, 6 aa, Mycobacterium avium
AHSTQG

SEQ ID NO: 60151 - protein, 7 aa, Mycobacterium avium
AHTDEAT

SEQ ID NO: 60152 - protein, 7 aa, Mycobacterium avium
AHTDNSA

SEQ ID NO: 60153 - protein, 8 aa, Mycobacterium avium
AHTGVDRA

SEQ ID NO: 60154 - protein, 7 aa, Mycobacterium avium
AHTPTPL

SEQ ID NO: 60155 - protein, 11 aa, Mycobacterium avium
AHTRAGAGANE

SEQ ID NO: 60156 - protein, 7 aa, Mycobacterium avium
AHTSGDT

SEQ ID NO: 60157 - protein, 19 aa, Mycobacterium avium
AHTTGDYPPLDAGSDDAVR

SEQ ID NO: 60158 - protein, 14 aa, Mycobacterium avium
AHVEPTGHVEPTSH

SEQ ID NO: 60159 - protein, 6 aa, Mycobacterium avium
AIAAAT

SEQ ID NO: 60160 - protein, 4 aa, Mycobacterium avium
AIAE

SEQ ID NO: 60161 - protein, 7 aa, Mycobacterium avium
AIAEPYD

SEQ ID NO: 60162 - protein, 12 aa, Mycobacterium avium
AIAPTRPHAGVE

SEQ ID NO: 60163 - protein, 4 aa, Mycobacterium avium
AIAQ

SEQ ID NO: 60164 - protein, 5 aa, Mycobacterium avium
AIARP

SEQ ID NO: 60165 - protein, 15 aa, Mycobacterium avium
AIARTKSELPQAVPA

SEQ ID NO: 60166 - protein, 16 aa, Mycobacterium avium
AIARTKSELPQSVPAS

SEQ ID NO: 60167 - protein, 12 aa, Mycobacterium avium
AIASGDERATAL

SEQ ID NO: 60168 - protein, 12 aa, Mycobacterium avium
AIDASAGAYAPY

SEQ ID NO: 60169 - protein, 10 aa, Mycobacterium avium
AIDDTKASVA

SEQ ID NO: 60170 - protein, 12 aa, Mycobacterium avium
AIDETERRRAKQ

SEQ ID NO: 60171 - protein, 16 aa, Mycobacterium avium
AIEAQKGWAATNPQRR

SEQ ID NO: 60172 - protein, 6 aa, Mycobacterium avium
AIGEPV

SEQ ID NO: 60173 - protein, 16 aa, Mycobacterium avium
AIGESAANVAAGDGMR

SEQ ID NO: 60174 - protein, 4 aa, Mycobacterium avium
AIGP

SEQ ID NO: 60175 - protein, 23 aa, Mycobacterium avium
AIHPAPSDTTEAPTTHRPERSDE

SEQ ID NO: 60176 - protein, 20 aa, Mycobacterium avium
AIKRGSSGESLTRPSRAPTI

SEQ ID NO: 60177 - protein, 8 aa, Mycobacterium avium
AINAGDPV

SEQ ID NO: 60178 - protein, 16 aa, Mycobacterium avium
AINPEPSEDDRRTVED

SEQ ID NO: 60179 - protein, 8 aa, Mycobacterium avium
AIPGAKPR

SEQ ID NO: 60180 - protein, 10 aa, Mycobacterium avium
AISAGDQSIG

SEQ ID NO: 60181 - protein, 10 aa, Mycobacterium avium
AISKGQRGGN

SEQ ID NO: 60182 - protein, 6 aa, Mycobacterium avium
AISPAL

SEQ ID NO: 60183 - protein, 6 aa, Mycobacterium avium
AISRGE

SEQ ID NO: 60184 - protein, 4 aa, Mycobacterium avium
AITP

SEQ ID NO: 60185 - protein, 16 aa, Mycobacterium avium
AKAAATPQLIPSPKAT

SEQ ID NO: 60186 - protein, 6 aa, Mycobacterium avium
AKADPI

SEQ ID NO: 60187 - protein, 14 aa, Mycobacterium avium
AKAGPDGAPETKGP

SEQ ID NO: 60188 - protein, 14 aa, Mycobacterium avium
AKAGPGGAPETKGP

SEQ ID NO: 60189 - protein, 14 aa, Mycobacterium avium
AKAGRDGAPETKGP

SEQ ID NO: 60190 - protein, 8 aa, Mycobacterium avium
AKALAPAP

SEQ ID NO: 60191 - protein, 8 aa, Mycobacterium avium
AKAPRGAR

SEQ ID NO: 60192 - protein, 22 aa, Mycobacterium avium
AKAREQATGAEPAADDGPTAGT

SEQ ID NO: 60193 - protein, 6 aa, Mycobacterium avium
AKARGA

SEQ ID NO: 60194 - protein, 12 aa, Mycobacterium avium
AKARRESLDSRP

SEQ ID NO: 60195 - protein, 7 aa, Mycobacterium avium
AKASANY

SEQ ID NO: 60196 - protein, 10 aa, Mycobacterium avium
AKASGAPAGT

SEQ ID NO: 60197 - protein, 11 aa, Mycobacterium avium
AKAVADKATRL

SEQ ID NO: 60198 - protein, 8 aa, Mycobacterium avium
AKAWGSEG

SEQ ID NO: 60199 - protein, 16 aa, Mycobacterium avium
AKDGASSTKTYSAHDP

SEQ ID NO: 60200 - protein, 10 aa, Mycobacterium avium
AKDLKQPPVP

SEQ ID NO: 60201 - protein, 17 aa, Mycobacterium avium
AKDRDRAPHMEKNDQGV

SEQ ID NO: 60202 - protein, 10 aa, Mycobacterium avium
AKDTRTPGVD

SEQ ID NO: 60203 - protein, 8 aa, Mycobacterium avium
AKEAGLTP

SEQ ID NO: 60204 - protein, 5 aa, Mycobacterium avium
AKEAI

SEQ ID NO: 60205 - protein, 16 aa, Mycobacterium avium
AKEATAAPPPPSRDHH

SEQ ID NO: 60206 - protein, 6 aa, Mycobacterium avium
AKEDPS

SEQ ID NO: 60207 - protein, 10 aa, Mycobacterium avium
AKEIPPGSRG

SEQ ID NO: 60208 - protein, 7 aa, Mycobacterium avium
AKELASG

SEQ ID NO: 60209 - protein, 11 aa, Mycobacterium avium
AKESGRKSARI

SEQ ID NO: 60210 - protein, 17 aa, Mycobacterium avium
AKFRRAQDHPPKPKREY

SEQ ID NO: 60211 - protein, 8 aa, Mycobacterium avium
AKGAGVSR

SEQ ID NO: 60212 - protein, 16 aa, Mycobacterium avium
AKGAPREGFPAGTSFA

SEQ ID NO: 60213 - protein, 8 aa, Mycobacterium avium
AKGAVAAA

SEQ ID NO: 60214 - protein, 6 aa, Mycobacterium avium
AKGEHT

SEQ ID NO: 60215 - protein, 13 aa, Mycobacterium avium
AKGEPRAAGTAVS

SEQ ID NO: 60216 - protein, 8 aa, Mycobacterium avium
AKGSAKKV

SEQ ID NO: 60217 - protein, 8 aa, Mycobacterium avium
AKGSSSHA

SEQ ID NO: 60218 - protein, 18 aa, Mycobacterium avium
AKGTNQAEGRAAASDAAW

SEQ ID NO: 60219 - protein, 9 aa, Mycobacterium avium
AKGVGHEPF

SEQ ID NO: 60220 - protein, 10 aa, Mycobacterium avium
AKGVSGNAVP

SEQ ID NO: 60221 - protein, 5 aa, Mycobacterium avium
AKGYE

SEQ ID NO: 60222 - protein, 15 aa, Mycobacterium avium
AKGYRNPVDPDPFAE

SEQ ID NO: 60223 - protein, 9 aa, Mycobacterium avium
AKHGDEPLY

SEQ ID NO: 60224 - protein, 6 aa, Mycobacterium avium
AKHSSL

SEQ ID NO: 60225 - protein, 6 aa, Mycobacterium avium
AKHTGG

SEQ ID NO: 60226 - protein, 5 aa, Mycobacterium avium
AKIRG

SEQ ID NO: 60227 - protein, 9 aa, Mycobacterium avium
AKKAVDAGV

SEQ ID NO: 60228 - protein, 6 aa, Mycobacterium avium
AKKDHI

SEQ ID NO: 60229 - protein, 13 aa, Mycobacterium avium
AKKPEDRYASAGD

SEQ ID NO: 60230 - protein, 8 aa, Mycobacterium avium
AKKPPFPY

SEQ ID NO: 60231 - protein, 9 aa, Mycobacterium avium
AKKTGAKVT

SEQ ID NO: 60232 - protein, 8 aa, Mycobacterium avium
AKLEERRN

SEQ ID NO: 60233 - protein, 8 aa, Mycobacterium avium
AKLEPEDA

SEQ ID NO: 60234 - protein, 7 aa, Mycobacterium avium
AKLPHGT

SEQ ID NO: 60235 - protein, 11 aa, Mycobacterium avium
AKLRGPKVDRA

SEQ ID NO: 60236 - protein, 32 aa, Mycobacterium avium; identical to SEQ ID NO: 4970

SEQ ID NO: 60237 - protein, 34 aa, Mycobacterium avium
AKNDRPGDHASSAGAAADAAAAGTSDQPDEDLDD

SEQ ID NO: 60238 - protein, 35 aa, Mycobacterium avium
AKNDRPGDHASSAGAAADAAAAGTSDQPDEDLDDE

SEQ ID NO: 60239 - protein, 10 aa, Mycobacterium avium
AKNEPEDEER

SEQ ID NO: 60240 - protein, 11 aa, Mycobacterium avium
AKNGAAQGDPI

SEQ ID NO: 60241 - protein, 5 aa, Mycobacterium avium
AKNLY

SEQ ID NO: 60242 - protein, 4 aa, Mycobacterium avium
AKNP

SEQ ID NO: 60243 - protein, 13 aa, Mycobacterium avium
AKNPFASAPVERS

SEQ ID NO: 60244 - protein, 4 aa, Mycobacterium avium
AKPG

SEQ ID NO: 60245 - protein, 8 aa, Mycobacterium avium
AKPGLGDD

SEQ ID NO: 60246 - protein, 6 aa, Mycobacterium avium
AKPGQR

SEQ ID NO: 60247 - protein, 7 aa, Mycobacterium avium
AKPLTRD

SEQ ID NO: 60248 - protein, 32 aa, Mycobacterium avium
AKPPAPQASWGQGSGGIGPVGGQDASWNDVIR

SEQ ID NO: 60249 - protein, 9 aa, Mycobacterium avium
AKPPPAGTP

SEQ ID NO: 60250 - protein, 7 aa, Mycobacterium avium
AKPPRRP

SEQ ID NO: 60251 - protein, 8 aa, Mycobacterium avium
AKPPRRPL

SEQ ID NO: 60252 - protein, 5 aa, Mycobacterium avium
AKPQI

SEQ ID NO: 60253 - protein, 7 aa, Mycobacterium avium
AKPSSNL

SEQ ID NO: 60254 - protein, 9 aa, Mycobacterium avium
AKPTQQMSQ

SEQ ID NO: 60255 - protein, 6 aa, Mycobacterium avium
AKPTSN

SEQ ID NO: 60256 - protein, 4 aa, Mycobacterium avium
AKPV

SEQ ID NO: 60257 - protein, 11 aa, Mycobacterium avium
AKQGASYGHTK

SEQ ID NO: 60258 - protein, 7 aa, Mycobacterium avium
AKQGFAP

SEQ ID NO: 60259 - protein, 4 aa, Mycobacterium avium
AKQR

SEQ ID NO: 60260 - protein, 5 aa, Mycobacterium avium
AKQRL

SEQ ID NO: 60261 - protein, 9 aa, Mycobacterium avium
AKQRNSYDA

SEQ ID NO: 60262 - protein, 5 aa, Mycobacterium avium
AKRDA

SEQ ID NO: 60263 - protein, 10 aa, Mycobacterium avium
AKRDPETALE

SEQ ID NO: 60264 - protein, 8 aa, Mycobacterium avium
AKREQGRY

SEQ ID NO: 60265 - protein, 6 aa, Mycobacterium avium
AKRGAH

SEQ ID NO: 60266 - protein, 9 aa, Mycobacterium avium
AKRRTQIRG

SEQ ID NO: 60267 - protein, 17 aa, Mycobacterium avium
AKRTPKTARTRSWTTDV

SEQ ID NO: 60268 - protein, 4 aa, Mycobacterium avium
AKRY

SEQ ID NO: 60269 - protein, 13 aa, Mycobacterium avium
AKSELARQIAGGT

SEQ ID NO: 60270 - protein, 8 aa, Mycobacterium avium
AKSGNPTA

SEQ ID NO: 60271 - protein, 9 aa, Mycobacterium avium
AKSIADGAS

SEQ ID NO: 60272 - protein, 15 aa, Mycobacterium avium
AKSNATVADSRLPGM

SEQ ID NO: 60273 - protein, 7 aa, Mycobacterium avium
AKSPIKG

SEQ ID NO: 60274 - protein, 9 aa, Mycobacterium avium
AKTAGASRA

SEQ ID NO: 60275 - protein, 11 aa, Mycobacterium avium
AKTAPKDKGLQ

SEQ ID NO: 60276 - protein, 11 aa, Mycobacterium avium
AKTGAAQGDPI

SEQ ID NO: 60277 - protein, 9 aa, Mycobacterium avium
AKTGIDADG

SEQ ID NO: 60278 - protein, 8 aa, Mycobacterium avium
AKTGNGFE

SEQ ID NO: 60279 - protein, 11 aa, Mycobacterium avium
AKVDPQGRCEP

SEQ ID NO: 60280 - protein, 12 aa, Mycobacterium avium
AKVQSQVTEQND

SEQ ID NO: 60281 - protein, 9 aa, Mycobacterium avium
AKWGPSGTN

SEQ ID NO: 60282 - protein, 8 aa, Mycobacterium avium
AKWTTPGG

SEQ ID NO: 60283 - protein, 4 aa, Mycobacterium avium
ALAA

SEQ ID NO: 60284 - protein, 9 aa, Mycobacterium avium
ALADSGGDG

SEQ ID NO: 60285 - protein, 15 aa, Mycobacterium avium
ALAEESRETGWDKPS

SEQ ID NO: 60286 - protein, 9 aa, Mycobacterium avium
ALAGGGPKY

SEQ ID NO: 60287 - protein, 5 aa, Mycobacterium avium
ALAGT

SEQ ID NO: 60288 - protein, 13 aa, Mycobacterium avium
ALAGTGAAERLRP

SEQ ID NO: 60289 - protein, 7 aa, Mycobacterium avium
ALAPDGR

SEQ ID NO: 60290 - protein, 11 aa, Mycobacterium avium
ALASRARKAPG

SEQ ID NO: 60291 - protein, 10 aa, Mycobacterium avium
ALDNGTPVGT

SEQ ID NO: 60292 - protein, 17 aa, Mycobacterium avium
ALDPKDFPGVPAEDLKP

SEQ ID NO: 60293 - protein, 5 aa, Mycobacterium avium
ALDTG

SEQ ID NO: 60294 - protein, 6 aa, Mycobacterium avium
ALDTGE

SEQ ID NO: 60295 - protein, 6 aa, Mycobacterium avium
ALEGGW

SEQ ID NO: 60296 - protein, 6 aa, Mycobacterium avium
ALEPER

SEQ ID NO: 60297 - protein, 5 aa, Mycobacterium avium
ALEPT

SEQ ID NO: 60298 - protein, 11 aa, Mycobacterium avium
ALERDSDKCDR

SEQ ID NO: 60299 - protein, 6 aa, Mycobacterium avium
ALGAPG

SEQ ID NO: 60300 - protein, 17 aa, Mycobacterium avium
ALGDGQADAERDDQAAD

SEQ ID NO: 60301 - protein, 21 aa, Mycobacterium avium
ALGDNDSDGRLDDQPADTRFE

SEQ ID NO: 60302 - protein, 11 aa, Mycobacterium avium
ALGERSGAGYR

SEQ ID NO: 60303 - protein, 9 aa, Mycobacterium avium
ALGGAGAPR

SEQ ID NO: 60304 - protein, 6 aa, Mycobacterium avium
ALGGIT

SEQ ID NO: 60305 - protein, 7 aa, Mycobacterium avium
ALGPRSR

SEQ ID NO: 60306 - protein, 11 aa, Mycobacterium avium
ALGRSTTGASV

SEQ ID NO: 60307 - protein, 11 aa, Mycobacterium avium
ALGSYAEPGWA

SEQ ID NO: 60308 - protein, 4 aa, Mycobacterium avium
ALGT

SEQ ID NO: 60309 - protein, 8 aa, Mycobacterium avium
ALGTEPGE

SEQ ID NO: 60310 - protein, 50 aa, Mycobacterium avium
ALHDRDAGVGGRRTDRREDRRPAQADQRVGHGGEAGRQRLTEGGRDPGVV

SEQ ID NO: 60311 - protein, 14 aa, Mycobacterium avium
ALHSSRRDALSAEL

SEQ ID NO: 60312 - protein, 8 aa, Mycobacterium avium
ALLGGSPT

SEQ ID NO: 60313 - protein, 7 aa, Mycobacterium avium
ALNGSGN

SEQ ID NO: 60314 - protein, 10 aa, Mycobacterium avium
ALNKPSNSDV

SEQ ID NO: 60315 - protein, 7 aa, Mycobacterium avium
ALNTEAF

SEQ ID NO: 60316 - protein, 10 aa, Mycobacterium avium
ALPAAQAGAG

SEQ ID NO: 60317 - protein, 7 aa, Mycobacterium avium
ALPAGVE

SEQ ID NO: 60318 - protein, 10 aa, Mycobacterium avium
ALPAKAADSL

SEQ ID NO: 60319 - protein, 26 aa, Mycobacterium avium
ALPDDVPASSAADVTGRRDDDGAEGH

SEQ ID NO: 60320 - protein, 5 aa, Mycobacterium avium
ALPDE

SEQ ID NO: 60321 - protein, 13 aa, Mycobacterium avium
ALPDGASGQPAYL

SEQ ID NO: 60322 - protein, 8 aa, Mycobacterium avium
ALPDGPDA

SEQ ID NO: 60323 - protein, 6 aa, Mycobacterium avium
ALPDGT

SEQ ID NO: 60324 - protein, 9 aa, Mycobacterium avium
ALPENSNQV

SEQ ID NO: 60325 - protein, 7 aa, Mycobacterium avium
ALPGPLT

SEQ ID NO: 60326 - protein, 17 aa, Mycobacterium avium
ALPGSASDNHHHGESET

SEQ ID NO: 60327 - protein, 6 aa, Mycobacterium avium
ALPPVR

SEQ ID NO: 60328 - protein, 22 aa, Mycobacterium avium
ALPQPQIGAGTEYRDPATPTEH

SEQ ID NO: 60329 - protein, 22 aa, Mycobacterium avium
ALPQPQIGAGTEYRDPTTPTEH

SEQ ID NO: 60330 - protein, 21 aa, Mycobacterium avium
ALPQPQLAAGTEYRDPTTPTE

SEQ ID NO: 60331 - protein, 16 aa, Mycobacterium avium
ALPRTPALSASPSGLG

SEQ ID NO: 60332 - protein, 16 aa, Mycobacterium avium
ALPRTPALSASPTGLG

SEQ ID NO: 60333 - protein, 8 aa, Mycobacterium avium
ALPSAAEP

SEQ ID NO: 60334 - protein, 7 aa, Mycobacterium avium
ALPSGAP

SEQ ID NO: 60335 - protein, 19 aa, Mycobacterium avium
ALPTADLDAPRTSPQGEVP

SEQ ID NO: 60336 - protein, 4 aa, Mycobacterium avium
ALQA

SEQ ID NO: 60337 - protein, 31 aa, Mycobacterium avium
ALQGRGPAKPEQPLTAEDEAALAAPGARRQA

SEQ ID NO: 60338 - protein, 31 aa, Mycobacterium avium
ALQGRGPAKPEQPLTAEDKAALAAPGARRQA

SEQ ID NO: 60339 - protein, 52 aa, Mycobacterium avium
ALQGRGPGQAGAAADGRGRSGVGRPGCATAGGAEPAAVPGTDQGARGAPRAV

SEQ ID NO: 60340 - protein, 7 aa, Mycobacterium avium
ALQTHGG

SEQ ID NO: 60341 - protein, 40 aa, Mycobacterium avium
ALRAGRPRCPAARQRPGPQQHRPHQRQQHRRQDPGRPLHP

SEQ ID NO: 60342 - protein, 7 aa, Mycobacterium avium
ALRDPDT

SEQ ID NO: 60343 - protein, 13 aa, Mycobacterium avium
ALRDPGTSEPALT

SEQ ID NO: 60344 - protein, 5 aa, Mycobacterium avium
ALRDV

SEQ ID NO: 60345 - protein, 5 aa, Mycobacterium avium
ALRGG

SEQ ID NO: 60346 - protein, 20 aa, Mycobacterium avium
ALRPAPVGAYPAGASACGAE

SEQ ID NO: 60347 - protein, 17 aa, Mycobacterium avium
ALRPGGSLPTNTDGGGL

SEQ ID NO: 60348 - protein, 7 aa, Mycobacterium avium
ALRPRPE

SEQ ID NO: 60349 - protein, 8 aa, Mycobacterium avium
ALRPVDSS

SEQ ID NO: 60350 - protein, 13 aa, Mycobacterium avium
ALRRQATAEGRSM

SEQ ID NO: 60351 - protein, 7 aa, Mycobacterium avium
ALRSGPL

SEQ ID NO: 60352 - protein, 6 aa, Mycobacterium avium
ALSAAG

SEQ ID NO: 60353 - protein, 9 aa, Mycobacterium avium
ALSAAPDGA

SEQ ID NO: 60354 - protein, 10 aa, Mycobacterium avium
ALSAAPDGTR

SEQ ID NO: 60355 - protein, 7 aa, Mycobacterium avium
ALSAGSS

SEQ ID NO: 60356 - protein, 9 aa, Mycobacterium avium
ALSAPPPAA

SEQ ID NO: 60357 - protein, 18 aa, Mycobacterium avium
ALSDDSDDSGDVDHDPKI

SEQ ID NO: 60358 - protein, 8 aa, Mycobacterium avium
ALSDPAAE

SEQ ID NO: 60359 - protein, 10 aa, Mycobacterium avium
ALSDRARNGR

SEQ ID NO: 60360 - protein, 5 aa, Mycobacterium avium
ALSEA

SEQ ID NO: 60361 - protein, 8 aa, Mycobacterium avium
ALSEGSGR

SEQ ID NO: 60362 - protein, 15 aa, Mycobacterium avium
ALSGEAAALSGEASA

SEQ ID NO: 60363 - protein, 6 aa, Mycobacterium avium
ALSNDP

SEQ ID NO: 60364 - protein, 18 aa, Mycobacterium avium
ALSPFEAPAGGGPGENPY

SEQ ID NO: 60365 - protein, 5 aa, Mycobacterium avium
ALSPR

SEQ ID NO: 60366 - protein, 8 aa, Mycobacterium avium
ALSQPSVP

SEQ ID NO: 60367 - protein, 5 aa, Mycobacterium avium
ALSTR

SEQ ID NO: 60368 - protein, 10 aa, Mycobacterium avium
ALSTRDRIGQ

SEQ ID NO: 60369 - protein, 6 aa, Mycobacterium avium
ALTNSE

SEQ ID NO: 60370 - protein, 5 aa, Mycobacterium avium
ALTPG

SEQ ID NO: 60371 - protein, 6 aa, Mycobacterium avium
ALTREE

SEQ ID NO: 60372 - protein, 6 aa, Mycobacterium avium
ALTSGH

SEQ ID NO: 60373 - protein, 4 aa, Mycobacterium avium
ALTY

SEQ ID NO: 60374 - protein, 5 aa, Mycobacterium avium
ALTYP

SEQ ID NO: 60375 - protein, 5 aa, Mycobacterium avium
AMAGE

SEQ ID NO: 60376 - protein, 15 aa, Mycobacterium avium
AMATAPTVKSPARER

SEQ ID NO: 60377 - protein, 12 aa, Mycobacterium avium
AMDNARDATQIH

SEQ ID NO: 60378 - protein, 23 aa, Mycobacterium avium
AMGAPDASTAAGDQNNAPGKWLI

SEQ ID NO: 60379 - protein, 13 aa, Mycobacterium avium
AMNADRSGDRFQT

SEQ ID NO: 60380 - protein, 16 aa, Mycobacterium avium
AMPGRDADPSPSSTST

SEQ ID NO: 60381 - protein, 16 aa, Mycobacterium avium
AMPGRDEEPSPSSTST

SEQ ID NO: 60382 - protein, 16 aa, Mycobacterium avium
AMPGRGEDPSPSSTST

SEQ ID NO: 60383 - protein, 9 aa, Mycobacterium avium
AMQTPGADR

SEQ ID NO: 60384 - protein, 10 aa, Mycobacterium avium
AMRPEPQRRH

SEQ ID NO: 60385 - protein, 7 aa, Mycobacterium avium
AMRSQQR

SEQ ID NO: 60386 - protein, 6 aa, Mycobacterium avium
AMRTTR

SEQ ID NO: 60387 - protein, 8 aa, Mycobacterium avium
AMSPDTSW

SEQ ID NO: 60388 - protein, 8 aa, Mycobacterium avium
AMTATGDE

SEQ ID NO: 60389 - protein, 5 aa, Mycobacterium avium
AMTGY

SEQ ID NO: 60390 - protein, 64 aa, Mycobacterium avium
AMVPPGEELPATSGAPPHGTTPGRTAPTTGPRNCPRRSGPRTPSWSTSARSRTTASTPPMPSSV

SEQ ID NO: 60391 - protein, 4 aa, Mycobacterium avium
ANAA

SEQ ID NO: 60392 - protein, 10 aa, Mycobacterium avium
ANAAKDHVRQ

SEQ ID NO: 60393 - protein, 5 aa, Mycobacterium avium
ANAEQ

SEQ ID NO: 60394 - protein, 6 aa, Mycobacterium avium
ANAFNR

SEQ ID NO: 60395 - protein, 8 aa, Mycobacterium avium
ANAGDYGP

SEQ ID NO: 60396 - protein, 7 aa, Mycobacterium avium
ANAGEQL

SEQ ID NO: 60397 - protein, 8 aa, Mycobacterium avium
ANAGLGEV

SEQ ID NO: 60398 - protein, 7 aa, Mycobacterium avium
ANAMGRP

SEQ ID NO: 60399 - protein, 9 aa, Mycobacterium avium
ANANDGANI

SEQ ID NO: 60400 - protein, 10 aa, Mycobacterium avium
ANAQRMAGDG

SEQ ID NO: 60401 - protein, 10 aa, Mycobacterium avium
ANASGASGEA

SEQ ID NO: 60402 - protein, 13 aa, Mycobacterium avium
ANASNPTSAQADS

SEQ ID NO: 60403 - protein, 8 aa, Mycobacterium avium
ANATGAVQ

SEQ ID NO: 60404 - protein, 13 aa, Mycobacterium avium
ANATQRPPREPAR

SEQ ID NO: 60405 - protein, 8 aa, Mycobacterium avium
ANAYAPQK

SEQ ID NO: 60406 - protein, 7 aa, Mycobacterium avium
ANDEQKE

SEQ ID NO: 60407 - protein, 9 aa, Mycobacterium avium
ANDPKQLHE

SEQ ID NO: 60408 - protein, 10 aa, Mycobacterium avium
ANDPKQLHEG

SEQ ID NO: 60409 - protein, 5 aa, Mycobacterium avium
ANDRP

SEQ ID NO: 60410 - protein, 5 aa, Mycobacterium avium
ANDTA

SEQ ID NO: 60411 - protein, 7 aa, Mycobacterium avium
ANDTGGG

SEQ ID NO: 60412 - protein, 5 aa, Mycobacterium avium
ANEGE

SEQ ID NO: 60413 - protein, 8 aa, Mycobacterium avium
ANEPGKRR

SEQ ID NO: 60414 - protein, 5 aa, Mycobacterium avium
ANESG

SEQ ID NO: 60415 - protein, 4 aa, Mycobacterium avium
ANEY

SEQ ID NO: 60416 - protein, 7 aa, Mycobacterium avium
ANFPGDQ

SEQ ID NO: 60417 - protein, 4 aa, Mycobacterium avium
ANGA

SEQ ID NO: 60418 - protein, 6 aa, Mycobacterium avium
ANGAAV

SEQ ID NO: 60419 - protein, 8 aa, Mycobacterium avium
ANGDPTVD

SEQ ID NO: 60420 - protein, 12 aa, Mycobacterium avium
ANGFDKDRTNAR

SEQ ID NO: 60421 - protein, 6 aa, Mycobacterium avium
ANGGDL

SEQ ID NO: 60422 - protein, 12 aa, Mycobacterium avium
ANGHSPETEEYG

SEQ ID NO: 60423 - protein, 16 aa, Mycobacterium avium
ANGKLDTRALPAPEFQ

SEQ ID NO: 60424 - protein, 28 aa, Mycobacterium avium
ANGKLDTRALPAPGYQNSDHRAPSSPVE

SEQ ID NO: 60425 - protein, 9 aa, Mycobacterium avium
ANGKVDRGK

SEQ ID NO: 60426 - protein, 8 aa, Mycobacterium avium
ANGNPTEI

SEQ ID NO: 60427 - protein, 27 aa, Mycobacterium avium
ANGQGRRRGVASAGGPRRRDGGRGRPR

SEQ ID NO: 60428 - protein, 12 aa, Mycobacterium avium
ANGRATKSPGKT

SEQ ID NO: 60429 - protein, 9 aa, Mycobacterium avium
ANGSESDAQ

SEQ ID NO: 60430 - protein, 11 aa, Mycobacterium avium
ANGTEGGTTDI

SEQ ID NO: 60431 - protein, 8 aa, Mycobacterium avium
ANHEPQLQ

SEQ ID NO: 60432 - protein, 20 aa, Mycobacterium avium
ANHEPQLQSARDLRAAAAAR

SEQ ID NO: 60433 - protein, 5 aa, Mycobacterium avium
ANKSV

SEQ ID NO: 60434 - protein, 7 aa, Mycobacterium avium
ANKVPGA

SEQ ID NO: 60435 - protein, 13 aa, Mycobacterium avium
ANLAAEGNAGFDD

SEQ ID NO: 60436 - protein, 7 aa, Mycobacterium avium
ANLNSPR

SEQ ID NO: 60437 - protein, 6 aa, Mycobacterium avium
ANLRAR

SEQ ID NO: 60438 - protein, 9 aa, Mycobacterium avium
ANLTSSPRW

SEQ ID NO: 60439 - protein, 6 aa, Mycobacterium avium
ANNAEL

SEQ ID NO: 60440 - protein, 9 aa, Mycobacterium avium
ANNSSYGLG

SEQ ID NO: 60441 - protein, 7 aa, Mycobacterium avium
ANPAAGI

SEQ ID NO: 60442 - protein, 6 aa, Mycobacterium avium
ANPAAR

SEQ ID NO: 60443 - protein, 10 aa, Mycobacterium avium
ANPARARRRA

SEQ ID NO: 60444 - protein, 11 aa, Mycobacterium avium
ANPASTEAKGA

SEQ ID NO: 60445 - protein, 14 aa, Mycobacterium avium
ANPCDGTKLPKVQR

SEQ ID NO: 60446 - protein, 15 aa, Mycobacterium avium
ANPDPDAVKPPALVN

SEQ ID NO: 60447 - protein, 15 aa, Mycobacterium avium
ANPDPEAVKPPQLAN

SEQ ID NO: 60448 - protein, 6 aa, Mycobacterium avium
ANPEAV

SEQ ID NO: 60449 - protein, 7 aa, Mycobacterium avium
ANPEAVT

SEQ ID NO: 60450 - protein, 6 aa, Mycobacterium avium
ANPETL

SEQ ID NO: 60451 - protein, 13 aa, Mycobacterium avium
ANPGFTPPSSMLS

SEQ ID NO: 60452 - protein, 7 aa, Mycobacterium avium
ANPLGED

SEQ ID NO: 60453 - protein, 7 aa, Mycobacterium avium
ANPPRRP

SEQ ID NO: 60454 - protein, 6 aa, Mycobacterium avium
ANPTTI

SEQ ID NO: 60455 - protein, 5 aa, Mycobacterium avium
ANPTV

SEQ ID NO: 60456 - protein, 11 aa, Mycobacterium avium
ANQGSDAAGHD

SEQ ID NO: 60457 - protein, 11 aa, Mycobacterium avium
ANRARDGYSKV

SEQ ID NO: 60458 - protein, 7 aa, Mycobacterium avium
ANRDEEI

SEQ ID NO: 60459 - protein, 8 aa, Mycobacterium avium
ANRDERRF

SEQ ID NO: 60460 - protein, 9 aa, Mycobacterium avium
ANRDERRFD

SEQ ID NO: 60461 - protein, 9 aa, Mycobacterium avium
ANRDESTFG

SEQ ID NO: 60462 - protein, 6 aa, Mycobacterium avium
ANRDPA

SEQ ID NO: 60463 - protein, 14 aa, Mycobacterium avium
ANRDPARWDRPDEY

SEQ ID NO: 60464 - protein, 14 aa, Mycobacterium avium
ANRDPAVYDDPDRV

SEQ ID NO: 60465 - protein, 13 aa, Mycobacterium avium
ANRDPRKFESPNE

SEQ ID NO: 60466 - protein, 12 aa, Mycobacterium avium
ANRENAAEALRS

SEQ ID NO: 60467 - protein, 4 aa, Mycobacterium avium
ANRL

SEQ ID NO: 60468 - protein, 12 aa, Mycobacterium avium
ANRQEDRYTDPD

SEQ ID NO: 60469 - protein, 8 aa, Mycobacterium avium
ANRYARAG

SEQ ID NO: 60470 - protein, 8 aa, Mycobacterium avium
ANSAGTLG

SEQ ID NO: 60471 - protein, 7 aa, Mycobacterium avium
ANSAGWS

SEQ ID NO: 60472 - protein, 25 aa, Mycobacterium avium
ANSASASALSPVPSPPQPTNPAAAG

SEQ ID NO: 60473 - protein, 15 aa, Mycobacterium avium
ANSDVNALYQWWRTN

SEQ ID NO: 60474 - protein, 11 aa, Mycobacterium avium
ANSGNSRVGSL

SEQ ID NO: 60475 - protein, 9 aa, Mycobacterium avium
ANSLGDHVS

SEQ ID NO: 60476 - protein, 8 aa, Mycobacterium avium
ANSNAAAH

SEQ ID NO: 60477 - protein, 11 aa, Mycobacterium avium
ANSPIDGKGRF

SEQ ID NO: 60478 - protein, 22 aa, Mycobacterium avium
ANSTPYDPDPMRAHSPASSYGA

SEQ ID NO: 60479 - protein, 4 aa, Mycobacterium avium
ANTE

SEQ ID NO: 60480 - protein, 9 aa, Mycobacterium avium
ANTGGDCDG

SEQ ID NO: 60481 - protein, 17 aa, Mycobacterium avium
ANTGRRCPEPPAPHANP

SEQ ID NO: 60482 - protein, 11 aa, Mycobacterium avium
ANTLGGGGEAF

SEQ ID NO: 60483 - protein, 7 aa, Mycobacterium avium
ANTNPDL

SEQ ID NO: 60484 - protein, 9 aa, Mycobacterium avium
ANTSRGAVG

SEQ ID NO: 60485 - protein, 15 aa, Mycobacterium avium
ANVGDQIEPSAFTED

SEQ ID NO: 60486 - protein, 7 aa, Mycobacterium avium
ANVPPSV

SEQ ID NO: 60487 - protein, 5 aa, Mycobacterium avium
ANVTS

SEQ ID NO: 60488 - protein, 5 aa, Mycobacterium avium
ANYGA

SEQ ID NO: 60489 - protein, 15 aa, Mycobacterium avium
APAAAAAPPGRPGPF

SEQ ID NO: 60490 - protein, 104 aa, Mycobacterium avium
APAAAAATPGPAGTPVAAAPAGSATLASATAPAGPARVATPAYAPAGSPSPVQPAASSAPAPAGTPAAAAQPEAAPQTSAGPALPVSARPAPHAPAQAQPATAP

SEQ ID NO: 60491 - protein, 17 aa, Mycobacterium avium
APAAAETEAAPASSAMP

SEQ ID NO: 60492 - protein, 17 aa, Mycobacterium avium
APAAAETEAAPASSTMP

SEQ ID NO: 60493 - protein, 19 aa, Mycobacterium avium
APAADETEAAPASSVMPDA

SEQ ID NO: 60494 - protein, 10 aa, Mycobacterium avium
APAANDPRLV

SEQ ID NO: 60495 - protein, 5 aa, Mycobacterium avium
APAAR

SEQ ID NO: 60496 - protein, 5 aa, Mycobacterium avium
APAAT

SEQ ID NO: 60497 - protein, 7 aa, Mycobacterium avium
APAATDI

SEQ ID NO: 60498 - protein, 11 aa, Mycobacterium avium
APACPGAPARW

SEQ ID NO: 60499 - protein, 15 aa, Mycobacterium avium
APACSGSGKCFPSGN

SEQ ID NO: 60500 - protein, 9 aa, Mycobacterium avium
APADGSDAL

SEQ ID NO: 60501 - protein, 6 aa, Mycobacterium avium
APADPK

SEQ ID NO: 60502 - protein, 9 aa, Mycobacterium avium
APADPPGLS

SEQ ID NO: 60503 - protein, 9 aa, Mycobacterium avium
APADPPGLT

SEQ ID NO: 60504 - protein, 9 aa, Mycobacterium avium
APADRGAAL

SEQ ID NO: 60505 - protein, 6 aa, Mycobacterium avium
APAEPV

SEQ ID NO: 60506 - protein, 5 aa, Mycobacterium avium
APAGA

SEQ ID NO: 60507 - protein, 9 aa, Mycobacterium avium
APAGDVESS

SEQ ID NO: 60508 - protein, 5 aa, Mycobacterium avium
APAGL

SEQ ID NO: 60509 - protein, 11 aa, Mycobacterium avium
APAGRGLPIPP

SEQ ID NO: 60510 - protein, 8 aa, Mycobacterium avium
APAKRELT

SEQ ID NO: 60511 - protein, 8 aa, Mycobacterium avium
APAKTSAA

SEQ ID NO: 60512 - protein, 11 aa, Mycobacterium avium
APALGEGNDDV

SEQ ID NO: 60513 - protein, 14 aa, Mycobacterium avium
APAPAAAGSAAPEV

SEQ ID NO: 60514 - protein, 15 aa, Mycobacterium avium
APAPAAASSAAPETV

SEQ ID NO: 60515 - protein, 13 aa, Mycobacterium avium
APAPAAGSRATGG

SEQ ID NO: 60516 - protein, 15 aa, Mycobacterium avium
APAPEAAGSAAPEAV

SEQ ID NO: 60517 - protein, 9 aa, Mycobacterium avium
APAPERSPA

SEQ ID NO: 60518 - protein, 18 aa, Mycobacterium avium
APAPGNAPGADLESQCAT

SEQ ID NO: 60519 - protein, 14 aa, Mycobacterium avium
APAPGRRPPGPRQR

SEQ ID NO: 60520 - protein, 13 aa, Mycobacterium avium
APAPGRRPPGPRR

SEQ ID NO: 60521 - protein, 14 aa, Mycobacterium avium
APAPGRRPPGPRRR

SEQ ID NO: 60522 - protein, 18 aa, Mycobacterium avium
APAPGSAPGADLESHCAT

SEQ ID NO: 60523 - protein, 10 aa, Mycobacterium avium
APAPPPLSDA

SEQ ID NO: 60524 - protein, 5 aa, Mycobacterium avium
APAPT

SEQ ID NO: 60525 - protein, 4 aa, Mycobacterium avium
APAQ

SEQ ID NO: 60526 - protein, 18 aa, Mycobacterium avium
APAQGNAPGADLESQCAT

SEQ ID NO: 60527 - protein, 7 aa, Mycobacterium avium
APARPVR

SEQ ID NO: 60528 - protein, 5 aa, Mycobacterium avium
APASA

SEQ ID NO: 60529 - protein, 20 aa, Mycobacterium avium
APASIEHAGSQAGYPAPPLQ

SEQ ID NO: 60530 - protein, 22 aa, Mycobacterium avium
APASISVSDEQLAPGGSAESAE

SEQ ID NO: 60531 - protein, 9 aa, Mycobacterium avium
APATPTEET

SEQ ID NO: 60532 - protein, 27 aa, Mycobacterium avium
APCDPPPGFGYTREGTYKGFPGSTVDR

SEQ ID NO: 60533 - protein, 6 aa, Mycobacterium avium
APCPPE

SEQ ID NO: 60534 - protein, 6 aa, Mycobacterium avium
APDAEG

SEQ ID NO: 60535 - protein, 5 aa, Mycobacterium avium
APDAF

SEQ ID NO: 60536 - protein, 14 aa, Mycobacterium avium
APDAGGVAGSMGRS

SEQ ID NO: 60537 - protein, 12 aa, Mycobacterium avium
APDAGTAEAEAA

SEQ ID NO: 60538 - protein, 5 aa, Mycobacterium avium
APDAP

SEQ ID NO: 60539 - protein, 11 aa, Mycobacterium avium
APDAPTSPGEI

SEQ ID NO: 60540 - protein, 21 aa, Mycobacterium avium
APDCSPSGVNSTVSAVEGSAQ

SEQ ID NO: 60541 - protein, 11 aa, Mycobacterium avium
APDDEPDARRG

SEQ ID NO: 60542 - protein, 7 aa, Mycobacterium avium
APDEKWG

SEQ ID NO: 60543 - protein, 7 aa, Mycobacterium avium
APDESIA

SEQ ID NO: 60544 - protein, 5 aa, Mycobacterium avium
APDGG

SEQ ID NO: 60545 - protein, 6 aa, Mycobacterium avium
APDGPS

SEQ ID NO: 60546 - protein, 5 aa, Mycobacterium avium
APDGR

SEQ ID NO: 60547 - protein, 8 aa, Mycobacterium avium
APDGTPQQ

SEQ ID NO: 60548 - protein, 4 aa, Mycobacterium avium
APDI

SEQ ID NO: 60549 - protein, 5 aa, Mycobacterium avium
APDLR

SEQ ID NO: 60550 - protein, 8 aa, Mycobacterium avium
APDNSAET

SEQ ID NO: 60551 - protein, 5 aa, Mycobacterium avium
APDPP

SEQ ID NO: 60552 - protein, 7 aa, Mycobacterium avium
APDQGLT

SEQ ID NO: 60553 - protein, 4 aa, Mycobacterium avium
APDR

SEQ ID NO: 60554 - protein, 7 aa, Mycobacterium avium
APDRDAA

SEQ ID NO: 60555 - protein, 5 aa, Mycobacterium avium
APDRT

SEQ ID NO: 60556 - protein, 6 aa, Mycobacterium avium
APDWPT

SEQ ID NO: 60557 - protein, 12 aa, Mycobacterium avium
APEAPPSAGGGP

SEQ ID NO: 60558 - protein, 6 aa, Mycobacterium avium
APEKAD

SEQ ID NO: 60559 - protein, 6 aa, Mycobacterium avium
APELTS

SEQ ID NO: 60560 - protein, 11 aa, Mycobacterium avium
APEPAPETVAP

SEQ ID NO: 60561 - protein, 10 aa, Mycobacterium avium
APEPPEDPAA

SEQ ID NO: 60562 - protein, 7 aa, Mycobacterium avium
APESAGI

SEQ ID NO: 60563 - protein, 8 aa, Mycobacterium avium
APETLARN

SEQ ID NO: 60564 - protein, 6 aa, Mycobacterium avium
APEVDN

SEQ ID NO: 60565 - protein, 5 aa, Mycobacterium avium
APEVE

SEQ ID NO: 60566 - protein, 6 aa, Mycobacterium avium
APEVGS

SEQ ID NO: 60567 - protein, 5 aa, Mycobacterium avium
APFGR

SEQ ID NO: 60568 - protein, 6 aa, Mycobacterium avium
APFPPT

SEQ ID NO: 60569 - protein, 6 aa, Mycobacterium avium
APGAAA

SEQ ID NO: 60570 - protein, 6 aa, Mycobacterium avium
APGAAW

SEQ ID NO: 60571 - protein, 7 aa, Mycobacterium avium
APGAGTL

SEQ ID NO: 60572 - protein, 5 aa, Mycobacterium avium
APGAL

SEQ ID NO: 60573 - protein, 5 aa, Mycobacterium avium
APGAN

SEQ ID NO: 60574 - protein, 10 aa, Mycobacterium avium
APGATGNIAT

SEQ ID NO: 60575 - protein, 7 aa, Mycobacterium avium
APGATPI

SEQ ID NO: 60576 - protein, 11 aa, Mycobacterium avium
APGFTEAASAA

SEQ ID NO: 60577 - protein, 9 aa, Mycobacterium avium
APGGIENAE

SEQ ID NO: 60578 - protein, 5 aa, Mycobacterium avium
APGGQ

SEQ ID NO: 60579 - protein, 6 aa, Mycobacterium avium
APGGQG

SEQ ID NO: 60580 - protein, 6 aa, Mycobacterium avium
APGHAD

SEQ ID NO: 60581 - protein, 6 aa, Mycobacterium avium
APGLGP

SEQ ID NO: 60582 - protein, 17 aa, Mycobacterium avium
APGLRRPALPGPAPPGQ

SEQ ID NO: 60583 - protein, 5 aa, Mycobacterium avium
APGPI

SEQ ID NO: 60584 - protein, 6 aa, Mycobacterium avium
APGPIE

SEQ ID NO: 60585 - protein, 12 aa, Mycobacterium avium
APGPIPPQPGSP

SEQ ID NO: 60586 - protein, 9 aa, Mycobacterium avium
APGPPGAHD

SEQ ID NO: 60587 - protein, 12 aa, Mycobacterium avium
APGQPLAAAGVR

SEQ ID NO: 60588 - protein, 9 aa, Mycobacterium avium
APGQTAAEQ

SEQ ID NO: 60589 - protein, 4 aa, Mycobacterium avium
APGR

SEQ ID NO: 60590 - protein, 24 aa, Mycobacterium avium
APGRMDSAHARAGRGEPLEPIGTD

SEQ ID NO: 60591 - protein, 4 aa, Mycobacterium avium
APGS

SEQ ID NO: 60592 - protein, 9 aa, Mycobacterium avium
APGSIKTPQ

SEQ ID NO: 60593 - protein, 8 aa, Mycobacterium avium
APGTGLPV

SEQ ID NO: 60594 - protein, 9 aa, Mycobacterium avium
APGTPGSRK

SEQ ID NO: 60595 - protein, 7 aa, Mycobacterium avium
APGTPPV

SEQ ID NO: 60596 - protein, 6 aa, Mycobacterium avium
APGTVG

SEQ ID NO: 60597 - protein, 6 aa, Mycobacterium avium
APGVGP

SEQ ID NO: 60598 - protein, 5 aa, Mycobacterium avium
APGVT

SEQ ID NO: 60599 - protein, 7 aa, Mycobacterium avium
APGWPRE

SEQ ID NO: 60600 - protein, 14 aa, Mycobacterium avium
APHAVPTTPLPEAH

SEQ ID NO: 60601 - protein, 4 aa, Mycobacterium avium
APHE

SEQ ID NO: 60602 - protein, 32 aa, Mycobacterium avium
APHPAPRLGEHTEGYRGAELTPRPAPDGGRAA

SEQ ID NO: 60603 - protein, 17 aa, Mycobacterium avium
APIGTDPWTAETEVGHD

SEQ ID NO: 60604 - protein, 8 aa, Mycobacterium avium
APISLPGA

SEQ ID NO: 60605 - protein, 4 aa, Mycobacterium avium
APIT

SEQ ID NO: 60606 - protein, 7 aa, Mycobacterium avium
APITDGD

SEQ ID NO: 60607 - protein, 12 aa, Mycobacterium avium
APKFAESQSLPD

SEQ ID NO: 60608 - protein, 5 aa, Mycobacterium avium
APKGP

SEQ ID NO: 60609 - protein, 23 aa, Mycobacterium avium
APKPAGLRNYGPTPTAADVEPGR

SEQ ID NO: 60610 - protein, 17 aa, Mycobacterium avium
APLAPTGRGTPADGGVR

SEQ ID NO: 60611 - protein, 10 aa, Mycobacterium avium
APLDDASRNR

SEQ ID NO: 60612 - protein, 6 aa, Mycobacterium avium
APLEDG

SEQ ID NO: 60613 - protein, 23 aa, Mycobacterium avium
APLPQPVNGAQPGAAPVASPGAP

SEQ ID NO: 60614 - protein, 7 aa, Mycobacterium avium
APLPTGR

SEQ ID NO: 60615 - protein, 15 aa, Mycobacterium avium
APLQKPNYGNVIPLH

SEQ ID NO: 60616 - protein, 54 aa, Mycobacterium avium
APLRAGPAPPPDQHDDHDHDTGDKAHTDPKSNGESQAAPATSVPSSDAVVGGST

SEQ ID NO: 60617 - protein, 58 aa, Mycobacterium avium
APLRAGPAPPPDQHDDQHDDQDHDTGDKAHTDPKSNGESQAAPATSVPSSDAVVGGST

SEQ ID NO: 60618 - protein, 58 aa, Mycobacterium avium
APLRAGPAPPPDQHDDQHHDKHHDTGDKAHTDPKSNGESQAAPATSVPSSDAVVGGST

SEQ ID NO: 60619 - protein, 5 aa, Mycobacterium avium
APLRR

SEQ ID NO: 60620 - protein, 11 aa, Mycobacterium avium
APLSAPPDRLT

SEQ ID NO: 60621 - protein, 8 aa, Mycobacterium avium
APLSETGR

SEQ ID NO: 60622 - protein, 14 aa, Mycobacterium avium
APLTAGSGFPPIGA

SEQ ID NO: 60623 - protein, 15 aa, Mycobacterium avium
APLTAGSGFPPIGAP

SEQ ID NO: 60624 - protein, 16 aa, Mycobacterium avium
APLTAGSGVPPIGSPL

SEQ ID NO: 60625 - protein, 6 aa, Mycobacterium avium
APLTSD

SEQ ID NO: 60626 - protein, 6 aa, Mycobacterium avium
APMPDQ

SEQ ID NO: 60627 - protein, 7 aa, Mycobacterium avium
APNGDTY

SEQ ID NO: 60628 - protein, 8 aa, Mycobacterium avium
APNGEPMT

SEQ ID NO: 60629 - protein, 9 aa, Mycobacterium avium
APNGEPTTE

SEQ ID NO: 60630 - protein, 4 aa, Mycobacterium avium
APNS

SEQ ID NO: 60631 - protein, 5 aa, Mycobacterium avium
APNSA

SEQ ID NO: 60632 - protein, 9 aa, Mycobacterium avium
APNYDRGSV

SEQ ID NO: 60633 - protein, 5 aa, Mycobacterium avium
APPAA

SEQ ID NO: 60634 - protein, 7 aa, Mycobacterium avium
APPADGQ

SEQ ID NO: 60635 - protein, 10 aa, Mycobacterium avium
APPAGGAHDE

SEQ ID NO: 60636 - protein, 6 aa, Mycobacterium avium
APPALV

SEQ ID NO: 60637 - protein, 10 aa, Mycobacterium avium
APPAPPASWA

SEQ ID NO: 60638 - protein, 7 aa, Mycobacterium avium
APPARRR

SEQ ID NO: 60639 - protein, 18 aa, Mycobacterium avium
APPASVPSRRSVERTRVR

SEQ ID NO: 60640 - protein, 16 aa, Mycobacterium avium
APPDVPWSTDADGGPA

SEQ ID NO: 60641 - protein, 6 aa, Mycobacterium avium
APPEDW

SEQ ID NO: 60642 - protein, 7 aa, Mycobacterium avium
APPGDGQ

SEQ ID NO: 60643 - protein, 7 aa, Mycobacterium avium
APPGDGY

SEQ ID NO: 60644 - protein, 27 aa, Mycobacterium avium
APPGGDGHRGAGGDGHRGPDGDGKPRR

SEQ ID NO: 60645 - protein, 8 aa, Mycobacterium avium
APPGKIGR

SEQ ID NO: 60646 - protein, 8 aa, Mycobacterium avium
APPGNTDR

SEQ ID NO: 60647 - protein, 18 aa, Mycobacterium avium
APPIPPRAGVRSAENEAE

SEQ ID NO: 60648 - protein, 11 aa, Mycobacterium avium
APPKDEPPVGR

SEQ ID NO: 60649 - protein, 11 aa, Mycobacterium avium
APPKGEPPVGR

SEQ ID NO: 60650 - protein, 13 aa, Mycobacterium avium
APPLPYKGSRDPK

SEQ ID NO: 60651 - protein, 50 aa, Mycobacterium avium
APPPDDVEDAPIPPAEPFPDTDAALSADDGADGEPVENGEPVTDTQPGWP

SEQ ID NO: 60652 - protein, 10 aa, Mycobacterium avium
APPPISLPGA

SEQ ID NO: 60653 - protein, 8 aa, Mycobacterium avium
APPPRPDR

SEQ ID NO: 60654 - protein, 4 aa, Mycobacterium avium
APPQ

SEQ ID NO: 60655 - protein, 6 aa, Mycobacterium avium
APPRIG

SEQ ID NO: 60656 - protein, 14 aa, Mycobacterium avium
APPRPIRCGRPGPT

SEQ ID NO: 60657 - protein, 21 aa, Mycobacterium avium
APPTRSAAPLADNEIETSGAD

SEQ ID NO: 60658 - protein, 5 aa, Mycobacterium avium
APPVG

SEQ ID NO: 60659 - protein, 22 aa, Mycobacterium avium
APPVQTGTSSVAASGPWPTTPL

SEQ ID NO: 60660 - protein, 38 aa, Mycobacterium avium
APQATTAATQVTPATPGTPGPAPAPAQAPAPAPATSGT

SEQ ID NO: 60661 - protein, 7 aa, Mycobacterium avium
APQEAAT

SEQ ID NO: 60662 - protein, 4 aa, Mycobacterium avium
APQL

SEQ ID NO: 60663 - protein, 7 aa, Mycobacterium avium
APQLASP

SEQ ID NO: 60664 - protein, 8 aa, Mycobacterium avium
APQPDGTP

SEQ ID NO: 60665 - protein, 9 aa, Mycobacterium avium
APQPPPAPR

SEQ ID NO: 60666 - protein, 12 aa, Mycobacterium avium
APQPVRNSEYTT

SEQ ID NO: 60667 - protein, 20 aa, Mycobacterium avium
APQPVTTQHATPAAESDARP

SEQ ID NO: 60668 - protein, 8 aa, Mycobacterium avium
APQRRGDP

SEQ ID NO: 60669 - protein, 5 aa, Mycobacterium avium
APQSI

SEQ ID NO: 60670 - protein, 21 aa, Mycobacterium avium
APQTRAEAAPARSRRNRSTAT

SEQ ID NO: 60671 - protein, 21 aa, Mycobacterium avium
APQTRAEAAPTRSRRNRNAAT

SEQ ID NO: 60672 - protein, 21 aa, Mycobacterium avium
APQTRAEAAPTRSRRNRSAAT

SEQ ID NO: 60673 - protein, 5 aa, Mycobacterium avium
APRAC

SEQ ID NO: 60674 - protein, 13 aa, Mycobacterium avium
APRALGGAATISS

SEQ ID NO: 60675 - protein, 14 aa, Mycobacterium avium
APRALGGGAATIPS

SEQ ID NO: 60676 - protein, 5 aa, Mycobacterium avium
APRAP

SEQ ID NO: 60677 - protein, 8 aa, Mycobacterium avium
APREPGKH

SEQ ID NO: 60678 - protein, 7 aa, Mycobacterium avium
APRGAAA

SEQ ID NO: 60679 - protein, 13 aa, Mycobacterium avium
APRGADAPGRRGV

SEQ ID NO: 60680 - protein, 12 aa, Mycobacterium avium
APRGAPSRAPAT

SEQ ID NO: 60681 - protein, 16 aa, Mycobacterium avium
APRGDLRQQQPRARAD

SEQ ID NO: 60682 - protein, 7 aa, Mycobacterium avium
APRGGYQ

SEQ ID NO: 60683 - protein, 6 aa, Mycobacterium avium
APRIPA

SEQ ID NO: 60684 - protein, 5 aa, Mycobacterium avium
APRIS

SEQ ID NO: 60685 - protein, 19 aa, Mycobacterium avium
APRPPTRSRRCASSPGPPA

SEQ ID NO: 60686 - protein, 7 aa, Mycobacterium avium
APRPSST

SEQ ID NO: 60687 - protein, 5 aa, Mycobacterium avium
APRPY

SEQ ID NO: 60688 - protein, 8 aa, Mycobacterium avium
APRRGEGV

SEQ ID NO: 60689 - protein, 42 aa, Mycobacterium avium
APRRPGAGGGAAPRRRRAQRPANPRTGPGADRPAAHRLTATN

SEQ ID NO: 60690 - protein, 19 aa, Mycobacterium avium
APRRRRAQRPPGRFPSSWP

SEQ ID NO: 60691 - protein, 28 aa, Mycobacterium avium
APRRRSGGVPRARPAARHSRCPGSAGPT

SEQ ID NO: 60692 - protein, 71 aa, Mycobacterium avium
APRRYPPHPAPGPPGDLESAGRRCAGDLDRADHQHPLRSGGAAPAAGGDRRSHPGRTNRRPTGGPGQRGRL

SEQ ID NO: 60693 - protein, 8 aa, Mycobacterium avium
APSAIGRG

SEQ ID NO: 60694 - protein, 5 aa, Mycobacterium avium
APSAR

SEQ ID NO: 60695 - protein, 14 aa, Mycobacterium avium
APSDGVTDHQRRRA

SEQ ID NO: 60696 - protein, 8 aa, Mycobacterium avium
APSEGGRI

SEQ ID NO: 60697 - protein, 8 aa, Mycobacterium avium
APSGGPGQ

SEQ ID NO: 60698 - protein, 5 aa, Mycobacterium avium
APSIA

SEQ ID NO: 60699 - protein, 9 aa, Mycobacterium avium
APSPNPATG

SEQ ID NO: 60700 - protein, 5 aa, Mycobacterium avium
APSQY

SEQ ID NO: 60701 - protein, 10 aa, Mycobacterium avium
APTAAGTRIT

SEQ ID NO: 60702 - protein, 11 aa, Mycobacterium avium
APTADEIARAE

SEQ ID NO: 60703 - protein, 8 aa, Mycobacterium avium
APTASNAQ

SEQ ID NO: 60704 - protein, 27 aa, Mycobacterium avium
APTDALRRGGYRRAHPGRRAATRFSIR

SEQ ID NO: 60705 - protein, 4 aa, Mycobacterium avium
APTG

SEQ ID NO: 60706 - protein, 43 aa, Mycobacterium avium
APTGVARPPADAGPAPDRESGAAADAIASAEAALAQQNSVSSQ

SEQ ID NO: 60707 - protein, 11 aa, Mycobacterium avium
APTHPHPGVES

SEQ ID NO: 60708 - protein, 13 aa, Mycobacterium avium
APTINSALAVHPA

SEQ ID NO: 60709 - protein, 4 aa, Mycobacterium avium
APTL

SEQ ID NO: 60710 - protein, 5 aa, Mycobacterium avium
APTLT

SEQ ID NO: 60711 - protein, 5 aa, Mycobacterium avium
APTNC

SEQ ID NO: 60712 - protein, 6 aa, Mycobacterium avium
APTNCS

SEQ ID NO: 60713 - protein, 13 aa, Mycobacterium avium
APTPAGANQLESP

SEQ ID NO: 60714 - protein, 27 aa, Mycobacterium avium
APTPHAVPGQRNPVHGKGFSAAGAYEG

SEQ ID NO: 60715 - protein, 35 aa, Mycobacterium avium
APTPHAVPGQRNPVRGKGFTAAGAYEGLPRSHRSA

SEQ ID NO: 60716 - protein, 13 aa, Mycobacterium avium
APTPTQAATLTPA

SEQ ID NO: 60717 - protein, 8 aa, Mycobacterium avium
APTQQAPL

SEQ ID NO: 60718 - protein, 4 aa, Mycobacterium avium
APTR

SEQ ID NO: 60719 - protein, 17 aa, Mycobacterium avium
APTRRSAARRRGGDPIT

SEQ ID NO: 60720 - protein, 14 aa, Mycobacterium avium
APTSFIPPPAGGQE

SEQ ID NO: 60721 - protein, 15 aa, Mycobacterium avium
APTSFIPPPAGGQEM

SEQ ID NO: 60722 - protein, 13 aa, Mycobacterium avium
APTTGWAGDEDEL

SEQ ID NO: 60723 - protein, 10 aa, Mycobacterium avium
APTVAQSDGD

SEQ ID NO: 60724 - protein, 5 aa, Mycobacterium avium
APVAA

SEQ ID NO: 60725 - protein, 17 aa, Mycobacterium avium
APVAPSPASSPSAGGTL

SEQ ID NO: 60726 - protein, 12 aa, Mycobacterium avium
APVDECKDKDMT

SEQ ID NO: 60727 - protein, 7 aa, Mycobacterium avium
APVDPGD

SEQ ID NO: 60728 - protein, 10 aa, Mycobacterium avium
APVGDPTRQR

SEQ ID NO: 60729 - protein, 6 aa, Mycobacterium avium
APVGGV

SEQ ID NO: 60730 - protein, 5 aa, Mycobacterium avium
APVKA

SEQ ID NO: 60731 - protein, 8 aa, Mycobacterium avium
APVKPSDL

SEQ ID NO: 60732 - protein, 6 aa, Mycobacterium avium
APVNGY

SEQ ID NO: 60733 - protein, 7 aa, Mycobacterium avium
APVPEPV

SEQ ID NO: 60734 - protein, 18 aa, Mycobacterium avium
APVPQTRRTRHTLPGDDE

SEQ ID NO: 60735 - protein, 4 aa, Mycobacterium avium
APVR

SEQ ID NO: 60736 - protein, 11 aa, Mycobacterium avium
APVSGEAASLT

SEQ ID NO: 60737 - protein, 7 aa, Mycobacterium avium
APVTAGD

SEQ ID NO: 60738 - protein, 26 aa, Mycobacterium avium
APVTAKTAVPTQGTSVVRGESGGNTH

SEQ ID NO: 60739 - protein, 5 aa, Mycobacterium avium
APVTG

SEQ ID NO: 60740 - protein, 11 aa, Mycobacterium avium
APVTSASPAVQ

SEQ ID NO: 60741 - protein, 6 aa, Mycobacterium avium
APWPPQ

SEQ ID NO: 60742 - protein, 7 aa, Mycobacterium avium
APYGPGS

SEQ ID NO: 60743 - protein, 9 aa, Mycobacterium avium
APYGRAADS

SEQ ID NO: 60744 - protein, 5 aa, Mycobacterium avium
APYPQ

SEQ ID NO: 60745 - protein, 6 aa, Mycobacterium avium
APYPRE

SEQ ID NO: 60746 - protein, 4 aa, Mycobacterium avium
APYQ

SEQ ID NO: 60747 - protein, 7 aa, Mycobacterium avium
AQAAERA

SEQ ID NO: 60748 - protein, 5 aa, Mycobacterium avium
AQAAG

SEQ ID NO: 60749 - protein, 6 aa, Mycobacterium avium
AQAALP

SEQ ID NO: 60750 - protein, 8 aa, Mycobacterium avium
AQAGAESQ

SEQ ID NO: 60751 - protein, 14 aa, Mycobacterium avium
AQAGAWGGPSAESY

SEQ ID NO: 60752 - protein, 53 aa, Mycobacterium avium
AQAGSEPDPDPDPPGGGQAGQTEQQPPQRDSAQDAKPRPPTTKPSAPPSKTFR

SEQ ID NO: 60753 - protein, 7 aa, Mycobacterium avium
AQAHDEA

SEQ ID NO: 60754 - protein, 6 aa, Mycobacterium avium
AQAKKE

SEQ ID NO: 60755 - protein, 8 aa, Mycobacterium avium
AQAPPQLR

SEQ ID NO: 60756 - protein, 7 aa, Mycobacterium avium
AQAPTSA

SEQ ID NO: 60757 - protein, 13 aa, Mycobacterium avium
AQAQAHPAAAKGA

SEQ ID NO: 60758 - protein, 13 aa, Mycobacterium avium
AQAQAHPATAKGA

SEQ ID NO: 60759 - protein, 15 aa, Mycobacterium avium
AQAQPGAERRDITPD

SEQ ID NO: 60760 - protein, 4 aa, Mycobacterium avium
AQAR

SEQ ID NO: 60761 - protein, 6 aa, Mycobacterium avium
AQARGV

SEQ ID NO: 60762 - protein, 5 aa, Mycobacterium avium
AQARK

SEQ ID NO: 60763 - protein, 15 aa, Mycobacterium avium
AQARPATASAKTPGV

SEQ ID NO: 60764 - protein, 11 aa, Mycobacterium avium
AQARSRADLTG

SEQ ID NO: 60765 - protein, 8 aa, Mycobacterium avium
AQARTATT

SEQ ID NO: 60766 - protein, 10 aa, Mycobacterium avium
AQASFDANTA

SEQ ID NO: 60767 - protein, 10 aa, Mycobacterium avium
AQASFDSNAA

SEQ ID NO: 60768 - protein, 7 aa, Mycobacterium avium
AQATRVT

SEQ ID NO: 60769 - protein, 13 aa, Mycobacterium avium
AQDAGQVSSDVDA

SEQ ID NO: 60770 - protein, 8 aa, Mycobacterium avium
AQDSSLSR

SEQ ID NO: 60771 - protein, 14 aa, Mycobacterium avium
AQEEVWGEDPNVRI

SEQ ID NO: 60772 - protein, 8 aa, Mycobacterium avium
AQEGEREL

SEQ ID NO: 60773 - protein, 6 aa, Mycobacterium avium
AQELGR

SEQ ID NO: 60774 - protein, 6 aa, Mycobacterium avium
AQELSR

SEQ ID NO: 60775 - protein, 7 aa, Mycobacterium avium
AQENRSL

SEQ ID NO: 60776 - protein, 8 aa, Mycobacterium avium
AQERESFG

SEQ ID NO: 60777 - protein, 16 aa, Mycobacterium avium
AQFGGGDRDDGHGVGE

SEQ ID NO: 60778 - protein, 8 aa, Mycobacterium avium
AQGAAYDG

SEQ ID NO: 60779 - protein, 19 aa, Mycobacterium avium
AQGASTPIRPGEFGDRGGF

SEQ ID NO: 60780 - protein, 5 aa, Mycobacterium avium
AQGFD

SEQ ID NO: 60781 - protein, 7 aa, Mycobacterium avium
AQGGAQR

SEQ ID NO: 60782 - protein, 7 aa, Mycobacterium avium
AQGGDRI

SEQ ID NO: 60783 - protein, 5 aa, Mycobacterium avium
AQGGF

SEQ ID NO: 60784 - protein, 6 aa, Mycobacterium avium
AQGGID

SEQ ID NO: 60785 - protein, 7 aa, Mycobacterium avium
AQGGTSF

SEQ ID NO: 60786 - protein, 4 aa, Mycobacterium avium
AQGL

SEQ ID NO: 60787 - protein, 7 aa, Mycobacterium avium
AQGNPQR

SEQ ID NO: 60788 - protein, 8 aa, Mycobacterium avium
AQGNSDSL

SEQ ID NO: 60789 - protein, 5 aa, Mycobacterium avium
AQGPV

SEQ ID NO: 60790 - protein, 13 aa, Mycobacterium avium
AQGQPGGRGGDLA

SEQ ID NO: 60791 - protein, 9 aa, Mycobacterium avium
AQGREAGGH

SEQ ID NO: 60792 - protein, 12 aa, Mycobacterium avium
AQGRRRRHHPEQ

SEQ ID NO: 60793 - protein, 4 aa, Mycobacterium avium
AQGV

SEQ ID NO: 60794 - protein, 5 aa, Mycobacterium avium
AQGVG

SEQ ID NO: 60795 - protein, 8 aa, Mycobacterium avium
AQHDDEEL

SEQ ID NO: 60796 - protein, 8 aa, Mycobacterium avium
AQHGHTGD

SEQ ID NO: 60797 - protein, 21 aa, Mycobacterium avium
AQHHSTPAPGAQQPGRHPLSS

SEQ ID NO: 60798 - protein, 12 aa, Mycobacterium avium
AQHQGVDEKPDH

SEQ ID NO: 60799 - protein, 6 aa, Mycobacterium avium
AQIGRT

SEQ ID NO: 60800 - protein, 14 aa, Mycobacterium avium
AQLASEEGADLGET

SEQ ID NO: 60801 - protein, 9 aa, Mycobacterium avium
AQLDGEQQA

SEQ ID NO: 60802 - protein, 4 aa, Mycobacterium avium
AQLE

SEQ ID NO: 60803 - protein, 9 aa, Mycobacterium avium
AQLGAEGAG

SEQ ID NO: 60804 - protein, 6 aa, Mycobacterium avium
AQLGTQ

SEQ ID NO: 60805 - protein, 5 aa, Mycobacterium avium
AQLPE

SEQ ID NO: 60806 - protein, 7 aa, Mycobacterium avium
AQLPNTN

SEQ ID NO: 60807 - protein, 11 aa, Mycobacterium avium
AQLRSNEGNPL

SEQ ID NO: 60808 - protein, 4 aa, Mycobacterium avium
AQMA

SEQ ID NO: 60809 - protein, 5 aa, Mycobacterium avium
AQMAA

SEQ ID NO: 60810 - protein, 11 aa, Mycobacterium avium
AQNTKDASGAR

SEQ ID NO: 60811 - protein, 5 aa, Mycobacterium avium
AQNTL

SEQ ID NO: 60812 - protein, 5 aa, Mycobacterium avium
AQPAP

SEQ ID NO: 60813 - protein, 5 aa, Mycobacterium avium
AQPES

SEQ ID NO: 60814 - protein, 10 aa, Mycobacterium avium
AQPGARPAEE

SEQ ID NO: 60815 - protein, 6 aa, Mycobacterium avium
AQPGSQ

SEQ ID NO: 60816 - protein, 6 aa, Mycobacterium avium
AQPGTL

SEQ ID NO: 60817 - protein, 7 aa, Mycobacterium avium
AQPIPGV

SEQ ID NO: 60818 - protein, 6 aa, Mycobacterium avium
AQPIPR

SEQ ID NO: 60819 - protein, 7 aa, Mycobacterium avium
AQPLGGE

SEQ ID NO: 60820 - protein, 10 aa, Mycobacterium avium
AQPNTGAPIP

SEQ ID NO: 60821 - protein, 16 aa, Mycobacterium avium
AQPPETTPVEGPRTHH

SEQ ID NO: 60822 - protein, 5 aa, Mycobacterium avium
AQPPF

SEQ ID NO: 60823 - protein, 18 aa, Mycobacterium avium
AQPPGAGGPQGPGGAGYS

SEQ ID NO: 60824 - protein, 6 aa, Mycobacterium avium
AQPPLR

SEQ ID NO: 60825 - protein, 8 aa, Mycobacterium avium
AQPPRALP

SEQ ID NO: 60826 - protein, 12 aa, Mycobacterium avium
AQPQLGAQVERG

SEQ ID NO: 60827 - protein, 7 aa, Mycobacterium avium
AQPQLSR

SEQ ID NO: 60828 - protein, 9 aa, Mycobacterium avium
AQPQRLPRG

SEQ ID NO: 60829 - protein, 7 aa, Mycobacterium avium
AQPQSIG

SEQ ID NO: 60830 - protein, 14 aa, Mycobacterium avium
AQPRLASDPAQLGD

SEQ ID NO: 60831 - protein, 8 aa, Mycobacterium avium
AQPRNAAT

SEQ ID NO: 60832 - protein, 29 aa, Mycobacterium avium
AQPSAELEPAAEDAASGGPDAGITGEPES

SEQ ID NO: 60833 - protein, 29 aa, Mycobacterium avium
AQPSAEPEPAAEDAASGGPDAGIAGEPES

SEQ ID NO: 60834 - protein, 18 aa, Mycobacterium avium
AQPSGVGSEPEAAGLDDE

SEQ ID NO: 60835 - protein, 9 aa, Mycobacterium avium
AQPTDTDNQ

SEQ ID NO: 60836 - protein, 17 aa, Mycobacterium avium
AQPVGDGNTVDDRDELA

SEQ ID NO: 60837 - protein, 6 aa, Mycobacterium avium
AQPYGG

SEQ ID NO: 60838 - protein, 17 aa, Mycobacterium avium
AQQAPPLRTETRFDSAP

SEQ ID NO: 60839 - protein, 19 aa, Mycobacterium avium
AQQDERNGLGSAPAGTYPP

SEQ ID NO: 60840 - protein, 19 aa, Mycobacterium avium
AQQDERNGLGSAPTGTYPP

SEQ ID NO: 60841 - protein, 19 aa, Mycobacterium avium
AQQDERNGLGSEPAGAYPP

SEQ ID NO: 60842 - protein, 15 aa, Mycobacterium avium
AQQQERARDRADAAY

SEQ ID NO: 60843 - protein, 16 aa, Mycobacterium avium
AQQQERARDRADAAYR

SEQ ID NO: 60844 - protein, 16 aa, Mycobacterium avium
AQQQEWARDRADTAYR

SEQ ID NO: 60845 - protein, 14 aa, Mycobacterium avium
AQQRQAEGKPIPDD

SEQ ID NO: 60846 - protein, 29 aa, Mycobacterium avium
AQQRRPQRVGGIDRSGQPTGHTDDSNRGR

SEQ ID NO: 60847 - protein, 7 aa, Mycobacterium avium
AQQRTTF

SEQ ID NO: 60848 - protein, 5 aa, Mycobacterium avium
AQRAA

SEQ ID NO: 60849 - protein, 19 aa, Mycobacterium avium
AQRAERAGEADQRRRPGPF

SEQ ID NO: 60850 - protein, 12 aa, Mycobacterium avium
AQRAGREALRAG

SEQ ID NO: 60851 - protein, 25 aa, Mycobacterium avium
AQRCPDRPGLVDERGSLTWRQLDVL

SEQ ID NO: 60852 - protein, 10 aa, Mycobacterium avium
AQRDEERDVG

SEQ ID NO: 60853 - protein, 18 aa, Mycobacterium avium
AQRGAATPDVKCGDRQRV

SEQ ID NO: 60854 - protein, 6 aa, Mycobacterium avium
AQRGAE

SEQ ID NO: 60855 - protein, 9 aa, Mycobacterium avium
AQRGAPVGV

SEQ ID NO: 60856 - protein, 15 aa, Mycobacterium avium
AQRGQPLKLPASPEV

SEQ ID NO: 60857 - protein, 11 aa, Mycobacterium avium
AQRPGADQRSQ

SEQ ID NO: 60858 - protein, 7 aa, Mycobacterium avium
AQRPGGL

SEQ ID NO: 60859 - protein, 13 aa, Mycobacterium avium
AQRPGVQEDRGGA

SEQ ID NO: 60860 - protein, 5 aa, Mycobacterium avium
AQRPL

SEQ ID NO: 60861 - protein, 8 aa, Mycobacterium avium
AQRPPSES

SEQ ID NO: 60862 - protein, 10 aa, Mycobacterium avium
AQRPRNPCPQ

SEQ ID NO: 60863 - protein, 16 aa, Mycobacterium avium
AQRPSFRTDEANSTHR

SEQ ID NO: 60864 - protein, 6 aa, Mycobacterium avium
AQRQSL

SEQ ID NO: 60865 - protein, 11 aa, Mycobacterium avium
AQRRDHRKLGS

SEQ ID NO: 60866 - protein, 10 aa, Mycobacterium avium
AQRRTPPAEL

SEQ ID NO: 60867 - protein, 10 aa, Mycobacterium avium
AQRSPQAPAV

SEQ ID NO: 60868 - protein, 7 aa, Mycobacterium avium
AQRSRDE

SEQ ID NO: 60869 - protein, 10 aa, Mycobacterium avium
AQRSRRSEED

SEQ ID NO: 60870 - protein, 8 aa, Mycobacterium avium
AQRSSGVR

SEQ ID NO: 60871 - protein, 28 aa, Mycobacterium avium
AQRSTRRRGRSTRSTRPARAARPPRLPR

SEQ ID NO: 60872 - protein, 13 aa, Mycobacterium avium
AQSAAQPGSNTAA

SEQ ID NO: 60873 - protein, 15 aa, Mycobacterium avium
AQSAPDDDDFRNSRN

SEQ ID NO: 60874 - protein, 5 aa, Mycobacterium avium
AQSEL

SEQ ID NO: 60875 - protein, 7 aa, Mycobacterium avium
AQSGEYP

SEQ ID NO: 60876 - protein, 5 aa, Mycobacterium avium
AQSGI

SEQ ID NO: 60877 - protein, 5 aa, Mycobacterium avium
AQSGY

SEQ ID NO: 60878 - protein, 15 aa, Mycobacterium avium
AQSPADGARSEELSR

SEQ ID NO: 60879 - protein, 11 aa, Mycobacterium avium
AQSSPATSVYD

SEQ ID NO: 60880 - protein, 17 aa, Mycobacterium avium
AQSSPATSVYDRDRAAR

SEQ ID NO: 60881 - protein, 18 aa, Mycobacterium avium
AQSSPATSVYDRDRAGRV

SEQ ID NO: 60882 - protein, 9 aa, Mycobacterium avium
AQSTDKRVN

SEQ ID NO: 60883 - protein, 7 aa, Mycobacterium avium
AQTADGP

SEQ ID NO: 60884 - protein, 14 aa, Mycobacterium avium
AQTAKVAAGRAHRA

SEQ ID NO: 60885 - protein, 8 aa, Mycobacterium avium
AQTAQDIN

SEQ ID NO: 60886 - protein, 9 aa, Mycobacterium avium
AQTAQDING

SEQ ID NO: 60887 - protein, 13 aa, Mycobacterium avium
AQTDTARGGQAEE

SEQ ID NO: 60888 - protein, 7 aa, Mycobacterium avium
AQTDTED

SEQ ID NO: 60889 - protein, 7 aa, Mycobacterium avium
AQTGATV

SEQ ID NO: 60890 - protein, 14 aa, Mycobacterium avium
AQTGLDDFGDDSFR

SEQ ID NO: 60891 - protein, 15 aa, Mycobacterium avium
AQTSNYTYDPSTNKL

SEQ ID NO: 60892 - protein, 11 aa, Mycobacterium avium
AQTTSPPQLED

SEQ ID NO: 60893 - protein, 7 aa, Mycobacterium avium
AQVADSA

SEQ ID NO: 60894 - protein, 6 aa, Mycobacterium avium
AQVDPD

SEQ ID NO: 60895 - protein, 9 aa, Mycobacterium avium
AQVEPTEGV

SEQ ID NO: 60896 - protein, 17 aa, Mycobacterium avium
AQVGGGDHRAGGGVGEH

SEQ ID NO: 60897 - protein, 8 aa, Mycobacterium avium
AQVGRDAG

SEQ ID NO: 60898 - protein, 6 aa, Mycobacterium avium
AQVTRA

SEQ ID NO: 60899 - protein, 8 aa, Mycobacterium avium
AQWRTAGD

SEQ ID NO: 60900 - protein, 13 aa, Mycobacterium avium
ARAAAERPDPPAG

SEQ ID NO: 60901 - protein, 13 aa, Mycobacterium avium
ARAAAEVQTGQSV

SEQ ID NO: 60902 - protein, 28 aa, Mycobacterium avium
ARAAGQRALPAARGGGAAGPRRRPRLGR

SEQ ID NO: 60903 - protein, 7 aa, Mycobacterium avium
ARAATTV

SEQ ID NO: 60904 - protein, 14 aa, Mycobacterium avium
ARADATRVRSGANR

SEQ ID NO: 60905 - protein, 11 aa, Mycobacterium avium
ARADDDRQTMN

SEQ ID NO: 60906 - protein, 11 aa, Mycobacterium avium
ARADKGPLKRN

SEQ ID NO: 60907 - protein, 8 aa, Mycobacterium avium
ARAEARAA

SEQ ID NO: 60908 - protein, 8 aa, Mycobacterium avium
ARAESDDN

SEQ ID NO: 60909 - protein, 5 aa, Mycobacterium avium
ARAGA

SEQ ID NO: 60910 - protein, 8 aa, Mycobacterium avium
ARAGAPAG

SEQ ID NO: 60911 - protein, 10 aa, Mycobacterium avium
ARAGERGAPV

SEQ ID NO: 60912 - protein, 8 aa, Mycobacterium avium
ARAGHGLS

SEQ ID NO: 60913 - protein, 13 aa, Mycobacterium avium
ARAGHPGGVGDQA

SEQ ID NO: 60914 - protein, 6 aa, Mycobacterium avium
ARAGKS

SEQ ID NO: 60915 - protein, 7 aa, Mycobacterium avium
ARAGNLA

SEQ ID NO: 60916 - protein, 9 aa, Mycobacterium avium
ARAGNRPLQ

SEQ ID NO: 60917 - protein, 9 aa, Mycobacterium avium
ARAGTAGDL

SEQ ID NO: 60918 - protein, 10 aa, Mycobacterium avium
ARAGTSSAYA

SEQ ID NO: 60919 - protein, 17 aa, Mycobacterium avium
ARALAEESRETGWDKPS

SEQ ID NO: 60920 - protein, 5 aa, Mycobacterium avium
ARANG

SEQ ID NO: 60921 - protein, 10 aa, Mycobacterium avium
ARANGSEAEL

SEQ ID NO: 60922 - protein, 8 aa, Mycobacterium avium
ARAPAGHR

SEQ ID NO: 60923 - protein, 9 aa, Mycobacterium avium
ARAPGAAGY

SEQ ID NO: 60924 - protein, 5 aa, Mycobacterium avium
ARAQI

SEQ ID NO: 60925 - protein, 14 aa, Mycobacterium avium
ARARRRSRWRAPRA

SEQ ID NO: 60926 - protein, 17 aa, Mycobacterium avium
ARARTTNPSTLRGDPAL

SEQ ID NO: 60927 - protein, 13 aa, Mycobacterium avium
ARASAAIDSGAAE

SEQ ID NO: 60928 - protein, 15 aa, Mycobacterium avium
ARASIDEARREAERE

SEQ ID NO: 60929 - protein, 4 aa, Mycobacterium avium
ARAT

SEQ ID NO: 60930 - protein, 8 aa, Mycobacterium avium
ARAVPDAA

SEQ ID NO: 60931 - protein, 28 aa, Mycobacterium avium
ARCAPRATKPSNSAETKAWPAMSWRASI

SEQ ID NO: 60932 - protein, 9 aa, Mycobacterium avium
ARCGEPDDE

SEQ ID NO: 60933 - protein, 8 aa, Mycobacterium avium
ARDADSAR

SEQ ID NO: 60934 - protein, 8 aa, Mycobacterium avium
ARDAPDPH

SEQ ID NO: 60935 - protein, 9 aa, Mycobacterium avium
ARDAPDPHC

SEQ ID NO: 60936 - protein, 9 aa, Mycobacterium avium
ARDAPNPHC

SEQ ID NO: 60937 - protein, 9 aa, Mycobacterium avium
ARDASRARA

SEQ ID NO: 60938 - protein, 8 aa, Mycobacterium avium
ARDATADV

SEQ ID NO: 60939 - protein, 12 aa, Mycobacterium avium
ARDDDAPAVGTV

SEQ ID NO: 60940 - protein, 14 aa, Mycobacterium avium
ARDDREGDSAGGTR

SEQ ID NO: 60941 - protein, 14 aa, Mycobacterium avium
ARDDREGGAAGGTR

SEQ ID NO: 60942 - protein, 28 aa, Mycobacterium avium
ARDDREGGAAGRSGSSPLARDDSAGGTR

SEQ ID NO: 60943 - protein, 4 aa, Mycobacterium avium
ARDE

SEQ ID NO: 60944 - protein, 5 aa, Mycobacterium avium
ARDEI

SEQ ID NO: 60945 - protein, 12 aa, Mycobacterium avium
ARDGCARTTPRA

SEQ ID NO: 60946 - protein, 12 aa, Mycobacterium avium
ARDGDAPAVGTV

SEQ ID NO: 60947 - protein, 5 aa, Mycobacterium avium
ARDGV

SEQ ID NO: 60948 - protein, 9 aa, Mycobacterium avium
ARDKLDEDD

SEQ ID NO: 60949 - protein, 10 aa, Mycobacterium avium
ARDLAKPPAV

SEQ ID NO: 60950 - protein, 9 aa, Mycobacterium avium
ARDLSTDGG

SEQ ID NO: 60951 - protein, 7 aa, Mycobacterium avium
ARDNAEA

SEQ ID NO: 60952 - protein, 8 aa, Mycobacterium avium
ARDPEAVR

SEQ ID NO: 60953 - protein, 6 aa, Mycobacterium avium
ARDPQK

SEQ ID NO: 60954 - protein, 13 aa, Mycobacterium avium
ARDPSVEVSPQVE

SEQ ID NO: 60955 - protein, 9 aa, Mycobacterium avium
ARDRGQPTH

SEQ ID NO: 60956 - protein, 4 aa, Mycobacterium avium
ARDS

SEQ ID NO: 60957 - protein, 9 aa, Mycobacterium avium
ARDTDAGAH

SEQ ID NO: 60958 - protein, 5 aa, Mycobacterium avium
ARDTG

SEQ ID NO: 60959 - protein, 9 aa, Mycobacterium avium
AREAGDNIA

SEQ ID NO: 60960 - protein, 8 aa, Mycobacterium avium
AREQATGW

SEQ ID NO: 60961 - protein, 5 aa, Mycobacterium avium
AREQG

SEQ ID NO: 60962 - protein, 18 aa, Mycobacterium avium
AREQGATVAYGGEPAGEL

SEQ ID NO: 60963 - protein, 18 aa, Mycobacterium avium
AREQGATVAYGGEPASDL

SEQ ID NO: 60964 - protein, 21 aa, Mycobacterium avium
ARERQSAGDTGGHETAPAELP

SEQ ID NO: 60965 - protein, 23 aa, Mycobacterium avium
ARERQSAGHTGGHETAPAEPPSF

SEQ ID NO: 60966 - protein, 5 aa, Mycobacterium avium
ARESI

SEQ ID NO: 60967 - protein, 10 aa, Mycobacterium avium
ARESPESVDP

SEQ ID NO: 60968 - protein, 4 aa, Mycobacterium avium
ARET

SEQ ID NO: 60969 - protein, 5 aa, Mycobacterium avium
ARETF

SEQ ID NO: 60970 - protein, 4 aa, Mycobacterium avium
ARGA

SEQ ID NO: 60971 - protein, 35 aa, Mycobacterium avium
ARGADHPGTAGGSGTPSSASTPRANVGKSVMSPST

SEQ ID NO: 60972 - protein, 6 aa, Mycobacterium avium
ARGARE

SEQ ID NO: 60973 - protein, 7 aa, Mycobacterium avium
ARGDGGF

SEQ ID NO: 60974 - protein, 8 aa, Mycobacterium avium
ARGDGPLA

SEQ ID NO: 60975 - protein, 9 aa, Mycobacterium avium
ARGDGPLAG

SEQ ID NO: 60976 - protein, 5 aa, Mycobacterium avium
ARGFT

SEQ ID NO: 60977 - protein, 8 aa, Mycobacterium avium
ARGGTTLP

SEQ ID NO: 60978 - protein, 46 aa, Mycobacterium avium
ARGHAARAQPIRTAGQPQRAGPAATGGGRQDDQRPVRRRDDRQPGR

SEQ ID NO: 60979 - protein, 4 aa, Mycobacterium avium
ARGI

SEQ ID NO: 60980 - protein, 4 aa, Mycobacterium avium
ARGM

SEQ ID NO: 60981 - protein, 6 aa, Mycobacterium avium
ARGMGA

SEQ ID NO: 60982 - protein, 10 aa, Mycobacterium avium
ARGQHGKAER

SEQ ID NO: 60983 - protein, 8 aa, Mycobacterium avium
ARGRRYGG

SEQ ID NO: 60984 - protein, 5 aa, Mycobacterium avium
ARGRS

SEQ ID NO: 60985 - protein, 13 aa, Mycobacterium avium
ARGSGRAGPGAAA

SEQ ID NO: 60986 - protein, 10 aa, Mycobacterium avium
ARGTSQQGFD

SEQ ID NO: 60987 - protein, 12 aa, Mycobacterium avium
ARHADHDAPPLT

SEQ ID NO: 60988 - protein, 11 aa, Mycobacterium avium
ARHGDSTTQRR

SEQ ID NO: 60989 - protein, 9 aa, Mycobacterium avium
ARHGTSPEP

SEQ ID NO: 60990 - protein, 43 aa, Mycobacterium avium
ARHPAGRGRGRHQPRRRPRRRRRPRAVPGGRPGSAGHRQRHDR

SEQ ID NO: 60991 - protein, 35 aa, Mycobacterium avium
ARHPVSSAGQGVRPAYHPGSRDRLGAERRADDGVP

SEQ ID NO: 60992 - protein, 4 aa, Mycobacterium avium
ARIA

SEQ ID NO: 60993 - protein, 8 aa, Mycobacterium avium
ARIPAARP

SEQ ID NO: 60994 - protein, 6 aa, Mycobacterium avium
ARIPDE

SEQ ID NO: 60995 - protein, 14 aa, Mycobacterium avium
ARITRGAPNLGEDT

SEQ ID NO: 60996 - protein, 7 aa, Mycobacterium avium
ARKATRD

SEQ ID NO: 60997 - protein, 9 aa, Mycobacterium avium
ARKQQRERR

SEQ ID NO: 60998 - protein, 8 aa, Mycobacterium avium
ARKSGADL

SEQ ID NO: 60999 - protein, 7 aa, Mycobacterium avium
ARKTGVS

SEQ ID NO: 61000 - protein, 23 aa, Mycobacterium avium
ARLDKAPSHRAAPVSEAVAAGSP

SEQ ID NO: 61001 - protein, 5 aa, Mycobacterium avium
ARLEG

SEQ ID NO: 61002 - protein, 4 aa, Mycobacterium avium
ARLG

SEQ ID NO: 61003 - protein, 10 aa, Mycobacterium avium
ARLGAAASSL

SEQ ID NO: 61004 - protein, 7 aa, Mycobacterium avium
ARLNPGA

SEQ ID NO: 61005 - protein, 11 aa, Mycobacterium avium
ARLPSPGARRN

SEQ ID NO: 61006 - protein, 4 aa, Mycobacterium avium
ARLQ

SEQ ID NO: 61007 - protein, 22 aa, Mycobacterium avium
ARLRGGRGAAALPPPGTSEGRQ

SEQ ID NO: 61008 - protein, 22 aa, Mycobacterium avium
ARLRGGRGAAALPTPGTSEGRQ

SEQ ID NO: 61009 - protein, 7 aa, Mycobacterium avium
ARLSGTG

SEQ ID NO: 61010 - protein, 5 aa, Mycobacterium avium
ARNDG

SEQ ID NO: 61011 - protein, 14 aa, Mycobacterium avium
ARNEAAAALADLLQ

SEQ ID NO: 61012 - protein, 7 aa, Mycobacterium avium
ARNHDEA

SEQ ID NO: 61013 - protein, 17 aa, Mycobacterium avium
ARNRGNPASQADANSTG

SEQ ID NO: 61014 - protein, 17 aa, Mycobacterium avium
ARNRGNTASQADANSTG

SEQ ID NO: 61015 - protein, 15 aa, Mycobacterium avium
ARNSGQVTAFVCQPS

SEQ ID NO: 61016 - protein, 7 aa, Mycobacterium avium
ARNTKQP

SEQ ID NO: 61017 - protein, 5 aa, Mycobacterium avium
ARNVT

SEQ ID NO: 61018 - protein, 10 aa, Mycobacterium avium
ARPAERNRLP

SEQ ID NO: 61019 - protein, 10 aa, Mycobacterium avium
ARPALPSESA

SEQ ID NO: 61020 - protein, 6 aa, Mycobacterium avium
ARPANV

SEQ ID NO: 61021 - protein, 17 aa, Mycobacterium avium
ARPAPHAPAQAQPATAP

SEQ ID NO: 61022 - protein, 25 aa, Mycobacterium avium
ARPASSPTPPGSAGPTCAVPIASPG

SEQ ID NO: 61023 - protein, 9 aa, Mycobacterium avium
ARPDAGLPD

SEQ ID NO: 61024 - protein, 7 aa, Mycobacterium avium
ARPDDFP

SEQ ID NO: 61025 - protein, 17 aa, Mycobacterium avium
ARPDPGSGPGRVTPVSI

SEQ ID NO: 61026 - protein, 8 aa, Mycobacterium avium
ARPEEPRD

SEQ ID NO: 61027 - protein, 6 aa, Mycobacterium avium
ARPEQI

SEQ ID NO: 61028 - protein, 7 aa, Mycobacterium avium
ARPGSAE

SEQ ID NO: 61029 - protein, 13 aa, Mycobacterium avium
ARPLTGEGVKNGM

SEQ ID NO: 61030 - protein, 15 aa, Mycobacterium avium
ARPPAPDSAPPPADY

SEQ ID NO: 61031 - protein, 15 aa, Mycobacterium avium
ARPPRPAPADSGSPL

SEQ ID NO: 61032 - protein, 5 aa, Mycobacterium avium
ARPQL

SEQ ID NO: 61033 - protein, 6 aa, Mycobacterium avium
ARPQLR

SEQ ID NO: 61034 - protein, 4 aa, Mycobacterium avium
ARPR

SEQ ID NO: 61035 - protein, 6 aa, Mycobacterium avium
ARPRRV

SEQ ID NO: 61036 - protein, 8 aa, Mycobacterium avium
ARPTGDEP

SEQ ID NO: 61037 - protein, 19 aa, Mycobacterium avium
ARPTGQVSRPALSPSRAAD

SEQ ID NO: 61038 - protein, 5 aa, Mycobacterium avium
ARPTL

SEQ ID NO: 61039 - protein, 12 aa, Mycobacterium avium
ARPTTQSDDSYE

SEQ ID NO: 61040 - protein, 26 aa, Mycobacterium avium
ARPVATPWDPAAAVGDPGGRGGERAT

SEQ ID NO: 61041 - protein, 10 aa, Mycobacterium avium
ARPVTTPWDP

SEQ ID NO: 61042 - protein, 25 aa, Mycobacterium avium
ARPVTTPWDPAAAVGDPGGCGGERA

SEQ ID NO: 61043 - protein, 6 aa, Mycobacterium avium
ARQDGA

SEQ ID NO: 61044 - protein, 19 aa, Mycobacterium avium
ARQDREARIEGELGQQPGY

SEQ ID NO: 61045 - protein, 6 aa, Mycobacterium avium
ARQGAR

SEQ ID NO: 61046 - protein, 6 aa, Mycobacterium avium
ARQRAE

SEQ ID NO: 61047 - protein, 5 aa, Mycobacterium avium
ARQRG

SEQ ID NO: 61048 - protein, 16 aa, Mycobacterium avium
ARQRGTKLDARRAREQ

SEQ ID NO: 61049 - protein, 11 aa, Mycobacterium avium
ARQRRQQRAAQ

SEQ ID NO: 61050 - protein, 8 aa, Mycobacterium avium
ARQSPGDV

SEQ ID NO: 61051 - protein, 4 aa, Mycobacterium avium
ARQT

SEQ ID NO: 61052 - protein, 7 aa, Mycobacterium avium
ARRADGR

SEQ ID NO: 61053 - protein, 10 aa, Mycobacterium avium
ARRADPGPDI

SEQ ID NO: 61054 - protein, 8 aa, Mycobacterium avium
ARRDVAGT

SEQ ID NO: 61055 - protein, 9 aa, Mycobacterium avium
ARRDVAGTP

SEQ ID NO: 61056 - protein, 6 aa, Mycobacterium avium
ARREAI

SEQ ID NO: 61057 - protein, 11 aa, Mycobacterium avium
ARREEQTERYR

SEQ ID NO: 61058 - protein, 32 aa, Mycobacterium avium
ARRENRRRRGLAGQGGRRAEQVQGRPSRPGRR

SEQ ID NO: 61059 - protein, 16 aa, Mycobacterium avium
ARRGRDAAAAGDNGRA

SEQ ID NO: 61060 - protein, 7 aa, Mycobacterium avium
ARRGTAE

SEQ ID NO: 61061 - protein, 4 aa, Mycobacterium avium
ARRP

SEQ ID NO: 61062 - protein, 7 aa, Mycobacterium avium
ARRPAQL

SEQ ID NO: 61063 - protein, 7 aa, Mycobacterium avium
ARRPAVD

SEQ ID NO: 61064 - protein, 13 aa, Mycobacterium avium
ARRPGLAPGWGSP

SEQ ID NO: 61065 - protein, 8 aa, Mycobacterium avium
ARRPGRAC

SEQ ID NO: 61066 - protein, 5 aa, Mycobacterium avium
ARRPI

SEQ ID NO: 61067 - protein, 9 aa, Mycobacterium avium
ARRPNGVQG

SEQ ID NO: 61068 - protein, 22 aa, Mycobacterium avium
ARRPSRRPGPARAGPAPTAERE

SEQ ID NO: 61069 - protein, 22 aa, Mycobacterium avium
ARRQPRRQAAGAPQGGAGQPFA

SEQ ID NO: 61070 - protein, 7 aa, Mycobacterium avium
ARRRDDI

SEQ ID NO: 61071 - protein, 19 aa, Mycobacterium avium
ARRRPQRPVQGAGRRPVHG

SEQ ID NO: 61072 - protein, 20 aa, Mycobacterium avium
ARRRRGAGRIEAGAAAAPRL

SEQ ID NO: 61073 - protein, 10 aa, Mycobacterium avium
ARRRTPPAEL

SEQ ID NO: 61074 - protein, 18 aa, Mycobacterium avium
ARRSALADQHGAASESDR

SEQ ID NO: 61075 - protein, 6 aa, Mycobacterium avium
ARRSFD

SEQ ID NO: 61076 - protein, 10 aa, Mycobacterium avium
ARRSGGRDDA

SEQ ID NO: 61077 - protein, 8 aa, Mycobacterium avium
ARRSMTQR

SEQ ID NO: 61078 - protein, 9 aa, Mycobacterium avium
ARRSPGKRE

SEQ ID NO: 61079 - protein, 18 aa, Mycobacterium avium
ARRSRDVPEVRSTHAGGG

SEQ ID NO: 61080 - protein, 13 aa, Mycobacterium avium
ARSAAERPDPPAG

SEQ ID NO: 61081 - protein, 6 aa, Mycobacterium avium
ARSASH

SEQ ID NO: 61082 - protein, 11 aa, Mycobacterium avium
ARSDRSTGTRE

SEQ ID NO: 61083 - protein, 6 aa, Mycobacterium avium
ARSGAP

SEQ ID NO: 61084 - protein, 7 aa, Mycobacterium avium
ARSGLDD

SEQ ID NO: 61085 - protein, 8 aa, Mycobacterium avium
ARSGNTAK

SEQ ID NO: 61086 - protein, 16 aa, Mycobacterium avium
ARSHQRAAAAQRSGAF

SEQ ID NO: 61087 - protein, 23 aa, Mycobacterium avium
ARSHSSSLSTRAGTATALPGTIG

SEQ ID NO: 61088 - protein, 6 aa, Mycobacterium avium
ARSIPK

SEQ ID NO: 61089 - protein, 17 aa, Mycobacterium avium
ARSRHGGFEPPDIPPAQ

SEQ ID NO: 61090 - protein, 5 aa, Mycobacterium avium
ARSRP

SEQ ID NO: 61091 - protein, 10 aa, Mycobacterium avium
ARSSADRGTK

SEQ ID NO: 61092 - protein, 28 aa, Mycobacterium avium
ARSSAPHRTAGTPDRRGRRPATKPDAVP

SEQ ID NO: 61093 - protein, 7 aa, Mycobacterium avium
ARSTEPV

SEQ ID NO: 61094 - protein, 12 aa, Mycobacterium avium
ARSTSGRPPICT

SEQ ID NO: 61095 - protein, 6 aa, Mycobacterium avium
ARSVDG

SEQ ID NO: 61096 - protein, 11 aa, Mycobacterium avium
ARTAAGTGAPE

SEQ ID NO: 61097 - protein, 6 aa, Mycobacterium avium
ARTDAV

SEQ ID NO: 61098 - protein, 6 aa, Mycobacterium avium
ARTDRV

SEQ ID NO: 61099 - protein, 15 aa, Mycobacterium avium
ARTENRSARTHNARK

SEQ ID NO: 61100 - protein, 8 aa, Mycobacterium avium
ARTGPARA

SEQ ID NO: 61101 - protein, 7 aa, Mycobacterium avium
ARTGSRP

SEQ ID NO: 61102 - protein, 6 aa, Mycobacterium avium
ARTGVP

SEQ ID NO: 61103 - protein, 6 aa, Mycobacterium avium
ARTPDA

SEQ ID NO: 61104 - protein, 6 aa, Mycobacterium avium
ARTPEA

SEQ ID NO: 61105 - protein, 6 aa, Mycobacterium avium
ARTPSC

SEQ ID NO: 61106 - protein, 5 aa, Mycobacterium avium
ARTPV

SEQ ID NO: 61107 - protein, 4 aa, Mycobacterium avium
ARTR

SEQ ID NO: 61108 - protein, 17 aa, Mycobacterium avium
ARTRAFNDAKSRAEQYA

SEQ ID NO: 61109 - protein, 5 aa, Mycobacterium avium
ARTRN

SEQ ID NO: 61110 - protein, 16 aa, Mycobacterium avium
ARTSAHPERDARAAGV

SEQ ID NO: 61111 - protein, 9 aa, Mycobacterium avium
ARTSAQTRT

SEQ ID NO: 61112 - protein, 27 aa, Mycobacterium avium
ARTSNAVKSTQPGLRPPRRTRAPRDRT

SEQ ID NO: 61113 - protein, 7 aa, Mycobacterium avium
ARTTAPF

SEQ ID NO: 61114 - protein, 19 aa, Mycobacterium avium
ARVGSDRSAAASPATLKSV

SEQ ID NO: 61115 - protein, 5 aa, Mycobacterium avium
ARVTA

SEQ ID NO: 61116 - protein, 10 aa, Mycobacterium avium
ARWGSRSGNQ

SEQ ID NO: 61117 - protein, 8 aa, Mycobacterium avium
ARYAGSGA

SEQ ID NO: 61118 - protein, 24 aa, Mycobacterium avium
ARYDEGNVAEHAPGTPADNTAHET

SEQ ID NO: 61119 - protein, 5 aa, Mycobacterium avium
ARYGV

SEQ ID NO: 61120 - protein, 8 aa, Mycobacterium avium
ASAAAAEL

SEQ ID NO: 61121 - protein, 41 aa, Mycobacterium avium
ASAAAAELTPFTEPPRTTESSAAARQSAAVAQSAASDLPAQ

SEQ ID NO: 61122 - protein, 5 aa, Mycobacterium avium
ASAAV

SEQ ID NO: 61123 - protein, 15 aa, Mycobacterium avium
ASADGVEVTAQQPLD

SEQ ID NO: 61124 - protein, 11 aa, Mycobacterium avium
ASADPGQHTPR

SEQ ID NO: 61125 - protein, 11 aa, Mycobacterium avium
ASADPSGGRVT

SEQ ID NO: 61126 - protein, 6 aa, Mycobacterium avium
ASADPV

SEQ ID NO: 61127 - protein, 11 aa, Mycobacterium avium
ASAEANNAKAA

SEQ ID NO: 61128 - protein, 8 aa, Mycobacterium avium
ASAEDPDL

SEQ ID NO: 61129 - protein, 4 aa, Mycobacterium avium
ASAG

SEQ ID NO: 61130 - protein, 13 aa, Mycobacterium avium
ASAGGARVKRVTT

SEQ ID NO: 61131 - protein, 13 aa, Mycobacterium avium
ASAGGAVARERAE

SEQ ID NO: 61132 - protein, 8 aa, Mycobacterium avium
ASAGGVEA

SEQ ID NO: 61133 - protein, 17 aa, Mycobacterium avium
ASAGPGPRGPQRKRGTE

SEQ ID NO: 61134 - protein, 8 aa, Mycobacterium avium
ASAGTGKT

SEQ ID NO: 61135 - protein, 21 aa, Mycobacterium avium
ASAHPVKSPRHPPVWRRAALP

SEQ ID NO: 61136 - protein, 9 aa, Mycobacterium avium
ASAHRTGWR

SEQ ID NO: 61137 - protein, 13 aa, Mycobacterium avium
ASAIGEAADALGG

SEQ ID NO: 61138 - protein, 12 aa, Mycobacterium avium
ASALDGKNEGVR

SEQ ID NO: 61139 - protein, 9 aa, Mycobacterium avium
ASANSAEMA

SEQ ID NO: 61140 - protein, 10 aa, Mycobacterium avium
ASAPDSPAVS

SEQ ID NO: 61141 - protein, 5 aa, Mycobacterium avium
ASAPI

SEQ ID NO: 61142 - protein, 4 aa, Mycobacterium avium
ASAQ

SEQ ID NO: 61143 - protein, 16 aa, Mycobacterium avium
ASARAQALRGLQSHRD

SEQ ID NO: 61144 - protein, 22 aa, Mycobacterium avium
ASARFTAGSPPGRHRGVGTGSA

SEQ ID NO: 61145 - protein, 10 aa, Mycobacterium avium
ASATKALAGH

SEQ ID NO: 61146 - protein, 6 aa, Mycobacterium avium
ASATLT

SEQ ID NO: 61147 - protein, 19 aa, Mycobacterium avium
ASATVAGVADPEVQNAKQR

SEQ ID NO: 61148 - protein, 8 aa, Mycobacterium avium
ASDDFGGH

SEQ ID NO: 61149 - protein, 9 aa, Mycobacterium avium
ASDDNQATA

SEQ ID NO: 61150 - protein, 7 aa, Mycobacterium avium
ASDGATQ

SEQ ID NO: 61151 - protein, 19 aa, Mycobacterium avium
ASDGGLAAAEGAAGAELSR

SEQ ID NO: 61152 - protein, 11 aa, Mycobacterium avium
ASDGSLDTAAA

SEQ ID NO: 61153 - protein, 7 aa, Mycobacterium avium
ASDGVGA

SEQ ID NO: 61154 - protein, 8 aa, Mycobacterium avium
ASDLAARQ

SEQ ID NO: 61155 - protein, 6 aa, Mycobacterium avium
ASDNDI

SEQ ID NO: 61156 - protein, 7 aa, Mycobacterium avium
ASDNDVA

SEQ ID NO: 61157 - protein, 7 aa, Mycobacterium avium
ASDPASV

SEQ ID NO: 61158 - protein, 6 aa, Mycobacterium avium
ASDPIG

SEQ ID NO: 61159 - protein, 7 aa, Mycobacterium avium
ASDPIGF

SEQ ID NO: 61160 - protein, 10 aa, Mycobacterium avium
ASDPQQARDD

SEQ ID NO: 61161 - protein, 8 aa, Mycobacterium avium
ASDVQARR

SEQ ID NO: 61162 - protein, 15 aa, Mycobacterium avium
ASEAGHPAAPRRGRD

SEQ ID NO: 61163 - protein, 4 aa, Mycobacterium avium
ASEP

SEQ ID NO: 61164 - protein, 4 aa, Mycobacterium avium
ASEQ

SEQ ID NO: 61165 - protein, 7 aa, Mycobacterium avium
ASEQAGV

SEQ ID NO: 61166 - protein, 10 aa, Mycobacterium avium
ASEQDRDDQA

SEQ ID NO: 61167 - protein, 4 aa, Mycobacterium avium
ASER

SEQ ID NO: 61168 - protein, 7 aa, Mycobacterium avium
ASERGDH

SEQ ID NO: 61169 - protein, 8 aa, Mycobacterium avium
ASERSELE

SEQ ID NO: 61170 - protein, 22 aa, Mycobacterium avium
ASESGDDSEVVAGNAEEVGGAH

SEQ ID NO: 61171 - protein, 7 aa, Mycobacterium avium
ASESTPQ

SEQ ID NO: 61172 - protein, 4 aa, Mycobacterium avium
ASFS

SEQ ID NO: 61173 - protein, 5 aa, Mycobacterium avium
ASFTD

SEQ ID NO: 61174 - protein, 9 aa, Mycobacterium avium
ASGAGTASW

SEQ ID NO: 61175 - protein, 6 aa, Mycobacterium avium
ASGAQI

SEQ ID NO: 61176 - protein, 10 aa, Mycobacterium avium
ASGDAGGGQR

SEQ ID NO: 61177 - protein, 7 aa, Mycobacterium avium
ASGDGAV

SEQ ID NO: 61178 - protein, 8 aa, Mycobacterium avium
ASGEAGTG

SEQ ID NO: 61179 - protein, 6 aa, Mycobacterium avium
ASGEGA

SEQ ID NO: 61180 - protein, 7 aa, Mycobacterium avium
ASGEGAV

SEQ ID NO: 61181 - protein, 6 aa, Mycobacterium avium
ASGELP

SEQ ID NO: 61182 - protein, 11 aa, Mycobacterium avium
ASGFAEYQAKT

SEQ ID NO: 61183 - protein, 11 aa, Mycobacterium avium
ASGGPSGTDTI

SEQ ID NO: 61184 - protein, 5 aa, Mycobacterium avium
ASGIG

SEQ ID NO: 61185 - protein, 7 aa, Mycobacterium avium
ASGIGRA

SEQ ID NO: 61186 - protein, 5 aa, Mycobacterium avium
ASGIP

SEQ ID NO: 61187 - protein, 4 aa, Mycobacterium avium
ASGL

SEQ ID NO: 61188 - protein, 6 aa, Mycobacterium avium
ASGLPP

SEQ ID NO: 61189 - protein, 8 aa, Mycobacterium avium
ASGMGRAS

SEQ ID NO: 61190 - protein, 9 aa, Mycobacterium avium
ASGNHDERL

SEQ ID NO: 61191 - protein, 4 aa, Mycobacterium avium
ASGP

SEQ ID NO: 61192 - protein, 10 aa, Mycobacterium avium
ASGRPGPATV

SEQ ID NO: 61193 - protein, 9 aa, Mycobacterium avium
ASGRSAPVR

SEQ ID NO: 61194 - protein, 8 aa, Mycobacterium avium
ASGSEGIA

SEQ ID NO: 61195 - protein, 10 aa, Mycobacterium avium
ASGSTAKGAT

SEQ ID NO: 61196 - protein, 9 aa, Mycobacterium avium
ASGTTGPWS

SEQ ID NO: 61197 - protein, 5 aa, Mycobacterium avium
ASHLD

SEQ ID NO: 61198 - protein, 6 aa, Mycobacterium avium
ASHPGV

SEQ ID NO: 61199 - protein, 14 aa, Mycobacterium avium
ASHYGGSGARGFSP

SEQ ID NO: 61200 - protein, 8 aa, Mycobacterium avium
ASKAYGPD

SEQ ID NO: 61201 - protein, 6 aa, Mycobacterium avium
ASKEDR

SEQ ID NO: 61202 - protein, 10 aa, Mycobacterium avium
ASKGGAPEHP

SEQ ID NO: 61203 - protein, 40 aa, Mycobacterium avium
ASKKPADVRTPQKRSAEDKAAREAARAAGHPAPQAVKSQA

SEQ ID NO: 61204 - protein, 9 aa, Mycobacterium avium
ASKRDLPGD

SEQ ID NO: 61205 - protein, 17 aa, Mycobacterium avium
ASKSRTREMIASLAAEL

SEQ ID NO: 61206 - protein, 7 aa, Mycobacterium avium
ASKYGLR

SEQ ID NO: 61207 - protein, 5 aa, Mycobacterium avium
ASLAP

SEQ ID NO: 61208 - protein, 6 aa, Mycobacterium avium
ASLATG

SEQ ID NO: 61209 - protein, 12 aa, Mycobacterium avium
ASLRTKTGVTGA

SEQ ID NO: 61210 - protein, 7 aa, Mycobacterium avium
ASLSYSG

SEQ ID NO: 61211 - protein, 13 aa, Mycobacterium avium
ASMGNSDRQGPLR

SEQ ID NO: 61212 - protein, 23 aa, Mycobacterium avium
ASMGRDERAEHDGYNEQDPREVA

SEQ ID NO: 61213 - protein, 22 aa, Mycobacterium avium
ASMGREERAEHDGYNEQDPREV

SEQ ID NO: 61214 - protein, 29 aa, Mycobacterium avium
ASMPGAAAPIEPDERSEDEFDPKDPSLGS

SEQ ID NO: 61215 - protein, 29 aa, Mycobacterium avium
ASMPGAQAPIEPDERAEDEFDPKDPSLGS

SEQ ID NO: 61216 - protein, 5 aa, Mycobacterium avium
ASMTP

SEQ ID NO: 61217 - protein, 9 aa, Mycobacterium avium
ASNGGGRDG

SEQ ID NO: 61218 - protein, 4 aa, Mycobacterium avium
ASPA

SEQ ID NO: 61219 - protein, 12 aa, Mycobacterium avium
ASPANTNSQKQI

SEQ ID NO: 61220 - protein, 10 aa, Mycobacterium avium
ASPAPRGHVP

SEQ ID NO: 61221 - protein, 23 aa, Mycobacterium avium
ASPASLDKARHAPNSAVPASYQQ

SEQ ID NO: 61222 - protein, 18 aa, Mycobacterium avium
ASPCQAAAAASNGADPGP

SEQ ID NO: 61223 - protein, 10 aa, Mycobacterium avium
ASPDRSRKAK

SEQ ID NO: 61224 - protein, 9 aa, Mycobacterium avium
ASPDTAAET

SEQ ID NO: 61225 - protein, 9 aa, Mycobacterium avium
ASPDTARQP

SEQ ID NO: 61226 - protein, 8 aa, Mycobacterium avium
ASPDTQQD

SEQ ID NO: 61227 - protein, 9 aa, Mycobacterium avium
ASPEQLSEA

SEQ ID NO: 61228 - protein, 6 aa, Mycobacterium avium
ASPEVT

SEQ ID NO: 61229 - protein, 6 aa, Mycobacterium avium
ASPSVS

SEQ ID NO: 61230 - protein, 22 aa, Mycobacterium avium
ASPTAGGMTSTNSFAPEAPEYT

SEQ ID NO: 61231 - protein, 14 aa, Mycobacterium avium
ASPTSTVVGGGAEA

SEQ ID NO: 61232 - protein, 6 aa, Mycobacterium avium
ASQELR

SEQ ID NO: 61233 - protein, 13 aa, Mycobacterium avium
ASQRALDRSEGLE

SEQ ID NO: 61234 - protein, 10 aa, Mycobacterium avium
ASRADDDDRL

SEQ ID NO: 61235 - protein, 16 aa, Mycobacterium avium
ASRASPATNGHDDKVN

SEQ ID NO: 61236 - protein, 5 aa, Mycobacterium avium
ASRDL

SEQ ID NO: 61237 - protein, 10 aa, Mycobacterium avium
ASRDRDASPA

SEQ ID NO: 61238 - protein, 6 aa, Mycobacterium avium
ASREAD

SEQ ID NO: 61239 - protein, 6 aa, Mycobacterium avium
ASREGR

SEQ ID NO: 61240 - protein, 7 aa, Mycobacterium avium
ASRFGAD

SEQ ID NO: 61241 - protein, 14 aa, Mycobacterium avium
ASRGETDGPRVDEA

SEQ ID NO: 61242 - protein, 6 aa, Mycobacterium avium
ASRGIG

SEQ ID NO: 61243 - protein, 16 aa, Mycobacterium avium
ASRGTRLPTRPPRRVL

SEQ ID NO: 61244 - protein, 6 aa, Mycobacterium avium
ASRPCH

SEQ ID NO: 61245 - protein, 14 aa, Mycobacterium avium
ASRPPSDTALDRSK

SEQ ID NO: 61246 - protein, 7 aa, Mycobacterium avium
ASRRADG

SEQ ID NO: 61247 - protein, 11 aa, Mycobacterium avium
ASRRADPEEDL

SEQ ID NO: 61248 - protein, 13 aa, Mycobacterium avium
ASRRGSSACRRPG

SEQ ID NO: 61249 - protein, 9 aa, Mycobacterium avium
ASRRPRLGM

SEQ ID NO: 61250 - protein, 7 aa, Mycobacterium avium
ASRRRPR

SEQ ID NO: 61251 - protein, 6 aa, Mycobacterium avium
ASRRRR

SEQ ID NO: 61252 - protein, 34 aa, Mycobacterium avium
ASRSAADGEPAEDGQPAEDGQQAAHETTAAQEEA

SEQ ID NO: 61253 - protein, 7 aa, Mycobacterium avium
ASRSYTD

SEQ ID NO: 61254 - protein, 6 aa, Mycobacterium avium
ASRTPG

SEQ ID NO: 61255 - protein, 7 aa, Mycobacterium avium
ASRTSGT

SEQ ID NO: 61256 - protein, 6 aa, Mycobacterium avium
ASRVSL

SEQ ID NO: 61257 - protein, 12 aa, Mycobacterium avium
ASRYGPAGELGA

SEQ ID NO: 61258 - protein, 29 aa, Mycobacterium avium
ASSASAAQLTPFTEPPRTTNESAGPLQSA

SEQ ID NO: 61259 - protein, 25 aa, Mycobacterium avium
ASSASASALSPVASPPPQTATSTAV

SEQ ID NO: 61260 - protein, 5 aa, Mycobacterium avium
ASSGG

SEQ ID NO: 61261 - protein, 12 aa, Mycobacterium avium
ASSGHSAGEPCY

SEQ ID NO: 61262 - protein, 6 aa, Mycobacterium avium
ASSGIG

SEQ ID NO: 61263 - protein, 10 aa, Mycobacterium avium
ASSGIGEAAA

SEQ ID NO: 61264 - protein, 9 aa, Mycobacterium avium
ASSHPDSTH

SEQ ID NO: 61265 - protein, 8 aa, Mycobacterium avium
ASSHPDTT

SEQ ID NO: 61266 - protein, 8 aa, Mycobacterium avium
ASSLAPGR

SEQ ID NO: 61267 - protein, 11 aa, Mycobacterium avium
ASSNEALRQAT

SEQ ID NO: 61268 - protein, 9 aa, Mycobacterium avium
ASSPADEDT

SEQ ID NO: 61269 - protein, 6 aa, Mycobacterium avium
ASSPEA

SEQ ID NO: 61270 - protein, 49 aa, Mycobacterium avium
ASSPGSGRTRPARPPRTGCRSERSDRSPDVAATPYAGRAESGKSVRGRR

SEQ ID NO: 61271 - protein, 15 aa, Mycobacterium avium
ASSPIPAADYVAAHP

SEQ ID NO: 61272 - protein, 20 aa, Mycobacterium avium
ASSPPDATDDWGAPQPHPLQ

SEQ ID NO: 61273 - protein, 11 aa, Mycobacterium avium
ASSSVAVNPTR

SEQ ID NO: 61274 - protein, 9 aa, Mycobacterium avium
ASTAGAQGP

SEQ ID NO: 61275 - protein, 7 aa, Mycobacterium avium
ASTARRL

SEQ ID NO: 61276 - protein, 9 aa, Mycobacterium avium
ASTDPAADI

SEQ ID NO: 61277 - protein, 8 aa, Mycobacterium avium
ASTDRTGV

SEQ ID NO: 61278 - protein, 6 aa, Mycobacterium avium
ASTGAA

SEQ ID NO: 61279 - protein, 7 aa, Mycobacterium avium
ASTKDRF

SEQ ID NO: 61280 - protein, 8 aa, Mycobacterium avium
ASTKGEAV

SEQ ID NO: 61281 - protein, 7 aa, Mycobacterium avium
ASTMPED

SEQ ID NO: 61282 - protein, 18 aa, Mycobacterium avium
ASTPEHRGTGGSTDGKRR

SEQ ID NO: 61283 - protein, 10 aa, Mycobacterium avium
ASTPESLAAT

SEQ ID NO: 61284 - protein, 20 aa, Mycobacterium avium
ASTPLAAGSGAPPIGSPVPG

SEQ ID NO: 61285 - protein, 4 aa, Mycobacterium avium
ASTR

SEQ ID NO: 61286 - protein, 8 aa, Mycobacterium avium
ASTSTPSC

SEQ ID NO: 61287 - protein, 7 aa, Mycobacterium avium
ASTTPLD

SEQ ID NO: 61288 - protein, 8 aa, Mycobacterium avium
ASTTRHRA

SEQ ID NO: 61289 - protein, 10 aa, Mycobacterium avium
ASVANTGQVA

SEQ ID NO: 61290 - protein, 6 aa, Mycobacterium avium
ASVDAE

SEQ ID NO: 61291 - protein, 13 aa, Mycobacterium avium
ASVEGAGGGPAVE

SEQ ID NO: 61292 - protein, 22 aa, Mycobacterium avium
ASVGRGGRGSTGRKQARGRTVA

SEQ ID NO: 61293 - protein, 5 aa, Mycobacterium avium
ASVPD

SEQ ID NO: 61294 - protein, 9 aa, Mycobacterium avium
ASVRDTMDS

SEQ ID NO: 61295 - protein, 9 aa, Mycobacterium avium
ASVSYPGCT

SEQ ID NO: 61296 - protein, 23 aa, Mycobacterium avium
ASWSAAAPATSLASSAAPLEGSG

SEQ ID NO: 61297 - protein, 9 aa, Mycobacterium avium
ASWTEPKGG

SEQ ID NO: 61298 - protein, 6 aa, Mycobacterium avium
ASYGNS

SEQ ID NO: 61299 - protein, 10 aa, Mycobacterium avium
ASYNEETKEI

SEQ ID NO: 61300 - protein, 21 aa, Mycobacterium avium
ASYSGVAGVGSGTTASGASAA

SEQ ID NO: 61301 - protein, 11 aa, Mycobacterium avium
ATAADAHPQTL

SEQ ID NO: 61302 - protein, 17 aa, Mycobacterium avium
ATAADSRAALGAGADGV

SEQ ID NO: 61303 - protein, 11 aa, Mycobacterium avium
ATAAENAAKRT

SEQ ID NO: 61304 - protein, 9 aa, Mycobacterium avium
ATAAQTVEE

SEQ ID NO: 61305 - protein, 13 aa, Mycobacterium avium
ATAARLRERLGGP

SEQ ID NO: 61306 - protein, 11 aa, Mycobacterium avium
ATADGSVGLAE

SEQ ID NO: 61307 - protein, 9 aa, Mycobacterium avium
ATAEPEDVA

SEQ ID NO: 61308 - protein, 6 aa, Mycobacterium avium
ATAERI

SEQ ID NO: 61309 - protein, 15 aa, Mycobacterium avium
ATAGAAPAATPEPGA

SEQ ID NO: 61310 - protein, 7 aa, Mycobacterium avium
ATAGLKG

SEQ ID NO: 61311 - protein, 7 aa, Mycobacterium avium
ATAGPGA

SEQ ID NO: 61312 - protein, 5 aa, Mycobacterium avium
ATAGR

SEQ ID NO: 61313 - protein, 6 aa, Mycobacterium avium
ATAGTP

SEQ ID NO: 61314 - protein, 7 aa, Mycobacterium avium
ATAGTPL

SEQ ID NO: 61315 - protein, 6 aa, Mycobacterium avium
ATAHTG

SEQ ID NO: 61316 - protein, 6 aa, Mycobacterium avium
ATAIQR

SEQ ID NO: 61317 - protein, 7 aa, Mycobacterium avium
ATANTTA

SEQ ID NO: 61318 - protein, 10 aa, Mycobacterium avium
ATAPAASEEW

SEQ ID NO: 61319 - protein, 9 aa, Mycobacterium avium
ATAPASPEL

SEQ ID NO: 61320 - protein, 19 aa, Mycobacterium avium
ATAPGADPSITRTDEGTAR

SEQ ID NO: 61321 - protein, 15 aa, Mycobacterium avium
ATAPGATDEASTAFS

SEQ ID NO: 61322 - protein, 10 aa, Mycobacterium avium
ATAPPGAARG

SEQ ID NO: 61323 - protein, 8 aa, Mycobacterium avium
ATAPSGAR

SEQ ID NO: 61324 - protein, 8 aa, Mycobacterium avium
ATAQAAAR

SEQ ID NO: 61325 - protein, 10 aa, Mycobacterium avium
ATAQGNKVNP

SEQ ID NO: 61326 - protein, 12 aa, Mycobacterium avium
ATAQSADDAGRL

SEQ ID NO: 61327 - protein, 4 aa, Mycobacterium avium
ATAR

SEQ ID NO: 61328 - protein, 6 aa, Mycobacterium avium
ATARDA

SEQ ID NO: 61329 - protein, 7 aa, Mycobacterium avium
ATAREEL

SEQ ID NO: 61330 - protein, 6 aa, Mycobacterium avium
ATARTL

SEQ ID NO: 61331 - protein, 7 aa, Mycobacterium avium
ATASAPA

SEQ ID NO: 61332 - protein, 9 aa, Mycobacterium avium
ATASPSPHR

SEQ ID NO: 61333 - protein, 4 aa, Mycobacterium avium
ATAT

SEQ ID NO: 61334 - protein, 11 aa, Mycobacterium avium
ATATDGGYRVN

SEQ ID NO: 61335 - protein, 5 aa, Mycobacterium avium
ATATF

SEQ ID NO: 61336 - protein, 6 aa, Mycobacterium avium
ATATQL

SEQ ID NO: 61337 - protein, 6 aa, Mycobacterium avium
ATDAET

SEQ ID NO: 61338 - protein, 13 aa, Mycobacterium avium
ATDAGPVLSPHQP

SEQ ID NO: 61339 - protein, 6 aa, Mycobacterium avium
ATDAPG

SEQ ID NO: 61340 - protein, 19 aa, Mycobacterium avium
ATDDGAIDLGTQRNVVRFA

SEQ ID NO: 61341 - protein, 6 aa, Mycobacterium avium
ATDDTV

SEQ ID NO: 61342 - protein, 8 aa, Mycobacterium avium
ATDGDGEA

SEQ ID NO: 61343 - protein, 12 aa, Mycobacterium avium
ATDKAVRGDQRE

SEQ ID NO: 61344 - protein, 6 aa, Mycobacterium avium
ATDLDG

SEQ ID NO: 61345 - protein, 8 aa, Mycobacterium avium
ATDPGHGL

SEQ ID NO: 61346 - protein, 16 aa, Mycobacterium avium
ATDPPRPQRRRRGRTL

SEQ ID NO: 61347 - protein, 5 aa, Mycobacterium avium
ATDPQ

SEQ ID NO: 61348 - protein, 4 aa, Mycobacterium avium
ATDR

SEQ ID NO: 61349 - protein, 19 aa, Mycobacterium avium
ATDTDEQLANSAGRPIPGS

SEQ ID NO: 61350 - protein, 5 aa, Mycobacterium avium
ATDTG

SEQ ID NO: 61351 - protein, 7 aa, Mycobacterium avium
ATDTGDW

SEQ ID NO: 61352 - protein, 9 aa, Mycobacterium avium
ATDTTPTIG

SEQ ID NO: 61353 - protein, 8 aa, Mycobacterium avium
ATDVSGAY

SEQ ID NO: 61354 - protein, 4 aa, Mycobacterium avium
ATDW

SEQ ID NO: 61355 - protein, 6 aa, Mycobacterium avium
ATEAAR

SEQ ID NO: 61356 - protein, 10 aa, Mycobacterium avium
ATEADHLPRA

SEQ ID NO: 61357 - protein, 19 aa, Mycobacterium avium
ATEAVRAGTTVAHTSGANG

SEQ ID NO: 61358 - protein, 13 aa, Mycobacterium avium
ATEGGAEQRATQV

SEQ ID NO: 61359 - protein, 6 aa, Mycobacterium avium
ATEPER

SEQ ID NO: 61360 - protein, 8 aa, Mycobacterium avium
ATEQHGTT

SEQ ID NO: 61361 - protein, 13 aa, Mycobacterium avium
ATERAEALRRYRS

SEQ ID NO: 61362 - protein, 8 aa, Mycobacterium avium
ATESARPD

SEQ ID NO: 61363 - protein, 10 aa, Mycobacterium avium
ATESSRDALS

SEQ ID NO: 61364 - protein, 37 aa, Mycobacterium avium
ATESSVSGKNCRPAADATAAAAAAPGPTAADRQTRRR

SEQ ID NO: 61365 - protein, 13 aa, Mycobacterium avium
ATESTPDANGISR

SEQ ID NO: 61366 - protein, 6 aa, Mycobacterium avium
ATETEQ

SEQ ID NO: 61367 - protein, 7 aa, Mycobacterium avium
ATEYGSP

SEQ ID NO: 61368 - protein, 10 aa, Mycobacterium avium
ATFDGKPLRA

SEQ ID NO: 61369 - protein, 11 aa, Mycobacterium avium
ATFDGKPVRAG

SEQ ID NO: 61370 - protein, 5 aa, Mycobacterium avium
ATGAL

SEQ ID NO: 61371 - protein, 20 aa, Mycobacterium avium
ATGALTDTEFAEQKQRLLRA

SEQ ID NO: 61372 - protein, 17 aa, Mycobacterium avium
ATGAQPGGPLPAPAPDN

SEQ ID NO: 61373 - protein, 7 aa, Mycobacterium avium
ATGASRA

SEQ ID NO: 61374 - protein, 5 aa, Mycobacterium avium
ATGAT

SEQ ID NO: 61375 - protein, 4 aa, Mycobacterium avium
ATGC

SEQ ID NO: 61376 - protein, 11 aa, Mycobacterium avium
ATGDDGRPSQV

SEQ ID NO: 61377 - protein, 8 aa, Mycobacterium avium
ATGDGIDG

SEQ ID NO: 61378 - protein, 6 aa, Mycobacterium avium
ATGDPA

SEQ ID NO: 61379 - protein, 10 aa, Mycobacterium avium
ATGDRTKRNA

SEQ ID NO: 61380 - protein, 6 aa, Mycobacterium avium
ATGDRW

SEQ ID NO: 61381 - protein, 8 aa, Mycobacterium avium
ATGEMSGD

SEQ ID NO: 61382 - protein, 6 aa, Mycobacterium avium
ATGETE

SEQ ID NO: 61383 - protein, 7 aa, Mycobacterium avium
ATGGDGE

SEQ ID NO: 61384 - protein, 6 aa, Mycobacterium avium
ATGGDR

SEQ ID NO: 61385 - protein, 8 aa, Mycobacterium avium
ATGGHLGP

SEQ ID NO: 61386 - protein, 11 aa, Mycobacterium avium
ATGGPSGTDTI

SEQ ID NO: 61387 - protein, 12 aa, Mycobacterium avium
ATGHQWGPPYDA

SEQ ID NO: 61388 - protein, 19 aa, Mycobacterium avium
ATGIGAATAERLASEGAAV

SEQ ID NO: 61389 - protein, 10 aa, Mycobacterium avium
ATGKGNASKN

SEQ ID NO: 61390 - protein, 8 aa, Mycobacterium avium
ATGKPTFS

SEQ ID NO: 61391 - protein, 5 aa, Mycobacterium avium
ATGLT

SEQ ID NO: 61392 - protein, 6 aa, Mycobacterium avium
ATGMAG

SEQ ID NO: 61393 - protein, 21 aa, Mycobacterium avium
ATGMIGDPRDVGERTLNEADT

SEQ ID NO: 61394 - protein, 5 aa, Mycobacterium avium
ATGQM

SEQ ID NO: 61395 - protein, 6 aa, Mycobacterium avium
ATGQRM

SEQ ID NO: 61396 - protein, 9 aa, Mycobacterium avium
ATGRDADPA

SEQ ID NO: 61397 - protein, 6 aa, Mycobacterium avium
ATGREH

SEQ ID NO: 61398 - protein, 10 aa, Mycobacterium avium
ATGRPRPAVK

SEQ ID NO: 61399 - protein, 6 aa, Mycobacterium avium
ATGRSV

SEQ ID NO: 61400 - protein, 7 aa, Mycobacterium avium
ATGRYSE

SEQ ID NO: 61401 - protein, 9 aa, Mycobacterium avium
ATGSGEERH

SEQ ID NO: 61402 - protein, 12 aa, Mycobacterium avium
ATGSRDLGIPGE

SEQ ID NO: 61403 - protein, 4 aa, Mycobacterium avium
ATGT

SEQ ID NO: 61404 - protein, 5 aa, Mycobacterium avium
ATGVT

SEQ ID NO: 61405 - protein, 12 aa, Mycobacterium avium
ATGWNPVRAVAT

SEQ ID NO: 61406 - protein, 8 aa, Mycobacterium avium
ATHAGSGA

SEQ ID NO: 61407 - protein, 9 aa, Mycobacterium avium
ATHTAADWN

SEQ ID NO: 61408 - protein, 9 aa, Mycobacterium avium
ATHTAPNQH

SEQ ID NO: 61409 - protein, 10 aa, Mycobacterium avium
ATIDNGSFGT

SEQ ID NO: 61410 - protein, 6 aa, Mycobacterium avium
ATIGGT

SEQ ID NO: 61411 - protein, 41 aa, Mycobacterium avium
ATINPGQAAVPATGVTGLTDAAPAAGGPGGVAGPVGGTGRR

SEQ ID NO: 61412 - protein, 4 aa, Mycobacterium avium
ATIS

SEQ ID NO: 61413 - protein, 7 aa, Mycobacterium avium
ATKDLDE

SEQ ID NO: 61414 - protein, 7 aa, Mycobacterium avium
ATKGGVG

SEQ ID NO: 61415 - protein, 10 aa, Mycobacterium avium
ATKSALSSFT

SEQ ID NO: 61416 - protein, 12 aa, Mycobacterium avium
ATLGQDPAAVAE

SEQ ID NO: 61417 - protein, 9 aa, Mycobacterium avium
ATLPDGSRA

SEQ ID NO: 61418 - protein, 8 aa, Mycobacterium avium
ATLPPDKE

SEQ ID NO: 61419 - protein, 19 aa, Mycobacterium avium
ATLSPTSTVRGWECMPALV

SEQ ID NO: 61420 - protein, 31 aa, Mycobacterium avium
ATMSGQVDSTFDTGCGGGPGGSNSWPFSLVR

SEQ ID NO: 61421 - protein, 10 aa, Mycobacterium avium
ATNDPAPGPL

SEQ ID NO: 61422 - protein, 11 aa, Mycobacterium avium
ATNGPVPIGRT

SEQ ID NO: 61423 - protein, 11 aa, Mycobacterium avium
ATNSPTAIRTT

SEQ ID NO: 61424 - protein, 23 aa, Mycobacterium avium
ATNTPTACPNSAAGCPPNYVPPS

SEQ ID NO: 61425 - protein, 7 aa, Mycobacterium avium
ATNYTGA

SEQ ID NO: 61426 - protein, 8 aa, Mycobacterium avium
ATPADDGG

SEQ ID NO: 61427 - protein, 5 aa, Mycobacterium avium
ATPAQ

SEQ ID NO: 61428 - protein, 8 aa, Mycobacterium avium
ATPDALQQ

SEQ ID NO: 61429 - protein, 7 aa, Mycobacterium avium
ATPEDRE

SEQ ID NO: 61430 - protein, 6 aa, Mycobacterium avium
ATPERL

SEQ ID NO: 61431 - protein, 13 aa, Mycobacterium avium
ATPGAADKVVVTF

SEQ ID NO: 61432 - protein, 7 aa, Mycobacterium avium
ATPGFGA

SEQ ID NO: 61433 - protein, 6 aa, Mycobacterium avium
ATPGKT

SEQ ID NO: 61434 - protein, 9 aa, Mycobacterium avium
ATPPALPAV

SEQ ID NO: 61435 - protein, 21 aa, Mycobacterium avium
ATPPALPPVRPEADTYQSAEN

SEQ ID NO: 61436 - protein, 5 aa, Mycobacterium avium
ATPPF

SEQ ID NO: 61437 - protein, 18 aa, Mycobacterium avium
ATPPGRQPSCNKRPRSSR

SEQ ID NO: 61438 - protein, 10 aa, Mycobacterium avium
ATPPPGTDPW

SEQ ID NO: 61439 - protein, 8 aa, Mycobacterium avium
ATPPPPDL

SEQ ID NO: 61440 - protein, 14 aa, Mycobacterium avium
ATPPPSGMSYQPSA

SEQ ID NO: 61441 - protein, 13 aa, Mycobacterium avium
ATPQSAPPPGAIT

SEQ ID NO: 61442 - protein, 7 aa, Mycobacterium avium
ATPRTDL

SEQ ID NO: 61443 - protein, 49 aa, Mycobacterium avium
ATPSAPEGPDDGSGGVDEGSGGFDDTAASPTDQAPTQNPPTRHPPTQQE

SEQ ID NO: 61444 - protein, 44 aa, Mycobacterium avium
ATPSAPEGPDDGSGGVDEGSGGFDDTAASPTDQVPTQHPPTQQE

SEQ ID NO: 61445 - protein, 10 aa, Mycobacterium avium
ATPSKSAQTA

SEQ ID NO: 61446 - protein, 17 aa, Mycobacterium avium
ATPSPSPVSPPTSRSPN

SEQ ID NO: 61447 - protein, 8 aa, Mycobacterium avium
ATPVAGGY

SEQ ID NO: 61448 - protein, 22 aa, Mycobacterium avium
ATPVEHADNTTAAAMPAAAAPS

SEQ ID NO: 61449 - protein, 9 aa, Mycobacterium avium
ATQAGVSRP

SEQ ID NO: 61450 - protein, 5 aa, Mycobacterium avium
ATQFQ

SEQ ID NO: 61451 - protein, 5 aa, Mycobacterium avium
ATQHR

SEQ ID NO: 61452 - protein, 6 aa, Mycobacterium avium
ATQHRA

SEQ ID NO: 61453 - protein, 6 aa, Mycobacterium avium
ATQYTD

SEQ ID NO: 61454 - protein, 6 aa, Mycobacterium avium
ATRARI

SEQ ID NO: 61455 - protein, 9 aa, Mycobacterium avium
ATRASQTAA

SEQ ID NO: 61456 - protein, 7 aa, Mycobacterium avium
ATRDGSS

SEQ ID NO: 61457 - protein, 10 aa, Mycobacterium avium
ATRDGYSNTL

SEQ ID NO: 61458 - protein, 6 aa, Mycobacterium avium
ATRDPA

SEQ ID NO: 61459 - protein, 20 aa, Mycobacterium avium
ATRERAETDLANQGGRYRPE

SEQ ID NO: 61460 - protein, 12 aa, Mycobacterium avium
ATRGLESALGNT

SEQ ID NO: 61461 - protein, 5 aa, Mycobacterium avium
ATRHH

SEQ ID NO: 61462 - protein, 8 aa, Mycobacterium avium
ATRNEAGV

SEQ ID NO: 61463 - protein, 44 aa, Mycobacterium avium
ATRPCAPSPTAGGAGVDSGRRPSTTSISSGPEAASVAWVRYVAL

SEQ ID NO: 61464 - protein, 8 aa, Mycobacterium avium
ATRPGVES

SEQ ID NO: 61465 - protein, 6 aa, Mycobacterium avium
ATRQGS

SEQ ID NO: 61466 - protein, 13 aa, Mycobacterium avium
ATRRLSEALADES

SEQ ID NO: 61467 - protein, 12 aa, Mycobacterium avium
ATRRLSEALTES

SEQ ID NO: 61468 - protein, 9 aa, Mycobacterium avium
ATRSQHEQE

SEQ ID NO: 61469 - protein, 16 aa, Mycobacterium avium
ATRSRSAPADALGRAR

SEQ ID NO: 61470 - protein, 8 aa, Mycobacterium avium
ATRTADGH

SEQ ID NO: 61471 - protein, 7 aa, Mycobacterium avium
ATRVPSL

SEQ ID NO: 61472 - protein, 10 aa, Mycobacterium avium
ATRYPPNGIR

SEQ ID NO: 61473 - protein, 4 aa, Mycobacterium avium
ATSA

SEQ ID NO: 61474 - protein, 9 aa, Mycobacterium avium
ATSAEPAVV

SEQ ID NO: 61475 - protein, 8 aa, Mycobacterium avium
ATSAGYEF

SEQ ID NO: 61476 - protein, 16 aa, Mycobacterium avium
ATSEEVREDLGVRDNA

SEQ ID NO: 61477 - protein, 9 aa, Mycobacterium avium
ATSGAGGLP

SEQ ID NO: 61478 - protein, 8 aa, Mycobacterium avium
ATSGGGSL

SEQ ID NO: 61479 - protein, 7 aa, Mycobacterium avium
ATSGPDK

SEQ ID NO: 61480 - protein, 8 aa, Mycobacterium avium
ATSGSGNK

SEQ ID NO: 61481 - protein, 4 aa, Mycobacterium avium
ATSN

SEQ ID NO: 61482 - protein, 7 aa, Mycobacterium avium
ATSPTAE

SEQ ID NO: 61483 - protein, 4 aa, Mycobacterium avium
ATSR

SEQ ID NO: 61484 - protein, 9 aa, Mycobacterium avium
ATSREGKAH

SEQ ID NO: 61485 - protein, 8 aa, Mycobacterium avium
ATSSDVDP

SEQ ID NO: 61486 - protein, 9 aa, Mycobacterium avium
ATSSKNESR

SEQ ID NO: 61487 - protein, 7 aa, Mycobacterium avium
ATSTEAD

SEQ ID NO: 61488 - protein, 6 aa, Mycobacterium avium
ATSTIQ

SEQ ID NO: 61489 - protein, 6 aa, Mycobacterium avium
ATSTIT

SEQ ID NO: 61490 - protein, 4 aa, Mycobacterium avium
ATSV

SEQ ID NO: 61491 - protein, 7 aa, Mycobacterium avium
ATSVGDV

SEQ ID NO: 61492 - protein, 4 aa, Mycobacterium avium
ATTA

SEQ ID NO: 61493 - protein, 13 aa, Mycobacterium avium
ATTADKPDTPDLA

SEQ ID NO: 61494 - protein, 13 aa, Mycobacterium avium
ATTAGGTVMANAA

SEQ ID NO: 61495 - protein, 4 aa, Mycobacterium avium
ATTD

SEQ ID NO: 61496 - protein, 16 aa, Mycobacterium avium
ATTEQHSGGQPPHNTR

SEQ ID NO: 61497 - protein, 6 aa, Mycobacterium avium
ATTGWS

SEQ ID NO: 61498 - protein, 4 aa, Mycobacterium avium
ATTP

SEQ ID NO: 61499 - protein, 71 aa, Mycobacterium avium
ATTPEVDEALSAKAEDELAEERDDEETDEADEAAEAPADATEPDEEALEADEADGEPDDDADETETRAAGD

SEQ ID NO: 61500 - protein, 71 aa, Mycobacterium avium
ATTPEVDETLSAKAEDELAEERDDEETDETDEAAEAPADATEPDEEALEDDEADGEPDDDADETETRAAGD

SEQ ID NO: 61501 - protein, 9 aa, Mycobacterium avium
ATTPEVEEA

SEQ ID NO: 61502 - protein, 10 aa, Mycobacterium avium
ATTPPGAARG

SEQ ID NO: 61503 - protein, 6 aa, Mycobacterium avium
ATTPRA

SEQ ID NO: 61504 - protein, 5 aa, Mycobacterium avium
ATTQA

SEQ ID NO: 61505 - protein, 12 aa, Mycobacterium avium
ATTRSGALTGPL

SEQ ID NO: 61506 - protein, 8 aa, Mycobacterium avium
ATTSDVRA

SEQ ID NO: 61507 - protein, 7 aa, Mycobacterium avium
ATTSNVR

SEQ ID NO: 61508 - protein, 17 aa, Mycobacterium avium
ATTSSRDVDTAKPEPGI

SEQ ID NO: 61509 - protein, 11 aa, Mycobacterium avium
ATTTAPYQAGN

SEQ ID NO: 61510 - protein, 7 aa, Mycobacterium avium
ATTTGLP

SEQ ID NO: 61511 - protein, 9 aa, Mycobacterium avium
ATTVSGKDA

SEQ ID NO: 61512 - protein, 12 aa, Mycobacterium avium
ATVAGRGATPAV

SEQ ID NO: 61513 - protein, 7 aa, Mycobacterium avium
ATVDDGT

SEQ ID NO: 61514 - protein, 19 aa, Mycobacterium avium
ATVGGTTQQAHDGDHPIGG

SEQ ID NO: 61515 - protein, 7 aa, Mycobacterium avium
ATVNGAA

SEQ ID NO: 61516 - protein, 11 aa, Mycobacterium avium
ATVPDGHGGTI

SEQ ID NO: 61517 - protein, 7 aa, Mycobacterium avium
ATVPGSS

SEQ ID NO: 61518 - protein, 7 aa, Mycobacterium avium
ATVSGPA

SEQ ID NO: 61519 - protein, 5 aa, Mycobacterium avium
ATWPP

SEQ ID NO: 61520 - protein, 19 aa, Mycobacterium avium
ATYGPALPEGAPDDGEDRG

SEQ ID NO: 61521 - protein, 13 aa, Mycobacterium avium
ATYHDDHGSFSPD

SEQ ID NO: 61522 - protein, 16 aa, Mycobacterium avium
ATYPNTDWPDETATAG

SEQ ID NO: 61523 - protein, 9 aa, Mycobacterium avium
ATYTPPDGL

SEQ ID NO: 61524 - protein, 5 aa, Mycobacterium avium
AVAAR

SEQ ID NO: 61525 - protein, 5 aa, Mycobacterium avium
AVAEE

SEQ ID NO: 61526 - protein, 15 aa, Mycobacterium avium
AVAEQPATGLPVPAA

SEQ ID NO: 61527 - protein, 11 aa, Mycobacterium avium
AVAHTGSVSSW

SEQ ID NO: 61528 - protein, 11 aa, Mycobacterium avium
AVAPELRQRRD

SEQ ID NO: 61529 - protein, 11 aa, Mycobacterium avium
AVAQADAQACD

SEQ ID NO: 61530 - protein, 10 aa, Mycobacterium avium
AVASQGPDAL

SEQ ID NO: 61531 - protein, 7 aa, Mycobacterium avium
AVASTRR

SEQ ID NO: 61532 - protein, 4 aa, Mycobacterium avium
AVDA

SEQ ID NO: 61533 - protein, 7 aa, Mycobacterium avium
AVDAAKG

SEQ ID NO: 61534 - protein, 6 aa, Mycobacterium avium
AVDADD

SEQ ID NO: 61535 - protein, 8 aa, Mycobacterium avium
AVDDGAGG

SEQ ID NO: 61536 - protein, 4 aa, Mycobacterium avium
AVDG

SEQ ID NO: 61537 - protein, 12 aa, Mycobacterium avium
AVDRTTKALADQ

SEQ ID NO: 61538 - protein, 5 aa, Mycobacterium avium
AVEAS

SEQ ID NO: 61539 - protein, 9 aa, Mycobacterium avium
AVEEANDAG

SEQ ID NO: 61540 - protein, 12 aa, Mycobacterium avium
AVEPPAKTAAGT

SEQ ID NO: 61541 - protein, 12 aa, Mycobacterium avium
AVEQARTARSAA

SEQ ID NO: 61542 - protein, 4 aa, Mycobacterium avium
AVEV

SEQ ID NO: 61543 - protein, 6 aa, Mycobacterium avium
AVGAEA

SEQ ID NO: 61544 - protein, 8 aa, Mycobacterium avium
AVGDGPQR

SEQ ID NO: 61545 - protein, 10 aa, Mycobacterium avium
AVGDPDDGQG

SEQ ID NO: 61546 - protein, 17 aa, Mycobacterium avium
AVGEPGPLPADEIAPER

SEQ ID NO: 61547 - protein, 17 aa, Mycobacterium avium
AVGEPGPLPEDEIAPER

SEQ ID NO: 61548 - protein, 7 aa, Mycobacterium avium
AVGEQAS

SEQ ID NO: 61549 - protein, 6 aa, Mycobacterium avium
AVGESW

SEQ ID NO: 61550 - protein, 4 aa, Mycobacterium avium
AVGG

SEQ ID NO: 61551 - protein, 5 aa, Mycobacterium avium
AVGGA

SEQ ID NO: 61552 - protein, 14 aa, Mycobacterium avium
AVGGPDDPEFHPPR

SEQ ID NO: 61553 - protein, 9 aa, Mycobacterium avium
AVGGSAVGD

SEQ ID NO: 61554 - protein, 7 aa, Mycobacterium avium
AVGGTPI

SEQ ID NO: 61555 - protein, 10 aa, Mycobacterium avium
AVGGTPSGYG

SEQ ID NO: 61556 - protein, 8 aa, Mycobacterium avium
AVGLPGED

SEQ ID NO: 61557 - protein, 23 aa, Mycobacterium avium
AVGPDDRGDARLETQSRRRGKGL

SEQ ID NO: 61558 - protein, 10 aa, Mycobacterium avium
AVGPHSAPPV

SEQ ID NO: 61559 - protein, 55 aa, Mycobacterium avium
AVGPPGLGAGGNLSAGTRAGQTSPDFATAAAPAAADRREQVRRRRRPRPGRIDPG

SEQ ID NO: 61560 - protein, 20 aa, Mycobacterium avium
AVGPSADDQPAQPDSAETQD

SEQ ID NO: 61561 - protein, 5 aa, Mycobacterium avium
AVGRG

SEQ ID NO: 61562 - protein, 6 aa, Mycobacterium avium
AVGSAN

SEQ ID NO: 61563 - protein, 8 aa, Mycobacterium avium
AVGSVGAT

SEQ ID NO: 61564 - protein, 9 aa, Mycobacterium avium
AVGTADPDI

SEQ ID NO: 61565 - protein, 19 aa, Mycobacterium avium
AVKGERRDLGYPQPNSRSR

SEQ ID NO: 61566 - protein, 6 aa, Mycobacterium avium
AVKPQE

SEQ ID NO: 61567 - protein, 10 aa, Mycobacterium avium
AVNPGTVDAA

SEQ ID NO: 61568 - protein, 10 aa, Mycobacterium avium
AVNRDPSEGL

SEQ ID NO: 61569 - protein, 5 aa, Mycobacterium avium
AVNSR

SEQ ID NO: 61570 - protein, 5 aa, Mycobacterium avium
AVNSS

SEQ ID NO: 61571 - protein, 6 aa, Mycobacterium avium
AVPAEA

SEQ ID NO: 61572 - protein, 8 aa, Mycobacterium avium
AVPARDQV

SEQ ID NO: 61573 - protein, 5 aa, Mycobacterium avium
AVPEE

SEQ ID NO: 61574 - protein, 6 aa, Mycobacterium avium
AVPEEA

SEQ ID NO: 61575 - protein, 12 aa, Mycobacterium avium
AVPESAGGDGAT

SEQ ID NO: 61576 - protein, 32 aa, Mycobacterium avium
AVPGAAAAAGTSTAAGVPGPAVAGAGTATTVG

SEQ ID NO: 61577 - protein, 31 aa, Mycobacterium avium
AVPGPHQQGAGRGDDRGLRDAPDLRQPAHPA

SEQ ID NO: 61578 - protein, 12 aa, Mycobacterium avium
AVPGSPGSQIAP

SEQ ID NO: 61579 - protein, 11 aa, Mycobacterium avium
AVPGVPSGNAL

SEQ ID NO: 61580 - protein, 7 aa, Mycobacterium avium
AVPPAAV

SEQ ID NO: 61581 - protein, 13 aa, Mycobacterium avium
AVPQGNRQGQQQG

SEQ ID NO: 61582 - protein, 11 aa, Mycobacterium avium
AVPRSERGVDA

SEQ ID NO: 61583 - protein, 8 aa, Mycobacterium avium
AVPSETAA

SEQ ID NO: 61584 - protein, 8 aa, Mycobacterium avium
AVPTASAT

SEQ ID NO: 61585 - protein, 10 aa, Mycobacterium avium
AVQGAKLAGA

SEQ ID NO: 61586 - protein, 4 aa, Mycobacterium avium
AVQQ

SEQ ID NO: 61587 - protein, 6 aa, Mycobacterium avium
AVQRNA

SEQ ID NO: 61588 - protein, 12 aa, Mycobacterium avium
AVQSGSSAHTTT

SEQ ID NO: 61589 - protein, 11 aa, Mycobacterium avium
AVRADSPFRRG

SEQ ID NO: 61590 - protein, 12 aa, Mycobacterium avium
AVRAGAKQIDGS

SEQ ID NO: 61591 - protein, 10 aa, Mycobacterium avium
AVRDPDTGDW

SEQ ID NO: 61592 - protein, 8 aa, Mycobacterium avium
AVREGAGD

SEQ ID NO: 61593 - protein, 19 aa, Mycobacterium avium
AVRGDAGRGHRPDARRTAG

SEQ ID NO: 61594 - protein, 27 aa, Mycobacterium avium
AVRPATARREQPAAGVQGQGRRRRPVQ

SEQ ID NO: 61595 - protein, 8 aa, Mycobacterium avium
AVRPATPV

SEQ ID NO: 61596 - protein, 11 aa, Mycobacterium avium
AVRPDSTVEYD

SEQ ID NO: 61597 - protein, 13 aa, Mycobacterium avium
AVRPGAHRPGHPR

SEQ ID NO: 61598 - protein, 18 aa, Mycobacterium avium
AVRPGGLGRGDGGGHPRV

SEQ ID NO: 61599 - protein, 11 aa, Mycobacterium avium
AVRPGGRGGGL

SEQ ID NO: 61600 - protein, 13 aa, Mycobacterium avium
AVRPGSAEAVAAA

SEQ ID NO: 61601 - protein, 11 aa, Mycobacterium avium
AVRRARDAVTG

SEQ ID NO: 61602 - protein, 9 aa, Mycobacterium avium
AVRRASGAE

SEQ ID NO: 61603 - protein, 10 aa, Mycobacterium avium
AVSAAPDGTR

SEQ ID NO: 61604 - protein, 11 aa, Mycobacterium avium
AVSGAKSDATD

SEQ ID NO: 61605 - protein, 8 aa, Mycobacterium avium
AVSGANYE

SEQ ID NO: 61606 - protein, 13 aa, Mycobacterium avium
AVSGRRGREQQAE

SEQ ID NO: 61607 - protein, 9 aa, Mycobacterium avium
AVSSPQGRF

SEQ ID NO: 61608 - protein, 12 aa, Mycobacterium avium
AVSTESRHTRER

SEQ ID NO: 61609 - protein, 7 aa, Mycobacterium avium
AVSTTTE

SEQ ID NO: 61610 - protein, 13 aa, Mycobacterium avium
AVTAGQPDRDDAH

SEQ ID NO: 61611 - protein, 15 aa, Mycobacterium avium
AVTGRGEDNPPDSQM

SEQ ID NO: 61612 - protein, 7 aa, Mycobacterium avium
AVTSPTA

SEQ ID NO: 61613 - protein, 7 aa, Mycobacterium avium
AVTTAEA

SEQ ID NO: 61614 - protein, 8 aa, Mycobacterium avium
AVTTPART

SEQ ID NO: 61615 - protein, 6 aa, Mycobacterium avium
AVTTPV

SEQ ID NO: 61616 - protein, 9 aa, Mycobacterium avium
AVVSGDAAN

SEQ ID NO: 61617 - protein, 11 aa, Mycobacterium avium
AVYAPKAALGH

SEQ ID NO: 61618 - protein, 4 aa, Mycobacterium avium
AWDP

SEQ ID NO: 61619 - protein, 4 aa, Mycobacterium avium
AWEE

SEQ ID NO: 61620 - protein, 10 aa, Mycobacterium avium
AWGQNSDPAS

SEQ ID NO: 61621 - protein, 9 aa, Mycobacterium avium
AWPPAGATK

SEQ ID NO: 61622 - protein, 13 aa, Mycobacterium avium
AWPPGHRPAVRRR

SEQ ID NO: 61623 - protein, 4 aa, Mycobacterium avium
AWSQ

SEQ ID NO: 61624 - protein, 11 aa, Mycobacterium avium
AWTNSREYGNR

SEQ ID NO: 61625 - protein, 5 aa, Mycobacterium avium
AYADG

SEQ ID NO: 61626 - protein, 24 aa, Mycobacterium avium
AYADGKRAVRPPDPADAAQIEAAR

SEQ ID NO: 61627 - protein, 16 aa, Mycobacterium avium
AYDGGGEVTLNSTDPF

SEQ ID NO: 61628 - protein, 5 aa, Mycobacterium avium
AYESW

SEQ ID NO: 61629 - protein, 13 aa, Mycobacterium avium
AYGAQKAGADKMA

SEQ ID NO: 61630 - protein, 9 aa, Mycobacterium avium
AYGGGGAGN

SEQ ID NO: 61631 - protein, 17 aa, Mycobacterium avium
AYGQPGAARKPKQVRAA

SEQ ID NO: 61632 - protein, 6 aa, Mycobacterium avium
AYGRSA

SEQ ID NO: 61633 - protein, 11 aa, Mycobacterium avium
AYGRSAKDAVD

SEQ ID NO: 61634 - protein, 8 aa, Mycobacterium avium
AYLPGPSL

SEQ ID NO: 61635 - protein, 8 aa, Mycobacterium avium
AYNGAGGH

SEQ ID NO: 61636 - protein, 8 aa, Mycobacterium avium
AYPDGLPT

SEQ ID NO: 61637 - protein, 6 aa, Mycobacterium avium
AYPNDP

SEQ ID NO: 61638 - protein, 13 aa, Mycobacterium avium
AYSDDDGIVVAVG

SEQ ID NO: 61639 - protein, 11 aa, Mycobacterium avium
AYTAPGDFDAT

SEQ ID NO: 61640 - protein, 25 aa, Mycobacterium avium
AYTDPDGFAAAPALPDLATDPTAIR

SEQ ID NO: 61641 - protein, 6 aa, Mycobacterium avium
AYTNAS

SEQ ID NO: 61642 - protein, 8 aa, Mycobacterium avium
AYTPQQAV

SEQ ID NO: 61643 - protein, 30 aa, Mycobacterium avium
AYTVSGAASDPGVAVTPTSGQFDAGGAASV

SEQ ID NO: 61644 - protein, 17 aa, Mycobacterium avium
CAAARSGDAFGRRPRRE

SEQ ID NO: 61645 - protein, 17 aa, Mycobacterium avium
CAAGQAAVQSAAASVRA

SEQ ID NO: 61646 - protein, 10 aa, Mycobacterium avium
CAAGTGPAAG

SEQ ID NO: 61647 - protein, 7 aa, Mycobacterium avium
CAEPPVQ

SEQ ID NO: 61648 - protein, 11 aa, Mycobacterium avium
CAGPPDGKADY

SEQ ID NO: 61649 - protein, 8 aa, Mycobacterium avium
CAGRDPDW

SEQ ID NO: 61650 - protein, 35 aa, Mycobacterium avium
CARDAAEADPGPAKRQVHNAPGADPAPVQVSADPQ

SEQ ID NO: 61651 - protein, 9 aa, Mycobacterium avium
CASGSEGIA

SEQ ID NO: 61652 - protein, 37 aa, Mycobacterium avium
CATPPRTPSCGLPPSGRSTTFGAASSQLTPGRLGRSY

SEQ ID NO: 61653 - protein, 5 aa, Mycobacterium avium
CCAGS

SEQ ID NO: 61654 - protein, 5 aa, Mycobacterium avium
CDAGE

SEQ ID NO: 61655 - protein, 9 aa, Mycobacterium avium
CDDDPATLR

SEQ ID NO: 61656 - protein, 11 aa, Mycobacterium avium
CDGAPPGAGRR

SEQ ID NO: 61657 - protein, 6 aa, Mycobacterium avium
CDGDDC

SEQ ID NO: 61658 - protein, 9 aa, Mycobacterium avium
CDGRGPDWT

SEQ ID NO: 61659 - protein, 5 aa, Mycobacterium avium
CDKGN

SEQ ID NO: 61660 - protein, 6 aa, Mycobacterium avium
CDPEGT

SEQ ID NO: 61661 - protein, 4 aa, Mycobacterium avium
CDPG

SEQ ID NO: 61662 - protein, 48 aa, Mycobacterium avium
CDPPWPGPPAGGAPCPPGGGGAPGAAPANPAPIPNAAAPSAPAMLTPP

SEQ ID NO: 61663 - protein, 49 aa, Mycobacterium avium
CDPPWPGPPAGGAPCPPGGGGAPGAAPANPAPIPNAAAPSAPAMPTPPT

SEQ ID NO: 61664 - protein, 5 aa, Mycobacterium avium
CDPQD

SEQ ID NO: 61665 - protein, 10 aa, Mycobacterium avium
CEGPHMATPN

SEQ ID NO: 61666 - protein, 5 aa, Mycobacterium avium
CEKPG

SEQ ID NO: 61667 - protein, 16 aa, Mycobacterium avium
CEPNSVAPTGGAPGNF

SEQ ID NO: 61668 - protein, 11 aa, Mycobacterium avium
CEQASPWSPRE

SEQ ID NO: 61669 - protein, 7 aa, Mycobacterium avium
CERGGSS

SEQ ID NO: 61670 - protein, 4 aa, Mycobacterium avium
CESG

SEQ ID NO: 61671 - protein, 8 aa, Mycobacterium avium
CESGGNWG

SEQ ID NO: 61672 - protein, 20 aa, Mycobacterium avium
CGAAEGPYGFAGTSNSFASG

SEQ ID NO: 61673 - protein, 6 aa, Mycobacterium avium
CGARQV

SEQ ID NO: 61674 - protein, 13 aa, Mycobacterium avium
CGATRGLHAHHLR

SEQ ID NO: 61675 - protein, 4 aa, Mycobacterium avium
CGDD

SEQ ID NO: 61676 - protein, 7 aa, Mycobacterium avium
CGDDGSA

SEQ ID NO: 61677 - protein, 21 aa, Mycobacterium avium
CGDPQDPGPFAARSFRRCSAT

SEQ ID NO: 61678 - protein, 6 aa, Mycobacterium avium
CGDQGD

SEQ ID NO: 61679 - protein, 8 aa, Mycobacterium avium
CGDRSAAV

SEQ ID NO: 61680 - protein, 9 aa, Mycobacterium avium
CGEDGANSY

SEQ ID NO: 61681 - protein, 9 aa, Mycobacterium avium
CGGAADPAL

SEQ ID NO: 61682 - protein, 9 aa, Mycobacterium avium
CGNGGGASY

SEQ ID NO: 61683 - protein, 17 aa, Mycobacterium avium
CGNPTSMTARGPAHQNR

SEQ ID NO: 61684 - protein, 23 aa, Mycobacterium avium
CGPPSSTTAGDVTTQTAGCADGR

SEQ ID NO: 61685 - protein, 8 aa, Mycobacterium avium
CGRPAPGA

SEQ ID NO: 61686 - protein, 4 aa, Mycobacterium avium
CGRQ

SEQ ID NO: 61687 - protein, 12 aa, Mycobacterium avium
CGRRGASGRTHR

SEQ ID NO: 61688 - protein, 11 aa, Mycobacterium avium
CGRTGDDARQS

SEQ ID NO: 61689 - protein, 7 aa, Mycobacterium avium
CGRVPDK

SEQ ID NO: 61690 - protein, 6 aa, Mycobacterium avium
CGSADR

SEQ ID NO: 61691 - protein, 14 aa, Mycobacterium avium
CGSGRRGVEPESGR

SEQ ID NO: 61692 - protein, 7 aa, Mycobacterium avium
CGSPADR

SEQ ID NO: 61693 - protein, 9 aa, Mycobacterium avium
CGTDRHPPT

SEQ ID NO: 61694 - protein, 4 aa, Mycobacterium avium
CGTN

SEQ ID NO: 61695 - protein, 6 aa, Mycobacterium avium
CHGGPG

SEQ ID NO: 61696 - protein, 6 aa, Mycobacterium avium
CHPPGH

SEQ ID NO: 61697 - protein, 7 aa, Mycobacterium avium
CKDGEQE

SEQ ID NO: 61698 - protein, 8 aa, Mycobacterium avium
CKSCPSSA

SEQ ID NO: 61699 - protein, 7 aa, Mycobacterium avium
CLKPDSR

SEQ ID NO: 61700 - protein, 34 aa, Mycobacterium avium
CNPDDPAPVVDGQPGQEAIQRDSRSAAQRNHDGL

SEQ ID NO: 61701 - protein, 7 aa, Mycobacterium avium
CPDTRPV

SEQ ID NO: 61702 - protein, 5 aa, Mycobacterium avium
CPGET

SEQ ID NO: 61703 - protein, 5 aa, Mycobacterium avium
CPLND

SEQ ID NO: 61704 - protein, 6 aa, Mycobacterium avium
CPLRSP

SEQ ID NO: 61705 - protein, 4 aa, Mycobacterium avium
CPNP

SEQ ID NO: 61706 - protein, 6 aa, Mycobacterium avium
CPPTDP

SEQ ID NO: 61707 - protein, 14 aa, Mycobacterium avium
CPRPPLENGATRAY

SEQ ID NO: 61708 - protein, 10 aa, Mycobacterium avium
CPSGTVGRGG

SEQ ID NO: 61709 - protein, 4 aa, Mycobacterium avium
CPTK

SEQ ID NO: 61710 - protein, 10 aa, Mycobacterium avium
CPTQGDNLSE

SEQ ID NO: 61711 - protein, 9 aa, Mycobacterium avium
CQGRQVDDD

SEQ ID NO: 61712 - protein, 4 aa, Mycobacterium avium
CQMP

SEQ ID NO: 61713 - protein, 5 aa, Mycobacterium avium
CQSGR

SEQ ID NO: 61714 - protein, 4 aa, Mycobacterium avium
CQTR

SEQ ID NO: 61715 - protein, 5 aa, Mycobacterium avium
CREGA

SEQ ID NO: 61716 - protein, 19 aa, Mycobacterium avium
CRETGSVPTADDASVSTPY

SEQ ID NO: 61717 - protein, 14 aa, Mycobacterium avium
CRGGGGVVTDRGGT

SEQ ID NO: 61718 - protein, 11 aa, Mycobacterium avium
CRQPPTPPIPH

SEQ ID NO: 61719 - protein, 12 aa, Mycobacterium avium
CRQRGRCGGDRL

SEQ ID NO: 61720 - protein, 15 aa, Mycobacterium avium
CRRGGGLGTSHTSRV

SEQ ID NO: 61721 - protein, 10 aa, Mycobacterium avium
CRSRAPKIDR

SEQ ID NO: 61722 - protein, 19 aa, Mycobacterium avium
CRSRRSSSASPAGSRWAIR

SEQ ID NO: 61723 - protein, 10 aa, Mycobacterium avium
CRSTDPRKSE

SEQ ID NO: 61724 - protein, 7 aa, Mycobacterium avium
CSDDGSA

SEQ ID NO: 61725 - protein, 8 aa, Mycobacterium avium
CSGAETHG

SEQ ID NO: 61726 - protein, 6 aa, Mycobacterium avium
CSGPSA

SEQ ID NO: 61727 - protein, 32 aa, Mycobacterium avium
CSGRSVPASTTAPAPAAGMDTAAAEAAAAQGR

SEQ ID NO: 61728 - protein, 24 aa, Mycobacterium avium
CSPSTPSSRPTRTPSSCGVTATPP

SEQ ID NO: 61729 - protein, 15 aa, Mycobacterium avium
CSRPPGPRDAAPARP

SEQ ID NO: 61730 - protein, 7 aa, Mycobacterium avium
CSSGDVG

SEQ ID NO: 61731 - protein, 15 aa, Mycobacterium avium
CSTRTGGKSRSARPV

SEQ ID NO: 61732 - protein, 13 aa, Mycobacterium avium
CTEEADDAFQQAR

SEQ ID NO: 61733 - protein, 19 aa, Mycobacterium avium
CTGKPRPSTCPCPPKSLSR

SEQ ID NO: 61734 - protein, 16 aa, Mycobacterium avium
CTGSPGCARSAADVRA

SEQ ID NO: 61735 - protein, 16 aa, Mycobacterium avium
CTGSPGCARSTADVRA

SEQ ID NO: 61736 - protein, 10 aa, Mycobacterium avium
CTTRNKRRAA

SEQ ID NO: 61737 - protein, 11 aa, Mycobacterium avium
CTTRNKRRAAR

SEQ ID NO: 61738 - protein, 12 aa, Mycobacterium avium
CTTRNKRRAARL

SEQ ID NO: 61739 - protein, 4 aa, Mycobacterium avium
DAAA

SEQ ID NO: 61740 - protein, 14 aa, Mycobacterium avium
DAAAAADAAAQASA

SEQ ID NO: 61741 - protein, 68 aa, Mycobacterium avium
DAAAADASVPETPASETPVPEAPAAEAPVPEAPAPEAPAAEVPEAPAPEAPAAEVPEPLGEPTTRGRH

SEQ ID NO: 61742 - protein, 20 aa, Mycobacterium avium
DAAADEQRDEAGDVAGGRVQ

SEQ ID NO: 61743 - protein, 9 aa, Mycobacterium avium
DAAAGAERL

SEQ ID NO: 61744 - protein, 8 aa, Mycobacterium avium
DAAAIGSA

SEQ ID NO: 61745 - protein, 7 aa, Mycobacterium avium
DAAARAL

SEQ ID NO: 61746 - protein, 8 aa, Mycobacterium avium
DAAAREAA

SEQ ID NO: 61747 - protein, 12 aa, Mycobacterium avium
DAAASSSDAVPV

SEQ ID NO: 61748 - protein, 16 aa, Mycobacterium avium
DAAAVDDAVDRARAAQ

SEQ ID NO: 61749 - protein, 26 aa, Mycobacterium avium
DAAAVPDLTQPGKITRPTAQHATRQG

SEQ ID NO: 61750 - protein, 8 aa, Mycobacterium avium
DAAAVSRK

SEQ ID NO: 61751 - protein, 58 aa, Mycobacterium avium
DAADDAAAGGGAQAPSQPSQPQAPAQPEPQAQAQPEAPAQPQAPAQPAPQESGGGAAT

SEQ ID NO: 61752 - protein, 7 aa, Mycobacterium avium
DAADPHA

SEQ ID NO: 61753 - protein, 7 aa, Mycobacterium avium
DAADTDV

SEQ ID NO: 61754 - protein, 13 aa, Mycobacterium avium
DAADTGLPDASGD

SEQ ID NO: 61755 - protein, 16 aa, Mycobacterium avium
DAAEAGEADQTDRPIP

SEQ ID NO: 61756 - protein, 7 aa, Mycobacterium avium
DAAEDGQ

SEQ ID NO: 61757 - protein, 8 aa, Mycobacterium avium
DAAFQEST

SEQ ID NO: 61758 - protein, 4 aa, Mycobacterium avium
DAAG

SEQ ID NO: 61759 - protein, 10 aa, Mycobacterium avium
DAAGDSGEFY

SEQ ID NO: 61760 - protein, 11 aa, Mycobacterium avium
DAAGDSGEFYT

SEQ ID NO: 61761 - protein, 7 aa, Mycobacterium avium
DAAGEGL

SEQ ID NO: 61762 - protein, 8 aa, Mycobacterium avium
DAAGLPPG

SEQ ID NO: 61763 - protein, 10 aa, Mycobacterium avium
DAAGMPAGDL

SEQ ID NO: 61764 - protein, 7 aa, Mycobacterium avium
DAAGNPL

SEQ ID NO: 61765 - protein, 22 aa, Mycobacterium avium
DAAGRTAAQLSPAEKDAVSHRG

SEQ ID NO: 61766 - protein, 9 aa, Mycobacterium avium
DAANASRDA

SEQ ID NO: 61767 - protein, 6 aa, Mycobacterium avium
DAANRE

SEQ ID NO: 61768 - protein, 47 aa, Mycobacterium avium
DAAPTLPDAAPTLPAAVSEPAAAATLPAAAPTPAAVPPAAAAPAADW

SEQ ID NO: 61769 - protein, 41 aa, Mycobacterium avium
DAAPTLPDAAPTLPAAVSEPAAAATLPAAVPSPAAAPAADW

SEQ ID NO: 61770 - protein, 15 aa, Mycobacterium avium
DAAQQNPTPASAPAD

SEQ ID NO: 61771 - protein, 9 aa, Mycobacterium avium
DAARGRADT

SEQ ID NO: 61772 - protein, 8 aa, Mycobacterium avium
DAARPAHA

SEQ ID NO: 61773 - protein, 7 aa, Mycobacterium avium
DAASDAL

SEQ ID NO: 61774 - protein, 5 aa, Mycobacterium avium
DAASH

SEQ ID NO: 61775 - protein, 9 aa, Mycobacterium avium
DAASQRAAA

SEQ ID NO: 61776 - protein, 9 aa, Mycobacterium avium
DAASQRDAA

SEQ ID NO: 61777 - protein, 10 aa, Mycobacterium avium
DAASQRDAAK

SEQ ID NO: 61778 - protein, 6 aa, Mycobacterium avium
DAASVA

SEQ ID NO: 61779 - protein, 11 aa, Mycobacterium avium
DAATPSDVDGA

SEQ ID NO: 61780 - protein, 11 aa, Mycobacterium avium
DADAAEPTTAL

SEQ ID NO: 61781 - protein, 8 aa, Mycobacterium avium
DADDAEKH

SEQ ID NO: 61782 - protein, 9 aa, Mycobacterium avium
DADDPDQGW

SEQ ID NO: 61783 - protein, 9 aa, Mycobacterium avium
DADESTRSA

SEQ ID NO: 61784 - protein, 5 aa, Mycobacterium avium
DADET

SEQ ID NO: 61785 - protein, 6 aa, Mycobacterium avium
DADETI

SEQ ID NO: 61786 - protein, 10 aa, Mycobacterium avium
DADEYNAEEI

SEQ ID NO: 61787 - protein, 7 aa, Mycobacterium avium
DADGAQK

SEQ ID NO: 61788 - protein, 9 aa, Mycobacterium avium
DADGQPCPT

SEQ ID NO: 61789 - protein, 16 aa, Mycobacterium avium
DADGVASAVAEAADEF

SEQ ID NO: 61790 - protein, 5 aa, Mycobacterium avium
DADIT

SEQ ID NO: 61791 - protein, 4 aa, Mycobacterium avium
DADL

SEQ ID NO: 61792 - protein, 7 aa, Mycobacterium avium
DADPEVT

SEQ ID NO: 61793 - protein, 9 aa, Mycobacterium avium
DADPPDDRI

SEQ ID NO: 61794 - protein, 6 aa, Mycobacterium avium
DADPQV

SEQ ID NO: 61795 - protein, 8 aa, Mycobacterium avium
DADRLNDK

SEQ ID NO: 61796 - protein, 6 aa, Mycobacterium avium
DADRNG

SEQ ID NO: 61797 - protein, 11 aa, Mycobacterium avium
DADSPDAADAL

SEQ ID NO: 61798 - protein, 7 aa, Mycobacterium avium
DADTARA

SEQ ID NO: 61799 - protein, 9 aa, Mycobacterium avium
DADTGVFPS

SEQ ID NO: 61800 - protein, 6 aa, Mycobacterium avium
DADTYQ

SEQ ID NO: 61801 - protein, 5 aa, Mycobacterium avium
DAEAA

SEQ ID NO: 61802 - protein, 8 aa, Mycobacterium avium
DAEADELC

SEQ ID NO: 61803 - protein, 8 aa, Mycobacterium avium
DAEDDEYA

SEQ ID NO: 61804 - protein, 8 aa, Mycobacterium avium
DAEEPSAI

SEQ ID NO: 61805 - protein, 12 aa, Mycobacterium avium
DAEHARATNAHD

SEQ ID NO: 61806 - protein, 34 aa, Mycobacterium avium
DAEHTAGPPAQQTPEARPRPTRRRAAEDEPAQLE

SEQ ID NO: 61807 - protein, 6 aa, Mycobacterium avium
DAEKLS

SEQ ID NO: 61808 - protein, 4 aa, Mycobacterium avium
DAEL

SEQ ID NO: 61809 - protein, 6 aa, Mycobacterium avium
DAEPAN

SEQ ID NO: 61810 - protein, 10 aa, Mycobacterium avium
DAEPEKTVPG

SEQ ID NO: 61811 - protein, 5 aa, Mycobacterium avium
DAEPH

SEQ ID NO: 61812 - protein, 6 aa, Mycobacterium avium
DAEPRH

SEQ ID NO: 61813 - protein, 6 aa, Mycobacterium avium
DAEPRR

SEQ ID NO: 61814 - protein, 4 aa, Mycobacterium avium
DAEQ

SEQ ID NO: 61815 - protein, 5 aa, Mycobacterium avium
DAERA

SEQ ID NO: 61816 - protein, 7 aa, Mycobacterium avium
DAERAAA

SEQ ID NO: 61817 - protein, 11 aa, Mycobacterium avium
DAERAGAAEPN

SEQ ID NO: 61818 - protein, 10 aa, Mycobacterium avium
DAERDGDNDV

SEQ ID NO: 61819 - protein, 10 aa, Mycobacterium avium
DAEREGDNDV

SEQ ID NO: 61820 - protein, 4 aa, Mycobacterium avium
DAES

SEQ ID NO: 61821 - protein, 7 aa, Mycobacterium avium
DAESELR

SEQ ID NO: 61822 - protein, 16 aa, Mycobacterium avium
DAETDGARVTGTATGV

SEQ ID NO: 61823 - protein, 5 aa, Mycobacterium avium
DAETL

SEQ ID NO: 61824 - protein, 12 aa, Mycobacterium avium
DAETRAELAEAA

SEQ ID NO: 61825 - protein, 8 aa, Mycobacterium avium
DAFGGAPT

SEQ ID NO: 61826 - protein, 12 aa, Mycobacterium avium
DAGADHQAVDRR

SEQ ID NO: 61827 - protein, 8 aa, Mycobacterium avium
DAGAEDMD

SEQ ID NO: 61828 - protein, 10 aa, Mycobacterium avium
DAGAEGHGRD

SEQ ID NO: 61829 - protein, 10 aa, Mycobacterium avium
DAGAQSPKET

SEQ ID NO: 61830 - protein, 26 aa, Mycobacterium avium
DAGGGDEQLRQAREQTYAGTRRYVRR

SEQ ID NO: 61831 - protein, 8 aa, Mycobacterium avium
DAGGSVEW

SEQ ID NO: 61832 - protein, 12 aa, Mycobacterium avium
DAGGTVTNFQTG

SEQ ID NO: 61833 - protein, 10 aa, Mycobacterium avium
DAGHQDERAL

SEQ ID NO: 61834 - protein, 20 aa, Mycobacterium avium
DAGIDTSRRTGRPLAAPPVR

SEQ ID NO: 61835 - protein, 8 aa, Mycobacterium avium
DAGIPPEK

SEQ ID NO: 61836 - protein, 8 aa, Mycobacterium avium
DAGMDPNT

SEQ ID NO: 61837 - protein, 9 aa, Mycobacterium avium
DAGPALTRG

SEQ ID NO: 61838 - protein, 9 aa, Mycobacterium avium
DAGPAPEFT

SEQ ID NO: 61839 - protein, 8 aa, Mycobacterium avium
DAGPASGP

SEQ ID NO: 61840 - protein, 7 aa, Mycobacterium avium
DAGPDHA

SEQ ID NO: 61841 - protein, 7 aa, Mycobacterium avium
DAGPELE

SEQ ID NO: 61842 - protein, 10 aa, Mycobacterium avium
DAGPNGRNAM

SEQ ID NO: 61843 - protein, 9 aa, Mycobacterium avium
DAGPRPVGA

SEQ ID NO: 61844 - protein, 9 aa, Mycobacterium avium
DAGPSLTRG

SEQ ID NO: 61845 - protein, 12 aa, Mycobacterium avium
DAGPWSRGAPSH

SEQ ID NO: 61846 - protein, 5 aa, Mycobacterium avium
DAGQP

SEQ ID NO: 61847 - protein, 20 aa, Mycobacterium avium
DAGQRGQRRNGRTAGNRRDR

SEQ ID NO: 61848 - protein, 9 aa, Mycobacterium avium
DAGQSDRAA

SEQ ID NO: 61849 - protein, 5 aa, Mycobacterium avium
DAGRE

SEQ ID NO: 61850 - protein, 11 aa, Mycobacterium avium
DAGRSTGEAEA

SEQ ID NO: 61851 - protein, 10 aa, Mycobacterium avium
DAGSDDAAEA

SEQ ID NO: 61852 - protein, 9 aa, Mycobacterium avium
DAGSRPVGA

SEQ ID NO: 61853 - protein, 10 aa, Mycobacterium avium
DAGSRSRLTG

SEQ ID NO: 61854 - protein, 5 aa, Mycobacterium avium
DAGVG

SEQ ID NO: 61855 - protein, 8 aa, Mycobacterium avium
DAGVQTTV

SEQ ID NO: 61856 - protein, 10 aa, Mycobacterium avium
DAGWQGPAAS

SEQ ID NO: 61857 - protein, 29 aa, Mycobacterium avium
DAHDDASALTRSARPSAKPAAEASVPTPA

SEQ ID NO: 61858 - protein, 14 aa, Mycobacterium avium
DAHQRPDQCRGGAH

SEQ ID NO: 61859 - protein, 13 aa, Mycobacterium avium
DAHRNSTADLDGD

SEQ ID NO: 61860 - protein, 8 aa, Mycobacterium avium
DAIADEAR

SEQ ID NO: 61861 - protein, 11 aa, Mycobacterium avium
DAIATRKASGA

SEQ ID NO: 61862 - protein, 6 aa, Mycobacterium avium
DAIEGP

SEQ ID NO: 61863 - protein, 15 aa, Mycobacterium avium
DAIGGLREKAVIGGS

SEQ ID NO: 61864 - protein, 8 aa, Mycobacterium avium
DAIRDTKA

SEQ ID NO: 61865 - protein, 13 aa, Mycobacterium avium
DAKADAADDTRDA

SEQ ID NO: 61866 - protein, 10 aa, Mycobacterium avium
DAKAGRDAGE

SEQ ID NO: 61867 - protein, 7 aa, Mycobacterium avium
DAKEQLR

SEQ ID NO: 61868 - protein, 9 aa, Mycobacterium avium
DAKTAAAHD

SEQ ID NO: 61869 - protein, 15 aa, Mycobacterium avium
DAKTDRAAMTGGTPF

SEQ ID NO: 61870 - protein, 8 aa, Mycobacterium avium
DALAPELG

SEQ ID NO: 61871 - protein, 9 aa, Mycobacterium avium
DALDQPDTL

SEQ ID NO: 61872 - protein, 12 aa, Mycobacterium avium
DALGTALADVVA

SEQ ID NO: 61873 - protein, 15 aa, Mycobacterium avium
DALPPTMTYGSRSDY

SEQ ID NO: 61874 - protein, 4 aa, Mycobacterium avium
DALR

SEQ ID NO: 61875 - protein, 10 aa, Mycobacterium avium
DALRDAATAS

SEQ ID NO: 61876 - protein, 9 aa, Mycobacterium avium
DALRDTKAA

SEQ ID NO: 61877 - protein, 11 aa, Mycobacterium avium
DALTDDEKQRF

SEQ ID NO: 61878 - protein, 9 aa, Mycobacterium avium
DALTEEAER

SEQ ID NO: 61879 - protein, 11 aa, Mycobacterium avium
DAMADGAPPVV

SEQ ID NO: 61880 - protein, 16 aa, Mycobacterium avium
DAMAPTTGWAGDEDEL

SEQ ID NO: 61881 - protein, 7 aa, Mycobacterium avium
DAMPVTD

SEQ ID NO: 61882 - protein, 12 aa, Mycobacterium avium
DAMTSDAPPLAP

SEQ ID NO: 61883 - protein, 8 aa, Mycobacterium avium
DANAANAR

SEQ ID NO: 61884 - protein, 5 aa, Mycobacterium avium
DANGN

SEQ ID NO: 61885 - protein, 4 aa, Mycobacterium avium
DANP

SEQ ID NO: 61886 - protein, 9 aa, Mycobacterium avium
DANPQTHAD

SEQ ID NO: 61887 - protein, 10 aa, Mycobacterium avium
DANPQTHSDL

SEQ ID NO: 61888 - protein, 10 aa, Mycobacterium avium
DAPADIGNKE

SEQ ID NO: 61889 - protein, 22 aa, Mycobacterium avium
DAPAQAGTESAVSGVEGLPAGS

SEQ ID NO: 61890 - protein, 10 aa, Mycobacterium avium
DAPEAARPQH

SEQ ID NO: 61891 - protein, 5 aa, Mycobacterium avium
DAPES

SEQ ID NO: 61892 - protein, 6 aa, Mycobacterium avium
DAPGAR

SEQ ID NO: 61893 - protein, 8 aa, Mycobacterium avium
DAPGHRGA

SEQ ID NO: 61894 - protein, 6 aa, Mycobacterium avium
DAPHGR

SEQ ID NO: 61895 - protein, 7 aa, Mycobacterium avium
DAPHSQA

SEQ ID NO: 61896 - protein, 5 aa, Mycobacterium avium
DAPIG

SEQ ID NO: 61897 - protein, 6 aa, Mycobacterium avium
DAPKAT

SEQ ID NO: 61898 - protein, 9 aa, Mycobacterium avium
DAPQEATPP

SEQ ID NO: 61899 - protein, 15 aa, Mycobacterium avium
DAPRCSSATPRWGTP

SEQ ID NO: 61900 - protein, 12 aa, Mycobacterium avium
DAPRKLATGGRA

SEQ ID NO: 61901 - protein, 14 aa, Mycobacterium avium
DAPSTLIGPPGRAT

SEQ ID NO: 61902 - protein, 7 aa, Mycobacterium avium
DAPVTDA

SEQ ID NO: 61903 - protein, 6 aa, Mycobacterium avium
DAPVTF

SEQ ID NO: 61904 - protein, 8 aa, Mycobacterium avium
DAPVTTRD

SEQ ID NO: 61905 - protein, 8 aa, Mycobacterium avium
DAQAGSFD

SEQ ID NO: 61906 - protein, 6 aa, Mycobacterium avium
DAQDAV

SEQ ID NO: 61907 - protein, 10 aa, Mycobacterium avium
DAQGNSAGLN

SEQ ID NO: 61908 - protein, 6 aa, Mycobacterium avium
DAQMAA

SEQ ID NO: 61909 - protein, 8 aa, Mycobacterium avium
DAQNAGFT

SEQ ID NO: 61910 - protein, 19 aa, Mycobacterium avium
DAQPPKPADFSLRIGSLKG

SEQ ID NO: 61911 - protein, 15 aa, Mycobacterium avium
DAQPSTAPPGPAPDD

SEQ ID NO: 61912 - protein, 5 aa, Mycobacterium avium
DAQRQ

SEQ ID NO: 61913 - protein, 10 aa, Mycobacterium avium
DAQRRQRHAV

SEQ ID NO: 61914 - protein, 9 aa, Mycobacterium avium
DAQTGAPLS

SEQ ID NO: 61915 - protein, 8 aa, Mycobacterium avium
DARAGTNS

SEQ ID NO: 61916 - protein, 9 aa, Mycobacterium avium
DARDPEGAG

SEQ ID NO: 61917 - protein, 8 aa, Mycobacterium avium
DAREWGET

SEQ ID NO: 61918 - protein, 4 aa, Mycobacterium avium
DARP

SEQ ID NO: 61919 - protein, 8 aa, Mycobacterium avium
DARPDGEA

SEQ ID NO: 61920 - protein, 5 aa, Mycobacterium avium
DARPP

SEQ ID NO: 61921 - protein, 14 aa, Mycobacterium avium
DARQGRSDDPHDPL

SEQ ID NO: 61922 - protein, 6 aa, Mycobacterium avium
DARQPI

SEQ ID NO: 61923 - protein, 8 aa, Mycobacterium avium
DARQQIQD

SEQ ID NO: 61924 - protein, 6 aa, Mycobacterium avium
DARRRT

SEQ ID NO: 61925 - protein, 4 aa, Mycobacterium avium
DARS

SEQ ID NO: 61926 - protein, 9 aa, Mycobacterium avium
DASAAVPDD

SEQ ID NO: 61927 - protein, 8 aa, Mycobacterium avium
DASADEDT

SEQ ID NO: 61928 - protein, 9 aa, Mycobacterium avium
DASADKSRA

SEQ ID NO: 61929 - protein, 6 aa, Mycobacterium avium
DASGAT

SEQ ID NO: 61930 - protein, 5 aa, Mycobacterium avium
DASGI

SEQ ID NO: 61931 - protein, 13 aa, Mycobacterium avium
DASGQESAIAAEQ

SEQ ID NO: 61932 - protein, 7 aa, Mycobacterium avium
DASGQNY

SEQ ID NO: 61933 - protein, 8 aa, Mycobacterium avium
DASKPNGQ

SEQ ID NO: 61934 - protein, 5 aa, Mycobacterium avium
DASSL

SEQ ID NO: 61935 - protein, 9 aa, Mycobacterium avium
DASTDATPR

SEQ ID NO: 61936 - protein, 8 aa, Mycobacterium avium
DATAPPTL

SEQ ID NO: 61937 - protein, 6 aa, Mycobacterium avium
DATDGG

SEQ ID NO: 61938 - protein, 8 aa, Mycobacterium avium
DATDGHAA

SEQ ID NO: 61939 - protein, 14 aa, Mycobacterium avium
DATEPSRREVEQRA

SEQ ID NO: 61940 - protein, 10 aa, Mycobacterium avium
DATESQREIR

SEQ ID NO: 61941 - protein, 8 aa, Mycobacterium avium
DATGATVS

SEQ ID NO: 61942 - protein, 7 aa, Mycobacterium avium
DATGERI

SEQ ID NO: 61943 - protein, 13 aa, Mycobacterium avium
DATKTQSGSTLSS

SEQ ID NO: 61944 - protein, 9 aa, Mycobacterium avium
DATNGADPL

SEQ ID NO: 61945 - protein, 8 aa, Mycobacterium avium
DATPHAAR

SEQ ID NO: 61946 - protein, 14 aa, Mycobacterium avium
DATPLAEVAPGDRH

SEQ ID NO: 61947 - protein, 4 aa, Mycobacterium avium
DATR

SEQ ID NO: 61948 - protein, 14 aa, Mycobacterium avium
DATRDKNVEDRADA

SEQ ID NO: 61949 - protein, 7 aa, Mycobacterium avium
DATRYGN

SEQ ID NO: 61950 - protein, 7 aa, Mycobacterium avium
DATTPYS

SEQ ID NO: 61951 - protein, 10 aa, Mycobacterium avium
DATVTAEGIR

SEQ ID NO: 61952 - protein, 5 aa, Mycobacterium avium
DAVAG

SEQ ID NO: 61953 - protein, 9 aa, Mycobacterium avium
DAVDGRPRG

SEQ ID NO: 61954 - protein, 8 aa, Mycobacterium avium
DAVGGTGF

SEQ ID NO: 61955 - protein, 21 aa, Mycobacterium avium
DAVGPSADDQLAQPDSAETQD

SEQ ID NO: 61956 - protein, 21 aa, Mycobacterium avium
DAVGPSADDQPAQPDSAETQD

SEQ ID NO: 61957 - protein, 15 aa, Mycobacterium avium
DAVRRNAQRTPERPA

SEQ ID NO: 61958 - protein, 20 aa, Mycobacterium avium
DAWATPGPGGSSPRRNMVST

SEQ ID NO: 61959 - protein, 20 aa, Mycobacterium avium
DAWATPGSGGSSPRRNMMST

SEQ ID NO: 61960 - protein, 10 aa, Mycobacterium avium
DAWDTEAETI

SEQ ID NO: 61961 - protein, 7 aa, Mycobacterium avium
DAYADED

SEQ ID NO: 61962 - protein, 9 aa, Mycobacterium avium
DAYDPPADD

SEQ ID NO: 61963 - protein, 6 aa, Mycobacterium avium
DAYETD

SEQ ID NO: 61964 - protein, 7 aa, Mycobacterium avium
DAYSRIA

SEQ ID NO: 61965 - protein, 9 aa, Mycobacterium avium
DCGSGFGTG

SEQ ID NO: 61966 - protein, 9 aa, Mycobacterium avium
DCGSSESTW

SEQ ID NO: 61967 - protein, 8 aa, Mycobacterium avium
DDAADLSD

SEQ ID NO: 61968 - protein, 10 aa, Mycobacterium avium
DDAAGEATAY

SEQ ID NO: 61969 - protein, 7 aa, Mycobacterium avium
DDAAKPQ

SEQ ID NO: 61970 - protein, 7 aa, Mycobacterium avium
DDAATEA

SEQ ID NO: 61971 - protein, 30 aa, Mycobacterium avium
DDADDDNSAASPSQAEAASNRGPEPAPPAI

SEQ ID NO: 61972 - protein, 8 aa, Mycobacterium avium
DDAGLGRR

SEQ ID NO: 61973 - protein, 10 aa, Mycobacterium avium
DDAGLTSSDV

SEQ ID NO: 61974 - protein, 9 aa, Mycobacterium avium
DDAGPLPED

SEQ ID NO: 61975 - protein, 15 aa, Mycobacterium avium
DDAHERAQRQRYERR

SEQ ID NO: 61976 - protein, 7 aa, Mycobacterium avium
DDAPAKA

SEQ ID NO: 61977 - protein, 10 aa, Mycobacterium avium
DDAQGNSGTF

SEQ ID NO: 61978 - protein, 4 aa, Mycobacterium avium
DDAR

SEQ ID NO: 61979 - protein, 8 aa, Mycobacterium avium
DDARGDAL

SEQ ID NO: 61980 - protein, 18 aa, Mycobacterium avium
DDATPAETVEQARARHDG

SEQ ID NO: 61981 - protein, 4 aa, Mycobacterium avium
DDAV

SEQ ID NO: 61982 - protein, 8 aa, Mycobacterium avium
DDDAAATV

SEQ ID NO: 61983 - protein, 4 aa, Mycobacterium avium
DDDD

SEQ ID NO: 61984 - protein, 8 aa, Mycobacterium avium
DDDDAVTI

SEQ ID NO: 61985 - protein, 9 aa, Mycobacterium avium
DDDDGSEDY

SEQ ID NO: 61986 - protein, 7 aa, Mycobacterium avium
DDDDTVE

SEQ ID NO: 61987 - protein, 14 aa, Mycobacterium avium
DDDDWDDEDFDADH

SEQ ID NO: 61988 - protein, 9 aa, Mycobacterium avium
DDDFGGSPR

SEQ ID NO: 61989 - protein, 9 aa, Mycobacterium avium
DDDGAYQGK

SEQ ID NO: 61990 - protein, 6 aa, Mycobacterium avium
DDDGDP

SEQ ID NO: 61991 - protein, 9 aa, Mycobacterium avium
DDDGNVVPT

SEQ ID NO: 61992 - protein, 36 aa, Mycobacterium avium
DDDLDTEDSDDSDDSDDSEDSDDSEDQRDPAAECPG

SEQ ID NO: 61993 - protein, 39 aa, Mycobacterium avium
DDDLDTEDSDDSDDSDDSEDSDDSEDQRDPAAERPGVSA

SEQ ID NO: 61994 - protein, 36 aa, Mycobacterium avium
DDDLDTEDSDDSDDSEDSDDSEDQRDPAAERPGVSA

SEQ ID NO: 61995 - protein, 4 aa, Mycobacterium avium
DDDP

SEQ ID NO: 61996 - protein, 10 aa, Mycobacterium avium
DDDPAGAVGK

SEQ ID NO: 61997 - protein, 10 aa, Mycobacterium avium
DDDPAGTVGK

SEQ ID NO: 61998 - protein, 6 aa, Mycobacterium avium
DDDPHI

SEQ ID NO: 61999 - protein, 5 aa, Mycobacterium avium
DDDPL

SEQ ID NO: 62000 - protein, 10 aa, Mycobacterium avium
DDDPLDTPAR

SEQ ID NO: 62001 - protein, 10 aa, Mycobacterium avium
DDDPRRGTTQ

SEQ ID NO: 62002 - protein, 10 aa, Mycobacterium avium
DDDPRRVSDR

SEQ ID NO: 62003 - protein, 14 aa, Mycobacterium avium
DDDPVQRKGNLPRL

SEQ ID NO: 62004 - protein, 9 aa, Mycobacterium avium
DDDRDAGTL

SEQ ID NO: 62005 - protein, 5 aa, Mycobacterium avium
DDDRR

SEQ ID NO: 62006 - protein, 6 aa, Mycobacterium avium
DDDTVE

SEQ ID NO: 62007 - protein, 13 aa, Mycobacterium avium
DDDVPESDPNAEL

SEQ ID NO: 62008 - protein, 5 aa, Mycobacterium avium
DDEDI

SEQ ID NO: 62009 - protein, 6 aa, Mycobacterium avium
DDEDLR

SEQ ID NO: 62010 - protein, 6 aa, Mycobacterium avium
DDEGLG

SEQ ID NO: 62011 - protein, 7 aa, Mycobacterium avium
DDEGRDA

SEQ ID NO: 62012 - protein, 7 aa, Mycobacterium avium
DDEGTIL

SEQ ID NO: 62013 - protein, 9 aa, Mycobacterium avium
DDEHRDPEA

SEQ ID NO: 62014 - protein, 12 aa, Mycobacterium avium
DDELDDHRSAAQ

SEQ ID NO: 62015 - protein, 4 aa, Mycobacterium avium
DDEQ

SEQ ID NO: 62016 - protein, 10 aa, Mycobacterium avium
DDERITPRTR

SEQ ID NO: 62017 - protein, 7 aa, Mycobacterium avium
DDETTMR

SEQ ID NO: 62018 - protein, 9 aa, Mycobacterium avium
DDEYPHLGG

SEQ ID NO: 62019 - protein, 6 aa, Mycobacterium avium
DDFESA

SEQ ID NO: 62020 - protein, 14 aa, Mycobacterium avium
DDFPRDSRDTAYED

SEQ ID NO: 62021 - protein, 8 aa, Mycobacterium avium
DDGAGGWS

SEQ ID NO: 62022 - protein, 7 aa, Mycobacterium avium
DDGALSD

SEQ ID NO: 62023 - protein, 6 aa, Mycobacterium avium
DDGATE

SEQ ID NO: 62024 - protein, 8 aa, Mycobacterium avium
DDGAYQGK

SEQ ID NO: 62025 - protein, 7 aa, Mycobacterium avium
DDGDAAM

SEQ ID NO: 62026 - protein, 4 aa, Mycobacterium avium
DDGG

SEQ ID NO: 62027 - protein, 6 aa, Mycobacterium avium
DDGGAA

SEQ ID NO: 62028 - protein, 6 aa, Mycobacterium avium
DDGHGT

SEQ ID NO: 62029 - protein, 5 aa, Mycobacterium avium
DDGRA

SEQ ID NO: 62030 - protein, 11 aa, Mycobacterium avium
DDGRDVLPGEA

SEQ ID NO: 62031 - protein, 13 aa, Mycobacterium avium
DDGRQAWADDEVS

SEQ ID NO: 62032 - protein, 19 aa, Mycobacterium avium
DDGRTGTTRPPRPVRSADD

SEQ ID NO: 62033 - protein, 15 aa, Mycobacterium avium
DDGRTPQSQLAARTG

SEQ ID NO: 62034 - protein, 8 aa, Mycobacterium avium
DDGSGLAE

SEQ ID NO: 62035 - protein, 8 aa, Mycobacterium avium
DDGTLDED

SEQ ID NO: 62036 - protein, 24 aa, Mycobacterium avium
DDGTVKTRGALKDPARKTDADGNT

SEQ ID NO: 62037 - protein, 4 aa, Mycobacterium avium
DDGV

SEQ ID NO: 62038 - protein, 4 aa, Mycobacterium avium
DDGY

SEQ ID NO: 62039 - protein, 6 aa, Mycobacterium avium
DDGYDG

SEQ ID NO: 62040 - protein, 5 aa, Mycobacterium avium
DDHGV

SEQ ID NO: 62041 - protein, 6 aa, Mycobacterium avium
DDHPAH

SEQ ID NO: 62042 - protein, 7 aa, Mycobacterium avium
DDHTGNM

SEQ ID NO: 62043 - protein, 4 aa, Mycobacterium avium
DDIT

SEQ ID NO: 62044 - protein, 8 aa, Mycobacterium avium
DDLDDLEP

SEQ ID NO: 62045 - protein, 14 aa, Mycobacterium avium
DDLEDGDDDSPAVE

SEQ ID NO: 62046 - protein, 7 aa, Mycobacterium avium
DDLPEDA

SEQ ID NO: 62047 - protein, 11 aa, Mycobacterium avium
DDLPPEVGPLG

SEQ ID NO: 62048 - protein, 7 aa, Mycobacterium avium
DDLSAEL

SEQ ID NO: 62049 - protein, 6 aa, Mycobacterium avium
DDNERR

SEQ ID NO: 62050 - protein, 10 aa, Mycobacterium avium
DDNPLDTPAR

SEQ ID NO: 62051 - protein, 6 aa, Mycobacterium avium
DDNSDT

SEQ ID NO: 62052 - protein, 7 aa, Mycobacterium avium
DDPAFRQ

SEQ ID NO: 62053 - protein, 35 aa, Mycobacterium avium
DDPALGASENRPEPETSQVNDAPPADEPPTDPAAD

SEQ ID NO: 62054 - protein, 18 aa, Mycobacterium avium
DDPALPEPLPDGPVRRAP

SEQ ID NO: 62055 - protein, 9 aa, Mycobacterium avium
DDPAPDAWQ

SEQ ID NO: 62056 - protein, 9 aa, Mycobacterium avium
DDPAYRGPG

SEQ ID NO: 62057 - protein, 6 aa, Mycobacterium avium
DDPDAD

SEQ ID NO: 62058 - protein, 7 aa, Mycobacterium avium
DDPDDTY

SEQ ID NO: 62059 - protein, 8 aa, Mycobacterium avium
DDPDNSAN

SEQ ID NO: 62060 - protein, 6 aa, Mycobacterium avium
DDPDRV

SEQ ID NO: 62061 - protein, 4 aa, Mycobacterium avium
DDPE

SEQ ID NO: 62062 - protein, 6 aa, Mycobacterium avium
DDPESP

SEQ ID NO: 62063 - protein, 7 aa, Mycobacterium avium
DDPETAV

SEQ ID NO: 62064 - protein, 8 aa, Mycobacterium avium
DDPGAGKT

SEQ ID NO: 62065 - protein, 10 aa, Mycobacterium avium
DDPGGINPEY

SEQ ID NO: 62066 - protein, 6 aa, Mycobacterium avium
DDPGRQ

SEQ ID NO: 62067 - protein, 8 aa, Mycobacterium avium
DDPHKKAV

SEQ ID NO: 62068 - protein, 19 aa, Mycobacterium avium
DDPPEITEHTQGRPLSTAD

SEQ ID NO: 62069 - protein, 7 aa, Mycobacterium avium
DDPQEGL

SEQ ID NO: 62070 - protein, 5 aa, Mycobacterium avium
DDPSI

SEQ ID NO: 62071 - protein, 7 aa, Mycobacterium avium
DDPSQRA

SEQ ID NO: 62072 - protein, 6 aa, Mycobacterium avium
DDPTEM

SEQ ID NO: 62073 - protein, 7 aa, Mycobacterium avium
DDPVPGS

SEQ ID NO: 62074 - protein, 8 aa, Mycobacterium avium
DDPWPPQL

SEQ ID NO: 62075 - protein, 10 aa, Mycobacterium avium
DDPYRAAKAA

SEQ ID NO: 62076 - protein, 11 aa, Mycobacterium avium
DDQANRASGGL

SEQ ID NO: 62077 - protein, 7 aa, Mycobacterium avium
DDQGRRF

SEQ ID NO: 62078 - protein, 7 aa, Mycobacterium avium
DDQHGDR

SEQ ID NO: 62079 - protein, 4 aa, Mycobacterium avium
DDQL

SEQ ID NO: 62080 - protein, 10 aa, Mycobacterium avium
DDQMPSAEEL

SEQ ID NO: 62081 - protein, 11 aa, Mycobacterium avium
DDQMPSAEELA

SEQ ID NO: 62082 - protein, 9 aa, Mycobacterium avium
DDRAEQRRR

SEQ ID NO: 62083 - protein, 5 aa, Mycobacterium avium
DDRAH

SEQ ID NO: 62084 - protein, 5 aa, Mycobacterium avium
DDRAR

SEQ ID NO: 62085 - protein, 7 aa, Mycobacterium avium
DDREAAA

SEQ ID NO: 62086 - protein, 5 aa, Mycobacterium avium
DDRGD

SEQ ID NO: 62087 - protein, 8 aa, Mycobacterium avium
DDRGNSAR

SEQ ID NO: 62088 - protein, 5 aa, Mycobacterium avium
DDRPH

SEQ ID NO: 62089 - protein, 10 aa, Mycobacterium avium
DDRPRTANRT

SEQ ID NO: 62090 - protein, 20 aa, Mycobacterium avium
DDRPVTERAEAKQISSESTF

SEQ ID NO: 62091 - protein, 4 aa, Mycobacterium avium
DDRR

SEQ ID NO: 62092 - protein, 7 aa, Mycobacterium avium
DDRSGTG

SEQ ID NO: 62093 - protein, 7 aa, Mycobacterium avium
DDRSTRL

SEQ ID NO: 62094 - protein, 17 aa, Mycobacterium avium
DDRTDLSAAQRGFAQPA

SEQ ID NO: 62095 - protein, 8 aa, Mycobacterium avium
DDRTRFAD

SEQ ID NO: 62096 - protein, 4 aa, Mycobacterium avium
DDSD

SEQ ID NO: 62097 - protein, 7 aa, Mycobacterium avium
DDSDRRA

SEQ ID NO: 62098 - protein, 8 aa, Mycobacterium avium
DDSGYVDP

SEQ ID NO: 62099 - protein, 7 aa, Mycobacterium avium
DDSGYVN

SEQ ID NO: 62100 - protein, 7 aa, Mycobacterium avium
DDSSYVN

SEQ ID NO: 62101 - protein, 4 aa, Mycobacterium avium
DDTD

SEQ ID NO: 62102 - protein, 8 aa, Mycobacterium avium
DDTDPDSP

SEQ ID NO: 62103 - protein, 4 aa, Mycobacterium avium
DDTE

SEQ ID NO: 62104 - protein, 9 aa, Mycobacterium avium
DDTGADDVA

SEQ ID NO: 62105 - protein, 6 aa, Mycobacterium avium
DDTGEV

SEQ ID NO: 62106 - protein, 7 aa, Mycobacterium avium
DDTPDLT

SEQ ID NO: 62107 - protein, 30 aa, Mycobacterium avium
DDTPPAAAAADSPAAGGAGPAKPAKTAPVE

SEQ ID NO: 62108 - protein, 7 aa, Mycobacterium avium
DDTQARE

SEQ ID NO: 62109 - protein, 13 aa, Mycobacterium avium
DDVAGEADPIGRN

SEQ ID NO: 62110 - protein, 17 aa, Mycobacterium avium
DDVDPRAGRLRPPHPDD

SEQ ID NO: 62111 - protein, 9 aa, Mycobacterium avium
DDVGGPRRR

SEQ ID NO: 62112 - protein, 6 aa, Mycobacterium avium
DDVPHE

SEQ ID NO: 62113 - protein, 5 aa, Mycobacterium avium
DDVQR

SEQ ID NO: 62114 - protein, 6 aa, Mycobacterium avium
DDVQRA

SEQ ID NO: 62115 - protein, 4 aa, Mycobacterium avium
DDVS

SEQ ID NO: 62116 - protein, 10 aa, Mycobacterium avium
DDVSGARTRL

SEQ ID NO: 62117 - protein, 6 aa, Mycobacterium avium
DDWTQE

SEQ ID NO: 62118 - protein, 7 aa, Mycobacterium avium
DDYDDQP

SEQ ID NO: 62119 - protein, 8 aa, Mycobacterium avium
DDYRGERH

SEQ ID NO: 62120 - protein, 9 aa, Mycobacterium avium
DDYRSGKGT

SEQ ID NO: 62121 - protein, 4 aa, Mycobacterium avium
DEAA

SEQ ID NO: 62122 - protein, 11 aa, Mycobacterium avium
DEAAAARTEEF

SEQ ID NO: 62123 - protein, 10 aa, Mycobacterium avium
DEAEDLADKG

SEQ ID NO: 62124 - protein, 17 aa, Mycobacterium avium
DEAEQPADARVTSPIRM

SEQ ID NO: 62125 - protein, 4 aa, Mycobacterium avium
DEAG

SEQ ID NO: 62126 - protein, 5 aa, Mycobacterium avium
DEAGG

SEQ ID NO: 62127 - protein, 6 aa, Mycobacterium avium
DEANKP

SEQ ID NO: 62128 - protein, 4 aa, Mycobacterium avium
DEAP

SEQ ID NO: 62129 - protein, 5 aa, Mycobacterium avium
DEAPA

SEQ ID NO: 62130 - protein, 7 aa, Mycobacterium avium
DEARARR

SEQ ID NO: 62131 - protein, 4 aa, Mycobacterium avium
DEAS

SEQ ID NO: 62132 - protein, 6 aa, Mycobacterium avium
DEATQQ

SEQ ID NO: 62133 - protein, 34 aa, Mycobacterium avium
DEAWEAPGPPALPEAQRAVREAANGRTAEPSGEA

SEQ ID NO: 62134 - protein, 17 aa, Mycobacterium avium
DEDALTEARGASYDARA

SEQ ID NO: 62135 - protein, 14 aa, Mycobacterium avium
DEDEAVAAANGTEF

SEQ ID NO: 62136 - protein, 8 aa, Mycobacterium avium
DEDEDEIK

SEQ ID NO: 62137 - protein, 8 aa, Mycobacterium avium
DEDIERAK

SEQ ID NO: 62138 - protein, 56 aa, Mycobacterium avium
DEDLPEDQGQQHDSPADGSAEQADDENASADEPPAGPTSVTLPDGETVTAASPQLA

SEQ ID NO: 62139 - protein, 56 aa, Mycobacterium avium
DEDLPEDQGQQHDSPADGSTEQADDENASADEPPAGPTSVTLPDGETVTAASPQLA

SEQ ID NO: 62140 - protein, 6 aa, Mycobacterium avium
DEDPDT

SEQ ID NO: 62141 - protein, 12 aa, Mycobacterium avium
DEDRQNPGDAGT

SEQ ID NO: 62142 - protein, 8 aa, Mycobacterium avium
DEDSASEV

SEQ ID NO: 62143 - protein, 8 aa, Mycobacterium avium
DEDTGKVI

SEQ ID NO: 62144 - protein, 15 aa, Mycobacterium avium
DEDTPVGAEIPEPDP

SEQ ID NO: 62145 - protein, 4 aa, Mycobacterium avium
DEDV

SEQ ID NO: 62146 - protein, 11 aa, Mycobacterium avium
DEDYTGRPFRE

SEQ ID NO: 62147 - protein, 7 aa, Mycobacterium avium
DEEATRL

SEQ ID NO: 62148 - protein, 4 aa, Mycobacterium avium
DEEG

SEQ ID NO: 62149 - protein, 15 aa, Mycobacterium avium
DEELAGHPGRTPRTE

SEQ ID NO: 62150 - protein, 4 aa, Mycobacterium avium
DEER

SEQ ID NO: 62151 - protein, 6 aa, Mycobacterium avium
DEESNR

SEQ ID NO: 62152 - protein, 6 aa, Mycobacterium avium
DEFDAD

SEQ ID NO: 62153 - protein, 7 aa, Mycobacterium avium
DEFGGAP

SEQ ID NO: 62154 - protein, 13 aa, Mycobacterium avium
DEGADGGAGDGQP

SEQ ID NO: 62155 - protein, 16 aa, Mycobacterium avium
DEGARTKSVVVLRPAT

SEQ ID NO: 62156 - protein, 15 aa, Mycobacterium avium
DEGDDLGSLTKGPLT

SEQ ID NO: 62157 - protein, 12 aa, Mycobacterium avium
DEGDPSVDKRNR

SEQ ID NO: 62158 - protein, 6 aa, Mycobacterium avium
DEGEGT

SEQ ID NO: 62159 - protein, 7 aa, Mycobacterium avium
DEGRTAL

SEQ ID NO: 62160 - protein, 12 aa, Mycobacterium avium
DEGVRPDCTPES

SEQ ID NO: 62161 - protein, 6 aa, Mycobacterium avium
DEHAER

SEQ ID NO: 62162 - protein, 7 aa, Mycobacterium avium
DEHASGW

SEQ ID NO: 62163 - protein, 7 aa, Mycobacterium avium
DEHDATA

SEQ ID NO: 62164 - protein, 5 aa, Mycobacterium avium
DEHNS

SEQ ID NO: 62165 - protein, 5 aa, Mycobacterium avium
DEIDG

SEQ ID NO: 62166 - protein, 5 aa, Mycobacterium avium
DEIER

SEQ ID NO: 62167 - protein, 5 aa, Mycobacterium avium
DEIGE

SEQ ID NO: 62168 - protein, 14 aa, Mycobacterium avium
DELAAERGQERDVE

SEQ ID NO: 62169 - protein, 5 aa, Mycobacterium avium
DELEQ

SEQ ID NO: 62170 - protein, 8 aa, Mycobacterium avium
DELESDRA

SEQ ID NO: 62171 - protein, 7 aa, Mycobacterium avium
DELGDLD

SEQ ID NO: 62172 - protein, 5 aa, Mycobacterium avium
DELPP

SEQ ID NO: 62173 - protein, 12 aa, Mycobacterium avium
DELRGSLSGDQA

SEQ ID NO: 62174 - protein, 18 aa, Mycobacterium avium
DELSAGRARRCAAGSGTA

SEQ ID NO: 62175 - protein, 4 aa, Mycobacterium avium
DELT

SEQ ID NO: 62176 - protein, 8 aa, Mycobacterium avium
DELTDDTV

SEQ ID NO: 62177 - protein, 8 aa, Mycobacterium avium
DELTGGEH

SEQ ID NO: 62178 - protein, 6 aa, Mycobacterium avium
DEMGQA

SEQ ID NO: 62179 - protein, 5 aa, Mycobacterium avium
DENQH

SEQ ID NO: 62180 - protein, 14 aa, Mycobacterium avium
DEPATTASPRGAGN

SEQ ID NO: 62181 - protein, 7 aa, Mycobacterium avium
DEPDHDM

SEQ ID NO: 62182 - protein, 14 aa, Mycobacterium avium
DEPDMTRHGPTPVD

SEQ ID NO: 62183 - protein, 8 aa, Mycobacterium avium
DEPDPAGI

SEQ ID NO: 62184 - protein, 9 aa, Mycobacterium avium
DEPEHPTGP

SEQ ID NO: 62185 - protein, 7 aa, Mycobacterium avium
DEPGWDR

SEQ ID NO: 62186 - protein, 6 aa, Mycobacterium avium
DEPMPL

SEQ ID NO: 62187 - protein, 8 aa, Mycobacterium avium
DEPPPMGE

SEQ ID NO: 62188 - protein, 7 aa, Mycobacterium avium
DEPPTMS

SEQ ID NO: 62189 - protein, 6 aa, Mycobacterium avium
DEPPVA

SEQ ID NO: 62190 - protein, 25 aa, Mycobacterium avium
DEPPVPPQQIQSRKGVGADGPASRT

SEQ ID NO: 62191 - protein, 24 aa, Mycobacterium avium
DEPPVPPQQIQSRKGVGADGPASW

SEQ ID NO: 62192 - protein, 6 aa, Mycobacterium avium
DEPQVA

SEQ ID NO: 62193 - protein, 9 aa, Mycobacterium avium
DEPSERGID

SEQ ID NO: 62194 - protein, 14 aa, Mycobacterium avium
DEPSRDDELATDQV

SEQ ID NO: 62195 - protein, 13 aa, Mycobacterium avium
DEQANRAAAGLAD

SEQ ID NO: 62196 - protein, 19 aa, Mycobacterium avium
DEQANRAAAGLADAGIAPG

SEQ ID NO: 62197 - protein, 4 aa, Mycobacterium avium
DEQD

SEQ ID NO: 62198 - protein, 7 aa, Mycobacterium avium
DEQGREH

SEQ ID NO: 62199 - protein, 6 aa, Mycobacterium avium
DEQGRR

SEQ ID NO: 62200 - protein, 8 aa, Mycobacterium avium
DEQPDGTT

SEQ ID NO: 62201 - protein, 20 aa, Mycobacterium avium
DEREPAHPERLPGGLAGHAS

SEQ ID NO: 62202 - protein, 7 aa, Mycobacterium avium
DERGRYI

SEQ ID NO: 62203 - protein, 9 aa, Mycobacterium avium
DERIAPADG

SEQ ID NO: 62204 - protein, 6 aa, Mycobacterium avium
DERLGP

SEQ ID NO: 62205 - protein, 4 aa, Mycobacterium avium
DERP

SEQ ID NO: 62206 - protein, 29 aa, Mycobacterium avium
DERPAASPANGGSWSKSRDFTDDPQRAAA

SEQ ID NO: 62207 - protein, 9 aa, Mycobacterium avium
DERRATAVE

SEQ ID NO: 62208 - protein, 6 aa, Mycobacterium avium
DERSLT

SEQ ID NO: 62209 - protein, 5 aa, Mycobacterium avium
DERTA

SEQ ID NO: 62210 - protein, 9 aa, Mycobacterium avium
DERTDTAGF

SEQ ID NO: 62211 - protein, 14 aa, Mycobacterium avium
DERTEQARRVGSAN

SEQ ID NO: 62212 - protein, 10 aa, Mycobacterium avium
DERTESGVPQ

SEQ ID NO: 62213 - protein, 9 aa, Mycobacterium avium
DERTESGVR

SEQ ID NO: 62214 - protein, 8 aa, Mycobacterium avium
DESADDAS

SEQ ID NO: 62215 - protein, 5 aa, Mycobacterium avium
DESDP

SEQ ID NO: 62216 - protein, 22 aa, Mycobacterium avium
DESEALRQARRDAELTASADSV

SEQ ID NO: 62217 - protein, 10 aa, Mycobacterium avium
DESEAQSRAA

SEQ ID NO: 62218 - protein, 7 aa, Mycobacterium avium
DESERRE

SEQ ID NO: 62219 - protein, 5 aa, Mycobacterium avium
DESGF

SEQ ID NO: 62220 - protein, 7 aa, Mycobacterium avium
DESLSDY

SEQ ID NO: 62221 - protein, 8 aa, Mycobacterium avium
DESSITEC

SEQ ID NO: 62222 - protein, 6 aa, Mycobacterium avium
DESTIS

SEQ ID NO: 62223 - protein, 7 aa, Mycobacterium avium
DESTVSA

SEQ ID NO: 62224 - protein, 7 aa, Mycobacterium avium
DESVSEA

SEQ ID NO: 62225 - protein, 9 aa, Mycobacterium avium
DESWSGPAS

SEQ ID NO: 62226 - protein, 13 aa, Mycobacterium avium
DETAGAGVAGAGD

SEQ ID NO: 62227 - protein, 5 aa, Mycobacterium avium
DETAN

SEQ ID NO: 62228 - protein, 7 aa, Mycobacterium avium
DETAREK

SEQ ID NO: 62229 - protein, 11 aa, Mycobacterium avium
DETASRRYGAD

SEQ ID NO: 62230 - protein, 11 aa, Mycobacterium avium
DETASRRYGAG

SEQ ID NO: 62231 - protein, 7 aa, Mycobacterium avium
DETAVQN

SEQ ID NO: 62232 - protein, 10 aa, Mycobacterium avium
DETDWSTNRE

SEQ ID NO: 62233 - protein, 6 aa, Mycobacterium avium
DETPAQ

SEQ ID NO: 62234 - protein, 6 aa, Mycobacterium avium
DETPFD

SEQ ID NO: 62235 - protein, 6 aa, Mycobacterium avium
DETPMT

SEQ ID NO: 62236 - protein, 6 aa, Mycobacterium avium
DETRGA

SEQ ID NO: 62237 - protein, 8 aa, Mycobacterium avium
DETRSRGI

SEQ ID NO: 62238 - protein, 10 aa, Mycobacterium avium
DETTNSVAVP

SEQ ID NO: 62239 - protein, 14 aa, Mycobacterium avium
DEVGPVANQPEPEV

SEQ ID NO: 62240 - protein, 6 aa, Mycobacterium avium
DEVRDR

SEQ ID NO: 62241 - protein, 10 aa, Mycobacterium avium
DEVSDQLPPL

SEQ ID NO: 62242 - protein, 13 aa, Mycobacterium avium
DEVSQKLSERGLA

SEQ ID NO: 62243 - protein, 9 aa, Mycobacterium avium
DFDSTGIRG

SEQ ID NO: 62244 - protein, 5 aa, Mycobacterium avium
DFGSY

SEQ ID NO: 62245 - protein, 5 aa, Mycobacterium avium
DFPAG

SEQ ID NO: 62246 - protein, 4 aa, Mycobacterium avium
DFPD

SEQ ID NO: 62247 - protein, 5 aa, Mycobacterium avium
DFPDD

SEQ ID NO: 62248 - protein, 7 aa, Mycobacterium avium
DFPDRPD

SEQ ID NO: 62249 - protein, 8 aa, Mycobacterium avium
DFPGGSTR

SEQ ID NO: 62250 - protein, 6 aa, Mycobacterium avium
DFSEPT

SEQ ID NO: 62251 - protein, 6 aa, Mycobacterium avium
DFTSKE

SEQ ID NO: 62252 - protein, 13 aa, Mycobacterium avium
DGAADQARSHAAS

SEQ ID NO: 62253 - protein, 33 aa, Mycobacterium avium
DGAAPREAGRRAAAAAGATVQRLGGRPDLTGLR

SEQ ID NO: 62254 - protein, 15 aa, Mycobacterium avium
DGAASQGAAEKAAMD

SEQ ID NO: 62255 - protein, 11 aa, Mycobacterium avium
DGAASTASGTL

SEQ ID NO: 62256 - protein, 11 aa, Mycobacterium avium
DGAAVSRGVTG

SEQ ID NO: 62257 - protein, 21 aa, Mycobacterium avium
DGADLKPAYTVTGGAVPGEET

SEQ ID NO: 62258 - protein, 8 aa, Mycobacterium avium
DGAEKFTK

SEQ ID NO: 62259 - protein, 6 aa, Mycobacterium avium
DGAEVP

SEQ ID NO: 62260 - protein, 7 aa, Mycobacterium avium
DGAGDDV

SEQ ID NO: 62261 - protein, 5 aa, Mycobacterium avium
DGAGG

SEQ ID NO: 62262 - protein, 6 aa, Mycobacterium avium
DGAGGL

SEQ ID NO: 62263 - protein, 8 aa, Mycobacterium avium
DGAGPPVT

SEQ ID NO: 62264 - protein, 4 aa, Mycobacterium avium
DGAH

SEQ ID NO: 62265 - protein, 9 aa, Mycobacterium avium
DGAIDPPAF

SEQ ID NO: 62266 - protein, 7 aa, Mycobacterium avium
DGAPEPL

SEQ ID NO: 62267 - protein, 12 aa, Mycobacterium avium
DGAPNRHDEAEY

SEQ ID NO: 62268 - protein, 6 aa, Mycobacterium avium
DGAPRL

SEQ ID NO: 62269 - protein, 7 aa, Mycobacterium avium
DGAPRLT

SEQ ID NO: 62270 - protein, 15 aa, Mycobacterium avium
DGAPSGEGAQASGLE

SEQ ID NO: 62271 - protein, 9 aa, Mycobacterium avium
DGAPSNVAT

SEQ ID NO: 62272 - protein, 10 aa, Mycobacterium avium
DGAPSTGQHA

SEQ ID NO: 62273 - protein, 15 aa, Mycobacterium avium
DGAQDGAGVNRTGGR

SEQ ID NO: 62274 - protein, 5 aa, Mycobacterium avium
DGARL

SEQ ID NO: 62275 - protein, 8 aa, Mycobacterium avium
DGASISAA

SEQ ID NO: 62276 - protein, 8 aa, Mycobacterium avium
DGATADGA

SEQ ID NO: 62277 - protein, 21 aa, Mycobacterium avium
DGAWSIPKGEYDEGEDPWPAA

SEQ ID NO: 62278 - protein, 11 aa, Mycobacterium avium
DGCGCRKPRPG

SEQ ID NO: 62279 - protein, 8 aa, Mycobacterium avium
DGCQGDPS

SEQ ID NO: 62280 - protein, 7 aa, Mycobacterium avium
DGDDGTG

SEQ ID NO: 62281 - protein, 8 aa, Mycobacterium avium
DGDDLPAG

SEQ ID NO: 62282 - protein, 6 aa, Mycobacterium avium
DGDEVP

SEQ ID NO: 62283 - protein, 7 aa, Mycobacterium avium
DGDEVPA

SEQ ID NO: 62284 - protein, 6 aa, Mycobacterium avium
DGDGSG

SEQ ID NO: 62285 - protein, 20 aa, Mycobacterium avium
DGDIGSDGSSPQDRANAAGF

SEQ ID NO: 62286 - protein, 16 aa, Mycobacterium avium
DGDITGGLAATRTAGG

SEQ ID NO: 62287 - protein, 6 aa, Mycobacterium avium
DGDPRA

SEQ ID NO: 62288 - protein, 5 aa, Mycobacterium avium
DGDQE

SEQ ID NO: 62289 - protein, 5 aa, Mycobacterium avium
DGDQT

SEQ ID NO: 62290 - protein, 14 aa, Mycobacterium avium
DGDRLTDARCSGSC

SEQ ID NO: 62291 - protein, 11 aa, Mycobacterium avium
DGDTAATQTAV

SEQ ID NO: 62292 - protein, 12 aa, Mycobacterium avium
DGDTEPLRTSGK

SEQ ID NO: 62293 - protein, 5 aa, Mycobacterium avium
DGDVE

SEQ ID NO: 62294 - protein, 6 aa, Mycobacterium avium
DGDVGA

SEQ ID NO: 62295 - protein, 8 aa, Mycobacterium avium
DGDVRPVK

SEQ ID NO: 62296 - protein, 7 aa, Mycobacterium avium
DGDVSRT

SEQ ID NO: 62297 - protein, 10 aa, Mycobacterium avium
DGEDAERHYR

SEQ ID NO: 62298 - protein, 7 aa, Mycobacterium avium
DGEHGTQ

SEQ ID NO: 62299 - protein, 4 aa, Mycobacterium avium
DGEI

SEQ ID NO: 62300 - protein, 7 aa, Mycobacterium avium
DGEIQAR

SEQ ID NO: 62301 - protein, 9 aa, Mycobacterium avium
DGELPPPAI

SEQ ID NO: 62302 - protein, 7 aa, Mycobacterium avium
DGEPLGT

SEQ ID NO: 62303 - protein, 6 aa, Mycobacterium avium
DGEQEA

SEQ ID NO: 62304 - protein, 5 aa, Mycobacterium avium
DGEQQ

SEQ ID NO: 62305 - protein, 16 aa, Mycobacterium avium
DGERGRARMQREQRAK

SEQ ID NO: 62306 - protein, 8 aa, Mycobacterium avium
DGERKRPV

SEQ ID NO: 62307 - protein, 7 aa, Mycobacterium avium
DGERPAV

SEQ ID NO: 62308 - protein, 7 aa, Mycobacterium avium
DGETLTP

SEQ ID NO: 62309 - protein, 5 aa, Mycobacterium avium
DGGAP

SEQ ID NO: 62310 - protein, 19 aa, Mycobacterium avium
DGGATADGSSGAMGGPGDR

SEQ ID NO: 62311 - protein, 7 aa, Mycobacterium avium
DGGATEL

SEQ ID NO: 62312 - protein, 8 aa, Mycobacterium avium
DGGDPVES

SEQ ID NO: 62313 - protein, 8 aa, Mycobacterium avium
DGGDRQPE

SEQ ID NO: 62314 - protein, 10 aa, Mycobacterium avium
DGGFGTSAAP

SEQ ID NO: 62315 - protein, 9 aa, Mycobacterium avium
DGGGADAAA

SEQ ID NO: 62316 - protein, 9 aa, Mycobacterium avium
DGGGAGARA

SEQ ID NO: 62317 - protein, 26 aa, Mycobacterium avium
DGGGGVGSGRGERVGDGQPRGQRGFD

SEQ ID NO: 62318 - protein, 5 aa, Mycobacterium avium
DGGGH

SEQ ID NO: 62319 - protein, 5 aa, Mycobacterium avium
DGGGI

SEQ ID NO: 62320 - protein, 6 aa, Mycobacterium avium
DGGGRC

SEQ ID NO: 62321 - protein, 11 aa, Mycobacterium avium
DGGPAIDSDRV

SEQ ID NO: 62322 - protein, 10 aa, Mycobacterium avium
DGGPSGAATF

SEQ ID NO: 62323 - protein, 12 aa, Mycobacterium avium
DGGPTELSKLKY

SEQ ID NO: 62324 - protein, 8 aa, Mycobacterium avium
DGGQESRQ

SEQ ID NO: 62325 - protein, 4 aa, Mycobacterium avium
DGGR

SEQ ID NO: 62326 - protein, 7 aa, Mycobacterium avium
DGGRAVD

SEQ ID NO: 62327 - protein, 6 aa, Mycobacterium avium
DGGRIA

SEQ ID NO: 62328 - protein, 4 aa, Mycobacterium avium
DGGS

SEQ ID NO: 62329 - protein, 8 aa, Mycobacterium avium
DGGSVGAA

SEQ ID NO: 62330 - protein, 8 aa, Mycobacterium avium
DGGTTLGA

SEQ ID NO: 62331 - protein, 14 aa, Mycobacterium avium
DGGVAGAPGPTRGK

SEQ ID NO: 62332 - protein, 23 aa, Mycobacterium avium
DGGVAGPGQVGDGPGQVGGQGER

SEQ ID NO: 62333 - protein, 4 aa, Mycobacterium avium
DGHA

SEQ ID NO: 62334 - protein, 10 aa, Mycobacterium avium
DGHGAAGEPL

SEQ ID NO: 62335 - protein, 9 aa, Mycobacterium avium
DGHGAEVRA

SEQ ID NO: 62336 - protein, 11 aa, Mycobacterium avium
DGHPEKALSRD

SEQ ID NO: 62337 - protein, 29 aa, Mycobacterium avium
DGHQRGTAIGRGDPRTGPPDGRVIAGRTA

SEQ ID NO: 62338 - protein, 13 aa, Mycobacterium avium
DGIGERSPASGIA

SEQ ID NO: 62339 - protein, 13 aa, Mycobacterium avium
DGKISQRNFGGHT

SEQ ID NO: 62340 - protein, 4 aa, Mycobacterium avium
DGKS

SEQ ID NO: 62341 - protein, 12 aa, Mycobacterium avium
DGLDELTTTTTS

SEQ ID NO: 62342 - protein, 11 aa, Mycobacterium avium
DGLGAEAGTAA

SEQ ID NO: 62343 - protein, 8 aa, Mycobacterium avium
DGLPAGRP

SEQ ID NO: 62344 - protein, 8 aa, Mycobacterium avium
DGLPEDER

SEQ ID NO: 62345 - protein, 7 aa, Mycobacterium avium
DGLPPGH

SEQ ID NO: 62346 - protein, 7 aa, Mycobacterium avium
DGLPPGR

SEQ ID NO: 62347 - protein, 10 aa, Mycobacterium avium
DGLPVSEDEP

SEQ ID NO: 62348 - protein, 5 aa, Mycobacterium avium
DGLRD

SEQ ID NO: 62349 - protein, 8 aa, Mycobacterium avium
DGLRGAGA

SEQ ID NO: 62350 - protein, 17 aa, Mycobacterium avium
DGLRGKGEALGEATTDL

SEQ ID NO: 62351 - protein, 9 aa, Mycobacterium avium
DGLTPETAD

SEQ ID NO: 62352 - protein, 10 aa, Mycobacterium avium
DGLTTRARRH

SEQ ID NO: 62353 - protein, 10 aa, Mycobacterium avium
DGLTTRTRRH

SEQ ID NO: 62354 - protein, 8 aa, Mycobacterium avium
DGMPANPA

SEQ ID NO: 62355 - protein, 8 aa, Mycobacterium avium
DGMPANPG

SEQ ID NO: 62356 - protein, 7 aa, Mycobacterium avium
DGMPDDL

SEQ ID NO: 62357 - protein, 10 aa, Mycobacterium avium
DGMRTSTTTY

SEQ ID NO: 62358 - protein, 6 aa, Mycobacterium avium
DGNDPL

SEQ ID NO: 62359 - protein, 7 aa, Mycobacterium avium
DGNDVPR

SEQ ID NO: 62360 - protein, 4 aa, Mycobacterium avium
DGNP

SEQ ID NO: 62361 - protein, 6 aa, Mycobacterium avium
DGNPAA

SEQ ID NO: 62362 - protein, 4 aa, Mycobacterium avium
DGNR

SEQ ID NO: 62363 - protein, 7 aa, Mycobacterium avium
DGNREGQ

SEQ ID NO: 62364 - protein, 12 aa, Mycobacterium avium
DGPAGSPPDPGK

SEQ ID NO: 62365 - protein, 6 aa, Mycobacterium avium
DGPKAT

SEQ ID NO: 62366 - protein, 8 aa, Mycobacterium avium
DGPPGFKS

SEQ ID NO: 62367 - protein, 14 aa, Mycobacterium avium
DGPPPRLRLATRLC

SEQ ID NO: 62368 - protein, 7 aa, Mycobacterium avium
DGPQARG

SEQ ID NO: 62369 - protein, 6 aa, Mycobacterium avium
DGPRGD

SEQ ID NO: 62370 - protein, 7 aa, Mycobacterium avium
DGPRGKV

SEQ ID NO: 62371 - protein, 8 aa, Mycobacterium avium
DGPSPVNN

SEQ ID NO: 62372 - protein, 7 aa, Mycobacterium avium
DGPTADR

SEQ ID NO: 62373 - protein, 4 aa, Mycobacterium avium
DGPV

SEQ ID NO: 62374 - protein, 7 aa, Mycobacterium avium
DGQAGTF

SEQ ID NO: 62375 - protein, 6 aa, Mycobacterium avium
DGQGIE

SEQ ID NO: 62376 - protein, 5 aa, Mycobacterium avium
DGQLA

SEQ ID NO: 62377 - protein, 7 aa, Mycobacterium avium
DGQLGGG

SEQ ID NO: 62378 - protein, 8 aa, Mycobacterium avium
DGQPVAAS

SEQ ID NO: 62379 - protein, 5 aa, Mycobacterium avium
DGQRR

SEQ ID NO: 62380 - protein, 12 aa, Mycobacterium avium
DGQVTGGISGPD

SEQ ID NO: 62381 - protein, 4 aa, Mycobacterium avium
DGRA

SEQ ID NO: 62382 - protein, 9 aa, Mycobacterium avium
DGRATVRTT

SEQ ID NO: 62383 - protein, 4 aa, Mycobacterium avium
DGRD

SEQ ID NO: 62384 - protein, 9 aa, Mycobacterium avium
DGRDTTPDL

SEQ ID NO: 62385 - protein, 9 aa, Mycobacterium avium
DGRELSAGE

SEQ ID NO: 62386 - protein, 29 aa, Mycobacterium avium
DGRERGDQQHQRRQHGPVATAQPRGAHGV

SEQ ID NO: 62387 - protein, 11 aa, Mycobacterium avium
DGREVKGRKIG

SEQ ID NO: 62388 - protein, 8 aa, Mycobacterium avium
DGRGGSDA

SEQ ID NO: 62389 - protein, 9 aa, Mycobacterium avium
DGRGGTDAY

SEQ ID NO: 62390 - protein, 8 aa, Mycobacterium avium
DGRGLPEG

SEQ ID NO: 62391 - protein, 4 aa, Mycobacterium avium
DGRI

SEQ ID NO: 62392 - protein, 6 aa, Mycobacterium avium
DGRPAG

SEQ ID NO: 62393 - protein, 5 aa, Mycobacterium avium
DGRPH

SEQ ID NO: 62394 - protein, 14 aa, Mycobacterium avium
DGRPIDRQLDQPPR

SEQ ID NO: 62395 - protein, 8 aa, Mycobacterium avium
DGRREKVS

SEQ ID NO: 62396 - protein, 6 aa, Mycobacterium avium
DGRRTL

SEQ ID NO: 62397 - protein, 10 aa, Mycobacterium avium
DGRTGETTAM

SEQ ID NO: 62398 - protein, 8 aa, Mycobacterium avium
DGRTSYRT

SEQ ID NO: 62399 - protein, 4 aa, Mycobacterium avium
DGRV

SEQ ID NO: 62400 - protein, 22 aa, Mycobacterium avium
DGRYRTQAAEQAPTSTSPSNAR

SEQ ID NO: 62401 - protein, 19 aa, Mycobacterium avium
DGSAPSWDPPHMPEAEDDD

SEQ ID NO: 62402 - protein, 5 aa, Mycobacterium avium
DGSDP

SEQ ID NO: 62403 - protein, 8 aa, Mycobacterium avium
DGSDSSMR

SEQ ID NO: 62404 - protein, 10 aa, Mycobacterium avium
DGSEAPQLPG

SEQ ID NO: 62405 - protein, 11 aa, Mycobacterium avium
DGSEAPQLPGA

SEQ ID NO: 62406 - protein, 7 aa, Mycobacterium avium
DGSGPWP

SEQ ID NO: 62407 - protein, 5 aa, Mycobacterium avium
DGSHA

SEQ ID NO: 62408 - protein, 9 aa, Mycobacterium avium
DGSLDTAAA

SEQ ID NO: 62409 - protein, 10 aa, Mycobacterium avium
DGSPDTQEDI

SEQ ID NO: 62410 - protein, 5 aa, Mycobacterium avium
DGSPL

SEQ ID NO: 62411 - protein, 5 aa, Mycobacterium avium
DGSPS

SEQ ID NO: 62412 - protein, 11 aa, Mycobacterium avium
DGSRRDAYGSV

SEQ ID NO: 62413 - protein, 7 aa, Mycobacterium avium
DGSSAIA

SEQ ID NO: 62414 - protein, 13 aa, Mycobacterium avium
DGSTDDTGEIARR

SEQ ID NO: 62415 - protein, 20 aa, Mycobacterium avium
DGSTKVSTRCYGGNNAEVVI

SEQ ID NO: 62416 - protein, 21 aa, Mycobacterium avium
DGSTLTNPSAAQVKAKLAEVG

SEQ ID NO: 62417 - protein, 10 aa, Mycobacterium avium
DGSTSTAPAF

SEQ ID NO: 62418 - protein, 19 aa, Mycobacterium avium
DGSTVYPGARSANAPYSGG

SEQ ID NO: 62419 - protein, 8 aa, Mycobacterium avium
DGSVSDGA

SEQ ID NO: 62420 - protein, 6 aa, Mycobacterium avium
DGTAAR

SEQ ID NO: 62421 - protein, 7 aa, Mycobacterium avium
DGTAARR

SEQ ID NO: 62422 - protein, 7 aa, Mycobacterium avium
DGTAFTG

SEQ ID NO: 62423 - protein, 8 aa, Mycobacterium avium
DGTEGEVR

SEQ ID NO: 62424 - protein, 6 aa, Mycobacterium avium
DGTEHR

SEQ ID NO: 62425 - protein, 16 aa, Mycobacterium avium
DGTEVESGVIAAIERV

SEQ ID NO: 62426 - protein, 7 aa, Mycobacterium avium
DGTGRVD

SEQ ID NO: 62427 - protein, 17 aa, Mycobacterium avium
DGTGSGGDERQQTTHGA

SEQ ID NO: 62428 - protein, 7 aa, Mycobacterium avium
DGTGTVA

SEQ ID NO: 62429 - protein, 5 aa, Mycobacterium avium
DGTGV

SEQ ID NO: 62430 - protein, 33 aa, Mycobacterium avium
DGTITGPGRRGVRSSRRRARVGQRGISGTTRRG

SEQ ID NO: 62431 - protein, 6 aa, Mycobacterium avium
DGTLPG

SEQ ID NO: 62432 - protein, 10 aa, Mycobacterium avium
DGTLSDADAA

SEQ ID NO: 62433 - protein, 10 aa, Mycobacterium avium
DGTLSDQDAA

SEQ ID NO: 62434 - protein, 7 aa, Mycobacterium avium
DGTNPTC

SEQ ID NO: 62435 - protein, 18 aa, Mycobacterium avium
DGTNTWTTSTSPPPPWPS

SEQ ID NO: 62436 - protein, 7 aa, Mycobacterium avium
DGTPAAV

SEQ ID NO: 62437 - protein, 10 aa, Mycobacterium avium
DGTPDKHRLG

SEQ ID NO: 62438 - protein, 5 aa, Mycobacterium avium
DGTPF

SEQ ID NO: 62439 - protein, 5 aa, Mycobacterium avium
DGTPH

SEQ ID NO: 62440 - protein, 4 aa, Mycobacterium avium
DGTQ

SEQ ID NO: 62441 - protein, 8 aa, Mycobacterium avium
DGTQAGHW

SEQ ID NO: 62442 - protein, 11 aa, Mycobacterium avium
DGTQRIAPADE

SEQ ID NO: 62443 - protein, 11 aa, Mycobacterium avium
DGTRNISSQAE

SEQ ID NO: 62444 - protein, 7 aa, Mycobacterium avium
DGTRVTP

SEQ ID NO: 62445 - protein, 13 aa, Mycobacterium avium
DGTVAARGTVRGE

SEQ ID NO: 62446 - protein, 13 aa, Mycobacterium avium
DGTVAEHRAALVP

SEQ ID NO: 62447 - protein, 11 aa, Mycobacterium avium
DGTWSGGPAAV

SEQ ID NO: 62448 - protein, 7 aa, Mycobacterium avium
DGVAEAA

SEQ ID NO: 62449 - protein, 10 aa, Mycobacterium avium
DGVATAQRRA

SEQ ID NO: 62450 - protein, 16 aa, Mycobacterium avium
DGVATAQRRAWSGPMW

SEQ ID NO: 62451 - protein, 4 aa, Mycobacterium avium
DGVD

SEQ ID NO: 62452 - protein, 12 aa, Mycobacterium avium
DGVDQPGETKNT

SEQ ID NO: 62453 - protein, 6 aa, Mycobacterium avium
DGVERP

SEQ ID NO: 62454 - protein, 8 aa, Mycobacterium avium
DGVRAGRN

SEQ ID NO: 62455 - protein, 6 aa, Mycobacterium avium
DGVRTP

SEQ ID NO: 62456 - protein, 4 aa, Mycobacterium avium
DGVS

SEQ ID NO: 62457 - protein, 11 aa, Mycobacterium avium
DGVTAAQRRAG

SEQ ID NO: 62458 - protein, 5 aa, Mycobacterium avium
DGYAK

SEQ ID NO: 62459 - protein, 32 aa, Mycobacterium avium
DGYDSTGVQAGPVPAPVDHPGGGPALTPTTGD

SEQ ID NO: 62460 - protein, 38 aa, Mycobacterium avium
DGYDSTGVQAGTVPAPVDHPGGGPALTPTTGDCGNRGC

SEQ ID NO: 62461 - protein, 38 aa, Mycobacterium avium
DGYGRYDGDDYDDPRREPADCPPPAGYRGGYAEESRYG

SEQ ID NO: 62462 - protein, 8 aa, Mycobacterium avium
DGYSDTLQ

SEQ ID NO: 62463 - protein, 12 aa, Mycobacterium avium
DGYTDPESSEKK

SEQ ID NO: 62464 - protein, 9 aa, Mycobacterium avium
DGYVRGEGG

SEQ ID NO: 62465 - protein, 6 aa, Mycobacterium avium
DHATGS

SEQ ID NO: 62466 - protein, 23 aa, Mycobacterium avium
DHDAVKRAAQAHAGRAEEERPSV

SEQ ID NO: 62467 - protein, 27 aa, Mycobacterium avium
DHDGSATRRRAGAPGTGNALRRRGYSD

SEQ ID NO: 62468 - protein, 9 aa, Mycobacterium avium
DHDSASTHG

SEQ ID NO: 62469 - protein, 5 aa, Mycobacterium avium
DHESV

SEQ ID NO: 62470 - protein, 20 aa, Mycobacterium avium
DHGAVSRGEWRTSVGDDGRL

SEQ ID NO: 62471 - protein, 6 aa, Mycobacterium avium
DHGDRH

SEQ ID NO: 62472 - protein, 6 aa, Mycobacterium avium
DHGGSL

SEQ ID NO: 62473 - protein, 6 aa, Mycobacterium avium
DHGLQP

SEQ ID NO: 62474 - protein, 7 aa, Mycobacterium avium
DHGPEPV

SEQ ID NO: 62475 - protein, 7 aa, Mycobacterium avium
DHGRWPQ

SEQ ID NO: 62476 - protein, 30 aa, Mycobacterium avium
DHKSGDKTSSSTSTATSSKSSTAPAAQAKY

SEQ ID NO: 62477 - protein, 16 aa, Mycobacterium avium
DHKTSSELRRNYRKAA

SEQ ID NO: 62478 - protein, 10 aa, Mycobacterium avium
DHNDIRDGVR

SEQ ID NO: 62479 - protein, 5 aa, Mycobacterium avium
DHNVP

SEQ ID NO: 62480 - protein, 7 aa, Mycobacterium avium
DHPAPDA

SEQ ID NO: 62481 - protein, 6 aa, Mycobacterium avium
DHPDGG

SEQ ID NO: 62482 - protein, 6 aa, Mycobacterium avium
DHPGGG

SEQ ID NO: 62483 - protein, 8 aa, Mycobacterium avium
DHPGRHRA

SEQ ID NO: 62484 - protein, 6 aa, Mycobacterium avium
DHPGRK

SEQ ID NO: 62485 - protein, 8 aa, Mycobacterium avium
DHPPHAGE

SEQ ID NO: 62486 - protein, 20 aa, Mycobacterium avium
DHPRHRSEQRPGEGDLGGVQ

SEQ ID NO: 62487 - protein, 10 aa, Mycobacterium avium
DHQHGSSGRF

SEQ ID NO: 62488 - protein, 4 aa, Mycobacterium avium
DHQS

SEQ ID NO: 62489 - protein, 5 aa, Mycobacterium avium
DHRIG

SEQ ID NO: 62490 - protein, 8 aa, Mycobacterium avium
DHRSRLGN

SEQ ID NO: 62491 - protein, 4 aa, Mycobacterium avium
DHRV

SEQ ID NO: 62492 - protein, 10 aa, Mycobacterium avium
DHTGRYRGRA

SEQ ID NO: 62493 - protein, 15 aa, Mycobacterium avium
DHTRNSLRENGNLSS

SEQ ID NO: 62494 - protein, 8 aa, Mycobacterium avium
DIDESRPF

SEQ ID NO: 62495 - protein, 9 aa, Mycobacterium avium
DIDKNTSYR

SEQ ID NO: 62496 - protein, 9 aa, Mycobacterium avium
DIDPEETSE

SEQ ID NO: 62497 - protein, 7 aa, Mycobacterium avium
DIDPTQV

SEQ ID NO: 62498 - protein, 11 aa, Mycobacterium avium
DIEGRDEFAGP

SEQ ID NO: 62499 - protein, 13 aa, Mycobacterium avium
DIGATENAQGFTT

SEQ ID NO: 62500 - protein, 19 aa, Mycobacterium avium
DIGDASRNAGTKAALSGDL

SEQ ID NO: 62501 - protein, 8 aa, Mycobacterium avium
DIKRPGAD

SEQ ID NO: 62502 - protein, 6 aa, Mycobacterium avium
DIPADQ

SEQ ID NO: 62503 - protein, 10 aa, Mycobacterium avium
DIQPPARPSV

SEQ ID NO: 62504 - protein, 6 aa, Mycobacterium avium
DIRDPG

SEQ ID NO: 62505 - protein, 7 aa, Mycobacterium avium
DIRDTAQ

SEQ ID NO: 62506 - protein, 21 aa, Mycobacterium avium
DISEETREKIGGLNAQRFYNL

SEQ ID NO: 62507 - protein, 6 aa, Mycobacterium avium
DISRRP

SEQ ID NO: 62508 - protein, 10 aa, Mycobacterium avium
DITEEPEPRG

SEQ ID NO: 62509 - protein, 6 aa, Mycobacterium avium
DKAAEQ

SEQ ID NO: 62510 - protein, 7 aa, Mycobacterium avium
DKAAPTI

SEQ ID NO: 62511 - protein, 13 aa, Mycobacterium avium
DKADLDAAGFTDD

SEQ ID NO: 62512 - protein, 11 aa, Mycobacterium avium
DKAETKARYGE

SEQ ID NO: 62513 - protein, 9 aa, Mycobacterium avium
DKAGPVTAA

SEQ ID NO: 62514 - protein, 4 aa, Mycobacterium avium
DKAN

SEQ ID NO: 62515 - protein, 13 aa, Mycobacterium avium
DKARSRATGGSGL

SEQ ID NO: 62516 - protein, 8 aa, Mycobacterium avium
DKAVTGES

SEQ ID NO: 62517 - protein, 11 aa, Mycobacterium avium
DKCGGAGFPEV

SEQ ID NO: 62518 - protein, 16 aa, Mycobacterium avium
DKCGGAGSRRWLTLVA

SEQ ID NO: 62519 - protein, 8 aa, Mycobacterium avium
DKDAGELR

SEQ ID NO: 62520 - protein, 14 aa, Mycobacterium avium
DKDTGGEAGKTLRN

SEQ ID NO: 62521 - protein, 5 aa, Mycobacterium avium
DKDTL

SEQ ID NO: 62522 - protein, 6 aa, Mycobacterium avium
DKDVER

SEQ ID NO: 62523 - protein, 8 aa, Mycobacterium avium
DKDVERAR

SEQ ID NO: 62524 - protein, 8 aa, Mycobacterium avium
DKGEGGAF

SEQ ID NO: 62525 - protein, 13 aa, Mycobacterium avium
DKGEKLALERYHA

SEQ ID NO: 62526 - protein, 8 aa, Mycobacterium avium
DKGEQLAR

SEQ ID NO: 62527 - protein, 8 aa, Mycobacterium avium
DKGIDKSE

SEQ ID NO: 62528 - protein, 8 aa, Mycobacterium avium
DKGIQKSE

SEQ ID NO: 62529 - protein, 7 aa, Mycobacterium avium
DKGQKAR

SEQ ID NO: 62530 - protein, 17 aa, Mycobacterium avium
DKKGKEDLARKNPYSSQ

SEQ ID NO: 62531 - protein, 14 aa, Mycobacterium avium
DKKPEGEDRATRAE

SEQ ID NO: 62532 - protein, 4 aa, Mycobacterium avium
DKLA

SEQ ID NO: 62533 - protein, 8 aa, Mycobacterium avium
DKQSINDR

SEQ ID NO: 62534 - protein, 4 aa, Mycobacterium avium
DKRG

SEQ ID NO: 62535 - protein, 14 aa, Mycobacterium avium
DKRRPSFGQRQGVR

SEQ ID NO: 62536 - protein, 13 aa, Mycobacterium avium
DKRTPNWAPLEDD

SEQ ID NO: 62537 - protein, 11 aa, Mycobacterium avium
DKRYQDEASGV

SEQ ID NO: 62538 - protein, 10 aa, Mycobacterium avium
DKSAETPQRG

SEQ ID NO: 62539 - protein, 7 aa, Mycobacterium avium
DKSQTAA

SEQ ID NO: 62540 - protein, 7 aa, Mycobacterium avium
DKTPVKS

SEQ ID NO: 62541 - protein, 8 aa, Mycobacterium avium
DKVESVQT

SEQ ID NO: 62542 - protein, 9 aa, Mycobacterium avium
DKVNRPAGG

SEQ ID NO: 62543 - protein, 10 aa, Mycobacterium avium
DKVSRRAARE

SEQ ID NO: 62544 - protein, 9 aa, Mycobacterium avium
DKVTSSPAF

SEQ ID NO: 62545 - protein, 5 aa, Mycobacterium avium
DLAGA

SEQ ID NO: 62546 - protein, 7 aa, Mycobacterium avium
DLAGGTF

SEQ ID NO: 62547 - protein, 15 aa, Mycobacterium avium
DLAGNGVEDRTDGEL

SEQ ID NO: 62548 - protein, 6 aa, Mycobacterium avium
DLAPPA

SEQ ID NO: 62549 - protein, 13 aa, Mycobacterium avium
DLAQQDRQRPAVE

SEQ ID NO: 62550 - protein, 6 aa, Mycobacterium avium
DLARAR

SEQ ID NO: 62551 - protein, 5 aa, Mycobacterium avium
DLARG

SEQ ID NO: 62552 - protein, 12 aa, Mycobacterium avium
DLATLDSAEGVP

SEQ ID NO: 62553 - protein, 7 aa, Mycobacterium avium
DLDDPAK

SEQ ID NO: 62554 - protein, 10 aa, Mycobacterium avium
DLDDPDSPIA

SEQ ID NO: 62555 - protein, 10 aa, Mycobacterium avium
DLDDPDSRIG

SEQ ID NO: 62556 - protein, 9 aa, Mycobacterium avium
DLDDPGSRI

SEQ ID NO: 62557 - protein, 9 aa, Mycobacterium avium
DLDDQGRIS

SEQ ID NO: 62558 - protein, 9 aa, Mycobacterium avium
DLDGDDPPI

SEQ ID NO: 62559 - protein, 10 aa, Mycobacterium avium
DLDRRGPRVD

SEQ ID NO: 62560 - protein, 7 aa, Mycobacterium avium
DLETPDS

SEQ ID NO: 62561 - protein, 9 aa, Mycobacterium avium
DLGKMGPPQ

SEQ ID NO: 62562 - protein, 5 aa, Mycobacterium avium
DLGND

SEQ ID NO: 62563 - protein, 6 aa, Mycobacterium avium
DLGPVE

SEQ ID NO: 62564 - protein, 7 aa, Mycobacterium avium
DLGPVGP

SEQ ID NO: 62565 - protein, 10 aa, Mycobacterium avium
DLGRERQPPR

SEQ ID NO: 62566 - protein, 8 aa, Mycobacterium avium
DLGRSPAE

SEQ ID NO: 62567 - protein, 9 aa, Mycobacterium avium
DLGSQNRGC

SEQ ID NO: 62568 - protein, 10 aa, Mycobacterium avium
DLLDGGGRGA

SEQ ID NO: 62569 - protein, 10 aa, Mycobacterium avium
DLNDPDSRIG

SEQ ID NO: 62570 - protein, 7 aa, Mycobacterium avium
DLPAETF

SEQ ID NO: 62571 - protein, 7 aa, Mycobacterium avium
DLPASKS

SEQ ID NO: 62572 - protein, 9 aa, Mycobacterium avium
DLPASTRDG

SEQ ID NO: 62573 - protein, 12 aa, Mycobacterium avium
DLPASTREDAEP

SEQ ID NO: 62574 - protein, 9 aa, Mycobacterium avium
DLPEDTRAR

SEQ ID NO: 62575 - protein, 6 aa, Mycobacterium avium
DLPGDT

SEQ ID NO: 62576 - protein, 5 aa, Mycobacterium avium
DLPGL

SEQ ID NO: 62577 - protein, 7 aa, Mycobacterium avium
DLPGQGG

SEQ ID NO: 62578 - protein, 15 aa, Mycobacterium avium
DLPGSARIGPPQQRL

SEQ ID NO: 62579 - protein, 30 aa, Mycobacterium avium
DLPHRAAGQLDGRQPRGGLQHRRDAGQRRL

SEQ ID NO: 62580 - protein, 4 aa, Mycobacterium avium
DLPP

SEQ ID NO: 62581 - protein, 13 aa, Mycobacterium avium
DLPPAPAPLSDAQ

SEQ ID NO: 62582 - protein, 12 aa, Mycobacterium avium
DLPPAPPPLSDA

SEQ ID NO: 62583 - protein, 9 aa, Mycobacterium avium
DLPPEAEQY

SEQ ID NO: 62584 - protein, 18 aa, Mycobacterium avium
DLPPGARRPAGTPPGAPV

SEQ ID NO: 62585 - protein, 27 aa, Mycobacterium avium
DLPSAAAEAETGYDTKTIRPQHRPKRR

SEQ ID NO: 62586 - protein, 28 aa, Mycobacterium avium
DLPSAAAEAETGYDTKTIRPQHRPKRRA

SEQ ID NO: 62587 - protein, 5 aa, Mycobacterium avium
DLPSV

SEQ ID NO: 62588 - protein, 8 aa, Mycobacterium avium
DLPTAEAD

SEQ ID NO: 62589 - protein, 9 aa, Mycobacterium avium
DLPTTPTGK

SEQ ID NO: 62590 - protein, 16 aa, Mycobacterium avium
DLQQRSNATVAPGEPI

SEQ ID NO: 62591 - protein, 8 aa, Mycobacterium avium
DLQRAEDS

SEQ ID NO: 62592 - protein, 9 aa, Mycobacterium avium
DLRDEGEGK

SEQ ID NO: 62593 - protein, 7 aa, Mycobacterium avium
DLRREPR

SEQ ID NO: 62594 - protein, 8 aa, Mycobacterium avium
DLSDEDRA

SEQ ID NO: 62595 - protein, 8 aa, Mycobacterium avium
DLSRKTDQ

SEQ ID NO: 62596 - protein, 4 aa, Mycobacterium avium
DLSS

SEQ ID NO: 62597 - protein, 8 aa, Mycobacterium avium
DLTDAESA

SEQ ID NO: 62598 - protein, 43 aa, Mycobacterium avium
DLTEEGQAQQDKADAQRDAGKKEAEAESARAGADAAEERQKKN

SEQ ID NO: 62599 - protein, 6 aa, Mycobacterium avium
DLTPRE

SEQ ID NO: 62600 - protein, 22 aa, Mycobacterium avium
DLTQNQKNQATQRQSQADGTVK

SEQ ID NO: 62601 - protein, 8 aa, Mycobacterium avium
DMSRPTPC

SEQ ID NO: 62602 - protein, 6 aa, Mycobacterium avium
DNAEFT

SEQ ID NO: 62603 - protein, 8 aa, Mycobacterium avium
DNAHNDRD

SEQ ID NO: 62604 - protein, 13 aa, Mycobacterium avium
DNDEERDQQREAV

SEQ ID NO: 62605 - protein, 11 aa, Mycobacterium avium
DNDETTPDGSV

SEQ ID NO: 62606 - protein, 9 aa, Mycobacterium avium
DNDGIPTRE

SEQ ID NO: 62607 - protein, 6 aa, Mycobacterium avium
DNDPFY

SEQ ID NO: 62608 - protein, 13 aa, Mycobacterium avium
DNDPQPKPRTRDR

SEQ ID NO: 62609 - protein, 8 aa, Mycobacterium avium
DNDSETLA

SEQ ID NO: 62610 - protein, 5 aa, Mycobacterium avium
DNDSV

SEQ ID NO: 62611 - protein, 6 aa, Mycobacterium avium
DNEEIE

SEQ ID NO: 62612 - protein, 4 aa, Mycobacterium avium
DNEI

SEQ ID NO: 62613 - protein, 21 aa, Mycobacterium avium
DNEIPNSKEASMSKAKAGRMA

SEQ ID NO: 62614 - protein, 8 aa, Mycobacterium avium
DNGAYQGK

SEQ ID NO: 62615 - protein, 10 aa, Mycobacterium avium
DNGDDQPDYV

SEQ ID NO: 62616 - protein, 9 aa, Mycobacterium avium
DNGEFSGSF

SEQ ID NO: 62617 - protein, 10 aa, Mycobacterium avium
DNGFDSSART

SEQ ID NO: 62618 - protein, 7 aa, Mycobacterium avium
DNGIDTE

SEQ ID NO: 62619 - protein, 8 aa, Mycobacterium avium
DNGPPRAR

SEQ ID NO: 62620 - protein, 6 aa, Mycobacterium avium
DNLGRP

SEQ ID NO: 62621 - protein, 18 aa, Mycobacterium avium
DNNKSPSRKTGELDNRGS

SEQ ID NO: 62622 - protein, 10 aa, Mycobacterium avium
DNPAPAYDEL

SEQ ID NO: 62623 - protein, 21 aa, Mycobacterium avium
DNPEAETAAAEVTEAPVEAVP

SEQ ID NO: 62624 - protein, 7 aa, Mycobacterium avium
DNPGDPW

SEQ ID NO: 62625 - protein, 6 aa, Mycobacterium avium
DNPGSC

SEQ ID NO: 62626 - protein, 5 aa, Mycobacterium avium
DNPTD

SEQ ID NO: 62627 - protein, 6 aa, Mycobacterium avium
DNPTSI

SEQ ID NO: 62628 - protein, 4 aa, Mycobacterium avium
DNQE

SEQ ID NO: 62629 - protein, 9 aa, Mycobacterium avium
DNQTPVPDR

SEQ ID NO: 62630 - protein, 6 aa, Mycobacterium avium
DNQVGE

SEQ ID NO: 62631 - protein, 4 aa, Mycobacterium avium
DNRR

SEQ ID NO: 62632 - protein, 17 aa, Mycobacterium avium
DNSAPADAPAAAPADAT

SEQ ID NO: 62633 - protein, 14 aa, Mycobacterium avium
DNSGTTACKDPQDR

SEQ ID NO: 62634 - protein, 4 aa, Mycobacterium avium
DNSS

SEQ ID NO: 62635 - protein, 12 aa, Mycobacterium avium
DNTPSGTTVSTS

SEQ ID NO: 62636 - protein, 7 aa, Mycobacterium avium
DNTPWPR

SEQ ID NO: 62637 - protein, 8 aa, Mycobacterium avium
DNVLDGGR

SEQ ID NO: 62638 - protein, 10 aa, Mycobacterium avium
DNWSADTPAL

SEQ ID NO: 62639 - protein, 36 aa, Mycobacterium avium
DPAAATVPQPHGPAGRRPPAPSQRVSPPARPTPTLG

SEQ ID NO: 62640 - protein, 14 aa, Mycobacterium avium
DPAASRAWITRLSE

SEQ ID NO: 62641 - protein, 8 aa, Mycobacterium avium
DPAAVEAA

SEQ ID NO: 62642 - protein, 10 aa, Mycobacterium avium
DPAAVEAART

SEQ ID NO: 62643 - protein, 8 aa, Mycobacterium avium
DPADAEVP

SEQ ID NO: 62644 - protein, 5 aa, Mycobacterium avium
DPAEL

SEQ ID NO: 62645 - protein, 4 aa, Mycobacterium avium
DPAG

SEQ ID NO: 62646 - protein, 6 aa, Mycobacterium avium
DPAHPV

SEQ ID NO: 62647 - protein, 14 aa, Mycobacterium avium
DPAKGLGPATLPNG

SEQ ID NO: 62648 - protein, 18 aa, Mycobacterium avium
DPALAGQPSAALPVPSSD

SEQ ID NO: 62649 - protein, 18 aa, Mycobacterium avium
DPALDGQPSAALPVPSSD

SEQ ID NO: 62650 - protein, 10 aa, Mycobacterium avium
DPALDPARSS

SEQ ID NO: 62651 - protein, 7 aa, Mycobacterium avium
DPAMDGS

SEQ ID NO: 62652 - protein, 6 aa, Mycobacterium avium
DPAMDS

SEQ ID NO: 62653 - protein, 7 aa, Mycobacterium avium
DPAPHVP

SEQ ID NO: 62654 - protein, 9 aa, Mycobacterium avium
DPAQTTGDT

SEQ ID NO: 62655 - protein, 9 aa, Mycobacterium avium
DPARIGSAD

SEQ ID NO: 62656 - protein, 21 aa, Mycobacterium avium
DPARLGPTLTEAARAAEQGGA

SEQ ID NO: 62657 - protein, 7 aa, Mycobacterium avium
DPARPLS

SEQ ID NO: 62658 - protein, 23 aa, Mycobacterium avium
DPASEASESAADVGEPVTPGEGF

SEQ ID NO: 62659 - protein, 10 aa, Mycobacterium avium
DPASRGTQMG

SEQ ID NO: 62660 - protein, 4 aa, Mycobacterium avium
DPAT

SEQ ID NO: 62661 - protein, 8 aa, Mycobacterium avium
DPATGRED

SEQ ID NO: 62662 - protein, 30 aa, Mycobacterium avium
DPAVGQPNQRRGVARPGPRHLGDGADGEQV

SEQ ID NO: 62663 - protein, 8 aa, Mycobacterium avium
DPAVTANG

SEQ ID NO: 62664 - protein, 8 aa, Mycobacterium avium
DPCPTPAE

SEQ ID NO: 62665 - protein, 8 aa, Mycobacterium avium
DPDADGVD

SEQ ID NO: 62666 - protein, 9 aa, Mycobacterium avium
DPDADYQQS

SEQ ID NO: 62667 - protein, 8 aa, Mycobacterium avium
DPDAEPPR

SEQ ID NO: 62668 - protein, 5 aa, Mycobacterium avium
DPDAL

SEQ ID NO: 62669 - protein, 17 aa, Mycobacterium avium
DPDAPAAPTPLAGWKVH

SEQ ID NO: 62670 - protein, 9 aa, Mycobacterium avium
DPDAPPPYV

SEQ ID NO: 62671 - protein, 9 aa, Mycobacterium avium
DPDDAPPRL

SEQ ID NO: 62672 - protein, 17 aa, Mycobacterium avium
DPDDCTVPAGADIMHSG

SEQ ID NO: 62673 - protein, 5 aa, Mycobacterium avium
DPDDI

SEQ ID NO: 62674 - protein, 8 aa, Mycobacterium avium
DPDDRAKV

SEQ ID NO: 62675 - protein, 18 aa, Mycobacterium avium
DPDDWNPPNLDEDTEIPG

SEQ ID NO: 62676 - protein, 4 aa, Mycobacterium avium
DPDH

SEQ ID NO: 62677 - protein, 4 aa, Mycobacterium avium
DPDK

SEQ ID NO: 62678 - protein, 12 aa, Mycobacterium avium
DPDNPNQPPYSQ

SEQ ID NO: 62679 - protein, 11 aa, Mycobacterium avium
DPDPANVGRQF

SEQ ID NO: 62680 - protein, 8 aa, Mycobacterium avium
DPDPARTV

SEQ ID NO: 62681 - protein, 18 aa, Mycobacterium avium
DPDPDSSAGRDAQAAAAA

SEQ ID NO: 62682 - protein, 7 aa, Mycobacterium avium
DPDPGQW

SEQ ID NO: 62683 - protein, 5 aa, Mycobacterium avium
DPDRT

SEQ ID NO: 62684 - protein, 16 aa, Mycobacterium avium
DPDSSAGRDAQAAAAA

SEQ ID NO: 62685 - protein, 5 aa, Mycobacterium avium
DPDTA

SEQ ID NO: 62686 - protein, 11 aa, Mycobacterium avium
DPDTGASCPPG

SEQ ID NO: 62687 - protein, 21 aa, Mycobacterium avium
DPDWGGPAGPESSASDRGAGA

SEQ ID NO: 62688 - protein, 22 aa, Mycobacterium avium
DPDWGGPHPGRESVASDQGARN

SEQ ID NO: 62689 - protein, 9 aa, Mycobacterium avium
DPEAAHSVE

SEQ ID NO: 62690 - protein, 5 aa, Mycobacterium avium
DPEHQ

SEQ ID NO: 62691 - protein, 4 aa, Mycobacterium avium
DPEI

SEQ ID NO: 62692 - protein, 14 aa, Mycobacterium avium
DPEPSTTASQLGAP

SEQ ID NO: 62693 - protein, 15 aa, Mycobacterium avium
DPEPSTTASQLGAPT

SEQ ID NO: 62694 - protein, 16 aa, Mycobacterium avium
DPEQPAPYTEAGWIVH

SEQ ID NO: 62695 - protein, 4 aa, Mycobacterium avium
DPER

SEQ ID NO: 62696 - protein, 7 aa, Mycobacterium avium
DPESGRR

SEQ ID NO: 62697 - protein, 5 aa, Mycobacterium avium
DPETI

SEQ ID NO: 62698 - protein, 6 aa, Mycobacterium avium
DPEYAA

SEQ ID NO: 62699 - protein, 6 aa, Mycobacterium avium
DPFAPD

SEQ ID NO: 62700 - protein, 4 aa, Mycobacterium avium
DPFT

SEQ ID NO: 62701 - protein, 10 aa, Mycobacterium avium
DPGAASPKET

SEQ ID NO: 62702 - protein, 13 aa, Mycobacterium avium
DPGARHRDAEDDA

SEQ ID NO: 62703 - protein, 4 aa, Mycobacterium avium
DPGC

SEQ ID NO: 62704 - protein, 76 aa, Mycobacterium avium
DPGHSAPRPPNPPAAPPVPPARPTVPDPTVPTQSATQRMPAAAPPPVPPPPVPPPPPPVPPPAPPAPAPEPPKGPG

SEQ ID NO: 62705 - protein, 6 aa, Mycobacterium avium
DPGKHR

SEQ ID NO: 62706 - protein, 6 aa, Mycobacterium avium
DPGLGR

SEQ ID NO: 62707 - protein, 12 aa, Mycobacterium avium
DPGPAGGNTSIR

SEQ ID NO: 62708 - protein, 13 aa, Mycobacterium avium
DPGPAGGNTSISA

SEQ ID NO: 62709 - protein, 5 aa, Mycobacterium avium
DPGQH

SEQ ID NO: 62710 - protein, 4 aa, Mycobacterium avium
DPGR

SEQ ID NO: 62711 - protein, 13 aa, Mycobacterium avium
DPGRRPEVQRSAR

SEQ ID NO: 62712 - protein, 14 aa, Mycobacterium avium
DPGSGAELPAGRSG

SEQ ID NO: 62713 - protein, 8 aa, Mycobacterium avium
DPGTTIDG

SEQ ID NO: 62714 - protein, 4 aa, Mycobacterium avium
DPGV

SEQ ID NO: 62715 - protein, 18 aa, Mycobacterium avium
DPGVGRDGSSSDEEGPAA

SEQ ID NO: 62716 - protein, 9 aa, Mycobacterium avium
DPGVQRGSM

SEQ ID NO: 62717 - protein, 7 aa, Mycobacterium avium
DPHEPGH

SEQ ID NO: 62718 - protein, 11 aa, Mycobacterium avium
DPHGPLDRTHP

SEQ ID NO: 62719 - protein, 13 aa, Mycobacterium avium
DPHLRTGERPPGY

SEQ ID NO: 62720 - protein, 6 aa, Mycobacterium avium
DPHPRN

SEQ ID NO: 62721 - protein, 8 aa, Mycobacterium avium
DPHPRNTY

SEQ ID NO: 62722 - protein, 7 aa, Mycobacterium avium
DPHRTAE

SEQ ID NO: 62723 - protein, 5 aa, Mycobacterium avium
DPIDA

SEQ ID NO: 62724 - protein, 16 aa, Mycobacterium avium
DPIHPEADATNRSPRA

SEQ ID NO: 62725 - protein, 5 aa, Mycobacterium avium
DPITD

SEQ ID NO: 62726 - protein, 9 aa, Mycobacterium avium
DPKGSAEYS

SEQ ID NO: 62727 - protein, 9 aa, Mycobacterium avium
DPKGSAEYT

SEQ ID NO: 62728 - protein, 8 aa, Mycobacterium avium
DPKRLADE

SEQ ID NO: 62729 - protein, 11 aa, Mycobacterium avium
DPKRSDRADYR

SEQ ID NO: 62730 - protein, 4 aa, Mycobacterium avium
DPLG

SEQ ID NO: 62731 - protein, 7 aa, Mycobacterium avium
DPLGNPV

SEQ ID NO: 62732 - protein, 10 aa, Mycobacterium avium
DPLPATPRRE

SEQ ID NO: 62733 - protein, 16 aa, Mycobacterium avium
DPLPDAHGARRGVPQG

SEQ ID NO: 62734 - protein, 7 aa, Mycobacterium avium
DPLPDGE

SEQ ID NO: 62735 - protein, 5 aa, Mycobacterium avium
DPLQP

SEQ ID NO: 62736 - protein, 11 aa, Mycobacterium avium
DPLSGAAQPYG

SEQ ID NO: 62737 - protein, 4 aa, Mycobacterium avium
DPLT

SEQ ID NO: 62738 - protein, 8 aa, Mycobacterium avium
DPNAAERL

SEQ ID NO: 62739 - protein, 8 aa, Mycobacterium avium
DPNGAEDE

SEQ ID NO: 62740 - protein, 4 aa, Mycobacterium avium
DPNI

SEQ ID NO: 62741 - protein, 7 aa, Mycobacterium avium
DPNRPDH

SEQ ID NO: 62742 - protein, 8 aa, Mycobacterium avium
DPNTKTRV

SEQ ID NO: 62743 - protein, 11 aa, Mycobacterium avium
DPPAVPEEPRP

SEQ ID NO: 62744 - protein, 6 aa, Mycobacterium avium
DPPDHA

SEQ ID NO: 62745 - protein, 14 aa, Mycobacterium avium
DPPDKLRDAAQELA

SEQ ID NO: 62746 - protein, 13 aa, Mycobacterium avium
DPPDQWQETRGGQ

SEQ ID NO: 62747 - protein, 8 aa, Mycobacterium avium
DPPEDWSE

SEQ ID NO: 62748 - protein, 6 aa, Mycobacterium avium
DPPEHQ

SEQ ID NO: 62749 - protein, 7 aa, Mycobacterium avium
DPPEQTR

SEQ ID NO: 62750 - protein, 12 aa, Mycobacterium avium
DPPGLTTSEAAG

SEQ ID NO: 62751 - protein, 11 aa, Mycobacterium avium
DPPLRRPSGPM

SEQ ID NO: 62752 - protein, 7 aa, Mycobacterium avium
DPPPDMA

SEQ ID NO: 62753 - protein, 30 aa, Mycobacterium avium
DPPPLPAPAMPAAPPARNGSLSIGSLKGTT

SEQ ID NO: 62754 - protein, 22 aa, Mycobacterium avium
DPPPLPAPGTPAAPPARNGSLS

SEQ ID NO: 62755 - protein, 30 aa, Mycobacterium avium
DPPPLPAPGTPAAPPARNGSLSIGSLKGTT

SEQ ID NO: 62756 - protein, 8 aa, Mycobacterium avium
DPPPNDPV

SEQ ID NO: 62757 - protein, 7 aa, Mycobacterium avium
DPPPVGR

SEQ ID NO: 62758 - protein, 6 aa, Mycobacterium avium
DPPRAG

SEQ ID NO: 62759 - protein, 5 aa, Mycobacterium avium
DPPTA

SEQ ID NO: 62760 - protein, 11 aa, Mycobacterium avium
DPQDDQERAGR

SEQ ID NO: 62761 - protein, 12 aa, Mycobacterium avium
DPQDDQERAGRD

SEQ ID NO: 62762 - protein, 6 aa, Mycobacterium avium
DPQFED

SEQ ID NO: 62763 - protein, 7 aa, Mycobacterium avium
DPQRTAE

SEQ ID NO: 62764 - protein, 7 aa, Mycobacterium avium
DPQSELA

SEQ ID NO: 62765 - protein, 22 aa, Mycobacterium avium
DPQTLPRSGQLRSAAVQPNSAL

SEQ ID NO: 62766 - protein, 25 aa, Mycobacterium avium
DPRARGAEDDVVPAGQRGQHHRPGR

SEQ ID NO: 62767 - protein, 6 aa, Mycobacterium avium
DPRARS

SEQ ID NO: 62768 - protein, 6 aa, Mycobacterium avium
DPRDSN

SEQ ID NO: 62769 - protein, 4 aa, Mycobacterium avium
DPRE

SEQ ID NO: 62770 - protein, 27 aa, Mycobacterium avium
DPREPEELPPDWAPDEPAYQPLPDDPP

SEQ ID NO: 62771 - protein, 5 aa, Mycobacterium avium
DPREQ

SEQ ID NO: 62772 - protein, 6 aa, Mycobacterium avium
DPRESL

SEQ ID NO: 62773 - protein, 9 aa, Mycobacterium avium
DPRFSGDPA

SEQ ID NO: 62774 - protein, 7 aa, Mycobacterium avium
DPRGPQY

SEQ ID NO: 62775 - protein, 6 aa, Mycobacterium avium
DPRHGP

SEQ ID NO: 62776 - protein, 16 aa, Mycobacterium avium
DPRIPQREHEPGHDQS

SEQ ID NO: 62777 - protein, 12 aa, Mycobacterium avium
DPRIQDRPATAL

SEQ ID NO: 62778 - protein, 17 aa, Mycobacterium avium
DPRIQDRPATALPVPAA

SEQ ID NO: 62779 - protein, 7 aa, Mycobacterium avium
DPRLAGS

SEQ ID NO: 62780 - protein, 4 aa, Mycobacterium avium
DPRM

SEQ ID NO: 62781 - protein, 4 aa, Mycobacterium avium
DPRR

SEQ ID NO: 62782 - protein, 8 aa, Mycobacterium avium
DPRSGEQR

SEQ ID NO: 62783 - protein, 5 aa, Mycobacterium avium
DPRWG

SEQ ID NO: 62784 - protein, 11 aa, Mycobacterium avium
DPRYPANTERL

SEQ ID NO: 62785 - protein, 13 aa, Mycobacterium avium
DPSAGGPGAYDTP

SEQ ID NO: 62786 - protein, 11 aa, Mycobacterium avium
DPSERQRLDDI

SEQ ID NO: 62787 - protein, 9 aa, Mycobacterium avium
DPSLGSGRE

SEQ ID NO: 62788 - protein, 9 aa, Mycobacterium avium
DPSLGSGRQ

SEQ ID NO: 62789 - protein, 21 aa, Mycobacterium avium
DPSLNEQSRRRIQAAGGEQLD

SEQ ID NO: 62790 - protein, 102 aa, Mycobacterium avium
DPSPTGAPGTQPVSGQTPGGVDQAVPGGTPPPAAPADATPQKPHDPAAGAPAPSGGVPSAGTPGAPKPTATGGGPSSAEATQTGVGQPSPSPSTSALDPTAV

SEQ ID NO: 62791 - protein, 20 aa, Mycobacterium avium
DPSSHPEEFPTEELQRKERE

SEQ ID NO: 62792 - protein, 9 aa, Mycobacterium avium
DPSSPFSGG

SEQ ID NO: 62793 - protein, 32 aa, Mycobacterium avium
DPSSQPSTESSRSSGSSPSAHVRRRGDGPRPQ

SEQ ID NO: 62794 - protein, 13 aa, Mycobacterium avium
DPSTAVKRTYKRR

SEQ ID NO: 62795 - protein, 9 aa, Mycobacterium avium
DPSTGTRRR

SEQ ID NO: 62796 - protein, 9 aa, Mycobacterium avium
DPTAAEGSV

SEQ ID NO: 62797 - protein, 8 aa, Mycobacterium avium
DPTAGMES

SEQ ID NO: 62798 - protein, 9 aa, Mycobacterium avium
DPTAGVESG

SEQ ID NO: 62799 - protein, 9 aa, Mycobacterium avium
DPTAPAARG

SEQ ID NO: 62800 - protein, 21 aa, Mycobacterium avium
DPTASANTVADSRYSRMTTPA

SEQ ID NO: 62801 - protein, 13 aa, Mycobacterium avium
DPTEFSDDTARAL

SEQ ID NO: 62802 - protein, 6 aa, Mycobacterium avium
DPTFTP

SEQ ID NO: 62803 - protein, 7 aa, Mycobacterium avium
DPTGSRW

SEQ ID NO: 62804 - protein, 8 aa, Mycobacterium avium
DPTPWSEA

SEQ ID NO: 62805 - protein, 7 aa, Mycobacterium avium
DPTSGRD

SEQ ID NO: 62806 - protein, 10 aa, Mycobacterium avium
DPTSRTGQQW

SEQ ID NO: 62807 - protein, 7 aa, Mycobacterium avium
DPTTEGG

SEQ ID NO: 62808 - protein, 5 aa, Mycobacterium avium
DPTVA

SEQ ID NO: 62809 - protein, 18 aa, Mycobacterium avium
DPVAAAAREELDESTRAS

SEQ ID NO: 62810 - protein, 8 aa, Mycobacterium avium
DPVAKKST

SEQ ID NO: 62811 - protein, 4 aa, Mycobacterium avium
DPVG

SEQ ID NO: 62812 - protein, 6 aa, Mycobacterium avium
DPVGPR

SEQ ID NO: 62813 - protein, 11 aa, Mycobacterium avium
DPVPTGGDNPH

SEQ ID NO: 62814 - protein, 11 aa, Mycobacterium avium
DPVRRTRGDVE

SEQ ID NO: 62815 - protein, 5 aa, Mycobacterium avium
DPVRV

SEQ ID NO: 62816 - protein, 6 aa, Mycobacterium avium
DPVTPG

SEQ ID NO: 62817 - protein, 6 aa, Mycobacterium avium
DPVVRG

SEQ ID NO: 62818 - protein, 20 aa, Mycobacterium avium
DPVYAPNSAGGPHADPARAG

SEQ ID NO: 62819 - protein, 10 aa, Mycobacterium avium
DQAAPAPRFS

SEQ ID NO: 62820 - protein, 31 aa, Mycobacterium avium
DQAAPAPRFSHTPARPVGRPPATSTPLDEIN

SEQ ID NO: 62821 - protein, 31 aa, Mycobacterium avium
DQAAPAPRFSHTPARPVGRPPATTTPLDEIN

SEQ ID NO: 62822 - protein, 7 aa, Mycobacterium avium
DQAQPAR

SEQ ID NO: 62823 - protein, 11 aa, Mycobacterium avium
DQARKTDPQLA

SEQ ID NO: 62824 - protein, 9 aa, Mycobacterium avium
DQARRALDA

SEQ ID NO: 62825 - protein, 13 aa, Mycobacterium avium
DQASAAATAAEHP

SEQ ID NO: 62826 - protein, 5 aa, Mycobacterium avium
DQASC

SEQ ID NO: 62827 - protein, 8 aa, Mycobacterium avium
DQASCASA

SEQ ID NO: 62828 - protein, 18 aa, Mycobacterium avium
DQASCASAIGEAADALGG

SEQ ID NO: 62829 - protein, 5 aa, Mycobacterium avium
DQAVA

SEQ ID NO: 62830 - protein, 8 aa, Mycobacterium avium
DQAVTGES

SEQ ID NO: 62831 - protein, 6 aa, Mycobacterium avium
DQDALR

SEQ ID NO: 62832 - protein, 5 aa, Mycobacterium avium
DQDEV

SEQ ID NO: 62833 - protein, 7 aa, Mycobacterium avium
DQDNATR

SEQ ID NO: 62834 - protein, 6 aa, Mycobacterium avium
DQDSLN

SEQ ID NO: 62835 - protein, 7 aa, Mycobacterium avium
DQDTEGL

SEQ ID NO: 62836 - protein, 13 aa, Mycobacterium avium
DQEKAQARATDPL

SEQ ID NO: 62837 - protein, 23 aa, Mycobacterium avium
DQEPGSDHGAHGEFDDTSHAHSP

SEQ ID NO: 62838 - protein, 7 aa, Mycobacterium avium
DQEPQRP

SEQ ID NO: 62839 - protein, 21 aa, Mycobacterium avium
DQEQGKTEEIAYTPAKTTASV

SEQ ID NO: 62840 - protein, 4 aa, Mycobacterium avium
DQFG

SEQ ID NO: 62841 - protein, 16 aa, Mycobacterium avium
DQGDQIADKIVAKIDN

SEQ ID NO: 62842 - protein, 7 aa, Mycobacterium avium
DQGTTAS

SEQ ID NO: 62843 - protein, 5 aa, Mycobacterium avium
DQHGR

SEQ ID NO: 62844 - protein, 6 aa, Mycobacterium avium
DQLGAS

SEQ ID NO: 62845 - protein, 8 aa, Mycobacterium avium
DQLNPTGG

SEQ ID NO: 62846 - protein, 4 aa, Mycobacterium avium
DQLP

SEQ ID NO: 62847 - protein, 12 aa, Mycobacterium avium
DQLPQDAGSRGG

SEQ ID NO: 62848 - protein, 12 aa, Mycobacterium avium
DQLTPSGSPDAV

SEQ ID NO: 62849 - protein, 18 aa, Mycobacterium avium
DQNRQQAEVDRPGTSESH

SEQ ID NO: 62850 - protein, 6 aa, Mycobacterium avium
DQPAER

SEQ ID NO: 62851 - protein, 14 aa, Mycobacterium avium
DQPEPADAGQPGAL

SEQ ID NO: 62852 - protein, 14 aa, Mycobacterium avium
DQPETPIPDESEGD

SEQ ID NO: 62853 - protein, 14 aa, Mycobacterium avium
DQPPLHPASHPGLA

SEQ ID NO: 62854 - protein, 8 aa, Mycobacterium avium
DQPRDRAE

SEQ ID NO: 62855 - protein, 12 aa, Mycobacterium avium
DQPRSKPAAEVA

SEQ ID NO: 62856 - protein, 5 aa, Mycobacterium avium
DQPVG

SEQ ID NO: 62857 - protein, 18 aa, Mycobacterium avium
DQQESHNRDAQVSCLDKS

SEQ ID NO: 62858 - protein, 7 aa, Mycobacterium avium
DQQNATE

SEQ ID NO: 62859 - protein, 10 aa, Mycobacterium avium
DQRAAEQLGA

SEQ ID NO: 62860 - protein, 8 aa, Mycobacterium avium
DQREDEAA

SEQ ID NO: 62861 - protein, 9 aa, Mycobacterium avium
DQRGDDMTR

SEQ ID NO: 62862 - protein, 6 aa, Mycobacterium avium
DQRGDI

SEQ ID NO: 62863 - protein, 15 aa, Mycobacterium avium
DQRGLRGDVCGHGQA

SEQ ID NO: 62864 - protein, 7 aa, Mycobacterium avium
DQRPDIS

SEQ ID NO: 62865 - protein, 8 aa, Mycobacterium avium
DQRPTFRE

SEQ ID NO: 62866 - protein, 6 aa, Mycobacterium avium
DQRSDI

SEQ ID NO: 62867 - protein, 16 aa, Mycobacterium avium
DQSGNPLLDSNDDPIP

SEQ ID NO: 62868 - protein, 12 aa, Mycobacterium avium
DQYHAPASAVEQ

SEQ ID NO: 62869 - protein, 8 aa, Mycobacterium avium
DRAAAQDA

SEQ ID NO: 62870 - protein, 5 aa, Mycobacterium avium
DRAAL

SEQ ID NO: 62871 - protein, 7 aa, Mycobacterium avium
DRAATDA

SEQ ID NO: 62872 - protein, 4 aa, Mycobacterium avium
DRAD

SEQ ID NO: 62873 - protein, 7 aa, Mycobacterium avium
DRADAPV

SEQ ID NO: 62874 - protein, 8 aa, Mycobacterium avium
DRAEGARV

SEQ ID NO: 62875 - protein, 6 aa, Mycobacterium avium
DRAEME

SEQ ID NO: 62876 - protein, 12 aa, Mycobacterium avium
DRAEPPAAPSLD

SEQ ID NO: 62877 - protein, 7 aa, Mycobacterium avium
DRAGAGA

SEQ ID NO: 62878 - protein, 10 aa, Mycobacterium avium
DRAGPTYTRD

SEQ ID NO: 62879 - protein, 5 aa, Mycobacterium avium
DRALR

SEQ ID NO: 62880 - protein, 12 aa, Mycobacterium avium
DRAPDDDRANAL

SEQ ID NO: 62881 - protein, 6 aa, Mycobacterium avium
DRAPFR

SEQ ID NO: 62882 - protein, 9 aa, Mycobacterium avium
DRATGAAKK

SEQ ID NO: 62883 - protein, 6 aa, Mycobacterium avium
DRDEER

SEQ ID NO: 62884 - protein, 4 aa, Mycobacterium avium
DRDG

SEQ ID NO: 62885 - protein, 8 aa, Mycobacterium avium
DRDGDKLD

SEQ ID NO: 62886 - protein, 6 aa, Mycobacterium avium
DRDGEA

SEQ ID NO: 62887 - protein, 24 aa, Mycobacterium avium
DRDGLQPAVQHPGAHARDRGADAH

SEQ ID NO: 62888 - protein, 9 aa, Mycobacterium avium
DRDGPGCGA

SEQ ID NO: 62889 - protein, 7 aa, Mycobacterium avium
DRDNTER

SEQ ID NO: 62890 - protein, 8 aa, Mycobacterium avium
DRDNTERV

SEQ ID NO: 62891 - protein, 16 aa, Mycobacterium avium
DRDPLGNAGGAGGVDD

SEQ ID NO: 62892 - protein, 5 aa, Mycobacterium avium
DRDRT

SEQ ID NO: 62893 - protein, 28 aa, Mycobacterium avium
DRERSGVDENGDSSGAANEFSGGGAQGS

SEQ ID NO: 62894 - protein, 8 aa, Mycobacterium avium
DRFGPAAA

SEQ ID NO: 62895 - protein, 13 aa, Mycobacterium avium
DRFPNGLGNNDYQ

SEQ ID NO: 62896 - protein, 8 aa, Mycobacterium avium
DRGAELTY

SEQ ID NO: 62897 - protein, 9 aa, Mycobacterium avium
DRGAGGGAY

SEQ ID NO: 62898 - protein, 8 aa, Mycobacterium avium
DRGARTND

SEQ ID NO: 62899 - protein, 10 aa, Mycobacterium avium
DRGDQPHGRQ

SEQ ID NO: 62900 - protein, 11 aa, Mycobacterium avium
DRGEAHPDVDP

SEQ ID NO: 62901 - protein, 11 aa, Mycobacterium avium
DRGEAHRDVDP

SEQ ID NO: 62902 - protein, 11 aa, Mycobacterium avium
DRGHGSSVPAR

SEQ ID NO: 62903 - protein, 8 aa, Mycobacterium avium
DRGLAPRA

SEQ ID NO: 62904 - protein, 10 aa, Mycobacterium avium
DRGLTPQPAA

SEQ ID NO: 62905 - protein, 18 aa, Mycobacterium avium
DRGQRGQAPRVGAGTHPQ

SEQ ID NO: 62906 - protein, 7 aa, Mycobacterium avium
DRGRGPF

SEQ ID NO: 62907 - protein, 6 aa, Mycobacterium avium
DRGYTE

SEQ ID NO: 62908 - protein, 4 aa, Mycobacterium avium
DRHA

SEQ ID NO: 62909 - protein, 13 aa, Mycobacterium avium
DRHATAKDRNGKV

SEQ ID NO: 62910 - protein, 11 aa, Mycobacterium avium
DRHGGSTLEEK

SEQ ID NO: 62911 - protein, 7 aa, Mycobacterium avium
DRHPDRA

SEQ ID NO: 62912 - protein, 24 aa, Mycobacterium avium
DRHRGGRSAEIRPGRLAGNAGPLG

SEQ ID NO: 62913 - protein, 6 aa, Mycobacterium avium
DRHYTN

SEQ ID NO: 62914 - protein, 4 aa, Mycobacterium avium
DRID

SEQ ID NO: 62915 - protein, 6 aa, Mycobacterium avium
DRITGP

SEQ ID NO: 62916 - protein, 9 aa, Mycobacterium avium
DRKAFGQPI

SEQ ID NO: 62917 - protein, 8 aa, Mycobacterium avium
DRKAFGQS

SEQ ID NO: 62918 - protein, 5 aa, Mycobacterium avium
DRLAR

SEQ ID NO: 62919 - protein, 8 aa, Mycobacterium avium
DRLGREHP

SEQ ID NO: 62920 - protein, 6 aa, Mycobacterium avium
DRLQAE

SEQ ID NO: 62921 - protein, 12 aa, Mycobacterium avium
DRLRAKARPGVT

SEQ ID NO: 62922 - protein, 8 aa, Mycobacterium avium
DRLTEGAA

SEQ ID NO: 62923 - protein, 4 aa, Mycobacterium avium
DRNE

SEQ ID NO: 62924 - protein, 8 aa, Mycobacterium avium
DRNGAPPV

SEQ ID NO: 62925 - protein, 5 aa, Mycobacterium avium
DRNPA

SEQ ID NO: 62926 - protein, 23 aa, Mycobacterium avium
DRNPSPESLDEAQAKIRAALAQL

SEQ ID NO: 62927 - protein, 8 aa, Mycobacterium avium
DRNQPRTN

SEQ ID NO: 62928 - protein, 5 aa, Mycobacterium avium
DRPAA

SEQ ID NO: 62929 - protein, 9 aa, Mycobacterium avium
DRPAAQRFT

SEQ ID NO: 62930 - protein, 18 aa, Mycobacterium avium
DRPAGRGGTVVRTASRWH

SEQ ID NO: 62931 - protein, 51 aa, Mycobacterium avium
DRPAPPDAPAPDAPPPAPADLPPAPADLPPAPPADATPPAPPADAPAPDGD

SEQ ID NO: 62932 - protein, 8 aa, Mycobacterium avium
DRPATRTS

SEQ ID NO: 62933 - protein, 15 aa, Mycobacterium avium
DRPDRFTKAASSDAD

SEQ ID NO: 62934 - protein, 7 aa, Mycobacterium avium
DRPDSGG

SEQ ID NO: 62935 - protein, 9 aa, Mycobacterium avium
DRPEDRWPE

SEQ ID NO: 62936 - protein, 7 aa, Mycobacterium avium
DRPEIQA

SEQ ID NO: 62937 - protein, 7 aa, Mycobacterium avium
DRPGGVQ

SEQ ID NO: 62938 - protein, 7 aa, Mycobacterium avium
DRPGHLR

SEQ ID NO: 62939 - protein, 7 aa, Mycobacterium avium
DRPINSA

SEQ ID NO: 62940 - protein, 16 aa, Mycobacterium avium
DRPRPGDDLPLPDDPP

SEQ ID NO: 62941 - protein, 16 aa, Mycobacterium avium
DRPRPGDGLPLPDDPP

SEQ ID NO: 62942 - protein, 6 aa, Mycobacterium avium
DRPTGV

SEQ ID NO: 62943 - protein, 6 aa, Mycobacterium avium
DRQRGI

SEQ ID NO: 62944 - protein, 8 aa, Mycobacterium avium
DRQRPAAG

SEQ ID NO: 62945 - protein, 7 aa, Mycobacterium avium
DRQSDAL

SEQ ID NO: 62946 - protein, 27 aa, Mycobacterium avium
DRQVGGAGLEHPQDRDDRLGRPRKQQC

SEQ ID NO: 62947 - protein, 10 aa, Mycobacterium avium
DRRATDPADA

SEQ ID NO: 62948 - protein, 4 aa, Mycobacterium avium
DRRD

SEQ ID NO: 62949 - protein, 7 aa, Mycobacterium avium
DRRDQLE

SEQ ID NO: 62950 - protein, 8 aa, Mycobacterium avium
DRREDGYH

SEQ ID NO: 62951 - protein, 7 aa, Mycobacterium avium
DRREQAR

SEQ ID NO: 62952 - protein, 6 aa, Mycobacterium avium
DRREVA

SEQ ID NO: 62953 - protein, 10 aa, Mycobacterium avium
DRRGRGEKRV

SEQ ID NO: 62954 - protein, 4 aa, Mycobacterium avium
DRRL

SEQ ID NO: 62955 - protein, 12 aa, Mycobacterium avium
DRRLGEAETPGL

SEQ ID NO: 62956 - protein, 21 aa, Mycobacterium avium
DRRLGRGAEHQRHHAGQHRGQ

SEQ ID NO: 62957 - protein, 29 aa, Mycobacterium avium
DRRLSRPGRAPNTAQQHTGATRWPSKHST

SEQ ID NO: 62958 - protein, 14 aa, Mycobacterium avium
DRRPTLENGATRAY

SEQ ID NO: 62959 - protein, 13 aa, Mycobacterium avium
DRRQQPVGLGPRR

SEQ ID NO: 62960 - protein, 7 aa, Mycobacterium avium
DRRQRPC

SEQ ID NO: 62961 - protein, 25 aa, Mycobacterium avium
DRRRGGGLQRRHRRGADQDAVDRHQ

SEQ ID NO: 62962 - protein, 24 aa, Mycobacterium avium
DRRRPGSGAHRGGDRGGANTNGAL

SEQ ID NO: 62963 - protein, 9 aa, Mycobacterium avium
DRRVGPGQV

SEQ ID NO: 62964 - protein, 12 aa, Mycobacterium avium
DRRVPGAGQAAH

SEQ ID NO: 62965 - protein, 28 aa, Mycobacterium avium
DRRVQPRAQRRGDFVPRDDASNTSGSVT

SEQ ID NO: 62966 - protein, 7 aa, Mycobacterium avium
DRSAYDD

SEQ ID NO: 62967 - protein, 12 aa, Mycobacterium avium
DRSCPEPEPLSP

SEQ ID NO: 62968 - protein, 13 aa, Mycobacterium avium
DRSDRAPAPDLNA

SEQ ID NO: 62969 - protein, 12 aa, Mycobacterium avium
DRSDREPAPDLN

SEQ ID NO: 62970 - protein, 7 aa, Mycobacterium avium
DRSETAR

SEQ ID NO: 62971 - protein, 7 aa, Mycobacterium avium
DRSGGSV

SEQ ID NO: 62972 - protein, 35 aa, Mycobacterium avium
DRSGRCDARPGWPVSGPRSAGCSRSAAGISRTSTR

SEQ ID NO: 62973 - protein, 6 aa, Mycobacterium avium
DRSGSY

SEQ ID NO: 62974 - protein, 6 aa, Mycobacterium avium
DRSPAT

SEQ ID NO: 62975 - protein, 7 aa, Mycobacterium avium
DRSQLTY

SEQ ID NO: 62976 - protein, 5 aa, Mycobacterium avium
DRSRP

SEQ ID NO: 62977 - protein, 15 aa, Mycobacterium avium
DRSTESTRAPASRDE

SEQ ID NO: 62978 - protein, 6 aa, Mycobacterium avium
DRSVRG

SEQ ID NO: 62979 - protein, 8 aa, Mycobacterium avium
DRTAPPTL

SEQ ID NO: 62980 - protein, 6 aa, Mycobacterium avium
DRTCES

SEQ ID NO: 62981 - protein, 10 aa, Mycobacterium avium
DRTGKRGGAG

SEQ ID NO: 62982 - protein, 8 aa, Mycobacterium avium
DRTGLSAQ

SEQ ID NO: 62983 - protein, 5 aa, Mycobacterium avium
DRTGR

SEQ ID NO: 62984 - protein, 6 aa, Mycobacterium avium
DRTLPA

SEQ ID NO: 62985 - protein, 8 aa, Mycobacterium avium
DRTPARTW

SEQ ID NO: 62986 - protein, 4 aa, Mycobacterium avium
DRTR

SEQ ID NO: 62987 - protein, 10 aa, Mycobacterium avium
DRTRGRADTY

SEQ ID NO: 62988 - protein, 10 aa, Mycobacterium avium
DRTRRYAPQG

SEQ ID NO: 62989 - protein, 5 aa, Mycobacterium avium
DRTTQ

SEQ ID NO: 62990 - protein, 7 aa, Mycobacterium avium
DRVAGAD

SEQ ID NO: 62991 - protein, 4 aa, Mycobacterium avium
DRVP

SEQ ID NO: 62992 - protein, 12 aa, Mycobacterium avium
DRVPDDLRDQAK

SEQ ID NO: 62993 - protein, 12 aa, Mycobacterium avium
DRVPDDLRDQAR

SEQ ID NO: 62994 - protein, 11 aa, Mycobacterium avium
DRYHTDDDGSY

SEQ ID NO: 62995 - protein, 10 aa, Mycobacterium avium
DRYRAPSTAV

SEQ ID NO: 62996 - protein, 5 aa, Mycobacterium avium
DRYRD

SEQ ID NO: 62997 - protein, 19 aa, Mycobacterium avium
DSAAKKGNSTLYATGSEPG

SEQ ID NO: 62998 - protein, 5 aa, Mycobacterium avium
DSAES

SEQ ID NO: 62999 - protein, 10 aa, Mycobacterium avium
DSAGADADAM

SEQ ID NO: 63000 - protein, 12 aa, Mycobacterium avium
DSAGGRGDVRPH

SEQ ID NO: 63001 - protein, 13 aa, Mycobacterium avium
DSAPKASAEAPIP

SEQ ID NO: 63002 - protein, 7 aa, Mycobacterium avium
DSAYGTR

SEQ ID NO: 63003 - protein, 16 aa, Mycobacterium avium
DSCPTAAPPSGGTPDW

SEQ ID NO: 63004 - protein, 5 aa, Mycobacterium avium
DSDAD

SEQ ID NO: 63005 - protein, 5 aa, Mycobacterium avium
DSDDL

SEQ ID NO: 63006 - protein, 10 aa, Mycobacterium avium
DSDDPEFGEE

SEQ ID NO: 63007 - protein, 9 aa, Mycobacterium avium
DSDDPHKVA

SEQ ID NO: 63008 - protein, 9 aa, Mycobacterium avium
DSDDRTRDA

SEQ ID NO: 63009 - protein, 9 aa, Mycobacterium avium
DSDEGWATG

SEQ ID NO: 63010 - protein, 6 aa, Mycobacterium avium
DSDEYA

SEQ ID NO: 63011 - protein, 10 aa, Mycobacterium avium
DSDGDGVGDI

SEQ ID NO: 63012 - protein, 15 aa, Mycobacterium avium
DSDGEQGRITDPGRI

SEQ ID NO: 63013 - protein, 6 aa, Mycobacterium avium
DSDGFA

SEQ ID NO: 63014 - protein, 7 aa, Mycobacterium avium
DSDIQQD

SEQ ID NO: 63015 - protein, 9 aa, Mycobacterium avium
DSDLPDRSI

SEQ ID NO: 63016 - protein, 6 aa, Mycobacterium avium
DSDPFY

SEQ ID NO: 63017 - protein, 10 aa, Mycobacterium avium
DSDRISGGGL

SEQ ID NO: 63018 - protein, 15 aa, Mycobacterium avium
DSDRISGGGLTAALS

SEQ ID NO: 63019 - protein, 13 aa, Mycobacterium avium
DSDTDGSDHEAAL

SEQ ID NO: 63020 - protein, 14 aa, Mycobacterium avium
DSDTDGSDREAALP

SEQ ID NO: 63021 - protein, 6 aa, Mycobacterium avium
DSDTWR

SEQ ID NO: 63022 - protein, 4 aa, Mycobacterium avium
DSEE

SEQ ID NO: 63023 - protein, 5 aa, Mycobacterium avium
DSEID

SEQ ID NO: 63024 - protein, 4 aa, Mycobacterium avium
DSEL

SEQ ID NO: 63025 - protein, 15 aa, Mycobacterium avium
DSERISGGGLTAALS

SEQ ID NO: 63026 - protein, 9 aa, Mycobacterium avium
DSEYRGDGR

SEQ ID NO: 63027 - protein, 7 aa, Mycobacterium avium
DSGAHGV

SEQ ID NO: 63028 - protein, 13 aa, Mycobacterium avium
DSGARGLDDGRNW

SEQ ID NO: 63029 - protein, 9 aa, Mycobacterium avium
DSGDLTSPA

SEQ ID NO: 63030 - protein, 9 aa, Mycobacterium avium
DSGDPQLGE

SEQ ID NO: 63031 - protein, 9 aa, Mycobacterium avium
DSGDTSSAA

SEQ ID NO: 63032 - protein, 8 aa, Mycobacterium avium
DSGEQPVP

SEQ ID NO: 63033 - protein, 4 aa, Mycobacterium avium
DSGF

SEQ ID NO: 63034 - protein, 10 aa, Mycobacterium avium
DSGNAQEDQS

SEQ ID NO: 63035 - protein, 10 aa, Mycobacterium avium
DSGNAQQDQS

SEQ ID NO: 63036 - protein, 6 aa, Mycobacterium avium
DSGNGL

SEQ ID NO: 63037 - protein, 8 aa, Mycobacterium avium
DSGNSTQG

SEQ ID NO: 63038 - protein, 8 aa, Mycobacterium avium
DSGPATLQ

SEQ ID NO: 63039 - protein, 8 aa, Mycobacterium avium
DSGPGIEG

SEQ ID NO: 63040 - protein, 6 aa, Mycobacterium avium
DSGQLD

SEQ ID NO: 63041 - protein, 5 aa, Mycobacterium avium
DSGQP

SEQ ID NO: 63042 - protein, 9 aa, Mycobacterium avium
DSGRPYHPD

SEQ ID NO: 63043 - protein, 4 aa, Mycobacterium avium
DSGV

SEQ ID NO: 63044 - protein, 7 aa, Mycobacterium avium
DSHEPGH

SEQ ID NO: 63045 - protein, 12 aa, Mycobacterium avium
DSIGNDAPGLNV

SEQ ID NO: 63046 - protein, 12 aa, Mycobacterium avium
DSIGNDTPGLNV

SEQ ID NO: 63047 - protein, 5 aa, Mycobacterium avium
DSIHD

SEQ ID NO: 63048 - protein, 4 aa, Mycobacterium avium
DSIT

SEQ ID NO: 63049 - protein, 9 aa, Mycobacterium avium
DSKSQAESA

SEQ ID NO: 63050 - protein, 7 aa, Mycobacterium avium
DSKYGLA

SEQ ID NO: 63051 - protein, 12 aa, Mycobacterium avium
DSLAAAKSKSAL

SEQ ID NO: 63052 - protein, 15 aa, Mycobacterium avium
DSLAEQSRRNPDGTG

SEQ ID NO: 63053 - protein, 8 aa, Mycobacterium avium
DSLAHPER

SEQ ID NO: 63054 - protein, 6 aa, Mycobacterium avium
DSLGPP

SEQ ID NO: 63055 - protein, 11 aa, Mycobacterium avium
DSLRSTRPALD

SEQ ID NO: 63056 - protein, 7 aa, Mycobacterium avium
DSLSSAA

SEQ ID NO: 63057 - protein, 6 aa, Mycobacterium avium
DSNERL

SEQ ID NO: 63058 - protein, 8 aa, Mycobacterium avium
DSNPPEAL

SEQ ID NO: 63059 - protein, 18 aa, Mycobacterium avium
DSNPTHTGLRSAATRGAT

SEQ ID NO: 63060 - protein, 7 aa, Mycobacterium avium
DSNRSRQ

SEQ ID NO: 63061 - protein, 9 aa, Mycobacterium avium
DSPAGDGEL

SEQ ID NO: 63062 - protein, 15 aa, Mycobacterium avium
DSPDGPDGVTSPEVP

SEQ ID NO: 63063 - protein, 35 aa, Mycobacterium avium
DSPDGPDGVTSPEVPEAHAEPAAHEETREETDAEL

SEQ ID NO: 63064 - protein, 9 aa, Mycobacterium avium
DSPDSGSIR

SEQ ID NO: 63065 - protein, 6 aa, Mycobacterium avium
DSPEGR

SEQ ID NO: 63066 - protein, 6 aa, Mycobacterium avium
DSPEQL

SEQ ID NO: 63067 - protein, 5 aa, Mycobacterium avium
DSPGF

SEQ ID NO: 63068 - protein, 9 aa, Mycobacterium avium
DSPNATAAI

SEQ ID NO: 63069 - protein, 7 aa, Mycobacterium avium
DSPSFDG

SEQ ID NO: 63070 - protein, 7 aa, Mycobacterium avium
DSPSYDG

SEQ ID NO: 63071 - protein, 5 aa, Mycobacterium avium
DSPVP

SEQ ID NO: 63072 - protein, 25 aa, Mycobacterium avium
DSPVPAGSGWPGDPATPQTPVAADA

SEQ ID NO: 63073 - protein, 11 aa, Mycobacterium avium
DSPYQPPANPD

SEQ ID NO: 63074 - protein, 5 aa, Mycobacterium avium
DSQRE

SEQ ID NO: 63075 - protein, 11 aa, Mycobacterium avium
DSQSEGTRRAY

SEQ ID NO: 63076 - protein, 5 aa, Mycobacterium avium
DSQVK

SEQ ID NO: 63077 - protein, 6 aa, Mycobacterium avium
DSRDER

SEQ ID NO: 63078 - protein, 10 aa, Mycobacterium avium
DSRDPDPRAA

SEQ ID NO: 63079 - protein, 10 aa, Mycobacterium avium
DSRDPGPRAA

SEQ ID NO: 63080 - protein, 7 aa, Mycobacterium avium
DSRPDAV

SEQ ID NO: 63081 - protein, 5 aa, Mycobacterium avium
DSRSR

SEQ ID NO: 63082 - protein, 8 aa, Mycobacterium avium
DSRTERNR

SEQ ID NO: 63083 - protein, 10 aa, Mycobacterium avium
DSRTRNPQYD

SEQ ID NO: 63084 - protein, 20 aa, Mycobacterium avium
DSSGAPEESLQETEARQAEG

SEQ ID NO: 63085 - protein, 9 aa, Mycobacterium avium
DSSLSYTGI

SEQ ID NO: 63086 - protein, 10 aa, Mycobacterium avium
DSSNAQEAQS

SEQ ID NO: 63087 - protein, 8 aa, Mycobacterium avium
DSSTYRTV

SEQ ID NO: 63088 - protein, 6 aa, Mycobacterium avium
DSTASD

SEQ ID NO: 63089 - protein, 5 aa, Mycobacterium avium
DSTGH

SEQ ID NO: 63090 - protein, 6 aa, Mycobacterium avium
DSTGLT

SEQ ID NO: 63091 - protein, 8 aa, Mycobacterium avium
DSTGSAGE

SEQ ID NO: 63092 - protein, 7 aa, Mycobacterium avium
DSTPEGF

SEQ ID NO: 63093 - protein, 7 aa, Mycobacterium avium
DSVEVSS

SEQ ID NO: 63094 - protein, 18 aa, Mycobacterium avium
DSVGQAVRRASAGGGPSL

SEQ ID NO: 63095 - protein, 7 aa, Mycobacterium avium
DSVGVGS

SEQ ID NO: 63096 - protein, 7 aa, Mycobacterium avium
DSVPTAE

SEQ ID NO: 63097 - protein, 5 aa, Mycobacterium avium
DSVPV

SEQ ID NO: 63098 - protein, 6 aa, Mycobacterium avium
DSVSAT

SEQ ID NO: 63099 - protein, 17 aa, Mycobacterium avium
DSYPHRGLAPGSSGDYN

SEQ ID NO: 63100 - protein, 7 aa, Mycobacterium avium
DSYRAAD

SEQ ID NO: 63101 - protein, 8 aa, Mycobacterium avium
DSYRTDAP

SEQ ID NO: 63102 - protein, 9 aa, Mycobacterium avium
DSYRTDAPE

SEQ ID NO: 63103 - protein, 4 aa, Mycobacterium avium
DTAA

SEQ ID NO: 63104 - protein, 5 aa, Mycobacterium avium
DTAER

SEQ ID NO: 63105 - protein, 18 aa, Mycobacterium avium
DTAKGRRPSWNAAAPAAI

SEQ ID NO: 63106 - protein, 7 aa, Mycobacterium avium
DTAPDGL

SEQ ID NO: 63107 - protein, 9 aa, Mycobacterium avium
DTAPPSDNT

SEQ ID NO: 63108 - protein, 19 aa, Mycobacterium avium
DTARERVGGQVGTGRRKLS

SEQ ID NO: 63109 - protein, 29 aa, Mycobacterium avium
DTASAAARSRAASAAAAYTKSAAAKVAGT

SEQ ID NO: 63110 - protein, 8 aa, Mycobacterium avium
DTATTTGM

SEQ ID NO: 63111 - protein, 5 aa, Mycobacterium avium
DTAVG

SEQ ID NO: 63112 - protein, 5 aa, Mycobacterium avium
DTAVQ

SEQ ID NO: 63113 - protein, 5 aa, Mycobacterium avium
DTAVS

SEQ ID NO: 63114 - protein, 4 aa, Mycobacterium avium
DTDA

SEQ ID NO: 63115 - protein, 15 aa, Mycobacterium avium
DTDAKVAGSPAELAA

SEQ ID NO: 63116 - protein, 8 aa, Mycobacterium avium
DTDDNGLA

SEQ ID NO: 63117 - protein, 7 aa, Mycobacterium avium
DTDERTI

SEQ ID NO: 63118 - protein, 4 aa, Mycobacterium avium
DTDI

SEQ ID NO: 63119 - protein, 7 aa, Mycobacterium avium
DTDIPPG

SEQ ID NO: 63120 - protein, 4 aa, Mycobacterium avium
DTDN

SEQ ID NO: 63121 - protein, 21 aa, Mycobacterium avium
DTDPGGGPASVTASDRGAGPI

SEQ ID NO: 63122 - protein, 6 aa, Mycobacterium avium
DTDSLA

SEQ ID NO: 63123 - protein, 7 aa, Mycobacterium avium
DTDTGKA

SEQ ID NO: 63124 - protein, 20 aa, Mycobacterium avium
DTDVTATGRGQPACRGPATS

SEQ ID NO: 63125 - protein, 10 aa, Mycobacterium avium
DTEAKRREEV

SEQ ID NO: 63126 - protein, 5 aa, Mycobacterium avium
DTEGI

SEQ ID NO: 63127 - protein, 13 aa, Mycobacterium avium
DTEGLTFGKPEEK

SEQ ID NO: 63128 - protein, 6 aa, Mycobacterium avium
DTEPGV

SEQ ID NO: 63129 - protein, 16 aa, Mycobacterium avium
DTFPPDGEFPGSDPDM

SEQ ID NO: 63130 - protein, 7 aa, Mycobacterium avium
DTGADCP

SEQ ID NO: 63131 - protein, 11 aa, Mycobacterium avium
DTGDYQERGLR

SEQ ID NO: 63132 - protein, 5 aa, Mycobacterium avium
DTGEI

SEQ ID NO: 63133 - protein, 10 aa, Mycobacterium avium
DTGFDSSART

SEQ ID NO: 63134 - protein, 12 aa, Mycobacterium avium
DTGGDTGGPDSA

SEQ ID NO: 63135 - protein, 7 aa, Mycobacterium avium
DTGGEFP

SEQ ID NO: 63136 - protein, 7 aa, Mycobacterium avium
DTGGGPL

SEQ ID NO: 63137 - protein, 5 aa, Mycobacterium avium
DTGQH

SEQ ID NO: 63138 - protein, 8 aa, Mycobacterium avium
DTGSEFPE

SEQ ID NO: 63139 - protein, 6 aa, Mycobacterium avium
DTGSPY

SEQ ID NO: 63140 - protein, 12 aa, Mycobacterium avium
DTGTLTARPGAQ

SEQ ID NO: 63141 - protein, 9 aa, Mycobacterium avium
DTHAGAGQA

SEQ ID NO: 63142 - protein, 4 aa, Mycobacterium avium
DTHY

SEQ ID NO: 63143 - protein, 5 aa, Mycobacterium avium
DTIIG

SEQ ID NO: 63144 - protein, 8 aa, Mycobacterium avium
DTITGAGG

SEQ ID NO: 63145 - protein, 9 aa, Mycobacterium avium
DTITGAGGV

SEQ ID NO: 63146 - protein, 15 aa, Mycobacterium avium
DTKIAAAKKTFAETG

SEQ ID NO: 63147 - protein, 18 aa, Mycobacterium avium
DTLGTQDNSTLSDPVDLA

SEQ ID NO: 63148 - protein, 6 aa, Mycobacterium avium
DTNAGD

SEQ ID NO: 63149 - protein, 4 aa, Mycobacterium avium
DTNT

SEQ ID NO: 63150 - protein, 12 aa, Mycobacterium avium
DTPAARYRRPAV

SEQ ID NO: 63151 - protein, 15 aa, Mycobacterium avium
DTPDFTAKGPDGNPL

SEQ ID NO: 63152 - protein, 9 aa, Mycobacterium avium
DTPDKHRLG

SEQ ID NO: 63153 - protein, 6 aa, Mycobacterium avium
DTPERF

SEQ ID NO: 63154 - protein, 6 aa, Mycobacterium avium
DTPERM

SEQ ID NO: 63155 - protein, 9 aa, Mycobacterium avium
DTPGFERGR

SEQ ID NO: 63156 - protein, 5 aa, Mycobacterium avium
DTPGL

SEQ ID NO: 63157 - protein, 6 aa, Mycobacterium avium
DTPGVT

SEQ ID NO: 63158 - protein, 4 aa, Mycobacterium avium
DTPK

SEQ ID NO: 63159 - protein, 12 aa, Mycobacterium avium
DTPLTQVRPSQV

SEQ ID NO: 63160 - protein, 6 aa, Mycobacterium avium
DTPPAV

SEQ ID NO: 63161 - protein, 5 aa, Mycobacterium avium
DTPSG

SEQ ID NO: 63162 - protein, 4 aa, Mycobacterium avium
DTPY

SEQ ID NO: 63163 - protein, 15 aa, Mycobacterium avium
DTQPITAPTNSTNAL

SEQ ID NO: 63164 - protein, 5 aa, Mycobacterium avium
DTRAK

SEQ ID NO: 63165 - protein, 7 aa, Mycobacterium avium
DTRALPA

SEQ ID NO: 63166 - protein, 25 aa, Mycobacterium avium
DTRALPAPDYRHTGGYRAPESPTEE

SEQ ID NO: 63167 - protein, 15 aa, Mycobacterium avium
DTRRGSIGPEARTRL

SEQ ID NO: 63168 - protein, 5 aa, Mycobacterium avium
DTRTA

SEQ ID NO: 63169 - protein, 8 aa, Mycobacterium avium
DTSAAAWA

SEQ ID NO: 63170 - protein, 14 aa, Mycobacterium avium
DTSAVGSATDENSL

SEQ ID NO: 63171 - protein, 4 aa, Mycobacterium avium
DTSD

SEQ ID NO: 63172 - protein, 11 aa, Mycobacterium avium
DTSEEAWRDAE

SEQ ID NO: 63173 - protein, 18 aa, Mycobacterium avium
DTSGTDGERGAHEAEVSL

SEQ ID NO: 63174 - protein, 18 aa, Mycobacterium avium
DTSGTDGQRGAHEAEVSL

SEQ ID NO: 63175 - protein, 18 aa, Mycobacterium avium
DTSGTDGQRRAHEAEVSL

SEQ ID NO: 63176 - protein, 5 aa, Mycobacterium avium
DTSRD

SEQ ID NO: 63177 - protein, 10 aa, Mycobacterium avium
DTTDWSTNRE

SEQ ID NO: 63178 - protein, 11 aa, Mycobacterium avium
DTTGRSDGDWF

SEQ ID NO: 63179 - protein, 4 aa, Mycobacterium avium
DTTS

SEQ ID NO: 63180 - protein, 6 aa, Mycobacterium avium
DTTSGF

SEQ ID NO: 63181 - protein, 7 aa, Mycobacterium avium
DTTSGFT

SEQ ID NO: 63182 - protein, 7 aa, Mycobacterium avium
DTTTPDW

SEQ ID NO: 63183 - protein, 7 aa, Mycobacterium avium
DTVPAPV

SEQ ID NO: 63184 - protein, 6 aa, Mycobacterium avium
DTVPEG

SEQ ID NO: 63185 - protein, 5 aa, Mycobacterium avium
DTVPK

SEQ ID NO: 63186 - protein, 18 aa, Mycobacterium avium
DTVTESSTGRPAPTPDPQ

SEQ ID NO: 63187 - protein, 10 aa, Mycobacterium avium
DTVTGTGPDV

SEQ ID NO: 63188 - protein, 6 aa, Mycobacterium avium
DTYEEG

SEQ ID NO: 63189 - protein, 18 aa, Mycobacterium avium
DTYRRVTPSDGAVPSTAE

SEQ ID NO: 63190 - protein, 6 aa, Mycobacterium avium
DTYTID

SEQ ID NO: 63191 - protein, 6 aa, Mycobacterium avium
DTYTVN

SEQ ID NO: 63192 - protein, 10 aa, Mycobacterium avium
DVAADGSSVR

SEQ ID NO: 63193 - protein, 8 aa, Mycobacterium avium
DVAEPGNR

SEQ ID NO: 63194 - protein, 4 aa, Mycobacterium avium
DVAG

SEQ ID NO: 63195 - protein, 8 aa, Mycobacterium avium
DVAGPSAV

SEQ ID NO: 63196 - protein, 7 aa, Mycobacterium avium
DVAPDDD

SEQ ID NO: 63197 - protein, 13 aa, Mycobacterium avium
DVAPEPVSGKGTV

SEQ ID NO: 63198 - protein, 7 aa, Mycobacterium avium
DVAPGGE

SEQ ID NO: 63199 - protein, 11 aa, Mycobacterium avium
DVARSGVEPDR

SEQ ID NO: 63200 - protein, 8 aa, Mycobacterium avium
DVDAATAR

SEQ ID NO: 63201 - protein, 9 aa, Mycobacterium avium
DVDDPHPIS

SEQ ID NO: 63202 - protein, 4 aa, Mycobacterium avium
DVDE

SEQ ID NO: 63203 - protein, 10 aa, Mycobacterium avium
DVDESTDAEA

SEQ ID NO: 63204 - protein, 6 aa, Mycobacterium avium
DVDGNQ

SEQ ID NO: 63205 - protein, 29 aa, Mycobacterium avium
DVGDAPSPEPEPANRKPARAAAQNRQAQR

SEQ ID NO: 63206 - protein, 31 aa, Mycobacterium avium
DVGDAPSPEPERANRKPARAAAQNRHTQRRR

SEQ ID NO: 63207 - protein, 5 aa, Mycobacterium avium
DVGER

SEQ ID NO: 63208 - protein, 10 aa, Mycobacterium avium
DVGGTDDMAQ

SEQ ID NO: 63209 - protein, 9 aa, Mycobacterium avium
DVGGTPSRL

SEQ ID NO: 63210 - protein, 7 aa, Mycobacterium avium
DVGNGAV

SEQ ID NO: 63211 - protein, 6 aa, Mycobacterium avium
DVGQSI

SEQ ID NO: 63212 - protein, 4 aa, Mycobacterium avium
DVGR

SEQ ID NO: 63213 - protein, 10 aa, Mycobacterium avium
DVGSGRATTI

SEQ ID NO: 63214 - protein, 10 aa, Mycobacterium avium
DVGTLDGDGN

SEQ ID NO: 63215 - protein, 17 aa, Mycobacterium avium
DVKPPSTTCTTARCCAR

SEQ ID NO: 63216 - protein, 12 aa, Mycobacterium avium
DVPARGSAEHYY

SEQ ID NO: 63217 - protein, 31 aa, Mycobacterium avium
DVPAVAGPSGARGCPDPARRSRAAEPRARQG

SEQ ID NO: 63218 - protein, 9 aa, Mycobacterium avium
DVPGLGGAD

SEQ ID NO: 63219 - protein, 5 aa, Mycobacterium avium
DVPGM

SEQ ID NO: 63220 - protein, 6 aa, Mycobacterium avium
DVPGPA

SEQ ID NO: 63221 - protein, 7 aa, Mycobacterium avium
DVPGSGL

SEQ ID NO: 63222 - protein, 8 aa, Mycobacterium avium
DVPTKEDA

SEQ ID NO: 63223 - protein, 5 aa, Mycobacterium avium
DVQRA

SEQ ID NO: 63224 - protein, 8 aa, Mycobacterium avium
DVRAPEPL

SEQ ID NO: 63225 - protein, 7 aa, Mycobacterium avium
DVRDADA

SEQ ID NO: 63226 - protein, 4 aa, Mycobacterium avium
DVRP

SEQ ID NO: 63227 - protein, 16 aa, Mycobacterium avium
DVRTPSAAVREDVTGT

SEQ ID NO: 63228 - protein, 8 aa, Mycobacterium avium
DVSDEQQV

SEQ ID NO: 63229 - protein, 4 aa, Mycobacterium avium
DVST

SEQ ID NO: 63230 - protein, 5 aa, Mycobacterium avium
DVTDA

SEQ ID NO: 63231 - protein, 4 aa, Mycobacterium avium
DVTS

SEQ ID NO: 63232 - protein, 14 aa, Mycobacterium avium
DVTTAMNQTNERQQ

SEQ ID NO: 63233 - protein, 6 aa, Mycobacterium avium
DVVKTT

SEQ ID NO: 63234 - protein, 5 aa, Mycobacterium avium
DVVPD

SEQ ID NO: 63235 - protein, 9 aa, Mycobacterium avium
DVVPIPGTK

SEQ ID NO: 63236 - protein, 17 aa, Mycobacterium avium
DWGNPRDQAVPVTTDRY

SEQ ID NO: 63237 - protein, 11 aa, Mycobacterium avium
DWGNPRDQAVQ

SEQ ID NO: 63238 - protein, 5 aa, Mycobacterium avium
DWGRA

SEQ ID NO: 63239 - protein, 15 aa, Mycobacterium avium
DWRTKDAREARDQAH

SEQ ID NO: 63240 - protein, 6 aa, Mycobacterium avium
DWSPDR

SEQ ID NO: 63241 - protein, 8 aa, Mycobacterium avium
DWTASTSR

SEQ ID NO: 63242 - protein, 9 aa, Mycobacterium avium
DYDASDELE

SEQ ID NO: 63243 - protein, 8 aa, Mycobacterium avium
DYDAYRPT

SEQ ID NO: 63244 - protein, 6 aa, Mycobacterium avium
DYDDQP

SEQ ID NO: 63245 - protein, 21 aa, Mycobacterium avium
DYDDTVGDADDADDDVSSRSR

SEQ ID NO: 63246 - protein, 13 aa, Mycobacterium avium
DYDGLRPQAPPEA

SEQ ID NO: 63247 - protein, 5 aa, Mycobacterium avium
DYDRP

SEQ ID NO: 63248 - protein, 9 aa, Mycobacterium avium
DYGDDTRRR

SEQ ID NO: 63249 - protein, 6 aa, Mycobacterium avium
DYGPDT

SEQ ID NO: 63250 - protein, 16 aa, Mycobacterium avium
DYHPEEPGGSAAGRTC

SEQ ID NO: 63251 - protein, 8 aa, Mycobacterium avium
DYHQARAD

SEQ ID NO: 63252 - protein, 6 aa, Mycobacterium avium
DYLPPY

SEQ ID NO: 63253 - protein, 8 aa, Mycobacterium avium
DYPGVGPE

SEQ ID NO: 63254 - protein, 12 aa, Mycobacterium avium
DYPNASPEDLDE

SEQ ID NO: 63255 - protein, 12 aa, Mycobacterium avium
DYPNATPDDLDE

SEQ ID NO: 63256 - protein, 11 aa, Mycobacterium avium
DYPNATPDELD

SEQ ID NO: 63257 - protein, 4 aa, Mycobacterium avium
DYPR

SEQ ID NO: 63258 - protein, 12 aa, Mycobacterium avium
DYQRGERPAARG

SEQ ID NO: 63259 - protein, 7 aa, Mycobacterium avium
DYQTTAE

SEQ ID NO: 63260 - protein, 8 aa, Mycobacterium avium
DYRGDPSA

SEQ ID NO: 63261 - protein, 4 aa, Mycobacterium avium
DYRP

SEQ ID NO: 63262 - protein, 17 aa, Mycobacterium avium
DYRPELPGGRPSGGRSL

SEQ ID NO: 63263 - protein, 5 aa, Mycobacterium avium
DYRPG

SEQ ID NO: 63264 - protein, 14 aa, Mycobacterium avium
DYSGPGSGLSGTES

SEQ ID NO: 63265 - protein, 5 aa, Mycobacterium avium
DYSSV

SEQ ID NO: 63266 - protein, 11 aa, Mycobacterium avium
DYVESDDDYRH

SEQ ID NO: 63267 - protein, 14 aa, Mycobacterium avium
DYYKRGGSLPKSIT

SEQ ID NO: 63268 - protein, 9 aa, Mycobacterium avium
EAAADTPGA

SEQ ID NO: 63269 - protein, 5 aa, Mycobacterium avium
EAAAP

SEQ ID NO: 63270 - protein, 13 aa, Mycobacterium avium
EAAARARAGRGPT

SEQ ID NO: 63271 - protein, 6 aa, Mycobacterium avium
EAAAVT

SEQ ID NO: 63272 - protein, 6 aa, Mycobacterium avium
EAADRC

SEQ ID NO: 63273 - protein, 5 aa, Mycobacterium avium
EAAEG

SEQ ID NO: 63274 - protein, 7 aa, Mycobacterium avium
EAAERGL

SEQ ID NO: 63275 - protein, 10 aa, Mycobacterium avium
EAAGGLGGNE

SEQ ID NO: 63276 - protein, 14 aa, Mycobacterium avium
EAAGVESAATASRV

SEQ ID NO: 63277 - protein, 18 aa, Mycobacterium avium
EAANTTPLQSAAGPASVA

SEQ ID NO: 63278 - protein, 9 aa, Mycobacterium avium
EAAPAPAAE

SEQ ID NO: 63279 - protein, 7 aa, Mycobacterium avium
EAAPDGI

SEQ ID NO: 63280 - protein, 12 aa, Mycobacterium avium
EAAPDTPSPAEL

SEQ ID NO: 63281 - protein, 6 aa, Mycobacterium avium
EAAPVD

SEQ ID NO: 63282 - protein, 6 aa, Mycobacterium avium
EAAQAQ

SEQ ID NO: 63283 - protein, 10 aa, Mycobacterium avium
EAARHPDDRD

SEQ ID NO: 63284 - protein, 19 aa, Mycobacterium avium
EAARPSAVEGSARPSASQP

SEQ ID NO: 63285 - protein, 5 aa, Mycobacterium avium
EAASQ

SEQ ID NO: 63286 - protein, 11 aa, Mycobacterium avium
EAATARPQYQQ

SEQ ID NO: 63287 - protein, 7 aa, Mycobacterium avium
EAATAYQ

SEQ ID NO: 63288 - protein, 22 aa, Mycobacterium avium
EAATGYATAGSRSGDDVKILLK

SEQ ID NO: 63289 - protein, 17 aa, Mycobacterium avium
EAATRDAQNLAAGPAEA

SEQ ID NO: 63290 - protein, 4 aa, Mycobacterium avium
EAAV

SEQ ID NO: 63291 - protein, 4 aa, Mycobacterium avium
EAAY

SEQ ID NO: 63292 - protein, 5 aa, Mycobacterium avium
EAAYD

SEQ ID NO: 63293 - protein, 7 aa, Mycobacterium avium
EADAAVS

SEQ ID NO: 63294 - protein, 8 aa, Mycobacterium avium
EADDAAAA

SEQ ID NO: 63295 - protein, 30 aa, Mycobacterium avium
EADDTETVEIGSGRSMSRGRRAQGEPGRAV

SEQ ID NO: 63296 - protein, 4 aa, Mycobacterium avium
EADE

SEQ ID NO: 63297 - protein, 9 aa, Mycobacterium avium
EADGGGPEL

SEQ ID NO: 63298 - protein, 7 aa, Mycobacterium avium
EADGTVE

SEQ ID NO: 63299 - protein, 13 aa, Mycobacterium avium
EADISRNLTTASA

SEQ ID NO: 63300 - protein, 8 aa, Mycobacterium avium
EADPAVSR

SEQ ID NO: 63301 - protein, 10 aa, Mycobacterium avium
EADPDGFAER

SEQ ID NO: 63302 - protein, 7 aa, Mycobacterium avium
EADQARL

SEQ ID NO: 63303 - protein, 30 aa, Mycobacterium avium
EADTEPDERAAADVAPQPNSSLTSERGAGR

SEQ ID NO: 63304 - protein, 9 aa, Mycobacterium avium
EADTVGGNR

SEQ ID NO: 63305 - protein, 6 aa, Mycobacterium avium
EAEADE

SEQ ID NO: 63306 - protein, 7 aa, Mycobacterium avium
EAEADEL

SEQ ID NO: 63307 - protein, 6 aa, Mycobacterium avium
EAEAEA

SEQ ID NO: 63308 - protein, 11 aa, Mycobacterium avium
EAEAYSARKRK

SEQ ID NO: 63309 - protein, 14 aa, Mycobacterium avium
EAEDARPQPARDAD

SEQ ID NO: 63310 - protein, 8 aa, Mycobacterium avium
EAEEKCER

SEQ ID NO: 63311 - protein, 8 aa, Mycobacterium avium
EAEGGMGP

SEQ ID NO: 63312 - protein, 59 aa, Mycobacterium avium
EAEGGPTTEAAKPKKKAATSGAKKAAKAAEPEAAASEAAEPEAAAAPAEGGEQAESSAE

SEQ ID NO: 63313 - protein, 4 aa, Mycobacterium avium
EAEK

SEQ ID NO: 63314 - protein, 5 aa, Mycobacterium avium
EAEKR

SEQ ID NO: 63315 - protein, 4 aa, Mycobacterium avium
EAEL

SEQ ID NO: 63316 - protein, 10 aa, Mycobacterium avium
EAERAGELGA

SEQ ID NO: 63317 - protein, 11 aa, Mycobacterium avium
EAERAGELGAQ

SEQ ID NO: 63318 - protein, 7 aa, Mycobacterium avium
EAETGLH

SEQ ID NO: 63319 - protein, 4 aa, Mycobacterium avium
EAGA

SEQ ID NO: 63320 - protein, 6 aa, Mycobacterium avium
EAGAAQ

SEQ ID NO: 63321 - protein, 5 aa, Mycobacterium avium
EAGAE

SEQ ID NO: 63322 - protein, 8 aa, Mycobacterium avium
EAGAGIGD

SEQ ID NO: 63323 - protein, 7 aa, Mycobacterium avium
EAGAGSI

SEQ ID NO: 63324 - protein, 4 aa, Mycobacterium avium
EAGD

SEQ ID NO: 63325 - protein, 6 aa, Mycobacterium avium
EAGEGD

SEQ ID NO: 63326 - protein, 14 aa, Mycobacterium avium
EAGETSPLGPDNRY

SEQ ID NO: 63327 - protein, 4 aa, Mycobacterium avium
EAGG

SEQ ID NO: 63328 - protein, 8 aa, Mycobacterium avium
EAGGDPWA

SEQ ID NO: 63329 - protein, 8 aa, Mycobacterium avium
EAGGRDAV

SEQ ID NO: 63330 - protein, 8 aa, Mycobacterium avium
EAGGVEPS

SEQ ID NO: 63331 - protein, 8 aa, Mycobacterium avium
EAGHGDRA

SEQ ID NO: 63332 - protein, 6 aa, Mycobacterium avium
EAGIPD

SEQ ID NO: 63333 - protein, 4 aa, Mycobacterium avium
EAGL

SEQ ID NO: 63334 - protein, 22 aa, Mycobacterium avium
EAGLAGTSRGDGGHGSSGGHAS

SEQ ID NO: 63335 - protein, 6 aa, Mycobacterium avium
EAGLRA

SEQ ID NO: 63336 - protein, 7 aa, Mycobacterium avium
EAGLRAG

SEQ ID NO: 63337 - protein, 8 aa, Mycobacterium avium
EAGLRAGD

SEQ ID NO: 63338 - protein, 8 aa, Mycobacterium avium
EAGPADVQ

SEQ ID NO: 63339 - protein, 10 aa, Mycobacterium avium
EAGPEAQEEL

SEQ ID NO: 63340 - protein, 6 aa, Mycobacterium avium
EAGPQG

SEQ ID NO: 63341 - protein, 14 aa, Mycobacterium avium
EAGQQVSRGTEGEL

SEQ ID NO: 63342 - protein, 7 aa, Mycobacterium avium
EAGQSAR

SEQ ID NO: 63343 - protein, 7 aa, Mycobacterium avium
EAGRPLA

SEQ ID NO: 63344 - protein, 9 aa, Mycobacterium avium
EAGTPDLTV

SEQ ID NO: 63345 - protein, 6 aa, Mycobacterium avium
EAGVTE

SEQ ID NO: 63346 - protein, 13 aa, Mycobacterium avium
EAHPTGTERNPTW

SEQ ID NO: 63347 - protein, 6 aa, Mycobacterium avium
EAHRAG

SEQ ID NO: 63348 - protein, 16 aa, Mycobacterium avium
EAIARTKSELPQAVPA

SEQ ID NO: 63349 - protein, 6 aa, Mycobacterium avium
EAIDDP

SEQ ID NO: 63350 - protein, 5 aa, Mycobacterium avium
EAIDE

SEQ ID NO: 63351 - protein, 4 aa, Mycobacterium avium
EAIG

SEQ ID NO: 63352 - protein, 11 aa, Mycobacterium avium
EAKAGGAEEVT

SEQ ID NO: 63353 - protein, 20 aa, Mycobacterium avium
EAKAGGAEEVTNWGTGTPRR

SEQ ID NO: 63354 - protein, 10 aa, Mycobacterium avium
EAKDGKDAGD

SEQ ID NO: 63355 - protein, 11 aa, Mycobacterium avium
EAKGRNGVPHP

SEQ ID NO: 63356 - protein, 4 aa, Mycobacterium avium
EAKR

SEQ ID NO: 63357 - protein, 34 aa, Mycobacterium avium
EALPTGGTPAAGGTQAAPAPGQGAGDAVSEKPLG

SEQ ID NO: 63358 - protein, 7 aa, Mycobacterium avium
EALPYRP

SEQ ID NO: 63359 - protein, 6 aa, Mycobacterium avium
EALRDR

SEQ ID NO: 63360 - protein, 12 aa, Mycobacterium avium
EALSTPDQDRAA

SEQ ID NO: 63361 - protein, 7 aa, Mycobacterium avium
EALTANG

SEQ ID NO: 63362 - protein, 6 aa, Mycobacterium avium
EAMEQT

SEQ ID NO: 63363 - protein, 7 aa, Mycobacterium avium
EANGTPV

SEQ ID NO: 63364 - protein, 9 aa, Mycobacterium avium
EANKDKAIA

SEQ ID NO: 63365 - protein, 5 aa, Mycobacterium avium
EANPR

SEQ ID NO: 63366 - protein, 6 aa, Mycobacterium avium
EANQRA

SEQ ID NO: 63367 - protein, 16 aa, Mycobacterium avium
EANQRNNSASAGAGPE

SEQ ID NO: 63368 - protein, 9 aa, Mycobacterium avium
EANSAEDTV

SEQ ID NO: 63369 - protein, 5 aa, Mycobacterium avium
EANVP

SEQ ID NO: 63370 - protein, 5 aa, Mycobacterium avium
EAPAI

SEQ ID NO: 63371 - protein, 11 aa, Mycobacterium avium
EAPAPPQNTPV

SEQ ID NO: 63372 - protein, 5 aa, Mycobacterium avium
EAPDA

SEQ ID NO: 63373 - protein, 6 aa, Mycobacterium avium
EAPELP

SEQ ID NO: 63374 - protein, 5 aa, Mycobacterium avium
EAPGF

SEQ ID NO: 63375 - protein, 15 aa, Mycobacterium avium
EAPKAYRQAVESFLA

SEQ ID NO: 63376 - protein, 4 aa, Mycobacterium avium
EAPP

SEQ ID NO: 63377 - protein, 5 aa, Mycobacterium avium
EAPQS

SEQ ID NO: 63378 - protein, 9 aa, Mycobacterium avium
EAPSDKPGA

SEQ ID NO: 63379 - protein, 12 aa, Mycobacterium avium
EAPSLEDADLTP

SEQ ID NO: 63380 - protein, 6 aa, Mycobacterium avium
EAPTSG

SEQ ID NO: 63381 - protein, 4 aa, Mycobacterium avium
EAPY

SEQ ID NO: 63382 - protein, 7 aa, Mycobacterium avium
EAQARGV

SEQ ID NO: 63383 - protein, 8 aa, Mycobacterium avium
EAQGVTNG

SEQ ID NO: 63384 - protein, 10 aa, Mycobacterium avium
EAQKAGTQRS

SEQ ID NO: 63385 - protein, 8 aa, Mycobacterium avium
EAQKPQGF

SEQ ID NO: 63386 - protein, 23 aa, Mycobacterium avium
EAQQSAGPAPGGRSGGPRHAAPS

SEQ ID NO: 63387 - protein, 8 aa, Mycobacterium avium
EAQRERRK

SEQ ID NO: 63388 - protein, 5 aa, Mycobacterium avium
EAQRV

SEQ ID NO: 63389 - protein, 9 aa, Mycobacterium avium
EARAHDGVP

SEQ ID NO: 63390 - protein, 5 aa, Mycobacterium avium
EARAT

SEQ ID NO: 63391 - protein, 7 aa, Mycobacterium avium
EARDDAV

SEQ ID NO: 63392 - protein, 8 aa, Mycobacterium avium
EARLNAKG

SEQ ID NO: 63393 - protein, 23 aa, Mycobacterium avium
EARLRGGRGAAALPTPGTSEGRQ

SEQ ID NO: 63394 - protein, 14 aa, Mycobacterium avium
EARPPRPGQQPPAG

SEQ ID NO: 63395 - protein, 6 aa, Mycobacterium avium
EARPPV

SEQ ID NO: 63396 - protein, 6 aa, Mycobacterium avium
EARQDY

SEQ ID NO: 63397 - protein, 6 aa, Mycobacterium avium
EARTRN

SEQ ID NO: 63398 - protein, 8 aa, Mycobacterium avium
EARTTPEA

SEQ ID NO: 63399 - protein, 4 aa, Mycobacterium avium
EARY

SEQ ID NO: 63400 - protein, 6 aa, Mycobacterium avium
EASEDV

SEQ ID NO: 63401 - protein, 6 aa, Mycobacterium avium
EASEQL

SEQ ID NO: 63402 - protein, 9 aa, Mycobacterium avium
EASERGVSG

SEQ ID NO: 63403 - protein, 29 aa, Mycobacterium avium
EASGDDVTRGAAPDDDEVKVSPVDDIWLR

SEQ ID NO: 63404 - protein, 14 aa, Mycobacterium avium
EASGGKAVAHTGSV

SEQ ID NO: 63405 - protein, 6 aa, Mycobacterium avium
EASGGR

SEQ ID NO: 63406 - protein, 11 aa, Mycobacterium avium
EASGGSGRRLD

SEQ ID NO: 63407 - protein, 11 aa, Mycobacterium avium
EASGWRTTYPA

SEQ ID NO: 63408 - protein, 7 aa, Mycobacterium avium
EASPAAD

SEQ ID NO: 63409 - protein, 7 aa, Mycobacterium avium
EASPAAG

SEQ ID NO: 63410 - protein, 21 aa, Mycobacterium avium
EASPQPISTSSGHGGRSGRTT

SEQ ID NO: 63411 - protein, 5 aa, Mycobacterium avium
EASVP

SEQ ID NO: 63412 - protein, 9 aa, Mycobacterium avium
EATDSGDRH

SEQ ID NO: 63413 - protein, 6 aa, Mycobacterium avium
EATEGR

SEQ ID NO: 63414 - protein, 9 aa, Mycobacterium avium
EATGDRGKI

SEQ ID NO: 63415 - protein, 7 aa, Mycobacterium avium
EATGGEL

SEQ ID NO: 63416 - protein, 6 aa, Mycobacterium avium
EATGGS

SEQ ID NO: 63417 - protein, 6 aa, Mycobacterium avium
EATRQT

SEQ ID NO: 63418 - protein, 10 aa, Mycobacterium avium
EATRRGEAAP

SEQ ID NO: 63419 - protein, 5 aa, Mycobacterium avium
EATRT

SEQ ID NO: 63420 - protein, 14 aa, Mycobacterium avium
EATYPDWKPRTSPV

SEQ ID NO: 63421 - protein, 7 aa, Mycobacterium avium
EAVAAGR

SEQ ID NO: 63422 - protein, 13 aa, Mycobacterium avium
EAVDTPPQTTRAR

SEQ ID NO: 63423 - protein, 7 aa, Mycobacterium avium
EAVEAAD

SEQ ID NO: 63424 - protein, 6 aa, Mycobacterium avium
EAVEHA

SEQ ID NO: 63425 - protein, 7 aa, Mycobacterium avium
EAVGASG

SEQ ID NO: 63426 - protein, 8 aa, Mycobacterium avium
EAVGESGR

SEQ ID NO: 63427 - protein, 12 aa, Mycobacterium avium
EAVGPQRDKSRW

SEQ ID NO: 63428 - protein, 20 aa, Mycobacterium avium
EAWGRTRKGGSARRSNERTT

SEQ ID NO: 63429 - protein, 13 aa, Mycobacterium avium
ECGGSGSTETLTA

SEQ ID NO: 63430 - protein, 7 aa, Mycobacterium avium
ECTDPAQ

SEQ ID NO: 63431 - protein, 9 aa, Mycobacterium avium
EDAAATRVD

SEQ ID NO: 63432 - protein, 15 aa, Mycobacterium avium
EDAAEAEARVQAGGT

SEQ ID NO: 63433 - protein, 4 aa, Mycobacterium avium
EDAE

SEQ ID NO: 63434 - protein, 6 aa, Mycobacterium avium
EDAGDT

SEQ ID NO: 63435 - protein, 8 aa, Mycobacterium avium
EDAPQSAF

SEQ ID NO: 63436 - protein, 9 aa, Mycobacterium avium
EDARQTAHD

SEQ ID NO: 63437 - protein, 16 aa, Mycobacterium avium
EDARQTARDTGDVGRA

SEQ ID NO: 63438 - protein, 5 aa, Mycobacterium avium
EDASP

SEQ ID NO: 63439 - protein, 6 aa, Mycobacterium avium
EDAYTY

SEQ ID NO: 63440 - protein, 5 aa, Mycobacterium avium
EDDLT

SEQ ID NO: 63441 - protein, 31 aa, Mycobacterium avium
EDDQEYIRDRGNAQLRTEAGKPMKAAEQGLS

SEQ ID NO: 63442 - protein, 7 aa, Mycobacterium avium
EDDSHAN

SEQ ID NO: 63443 - protein, 13 aa, Mycobacterium avium
EDDVDPRRTRSRT

SEQ ID NO: 63444 - protein, 13 aa, Mycobacterium avium
EDEAIAAANDTEF

SEQ ID NO: 63445 - protein, 10 aa, Mycobacterium avium
EDELTDEQAR

SEQ ID NO: 63446 - protein, 18 aa, Mycobacterium avium
EDEYYDDRAPSRGFPRPR

SEQ ID NO: 63447 - protein, 6 aa, Mycobacterium avium
EDGAPN

SEQ ID NO: 63448 - protein, 10 aa, Mycobacterium avium
EDGAPPHPDT

SEQ ID NO: 63449 - protein, 10 aa, Mycobacterium avium
EDGAQRRVAG

SEQ ID NO: 63450 - protein, 6 aa, Mycobacterium avium
EDGDEL

SEQ ID NO: 63451 - protein, 5 aa, Mycobacterium avium
EDGEP

SEQ ID NO: 63452 - protein, 11 aa, Mycobacterium avium
EDGKPGDPDYH

SEQ ID NO: 63453 - protein, 11 aa, Mycobacterium avium
EDGQADGSIRP

SEQ ID NO: 63454 - protein, 9 aa, Mycobacterium avium
EDGRISDSA

SEQ ID NO: 63455 - protein, 9 aa, Mycobacterium avium
EDGSRGLTH

SEQ ID NO: 63456 - protein, 8 aa, Mycobacterium avium
EDGTAAAH

SEQ ID NO: 63457 - protein, 14 aa, Mycobacterium avium
EDGTPKTKHNTTNV

SEQ ID NO: 63458 - protein, 15 aa, Mycobacterium avium
EDGTPPGSIGRPYPG

SEQ ID NO: 63459 - protein, 12 aa, Mycobacterium avium
EDGTVLGPGETG

SEQ ID NO: 63460 - protein, 7 aa, Mycobacterium avium
EDGVGER

SEQ ID NO: 63461 - protein, 7 aa, Mycobacterium avium
EDHSGPL

SEQ ID NO: 63462 - protein, 9 aa, Mycobacterium avium
EDHTTTDST

SEQ ID NO: 63463 - protein, 31 aa, Mycobacterium avium
EDIDETDGATKPKSATAPAQPDELGDATPGP

SEQ ID NO: 63464 - protein, 7 aa, Mycobacterium avium
EDIPSNQ

SEQ ID NO: 63465 - protein, 5 aa, Mycobacterium avium
EDKGV

SEQ ID NO: 63466 - protein, 12 aa, Mycobacterium avium
EDLAQQDRHRPA

SEQ ID NO: 63467 - protein, 4 aa, Mycobacterium avium
EDLD

SEQ ID NO: 63468 - protein, 5 aa, Mycobacterium avium
EDLDG

SEQ ID NO: 63469 - protein, 8 aa, Mycobacterium avium
EDLGNDEF

SEQ ID NO: 63470 - protein, 6 aa, Mycobacterium avium
EDLQGA

SEQ ID NO: 63471 - protein, 27 aa, Mycobacterium avium
EDLRRRGAQVASRVSGRVGEEMRRLHG

SEQ ID NO: 63472 - protein, 8 aa, Mycobacterium avium
EDLSNDEF

SEQ ID NO: 63473 - protein, 8 aa, Mycobacterium avium
EDMPPDRK

SEQ ID NO: 63474 - protein, 6 aa, Mycobacterium avium
EDPARR

SEQ ID NO: 63475 - protein, 19 aa, Mycobacterium avium
EDPDAVRRSQQSRGEDPSL

SEQ ID NO: 63476 - protein, 11 aa, Mycobacterium avium
EDPDKAPSLDE

SEQ ID NO: 63477 - protein, 15 aa, Mycobacterium avium
EDPDRHGLAETPARV

SEQ ID NO: 63478 - protein, 8 aa, Mycobacterium avium
EDPEYPPL

SEQ ID NO: 63479 - protein, 8 aa, Mycobacterium avium
EDPGLRRQ

SEQ ID NO: 63480 - protein, 4 aa, Mycobacterium avium
EDPK

SEQ ID NO: 63481 - protein, 5 aa, Mycobacterium avium
EDPRF

SEQ ID NO: 63482 - protein, 7 aa, Mycobacterium avium
EDPVRRT

SEQ ID NO: 63483 - protein, 6 aa, Mycobacterium avium
EDPVSG

SEQ ID NO: 63484 - protein, 8 aa, Mycobacterium avium
EDQGDSPW

SEQ ID NO: 63485 - protein, 14 aa, Mycobacterium avium
EDQGRRKRQSGRGF

SEQ ID NO: 63486 - protein, 7 aa, Mycobacterium avium
EDQRPQI

SEQ ID NO: 63487 - protein, 8 aa, Mycobacterium avium
EDQRPQIT

SEQ ID NO: 63488 - protein, 8 aa, Mycobacterium avium
EDQRVPNN

SEQ ID NO: 63489 - protein, 11 aa, Mycobacterium avium
EDRAAGLAESE

SEQ ID NO: 63490 - protein, 8 aa, Mycobacterium avium
EDRPGDKR

SEQ ID NO: 63491 - protein, 7 aa, Mycobacterium avium
EDRPRDK

SEQ ID NO: 63492 - protein, 7 aa, Mycobacterium avium
EDRPSLH

SEQ ID NO: 63493 - protein, 19 aa, Mycobacterium avium
EDRQRQITDHGEETLQGKT

SEQ ID NO: 63494 - protein, 14 aa, Mycobacterium avium
EDSLPVPTSKPDPA

SEQ ID NO: 63495 - protein, 9 aa, Mycobacterium avium
EDSRSADER

SEQ ID NO: 63496 - protein, 6 aa, Mycobacterium avium
EDSSDS

SEQ ID NO: 63497 - protein, 24 aa, Mycobacterium avium
EDSTSITPDQTMQQTPSAQQVRSA

SEQ ID NO: 63498 - protein, 4 aa, Mycobacterium avium
EDSV

SEQ ID NO: 63499 - protein, 17 aa, Mycobacterium avium
EDTENAMDRVACGVIGT

SEQ ID NO: 63500 - protein, 6 aa, Mycobacterium avium
EDTESF

SEQ ID NO: 63501 - protein, 18 aa, Mycobacterium avium
EDTQKFAPDALNDESKSE

SEQ ID NO: 63502 - protein, 5 aa, Mycobacterium avium
EDTRS

SEQ ID NO: 63503 - protein, 4 aa, Mycobacterium avium
EDTV

SEQ ID NO: 63504 - protein, 52 aa, Mycobacterium avium
EDVAADDADIEPGDAEEGEDEEAAAPKAAGATVADEDDEIAEPSEKDKASGD

SEQ ID NO: 63505 - protein, 4 aa, Mycobacterium avium
EDWT

SEQ ID NO: 63506 - protein, 11 aa, Mycobacterium avium
EDYGGGGNPDF

SEQ ID NO: 63507 - protein, 26 aa, Mycobacterium avium
EDYHRGESAYDRYYGDPTNKPNPNLG

SEQ ID NO: 63508 - protein, 11 aa, Mycobacterium avium
EEAAPSALPVG

SEQ ID NO: 63509 - protein, 9 aa, Mycobacterium avium
EEAGGAGWR

SEQ ID NO: 63510 - protein, 10 aa, Mycobacterium avium
EEAPSPLLDP

SEQ ID NO: 63511 - protein, 8 aa, Mycobacterium avium
EEASPVPV

SEQ ID NO: 63512 - protein, 8 aa, Mycobacterium avium
EEAVGAPS

SEQ ID NO: 63513 - protein, 7 aa, Mycobacterium avium
EEDETAW

SEQ ID NO: 63514 - protein, 5 aa, Mycobacterium avium
EEDLT

SEQ ID NO: 63515 - protein, 14 aa, Mycobacterium avium
EEEADRARTGGGDW

SEQ ID NO: 63516 - protein, 6 aa, Mycobacterium avium
EEEASY

SEQ ID NO: 63517 - protein, 5 aa, Mycobacterium avium
EEEQA

SEQ ID NO: 63518 - protein, 6 aa, Mycobacterium avium
EEFDPE

SEQ ID NO: 63519 - protein, 11 aa, Mycobacterium avium
EEGAEVATSRL

SEQ ID NO: 63520 - protein, 7 aa, Mycobacterium avium
EEGDQGT

SEQ ID NO: 63521 - protein, 8 aa, Mycobacterium avium
EEGETGDV

SEQ ID NO: 63522 - protein, 8 aa, Mycobacterium avium
EEGGAATH

SEQ ID NO: 63523 - protein, 5 aa, Mycobacterium avium
EEGGR

SEQ ID NO: 63524 - protein, 10 aa, Mycobacterium avium
EEGGSGEPEF

SEQ ID NO: 63525 - protein, 6 aa, Mycobacterium avium
EEGHPH

SEQ ID NO: 63526 - protein, 6 aa, Mycobacterium avium
EEGKSA

SEQ ID NO: 63527 - protein, 12 aa, Mycobacterium avium
EEIDGTGVLWRK

SEQ ID NO: 63528 - protein, 18 aa, Mycobacterium avium
EEIGGVGGAYASGTLPGD

SEQ ID NO: 63529 - protein, 8 aa, Mycobacterium avium
EELGSLTK

SEQ ID NO: 63530 - protein, 4 aa, Mycobacterium avium
EENR

SEQ ID NO: 63531 - protein, 25 aa, Mycobacterium avium
EEPAKPPAAEPAEPEEKPVHTRRGK

SEQ ID NO: 63532 - protein, 8 aa, Mycobacterium avium
EEPDPRPL

SEQ ID NO: 63533 - protein, 6 aa, Mycobacterium avium
EEPDTR

SEQ ID NO: 63534 - protein, 7 aa, Mycobacterium avium
EEPEGPV

SEQ ID NO: 63535 - protein, 7 aa, Mycobacterium avium
EEPIDHT

SEQ ID NO: 63536 - protein, 6 aa, Mycobacterium avium
EEPPPS

SEQ ID NO: 63537 - protein, 9 aa, Mycobacterium avium
EEPPRQDNP

SEQ ID NO: 63538 - protein, 9 aa, Mycobacterium avium
EEPPRTAAK

SEQ ID NO: 63539 - protein, 9 aa, Mycobacterium avium
EERAERAEA

SEQ ID NO: 63540 - protein, 8 aa, Mycobacterium avium
EERDPAGF

SEQ ID NO: 63541 - protein, 7 aa, Mycobacterium avium
EERDTGG

SEQ ID NO: 63542 - protein, 14 aa, Mycobacterium avium
EERFSRRKHGKPAV

SEQ ID NO: 63543 - protein, 7 aa, Mycobacterium avium
EERMSAQ

SEQ ID NO: 63544 - protein, 6 aa, Mycobacterium avium
EERMTA

SEQ ID NO: 63545 - protein, 19 aa, Mycobacterium avium
EERRPGHRGADRREARPGR

SEQ ID NO: 63546 - protein, 11 aa, Mycobacterium avium
EERSWSRPEIQ

SEQ ID NO: 63547 - protein, 4 aa, Mycobacterium avium
EERT

SEQ ID NO: 63548 - protein, 10 aa, Mycobacterium avium
EERTKSDTEL

SEQ ID NO: 63549 - protein, 6 aa, Mycobacterium avium
EERTTD

SEQ ID NO: 63550 - protein, 17 aa, Mycobacterium avium
EESADPAIDADSDVTAW

SEQ ID NO: 63551 - protein, 5 aa, Mycobacterium avium
EESAN

SEQ ID NO: 63552 - protein, 8 aa, Mycobacterium avium
EESGKADF

SEQ ID NO: 63553 - protein, 16 aa, Mycobacterium avium
EESPQSRAHDGVNLVF

SEQ ID NO: 63554 - protein, 13 aa, Mycobacterium avium
EESSMATAGEWPE

SEQ ID NO: 63555 - protein, 11 aa, Mycobacterium avium
EESTRSGDLPD

SEQ ID NO: 63556 - protein, 6 aa, Mycobacterium avium
EETPAL

SEQ ID NO: 63557 - protein, 7 aa, Mycobacterium avium
EETPLEQ

SEQ ID NO: 63558 - protein, 10 aa, Mycobacterium avium
EETSEGPGDF

SEQ ID NO: 63559 - protein, 5 aa, Mycobacterium avium
EETVD

SEQ ID NO: 63560 - protein, 4 aa, Mycobacterium avium
EEVT

SEQ ID NO: 63561 - protein, 33 aa, Mycobacterium avium
EEWQDSPHGWPSRPTHSGWPDSPAIARAYGPND

SEQ ID NO: 63562 - protein, 14 aa, Mycobacterium avium
EEYEAERRRGADPQ

SEQ ID NO: 63563 - protein, 9 aa, Mycobacterium avium
EEYGGSPVG

SEQ ID NO: 63564 - protein, 6 aa, Mycobacterium avium
EFAPAR

SEQ ID NO: 63565 - protein, 9 aa, Mycobacterium avium
EFASSGDDY

SEQ ID NO: 63566 - protein, 5 aa, Mycobacterium avium
EFDAD

SEQ ID NO: 63567 - protein, 6 aa, Mycobacterium avium
EFDSRR

SEQ ID NO: 63568 - protein, 5 aa, Mycobacterium avium
EFGRR

SEQ ID NO: 63569 - protein, 4 aa, Mycobacterium avium
EFGT

SEQ ID NO: 63570 - protein, 16 aa, Mycobacterium avium
EFPPPLPYKGNRDPKV

SEQ ID NO: 63571 - protein, 7 aa, Mycobacterium avium
EFPQDTQ

SEQ ID NO: 63572 - protein, 4 aa, Mycobacterium avium
EFSG

SEQ ID NO: 63573 - protein, 10 aa, Mycobacterium avium
EFSKESGRSE

SEQ ID NO: 63574 - protein, 6 aa, Mycobacterium avium
EFSQDP

SEQ ID NO: 63575 - protein, 7 aa, Mycobacterium avium
EFSQPGR

SEQ ID NO: 63576 - protein, 14 aa, Mycobacterium avium
EFVDEKTQGKYSDT

SEQ ID NO: 63577 - protein, 31 aa, Mycobacterium avium
EGAAGAVGHDTTQAATAVDEPAPAESRAAAA

SEQ ID NO: 63578 - protein, 6 aa, Mycobacterium avium
EGAANP

SEQ ID NO: 63579 - protein, 14 aa, Mycobacterium avium
EGAASCPERAIRVE

SEQ ID NO: 63580 - protein, 16 aa, Mycobacterium avium
EGAESARRVGTDALTP

SEQ ID NO: 63581 - protein, 4 aa, Mycobacterium avium
EGAG

SEQ ID NO: 63582 - protein, 15 aa, Mycobacterium avium
EGAPDPEQQAKDYAH

SEQ ID NO: 63583 - protein, 9 aa, Mycobacterium avium
EGAPLTPED

SEQ ID NO: 63584 - protein, 9 aa, Mycobacterium avium
EGAPMTPED

SEQ ID NO: 63585 - protein, 10 aa, Mycobacterium avium
EGAPSREQPG

SEQ ID NO: 63586 - protein, 10 aa, Mycobacterium avium
EGASPALGSV

SEQ ID NO: 63587 - protein, 10 aa, Mycobacterium avium
EGATPESAAT

SEQ ID NO: 63588 - protein, 20 aa, Mycobacterium avium
EGAVSQSQRPGHRAPSTPLQ

SEQ ID NO: 63589 - protein, 9 aa, Mycobacterium avium
EGDAEKAGE

SEQ ID NO: 63590 - protein, 12 aa, Mycobacterium avium
EGDATTRQANER

SEQ ID NO: 63591 - protein, 6 aa, Mycobacterium avium
EGDDVH

SEQ ID NO: 63592 - protein, 20 aa, Mycobacterium avium
EGDESVPLAGSAQRTHRAIP

SEQ ID NO: 63593 - protein, 9 aa, Mycobacterium avium
EGDGGGLGP

SEQ ID NO: 63594 - protein, 8 aa, Mycobacterium avium
EGDKVTRE

SEQ ID NO: 63595 - protein, 9 aa, Mycobacterium avium
EGDRATART

SEQ ID NO: 63596 - protein, 8 aa, Mycobacterium avium
EGDSGEPL

SEQ ID NO: 63597 - protein, 15 aa, Mycobacterium avium
EGEDFGSGGDLPEQR

SEQ ID NO: 63598 - protein, 8 aa, Mycobacterium avium
EGEDGSAQ

SEQ ID NO: 63599 - protein, 7 aa, Mycobacterium avium
EGEEASV

SEQ ID NO: 63600 - protein, 8 aa, Mycobacterium avium
EGEEATGA

SEQ ID NO: 63601 - protein, 14 aa, Mycobacterium avium
EGEPKPIAGAPSSW

SEQ ID NO: 63602 - protein, 13 aa, Mycobacterium avium
EGERESDERARRA

SEQ ID NO: 63603 - protein, 6 aa, Mycobacterium avium
EGERVR

SEQ ID NO: 63604 - protein, 5 aa, Mycobacterium avium
EGESM

SEQ ID NO: 63605 - protein, 12 aa, Mycobacterium avium
EGFDPQAPAAWS

SEQ ID NO: 63606 - protein, 13 aa, Mycobacterium avium
EGFDTQAPAAWSA

SEQ ID NO: 63607 - protein, 17 aa, Mycobacterium avium
EGFGEPAQLAGAPAQDV

SEQ ID NO: 63608 - protein, 8 aa, Mycobacterium avium
EGFRDDGH

SEQ ID NO: 63609 - protein, 12 aa, Mycobacterium avium
EGGDRQAPRTPE

SEQ ID NO: 63610 - protein, 24 aa, Mycobacterium avium
EGGFGGMPGQRPIAPEFPDREPDA

SEQ ID NO: 63611 - protein, 13 aa, Mycobacterium avium
EGGGQANVTIIER

SEQ ID NO: 63612 - protein, 18 aa, Mycobacterium avium
EGGGSASDPGRDGASLGR

SEQ ID NO: 63613 - protein, 5 aa, Mycobacterium avium
EGGGT

SEQ ID NO: 63614 - protein, 14 aa, Mycobacterium avium
EGGGTANATPVELV

SEQ ID NO: 63615 - protein, 9 aa, Mycobacterium avium
EGGHPAGNL

SEQ ID NO: 63616 - protein, 4 aa, Mycobacterium avium
EGGI

SEQ ID NO: 63617 - protein, 11 aa, Mycobacterium avium
EGGKPPPDPAD

SEQ ID NO: 63618 - protein, 14 aa, Mycobacterium avium
EGGPLHAPGPKGHD

SEQ ID NO: 63619 - protein, 6 aa, Mycobacterium avium
EGGPTT

SEQ ID NO: 63620 - protein, 4 aa, Mycobacterium avium
EGGS

SEQ ID NO: 63621 - protein, 10 aa, Mycobacterium avium
EGGSPVDDEF

SEQ ID NO: 63622 - protein, 5 aa, Mycobacterium avium
EGGTG

SEQ ID NO: 63623 - protein, 5 aa, Mycobacterium avium
EGHAP

SEQ ID NO: 63624 - protein, 5 aa, Mycobacterium avium
EGHAY

SEQ ID NO: 63625 - protein, 4 aa, Mycobacterium avium
EGIG

SEQ ID NO: 63626 - protein, 4 aa, Mycobacterium avium
EGIT

SEQ ID NO: 63627 - protein, 7 aa, Mycobacterium avium
EGLPARR

SEQ ID NO: 63628 - protein, 9 aa, Mycobacterium avium
EGLRPGDAD

SEQ ID NO: 63629 - protein, 4 aa, Mycobacterium avium
EGMP

SEQ ID NO: 63630 - protein, 4 aa, Mycobacterium avium
EGMQ

SEQ ID NO: 63631 - protein, 18 aa, Mycobacterium avium
EGNADKAVTSAAAVFEVV

SEQ ID NO: 63632 - protein, 8 aa, Mycobacterium avium
EGNEAGEG

SEQ ID NO: 63633 - protein, 9 aa, Mycobacterium avium
EGPDAIGQS

SEQ ID NO: 63634 - protein, 7 aa, Mycobacterium avium
EGPDTYT

SEQ ID NO: 63635 - protein, 7 aa, Mycobacterium avium
EGPMTPG

SEQ ID NO: 63636 - protein, 7 aa, Mycobacterium avium
EGPPPWN

SEQ ID NO: 63637 - protein, 6 aa, Mycobacterium avium
EGPRNV

SEQ ID NO: 63638 - protein, 15 aa, Mycobacterium avium
EGPSTEANLARRFLT

SEQ ID NO: 63639 - protein, 7 aa, Mycobacterium avium
EGQHVPK

SEQ ID NO: 63640 - protein, 13 aa, Mycobacterium avium
EGQPFSGDPAPYE

SEQ ID NO: 63641 - protein, 4 aa, Mycobacterium avium
EGQR

SEQ ID NO: 63642 - protein, 8 aa, Mycobacterium avium
EGRAGRMG

SEQ ID NO: 63643 - protein, 10 aa, Mycobacterium avium
EGRGENRSAK

SEQ ID NO: 63644 - protein, 4 aa, Mycobacterium avium
EGRI

SEQ ID NO: 63645 - protein, 8 aa, Mycobacterium avium
EGRKSTHG

SEQ ID NO: 63646 - protein, 6 aa, Mycobacterium avium
EGRLPQ

SEQ ID NO: 63647 - protein, 9 aa, Mycobacterium avium
EGRNDGETF

SEQ ID NO: 63648 - protein, 13 aa, Mycobacterium avium
EGRNIRGVIDFAS

SEQ ID NO: 63649 - protein, 9 aa, Mycobacterium avium
EGRNLTTDA

SEQ ID NO: 63650 - protein, 4 aa, Mycobacterium avium
EGRP

SEQ ID NO: 63651 - protein, 9 aa, Mycobacterium avium
EGRPGINDS

SEQ ID NO: 63652 - protein, 4 aa, Mycobacterium avium
EGRS

SEQ ID NO: 63653 - protein, 5 aa, Mycobacterium avium
EGRVG

SEQ ID NO: 63654 - protein, 4 aa, Mycobacterium avium
EGSG

SEQ ID NO: 63655 - protein, 5 aa, Mycobacterium avium
EGSLD

SEQ ID NO: 63656 - protein, 6 aa, Mycobacterium avium
EGSLGP

SEQ ID NO: 63657 - protein, 16 aa, Mycobacterium avium
EGSNSSPWPARCWPSR

SEQ ID NO: 63658 - protein, 11 aa, Mycobacterium avium
EGSPSEDEQDP

SEQ ID NO: 63659 - protein, 9 aa, Mycobacterium avium
EGSTDGPLL

SEQ ID NO: 63660 - protein, 11 aa, Mycobacterium avium
EGTDADGVARG

SEQ ID NO: 63661 - protein, 6 aa, Mycobacterium avium
EGTPEF

SEQ ID NO: 63662 - protein, 5 aa, Mycobacterium avium
EGTPP

SEQ ID NO: 63663 - protein, 11 aa, Mycobacterium avium
EGTRSPDGRLY

SEQ ID NO: 63664 - protein, 5 aa, Mycobacterium avium
EGTRT

SEQ ID NO: 63665 - protein, 7 aa, Mycobacterium avium
EGTTDDP

SEQ ID NO: 63666 - protein, 4 aa, Mycobacterium avium
EGVD

SEQ ID NO: 63667 - protein, 5 aa, Mycobacterium avium
EGVEA

SEQ ID NO: 63668 - protein, 7 aa, Mycobacterium avium
EGVPPIS

SEQ ID NO: 63669 - protein, 22 aa, Mycobacterium avium
EGVRRGKRVRTTKPDPAAARHP

SEQ ID NO: 63670 - protein, 15 aa, Mycobacterium avium
EGVSGGKALDARPAL

SEQ ID NO: 63671 - protein, 7 aa, Mycobacterium avium
EGWDDDD

SEQ ID NO: 63672 - protein, 6 aa, Mycobacterium avium
EGYGEE

SEQ ID NO: 63673 - protein, 10 aa, Mycobacterium avium
EHAESKDHHP

SEQ ID NO: 63674 - protein, 6 aa, Mycobacterium avium
EHAGAP

SEQ ID NO: 63675 - protein, 32 aa, Mycobacterium avium
EHAGPGVPGHHRGEGGLKSVAASSRHRPRGAV

SEQ ID NO: 63676 - protein, 10 aa, Mycobacterium avium
EHAKTRRQFG

SEQ ID NO: 63677 - protein, 6 aa, Mycobacterium avium
EHAPND

SEQ ID NO: 63678 - protein, 10 aa, Mycobacterium avium
EHAPNDLRST

SEQ ID NO: 63679 - protein, 4 aa, Mycobacterium avium
EHDA

SEQ ID NO: 63680 - protein, 6 aa, Mycobacterium avium
EHDPAA

SEQ ID NO: 63681 - protein, 8 aa, Mycobacterium avium
EHDPSRTA

SEQ ID NO: 63682 - protein, 10 aa, Mycobacterium avium
EHDSSHDLGV

SEQ ID NO: 63683 - protein, 6 aa, Mycobacterium avium
EHEDGD

SEQ ID NO: 63684 - protein, 6 aa, Mycobacterium avium
EHEPEA

SEQ ID NO: 63685 - protein, 11 aa, Mycobacterium avium
EHEPRESDPHY

SEQ ID NO: 63686 - protein, 8 aa, Mycobacterium avium
EHGAGSDL

SEQ ID NO: 63687 - protein, 11 aa, Mycobacterium avium
EHGAGSDLAAV

SEQ ID NO: 63688 - protein, 7 aa, Mycobacterium avium
EHGDEGK

SEQ ID NO: 63689 - protein, 10 aa, Mycobacterium avium
EHGFGSPHTD

SEQ ID NO: 63690 - protein, 22 aa, Mycobacterium avium
EHGLPGPDSDIRPGQRQDEKYW

SEQ ID NO: 63691 - protein, 4 aa, Mycobacterium avium
EHGP

SEQ ID NO: 63692 - protein, 11 aa, Mycobacterium avium
EHGSNTIERNR

SEQ ID NO: 63693 - protein, 7 aa, Mycobacterium avium
EHGSPQV

SEQ ID NO: 63694 - protein, 7 aa, Mycobacterium avium
EHHDGTD

SEQ ID NO: 63695 - protein, 11 aa, Mycobacterium avium
EHHPEEGSHVQ

SEQ ID NO: 63696 - protein, 4 aa, Mycobacterium avium
EHNA

SEQ ID NO: 63697 - protein, 11 aa, Mycobacterium avium
EHPAAELAPGQ

SEQ ID NO: 63698 - protein, 7 aa, Mycobacterium avium
EHPDQRA

SEQ ID NO: 63699 - protein, 8 aa, Mycobacterium avium
EHPDQRRD

SEQ ID NO: 63700 - protein, 6 aa, Mycobacterium avium
EHPNEV

SEQ ID NO: 63701 - protein, 5 aa, Mycobacterium avium
EHPRL

SEQ ID NO: 63702 - protein, 4 aa, Mycobacterium avium
EHPT

SEQ ID NO: 63703 - protein, 6 aa, Mycobacterium avium
EHPYPD

SEQ ID NO: 63704 - protein, 9 aa, Mycobacterium avium
EHQATTAKQ

SEQ ID NO: 63705 - protein, 4 aa, Mycobacterium avium
EHRA

SEQ ID NO: 63706 - protein, 24 aa, Mycobacterium avium
EHRDAAPAGHQRAGGTDQLGQRQQ

SEQ ID NO: 63707 - protein, 9 aa, Mycobacterium avium
EHRDHPEHG

SEQ ID NO: 63708 - protein, 18 aa, Mycobacterium avium
EHREDGGDRLGGSRKQQC

SEQ ID NO: 63709 - protein, 4 aa, Mycobacterium avium
EHRG

SEQ ID NO: 63710 - protein, 4 aa, Mycobacterium avium
EHRL

SEQ ID NO: 63711 - protein, 7 aa, Mycobacterium avium
EHRQPRV

SEQ ID NO: 63712 - protein, 19 aa, Mycobacterium avium
EHRRDGTARDWADGAADID

SEQ ID NO: 63713 - protein, 11 aa, Mycobacterium avium
EHSDPKRGEQL

SEQ ID NO: 63714 - protein, 7 aa, Mycobacterium avium
EHSPGGL

SEQ ID NO: 63715 - protein, 7 aa, Mycobacterium avium
EHSSPDQ

SEQ ID NO: 63716 - protein, 5 aa, Mycobacterium avium
EHTGA

SEQ ID NO: 63717 - protein, 8 aa, Mycobacterium avium
EHTGRRPV

SEQ ID NO: 63718 - protein, 12 aa, Mycobacterium avium
EHVPDPNAFSDE

SEQ ID NO: 63719 - protein, 5 aa, Mycobacterium avium
EIADG

SEQ ID NO: 63720 - protein, 11 aa, Mycobacterium avium
EIAQSRAAGDG

SEQ ID NO: 63721 - protein, 9 aa, Mycobacterium avium
EIASTGNRE

SEQ ID NO: 63722 - protein, 18 aa, Mycobacterium avium
EIDSRRGQSGVDRDVRGA

SEQ ID NO: 63723 - protein, 10 aa, Mycobacterium avium
EIERDGAPAA

SEQ ID NO: 63724 - protein, 6 aa, Mycobacterium avium
EIGDSG

SEQ ID NO: 63725 - protein, 10 aa, Mycobacterium avium
EIGPSPPEAD

SEQ ID NO: 63726 - protein, 11 aa, Mycobacterium avium
EIKPGTSEFDP

SEQ ID NO: 63727 - protein, 4 aa, Mycobacterium avium
EINR

SEQ ID NO: 63728 - protein, 10 aa, Mycobacterium avium
EIPAADASLR

SEQ ID NO: 63729 - protein, 6 aa, Mycobacterium avium
EIPAGT

SEQ ID NO: 63730 - protein, 6 aa, Mycobacterium avium
EIPGSG

SEQ ID NO: 63731 - protein, 4 aa, Mycobacterium avium
EIPP

SEQ ID NO: 63732 - protein, 7 aa, Mycobacterium avium
EIRQQRP

SEQ ID NO: 63733 - protein, 7 aa, Mycobacterium avium
EIRTGQD

SEQ ID NO: 63734 - protein, 5 aa, Mycobacterium avium
EISSA

SEQ ID NO: 63735 - protein, 8 aa, Mycobacterium avium
EISTEKGA

SEQ ID NO: 63736 - protein, 11 aa, Mycobacterium avium
EITTGPLGQGL

SEQ ID NO: 63737 - protein, 8 aa, Mycobacterium avium
EIYGGTRS

SEQ ID NO: 63738 - protein, 11 aa, Mycobacterium avium
EKAAAGPYGKT

SEQ ID NO: 63739 - protein, 15 aa, Mycobacterium avium
EKAEQAQAAGADIVG

SEQ ID NO: 63740 - protein, 4 aa, Mycobacterium avium
EKAG

SEQ ID NO: 63741 - protein, 7 aa, Mycobacterium avium
EKAGRDV

SEQ ID NO: 63742 - protein, 19 aa, Mycobacterium avium
EKAKPRKIAVSRNGQAAVN

SEQ ID NO: 63743 - protein, 14 aa, Mycobacterium avium
EKANAQDQKLAEEV

SEQ ID NO: 63744 - protein, 7 aa, Mycobacterium avium
EKARRRR

SEQ ID NO: 63745 - protein, 8 aa, Mycobacterium avium
EKAVSAED

SEQ ID NO: 63746 - protein, 6 aa, Mycobacterium avium
EKAYDA

SEQ ID NO: 63747 - protein, 6 aa, Mycobacterium avium
EKDPVK

SEQ ID NO: 63748 - protein, 13 aa, Mycobacterium avium
EKEARTSKERRPV

SEQ ID NO: 63749 - protein, 5 aa, Mycobacterium avium
EKEGP

SEQ ID NO: 63750 - protein, 7 aa, Mycobacterium avium
EKEPSID

SEQ ID NO: 63751 - protein, 4 aa, Mycobacterium avium
EKEV

SEQ ID NO: 63752 - protein, 9 aa, Mycobacterium avium
EKKGIPRAK

SEQ ID NO: 63753 - protein, 4 aa, Mycobacterium avium
EKKR

SEQ ID NO: 63754 - protein, 8 aa, Mycobacterium avium
EKKSLADR

SEQ ID NO: 63755 - protein, 23 aa, Mycobacterium avium
EKLEAAKKVAPTRPHPDTPPNPA

SEQ ID NO: 63756 - protein, 4 aa, Mycobacterium avium
EKLK

SEQ ID NO: 63757 - protein, 14 aa, Mycobacterium avium
EKPCAQGDLGGQVE

SEQ ID NO: 63758 - protein, 6 aa, Mycobacterium avium
EKPERL

SEQ ID NO: 63759 - protein, 9 aa, Mycobacterium avium
EKPGPVAPR

SEQ ID NO: 63760 - protein, 18 aa, Mycobacterium avium
EKPKPDVDKAEPKAKVKD

SEQ ID NO: 63761 - protein, 6 aa, Mycobacterium avium
EKPSLG

SEQ ID NO: 63762 - protein, 12 aa, Mycobacterium avium
EKPVTSDGPHYP

SEQ ID NO: 63763 - protein, 16 aa, Mycobacterium avium
EKRAPQWQPLPDVAEV

SEQ ID NO: 63764 - protein, 9 aa, Mycobacterium avium
EKRGSVGRA

SEQ ID NO: 63765 - protein, 16 aa, Mycobacterium avium
EKRPYPPGQHGRARIK

SEQ ID NO: 63766 - protein, 17 aa, Mycobacterium avium
EKRSPSWVHPDLRVDGR

SEQ ID NO: 63767 - protein, 7 aa, Mycobacterium avium
EKSPSFH

SEQ ID NO: 63768 - protein, 18 aa, Mycobacterium avium
EKSQAQRRARDRSEFIVD

SEQ ID NO: 63769 - protein, 8 aa, Mycobacterium avium
EKSSSALI

SEQ ID NO: 63770 - protein, 6 aa, Mycobacterium avium
EKTDPD

SEQ ID NO: 63771 - protein, 7 aa, Mycobacterium avium
EKTRRGL

SEQ ID NO: 63772 - protein, 32 aa, Mycobacterium avium
EKVADDREAEGVPGKPSDREDAAVRGSDDEPP

SEQ ID NO: 63773 - protein, 6 aa, Mycobacterium avium
EKWRGD

SEQ ID NO: 63774 - protein, 9 aa, Mycobacterium avium
EKYDSGERC

SEQ ID NO: 63775 - protein, 7 aa, Mycobacterium avium
ELAPPHG

SEQ ID NO: 63776 - protein, 7 aa, Mycobacterium avium
ELAQGPQ

SEQ ID NO: 63777 - protein, 10 aa, Mycobacterium avium
ELARSSRTTV

SEQ ID NO: 63778 - protein, 7 aa, Mycobacterium avium
ELDDPRS

SEQ ID NO: 63779 - protein, 8 aa, Mycobacterium avium
ELDGRSPV

SEQ ID NO: 63780 - protein, 12 aa, Mycobacterium avium
ELDPDKARALAN

SEQ ID NO: 63781 - protein, 10 aa, Mycobacterium avium
ELDRAGIGTA

SEQ ID NO: 63782 - protein, 6 aa, Mycobacterium avium
ELEGAG

SEQ ID NO: 63783 - protein, 5 aa, Mycobacterium avium
ELEPV

SEQ ID NO: 63784 - protein, 14 aa, Mycobacterium avium
ELERPGEWQGYDDP

SEQ ID NO: 63785 - protein, 4 aa, Mycobacterium avium
ELET

SEQ ID NO: 63786 - protein, 18 aa, Mycobacterium avium
ELETTNEELQSTNEELET

SEQ ID NO: 63787 - protein, 12 aa, Mycobacterium avium
ELGGTAVPPAAQ

SEQ ID NO: 63788 - protein, 10 aa, Mycobacterium avium
ELGGTAVPTA

SEQ ID NO: 63789 - protein, 11 aa, Mycobacterium avium
ELGGTAVPTAA

SEQ ID NO: 63790 - protein, 6 aa, Mycobacterium avium
ELGNPR

SEQ ID NO: 63791 - protein, 27 aa, Mycobacterium avium
ELGPAGMADRSSRPLRSPNQTPTRTER

SEQ ID NO: 63792 - protein, 23 aa, Mycobacterium avium
ELGPQAHSIQSPEFAQRLAAAQR

SEQ ID NO: 63793 - protein, 4 aa, Mycobacterium avium
ELGQ

SEQ ID NO: 63794 - protein, 13 aa, Mycobacterium avium
ELGRDPANVRAEA

SEQ ID NO: 63795 - protein, 12 aa, Mycobacterium avium
ELGRTPVEQPFN

SEQ ID NO: 63796 - protein, 16 aa, Mycobacterium avium
ELHGGTAELQNSPLGG

SEQ ID NO: 63797 - protein, 5 aa, Mycobacterium avium
ELHPG

SEQ ID NO: 63798 - protein, 15 aa, Mycobacterium avium
ELKAPYPARRRHRSG

SEQ ID NO: 63799 - protein, 14 aa, Mycobacterium avium
ELKPSDASDANGGP

SEQ ID NO: 63800 - protein, 13 aa, Mycobacterium avium
ELKPSDATDATGG

SEQ ID NO: 63801 - protein, 4 aa, Mycobacterium avium
ELKR

SEQ ID NO: 63802 - protein, 11 aa, Mycobacterium avium
ELKTPDGRSVA

SEQ ID NO: 63803 - protein, 6 aa, Mycobacterium avium
ELNPDE

SEQ ID NO: 63804 - protein, 21 aa, Mycobacterium avium
ELPDPPALPTTAGRAENQSTR

SEQ ID NO: 63805 - protein, 10 aa, Mycobacterium avium
ELPEPEHADA

SEQ ID NO: 63806 - protein, 5 aa, Mycobacterium avium
ELPNT

SEQ ID NO: 63807 - protein, 10 aa, Mycobacterium avium
ELPPGPPGAM

SEQ ID NO: 63808 - protein, 15 aa, Mycobacterium avium
ELPPSDHRVTDHDSA

SEQ ID NO: 63809 - protein, 16 aa, Mycobacterium avium
ELPPSDHRVTDHDSAS

SEQ ID NO: 63810 - protein, 17 aa, Mycobacterium avium
ELPPSDHRVTDHDSASA

SEQ ID NO: 63811 - protein, 6 aa, Mycobacterium avium
ELPRGD

SEQ ID NO: 63812 - protein, 12 aa, Mycobacterium avium
ELPTNTDGGGLS

SEQ ID NO: 63813 - protein, 8 aa, Mycobacterium avium
ELPTSDDG

SEQ ID NO: 63814 - protein, 6 aa, Mycobacterium avium
ELPTTH

SEQ ID NO: 63815 - protein, 5 aa, Mycobacterium avium
ELPTV

SEQ ID NO: 63816 - protein, 7 aa, Mycobacterium avium
ELQGRGH

SEQ ID NO: 63817 - protein, 9 aa, Mycobacterium avium
ELQGRGRGG

SEQ ID NO: 63818 - protein, 4 aa, Mycobacterium avium
ELQP

SEQ ID NO: 63819 - protein, 13 aa, Mycobacterium avium
ELQPERREPLRDK

SEQ ID NO: 63820 - protein, 13 aa, Mycobacterium avium
ELRAAGADPVFAD

SEQ ID NO: 63821 - protein, 19 aa, Mycobacterium avium
ELRARAGERWTPSEDPADP

SEQ ID NO: 63822 - protein, 5 aa, Mycobacterium avium
ELRGV

SEQ ID NO: 63823 - protein, 11 aa, Mycobacterium avium
ELRSAATDYES

SEQ ID NO: 63824 - protein, 10 aa, Mycobacterium avium
ELRSGRSARE

SEQ ID NO: 63825 - protein, 7 aa, Mycobacterium avium
ELRSGRT

SEQ ID NO: 63826 - protein, 18 aa, Mycobacterium avium
ELRTATNSFEAQAARDGL

SEQ ID NO: 63827 - protein, 14 aa, Mycobacterium avium
ELSASDDTDETKPQ

SEQ ID NO: 63828 - protein, 13 aa, Mycobacterium avium
ELSDEVASTGAQR

SEQ ID NO: 63829 - protein, 18 aa, Mycobacterium avium
ELSDTKIAAAKKTFAETG

SEQ ID NO: 63830 - protein, 15 aa, Mycobacterium avium
ELSETPGYQQLCRLW

SEQ ID NO: 63831 - protein, 15 aa, Mycobacterium avium
ELSSAQTAAAQADAL

SEQ ID NO: 63832 - protein, 11 aa, Mycobacterium avium
ELTGKKTYHGF

SEQ ID NO: 63833 - protein, 5 aa, Mycobacterium avium
ELTGS

SEQ ID NO: 63834 - protein, 10 aa, Mycobacterium avium
ELTPAGKARA

SEQ ID NO: 63835 - protein, 10 aa, Mycobacterium avium
ELTPATQDDV

SEQ ID NO: 63836 - protein, 7 aa, Mycobacterium avium
ELTPPAA

SEQ ID NO: 63837 - protein, 10 aa, Mycobacterium avium
ELTPRSAFRD

SEQ ID NO: 63838 - protein, 6 aa, Mycobacterium avium
ELTPVD

SEQ ID NO: 63839 - protein, 10 aa, Mycobacterium avium
ELTSSTGERV

SEQ ID NO: 63840 - protein, 9 aa, Mycobacterium avium
EMAAADADR

SEQ ID NO: 63841 - protein, 11 aa, Mycobacterium avium
EMDPQSAAGLR

SEQ ID NO: 63842 - protein, 48 aa, Mycobacterium avium
EMQSENKTETSALGAQSESSAANPTPVQSQRVDPAAPSEQGHSEARPA

SEQ ID NO: 63843 - protein, 8 aa, Mycobacterium avium
EMTPEPVP

SEQ ID NO: 63844 - protein, 10 aa, Mycobacterium avium
EMTPRNADGE

SEQ ID NO: 63845 - protein, 6 aa, Mycobacterium avium
EMTSDE

SEQ ID NO: 63846 - protein, 10 aa, Mycobacterium avium
EMYERNQEGL

SEQ ID NO: 63847 - protein, 6 aa, Mycobacterium avium
ENATTI

SEQ ID NO: 63848 - protein, 7 aa, Mycobacterium avium
ENDDEDW

SEQ ID NO: 63849 - protein, 7 aa, Mycobacterium avium
ENDEAAL

SEQ ID NO: 63850 - protein, 4 aa, Mycobacterium avium
ENDR

SEQ ID NO: 63851 - protein, 7 aa, Mycobacterium avium
ENDRDNF

SEQ ID NO: 63852 - protein, 6 aa, Mycobacterium avium
ENDYAD

SEQ ID NO: 63853 - protein, 8 aa, Mycobacterium avium
ENETDGYH

SEQ ID NO: 63854 - protein, 7 aa, Mycobacterium avium
ENGERVR

SEQ ID NO: 63855 - protein, 4 aa, Mycobacterium avium
ENGQ

SEQ ID NO: 63856 - protein, 8 aa, Mycobacterium avium
ENHTPPQR

SEQ ID NO: 63857 - protein, 11 aa, Mycobacterium avium
ENIAPAEVEES

SEQ ID NO: 63858 - protein, 8 aa, Mycobacterium avium
ENIAPDEI

SEQ ID NO: 63859 - protein, 8 aa, Mycobacterium avium
ENIAPSEV

SEQ ID NO: 63860 - protein, 7 aa, Mycobacterium avium
ENLGAAP

SEQ ID NO: 63861 - protein, 9 aa, Mycobacterium avium
ENNPPDPAV

SEQ ID NO: 63862 - protein, 9 aa, Mycobacterium avium
ENNQLKSDY

SEQ ID NO: 63863 - protein, 5 aa, Mycobacterium avium
ENPAT

SEQ ID NO: 63864 - protein, 7 aa, Mycobacterium avium
ENPEPLG

SEQ ID NO: 63865 - protein, 10 aa, Mycobacterium avium
ENPGAFTAPT

SEQ ID NO: 63866 - protein, 9 aa, Mycobacterium avium
ENPGTPKGL

SEQ ID NO: 63867 - protein, 4 aa, Mycobacterium avium
ENQF

SEQ ID NO: 63868 - protein, 6 aa, Mycobacterium avium
ENQHDR

SEQ ID NO: 63869 - protein, 9 aa, Mycobacterium avium
ENRPNRGRK

SEQ ID NO: 63870 - protein, 9 aa, Mycobacterium avium
ENRRRPSPF

SEQ ID NO: 63871 - protein, 15 aa, Mycobacterium avium
ENRYRAPQNPTEESL

SEQ ID NO: 63872 - protein, 6 aa, Mycobacterium avium
ENTEEA

SEQ ID NO: 63873 - protein, 15 aa, Mycobacterium avium
ENTPWPSNGHHPRRA

SEQ ID NO: 63874 - protein, 15 aa, Mycobacterium avium
ENTPWTSNGHHPRRA

SEQ ID NO: 63875 - protein, 6 aa, Mycobacterium avium
ENTSSI

SEQ ID NO: 63876 - protein, 8 aa, Mycobacterium avium
ENVAPDEI

SEQ ID NO: 63877 - protein, 6 aa, Mycobacterium avium
ENYDPS

SEQ ID NO: 63878 - protein, 10 aa, Mycobacterium avium
EPAAGAGEQV

SEQ ID NO: 63879 - protein, 16 aa, Mycobacterium avium
EPAAHEEAREETDAEL

SEQ ID NO: 63880 - protein, 24 aa, Mycobacterium avium
EPAAHEETREEAHEEAREETDAEL

SEQ ID NO: 63881 - protein, 8 aa, Mycobacterium avium
EPADTANA

SEQ ID NO: 63882 - protein, 5 aa, Mycobacterium avium
EPAME

SEQ ID NO: 63883 - protein, 6 aa, Mycobacterium avium
EPANLS

SEQ ID NO: 63884 - protein, 24 aa, Mycobacterium avium
EPDAGSDIAGVRSRGTRQDDGSWR

SEQ ID NO: 63885 - protein, 8 aa, Mycobacterium avium
EPDATSTV

SEQ ID NO: 63886 - protein, 5 aa, Mycobacterium avium
EPDDV

SEQ ID NO: 63887 - protein, 14 aa, Mycobacterium avium
EPDEHGRRKPESLY

SEQ ID NO: 63888 - protein, 5 aa, Mycobacterium avium
EPDGE

SEQ ID NO: 63889 - protein, 6 aa, Mycobacterium avium
EPDQRR

SEQ ID NO: 63890 - protein, 8 aa, Mycobacterium avium
EPDYEQAA

SEQ ID NO: 63891 - protein, 4 aa, Mycobacterium avium
EPEA

SEQ ID NO: 63892 - protein, 11 aa, Mycobacterium avium
EPEADAQARAV

SEQ ID NO: 63893 - protein, 15 aa, Mycobacterium avium
EPEAGTSSASTGGSA

SEQ ID NO: 63894 - protein, 19 aa, Mycobacterium avium
EPECGSDVAAAATRAVRDG

SEQ ID NO: 63895 - protein, 15 aa, Mycobacterium avium
EPEGELPPRLTPRRP

SEQ ID NO: 63896 - protein, 16 aa, Mycobacterium avium
EPEGELPRRPTPRRPL

SEQ ID NO: 63897 - protein, 15 aa, Mycobacterium avium
EPEGESPPRPTPRRP

SEQ ID NO: 63898 - protein, 8 aa, Mycobacterium avium
EPEGPPRF

SEQ ID NO: 63899 - protein, 5 aa, Mycobacterium avium
EPESV

SEQ ID NO: 63900 - protein, 4 aa, Mycobacterium avium
EPET

SEQ ID NO: 63901 - protein, 6 aa, Mycobacterium avium
EPFAGS

SEQ ID NO: 63902 - protein, 19 aa, Mycobacterium avium
EPFTGGEPLDDEDARPRQK

SEQ ID NO: 63903 - protein, 6 aa, Mycobacterium avium
EPGAAL

SEQ ID NO: 63904 - protein, 9 aa, Mycobacterium avium
EPGAAPDVQ

SEQ ID NO: 63905 - protein, 30 aa, Mycobacterium avium
EPGAEQMGPGTQPAEVGDDAQAGAATGRLQ

SEQ ID NO: 63906 - protein, 21 aa, Mycobacterium avium
EPGAGSDAAALSTRAVRQGGD

SEQ ID NO: 63907 - protein, 19 aa, Mycobacterium avium
EPGAGSDAAAVATKARRVD

SEQ ID NO: 63908 - protein, 18 aa, Mycobacterium avium
EPGAGSDAAAVATKATRV

SEQ ID NO: 63909 - protein, 22 aa, Mycobacterium avium
EPGAGSDLASVRTKAEKTETGW

SEQ ID NO: 63910 - protein, 23 aa, Mycobacterium avium
EPGDPTHDATKPWPQSRRTVDAG

SEQ ID NO: 63911 - protein, 5 aa, Mycobacterium avium
EPGEG

SEQ ID NO: 63912 - protein, 7 aa, Mycobacterium avium
EPGEHMS

SEQ ID NO: 63913 - protein, 5 aa, Mycobacterium avium
EPGFA

SEQ ID NO: 63914 - protein, 5 aa, Mycobacterium avium
EPGHQ

SEQ ID NO: 63915 - protein, 8 aa, Mycobacterium avium
EPGKQPPG

SEQ ID NO: 63916 - protein, 8 aa, Mycobacterium avium
EPGPDSRE

SEQ ID NO: 63917 - protein, 24 aa, Mycobacterium avium
EPGQGWAPLNPSVTATETDSGYRI

SEQ ID NO: 63918 - protein, 6 aa, Mycobacterium avium
EPGQQT

SEQ ID NO: 63919 - protein, 22 aa, Mycobacterium avium
EPGQRKPTAEVGTKAARQGDSW

SEQ ID NO: 63920 - protein, 9 aa, Mycobacterium avium
EPGRAPLQA

SEQ ID NO: 63921 - protein, 18 aa, Mycobacterium avium
EPGRRDVGRRQPAAAGAH

SEQ ID NO: 63922 - protein, 9 aa, Mycobacterium avium
EPGSFQSGH

SEQ ID NO: 63923 - protein, 18 aa, Mycobacterium avium
EPGSPVPNGVTPPDGAPV

SEQ ID NO: 63924 - protein, 6 aa, Mycobacterium avium
EPGSRG

SEQ ID NO: 63925 - protein, 5 aa, Mycobacterium avium
EPGVV

SEQ ID NO: 63926 - protein, 7 aa, Mycobacterium avium
EPHSGIR

SEQ ID NO: 63927 - protein, 20 aa, Mycobacterium avium
EPKKQNAADHIPTRKRGIAD

SEQ ID NO: 63928 - protein, 17 aa, Mycobacterium avium
EPKRRGRQGAAAPPLRE

SEQ ID NO: 63929 - protein, 6 aa, Mycobacterium avium
EPLADG

SEQ ID NO: 63930 - protein, 28 aa, Mycobacterium avium
EPLHPRPERHHGAQGRLGAGDPERPGQP

SEQ ID NO: 63931 - protein, 6 aa, Mycobacterium avium
EPMTAS

SEQ ID NO: 63932 - protein, 6 aa, Mycobacterium avium
EPNGAR

SEQ ID NO: 63933 - protein, 8 aa, Mycobacterium avium
EPPAPADE

SEQ ID NO: 63934 - protein, 6 aa, Mycobacterium avium
EPPAPH

SEQ ID NO: 63935 - protein, 6 aa, Mycobacterium avium
EPPCPG

SEQ ID NO: 63936 - protein, 11 aa, Mycobacterium avium
EPPDALSDEEA

SEQ ID NO: 63937 - protein, 7 aa, Mycobacterium avium
EPPDERR

SEQ ID NO: 63938 - protein, 6 aa, Mycobacterium avium
EPPDTF

SEQ ID NO: 63939 - protein, 8 aa, Mycobacterium avium
EPPEGDPI

SEQ ID NO: 63940 - protein, 6 aa, Mycobacterium avium
EPPENH

SEQ ID NO: 63941 - protein, 11 aa, Mycobacterium avium
EPPERGSATRA

SEQ ID NO: 63942 - protein, 14 aa, Mycobacterium avium
EPPGGLISSTASGL

SEQ ID NO: 63943 - protein, 5 aa, Mycobacterium avium
EPPGQ

SEQ ID NO: 63944 - protein, 19 aa, Mycobacterium avium
EPPRRPEPERPAAPPASRA

SEQ ID NO: 63945 - protein, 8 aa, Mycobacterium avium
EPPSTSSA

SEQ ID NO: 63946 - protein, 8 aa, Mycobacterium avium
EPPTERPV

SEQ ID NO: 63947 - protein, 8 aa, Mycobacterium avium
EPQAPRPR

SEQ ID NO: 63948 - protein, 9 aa, Mycobacterium avium
EPQAPRPRV

SEQ ID NO: 63949 - protein, 15 aa, Mycobacterium avium
EPQDGRYDDLSPSTE

SEQ ID NO: 63950 - protein, 13 aa, Mycobacterium avium
EPQHGPGAQRVGQ

SEQ ID NO: 63951 - protein, 14 aa, Mycobacterium avium
EPQPGLGERQRQHR

SEQ ID NO: 63952 - protein, 15 aa, Mycobacterium avium
EPQPGLGKRQRNHRR

SEQ ID NO: 63953 - protein, 10 aa, Mycobacterium avium
EPQSAGACGS

SEQ ID NO: 63954 - protein, 4 aa, Mycobacterium avium
EPQT

SEQ ID NO: 63955 - protein, 11 aa, Mycobacterium avium
EPREGGDPQRG

SEQ ID NO: 63956 - protein, 9 aa, Mycobacterium avium
EPRGDGGFG

SEQ ID NO: 63957 - protein, 10 aa, Mycobacterium avium
EPRKGDNSPM

SEQ ID NO: 63958 - protein, 5 aa, Mycobacterium avium
EPRPI

SEQ ID NO: 63959 - protein, 7 aa, Mycobacterium avium
EPRQPVD

SEQ ID NO: 63960 - protein, 8 aa, Mycobacterium avium
EPSGRSDL

SEQ ID NO: 63961 - protein, 11 aa, Mycobacterium avium
EPSLSDEEAAL

SEQ ID NO: 63962 - protein, 9 aa, Mycobacterium avium
EPSSGLDPS

SEQ ID NO: 63963 - protein, 10 aa, Mycobacterium avium
EPTAGLNAAQ

SEQ ID NO: 63964 - protein, 10 aa, Mycobacterium avium
EPTAPERGRF

SEQ ID NO: 63965 - protein, 7 aa, Mycobacterium avium
EPTAPEV

SEQ ID NO: 63966 - protein, 13 aa, Mycobacterium avium
EPTAPEVPYYSAT

SEQ ID NO: 63967 - protein, 5 aa, Mycobacterium avium
EPTIE

SEQ ID NO: 63968 - protein, 4 aa, Mycobacterium avium
EPTN

SEQ ID NO: 63969 - protein, 17 aa, Mycobacterium avium
EPTTATPTRRPRSMRRT

SEQ ID NO: 63970 - protein, 5 aa, Mycobacterium avium
EPTVR

SEQ ID NO: 63971 - protein, 4 aa, Mycobacterium avium
EPVG

SEQ ID NO: 63972 - protein, 6 aa, Mycobacterium avium
EPVPPM

SEQ ID NO: 63973 - protein, 6 aa, Mycobacterium avium
EPVPTE

SEQ ID NO: 63974 - protein, 10 aa, Mycobacterium avium
EPVSAGTATA

SEQ ID NO: 63975 - protein, 4 aa, Mycobacterium avium
EPVT

SEQ ID NO: 63976 - protein, 14 aa, Mycobacterium avium
EPYDDSEDKTRQQL

SEQ ID NO: 63977 - protein, 10 aa, Mycobacterium avium
EQAAHAPGDY

SEQ ID NO: 63978 - protein, 20 aa, Mycobacterium avium
EQADERPERQGLGGLGADDP

SEQ ID NO: 63979 - protein, 5 aa, Mycobacterium avium
EQAER

SEQ ID NO: 63980 - protein, 5 aa, Mycobacterium avium
EQAES

SEQ ID NO: 63981 - protein, 13 aa, Mycobacterium avium
EQAGSDDFGAEGW

SEQ ID NO: 63982 - protein, 11 aa, Mycobacterium avium
EQAGVSGPLPE

SEQ ID NO: 63983 - protein, 5 aa, Mycobacterium avium
EQAHG

SEQ ID NO: 63984 - protein, 8 aa, Mycobacterium avium
EQATADAF

SEQ ID NO: 63985 - protein, 5 aa, Mycobacterium avium
EQDGV

SEQ ID NO: 63986 - protein, 22 aa, Mycobacterium avium
EQDTQNGAHPTEPGKGGKAVSQ

SEQ ID NO: 63987 - protein, 9 aa, Mycobacterium avium
EQEGDFDAT

SEQ ID NO: 63988 - protein, 13 aa, Mycobacterium avium
EQEGPDSPGSGGD

SEQ ID NO: 63989 - protein, 6 aa, Mycobacterium avium
EQGAGG

SEQ ID NO: 63990 - protein, 9 aa, Mycobacterium avium
EQGAVTPQP

SEQ ID NO: 63991 - protein, 5 aa, Mycobacterium avium
EQGEF

SEQ ID NO: 63992 - protein, 5 aa, Mycobacterium avium
EQGGL

SEQ ID NO: 63993 - protein, 50 aa, Mycobacterium avium
EQGKPRRRRGRRRGRGAATSSEKQTNGQLTGDSTATKPRRSRAARRAPDR

SEQ ID NO: 63994 - protein, 4 aa, Mycobacterium avium
EQGL

SEQ ID NO: 63995 - protein, 4 aa, Mycobacterium avium
EQGP

SEQ ID NO: 63996 - protein, 13 aa, Mycobacterium avium
EQGPGHVTQPAGH

SEQ ID NO: 63997 - protein, 10 aa, Mycobacterium avium
EQGSAEHGDT

SEQ ID NO: 63998 - protein, 5 aa, Mycobacterium avium
EQHGG

SEQ ID NO: 63999 - protein, 5 aa, Mycobacterium avium
EQHRG

SEQ ID NO: 64000 - protein, 9 aa, Mycobacterium avium
EQHSQPSPF

SEQ ID NO: 64001 - protein, 14 aa, Mycobacterium avium
EQIGSPTEVYDAPT

SEQ ID NO: 64002 - protein, 9 aa, Mycobacterium avium
EQLSNADVD

SEQ ID NO: 64003 - protein, 9 aa, Mycobacterium avium
EQNDEWAEG

SEQ ID NO: 64004 - protein, 7 aa, Mycobacterium avium
EQNHDSG

SEQ ID NO: 64005 - protein, 4 aa, Mycobacterium avium
EQPD

SEQ ID NO: 64006 - protein, 5 aa, Mycobacterium avium
EQPDL

SEQ ID NO: 64007 - protein, 4 aa, Mycobacterium avium
EQPG

SEQ ID NO: 64008 - protein, 5 aa, Mycobacterium avium
EQPID

SEQ ID NO: 64009 - protein, 6 aa, Mycobacterium avium
EQQGPT

SEQ ID NO: 64010 - protein, 12 aa, Mycobacterium avium
EQREYNSEDNDP

SEQ ID NO: 64011 - protein, 14 aa, Mycobacterium avium
EQRGPEAWRLRLIK

SEQ ID NO: 64012 - protein, 7 aa, Mycobacterium avium
EQRGPWG

SEQ ID NO: 64013 - protein, 14 aa, Mycobacterium avium
EQRGRYRKAEDFAS

SEQ ID NO: 64014 - protein, 8 aa, Mycobacterium avium
EQRKAYGG

SEQ ID NO: 64015 - protein, 21 aa, Mycobacterium avium
EQRRDRRPGGGPVQDRPGAPV

SEQ ID NO: 64016 - protein, 6 aa, Mycobacterium avium
EQRRRA

SEQ ID NO: 64017 - protein, 11 aa, Mycobacterium avium
EQRRRKPTDDI

SEQ ID NO: 64018 - protein, 5 aa, Mycobacterium avium
EQSEP

SEQ ID NO: 64019 - protein, 7 aa, Mycobacterium avium
EQSGPKE

SEQ ID NO: 64020 - protein, 8 aa, Mycobacterium avium
EQSLTSDR

SEQ ID NO: 64021 - protein, 7 aa, Mycobacterium avium
EQTQAGQ

SEQ ID NO: 64022 - protein, 8 aa, Mycobacterium avium
EQTQTDAE

SEQ ID NO: 64023 - protein, 15 aa, Mycobacterium avium
EQVDRDDTHVSPAQA

SEQ ID NO: 64024 - protein, 6 aa, Mycobacterium avium
EQVGAA

SEQ ID NO: 64025 - protein, 10 aa, Mycobacterium avium
EQWGGGGQPY

SEQ ID NO: 64026 - protein, 9 aa, Mycobacterium avium
EQYGGGGAG

SEQ ID NO: 64027 - protein, 8 aa, Mycobacterium avium
EQYGGSGV

SEQ ID NO: 64028 - protein, 4 aa, Mycobacterium avium
ERAA

SEQ ID NO: 64029 - protein, 7 aa, Mycobacterium avium
ERAAGAT

SEQ ID NO: 64030 - protein, 5 aa, Mycobacterium avium
ERAAQ

SEQ ID NO: 64031 - protein, 8 aa, Mycobacterium avium
ERAAQRNP

SEQ ID NO: 64032 - protein, 7 aa, Mycobacterium avium
ERAASQA

SEQ ID NO: 64033 - protein, 15 aa, Mycobacterium avium
ERADPVPDGDLAAQR

SEQ ID NO: 64034 - protein, 10 aa, Mycobacterium avium
ERAEAETEEL

SEQ ID NO: 64035 - protein, 18 aa, Mycobacterium avium
ERAEETRAETRTRVGERR

SEQ ID NO: 64036 - protein, 9 aa, Mycobacterium avium
ERAGAREAG

SEQ ID NO: 64037 - protein, 7 aa, Mycobacterium avium
ERAGERP

SEQ ID NO: 64038 - protein, 10 aa, Mycobacterium avium
ERANAQSSEM

SEQ ID NO: 64039 - protein, 8 aa, Mycobacterium avium
ERAPAELA

SEQ ID NO: 64040 - protein, 8 aa, Mycobacterium avium
ERAPDDDR

SEQ ID NO: 64041 - protein, 12 aa, Mycobacterium avium
ERAPSDTRANAV

SEQ ID NO: 64042 - protein, 9 aa, Mycobacterium avium
ERAQTRASR

SEQ ID NO: 64043 - protein, 5 aa, Mycobacterium avium
ERARA

SEQ ID NO: 64044 - protein, 27 aa, Mycobacterium avium
ERASVGDEELAASADAALRAEQAAERR

SEQ ID NO: 64045 - protein, 9 aa, Mycobacterium avium
ERATPPGLA

SEQ ID NO: 64046 - protein, 10 aa, Mycobacterium avium
ERDAQRRRNL

SEQ ID NO: 64047 - protein, 5 aa, Mycobacterium avium
ERDDP

SEQ ID NO: 64048 - protein, 6 aa, Mycobacterium avium
ERDETS

SEQ ID NO: 64049 - protein, 9 aa, Mycobacterium avium
ERDGAGEPL

SEQ ID NO: 64050 - protein, 8 aa, Mycobacterium avium
ERDGIDTT

SEQ ID NO: 64051 - protein, 16 aa, Mycobacterium avium
ERDHHSPAGHRGQQTG

SEQ ID NO: 64052 - protein, 10 aa, Mycobacterium avium
ERDKARMSRA

SEQ ID NO: 64053 - protein, 8 aa, Mycobacterium avium
ERDLGEAE

SEQ ID NO: 64054 - protein, 7 aa, Mycobacterium avium
ERDNERC

SEQ ID NO: 64055 - protein, 6 aa, Mycobacterium avium
ERDNQR

SEQ ID NO: 64056 - protein, 10 aa, Mycobacterium avium
ERDPDADKRL

SEQ ID NO: 64057 - protein, 8 aa, Mycobacterium avium
ERDPGNTR

SEQ ID NO: 64058 - protein, 12 aa, Mycobacterium avium
ERDRDSNSGKVR

SEQ ID NO: 64059 - protein, 9 aa, Mycobacterium avium
ERDRGAATR

SEQ ID NO: 64060 - protein, 8 aa, Mycobacterium avium
ERDYSGAL

SEQ ID NO: 64061 - protein, 6 aa, Mycobacterium avium
ERDYTT

SEQ ID NO: 64062 - protein, 5 aa, Mycobacterium avium
EREAH

SEQ ID NO: 64063 - protein, 4 aa, Mycobacterium avium
EREG

SEQ ID NO: 64064 - protein, 13 aa, Mycobacterium avium
EREPAHPDRLPRG

SEQ ID NO: 64065 - protein, 13 aa, Mycobacterium avium
ERERGAAPDTIPA

SEQ ID NO: 64066 - protein, 11 aa, Mycobacterium avium
ERETAERERQL

SEQ ID NO: 64067 - protein, 6 aa, Mycobacterium avium
EREYTS

SEQ ID NO: 64068 - protein, 20 aa, Mycobacterium avium
ERFGGDDAVRPEFDSPPIPL

SEQ ID NO: 64069 - protein, 6 aa, Mycobacterium avium
ERGAER

SEQ ID NO: 64070 - protein, 16 aa, Mycobacterium avium
ERGAGARAVARRRGGV

SEQ ID NO: 64071 - protein, 5 aa, Mycobacterium avium
ERGAQ

SEQ ID NO: 64072 - protein, 4 aa, Mycobacterium avium
ERGD

SEQ ID NO: 64073 - protein, 8 aa, Mycobacterium avium
ERGEGGNL

SEQ ID NO: 64074 - protein, 9 aa, Mycobacterium avium
ERGEKESVK

SEQ ID NO: 64075 - protein, 15 aa, Mycobacterium avium
ERGGATLAGGGSIPG

SEQ ID NO: 64076 - protein, 5 aa, Mycobacterium avium
ERGGV

SEQ ID NO: 64077 - protein, 4 aa, Mycobacterium avium
ERGL

SEQ ID NO: 64078 - protein, 5 aa, Mycobacterium avium
ERGLA

SEQ ID NO: 64079 - protein, 23 aa, Mycobacterium avium
ERGLARPTGAASVATYDEPRMSA

SEQ ID NO: 64080 - protein, 18 aa, Mycobacterium avium
ERGLSRSAGTARHDEPRM

SEQ ID NO: 64081 - protein, 18 aa, Mycobacterium avium
ERGLSRSTGTARHDEPRM

SEQ ID NO: 64082 - protein, 4 aa, Mycobacterium avium
ERGN

SEQ ID NO: 64083 - protein, 8 aa, Mycobacterium avium
ERGQGGNL

SEQ ID NO: 64084 - protein, 7 aa, Mycobacterium avium
ERGQPRV

SEQ ID NO: 64085 - protein, 4 aa, Mycobacterium avium
ERGR

SEQ ID NO: 64086 - protein, 9 aa, Mycobacterium avium
ERGSAEPAV

SEQ ID NO: 64087 - protein, 22 aa, Mycobacterium avium
ERGSGGGPAVRPGLSREPTRPG

SEQ ID NO: 64088 - protein, 4 aa, Mycobacterium avium
ERGW

SEQ ID NO: 64089 - protein, 5 aa, Mycobacterium avium
ERHGG

SEQ ID NO: 64090 - protein, 4 aa, Mycobacterium avium
ERHH

SEQ ID NO: 64091 - protein, 5 aa, Mycobacterium avium
ERHPD

SEQ ID NO: 64092 - protein, 12 aa, Mycobacterium avium
ERHTHAGGDYAA

SEQ ID NO: 64093 - protein, 26 aa, Mycobacterium avium
ERIDGARGGQARGRGHHQVRPDAGGH

SEQ ID NO: 64094 - protein, 9 aa, Mycobacterium avium
ERKANGPFT

SEQ ID NO: 64095 - protein, 5 aa, Mycobacterium avium
ERKDE

SEQ ID NO: 64096 - protein, 11 aa, Mycobacterium avium
ERKPKDGETKQ

SEQ ID NO: 64097 - protein, 7 aa, Mycobacterium avium
ERKTGSI

SEQ ID NO: 64098 - protein, 4 aa, Mycobacterium avium
ERLG

SEQ ID NO: 64099 - protein, 6 aa, Mycobacterium avium
ERLGGQ

SEQ ID NO: 64100 - protein, 10 aa, Mycobacterium avium
ERNDKGGRAT

SEQ ID NO: 64101 - protein, 6 aa, Mycobacterium avium
ERNSGL

SEQ ID NO: 64102 - protein, 14 aa, Mycobacterium avium
ERPAGSAPLSWPPG

SEQ ID NO: 64103 - protein, 9 aa, Mycobacterium avium
ERPALDPSR

SEQ ID NO: 64104 - protein, 6 aa, Mycobacterium avium
ERPDDA

SEQ ID NO: 64105 - protein, 18 aa, Mycobacterium avium
ERPDHHAETSSDLAADEA

SEQ ID NO: 64106 - protein, 7 aa, Mycobacterium avium
ERPEETD

SEQ ID NO: 64107 - protein, 24 aa, Mycobacterium avium
ERPGLPGEWPTGYDDATQQNTPAW

SEQ ID NO: 64108 - protein, 14 aa, Mycobacterium avium
ERPGRPLGASTAEF

SEQ ID NO: 64109 - protein, 4 aa, Mycobacterium avium
ERPH

SEQ ID NO: 64110 - protein, 8 aa, Mycobacterium avium
ERPHENEL

SEQ ID NO: 64111 - protein, 7 aa, Mycobacterium avium
ERPHPGA

SEQ ID NO: 64112 - protein, 10 aa, Mycobacterium avium
ERPHQPGPDL

SEQ ID NO: 64113 - protein, 5 aa, Mycobacterium avium
ERPHR

SEQ ID NO: 64114 - protein, 4 aa, Mycobacterium avium
ERPI

SEQ ID NO: 64115 - protein, 8 aa, Mycobacterium avium
ERPQASPL

SEQ ID NO: 64116 - protein, 11 aa, Mycobacterium avium
ERPQGGDFARG

SEQ ID NO: 64117 - protein, 6 aa, Mycobacterium avium
ERPRGV

SEQ ID NO: 64118 - protein, 7 aa, Mycobacterium avium
ERPSDAS

SEQ ID NO: 64119 - protein, 12 aa, Mycobacterium avium
ERPVRSARGWSA

SEQ ID NO: 64120 - protein, 6 aa, Mycobacterium avium
ERPWRR

SEQ ID NO: 64121 - protein, 8 aa, Mycobacterium avium
ERQQFGRP

SEQ ID NO: 64122 - protein, 6 aa, Mycobacterium avium
ERQRHQ

SEQ ID NO: 64123 - protein, 6 aa, Mycobacterium avium
ERQTPL

SEQ ID NO: 64124 - protein, 4 aa, Mycobacterium avium
ERRA

SEQ ID NO: 64125 - protein, 11 aa, Mycobacterium avium
ERRADATLDPA

SEQ ID NO: 64126 - protein, 8 aa, Mycobacterium avium
ERRAEGLG

SEQ ID NO: 64127 - protein, 6 aa, Mycobacterium avium
ERRAYT

SEQ ID NO: 64128 - protein, 4 aa, Mycobacterium avium
ERRG

SEQ ID NO: 64129 - protein, 5 aa, Mycobacterium avium
ERRGI

SEQ ID NO: 64130 - protein, 11 aa, Mycobacterium avium
ERRNDGKSPDD

SEQ ID NO: 64131 - protein, 25 aa, Mycobacterium avium
ERRQSVRHGNRTAAKPSGMAGSPVS

SEQ ID NO: 64132 - protein, 5 aa, Mycobacterium avium
ERRRP

SEQ ID NO: 64133 - protein, 45 aa, Mycobacterium avium
ERSAASAAAGQAGAGSSTLANASAVSAAAGATAGAASSRAAEQQR

SEQ ID NO: 64134 - protein, 45 aa, Mycobacterium avium
ERSAASAAAGQAGAGSSTLANASAVSATAGATAGAASSRAAEQQR

SEQ ID NO: 64135 - protein, 9 aa, Mycobacterium avium
ERSATSALP

SEQ ID NO: 64136 - protein, 7 aa, Mycobacterium avium
ERSDGSW

SEQ ID NO: 64137 - protein, 12 aa, Mycobacterium avium
ERSKARGRKKYE

SEQ ID NO: 64138 - protein, 5 aa, Mycobacterium avium
ERSPF

SEQ ID NO: 64139 - protein, 10 aa, Mycobacterium avium
ERSPVGSARE

SEQ ID NO: 64140 - protein, 7 aa, Mycobacterium avium
ERSRAER

SEQ ID NO: 64141 - protein, 13 aa, Mycobacterium avium
ERSSAAGSARRER

SEQ ID NO: 64142 - protein, 4 aa, Mycobacterium avium
ERST

SEQ ID NO: 64143 - protein, 10 aa, Mycobacterium avium
ERSVAGEKLP

SEQ ID NO: 64144 - protein, 8 aa, Mycobacterium avium
ERTGEPTI

SEQ ID NO: 64145 - protein, 9 aa, Mycobacterium avium
ERTGGGARR

SEQ ID NO: 64146 - protein, 5 aa, Mycobacterium avium
ERTNR

SEQ ID NO: 64147 - protein, 13 aa, Mycobacterium avium
ERTPPAHRTAGQT

SEQ ID NO: 64148 - protein, 6 aa, Mycobacterium avium
ERTREF

SEQ ID NO: 64149 - protein, 8 aa, Mycobacterium avium
ERTRGSRP

SEQ ID NO: 64150 - protein, 8 aa, Mycobacterium avium
ERTRPSHP

SEQ ID NO: 64151 - protein, 7 aa, Mycobacterium avium
ERTSEPD

SEQ ID NO: 64152 - protein, 16 aa, Mycobacterium avium
ERVDPDKDADGLHPTN

SEQ ID NO: 64153 - protein, 12 aa, Mycobacterium avium
ERVNRNGPISAV

SEQ ID NO: 64154 - protein, 13 aa, Mycobacterium avium
ERYGRESPRGAEP

SEQ ID NO: 64155 - protein, 204 aa, Mycobacterium avium
ERYGRPQDDARGGSEPQGAPDQRGGYPPEQAGYPPQQGYPPPRHPEQGGYPEQGGYPPPQSYQEHGGYPDQRGGYPEPGQGGYPPQQHGYPDQRGYPEPAQGGYPQSYEQRPPAPPGYSGQGYDQGYRPPGGYPPPGGQPAGGPQGYGGYGDYGRGPARPDEGGYAPPEQRPAYPEQGGGYDQGYPQGGGYGRQDYGSAEYTQY

SEQ ID NO: 64156 - protein, 91 aa, Mycobacterium avium
ERYGRPQDDARGGSEPQGAPDQRGGYPPEQGGYPPQQGYPPPRHPEQGGYPEQGGYPPPQSYQEHGGYPDQRGGYPEPGQAGYPPQQHGYP

SEQ ID NO: 64157 - protein, 7 aa, Mycobacterium avium
ERYTEAE

SEQ ID NO: 64158 - protein, 12 aa, Mycobacterium avium
ESAAGQGLTGGG

SEQ ID NO: 64159 - protein, 7 aa, Mycobacterium avium
ESAATTL

SEQ ID NO: 64160 - protein, 19 aa, Mycobacterium avium
ESADEQPPLRAGPVRWHRR

SEQ ID NO: 64161 - protein, 9 aa, Mycobacterium avium
ESADRPLDD

SEQ ID NO: 64162 - protein, 11 aa, Mycobacterium avium
ESAFSGGRSVK

SEQ ID NO: 64163 - protein, 16 aa, Mycobacterium avium
ESAGGAATPETATESA

SEQ ID NO: 64164 - protein, 9 aa, Mycobacterium avium
ESAGGQVDQ

SEQ ID NO: 64165 - protein, 6 aa, Mycobacterium avium
ESAGNA

SEQ ID NO: 64166 - protein, 6 aa, Mycobacterium avium
ESAGWA

SEQ ID NO: 64167 - protein, 7 aa, Mycobacterium avium
ESALTAK

SEQ ID NO: 64168 - protein, 10 aa, Mycobacterium avium
ESARQFATRS

SEQ ID NO: 64169 - protein, 12 aa, Mycobacterium avium
ESATATADPAEI

SEQ ID NO: 64170 - protein, 12 aa, Mycobacterium avium
ESATGTADPAEI

SEQ ID NO: 64171 - protein, 13 aa, Mycobacterium avium
ESATGTADPGEIR

SEQ ID NO: 64172 - protein, 17 aa, Mycobacterium avium
ESAWGENDVDNSVAGPP

SEQ ID NO: 64173 - protein, 9 aa, Mycobacterium avium
ESDDTLDDG

SEQ ID NO: 64174 - protein, 8 aa, Mycobacterium avium
ESDLEESG

SEQ ID NO: 64175 - protein, 11 aa, Mycobacterium avium
ESDPANQNRID

SEQ ID NO: 64176 - protein, 11 aa, Mycobacterium avium
ESDPTRGERTR

SEQ ID NO: 64177 - protein, 8 aa, Mycobacterium avium
ESDSRRGP

SEQ ID NO: 64178 - protein, 6 aa, Mycobacterium avium
ESDTGA

SEQ ID NO: 64179 - protein, 5 aa, Mycobacterium avium
ESDVD

SEQ ID NO: 64180 - protein, 10 aa, Mycobacterium avium
ESEDAKHRAD

SEQ ID NO: 64181 - protein, 11 aa, Mycobacterium avium
ESEFSGGRSVK

SEQ ID NO: 64182 - protein, 9 aa, Mycobacterium avium
ESEGYQKAA

SEQ ID NO: 64183 - protein, 24 aa, Mycobacterium avium
ESEPVSVRDANDANLRTKPGAPLR

SEQ ID NO: 64184 - protein, 42 aa, Mycobacterium avium
ESFGGGKAAEGAAKAPAKAAAKGDAKTAAKGDVKAPDKALDA

SEQ ID NO: 64185 - protein, 6 aa, Mycobacterium avium
ESGAKE

SEQ ID NO: 64186 - protein, 22 aa, Mycobacterium avium
ESGDAKAVPKTAADRRPPVGAG

SEQ ID NO: 64187 - protein, 10 aa, Mycobacterium avium
ESGEPGGIGG

SEQ ID NO: 64188 - protein, 7 aa, Mycobacterium avium
ESGGRAA

SEQ ID NO: 64189 - protein, 16 aa, Mycobacterium avium
ESGHAGGGAVDARGTA

SEQ ID NO: 64190 - protein, 8 aa, Mycobacterium avium
ESGKEHKG

SEQ ID NO: 64191 - protein, 7 aa, Mycobacterium avium
ESGLPRE

SEQ ID NO: 64192 - protein, 6 aa, Mycobacterium avium
ESGPDS

SEQ ID NO: 64193 - protein, 11 aa, Mycobacterium avium
ESGRGSGTANI

SEQ ID NO: 64194 - protein, 8 aa, Mycobacterium avium
ESGRQLDE

SEQ ID NO: 64195 - protein, 16 aa, Mycobacterium avium
ESGRRGTGVGPVGEKL

SEQ ID NO: 64196 - protein, 20 aa, Mycobacterium avium
ESGSGLPNGLNETLGGPLGP

SEQ ID NO: 64197 - protein, 10 aa, Mycobacterium avium
ESGSIPRQPI

SEQ ID NO: 64198 - protein, 10 aa, Mycobacterium avium
ESGTAPAPER

SEQ ID NO: 64199 - protein, 11 aa, Mycobacterium avium
ESGVDSTGMSS

SEQ ID NO: 64200 - protein, 16 aa, Mycobacterium avium
ESGVGAAIDDDAPVDF

SEQ ID NO: 64201 - protein, 5 aa, Mycobacterium avium
ESHGR

SEQ ID NO: 64202 - protein, 5 aa, Mycobacterium avium
ESHPP

SEQ ID NO: 64203 - protein, 10 aa, Mycobacterium avium
ESIGTGEQLT

SEQ ID NO: 64204 - protein, 5 aa, Mycobacterium avium
ESITR

SEQ ID NO: 64205 - protein, 4 aa, Mycobacterium avium
ESLG

SEQ ID NO: 64206 - protein, 11 aa, Mycobacterium avium
ESLSEGGGGTV

SEQ ID NO: 64207 - protein, 9 aa, Mycobacterium avium
ESNADTPGA

SEQ ID NO: 64208 - protein, 4 aa, Mycobacterium avium
ESNG

SEQ ID NO: 64209 - protein, 5 aa, Mycobacterium avium
ESNRL

SEQ ID NO: 64210 - protein, 7 aa, Mycobacterium avium
ESNSGTG

SEQ ID NO: 64211 - protein, 4 aa, Mycobacterium avium
ESNW

SEQ ID NO: 64212 - protein, 4 aa, Mycobacterium avium
ESPE

SEQ ID NO: 64213 - protein, 13 aa, Mycobacterium avium
ESPGIDAAPQFPP

SEQ ID NO: 64214 - protein, 20 aa, Mycobacterium avium
ESPGRLRNAGPARPGQHNDE

SEQ ID NO: 64215 - protein, 13 aa, Mycobacterium avium
ESPGTGPGKADPG

SEQ ID NO: 64216 - protein, 6 aa, Mycobacterium avium
ESPRRA

SEQ ID NO: 64217 - protein, 16 aa, Mycobacterium avium
ESPVKSDSRLARRATA

SEQ ID NO: 64218 - protein, 4 aa, Mycobacterium avium
ESQD

SEQ ID NO: 64219 - protein, 17 aa, Mycobacterium avium
ESRGGEGPGTAFAAEAP

SEQ ID NO: 64220 - protein, 9 aa, Mycobacterium avium
ESRKLDTDA

SEQ ID NO: 64221 - protein, 19 aa, Mycobacterium avium
ESRRMGRDKATLPGPRGAA

SEQ ID NO: 64222 - protein, 9 aa, Mycobacterium avium
ESRSRQPIL

SEQ ID NO: 64223 - protein, 6 aa, Mycobacterium avium
ESRVPE

SEQ ID NO: 64224 - protein, 6 aa, Mycobacterium avium
ESRYVT

SEQ ID NO: 64225 - protein, 7 aa, Mycobacterium avium
ESSGRGT

SEQ ID NO: 64226 - protein, 7 aa, Mycobacterium avium
ESTASGE

SEQ ID NO: 64227 - protein, 12 aa, Mycobacterium avium
ESTDGTELARGK

SEQ ID NO: 64228 - protein, 9 aa, Mycobacterium avium
ESTDSSTWS

SEQ ID NO: 64229 - protein, 6 aa, Mycobacterium avium
ESTFTQ

SEQ ID NO: 64230 - protein, 13 aa, Mycobacterium avium
ESTPWGGSGGDFT

SEQ ID NO: 64231 - protein, 10 aa, Mycobacterium avium
ESTSDSVETI

SEQ ID NO: 64232 - protein, 9 aa, Mycobacterium avium
ESTSERVRA

SEQ ID NO: 64233 - protein, 9 aa, Mycobacterium avium
ESVGGQHPL

SEQ ID NO: 64234 - protein, 9 aa, Mycobacterium avium
ESVGGSGGS

SEQ ID NO: 64235 - protein, 24 aa, Mycobacterium avium
ESVRKAVRDGADAKALYESDAAVD

SEQ ID NO: 64236 - protein, 6 aa, Mycobacterium avium
ESVSAR

SEQ ID NO: 64237 - protein, 12 aa, Mycobacterium avium
ETAAGKGLTGGG

SEQ ID NO: 64238 - protein, 13 aa, Mycobacterium avium
ETAALTAPQAGRI

SEQ ID NO: 64239 - protein, 9 aa, Mycobacterium avium
ETAEPAELA

SEQ ID NO: 64240 - protein, 11 aa, Mycobacterium avium
ETAIPSNVTAT

SEQ ID NO: 64241 - protein, 18 aa, Mycobacterium avium
ETAREYTRTQARPWTPAG

SEQ ID NO: 64242 - protein, 17 aa, Mycobacterium avium
ETASHPELDATDSRRQL

SEQ ID NO: 64243 - protein, 10 aa, Mycobacterium avium
ETATRTGAQA

SEQ ID NO: 64244 - protein, 10 aa, Mycobacterium avium
ETATVDRRDT

SEQ ID NO: 64245 - protein, 8 aa, Mycobacterium avium
ETCGTVES

SEQ ID NO: 64246 - protein, 7 aa, Mycobacterium avium
ETDAEGN

SEQ ID NO: 64247 - protein, 7 aa, Mycobacterium avium
ETDAETL

SEQ ID NO: 64248 - protein, 4 aa, Mycobacterium avium
ETDE

SEQ ID NO: 64249 - protein, 9 aa, Mycobacterium avium
ETDKTKWTK

SEQ ID NO: 64250 - protein, 14 aa, Mycobacterium avium
ETDPGGDGHDGARA

SEQ ID NO: 64251 - protein, 8 aa, Mycobacterium avium
ETDPPIDG

SEQ ID NO: 64252 - protein, 9 aa, Mycobacterium avium
ETDPRRPVS

SEQ ID NO: 64253 - protein, 6 aa, Mycobacterium avium
ETDTPG

SEQ ID NO: 64254 - protein, 6 aa, Mycobacterium avium
ETDYGL

SEQ ID NO: 64255 - protein, 6 aa, Mycobacterium avium
ETEAGR

SEQ ID NO: 64256 - protein, 6 aa, Mycobacterium avium
ETEERE

SEQ ID NO: 64257 - protein, 14 aa, Mycobacterium avium
ETEPYTGTIARSGE

SEQ ID NO: 64258 - protein, 17 aa, Mycobacterium avium
ETFAPTGSTEVPGDDAS

SEQ ID NO: 64259 - protein, 21 aa, Mycobacterium avium
ETGAPQTPAGTPPVAPTVPSA

SEQ ID NO: 64260 - protein, 6 aa, Mycobacterium avium
ETGAVK

SEQ ID NO: 64261 - protein, 22 aa, Mycobacterium avium
ETGHGSDVQSLETTATYDPATD

SEQ ID NO: 64262 - protein, 8 aa, Mycobacterium avium
ETGPIGSG

SEQ ID NO: 64263 - protein, 8 aa, Mycobacterium avium
ETGTTRRL

SEQ ID NO: 64264 - protein, 5 aa, Mycobacterium avium
ETHGA

SEQ ID NO: 64265 - protein, 8 aa, Mycobacterium avium
ETISSGQV

SEQ ID NO: 64266 - protein, 5 aa, Mycobacterium avium
ETKIA

SEQ ID NO: 64267 - protein, 5 aa, Mycobacterium avium
ETKRQ

SEQ ID NO: 64268 - protein, 11 aa, Mycobacterium avium
ETLAAGGDALT

SEQ ID NO: 64269 - protein, 18 aa, Mycobacterium avium
ETLADRKPRQLSGGQAQR

SEQ ID NO: 64270 - protein, 6 aa, Mycobacterium avium
ETLARN

SEQ ID NO: 64271 - protein, 9 aa, Mycobacterium avium
ETLEATATE

SEQ ID NO: 64272 - protein, 10 aa, Mycobacterium avium
ETLGGAGARP

SEQ ID NO: 64273 - protein, 12 aa, Mycobacterium avium
ETLPDSAATDGI

SEQ ID NO: 64274 - protein, 4 aa, Mycobacterium avium
ETMP

SEQ ID NO: 64275 - protein, 6 aa, Mycobacterium avium
ETNPGV

SEQ ID NO: 64276 - protein, 7 aa, Mycobacterium avium
ETNTADI

SEQ ID NO: 64277 - protein, 8 aa, Mycobacterium avium
ETPAERAD

SEQ ID NO: 64278 - protein, 4 aa, Mycobacterium avium
ETPD

SEQ ID NO: 64279 - protein, 6 aa, Mycobacterium avium
ETPDDI

SEQ ID NO: 64280 - protein, 11 aa, Mycobacterium avium
ETPDPEPGPGE

SEQ ID NO: 64281 - protein, 6 aa, Mycobacterium avium
ETPGWT

SEQ ID NO: 64282 - protein, 5 aa, Mycobacterium avium
ETPVD

SEQ ID NO: 64283 - protein, 8 aa, Mycobacterium avium
ETPVDDPL

SEQ ID NO: 64284 - protein, 7 aa, Mycobacterium avium
ETQMPSR

SEQ ID NO: 64285 - protein, 7 aa, Mycobacterium avium
ETQTTDG

SEQ ID NO: 64286 - protein, 6 aa, Mycobacterium avium
ETQWPS

SEQ ID NO: 64287 - protein, 12 aa, Mycobacterium avium
ETQWRAPSPLPG

SEQ ID NO: 64288 - protein, 9 aa, Mycobacterium avium
ETRDETSAA

SEQ ID NO: 64289 - protein, 6 aa, Mycobacterium avium
ETRKSF

SEQ ID NO: 64290 - protein, 5 aa, Mycobacterium avium
ETRLG

SEQ ID NO: 64291 - protein, 13 aa, Mycobacterium avium
ETRMRGGTSDDPV

SEQ ID NO: 64292 - protein, 18 aa, Mycobacterium avium
ETRPGQGYPRTYEDQERW

SEQ ID NO: 64293 - protein, 11 aa, Mycobacterium avium
ETRYQAGATAT

SEQ ID NO: 64294 - protein, 4 aa, Mycobacterium avium
ETSA

SEQ ID NO: 64295 - protein, 6 aa, Mycobacterium avium
ETSGWT

SEQ ID NO: 64296 - protein, 9 aa, Mycobacterium avium
ETSNGERGW

SEQ ID NO: 64297 - protein, 35 aa, Mycobacterium avium
ETSNHQAKVGRERGKASPMPESPASAALTGRNDPS

SEQ ID NO: 64298 - protein, 4 aa, Mycobacterium avium
ETSP

SEQ ID NO: 64299 - protein, 7 aa, Mycobacterium avium
ETSYPKR

SEQ ID NO: 64300 - protein, 10 aa, Mycobacterium avium
ETTARSRGVQ

SEQ ID NO: 64301 - protein, 7 aa, Mycobacterium avium
ETTHVTG

SEQ ID NO: 64302 - protein, 8 aa, Mycobacterium avium
ETTSTPAE

SEQ ID NO: 64303 - protein, 6 aa, Mycobacterium avium
ETTVDD

SEQ ID NO: 64304 - protein, 4 aa, Mycobacterium avium
ETTY

SEQ ID NO: 64305 - protein, 10 aa, Mycobacterium avium
ETVPPGETSF

SEQ ID NO: 64306 - protein, 5 aa, Mycobacterium avium
ETVQE

SEQ ID NO: 64307 - protein, 11 aa, Mycobacterium avium
ETVRAQARSPQ

SEQ ID NO: 64308 - protein, 13 aa, Mycobacterium avium
ETVTENGERAYST

SEQ ID NO: 64309 - protein, 7 aa, Mycobacterium avium
ETYSSAR

SEQ ID NO: 64310 - protein, 10 aa, Mycobacterium avium
ETYTPAGYGT

SEQ ID NO: 64311 - protein, 14 aa, Mycobacterium avium
EVAGETAPGDPSGH

SEQ ID NO: 64312 - protein, 6 aa, Mycobacterium avium
EVAGGA

SEQ ID NO: 64313 - protein, 14 aa, Mycobacterium avium
EVAPPSPGQPFQAT

SEQ ID NO: 64314 - protein, 9 aa, Mycobacterium avium
EVDDGELPG

SEQ ID NO: 64315 - protein, 18 aa, Mycobacterium avium
EVDDQSRARAALRDSRPI

SEQ ID NO: 64316 - protein, 5 aa, Mycobacterium avium
EVDES

SEQ ID NO: 64317 - protein, 14 aa, Mycobacterium avium
EVDGEQASARDETE

SEQ ID NO: 64318 - protein, 21 aa, Mycobacterium avium
EVDLSAEGEESQAERDEQQKE

SEQ ID NO: 64319 - protein, 4 aa, Mycobacterium avium
EVDP

SEQ ID NO: 64320 - protein, 6 aa, Mycobacterium avium
EVDQER

SEQ ID NO: 64321 - protein, 6 aa, Mycobacterium avium
EVEGDN

SEQ ID NO: 64322 - protein, 12 aa, Mycobacterium avium
EVGRDPATLETS

SEQ ID NO: 64323 - protein, 12 aa, Mycobacterium avium
EVGSSSDHGAHS

SEQ ID NO: 64324 - protein, 13 aa, Mycobacterium avium
EVGSSSDHGAQSD

SEQ ID NO: 64325 - protein, 7 aa, Mycobacterium avium
EVKPNGI

SEQ ID NO: 64326 - protein, 7 aa, Mycobacterium avium
EVPAVTA

SEQ ID NO: 64327 - protein, 9 aa, Mycobacterium avium
EVPGQDPQQ

SEQ ID NO: 64328 - protein, 12 aa, Mycobacterium avium
EVPGSDGINPHD

SEQ ID NO: 64329 - protein, 22 aa, Mycobacterium avium
EVPGSDGINPHDHSSSYHRGSE

SEQ ID NO: 64330 - protein, 18 aa, Mycobacterium avium
EVPPEADTPAAFSPETRL

SEQ ID NO: 64331 - protein, 10 aa, Mycobacterium avium
EVPQRGSANR

SEQ ID NO: 64332 - protein, 9 aa, Mycobacterium avium
EVPRPGPSD

SEQ ID NO: 64333 - protein, 7 aa, Mycobacterium avium
EVPSTTR

SEQ ID NO: 64334 - protein, 6 aa, Mycobacterium avium
EVPTAT

SEQ ID NO: 64335 - protein, 8 aa, Mycobacterium avium
EVQPGERL

SEQ ID NO: 64336 - protein, 4 aa, Mycobacterium avium
EVRG

SEQ ID NO: 64337 - protein, 10 aa, Mycobacterium avium
EVRGARKDDI

SEQ ID NO: 64338 - protein, 6 aa, Mycobacterium avium
EVRGDR

SEQ ID NO: 64339 - protein, 7 aa, Mycobacterium avium
EVRGDTH

SEQ ID NO: 64340 - protein, 7 aa, Mycobacterium avium
EVRPADL

SEQ ID NO: 64341 - protein, 12 aa, Mycobacterium avium
EVRPEDEQLTRD

SEQ ID NO: 64342 - protein, 7 aa, Mycobacterium avium
EVRPGDT

SEQ ID NO: 64343 - protein, 16 aa, Mycobacterium avium
EVRPQQAEQHPVSSPW

SEQ ID NO: 64344 - protein, 8 aa, Mycobacterium avium
EVRRGAEP

SEQ ID NO: 64345 - protein, 6 aa, Mycobacterium avium
EVRSTR

SEQ ID NO: 64346 - protein, 6 aa, Mycobacterium avium
EVRTGA

SEQ ID NO: 64347 - protein, 4 aa, Mycobacterium avium
EVSA

SEQ ID NO: 64348 - protein, 8 aa, Mycobacterium avium
EVSAERPG

SEQ ID NO: 64349 - protein, 9 aa, Mycobacterium avium
EVSAPRDTV

SEQ ID NO: 64350 - protein, 8 aa, Mycobacterium avium
EVSDAKGD

SEQ ID NO: 64351 - protein, 8 aa, Mycobacterium avium
EVSEEAND

SEQ ID NO: 64352 - protein, 15 aa, Mycobacterium avium
EVSPTPTPTPQQTLS

SEQ ID NO: 64353 - protein, 13 aa, Mycobacterium avium
EVSRDELSASAQR

SEQ ID NO: 64354 - protein, 13 aa, Mycobacterium avium
EVTSGESEAGAEV

SEQ ID NO: 64355 - protein, 7 aa, Mycobacterium avium
EVTTAAA

SEQ ID NO: 64356 - protein, 6 aa, Mycobacterium avium
EVTTPG

SEQ ID NO: 64357 - protein, 10 aa, Mycobacterium avium
EVTVGSDRHR

SEQ ID NO: 64358 - protein, 12 aa, Mycobacterium avium
EVVEKDADGYPK

SEQ ID NO: 64359 - protein, 12 aa, Mycobacterium avium
EVVETGADSVTV

SEQ ID NO: 64360 - protein, 7 aa, Mycobacterium avium
EVVGGGT

SEQ ID NO: 64361 - protein, 10 aa, Mycobacterium avium
EWGDKGVHSS

SEQ ID NO: 64362 - protein, 15 aa, Mycobacterium avium
EWPEPAESLPPPYDN

SEQ ID NO: 64363 - protein, 22 aa, Mycobacterium avium
EWPRPTAPVRSPPGSRRHAPQA

SEQ ID NO: 64364 - protein, 18 aa, Mycobacterium avium
EWQERAREESTRLGDGPL

SEQ ID NO: 64365 - protein, 6 aa, Mycobacterium avium
EYAKSI

SEQ ID NO: 64366 - protein, 9 aa, Mycobacterium avium
EYASAAAEL

SEQ ID NO: 64367 - protein, 8 aa, Mycobacterium avium
EYEASTDY

SEQ ID NO: 64368 - protein, 9 aa, Mycobacterium avium
EYEASTDYL

SEQ ID NO: 64369 - protein, 4 aa, Mycobacterium avium
EYEG

SEQ ID NO: 64370 - protein, 11 aa, Mycobacterium avium
EYGGHGLGTTE

SEQ ID NO: 64371 - protein, 8 aa, Mycobacterium avium
EYGGRDDY

SEQ ID NO: 64372 - protein, 4 aa, Mycobacterium avium
EYGL

SEQ ID NO: 64373 - protein, 5 aa, Mycobacterium avium
EYGNR

SEQ ID NO: 64374 - protein, 4 aa, Mycobacterium avium
EYGV

SEQ ID NO: 64375 - protein, 8 aa, Mycobacterium avium
EYGVPDAQ

SEQ ID NO: 64376 - protein, 6 aa, Mycobacterium avium
EYNGSI

SEQ ID NO: 64377 - protein, 4 aa, Mycobacterium avium
EYRP

SEQ ID NO: 64378 - protein, 8 aa, Mycobacterium avium
EYRPAEEA

SEQ ID NO: 64379 - protein, 12 aa, Mycobacterium avium
EYSRNSGRTTRG

SEQ ID NO: 64380 - protein, 4 aa, Mycobacterium avium
EYTA

SEQ ID NO: 64381 - protein, 4 aa, Mycobacterium avium
FAAD

SEQ ID NO: 64382 - protein, 5 aa, Mycobacterium avium
FAAST

SEQ ID NO: 64383 - protein, 12 aa, Mycobacterium avium
FADADARAAHDD

SEQ ID NO: 64384 - protein, 11 aa, Mycobacterium avium
FADGEGQVHPR

SEQ ID NO: 64385 - protein, 23 aa, Mycobacterium avium
FADGGDVAVGNPAPAPGTAIALG

SEQ ID NO: 64386 - protein, 12 aa, Mycobacterium avium
FADSDGDGVGDI

SEQ ID NO: 64387 - protein, 22 aa, Mycobacterium avium
FADSGAAVTVTGTRAAATDYPG

SEQ ID NO: 64388 - protein, 22 aa, Mycobacterium avium
FADSGAAVTVTGTRAAATGYPD

SEQ ID NO: 64389 - protein, 9 aa, Mycobacterium avium
FAESPASPF

SEQ ID NO: 64390 - protein, 5 aa, Mycobacterium avium
FAGQG

SEQ ID NO: 64391 - protein, 6 aa, Mycobacterium avium
FAGRSL

SEQ ID NO: 64392 - protein, 5 aa, Mycobacterium avium
FAGTG

SEQ ID NO: 64393 - protein, 8 aa, Mycobacterium avium
FANSQGSK

SEQ ID NO: 64394 - protein, 12 aa, Mycobacterium avium
FAPAGPPRRDGH

SEQ ID NO: 64395 - protein, 14 aa, Mycobacterium avium
FAPGGDLGQGGEDD

SEQ ID NO: 64396 - protein, 12 aa, Mycobacterium avium
FAPGGDLGQKAA

SEQ ID NO: 64397 - protein, 14 aa, Mycobacterium avium
FAPGGDMGGGGGAD

SEQ ID NO: 64398 - protein, 5 aa, Mycobacterium avium
FAPPP

SEQ ID NO: 64399 - protein, 20 aa, Mycobacterium avium
FATDRGAGAGSTASRSGSGL

SEQ ID NO: 64400 - protein, 12 aa, Mycobacterium avium
FATPTESGLGPG

SEQ ID NO: 64401 - protein, 9 aa, Mycobacterium avium
FDAESVGYE

SEQ ID NO: 64402 - protein, 9 aa, Mycobacterium avium
FDASAPSVW

SEQ ID NO: 64403 - protein, 10 aa, Mycobacterium avium
FDATTSLSDN

SEQ ID NO: 64404 - protein, 4 aa, Mycobacterium avium
FDDE

SEQ ID NO: 64405 - protein, 15 aa, Mycobacterium avium
FDDSNGSQPSYPPEL

SEQ ID NO: 64406 - protein, 9 aa, Mycobacterium avium
FDEAPETGA

SEQ ID NO: 64407 - protein, 36 aa, Mycobacterium avium
FDEPPRTTNADGPGAQAAAVARSATGSAANQSHASL

SEQ ID NO: 64408 - protein, 6 aa, Mycobacterium avium
FDGGTL

SEQ ID NO: 64409 - protein, 7 aa, Mycobacterium avium
FDGTTTA

SEQ ID NO: 64410 - protein, 10 aa, Mycobacterium avium
FDNRGRRADE

SEQ ID NO: 64411 - protein, 7 aa, Mycobacterium avium
FDPDGKV

SEQ ID NO: 64412 - protein, 12 aa, Mycobacterium avium
FDPDGKVPDSDV

SEQ ID NO: 64413 - protein, 7 aa, Mycobacterium avium
FDPGLGR

SEQ ID NO: 64414 - protein, 12 aa, Mycobacterium avium
FDPGPNPYGPPP

SEQ ID NO: 64415 - protein, 6 aa, Mycobacterium avium
FDRSQG

SEQ ID NO: 64416 - protein, 7 aa, Mycobacterium avium
FDSGPWG

SEQ ID NO: 64417 - protein, 8 aa, Mycobacterium avium
FDSRTNGS

SEQ ID NO: 64418 - protein, 9 aa, Mycobacterium avium
FEDETGTVR

SEQ ID NO: 64419 - protein, 11 aa, Mycobacterium avium
FEGQLGKRSRM

SEQ ID NO: 64420 - protein, 15 aa, Mycobacterium avium
FEHTTGTLAPRAAVP

SEQ ID NO: 64421 - protein, 6 aa, Mycobacterium avium
FENDDS

SEQ ID NO: 64422 - protein, 11 aa, Mycobacterium avium
FEPSRTGRTEL

SEQ ID NO: 64423 - protein, 5 aa, Mycobacterium avium
FEQGD

SEQ ID NO: 64424 - protein, 10 aa, Mycobacterium avium
FESKGADLPD

SEQ ID NO: 64425 - protein, 28 aa, Mycobacterium avium
FGADHQRGAVQPVGAQQSDGRRGLGQDG

SEQ ID NO: 64426 - protein, 10 aa, Mycobacterium avium
FGAEPGSRLY

SEQ ID NO: 64427 - protein, 8 aa, Mycobacterium avium
FGAEPNTQ

SEQ ID NO: 64428 - protein, 17 aa, Mycobacterium avium
FGANAGTSGADPHAVAA

SEQ ID NO: 64429 - protein, 7 aa, Mycobacterium avium
FGDDPAT

SEQ ID NO: 64430 - protein, 10 aa, Mycobacterium avium
FGDGALKGKP

SEQ ID NO: 64431 - protein, 9 aa, Mycobacterium avium
FGDGEFPDS

SEQ ID NO: 64432 - protein, 9 aa, Mycobacterium avium
FGDRDAAVS

SEQ ID NO: 64433 - protein, 8 aa, Mycobacterium avium
FGELSETE

SEQ ID NO: 64434 - protein, 8 aa, Mycobacterium avium
FGERDAAV

SEQ ID NO: 64435 - protein, 7 aa, Mycobacterium avium
FGGDPAN

SEQ ID NO: 64436 - protein, 9 aa, Mycobacterium avium
FGGGANATI

SEQ ID NO: 64437 - protein, 7 aa, Mycobacterium avium
FGGGPVG

SEQ ID NO: 64438 - protein, 6 aa, Mycobacterium avium
FGGGRA

SEQ ID NO: 64439 - protein, 12 aa, Mycobacterium avium
FGGGTFQRAEDK

SEQ ID NO: 64440 - protein, 8 aa, Mycobacterium avium
FGGIGSPA

SEQ ID NO: 64441 - protein, 5 aa, Mycobacterium avium
FGGPG

SEQ ID NO: 64442 - protein, 4 aa, Mycobacterium avium
FGHN

SEQ ID NO: 64443 - protein, 5 aa, Mycobacterium avium
FGHRE

SEQ ID NO: 64444 - protein, 8 aa, Mycobacterium avium
FGKGQPTA

SEQ ID NO: 64445 - protein, 4 aa, Mycobacterium avium
FGLG

SEQ ID NO: 64446 - protein, 17 aa, Mycobacterium avium
FGNDAQLDEDPANGGRY

SEQ ID NO: 64447 - protein, 9 aa, Mycobacterium avium
FGNGPNSTN

SEQ ID NO: 64448 - protein, 5 aa, Mycobacterium avium
FGPAA

SEQ ID NO: 64449 - protein, 8 aa, Mycobacterium avium
FGPDEGSD

SEQ ID NO: 64450 - protein, 4 aa, Mycobacterium avium
FGPG

SEQ ID NO: 64451 - protein, 14 aa, Mycobacterium avium
FGPGDPNLAHRRDE

SEQ ID NO: 64452 - protein, 8 aa, Mycobacterium avium
FGPGEGSD

SEQ ID NO: 64453 - protein, 9 aa, Mycobacterium avium
FGPGSSIED

SEQ ID NO: 64454 - protein, 13 aa, Mycobacterium avium
FGPGTLTKSGYPR

SEQ ID NO: 64455 - protein, 9 aa, Mycobacterium avium
FGPNPLDPG

SEQ ID NO: 64456 - protein, 10 aa, Mycobacterium avium
FGPSPQELAD

SEQ ID NO: 64457 - protein, 9 aa, Mycobacterium avium
FGPSQHELA

SEQ ID NO: 64458 - protein, 10 aa, Mycobacterium avium
FGPSQQELAD

SEQ ID NO: 64459 - protein, 6 aa, Mycobacterium avium
FGPTAD

SEQ ID NO: 64460 - protein, 9 aa, Mycobacterium avium
FGQEGPLRD

SEQ ID NO: 64461 - protein, 11 aa, Mycobacterium avium
FGQGPGPGENI

SEQ ID NO: 64462 - protein, 4 aa, Mycobacterium avium
FGQN

SEQ ID NO: 64463 - protein, 11 aa, Mycobacterium avium
FGQREGQVHAG

SEQ ID NO: 64464 - protein, 4 aa, Mycobacterium avium
FGRA

SEQ ID NO: 64465 - protein, 4 aa, Mycobacterium avium
FGRP

SEQ ID NO: 64466 - protein, 7 aa, Mycobacterium avium
FGSAASA

SEQ ID NO: 64467 - protein, 5 aa, Mycobacterium avium
FGSAE

SEQ ID NO: 64468 - protein, 13 aa, Mycobacterium avium
FGSGRAAPQLGRQ

SEQ ID NO: 64469 - protein, 13 aa, Mycobacterium avium
FGSTSAATRCRRR

SEQ ID NO: 64470 - protein, 10 aa, Mycobacterium avium
FGTSPDDDSP

SEQ ID NO: 64471 - protein, 12 aa, Mycobacterium avium
FKAARGRGRRGR

SEQ ID NO: 64472 - protein, 19 aa, Mycobacterium avium
FKASPGRTCSSRITPRSAR

SEQ ID NO: 64473 - protein, 8 aa, Mycobacterium avium
FKASPRSD

SEQ ID NO: 64474 - protein, 12 aa, Mycobacterium avium
FKPHSADIDDGL

SEQ ID NO: 64475 - protein, 8 aa, Mycobacterium avium
FKSGAIKA

SEQ ID NO: 64476 - protein, 11 aa, Mycobacterium avium
FNASASGGKKI

SEQ ID NO: 64477 - protein, 4 aa, Mycobacterium avium
FNEG

SEQ ID NO: 64478 - protein, 4 aa, Mycobacterium avium
FNGD

SEQ ID NO: 64479 - protein, 14 aa, Mycobacterium avium
FNGSVAEHRAALLT

SEQ ID NO: 64480 - protein, 6 aa, Mycobacterium avium
FNGTGR

SEQ ID NO: 64481 - protein, 5 aa, Mycobacterium avium
FNPPA

SEQ ID NO: 64482 - protein, 7 aa, Mycobacterium avium
FNSEGGL

SEQ ID NO: 64483 - protein, 10 aa, Mycobacterium avium
FNTESNKTRL

SEQ ID NO: 64484 - protein, 4 aa, Mycobacterium avium
FNTG

SEQ ID NO: 64485 - protein, 4 aa, Mycobacterium avium
FNTT

SEQ ID NO: 64486 - protein, 18 aa, Mycobacterium avium
FPAEMQPKPNEVDEDELR

SEQ ID NO: 64487 - protein, 5 aa, Mycobacterium avium
FPAER

SEQ ID NO: 64488 - protein, 13 aa, Mycobacterium avium
FPAPKTTAAGKPD

SEQ ID NO: 64489 - protein, 6 aa, Mycobacterium avium
FPAREL

SEQ ID NO: 64490 - protein, 8 aa, Mycobacterium avium
FPDAADAD

SEQ ID NO: 64491 - protein, 4 aa, Mycobacterium avium
FPDD

SEQ ID NO: 64492 - protein, 7 aa, Mycobacterium avium
FPDDPTE

SEQ ID NO: 64493 - protein, 6 aa, Mycobacterium avium
FPDEAA

SEQ ID NO: 64494 - protein, 4 aa, Mycobacterium avium
FPDP

SEQ ID NO: 64495 - protein, 5 aa, Mycobacterium avium
FPDSK

SEQ ID NO: 64496 - protein, 9 aa, Mycobacterium avium
FPEPGNPGH

SEQ ID NO: 64497 - protein, 11 aa, Mycobacterium avium
FPEPGSSVEKG

SEQ ID NO: 64498 - protein, 12 aa, Mycobacterium avium
FPEPQEQGTGPF

SEQ ID NO: 64499 - protein, 9 aa, Mycobacterium avium
FPGGTTAAG

SEQ ID NO: 64500 - protein, 4 aa, Mycobacterium avium
FPGP

SEQ ID NO: 64501 - protein, 6 aa, Mycobacterium avium
FPGSPE

SEQ ID NO: 64502 - protein, 8 aa, Mycobacterium avium
FPPAGTLT

SEQ ID NO: 64503 - protein, 4 aa, Mycobacterium avium
FPPE

SEQ ID NO: 64504 - protein, 5 aa, Mycobacterium avium
FPPIG

SEQ ID NO: 64505 - protein, 7 aa, Mycobacterium avium
FPPPKTR

SEQ ID NO: 64506 - protein, 7 aa, Mycobacterium avium
FPPQVGR

SEQ ID NO: 64507 - protein, 4 aa, Mycobacterium avium
FPQQ

SEQ ID NO: 64508 - protein, 14 aa, Mycobacterium avium
FPRDKACGDGLTPR

SEQ ID NO: 64509 - protein, 6 aa, Mycobacterium avium
FPRPQT

SEQ ID NO: 64510 - protein, 8 aa, Mycobacterium avium
FPRPQTQI

SEQ ID NO: 64511 - protein, 12 aa, Mycobacterium avium
FPRSVRDRAPGS

SEQ ID NO: 64512 - protein, 4 aa, Mycobacterium avium
FPSP

SEQ ID NO: 64513 - protein, 8 aa, Mycobacterium avium
FPTKSSAG

SEQ ID NO: 64514 - protein, 16 aa, Mycobacterium avium
FPTPTDVASPAYTAQI

SEQ ID NO: 64515 - protein, 9 aa, Mycobacterium avium
FPTSGSARW

SEQ ID NO: 64516 - protein, 4 aa, Mycobacterium avium
FPYP

SEQ ID NO: 64517 - protein, 17 aa, Mycobacterium avium
FQAPDGKPLFCIWENAR

SEQ ID NO: 64518 - protein, 16 aa, Mycobacterium avium
FQAPGHTGEPASGDLT

SEQ ID NO: 64519 - protein, 8 aa, Mycobacterium avium
FQDGGNSY

SEQ ID NO: 64520 - protein, 5 aa, Mycobacterium avium
FQDGN

SEQ ID NO: 64521 - protein, 46 aa, Mycobacterium avium
FQDGQGPVFGGDPRDGVPRSPASELAQGPPGTRPLPTGTALGPDGH

SEQ ID NO: 64522 - protein, 4 aa, Mycobacterium avium
FQHQ

SEQ ID NO: 64523 - protein, 7 aa, Mycobacterium avium
FQPGTKT

SEQ ID NO: 64524 - protein, 6 aa, Mycobacterium avium
FQRPGD

SEQ ID NO: 64525 - protein, 9 aa, Mycobacterium avium
FQSEEAGVD

SEQ ID NO: 64526 - protein, 12 aa, Mycobacterium avium
FQTGQQRGGPVG

SEQ ID NO: 64527 - protein, 5 aa, Mycobacterium avium
FREGA

SEQ ID NO: 64528 - protein, 8 aa, Mycobacterium avium
FRGGNTAG

SEQ ID NO: 64529 - protein, 8 aa, Mycobacterium avium
FRHPGQGS

SEQ ID NO: 64530 - protein, 6 aa, Mycobacterium avium
FRPPQR

SEQ ID NO: 64531 - protein, 13 aa, Mycobacterium avium
FRPPSADPSAREF

SEQ ID NO: 64532 - protein, 5 aa, Mycobacterium avium
FRPSG

SEQ ID NO: 64533 - protein, 13 aa, Mycobacterium avium
FRPSQAERDQQDV

SEQ ID NO: 64534 - protein, 5 aa, Mycobacterium avium
FRPTS

SEQ ID NO: 64535 - protein, 10 aa, Mycobacterium avium
FRQRHEGDGF

SEQ ID NO: 64536 - protein, 4 aa, Mycobacterium avium
FSAE

SEQ ID NO: 64537 - protein, 9 aa, Mycobacterium avium
FSATTSETL

SEQ ID NO: 64538 - protein, 4 aa, Mycobacterium avium
FSDS

SEQ ID NO: 64539 - protein, 6 aa, Mycobacterium avium
FSGADP

SEQ ID NO: 64540 - protein, 20 aa, Mycobacterium avium
FSGGATSRGPIGRVRPGSDS

SEQ ID NO: 64541 - protein, 7 aa, Mycobacterium avium
FSGGGYT

SEQ ID NO: 64542 - protein, 12 aa, Mycobacterium avium
FSGNKAYDGTHY

SEQ ID NO: 64543 - protein, 7 aa, Mycobacterium avium
FSGQTRD

SEQ ID NO: 64544 - protein, 9 aa, Mycobacterium avium
FSGTSPDGH

SEQ ID NO: 64545 - protein, 8 aa, Mycobacterium avium
FSKPPPLA

SEQ ID NO: 64546 - protein, 21 aa, Mycobacterium avium
FSPFPSPRRTTDPGGVTAQQA

SEQ ID NO: 64547 - protein, 9 aa, Mycobacterium avium
FSPGSAERF

SEQ ID NO: 64548 - protein, 10 aa, Mycobacterium avium
FSPGSAERFR

SEQ ID NO: 64549 - protein, 5 aa, Mycobacterium avium
FSQDP

SEQ ID NO: 64550 - protein, 33 aa, Mycobacterium avium
FSRSEEVGRKKSEEESGGQPSAATHARARSSLP

SEQ ID NO: 64551 - protein, 15 aa, Mycobacterium avium
FSSGPPEEPAPELDP

SEQ ID NO: 64552 - protein, 6 aa, Mycobacterium avium
FSTPEF

SEQ ID NO: 64553 - protein, 6 aa, Mycobacterium avium
FSVDGS

SEQ ID NO: 64554 - protein, 11 aa, Mycobacterium avium
FSYRPAGNKPG

SEQ ID NO: 64555 - protein, 5 aa, Mycobacterium avium
FTAAD

SEQ ID NO: 64556 - protein, 20 aa, Mycobacterium avium
FTAAQGANSGKAGSYRRQHG

SEQ ID NO: 64557 - protein, 43 aa, Mycobacterium avium
FTAPGRPPAPGGEARAKPAAGGAKPASGGAKPASGGAKPGWPG

SEQ ID NO: 64558 - protein, 60 aa, Mycobacterium avium
FTAPGRPPAPGGEARAKPAAGGEARAKPASGGAKPASGGAKPASGGAKPASGGAKPGWPG

SEQ ID NO: 64559 - protein, 46 aa, Mycobacterium avium
FTAPGRPPAPGGEARAKPAAGGEARAKPASGGAKPASGGAKPGWPG

SEQ ID NO: 64560 - protein, 38 aa, Mycobacterium avium
FTARTQATVGGVTQAAGGYTAQEATAAGQMSNITGVTV

SEQ ID NO: 64561 - protein, 4 aa, Mycobacterium avium
FTGE

SEQ ID NO: 64562 - protein, 5 aa, Mycobacterium avium
FTGER

SEQ ID NO: 64563 - protein, 9 aa, Mycobacterium avium
FTGGPDTAR

SEQ ID NO: 64564 - protein, 11 aa, Mycobacterium avium
FTGQSQPARDA

SEQ ID NO: 64565 - protein, 9 aa, Mycobacterium avium
FTGSTATGI

SEQ ID NO: 64566 - protein, 18 aa, Mycobacterium avium
FTKTTSRGVETIGGAKRG

SEQ ID NO: 64567 - protein, 7 aa, Mycobacterium avium
FTPDSGA

SEQ ID NO: 64568 - protein, 4 aa, Mycobacterium avium
FTPF

SEQ ID NO: 64569 - protein, 7 aa, Mycobacterium avium
FTPGPEG

SEQ ID NO: 64570 - protein, 5 aa, Mycobacterium avium
FTPPE

SEQ ID NO: 64571 - protein, 15 aa, Mycobacterium avium
FTPPPDTTDEAGVAR

SEQ ID NO: 64572 - protein, 5 aa, Mycobacterium avium
FTPRQ

SEQ ID NO: 64573 - protein, 14 aa, Mycobacterium avium
FTRPAAPDSGFPTH

SEQ ID NO: 64574 - protein, 5 aa, Mycobacterium avium
FTSGT

SEQ ID NO: 64575 - protein, 5 aa, Mycobacterium avium
FTSQA

SEQ ID NO: 64576 - protein, 19 aa, Mycobacterium avium
FTSTSTDHTVAQSSAFAGN

SEQ ID NO: 64577 - protein, 11 aa, Mycobacterium avium
FTTSPAARSGP

SEQ ID NO: 64578 - protein, 9 aa, Mycobacterium avium
FVPGTGQDL

SEQ ID NO: 64579 - protein, 10 aa, Mycobacterium avium
FVSSDDPKKA

SEQ ID NO: 64580 - protein, 10 aa, Mycobacterium avium
FVTPPRAPGH

SEQ ID NO: 64581 - protein, 7 aa, Mycobacterium avium
FYPEESP

SEQ ID NO: 64582 - protein, 6 aa, Mycobacterium avium
GAAAEL

SEQ ID NO: 64583 - protein, 8 aa, Mycobacterium avium
GAAANPGL

SEQ ID NO: 64584 - protein, 16 aa, Mycobacterium avium
GAAANTGDGIRAGQEI

SEQ ID NO: 64585 - protein, 28 aa, Mycobacterium avium
GAAARALGEQARTRWQTATKQSLSPVTA

SEQ ID NO: 64586 - protein, 9 aa, Mycobacterium avium
GAAARPVQR

SEQ ID NO: 64587 - protein, 4 aa, Mycobacterium avium
GAAD

SEQ ID NO: 64588 - protein, 7 aa, Mycobacterium avium
GAADAES

SEQ ID NO: 64589 - protein, 7 aa, Mycobacterium avium
GAAEDRY

SEQ ID NO: 64590 - protein, 10 aa, Mycobacterium avium
GAAEEAQHQR

SEQ ID NO: 64591 - protein, 19 aa, Mycobacterium avium
GAAEGPYGFAGTSNSFASG

SEQ ID NO: 64592 - protein, 19 aa, Mycobacterium avium
GAAEGPYGFTGTSNSFASG

SEQ ID NO: 64593 - protein, 16 aa, Mycobacterium avium
GAAEPQQRPRRRASKA

SEQ ID NO: 64594 - protein, 7 aa, Mycobacterium avium
GAAERTL

SEQ ID NO: 64595 - protein, 15 aa, Mycobacterium avium
GAAESIADRVRSGGV

SEQ ID NO: 64596 - protein, 9 aa, Mycobacterium avium
GAAGAASSQ

SEQ ID NO: 64597 - protein, 10 aa, Mycobacterium avium
GAAGAASSQF

SEQ ID NO: 64598 - protein, 29 aa, Mycobacterium avium
GAAGAPDQATGTDNLPPIEPAPPNAATGC

SEQ ID NO: 64599 - protein, 5 aa, Mycobacterium avium
GAAGD

SEQ ID NO: 64600 - protein, 8 aa, Mycobacterium avium
GAAGDAPG

SEQ ID NO: 64601 - protein, 13 aa, Mycobacterium avium
GAAGIDERTPQQT

SEQ ID NO: 64602 - protein, 7 aa, Mycobacterium avium
GAAGISR

SEQ ID NO: 64603 - protein, 13 aa, Mycobacterium avium
GAAGQVLSDGTDL

SEQ ID NO: 64604 - protein, 17 aa, Mycobacterium avium
GAAIGGLAGAPEAGVGA

SEQ ID NO: 64605 - protein, 17 aa, Mycobacterium avium
GAAPADTTEPQQGDHER

SEQ ID NO: 64606 - protein, 7 aa, Mycobacterium avium
GAAPAGV

SEQ ID NO: 64607 - protein, 10 aa, Mycobacterium avium
GAAPAMRPPP

SEQ ID NO: 64608 - protein, 6 aa, Mycobacterium avium
GAAPGG

SEQ ID NO: 64609 - protein, 9 aa, Mycobacterium avium
GAAPGTRTT

SEQ ID NO: 64610 - protein, 39 aa, Mycobacterium avium
GAAPGVSAVSATTGLSAAEAGAGGAGSLGSAGVPATSFT

SEQ ID NO: 64611 - protein, 43 aa, Mycobacterium avium
GAAPPRSRHGADGGRTRDDDVGGGRAHRRRAGAAAARTRSRPG

SEQ ID NO: 64612 - protein, 21 aa, Mycobacterium avium
GAAPSSTATGSTASPKTPLAR

SEQ ID NO: 64613 - protein, 7 aa, Mycobacterium avium
GAAPTAE

SEQ ID NO: 64614 - protein, 4 aa, Mycobacterium avium
GAAQ

SEQ ID NO: 64615 - protein, 55 aa, Mycobacterium avium
GAAQAASRVTPFTPPQRTTNEAGMGAQNASVAQAAGTSAGHVQSAVSNSNAMSAV

SEQ ID NO: 64616 - protein, 6 aa, Mycobacterium avium
GAARSA

SEQ ID NO: 64617 - protein, 14 aa, Mycobacterium avium
GAASSVAPRAYRAA

SEQ ID NO: 64618 - protein, 4 aa, Mycobacterium avium
GAAT

SEQ ID NO: 64619 - protein, 10 aa, Mycobacterium avium
GAATARAGAV

SEQ ID NO: 64620 - protein, 8 aa, Mycobacterium avium
GAATPSYG

SEQ ID NO: 64621 - protein, 4 aa, Mycobacterium avium
GAAY

SEQ ID NO: 64622 - protein, 11 aa, Mycobacterium avium
GAAYSPESAKR

SEQ ID NO: 64623 - protein, 9 aa, Mycobacterium avium
GADAPRRGA

SEQ ID NO: 64624 - protein, 8 aa, Mycobacterium avium
GADAQSAR

SEQ ID NO: 64625 - protein, 7 aa, Mycobacterium avium
GADDGRV

SEQ ID NO: 64626 - protein, 9 aa, Mycobacterium avium
GADDPAAAV

SEQ ID NO: 64627 - protein, 7 aa, Mycobacterium avium
GADEAEA

SEQ ID NO: 64628 - protein, 5 aa, Mycobacterium avium
GADER

SEQ ID NO: 64629 - protein, 9 aa, Mycobacterium avium
GADGDAPGF

SEQ ID NO: 64630 - protein, 19 aa, Mycobacterium avium
GADGGNVGDGGGDGHPAGL

SEQ ID NO: 64631 - protein, 17 aa, Mycobacterium avium
GADGRTKDTKAVSPEST

SEQ ID NO: 64632 - protein, 5 aa, Mycobacterium avium
GADKT

SEQ ID NO: 64633 - protein, 10 aa, Mycobacterium avium
GADKTRASVD

SEQ ID NO: 64634 - protein, 18 aa, Mycobacterium avium
GADPASIATVTSGSPHFR

SEQ ID NO: 64635 - protein, 9 aa, Mycobacterium avium
GADPDGAHR

SEQ ID NO: 64636 - protein, 9 aa, Mycobacterium avium
GADPEEAEA

SEQ ID NO: 64637 - protein, 17 aa, Mycobacterium avium
GADPGAYRRAEAAGRLA

SEQ ID NO: 64638 - protein, 18 aa, Mycobacterium avium
GADPIELGKNNSGRGVGG

SEQ ID NO: 64639 - protein, 17 aa, Mycobacterium avium
GADPNARAAYHRRLAEE

SEQ ID NO: 64640 - protein, 7 aa, Mycobacterium avium
GADPNTQ

SEQ ID NO: 64641 - protein, 7 aa, Mycobacterium avium
GADPVAD

SEQ ID NO: 64642 - protein, 23 aa, Mycobacterium avium
GADRDQRRGVGQHEPDPLARQRR

SEQ ID NO: 64643 - protein, 7 aa, Mycobacterium avium
GADRPAL

SEQ ID NO: 64644 - protein, 9 aa, Mycobacterium avium
GADTARADA

SEQ ID NO: 64645 - protein, 7 aa, Mycobacterium avium
GADTWTG

SEQ ID NO: 64646 - protein, 6 aa, Mycobacterium avium
GADVAA

SEQ ID NO: 64647 - protein, 7 aa, Mycobacterium avium
GADVGRE

SEQ ID NO: 64648 - protein, 17 aa, Mycobacterium avium
GAEAARPHRVTHRKLTR

SEQ ID NO: 64649 - protein, 43 aa, Mycobacterium avium
GAEAEADTETATYDEGEGVPSRARREGAARVRAASVPDVHEAA

SEQ ID NO: 64650 - protein, 9 aa, Mycobacterium avium
GAEEIERQR

SEQ ID NO: 64651 - protein, 6 aa, Mycobacterium avium
GAEFDD

SEQ ID NO: 64652 - protein, 13 aa, Mycobacterium avium
GAEGAGGVEGISG

SEQ ID NO: 64653 - protein, 6 aa, Mycobacterium avium
GAEGLP

SEQ ID NO: 64654 - protein, 23 aa, Mycobacterium avium
GAEGLRHAGEEAQRSPAATVPAA

SEQ ID NO: 64655 - protein, 6 aa, Mycobacterium avium
GAEGQG

SEQ ID NO: 64656 - protein, 8 aa, Mycobacterium avium
GAELPDGQ

SEQ ID NO: 64657 - protein, 14 aa, Mycobacterium avium
GAENELPAGQEGEL

SEQ ID NO: 64658 - protein, 6 aa, Mycobacterium avium
GAEPCT

SEQ ID NO: 64659 - protein, 8 aa, Mycobacterium avium
GAEPKADL

SEQ ID NO: 64660 - protein, 7 aa, Mycobacterium avium
GAEPLRG

SEQ ID NO: 64661 - protein, 7 aa, Mycobacterium avium
GAEPPAR

SEQ ID NO: 64662 - protein, 8 aa, Mycobacterium avium
GAEPVGEP

SEQ ID NO: 64663 - protein, 10 aa, Mycobacterium avium
GAEQAEPDLD

SEQ ID NO: 64664 - protein, 8 aa, Mycobacterium avium
GAEQPLGG

SEQ ID NO: 64665 - protein, 4 aa, Mycobacterium avium
GAER

SEQ ID NO: 64666 - protein, 6 aa, Mycobacterium avium
GAERAR

SEQ ID NO: 64667 - protein, 11 aa, Mycobacterium avium
GAERDTGHGRF

SEQ ID NO: 64668 - protein, 7 aa, Mycobacterium avium
GAERDVG

SEQ ID NO: 64669 - protein, 5 aa, Mycobacterium avium
GAERG

SEQ ID NO: 64670 - protein, 6 aa, Mycobacterium avium
GAESLN

SEQ ID NO: 64671 - protein, 4 aa, Mycobacterium avium
GAEV

SEQ ID NO: 64672 - protein, 7 aa, Mycobacterium avium
GAEVSDT

SEQ ID NO: 64673 - protein, 17 aa, Mycobacterium avium
GAFGPAQPAPENSSATA

SEQ ID NO: 64674 - protein, 17 aa, Mycobacterium avium
GAFGPAQPAPENSSPTA

SEQ ID NO: 64675 - protein, 14 aa, Mycobacterium avium
GAFRRSAASQKLTE

SEQ ID NO: 64676 - protein, 5 aa, Mycobacterium avium
GAGAP

SEQ ID NO: 64677 - protein, 9 aa, Mycobacterium avium
GAGAPRRHP

SEQ ID NO: 64678 - protein, 5 aa, Mycobacterium avium
GAGAT

SEQ ID NO: 64679 - protein, 20 aa, Mycobacterium avium
GAGDDDRTAAVADGQHGRQH

SEQ ID NO: 64680 - protein, 9 aa, Mycobacterium avium
GAGDYLPPY

SEQ ID NO: 64681 - protein, 6 aa, Mycobacterium avium
GAGEDV

SEQ ID NO: 64682 - protein, 17 aa, Mycobacterium avium
GAGEPRLRPANPDSPLP

SEQ ID NO: 64683 - protein, 5 aa, Mycobacterium avium
GAGEV

SEQ ID NO: 64684 - protein, 14 aa, Mycobacterium avium
GAGGDGLRQRTGAD

SEQ ID NO: 64685 - protein, 5 aa, Mycobacterium avium
GAGGG

SEQ ID NO: 64686 - protein, 5 aa, Mycobacterium avium
GAGGP

SEQ ID NO: 64687 - protein, 6 aa, Mycobacterium avium
GAGGPH

SEQ ID NO: 64688 - protein, 7 aa, Mycobacterium avium
GAGGPLP

SEQ ID NO: 64689 - protein, 9 aa, Mycobacterium avium
GAGHPDHEA

SEQ ID NO: 64690 - protein, 5 aa, Mycobacterium avium
GAGIQ

SEQ ID NO: 64691 - protein, 5 aa, Mycobacterium avium
GAGLQ

SEQ ID NO: 64692 - protein, 8 aa, Mycobacterium avium
GAGNETTT

SEQ ID NO: 64693 - protein, 7 aa, Mycobacterium avium
GAGPAAM

SEQ ID NO: 64694 - protein, 27 aa, Mycobacterium avium
GAGPAELTEQRVREPGHQGARGAFDGH

SEQ ID NO: 64695 - protein, 7 aa, Mycobacterium avium
GAGPEFG

SEQ ID NO: 64696 - protein, 6 aa, Mycobacterium avium
GAGPGD

SEQ ID NO: 64697 - protein, 15 aa, Mycobacterium avium
GAGPSPTSGMILTGS

SEQ ID NO: 64698 - protein, 8 aa, Mycobacterium avium
GAGRGATR

SEQ ID NO: 64699 - protein, 26 aa, Mycobacterium avium
GAGRGFSSGAGISADDVSDGGGVPPD

SEQ ID NO: 64700 - protein, 6 aa, Mycobacterium avium
GAGRHG

SEQ ID NO: 64701 - protein, 17 aa, Mycobacterium avium
GAGRHQPDLFPAAATKV

SEQ ID NO: 64702 - protein, 14 aa, Mycobacterium avium
GAGRNASPGMASYS

SEQ ID NO: 64703 - protein, 14 aa, Mycobacterium avium
GAGRNVSPGMASYS

SEQ ID NO: 64704 - protein, 15 aa, Mycobacterium avium
GAGRNVSPGMASYSA

SEQ ID NO: 64705 - protein, 8 aa, Mycobacterium avium
GAGRQPGV

SEQ ID NO: 64706 - protein, 5 aa, Mycobacterium avium
GAGRR

SEQ ID NO: 64707 - protein, 29 aa, Mycobacterium avium
GAGRRRAARSQPPGSPGRRTTRAATPIGP

SEQ ID NO: 64708 - protein, 11 aa, Mycobacterium avium
GAGSNADRAQR

SEQ ID NO: 64709 - protein, 9 aa, Mycobacterium avium
GAGSNADRV

SEQ ID NO: 64710 - protein, 6 aa, Mycobacterium avium
GAGTDA

SEQ ID NO: 64711 - protein, 4 aa, Mycobacterium avium
GAGV

SEQ ID NO: 64712 - protein, 9 aa, Mycobacterium avium
GAGVDGAGV

SEQ ID NO: 64713 - protein, 9 aa, Mycobacterium avium
GAGVGAAGG

SEQ ID NO: 64714 - protein, 5 aa, Mycobacterium avium
GAGVT

SEQ ID NO: 64715 - protein, 5 aa, Mycobacterium avium
GAGYG

SEQ ID NO: 64716 - protein, 15 aa, Mycobacterium avium
GAHDSALRKADPRAD

SEQ ID NO: 64717 - protein, 8 aa, Mycobacterium avium
GAHLQPGQ

SEQ ID NO: 64718 - protein, 5 aa, Mycobacterium avium
GAHNA

SEQ ID NO: 64719 - protein, 8 aa, Mycobacterium avium
GAHPAGAM

SEQ ID NO: 64720 - protein, 6 aa, Mycobacterium avium
GAHPGA

SEQ ID NO: 64721 - protein, 10 aa, Mycobacterium avium
GAHTRAGQPL

SEQ ID NO: 64722 - protein, 8 aa, Mycobacterium avium
GAIDPPAF

SEQ ID NO: 64723 - protein, 4 aa, Mycobacterium avium
GAIP

SEQ ID NO: 64724 - protein, 6 aa, Mycobacterium avium
GAIPDD

SEQ ID NO: 64725 - protein, 16 aa, Mycobacterium avium
GAITPEGPVGSDAVKG

SEQ ID NO: 64726 - protein, 15 aa, Mycobacterium avium
GAKDVGKRAERATAE

SEQ ID NO: 64727 - protein, 5 aa, Mycobacterium avium
GAKVA

SEQ ID NO: 64728 - protein, 11 aa, Mycobacterium avium
GAKYDSPTTRS

SEQ ID NO: 64729 - protein, 11 aa, Mycobacterium avium
GALASAPADVR

SEQ ID NO: 64730 - protein, 9 aa, Mycobacterium avium
GALDGGGAD

SEQ ID NO: 64731 - protein, 6 aa, Mycobacterium avium
GALHNR

SEQ ID NO: 64732 - protein, 10 aa, Mycobacterium avium
GALRGAGIER

SEQ ID NO: 64733 - protein, 10 aa, Mycobacterium avium
GALRGAGIQR

SEQ ID NO: 64734 - protein, 10 aa, Mycobacterium avium
GALRGDGIER

SEQ ID NO: 64735 - protein, 6 aa, Mycobacterium avium
GALRSD

SEQ ID NO: 64736 - protein, 8 aa, Mycobacterium avium
GALSGDQE

SEQ ID NO: 64737 - protein, 9 aa, Mycobacterium avium
GALSGPGGR

SEQ ID NO: 64738 - protein, 10 aa, Mycobacterium avium
GAMSPNAGAI

SEQ ID NO: 64739 - protein, 4 aa, Mycobacterium avium
GANA

SEQ ID NO: 64740 - protein, 20 aa, Mycobacterium avium
GANAPTSAPTSTSVAPDPST

SEQ ID NO: 64741 - protein, 6 aa, Mycobacterium avium
GANGAL

SEQ ID NO: 64742 - protein, 7 aa, Mycobacterium avium
GANGMGR

SEQ ID NO: 64743 - protein, 9 aa, Mycobacterium avium
GANGTQDGG

SEQ ID NO: 64744 - protein, 7 aa, Mycobacterium avium
GANTPTL

SEQ ID NO: 64745 - protein, 22 aa, Mycobacterium avium
GAPAAMAPSGLGLGQGGQPNLA

SEQ ID NO: 64746 - protein, 14 aa, Mycobacterium avium
GAPAELIGTDGGAA

SEQ ID NO: 64747 - protein, 5 aa, Mycobacterium avium
GAPAI

SEQ ID NO: 64748 - protein, 9 aa, Mycobacterium avium
GAPAPGPRR

SEQ ID NO: 64749 - protein, 9 aa, Mycobacterium avium
GAPARGQRV

SEQ ID NO: 64750 - protein, 16 aa, Mycobacterium avium
GAPASTEITSARVDPA

SEQ ID NO: 64751 - protein, 22 aa, Mycobacterium avium
GAPDEHRRDGTARDWADAAGDI

SEQ ID NO: 64752 - protein, 23 aa, Mycobacterium avium
GAPDEHRRDGTARDWADGAADID

SEQ ID NO: 64753 - protein, 6 aa, Mycobacterium avium
GAPELN

SEQ ID NO: 64754 - protein, 6 aa, Mycobacterium avium
GAPEPL

SEQ ID NO: 64755 - protein, 5 aa, Mycobacterium avium
GAPEW

SEQ ID NO: 64756 - protein, 6 aa, Mycobacterium avium
GAPGDL

SEQ ID NO: 64757 - protein, 7 aa, Mycobacterium avium
GAPGDLT

SEQ ID NO: 64758 - protein, 6 aa, Mycobacterium avium
GAPGLG

SEQ ID NO: 64759 - protein, 6 aa, Mycobacterium avium
GAPGQG

SEQ ID NO: 64760 - protein, 10 aa, Mycobacterium avium
GAPGQGNYAA

SEQ ID NO: 64761 - protein, 6 aa, Mycobacterium avium
GAPGSI

SEQ ID NO: 64762 - protein, 4 aa, Mycobacterium avium
GAPL

SEQ ID NO: 64763 - protein, 11 aa, Mycobacterium avium
GAPLQSAPAIG

SEQ ID NO: 64764 - protein, 9 aa, Mycobacterium avium
GAPPSPGLS

SEQ ID NO: 64765 - protein, 26 aa, Mycobacterium avium
GAPPTIEPAGAAVSPPSAQQPAGSVR

SEQ ID NO: 64766 - protein, 6 aa, Mycobacterium avium
GAPSSD

SEQ ID NO: 64767 - protein, 7 aa, Mycobacterium avium
GAPSVYA

SEQ ID NO: 64768 - protein, 5 aa, Mycobacterium avium
GAPTA

SEQ ID NO: 64769 - protein, 24 aa, Mycobacterium avium
GAPTRDPLGAPTVRPRTTSPSTLP

SEQ ID NO: 64770 - protein, 18 aa, Mycobacterium avium
GAPVGAPAEAVRSDYGPV

SEQ ID NO: 64771 - protein, 7 aa, Mycobacterium avium
GAPVGTA

SEQ ID NO: 64772 - protein, 7 aa, Mycobacterium avium
GAPVPRG

SEQ ID NO: 64773 - protein, 12 aa, Mycobacterium avium
GAPVRPGAERSS

SEQ ID NO: 64774 - protein, 5 aa, Mycobacterium avium
GAPYR

SEQ ID NO: 64775 - protein, 4 aa, Mycobacterium avium
GAQA

SEQ ID NO: 64776 - protein, 9 aa, Mycobacterium avium
GAQADTGLR

SEQ ID NO: 64777 - protein, 6 aa, Mycobacterium avium
GAQAGN

SEQ ID NO: 64778 - protein, 15 aa, Mycobacterium avium
GAQDFAEDPSRYDIP

SEQ ID NO: 64779 - protein, 9 aa, Mycobacterium avium
GAQEEQPEM

SEQ ID NO: 64780 - protein, 9 aa, Mycobacterium avium
GAQGARVYE

SEQ ID NO: 64781 - protein, 11 aa, Mycobacterium avium
GAQGARVYEPR

SEQ ID NO: 64782 - protein, 10 aa, Mycobacterium avium
GAQGHTNTSH

SEQ ID NO: 64783 - protein, 11 aa, Mycobacterium avium
GAQGTDDQAYY

SEQ ID NO: 64784 - protein, 18 aa, Mycobacterium avium
GAQHRGPGARPGRPRIPD

SEQ ID NO: 64785 - protein, 15 aa, Mycobacterium avium
GAQPPNRRSQLKSDR

SEQ ID NO: 64786 - protein, 7 aa, Mycobacterium avium
GAQPVKG

SEQ ID NO: 64787 - protein, 9 aa, Mycobacterium avium
GAQQPDGMS

SEQ ID NO: 64788 - protein, 12 aa, Mycobacterium avium
GAQSAKGEPSAA

SEQ ID NO: 64789 - protein, 11 aa, Mycobacterium avium
GAQSEQLPKIG

SEQ ID NO: 64790 - protein, 13 aa, Mycobacterium avium
GAQVAGHDPQLPN

SEQ ID NO: 64791 - protein, 13 aa, Mycobacterium avium
GAQVAGYDPQLPN

SEQ ID NO: 64792 - protein, 14 aa, Mycobacterium avium
GAQVAGYDPQLPNI

SEQ ID NO: 64793 - protein, 4 aa, Mycobacterium avium
GARA

SEQ ID NO: 64794 - protein, 9 aa, Mycobacterium avium
GARAGASAP

SEQ ID NO: 64795 - protein, 13 aa, Mycobacterium avium
GARAGVERRGERR

SEQ ID NO: 64796 - protein, 5 aa, Mycobacterium avium
GARAR

SEQ ID NO: 64797 - protein, 15 aa, Mycobacterium avium
GARARPAGARPDGMR

SEQ ID NO: 64798 - protein, 25 aa, Mycobacterium avium
GARATIPGGPGRRDCADGRPPAPAP

SEQ ID NO: 64799 - protein, 26 aa, Mycobacterium avium
GARATIPGGPGRRDCADGRPPAPAPI

SEQ ID NO: 64800 - protein, 15 aa, Mycobacterium avium
GARDRYGSPERAPRA

SEQ ID NO: 64801 - protein, 4 aa, Mycobacterium avium
GARF

SEQ ID NO: 64802 - protein, 5 aa, Mycobacterium avium
GARFS

SEQ ID NO: 64803 - protein, 6 aa, Mycobacterium avium
GARGAH

SEQ ID NO: 64804 - protein, 15 aa, Mycobacterium avium
GARGGIDVPKSDIDR

SEQ ID NO: 64805 - protein, 13 aa, Mycobacterium avium
GARLDAEPPAVQG

SEQ ID NO: 64806 - protein, 6 aa, Mycobacterium avium
GARPAE

SEQ ID NO: 64807 - protein, 7 aa, Mycobacterium avium
GARPAEE

SEQ ID NO: 64808 - protein, 8 aa, Mycobacterium avium
GARPGEQR

SEQ ID NO: 64809 - protein, 13 aa, Mycobacterium avium
GARPGEQRTYTLP

SEQ ID NO: 64810 - protein, 5 aa, Mycobacterium avium
GARPP

SEQ ID NO: 64811 - protein, 5 aa, Mycobacterium avium
GARPS

SEQ ID NO: 64812 - protein, 8 aa, Mycobacterium avium
GARPSALA

SEQ ID NO: 64813 - protein, 9 aa, Mycobacterium avium
GARPVGADS

SEQ ID NO: 64814 - protein, 6 aa, Mycobacterium avium
GARQRF

SEQ ID NO: 64815 - protein, 23 aa, Mycobacterium avium
GARRDDRGGMHPAQQRDDLRRGI

SEQ ID NO: 64816 - protein, 8 aa, Mycobacterium avium
GARRGTAE

SEQ ID NO: 64817 - protein, 7 aa, Mycobacterium avium
GARRGTG

SEQ ID NO: 64818 - protein, 9 aa, Mycobacterium avium
GARRPQGAV

SEQ ID NO: 64819 - protein, 23 aa, Mycobacterium avium
GARSAQSHAAAVAGTDDLPTAAS

SEQ ID NO: 64820 - protein, 8 aa, Mycobacterium avium
GARSSDMA

SEQ ID NO: 64821 - protein, 8 aa, Mycobacterium avium
GARSSLGR

SEQ ID NO: 64822 - protein, 11 aa, Mycobacterium avium
GARTDGHDHAE

SEQ ID NO: 64823 - protein, 15 aa, Mycobacterium avium
GARTRTGHARSSGLP

SEQ ID NO: 64824 - protein, 9 aa, Mycobacterium avium
GASAGGVEA

SEQ ID NO: 64825 - protein, 12 aa, Mycobacterium avium
GASAPARQWPPD

SEQ ID NO: 64826 - protein, 12 aa, Mycobacterium avium
GASARARQWPPD

SEQ ID NO: 64827 - protein, 8 aa, Mycobacterium avium
GASARVEG

SEQ ID NO: 64828 - protein, 5 aa, Mycobacterium avium
GASDD

SEQ ID NO: 64829 - protein, 8 aa, Mycobacterium avium
GASDGVGA

SEQ ID NO: 64830 - protein, 28 aa, Mycobacterium avium
GASEATGDDLAAEEGRITDEDIERAKGQ

SEQ ID NO: 64831 - protein, 4 aa, Mycobacterium avium
GASG

SEQ ID NO: 64832 - protein, 12 aa, Mycobacterium avium
GASGITPAQADL

SEQ ID NO: 64833 - protein, 7 aa, Mycobacterium avium
GASGMGA

SEQ ID NO: 64834 - protein, 15 aa, Mycobacterium avium
GASGPTVGDPDDGVE

SEQ ID NO: 64835 - protein, 4 aa, Mycobacterium avium
GASK

SEQ ID NO: 64836 - protein, 8 aa, Mycobacterium avium
GASKGSIA

SEQ ID NO: 64837 - protein, 9 aa, Mycobacterium avium
GASKGSIAS

SEQ ID NO: 64838 - protein, 8 aa, Mycobacterium avium
GASLGHDR

SEQ ID NO: 64839 - protein, 14 aa, Mycobacterium avium
GASLTEAQSKQESG

SEQ ID NO: 64840 - protein, 11 aa, Mycobacterium avium
GASPAAPAEAV

SEQ ID NO: 64841 - protein, 7 aa, Mycobacterium avium
GASPQQL

SEQ ID NO: 64842 - protein, 5 aa, Mycobacterium avium
GASPR

SEQ ID NO: 64843 - protein, 7 aa, Mycobacterium avium
GASPRAE

SEQ ID NO: 64844 - protein, 4 aa, Mycobacterium avium
GASQ

SEQ ID NO: 64845 - protein, 4 aa, Mycobacterium avium
GASR

SEQ ID NO: 64846 - protein, 25 aa, Mycobacterium avium
GASRRKSSRNAVPEADFASAREGKE

SEQ ID NO: 64847 - protein, 12 aa, Mycobacterium avium
GASSNNYGSPQA

SEQ ID NO: 64848 - protein, 9 aa, Mycobacterium avium
GASTDQERR

SEQ ID NO: 64849 - protein, 9 aa, Mycobacterium avium
GASTGIGKQ

SEQ ID NO: 64850 - protein, 12 aa, Mycobacterium avium
GASYGRSAPTLQ

SEQ ID NO: 64851 - protein, 25 aa, Mycobacterium avium
GATADAIDADADPNHSSLASAVTTL

SEQ ID NO: 64852 - protein, 7 aa, Mycobacterium avium
GATAGHD

SEQ ID NO: 64853 - protein, 8 aa, Mycobacterium avium
GATAGHDA

SEQ ID NO: 64854 - protein, 8 aa, Mycobacterium avium
GATAGHDE

SEQ ID NO: 64855 - protein, 8 aa, Mycobacterium avium
GATARRRA

SEQ ID NO: 64856 - protein, 21 aa, Mycobacterium avium
GATCPSPQRIEDTAAEESPNR

SEQ ID NO: 64857 - protein, 8 aa, Mycobacterium avium
GATDAQRQ

SEQ ID NO: 64858 - protein, 8 aa, Mycobacterium avium
GATDDPTI

SEQ ID NO: 64859 - protein, 4 aa, Mycobacterium avium
GATE

SEQ ID NO: 64860 - protein, 17 aa, Mycobacterium avium
GATEHPTVTGEHEGQPQ

SEQ ID NO: 64861 - protein, 7 aa, Mycobacterium avium
GATELDA

SEQ ID NO: 64862 - protein, 7 aa, Mycobacterium avium
GATETRS

SEQ ID NO: 64863 - protein, 16 aa, Mycobacterium avium
GATGGGDGDSGGGPGR

SEQ ID NO: 64864 - protein, 13 aa, Mycobacterium avium
GATGWNPVRAVAT

SEQ ID NO: 64865 - protein, 7 aa, Mycobacterium avium
GATKIGG

SEQ ID NO: 64866 - protein, 55 aa, Mycobacterium avium
GATPASVAAPAPDPQAEPETQPAPPPPSDTPIPPPPTDPSGPSANGGQPKPSLAE

SEQ ID NO: 64867 - protein, 8 aa, Mycobacterium avium
GATPLKAP

SEQ ID NO: 64868 - protein, 8 aa, Mycobacterium avium
GATPVKAP

SEQ ID NO: 64869 - protein, 6 aa, Mycobacterium avium
GATQIG

SEQ ID NO: 64870 - protein, 5 aa, Mycobacterium avium
GATRG

SEQ ID NO: 64871 - protein, 7 aa, Mycobacterium avium
GATRSTA

SEQ ID NO: 64872 - protein, 12 aa, Mycobacterium avium
GATRSTWPATSS

SEQ ID NO: 64873 - protein, 8 aa, Mycobacterium avium
GATSGSKN

SEQ ID NO: 64874 - protein, 24 aa, Mycobacterium avium
GATTPKGNGETGFHPRPDGYQSPM

SEQ ID NO: 64875 - protein, 11 aa, Mycobacterium avium
GATTRIDSGAT

SEQ ID NO: 64876 - protein, 15 aa, Mycobacterium avium
GATTTGAAEHAASAV

SEQ ID NO: 64877 - protein, 15 aa, Mycobacterium avium
GAVAGGTADGVRQAT

SEQ ID NO: 64878 - protein, 4 aa, Mycobacterium avium
GAVE

SEQ ID NO: 64879 - protein, 6 aa, Mycobacterium avium
GAVGPG

SEQ ID NO: 64880 - protein, 14 aa, Mycobacterium avium
GAVKVNTDATTTRE

SEQ ID NO: 64881 - protein, 8 aa, Mycobacterium avium
GAVSPTGR

SEQ ID NO: 64882 - protein, 5 aa, Mycobacterium avium
GAVTR

SEQ ID NO: 64883 - protein, 9 aa, Mycobacterium avium
GAWAAAAGD

SEQ ID NO: 64884 - protein, 13 aa, Mycobacterium avium
GAWADPKAGERPV

SEQ ID NO: 64885 - protein, 5 aa, Mycobacterium avium
GAWQS

SEQ ID NO: 64886 - protein, 6 aa, Mycobacterium avium
GAWQSG

SEQ ID NO: 64887 - protein, 6 aa, Mycobacterium avium
GAYEPM

SEQ ID NO: 64888 - protein, 9 aa, Mycobacterium avium
GAYGPEQAH

SEQ ID NO: 64889 - protein, 8 aa, Mycobacterium avium
GAYTKAAP

SEQ ID NO: 64890 - protein, 8 aa, Mycobacterium avium
GCERPTEP

SEQ ID NO: 64891 - protein, 11 aa, Mycobacterium avium
GCGETDADDPV

SEQ ID NO: 64892 - protein, 6 aa, Mycobacterium avium
GCHGGP

SEQ ID NO: 64893 - protein, 5 aa, Mycobacterium avium
GCPGT

SEQ ID NO: 64894 - protein, 7 aa, Mycobacterium avium
GCPPTPA

SEQ ID NO: 64895 - protein, 9 aa, Mycobacterium avium
GCREDADGV

SEQ ID NO: 64896 - protein, 15 aa, Mycobacterium avium
GCRRSGRCSRPGASI

SEQ ID NO: 64897 - protein, 10 aa, Mycobacterium avium
GCRSSTSTGC

SEQ ID NO: 64898 - protein, 5 aa, Mycobacterium avium
GCRTG

SEQ ID NO: 64899 - protein, 12 aa, Mycobacterium avium
GCSAGSSPRGRL

SEQ ID NO: 64900 - protein, 7 aa, Mycobacterium avium
GCSGQTT

SEQ ID NO: 64901 - protein, 10 aa, Mycobacterium avium
GCTGKGNDQV

SEQ ID NO: 64902 - protein, 5 aa, Mycobacterium avium
GCTGR

SEQ ID NO: 64903 - protein, 10 aa, Mycobacterium avium
GDAAPRLGNT

SEQ ID NO: 64904 - protein, 7 aa, Mycobacterium avium
GDADAEV

SEQ ID NO: 64905 - protein, 10 aa, Mycobacterium avium
GDADKAAGAG

SEQ ID NO: 64906 - protein, 10 aa, Mycobacterium avium
GDADKAAQSL

SEQ ID NO: 64907 - protein, 10 aa, Mycobacterium avium
GDADPAEARA

SEQ ID NO: 64908 - protein, 12 aa, Mycobacterium avium
GDADPAEARARL

SEQ ID NO: 64909 - protein, 10 aa, Mycobacterium avium
GDADRAAQSL

SEQ ID NO: 64910 - protein, 7 aa, Mycobacterium avium
GDADVAR

SEQ ID NO: 64911 - protein, 6 aa, Mycobacterium avium
GDADVT

SEQ ID NO: 64912 - protein, 4 aa, Mycobacterium avium
GDAE

SEQ ID NO: 64913 - protein, 10 aa, Mycobacterium avium
GDAEPDGGDV

SEQ ID NO: 64914 - protein, 9 aa, Mycobacterium avium
GDAGARGAV

SEQ ID NO: 64915 - protein, 12 aa, Mycobacterium avium
GDAGHRGGARDD

SEQ ID NO: 64916 - protein, 5 aa, Mycobacterium avium
GDAGT

SEQ ID NO: 64917 - protein, 7 aa, Mycobacterium avium
GDAGTLE

SEQ ID NO: 64918 - protein, 6 aa, Mycobacterium avium
GDAKER

SEQ ID NO: 64919 - protein, 13 aa, Mycobacterium avium
GDAPLAGSEDAER

SEQ ID NO: 64920 - protein, 7 aa, Mycobacterium avium
GDAPLGD

SEQ ID NO: 64921 - protein, 7 aa, Mycobacterium avium
GDAPQAN

SEQ ID NO: 64922 - protein, 9 aa, Mycobacterium avium
GDAQRQRAE

SEQ ID NO: 64923 - protein, 29 aa, Mycobacterium avium
GDATKEPKQASPLKPHTPTAPTSGTTSRT

SEQ ID NO: 64924 - protein, 7 aa, Mycobacterium avium
GDAVPTE

SEQ ID NO: 64925 - protein, 11 aa, Mycobacterium avium
GDDADDDELRD

SEQ ID NO: 64926 - protein, 9 aa, Mycobacterium avium
GDDAEIADG

SEQ ID NO: 64927 - protein, 13 aa, Mycobacterium avium
GDDAEIADGLTRR

SEQ ID NO: 64928 - protein, 18 aa, Mycobacterium avium
GDDGAATQAGKTLGPIDT

SEQ ID NO: 64929 - protein, 21 aa, Mycobacterium avium
GDDGEPTPQRANLNDSLTPDE

SEQ ID NO: 64930 - protein, 12 aa, Mycobacterium avium
GDDGIDDDHRPR

SEQ ID NO: 64931 - protein, 14 aa, Mycobacterium avium
GDDHPGAAYRLRRD

SEQ ID NO: 64932 - protein, 8 aa, Mycobacterium avium
GDDIPGAR

SEQ ID NO: 64933 - protein, 8 aa, Mycobacterium avium
GDDKRNRY

SEQ ID NO: 64934 - protein, 12 aa, Mycobacterium avium
GDDPPDDGVAEP

SEQ ID NO: 64935 - protein, 7 aa, Mycobacterium avium
GDDPTRL

SEQ ID NO: 64936 - protein, 5 aa, Mycobacterium avium
GDDSF

SEQ ID NO: 64937 - protein, 7 aa, Mycobacterium avium
GDDSPWA

SEQ ID NO: 64938 - protein, 10 aa, Mycobacterium avium
GDDTNAAAKD

SEQ ID NO: 64939 - protein, 5 aa, Mycobacterium avium
GDDTV

SEQ ID NO: 64940 - protein, 4 aa, Mycobacterium avium
GDEA

SEQ ID NO: 64941 - protein, 12 aa, Mycobacterium avium
GDEELDDGRTQA

SEQ ID NO: 64942 - protein, 9 aa, Mycobacterium avium
GDEFGGGAG

SEQ ID NO: 64943 - protein, 6 aa, Mycobacterium avium
GDEGAG

SEQ ID NO: 64944 - protein, 6 aa, Mycobacterium avium
GDEGDI

SEQ ID NO: 64945 - protein, 8 aa, Mycobacterium avium
GDEGDRLD

SEQ ID NO: 64946 - protein, 5 aa, Mycobacterium avium
GDEGF

SEQ ID NO: 64947 - protein, 7 aa, Mycobacterium avium
GDEITGE

SEQ ID NO: 64948 - protein, 26 aa, Mycobacterium avium
GDELGTAKTKAANGYSTLSGVNANST

SEQ ID NO: 64949 - protein, 8 aa, Mycobacterium avium
GDEMTSTA

SEQ ID NO: 64950 - protein, 8 aa, Mycobacterium avium
GDEPGRGF

SEQ ID NO: 64951 - protein, 8 aa, Mycobacterium avium
GDEPHDEL

SEQ ID NO: 64952 - protein, 6 aa, Mycobacterium avium
GDERRR

SEQ ID NO: 64953 - protein, 7 aa, Mycobacterium avium
GDERRRQ

SEQ ID NO: 64954 - protein, 4 aa, Mycobacterium avium
GDET

SEQ ID NO: 64955 - protein, 6 aa, Mycobacterium avium
GDFPAD

SEQ ID NO: 64956 - protein, 9 aa, Mycobacterium avium
GDGAADGEA

SEQ ID NO: 64957 - protein, 16 aa, Mycobacterium avium
GDGAAPDWPRHPSPLG

SEQ ID NO: 64958 - protein, 12 aa, Mycobacterium avium
GDGARSKRSPVT

SEQ ID NO: 64959 - protein, 19 aa, Mycobacterium avium
GDGDLGAAQRRARAGPGED

SEQ ID NO: 64960 - protein, 11 aa, Mycobacterium avium
GDGDRNRDDAA

SEQ ID NO: 64961 - protein, 7 aa, Mycobacterium avium
GDGEKET

SEQ ID NO: 64962 - protein, 16 aa, Mycobacterium avium
GDGGRAVGGVRRRGRH

SEQ ID NO: 64963 - protein, 8 aa, Mycobacterium avium
GDGITPAG

SEQ ID NO: 64964 - protein, 9 aa, Mycobacterium avium
GDGKPHPID

SEQ ID NO: 64965 - protein, 12 aa, Mycobacterium avium
GDGKSEEGAPTK

SEQ ID NO: 64966 - protein, 19 aa, Mycobacterium avium
GDGLDGADPFGDQDPLDDN

SEQ ID NO: 64967 - protein, 19 aa, Mycobacterium avium
GDGLDGSDPFGDQDPLDDN

SEQ ID NO: 64968 - protein, 7 aa, Mycobacterium avium
GDGLTGR

SEQ ID NO: 64969 - protein, 4 aa, Mycobacterium avium
GDGP

SEQ ID NO: 64970 - protein, 11 aa, Mycobacterium avium
GDGSALKSGNF

SEQ ID NO: 64971 - protein, 7 aa, Mycobacterium avium
GDGSSIA

SEQ ID NO: 64972 - protein, 7 aa, Mycobacterium avium
GDGTNRW

SEQ ID NO: 64973 - protein, 7 aa, Mycobacterium avium
GDGTTYD

SEQ ID NO: 64974 - protein, 10 aa, Mycobacterium avium
GDHAQETNDR

SEQ ID NO: 64975 - protein, 5 aa, Mycobacterium avium
GDHPR

SEQ ID NO: 64976 - protein, 4 aa, Mycobacterium avium
GDHR

SEQ ID NO: 64977 - protein, 7 aa, Mycobacterium avium
GDIERAR

SEQ ID NO: 64978 - protein, 4 aa, Mycobacterium avium
GDIK

SEQ ID NO: 64979 - protein, 4 aa, Mycobacterium avium
GDIP

SEQ ID NO: 64980 - protein, 10 aa, Mycobacterium avium
GDIPADDEEA

SEQ ID NO: 64981 - protein, 6 aa, Mycobacterium avium
GDIPEG

SEQ ID NO: 64982 - protein, 8 aa, Mycobacterium avium
GDKAAPTI

SEQ ID NO: 64983 - protein, 9 aa, Mycobacterium avium
GDKAGSLPT

SEQ ID NO: 64984 - protein, 8 aa, Mycobacterium avium
GDKKYRDF

SEQ ID NO: 64985 - protein, 4 aa, Mycobacterium avium
GDLA

SEQ ID NO: 64986 - protein, 18 aa, Mycobacterium avium
GDLAKGHPHAQQRDNALS

SEQ ID NO: 64987 - protein, 11 aa, Mycobacterium avium
GDLGDRPQDFD

SEQ ID NO: 64988 - protein, 8 aa, Mycobacterium avium
GDLGTSRV

SEQ ID NO: 64989 - protein, 25 aa, Mycobacterium avium
GDLPGRDPRGQVGGDGAGTATDVEH

SEQ ID NO: 64990 - protein, 4 aa, Mycobacterium avium
GDLR

SEQ ID NO: 64991 - protein, 4 aa, Mycobacterium avium
GDLS

SEQ ID NO: 64992 - protein, 28 aa, Mycobacterium avium
GDLSGLSRPGQGDDRTAARAKDTGDDWQ

SEQ ID NO: 64993 - protein, 16 aa, Mycobacterium avium
GDLTGGDTAGAADAAN

SEQ ID NO: 64994 - protein, 17 aa, Mycobacterium avium
GDLTGGDTEGAAQAAND

SEQ ID NO: 64995 - protein, 6 aa, Mycobacterium avium
GDLTPT

SEQ ID NO: 64996 - protein, 6 aa, Mycobacterium avium
GDNAGN

SEQ ID NO: 64997 - protein, 10 aa, Mycobacterium avium
GDNPATNPNF

SEQ ID NO: 64998 - protein, 11 aa, Mycobacterium avium
GDPAAESTDIG

SEQ ID NO: 64999 - protein, 8 aa, Mycobacterium avium
GDPAARDA

SEQ ID NO: 65000 - protein, 8 aa, Mycobacterium avium
GDPADPNT

SEQ ID NO: 65001 - protein, 8 aa, Mycobacterium avium
GDPAKLAE

SEQ ID NO: 65002 - protein, 12 aa, Mycobacterium avium
GDPALPERLSAR

SEQ ID NO: 65003 - protein, 22 aa, Mycobacterium avium
GDPARLGPTLSEAARAAEQGGA

SEQ ID NO: 65004 - protein, 22 aa, Mycobacterium avium
GDPARLGPTLTEAARAAEQGGA

SEQ ID NO: 65005 - protein, 5 aa, Mycobacterium avium
GDPAV

SEQ ID NO: 65006 - protein, 11 aa, Mycobacterium avium
GDPDFSDPQRR

SEQ ID NO: 65007 - protein, 17 aa, Mycobacterium avium
GDPDSRNDDDSAPSMPK

SEQ ID NO: 65008 - protein, 9 aa, Mycobacterium avium
GDPDVLDGG

SEQ ID NO: 65009 - protein, 11 aa, Mycobacterium avium
GDPEFSDPQRR

SEQ ID NO: 65010 - protein, 6 aa, Mycobacterium avium
GDPERI

SEQ ID NO: 65011 - protein, 8 aa, Mycobacterium avium
GDPGLDTS

SEQ ID NO: 65012 - protein, 7 aa, Mycobacterium avium
GDPGPFT

SEQ ID NO: 65013 - protein, 6 aa, Mycobacterium avium
GDPGTE

SEQ ID NO: 65014 - protein, 6 aa, Mycobacterium avium
GDPICS

SEQ ID NO: 65015 - protein, 6 aa, Mycobacterium avium
GDPIDR

SEQ ID NO: 65016 - protein, 17 aa, Mycobacterium avium
GDPIHPEADATNRSPRA

SEQ ID NO: 65017 - protein, 16 aa, Mycobacterium avium
GDPLTAGLSGRPAPGL

SEQ ID NO: 65018 - protein, 7 aa, Mycobacterium avium
GDPLTVS

SEQ ID NO: 65019 - protein, 12 aa, Mycobacterium avium
GDPLTVSGTGLQ

SEQ ID NO: 65020 - protein, 16 aa, Mycobacterium avium
GDPMENAAAAGGGFGG

SEQ ID NO: 65021 - protein, 6 aa, Mycobacterium avium
GDPQPE

SEQ ID NO: 65022 - protein, 8 aa, Mycobacterium avium
GDPQPQHG

SEQ ID NO: 65023 - protein, 4 aa, Mycobacterium avium
GDPR

SEQ ID NO: 65024 - protein, 4 aa, Mycobacterium avium
GDPS

SEQ ID NO: 65025 - protein, 7 aa, Mycobacterium avium
GDPSDRD

SEQ ID NO: 65026 - protein, 10 aa, Mycobacterium avium
GDPSGAAAGD

SEQ ID NO: 65027 - protein, 11 aa, Mycobacterium avium
GDPSGAAAGDL

SEQ ID NO: 65028 - protein, 11 aa, Mycobacterium avium
GDPSPTRPRGV

SEQ ID NO: 65029 - protein, 9 aa, Mycobacterium avium
GDPTRYRGR

SEQ ID NO: 65030 - protein, 4 aa, Mycobacterium avium
GDPV

SEQ ID NO: 65031 - protein, 5 aa, Mycobacterium avium
GDPVH

SEQ ID NO: 65032 - protein, 8 aa, Mycobacterium avium
GDQAGEAQ

SEQ ID NO: 65033 - protein, 7 aa, Mycobacterium avium
GDQDALR

SEQ ID NO: 65034 - protein, 5 aa, Mycobacterium avium
GDQDQ

SEQ ID NO: 65035 - protein, 9 aa, Mycobacterium avium
GDQKGGTEA

SEQ ID NO: 65036 - protein, 7 aa, Mycobacterium avium
GDQPAHR

SEQ ID NO: 65037 - protein, 7 aa, Mycobacterium avium
GDQPEVK

SEQ ID NO: 65038 - protein, 10 aa, Mycobacterium avium
GDQRASTTAI

SEQ ID NO: 65039 - protein, 9 aa, Mycobacterium avium
GDQRGGTIR

SEQ ID NO: 65040 - protein, 11 aa, Mycobacterium avium
GDQTDVPESGD

SEQ ID NO: 65041 - protein, 5 aa, Mycobacterium avium
GDRAR

SEQ ID NO: 65042 - protein, 7 aa, Mycobacterium avium
GDRATTY

SEQ ID NO: 65043 - protein, 4 aa, Mycobacterium avium
GDRD

SEQ ID NO: 65044 - protein, 4 aa, Mycobacterium avium
GDRF

SEQ ID NO: 65045 - protein, 4 aa, Mycobacterium avium
GDRG

SEQ ID NO: 65046 - protein, 8 aa, Mycobacterium avium
GDRGHLRP

SEQ ID NO: 65047 - protein, 13 aa, Mycobacterium avium
GDRGRALARRFPV

SEQ ID NO: 65048 - protein, 9 aa, Mycobacterium avium
GDRHRGGCG

SEQ ID NO: 65049 - protein, 5 aa, Mycobacterium avium
GDRLG

SEQ ID NO: 65050 - protein, 7 aa, Mycobacterium avium
GDRPADI

SEQ ID NO: 65051 - protein, 7 aa, Mycobacterium avium
GDRPPFG

SEQ ID NO: 65052 - protein, 8 aa, Mycobacterium avium
GDRQRLGD

SEQ ID NO: 65053 - protein, 7 aa, Mycobacterium avium
GDRSAAV

SEQ ID NO: 65054 - protein, 7 aa, Mycobacterium avium
GDRSRGV

SEQ ID NO: 65055 - protein, 11 aa, Mycobacterium avium
GDRTGQPVGDR

SEQ ID NO: 65056 - protein, 13 aa, Mycobacterium avium
GDRVPDDLRDQAK

SEQ ID NO: 65057 - protein, 11 aa, Mycobacterium avium
GDRVSRSVRAD

SEQ ID NO: 65058 - protein, 7 aa, Mycobacterium avium
GDSFTTQ

SEQ ID NO: 65059 - protein, 12 aa, Mycobacterium avium
GDSGDLSGITKR

SEQ ID NO: 65060 - protein, 9 aa, Mycobacterium avium
GDSGGDENA

SEQ ID NO: 65061 - protein, 26 aa, Mycobacterium avium
GDSPGGAGGHSESRPEHGATHGMAHD

SEQ ID NO: 65062 - protein, 26 aa, Mycobacterium avium
GDSPGGAGGHSESRPEHGATHGMVHD

SEQ ID NO: 65063 - protein, 4 aa, Mycobacterium avium
GDST

SEQ ID NO: 65064 - protein, 5 aa, Mycobacterium avium
GDSTL

SEQ ID NO: 65065 - protein, 41 aa, Mycobacterium avium
GDSTVAKTPQARTTSETPSITAPATPSAAAAQPGVGQPADP

SEQ ID NO: 65066 - protein, 9 aa, Mycobacterium avium
GDTAAEGTG

SEQ ID NO: 65067 - protein, 17 aa, Mycobacterium avium
GDTADKRRRRAEAAGRR

SEQ ID NO: 65068 - protein, 4 aa, Mycobacterium avium
GDTD

SEQ ID NO: 65069 - protein, 4 aa, Mycobacterium avium
GDTE

SEQ ID NO: 65070 - protein, 7 aa, Mycobacterium avium
GDTGDKL

SEQ ID NO: 65071 - protein, 9 aa, Mycobacterium avium
GDTGGPDSA

SEQ ID NO: 65072 - protein, 7 aa, Mycobacterium avium
GDTGQKL

SEQ ID NO: 65073 - protein, 9 aa, Mycobacterium avium
GDTGRNHPD

SEQ ID NO: 65074 - protein, 18 aa, Mycobacterium avium
GDTGYTKTFAQTGAEHGP

SEQ ID NO: 65075 - protein, 9 aa, Mycobacterium avium
GDTIEYQGT

SEQ ID NO: 65076 - protein, 10 aa, Mycobacterium avium
GDTQRECPPG

SEQ ID NO: 65077 - protein, 6 aa, Mycobacterium avium
GDTRHD

SEQ ID NO: 65078 - protein, 12 aa, Mycobacterium avium
GDTRSAAQRNHD

SEQ ID NO: 65079 - protein, 7 aa, Mycobacterium avium
GDTSNNA

SEQ ID NO: 65080 - protein, 12 aa, Mycobacterium avium
GDTTGRSDGDWF

SEQ ID NO: 65081 - protein, 7 aa, Mycobacterium avium
GDTTTNT

SEQ ID NO: 65082 - protein, 16 aa, Mycobacterium avium
GDTYVTTPGSALLFPT

SEQ ID NO: 65083 - protein, 6 aa, Mycobacterium avium
GDVGDG

SEQ ID NO: 65084 - protein, 6 aa, Mycobacterium avium
GDVKDE

SEQ ID NO: 65085 - protein, 7 aa, Mycobacterium avium
GDVMPPR

SEQ ID NO: 65086 - protein, 5 aa, Mycobacterium avium
GDVPA

SEQ ID NO: 65087 - protein, 9 aa, Mycobacterium avium
GDVRDRASI

SEQ ID NO: 65088 - protein, 4 aa, Mycobacterium avium
GDVT

SEQ ID NO: 65089 - protein, 11 aa, Mycobacterium avium
GDVTDSDSPIA

SEQ ID NO: 65090 - protein, 22 aa, Mycobacterium avium
GDYESPGDASPGTHWPPSQGPQ

SEQ ID NO: 65091 - protein, 6 aa, Mycobacterium avium
GDYPRP

SEQ ID NO: 65092 - protein, 5 aa, Mycobacterium avium
GEADD

SEQ ID NO: 65093 - protein, 9 aa, Mycobacterium avium
GEAEDGSAA

SEQ ID NO: 65094 - protein, 9 aa, Mycobacterium avium
GEAENQVDG

SEQ ID NO: 65095 - protein, 5 aa, Mycobacterium avium
GEAFG

SEQ ID NO: 65096 - protein, 6 aa, Mycobacterium avium
GEAFGR

SEQ ID NO: 65097 - protein, 10 aa, Mycobacterium avium
GEAGQSFDTP

SEQ ID NO: 65098 - protein, 8 aa, Mycobacterium avium
GEAGVTPA

SEQ ID NO: 65099 - protein, 6 aa, Mycobacterium avium
GEALGS

SEQ ID NO: 65100 - protein, 35 aa, Mycobacterium avium
GEALPTGGTPAAGGTPATPAPGQGAGDAVSEKPLG

SEQ ID NO: 65101 - protein, 35 aa, Mycobacterium avium
GEALPTGGTPAAGGTQATPAPGQGAGDAVSEKPLG

SEQ ID NO: 65102 - protein, 7 aa, Mycobacterium avium
GEAPEGT

SEQ ID NO: 65103 - protein, 7 aa, Mycobacterium avium
GEAPTVS

SEQ ID NO: 65104 - protein, 4 aa, Mycobacterium avium
GEAQ

SEQ ID NO: 65105 - protein, 8 aa, Mycobacterium avium
GEASAHAR

SEQ ID NO: 65106 - protein, 8 aa, Mycobacterium avium
GEASPAQI

SEQ ID NO: 65107 - protein, 7 aa, Mycobacterium avium
GEATGGV

SEQ ID NO: 65108 - protein, 7 aa, Mycobacterium avium
GEATGQQ

SEQ ID NO: 65109 - protein, 9 aa, Mycobacterium avium
GEAVGADSS

SEQ ID NO: 65110 - protein, 8 aa, Mycobacterium avium
GEDAATAR

SEQ ID NO: 65111 - protein, 15 aa, Mycobacterium avium
GEDAEPAALQPVSAP

SEQ ID NO: 65112 - protein, 20 aa, Mycobacterium avium
GEDIGADTGHTTPRNPCGQE

SEQ ID NO: 65113 - protein, 9 aa, Mycobacterium avium
GEDNTTITG

SEQ ID NO: 65114 - protein, 8 aa, Mycobacterium avium
GEDPGGMA

SEQ ID NO: 65115 - protein, 8 aa, Mycobacterium avium
GEDPGGVA

SEQ ID NO: 65116 - protein, 11 aa, Mycobacterium avium
GEDPPDDGIAE

SEQ ID NO: 65117 - protein, 9 aa, Mycobacterium avium
GEDQPEPVG

SEQ ID NO: 65118 - protein, 8 aa, Mycobacterium avium
GEDQQPGG

SEQ ID NO: 65119 - protein, 6 aa, Mycobacterium avium
GEDVET

SEQ ID NO: 65120 - protein, 10 aa, Mycobacterium avium
GEEESGSPSL

SEQ ID NO: 65121 - protein, 17 aa, Mycobacterium avium
GEEGGGPAEPSPPGDGT

SEQ ID NO: 65122 - protein, 7 aa, Mycobacterium avium
GEEGQGF

SEQ ID NO: 65123 - protein, 6 aa, Mycobacterium avium
GEEMDS

SEQ ID NO: 65124 - protein, 4 aa, Mycobacterium avium
GEEP

SEQ ID NO: 65125 - protein, 7 aa, Mycobacterium avium
GEEPLDD

SEQ ID NO: 65126 - protein, 7 aa, Mycobacterium avium
GEERGSR

SEQ ID NO: 65127 - protein, 5 aa, Mycobacterium avium
GEFET

SEQ ID NO: 65128 - protein, 4 aa, Mycobacterium avium
GEFN

SEQ ID NO: 65129 - protein, 4 aa, Mycobacterium avium
GEGA

SEQ ID NO: 65130 - protein, 5 aa, Mycobacterium avium
GEGER

SEQ ID NO: 65131 - protein, 7 aa, Mycobacterium avium
GEGFKAR

SEQ ID NO: 65132 - protein, 24 aa, Mycobacterium avium
GEGGFGGERGPSGGDAAPERAPDV

SEQ ID NO: 65133 - protein, 13 aa, Mycobacterium avium
GEGGLEAAARRAR

SEQ ID NO: 65134 - protein, 7 aa, Mycobacterium avium
GEGGPFI

SEQ ID NO: 65135 - protein, 12 aa, Mycobacterium avium
GEGGVKGLSTAE

SEQ ID NO: 65136 - protein, 6 aa, Mycobacterium avium
GEGPCA

SEQ ID NO: 65137 - protein, 9 aa, Mycobacterium avium
GEGYGRTTW

SEQ ID NO: 65138 - protein, 4 aa, Mycobacterium avium
GEHA

SEQ ID NO: 65139 - protein, 7 aa, Mycobacterium avium
GEHGDLA

SEQ ID NO: 65140 - protein, 4 aa, Mycobacterium avium
GEHM

SEQ ID NO: 65141 - protein, 7 aa, Mycobacterium avium
GEHRGHR

SEQ ID NO: 65142 - protein, 6 aa, Mycobacterium avium
GEHTRD

SEQ ID NO: 65143 - protein, 10 aa, Mycobacterium avium
GEIDTPARAA

SEQ ID NO: 65144 - protein, 7 aa, Mycobacterium avium
GEIETPN

SEQ ID NO: 65145 - protein, 5 aa, Mycobacterium avium
GEIPG

SEQ ID NO: 65146 - protein, 16 aa, Mycobacterium avium
GEKADDPALDPARSSD

SEQ ID NO: 65147 - protein, 8 aa, Mycobacterium avium
GELAPQAR

SEQ ID NO: 65148 - protein, 11 aa, Mycobacterium avium
GELDGRKAATE

SEQ ID NO: 65149 - protein, 9 aa, Mycobacterium avium
GELDPDTLD

SEQ ID NO: 65150 - protein, 4 aa, Mycobacterium avium
GELE

SEQ ID NO: 65151 - protein, 16 aa, Mycobacterium avium
GELEATATERARLEGA

SEQ ID NO: 65152 - protein, 4 aa, Mycobacterium avium
GELG

SEQ ID NO: 65153 - protein, 16 aa, Mycobacterium avium
GELGAADEGIGPVQPT

SEQ ID NO: 65154 - protein, 15 aa, Mycobacterium avium
GELGAADEGIGPVRP

SEQ ID NO: 65155 - protein, 21 aa, Mycobacterium avium
GELGAAPGRVAVGGDSAGGNL

SEQ ID NO: 65156 - protein, 9 aa, Mycobacterium avium
GELSDAEAV

SEQ ID NO: 65157 - protein, 27 aa, Mycobacterium avium
GELSESGPPARPARTGWPRNCCGACPS

SEQ ID NO: 65158 - protein, 7 aa, Mycobacterium avium
GEMDARA

SEQ ID NO: 65159 - protein, 6 aa, Mycobacterium avium
GENARS

SEQ ID NO: 65160 - protein, 37 aa, Mycobacterium avium
GENGPKAAAAVKEVSQAQADGAGNTKGFTESQETYNA

SEQ ID NO: 65161 - protein, 4 aa, Mycobacterium avium
GENT

SEQ ID NO: 65162 - protein, 7 aa, Mycobacterium avium
GEPAADN

SEQ ID NO: 65163 - protein, 12 aa, Mycobacterium avium
GEPADGAGQVDA

SEQ ID NO: 65164 - protein, 10 aa, Mycobacterium avium
GEPAHAGTDD

SEQ ID NO: 65165 - protein, 6 aa, Mycobacterium avium
GEPASP

SEQ ID NO: 65166 - protein, 7 aa, Mycobacterium avium
GEPATLG

SEQ ID NO: 65167 - protein, 21 aa, Mycobacterium avium
GEPDEESATKDSRTPAQRQHD

SEQ ID NO: 65168 - protein, 10 aa, Mycobacterium avium
GEPDTPIDDE

SEQ ID NO: 65169 - protein, 12 aa, Mycobacterium avium
GEPFGSSDPWTG

SEQ ID NO: 65170 - protein, 6 aa, Mycobacterium avium
GEPGQG

SEQ ID NO: 65171 - protein, 9 aa, Mycobacterium avium
GEPGSISSE

SEQ ID NO: 65172 - protein, 7 aa, Mycobacterium avium
GEPGTRM

SEQ ID NO: 65173 - protein, 5 aa, Mycobacterium avium
GEPIP

SEQ ID NO: 65174 - protein, 5 aa, Mycobacterium avium
GEPSF

SEQ ID NO: 65175 - protein, 9 aa, Mycobacterium avium
GEPTRYRGR

SEQ ID NO: 65176 - protein, 15 aa, Mycobacterium avium
GEPVATRGFEEREGP

SEQ ID NO: 65177 - protein, 7 aa, Mycobacterium avium
GEPVDAA

SEQ ID NO: 65178 - protein, 12 aa, Mycobacterium avium
GEPVKTSARDAV

SEQ ID NO: 65179 - protein, 30 aa, Mycobacterium avium
GEPVPGGDRRGLRHRGRGAKNRDDGRAHGD

SEQ ID NO: 65180 - protein, 8 aa, Mycobacterium avium
GEQAAAAA

SEQ ID NO: 65181 - protein, 9 aa, Mycobacterium avium
GEQDRPLSE

SEQ ID NO: 65182 - protein, 7 aa, Mycobacterium avium
GEQEAVS

SEQ ID NO: 65183 - protein, 10 aa, Mycobacterium avium
GEQGAVPKAR

SEQ ID NO: 65184 - protein, 6 aa, Mycobacterium avium
GEQHKR

SEQ ID NO: 65185 - protein, 5 aa, Mycobacterium avium
GEQLR

SEQ ID NO: 65186 - protein, 13 aa, Mycobacterium avium
GEQQPDAGRVTRR

SEQ ID NO: 65187 - protein, 14 aa, Mycobacterium avium
GEQQPDAGRVTRRS

SEQ ID NO: 65188 - protein, 14 aa, Mycobacterium avium
GEQQPDTGRVTRRS

SEQ ID NO: 65189 - protein, 9 aa, Mycobacterium avium
GEQRKENDR

SEQ ID NO: 65190 - protein, 6 aa, Mycobacterium avium
GERAAD

SEQ ID NO: 65191 - protein, 8 aa, Mycobacterium avium
GERADGPG

SEQ ID NO: 65192 - protein, 4 aa, Mycobacterium avium
GERD

SEQ ID NO: 65193 - protein, 5 aa, Mycobacterium avium
GERDW

SEQ ID NO: 65194 - protein, 5 aa, Mycobacterium avium
GERGI

SEQ ID NO: 65195 - protein, 5 aa, Mycobacterium avium
GERNY

SEQ ID NO: 65196 - protein, 5 aa, Mycobacterium avium
GERPA

SEQ ID NO: 65197 - protein, 8 aa, Mycobacterium avium
GERPNRPG

SEQ ID NO: 65198 - protein, 45 aa, Mycobacterium avium
GERPSTATADKLEGEASGDPRARTLASSRPATRGGCTPRELSPPC

SEQ ID NO: 65199 - protein, 5 aa, Mycobacterium avium
GERRD

SEQ ID NO: 65200 - protein, 6 aa, Mycobacterium avium
GERTGV

SEQ ID NO: 65201 - protein, 7 aa, Mycobacterium avium
GERTGVA

SEQ ID NO: 65202 - protein, 5 aa, Mycobacterium avium
GERTL

SEQ ID NO: 65203 - protein, 5 aa, Mycobacterium avium
GERTN

SEQ ID NO: 65204 - protein, 4 aa, Mycobacterium avium
GESD

SEQ ID NO: 65205 - protein, 19 aa, Mycobacterium avium
GESEQHAEGDGRDSARANF

SEQ ID NO: 65206 - protein, 4 aa, Mycobacterium avium
GESG

SEQ ID NO: 65207 - protein, 16 aa, Mycobacterium avium
GESGSRRGKTVRATAQ

SEQ ID NO: 65208 - protein, 14 aa, Mycobacterium avium
GESGTDRSGRPYDE

SEQ ID NO: 65209 - protein, 6 aa, Mycobacterium avium
GESGVG

SEQ ID NO: 65210 - protein, 11 aa, Mycobacterium avium
GESSPDQRVPE

SEQ ID NO: 65211 - protein, 5 aa, Mycobacterium avium
GESTA

SEQ ID NO: 65212 - protein, 12 aa, Mycobacterium avium
GESVMASEAQRE

SEQ ID NO: 65213 - protein, 11 aa, Mycobacterium avium
GESVSAAGKAL

SEQ ID NO: 65214 - protein, 5 aa, Mycobacterium avium
GETDL

SEQ ID NO: 65215 - protein, 9 aa, Mycobacterium avium
GETDLPADE

SEQ ID NO: 65216 - protein, 5 aa, Mycobacterium avium
GETGF

SEQ ID NO: 65217 - protein, 21 aa, Mycobacterium avium
GETGRDDRRTAPPEGAPGDFR

SEQ ID NO: 65218 - protein, 9 aa, Mycobacterium avium
GETISSGQV

SEQ ID NO: 65219 - protein, 6 aa, Mycobacterium avium
GETKGR

SEQ ID NO: 65220 - protein, 5 aa, Mycobacterium avium
GETLT

SEQ ID NO: 65221 - protein, 6 aa, Mycobacterium avium
GETRGA

SEQ ID NO: 65222 - protein, 6 aa, Mycobacterium avium
GETSRS

SEQ ID NO: 65223 - protein, 20 aa, Mycobacterium avium
GETTMTNEHGYSQQKDNYAK

SEQ ID NO: 65224 - protein, 6 aa, Mycobacterium avium
GETVTE

SEQ ID NO: 65225 - protein, 4 aa, Mycobacterium avium
GEVA

SEQ ID NO: 65226 - protein, 4 aa, Mycobacterium avium
GEVG

SEQ ID NO: 65227 - protein, 26 aa, Mycobacterium avium
GEVPQEQAEAARNGAANCPEGAISVT

SEQ ID NO: 65228 - protein, 5 aa, Mycobacterium avium
GEVQP

SEQ ID NO: 65229 - protein, 4 aa, Mycobacterium avium
GEVR

SEQ ID NO: 65230 - protein, 7 aa, Mycobacterium avium
GEVTDDP

SEQ ID NO: 65231 - protein, 9 aa, Mycobacterium avium
GEVTPGEGE

SEQ ID NO: 65232 - protein, 15 aa, Mycobacterium avium
GEWPVEDNPLRGAPH

SEQ ID NO: 65233 - protein, 21 aa, Mycobacterium avium
GEYGEDEVDGEQEADQGDDHA

SEQ ID NO: 65234 - protein, 5 aa, Mycobacterium avium
GFAKP

SEQ ID NO: 65235 - protein, 5 aa, Mycobacterium avium
GFASS

SEQ ID NO: 65236 - protein, 37 aa, Mycobacterium avium
GFATGTVGNNDGGHVKTSQVRAAKSDDLGAKEVSKEL

SEQ ID NO: 65237 - protein, 8 aa, Mycobacterium avium
GFDPAQPT

SEQ ID NO: 65238 - protein, 11 aa, Mycobacterium avium
GFDPARPTAWS

SEQ ID NO: 65239 - protein, 8 aa, Mycobacterium avium
GFEANPDL

SEQ ID NO: 65240 - protein, 15 aa, Mycobacterium avium
GFGEPAQLAGAPAED

SEQ ID NO: 65241 - protein, 15 aa, Mycobacterium avium
GFGEPAQLAGAPAQD

SEQ ID NO: 65242 - protein, 5 aa, Mycobacterium avium
GFGGS

SEQ ID NO: 65243 - protein, 6 aa, Mycobacterium avium
GFGGSA

SEQ ID NO: 65244 - protein, 7 aa, Mycobacterium avium
GFGPGFG

SEQ ID NO: 65245 - protein, 11 aa, Mycobacterium avium
GFGPGFGPGFG

SEQ ID NO: 65246 - protein, 6 aa, Mycobacterium avium
GFGRDR

SEQ ID NO: 65247 - protein, 6 aa, Mycobacterium avium
GFGSAE

SEQ ID NO: 65248 - protein, 5 aa, Mycobacterium avium
GFGSE

SEQ ID NO: 65249 - protein, 5 aa, Mycobacterium avium
GFGSI

SEQ ID NO: 65250 - protein, 8 aa, Mycobacterium avium
GFGSTEGG

SEQ ID NO: 65251 - protein, 9 aa, Mycobacterium avium
GFNGGRDRT

SEQ ID NO: 65252 - protein, 14 aa, Mycobacterium avium
GFNTQEAPAPQQIT

SEQ ID NO: 65253 - protein, 7 aa, Mycobacterium avium
GFPGRSG

SEQ ID NO: 65254 - protein, 5 aa, Mycobacterium avium
GFPPP

SEQ ID NO: 65255 - protein, 5 aa, Mycobacterium avium
GFPQQ

SEQ ID NO: 65256 - protein, 11 aa, Mycobacterium avium
GFQPAARRGQL

SEQ ID NO: 65257 - protein, 5 aa, Mycobacterium avium
GFRGA

SEQ ID NO: 65258 - protein, 12 aa, Mycobacterium avium
GFRGQGASHGAQ

SEQ ID NO: 65259 - protein, 25 aa, Mycobacterium avium
GFSATGIDGSAAAIERARANAHKAG

SEQ ID NO: 65260 - protein, 26 aa, Mycobacterium avium
GFSATGIDGSAAAIERARANARKAGV

SEQ ID NO: 65261 - protein, 25 aa, Mycobacterium avium
GFSATGIDGSAAAIERARANARTAG

SEQ ID NO: 65262 - protein, 9 aa, Mycobacterium avium
GFSDKPDYD

SEQ ID NO: 65263 - protein, 5 aa, Mycobacterium avium
GFSDR

SEQ ID NO: 65264 - protein, 7 aa, Mycobacterium avium
GFSEAND

SEQ ID NO: 65265 - protein, 9 aa, Mycobacterium avium
GFSGKPDYD

SEQ ID NO: 65266 - protein, 7 aa, Mycobacterium avium
GFSRGRK

SEQ ID NO: 65267 - protein, 12 aa, Mycobacterium avium
GFSTDNPVLGNP

SEQ ID NO: 65268 - protein, 7 aa, Mycobacterium avium
GFTGGYA

SEQ ID NO: 65269 - protein, 5 aa, Mycobacterium avium
GFTPR

SEQ ID NO: 65270 - protein, 6 aa, Mycobacterium avium
GFTRGR

SEQ ID NO: 65271 - protein, 10 aa, Mycobacterium avium
GGAAASAGLP

SEQ ID NO: 65272 - protein, 40 aa, Mycobacterium avium
GGAAPGVSAVSATTGLSAAEAGAGGAGSLGSAGVPATSFT

SEQ ID NO: 65273 - protein, 7 aa, Mycobacterium avium
GGAATGE

SEQ ID NO: 65274 - protein, 9 aa, Mycobacterium avium
GGADAGRER

SEQ ID NO: 65275 - protein, 6 aa, Mycobacterium avium
GGADAS

SEQ ID NO: 65276 - protein, 6 aa, Mycobacterium avium
GGAEAS

SEQ ID NO: 65277 - protein, 10 aa, Mycobacterium avium
GGAESPYETK

SEQ ID NO: 65278 - protein, 23 aa, Mycobacterium avium
GGAFRAPTQAAGPSGDAAPTERL

SEQ ID NO: 65279 - protein, 5 aa, Mycobacterium avium
GGAGA

SEQ ID NO: 65280 - protein, 12 aa, Mycobacterium avium
GGAGDEQTQRAN

SEQ ID NO: 65281 - protein, 6 aa, Mycobacterium avium
GGAGDS

SEQ ID NO: 65282 - protein, 34 aa, Mycobacterium avium
GGAGQQAPSAPSAPAAPPSGAQSPAAAPAPQAAH

SEQ ID NO: 65283 - protein, 17 aa, Mycobacterium avium
GGAGSGGPLPSGPKPLP

SEQ ID NO: 65284 - protein, 22 aa, Mycobacterium avium
GGAGSSKDKESTTLASGSAESD

SEQ ID NO: 65285 - protein, 10 aa, Mycobacterium avium
GGAGTTAAGM

SEQ ID NO: 65286 - protein, 8 aa, Mycobacterium avium
GGAHADDP

SEQ ID NO: 65287 - protein, 9 aa, Mycobacterium avium
GGAIDPPAF

SEQ ID NO: 65288 - protein, 10 aa, Mycobacterium avium
GGALGEDTRD

SEQ ID NO: 65289 - protein, 6 aa, Mycobacterium avium
GGAPDD

SEQ ID NO: 65290 - protein, 6 aa, Mycobacterium avium
GGAPGY

SEQ ID NO: 65291 - protein, 7 aa, Mycobacterium avium
GGAPRHP

SEQ ID NO: 65292 - protein, 7 aa, Mycobacterium avium
GGAPVSV

SEQ ID NO: 65293 - protein, 14 aa, Mycobacterium avium
GGAPYGADTPFGGY

SEQ ID NO: 65294 - protein, 4 aa, Mycobacterium avium
GGAQ

SEQ ID NO: 65295 - protein, 14 aa, Mycobacterium avium
GGARDGSGAGTSMA

SEQ ID NO: 65296 - protein, 7 aa, Mycobacterium avium
GGARGIG

SEQ ID NO: 65297 - protein, 6 aa, Mycobacterium avium
GGARPP

SEQ ID NO: 65298 - protein, 8 aa, Mycobacterium avium
GGASPHTV

SEQ ID NO: 65299 - protein, 7 aa, Mycobacterium avium
GGATEAA

SEQ ID NO: 65300 - protein, 5 aa, Mycobacterium avium
GGATM

SEQ ID NO: 65301 - protein, 11 aa, Mycobacterium avium
GGAVPAVQSDG

SEQ ID NO: 65302 - protein, 9 aa, Mycobacterium avium
GGAYEDDPY

SEQ ID NO: 65303 - protein, 4 aa, Mycobacterium avium
GGDA

SEQ ID NO: 65304 - protein, 7 aa, Mycobacterium avium
GGDAAEG

SEQ ID NO: 65305 - protein, 10 aa, Mycobacterium avium
GGDAQTNAAE

SEQ ID NO: 65306 - protein, 42 aa, Mycobacterium avium
GGDDGNGSSSSEIKGIDGSTRLEAKRQRRRDGRDAGRRRPPV

SEQ ID NO: 65307 - protein, 6 aa, Mycobacterium avium
GGDFDT

SEQ ID NO: 65308 - protein, 7 aa, Mycobacterium avium
GGDGDRR

SEQ ID NO: 65309 - protein, 9 aa, Mycobacterium avium
GGDHRGAAV

SEQ ID NO: 65310 - protein, 7 aa, Mycobacterium avium
GGDHRPF

SEQ ID NO: 65311 - protein, 7 aa, Mycobacterium avium
GGDIDEQ

SEQ ID NO: 65312 - protein, 7 aa, Mycobacterium avium
GGDIDGQ

SEQ ID NO: 65313 - protein, 35 aa, Mycobacterium avium
GGDLDSDVRAQPRATARDHRHARTSVRDPPNPVPD

SEQ ID NO: 65314 - protein, 9 aa, Mycobacterium avium
GGDPAGWRP

SEQ ID NO: 65315 - protein, 7 aa, Mycobacterium avium
GGDPSAP

SEQ ID NO: 65316 - protein, 11 aa, Mycobacterium avium
GGDRRSAPPEV

SEQ ID NO: 65317 - protein, 10 aa, Mycobacterium avium
GGDSKDPKAL

SEQ ID NO: 65318 - protein, 7 aa, Mycobacterium avium
GGEEIYQ

SEQ ID NO: 65319 - protein, 7 aa, Mycobacterium avium
GGEEPAT

SEQ ID NO: 65320 - protein, 8 aa, Mycobacterium avium
GGEGDRSQ

SEQ ID NO: 65321 - protein, 12 aa, Mycobacterium avium
GGEGGGHTGPVA

SEQ ID NO: 65322 - protein, 4 aa, Mycobacterium avium
GGEL

SEQ ID NO: 65323 - protein, 8 aa, Mycobacterium avium
GGELDPAE

SEQ ID NO: 65324 - protein, 9 aa, Mycobacterium avium
GGEPAHGVG

SEQ ID NO: 65325 - protein, 10 aa, Mycobacterium avium
GGEQDADYAD

SEQ ID NO: 65326 - protein, 4 aa, Mycobacterium avium
GGER

SEQ ID NO: 65327 - protein, 6 aa, Mycobacterium avium
GGERAG

SEQ ID NO: 65328 - protein, 6 aa, Mycobacterium avium
GGESDV

SEQ ID NO: 65329 - protein, 21 aa, Mycobacterium avium
GGESRRMGRDKATLPGPRGAA

SEQ ID NO: 65330 - protein, 19 aa, Mycobacterium avium
GGETSADDGYNLAGEPRGR

SEQ ID NO: 65331 - protein, 7 aa, Mycobacterium avium
GGFDEGK

SEQ ID NO: 65332 - protein, 17 aa, Mycobacterium avium
GGFEHTTGTLAPRAAVP

SEQ ID NO: 65333 - protein, 4 aa, Mycobacterium avium
GGFG

SEQ ID NO: 65334 - protein, 5 aa, Mycobacterium avium
GGFGG

SEQ ID NO: 65335 - protein, 17 aa, Mycobacterium avium
GGFNPPEPTTKGGPDYG

SEQ ID NO: 65336 - protein, 8 aa, Mycobacterium avium
GGFPPPGG

SEQ ID NO: 65337 - protein, 11 aa, Mycobacterium avium
GGFQPSQPVLP

SEQ ID NO: 65338 - protein, 6 aa, Mycobacterium avium
GGFTAA

SEQ ID NO: 65339 - protein, 10 aa, Mycobacterium avium
GGGAKDAVAN

SEQ ID NO: 65340 - protein, 7 aa, Mycobacterium avium
GGGANEL

SEQ ID NO: 65341 - protein, 8 aa, Mycobacterium avium
GGGAPITA

SEQ ID NO: 65342 - protein, 8 aa, Mycobacterium avium
GGGDDHVS

SEQ ID NO: 65343 - protein, 8 aa, Mycobacterium avium
GGGDGGRL

SEQ ID NO: 65344 - protein, 9 aa, Mycobacterium avium
GGGDGHSGF

SEQ ID NO: 65345 - protein, 9 aa, Mycobacterium avium
GGGDLSQAG

SEQ ID NO: 65346 - protein, 11 aa, Mycobacterium avium
GGGEGGHNGLR

SEQ ID NO: 65347 - protein, 58 aa, Mycobacterium avium
GGGGAFGSTGGGGAPFGGAGGAPFGGAPAGGGAALGSFGAGAAGAGCPLGAGAAGAGC

SEQ ID NO: 65348 - protein, 14 aa, Mycobacterium avium
GGGGASYTEPDGIA

SEQ ID NO: 65349 - protein, 5 aa, Mycobacterium avium
GGGGL

SEQ ID NO: 65350 - protein, 6 aa, Mycobacterium avium
GGGGPH

SEQ ID NO: 65351 - protein, 10 aa, Mycobacterium avium
GGGGQAVDDA

SEQ ID NO: 65352 - protein, 10 aa, Mycobacterium avium
GGGGRAVQDA

SEQ ID NO: 65353 - protein, 17 aa, Mycobacterium avium
GGGGRPGDTDVGGAAGL

SEQ ID NO: 65354 - protein, 18 aa, Mycobacterium avium
GGGGRQPRQPPPQRPPRS

SEQ ID NO: 65355 - protein, 11 aa, Mycobacterium avium
GGGGRVSGPQQ

SEQ ID NO: 65356 - protein, 10 aa, Mycobacterium avium
GGGHDIGETI

SEQ ID NO: 65357 - protein, 8 aa, Mycobacterium avium
GGGKSLGY

SEQ ID NO: 65358 - protein, 7 aa, Mycobacterium avium
GGGLDEA

SEQ ID NO: 65359 - protein, 18 aa, Mycobacterium avium
GGGNQPWTHPDDAPQPAT

SEQ ID NO: 65360 - protein, 6 aa, Mycobacterium avium
GGGPAD

SEQ ID NO: 65361 - protein, 15 aa, Mycobacterium avium
GGGPDVKDSGGNNWT

SEQ ID NO: 65362 - protein, 7 aa, Mycobacterium avium
GGGPPDV

SEQ ID NO: 65363 - protein, 7 aa, Mycobacterium avium
GGGPREL

SEQ ID NO: 65364 - protein, 13 aa, Mycobacterium avium
GGGPVAGSMLLSS

SEQ ID NO: 65365 - protein, 32 aa, Mycobacterium avium
GGGQHHQPDRLDAGRAEIADASGETQREPLAP

SEQ ID NO: 65366 - protein, 14 aa, Mycobacterium avium
GGGRGANPAAAERI

SEQ ID NO: 65367 - protein, 7 aa, Mycobacterium avium
GGGRGIG

SEQ ID NO: 65368 - protein, 5 aa, Mycobacterium avium
GGGRL

SEQ ID NO: 65369 - protein, 10 aa, Mycobacterium avium
GGGSGIGKGV

SEQ ID NO: 65370 - protein, 8 aa, Mycobacterium avium
GGGTAGHV

SEQ ID NO: 65371 - protein, 6 aa, Mycobacterium avium
GGGTSV

SEQ ID NO: 65372 - protein, 8 aa, Mycobacterium avium
GGGVDTRI

SEQ ID NO: 65373 - protein, 19 aa, Mycobacterium avium
GGGVNPTVVPTSAATSAQV

SEQ ID NO: 65374 - protein, 6 aa, Mycobacterium avium
GGHAAT

SEQ ID NO: 65375 - protein, 7 aa, Mycobacterium avium
GGHATAQ

SEQ ID NO: 65376 - protein, 5 aa, Mycobacterium avium
GGHDA

SEQ ID NO: 65377 - protein, 33 aa, Mycobacterium avium
GGHGHGPTTTPSTPKVTTLGRTAPNAPAGGPLT

SEQ ID NO: 65378 - protein, 17 aa, Mycobacterium avium
GGHGHGPTTTPSTPRVT

SEQ ID NO: 65379 - protein, 10 aa, Mycobacterium avium
GGHHAEARAG

SEQ ID NO: 65380 - protein, 6 aa, Mycobacterium avium
GGHNGY

SEQ ID NO: 65381 - protein, 14 aa, Mycobacterium avium
GGHPSANKSHAQTV

SEQ ID NO: 65382 - protein, 4 aa, Mycobacterium avium
GGHQ

SEQ ID NO: 65383 - protein, 11 aa, Mycobacterium avium
GGHRQAPKTPE

SEQ ID NO: 65384 - protein, 17 aa, Mycobacterium avium
GGHRRGPSGNNTNTSSV

SEQ ID NO: 65385 - protein, 22 aa, Mycobacterium avium
GGHRRSESDRHDRAAHQPSHPL

SEQ ID NO: 65386 - protein, 9 aa, Mycobacterium avium
GGHTWPGGK

SEQ ID NO: 65387 - protein, 10 aa, Mycobacterium avium
GGHTWPGGKQ

SEQ ID NO: 65388 - protein, 8 aa, Mycobacterium avium
GGIDPERL

SEQ ID NO: 65389 - protein, 6 aa, Mycobacterium avium
GGIGEK

SEQ ID NO: 65390 - protein, 7 aa, Mycobacterium avium
GGIGSPA

SEQ ID NO: 65391 - protein, 13 aa, Mycobacterium avium
GGIGTTRGLPTAG

SEQ ID NO: 65392 - protein, 18 aa, Mycobacterium avium
GGINGPTRGTGTGANTVG

SEQ ID NO: 65393 - protein, 8 aa, Mycobacterium avium
GGKALRPA

SEQ ID NO: 65394 - protein, 28 aa, Mycobacterium avium
GGKAPPRTGARHPTIAPYGPVTAGDGGT

SEQ ID NO: 65395 - protein, 6 aa, Mycobacterium avium
GGKATI

SEQ ID NO: 65396 - protein, 4 aa, Mycobacterium avium
GGKS

SEQ ID NO: 65397 - protein, 6 aa, Mycobacterium avium
GGKSGN

SEQ ID NO: 65398 - protein, 9 aa, Mycobacterium avium
GGKSPEGVD

SEQ ID NO: 65399 - protein, 7 aa, Mycobacterium avium
GGKVSEA

SEQ ID NO: 65400 - protein, 49 aa, Mycobacterium avium
GGLAGRGGGGPCRQRPARSGGRRRHDQQHDQTRRPPQLRPQDQGRRRAR

SEQ ID NO: 65401 - protein, 21 aa, Mycobacterium avium
GGLAGSGMGSGLGSGLGGGGG

SEQ ID NO: 65402 - protein, 25 aa, Mycobacterium avium
GGLDPQRGEHRPGGRVQPGPGRQQR

SEQ ID NO: 65403 - protein, 9 aa, Mycobacterium avium
GGLDSSDPK

SEQ ID NO: 65404 - protein, 5 aa, Mycobacterium avium
GGLGQ

SEQ ID NO: 65405 - protein, 14 aa, Mycobacterium avium
GGLGRGDGGGHPRV

SEQ ID NO: 65406 - protein, 14 aa, Mycobacterium avium
GGLPDQADKPETVR

SEQ ID NO: 65407 - protein, 10 aa, Mycobacterium avium
GGLPKGDALA

SEQ ID NO: 65408 - protein, 5 aa, Mycobacterium avium
GGLPY

SEQ ID NO: 65409 - protein, 10 aa, Mycobacterium avium
GGLQESPETI

SEQ ID NO: 65410 - protein, 10 aa, Mycobacterium avium
GGLRATDGGL

SEQ ID NO: 65411 - protein, 30 aa, Mycobacterium avium
GGLRGRGRRGRGDAGSAGCVGGGPPGGSAH

SEQ ID NO: 65412 - protein, 7 aa, Mycobacterium avium
GGLRGSG

SEQ ID NO: 65413 - protein, 18 aa, Mycobacterium avium
GGLRRRDGGGGGAAPPGA

SEQ ID NO: 65414 - protein, 18 aa, Mycobacterium avium
GGLRRRDGGGGRAAPPGA

SEQ ID NO: 65415 - protein, 4 aa, Mycobacterium avium
GGLT

SEQ ID NO: 65416 - protein, 12 aa, Mycobacterium avium
GGLTRRPNRGTL

SEQ ID NO: 65417 - protein, 9 aa, Mycobacterium avium
GGMATADDY

SEQ ID NO: 65418 - protein, 4 aa, Mycobacterium avium
GGMG

SEQ ID NO: 65419 - protein, 7 aa, Mycobacterium avium
GGNGARA

SEQ ID NO: 65420 - protein, 7 aa, Mycobacterium avium
GGNGSRR

SEQ ID NO: 65421 - protein, 5 aa, Mycobacterium avium
GGNKL

SEQ ID NO: 65422 - protein, 7 aa, Mycobacterium avium
GGNPLTA

SEQ ID NO: 65423 - protein, 10 aa, Mycobacterium avium
GGNTYAAEGA

SEQ ID NO: 65424 - protein, 11 aa, Mycobacterium avium
GGNTYAAEGAT

SEQ ID NO: 65425 - protein, 7 aa, Mycobacterium avium
GGPAAAK

SEQ ID NO: 65426 - protein, 21 aa, Mycobacterium avium
GGPAGPADENWTKQEAGTDRR

SEQ ID NO: 65427 - protein, 26 aa, Mycobacterium avium
GGPARRRRAPRRREQGAGRAALEWNS

SEQ ID NO: 65428 - protein, 16 aa, Mycobacterium avium
GGPASLPVSGLILGKA

SEQ ID NO: 65429 - protein, 16 aa, Mycobacterium avium
GGPASLPVSGLILGRA

SEQ ID NO: 65430 - protein, 8 aa, Mycobacterium avium
GGPATRYE

SEQ ID NO: 65431 - protein, 14 aa, Mycobacterium avium
GGPAVAKYAGRAGD

SEQ ID NO: 65432 - protein, 20 aa, Mycobacterium avium
GGPDHPDRRGHPAPAGRGAA

SEQ ID NO: 65433 - protein, 4 aa, Mycobacterium avium
GGPG

SEQ ID NO: 65434 - protein, 16 aa, Mycobacterium avium
GGPGASGVSNYSRNID

SEQ ID NO: 65435 - protein, 5 aa, Mycobacterium avium
GGPGL

SEQ ID NO: 65436 - protein, 6 aa, Mycobacterium avium
GGPGTT

SEQ ID NO: 65437 - protein, 4 aa, Mycobacterium avium
GGPH

SEQ ID NO: 65438 - protein, 12 aa, Mycobacterium avium
GGPKSAKLAGQF

SEQ ID NO: 65439 - protein, 10 aa, Mycobacterium avium
GGPKSGKSTA

SEQ ID NO: 65440 - protein, 5 aa, Mycobacterium avium
GGPLP

SEQ ID NO: 65441 - protein, 12 aa, Mycobacterium avium
GGPLSALHALKQ

SEQ ID NO: 65442 - protein, 18 aa, Mycobacterium avium
GGPPATPPRTLDEQAEAT

SEQ ID NO: 65443 - protein, 9 aa, Mycobacterium avium
GGPPGINRE

SEQ ID NO: 65444 - protein, 7 aa, Mycobacterium avium
GGPRAAS

SEQ ID NO: 65445 - protein, 9 aa, Mycobacterium avium
GGPRDSSEL

SEQ ID NO: 65446 - protein, 6 aa, Mycobacterium avium
GGPSAG

SEQ ID NO: 65447 - protein, 13 aa, Mycobacterium avium
GGPSGTGLASPDG

SEQ ID NO: 65448 - protein, 7 aa, Mycobacterium avium
GGPSTSP

SEQ ID NO: 65449 - protein, 9 aa, Mycobacterium avium
GGPVGHAGG

SEQ ID NO: 65450 - protein, 6 aa, Mycobacterium avium
GGPVPI

SEQ ID NO: 65451 - protein, 25 aa, Mycobacterium avium
GGQAPASAASRIASPATGFEPPSPR

SEQ ID NO: 65452 - protein, 10 aa, Mycobacterium avium
GGQAPASAVS

SEQ ID NO: 65453 - protein, 8 aa, Mycobacterium avium
GGQERDAA

SEQ ID NO: 65454 - protein, 7 aa, Mycobacterium avium
GGQGPVR

SEQ ID NO: 65455 - protein, 7 aa, Mycobacterium avium
GGQGRVI

SEQ ID NO: 65456 - protein, 4 aa, Mycobacterium avium
GGQL

SEQ ID NO: 65457 - protein, 8 aa, Mycobacterium avium
GGQPEAHQ

SEQ ID NO: 65458 - protein, 9 aa, Mycobacterium avium
GGQPQPGVA

SEQ ID NO: 65459 - protein, 11 aa, Mycobacterium avium
GGQRAHPGQRL

SEQ ID NO: 65460 - protein, 12 aa, Mycobacterium avium
GGQRARRAPSAG

SEQ ID NO: 65461 - protein, 12 aa, Mycobacterium avium
GGQRVPADERVG

SEQ ID NO: 65462 - protein, 6 aa, Mycobacterium avium
GGQSPK

SEQ ID NO: 65463 - protein, 9 aa, Mycobacterium avium
GGQSRNAWD

SEQ ID NO: 65464 - protein, 9 aa, Mycobacterium avium
GGQTRRSWG

SEQ ID NO: 65465 - protein, 11 aa, Mycobacterium avium
GGQVGEPGQVG

SEQ ID NO: 65466 - protein, 12 aa, Mycobacterium avium
GGRAAQHGGDVG

SEQ ID NO: 65467 - protein, 20 aa, Mycobacterium avium
GGRAGARDDDDRGQHRHHGP

SEQ ID NO: 65468 - protein, 11 aa, Mycobacterium avium
GGRANSMAADP

SEQ ID NO: 65469 - protein, 9 aa, Mycobacterium avium
GGRDDRSAE

SEQ ID NO: 65470 - protein, 5 aa, Mycobacterium avium
GGREN

SEQ ID NO: 65471 - protein, 5 aa, Mycobacterium avium
GGRGG

SEQ ID NO: 65472 - protein, 9 aa, Mycobacterium avium
GGRGPSRDK

SEQ ID NO: 65473 - protein, 18 aa, Mycobacterium avium
GGRGYETAESLAARGERA

SEQ ID NO: 65474 - protein, 18 aa, Mycobacterium avium
GGRINTDAMDNSAGVDCS

SEQ ID NO: 65475 - protein, 13 aa, Mycobacterium avium
GGRLTSSEILQPN

SEQ ID NO: 65476 - protein, 12 aa, Mycobacterium avium
GGRNSGSGNGEL

SEQ ID NO: 65477 - protein, 8 aa, Mycobacterium avium
GGRPAGLD

SEQ ID NO: 65478 - protein, 5 aa, Mycobacterium avium
GGRRR

SEQ ID NO: 65479 - protein, 6 aa, Mycobacterium avium
GGRRRF

SEQ ID NO: 65480 - protein, 9 aa, Mycobacterium avium
GGRSPEVVS

SEQ ID NO: 65481 - protein, 5 aa, Mycobacterium avium
GGRSV

SEQ ID NO: 65482 - protein, 8 aa, Mycobacterium avium
GGRTSAEL

SEQ ID NO: 65483 - protein, 8 aa, Mycobacterium avium
GGSEKNLD

SEQ ID NO: 65484 - protein, 6 aa, Mycobacterium avium
GGSGAI

SEQ ID NO: 65485 - protein, 6 aa, Mycobacterium avium
GGSGIT

SEQ ID NO: 65486 - protein, 15 aa, Mycobacterium avium
GGSGPDAASADSDAL

SEQ ID NO: 65487 - protein, 14 aa, Mycobacterium avium
GGSGPLRSDSPSKF

SEQ ID NO: 65488 - protein, 5 aa, Mycobacterium avium
GGSGR

SEQ ID NO: 65489 - protein, 7 aa, Mycobacterium avium
GGSGRTG

SEQ ID NO: 65490 - protein, 4 aa, Mycobacterium avium
GGSH

SEQ ID NO: 65491 - protein, 5 aa, Mycobacterium avium
GGSKV

SEQ ID NO: 65492 - protein, 9 aa, Mycobacterium avium
GGSLPKSIT

SEQ ID NO: 65493 - protein, 9 aa, Mycobacterium avium
GGSPDTFPG

SEQ ID NO: 65494 - protein, 9 aa, Mycobacterium avium
GGSRPASLR

SEQ ID NO: 65495 - protein, 8 aa, Mycobacterium avium
GGSTDRTL

SEQ ID NO: 65496 - protein, 7 aa, Mycobacterium avium
GGSTGGY

SEQ ID NO: 65497 - protein, 14 aa, Mycobacterium avium
GGSTQSRSLGPQKA

SEQ ID NO: 65498 - protein, 4 aa, Mycobacterium avium
GGSV

SEQ ID NO: 65499 - protein, 8 aa, Mycobacterium avium
GGSVSDGA

SEQ ID NO: 65500 - protein, 29 aa, Mycobacterium avium
GGSWSSAATGGPSVPSGSLPAYGSDLRPP

SEQ ID NO: 65501 - protein, 12 aa, Mycobacterium avium
GGTARKSRGSRS

SEQ ID NO: 65502 - protein, 5 aa, Mycobacterium avium
GGTAT

SEQ ID NO: 65503 - protein, 4 aa, Mycobacterium avium
GGTD

SEQ ID NO: 65504 - protein, 6 aa, Mycobacterium avium
GGTDNF

SEQ ID NO: 65505 - protein, 14 aa, Mycobacterium avium
GGTDTQPFGTDAQL

SEQ ID NO: 65506 - protein, 5 aa, Mycobacterium avium
GGTEI

SEQ ID NO: 65507 - protein, 7 aa, Mycobacterium avium
GGTGLEA

SEQ ID NO: 65508 - protein, 5 aa, Mycobacterium avium
GGTGQ

SEQ ID NO: 65509 - protein, 9 aa, Mycobacterium avium
GGTGTAADA

SEQ ID NO: 65510 - protein, 7 aa, Mycobacterium avium
GGTGYVS

SEQ ID NO: 65511 - protein, 4 aa, Mycobacterium avium
GGTP

SEQ ID NO: 65512 - protein, 8 aa, Mycobacterium avium
GGTPPVTA

SEQ ID NO: 65513 - protein, 4 aa, Mycobacterium avium
GGTR

SEQ ID NO: 65514 - protein, 7 aa, Mycobacterium avium
GGTREDY

SEQ ID NO: 65515 - protein, 7 aa, Mycobacterium avium
GGTREPV

SEQ ID NO: 65516 - protein, 6 aa, Mycobacterium avium
GGTRQD

SEQ ID NO: 65517 - protein, 5 aa, Mycobacterium avium
GGTRS

SEQ ID NO: 65518 - protein, 5 aa, Mycobacterium avium
GGTSF

SEQ ID NO: 65519 - protein, 9 aa, Mycobacterium avium
GGTTGTPKL

SEQ ID NO: 65520 - protein, 4 aa, Mycobacterium avium
GGVA

SEQ ID NO: 65521 - protein, 6 aa, Mycobacterium avium
GGVAGN

SEQ ID NO: 65522 - protein, 13 aa, Mycobacterium avium
GGVAVGSSQPGER

SEQ ID NO: 65523 - protein, 7 aa, Mycobacterium avium
GGVDPDG

SEQ ID NO: 65524 - protein, 5 aa, Mycobacterium avium
GGVEG

SEQ ID NO: 65525 - protein, 6 aa, Mycobacterium avium
GGVEPD

SEQ ID NO: 65526 - protein, 9 aa, Mycobacterium avium
GGVGDGRGL

SEQ ID NO: 65527 - protein, 10 aa, Mycobacterium avium
GGVGKTTTAA

SEQ ID NO: 65528 - protein, 5 aa, Mycobacterium avium
GGVNT

SEQ ID NO: 65529 - protein, 4 aa, Mycobacterium avium
GGVP

SEQ ID NO: 65530 - protein, 9 aa, Mycobacterium avium
GGVPAAPIP

SEQ ID NO: 65531 - protein, 4 aa, Mycobacterium avium
GGVT

SEQ ID NO: 65532 - protein, 4 aa, Mycobacterium avium
GGVY

SEQ ID NO: 65533 - protein, 7 aa, Mycobacterium avium
GGWGPSL

SEQ ID NO: 65534 - protein, 11 aa, Mycobacterium avium
GGYKQSGIGRE

SEQ ID NO: 65535 - protein, 6 aa, Mycobacterium avium
GGYPDA

SEQ ID NO: 65536 - protein, 4 aa, Mycobacterium avium
GGYS

SEQ ID NO: 65537 - protein, 4 aa, Mycobacterium avium
GGYT

SEQ ID NO: 65538 - protein, 4 aa, Mycobacterium avium
GGYW

SEQ ID NO: 65539 - protein, 4 aa, Mycobacterium avium
GHAD

SEQ ID NO: 65540 - protein, 5 aa, Mycobacterium avium
GHADT

SEQ ID NO: 65541 - protein, 15 aa, Mycobacterium avium
GHAGPVANARSNKAH

SEQ ID NO: 65542 - protein, 6 aa, Mycobacterium avium
GHAPGW

SEQ ID NO: 65543 - protein, 11 aa, Mycobacterium avium
GHAQKNSRTTA

SEQ ID NO: 65544 - protein, 4 aa, Mycobacterium avium
GHAS

SEQ ID NO: 65545 - protein, 6 aa, Mycobacterium avium
GHASLG

SEQ ID NO: 65546 - protein, 18 aa, Mycobacterium avium
GHDDQPPAAQQRAEDLPH

SEQ ID NO: 65547 - protein, 12 aa, Mycobacterium avium
GHDKDGNPVDSW

SEQ ID NO: 65548 - protein, 10 aa, Mycobacterium avium
GHDPAAHESR

SEQ ID NO: 65549 - protein, 6 aa, Mycobacterium avium
GHDPYP

SEQ ID NO: 65550 - protein, 9 aa, Mycobacterium avium
GHDSGLAGQ

SEQ ID NO: 65551 - protein, 6 aa, Mycobacterium avium
GHDSKQ

SEQ ID NO: 65552 - protein, 6 aa, Mycobacterium avium
GHDTKQ

SEQ ID NO: 65553 - protein, 5 aa, Mycobacterium avium
GHEGE

SEQ ID NO: 65554 - protein, 9 aa, Mycobacterium avium
GHELPPGVP

SEQ ID NO: 65555 - protein, 16 aa, Mycobacterium avium
GHEPAGHESGGTESAC

SEQ ID NO: 65556 - protein, 8 aa, Mycobacterium avium
GHEPDSAS

SEQ ID NO: 65557 - protein, 7 aa, Mycobacterium avium
GHERTSV

SEQ ID NO: 65558 - protein, 4 aa, Mycobacterium avium
GHET

SEQ ID NO: 65559 - protein, 11 aa, Mycobacterium avium
GHGAGTAGPGV

SEQ ID NO: 65560 - protein, 10 aa, Mycobacterium avium
GHGDQLQADG

SEQ ID NO: 65561 - protein, 13 aa, Mycobacterium avium
GHGDQLQADGMTA

SEQ ID NO: 65562 - protein, 11 aa, Mycobacterium avium
GHGDQYPPHPL

SEQ ID NO: 65563 - protein, 15 aa, Mycobacterium avium
GHGGDEIEAYRPEAA

SEQ ID NO: 65564 - protein, 6 aa, Mycobacterium avium
GHGGMQ

SEQ ID NO: 65565 - protein, 11 aa, Mycobacterium avium
GHGGPEDHERR

SEQ ID NO: 65566 - protein, 6 aa, Mycobacterium avium
GHGIGR

SEQ ID NO: 65567 - protein, 7 aa, Mycobacterium avium
GHGPHEA

SEQ ID NO: 65568 - protein, 19 aa, Mycobacterium avium
GHGQQATGAGRRRCGPARV

SEQ ID NO: 65569 - protein, 7 aa, Mycobacterium avium
GHGRHEE

SEQ ID NO: 65570 - protein, 9 aa, Mycobacterium avium
GHGRREELG

SEQ ID NO: 65571 - protein, 9 aa, Mycobacterium avium
GHGTDLRGP

SEQ ID NO: 65572 - protein, 12 aa, Mycobacterium avium
GHLPPEANTHAA

SEQ ID NO: 65573 - protein, 8 aa, Mycobacterium avium
GHNGGPYA

SEQ ID NO: 65574 - protein, 10 aa, Mycobacterium avium
GHPAAGRRVR

SEQ ID NO: 65575 - protein, 9 aa, Mycobacterium avium
GHPATRAAD

SEQ ID NO: 65576 - protein, 12 aa, Mycobacterium avium
GHPDPSSGTIDA

SEQ ID NO: 65577 - protein, 5 aa, Mycobacterium avium
GHPDR

SEQ ID NO: 65578 - protein, 8 aa, Mycobacterium avium
GHPDRHRP

SEQ ID NO: 65579 - protein, 7 aa, Mycobacterium avium
GHPDVTG

SEQ ID NO: 65580 - protein, 12 aa, Mycobacterium avium
GHPGGDAIDPDR

SEQ ID NO: 65581 - protein, 5 aa, Mycobacterium avium
GHPSG

SEQ ID NO: 65582 - protein, 4 aa, Mycobacterium avium
GHPV

SEQ ID NO: 65583 - protein, 6 aa, Mycobacterium avium
GHPVPG

SEQ ID NO: 65584 - protein, 21 aa, Mycobacterium avium
GHQSPGPAGAGRDAGRQLGDG

SEQ ID NO: 65585 - protein, 11 aa, Mycobacterium avium
GHRESSGRPIR

SEQ ID NO: 65586 - protein, 18 aa, Mycobacterium avium
GHRGPGDAELASQTFADD

SEQ ID NO: 65587 - protein, 18 aa, Mycobacterium avium
GHRGPGDAELASQTFGDD

SEQ ID NO: 65588 - protein, 71 aa, Mycobacterium avium
GHRPGYAEAQRRRRAARRAGADRQRADRDHRHRPAPHGGPRGADGGGGAVPGVRRRGRRRPTGHRGRSEHR

SEQ ID NO: 65589 - protein, 10 aa, Mycobacterium avium
GHRPPGDHQL

SEQ ID NO: 65590 - protein, 7 aa, Mycobacterium avium
GHRQPRR

SEQ ID NO: 65591 - protein, 12 aa, Mycobacterium avium
GHRRDAPGAGQV

SEQ ID NO: 65592 - protein, 17 aa, Mycobacterium avium
GHRSGRRRGAAEEHRGY

SEQ ID NO: 65593 - protein, 12 aa, Mycobacterium avium
GHSDDGNGCGSC

SEQ ID NO: 65594 - protein, 6 aa, Mycobacterium avium
GHSEDV

SEQ ID NO: 65595 - protein, 20 aa, Mycobacterium avium
GHSGDNANHAAQSKPGGGNA

SEQ ID NO: 65596 - protein, 12 aa, Mycobacterium avium
GHSSDDSLAAAA

SEQ ID NO: 65597 - protein, 8 aa, Mycobacterium avium
GHSTPTVT

SEQ ID NO: 65598 - protein, 9 aa, Mycobacterium avium
GHSYGGRQT

SEQ ID NO: 65599 - protein, 4 aa, Mycobacterium avium
GHTA

SEQ ID NO: 65600 - protein, 285 aa, Mycobacterium avium
GHTAADALKGLKKPPGVPKPPEVKPPAAPKAPDSGQPAPSGKPGPVAPSGKPAPGPADGPLPHSPTESKPPAGGTPPAAEPPKPTAAPHSGEPKPIATPPESVGKPVTPAPAEGAPAQPHEPVPAHAPASPGEPLATPAPAAAVPAAAAAPASAPAPAAAAAAPVPSASSVPMGGGAPAETPSGLGDVPHGGEPGAHPVEPPHDGAPHVPGGGDGPYHPGDGGPHGPGDGHPLADGSGPHQPGGHHPPGDGDRPPGSHPPHDGAPPDEPADGHPPEIPTPSDLPP

SEQ ID NO: 65601 - protein, 15 aa, Mycobacterium avium
GHTASPAGSISTPVD

SEQ ID NO: 65602 - protein, 4 aa, Mycobacterium avium
GHTD

SEQ ID NO: 65603 - protein, 5 aa, Mycobacterium avium
GHTDG

SEQ ID NO: 65604 - protein, 4 aa, Mycobacterium avium
GHTG

SEQ ID NO: 65605 - protein, 12 aa, Mycobacterium avium
GHTGGAGGVDDV

SEQ ID NO: 65606 - protein, 16 aa, Mycobacterium avium
GHTPATEKQTQAHGSG

SEQ ID NO: 65607 - protein, 11 aa, Mycobacterium avium
GHTPSSTEDQV

SEQ ID NO: 65608 - protein, 4 aa, Mycobacterium avium
GHTR

SEQ ID NO: 65609 - protein, 16 aa, Mycobacterium avium
GHTSTRSQRRDTQRSL

SEQ ID NO: 65610 - protein, 14 aa, Mycobacterium avium
GHTVGREKSPSAAL

SEQ ID NO: 65611 - protein, 7 aa, Mycobacterium avium
GHTVKSG

SEQ ID NO: 65612 - protein, 10 aa, Mycobacterium avium
GHVTGTKDKN

SEQ ID NO: 65613 - protein, 17 aa, Mycobacterium avium
GHYQAPGHTGKPESGDL

SEQ ID NO: 65614 - protein, 4 aa, Mycobacterium avium
GIAG

SEQ ID NO: 65615 - protein, 13 aa, Mycobacterium avium
GIARNGASDIGAA

SEQ ID NO: 65616 - protein, 4 aa, Mycobacterium avium
GIAS

SEQ ID NO: 65617 - protein, 10 aa, Mycobacterium avium
GIASGDPVSA

SEQ ID NO: 65618 - protein, 8 aa, Mycobacterium avium
GIASRRAA

SEQ ID NO: 65619 - protein, 9 aa, Mycobacterium avium
GIDDAGQAP

SEQ ID NO: 65620 - protein, 10 aa, Mycobacterium avium
GIDGTAPTRE

SEQ ID NO: 65621 - protein, 10 aa, Mycobacterium avium
GIDPERTADQ

SEQ ID NO: 65622 - protein, 5 aa, Mycobacterium avium
GIDRQ

SEQ ID NO: 65623 - protein, 10 aa, Mycobacterium avium
GIEPTKRQPN

SEQ ID NO: 65624 - protein, 5 aa, Mycobacterium avium
GIGAS

SEQ ID NO: 65625 - protein, 17 aa, Mycobacterium avium
GIGDAYSAGDGTYPPIQ

SEQ ID NO: 65626 - protein, 18 aa, Mycobacterium avium
GIGEGYAAGDGSYPPIQR

SEQ ID NO: 65627 - protein, 5 aa, Mycobacterium avium
GIGGH

SEQ ID NO: 65628 - protein, 6 aa, Mycobacterium avium
GIGPVQ

SEQ ID NO: 65629 - protein, 8 aa, Mycobacterium avium
GIGRENGI

SEQ ID NO: 65630 - protein, 8 aa, Mycobacterium avium
GIGRQNGI

SEQ ID NO: 65631 - protein, 9 aa, Mycobacterium avium
GIGRQNGIE

SEQ ID NO: 65632 - protein, 16 aa, Mycobacterium avium
GIGTGHSSVGDQDKAR

SEQ ID NO: 65633 - protein, 12 aa, Mycobacterium avium
GIPAPSTALDAT

SEQ ID NO: 65634 - protein, 8 aa, Mycobacterium avium
GIPDNDPV

SEQ ID NO: 65635 - protein, 9 aa, Mycobacterium avium
GIPDTVDTT

SEQ ID NO: 65636 - protein, 6 aa, Mycobacterium avium
GIPEQD

SEQ ID NO: 65637 - protein, 6 aa, Mycobacterium avium
GIPGAI

SEQ ID NO: 65638 - protein, 11 aa, Mycobacterium avium
GIPGPPIPGEV

SEQ ID NO: 65639 - protein, 13 aa, Mycobacterium avium
GIPGSAGATPIQN

SEQ ID NO: 65640 - protein, 5 aa, Mycobacterium avium
GIRPA

SEQ ID NO: 65641 - protein, 6 aa, Mycobacterium avium
GISEPM

SEQ ID NO: 65642 - protein, 5 aa, Mycobacterium avium
GISGP

SEQ ID NO: 65643 - protein, 8 aa, Mycobacterium avium
GISPPDDD

SEQ ID NO: 65644 - protein, 9 aa, Mycobacterium avium
GISPPDDDV

SEQ ID NO: 65645 - protein, 7 aa, Mycobacterium avium
GISTRDS

SEQ ID NO: 65646 - protein, 6 aa, Mycobacterium avium
GITGRD

SEQ ID NO: 65647 - protein, 13 aa, Mycobacterium avium
GITPSDDPLPAAR

SEQ ID NO: 65648 - protein, 10 aa, Mycobacterium avium
GITRPSAANA

SEQ ID NO: 65649 - protein, 6 aa, Mycobacterium avium
GITRTA

SEQ ID NO: 65650 - protein, 13 aa, Mycobacterium avium
GIVEPGGTALTRG

SEQ ID NO: 65651 - protein, 4 aa, Mycobacterium avium
GKAA

SEQ ID NO: 65652 - protein, 37 aa, Mycobacterium avium
GKAAEGAAKAPAKAAAKGDAKTAAKGDVKAPDKALDA

SEQ ID NO: 65653 - protein, 4 aa, Mycobacterium avium
GKAE

SEQ ID NO: 65654 - protein, 12 aa, Mycobacterium avium
GKAGGTIGRNTS

SEQ ID NO: 65655 - protein, 9 aa, Mycobacterium avium
GKAKEVPAA

SEQ ID NO: 65656 - protein, 11 aa, Mycobacterium avium
GKALDTAESMG

SEQ ID NO: 65657 - protein, 8 aa, Mycobacterium avium
GKATGAPI

SEQ ID NO: 65658 - protein, 4 aa, Mycobacterium avium
GKDG

SEQ ID NO: 65659 - protein, 20 aa, Mycobacterium avium
GKDIGADTGHTTPRNPCGQE

SEQ ID NO: 65660 - protein, 12 aa, Mycobacterium avium
GKDNLPKRRGNR

SEQ ID NO: 65661 - protein, 7 aa, Mycobacterium avium
GKDPRDA

SEQ ID NO: 65662 - protein, 8 aa, Mycobacterium avium
GKDSPDFK

SEQ ID NO: 65663 - protein, 9 aa, Mycobacterium avium
GKDTEPLDT

SEQ ID NO: 65664 - protein, 7 aa, Mycobacterium avium
GKEGAAM

SEQ ID NO: 65665 - protein, 11 aa, Mycobacterium avium
GKEGVEPQSEQ

SEQ ID NO: 65666 - protein, 5 aa, Mycobacterium avium
GKEQL

SEQ ID NO: 65667 - protein, 5 aa, Mycobacterium avium
GKEVS

SEQ ID NO: 65668 - protein, 19 aa, Mycobacterium avium
GKFTGSGGNLEQTVTKNNL

SEQ ID NO: 65669 - protein, 8 aa, Mycobacterium avium
GKGEGGAF

SEQ ID NO: 65670 - protein, 9 aa, Mycobacterium avium
GKGERISAQ

SEQ ID NO: 65671 - protein, 10 aa, Mycobacterium avium
GKGGKGRVSP

SEQ ID NO: 65672 - protein, 10 aa, Mycobacterium avium
GKGRHTSTQS

SEQ ID NO: 65673 - protein, 9 aa, Mycobacterium avium
GKGSDAATV

SEQ ID NO: 65674 - protein, 8 aa, Mycobacterium avium
GKGSKLTE

SEQ ID NO: 65675 - protein, 10 aa, Mycobacterium avium
GKGTQAQKLS

SEQ ID NO: 65676 - protein, 15 aa, Mycobacterium avium
GKGYPVPDPGGPEAP

SEQ ID NO: 65677 - protein, 17 aa, Mycobacterium avium
GKHAQEGDAETAPLSNP

SEQ ID NO: 65678 - protein, 4 aa, Mycobacterium avium
GKHV

SEQ ID NO: 65679 - protein, 8 aa, Mycobacterium avium
GKIRSRQV

SEQ ID NO: 65680 - protein, 9 aa, Mycobacterium avium
GKKGRVPVD

SEQ ID NO: 65681 - protein, 6 aa, Mycobacterium avium
GKLDRR

SEQ ID NO: 65682 - protein, 9 aa, Mycobacterium avium
GKLGAASTA

SEQ ID NO: 65683 - protein, 12 aa, Mycobacterium avium
GKLGADVAGQGV

SEQ ID NO: 65684 - protein, 9 aa, Mycobacterium avium
GKLGQHNGL

SEQ ID NO: 65685 - protein, 7 aa, Mycobacterium avium
GKNAGEH

SEQ ID NO: 65686 - protein, 6 aa, Mycobacterium avium
GKNALA

SEQ ID NO: 65687 - protein, 12 aa, Mycobacterium avium
GKNIPPPNEPGA

SEQ ID NO: 65688 - protein, 8 aa, Mycobacterium avium
GKNVPGSI

SEQ ID NO: 65689 - protein, 15 aa, Mycobacterium avium
GKPAEIGYEPMTDVE

SEQ ID NO: 65690 - protein, 5 aa, Mycobacterium avium
GKPDA

SEQ ID NO: 65691 - protein, 6 aa, Mycobacterium avium
GKPDDV

SEQ ID NO: 65692 - protein, 9 aa, Mycobacterium avium
GKPDGHVPA

SEQ ID NO: 65693 - protein, 26 aa, Mycobacterium avium
GKPGWPDPSDFTRGYDGGVADAHTAT

SEQ ID NO: 65694 - protein, 5 aa, Mycobacterium avium
GKPHA

SEQ ID NO: 65695 - protein, 6 aa, Mycobacterium avium
GKPHAR

SEQ ID NO: 65696 - protein, 7 aa, Mycobacterium avium
GKPLTEL

SEQ ID NO: 65697 - protein, 19 aa, Mycobacterium avium
GKPLTPLRPAPRVGEHNDS

SEQ ID NO: 65698 - protein, 9 aa, Mycobacterium avium
GKPLTPNGN

SEQ ID NO: 65699 - protein, 4 aa, Mycobacterium avium
GKPN

SEQ ID NO: 65700 - protein, 12 aa, Mycobacterium avium
GKPQHPSQSVEH

SEQ ID NO: 65701 - protein, 20 aa, Mycobacterium avium
GKPSRYRSEPQRQHLAAVPA

SEQ ID NO: 65702 - protein, 12 aa, Mycobacterium avium
GKPTAREGSEPW

SEQ ID NO: 65703 - protein, 11 aa, Mycobacterium avium
GKPVEDGALPG

SEQ ID NO: 65704 - protein, 6 aa, Mycobacterium avium
GKPVPG

SEQ ID NO: 65705 - protein, 12 aa, Mycobacterium avium
GKQTITSLPGSS

SEQ ID NO: 65706 - protein, 23 aa, Mycobacterium avium
GKRITGESGPRPDSRAPPHPNYG

SEQ ID NO: 65707 - protein, 24 aa, Mycobacterium avium
GKRITGESGPRPDSRAPPRPNYGA

SEQ ID NO: 65708 - protein, 6 aa, Mycobacterium avium
GKRPEL

SEQ ID NO: 65709 - protein, 15 aa, Mycobacterium avium
GKSAKAVMSAAASRY

SEQ ID NO: 65710 - protein, 10 aa, Mycobacterium avium
GKSDRPGRNQ

SEQ ID NO: 65711 - protein, 9 aa, Mycobacterium avium
GKSDSGFDA

SEQ ID NO: 65712 - protein, 7 aa, Mycobacterium avium
GKSGLRR

SEQ ID NO: 65713 - protein, 8 aa, Mycobacterium avium
GKSQWAED

SEQ ID NO: 65714 - protein, 9 aa, Mycobacterium avium
GKSSAYHAS

SEQ ID NO: 65715 - protein, 6 aa, Mycobacterium avium
GKSTLA

SEQ ID NO: 65716 - protein, 22 aa, Mycobacterium avium
GKTAYASDPGMTDTGITRNGSG

SEQ ID NO: 65717 - protein, 7 aa, Mycobacterium avium
GKTGEGV

SEQ ID NO: 65718 - protein, 17 aa, Mycobacterium avium
GKVDKKRLRAEIAAAAA

SEQ ID NO: 65719 - protein, 16 aa, Mycobacterium avium
GKVDKKRLRAELKAAA

SEQ ID NO: 65720 - protein, 16 aa, Mycobacterium avium
GKVDTAAGRRSKAAAR

SEQ ID NO: 65721 - protein, 7 aa, Mycobacterium avium
GKVKPSE

SEQ ID NO: 65722 - protein, 4 aa, Mycobacterium avium
GKVN

SEQ ID NO: 65723 - protein, 6 aa, Mycobacterium avium
GKVRME

SEQ ID NO: 65724 - protein, 8 aa, Mycobacterium avium
GKVTDTKP

SEQ ID NO: 65725 - protein, 13 aa, Mycobacterium avium
GKVTGKGQRADEA

SEQ ID NO: 65726 - protein, 5 aa, Mycobacterium avium
GKYPS

SEQ ID NO: 65727 - protein, 14 aa, Mycobacterium avium
GKYSSSRGPSFSSY

SEQ ID NO: 65728 - protein, 4 aa, Mycobacterium avium
GKYY

SEQ ID NO: 65729 - protein, 14 aa, Mycobacterium avium
GLAAKGGWGPGGRD

SEQ ID NO: 65730 - protein, 17 aa, Mycobacterium avium
GLADGRPLDESAEQQRR

SEQ ID NO: 65731 - protein, 5 aa, Mycobacterium avium
GLADP

SEQ ID NO: 65732 - protein, 7 aa, Mycobacterium avium
GLADQAR

SEQ ID NO: 65733 - protein, 15 aa, Mycobacterium avium
GLAETQASCGPGQVT

SEQ ID NO: 65734 - protein, 11 aa, Mycobacterium avium
GLAGGAPAPVL

SEQ ID NO: 65735 - protein, 13 aa, Mycobacterium avium
GLAPDLKPEQRGK

SEQ ID NO: 65736 - protein, 13 aa, Mycobacterium avium
GLAPDLKPEQRGQ

SEQ ID NO: 65737 - protein, 8 aa, Mycobacterium avium
GLAPGDRV

SEQ ID NO: 65738 - protein, 12 aa, Mycobacterium avium
GLAPLDDGAGHL

SEQ ID NO: 65739 - protein, 9 aa, Mycobacterium avium
GLAPQPRPA

SEQ ID NO: 65740 - protein, 18 aa, Mycobacterium avium
GLARTRAAADDAGTGKRL

SEQ ID NO: 65741 - protein, 6 aa, Mycobacterium avium
GLASDK

SEQ ID NO: 65742 - protein, 15 aa, Mycobacterium avium
GLASTGQGTLPPTDV

SEQ ID NO: 65743 - protein, 6 aa, Mycobacterium avium
GLCPTS

SEQ ID NO: 65744 - protein, 8 aa, Mycobacterium avium
GLDAPDAA

SEQ ID NO: 65745 - protein, 7 aa, Mycobacterium avium
GLDATDP

SEQ ID NO: 65746 - protein, 10 aa, Mycobacterium avium
GLDDPVAEAR

SEQ ID NO: 65747 - protein, 7 aa, Mycobacterium avium
GLDGEEA

SEQ ID NO: 65748 - protein, 8 aa, Mycobacterium avium
GLDKPSLG

SEQ ID NO: 65749 - protein, 20 aa, Mycobacterium avium
GLDPAGSAAALAEFERSCAW

SEQ ID NO: 65750 - protein, 7 aa, Mycobacterium avium
GLDPSAP

SEQ ID NO: 65751 - protein, 7 aa, Mycobacterium avium
GLDRREK

SEQ ID NO: 65752 - protein, 9 aa, Mycobacterium avium
GLDRTGDTM

SEQ ID NO: 65753 - protein, 9 aa, Mycobacterium avium
GLDTSTPDG

SEQ ID NO: 65754 - protein, 9 aa, Mycobacterium avium
GLDTSTPEG

SEQ ID NO: 65755 - protein, 5 aa, Mycobacterium avium
GLEAR

SEQ ID NO: 65756 - protein, 36 aa, Mycobacterium avium
GLEHRQDGHHRAGGPRDQHGDPLARAGAPAGQHARQ

SEQ ID NO: 65757 - protein, 42 aa, Mycobacterium avium
GLGEAGAAADGASAAARGAEAEADAAGAAGRVGGIAGARGAL

SEQ ID NO: 65758 - protein, 6 aa, Mycobacterium avium
GLGENT

SEQ ID NO: 65759 - protein, 7 aa, Mycobacterium avium
GLGENTA

SEQ ID NO: 65760 - protein, 19 aa, Mycobacterium avium
GLGGDGGVGDVDDGEVETV

SEQ ID NO: 65761 - protein, 6 aa, Mycobacterium avium
GLGGKF

SEQ ID NO: 65762 - protein, 23 aa, Mycobacterium avium
GLGGRRRARGRRRARGRRRASGH

SEQ ID NO: 65763 - protein, 4 aa, Mycobacterium avium
GLGM

SEQ ID NO: 65764 - protein, 5 aa, Mycobacterium avium
GLGNG

SEQ ID NO: 65765 - protein, 33 aa, Mycobacterium avium
GLGPAQGGVPGVPQIGSADAGGAEANAATGNIA

SEQ ID NO: 65766 - protein, 11 aa, Mycobacterium avium
GLGPGGPTNVT

SEQ ID NO: 65767 - protein, 14 aa, Mycobacterium avium
GLGPGSANIVPAGQ

SEQ ID NO: 65768 - protein, 4 aa, Mycobacterium avium
GLGR

SEQ ID NO: 65769 - protein, 44 aa, Mycobacterium avium
GLGRKSATRKAKGAKGKAKKGKKGARGPTPPEVRSPLGPGMPAG

SEQ ID NO: 65770 - protein, 5 aa, Mycobacterium avium
GLGSA

SEQ ID NO: 65771 - protein, 5 aa, Mycobacterium avium
GLGSD

SEQ ID NO: 65772 - protein, 6 aa, Mycobacterium avium
GLGTPP

SEQ ID NO: 65773 - protein, 6 aa, Mycobacterium avium
GLGTPS

SEQ ID NO: 65774 - protein, 13 aa, Mycobacterium avium
GLKGPDRDAGAYD

SEQ ID NO: 65775 - protein, 4 aa, Mycobacterium avium
GLKT

SEQ ID NO: 65776 - protein, 11 aa, Mycobacterium avium
GLNPTGSFKDR

SEQ ID NO: 65777 - protein, 8 aa, Mycobacterium avium
GLNVPPEA

SEQ ID NO: 65778 - protein, 13 aa, Mycobacterium avium
GLPAPKYGTATTF

SEQ ID NO: 65779 - protein, 19 aa, Mycobacterium avium
GLPASLQSAYQERTSPSEA

SEQ ID NO: 65780 - protein, 6 aa, Mycobacterium avium
GLPDEV

SEQ ID NO: 65781 - protein, 7 aa, Mycobacterium avium
GLPDPDP

SEQ ID NO: 65782 - protein, 6 aa, Mycobacterium avium
GLPDPV

SEQ ID NO: 65783 - protein, 7 aa, Mycobacterium avium
GLPDRDP

SEQ ID NO: 65784 - protein, 25 aa, Mycobacterium avium
GLPEDTGLRPDFPRQPVPSGEGESV

SEQ ID NO: 65785 - protein, 8 aa, Mycobacterium avium
GLPESVPG

SEQ ID NO: 65786 - protein, 13 aa, Mycobacterium avium
GLPGASGSSRPER

SEQ ID NO: 65787 - protein, 5 aa, Mycobacterium avium
GLPGL

SEQ ID NO: 65788 - protein, 9 aa, Mycobacterium avium
GLPGQRSVA

SEQ ID NO: 65789 - protein, 9 aa, Mycobacterium avium
GLPGTQPKI

SEQ ID NO: 65790 - protein, 7 aa, Mycobacterium avium
GLPIGPA

SEQ ID NO: 65791 - protein, 21 aa, Mycobacterium avium
GLPIPPPSKKEQRAQRKKGDT

SEQ ID NO: 65792 - protein, 23 aa, Mycobacterium avium
GLPKPSLSELGPDYEAKAKAAAH

SEQ ID NO: 65793 - protein, 6 aa, Mycobacterium avium
GLPKVT

SEQ ID NO: 65794 - protein, 32 aa, Mycobacterium avium
GLPPAPPPGRPRDAGPPPAGSEPFTPPVPGAI

SEQ ID NO: 65795 - protein, 7 aa, Mycobacterium avium
GLPPDIP

SEQ ID NO: 65796 - protein, 16 aa, Mycobacterium avium
GLPPIGSGLATGTGLR

SEQ ID NO: 65797 - protein, 6 aa, Mycobacterium avium
GLPPVR

SEQ ID NO: 65798 - protein, 5 aa, Mycobacterium avium
GLPQP

SEQ ID NO: 65799 - protein, 13 aa, Mycobacterium avium
GLPSGQRSLTAAS

SEQ ID NO: 65800 - protein, 13 aa, Mycobacterium avium
GLPSSQRSLTAAS

SEQ ID NO: 65801 - protein, 10 aa, Mycobacterium avium
GLPTNSKAAP

SEQ ID NO: 65802 - protein, 22 aa, Mycobacterium avium
GLQARAGVGRGDGKPEVEAAEP

SEQ ID NO: 65803 - protein, 8 aa, Mycobacterium avium
GLQPGGPV

SEQ ID NO: 65804 - protein, 8 aa, Mycobacterium avium
GLRDAQQK

SEQ ID NO: 65805 - protein, 18 aa, Mycobacterium avium
GLRGKGRLTDADIEATTR

SEQ ID NO: 65806 - protein, 33 aa, Mycobacterium avium
GLRGPARDGGDRHGQPGREVPRRAARRAGPGRL

SEQ ID NO: 65807 - protein, 4 aa, Mycobacterium avium
GLRP

SEQ ID NO: 65808 - protein, 6 aa, Mycobacterium avium
GLRSTT

SEQ ID NO: 65809 - protein, 7 aa, Mycobacterium avium
GLSEADT

SEQ ID NO: 65810 - protein, 9 aa, Mycobacterium avium
GLSEGAASE

SEQ ID NO: 65811 - protein, 8 aa, Mycobacterium avium
GLSPGDRA

SEQ ID NO: 65812 - protein, 7 aa, Mycobacterium avium
GLSPQGR

SEQ ID NO: 65813 - protein, 18 aa, Mycobacterium avium
GLSPRSPLPGDDGISPVT

SEQ ID NO: 65814 - protein, 7 aa, Mycobacterium avium
GLSTHDG

SEQ ID NO: 65815 - protein, 35 aa, Mycobacterium avium
GLSTPGSSSSTGLSQAAMGTGASLGSSGATAPLSA

SEQ ID NO: 65816 - protein, 33 aa, Mycobacterium avium
GLSTPGSTPGNGLSPTAMGTGAALGSSGPFSSL

SEQ ID NO: 65817 - protein, 11 aa, Mycobacterium avium
GLTDRERAYGA

SEQ ID NO: 65818 - protein, 4 aa, Mycobacterium avium
GLTN

SEQ ID NO: 65819 - protein, 26 aa, Mycobacterium avium
GLTNASGKGATKSASTGAGAATGLAS

SEQ ID NO: 65820 - protein, 8 aa, Mycobacterium avium
GLTPEGVR

SEQ ID NO: 65821 - protein, 6 aa, Mycobacterium avium
GLTPGG

SEQ ID NO: 65822 - protein, 24 aa, Mycobacterium avium
GLTPPVPGQDPGSQVAPAQAKPGD

SEQ ID NO: 65823 - protein, 10 aa, Mycobacterium avium
GLTPTAKEVT

SEQ ID NO: 65824 - protein, 6 aa, Mycobacterium avium
GLTRAE

SEQ ID NO: 65825 - protein, 7 aa, Mycobacterium avium
GLTRAER

SEQ ID NO: 65826 - protein, 11 aa, Mycobacterium avium
GLTTRPGPAYT

SEQ ID NO: 65827 - protein, 12 aa, Mycobacterium avium
GLTVPGAAPVLP

SEQ ID NO: 65828 - protein, 36 aa, Mycobacterium avium
GMCNPDDPAPVVDGPPGQEAIQRDSRSAAQRNHDGL

SEQ ID NO: 65829 - protein, 19 aa, Mycobacterium avium
GMDGTDAEAPGQTAPSRAE

SEQ ID NO: 65830 - protein, 4 aa, Mycobacterium avium
GMGE

SEQ ID NO: 65831 - protein, 6 aa, Mycobacterium avium
GMGEAS

SEQ ID NO: 65832 - protein, 5 aa, Mycobacterium avium
GMGGT

SEQ ID NO: 65833 - protein, 10 aa, Mycobacterium avium
GMGKEGGRQG

SEQ ID NO: 65834 - protein, 28 aa, Mycobacterium avium
GMPAGDLGGLAESGMGSGLGSGLGGGGG

SEQ ID NO: 65835 - protein, 7 aa, Mycobacterium avium
GMPANPG

SEQ ID NO: 65836 - protein, 11 aa, Mycobacterium avium
GMPARKPGTAV

SEQ ID NO: 65837 - protein, 4 aa, Mycobacterium avium
GMPP

SEQ ID NO: 65838 - protein, 4 aa, Mycobacterium avium
GMQA

SEQ ID NO: 65839 - protein, 18 aa, Mycobacterium avium
GMREDRPLKREGTPDDVA

SEQ ID NO: 65840 - protein, 8 aa, Mycobacterium avium
GMRGGFGG

SEQ ID NO: 65841 - protein, 20 aa, Mycobacterium avium
GMSEGNRLEAGGADAASYAD

SEQ ID NO: 65842 - protein, 26 aa, Mycobacterium avium
GMTPAPLSSTPAQVAAATARALAKGR

SEQ ID NO: 65843 - protein, 16 aa, Mycobacterium avium
GMTSASTNTSIPPGSR

SEQ ID NO: 65844 - protein, 5 aa, Mycobacterium avium
GNAAK

SEQ ID NO: 65845 - protein, 5 aa, Mycobacterium avium
GNAAL

SEQ ID NO: 65846 - protein, 18 aa, Mycobacterium avium
GNAGATPDSLNNKKRPRT

SEQ ID NO: 65847 - protein, 18 aa, Mycobacterium avium
GNAPSDPPDAEKIPVTPD

SEQ ID NO: 65848 - protein, 9 aa, Mycobacterium avium
GNASSENNS

SEQ ID NO: 65849 - protein, 5 aa, Mycobacterium avium
GNDAD

SEQ ID NO: 65850 - protein, 9 aa, Mycobacterium avium
GNDAPPGDV

SEQ ID NO: 65851 - protein, 16 aa, Mycobacterium avium
GNDAQLDEDPANGGRY

SEQ ID NO: 65852 - protein, 16 aa, Mycobacterium avium
GNDAQLDEDPANSGRY

SEQ ID NO: 65853 - protein, 4 aa, Mycobacterium avium
GNDD

SEQ ID NO: 65854 - protein, 10 aa, Mycobacterium avium
GNDTTRTTTT

SEQ ID NO: 65855 - protein, 7 aa, Mycobacterium avium
GNEEQRE

SEQ ID NO: 65856 - protein, 4 aa, Mycobacterium avium
GNET

SEQ ID NO: 65857 - protein, 8 aa, Mycobacterium avium
GNETSNPQ

SEQ ID NO: 65858 - protein, 4 aa, Mycobacterium avium
GNGA

SEQ ID NO: 65859 - protein, 10 aa, Mycobacterium avium
GNGDPNEPRK

SEQ ID NO: 65860 - protein, 9 aa, Mycobacterium avium
GNGHAEGAA

SEQ ID NO: 65861 - protein, 11 aa, Mycobacterium avium
GNGHAEGAAGA

SEQ ID NO: 65862 - protein, 8 aa, Mycobacterium avium
GNGPSFCS

SEQ ID NO: 65863 - protein, 10 aa, Mycobacterium avium
GNHQTPNGTY

SEQ ID NO: 65864 - protein, 15 aa, Mycobacterium avium
GNKPVTESLHPSSPE

SEQ ID NO: 65865 - protein, 33 aa, Mycobacterium avium
GNLKSDGYDPAGIRAQEGPLSPAPPLPDDPTQF

SEQ ID NO: 65866 - protein, 18 aa, Mycobacterium avium
GNPDAPLYADPQTTAQLG

SEQ ID NO: 65867 - protein, 21 aa, Mycobacterium avium
GNPDAVNREPLDDAGYDSSPM

SEQ ID NO: 65868 - protein, 4 aa, Mycobacterium avium
GNPG

SEQ ID NO: 65869 - protein, 12 aa, Mycobacterium avium
GNPQDSGKIRGQ

SEQ ID NO: 65870 - protein, 6 aa, Mycobacterium avium
GNPRPV

SEQ ID NO: 65871 - protein, 7 aa, Mycobacterium avium
GNPSARV

SEQ ID NO: 65872 - protein, 9 aa, Mycobacterium avium
GNPSGRAGR

SEQ ID NO: 65873 - protein, 5 aa, Mycobacterium avium
GNPSM

SEQ ID NO: 65874 - protein, 9 aa, Mycobacterium avium
GNPVPNRAP

SEQ ID NO: 65875 - protein, 4 aa, Mycobacterium avium
GNQP

SEQ ID NO: 65876 - protein, 18 aa, Mycobacterium avium
GNQTDGLPEGPLPLGTPV

SEQ ID NO: 65877 - protein, 9 aa, Mycobacterium avium
GNRAASPSM

SEQ ID NO: 65878 - protein, 15 aa, Mycobacterium avium
GNRAASSLSGGADTL

SEQ ID NO: 65879 - protein, 9 aa, Mycobacterium avium
GNRADAEDL

SEQ ID NO: 65880 - protein, 7 aa, Mycobacterium avium
GNRGHRG

SEQ ID NO: 65881 - protein, 7 aa, Mycobacterium avium
GNRIKAN

SEQ ID NO: 65882 - protein, 23 aa, Mycobacterium avium
GNRMHSSTKVQDAYQKVKDTAAR

SEQ ID NO: 65883 - protein, 13 aa, Mycobacterium avium
GNRSDEYAGTGAD

SEQ ID NO: 65884 - protein, 4 aa, Mycobacterium avium
GNRT

SEQ ID NO: 65885 - protein, 7 aa, Mycobacterium avium
GNSADVS

SEQ ID NO: 65886 - protein, 4 aa, Mycobacterium avium
GNSD

SEQ ID NO: 65887 - protein, 7 aa, Mycobacterium avium
GNSPAFG

SEQ ID NO: 65888 - protein, 13 aa, Mycobacterium avium
GNSPWHPTDPGYR

SEQ ID NO: 65889 - protein, 6 aa, Mycobacterium avium
GNTDVP

SEQ ID NO: 65890 - protein, 4 aa, Mycobacterium avium
GNTE

SEQ ID NO: 65891 - protein, 7 aa, Mycobacterium avium
GNTPPIF

SEQ ID NO: 65892 - protein, 5 aa, Mycobacterium avium
GNTQL

SEQ ID NO: 65893 - protein, 11 aa, Mycobacterium avium
GPAAAGAPVEA

SEQ ID NO: 65894 - protein, 21 aa, Mycobacterium avium
GPAADPDGVAAPLGVGSERPP

SEQ ID NO: 65895 - protein, 6 aa, Mycobacterium avium
GPAAGV

SEQ ID NO: 65896 - protein, 11 aa, Mycobacterium avium
GPAAPHASPDA

SEQ ID NO: 65897 - protein, 5 aa, Mycobacterium avium
GPAAS

SEQ ID NO: 65898 - protein, 5 aa, Mycobacterium avium
GPADA

SEQ ID NO: 65899 - protein, 18 aa, Mycobacterium avium
GPAETHEPNTVQHAGAGT

SEQ ID NO: 65900 - protein, 4 aa, Mycobacterium avium
GPAG

SEQ ID NO: 65901 - protein, 21 aa, Mycobacterium avium
GPAGPFGGLQPPHDRGGRHRA

SEQ ID NO: 65902 - protein, 6 aa, Mycobacterium avium
GPAGQL

SEQ ID NO: 65903 - protein, 6 aa, Mycobacterium avium
GPAIEA

SEQ ID NO: 65904 - protein, 14 aa, Mycobacterium avium
GPAKEAFGQPGGGD

SEQ ID NO: 65905 - protein, 13 aa, Mycobacterium avium
GPAKGTGEGGGSE

SEQ ID NO: 65906 - protein, 7 aa, Mycobacterium avium
GPALAAP

SEQ ID NO: 65907 - protein, 6 aa, Mycobacterium avium
GPALSR

SEQ ID NO: 65908 - protein, 11 aa, Mycobacterium avium
GPAPQEASPVG

SEQ ID NO: 65909 - protein, 9 aa, Mycobacterium avium
GPAQSVGAT

SEQ ID NO: 65910 - protein, 5 aa, Mycobacterium avium
GPARA

SEQ ID NO: 65911 - protein, 4 aa, Mycobacterium avium
GPAS

SEQ ID NO: 65912 - protein, 22 aa, Mycobacterium avium
GPASFGGSTSSSGGGFLGGGGR

SEQ ID NO: 65913 - protein, 10 aa, Mycobacterium avium
GPASQPPVPP

SEQ ID NO: 65914 - protein, 8 aa, Mycobacterium avium
GPASVSGP

SEQ ID NO: 65915 - protein, 4 aa, Mycobacterium avium
GPAV

SEQ ID NO: 65916 - protein, 35 aa, Mycobacterium avium
GPAVAGQRDRVGGARRLRGEPGGHRHRGGRPGQHR

SEQ ID NO: 65917 - protein, 12 aa, Mycobacterium avium
GPAYGRSPGDPY

SEQ ID NO: 65918 - protein, 6 aa, Mycobacterium avium
GPDEID

SEQ ID NO: 65919 - protein, 19 aa, Mycobacterium avium
GPDGDYRTRNTETVTSTAG

SEQ ID NO: 65920 - protein, 18 aa, Mycobacterium avium
GPDGDYRTRNTETVTTTA

SEQ ID NO: 65921 - protein, 14 aa, Mycobacterium avium
GPDGKLQTIGKIPN

SEQ ID NO: 65922 - protein, 24 aa, Mycobacterium avium
GPDGNYSGPALPNLGPKSVAPPVK

SEQ ID NO: 65923 - protein, 16 aa, Mycobacterium avium
GPDGTPRPPDGRETAT

SEQ ID NO: 65924 - protein, 8 aa, Mycobacterium avium
GPDGVPGA

SEQ ID NO: 65925 - protein, 6 aa, Mycobacterium avium
GPDITP

SEQ ID NO: 65926 - protein, 15 aa, Mycobacterium avium
GPDPAANYAGSYSDE

SEQ ID NO: 65927 - protein, 16 aa, Mycobacterium avium
GPDPEQRLREQRQDGV

SEQ ID NO: 65928 - protein, 8 aa, Mycobacterium avium
GPDPGPQA

SEQ ID NO: 65929 - protein, 22 aa, Mycobacterium avium
GPDQGRGVEAGEHLGPRRAGGV

SEQ ID NO: 65930 - protein, 6 aa, Mycobacterium avium
GPDRSM

SEQ ID NO: 65931 - protein, 5 aa, Mycobacterium avium
GPDSA

SEQ ID NO: 65932 - protein, 12 aa, Mycobacterium avium
GPDTPVRDGHPS

SEQ ID NO: 65933 - protein, 6 aa, Mycobacterium avium
GPEAAE

SEQ ID NO: 65934 - protein, 4 aa, Mycobacterium avium
GPED

SEQ ID NO: 65935 - protein, 5 aa, Mycobacterium avium
GPEGS

SEQ ID NO: 65936 - protein, 22 aa, Mycobacterium avium
GPEQPAGSRRSGKTEGTVRSRP

SEQ ID NO: 65937 - protein, 5 aa, Mycobacterium avium
GPERD

SEQ ID NO: 65938 - protein, 21 aa, Mycobacterium avium
GPERELDGAERTPARYYLFQR

SEQ ID NO: 65939 - protein, 5 aa, Mycobacterium avium
GPERG

SEQ ID NO: 65940 - protein, 4 aa, Mycobacterium avium
GPET

SEQ ID NO: 65941 - protein, 6 aa, Mycobacterium avium
GPETRE

SEQ ID NO: 65942 - protein, 4 aa, Mycobacterium avium
GPFG

SEQ ID NO: 65943 - protein, 7 aa, Mycobacterium avium
GPFPGQP

SEQ ID NO: 65944 - protein, 7 aa, Mycobacterium avium
GPFPTDR

SEQ ID NO: 65945 - protein, 8 aa, Mycobacterium avium
GPFSPGGG

SEQ ID NO: 65946 - protein, 14 aa, Mycobacterium avium
GPFTPDDITASRPI

SEQ ID NO: 65947 - protein, 5 aa, Mycobacterium avium
GPGDA

SEQ ID NO: 65948 - protein, 19 aa, Mycobacterium avium
GPGDDQRLRADRDHHVGVA

SEQ ID NO: 65949 - protein, 6 aa, Mycobacterium avium
GPGDPR

SEQ ID NO: 65950 - protein, 4 aa, Mycobacterium avium
GPGE

SEQ ID NO: 65951 - protein, 6 aa, Mycobacterium avium
GPGEAV

SEQ ID NO: 65952 - protein, 9 aa, Mycobacterium avium
GPGERGSNG

SEQ ID NO: 65953 - protein, 8 aa, Mycobacterium avium
GPGFGHES

SEQ ID NO: 65954 - protein, 4 aa, Mycobacterium avium
GPGG

SEQ ID NO: 65955 - protein, 5 aa, Mycobacterium avium
GPGGL

SEQ ID NO: 65956 - protein, 9 aa, Mycobacterium avium
GPGGTSFDT

SEQ ID NO: 65957 - protein, 8 aa, Mycobacterium avium
GPGHDDPL

SEQ ID NO: 65958 - protein, 10 aa, Mycobacterium avium
GPGMRADDGR

SEQ ID NO: 65959 - protein, 7 aa, Mycobacterium avium
GPGPLAA

SEQ ID NO: 65960 - protein, 13 aa, Mycobacterium avium
GPGQHWDRVGLRV

SEQ ID NO: 65961 - protein, 44 aa, Mycobacterium avium
GPGQQQQNQHRRGRDVADGPHPRAEPVRPAAHRDPAERAEQLGQ

SEQ ID NO: 65962 - protein, 29 aa, Mycobacterium avium
GPGQRRYQRTLGEGSTLSSSSHGRGGRGY

SEQ ID NO: 65963 - protein, 6 aa, Mycobacterium avium
GPGREQ

SEQ ID NO: 65964 - protein, 11 aa, Mycobacterium avium
GPGRPGDEYYD

SEQ ID NO: 65965 - protein, 6 aa, Mycobacterium avium
GPGRTG

SEQ ID NO: 65966 - protein, 12 aa, Mycobacterium avium
GPGVPDPGFSGA

SEQ ID NO: 65967 - protein, 5 aa, Mycobacterium avium
GPHEI

SEQ ID NO: 65968 - protein, 8 aa, Mycobacterium avium
GPHGRATL

SEQ ID NO: 65969 - protein, 5 aa, Mycobacterium avium
GPHGT

SEQ ID NO: 65970 - protein, 4 aa, Mycobacterium avium
GPHL

SEQ ID NO: 65971 - protein, 5 aa, Mycobacterium avium
GPHPL

SEQ ID NO: 65972 - protein, 4 aa, Mycobacterium avium
GPIG

SEQ ID NO: 65973 - protein, 5 aa, Mycobacterium avium
GPIGT

SEQ ID NO: 65974 - protein, 7 aa, Mycobacterium avium
GPIHPRQ

SEQ ID NO: 65975 - protein, 4 aa, Mycobacterium avium
GPIP

SEQ ID NO: 65976 - protein, 17 aa, Mycobacterium avium
GPKDGDRDDECAARGGE

SEQ ID NO: 65977 - protein, 8 aa, Mycobacterium avium
GPKPIRKP

SEQ ID NO: 65978 - protein, 9 aa, Mycobacterium avium
GPKPISTPH

SEQ ID NO: 65979 - protein, 8 aa, Mycobacterium avium
GPKTAKKL

SEQ ID NO: 65980 - protein, 5 aa, Mycobacterium avium
GPLDR

SEQ ID NO: 65981 - protein, 7 aa, Mycobacterium avium
GPLDTDA

SEQ ID NO: 65982 - protein, 4 aa, Mycobacterium avium
GPLG

SEQ ID NO: 65983 - protein, 5 aa, Mycobacterium avium
GPLGG

SEQ ID NO: 65984 - protein, 8 aa, Mycobacterium avium
GPLPMPPS

SEQ ID NO: 65985 - protein, 18 aa, Mycobacterium avium
GPLPPSVPYDSSTPEDLA

SEQ ID NO: 65986 - protein, 9 aa, Mycobacterium avium
GPLPRNAGG

SEQ ID NO: 65987 - protein, 10 aa, Mycobacterium avium
GPLPTHPDED

SEQ ID NO: 65988 - protein, 5 aa, Mycobacterium avium
GPLTD

SEQ ID NO: 65989 - protein, 4 aa, Mycobacterium avium
GPMF

SEQ ID NO: 65990 - protein, 9 aa, Mycobacterium avium
GPNAGAFED

SEQ ID NO: 65991 - protein, 5 aa, Mycobacterium avium
GPNKD

SEQ ID NO: 65992 - protein, 7 aa, Mycobacterium avium
GPNPTGI

SEQ ID NO: 65993 - protein, 9 aa, Mycobacterium avium
GPNRPGPKG

SEQ ID NO: 65994 - protein, 7 aa, Mycobacterium avium
GPPAGAF

SEQ ID NO: 65995 - protein, 8 aa, Mycobacterium avium
GPPETPDR

SEQ ID NO: 65996 - protein, 16 aa, Mycobacterium avium
GPPGAADAGIGEDDSL

SEQ ID NO: 65997 - protein, 11 aa, Mycobacterium avium
GPPGQDGQTTI

SEQ ID NO: 65998 - protein, 8 aa, Mycobacterium avium
GPPGSGRS

SEQ ID NO: 65999 - protein, 12 aa, Mycobacterium avium
GPPGTGKTSVAR

SEQ ID NO: 66000 - protein, 9 aa, Mycobacterium avium
GPPGVGKTA

SEQ ID NO: 66001 - protein, 14 aa, Mycobacterium avium
GPPHVGGQLGGPAL

SEQ ID NO: 66002 - protein, 7 aa, Mycobacterium avium
GPPIHDD

SEQ ID NO: 66003 - protein, 7 aa, Mycobacterium avium
GPPKGVE

SEQ ID NO: 66004 - protein, 9 aa, Mycobacterium avium
GPPKTRAGI

SEQ ID NO: 66005 - protein, 5 aa, Mycobacterium avium
GPPPA

SEQ ID NO: 66006 - protein, 17 aa, Mycobacterium avium
GPPPGRPAGPAADSAVP

SEQ ID NO: 66007 - protein, 16 aa, Mycobacterium avium
GPPPGRPAGPSTDSAV

SEQ ID NO: 66008 - protein, 30 aa, Mycobacterium avium
GPPPPPDAPPPPPDAPAPPPDAPPAPPEAP

SEQ ID NO: 66009 - protein, 16 aa, Mycobacterium avium
GPPSGRPAGPAADSAV

SEQ ID NO: 66010 - protein, 6 aa, Mycobacterium avium
GPPTGQ

SEQ ID NO: 66011 - protein, 5 aa, Mycobacterium avium
GPQRR

SEQ ID NO: 66012 - protein, 9 aa, Mycobacterium avium
GPRADRARR

SEQ ID NO: 66013 - protein, 4 aa, Mycobacterium avium
GPRG

SEQ ID NO: 66014 - protein, 11 aa, Mycobacterium avium
GPRQPNGQRDV

SEQ ID NO: 66015 - protein, 11 aa, Mycobacterium avium
GPRRGAGSGGA

SEQ ID NO: 66016 - protein, 13 aa, Mycobacterium avium
GPRRLSRSKPMKT

SEQ ID NO: 66017 - protein, 11 aa, Mycobacterium avium
GPRRRAGSGGA

SEQ ID NO: 66018 - protein, 5 aa, Mycobacterium avium
GPRRT

SEQ ID NO: 66019 - protein, 5 aa, Mycobacterium avium
GPRSA

SEQ ID NO: 66020 - protein, 5 aa, Mycobacterium avium
GPRSR

SEQ ID NO: 66021 - protein, 14 aa, Mycobacterium avium
GPSAAAGGDQDVDL

SEQ ID NO: 66022 - protein, 8 aa, Mycobacterium avium
GPSAAKMS

SEQ ID NO: 66023 - protein, 7 aa, Mycobacterium avium
GPSAARN

SEQ ID NO: 66024 - protein, 14 aa, Mycobacterium avium
GPSAATGGDQDVDL

SEQ ID NO: 66025 - protein, 14 aa, Mycobacterium avium
GPSAATNGNQDVDL

SEQ ID NO: 66026 - protein, 11 aa, Mycobacterium avium
GPSAGTPQGPW

SEQ ID NO: 66027 - protein, 12 aa, Mycobacterium avium
GPSAVAGGSYDA

SEQ ID NO: 66028 - protein, 7 aa, Mycobacterium avium
GPSDAVA

SEQ ID NO: 66029 - protein, 5 aa, Mycobacterium avium
GPSDM

SEQ ID NO: 66030 - protein, 22 aa, Mycobacterium avium
GPSDQAWTTTIDGDGNMSASDT

SEQ ID NO: 66031 - protein, 5 aa, Mycobacterium avium
GPSPI

SEQ ID NO: 66032 - protein, 5 aa, Mycobacterium avium
GPSPL

SEQ ID NO: 66033 - protein, 15 aa, Mycobacterium avium
GPTAGTGTPTGDYGI

SEQ ID NO: 66034 - protein, 7 aa, Mycobacterium avium
GPTEPPL

SEQ ID NO: 66035 - protein, 9 aa, Mycobacterium avium
GPTEPTPRR

SEQ ID NO: 66036 - protein, 17 aa, Mycobacterium avium
GPTEREYTTSVGGGPIV

SEQ ID NO: 66037 - protein, 8 aa, Mycobacterium avium
GPTGCGKT

SEQ ID NO: 66038 - protein, 9 aa, Mycobacterium avium
GPTGTGKSQ

SEQ ID NO: 66039 - protein, 9 aa, Mycobacterium avium
GPTREEAEA

SEQ ID NO: 66040 - protein, 5 aa, Mycobacterium avium
GPTSI

SEQ ID NO: 66041 - protein, 6 aa, Mycobacterium avium
GPTTVT

SEQ ID NO: 66042 - protein, 11 aa, Mycobacterium avium
GPVEPAPGNVT

SEQ ID NO: 66043 - protein, 8 aa, Mycobacterium avium
GPVEPVPG

SEQ ID NO: 66044 - protein, 5 aa, Mycobacterium avium
GPVPL

SEQ ID NO: 66045 - protein, 6 aa, Mycobacterium avium
GPVQTG

SEQ ID NO: 66046 - protein, 11 aa, Mycobacterium avium
GPVRGAEGRRW

SEQ ID NO: 66047 - protein, 7 aa, Mycobacterium avium
GPYPADA

SEQ ID NO: 66048 - protein, 8 aa, Mycobacterium avium
GQAAPAHL

SEQ ID NO: 66049 - protein, 10 aa, Mycobacterium avium
GQAENQVDGA

SEQ ID NO: 66050 - protein, 10 aa, Mycobacterium avium
GQAGAPPTLP

SEQ ID NO: 66051 - protein, 9 aa, Mycobacterium avium
GQAGGDPWE

SEQ ID NO: 66052 - protein, 9 aa, Mycobacterium avium
GQAGTPPTL

SEQ ID NO: 66053 - protein, 5 aa, Mycobacterium avium
GQAHG

SEQ ID NO: 66054 - protein, 7 aa, Mycobacterium avium
GQAPART

SEQ ID NO: 66055 - protein, 7 aa, Mycobacterium avium
GQAPESL

SEQ ID NO: 66056 - protein, 16 aa, Mycobacterium avium
GQAPPGAGGAGGGFGG

SEQ ID NO: 66057 - protein, 24 aa, Mycobacterium avium
GQAPPGAGGTGGGFGGLSAPGGLG

SEQ ID NO: 66058 - protein, 7 aa, Mycobacterium avium
GQAPYTP

SEQ ID NO: 66059 - protein, 7 aa, Mycobacterium avium
GQATPPP

SEQ ID NO: 66060 - protein, 16 aa, Mycobacterium avium
GQCDGGQSAVTDRDHH

SEQ ID NO: 66061 - protein, 10 aa, Mycobacterium avium
GQDADPGAGL

SEQ ID NO: 66062 - protein, 8 aa, Mycobacterium avium
GQDAERGV

SEQ ID NO: 66063 - protein, 19 aa, Mycobacterium avium
GQDELNERTLRRSEGAMGP

SEQ ID NO: 66064 - protein, 6 aa, Mycobacterium avium
GQDGPC

SEQ ID NO: 66065 - protein, 8 aa, Mycobacterium avium
GQDGSYTE

SEQ ID NO: 66066 - protein, 9 aa, Mycobacterium avium
GQDGSYTED

SEQ ID NO: 66067 - protein, 8 aa, Mycobacterium avium
GQDGSYTK

SEQ ID NO: 66068 - protein, 5 aa, Mycobacterium avium
GQEHP

SEQ ID NO: 66069 - protein, 20 aa, Mycobacterium avium
GQFTSPDGKTIPIKDSENDT

SEQ ID NO: 66070 - protein, 9 aa, Mycobacterium avium
GQGADEVEN

SEQ ID NO: 66071 - protein, 5 aa, Mycobacterium avium
GQGAG

SEQ ID NO: 66072 - protein, 9 aa, Mycobacterium avium
GQGAGPGQR

SEQ ID NO: 66073 - protein, 15 aa, Mycobacterium avium
GQGGVAVGSSQPGER

SEQ ID NO: 66074 - protein, 5 aa, Mycobacterium avium
GQGIE

SEQ ID NO: 66075 - protein, 48 aa, Mycobacterium avium
GQGKSSTGPGVGGGMPSEPHSSGSDQALSNGSPGVGAAGFPGRPHTDA

SEQ ID NO: 66076 - protein, 48 aa, Mycobacterium avium
GQGMVGGAGNANVPKDAADAAAADADRKARAADAAAKFPANEANGSQE

SEQ ID NO: 66077 - protein, 11 aa, Mycobacterium avium
GQGQPNWSPSE

SEQ ID NO: 66078 - protein, 8 aa, Mycobacterium avium
GQHTNDRE

SEQ ID NO: 66079 - protein, 6 aa, Mycobacterium avium
GQHVPK

SEQ ID NO: 66080 - protein, 7 aa, Mycobacterium avium
GQIPDEM

SEQ ID NO: 66081 - protein, 7 aa, Mycobacterium avium
GQITKQG

SEQ ID NO: 66082 - protein, 8 aa, Mycobacterium avium
GQKTVATS

SEQ ID NO: 66083 - protein, 16 aa, Mycobacterium avium
GQLSSPEGLGDAVGRS

SEQ ID NO: 66084 - protein, 6 aa, Mycobacterium avium
GQLTGT

SEQ ID NO: 66085 - protein, 12 aa, Mycobacterium avium
GQLTRAQAGGKA

SEQ ID NO: 66086 - protein, 6 aa, Mycobacterium avium
GQMGSG

SEQ ID NO: 66087 - protein, 6 aa, Mycobacterium avium
GQMSDA

SEQ ID NO: 66088 - protein, 4 aa, Mycobacterium avium
GQNS

SEQ ID NO: 66089 - protein, 12 aa, Mycobacterium avium
GQPAADDFGSPE

SEQ ID NO: 66090 - protein, 5 aa, Mycobacterium avium
GQPAF

SEQ ID NO: 66091 - protein, 7 aa, Mycobacterium avium
GQPDDLR

SEQ ID NO: 66092 - protein, 27 aa, Mycobacterium avium
GQPDYRSNRPAPPQRGVSAGSKSGGVP

SEQ ID NO: 66093 - protein, 4 aa, Mycobacterium avium
GQPE

SEQ ID NO: 66094 - protein, 6 aa, Mycobacterium avium
GQPFDP

SEQ ID NO: 66095 - protein, 6 aa, Mycobacterium avium
GQPGAA

SEQ ID NO: 66096 - protein, 7 aa, Mycobacterium avium
GQPGDGR

SEQ ID NO: 66097 - protein, 18 aa, Mycobacterium avium
GQPGEEGPVGAGGGQPLP

SEQ ID NO: 66098 - protein, 11 aa, Mycobacterium avium
GQPHTAVRRGG

SEQ ID NO: 66099 - protein, 6 aa, Mycobacterium avium
GQPLTP

SEQ ID NO: 66100 - protein, 10 aa, Mycobacterium avium
GQPPLNSRGP

SEQ ID NO: 66101 - protein, 7 aa, Mycobacterium avium
GQPPLVS

SEQ ID NO: 66102 - protein, 35 aa, Mycobacterium avium
GQPQADPSGRGATPLNTEGQNIPLDPSPDYDASDE

SEQ ID NO: 66103 - protein, 7 aa, Mycobacterium avium
GQPRVEP

SEQ ID NO: 66104 - protein, 17 aa, Mycobacterium avium
GQPTAESTRECGADGDL

SEQ ID NO: 66105 - protein, 9 aa, Mycobacterium avium
GQPVSLSPT

SEQ ID NO: 66106 - protein, 5 aa, Mycobacterium avium
GQQEG

SEQ ID NO: 66107 - protein, 12 aa, Mycobacterium avium
GQQRARRSVAAG

SEQ ID NO: 66108 - protein, 4 aa, Mycobacterium avium
GQQW

SEQ ID NO: 66109 - protein, 15 aa, Mycobacterium avium
GQREGQRGVAGTGAQ

SEQ ID NO: 66110 - protein, 11 aa, Mycobacterium avium
GQREPDGASFC

SEQ ID NO: 66111 - protein, 7 aa, Mycobacterium avium
GQRFAPG

SEQ ID NO: 66112 - protein, 11 aa, Mycobacterium avium
GQRGAAAEQIE

SEQ ID NO: 66113 - protein, 9 aa, Mycobacterium avium
GQRGRPERH

SEQ ID NO: 66114 - protein, 4 aa, Mycobacterium avium
GQRI

SEQ ID NO: 66115 - protein, 24 aa, Mycobacterium avium
GQRQDAVAAQPGQVGGVQAPGHGA

SEQ ID NO: 66116 - protein, 5 aa, Mycobacterium avium
GQRQR

SEQ ID NO: 66117 - protein, 10 aa, Mycobacterium avium
GQRQRGVRQG

SEQ ID NO: 66118 - protein, 7 aa, Mycobacterium avium
GQRRYNP

SEQ ID NO: 66119 - protein, 9 aa, Mycobacterium avium
GQSAYGAAK

SEQ ID NO: 66120 - protein, 10 aa, Mycobacterium avium
GQSAYGAAKA

SEQ ID NO: 66121 - protein, 10 aa, Mycobacterium avium
GQSNYGAAKA

SEQ ID NO: 66122 - protein, 16 aa, Mycobacterium avium
GQSRSPGHRAASTPLE

SEQ ID NO: 66123 - protein, 6 aa, Mycobacterium avium
GQSVGQ

SEQ ID NO: 66124 - protein, 6 aa, Mycobacterium avium
GQTDDA

SEQ ID NO: 66125 - protein, 16 aa, Mycobacterium avium
GQTEGSPITSLGPADH

SEQ ID NO: 66126 - protein, 6 aa, Mycobacterium avium
GQTELG

SEQ ID NO: 66127 - protein, 9 aa, Mycobacterium avium
GQTPNPGQR

SEQ ID NO: 66128 - protein, 4 aa, Mycobacterium avium
GQTV

SEQ ID NO: 66129 - protein, 13 aa, Mycobacterium avium
GRAADNRGPATGN

SEQ ID NO: 66130 - protein, 11 aa, Mycobacterium avium
GRAADPEATAQ

SEQ ID NO: 66131 - protein, 9 aa, Mycobacterium avium
GRAAPAPDD

SEQ ID NO: 66132 - protein, 14 aa, Mycobacterium avium
GRAAPGTGNRDTYP

SEQ ID NO: 66133 - protein, 9 aa, Mycobacterium avium
GRAAQDDKY

SEQ ID NO: 66134 - protein, 8 aa, Mycobacterium avium
GRAATELT

SEQ ID NO: 66135 - protein, 7 aa, Mycobacterium avium
GRADVSG

SEQ ID NO: 66136 - protein, 9 aa, Mycobacterium avium
GRAFSAGGD

SEQ ID NO: 66137 - protein, 13 aa, Mycobacterium avium
GRAGARQLSDPHT

SEQ ID NO: 66138 - protein, 9 aa, Mycobacterium avium
GRAGEPQWV

SEQ ID NO: 66139 - protein, 8 aa, Mycobacterium avium
GRAGETAA

SEQ ID NO: 66140 - protein, 6 aa, Mycobacterium avium
GRAGLT

SEQ ID NO: 66141 - protein, 8 aa, Mycobacterium avium
GRAPRPGH

SEQ ID NO: 66142 - protein, 12 aa, Mycobacterium avium
GRAPVPSRATAV

SEQ ID NO: 66143 - protein, 7 aa, Mycobacterium avium
GRAQTTV

SEQ ID NO: 66144 - protein, 5 aa, Mycobacterium avium
GRARR

SEQ ID NO: 66145 - protein, 34 aa, Mycobacterium avium
GRATGNTGMRAEGRAGQVKGNAKQAGDKLNDAFK

SEQ ID NO: 66146 - protein, 11 aa, Mycobacterium avium
GRCEACTGDGT

SEQ ID NO: 66147 - protein, 9 aa, Mycobacterium avium
GRCGAPSCR

SEQ ID NO: 66148 - protein, 7 aa, Mycobacterium avium
GRDDPAL

SEQ ID NO: 66149 - protein, 11 aa, Mycobacterium avium
GRDESAYPNAR

SEQ ID NO: 66150 - protein, 38 aa, Mycobacterium avium
GRDGDDAGGGGGPSHTSGDDAGRGAAGGGGGPSHRGRG

SEQ ID NO: 66151 - protein, 13 aa, Mycobacterium avium
GRDLTGKGAAEKL

SEQ ID NO: 66152 - protein, 6 aa, Mycobacterium avium
GRDPDW

SEQ ID NO: 66153 - protein, 6 aa, Mycobacterium avium
GRDPEL

SEQ ID NO: 66154 - protein, 20 aa, Mycobacterium avium
GRDPKDAPTVHTDGTVGRTG

SEQ ID NO: 66155 - protein, 9 aa, Mycobacterium avium
GRDPQAVQE

SEQ ID NO: 66156 - protein, 9 aa, Mycobacterium avium
GRDRAGARA

SEQ ID NO: 66157 - protein, 5 aa, Mycobacterium avium
GRDSK

SEQ ID NO: 66158 - protein, 4 aa, Mycobacterium avium
GRDT

SEQ ID NO: 66159 - protein, 6 aa, Mycobacterium avium
GRDYPD

SEQ ID NO: 66160 - protein, 11 aa, Mycobacterium avium
GREADTLGGQI

SEQ ID NO: 66161 - protein, 14 aa, Mycobacterium avium
GREAGAEQRRGGLG

SEQ ID NO: 66162 - protein, 30 aa, Mycobacterium avium
GREALGGKPFGDGTPPGPPVEAERVPAGHG

SEQ ID NO: 66163 - protein, 28 aa, Mycobacterium avium
GREALGGRPFGDGTPPATAPNAGPCRRT

SEQ ID NO: 66164 - protein, 6 aa, Mycobacterium avium
GREGDG

SEQ ID NO: 66165 - protein, 10 aa, Mycobacterium avium
GREGGSAPTA

SEQ ID NO: 66166 - protein, 11 aa, Mycobacterium avium
GREPSSAADWE

SEQ ID NO: 66167 - protein, 9 aa, Mycobacterium avium
GRERASDDL

SEQ ID NO: 66168 - protein, 7 aa, Mycobacterium avium
GRESGLD

SEQ ID NO: 66169 - protein, 6 aa, Mycobacterium avium
GREVTP

SEQ ID NO: 66170 - protein, 12 aa, Mycobacterium avium
GRFPADEPLNEL

SEQ ID NO: 66171 - protein, 9 aa, Mycobacterium avium
GRGAGGVGQ

SEQ ID NO: 66172 - protein, 14 aa, Mycobacterium avium
GRGDEGYTLSDNEI

SEQ ID NO: 66173 - protein, 6 aa, Mycobacterium avium
GRGDNM

SEQ ID NO: 66174 - protein, 7 aa, Mycobacterium avium
GRGDQLA

SEQ ID NO: 66175 - protein, 8 aa, Mycobacterium avium
GRGEPADA

SEQ ID NO: 66176 - protein, 22 aa, Mycobacterium avium
GRGHAGQQDRRAARQAGELGRQ

SEQ ID NO: 66177 - protein, 17 aa, Mycobacterium avium
GRGIDTPPGARNPEDRI

SEQ ID NO: 66178 - protein, 17 aa, Mycobacterium avium
GRGIETPPAARNPEDRI

SEQ ID NO: 66179 - protein, 4 aa, Mycobacterium avium
GRGP

SEQ ID NO: 66180 - protein, 27 aa, Mycobacterium avium
GRGPAQQAGVADRDALGDTGGTRREDQ

SEQ ID NO: 66181 - protein, 9 aa, Mycobacterium avium
GRGPNAPQV

SEQ ID NO: 66182 - protein, 10 aa, Mycobacterium avium
GRGPNSPQVP

SEQ ID NO: 66183 - protein, 14 aa, Mycobacterium avium
GRGPVPDDRTAADI

SEQ ID NO: 66184 - protein, 18 aa, Mycobacterium avium
GRGQPQRGPGGARAISGA

SEQ ID NO: 66185 - protein, 7 aa, Mycobacterium avium
GRGQWGP

SEQ ID NO: 66186 - protein, 4 aa, Mycobacterium avium
GRGR

SEQ ID NO: 66187 - protein, 10 aa, Mycobacterium avium
GRGRPADRPA

SEQ ID NO: 66188 - protein, 16 aa, Mycobacterium avium
GRGSPQGLAASKALTT

SEQ ID NO: 66189 - protein, 11 aa, Mycobacterium avium
GRHDRANGTDY

SEQ ID NO: 66190 - protein, 7 aa, Mycobacterium avium
GRHGEGG

SEQ ID NO: 66191 - protein, 37 aa, Mycobacterium avium
GRHPAQPAVQHEQRRPGHRRADRHRGAARTQRRGHRR

SEQ ID NO: 66192 - protein, 6 aa, Mycobacterium avium
GRHRGG

SEQ ID NO: 66193 - protein, 11 aa, Mycobacterium avium
GRIADTGTQFD

SEQ ID NO: 66194 - protein, 7 aa, Mycobacterium avium
GRIDDDG

SEQ ID NO: 66195 - protein, 11 aa, Mycobacterium avium
GRIDGADATEV

SEQ ID NO: 66196 - protein, 14 aa, Mycobacterium avium
GRIEPDTTVPEPTA

SEQ ID NO: 66197 - protein, 9 aa, Mycobacterium avium
GRIGQPREV

SEQ ID NO: 66198 - protein, 7 aa, Mycobacterium avium
GRIPERE

SEQ ID NO: 66199 - protein, 10 aa, Mycobacterium avium
GRIQPGRDDK

SEQ ID NO: 66200 - protein, 5 aa, Mycobacterium avium
GRKAE

SEQ ID NO: 66201 - protein, 9 aa, Mycobacterium avium
GRKPQTRQV

SEQ ID NO: 66202 - protein, 14 aa, Mycobacterium avium
GRKRPPNARRDDGT

SEQ ID NO: 66203 - protein, 13 aa, Mycobacterium avium
GRKVEEGVRANLN

SEQ ID NO: 66204 - protein, 12 aa, Mycobacterium avium
GRLASNEILQPN

SEQ ID NO: 66205 - protein, 12 aa, Mycobacterium avium
GRLASSEILQPN

SEQ ID NO: 66206 - protein, 12 aa, Mycobacterium avium
GRLDGHTAAPAD

SEQ ID NO: 66207 - protein, 11 aa, Mycobacterium avium
GRLENGPHPEI

SEQ ID NO: 66208 - protein, 11 aa, Mycobacterium avium
GRLPVNPDGGL

SEQ ID NO: 66209 - protein, 8 aa, Mycobacterium avium
GRMDPSVT

SEQ ID NO: 66210 - protein, 20 aa, Mycobacterium avium
GRNAEIPYGEAQSINARTRS

SEQ ID NO: 66211 - protein, 9 aa, Mycobacterium avium
GRNGDGKSS

SEQ ID NO: 66212 - protein, 9 aa, Mycobacterium avium
GRNKVDEDD

SEQ ID NO: 66213 - protein, 5 aa, Mycobacterium avium
GRNLP

SEQ ID NO: 66214 - protein, 4 aa, Mycobacterium avium
GRNP

SEQ ID NO: 66215 - protein, 7 aa, Mycobacterium avium
GRNPTGV

SEQ ID NO: 66216 - protein, 9 aa, Mycobacterium avium
GRNQRRSAA

SEQ ID NO: 66217 - protein, 4 aa, Mycobacterium avium
GRPA

SEQ ID NO: 66218 - protein, 6 aa, Mycobacterium avium
GRPAAG

SEQ ID NO: 66219 - protein, 8 aa, Mycobacterium avium
GRPAAREA

SEQ ID NO: 66220 - protein, 9 aa, Mycobacterium avium
GRPADHRQN

SEQ ID NO: 66221 - protein, 10 aa, Mycobacterium avium
GRPAGRNLAP

SEQ ID NO: 66222 - protein, 8 aa, Mycobacterium avium
GRPAPGQT

SEQ ID NO: 66223 - protein, 6 aa, Mycobacterium avium
GRPATG

SEQ ID NO: 66224 - protein, 18 aa, Mycobacterium avium
GRPDVNDLGTSYGEAHLD

SEQ ID NO: 66225 - protein, 6 aa, Mycobacterium avium
GRPEEV

SEQ ID NO: 66226 - protein, 13 aa, Mycobacterium avium
GRPEGCIEVGPVV

SEQ ID NO: 66227 - protein, 11 aa, Mycobacterium avium
GRPGAAPQPVV

SEQ ID NO: 66228 - protein, 26 aa, Mycobacterium avium
GRPGGTGRRRPCRGDQTATATPAGSG

SEQ ID NO: 66229 - protein, 5 aa, Mycobacterium avium
GRPGL

SEQ ID NO: 66230 - protein, 6 aa, Mycobacterium avium
GRPGLS

SEQ ID NO: 66231 - protein, 7 aa, Mycobacterium avium
GRPGPEL

SEQ ID NO: 66232 - protein, 17 aa, Mycobacterium avium
GRPGQQALTNPTEQERA

SEQ ID NO: 66233 - protein, 10 aa, Mycobacterium avium
GRPHAMSRTD

SEQ ID NO: 66234 - protein, 11 aa, Mycobacterium avium
GRPHAMSRTDD

SEQ ID NO: 66235 - protein, 10 aa, Mycobacterium avium
GRPHAMTRTD

SEQ ID NO: 66236 - protein, 14 aa, Mycobacterium avium
GRPLPSEYTSGDRG

SEQ ID NO: 66237 - protein, 9 aa, Mycobacterium avium
GRPPAAADL

SEQ ID NO: 66238 - protein, 8 aa, Mycobacterium avium
GRPPEDVS

SEQ ID NO: 66239 - protein, 6 aa, Mycobacterium avium
GRPPRR

SEQ ID NO: 66240 - protein, 13 aa, Mycobacterium avium
GRPPSRPVNPRSL

SEQ ID NO: 66241 - protein, 6 aa, Mycobacterium avium
GRPQHG

SEQ ID NO: 66242 - protein, 21 aa, Mycobacterium avium
GRPQVGDPLPLGEPALAGGAL

SEQ ID NO: 66243 - protein, 5 aa, Mycobacterium avium
GRPRG

SEQ ID NO: 66244 - protein, 12 aa, Mycobacterium avium
GRPRHRRCGGRG

SEQ ID NO: 66245 - protein, 10 aa, Mycobacterium avium
GRPSPGTPVG

SEQ ID NO: 66246 - protein, 12 aa, Mycobacterium avium
GRPSRRYPVGEG

SEQ ID NO: 66247 - protein, 9 aa, Mycobacterium avium
GRPTTVPSS

SEQ ID NO: 66248 - protein, 5 aa, Mycobacterium avium
GRPVP

SEQ ID NO: 66249 - protein, 13 aa, Mycobacterium avium
GRPVSGPNSKTEI

SEQ ID NO: 66250 - protein, 18 aa, Mycobacterium avium
GRQAVDVNGTDGTVFLVQ

SEQ ID NO: 66251 - protein, 17 aa, Mycobacterium avium
GRQGEALGAYQGARAQL

SEQ ID NO: 66252 - protein, 6 aa, Mycobacterium avium
GRQPVQ

SEQ ID NO: 66253 - protein, 9 aa, Mycobacterium avium
GRQSEEGSG

SEQ ID NO: 66254 - protein, 9 aa, Mycobacterium avium
GRQTTGQTS

SEQ ID NO: 66255 - protein, 7 aa, Mycobacterium avium
GRQVEDD

SEQ ID NO: 66256 - protein, 14 aa, Mycobacterium avium
GRQYDQTFNLIVQQ

SEQ ID NO: 66257 - protein, 9 aa, Mycobacterium avium
GRRATVPTP

SEQ ID NO: 66258 - protein, 7 aa, Mycobacterium avium
GRRCPAS

SEQ ID NO: 66259 - protein, 7 aa, Mycobacterium avium
GRREPAL

SEQ ID NO: 66260 - protein, 9 aa, Mycobacterium avium
GRREQGTQA

SEQ ID NO: 66261 - protein, 14 aa, Mycobacterium avium
GRRGCSGELGDDVT

SEQ ID NO: 66262 - protein, 8 aa, Mycobacterium avium
GRRGGDVN

SEQ ID NO: 66263 - protein, 10 aa, Mycobacterium avium
GRRGRDVPEV

SEQ ID NO: 66264 - protein, 7 aa, Mycobacterium avium
GRRKLPQ

SEQ ID NO: 66265 - protein, 5 aa, Mycobacterium avium
GRRPG

SEQ ID NO: 66266 - protein, 9 aa, Mycobacterium avium
GRRPGEPVV

SEQ ID NO: 66267 - protein, 14 aa, Mycobacterium avium
GRRPGPRRGRPRPG

SEQ ID NO: 66268 - protein, 7 aa, Mycobacterium avium
GRRPGSV

SEQ ID NO: 66269 - protein, 7 aa, Mycobacterium avium
GRRPRPF

SEQ ID NO: 66270 - protein, 20 aa, Mycobacterium avium
GRRRARGRRRARGRRRASGH

SEQ ID NO: 66271 - protein, 5 aa, Mycobacterium avium
GRRRF

SEQ ID NO: 66272 - protein, 7 aa, Mycobacterium avium
GRRRPVP

SEQ ID NO: 66273 - protein, 12 aa, Mycobacterium avium
GRRRSGAGTRGG

SEQ ID NO: 66274 - protein, 7 aa, Mycobacterium avium
GRRRVPD

SEQ ID NO: 66275 - protein, 17 aa, Mycobacterium avium
GRRSGARRARPTRADHR

SEQ ID NO: 66276 - protein, 12 aa, Mycobacterium avium
GRRSRSTPGDDD

SEQ ID NO: 66277 - protein, 17 aa, Mycobacterium avium
GRRSYDAGLGRRGIPDQ

SEQ ID NO: 66278 - protein, 28 aa, Mycobacterium avium
GRRTGKELAATKPGGSPFPRDIRWGRIS

SEQ ID NO: 66279 - protein, 8 aa, Mycobacterium avium
GRRTGRAL

SEQ ID NO: 66280 - protein, 8 aa, Mycobacterium avium
GRRVQGSA

SEQ ID NO: 66281 - protein, 5 aa, Mycobacterium avium
GRSAA

SEQ ID NO: 66282 - protein, 20 aa, Mycobacterium avium
GRSAIGKTSEAGAKSIAPAP

SEQ ID NO: 66283 - protein, 9 aa, Mycobacterium avium
GRSATAPGV

SEQ ID NO: 66284 - protein, 7 aa, Mycobacterium avium
GRSCGGR

SEQ ID NO: 66285 - protein, 8 aa, Mycobacterium avium
GRSGGHLS

SEQ ID NO: 66286 - protein, 5 aa, Mycobacterium avium
GRSGH

SEQ ID NO: 66287 - protein, 27 aa, Mycobacterium avium
GRSGQRRAEAAASSAAASPPEARPWRE

SEQ ID NO: 66288 - protein, 27 aa, Mycobacterium avium
GRSGQRRAEAAASSAAASRPEARPWRQ

SEQ ID NO: 66289 - protein, 27 aa, Mycobacterium avium
GRSGQRRAEVAASPTAASPPEARPWRE

SEQ ID NO: 66290 - protein, 19 aa, Mycobacterium avium
GRSGTGKTQSSRMSASPHD

SEQ ID NO: 66291 - protein, 4 aa, Mycobacterium avium
GRSH

SEQ ID NO: 66292 - protein, 12 aa, Mycobacterium avium
GRSNVNSDVDAV

SEQ ID NO: 66293 - protein, 7 aa, Mycobacterium avium
GRSPEVS

SEQ ID NO: 66294 - protein, 17 aa, Mycobacterium avium
GRSQHGGFEPPDIPPAQ

SEQ ID NO: 66295 - protein, 9 aa, Mycobacterium avium
GRSRRRKSW

SEQ ID NO: 66296 - protein, 9 aa, Mycobacterium avium
GRSSDYPQK

SEQ ID NO: 66297 - protein, 12 aa, Mycobacterium avium
GRSTVAGSTERQ

SEQ ID NO: 66298 - protein, 4 aa, Mycobacterium avium
GRTA

SEQ ID NO: 66299 - protein, 7 aa, Mycobacterium avium
GRTAEDV

SEQ ID NO: 66300 - protein, 14 aa, Mycobacterium avium
GRTAPNAPAGGPLT

SEQ ID NO: 66301 - protein, 14 aa, Mycobacterium avium
GRTARRARGATGGR

SEQ ID NO: 66302 - protein, 5 aa, Mycobacterium avium
GRTEV

SEQ ID NO: 66303 - protein, 4 aa, Mycobacterium avium
GRTG

SEQ ID NO: 66304 - protein, 8 aa, Mycobacterium avium
GRTGEPTI

SEQ ID NO: 66305 - protein, 6 aa, Mycobacterium avium
GRTGLT

SEQ ID NO: 66306 - protein, 5 aa, Mycobacterium avium
GRTKT

SEQ ID NO: 66307 - protein, 11 aa, Mycobacterium avium
GRTLNKEPRWR

SEQ ID NO: 66308 - protein, 25 aa, Mycobacterium avium
GRTLSSDPVSRPATSYTAAAPDNSI

SEQ ID NO: 66309 - protein, 8 aa, Mycobacterium avium
GRTNYRNP

SEQ ID NO: 66310 - protein, 4 aa, Mycobacterium avium
GRTP

SEQ ID NO: 66311 - protein, 13 aa, Mycobacterium avium
GRTPDGWVCQQAN

SEQ ID NO: 66312 - protein, 5 aa, Mycobacterium avium
GRTPI

SEQ ID NO: 66313 - protein, 8 aa, Mycobacterium avium
GRTPPDVP

SEQ ID NO: 66314 - protein, 5 aa, Mycobacterium avium
GRTRD

SEQ ID NO: 66315 - protein, 6 aa, Mycobacterium avium
GRTRTR

SEQ ID NO: 66316 - protein, 16 aa, Mycobacterium avium
GRTTGVADAQAIGDDG

SEQ ID NO: 66317 - protein, 11 aa, Mycobacterium avium
GRTTLSDSTAN

SEQ ID NO: 66318 - protein, 7 aa, Mycobacterium avium
GRTTPGR

SEQ ID NO: 66319 - protein, 8 aa, Mycobacterium avium
GRTTTYRE

SEQ ID NO: 66320 - protein, 7 aa, Mycobacterium avium
GRVDDEG

SEQ ID NO: 66321 - protein, 10 aa, Mycobacterium avium
GRVDDKGPYE

SEQ ID NO: 66322 - protein, 10 aa, Mycobacterium avium
GRVERGGDKP

SEQ ID NO: 66323 - protein, 5 aa, Mycobacterium avium
GRVRA

SEQ ID NO: 66324 - protein, 9 aa, Mycobacterium avium
GRVSNDAAG

SEQ ID NO: 66325 - protein, 11 aa, Mycobacterium avium
GRVTKPDGSPY

SEQ ID NO: 66326 - protein, 16 aa, Mycobacterium avium
GRWRDSGMPGTPKRRR

SEQ ID NO: 66327 - protein, 17 aa, Mycobacterium avium
GRWRDSGMPGTPKRRRQ

SEQ ID NO: 66328 - protein, 16 aa, Mycobacterium avium
GRWRDSGMPGTPRRRR

SEQ ID NO: 66329 - protein, 11 aa, Mycobacterium avium
GRWSDDRGANI

SEQ ID NO: 66330 - protein, 9 aa, Mycobacterium avium
GRYEKDYAT

SEQ ID NO: 66331 - protein, 4 aa, Mycobacterium avium
GRYP

SEQ ID NO: 66332 - protein, 12 aa, Mycobacterium avium
GRYRRTSPSADD

SEQ ID NO: 66333 - protein, 6 aa, Mycobacterium avium
GRYYTG

SEQ ID NO: 66334 - protein, 11 aa, Mycobacterium avium
GSAANDRQKIS

SEQ ID NO: 66335 - protein, 7 aa, Mycobacterium avium
GSAANRP

SEQ ID NO: 66336 - protein, 8 aa, Mycobacterium avium
GSADPADA

SEQ ID NO: 66337 - protein, 11 aa, Mycobacterium avium
GSADPISAEPA

SEQ ID NO: 66338 - protein, 19 aa, Mycobacterium avium
GSADRPATGDPVQAGGRAV

SEQ ID NO: 66339 - protein, 5 aa, Mycobacterium avium
GSAEQ

SEQ ID NO: 66340 - protein, 10 aa, Mycobacterium avium
GSAEVKHVGD

SEQ ID NO: 66341 - protein, 4 aa, Mycobacterium avium
GSAG

SEQ ID NO: 66342 - protein, 6 aa, Mycobacterium avium
GSAGSV

SEQ ID NO: 66343 - protein, 8 aa, Mycobacterium avium
GSAGTATA

SEQ ID NO: 66344 - protein, 6 aa, Mycobacterium avium
GSAHVN

SEQ ID NO: 66345 - protein, 8 aa, Mycobacterium avium
GSAKTSFQ

SEQ ID NO: 66346 - protein, 6 aa, Mycobacterium avium
GSALGR

SEQ ID NO: 66347 - protein, 9 aa, Mycobacterium avium
GSALSKRPP

SEQ ID NO: 66348 - protein, 16 aa, Mycobacterium avium
GSAPDIAGQGIADPTA

SEQ ID NO: 66349 - protein, 25 aa, Mycobacterium avium
GSAPDSPAGPGIPPALRTADRSAGV

SEQ ID NO: 66350 - protein, 5 aa, Mycobacterium avium
GSAPP

SEQ ID NO: 66351 - protein, 7 aa, Mycobacterium avium
GSAPQQL

SEQ ID NO: 66352 - protein, 15 aa, Mycobacterium avium
GSAQSKQELVDNPRG

SEQ ID NO: 66353 - protein, 11 aa, Mycobacterium avium
GSARGAPAAGV

SEQ ID NO: 66354 - protein, 8 aa, Mycobacterium avium
GSATRDER

SEQ ID NO: 66355 - protein, 13 aa, Mycobacterium avium
GSAVHGVESVFGF

SEQ ID NO: 66356 - protein, 7 aa, Mycobacterium avium
GSCGCPK

SEQ ID NO: 66357 - protein, 4 aa, Mycobacterium avium
GSCN

SEQ ID NO: 66358 - protein, 6 aa, Mycobacterium avium
GSDANE

SEQ ID NO: 66359 - protein, 5 aa, Mycobacterium avium
GSDER

SEQ ID NO: 66360 - protein, 8 aa, Mycobacterium avium
GSDGDGRT

SEQ ID NO: 66361 - protein, 8 aa, Mycobacterium avium
GSDGTDCP

SEQ ID NO: 66362 - protein, 7 aa, Mycobacterium avium
GSDNPHG

SEQ ID NO: 66363 - protein, 6 aa, Mycobacterium avium
GSDPNV

SEQ ID NO: 66364 - protein, 7 aa, Mycobacterium avium
GSDSKRA

SEQ ID NO: 66365 - protein, 5 aa, Mycobacterium avium
GSDYP

SEQ ID NO: 66366 - protein, 4 aa, Mycobacterium avium
GSEA

SEQ ID NO: 66367 - protein, 13 aa, Mycobacterium avium
GSEDARDHAKPGY

SEQ ID NO: 66368 - protein, 6 aa, Mycobacterium avium
GSEEQC

SEQ ID NO: 66369 - protein, 34 aa, Mycobacterium avium
GSETRKNKGAERVPDGSPAVNAEKPFTHEQHVPT

SEQ ID NO: 66370 - protein, 15 aa, Mycobacterium avium
GSGAEQFDDSTPGAL

SEQ ID NO: 66371 - protein, 20 aa, Mycobacterium avium
GSGDGAAEVADEGVGPVPPT

SEQ ID NO: 66372 - protein, 20 aa, Mycobacterium avium
GSGDRAAEVADEGVGPVPPT

SEQ ID NO: 66373 - protein, 9 aa, Mycobacterium avium
GSGDSAVPR

SEQ ID NO: 66374 - protein, 9 aa, Mycobacterium avium
GSGEFTRDT

SEQ ID NO: 66375 - protein, 8 aa, Mycobacterium avium
GSGGARGY

SEQ ID NO: 66376 - protein, 8 aa, Mycobacterium avium
GSGGLAPY

SEQ ID NO: 66377 - protein, 12 aa, Mycobacterium avium
GSGGYGDLDEET

SEQ ID NO: 66378 - protein, 7 aa, Mycobacterium avium
GSGKSQT

SEQ ID NO: 66379 - protein, 4 aa, Mycobacterium avium
GSGL

SEQ ID NO: 66380 - protein, 8 aa, Mycobacterium avium
GSGMTRQR

SEQ ID NO: 66381 - protein, 5 aa, Mycobacterium avium
GSGPA

SEQ ID NO: 66382 - protein, 15 aa, Mycobacterium avium
GSGPHGQAPSGEPLA

SEQ ID NO: 66383 - protein, 7 aa, Mycobacterium avium
GSGPKAL

SEQ ID NO: 66384 - protein, 6 aa, Mycobacterium avium
GSGRAD

SEQ ID NO: 66385 - protein, 5 aa, Mycobacterium avium
GSGRD

SEQ ID NO: 66386 - protein, 15 aa, Mycobacterium avium
GSGSHGQAPSGEPLA

SEQ ID NO: 66387 - protein, 14 aa, Mycobacterium avium
GSGSHGQAPSGQPL

SEQ ID NO: 66388 - protein, 5 aa, Mycobacterium avium
GSGTF

SEQ ID NO: 66389 - protein, 5 aa, Mycobacterium avium
GSGTL

SEQ ID NO: 66390 - protein, 6 aa, Mycobacterium avium
GSGTTA

SEQ ID NO: 66391 - protein, 6 aa, Mycobacterium avium
GSGTTW

SEQ ID NO: 66392 - protein, 14 aa, Mycobacterium avium
GSGVASTKRPESTQ

SEQ ID NO: 66393 - protein, 4 aa, Mycobacterium avium
GSHA

SEQ ID NO: 66394 - protein, 5 aa, Mycobacterium avium
GSHEP

SEQ ID NO: 66395 - protein, 4 aa, Mycobacterium avium
GSHG

SEQ ID NO: 66396 - protein, 10 aa, Mycobacterium avium
GSHQDAINKG

SEQ ID NO: 66397 - protein, 6 aa, Mycobacterium avium
GSHRPQ

SEQ ID NO: 66398 - protein, 15 aa, Mycobacterium avium
GSIEGRPRWSRRPGA

SEQ ID NO: 66399 - protein, 8 aa, Mycobacterium avium
GSIPRGLG

SEQ ID NO: 66400 - protein, 7 aa, Mycobacterium avium
GSIRQRS

SEQ ID NO: 66401 - protein, 6 aa, Mycobacterium avium
GSKAEL

SEQ ID NO: 66402 - protein, 6 aa, Mycobacterium avium
GSKEQV

SEQ ID NO: 66403 - protein, 6 aa, Mycobacterium avium
GSKERA

SEQ ID NO: 66404 - protein, 25 aa, Mycobacterium avium
GSKSLMDTATEGLRKRVTEVKKRAA

SEQ ID NO: 66405 - protein, 5 aa, Mycobacterium avium
GSKSR

SEQ ID NO: 66406 - protein, 9 aa, Mycobacterium avium
GSKWEPPAA

SEQ ID NO: 66407 - protein, 8 aa, Mycobacterium avium
GSLAGGAF

SEQ ID NO: 66408 - protein, 6 aa, Mycobacterium avium
GSLEDG

SEQ ID NO: 66409 - protein, 12 aa, Mycobacterium avium
GSLEPRRTRSRP

SEQ ID NO: 66410 - protein, 22 aa, Mycobacterium avium
GSLNDASQASTEQARRTTEGWR

SEQ ID NO: 66411 - protein, 4 aa, Mycobacterium avium
GSMA

SEQ ID NO: 66412 - protein, 14 aa, Mycobacterium avium
GSMAARDRDGGGQR

SEQ ID NO: 66413 - protein, 15 aa, Mycobacterium avium
GSMAEENKSGPAEAV

SEQ ID NO: 66414 - protein, 6 aa, Mycobacterium avium
GSMPEE

SEQ ID NO: 66415 - protein, 11 aa, Mycobacterium avium
GSNPAEALGKS

SEQ ID NO: 66416 - protein, 6 aa, Mycobacterium avium
GSNYGK

SEQ ID NO: 66417 - protein, 15 aa, Mycobacterium avium
GSPDCPSAAAPAPRS

SEQ ID NO: 66418 - protein, 5 aa, Mycobacterium avium
GSPEE

SEQ ID NO: 66419 - protein, 6 aa, Mycobacterium avium
GSPEEQ

SEQ ID NO: 66420 - protein, 6 aa, Mycobacterium avium
GSPEEW

SEQ ID NO: 66421 - protein, 5 aa, Mycobacterium avium
GSPEH

SEQ ID NO: 66422 - protein, 7 aa, Mycobacterium avium
GSPFAPL

SEQ ID NO: 66423 - protein, 10 aa, Mycobacterium avium
GSPFEDEQDP

SEQ ID NO: 66424 - protein, 28 aa, Mycobacterium avium
GSPGGAAKVGLTENDPAPVKNLESRAEA

SEQ ID NO: 66425 - protein, 28 aa, Mycobacterium avium
GSPGGAAKVGLTENDPQVVKDLPPQGED

SEQ ID NO: 66426 - protein, 8 aa, Mycobacterium avium
GSPGRNNP

SEQ ID NO: 66427 - protein, 6 aa, Mycobacterium avium
GSPKSA

SEQ ID NO: 66428 - protein, 4 aa, Mycobacterium avium
GSPL

SEQ ID NO: 66429 - protein, 4 aa, Mycobacterium avium
GSPP

SEQ ID NO: 66430 - protein, 5 aa, Mycobacterium avium
GSPPV

SEQ ID NO: 66431 - protein, 12 aa, Mycobacterium avium
GSPSYQRVTDAS

SEQ ID NO: 66432 - protein, 15 aa, Mycobacterium avium
GSPTDTRSLDDRDDL

SEQ ID NO: 66433 - protein, 6 aa, Mycobacterium avium
GSPTRR

SEQ ID NO: 66434 - protein, 6 aa, Mycobacterium avium
GSPVPG

SEQ ID NO: 66435 - protein, 10 aa, Mycobacterium avium
GSQAGDIART

SEQ ID NO: 66436 - protein, 5 aa, Mycobacterium avium
GSQGT

SEQ ID NO: 66437 - protein, 6 aa, Mycobacterium avium
GSQRAM

SEQ ID NO: 66438 - protein, 6 aa, Mycobacterium avium
GSQSPV

SEQ ID NO: 66439 - protein, 8 aa, Mycobacterium avium
GSQTSDKV

SEQ ID NO: 66440 - protein, 6 aa, Mycobacterium avium
GSRGLG

SEQ ID NO: 66441 - protein, 7 aa, Mycobacterium avium
GSRGLTH

SEQ ID NO: 66442 - protein, 6 aa, Mycobacterium avium
GSRGMG

SEQ ID NO: 66443 - protein, 6 aa, Mycobacterium avium
GSRIDT

SEQ ID NO: 66444 - protein, 11 aa, Mycobacterium avium
GSRPRVTSRPH

SEQ ID NO: 66445 - protein, 9 aa, Mycobacterium avium
GSRQDASAA

SEQ ID NO: 66446 - protein, 5 aa, Mycobacterium avium
GSRRS

SEQ ID NO: 66447 - protein, 4 aa, Mycobacterium avium
GSRT

SEQ ID NO: 66448 - protein, 9 aa, Mycobacterium avium
GSSATPDAL

SEQ ID NO: 66449 - protein, 18 aa, Mycobacterium avium
GSSETPVSTSGLRTEPRD

SEQ ID NO: 66450 - protein, 7 aa, Mycobacterium avium
GSSGEIV

SEQ ID NO: 66451 - protein, 6 aa, Mycobacterium avium
GSSGLV

SEQ ID NO: 66452 - protein, 30 aa, Mycobacterium avium
GSSGPHHRGGGGVAPSPTAAHGFSDPEARQ

SEQ ID NO: 66453 - protein, 22 aa, Mycobacterium avium
GSSGRDGDKISKLRSKPGVTGA

SEQ ID NO: 66454 - protein, 10 aa, Mycobacterium avium
GSSGRDGDKL

SEQ ID NO: 66455 - protein, 17 aa, Mycobacterium avium
GSSGSSPSTTADAPPDV

SEQ ID NO: 66456 - protein, 14 aa, Mycobacterium avium
GSSKSGDAGGGSKV

SEQ ID NO: 66457 - protein, 7 aa, Mycobacterium avium
GSSLPGE

SEQ ID NO: 66458 - protein, 4 aa, Mycobacterium avium
GSSR

SEQ ID NO: 66459 - protein, 7 aa, Mycobacterium avium
GSSRGLG

SEQ ID NO: 66460 - protein, 8 aa, Mycobacterium avium
GSSSTLPK

SEQ ID NO: 66461 - protein, 7 aa, Mycobacterium avium
GSSTSHV

SEQ ID NO: 66462 - protein, 7 aa, Mycobacterium avium
GSSYGKA

SEQ ID NO: 66463 - protein, 14 aa, Mycobacterium avium
GSTARSDVKRQLRA

SEQ ID NO: 66464 - protein, 5 aa, Mycobacterium avium
GSTDP

SEQ ID NO: 66465 - protein, 9 aa, Mycobacterium avium
GSTETSGAV

SEQ ID NO: 66466 - protein, 20 aa, Mycobacterium avium
GSTETSGAVSRGPLSPPNPL

SEQ ID NO: 66467 - protein, 20 aa, Mycobacterium avium
GSTGIGAATAERLASEGAAV

SEQ ID NO: 66468 - protein, 7 aa, Mycobacterium avium
GSTGVPK

SEQ ID NO: 66469 - protein, 12 aa, Mycobacterium avium
GSTLGSVSAKLD

SEQ ID NO: 66470 - protein, 7 aa, Mycobacterium avium
GSTSSHG

SEQ ID NO: 66471 - protein, 5 aa, Mycobacterium avium
GSTTA

SEQ ID NO: 66472 - protein, 8 aa, Mycobacterium avium
GSTTIGRL

SEQ ID NO: 66473 - protein, 9 aa, Mycobacterium avium
GSTVTGRSV

SEQ ID NO: 66474 - protein, 28 aa, Mycobacterium avium
GSVAQRRATTGLASGRFGEKPSDAAQFT

SEQ ID NO: 66475 - protein, 28 aa, Mycobacterium avium
GSVAQRRATTGLASGRLGEKPSDAAQFT

SEQ ID NO: 66476 - protein, 19 aa, Mycobacterium avium
GSVGGASHVSATSAGAGRV

SEQ ID NO: 66477 - protein, 14 aa, Mycobacterium avium
GSVRPREGNRHREY

SEQ ID NO: 66478 - protein, 16 aa, Mycobacterium avium
GSVSSRDARGGTAPAR

SEQ ID NO: 66479 - protein, 7 aa, Mycobacterium avium
GSVTGHS

SEQ ID NO: 66480 - protein, 21 aa, Mycobacterium avium
GTAAAARARQDTLTKPRGALG

SEQ ID NO: 66481 - protein, 15 aa, Mycobacterium avium
GTAAEAEKSTATNAC

SEQ ID NO: 66482 - protein, 16 aa, Mycobacterium avium
GTAAKRAAAAPAGLSA

SEQ ID NO: 66483 - protein, 16 aa, Mycobacterium avium
GTAANRAAAAPAGLSA

SEQ ID NO: 66484 - protein, 10 aa, Mycobacterium avium
GTAAQTVGIS

SEQ ID NO: 66485 - protein, 6 aa, Mycobacterium avium
GTADNN

SEQ ID NO: 66486 - protein, 8 aa, Mycobacterium avium
GTADPAAV

SEQ ID NO: 66487 - protein, 9 aa, Mycobacterium avium
GTADPAQVR

SEQ ID NO: 66488 - protein, 6 aa, Mycobacterium avium
GTADPV

SEQ ID NO: 66489 - protein, 6 aa, Mycobacterium avium
GTAEQI

SEQ ID NO: 66490 - protein, 14 aa, Mycobacterium avium
GTAERTPYAATKGA

SEQ ID NO: 66491 - protein, 13 aa, Mycobacterium avium
GTAGDRQVPNEPR

SEQ ID NO: 66492 - protein, 9 aa, Mycobacterium avium
GTAGPNYDA

SEQ ID NO: 66493 - protein, 13 aa, Mycobacterium avium
GTAGPNYDAGSVA

SEQ ID NO: 66494 - protein, 10 aa, Mycobacterium avium
GTAGRAELAA

SEQ ID NO: 66495 - protein, 17 aa, Mycobacterium avium
GTAGSTGTPKTAALSPD

SEQ ID NO: 66496 - protein, 9 aa, Mycobacterium avium
GTALGGGSE

SEQ ID NO: 66497 - protein, 8 aa, Mycobacterium avium
GTAPGART

SEQ ID NO: 66498 - protein, 9 aa, Mycobacterium avium
GTAPGTRTT

SEQ ID NO: 66499 - protein, 12 aa, Mycobacterium avium
GTAPTDLANTNT

SEQ ID NO: 66500 - protein, 6 aa, Mycobacterium avium
GTARGL

SEQ ID NO: 66501 - protein, 16 aa, Mycobacterium avium
GTARRNAAAAAGGLTT

SEQ ID NO: 66502 - protein, 4 aa, Mycobacterium avium
GTAS

SEQ ID NO: 66503 - protein, 8 aa, Mycobacterium avium
GTATEQAR

SEQ ID NO: 66504 - protein, 17 aa, Mycobacterium avium
GTATRDIPYEGSPDMDM

SEQ ID NO: 66505 - protein, 7 aa, Mycobacterium avium
GTCTTGS

SEQ ID NO: 66506 - protein, 4 aa, Mycobacterium avium
GTDA

SEQ ID NO: 66507 - protein, 6 aa, Mycobacterium avium
GTDAAG

SEQ ID NO: 66508 - protein, 19 aa, Mycobacterium avium
GTDAGANAGLGSDTSAVAP

SEQ ID NO: 66509 - protein, 5 aa, Mycobacterium avium
GTDAW

SEQ ID NO: 66510 - protein, 8 aa, Mycobacterium avium
GTDDPGGL

SEQ ID NO: 66511 - protein, 8 aa, Mycobacterium avium
GTDEASRH

SEQ ID NO: 66512 - protein, 6 aa, Mycobacterium avium
GTDEQR

SEQ ID NO: 66513 - protein, 20 aa, Mycobacterium avium
GTDFRPAKRLPAQQVTHWDS

SEQ ID NO: 66514 - protein, 16 aa, Mycobacterium avium
GTDGGYPSDGASEMST

SEQ ID NO: 66515 - protein, 7 aa, Mycobacterium avium
GTDPATA

SEQ ID NO: 66516 - protein, 10 aa, Mycobacterium avium
GTDPNDSPEV

SEQ ID NO: 66517 - protein, 9 aa, Mycobacterium avium
GTDTAARAR

SEQ ID NO: 66518 - protein, 4 aa, Mycobacterium avium
GTDV

SEQ ID NO: 66519 - protein, 9 aa, Mycobacterium avium
GTDVARGSV

SEQ ID NO: 66520 - protein, 9 aa, Mycobacterium avium
GTDVARRSV

SEQ ID NO: 66521 - protein, 5 aa, Mycobacterium avium
GTDVQ

SEQ ID NO: 66522 - protein, 9 aa, Mycobacterium avium
GTDYTPPNK

SEQ ID NO: 66523 - protein, 7 aa, Mycobacterium avium
GTEDYGR

SEQ ID NO: 66524 - protein, 7 aa, Mycobacterium avium
GTEEQKA

SEQ ID NO: 66525 - protein, 7 aa, Mycobacterium avium
GTEEQKQ

SEQ ID NO: 66526 - protein, 9 aa, Mycobacterium avium
GTEEQKQKY

SEQ ID NO: 66527 - protein, 8 aa, Mycobacterium avium
GTEEQKTK

SEQ ID NO: 66528 - protein, 15 aa, Mycobacterium avium
GTEGTAASANDNAME

SEQ ID NO: 66529 - protein, 25 aa, Mycobacterium avium
GTENDITDDSGIINRDKSAETPQRG

SEQ ID NO: 66530 - protein, 7 aa, Mycobacterium avium
GTEPAPL

SEQ ID NO: 66531 - protein, 10 aa, Mycobacterium avium
GTETTPAQER

SEQ ID NO: 66532 - protein, 5 aa, Mycobacterium avium
GTEVG

SEQ ID NO: 66533 - protein, 9 aa, Mycobacterium avium
GTEWTDGHQ

SEQ ID NO: 66534 - protein, 8 aa, Mycobacterium avium
GTFTDDDA

SEQ ID NO: 66535 - protein, 9 aa, Mycobacterium avium
GTGAADADD

SEQ ID NO: 66536 - protein, 21 aa, Mycobacterium avium
GTGALDGRIEPDTTAPEPTAD

SEQ ID NO: 66537 - protein, 20 aa, Mycobacterium avium
GTGALDGRIEPDTTVPEPTA

SEQ ID NO: 66538 - protein, 14 aa, Mycobacterium avium
GTGASEEASRDRAL

SEQ ID NO: 66539 - protein, 13 aa, Mycobacterium avium
GTGATNHRQPRGM

SEQ ID NO: 66540 - protein, 7 aa, Mycobacterium avium
GTGDSVA

SEQ ID NO: 66541 - protein, 10 aa, Mycobacterium avium
GTGENSARPG

SEQ ID NO: 66542 - protein, 8 aa, Mycobacterium avium
GTGGDGVN

SEQ ID NO: 66543 - protein, 11 aa, Mycobacterium avium
GTGGQRQVPGA

SEQ ID NO: 66544 - protein, 9 aa, Mycobacterium avium
GTGKELPEG

SEQ ID NO: 66545 - protein, 9 aa, Mycobacterium avium
GTGKPFVST

SEQ ID NO: 66546 - protein, 6 aa, Mycobacterium avium
GTGLRQ

SEQ ID NO: 66547 - protein, 10 aa, Mycobacterium avium
GTGPDLAAAR

SEQ ID NO: 66548 - protein, 8 aa, Mycobacterium avium
GTGPNAAP

SEQ ID NO: 66549 - protein, 16 aa, Mycobacterium avium
GTGPPPRPADREFPDG

SEQ ID NO: 66550 - protein, 7 aa, Mycobacterium avium
GTGPQVA

SEQ ID NO: 66551 - protein, 15 aa, Mycobacterium avium
GTGQGEAATTTVGAG

SEQ ID NO: 66552 - protein, 12 aa, Mycobacterium avium
GTGRGGAELDTA

SEQ ID NO: 66553 - protein, 6 aa, Mycobacterium avium
GTGRHH

SEQ ID NO: 66554 - protein, 18 aa, Mycobacterium avium
GTGSAMDNTGWPQPAAVA

SEQ ID NO: 66555 - protein, 8 aa, Mycobacterium avium
GTGSDPVR

SEQ ID NO: 66556 - protein, 6 aa, Mycobacterium avium
GTGSLP

SEQ ID NO: 66557 - protein, 12 aa, Mycobacterium avium
GTGVGTSGSACE

SEQ ID NO: 66558 - protein, 22 aa, Mycobacterium avium
GTGWGKAGDLATATVTAPGTRF

SEQ ID NO: 66559 - protein, 8 aa, Mycobacterium avium
GTLDNDEN

SEQ ID NO: 66560 - protein, 8 aa, Mycobacterium avium
GTLSEPAT

SEQ ID NO: 66561 - protein, 13 aa, Mycobacterium avium
GTLSTGSIEPGAD

SEQ ID NO: 66562 - protein, 4 aa, Mycobacterium avium
GTLT

SEQ ID NO: 66563 - protein, 8 aa, Mycobacterium avium
GTMESNSP

SEQ ID NO: 66564 - protein, 9 aa, Mycobacterium avium
GTMGRPEEI

SEQ ID NO: 66565 - protein, 4 aa, Mycobacterium avium
GTNL

SEQ ID NO: 66566 - protein, 8 aa, Mycobacterium avium
GTPADQVA

SEQ ID NO: 66567 - protein, 13 aa, Mycobacterium avium
GTPALATRGFGGA

SEQ ID NO: 66568 - protein, 7 aa, Mycobacterium avium
GTPARQV

SEQ ID NO: 66569 - protein, 15 aa, Mycobacterium avium
GTPDAAGWASPLRSA

SEQ ID NO: 66570 - protein, 7 aa, Mycobacterium avium
GTPDRAA

SEQ ID NO: 66571 - protein, 8 aa, Mycobacterium avium
GTPEPRHD

SEQ ID NO: 66572 - protein, 4 aa, Mycobacterium avium
GTPG

SEQ ID NO: 66573 - protein, 9 aa, Mycobacterium avium
GTPGAAPGF

SEQ ID NO: 66574 - protein, 6 aa, Mycobacterium avium
GTPGVT

SEQ ID NO: 66575 - protein, 7 aa, Mycobacterium avium
GTPLPGN

SEQ ID NO: 66576 - protein, 7 aa, Mycobacterium avium
GTPMRPG

SEQ ID NO: 66577 - protein, 4 aa, Mycobacterium avium
GTPP

SEQ ID NO: 66578 - protein, 6 aa, Mycobacterium avium
GTPPEA

SEQ ID NO: 66579 - protein, 7 aa, Mycobacterium avium
GTPSRLS

SEQ ID NO: 66580 - protein, 7 aa, Mycobacterium avium
GTPTERA

SEQ ID NO: 66581 - protein, 15 aa, Mycobacterium avium
GTPVGTALSAPPKPV

SEQ ID NO: 66582 - protein, 13 aa, Mycobacterium avium
GTPYEGRSLPHTS

SEQ ID NO: 66583 - protein, 6 aa, Mycobacterium avium
GTQDGT

SEQ ID NO: 66584 - protein, 13 aa, Mycobacterium avium
GTQLDGTRQVGGA

SEQ ID NO: 66585 - protein, 8 aa, Mycobacterium avium
GTQPDTPN

SEQ ID NO: 66586 - protein, 7 aa, Mycobacterium avium
GTQQQKD

SEQ ID NO: 66587 - protein, 6 aa, Mycobacterium avium
GTQRIT

SEQ ID NO: 66588 - protein, 9 aa, Mycobacterium avium
GTQTGSAVP

SEQ ID NO: 66589 - protein, 6 aa, Mycobacterium avium
GTQTLP

SEQ ID NO: 66590 - protein, 6 aa, Mycobacterium avium
GTRDAA

SEQ ID NO: 66591 - protein, 49 aa, Mycobacterium avium
GTRGAVRPAGHPGERAVPRAGQHPAAAGAVRQRPAARRPPAGARAGRPL

SEQ ID NO: 66592 - protein, 8 aa, Mycobacterium avium
GTRGPHGG

SEQ ID NO: 66593 - protein, 19 aa, Mycobacterium avium
GTRIPTGATIEASAPDGTP

SEQ ID NO: 66594 - protein, 4 aa, Mycobacterium avium
GTRP

SEQ ID NO: 66595 - protein, 14 aa, Mycobacterium avium
GTRQSAVAPNTGTL

SEQ ID NO: 66596 - protein, 5 aa, Mycobacterium avium
GTRRK

SEQ ID NO: 66597 - protein, 6 aa, Mycobacterium avium
GTRTDA

SEQ ID NO: 66598 - protein, 11 aa, Mycobacterium avium
GTRTPSSGRIT

SEQ ID NO: 66599 - protein, 15 aa, Mycobacterium avium
GTRYSSGSQAAGTQS

SEQ ID NO: 66600 - protein, 4 aa, Mycobacterium avium
GTSA

SEQ ID NO: 66601 - protein, 8 aa, Mycobacterium avium
GTSAGSAV

SEQ ID NO: 66602 - protein, 15 aa, Mycobacterium avium
GTSEAAARQLASRAR

SEQ ID NO: 66603 - protein, 5 aa, Mycobacterium avium
GTSEI

SEQ ID NO: 66604 - protein, 9 aa, Mycobacterium avium
GTSGAGPER

SEQ ID NO: 66605 - protein, 9 aa, Mycobacterium avium
GTSGEPKAV

SEQ ID NO: 66606 - protein, 16 aa, Mycobacterium avium
GTSGQPAAAAAPGEAE

SEQ ID NO: 66607 - protein, 12 aa, Mycobacterium avium
GTSHPGTAYRGR

SEQ ID NO: 66608 - protein, 7 aa, Mycobacterium avium
GTSRGLG

SEQ ID NO: 66609 - protein, 13 aa, Mycobacterium avium
GTSRRFSATTPET

SEQ ID NO: 66610 - protein, 6 aa, Mycobacterium avium
GTSSVG

SEQ ID NO: 66611 - protein, 7 aa, Mycobacterium avium
GTSSYVA

SEQ ID NO: 66612 - protein, 11 aa, Mycobacterium avium
GTTAAPKGARH

SEQ ID NO: 66613 - protein, 7 aa, Mycobacterium avium
GTTAAQH

SEQ ID NO: 66614 - protein, 10 aa, Mycobacterium avium
GTTAEAAKAA

SEQ ID NO: 66615 - protein, 9 aa, Mycobacterium avium
GTTAEAARA

SEQ ID NO: 66616 - protein, 6 aa, Mycobacterium avium
GTTDEL

SEQ ID NO: 66617 - protein, 6 aa, Mycobacterium avium
GTTGAS

SEQ ID NO: 66618 - protein, 7 aa, Mycobacterium avium
GTTGFPK

SEQ ID NO: 66619 - protein, 7 aa, Mycobacterium avium
GTTGIPK

SEQ ID NO: 66620 - protein, 8 aa, Mycobacterium avium
GTTGPALG

SEQ ID NO: 66621 - protein, 16 aa, Mycobacterium avium
GTTGQRESAPEDVTAS

SEQ ID NO: 66622 - protein, 12 aa, Mycobacterium avium
GTTGRPKAVRHS

SEQ ID NO: 66623 - protein, 9 aa, Mycobacterium avium
GTTGRPKGA

SEQ ID NO: 66624 - protein, 12 aa, Mycobacterium avium
GTTGRPKGVRHT

SEQ ID NO: 66625 - protein, 12 aa, Mycobacterium avium
GTTGTPKGAAFD

SEQ ID NO: 66626 - protein, 7 aa, Mycobacterium avium
GTTGVPK

SEQ ID NO: 66627 - protein, 8 aa, Mycobacterium avium
GTTGVPTG

SEQ ID NO: 66628 - protein, 6 aa, Mycobacterium avium
GTTLPG

SEQ ID NO: 66629 - protein, 6 aa, Mycobacterium avium
GTTNGR

SEQ ID NO: 66630 - protein, 9 aa, Mycobacterium avium
GTTRRAPTT

SEQ ID NO: 66631 - protein, 23 aa, Mycobacterium avium
GTTTTYPTPDQGKPIDGGSVPCV

SEQ ID NO: 66632 - protein, 9 aa, Mycobacterium avium
GTTVNNAPV

SEQ ID NO: 66633 - protein, 4 aa, Mycobacterium avium
GTTY

SEQ ID NO: 66634 - protein, 6 aa, Mycobacterium avium
GTVAGQ

SEQ ID NO: 66635 - protein, 5 aa, Mycobacterium avium
GTVAQ

SEQ ID NO: 66636 - protein, 4 aa, Mycobacterium avium
GTVE

SEQ ID NO: 66637 - protein, 10 aa, Mycobacterium avium
GTVEDDGAEL

SEQ ID NO: 66638 - protein, 17 aa, Mycobacterium avium
GTVEEQAQRVIDLLESR

SEQ ID NO: 66639 - protein, 6 aa, Mycobacterium avium
GTVNVK

SEQ ID NO: 66640 - protein, 10 aa, Mycobacterium avium
GTVPAVQSDG

SEQ ID NO: 66641 - protein, 8 aa, Mycobacterium avium
GTVPDPAQ

SEQ ID NO: 66642 - protein, 5 aa, Mycobacterium avium
GTVTD

SEQ ID NO: 66643 - protein, 6 aa, Mycobacterium avium
GTVTGG

SEQ ID NO: 66644 - protein, 14 aa, Mycobacterium avium
GTVTQPESTEQQEI

SEQ ID NO: 66645 - protein, 14 aa, Mycobacterium avium
GTVTSKGEGAEDPV

SEQ ID NO: 66646 - protein, 9 aa, Mycobacterium avium
GTWQGPSAE

SEQ ID NO: 66647 - protein, 5 aa, Mycobacterium avium
GTYHR

SEQ ID NO: 66648 - protein, 6 aa, Mycobacterium avium
GTYPAS

SEQ ID NO: 66649 - protein, 11 aa, Mycobacterium avium
GTYQRGGKTRV

SEQ ID NO: 66650 - protein, 6 aa, Mycobacterium avium
GTYRDG

SEQ ID NO: 66651 - protein, 8 aa, Mycobacterium avium
GVAEGPAR

SEQ ID NO: 66652 - protein, 8 aa, Mycobacterium avium
GVAGGGAD

SEQ ID NO: 66653 - protein, 8 aa, Mycobacterium avium
GVAGRGRH

SEQ ID NO: 66654 - protein, 5 aa, Mycobacterium avium
GVAKP

SEQ ID NO: 66655 - protein, 13 aa, Mycobacterium avium
GVAPPASKSWQTT

SEQ ID NO: 66656 - protein, 16 aa, Mycobacterium avium
GVAPRDREYRRPGRSL

SEQ ID NO: 66657 - protein, 26 aa, Mycobacterium avium
GVDAESPNTFPRAAATDADGKRGRAA

SEQ ID NO: 66658 - protein, 9 aa, Mycobacterium avium
GVDAHGRSG

SEQ ID NO: 66659 - protein, 15 aa, Mycobacterium avium
GVDAPSPFGAGPAAE

SEQ ID NO: 66660 - protein, 22 aa, Mycobacterium avium
GVDGGAGAGQPVLPGRQPFGAA

SEQ ID NO: 66661 - protein, 14 aa, Mycobacterium avium
GVDGGDQPHRRQGI

SEQ ID NO: 66662 - protein, 26 aa, Mycobacterium avium
GVDHAGKRPLRGNPGDDAGQRGPVGR

SEQ ID NO: 66663 - protein, 6 aa, Mycobacterium avium
GVDKER

SEQ ID NO: 66664 - protein, 7 aa, Mycobacterium avium
GVDPAQV

SEQ ID NO: 66665 - protein, 9 aa, Mycobacterium avium
GVDPARGWG

SEQ ID NO: 66666 - protein, 21 aa, Mycobacterium avium
GVDPDEVSRADQSGLAAAAPE

SEQ ID NO: 66667 - protein, 21 aa, Mycobacterium avium
GVDPDEVSRADRAGLAAAAPE

SEQ ID NO: 66668 - protein, 9 aa, Mycobacterium avium
GVDPERGWG

SEQ ID NO: 66669 - protein, 8 aa, Mycobacterium avium
GVDPPAGV

SEQ ID NO: 66670 - protein, 15 aa, Mycobacterium avium
GVDPPRVADPETQPT

SEQ ID NO: 66671 - protein, 16 aa, Mycobacterium avium
GVDRKDYNSFGSRRGN

SEQ ID NO: 66672 - protein, 10 aa, Mycobacterium avium
GVEGAGEGEI

SEQ ID NO: 66673 - protein, 7 aa, Mycobacterium avium
GVEQPGE

SEQ ID NO: 66674 - protein, 5 aa, Mycobacterium avium
GVETT

SEQ ID NO: 66675 - protein, 6 aa, Mycobacterium avium
GVGAGY

SEQ ID NO: 66676 - protein, 13 aa, Mycobacterium avium
GVGDAGWQGPAAS

SEQ ID NO: 66677 - protein, 5 aa, Mycobacterium avium
GVGEE

SEQ ID NO: 66678 - protein, 7 aa, Mycobacterium avium
GVGEEVN

SEQ ID NO: 66679 - protein, 9 aa, Mycobacterium avium
GVGEQNCPE

SEQ ID NO: 66680 - protein, 6 aa, Mycobacterium avium
GVGESV

SEQ ID NO: 66681 - protein, 12 aa, Mycobacterium avium
GVGETRSCGTGT

SEQ ID NO: 66682 - protein, 4 aa, Mycobacterium avium
GVGG

SEQ ID NO: 66683 - protein, 8 aa, Mycobacterium avium
GVGPDAPT

SEQ ID NO: 66684 - protein, 7 aa, Mycobacterium avium
GVGPGDA

SEQ ID NO: 66685 - protein, 6 aa, Mycobacterium avium
GVGPGQ

SEQ ID NO: 66686 - protein, 8 aa, Mycobacterium avium
GVGPSGGR

SEQ ID NO: 66687 - protein, 7 aa, Mycobacterium avium
GVGPTGQ

SEQ ID NO: 66688 - protein, 6 aa, Mycobacterium avium
GVGRKT

SEQ ID NO: 66689 - protein, 15 aa, Mycobacterium avium
GVGSPKPLHETDDDT

SEQ ID NO: 66690 - protein, 8 aa, Mycobacterium avium
GVGTDGRK

SEQ ID NO: 66691 - protein, 5 aa, Mycobacterium avium
GVGTE

SEQ ID NO: 66692 - protein, 6 aa, Mycobacterium avium
GVGTRG

SEQ ID NO: 66693 - protein, 5 aa, Mycobacterium avium
GVGTS

SEQ ID NO: 66694 - protein, 9 aa, Mycobacterium avium
GVHRAGRGV

SEQ ID NO: 66695 - protein, 7 aa, Mycobacterium avium
GVIGPQA

SEQ ID NO: 66696 - protein, 9 aa, Mycobacterium avium
GVLAGERPA

SEQ ID NO: 66697 - protein, 5 aa, Mycobacterium avium
GVNEP

SEQ ID NO: 66698 - protein, 11 aa, Mycobacterium avium
GVNSDAPPHGV

SEQ ID NO: 66699 - protein, 6 aa, Mycobacterium avium
GVNSPV

SEQ ID NO: 66700 - protein, 4 aa, Mycobacterium avium
GVPA

SEQ ID NO: 66701 - protein, 40 aa, Mycobacterium avium
GVPAAGSPVSASSPAAVPSIPGLPQAAAPSAPSTATGGIP

SEQ ID NO: 66702 - protein, 40 aa, Mycobacterium avium
GVPAAGSPVTASSPAAVPSIPGLPQAAAPSAPSTATGGIP

SEQ ID NO: 66703 - protein, 12 aa, Mycobacterium avium
GVPAAKSATVPD

SEQ ID NO: 66704 - protein, 11 aa, Mycobacterium avium
GVPADRPARRS

SEQ ID NO: 66705 - protein, 5 aa, Mycobacterium avium
GVPAG

SEQ ID NO: 66706 - protein, 7 aa, Mycobacterium avium
GVPAGDR

SEQ ID NO: 66707 - protein, 11 aa, Mycobacterium avium
GVPAGEATIGQ

SEQ ID NO: 66708 - protein, 13 aa, Mycobacterium avium
GVPAGEATIGQPG

SEQ ID NO: 66709 - protein, 12 aa, Mycobacterium avium
GVPAGKSDRLTG

SEQ ID NO: 66710 - protein, 7 aa, Mycobacterium avium
GVPAPIP

SEQ ID NO: 66711 - protein, 7 aa, Mycobacterium avium
GVPDGIS

SEQ ID NO: 66712 - protein, 5 aa, Mycobacterium avium
GVPDT

SEQ ID NO: 66713 - protein, 12 aa, Mycobacterium avium
GVPDTDSVTVRY

SEQ ID NO: 66714 - protein, 6 aa, Mycobacterium avium
GVPENE

SEQ ID NO: 66715 - protein, 6 aa, Mycobacterium avium
GVPGGL

SEQ ID NO: 66716 - protein, 13 aa, Mycobacterium avium
GVPGVGSRSHPDV

SEQ ID NO: 66717 - protein, 13 aa, Mycobacterium avium
GVPPATSDRIAEA

SEQ ID NO: 66718 - protein, 5 aa, Mycobacterium avium
GVPPR

SEQ ID NO: 66719 - protein, 19 aa, Mycobacterium avium
GVPRTPDGTDFPSYDTTSR

SEQ ID NO: 66720 - protein, 7 aa, Mycobacterium avium
GVQGSKA

SEQ ID NO: 66721 - protein, 4 aa, Mycobacterium avium
GVQI

SEQ ID NO: 66722 - protein, 5 aa, Mycobacterium avium
GVQIG

SEQ ID NO: 66723 - protein, 13 aa, Mycobacterium avium
GVQPARGTKSRAE

SEQ ID NO: 66724 - protein, 16 aa, Mycobacterium avium
GVQPPGQPQRHGDVVH

SEQ ID NO: 66725 - protein, 10 aa, Mycobacterium avium
GVQRDSSGAV

SEQ ID NO: 66726 - protein, 22 aa, Mycobacterium avium
GVQTGTQGAGQAASSGQDLGGQ

SEQ ID NO: 66727 - protein, 8 aa, Mycobacterium avium
GVQTRAPR

SEQ ID NO: 66728 - protein, 4 aa, Mycobacterium avium
GVRA

SEQ ID NO: 66729 - protein, 9 aa, Mycobacterium avium
GVRAKEQRA

SEQ ID NO: 66730 - protein, 15 aa, Mycobacterium avium
GVRGGARVTRPRRET

SEQ ID NO: 66731 - protein, 7 aa, Mycobacterium avium
GVRGPGT

SEQ ID NO: 66732 - protein, 33 aa, Mycobacterium avium
GVRHPGDRRQECGQPRRPALRRGADGPGGCRAL

SEQ ID NO: 66733 - protein, 19 aa, Mycobacterium avium
GVRRGKRVRTTKPGPGAPR

SEQ ID NO: 66734 - protein, 10 aa, Mycobacterium avium
GVRRGTGSAR

SEQ ID NO: 66735 - protein, 6 aa, Mycobacterium avium
GVRTDA

SEQ ID NO: 66736 - protein, 13 aa, Mycobacterium avium
GVRTRAERTTTGW

SEQ ID NO: 66737 - protein, 8 aa, Mycobacterium avium
GVSAGEGV

SEQ ID NO: 66738 - protein, 7 aa, Mycobacterium avium
GVSDERV

SEQ ID NO: 66739 - protein, 7 aa, Mycobacterium avium
GVSEAAK

SEQ ID NO: 66740 - protein, 4 aa, Mycobacterium avium
GVSG

SEQ ID NO: 66741 - protein, 5 aa, Mycobacterium avium
GVSGR

SEQ ID NO: 66742 - protein, 7 aa, Mycobacterium avium
GVSGYDR

SEQ ID NO: 66743 - protein, 4 aa, Mycobacterium avium
GVSP

SEQ ID NO: 66744 - protein, 6 aa, Mycobacterium avium
GVSPAD

SEQ ID NO: 66745 - protein, 7 aa, Mycobacterium avium
GVSPSDV

SEQ ID NO: 66746 - protein, 4 aa, Mycobacterium avium
GVSR

SEQ ID NO: 66747 - protein, 5 aa, Mycobacterium avium
GVSSG

SEQ ID NO: 66748 - protein, 11 aa, Mycobacterium avium
GVSSPGSDAWS

SEQ ID NO: 66749 - protein, 6 aa, Mycobacterium avium
GVSSTS

SEQ ID NO: 66750 - protein, 6 aa, Mycobacterium avium
GVTADP

SEQ ID NO: 66751 - protein, 11 aa, Mycobacterium avium
GVTAKQPPRTL

SEQ ID NO: 66752 - protein, 13 aa, Mycobacterium avium
GVTDTGLDDQDAD

SEQ ID NO: 66753 - protein, 5 aa, Mycobacterium avium
GVTIE

SEQ ID NO: 66754 - protein, 4 aa, Mycobacterium avium
GVTS

SEQ ID NO: 66755 - protein, 7 aa, Mycobacterium avium
GVTTGQA

SEQ ID NO: 66756 - protein, 49 aa, Mycobacterium avium
GVVPPSAGGPGVGGAGLPGPTAPASPVPAGAPSFSAASGTVPSGVPGVH

SEQ ID NO: 66757 - protein, 9 aa, Mycobacterium avium
GWDPPRYTT

SEQ ID NO: 66758 - protein, 5 aa, Mycobacterium avium
GWPAA

SEQ ID NO: 66759 - protein, 6 aa, Mycobacterium avium
GWPASR

SEQ ID NO: 66760 - protein, 7 aa, Mycobacterium avium
GWPEQSM

SEQ ID NO: 66761 - protein, 19 aa, Mycobacterium avium
GWPSPRATSPSNGIGPQSL

SEQ ID NO: 66762 - protein, 16 aa, Mycobacterium avium
GWRDHSRGPRGADTLT

SEQ ID NO: 66763 - protein, 13 aa, Mycobacterium avium
GWRPPVKTGAASA

SEQ ID NO: 66764 - protein, 13 aa, Mycobacterium avium
GWSAPPGAGARDL

SEQ ID NO: 66765 - protein, 5 aa, Mycobacterium avium
GWSPA

SEQ ID NO: 66766 - protein, 8 aa, Mycobacterium avium
GWSTAAPE

SEQ ID NO: 66767 - protein, 6 aa, Mycobacterium avium
GWSTAN

SEQ ID NO: 66768 - protein, 4 aa, Mycobacterium avium
GWTG

SEQ ID NO: 66769 - protein, 17 aa, Mycobacterium avium
GWVTSGPELPEWDGTGL

SEQ ID NO: 66770 - protein, 5 aa, Mycobacterium avium
GYADL

SEQ ID NO: 66771 - protein, 12 aa, Mycobacterium avium
GYAPAANHGVGR

SEQ ID NO: 66772 - protein, 6 aa, Mycobacterium avium
GYASSF

SEQ ID NO: 66773 - protein, 9 aa, Mycobacterium avium
GYCRDDDPQ

SEQ ID NO: 66774 - protein, 10 aa, Mycobacterium avium
GYDDTSVQDI

SEQ ID NO: 66775 - protein, 4 aa, Mycobacterium avium
GYDE

SEQ ID NO: 66776 - protein, 18 aa, Mycobacterium avium
GYDQTTTDEIAEAAGVSP

SEQ ID NO: 66777 - protein, 7 aa, Mycobacterium avium
GYEKSGL

SEQ ID NO: 66778 - protein, 7 aa, Mycobacterium avium
GYERDAR

SEQ ID NO: 66779 - protein, 15 aa, Mycobacterium avium
GYGADKLASPVGRGR

SEQ ID NO: 66780 - protein, 13 aa, Mycobacterium avium
GYGDSYAADAAGD

SEQ ID NO: 66781 - protein, 12 aa, Mycobacterium avium
GYGNNPNTASGL

SEQ ID NO: 66782 - protein, 9 aa, Mycobacterium avium
GYGRAGKPT

SEQ ID NO: 66783 - protein, 23 aa, Mycobacterium avium
GYGTGAFGDANNLANARNTTVDA

SEQ ID NO: 66784 - protein, 13 aa, Mycobacterium avium
GYGVSGKPTRAGW

SEQ ID NO: 66785 - protein, 5 aa, Mycobacterium avium
GYKQP

SEQ ID NO: 66786 - protein, 7 aa, Mycobacterium avium
GYKQPRR

SEQ ID NO: 66787 - protein, 5 aa, Mycobacterium avium
GYLRP

SEQ ID NO: 66788 - protein, 6 aa, Mycobacterium avium
GYNEDE

SEQ ID NO: 66789 - protein, 4 aa, Mycobacterium avium
GYNQ

SEQ ID NO: 66790 - protein, 111 aa, Mycobacterium avium
GYPEPAQGGYPQSYEQRPPAPPGYSGQGYDQGYRPPGGGYPPPGGQPAGGPQGYGGYGDYGRGPARPDEGGYAPPEQRPAYPEQGGGYDQGYPQGGGYGRQDYGSAEYTQY

SEQ ID NO: 66791 - protein, 7 aa, Mycobacterium avium
GYPGDGQ

SEQ ID NO: 66792 - protein, 5 aa, Mycobacterium avium
GYPSG

SEQ ID NO: 66793 - protein, 4 aa, Mycobacterium avium
GYRP

SEQ ID NO: 66794 - protein, 5 aa, Mycobacterium avium
GYSKE

SEQ ID NO: 66795 - protein, 5 aa, Mycobacterium avium
GYTGA

SEQ ID NO: 66796 - protein, 6 aa, Mycobacterium avium
GYTGAG

SEQ ID NO: 66797 - protein, 6 aa, Mycobacterium avium
GYTNEH

SEQ ID NO: 66798 - protein, 12 aa, Mycobacterium avium
GYTPDDTHRYQS

SEQ ID NO: 66799 - protein, 5 aa, Mycobacterium avium
GYVGE

SEQ ID NO: 66800 - protein, 5 aa, Mycobacterium avium
GYYEQ

SEQ ID NO: 66801 - protein, 19 aa, Mycobacterium avium
HAAAQESARRLDASAEQID

SEQ ID NO: 66802 - protein, 7 aa, Mycobacterium avium
HAAGENP

SEQ ID NO: 66803 - protein, 7 aa, Mycobacterium avium
HAANNPD

SEQ ID NO: 66804 - protein, 17 aa, Mycobacterium avium
HAASNGKTWEGKSIPGL

SEQ ID NO: 66805 - protein, 13 aa, Mycobacterium avium
HAATTKAPRRPWT

SEQ ID NO: 66806 - protein, 8 aa, Mycobacterium avium
HADEEERD

SEQ ID NO: 66807 - protein, 7 aa, Mycobacterium avium
HADPGDI

SEQ ID NO: 66808 - protein, 5 aa, Mycobacterium avium
HADQP

SEQ ID NO: 66809 - protein, 4 aa, Mycobacterium avium
HADR

SEQ ID NO: 66810 - protein, 7 aa, Mycobacterium avium
HAEAPIP

SEQ ID NO: 66811 - protein, 6 aa, Mycobacterium avium
HAEARP

SEQ ID NO: 66812 - protein, 7 aa, Mycobacterium avium
HAELTAE

SEQ ID NO: 66813 - protein, 5 aa, Mycobacterium avium
HAEPA

SEQ ID NO: 66814 - protein, 13 aa, Mycobacterium avium
HAEPSGPTACPPQ

SEQ ID NO: 66815 - protein, 7 aa, Mycobacterium avium
HAGPEFG

SEQ ID NO: 66816 - protein, 10 aa, Mycobacterium avium
HAGPRTGPEV

SEQ ID NO: 66817 - protein, 6 aa, Mycobacterium avium
HAGPVA

SEQ ID NO: 66818 - protein, 24 aa, Mycobacterium avium
HAGQAEPPGTAVAPAVGGSPGPEW

SEQ ID NO: 66819 - protein, 6 aa, Mycobacterium avium
HAGQRG

SEQ ID NO: 66820 - protein, 4 aa, Mycobacterium avium
HAGR

SEQ ID NO: 66821 - protein, 8 aa, Mycobacterium avium
HAGSDPAP

SEQ ID NO: 66822 - protein, 8 aa, Mycobacterium avium
HAGTPGLD

SEQ ID NO: 66823 - protein, 20 aa, Mycobacterium avium
HAHDPSADGWAEQSDGLQGT

SEQ ID NO: 66824 - protein, 6 aa, Mycobacterium avium
HAKPGT

SEQ ID NO: 66825 - protein, 6 aa, Mycobacterium avium
HALSDD

SEQ ID NO: 66826 - protein, 5 aa, Mycobacterium avium
HANAH

SEQ ID NO: 66827 - protein, 11 aa, Mycobacterium avium
HANSAKDHVRQ

SEQ ID NO: 66828 - protein, 9 aa, Mycobacterium avium
HAPDDPAPL

SEQ ID NO: 66829 - protein, 5 aa, Mycobacterium avium
HAPGW

SEQ ID NO: 66830 - protein, 6 aa, Mycobacterium avium
HAPKTV

SEQ ID NO: 66831 - protein, 10 aa, Mycobacterium avium
HAPSAENSQP

SEQ ID NO: 66832 - protein, 10 aa, Mycobacterium avium
HAPSAENTQP

SEQ ID NO: 66833 - protein, 17 aa, Mycobacterium avium
HAQEAGGPADQPRRRAG

SEQ ID NO: 66834 - protein, 6 aa, Mycobacterium avium
HAQGRL

SEQ ID NO: 66835 - protein, 4 aa, Mycobacterium avium
HAQQ

SEQ ID NO: 66836 - protein, 9 aa, Mycobacterium avium
HAQRGEPAR

SEQ ID NO: 66837 - protein, 23 aa, Mycobacterium avium
HAQSSAANVRATEDELMRLCRDG

SEQ ID NO: 66838 - protein, 8 aa, Mycobacterium avium
HARGNDFP

SEQ ID NO: 66839 - protein, 4 aa, Mycobacterium avium
HARP

SEQ ID NO: 66840 - protein, 5 aa, Mycobacterium avium
HARSA

SEQ ID NO: 66841 - protein, 17 aa, Mycobacterium avium
HASAGPAADIVAGLAAT

SEQ ID NO: 66842 - protein, 9 aa, Mycobacterium avium
HASRPQRHD

SEQ ID NO: 66843 - protein, 8 aa, Mycobacterium avium
HASSPAVV

SEQ ID NO: 66844 - protein, 6 aa, Mycobacterium avium
HATADA

SEQ ID NO: 66845 - protein, 15 aa, Mycobacterium avium
HATAEQVEAARHDSK

SEQ ID NO: 66846 - protein, 7 aa, Mycobacterium avium
HATAGRP

SEQ ID NO: 66847 - protein, 12 aa, Mycobacterium avium
HATANPAAQPEG

SEQ ID NO: 66848 - protein, 14 aa, Mycobacterium avium
HAVGPQADERPGPF

SEQ ID NO: 66849 - protein, 12 aa, Mycobacterium avium
HCAEGSPAQRPA

SEQ ID NO: 66850 - protein, 12 aa, Mycobacterium avium
HCAEGSPARRPA

SEQ ID NO: 66851 - protein, 12 aa, Mycobacterium avium
HCSPDSRALSGR

SEQ ID NO: 66852 - protein, 11 aa, Mycobacterium avium
HDADTAVRRGR

SEQ ID NO: 66853 - protein, 12 aa, Mycobacterium avium
HDADTAVRRGRQ

SEQ ID NO: 66854 - protein, 6 aa, Mycobacterium avium
HDAGEI

SEQ ID NO: 66855 - protein, 4 aa, Mycobacterium avium
HDAH

SEQ ID NO: 66856 - protein, 4 aa, Mycobacterium avium
HDDE

SEQ ID NO: 66857 - protein, 6 aa, Mycobacterium avium
HDDPDQ

SEQ ID NO: 66858 - protein, 7 aa, Mycobacterium avium
HDDRRAA

SEQ ID NO: 66859 - protein, 8 aa, Mycobacterium avium
HDDRRAAL

SEQ ID NO: 66860 - protein, 9 aa, Mycobacterium avium
HDDSGAPKV

SEQ ID NO: 66861 - protein, 9 aa, Mycobacterium avium
HDDVATGNF

SEQ ID NO: 66862 - protein, 15 aa, Mycobacterium avium
HDEGAAGADAARAAR

SEQ ID NO: 66863 - protein, 7 aa, Mycobacterium avium
HDENEFH

SEQ ID NO: 66864 - protein, 6 aa, Mycobacterium avium
HDEPDE

SEQ ID NO: 66865 - protein, 5 aa, Mycobacterium avium
HDGDA

SEQ ID NO: 66866 - protein, 9 aa, Mycobacterium avium
HDGDGGRYI

SEQ ID NO: 66867 - protein, 19 aa, Mycobacterium avium
HDGNSTAEAVTRETAGTAA

SEQ ID NO: 66868 - protein, 8 aa, Mycobacterium avium
HDGQITKQ

SEQ ID NO: 66869 - protein, 9 aa, Mycobacterium avium
HDGQITKQG

SEQ ID NO: 66870 - protein, 32 aa, Mycobacterium avium
HDHDERPAASPANGGSWSKSRDFTDDPQRAAA

SEQ ID NO: 66871 - protein, 33 aa, Mycobacterium avium
HDHDERPAASPANGGSWSKSRDFTDDPQRAAAV

SEQ ID NO: 66872 - protein, 5 aa, Mycobacterium avium
HDHTG

SEQ ID NO: 66873 - protein, 22 aa, Mycobacterium avium
HDIGSKQARAEFGPGPGQHPTV

SEQ ID NO: 66874 - protein, 9 aa, Mycobacterium avium
HDLEPAGTF

SEQ ID NO: 66875 - protein, 28 aa, Mycobacterium avium
HDNGTRNPKAQFRSPVSRDTIDNAPKVA

SEQ ID NO: 66876 - protein, 18 aa, Mycobacterium avium
HDPDGDEVLGSATIAGTS

SEQ ID NO: 66877 - protein, 7 aa, Mycobacterium avium
HDPEATV

SEQ ID NO: 66878 - protein, 8 aa, Mycobacterium avium
HDPERPVG

SEQ ID NO: 66879 - protein, 5 aa, Mycobacterium avium
HDPFE

SEQ ID NO: 66880 - protein, 12 aa, Mycobacterium avium
HDPKSKTAKGLR

SEQ ID NO: 66881 - protein, 4 aa, Mycobacterium avium
HDPR

SEQ ID NO: 66882 - protein, 8 aa, Mycobacterium avium
HDQANGTD

SEQ ID NO: 66883 - protein, 15 aa, Mycobacterium avium
HDQRRPGSRGQQQFP

SEQ ID NO: 66884 - protein, 9 aa, Mycobacterium avium
HDQSKQGIQ

SEQ ID NO: 66885 - protein, 24 aa, Mycobacterium avium
HDRPGGDADAGRAGRQPRDARGAG

SEQ ID NO: 66886 - protein, 7 aa, Mycobacterium avium
HDRSTTA

SEQ ID NO: 66887 - protein, 6 aa, Mycobacterium avium
HDSGAT

SEQ ID NO: 66888 - protein, 10 aa, Mycobacterium avium
HDTGEPPADL

SEQ ID NO: 66889 - protein, 9 aa, Mycobacterium avium
HDVGRPRAG

SEQ ID NO: 66890 - protein, 7 aa, Mycobacterium avium
HDVGTYP

SEQ ID NO: 66891 - protein, 8 aa, Mycobacterium avium
HEEAPEEI

SEQ ID NO: 66892 - protein, 10 aa, Mycobacterium avium
HEENKKAFAG

SEQ ID NO: 66893 - protein, 5 aa, Mycobacterium avium
HEGGG

SEQ ID NO: 66894 - protein, 6 aa, Mycobacterium avium
HEGSGV

SEQ ID NO: 66895 - protein, 11 aa, Mycobacterium avium
HEKAPKTVRSA

SEQ ID NO: 66896 - protein, 9 aa, Mycobacterium avium
HEKNETYPE

SEQ ID NO: 66897 - protein, 20 aa, Mycobacterium avium
HENDENPINGSAEVQRTTTS

SEQ ID NO: 66898 - protein, 5 aa, Mycobacterium avium
HEPAA

SEQ ID NO: 66899 - protein, 6 aa, Mycobacterium avium
HEPNGG

SEQ ID NO: 66900 - protein, 9 aa, Mycobacterium avium
HEPPPTTPD

SEQ ID NO: 66901 - protein, 6 aa, Mycobacterium avium
HERTNV

SEQ ID NO: 66902 - protein, 8 aa, Mycobacterium avium
HESQDTLN

SEQ ID NO: 66903 - protein, 10 aa, Mycobacterium avium
HEYGSTSEDL

SEQ ID NO: 66904 - protein, 5 aa, Mycobacterium avium
HFPPG

SEQ ID NO: 66905 - protein, 8 aa, Mycobacterium avium
HGAARRPA

SEQ ID NO: 66906 - protein, 4 aa, Mycobacterium avium
HGAD

SEQ ID NO: 66907 - protein, 43 aa, Mycobacterium avium
HGAGGGGVRRGRSRGVAAGRQAGRGGGDERGGRGAGQHPGGGA

SEQ ID NO: 66908 - protein, 8 aa, Mycobacterium avium
HGAGPGQS

SEQ ID NO: 66909 - protein, 16 aa, Mycobacterium avium
HGAPAGSYTYPFTLSR

SEQ ID NO: 66910 - protein, 13 aa, Mycobacterium avium
HGAPGGHEPDTRL

SEQ ID NO: 66911 - protein, 8 aa, Mycobacterium avium
HGAPGYEG

SEQ ID NO: 66912 - protein, 8 aa, Mycobacterium avium
HGAQRGVA

SEQ ID NO: 66913 - protein, 9 aa, Mycobacterium avium
HGASPAHDA

SEQ ID NO: 66914 - protein, 14 aa, Mycobacterium avium
HGDDVEEALPSRPV

SEQ ID NO: 66915 - protein, 30 aa, Mycobacterium avium
HGDGYDQAGIQAAEGPLSPLPDLPDNPKQF

SEQ ID NO: 66916 - protein, 9 aa, Mycobacterium avium
HGDPDNPDD

SEQ ID NO: 66917 - protein, 6 aa, Mycobacterium avium
HGDRYG

SEQ ID NO: 66918 - protein, 4 aa, Mycobacterium avium
HGEA

SEQ ID NO: 66919 - protein, 9 aa, Mycobacterium avium
HGEDHAEQG

SEQ ID NO: 66920 - protein, 7 aa, Mycobacterium avium
HGEPPPE

SEQ ID NO: 66921 - protein, 11 aa, Mycobacterium avium
HGESAKLRTDY

SEQ ID NO: 66922 - protein, 10 aa, Mycobacterium avium
HGEVEGAPRV

SEQ ID NO: 66923 - protein, 17 aa, Mycobacterium avium
HGGELTAGAEVTEPPGG

SEQ ID NO: 66924 - protein, 9 aa, Mycobacterium avium
HGGGAAAGT

SEQ ID NO: 66925 - protein, 11 aa, Mycobacterium avium
HGGLGAGNEVA

SEQ ID NO: 66926 - protein, 6 aa, Mycobacterium avium
HGGQPV

SEQ ID NO: 66927 - protein, 4 aa, Mycobacterium avium
HGGR

SEQ ID NO: 66928 - protein, 5 aa, Mycobacterium avium
HGGRS

SEQ ID NO: 66929 - protein, 18 aa, Mycobacterium avium
HGGSSIPKYSHADAPNPL

SEQ ID NO: 66930 - protein, 9 aa, Mycobacterium avium
HGHPNAQET

SEQ ID NO: 66931 - protein, 10 aa, Mycobacterium avium
HGHRRGGAEH

SEQ ID NO: 66932 - protein, 20 aa, Mycobacterium avium
HGHSDYPRFPGNGGTRTTNY

SEQ ID NO: 66933 - protein, 11 aa, Mycobacterium avium
HGIPDDGGTAV

SEQ ID NO: 66934 - protein, 27 aa, Mycobacterium avium
HGLPTGESELQPAQREPLRDKTFDDAY

SEQ ID NO: 66935 - protein, 21 aa, Mycobacterium avium
HGLPTGESELQPARREPLRDK

SEQ ID NO: 66936 - protein, 10 aa, Mycobacterium avium
HGLTDPQDHG

SEQ ID NO: 66937 - protein, 12 aa, Mycobacterium avium
HGMQAPKPPEGQ

SEQ ID NO: 66938 - protein, 12 aa, Mycobacterium avium
HGMQAPNPAEGQ

SEQ ID NO: 66939 - protein, 19 aa, Mycobacterium avium
HGNATTIGAERRLNPFLEG

SEQ ID NO: 66940 - protein, 11 aa, Mycobacterium avium
HGNGSPGTLQH

SEQ ID NO: 66941 - protein, 6 aa, Mycobacterium avium
HGNGTQ

SEQ ID NO: 66942 - protein, 18 aa, Mycobacterium avium
HGPERQGVRGARRGHPHK

SEQ ID NO: 66943 - protein, 7 aa, Mycobacterium avium
HGPNEGN

SEQ ID NO: 66944 - protein, 10 aa, Mycobacterium avium
HGPNPLPPNG

SEQ ID NO: 66945 - protein, 15 aa, Mycobacterium avium
HGPQIDKGARWDPAE

SEQ ID NO: 66946 - protein, 18 aa, Mycobacterium avium
HGPSDADVRHDTDDADDV

SEQ ID NO: 66947 - protein, 18 aa, Mycobacterium avium
HGPSDADVRHDTDDGDDV

SEQ ID NO: 66948 - protein, 4 aa, Mycobacterium avium
HGPT

SEQ ID NO: 66949 - protein, 11 aa, Mycobacterium avium
HGQGAPPEFDN

SEQ ID NO: 66950 - protein, 4 aa, Mycobacterium avium
HGQL

SEQ ID NO: 66951 - protein, 6 aa, Mycobacterium avium
HGQQMQ

SEQ ID NO: 66952 - protein, 19 aa, Mycobacterium avium
HGRDLGQQHAGDGDRGRGQ

SEQ ID NO: 66953 - protein, 6 aa, Mycobacterium avium
HGRGDH

SEQ ID NO: 66954 - protein, 6 aa, Mycobacterium avium
HGRLDP

SEQ ID NO: 66955 - protein, 5 aa, Mycobacterium avium
HGRSM

SEQ ID NO: 66956 - protein, 23 aa, Mycobacterium avium
HGRTYADHARRSLDRADTAAEPV

SEQ ID NO: 66957 - protein, 7 aa, Mycobacterium avium
HGSDPSD

SEQ ID NO: 66958 - protein, 5 aa, Mycobacterium avium
HGSHD

SEQ ID NO: 66959 - protein, 24 aa, Mycobacterium avium
HGSIAGADYDPVADRYQPGAREET

SEQ ID NO: 66960 - protein, 6 aa, Mycobacterium avium
HGSRAV

SEQ ID NO: 66961 - protein, 9 aa, Mycobacterium avium
HGSSIYSSN

SEQ ID NO: 66962 - protein, 8 aa, Mycobacterium avium
HGTDQQKK

SEQ ID NO: 66963 - protein, 6 aa, Mycobacterium avium
HGTEDQ

SEQ ID NO: 66964 - protein, 5 aa, Mycobacterium avium
HGTGE

SEQ ID NO: 66965 - protein, 11 aa, Mycobacterium avium
HGTGTPVGDPI

SEQ ID NO: 66966 - protein, 14 aa, Mycobacterium avium
HGTGTRVGDAVETQ

SEQ ID NO: 66967 - protein, 5 aa, Mycobacterium avium
HGTST

SEQ ID NO: 66968 - protein, 27 aa, Mycobacterium avium
HGTTLGRNESIRRGVEGATATGRGQHS

SEQ ID NO: 66969 - protein, 7 aa, Mycobacterium avium
HGTTPPM

SEQ ID NO: 66970 - protein, 7 aa, Mycobacterium avium
HGYAASS

SEQ ID NO: 66971 - protein, 8 aa, Mycobacterium avium
HGYAASSL

SEQ ID NO: 66972 - protein, 13 aa, Mycobacterium avium
HGYADPALADDPA

SEQ ID NO: 66973 - protein, 7 aa, Mycobacterium avium
HGYDTTD

SEQ ID NO: 66974 - protein, 14 aa, Mycobacterium avium
HGYGTKGDLASQGG

SEQ ID NO: 66975 - protein, 14 aa, Mycobacterium avium
HGYGTRGDLASQGG

SEQ ID NO: 66976 - protein, 5 aa, Mycobacterium avium
HHGEV

SEQ ID NO: 66977 - protein, 8 aa, Mycobacterium avium
HHGGPADL

SEQ ID NO: 66978 - protein, 7 aa, Mycobacterium avium
HHGPKTL

SEQ ID NO: 66979 - protein, 16 aa, Mycobacterium avium
HHGQGRDQRNRGHSRP

SEQ ID NO: 66980 - protein, 28 aa, Mycobacterium avium
HHGQRSRHVGATGPARRDGRGLHPGGQR

SEQ ID NO: 66981 - protein, 10 aa, Mycobacterium avium
HHGRDDLGGT

SEQ ID NO: 66982 - protein, 15 aa, Mycobacterium avium
HHPRQRGIASGGTAV

SEQ ID NO: 66983 - protein, 17 aa, Mycobacterium avium
HHPSKRAATTAHPRRQL

SEQ ID NO: 66984 - protein, 36 aa, Mycobacterium avium
HHQPARRHGQRHGDQHRRPTRPRRHGPPRARRPGHR

SEQ ID NO: 66985 - protein, 4 aa, Mycobacterium avium
HHRG

SEQ ID NO: 66986 - protein, 13 aa, Mycobacterium avium
HHRPGPPPASGNT

SEQ ID NO: 66987 - protein, 4 aa, Mycobacterium avium
HHSD

SEQ ID NO: 66988 - protein, 10 aa, Mycobacterium avium
HIETDDGRNI

SEQ ID NO: 66989 - protein, 6 aa, Mycobacterium avium
HIGDSR

SEQ ID NO: 66990 - protein, 7 aa, Mycobacterium avium
HIGDSRT

SEQ ID NO: 66991 - protein, 17 aa, Mycobacterium avium
HISETPVHRGDPGPNVD

SEQ ID NO: 66992 - protein, 9 aa, Mycobacterium avium
HISPDEGRA

SEQ ID NO: 66993 - protein, 6 aa, Mycobacterium avium
HITSDS

SEQ ID NO: 66994 - protein, 13 aa, Mycobacterium avium
HKERRAVTGTSRC

SEQ ID NO: 66995 - protein, 5 aa, Mycobacterium avium
HKGSV

SEQ ID NO: 66996 - protein, 46 aa, Mycobacterium avium
HKMTEPSAKSKAVAAPERLEPPAGSRSSGATTVSAGMGRASSLGGM

SEQ ID NO: 66997 - protein, 14 aa, Mycobacterium avium
HKPTEARPRDDAGI

SEQ ID NO: 66998 - protein, 9 aa, Mycobacterium avium
HKPTKQGDA

SEQ ID NO: 66999 - protein, 28 aa, Mycobacterium avium
HKRGSDSEAKKFAKQATEHRGTANRTNR

SEQ ID NO: 67000 - protein, 32 aa, Mycobacterium avium
HKRREPLTQPGPNLDRVSGSGHIADKPPLTDP

SEQ ID NO: 67001 - protein, 11 aa, Mycobacterium avium
HLPRPGQRQRH

SEQ ID NO: 67002 - protein, 8 aa, Mycobacterium avium
HLQTGGDH

SEQ ID NO: 67003 - protein, 18 aa, Mycobacterium avium
HLRGQRRAQQPGTERDQK

SEQ ID NO: 67004 - protein, 6 aa, Mycobacterium avium
HLRSGA

SEQ ID NO: 67005 - protein, 9 aa, Mycobacterium avium
HMADNGGGT

SEQ ID NO: 67006 - protein, 4 aa, Mycobacterium avium
HNDE

SEQ ID NO: 67007 - protein, 11 aa, Mycobacterium avium
HNDGPVDDSPL

SEQ ID NO: 67008 - protein, 9 aa, Mycobacterium avium
HNDIRDGVR

SEQ ID NO: 67009 - protein, 19 aa, Mycobacterium avium
HNDIRDGVRATNAAQPGTE

SEQ ID NO: 67010 - protein, 15 aa, Mycobacterium avium
HNDRPDVRDKPPLTG

SEQ ID NO: 67011 - protein, 15 aa, Mycobacterium avium
HNDRPEVRTKPPLTG

SEQ ID NO: 67012 - protein, 9 aa, Mycobacterium avium
HNDTGGPMP

SEQ ID NO: 67013 - protein, 11 aa, Mycobacterium avium
HNESADRPLDD

SEQ ID NO: 67014 - protein, 6 aa, Mycobacterium avium
HNHPSY

SEQ ID NO: 67015 - protein, 14 aa, Mycobacterium avium
HNHRAGEQVRPLPG

SEQ ID NO: 67016 - protein, 7 aa, Mycobacterium avium
HNPAAYN

SEQ ID NO: 67017 - protein, 7 aa, Mycobacterium avium
HNPDGSD

SEQ ID NO: 67018 - protein, 9 aa, Mycobacterium avium
HNPTGTVES

SEQ ID NO: 67019 - protein, 12 aa, Mycobacterium avium
HNRAYSDGDRDG

SEQ ID NO: 67020 - protein, 9 aa, Mycobacterium avium
HNRNGGRRW

SEQ ID NO: 67021 - protein, 8 aa, Mycobacterium avium
HNSKEEPV

SEQ ID NO: 67022 - protein, 18 aa, Mycobacterium avium
HPAAAADQRDGVRGAGGL

SEQ ID NO: 67023 - protein, 6 aa, Mycobacterium avium
HPADGR

SEQ ID NO: 67024 - protein, 22 aa, Mycobacterium avium
HPADPSRYHTATRDGVATPLGD

SEQ ID NO: 67025 - protein, 5 aa, Mycobacterium avium
HPADR

SEQ ID NO: 67026 - protein, 4 aa, Mycobacterium avium
HPAF

SEQ ID NO: 67027 - protein, 10 aa, Mycobacterium avium
HPAPAAAGAQ

SEQ ID NO: 67028 - protein, 8 aa, Mycobacterium avium
HPAPAIAG

SEQ ID NO: 67029 - protein, 9 aa, Mycobacterium avium
HPAPALPGH

SEQ ID NO: 67030 - protein, 20 aa, Mycobacterium avium
HPAPPAPAPAPAAPRPQPDA

SEQ ID NO: 67031 - protein, 11 aa, Mycobacterium avium
HPAPPPATAYG

SEQ ID NO: 67032 - protein, 5 aa, Mycobacterium avium
HPAPR

SEQ ID NO: 67033 - protein, 12 aa, Mycobacterium avium
HPAPRRPGQNRR

SEQ ID NO: 67034 - protein, 9 aa, Mycobacterium avium
HPATRAADR

SEQ ID NO: 67035 - protein, 9 aa, Mycobacterium avium
HPDAEHKAR

SEQ ID NO: 67036 - protein, 8 aa, Mycobacterium avium
HPDGPPVI

SEQ ID NO: 67037 - protein, 7 aa, Mycobacterium avium
HPDGTAS

SEQ ID NO: 67038 - protein, 4 aa, Mycobacterium avium
HPDK

SEQ ID NO: 67039 - protein, 7 aa, Mycobacterium avium
HPDPDLN

SEQ ID NO: 67040 - protein, 14 aa, Mycobacterium avium
HPDRPVGPTPEDQP

SEQ ID NO: 67041 - protein, 17 aa, Mycobacterium avium
HPDTSPPDSATEGSERL

SEQ ID NO: 67042 - protein, 10 aa, Mycobacterium avium
HPDVADRAGA

SEQ ID NO: 67043 - protein, 11 aa, Mycobacterium avium
HPDWANGKTPF

SEQ ID NO: 67044 - protein, 9 aa, Mycobacterium avium
HPEAEDFDN

SEQ ID NO: 67045 - protein, 10 aa, Mycobacterium avium
HPEDDAESFD

SEQ ID NO: 67046 - protein, 15 aa, Mycobacterium avium
HPEGEQFYRPLFIQR

SEQ ID NO: 67047 - protein, 8 aa, Mycobacterium avium
HPEGLGPN

SEQ ID NO: 67048 - protein, 8 aa, Mycobacterium avium
HPEGPPVI

SEQ ID NO: 67049 - protein, 12 aa, Mycobacterium avium
HPENEQVEQALT

SEQ ID NO: 67050 - protein, 14 aa, Mycobacterium avium
HPEPLRRGADRTIT

SEQ ID NO: 67051 - protein, 6 aa, Mycobacterium avium
HPEQRD

SEQ ID NO: 67052 - protein, 6 aa, Mycobacterium avium
HPEQRN

SEQ ID NO: 67053 - protein, 5 aa, Mycobacterium avium
HPETA

SEQ ID NO: 67054 - protein, 8 aa, Mycobacterium avium
HPEVAEQK

SEQ ID NO: 67055 - protein, 11 aa, Mycobacterium avium
HPFGRPGQAAD

SEQ ID NO: 67056 - protein, 6 aa, Mycobacterium avium
HPGAAK

SEQ ID NO: 67057 - protein, 12 aa, Mycobacterium avium
HPGAAKAITAAT

SEQ ID NO: 67058 - protein, 5 aa, Mycobacterium avium
HPGEV

SEQ ID NO: 67059 - protein, 7 aa, Mycobacterium avium
HPGEWNP

SEQ ID NO: 67060 - protein, 6 aa, Mycobacterium avium
HPGGEP

SEQ ID NO: 67061 - protein, 36 aa, Mycobacterium avium
HPGGTQATAPSSSLIAPPEQRSGRRRGHLRVLPDPS

SEQ ID NO: 67062 - protein, 8 aa, Mycobacterium avium
HPGHADDE

SEQ ID NO: 67063 - protein, 12 aa, Mycobacterium avium
HPGPVNTPMGGG

SEQ ID NO: 67064 - protein, 4 aa, Mycobacterium avium
HPGQ

SEQ ID NO: 67065 - protein, 27 aa, Mycobacterium avium
HPGSGFAERAGQEARGGQSRSAPIADA

SEQ ID NO: 67066 - protein, 6 aa, Mycobacterium avium
HPGTAR

SEQ ID NO: 67067 - protein, 4 aa, Mycobacterium avium
HPGY

SEQ ID NO: 67068 - protein, 14 aa, Mycobacterium avium
HPMDAGRKGQKGIE

SEQ ID NO: 67069 - protein, 10 aa, Mycobacterium avium
HPMTEPTAEI

SEQ ID NO: 67070 - protein, 4 aa, Mycobacterium avium
HPNA

SEQ ID NO: 67071 - protein, 5 aa, Mycobacterium avium
HPNAQ

SEQ ID NO: 67072 - protein, 9 aa, Mycobacterium avium
HPNGPGGLR

SEQ ID NO: 67073 - protein, 8 aa, Mycobacterium avium
HPPADAGE

SEQ ID NO: 67074 - protein, 6 aa, Mycobacterium avium
HPPAGT

SEQ ID NO: 67075 - protein, 6 aa, Mycobacterium avium
HPPDAA

SEQ ID NO: 67076 - protein, 4 aa, Mycobacterium avium
HPPP

SEQ ID NO: 67077 - protein, 7 aa, Mycobacterium avium
HPPQPFD

SEQ ID NO: 67078 - protein, 34 aa, Mycobacterium avium
HPPRPSHQGNSGFGRPAPGGGVAGRGRGRLRTPR

SEQ ID NO: 67079 - protein, 12 aa, Mycobacterium avium
HPQARPADPTVA

SEQ ID NO: 67080 - protein, 8 aa, Mycobacterium avium
HPQQGNAY

SEQ ID NO: 67081 - protein, 15 aa, Mycobacterium avium
HPRGAVDGRAEGRNR

SEQ ID NO: 67082 - protein, 4 aa, Mycobacterium avium
HPRP

SEQ ID NO: 67083 - protein, 11 aa, Mycobacterium avium
HPRPAGGPSHH

SEQ ID NO: 67084 - protein, 8 aa, Mycobacterium avium
HPRRDTSM

SEQ ID NO: 67085 - protein, 8 aa, Mycobacterium avium
HPRRDTTV

SEQ ID NO: 67086 - protein, 8 aa, Mycobacterium avium
HPRRGGQH

SEQ ID NO: 67087 - protein, 5 aa, Mycobacterium avium
HPRRR

SEQ ID NO: 67088 - protein, 12 aa, Mycobacterium avium
HPRSPTTGQPLT

SEQ ID NO: 67089 - protein, 4 aa, Mycobacterium avium
HPRT

SEQ ID NO: 67090 - protein, 7 aa, Mycobacterium avium
HPSDRLS

SEQ ID NO: 67091 - protein, 14 aa, Mycobacterium avium
HPSGSATGSSAAPR

SEQ ID NO: 67092 - protein, 6 aa, Mycobacterium avium
HPSPDA

SEQ ID NO: 67093 - protein, 13 aa, Mycobacterium avium
HPSPTGWRTDPAE

SEQ ID NO: 67094 - protein, 5 aa, Mycobacterium avium
HPSRA

SEQ ID NO: 67095 - protein, 4 aa, Mycobacterium avium
HPTN

SEQ ID NO: 67096 - protein, 8 aa, Mycobacterium avium
HPVAGSGA

SEQ ID NO: 67097 - protein, 4 aa, Mycobacterium avium
HPVG

SEQ ID NO: 67098 - protein, 26 aa, Mycobacterium avium
HPYPPTPWNANPRDVYGTPGPYEDAV

SEQ ID NO: 67099 - protein, 25 aa, Mycobacterium avium
HQAGDDGRAGHRRAPGELAEQRRER

SEQ ID NO: 67100 - protein, 7 aa, Mycobacterium avium
HQASAAA

SEQ ID NO: 67101 - protein, 6 aa, Mycobacterium avium
HQATAA

SEQ ID NO: 67102 - protein, 8 aa, Mycobacterium avium
HQDASGLT

SEQ ID NO: 67103 - protein, 4 aa, Mycobacterium avium
HQDG

SEQ ID NO: 67104 - protein, 17 aa, Mycobacterium avium
HQDGDHPINDSAEVERV

SEQ ID NO: 67105 - protein, 10 aa, Mycobacterium avium
HQDSYGGGGL

SEQ ID NO: 67106 - protein, 5 aa, Mycobacterium avium
HQGGQ

SEQ ID NO: 67107 - protein, 11 aa, Mycobacterium avium
HQGSDDTSPDC

SEQ ID NO: 67108 - protein, 11 aa, Mycobacterium avium
HQGSEDTSPDC

SEQ ID NO: 67109 - protein, 4 aa, Mycobacterium avium
HQGV

SEQ ID NO: 67110 - protein, 17 aa, Mycobacterium avium
HQNGDHPINDSAEVQRT

SEQ ID NO: 67111 - protein, 16 aa, Mycobacterium avium
HQPDPRLQGANPAMST

SEQ ID NO: 67112 - protein, 10 aa, Mycobacterium avium
HQPGQARHPE

SEQ ID NO: 67113 - protein, 13 aa, Mycobacterium avium
HQPGRRHRPVPGR

SEQ ID NO: 67114 - protein, 10 aa, Mycobacterium avium
HQQPDGSVRV

SEQ ID NO: 67115 - protein, 16 aa, Mycobacterium avium
HQQPPAAQQGAEDLPH

SEQ ID NO: 67116 - protein, 11 aa, Mycobacterium avium
HQRGQRPSVRG

SEQ ID NO: 67117 - protein, 14 aa, Mycobacterium avium
HQSSLNAHQTAVDA

SEQ ID NO: 67118 - protein, 11 aa, Mycobacterium avium
HQTRSSTTQTG

SEQ ID NO: 67119 - protein, 6 aa, Mycobacterium avium
HRAEQA

SEQ ID NO: 67120 - protein, 10 aa, Mycobacterium avium
HRAEQPGGAH

SEQ ID NO: 67121 - protein, 12 aa, Mycobacterium avium
HRAGELPGQQLD

SEQ ID NO: 67122 - protein, 52 aa, Mycobacterium avium
HRAQSAAAGAAQRPGRADPGAGARGRPARHERHRRRGDRAAAGVPAAADPYR

SEQ ID NO: 67123 - protein, 11 aa, Mycobacterium avium
HRARPEVGARP

SEQ ID NO: 67124 - protein, 6 aa, Mycobacterium avium
HRDGGQ

SEQ ID NO: 67125 - protein, 8 aa, Mycobacterium avium
HRDPGVVP

SEQ ID NO: 67126 - protein, 15 aa, Mycobacterium avium
HRDSYSRWRDNGAAG

SEQ ID NO: 67127 - protein, 16 aa, Mycobacterium avium
HRDSYSRWRDNGAAGW

SEQ ID NO: 67128 - protein, 4 aa, Mycobacterium avium
HRDT

SEQ ID NO: 67129 - protein, 8 aa, Mycobacterium avium
HREGQRPI

SEQ ID NO: 67130 - protein, 23 aa, Mycobacterium avium
HREGTHVDGRGDGDVAAAPARGV

SEQ ID NO: 67131 - protein, 6 aa, Mycobacterium avium
HREQAA

SEQ ID NO: 67132 - protein, 27 aa, Mycobacterium avium
HRGAEARRGHPERSRDQRTSDRLSQPH

SEQ ID NO: 67133 - protein, 27 aa, Mycobacterium avium
HRGAEARRGHTERSRDQRTSDRLPQPH

SEQ ID NO: 67134 - protein, 33 aa, Mycobacterium avium
HRGAKTRARARHPEGPGGAASDSDAAADAEPSS

SEQ ID NO: 67135 - protein, 5 aa, Mycobacterium avium
HRGAR

SEQ ID NO: 67136 - protein, 6 aa, Mycobacterium avium
HRGDPL

SEQ ID NO: 67137 - protein, 7 aa, Mycobacterium avium
HRGEVGG

SEQ ID NO: 67138 - protein, 19 aa, Mycobacterium avium
HRGGTGPVAGGHRRQPGRR

SEQ ID NO: 67139 - protein, 18 aa, Mycobacterium avium
HRGQRRRGRRHRLPGAGP

SEQ ID NO: 67140 - protein, 17 aa, Mycobacterium avium
HRGREGGYELARPGKDI

SEQ ID NO: 67141 - protein, 11 aa, Mycobacterium avium
HRGRTSGKQYE

SEQ ID NO: 67142 - protein, 13 aa, Mycobacterium avium
HRGWNNSAGDRTT

SEQ ID NO: 67143 - protein, 44 aa, Mycobacterium avium
HRHRTQPAVQHKEGRPAHRPADGRHAGSRGQRRAVGGPHGGFGG

SEQ ID NO: 67144 - protein, 6 aa, Mycobacterium avium
HRKAEA

SEQ ID NO: 67145 - protein, 16 aa, Mycobacterium avium
HRKAMEDAEGAEAEPA

SEQ ID NO: 67146 - protein, 16 aa, Mycobacterium avium
HRLRSDESLTLSEDPP

SEQ ID NO: 67147 - protein, 12 aa, Mycobacterium avium
HRNATTTPAPAG

SEQ ID NO: 67148 - protein, 6 aa, Mycobacterium avium
HRNPAA

SEQ ID NO: 67149 - protein, 12 aa, Mycobacterium avium
HRNPNGRNRKEA

SEQ ID NO: 67150 - protein, 10 aa, Mycobacterium avium
HRPGDAGLAR

SEQ ID NO: 67151 - protein, 10 aa, Mycobacterium avium
HRPGDSGVAR

SEQ ID NO: 67152 - protein, 15 aa, Mycobacterium avium
HRPGPDVGGRCRSTH

SEQ ID NO: 67153 - protein, 7 aa, Mycobacterium avium
HRPPYRA

SEQ ID NO: 67154 - protein, 9 aa, Mycobacterium avium
HRPRPRNLD

SEQ ID NO: 67155 - protein, 8 aa, Mycobacterium avium
HRPSGVGG

SEQ ID NO: 67156 - protein, 8 aa, Mycobacterium avium
HRQGQGRR

SEQ ID NO: 67157 - protein, 5 aa, Mycobacterium avium
HRQPA

SEQ ID NO: 67158 - protein, 5 aa, Mycobacterium avium
HRQPR

SEQ ID NO: 67159 - protein, 23 aa, Mycobacterium avium
HRQPRSPATLSPNVPDSLAAPYE

SEQ ID NO: 67160 - protein, 4 aa, Mycobacterium avium
HRRG

SEQ ID NO: 67161 - protein, 19 aa, Mycobacterium avium
HRRGAGTRRAECGRPGALP

SEQ ID NO: 67162 - protein, 11 aa, Mycobacterium avium
HRRGDTGREHH

SEQ ID NO: 67163 - protein, 16 aa, Mycobacterium avium
HRRPKTPTPQHRRRQR

SEQ ID NO: 67164 - protein, 21 aa, Mycobacterium avium
HRRPQPDDGAQRQRQPAEQLP

SEQ ID NO: 67165 - protein, 6 aa, Mycobacterium avium
HRRRQP

SEQ ID NO: 67166 - protein, 7 aa, Mycobacterium avium
HRRRRPR

SEQ ID NO: 67167 - protein, 9 aa, Mycobacterium avium
HRRSTGEGQ

SEQ ID NO: 67168 - protein, 14 aa, Mycobacterium avium
HRRTRTAARAGGRL

SEQ ID NO: 67169 - protein, 13 aa, Mycobacterium avium
HRSAEGGGWEQVQ

SEQ ID NO: 67170 - protein, 21 aa, Mycobacterium avium
HRSETAPVGPASPPGNRIAVR

SEQ ID NO: 67171 - protein, 10 aa, Mycobacterium avium
HRSHRKPRSL

SEQ ID NO: 67172 - protein, 6 aa, Mycobacterium avium
HRSPQY

SEQ ID NO: 67173 - protein, 12 aa, Mycobacterium avium
HRSQAPKSDTLG

SEQ ID NO: 67174 - protein, 5 aa, Mycobacterium avium
HRSSV

SEQ ID NO: 67175 - protein, 14 aa, Mycobacterium avium
HRSVDDAPYGGGPG

SEQ ID NO: 67176 - protein, 11 aa, Mycobacterium avium
HRTGEAQTYCP

SEQ ID NO: 67177 - protein, 10 aa, Mycobacterium avium
HRTGEVNQTD

SEQ ID NO: 67178 - protein, 12 aa, Mycobacterium avium
HRTQAPGNPLTG

SEQ ID NO: 67179 - protein, 6 aa, Mycobacterium avium
HRTSGR

SEQ ID NO: 67180 - protein, 5 aa, Mycobacterium avium
HRVPG

SEQ ID NO: 67181 - protein, 6 aa, Mycobacterium avium
HRVPGS

SEQ ID NO: 67182 - protein, 28 aa, Mycobacterium avium
HRVSEGDPLDGDPATRTQNEKSELDNGF

SEQ ID NO: 67183 - protein, 9 aa, Mycobacterium avium
HRYSDDGSE

SEQ ID NO: 67184 - protein, 9 aa, Mycobacterium avium
HSAGPLGAT

SEQ ID NO: 67185 - protein, 13 aa, Mycobacterium avium
HSAPDDDEFRNSR

SEQ ID NO: 67186 - protein, 9 aa, Mycobacterium avium
HSDAGSQYT

SEQ ID NO: 67187 - protein, 10 aa, Mycobacterium avium
HSDEPAEAAA

SEQ ID NO: 67188 - protein, 9 aa, Mycobacterium avium
HSDEVANAQ

SEQ ID NO: 67189 - protein, 4 aa, Mycobacterium avium
HSDP

SEQ ID NO: 67190 - protein, 20 aa, Mycobacterium avium
HSENPGATPGLVGRSTGPDI

SEQ ID NO: 67191 - protein, 12 aa, Mycobacterium avium
HSETAIDAAGAS

SEQ ID NO: 67192 - protein, 18 aa, Mycobacterium avium
HSETLTGVGTKAHHAANG

SEQ ID NO: 67193 - protein, 8 aa, Mycobacterium avium
HSGDPSLY

SEQ ID NO: 67194 - protein, 6 aa, Mycobacterium avium
HSGDPV

SEQ ID NO: 67195 - protein, 17 aa, Mycobacterium avium
HSGNRPTVTTEQVTAGA

SEQ ID NO: 67196 - protein, 9 aa, Mycobacterium avium
HSGPRAQST

SEQ ID NO: 67197 - protein, 11 aa, Mycobacterium avium
HSHHQPDPTGL

SEQ ID NO: 67198 - protein, 10 aa, Mycobacterium avium
HSHRRTPRRW

SEQ ID NO: 67199 - protein, 9 aa, Mycobacterium avium
HSHRRTRRR

SEQ ID NO: 67200 - protein, 7 aa, Mycobacterium avium
HSKAERE

SEQ ID NO: 67201 - protein, 8 aa, Mycobacterium avium
HSKTLSEK

SEQ ID NO: 67202 - protein, 9 aa, Mycobacterium avium
HSLTQVGRS

SEQ ID NO: 67203 - protein, 10 aa, Mycobacterium avium
HSLTQVGSSG

SEQ ID NO: 67204 - protein, 6 aa, Mycobacterium avium
HSNNPE

SEQ ID NO: 67205 - protein, 4 aa, Mycobacterium avium
HSPA

SEQ ID NO: 67206 - protein, 9 aa, Mycobacterium avium
HSPGKERDV

SEQ ID NO: 67207 - protein, 10 aa, Mycobacterium avium
HSPGKERDVE

SEQ ID NO: 67208 - protein, 4 aa, Mycobacterium avium
HSPR

SEQ ID NO: 67209 - protein, 6 aa, Mycobacterium avium
HSQGEI

SEQ ID NO: 67210 - protein, 13 aa, Mycobacterium avium
HSRAAARRAGRFG

SEQ ID NO: 67211 - protein, 9 aa, Mycobacterium avium
HSSAKTTLD

SEQ ID NO: 67212 - protein, 9 aa, Mycobacterium avium
HSSEDTPEY

SEQ ID NO: 67213 - protein, 6 aa, Mycobacterium avium
HSSRGA

SEQ ID NO: 67214 - protein, 13 aa, Mycobacterium avium
HSTAPGAQQYSDA

SEQ ID NO: 67215 - protein, 6 aa, Mycobacterium avium
HSTPQA

SEQ ID NO: 67216 - protein, 15 aa, Mycobacterium avium
HSTPTGGADLGAEAA

SEQ ID NO: 67217 - protein, 7 aa, Mycobacterium avium
HSTTGGV

SEQ ID NO: 67218 - protein, 9 aa, Mycobacterium avium
HTAGRELAQ

SEQ ID NO: 67219 - protein, 10 aa, Mycobacterium avium
HTAGRELAQT

SEQ ID NO: 67220 - protein, 7 aa, Mycobacterium avium
HTDPGET

SEQ ID NO: 67221 - protein, 8 aa, Mycobacterium avium
HTDPQVGQ

SEQ ID NO: 67222 - protein, 6 aa, Mycobacterium avium
HTDPSW

SEQ ID NO: 67223 - protein, 4 aa, Mycobacterium avium
HTDQ

SEQ ID NO: 67224 - protein, 6 aa, Mycobacterium avium
HTERPV

SEQ ID NO: 67225 - protein, 8 aa, Mycobacterium avium
HTGDETGT

SEQ ID NO: 67226 - protein, 7 aa, Mycobacterium avium
HTGNGSV

SEQ ID NO: 67227 - protein, 6 aa, Mycobacterium avium
HTNGTV

SEQ ID NO: 67228 - protein, 13 aa, Mycobacterium avium
HTNPHPQKRDMED

SEQ ID NO: 67229 - protein, 10 aa, Mycobacterium avium
HTPAAPDATA

SEQ ID NO: 67230 - protein, 9 aa, Mycobacterium avium
HTPAGPAQL

SEQ ID NO: 67231 - protein, 10 aa, Mycobacterium avium
HTPFSTAEAA

SEQ ID NO: 67232 - protein, 7 aa, Mycobacterium avium
HTPGHTR

SEQ ID NO: 67233 - protein, 13 aa, Mycobacterium avium
HTPNRSADAAREA

SEQ ID NO: 67234 - protein, 5 aa, Mycobacterium avium
HTPVA

SEQ ID NO: 67235 - protein, 14 aa, Mycobacterium avium
HTQPPHYYRPNEDT

SEQ ID NO: 67236 - protein, 11 aa, Mycobacterium avium
HTRAGAGANEV

SEQ ID NO: 67237 - protein, 5 aa, Mycobacterium avium
HTSPN

SEQ ID NO: 67238 - protein, 9 aa, Mycobacterium avium
HTSRTGAAV

SEQ ID NO: 67239 - protein, 5 aa, Mycobacterium avium
HVAER

SEQ ID NO: 67240 - protein, 8 aa, Mycobacterium avium
HVATTPAG

SEQ ID NO: 67241 - protein, 23 aa, Mycobacterium avium
HVDDQGAAAQLEPPVAARGSVTD

SEQ ID NO: 67242 - protein, 5 aa, Mycobacterium avium
HVDGD

SEQ ID NO: 67243 - protein, 7 aa, Mycobacterium avium
HVDTAGA

SEQ ID NO: 67244 - protein, 13 aa, Mycobacterium avium
HVEPTGHVEPTSH

SEQ ID NO: 67245 - protein, 9 aa, Mycobacterium avium
HVGDQDALT

SEQ ID NO: 67246 - protein, 12 aa, Mycobacterium avium
HVGPDGRRPAIA

SEQ ID NO: 67247 - protein, 13 aa, Mycobacterium avium
HVGPDGRRPAIAD

SEQ ID NO: 67248 - protein, 4 aa, Mycobacterium avium
HVNP

SEQ ID NO: 67249 - protein, 21 aa, Mycobacterium avium
HVPAKPNSSAVSVKPEPGARC

SEQ ID NO: 67250 - protein, 12 aa, Mycobacterium avium
HVPEQVPGSTLR

SEQ ID NO: 67251 - protein, 16 aa, Mycobacterium avium
HVPPADPARGCLGPTE

SEQ ID NO: 67252 - protein, 29 aa, Mycobacterium avium
HVPPGDTPGGTAPQAATAESGGAAADKVA

SEQ ID NO: 67253 - protein, 29 aa, Mycobacterium avium
HVPPGDTPGGTAPQAATAESGGAGADKVA

SEQ ID NO: 67254 - protein, 4 aa, Mycobacterium avium
HVPR

SEQ ID NO: 67255 - protein, 7 aa, Mycobacterium avium
HVQQQPS

SEQ ID NO: 67256 - protein, 9 aa, Mycobacterium avium
HVTGTKDKN

SEQ ID NO: 67257 - protein, 37 aa, Mycobacterium avium
HWEPKAKKGPSDPRARSGGPRASGASAEGVDANASKK

SEQ ID NO: 67258 - protein, 12 aa, Mycobacterium avium
HYESSADYRDDE

SEQ ID NO: 67259 - protein, 5 aa, Mycobacterium avium
HYGPP

SEQ ID NO: 67260 - protein, 10 aa, Mycobacterium avium
HYSEGAPEGW

SEQ ID NO: 67261 - protein, 14 aa, Mycobacterium avium
IAAAPSKRPTTTLA

SEQ ID NO: 67262 - protein, 10 aa, Mycobacterium avium
IAAERGYEAT

SEQ ID NO: 67263 - protein, 8 aa, Mycobacterium avium
IAANEAQY

SEQ ID NO: 67264 - protein, 7 aa, Mycobacterium avium
IAANTAD

SEQ ID NO: 67265 - protein, 7 aa, Mycobacterium avium
IAANTAE

SEQ ID NO: 67266 - protein, 8 aa, Mycobacterium avium
IAANTGDA

SEQ ID NO: 67267 - protein, 8 aa, Mycobacterium avium
IAAPGAAR

SEQ ID NO: 67268 - protein, 5 aa, Mycobacterium avium
IAAPS

SEQ ID NO: 67269 - protein, 10 aa, Mycobacterium avium
IAARGRRAGG

SEQ ID NO: 67270 - protein, 8 aa, Mycobacterium avium
IAASQPAA

SEQ ID NO: 67271 - protein, 7 aa, Mycobacterium avium
IAATEAE

SEQ ID NO: 67272 - protein, 13 aa, Mycobacterium avium
IADAKTALGGTDI

SEQ ID NO: 67273 - protein, 7 aa, Mycobacterium avium
IADGATE

SEQ ID NO: 67274 - protein, 6 aa, Mycobacterium avium
IADGDD

SEQ ID NO: 67275 - protein, 14 aa, Mycobacterium avium
IADGTLSPTDLEGQ

SEQ ID NO: 67276 - protein, 16 aa, Mycobacterium avium
IADPGASGPTAGLSTK

SEQ ID NO: 67277 - protein, 18 aa, Mycobacterium avium
IADTDNADEPDLTVEEGM

SEQ ID NO: 67278 - protein, 7 aa, Mycobacterium avium
IAENPDR

SEQ ID NO: 67279 - protein, 8 aa, Mycobacterium avium
IAEPDTAE

SEQ ID NO: 67280 - protein, 15 aa, Mycobacterium avium
IAERGADAQDGNKRS

SEQ ID NO: 67281 - protein, 8 aa, Mycobacterium avium
IAETENEY

SEQ ID NO: 67282 - protein, 10 aa, Mycobacterium avium
IAETQRAEDG

SEQ ID NO: 67283 - protein, 9 aa, Mycobacterium avium
IAGATPERP

SEQ ID NO: 67284 - protein, 10 aa, Mycobacterium avium
IAGGGGVHSP

SEQ ID NO: 67285 - protein, 5 aa, Mycobacterium avium
IAGPD

SEQ ID NO: 67286 - protein, 9 aa, Mycobacterium avium
IAGPDTTSY

SEQ ID NO: 67287 - protein, 14 aa, Mycobacterium avium
IAGPLTDDAAVGKA

SEQ ID NO: 67288 - protein, 10 aa, Mycobacterium avium
IAGSSGAERV

SEQ ID NO: 67289 - protein, 9 aa, Mycobacterium avium
IAKATDTSA

SEQ ID NO: 67290 - protein, 4 aa, Mycobacterium avium
IAKG

SEQ ID NO: 67291 - protein, 11 aa, Mycobacterium avium
IAKNSPSAMRA

SEQ ID NO: 67292 - protein, 4 aa, Mycobacterium avium
IAPA

SEQ ID NO: 67293 - protein, 6 aa, Mycobacterium avium
IAPAPI

SEQ ID NO: 67294 - protein, 10 aa, Mycobacterium avium
IAPESACTST

SEQ ID NO: 67295 - protein, 10 aa, Mycobacterium avium
IAPKPLQRPH

SEQ ID NO: 67296 - protein, 11 aa, Mycobacterium avium
IAPNLDDDDPH

SEQ ID NO: 67297 - protein, 17 aa, Mycobacterium avium
IAPPATPPVPPAPVTGA

SEQ ID NO: 67298 - protein, 11 aa, Mycobacterium avium
IAPPLESPQDP

SEQ ID NO: 67299 - protein, 20 aa, Mycobacterium avium
IAPSPTAKTPATTAGQTISP

SEQ ID NO: 67300 - protein, 12 aa, Mycobacterium avium
IAPTHPDPGVES

SEQ ID NO: 67301 - protein, 12 aa, Mycobacterium avium
IAPTHPHPGVES

SEQ ID NO: 67302 - protein, 13 aa, Mycobacterium avium
IAPVTPVDSNGRF

SEQ ID NO: 67303 - protein, 8 aa, Mycobacterium avium
IAQSAGGL

SEQ ID NO: 67304 - protein, 9 aa, Mycobacterium avium
IAQSAGGLA

SEQ ID NO: 67305 - protein, 11 aa, Mycobacterium avium
IARADGDEPQY

SEQ ID NO: 67306 - protein, 8 aa, Mycobacterium avium
IARGGPDT

SEQ ID NO: 67307 - protein, 14 aa, Mycobacterium avium
IARGSQDGRPRNKF

SEQ ID NO: 67308 - protein, 7 aa, Mycobacterium avium
IARSGGL

SEQ ID NO: 67309 - protein, 8 aa, Mycobacterium avium
IASANTEE

SEQ ID NO: 67310 - protein, 18 aa, Mycobacterium avium
IASEQATLSNAWQGDTGM

SEQ ID NO: 67311 - protein, 14 aa, Mycobacterium avium
IASPATGFEPPSPR

SEQ ID NO: 67312 - protein, 5 aa, Mycobacterium avium
IASYG

SEQ ID NO: 67313 - protein, 19 aa, Mycobacterium avium
IASYPGPGVPDAGFSGATV

SEQ ID NO: 67314 - protein, 4 aa, Mycobacterium avium
IATR

SEQ ID NO: 67315 - protein, 11 aa, Mycobacterium avium
IDADGSDAHAG

SEQ ID NO: 67316 - protein, 5 aa, Mycobacterium avium
IDADT

SEQ ID NO: 67317 - protein, 15 aa, Mycobacterium avium
IDAERAARLADQGAD

SEQ ID NO: 67318 - protein, 10 aa, Mycobacterium avium
IDAVGQPGRV

SEQ ID NO: 67319 - protein, 8 aa, Mycobacterium avium
IDDAGQAP

SEQ ID NO: 67320 - protein, 7 aa, Mycobacterium avium
IDDEANK

SEQ ID NO: 67321 - protein, 8 aa, Mycobacterium avium
IDDEGAEY

SEQ ID NO: 67322 - protein, 17 aa, Mycobacterium avium
IDDGPNQSALFSSEITA

SEQ ID NO: 67323 - protein, 8 aa, Mycobacterium avium
IDDSDPKL

SEQ ID NO: 67324 - protein, 14 aa, Mycobacterium avium
IDEARENRWDTAGS

SEQ ID NO: 67325 - protein, 13 aa, Mycobacterium avium
IDEPDGTRRPLSR

SEQ ID NO: 67326 - protein, 8 aa, Mycobacterium avium
IDEPRPIA

SEQ ID NO: 67327 - protein, 8 aa, Mycobacterium avium
IDGEKLTD

SEQ ID NO: 67328 - protein, 7 aa, Mycobacterium avium
IDGGREP

SEQ ID NO: 67329 - protein, 4 aa, Mycobacterium avium
IDGR

SEQ ID NO: 67330 - protein, 18 aa, Mycobacterium avium
IDGSAKPACVAESVVRFV

SEQ ID NO: 67331 - protein, 14 aa, Mycobacterium avium
IDGSQTARRVGTDA

SEQ ID NO: 67332 - protein, 7 aa, Mycobacterium avium
IDKRRRA

SEQ ID NO: 67333 - protein, 10 aa, Mycobacterium avium
IDNGDTGYPC

SEQ ID NO: 67334 - protein, 5 aa, Mycobacterium avium
IDPDT

SEQ ID NO: 67335 - protein, 8 aa, Mycobacterium avium
IDPEDHES

SEQ ID NO: 67336 - protein, 14 aa, Mycobacterium avium
IDPGGASAGQDAAV

SEQ ID NO: 67337 - protein, 9 aa, Mycobacterium avium
IDPSPAAQV

SEQ ID NO: 67338 - protein, 7 aa, Mycobacterium avium
IDPTEED

SEQ ID NO: 67339 - protein, 16 aa, Mycobacterium avium
IDQTEEDLAERSTPTT

SEQ ID NO: 67340 - protein, 6 aa, Mycobacterium avium
IDRSSR

SEQ ID NO: 67341 - protein, 8 aa, Mycobacterium avium
IDSDTGSV

SEQ ID NO: 67342 - protein, 19 aa, Mycobacterium avium
IDSETAAATQQVDEATGPM

SEQ ID NO: 67343 - protein, 4 aa, Mycobacterium avium
IDSF

SEQ ID NO: 67344 - protein, 4 aa, Mycobacterium avium
IDSS

SEQ ID NO: 67345 - protein, 4 aa, Mycobacterium avium
IDST

SEQ ID NO: 67346 - protein, 5 aa, Mycobacterium avium
IDTGP

SEQ ID NO: 67347 - protein, 6 aa, Mycobacterium avium
IDTGPT

SEQ ID NO: 67348 - protein, 13 aa, Mycobacterium avium
IDTQGRNSETCSD

SEQ ID NO: 67349 - protein, 11 aa, Mycobacterium avium
IDTSAYPPMGP

SEQ ID NO: 67350 - protein, 15 aa, Mycobacterium avium
IDYPPVATPHRAARS

SEQ ID NO: 67351 - protein, 9 aa, Mycobacterium avium
IEAAQQTFE

SEQ ID NO: 67352 - protein, 9 aa, Mycobacterium avium
IEADSDRDR

SEQ ID NO: 67353 - protein, 16 aa, Mycobacterium avium
IEAREGHRAPETAEQE

SEQ ID NO: 67354 - protein, 19 aa, Mycobacterium avium
IEARTDPWDPETEPSAEDF

SEQ ID NO: 67355 - protein, 21 aa, Mycobacterium avium
IEDTALTAESVASSIDEIDDS

SEQ ID NO: 67356 - protein, 7 aa, Mycobacterium avium
IEETSTD

SEQ ID NO: 67357 - protein, 12 aa, Mycobacterium avium
IEGGDDDTALGY

SEQ ID NO: 67358 - protein, 5 aa, Mycobacterium avium
IEGGS

SEQ ID NO: 67359 - protein, 4 aa, Mycobacterium avium
IEGK

SEQ ID NO: 67360 - protein, 17 aa, Mycobacterium avium
IEGSGEEPTPGSGAPLK

SEQ ID NO: 67361 - protein, 13 aa, Mycobacterium avium
IEGSRTAEPRPEQ

SEQ ID NO: 67362 - protein, 5 aa, Mycobacterium avium
IEKDS

SEQ ID NO: 67363 - protein, 10 aa, Mycobacterium avium
IEPAPAGQER

SEQ ID NO: 67364 - protein, 8 aa, Mycobacterium avium
IEPDQRAT

SEQ ID NO: 67365 - protein, 16 aa, Mycobacterium avium
IEPGRRSGQRRPVAQG

SEQ ID NO: 67366 - protein, 8 aa, Mycobacterium avium
IEPKPDWE

SEQ ID NO: 67367 - protein, 5 aa, Mycobacterium avium
IEPRN

SEQ ID NO: 67368 - protein, 7 aa, Mycobacterium avium
IEQTRAH

SEQ ID NO: 67369 - protein, 7 aa, Mycobacterium avium
IEQTSTD

SEQ ID NO: 67370 - protein, 9 aa, Mycobacterium avium
IERDGQVEK

SEQ ID NO: 67371 - protein, 5 aa, Mycobacterium avium
IEREQ

SEQ ID NO: 67372 - protein, 5 aa, Mycobacterium avium
IERSE

SEQ ID NO: 67373 - protein, 7 aa, Mycobacterium avium
IETETGV

SEQ ID NO: 67374 - protein, 6 aa, Mycobacterium avium
IETPAP

SEQ ID NO: 67375 - protein, 4 aa, Mycobacterium avium
IETT

SEQ ID NO: 67376 - protein, 18 aa, Mycobacterium avium
IEVTDTADGPQWTLGGDG

SEQ ID NO: 67377 - protein, 6 aa, Mycobacterium avium
IGAEEA

SEQ ID NO: 67378 - protein, 4 aa, Mycobacterium avium
IGCP

SEQ ID NO: 67379 - protein, 10 aa, Mycobacterium avium
IGDAGLRPAD

SEQ ID NO: 67380 - protein, 11 aa, Mycobacterium avium
IGDGAPTDTQP

SEQ ID NO: 67381 - protein, 14 aa, Mycobacterium avium
IGDNYRDAATETGQ

SEQ ID NO: 67382 - protein, 10 aa, Mycobacterium avium
IGDPESDIGS

SEQ ID NO: 67383 - protein, 13 aa, Mycobacterium avium
IGEAGVRRAARKE

SEQ ID NO: 67384 - protein, 6 aa, Mycobacterium avium
IGEHGE

SEQ ID NO: 67385 - protein, 9 aa, Mycobacterium avium
IGEHSNIGA

SEQ ID NO: 67386 - protein, 5 aa, Mycobacterium avium
IGENT

SEQ ID NO: 67387 - protein, 7 aa, Mycobacterium avium
IGEPQSE

SEQ ID NO: 67388 - protein, 7 aa, Mycobacterium avium
IGERGTD

SEQ ID NO: 67389 - protein, 12 aa, Mycobacterium avium
IGESTDPIASGP

SEQ ID NO: 67390 - protein, 6 aa, Mycobacterium avium
IGGDGL

SEQ ID NO: 67391 - protein, 4 aa, Mycobacterium avium
IGGR

SEQ ID NO: 67392 - protein, 5 aa, Mycobacterium avium
IGGRG

SEQ ID NO: 67393 - protein, 15 aa, Mycobacterium avium
IGGRRGRGWPGDSRT

SEQ ID NO: 67394 - protein, 8 aa, Mycobacterium avium
IGGSENIG

SEQ ID NO: 67395 - protein, 20 aa, Mycobacterium avium
IGGSTAGAQRGAGYRSTDDY

SEQ ID NO: 67396 - protein, 20 aa, Mycobacterium avium
IGGSTAGAQRGSGYRSTEDY

SEQ ID NO: 67397 - protein, 7 aa, Mycobacterium avium
IGGTTSH

SEQ ID NO: 67398 - protein, 19 aa, Mycobacterium avium
IGHRPALTGADVRPAAPPP

SEQ ID NO: 67399 - protein, 19 aa, Mycobacterium avium
IGHRPALTGADVRPADPPP

SEQ ID NO: 67400 - protein, 11 aa, Mycobacterium avium
IGKGPHTSTQS

SEQ ID NO: 67401 - protein, 11 aa, Mycobacterium avium
IGKGRHTSTQS

SEQ ID NO: 67402 - protein, 20 aa, Mycobacterium avium
IGKPEPPPADPDSGPPKTVP

SEQ ID NO: 67403 - protein, 8 aa, Mycobacterium avium
IGKPERLR

SEQ ID NO: 67404 - protein, 10 aa, Mycobacterium avium
IGNDAADVHE

SEQ ID NO: 67405 - protein, 10 aa, Mycobacterium avium
IGNGHDSKTI

SEQ ID NO: 67406 - protein, 10 aa, Mycobacterium avium
IGNPDKARNT

SEQ ID NO: 67407 - protein, 11 aa, Mycobacterium avium
IGNRLAEDTDV

SEQ ID NO: 67408 - protein, 5 aa, Mycobacterium avium
IGPED

SEQ ID NO: 67409 - protein, 16 aa, Mycobacterium avium
IGPGDGDFEELDDTGW

SEQ ID NO: 67410 - protein, 5 aa, Mycobacterium avium
IGPGF

SEQ ID NO: 67411 - protein, 9 aa, Mycobacterium avium
IGPGYGATL

SEQ ID NO: 67412 - protein, 14 aa, Mycobacterium avium
IGPNGGGFLSPEGV

SEQ ID NO: 67413 - protein, 5 aa, Mycobacterium avium
IGPNT

SEQ ID NO: 67414 - protein, 7 aa, Mycobacterium avium
IGPPATD

SEQ ID NO: 67415 - protein, 15 aa, Mycobacterium avium
IGPRPTARPAGKGRR

SEQ ID NO: 67416 - protein, 4 aa, Mycobacterium avium
IGPS

SEQ ID NO: 67417 - protein, 14 aa, Mycobacterium avium
IGPSGASPASGSTA

SEQ ID NO: 67418 - protein, 5 aa, Mycobacterium avium
IGPVQ

SEQ ID NO: 67419 - protein, 16 aa, Mycobacterium avium
IGQVTANDKVSTIGKS

SEQ ID NO: 67420 - protein, 28 aa, Mycobacterium avium
IGRPRLERGQDGHDRLGRPGEQQRHPLT

SEQ ID NO: 67421 - protein, 6 aa, Mycobacterium avium
IGRREE

SEQ ID NO: 67422 - protein, 8 aa, Mycobacterium avium
IGRSATGR

SEQ ID NO: 67423 - protein, 6 aa, Mycobacterium avium
IGSASK

SEQ ID NO: 67424 - protein, 20 aa, Mycobacterium avium
IGSDFDTSRAVADASTSAAA

SEQ ID NO: 67425 - protein, 8 aa, Mycobacterium avium
IGSDGDIT

SEQ ID NO: 67426 - protein, 11 aa, Mycobacterium avium
IGSETGRIHGA

SEQ ID NO: 67427 - protein, 8 aa, Mycobacterium avium
IGSPASHG

SEQ ID NO: 67428 - protein, 8 aa, Mycobacterium avium
IGSPVPGG

SEQ ID NO: 67429 - protein, 8 aa, Mycobacterium avium
IGSSYPEE

SEQ ID NO: 67430 - protein, 20 aa, Mycobacterium avium
IGSTTAGAQRGAGYRSTDDY

SEQ ID NO: 67431 - protein, 4 aa, Mycobacterium avium
IGTA

SEQ ID NO: 67432 - protein, 5 aa, Mycobacterium avium
IGTED

SEQ ID NO: 67433 - protein, 66 aa, Mycobacterium avium
IGTGAQAPAPAAPQPPPAPKPEPKPEPAPQPQAQPAPQPQAQPAPEPKAQPAQAQPAAGGEGTPYV

SEQ ID NO: 67434 - protein, 75 aa, Mycobacterium avium
IGTGAQAPAPAAPQPPPAPKPEPKPEPAPQPQAQPAPQPQPQPQAQPAPEPKAQPAQAQPAQAQPAAGGEGTPYV

SEQ ID NO: 67435 - protein, 8 aa, Mycobacterium avium
IGTNSDVA

SEQ ID NO: 67436 - protein, 9 aa, Mycobacterium avium
IGYQPQRAA

SEQ ID NO: 67437 - protein, 8 aa, Mycobacterium avium
IGYRPQRA

SEQ ID NO: 67438 - protein, 10 aa, Mycobacterium avium
IHGPANDRRY

SEQ ID NO: 67439 - protein, 5 aa, Mycobacterium avium
IHPGY

SEQ ID NO: 67440 - protein, 10 aa, Mycobacterium avium
IIGAEEPKWE

SEQ ID NO: 67441 - protein, 4 aa, Mycobacterium avium
IKAA

SEQ ID NO: 67442 - protein, 221 aa, Mycobacterium avium
IKAGGNGEAAAPPAQPGGTATTPAAQATPEAPARPGPAAARPSAPAPGQPKPPAPGQPPRPGATPGPRPGPAPKPAARTPRVGNNPFSSAQPVDRPIPRPVPRPGAPRPGAPRPGASPGNMPPRPGGVGGPGRPARPGAPRPGGGRPGGPGGRDGGGGNYRGGGVGAPPGGGGGFRGRPGGGGGGRPGQRGGAAGAFGRPGGAPRRGRKSKRQKRQEYDSM

SEQ ID NO: 67443 - protein, 221 aa, Mycobacterium avium
IKAGGNGEAAAPPAQPGGTATTPAAQATPEAPARPGPAAARPSAPAPGQPKPPAPGQPPRPGATPGPRPGPAPKPAARTPRVGNNPFSSAQPVDRPIPRPVPRPGAPRPGAPRPGASPGNMPPRPGGVGGPGRPARPGAPRPGGGRPGGPGGRDGGGGNYRGGGVGASPGGGGGFRGRPGGGGGGRPGQRGGAAGAFGRPGGAPRRGRKSKRQKRQEYDSM

SEQ ID NO: 67444 - protein, 8 aa, Mycobacterium avium
IKGPDGRE

SEQ ID NO: 67445 - protein, 14 aa, Mycobacterium avium
IKKSASNETAPPTI

SEQ ID NO: 67446 - protein, 4 aa, Mycobacterium avium
IKPA

SEQ ID NO: 67447 - protein, 7 aa, Mycobacterium avium
IKRPDYG

SEQ ID NO: 67448 - protein, 7 aa, Mycobacterium avium
IKTPDEM

SEQ ID NO: 67449 - protein, 5 aa, Mycobacterium avium
IKVEG

SEQ ID NO: 67450 - protein, 7 aa, Mycobacterium avium
INDEGDV

SEQ ID NO: 67451 - protein, 9 aa, Mycobacterium avium
INDGPWPET

SEQ ID NO: 67452 - protein, 7 aa, Mycobacterium avium
INDRNVD

SEQ ID NO: 67453 - protein, 20 aa, Mycobacterium avium
INGAKGGPGGQPGCGSLPDV

SEQ ID NO: 67454 - protein, 12 aa, Mycobacterium avium
INGGTRDGAERT

SEQ ID NO: 67455 - protein, 8 aa, Mycobacterium avium
INPEGKTL

SEQ ID NO: 67456 - protein, 9 aa, Mycobacterium avium
INSRGAKDT

SEQ ID NO: 67457 - protein, 5 aa, Mycobacterium avium
INTDG

SEQ ID NO: 67458 - protein, 4 aa, Mycobacterium avium
INTG

SEQ ID NO: 67459 - protein, 9 aa, Mycobacterium avium
INTGNGYHG

SEQ ID NO: 67460 - protein, 6 aa, Mycobacterium avium
INTNGG

SEQ ID NO: 67461 - protein, 9 aa, Mycobacterium avium
INTTPKGNF

SEQ ID NO: 67462 - protein, 6 aa, Mycobacterium avium
IPADEP

SEQ ID NO: 67463 - protein, 12 aa, Mycobacterium avium
IPAGSTPAEPVE

SEQ ID NO: 67464 - protein, 4 aa, Mycobacterium avium
IPAH

SEQ ID NO: 67465 - protein, 5 aa, Mycobacterium avium
IPAHG

SEQ ID NO: 67466 - protein, 13 aa, Mycobacterium avium
IPAPSARRPGVPK

SEQ ID NO: 67467 - protein, 6 aa, Mycobacterium avium
IPAPYD

SEQ ID NO: 67468 - protein, 6 aa, Mycobacterium avium
IPAQGG

SEQ ID NO: 67469 - protein, 6 aa, Mycobacterium avium
IPATEL

SEQ ID NO: 67470 - protein, 6 aa, Mycobacterium avium
IPDAPP

SEQ ID NO: 67471 - protein, 15 aa, Mycobacterium avium
IPDDEDLPAQLPPPT

SEQ ID NO: 67472 - protein, 4 aa, Mycobacterium avium
IPDE

SEQ ID NO: 67473 - protein, 8 aa, Mycobacterium avium
IPDGVDPA

SEQ ID NO: 67474 - protein, 10 aa, Mycobacterium avium
IPDNTQAART

SEQ ID NO: 67475 - protein, 9 aa, Mycobacterium avium
IPDRGGDTV

SEQ ID NO: 67476 - protein, 21 aa, Mycobacterium avium
IPDSEPDWGPYAAPTAPPNAP

SEQ ID NO: 67477 - protein, 16 aa, Mycobacterium avium
IPDYTGVDPASVNVTP

SEQ ID NO: 67478 - protein, 13 aa, Mycobacterium avium
IPEPGVALRPAKQ

SEQ ID NO: 67479 - protein, 10 aa, Mycobacterium avium
IPESPSPRRL

SEQ ID NO: 67480 - protein, 4 aa, Mycobacterium avium
IPGA

SEQ ID NO: 67481 - protein, 11 aa, Mycobacterium avium
IPGAENLPSGE

SEQ ID NO: 67482 - protein, 11 aa, Mycobacterium avium
IPGGSPSTPAF

SEQ ID NO: 67483 - protein, 4 aa, Mycobacterium avium
IPGK

SEQ ID NO: 67484 - protein, 9 aa, Mycobacterium avium
IPGPDGQPV

SEQ ID NO: 67485 - protein, 7 aa, Mycobacterium avium
IPGPQGP

SEQ ID NO: 67486 - protein, 8 aa, Mycobacterium avium
IPGQSGAA

SEQ ID NO: 67487 - protein, 8 aa, Mycobacterium avium
IPGRARDL

SEQ ID NO: 67488 - protein, 19 aa, Mycobacterium avium
IPGSTRPASYQGGSQTQIS

SEQ ID NO: 67489 - protein, 7 aa, Mycobacterium avium
IPGTAPA

SEQ ID NO: 67490 - protein, 9 aa, Mycobacterium avium
IPGVRGPGT

SEQ ID NO: 67491 - protein, 12 aa, Mycobacterium avium
IPKPRDRGDPRI

SEQ ID NO: 67492 - protein, 10 aa, Mycobacterium avium
IPPADTSPEQ

SEQ ID NO: 67493 - protein, 12 aa, Mycobacterium avium
IPPASTETLRTD

SEQ ID NO: 67494 - protein, 50 aa, Mycobacterium avium; identical to SEQ ID NO: 5757

SEQ ID NO: 67495 - protein, 4 aa, Mycobacterium avium
IPPG

SEQ ID NO: 67496 - protein, 6 aa, Mycobacterium avium
IPPGAV

SEQ ID NO: 67497 - protein, 7 aa, Mycobacterium avium
IPPGPEQ

SEQ ID NO: 67498 - protein, 9 aa, Mycobacterium avium
IPPGTQPAS

SEQ ID NO: 67499 - protein, 5 aa, Mycobacterium avium
IPPPV

SEQ ID NO: 67500 - protein, 7 aa, Mycobacterium avium
IPPRPSS

SEQ ID NO: 67501 - protein, 5 aa, Mycobacterium avium
IPQTS

SEQ ID NO: 67502 - protein, 4 aa, Mycobacterium avium
IPRG

SEQ ID NO: 67503 - protein, 7 aa, Mycobacterium avium
IPRPAPV

SEQ ID NO: 67504 - protein, 19 aa, Mycobacterium avium
IPRPEYVGKPTAREGSEPW

SEQ ID NO: 67505 - protein, 20 aa, Mycobacterium avium
IPRPEYVGKPTAREGSEPWV

SEQ ID NO: 67506 - protein, 12 aa, Mycobacterium avium
IPRTPPDTTQTL

SEQ ID NO: 67507 - protein, 12 aa, Mycobacterium avium
IPRTPPTTTQTL

SEQ ID NO: 67508 - protein, 20 aa, Mycobacterium avium
IPSAHRRRGGKNAQNLRDAR

SEQ ID NO: 67509 - protein, 4 aa, Mycobacterium avium
IPSE

SEQ ID NO: 67510 - protein, 12 aa, Mycobacterium avium
IPSESRDEARLA

SEQ ID NO: 67511 - protein, 15 aa, Mycobacterium avium
IPSGDELVLHQFRPA

SEQ ID NO: 67512 - protein, 5 aa, Mycobacterium avium
IPSGG

SEQ ID NO: 67513 - protein, 7 aa, Mycobacterium avium
IPSGGGA

SEQ ID NO: 67514 - protein, 6 aa, Mycobacterium avium
IPSKTL

SEQ ID NO: 67515 - protein, 12 aa, Mycobacterium avium
IPSPAELSRDGE

SEQ ID NO: 67516 - protein, 9 aa, Mycobacterium avium
IPTDGGTIA

SEQ ID NO: 67517 - protein, 4 aa, Mycobacterium avium
IPTP

SEQ ID NO: 67518 - protein, 8 aa, Mycobacterium avium
IPTPPGWA

SEQ ID NO: 67519 - protein, 9 aa, Mycobacterium avium
IPTPPGWAP

SEQ ID NO: 67520 - protein, 6 aa, Mycobacterium avium
IPVAEG

SEQ ID NO: 67521 - protein, 10 aa, Mycobacterium avium
IPVNTHGGQL

SEQ ID NO: 67522 - protein, 5 aa, Mycobacterium avium
IQEGN

SEQ ID NO: 67523 - protein, 11 aa, Mycobacterium avium
IQEGSGLSKEE

SEQ ID NO: 67524 - protein, 6 aa, Mycobacterium avium
IQGTAA

SEQ ID NO: 67525 - protein, 8 aa, Mycobacterium avium
IQPSGVET

SEQ ID NO: 67526 - protein, 15 aa, Mycobacterium avium
IQPTAPGGAPRSPRG

SEQ ID NO: 67527 - protein, 21 aa, Mycobacterium avium
IQPTTVNSRRTRTPALDAGRE

SEQ ID NO: 67528 - protein, 9 aa, Mycobacterium avium
IQRGEDRQR

SEQ ID NO: 67529 - protein, 10 aa, Mycobacterium avium
IQRPDGHRYS

SEQ ID NO: 67530 - protein, 6 aa, Mycobacterium avium
IQRQSP

SEQ ID NO: 67531 - protein, 22 aa, Mycobacterium avium
IQSADDPDADEQRELEARAAGL

SEQ ID NO: 67532 - protein, 9 aa, Mycobacterium avium
IRAPSGGNV

SEQ ID NO: 67533 - protein, 20 aa, Mycobacterium avium
IRDEDNGRKSVGAWLLSAHL

SEQ ID NO: 67534 - protein, 11 aa, Mycobacterium avium
IRGTGGAQPGC

SEQ ID NO: 67535 - protein, 10 aa, Mycobacterium avium
IRITGETTLD

SEQ ID NO: 67536 - protein, 15 aa, Mycobacterium avium
IRPAEDPGDERGAHR

SEQ ID NO: 67537 - protein, 8 aa, Mycobacterium avium
IRPAPDTM

SEQ ID NO: 67538 - protein, 49 aa, Mycobacterium avium
IRPGPDSPPQQAPVAPRGSVPDATAAISAGRTAAGTADVYPGPVPQVGG

SEQ ID NO: 67539 - protein, 49 aa, Mycobacterium avium
IRPGPDSPPQQAPVAPRGSVPDATAATSAGRTAAGTADVYPGPVPQVGG

SEQ ID NO: 67540 - protein, 6 aa, Mycobacterium avium
IRPGTQ

SEQ ID NO: 67541 - protein, 5 aa, Mycobacterium avium
IRPQR

SEQ ID NO: 67542 - protein, 27 aa, Mycobacterium avium
IRQPGGPRVPSAPPANQAGRTQRTRRT

SEQ ID NO: 67543 - protein, 5 aa, Mycobacterium avium
IRRRT

SEQ ID NO: 67544 - protein, 14 aa, Mycobacterium avium
IRSGRRAAAEVIAL

SEQ ID NO: 67545 - protein, 14 aa, Mycobacterium avium
IRSGRRAAAEVTAL

SEQ ID NO: 67546 - protein, 10 aa, Mycobacterium avium
IRSPGGRREL

SEQ ID NO: 67547 - protein, 7 aa, Mycobacterium avium
IRSQQAA

SEQ ID NO: 67548 - protein, 8 aa, Mycobacterium avium
ISAEGRTR

SEQ ID NO: 67549 - protein, 25 aa, Mycobacterium avium
ISAGSGRAADPAGRSLTHAPAQPGH

SEQ ID NO: 67550 - protein, 10 aa, Mycobacterium avium
ISAKDPDSVQ

SEQ ID NO: 67551 - protein, 9 aa, Mycobacterium avium
ISAPSETAQ

SEQ ID NO: 67552 - protein, 9 aa, Mycobacterium avium
ISDDGRRAE

SEQ ID NO: 67553 - protein, 4 aa, Mycobacterium avium
ISDG

SEQ ID NO: 67554 - protein, 10 aa, Mycobacterium avium
ISDNKQRAKI

SEQ ID NO: 67555 - protein, 6 aa, Mycobacterium avium
ISDQTV

SEQ ID NO: 67556 - protein, 8 aa, Mycobacterium avium
ISETGEVE

SEQ ID NO: 67557 - protein, 7 aa, Mycobacterium avium
ISGGSSE

SEQ ID NO: 67558 - protein, 12 aa, Mycobacterium avium
ISGPSGSGKSSL

SEQ ID NO: 67559 - protein, 6 aa, Mycobacterium avium
ISGPYA

SEQ ID NO: 67560 - protein, 26 aa, Mycobacterium avium
ISGTADGYKTDKPSEPATATFKIVVT

SEQ ID NO: 67561 - protein, 13 aa, Mycobacterium avium
ISHPNDPAPTDNL

SEQ ID NO: 67562 - protein, 5 aa, Mycobacterium avium
ISKGD

SEQ ID NO: 67563 - protein, 8 aa, Mycobacterium avium
ISLGDGSF

SEQ ID NO: 67564 - protein, 9 aa, Mycobacterium avium
ISNRDDRAA

SEQ ID NO: 67565 - protein, 4 aa, Mycobacterium avium
ISPD

SEQ ID NO: 67566 - protein, 9 aa, Mycobacterium avium
ISPGRSGRG

SEQ ID NO: 67567 - protein, 7 aa, Mycobacterium avium
ISPGSTL

SEQ ID NO: 67568 - protein, 8 aa, Mycobacterium avium
ISPTPRPA

SEQ ID NO: 67569 - protein, 4 aa, Mycobacterium avium
ISQT

SEQ ID NO: 67570 - protein, 5 aa, Mycobacterium avium
ISRGD

SEQ ID NO: 67571 - protein, 12 aa, Mycobacterium avium
ISRTGTDGGASD

SEQ ID NO: 67572 - protein, 8 aa, Mycobacterium avium
ISSEVTAS

SEQ ID NO: 67573 - protein, 9 aa, Mycobacterium avium
ISSGARPAR

SEQ ID NO: 67574 - protein, 9 aa, Mycobacterium avium
ISTGGGASL

SEQ ID NO: 67575 - protein, 19 aa, Mycobacterium avium
ISTPKGSVRVTTENTANGV

SEQ ID NO: 67576 - protein, 9 aa, Mycobacterium avium
ISTQPVAGA

SEQ ID NO: 67577 - protein, 25 aa, Mycobacterium avium
ITAASTPWRQDPYRDTQGGSSLADY

SEQ ID NO: 67578 - protein, 12 aa, Mycobacterium avium
ITAGPADDDGAV

SEQ ID NO: 67579 - protein, 12 aa, Mycobacterium avium
ITAGSADDDGAV

SEQ ID NO: 67580 - protein, 13 aa, Mycobacterium avium
ITAPDAARRRVTG

SEQ ID NO: 67581 - protein, 5 aa, Mycobacterium avium
ITAPG

SEQ ID NO: 67582 - protein, 5 aa, Mycobacterium avium
ITDPR

SEQ ID NO: 67583 - protein, 7 aa, Mycobacterium avium
ITDPTGA

SEQ ID NO: 67584 - protein, 4 aa, Mycobacterium avium
ITEI

SEQ ID NO: 67585 - protein, 18 aa, Mycobacterium avium
ITGATAGAPAGEPGSRTQ

SEQ ID NO: 67586 - protein, 18 aa, Mycobacterium avium
ITGGPDAPVVTDGPFAET

SEQ ID NO: 67587 - protein, 4 aa, Mycobacterium avium
ITGR

SEQ ID NO: 67588 - protein, 18 aa, Mycobacterium avium
ITGRGGDEIEAYRPEATA

SEQ ID NO: 67589 - protein, 19 aa, Mycobacterium avium
ITGRGGDEIEAYRSEATAI

SEQ ID NO: 67590 - protein, 6 aa, Mycobacterium avium
ITGRRP

SEQ ID NO: 67591 - protein, 10 aa, Mycobacterium avium
ITGSKSTLNE

SEQ ID NO: 67592 - protein, 8 aa, Mycobacterium avium
ITGTDRRG

SEQ ID NO: 67593 - protein, 11 aa, Mycobacterium avium
ITGTGVGGRIR

SEQ ID NO: 67594 - protein, 4 aa, Mycobacterium avium
ITHS

SEQ ID NO: 67595 - protein, 5 aa, Mycobacterium avium
ITKET

SEQ ID NO: 67596 - protein, 7 aa, Mycobacterium avium
ITKNNPE

SEQ ID NO: 67597 - protein, 5 aa, Mycobacterium avium
ITPAE

SEQ ID NO: 67598 - protein, 13 aa, Mycobacterium avium
ITPDAVATTDGEH

SEQ ID NO: 67599 - protein, 7 aa, Mycobacterium avium
ITPERAD

SEQ ID NO: 67600 - protein, 5 aa, Mycobacterium avium
ITPKG

SEQ ID NO: 67601 - protein, 14 aa, Mycobacterium avium
ITPPNDKLAIGYRG

SEQ ID NO: 67602 - protein, 5 aa, Mycobacterium avium
ITPRA

SEQ ID NO: 67603 - protein, 8 aa, Mycobacterium avium
ITPYPPGI

SEQ ID NO: 67604 - protein, 8 aa, Mycobacterium avium
ITRPPRPL

SEQ ID NO: 67605 - protein, 10 aa, Mycobacterium avium
ITRTAKDQAE

SEQ ID NO: 67606 - protein, 7 aa, Mycobacterium avium
ITRTERS

SEQ ID NO: 67607 - protein, 7 aa, Mycobacterium avium
ITRTTTK

SEQ ID NO: 67608 - protein, 6 aa, Mycobacterium avium
ITSAPD

SEQ ID NO: 67609 - protein, 19 aa, Mycobacterium avium
ITSNGTVTAGNSSQQNDAA

SEQ ID NO: 67610 - protein, 9 aa, Mycobacterium avium
ITSRESTHY

SEQ ID NO: 67611 - protein, 15 aa, Mycobacterium avium
ITSTTSTATRKSSTT

SEQ ID NO: 67612 - protein, 6 aa, Mycobacterium avium
ITTGEA

SEQ ID NO: 67613 - protein, 10 aa, Mycobacterium avium
ITTGKQPQAL

SEQ ID NO: 67614 - protein, 9 aa, Mycobacterium avium
ITTNGEPYA

SEQ ID NO: 67615 - protein, 13 aa, Mycobacterium avium
ITTPKSDAGRRDV

SEQ ID NO: 67616 - protein, 8 aa, Mycobacterium avium
ITVTDPDV

SEQ ID NO: 67617 - protein, 8 aa, Mycobacterium avium
IVGAPNPY

SEQ ID NO: 67618 - protein, 9 aa, Mycobacterium avium
IVPNDGGRV

SEQ ID NO: 67619 - protein, 7 aa, Mycobacterium avium
IYQPDAE

SEQ ID NO: 67620 - protein, 9 aa, Mycobacterium avium
KAAADEAAV

SEQ ID NO: 67621 - protein, 9 aa, Mycobacterium avium
KAAAGRAHR

SEQ ID NO: 67622 - protein, 10 aa, Mycobacterium avium
KAADADGHAG

SEQ ID NO: 67623 - protein, 11 aa, Mycobacterium avium
KAADSDGRAGD

SEQ ID NO: 67624 - protein, 11 aa, Mycobacterium avium
KAAERAKIDEA

SEQ ID NO: 67625 - protein, 7 aa, Mycobacterium avium
KAAERAV

SEQ ID NO: 67626 - protein, 8 aa, Mycobacterium avium
KAAGASAV

SEQ ID NO: 67627 - protein, 8 aa, Mycobacterium avium
KAAGATTL

SEQ ID NO: 67628 - protein, 10 aa, Mycobacterium avium
KAAGEDHEAG

SEQ ID NO: 67629 - protein, 6 aa, Mycobacterium avium
KAAGLA

SEQ ID NO: 67630 - protein, 26 aa, Mycobacterium avium
KAAGQITATAGDVGNATFTPAHNGNG

SEQ ID NO: 67631 - protein, 7 aa, Mycobacterium avium
KAAGVSR

SEQ ID NO: 67632 - protein, 7 aa, Mycobacterium avium
KAAKEQL

SEQ ID NO: 67633 - protein, 9 aa, Mycobacterium avium
KAAPGPHGA

SEQ ID NO: 67634 - protein, 8 aa, Mycobacterium avium
KAAPTRKN

SEQ ID NO: 67635 - protein, 6 aa, Mycobacterium avium
KAATAL

SEQ ID NO: 67636 - protein, 11 aa, Mycobacterium avium
KADAARHDPGD

SEQ ID NO: 67637 - protein, 13 aa, Mycobacterium avium
KADPNSGPTRPGI

SEQ ID NO: 67638 - protein, 5 aa, Mycobacterium avium
KADTV

SEQ ID NO: 67639 - protein, 6 aa, Mycobacterium avium
KADVPA

SEQ ID NO: 67640 - protein, 7 aa, Mycobacterium avium
KADWGAA

SEQ ID NO: 67641 - protein, 9 aa, Mycobacterium avium
KAEESQRRR

SEQ ID NO: 67642 - protein, 9 aa, Mycobacterium avium
KAESAGGQQ

SEQ ID NO: 67643 - protein, 7 aa, Mycobacterium avium
KAFAAGA

SEQ ID NO: 67644 - protein, 9 aa, Mycobacterium avium
KAFTDTADH

SEQ ID NO: 67645 - protein, 23 aa, Mycobacterium avium
KAFTQGSSQSHQSETKEGKETMT

SEQ ID NO: 67646 - protein, 7 aa, Mycobacterium avium
KAGADIS

SEQ ID NO: 67647 - protein, 8 aa, Mycobacterium avium
KAGDGSTR

SEQ ID NO: 67648 - protein, 19 aa, Mycobacterium avium
KAGDSAEDAAAQGTEAGRE

SEQ ID NO: 67649 - protein, 7 aa, Mycobacterium avium
KAGEAVD

SEQ ID NO: 67650 - protein, 17 aa, Mycobacterium avium
KAGEGVVNDDGTLTAGP

SEQ ID NO: 67651 - protein, 5 aa, Mycobacterium avium
KAGGF

SEQ ID NO: 67652 - protein, 9 aa, Mycobacterium avium
KAGLTPEQI

SEQ ID NO: 67653 - protein, 26 aa, Mycobacterium avium
KAGPTSSTSRTPSKPRRCTTSAAGAR

SEQ ID NO: 67654 - protein, 9 aa, Mycobacterium avium
KAGVPDGTT

SEQ ID NO: 67655 - protein, 11 aa, Mycobacterium avium
KAGVPGADPAS

SEQ ID NO: 67656 - protein, 6 aa, Mycobacterium avium
KAGVTP

SEQ ID NO: 67657 - protein, 8 aa, Mycobacterium avium
KAGYRGSD

SEQ ID NO: 67658 - protein, 8 aa, Mycobacterium avium
KAHSTAPA

SEQ ID NO: 67659 - protein, 5 aa, Mycobacterium avium
KAKGE

SEQ ID NO: 67660 - protein, 29 aa, Mycobacterium avium
KAKKSSVPNENIERARKRGAGEEAGGADW

SEQ ID NO: 67661 - protein, 8 aa, Mycobacterium avium
KAKQYTDS

SEQ ID NO: 67662 - protein, 8 aa, Mycobacterium avium
KALADELG

SEQ ID NO: 67663 - protein, 6 aa, Mycobacterium avium
KALGEA

SEQ ID NO: 67664 - protein, 5 aa, Mycobacterium avium
KANDI

SEQ ID NO: 67665 - protein, 15 aa, Mycobacterium avium
KAPAFSLPDADGNTV

SEQ ID NO: 67666 - protein, 18 aa, Mycobacterium avium
KAPAGTALHGTAESGVPL

SEQ ID NO: 67667 - protein, 6 aa, Mycobacterium avium
KAPGTW

SEQ ID NO: 67668 - protein, 8 aa, Mycobacterium avium
KAPPAPDI

SEQ ID NO: 67669 - protein, 9 aa, Mycobacterium avium
KAPPKATAN

SEQ ID NO: 67670 - protein, 4 aa, Mycobacterium avium
KAPQ

SEQ ID NO: 67671 - protein, 11 aa, Mycobacterium avium
KAPTVAPGPTD

SEQ ID NO: 67672 - protein, 8 aa, Mycobacterium avium
KAQGESVD

SEQ ID NO: 67673 - protein, 15 aa, Mycobacterium avium
KAQGHDKDSRGGSSF

SEQ ID NO: 67674 - protein, 8 aa, Mycobacterium avium
KAQHPDWA

SEQ ID NO: 67675 - protein, 7 aa, Mycobacterium avium
KARALPA

SEQ ID NO: 67676 - protein, 6 aa, Mycobacterium avium
KARDAE

SEQ ID NO: 67677 - protein, 9 aa, Mycobacterium avium
KARDAFDAT

SEQ ID NO: 67678 - protein, 5 aa, Mycobacterium avium
KAREA

SEQ ID NO: 67679 - protein, 22 aa, Mycobacterium avium
KAREQATGAEPAADDGPTPGTI

SEQ ID NO: 67680 - protein, 8 aa, Mycobacterium avium
KARLGDLD

SEQ ID NO: 67681 - protein, 8 aa, Mycobacterium avium
KARPTDTV

SEQ ID NO: 67682 - protein, 6 aa, Mycobacterium avium
KARRFA

SEQ ID NO: 67683 - protein, 8 aa, Mycobacterium avium
KASAGECQ

SEQ ID NO: 67684 - protein, 7 aa, Mycobacterium avium
KASDEAY

SEQ ID NO: 67685 - protein, 9 aa, Mycobacterium avium
KASGRDLSD

SEQ ID NO: 67686 - protein, 6 aa, Mycobacterium avium
KASIST

SEQ ID NO: 67687 - protein, 8 aa, Mycobacterium avium
KASKVART

SEQ ID NO: 67688 - protein, 6 aa, Mycobacterium avium
KASTTT

SEQ ID NO: 67689 - protein, 5 aa, Mycobacterium avium
KATDR

SEQ ID NO: 67690 - protein, 8 aa, Mycobacterium avium
KATGTEIT

SEQ ID NO: 67691 - protein, 5 aa, Mycobacterium avium
KATRA

SEQ ID NO: 67692 - protein, 7 aa, Mycobacterium avium
KATRDDI

SEQ ID NO: 67693 - protein, 9 aa, Mycobacterium avium
KATTGQGSV

SEQ ID NO: 67694 - protein, 8 aa, Mycobacterium avium
KATVEGRP

SEQ ID NO: 67695 - protein, 11 aa, Mycobacterium avium
KAVAPGVTTDE

SEQ ID NO: 67696 - protein, 5 aa, Mycobacterium avium
KAVDG

SEQ ID NO: 67697 - protein, 7 aa, Mycobacterium avium
KAVPAGI

SEQ ID NO: 67698 - protein, 19 aa, Mycobacterium avium
KAVQTSSADLVSGRKDGPL

SEQ ID NO: 67699 - protein, 6 aa, Mycobacterium avium
KAVRAD

SEQ ID NO: 67700 - protein, 6 aa, Mycobacterium avium
KAVRGA

SEQ ID NO: 67701 - protein, 9 aa, Mycobacterium avium
KAYGPEQAH

SEQ ID NO: 67702 - protein, 34 aa, Mycobacterium avium
KDAADAAAADADRKARAADAAAKFPANEANGSQE

SEQ ID NO: 67703 - protein, 21 aa, Mycobacterium avium
KDAAVKQNSVTKEIRTNVAAS

SEQ ID NO: 67704 - protein, 10 aa, Mycobacterium avium
KDAKMGQEGA

SEQ ID NO: 67705 - protein, 26 aa, Mycobacterium avium
KDAPTGPAPTGGPVPGQPVRPGPSGA

SEQ ID NO: 67706 - protein, 4 aa, Mycobacterium avium
KDAR

SEQ ID NO: 67707 - protein, 6 aa, Mycobacterium avium
KDARTL

SEQ ID NO: 67708 - protein, 6 aa, Mycobacterium avium
KDDTRL

SEQ ID NO: 67709 - protein, 20 aa, Mycobacterium avium
KDEGATIITGGERAELGGDL

SEQ ID NO: 67710 - protein, 10 aa, Mycobacterium avium
KDEKKTAETF

SEQ ID NO: 67711 - protein, 8 aa, Mycobacterium avium
KDETPSTV

SEQ ID NO: 67712 - protein, 4 aa, Mycobacterium avium
KDGH

SEQ ID NO: 67713 - protein, 14 aa, Mycobacterium avium
KDGQPNTHDDSGYD

SEQ ID NO: 67714 - protein, 6 aa, Mycobacterium avium
KDGRHS

SEQ ID NO: 67715 - protein, 7 aa, Mycobacterium avium
KDGSGEP

SEQ ID NO: 67716 - protein, 11 aa, Mycobacterium avium
KDGTNAVGNRT

SEQ ID NO: 67717 - protein, 13 aa, Mycobacterium avium
KDHDEKRLTSCGR

SEQ ID NO: 67718 - protein, 7 aa, Mycobacterium avium
KDHGLQP

SEQ ID NO: 67719 - protein, 7 aa, Mycobacterium avium
KDISTTE

SEQ ID NO: 67720 - protein, 7 aa, Mycobacterium avium
KDITESG

SEQ ID NO: 67721 - protein, 9 aa, Mycobacterium avium
KDKETKERY

SEQ ID NO: 67722 - protein, 15 aa, Mycobacterium avium
KDKHEELAGHDQSDH

SEQ ID NO: 67723 - protein, 6 aa, Mycobacterium avium
KDKKNR

SEQ ID NO: 67724 - protein, 5 aa, Mycobacterium avium
KDLEP

SEQ ID NO: 67725 - protein, 7 aa, Mycobacterium avium
KDLGAEA

SEQ ID NO: 67726 - protein, 8 aa, Mycobacterium avium
KDLPAGSL

SEQ ID NO: 67727 - protein, 15 aa, Mycobacterium avium
KDLPAVGEPPADEDS

SEQ ID NO: 67728 - protein, 6 aa, Mycobacterium avium
KDLPEN

SEQ ID NO: 67729 - protein, 38 aa, Mycobacterium avium
KDLTDAARAVRRDRTERESDAERRAREDRRDAELDRRN

SEQ ID NO: 67730 - protein, 13 aa, Mycobacterium avium
KDPAAREKLAAAG

SEQ ID NO: 67731 - protein, 7 aa, Mycobacterium avium
KDPDTGW

SEQ ID NO: 67732 - protein, 8 aa, Mycobacterium avium
KDPQRGAW

SEQ ID NO: 67733 - protein, 19 aa, Mycobacterium avium
KDPTGLEHPGKLENRRSGV

SEQ ID NO: 67734 - protein, 13 aa, Mycobacterium avium
KDPVGHKGARLTT

SEQ ID NO: 67735 - protein, 6 aa, Mycobacterium avium
KDQAGA

SEQ ID NO: 67736 - protein, 18 aa, Mycobacterium avium
KDQREAEGGSKVPEETLS

SEQ ID NO: 67737 - protein, 7 aa, Mycobacterium avium
KDREGRN

SEQ ID NO: 67738 - protein, 6 aa, Mycobacterium avium
KDRGDQ

SEQ ID NO: 67739 - protein, 6 aa, Mycobacterium avium
KDRNPK

SEQ ID NO: 67740 - protein, 9 aa, Mycobacterium avium
KDRRGARRR

SEQ ID NO: 67741 - protein, 24 aa, Mycobacterium avium
KDRSTKKEVKQVKPTHSDVGSEVS

SEQ ID NO: 67742 - protein, 10 aa, Mycobacterium avium
KDSTGLRPEQ

SEQ ID NO: 67743 - protein, 4 aa, Mycobacterium avium
KDSY

SEQ ID NO: 67744 - protein, 6 aa, Mycobacterium avium
KDTDPV

SEQ ID NO: 67745 - protein, 4 aa, Mycobacterium avium
KDTE

SEQ ID NO: 67746 - protein, 6 aa, Mycobacterium avium
KDTEPF

SEQ ID NO: 67747 - protein, 13 aa, Mycobacterium avium
KDYETFSSAKGAT

SEQ ID NO: 67748 - protein, 5 aa, Mycobacterium avium
KDYRT

SEQ ID NO: 67749 - protein, 4 aa, Mycobacterium avium
KEAG

SEQ ID NO: 67750 - protein, 13 aa, Mycobacterium avium
KEATDAALALAAG

SEQ ID NO: 67751 - protein, 11 aa, Mycobacterium avium
KEDPPPNGSYP

SEQ ID NO: 67752 - protein, 19 aa, Mycobacterium avium
KEEGARVTIGGGKPEGLDS

SEQ ID NO: 67753 - protein, 6 aa, Mycobacterium avium
KEEPGV

SEQ ID NO: 67754 - protein, 6 aa, Mycobacterium avium
KEFDRT

SEQ ID NO: 67755 - protein, 19 aa, Mycobacterium avium
KEGAVPPVKATNVSPVETE

SEQ ID NO: 67756 - protein, 8 aa, Mycobacterium avium
KEGREEAV

SEQ ID NO: 67757 - protein, 5 aa, Mycobacterium avium
KEGRR

SEQ ID NO: 67758 - protein, 14 aa, Mycobacterium avium
KEGSTRPTTARATD

SEQ ID NO: 67759 - protein, 9 aa, Mycobacterium avium
KEHRDAVPR

SEQ ID NO: 67760 - protein, 5 aa, Mycobacterium avium
KENRR

SEQ ID NO: 67761 - protein, 21 aa, Mycobacterium avium
KEPGGEKAAAKRDKKGIPSAR

SEQ ID NO: 67762 - protein, 7 aa, Mycobacterium avium
KEPPKRV

SEQ ID NO: 67763 - protein, 14 aa, Mycobacterium avium
KEPPPPLPAELPPN

SEQ ID NO: 67764 - protein, 22 aa, Mycobacterium avium
KEPPPPLPAELPPNVRELIEIT

SEQ ID NO: 67765 - protein, 7 aa, Mycobacterium avium
KEPQQMR

SEQ ID NO: 67766 - protein, 7 aa, Mycobacterium avium
KEPQRGA

SEQ ID NO: 67767 - protein, 11 aa, Mycobacterium avium
KEQLRSLPDPL

SEQ ID NO: 67768 - protein, 12 aa, Mycobacterium avium
KERELPGPDDEF

SEQ ID NO: 67769 - protein, 31 aa, Mycobacterium avium
KERKMGSSERSEAFGTPRESDMSSGDEAELE

SEQ ID NO: 67770 - protein, 17 aa, Mycobacterium avium
KERRRTGGHPAHTSAPH

SEQ ID NO: 67771 - protein, 8 aa, Mycobacterium avium
KESASGAR

SEQ ID NO: 67772 - protein, 4 aa, Mycobacterium avium
KESL

SEQ ID NO: 67773 - protein, 7 aa, Mycobacterium avium
KESSPRV

SEQ ID NO: 67774 - protein, 7 aa, Mycobacterium avium
KETESLQ

SEQ ID NO: 67775 - protein, 17 aa, Mycobacterium avium
KEVRAPRARMTGSERRQ

SEQ ID NO: 67776 - protein, 4 aa, Mycobacterium avium
KEVS

SEQ ID NO: 67777 - protein, 7 aa, Mycobacterium avium
KEYGGQG

SEQ ID NO: 67778 - protein, 18 aa, Mycobacterium avium
KFGANADTSGADPHAVAA

SEQ ID NO: 67779 - protein, 18 aa, Mycobacterium avium
KFGANAGTSGADPHAVAA

SEQ ID NO: 67780 - protein, 13 aa, Mycobacterium avium
KFGPGGGSSPHHH

SEQ ID NO: 67781 - protein, 7 aa, Mycobacterium avium
KFGPIAT

SEQ ID NO: 67782 - protein, 13 aa, Mycobacterium avium
KFGVGGGPIANED

SEQ ID NO: 67783 - protein, 7 aa, Mycobacterium avium
KFREETR

SEQ ID NO: 67784 - protein, 13 aa, Mycobacterium avium
KFSAGSAEGMLSP

SEQ ID NO: 67785 - protein, 14 aa, Mycobacterium avium
KFSAGSAEGMLSPT

SEQ ID NO: 67786 - protein, 13 aa, Mycobacterium avium
KFSGQPPVSPDVA

SEQ ID NO: 67787 - protein, 9 aa, Mycobacterium avium
KGAHGSCSS

SEQ ID NO: 67788 - protein, 12 aa, Mycobacterium avium
KGAPASGFMTDG

SEQ ID NO: 67789 - protein, 13 aa, Mycobacterium avium
KGAPPPHDNETAA

SEQ ID NO: 67790 - protein, 11 aa, Mycobacterium avium
KGDALTSQERG

SEQ ID NO: 67791 - protein, 7 aa, Mycobacterium avium
KGDPAVV

SEQ ID NO: 67792 - protein, 6 aa, Mycobacterium avium
KGDRDL

SEQ ID NO: 67793 - protein, 9 aa, Mycobacterium avium
KGEAGADSF

SEQ ID NO: 67794 - protein, 6 aa, Mycobacterium avium
KGEAKE

SEQ ID NO: 67795 - protein, 9 aa, Mycobacterium avium
KGEGGPYVA

SEQ ID NO: 67796 - protein, 12 aa, Mycobacterium avium
KGEPRTAGTAVS

SEQ ID NO: 67797 - protein, 8 aa, Mycobacterium avium
KGERPGRK

SEQ ID NO: 67798 - protein, 4 aa, Mycobacterium avium
KGEY

SEQ ID NO: 67799 - protein, 9 aa, Mycobacterium avium
KGFASHGES

SEQ ID NO: 67800 - protein, 8 aa, Mycobacterium avium
KGFSASAP

SEQ ID NO: 67801 - protein, 5 aa, Mycobacterium avium
KGGAM

SEQ ID NO: 67802 - protein, 10 aa, Mycobacterium avium
KGGAPEAPGW

SEQ ID NO: 67803 - protein, 8 aa, Mycobacterium avium
KGGDYLAD

SEQ ID NO: 67804 - protein, 5 aa, Mycobacterium avium
KGGHH

SEQ ID NO: 67805 - protein, 5 aa, Mycobacterium avium
KGHAA

SEQ ID NO: 67806 - protein, 14 aa, Mycobacterium avium
KGHSASGASALPKS

SEQ ID NO: 67807 - protein, 14 aa, Mycobacterium avium
KGHSASGASVLPKS

SEQ ID NO: 67808 - protein, 4 aa, Mycobacterium avium
KGIE

SEQ ID NO: 67809 - protein, 16 aa, Mycobacterium avium
KGITIPDPSQPEPVQE

SEQ ID NO: 67810 - protein, 10 aa, Mycobacterium avium
KGKAAKGDGD

SEQ ID NO: 67811 - protein, 12 aa, Mycobacterium avium
KGKKVAVTKGTD

SEQ ID NO: 67812 - protein, 8 aa, Mycobacterium avium
KGKNDGVE

SEQ ID NO: 67813 - protein, 5 aa, Mycobacterium avium
KGLDE

SEQ ID NO: 67814 - protein, 23 aa, Mycobacterium avium
KGLPPNPDATSTSLPGARGADVD

SEQ ID NO: 67815 - protein, 16 aa, Mycobacterium avium
KGLSATGSFTSTGAGA

SEQ ID NO: 67816 - protein, 7 aa, Mycobacterium avium
KGLSPQR

SEQ ID NO: 67817 - protein, 6 aa, Mycobacterium avium
KGNALD

SEQ ID NO: 67818 - protein, 4 aa, Mycobacterium avium
KGPV

SEQ ID NO: 67819 - protein, 13 aa, Mycobacterium avium
KGQLEGPGPSAGP

SEQ ID NO: 67820 - protein, 6 aa, Mycobacterium avium
KGQLSD

SEQ ID NO: 67821 - protein, 12 aa, Mycobacterium avium
KGQPRTAGTAVS

SEQ ID NO: 67822 - protein, 10 aa, Mycobacterium avium
KGQVGPGGVV

SEQ ID NO: 67823 - protein, 6 aa, Mycobacterium avium
KGRVGE

SEQ ID NO: 67824 - protein, 6 aa, Mycobacterium avium
KGTEDQ

SEQ ID NO: 67825 - protein, 6 aa, Mycobacterium avium
KGTGAP

SEQ ID NO: 67826 - protein, 6 aa, Mycobacterium avium
KGTLQD

SEQ ID NO: 67827 - protein, 7 aa, Mycobacterium avium
KGTPGFE

SEQ ID NO: 67828 - protein, 14 aa, Mycobacterium avium
KGTRPDGARYDADD

SEQ ID NO: 67829 - protein, 8 aa, Mycobacterium avium
KGVAPETP

SEQ ID NO: 67830 - protein, 4 aa, Mycobacterium avium
KHAA

SEQ ID NO: 67831 - protein, 5 aa, Mycobacterium avium
KHAAE

SEQ ID NO: 67832 - protein, 9 aa, Mycobacterium avium
KHADGDRTQ

SEQ ID NO: 67833 - protein, 4 aa, Mycobacterium avium
KHPG

SEQ ID NO: 67834 - protein, 7 aa, Mycobacterium avium
KHPNAAG

SEQ ID NO: 67835 - protein, 10 aa, Mycobacterium avium
KHPPSRERQR

SEQ ID NO: 67836 - protein, 9 aa, Mycobacterium avium
KHPRSPLET

SEQ ID NO: 67837 - protein, 6 aa, Mycobacterium avium
KIAGEG

SEQ ID NO: 67838 - protein, 7 aa, Mycobacterium avium
KIAPARK

SEQ ID NO: 67839 - protein, 6 aa, Mycobacterium avium
KIDGDA

SEQ ID NO: 67840 - protein, 14 aa, Mycobacterium avium
KIGKTTRLADDPRL

SEQ ID NO: 67841 - protein, 7 aa, Mycobacterium avium
KIRDDDP

SEQ ID NO: 67842 - protein, 6 aa, Mycobacterium avium
KIRTGT

SEQ ID NO: 67843 - protein, 7 aa, Mycobacterium avium
KIRTPRG

SEQ ID NO: 67844 - protein, 14 aa, Mycobacterium avium
KITPDAVATTDGEH

SEQ ID NO: 67845 - protein, 15 aa, Mycobacterium avium
KITPDAVATTDGETH

SEQ ID NO: 67846 - protein, 9 aa, Mycobacterium avium
KKATGNVET

SEQ ID NO: 67847 - protein, 6 aa, Mycobacterium avium
KKENFT

SEQ ID NO: 67848 - protein, 8 aa, Mycobacterium avium
KKEQTPMR

SEQ ID NO: 67849 - protein, 15 aa, Mycobacterium avium
KKGDKSKVLPADAQL

SEQ ID NO: 67850 - protein, 6 aa, Mycobacterium avium
KKGEPV

SEQ ID NO: 67851 - protein, 7 aa, Mycobacterium avium
KKGKEAY

SEQ ID NO: 67852 - protein, 7 aa, Mycobacterium avium
KKHTVSE

SEQ ID NO: 67853 - protein, 5 aa, Mycobacterium avium
KKLNP

SEQ ID NO: 67854 - protein, 8 aa, Mycobacterium avium
KKLPPEKL

SEQ ID NO: 67855 - protein, 10 aa, Mycobacterium avium
KKPKQAHPNI

SEQ ID NO: 67856 - protein, 10 aa, Mycobacterium avium
KKRGGSDEEV

SEQ ID NO: 67857 - protein, 11 aa, Mycobacterium avium
KKRKGSVQSPK

SEQ ID NO: 67858 - protein, 5 aa, Mycobacterium avium
KKRRS

SEQ ID NO: 67859 - protein, 5 aa, Mycobacterium avium
KKTNL

SEQ ID NO: 67860 - protein, 6 aa, Mycobacterium avium
KKTPSV

SEQ ID NO: 67861 - protein, 32 aa, Mycobacterium avium
KKTRINAASKRYSQRQKGRTGREPQESPSAPI

SEQ ID NO: 67862 - protein, 28 aa, Mycobacterium avium
KKTRINAASKRYSQRQKGRTGREQQESL

SEQ ID NO: 67863 - protein, 16 aa, Mycobacterium avium
KKVRTTIADPAAARAA

SEQ ID NO: 67864 - protein, 11 aa, Mycobacterium avium
KLAARTGVPEE

SEQ ID NO: 67865 - protein, 12 aa, Mycobacterium avium
KLADDLGPATVQ

SEQ ID NO: 67866 - protein, 12 aa, Mycobacterium avium
KLARRTRDNYQG

SEQ ID NO: 67867 - protein, 8 aa, Mycobacterium avium
KLATTGKV

SEQ ID NO: 67868 - protein, 8 aa, Mycobacterium avium
KLEAETEK

SEQ ID NO: 67869 - protein, 15 aa, Mycobacterium avium
KLGAPNGRIKATHCS

SEQ ID NO: 67870 - protein, 9 aa, Mycobacterium avium
KLGATPQAT

SEQ ID NO: 67871 - protein, 22 aa, Mycobacterium avium
KLGDPKDPATEMGPVSNQPQYE

SEQ ID NO: 67872 - protein, 8 aa, Mycobacterium avium
KLGGAQPT

SEQ ID NO: 67873 - protein, 8 aa, Mycobacterium avium
KLGGEEVK

SEQ ID NO: 67874 - protein, 15 aa, Mycobacterium avium
KLGNHANASSEVEYD

SEQ ID NO: 67875 - protein, 6 aa, Mycobacterium avium
KLGNQA

SEQ ID NO: 67876 - protein, 5 aa, Mycobacterium avium
KLGPQ

SEQ ID NO: 67877 - protein, 9 aa, Mycobacterium avium
KLGQESQAL

SEQ ID NO: 67878 - protein, 10 aa, Mycobacterium avium
KLGQPEDPDV

SEQ ID NO: 67879 - protein, 10 aa, Mycobacterium avium
KLGSVGRPLP

SEQ ID NO: 67880 - protein, 4 aa, Mycobacterium avium
KLGT

SEQ ID NO: 67881 - protein, 6 aa, Mycobacterium avium
KLNAQR

SEQ ID NO: 67882 - protein, 13 aa, Mycobacterium avium
KLNPHPEDPFTAD

SEQ ID NO: 67883 - protein, 8 aa, Mycobacterium avium
KLNRSPKE

SEQ ID NO: 67884 - protein, 16 aa, Mycobacterium avium
KLPAPSIPPRIAAAEA

SEQ ID NO: 67885 - protein, 7 aa, Mycobacterium avium
KLPPDQQ

SEQ ID NO: 67886 - protein, 6 aa, Mycobacterium avium
KLPSAD

SEQ ID NO: 67887 - protein, 8 aa, Mycobacterium avium
KLPSSDAL

SEQ ID NO: 67888 - protein, 13 aa, Mycobacterium avium
KLPTAGEAQGVPN

SEQ ID NO: 67889 - protein, 13 aa, Mycobacterium avium
KLQPPTHTPPHQI

SEQ ID NO: 67890 - protein, 6 aa, Mycobacterium avium
KLRARG

SEQ ID NO: 67891 - protein, 23 aa, Mycobacterium avium
KLRDRSKPSPSRATSRRTGEKQT

SEQ ID NO: 67892 - protein, 8 aa, Mycobacterium avium
KLSAPPSE

SEQ ID NO: 67893 - protein, 13 aa, Mycobacterium avium
KLSDQGPASTFTS

SEQ ID NO: 67894 - protein, 5 aa, Mycobacterium avium
KLSGR

SEQ ID NO: 67895 - protein, 11 aa, Mycobacterium avium
KLSPPRRRPVS

SEQ ID NO: 67896 - protein, 7 aa, Mycobacterium avium
KLSRSPK

SEQ ID NO: 67897 - protein, 6 aa, Mycobacterium avium
KMGEPY

SEQ ID NO: 67898 - protein, 6 aa, Mycobacterium avium
KMPDDA

SEQ ID NO: 67899 - protein, 8 aa, Mycobacterium avium
KMSGSNIR

SEQ ID NO: 67900 - protein, 5 aa, Mycobacterium avium
KMSPD

SEQ ID NO: 67901 - protein, 22 aa, Mycobacterium avium
KNAQEAHEAIRPAGETFATPDA

SEQ ID NO: 67902 - protein, 7 aa, Mycobacterium avium
KNDDPVG

SEQ ID NO: 67903 - protein, 18 aa, Mycobacterium avium
KNDGVPLKAGKKKSARAA

SEQ ID NO: 67904 - protein, 16 aa, Mycobacterium avium
KNEMGPPPDKVQPGEI

SEQ ID NO: 67905 - protein, 5 aa, Mycobacterium avium
KNGSY

SEQ ID NO: 67906 - protein, 10 aa, Mycobacterium avium
KNGTAEQKSR

SEQ ID NO: 67907 - protein, 8 aa, Mycobacterium avium
KNGYTGHK

SEQ ID NO: 67908 - protein, 10 aa, Mycobacterium avium
KNISASQVED

SEQ ID NO: 67909 - protein, 9 aa, Mycobacterium avium
KNLEPQSSR

SEQ ID NO: 67910 - protein, 18 aa, Mycobacterium avium
KNLQPAEPARGAFAPTDR

SEQ ID NO: 67911 - protein, 11 aa, Mycobacterium avium
KNLSDAERAGL

SEQ ID NO: 67912 - protein, 11 aa, Mycobacterium avium
KNLSEAERAGL

SEQ ID NO: 67913 - protein, 11 aa, Mycobacterium avium
KNNRRDGENTF

SEQ ID NO: 67914 - protein, 12 aa, Mycobacterium avium
KNNRRDGENTFR

SEQ ID NO: 67915 - protein, 5 aa, Mycobacterium avium
KNPAI

SEQ ID NO: 67916 - protein, 12 aa, Mycobacterium avium
KNPFASAPVERS

SEQ ID NO: 67917 - protein, 4 aa, Mycobacterium avium
KNPK

SEQ ID NO: 67918 - protein, 9 aa, Mycobacterium avium
KNPQLTASE

SEQ ID NO: 67919 - protein, 9 aa, Mycobacterium avium
KNQKDYSAA

SEQ ID NO: 67920 - protein, 8 aa, Mycobacterium avium
KNTDDPEI

SEQ ID NO: 67921 - protein, 6 aa, Mycobacterium avium
KNVPGS

SEQ ID NO: 67922 - protein, 8 aa, Mycobacterium avium
KNYNGSWT

SEQ ID NO: 67923 - protein, 19 aa, Mycobacterium avium
KPASNPLASGSAARPDPTA

SEQ ID NO: 67924 - protein, 21 aa, Mycobacterium avium
KPCERTQLTGPSAARDVTENP

SEQ ID NO: 67925 - protein, 8 aa, Mycobacterium avium
KPDAGPRP

SEQ ID NO: 67926 - protein, 4 aa, Mycobacterium avium
KPDD

SEQ ID NO: 67927 - protein, 4 aa, Mycobacterium avium
KPDR

SEQ ID NO: 67928 - protein, 18 aa, Mycobacterium avium
KPDRRGARRPARHDVPPH

SEQ ID NO: 67929 - protein, 11 aa, Mycobacterium avium
KPEADAQARAV

SEQ ID NO: 67930 - protein, 5 aa, Mycobacterium avium
KPEQQ

SEQ ID NO: 67931 - protein, 7 aa, Mycobacterium avium
KPERRTE

SEQ ID NO: 67932 - protein, 6 aa, Mycobacterium avium
KPFGTD

SEQ ID NO: 67933 - protein, 6 aa, Mycobacterium avium
KPFKKE

SEQ ID NO: 67934 - protein, 12 aa, Mycobacterium avium
KPFTSGKSPEDY

SEQ ID NO: 67935 - protein, 13 aa, Mycobacterium avium
KPGAGSLSIGQTP

SEQ ID NO: 67936 - protein, 9 aa, Mycobacterium avium
KPGAGTDAA

SEQ ID NO: 67937 - protein, 14 aa, Mycobacterium avium
KPGAKVDARSERWR

SEQ ID NO: 67938 - protein, 6 aa, Mycobacterium avium
KPGGSV

SEQ ID NO: 67939 - protein, 10 aa, Mycobacterium avium
KPGTAGNDIP

SEQ ID NO: 67940 - protein, 44 aa, Mycobacterium avium
KPGYTGPSTDEATPAAAEAADAAGEDADRGDTVEPVDTGPVPLS

SEQ ID NO: 67941 - protein, 9 aa, Mycobacterium avium
KPHEEEPNR

SEQ ID NO: 67942 - protein, 9 aa, Mycobacterium avium
KPKAPQSGY

SEQ ID NO: 67943 - protein, 15 aa, Mycobacterium avium
KPKGIRDAKARIGDL

SEQ ID NO: 67944 - protein, 8 aa, Mycobacterium avium
KPKPTTLR

SEQ ID NO: 67945 - protein, 6 aa, Mycobacterium avium
KPLDDT

SEQ ID NO: 67946 - protein, 4 aa, Mycobacterium avium
KPLF

SEQ ID NO: 67947 - protein, 9 aa, Mycobacterium avium
KPLSSAERR

SEQ ID NO: 67948 - protein, 4 aa, Mycobacterium avium
KPMS

SEQ ID NO: 67949 - protein, 5 aa, Mycobacterium avium
KPMSP

SEQ ID NO: 67950 - protein, 4 aa, Mycobacterium avium
KPNN

SEQ ID NO: 67951 - protein, 5 aa, Mycobacterium avium
KPPPL

SEQ ID NO: 67952 - protein, 26 aa, Mycobacterium avium
KPPTAPPPQIQKTGVANQDAGGGPTQ

SEQ ID NO: 67953 - protein, 4 aa, Mycobacterium avium
KPQA

SEQ ID NO: 67954 - protein, 7 aa, Mycobacterium avium
KPQETER

SEQ ID NO: 67955 - protein, 10 aa, Mycobacterium avium
KPQTDDVRAA

SEQ ID NO: 67956 - protein, 14 aa, Mycobacterium avium
KPRARKRPKGAPTH

SEQ ID NO: 67957 - protein, 7 aa, Mycobacterium avium
KPRPARP

SEQ ID NO: 67958 - protein, 14 aa, Mycobacterium avium
KPRPDINPDGPTTL

SEQ ID NO: 67959 - protein, 29 aa, Mycobacterium avium
KPSAPGRQYSAPVHPRAEGPGPDPSAPMY

SEQ ID NO: 67960 - protein, 5 aa, Mycobacterium avium
KPSHT

SEQ ID NO: 67961 - protein, 8 aa, Mycobacterium avium
KPSRGRLP

SEQ ID NO: 67962 - protein, 8 aa, Mycobacterium avium
KPTLAQST

SEQ ID NO: 67963 - protein, 4 aa, Mycobacterium avium
KPTV

SEQ ID NO: 67964 - protein, 12 aa, Mycobacterium avium
KPVASGPSFATA

SEQ ID NO: 67965 - protein, 7 aa, Mycobacterium avium
KPVDDDS

SEQ ID NO: 67966 - protein, 4 aa, Mycobacterium avium
KPVG

SEQ ID NO: 67967 - protein, 6 aa, Mycobacterium avium
KPVPGQ

SEQ ID NO: 67968 - protein, 13 aa, Mycobacterium avium
KPVPSTGKPDPQK

SEQ ID NO: 67969 - protein, 12 aa, Mycobacterium avium
KPWGGRKKADDA

SEQ ID NO: 67970 - protein, 10 aa, Mycobacterium avium
KPYGRGADSV

SEQ ID NO: 67971 - protein, 8 aa, Mycobacterium avium
KQDGGRRQ

SEQ ID NO: 67972 - protein, 6 aa, Mycobacterium avium
KQEVEG

SEQ ID NO: 67973 - protein, 7 aa, Mycobacterium avium
KQGTGGS

SEQ ID NO: 67974 - protein, 6 aa, Mycobacterium avium
KQLKNN

SEQ ID NO: 67975 - protein, 7 aa, Mycobacterium avium
KQPEGRR

SEQ ID NO: 67976 - protein, 6 aa, Mycobacterium avium
KQPERQ

SEQ ID NO: 67977 - protein, 13 aa, Mycobacterium avium
KQPLGKDKDGNDV

SEQ ID NO: 67978 - protein, 4 aa, Mycobacterium avium
KQQA

SEQ ID NO: 67979 - protein, 138 aa, Mycobacterium avium
KQQMPTTPSTPNLGNGLGSGSPLGTGGSPLSTSPSKPLDTSSDRKLDDGRKGEEKKEERKLAEPKKEKSETKPSLAASKTDNAKAPESKLATAEKPGAHTAAVPAQPSAAAAAANPAAPAAQGQSAPPEQSKQVDVKG

SEQ ID NO: 67980 - protein, 21 aa, Mycobacterium avium
KQQWSDKPLKTEGSSAPIPIP

SEQ ID NO: 67981 - protein, 11 aa, Mycobacterium avium
KQRAEAGRGAA

SEQ ID NO: 67982 - protein, 5 aa, Mycobacterium avium
KQRDR

SEQ ID NO: 67983 - protein, 5 aa, Mycobacterium avium
KQREQ

SEQ ID NO: 67984 - protein, 8 aa, Mycobacterium avium
KQREQFGA

SEQ ID NO: 67985 - protein, 7 aa, Mycobacterium avium
KQSINDR

SEQ ID NO: 67986 - protein, 9 aa, Mycobacterium avium
KQTASPSLA

SEQ ID NO: 67987 - protein, 18 aa, Mycobacterium avium
KQTGSGNPEESYEPQPMQ

SEQ ID NO: 67988 - protein, 14 aa, Mycobacterium avium
KQTSWPKETPLSPT

SEQ ID NO: 67989 - protein, 17 aa, Mycobacterium avium
KQVAQRKAELKGADTPV

SEQ ID NO: 67990 - protein, 9 aa, Mycobacterium avium
KQVNDGGHR

SEQ ID NO: 67991 - protein, 14 aa, Mycobacterium avium
KQWQTDPKELPASN

SEQ ID NO: 67992 - protein, 20 aa, Mycobacterium avium
KRAAGPDVAAAEPAPPGAGE

SEQ ID NO: 67993 - protein, 20 aa, Mycobacterium avium
KRAAGPDVAAAEPTPPGAGE

SEQ ID NO: 67994 - protein, 21 aa, Mycobacterium avium
KRAAGPDVAAAEPTPPGAGEA

SEQ ID NO: 67995 - protein, 20 aa, Mycobacterium avium
KRAGADEIATYGSTPSQNAG

SEQ ID NO: 67996 - protein, 20 aa, Mycobacterium avium
KRAGRRKPTEADEVAAATAQ

SEQ ID NO: 67997 - protein, 8 aa, Mycobacterium avium
KRAGSAEL

SEQ ID NO: 67998 - protein, 6 aa, Mycobacterium avium
KRAGVN

SEQ ID NO: 67999 - protein, 12 aa, Mycobacterium avium
KRAPAPATTDSD

SEQ ID NO: 68000 - protein, 10 aa, Mycobacterium avium
KRAQPSLPAG

SEQ ID NO: 68001 - protein, 23 aa, Mycobacterium avium
KRASDSKSAGSDQAVAAVPDPDS

SEQ ID NO: 68002 - protein, 17 aa, Mycobacterium avium
KRDGGRVTTGGGVPDGL

SEQ ID NO: 68003 - protein, 12 aa, Mycobacterium avium
KRDGTGGNQPRT

SEQ ID NO: 68004 - protein, 10 aa, Mycobacterium avium
KRDPYGRTAR

SEQ ID NO: 68005 - protein, 11 aa, Mycobacterium avium
KRDPYGRTARQ

SEQ ID NO: 68006 - protein, 5 aa, Mycobacterium avium
KREAK

SEQ ID NO: 68007 - protein, 10 aa, Mycobacterium avium
KRGELSPVSR

SEQ ID NO: 68008 - protein, 14 aa, Mycobacterium avium
KRGIQEETGIKPPW

SEQ ID NO: 68009 - protein, 11 aa, Mycobacterium avium
KRGITDSASRR

SEQ ID NO: 68010 - protein, 12 aa, Mycobacterium avium
KRGNDSRSLASE

SEQ ID NO: 68011 - protein, 6 aa, Mycobacterium avium
KRGPGQ

SEQ ID NO: 68012 - protein, 9 aa, Mycobacterium avium
KRGSTAQSC

SEQ ID NO: 68013 - protein, 7 aa, Mycobacterium avium
KRHPRDD

SEQ ID NO: 68014 - protein, 7 aa, Mycobacterium avium
KRIDSAA

SEQ ID NO: 68015 - protein, 6 aa, Mycobacterium avium
KRKGAA

SEQ ID NO: 68016 - protein, 8 aa, Mycobacterium avium
KRKPSEYV

SEQ ID NO: 68017 - protein, 4 aa, Mycobacterium avium
KRKV

SEQ ID NO: 68018 - protein, 7 aa, Mycobacterium avium
KRPESKL

SEQ ID NO: 68019 - protein, 8 aa, Mycobacterium avium
KRPGERTE

SEQ ID NO: 68020 - protein, 8 aa, Mycobacterium avium
KRPGPGMK

SEQ ID NO: 68021 - protein, 26 aa, Mycobacterium avium
KRPRQRGRASGGGRREGRRGRPAGEA

SEQ ID NO: 68022 - protein, 25 aa, Mycobacterium avium
KRPSGDGAADEDADQADETTTADAG

SEQ ID NO: 68023 - protein, 10 aa, Mycobacterium avium
KRPVDAAEPE

SEQ ID NO: 68024 - protein, 9 aa, Mycobacterium avium
KRRGAPGDD

SEQ ID NO: 68025 - protein, 10 aa, Mycobacterium avium
KRRIDPETGE

SEQ ID NO: 68026 - protein, 7 aa, Mycobacterium avium
KRSERFS

SEQ ID NO: 68027 - protein, 10 aa, Mycobacterium avium
KRSMVGRSRA

SEQ ID NO: 68028 - protein, 16 aa, Mycobacterium avium
KRSVTFGSGGDDNAAR

SEQ ID NO: 68029 - protein, 10 aa, Mycobacterium avium
KRSVVGRGRA

SEQ ID NO: 68030 - protein, 12 aa, Mycobacterium avium
KRVEGQETDPPA

SEQ ID NO: 68031 - protein, 13 aa, Mycobacterium avium
KRVPDTAFASPPS

SEQ ID NO: 68032 - protein, 6 aa, Mycobacterium avium
KRYGGH

SEQ ID NO: 68033 - protein, 8 aa, Mycobacterium avium
KRYPNSGL

SEQ ID NO: 68034 - protein, 9 aa, Mycobacterium avium
KRYSQKPRA

SEQ ID NO: 68035 - protein, 9 aa, Mycobacterium avium
KSAASRVAS

SEQ ID NO: 68036 - protein, 7 aa, Mycobacterium avium
KSADEYV

SEQ ID NO: 68037 - protein, 6 aa, Mycobacterium avium
KSAGVN

SEQ ID NO: 68038 - protein, 4 aa, Mycobacterium avium
KSAK

SEQ ID NO: 68039 - protein, 6 aa, Mycobacterium avium
KSALPD

SEQ ID NO: 68040 - protein, 7 aa, Mycobacterium avium
KSARVTS

SEQ ID NO: 68041 - protein, 5 aa, Mycobacterium avium
KSAWD

SEQ ID NO: 68042 - protein, 6 aa, Mycobacterium avium
KSAWDY

SEQ ID NO: 68043 - protein, 16 aa, Mycobacterium avium
KSDGESNFGNIGSPQI

SEQ ID NO: 68044 - protein, 4 aa, Mycobacterium avium
KSDK

SEQ ID NO: 68045 - protein, 9 aa, Mycobacterium avium
KSDMSTLTR

SEQ ID NO: 68046 - protein, 17 aa, Mycobacterium avium
KSDRQGARQFQRPRERP

SEQ ID NO: 68047 - protein, 8 aa, Mycobacterium avium
KSDRTRES

SEQ ID NO: 68048 - protein, 6 aa, Mycobacterium avium
KSGARD

SEQ ID NO: 68049 - protein, 6 aa, Mycobacterium avium
KSGASY

SEQ ID NO: 68050 - protein, 5 aa, Mycobacterium avium
KSGAW

SEQ ID NO: 68051 - protein, 8 aa, Mycobacterium avium
KSGEGRYV

SEQ ID NO: 68052 - protein, 7 aa, Mycobacterium avium
KSGELPE

SEQ ID NO: 68053 - protein, 8 aa, Mycobacterium avium
KSGSTRCQ

SEQ ID NO: 68054 - protein, 7 aa, Mycobacterium avium
KSGYDQN

SEQ ID NO: 68055 - protein, 10 aa, Mycobacterium avium
KSHGPGSPIA

SEQ ID NO: 68056 - protein, 6 aa, Mycobacterium avium
KSHQQL

SEQ ID NO: 68057 - protein, 8 aa, Mycobacterium avium
KSIADGAS

SEQ ID NO: 68058 - protein, 5 aa, Mycobacterium avium
KSIDP

SEQ ID NO: 68059 - protein, 6 aa, Mycobacterium avium
KSLATT

SEQ ID NO: 68060 - protein, 5 aa, Mycobacterium avium
KSLSD

SEQ ID NO: 68061 - protein, 9 aa, Mycobacterium avium
KSLSPADRD

SEQ ID NO: 68062 - protein, 6 aa, Mycobacterium avium
KSLTGG

SEQ ID NO: 68063 - protein, 8 aa, Mycobacterium avium
KSMSTGGV

SEQ ID NO: 68064 - protein, 24 aa, Mycobacterium avium
KSPDKGRLTRTGGQAAARRRADDS

SEQ ID NO: 68065 - protein, 5 aa, Mycobacterium avium
KSPEM

SEQ ID NO: 68066 - protein, 36 aa, Mycobacterium avium
KSPQAPTSAAPEGPGAPAPPAEPAPPPEPAPTQTPP

SEQ ID NO: 68067 - protein, 11 aa, Mycobacterium avium
KSQAALPPEVT

SEQ ID NO: 68068 - protein, 17 aa, Mycobacterium avium
KSRAATEDAASGAKAID

SEQ ID NO: 68069 - protein, 11 aa, Mycobacterium avium
KSRGMGRNGPW

SEQ ID NO: 68070 - protein, 8 aa, Mycobacterium avium
KSRLPGAP

SEQ ID NO: 68071 - protein, 8 aa, Mycobacterium avium
KSRTRGYA

SEQ ID NO: 68072 - protein, 6 aa, Mycobacterium avium
KSSEFA

SEQ ID NO: 68073 - protein, 15 aa, Mycobacterium avium
KSSHGTGVGKDAITS

SEQ ID NO: 68074 - protein, 5 aa, Mycobacterium avium
KSTAA

SEQ ID NO: 68075 - protein, 13 aa, Mycobacterium avium
KSTADLPKNLEGV

SEQ ID NO: 68076 - protein, 10 aa, Mycobacterium avium
KSTDGNPPPI

SEQ ID NO: 68077 - protein, 6 aa, Mycobacterium avium
KSTEGM

SEQ ID NO: 68078 - protein, 9 aa, Mycobacterium avium
KSTEQQQAI

SEQ ID NO: 68079 - protein, 9 aa, Mycobacterium avium
KSTESARTL

SEQ ID NO: 68080 - protein, 19 aa, Mycobacterium avium
KSVTNPDGTGVRGKEAVDA

SEQ ID NO: 68081 - protein, 7 aa, Mycobacterium avium
KSVVASG

SEQ ID NO: 68082 - protein, 8 aa, Mycobacterium avium
KSYPTFTP

SEQ ID NO: 68083 - protein, 12 aa, Mycobacterium avium
KSYRPDYAPADR

SEQ ID NO: 68084 - protein, 6 aa, Mycobacterium avium
KTADQV

SEQ ID NO: 68085 - protein, 21 aa, Mycobacterium avium
KTANKDRDDITPEDARHPDLD

SEQ ID NO: 68086 - protein, 8 aa, Mycobacterium avium
KTDAAGDV

SEQ ID NO: 68087 - protein, 7 aa, Mycobacterium avium
KTDGAQC

SEQ ID NO: 68088 - protein, 12 aa, Mycobacterium avium
KTDPGVANPVEP

SEQ ID NO: 68089 - protein, 6 aa, Mycobacterium avium
KTDQEF

SEQ ID NO: 68090 - protein, 7 aa, Mycobacterium avium
KTDSARE

SEQ ID NO: 68091 - protein, 4 aa, Mycobacterium avium
KTFQ

SEQ ID NO: 68092 - protein, 15 aa, Mycobacterium avium
KTGEANGPLQNSRAG

SEQ ID NO: 68093 - protein, 13 aa, Mycobacterium avium
KTGGGTNITPSEV

SEQ ID NO: 68094 - protein, 35 aa, Mycobacterium avium
KTGGGVDPLTDAPAPITEQQRKESGIDVKPDRVEQ

SEQ ID NO: 68095 - protein, 8 aa, Mycobacterium avium
KTGKQARA

SEQ ID NO: 68096 - protein, 7 aa, Mycobacterium avium
KTGQQVE

SEQ ID NO: 68097 - protein, 6 aa, Mycobacterium avium
KTGSRR

SEQ ID NO: 68098 - protein, 20 aa, Mycobacterium avium
KTGTYSRYPAGPAALPSKKE

SEQ ID NO: 68099 - protein, 8 aa, Mycobacterium avium
KTHDVNST

SEQ ID NO: 68100 - protein, 4 aa, Mycobacterium avium
KTID

SEQ ID NO: 68101 - protein, 4 aa, Mycobacterium avium
KTIE

SEQ ID NO: 68102 - protein, 7 aa, Mycobacterium avium
KTIPEGS

SEQ ID NO: 68103 - protein, 7 aa, Mycobacterium avium
KTKGGKT

SEQ ID NO: 68104 - protein, 15 aa, Mycobacterium avium
KTLDRLHSPTQTATG

SEQ ID NO: 68105 - protein, 5 aa, Mycobacterium avium
KTLGG

SEQ ID NO: 68106 - protein, 16 aa, Mycobacterium avium
KTLRRQRTELTDQPEG

SEQ ID NO: 68107 - protein, 5 aa, Mycobacterium avium
KTNPI

SEQ ID NO: 68108 - protein, 8 aa, Mycobacterium avium
KTPETAGL

SEQ ID NO: 68109 - protein, 7 aa, Mycobacterium avium
KTPPSRA

SEQ ID NO: 68110 - protein, 18 aa, Mycobacterium avium
KTPTTTTTTSATAKPVPL

SEQ ID NO: 68111 - protein, 8 aa, Mycobacterium avium
KTQGGGRT

SEQ ID NO: 68112 - protein, 27 aa, Mycobacterium avium
KTQTPNPKIAGTLGETADAVQRAGGRA

SEQ ID NO: 68113 - protein, 27 aa, Mycobacterium avium
KTQTPNPKIAGTLTETAEAVRTAGGRA

SEQ ID NO: 68114 - protein, 4 aa, Mycobacterium avium
KTRA

SEQ ID NO: 68115 - protein, 4 aa, Mycobacterium avium
KTRD

SEQ ID NO: 68116 - protein, 23 aa, Mycobacterium avium
KTRQKSERAAAPRQCRGEARREA

SEQ ID NO: 68117 - protein, 23 aa, Mycobacterium avium
KTRQNPERAAAPRQCRGEARREA

SEQ ID NO: 68118 - protein, 23 aa, Mycobacterium avium
KTRQNSERAAAPRQGRGEARREA

SEQ ID NO: 68119 - protein, 12 aa, Mycobacterium avium
KTSIATSCGQET

SEQ ID NO: 68120 - protein, 24 aa, Mycobacterium avium
KTSSSTSTATSSKSSTAPAAQAKY

SEQ ID NO: 68121 - protein, 30 aa, Mycobacterium avium
KTSSSTSTSTSTSTATSSKSSTAPAAQAKY

SEQ ID NO: 68122 - protein, 9 aa, Mycobacterium avium
KTSSVRHTN

SEQ ID NO: 68123 - protein, 6 aa, Mycobacterium avium
KTSTVE

SEQ ID NO: 68124 - protein, 9 aa, Mycobacterium avium
KTTSSDTYA

SEQ ID NO: 68125 - protein, 14 aa, Mycobacterium avium
KTTVDASASVSSPG

SEQ ID NO: 68126 - protein, 22 aa, Mycobacterium avium
KTVTQRWPSGIKDGAEFSIPTM

SEQ ID NO: 68127 - protein, 67 aa, Mycobacterium avium
KTVTSEADRARRVKASKKAPEAAAAAPQAAVEPEAAEAAPAPDAPEAAPEAEAAAPRPADEAEGSSE

SEQ ID NO: 68128 - protein, 8 aa, Mycobacterium avium
KTYGRNSD

SEQ ID NO: 68129 - protein, 12 aa, Mycobacterium avium
KVAADSGVDNPT

SEQ ID NO: 68130 - protein, 7 aa, Mycobacterium avium
KVAPATA

SEQ ID NO: 68131 - protein, 18 aa, Mycobacterium avium
KVDGYSKALRTGRDTIET

SEQ ID NO: 68132 - protein, 12 aa, Mycobacterium avium
KVEGQSESLAER

SEQ ID NO: 68133 - protein, 7 aa, Mycobacterium avium
KVGGDDG

SEQ ID NO: 68134 - protein, 4 aa, Mycobacterium avium
KVGI

SEQ ID NO: 68135 - protein, 12 aa, Mycobacterium avium
KVGRRSADGRES

SEQ ID NO: 68136 - protein, 16 aa, Mycobacterium avium
KVGSSQRFSKTTEESL

SEQ ID NO: 68137 - protein, 5 aa, Mycobacterium avium
KVPPA

SEQ ID NO: 68138 - protein, 8 aa, Mycobacterium avium
KVPPTGSQ

SEQ ID NO: 68139 - protein, 8 aa, Mycobacterium avium
KVPVEDGK

SEQ ID NO: 68140 - protein, 16 aa, Mycobacterium avium
KVREGLDGGPAPTATM

SEQ ID NO: 68141 - protein, 12 aa, Mycobacterium avium
KVRSGPPVDDPQ

SEQ ID NO: 68142 - protein, 15 aa, Mycobacterium avium
KVRSGPPVDDPQDRA

SEQ ID NO: 68143 - protein, 8 aa, Mycobacterium avium
KWREQGPR

SEQ ID NO: 68144 - protein, 6 aa, Mycobacterium avium
KYATQP

SEQ ID NO: 68145 - protein, 5 aa, Mycobacterium avium
KYDGR

SEQ ID NO: 68146 - protein, 6 aa, Mycobacterium avium
KYGETE

SEQ ID NO: 68147 - protein, 5 aa, Mycobacterium avium
KYGTE

SEQ ID NO: 68148 - protein, 18 aa, Mycobacterium avium
KYQAKASAFNSAADATDY

SEQ ID NO: 68149 - protein, 7 aa, Mycobacterium avium
KYQRPGD

SEQ ID NO: 68150 - protein, 4 aa, Mycobacterium avium
KYTE

SEQ ID NO: 68151 - protein, 10 aa, Mycobacterium avium
LAADAAAGAA

SEQ ID NO: 68152 - protein, 8 aa, Mycobacterium avium
LAADADGR

SEQ ID NO: 68153 - protein, 18 aa, Mycobacterium avium
LAADAGRHGVKAQEAYRR

SEQ ID NO: 68154 - protein, 20 aa, Mycobacterium avium
LAADGGISGAVASGVVPAPE

SEQ ID NO: 68155 - protein, 10 aa, Mycobacterium avium
LAADRDAVAA

SEQ ID NO: 68156 - protein, 29 aa, Mycobacterium avium
LAADSDVSNAHYGKRYRSSVGKRRPAPPL

SEQ ID NO: 68157 - protein, 6 aa, Mycobacterium avium
LAAEGA

SEQ ID NO: 68158 - protein, 9 aa, Mycobacterium avium
LAAERGLQP

SEQ ID NO: 68159 - protein, 6 aa, Mycobacterium avium
LAAGAA

SEQ ID NO: 68160 - protein, 7 aa, Mycobacterium avium
LAAGAAE

SEQ ID NO: 68161 - protein, 26 aa, Mycobacterium avium
LAAGPAADGAAAGLAEEAAGYGADGA

SEQ ID NO: 68162 - protein, 6 aa, Mycobacterium avium
LAAGQR

SEQ ID NO: 68163 - protein, 8 aa, Mycobacterium avium
LAAGQSPT

SEQ ID NO: 68164 - protein, 20 aa, Mycobacterium avium
LAAKNEARRAKSALRAQDKA

SEQ ID NO: 68165 - protein, 6 aa, Mycobacterium avium
LAAKPA

SEQ ID NO: 68166 - protein, 26 aa, Mycobacterium avium
LAAPASAPAPAAMPQPAAMGAQPPVV

SEQ ID NO: 68167 - protein, 26 aa, Mycobacterium avium
LAAPASAPAPAAMPQPAGMGAQPPVV

SEQ ID NO: 68168 - protein, 10 aa, Mycobacterium avium
LAAPGWPKSV

SEQ ID NO: 68169 - protein, 27 aa, Mycobacterium avium
LAARSAGGAEGQRAGGASVASALGSTQ

SEQ ID NO: 68170 - protein, 7 aa, Mycobacterium avium
LAASPGV

SEQ ID NO: 68171 - protein, 6 aa, Mycobacterium avium
LAATAE

SEQ ID NO: 68172 - protein, 20 aa, Mycobacterium avium
LAATLSTGSFEVPSQTTNQR

SEQ ID NO: 68173 - protein, 18 aa, Mycobacterium avium
LADAAEADRRRAAGDTAP

SEQ ID NO: 68174 - protein, 11 aa, Mycobacterium avium
LADASSATADV

SEQ ID NO: 68175 - protein, 11 aa, Mycobacterium avium
LADDDDEAVEL

SEQ ID NO: 68176 - protein, 19 aa, Mycobacterium avium
LADDQKGVDQVDTPGGRQQ

SEQ ID NO: 68177 - protein, 9 aa, Mycobacterium avium
LADDSSPAA

SEQ ID NO: 68178 - protein, 9 aa, Mycobacterium avium
LADEKDAYG

SEQ ID NO: 68179 - protein, 10 aa, Mycobacterium avium
LADEKDPYGI

SEQ ID NO: 68180 - protein, 20 aa, Mycobacterium avium
LADETASTIAASGGSAHPIT

SEQ ID NO: 68181 - protein, 8 aa, Mycobacterium avium
LADGAGNY

SEQ ID NO: 68182 - protein, 7 aa, Mycobacterium avium
LADGGAG

SEQ ID NO: 68183 - protein, 7 aa, Mycobacterium avium
LADGGRI

SEQ ID NO: 68184 - protein, 12 aa, Mycobacterium avium
LADGSLPNAHPE

SEQ ID NO: 68185 - protein, 10 aa, Mycobacterium avium
LADRTGASAL

SEQ ID NO: 68186 - protein, 10 aa, Mycobacterium avium
LADSARDVPG

SEQ ID NO: 68187 - protein, 11 aa, Mycobacterium avium
LADSATAADGA

SEQ ID NO: 68188 - protein, 8 aa, Mycobacterium avium
LADSGGDG

SEQ ID NO: 68189 - protein, 6 aa, Mycobacterium avium
LADTGR

SEQ ID NO: 68190 - protein, 9 aa, Mycobacterium avium
LADTNPEVA

SEQ ID NO: 68191 - protein, 17 aa, Mycobacterium avium
LADTVDRAREAAGEQWS

SEQ ID NO: 68192 - protein, 9 aa, Mycobacterium avium
LADYPDQRR

SEQ ID NO: 68193 - protein, 8 aa, Mycobacterium avium
LAEATENP

SEQ ID NO: 68194 - protein, 24 aa, Mycobacterium avium
LAEGGDEAQAKLSEASAAIARLVR

SEQ ID NO: 68195 - protein, 7 aa, Mycobacterium avium
LAENPNA

SEQ ID NO: 68196 - protein, 14 aa, Mycobacterium avium
LAEPARGAFAPTDR

SEQ ID NO: 68197 - protein, 23 aa, Mycobacterium avium
LAEPSRSDPARPATTARRDGPNW

SEQ ID NO: 68198 - protein, 10 aa, Mycobacterium avium
LAEQRGDDTA

SEQ ID NO: 68199 - protein, 4 aa, Mycobacterium avium
LAER

SEQ ID NO: 68200 - protein, 7 aa, Mycobacterium avium
LAGAAKR

SEQ ID NO: 68201 - protein, 21 aa, Mycobacterium avium
LAGDADRRRHPFGQGGQREPG

SEQ ID NO: 68202 - protein, 6 aa, Mycobacterium avium
LAGDDP

SEQ ID NO: 68203 - protein, 11 aa, Mycobacterium avium
LAGDGTAKPGT

SEQ ID NO: 68204 - protein, 9 aa, Mycobacterium avium
LAGDNYSTR

SEQ ID NO: 68205 - protein, 12 aa, Mycobacterium avium
LAGDTTDDLGPI

SEQ ID NO: 68206 - protein, 5 aa, Mycobacterium avium
LAGDV

SEQ ID NO: 68207 - protein, 6 aa, Mycobacterium avium
LAGEAG

SEQ ID NO: 68208 - protein, 6 aa, Mycobacterium avium
LAGEDR

SEQ ID NO: 68209 - protein, 10 aa, Mycobacterium avium
LAGEPRDSVP

SEQ ID NO: 68210 - protein, 6 aa, Mycobacterium avium
LAGGGL

SEQ ID NO: 68211 - protein, 20 aa, Mycobacterium avium
LAGGGLGARGGGLGGPGHRA

SEQ ID NO: 68212 - protein, 8 aa, Mycobacterium avium
LAGGTTDA

SEQ ID NO: 68213 - protein, 7 aa, Mycobacterium avium
LAGKPDA

SEQ ID NO: 68214 - protein, 9 aa, Mycobacterium avium
LAGNPNWSA

SEQ ID NO: 68215 - protein, 7 aa, Mycobacterium avium
LAGRALA

SEQ ID NO: 68216 - protein, 53 aa, Mycobacterium avium
LAGRAMAGTTGLGRERARAEAAKAPREPGQEPGKAPKQEPAAPAVSAGGPITS

SEQ ID NO: 68217 - protein, 8 aa, Mycobacterium avium
LAGREGPA

SEQ ID NO: 68218 - protein, 21 aa, Mycobacterium avium
LAGRPASPALPAVNGSPRGAF

SEQ ID NO: 68219 - protein, 11 aa, Mycobacterium avium
LAGRRPRPYAS

SEQ ID NO: 68220 - protein, 9 aa, Mycobacterium avium
LAGRSSVDA

SEQ ID NO: 68221 - protein, 4 aa, Mycobacterium avium
LAGT

SEQ ID NO: 68222 - protein, 8 aa, Mycobacterium avium
LAGTSSGL

SEQ ID NO: 68223 - protein, 9 aa, Mycobacterium avium
LAKEHSSAI

SEQ ID NO: 68224 - protein, 12 aa, Mycobacterium avium
LAKGRTTEAKSR

SEQ ID NO: 68225 - protein, 4 aa, Mycobacterium avium
LAKR

SEQ ID NO: 68226 - protein, 7 aa, Mycobacterium avium
LALPAGA

SEQ ID NO: 68227 - protein, 6 aa, Mycobacterium avium
LANGGD

SEQ ID NO: 68228 - protein, 8 aa, Mycobacterium avium
LANGPTHS

SEQ ID NO: 68229 - protein, 6 aa, Mycobacterium avium
LANPNQ

SEQ ID NO: 68230 - protein, 10 aa, Mycobacterium avium
LANTPTNYPL

SEQ ID NO: 68231 - protein, 6 aa, Mycobacterium avium
LAPAGA

SEQ ID NO: 68232 - protein, 9 aa, Mycobacterium avium
LAPAGEPLP

SEQ ID NO: 68233 - protein, 6 aa, Mycobacterium avium
LAPART

SEQ ID NO: 68234 - protein, 7 aa, Mycobacterium avium
LAPATRT

SEQ ID NO: 68235 - protein, 5 aa, Mycobacterium avium
LAPDD

SEQ ID NO: 68236 - protein, 5 aa, Mycobacterium avium
LAPDR

SEQ ID NO: 68237 - protein, 4 aa, Mycobacterium avium
LAPE

SEQ ID NO: 68238 - protein, 8 aa, Mycobacterium avium
LAPERAGF

SEQ ID NO: 68239 - protein, 10 aa, Mycobacterium avium
LAPGAAERTL

SEQ ID NO: 68240 - protein, 8 aa, Mycobacterium avium
LAPGEKAP

SEQ ID NO: 68241 - protein, 5 aa, Mycobacterium avium
LAPGG

SEQ ID NO: 68242 - protein, 9 aa, Mycobacterium avium
LAPGPAGGV

SEQ ID NO: 68243 - protein, 43 aa, Mycobacterium avium
LAPGPGASAATVSPAPAPAGMPATAPAPVGPPTPPPATGVPGF

SEQ ID NO: 68244 - protein, 6 aa, Mycobacterium avium
LAPGQI

SEQ ID NO: 68245 - protein, 6 aa, Mycobacterium avium
LAPGQV

SEQ ID NO: 68246 - protein, 16 aa, Mycobacterium avium
LAPRDDEERQKAIDAG

SEQ ID NO: 68247 - protein, 5 aa, Mycobacterium avium
LAPTA

SEQ ID NO: 68248 - protein, 11 aa, Mycobacterium avium
LAPYNASKAGV

SEQ ID NO: 68249 - protein, 22 aa, Mycobacterium avium
LAQPNRGGDIRNRAGRVDTQHL

SEQ ID NO: 68250 - protein, 6 aa, Mycobacterium avium
LAQQAA

SEQ ID NO: 68251 - protein, 9 aa, Mycobacterium avium
LAQSDDADR

SEQ ID NO: 68252 - protein, 8 aa, Mycobacterium avium
LAQTDPKK

SEQ ID NO: 68253 - protein, 5 aa, Mycobacterium avium
LARAG

SEQ ID NO: 68254 - protein, 10 aa, Mycobacterium avium
LARGAAAEAA

SEQ ID NO: 68255 - protein, 27 aa, Mycobacterium avium
LARPDTQDALNADSSARLPRPATGAEL

SEQ ID NO: 68256 - protein, 5 aa, Mycobacterium avium
LARPE

SEQ ID NO: 68257 - protein, 7 aa, Mycobacterium avium
LARPPER

SEQ ID NO: 68258 - protein, 19 aa, Mycobacterium avium
LARQAAPARRIPPAGEPEL

SEQ ID NO: 68259 - protein, 8 aa, Mycobacterium avium
LARRGSTK

SEQ ID NO: 68260 - protein, 6 aa, Mycobacterium avium
LASAER

SEQ ID NO: 68261 - protein, 14 aa, Mycobacterium avium
LASAPNLPKPATEV

SEQ ID NO: 68262 - protein, 9 aa, Mycobacterium avium
LASEGTRLN

SEQ ID NO: 68263 - protein, 10 aa, Mycobacterium avium
LASGRPDAAT

SEQ ID NO: 68264 - protein, 13 aa, Mycobacterium avium
LASGRTPGPLLSI

SEQ ID NO: 68265 - protein, 20 aa, Mycobacterium avium
LASRPDQLAGSRFGRRRKES

SEQ ID NO: 68266 - protein, 16 aa, Mycobacterium avium
LASSSRPDPVPPPTGI

SEQ ID NO: 68267 - protein, 15 aa, Mycobacterium avium
LASSSSSSSAASGLS

SEQ ID NO: 68268 - protein, 7 aa, Mycobacterium avium
LASTRPL

SEQ ID NO: 68269 - protein, 4 aa, Mycobacterium avium
LASV

SEQ ID NO: 68270 - protein, 8 aa, Mycobacterium avium
LATAGAAL

SEQ ID NO: 68271 - protein, 12 aa, Mycobacterium avium
LATDPEARQRRE

SEQ ID NO: 68272 - protein, 6 aa, Mycobacterium avium
LATDPQ

SEQ ID NO: 68273 - protein, 5 aa, Mycobacterium avium
LATEG

SEQ ID NO: 68274 - protein, 5 aa, Mycobacterium avium
LATGA

SEQ ID NO: 68275 - protein, 10 aa, Mycobacterium avium
LATGSAPAPH

SEQ ID NO: 68276 - protein, 11 aa, Mycobacterium avium
LATGSAPAPHI

SEQ ID NO: 68277 - protein, 5 aa, Mycobacterium avium
LATTV

SEQ ID NO: 68278 - protein, 20 aa, Mycobacterium avium
LDAAPPPTPRRALADVLRRT

SEQ ID NO: 68279 - protein, 7 aa, Mycobacterium avium
LDAATGK

SEQ ID NO: 68280 - protein, 8 aa, Mycobacterium avium
LDADGAQK

SEQ ID NO: 68281 - protein, 10 aa, Mycobacterium avium
LDADGSPVSI

SEQ ID NO: 68282 - protein, 6 aa, Mycobacterium avium
LDADPA

SEQ ID NO: 68283 - protein, 8 aa, Mycobacterium avium
LDADTARE

SEQ ID NO: 68284 - protein, 8 aa, Mycobacterium avium
LDAGDQAG

SEQ ID NO: 68285 - protein, 7 aa, Mycobacterium avium
LDAGRRQ

SEQ ID NO: 68286 - protein, 10 aa, Mycobacterium avium
LDAGRRQRRV

SEQ ID NO: 68287 - protein, 26 aa, Mycobacterium avium
LDAPASAPAPAAMPQPAAMGAQPPVV

SEQ ID NO: 68288 - protein, 9 aa, Mycobacterium avium
LDAPSEPLH

SEQ ID NO: 68289 - protein, 8 aa, Mycobacterium avium
LDAPSTDR

SEQ ID NO: 68290 - protein, 12 aa, Mycobacterium avium
LDAPTAMSYPQT

SEQ ID NO: 68291 - protein, 11 aa, Mycobacterium avium
LDASTEPTSDC

SEQ ID NO: 68292 - protein, 7 aa, Mycobacterium avium
LDDATKR

SEQ ID NO: 68293 - protein, 9 aa, Mycobacterium avium
LDDDQQQRY

SEQ ID NO: 68294 - protein, 6 aa, Mycobacterium avium
LDDGTT

SEQ ID NO: 68295 - protein, 5 aa, Mycobacterium avium
LDDGY

SEQ ID NO: 68296 - protein, 7 aa, Mycobacterium avium
LDDPAEK

SEQ ID NO: 68297 - protein, 14 aa, Mycobacterium avium
LDDPDSAAAGEAGW

SEQ ID NO: 68298 - protein, 9 aa, Mycobacterium avium
LDDPGLADA

SEQ ID NO: 68299 - protein, 5 aa, Mycobacterium avium
LDDQA

SEQ ID NO: 68300 - protein, 6 aa, Mycobacterium avium
LDDRGA

SEQ ID NO: 68301 - protein, 6 aa, Mycobacterium avium
LDDSKK

SEQ ID NO: 68302 - protein, 11 aa, Mycobacterium avium
LDDSKKLTESV

SEQ ID NO: 68303 - protein, 6 aa, Mycobacterium avium
LDDTEA

SEQ ID NO: 68304 - protein, 11 aa, Mycobacterium avium
LDENKQPTAER

SEQ ID NO: 68305 - protein, 8 aa, Mycobacterium avium
LDGADPPI

SEQ ID NO: 68306 - protein, 20 aa, Mycobacterium avium
LDGDDPDLGARRLDPDRDRA

SEQ ID NO: 68307 - protein, 20 aa, Mycobacterium avium
LDGDDPDLGARRVDPARDRA

SEQ ID NO: 68308 - protein, 12 aa, Mycobacterium avium
LDGDRKEGERGG

SEQ ID NO: 68309 - protein, 6 aa, Mycobacterium avium
LDGGRV

SEQ ID NO: 68310 - protein, 9 aa, Mycobacterium avium
LDGGVGGDD

SEQ ID NO: 68311 - protein, 6 aa, Mycobacterium avium
LDGKAG

SEQ ID NO: 68312 - protein, 8 aa, Mycobacterium avium
LDGKRATT

SEQ ID NO: 68313 - protein, 4 aa, Mycobacterium avium
LDGQ

SEQ ID NO: 68314 - protein, 5 aa, Mycobacterium avium
LDGSA

SEQ ID NO: 68315 - protein, 14 aa, Mycobacterium avium
LDGSGGDVTEMTPP

SEQ ID NO: 68316 - protein, 5 aa, Mycobacterium avium
LDGTR

SEQ ID NO: 68317 - protein, 14 aa, Mycobacterium avium
LDHQDEDPDGPGLH

SEQ ID NO: 68318 - protein, 9 aa, Mycobacterium avium
LDLDGDGRF

SEQ ID NO: 68319 - protein, 13 aa, Mycobacterium avium
LDNATADDAAEAL

SEQ ID NO: 68320 - protein, 7 aa, Mycobacterium avium
LDNEPGL

SEQ ID NO: 68321 - protein, 16 aa, Mycobacterium avium
LDPAAETEVAPQAQRP

SEQ ID NO: 68322 - protein, 8 aa, Mycobacterium avium
LDPARPPH

SEQ ID NO: 68323 - protein, 7 aa, Mycobacterium avium
LDPATGV

SEQ ID NO: 68324 - protein, 11 aa, Mycobacterium avium
LDPDDARQRRT

SEQ ID NO: 68325 - protein, 7 aa, Mycobacterium avium
LDPDDVT

SEQ ID NO: 68326 - protein, 11 aa, Mycobacterium avium
LDPDSTARLGG

SEQ ID NO: 68327 - protein, 6 aa, Mycobacterium avium
LDPEAR

SEQ ID NO: 68328 - protein, 6 aa, Mycobacterium avium
LDPERG

SEQ ID NO: 68329 - protein, 8 aa, Mycobacterium avium
LDPETEKL

SEQ ID NO: 68330 - protein, 7 aa, Mycobacterium avium
LDPGGED

SEQ ID NO: 68331 - protein, 8 aa, Mycobacterium avium
LDPGSAVQ

SEQ ID NO: 68332 - protein, 9 aa, Mycobacterium avium
LDPGTGPGH

SEQ ID NO: 68333 - protein, 4 aa, Mycobacterium avium
LDPN

SEQ ID NO: 68334 - protein, 7 aa, Mycobacterium avium
LDPPHAG

SEQ ID NO: 68335 - protein, 7 aa, Mycobacterium avium
LDPPRAG

SEQ ID NO: 68336 - protein, 8 aa, Mycobacterium avium
LDPPRSGE

SEQ ID NO: 68337 - protein, 11 aa, Mycobacterium avium
LDPQRSGEQPE

SEQ ID NO: 68338 - protein, 8 aa, Mycobacterium avium
LDPSRPDE

SEQ ID NO: 68339 - protein, 16 aa, Mycobacterium avium
LDPSTQPPASPEVTKE

SEQ ID NO: 68340 - protein, 18 aa, Mycobacterium avium
LDPTDPEIHDAPASENAE

SEQ ID NO: 68341 - protein, 11 aa, Mycobacterium avium
LDQSAAPGEQR

SEQ ID NO: 68342 - protein, 12 aa, Mycobacterium avium
LDQTPKFTDPDR

SEQ ID NO: 68343 - protein, 12 aa, Mycobacterium avium
LDQTPKFTDPER

SEQ ID NO: 68344 - protein, 8 aa, Mycobacterium avium
LDRASSAA

SEQ ID NO: 68345 - protein, 7 aa, Mycobacterium avium
LDRPNAK

SEQ ID NO: 68346 - protein, 8 aa, Mycobacterium avium
LDSDPQVR

SEQ ID NO: 68347 - protein, 8 aa, Mycobacterium avium
LDSDPRLA

SEQ ID NO: 68348 - protein, 8 aa, Mycobacterium avium
LDSGRRYE

SEQ ID NO: 68349 - protein, 16 aa, Mycobacterium avium
LDSQTYDSKFNGAKSE

SEQ ID NO: 68350 - protein, 15 aa, Mycobacterium avium
LDSSNRQVREAAERA

SEQ ID NO: 68351 - protein, 8 aa, Mycobacterium avium
LDSVPDGQ

SEQ ID NO: 68352 - protein, 4 aa, Mycobacterium avium
LDTD

SEQ ID NO: 68353 - protein, 6 aa, Mycobacterium avium
LDTDAM

SEQ ID NO: 68354 - protein, 6 aa, Mycobacterium avium
LDTDPD

SEQ ID NO: 68355 - protein, 11 aa, Mycobacterium avium
LDTDRIEATYT

SEQ ID NO: 68356 - protein, 12 aa, Mycobacterium avium
LDTDSADASTLP

SEQ ID NO: 68357 - protein, 8 aa, Mycobacterium avium
LDTETTRT

SEQ ID NO: 68358 - protein, 10 aa, Mycobacterium avium
LDTPARGATI

SEQ ID NO: 68359 - protein, 12 aa, Mycobacterium avium
LDTRALPAPEFQ

SEQ ID NO: 68360 - protein, 12 aa, Mycobacterium avium
LDTRALPAPELR

SEQ ID NO: 68361 - protein, 13 aa, Mycobacterium avium
LDTRALPAPEYSD

SEQ ID NO: 68362 - protein, 5 aa, Mycobacterium avium
LDTRP

SEQ ID NO: 68363 - protein, 29 aa, Mycobacterium avium
LDTRPPGAELTPLGRDQAREFARRSGRPA

SEQ ID NO: 68364 - protein, 7 aa, Mycobacterium avium
LEAPSRA

SEQ ID NO: 68365 - protein, 8 aa, Mycobacterium avium
LEASDAVE

SEQ ID NO: 68366 - protein, 8 aa, Mycobacterium avium
LEEAQRDP

SEQ ID NO: 68367 - protein, 10 aa, Mycobacterium avium
LEENREITEE

SEQ ID NO: 68368 - protein, 11 aa, Mycobacterium avium
LEENREITEEN

SEQ ID NO: 68369 - protein, 5 aa, Mycobacterium avium
LEGSD

SEQ ID NO: 68370 - protein, 12 aa, Mycobacterium avium
LEGTDQTADLAK

SEQ ID NO: 68371 - protein, 7 aa, Mycobacterium avium
LEKSTTA

SEQ ID NO: 68372 - protein, 7 aa, Mycobacterium avium
LENAGQP

SEQ ID NO: 68373 - protein, 7 aa, Mycobacterium avium
LENAGTE

SEQ ID NO: 68374 - protein, 10 aa, Mycobacterium avium
LENPGPDDFA

SEQ ID NO: 68375 - protein, 8 aa, Mycobacterium avium
LENPTAED

SEQ ID NO: 68376 - protein, 11 aa, Mycobacterium avium
LEPARATAATL

SEQ ID NO: 68377 - protein, 9 aa, Mycobacterium avium
LEPDGSKMS

SEQ ID NO: 68378 - protein, 22 aa, Mycobacterium avium
LEPENPAKPLGAEADRGVEPTA

SEQ ID NO: 68379 - protein, 13 aa, Mycobacterium avium
LEPPGLATSEAAG

SEQ ID NO: 68380 - protein, 9 aa, Mycobacterium avium
LEPTAGQQN

SEQ ID NO: 68381 - protein, 7 aa, Mycobacterium avium
LEQAESK

SEQ ID NO: 68382 - protein, 9 aa, Mycobacterium avium
LEQEQSGKK

SEQ ID NO: 68383 - protein, 10 aa, Mycobacterium avium
LEQGADGQVG

SEQ ID NO: 68384 - protein, 7 aa, Mycobacterium avium
LEQPAAA

SEQ ID NO: 68385 - protein, 13 aa, Mycobacterium avium
LEQPVGAASTPAN

SEQ ID NO: 68386 - protein, 7 aa, Mycobacterium avium
LEQRPEC

SEQ ID NO: 68387 - protein, 10 aa, Mycobacterium avium
LEQSADDQTW

SEQ ID NO: 68388 - protein, 7 aa, Mycobacterium avium
LERANEE

SEQ ID NO: 68389 - protein, 9 aa, Mycobacterium avium
LERAPSDYY

SEQ ID NO: 68390 - protein, 6 aa, Mycobacterium avium
LERASQ

SEQ ID NO: 68391 - protein, 7 aa, Mycobacterium avium
LERHGRD

SEQ ID NO: 68392 - protein, 13 aa, Mycobacterium avium
LERPGEWEGYDDP

SEQ ID NO: 68393 - protein, 11 aa, Mycobacterium avium
LERPNGGKGGF

SEQ ID NO: 68394 - protein, 17 aa, Mycobacterium avium
LERRQKSRQTRASRDAL

SEQ ID NO: 68395 - protein, 13 aa, Mycobacterium avium
LESAAGKGLTAGG

SEQ ID NO: 68396 - protein, 8 aa, Mycobacterium avium
LESRSGRR

SEQ ID NO: 68397 - protein, 6 aa, Mycobacterium avium
LETQPD

SEQ ID NO: 68398 - protein, 6 aa, Mycobacterium avium
LETRDR

SEQ ID NO: 68399 - protein, 7 aa, Mycobacterium avium
LETRTRN

SEQ ID NO: 68400 - protein, 9 aa, Mycobacterium avium
LETSLKSGE

SEQ ID NO: 68401 - protein, 5 aa, Mycobacterium avium
LEVPG

SEQ ID NO: 68402 - protein, 8 aa, Mycobacterium avium
LGAAGERD

SEQ ID NO: 68403 - protein, 22 aa, Mycobacterium avium
LGAARSADQRRRELQGTRDQLG

SEQ ID NO: 68404 - protein, 12 aa, Mycobacterium avium
LGAATDAGLSPL

SEQ ID NO: 68405 - protein, 9 aa, Mycobacterium avium
LGAATDDGL

SEQ ID NO: 68406 - protein, 10 aa, Mycobacterium avium
LGADGSARAP

SEQ ID NO: 68407 - protein, 6 aa, Mycobacterium avium
LGAEGA

SEQ ID NO: 68408 - protein, 9 aa, Mycobacterium avium
LGAEPKADL

SEQ ID NO: 68409 - protein, 9 aa, Mycobacterium avium
LGAGAAGGA

SEQ ID NO: 68410 - protein, 8 aa, Mycobacterium avium
LGAGANPF

SEQ ID NO: 68411 - protein, 19 aa, Mycobacterium avium
LGAGGTGKGTAGAMRGAAG

SEQ ID NO: 68412 - protein, 13 aa, Mycobacterium avium
LGAGRGGKESPLA

SEQ ID NO: 68413 - protein, 9 aa, Mycobacterium avium
LGAPRPRVD

SEQ ID NO: 68414 - protein, 5 aa, Mycobacterium avium
LGAQS

SEQ ID NO: 68415 - protein, 5 aa, Mycobacterium avium
LGASA

SEQ ID NO: 68416 - protein, 16 aa, Mycobacterium avium
LGASRADHKPGKQIGA

SEQ ID NO: 68417 - protein, 7 aa, Mycobacterium avium
LGATPAQ

SEQ ID NO: 68418 - protein, 10 aa, Mycobacterium avium
LGDAADRQRV

SEQ ID NO: 68419 - protein, 10 aa, Mycobacterium avium
LGDAATAAEF

SEQ ID NO: 68420 - protein, 5 aa, Mycobacterium avium
LGDDG

SEQ ID NO: 68421 - protein, 25 aa, Mycobacterium avium
LGDDGKLGRSSRPRTPPSAPAPRCR

SEQ ID NO: 68422 - protein, 15 aa, Mycobacterium avium
LGDDHPGAAYRLRRD

SEQ ID NO: 68423 - protein, 9 aa, Mycobacterium avium
LGDDSPDNL

SEQ ID NO: 68424 - protein, 6 aa, Mycobacterium avium
LGDDTD

SEQ ID NO: 68425 - protein, 9 aa, Mycobacterium avium
LGDEAAVDA

SEQ ID NO: 68426 - protein, 10 aa, Mycobacterium avium
LGDGQPVRAQ

SEQ ID NO: 68427 - protein, 7 aa, Mycobacterium avium
LGDGSPD

SEQ ID NO: 68428 - protein, 5 aa, Mycobacterium avium
LGDPA

SEQ ID NO: 68429 - protein, 8 aa, Mycobacterium avium
LGDPATDL

SEQ ID NO: 68430 - protein, 8 aa, Mycobacterium avium
LGDPERTA

SEQ ID NO: 68431 - protein, 13 aa, Mycobacterium avium
LGDPKDPTTEMGP

SEQ ID NO: 68432 - protein, 6 aa, Mycobacterium avium
LGDPQA

SEQ ID NO: 68433 - protein, 6 aa, Mycobacterium avium
LGDPRA

SEQ ID NO: 68434 - protein, 15 aa, Mycobacterium avium
LGDRPDGAVLVDASA

SEQ ID NO: 68435 - protein, 6 aa, Mycobacterium avium
LGDSHA

SEQ ID NO: 68436 - protein, 6 aa, Mycobacterium avium
LGDTRE

SEQ ID NO: 68437 - protein, 10 aa, Mycobacterium avium
LGEARPAAEH

SEQ ID NO: 68438 - protein, 9 aa, Mycobacterium avium
LGEGASNDE

SEQ ID NO: 68439 - protein, 18 aa, Mycobacterium avium
LGEGATEVQREIIARSLV

SEQ ID NO: 68440 - protein, 18 aa, Mycobacterium avium
LGEGATEVQREVIARSLV

SEQ ID NO: 68441 - protein, 4 aa, Mycobacterium avium
LGEH

SEQ ID NO: 68442 - protein, 5 aa, Mycobacterium avium
LGEPV

SEQ ID NO: 68443 - protein, 7 aa, Mycobacterium avium
LGEQRAE

SEQ ID NO: 68444 - protein, 9 aa, Mycobacterium avium
LGESEFSRV

SEQ ID NO: 68445 - protein, 5 aa, Mycobacterium avium
LGETA

SEQ ID NO: 68446 - protein, 4 aa, Mycobacterium avium
LGGA

SEQ ID NO: 68447 - protein, 6 aa, Mycobacterium avium
LGGAGF

SEQ ID NO: 68448 - protein, 12 aa, Mycobacterium avium
LGGAPAATAVTD

SEQ ID NO: 68449 - protein, 13 aa, Mycobacterium avium
LGGAPAATAVTDS

SEQ ID NO: 68450 - protein, 7 aa, Mycobacterium avium
LGGDAAA

SEQ ID NO: 68451 - protein, 10 aa, Mycobacterium avium
LGGDADHRTD

SEQ ID NO: 68452 - protein, 7 aa, Mycobacterium avium
LGGDPAA

SEQ ID NO: 68453 - protein, 9 aa, Mycobacterium avium
LGGEPGRGF

SEQ ID NO: 68454 - protein, 9 aa, Mycobacterium avium
LGGEPVTDP

SEQ ID NO: 68455 - protein, 5 aa, Mycobacterium avium
LGGEQ

SEQ ID NO: 68456 - protein, 10 aa, Mycobacterium avium
LGGGDGGDRF

SEQ ID NO: 68457 - protein, 9 aa, Mycobacterium avium
LGGGDPAVD

SEQ ID NO: 68458 - protein, 10 aa, Mycobacterium avium
LGGGDPAVDG

SEQ ID NO: 68459 - protein, 9 aa, Mycobacterium avium
LGGGGQPHA

SEQ ID NO: 68460 - protein, 8 aa, Mycobacterium avium
LGGGQGAG

SEQ ID NO: 68461 - protein, 15 aa, Mycobacterium avium
LGGGSGANPAAAERI

SEQ ID NO: 68462 - protein, 15 aa, Mycobacterium avium
LGGGSGANPAAAERV

SEQ ID NO: 68463 - protein, 4 aa, Mycobacterium avium
LGGH

SEQ ID NO: 68464 - protein, 12 aa, Mycobacterium avium
LGGHPLGSADQH

SEQ ID NO: 68465 - protein, 15 aa, Mycobacterium avium
LGGHRPVRAKIVDAD

SEQ ID NO: 68466 - protein, 6 aa, Mycobacterium avium
LGGKSA

SEQ ID NO: 68467 - protein, 8 aa, Mycobacterium avium
LGGPAGGT

SEQ ID NO: 68468 - protein, 5 aa, Mycobacterium avium
LGGPG

SEQ ID NO: 68469 - protein, 12 aa, Mycobacterium avium
LGGPTPSAHDRD

SEQ ID NO: 68470 - protein, 7 aa, Mycobacterium avium
LGGRPGG

SEQ ID NO: 68471 - protein, 4 aa, Mycobacterium avium
LGGS

SEQ ID NO: 68472 - protein, 6 aa, Mycobacterium avium
LGGSAM

SEQ ID NO: 68473 - protein, 7 aa, Mycobacterium avium
LGGSTSH

SEQ ID NO: 68474 - protein, 24 aa, Mycobacterium avium
LGGTANLASAAAPGAAAAAGVGQA

SEQ ID NO: 68475 - protein, 39 aa, Mycobacterium avium
LGGTAPTPAEAARMEADEAAARAAAAAAKKAANRAGRPG

SEQ ID NO: 68476 - protein, 11 aa, Mycobacterium avium
LGGTDPAGPLT

SEQ ID NO: 68477 - protein, 21 aa, Mycobacterium avium
LGGTDRKASVGPRRRAPADDS

SEQ ID NO: 68478 - protein, 12 aa, Mycobacterium avium
LGGTGQLALVSA

SEQ ID NO: 68479 - protein, 29 aa, Mycobacterium avium
LGGVPKDQRADAGRRVNAARAQAQQAYDE

SEQ ID NO: 68480 - protein, 5 aa, Mycobacterium avium
LGHRG

SEQ ID NO: 68481 - protein, 7 aa, Mycobacterium avium
LGKAGES

SEQ ID NO: 68482 - protein, 9 aa, Mycobacterium avium
LGLSGTVTT

SEQ ID NO: 68483 - protein, 12 aa, Mycobacterium avium
LGNASDGAATAY

SEQ ID NO: 68484 - protein, 12 aa, Mycobacterium avium
LGNGKNVGAGED

SEQ ID NO: 68485 - protein, 4 aa, Mycobacterium avium
LGPA

SEQ ID NO: 68486 - protein, 5 aa, Mycobacterium avium
LGPAA

SEQ ID NO: 68487 - protein, 5 aa, Mycobacterium avium
LGPDE

SEQ ID NO: 68488 - protein, 6 aa, Mycobacterium avium
LGPDGH

SEQ ID NO: 68489 - protein, 6 aa, Mycobacterium avium
LGPDGP

SEQ ID NO: 68490 - protein, 22 aa, Mycobacterium avium
LGPDPTGASFGGTPFEAAPGKA

SEQ ID NO: 68491 - protein, 8 aa, Mycobacterium avium
LGPDTSPS

SEQ ID NO: 68492 - protein, 7 aa, Mycobacterium avium
LGPEPSD

SEQ ID NO: 68493 - protein, 12 aa, Mycobacterium avium
LGPGKEATYENE

SEQ ID NO: 68494 - protein, 6 aa, Mycobacterium avium
LGPGPH

SEQ ID NO: 68495 - protein, 10 aa, Mycobacterium avium
LGPLGPTAEG

SEQ ID NO: 68496 - protein, 16 aa, Mycobacterium avium
LGPPASPVPRQPVTTE

SEQ ID NO: 68497 - protein, 7 aa, Mycobacterium avium
LGPPHTA

SEQ ID NO: 68498 - protein, 4 aa, Mycobacterium avium
LGPQ

SEQ ID NO: 68499 - protein, 12 aa, Mycobacterium avium
LGPRRGAGSGGA

SEQ ID NO: 68500 - protein, 10 aa, Mycobacterium avium
LGPRSPTPAN

SEQ ID NO: 68501 - protein, 6 aa, Mycobacterium avium
LGPTVD

SEQ ID NO: 68502 - protein, 5 aa, Mycobacterium avium
LGPVP

SEQ ID NO: 68503 - protein, 20 aa, Mycobacterium avium
LGPVPTPSPNAYGPPSHGSD

SEQ ID NO: 68504 - protein, 7 aa, Mycobacterium avium
LGPVRQP

SEQ ID NO: 68505 - protein, 9 aa, Mycobacterium avium
LGPYSDGGI

SEQ ID NO: 68506 - protein, 10 aa, Mycobacterium avium
LGQFPGQGDV

SEQ ID NO: 68507 - protein, 5 aa, Mycobacterium avium
LGQHA

SEQ ID NO: 68508 - protein, 5 aa, Mycobacterium avium
LGQPR

SEQ ID NO: 68509 - protein, 11 aa, Mycobacterium avium
LGQQHGQGGLD

SEQ ID NO: 68510 - protein, 8 aa, Mycobacterium avium
LGRANDRS

SEQ ID NO: 68511 - protein, 7 aa, Mycobacterium avium
LGREPRG

SEQ ID NO: 68512 - protein, 5 aa, Mycobacterium avium
LGRGA

SEQ ID NO: 68513 - protein, 7 aa, Mycobacterium avium
LGRGFRG

SEQ ID NO: 68514 - protein, 8 aa, Mycobacterium avium
LGRGFRGT

SEQ ID NO: 68515 - protein, 6 aa, Mycobacterium avium
LGRGWS

SEQ ID NO: 68516 - protein, 12 aa, Mycobacterium avium
LGRKEDASDDSR

SEQ ID NO: 68517 - protein, 10 aa, Mycobacterium avium
LGRPGQPDEI

SEQ ID NO: 68518 - protein, 18 aa, Mycobacterium avium
LGRPGQVGLGPQGRRQRP

SEQ ID NO: 68519 - protein, 17 aa, Mycobacterium avium
LGRQPRPGSAGGRHRAD

SEQ ID NO: 68520 - protein, 4 aa, Mycobacterium avium
LGRT

SEQ ID NO: 68521 - protein, 6 aa, Mycobacterium avium
LGRTAA

SEQ ID NO: 68522 - protein, 18 aa, Mycobacterium avium
LGSAEATGGQRTALPRTT

SEQ ID NO: 68523 - protein, 18 aa, Mycobacterium avium
LGSAQPRPRCPATRRAEE

SEQ ID NO: 68524 - protein, 11 aa, Mycobacterium avium
LGSCDSTTTSL

SEQ ID NO: 68525 - protein, 15 aa, Mycobacterium avium
LGSLAGGALGSPAAR

SEQ ID NO: 68526 - protein, 10 aa, Mycobacterium avium
LGSLPGGVGH

SEQ ID NO: 68527 - protein, 6 aa, Mycobacterium avium
LGSPDD

SEQ ID NO: 68528 - protein, 9 aa, Mycobacterium avium
LGSPDDDPV

SEQ ID NO: 68529 - protein, 8 aa, Mycobacterium avium
LGSPLGGT

SEQ ID NO: 68530 - protein, 6 aa, Mycobacterium avium
LGSPTL

SEQ ID NO: 68531 - protein, 4 aa, Mycobacterium avium
LGSR

SEQ ID NO: 68532 - protein, 6 aa, Mycobacterium avium
LGSRAA

SEQ ID NO: 68533 - protein, 14 aa, Mycobacterium avium
LGSRREARNEWAGS

SEQ ID NO: 68534 - protein, 11 aa, Mycobacterium avium
LGTDGKPLPGS

SEQ ID NO: 68535 - protein, 9 aa, Mycobacterium avium
LGTDPAHAG

SEQ ID NO: 68536 - protein, 5 aa, Mycobacterium avium
LGTDR

SEQ ID NO: 68537 - protein, 13 aa, Mycobacterium avium
LGTDTRTPIPVDT

SEQ ID NO: 68538 - protein, 14 aa, Mycobacterium avium
LGTDTRTPIPVDTR

SEQ ID NO: 68539 - protein, 8 aa, Mycobacterium avium
LGTPAEYA

SEQ ID NO: 68540 - protein, 7 aa, Mycobacterium avium
LGTPDEF

SEQ ID NO: 68541 - protein, 8 aa, Mycobacterium avium
LGTPEYRR

SEQ ID NO: 68542 - protein, 6 aa, Mycobacterium avium
LGTPTA

SEQ ID NO: 68543 - protein, 8 aa, Mycobacterium avium
LGVSQSTL

SEQ ID NO: 68544 - protein, 5 aa, Mycobacterium avium
LGYGT

SEQ ID NO: 68545 - protein, 20 aa, Mycobacterium avium
LGYPGPDPVARSLRTRKAGA

SEQ ID NO: 68546 - protein, 4 aa, Mycobacterium avium
LHAQ

SEQ ID NO: 68547 - protein, 6 aa, Mycobacterium avium
LHPGPG

SEQ ID NO: 68548 - protein, 7 aa, Mycobacterium avium
LHPGRPP

SEQ ID NO: 68549 - protein, 19 aa, Mycobacterium avium
LHSERGARKGEHPGRSRNP

SEQ ID NO: 68550 - protein, 5 aa, Mycobacterium avium
LHSPR

SEQ ID NO: 68551 - protein, 33 aa, Mycobacterium avium
LITPNNTAQTLTSGQRAPAAPTDPPRRSAVYDS

SEQ ID NO: 68552 - protein, 9 aa, Mycobacterium avium
LKAAGASAV

SEQ ID NO: 68553 - protein, 22 aa, Mycobacterium avium
LKAEDAKRLKDSNARTPPSMGS

SEQ ID NO: 68554 - protein, 4 aa, Mycobacterium avium
LKAP

SEQ ID NO: 68555 - protein, 15 aa, Mycobacterium avium
LKDDELGRGSFTGRT

SEQ ID NO: 68556 - protein, 8 aa, Mycobacterium avium
LKDPADHA

SEQ ID NO: 68557 - protein, 8 aa, Mycobacterium avium
LKDRTRQH

SEQ ID NO: 68558 - protein, 8 aa, Mycobacterium avium
LKDSGYSG

SEQ ID NO: 68559 - protein, 7 aa, Mycobacterium avium
LKEGNER

SEQ ID NO: 68560 - protein, 7 aa, Mycobacterium avium
LKEPRES

SEQ ID NO: 68561 - protein, 6 aa, Mycobacterium avium
LKGRTA

SEQ ID NO: 68562 - protein, 9 aa, Mycobacterium avium
LKGSPMPAP

SEQ ID NO: 68563 - protein, 9 aa, Mycobacterium avium
LKPASAGGV

SEQ ID NO: 68564 - protein, 9 aa, Mycobacterium avium
LKPEPAPVE

SEQ ID NO: 68565 - protein, 21 aa, Mycobacterium avium
LKPPAPAAEPEPEPQPAPVAA

SEQ ID NO: 68566 - protein, 4 aa, Mycobacterium avium
LKPS

SEQ ID NO: 68567 - protein, 13 aa, Mycobacterium avium
LKPSDTSDATGGP

SEQ ID NO: 68568 - protein, 8 aa, Mycobacterium avium
LKPSLTEA

SEQ ID NO: 68569 - protein, 9 aa, Mycobacterium avium
LKQRATAAG

SEQ ID NO: 68570 - protein, 9 aa, Mycobacterium avium
LKSGKGDVQ

SEQ ID NO: 68571 - protein, 10 aa, Mycobacterium avium
LKYDPDDTSE

SEQ ID NO: 68572 - protein, 14 aa, Mycobacterium avium
LNADGTPTGQGGSQ

SEQ ID NO: 68573 - protein, 15 aa, Mycobacterium avium
LNAGPPQRAVELPAQ

SEQ ID NO: 68574 - protein, 8 aa, Mycobacterium avium
LNDPDDGH

SEQ ID NO: 68575 - protein, 5 aa, Mycobacterium avium
LNEES

SEQ ID NO: 68576 - protein, 4 aa, Mycobacterium avium
LNEL

SEQ ID NO: 68577 - protein, 5 aa, Mycobacterium avium
LNELG

SEQ ID NO: 68578 - protein, 18 aa, Mycobacterium avium
LNEPGTPLPDRPATTFAD

SEQ ID NO: 68579 - protein, 9 aa, Mycobacterium avium
LNGEPLDDG

SEQ ID NO: 68580 - protein, 5 aa, Mycobacterium avium
LNGGR

SEQ ID NO: 68581 - protein, 10 aa, Mycobacterium avium
LNGKPLDDGQ

SEQ ID NO: 68582 - protein, 6 aa, Mycobacterium avium
LNLDPG

SEQ ID NO: 68583 - protein, 8 aa, Mycobacterium avium
LNLPDSSH

SEQ ID NO: 68584 - protein, 10 aa, Mycobacterium avium
LNNADNKTFP

SEQ ID NO: 68585 - protein, 11 aa, Mycobacterium avium
LNNPDTAKRNA

SEQ ID NO: 68586 - protein, 12 aa, Mycobacterium avium
LNPNHSKGRYGG

SEQ ID NO: 68587 - protein, 7 aa, Mycobacterium avium
LNPQPLG

SEQ ID NO: 68588 - protein, 7 aa, Mycobacterium avium
LNPQQRQ

SEQ ID NO: 68589 - protein, 7 aa, Mycobacterium avium
LNPRLGR

SEQ ID NO: 68590 - protein, 8 aa, Mycobacterium avium
LNPRLGRR

SEQ ID NO: 68591 - protein, 6 aa, Mycobacterium avium
LNRDQV

SEQ ID NO: 68592 - protein, 4 aa, Mycobacterium avium
LNSA

SEQ ID NO: 68593 - protein, 14 aa, Mycobacterium avium
LNTGNDHGGGDTLA

SEQ ID NO: 68594 - protein, 11 aa, Mycobacterium avium
LNTHGGQLSEG

SEQ ID NO: 68595 - protein, 4 aa, Mycobacterium avium
LNTP

SEQ ID NO: 68596 - protein, 4 aa, Mycobacterium avium
LNTS

SEQ ID NO: 68597 - protein, 9 aa, Mycobacterium avium
LPAAAGASV

SEQ ID NO: 68598 - protein, 37 aa, Mycobacterium avium
LPAADPDLQAENPAQFPKPPSSVVEPDVPADTEPVDT

SEQ ID NO: 68599 - protein, 27 aa, Mycobacterium avium
LPAASAPEPLQPSPEDELAHDPTTEPL

SEQ ID NO: 68600 - protein, 7 aa, Mycobacterium avium
LPADDER

SEQ ID NO: 68601 - protein, 10 aa, Mycobacterium avium
LPADPGRSGQ

SEQ ID NO: 68602 - protein, 12 aa, Mycobacterium avium
LPADREQTVESC

SEQ ID NO: 68603 - protein, 14 aa, Mycobacterium avium
LPADTANLREGADL

SEQ ID NO: 68604 - protein, 6 aa, Mycobacterium avium
LPAEGD

SEQ ID NO: 68605 - protein, 7 aa, Mycobacterium avium
LPAGHGL

SEQ ID NO: 68606 - protein, 9 aa, Mycobacterium avium
LPAGNGESE

SEQ ID NO: 68607 - protein, 17 aa, Mycobacterium avium
LPAGRGGTVVRTASRWH

SEQ ID NO: 68608 - protein, 6 aa, Mycobacterium avium
LPAGTD

SEQ ID NO: 68609 - protein, 7 aa, Mycobacterium avium
LPAPAPY

SEQ ID NO: 68610 - protein, 11 aa, Mycobacterium avium
LPAPGLGSGGY

SEQ ID NO: 68611 - protein, 9 aa, Mycobacterium avium
LPAPGTAVA

SEQ ID NO: 68612 - protein, 10 aa, Mycobacterium avium
LPAPGTAVAN

SEQ ID NO: 68613 - protein, 21 aa, Mycobacterium avium
LPAPGYVGSQSDGSANDDGRS

SEQ ID NO: 68614 - protein, 9 aa, Mycobacterium avium
LPAPLPPEV

SEQ ID NO: 68615 - protein, 7 aa, Mycobacterium avium
LPAPPSY

SEQ ID NO: 68616 - protein, 8 aa, Mycobacterium avium
LPAPTSAQ

SEQ ID NO: 68617 - protein, 6 aa, Mycobacterium avium
LPAQDT

SEQ ID NO: 68618 - protein, 6 aa, Mycobacterium avium
LPARAT

SEQ ID NO: 68619 - protein, 8 aa, Mycobacterium avium
LPARPRRR

SEQ ID NO: 68620 - protein, 37 aa, Mycobacterium avium
LPDAEPEPGAAVAANPNPGSETGTGEAEPEREAAPEP

SEQ ID NO: 68621 - protein, 7 aa, Mycobacterium avium
LPDARPA

SEQ ID NO: 68622 - protein, 8 aa, Mycobacterium avium
LPDATTRG

SEQ ID NO: 68623 - protein, 9 aa, Mycobacterium avium
LPDGPADFS

SEQ ID NO: 68624 - protein, 7 aa, Mycobacterium avium
LPDGRRV

SEQ ID NO: 68625 - protein, 5 aa, Mycobacterium avium
LPDGS

SEQ ID NO: 68626 - protein, 14 aa, Mycobacterium avium
LPDGSPDDAGDAET

SEQ ID NO: 68627 - protein, 12 aa, Mycobacterium avium
LPDGSTTDVSAQ

SEQ ID NO: 68628 - protein, 13 aa, Mycobacterium avium
LPDGSTTDVSAQT

SEQ ID NO: 68629 - protein, 6 aa, Mycobacterium avium
LPDGTN

SEQ ID NO: 68630 - protein, 7 aa, Mycobacterium avium
LPDPAPE

SEQ ID NO: 68631 - protein, 7 aa, Mycobacterium avium
LPDPAQG

SEQ ID NO: 68632 - protein, 10 aa, Mycobacterium avium
LPDQNDKGTV

SEQ ID NO: 68633 - protein, 6 aa, Mycobacterium avium
LPDTVD

SEQ ID NO: 68634 - protein, 4 aa, Mycobacterium avium
LPDY

SEQ ID NO: 68635 - protein, 10 aa, Mycobacterium avium
LPEAPQGEPG

SEQ ID NO: 68636 - protein, 11 aa, Mycobacterium avium
LPEELQPYQAD

SEQ ID NO: 68637 - protein, 7 aa, Mycobacterium avium
LPEEPER

SEQ ID NO: 68638 - protein, 38 aa, Mycobacterium avium; identical to SEQ ID NO: 8727

SEQ ID NO: 68639 - protein, 11 aa, Mycobacterium avium
LPEGGLARADA

SEQ ID NO: 68640 - protein, 12 aa, Mycobacterium avium
LPEGPPPPKVFG

SEQ ID NO: 68641 - protein, 5 aa, Mycobacterium avium
LPEGR

SEQ ID NO: 68642 - protein, 9 aa, Mycobacterium avium
LPEGTPADK

SEQ ID NO: 68643 - protein, 4 aa, Mycobacterium avium
LPEN

SEQ ID NO: 68644 - protein, 31 aa, Mycobacterium avium
LPEPADAEKEASEARTAGRASRFREETRSER

SEQ ID NO: 68645 - protein, 11 aa, Mycobacterium avium
LPEPTASTAFS

SEQ ID NO: 68646 - protein, 4 aa, Mycobacterium avium
LPER

SEQ ID NO: 68647 - protein, 18 aa, Mycobacterium avium
LPESVPYESPTRDDLAET

SEQ ID NO: 68648 - protein, 26 aa, Mycobacterium avium
LPFTASGKVKKSELAQQLSELLAHPK

SEQ ID NO: 68649 - protein, 18 aa, Mycobacterium avium
LPGDDYRDSEGTDTRNYG

SEQ ID NO: 68650 - protein, 13 aa, Mycobacterium avium
LPGEAERAQDDRL

SEQ ID NO: 68651 - protein, 4 aa, Mycobacterium avium
LPGG

SEQ ID NO: 68652 - protein, 15 aa, Mycobacterium avium
LPGGAEPAVTSDPVA

SEQ ID NO: 68653 - protein, 10 aa, Mycobacterium avium
LPGGAPERRA

SEQ ID NO: 68654 - protein, 8 aa, Mycobacterium avium
LPGGPLSK

SEQ ID NO: 68655 - protein, 7 aa, Mycobacterium avium
LPGGPTA

SEQ ID NO: 68656 - protein, 11 aa, Mycobacterium avium
LPGGQYRKREQ

SEQ ID NO: 68657 - protein, 6 aa, Mycobacterium avium
LPGGRP

SEQ ID NO: 68658 - protein, 10 aa, Mycobacterium avium
LPGGYSDSEL

SEQ ID NO: 68659 - protein, 4 aa, Mycobacterium avium
LPGL

SEQ ID NO: 68660 - protein, 13 aa, Mycobacterium avium
LPGLSDQREPGRI

SEQ ID NO: 68661 - protein, 13 aa, Mycobacterium avium
LPGNRSDIRERST

SEQ ID NO: 68662 - protein, 14 aa, Mycobacterium avium
LPGPATALTGDGRG

SEQ ID NO: 68663 - protein, 11 aa, Mycobacterium avium
LPGQPESPADR

SEQ ID NO: 68664 - protein, 4 aa, Mycobacterium avium
LPGR

SEQ ID NO: 68665 - protein, 13 aa, Mycobacterium avium
LPGRPAPLHPNAA

SEQ ID NO: 68666 - protein, 11 aa, Mycobacterium avium
LPGSAESAVGR

SEQ ID NO: 68667 - protein, 6 aa, Mycobacterium avium
LPGSVA

SEQ ID NO: 68668 - protein, 5 aa, Mycobacterium avium
LPGTG

SEQ ID NO: 68669 - protein, 10 aa, Mycobacterium avium
LPGYTAGDTD

SEQ ID NO: 68670 - protein, 12 aa, Mycobacterium avium
LPHPSEGVPPIS

SEQ ID NO: 68671 - protein, 12 aa, Mycobacterium avium
LPHRSPGERQIR

SEQ ID NO: 68672 - protein, 11 aa, Mycobacterium avium
LPITGSSDAVL

SEQ ID NO: 68673 - protein, 4 aa, Mycobacterium avium
LPLP

SEQ ID NO: 68674 - protein, 5 aa, Mycobacterium avium
LPNGD

SEQ ID NO: 68675 - protein, 9 aa, Mycobacterium avium
LPNGPADFS

SEQ ID NO: 68676 - protein, 5 aa, Mycobacterium avium
LPNTT

SEQ ID NO: 68677 - protein, 4 aa, Mycobacterium avium
LPPA

SEQ ID NO: 68678 - protein, 8 aa, Mycobacterium avium
LPPAAADL

SEQ ID NO: 68679 - protein, 5 aa, Mycobacterium avium
LPPAE

SEQ ID NO: 68680 - protein, 18 aa, Mycobacterium avium
LPPAPDTDRSESQRRGTM

SEQ ID NO: 68681 - protein, 13 aa, Mycobacterium avium
LPPASETLDRPRS

SEQ ID NO: 68682 - protein, 4 aa, Mycobacterium avium
LPPE

SEQ ID NO: 68683 - protein, 12 aa, Mycobacterium avium
LPPETSAEQRDR

SEQ ID NO: 68684 - protein, 10 aa, Mycobacterium avium
LPPGAVGTEE

SEQ ID NO: 68685 - protein, 21 aa, Mycobacterium avium
LPPGGPGGGPGAGTPKTTVTF

SEQ ID NO: 68686 - protein, 6 aa, Mycobacterium avium
LPPGID

SEQ ID NO: 68687 - protein, 6 aa, Mycobacterium avium
LPPGQL

SEQ ID NO: 68688 - protein, 6 aa, Mycobacterium avium
LPPGSE

SEQ ID NO: 68689 - protein, 16 aa, Mycobacterium avium
LPPGSEVDIVEHAGHF

SEQ ID NO: 68690 - protein, 16 aa, Mycobacterium avium
LPPGSLVGTSSPRRAA

SEQ ID NO: 68691 - protein, 4 aa, Mycobacterium avium
LPPH

SEQ ID NO: 68692 - protein, 4 aa, Mycobacterium avium
LPPN

SEQ ID NO: 68693 - protein, 6 aa, Mycobacterium avium
LPPPAR

SEQ ID NO: 68694 - protein, 7 aa, Mycobacterium avium
LPPQALR

SEQ ID NO: 68695 - protein, 7 aa, Mycobacterium avium
LPPSEAP

SEQ ID NO: 68696 - protein, 5 aa, Mycobacterium avium
LPPTI

SEQ ID NO: 68697 - protein, 5 aa, Mycobacterium avium
LPPTQ

SEQ ID NO: 68698 - protein, 4 aa, Mycobacterium avium
LPPV

SEQ ID NO: 68699 - protein, 48 aa, Mycobacterium avium
LPPVSGPAPAEPAPNGEGAGSEQGQAQPAVISGGPDIRPALGDPAEVA

SEQ ID NO: 68700 - protein, 48 aa, Mycobacterium avium
LPPVSGPAPAEPASNGEGSGSEQGQAQPAVISGGPDIRPALGDPAEVA

SEQ ID NO: 68701 - protein, 42 aa, Mycobacterium avium
LPQAETGEAQPFSGRRGARKTALEAKRADGAMTQAGDGSPQV

SEQ ID NO: 68702 - protein, 27 aa, Mycobacterium avium
LPQKQRVAPGEPPEPRRAPRIDRATQR

SEQ ID NO: 68703 - protein, 17 aa, Mycobacterium avium
LPQPALRRDQGGRVETG

SEQ ID NO: 68704 - protein, 6 aa, Mycobacterium avium
LPQPEP

SEQ ID NO: 68705 - protein, 37 aa, Mycobacterium avium
LPQRAEDGRRDGSGGDDRGVDGGDAVTDQPDAGAVDD

SEQ ID NO: 68706 - protein, 12 aa, Mycobacterium avium
LPQRPVDPASRA

SEQ ID NO: 68707 - protein, 12 aa, Mycobacterium avium
LPQSSEPPQPEH

SEQ ID NO: 68708 - protein, 9 aa, Mycobacterium avium
LPRDPNGKL

SEQ ID NO: 68709 - protein, 19 aa, Mycobacterium avium
LPRDPRSQQPWNPEPLAGN

SEQ ID NO: 68710 - protein, 14 aa, Mycobacterium avium
LPRPGRPARPRRQS

SEQ ID NO: 68711 - protein, 8 aa, Mycobacterium avium
LPRPQTQI

SEQ ID NO: 68712 - protein, 7 aa, Mycobacterium avium
LPRSSGA

SEQ ID NO: 68713 - protein, 15 aa, Mycobacterium avium
LPRSSGGKVAKGRLR

SEQ ID NO: 68714 - protein, 11 aa, Mycobacterium avium
LPRSSTGKIAR

SEQ ID NO: 68715 - protein, 8 aa, Mycobacterium avium
LPRTDAGK

SEQ ID NO: 68716 - protein, 6 aa, Mycobacterium avium
LPRTGT

SEQ ID NO: 68717 - protein, 5 aa, Mycobacterium avium
LPSAT

SEQ ID NO: 68718 - protein, 12 aa, Mycobacterium avium
LPSATGFSPDRP

SEQ ID NO: 68719 - protein, 13 aa, Mycobacterium avium
LPSATGFSPDRPL

SEQ ID NO: 68720 - protein, 7 aa, Mycobacterium avium
LPSDTGH

SEQ ID NO: 68721 - protein, 4 aa, Mycobacterium avium
LPSP

SEQ ID NO: 68722 - protein, 7 aa, Mycobacterium avium
LPSPGEM

SEQ ID NO: 68723 - protein, 9 aa, Mycobacterium avium
LPSPGGPKE

SEQ ID NO: 68724 - protein, 52 aa, Mycobacterium avium
LPSPHRAGGSPRRSRAGVRAAPAWPARAPAALGGPRDAARRPGDRAGRPGCR

SEQ ID NO: 68725 - protein, 12 aa, Mycobacterium avium
LPSPLSLPVLPD

SEQ ID NO: 68726 - protein, 7 aa, Mycobacterium avium
LPSPNRQ

SEQ ID NO: 68727 - protein, 7 aa, Mycobacterium avium
LPSPSEM

SEQ ID NO: 68728 - protein, 18 aa, Mycobacterium avium
LPSTAPIHAKETKEVERR

SEQ ID NO: 68729 - protein, 7 aa, Mycobacterium avium
LPSTATH

SEQ ID NO: 68730 - protein, 6 aa, Mycobacterium avium
LPSWDG

SEQ ID NO: 68731 - protein, 9 aa, Mycobacterium avium
LPTAERPGT

SEQ ID NO: 68732 - protein, 6 aa, Mycobacterium avium
LPTAPV

SEQ ID NO: 68733 - protein, 7 aa, Mycobacterium avium
LPTDADA

SEQ ID NO: 68734 - protein, 9 aa, Mycobacterium avium
LPTEGRGGR

SEQ ID NO: 68735 - protein, 4 aa, Mycobacterium avium
LPTG

SEQ ID NO: 68736 - protein, 10 aa, Mycobacterium avium
LPTPGTAVAN

SEQ ID NO: 68737 - protein, 9 aa, Mycobacterium avium
LPTPSGNTF

SEQ ID NO: 68738 - protein, 23 aa, Mycobacterium avium
LPTQRGRGSEPARAPTLTSAAGS

SEQ ID NO: 68739 - protein, 7 aa, Mycobacterium avium
LPTTPPP

SEQ ID NO: 68740 - protein, 8 aa, Mycobacterium avium
LPTTPTGK

SEQ ID NO: 68741 - protein, 11 aa, Mycobacterium avium
LQAGSPSQISN

SEQ ID NO: 68742 - protein, 10 aa, Mycobacterium avium
LQAPDDPKVR

SEQ ID NO: 68743 - protein, 7 aa, Mycobacterium avium
LQDGRRR

SEQ ID NO: 68744 - protein, 8 aa, Mycobacterium avium
LQDRDEER

SEQ ID NO: 68745 - protein, 14 aa, Mycobacterium avium
LQESSAPPAENVGG

SEQ ID NO: 68746 - protein, 10 aa, Mycobacterium avium
LQETDYADGC

SEQ ID NO: 68747 - protein, 5 aa, Mycobacterium avium
LQGGP

SEQ ID NO: 68748 - protein, 6 aa, Mycobacterium avium
LQGKGY

SEQ ID NO: 68749 - protein, 12 aa, Mycobacterium avium
LQGPNSSLPIPD

SEQ ID NO: 68750 - protein, 6 aa, Mycobacterium avium
LQGRGS

SEQ ID NO: 68751 - protein, 7 aa, Mycobacterium avium
LQKGGYG

SEQ ID NO: 68752 - protein, 4 aa, Mycobacterium avium
LQPA

SEQ ID NO: 68753 - protein, 6 aa, Mycobacterium avium
LQPAER

SEQ ID NO: 68754 - protein, 5 aa, Mycobacterium avium
LQPEP

SEQ ID NO: 68755 - protein, 10 aa, Mycobacterium avium
LQPGPEGGPY

SEQ ID NO: 68756 - protein, 18 aa, Mycobacterium avium
LQPIPGAERPTDSDDPDA

SEQ ID NO: 68757 - protein, 33 aa, Mycobacterium avium
LQPLPAPRFSRTAPETPRPAAPVTDATAILDEW

SEQ ID NO: 68758 - protein, 12 aa, Mycobacterium avium
LQPNAGSQGEYA

SEQ ID NO: 68759 - protein, 9 aa, Mycobacterium avium
LQPPPPTLG

SEQ ID NO: 68760 - protein, 8 aa, Mycobacterium avium
LQPSGHND

SEQ ID NO: 68761 - protein, 8 aa, Mycobacterium avium
LQPTKGKI

SEQ ID NO: 68762 - protein, 6 aa, Mycobacterium avium
LQRAAA

SEQ ID NO: 68763 - protein, 8 aa, Mycobacterium avium
LQRGSQNG

SEQ ID NO: 68764 - protein, 4 aa, Mycobacterium avium
LQRK

SEQ ID NO: 68765 - protein, 20 aa, Mycobacterium avium
LQRTESRGGHTRDDHPSMDS

SEQ ID NO: 68766 - protein, 10 aa, Mycobacterium avium
LQSAAEPNLD

SEQ ID NO: 68767 - protein, 6 aa, Mycobacterium avium
LQSGAP

SEQ ID NO: 68768 - protein, 10 aa, Mycobacterium avium
LQSGRPAQIS

SEQ ID NO: 68769 - protein, 14 aa, Mycobacterium avium
LQSGSTAHATATQW

SEQ ID NO: 68770 - protein, 14 aa, Mycobacterium avium
LQSKNSNLSDDHAN

SEQ ID NO: 68771 - protein, 11 aa, Mycobacterium avium
LQSKPTQKLTD

SEQ ID NO: 68772 - protein, 13 aa, Mycobacterium avium
LQSPDAPSTPSDM

SEQ ID NO: 68773 - protein, 5 aa, Mycobacterium avium
LQSPG

SEQ ID NO: 68774 - protein, 7 aa, Mycobacterium avium
LQSRPAE

SEQ ID NO: 68775 - protein, 14 aa, Mycobacterium avium
LQVGSARADPGPFV

SEQ ID NO: 68776 - protein, 6 aa, Mycobacterium avium
LRADGE

SEQ ID NO: 68777 - protein, 6 aa, Mycobacterium avium
LRAGPG

SEQ ID NO: 68778 - protein, 7 aa, Mycobacterium avium
LRAGQQG

SEQ ID NO: 68779 - protein, 9 aa, Mycobacterium avium
LRAGSPEAP

SEQ ID NO: 68780 - protein, 5 aa, Mycobacterium avium
LRANE

SEQ ID NO: 68781 - protein, 4 aa, Mycobacterium avium
LRAT

SEQ ID NO: 68782 - protein, 9 aa, Mycobacterium avium
LRDDGTTTL

SEQ ID NO: 68783 - protein, 7 aa, Mycobacterium avium
LRDEPRW

SEQ ID NO: 68784 - protein, 14 aa, Mycobacterium avium
LRDGADDGDDRGTD

SEQ ID NO: 68785 - protein, 18 aa, Mycobacterium avium
LRDGADDSDGAGDDRGTD

SEQ ID NO: 68786 - protein, 17 aa, Mycobacterium avium
LRDGGTISSRRVTASQS

SEQ ID NO: 68787 - protein, 8 aa, Mycobacterium avium
LRDKSTTA

SEQ ID NO: 68788 - protein, 6 aa, Mycobacterium avium
LRDRAA

SEQ ID NO: 68789 - protein, 7 aa, Mycobacterium avium
LRDRNKM

SEQ ID NO: 68790 - protein, 8 aa, Mycobacterium avium
LRDRSTTA

SEQ ID NO: 68791 - protein, 8 aa, Mycobacterium avium
LRDRTATA

SEQ ID NO: 68792 - protein, 4 aa, Mycobacterium avium
LREA

SEQ ID NO: 68793 - protein, 12 aa, Mycobacterium avium
LREGEDEDLERA

SEQ ID NO: 68794 - protein, 6 aa, Mycobacterium avium
LRERDQ

SEQ ID NO: 68795 - protein, 7 aa, Mycobacterium avium
LRETPGT

SEQ ID NO: 68796 - protein, 7 aa, Mycobacterium avium
LRGAGAS

SEQ ID NO: 68797 - protein, 13 aa, Mycobacterium avium
LRGEASTESRQRF

SEQ ID NO: 68798 - protein, 11 aa, Mycobacterium avium
LRGECGPRQVP

SEQ ID NO: 68799 - protein, 11 aa, Mycobacterium avium
LRGGGGRGDLG

SEQ ID NO: 68800 - protein, 23 aa, Mycobacterium avium
LRGGPDSRQAFAASPDDNEMPGG

SEQ ID NO: 68801 - protein, 7 aa, Mycobacterium avium
LRGGPEL

SEQ ID NO: 68802 - protein, 6 aa, Mycobacterium avium
LRGKTV

SEQ ID NO: 68803 - protein, 28 aa, Mycobacterium avium
LRGPARHRGAEDDVALPGEGAQQARERR

SEQ ID NO: 68804 - protein, 5 aa, Mycobacterium avium
LRGPG

SEQ ID NO: 68805 - protein, 15 aa, Mycobacterium avium
LRGRRVDGQVGRPRL

SEQ ID NO: 68806 - protein, 21 aa, Mycobacterium avium
LRGRSTRAPPWRPGSPPCATS

SEQ ID NO: 68807 - protein, 8 aa, Mycobacterium avium
LRGSRTPD

SEQ ID NO: 68808 - protein, 5 aa, Mycobacterium avium
LRKGQ

SEQ ID NO: 68809 - protein, 7 aa, Mycobacterium avium
LRNDEPE

SEQ ID NO: 68810 - protein, 10 aa, Mycobacterium avium
LRPAQPGDVQ

SEQ ID NO: 68811 - protein, 8 aa, Mycobacterium avium
LRPDERRT

SEQ ID NO: 68812 - protein, 10 aa, Mycobacterium avium
LRPDNSPQRF

SEQ ID NO: 68813 - protein, 6 aa, Mycobacterium avium
LRPDSQ

SEQ ID NO: 68814 - protein, 5 aa, Mycobacterium avium
LRPED

SEQ ID NO: 68815 - protein, 5 aa, Mycobacterium avium
LRPPQ

SEQ ID NO: 68816 - protein, 6 aa, Mycobacterium avium
LRPRPE

SEQ ID NO: 68817 - protein, 14 aa, Mycobacterium avium
LRPRSVRGDHRDRR

SEQ ID NO: 68818 - protein, 20 aa, Mycobacterium avium
LRPSEREALARTGAEPAPGD

SEQ ID NO: 68819 - protein, 20 aa, Mycobacterium avium
LRPSEREALARTGAEPAPGN

SEQ ID NO: 68820 - protein, 20 aa, Mycobacterium avium
LRPSEREALARTGAEPTPGD

SEQ ID NO: 68821 - protein, 5 aa, Mycobacterium avium
LRPTA

SEQ ID NO: 68822 - protein, 6 aa, Mycobacterium avium
LRRRGA

SEQ ID NO: 68823 - protein, 4 aa, Mycobacterium avium
LRSE

SEQ ID NO: 68824 - protein, 12 aa, Mycobacterium avium
LRSETVDGTGYP

SEQ ID NO: 68825 - protein, 9 aa, Mycobacterium avium
LRSGRRRRA

SEQ ID NO: 68826 - protein, 9 aa, Mycobacterium avium
LRSGTGHSG

SEQ ID NO: 68827 - protein, 22 aa, Mycobacterium avium
LRSPDVNGQVEVPAGGQQKSPL

SEQ ID NO: 68828 - protein, 13 aa, Mycobacterium avium
LRSPGYANGNAYA

SEQ ID NO: 68829 - protein, 9 aa, Mycobacterium avium
LRSQRSVEV

SEQ ID NO: 68830 - protein, 10 aa, Mycobacterium avium
LRSTAELSRQ

SEQ ID NO: 68831 - protein, 17 aa, Mycobacterium avium
LRTATNSFEAQAARDGL

SEQ ID NO: 68832 - protein, 12 aa, Mycobacterium avium
LRTPEEIEEAER

SEQ ID NO: 68833 - protein, 5 aa, Mycobacterium avium
LSAAS

SEQ ID NO: 68834 - protein, 11 aa, Mycobacterium avium
LSAASGRRTHQ

SEQ ID NO: 68835 - protein, 14 aa, Mycobacterium avium
LSADEAEAAGNGRA

SEQ ID NO: 68836 - protein, 6 aa, Mycobacterium avium
LSADER

SEQ ID NO: 68837 - protein, 8 aa, Mycobacterium avium
LSADERAA

SEQ ID NO: 68838 - protein, 9 aa, Mycobacterium avium
LSADPTAIR

SEQ ID NO: 68839 - protein, 12 aa, Mycobacterium avium
LSAEAAAQHQGV

SEQ ID NO: 68840 - protein, 14 aa, Mycobacterium avium
LSAGQSPGAASSIG

SEQ ID NO: 68841 - protein, 62 aa, Mycobacterium avium
LSAKAEDELAEERDDEETDEADEAAEAPADATEPDEEALENDEADGEPDDDADETETRAAGD

SEQ ID NO: 68842 - protein, 7 aa, Mycobacterium avium
LSAPAVK

SEQ ID NO: 68843 - protein, 6 aa, Mycobacterium avium
LSARPG

SEQ ID NO: 68844 - protein, 6 aa, Mycobacterium avium
LSARTI

SEQ ID NO: 68845 - protein, 8 aa, Mycobacterium avium
LSATPPQT

SEQ ID NO: 68846 - protein, 17 aa, Mycobacterium avium
LSDAERAGYDAPFPSDE

SEQ ID NO: 68847 - protein, 7 aa, Mycobacterium avium
LSDDEAI

SEQ ID NO: 68848 - protein, 7 aa, Mycobacterium avium
LSDDERA

SEQ ID NO: 68849 - protein, 10 aa, Mycobacterium avium
LSDDETERAV

SEQ ID NO: 68850 - protein, 4 aa, Mycobacterium avium
LSDG

SEQ ID NO: 68851 - protein, 6 aa, Mycobacterium avium
LSDGKI

SEQ ID NO: 68852 - protein, 7 aa, Mycobacterium avium
LSDGTDP

SEQ ID NO: 68853 - protein, 14 aa, Mycobacterium avium
LSDGTSAKALTGID

SEQ ID NO: 68854 - protein, 6 aa, Mycobacterium avium
LSDKDS

SEQ ID NO: 68855 - protein, 9 aa, Mycobacterium avium
LSDKPSEPY

SEQ ID NO: 68856 - protein, 10 aa, Mycobacterium avium
LSDPQPPHAT

SEQ ID NO: 68857 - protein, 9 aa, Mycobacterium avium
LSEGADGEA

SEQ ID NO: 68858 - protein, 8 aa, Mycobacterium avium
LSEGGGGT

SEQ ID NO: 68859 - protein, 11 aa, Mycobacterium avium
LSEGGPDEAAR

SEQ ID NO: 68860 - protein, 6 aa, Mycobacterium avium
LSEPAT

SEQ ID NO: 68861 - protein, 5 aa, Mycobacterium avium
LSEPL

SEQ ID NO: 68862 - protein, 12 aa, Mycobacterium avium
LSEPQAGSDAAA

SEQ ID NO: 68863 - protein, 6 aa, Mycobacterium avium
LSERNQ

SEQ ID NO: 68864 - protein, 5 aa, Mycobacterium avium
LSEST

SEQ ID NO: 68865 - protein, 6 aa, Mycobacterium avium
LSETAT

SEQ ID NO: 68866 - protein, 6 aa, Mycobacterium avium
LSEVSS

SEQ ID NO: 68867 - protein, 12 aa, Mycobacterium avium
LSGDDDEHDVDR

SEQ ID NO: 68868 - protein, 10 aa, Mycobacterium avium
LSGDDNAPPV

SEQ ID NO: 68869 - protein, 7 aa, Mycobacterium avium
LSGEEDS

SEQ ID NO: 68870 - protein, 7 aa, Mycobacterium avium
LSGGQRQ

SEQ ID NO: 68871 - protein, 17 aa, Mycobacterium avium
LSGKAGNPGQTNYSAAK

SEQ ID NO: 68872 - protein, 6 aa, Mycobacterium avium
LSGNST

SEQ ID NO: 68873 - protein, 5 aa, Mycobacterium avium
LSGPG

SEQ ID NO: 68874 - protein, 8 aa, Mycobacterium avium
LSGQAADG

SEQ ID NO: 68875 - protein, 7 aa, Mycobacterium avium
LSGQGTS

SEQ ID NO: 68876 - protein, 7 aa, Mycobacterium avium
LSGRPSY

SEQ ID NO: 68877 - protein, 6 aa, Mycobacterium avium
LSGRQR

SEQ ID NO: 68878 - protein, 11 aa, Mycobacterium avium
LSGSDNSAFGT

SEQ ID NO: 68879 - protein, 6 aa, Mycobacterium avium
LSGSKT

SEQ ID NO: 68880 - protein, 8 aa, Mycobacterium avium
LSGTADAL

SEQ ID NO: 68881 - protein, 7 aa, Mycobacterium avium
LSHAQGE

SEQ ID NO: 68882 - protein, 6 aa, Mycobacterium avium
LSKGAR

SEQ ID NO: 68883 - protein, 9 aa, Mycobacterium avium
LSKHKTPER

SEQ ID NO: 68884 - protein, 8 aa, Mycobacterium avium
LSLPAGGT

SEQ ID NO: 68885 - protein, 8 aa, Mycobacterium avium
LSNDEQKE

SEQ ID NO: 68886 - protein, 9 aa, Mycobacterium avium
LSNEGPQKL

SEQ ID NO: 68887 - protein, 7 aa, Mycobacterium avium
LSNGHPV

SEQ ID NO: 68888 - protein, 14 aa, Mycobacterium avium
LSNPGFTPPPSMVV

SEQ ID NO: 68889 - protein, 60 aa, Mycobacterium avium
LSNPNKPPRNPPETTTTNPTTTETSPVTTTETTSTTPTTAAAAPPGVGSSELLGGDAGDI

SEQ ID NO: 68890 - protein, 60 aa, Mycobacterium avium
LSNPNKPPRNPPETTTTSTNPTTTETSPVTTTETTSTTPTTAAAAPPGVGSSELLGGDAG

SEQ ID NO: 68891 - protein, 37 aa, Mycobacterium avium
LSPAGRGGHDAHTEAADHRRGQPGQDVAGAQVQNPAR

SEQ ID NO: 68892 - protein, 9 aa, Mycobacterium avium
LSPAGRRSL

SEQ ID NO: 68893 - protein, 7 aa, Mycobacterium avium
LSPASQG

SEQ ID NO: 68894 - protein, 16 aa, Mycobacterium avium
LSPEEVPGQLDRDSYP

SEQ ID NO: 68895 - protein, 10 aa, Mycobacterium avium
LSPGGDRRQT

SEQ ID NO: 68896 - protein, 6 aa, Mycobacterium avium
LSPQNT

SEQ ID NO: 68897 - protein, 22 aa, Mycobacterium avium
LSPQPAQGRRRPDGVPQTAGGT

SEQ ID NO: 68898 - protein, 4 aa, Mycobacterium avium
LSPR

SEQ ID NO: 68899 - protein, 9 aa, Mycobacterium avium
LSPRVPESG

SEQ ID NO: 68900 - protein, 5 aa, Mycobacterium avium
LSPTL

SEQ ID NO: 68901 - protein, 6 aa, Mycobacterium avium
LSPTLP

SEQ ID NO: 68902 - protein, 19 aa, Mycobacterium avium
LSQAGSQPAALDGPVPRDR

SEQ ID NO: 68903 - protein, 6 aa, Mycobacterium avium
LSQAKD

SEQ ID NO: 68904 - protein, 16 aa, Mycobacterium avium
LSQEAQAAHAAGEDTF

SEQ ID NO: 68905 - protein, 6 aa, Mycobacterium avium
LSQRSI

SEQ ID NO: 68906 - protein, 4 aa, Mycobacterium avium
LSQS

SEQ ID NO: 68907 - protein, 16 aa, Mycobacterium avium
LSRASHAGEDLSTKLR

SEQ ID NO: 68908 - protein, 9 aa, Mycobacterium avium
LSRDPSISI

SEQ ID NO: 68909 - protein, 4 aa, Mycobacterium avium
LSRG

SEQ ID NO: 68910 - protein, 9 aa, Mycobacterium avium
LSRPNAKKQ

SEQ ID NO: 68911 - protein, 15 aa, Mycobacterium avium
LSRQPHTALPAPDPD

SEQ ID NO: 68912 - protein, 13 aa, Mycobacterium avium
LSRRTNPAGLTGS

SEQ ID NO: 68913 - protein, 6 aa, Mycobacterium avium
LSSDAF

SEQ ID NO: 68914 - protein, 5 aa, Mycobacterium avium
LSSDK

SEQ ID NO: 68915 - protein, 8 aa, Mycobacterium avium
LSSDPDDL

SEQ ID NO: 68916 - protein, 9 aa, Mycobacterium avium
LSSETNKAL

SEQ ID NO: 68917 - protein, 13 aa, Mycobacterium avium
LSSETTAAATGTV

SEQ ID NO: 68918 - protein, 10 aa, Mycobacterium avium
LSSGPGPGSL

SEQ ID NO: 68919 - protein, 11 aa, Mycobacterium avium
LSSGQLTQSRP

SEQ ID NO: 68920 - protein, 6 aa, Mycobacterium avium
LSSGSE

SEQ ID NO: 68921 - protein, 15 aa, Mycobacterium avium
LSSGSPFSRPVNGTD

SEQ ID NO: 68922 - protein, 23 aa, Mycobacterium avium
LSSGTAPAAPCSGADEDDDATTG

SEQ ID NO: 68923 - protein, 7 aa, Mycobacterium avium
LSSHSGL

SEQ ID NO: 68924 - protein, 4 aa, Mycobacterium avium
LSSR

SEQ ID NO: 68925 - protein, 5 aa, Mycobacterium avium
LSSRA

SEQ ID NO: 68926 - protein, 18 aa, Mycobacterium avium
LSSSGELTAGGATFRPSA

SEQ ID NO: 68927 - protein, 6 aa, Mycobacterium avium
LSTGPI

SEQ ID NO: 68928 - protein, 6 aa, Mycobacterium avium
LSTGPT

SEQ ID NO: 68929 - protein, 10 aa, Mycobacterium avium
LSTGTANGVA

SEQ ID NO: 68930 - protein, 8 aa, Mycobacterium avium
LSTPGGQD

SEQ ID NO: 68931 - protein, 24 aa, Mycobacterium avium
LSTPGSRLGSEAVPDTADMDPHAA

SEQ ID NO: 68932 - protein, 9 aa, Mycobacterium avium
LSTPHADDP

SEQ ID NO: 68933 - protein, 9 aa, Mycobacterium avium
LSTPRADDP

SEQ ID NO: 68934 - protein, 10 aa, Mycobacterium avium
LSTPRADDPW

SEQ ID NO: 68935 - protein, 18 aa, Mycobacterium avium
LSTPVRDSQHALPDTRRT

SEQ ID NO: 68936 - protein, 10 aa, Mycobacterium avium
LSTQSPTTVA

SEQ ID NO: 68937 - protein, 19 aa, Mycobacterium avium
LSTSSGSYAATEAANAAAA

SEQ ID NO: 68938 - protein, 7 aa, Mycobacterium avium
LSTTAAP

SEQ ID NO: 68939 - protein, 8 aa, Mycobacterium avium
LSTYPGPV

SEQ ID NO: 68940 - protein, 20 aa, Mycobacterium avium
LTAAAADYRNTHGHQPTSIT

SEQ ID NO: 68941 - protein, 5 aa, Mycobacterium avium
LTAAG

SEQ ID NO: 68942 - protein, 4 aa, Mycobacterium avium
LTAE

SEQ ID NO: 68943 - protein, 9 aa, Mycobacterium avium
LTAGENPGI

SEQ ID NO: 68944 - protein, 11 aa, Mycobacterium avium
LTAGLDDEQRE

SEQ ID NO: 68945 - protein, 9 aa, Mycobacterium avium
LTAHENHDK

SEQ ID NO: 68946 - protein, 10 aa, Mycobacterium avium
LTAHENHDKV

SEQ ID NO: 68947 - protein, 14 aa, Mycobacterium avium
LTAHENHDKVSAGD

SEQ ID NO: 68948 - protein, 10 aa, Mycobacterium avium
LTAPSTKPAA

SEQ ID NO: 68949 - protein, 12 aa, Mycobacterium avium
LTARGADGARHS

SEQ ID NO: 68950 - protein, 7 aa, Mycobacterium avium
LTASENN

SEQ ID NO: 68951 - protein, 7 aa, Mycobacterium avium
LTDADGL

SEQ ID NO: 68952 - protein, 9 aa, Mycobacterium avium
LTDDPADPS

SEQ ID NO: 68953 - protein, 14 aa, Mycobacterium avium
LTDDTAAAVGARRV

SEQ ID NO: 68954 - protein, 15 aa, Mycobacterium avium
LTDEDGAKDRLTDRE

SEQ ID NO: 68955 - protein, 10 aa, Mycobacterium avium
LTDEQRAAAL

SEQ ID NO: 68956 - protein, 13 aa, Mycobacterium avium
LTDGQARSAPSVS

SEQ ID NO: 68957 - protein, 4 aa, Mycobacterium avium
LTDR

SEQ ID NO: 68958 - protein, 21 aa, Mycobacterium avium
LTDSPSTKAAAEIATGGRTDN

SEQ ID NO: 68959 - protein, 24 aa, Mycobacterium avium
LTEDPEQRDSEELSDEVASTGAQR

SEQ ID NO: 68960 - protein, 4 aa, Mycobacterium avium
LTEG

SEQ ID NO: 68961 - protein, 9 aa, Mycobacterium avium
LTENDPAKL

SEQ ID NO: 68962 - protein, 6 aa, Mycobacterium avium
LTERPS

SEQ ID NO: 68963 - protein, 12 aa, Mycobacterium avium
LTESGYAATESV

SEQ ID NO: 68964 - protein, 19 aa, Mycobacterium avium
LTESVRPVGPAPVQPGGPP

SEQ ID NO: 68965 - protein, 6 aa, Mycobacterium avium
LTETSS

SEQ ID NO: 68966 - protein, 14 aa, Mycobacterium avium
LTGAAGPSARRDHA

SEQ ID NO: 68967 - protein, 7 aa, Mycobacterium avium
LTGADGQ

SEQ ID NO: 68968 - protein, 15 aa, Mycobacterium avium
LTGAGKSQVGRRLGR

SEQ ID NO: 68969 - protein, 5 aa, Mycobacterium avium
LTGAP

SEQ ID NO: 68970 - protein, 18 aa, Mycobacterium avium
LTGDGGASVTPLARQTRS

SEQ ID NO: 68971 - protein, 14 aa, Mycobacterium avium
LTGDGGPGMYESEP

SEQ ID NO: 68972 - protein, 8 aa, Mycobacterium avium
LTGDRGAL

SEQ ID NO: 68973 - protein, 6 aa, Mycobacterium avium
LTGEVR

SEQ ID NO: 68974 - protein, 6 aa, Mycobacterium avium
LTGGLG

SEQ ID NO: 68975 - protein, 8 aa, Mycobacterium avium
LTGGLGEA

SEQ ID NO: 68976 - protein, 28 aa, Mycobacterium avium
LTGNGKLDTRALPAPDYAGGRYRAPGDA

SEQ ID NO: 68977 - protein, 17 aa, Mycobacterium avium
LTGRAATDTVPPDRSRT

SEQ ID NO: 68978 - protein, 5 aa, Mycobacterium avium
LTGRE

SEQ ID NO: 68979 - protein, 6 aa, Mycobacterium avium
LTGRGV

SEQ ID NO: 68980 - protein, 7 aa, Mycobacterium avium
LTGTSTC

SEQ ID NO: 68981 - protein, 12 aa, Mycobacterium avium
LTHGGDAANQAA

SEQ ID NO: 68982 - protein, 5 aa, Mycobacterium avium
LTHGR

SEQ ID NO: 68983 - protein, 9 aa, Mycobacterium avium
LTKAGVPFT

SEQ ID NO: 68984 - protein, 7 aa, Mycobacterium avium
LTKTTGD

SEQ ID NO: 68985 - protein, 14 aa, Mycobacterium avium
LTNMRSSTADVSET

SEQ ID NO: 68986 - protein, 11 aa, Mycobacterium avium
LTNPASGRGED

SEQ ID NO: 68987 - protein, 10 aa, Mycobacterium avium
LTNPSREDAE

SEQ ID NO: 68988 - protein, 6 aa, Mycobacterium avium
LTPADD

SEQ ID NO: 68989 - protein, 5 aa, Mycobacterium avium
LTPAQ

SEQ ID NO: 68990 - protein, 16 aa, Mycobacterium avium
LTPARAEAVQRDRDEV

SEQ ID NO: 68991 - protein, 6 aa, Mycobacterium avium
LTPASA

SEQ ID NO: 68992 - protein, 16 aa, Mycobacterium avium
LTPATAAAAAPAAGIP

SEQ ID NO: 68993 - protein, 12 aa, Mycobacterium avium
LTPEDRRATQRD

SEQ ID NO: 68994 - protein, 12 aa, Mycobacterium avium
LTPELGGAGALP

SEQ ID NO: 68995 - protein, 5 aa, Mycobacterium avium
LTPGD

SEQ ID NO: 68996 - protein, 32 aa, Mycobacterium avium
LTPNGKIDTRALPTPEYTGSRYRAPSNAVEET

SEQ ID NO: 68997 - protein, 31 aa, Mycobacterium avium
LTPNGKLDARALPAPDYAAGEYRAPESPTEE

SEQ ID NO: 68998 - protein, 31 aa, Mycobacterium avium
LTPNGKLDARALPAPDYAAGEYRAPQTPTEE

SEQ ID NO: 68999 - protein, 11 aa, Mycobacterium avium
LTPNGKLDEST

SEQ ID NO: 69000 - protein, 19 aa, Mycobacterium avium
LTPNGKLDTGALPAPDYHG

SEQ ID NO: 69001 - protein, 30 aa, Mycobacterium avium
LTPNGKLDTRALPAPEYSDADRYRAPDNAV

SEQ ID NO: 69002 - protein, 32 aa, Mycobacterium avium
LTPNGKLDTRALPAPEYSDAGQYRAPETPVEQ

SEQ ID NO: 69003 - protein, 31 aa, Mycobacterium avium
LTPNGKLDTRALPTPEYSTGEYRAPESPTEE

SEQ ID NO: 69004 - protein, 14 aa, Mycobacterium avium
LTPPAGSPADSGAG

SEQ ID NO: 69005 - protein, 14 aa, Mycobacterium avium
LTPRAEKDPDGEYE

SEQ ID NO: 69006 - protein, 6 aa, Mycobacterium avium
LTPRRA

SEQ ID NO: 69007 - protein, 22 aa, Mycobacterium avium
LTPSGKLDTGALPAPDYQGPED

SEQ ID NO: 69008 - protein, 8 aa, Mycobacterium avium
LTPSSAHG

SEQ ID NO: 69009 - protein, 6 aa, Mycobacterium avium
LTPSVA

SEQ ID NO: 69010 - protein, 4 aa, Mycobacterium avium
LTQR

SEQ ID NO: 69011 - protein, 9 aa, Mycobacterium avium
LTQSPGDVA

SEQ ID NO: 69012 - protein, 12 aa, Mycobacterium avium
LTQTHPDIPEQM

SEQ ID NO: 69013 - protein, 5 aa, Mycobacterium avium
LTQTP

SEQ ID NO: 69014 - protein, 9 aa, Mycobacterium avium
LTREGQPDT

SEQ ID NO: 69015 - protein, 8 aa, Mycobacterium avium
LTREQRDE

SEQ ID NO: 69016 - protein, 7 aa, Mycobacterium avium
LTRNPNA

SEQ ID NO: 69017 - protein, 11 aa, Mycobacterium avium
LTRPQNPPTSI

SEQ ID NO: 69018 - protein, 13 aa, Mycobacterium avium
LTSGDERPGDGSI

SEQ ID NO: 69019 - protein, 5 aa, Mycobacterium avium
LTSSD

SEQ ID NO: 69020 - protein, 8 aa, Mycobacterium avium
LTSSSGGM

SEQ ID NO: 69021 - protein, 6 aa, Mycobacterium avium
LTTAPG

SEQ ID NO: 69022 - protein, 7 aa, Mycobacterium avium
LTTPART

SEQ ID NO: 69023 - protein, 5 aa, Mycobacterium avium
LTTPD

SEQ ID NO: 69024 - protein, 32 aa, Mycobacterium avium
LTTPKRSVEPASDFGDLEPPALGSGTDDPDEP

SEQ ID NO: 69025 - protein, 36 aa, Mycobacterium avium
LTTTQTRRTKRPPGSAGPAGRALRTPSGGRAAAKGR

SEQ ID NO: 69026 - protein, 36 aa, Mycobacterium avium
LTTTQTRRTKRPPNSAGPTGRALRTPSGGRAAAKGR

SEQ ID NO: 69027 - protein, 38 aa, Mycobacterium avium
LTTTQTRRTKRPPSRRRAGGPGASDAIRRPGSGQGAQA

SEQ ID NO: 69028 - protein, 36 aa, Mycobacterium avium
LTVTDSDGRPLSPGSLARPPTQPPPAVPPCPGPLGE

SEQ ID NO: 69029 - protein, 14 aa, Mycobacterium avium
LVGPQDPVELGPQQ

SEQ ID NO: 69030 - protein, 4 aa, Mycobacterium avium
LVSD

SEQ ID NO: 69031 - protein, 9 aa, Mycobacterium avium
LVSEKTNAT

SEQ ID NO: 69032 - protein, 6 aa, Mycobacterium avium
LYGNQG

SEQ ID NO: 69033 - protein, 13 aa, Mycobacterium avium
LYSAKAKAKELGF

SEQ ID NO: 69034 - protein, 16 aa, Mycobacterium avium
MAAPPHPMAPGSTERD

SEQ ID NO: 69035 - protein, 8 aa, Mycobacterium avium
MADNGGGA

SEQ ID NO: 69036 - protein, 8 aa, Mycobacterium avium
MADNGGGT

SEQ ID NO: 69037 - protein, 12 aa, Mycobacterium avium
MAGEEKTTGVSS

SEQ ID NO: 69038 - protein, 5 aa, Mycobacterium avium
MAPAT

SEQ ID NO: 69039 - protein, 10 aa, Mycobacterium avium
MAPDGGSSVT

SEQ ID NO: 69040 - protein, 4 aa, Mycobacterium avium
MAPP

SEQ ID NO: 69041 - protein, 11 aa, Mycobacterium avium
MAPTPPDLDPV

SEQ ID NO: 69042 - protein, 6 aa, Mycobacterium avium
MARPDQ

SEQ ID NO: 69043 - protein, 5 aa, Mycobacterium avium
MARPE

SEQ ID NO: 69044 - protein, 6 aa, Mycobacterium avium
MATDDA

SEQ ID NO: 69045 - protein, 8 aa, Mycobacterium avium
MATRADNP

SEQ ID NO: 69046 - protein, 7 aa, Mycobacterium avium
MCNPDDE

SEQ ID NO: 69047 - protein, 8 aa, Mycobacterium avium
MDAPPGGG

SEQ ID NO: 69048 - protein, 14 aa, Mycobacterium avium
MDDPEPAPASLPNC

SEQ ID NO: 69049 - protein, 5 aa, Mycobacterium avium
MDERR

SEQ ID NO: 69050 - protein, 7 aa, Mycobacterium avium
MDGNPTL

SEQ ID NO: 69051 - protein, 5 aa, Mycobacterium avium
MDKRR

SEQ ID NO: 69052 - protein, 14 aa, Mycobacterium avium
MDRKTGKAKTAKTT

SEQ ID NO: 69053 - protein, 4 aa, Mycobacterium avium
MEGA

SEQ ID NO: 69054 - protein, 13 aa, Mycobacterium avium
MEQTGGFEGRTKK

SEQ ID NO: 69055 - protein, 30 aa, Mycobacterium avium
MGAGGEGGNKDKPAEKRVTAPGVPNGQPVK

SEQ ID NO: 69056 - protein, 7 aa, Mycobacterium avium
MGASGVT

SEQ ID NO: 69057 - protein, 10 aa, Mycobacterium avium
MGEPAAATLD

SEQ ID NO: 69058 - protein, 4 aa, Mycobacterium avium
MGGH

SEQ ID NO: 69059 - protein, 5 aa, Mycobacterium avium
MGGHS

SEQ ID NO: 69060 - protein, 10 aa, Mycobacterium avium
MGGSDDPNSV

SEQ ID NO: 69061 - protein, 10 aa, Mycobacterium avium
MGGSPDTFPG

SEQ ID NO: 69062 - protein, 7 aa, Mycobacterium avium
MGGTAEV

SEQ ID NO: 69063 - protein, 10 aa, Mycobacterium avium
MGRAGEPSEV

SEQ ID NO: 69064 - protein, 18 aa, Mycobacterium avium
MGSEQTAAAEGKVGTVRR

SEQ ID NO: 69065 - protein, 7 aa, Mycobacterium avium
MGTPQDI

SEQ ID NO: 69066 - protein, 8 aa, Mycobacterium avium
MKKAGRGS

SEQ ID NO: 69067 - protein, 7 aa, Mycobacterium avium
MNAGKDV

SEQ ID NO: 69068 - protein, 15 aa, Mycobacterium avium
MNDGTAGGYETNTAP

SEQ ID NO: 69069 - protein, 8 aa, Mycobacterium avium
MNPEQRQA

SEQ ID NO: 69070 - protein, 7 aa, Mycobacterium avium
MPAKPTA

SEQ ID NO: 69071 - protein, 16 aa, Mycobacterium avium
MPAPVDPSGWDGYGRG

SEQ ID NO: 69072 - protein, 15 aa, Mycobacterium avium
MPAPVDPSGWEGYGR

SEQ ID NO: 69073 - protein, 8 aa, Mycobacterium avium
MPDEPNVE

SEQ ID NO: 69074 - protein, 18 aa, Mycobacterium avium
MPDTAPPRRAPEPHNMIR

SEQ ID NO: 69075 - protein, 4 aa, Mycobacterium avium
MPEH

SEQ ID NO: 69076 - protein, 4 aa, Mycobacterium avium
MPFP

SEQ ID NO: 69077 - protein, 5 aa, Mycobacterium avium
MPPER

SEQ ID NO: 69078 - protein, 9 aa, Mycobacterium avium
MPPKALSAT

SEQ ID NO: 69079 - protein, 12 aa, Mycobacterium avium
MPPLDAAPTLPD

SEQ ID NO: 69080 - protein, 5 aa, Mycobacterium avium
MPPPK

SEQ ID NO: 69081 - protein, 11 aa, Mycobacterium avium
MPPPYESQYDT

SEQ ID NO: 69082 - protein, 15 aa, Mycobacterium avium
MPPVEEESVPEGPFG

SEQ ID NO: 69083 - protein, 8 aa, Mycobacterium avium
MPSPYTAR

SEQ ID NO: 69084 - protein, 16 aa, Mycobacterium avium
MQHQGQADGYLPSNEQ

SEQ ID NO: 69085 - protein, 21 aa, Mycobacterium avium
MQPPSPVTGGNPLTYPYHFGG

SEQ ID NO: 69086 - protein, 8 aa, Mycobacterium avium
MREDKNDR

SEQ ID NO: 69087 - protein, 14 aa, Mycobacterium avium
MRETRGRKQGSDPI

SEQ ID NO: 69088 - protein, 17 aa, Mycobacterium avium
MRKAGYKPARREGAREG

SEQ ID NO: 69089 - protein, 11 aa, Mycobacterium avium
MRKESAPAPIW

SEQ ID NO: 69090 - protein, 7 aa, Mycobacterium avium
MRPDGTV

SEQ ID NO: 69091 - protein, 10 aa, Mycobacterium avium
MRSSAGRDRF

SEQ ID NO: 69092 - protein, 22 aa, Mycobacterium avium
MSAATGYADGPPCNLQGPADPI

SEQ ID NO: 69093 - protein, 7 aa, Mycobacterium avium
MSAKGIP

SEQ ID NO: 69094 - protein, 17 aa, Mycobacterium avium
MSEPTGASGPNSDEQAA

SEQ ID NO: 69095 - protein, 7 aa, Mycobacterium avium
MSGDEDS

SEQ ID NO: 69096 - protein, 6 aa, Mycobacterium avium
MSRGEH

SEQ ID NO: 69097 - protein, 6 aa, Mycobacterium avium
MSSREK

SEQ ID NO: 69098 - protein, 10 aa, Mycobacterium avium
MSTSGLSASD

SEQ ID NO: 69099 - protein, 9 aa, Mycobacterium avium
MTATPEAFN

SEQ ID NO: 69100 - protein, 27 aa, Mycobacterium avium
MTEKQGGSDVRAGTTQAVPNGDGSYRL

SEQ ID NO: 69101 - protein, 15 aa, Mycobacterium avium
MTEPTAAGDSDEHAA

SEQ ID NO: 69102 - protein, 15 aa, Mycobacterium avium
MTPQQTRRNDENTIV

SEQ ID NO: 69103 - protein, 10 aa, Mycobacterium avium
MTPTSPDSHG

SEQ ID NO: 69104 - protein, 6 aa, Mycobacterium avium
MTPVPE

SEQ ID NO: 69105 - protein, 5 aa, Mycobacterium avium
MTRSP

SEQ ID NO: 69106 - protein, 16 aa, Mycobacterium avium
MTSEATPSATAAGPRL

SEQ ID NO: 69107 - protein, 16 aa, Mycobacterium avium
MTSGGGANGQPACRGI

SEQ ID NO: 69108 - protein, 5 aa, Mycobacterium avium
MTSTY

SEQ ID NO: 69109 - protein, 12 aa, Mycobacterium avium
MTTDGTRRRHLG

SEQ ID NO: 69110 - protein, 6 aa, Mycobacterium avium
MTTQPQ

SEQ ID NO: 69111 - protein, 18 aa, Mycobacterium avium
MTTSGKLDRKALPAPDYQ

SEQ ID NO: 69112 - protein, 30 aa, Mycobacterium avium
MTTSGKLDRKALPAPDYQDADRYRAPSTAV

SEQ ID NO: 69113 - protein, 5 aa, Mycobacterium avium
MVPPQ

SEQ ID NO: 69114 - protein, 4 aa, Mycobacterium avium
MYPD

SEQ ID NO: 69115 - protein, 10 aa, Mycobacterium avium
MYSGPGPASL

SEQ ID NO: 69116 - protein, 10 aa, Mycobacterium avium
MYSGPGSGSM

SEQ ID NO: 69117 - protein, 4 aa, Mycobacterium avium
MYTG

SEQ ID NO: 69118 - protein, 5 aa, Mycobacterium avium
NAAEG

SEQ ID NO: 69119 - protein, 9 aa, Mycobacterium avium
NAAENPEAY

SEQ ID NO: 69120 - protein, 16 aa, Mycobacterium avium
NAAEPRAAGRDRVLGA

SEQ ID NO: 69121 - protein, 6 aa, Mycobacterium avium
NAAGRG

SEQ ID NO: 69122 - protein, 15 aa, Mycobacterium avium
NAAPDTELRATAKRA

SEQ ID NO: 69123 - protein, 9 aa, Mycobacterium avium
NAAQSGTHD

SEQ ID NO: 69124 - protein, 33 aa, Mycobacterium avium; identical to SEQ ID NO: 8839

SEQ ID NO: 69125 - protein, 7 aa, Mycobacterium avium
NAATHPA

SEQ ID NO: 69126 - protein, 9 aa, Mycobacterium avium
NACGANDGA

SEQ ID NO: 69127 - protein, 6 aa, Mycobacterium avium
NADGAQ

SEQ ID NO: 69128 - protein, 9 aa, Mycobacterium avium
NADIPDTDE

SEQ ID NO: 69129 - protein, 7 aa, Mycobacterium avium
NADPAHP

SEQ ID NO: 69130 - protein, 5 aa, Mycobacterium avium
NADPD

SEQ ID NO: 69131 - protein, 8 aa, Mycobacterium avium
NADPGRTI

SEQ ID NO: 69132 - protein, 4 aa, Mycobacterium avium
NADR

SEQ ID NO: 69133 - protein, 7 aa, Mycobacterium avium
NADTGTI

SEQ ID NO: 69134 - protein, 6 aa, Mycobacterium avium
NAEARE

SEQ ID NO: 69135 - protein, 18 aa, Mycobacterium avium
NAEAVDGAAPPQTGTESA

SEQ ID NO: 69136 - protein, 18 aa, Mycobacterium avium
NAEAVDGAATPQTGTESA

SEQ ID NO: 69137 - protein, 20 aa, Mycobacterium avium
NAEEAADEAVDESDGAAGSD

SEQ ID NO: 69138 - protein, 5 aa, Mycobacterium avium
NAEGH

SEQ ID NO: 69139 - protein, 17 aa, Mycobacterium avium
NAEKGLPHGPARPFGYE

SEQ ID NO: 69140 - protein, 10 aa, Mycobacterium avium
NAEKKRGMGL

SEQ ID NO: 69141 - protein, 6 aa, Mycobacterium avium
NAEKWE

SEQ ID NO: 69142 - protein, 13 aa, Mycobacterium avium
NAEQRAKDRGALY

SEQ ID NO: 69143 - protein, 15 aa, Mycobacterium avium
NAERQGSKKSGKLKD

SEQ ID NO: 69144 - protein, 9 aa, Mycobacterium avium
NAETDTTWG

SEQ ID NO: 69145 - protein, 17 aa, Mycobacterium avium
NAGATPDSLNNKKKPRT

SEQ ID NO: 69146 - protein, 10 aa, Mycobacterium avium
NAGATRGEDP

SEQ ID NO: 69147 - protein, 7 aa, Mycobacterium avium
NAGDTPA

SEQ ID NO: 69148 - protein, 7 aa, Mycobacterium avium
NAGLGEV

SEQ ID NO: 69149 - protein, 12 aa, Mycobacterium avium
NAGYKGFSLVKA

SEQ ID NO: 69150 - protein, 7 aa, Mycobacterium avium
NAKPGQR

SEQ ID NO: 69151 - protein, 10 aa, Mycobacterium avium
NALGPHGGNA

SEQ ID NO: 69152 - protein, 21 aa, Mycobacterium avium
NALGPHGGNAAVYAPKAALGH

SEQ ID NO: 69153 - protein, 7 aa, Mycobacterium avium
NALPDSS

SEQ ID NO: 69154 - protein, 11 aa, Mycobacterium avium
NALTTDKDGVP

SEQ ID NO: 69155 - protein, 8 aa, Mycobacterium avium
NALTTPAG

SEQ ID NO: 69156 - protein, 7 aa, Mycobacterium avium
NANPECT

SEQ ID NO: 69157 - protein, 7 aa, Mycobacterium avium
NANQADL

SEQ ID NO: 69158 - protein, 6 aa, Mycobacterium avium
NANYPQ

SEQ ID NO: 69159 - protein, 9 aa, Mycobacterium avium
NAPIAATRD

SEQ ID NO: 69160 - protein, 10 aa, Mycobacterium avium
NAPIAATRDS

SEQ ID NO: 69161 - protein, 8 aa, Mycobacterium avium
NAPRPAGL

SEQ ID NO: 69162 - protein, 7 aa, Mycobacterium avium
NAPRRSK

SEQ ID NO: 69163 - protein, 6 aa, Mycobacterium avium
NAPTVG

SEQ ID NO: 69164 - protein, 7 aa, Mycobacterium avium
NAPWTGY

SEQ ID NO: 69165 - protein, 5 aa, Mycobacterium avium
NARAA

SEQ ID NO: 69166 - protein, 6 aa, Mycobacterium avium
NARAAW

SEQ ID NO: 69167 - protein, 10 aa, Mycobacterium avium
NARAGAKGVG

SEQ ID NO: 69168 - protein, 4 aa, Mycobacterium avium
NARI

SEQ ID NO: 69169 - protein, 9 aa, Mycobacterium avium
NARSFSDTQ

SEQ ID NO: 69170 - protein, 8 aa, Mycobacterium avium
NASADRLT

SEQ ID NO: 69171 - protein, 5 aa, Mycobacterium avium
NASGA

SEQ ID NO: 69172 - protein, 8 aa, Mycobacterium avium
NASGERFR

SEQ ID NO: 69173 - protein, 11 aa, Mycobacterium avium
NASIGGDLPRP

SEQ ID NO: 69174 - protein, 4 aa, Mycobacterium avium
NASM

SEQ ID NO: 69175 - protein, 8 aa, Mycobacterium avium
NASRSAAE

SEQ ID NO: 69176 - protein, 20 aa, Mycobacterium avium
NASTAVTRPAGSGAVARGYT

SEQ ID NO: 69177 - protein, 7 aa, Mycobacterium avium
NATQEST

SEQ ID NO: 69178 - protein, 12 aa, Mycobacterium avium
NAVGSANDENSI

SEQ ID NO: 69179 - protein, 4 aa, Mycobacterium avium
NAYR

SEQ ID NO: 69180 - protein, 4 aa, Mycobacterium avium
NCPN

SEQ ID NO: 69181 - protein, 6 aa, Mycobacterium avium
NDAADR

SEQ ID NO: 69182 - protein, 5 aa, Mycobacterium avium
NDAGS

SEQ ID NO: 69183 - protein, 8 aa, Mycobacterium avium
NDAKARRA

SEQ ID NO: 69184 - protein, 10 aa, Mycobacterium avium
NDALRDTKAA

SEQ ID NO: 69185 - protein, 21 aa, Mycobacterium avium
NDAPGSGEDARLTPLQGGSQN

SEQ ID NO: 69186 - protein, 4 aa, Mycobacterium avium
NDAR

SEQ ID NO: 69187 - protein, 23 aa, Mycobacterium avium
NDARERAESRRRTHEFLSSVCPA

SEQ ID NO: 69188 - protein, 4 aa, Mycobacterium avium
NDAT

SEQ ID NO: 69189 - protein, 9 aa, Mycobacterium avium
NDDGDRATA

SEQ ID NO: 69190 - protein, 8 aa, Mycobacterium avium
NDDKPVTR

SEQ ID NO: 69191 - protein, 8 aa, Mycobacterium avium
NDDPARAI

SEQ ID NO: 69192 - protein, 4 aa, Mycobacterium avium
NDDQ

SEQ ID NO: 69193 - protein, 15 aa, Mycobacterium avium
NDDSRLADHNAEARR

SEQ ID NO: 69194 - protein, 4 aa, Mycobacterium avium
NDDV

SEQ ID NO: 69195 - protein, 10 aa, Mycobacterium avium
NDEAAEAERM

SEQ ID NO: 69196 - protein, 6 aa, Mycobacterium avium
NDEGDV

SEQ ID NO: 69197 - protein, 6 aa, Mycobacterium avium
NDEQKQ

SEQ ID NO: 69198 - protein, 6 aa, Mycobacterium avium
NDEQPI

SEQ ID NO: 69199 - protein, 6 aa, Mycobacterium avium
NDESTL

SEQ ID NO: 69200 - protein, 8 aa, Mycobacterium avium
NDEYAGPG

SEQ ID NO: 69201 - protein, 14 aa, Mycobacterium avium
NDFPETRLTPETDY

SEQ ID NO: 69202 - protein, 6 aa, Mycobacterium avium
NDGEAA

SEQ ID NO: 69203 - protein, 9 aa, Mycobacterium avium
NDGPLGHQT

SEQ ID NO: 69204 - protein, 15 aa, Mycobacterium avium
NDGSEAGSPMRGRSC

SEQ ID NO: 69205 - protein, 6 aa, Mycobacterium avium
NDHPTV

SEQ ID NO: 69206 - protein, 10 aa, Mycobacterium avium
NDLADHADAA

SEQ ID NO: 69207 - protein, 5 aa, Mycobacterium avium
NDLAV

SEQ ID NO: 69208 - protein, 4 aa, Mycobacterium avium
NDLD

SEQ ID NO: 69209 - protein, 12 aa, Mycobacterium avium
NDLRGGAADPAL

SEQ ID NO: 69210 - protein, 13 aa, Mycobacterium avium
NDPAGVRPTHDAA

SEQ ID NO: 69211 - protein, 17 aa, Mycobacterium avium
NDPAGVRPTHDAAKSLT

SEQ ID NO: 69212 - protein, 12 aa, Mycobacterium avium
NDPAGVRPTYDA

SEQ ID NO: 69213 - protein, 12 aa, Mycobacterium avium
NDPARVQDDEYV

SEQ ID NO: 69214 - protein, 4 aa, Mycobacterium avium
NDPD

SEQ ID NO: 69215 - protein, 13 aa, Mycobacterium avium
NDPDRRNAVTAEM

SEQ ID NO: 69216 - protein, 6 aa, Mycobacterium avium
NDPDRV

SEQ ID NO: 69217 - protein, 12 aa, Mycobacterium avium
NDPEKTASSRHP

SEQ ID NO: 69218 - protein, 6 aa, Mycobacterium avium
NDPPPC

SEQ ID NO: 69219 - protein, 5 aa, Mycobacterium avium
NDPVD

SEQ ID NO: 69220 - protein, 10 aa, Mycobacterium avium
NDQTTCASAG

SEQ ID NO: 69221 - protein, 6 aa, Mycobacterium avium
NDTGGG

SEQ ID NO: 69222 - protein, 9 aa, Mycobacterium avium
NDTSHGPAA

SEQ ID NO: 69223 - protein, 10 aa, Mycobacterium avium
NDTSRGPAAA

SEQ ID NO: 69224 - protein, 4 aa, Mycobacterium avium
NDVA

SEQ ID NO: 69225 - protein, 11 aa, Mycobacterium avium
NDVAVSPDTSW

SEQ ID NO: 69226 - protein, 5 aa, Mycobacterium avium
NEADK

SEQ ID NO: 69227 - protein, 5 aa, Mycobacterium avium
NEAEL

SEQ ID NO: 69228 - protein, 5 aa, Mycobacterium avium
NEAGD

SEQ ID NO: 69229 - protein, 9 aa, Mycobacterium avium
NEANDKDIE

SEQ ID NO: 69230 - protein, 10 aa, Mycobacterium avium
NEARRQRARE

SEQ ID NO: 69231 - protein, 21 aa, Mycobacterium avium
NEDASKDENPNVPYGAEETAR

SEQ ID NO: 69232 - protein, 18 aa, Mycobacterium avium
NEDVRDDGDQWPDEEHDR

SEQ ID NO: 69233 - protein, 8 aa, Mycobacterium avium
NEEETSEW

SEQ ID NO: 69234 - protein, 6 aa, Mycobacterium avium
NEEFGN

SEQ ID NO: 69235 - protein, 19 aa, Mycobacterium avium
NEGKGDDPEQTPIGTYPGN

SEQ ID NO: 69236 - protein, 4 aa, Mycobacterium avium
NEGR

SEQ ID NO: 69237 - protein, 18 aa, Mycobacterium avium
NEGRVQAAQRAKEQQQQK

SEQ ID NO: 69238 - protein, 6 aa, Mycobacterium avium
NEGVPA

SEQ ID NO: 69239 - protein, 9 aa, Mycobacterium avium
NEHETRNAQ

SEQ ID NO: 69240 - protein, 4 aa, Mycobacterium avium
NENS

SEQ ID NO: 69241 - protein, 4 aa, Mycobacterium avium
NEPD

SEQ ID NO: 69242 - protein, 10 aa, Mycobacterium avium
NEPDADRRTP

SEQ ID NO: 69243 - protein, 6 aa, Mycobacterium avium
NEPDDV

SEQ ID NO: 69244 - protein, 7 aa, Mycobacterium avium
NEPKLRP

SEQ ID NO: 69245 - protein, 5 aa, Mycobacterium avium
NEPSF

SEQ ID NO: 69246 - protein, 9 aa, Mycobacterium avium
NEQDESTRA

SEQ ID NO: 69247 - protein, 9 aa, Mycobacterium avium
NEQGDGGTA

SEQ ID NO: 69248 - protein, 11 aa, Mycobacterium avium
NERAGTDSSPI

SEQ ID NO: 69249 - protein, 5 aa, Mycobacterium avium
NERNE

SEQ ID NO: 69250 - protein, 8 aa, Mycobacterium avium
NESPMAAT

SEQ ID NO: 69251 - protein, 19 aa, Mycobacterium avium
NESTGAAQSATPAVTTEKD

SEQ ID NO: 69252 - protein, 5 aa, Mycobacterium avium
NETGM

SEQ ID NO: 69253 - protein, 5 aa, Mycobacterium avium
NETQA

SEQ ID NO: 69254 - protein, 15 aa, Mycobacterium avium
NEYPLATSRDLEEAG

SEQ ID NO: 69255 - protein, 6 aa, Mycobacterium avium
NFDNGA

SEQ ID NO: 69256 - protein, 13 aa, Mycobacterium avium
NFDNGAKNPNAWR

SEQ ID NO: 69257 - protein, 4 aa, Mycobacterium avium
NFEA

SEQ ID NO: 69258 - protein, 8 aa, Mycobacterium avium
NFGGGKTH

SEQ ID NO: 69259 - protein, 12 aa, Mycobacterium avium
NFGHTQSAAGTL

SEQ ID NO: 69260 - protein, 7 aa, Mycobacterium avium
NFTPEPA

SEQ ID NO: 69261 - protein, 8 aa, Mycobacterium avium
NGAAAPCG

SEQ ID NO: 69262 - protein, 7 aa, Mycobacterium avium
NGAAAQR

SEQ ID NO: 69263 - protein, 6 aa, Mycobacterium avium
NGAEGA

SEQ ID NO: 69264 - protein, 11 aa, Mycobacterium avium
NGANPIGDVDP

SEQ ID NO: 69265 - protein, 5 aa, Mycobacterium avium
NGAQR

SEQ ID NO: 69266 - protein, 4 aa, Mycobacterium avium
NGDK

SEQ ID NO: 69267 - protein, 8 aa, Mycobacterium avium
NGDPGAPK

SEQ ID NO: 69268 - protein, 19 aa, Mycobacterium avium
NGDPGNAGTSNLSAVTSRQ

SEQ ID NO: 69269 - protein, 7 aa, Mycobacterium avium
NGDVPAN

SEQ ID NO: 69270 - protein, 8 aa, Mycobacterium avium
NGFDSSAR

SEQ ID NO: 69271 - protein, 12 aa, Mycobacterium avium
NGFHEPDAARRA

SEQ ID NO: 69272 - protein, 8 aa, Mycobacterium avium
NGGAETGE

SEQ ID NO: 69273 - protein, 7 aa, Mycobacterium avium
NGGEPVD

SEQ ID NO: 69274 - protein, 5 aa, Mycobacterium avium
NGGSW

SEQ ID NO: 69275 - protein, 6 aa, Mycobacterium avium
NGIGDT

SEQ ID NO: 69276 - protein, 5 aa, Mycobacterium avium
NGIGS

SEQ ID NO: 69277 - protein, 13 aa, Mycobacterium avium
NGKGLPDDVSEAG

SEQ ID NO: 69278 - protein, 6 aa, Mycobacterium avium
NGKHSV

SEQ ID NO: 69279 - protein, 14 aa, Mycobacterium avium
NGKIDTRALPTPEY

SEQ ID NO: 69280 - protein, 6 aa, Mycobacterium avium
NGNGPR

SEQ ID NO: 69281 - protein, 12 aa, Mycobacterium avium
NGNGTELANGDS

SEQ ID NO: 69282 - protein, 16 aa, Mycobacterium avium
NGNTFGGPGGSRGVDD

SEQ ID NO: 69283 - protein, 4 aa, Mycobacterium avium
NGPE

SEQ ID NO: 69284 - protein, 6 aa, Mycobacterium avium
NGPLTE

SEQ ID NO: 69285 - protein, 15 aa, Mycobacterium avium
NGPQGANLPADDPSA

SEQ ID NO: 69286 - protein, 16 aa, Mycobacterium avium
NGPSLPAAGPDGRPTV

SEQ ID NO: 69287 - protein, 13 aa, Mycobacterium avium
NGPSVGESVAEGI

SEQ ID NO: 69288 - protein, 35 aa, Mycobacterium avium
NGPTGPDEQAGGNRDHARRSGRGDRRRRGALQPDP

SEQ ID NO: 69289 - protein, 6 aa, Mycobacterium avium
NGPVDE

SEQ ID NO: 69290 - protein, 5 aa, Mycobacterium avium
NGQSI

SEQ ID NO: 69291 - protein, 4 aa, Mycobacterium avium
NGRA

SEQ ID NO: 69292 - protein, 15 aa, Mycobacterium avium
NGRGIAAGNTRRSGL

SEQ ID NO: 69293 - protein, 6 aa, Mycobacterium avium
NGRKHP

SEQ ID NO: 69294 - protein, 8 aa, Mycobacterium avium
NGRQPQTP

SEQ ID NO: 69295 - protein, 5 aa, Mycobacterium avium
NGRSP

SEQ ID NO: 69296 - protein, 8 aa, Mycobacterium avium
NGRSSPYA

SEQ ID NO: 69297 - protein, 8 aa, Mycobacterium avium
NGSADNPA

SEQ ID NO: 69298 - protein, 10 aa, Mycobacterium avium
NGSGAAAANA

SEQ ID NO: 69299 - protein, 7 aa, Mycobacterium avium
NGSGPEL

SEQ ID NO: 69300 - protein, 5 aa, Mycobacterium avium
NGSPE

SEQ ID NO: 69301 - protein, 13 aa, Mycobacterium avium
NGSPRVDGPSVES

SEQ ID NO: 69302 - protein, 5 aa, Mycobacterium avium
NGSTQ

SEQ ID NO: 69303 - protein, 6 aa, Mycobacterium avium
NGTAYD

SEQ ID NO: 69304 - protein, 4 aa, Mycobacterium avium
NGTD

SEQ ID NO: 69305 - protein, 7 aa, Mycobacterium avium
NGTDGNI

SEQ ID NO: 69306 - protein, 7 aa, Mycobacterium avium
NGTDGNV

SEQ ID NO: 69307 - protein, 14 aa, Mycobacterium avium
NGTDPAAHLPASPG

SEQ ID NO: 69308 - protein, 8 aa, Mycobacterium avium
NGTETPWH

SEQ ID NO: 69309 - protein, 6 aa, Mycobacterium avium
NGTGEF

SEQ ID NO: 69310 - protein, 12 aa, Mycobacterium avium
NGTIPGDAPFGG

SEQ ID NO: 69311 - protein, 7 aa, Mycobacterium avium
NGTNPDS

SEQ ID NO: 69312 - protein, 10 aa, Mycobacterium avium
NGTRTDYPSL

SEQ ID NO: 69313 - protein, 8 aa, Mycobacterium avium
NGTSVDAG

SEQ ID NO: 69314 - protein, 8 aa, Mycobacterium avium
NGVGRQGE

SEQ ID NO: 69315 - protein, 14 aa, Mycobacterium avium
NGVIPRRDDTSHRA

SEQ ID NO: 69316 - protein, 5 aa, Mycobacterium avium
NGWTK

SEQ ID NO: 69317 - protein, 12 aa, Mycobacterium avium
NGYDETTTDQIA

SEQ ID NO: 69318 - protein, 10 aa, Mycobacterium avium
NGYDPSPDVR

SEQ ID NO: 69319 - protein, 20 aa, Mycobacterium avium
NHCATDADGPCEQVKSWLTV

SEQ ID NO: 69320 - protein, 11 aa, Mycobacterium avium
NHGGRQANGGL

SEQ ID NO: 69321 - protein, 5 aa, Mycobacterium avium
NHNGT

SEQ ID NO: 69322 - protein, 9 aa, Mycobacterium avium
NHPAHSPRT

SEQ ID NO: 69323 - protein, 8 aa, Mycobacterium avium
NHPSPRSK

SEQ ID NO: 69324 - protein, 16 aa, Mycobacterium avium
NHRGGTVLGPSAAPLG

SEQ ID NO: 69325 - protein, 10 aa, Mycobacterium avium
NHRGHGTELA

SEQ ID NO: 69326 - protein, 6 aa, Mycobacterium avium
NHRKGD

SEQ ID NO: 69327 - protein, 10 aa, Mycobacterium avium
NHSPDDIEST

SEQ ID NO: 69328 - protein, 15 aa, Mycobacterium avium
NHVGGQATTGHTHSA

SEQ ID NO: 69329 - protein, 7 aa, Mycobacterium avium
NIATNAG

SEQ ID NO: 69330 - protein, 13 aa, Mycobacterium avium
NIGDKSQSFSASN

SEQ ID NO: 69331 - protein, 6 aa, Mycobacterium avium
NIGPHA

SEQ ID NO: 69332 - protein, 7 aa, Mycobacterium avium
NIPDTPP

SEQ ID NO: 69333 - protein, 4 aa, Mycobacterium avium
NITA

SEQ ID NO: 69334 - protein, 5 aa, Mycobacterium avium
NITAG

SEQ ID NO: 69335 - protein, 5 aa, Mycobacterium avium
NITSG

SEQ ID NO: 69336 - protein, 7 aa, Mycobacterium avium
NIYSPEV

SEQ ID NO: 69337 - protein, 21 aa, Mycobacterium avium
NKAADHDMENAAGIDNQGEPI

SEQ ID NO: 69338 - protein, 26 aa, Mycobacterium avium
NKATEGLDEETKRKVLSTNAKNFFGM

SEQ ID NO: 69339 - protein, 7 aa, Mycobacterium avium
NKDRARD

SEQ ID NO: 69340 - protein, 19 aa, Mycobacterium avium
NKGKGDDPEQTPIGTYPGN

SEQ ID NO: 69341 - protein, 19 aa, Mycobacterium avium
NKGKGNDPEQTPIGTYPGN

SEQ ID NO: 69342 - protein, 4 aa, Mycobacterium avium
NKGR

SEQ ID NO: 69343 - protein, 15 aa, Mycobacterium avium
NKIGQWDSPDGSTTH

SEQ ID NO: 69344 - protein, 14 aa, Mycobacterium avium
NKPAEPRPRDDAGI

SEQ ID NO: 69345 - protein, 12 aa, Mycobacterium avium
NKPHGERPSAVY

SEQ ID NO: 69346 - protein, 10 aa, Mycobacterium avium
NKRGQDIGPT

SEQ ID NO: 69347 - protein, 22 aa, Mycobacterium avium
NKTPAGYRRASANESEPSPGDV

SEQ ID NO: 69348 - protein, 7 aa, Mycobacterium avium
NKTPPLR

SEQ ID NO: 69349 - protein, 6 aa, Mycobacterium avium
NKVPNA

SEQ ID NO: 69350 - protein, 8 aa, Mycobacterium avium
NLAGSPEI

SEQ ID NO: 69351 - protein, 12 aa, Mycobacterium avium
NLDEGEPYGLPG

SEQ ID NO: 69352 - protein, 7 aa, Mycobacterium avium
NLGAQAQ

SEQ ID NO: 69353 - protein, 9 aa, Mycobacterium avium
NLGATRPFG

SEQ ID NO: 69354 - protein, 13 aa, Mycobacterium avium
NLNPAQAHGSGDV

SEQ ID NO: 69355 - protein, 7 aa, Mycobacterium avium
NLPDTPP

SEQ ID NO: 69356 - protein, 8 aa, Mycobacterium avium
NLPKSGGA

SEQ ID NO: 69357 - protein, 7 aa, Mycobacterium avium
NLRDPRQ

SEQ ID NO: 69358 - protein, 10 aa, Mycobacterium avium
NLSEAERAGL

SEQ ID NO: 69359 - protein, 8 aa, Mycobacterium avium
NLSFPDES

SEQ ID NO: 69360 - protein, 49 aa, Mycobacterium avium
NLSGTVSAGSARAGRPAATRAPGGPAAADIQPALSPARQWAGRQGSAGD

SEQ ID NO: 69361 - protein, 6 aa, Mycobacterium avium
NLSTTA

SEQ ID NO: 69362 - protein, 12 aa, Mycobacterium avium
NLTDGSDELSRT

SEQ ID NO: 69363 - protein, 9 aa, Mycobacterium avium
NLTEGGAAM

SEQ ID NO: 69364 - protein, 6 aa, Mycobacterium avium
NLTPGY

SEQ ID NO: 69365 - protein, 10 aa, Mycobacterium avium
NMQPNPDEPV

SEQ ID NO: 69366 - protein, 8 aa, Mycobacterium avium
NNADRTLA

SEQ ID NO: 69367 - protein, 22 aa, Mycobacterium avium
NNAKSERKPRVGSTQRRLPNKA

SEQ ID NO: 69368 - protein, 8 aa, Mycobacterium avium
NNDGPALR

SEQ ID NO: 69369 - protein, 6 aa, Mycobacterium avium
NNEAAR

SEQ ID NO: 69370 - protein, 4 aa, Mycobacterium avium
NNEI

SEQ ID NO: 69371 - protein, 13 aa, Mycobacterium avium
NNEVSADEQTRLR

SEQ ID NO: 69372 - protein, 11 aa, Mycobacterium avium
NNGKSATAISI

SEQ ID NO: 69373 - protein, 6 aa, Mycobacterium avium
NNGTLP

SEQ ID NO: 69374 - protein, 10 aa, Mycobacterium avium
NNNWNSEQDA

SEQ ID NO: 69375 - protein, 6 aa, Mycobacterium avium
NNPEGL

SEQ ID NO: 69376 - protein, 6 aa, Mycobacterium avium
NNPIRV

SEQ ID NO: 69377 - protein, 9 aa, Mycobacterium avium
NNSAVGASY

SEQ ID NO: 69378 - protein, 10 aa, Mycobacterium avium
NNSGPGAEAV

SEQ ID NO: 69379 - protein, 7 aa, Mycobacterium avium
NNSGVRD

SEQ ID NO: 69380 - protein, 14 aa, Mycobacterium avium
NNSPAPQSDSSTDA

SEQ ID NO: 69381 - protein, 7 aa, Mycobacterium avium
NNSTYGL

SEQ ID NO: 69382 - protein, 15 aa, Mycobacterium avium
NPAAPPAHVPLLRDA

SEQ ID NO: 69383 - protein, 12 aa, Mycobacterium avium
NPAGGQDGTEDD

SEQ ID NO: 69384 - protein, 9 aa, Mycobacterium avium
NPAGPRSVY

SEQ ID NO: 69385 - protein, 5 aa, Mycobacterium avium
NPAIQ

SEQ ID NO: 69386 - protein, 10 aa, Mycobacterium avium
NPANEASYLT

SEQ ID NO: 69387 - protein, 11 aa, Mycobacterium avium
NPATGEAARKL

SEQ ID NO: 69388 - protein, 7 aa, Mycobacterium avium
NPATITG

SEQ ID NO: 69389 - protein, 13 aa, Mycobacterium avium
NPCSRRTAPPMGK

SEQ ID NO: 69390 - protein, 33 aa, Mycobacterium avium
NPDDDAPVVDGPPPEAAAQRDSRSAAQRNHDGL

SEQ ID NO: 69391 - protein, 6 aa, Mycobacterium avium
NPDGSD

SEQ ID NO: 69392 - protein, 8 aa, Mycobacterium avium
NPDGSDGW

SEQ ID NO: 69393 - protein, 6 aa, Mycobacterium avium
NPDLAD

SEQ ID NO: 69394 - protein, 52 aa, Mycobacterium avium
NPDVQPRPTVDDPVRPQSNNAFGEERGVAPMTDNSSYRGAQGPGRPGDEYYD

SEQ ID NO: 69395 - protein, 154 aa, Mycobacterium avium
NPDVQPRPTVDDPVRPQSNNAFGEERGVAPMTDNSSYRGAQGPGRPGDEYYDERYGRPQDDARGGSEPQGAPDQRGGYPPEQGGYPPQQGYPPPRHPEQGGYPEQGGYPPPQSYQEHGGYPDQRGGYPEPGQAGYPPQQHGYPDQRGYPEPAQG

SEQ ID NO: 69396 - protein, 9 aa, Mycobacterium avium
NPEEPGATD

SEQ ID NO: 69397 - protein, 14 aa, Mycobacterium avium
NPESFDADRNPRGH

SEQ ID NO: 69398 - protein, 5 aa, Mycobacterium avium
NPEVP

SEQ ID NO: 69399 - protein, 13 aa, Mycobacterium avium
NPFEADTVSGPVV

SEQ ID NO: 69400 - protein, 4 aa, Mycobacterium avium
NPFT

SEQ ID NO: 69401 - protein, 9 aa, Mycobacterium avium
NPFTGAPAV

SEQ ID NO: 69402 - protein, 8 aa, Mycobacterium avium
NPGAGPHL

SEQ ID NO: 69403 - protein, 10 aa, Mycobacterium avium
NPGGASRTAA

SEQ ID NO: 69404 - protein, 8 aa, Mycobacterium avium
NPGKGGTI

SEQ ID NO: 69405 - protein, 4 aa, Mycobacterium avium
NPGM

SEQ ID NO: 69406 - protein, 6 aa, Mycobacterium avium
NPGTSE

SEQ ID NO: 69407 - protein, 11 aa, Mycobacterium avium
NPHRPRPTDLE

SEQ ID NO: 69408 - protein, 5 aa, Mycobacterium avium
NPIEY

SEQ ID NO: 69409 - protein, 7 aa, Mycobacterium avium
NPITPQE

SEQ ID NO: 69410 - protein, 9 aa, Mycobacterium avium
NPKGSGYEY

SEQ ID NO: 69411 - protein, 9 aa, Mycobacterium avium
NPNPPHPQH

SEQ ID NO: 69412 - protein, 7 aa, Mycobacterium avium
NPPDTTA

SEQ ID NO: 69413 - protein, 9 aa, Mycobacterium avium
NPPGSTARG

SEQ ID NO: 69414 - protein, 20 aa, Mycobacterium avium
NPPLAPPPSPGAPASAPPVM

SEQ ID NO: 69415 - protein, 9 aa, Mycobacterium avium
NPPNAYYSS

SEQ ID NO: 69416 - protein, 6 aa, Mycobacterium avium
NPPPLD

SEQ ID NO: 69417 - protein, 5 aa, Mycobacterium avium
NPPPQ

SEQ ID NO: 69418 - protein, 6 aa, Mycobacterium avium
NPPVTV

SEQ ID NO: 69419 - protein, 6 aa, Mycobacterium avium
NPPYQL

SEQ ID NO: 69420 - protein, 7 aa, Mycobacterium avium
NPQARTY

SEQ ID NO: 69421 - protein, 8 aa, Mycobacterium avium
NPQCPASR

SEQ ID NO: 69422 - protein, 5 aa, Mycobacterium avium
NPQEF

SEQ ID NO: 69423 - protein, 4 aa, Mycobacterium avium
NPQG

SEQ ID NO: 69424 - protein, 8 aa, Mycobacterium avium
NPQQRRTN

SEQ ID NO: 69425 - protein, 5 aa, Mycobacterium avium
NPREA

SEQ ID NO: 69426 - protein, 6 aa, Mycobacterium avium
NPRRLA

SEQ ID NO: 69427 - protein, 5 aa, Mycobacterium avium
NPRRV

SEQ ID NO: 69428 - protein, 9 aa, Mycobacterium avium
NPRSDPVAA

SEQ ID NO: 69429 - protein, 17 aa, Mycobacterium avium
NPRSETIRADSRALEGF

SEQ ID NO: 69430 - protein, 13 aa, Mycobacterium avium
NPRTTALSQRSRP

SEQ ID NO: 69431 - protein, 12 aa, Mycobacterium avium
NPSDPPRDADQL

SEQ ID NO: 69432 - protein, 6 aa, Mycobacterium avium
NPSEGE

SEQ ID NO: 69433 - protein, 10 aa, Mycobacterium avium
NPSRLSDDQL

SEQ ID NO: 69434 - protein, 8 aa, Mycobacterium avium
NPSSPVSL

SEQ ID NO: 69435 - protein, 11 aa, Mycobacterium avium
NPSTAYVAGPQ

SEQ ID NO: 69436 - protein, 4 aa, Mycobacterium avium
NPTL

SEQ ID NO: 69437 - protein, 5 aa, Mycobacterium avium
NPTSI

SEQ ID NO: 69438 - protein, 12 aa, Mycobacterium avium
NPTSRAEAHPAE

SEQ ID NO: 69439 - protein, 9 aa, Mycobacterium avium
NPVGPRSVY

SEQ ID NO: 69440 - protein, 12 aa, Mycobacterium avium
NPVPPDGRSDIR

SEQ ID NO: 69441 - protein, 11 aa, Mycobacterium avium
NPVRRTRGDVE

SEQ ID NO: 69442 - protein, 9 aa, Mycobacterium avium
NPVTGDAQR

SEQ ID NO: 69443 - protein, 19 aa, Mycobacterium avium
NPWDTDYTAGASSSGSGAF

SEQ ID NO: 69444 - protein, 15 aa, Mycobacterium avium
NPWRGPPVPYDTPVT

SEQ ID NO: 69445 - protein, 16 aa, Mycobacterium avium
NPYNPGAGWTPSPPPL

SEQ ID NO: 69446 - protein, 12 aa, Mycobacterium avium
NPYPQTAPPQRP

SEQ ID NO: 69447 - protein, 7 aa, Mycobacterium avium
NQAPDRE

SEQ ID NO: 69448 - protein, 21 aa, Mycobacterium avium
NQATDSTSPAGGSSAPDVPPF

SEQ ID NO: 69449 - protein, 9 aa, Mycobacterium avium
NQEDPGQLL

SEQ ID NO: 69450 - protein, 5 aa, Mycobacterium avium
NQEGR

SEQ ID NO: 69451 - protein, 7 aa, Mycobacterium avium
NQGHTAD

SEQ ID NO: 69452 - protein, 6 aa, Mycobacterium avium
NQIEHQ

SEQ ID NO: 69453 - protein, 6 aa, Mycobacterium avium
NQIPSA

SEQ ID NO: 69454 - protein, 4 aa, Mycobacterium avium
NQLR

SEQ ID NO: 69455 - protein, 7 aa, Mycobacterium avium
NQPAANV

SEQ ID NO: 69456 - protein, 5 aa, Mycobacterium avium
NQPNR

SEQ ID NO: 69457 - protein, 13 aa, Mycobacterium avium
NQPPAAQGLPPGS

SEQ ID NO: 69458 - protein, 6 aa, Mycobacterium avium
NQQLTS

SEQ ID NO: 69459 - protein, 12 aa, Mycobacterium avium
NQRDESTTKGTA

SEQ ID NO: 69460 - protein, 11 aa, Mycobacterium avium
NQRTDADRYTT

SEQ ID NO: 69461 - protein, 4 aa, Mycobacterium avium
NQSN

SEQ ID NO: 69462 - protein, 8 aa, Mycobacterium avium
NQSNYAAA

SEQ ID NO: 69463 - protein, 12 aa, Mycobacterium avium
NQTASANQWSTT

SEQ ID NO: 69464 - protein, 7 aa, Mycobacterium avium
NRAAREQ

SEQ ID NO: 69465 - protein, 7 aa, Mycobacterium avium
NRADPLA

SEQ ID NO: 69466 - protein, 21 aa, Mycobacterium avium
NRAESAGLGAPGDGGTITGGL

SEQ ID NO: 69467 - protein, 8 aa, Mycobacterium avium
NRAGRDKA

SEQ ID NO: 69468 - protein, 7 aa, Mycobacterium avium
NRAGRRR

SEQ ID NO: 69469 - protein, 7 aa, Mycobacterium avium
NRAVPAG

SEQ ID NO: 69470 - protein, 4 aa, Mycobacterium avium
NRCT

SEQ ID NO: 69471 - protein, 11 aa, Mycobacterium avium
NRDDSDEISTN

SEQ ID NO: 69472 - protein, 29 aa, Mycobacterium avium
NRDDYADHRQDHQNTDDRARAELAAMGID

SEQ ID NO: 69473 - protein, 10 aa, Mycobacterium avium
NRDERQFPNP

SEQ ID NO: 69474 - protein, 11 aa, Mycobacterium avium
NRDHRRFPPDG

SEQ ID NO: 69475 - protein, 5 aa, Mycobacterium avium
NRDPA

SEQ ID NO: 69476 - protein, 16 aa, Mycobacterium avium
NRDPAEFDRPDTFDPD

SEQ ID NO: 69477 - protein, 18 aa, Mycobacterium avium
NRDPAEFDRPDTFDPDRK

SEQ ID NO: 69478 - protein, 19 aa, Mycobacterium avium
NRDPAEFDRPDTFDPDRKG

SEQ ID NO: 69479 - protein, 4 aa, Mycobacterium avium
NRDV

SEQ ID NO: 69480 - protein, 4 aa, Mycobacterium avium
NREN

SEQ ID NO: 69481 - protein, 15 aa, Mycobacterium avium
NRESAREKSIRHGHP

SEQ ID NO: 69482 - protein, 6 aa, Mycobacterium avium
NRGANF

SEQ ID NO: 69483 - protein, 7 aa, Mycobacterium avium
NRGKKSI

SEQ ID NO: 69484 - protein, 9 aa, Mycobacterium avium
NRGTARSDD

SEQ ID NO: 69485 - protein, 18 aa, Mycobacterium avium
NRKYGRTSEIMKEIISRS

SEQ ID NO: 69486 - protein, 9 aa, Mycobacterium avium
NRLSTGDID

SEQ ID NO: 69487 - protein, 8 aa, Mycobacterium avium
NRNDAPPV

SEQ ID NO: 69488 - protein, 13 aa, Mycobacterium avium
NRNRGPGASPQGV

SEQ ID NO: 69489 - protein, 9 aa, Mycobacterium avium
NRPDSPRPR

SEQ ID NO: 69490 - protein, 8 aa, Mycobacterium avium
NRPDSPRV

SEQ ID NO: 69491 - protein, 7 aa, Mycobacterium avium
NRPGFDG

SEQ ID NO: 69492 - protein, 9 aa, Mycobacterium avium
NRPGRPDEI

SEQ ID NO: 69493 - protein, 8 aa, Mycobacterium avium
NRPNIPAV

SEQ ID NO: 69494 - protein, 4 aa, Mycobacterium avium
NRPP

SEQ ID NO: 69495 - protein, 6 aa, Mycobacterium avium
NRPQRE

SEQ ID NO: 69496 - protein, 10 aa, Mycobacterium avium
NRPQTSNGLN

SEQ ID NO: 69497 - protein, 16 aa, Mycobacterium avium
NRPRSFAGAADAVTNR

SEQ ID NO: 69498 - protein, 14 aa, Mycobacterium avium
NRQDTVPADGTNPE

SEQ ID NO: 69499 - protein, 6 aa, Mycobacterium avium
NRRARQ

SEQ ID NO: 69500 - protein, 11 aa, Mycobacterium avium
NRRDDDARQWA

SEQ ID NO: 69501 - protein, 11 aa, Mycobacterium avium
NRRETPPTTSD

SEQ ID NO: 69502 - protein, 14 aa, Mycobacterium avium
NRRPTLENGATRAY

SEQ ID NO: 69503 - protein, 5 aa, Mycobacterium avium
NRRRA

SEQ ID NO: 69504 - protein, 19 aa, Mycobacterium avium
NRSISGPNAVSGYAPRTAP

SEQ ID NO: 69505 - protein, 22 aa, Mycobacterium avium
NRSLQPTEGTRAAQAVSRSAKT

SEQ ID NO: 69506 - protein, 22 aa, Mycobacterium avium
NRSLQPTKGTRAEQAVRRSAKT

SEQ ID NO: 69507 - protein, 4 aa, Mycobacterium avium
NRSR

SEQ ID NO: 69508 - protein, 4 aa, Mycobacterium avium
NRYV

SEQ ID NO: 69509 - protein, 10 aa, Mycobacterium avium
NSAGRSFDSN

SEQ ID NO: 69510 - protein, 11 aa, Mycobacterium avium
NSATTMPTVPR

SEQ ID NO: 69511 - protein, 12 aa, Mycobacterium avium
NSATTMPTVPRR

SEQ ID NO: 69512 - protein, 10 aa, Mycobacterium avium
NSDEENLTPQ

SEQ ID NO: 69513 - protein, 6 aa, Mycobacterium avium
NSDGSV

SEQ ID NO: 69514 - protein, 6 aa, Mycobacterium avium
NSDLRQ

SEQ ID NO: 69515 - protein, 8 aa, Mycobacterium avium
NSDSGYER

SEQ ID NO: 69516 - protein, 8 aa, Mycobacterium avium
NSDYPEAG

SEQ ID NO: 69517 - protein, 6 aa, Mycobacterium avium
NSEARP

SEQ ID NO: 69518 - protein, 10 aa, Mycobacterium avium
NSEIDDARAY

SEQ ID NO: 69519 - protein, 8 aa, Mycobacterium avium
NSELRDTN

SEQ ID NO: 69520 - protein, 10 aa, Mycobacterium avium
NSEPTAPTEC

SEQ ID NO: 69521 - protein, 10 aa, Mycobacterium avium
NSGINPDDLA

SEQ ID NO: 69522 - protein, 14 aa, Mycobacterium avium
NSGRMHSGPGAGSL

SEQ ID NO: 69523 - protein, 5 aa, Mycobacterium avium
NSIAP

SEQ ID NO: 69524 - protein, 8 aa, Mycobacterium avium
NSKPAVRR

SEQ ID NO: 69525 - protein, 4 aa, Mycobacterium avium
NSPD

SEQ ID NO: 69526 - protein, 9 aa, Mycobacterium avium
NSPGSPGPL

SEQ ID NO: 69527 - protein, 9 aa, Mycobacterium avium
NSPSAQAVA

SEQ ID NO: 69528 - protein, 8 aa, Mycobacterium avium
NSRRPGQH

SEQ ID NO: 69529 - protein, 7 aa, Mycobacterium avium
NSRTRAV

SEQ ID NO: 69530 - protein, 17 aa, Mycobacterium avium
NSSGGDYKKNDGSADWM

SEQ ID NO: 69531 - protein, 16 aa, Mycobacterium avium
NSSGYAQLNPSGTANF

SEQ ID NO: 69532 - protein, 5 aa, Mycobacterium avium
NSTVP

SEQ ID NO: 69533 - protein, 9 aa, Mycobacterium avium
NSVDETVDA

SEQ ID NO: 69534 - protein, 5 aa, Mycobacterium avium
NSWER

SEQ ID NO: 69535 - protein, 6 aa, Mycobacterium avium
NSYGGS

SEQ ID NO: 69536 - protein, 25 aa, Mycobacterium avium
NTAKDGNGVPIGTPYNTREFQLNPF

SEQ ID NO: 69537 - protein, 10 aa, Mycobacterium avium
NTASGAALKA

SEQ ID NO: 69538 - protein, 5 aa, Mycobacterium avium
NTDDP

SEQ ID NO: 69539 - protein, 6 aa, Mycobacterium avium
NTDGTL

SEQ ID NO: 69540 - protein, 7 aa, Mycobacterium avium
NTDPESF

SEQ ID NO: 69541 - protein, 14 aa, Mycobacterium avium
NTFGRTGGAGGVDQ

SEQ ID NO: 69542 - protein, 17 aa, Mycobacterium avium
NTGAAVDGTSDKDSTIA

SEQ ID NO: 69543 - protein, 16 aa, Mycobacterium avium
NTGASGDALNAAGEKW

SEQ ID NO: 69544 - protein, 9 aa, Mycobacterium avium
NTGAVARDD

SEQ ID NO: 69545 - protein, 4 aa, Mycobacterium avium
NTGG

SEQ ID NO: 69546 - protein, 5 aa, Mycobacterium avium
NTGGE

SEQ ID NO: 69547 - protein, 25 aa, Mycobacterium avium
NTGKDGNNVPIGTPYDTREFQVNPF

SEQ ID NO: 69548 - protein, 10 aa, Mycobacterium avium
NTIDATGVGT

SEQ ID NO: 69549 - protein, 12 aa, Mycobacterium avium
NTNTETLAVGGA

SEQ ID NO: 69550 - protein, 13 aa, Mycobacterium avium
NTPQAVQPGDEYP

SEQ ID NO: 69551 - protein, 14 aa, Mycobacterium avium
NTPRPSAAQTRHPL

SEQ ID NO: 69552 - protein, 15 aa, Mycobacterium avium
NTPTTVARNDNDHTP

SEQ ID NO: 69553 - protein, 14 aa, Mycobacterium avium
NTQWPSNGHHPRRA

SEQ ID NO: 69554 - protein, 7 aa, Mycobacterium avium
NTRENYQ

SEQ ID NO: 69555 - protein, 5 aa, Mycobacterium avium
NTRGI

SEQ ID NO: 69556 - protein, 10 aa, Mycobacterium avium
NTRLPEGHPV

SEQ ID NO: 69557 - protein, 8 aa, Mycobacterium avium
NTSDAQAL

SEQ ID NO: 69558 - protein, 13 aa, Mycobacterium avium
NTSGEGIDVSLRD

SEQ ID NO: 69559 - protein, 10 aa, Mycobacterium avium
NTSNRNGDLT

SEQ ID NO: 69560 - protein, 5 aa, Mycobacterium avium
NTTDS

SEQ ID NO: 69561 - protein, 9 aa, Mycobacterium avium
NTTGGGQFS

SEQ ID NO: 69562 - protein, 10 aa, Mycobacterium avium
NTTNDPQRTK

SEQ ID NO: 69563 - protein, 4 aa, Mycobacterium avium
NVAG

SEQ ID NO: 69564 - protein, 12 aa, Mycobacterium avium
NVEGGNKQLEQL

SEQ ID NO: 69565 - protein, 6 aa, Mycobacterium avium
NVGGSS

SEQ ID NO: 69566 - protein, 6 aa, Mycobacterium avium
NVGPNQ

SEQ ID NO: 69567 - protein, 12 aa, Mycobacterium avium
NVGRTSAEATEQ

SEQ ID NO: 69568 - protein, 5 aa, Mycobacterium avium
NVGSD

SEQ ID NO: 69569 - protein, 7 aa, Mycobacterium avium
NVNGSGI

SEQ ID NO: 69570 - protein, 8 aa, Mycobacterium avium
NVPDVSDA

SEQ ID NO: 69571 - protein, 8 aa, Mycobacterium avium
NVPDVSNA

SEQ ID NO: 69572 - protein, 15 aa, Mycobacterium avium
NVPESPSQDQRRHNQ

SEQ ID NO: 69573 - protein, 9 aa, Mycobacterium avium
NVPGPRQPG

SEQ ID NO: 69574 - protein, 5 aa, Mycobacterium avium
NVPHP

SEQ ID NO: 69575 - protein, 7 aa, Mycobacterium avium
NVREAEQ

SEQ ID NO: 69576 - protein, 7 aa, Mycobacterium avium
NVRPGDT

SEQ ID NO: 69577 - protein, 7 aa, Mycobacterium avium
NVTSEDS

SEQ ID NO: 69578 - protein, 5 aa, Mycobacterium avium
NVVAT

SEQ ID NO: 69579 - protein, 6 aa, Mycobacterium avium
NVYSPE

SEQ ID NO: 69580 - protein, 9 aa, Mycobacterium avium
NWGTGTPRR

SEQ ID NO: 69581 - protein, 7 aa, Mycobacterium avium
NWTGQKE

SEQ ID NO: 69582 - protein, 7 aa, Mycobacterium avium
NYADDEK

SEQ ID NO: 69583 - protein, 10 aa, Mycobacterium avium
NYDAKLKGGP

SEQ ID NO: 69584 - protein, 13 aa, Mycobacterium avium
NYGPTPTADDVEA

SEQ ID NO: 69585 - protein, 25 aa, Mycobacterium avium
NYPEDGGPGAGCPPEHGISDAPDIN

SEQ ID NO: 69586 - protein, 14 aa, Mycobacterium avium
NYQATKDLPAATGD

SEQ ID NO: 69587 - protein, 12 aa, Mycobacterium avium
NYQDPSWLTKLT

SEQ ID NO: 69588 - protein, 22 aa, Mycobacterium avium
PAAAATPDKPLTPSAIDATQSY

SEQ ID NO: 69589 - protein, 5 aa, Mycobacterium avium
PAAAD

SEQ ID NO: 69590 - protein, 10 aa, Mycobacterium avium
PAAADSTDDE

SEQ ID NO: 69591 - protein, 8 aa, Mycobacterium avium
PAAAEGSV

SEQ ID NO: 69592 - protein, 9 aa, Mycobacterium avium
PAAAEGSVT

SEQ ID NO: 69593 - protein, 22 aa, Mycobacterium avium
PAAALDGRGSFQDTSGANGSLD

SEQ ID NO: 69594 - protein, 16 aa, Mycobacterium avium
PAAAPAPMPPAPADYT

SEQ ID NO: 69595 - protein, 5 aa, Mycobacterium avium
PAAAQ

SEQ ID NO: 69596 - protein, 12 aa, Mycobacterium avium
PAAASVSANPNH

SEQ ID NO: 69597 - protein, 10 aa, Mycobacterium avium
PAAATHAAQT

SEQ ID NO: 69598 - protein, 5 aa, Mycobacterium avium
PAADE

SEQ ID NO: 69599 - protein, 10 aa, Mycobacterium avium
PAADPDRYAG

SEQ ID NO: 69600 - protein, 4 aa, Mycobacterium avium
PAAE

SEQ ID NO: 69601 - protein, 6 aa, Mycobacterium avium
PAAERA

SEQ ID NO: 69602 - protein, 18 aa, Mycobacterium avium
PAAERLEAAGAAGEGAAA

SEQ ID NO: 69603 - protein, 11 aa, Mycobacterium avium
PAAGDPEVPPV

SEQ ID NO: 69604 - protein, 7 aa, Mycobacterium avium
PAAGESA

SEQ ID NO: 69605 - protein, 12 aa, Mycobacterium avium
PAAGMASTARWL

SEQ ID NO: 69606 - protein, 17 aa, Mycobacterium avium
PAAGQLGPVPGVGRGGH

SEQ ID NO: 69607 - protein, 6 aa, Mycobacterium avium
PAAGTS

SEQ ID NO: 69608 - protein, 8 aa, Mycobacterium avium
PAAHPGLR

SEQ ID NO: 69609 - protein, 5 aa, Mycobacterium avium
PAAIG

SEQ ID NO: 69610 - protein, 8 aa, Mycobacterium avium
PAAKAALP

SEQ ID NO: 69611 - protein, 9 aa, Mycobacterium avium
PAANLASKG

SEQ ID NO: 69612 - protein, 7 aa, Mycobacterium avium
PAAPDAT

SEQ ID NO: 69613 - protein, 6 aa, Mycobacterium avium
PAAPKH

SEQ ID NO: 69614 - protein, 7 aa, Mycobacterium avium
PAAPPLQ

SEQ ID NO: 69615 - protein, 9 aa, Mycobacterium avium
PAARMGKPH

SEQ ID NO: 69616 - protein, 22 aa, Mycobacterium avium
PAARSSQSQDSATTHIGFRCIA

SEQ ID NO: 69617 - protein, 16 aa, Mycobacterium avium
PAASHREYSANQHAYT

SEQ ID NO: 69618 - protein, 14 aa, Mycobacterium avium
PAATRNREDSISAK

SEQ ID NO: 69619 - protein, 7 aa, Mycobacterium avium
PAATTTL

SEQ ID NO: 69620 - protein, 8 aa, Mycobacterium avium
PACGSGNA

SEQ ID NO: 69621 - protein, 6 aa, Mycobacterium avium
PACSPT

SEQ ID NO: 69622 - protein, 4 aa, Mycobacterium avium
PADD

SEQ ID NO: 69623 - protein, 5 aa, Mycobacterium avium
PADGD

SEQ ID NO: 69624 - protein, 6 aa, Mycobacterium avium
PADGYQ

SEQ ID NO: 69625 - protein, 7 aa, Mycobacterium avium
PADPGVA

SEQ ID NO: 69626 - protein, 4 aa, Mycobacterium avium
PADR

SEQ ID NO: 69627 - protein, 5 aa, Mycobacterium avium
PADRD

SEQ ID NO: 69628 - protein, 10 aa, Mycobacterium avium
PADRGTGLGK

SEQ ID NO: 69629 - protein, 6 aa, Mycobacterium avium
PADRVT

SEQ ID NO: 69630 - protein, 5 aa, Mycobacterium avium
PADTD

SEQ ID NO: 69631 - protein, 6 aa, Mycobacterium avium
PADTPV

SEQ ID NO: 69632 - protein, 4 aa, Mycobacterium avium
PADV

SEQ ID NO: 69633 - protein, 8 aa, Mycobacterium avium
PADVSGEK

SEQ ID NO: 69634 - protein, 9 aa, Mycobacterium avium
PAEAADLEQ

SEQ ID NO: 69635 - protein, 5 aa, Mycobacterium avium
PAEAT

SEQ ID NO: 69636 - protein, 15 aa, Mycobacterium avium
PAEDPVDTGKAAGAA

SEQ ID NO: 69637 - protein, 15 aa, Mycobacterium avium
PAEDPVDTGKAANAA

SEQ ID NO: 69638 - protein, 15 aa, Mycobacterium avium
PAEDPVDTGKAASAA

SEQ ID NO: 69639 - protein, 4 aa, Mycobacterium avium
PAEG

SEQ ID NO: 69640 - protein, 10 aa, Mycobacterium avium
PAEGAGTETV

SEQ ID NO: 69641 - protein, 6 aa, Mycobacterium avium
PAEGTE

SEQ ID NO: 69642 - protein, 7 aa, Mycobacterium avium
PAEIATN

SEQ ID NO: 69643 - protein, 10 aa, Mycobacterium avium
PAEPADDYPR

SEQ ID NO: 69644 - protein, 5 aa, Mycobacterium avium
PAEPD

SEQ ID NO: 69645 - protein, 7 aa, Mycobacterium avium
PAEPDDP

SEQ ID NO: 69646 - protein, 6 aa, Mycobacterium avium
PAEPDR

SEQ ID NO: 69647 - protein, 10 aa, Mycobacterium avium
PAEPGKQPPG

SEQ ID NO: 69648 - protein, 7 aa, Mycobacterium avium
PAEPTPL

SEQ ID NO: 69649 - protein, 8 aa, Mycobacterium avium
PAEPTPLT

SEQ ID NO: 69650 - protein, 8 aa, Mycobacterium avium
PAEPTPVT

SEQ ID NO: 69651 - protein, 7 aa, Mycobacterium avium
PAERERV

SEQ ID NO: 69652 - protein, 9 aa, Mycobacterium avium
PAERSEIPS

SEQ ID NO: 69653 - protein, 8 aa, Mycobacterium avium
PAETADAL

SEQ ID NO: 69654 - protein, 9 aa, Mycobacterium avium
PAETVAAGR

SEQ ID NO: 69655 - protein, 12 aa, Mycobacterium avium
PAEVASERQRAG

SEQ ID NO: 69656 - protein, 8 aa, Mycobacterium avium
PAEVATNR

SEQ ID NO: 69657 - protein, 7 aa, Mycobacterium avium
PAFGPDE

SEQ ID NO: 69658 - protein, 4 aa, Mycobacterium avium
PAFR

SEQ ID NO: 69659 - protein, 12 aa, Mycobacterium avium
PAFTDGAPIPPR

SEQ ID NO: 69660 - protein, 6 aa, Mycobacterium avium
PAGAGA

SEQ ID NO: 69661 - protein, 100 aa, Mycobacterium avium
PAGAGGRVGAARKPQGPRRSAERATGKPDQKSETATRRSGTRRRRTRGGQPVSGHPSGNGAASSNGEAAADAPAGSPPGNPGSSRRRRRRRKPADATAQS

SEQ ID NO: 69662 - protein, 19 aa, Mycobacterium avium
PAGARQRARHANDPRANTK

SEQ ID NO: 69663 - protein, 19 aa, Mycobacterium avium
PAGARQRTRHANDPRANTK

SEQ ID NO: 69664 - protein, 5 aa, Mycobacterium avium
PAGAT

SEQ ID NO: 69665 - protein, 8 aa, Mycobacterium avium
PAGDAPVT

SEQ ID NO: 69666 - protein, 9 aa, Mycobacterium avium
PAGDAPVTA

SEQ ID NO: 69667 - protein, 7 aa, Mycobacterium avium
PAGDQAV

SEQ ID NO: 69668 - protein, 23 aa, Mycobacterium avium
PAGDTDPEPAPAEQLTDDAGGDE

SEQ ID NO: 69669 - protein, 9 aa, Mycobacterium avium
PAGFGAGGL

SEQ ID NO: 69670 - protein, 5 aa, Mycobacterium avium
PAGGD

SEQ ID NO: 69671 - protein, 13 aa, Mycobacterium avium
PAGGKPHSTEEAR

SEQ ID NO: 69672 - protein, 13 aa, Mycobacterium avium
PAGGVADRPGHRD

SEQ ID NO: 69673 - protein, 8 aa, Mycobacterium avium
PAGIEGSA

SEQ ID NO: 69674 - protein, 7 aa, Mycobacterium avium
PAGIRTE

SEQ ID NO: 69675 - protein, 12 aa, Mycobacterium avium
PAGKGPDKSAAI

SEQ ID NO: 69676 - protein, 6 aa, Mycobacterium avium
PAGMDQ

SEQ ID NO: 69677 - protein, 7 aa, Mycobacterium avium
PAGPAGR

SEQ ID NO: 69678 - protein, 5 aa, Mycobacterium avium
PAGPK

SEQ ID NO: 69679 - protein, 5 aa, Mycobacterium avium
PAGRP

SEQ ID NO: 69680 - protein, 9 aa, Mycobacterium avium
PAGSDGAGL

SEQ ID NO: 69681 - protein, 16 aa, Mycobacterium avium
PAGSDGVTAFQNREVA

SEQ ID NO: 69682 - protein, 10 aa, Mycobacterium avium
PAGSEGQRRL

SEQ ID NO: 69683 - protein, 53 aa, Mycobacterium avium
PAGSRTGARCTTRATARSAARARSTPATPSATTSPSTPASFPAHREDREDSTA

SEQ ID NO: 69684 - protein, 12 aa, Mycobacterium avium
PAGSVRPAEPLA

SEQ ID NO: 69685 - protein, 5 aa, Mycobacterium avium
PAGTD

SEQ ID NO: 69686 - protein, 11 aa, Mycobacterium avium
PAGTTLSEAQR

SEQ ID NO: 69687 - protein, 8 aa, Mycobacterium avium
PAGVDAPP

SEQ ID NO: 69688 - protein, 7 aa, Mycobacterium avium
PAGVSQS

SEQ ID NO: 69689 - protein, 6 aa, Mycobacterium avium
PAGVTE

SEQ ID NO: 69690 - protein, 5 aa, Mycobacterium avium
PAGYT

SEQ ID NO: 69691 - protein, 13 aa, Mycobacterium avium
PAHDRGGLHRPDP

SEQ ID NO: 69692 - protein, 6 aa, Mycobacterium avium
PAHRAG

SEQ ID NO: 69693 - protein, 17 aa, Mycobacterium avium
PAIPPRAGVRSAENDAE

SEQ ID NO: 69694 - protein, 6 aa, Mycobacterium avium
PAISPA

SEQ ID NO: 69695 - protein, 16 aa, Mycobacterium avium
PAKATQKYAAQAPRGE

SEQ ID NO: 69696 - protein, 9 aa, Mycobacterium avium
PAKISDEDA

SEQ ID NO: 69697 - protein, 27 aa, Mycobacterium avium
PAKKSDMRAGDDAERSDAEERRPTTVP

SEQ ID NO: 69698 - protein, 94 aa, Mycobacterium avium
PAKRPAAKAANGSAPAKRATKTASRSAKSEAGAAAEPAKKTRSSAKGADAKAPSARGTKAAKGGPADPDALDTDGAVEDLDTEPDLEGEPGEDL

SEQ ID NO: 69699 - protein, 11 aa, Mycobacterium avium
PAKRSGGRAGL

SEQ ID NO: 69700 - protein, 20 aa, Mycobacterium avium
PALADYPATEPAGPGPAAGD

SEQ ID NO: 69701 - protein, 5 aa, Mycobacterium avium
PALAG

SEQ ID NO: 69702 - protein, 18 aa, Mycobacterium avium
PALAGQPGTAPPTPAPDD

SEQ ID NO: 69703 - protein, 5 aa, Mycobacterium avium
PALDA

SEQ ID NO: 69704 - protein, 12 aa, Mycobacterium avium
PALDTSTRGAIE

SEQ ID NO: 69705 - protein, 13 aa, Mycobacterium avium
PALDTSTRGAIER

SEQ ID NO: 69706 - protein, 6 aa, Mycobacterium avium
PALGEP

SEQ ID NO: 69707 - protein, 16 aa, Mycobacterium avium
PALLGDDSAPNPSETA

SEQ ID NO: 69708 - protein, 4 aa, Mycobacterium avium
PALP

SEQ ID NO: 69709 - protein, 16 aa, Mycobacterium avium
PALPAADQLSRSRSVG

SEQ ID NO: 69710 - protein, 9 aa, Mycobacterium avium
PALPAGDDE

SEQ ID NO: 69711 - protein, 4 aa, Mycobacterium avium
PALQ

SEQ ID NO: 69712 - protein, 20 aa, Mycobacterium avium
PALSGDGRYATRDARHRHTD

SEQ ID NO: 69713 - protein, 5 aa, Mycobacterium avium
PALTG

SEQ ID NO: 69714 - protein, 10 aa, Mycobacterium avium
PAMPPQLPST

SEQ ID NO: 69715 - protein, 27 aa, Mycobacterium avium
PAMSGAPGAAPMTAATTGSTGSSSGVP

SEQ ID NO: 69716 - protein, 6 aa, Mycobacterium avium
PANDRI

SEQ ID NO: 69717 - protein, 11 aa, Mycobacterium avium
PANHPKDAISP

SEQ ID NO: 69718 - protein, 11 aa, Mycobacterium avium
PANHPKDGISP

SEQ ID NO: 69719 - protein, 12 aa, Mycobacterium avium
PANHPKDGISPL

SEQ ID NO: 69720 - protein, 9 aa, Mycobacterium avium
PANPGITGA

SEQ ID NO: 69721 - protein, 12 aa, Mycobacterium avium
PANPVNRVRDGG

SEQ ID NO: 69722 - protein, 7 aa, Mycobacterium avium
PANTANT

SEQ ID NO: 69723 - protein, 8 aa, Mycobacterium avium
PAPAGAQE

SEQ ID NO: 69724 - protein, 27 aa, Mycobacterium avium
PAPAPPAGPPPAGRSAAPKTARPHTRS

SEQ ID NO: 69725 - protein, 8 aa, Mycobacterium avium
PAPDGAPR

SEQ ID NO: 69726 - protein, 15 aa, Mycobacterium avium
PAPEARPRRHHTDPL

SEQ ID NO: 69727 - protein, 18 aa, Mycobacterium avium
PAPEYAAAGYRSPTTPAE

SEQ ID NO: 69728 - protein, 12 aa, Mycobacterium avium
PAPFDTDPRARR

SEQ ID NO: 69729 - protein, 8 aa, Mycobacterium avium
PAPLPATE

SEQ ID NO: 69730 - protein, 7 aa, Mycobacterium avium
PAPPEGD

SEQ ID NO: 69731 - protein, 6 aa, Mycobacterium avium
PAPPLA

SEQ ID NO: 69732 - protein, 5 aa, Mycobacterium avium
PAPRP

SEQ ID NO: 69733 - protein, 12 aa, Mycobacterium avium
PAPRQLPAPEAV

SEQ ID NO: 69734 - protein, 6 aa, Mycobacterium avium
PAPRVS

SEQ ID NO: 69735 - protein, 18 aa, Mycobacterium avium
PAPTRRSAARRRGGDPVT

SEQ ID NO: 69736 - protein, 15 aa, Mycobacterium avium
PAPVGDTPAVGEADR

SEQ ID NO: 69737 - protein, 34 aa, Mycobacterium avium
PAPVGDTPAVGEADRESPWRRDDSGSAPDPTLPP

SEQ ID NO: 69738 - protein, 34 aa, Mycobacterium avium
PAPVGDTPAVGEADRETPWRRDDSGSAPDPTLPP

SEQ ID NO: 69739 - protein, 8 aa, Mycobacterium avium
PAPVPDPL

SEQ ID NO: 69740 - protein, 6 aa, Mycobacterium avium
PAPVSR

SEQ ID NO: 69741 - protein, 5 aa, Mycobacterium avium
PAPYD

SEQ ID NO: 69742 - protein, 6 aa, Mycobacterium avium
PAQAQA

SEQ ID NO: 69743 - protein, 7 aa, Mycobacterium avium
PAQELDA

SEQ ID NO: 69744 - protein, 10 aa, Mycobacterium avium
PAQETQSLGA

SEQ ID NO: 69745 - protein, 8 aa, Mycobacterium avium
PAQGTVNG

SEQ ID NO: 69746 - protein, 10 aa, Mycobacterium avium
PAQKSTRRNR

SEQ ID NO: 69747 - protein, 13 aa, Mycobacterium avium
PAQPGQPAQPRTR

SEQ ID NO: 69748 - protein, 9 aa, Mycobacterium avium
PAQSTSSVG

SEQ ID NO: 69749 - protein, 6 aa, Mycobacterium avium
PAQTPH

SEQ ID NO: 69750 - protein, 12 aa, Mycobacterium avium
PAQWGKTAPGFG

SEQ ID NO: 69751 - protein, 8 aa, Mycobacterium avium
PARAAPGL

SEQ ID NO: 69752 - protein, 16 aa, Mycobacterium avium
PARASSRATPKATASA

SEQ ID NO: 69753 - protein, 6 aa, Mycobacterium avium
PARGQR

SEQ ID NO: 69754 - protein, 15 aa, Mycobacterium avium
PARISTAAPSLGQHT

SEQ ID NO: 69755 - protein, 11 aa, Mycobacterium avium
PARKEADAGDA

SEQ ID NO: 69756 - protein, 38 aa, Mycobacterium avium
PARPARPARRRAQRSTRSTRSTRPARAARPRSPRLPRA

SEQ ID NO: 69757 - protein, 18 aa, Mycobacterium avium
PARPRRARSRGARIGGGD

SEQ ID NO: 69758 - protein, 21 aa, Mycobacterium avium
PARQPGWDGNDNLASAAPGQR

SEQ ID NO: 69759 - protein, 22 aa, Mycobacterium avium
PARQPGWDGNDNLASAAPGQRV

SEQ ID NO: 69760 - protein, 6 aa, Mycobacterium avium
PARREV

SEQ ID NO: 69761 - protein, 16 aa, Mycobacterium avium
PARRHRRTARRPPVAA

SEQ ID NO: 69762 - protein, 11 aa, Mycobacterium avium
PARRPKGPNAL

SEQ ID NO: 69763 - protein, 7 aa, Mycobacterium avium
PARRPSM

SEQ ID NO: 69764 - protein, 8 aa, Mycobacterium avium
PARSTAPT

SEQ ID NO: 69765 - protein, 4 aa, Mycobacterium avium
PART

SEQ ID NO: 69766 - protein, 5 aa, Mycobacterium avium
PARTE

SEQ ID NO: 69767 - protein, 6 aa, Mycobacterium avium
PARTPR

SEQ ID NO: 69768 - protein, 5 aa, Mycobacterium avium
PARTR

SEQ ID NO: 69769 - protein, 23 aa, Mycobacterium avium
PARVTGRNVPSESKAPYDPQRAD

SEQ ID NO: 69770 - protein, 4 aa, Mycobacterium avium
PASD

SEQ ID NO: 69771 - protein, 5 aa, Mycobacterium avium
PASDL

SEQ ID NO: 69772 - protein, 8 aa, Mycobacterium avium
PASGFGRT

SEQ ID NO: 69773 - protein, 7 aa, Mycobacterium avium
PASKART

SEQ ID NO: 69774 - protein, 10 aa, Mycobacterium avium
PASRQQGDEV

SEQ ID NO: 69775 - protein, 7 aa, Mycobacterium avium
PASRRHD

SEQ ID NO: 69776 - protein, 4 aa, Mycobacterium avium
PAST

SEQ ID NO: 69777 - protein, 5 aa, Mycobacterium avium
PASTV

SEQ ID NO: 69778 - protein, 5 aa, Mycobacterium avium
PASYT

SEQ ID NO: 69779 - protein, 14 aa, Mycobacterium avium
PATARATAAATTPE

SEQ ID NO: 69780 - protein, 7 aa, Mycobacterium avium
PATDAER

SEQ ID NO: 69781 - protein, 7 aa, Mycobacterium avium
PATDQWD

SEQ ID NO: 69782 - protein, 20 aa, Mycobacterium avium
PATDTEEQQSNSSGRPIPGS

SEQ ID NO: 69783 - protein, 6 aa, Mycobacterium avium
PATLPK

SEQ ID NO: 69784 - protein, 20 aa, Mycobacterium avium
PATNAADSGTQTGVAGTLQA

SEQ ID NO: 69785 - protein, 7 aa, Mycobacterium avium
PATPGTP

SEQ ID NO: 69786 - protein, 6 aa, Mycobacterium avium
PATPPP

SEQ ID NO: 69787 - protein, 8 aa, Mycobacterium avium
PATREPDV

SEQ ID NO: 69788 - protein, 17 aa, Mycobacterium avium
PATSTDAAIIAAIRMKS

SEQ ID NO: 69789 - protein, 18 aa, Mycobacterium avium
PATTDFPTAADGISDAGA

SEQ ID NO: 69790 - protein, 17 aa, Mycobacterium avium
PAVDTQPSTPLPPPGAD

SEQ ID NO: 69791 - protein, 8 aa, Mycobacterium avium
PAVGGADE

SEQ ID NO: 69792 - protein, 5 aa, Mycobacterium avium
PAVGR

SEQ ID NO: 69793 - protein, 25 aa, Mycobacterium avium
PAVGRVNGTTYSGTPVHAGQKPGTV

SEQ ID NO: 69794 - protein, 6 aa, Mycobacterium avium
PAVPPR

SEQ ID NO: 69795 - protein, 6 aa, Mycobacterium avium
PAVRGP

SEQ ID NO: 69796 - protein, 6 aa, Mycobacterium avium
PAVSTK

SEQ ID NO: 69797 - protein, 12 aa, Mycobacterium avium
PAWPAANPVAPL

SEQ ID NO: 69798 - protein, 9 aa, Mycobacterium avium
PAWQPTNAS

SEQ ID NO: 69799 - protein, 7 aa, Mycobacterium avium
PAYRGPD

SEQ ID NO: 69800 - protein, 5 aa, Mycobacterium avium
PCAPD

SEQ ID NO: 69801 - protein, 7 aa, Mycobacterium avium
PCERDGD

SEQ ID NO: 69802 - protein, 22 aa, Mycobacterium avium
PCGDPAQGTEENTPAHYSTDGD

SEQ ID NO: 69803 - protein, 8 aa, Mycobacterium avium
PCGTGDQR

SEQ ID NO: 69804 - protein, 4 aa, Mycobacterium avium
PCQP

SEQ ID NO: 69805 - protein, 5 aa, Mycobacterium avium
PCQPL

SEQ ID NO: 69806 - protein, 14 aa, Mycobacterium avium
PCRGGQNKTTSVGQ

SEQ ID NO: 69807 - protein, 14 aa, Mycobacterium avium
PCRPGGAGVASPHT

SEQ ID NO: 69808 - protein, 25 aa, Mycobacterium avium
PCVEGTPSQTAIEGDARSAAQRNHD

SEQ ID NO: 69809 - protein, 8 aa, Mycobacterium avium
PDAAGGVT

SEQ ID NO: 69810 - protein, 13 aa, Mycobacterium avium
PDAARNAGNPTTF

SEQ ID NO: 69811 - protein, 6 aa, Mycobacterium avium
PDAGRS

SEQ ID NO: 69812 - protein, 11 aa, Mycobacterium avium
PDAINTEPDYV

SEQ ID NO: 69813 - protein, 5 aa, Mycobacterium avium
PDAIP

SEQ ID NO: 69814 - protein, 17 aa, Mycobacterium avium
PDANATAETQWAGSPTE

SEQ ID NO: 69815 - protein, 10 aa, Mycobacterium avium
PDANSDDPAA

SEQ ID NO: 69816 - protein, 7 aa, Mycobacterium avium
PDAPGAR

SEQ ID NO: 69817 - protein, 21 aa, Mycobacterium avium
PDASAPRRSAATATKPRRRRA

SEQ ID NO: 69818 - protein, 5 aa, Mycobacterium avium
PDATA

SEQ ID NO: 69819 - protein, 10 aa, Mycobacterium avium
PDATQSALDT

SEQ ID NO: 69820 - protein, 7 aa, Mycobacterium avium
PDDDTAA

SEQ ID NO: 69821 - protein, 4 aa, Mycobacterium avium
PDDE

SEQ ID NO: 69822 - protein, 8 aa, Mycobacterium avium
PDDEQPPD

SEQ ID NO: 69823 - protein, 26 aa, Mycobacterium avium
PDDGERQQAHQGGERVPEPGRPQRAA

SEQ ID NO: 69824 - protein, 12 aa, Mycobacterium avium
PDDGRGETRDRL

SEQ ID NO: 69825 - protein, 6 aa, Mycobacterium avium
PDDKWG

SEQ ID NO: 69826 - protein, 9 aa, Mycobacterium avium
PDDQRDEAA

SEQ ID NO: 69827 - protein, 12 aa, Mycobacterium avium
PDDSSAAPAATD

SEQ ID NO: 69828 - protein, 6 aa, Mycobacterium avium
PDDSTA

SEQ ID NO: 69829 - protein, 17 aa, Mycobacterium avium
PDEAAALGDELKGVTSS

SEQ ID NO: 69830 - protein, 16 aa, Mycobacterium avium
PDEDDPELGADPLRNN

SEQ ID NO: 69831 - protein, 15 aa, Mycobacterium avium
PDEHTGPRAGQGGRI

SEQ ID NO: 69832 - protein, 6 aa, Mycobacterium avium
PDELPA

SEQ ID NO: 69833 - protein, 4 aa, Mycobacterium avium
PDEN

SEQ ID NO: 69834 - protein, 14 aa, Mycobacterium avium
PDEPAYQPLPDDPP

SEQ ID NO: 69835 - protein, 13 aa, Mycobacterium avium
PDEPGAAVTPEQL

SEQ ID NO: 69836 - protein, 6 aa, Mycobacterium avium
PDEPGT

SEQ ID NO: 69837 - protein, 5 aa, Mycobacterium avium
PDERL

SEQ ID NO: 69838 - protein, 7 aa, Mycobacterium avium
PDESPRS

SEQ ID NO: 69839 - protein, 6 aa, Mycobacterium avium
PDETAQ

SEQ ID NO: 69840 - protein, 17 aa, Mycobacterium avium
PDFPQSPKTDEDREIRE

SEQ ID NO: 69841 - protein, 5 aa, Mycobacterium avium
PDFSG

SEQ ID NO: 69842 - protein, 6 aa, Mycobacterium avium
PDGAEP

SEQ ID NO: 69843 - protein, 10 aa, Mycobacterium avium
PDGAEPEVTV

SEQ ID NO: 69844 - protein, 5 aa, Mycobacterium avium
PDGAS

SEQ ID NO: 69845 - protein, 4 aa, Mycobacterium avium
PDGD

SEQ ID NO: 69846 - protein, 8 aa, Mycobacterium avium
PDGDEAGL

SEQ ID NO: 69847 - protein, 10 aa, Mycobacterium avium
PDGDEQPVGV

SEQ ID NO: 69848 - protein, 7 aa, Mycobacterium avium
PDGDPHI

SEQ ID NO: 69849 - protein, 5 aa, Mycobacterium avium
PDGEI

SEQ ID NO: 69850 - protein, 6 aa, Mycobacterium avium
PDGGAS

SEQ ID NO: 69851 - protein, 7 aa, Mycobacterium avium
PDGGASA

SEQ ID NO: 69852 - protein, 6 aa, Mycobacterium avium
PDGGGL

SEQ ID NO: 69853 - protein, 7 aa, Mycobacterium avium
PDGGGRI

SEQ ID NO: 69854 - protein, 14 aa, Mycobacterium avium
PDGGPSLWAMWRPP

SEQ ID NO: 69855 - protein, 5 aa, Mycobacterium avium
PDGGY

SEQ ID NO: 69856 - protein, 6 aa, Mycobacterium avium
PDGHGD

SEQ ID NO: 69857 - protein, 4 aa, Mycobacterium avium
PDGI

SEQ ID NO: 69858 - protein, 8 aa, Mycobacterium avium
PDGIGKST

SEQ ID NO: 69859 - protein, 7 aa, Mycobacterium avium
PDGKTQV

SEQ ID NO: 69860 - protein, 11 aa, Mycobacterium avium
PDGPAGLSGGT

SEQ ID NO: 69861 - protein, 25 aa, Mycobacterium avium
PDGQDRFTADTAGDIGAGGDERQVV

SEQ ID NO: 69862 - protein, 14 aa, Mycobacterium avium
PDGRDGDGLRAAGA

SEQ ID NO: 69863 - protein, 19 aa, Mycobacterium avium
PDGSAIAVGSADKITATAD

SEQ ID NO: 69864 - protein, 13 aa, Mycobacterium avium
PDGSPDDAEDAET

SEQ ID NO: 69865 - protein, 13 aa, Mycobacterium avium
PDGSPDDAGDAET

SEQ ID NO: 69866 - protein, 12 aa, Mycobacterium avium
PDGSTTDVSAQT

SEQ ID NO: 69867 - protein, 9 aa, Mycobacterium avium
PDGSTTVDT

SEQ ID NO: 69868 - protein, 8 aa, Mycobacterium avium
PDGSVAQT

SEQ ID NO: 69869 - protein, 8 aa, Mycobacterium avium
PDGTEVPG

SEQ ID NO: 69870 - protein, 5 aa, Mycobacterium avium
PDGTL

SEQ ID NO: 69871 - protein, 6 aa, Mycobacterium avium
PDGTTD

SEQ ID NO: 69872 - protein, 5 aa, Mycobacterium avium
PDGTV

SEQ ID NO: 69873 - protein, 7 aa, Mycobacterium avium
PDGYHPP

SEQ ID NO: 69874 - protein, 5 aa, Mycobacterium avium
PDHAE

SEQ ID NO: 69875 - protein, 5 aa, Mycobacterium avium
PDHAV

SEQ ID NO: 69876 - protein, 4 aa, Mycobacterium avium
PDHD

SEQ ID NO: 69877 - protein, 5 aa, Mycobacterium avium
PDHEG

SEQ ID NO: 69878 - protein, 6 aa, Mycobacterium avium
PDHGGC

SEQ ID NO: 69879 - protein, 13 aa, Mycobacterium avium
PDHGRPLEVGEPA

SEQ ID NO: 69880 - protein, 7 aa, Mycobacterium avium
PDHRETY

SEQ ID NO: 69881 - protein, 7 aa, Mycobacterium avium
PDKDQLA

SEQ ID NO: 69882 - protein, 6 aa, Mycobacterium avium
PDKPPH

SEQ ID NO: 69883 - protein, 20 aa, Mycobacterium avium
PDLGVTGATGRPGPARSRGC

SEQ ID NO: 69884 - protein, 10 aa, Mycobacterium avium
PDLSPKARPR

SEQ ID NO: 69885 - protein, 4 aa, Mycobacterium avium
PDMD

SEQ ID NO: 69886 - protein, 7 aa, Mycobacterium avium
PDPEMGE

SEQ ID NO: 69887 - protein, 7 aa, Mycobacterium avium
PDPGPQA

SEQ ID NO: 69888 - protein, 25 aa, Mycobacterium avium
PDPGRRGGPATGGRQAGRDPRRRTR

SEQ ID NO: 69889 - protein, 7 aa, Mycobacterium avium
PDPLPPH

SEQ ID NO: 69890 - protein, 14 aa, Mycobacterium avium
PDPNAPRVPPGDPF

SEQ ID NO: 69891 - protein, 10 aa, Mycobacterium avium
PDPNGERAGH

SEQ ID NO: 69892 - protein, 11 aa, Mycobacterium avium
PDPNGERAGHA

SEQ ID NO: 69893 - protein, 9 aa, Mycobacterium avium
PDPPRAPRR

SEQ ID NO: 69894 - protein, 6 aa, Mycobacterium avium
PDPPRQ

SEQ ID NO: 69895 - protein, 5 aa, Mycobacterium avium
PDPRR

SEQ ID NO: 69896 - protein, 10 aa, Mycobacterium avium
PDPTKPGQRQ

SEQ ID NO: 69897 - protein, 4 aa, Mycobacterium avium
PDPY

SEQ ID NO: 69898 - protein, 19 aa, Mycobacterium avium
PDQASSITPATPTDTPPST

SEQ ID NO: 69899 - protein, 8 aa, Mycobacterium avium
PDQNEGPL

SEQ ID NO: 69900 - protein, 8 aa, Mycobacterium avium
PDRAVPRT

SEQ ID NO: 69901 - protein, 4 aa, Mycobacterium avium
PDRD

SEQ ID NO: 69902 - protein, 6 aa, Mycobacterium avium
PDRDAA

SEQ ID NO: 69903 - protein, 5 aa, Mycobacterium avium
PDRIG

SEQ ID NO: 69904 - protein, 4 aa, Mycobacterium avium
PDRL

SEQ ID NO: 69905 - protein, 16 aa, Mycobacterium avium
PDRLPGISSPGAIPGI

SEQ ID NO: 69906 - protein, 6 aa, Mycobacterium avium
PDRNAA

SEQ ID NO: 69907 - protein, 6 aa, Mycobacterium avium
PDRNTP

SEQ ID NO: 69908 - protein, 31 aa, Mycobacterium avium
PDSAAARGVATEPRPAERTERTAPRKPRRPV

SEQ ID NO: 69909 - protein, 13 aa, Mycobacterium avium
PDSAEDPSEREFG

SEQ ID NO: 69910 - protein, 5 aa, Mycobacterium avium
PDSAG

SEQ ID NO: 69911 - protein, 4 aa, Mycobacterium avium
PDSD

SEQ ID NO: 69912 - protein, 11 aa, Mycobacterium avium
PDSEHPHGLPD

SEQ ID NO: 69913 - protein, 15 aa, Mycobacterium avium
PDSGEELPPGTPGEL

SEQ ID NO: 69914 - protein, 10 aa, Mycobacterium avium
PDSGSSPETR

SEQ ID NO: 69915 - protein, 10 aa, Mycobacterium avium
PDSGSSPQTR

SEQ ID NO: 69916 - protein, 18 aa, Mycobacterium avium
PDSHEPGTLAPTADDTEA

SEQ ID NO: 69917 - protein, 4 aa, Mycobacterium avium
PDSK

SEQ ID NO: 69918 - protein, 10 aa, Mycobacterium avium
PDSMKGDDDG

SEQ ID NO: 69919 - protein, 9 aa, Mycobacterium avium
PDSPLTPPR

SEQ ID NO: 69920 - protein, 14 aa, Mycobacterium avium
PDSPPTDELDGAEA

SEQ ID NO: 69921 - protein, 5 aa, Mycobacterium avium
PDSVG

SEQ ID NO: 69922 - protein, 5 aa, Mycobacterium avium
PDSVP

SEQ ID NO: 69923 - protein, 10 aa, Mycobacterium avium
PDTDANDAHR

SEQ ID NO: 69924 - protein, 4 aa, Mycobacterium avium
PDTE

SEQ ID NO: 69925 - protein, 12 aa, Mycobacterium avium
PDTGRPVPVGAP

SEQ ID NO: 69926 - protein, 13 aa, Mycobacterium avium
PDTLGPQRERAGW

SEQ ID NO: 69927 - protein, 5 aa, Mycobacterium avium
PDTPS

SEQ ID NO: 69928 - protein, 18 aa, Mycobacterium avium
PDTPVRPGSTAAGRRPWG

SEQ ID NO: 69929 - protein, 5 aa, Mycobacterium avium
PDTQY

SEQ ID NO: 69930 - protein, 13 aa, Mycobacterium avium
PDTRDADPVPWGG

SEQ ID NO: 69931 - protein, 11 aa, Mycobacterium avium
PDTVSEEVSTD

SEQ ID NO: 69932 - protein, 5 aa, Mycobacterium avium
PDVDE

SEQ ID NO: 69933 - protein, 6 aa, Mycobacterium avium
PDVGDL

SEQ ID NO: 69934 - protein, 44 aa, Mycobacterium avium; identical to SEQ ID NO: 9022

SEQ ID NO: 69935 - protein, 7 aa, Mycobacterium avium
PDVTAED

SEQ ID NO: 69936 - protein, 10 aa, Mycobacterium avium
PEAAAATGNP

SEQ ID NO: 69937 - protein, 15 aa, Mycobacterium avium
PEAADVESAATASRV

SEQ ID NO: 69938 - protein, 15 aa, Mycobacterium avium
PEAADVESAATTSRV

SEQ ID NO: 69939 - protein, 8 aa, Mycobacterium avium
PEADRERF

SEQ ID NO: 69940 - protein, 6 aa, Mycobacterium avium
PEAGHI

SEQ ID NO: 69941 - protein, 6 aa, Mycobacterium avium
PEAGHV

SEQ ID NO: 69942 - protein, 6 aa, Mycobacterium avium
PEAGNA

SEQ ID NO: 69943 - protein, 8 aa, Mycobacterium avium
PEAHPRGG

SEQ ID NO: 69944 - protein, 10 aa, Mycobacterium avium
PEAPGQTTSS

SEQ ID NO: 69945 - protein, 7 aa, Mycobacterium avium
PEAPVSQ

SEQ ID NO: 69946 - protein, 5 aa, Mycobacterium avium
PEDDI

SEQ ID NO: 69947 - protein, 11 aa, Mycobacterium avium
PEDEADDPKSR

SEQ ID NO: 69948 - protein, 5 aa, Mycobacterium avium
PEDGH

SEQ ID NO: 69949 - protein, 4 aa, Mycobacterium avium
PEEG

SEQ ID NO: 69950 - protein, 5 aa, Mycobacterium avium
PEELP

SEQ ID NO: 69951 - protein, 9 aa, Mycobacterium avium
PEETDEEEL

SEQ ID NO: 69952 - protein, 5 aa, Mycobacterium avium
PEFGE

SEQ ID NO: 69953 - protein, 7 aa, Mycobacterium avium
PEFTGAQ

SEQ ID NO: 69954 - protein, 21 aa, Mycobacterium avium
PEGAEPEVTVESGVDSTGMSS

SEQ ID NO: 69955 - protein, 8 aa, Mycobacterium avium
PEGAGATW

SEQ ID NO: 69956 - protein, 8 aa, Mycobacterium avium
PEGGIADD

SEQ ID NO: 69957 - protein, 4 aa, Mycobacterium avium
PEGL

SEQ ID NO: 69958 - protein, 7 aa, Mycobacterium avium
PEGQPAL

SEQ ID NO: 69959 - protein, 11 aa, Mycobacterium avium
PEGTPDPPAEL

SEQ ID NO: 69960 - protein, 6 aa, Mycobacterium avium
PEGTQS

SEQ ID NO: 69961 - protein, 12 aa, Mycobacterium avium
PEGTRSPDGRLY

SEQ ID NO: 69962 - protein, 5 aa, Mycobacterium avium
PEHAA

SEQ ID NO: 69963 - protein, 5 aa, Mycobacterium avium
PEHAT

SEQ ID NO: 69964 - protein, 5 aa, Mycobacterium avium
PEHEP

SEQ ID NO: 69965 - protein, 12 aa, Mycobacterium avium
PEHFPADGSAAI

SEQ ID NO: 69966 - protein, 18 aa, Mycobacterium avium
PEHRSRAERAAAALEGPP

SEQ ID NO: 69967 - protein, 12 aa, Mycobacterium avium
PEIATGEAGKVT

SEQ ID NO: 69968 - protein, 153 aa, Mycobacterium avium
PEIKPPTGGAPVGLGPGGKPIEAPVESAPRPPDGTPGAQRGSPPVATSPASPGPAGDSGAGPHGPSSSPAPAAPPGGPVGPHDPAPAPAPAASPGGPGGSGGVHDPAPAPAPAPAASGGPGDPASVPSGGPHEPASVPAEEPREPVSVPAGGV

SEQ ID NO: 69969 - protein, 8 aa, Mycobacterium avium
PEISGGEA

SEQ ID NO: 69970 - protein, 10 aa, Mycobacterium avium
PEKAGRDAGE

SEQ ID NO: 69971 - protein, 4 aa, Mycobacterium avium
PEKL

SEQ ID NO: 69972 - protein, 12 aa, Mycobacterium avium
PEKLARQSLSGA

SEQ ID NO: 69973 - protein, 4 aa, Mycobacterium avium
PEKS

SEQ ID NO: 69974 - protein, 7 aa, Mycobacterium avium
PELDPAG

SEQ ID NO: 69975 - protein, 6 aa, Mycobacterium avium
PELGPE

SEQ ID NO: 69976 - protein, 21 aa, Mycobacterium avium
PELTEAEQGPAATLSFVRAIK

SEQ ID NO: 69977 - protein, 10 aa, Mycobacterium avium
PEMSTTDTIR

SEQ ID NO: 69978 - protein, 10 aa, Mycobacterium avium
PEPAATTVGA

SEQ ID NO: 69979 - protein, 12 aa, Mycobacterium avium
PEPDGWTATRAA

SEQ ID NO: 69980 - protein, 11 aa, Mycobacterium avium
PEPDSHARGGL

SEQ ID NO: 69981 - protein, 8 aa, Mycobacterium avium
PEPDSPRL

SEQ ID NO: 69982 - protein, 6 aa, Mycobacterium avium
PEPESV

SEQ ID NO: 69983 - protein, 10 aa, Mycobacterium avium
PEPETGKSTV

SEQ ID NO: 69984 - protein, 17 aa, Mycobacterium avium
PEPGDGTAARRALEAGA

SEQ ID NO: 69985 - protein, 4 aa, Mycobacterium avium
PEPH

SEQ ID NO: 69986 - protein, 5 aa, Mycobacterium avium
PEPID

SEQ ID NO: 69987 - protein, 6 aa, Mycobacterium avium
PEPIDA

SEQ ID NO: 69988 - protein, 6 aa, Mycobacterium avium
PEPLEQ

SEQ ID NO: 69989 - protein, 7 aa, Mycobacterium avium
PEPTGLD

SEQ ID NO: 69990 - protein, 9 aa, Mycobacterium avium
PEPVSGGTA

SEQ ID NO: 69991 - protein, 4 aa, Mycobacterium avium
PEPY

SEQ ID NO: 69992 - protein, 9 aa, Mycobacterium avium
PEQAGVSTG

SEQ ID NO: 69993 - protein, 4 aa, Mycobacterium avium
PEQF

SEQ ID NO: 69994 - protein, 5 aa, Mycobacterium avium
PEQFA

SEQ ID NO: 69995 - protein, 12 aa, Mycobacterium avium
PEQPAVRPSHRT

SEQ ID NO: 69996 - protein, 20 aa, Mycobacterium avium
PEQRDSEELSDEVASTGAQR

SEQ ID NO: 69997 - protein, 5 aa, Mycobacterium avium
PEQVA

SEQ ID NO: 69998 - protein, 5 aa, Mycobacterium avium
PERER

SEQ ID NO: 69999 - protein, 4 aa, Mycobacterium avium
PERG

SEQ ID NO: 70000 - protein, 10 aa, Mycobacterium avium
PERLGGPGVD

SEQ ID NO: 70001 - protein, 11 aa, Mycobacterium avium
PERLSPSDDFP

SEQ ID NO: 70002 - protein, 4 aa, Mycobacterium avium
PERM

SEQ ID NO: 70003 - protein, 7 aa, Mycobacterium avium
PERRGVP

SEQ ID NO: 70004 - protein, 5 aa, Mycobacterium avium
PESDV

SEQ ID NO: 70005 - protein, 8 aa, Mycobacterium avium
PESERERM

SEQ ID NO: 70006 - protein, 4 aa, Mycobacterium avium
PESQ

SEQ ID NO: 70007 - protein, 4 aa, Mycobacterium avium
PESR

SEQ ID NO: 70008 - protein, 6 aa, Mycobacterium avium
PESVDQ

SEQ ID NO: 70009 - protein, 21 aa, Mycobacterium avium
PETATTDAKISDADIDSLSPD

SEQ ID NO: 70010 - protein, 8 aa, Mycobacterium avium
PETDHPDE

SEQ ID NO: 70011 - protein, 4 aa, Mycobacterium avium
PETG

SEQ ID NO: 70012 - protein, 28 aa, Mycobacterium avium
PETGQNARIGTTSDINPRDPATLQDGGN

SEQ ID NO: 70013 - protein, 9 aa, Mycobacterium avium
PETKIEPSL

SEQ ID NO: 70014 - protein, 5 aa, Mycobacterium avium
PETSF

SEQ ID NO: 70015 - protein, 12 aa, Mycobacterium avium
PETSRFKEAAER

SEQ ID NO: 70016 - protein, 11 aa, Mycobacterium avium
PETSTECPPGT

SEQ ID NO: 70017 - protein, 7 aa, Mycobacterium avium
PETTPVR

SEQ ID NO: 70018 - protein, 5 aa, Mycobacterium avium
PEVAN

SEQ ID NO: 70019 - protein, 16 aa, Mycobacterium avium
PEVTGPDGKRKQQRKR

SEQ ID NO: 70020 - protein, 4 aa, Mycobacterium avium
PEVY

SEQ ID NO: 70021 - protein, 16 aa, Mycobacterium avium
PEYAERAGRMAKGEDC

SEQ ID NO: 70022 - protein, 19 aa, Mycobacterium avium
PFASPRRTTDPGGVTAQQA

SEQ ID NO: 70023 - protein, 13 aa, Mycobacterium avium
PFATAGKLSDKQL

SEQ ID NO: 70024 - protein, 4 aa, Mycobacterium avium
PFDP

SEQ ID NO: 70025 - protein, 6 aa, Mycobacterium avium
PFKATG

SEQ ID NO: 70026 - protein, 7 aa, Mycobacterium avium
PFNKQAR

SEQ ID NO: 70027 - protein, 6 aa, Mycobacterium avium
PFNKRA

SEQ ID NO: 70028 - protein, 13 aa, Mycobacterium avium
PFPGRPSRPTDLG

SEQ ID NO: 70029 - protein, 5 aa, Mycobacterium avium
PFPGV

SEQ ID NO: 70030 - protein, 16 aa, Mycobacterium avium
PFPPLPVTPEGDDISA

SEQ ID NO: 70031 - protein, 5 aa, Mycobacterium avium
PFSKQ

SEQ ID NO: 70032 - protein, 9 aa, Mycobacterium avium
PFTAPGGWT

SEQ ID NO: 70033 - protein, 7 aa, Mycobacterium avium
PFTPGGR

SEQ ID NO: 70034 - protein, 36 aa, Mycobacterium avium
PFTPPRPDTAANGIAAQANTVAQAANDAGSGDPSGG

SEQ ID NO: 70035 - protein, 4 aa, Mycobacterium avium
PGAA

SEQ ID NO: 70036 - protein, 7 aa, Mycobacterium avium
PGAALTS

SEQ ID NO: 70037 - protein, 7 aa, Mycobacterium avium
PGAAPDV

SEQ ID NO: 70038 - protein, 10 aa, Mycobacterium avium
PGAEPVATAE

SEQ ID NO: 70039 - protein, 10 aa, Mycobacterium avium
PGAERAQRVD

SEQ ID NO: 70040 - protein, 10 aa, Mycobacterium avium
PGAESVDASQ

SEQ ID NO: 70041 - protein, 8 aa, Mycobacterium avium
PGAGAGAT

SEQ ID NO: 70042 - protein, 10 aa, Mycobacterium avium
PGAGPVPVAT

SEQ ID NO: 70043 - protein, 5 aa, Mycobacterium avium
PGAGT

SEQ ID NO: 70044 - protein, 5 aa, Mycobacterium avium
PGAHG

SEQ ID NO: 70045 - protein, 5 aa, Mycobacterium avium
PGAIS

SEQ ID NO: 70046 - protein, 4 aa, Mycobacterium avium
PGAL

SEQ ID NO: 70047 - protein, 6 aa, Mycobacterium avium
PGAMER

SEQ ID NO: 70048 - protein, 8 aa, Mycobacterium avium
PGAPDPGS

SEQ ID NO: 70049 - protein, 10 aa, Mycobacterium avium
PGAPPPGDHG

SEQ ID NO: 70050 - protein, 7 aa, Mycobacterium avium
PGAQLDE

SEQ ID NO: 70051 - protein, 7 aa, Mycobacterium avium
PGASSVE

SEQ ID NO: 70052 - protein, 7 aa, Mycobacterium avium
PGATITE

SEQ ID NO: 70053 - protein, 6 aa, Mycobacterium avium
PGATPL

SEQ ID NO: 70054 - protein, 5 aa, Mycobacterium avium
PGATS

SEQ ID NO: 70055 - protein, 11 aa, Mycobacterium avium
PGAVPPPSLDV

SEQ ID NO: 70056 - protein, 19 aa, Mycobacterium avium
PGDANFDAATGQVTVTPAT

SEQ ID NO: 70057 - protein, 18 aa, Mycobacterium avium
PGDEDKDPIGSAGTDPDG

SEQ ID NO: 70058 - protein, 4 aa, Mycobacterium avium
PGDG

SEQ ID NO: 70059 - protein, 12 aa, Mycobacterium avium
PGDGDLHAGPGD

SEQ ID NO: 70060 - protein, 10 aa, Mycobacterium avium
PGDGGRPLRN

SEQ ID NO: 70061 - protein, 4 aa, Mycobacterium avium
PGDP

SEQ ID NO: 70062 - protein, 13 aa, Mycobacterium avium
PGDPDQDPGRGRR

SEQ ID NO: 70063 - protein, 12 aa, Mycobacterium avium
PGDPLPDGKPYV

SEQ ID NO: 70064 - protein, 14 aa, Mycobacterium avium
PGDRPQPASQPVPV

SEQ ID NO: 70065 - protein, 12 aa, Mycobacterium avium
PGDTDVAARRDA

SEQ ID NO: 70066 - protein, 20 aa, Mycobacterium avium
PGDTGEPAADSAPHPTLDPQ

SEQ ID NO: 70067 - protein, 5 aa, Mycobacterium avium
PGEPL

SEQ ID NO: 70068 - protein, 8 aa, Mycobacterium avium
PGEPVAAG

SEQ ID NO: 70069 - protein, 5 aa, Mycobacterium avium
PGESM

SEQ ID NO: 70070 - protein, 5 aa, Mycobacterium avium
PGFDG

SEQ ID NO: 70071 - protein, 6 aa, Mycobacterium avium
PGFGKS

SEQ ID NO: 70072 - protein, 6 aa, Mycobacterium avium
PGFPEE

SEQ ID NO: 70073 - protein, 8 aa, Mycobacterium avium
PGGAEAGA

SEQ ID NO: 70074 - protein, 8 aa, Mycobacterium avium
PGGAPIPQ

SEQ ID NO: 70075 - protein, 6 aa, Mycobacterium avium
PGGCGR

SEQ ID NO: 70076 - protein, 5 aa, Mycobacterium avium
PGGDA

SEQ ID NO: 70077 - protein, 5 aa, Mycobacterium avium
PGGDT

SEQ ID NO: 70078 - protein, 7 aa, Mycobacterium avium
PGGELTA

SEQ ID NO: 70079 - protein, 17 aa, Mycobacterium avium
PGGESVAQVSGRADAAV

SEQ ID NO: 70080 - protein, 10 aa, Mycobacterium avium
PGGGRASFPA

SEQ ID NO: 70081 - protein, 8 aa, Mycobacterium avium
PGGGSTVR

SEQ ID NO: 70082 - protein, 6 aa, Mycobacterium avium
PGGIPA

SEQ ID NO: 70083 - protein, 8 aa, Mycobacterium avium
PGGLSGLS

SEQ ID NO: 70084 - protein, 10 aa, Mycobacterium avium
PGGPGTAVHA

SEQ ID NO: 70085 - protein, 4 aa, Mycobacterium avium
PGGR

SEQ ID NO: 70086 - protein, 5 aa, Mycobacterium avium
PGGVG

SEQ ID NO: 70087 - protein, 5 aa, Mycobacterium avium
PGHAA

SEQ ID NO: 70088 - protein, 5 aa, Mycobacterium avium
PGHAE

SEQ ID NO: 70089 - protein, 4 aa, Mycobacterium avium
PGHE

SEQ ID NO: 70090 - protein, 5 aa, Mycobacterium avium
PGHGH

SEQ ID NO: 70091 - protein, 11 aa, Mycobacterium avium
PGHGNKPGDLA

SEQ ID NO: 70092 - protein, 5 aa, Mycobacterium avium
PGHGP

SEQ ID NO: 70093 - protein, 7 aa, Mycobacterium avium
PGHRGSV

SEQ ID NO: 70094 - protein, 8 aa, Mycobacterium avium
PGHSGQRP

SEQ ID NO: 70095 - protein, 6 aa, Mycobacterium avium
PGHTER

SEQ ID NO: 70096 - protein, 5 aa, Mycobacterium avium
PGIAT

SEQ ID NO: 70097 - protein, 10 aa, Mycobacterium avium
PGIEASTPQQ

SEQ ID NO: 70098 - protein, 45 aa, Mycobacterium avium
PGKAEAAGKKAQKAIAKAPAKKAPAKKAPAKKAPAKKAAAKKVTQ

SEQ ID NO: 70099 - protein, 30 aa, Mycobacterium avium
PGKAEAAGKKAQKAIAKAPAKKAPAKKVTQ

SEQ ID NO: 70100 - protein, 45 aa, Mycobacterium avium
PGKAEAAGKKTQKAIAKAPAKKAPAKKAPAKKAPAKKAAAKKVTQ

SEQ ID NO: 70101 - protein, 10 aa, Mycobacterium avium
PGKAGPGRVE

SEQ ID NO: 70102 - protein, 14 aa, Mycobacterium avium
PGKAKRNLPGAPSA

SEQ ID NO: 70103 - protein, 14 aa, Mycobacterium avium
PGKAKRNLPTSPTI

SEQ ID NO: 70104 - protein, 7 aa, Mycobacterium avium
PGKRAPT

SEQ ID NO: 70105 - protein, 10 aa, Mycobacterium avium
PGLAPTAPLP

SEQ ID NO: 70106 - protein, 10 aa, Mycobacterium avium
PGLGTDDAGA

SEQ ID NO: 70107 - protein, 5 aa, Mycobacterium avium
PGLPS

SEQ ID NO: 70108 - protein, 7 aa, Mycobacterium avium
PGLQEKP

SEQ ID NO: 70109 - protein, 7 aa, Mycobacterium avium
PGLRAGA

SEQ ID NO: 70110 - protein, 5 aa, Mycobacterium avium
PGLRD

SEQ ID NO: 70111 - protein, 9 aa, Mycobacterium avium
PGLSPGDRA

SEQ ID NO: 70112 - protein, 6 aa, Mycobacterium avium
PGLTDK

SEQ ID NO: 70113 - protein, 5 aa, Mycobacterium avium
PGMPA

SEQ ID NO: 70114 - protein, 9 aa, Mycobacterium avium
PGMRADDGR

SEQ ID NO: 70115 - protein, 15 aa, Mycobacterium avium
PGNKPRALEKGKSLP

SEQ ID NO: 70116 - protein, 16 aa, Mycobacterium avium
PGNKPRALEKGKSLPA

SEQ ID NO: 70117 - protein, 4 aa, Mycobacterium avium
PGNQ

SEQ ID NO: 70118 - protein, 7 aa, Mycobacterium avium
PGNRAPL

SEQ ID NO: 70119 - protein, 12 aa, Mycobacterium avium
PGNRSDIRERST

SEQ ID NO: 70120 - protein, 11 aa, Mycobacterium avium
PGPAGATESEL

SEQ ID NO: 70121 - protein, 10 aa, Mycobacterium avium
PGPAPDIGKE

SEQ ID NO: 70122 - protein, 9 aa, Mycobacterium avium
PGPAPDIGR

SEQ ID NO: 70123 - protein, 5 aa, Mycobacterium avium
PGPEV

SEQ ID NO: 70124 - protein, 5 aa, Mycobacterium avium
PGPFT

SEQ ID NO: 70125 - protein, 18 aa, Mycobacterium avium
PGPGSEPGESREYQPGAD

SEQ ID NO: 70126 - protein, 5 aa, Mycobacterium avium
PGPHF

SEQ ID NO: 70127 - protein, 4 aa, Mycobacterium avium
PGPI

SEQ ID NO: 70128 - protein, 5 aa, Mycobacterium avium
PGPNG

SEQ ID NO: 70129 - protein, 4 aa, Mycobacterium avium
PGPP

SEQ ID NO: 70130 - protein, 15 aa, Mycobacterium avium
PGPREVPARRRFMDD

SEQ ID NO: 70131 - protein, 10 aa, Mycobacterium avium
PGPRTTRSRP

SEQ ID NO: 70132 - protein, 4 aa, Mycobacterium avium
PGPS

SEQ ID NO: 70133 - protein, 7 aa, Mycobacterium avium
PGPTDTP

SEQ ID NO: 70134 - protein, 5 aa, Mycobacterium avium
PGPVQ

SEQ ID NO: 70135 - protein, 6 aa, Mycobacterium avium
PGPYPF

SEQ ID NO: 70136 - protein, 6 aa, Mycobacterium avium
PGQHGI

SEQ ID NO: 70137 - protein, 7 aa, Mycobacterium avium
PGQPLPE

SEQ ID NO: 70138 - protein, 4 aa, Mycobacterium avium
PGQR

SEQ ID NO: 70139 - protein, 6 aa, Mycobacterium avium
PGQTGM

SEQ ID NO: 70140 - protein, 44 aa, Mycobacterium avium
PGRCGRAATASGRPAARGARADLPAAAPPGRAAAAAGGVQAAPV

SEQ ID NO: 70141 - protein, 15 aa, Mycobacterium avium
PGRDGAIARNDYRNV

SEQ ID NO: 70142 - protein, 46 aa, Mycobacterium avium
PGRGAADSRDGRSSGDAGTAGRGRRAAASHGPAGAARTASTGTTAE

SEQ ID NO: 70143 - protein, 12 aa, Mycobacterium avium
PGRGGPASGTGA

SEQ ID NO: 70144 - protein, 5 aa, Mycobacterium avium
PGRPI

SEQ ID NO: 70145 - protein, 10 aa, Mycobacterium avium
PGRQPAPDRR

SEQ ID NO: 70146 - protein, 7 aa, Mycobacterium avium
PGRRADA

SEQ ID NO: 70147 - protein, 7 aa, Mycobacterium avium
PGRRARV

SEQ ID NO: 70148 - protein, 16 aa, Mycobacterium avium
PGRRPGGCSTSARSTC

SEQ ID NO: 70149 - protein, 7 aa, Mycobacterium avium
PGRTFAS

SEQ ID NO: 70150 - protein, 6 aa, Mycobacterium avium
PGRTPP

SEQ ID NO: 70151 - protein, 8 aa, Mycobacterium avium
PGSAPGVT

SEQ ID NO: 70152 - protein, 19 aa, Mycobacterium avium
PGSASVPHSARRPPPESNW

SEQ ID NO: 70153 - protein, 4 aa, Mycobacterium avium
PGSC

SEQ ID NO: 70154 - protein, 7 aa, Mycobacterium avium
PGSDPAV

SEQ ID NO: 70155 - protein, 8 aa, Mycobacterium avium
PGSDRTSQ

SEQ ID NO: 70156 - protein, 5 aa, Mycobacterium avium
PGSGF

SEQ ID NO: 70157 - protein, 10 aa, Mycobacterium avium
PGSGKSTIGR

SEQ ID NO: 70158 - protein, 8 aa, Mycobacterium avium
PGSGQAQW

SEQ ID NO: 70159 - protein, 11 aa, Mycobacterium avium
PGSRTASSARL

SEQ ID NO: 70160 - protein, 12 aa, Mycobacterium avium
PGSRTASSARLA

SEQ ID NO: 70161 - protein, 10 aa, Mycobacterium avium
PGSVEQAVRT

SEQ ID NO: 70162 - protein, 5 aa, Mycobacterium avium
PGSVK

SEQ ID NO: 70163 - protein, 14 aa, Mycobacterium avium
PGSVRSTSTKAWLL

SEQ ID NO: 70164 - protein, 26 aa, Mycobacterium avium
PGSWSGAAGRCSPSPTTRPPSTPRRR

SEQ ID NO: 70165 - protein, 5 aa, Mycobacterium avium
PGSYE

SEQ ID NO: 70166 - protein, 10 aa, Mycobacterium avium
PGTGAHTNPH

SEQ ID NO: 70167 - protein, 10 aa, Mycobacterium avium
PGTNSSVRGG

SEQ ID NO: 70168 - protein, 4 aa, Mycobacterium avium
PGVA

SEQ ID NO: 70169 - protein, 6 aa, Mycobacterium avium
PGVAER

SEQ ID NO: 70170 - protein, 10 aa, Mycobacterium avium
PGVGDPDSVG

SEQ ID NO: 70171 - protein, 7 aa, Mycobacterium avium
PGVPDDD

SEQ ID NO: 70172 - protein, 4 aa, Mycobacterium avium
PGVR

SEQ ID NO: 70173 - protein, 4 aa, Mycobacterium avium
PGVS

SEQ ID NO: 70174 - protein, 8 aa, Mycobacterium avium
PGVSPLPR

SEQ ID NO: 70175 - protein, 4 aa, Mycobacterium avium
PGWD

SEQ ID NO: 70176 - protein, 7 aa, Mycobacterium avium
PGWNDRD

SEQ ID NO: 70177 - protein, 9 aa, Mycobacterium avium
PGYADGPAA

SEQ ID NO: 70178 - protein, 11 aa, Mycobacterium avium
PGYGDGPPCGH

SEQ ID NO: 70179 - protein, 16 aa, Mycobacterium avium
PGYGRSAKGVDQSDPF

SEQ ID NO: 70180 - protein, 20 aa, Mycobacterium avium
PHAGSGSSIRPVAPHACGPA

SEQ ID NO: 70181 - protein, 12 aa, Mycobacterium avium
PHAKDAEAAARE

SEQ ID NO: 70182 - protein, 5 aa, Mycobacterium avium
PHARN

SEQ ID NO: 70183 - protein, 10 aa, Mycobacterium avium
PHDDDGAEVR

SEQ ID NO: 70184 - protein, 7 aa, Mycobacterium avium
PHDPSTV

SEQ ID NO: 70185 - protein, 10 aa, Mycobacterium avium
PHEPGYPDSP

SEQ ID NO: 70186 - protein, 7 aa, Mycobacterium avium
PHETEKT

SEQ ID NO: 70187 - protein, 29 aa, Mycobacterium avium
PHFEQGNSDRHVEQRQSSRSDPVGRLGGG

SEQ ID NO: 70188 - protein, 12 aa, Mycobacterium avium
PHGAPNDPVTND

SEQ ID NO: 70189 - protein, 6 aa, Mycobacterium avium
PHGGFG

SEQ ID NO: 70190 - protein, 16 aa, Mycobacterium avium
PHIGGNAYSEPEPHTG

SEQ ID NO: 70191 - protein, 4 aa, Mycobacterium avium
PHLR

SEQ ID NO: 70192 - protein, 8 aa, Mycobacterium avium
PHPAPVAP

SEQ ID NO: 70193 - protein, 17 aa, Mycobacterium avium
PHPDSSAGRDAQAAAAA

SEQ ID NO: 70194 - protein, 7 aa, Mycobacterium avium
PHPEGIG

SEQ ID NO: 70195 - protein, 12 aa, Mycobacterium avium
PHPGAGGRVTSQ

SEQ ID NO: 70196 - protein, 15 aa, Mycobacterium avium
PHPGRLENAASQTYE

SEQ ID NO: 70197 - protein, 14 aa, Mycobacterium avium
PHPHPGHAAHPPGG

SEQ ID NO: 70198 - protein, 13 aa, Mycobacterium avium
PHPHPTKRTRHKA

SEQ ID NO: 70199 - protein, 14 aa, Mycobacterium avium
PHPRRRQAGVQRAE

SEQ ID NO: 70200 - protein, 4 aa, Mycobacterium avium
PHQI

SEQ ID NO: 70201 - protein, 6 aa, Mycobacterium avium
PHRDHP

SEQ ID NO: 70202 - protein, 4 aa, Mycobacterium avium
PHRG

SEQ ID NO: 70203 - protein, 8 aa, Mycobacterium avium
PHRGRANE

SEQ ID NO: 70204 - protein, 23 aa, Mycobacterium avium
PHRPAAPARRPDRRRASRAQGSA

SEQ ID NO: 70205 - protein, 23 aa, Mycobacterium avium
PHRPAAPVRRPDRRRASRAQGSA

SEQ ID NO: 70206 - protein, 11 aa, Mycobacterium avium
PHRRASSQRAL

SEQ ID NO: 70207 - protein, 6 aa, Mycobacterium avium
PHRYSQ

SEQ ID NO: 70208 - protein, 11 aa, Mycobacterium avium
PHSDSSWPAAA

SEQ ID NO: 70209 - protein, 19 aa, Mycobacterium avium
PHSEQPIGHAQAAGPEDVD

SEQ ID NO: 70210 - protein, 20 aa, Mycobacterium avium
PHSRPPQAELPAEAKAQIEN

SEQ ID NO: 70211 - protein, 6 aa, Mycobacterium avium
PHSTAP

SEQ ID NO: 70212 - protein, 11 aa, Mycobacterium avium
PHSTPEDLAET

SEQ ID NO: 70213 - protein, 4 aa, Mycobacterium avium
PHTG

SEQ ID NO: 70214 - protein, 11 aa, Mycobacterium avium
PHTGYPASDTG

SEQ ID NO: 70215 - protein, 4 aa, Mycobacterium avium
PHTQ

SEQ ID NO: 70216 - protein, 12 aa, Mycobacterium avium
PHTTNGAEPSHN

SEQ ID NO: 70217 - protein, 16 aa, Mycobacterium avium
PHYPPPGYADAPSAAG

SEQ ID NO: 70218 - protein, 10 aa, Mycobacterium avium
PIADEAEKAA

SEQ ID NO: 70219 - protein, 5 aa, Mycobacterium avium
PIARQ

SEQ ID NO: 70220 - protein, 7 aa, Mycobacterium avium
PIDESQR

SEQ ID NO: 70221 - protein, 9 aa, Mycobacterium avium
PIDPAQPNS

SEQ ID NO: 70222 - protein, 10 aa, Mycobacterium avium
PIEDSDSDSL

SEQ ID NO: 70223 - protein, 12 aa, Mycobacterium avium
PIGSATSTVGNT

SEQ ID NO: 70224 - protein, 5 aa, Mycobacterium avium
PIHPQ

SEQ ID NO: 70225 - protein, 19 aa, Mycobacterium avium
PINPSGGLKAKGHPPGATG

SEQ ID NO: 70226 - protein, 4 aa, Mycobacterium avium
PIPA

SEQ ID NO: 70227 - protein, 6 aa, Mycobacterium avium
PIPGTE

SEQ ID NO: 70228 - protein, 10 aa, Mycobacterium avium
PIPPNSLSPY

SEQ ID NO: 70229 - protein, 9 aa, Mycobacterium avium
PIPTEESPS

SEQ ID NO: 70230 - protein, 6 aa, Mycobacterium avium
PIQQGA

SEQ ID NO: 70231 - protein, 7 aa, Mycobacterium avium
PISLPGA

SEQ ID NO: 70232 - protein, 10 aa, Mycobacterium avium
PITGADEPFG

SEQ ID NO: 70233 - protein, 6 aa, Mycobacterium avium
PITGRE

SEQ ID NO: 70234 - protein, 4 aa, Mycobacterium avium
PITS

SEQ ID NO: 70235 - protein, 4 aa, Mycobacterium avium
PKAQ

SEQ ID NO: 70236 - protein, 10 aa, Mycobacterium avium
PKATRRSQRR

SEQ ID NO: 70237 - protein, 11 aa, Mycobacterium avium
PKATRRSQRRI

SEQ ID NO: 70238 - protein, 7 aa, Mycobacterium avium
PKAVPSR

SEQ ID NO: 70239 - protein, 7 aa, Mycobacterium avium
PKEHRGK

SEQ ID NO: 70240 - protein, 4 aa, Mycobacterium avium
PKEN

SEQ ID NO: 70241 - protein, 17 aa, Mycobacterium avium
PKEPDPWKGKPWKDIPR

SEQ ID NO: 70242 - protein, 8 aa, Mycobacterium avium
PKETGHRD

SEQ ID NO: 70243 - protein, 9 aa, Mycobacterium avium
PKGEGGPFV

SEQ ID NO: 70244 - protein, 6 aa, Mycobacterium avium
PKGPSQ

SEQ ID NO: 70245 - protein, 7 aa, Mycobacterium avium
PKGRPEV

SEQ ID NO: 70246 - protein, 6 aa, Mycobacterium avium
PKGSAE

SEQ ID NO: 70247 - protein, 8 aa, Mycobacterium avium
PKHWPQPQ

SEQ ID NO: 70248 - protein, 18 aa, Mycobacterium avium
PKKPPPPEESPVSPADES

SEQ ID NO: 70249 - protein, 4 aa, Mycobacterium avium
PKKV

SEQ ID NO: 70250 - protein, 22 aa, Mycobacterium avium
PKLEGIGERGGAPVEIDGNPTA

SEQ ID NO: 70251 - protein, 22 aa, Mycobacterium avium
PKLEGIGERGGAPVEIDSSPTA

SEQ ID NO: 70252 - protein, 5 aa, Mycobacterium avium
PKLNA

SEQ ID NO: 70253 - protein, 5 aa, Mycobacterium avium
PKPHR

SEQ ID NO: 70254 - protein, 9 aa, Mycobacterium avium
PKPSRVEQG

SEQ ID NO: 70255 - protein, 7 aa, Mycobacterium avium
PKQDRDQ

SEQ ID NO: 70256 - protein, 7 aa, Mycobacterium avium
PKQRDLE

SEQ ID NO: 70257 - protein, 8 aa, Mycobacterium avium
PKRYGAGP

SEQ ID NO: 70258 - protein, 7 aa, Mycobacterium avium
PKSARSE

SEQ ID NO: 70259 - protein, 8 aa, Mycobacterium avium
PKSECTAA

SEQ ID NO: 70260 - protein, 10 aa, Mycobacterium avium
PKSWDPPAAE

SEQ ID NO: 70261 - protein, 7 aa, Mycobacterium avium
PKTAEQI

SEQ ID NO: 70262 - protein, 14 aa, Mycobacterium avium
PKTESGKLNRPGLP

SEQ ID NO: 70263 - protein, 34 aa, Mycobacterium avium
PKTESGKLNRPGLPRPAVSTGGRTEPARTDTERA

SEQ ID NO: 70264 - protein, 9 aa, Mycobacterium avium
PKTNAPQQQ

SEQ ID NO: 70265 - protein, 18 aa, Mycobacterium avium
PKTVDPRKCQAGRNQAYY

SEQ ID NO: 70266 - protein, 23 aa, Mycobacterium avium
PKVERRTQAPGNPLTGAYRTSDG

SEQ ID NO: 70267 - protein, 5 aa, Mycobacterium avium
PKVGG

SEQ ID NO: 70268 - protein, 11 aa, Mycobacterium avium
PLAAAQADGAD

SEQ ID NO: 70269 - protein, 15 aa, Mycobacterium avium
PLAAGSGAPPIGSPV

SEQ ID NO: 70270 - protein, 10 aa, Mycobacterium avium
PLAAPASDVA

SEQ ID NO: 70271 - protein, 27 aa, Mycobacterium avium
PLAGGSQRSGQRMNSQTVGQVPGPGRF

SEQ ID NO: 70272 - protein, 7 aa, Mycobacterium avium
PLAGRSV

SEQ ID NO: 70273 - protein, 5 aa, Mycobacterium avium
PLAGT

SEQ ID NO: 70274 - protein, 11 aa, Mycobacterium avium
PLAPGDGGPEL

SEQ ID NO: 70275 - protein, 14 aa, Mycobacterium avium
PLDDAARGALADGA

SEQ ID NO: 70276 - protein, 7 aa, Mycobacterium avium
PLDDGSA

SEQ ID NO: 70277 - protein, 5 aa, Mycobacterium avium
PLDPR

SEQ ID NO: 70278 - protein, 15 aa, Mycobacterium avium
PLDTDRLGAEPPSDY

SEQ ID NO: 70279 - protein, 8 aa, Mycobacterium avium
PLDTEPRA

SEQ ID NO: 70280 - protein, 15 aa, Mycobacterium avium
PLEPGSGVPPIGAPV

SEQ ID NO: 70281 - protein, 6 aa, Mycobacterium avium
PLETTV

SEQ ID NO: 70282 - protein, 5 aa, Mycobacterium avium
PLGAS

SEQ ID NO: 70283 - protein, 4 aa, Mycobacterium avium
PLGD

SEQ ID NO: 70284 - protein, 8 aa, Mycobacterium avium
PLGDGGRI

SEQ ID NO: 70285 - protein, 11 aa, Mycobacterium avium
PLGEQRAAETE

SEQ ID NO: 70286 - protein, 11 aa, Mycobacterium avium
PLGGGEQGAQA

SEQ ID NO: 70287 - protein, 5 aa, Mycobacterium avium
PLGPA

SEQ ID NO: 70288 - protein, 5 aa, Mycobacterium avium
PLGPL

SEQ ID NO: 70289 - protein, 32 aa, Mycobacterium avium
PLGQQGSGRLQPGATIPLSRSSAYPSTEQTLS

SEQ ID NO: 70290 - protein, 7 aa, Mycobacterium avium
PLGRPAH

SEQ ID NO: 70291 - protein, 14 aa, Mycobacterium avium
PLGRSVAGARPGEQ

SEQ ID NO: 70292 - protein, 11 aa, Mycobacterium avium
PLGTATPNAKP

SEQ ID NO: 70293 - protein, 13 aa, Mycobacterium avium
PLGTGDSSQPASD

SEQ ID NO: 70294 - protein, 5 aa, Mycobacterium avium
PLGTM

SEQ ID NO: 70295 - protein, 10 aa, Mycobacterium avium
PLHDPAKEPL

SEQ ID NO: 70296 - protein, 11 aa, Mycobacterium avium
PLHDPAKEPLP

SEQ ID NO: 70297 - protein, 7 aa, Mycobacterium avium
PLHPGQA

SEQ ID NO: 70298 - protein, 11 aa, Mycobacterium avium
PLKPGSAGSGV

SEQ ID NO: 70299 - protein, 10 aa, Mycobacterium avium
PLNPRAADPE

SEQ ID NO: 70300 - protein, 49 aa, Mycobacterium avium
PLPAVPQTKPQIKPPSGPAPAPAGEPAAPDEQPGIGDDRQMESGNRQPY

SEQ ID NO: 70301 - protein, 49 aa, Mycobacterium avium
PLPAVPQTKPQTKPPSGPAPAPAGEPAAPDEQPGIGDDRQMESGNRQPY

SEQ ID NO: 70302 - protein, 5 aa, Mycobacterium avium
PLPDP

SEQ ID NO: 70303 - protein, 5 aa, Mycobacterium avium
PLPGE

SEQ ID NO: 70304 - protein, 41 aa, Mycobacterium avium
PLPGPPPGAAPLPGPPPGAAPLPDAGLGQTPPAATAPTEGG

SEQ ID NO: 70305 - protein, 22 aa, Mycobacterium avium
PLPGRRRPSSRAVRSARVIDTD

SEQ ID NO: 70306 - protein, 10 aa, Mycobacterium avium
PLPPKAAQNE

SEQ ID NO: 70307 - protein, 20 aa, Mycobacterium avium
PLPPPPSTPMPPPPPPEPGV

SEQ ID NO: 70308 - protein, 6 aa, Mycobacterium avium
PLPPPR

SEQ ID NO: 70309 - protein, 7 aa, Mycobacterium avium
PLPPQAA

SEQ ID NO: 70310 - protein, 7 aa, Mycobacterium avium
PLPPVTE

SEQ ID NO: 70311 - protein, 15 aa, Mycobacterium avium
PLQEATRTLTDEGIE

SEQ ID NO: 70312 - protein, 17 aa, Mycobacterium avium
PLRAGGAAVPIGSPVPG

SEQ ID NO: 70313 - protein, 5 aa, Mycobacterium avium
PLRDG

SEQ ID NO: 70314 - protein, 5 aa, Mycobacterium avium
PLRGP

SEQ ID NO: 70315 - protein, 7 aa, Mycobacterium avium
PLRGSKA

SEQ ID NO: 70316 - protein, 8 aa, Mycobacterium avium
PLRGSKAH

SEQ ID NO: 70317 - protein, 7 aa, Mycobacterium avium
PLRPGAL

SEQ ID NO: 70318 - protein, 11 aa, Mycobacterium avium
PLRQPGQRVGP

SEQ ID NO: 70319 - protein, 10 aa, Mycobacterium avium
PLRSPEDSHA

SEQ ID NO: 70320 - protein, 9 aa, Mycobacterium avium
PLSAEGSRF

SEQ ID NO: 70321 - protein, 8 aa, Mycobacterium avium
PLSGGASG

SEQ ID NO: 70322 - protein, 38 aa, Mycobacterium avium
PLSGPTPRDVPAPAGLDAPGVNGVPQAPPADAPPPAPV

SEQ ID NO: 70323 - protein, 4 aa, Mycobacterium avium
PLSP

SEQ ID NO: 70324 - protein, 8 aa, Mycobacterium avium
PLSPRGVK

SEQ ID NO: 70325 - protein, 5 aa, Mycobacterium avium
PLSPV

SEQ ID NO: 70326 - protein, 11 aa, Mycobacterium avium
PLTAETAQALQ

SEQ ID NO: 70327 - protein, 19 aa, Mycobacterium avium
PLTAGSTGSDAVPIGSPVP

SEQ ID NO: 70328 - protein, 8 aa, Mycobacterium avium
PLTHSGTP

SEQ ID NO: 70329 - protein, 13 aa, Mycobacterium avium
PLVPGTPDPVKDA

SEQ ID NO: 70330 - protein, 8 aa, Mycobacterium avium
PLVTDSGR

SEQ ID NO: 70331 - protein, 13 aa, Mycobacterium avium
PMAATREGETTAL

SEQ ID NO: 70332 - protein, 15 aa, Mycobacterium avium
PMAPEASAPRRTPGN

SEQ ID NO: 70333 - protein, 15 aa, Mycobacterium avium
PMAPEASARRRTPEN

SEQ ID NO: 70334 - protein, 22 aa, Mycobacterium avium
PMAPTSPVAPATSAASTPAPVA

SEQ ID NO: 70335 - protein, 9 aa, Mycobacterium avium
PMGESGAAD

SEQ ID NO: 70336 - protein, 16 aa, Mycobacterium avium
PMGSDGGAWATDPETN

SEQ ID NO: 70337 - protein, 6 aa, Mycobacterium avium
PMPEAR

SEQ ID NO: 70338 - protein, 11 aa, Mycobacterium avium
PMPGAGTPSVN

SEQ ID NO: 70339 - protein, 22 aa, Mycobacterium avium
PMPNDGPDWSARDAADAPRLGP

SEQ ID NO: 70340 - protein, 22 aa, Mycobacterium avium
PMPTDGPDWSARDAADAPRLGP

SEQ ID NO: 70341 - protein, 35 aa, Mycobacterium avium
PMSESRGDSRSSGRSSRFSRRSAPRRLSRRGRDMR

SEQ ID NO: 70342 - protein, 10 aa, Mycobacterium avium
PMTGPPPPLG

SEQ ID NO: 70343 - protein, 4 aa, Mycobacterium avium
PMTN

SEQ ID NO: 70344 - protein, 15 aa, Mycobacterium avium
PMTRTPESQQESDYG

SEQ ID NO: 70345 - protein, 5 aa, Mycobacterium avium
PNAAP

SEQ ID NO: 70346 - protein, 19 aa, Mycobacterium avium
PNAPQPARDDYRADPYPSN

SEQ ID NO: 70347 - protein, 8 aa, Mycobacterium avium
PNAPSWDT

SEQ ID NO: 70348 - protein, 4 aa, Mycobacterium avium
PNDD

SEQ ID NO: 70349 - protein, 6 aa, Mycobacterium avium
PNDTGR

SEQ ID NO: 70350 - protein, 9 aa, Mycobacterium avium
PNEETSGAC

SEQ ID NO: 70351 - protein, 6 aa, Mycobacterium avium
PNENIN

SEQ ID NO: 70352 - protein, 9 aa, Mycobacterium avium
PNEQTARAA

SEQ ID NO: 70353 - protein, 4 aa, Mycobacterium avium
PNGA

SEQ ID NO: 70354 - protein, 7 aa, Mycobacterium avium
PNGAGKT

SEQ ID NO: 70355 - protein, 8 aa, Mycobacterium avium
PNGEPGVV

SEQ ID NO: 70356 - protein, 4 aa, Mycobacterium avium
PNGR

SEQ ID NO: 70357 - protein, 4 aa, Mycobacterium avium
PNGT

SEQ ID NO: 70358 - protein, 6 aa, Mycobacterium avium
PNKVNS

SEQ ID NO: 70359 - protein, 18 aa, Mycobacterium avium
PNLAQDGKGYASGTQLGE

SEQ ID NO: 70360 - protein, 48 aa, Mycobacterium avium
PNPAPLAAPPGAAGADDAAAAGLDTARGNTTGQAPSSGGGAGAGGGSE

SEQ ID NO: 70361 - protein, 64 aa, Mycobacterium avium
PNPAPLAAPPGAPGADDAAAAGLDTARGNTIGPTPSSGGAGAGAGASGGGAPSAPADLNGPLTA

SEQ ID NO: 70362 - protein, 5 aa, Mycobacterium avium
PNPHV

SEQ ID NO: 70363 - protein, 10 aa, Mycobacterium avium
PNPHVGFGGT

SEQ ID NO: 70364 - protein, 14 aa, Mycobacterium avium
PNPMHRESGPNDAW

SEQ ID NO: 70365 - protein, 9 aa, Mycobacterium avium
PNPSSRGWT

SEQ ID NO: 70366 - protein, 13 aa, Mycobacterium avium
PNPTRAGGFPTRG

SEQ ID NO: 70367 - protein, 12 aa, Mycobacterium avium
PNQGRRGEPGPP

SEQ ID NO: 70368 - protein, 6 aa, Mycobacterium avium
PNQQLA

SEQ ID NO: 70369 - protein, 4 aa, Mycobacterium avium
PNRQ

SEQ ID NO: 70370 - protein, 9 aa, Mycobacterium avium
PNSPPPACA

SEQ ID NO: 70371 - protein, 16 aa, Mycobacterium avium
PNYDKTAKAWRADPGK

SEQ ID NO: 70372 - protein, 17 aa, Mycobacterium avium
PNYPGDPKTDEEKEITQ

SEQ ID NO: 70373 - protein, 16 aa, Mycobacterium avium
PPAAAAARSAAEKRGA

SEQ ID NO: 70374 - protein, 28 aa, Mycobacterium avium
PPAAAAGDEKKDAAEPQPEPGGDAPTKA

SEQ ID NO: 70375 - protein, 33 aa, Mycobacterium avium
PPAAPGGDGCGDTRSAPVQPVSNRRAAKHPGRR

SEQ ID NO: 70376 - protein, 7 aa, Mycobacterium avium
PPADAEA

SEQ ID NO: 70377 - protein, 10 aa, Mycobacterium avium
PPADYVTPER

SEQ ID NO: 70378 - protein, 6 aa, Mycobacterium avium
PPAELV

SEQ ID NO: 70379 - protein, 10 aa, Mycobacterium avium
PPAGAAPAGD

SEQ ID NO: 70380 - protein, 5 aa, Mycobacterium avium
PPAGE

SEQ ID NO: 70381 - protein, 10 aa, Mycobacterium avium
PPAGTAPAGD

SEQ ID NO: 70382 - protein, 8 aa, Mycobacterium avium
PPAITPNP

SEQ ID NO: 70383 - protein, 5 aa, Mycobacterium avium
PPALD

SEQ ID NO: 70384 - protein, 10 aa, Mycobacterium avium
PPANVPTPVE

SEQ ID NO: 70385 - protein, 5 aa, Mycobacterium avium
PPAPF

SEQ ID NO: 70386 - protein, 20 aa, Mycobacterium avium
PPAPPGMTDNPDRRAAGRAT

SEQ ID NO: 70387 - protein, 16 aa, Mycobacterium avium
PPAPPGPMKSPLEQQQ

SEQ ID NO: 70388 - protein, 10 aa, Mycobacterium avium
PPAPPNAPRP

SEQ ID NO: 70389 - protein, 17 aa, Mycobacterium avium
PPAPSHREYSARQHTYT

SEQ ID NO: 70390 - protein, 9 aa, Mycobacterium avium
PPAPTSGTL

SEQ ID NO: 70391 - protein, 4 aa, Mycobacterium avium
PPAR

SEQ ID NO: 70392 - protein, 16 aa, Mycobacterium avium
PPARIGRSTSAPAAAC

SEQ ID NO: 70393 - protein, 12 aa, Mycobacterium avium
PPATTATLKSDP

SEQ ID NO: 70394 - protein, 22 aa, Mycobacterium avium
PPATTMSSASRTRNRVDRSDEC

SEQ ID NO: 70395 - protein, 10 aa, Mycobacterium avium
PPDDASPCAS

SEQ ID NO: 70396 - protein, 13 aa, Mycobacterium avium
PPDELGMRLAKNS

SEQ ID NO: 70397 - protein, 14 aa, Mycobacterium avium
PPDGPLQGAPPPVD

SEQ ID NO: 70398 - protein, 8 aa, Mycobacterium avium
PPDGSPLR

SEQ ID NO: 70399 - protein, 4 aa, Mycobacterium avium
PPDL

SEQ ID NO: 70400 - protein, 10 aa, Mycobacterium avium
PPDPGAAAQE

SEQ ID NO: 70401 - protein, 10 aa, Mycobacterium avium
PPEADEQPVP

SEQ ID NO: 70402 - protein, 12 aa, Mycobacterium avium
PPEDGGAPPPAM

SEQ ID NO: 70403 - protein, 7 aa, Mycobacterium avium
PPEDTDK

SEQ ID NO: 70404 - protein, 5 aa, Mycobacterium avium
PPEEA

SEQ ID NO: 70405 - protein, 9 aa, Mycobacterium avium
PPEEKMSPD

SEQ ID NO: 70406 - protein, 6 aa, Mycobacterium avium
PPEGFD

SEQ ID NO: 70407 - protein, 5 aa, Mycobacterium avium
PPEHT

SEQ ID NO: 70408 - protein, 7 aa, Mycobacterium avium
PPEQVTV

SEQ ID NO: 70409 - protein, 23 aa, Mycobacterium avium
PPETTRLPAAPAQRDPWPSAPVP

SEQ ID NO: 70410 - protein, 4 aa, Mycobacterium avium
PPFR

SEQ ID NO: 70411 - protein, 9 aa, Mycobacterium avium
PPGAEQAPR

SEQ ID NO: 70412 - protein, 4 aa, Mycobacterium avium
PPGD

SEQ ID NO: 70413 - protein, 10 aa, Mycobacterium avium
PPGDRESATL

SEQ ID NO: 70414 - protein, 10 aa, Mycobacterium avium
PPGHHAETER

SEQ ID NO: 70415 - protein, 54 aa, Mycobacterium avium
PPGIGTGSGMAASASSSAKRKAPEPDSAAAAAAASAREAARARRRQRQRQRGFG

SEQ ID NO: 70416 - protein, 6 aa, Mycobacterium avium
PPGLGA

SEQ ID NO: 70417 - protein, 15 aa, Mycobacterium avium
PPGLTDAQAAAVTTA

SEQ ID NO: 70418 - protein, 11 aa, Mycobacterium avium
PPGQLPGDPRF

SEQ ID NO: 70419 - protein, 8 aa, Mycobacterium avium
PPGTGKTH

SEQ ID NO: 70420 - protein, 5 aa, Mycobacterium avium
PPGTL

SEQ ID NO: 70421 - protein, 4 aa, Mycobacterium avium
PPGV

SEQ ID NO: 70422 - protein, 6 aa, Mycobacterium avium
PPGVAP

SEQ ID NO: 70423 - protein, 9 aa, Mycobacterium avium
PPGYSGPAD

SEQ ID NO: 70424 - protein, 14 aa, Mycobacterium avium
PPHGADPATGQPTT

SEQ ID NO: 70425 - protein, 4 aa, Mycobacterium avium
PPIE

SEQ ID NO: 70426 - protein, 8 aa, Mycobacterium avium
PPIPRDET

SEQ ID NO: 70427 - protein, 28 aa, Mycobacterium avium
PPIRPTRTAPRCPGRPRARTGPGPAARP

SEQ ID NO: 70428 - protein, 7 aa, Mycobacterium avium
PPKYARD

SEQ ID NO: 70429 - protein, 17 aa, Mycobacterium avium
PPLGQPPRGRLQPGATI

SEQ ID NO: 70430 - protein, 11 aa, Mycobacterium avium
PPLKSATPEER

SEQ ID NO: 70431 - protein, 8 aa, Mycobacterium avium
PPLPPTGQ

SEQ ID NO: 70432 - protein, 14 aa, Mycobacterium avium
PPLQTGGLHDGQTA

SEQ ID NO: 70433 - protein, 7 aa, Mycobacterium avium
PPMRGGL

SEQ ID NO: 70434 - protein, 8 aa, Mycobacterium avium
PPNEPEAV

SEQ ID NO: 70435 - protein, 7 aa, Mycobacterium avium
PPNQLPD

SEQ ID NO: 70436 - protein, 6 aa, Mycobacterium avium
PPPAVA

SEQ ID NO: 70437 - protein, 7 aa, Mycobacterium avium
PPPEHPL

SEQ ID NO: 70438 - protein, 9 aa, Mycobacterium avium
PPPGDAGLG

SEQ ID NO: 70439 - protein, 38 aa, Mycobacterium avium
PPPGPGVAPGPVAPTPAPVSAPAPNAGGPAAPADFGGG

SEQ ID NO: 70440 - protein, 7 aa, Mycobacterium avium
PPPGSVD

SEQ ID NO: 70441 - protein, 8 aa, Mycobacterium avium
PPPGSVDA

SEQ ID NO: 70442 - protein, 6 aa, Mycobacterium avium
PPPHPD

SEQ ID NO: 70443 - protein, 10 aa, Mycobacterium avium
PPPKLGEHNE

SEQ ID NO: 70444 - protein, 10 aa, Mycobacterium avium
PPPLTTGGPP

SEQ ID NO: 70445 - protein, 15 aa, Mycobacterium avium
PPPPPPPPPPPPPPP

SEQ ID NO: 70446 - protein, 16 aa, Mycobacterium avium
PPPPQAAGKDTLPAGS

SEQ ID NO: 70447 - protein, 24 aa, Mycobacterium avium
PPPPTSPRQADGYDPLTGWSPGGR

SEQ ID NO: 70448 - protein, 13 aa, Mycobacterium avium
PPPQWDRGARTNE

SEQ ID NO: 70449 - protein, 8 aa, Mycobacterium avium
PPQALRSS

SEQ ID NO: 70450 - protein, 7 aa, Mycobacterium avium
PPQGSAI

SEQ ID NO: 70451 - protein, 17 aa, Mycobacterium avium
PPQQPSKGILNDVVKPP

SEQ ID NO: 70452 - protein, 6 aa, Mycobacterium avium
PPQVPG

SEQ ID NO: 70453 - protein, 14 aa, Mycobacterium avium
PPRLDDADATGAGE

SEQ ID NO: 70454 - protein, 11 aa, Mycobacterium avium
PPRPDGQPTFN

SEQ ID NO: 70455 - protein, 8 aa, Mycobacterium avium
PPRPEELG

SEQ ID NO: 70456 - protein, 16 aa, Mycobacterium avium
PPRPEPARGEDAGTLP

SEQ ID NO: 70457 - protein, 6 aa, Mycobacterium avium
PPRPGG

SEQ ID NO: 70458 - protein, 16 aa, Mycobacterium avium
PPRPGPARGEDAGTLP

SEQ ID NO: 70459 - protein, 22 aa, Mycobacterium avium
PPRQQNNGGRTWRTAPRAVVKQ

SEQ ID NO: 70460 - protein, 14 aa, Mycobacterium avium
PPRRQPPKTVPPLR

SEQ ID NO: 70461 - protein, 4 aa, Mycobacterium avium
PPRT

SEQ ID NO: 70462 - protein, 6 aa, Mycobacterium avium
PPRTGH

SEQ ID NO: 70463 - protein, 25 aa, Mycobacterium avium
PPSAPASTKLRNGSRIERQNTRIGQ

SEQ ID NO: 70464 - protein, 7 aa, Mycobacterium avium
PPSDDTV

SEQ ID NO: 70465 - protein, 8 aa, Mycobacterium avium
PPSGPGVR

SEQ ID NO: 70466 - protein, 7 aa, Mycobacterium avium
PPSLSPA

SEQ ID NO: 70467 - protein, 18 aa, Mycobacterium avium
PPSRPSRGTPARRPSATT

SEQ ID NO: 70468 - protein, 7 aa, Mycobacterium avium
PPSVRPE

SEQ ID NO: 70469 - protein, 5 aa, Mycobacterium avium
PPSWA

SEQ ID NO: 70470 - protein, 6 aa, Mycobacterium avium
PPTDVP

SEQ ID NO: 70471 - protein, 4 aa, Mycobacterium avium
PPTE

SEQ ID NO: 70472 - protein, 10 aa, Mycobacterium avium
PPTGAQTVTA

SEQ ID NO: 70473 - protein, 8 aa, Mycobacterium avium
PPTLTPAG

SEQ ID NO: 70474 - protein, 12 aa, Mycobacterium avium
PPTPCSASPGRA

SEQ ID NO: 70475 - protein, 15 aa, Mycobacterium avium
PPTPRGAGRSRGHPP

SEQ ID NO: 70476 - protein, 15 aa, Mycobacterium avium
PPTPRRAGRSRGHPP

SEQ ID NO: 70477 - protein, 11 aa, Mycobacterium avium
PPTSVEASRSL

SEQ ID NO: 70478 - protein, 5 aa, Mycobacterium avium
PPTTR

SEQ ID NO: 70479 - protein, 10 aa, Mycobacterium avium
PPVNPAPGGL

SEQ ID NO: 70480 - protein, 8 aa, Mycobacterium avium
PPVPVGQG

SEQ ID NO: 70481 - protein, 8 aa, Mycobacterium avium
PPYATPAE

SEQ ID NO: 70482 - protein, 9 aa, Mycobacterium avium
PPYATPAEL

SEQ ID NO: 70483 - protein, 10 aa, Mycobacterium avium
PPYATPAELR

SEQ ID NO: 70484 - protein, 11 aa, Mycobacterium avium
PPYNSGAKDWK

SEQ ID NO: 70485 - protein, 9 aa, Mycobacterium avium
PQAAGGRDV

SEQ ID NO: 70486 - protein, 5 aa, Mycobacterium avium
PQADG

SEQ ID NO: 70487 - protein, 5 aa, Mycobacterium avium
PQAEA

SEQ ID NO: 70488 - protein, 6 aa, Mycobacterium avium
PQAGGN

SEQ ID NO: 70489 - protein, 21 aa, Mycobacterium avium
PQAGGVSGQGGLQGPGGDGYG

SEQ ID NO: 70490 - protein, 10 aa, Mycobacterium avium
PQANASTALG

SEQ ID NO: 70491 - protein, 7 aa, Mycobacterium avium
PQAPIPQ

SEQ ID NO: 70492 - protein, 17 aa, Mycobacterium avium
PQAPRQRDRRKPVRPPM

SEQ ID NO: 70493 - protein, 11 aa, Mycobacterium avium
PQARAKRRERM

SEQ ID NO: 70494 - protein, 9 aa, Mycobacterium avium
PQDFDTPSE

SEQ ID NO: 70495 - protein, 7 aa, Mycobacterium avium
PQDRFGS

SEQ ID NO: 70496 - protein, 9 aa, Mycobacterium avium
PQDYPGARA

SEQ ID NO: 70497 - protein, 4 aa, Mycobacterium avium
PQEQ

SEQ ID NO: 70498 - protein, 14 aa, Mycobacterium avium
PQFDEPSLNSGGQA

SEQ ID NO: 70499 - protein, 7 aa, Mycobacterium avium
PQGALSA

SEQ ID NO: 70500 - protein, 8 aa, Mycobacterium avium
PQGDPLPD

SEQ ID NO: 70501 - protein, 12 aa, Mycobacterium avium
PQGDSRSAEETF

SEQ ID NO: 70502 - protein, 30 aa, Mycobacterium avium
PQGGHGKAGRHHRSQESGPVPRGRGQACAR

SEQ ID NO: 70503 - protein, 7 aa, Mycobacterium avium
PQGGHRR

SEQ ID NO: 70504 - protein, 5 aa, Mycobacterium avium
PQGLE

SEQ ID NO: 70505 - protein, 6 aa, Mycobacterium avium
PQGPAQ

SEQ ID NO: 70506 - protein, 5 aa, Mycobacterium avium
PQGRV

SEQ ID NO: 70507 - protein, 6 aa, Mycobacterium avium
PQGRVV

SEQ ID NO: 70508 - protein, 8 aa, Mycobacterium avium
PQHTPQYN

SEQ ID NO: 70509 - protein, 5 aa, Mycobacterium avium
PQLPP

SEQ ID NO: 70510 - protein, 5 aa, Mycobacterium avium
PQLTP

SEQ ID NO: 70511 - protein, 21 aa, Mycobacterium avium
PQNISRPGCAPGGTTLSSTPK

SEQ ID NO: 70512 - protein, 6 aa, Mycobacterium avium
PQPDPR

SEQ ID NO: 70513 - protein, 4 aa, Mycobacterium avium
PQPF

SEQ ID NO: 70514 - protein, 5 aa, Mycobacterium avium
PQPMD

SEQ ID NO: 70515 - protein, 28 aa, Mycobacterium avium
PQPPFDSGAFGKADAATVARAEEYLTGR

SEQ ID NO: 70516 - protein, 6 aa, Mycobacterium avium
PQPRSH

SEQ ID NO: 70517 - protein, 6 aa, Mycobacterium avium
PQQARK

SEQ ID NO: 70518 - protein, 18 aa, Mycobacterium avium
PQQGKTLAEHPDFPGRDL

SEQ ID NO: 70519 - protein, 6 aa, Mycobacterium avium
PQQNTS

SEQ ID NO: 70520 - protein, 6 aa, Mycobacterium avium
PQQSLT

SEQ ID NO: 70521 - protein, 15 aa, Mycobacterium avium
PQQSPFPTGKSGTTI

SEQ ID NO: 70522 - protein, 10 aa, Mycobacterium avium
PQRGGAQLRR

SEQ ID NO: 70523 - protein, 10 aa, Mycobacterium avium
PQRGRPVTGH

SEQ ID NO: 70524 - protein, 11 aa, Mycobacterium avium
PQRPNDALAQR

SEQ ID NO: 70525 - protein, 34 aa, Mycobacterium avium
PQRRPARPGGAERGGEHRDRPRIEQPSPRTARRR

SEQ ID NO: 70526 - protein, 9 aa, Mycobacterium avium
PQRSNTPFP

SEQ ID NO: 70527 - protein, 10 aa, Mycobacterium avium
PQRVTAGSEA

SEQ ID NO: 70528 - protein, 9 aa, Mycobacterium avium
PQRVTAGSQ

SEQ ID NO: 70529 - protein, 8 aa, Mycobacterium avium
PQSEGLAR

SEQ ID NO: 70530 - protein, 7 aa, Mycobacterium avium
PQSGTVR

SEQ ID NO: 70531 - protein, 18 aa, Mycobacterium avium
PQSRAYYQSKRDEGKQSI

SEQ ID NO: 70532 - protein, 6 aa, Mycobacterium avium
PQSVNS

SEQ ID NO: 70533 - protein, 14 aa, Mycobacterium avium
PQSVSEASIGSSDL

SEQ ID NO: 70534 - protein, 20 aa, Mycobacterium avium
PQSWKKPKPRDDAEALKASS

SEQ ID NO: 70535 - protein, 20 aa, Mycobacterium avium
PQSWKKPQPRDDAEALKASS

SEQ ID NO: 70536 - protein, 5 aa, Mycobacterium avium
PQSYR

SEQ ID NO: 70537 - protein, 7 aa, Mycobacterium avium
PQTEALA

SEQ ID NO: 70538 - protein, 10 aa, Mycobacterium avium
PQTSRPEFRS

SEQ ID NO: 70539 - protein, 7 aa, Mycobacterium avium
PQTWSPR

SEQ ID NO: 70540 - protein, 6 aa, Mycobacterium avium
PQVPPR

SEQ ID NO: 70541 - protein, 8 aa, Mycobacterium avium
PQVSGRYT

SEQ ID NO: 70542 - protein, 4 aa, Mycobacterium avium
PQYQ

SEQ ID NO: 70543 - protein, 6 aa, Mycobacterium avium
PQYSRK

SEQ ID NO: 70544 - protein, 20 aa, Mycobacterium avium
PRADAARYPAEFSGGQKQRI

SEQ ID NO: 70545 - protein, 5 aa, Mycobacterium avium
PRAKA

SEQ ID NO: 70546 - protein, 4 aa, Mycobacterium avium
PRAP

SEQ ID NO: 70547 - protein, 7 aa, Mycobacterium avium
PRAPAEG

SEQ ID NO: 70548 - protein, 8 aa, Mycobacterium avium
PRAPGEQR

SEQ ID NO: 70549 - protein, 15 aa, Mycobacterium avium
PRAPRDVRASGKEKS

SEQ ID NO: 70550 - protein, 7 aa, Mycobacterium avium
PRAQQDL

SEQ ID NO: 70551 - protein, 13 aa, Mycobacterium avium
PRARVEGGPGRCD

SEQ ID NO: 70552 - protein, 8 aa, Mycobacterium avium
PRATAAKY

SEQ ID NO: 70553 - protein, 17 aa, Mycobacterium avium
PRCPRAPARAAARPGRR

SEQ ID NO: 70554 - protein, 7 aa, Mycobacterium avium
PRDEQQR

SEQ ID NO: 70555 - protein, 14 aa, Mycobacterium avium
PRDLSGGNYPQVPS

SEQ ID NO: 70556 - protein, 9 aa, Mycobacterium avium
PRDPKEGDL

SEQ ID NO: 70557 - protein, 8 aa, Mycobacterium avium
PRDSHDAD

SEQ ID NO: 70558 - protein, 5 aa, Mycobacterium avium
PREAA

SEQ ID NO: 70559 - protein, 11 aa, Mycobacterium avium
PREAAAMDPRQ

SEQ ID NO: 70560 - protein, 12 aa, Mycobacterium avium
PREDMGAQGVTK

SEQ ID NO: 70561 - protein, 10 aa, Mycobacterium avium
PREEVSERAQ

SEQ ID NO: 70562 - protein, 9 aa, Mycobacterium avium
PREHGGRSL

SEQ ID NO: 70563 - protein, 10 aa, Mycobacterium avium
PREPEELPPD

SEQ ID NO: 70564 - protein, 26 aa, Mycobacterium avium
PREPEELPPDWAPDEPAYQPLPDDPP

SEQ ID NO: 70565 - protein, 12 aa, Mycobacterium avium
PREPEPDGAALG

SEQ ID NO: 70566 - protein, 8 aa, Mycobacterium avium
PRERGGYG

SEQ ID NO: 70567 - protein, 13 aa, Mycobacterium avium
PRFATNPDRVAHR

SEQ ID NO: 70568 - protein, 6 aa, Mycobacterium avium
PRGRAV

SEQ ID NO: 70569 - protein, 7 aa, Mycobacterium avium
PRGRAVH

SEQ ID NO: 70570 - protein, 6 aa, Mycobacterium avium
PRGREV

SEQ ID NO: 70571 - protein, 5 aa, Mycobacterium avium
PRGRQ

SEQ ID NO: 70572 - protein, 10 aa, Mycobacterium avium
PRGSRSRGDQ

SEQ ID NO: 70573 - protein, 13 aa, Mycobacterium avium
PRGVRRFAARARR

SEQ ID NO: 70574 - protein, 9 aa, Mycobacterium avium
PRHDAPDGI

SEQ ID NO: 70575 - protein, 6 aa, Mycobacterium avium
PRHPAG

SEQ ID NO: 70576 - protein, 20 aa, Mycobacterium avium
PRIGEDAGRLDPLTAGERPA

SEQ ID NO: 70577 - protein, 20 aa, Mycobacterium avium
PRIGEGGSGLEPLTAGERPA

SEQ ID NO: 70578 - protein, 20 aa, Mycobacterium avium
PRIGEGGSGLEPLTAGERPT

SEQ ID NO: 70579 - protein, 10 aa, Mycobacterium avium
PRIPPGKGEM

SEQ ID NO: 70580 - protein, 17 aa, Mycobacterium avium
PRIQTRPSTPLPAPAPH

SEQ ID NO: 70581 - protein, 8 aa, Mycobacterium avium
PRIRSSRG

SEQ ID NO: 70582 - protein, 9 aa, Mycobacterium avium
PRKKAARRG

SEQ ID NO: 70583 - protein, 9 aa, Mycobacterium avium
PRKPADPAL

SEQ ID NO: 70584 - protein, 7 aa, Mycobacterium avium
PRKTAAE

SEQ ID NO: 70585 - protein, 8 aa, Mycobacterium avium
PRLAAAGG

SEQ ID NO: 70586 - protein, 13 aa, Mycobacterium avium
PRLDEADATGAGE

SEQ ID NO: 70587 - protein, 10 aa, Mycobacterium avium
PRLDGQPTFN

SEQ ID NO: 70588 - protein, 8 aa, Mycobacterium avium
PRLEDGGD

SEQ ID NO: 70589 - protein, 14 aa, Mycobacterium avium
PRNDTGYGHSPEDV

SEQ ID NO: 70590 - protein, 5 aa, Mycobacterium avium
PRNDV

SEQ ID NO: 70591 - protein, 4 aa, Mycobacterium avium
PRNQ

SEQ ID NO: 70592 - protein, 12 aa, Mycobacterium avium
PRNSLPDNPISE

SEQ ID NO: 70593 - protein, 17 aa, Mycobacterium avium
PRNSTGKVLKTELRARF

SEQ ID NO: 70594 - protein, 4 aa, Mycobacterium avium
PRPA

SEQ ID NO: 70595 - protein, 12 aa, Mycobacterium avium
PRPADAPPTDRR

SEQ ID NO: 70596 - protein, 24 aa, Mycobacterium avium
PRPAPADRGPAPADGSPAPADGRP

SEQ ID NO: 70597 - protein, 24 aa, Mycobacterium avium
PRPAPAEGGPAPADGGPAPADGRP

SEQ ID NO: 70598 - protein, 19 aa, Mycobacterium avium
PRPAPSASTVSTCPPSTRS

SEQ ID NO: 70599 - protein, 9 aa, Mycobacterium avium
PRPEGHAGQ

SEQ ID NO: 70600 - protein, 13 aa, Mycobacterium avium
PRPGAGGGTNSAA

SEQ ID NO: 70601 - protein, 13 aa, Mycobacterium avium
PRPGGGGGTNSAA

SEQ ID NO: 70602 - protein, 19 aa, Mycobacterium avium
PRPGGGGGTNSAAPRVSVG

SEQ ID NO: 70603 - protein, 7 aa, Mycobacterium avium
PRPGQGR

SEQ ID NO: 70604 - protein, 14 aa, Mycobacterium avium
PRPMPERKGSTNDN

SEQ ID NO: 70605 - protein, 5 aa, Mycobacterium avium
PRPPF

SEQ ID NO: 70606 - protein, 6 aa, Mycobacterium avium
PRPRDA

SEQ ID NO: 70607 - protein, 18 aa, Mycobacterium avium
PRPRRARPGRRPYRDRRA

SEQ ID NO: 70608 - protein, 18 aa, Mycobacterium avium
PRPRRARRGRRPHRDRRA

SEQ ID NO: 70609 - protein, 6 aa, Mycobacterium avium
PRPTEL

SEQ ID NO: 70610 - protein, 4 aa, Mycobacterium avium
PRPV

SEQ ID NO: 70611 - protein, 5 aa, Mycobacterium avium
PRPVA

SEQ ID NO: 70612 - protein, 7 aa, Mycobacterium avium
PRPYTGR

SEQ ID NO: 70613 - protein, 11 aa, Mycobacterium avium
PRQRGSRRRPS

SEQ ID NO: 70614 - protein, 16 aa, Mycobacterium avium
PRRAATAAHYENRDGA

SEQ ID NO: 70615 - protein, 20 aa, Mycobacterium avium
PRRANGDESPGPLLQLVTKP

SEQ ID NO: 70616 - protein, 17 aa, Mycobacterium avium
PRRAPSQSGDPAPIGWA

SEQ ID NO: 70617 - protein, 10 aa, Mycobacterium avium
PRRDDTSHRA

SEQ ID NO: 70618 - protein, 9 aa, Mycobacterium avium
PRRGDPLTA

SEQ ID NO: 70619 - protein, 13 aa, Mycobacterium avium
PRRGYAVEQEAKT

SEQ ID NO: 70620 - protein, 49 aa, Mycobacterium avium
PRRHRPRPPRRRRPRRPRRRPPRPHPARRRPPRRGRRWPPCTASPTWSA

SEQ ID NO: 70621 - protein, 29 aa, Mycobacterium avium
PRRITPGAKRIGHRPALTGADVRPAAPPP

SEQ ID NO: 70622 - protein, 4 aa, Mycobacterium avium
PRRP

SEQ ID NO: 70623 - protein, 15 aa, Mycobacterium avium
PRRPPPPGSPRESRC

SEQ ID NO: 70624 - protein, 12 aa, Mycobacterium avium
PRRPRFSRRARQ

SEQ ID NO: 70625 - protein, 10 aa, Mycobacterium avium
PRRPSGPSKS

SEQ ID NO: 70626 - protein, 6 aa, Mycobacterium avium
PRRRGA

SEQ ID NO: 70627 - protein, 23 aa, Mycobacterium avium
PRRSPPADAPDEAHLDGGVDPDG

SEQ ID NO: 70628 - protein, 14 aa, Mycobacterium avium
PRRSPPADAPDEAY

SEQ ID NO: 70629 - protein, 7 aa, Mycobacterium avium
PRRTEEV

SEQ ID NO: 70630 - protein, 11 aa, Mycobacterium avium
PRSAASDAERT

SEQ ID NO: 70631 - protein, 11 aa, Mycobacterium avium
PRSATSDAERT

SEQ ID NO: 70632 - protein, 12 aa, Mycobacterium avium
PRSDSGAMIRTC

SEQ ID NO: 70633 - protein, 10 aa, Mycobacterium avium
PRSGELPADA

SEQ ID NO: 70634 - protein, 17 aa, Mycobacterium avium
PRSGGHSYTGASTANGT

SEQ ID NO: 70635 - protein, 10 aa, Mycobacterium avium
PRSLGDRSHD

SEQ ID NO: 70636 - protein, 4 aa, Mycobacterium avium
PRSQ

SEQ ID NO: 70637 - protein, 9 aa, Mycobacterium avium
PRSRGGDHS

SEQ ID NO: 70638 - protein, 8 aa, Mycobacterium avium
PRSSCRGI

SEQ ID NO: 70639 - protein, 6 aa, Mycobacterium avium
PRSSGI

SEQ ID NO: 70640 - protein, 19 aa, Mycobacterium avium
PRTAPSSPAGTTRRVRPSA

SEQ ID NO: 70641 - protein, 8 aa, Mycobacterium avium
PRTATADR

SEQ ID NO: 70642 - protein, 6 aa, Mycobacterium avium
PRTATG

SEQ ID NO: 70643 - protein, 15 aa, Mycobacterium avium
PRTEPRPVPWGGNQQ

SEQ ID NO: 70644 - protein, 22 aa, Mycobacterium avium
PRTGQADTKVRDAAGNESDLPT

SEQ ID NO: 70645 - protein, 7 aa, Mycobacterium avium
PRTGSTA

SEQ ID NO: 70646 - protein, 5 aa, Mycobacterium avium
PRTPM

SEQ ID NO: 70647 - protein, 16 aa, Mycobacterium avium
PRTPTSEAERSSTTAG

SEQ ID NO: 70648 - protein, 6 aa, Mycobacterium avium
PRTSLG

SEQ ID NO: 70649 - protein, 5 aa, Mycobacterium avium
PRTTI

SEQ ID NO: 70650 - protein, 5 aa, Mycobacterium avium
PRTTV

SEQ ID NO: 70651 - protein, 9 aa, Mycobacterium avium
PRVDGERGS

SEQ ID NO: 70652 - protein, 9 aa, Mycobacterium avium
PRVRGGGRT

SEQ ID NO: 70653 - protein, 4 aa, Mycobacterium avium
PRVS

SEQ ID NO: 70654 - protein, 4 aa, Mycobacterium avium
PRWT

SEQ ID NO: 70655 - protein, 8 aa, Mycobacterium avium
PSAARQVT

SEQ ID NO: 70656 - protein, 7 aa, Mycobacterium avium
PSAENPD

SEQ ID NO: 70657 - protein, 12 aa, Mycobacterium avium
PSAGGGGAGATI

SEQ ID NO: 70658 - protein, 13 aa, Mycobacterium avium
PSAGGGGAGATID

SEQ ID NO: 70659 - protein, 10 aa, Mycobacterium avium
PSAIPSDGSY

SEQ ID NO: 70660 - protein, 18 aa, Mycobacterium avium
PSAPGGRGLSAAQRRRRA

SEQ ID NO: 70661 - protein, 26 aa, Mycobacterium avium
PSAPYEGPPPGPGDLPAIDASPVRAY

SEQ ID NO: 70662 - protein, 4 aa, Mycobacterium avium
PSAR

SEQ ID NO: 70663 - protein, 22 aa, Mycobacterium avium
PSARAGREQGRREAAAVAGFLG

SEQ ID NO: 70664 - protein, 5 aa, Mycobacterium avium
PSARE

SEQ ID NO: 70665 - protein, 8 aa, Mycobacterium avium
PSARSEAL

SEQ ID NO: 70666 - protein, 9 aa, Mycobacterium avium
PSASGAPGT

SEQ ID NO: 70667 - protein, 13 aa, Mycobacterium avium
PSATADDPDDPDH

SEQ ID NO: 70668 - protein, 10 aa, Mycobacterium avium
PSDNAPADYV

SEQ ID NO: 70669 - protein, 6 aa, Mycobacterium avium
PSDPLG

SEQ ID NO: 70670 - protein, 8 aa, Mycobacterium avium
PSDRRDDY

SEQ ID NO: 70671 - protein, 5 aa, Mycobacterium avium
PSDVS

SEQ ID NO: 70672 - protein, 13 aa, Mycobacterium avium
PSEDLAAATDAEL

SEQ ID NO: 70673 - protein, 13 aa, Mycobacterium avium
PSEELAAATDAEL

SEQ ID NO: 70674 - protein, 13 aa, Mycobacterium avium
PSEELATATDAEL

SEQ ID NO: 70675 - protein, 9 aa, Mycobacterium avium
PSEHKREEA

SEQ ID NO: 70676 - protein, 7 aa, Mycobacterium avium
PSESGTF

SEQ ID NO: 70677 - protein, 4 aa, Mycobacterium avium
PSEV

SEQ ID NO: 70678 - protein, 7 aa, Mycobacterium avium
PSEVTQR

SEQ ID NO: 70679 - protein, 8 aa, Mycobacterium avium
PSEYKRAE

SEQ ID NO: 70680 - protein, 5 aa, Mycobacterium avium
PSFGN

SEQ ID NO: 70681 - protein, 14 aa, Mycobacterium avium
PSGAVRYRSGDDEH

SEQ ID NO: 70682 - protein, 15 aa, Mycobacterium avium
PSGAVRYRSGDDEHV

SEQ ID NO: 70683 - protein, 7 aa, Mycobacterium avium
PSGEGAL

SEQ ID NO: 70684 - protein, 19 aa, Mycobacterium avium
PSGGAAQLTQEAESAQRRA

SEQ ID NO: 70685 - protein, 5 aa, Mycobacterium avium
PSGGR

SEQ ID NO: 70686 - protein, 6 aa, Mycobacterium avium
PSGPVT

SEQ ID NO: 70687 - protein, 7 aa, Mycobacterium avium
PSGQAAL

SEQ ID NO: 70688 - protein, 10 aa, Mycobacterium avium
PSGQDDPVNA

SEQ ID NO: 70689 - protein, 18 aa, Mycobacterium avium
PSGRDGKRSQTHCRRSTC

SEQ ID NO: 70690 - protein, 8 aa, Mycobacterium avium
PSGRIERD

SEQ ID NO: 70691 - protein, 9 aa, Mycobacterium avium
PSGSDRSEL

SEQ ID NO: 70692 - protein, 9 aa, Mycobacterium avium
PSHSENRPA

SEQ ID NO: 70693 - protein, 6 aa, Mycobacterium avium
PSKATG

SEQ ID NO: 70694 - protein, 11 aa, Mycobacterium avium
PSKENHVNPGI

SEQ ID NO: 70695 - protein, 5 aa, Mycobacterium avium
PSKTL

SEQ ID NO: 70696 - protein, 5 aa, Mycobacterium avium
PSLAG

SEQ ID NO: 70697 - protein, 11 aa, Mycobacterium avium
PSLGKGGDDGA

SEQ ID NO: 70698 - protein, 5 aa, Mycobacterium avium
PSLLP

SEQ ID NO: 70699 - protein, 4 aa, Mycobacterium avium
PSLR

SEQ ID NO: 70700 - protein, 17 aa, Mycobacterium avium
PSLSRRAKGTPVTEGTR

SEQ ID NO: 70701 - protein, 12 aa, Mycobacterium avium
PSMAPPGKHAAS

SEQ ID NO: 70702 - protein, 8 aa, Mycobacterium avium
PSMSPPGK

SEQ ID NO: 70703 - protein, 10 aa, Mycobacterium avium
PSNANPAAQE

SEQ ID NO: 70704 - protein, 7 aa, Mycobacterium avium
PSNDPSV

SEQ ID NO: 70705 - protein, 13 aa, Mycobacterium avium
PSNEGQPVNDSGD

SEQ ID NO: 70706 - protein, 12 aa, Mycobacterium avium
PSNVDRDANESR

SEQ ID NO: 70707 - protein, 5 aa, Mycobacterium avium
PSPAE

SEQ ID NO: 70708 - protein, 12 aa, Mycobacterium avium
PSPASPELPPDT

SEQ ID NO: 70709 - protein, 5 aa, Mycobacterium avium
PSPGM

SEQ ID NO: 70710 - protein, 6 aa, Mycobacterium avium
PSPLPG

SEQ ID NO: 70711 - protein, 6 aa, Mycobacterium avium
PSPLTP

SEQ ID NO: 70712 - protein, 13 aa, Mycobacterium avium
PSPRAATLQISSD

SEQ ID NO: 70713 - protein, 8 aa, Mycobacterium avium
PSPSDWSP

SEQ ID NO: 70714 - protein, 4 aa, Mycobacterium avium
PSPY

SEQ ID NO: 70715 - protein, 20 aa, Mycobacterium avium
PSQATIPEPQALDDDPAHDE

SEQ ID NO: 70716 - protein, 7 aa, Mycobacterium avium
PSQDTTR

SEQ ID NO: 70717 - protein, 12 aa, Mycobacterium avium
PSQPADQGLQRP

SEQ ID NO: 70718 - protein, 13 aa, Mycobacterium avium
PSQTVIGGPPEQI

SEQ ID NO: 70719 - protein, 118 aa, Mycobacterium avium
PSQVPVPAGGSSGEAASVGAHSPSSASSAAPHFESPGGRPSEVPAPNGGAHGPGESGPAGGHPPGEPPHGGKPSGDGGPPDEDSHRDGTPGNGDDGAAGEIDDGPAGVDGQSTPAKVA

SEQ ID NO: 70720 - protein, 6 aa, Mycobacterium avium
PSRGTG

SEQ ID NO: 70721 - protein, 6 aa, Mycobacterium avium
PSRKDR

SEQ ID NO: 70722 - protein, 5 aa, Mycobacterium avium
PSRPV

SEQ ID NO: 70723 - protein, 12 aa, Mycobacterium avium
PSRSAGSPRTSV

SEQ ID NO: 70724 - protein, 7 aa, Mycobacterium avium
PSRSPRH

SEQ ID NO: 70725 - protein, 15 aa, Mycobacterium avium
PSRTAGRAGAGGHPC

SEQ ID NO: 70726 - protein, 9 aa, Mycobacterium avium
PSRTAKDSL

SEQ ID NO: 70727 - protein, 4 aa, Mycobacterium avium
PSSA

SEQ ID NO: 70728 - protein, 6 aa, Mycobacterium avium
PSSAAS

SEQ ID NO: 70729 - protein, 7 aa, Mycobacterium avium
PSSCGKT

SEQ ID NO: 70730 - protein, 5 aa, Mycobacterium avium
PSSET

SEQ ID NO: 70731 - protein, 7 aa, Mycobacterium avium
PSTALRA

SEQ ID NO: 70732 - protein, 11 aa, Mycobacterium avium
PSTAQTGARGL

SEQ ID NO: 70733 - protein, 5 aa, Mycobacterium avium
PSTEA

SEQ ID NO: 70734 - protein, 10 aa, Mycobacterium avium
PSTEALSPNS

SEQ ID NO: 70735 - protein, 9 aa, Mycobacterium avium
PSTGHDPSH

SEQ ID NO: 70736 - protein, 9 aa, Mycobacterium avium
PSTPGSPVP

SEQ ID NO: 70737 - protein, 5 aa, Mycobacterium avium
PSTRK

SEQ ID NO: 70738 - protein, 7 aa, Mycobacterium avium
PSTTPTS

SEQ ID NO: 70739 - protein, 28 aa, Mycobacterium avium
PSVEETPTGAPGTVKVGTPKGSVTQLAD

SEQ ID NO: 70740 - protein, 30 aa, Mycobacterium avium
PSVPSAPTGPVSGAPVAPSPASSPSAGGTL

SEQ ID NO: 70741 - protein, 4 aa, Mycobacterium avium
PSVR

SEQ ID NO: 70742 - protein, 7 aa, Mycobacterium avium
PSYPEEG

SEQ ID NO: 70743 - protein, 7 aa, Mycobacterium avium
PTAAAPE

SEQ ID NO: 70744 - protein, 13 aa, Mycobacterium avium
PTAAPEWNDPAGV

SEQ ID NO: 70745 - protein, 13 aa, Mycobacterium avium
PTADGEPGNDDLG

SEQ ID NO: 70746 - protein, 6 aa, Mycobacterium avium
PTAEQQ

SEQ ID NO: 70747 - protein, 6 aa, Mycobacterium avium
PTAGPV

SEQ ID NO: 70748 - protein, 7 aa, Mycobacterium avium
PTALRGA

SEQ ID NO: 70749 - protein, 7 aa, Mycobacterium avium
PTAPPDG

SEQ ID NO: 70750 - protein, 5 aa, Mycobacterium avium
PTAPV

SEQ ID NO: 70751 - protein, 9 aa, Mycobacterium avium
PTAQLPPKS

SEQ ID NO: 70752 - protein, 10 aa, Mycobacterium avium
PTAQSCTKAL

SEQ ID NO: 70753 - protein, 7 aa, Mycobacterium avium
PTARPLT

SEQ ID NO: 70754 - protein, 32 aa, Mycobacterium avium
PTCASTSGCRRSRPTRGPGRDSAWSCPSCCPT

SEQ ID NO: 70755 - protein, 8 aa, Mycobacterium avium
PTDANGPM

SEQ ID NO: 70756 - protein, 12 aa, Mycobacterium avium
PTDEHGDPDGET

SEQ ID NO: 70757 - protein, 29 aa, Mycobacterium avium
PTDFPEEGGPGDTLNASEGTDSDELRNHD

SEQ ID NO: 70758 - protein, 5 aa, Mycobacterium avium
PTDGT

SEQ ID NO: 70759 - protein, 16 aa, Mycobacterium avium
PTDPQPELAQSHRADD

SEQ ID NO: 70760 - protein, 8 aa, Mycobacterium avium
PTEDRREH

SEQ ID NO: 70761 - protein, 6 aa, Mycobacterium avium
PTEKGR

SEQ ID NO: 70762 - protein, 8 aa, Mycobacterium avium
PTEPEPPY

SEQ ID NO: 70763 - protein, 7 aa, Mycobacterium avium
PTEPGGY

SEQ ID NO: 70764 - protein, 6 aa, Mycobacterium avium
PTEQGY

SEQ ID NO: 70765 - protein, 4 aa, Mycobacterium avium
PTET

SEQ ID NO: 70766 - protein, 4 aa, Mycobacterium avium
PTEW

SEQ ID NO: 70767 - protein, 4 aa, Mycobacterium avium
PTFE

SEQ ID NO: 70768 - protein, 7 aa, Mycobacterium avium
PTFNQAG

SEQ ID NO: 70769 - protein, 5 aa, Mycobacterium avium
PTFPD

SEQ ID NO: 70770 - protein, 15 aa, Mycobacterium avium
PTGEPDADYNTYKHH

SEQ ID NO: 70771 - protein, 8 aa, Mycobacterium avium
PTGGDNPH

SEQ ID NO: 70772 - protein, 10 aa, Mycobacterium avium
PTGGTDERDL

SEQ ID NO: 70773 - protein, 5 aa, Mycobacterium avium
PTGIQ

SEQ ID NO: 70774 - protein, 4 aa, Mycobacterium avium
PTGL

SEQ ID NO: 70775 - protein, 6 aa, Mycobacterium avium
PTGNGE

SEQ ID NO: 70776 - protein, 5 aa, Mycobacterium avium
PTGPV

SEQ ID NO: 70777 - protein, 6 aa, Mycobacterium avium
PTGPVT

SEQ ID NO: 70778 - protein, 13 aa, Mycobacterium avium
PTGYHVGRANHRV

SEQ ID NO: 70779 - protein, 12 aa, Mycobacterium avium
PTIGSAHKGIET

SEQ ID NO: 70780 - protein, 4 aa, Mycobacterium avium
PTIP

SEQ ID NO: 70781 - protein, 4 aa, Mycobacterium avium
PTKH

SEQ ID NO: 70782 - protein, 5 aa, Mycobacterium avium
PTLAA

SEQ ID NO: 70783 - protein, 5 aa, Mycobacterium avium
PTLGD

SEQ ID NO: 70784 - protein, 18 aa, Mycobacterium avium
PTLGEPEPAVGGRTKSGG

SEQ ID NO: 70785 - protein, 10 aa, Mycobacterium avium
PTLPGSRNGG

SEQ ID NO: 70786 - protein, 14 aa, Mycobacterium avium
PTLPTLPEETGTLP

SEQ ID NO: 70787 - protein, 5 aa, Mycobacterium avium
PTLSG

SEQ ID NO: 70788 - protein, 5 aa, Mycobacterium avium
PTLVG

SEQ ID NO: 70789 - protein, 4 aa, Mycobacterium avium
PTMG

SEQ ID NO: 70790 - protein, 10 aa, Mycobacterium avium
PTNGGSVNAV

SEQ ID NO: 70791 - protein, 6 aa, Mycobacterium avium
PTPAEA

SEQ ID NO: 70792 - protein, 35 aa, Mycobacterium avium
PTPEHEAAAQVPRPDNVPGGDLPNNPRDFKTPNYG

SEQ ID NO: 70793 - protein, 4 aa, Mycobacterium avium
PTPG

SEQ ID NO: 70794 - protein, 5 aa, Mycobacterium avium
PTPGA

SEQ ID NO: 70795 - protein, 9 aa, Mycobacterium avium
PTPGATPTL

SEQ ID NO: 70796 - protein, 5 aa, Mycobacterium avium
PTPGV

SEQ ID NO: 70797 - protein, 4 aa, Mycobacterium avium
PTPL

SEQ ID NO: 70798 - protein, 39 aa, Mycobacterium avium
PTPQPRARQPRLTQPRLTRPSSPSRSCRASGPTSPTRSR

SEQ ID NO: 70799 - protein, 37 aa, Mycobacterium avium
PTPQPRARQPRLTQPRPTRPSSPSRSCRASGPISPTP

SEQ ID NO: 70800 - protein, 36 aa, Mycobacterium avium
PTPQPRARQPRLTQSRPTRPSSPSCRASGPTSPTPW

SEQ ID NO: 70801 - protein, 9 aa, Mycobacterium avium
PTPTNTDDQ

SEQ ID NO: 70802 - protein, 4 aa, Mycobacterium avium
PTPV

SEQ ID NO: 70803 - protein, 37 aa, Mycobacterium avium
PTPVAPAAAPASAPAPAPATTATTVAPAPAAPAPVAA

SEQ ID NO: 70804 - protein, 14 aa, Mycobacterium avium
PTPYGGPVLPIEPP

SEQ ID NO: 70805 - protein, 5 aa, Mycobacterium avium
PTQDR

SEQ ID NO: 70806 - protein, 4 aa, Mycobacterium avium
PTRE

SEQ ID NO: 70807 - protein, 6 aa, Mycobacterium avium
PTREAA

SEQ ID NO: 70808 - protein, 19 aa, Mycobacterium avium
PTRGENMRRRGAQQRLGSK

SEQ ID NO: 70809 - protein, 11 aa, Mycobacterium avium
PTRLGGQRRYD

SEQ ID NO: 70810 - protein, 4 aa, Mycobacterium avium
PTRR

SEQ ID NO: 70811 - protein, 5 aa, Mycobacterium avium
PTRRK

SEQ ID NO: 70812 - protein, 7 aa, Mycobacterium avium
PTRSLGA

SEQ ID NO: 70813 - protein, 7 aa, Mycobacterium avium
PTRYGAP

SEQ ID NO: 70814 - protein, 4 aa, Mycobacterium avium
PTSA

SEQ ID NO: 70815 - protein, 7 aa, Mycobacterium avium
PTSNIHS

SEQ ID NO: 70816 - protein, 6 aa, Mycobacterium avium
PTTAQT

SEQ ID NO: 70817 - protein, 9 aa, Mycobacterium avium
PTTDPDDVA

SEQ ID NO: 70818 - protein, 4 aa, Mycobacterium avium
PTTL

SEQ ID NO: 70819 - protein, 7 aa, Mycobacterium avium
PTTPIGK

SEQ ID NO: 70820 - protein, 6 aa, Mycobacterium avium
PTTPVS

SEQ ID NO: 70821 - protein, 7 aa, Mycobacterium avium
PTTQSAD

SEQ ID NO: 70822 - protein, 12 aa, Mycobacterium avium
PTTREGVQPNDD

SEQ ID NO: 70823 - protein, 14 aa, Mycobacterium avium
PTTSDQAEHTITQA

SEQ ID NO: 70824 - protein, 20 aa, Mycobacterium avium
PTTVTDPEPGGTDTAGPGGR

SEQ ID NO: 70825 - protein, 4 aa, Mycobacterium avium
PTVA

SEQ ID NO: 70826 - protein, 11 aa, Mycobacterium avium
PTVDADTTALQ

SEQ ID NO: 70827 - protein, 18 aa, Mycobacterium avium
PTVLPDPRSPRQPDGVHT

SEQ ID NO: 70828 - protein, 17 aa, Mycobacterium avium
PTVLPDPRSPRQPEGVH

SEQ ID NO: 70829 - protein, 17 aa, Mycobacterium avium
PTVLPDPRSPRQPNGVH

SEQ ID NO: 70830 - protein, 4 aa, Mycobacterium avium
PTVP

SEQ ID NO: 70831 - protein, 5 aa, Mycobacterium avium
PTVPQ

SEQ ID NO: 70832 - protein, 13 aa, Mycobacterium avium
PTVRSPGGGAEYG

SEQ ID NO: 70833 - protein, 5 aa, Mycobacterium avium
PTVTE

SEQ ID NO: 70834 - protein, 4 aa, Mycobacterium avium
PTWT

SEQ ID NO: 70835 - protein, 8 aa, Mycobacterium avium
PTYGEETE

SEQ ID NO: 70836 - protein, 6 aa, Mycobacterium avium
PTYPED

SEQ ID NO: 70837 - protein, 4 aa, Mycobacterium avium
PTYR

SEQ ID NO: 70838 - protein, 10 aa, Mycobacterium avium
PVAADPNLGR

SEQ ID NO: 70839 - protein, 22 aa, Mycobacterium avium
PVAEPTGGPHEPASVPAAGSRL

SEQ ID NO: 70840 - protein, 4 aa, Mycobacterium avium
PVAG

SEQ ID NO: 70841 - protein, 17 aa, Mycobacterium avium
PVAGPAITPANARIGAP

SEQ ID NO: 70842 - protein, 14 aa, Mycobacterium avium
PVAGTGANPGIPGI

SEQ ID NO: 70843 - protein, 4 aa, Mycobacterium avium
PVAS

SEQ ID NO: 70844 - protein, 8 aa, Mycobacterium avium
PVDDSTSD

SEQ ID NO: 70845 - protein, 7 aa, Mycobacterium avium
PVDDTRS

SEQ ID NO: 70846 - protein, 22 aa, Mycobacterium avium
PVDPNAPPPPPADPNAGRIPNA

SEQ ID NO: 70847 - protein, 4 aa, Mycobacterium avium
PVGA

SEQ ID NO: 70848 - protein, 5 aa, Mycobacterium avium
PVGAQ

SEQ ID NO: 70849 - protein, 7 aa, Mycobacterium avium
PVGATGG

SEQ ID NO: 70850 - protein, 15 aa, Mycobacterium avium
PVGDGERREQGDGRD

SEQ ID NO: 70851 - protein, 5 aa, Mycobacterium avium
PVHSR

SEQ ID NO: 70852 - protein, 4 aa, Mycobacterium avium
PVNG

SEQ ID NO: 70853 - protein, 19 aa, Mycobacterium avium
PVNPSGGLKAKGHPPGATG

SEQ ID NO: 70854 - protein, 16 aa, Mycobacterium avium
PVNPSGGVLSSNPIGA

SEQ ID NO: 70855 - protein, 9 aa, Mycobacterium avium
PVNTGSDDI

SEQ ID NO: 70856 - protein, 11 aa, Mycobacterium avium
PVPAAGRDEPY

SEQ ID NO: 70857 - protein, 9 aa, Mycobacterium avium
PVPAEQTAL

SEQ ID NO: 70858 - protein, 10 aa, Mycobacterium avium
PVPAGQEALA

SEQ ID NO: 70859 - protein, 5 aa, Mycobacterium avium
PVPDG

SEQ ID NO: 70860 - protein, 4 aa, Mycobacterium avium
PVPG

SEQ ID NO: 70861 - protein, 9 aa, Mycobacterium avium
PVPHASSPL

SEQ ID NO: 70862 - protein, 6 aa, Mycobacterium avium
PVPPGW

SEQ ID NO: 70863 - protein, 15 aa, Mycobacterium avium
PVPREDGTSRSPALP

SEQ ID NO: 70864 - protein, 19 aa, Mycobacterium avium
PVPSDSGKRTGRLHTPQRY

SEQ ID NO: 70865 - protein, 5 aa, Mycobacterium avium
PVPSP

SEQ ID NO: 70866 - protein, 12 aa, Mycobacterium avium
PVPSRFGGSRSM

SEQ ID NO: 70867 - protein, 4 aa, Mycobacterium avium
PVPT

SEQ ID NO: 70868 - protein, 5 aa, Mycobacterium avium
PVPTT

SEQ ID NO: 70869 - protein, 13 aa, Mycobacterium avium
PVPVGDDGSLPAD

SEQ ID NO: 70870 - protein, 7 aa, Mycobacterium avium
PVPVGQG

SEQ ID NO: 70871 - protein, 10 aa, Mycobacterium avium
PVRAPATERK

SEQ ID NO: 70872 - protein, 5 aa, Mycobacterium avium
PVRGG

SEQ ID NO: 70873 - protein, 11 aa, Mycobacterium avium
PVRKTAGAGGE

SEQ ID NO: 70874 - protein, 7 aa, Mycobacterium avium
PVRTPGA

SEQ ID NO: 70875 - protein, 5 aa, Mycobacterium avium
PVSAP

SEQ ID NO: 70876 - protein, 12 aa, Mycobacterium avium
PVSGGPARGQVQ

SEQ ID NO: 70877 - protein, 7 aa, Mycobacterium avium
PVSGHGA

SEQ ID NO: 70878 - protein, 5 aa, Mycobacterium avium
PVSPT

SEQ ID NO: 70879 - protein, 4 aa, Mycobacterium avium
PVSR

SEQ ID NO: 70880 - protein, 10 aa, Mycobacterium avium
PVSSAERSRV

SEQ ID NO: 70881 - protein, 7 aa, Mycobacterium avium
PVTASYN

SEQ ID NO: 70882 - protein, 4 aa, Mycobacterium avium
PVTD

SEQ ID NO: 70883 - protein, 5 aa, Mycobacterium avium
PVTGD

SEQ ID NO: 70884 - protein, 8 aa, Mycobacterium avium
PVTGDAQR

SEQ ID NO: 70885 - protein, 5 aa, Mycobacterium avium
PVTNA

SEQ ID NO: 70886 - protein, 4 aa, Mycobacterium avium
PVTP

SEQ ID NO: 70887 - protein, 7 aa, Mycobacterium avium
PVTPTGK

SEQ ID NO: 70888 - protein, 17 aa, Mycobacterium avium
PVTQPHTVPDTADQQQA

SEQ ID NO: 70889 - protein, 19 aa, Mycobacterium avium
PVYAPNSAGGPHADPARAG

SEQ ID NO: 70890 - protein, 19 aa, Mycobacterium avium
PVYAPNSAGGPQADPARAG

SEQ ID NO: 70891 - protein, 11 aa, Mycobacterium avium
PWADQRPTFRE

SEQ ID NO: 70892 - protein, 12 aa, Mycobacterium avium
PWEPSAEGDWTT

SEQ ID NO: 70893 - protein, 5 aa, Mycobacterium avium
PWGTP

SEQ ID NO: 70894 - protein, 4 aa, Mycobacterium avium
PWMG

SEQ ID NO: 70895 - protein, 5 aa, Mycobacterium avium
PWPAH

SEQ ID NO: 70896 - protein, 10 aa, Mycobacterium avium
PWPATDGQRI

SEQ ID NO: 70897 - protein, 13 aa, Mycobacterium avium
PWPDRGGPRRAGV

SEQ ID NO: 70898 - protein, 11 aa, Mycobacterium avium
PWPKTSGSRGF

SEQ ID NO: 70899 - protein, 5 aa, Mycobacterium avium
PWPPR

SEQ ID NO: 70900 - protein, 13 aa, Mycobacterium avium
PWQGYGGRQKPSR

SEQ ID NO: 70901 - protein, 12 aa, Mycobacterium avium
PWRGPEDIATNT

SEQ ID NO: 70902 - protein, 9 aa, Mycobacterium avium
PWVGPGPRQ

SEQ ID NO: 70903 - protein, 13 aa, Mycobacterium avium
PYAPQGVAKPVDG

SEQ ID NO: 70904 - protein, 10 aa, Mycobacterium avium
PYDGGDDGAI

SEQ ID NO: 70905 - protein, 11 aa, Mycobacterium avium
PYDGGDDGAVE

SEQ ID NO: 70906 - protein, 18 aa, Mycobacterium avium
PYDRRRPRNDSASQSPCP

SEQ ID NO: 70907 - protein, 16 aa, Mycobacterium avium
PYEDPDQTGWESPISA

SEQ ID NO: 70908 - protein, 11 aa, Mycobacterium avium
PYGAQSAGPPP

SEQ ID NO: 70909 - protein, 11 aa, Mycobacterium avium
PYGGDPGSRLY

SEQ ID NO: 70910 - protein, 6 aa, Mycobacterium avium
PYGGPD

SEQ ID NO: 70911 - protein, 6 aa, Mycobacterium avium
PYGGPR

SEQ ID NO: 70912 - protein, 7 aa, Mycobacterium avium
PYGGPRP

SEQ ID NO: 70913 - protein, 4 aa, Mycobacterium avium
PYGP

SEQ ID NO: 70914 - protein, 8 aa, Mycobacterium avium
PYPAEAQS

SEQ ID NO: 70915 - protein, 16 aa, Mycobacterium avium
PYPPDLQHALDVLRDE

SEQ ID NO: 70916 - protein, 5 aa, Mycobacterium avium
PYPTY

SEQ ID NO: 70917 - protein, 10 aa, Mycobacterium avium
PYQGAATGVG

SEQ ID NO: 70918 - protein, 22 aa, Mycobacterium avium
PYRNDGARGWTGTSPVGTFAPN

SEQ ID NO: 70919 - protein, 17 aa, Mycobacterium avium
PYRRGRRHPGPSGDRRT

SEQ ID NO: 70920 - protein, 16 aa, Mycobacterium avium
PYSDPGMDGPTIARAT

SEQ ID NO: 70921 - protein, 11 aa, Mycobacterium avium
PYSREQAAYPL

SEQ ID NO: 70922 - protein, 21 aa, Mycobacterium avium
PYSRGGEKPDGRLYPEDQPDR

SEQ ID NO: 70923 - protein, 16 aa, Mycobacterium avium
PYSTKRSLPQQLRAMV

SEQ ID NO: 70924 - protein, 8 aa, Mycobacterium avium
PYTGAPTV

SEQ ID NO: 70925 - protein, 12 aa, Mycobacterium avium
QAAADTPSPAEL

SEQ ID NO: 70926 - protein, 13 aa, Mycobacterium avium
QAAAGDGLPSATP

SEQ ID NO: 70927 - protein, 13 aa, Mycobacterium avium
QAAAGKGLTGGGT

SEQ ID NO: 70928 - protein, 7 aa, Mycobacterium avium
QAADMDG

SEQ ID NO: 70929 - protein, 5 aa, Mycobacterium avium
QAADQ

SEQ ID NO: 70930 - protein, 47 aa, Mycobacterium avium
QAAGLNPGQQLGEAGVAGQVDPQHQRVDEEADQPVERGVAPPGDREA

SEQ ID NO: 70931 - protein, 9 aa, Mycobacterium avium
QAAGQSNTS

SEQ ID NO: 70932 - protein, 7 aa, Mycobacterium avium
QAAGRRG

SEQ ID NO: 70933 - protein, 9 aa, Mycobacterium avium
QAAKADGVA

SEQ ID NO: 70934 - protein, 6 aa, Mycobacterium avium
QAAPVG

SEQ ID NO: 70935 - protein, 5 aa, Mycobacterium avium
QAAQA

SEQ ID NO: 70936 - protein, 14 aa, Mycobacterium avium
QAARKGKAYSENLE

SEQ ID NO: 70937 - protein, 17 aa, Mycobacterium avium
QAARRVPNGGASPSQSQ

SEQ ID NO: 70938 - protein, 16 aa, Mycobacterium avium
QAASAGVGPTGPGGMG

SEQ ID NO: 70939 - protein, 8 aa, Mycobacterium avium
QAASATEV

SEQ ID NO: 70940 - protein, 8 aa, Mycobacterium avium
QAATAPSR

SEQ ID NO: 70941 - protein, 12 aa, Mycobacterium avium
QADEHRKRHGGN

SEQ ID NO: 70942 - protein, 7 aa, Mycobacterium avium
QADGSTI

SEQ ID NO: 70943 - protein, 4 aa, Mycobacterium avium
QADP

SEQ ID NO: 70944 - protein, 5 aa, Mycobacterium avium
QADPA

SEQ ID NO: 70945 - protein, 8 aa, Mycobacterium avium
QADPLTGR

SEQ ID NO: 70946 - protein, 9 aa, Mycobacterium avium
QADRPTPDI

SEQ ID NO: 70947 - protein, 7 aa, Mycobacterium avium
QADVDAG

SEQ ID NO: 70948 - protein, 17 aa, Mycobacterium avium
QAEGDPSTLNMIRRLRV

SEQ ID NO: 70949 - protein, 6 aa, Mycobacterium avium
QAEHPG

SEQ ID NO: 70950 - protein, 4 aa, Mycobacterium avium
QAEL

SEQ ID NO: 70951 - protein, 9 aa, Mycobacterium avium
QAESAMGSA

SEQ ID NO: 70952 - protein, 6 aa, Mycobacterium avium
QAETLE

SEQ ID NO: 70953 - protein, 10 aa, Mycobacterium avium
QAFDAAEGSM

SEQ ID NO: 70954 - protein, 9 aa, Mycobacterium avium
QAGADPQLY

SEQ ID NO: 70955 - protein, 5 aa, Mycobacterium avium
QAGAG

SEQ ID NO: 70956 - protein, 6 aa, Mycobacterium avium
QAGAGV

SEQ ID NO: 70957 - protein, 6 aa, Mycobacterium avium
QAGDAL

SEQ ID NO: 70958 - protein, 70 aa, Mycobacterium avium
QAGDASDPALQDLGDEDLPEDQGQQHDSPADGSAEQADDENASADEPPAGPTSVTLPDGETVAAASPQLA

SEQ ID NO: 70959 - protein, 4 aa, Mycobacterium avium
QAGE

SEQ ID NO: 70960 - protein, 18 aa, Mycobacterium avium
QAGEYRDHEATAPWTRPE

SEQ ID NO: 70961 - protein, 17 aa, Mycobacterium avium
QAGGDTARTKSCPKLGD

SEQ ID NO: 70962 - protein, 6 aa, Mycobacterium avium
QAGIAA

SEQ ID NO: 70963 - protein, 34 aa, Mycobacterium avium
QAGLPDGDQGVQPVEPATVQRRDHGGGQDGRADP

SEQ ID NO: 70964 - protein, 12 aa, Mycobacterium avium
QAGLPGADLDDT

SEQ ID NO: 70965 - protein, 5 aa, Mycobacterium avium
QAGMA

SEQ ID NO: 70966 - protein, 7 aa, Mycobacterium avium
QAGMTRS

SEQ ID NO: 70967 - protein, 13 aa, Mycobacterium avium
QAGRRPDAEHGPG

SEQ ID NO: 70968 - protein, 7 aa, Mycobacterium avium
QAGSPLQ

SEQ ID NO: 70969 - protein, 5 aa, Mycobacterium avium
QAGVK

SEQ ID NO: 70970 - protein, 7 aa, Mycobacterium avium
QAHPEDT

SEQ ID NO: 70971 - protein, 6 aa, Mycobacterium avium
QAITRP

SEQ ID NO: 70972 - protein, 9 aa, Mycobacterium avium
QAKNPKYLR

SEQ ID NO: 70973 - protein, 12 aa, Mycobacterium avium
QALADPKRNTAL

SEQ ID NO: 70974 - protein, 6 aa, Mycobacterium avium
QALAPN

SEQ ID NO: 70975 - protein, 35 aa, Mycobacterium avium
QALDAPAESPPNPVIETPEPPTESLKTSSSASRRV

SEQ ID NO: 70976 - protein, 4 aa, Mycobacterium avium
QALE

SEQ ID NO: 70977 - protein, 7 aa, Mycobacterium avium
QALPPGR

SEQ ID NO: 70978 - protein, 4 aa, Mycobacterium avium
QALT

SEQ ID NO: 70979 - protein, 12 aa, Mycobacterium avium
QANASAERTRQV

SEQ ID NO: 70980 - protein, 4 aa, Mycobacterium avium
QANQ

SEQ ID NO: 70981 - protein, 9 aa, Mycobacterium avium
QAPDDPEVR

SEQ ID NO: 70982 - protein, 16 aa, Mycobacterium avium
QAPENGFAGNPIESNH

SEQ ID NO: 70983 - protein, 15 aa, Mycobacterium avium
QAPGHTGEPASGDLT

SEQ ID NO: 70984 - protein, 15 aa, Mycobacterium avium
QAPNASGGVKPTPAG

SEQ ID NO: 70985 - protein, 7 aa, Mycobacterium avium
QAPQGIT

SEQ ID NO: 70986 - protein, 25 aa, Mycobacterium avium
QAPRDRRSSSPSGAGGPGPRSGSDA

SEQ ID NO: 70987 - protein, 10 aa, Mycobacterium avium
QAPSTVADAE

SEQ ID NO: 70988 - protein, 17 aa, Mycobacterium avium
QAPTFGPPKTRASNRAI

SEQ ID NO: 70989 - protein, 7 aa, Mycobacterium avium
QAPTQVE

SEQ ID NO: 70990 - protein, 8 aa, Mycobacterium avium
QAQAAEAD

SEQ ID NO: 70991 - protein, 9 aa, Mycobacterium avium
QAQAAEAEG

SEQ ID NO: 70992 - protein, 12 aa, Mycobacterium avium
QAQAHPAAAKGA

SEQ ID NO: 70993 - protein, 23 aa, Mycobacterium avium
QAQPTLDAAARAGQARDSLAQSQ

SEQ ID NO: 70994 - protein, 6 aa, Mycobacterium avium
QAQQQG

SEQ ID NO: 70995 - protein, 16 aa, Mycobacterium avium
QAQQRARAGEISPEQV

SEQ ID NO: 70996 - protein, 16 aa, Mycobacterium avium
QAQQRARAGKISPEQV

SEQ ID NO: 70997 - protein, 11 aa, Mycobacterium avium
QAQRVREGEVP

SEQ ID NO: 70998 - protein, 5 aa, Mycobacterium avium
QARDA

SEQ ID NO: 70999 - protein, 15 aa, Mycobacterium avium
QARLANDPTAPPPNT

SEQ ID NO: 71000 - protein, 13 aa, Mycobacterium avium
QARLDEPDSRPVP

SEQ ID NO: 71001 - protein, 6 aa, Mycobacterium avium
QARNTQ

SEQ ID NO: 71002 - protein, 14 aa, Mycobacterium avium
QASFDSNKDLANVP

SEQ ID NO: 71003 - protein, 4 aa, Mycobacterium avium
QASP

SEQ ID NO: 71004 - protein, 8 aa, Mycobacterium avium
QASSQLDR

SEQ ID NO: 71005 - protein, 6 aa, Mycobacterium avium
QATAAA

SEQ ID NO: 71006 - protein, 7 aa, Mycobacterium avium
QATEEVA

SEQ ID NO: 71007 - protein, 7 aa, Mycobacterium avium
QATGAGV

SEQ ID NO: 71008 - protein, 14 aa, Mycobacterium avium
QATRSAKSSGGNNV

SEQ ID NO: 71009 - protein, 15 aa, Mycobacterium avium
QATSTDDAEGDVARS

SEQ ID NO: 71010 - protein, 5 aa, Mycobacterium avium
QATTA

SEQ ID NO: 71011 - protein, 6 aa, Mycobacterium avium
QATTSL

SEQ ID NO: 71012 - protein, 15 aa, Mycobacterium avium
QATVSQSVAQEELGR

SEQ ID NO: 71013 - protein, 6 aa, Mycobacterium avium
QAVNEG

SEQ ID NO: 71014 - protein, 7 aa, Mycobacterium avium
QAVPGPT

SEQ ID NO: 71015 - protein, 12 aa, Mycobacterium avium
QAVYGDSDSRFP

SEQ ID NO: 71016 - protein, 4 aa, Mycobacterium avium
QAYD

SEQ ID NO: 71017 - protein, 9 aa, Mycobacterium avium
QAYPQLRPE

SEQ ID NO: 71018 - protein, 16 aa, Mycobacterium avium
QAYSRREVTDERNHRA

SEQ ID NO: 71019 - protein, 9 aa, Mycobacterium avium
QAYTPQQAV

SEQ ID NO: 71020 - protein, 15 aa, Mycobacterium avium
QCGRAAAQATAAASA

SEQ ID NO: 71021 - protein, 6 aa, Mycobacterium avium
QCGSAQ

SEQ ID NO: 71022 - protein, 11 aa, Mycobacterium avium
QCGSRTPALDA

SEQ ID NO: 71023 - protein, 4 aa, Mycobacterium avium
QDAE

SEQ ID NO: 71024 - protein, 18 aa, Mycobacterium avium
QDALNERTLRRSEGAMGP

SEQ ID NO: 71025 - protein, 10 aa, Mycobacterium avium
QDASWPSAQT

SEQ ID NO: 71026 - protein, 11 aa, Mycobacterium avium
QDASWPSAQTR

SEQ ID NO: 71027 - protein, 9 aa, Mycobacterium avium
QDATAQDAA

SEQ ID NO: 71028 - protein, 4 aa, Mycobacterium avium
QDDP

SEQ ID NO: 71029 - protein, 22 aa, Mycobacterium avium
QDDPASGAAASAARIATTTCDQ

SEQ ID NO: 71030 - protein, 5 aa, Mycobacterium avium
QDEAR

SEQ ID NO: 71031 - protein, 7 aa, Mycobacterium avium
QDENETA

SEQ ID NO: 71032 - protein, 22 aa, Mycobacterium avium
QDEQLQRRAGQPSAGDAPPATV

SEQ ID NO: 71033 - protein, 7 aa, Mycobacterium avium
QDEVGDA

SEQ ID NO: 71034 - protein, 8 aa, Mycobacterium avium
QDFTSRDG

SEQ ID NO: 71035 - protein, 13 aa, Mycobacterium avium
QDGGPVCDDPDYN

SEQ ID NO: 71036 - protein, 6 aa, Mycobacterium avium
QDGPAT

SEQ ID NO: 71037 - protein, 5 aa, Mycobacterium avium
QDGPR

SEQ ID NO: 71038 - protein, 21 aa, Mycobacterium avium
QDGRGGSSHHSSIGPRRQCLH

SEQ ID NO: 71039 - protein, 11 aa, Mycobacterium avium
QDGRRGVERGA

SEQ ID NO: 71040 - protein, 4 aa, Mycobacterium avium
QDHA

SEQ ID NO: 71041 - protein, 5 aa, Mycobacterium avium
QDHPH

SEQ ID NO: 71042 - protein, 8 aa, Mycobacterium avium
QDHTDPNS

SEQ ID NO: 71043 - protein, 7 aa, Mycobacterium avium
QDKKAEV

SEQ ID NO: 71044 - protein, 12 aa, Mycobacterium avium
QDKKHRGREPIS

SEQ ID NO: 71045 - protein, 7 aa, Mycobacterium avium
QDLPGDT

SEQ ID NO: 71046 - protein, 5 aa, Mycobacterium avium
QDLRG

SEQ ID NO: 71047 - protein, 18 aa, Mycobacterium avium
QDPANAGSRQDGWTGRGP

SEQ ID NO: 71048 - protein, 4 aa, Mycobacterium avium
QDPE

SEQ ID NO: 71049 - protein, 18 aa, Mycobacterium avium
QDPEATVTAGNASGQNDV

SEQ ID NO: 71050 - protein, 7 aa, Mycobacterium avium
QDPESVD

SEQ ID NO: 71051 - protein, 8 aa, Mycobacterium avium
QDPGLRRQ

SEQ ID NO: 71052 - protein, 9 aa, Mycobacterium avium
QDPGLRRQD

SEQ ID NO: 71053 - protein, 12 aa, Mycobacterium avium
QDPGREPTPEEL

SEQ ID NO: 71054 - protein, 9 aa, Mycobacterium avium
QDPHNSDRR

SEQ ID NO: 71055 - protein, 13 aa, Mycobacterium avium
QDPPGDGTAPELS

SEQ ID NO: 71056 - protein, 5 aa, Mycobacterium avium
QDPPR

SEQ ID NO: 71057 - protein, 4 aa, Mycobacterium avium
QDPR

SEQ ID NO: 71058 - protein, 7 aa, Mycobacterium avium
QDQVPER

SEQ ID NO: 71059 - protein, 34 aa, Mycobacterium avium
QDRCGPGKHRREPGRGAKNRGGADRSVGKSAAAT

SEQ ID NO: 71060 - protein, 11 aa, Mycobacterium avium
QDRPNKARRVR

SEQ ID NO: 71061 - protein, 14 aa, Mycobacterium avium
QDSPRVDGQPADPV

SEQ ID NO: 71062 - protein, 4 aa, Mycobacterium avium
QDTH

SEQ ID NO: 71063 - protein, 13 aa, Mycobacterium avium
QDVPRSPARPALG

SEQ ID NO: 71064 - protein, 11 aa, Mycobacterium avium
QDVPRSPTRPA

SEQ ID NO: 71065 - protein, 7 aa, Mycobacterium avium
QDVQGND

SEQ ID NO: 71066 - protein, 16 aa, Mycobacterium avium
QEAALPPRGSATPGPA

SEQ ID NO: 71067 - protein, 42 aa, Mycobacterium avium
QEAAMAQEQTKRGGGGDDEDDFASSTAAGQERREKLAEDTDD

SEQ ID NO: 71068 - protein, 17 aa, Mycobacterium avium
QEADDDPEEVERQQHGA

SEQ ID NO: 71069 - protein, 6 aa, Mycobacterium avium
QEAEPA

SEQ ID NO: 71070 - protein, 5 aa, Mycobacterium avium
QEAIA

SEQ ID NO: 71071 - protein, 18 aa, Mycobacterium avium
QEAQRTVERSAGREEADR

SEQ ID NO: 71072 - protein, 5 aa, Mycobacterium avium
QEARA

SEQ ID NO: 71073 - protein, 9 aa, Mycobacterium avium
QEDDTVEVG

SEQ ID NO: 71074 - protein, 9 aa, Mycobacterium avium
QEDPGELLG

SEQ ID NO: 71075 - protein, 10 aa, Mycobacterium avium
QEDRDKIPGA

SEQ ID NO: 71076 - protein, 7 aa, Mycobacterium avium
QEEAEDI

SEQ ID NO: 71077 - protein, 9 aa, Mycobacterium avium
QEEKEDARA

SEQ ID NO: 71078 - protein, 6 aa, Mycobacterium avium
QEEPVR

SEQ ID NO: 71079 - protein, 7 aa, Mycobacterium avium
QEGADGW

SEQ ID NO: 71080 - protein, 4 aa, Mycobacterium avium
QEID

SEQ ID NO: 71081 - protein, 8 aa, Mycobacterium avium
QEISTQQA

SEQ ID NO: 71082 - protein, 26 aa, Mycobacterium avium
QEITGTGYTAGGQALSGVQTSYSSNT

SEQ ID NO: 71083 - protein, 30 aa, Mycobacterium avium
QEKKAAECPAEAPQPAAETPAEAPEAPADA

SEQ ID NO: 71084 - protein, 30 aa, Mycobacterium avium
QEKKAAEGPAEAPQPAAETPAEAPEAPADA

SEQ ID NO: 71085 - protein, 30 aa, Mycobacterium avium
QEKKAAEGPAEAPQPATEPPAEAPEAPADA

SEQ ID NO: 71086 - protein, 5 aa, Mycobacterium avium
QELSR

SEQ ID NO: 71087 - protein, 8 aa, Mycobacterium avium
QENQQLGG

SEQ ID NO: 71088 - protein, 12 aa, Mycobacterium avium
QEPASGQPARLP

SEQ ID NO: 71089 - protein, 8 aa, Mycobacterium avium
QEPGDHGV

SEQ ID NO: 71090 - protein, 6 aa, Mycobacterium avium
QEPPGL

SEQ ID NO: 71091 - protein, 16 aa, Mycobacterium avium
QERAREESARLGDGPL

SEQ ID NO: 71092 - protein, 16 aa, Mycobacterium avium
QERAREESTRLGDGPL

SEQ ID NO: 71093 - protein, 6 aa, Mycobacterium avium
QERGSK

SEQ ID NO: 71094 - protein, 18 aa, Mycobacterium avium
QERLPDGSTAWKRSPGGL

SEQ ID NO: 71095 - protein, 10 aa, Mycobacterium avium
QERNRPGVGH

SEQ ID NO: 71096 - protein, 21 aa, Mycobacterium avium
QERYGDLDPTQLADRFRMAWS

SEQ ID NO: 71097 - protein, 13 aa, Mycobacterium avium
QESGHRDGAVRGG

SEQ ID NO: 71098 - protein, 5 aa, Mycobacterium avium
QESIT

SEQ ID NO: 71099 - protein, 28 aa, Mycobacterium avium
QETAPTRGAREDSVTVPQSPSQFSDGLA

SEQ ID NO: 71100 - protein, 7 aa, Mycobacterium avium
QETGHTP

SEQ ID NO: 71101 - protein, 41 aa, Mycobacterium avium
QETSANTTASRPPSSSPPPWPTSKPPPAKASPAGAPCYPCP

SEQ ID NO: 71102 - protein, 5 aa, Mycobacterium avium
QEYYK

SEQ ID NO: 71103 - protein, 9 aa, Mycobacterium avium
QFDPTTMGT

SEQ ID NO: 71104 - protein, 7 aa, Mycobacterium avium
QFDRGQR

SEQ ID NO: 71105 - protein, 6 aa, Mycobacterium avium
QGAPPK

SEQ ID NO: 71106 - protein, 13 aa, Mycobacterium avium
QGAQNTDKQLAAR

SEQ ID NO: 71107 - protein, 4 aa, Mycobacterium avium
QGAR

SEQ ID NO: 71108 - protein, 47 aa, Mycobacterium avium
QGASNYSAAEAASTLGGGSGALPAPSAPADLAAPGPPGTWGKGEPPP

SEQ ID NO: 71109 - protein, 4 aa, Mycobacterium avium
QGAT

SEQ ID NO: 71110 - protein, 16 aa, Mycobacterium avium
QGCGPTADSGDYSAEL

SEQ ID NO: 71111 - protein, 11 aa, Mycobacterium avium
QGDGVDPADVR

SEQ ID NO: 71112 - protein, 10 aa, Mycobacterium avium
QGDPAEAGRQ

SEQ ID NO: 71113 - protein, 8 aa, Mycobacterium avium
QGDPAVGA

SEQ ID NO: 71114 - protein, 10 aa, Mycobacterium avium
QGDPTEAGER

SEQ ID NO: 71115 - protein, 13 aa, Mycobacterium avium
QGDRRAVRSVEPA

SEQ ID NO: 71116 - protein, 7 aa, Mycobacterium avium
QGDRSGV

SEQ ID NO: 71117 - protein, 14 aa, Mycobacterium avium
QGEDDDGEVDGDEP

SEQ ID NO: 71118 - protein, 22 aa, Mycobacterium avium
QGEDDDGEVDGEQEADQGDDHA

SEQ ID NO: 71119 - protein, 12 aa, Mycobacterium avium
QGEEDGDEDEDE

SEQ ID NO: 71120 - protein, 5 aa, Mycobacterium avium
QGEFD

SEQ ID NO: 71121 - protein, 8 aa, Mycobacterium avium
QGERPRHQ

SEQ ID NO: 71122 - protein, 8 aa, Mycobacterium avium
QGESPSRV

SEQ ID NO: 71123 - protein, 7 aa, Mycobacterium avium
QGFRSGT

SEQ ID NO: 71124 - protein, 12 aa, Mycobacterium avium
QGGAGNATATPE

SEQ ID NO: 71125 - protein, 5 aa, Mycobacterium avium
QGGAT

SEQ ID NO: 71126 - protein, 7 aa, Mycobacterium avium
QGGCQGL

SEQ ID NO: 71127 - protein, 10 aa, Mycobacterium avium
QGGDSLRATE

SEQ ID NO: 71128 - protein, 10 aa, Mycobacterium avium
QGGEAGGHGM

SEQ ID NO: 71129 - protein, 6 aa, Mycobacterium avium
QGGKQM

SEQ ID NO: 71130 - protein, 4 aa, Mycobacterium avium
QGGL

SEQ ID NO: 71131 - protein, 4 aa, Mycobacterium avium
QGIG

SEQ ID NO: 71132 - protein, 6 aa, Mycobacterium avium
QGIRDA

SEQ ID NO: 71133 - protein, 4 aa, Mycobacterium avium
QGIT

SEQ ID NO: 71134 - protein, 14 aa, Mycobacterium avium
QGKGTNGDSAPVPC

SEQ ID NO: 71135 - protein, 8 aa, Mycobacterium avium
QGKPITRS

SEQ ID NO: 71136 - protein, 23 aa, Mycobacterium avium
QGKPQTDVGTGTPVAAMASEEGR

SEQ ID NO: 71137 - protein, 14 aa, Mycobacterium avium
QGNGAEALRSRTYA

SEQ ID NO: 71138 - protein, 4 aa, Mycobacterium avium
QGNQ

SEQ ID NO: 71139 - protein, 6 aa, Mycobacterium avium
QGNTQL

SEQ ID NO: 71140 - protein, 8 aa, Mycobacterium avium
QGPASGYD

SEQ ID NO: 71141 - protein, 15 aa, Mycobacterium avium
QGPGETVFLAYRTDG

SEQ ID NO: 71142 - protein, 4 aa, Mycobacterium avium
QGPR

SEQ ID NO: 71143 - protein, 6 aa, Mycobacterium avium
QGPRSA

SEQ ID NO: 71144 - protein, 5 aa, Mycobacterium avium
QGPSG

SEQ ID NO: 71145 - protein, 6 aa, Mycobacterium avium
QGPSPM

SEQ ID NO: 71146 - protein, 9 aa, Mycobacterium avium
QGPTPKAVT

SEQ ID NO: 71147 - protein, 23 aa, Mycobacterium avium
QGQGGVTQRKSPHAAPSDDSRKA

SEQ ID NO: 71148 - protein, 5 aa, Mycobacterium avium
QGQIG

SEQ ID NO: 71149 - protein, 9 aa, Mycobacterium avium
QGQQRPAHR

SEQ ID NO: 71150 - protein, 4 aa, Mycobacterium avium
QGRA

SEQ ID NO: 71151 - protein, 13 aa, Mycobacterium avium
QGRDAAEPPLTTR

SEQ ID NO: 71152 - protein, 19 aa, Mycobacterium avium
QGRDEPLGSPGGAAKIGPL

SEQ ID NO: 71153 - protein, 26 aa, Mycobacterium avium
QGRDGTASVAPPRGKRPAPPAAPDDR

SEQ ID NO: 71154 - protein, 24 aa, Mycobacterium avium
QGRGGAALARGRATRRRGTQDRVT

SEQ ID NO: 71155 - protein, 8 aa, Mycobacterium avium
QGRGREAD

SEQ ID NO: 71156 - protein, 4 aa, Mycobacterium avium
QGRQ

SEQ ID NO: 71157 - protein, 5 aa, Mycobacterium avium
QGRRA

SEQ ID NO: 71158 - protein, 11 aa, Mycobacterium avium
QGRRGGVGGEW

SEQ ID NO: 71159 - protein, 14 aa, Mycobacterium avium
QGRYPNQLAGGQRQ

SEQ ID NO: 71160 - protein, 5 aa, Mycobacterium avium
QGSAR

SEQ ID NO: 71161 - protein, 19 aa, Mycobacterium avium
QGSIEASEGGTWGKPEATY

SEQ ID NO: 71162 - protein, 10 aa, Mycobacterium avium
QGSPPSREDV

SEQ ID NO: 71163 - protein, 6 aa, Mycobacterium avium
QGSQWT

SEQ ID NO: 71164 - protein, 6 aa, Mycobacterium avium
QGSRQF

SEQ ID NO: 71165 - protein, 6 aa, Mycobacterium avium
QGTAVA

SEQ ID NO: 71166 - protein, 4 aa, Mycobacterium avium
QGTP

SEQ ID NO: 71167 - protein, 5 aa, Mycobacterium avium
QGTPP

SEQ ID NO: 71168 - protein, 4 aa, Mycobacterium avium
QGTT

SEQ ID NO: 71169 - protein, 12 aa, Mycobacterium avium
QGTVAGRPDDGC

SEQ ID NO: 71170 - protein, 4 aa, Mycobacterium avium
QGVA

SEQ ID NO: 71171 - protein, 13 aa, Mycobacterium avium
QGVDCGDPVWKIG

SEQ ID NO: 71172 - protein, 10 aa, Mycobacterium avium
QGVGQPGGSI

SEQ ID NO: 71173 - protein, 14 aa, Mycobacterium avium
QGWDPSDVDNGDIA

SEQ ID NO: 71174 - protein, 5 aa, Mycobacterium avium
QGYRA

SEQ ID NO: 71175 - protein, 7 aa, Mycobacterium avium
QHADPAR

SEQ ID NO: 71176 - protein, 19 aa, Mycobacterium avium
QHAGGKSGDQHGSQFPTGP

SEQ ID NO: 71177 - protein, 39 aa, Mycobacterium avium
QHANAHRRAAAGAGRLRSRSRQGATSGVRRSLVPAVQPG

SEQ ID NO: 71178 - protein, 15 aa, Mycobacterium avium
QHATASGKQNADCDP

SEQ ID NO: 71179 - protein, 4 aa, Mycobacterium avium
QHEA

SEQ ID NO: 71180 - protein, 7 aa, Mycobacterium avium
QHEPVPV

SEQ ID NO: 71181 - protein, 7 aa, Mycobacterium avium
QHEQGGL

SEQ ID NO: 71182 - protein, 16 aa, Mycobacterium avium
QHHPRQRGIASGGTAV

SEQ ID NO: 71183 - protein, 11 aa, Mycobacterium avium
QHNGDTDFSGS

SEQ ID NO: 71184 - protein, 10 aa, Mycobacterium avium
QHNGRDGTAI

SEQ ID NO: 71185 - protein, 40 aa, Mycobacterium avium
QHNSPGRRRGAGRRPNGGCGRSSPRSSPCSSSSRAGWASG

SEQ ID NO: 71186 - protein, 6 aa, Mycobacterium avium
QHPGED

SEQ ID NO: 71187 - protein, 7 aa, Mycobacterium avium
QHPGEDV

SEQ ID NO: 71188 - protein, 10 aa, Mycobacterium avium
QHPPQPPDQR

SEQ ID NO: 71189 - protein, 14 aa, Mycobacterium avium
QHQRHHPGDHPGQR

SEQ ID NO: 71190 - protein, 11 aa, Mycobacterium avium
QHQRVDEETDQ

SEQ ID NO: 71191 - protein, 11 aa, Mycobacterium avium
QHRAEQPGGAH

SEQ ID NO: 71192 - protein, 12 aa, Mycobacterium avium
QHRAEQPGGAHD

SEQ ID NO: 71193 - protein, 10 aa, Mycobacterium avium
QHRAGSPDCF

SEQ ID NO: 71194 - protein, 5 aa, Mycobacterium avium
QHSDR

SEQ ID NO: 71195 - protein, 7 aa, Mycobacterium avium
QHSEESE

SEQ ID NO: 71196 - protein, 5 aa, Mycobacterium avium
QHTST

SEQ ID NO: 71197 - protein, 5 aa, Mycobacterium avium
QIAGP

SEQ ID NO: 71198 - protein, 6 aa, Mycobacterium avium
QIAGPD

SEQ ID NO: 71199 - protein, 7 aa, Mycobacterium avium
QIAGPDA

SEQ ID NO: 71200 - protein, 5 aa, Mycobacterium avium
QIASG

SEQ ID NO: 71201 - protein, 7 aa, Mycobacterium avium
QIDTGRR

SEQ ID NO: 71202 - protein, 5 aa, Mycobacterium avium
QIERN

SEQ ID NO: 71203 - protein, 4 aa, Mycobacterium avium
QIGD

SEQ ID NO: 71204 - protein, 12 aa, Mycobacterium avium
QIGTGAERFEQA

SEQ ID NO: 71205 - protein, 12 aa, Mycobacterium avium
QIPDSPAMSGPY

SEQ ID NO: 71206 - protein, 5 aa, Mycobacterium avium
QIRAG

SEQ ID NO: 71207 - protein, 5 aa, Mycobacterium avium
QISDA

SEQ ID NO: 71208 - protein, 63 aa, Mycobacterium avium
QKARKRSEELAEEAAERGKSLAKKARKRSEKLAKKARKRSEKLAGTARVRGEELAETARQRGS

SEQ ID NO: 71209 - protein, 9 aa, Mycobacterium avium
QKDRSKIPA

SEQ ID NO: 71210 - protein, 17 aa, Mycobacterium avium
QKDSPDWVHPELRVQGR

SEQ ID NO: 71211 - protein, 10 aa, Mycobacterium avium
QKKRGSVGRA

SEQ ID NO: 71212 - protein, 5 aa, Mycobacterium avium
QKVNP

SEQ ID NO: 71213 - protein, 26 aa, Mycobacterium avium
QLAPGTAAPVAAASRPALPTGPLTSV

SEQ ID NO: 71214 - protein, 8 aa, Mycobacterium avium
QLASTSAA

SEQ ID NO: 71215 - protein, 4 aa, Mycobacterium avium
QLDG

SEQ ID NO: 71216 - protein, 20 aa, Mycobacterium avium
QLDQAAGEAEARGDTARAEE

SEQ ID NO: 71217 - protein, 9 aa, Mycobacterium avium
QLDQGPASA

SEQ ID NO: 71218 - protein, 5 aa, Mycobacterium avium
QLGAG

SEQ ID NO: 71219 - protein, 7 aa, Mycobacterium avium
QLGDAPE

SEQ ID NO: 71220 - protein, 4 aa, Mycobacterium avium
QLGG

SEQ ID NO: 71221 - protein, 13 aa, Mycobacterium avium
QLGGRRTTSATIP

SEQ ID NO: 71222 - protein, 4 aa, Mycobacterium avium
QLGP

SEQ ID NO: 71223 - protein, 6 aa, Mycobacterium avium
QLGPRT

SEQ ID NO: 71224 - protein, 7 aa, Mycobacterium avium
QLGTDEA

SEQ ID NO: 71225 - protein, 10 aa, Mycobacterium avium
QLNDGAKALD

SEQ ID NO: 71226 - protein, 18 aa, Mycobacterium avium
QLPESVPYESPTPDDLAE

SEQ ID NO: 71227 - protein, 30 aa, Mycobacterium avium
QLPGGLAGAQAAQAIAGAATAQAQLTGVFG

SEQ ID NO: 71228 - protein, 6 aa, Mycobacterium avium
QLPPGS

SEQ ID NO: 71229 - protein, 6 aa, Mycobacterium avium
QLPPLE

SEQ ID NO: 71230 - protein, 6 aa, Mycobacterium avium
QLPSRR

SEQ ID NO: 71231 - protein, 6 aa, Mycobacterium avium
QLQSAP

SEQ ID NO: 71232 - protein, 10 aa, Mycobacterium avium
QLRGTDAGTP

SEQ ID NO: 71233 - protein, 14 aa, Mycobacterium avium
QLRTPRDRRGGPLE

SEQ ID NO: 71234 - protein, 18 aa, Mycobacterium avium
QLTAGESFGEVESTKSVS

SEQ ID NO: 71235 - protein, 7 aa, Mycobacterium avium
QLTGQAD

SEQ ID NO: 71236 - protein, 5 aa, Mycobacterium avium
QLTPV

SEQ ID NO: 71237 - protein, 25 aa, Mycobacterium avium
QLTSAGPTPAAPAETAAPPDRSSRI

SEQ ID NO: 71238 - protein, 5 aa, Mycobacterium avium
QMPEE

SEQ ID NO: 71239 - protein, 7 aa, Mycobacterium avium
QNEMPSR

SEQ ID NO: 71240 - protein, 9 aa, Mycobacterium avium
QNESAVELQ

SEQ ID NO: 71241 - protein, 9 aa, Mycobacterium avium
QNGDPGAPK

SEQ ID NO: 71242 - protein, 8 aa, Mycobacterium avium
QNGKNGGI

SEQ ID NO: 71243 - protein, 6 aa, Mycobacterium avium
QNGTGE

SEQ ID NO: 71244 - protein, 8 aa, Mycobacterium avium
QNGTGPTV

SEQ ID NO: 71245 - protein, 17 aa, Mycobacterium avium
QNITAGSIQPSRNKRGR

SEQ ID NO: 71246 - protein, 13 aa, Mycobacterium avium
QNLPAQPPAYDAE

SEQ ID NO: 71247 - protein, 13 aa, Mycobacterium avium
QNLPAQPSAYDAE

SEQ ID NO: 71248 - protein, 7 aa, Mycobacterium avium
QNNAEAY

SEQ ID NO: 71249 - protein, 8 aa, Mycobacterium avium
QNPDDQKA

SEQ ID NO: 71250 - protein, 7 aa, Mycobacterium avium
QNTPAIA

SEQ ID NO: 71251 - protein, 6 aa, Mycobacterium avium
QNTTHR

SEQ ID NO: 71252 - protein, 8 aa, Mycobacterium avium
QPADPLGV

SEQ ID NO: 71253 - protein, 11 aa, Mycobacterium avium
QPADTAPPIGT

SEQ ID NO: 71254 - protein, 5 aa, Mycobacterium avium
QPAEV

SEQ ID NO: 71255 - protein, 7 aa, Mycobacterium avium
QPAGRPA

SEQ ID NO: 71256 - protein, 7 aa, Mycobacterium avium
QPAQPED

SEQ ID NO: 71257 - protein, 9 aa, Mycobacterium avium
QPARRPSVG

SEQ ID NO: 71258 - protein, 12 aa, Mycobacterium avium
QPCAGDPDGGLA

SEQ ID NO: 71259 - protein, 5 aa, Mycobacterium avium
QPDAA

SEQ ID NO: 71260 - protein, 19 aa, Mycobacterium avium
QPDCPARTGDQHADDGTGA

SEQ ID NO: 71261 - protein, 19 aa, Mycobacterium avium
QPDCPARTGNQNADDRTGA

SEQ ID NO: 71262 - protein, 19 aa, Mycobacterium avium
QPDCPARTRDQNADDRTGA

SEQ ID NO: 71263 - protein, 14 aa, Mycobacterium avium
QPDEDFASSGHRTV

SEQ ID NO: 71264 - protein, 6 aa, Mycobacterium avium
QPDELR

SEQ ID NO: 71265 - protein, 4 aa, Mycobacterium avium
QPDH

SEQ ID NO: 71266 - protein, 5 aa, Mycobacterium avium
QPDKV

SEQ ID NO: 71267 - protein, 9 aa, Mycobacterium avium
QPDLGPKQW

SEQ ID NO: 71268 - protein, 6 aa, Mycobacterium avium
QPDPHG

SEQ ID NO: 71269 - protein, 4 aa, Mycobacterium avium
QPDR

SEQ ID NO: 71270 - protein, 19 aa, Mycobacterium avium
QPDSHEPGTSAPTADDTEA

SEQ ID NO: 71271 - protein, 30 aa, Mycobacterium avium
QPDTGTASKSESENPAIPSPHPKSNAPLTN

SEQ ID NO: 71272 - protein, 19 aa, Mycobacterium avium
QPDTVEKDLGAARDRLTGK

SEQ ID NO: 71273 - protein, 4 aa, Mycobacterium avium
QPED

SEQ ID NO: 71274 - protein, 8 aa, Mycobacterium avium
QPEEASDF

SEQ ID NO: 71275 - protein, 17 aa, Mycobacterium avium
QPEQTAETFRPDGLRTG

SEQ ID NO: 71276 - protein, 75 aa, Mycobacterium avium
QPERPSARPAPAPPPPPVASRPAPPRPPTPAPTPPTRPPAPPTFRPHPPAAAPAPAAPPTPRPQPSGAPQLPDRG

SEQ ID NO: 71277 - protein, 76 aa, Mycobacterium avium
QPERPSARPAPEAPPPPVAPRPAPPPRPPTPAPTPPTRPPAPPTFRPHPPAAAPAPAAPPTPRPQPSATPQLPDRG

SEQ ID NO: 71278 - protein, 5 aa, Mycobacterium avium
QPETR

SEQ ID NO: 71279 - protein, 7 aa, Mycobacterium avium
QPGGDTT

SEQ ID NO: 71280 - protein, 5 aa, Mycobacterium avium
QPGGE

SEQ ID NO: 71281 - protein, 18 aa, Mycobacterium avium
QPGRGDVRRGETAAAGAH

SEQ ID NO: 71282 - protein, 8 aa, Mycobacterium avium
QPGRGPGR

SEQ ID NO: 71283 - protein, 5 aa, Mycobacterium avium
QPGVV

SEQ ID NO: 71284 - protein, 16 aa, Mycobacterium avium
QPGYGLSDKRSEHGQF

SEQ ID NO: 71285 - protein, 6 aa, Mycobacterium avium
QPHEPV

SEQ ID NO: 71286 - protein, 6 aa, Mycobacterium avium
QPHPRE

SEQ ID NO: 71287 - protein, 6 aa, Mycobacterium avium
QPHRPG

SEQ ID NO: 71288 - protein, 134 aa, Mycobacterium avium
QPLESSDDDGDADETADSDDSDGDDDEQADRPSSRRRRRGRRGRGRGRGEQGGSDGPGDGDDDEPQNRGKKGGQSDGDDDSDGQDAEDADDSDTGDDGSADGGNRRRRRRRRRKSGSGDDNEDGPSPDDPPNTV

SEQ ID NO: 71289 - protein, 134 aa, Mycobacterium avium
QPLESSDDDGDADETADSDDSDGDDDEQADRPSSRRRRRGRRGRGRGRGEQGGSDGPGDGDNDEPQNRGKKGGQSDGDDDSDGQDAEDADDSDTGDDGSADGGNRRRRRRRRRKSGSGDDNEDGPSPDDPPNTV

SEQ ID NO: 71290 - protein, 13 aa, Mycobacterium avium
QPLGGKAQFGGQR

SEQ ID NO: 71291 - protein, 9 aa, Mycobacterium avium
QPLGGRREG

SEQ ID NO: 71292 - protein, 20 aa, Mycobacterium avium
QPLSQRGGGDRDDRGGVGEH

SEQ ID NO: 71293 - protein, 15 aa, Mycobacterium avium
QPLSTASGRQPWEGP

SEQ ID NO: 71294 - protein, 4 aa, Mycobacterium avium
QPLW

SEQ ID NO: 71295 - protein, 6 aa, Mycobacterium avium
QPMPEH

SEQ ID NO: 71296 - protein, 4 aa, Mycobacterium avium
QPMT

SEQ ID NO: 71297 - protein, 6 aa, Mycobacterium avium
QPNVAD

SEQ ID NO: 71298 - protein, 5 aa, Mycobacterium avium
QPPAV

SEQ ID NO: 71299 - protein, 4 aa, Mycobacterium avium
QPPD

SEQ ID NO: 71300 - protein, 7 aa, Mycobacterium avium
QPPDYPA

SEQ ID NO: 71301 - protein, 13 aa, Mycobacterium avium
QPPGTHTAPPVDE

SEQ ID NO: 71302 - protein, 8 aa, Mycobacterium avium
QPPPPDHP

SEQ ID NO: 71303 - protein, 7 aa, Mycobacterium avium
QPPPPHH

SEQ ID NO: 71304 - protein, 6 aa, Mycobacterium avium
QPPPPL

SEQ ID NO: 71305 - protein, 4 aa, Mycobacterium avium
QPPQ

SEQ ID NO: 71306 - protein, 6 aa, Mycobacterium avium
QPPQRL

SEQ ID NO: 71307 - protein, 17 aa, Mycobacterium avium
QPPRTSPQASRWSPERA

SEQ ID NO: 71308 - protein, 9 aa, Mycobacterium avium
QPQRADRPV

SEQ ID NO: 71309 - protein, 6 aa, Mycobacterium avium
QPRAAA

SEQ ID NO: 71310 - protein, 24 aa, Mycobacterium avium
QPRGPARAAPTPNRRSRSKQRNGR

SEQ ID NO: 71311 - protein, 15 aa, Mycobacterium avium
QPRGVERAGDGDVEL

SEQ ID NO: 71312 - protein, 11 aa, Mycobacterium avium
QPRPGGRVGGA

SEQ ID NO: 71313 - protein, 11 aa, Mycobacterium avium
QPRRSAELAKT

SEQ ID NO: 71314 - protein, 5 aa, Mycobacterium avium
QPRSH

SEQ ID NO: 71315 - protein, 4 aa, Mycobacterium avium
QPSA

SEQ ID NO: 71316 - protein, 7 aa, Mycobacterium avium
QPSAAVQ

SEQ ID NO: 71317 - protein, 8 aa, Mycobacterium avium
QPSNGRPL

SEQ ID NO: 71318 - protein, 8 aa, Mycobacterium avium
QPSPPHHP

SEQ ID NO: 71319 - protein, 6 aa, Mycobacterium avium
QPSYLP

SEQ ID NO: 71320 - protein, 5 aa, Mycobacterium avium
QPTAR

SEQ ID NO: 71321 - protein, 8 aa, Mycobacterium avium
QPTASGSI

SEQ ID NO: 71322 - protein, 17 aa, Mycobacterium avium
QPTDPSSLPPDTPDDRK

SEQ ID NO: 71323 - protein, 6 aa, Mycobacterium avium
QPTGDG

SEQ ID NO: 71324 - protein, 6 aa, Mycobacterium avium
QPTGKH

SEQ ID NO: 71325 - protein, 24 aa, Mycobacterium avium
QPTGQVRDAEAGERLARARGAEEQ

SEQ ID NO: 71326 - protein, 7 aa, Mycobacterium avium
QPTPRGY

SEQ ID NO: 71327 - protein, 29 aa, Mycobacterium avium
QPTTVGQAPPTTALSGVGSGGSLCTDPVD

SEQ ID NO: 71328 - protein, 9 aa, Mycobacterium avium
QPVAQRVGQ

SEQ ID NO: 71329 - protein, 7 aa, Mycobacterium avium
QPVDRPA

SEQ ID NO: 71330 - protein, 4 aa, Mycobacterium avium
QPVG

SEQ ID NO: 71331 - protein, 25 aa, Mycobacterium avium
QPVRQGVGARRPDLRPRPDQPRGGH

SEQ ID NO: 71332 - protein, 8 aa, Mycobacterium avium
QPVSLSPN

SEQ ID NO: 71333 - protein, 8 aa, Mycobacterium avium
QPVSLSPT

SEQ ID NO: 71334 - protein, 10 aa, Mycobacterium avium
QQAAGQSNAS

SEQ ID NO: 71335 - protein, 7 aa, Mycobacterium avium
QQAPGSL

SEQ ID NO: 71336 - protein, 7 aa, Mycobacterium avium
QQATAAP

SEQ ID NO: 71337 - protein, 25 aa, Mycobacterium avium
QQDRGTRQRQRHQQRSVVSHVGVLS

SEQ ID NO: 71338 - protein, 5 aa, Mycobacterium avium
QQEAL

SEQ ID NO: 71339 - protein, 4 aa, Mycobacterium avium
QQFG

SEQ ID NO: 71340 - protein, 6 aa, Mycobacterium avium
QQFTAE

SEQ ID NO: 71341 - protein, 5 aa, Mycobacterium avium
QQGCS

SEQ ID NO: 71342 - protein, 14 aa, Mycobacterium avium
QQGEHRDGIPNRSL

SEQ ID NO: 71343 - protein, 5 aa, Mycobacterium avium
QQGGA

SEQ ID NO: 71344 - protein, 7 aa, Mycobacterium avium
QQGGDGL

SEQ ID NO: 71345 - protein, 7 aa, Mycobacterium avium
QQGGSTI

SEQ ID NO: 71346 - protein, 5 aa, Mycobacterium avium
QQGNT

SEQ ID NO: 71347 - protein, 21 aa, Mycobacterium avium
QQGYQDNSTTVPYDPAAAGRE

SEQ ID NO: 71348 - protein, 8 aa, Mycobacterium avium
QQHQRGRY

SEQ ID NO: 71349 - protein, 7 aa, Mycobacterium avium
QQIPEGA

SEQ ID NO: 71350 - protein, 8 aa, Mycobacterium avium
QQIPEGEK

SEQ ID NO: 71351 - protein, 22 aa, Mycobacterium avium
QQKGIDEAGGRALPDWSPEASL

SEQ ID NO: 71352 - protein, 7 aa, Mycobacterium avium
QQLERNQ

SEQ ID NO: 71353 - protein, 4 aa, Mycobacterium avium
QQLG

SEQ ID NO: 71354 - protein, 8 aa, Mycobacterium avium
QQLPADQL

SEQ ID NO: 71355 - protein, 10 aa, Mycobacterium avium
QQLPTQQSPL

SEQ ID NO: 71356 - protein, 6 aa, Mycobacterium avium
QQLRTR

SEQ ID NO: 71357 - protein, 15 aa, Mycobacterium avium
QQPQVGASALESGQV

SEQ ID NO: 71358 - protein, 7 aa, Mycobacterium avium
QQPRRAA

SEQ ID NO: 71359 - protein, 11 aa, Mycobacterium avium
QQPSDAGPTNN

SEQ ID NO: 71360 - protein, 8 aa, Mycobacterium avium
QQPVGQRF

SEQ ID NO: 71361 - protein, 8 aa, Mycobacterium avium
QQPVPVGR

SEQ ID NO: 71362 - protein, 5 aa, Mycobacterium avium
QQQGS

SEQ ID NO: 71363 - protein, 4 aa, Mycobacterium avium
QQQQ

SEQ ID NO: 71364 - protein, 9 aa, Mycobacterium avium
QQRAPDLPH

SEQ ID NO: 71365 - protein, 4 aa, Mycobacterium avium
QQRE

SEQ ID NO: 71366 - protein, 12 aa, Mycobacterium avium
QQRERPKIGQQA

SEQ ID NO: 71367 - protein, 8 aa, Mycobacterium avium
QQRNGCAG

SEQ ID NO: 71368 - protein, 5 aa, Mycobacterium avium
QQRPS

SEQ ID NO: 71369 - protein, 4 aa, Mycobacterium avium
QQRQ

SEQ ID NO: 71370 - protein, 12 aa, Mycobacterium avium
QQRSQAEGGNGN

SEQ ID NO: 71371 - protein, 13 aa, Mycobacterium avium
QQSPLQPAGAGLT

SEQ ID NO: 71372 - protein, 12 aa, Mycobacterium avium
QQTATQARAAAA

SEQ ID NO: 71373 - protein, 15 aa, Mycobacterium avium
QQTELPLGAGETGFL

SEQ ID NO: 71374 - protein, 9 aa, Mycobacterium avium
QQTKVDDVT

SEQ ID NO: 71375 - protein, 4 aa, Mycobacterium avium
QQVH

SEQ ID NO: 71376 - protein, 9 aa, Mycobacterium avium
QQVPAPPAA

SEQ ID NO: 71377 - protein, 8 aa, Mycobacterium avium
QRADRDAG

SEQ ID NO: 71378 - protein, 13 aa, Mycobacterium avium
QRADRLSEPAHES

SEQ ID NO: 71379 - protein, 13 aa, Mycobacterium avium
QRAERLGDPAHES

SEQ ID NO: 71380 - protein, 43 aa, Mycobacterium avium
QRAGEPVGTPALAETPPEPVSLPTEAHGPETVPAADDVPDPAP

SEQ ID NO: 71381 - protein, 8 aa, Mycobacterium avium
QRAGHPGA

SEQ ID NO: 71382 - protein, 21 aa, Mycobacterium avium
QRAGNGAHSAAPEGVEGEFDD

SEQ ID NO: 71383 - protein, 9 aa, Mycobacterium avium
QRAGQPGAQ

SEQ ID NO: 71384 - protein, 5 aa, Mycobacterium avium
QRAGV

SEQ ID NO: 71385 - protein, 6 aa, Mycobacterium avium
QRAKAA

SEQ ID NO: 71386 - protein, 4 aa, Mycobacterium avium
QRAP

SEQ ID NO: 71387 - protein, 11 aa, Mycobacterium avium
QRDDDRGEQTP

SEQ ID NO: 71388 - protein, 20 aa, Mycobacterium avium
QRDERSGAPERNRRLDSDAA

SEQ ID NO: 71389 - protein, 8 aa, Mycobacterium avium
QRDGEEPA

SEQ ID NO: 71390 - protein, 5 aa, Mycobacterium avium
QRDGL

SEQ ID NO: 71391 - protein, 12 aa, Mycobacterium avium
QRDRDIQRRQPT

SEQ ID NO: 71392 - protein, 33 aa, Mycobacterium avium
QRDRDSRTQASTAQERWESEGGTTASPRPAQLP

SEQ ID NO: 71393 - protein, 4 aa, Mycobacterium avium
QRDV

SEQ ID NO: 71394 - protein, 5 aa, Mycobacterium avium
QREAV

SEQ ID NO: 71395 - protein, 5 aa, Mycobacterium avium
QRESL

SEQ ID NO: 71396 - protein, 5 aa, Mycobacterium avium
QRETS

SEQ ID NO: 71397 - protein, 5 aa, Mycobacterium avium
QRFSE

SEQ ID NO: 71398 - protein, 6 aa, Mycobacterium avium
QRFSGP

SEQ ID NO: 71399 - protein, 5 aa, Mycobacterium avium
QRGAH

SEQ ID NO: 71400 - protein, 14 aa, Mycobacterium avium
QRGAHPDERQQHQI

SEQ ID NO: 71401 - protein, 16 aa, Mycobacterium avium
QRGATGTHTHGAEERV

SEQ ID NO: 71402 - protein, 6 aa, Mycobacterium avium
QRGIGA

SEQ ID NO: 71403 - protein, 10 aa, Mycobacterium avium
QRGQSTPPPL

SEQ ID NO: 71404 - protein, 13 aa, Mycobacterium avium
QRGRHGDASDDHV

SEQ ID NO: 71405 - protein, 11 aa, Mycobacterium avium
QRGTTELQQGG

SEQ ID NO: 71406 - protein, 9 aa, Mycobacterium avium
QRHGSGDRV

SEQ ID NO: 71407 - protein, 14 aa, Mycobacterium avium
QRHPEWNTAENDSV

SEQ ID NO: 71408 - protein, 11 aa, Mycobacterium avium
QRHQPQPVAEP

SEQ ID NO: 71409 - protein, 9 aa, Mycobacterium avium
QRIGSGAAS

SEQ ID NO: 71410 - protein, 11 aa, Mycobacterium avium
QRKGLTDERQA

SEQ ID NO: 71411 - protein, 22 aa, Mycobacterium avium
QRKPGRPRNSAVDSQQRDYALG

SEQ ID NO: 71412 - protein, 9 aa, Mycobacterium avium
QRKSQPTED

SEQ ID NO: 71413 - protein, 4 aa, Mycobacterium avium
QRLD

SEQ ID NO: 71414 - protein, 12 aa, Mycobacterium avium
QRLQEGAAVGPA

SEQ ID NO: 71415 - protein, 13 aa, Mycobacterium avium
QRNARRSVGRIIH

SEQ ID NO: 71416 - protein, 12 aa, Mycobacterium avium
QRNGSVRPGDPV

SEQ ID NO: 71417 - protein, 13 aa, Mycobacterium avium
QRNKYEVNHETGR

SEQ ID NO: 71418 - protein, 12 aa, Mycobacterium avium
QRPAGQGQRRHV

SEQ ID NO: 71419 - protein, 7 aa, Mycobacterium avium
QRPEDGI

SEQ ID NO: 71420 - protein, 10 aa, Mycobacterium avium
QRPGGPPANA

SEQ ID NO: 71421 - protein, 7 aa, Mycobacterium avium
QRPPRHP

SEQ ID NO: 71422 - protein, 13 aa, Mycobacterium avium
QRPQRPGGIGGHR

SEQ ID NO: 71423 - protein, 7 aa, Mycobacterium avium
QRPSSRA

SEQ ID NO: 71424 - protein, 5 aa, Mycobacterium avium
QRQHV

SEQ ID NO: 71425 - protein, 5 aa, Mycobacterium avium
QRQNP

SEQ ID NO: 71426 - protein, 18 aa, Mycobacterium avium
QRQQRQARGQSEVPPPGI

SEQ ID NO: 71427 - protein, 4 aa, Mycobacterium avium
QRRA

SEQ ID NO: 71428 - protein, 8 aa, Mycobacterium avium
QRRAEGLG

SEQ ID NO: 71429 - protein, 46 aa, Mycobacterium avium
QRRAGDRDGGGGQEARGRGPRDPGGGGAVPAEGGAPKPARITPRGA

SEQ ID NO: 71430 - protein, 35 aa, Mycobacterium avium
QRRDAAPPAGPTAVAPQAMSGAQRRAAEKELAAAD

SEQ ID NO: 71431 - protein, 6 aa, Mycobacterium avium
QRRGPR

SEQ ID NO: 71432 - protein, 38 aa, Mycobacterium avium
QRRHRAAAGVPAGRGGAVRPGRRGRAGRRRRQPRSADL

SEQ ID NO: 71433 - protein, 6 aa, Mycobacterium avium
QRRPAQ

SEQ ID NO: 71434 - protein, 6 aa, Mycobacterium avium
QRRPVD

SEQ ID NO: 71435 - protein, 6 aa, Mycobacterium avium
QRRREL

SEQ ID NO: 71436 - protein, 5 aa, Mycobacterium avium
QRSGH

SEQ ID NO: 71437 - protein, 6 aa, Mycobacterium avium
QRSGST

SEQ ID NO: 71438 - protein, 5 aa, Mycobacterium avium
QRSIP

SEQ ID NO: 71439 - protein, 7 aa, Mycobacterium avium
QRTEPET

SEQ ID NO: 71440 - protein, 23 aa, Mycobacterium avium
QRTHRNPSTQHTIDRRDQPHRRQ

SEQ ID NO: 71441 - protein, 7 aa, Mycobacterium avium
QRTPELR

SEQ ID NO: 71442 - protein, 7 aa, Mycobacterium avium
QRTPLGG

SEQ ID NO: 71443 - protein, 9 aa, Mycobacterium avium
QRTRERRPD

SEQ ID NO: 71444 - protein, 4 aa, Mycobacterium avium
QRTV

SEQ ID NO: 71445 - protein, 22 aa, Mycobacterium avium
QRTVGRPGRRLPRGRDRPRLPR

SEQ ID NO: 71446 - protein, 10 aa, Mycobacterium avium
QRVDAGPQRG

SEQ ID NO: 71447 - protein, 7 aa, Mycobacterium avium
QRVNGAP

SEQ ID NO: 71448 - protein, 9 aa, Mycobacterium avium
QRVNGAPAS

SEQ ID NO: 71449 - protein, 8 aa, Mycobacterium avium
QRVNGTPA

SEQ ID NO: 71450 - protein, 6 aa, Mycobacterium avium
QRVRPE

SEQ ID NO: 71451 - protein, 13 aa, Mycobacterium avium
QSADGHSLSRPTW

SEQ ID NO: 71452 - protein, 6 aa, Mycobacterium avium
QSAELP

SEQ ID NO: 71453 - protein, 13 aa, Mycobacterium avium
QSAGCDVAGWPPG

SEQ ID NO: 71454 - protein, 8 aa, Mycobacterium avium
QSAGGAAT

SEQ ID NO: 71455 - protein, 7 aa, Mycobacterium avium
QSAKPVV

SEQ ID NO: 71456 - protein, 4 aa, Mycobacterium avium
QSAM

SEQ ID NO: 71457 - protein, 9 aa, Mycobacterium avium
QSATVDSAR

SEQ ID NO: 71458 - protein, 6 aa, Mycobacterium avium
QSDGSE

SEQ ID NO: 71459 - protein, 7 aa, Mycobacterium avium
QSDYARM

SEQ ID NO: 71460 - protein, 4 aa, Mycobacterium avium
QSED

SEQ ID NO: 71461 - protein, 6 aa, Mycobacterium avium
QSERDR

SEQ ID NO: 71462 - protein, 5 aa, Mycobacterium avium
QSERL

SEQ ID NO: 71463 - protein, 6 aa, Mycobacterium avium
QSFAGR

SEQ ID NO: 71464 - protein, 6 aa, Mycobacterium avium
QSFASS

SEQ ID NO: 71465 - protein, 8 aa, Mycobacterium avium
QSGDVTNP

SEQ ID NO: 71466 - protein, 4 aa, Mycobacterium avium
QSGH

SEQ ID NO: 71467 - protein, 27 aa, Mycobacterium avium
QSGHRLPKPPPGYSGNTITTPSKTEVS

SEQ ID NO: 71468 - protein, 23 aa, Mycobacterium avium
QSGIGREGGPEGIAGFVEHQAII

SEQ ID NO: 71469 - protein, 5 aa, Mycobacterium avium
QSGIR

SEQ ID NO: 71470 - protein, 16 aa, Mycobacterium avium
QSGKPTKVFGDGTNTR

SEQ ID NO: 71471 - protein, 9 aa, Mycobacterium avium
QSGNAGPAV

SEQ ID NO: 71472 - protein, 12 aa, Mycobacterium avium
QSGPPGERRARR

SEQ ID NO: 71473 - protein, 14 aa, Mycobacterium avium
QSGTSRPADAPERT

SEQ ID NO: 71474 - protein, 23 aa, Mycobacterium avium
QSGVGREGGPEGIAGFIEYQSVI

SEQ ID NO: 71475 - protein, 10 aa, Mycobacterium avium
QSHNATEYGS

SEQ ID NO: 71476 - protein, 11 aa, Mycobacterium avium
QSHNGDSGGPV

SEQ ID NO: 71477 - protein, 5 aa, Mycobacterium avium
QSHRL

SEQ ID NO: 71478 - protein, 15 aa, Mycobacterium avium
QSHSPGHRAASTPLE

SEQ ID NO: 71479 - protein, 5 aa, Mycobacterium avium
QSIDE

SEQ ID NO: 71480 - protein, 9 aa, Mycobacterium avium
QSKNPDSPF

SEQ ID NO: 71481 - protein, 14 aa, Mycobacterium avium
QSKSAYQAEIDSPC

SEQ ID NO: 71482 - protein, 12 aa, Mycobacterium avium
QSLSGELTYGQS

SEQ ID NO: 71483 - protein, 14 aa, Mycobacterium avium
QSMQAQDAADSNNG

SEQ ID NO: 71484 - protein, 6 aa, Mycobacterium avium
QSPALI

SEQ ID NO: 71485 - protein, 13 aa, Mycobacterium avium
QSPGIDSAPQFPP

SEQ ID NO: 71486 - protein, 9 aa, Mycobacterium avium
QSPPSAGFA

SEQ ID NO: 71487 - protein, 8 aa, Mycobacterium avium
QSPSRKDR

SEQ ID NO: 71488 - protein, 7 aa, Mycobacterium avium
QSQAMGP

SEQ ID NO: 71489 - protein, 12 aa, Mycobacterium avium
QSQPRPRQVDPT

SEQ ID NO: 71490 - protein, 6 aa, Mycobacterium avium
QSQWKE

SEQ ID NO: 71491 - protein, 23 aa, Mycobacterium avium
QSRSGVTTETGNVRVDDAVWERG

SEQ ID NO: 71492 - protein, 17 aa, Mycobacterium avium
QSRSRADTFGPDAAGGD

SEQ ID NO: 71493 - protein, 15 aa, Mycobacterium avium
QSRTDRDIPVVVLTP

SEQ ID NO: 71494 - protein, 7 aa, Mycobacterium avium
QSSATGM

SEQ ID NO: 71495 - protein, 11 aa, Mycobacterium avium
QSSGGRDQPYQ

SEQ ID NO: 71496 - protein, 8 aa, Mycobacterium avium
QSTADRNP

SEQ ID NO: 71497 - protein, 6 aa, Mycobacterium avium
QSVPEK

SEQ ID NO: 71498 - protein, 6 aa, Mycobacterium avium
QSVQNT

SEQ ID NO: 71499 - protein, 5 aa, Mycobacterium avium
QSVST

SEQ ID NO: 71500 - protein, 19 aa, Mycobacterium avium
QSWKKPQPRDDAEALKASS

SEQ ID NO: 71501 - protein, 4 aa, Mycobacterium avium
QSYL

SEQ ID NO: 71502 - protein, 18 aa, Mycobacterium avium
QTDAAAGALPGLSQPAAK

SEQ ID NO: 71503 - protein, 6 aa, Mycobacterium avium
QTDPYT

SEQ ID NO: 71504 - protein, 6 aa, Mycobacterium avium
QTEALA

SEQ ID NO: 71505 - protein, 7 aa, Mycobacterium avium
QTEALAT

SEQ ID NO: 71506 - protein, 4 aa, Mycobacterium avium
QTEG

SEQ ID NO: 71507 - protein, 10 aa, Mycobacterium avium
QTEGSIPEEI

SEQ ID NO: 71508 - protein, 5 aa, Mycobacterium avium
QTFGG

SEQ ID NO: 71509 - protein, 6 aa, Mycobacterium avium
QTFRGP

SEQ ID NO: 71510 - protein, 22 aa, Mycobacterium avium
QTFRSDRYPEYKANRSATPDEF

SEQ ID NO: 71511 - protein, 15 aa, Mycobacterium avium
QTGDQPAWVEASSPN

SEQ ID NO: 71512 - protein, 10 aa, Mycobacterium avium
QTGHQPAGLP

SEQ ID NO: 71513 - protein, 8 aa, Mycobacterium avium
QTGQHGTD

SEQ ID NO: 71514 - protein, 13 aa, Mycobacterium avium
QTHKRPDAERGPG

SEQ ID NO: 71515 - protein, 12 aa, Mycobacterium avium
QTHTPRTITGPD

SEQ ID NO: 71516 - protein, 12 aa, Mycobacterium avium
QTIPKRAAKPIK

SEQ ID NO: 71517 - protein, 10 aa, Mycobacterium avium
QTKSSASAQG

SEQ ID NO: 71518 - protein, 6 aa, Mycobacterium avium
QTLGPA

SEQ ID NO: 71519 - protein, 9 aa, Mycobacterium avium
QTLSSPATV

SEQ ID NO: 71520 - protein, 8 aa, Mycobacterium avium
QTPAERDR

SEQ ID NO: 71521 - protein, 5 aa, Mycobacterium avium
QTPDD

SEQ ID NO: 71522 - protein, 20 aa, Mycobacterium avium
QTPDSAQARREEITGSNGSK

SEQ ID NO: 71523 - protein, 4 aa, Mycobacterium avium
QTPG

SEQ ID NO: 71524 - protein, 16 aa, Mycobacterium avium
QTPGGPAAALPPPAGL

SEQ ID NO: 71525 - protein, 14 aa, Mycobacterium avium
QTPSAAGALSPQGL

SEQ ID NO: 71526 - protein, 6 aa, Mycobacterium avium
QTPSAF

SEQ ID NO: 71527 - protein, 14 aa, Mycobacterium avium
QTPSAVSTLSPHGL

SEQ ID NO: 71528 - protein, 37 aa, Mycobacterium avium
QTPVEPTPPPETSQAEPETSEVEPETQAEPEPETETP

SEQ ID NO: 71529 - protein, 7 aa, Mycobacterium avium
QTQRGDG

SEQ ID NO: 71530 - protein, 29 aa, Mycobacterium avium
QTRCPRAPRSTRGAGPGRRSGRRAPGAAA

SEQ ID NO: 71531 - protein, 5 aa, Mycobacterium avium
QTRDA

SEQ ID NO: 71532 - protein, 6 aa, Mycobacterium avium
QTRDAI

SEQ ID NO: 71533 - protein, 7 aa, Mycobacterium avium
QTRDGAV

SEQ ID NO: 71534 - protein, 8 aa, Mycobacterium avium
QTRGDGRT

SEQ ID NO: 71535 - protein, 9 aa, Mycobacterium avium
QTRREITTA

SEQ ID NO: 71536 - protein, 5 aa, Mycobacterium avium
QTRSR

SEQ ID NO: 71537 - protein, 18 aa, Mycobacterium avium
QTSAGSYAATEAANAAAA

SEQ ID NO: 71538 - protein, 11 aa, Mycobacterium avium
QTSPATSAEYE

SEQ ID NO: 71539 - protein, 11 aa, Mycobacterium avium
QTSRTFGRGPR

SEQ ID NO: 71540 - protein, 7 aa, Mycobacterium avium
QTSSDLV

SEQ ID NO: 71541 - protein, 7 aa, Mycobacterium avium
QTTAKYP

SEQ ID NO: 71542 - protein, 4 aa, Mycobacterium avium
QTTE

SEQ ID NO: 71543 - protein, 14 aa, Mycobacterium avium
QTTIDASASVSSPG

SEQ ID NO: 71544 - protein, 6 aa, Mycobacterium avium
QTTPWV

SEQ ID NO: 71545 - protein, 7 aa, Mycobacterium avium
QTTSGTG

SEQ ID NO: 71546 - protein, 13 aa, Mycobacterium avium
QTTVDASASVSSP

SEQ ID NO: 71547 - protein, 7 aa, Mycobacterium avium
QTVAGPQ

SEQ ID NO: 71548 - protein, 12 aa, Mycobacterium avium
QTYGDTEAGAGA

SEQ ID NO: 71549 - protein, 7 aa, Mycobacterium avium
QVADSAN

SEQ ID NO: 71550 - protein, 14 aa, Mycobacterium avium
QVAGDGPAAKPSDE

SEQ ID NO: 71551 - protein, 11 aa, Mycobacterium avium
QVARDDARAEL

SEQ ID NO: 71552 - protein, 8 aa, Mycobacterium avium
QVDEPASI

SEQ ID NO: 71553 - protein, 12 aa, Mycobacterium avium
QVDGTPALESAD

SEQ ID NO: 71554 - protein, 12 aa, Mycobacterium avium
QVDPEGKLPPAL

SEQ ID NO: 71555 - protein, 13 aa, Mycobacterium avium
QVDSQAPRPEYTE

SEQ ID NO: 71556 - protein, 12 aa, Mycobacterium avium
QVEEPESTTAPV

SEQ ID NO: 71557 - protein, 9 aa, Mycobacterium avium
QVEHETGRR

SEQ ID NO: 71558 - protein, 9 aa, Mycobacterium avium
QVGRDAGTA

SEQ ID NO: 71559 - protein, 10 aa, Mycobacterium avium
QVGRDAGTGF

SEQ ID NO: 71560 - protein, 19 aa, Mycobacterium avium
QVKPDDTFAPAPDTDDHEA

SEQ ID NO: 71561 - protein, 8 aa, Mycobacterium avium
QVKPGTVA

SEQ ID NO: 71562 - protein, 10 aa, Mycobacterium avium
QVKPGTVTRT

SEQ ID NO: 71563 - protein, 13 aa, Mycobacterium avium
QVLTGGAGGLAGR

SEQ ID NO: 71564 - protein, 9 aa, Mycobacterium avium
QVPDPEGQQ

SEQ ID NO: 71565 - protein, 11 aa, Mycobacterium avium
QVPEGVSPAGR

SEQ ID NO: 71566 - protein, 7 aa, Mycobacterium avium
QVPERER

SEQ ID NO: 71567 - protein, 12 aa, Mycobacterium avium
QVPPAGWERPSN

SEQ ID NO: 71568 - protein, 8 aa, Mycobacterium avium
QVPRDYDR

SEQ ID NO: 71569 - protein, 12 aa, Mycobacterium avium
QVPSANWERPSN

SEQ ID NO: 71570 - protein, 11 aa, Mycobacterium avium
QVRGTSHNQVD

SEQ ID NO: 71571 - protein, 7 aa, Mycobacterium avium
QVRPEQQ

SEQ ID NO: 71572 - protein, 5 aa, Mycobacterium avium
QVRPG

SEQ ID NO: 71573 - protein, 5 aa, Mycobacterium avium
QVSEG

SEQ ID NO: 71574 - protein, 13 aa, Mycobacterium avium
QVSGRAELPPDQM

SEQ ID NO: 71575 - protein, 10 aa, Mycobacterium avium
QVSIDGETHR

SEQ ID NO: 71576 - protein, 7 aa, Mycobacterium avium
QVTQKGL

SEQ ID NO: 71577 - protein, 10 aa, Mycobacterium avium
QWGDAAGAVR

SEQ ID NO: 71578 - protein, 20 aa, Mycobacterium avium
QWGPPASKNFLGTNPKALPH

SEQ ID NO: 71579 - protein, 6 aa, Mycobacterium avium
QWNASG

SEQ ID NO: 71580 - protein, 12 aa, Mycobacterium avium
QWPGGAPSPLAE

SEQ ID NO: 71581 - protein, 7 aa, Mycobacterium avium
QWPPGTT

SEQ ID NO: 71582 - protein, 7 aa, Mycobacterium avium
QYGGGGV

SEQ ID NO: 71583 - protein, 4 aa, Mycobacterium avium
QYHR

SEQ ID NO: 71584 - protein, 13 aa, Mycobacterium avium
QYPPGTAFGSPMG

SEQ ID NO: 71585 - protein, 12 aa, Mycobacterium avium
QYRQRTGRELTD

SEQ ID NO: 71586 - protein, 6 aa, Mycobacterium avium
QYSPTM

SEQ ID NO: 71587 - protein, 10 aa, Mycobacterium avium
RAAAELGGAT

SEQ ID NO: 71588 - protein, 11 aa, Mycobacterium avium
RAAAELGGATQ

SEQ ID NO: 71589 - protein, 12 aa, Mycobacterium avium
RAAAERPDPPAG

SEQ ID NO: 71590 - protein, 77 aa, Mycobacterium avium
RAAAGPLRHRRQDAAGRRAAGRARADRPGEGPRPGAPRPRGGAHRRPGHRRPGSVGPQPDRRGPAGRRGRGRGGGGL

SEQ ID NO: 71591 - protein, 14 aa, Mycobacterium avium
RAAANPRRVIPPRR

SEQ ID NO: 71592 - protein, 14 aa, Mycobacterium avium
RAAAPARSSNSPTP

SEQ ID NO: 71593 - protein, 10 aa, Mycobacterium avium
RAAARAPITE

SEQ ID NO: 71594 - protein, 5 aa, Mycobacterium avium
RAAAY

SEQ ID NO: 71595 - protein, 30 aa, Mycobacterium avium
RAADRGDPERQPQQGHRPAGGRHPQPDLGD

SEQ ID NO: 71596 - protein, 6 aa, Mycobacterium avium
RAAEIG

SEQ ID NO: 71597 - protein, 7 aa, Mycobacterium avium
RAAERYA

SEQ ID NO: 71598 - protein, 8 aa, Mycobacterium avium
RAAEVEDR

SEQ ID NO: 71599 - protein, 9 aa, Mycobacterium avium
RAAGADALH

SEQ ID NO: 71600 - protein, 14 aa, Mycobacterium avium
RAAGAPAATSPRSI

SEQ ID NO: 71601 - protein, 11 aa, Mycobacterium avium
RAAGKTPDELA

SEQ ID NO: 71602 - protein, 13 aa, Mycobacterium avium
RAAGTSRQDPRPA

SEQ ID NO: 71603 - protein, 11 aa, Mycobacterium avium
RAALESTDDPK

SEQ ID NO: 71604 - protein, 9 aa, Mycobacterium avium
RAALSGPAA

SEQ ID NO: 71605 - protein, 5 aa, Mycobacterium avium
RAANP

SEQ ID NO: 71606 - protein, 4 aa, Mycobacterium avium
RAAP

SEQ ID NO: 71607 - protein, 9 aa, Mycobacterium avium
RAAPAAASR

SEQ ID NO: 71608 - protein, 8 aa, Mycobacterium avium
RAAPNPDD

SEQ ID NO: 71609 - protein, 8 aa, Mycobacterium avium
RAAPNPDG

SEQ ID NO: 71610 - protein, 8 aa, Mycobacterium avium
RAAPNPND

SEQ ID NO: 71611 - protein, 11 aa, Mycobacterium avium
RAAQDGGQAVH

SEQ ID NO: 71612 - protein, 31 aa, Mycobacterium avium
RAAQPSTGRRNPSRRKRLGARGSRQCPNTEA

SEQ ID NO: 71613 - protein, 17 aa, Mycobacterium avium
RAARGDAGHSDAGAGTM

SEQ ID NO: 71614 - protein, 9 aa, Mycobacterium avium
RAASEAGIE

SEQ ID NO: 71615 - protein, 10 aa, Mycobacterium avium
RAATGAESET

SEQ ID NO: 71616 - protein, 16 aa, Mycobacterium avium
RAATPTGAMYFFMSFS

SEQ ID NO: 71617 - protein, 8 aa, Mycobacterium avium
RADAADTA

SEQ ID NO: 71618 - protein, 16 aa, Mycobacterium avium
RADAGQRLRPQPAQPG

SEQ ID NO: 71619 - protein, 22 aa, Mycobacterium avium
RADATTVGSPETLGEVGSDVAG

SEQ ID NO: 71620 - protein, 7 aa, Mycobacterium avium
RADDGLE

SEQ ID NO: 71621 - protein, 7 aa, Mycobacterium avium
RADDGPG

SEQ ID NO: 71622 - protein, 32 aa, Mycobacterium avium
RADEQTPGSPRAASPTTASSPSSTAGRGPRTW

SEQ ID NO: 71623 - protein, 8 aa, Mycobacterium avium
RADGAASV

SEQ ID NO: 71624 - protein, 8 aa, Mycobacterium avium
RADGAPDA

SEQ ID NO: 71625 - protein, 5 aa, Mycobacterium avium
RADGC

SEQ ID NO: 71626 - protein, 9 aa, Mycobacterium avium
RADGDEPQY

SEQ ID NO: 71627 - protein, 8 aa, Mycobacterium avium
RADGEMSR

SEQ ID NO: 71628 - protein, 7 aa, Mycobacterium avium
RADGRDC

SEQ ID NO: 71629 - protein, 13 aa, Mycobacterium avium
RADKIGGKRKNTV

SEQ ID NO: 71630 - protein, 10 aa, Mycobacterium avium
RADNPQPGGL

SEQ ID NO: 71631 - protein, 14 aa, Mycobacterium avium
RADPPAPERRVRPA

SEQ ID NO: 71632 - protein, 12 aa, Mycobacterium avium
RADPVANGKTLR

SEQ ID NO: 71633 - protein, 5 aa, Mycobacterium avium
RADQA

SEQ ID NO: 71634 - protein, 22 aa, Mycobacterium avium
RADQGGARSPAHQADPGPQVRA

SEQ ID NO: 71635 - protein, 6 aa, Mycobacterium avium
RADRDE

SEQ ID NO: 71636 - protein, 9 aa, Mycobacterium avium
RADRRQPVV

SEQ ID NO: 71637 - protein, 13 aa, Mycobacterium avium
RADRRRRRGRGQR

SEQ ID NO: 71638 - protein, 4 aa, Mycobacterium avium
RADV

SEQ ID NO: 71639 - protein, 6 aa, Mycobacterium avium
RADVEG

SEQ ID NO: 71640 - protein, 19 aa, Mycobacterium avium
RAEAEAEVQRSIERFKAQG

SEQ ID NO: 71641 - protein, 5 aa, Mycobacterium avium
RAEAV

SEQ ID NO: 71642 - protein, 6 aa, Mycobacterium avium
RAEDRQ

SEQ ID NO: 71643 - protein, 7 aa, Mycobacterium avium
RAEERKA

SEQ ID NO: 71644 - protein, 8 aa, Mycobacterium avium
RAEERPVR

SEQ ID NO: 71645 - protein, 9 aa, Mycobacterium avium
RAEERSETT

SEQ ID NO: 71646 - protein, 4 aa, Mycobacterium avium
RAEG

SEQ ID NO: 71647 - protein, 23 aa, Mycobacterium avium
RAEGFDTDNPSLKATDTFIIKVA

SEQ ID NO: 71648 - protein, 50 aa, Mycobacterium avium; identical to SEQ ID NO: 6332

SEQ ID NO: 71649 - protein, 8 aa, Mycobacterium avium
RAEQLEGV

SEQ ID NO: 71650 - protein, 7 aa, Mycobacterium avium
RAERAMS

SEQ ID NO: 71651 - protein, 6 aa, Mycobacterium avium
RAESDA

SEQ ID NO: 71652 - protein, 11 aa, Mycobacterium avium
RAESKESGAKV

SEQ ID NO: 71653 - protein, 11 aa, Mycobacterium avium
RAESKESGGKV

SEQ ID NO: 71654 - protein, 9 aa, Mycobacterium avium
RAESSEAVG

SEQ ID NO: 71655 - protein, 7 aa, Mycobacterium avium
RAETTGV

SEQ ID NO: 71656 - protein, 4 aa, Mycobacterium avium
RAFP

SEQ ID NO: 71657 - protein, 4 aa, Mycobacterium avium
RAGA

SEQ ID NO: 71658 - protein, 7 aa, Mycobacterium avium
RAGADSL

SEQ ID NO: 71659 - protein, 12 aa, Mycobacterium avium
RAGAGRGQAMRQ

SEQ ID NO: 71660 - protein, 7 aa, Mycobacterium avium
RAGARAE

SEQ ID NO: 71661 - protein, 18 aa, Mycobacterium avium
RAGARRAAHGGTPAIPSH

SEQ ID NO: 71662 - protein, 7 aa, Mycobacterium avium
RAGATID

SEQ ID NO: 71663 - protein, 5 aa, Mycobacterium avium
RAGDA

SEQ ID NO: 71664 - protein, 11 aa, Mycobacterium avium
RAGDEEATNTD

SEQ ID NO: 71665 - protein, 34 aa, Mycobacterium avium
RAGDGVAGRGRLSGPQGGAAGLAGLSSGYQASSS

SEQ ID NO: 71666 - protein, 6 aa, Mycobacterium avium
RAGDSR

SEQ ID NO: 71667 - protein, 8 aa, Mycobacterium avium
RAGEGKLT

SEQ ID NO: 71668 - protein, 7 aa, Mycobacterium avium
RAGEGPL

SEQ ID NO: 71669 - protein, 8 aa, Mycobacterium avium
RAGEPEEV

SEQ ID NO: 71670 - protein, 17 aa, Mycobacterium avium
RAGGDTARTKSCPKLGD

SEQ ID NO: 71671 - protein, 17 aa, Mycobacterium avium
RAGGGETTGSAAGPHTK

SEQ ID NO: 71672 - protein, 5 aa, Mycobacterium avium
RAGGL

SEQ ID NO: 71673 - protein, 17 aa, Mycobacterium avium
RAGGNTARTKSCPKLGD

SEQ ID NO: 71674 - protein, 7 aa, Mycobacterium avium
RAGHPGA

SEQ ID NO: 71675 - protein, 12 aa, Mycobacterium avium
RAGKNIRGVIAF

SEQ ID NO: 71676 - protein, 6 aa, Mycobacterium avium
RAGLGR

SEQ ID NO: 71677 - protein, 5 aa, Mycobacterium avium
RAGLT

SEQ ID NO: 71678 - protein, 6 aa, Mycobacterium avium
RAGNGE

SEQ ID NO: 71679 - protein, 9 aa, Mycobacterium avium
RAGPADTGP

SEQ ID NO: 71680 - protein, 16 aa, Mycobacterium avium
RAGPGHPGLPSRRREG

SEQ ID NO: 71681 - protein, 18 aa, Mycobacterium avium
RAGPPDSDASATLPGGTE

SEQ ID NO: 71682 - protein, 16 aa, Mycobacterium avium
RAGQKAERAQRERELQ

SEQ ID NO: 71683 - protein, 5 aa, Mycobacterium avium
RAGRK

SEQ ID NO: 71684 - protein, 9 aa, Mycobacterium avium
RAGRTAGSA

SEQ ID NO: 71685 - protein, 11 aa, Mycobacterium avium
RAGSGTAEIPV

SEQ ID NO: 71686 - protein, 14 aa, Mycobacterium avium
RAGTAGDDIRARAA

SEQ ID NO: 71687 - protein, 10 aa, Mycobacterium avium
RAGTSAQTRT

SEQ ID NO: 71688 - protein, 6 aa, Mycobacterium avium
RAGTVR

SEQ ID NO: 71689 - protein, 4 aa, Mycobacterium avium
RAGY

SEQ ID NO: 71690 - protein, 12 aa, Mycobacterium avium
RAHAGKSKRALA

SEQ ID NO: 71691 - protein, 8 aa, Mycobacterium avium
RAHAGPRV

SEQ ID NO: 71692 - protein, 10 aa, Mycobacterium avium
RAHDPEKAGI

SEQ ID NO: 71693 - protein, 11 aa, Mycobacterium avium
RAHDPERAGAA

SEQ ID NO: 71694 - protein, 17 aa, Mycobacterium avium
RAHRGPGEGREGRIPGP

SEQ ID NO: 71695 - protein, 7 aa, Mycobacterium avium
RAHTATE

SEQ ID NO: 71696 - protein, 5 aa, Mycobacterium avium
RAKAA

SEQ ID NO: 71697 - protein, 9 aa, Mycobacterium avium
RAKAETASA

SEQ ID NO: 71698 - protein, 12 aa, Mycobacterium avium
RAKAGLSVDGDG

SEQ ID NO: 71699 - protein, 6 aa, Mycobacterium avium
RAKDLR

SEQ ID NO: 71700 - protein, 6 aa, Mycobacterium avium
RAKELG

SEQ ID NO: 71701 - protein, 7 aa, Mycobacterium avium
RAKKNAI

SEQ ID NO: 71702 - protein, 6 aa, Mycobacterium avium
RAKRTR

SEQ ID NO: 71703 - protein, 6 aa, Mycobacterium avium
RALDTG

SEQ ID NO: 71704 - protein, 4 aa, Mycobacterium avium
RALG

SEQ ID NO: 71705 - protein, 8 aa, Mycobacterium avium
RALGGTSN

SEQ ID NO: 71706 - protein, 22 aa, Mycobacterium avium
RALPAPEYAGGAYRAPSTPTEE

SEQ ID NO: 71707 - protein, 7 aa, Mycobacterium avium
RALRSAT

SEQ ID NO: 71708 - protein, 12 aa, Mycobacterium avium
RALSQKSQQASI

SEQ ID NO: 71709 - protein, 9 aa, Mycobacterium avium
RANAELNPT

SEQ ID NO: 71710 - protein, 5 aa, Mycobacterium avium
RANDG

SEQ ID NO: 71711 - protein, 6 aa, Mycobacterium avium
RANDGI

SEQ ID NO: 71712 - protein, 4 aa, Mycobacterium avium
RANR

SEQ ID NO: 71713 - protein, 7 aa, Mycobacterium avium
RANRSPV

SEQ ID NO: 71714 - protein, 6 aa, Mycobacterium avium
RANTAF

SEQ ID NO: 71715 - protein, 9 aa, Mycobacterium avium
RANTASARA

SEQ ID NO: 71716 - protein, 6 aa, Mycobacterium avium
RAPAPA

SEQ ID NO: 71717 - protein, 6 aa, Mycobacterium avium
RAPDRR

SEQ ID NO: 71718 - protein, 15 aa, Mycobacterium avium
RAPGPPSSADPGSPA

SEQ ID NO: 71719 - protein, 13 aa, Mycobacterium avium
RAPKRVRRQSREY

SEQ ID NO: 71720 - protein, 6 aa, Mycobacterium avium
RAPLSR

SEQ ID NO: 71721 - protein, 6 aa, Mycobacterium avium
RAPNPH

SEQ ID NO: 71722 - protein, 7 aa, Mycobacterium avium
RAPPASR

SEQ ID NO: 71723 - protein, 7 aa, Mycobacterium avium
RAPRPVD

SEQ ID NO: 71724 - protein, 9 aa, Mycobacterium avium
RAPSDPDQP

SEQ ID NO: 71725 - protein, 8 aa, Mycobacterium avium
RAPSRDTY

SEQ ID NO: 71726 - protein, 19 aa, Mycobacterium avium
RAPVPGGVEVGSPKTAAGL

SEQ ID NO: 71727 - protein, 12 aa, Mycobacterium avium
RAQAPSAQSGSV

SEQ ID NO: 71728 - protein, 5 aa, Mycobacterium avium
RAQEP

SEQ ID NO: 71729 - protein, 5 aa, Mycobacterium avium
RAQLP

SEQ ID NO: 71730 - protein, 5 aa, Mycobacterium avium
RAQNA

SEQ ID NO: 71731 - protein, 16 aa, Mycobacterium avium
RAQNPTGAALSADRAA

SEQ ID NO: 71732 - protein, 19 aa, Mycobacterium avium
RAQPESGTHRSRPTAEDRP

SEQ ID NO: 71733 - protein, 8 aa, Mycobacterium avium
RAQPRLSE

SEQ ID NO: 71734 - protein, 6 aa, Mycobacterium avium
RAQPVT

SEQ ID NO: 71735 - protein, 16 aa, Mycobacterium avium
RAQRARSARSRGSSMS

SEQ ID NO: 71736 - protein, 10 aa, Mycobacterium avium
RAQRDSDRNA

SEQ ID NO: 71737 - protein, 21 aa, Mycobacterium avium
RAQRTASAQRTRELLSELVRL

SEQ ID NO: 71738 - protein, 9 aa, Mycobacterium avium
RAQSSEKIR

SEQ ID NO: 71739 - protein, 9 aa, Mycobacterium avium
RAQTDWTPR

SEQ ID NO: 71740 - protein, 4 aa, Mycobacterium avium
RARA

SEQ ID NO: 71741 - protein, 11 aa, Mycobacterium avium
RARAALDSESL

SEQ ID NO: 71742 - protein, 5 aa, Mycobacterium avium
RARAM

SEQ ID NO: 71743 - protein, 11 aa, Mycobacterium avium
RARAVSDGRPV

SEQ ID NO: 71744 - protein, 6 aa, Mycobacterium avium
RARETF

SEQ ID NO: 71745 - protein, 8 aa, Mycobacterium avium
RAREYTDT

SEQ ID NO: 71746 - protein, 9 aa, Mycobacterium avium
RARGEQTRR

SEQ ID NO: 71747 - protein, 18 aa, Mycobacterium avium
RARGHGDEGGDNDPMNAH

SEQ ID NO: 71748 - protein, 4 aa, Mycobacterium avium
RARH

SEQ ID NO: 71749 - protein, 10 aa, Mycobacterium avium
RARKSGVEQP

SEQ ID NO: 71750 - protein, 4 aa, Mycobacterium avium
RARP

SEQ ID NO: 71751 - protein, 7 aa, Mycobacterium avium
RARRAQR

SEQ ID NO: 71752 - protein, 17 aa, Mycobacterium avium
RARRDAAAAQSRLDAGE

SEQ ID NO: 71753 - protein, 8 aa, Mycobacterium avium
RARSAALT

SEQ ID NO: 71754 - protein, 7 aa, Mycobacterium avium
RARSTGK

SEQ ID NO: 71755 - protein, 46 aa, Mycobacterium avium
RARTDLSQGVAPARRDADRVGEHPAHHGTAHPGHLPRQPRPRLPHP

SEQ ID NO: 71756 - protein, 9 aa, Mycobacterium avium
RASAGDPDR

SEQ ID NO: 71757 - protein, 19 aa, Mycobacterium avium
RASARTRGKLKRPGFPGGS

SEQ ID NO: 71758 - protein, 7 aa, Mycobacterium avium
RASATAT

SEQ ID NO: 71759 - protein, 15 aa, Mycobacterium avium
RASATATHARLGGPG

SEQ ID NO: 71760 - protein, 15 aa, Mycobacterium avium
RASATATHERLGGPG

SEQ ID NO: 71761 - protein, 8 aa, Mycobacterium avium
RASEDGQA

SEQ ID NO: 71762 - protein, 40 aa, Mycobacterium avium
RASGPTPEPPPDGPPGGAPDTPDTGQAPRTRYQPIPVTFE

SEQ ID NO: 71763 - protein, 5 aa, Mycobacterium avium
RASGS

SEQ ID NO: 71764 - protein, 15 aa, Mycobacterium avium
RASHNDAVTGGRPSL

SEQ ID NO: 71765 - protein, 6 aa, Mycobacterium avium
RASLGD

SEQ ID NO: 71766 - protein, 20 aa, Mycobacterium avium
RASPGARRHYDARRAAGDWN

SEQ ID NO: 71767 - protein, 9 aa, Mycobacterium avium
RASRDGARL

SEQ ID NO: 71768 - protein, 8 aa, Mycobacterium avium
RASSDSQA

SEQ ID NO: 71769 - protein, 15 aa, Mycobacterium avium
RATAERPQQRAAQRR

SEQ ID NO: 71770 - protein, 7 aa, Mycobacterium avium
RATAPLS

SEQ ID NO: 71771 - protein, 14 aa, Mycobacterium avium
RATDPAVRPTGDEL

SEQ ID NO: 71772 - protein, 8 aa, Mycobacterium avium
RATDTHPD

SEQ ID NO: 71773 - protein, 7 aa, Mycobacterium avium
RATEDVE

SEQ ID NO: 71774 - protein, 16 aa, Mycobacterium avium
RATEIPAQTGSEDFSD

SEQ ID NO: 71775 - protein, 8 aa, Mycobacterium avium
RATGAAKK

SEQ ID NO: 71776 - protein, 7 aa, Mycobacterium avium
RATGATS

SEQ ID NO: 71777 - protein, 6 aa, Mycobacterium avium
RATGFK

SEQ ID NO: 71778 - protein, 6 aa, Mycobacterium avium
RATGGR

SEQ ID NO: 71779 - protein, 20 aa, Mycobacterium avium
RATGGRLESGPVEPAPGNVT

SEQ ID NO: 71780 - protein, 6 aa, Mycobacterium avium
RATGLT

SEQ ID NO: 71781 - protein, 8 aa, Mycobacterium avium
RATGRGLR

SEQ ID NO: 71782 - protein, 7 aa, Mycobacterium avium
RATGSGH

SEQ ID NO: 71783 - protein, 7 aa, Mycobacterium avium
RATGTGV

SEQ ID NO: 71784 - protein, 7 aa, Mycobacterium avium
RATITAA

SEQ ID NO: 71785 - protein, 7 aa, Mycobacterium avium
RATKPGA

SEQ ID NO: 71786 - protein, 5 aa, Mycobacterium avium
RATPR

SEQ ID NO: 71787 - protein, 4 aa, Mycobacterium avium
RATQ

SEQ ID NO: 71788 - protein, 19 aa, Mycobacterium avium
RATQPRCSGAPGSHRGSSE

SEQ ID NO: 71789 - protein, 6 aa, Mycobacterium avium
RATRAE

SEQ ID NO: 71790 - protein, 25 aa, Mycobacterium avium
RATRPAPAASQSWPAGHGPDADPPP

SEQ ID NO: 71791 - protein, 14 aa, Mycobacterium avium
RATSGDNQLGGDDW

SEQ ID NO: 71792 - protein, 8 aa, Mycobacterium avium
RATTGAVR

SEQ ID NO: 71793 - protein, 6 aa, Mycobacterium avium
RATTRT

SEQ ID NO: 71794 - protein, 7 aa, Mycobacterium avium
RATTSFE

SEQ ID NO: 71795 - protein, 4 aa, Mycobacterium avium
RAVA

SEQ ID NO: 71796 - protein, 13 aa, Mycobacterium avium
RAVGGEKIGTLVT

SEQ ID NO: 71797 - protein, 10 aa, Mycobacterium avium
RAVNDHGLQP

SEQ ID NO: 71798 - protein, 4 aa, Mycobacterium avium
RAVP

SEQ ID NO: 71799 - protein, 7 aa, Mycobacterium avium
RAVPDAA

SEQ ID NO: 71800 - protein, 8 aa, Mycobacterium avium
RAVPDAAA

SEQ ID NO: 71801 - protein, 9 aa, Mycobacterium avium
RAVQRDRDD

SEQ ID NO: 71802 - protein, 13 aa, Mycobacterium avium
RAVTADEPAWSTW

SEQ ID NO: 71803 - protein, 10 aa, Mycobacterium avium
RAVTDDAANS

SEQ ID NO: 71804 - protein, 4 aa, Mycobacterium avium
RAWG

SEQ ID NO: 71805 - protein, 4 aa, Mycobacterium avium
RAYE

SEQ ID NO: 71806 - protein, 7 aa, Mycobacterium avium
RAYRQDG

SEQ ID NO: 71807 - protein, 11 aa, Mycobacterium avium
RCASTANSPGA

SEQ ID NO: 71808 - protein, 4 aa, Mycobacterium avium
RCDD

SEQ ID NO: 71809 - protein, 5 aa, Mycobacterium avium
RCGSG

SEQ ID NO: 71810 - protein, 8 aa, Mycobacterium avium
RCNPRTGD

SEQ ID NO: 71811 - protein, 25 aa, Mycobacterium avium
RCPAAGSRSRPRRSRRRRTRQRNRL

SEQ ID NO: 71812 - protein, 5 aa, Mycobacterium avium
RCPRG

SEQ ID NO: 71813 - protein, 9 aa, Mycobacterium avium
RCRGRPPDW

SEQ ID NO: 71814 - protein, 7 aa, Mycobacterium avium
RCSPSDI

SEQ ID NO: 71815 - protein, 6 aa, Mycobacterium avium
RCTPED

SEQ ID NO: 71816 - protein, 9 aa, Mycobacterium avium
RDAANGLPR

SEQ ID NO: 71817 - protein, 14 aa, Mycobacterium avium
RDAAPAEDAEERSA

SEQ ID NO: 71818 - protein, 8 aa, Mycobacterium avium
RDAEERRV

SEQ ID NO: 71819 - protein, 5 aa, Mycobacterium avium
RDAEL

SEQ ID NO: 71820 - protein, 6 aa, Mycobacterium avium
RDAGAL

SEQ ID NO: 71821 - protein, 12 aa, Mycobacterium avium
RDAGGTDKVVWK

SEQ ID NO: 71822 - protein, 5 aa, Mycobacterium avium
RDANF

SEQ ID NO: 71823 - protein, 7 aa, Mycobacterium avium
RDAPASA

SEQ ID NO: 71824 - protein, 20 aa, Mycobacterium avium
RDAQEKFNAGMGADGAATPY

SEQ ID NO: 71825 - protein, 8 aa, Mycobacterium avium
RDAQGGRM

SEQ ID NO: 71826 - protein, 9 aa, Mycobacterium avium
RDATKGLPR

SEQ ID NO: 71827 - protein, 4 aa, Mycobacterium avium
RDCK

SEQ ID NO: 71828 - protein, 7 aa, Mycobacterium avium
RDDATGE

SEQ ID NO: 71829 - protein, 7 aa, Mycobacterium avium
RDDDFTE

SEQ ID NO: 71830 - protein, 9 aa, Mycobacterium avium
RDDDPEDAL

SEQ ID NO: 71831 - protein, 6 aa, Mycobacterium avium
RDDEFT

SEQ ID NO: 71832 - protein, 8 aa, Mycobacterium avium
RDDGAGHP

SEQ ID NO: 71833 - protein, 15 aa, Mycobacterium avium
RDDPRLPDSVDTPHG

SEQ ID NO: 71834 - protein, 15 aa, Mycobacterium avium
RDDPRLPDSVETPHG

SEQ ID NO: 71835 - protein, 7 aa, Mycobacterium avium
RDDSGAR

SEQ ID NO: 71836 - protein, 14 aa, Mycobacterium avium
RDDSGSAPDPTLPP

SEQ ID NO: 71837 - protein, 20 aa, Mycobacterium avium
RDDTGRHHERTHHDSVTIGP

SEQ ID NO: 71838 - protein, 20 aa, Mycobacterium avium
RDDTGRHHERTHRDSVTIGP

SEQ ID NO: 71839 - protein, 7 aa, Mycobacterium avium
RDDVPED

SEQ ID NO: 71840 - protein, 7 aa, Mycobacterium avium
RDDYSGD

SEQ ID NO: 71841 - protein, 11 aa, Mycobacterium avium
RDEAQFGSDAG

SEQ ID NO: 71842 - protein, 17 aa, Mycobacterium avium
RDEDKDPIGSAGTDPDG

SEQ ID NO: 71843 - protein, 17 aa, Mycobacterium avium
RDEEKDPIGSAGTDPDG

SEQ ID NO: 71844 - protein, 7 aa, Mycobacterium avium
RDEPRRP

SEQ ID NO: 71845 - protein, 9 aa, Mycobacterium avium
RDESARVNL

SEQ ID NO: 71846 - protein, 4 aa, Mycobacterium avium
RDGA

SEQ ID NO: 71847 - protein, 8 aa, Mycobacterium avium
RDGAEAEA

SEQ ID NO: 71848 - protein, 4 aa, Mycobacterium avium
RDGD

SEQ ID NO: 71849 - protein, 9 aa, Mycobacterium avium
RDGDKLRAA

SEQ ID NO: 71850 - protein, 6 aa, Mycobacterium avium
RDGDLD

SEQ ID NO: 71851 - protein, 5 aa, Mycobacterium avium
RDGDS

SEQ ID NO: 71852 - protein, 12 aa, Mycobacterium avium
RDGGDHQRAGNE

SEQ ID NO: 71853 - protein, 30 aa, Mycobacterium avium
RDGGDHQRAGNELTATDWDPASKQPSFKTA

SEQ ID NO: 71854 - protein, 31 aa, Mycobacterium avium
RDGGDHQRAGNELTATDWDPASKQPSFKTAA

SEQ ID NO: 71855 - protein, 5 aa, Mycobacterium avium
RDGRP

SEQ ID NO: 71856 - protein, 5 aa, Mycobacterium avium
RDGRT

SEQ ID NO: 71857 - protein, 8 aa, Mycobacterium avium
RDGSPADM

SEQ ID NO: 71858 - protein, 10 aa, Mycobacterium avium
RDGSPADMGG

SEQ ID NO: 71859 - protein, 7 aa, Mycobacterium avium
RDGSPVD

SEQ ID NO: 71860 - protein, 12 aa, Mycobacterium avium
RDGSSATATSTA

SEQ ID NO: 71861 - protein, 8 aa, Mycobacterium avium
RDGTAPGH

SEQ ID NO: 71862 - protein, 7 aa, Mycobacterium avium
RDGTPVD

SEQ ID NO: 71863 - protein, 7 aa, Mycobacterium avium
RDGTTTH

SEQ ID NO: 71864 - protein, 7 aa, Mycobacterium avium
RDHEDRS

SEQ ID NO: 71865 - protein, 8 aa, Mycobacterium avium
RDHGPTAT

SEQ ID NO: 71866 - protein, 4 aa, Mycobacterium avium
RDHP

SEQ ID NO: 71867 - protein, 11 aa, Mycobacterium avium
RDHSSGVRDVT

SEQ ID NO: 71868 - protein, 26 aa, Mycobacterium avium
RDHVGGQPFGQRGARLGRGHRPGDVA

SEQ ID NO: 71869 - protein, 4 aa, Mycobacterium avium
RDIQ

SEQ ID NO: 71870 - protein, 8 aa, Mycobacterium avium
RDKEALTR

SEQ ID NO: 71871 - protein, 6 aa, Mycobacterium avium
RDLPDP

SEQ ID NO: 71872 - protein, 13 aa, Mycobacterium avium
RDLQTAADGAAQE

SEQ ID NO: 71873 - protein, 10 aa, Mycobacterium avium
RDLRGTDDHL

SEQ ID NO: 71874 - protein, 8 aa, Mycobacterium avium
RDLRQPPV

SEQ ID NO: 71875 - protein, 4 aa, Mycobacterium avium
RDLS

SEQ ID NO: 71876 - protein, 7 aa, Mycobacterium avium
RDLSSAG

SEQ ID NO: 71877 - protein, 7 aa, Mycobacterium avium
RDNGRGH

SEQ ID NO: 71878 - protein, 10 aa, Mycobacterium avium
RDNKDATKQY

SEQ ID NO: 71879 - protein, 7 aa, Mycobacterium avium
RDNKRAD

SEQ ID NO: 71880 - protein, 6 aa, Mycobacterium avium
RDNLET

SEQ ID NO: 71881 - protein, 10 aa, Mycobacterium avium
RDNTDQFNTR

SEQ ID NO: 71882 - protein, 4 aa, Mycobacterium avium
RDPA

SEQ ID NO: 71883 - protein, 8 aa, Mycobacterium avium
RDPAPTTG

SEQ ID NO: 71884 - protein, 8 aa, Mycobacterium avium
RDPEASQQ

SEQ ID NO: 71885 - protein, 5 aa, Mycobacterium avium
RDPEI

SEQ ID NO: 71886 - protein, 7 aa, Mycobacterium avium
RDPESAR

SEQ ID NO: 71887 - protein, 13 aa, Mycobacterium avium
RDPHARADPRGAE

SEQ ID NO: 71888 - protein, 4 aa, Mycobacterium avium
RDPL

SEQ ID NO: 71889 - protein, 6 aa, Mycobacterium avium
RDPNLF

SEQ ID NO: 71890 - protein, 4 aa, Mycobacterium avium
RDPQ

SEQ ID NO: 71891 - protein, 12 aa, Mycobacterium avium
RDPRSAANAEAV

SEQ ID NO: 71892 - protein, 20 aa, Mycobacterium avium
RDPTIKGPAATPQHEQNGYD

SEQ ID NO: 71893 - protein, 11 aa, Mycobacterium avium
RDPVAGSPGVG

SEQ ID NO: 71894 - protein, 22 aa, Mycobacterium avium
RDQEAAGDDHGGQHGQGDPAAV

SEQ ID NO: 71895 - protein, 7 aa, Mycobacterium avium
RDQHTKT

SEQ ID NO: 71896 - protein, 7 aa, Mycobacterium avium
RDQNGEV

SEQ ID NO: 71897 - protein, 8 aa, Mycobacterium avium
RDQPGRAC

SEQ ID NO: 71898 - protein, 20 aa, Mycobacterium avium
RDRAAADQTADAVRAAGAGA

SEQ ID NO: 71899 - protein, 6 aa, Mycobacterium avium
RDRAAR

SEQ ID NO: 71900 - protein, 16 aa, Mycobacterium avium
RDRADDGDDGDDRGTD

SEQ ID NO: 71901 - protein, 12 aa, Mycobacterium avium
RDRAGRRRNRGT

SEQ ID NO: 71902 - protein, 8 aa, Mycobacterium avium
RDRARREA

SEQ ID NO: 71903 - protein, 8 aa, Mycobacterium avium
RDRDDPNY

SEQ ID NO: 71904 - protein, 12 aa, Mycobacterium avium
RDRESSEPDGLA

SEQ ID NO: 71905 - protein, 14 aa, Mycobacterium avium
RDREWDGDAAEKRV

SEQ ID NO: 71906 - protein, 6 aa, Mycobacterium avium
RDRGPT

SEQ ID NO: 71907 - protein, 14 aa, Mycobacterium avium
RDRHPAPLDPNFTG

SEQ ID NO: 71908 - protein, 21 aa, Mycobacterium avium
RDRNAAADPYSSGPNDPFPGA

SEQ ID NO: 71909 - protein, 6 aa, Mycobacterium avium
RDRPTP

SEQ ID NO: 71910 - protein, 7 aa, Mycobacterium avium
RDRRGPP

SEQ ID NO: 71911 - protein, 10 aa, Mycobacterium avium
RDRRQQPLQP

SEQ ID NO: 71912 - protein, 6 aa, Mycobacterium avium
RDRRSR

SEQ ID NO: 71913 - protein, 8 aa, Mycobacterium avium
RDRSERHD

SEQ ID NO: 71914 - protein, 6 aa, Mycobacterium avium
RDSARA

SEQ ID NO: 71915 - protein, 7 aa, Mycobacterium avium
RDSASLA

SEQ ID NO: 71916 - protein, 10 aa, Mycobacterium avium
RDSDAPAAVT

SEQ ID NO: 71917 - protein, 7 aa, Mycobacterium avium
RDSGQVD

SEQ ID NO: 71918 - protein, 4 aa, Mycobacterium avium
RDSI

SEQ ID NO: 71919 - protein, 8 aa, Mycobacterium avium
RDSSAAAP

SEQ ID NO: 71920 - protein, 7 aa, Mycobacterium avium
RDSSPAL

SEQ ID NO: 71921 - protein, 9 aa, Mycobacterium avium
RDSSSPQDL

SEQ ID NO: 71922 - protein, 17 aa, Mycobacterium avium
RDSSTGKTVDNINPANE

SEQ ID NO: 71923 - protein, 18 aa, Mycobacterium avium
RDSSTGKVAENINPATEE

SEQ ID NO: 71924 - protein, 8 aa, Mycobacterium avium
RDSWPATA

SEQ ID NO: 71925 - protein, 4 aa, Mycobacterium avium
RDTA

SEQ ID NO: 71926 - protein, 5 aa, Mycobacterium avium
RDTAA

SEQ ID NO: 71927 - protein, 12 aa, Mycobacterium avium
RDTDDDSSAPSL

SEQ ID NO: 71928 - protein, 6 aa, Mycobacterium avium
RDTEAQ

SEQ ID NO: 71929 - protein, 8 aa, Mycobacterium avium
RDTGRTAT

SEQ ID NO: 71930 - protein, 9 aa, Mycobacterium avium
RDTGRTATV

SEQ ID NO: 71931 - protein, 8 aa, Mycobacterium avium
RDTKTDWT

SEQ ID NO: 71932 - protein, 4 aa, Mycobacterium avium
RDTL

SEQ ID NO: 71933 - protein, 19 aa, Mycobacterium avium
RDTPGDDRAREVNAATARR

SEQ ID NO: 71934 - protein, 8 aa, Mycobacterium avium
RDTRGREI

SEQ ID NO: 71935 - protein, 19 aa, Mycobacterium avium
RDTRGREISAACGQLAFEK

SEQ ID NO: 71936 - protein, 9 aa, Mycobacterium avium
RDTSDAAWA

SEQ ID NO: 71937 - protein, 4 aa, Mycobacterium avium
RDVD

SEQ ID NO: 71938 - protein, 8 aa, Mycobacterium avium
RDVDPAVA

SEQ ID NO: 71939 - protein, 7 aa, Mycobacterium avium
RDVGGAE

SEQ ID NO: 71940 - protein, 6 aa, Mycobacterium avium
RDVGGP

SEQ ID NO: 71941 - protein, 5 aa, Mycobacterium avium
RDVTD

SEQ ID NO: 71942 - protein, 7 aa, Mycobacterium avium
RDYPTDK

SEQ ID NO: 71943 - protein, 8 aa, Mycobacterium avium
REAAAEAG

SEQ ID NO: 71944 - protein, 11 aa, Mycobacterium avium
REAARAEARAA

SEQ ID NO: 71945 - protein, 14 aa, Mycobacterium avium
REAATAALAAYEAL

SEQ ID NO: 71946 - protein, 17 aa, Mycobacterium avium
REALETEREDAKKELEA

SEQ ID NO: 71947 - protein, 17 aa, Mycobacterium avium
REALETEREEAKKDLEA

SEQ ID NO: 71948 - protein, 17 aa, Mycobacterium avium
REALETEREEAKKELEA

SEQ ID NO: 71949 - protein, 29 aa, Mycobacterium avium
REALGGRPFGDGTPPGPPVEAERVPAGHG

SEQ ID NO: 71950 - protein, 4 aa, Mycobacterium avium
REAQ

SEQ ID NO: 71951 - protein, 8 aa, Mycobacterium avium
REARTAGR

SEQ ID NO: 71952 - protein, 10 aa, Mycobacterium avium
REARTAGRLQ

SEQ ID NO: 71953 - protein, 5 aa, Mycobacterium avium
REDDS

SEQ ID NO: 71954 - protein, 5 aa, Mycobacterium avium
REDES

SEQ ID NO: 71955 - protein, 7 aa, Mycobacterium avium
REDGPHV

SEQ ID NO: 71956 - protein, 26 aa, Mycobacterium avium
REDGSGTRPWTDDERTTLNELITAAK

SEQ ID NO: 71957 - protein, 15 aa, Mycobacterium avium
REDRDTVTAVREESE

SEQ ID NO: 71958 - protein, 9 aa, Mycobacterium avium
REDRPGDER

SEQ ID NO: 71959 - protein, 8 aa, Mycobacterium avium
REDSPGHK

SEQ ID NO: 71960 - protein, 15 aa, Mycobacterium avium
REDTAGTAPPPLTRE

SEQ ID NO: 71961 - protein, 7 aa, Mycobacterium avium
REDTRRT

SEQ ID NO: 71962 - protein, 5 aa, Mycobacterium avium
REEDL

SEQ ID NO: 71963 - protein, 8 aa, Mycobacterium avium
REEGRADL

SEQ ID NO: 71964 - protein, 11 aa, Mycobacterium avium
REENPDPHTTA

SEQ ID NO: 71965 - protein, 10 aa, Mycobacterium avium
REEREGESLD

SEQ ID NO: 71966 - protein, 7 aa, Mycobacterium avium
REEVDNN

SEQ ID NO: 71967 - protein, 10 aa, Mycobacterium avium
REFTPKQEEA

SEQ ID NO: 71968 - protein, 4 aa, Mycobacterium avium
REGA

SEQ ID NO: 71969 - protein, 8 aa, Mycobacterium avium
REGAAAAD

SEQ ID NO: 71970 - protein, 5 aa, Mycobacterium avium
REGDT

SEQ ID NO: 71971 - protein, 5 aa, Mycobacterium avium
REGED

SEQ ID NO: 71972 - protein, 4 aa, Mycobacterium avium
REGL

SEQ ID NO: 71973 - protein, 16 aa, Mycobacterium avium
REGNSDRRAPKPVKQY

SEQ ID NO: 71974 - protein, 14 aa, Mycobacterium avium
REGPLTLDDRAAGQ

SEQ ID NO: 71975 - protein, 11 aa, Mycobacterium avium
REGRAPRPGER

SEQ ID NO: 71976 - protein, 8 aa, Mycobacterium avium
REGTAPGH

SEQ ID NO: 71977 - protein, 8 aa, Mycobacterium avium
REGTVREA

SEQ ID NO: 71978 - protein, 4 aa, Mycobacterium avium
REGV

SEQ ID NO: 71979 - protein, 9 aa, Mycobacterium avium
REHGEDDPA

SEQ ID NO: 71980 - protein, 8 aa, Mycobacterium avium
REHGGSTV

SEQ ID NO: 71981 - protein, 5 aa, Mycobacterium avium
REHPY

SEQ ID NO: 71982 - protein, 4 aa, Mycobacterium avium
REHR

SEQ ID NO: 71983 - protein, 13 aa, Mycobacterium avium
REHTRRAEAPSMP

SEQ ID NO: 71984 - protein, 4 aa, Mycobacterium avium
REIT

SEQ ID NO: 71985 - protein, 6 aa, Mycobacterium avium
REKDGR

SEQ ID NO: 71986 - protein, 11 aa, Mycobacterium avium
REKGDQNSSSL

SEQ ID NO: 71987 - protein, 19 aa, Mycobacterium avium
REKPDHSETVEGSLEDRGF

SEQ ID NO: 71988 - protein, 5 aa, Mycobacterium avium
RELDG

SEQ ID NO: 71989 - protein, 8 aa, Mycobacterium avium
RELESTRP

SEQ ID NO: 71990 - protein, 8 aa, Mycobacterium avium
RELPKRRP

SEQ ID NO: 71991 - protein, 13 aa, Mycobacterium avium
RELTTTTADLGTV

SEQ ID NO: 71992 - protein, 8 aa, Mycobacterium avium
REMPPTTS

SEQ ID NO: 71993 - protein, 8 aa, Mycobacterium avium
RENGQQSI

SEQ ID NO: 71994 - protein, 5 aa, Mycobacterium avium
REPDA

SEQ ID NO: 71995 - protein, 22 aa, Mycobacterium avium
REPEPTPAPQAAAEPTELPEPQ

SEQ ID NO: 71996 - protein, 23 aa, Mycobacterium avium
REPEPTPAPQAAAEPTESPEPQA

SEQ ID NO: 71997 - protein, 4 aa, Mycobacterium avium
REPQ

SEQ ID NO: 71998 - protein, 51 aa, Mycobacterium avium
REPREDVGPERGDHGDRQRRDLRARTDQSANPEPGAVPHRPERGAASGAAG

SEQ ID NO: 71999 - protein, 6 aa, Mycobacterium avium
REPRPY

SEQ ID NO: 72000 - protein, 19 aa, Mycobacterium avium
REPRSNCGTGHQGRDPPVG

SEQ ID NO: 72001 - protein, 9 aa, Mycobacterium avium
REPTPREQD

SEQ ID NO: 72002 - protein, 10 aa, Mycobacterium avium
REQDSYDPPI

SEQ ID NO: 72003 - protein, 10 aa, Mycobacterium avium
REQGYGPEVK

SEQ ID NO: 72004 - protein, 10 aa, Mycobacterium avium
REQTRKSVGA

SEQ ID NO: 72005 - protein, 16 aa, Mycobacterium avium
RERALAAGTSTSHRSW

SEQ ID NO: 72006 - protein, 6 aa, Mycobacterium avium
REREEV

SEQ ID NO: 72007 - protein, 20 aa, Mycobacterium avium
RERIGEETPTPSIADTHDHE

SEQ ID NO: 72008 - protein, 14 aa, Mycobacterium avium
RERIRPDPTTRAAN

SEQ ID NO: 72009 - protein, 10 aa, Mycobacterium avium
RERKPDDAAA

SEQ ID NO: 72010 - protein, 8 aa, Mycobacterium avium
RERQAQIT

SEQ ID NO: 72011 - protein, 8 aa, Mycobacterium avium
RERQKRAD

SEQ ID NO: 72012 - protein, 5 aa, Mycobacterium avium
RERQT

SEQ ID NO: 72013 - protein, 7 aa, Mycobacterium avium
RERQTRD

SEQ ID NO: 72014 - protein, 10 aa, Mycobacterium avium
RERSQGEADR

SEQ ID NO: 72015 - protein, 11 aa, Mycobacterium avium
RESDPDSEQRL

SEQ ID NO: 72016 - protein, 8 aa, Mycobacterium avium
RESEGAVQ

SEQ ID NO: 72017 - protein, 8 aa, Mycobacterium avium
RESEGPVH

SEQ ID NO: 72018 - protein, 6 aa, Mycobacterium avium
RESGTD

SEQ ID NO: 72019 - protein, 7 aa, Mycobacterium avium
RESLDSA

SEQ ID NO: 72020 - protein, 12 aa, Mycobacterium avium
RESSDGKAMAEG

SEQ ID NO: 72021 - protein, 11 aa, Mycobacterium avium
RESSGRGQTVE

SEQ ID NO: 72022 - protein, 8 aa, Mycobacterium avium
RESTATPF

SEQ ID NO: 72023 - protein, 8 aa, Mycobacterium avium
RESTDREF

SEQ ID NO: 72024 - protein, 9 aa, Mycobacterium avium
RESTETAPK

SEQ ID NO: 72025 - protein, 12 aa, Mycobacterium avium
RESVGDGIATGE

SEQ ID NO: 72026 - protein, 16 aa, Mycobacterium avium
RETADDINENHRNSRY

SEQ ID NO: 72027 - protein, 17 aa, Mycobacterium avium
RETADDINENHRNSRYL

SEQ ID NO: 72028 - protein, 11 aa, Mycobacterium avium
RETATSRPLDA

SEQ ID NO: 72029 - protein, 10 aa, Mycobacterium avium
RETDGPAFGT

SEQ ID NO: 72030 - protein, 5 aa, Mycobacterium avium
RETEI

SEQ ID NO: 72031 - protein, 4 aa, Mycobacterium avium
RETF

SEQ ID NO: 72032 - protein, 4 aa, Mycobacterium avium
RETG

SEQ ID NO: 72033 - protein, 8 aa, Mycobacterium avium
RETGFGPE

SEQ ID NO: 72034 - protein, 6 aa, Mycobacterium avium
RETGSA

SEQ ID NO: 72035 - protein, 11 aa, Mycobacterium avium
RETLAEDDARV

SEQ ID NO: 72036 - protein, 11 aa, Mycobacterium avium
RETLAEDNARV

SEQ ID NO: 72037 - protein, 11 aa, Mycobacterium avium
RETLAQDDARV

SEQ ID NO: 72038 - protein, 9 aa, Mycobacterium avium
RETLGNKGY

SEQ ID NO: 72039 - protein, 13 aa, Mycobacterium avium
RETMRRRKERQRL

SEQ ID NO: 72040 - protein, 7 aa, Mycobacterium avium
RETSGLG

SEQ ID NO: 72041 - protein, 4 aa, Mycobacterium avium
RETV

SEQ ID NO: 72042 - protein, 17 aa, Mycobacterium avium
REVPAPQQSGAPGPGTL

SEQ ID NO: 72043 - protein, 14 aa, Mycobacterium avium
REVQGLQQSGPVEA

SEQ ID NO: 72044 - protein, 13 aa, Mycobacterium avium
REVREEAGVSARA

SEQ ID NO: 72045 - protein, 8 aa, Mycobacterium avium
REVSDTAR

SEQ ID NO: 72046 - protein, 5 aa, Mycobacterium avium
REYEG

SEQ ID NO: 72047 - protein, 7 aa, Mycobacterium avium
REYGEPA

SEQ ID NO: 72048 - protein, 5 aa, Mycobacterium avium
REYNS

SEQ ID NO: 72049 - protein, 11 aa, Mycobacterium avium
REYQPRAIAGE

SEQ ID NO: 72050 - protein, 7 aa, Mycobacterium avium
RFAPDGT

SEQ ID NO: 72051 - protein, 7 aa, Mycobacterium avium
RFASPAA

SEQ ID NO: 72052 - protein, 6 aa, Mycobacterium avium
RFATSD

SEQ ID NO: 72053 - protein, 10 aa, Mycobacterium avium
RFDPSHRTRA

SEQ ID NO: 72054 - protein, 12 aa, Mycobacterium avium
RFDTQAPAAWSA

SEQ ID NO: 72055 - protein, 13 aa, Mycobacterium avium
RFEGKQKKAAYTK

SEQ ID NO: 72056 - protein, 9 aa, Mycobacterium avium
RFGERDAAV

SEQ ID NO: 72057 - protein, 9 aa, Mycobacterium avium
RFGPNKPVA

SEQ ID NO: 72058 - protein, 12 aa, Mycobacterium avium
RFGRGGDGVSAS

SEQ ID NO: 72059 - protein, 7 aa, Mycobacterium avium
RFPAPTR

SEQ ID NO: 72060 - protein, 10 aa, Mycobacterium avium
RFPTAADDVR

SEQ ID NO: 72061 - protein, 30 aa, Mycobacterium avium
RFRRRGDPRAPDGDDAVAAGARDQPRPAVD

SEQ ID NO: 72062 - protein, 9 aa, Mycobacterium avium
RFSATTSET

SEQ ID NO: 72063 - protein, 7 aa, Mycobacterium avium
RFSTRAE

SEQ ID NO: 72064 - protein, 13 aa, Mycobacterium avium
RFTDAESRAAHDD

SEQ ID NO: 72065 - protein, 4 aa, Mycobacterium avium
RFTG

SEQ ID NO: 72066 - protein, 4 aa, Mycobacterium avium
RGAA

SEQ ID NO: 72067 - protein, 5 aa, Mycobacterium avium
RGAAG

SEQ ID NO: 72068 - protein, 8 aa, Mycobacterium avium
RGAAPDEL

SEQ ID NO: 72069 - protein, 5 aa, Mycobacterium avium
RGAAR

SEQ ID NO: 72070 - protein, 6 aa, Mycobacterium avium
RGAARR

SEQ ID NO: 72071 - protein, 9 aa, Mycobacterium avium
RGADFEPTR

SEQ ID NO: 72072 - protein, 10 aa, Mycobacterium avium
RGADPDTLRG

SEQ ID NO: 72073 - protein, 11 aa, Mycobacterium avium
RGADPDTLRGQ

SEQ ID NO: 72074 - protein, 9 aa, Mycobacterium avium
RGAEIGPGV

SEQ ID NO: 72075 - protein, 23 aa, Mycobacterium avium
RGAGGDADAARAGRQPRRTRRVD

SEQ ID NO: 72076 - protein, 9 aa, Mycobacterium avium
RGAGGGENP

SEQ ID NO: 72077 - protein, 7 aa, Mycobacterium avium
RGAGPGE

SEQ ID NO: 72078 - protein, 18 aa, Mycobacterium avium
RGAGRPAARRLLSSRRSH

SEQ ID NO: 72079 - protein, 14 aa, Mycobacterium avium
RGAGRPGTATARPS

SEQ ID NO: 72080 - protein, 12 aa, Mycobacterium avium
RGAPAPHDRPRT

SEQ ID NO: 72081 - protein, 8 aa, Mycobacterium avium
RGAPGDLT

SEQ ID NO: 72082 - protein, 4 aa, Mycobacterium avium
RGAR

SEQ ID NO: 72083 - protein, 8 aa, Mycobacterium avium
RGARPGER

SEQ ID NO: 72084 - protein, 24 aa, Mycobacterium avium
RGARTAGTRLDDADLRGGAADPAL

SEQ ID NO: 72085 - protein, 11 aa, Mycobacterium avium
RGARTTGTRLD

SEQ ID NO: 72086 - protein, 5 aa, Mycobacterium avium
RGATD

SEQ ID NO: 72087 - protein, 10 aa, Mycobacterium avium
RGATGSSSRT

SEQ ID NO: 72088 - protein, 4 aa, Mycobacterium avium
RGAV

SEQ ID NO: 72089 - protein, 10 aa, Mycobacterium avium
RGAVEGDENV

SEQ ID NO: 72090 - protein, 7 aa, Mycobacterium avium
RGAVPPG

SEQ ID NO: 72091 - protein, 4 aa, Mycobacterium avium
RGAW

SEQ ID NO: 72092 - protein, 11 aa, Mycobacterium avium
RGAWADGPEAI

SEQ ID NO: 72093 - protein, 13 aa, Mycobacterium avium
RGAYASSIHFRLE

SEQ ID NO: 72094 - protein, 5 aa, Mycobacterium avium
RGDAP

SEQ ID NO: 72095 - protein, 16 aa, Mycobacterium avium
RGDAPDAFDDAEPPSA

SEQ ID NO: 72096 - protein, 16 aa, Mycobacterium avium
RGDAPHAFDGAEPPSA

SEQ ID NO: 72097 - protein, 19 aa, Mycobacterium avium
RGDARARRTERDAHPGGTH

SEQ ID NO: 72098 - protein, 20 aa, Mycobacterium avium
RGDATPVDGPLPAAAADALA

SEQ ID NO: 72099 - protein, 11 aa, Mycobacterium avium
RGDDPLPAGAA

SEQ ID NO: 72100 - protein, 7 aa, Mycobacterium avium
RGDEGYA

SEQ ID NO: 72101 - protein, 13 aa, Mycobacterium avium
RGDEGYTLSDNEI

SEQ ID NO: 72102 - protein, 9 aa, Mycobacterium avium
RGDENLCPE

SEQ ID NO: 72103 - protein, 7 aa, Mycobacterium avium
RGDFTPE

SEQ ID NO: 72104 - protein, 9 aa, Mycobacterium avium
RGDGHPDHE

SEQ ID NO: 72105 - protein, 10 aa, Mycobacterium avium
RGDGHPDHEA

SEQ ID NO: 72106 - protein, 7 aa, Mycobacterium avium
RGDGLGD

SEQ ID NO: 72107 - protein, 32 aa, Mycobacterium avium
RGDGPRSTGRCRPRRPTPWPMPGRSASPTTAR

SEQ ID NO: 72108 - protein, 5 aa, Mycobacterium avium
RGDMV

SEQ ID NO: 72109 - protein, 15 aa, Mycobacterium avium
RGDQVSDRDGGARTA

SEQ ID NO: 72110 - protein, 10 aa, Mycobacterium avium
RGDRNGDTDE

SEQ ID NO: 72111 - protein, 4 aa, Mycobacterium avium
RGDT

SEQ ID NO: 72112 - protein, 10 aa, Mycobacterium avium
RGDYDEARRM

SEQ ID NO: 72113 - protein, 8 aa, Mycobacterium avium
RGEAAPGM

SEQ ID NO: 72114 - protein, 18 aa, Mycobacterium avium
RGEADAGTACRVPAATDR

SEQ ID NO: 72115 - protein, 14 aa, Mycobacterium avium
RGEAGERQVPGNPR

SEQ ID NO: 72116 - protein, 5 aa, Mycobacterium avium
RGEAI

SEQ ID NO: 72117 - protein, 5 aa, Mycobacterium avium
RGEAK

SEQ ID NO: 72118 - protein, 4 aa, Mycobacterium avium
RGEE

SEQ ID NO: 72119 - protein, 5 aa, Mycobacterium avium
RGEGT

SEQ ID NO: 72120 - protein, 8 aa, Mycobacterium avium
RGEGYQPG

SEQ ID NO: 72121 - protein, 4 aa, Mycobacterium avium
RGEH

SEQ ID NO: 72122 - protein, 7 aa, Mycobacterium avium
RGELAEK

SEQ ID NO: 72123 - protein, 19 aa, Mycobacterium avium
RGENDDGEDEDEDEDSDDA

SEQ ID NO: 72124 - protein, 26 aa, Mycobacterium avium
RGENDNGEDDGDEEEDDDSGDDDDAA

SEQ ID NO: 72125 - protein, 18 aa, Mycobacterium avium
RGENEDEDEDSDGDDDAA

SEQ ID NO: 72126 - protein, 16 aa, Mycobacterium avium
RGENGGEDDDGDDDEA

SEQ ID NO: 72127 - protein, 18 aa, Mycobacterium avium
RGENGGEDDDGDDDGDEP

SEQ ID NO: 72128 - protein, 8 aa, Mycobacterium avium
RGEPASPW

SEQ ID NO: 72129 - protein, 30 aa, Mycobacterium avium
RGEPGRHQSAAGRVAAGRRHAAEKQVRRDQ

SEQ ID NO: 72130 - protein, 15 aa, Mycobacterium avium
RGEQITDADPDDCPV

SEQ ID NO: 72131 - protein, 5 aa, Mycobacterium avium
RGETV

SEQ ID NO: 72132 - protein, 8 aa, Mycobacterium avium
RGEVRTEN

SEQ ID NO: 72133 - protein, 8 aa, Mycobacterium avium
RGFNPNDR

SEQ ID NO: 72134 - protein, 6 aa, Mycobacterium avium
RGFRAA

SEQ ID NO: 72135 - protein, 19 aa, Mycobacterium avium
RGGARTGPRQPDRTQPEPA

SEQ ID NO: 72136 - protein, 8 aa, Mycobacterium avium
RGGASPTL

SEQ ID NO: 72137 - protein, 8 aa, Mycobacterium avium
RGGEPPLS

SEQ ID NO: 72138 - protein, 5 aa, Mycobacterium avium
RGGGL

SEQ ID NO: 72139 - protein, 6 aa, Mycobacterium avium
RGGGYI

SEQ ID NO: 72140 - protein, 6 aa, Mycobacterium avium
RGGKVS

SEQ ID NO: 72141 - protein, 4 aa, Mycobacterium avium
RGGL

SEQ ID NO: 72142 - protein, 6 aa, Mycobacterium avium
RGGPLR

SEQ ID NO: 72143 - protein, 10 aa, Mycobacterium avium
RGGPPCPPRA

SEQ ID NO: 72144 - protein, 15 aa, Mycobacterium avium
RGGRAGRAQGRIPCV

SEQ ID NO: 72145 - protein, 10 aa, Mycobacterium avium
RGGRQPGGFG

SEQ ID NO: 72146 - protein, 17 aa, Mycobacterium avium
RGGSADGLTSPDATHSP

SEQ ID NO: 72147 - protein, 10 aa, Mycobacterium avium
RGGSRPPAAI

SEQ ID NO: 72148 - protein, 6 aa, Mycobacterium avium
RGGSYA

SEQ ID NO: 72149 - protein, 7 aa, Mycobacterium avium
RGGTRNV

SEQ ID NO: 72150 - protein, 21 aa, Mycobacterium avium
RGGTSKMGTWNAPEKIKGKQV

SEQ ID NO: 72151 - protein, 18 aa, Mycobacterium avium
RGGVPDGGSDRPATGPGW

SEQ ID NO: 72152 - protein, 8 aa, Mycobacterium avium
RGGWGPSL

SEQ ID NO: 72153 - protein, 14 aa, Mycobacterium avium
RGISGTIGHTQPRR

SEQ ID NO: 72154 - protein, 5 aa, Mycobacterium avium
RGKGF

SEQ ID NO: 72155 - protein, 7 aa, Mycobacterium avium
RGKSQAR

SEQ ID NO: 72156 - protein, 6 aa, Mycobacterium avium
RGLEKN

SEQ ID NO: 72157 - protein, 6 aa, Mycobacterium avium
RGLEPG

SEQ ID NO: 72158 - protein, 8 aa, Mycobacterium avium
RGLPAPDG

SEQ ID NO: 72159 - protein, 8 aa, Mycobacterium avium
RGLPGGED

SEQ ID NO: 72160 - protein, 7 aa, Mycobacterium avium
RGLSQTP

SEQ ID NO: 72161 - protein, 10 aa, Mycobacterium avium
RGLTEESPEI

SEQ ID NO: 72162 - protein, 8 aa, Mycobacterium avium
RGLTPEGE

SEQ ID NO: 72163 - protein, 5 aa, Mycobacterium avium
RGLVG

SEQ ID NO: 72164 - protein, 7 aa, Mycobacterium avium
RGMPAGT

SEQ ID NO: 72165 - protein, 4 aa, Mycobacterium avium
RGMS

SEQ ID NO: 72166 - protein, 4 aa, Mycobacterium avium
RGNG

SEQ ID NO: 72167 - protein, 8 aa, Mycobacterium avium
RGNRPATA

SEQ ID NO: 72168 - protein, 4 aa, Mycobacterium avium
RGPA

SEQ ID NO: 72169 - protein, 7 aa, Mycobacterium avium
RGPAKAL

SEQ ID NO: 72170 - protein, 8 aa, Mycobacterium avium
RGPDPNLK

SEQ ID NO: 72171 - protein, 13 aa, Mycobacterium avium
RGPETEHLLALAG

SEQ ID NO: 72172 - protein, 20 aa, Mycobacterium avium
RGPFARPPVVPTEARRRAQR

SEQ ID NO: 72173 - protein, 5 aa, Mycobacterium avium
RGPGG

SEQ ID NO: 72174 - protein, 6 aa, Mycobacterium avium
RGPGGA

SEQ ID NO: 72175 - protein, 4 aa, Mycobacterium avium
RGPH

SEQ ID NO: 72176 - protein, 9 aa, Mycobacterium avium
RGPHPLGEQ

SEQ ID NO: 72177 - protein, 7 aa, Mycobacterium avium
RGPIPRA

SEQ ID NO: 72178 - protein, 8 aa, Mycobacterium avium
RGPLPPVR

SEQ ID NO: 72179 - protein, 4 aa, Mycobacterium avium
RGPR

SEQ ID NO: 72180 - protein, 6 aa, Mycobacterium avium
RGPVHD

SEQ ID NO: 72181 - protein, 5 aa, Mycobacterium avium
RGPVP

SEQ ID NO: 72182 - protein, 10 aa, Mycobacterium avium
RGPVRGGPDA

SEQ ID NO: 72183 - protein, 6 aa, Mycobacterium avium
RGPVTA

SEQ ID NO: 72184 - protein, 9 aa, Mycobacterium avium
RGQDTIAAT

SEQ ID NO: 72185 - protein, 10 aa, Mycobacterium avium
RGQDVDPDAR

SEQ ID NO: 72186 - protein, 13 aa, Mycobacterium avium
RGQGEDVVSGRKD

SEQ ID NO: 72187 - protein, 6 aa, Mycobacterium avium
RGQGGT

SEQ ID NO: 72188 - protein, 7 aa, Mycobacterium avium
RGQGRSH

SEQ ID NO: 72189 - protein, 7 aa, Mycobacterium avium
RGQRPAR

SEQ ID NO: 72190 - protein, 10 aa, Mycobacterium avium
RGQRQDVGDA

SEQ ID NO: 72191 - protein, 8 aa, Mycobacterium avium
RGQTPADH

SEQ ID NO: 72192 - protein, 5 aa, Mycobacterium avium
RGRAG

SEQ ID NO: 72193 - protein, 24 aa, Mycobacterium avium
RGRAPASPASAPPAAGPAGARSSS

SEQ ID NO: 72194 - protein, 6 aa, Mycobacterium avium
RGRDEN

SEQ ID NO: 72195 - protein, 6 aa, Mycobacterium avium
RGRDGS

SEQ ID NO: 72196 - protein, 7 aa, Mycobacterium avium
RGREMSQ

SEQ ID NO: 72197 - protein, 12 aa, Mycobacterium avium
RGRGAAAEFTHK

SEQ ID NO: 72198 - protein, 5 aa, Mycobacterium avium
RGRIP

SEQ ID NO: 72199 - protein, 5 aa, Mycobacterium avium
RGRIT

SEQ ID NO: 72200 - protein, 5 aa, Mycobacterium avium
RGRMD

SEQ ID NO: 72201 - protein, 14 aa, Mycobacterium avium
RGRNEGSADRRAGA

SEQ ID NO: 72202 - protein, 9 aa, Mycobacterium avium
RGRPADRPA

SEQ ID NO: 72203 - protein, 12 aa, Mycobacterium avium
RGRPPADARDVR

SEQ ID NO: 72204 - protein, 8 aa, Mycobacterium avium
RGRRGRRA

SEQ ID NO: 72205 - protein, 7 aa, Mycobacterium avium
RGRRHRD

SEQ ID NO: 72206 - protein, 32 aa, Mycobacterium avium
RGRVADQREQIADEREQLADEREGTAAERERA

SEQ ID NO: 72207 - protein, 8 aa, Mycobacterium avium
RGRVDDEG

SEQ ID NO: 72208 - protein, 14 aa, Mycobacterium avium
RGRVPEEVPGSTLR

SEQ ID NO: 72209 - protein, 10 aa, Mycobacterium avium
RGRYDEGPDV

SEQ ID NO: 72210 - protein, 6 aa, Mycobacterium avium
RGSATG

SEQ ID NO: 72211 - protein, 9 aa, Mycobacterium avium
RGSCTDMPN

SEQ ID NO: 72212 - protein, 4 aa, Mycobacterium avium
RGSD

SEQ ID NO: 72213 - protein, 11 aa, Mycobacterium avium
RGSEGGGDGEV

SEQ ID NO: 72214 - protein, 7 aa, Mycobacterium avium
RGSGERA

SEQ ID NO: 72215 - protein, 8 aa, Mycobacterium avium
RGSGMPDL

SEQ ID NO: 72216 - protein, 5 aa, Mycobacterium avium
RGSGQ

SEQ ID NO: 72217 - protein, 4 aa, Mycobacterium avium
RGSL

SEQ ID NO: 72218 - protein, 4 aa, Mycobacterium avium
RGSM

SEQ ID NO: 72219 - protein, 8 aa, Mycobacterium avium
RGSREHGQ

SEQ ID NO: 72220 - protein, 9 aa, Mycobacterium avium
RGSRTGARV

SEQ ID NO: 72221 - protein, 8 aa, Mycobacterium avium
RGSSTMTG

SEQ ID NO: 72222 - protein, 7 aa, Mycobacterium avium
RGSTSAF

SEQ ID NO: 72223 - protein, 4 aa, Mycobacterium avium
RGSV

SEQ ID NO: 72224 - protein, 5 aa, Mycobacterium avium
RGSYR

SEQ ID NO: 72225 - protein, 5 aa, Mycobacterium avium
RGTAA

SEQ ID NO: 72226 - protein, 7 aa, Mycobacterium avium
RGTAFAP

SEQ ID NO: 72227 - protein, 15 aa, Mycobacterium avium
RGTAGDRQVPNDPQV

SEQ ID NO: 72228 - protein, 7 aa, Mycobacterium avium
RGTARQR

SEQ ID NO: 72229 - protein, 6 aa, Mycobacterium avium
RGTDPV

SEQ ID NO: 72230 - protein, 10 aa, Mycobacterium avium
RGTEQPPFDE

SEQ ID NO: 72231 - protein, 16 aa, Mycobacterium avium
RGTFDQPMTAQQRADA

SEQ ID NO: 72232 - protein, 12 aa, Mycobacterium avium
RGTGGERQVPGA

SEQ ID NO: 72233 - protein, 19 aa, Mycobacterium avium
RGTGRDHPVRRRRSGAESW

SEQ ID NO: 72234 - protein, 7 aa, Mycobacterium avium
RGTHPKY

SEQ ID NO: 72235 - protein, 20 aa, Mycobacterium avium
RGTKPGLENASAPPKRPPMP

SEQ ID NO: 72236 - protein, 9 aa, Mycobacterium avium
RGTLRGGDH

SEQ ID NO: 72237 - protein, 6 aa, Mycobacterium avium
RGTPAA

SEQ ID NO: 72238 - protein, 8 aa, Mycobacterium avium
RGTPPAEA

SEQ ID NO: 72239 - protein, 7 aa, Mycobacterium avium
RGTQTAS

SEQ ID NO: 72240 - protein, 9 aa, Mycobacterium avium
RGTSDSGFD

SEQ ID NO: 72241 - protein, 13 aa, Mycobacterium avium
RGTSGRRLPPGGR

SEQ ID NO: 72242 - protein, 9 aa, Mycobacterium avium
RGTSPEGVD

SEQ ID NO: 72243 - protein, 12 aa, Mycobacterium avium
RGTTEAVSGDPA

SEQ ID NO: 72244 - protein, 12 aa, Mycobacterium avium
RGTVEDPPTVEA

SEQ ID NO: 72245 - protein, 6 aa, Mycobacterium avium
RGTWTP

SEQ ID NO: 72246 - protein, 7 aa, Mycobacterium avium
RGVAGAE

SEQ ID NO: 72247 - protein, 10 aa, Mycobacterium avium
RGVAGRPGLG

SEQ ID NO: 72248 - protein, 4 aa, Mycobacterium avium
RGVD

SEQ ID NO: 72249 - protein, 11 aa, Mycobacterium avium
RGVGGPGEVGD

SEQ ID NO: 72250 - protein, 9 aa, Mycobacterium avium
RGVGHSTPS

SEQ ID NO: 72251 - protein, 5 aa, Mycobacterium avium
RGVGK

SEQ ID NO: 72252 - protein, 7 aa, Mycobacterium avium
RGVPSAR

SEQ ID NO: 72253 - protein, 7 aa, Mycobacterium avium
RGVPTPV

SEQ ID NO: 72254 - protein, 4 aa, Mycobacterium avium
RGVR

SEQ ID NO: 72255 - protein, 14 aa, Mycobacterium avium
RGVSSFAGDGTQRW

SEQ ID NO: 72256 - protein, 10 aa, Mycobacterium avium
RGVTPQQAKD

SEQ ID NO: 72257 - protein, 5 aa, Mycobacterium avium
RGYAR

SEQ ID NO: 72258 - protein, 6 aa, Mycobacterium avium
RGYDGA

SEQ ID NO: 72259 - protein, 7 aa, Mycobacterium avium
RGYDGET

SEQ ID NO: 72260 - protein, 6 aa, Mycobacterium avium
RGYGED

SEQ ID NO: 72261 - protein, 7 aa, Mycobacterium avium
RGYRAST

SEQ ID NO: 72262 - protein, 9 aa, Mycobacterium avium
RGYSDDEAA

SEQ ID NO: 72263 - protein, 10 aa, Mycobacterium avium
RHAPAPTGPF

SEQ ID NO: 72264 - protein, 9 aa, Mycobacterium avium
RHEHAPEDP

SEQ ID NO: 72265 - protein, 15 aa, Mycobacterium avium
RHGDGGGRAGGRPAV

SEQ ID NO: 72266 - protein, 13 aa, Mycobacterium avium
RHGGSDDTTGKDV

SEQ ID NO: 72267 - protein, 7 aa, Mycobacterium avium
RHHGRTV

SEQ ID NO: 72268 - protein, 7 aa, Mycobacterium avium
RHKNQRT

SEQ ID NO: 72269 - protein, 8 aa, Mycobacterium avium
RHNNPTNR

SEQ ID NO: 72270 - protein, 9 aa, Mycobacterium avium
RHNSNEGLR

SEQ ID NO: 72271 - protein, 9 aa, Mycobacterium avium
RHPAADELP

SEQ ID NO: 72272 - protein, 5 aa, Mycobacterium avium
RHPAH

SEQ ID NO: 72273 - protein, 7 aa, Mycobacterium avium
RHPDAQR

SEQ ID NO: 72274 - protein, 11 aa, Mycobacterium avium
RHPEDDAESFD

SEQ ID NO: 72275 - protein, 8 aa, Mycobacterium avium
RHPEVREQ

SEQ ID NO: 72276 - protein, 11 aa, Mycobacterium avium
RHPGAAARLQP

SEQ ID NO: 72277 - protein, 9 aa, Mycobacterium avium
RHPQPVPPI

SEQ ID NO: 72278 - protein, 21 aa, Mycobacterium avium
RHPRDVGRARRGADDGGDNGF

SEQ ID NO: 72279 - protein, 11 aa, Mycobacterium avium
RHPRPRDQRRL

SEQ ID NO: 72280 - protein, 16 aa, Mycobacterium avium
RHPSGPDSDIADRADH

SEQ ID NO: 72281 - protein, 25 aa, Mycobacterium avium
RHRGGGSGPRGPGLDTDHHERQGAA

SEQ ID NO: 72282 - protein, 6 aa, Mycobacterium avium
RHRGHR

SEQ ID NO: 72283 - protein, 4 aa, Mycobacterium avium
RHRL

SEQ ID NO: 72284 - protein, 9 aa, Mycobacterium avium
RHRRAGRAG

SEQ ID NO: 72285 - protein, 29 aa, Mycobacterium avium
RHRRDHRSGRPAVGADVGADDRRPHRADR

SEQ ID NO: 72286 - protein, 12 aa, Mycobacterium avium
RHRRQGEQRAQQ

SEQ ID NO: 72287 - protein, 22 aa, Mycobacterium avium
RHRSETAPVGPASPPGNRIAVR

SEQ ID NO: 72288 - protein, 20 aa, Mycobacterium avium
RHSAQPQNPPVVRPPESHAG

SEQ ID NO: 72289 - protein, 10 aa, Mycobacterium avium
RHSRRTRDAE

SEQ ID NO: 72290 - protein, 6 aa, Mycobacterium avium
RHTGSL

SEQ ID NO: 72291 - protein, 8 aa, Mycobacterium avium
RIANPRDD

SEQ ID NO: 72292 - protein, 16 aa, Mycobacterium avium
RIAPGAAAEASPGEEA

SEQ ID NO: 72293 - protein, 16 aa, Mycobacterium avium
RIAPGGAAEASPGEEA

SEQ ID NO: 72294 - protein, 4 aa, Mycobacterium avium
RIDG

SEQ ID NO: 72295 - protein, 12 aa, Mycobacterium avium
RIDGQRPPALDT

SEQ ID NO: 72296 - protein, 17 aa, Mycobacterium avium
RIDRDRTRDLEVVRRHL

SEQ ID NO: 72297 - protein, 10 aa, Mycobacterium avium
RIDRGAAGPL

SEQ ID NO: 72298 - protein, 5 aa, Mycobacterium avium
RIDRT

SEQ ID NO: 72299 - protein, 8 aa, Mycobacterium avium
RIGAEGQG

SEQ ID NO: 72300 - protein, 12 aa, Mycobacterium avium
RIGKKTGQGFYT

SEQ ID NO: 72301 - protein, 6 aa, Mycobacterium avium
RIGPDP

SEQ ID NO: 72302 - protein, 5 aa, Mycobacterium avium
RIPDE

SEQ ID NO: 72303 - protein, 5 aa, Mycobacterium avium
RIPDR

SEQ ID NO: 72304 - protein, 6 aa, Mycobacterium avium
RIPKQR

SEQ ID NO: 72305 - protein, 5 aa, Mycobacterium avium
RIRPG

SEQ ID NO: 72306 - protein, 10 aa, Mycobacterium avium
RIRQRSGELG

SEQ ID NO: 72307 - protein, 5 aa, Mycobacterium avium
RITPQ

SEQ ID NO: 72308 - protein, 11 aa, Mycobacterium avium
RKAAEKPRKSV

SEQ ID NO: 72309 - protein, 6 aa, Mycobacterium avium
RKAGQS

SEQ ID NO: 72310 - protein, 10 aa, Mycobacterium avium
RKAGTEIRVP

SEQ ID NO: 72311 - protein, 5 aa, Mycobacterium avium
RKAHE

SEQ ID NO: 72312 - protein, 4 aa, Mycobacterium avium
RKAR

SEQ ID NO: 72313 - protein, 6 aa, Mycobacterium avium
RKDGVE

SEQ ID NO: 72314 - protein, 4 aa, Mycobacterium avium
RKDL

SEQ ID NO: 72315 - protein, 10 aa, Mycobacterium avium
RKDRGGLSVE

SEQ ID NO: 72316 - protein, 6 aa, Mycobacterium avium
RKEAEA

SEQ ID NO: 72317 - protein, 9 aa, Mycobacterium avium
RKELYKSGG

SEQ ID NO: 72318 - protein, 14 aa, Mycobacterium avium
RKFSAGSAEGMLSP

SEQ ID NO: 72319 - protein, 7 aa, Mycobacterium avium
RKGRGGP

SEQ ID NO: 72320 - protein, 4 aa, Mycobacterium avium
RKGY

SEQ ID NO: 72321 - protein, 6 aa, Mycobacterium avium
RKHPHS

SEQ ID NO: 72322 - protein, 23 aa, Mycobacterium avium
RKLSPPRRRPATSVTYREAFGNP

SEQ ID NO: 72323 - protein, 10 aa, Mycobacterium avium
RKNHEANAET

SEQ ID NO: 72324 - protein, 9 aa, Mycobacterium avium
RKPAPHRAI

SEQ ID NO: 72325 - protein, 5 aa, Mycobacterium avium
RKPDL

SEQ ID NO: 72326 - protein, 6 aa, Mycobacterium avium
RKPDLA

SEQ ID NO: 72327 - protein, 4 aa, Mycobacterium avium
RKPE

SEQ ID NO: 72328 - protein, 7 aa, Mycobacterium avium
RKPEIAE

SEQ ID NO: 72329 - protein, 5 aa, Mycobacterium avium
RKPFG

SEQ ID NO: 72330 - protein, 6 aa, Mycobacterium avium
RKPGGQ

SEQ ID NO: 72331 - protein, 6 aa, Mycobacterium avium
RKPMSE

SEQ ID NO: 72332 - protein, 5 aa, Mycobacterium avium
RKPNN

SEQ ID NO: 72333 - protein, 8 aa, Mycobacterium avium
RKPPAADV

SEQ ID NO: 72334 - protein, 10 aa, Mycobacterium avium
RKPTKSPNQL

SEQ ID NO: 72335 - protein, 8 aa, Mycobacterium avium
RKQDPQHA

SEQ ID NO: 72336 - protein, 8 aa, Mycobacterium avium
RKRAARRR

SEQ ID NO: 72337 - protein, 10 aa, Mycobacterium avium
RKRAEEGLAP

SEQ ID NO: 72338 - protein, 12 aa, Mycobacterium avium
RKRAGASGDADV

SEQ ID NO: 72339 - protein, 7 aa, Mycobacterium avium
RKRRQPV

SEQ ID NO: 72340 - protein, 10 aa, Mycobacterium avium
RKRSEERAEL

SEQ ID NO: 72341 - protein, 12 aa, Mycobacterium avium
RKSMDADAAARF

SEQ ID NO: 72342 - protein, 8 aa, Mycobacterium avium
RKSRAPRY

SEQ ID NO: 72343 - protein, 10 aa, Mycobacterium avium
RKSRSAPGLA

SEQ ID NO: 72344 - protein, 7 aa, Mycobacterium avium
RKSRSSM

SEQ ID NO: 72345 - protein, 9 aa, Mycobacterium avium
RKTGSYGAP

SEQ ID NO: 72346 - protein, 6 aa, Mycobacterium avium
RKTHAT

SEQ ID NO: 72347 - protein, 9 aa, Mycobacterium avium
RKTLNDDTA

SEQ ID NO: 72348 - protein, 8 aa, Mycobacterium avium
RKTTDEDM

SEQ ID NO: 72349 - protein, 10 aa, Mycobacterium avium
RKVTADKNIT

SEQ ID NO: 72350 - protein, 10 aa, Mycobacterium avium
RKYDQSNHGV

SEQ ID NO: 72351 - protein, 7 aa, Mycobacterium avium
RLAGQRD

SEQ ID NO: 72352 - protein, 19 aa, Mycobacterium avium
RLAPGGEGPKPGPPEIPPA

SEQ ID NO: 72353 - protein, 9 aa, Mycobacterium avium
RLDEEAREA

SEQ ID NO: 72354 - protein, 10 aa, Mycobacterium avium
RLDGHTAATA

SEQ ID NO: 72355 - protein, 9 aa, Mycobacterium avium
RLDQPGDVE

SEQ ID NO: 72356 - protein, 13 aa, Mycobacterium avium
RLDRTDPRVSPAL

SEQ ID NO: 72357 - protein, 7 aa, Mycobacterium avium
RLEGGHG

SEQ ID NO: 72358 - protein, 4 aa, Mycobacterium avium
RLEP

SEQ ID NO: 72359 - protein, 13 aa, Mycobacterium avium
RLEPSGPRGAAED

SEQ ID NO: 72360 - protein, 7 aa, Mycobacterium avium
RLEQAES

SEQ ID NO: 72361 - protein, 6 aa, Mycobacterium avium
RLESDE

SEQ ID NO: 72362 - protein, 4 aa, Mycobacterium avium
RLGA

SEQ ID NO: 72363 - protein, 5 aa, Mycobacterium avium
RLGAK

SEQ ID NO: 72364 - protein, 6 aa, Mycobacterium avium
RLGGER

SEQ ID NO: 72365 - protein, 13 aa, Mycobacterium avium
RLGHPAQANEAIA

SEQ ID NO: 72366 - protein, 11 aa, Mycobacterium avium
RLGNDGDLSIG

SEQ ID NO: 72367 - protein, 7 aa, Mycobacterium avium
RLGPDTS

SEQ ID NO: 72368 - protein, 9 aa, Mycobacterium avium
RLGQPEHPD

SEQ ID NO: 72369 - protein, 4 aa, Mycobacterium avium
RLGS

SEQ ID NO: 72370 - protein, 9 aa, Mycobacterium avium
RLNEKTVTR

SEQ ID NO: 72371 - protein, 5 aa, Mycobacterium avium
RLNPA

SEQ ID NO: 72372 - protein, 11 aa, Mycobacterium avium
RLNPRDTAHNM

SEQ ID NO: 72373 - protein, 8 aa, Mycobacterium avium
RLPAPAPY

SEQ ID NO: 72374 - protein, 31 aa, Mycobacterium avium
RLPAPDADGMDAHKPDHLDDAHQTMKVGSTA

SEQ ID NO: 72375 - protein, 5 aa, Mycobacterium avium
RLPDG

SEQ ID NO: 72376 - protein, 17 aa, Mycobacterium avium
RLPDGSHAAGAAPDGSW

SEQ ID NO: 72377 - protein, 4 aa, Mycobacterium avium
RLPE

SEQ ID NO: 72378 - protein, 14 aa, Mycobacterium avium
RLPEDPAGRPRRRR

SEQ ID NO: 72379 - protein, 11 aa, Mycobacterium avium
RLPEGPQLPRV

SEQ ID NO: 72380 - protein, 8 aa, Mycobacterium avium
RLPEPSPS

SEQ ID NO: 72381 - protein, 8 aa, Mycobacterium avium
RLPGAQQQ

SEQ ID NO: 72382 - protein, 10 aa, Mycobacterium avium
RLPGNTDEDR

SEQ ID NO: 72383 - protein, 21 aa, Mycobacterium avium
RLPPAARKSGIESSARGTDKL

SEQ ID NO: 72384 - protein, 5 aa, Mycobacterium avium
RLPPD

SEQ ID NO: 72385 - protein, 21 aa, Mycobacterium avium
RLPRARQPRPLNDQRAEGTPV

SEQ ID NO: 72386 - protein, 13 aa, Mycobacterium avium
RLPSSQRSLTAAS

SEQ ID NO: 72387 - protein, 5 aa, Mycobacterium avium
RLPTG

SEQ ID NO: 72388 - protein, 5 aa, Mycobacterium avium
RLQRN

SEQ ID NO: 72389 - protein, 5 aa, Mycobacterium avium
RLRAP

SEQ ID NO: 72390 - protein, 5 aa, Mycobacterium avium
RLRGE

SEQ ID NO: 72391 - protein, 6 aa, Mycobacterium avium
RLRGRA

SEQ ID NO: 72392 - protein, 20 aa, Mycobacterium avium
RLSAPRQGRRDHVPATAGAA

SEQ ID NO: 72393 - protein, 13 aa, Mycobacterium avium
RLSESGDAGERRA

SEQ ID NO: 72394 - protein, 8 aa, Mycobacterium avium
RLSGADAV

SEQ ID NO: 72395 - protein, 4 aa, Mycobacterium avium
RLSN

SEQ ID NO: 72396 - protein, 8 aa, Mycobacterium avium
RLSPEAPV

SEQ ID NO: 72397 - protein, 7 aa, Mycobacterium avium
RLSPRTA

SEQ ID NO: 72398 - protein, 6 aa, Mycobacterium avium
RLSSAE

SEQ ID NO: 72399 - protein, 7 aa, Mycobacterium avium
RLSSAER

SEQ ID NO: 72400 - protein, 6 aa, Mycobacterium avium
RLTAPE

SEQ ID NO: 72401 - protein, 8 aa, Mycobacterium avium
RLTDGQGC

SEQ ID NO: 72402 - protein, 9 aa, Mycobacterium avium
RLTRTDTST

SEQ ID NO: 72403 - protein, 11 aa, Mycobacterium avium
RLTSDPGAARE

SEQ ID NO: 72404 - protein, 7 aa, Mycobacterium avium
RMAPPER

SEQ ID NO: 72405 - protein, 8 aa, Mycobacterium avium
RMGQGAAA

SEQ ID NO: 72406 - protein, 7 aa, Mycobacterium avium
RMPAPDS

SEQ ID NO: 72407 - protein, 15 aa, Mycobacterium avium
RMQDGEPHLAGTARQ

SEQ ID NO: 72408 - protein, 10 aa, Mycobacterium avium
RMRDPDPQKI

SEQ ID NO: 72409 - protein, 11 aa, Mycobacterium avium
RMTKPGESVAA

SEQ ID NO: 72410 - protein, 11 aa, Mycobacterium avium
RMTKSSDSAAV

SEQ ID NO: 72411 - protein, 8 aa, Mycobacterium avium
RNAALNPS

SEQ ID NO: 72412 - protein, 5 aa, Mycobacterium avium
RNAEQ

SEQ ID NO: 72413 - protein, 9 aa, Mycobacterium avium
RNAGDAEIK

SEQ ID NO: 72414 - protein, 9 aa, Mycobacterium avium
RNAGLNPDA

SEQ ID NO: 72415 - protein, 9 aa, Mycobacterium avium
RNAKAAVEE

SEQ ID NO: 72416 - protein, 5 aa, Mycobacterium avium
RNALR

SEQ ID NO: 72417 - protein, 10 aa, Mycobacterium avium
RNAPSRVDRG

SEQ ID NO: 72418 - protein, 7 aa, Mycobacterium avium
RNATKAN

SEQ ID NO: 72419 - protein, 19 aa, Mycobacterium avium
RNCRATPPGAADGSDATAA

SEQ ID NO: 72420 - protein, 19 aa, Mycobacterium avium
RNCRATPPSAADGSGATAA

SEQ ID NO: 72421 - protein, 14 aa, Mycobacterium avium
RNDAGQQLKSSIEG

SEQ ID NO: 72422 - protein, 8 aa, Mycobacterium avium
RNDAGRKD

SEQ ID NO: 72423 - protein, 14 aa, Mycobacterium avium
RNDDPLAAAQADGA

SEQ ID NO: 72424 - protein, 15 aa, Mycobacterium avium
RNDDPLAAAQADGAD

SEQ ID NO: 72425 - protein, 7 aa, Mycobacterium avium
RNDPAFS

SEQ ID NO: 72426 - protein, 21 aa, Mycobacterium avium
RNDQPGRQGDYSEFETGPQRT

SEQ ID NO: 72427 - protein, 21 aa, Mycobacterium avium
RNDTQTPVTADRRRDGGGPDV

SEQ ID NO: 72428 - protein, 7 aa, Mycobacterium avium
RNEAAPY

SEQ ID NO: 72429 - protein, 4 aa, Mycobacterium avium
RNGD

SEQ ID NO: 72430 - protein, 8 aa, Mycobacterium avium
RNGGGGRV

SEQ ID NO: 72431 - protein, 6 aa, Mycobacterium avium
RNGGYT

SEQ ID NO: 72432 - protein, 13 aa, Mycobacterium avium
RNGNRGPGASPQG

SEQ ID NO: 72433 - protein, 8 aa, Mycobacterium avium
RNGPPYAP

SEQ ID NO: 72434 - protein, 8 aa, Mycobacterium avium
RNGPPYTP

SEQ ID NO: 72435 - protein, 7 aa, Mycobacterium avium
RNGSGRW

SEQ ID NO: 72436 - protein, 7 aa, Mycobacterium avium
RNGTVEK

SEQ ID NO: 72437 - protein, 6 aa, Mycobacterium avium
RNGTYA

SEQ ID NO: 72438 - protein, 8 aa, Mycobacterium avium
RNGVSDHS

SEQ ID NO: 72439 - protein, 4 aa, Mycobacterium avium
RNGY

SEQ ID NO: 72440 - protein, 6 aa, Mycobacterium avium
RNGYVT

SEQ ID NO: 72441 - protein, 9 aa, Mycobacterium avium
RNHAGPNEH

SEQ ID NO: 72442 - protein, 17 aa, Mycobacterium avium
RNHPGTRRGVTRANVAP

SEQ ID NO: 72443 - protein, 7 aa, Mycobacterium avium
RNHYPQD

SEQ ID NO: 72444 - protein, 7 aa, Mycobacterium avium
RNKARSV

SEQ ID NO: 72445 - protein, 18 aa, Mycobacterium avium
RNLAGGKGARQISADDSP

SEQ ID NO: 72446 - protein, 18 aa, Mycobacterium avium
RNLAGSKGGRQISADDSP

SEQ ID NO: 72447 - protein, 18 aa, Mycobacterium avium
RNLPGAKGARQISADDSP

SEQ ID NO: 72448 - protein, 10 aa, Mycobacterium avium
RNNSGRPGGR

SEQ ID NO: 72449 - protein, 4 aa, Mycobacterium avium
RNNT

SEQ ID NO: 72450 - protein, 7 aa, Mycobacterium avium
RNPDGQD

SEQ ID NO: 72451 - protein, 11 aa, Mycobacterium avium
RNPDRRAGVTR

SEQ ID NO: 72452 - protein, 6 aa, Mycobacterium avium
RNPGKL

SEQ ID NO: 72453 - protein, 5 aa, Mycobacterium avium
RNPLP

SEQ ID NO: 72454 - protein, 12 aa, Mycobacterium avium
RNPNGDNPNEEE

SEQ ID NO: 72455 - protein, 6 aa, Mycobacterium avium
RNPNPH

SEQ ID NO: 72456 - protein, 5 aa, Mycobacterium avium
RNPQL

SEQ ID NO: 72457 - protein, 11 aa, Mycobacterium avium
RNPRPAGPAPW

SEQ ID NO: 72458 - protein, 7 aa, Mycobacterium avium
RNQQAHV

SEQ ID NO: 72459 - protein, 5 aa, Mycobacterium avium
RNRAE

SEQ ID NO: 72460 - protein, 17 aa, Mycobacterium avium
RNRHPPGRRSGQRGTVA

SEQ ID NO: 72461 - protein, 6 aa, Mycobacterium avium
RNRIDT

SEQ ID NO: 72462 - protein, 13 aa, Mycobacterium avium
RNRNNITSAEQDR

SEQ ID NO: 72463 - protein, 5 aa, Mycobacterium avium
RNSDG

SEQ ID NO: 72464 - protein, 7 aa, Mycobacterium avium
RNSPEGR

SEQ ID NO: 72465 - protein, 10 aa, Mycobacterium avium
RNSRPGSRRH

SEQ ID NO: 72466 - protein, 26 aa, Mycobacterium avium
RNTGVSDAQAIGDDGKVAIAARVTAY

SEQ ID NO: 72467 - protein, 4 aa, Mycobacterium avium
RNTY

SEQ ID NO: 72468 - protein, 6 aa, Mycobacterium avium
RNVRET

SEQ ID NO: 72469 - protein, 6 aa, Mycobacterium avium
RNVTTE

SEQ ID NO: 72470 - protein, 6 aa, Mycobacterium avium
RPAADE

SEQ ID NO: 72471 - protein, 12 aa, Mycobacterium avium
RPAAEAAARRVP

SEQ ID NO: 72472 - protein, 15 aa, Mycobacterium avium
RPAAGSANQPGGRPA

SEQ ID NO: 72473 - protein, 38 aa, Mycobacterium avium
RPAAPPRGPPAAGPGAARAPVGARARASLTGSGRDRAA

SEQ ID NO: 72474 - protein, 8 aa, Mycobacterium avium
RPAARNAM

SEQ ID NO: 72475 - protein, 8 aa, Mycobacterium avium
RPADRRPV

SEQ ID NO: 72476 - protein, 19 aa, Mycobacterium avium
RPADSDRRRRNNAPAARPA

SEQ ID NO: 72477 - protein, 15 aa, Mycobacterium avium
RPAEAVPHDQPGRGL

SEQ ID NO: 72478 - protein, 7 aa, Mycobacterium avium
RPAERSE

SEQ ID NO: 72479 - protein, 12 aa, Mycobacterium avium
RPAGCRAGDRRR

SEQ ID NO: 72480 - protein, 6 aa, Mycobacterium avium
RPAGGA

SEQ ID NO: 72481 - protein, 5 aa, Mycobacterium avium
RPAGR

SEQ ID NO: 72482 - protein, 10 aa, Mycobacterium avium
RPAGSAPLSW

SEQ ID NO: 72483 - protein, 14 aa, Mycobacterium avium
RPAKTASSSATQAA

SEQ ID NO: 72484 - protein, 4 aa, Mycobacterium avium
RPAN

SEQ ID NO: 72485 - protein, 5 aa, Mycobacterium avium
RPAPA

SEQ ID NO: 72486 - protein, 8 aa, Mycobacterium avium
RPAPARQR

SEQ ID NO: 72487 - protein, 7 aa, Mycobacterium avium
RPAPGQT

SEQ ID NO: 72488 - protein, 8 aa, Mycobacterium avium
RPAPPGQV

SEQ ID NO: 72489 - protein, 8 aa, Mycobacterium avium
RPAPPPEL

SEQ ID NO: 72490 - protein, 8 aa, Mycobacterium avium
RPAPRLGE

SEQ ID NO: 72491 - protein, 53 aa, Mycobacterium avium
RPARGGARPAAPDRRVGGPRVAARGPPRHGPGRGTAAAAGAGDRHRGAGVVGR

SEQ ID NO: 72492 - protein, 7 aa, Mycobacterium avium
RPARPAR

SEQ ID NO: 72493 - protein, 6 aa, Mycobacterium avium
RPASDC

SEQ ID NO: 72494 - protein, 41 aa, Mycobacterium avium
RPASPGPKRPRPPRRREWPEAPGSPRVAPARPRPPAAGSVA

SEQ ID NO: 72495 - protein, 7 aa, Mycobacterium avium
RPATPVS

SEQ ID NO: 72496 - protein, 8 aa, Mycobacterium avium
RPATPVSV

SEQ ID NO: 72497 - protein, 12 aa, Mycobacterium avium
RPAVAPKTLPEA

SEQ ID NO: 72498 - protein, 14 aa, Mycobacterium avium
RPDAANAVRPDDRD

SEQ ID NO: 72499 - protein, 10 aa, Mycobacterium avium
RPDAQNSATL

SEQ ID NO: 72500 - protein, 18 aa, Mycobacterium avium
RPDARNAVNGAVSTAVGD

SEQ ID NO: 72501 - protein, 5 aa, Mycobacterium avium
RPDDA

SEQ ID NO: 72502 - protein, 7 aa, Mycobacterium avium
RPDDADP

SEQ ID NO: 72503 - protein, 5 aa, Mycobacterium avium
RPDDQ

SEQ ID NO: 72504 - protein, 6 aa, Mycobacterium avium
RPDEVQ

SEQ ID NO: 72505 - protein, 7 aa, Mycobacterium avium
RPDGADP

SEQ ID NO: 72506 - protein, 6 aa, Mycobacterium avium
RPDGFP

SEQ ID NO: 72507 - protein, 26 aa, Mycobacterium avium
RPDGQDRFTADTAGDIGAGGDERQVV

SEQ ID NO: 72508 - protein, 26 aa, Mycobacterium avium
RPDGQDRFTADTAGDIGGGGDERQVV

SEQ ID NO: 72509 - protein, 6 aa, Mycobacterium avium
RPDGTN

SEQ ID NO: 72510 - protein, 6 aa, Mycobacterium avium
RPDHEV

SEQ ID NO: 72511 - protein, 5 aa, Mycobacterium avium
RPDKL

SEQ ID NO: 72512 - protein, 15 aa, Mycobacterium avium
RPDKLESEAAADAKR

SEQ ID NO: 72513 - protein, 34 aa, Mycobacterium avium
RPDKPGMPTPPAEQRRDGRWSRPAVPASSLPTDA

SEQ ID NO: 72514 - protein, 21 aa, Mycobacterium avium
RPDLRDDPRFASAAARREHHD

SEQ ID NO: 72515 - protein, 11 aa, Mycobacterium avium
RPDNRGSNSNA

SEQ ID NO: 72516 - protein, 9 aa, Mycobacterium avium
RPDNSPQRF

SEQ ID NO: 72517 - protein, 6 aa, Mycobacterium avium
RPDPDI

SEQ ID NO: 72518 - protein, 5 aa, Mycobacterium avium
RPDPR

SEQ ID NO: 72519 - protein, 4 aa, Mycobacterium avium
RPDQ

SEQ ID NO: 72520 - protein, 8 aa, Mycobacterium avium
RPDQHRPG

SEQ ID NO: 72521 - protein, 10 aa, Mycobacterium avium
RPDQKNSVSG

SEQ ID NO: 72522 - protein, 10 aa, Mycobacterium avium
RPDQRNAQNR

SEQ ID NO: 72523 - protein, 4 aa, Mycobacterium avium
RPDR

SEQ ID NO: 72524 - protein, 5 aa, Mycobacterium avium
RPDTG

SEQ ID NO: 72525 - protein, 7 aa, Mycobacterium avium
RPDVGPR

SEQ ID NO: 72526 - protein, 7 aa, Mycobacterium avium
RPDVRQR

SEQ ID NO: 72527 - protein, 14 aa, Mycobacterium avium
RPEAANAVRPDDRD

SEQ ID NO: 72528 - protein, 7 aa, Mycobacterium avium
RPEARNA

SEQ ID NO: 72529 - protein, 16 aa, Mycobacterium avium
RPEDAQKATEEQRKLQ

SEQ ID NO: 72530 - protein, 10 aa, Mycobacterium avium
RPEEGSGSAM

SEQ ID NO: 72531 - protein, 7 aa, Mycobacterium avium
RPEGGWT

SEQ ID NO: 72532 - protein, 8 aa, Mycobacterium avium
RPEGGWTP

SEQ ID NO: 72533 - protein, 5 aa, Mycobacterium avium
RPEKL

SEQ ID NO: 72534 - protein, 5 aa, Mycobacterium avium
RPEKM

SEQ ID NO: 72535 - protein, 12 aa, Mycobacterium avium
RPEPGHKAAPSW

SEQ ID NO: 72536 - protein, 13 aa, Mycobacterium avium
RPEPGHRASPSWL

SEQ ID NO: 72537 - protein, 7 aa, Mycobacterium avium
RPEPGTI

SEQ ID NO: 72538 - protein, 18 aa, Mycobacterium avium
RPEQTAETFRPDGLRSGD

SEQ ID NO: 72539 - protein, 6 aa, Mycobacterium avium
RPEQVD

SEQ ID NO: 72540 - protein, 5 aa, Mycobacterium avium
RPERF

SEQ ID NO: 72541 - protein, 5 aa, Mycobacterium avium
RPETE

SEQ ID NO: 72542 - protein, 6 aa, Mycobacterium avium
RPETPI

SEQ ID NO: 72543 - protein, 19 aa, Mycobacterium avium
RPEVSAYRRSPRAPAPGTS

SEQ ID NO: 72544 - protein, 32 aa, Mycobacterium avium
RPFSAEEQQRIQEQYPERRRRSAYATSGTPHG

SEQ ID NO: 72545 - protein, 11 aa, Mycobacterium avium
RPGAAADGEAL

SEQ ID NO: 72546 - protein, 23 aa, Mycobacterium avium
RPGAKHDSAVADYQKDHQGPLGS

SEQ ID NO: 72547 - protein, 6 aa, Mycobacterium avium
RPGALT

SEQ ID NO: 72548 - protein, 24 aa, Mycobacterium avium
RPGAPQRRTGQPGLAHAGGPGDHH

SEQ ID NO: 72549 - protein, 8 aa, Mycobacterium avium
RPGAQLDE

SEQ ID NO: 72550 - protein, 6 aa, Mycobacterium avium
RPGATP

SEQ ID NO: 72551 - protein, 6 aa, Mycobacterium avium
RPGDER

SEQ ID NO: 72552 - protein, 4 aa, Mycobacterium avium
RPGE

SEQ ID NO: 72553 - protein, 6 aa, Mycobacterium avium
RPGEAR

SEQ ID NO: 72554 - protein, 14 aa, Mycobacterium avium
RPGEECDGEDNRLG

SEQ ID NO: 72555 - protein, 8 aa, Mycobacterium avium
RPGEERRQ

SEQ ID NO: 72556 - protein, 19 aa, Mycobacterium avium
RPGEIATTAEGFEASTKTG

SEQ ID NO: 72557 - protein, 4 aa, Mycobacterium avium
RPGF

SEQ ID NO: 72558 - protein, 7 aa, Mycobacterium avium
RPGGGAK

SEQ ID NO: 72559 - protein, 9 aa, Mycobacterium avium
RPGIPPTHP

SEQ ID NO: 72560 - protein, 13 aa, Mycobacterium avium
RPGMTAEQVDAAA

SEQ ID NO: 72561 - protein, 11 aa, Mycobacterium avium
RPGRAARPSVR

SEQ ID NO: 72562 - protein, 7 aa, Mycobacterium avium
RPGRGVR

SEQ ID NO: 72563 - protein, 4 aa, Mycobacterium avium
RPGS

SEQ ID NO: 72564 - protein, 17 aa, Mycobacterium avium
RPGTTPAETGDTPPPGL

SEQ ID NO: 72565 - protein, 5 aa, Mycobacterium avium
RPGVG

SEQ ID NO: 72566 - protein, 5 aa, Mycobacterium avium
RPGVT

SEQ ID NO: 72567 - protein, 13 aa, Mycobacterium avium
RPGVTAEQVDAAA

SEQ ID NO: 72568 - protein, 19 aa, Mycobacterium avium
RPGYGSSAPYPEAMTRPEQ

SEQ ID NO: 72569 - protein, 10 aa, Mycobacterium avium
RPHDATDPAA

SEQ ID NO: 72570 - protein, 14 aa, Mycobacterium avium
RPHPGARADPDASG

SEQ ID NO: 72571 - protein, 21 aa, Mycobacterium avium
RPHPGGAGRPGPRGGVGQPVG

SEQ ID NO: 72572 - protein, 6 aa, Mycobacterium avium
RPHPRN

SEQ ID NO: 72573 - protein, 4 aa, Mycobacterium avium
RPHQ

SEQ ID NO: 72574 - protein, 7 aa, Mycobacterium avium
RPHTGGR

SEQ ID NO: 72575 - protein, 8 aa, Mycobacterium avium
RPIDPAPF

SEQ ID NO: 72576 - protein, 5 aa, Mycobacterium avium
RPIEE

SEQ ID NO: 72577 - protein, 11 aa, Mycobacterium avium
RPKAIRNSGVS

SEQ ID NO: 72578 - protein, 6 aa, Mycobacterium avium
RPKPTK

SEQ ID NO: 72579 - protein, 4 aa, Mycobacterium avium
RPKS

SEQ ID NO: 72580 - protein, 22 aa, Mycobacterium avium
RPLGGADAAADADGDVGPRPQL

SEQ ID NO: 72581 - protein, 6 aa, Mycobacterium avium
RPLGYD

SEQ ID NO: 72582 - protein, 4 aa, Mycobacterium avium
RPLP

SEQ ID NO: 72583 - protein, 6 aa, Mycobacterium avium
RPLSGR

SEQ ID NO: 72584 - protein, 7 aa, Mycobacterium avium
RPNCERP

SEQ ID NO: 72585 - protein, 11 aa, Mycobacterium avium
RPNDERRNRSL

SEQ ID NO: 72586 - protein, 7 aa, Mycobacterium avium
RPNPGIG

SEQ ID NO: 72587 - protein, 22 aa, Mycobacterium avium
RPNPPGRADRAPRPGAAGGHDL

SEQ ID NO: 72588 - protein, 6 aa, Mycobacterium avium
RPPAPR

SEQ ID NO: 72589 - protein, 5 aa, Mycobacterium avium
RPPDI

SEQ ID NO: 72590 - protein, 9 aa, Mycobacterium avium
RPPGQTKPL

SEQ ID NO: 72591 - protein, 7 aa, Mycobacterium avium
RPPPAEQ

SEQ ID NO: 72592 - protein, 9 aa, Mycobacterium avium
RPPPGRSRA

SEQ ID NO: 72593 - protein, 7 aa, Mycobacterium avium
RPPSPSW

SEQ ID NO: 72594 - protein, 5 aa, Mycobacterium avium
RPPTH

SEQ ID NO: 72595 - protein, 10 aa, Mycobacterium avium
RPPTNPRAPG

SEQ ID NO: 72596 - protein, 9 aa, Mycobacterium avium
RPQASESEV

SEQ ID NO: 72597 - protein, 9 aa, Mycobacterium avium
RPQHPPTSI

SEQ ID NO: 72598 - protein, 17 aa, Mycobacterium avium
RPQPPRRYSQAEHRDRR

SEQ ID NO: 72599 - protein, 19 aa, Mycobacterium avium
RPQQGADAAAAPAGENGRI

SEQ ID NO: 72600 - protein, 24 aa, Mycobacterium avium
RPQVPDGKGDVHGGDRPDQVAPGD

SEQ ID NO: 72601 - protein, 6 aa, Mycobacterium avium
RPRAAP

SEQ ID NO: 72602 - protein, 6 aa, Mycobacterium avium
RPRDRG

SEQ ID NO: 72603 - protein, 7 aa, Mycobacterium avium
RPRFDSA

SEQ ID NO: 72604 - protein, 16 aa, Mycobacterium avium
RPRGARVATPQQRRAY

SEQ ID NO: 72605 - protein, 6 aa, Mycobacterium avium
RPRKSL

SEQ ID NO: 72606 - protein, 6 aa, Mycobacterium avium
RPRLPR

SEQ ID NO: 72607 - protein, 23 aa, Mycobacterium avium
RPRPRPNSNDCKCGGPISSPSCR

SEQ ID NO: 72608 - protein, 5 aa, Mycobacterium avium
RPRPV

SEQ ID NO: 72609 - protein, 10 aa, Mycobacterium avium
RPRQRGAGLG

SEQ ID NO: 72610 - protein, 11 aa, Mycobacterium avium
RPRRGQPPGVV

SEQ ID NO: 72611 - protein, 39 aa, Mycobacterium avium
RPRRPRRGRAGRRPPSRSGEPGRGGRGRDRAHRGRRPDA

SEQ ID NO: 72612 - protein, 11 aa, Mycobacterium avium
RPRSARRTTSI

SEQ ID NO: 72613 - protein, 61 aa, Mycobacterium avium
RPSAAPKPASKPEPAAAKPEHEPEPQPEARPEPRAEPTPEPKPAPEPARASETPSAPGELN

SEQ ID NO: 72614 - protein, 61 aa, Mycobacterium avium
RPSAAPKPASKPEPAAAKPEHEPEPQPEARPEPRAKPTPEPKPAPEPARASETPSAPGELN

SEQ ID NO: 72615 - protein, 57 aa, Mycobacterium avium
RPSAAPKPASKPEPAAAKSEHEPEPQPEARPEPRPEPTPEPKPARASETPSAPGELN

SEQ ID NO: 72616 - protein, 10 aa, Mycobacterium avium
RPSALDSETQ

SEQ ID NO: 72617 - protein, 14 aa, Mycobacterium avium
RPSAQSRRPGPPGI

SEQ ID NO: 72618 - protein, 34 aa, Mycobacterium avium
RPSARAPLRRGGGHASPRACGGPPGRAAAPQAGA

SEQ ID NO: 72619 - protein, 34 aa, Mycobacterium avium
RPSARAPLRRGSGHASPRACGGPPGRAAAPPSGA

SEQ ID NO: 72620 - protein, 20 aa, Mycobacterium avium
RPSGCSTARRPGRRPASPRW

SEQ ID NO: 72621 - protein, 57 aa, Mycobacterium avium
RPSGRLPSPHRAGGSPRRSRAGVRAAPAWPARAPAALGGSGDAARRPGDRAGRPGCR

SEQ ID NO: 72622 - protein, 5 aa, Mycobacterium avium
RPSLR

SEQ ID NO: 72623 - protein, 7 aa, Mycobacterium avium
RPSLTGS

SEQ ID NO: 72624 - protein, 11 aa, Mycobacterium avium
RPSPAATGSPT

SEQ ID NO: 72625 - protein, 10 aa, Mycobacterium avium
RPSQSTLSLQ

SEQ ID NO: 72626 - protein, 5 aa, Mycobacterium avium
RPSRE

SEQ ID NO: 72627 - protein, 5 aa, Mycobacterium avium
RPSRG

SEQ ID NO: 72628 - protein, 13 aa, Mycobacterium avium
RPSRSSASCTRAA

SEQ ID NO: 72629 - protein, 4 aa, Mycobacterium avium
RPSS

SEQ ID NO: 72630 - protein, 7 aa, Mycobacterium avium
RPSVGGT

SEQ ID NO: 72631 - protein, 4 aa, Mycobacterium avium
RPTE

SEQ ID NO: 72632 - protein, 37 aa, Mycobacterium avium
RPTGQGPLQPAGGARLDEAAGVRTPGARSGGQSAHRH

SEQ ID NO: 72633 - protein, 12 aa, Mycobacterium avium
RPTGRGAEREIA

SEQ ID NO: 72634 - protein, 8 aa, Mycobacterium avium
RPTLDPAA

SEQ ID NO: 72635 - protein, 9 aa, Mycobacterium avium
RPTNGRREI

SEQ ID NO: 72636 - protein, 9 aa, Mycobacterium avium
RPTPKLPPK

SEQ ID NO: 72637 - protein, 7 aa, Mycobacterium avium
RPTRHTR

SEQ ID NO: 72638 - protein, 9 aa, Mycobacterium avium
RPTSGRARV

SEQ ID NO: 72639 - protein, 6 aa, Mycobacterium avium
RPTTAE

SEQ ID NO: 72640 - protein, 7 aa, Mycobacterium avium
RPTTAER

SEQ ID NO: 72641 - protein, 6 aa, Mycobacterium avium
RPTTEN

SEQ ID NO: 72642 - protein, 6 aa, Mycobacterium avium
RPTTPT

SEQ ID NO: 72643 - protein, 6 aa, Mycobacterium avium
RPVDEQ

SEQ ID NO: 72644 - protein, 7 aa, Mycobacterium avium
RPVDSGD

SEQ ID NO: 72645 - protein, 5 aa, Mycobacterium avium
RPVED

SEQ ID NO: 72646 - protein, 6 aa, Mycobacterium avium
RPVEDE

SEQ ID NO: 72647 - protein, 6 aa, Mycobacterium avium
RPVEPR

SEQ ID NO: 72648 - protein, 30 aa, Mycobacterium avium
RPVGVSAGAPARIGDPEVPGERGDRPAVGG

SEQ ID NO: 72649 - protein, 4 aa, Mycobacterium avium
RPVP

SEQ ID NO: 72650 - protein, 9 aa, Mycobacterium avium
RPVSGPVSR

SEQ ID NO: 72651 - protein, 14 aa, Mycobacterium avium
RPVSTTGESGNQNT

SEQ ID NO: 72652 - protein, 4 aa, Mycobacterium avium
RPWA

SEQ ID NO: 72653 - protein, 11 aa, Mycobacterium avium
RPYSAQASGTV

SEQ ID NO: 72654 - protein, 4 aa, Mycobacterium avium
RPYW

SEQ ID NO: 72655 - protein, 4 aa, Mycobacterium avium
RQAA

SEQ ID NO: 72656 - protein, 7 aa, Mycobacterium avium
RQAASDA

SEQ ID NO: 72657 - protein, 8 aa, Mycobacterium avium
RQADPQLR

SEQ ID NO: 72658 - protein, 14 aa, Mycobacterium avium
RQAGNHDVSDRGAA

SEQ ID NO: 72659 - protein, 10 aa, Mycobacterium avium
RQARGLPATG

SEQ ID NO: 72660 - protein, 10 aa, Mycobacterium avium
RQASLDSAPP

SEQ ID NO: 72661 - protein, 8 aa, Mycobacterium avium
RQATGAPG

SEQ ID NO: 72662 - protein, 9 aa, Mycobacterium avium
RQATGEPSV

SEQ ID NO: 72663 - protein, 5 aa, Mycobacterium avium
RQAVD

SEQ ID NO: 72664 - protein, 6 aa, Mycobacterium avium
RQDGPH

SEQ ID NO: 72665 - protein, 4 aa, Mycobacterium avium
RQEE

SEQ ID NO: 72666 - protein, 6 aa, Mycobacterium avium
RQEPGL

SEQ ID NO: 72667 - protein, 10 aa, Mycobacterium avium
RQFGRPQPAC

SEQ ID NO: 72668 - protein, 8 aa, Mycobacterium avium
RQGGATEL

SEQ ID NO: 72669 - protein, 9 aa, Mycobacterium avium
RQGLQSTAP

SEQ ID NO: 72670 - protein, 7 aa, Mycobacterium avium
RQGRGAG

SEQ ID NO: 72671 - protein, 4 aa, Mycobacterium avium
RQGS

SEQ ID NO: 72672 - protein, 8 aa, Mycobacterium avium
RQGTDKEF

SEQ ID NO: 72673 - protein, 14 aa, Mycobacterium avium
RQHRDDGVGAAGEH

SEQ ID NO: 72674 - protein, 9 aa, Mycobacterium avium
RQIAEEDER

SEQ ID NO: 72675 - protein, 9 aa, Mycobacterium avium
RQKPVKRQT

SEQ ID NO: 72676 - protein, 26 aa, Mycobacterium avium
RQLEPVQRAGQRRGADRGDRGGVGQH

SEQ ID NO: 72677 - protein, 18 aa, Mycobacterium avium
RQNRHDRLSRARKHQGHK

SEQ ID NO: 72678 - protein, 6 aa, Mycobacterium avium
RQPAAV

SEQ ID NO: 72679 - protein, 10 aa, Mycobacterium avium
RQPAGPATLA

SEQ ID NO: 72680 - protein, 12 aa, Mycobacterium avium
RQPAGPATQATE

SEQ ID NO: 72681 - protein, 17 aa, Mycobacterium avium
RQPARRRGAAGDRRGIP

SEQ ID NO: 72682 - protein, 26 aa, Mycobacterium avium
RQPASAPRFSRTPAAQPRPARVAPRS

SEQ ID NO: 72683 - protein, 4 aa, Mycobacterium avium
RQPG

SEQ ID NO: 72684 - protein, 6 aa, Mycobacterium avium
RQPGQW

SEQ ID NO: 72685 - protein, 11 aa, Mycobacterium avium
RQPGRRPPRRV

SEQ ID NO: 72686 - protein, 7 aa, Mycobacterium avium
RQPPKTL

SEQ ID NO: 72687 - protein, 8 aa, Mycobacterium avium
RQPPQDLA

SEQ ID NO: 72688 - protein, 8 aa, Mycobacterium avium
RQPQNAIS

SEQ ID NO: 72689 - protein, 4 aa, Mycobacterium avium
RQPR

SEQ ID NO: 72690 - protein, 23 aa, Mycobacterium avium
RQQAQRAVAQARPATVSAKTPGV

SEQ ID NO: 72691 - protein, 9 aa, Mycobacterium avium
RQQEPPATA

SEQ ID NO: 72692 - protein, 10 aa, Mycobacterium avium
RQQEPPATAR

SEQ ID NO: 72693 - protein, 7 aa, Mycobacterium avium
RQQHRQG

SEQ ID NO: 72694 - protein, 6 aa, Mycobacterium avium
RQQQRV

SEQ ID NO: 72695 - protein, 9 aa, Mycobacterium avium
RQRAGKPLT

SEQ ID NO: 72696 - protein, 12 aa, Mycobacterium avium
RQRAHHRRGHPN

SEQ ID NO: 72697 - protein, 8 aa, Mycobacterium avium
RQRAQRAV

SEQ ID NO: 72698 - protein, 7 aa, Mycobacterium avium
RQREKAA

SEQ ID NO: 72699 - protein, 9 aa, Mycobacterium avium
RQREKAATL

SEQ ID NO: 72700 - protein, 28 aa, Mycobacterium avium
RQRELEDAARQLGARATAVRGDVGAPRD

SEQ ID NO: 72701 - protein, 4 aa, Mycobacterium avium
RQRP

SEQ ID NO: 72702 - protein, 12 aa, Mycobacterium avium
RQRQRVERQHRR

SEQ ID NO: 72703 - protein, 7 aa, Mycobacterium avium
RQRRAAQ

SEQ ID NO: 72704 - protein, 26 aa, Mycobacterium avium
RQRRARHAGATGDQHGAGGKRPGHRH

SEQ ID NO: 72705 - protein, 23 aa, Mycobacterium avium
RQRRSVQTQRVRDPPGRHSETVA

SEQ ID NO: 72706 - protein, 13 aa, Mycobacterium avium
RQRSGVGQQVSTT

SEQ ID NO: 72707 - protein, 21 aa, Mycobacterium avium
RQSGQAGPHEPSSCSGRTSQC

SEQ ID NO: 72708 - protein, 4 aa, Mycobacterium avium
RQSP

SEQ ID NO: 72709 - protein, 5 aa, Mycobacterium avium
RQTAR

SEQ ID NO: 72710 - protein, 4 aa, Mycobacterium avium
RQTP

SEQ ID NO: 72711 - protein, 9 aa, Mycobacterium avium
RQTRTSDPY

SEQ ID NO: 72712 - protein, 8 aa, Mycobacterium avium
RQTSGRGQ

SEQ ID NO: 72713 - protein, 4 aa, Mycobacterium avium
RQVE

SEQ ID NO: 72714 - protein, 7 aa, Mycobacterium avium
RQWPDRT

SEQ ID NO: 72715 - protein, 7 aa, Mycobacterium avium
RQYGIEP

SEQ ID NO: 72716 - protein, 4 aa, Mycobacterium avium
RQYP

SEQ ID NO: 72717 - protein, 12 aa, Mycobacterium avium
RRAAPSRRNRRT

SEQ ID NO: 72718 - protein, 13 aa, Mycobacterium avium
RRAAQQKPNREDD

SEQ ID NO: 72719 - protein, 7 aa, Mycobacterium avium
RRADPHH

SEQ ID NO: 72720 - protein, 18 aa, Mycobacterium avium
RRAEEPKSHSEVNVTRVL

SEQ ID NO: 72721 - protein, 6 aa, Mycobacterium avium
RRAEKA

SEQ ID NO: 72722 - protein, 6 aa, Mycobacterium avium
RRAEPC

SEQ ID NO: 72723 - protein, 14 aa, Mycobacterium avium
RRAERLGATGPDIL

SEQ ID NO: 72724 - protein, 9 aa, Mycobacterium avium
RRAERVGGT

SEQ ID NO: 72725 - protein, 11 aa, Mycobacterium avium
RRAGAADPQVL

SEQ ID NO: 72726 - protein, 6 aa, Mycobacterium avium
RRAGAE

SEQ ID NO: 72727 - protein, 10 aa, Mycobacterium avium
RRAGASDPQL

SEQ ID NO: 72728 - protein, 14 aa, Mycobacterium avium
RRAGDPPRLPGPGP

SEQ ID NO: 72729 - protein, 12 aa, Mycobacterium avium
RRAGEDVSPGTT

SEQ ID NO: 72730 - protein, 53 aa, Mycobacterium avium
RRAGHAAGRRAGRRLGRPDGRRLPGRARPLSGLAGAGEHRQRGRGRPAGSRRR

SEQ ID NO: 72731 - protein, 38 aa, Mycobacterium avium
RRAGPTARHPHPPGHRAGHRDRMAQPAAGTGAPHLRGP

SEQ ID NO: 72732 - protein, 6 aa, Mycobacterium avium
RRAGYG

SEQ ID NO: 72733 - protein, 7 aa, Mycobacterium avium
RRAHPEN

SEQ ID NO: 72734 - protein, 18 aa, Mycobacterium avium
RRAKPPHSKSARTGKAGT

SEQ ID NO: 72735 - protein, 15 aa, Mycobacterium avium
RRALGGGAGGRGHAG

SEQ ID NO: 72736 - protein, 12 aa, Mycobacterium avium
RRALGRKATDQM

SEQ ID NO: 72737 - protein, 7 aa, Mycobacterium avium
RRAPDAA

SEQ ID NO: 72738 - protein, 15 aa, Mycobacterium avium
RRAQAEGRCRDDDPQ

SEQ ID NO: 72739 - protein, 6 aa, Mycobacterium avium
RRAQAR

SEQ ID NO: 72740 - protein, 15 aa, Mycobacterium avium
RRAQARGYCRDDDPQ

SEQ ID NO: 72741 - protein, 11 aa, Mycobacterium avium
RRAQEQGYGTE

SEQ ID NO: 72742 - protein, 22 aa, Mycobacterium avium
RRAQRPGVEPTAQPQRRGHVVQ

SEQ ID NO: 72743 - protein, 4 aa, Mycobacterium avium
RRAS

SEQ ID NO: 72744 - protein, 9 aa, Mycobacterium avium
RRASDDVST

SEQ ID NO: 72745 - protein, 11 aa, Mycobacterium avium
RRASSSERTIN

SEQ ID NO: 72746 - protein, 8 aa, Mycobacterium avium
RRATRVDA

SEQ ID NO: 72747 - protein, 5 aa, Mycobacterium avium
RRAYT

SEQ ID NO: 72748 - protein, 7 aa, Mycobacterium avium
RRCPPDS

SEQ ID NO: 72749 - protein, 10 aa, Mycobacterium avium
RRCRSSPTRA

SEQ ID NO: 72750 - protein, 6 aa, Mycobacterium avium
RRDAEM

SEQ ID NO: 72751 - protein, 9 aa, Mycobacterium avium
RRDDMSQER

SEQ ID NO: 72752 - protein, 7 aa, Mycobacterium avium
RRDERQE

SEQ ID NO: 72753 - protein, 10 aa, Mycobacterium avium
RRDGGQAVAS

SEQ ID NO: 72754 - protein, 13 aa, Mycobacterium avium
RRDGIDATSEIAS

SEQ ID NO: 72755 - protein, 7 aa, Mycobacterium avium
RRDKIGK

SEQ ID NO: 72756 - protein, 8 aa, Mycobacterium avium
RRDLTGRP

SEQ ID NO: 72757 - protein, 9 aa, Mycobacterium avium
RRDPDNYPV

SEQ ID NO: 72758 - protein, 5 aa, Mycobacterium avium
RRDPF

SEQ ID NO: 72759 - protein, 5 aa, Mycobacterium avium
RRDPR

SEQ ID NO: 72760 - protein, 5 aa, Mycobacterium avium
RRDRR

SEQ ID NO: 72761 - protein, 6 aa, Mycobacterium avium
RRDRRE

SEQ ID NO: 72762 - protein, 4 aa, Mycobacterium avium
RRDT

SEQ ID NO: 72763 - protein, 18 aa, Mycobacterium avium
RRDVRRPAPRSQTERTDR

SEQ ID NO: 72764 - protein, 10 aa, Mycobacterium avium
RREAATSFGD

SEQ ID NO: 72765 - protein, 16 aa, Mycobacterium avium
RREAFRDSRGGVPDDG

SEQ ID NO: 72766 - protein, 9 aa, Mycobacterium avium
RRECEPGHV

SEQ ID NO: 72767 - protein, 8 aa, Mycobacterium avium
RREDGPHV

SEQ ID NO: 72768 - protein, 7 aa, Mycobacterium avium
RREDGRR

SEQ ID NO: 72769 - protein, 8 aa, Mycobacterium avium
RREDTRNT

SEQ ID NO: 72770 - protein, 6 aa, Mycobacterium avium
RREEDA

SEQ ID NO: 72771 - protein, 5 aa, Mycobacterium avium
RREEY

SEQ ID NO: 72772 - protein, 4 aa, Mycobacterium avium
RREG

SEQ ID NO: 72773 - protein, 9 aa, Mycobacterium avium
RREHDEASA

SEQ ID NO: 72774 - protein, 10 aa, Mycobacterium avium
RREHDEASAR

SEQ ID NO: 72775 - protein, 12 aa, Mycobacterium avium
RRENRDPDADDI

SEQ ID NO: 72776 - protein, 10 aa, Mycobacterium avium
RREPAPRPIR

SEQ ID NO: 72777 - protein, 10 aa, Mycobacterium avium
RRERDRSGRA

SEQ ID NO: 72778 - protein, 4 aa, Mycobacterium avium
RRFA

SEQ ID NO: 72779 - protein, 10 aa, Mycobacterium avium
RRGAGGGENP

SEQ ID NO: 72780 - protein, 4 aa, Mycobacterium avium
RRGD

SEQ ID NO: 72781 - protein, 23 aa, Mycobacterium avium
RRGDGVATASENVDQASTREPNL

SEQ ID NO: 72782 - protein, 6 aa, Mycobacterium avium
RRGEVG

SEQ ID NO: 72783 - protein, 4 aa, Mycobacterium avium
RRGF

SEQ ID NO: 72784 - protein, 9 aa, Mycobacterium avium
RRGGPGGDG

SEQ ID NO: 72785 - protein, 9 aa, Mycobacterium avium
RRGGPGRAA

SEQ ID NO: 72786 - protein, 9 aa, Mycobacterium avium
RRGGPRGDG

SEQ ID NO: 72787 - protein, 7 aa, Mycobacterium avium
RRGGQGI

SEQ ID NO: 72788 - protein, 43 aa, Mycobacterium avium
RRGGRGARPGVVGRGGHRPVAGQRPGDEPAAGRAGRAGEGHAR

SEQ ID NO: 72789 - protein, 19 aa, Mycobacterium avium
RRGGSGRGVRVGQSRDHRV

SEQ ID NO: 72790 - protein, 5 aa, Mycobacterium avium
RRGKA

SEQ ID NO: 72791 - protein, 9 aa, Mycobacterium avium
RRGNGRESI

SEQ ID NO: 72792 - protein, 8 aa, Mycobacterium avium
RRGREVPE

SEQ ID NO: 72793 - protein, 7 aa, Mycobacterium avium
RRGRGTP

SEQ ID NO: 72794 - protein, 7 aa, Mycobacterium avium
RRGRLGN

SEQ ID NO: 72795 - protein, 32 aa, Mycobacterium avium
RRGRPARAAGLDGPDRGAGCRAPVDDQPGRPG

SEQ ID NO: 72796 - protein, 43 aa, Mycobacterium avium
RRGRRRGRGAATSSEKQTNGQLTGDSTATKPRRSRAARRAPDR

SEQ ID NO: 72797 - protein, 23 aa, Mycobacterium avium
RRGRTAYASDPGMTATDITRDGS

SEQ ID NO: 72798 - protein, 25 aa, Mycobacterium avium
RRGSDARITGDGGPPGAPPTPPPTI

SEQ ID NO: 72799 - protein, 13 aa, Mycobacterium avium
RRGSGRIGPPMPG

SEQ ID NO: 72800 - protein, 8 aa, Mycobacterium avium
RRGSPRPL

SEQ ID NO: 72801 - protein, 7 aa, Mycobacterium avium
RRGTADL

SEQ ID NO: 72802 - protein, 13 aa, Mycobacterium avium
RRHAGHRSTGPGM

SEQ ID NO: 72803 - protein, 7 aa, Mycobacterium avium
RRHGGPA

SEQ ID NO: 72804 - protein, 13 aa, Mycobacterium avium
RRHRAAAKQLGRG

SEQ ID NO: 72805 - protein, 17 aa, Mycobacterium avium
RRHRPGGIGGHGEQHPL

SEQ ID NO: 72806 - protein, 14 aa, Mycobacterium avium
RRHRRRAWGECLNS

SEQ ID NO: 72807 - protein, 13 aa, Mycobacterium avium
RRHSAQPQNPPSY

SEQ ID NO: 72808 - protein, 14 aa, Mycobacterium avium
RRHSPAAGQRANHQ

SEQ ID NO: 72809 - protein, 4 aa, Mycobacterium avium
RRIR

SEQ ID NO: 72810 - protein, 8 aa, Mycobacterium avium
RRITETPI

SEQ ID NO: 72811 - protein, 8 aa, Mycobacterium avium
RRKSPKDD

SEQ ID NO: 72812 - protein, 5 aa, Mycobacterium avium
RRKTC

SEQ ID NO: 72813 - protein, 12 aa, Mycobacterium avium
RRLDDAQPWADG

SEQ ID NO: 72814 - protein, 8 aa, Mycobacterium avium
RRLGGTPP

SEQ ID NO: 72815 - protein, 7 aa, Mycobacterium avium
RRLPSEA

SEQ ID NO: 72816 - protein, 5 aa, Mycobacterium avium
RRLSA

SEQ ID NO: 72817 - protein, 8 aa, Mycobacterium avium
RRLSTYSG

SEQ ID NO: 72818 - protein, 8 aa, Mycobacterium avium
RRNAEKGC

SEQ ID NO: 72819 - protein, 8 aa, Mycobacterium avium
RRNGDERF

SEQ ID NO: 72820 - protein, 11 aa, Mycobacterium avium
RRNGRPSERAL

SEQ ID NO: 72821 - protein, 10 aa, Mycobacterium avium
RRNHEANRET

SEQ ID NO: 72822 - protein, 7 aa, Mycobacterium avium
RRNHGRS

SEQ ID NO: 72823 - protein, 8 aa, Mycobacterium avium
RRNHGRSR

SEQ ID NO: 72824 - protein, 16 aa, Mycobacterium avium
RRPAAGPTNQPGGRPA

SEQ ID NO: 72825 - protein, 16 aa, Mycobacterium avium
RRPAAGSANQPGGRPA

SEQ ID NO: 72826 - protein, 8 aa, Mycobacterium avium
RRPAAQAS

SEQ ID NO: 72827 - protein, 8 aa, Mycobacterium avium
RRPAGDHL

SEQ ID NO: 72828 - protein, 19 aa, Mycobacterium avium
RRPAGRRARRRGRDGRRHA

SEQ ID NO: 72829 - protein, 7 aa, Mycobacterium avium
RRPATGN

SEQ ID NO: 72830 - protein, 7 aa, Mycobacterium avium
RRPDAGA

SEQ ID NO: 72831 - protein, 14 aa, Mycobacterium avium
RRPDGLPDDQPDPW

SEQ ID NO: 72832 - protein, 8 aa, Mycobacterium avium
RRPDLDPD

SEQ ID NO: 72833 - protein, 16 aa, Mycobacterium avium
RRPDPLRATAKEVEAL

SEQ ID NO: 72834 - protein, 11 aa, Mycobacterium avium
RRPDPNDKRRQ

SEQ ID NO: 72835 - protein, 13 aa, Mycobacterium avium
RRPDRSADRRPPE

SEQ ID NO: 72836 - protein, 4 aa, Mycobacterium avium
RRPE

SEQ ID NO: 72837 - protein, 6 aa, Mycobacterium avium
RRPEES

SEQ ID NO: 72838 - protein, 67 aa, Mycobacterium avium
RRPGDAAEQPAPARPAAGGDPAPAGPAAAGRQRRPAPANPAPEAPPAAPPPPPPPAPEAPPGGPPPA

SEQ ID NO: 72839 - protein, 13 aa, Mycobacterium avium
RRPGDFSSGQGTQ

SEQ ID NO: 72840 - protein, 15 aa, Mycobacterium avium
RRPGFPGAEEQAPVT

SEQ ID NO: 72841 - protein, 10 aa, Mycobacterium avium
RRPGGEEIYQ

SEQ ID NO: 72842 - protein, 9 aa, Mycobacterium avium
RRPGQANDN

SEQ ID NO: 72843 - protein, 6 aa, Mycobacterium avium
RRPGRH

SEQ ID NO: 72844 - protein, 5 aa, Mycobacterium avium
RRPLR

SEQ ID NO: 72845 - protein, 16 aa, Mycobacterium avium
RRPNSRESLRADPPCA

SEQ ID NO: 72846 - protein, 8 aa, Mycobacterium avium
RRPNTDDL

SEQ ID NO: 72847 - protein, 6 aa, Mycobacterium avium
RRPPHD

SEQ ID NO: 72848 - protein, 31 aa, Mycobacterium avium
RRPPVRDGGCTRRADRTGCDRGRATGRTMSP

SEQ ID NO: 72849 - protein, 15 aa, Mycobacterium avium
RRPQEPPNANSCNEI

SEQ ID NO: 72850 - protein, 7 aa, Mycobacterium avium
RRPQRRT

SEQ ID NO: 72851 - protein, 6 aa, Mycobacterium avium
RRPREL

SEQ ID NO: 72852 - protein, 7 aa, Mycobacterium avium
RRPRLGV

SEQ ID NO: 72853 - protein, 14 aa, Mycobacterium avium
RRPRLGVDTDERTI

SEQ ID NO: 72854 - protein, 12 aa, Mycobacterium avium
RRPRRDRTVPAD

SEQ ID NO: 72855 - protein, 25 aa, Mycobacterium avium
RRPSVDGTDTEPTTRIDTGRPTSWS

SEQ ID NO: 72856 - protein, 19 aa, Mycobacterium avium
RRPTGTDSRTHPSTDQISE

SEQ ID NO: 72857 - protein, 27 aa, Mycobacterium avium
RRPVAPAGQGGGRPTELTPPPCTGPGV

SEQ ID NO: 72858 - protein, 16 aa, Mycobacterium avium
RRPVGAAPVAPPGIGR

SEQ ID NO: 72859 - protein, 13 aa, Mycobacterium avium
RRPVRAPARGDDR

SEQ ID NO: 72860 - protein, 15 aa, Mycobacterium avium
RRPVRGPPAAPAGIR

SEQ ID NO: 72861 - protein, 5 aa, Mycobacterium avium
RRPVV

SEQ ID NO: 72862 - protein, 19 aa, Mycobacterium avium
RRQAATAAAARLAETATAA

SEQ ID NO: 72863 - protein, 8 aa, Mycobacterium avium
RRQDPQDD

SEQ ID NO: 72864 - protein, 13 aa, Mycobacterium avium
RRQGRDRRRGLRQ

SEQ ID NO: 72865 - protein, 8 aa, Mycobacterium avium
RRQLGEEG

SEQ ID NO: 72866 - protein, 9 aa, Mycobacterium avium
RRQPGDVPA

SEQ ID NO: 72867 - protein, 10 aa, Mycobacterium avium
RRQPGDVPTL

SEQ ID NO: 72868 - protein, 32 aa, Mycobacterium avium
RRQTDRHAQAGDGLGNPGNSFQPIRGAGYTNG

SEQ ID NO: 72869 - protein, 22 aa, Mycobacterium avium
RRRAGRRRAGGAGRDCAGAPSF

SEQ ID NO: 72870 - protein, 5 aa, Mycobacterium avium
RRRAT

SEQ ID NO: 72871 - protein, 13 aa, Mycobacterium avium
RRRDAGLPYSRNA

SEQ ID NO: 72872 - protein, 6 aa, Mycobacterium avium
RRRDDI

SEQ ID NO: 72873 - protein, 12 aa, Mycobacterium avium
RRRDGELEPSAE

SEQ ID NO: 72874 - protein, 11 aa, Mycobacterium avium
RRRDSHGEPMA

SEQ ID NO: 72875 - protein, 6 aa, Mycobacterium avium
RRREDE

SEQ ID NO: 72876 - protein, 4 aa, Mycobacterium avium
RRRG

SEQ ID NO: 72877 - protein, 31 aa, Mycobacterium avium
RRRGGGLSRRGAAEQQRADHGPSRRDTRDDT

SEQ ID NO: 72878 - protein, 9 aa, Mycobacterium avium
RRRGGQTTI

SEQ ID NO: 72879 - protein, 8 aa, Mycobacterium avium
RRRGRPGR

SEQ ID NO: 72880 - protein, 43 aa, Mycobacterium avium
RRRGRWRGSRASPNRWAGRASPAGSPASPPGAPTAGCRSTRRS

SEQ ID NO: 72881 - protein, 5 aa, Mycobacterium avium
RRRIR

SEQ ID NO: 72882 - protein, 10 aa, Mycobacterium avium
RRRLEGDGIS

SEQ ID NO: 72883 - protein, 36 aa, Mycobacterium avium
RRRPDGPAGDRRRTGRELAPGLPGGTRATATGRRRP

SEQ ID NO: 72884 - protein, 9 aa, Mycobacterium avium
RRRPESGHV

SEQ ID NO: 72885 - protein, 20 aa, Mycobacterium avium
RRRPGEWTPPAERAARRQAE

SEQ ID NO: 72886 - protein, 22 aa, Mycobacterium avium
RRRPGPVGVQPRAGRGVDGDRV

SEQ ID NO: 72887 - protein, 60 aa, Mycobacterium avium
RRRPGRTARRAQPRRVGDRHRRGPAQQPPGPGRRGGTAPRPPLQPGPPAGLGRPRGARAG

SEQ ID NO: 72888 - protein, 10 aa, Mycobacterium avium
RRRPLDPARA

SEQ ID NO: 72889 - protein, 14 aa, Mycobacterium avium
RRRPRPWTSAPRCP

SEQ ID NO: 72890 - protein, 12 aa, Mycobacterium avium
RRRPRRPSRGRR

SEQ ID NO: 72891 - protein, 55 aa, Mycobacterium avium
RRRPRSRRPARRPGPRPRPRPARPQRRHRRRPHPPAPGIGPAAAHAAGGRHRGHR

SEQ ID NO: 72892 - protein, 4 aa, Mycobacterium avium
RRRQ

SEQ ID NO: 72893 - protein, 8 aa, Mycobacterium avium
RRRQPRED

SEQ ID NO: 72894 - protein, 10 aa, Mycobacterium avium
RRRQPSGTPV

SEQ ID NO: 72895 - protein, 11 aa, Mycobacterium avium
RRRQRIRTGNA

SEQ ID NO: 72896 - protein, 25 aa, Mycobacterium avium
RRRRAARPPLGRVPPAHPSAPGHAR

SEQ ID NO: 72897 - protein, 25 aa, Mycobacterium avium
RRRRAARSPLGRVPPAHPSAPGHAR

SEQ ID NO: 72898 - protein, 12 aa, Mycobacterium avium
RRRRDVSNRTVG

SEQ ID NO: 72899 - protein, 18 aa, Mycobacterium avium
RRRRGDAAERQGECRRDE

SEQ ID NO: 72900 - protein, 26 aa, Mycobacterium avium
RRRRGTGQVQRQPGRDEVDPDPVGRL

SEQ ID NO: 72901 - protein, 11 aa, Mycobacterium avium
RRRRPGNRTRI

SEQ ID NO: 72902 - protein, 10 aa, Mycobacterium avium
RRRRPPAVSR

SEQ ID NO: 72903 - protein, 30 aa, Mycobacterium avium
RRRRPRAAPASFPSPRREHRGSAAEPAAGR

SEQ ID NO: 72904 - protein, 30 aa, Mycobacterium avium
RRRRQELSAGVGATRETVATAQRRAEESRR

SEQ ID NO: 72905 - protein, 30 aa, Mycobacterium avium
RRRRQELSAGVGATRETVATARRRAEESRR

SEQ ID NO: 72906 - protein, 12 aa, Mycobacterium avium
RRRRRPDRQRPG

SEQ ID NO: 72907 - protein, 19 aa, Mycobacterium avium
RRRRRRGLAQHGDALADQQ

SEQ ID NO: 72908 - protein, 10 aa, Mycobacterium avium
RRRRSRAGTI

SEQ ID NO: 72909 - protein, 9 aa, Mycobacterium avium
RRRSERSRT

SEQ ID NO: 72910 - protein, 7 aa, Mycobacterium avium
RRRSRPD

SEQ ID NO: 72911 - protein, 8 aa, Mycobacterium avium
RRRSSGAV

SEQ ID NO: 72912 - protein, 6 aa, Mycobacterium avium
RRRSTG

SEQ ID NO: 72913 - protein, 19 aa, Mycobacterium avium
RRRSTPRRCRRTDRPVRAR

SEQ ID NO: 72914 - protein, 4 aa, Mycobacterium avium
RRRT

SEQ ID NO: 72915 - protein, 6 aa, Mycobacterium avium
RRRTAR

SEQ ID NO: 72916 - protein, 9 aa, Mycobacterium avium
RRRTPPAEL

SEQ ID NO: 72917 - protein, 13 aa, Mycobacterium avium
RRSAEGGGWEPVQ

SEQ ID NO: 72918 - protein, 11 aa, Mycobacterium avium
RRSEPVTPAPV

SEQ ID NO: 72919 - protein, 14 aa, Mycobacterium avium
RRSEQPDDQPDVTP

SEQ ID NO: 72920 - protein, 10 aa, Mycobacterium avium
RRSGEVSGQD

SEQ ID NO: 72921 - protein, 6 aa, Mycobacterium avium
RRSGGL

SEQ ID NO: 72922 - protein, 16 aa, Mycobacterium avium
RRSGYGAAATRVLSQL

SEQ ID NO: 72923 - protein, 18 aa, Mycobacterium avium
RRSIDGLPALDSDHPGPP

SEQ ID NO: 72924 - protein, 7 aa, Mycobacterium avium
RRSMTGG

SEQ ID NO: 72925 - protein, 9 aa, Mycobacterium avium
RRSNPESGR

SEQ ID NO: 72926 - protein, 43 aa, Mycobacterium avium
RRSPGRSSNHAPRVRPTGRCRGSAARGPSNAGRRRIPRRPSIP

SEQ ID NO: 72927 - protein, 16 aa, Mycobacterium avium
RRSPVDGDGGVVSGPP

SEQ ID NO: 72928 - protein, 13 aa, Mycobacterium avium
RRSSELSRRGRDL

SEQ ID NO: 72929 - protein, 7 aa, Mycobacterium avium
RRSTHEA

SEQ ID NO: 72930 - protein, 50 aa, Mycobacterium avium
RRSVGAAAASRARAAGAREPDTAQPDAGQPVGRQSQAGRAGVRPAGARRR

SEQ ID NO: 72931 - protein, 13 aa, Mycobacterium avium
RRTAAAALTGDGG

SEQ ID NO: 72932 - protein, 9 aa, Mycobacterium avium
RRTADDDIA

SEQ ID NO: 72933 - protein, 8 aa, Mycobacterium avium
RRTEPKDD

SEQ ID NO: 72934 - protein, 13 aa, Mycobacterium avium
RRTFDETDWSRNT

SEQ ID NO: 72935 - protein, 8 aa, Mycobacterium avium
RRTGEKHR

SEQ ID NO: 72936 - protein, 8 aa, Mycobacterium avium
RRTHGGEE

SEQ ID NO: 72937 - protein, 12 aa, Mycobacterium avium
RRTPASPIRRPG

SEQ ID NO: 72938 - protein, 8 aa, Mycobacterium avium
RRTPPRRQ

SEQ ID NO: 72939 - protein, 18 aa, Mycobacterium avium
RRTRAGDAHAAGRRPRGV

SEQ ID NO: 72940 - protein, 4 aa, Mycobacterium avium
RRTV

SEQ ID NO: 72941 - protein, 13 aa, Mycobacterium avium
RRTVAQAENSLQN

SEQ ID NO: 72942 - protein, 32 aa, Mycobacterium avium
RRVPAPEREPAPPTAPRPGGMPPWDSTPVTGI

SEQ ID NO: 72943 - protein, 5 aa, Mycobacterium avium
RRVQR

SEQ ID NO: 72944 - protein, 6 aa, Mycobacterium avium
RRVQRS

SEQ ID NO: 72945 - protein, 12 aa, Mycobacterium avium
RRVSGQRAGRAV

SEQ ID NO: 72946 - protein, 6 aa, Mycobacterium avium
RRVSKK

SEQ ID NO: 72947 - protein, 4 aa, Mycobacterium avium
RRWT

SEQ ID NO: 72948 - protein, 12 aa, Mycobacterium avium
RRYANTPRGARL

SEQ ID NO: 72949 - protein, 5 aa, Mycobacterium avium
RRYAS

SEQ ID NO: 72950 - protein, 8 aa, Mycobacterium avium
RRYDGDER

SEQ ID NO: 72951 - protein, 4 aa, Mycobacterium avium
RRYG

SEQ ID NO: 72952 - protein, 6 aa, Mycobacterium avium
RRYPDK

SEQ ID NO: 72953 - protein, 6 aa, Mycobacterium avium
RRYPQK

SEQ ID NO: 72954 - protein, 11 aa, Mycobacterium avium
RRYTGHSSRGA

SEQ ID NO: 72955 - protein, 10 aa, Mycobacterium avium
RSAADGAPEL

SEQ ID NO: 72956 - protein, 9 aa, Mycobacterium avium
RSAAEQSSV

SEQ ID NO: 72957 - protein, 7 aa, Mycobacterium avium
RSAAETL

SEQ ID NO: 72958 - protein, 26 aa, Mycobacterium avium
RSAAGRGLGGHEVGTGGGPGRRGGPQ

SEQ ID NO: 72959 - protein, 8 aa, Mycobacterium avium
RSAAPEIS

SEQ ID NO: 72960 - protein, 9 aa, Mycobacterium avium
RSAARDAHS

SEQ ID NO: 72961 - protein, 24 aa, Mycobacterium avium
RSAARSGRSSGRRPRRRARSPAAR

SEQ ID NO: 72962 - protein, 10 aa, Mycobacterium avium
RSAASDAERT

SEQ ID NO: 72963 - protein, 5 aa, Mycobacterium avium
RSAAT

SEQ ID NO: 72964 - protein, 13 aa, Mycobacterium avium
RSAATRDARDGDA

SEQ ID NO: 72965 - protein, 11 aa, Mycobacterium avium
RSAEQQADGDI

SEQ ID NO: 72966 - protein, 9 aa, Mycobacterium avium
RSAGAGLTG

SEQ ID NO: 72967 - protein, 16 aa, Mycobacterium avium
RSAGARFGDRPPPGRA

SEQ ID NO: 72968 - protein, 6 aa, Mycobacterium avium
RSAGGA

SEQ ID NO: 72969 - protein, 13 aa, Mycobacterium avium
RSAGGNSENQGEN

SEQ ID NO: 72970 - protein, 6 aa, Mycobacterium avium
RSAGSG

SEQ ID NO: 72971 - protein, 12 aa, Mycobacterium avium
RSAHSTVDREDA

SEQ ID NO: 72972 - protein, 11 aa, Mycobacterium avium
RSALNPRPDRE

SEQ ID NO: 72973 - protein, 8 aa, Mycobacterium avium
RSALQDGA

SEQ ID NO: 72974 - protein, 8 aa, Mycobacterium avium
RSAPEDFP

SEQ ID NO: 72975 - protein, 4 aa, Mycobacterium avium
RSAS

SEQ ID NO: 72976 - protein, 7 aa, Mycobacterium avium
RSASQAA

SEQ ID NO: 72977 - protein, 8 aa, Mycobacterium avium
RSASQAAL

SEQ ID NO: 72978 - protein, 18 aa, Mycobacterium avium
RSCTQCSPHTGVSLPIEL

SEQ ID NO: 72979 - protein, 16 aa, Mycobacterium avium
RSDADQGTGGINGRQA

SEQ ID NO: 72980 - protein, 22 aa, Mycobacterium avium
RSDAGRRAGGVPTLPPSAPFDS

SEQ ID NO: 72981 - protein, 11 aa, Mycobacterium avium
RSDDASPQEAL

SEQ ID NO: 72982 - protein, 10 aa, Mycobacterium avium
RSDEADVDKA

SEQ ID NO: 72983 - protein, 12 aa, Mycobacterium avium
RSDRAPAPDLNA

SEQ ID NO: 72984 - protein, 15 aa, Mycobacterium avium
RSDTGGTTVHLSARI

SEQ ID NO: 72985 - protein, 14 aa, Mycobacterium avium
RSDVEPVEDPAQSW

SEQ ID NO: 72986 - protein, 12 aa, Mycobacterium avium
RSEASAATISGL

SEQ ID NO: 72987 - protein, 7 aa, Mycobacterium avium
RSEEERE

SEQ ID NO: 72988 - protein, 18 aa, Mycobacterium avium
RSEMPTTSQGSFDFEEDT

SEQ ID NO: 72989 - protein, 6 aa, Mycobacterium avium
RSEQRY

SEQ ID NO: 72990 - protein, 14 aa, Mycobacterium avium
RSERPVAPATEAAV

SEQ ID NO: 72991 - protein, 14 aa, Mycobacterium avium
RSFSRRRASGQTRH

SEQ ID NO: 72992 - protein, 9 aa, Mycobacterium avium
RSGAGPGAL

SEQ ID NO: 72993 - protein, 8 aa, Mycobacterium avium
RSGAPPGV

SEQ ID NO: 72994 - protein, 12 aa, Mycobacterium avium
RSGCTGSARGDH

SEQ ID NO: 72995 - protein, 12 aa, Mycobacterium avium
RSGDPAQTPGTR

SEQ ID NO: 72996 - protein, 6 aa, Mycobacterium avium
RSGELD

SEQ ID NO: 72997 - protein, 19 aa, Mycobacterium avium
RSGGGGGLTPSDIAPARLT

SEQ ID NO: 72998 - protein, 18 aa, Mycobacterium avium
RSGGGGLTPSDIAPARLT

SEQ ID NO: 72999 - protein, 10 aa, Mycobacterium avium
RSGGPQSTTM

SEQ ID NO: 73000 - protein, 9 aa, Mycobacterium avium
RSGGRGPAE

SEQ ID NO: 73001 - protein, 8 aa, Mycobacterium avium
RSGKSSAV

SEQ ID NO: 73002 - protein, 4 aa, Mycobacterium avium
RSGL

SEQ ID NO: 73003 - protein, 7 aa, Mycobacterium avium
RSGLDAA

SEQ ID NO: 73004 - protein, 4 aa, Mycobacterium avium
RSGN

SEQ ID NO: 73005 - protein, 9 aa, Mycobacterium avium
RSGNPSADV

SEQ ID NO: 73006 - protein, 5 aa, Mycobacterium avium
RSGPE

SEQ ID NO: 73007 - protein, 10 aa, Mycobacterium avium
RSGPTGATPK

SEQ ID NO: 73008 - protein, 7 aa, Mycobacterium avium
RSGRGLR

SEQ ID NO: 73009 - protein, 8 aa, Mycobacterium avium
RSGRGTTA

SEQ ID NO: 73010 - protein, 8 aa, Mycobacterium avium
RSGRGVRD

SEQ ID NO: 73011 - protein, 13 aa, Mycobacterium avium
RSGRRAAAEVTAL

SEQ ID NO: 73012 - protein, 14 aa, Mycobacterium avium
RSGRSVDADAATSL

SEQ ID NO: 73013 - protein, 10 aa, Mycobacterium avium
RSGSTTISTG

SEQ ID NO: 73014 - protein, 6 aa, Mycobacterium avium
RSGTLA

SEQ ID NO: 73015 - protein, 10 aa, Mycobacterium avium
RSGVQTADGA

SEQ ID NO: 73016 - protein, 12 aa, Mycobacterium avium
RSGVQTADGAHH

SEQ ID NO: 73017 - protein, 6 aa, Mycobacterium avium
RSHPDV

SEQ ID NO: 73018 - protein, 6 aa, Mycobacterium avium
RSHPGV

SEQ ID NO: 73019 - protein, 12 aa, Mycobacterium avium
RSHRRTAAALGE

SEQ ID NO: 73020 - protein, 23 aa, Mycobacterium avium
RSIPQGAQDSMPPTLYVSAQRRA

SEQ ID NO: 73021 - protein, 23 aa, Mycobacterium avium
RSIPQGAQDSMPPTLYVSARRRA

SEQ ID NO: 73022 - protein, 9 aa, Mycobacterium avium
RSKAAGETT

SEQ ID NO: 73023 - protein, 12 aa, Mycobacterium avium
RSKGPAAARNTG

SEQ ID NO: 73024 - protein, 11 aa, Mycobacterium avium
RSKPRSPEGLK

SEQ ID NO: 73025 - protein, 7 aa, Mycobacterium avium
RSKTGTE

SEQ ID NO: 73026 - protein, 11 aa, Mycobacterium avium
RSLAARAESHP

SEQ ID NO: 73027 - protein, 25 aa, Mycobacterium avium
RSLGPRGEAVEDQRGIGRPAQHPHQ

SEQ ID NO: 73028 - protein, 14 aa, Mycobacterium avium
RSLSGSNIGGIAET

SEQ ID NO: 73029 - protein, 6 aa, Mycobacterium avium
RSMTPR

SEQ ID NO: 73030 - protein, 10 aa, Mycobacterium avium
RSNPNPYGKA

SEQ ID NO: 73031 - protein, 6 aa, Mycobacterium avium
RSPADY

SEQ ID NO: 73032 - protein, 32 aa, Mycobacterium avium; identical to SEQ ID NO: 6502

SEQ ID NO: 73033 - protein, 15 aa, Mycobacterium avium
RSPDAAKKLASRARD

SEQ ID NO: 73034 - protein, 21 aa, Mycobacterium avium
RSPDQRRSRRRSGETHGRHRA

SEQ ID NO: 73035 - protein, 24 aa, Mycobacterium avium
RSPGARGVGQFGGAGAAQDRETLV

SEQ ID NO: 73036 - protein, 14 aa, Mycobacterium avium
RSPNRHRAFGGGPH

SEQ ID NO: 73037 - protein, 14 aa, Mycobacterium avium
RSPSTDSSPPIRTT

SEQ ID NO: 73038 - protein, 8 aa, Mycobacterium avium
RSQAERSL

SEQ ID NO: 73039 - protein, 8 aa, Mycobacterium avium
RSQDELAT

SEQ ID NO: 73040 - protein, 6 aa, Mycobacterium avium
RSQLPS

SEQ ID NO: 73041 - protein, 43 aa, Mycobacterium avium
RSQSKHSAGAGRGGSGARVSRRAEQSAAPAGPAASRPDPRDPT

SEQ ID NO: 73042 - protein, 30 aa, Mycobacterium avium
RSRAHAEVEKERAAADDAGDAEKLRTHGKR

SEQ ID NO: 73043 - protein, 8 aa, Mycobacterium avium
RSRFDDDA

SEQ ID NO: 73044 - protein, 9 aa, Mycobacterium avium
RSRLDAGQA

SEQ ID NO: 73045 - protein, 8 aa, Mycobacterium avium
RSRLNPGA

SEQ ID NO: 73046 - protein, 4 aa, Mycobacterium avium
RSRP

SEQ ID NO: 73047 - protein, 10 aa, Mycobacterium avium
RSRPPAAAHP

SEQ ID NO: 73048 - protein, 23 aa, Mycobacterium avium
RSRPSAPKPTWPASPPMWPAWWC

SEQ ID NO: 73049 - protein, 16 aa, Mycobacterium avium
RSRRATAPLVAAHAGS

SEQ ID NO: 73050 - protein, 9 aa, Mycobacterium avium
RSRSNFPRS

SEQ ID NO: 73051 - protein, 13 aa, Mycobacterium avium
RSRVPGNHRTGSR

SEQ ID NO: 73052 - protein, 10 aa, Mycobacterium avium
RSSADATRGS

SEQ ID NO: 73053 - protein, 23 aa, Mycobacterium avium
RSSDPAQTPGARLRRPGGEEIYQ

SEQ ID NO: 73054 - protein, 11 aa, Mycobacterium avium
RSSDPAQTPGV

SEQ ID NO: 73055 - protein, 10 aa, Mycobacterium avium
RSSGRGPDWG

SEQ ID NO: 73056 - protein, 8 aa, Mycobacterium avium
RSSISTGT

SEQ ID NO: 73057 - protein, 5 aa, Mycobacterium avium
RSSPD

SEQ ID NO: 73058 - protein, 8 aa, Mycobacterium avium
RSSRERPA

SEQ ID NO: 73059 - protein, 7 aa, Mycobacterium avium
RSSSERV

SEQ ID NO: 73060 - protein, 9 aa, Mycobacterium avium
RSSSVDGAE

SEQ ID NO: 73061 - protein, 14 aa, Mycobacterium avium
RSSTREAAQHRDAK

SEQ ID NO: 73062 - protein, 19 aa, Mycobacterium avium
RSTELEGSRSTNATRADQV

SEQ ID NO: 73063 - protein, 12 aa, Mycobacterium avium
RSTFAESADRTR

SEQ ID NO: 73064 - protein, 13 aa, Mycobacterium avium
RSTFAESADRTRR

SEQ ID NO: 73065 - protein, 11 aa, Mycobacterium avium
RSTGKSPTGTT

SEQ ID NO: 73066 - protein, 7 aa, Mycobacterium avium
RSTGQHC

SEQ ID NO: 73067 - protein, 9 aa, Mycobacterium avium
RSTGTPQST

SEQ ID NO: 73068 - protein, 8 aa, Mycobacterium avium
RSTKDGGR

SEQ ID NO: 73069 - protein, 5 aa, Mycobacterium avium
RSTPA

SEQ ID NO: 73070 - protein, 12 aa, Mycobacterium avium
RSTRPATGAERE

SEQ ID NO: 73071 - protein, 10 aa, Mycobacterium avium
RSTRPLRDTG

SEQ ID NO: 73072 - protein, 15 aa, Mycobacterium avium
RSTSSNWADRASPSW

SEQ ID NO: 73073 - protein, 10 aa, Mycobacterium avium
RSTTSQQTRV

SEQ ID NO: 73074 - protein, 9 aa, Mycobacterium avium
RSVAGEKLP

SEQ ID NO: 73075 - protein, 21 aa, Mycobacterium avium
RSVAGEKPPGYYPLGQAPVPI

SEQ ID NO: 73076 - protein, 4 aa, Mycobacterium avium
RSVP

SEQ ID NO: 73077 - protein, 23 aa, Mycobacterium avium
RSVPQGAQDSMPPTLYVSAQRRV

SEQ ID NO: 73078 - protein, 14 aa, Mycobacterium avium
RSYKKQTKAAAKAA

SEQ ID NO: 73079 - protein, 21 aa, Mycobacterium avium
RSYTEGASRWGADDERPPAGE

SEQ ID NO: 73080 - protein, 4 aa, Mycobacterium avium
RTAA

SEQ ID NO: 73081 - protein, 16 aa, Mycobacterium avium
RTAARPVRRHRLPACW

SEQ ID NO: 73082 - protein, 15 aa, Mycobacterium avium
RTACAGGPESAQQPV

SEQ ID NO: 73083 - protein, 5 aa, Mycobacterium avium
RTADG

SEQ ID NO: 73084 - protein, 12 aa, Mycobacterium avium
RTAEDAARAGLT

SEQ ID NO: 73085 - protein, 36 aa, Mycobacterium avium
RTAGQQNTAGQTQQPFASNASSDQYANVGNTQPQAP

SEQ ID NO: 73086 - protein, 6 aa, Mycobacterium avium
RTAQVE

SEQ ID NO: 73087 - protein, 6 aa, Mycobacterium avium
RTARDD

SEQ ID NO: 73088 - protein, 24 aa, Mycobacterium avium
RTARGQRPGGRDHGRGRPHAGGQI

SEQ ID NO: 73089 - protein, 16 aa, Mycobacterium avium
RTATNSFEAQAARDGL

SEQ ID NO: 73090 - protein, 8 aa, Mycobacterium avium
RTDAPSGL

SEQ ID NO: 73091 - protein, 5 aa, Mycobacterium avium
RTDAV

SEQ ID NO: 73092 - protein, 8 aa, Mycobacterium avium
RTDGTTNG

SEQ ID NO: 73093 - protein, 11 aa, Mycobacterium avium
RTDPAAQPGRV

SEQ ID NO: 73094 - protein, 9 aa, Mycobacterium avium
RTDPEAPKH

SEQ ID NO: 73095 - protein, 12 aa, Mycobacterium avium
RTDPGVANPVAP

SEQ ID NO: 73096 - protein, 12 aa, Mycobacterium avium
RTDPGVANPVEP

SEQ ID NO: 73097 - protein, 10 aa, Mycobacterium avium
RTDPKVPTDG

SEQ ID NO: 73098 - protein, 10 aa, Mycobacterium avium
RTDPNGGSGA

SEQ ID NO: 73099 - protein, 11 aa, Mycobacterium avium
RTDPSAPKHSG

SEQ ID NO: 73100 - protein, 7 aa, Mycobacterium avium
RTDPSHP

SEQ ID NO: 73101 - protein, 8 aa, Mycobacterium avium
RTDQKPND

SEQ ID NO: 73102 - protein, 9 aa, Mycobacterium avium
RTDQSGDIG

SEQ ID NO: 73103 - protein, 8 aa, Mycobacterium avium
RTDRGRRS

SEQ ID NO: 73104 - protein, 8 aa, Mycobacterium avium
RTDSGTTE

SEQ ID NO: 73105 - protein, 6 aa, Mycobacterium avium
RTDSPQ

SEQ ID NO: 73106 - protein, 11 aa, Mycobacterium avium
RTDTGAEAGRR

SEQ ID NO: 73107 - protein, 10 aa, Mycobacterium avium
RTDVASVADG

SEQ ID NO: 73108 - protein, 6 aa, Mycobacterium avium
RTEAAA

SEQ ID NO: 73109 - protein, 7 aa, Mycobacterium avium
RTEAAAK

SEQ ID NO: 73110 - protein, 8 aa, Mycobacterium avium
RTEGGTAI

SEQ ID NO: 73111 - protein, 13 aa, Mycobacterium avium
RTEPPVRAAGSAQ

SEQ ID NO: 73112 - protein, 4 aa, Mycobacterium avium
RTER

SEQ ID NO: 73113 - protein, 11 aa, Mycobacterium avium
RTGAADADDPI

SEQ ID NO: 73114 - protein, 10 aa, Mycobacterium avium
RTGAQRGGPR

SEQ ID NO: 73115 - protein, 6 aa, Mycobacterium avium
RTGCGG

SEQ ID NO: 73116 - protein, 14 aa, Mycobacterium avium
RTGDRRMSQLPDAS

SEQ ID NO: 73117 - protein, 5 aa, Mycobacterium avium
RTGDV

SEQ ID NO: 73118 - protein, 8 aa, Mycobacterium avium
RTGEGGQG

SEQ ID NO: 73119 - protein, 8 aa, Mycobacterium avium
RTGEGRHG

SEQ ID NO: 73120 - protein, 8 aa, Mycobacterium avium
RTGEGRNG

SEQ ID NO: 73121 - protein, 6 aa, Mycobacterium avium
RTGGPL

SEQ ID NO: 73122 - protein, 5 aa, Mycobacterium avium
RTGGR

SEQ ID NO: 73123 - protein, 11 aa, Mycobacterium avium
RTGGRGKAGSH

SEQ ID NO: 73124 - protein, 16 aa, Mycobacterium avium
RTGRSHARESSEGPDQ

SEQ ID NO: 73125 - protein, 10 aa, Mycobacterium avium
RTGSAGIDPL

SEQ ID NO: 73126 - protein, 10 aa, Mycobacterium avium
RTGSAGTATA

SEQ ID NO: 73127 - protein, 8 aa, Mycobacterium avium
RTGSSDRG

SEQ ID NO: 73128 - protein, 10 aa, Mycobacterium avium
RTGTADPAAV

SEQ ID NO: 73129 - protein, 6 aa, Mycobacterium avium
RTGTTA

SEQ ID NO: 73130 - protein, 5 aa, Mycobacterium avium
RTGTV

SEQ ID NO: 73131 - protein, 5 aa, Mycobacterium avium
RTGVG

SEQ ID NO: 73132 - protein, 10 aa, Mycobacterium avium
RTGVPGEDWP

SEQ ID NO: 73133 - protein, 19 aa, Mycobacterium avium
RTGYDSQQTEQPVGGDRPH

SEQ ID NO: 73134 - protein, 4 aa, Mycobacterium avium
RTHE

SEQ ID NO: 73135 - protein, 5 aa, Mycobacterium avium
RTHEP

SEQ ID NO: 73136 - protein, 8 aa, Mycobacterium avium
RTHGKDGI

SEQ ID NO: 73137 - protein, 19 aa, Mycobacterium avium
RTHGKSGIRANSVAPGAVE

SEQ ID NO: 73138 - protein, 10 aa, Mycobacterium avium
RTIADTPSGV

SEQ ID NO: 73139 - protein, 5 aa, Mycobacterium avium
RTIDE

SEQ ID NO: 73140 - protein, 4 aa, Mycobacterium avium
RTKD

SEQ ID NO: 73141 - protein, 5 aa, Mycobacterium avium
RTKIA

SEQ ID NO: 73142 - protein, 14 aa, Mycobacterium avium
RTKRDAPGLDTSGL

SEQ ID NO: 73143 - protein, 9 aa, Mycobacterium avium
RTKSGGRGF

SEQ ID NO: 73144 - protein, 5 aa, Mycobacterium avium
RTLPA

SEQ ID NO: 73145 - protein, 19 aa, Mycobacterium avium
RTMGDGSEYTSGPGIAEAQ

SEQ ID NO: 73146 - protein, 10 aa, Mycobacterium avium
RTNAGLNPDA

SEQ ID NO: 73147 - protein, 8 aa, Mycobacterium avium
RTNITGSA

SEQ ID NO: 73148 - protein, 20 aa, Mycobacterium avium
RTNQHDGYGQHTIPQGRSSY

SEQ ID NO: 73149 - protein, 5 aa, Mycobacterium avium
RTPAG

SEQ ID NO: 73150 - protein, 6 aa, Mycobacterium avium
RTPALP

SEQ ID NO: 73151 - protein, 5 aa, Mycobacterium avium
RTPDD

SEQ ID NO: 73152 - protein, 9 aa, Mycobacterium avium
RTPDGLGGG

SEQ ID NO: 73153 - protein, 8 aa, Mycobacterium avium
RTPDGSRA

SEQ ID NO: 73154 - protein, 14 aa, Mycobacterium avium
RTPDTPPGSLGPLP

SEQ ID NO: 73155 - protein, 6 aa, Mycobacterium avium
RTPDYA

SEQ ID NO: 73156 - protein, 19 aa, Mycobacterium avium
RTPEESLDHPQTAHEGRAA

SEQ ID NO: 73157 - protein, 18 aa, Mycobacterium avium
RTPEESLDHPQTVHEGRS

SEQ ID NO: 73158 - protein, 17 aa, Mycobacterium avium
RTPESARKLASRARRRI

SEQ ID NO: 73159 - protein, 16 aa, Mycobacterium avium
RTPGPDQEDGVVAPGG

SEQ ID NO: 73160 - protein, 4 aa, Mycobacterium avium
RTPH

SEQ ID NO: 73161 - protein, 4 aa, Mycobacterium avium
RTPI

SEQ ID NO: 73162 - protein, 7 aa, Mycobacterium avium
RTPPAGA

SEQ ID NO: 73163 - protein, 10 aa, Mycobacterium avium
RTPPYPTATS

SEQ ID NO: 73164 - protein, 5 aa, Mycobacterium avium
RTPRA

SEQ ID NO: 73165 - protein, 7 aa, Mycobacterium avium
RTPRERV

SEQ ID NO: 73166 - protein, 8 aa, Mycobacterium avium
RTPRPNPR

SEQ ID NO: 73167 - protein, 10 aa, Mycobacterium avium
RTPSARAQRD

SEQ ID NO: 73168 - protein, 8 aa, Mycobacterium avium
RTPSEAPL

SEQ ID NO: 73169 - protein, 6 aa, Mycobacterium avium
RTPSEV

SEQ ID NO: 73170 - protein, 11 aa, Mycobacterium avium
RTPTPAPTPPS

SEQ ID NO: 73171 - protein, 8 aa, Mycobacterium avium
RTQAEGGW

SEQ ID NO: 73172 - protein, 11 aa, Mycobacterium avium
RTQGGQQHRQG

SEQ ID NO: 73173 - protein, 5 aa, Mycobacterium avium
RTQSQ

SEQ ID NO: 73174 - protein, 11 aa, Mycobacterium avium
RTRAADDGAGG

SEQ ID NO: 73175 - protein, 17 aa, Mycobacterium avium
RTRAGDAHAAGRRPRGV

SEQ ID NO: 73176 - protein, 6 aa, Mycobacterium avium
RTRDNG

SEQ ID NO: 73177 - protein, 5 aa, Mycobacterium avium
RTREF

SEQ ID NO: 73178 - protein, 6 aa, Mycobacterium avium
RTRGEY

SEQ ID NO: 73179 - protein, 4 aa, Mycobacterium avium
RTRH

SEQ ID NO: 73180 - protein, 18 aa, Mycobacterium avium
RTRRSAQVRSRHRVQCLT

SEQ ID NO: 73181 - protein, 4 aa, Mycobacterium avium
RTRT

SEQ ID NO: 73182 - protein, 9 aa, Mycobacterium avium
RTRTPARHR

SEQ ID NO: 73183 - protein, 7 aa, Mycobacterium avium
RTRTTQE

SEQ ID NO: 73184 - protein, 6 aa, Mycobacterium avium
RTSAKS

SEQ ID NO: 73185 - protein, 14 aa, Mycobacterium avium
RTSDPVRELPDGGT

SEQ ID NO: 73186 - protein, 22 aa, Mycobacterium avium
RTSDPVRELPDGGTLPVTADDT

SEQ ID NO: 73187 - protein, 6 aa, Mycobacterium avium
RTSKRT

SEQ ID NO: 73188 - protein, 10 aa, Mycobacterium avium
RTSPPDPEHR

SEQ ID NO: 73189 - protein, 4 aa, Mycobacterium avium
RTSR

SEQ ID NO: 73190 - protein, 28 aa, Mycobacterium avium
RTSSDSEYVAEPPAPARAGGTQSGRANC

SEQ ID NO: 73191 - protein, 6 aa, Mycobacterium avium
RTSTDD

SEQ ID NO: 73192 - protein, 7 aa, Mycobacterium avium
RTSVGTQ

SEQ ID NO: 73193 - protein, 13 aa, Mycobacterium avium
RTTEAGPGEPGTV

SEQ ID NO: 73194 - protein, 4 aa, Mycobacterium avium
RTTG

SEQ ID NO: 73195 - protein, 9 aa, Mycobacterium avium
RTTGGQRVG

SEQ ID NO: 73196 - protein, 8 aa, Mycobacterium avium
RTTGGSAD

SEQ ID NO: 73197 - protein, 5 aa, Mycobacterium avium
RTTGI

SEQ ID NO: 73198 - protein, 9 aa, Mycobacterium avium
RTTGKPGHL

SEQ ID NO: 73199 - protein, 10 aa, Mycobacterium avium
RTTGRPGTAI

SEQ ID NO: 73200 - protein, 17 aa, Mycobacterium avium
RTTPHPRKARHPGRPMR

SEQ ID NO: 73201 - protein, 6 aa, Mycobacterium avium
RTTPSG

SEQ ID NO: 73202 - protein, 5 aa, Mycobacterium avium
RTTRT

SEQ ID NO: 73203 - protein, 6 aa, Mycobacterium avium
RTTYDR

SEQ ID NO: 73204 - protein, 14 aa, Mycobacterium avium
RTVPGRGAGIVERS

SEQ ID NO: 73205 - protein, 19 aa, Mycobacterium avium
RTVSENAQTLKFDQSGFEE

SEQ ID NO: 73206 - protein, 26 aa, Mycobacterium avium
RTVTTATGDGYRRTSYRELGDQAAQL

SEQ ID NO: 73207 - protein, 25 aa, Mycobacterium avium
RTWAQGNPDAVNREPLDDAGYDASP

SEQ ID NO: 73208 - protein, 15 aa, Mycobacterium avium
RTWPADKKHAPSGAA

SEQ ID NO: 73209 - protein, 14 aa, Mycobacterium avium
RTWQPDSPPITESA

SEQ ID NO: 73210 - protein, 6 aa, Mycobacterium avium
RTWSTA

SEQ ID NO: 73211 - protein, 4 aa, Mycobacterium avium
RTYA

SEQ ID NO: 73212 - protein, 11 aa, Mycobacterium avium
RVAAKGARTIS

SEQ ID NO: 73213 - protein, 6 aa, Mycobacterium avium
RVADPD

SEQ ID NO: 73214 - protein, 13 aa, Mycobacterium avium
RVAEPGSPGSQIA

SEQ ID NO: 73215 - protein, 14 aa, Mycobacterium avium
RVAEPGSPGSQITP

SEQ ID NO: 73216 - protein, 13 aa, Mycobacterium avium
RVAPAGRGLPIPP

SEQ ID NO: 73217 - protein, 31 aa, Mycobacterium avium
RVAPASAESHDRGQPGRRGAGHQPGPDRRQQ

SEQ ID NO: 73218 - protein, 8 aa, Mycobacterium avium
RVAPDGSV

SEQ ID NO: 73219 - protein, 9 aa, Mycobacterium avium
RVARQSGGH

SEQ ID NO: 73220 - protein, 7 aa, Mycobacterium avium
RVAYGAD

SEQ ID NO: 73221 - protein, 14 aa, Mycobacterium avium
RVDASDEDSGITSI

SEQ ID NO: 73222 - protein, 18 aa, Mycobacterium avium
RVDDDGVEAARRQPVGDV

SEQ ID NO: 73223 - protein, 8 aa, Mycobacterium avium
RVDGERGS

SEQ ID NO: 73224 - protein, 6 aa, Mycobacterium avium
RVDGSD

SEQ ID NO: 73225 - protein, 17 aa, Mycobacterium avium
RVDPARPHPFTEAGNSE

SEQ ID NO: 73226 - protein, 6 aa, Mycobacterium avium
RVDTEN

SEQ ID NO: 73227 - protein, 8 aa, Mycobacterium avium
RVEAPASQ

SEQ ID NO: 73228 - protein, 8 aa, Mycobacterium avium
RVEDMDRS

SEQ ID NO: 73229 - protein, 5 aa, Mycobacterium avium
RVEHP

SEQ ID NO: 73230 - protein, 7 aa, Mycobacterium avium
RVEPDGS

SEQ ID NO: 73231 - protein, 6 aa, Mycobacterium avium
RVEPDH

SEQ ID NO: 73232 - protein, 10 aa, Mycobacterium avium
RVERQPAGVA

SEQ ID NO: 73233 - protein, 8 aa, Mycobacterium avium
RVESGVGE

SEQ ID NO: 73234 - protein, 11 aa, Mycobacterium avium
RVGRKAARDRA

SEQ ID NO: 73235 - protein, 10 aa, Mycobacterium avium
RVHAGSQRTM

SEQ ID NO: 73236 - protein, 9 aa, Mycobacterium avium
RVKGPDEDA

SEQ ID NO: 73237 - protein, 8 aa, Mycobacterium avium
RVKPPDTV

SEQ ID NO: 73238 - protein, 8 aa, Mycobacterium avium
RVNGRSPL

SEQ ID NO: 73239 - protein, 8 aa, Mycobacterium avium
RVNGSPVR

SEQ ID NO: 73240 - protein, 12 aa, Mycobacterium avium
RVNSPQRQRPSI

SEQ ID NO: 73241 - protein, 22 aa, Mycobacterium avium
RVPAARAARPPRPAPADSGNPL

SEQ ID NO: 73242 - protein, 22 aa, Mycobacterium avium
RVPEAEPAGEPDVEEVPDDLTP

SEQ ID NO: 73243 - protein, 20 aa, Mycobacterium avium
RVPGGTVQEGHDHCAGEGSP

SEQ ID NO: 73244 - protein, 11 aa, Mycobacterium avium
RVPGQRPDSAL

SEQ ID NO: 73245 - protein, 115 aa, Mycobacterium avium
RVPPTVPAADTPAPSAPAASMSAASGPPMPPTPSLPEPASLPSGPSGDLPAETPPTAGIPHSGEPSAPSSVPPHFPDTPTHGLGDGGAHGPPESDPKNANGHGPHDASLDSGSDH

SEQ ID NO: 73246 - protein, 23 aa, Mycobacterium avium
RVPTPTGSPTTARAASPTSSGWS

SEQ ID NO: 73247 - protein, 4 aa, Mycobacterium avium
RVQA

SEQ ID NO: 73248 - protein, 7 aa, Mycobacterium avium
RVRAQSS

SEQ ID NO: 73249 - protein, 4 aa, Mycobacterium avium
RVRR

SEQ ID NO: 73250 - protein, 13 aa, Mycobacterium avium
RVRRSARKLSPEL

SEQ ID NO: 73251 - protein, 4 aa, Mycobacterium avium
RVRT

SEQ ID NO: 73252 - protein, 13 aa, Mycobacterium avium
RVSEETDAPDPDA

SEQ ID NO: 73253 - protein, 9 aa, Mycobacterium avium
RVSGDTSAA

SEQ ID NO: 73254 - protein, 6 aa, Mycobacterium avium
RVSGTL

SEQ ID NO: 73255 - protein, 7 aa, Mycobacterium avium
RVSPARL

SEQ ID NO: 73256 - protein, 6 aa, Mycobacterium avium
RVSPQD

SEQ ID NO: 73257 - protein, 6 aa, Mycobacterium avium
RVSQAD

SEQ ID NO: 73258 - protein, 6 aa, Mycobacterium avium
RVSSGG

SEQ ID NO: 73259 - protein, 10 aa, Mycobacterium avium
RVSSKKRDDL

SEQ ID NO: 73260 - protein, 4 aa, Mycobacterium avium
RVST

SEQ ID NO: 73261 - protein, 6 aa, Mycobacterium avium
RVSTTL

SEQ ID NO: 73262 - protein, 20 aa, Mycobacterium avium
RVTDPDVEGTGSGDASPAPV

SEQ ID NO: 73263 - protein, 13 aa, Mycobacterium avium
RVTEAASPPAPTV

SEQ ID NO: 73264 - protein, 6 aa, Mycobacterium avium
RVTGSA

SEQ ID NO: 73265 - protein, 4 aa, Mycobacterium avium
RVTL

SEQ ID NO: 73266 - protein, 14 aa, Mycobacterium avium
RVTPPDGAVPSTAE

SEQ ID NO: 73267 - protein, 14 aa, Mycobacterium avium
RVTPPHGAVPSTAE

SEQ ID NO: 73268 - protein, 9 aa, Mycobacterium avium
RVTQRDNGS

SEQ ID NO: 73269 - protein, 15 aa, Mycobacterium avium
RVTRRASDGTRVLIA

SEQ ID NO: 73270 - protein, 4 aa, Mycobacterium avium
RVTT

SEQ ID NO: 73271 - protein, 5 aa, Mycobacterium avium
RWAPA

SEQ ID NO: 73272 - protein, 6 aa, Mycobacterium avium
RWAPPG

SEQ ID NO: 73273 - protein, 11 aa, Mycobacterium avium
RWAPPYAEAGA

SEQ ID NO: 73274 - protein, 7 aa, Mycobacterium avium
RWATPTR

SEQ ID NO: 73275 - protein, 16 aa, Mycobacterium avium
RWGDPDAPLVPAPGDP

SEQ ID NO: 73276 - protein, 7 aa, Mycobacterium avium
RWGEPAQ

SEQ ID NO: 73277 - protein, 5 aa, Mycobacterium avium
RWGTD

SEQ ID NO: 73278 - protein, 12 aa, Mycobacterium avium
RWPTPSARAPGT

SEQ ID NO: 73279 - protein, 10 aa, Mycobacterium avium
RWRSTTPSAG

SEQ ID NO: 73280 - protein, 10 aa, Mycobacterium avium
RWSDGRGDNI

SEQ ID NO: 73281 - protein, 19 aa, Mycobacterium avium
RWSGSPPATKTPSPPRKVT

SEQ ID NO: 73282 - protein, 8 aa, Mycobacterium avium
RYAPAQEL

SEQ ID NO: 73283 - protein, 33 aa, Mycobacterium avium
RYATAQGAADLDAESPEGRSVAEQYDERERAAA

SEQ ID NO: 73284 - protein, 34 aa, Mycobacterium avium
RYATAQGAADLDAESPEGRSVAEQYDERKRAAAR

SEQ ID NO: 73285 - protein, 34 aa, Mycobacterium avium
RYATAQGAADLNAESPEGRSVAEQYDERKRAAAR

SEQ ID NO: 73286 - protein, 11 aa, Mycobacterium avium
RYDAGERADME

SEQ ID NO: 73287 - protein, 5 aa, Mycobacterium avium
RYDEA

SEQ ID NO: 73288 - protein, 8 aa, Mycobacterium avium
RYDHTGDP

SEQ ID NO: 73289 - protein, 9 aa, Mycobacterium avium
RYDPSPDVR

SEQ ID NO: 73290 - protein, 7 aa, Mycobacterium avium
RYEGPDW

SEQ ID NO: 73291 - protein, 6 aa, Mycobacterium avium
RYGDQE

SEQ ID NO: 73292 - protein, 11 aa, Mycobacterium avium
RYGGDDPVAEA

SEQ ID NO: 73293 - protein, 5 aa, Mycobacterium avium
RYGGH

SEQ ID NO: 73294 - protein, 10 aa, Mycobacterium avium
RYGGPAPALS

SEQ ID NO: 73295 - protein, 11 aa, Mycobacterium avium
RYGGPSPSLSL

SEQ ID NO: 73296 - protein, 5 aa, Mycobacterium avium
RYGPL

SEQ ID NO: 73297 - protein, 7 aa, Mycobacterium avium
RYGPRAP

SEQ ID NO: 73298 - protein, 4 aa, Mycobacterium avium
RYHG

SEQ ID NO: 73299 - protein, 9 aa, Mycobacterium avium
RYHGDQAVA

SEQ ID NO: 73300 - protein, 4 aa, Mycobacterium avium
RYKH

SEQ ID NO: 73301 - protein, 9 aa, Mycobacterium avium
RYNEADPED

SEQ ID NO: 73302 - protein, 4 aa, Mycobacterium avium
RYPA

SEQ ID NO: 73303 - protein, 6 aa, Mycobacterium avium
RYPGMA

SEQ ID NO: 73304 - protein, 4 aa, Mycobacterium avium
RYPI

SEQ ID NO: 73305 - protein, 7 aa, Mycobacterium avium
RYPPNEG

SEQ ID NO: 73306 - protein, 6 aa, Mycobacterium avium
RYPQTN

SEQ ID NO: 73307 - protein, 10 aa, Mycobacterium avium
RYRDEPVSDE

SEQ ID NO: 73308 - protein, 15 aa, Mycobacterium avium
RYSGPTRQPPAECRT

SEQ ID NO: 73309 - protein, 22 aa, Mycobacterium avium
RYSGRGNPALTETGRRQADAAA

SEQ ID NO: 73310 - protein, 13 aa, Mycobacterium avium
SAAAALAEDGGVE

SEQ ID NO: 73311 - protein, 7 aa, Mycobacterium avium
SAAAEDD

SEQ ID NO: 73312 - protein, 10 aa, Mycobacterium avium
SAAAKDPATM

SEQ ID NO: 73313 - protein, 13 aa, Mycobacterium avium
SAAALADAGLERA

SEQ ID NO: 73314 - protein, 13 aa, Mycobacterium avium
SAAARNSAQPIND

SEQ ID NO: 73315 - protein, 7 aa, Mycobacterium avium
SAAARTG

SEQ ID NO: 73316 - protein, 5 aa, Mycobacterium avium
SAAAS

SEQ ID NO: 73317 - protein, 9 aa, Mycobacterium avium
SAAASFGSA

SEQ ID NO: 73318 - protein, 7 aa, Mycobacterium avium
SAAASIA

SEQ ID NO: 73319 - protein, 7 aa, Mycobacterium avium
SAAATPL

SEQ ID NO: 73320 - protein, 8 aa, Mycobacterium avium
SAADAAAG

SEQ ID NO: 73321 - protein, 7 aa, Mycobacterium avium
SAADFGR

SEQ ID NO: 73322 - protein, 16 aa, Mycobacterium avium
SAADNSIDATASRDFA

SEQ ID NO: 73323 - protein, 11 aa, Mycobacterium avium
SAADPAVATRD

SEQ ID NO: 73324 - protein, 6 aa, Mycobacterium avium
SAADRR

SEQ ID NO: 73325 - protein, 8 aa, Mycobacterium avium
SAADYGRP

SEQ ID NO: 73326 - protein, 8 aa, Mycobacterium avium
SAAEDPDL

SEQ ID NO: 73327 - protein, 5 aa, Mycobacterium avium
SAAEH

SEQ ID NO: 73328 - protein, 24 aa, Mycobacterium avium
SAAEPGVAGRHASKVGDPAHPTEP

SEQ ID NO: 73329 - protein, 24 aa, Mycobacterium avium
SAAEPGVAGRHSSKVGDPAHPTEP

SEQ ID NO: 73330 - protein, 16 aa, Mycobacterium avium
SAAEPGVAGRHSSNPV

SEQ ID NO: 73331 - protein, 17 aa, Mycobacterium avium
SAAEPGVAGRHSSNPVA

SEQ ID NO: 73332 - protein, 16 aa, Mycobacterium avium
SAAEPRAADRDHVLGA

SEQ ID NO: 73333 - protein, 16 aa, Mycobacterium avium
SAAEPRAAGRDHVLGA

SEQ ID NO: 73334 - protein, 6 aa, Mycobacterium avium
SAAETL

SEQ ID NO: 73335 - protein, 7 aa, Mycobacterium avium
SAAGFGR

SEQ ID NO: 73336 - protein, 7 aa, Mycobacterium avium
SAAGGRV

SEQ ID NO: 73337 - protein, 10 aa, Mycobacterium avium
SAAGSGSQRL

SEQ ID NO: 73338 - protein, 16 aa, Mycobacterium avium
SAAGTEAVPAAALGEG

SEQ ID NO: 73339 - protein, 10 aa, Mycobacterium avium
SAAKLSPAGV

SEQ ID NO: 73340 - protein, 18 aa, Mycobacterium avium
SAAMRAAQSADPPSPELT

SEQ ID NO: 73341 - protein, 8 aa, Mycobacterium avium
SAANPESV

SEQ ID NO: 73342 - protein, 6 aa, Mycobacterium avium
SAAPAG

SEQ ID NO: 73343 - protein, 8 aa, Mycobacterium avium
SAAPAKHS

SEQ ID NO: 73344 - protein, 12 aa, Mycobacterium avium
SAAPGQDGPDGA

SEQ ID NO: 73345 - protein, 10 aa, Mycobacterium avium
SAAPPGQPTW

SEQ ID NO: 73346 - protein, 20 aa, Mycobacterium avium
SAAQPGAAGRHADDLVGAQC

SEQ ID NO: 73347 - protein, 10 aa, Mycobacterium avium
SAAQQRAEDL

SEQ ID NO: 73348 - protein, 4 aa, Mycobacterium avium
SAAR

SEQ ID NO: 73349 - protein, 5 aa, Mycobacterium avium
SAARG

SEQ ID NO: 73350 - protein, 6 aa, Mycobacterium avium
SAARPA

SEQ ID NO: 73351 - protein, 8 aa, Mycobacterium avium
SAARQSRR

SEQ ID NO: 73352 - protein, 8 aa, Mycobacterium avium
SAARQWKR

SEQ ID NO: 73353 - protein, 9 aa, Mycobacterium avium
SAASAGEQC

SEQ ID NO: 73354 - protein, 10 aa, Mycobacterium avium
SAASDHDAAL

SEQ ID NO: 73355 - protein, 8 aa, Mycobacterium avium
SAATPAYG

SEQ ID NO: 73356 - protein, 8 aa, Mycobacterium avium
SAATPQGL

SEQ ID NO: 73357 - protein, 8 aa, Mycobacterium avium
SAAVENAA

SEQ ID NO: 73358 - protein, 7 aa, Mycobacterium avium
SADASVR

SEQ ID NO: 73359 - protein, 15 aa, Mycobacterium avium
SADAVTGAERLPAGT

SEQ ID NO: 73360 - protein, 9 aa, Mycobacterium avium
SADDNDAEI

SEQ ID NO: 73361 - protein, 9 aa, Mycobacterium avium
SADDSETVR

SEQ ID NO: 73362 - protein, 8 aa, Mycobacterium avium
SADEARRI

SEQ ID NO: 73363 - protein, 6 aa, Mycobacterium avium
SADEYE

SEQ ID NO: 73364 - protein, 4 aa, Mycobacterium avium
SADG

SEQ ID NO: 73365 - protein, 18 aa, Mycobacterium avium
SADGEPSPLPADEIAPER

SEQ ID NO: 73366 - protein, 6 aa, Mycobacterium avium
SADGQQ

SEQ ID NO: 73367 - protein, 8 aa, Mycobacterium avium
SADKAKSF

SEQ ID NO: 73368 - protein, 13 aa, Mycobacterium avium
SADLVSGRKDGPL

SEQ ID NO: 73369 - protein, 8 aa, Mycobacterium avium
SADPAAGV

SEQ ID NO: 73370 - protein, 6 aa, Mycobacterium avium
SADPGC

SEQ ID NO: 73371 - protein, 8 aa, Mycobacterium avium
SADPTAIR

SEQ ID NO: 73372 - protein, 5 aa, Mycobacterium avium
SADRE

SEQ ID NO: 73373 - protein, 23 aa, Mycobacterium avium
SADRGGSDREGTSPPTAGQGAPA

SEQ ID NO: 73374 - protein, 8 aa, Mycobacterium avium
SADSTRDL

SEQ ID NO: 73375 - protein, 10 aa, Mycobacterium avium
SADTPTADPQ

SEQ ID NO: 73376 - protein, 8 aa, Mycobacterium avium
SADTTRAL

SEQ ID NO: 73377 - protein, 15 aa, Mycobacterium avium
SADVTGAGDRQPPIF

SEQ ID NO: 73378 - protein, 18 aa, Mycobacterium avium
SADYPDGLRQARAGEAMG

SEQ ID NO: 73379 - protein, 18 aa, Mycobacterium avium
SADYPDGLRQARAGEAMS

SEQ ID NO: 73380 - protein, 18 aa, Mycobacterium avium
SADYPDGLRQARASEAMG

SEQ ID NO: 73381 - protein, 25 aa, Mycobacterium avium
SAECDTHRQAATAAAARLAETATAA

SEQ ID NO: 73382 - protein, 25 aa, Mycobacterium avium
SAECDTRRQAATAAAARLAETATAA

SEQ ID NO: 73383 - protein, 11 aa, Mycobacterium avium
SAEDPSEREFG

SEQ ID NO: 73384 - protein, 11 aa, Mycobacterium avium
SAEFADADADE

SEQ ID NO: 73385 - protein, 6 aa, Mycobacterium avium
SAEFSG

SEQ ID NO: 73386 - protein, 6 aa, Mycobacterium avium
SAEGQQ

SEQ ID NO: 73387 - protein, 9 aa, Mycobacterium avium
SAENLGRDT

SEQ ID NO: 73388 - protein, 9 aa, Mycobacterium avium
SAERERAQG

SEQ ID NO: 73389 - protein, 6 aa, Mycobacterium avium
SAERRQ

SEQ ID NO: 73390 - protein, 4 aa, Mycobacterium avium
SAES

SEQ ID NO: 73391 - protein, 8 aa, Mycobacterium avium
SAETTRAL

SEQ ID NO: 73392 - protein, 5 aa, Mycobacterium avium
SAFGD

SEQ ID NO: 73393 - protein, 6 aa, Mycobacterium avium
SAFPAP

SEQ ID NO: 73394 - protein, 5 aa, Mycobacterium avium
SAFTA

SEQ ID NO: 73395 - protein, 13 aa, Mycobacterium avium
SAGADDVGRAEED

SEQ ID NO: 73396 - protein, 10 aa, Mycobacterium avium
SAGAGRAGAL

SEQ ID NO: 73397 - protein, 7 aa, Mycobacterium avium
SAGAGRV

SEQ ID NO: 73398 - protein, 9 aa, Mycobacterium avium
SAGALTERD

SEQ ID NO: 73399 - protein, 6 aa, Mycobacterium avium
SAGATQ

SEQ ID NO: 73400 - protein, 9 aa, Mycobacterium avium
SAGDMDPEQ

SEQ ID NO: 73401 - protein, 8 aa, Mycobacterium avium
SAGDQHSD

SEQ ID NO: 73402 - protein, 8 aa, Mycobacterium avium
SAGGDDLS

SEQ ID NO: 73403 - protein, 18 aa, Mycobacterium avium
SAGGFPEIKPAESAPPGL

SEQ ID NO: 73404 - protein, 22 aa, Mycobacterium avium
SAGGGGDKHEFTGDRKGHGRRL

SEQ ID NO: 73405 - protein, 12 aa, Mycobacterium avium
SAGGGPATDIGR

SEQ ID NO: 73406 - protein, 6 aa, Mycobacterium avium
SAGGTA

SEQ ID NO: 73407 - protein, 10 aa, Mycobacterium avium
SAGGVEASKG

SEQ ID NO: 73408 - protein, 16 aa, Mycobacterium avium
SAGIGRATAKEFGRRG

SEQ ID NO: 73409 - protein, 18 aa, Mycobacterium avium
SAGKARDAGSGDGQQGRT

SEQ ID NO: 73410 - protein, 11 aa, Mycobacterium avium
SAGLGQANTVG

SEQ ID NO: 73411 - protein, 6 aa, Mycobacterium avium
SAGLGT

SEQ ID NO: 73412 - protein, 5 aa, Mycobacterium avium
SAGND

SEQ ID NO: 73413 - protein, 8 aa, Mycobacterium avium
SAGNHAQG

SEQ ID NO: 73414 - protein, 16 aa, Mycobacterium avium
SAGPIGAQIWTRYLAC

SEQ ID NO: 73415 - protein, 11 aa, Mycobacterium avium
SAGRPDIGGQG

SEQ ID NO: 73416 - protein, 5 aa, Mycobacterium avium
SAGSG

SEQ ID NO: 73417 - protein, 12 aa, Mycobacterium avium
SAGSGSGAPVGL

SEQ ID NO: 73418 - protein, 12 aa, Mycobacterium avium
SAGSTDQFGPEL

SEQ ID NO: 73419 - protein, 7 aa, Mycobacterium avium
SAHGPLS

SEQ ID NO: 73420 - protein, 6 aa, Mycobacterium avium
SAHRRE

SEQ ID NO: 73421 - protein, 13 aa, Mycobacterium avium
SAIHRRDPESARA

SEQ ID NO: 73422 - protein, 9 aa, Mycobacterium avium
SAIPSDGSY

SEQ ID NO: 73423 - protein, 8 aa, Mycobacterium avium
SAIQQTAD

SEQ ID NO: 73424 - protein, 9 aa, Mycobacterium avium
SAKDAYTQA

SEQ ID NO: 73425 - protein, 8 aa, Mycobacterium avium
SAKKNEPE

SEQ ID NO: 73426 - protein, 7 aa, Mycobacterium avium
SAKPIPP

SEQ ID NO: 73427 - protein, 24 aa, Mycobacterium avium
SAKTAGPTKAAKEAGSTKSARRRQ

SEQ ID NO: 73428 - protein, 8 aa, Mycobacterium avium
SAKTTPPR

SEQ ID NO: 73429 - protein, 7 aa, Mycobacterium avium
SALARKP

SEQ ID NO: 73430 - protein, 4 aa, Mycobacterium avium
SALD

SEQ ID NO: 73431 - protein, 7 aa, Mycobacterium avium
SALDDQQ

SEQ ID NO: 73432 - protein, 5 aa, Mycobacterium avium
SALDP

SEQ ID NO: 73433 - protein, 8 aa, Mycobacterium avium
SALDPGTF

SEQ ID NO: 73434 - protein, 14 aa, Mycobacterium avium
SALPDPGDLPAERA

SEQ ID NO: 73435 - protein, 15 aa, Mycobacterium avium
SALPTDTPGSPDDGA

SEQ ID NO: 73436 - protein, 21 aa, Mycobacterium avium
SALRADEQTHRIAPSREPDDG

SEQ ID NO: 73437 - protein, 9 aa, Mycobacterium avium
SALSDRQAQ

SEQ ID NO: 73438 - protein, 6 aa, Mycobacterium avium
SAMPGG

SEQ ID NO: 73439 - protein, 9 aa, Mycobacterium avium
SANDDERTV

SEQ ID NO: 73440 - protein, 8 aa, Mycobacterium avium
SANGGNAQ

SEQ ID NO: 73441 - protein, 9 aa, Mycobacterium avium
SANGTPLRN

SEQ ID NO: 73442 - protein, 12 aa, Mycobacterium avium
SANHDETRWEDA

SEQ ID NO: 73443 - protein, 6 aa, Mycobacterium avium
SANPDV

SEQ ID NO: 73444 - protein, 7 aa, Mycobacterium avium
SANRDER

SEQ ID NO: 73445 - protein, 6 aa, Mycobacterium avium
SANRDN

SEQ ID NO: 73446 - protein, 6 aa, Mycobacterium avium
SAPAAL

SEQ ID NO: 73447 - protein, 6 aa, Mycobacterium avium
SAPALR

SEQ ID NO: 73448 - protein, 7 aa, Mycobacterium avium
SAPAMRT

SEQ ID NO: 73449 - protein, 8 aa, Mycobacterium avium
SAPDPGPM

SEQ ID NO: 73450 - protein, 13 aa, Mycobacterium avium
SAPEEDELTGPPR

SEQ ID NO: 73451 - protein, 14 aa, Mycobacterium avium
SAPENPSRQRISPR

SEQ ID NO: 73452 - protein, 8 aa, Mycobacterium avium
SAPGLARP

SEQ ID NO: 73453 - protein, 9 aa, Mycobacterium avium
SAPGSEKEV

SEQ ID NO: 73454 - protein, 28 aa, Mycobacterium avium
SAPGSRLASNVPDSGFTDPDRLARQRED

SEQ ID NO: 73455 - protein, 6 aa, Mycobacterium avium
SAPHGT

SEQ ID NO: 73456 - protein, 4 aa, Mycobacterium avium
SAPK

SEQ ID NO: 73457 - protein, 9 aa, Mycobacterium avium
SAPLDRTAS

SEQ ID NO: 73458 - protein, 9 aa, Mycobacterium avium
SAPPAAGDV

SEQ ID NO: 73459 - protein, 8 aa, Mycobacterium avium
SAPPGAAA

SEQ ID NO: 73460 - protein, 9 aa, Mycobacterium avium
SAPQPAGTP

SEQ ID NO: 73461 - protein, 16 aa, Mycobacterium avium
SAPQSTVHTTTSTTDN

SEQ ID NO: 73462 - protein, 16 aa, Mycobacterium avium
SAPQSTVRTTTSTTDN

SEQ ID NO: 73463 - protein, 11 aa, Mycobacterium avium
SAPRDPAVGED

SEQ ID NO: 73464 - protein, 16 aa, Mycobacterium avium
SAPSGIIGNGGTTGAL

SEQ ID NO: 73465 - protein, 8 aa, Mycobacterium avium
SAPTTAET

SEQ ID NO: 73466 - protein, 8 aa, Mycobacterium avium
SAPYRADS

SEQ ID NO: 73467 - protein, 13 aa, Mycobacterium avium
SAPYRGPETAGVE

SEQ ID NO: 73468 - protein, 15 aa, Mycobacterium avium
SAQATDELIAAGVTT

SEQ ID NO: 73469 - protein, 10 aa, Mycobacterium avium
SAQGDTPWGD

SEQ ID NO: 73470 - protein, 6 aa, Mycobacterium avium
SAQGKT

SEQ ID NO: 73471 - protein, 22 aa, Mycobacterium avium
SAQPARHGYEPNIGKPPPYSGI

SEQ ID NO: 73472 - protein, 4 aa, Mycobacterium avium
SAQR

SEQ ID NO: 73473 - protein, 7 aa, Mycobacterium avium
SAQVQRD

SEQ ID NO: 73474 - protein, 4 aa, Mycobacterium avium
SARA

SEQ ID NO: 73475 - protein, 13 aa, Mycobacterium avium
SARAAETRSENPL

SEQ ID NO: 73476 - protein, 18 aa, Mycobacterium avium
SARAGTAGKKTSAQPARL

SEQ ID NO: 73477 - protein, 9 aa, Mycobacterium avium
SARASMDPG

SEQ ID NO: 73478 - protein, 13 aa, Mycobacterium avium
SARCASAANSPGA

SEQ ID NO: 73479 - protein, 13 aa, Mycobacterium avium
SARCASTANSPGA

SEQ ID NO: 73480 - protein, 8 aa, Mycobacterium avium
SARGPDDI

SEQ ID NO: 73481 - protein, 4 aa, Mycobacterium avium
SARH

SEQ ID NO: 73482 - protein, 18 aa, Mycobacterium avium
SARIPAESVDRSALPNDV

SEQ ID NO: 73483 - protein, 7 aa, Mycobacterium avium
SARKRGP

SEQ ID NO: 73484 - protein, 29 aa, Mycobacterium avium
SARKTGSGGGPPGADSPTHRTDSGKRGAY

SEQ ID NO: 73485 - protein, 6 aa, Mycobacterium avium
SARLSG

SEQ ID NO: 73486 - protein, 6 aa, Mycobacterium avium
SARRHG

SEQ ID NO: 73487 - protein, 7 aa, Mycobacterium avium
SARSRGP

SEQ ID NO: 73488 - protein, 4 aa, Mycobacterium avium
SARW

SEQ ID NO: 73489 - protein, 7 aa, Mycobacterium avium
SASADTA

SEQ ID NO: 73490 - protein, 41 aa, Mycobacterium avium
SASARRRAAAATGPPAGGAAPPARCTARRRAPGRTPAAGRC

SEQ ID NO: 73491 - protein, 7 aa, Mycobacterium avium
SASDTEA

SEQ ID NO: 73492 - protein, 8 aa, Mycobacterium avium
SASDTESA

SEQ ID NO: 73493 - protein, 8 aa, Mycobacterium avium
SASDTETA

SEQ ID NO: 73494 - protein, 10 aa, Mycobacterium avium
SASERSELES

SEQ ID NO: 73495 - protein, 7 aa, Mycobacterium avium
SASGTAR

SEQ ID NO: 73496 - protein, 5 aa, Mycobacterium avium
SASGV

SEQ ID NO: 73497 - protein, 4 aa, Mycobacterium avium
SASI

SEQ ID NO: 73498 - protein, 5 aa, Mycobacterium avium
SASKA

SEQ ID NO: 73499 - protein, 6 aa, Mycobacterium avium
SASPAW

SEQ ID NO: 73500 - protein, 19 aa, Mycobacterium avium
SASRGQAPLTAAPTIGSLG

SEQ ID NO: 73501 - protein, 5 aa, Mycobacterium avium
SASRI

SEQ ID NO: 73502 - protein, 9 aa, Mycobacterium avium
SASSAAAAQ

SEQ ID NO: 73503 - protein, 11 aa, Mycobacterium avium
SASSAAAAQFS

SEQ ID NO: 73504 - protein, 9 aa, Mycobacterium avium
SASSTVEAP

SEQ ID NO: 73505 - protein, 8 aa, Mycobacterium avium
SASSYTAE

SEQ ID NO: 73506 - protein, 5 aa, Mycobacterium avium
SASTD

SEQ ID NO: 73507 - protein, 5 aa, Mycobacterium avium
SASVE

SEQ ID NO: 73508 - protein, 6 aa, Mycobacterium avium
SATAGM

SEQ ID NO: 73509 - protein, 26 aa, Mycobacterium avium
SATAQPAAQAAGNAASTTTASTQLTT

SEQ ID NO: 73510 - protein, 5 aa, Mycobacterium avium
SATAT

SEQ ID NO: 73511 - protein, 6 aa, Mycobacterium avium
SATATA

SEQ ID NO: 73512 - protein, 7 aa, Mycobacterium avium
SATERLA

SEQ ID NO: 73513 - protein, 23 aa, Mycobacterium avium
SATGFKADNPSARTTETFSIRVT

SEQ ID NO: 73514 - protein, 6 aa, Mycobacterium avium
SATGRE

SEQ ID NO: 73515 - protein, 5 aa, Mycobacterium avium
SATHE

SEQ ID NO: 73516 - protein, 7 aa, Mycobacterium avium
SATRAKL

SEQ ID NO: 73517 - protein, 24 aa, Mycobacterium avium
SATRPAAHQQRARGGGDRKAADGK

SEQ ID NO: 73518 - protein, 21 aa, Mycobacterium avium
SATSCTTSARRCPATRPMCAN

SEQ ID NO: 73519 - protein, 17 aa, Mycobacterium avium
SATSGGGVSAVDPGERR

SEQ ID NO: 73520 - protein, 9 aa, Mycobacterium avium
SATSPSETV

SEQ ID NO: 73521 - protein, 4 aa, Mycobacterium avium
SATT

SEQ ID NO: 73522 - protein, 16 aa, Mycobacterium avium
SATTATSWWPPSAGPA

SEQ ID NO: 73523 - protein, 10 aa, Mycobacterium avium
SATTDEKLTQ

SEQ ID NO: 73524 - protein, 18 aa, Mycobacterium avium
SATTSPSCCRSSPWRRSG

SEQ ID NO: 73525 - protein, 11 aa, Mycobacterium avium
SATVPVSAGEP

SEQ ID NO: 73526 - protein, 4 aa, Mycobacterium avium
SAVG

SEQ ID NO: 73527 - protein, 15 aa, Mycobacterium avium
SAVGAAVDDDAPVDF

SEQ ID NO: 73528 - protein, 15 aa, Mycobacterium avium
SAVPHGPDQVKQNED

SEQ ID NO: 73529 - protein, 9 aa, Mycobacterium avium
SAVRGESGV

SEQ ID NO: 73530 - protein, 16 aa, Mycobacterium avium
SAWGPPQVHRQRVLEA

SEQ ID NO: 73531 - protein, 5 aa, Mycobacterium avium
SAYAT

SEQ ID NO: 73532 - protein, 6 aa, Mycobacterium avium
SAYDER

SEQ ID NO: 73533 - protein, 10 aa, Mycobacterium avium
SAYPGGTGYA

SEQ ID NO: 73534 - protein, 8 aa, Mycobacterium avium
SAYPSRSI

SEQ ID NO: 73535 - protein, 5 aa, Mycobacterium avium
SAYTP

SEQ ID NO: 73536 - protein, 29 aa, Mycobacterium avium
SCPIPAPASTRTAPRSTAPTEAPAARRTT

SEQ ID NO: 73537 - protein, 8 aa, Mycobacterium avium
SCRNGDGG

SEQ ID NO: 73538 - protein, 14 aa, Mycobacterium avium
SCTGRRAAARPRWP

SEQ ID NO: 73539 - protein, 10 aa, Mycobacterium avium
SCTSAGTSCG

SEQ ID NO: 73540 - protein, 4 aa, Mycobacterium avium
SDAA

SEQ ID NO: 73541 - protein, 8 aa, Mycobacterium avium
SDAFPTAA

SEQ ID NO: 73542 - protein, 8 aa, Mycobacterium avium
SDAGATAV

SEQ ID NO: 73543 - protein, 7 aa, Mycobacterium avium
SDAGAVA

SEQ ID NO: 73544 - protein, 5 aa, Mycobacterium avium
SDAGV

SEQ ID NO: 73545 - protein, 6 aa, Mycobacterium avium
SDALDA

SEQ ID NO: 73546 - protein, 7 aa, Mycobacterium avium
SDAPAEL

SEQ ID NO: 73547 - protein, 8 aa, Mycobacterium avium
SDAPPRAA

SEQ ID NO: 73548 - protein, 6 aa, Mycobacterium avium
SDAPTY

SEQ ID NO: 73549 - protein, 8 aa, Mycobacterium avium
SDASRGYQ

SEQ ID NO: 73550 - protein, 4 aa, Mycobacterium avium
SDAT

SEQ ID NO: 73551 - protein, 4 aa, Mycobacterium avium
SDAV

SEQ ID NO: 73552 - protein, 6 aa, Mycobacterium avium
SDDDAW

SEQ ID NO: 73553 - protein, 7 aa, Mycobacterium avium
SDDDAWD

SEQ ID NO: 73554 - protein, 27 aa, Mycobacterium avium
SDDEPVAVTPTVPDRYRPSDSGGSIQG

SEQ ID NO: 73555 - protein, 5 aa, Mycobacterium avium
SDDEW

SEQ ID NO: 73556 - protein, 12 aa, Mycobacterium avium
SDDFESVADTDS

SEQ ID NO: 73557 - protein, 23 aa, Mycobacterium avium
SDDPAGRAEADATVDTLPGPLST

SEQ ID NO: 73558 - protein, 6 aa, Mycobacterium avium
SDDSNA

SEQ ID NO: 73559 - protein, 6 aa, Mycobacterium avium
SDDTII

SEQ ID NO: 73560 - protein, 18 aa, Mycobacterium avium
SDDVDPQSRDLPRPHPDD

SEQ ID NO: 73561 - protein, 6 aa, Mycobacterium avium
SDEAAE

SEQ ID NO: 73562 - protein, 7 aa, Mycobacterium avium
SDEAERT

SEQ ID NO: 73563 - protein, 5 aa, Mycobacterium avium
SDEDW

SEQ ID NO: 73564 - protein, 8 aa, Mycobacterium avium
SDEERAAA

SEQ ID NO: 73565 - protein, 12 aa, Mycobacterium avium
SDEIRASEPITQ

SEQ ID NO: 73566 - protein, 9 aa, Mycobacterium avium
SDEKTTAMG

SEQ ID NO: 73567 - protein, 7 aa, Mycobacterium avium
SDELPSV

SEQ ID NO: 73568 - protein, 5 aa, Mycobacterium avium
SDEQK

SEQ ID NO: 73569 - protein, 10 aa, Mycobacterium avium
SDEQRTAGYA

SEQ ID NO: 73570 - protein, 5 aa, Mycobacterium avium
SDERK

SEQ ID NO: 73571 - protein, 9 aa, Mycobacterium avium
SDESTRSVD

SEQ ID NO: 73572 - protein, 8 aa, Mycobacterium avium
SDETGTRR

SEQ ID NO: 73573 - protein, 7 aa, Mycobacterium avium
SDETIRQ

SEQ ID NO: 73574 - protein, 7 aa, Mycobacterium avium
SDEYSRK

SEQ ID NO: 73575 - protein, 4 aa, Mycobacterium avium
SDGA

SEQ ID NO: 73576 - protein, 7 aa, Mycobacterium avium
SDGADDA

SEQ ID NO: 73577 - protein, 8 aa, Mycobacterium avium
SDGDEEKE

SEQ ID NO: 73578 - protein, 17 aa, Mycobacterium avium
SDGDGLAPYDPALSPAQ

SEQ ID NO: 73579 - protein, 6 aa, Mycobacterium avium
SDGFGP

SEQ ID NO: 73580 - protein, 12 aa, Mycobacterium avium
SDGGRYLDPDKA

SEQ ID NO: 73581 - protein, 25 aa, Mycobacterium avium
SDGPAVPPQQIQSRKGVGADGPASW

SEQ ID NO: 73582 - protein, 8 aa, Mycobacterium avium
SDGPWPET

SEQ ID NO: 73583 - protein, 8 aa, Mycobacterium avium
SDGQPPLW

SEQ ID NO: 73584 - protein, 8 aa, Mycobacterium avium
SDGRPPLD

SEQ ID NO: 73585 - protein, 7 aa, Mycobacterium avium
SDGRTAP

SEQ ID NO: 73586 - protein, 8 aa, Mycobacterium avium
SDGTEFSE

SEQ ID NO: 73587 - protein, 5 aa, Mycobacterium avium
SDGTP

SEQ ID NO: 73588 - protein, 4 aa, Mycobacterium avium
SDGY

SEQ ID NO: 73589 - protein, 16 aa, Mycobacterium avium
SDHPSGPATGSSAAPR

SEQ ID NO: 73590 - protein, 8 aa, Mycobacterium avium
SDHTPAST

SEQ ID NO: 73591 - protein, 8 aa, Mycobacterium avium
SDHTPTST

SEQ ID NO: 73592 - protein, 21 aa, Mycobacterium avium
SDKGLDAAEADPNYADQEHAV

SEQ ID NO: 73593 - protein, 8 aa, Mycobacterium avium
SDKNAGLS

SEQ ID NO: 73594 - protein, 7 aa, Mycobacterium avium
SDKPGSV

SEQ ID NO: 73595 - protein, 7 aa, Mycobacterium avium
SDKSEAV

SEQ ID NO: 73596 - protein, 11 aa, Mycobacterium avium
SDLAGGRLTGT

SEQ ID NO: 73597 - protein, 6 aa, Mycobacterium avium
SDLSAD

SEQ ID NO: 73598 - protein, 12 aa, Mycobacterium avium
SDLSAENLGRDT

SEQ ID NO: 73599 - protein, 7 aa, Mycobacterium avium
SDLTPTE

SEQ ID NO: 73600 - protein, 11 aa, Mycobacterium avium
SDNKTGATPTW

SEQ ID NO: 73601 - protein, 4 aa, Mycobacterium avium
SDNM

SEQ ID NO: 73602 - protein, 4 aa, Mycobacterium avium
SDPA

SEQ ID NO: 73603 - protein, 12 aa, Mycobacterium avium
SDPAAGKKPRKT

SEQ ID NO: 73604 - protein, 11 aa, Mycobacterium avium
SDPAAYDAASD

SEQ ID NO: 73605 - protein, 19 aa, Mycobacterium avium
SDPAGGGSRTLPVTLGKAD

SEQ ID NO: 73606 - protein, 11 aa, Mycobacterium avium
SDPALAGQPAP

SEQ ID NO: 73607 - protein, 7 aa, Mycobacterium avium
SDPDATA

SEQ ID NO: 73608 - protein, 5 aa, Mycobacterium avium
SDPDL

SEQ ID NO: 73609 - protein, 12 aa, Mycobacterium avium
SDPDRLRGAVGG

SEQ ID NO: 73610 - protein, 5 aa, Mycobacterium avium
SDPDV

SEQ ID NO: 73611 - protein, 8 aa, Mycobacterium avium
SDPEDVAR

SEQ ID NO: 73612 - protein, 8 aa, Mycobacterium avium
SDPEYVPD

SEQ ID NO: 73613 - protein, 9 aa, Mycobacterium avium
SDPEYVPDQ

SEQ ID NO: 73614 - protein, 7 aa, Mycobacterium avium
SDPGEVD

SEQ ID NO: 73615 - protein, 8 aa, Mycobacterium avium
SDPGTRMA

SEQ ID NO: 73616 - protein, 6 aa, Mycobacterium avium
SDPIGF

SEQ ID NO: 73617 - protein, 9 aa, Mycobacterium avium
SDPPETQEL

SEQ ID NO: 73618 - protein, 9 aa, Mycobacterium avium
SDPPETQQL

SEQ ID NO: 73619 - protein, 7 aa, Mycobacterium avium
SDPPPPR

SEQ ID NO: 73620 - protein, 6 aa, Mycobacterium avium
SDPQFQ

SEQ ID NO: 73621 - protein, 8 aa, Mycobacterium avium
SDPQHPAR

SEQ ID NO: 73622 - protein, 9 aa, Mycobacterium avium
SDPTPGKNR

SEQ ID NO: 73623 - protein, 10 aa, Mycobacterium avium
SDQDSAPLRE

SEQ ID NO: 73624 - protein, 9 aa, Mycobacterium avium
SDQNPSNVK

SEQ ID NO: 73625 - protein, 8 aa, Mycobacterium avium
SDRAERGG

SEQ ID NO: 73626 - protein, 4 aa, Mycobacterium avium
SDRE

SEQ ID NO: 73627 - protein, 8 aa, Mycobacterium avium
SDRGERGR

SEQ ID NO: 73628 - protein, 8 aa, Mycobacterium avium
SDRGRREP

SEQ ID NO: 73629 - protein, 5 aa, Mycobacterium avium
SDRME

SEQ ID NO: 73630 - protein, 5 aa, Mycobacterium avium
SDRQG

SEQ ID NO: 73631 - protein, 9 aa, Mycobacterium avium
SDRRGPKTL

SEQ ID NO: 73632 - protein, 9 aa, Mycobacterium avium
SDRSDRTLA

SEQ ID NO: 73633 - protein, 6 aa, Mycobacterium avium
SDRTKA

SEQ ID NO: 73634 - protein, 8 aa, Mycobacterium avium
SDSAFESD

SEQ ID NO: 73635 - protein, 9 aa, Mycobacterium avium
SDSFAPNIR

SEQ ID NO: 73636 - protein, 19 aa, Mycobacterium avium
SDSFGTSPEHSEGGTAEGG

SEQ ID NO: 73637 - protein, 6 aa, Mycobacterium avium
SDSGYQ

SEQ ID NO: 73638 - protein, 9 aa, Mycobacterium avium
SDSKHDRAS

SEQ ID NO: 73639 - protein, 9 aa, Mycobacterium avium
SDSKTLRPA

SEQ ID NO: 73640 - protein, 17 aa, Mycobacterium avium
SDSVESAKREIALWFPD

SEQ ID NO: 73641 - protein, 5 aa, Mycobacterium avium
SDSWR

SEQ ID NO: 73642 - protein, 5 aa, Mycobacterium avium
SDTAS

SEQ ID NO: 73643 - protein, 7 aa, Mycobacterium avium
SDTDAAV

SEQ ID NO: 73644 - protein, 7 aa, Mycobacterium avium
SDTDGTF

SEQ ID NO: 73645 - protein, 6 aa, Mycobacterium avium
SDTESI

SEQ ID NO: 73646 - protein, 9 aa, Mycobacterium avium
SDTESRQLA

SEQ ID NO: 73647 - protein, 7 aa, Mycobacterium avium
SDTGEVA

SEQ ID NO: 73648 - protein, 10 aa, Mycobacterium avium
SDTGLDAGAV

SEQ ID NO: 73649 - protein, 7 aa, Mycobacterium avium
SDTGRTE

SEQ ID NO: 73650 - protein, 9 aa, Mycobacterium avium
SDTPDEPDR

SEQ ID NO: 73651 - protein, 5 aa, Mycobacterium avium
SDTPK

SEQ ID NO: 73652 - protein, 5 aa, Mycobacterium avium
SDTPQ

SEQ ID NO: 73653 - protein, 7 aa, Mycobacterium avium
SDTPRFD

SEQ ID NO: 73654 - protein, 12 aa, Mycobacterium avium
SDTSRSAPPSVE

SEQ ID NO: 73655 - protein, 4 aa, Mycobacterium avium
SDTT

SEQ ID NO: 73656 - protein, 7 aa, Mycobacterium avium
SDTYSAA

SEQ ID NO: 73657 - protein, 9 aa, Mycobacterium avium
SDVGDEEQV

SEQ ID NO: 73658 - protein, 5 aa, Mycobacterium avium
SDVNP

SEQ ID NO: 73659 - protein, 7 aa, Mycobacterium avium
SDWRGRA

SEQ ID NO: 73660 - protein, 7 aa, Mycobacterium avium
SEAADTI

SEQ ID NO: 73661 - protein, 6 aa, Mycobacterium avium
SEAAGA

SEQ ID NO: 73662 - protein, 8 aa, Mycobacterium avium
SEAAGGNF

SEQ ID NO: 73663 - protein, 4 aa, Mycobacterium avium
SEAE

SEQ ID NO: 73664 - protein, 8 aa, Mycobacterium avium
SEAEPVTA

SEQ ID NO: 73665 - protein, 19 aa, Mycobacterium avium
SEAGKEDLKSLGGVSATTA

SEQ ID NO: 73666 - protein, 6 aa, Mycobacterium avium
SEAGYT

SEQ ID NO: 73667 - protein, 8 aa, Mycobacterium avium
SEAKGEEL

SEQ ID NO: 73668 - protein, 5 aa, Mycobacterium avium
SEANL

SEQ ID NO: 73669 - protein, 80 aa, Mycobacterium avium
SEAREGAATPAPDASSATHTPAAPIGPGAPSGTPGASAVASPAPTAATAPPSSAAAPAPPPANVSRETADEFDTPIGAAA

SEQ ID NO: 73670 - protein, 19 aa, Mycobacterium avium
SEATGNAPPPGGPPPSPRA

SEQ ID NO: 73671 - protein, 6 aa, Mycobacterium avium
SEATPR

SEQ ID NO: 73672 - protein, 7 aa, Mycobacterium avium
SEATQAT

SEQ ID NO: 73673 - protein, 4 aa, Mycobacterium avium
SEAV

SEQ ID NO: 73674 - protein, 38 aa, Mycobacterium avium
SEAVKQTKKDMGEDITPAEKRQLSDEEKEYKSKRKQIQ

SEQ ID NO: 73675 - protein, 9 aa, Mycobacterium avium
SEDAKEGPL

SEQ ID NO: 73676 - protein, 6 aa, Mycobacterium avium
SEDDAA

SEQ ID NO: 73677 - protein, 9 aa, Mycobacterium avium
SEDDSSDLA

SEQ ID NO: 73678 - protein, 7 aa, Mycobacterium avium
SEDGSSL

SEQ ID NO: 73679 - protein, 6 aa, Mycobacterium avium
SEDHAG

SEQ ID NO: 73680 - protein, 10 aa, Mycobacterium avium
SEDPRARSDY

SEQ ID NO: 73681 - protein, 19 aa, Mycobacterium avium
SEEAGNTRPRYAAEVARRN

SEQ ID NO: 73682 - protein, 6 aa, Mycobacterium avium
SEEAYD

SEQ ID NO: 73683 - protein, 27 aa, Mycobacterium avium
SEEKDEATMAEEQAALEAGQHAGGVEE

SEQ ID NO: 73684 - protein, 4 aa, Mycobacterium avium
SEGA

SEQ ID NO: 73685 - protein, 6 aa, Mycobacterium avium
SEGDYY

SEQ ID NO: 73686 - protein, 8 aa, Mycobacterium avium
SEGPLSGA

SEQ ID NO: 73687 - protein, 9 aa, Mycobacterium avium
SEGSGQPLD

SEQ ID NO: 73688 - protein, 6 aa, Mycobacterium avium
SEGSVR

SEQ ID NO: 73689 - protein, 7 aa, Mycobacterium avium
SEGVARD

SEQ ID NO: 73690 - protein, 5 aa, Mycobacterium avium
SEGVT

SEQ ID NO: 73691 - protein, 11 aa, Mycobacterium avium
SEHAGTGEFSD

SEQ ID NO: 73692 - protein, 6 aa, Mycobacterium avium
SEHDRV

SEQ ID NO: 73693 - protein, 11 aa, Mycobacterium avium
SEHGFNSPHTD

SEQ ID NO: 73694 - protein, 15 aa, Mycobacterium avium
SEHGSPEDGSSREPE

SEQ ID NO: 73695 - protein, 13 aa, Mycobacterium avium
SEIDKAGAELAAA

SEQ ID NO: 73696 - protein, 13 aa, Mycobacterium avium
SEIDKASAELAAA

SEQ ID NO: 73697 - protein, 8 aa, Mycobacterium avium
SELAPATS

SEQ ID NO: 73698 - protein, 17 aa, Mycobacterium avium
SELPSDTARVTAGQRES

SEQ ID NO: 73699 - protein, 4 aa, Mycobacterium avium
SELS

SEQ ID NO: 73700 - protein, 13 aa, Mycobacterium avium
SEMTDSGEASTGW

SEQ ID NO: 73701 - protein, 8 aa, Mycobacterium avium
SENAPLAG

SEQ ID NO: 73702 - protein, 8 aa, Mycobacterium avium
SENKAAAV

SEQ ID NO: 73703 - protein, 5 aa, Mycobacterium avium
SENNT

SEQ ID NO: 73704 - protein, 9 aa, Mycobacterium avium
SEPADAAAL

SEQ ID NO: 73705 - protein, 9 aa, Mycobacterium avium
SEPDENRSP

SEQ ID NO: 73706 - protein, 9 aa, Mycobacterium avium
SEPEAGSDL

SEQ ID NO: 73707 - protein, 10 aa, Mycobacterium avium
SEPGAGSDLA

SEQ ID NO: 73708 - protein, 19 aa, Mycobacterium avium
SEPGAGSDLASLSTRAVRD

SEQ ID NO: 73709 - protein, 19 aa, Mycobacterium avium
SEPGAGSDLSSLSTRAVRD

SEQ ID NO: 73710 - protein, 11 aa, Mycobacterium avium
SEPGPLPQRVG

SEQ ID NO: 73711 - protein, 18 aa, Mycobacterium avium
SEPQFEGQTKTKLGNTEV

SEQ ID NO: 73712 - protein, 13 aa, Mycobacterium avium
SEQGAAPARTLRA

SEQ ID NO: 73713 - protein, 18 aa, Mycobacterium avium
SEQLPKIGTDLEEHRRRA

SEQ ID NO: 73714 - protein, 8 aa, Mycobacterium avium
SEQPESVQ

SEQ ID NO: 73715 - protein, 6 aa, Mycobacterium avium
SEQRIK

SEQ ID NO: 73716 - protein, 6 aa, Mycobacterium avium
SEQRRE

SEQ ID NO: 73717 - protein, 7 aa, Mycobacterium avium
SEQRREG

SEQ ID NO: 73718 - protein, 9 aa, Mycobacterium avium
SEQTRPGGN

SEQ ID NO: 73719 - protein, 4 aa, Mycobacterium avium
SERA

SEQ ID NO: 73720 - protein, 6 aa, Mycobacterium avium
SERDAY

SEQ ID NO: 73721 - protein, 9 aa, Mycobacterium avium
SERLERKKQ

SEQ ID NO: 73722 - protein, 9 aa, Mycobacterium avium
SERNDSPSV

SEQ ID NO: 73723 - protein, 7 aa, Mycobacterium avium
SERPRGV

SEQ ID NO: 73724 - protein, 13 aa, Mycobacterium avium
SERPRSRSCAGNH

SEQ ID NO: 73725 - protein, 10 aa, Mycobacterium avium
SERSAGLSKR

SEQ ID NO: 73726 - protein, 13 aa, Mycobacterium avium
SERTTSLSKRAVT

SEQ ID NO: 73727 - protein, 5 aa, Mycobacterium avium
SESAD

SEQ ID NO: 73728 - protein, 13 aa, Mycobacterium avium
SESCPNDDSHGAV

SEQ ID NO: 73729 - protein, 6 aa, Mycobacterium avium
SESKNQ

SEQ ID NO: 73730 - protein, 9 aa, Mycobacterium avium
SESLDSEPR

SEQ ID NO: 73731 - protein, 6 aa, Mycobacterium avium
SESRPA

SEQ ID NO: 73732 - protein, 18 aa, Mycobacterium avium
SESTCGKDPSLRGQDGPM

SEQ ID NO: 73733 - protein, 9 aa, Mycobacterium avium
SETDQDLGD

SEQ ID NO: 73734 - protein, 9 aa, Mycobacterium avium
SETDRDLGD

SEQ ID NO: 73735 - protein, 7 aa, Mycobacterium avium
SETGGPE

SEQ ID NO: 73736 - protein, 5 aa, Mycobacterium avium
SETGL

SEQ ID NO: 73737 - protein, 6 aa, Mycobacterium avium
SETPEY

SEQ ID NO: 73738 - protein, 7 aa, Mycobacterium avium
SETPLSA

SEQ ID NO: 73739 - protein, 8 aa, Mycobacterium avium
SETTPDSL

SEQ ID NO: 73740 - protein, 9 aa, Mycobacterium avium
SEVAQPNDY

SEQ ID NO: 73741 - protein, 13 aa, Mycobacterium avium
SEVCDNGSATYAF

SEQ ID NO: 73742 - protein, 4 aa, Mycobacterium avium
SEVS

SEQ ID NO: 73743 - protein, 8 aa, Mycobacterium avium
SEVSEPGD

SEQ ID NO: 73744 - protein, 8 aa, Mycobacterium avium
SEVSERGD

SEQ ID NO: 73745 - protein, 11 aa, Mycobacterium avium
SEVTDADGKPI

SEQ ID NO: 73746 - protein, 4 aa, Mycobacterium avium
SEWA

SEQ ID NO: 73747 - protein, 11 aa, Mycobacterium avium
SEYAGSGSTAV

SEQ ID NO: 73748 - protein, 4 aa, Mycobacterium avium
SEYP

SEQ ID NO: 73749 - protein, 14 aa, Mycobacterium avium
SFAAGDSALQPLNP

SEQ ID NO: 73750 - protein, 5 aa, Mycobacterium avium
SFADG

SEQ ID NO: 73751 - protein, 7 aa, Mycobacterium avium
SFAPNIR

SEQ ID NO: 73752 - protein, 15 aa, Mycobacterium avium
SFGTAAPARSEEEAD

SEQ ID NO: 73753 - protein, 7 aa, Mycobacterium avium
SFPPIEP

SEQ ID NO: 73754 - protein, 6 aa, Mycobacterium avium
SFPTEP

SEQ ID NO: 73755 - protein, 18 aa, Mycobacterium avium
SFQAPDGKPLFCIWENAQ

SEQ ID NO: 73756 - protein, 7 aa, Mycobacterium avium
SFQSPRH

SEQ ID NO: 73757 - protein, 18 aa, Mycobacterium avium
SFSRTTGHRMDGGSFSDP

SEQ ID NO: 73758 - protein, 5 aa, Mycobacterium avium
SFSSD

SEQ ID NO: 73759 - protein, 18 aa, Mycobacterium avium
SFYGRRAGASAAGRRLPR

SEQ ID NO: 73760 - protein, 10 aa, Mycobacterium avium
SGAAPGLTAY

SEQ ID NO: 73761 - protein, 9 aa, Mycobacterium avium
SGAATDVPK

SEQ ID NO: 73762 - protein, 11 aa, Mycobacterium avium
SGADAPHLETD

SEQ ID NO: 73763 - protein, 7 aa, Mycobacterium avium
SGAGATV

SEQ ID NO: 73764 - protein, 27 aa, Mycobacterium avium
SGAGEGSSIPDSEFKAAGAQLADTAEQ

SEQ ID NO: 73765 - protein, 12 aa, Mycobacterium avium
SGAGHPAGSPTL

SEQ ID NO: 73766 - protein, 13 aa, Mycobacterium avium
SGAHALRPGELTE

SEQ ID NO: 73767 - protein, 17 aa, Mycobacterium avium
SGAHHESSSQNATYGVP

SEQ ID NO: 73768 - protein, 9 aa, Mycobacterium avium
SGAHQRGAE

SEQ ID NO: 73769 - protein, 14 aa, Mycobacterium avium
SGAMTPDENEATAR

SEQ ID NO: 73770 - protein, 4 aa, Mycobacterium avium
SGAP

SEQ ID NO: 73771 - protein, 22 aa, Mycobacterium avium
SGARPPAPPRPTLDAPGADLER

SEQ ID NO: 73772 - protein, 12 aa, Mycobacterium avium
SGARSSSSARSS

SEQ ID NO: 73773 - protein, 11 aa, Mycobacterium avium
SGATAPAARRP

SEQ ID NO: 73774 - protein, 56 aa, Mycobacterium avium; identical to SEQ ID NO: 9761

SEQ ID NO: 73775 - protein, 8 aa, Mycobacterium avium
SGATPLSE

SEQ ID NO: 73776 - protein, 22 aa, Mycobacterium avium
SGAVGAVGPRPGGRGGHRPHRR

SEQ ID NO: 73777 - protein, 16 aa, Mycobacterium avium
SGAVGGSAPTAPAAPL

SEQ ID NO: 73778 - protein, 8 aa, Mycobacterium avium
SGCPGGGG

SEQ ID NO: 73779 - protein, 11 aa, Mycobacterium avium
SGDAPDDVGER

SEQ ID NO: 73780 - protein, 12 aa, Mycobacterium avium
SGDAPDDVGERL

SEQ ID NO: 73781 - protein, 13 aa, Mycobacterium avium
SGDAPDDVGERLR

SEQ ID NO: 73782 - protein, 9 aa, Mycobacterium avium
SGDCDRDDL

SEQ ID NO: 73783 - protein, 20 aa, Mycobacterium avium
SGDETAGVDSYGRNSNPTWR

SEQ ID NO: 73784 - protein, 20 aa, Mycobacterium avium
SGDETGGVDSYGRNSNPTWR

SEQ ID NO: 73785 - protein, 4 aa, Mycobacterium avium
SGDG

SEQ ID NO: 73786 - protein, 10 aa, Mycobacterium avium
SGDGHRRRGR

SEQ ID NO: 73787 - protein, 5 aa, Mycobacterium avium
SGDGT

SEQ ID NO: 73788 - protein, 9 aa, Mycobacterium avium
SGDLQEGHN

SEQ ID NO: 73789 - protein, 15 aa, Mycobacterium avium
SGDLSQSPSNPSATL

SEQ ID NO: 73790 - protein, 8 aa, Mycobacterium avium
SGDPITDC

SEQ ID NO: 73791 - protein, 6 aa, Mycobacterium avium
SGDPSF

SEQ ID NO: 73792 - protein, 10 aa, Mycobacterium avium
SGDPTVETPW

SEQ ID NO: 73793 - protein, 7 aa, Mycobacterium avium
SGDQDRA

SEQ ID NO: 73794 - protein, 5 aa, Mycobacterium avium
SGEAA

SEQ ID NO: 73795 - protein, 6 aa, Mycobacterium avium
SGEAAV

SEQ ID NO: 73796 - protein, 7 aa, Mycobacterium avium
SGEGADE

SEQ ID NO: 73797 - protein, 4 aa, Mycobacterium avium
SGEH

SEQ ID NO: 73798 - protein, 10 aa, Mycobacterium avium
SGELDPDDLE

SEQ ID NO: 73799 - protein, 8 aa, Mycobacterium avium
SGEPIGAQ

SEQ ID NO: 73800 - protein, 13 aa, Mycobacterium avium
SGESMFPGKAGTD

SEQ ID NO: 73801 - protein, 7 aa, Mycobacterium avium
SGETTSH

SEQ ID NO: 73802 - protein, 6 aa, Mycobacterium avium
SGEVQP

SEQ ID NO: 73803 - protein, 8 aa, Mycobacterium avium
SGEWAGET

SEQ ID NO: 73804 - protein, 8 aa, Mycobacterium avium
SGFGQSLS

SEQ ID NO: 73805 - protein, 17 aa, Mycobacterium avium
SGFGSQGPDRETGAHDT

SEQ ID NO: 73806 - protein, 7 aa, Mycobacterium avium
SGFTGPW

SEQ ID NO: 73807 - protein, 9 aa, Mycobacterium avium
SGGAEAGPI

SEQ ID NO: 73808 - protein, 44 aa, Mycobacterium avium
SGGAGTVSEHDARARHPSAASAAPRLAAGRRRAVERRAARMKIP

SEQ ID NO: 73809 - protein, 5 aa, Mycobacterium avium
SGGAI

SEQ ID NO: 73810 - protein, 12 aa, Mycobacterium avium
SGGCSLDPQTGI

SEQ ID NO: 73811 - protein, 6 aa, Mycobacterium avium
SGGDGR

SEQ ID NO: 73812 - protein, 7 aa, Mycobacterium avium
SGGDRDA

SEQ ID NO: 73813 - protein, 7 aa, Mycobacterium avium
SGGEAAV

SEQ ID NO: 73814 - protein, 6 aa, Mycobacterium avium
SGGEQK

SEQ ID NO: 73815 - protein, 7 aa, Mycobacterium avium
SGGERSP

SEQ ID NO: 73816 - protein, 4 aa, Mycobacterium avium
SGGF

SEQ ID NO: 73817 - protein, 15 aa, Mycobacterium avium
SGGGRVLSEDGRRVT

SEQ ID NO: 73818 - protein, 80 aa, Mycobacterium avium
SGGIGGSGDRDAAGGPGQRPVRRATAGRRGGRAGVGGAGRARTGEHRSSGRETGRERGGRKRPDGVHSRHATGTAPFRGR

SEQ ID NO: 73819 - protein, 76 aa, Mycobacterium avium
SGGIGGSGDRDAAGGPGQRPVRRATAGRRGGRAGVGGAGSARTGEHRSGGRETGRERGDRKRPDGVHGRHATGTAP

SEQ ID NO: 73820 - protein, 10 aa, Mycobacterium avium
SGGKGRSWET

SEQ ID NO: 73821 - protein, 17 aa, Mycobacterium avium
SGGKNTNAGIIRNPNRP

SEQ ID NO: 73822 - protein, 14 aa, Mycobacterium avium
SGGLDDRRASNGYL

SEQ ID NO: 73823 - protein, 13 aa, Mycobacterium avium
SGGLSGDSATGLF

SEQ ID NO: 73824 - protein, 7 aa, Mycobacterium avium
SGGPDSL

SEQ ID NO: 73825 - protein, 10 aa, Mycobacterium avium
SGGPRAAGDA

SEQ ID NO: 73826 - protein, 8 aa, Mycobacterium avium
SGGPVGNG

SEQ ID NO: 73827 - protein, 16 aa, Mycobacterium avium
SGGQASDAALTFDVDQ

SEQ ID NO: 73828 - protein, 4 aa, Mycobacterium avium
SGGR

SEQ ID NO: 73829 - protein, 7 aa, Mycobacterium avium
SGGRDGE

SEQ ID NO: 73830 - protein, 7 aa, Mycobacterium avium
SGGRGGS

SEQ ID NO: 73831 - protein, 14 aa, Mycobacterium avium
SGGVTEEREEQASA

SEQ ID NO: 73832 - protein, 14 aa, Mycobacterium avium
SGHAKGCESGSGTA

SEQ ID NO: 73833 - protein, 9 aa, Mycobacterium avium
SGHDPDHDE

SEQ ID NO: 73834 - protein, 17 aa, Mycobacterium avium
SGHGPKGPDSDKPGYDG

SEQ ID NO: 73835 - protein, 6 aa, Mycobacterium avium
SGHPET

SEQ ID NO: 73836 - protein, 11 aa, Mycobacterium avium
SGHRERPVTES

SEQ ID NO: 73837 - protein, 7 aa, Mycobacterium avium
SGHTERL

SEQ ID NO: 73838 - protein, 8 aa, Mycobacterium avium
SGIDDNPY

SEQ ID NO: 73839 - protein, 7 aa, Mycobacterium avium
SGIGEAR

SEQ ID NO: 73840 - protein, 8 aa, Mycobacterium avium
SGIGREGG

SEQ ID NO: 73841 - protein, 9 aa, Mycobacterium avium
SGIGRENGI

SEQ ID NO: 73842 - protein, 11 aa, Mycobacterium avium
SGIGTPGRARE

SEQ ID NO: 73843 - protein, 7 aa, Mycobacterium avium
SGIRTDA

SEQ ID NO: 73844 - protein, 9 aa, Mycobacterium avium
SGKADQLRK

SEQ ID NO: 73845 - protein, 6 aa, Mycobacterium avium
SGKATL

SEQ ID NO: 73846 - protein, 5 aa, Mycobacterium avium
SGKGF

SEQ ID NO: 73847 - protein, 7 aa, Mycobacterium avium
SGKPIPP

SEQ ID NO: 73848 - protein, 8 aa, Mycobacterium avium
SGKRGAKG

SEQ ID NO: 73849 - protein, 6 aa, Mycobacterium avium
SGKTPI

SEQ ID NO: 73850 - protein, 5 aa, Mycobacterium avium
SGKTT

SEQ ID NO: 73851 - protein, 5 aa, Mycobacterium avium
SGKVD

SEQ ID NO: 73852 - protein, 13 aa, Mycobacterium avium
SGKVGEEMRRLYG

SEQ ID NO: 73853 - protein, 6 aa, Mycobacterium avium
SGLATG

SEQ ID NO: 73854 - protein, 18 aa, Mycobacterium avium
SGLATGQATGPGGQAFPA

SEQ ID NO: 73855 - protein, 5 aa, Mycobacterium avium
SGLDA

SEQ ID NO: 73856 - protein, 8 aa, Mycobacterium avium
SGLERPRS

SEQ ID NO: 73857 - protein, 12 aa, Mycobacterium avium
SGLGSYPTTAPA

SEQ ID NO: 73858 - protein, 8 aa, Mycobacterium avium
SGLKPQDI

SEQ ID NO: 73859 - protein, 10 aa, Mycobacterium avium
SGLPAGGADL

SEQ ID NO: 73860 - protein, 7 aa, Mycobacterium avium
SGLPEGL

SEQ ID NO: 73861 - protein, 9 aa, Mycobacterium avium
SGLPKVPTS

SEQ ID NO: 73862 - protein, 9 aa, Mycobacterium avium
SGLPRPQTQ

SEQ ID NO: 73863 - protein, 5 aa, Mycobacterium avium
SGLRG

SEQ ID NO: 73864 - protein, 9 aa, Mycobacterium avium
SGLSPDDDL

SEQ ID NO: 73865 - protein, 6 aa, Mycobacterium avium
SGLSVD

SEQ ID NO: 73866 - protein, 6 aa, Mycobacterium avium
SGLTGG

SEQ ID NO: 73867 - protein, 12 aa, Mycobacterium avium
SGMGADQATQNM

SEQ ID NO: 73868 - protein, 4 aa, Mycobacterium avium
SGMN

SEQ ID NO: 73869 - protein, 10 aa, Mycobacterium avium
SGMPGQNAAR

SEQ ID NO: 73870 - protein, 31 aa, Mycobacterium avium
SGNARGPAPGGSGWTASRSTRCTSPTRCSPI

SEQ ID NO: 73871 - protein, 8 aa, Mycobacterium avium
SGNEDDYQ

SEQ ID NO: 73872 - protein, 11 aa, Mycobacterium avium
SGNKMGDGEHY

SEQ ID NO: 73873 - protein, 10 aa, Mycobacterium avium
SGNKMGEGEH

SEQ ID NO: 73874 - protein, 6 aa, Mycobacterium avium
SGNPIR

SEQ ID NO: 73875 - protein, 6 aa, Mycobacterium avium
SGPATG

SEQ ID NO: 73876 - protein, 8 aa, Mycobacterium avium
SGPATLKS

SEQ ID NO: 73877 - protein, 10 aa, Mycobacterium avium
SGPDDGPYDA

SEQ ID NO: 73878 - protein, 27 aa, Mycobacterium avium
SGPGAGPLRRPGTAWPPNYVPPQRPSG

SEQ ID NO: 73879 - protein, 7 aa, Mycobacterium avium
SGPGAGS

SEQ ID NO: 73880 - protein, 9 aa, Mycobacterium avium
SGPGQGRGR

SEQ ID NO: 73881 - protein, 10 aa, Mycobacterium avium
SGPGQGRRRD

SEQ ID NO: 73882 - protein, 5 aa, Mycobacterium avium
SGPIS

SEQ ID NO: 73883 - protein, 8 aa, Mycobacterium avium
SGPNRIGQ

SEQ ID NO: 73884 - protein, 5 aa, Mycobacterium avium
SGPPI

SEQ ID NO: 73885 - protein, 6 aa, Mycobacterium avium
SGPQHP

SEQ ID NO: 73886 - protein, 24 aa, Mycobacterium avium
SGPRSIRTPSSSSVSAPPESDDAA

SEQ ID NO: 73887 - protein, 4 aa, Mycobacterium avium
SGPW

SEQ ID NO: 73888 - protein, 14 aa, Mycobacterium avium
SGQAVTASAASNPD

SEQ ID NO: 73889 - protein, 4 aa, Mycobacterium avium
SGQF

SEQ ID NO: 73890 - protein, 6 aa, Mycobacterium avium
SGQFGA

SEQ ID NO: 73891 - protein, 8 aa, Mycobacterium avium
SGQGEDVV

SEQ ID NO: 73892 - protein, 5 aa, Mycobacterium avium
SGQGG

SEQ ID NO: 73893 - protein, 11 aa, Mycobacterium avium
SGQIGPGSHQR

SEQ ID NO: 73894 - protein, 8 aa, Mycobacterium avium
SGQNPEGL

SEQ ID NO: 73895 - protein, 8 aa, Mycobacterium avium
SGQNTEGL

SEQ ID NO: 73896 - protein, 10 aa, Mycobacterium avium
SGQPAGSDAE

SEQ ID NO: 73897 - protein, 8 aa, Mycobacterium avium
SGQPIEHG

SEQ ID NO: 73898 - protein, 7 aa, Mycobacterium avium
SGQRLGS

SEQ ID NO: 73899 - protein, 16 aa, Mycobacterium avium
SGRADQPRHRGKHHER

SEQ ID NO: 73900 - protein, 16 aa, Mycobacterium avium
SGRAPDEPAVTSPNGA

SEQ ID NO: 73901 - protein, 4 aa, Mycobacterium avium
SGRG

SEQ ID NO: 73902 - protein, 5 aa, Mycobacterium avium
SGRHL

SEQ ID NO: 73903 - protein, 12 aa, Mycobacterium avium
SGRKFSLRDADA

SEQ ID NO: 73904 - protein, 13 aa, Mycobacterium avium
SGRMHSGPGAGSL

SEQ ID NO: 73905 - protein, 10 aa, Mycobacterium avium
SGRQTGLARS

SEQ ID NO: 73906 - protein, 12 aa, Mycobacterium avium
SGRRRKGRRALS

SEQ ID NO: 73907 - protein, 6 aa, Mycobacterium avium
SGRRSG

SEQ ID NO: 73908 - protein, 5 aa, Mycobacterium avium
SGRVA

SEQ ID NO: 73909 - protein, 6 aa, Mycobacterium avium
SGRVDQ

SEQ ID NO: 73910 - protein, 10 aa, Mycobacterium avium
SGRVKRPQTG

SEQ ID NO: 73911 - protein, 5 aa, Mycobacterium avium
SGSAL

SEQ ID NO: 73912 - protein, 5 aa, Mycobacterium avium
SGSDL

SEQ ID NO: 73913 - protein, 10 aa, Mycobacterium avium
SGSEEDETAW

SEQ ID NO: 73914 - protein, 7 aa, Mycobacterium avium
SGSEGAL

SEQ ID NO: 73915 - protein, 7 aa, Mycobacterium avium
SGSGPTC

SEQ ID NO: 73916 - protein, 7 aa, Mycobacterium avium
SGSITGP

SEQ ID NO: 73917 - protein, 10 aa, Mycobacterium avium
SGSPDPEREV

SEQ ID NO: 73918 - protein, 7 aa, Mycobacterium avium
SGSRAGE

SEQ ID NO: 73919 - protein, 11 aa, Mycobacterium avium
SGSSDPEREVR

SEQ ID NO: 73920 - protein, 17 aa, Mycobacterium avium
SGSSGTAAAKKEALEAA

SEQ ID NO: 73921 - protein, 12 aa, Mycobacterium avium
SGSSLAGNSRAT

SEQ ID NO: 73922 - protein, 13 aa, Mycobacterium avium
SGSTGDPKGPVHT

SEQ ID NO: 73923 - protein, 9 aa, Mycobacterium avium
SGSTGEPKG

SEQ ID NO: 73924 - protein, 11 aa, Mycobacterium avium
SGSTGLPKGVP

SEQ ID NO: 73925 - protein, 8 aa, Mycobacterium avium
SGSTGTVS

SEQ ID NO: 73926 - protein, 6 aa, Mycobacterium avium
SGSVQR

SEQ ID NO: 73927 - protein, 8 aa, Mycobacterium avium
SGTALGNP

SEQ ID NO: 73928 - protein, 7 aa, Mycobacterium avium
SGTDLRT

SEQ ID NO: 73929 - protein, 6 aa, Mycobacterium avium
SGTEGR

SEQ ID NO: 73930 - protein, 10 aa, Mycobacterium avium
SGTGALGAAG

SEQ ID NO: 73931 - protein, 5 aa, Mycobacterium avium
SGTGN

SEQ ID NO: 73932 - protein, 15 aa, Mycobacterium avium
SGTGVPTSGLILAPD

SEQ ID NO: 73933 - protein, 7 aa, Mycobacterium avium
SGTGYDP

SEQ ID NO: 73934 - protein, 7 aa, Mycobacterium avium
SGTHPVA

SEQ ID NO: 73935 - protein, 7 aa, Mycobacterium avium
SGTIAGG

SEQ ID NO: 73936 - protein, 7 aa, Mycobacterium avium
SGTKGLS

SEQ ID NO: 73937 - protein, 8 aa, Mycobacterium avium
SGTNVDRR

SEQ ID NO: 73938 - protein, 4 aa, Mycobacterium avium
SGTP

SEQ ID NO: 73939 - protein, 71 aa, Mycobacterium avium
SGTPGASAVGSPASPPTAATASPSSAAASTSPPSSAAAPNPSSAAAPAPPPANVSRETADEFDTPIGAAAE

SEQ ID NO: 73940 - protein, 6 aa, Mycobacterium avium
SGTSYG

SEQ ID NO: 73941 - protein, 13 aa, Mycobacterium avium
SGTTAAPKGIRHT

SEQ ID NO: 73942 - protein, 9 aa, Mycobacterium avium
SGTTARPKG

SEQ ID NO: 73943 - protein, 10 aa, Mycobacterium avium
SGTTGAPKRI

SEQ ID NO: 73944 - protein, 7 aa, Mycobacterium avium
SGTTGAS

SEQ ID NO: 73945 - protein, 11 aa, Mycobacterium avium
SGTTGKPKGIV

SEQ ID NO: 73946 - protein, 13 aa, Mycobacterium avium
SGTTGPAKRVPLG

SEQ ID NO: 73947 - protein, 11 aa, Mycobacterium avium
SGTTGPPKPVP

SEQ ID NO: 73948 - protein, 9 aa, Mycobacterium avium
SGTTGSPKG

SEQ ID NO: 73949 - protein, 10 aa, Mycobacterium avium
SGTTGTPKGA

SEQ ID NO: 73950 - protein, 13 aa, Mycobacterium avium
SGTTGYPKGVPTT

SEQ ID NO: 73951 - protein, 9 aa, Mycobacterium avium
SGTTPSDQL

SEQ ID NO: 73952 - protein, 15 aa, Mycobacterium avium
SGTTSAPKGVQHTNN

SEQ ID NO: 73953 - protein, 9 aa, Mycobacterium avium
SGTTSRPKA

SEQ ID NO: 73954 - protein, 9 aa, Mycobacterium avium
SGTTSRPKG

SEQ ID NO: 73955 - protein, 10 aa, Mycobacterium avium
SGTTSSPKGV

SEQ ID NO: 73956 - protein, 14 aa, Mycobacterium avium
SGTTSVPKGVQQSH

SEQ ID NO: 73957 - protein, 4 aa, Mycobacterium avium
SGVD

SEQ ID NO: 73958 - protein, 9 aa, Mycobacterium avium
SGVDPDLQP

SEQ ID NO: 73959 - protein, 4 aa, Mycobacterium avium
SGVE

SEQ ID NO: 73960 - protein, 6 aa, Mycobacterium avium
SGVGED

SEQ ID NO: 73961 - protein, 5 aa, Mycobacterium avium
SGVGG

SEQ ID NO: 73962 - protein, 6 aa, Mycobacterium avium
SGVGTR

SEQ ID NO: 73963 - protein, 8 aa, Mycobacterium avium
SGVHPRAD

SEQ ID NO: 73964 - protein, 4 aa, Mycobacterium avium
SGVL

SEQ ID NO: 73965 - protein, 4 aa, Mycobacterium avium
SGVQ

SEQ ID NO: 73966 - protein, 6 aa, Mycobacterium avium
SGVTNY

SEQ ID NO: 73967 - protein, 8 aa, Mycobacterium avium
SGVTPTAV

SEQ ID NO: 73968 - protein, 6 aa, Mycobacterium avium
SGVVRP

SEQ ID NO: 73969 - protein, 10 aa, Mycobacterium avium
SGVVTSDSRE

SEQ ID NO: 73970 - protein, 6 aa, Mycobacterium avium
SGWDQA

SEQ ID NO: 73971 - protein, 7 aa, Mycobacterium avium
SGWPTDR

SEQ ID NO: 73972 - protein, 12 aa, Mycobacterium avium
SGYAASDVERAA

SEQ ID NO: 73973 - protein, 9 aa, Mycobacterium avium
SGYDESTGI

SEQ ID NO: 73974 - protein, 6 aa, Mycobacterium avium
SGYGLD

SEQ ID NO: 73975 - protein, 12 aa, Mycobacterium avium
SGYGQDGPWRDR

SEQ ID NO: 73976 - protein, 8 aa, Mycobacterium avium
SGYGVDGP

SEQ ID NO: 73977 - protein, 5 aa, Mycobacterium avium
SGYLG

SEQ ID NO: 73978 - protein, 17 aa, Mycobacterium avium
SHAEGGPLHAPGPKGHD

SEQ ID NO: 73979 - protein, 6 aa, Mycobacterium avium
SHDGTA

SEQ ID NO: 73980 - protein, 11 aa, Mycobacterium avium
SHDTGEPATDL

SEQ ID NO: 73981 - protein, 6 aa, Mycobacterium avium
SHDTLT

SEQ ID NO: 73982 - protein, 5 aa, Mycobacterium avium
SHESA

SEQ ID NO: 73983 - protein, 7 aa, Mycobacterium avium
SHEYRRQ

SEQ ID NO: 73984 - protein, 8 aa, Mycobacterium avium
SHGEREPA

SEQ ID NO: 73985 - protein, 5 aa, Mycobacterium avium
SHGEV

SEQ ID NO: 73986 - protein, 7 aa, Mycobacterium avium
SHGLPSA

SEQ ID NO: 73987 - protein, 10 aa, Mycobacterium avium
SHGPEGTTAR

SEQ ID NO: 73988 - protein, 6 aa, Mycobacterium avium
SHGSRR

SEQ ID NO: 73989 - protein, 13 aa, Mycobacterium avium
SHNPTAPTESKNV

SEQ ID NO: 73990 - protein, 4 aa, Mycobacterium avium
SHPA

SEQ ID NO: 73991 - protein, 6 aa, Mycobacterium avium
SHPAGH

SEQ ID NO: 73992 - protein, 7 aa, Mycobacterium avium
SHPAKAT

SEQ ID NO: 73993 - protein, 26 aa, Mycobacterium avium
SHPDSAIGTGPSAGHDTPESSPTEVR

SEQ ID NO: 73994 - protein, 17 aa, Mycobacterium avium
SHPPNAAALRGQPSRSD

SEQ ID NO: 73995 - protein, 6 aa, Mycobacterium avium
SHPREV

SEQ ID NO: 73996 - protein, 10 aa, Mycobacterium avium
SHPSKSPMRT

SEQ ID NO: 73997 - protein, 7 aa, Mycobacterium avium
SHPYPGV

SEQ ID NO: 73998 - protein, 29 aa, Mycobacterium avium
SHQGNSGFGRPAPGGGIAGRGRGRLRTPR

SEQ ID NO: 73999 - protein, 28 aa, Mycobacterium avium
SHRGDGESEQPQGRDVRPNRSQREEELS

SEQ ID NO: 74000 - protein, 9 aa, Mycobacterium avium
SHRGEGRRA

SEQ ID NO: 74001 - protein, 28 aa, Mycobacterium avium
SHRGEGTREAAVTPGAPLAVPEEDEREL

SEQ ID NO: 74002 - protein, 11 aa, Mycobacterium avium
SHRKGEFRDGY

SEQ ID NO: 74003 - protein, 7 aa, Mycobacterium avium
SHSESCP

SEQ ID NO: 74004 - protein, 12 aa, Mycobacterium avium
SHSGDGGAQEDV

SEQ ID NO: 74005 - protein, 7 aa, Mycobacterium avium
SHSGVAQ

SEQ ID NO: 74006 - protein, 7 aa, Mycobacterium avium
SHSPQVD

SEQ ID NO: 74007 - protein, 5 aa, Mycobacterium avium
SHTGT

SEQ ID NO: 74008 - protein, 13 aa, Mycobacterium avium
SHYGTAGVATGTA

SEQ ID NO: 74009 - protein, 8 aa, Mycobacterium avium
SIADAEAA

SEQ ID NO: 74010 - protein, 6 aa, Mycobacterium avium
SIDPGT

SEQ ID NO: 74011 - protein, 6 aa, Mycobacterium avium
SIGPAD

SEQ ID NO: 74012 - protein, 7 aa, Mycobacterium avium
SIGPANR

SEQ ID NO: 74013 - protein, 23 aa, Mycobacterium avium
SIIGSSSVNSDTPNPTLAPYAAT

SEQ ID NO: 74014 - protein, 6 aa, Mycobacterium avium
SIPATS

SEQ ID NO: 74015 - protein, 7 aa, Mycobacterium avium
SIPRDET

SEQ ID NO: 74016 - protein, 7 aa, Mycobacterium avium
SIPVSPQ

SEQ ID NO: 74017 - protein, 9 aa, Mycobacterium avium
SITEADRQR

SEQ ID NO: 74018 - protein, 12 aa, Mycobacterium avium
SITGTGVGGRIR

SEQ ID NO: 74019 - protein, 7 aa, Mycobacterium avium
SITPKRD

SEQ ID NO: 74020 - protein, 7 aa, Mycobacterium avium
SKAAADA

SEQ ID NO: 74021 - protein, 7 aa, Mycobacterium avium
SKAALAS

SEQ ID NO: 74022 - protein, 8 aa, Mycobacterium avium
SKADSARL

SEQ ID NO: 74023 - protein, 13 aa, Mycobacterium avium
SKAGARPIRTGRK

SEQ ID NO: 74024 - protein, 6 aa, Mycobacterium avium
SKAGLP

SEQ ID NO: 74025 - protein, 8 aa, Mycobacterium avium
SKAPGDKI

SEQ ID NO: 74026 - protein, 17 aa, Mycobacterium avium
SKAPRGKRRGEGPHAHP

SEQ ID NO: 74027 - protein, 7 aa, Mycobacterium avium
SKAQTWA

SEQ ID NO: 74028 - protein, 11 aa, Mycobacterium avium
SKASGSSTRRI

SEQ ID NO: 74029 - protein, 10 aa, Mycobacterium avium
SKDDDAGAFD

SEQ ID NO: 74030 - protein, 6 aa, Mycobacterium avium
SKDGNS

SEQ ID NO: 74031 - protein, 4 aa, Mycobacterium avium
SKFG

SEQ ID NO: 74032 - protein, 7 aa, Mycobacterium avium
SKGAATL

SEQ ID NO: 74033 - protein, 4 aa, Mycobacterium avium
SKGI

SEQ ID NO: 74034 - protein, 7 aa, Mycobacterium avium
SKGIGRA

SEQ ID NO: 74035 - protein, 4 aa, Mycobacterium avium
SKGL

SEQ ID NO: 74036 - protein, 7 aa, Mycobacterium avium
SKGYPYA

SEQ ID NO: 74037 - protein, 8 aa, Mycobacterium avium
SKGYPYEE

SEQ ID NO: 74038 - protein, 5 aa, Mycobacterium avium
SKGYT

SEQ ID NO: 74039 - protein, 6 aa, Mycobacterium avium
SKHAAD

SEQ ID NO: 74040 - protein, 9 aa, Mycobacterium avium
SKKANKAAI

SEQ ID NO: 74041 - protein, 8 aa, Mycobacterium avium
SKLGPSGM

SEQ ID NO: 74042 - protein, 9 aa, Mycobacterium avium
SKPGKRGGT

SEQ ID NO: 74043 - protein, 9 aa, Mycobacterium avium
SKPGTGSTF

SEQ ID NO: 74044 - protein, 39 aa, Mycobacterium avium
SKPRRAGESPAPEPDGPLSRGRATYRPPDEGRAARSSVP

SEQ ID NO: 74045 - protein, 8 aa, Mycobacterium avium
SKPSTTRP

SEQ ID NO: 74046 - protein, 7 aa, Mycobacterium avium
SKQFDGV

SEQ ID NO: 74047 - protein, 5 aa, Mycobacterium avium
SKQRL

SEQ ID NO: 74048 - protein, 5 aa, Mycobacterium avium
SKRPG

SEQ ID NO: 74049 - protein, 16 aa, Mycobacterium avium
SKRRTREMIASLAAEL

SEQ ID NO: 74050 - protein, 4 aa, Mycobacterium avium
SKRS

SEQ ID NO: 74051 - protein, 5 aa, Mycobacterium avium
SKSKY

SEQ ID NO: 74052 - protein, 6 aa, Mycobacterium avium
SKSLAA

SEQ ID NO: 74053 - protein, 7 aa, Mycobacterium avium
SKSLGAE

SEQ ID NO: 74054 - protein, 9 aa, Mycobacterium avium
SKSPRPDPR

SEQ ID NO: 74055 - protein, 9 aa, Mycobacterium avium
SKSRRYSTT

SEQ ID NO: 74056 - protein, 6 aa, Mycobacterium avium
SKTADQ

SEQ ID NO: 74057 - protein, 18 aa, Mycobacterium avium
SKTDQLGEGGTYPLPRTK

SEQ ID NO: 74058 - protein, 10 aa, Mycobacterium avium
SKTGARYSYQ

SEQ ID NO: 74059 - protein, 7 aa, Mycobacterium avium
SKTGKTT

SEQ ID NO: 74060 - protein, 20 aa, Mycobacterium avium
SKTPTTTTTTTSATAKPVPL

SEQ ID NO: 74061 - protein, 15 aa, Mycobacterium avium
SKTSRHSATLRRNSR

SEQ ID NO: 74062 - protein, 5 aa, Mycobacterium avium
SKVTY

SEQ ID NO: 74063 - protein, 6 aa, Mycobacterium avium
SLAGAP

SEQ ID NO: 74064 - protein, 12 aa, Mycobacterium avium
SLAGGPGGAGYG

SEQ ID NO: 74065 - protein, 11 aa, Mycobacterium avium
SLAGQQKTPDS

SEQ ID NO: 74066 - protein, 4 aa, Mycobacterium avium
SLAN

SEQ ID NO: 74067 - protein, 10 aa, Mycobacterium avium
SLANGGRPYP

SEQ ID NO: 74068 - protein, 12 aa, Mycobacterium avium
SLASSLAGRRQT

SEQ ID NO: 74069 - protein, 11 aa, Mycobacterium avium
SLATDDPRGLT

SEQ ID NO: 74070 - protein, 7 aa, Mycobacterium avium
SLDNDEN

SEQ ID NO: 74071 - protein, 17 aa, Mycobacterium avium
SLDPARHTVQRGSTPIA

SEQ ID NO: 74072 - protein, 19 aa, Mycobacterium avium
SLEAAATAPRIAADDPPLK

SEQ ID NO: 74073 - protein, 6 aa, Mycobacterium avium
SLEADG

SEQ ID NO: 74074 - protein, 5 aa, Mycobacterium avium
SLGAA

SEQ ID NO: 74075 - protein, 6 aa, Mycobacterium avium
SLGADR

SEQ ID NO: 74076 - protein, 5 aa, Mycobacterium avium
SLGFG

SEQ ID NO: 74077 - protein, 7 aa, Mycobacterium avium
SLGGAIS

SEQ ID NO: 74078 - protein, 14 aa, Mycobacterium avium
SLGREDVEGIERFE

SEQ ID NO: 74079 - protein, 8 aa, Mycobacterium avium
SLGRGFRG

SEQ ID NO: 74080 - protein, 6 aa, Mycobacterium avium
SLGSMD

SEQ ID NO: 74081 - protein, 10 aa, Mycobacterium avium
SLGSSSDLRV

SEQ ID NO: 74082 - protein, 7 aa, Mycobacterium avium
SLGTTRT

SEQ ID NO: 74083 - protein, 7 aa, Mycobacterium avium
SLHGDTA

SEQ ID NO: 74084 - protein, 10 aa, Mycobacterium avium
SLKDGRATLA

SEQ ID NO: 74085 - protein, 15 aa, Mycobacterium avium
SLNEATTDADGFHRR

SEQ ID NO: 74086 - protein, 9 aa, Mycobacterium avium
SLNEESPEI

SEQ ID NO: 74087 - protein, 7 aa, Mycobacterium avium
SLPEPQL

SEQ ID NO: 74088 - protein, 8 aa, Mycobacterium avium
SLPGDRES

SEQ ID NO: 74089 - protein, 8 aa, Mycobacterium avium
SLPPAPKL

SEQ ID NO: 74090 - protein, 21 aa, Mycobacterium avium
SLPPIGGARGDRGKPPETARK

SEQ ID NO: 74091 - protein, 5 aa, Mycobacterium avium
SLPPR

SEQ ID NO: 74092 - protein, 7 aa, Mycobacterium avium
SLPPRQR

SEQ ID NO: 74093 - protein, 11 aa, Mycobacterium avium
SLPQSPSPQGH

SEQ ID NO: 74094 - protein, 10 aa, Mycobacterium avium
SLPRTSSGKL

SEQ ID NO: 74095 - protein, 13 aa, Mycobacterium avium
SLPSHPRASHAIP

SEQ ID NO: 74096 - protein, 9 aa, Mycobacterium avium
SLPTTPIGK

SEQ ID NO: 74097 - protein, 7 aa, Mycobacterium avium
SLQPGRA

SEQ ID NO: 74098 - protein, 5 aa, Mycobacterium avium
SLRDG

SEQ ID NO: 74099 - protein, 9 aa, Mycobacterium avium
SLRKEGRER

SEQ ID NO: 74100 - protein, 6 aa, Mycobacterium avium
SLRNGG

SEQ ID NO: 74101 - protein, 4 aa, Mycobacterium avium
SLRP

SEQ ID NO: 74102 - protein, 18 aa, Mycobacterium avium
SLRPGGTDWTGAGAEAFQ

SEQ ID NO: 74103 - protein, 12 aa, Mycobacterium avium
SLSDEAADRTVT

SEQ ID NO: 74104 - protein, 9 aa, Mycobacterium avium
SLSGAAPGL

SEQ ID NO: 74105 - protein, 4 aa, Mycobacterium avium
SLST

SEQ ID NO: 74106 - protein, 23 aa, Mycobacterium avium
SLTATLSRAADRAPAEDRPDAGE

SEQ ID NO: 74107 - protein, 7 aa, Mycobacterium avium
SLTDKPV

SEQ ID NO: 74108 - protein, 17 aa, Mycobacterium avium
SLTEDEIGEYSGERKEI

SEQ ID NO: 74109 - protein, 10 aa, Mycobacterium avium
SLTEPGRSSA

SEQ ID NO: 74110 - protein, 5 aa, Mycobacterium avium
SLTGE

SEQ ID NO: 74111 - protein, 9 aa, Mycobacterium avium
SLTGPAPGA

SEQ ID NO: 74112 - protein, 9 aa, Mycobacterium avium
SLTGPEPGA

SEQ ID NO: 74113 - protein, 9 aa, Mycobacterium avium
SLTQVGSSG

SEQ ID NO: 74114 - protein, 17 aa, Mycobacterium avium
SMCGKDPSLRGQDGPMA

SEQ ID NO: 74115 - protein, 7 aa, Mycobacterium avium
SMGGGEV

SEQ ID NO: 74116 - protein, 8 aa, Mycobacterium avium
SMGKDTLD

SEQ ID NO: 74117 - protein, 18 aa, Mycobacterium avium
SMPSPASPNSPAAPLDRS

SEQ ID NO: 74118 - protein, 23 aa, Mycobacterium avium
SMRDASKTPEPVPDAKPAAGQGN

SEQ ID NO: 74119 - protein, 4 aa, Mycobacterium avium
SMTP

SEQ ID NO: 74120 - protein, 8 aa, Mycobacterium avium
SMTTNGVS

SEQ ID NO: 74121 - protein, 7 aa, Mycobacterium avium
SNADLGR

SEQ ID NO: 74122 - protein, 8 aa, Mycobacterium avium
SNALGSKD

SEQ ID NO: 74123 - protein, 21 aa, Mycobacterium avium
SNASTAVTRPAGSGAVARGYT

SEQ ID NO: 74124 - protein, 6 aa, Mycobacterium avium
SNDGDT

SEQ ID NO: 74125 - protein, 7 aa, Mycobacterium avium
SNDPVDK

SEQ ID NO: 74126 - protein, 9 aa, Mycobacterium avium
SNEATTHPY

SEQ ID NO: 74127 - protein, 5 aa, Mycobacterium avium
SNEDW

SEQ ID NO: 74128 - protein, 5 aa, Mycobacterium avium
SNFES

SEQ ID NO: 74129 - protein, 8 aa, Mycobacterium avium
SNGAGKTT

SEQ ID NO: 74130 - protein, 23 aa, Mycobacterium avium
SNGGGESIRGPWNQGQGPWPEGT

SEQ ID NO: 74131 - protein, 12 aa, Mycobacterium avium
SNGPAPDERTAT

SEQ ID NO: 74132 - protein, 9 aa, Mycobacterium avium
SNGSEPGRE

SEQ ID NO: 74133 - protein, 9 aa, Mycobacterium avium
SNGSEPGRK

SEQ ID NO: 74134 - protein, 13 aa, Mycobacterium avium
SNIAANARTAKVA

SEQ ID NO: 74135 - protein, 10 aa, Mycobacterium avium
SNIRARKRTA

SEQ ID NO: 74136 - protein, 7 aa, Mycobacterium avium
SNLGDAP

SEQ ID NO: 74137 - protein, 11 aa, Mycobacterium avium
SNLGDAPLKAA

SEQ ID NO: 74138 - protein, 12 aa, Mycobacterium avium
SNLGDAPLKAAA

SEQ ID NO: 74139 - protein, 16 aa, Mycobacterium avium
SNLPPPTDAQRPVVQP

SEQ ID NO: 74140 - protein, 10 aa, Mycobacterium avium
SNPGAASDSI

SEQ ID NO: 74141 - protein, 9 aa, Mycobacterium avium
SNPKHPAKP

SEQ ID NO: 74142 - protein, 15 aa, Mycobacterium avium
SNPQLRTDATLGEGD

SEQ ID NO: 74143 - protein, 4 aa, Mycobacterium avium
SNPS

SEQ ID NO: 74144 - protein, 9 aa, Mycobacterium avium
SNPSWRERP

SEQ ID NO: 74145 - protein, 4 aa, Mycobacterium avium
SNPV

SEQ ID NO: 74146 - protein, 8 aa, Mycobacterium avium
SNPYPGVY

SEQ ID NO: 74147 - protein, 9 aa, Mycobacterium avium
SNQGTQEGW

SEQ ID NO: 74148 - protein, 12 aa, Mycobacterium avium
SNRRANPPQTPE

SEQ ID NO: 74149 - protein, 17 aa, Mycobacterium avium
SNSAAVTPTTALAPAAA

SEQ ID NO: 74150 - protein, 17 aa, Mycobacterium avium
SNSAVAAPTTAVAPAAA

SEQ ID NO: 74151 - protein, 7 aa, Mycobacterium avium
SNSCNGT

SEQ ID NO: 74152 - protein, 7 aa, Mycobacterium avium
SNSELPA

SEQ ID NO: 74153 - protein, 4 aa, Mycobacterium avium
SNSP

SEQ ID NO: 74154 - protein, 18 aa, Mycobacterium avium
SNSQGGAGWSEWDDPTEM

SEQ ID NO: 74155 - protein, 8 aa, Mycobacterium avium
SNSQTLYD

SEQ ID NO: 74156 - protein, 10 aa, Mycobacterium avium
SNSSSYPNTI

SEQ ID NO: 74157 - protein, 10 aa, Mycobacterium avium
SNSWEYTGDG

SEQ ID NO: 74158 - protein, 5 aa, Mycobacterium avium
SNTAI

SEQ ID NO: 74159 - protein, 23 aa, Mycobacterium avium
SNTKNDAPATGDPIGGAPEPAAN

SEQ ID NO: 74160 - protein, 6 aa, Mycobacterium avium
SNTREG

SEQ ID NO: 74161 - protein, 5 aa, Mycobacterium avium
SNVGH

SEQ ID NO: 74162 - protein, 6 aa, Mycobacterium avium
SNYQGS

SEQ ID NO: 74163 - protein, 6 aa, Mycobacterium avium
SPAALR

SEQ ID NO: 74164 - protein, 11 aa, Mycobacterium avium
SPAAPPPAYDE

SEQ ID NO: 74165 - protein, 7 aa, Mycobacterium avium
SPAFSDE

SEQ ID NO: 74166 - protein, 13 aa, Mycobacterium avium
SPAFTDGAPIPPR

SEQ ID NO: 74167 - protein, 14 aa, Mycobacterium avium
SPAGAPPKDDGTRI

SEQ ID NO: 74168 - protein, 13 aa, Mycobacterium avium
SPAGRTYVTTPGS

SEQ ID NO: 74169 - protein, 9 aa, Mycobacterium avium
SPAGSEREA

SEQ ID NO: 74170 - protein, 6 aa, Mycobacterium avium
SPAHED

SEQ ID NO: 74171 - protein, 17 aa, Mycobacterium avium
SPAISRPPSAVSSSARR

SEQ ID NO: 74172 - protein, 8 aa, Mycobacterium avium
SPALGSPQ

SEQ ID NO: 74173 - protein, 9 aa, Mycobacterium avium
SPANREGAA

SEQ ID NO: 74174 - protein, 10 aa, Mycobacterium avium
SPANREGAAT

SEQ ID NO: 74175 - protein, 10 aa, Mycobacterium avium
SPANREGTAT

SEQ ID NO: 74176 - protein, 4 aa, Mycobacterium avium
SPAP

SEQ ID NO: 74177 - protein, 31 aa, Mycobacterium avium
SPAPEPDGPLSRGRATYRPPDEGRAARSSVP

SEQ ID NO: 74178 - protein, 15 aa, Mycobacterium avium
SPAQFDDDPASLTRA

SEQ ID NO: 74179 - protein, 4 aa, Mycobacterium avium
SPAR

SEQ ID NO: 74180 - protein, 8 aa, Mycobacterium avium
SPARAAEF

SEQ ID NO: 74181 - protein, 7 aa, Mycobacterium avium
SPARARY

SEQ ID NO: 74182 - protein, 7 aa, Mycobacterium avium
SPARGGR

SEQ ID NO: 74183 - protein, 22 aa, Mycobacterium avium
SPASFGGSTSSSGGGFLGGGGR

SEQ ID NO: 74184 - protein, 7 aa, Mycobacterium avium
SPDADAM

SEQ ID NO: 74185 - protein, 12 aa, Mycobacterium avium
SPDGRNKGTRSL

SEQ ID NO: 74186 - protein, 13 aa, Mycobacterium avium
SPDGSSDPIEVPD

SEQ ID NO: 74187 - protein, 4 aa, Mycobacterium avium
SPDR

SEQ ID NO: 74188 - protein, 16 aa, Mycobacterium avium
SPDRQSPVPTGNSLCT

SEQ ID NO: 74189 - protein, 20 aa, Mycobacterium avium
SPDTAGNYAGYNYDNPRATG

SEQ ID NO: 74190 - protein, 11 aa, Mycobacterium avium
SPDYPDAEEAR

SEQ ID NO: 74191 - protein, 11 aa, Mycobacterium avium
SPEAPNPEDAV

SEQ ID NO: 74192 - protein, 5 aa, Mycobacterium avium
SPEEA

SEQ ID NO: 74193 - protein, 7 aa, Mycobacterium avium
SPEFGSR

SEQ ID NO: 74194 - protein, 9 aa, Mycobacterium avium
SPEFRDDPY

SEQ ID NO: 74195 - protein, 9 aa, Mycobacterium avium
SPEFREDPY

SEQ ID NO: 74196 - protein, 16 aa, Mycobacterium avium
SPEFTPEAGSVPHDDL

SEQ ID NO: 74197 - protein, 14 aa, Mycobacterium avium
SPELTADLDPTQHG

SEQ ID NO: 74198 - protein, 6 aa, Mycobacterium avium
SPENAR

SEQ ID NO: 74199 - protein, 6 aa, Mycobacterium avium
SPEQAR

SEQ ID NO: 74200 - protein, 6 aa, Mycobacterium avium
SPEQAS

SEQ ID NO: 74201 - protein, 6 aa, Mycobacterium avium
SPEQKE

SEQ ID NO: 74202 - protein, 5 aa, Mycobacterium avium
SPEQQ

SEQ ID NO: 74203 - protein, 10 aa, Mycobacterium avium
SPESYTGTEL

SEQ ID NO: 74204 - protein, 4 aa, Mycobacterium avium
SPET

SEQ ID NO: 74205 - protein, 6 aa, Mycobacterium avium
SPEYAG

SEQ ID NO: 74206 - protein, 11 aa, Mycobacterium avium
SPFEGPTPPQR

SEQ ID NO: 74207 - protein, 5 aa, Mycobacterium avium
SPFGQ

SEQ ID NO: 74208 - protein, 4 aa, Mycobacterium avium
SPGA

SEQ ID NO: 74209 - protein, 5 aa, Mycobacterium avium
SPGAL

SEQ ID NO: 74210 - protein, 8 aa, Mycobacterium avium
SPGARTSG

SEQ ID NO: 74211 - protein, 5 aa, Mycobacterium avium
SPGER

SEQ ID NO: 74212 - protein, 13 aa, Mycobacterium avium
SPGPGTPERAGAS

SEQ ID NO: 74213 - protein, 6 aa, Mycobacterium avium
SPGPGV

SEQ ID NO: 74214 - protein, 5 aa, Mycobacterium avium
SPGTS

SEQ ID NO: 74215 - protein, 10 aa, Mycobacterium avium
SPGVDVPEER

SEQ ID NO: 74216 - protein, 11 aa, Mycobacterium avium
SPGVVDADPSR

SEQ ID NO: 74217 - protein, 7 aa, Mycobacterium avium
SPHAGSW

SEQ ID NO: 74218 - protein, 8 aa, Mycobacterium avium
SPHPDGPG

SEQ ID NO: 74219 - protein, 13 aa, Mycobacterium avium
SPIGKRNGGLSGV

SEQ ID NO: 74220 - protein, 5 aa, Mycobacterium avium
SPIGR

SEQ ID NO: 74221 - protein, 12 aa, Mycobacterium avium
SPIGSLQSPRHA

SEQ ID NO: 74222 - protein, 7 aa, Mycobacterium avium
SPIPEPD

SEQ ID NO: 74223 - protein, 6 aa, Mycobacterium avium
SPIREV

SEQ ID NO: 74224 - protein, 4 aa, Mycobacterium avium
SPIT

SEQ ID NO: 74225 - protein, 6 aa, Mycobacterium avium
SPITSV

SEQ ID NO: 74226 - protein, 18 aa, Mycobacterium avium
SPKAQQRAVAAGGDDTVR

SEQ ID NO: 74227 - protein, 23 aa, Mycobacterium avium
SPKLEGIGERGGAPVEIDSNPTA

SEQ ID NO: 74228 - protein, 10 aa, Mycobacterium avium
SPKPPPPSWT

SEQ ID NO: 74229 - protein, 8 aa, Mycobacterium avium
SPKTWSGY

SEQ ID NO: 74230 - protein, 6 aa, Mycobacterium avium
SPLDPK

SEQ ID NO: 74231 - protein, 6 aa, Mycobacterium avium
SPLDTI

SEQ ID NO: 74232 - protein, 13 aa, Mycobacterium avium
SPLLSAEDANTLG

SEQ ID NO: 74233 - protein, 8 aa, Mycobacterium avium
SPLPDDTV

SEQ ID NO: 74234 - protein, 5 aa, Mycobacterium avium
SPLTP

SEQ ID NO: 74235 - protein, 6 aa, Mycobacterium avium
SPLTPL

SEQ ID NO: 74236 - protein, 5 aa, Mycobacterium avium
SPMDG

SEQ ID NO: 74237 - protein, 6 aa, Mycobacterium avium
SPNAEL

SEQ ID NO: 74238 - protein, 10 aa, Mycobacterium avium
SPNDIDTFTS

SEQ ID NO: 74239 - protein, 4 aa, Mycobacterium avium
SPNR

SEQ ID NO: 74240 - protein, 14 aa, Mycobacterium avium
SPPADGRAEAAPAA

SEQ ID NO: 74241 - protein, 6 aa, Mycobacterium avium
SPPEMD

SEQ ID NO: 74242 - protein, 8 aa, Mycobacterium avium
SPPGQRQQ

SEQ ID NO: 74243 - protein, 12 aa, Mycobacterium avium
SPPPAPRDDERA

SEQ ID NO: 74244 - protein, 6 aa, Mycobacterium avium
SPPVHR

SEQ ID NO: 74245 - protein, 4 aa, Mycobacterium avium
SPQF

SEQ ID NO: 74246 - protein, 5 aa, Mycobacterium avium
SPQLA

SEQ ID NO: 74247 - protein, 5 aa, Mycobacterium avium
SPQQR

SEQ ID NO: 74248 - protein, 11 aa, Mycobacterium avium
SPQRTSGGGRW

SEQ ID NO: 74249 - protein, 5 aa, Mycobacterium avium
SPRAV

SEQ ID NO: 74250 - protein, 5 aa, Mycobacterium avium
SPRHA

SEQ ID NO: 74251 - protein, 16 aa, Mycobacterium avium
SPRIAQSPADGARSTI

SEQ ID NO: 74252 - protein, 25 aa, Mycobacterium avium
SPRSTPEQRTAAQNELAHQPRDASA

SEQ ID NO: 74253 - protein, 7 aa, Mycobacterium avium
SPRTARE

SEQ ID NO: 74254 - protein, 8 aa, Mycobacterium avium
SPRTAREQ

SEQ ID NO: 74255 - protein, 5 aa, Mycobacterium avium
SPRTT

SEQ ID NO: 74256 - protein, 5 aa, Mycobacterium avium
SPSDL

SEQ ID NO: 74257 - protein, 9 aa, Mycobacterium avium
SPSKPGLPL

SEQ ID NO: 74258 - protein, 15 aa, Mycobacterium avium
SPSNRGTSNVLVSQH

SEQ ID NO: 74259 - protein, 4 aa, Mycobacterium avium
SPSP

SEQ ID NO: 74260 - protein, 12 aa, Mycobacterium avium
SPTAAPPAYDES

SEQ ID NO: 74261 - protein, 14 aa, Mycobacterium avium
SPTGRAYRTSPAGA

SEQ ID NO: 74262 - protein, 7 aa, Mycobacterium avium
SPTGTPH

SEQ ID NO: 74263 - protein, 7 aa, Mycobacterium avium
SPTKARK

SEQ ID NO: 74264 - protein, 9 aa, Mycobacterium avium
SPTNRRVAG

SEQ ID NO: 74265 - protein, 26 aa, Mycobacterium avium
SPTPAVPTTGPTTRSITGSTAAVANR

SEQ ID NO: 74266 - protein, 21 aa, Mycobacterium avium
SPTPAVPTTGSTTGSTAAVAN

SEQ ID NO: 74267 - protein, 6 aa, Mycobacterium avium
SPTSTV

SEQ ID NO: 74268 - protein, 12 aa, Mycobacterium avium
SPTTLAGPPRAM

SEQ ID NO: 74269 - protein, 4 aa, Mycobacterium avium
SPVA

SEQ ID NO: 74270 - protein, 7 aa, Mycobacterium avium
SPVPEPE

SEQ ID NO: 74271 - protein, 6 aa, Mycobacterium avium
SPVRSL

SEQ ID NO: 74272 - protein, 6 aa, Mycobacterium avium
SPVTPA

SEQ ID NO: 74273 - protein, 7 aa, Mycobacterium avium
SQAAMAN

SEQ ID NO: 74274 - protein, 6 aa, Mycobacterium avium
SQAFGP

SEQ ID NO: 74275 - protein, 6 aa, Mycobacterium avium
SQAGLP

SEQ ID NO: 74276 - protein, 10 aa, Mycobacterium avium
SQAGQSAPGL

SEQ ID NO: 74277 - protein, 15 aa, Mycobacterium avium
SQARRSRAKRVATHR

SEQ ID NO: 74278 - protein, 8 aa, Mycobacterium avium
SQDLPGDS

SEQ ID NO: 74279 - protein, 8 aa, Mycobacterium avium
SQDLPGDT

SEQ ID NO: 74280 - protein, 7 aa, Mycobacterium avium
SQDLTGD

SEQ ID NO: 74281 - protein, 8 aa, Mycobacterium avium
SQDSDEYA

SEQ ID NO: 74282 - protein, 9 aa, Mycobacterium avium
SQDSDEYAT

SEQ ID NO: 74283 - protein, 7 aa, Mycobacterium avium
SQEQKDR

SEQ ID NO: 74284 - protein, 6 aa, Mycobacterium avium
SQERAD

SEQ ID NO: 74285 - protein, 5 aa, Mycobacterium avium
SQESQ

SEQ ID NO: 74286 - protein, 7 aa, Mycobacterium avium
SQESQTK

SEQ ID NO: 74287 - protein, 4 aa, Mycobacterium avium
SQFG

SEQ ID NO: 74288 - protein, 9 aa, Mycobacterium avium
SQFSPSIEE

SEQ ID NO: 74289 - protein, 10 aa, Mycobacterium avium
SQGGRRSAAD

SEQ ID NO: 74290 - protein, 7 aa, Mycobacterium avium
SQGPSPL

SEQ ID NO: 74291 - protein, 9 aa, Mycobacterium avium
SQGQQDAWS

SEQ ID NO: 74292 - protein, 89 aa, Mycobacterium avium
SQGSPPAGPPPFGAPPPFAPPPSGPPPFAPPPSGPPPFGPPPPDAGPVPAPPAGVAPQAAPSPPAGPAPQAPSPAAAGPAPNAPKKPGP

SEQ ID NO: 74293 - protein, 6 aa, Mycobacterium avium
SQHEYG

SEQ ID NO: 74294 - protein, 7 aa, Mycobacterium avium
SQHEYGN

SEQ ID NO: 74295 - protein, 7 aa, Mycobacterium avium
SQISDGA

SEQ ID NO: 74296 - protein, 11 aa, Mycobacterium avium
SQLNPGSEAVD

SEQ ID NO: 74297 - protein, 5 aa, Mycobacterium avium
SQLRE

SEQ ID NO: 74298 - protein, 4 aa, Mycobacterium avium
SQMA

SEQ ID NO: 74299 - protein, 7 aa, Mycobacterium avium
SQNTTRR

SEQ ID NO: 74300 - protein, 7 aa, Mycobacterium avium
SQPAVSR

SEQ ID NO: 74301 - protein, 7 aa, Mycobacterium avium
SQPDAGA

SEQ ID NO: 74302 - protein, 8 aa, Mycobacterium avium
SQPGADQQ

SEQ ID NO: 74303 - protein, 6 aa, Mycobacterium avium
SQPPEI

SEQ ID NO: 74304 - protein, 8 aa, Mycobacterium avium
SQPVDEAS

SEQ ID NO: 74305 - protein, 16 aa, Mycobacterium avium
SQQAAATAPEAGDAAP

SEQ ID NO: 74306 - protein, 7 aa, Mycobacterium avium
SQQQETL

SEQ ID NO: 74307 - protein, 13 aa, Mycobacterium avium
SQRAGDVGARHDA

SEQ ID NO: 74308 - protein, 6 aa, Mycobacterium avium
SQRTEN

SEQ ID NO: 74309 - protein, 11 aa, Mycobacterium avium
SQSNGSEPGRE

SEQ ID NO: 74310 - protein, 22 aa, Mycobacterium avium
SQSPTPPPEAATQHSDPRIAQA

SEQ ID NO: 74311 - protein, 5 aa, Mycobacterium avium
SQTGL

SEQ ID NO: 74312 - protein, 5 aa, Mycobacterium avium
SQTIS

SEQ ID NO: 74313 - protein, 6 aa, Mycobacterium avium
SQTPQT

SEQ ID NO: 74314 - protein, 5 aa, Mycobacterium avium
SQTPS

SEQ ID NO: 74315 - protein, 15 aa, Mycobacterium avium
SQTPSAAAALSPERL

SEQ ID NO: 74316 - protein, 15 aa, Mycobacterium avium
SQTPSAAGALSPEGL

SEQ ID NO: 74317 - protein, 15 aa, Mycobacterium avium
SQTPSAAGTLSPEGL

SEQ ID NO: 74318 - protein, 17 aa, Mycobacterium avium
SQTPSAAGTLSPEGLES

SEQ ID NO: 74319 - protein, 7 aa, Mycobacterium avium
SQTPSAF

SEQ ID NO: 74320 - protein, 21 aa, Mycobacterium avium
SQTQWYSDDSGDRVFTPRRYE

SEQ ID NO: 74321 - protein, 12 aa, Mycobacterium avium
SQTVIGGPPEQI

SEQ ID NO: 74322 - protein, 17 aa, Mycobacterium avium
SQVQNPDPHWPQTDGPK

SEQ ID NO: 74323 - protein, 5 aa, Mycobacterium avium
SQVYA

SEQ ID NO: 74324 - protein, 13 aa, Mycobacterium avium
SQYDAARDGSKYL

SEQ ID NO: 74325 - protein, 17 aa, Mycobacterium avium
SRAAADLDDPEVMENAW

SEQ ID NO: 74326 - protein, 31 aa, Mycobacterium avium
SRAAAVTQTQAQVQQAAADHAAARADAQACD

SEQ ID NO: 74327 - protein, 5 aa, Mycobacterium avium
SRAEQ

SEQ ID NO: 74328 - protein, 8 aa, Mycobacterium avium
SRAGDADA

SEQ ID NO: 74329 - protein, 9 aa, Mycobacterium avium
SRAGPPHAQ

SEQ ID NO: 74330 - protein, 10 aa, Mycobacterium avium
SRAMAAGAAP

SEQ ID NO: 74331 - protein, 12 aa, Mycobacterium avium
SRAMAAGAAPTW

SEQ ID NO: 74332 - protein, 7 aa, Mycobacterium avium
SRARAAG

SEQ ID NO: 74333 - protein, 9 aa, Mycobacterium avium
SRARAAGLP

SEQ ID NO: 74334 - protein, 4 aa, Mycobacterium avium
SRAS

SEQ ID NO: 74335 - protein, 7 aa, Mycobacterium avium
SRASDGA

SEQ ID NO: 74336 - protein, 7 aa, Mycobacterium avium
SRATVST

SEQ ID NO: 74337 - protein, 4 aa, Mycobacterium avium
SRAW

SEQ ID NO: 74338 - protein, 16 aa, Mycobacterium avium
SRDGNTAYRAGRDIQA

SEQ ID NO: 74339 - protein, 10 aa, Mycobacterium avium
SRDGRRTERF

SEQ ID NO: 74340 - protein, 10 aa, Mycobacterium avium
SRDPQIETGE

SEQ ID NO: 74341 - protein, 19 aa, Mycobacterium avium
SRDRGPVRLPDPPGGATNL

SEQ ID NO: 74342 - protein, 6 aa, Mycobacterium avium
SRDSTR

SEQ ID NO: 74343 - protein, 11 aa, Mycobacterium avium
SRDTQPQAGPT

SEQ ID NO: 74344 - protein, 7 aa, Mycobacterium avium
SRDVPRK

SEQ ID NO: 74345 - protein, 7 aa, Mycobacterium avium
SREDNER

SEQ ID NO: 74346 - protein, 7 aa, Mycobacterium avium
SREDQDE

SEQ ID NO: 74347 - protein, 8 aa, Mycobacterium avium
SREHTEAR

SEQ ID NO: 74348 - protein, 9 aa, Mycobacterium avium
SRELRNDTA

SEQ ID NO: 74349 - protein, 7 aa, Mycobacterium avium
SRFDDDA

SEQ ID NO: 74350 - protein, 12 aa, Mycobacterium avium
SRGCGRSPAPGS

SEQ ID NO: 74351 - protein, 8 aa, Mycobacterium avium
SRGDVEPH

SEQ ID NO: 74352 - protein, 5 aa, Mycobacterium avium
SRGEI

SEQ ID NO: 74353 - protein, 10 aa, Mycobacterium avium
SRGEIGASTI

SEQ ID NO: 74354 - protein, 19 aa, Mycobacterium avium
SRGGKAVSDFSDVGDEEQV

SEQ ID NO: 74355 - protein, 7 aa, Mycobacterium avium
SRGGRAG

SEQ ID NO: 74356 - protein, 13 aa, Mycobacterium avium
SRGGSGSADMSMT

SEQ ID NO: 74357 - protein, 9 aa, Mycobacterium avium
SRGGTAVSD

SEQ ID NO: 74358 - protein, 9 aa, Mycobacterium avium
SRGPDGSVA

SEQ ID NO: 74359 - protein, 26 aa, Mycobacterium avium
SRGRGTGGGAATRGGVPDYAIGARRC

SEQ ID NO: 74360 - protein, 19 aa, Mycobacterium avium
SRGRRRPDRLQDATRPFGE

SEQ ID NO: 74361 - protein, 13 aa, Mycobacterium avium
SRGRSAEASDEEI

SEQ ID NO: 74362 - protein, 4 aa, Mycobacterium avium
SRIQ

SEQ ID NO: 74363 - protein, 11 aa, Mycobacterium avium
SRKQSAATARH

SEQ ID NO: 74364 - protein, 19 aa, Mycobacterium avium
SRLAGAYGEDAAAEIAALL

SEQ ID NO: 74365 - protein, 9 aa, Mycobacterium avium
SRLEGDRSG

SEQ ID NO: 74366 - protein, 31 aa, Mycobacterium avium
SRLGGNTKGPQPPGPPSAPPTPWTESTRGQS

SEQ ID NO: 74367 - protein, 6 aa, Mycobacterium avium
SRLNPA

SEQ ID NO: 74368 - protein, 26 aa, Mycobacterium avium
SRLPGDCPYADRSGGVLPGYGGSKAA

SEQ ID NO: 74369 - protein, 14 aa, Mycobacterium avium
SRLRPNGPGGLRAS

SEQ ID NO: 74370 - protein, 5 aa, Mycobacterium avium
SRMRG

SEQ ID NO: 74371 - protein, 20 aa, Mycobacterium avium
SRNATAPNSDAERRIDEPLS

SEQ ID NO: 74372 - protein, 7 aa, Mycobacterium avium
SRNEELQ

SEQ ID NO: 74373 - protein, 8 aa, Mycobacterium avium
SRNPDKAA

SEQ ID NO: 74374 - protein, 65 aa, Mycobacterium avium
SRPAKDQRSAKSSRTRRAEASKAAAKAPAKKAPAKKAPAKKAPAKTAAKKAPAKTSETSDAKGGS

SEQ ID NO: 74375 - protein, 7 aa, Mycobacterium avium
SRPDAVR

SEQ ID NO: 74376 - protein, 8 aa, Mycobacterium avium
SRPDGAVD

SEQ ID NO: 74377 - protein, 16 aa, Mycobacterium avium
SRPERQRRISAQRRAE

SEQ ID NO: 74378 - protein, 7 aa, Mycobacterium avium
SRPGADF

SEQ ID NO: 74379 - protein, 5 aa, Mycobacterium avium
SRPGD

SEQ ID NO: 74380 - protein, 8 aa, Mycobacterium avium
SRPGRSAL

SEQ ID NO: 74381 - protein, 11 aa, Mycobacterium avium
SRPGRSALAGN

SEQ ID NO: 74382 - protein, 9 aa, Mycobacterium avium
SRPLPDGMR

SEQ ID NO: 74383 - protein, 22 aa, Mycobacterium avium
SRPPGLSDRGTHALKGKSAPTA

SEQ ID NO: 74384 - protein, 9 aa, Mycobacterium avium
SRPRPCQPS

SEQ ID NO: 74385 - protein, 12 aa, Mycobacterium avium
SRPSSPEREQEY

SEQ ID NO: 74386 - protein, 16 aa, Mycobacterium avium
SRPTIGESAVEAAAKR

SEQ ID NO: 74387 - protein, 9 aa, Mycobacterium avium
SRPTSTPAH

SEQ ID NO: 74388 - protein, 5 aa, Mycobacterium avium
SRPVR

SEQ ID NO: 74389 - protein, 23 aa, Mycobacterium avium
SRQSPSEPSQPPSAAGFRCNGID

SEQ ID NO: 74390 - protein, 12 aa, Mycobacterium avium
SRQSRDHQGGEH

SEQ ID NO: 74391 - protein, 13 aa, Mycobacterium avium
SRQSRDHQGGEHF

SEQ ID NO: 74392 - protein, 14 aa, Mycobacterium avium
SRRAGREWTNRPAD

SEQ ID NO: 74393 - protein, 5 aa, Mycobacterium avium
SRRAL

SEQ ID NO: 74394 - protein, 5 aa, Mycobacterium avium
SRRDG

SEQ ID NO: 74395 - protein, 7 aa, Mycobacterium avium
SRRGEEL

SEQ ID NO: 74396 - protein, 10 aa, Mycobacterium avium
SRRGREVTGE

SEQ ID NO: 74397 - protein, 8 aa, Mycobacterium avium
SRRPGETA

SEQ ID NO: 74398 - protein, 12 aa, Mycobacterium avium
SRRPPAGLSPQE

SEQ ID NO: 74399 - protein, 8 aa, Mycobacterium avium
SRRRRGDN

SEQ ID NO: 74400 - protein, 21 aa, Mycobacterium avium
SRRVAEAGRRYASNEADSANA

SEQ ID NO: 74401 - protein, 8 aa, Mycobacterium avium
SRSEPNQR

SEQ ID NO: 74402 - protein, 11 aa, Mycobacterium avium
SRSGAADRRAH

SEQ ID NO: 74403 - protein, 7 aa, Mycobacterium avium
SRSLGAD

SEQ ID NO: 74404 - protein, 15 aa, Mycobacterium avium
SRSMPTSRRAGAAAP

SEQ ID NO: 74405 - protein, 6 aa, Mycobacterium avium
SRSPAA

SEQ ID NO: 74406 - protein, 7 aa, Mycobacterium avium
SRSTAGS

SEQ ID NO: 74407 - protein, 8 aa, Mycobacterium avium
SRTAASAG

SEQ ID NO: 74408 - protein, 24 aa, Mycobacterium avium
SRTAPETPRPAAPVTDATAILDEW

SEQ ID NO: 74409 - protein, 24 aa, Mycobacterium avium
SRTAPQTPRPAAPVTDATAILDEW

SEQ ID NO: 74410 - protein, 14 aa, Mycobacterium avium
SRTDAHGNPLSQQE

SEQ ID NO: 74411 - protein, 16 aa, Mycobacterium avium
SRTEQPGGKTSPEELA

SEQ ID NO: 74412 - protein, 11 aa, Mycobacterium avium
SRTERGERPAR

SEQ ID NO: 74413 - protein, 6 aa, Mycobacterium avium
SRTESD

SEQ ID NO: 74414 - protein, 4 aa, Mycobacterium avium
SRTG

SEQ ID NO: 74415 - protein, 16 aa, Mycobacterium avium
SRTGTLATIGRDGQPH

SEQ ID NO: 74416 - protein, 11 aa, Mycobacterium avium
SRTPGAAGKYA

SEQ ID NO: 74417 - protein, 15 aa, Mycobacterium avium
SRTRDRQVSAPMPGL

SEQ ID NO: 74418 - protein, 6 aa, Mycobacterium avium
SRTSLT

SEQ ID NO: 74419 - protein, 7 aa, Mycobacterium avium
SRTTHTR

SEQ ID NO: 74420 - protein, 7 aa, Mycobacterium avium
SRVPGTQ

SEQ ID NO: 74421 - protein, 8 aa, Mycobacterium avium
SRVRAQSS

SEQ ID NO: 74422 - protein, 6 aa, Mycobacterium avium
SRYTGG

SEQ ID NO: 74423 - protein, 4 aa, Mycobacterium avium
SRYV

SEQ ID NO: 74424 - protein, 6 aa, Mycobacterium avium
SSAAAQ

SEQ ID NO: 74425 - protein, 8 aa, Mycobacterium avium
SSAAASAR

SEQ ID NO: 74426 - protein, 7 aa, Mycobacterium avium
SSAAETI

SEQ ID NO: 74427 - protein, 19 aa, Mycobacterium avium
SSAAKGDESAADATEFDAR

SEQ ID NO: 74428 - protein, 9 aa, Mycobacterium avium
SSAAKSAKY

SEQ ID NO: 74429 - protein, 20 aa, Mycobacterium avium
SSAAPRGPAPPGRRLQSNRR

SEQ ID NO: 74430 - protein, 11 aa, Mycobacterium avium
SSADRTKADNA

SEQ ID NO: 74431 - protein, 8 aa, Mycobacterium avium
SSAEETAK

SEQ ID NO: 74432 - protein, 14 aa, Mycobacterium avium
SSAKALIGSRATRD

SEQ ID NO: 74433 - protein, 7 aa, Mycobacterium avium
SSANTRN

SEQ ID NO: 74434 - protein, 25 aa, Mycobacterium avium
SSANYTSLSGNVPGRGVNSGGVSVL

SEQ ID NO: 74435 - protein, 46 aa, Mycobacterium avium
SSAPSRPEAPAGRGRAAAKMPGRRSARSESPSSTSPSARSRKAAPP

SEQ ID NO: 74436 - protein, 9 aa, Mycobacterium avium
SSARARALA

SEQ ID NO: 74437 - protein, 7 aa, Mycobacterium avium
SSARTAA

SEQ ID NO: 74438 - protein, 4 aa, Mycobacterium avium
SSAT

SEQ ID NO: 74439 - protein, 12 aa, Mycobacterium avium
SSAVGREIGRRG

SEQ ID NO: 74440 - protein, 5 aa, Mycobacterium avium
SSDER

SEQ ID NO: 74441 - protein, 9 aa, Mycobacterium avium
SSDGAVTDG

SEQ ID NO: 74442 - protein, 17 aa, Mycobacterium avium
SSDLSGRRGGKRATRHP

SEQ ID NO: 74443 - protein, 7 aa, Mycobacterium avium
SSDPVTH

SEQ ID NO: 74444 - protein, 13 aa, Mycobacterium avium
SSDRNDPHELGRE

SEQ ID NO: 74445 - protein, 13 aa, Mycobacterium avium
SSDRYPGEDQAPA

SEQ ID NO: 74446 - protein, 12 aa, Mycobacterium avium
SSEKPDPALTGA

SEQ ID NO: 74447 - protein, 12 aa, Mycobacterium avium
SSEKPEPALTGA

SEQ ID NO: 74448 - protein, 12 aa, Mycobacterium avium
SSEKPNPALTGA

SEQ ID NO: 74449 - protein, 7 aa, Mycobacterium avium
SSEPERR

SEQ ID NO: 74450 - protein, 20 aa, Mycobacterium avium
SSESSAASAARRPSGGPATS

SEQ ID NO: 74451 - protein, 4 aa, Mycobacterium avium
SSFV

SEQ ID NO: 74452 - protein, 14 aa, Mycobacterium avium
SSGAGAVRANHPDM

SEQ ID NO: 74453 - protein, 8 aa, Mycobacterium avium
SSGAKGSD

SEQ ID NO: 74454 - protein, 6 aa, Mycobacterium avium
SSGDLS

SEQ ID NO: 74455 - protein, 24 aa, Mycobacterium avium
SSGEDPDKPGKKDPDSGSNPSDPF

SEQ ID NO: 74456 - protein, 10 aa, Mycobacterium avium
SSGEKKTLPR

SEQ ID NO: 74457 - protein, 17 aa, Mycobacterium avium
SSGFSGDRVCALPETGR

SEQ ID NO: 74458 - protein, 18 aa, Mycobacterium avium
SSGGKPTVTLPGAGPAGS

SEQ ID NO: 74459 - protein, 8 aa, Mycobacterium avium
SSGKITMT

SEQ ID NO: 74460 - protein, 4 aa, Mycobacterium avium
SSGN

SEQ ID NO: 74461 - protein, 6 aa, Mycobacterium avium
SSGPCL

SEQ ID NO: 74462 - protein, 9 aa, Mycobacterium avium
SSGPGPGSL

SEQ ID NO: 74463 - protein, 6 aa, Mycobacterium avium
SSGPGV

SEQ ID NO: 74464 - protein, 6 aa, Mycobacterium avium
SSGSAR

SEQ ID NO: 74465 - protein, 5 aa, Mycobacterium avium
SSGSP

SEQ ID NO: 74466 - protein, 21 aa, Mycobacterium avium
SSGSVGIAASSGSVGIAASAA

SEQ ID NO: 74467 - protein, 16 aa, Mycobacterium avium
SSGSYAATEAANAAAA

SEQ ID NO: 74468 - protein, 4 aa, Mycobacterium avium
SSGT

SEQ ID NO: 74469 - protein, 7 aa, Mycobacterium avium
SSGTTDL

SEQ ID NO: 74470 - protein, 12 aa, Mycobacterium avium
SSGTTGRPKGIR

SEQ ID NO: 74471 - protein, 7 aa, Mycobacterium avium
SSGTTSI

SEQ ID NO: 74472 - protein, 6 aa, Mycobacterium avium
SSIESA

SEQ ID NO: 74473 - protein, 6 aa, Mycobacterium avium
SSIKSA

SEQ ID NO: 74474 - protein, 4 aa, Mycobacterium avium
SSIS

SEQ ID NO: 74475 - protein, 8 aa, Mycobacterium avium
SSKPENVP

SEQ ID NO: 74476 - protein, 21 aa, Mycobacterium avium
SSKSSGGAGSSKSDDDTKRRF

SEQ ID NO: 74477 - protein, 7 aa, Mycobacterium avium
SSLAPGA

SEQ ID NO: 74478 - protein, 18 aa, Mycobacterium avium
SSLGAAAAAEVNAGDRDY

SEQ ID NO: 74479 - protein, 4 aa, Mycobacterium avium
SSLP

SEQ ID NO: 74480 - protein, 7 aa, Mycobacterium avium
SSLQPRA

SEQ ID NO: 74481 - protein, 24 aa, Mycobacterium avium
SSLTGASGKGATKSASTGAGAGLA

SEQ ID NO: 74482 - protein, 6 aa, Mycobacterium avium
SSNLSQ

SEQ ID NO: 74483 - protein, 10 aa, Mycobacterium avium
SSNSQGGAGW

SEQ ID NO: 74484 - protein, 13 aa, Mycobacterium avium
SSNTAANARTAKV

SEQ ID NO: 74485 - protein, 9 aa, Mycobacterium avium
SSPAAAEDE

SEQ ID NO: 74486 - protein, 13 aa, Mycobacterium avium
SSPAYADKTNATA

SEQ ID NO: 74487 - protein, 7 aa, Mycobacterium avium
SSPEPVD

SEQ ID NO: 74488 - protein, 4 aa, Mycobacterium avium
SSPG

SEQ ID NO: 74489 - protein, 6 aa, Mycobacterium avium
SSPMTA

SEQ ID NO: 74490 - protein, 13 aa, Mycobacterium avium
SSPNMHGDKEYQH

SEQ ID NO: 74491 - protein, 9 aa, Mycobacterium avium
SSPSVSEWT

SEQ ID NO: 74492 - protein, 4 aa, Mycobacterium avium
SSPT

SEQ ID NO: 74493 - protein, 7 aa, Mycobacterium avium
SSQAAAD

SEQ ID NO: 74494 - protein, 9 aa, Mycobacterium avium
SSQAEAVEE

SEQ ID NO: 74495 - protein, 5 aa, Mycobacterium avium
SSQAG

SEQ ID NO: 74496 - protein, 4 aa, Mycobacterium avium
SSQG

SEQ ID NO: 74497 - protein, 9 aa, Mycobacterium avium
SSQGVRPDR

SEQ ID NO: 74498 - protein, 8 aa, Mycobacterium avium
SSQGVRPE

SEQ ID NO: 74499 - protein, 10 aa, Mycobacterium avium
SSQPCPPPST

SEQ ID NO: 74500 - protein, 5 aa, Mycobacterium avium
SSQRQ

SEQ ID NO: 74501 - protein, 6 aa, Mycobacterium avium
SSQRQL

SEQ ID NO: 74502 - protein, 6 aa, Mycobacterium avium
SSRDVN

SEQ ID NO: 74503 - protein, 14 aa, Mycobacterium avium
SSREDVADTPSRRR

SEQ ID NO: 74504 - protein, 13 aa, Mycobacterium avium
SSRERAELAVSRS

SEQ ID NO: 74505 - protein, 25 aa, Mycobacterium avium
SSRLGKHSREVNPAVGSGNGIPPPP

SEQ ID NO: 74506 - protein, 9 aa, Mycobacterium avium
SSRPAPRTT

SEQ ID NO: 74507 - protein, 5 aa, Mycobacterium avium
SSRPE

SEQ ID NO: 74508 - protein, 21 aa, Mycobacterium avium
SSRRAVADAGLTKEDIDGFGG

SEQ ID NO: 74509 - protein, 6 aa, Mycobacterium avium
SSRRGE

SEQ ID NO: 74510 - protein, 9 aa, Mycobacterium avium
SSRSEDFKE

SEQ ID NO: 74511 - protein, 8 aa, Mycobacterium avium
SSRVPEEV

SEQ ID NO: 74512 - protein, 4 aa, Mycobacterium avium
SSSA

SEQ ID NO: 74513 - protein, 23 aa, Mycobacterium avium
SSSAGLKATGTDRAGAQAYTAAK

SEQ ID NO: 74514 - protein, 23 aa, Mycobacterium avium
SSSAGLKGTGTDRAGGQAYTAAK

SEQ ID NO: 74515 - protein, 24 aa, Mycobacterium avium
SSSAGLKGTGTDRAGGQAYTASKR

SEQ ID NO: 74516 - protein, 41 aa, Mycobacterium avium
SSSAKRKAPEPDSAAAAAAAAARNAARSRRRRRATRRGHGE

SEQ ID NO: 74517 - protein, 11 aa, Mycobacterium avium
SSSDEGLRETA

SEQ ID NO: 74518 - protein, 43 aa, Mycobacterium avium
SSSGESSPAIGPGSSGCTAASASGSARSRRCGRSAGSSVCMAR

SEQ ID NO: 74519 - protein, 8 aa, Mycobacterium avium
SSSPVAAE

SEQ ID NO: 74520 - protein, 7 aa, Mycobacterium avium
SSSQSRR

SEQ ID NO: 74521 - protein, 17 aa, Mycobacterium avium
SSSRRVLGDEDSTGKLD

SEQ ID NO: 74522 - protein, 7 aa, Mycobacterium avium
SSSSEAV

SEQ ID NO: 74523 - protein, 15 aa, Mycobacterium avium
SSSSLTKSSPDSPHV

SEQ ID NO: 74524 - protein, 8 aa, Mycobacterium avium
SSSYAQVP

SEQ ID NO: 74525 - protein, 7 aa, Mycobacterium avium
SSTAEVT

SEQ ID NO: 74526 - protein, 7 aa, Mycobacterium avium
SSTDPEV

SEQ ID NO: 74527 - protein, 19 aa, Mycobacterium avium
SSTFAGKDKTVGPSGACGQ

SEQ ID NO: 74528 - protein, 6 aa, Mycobacterium avium
SSTKME

SEQ ID NO: 74529 - protein, 20 aa, Mycobacterium avium
SSTMEPGKPITATDSSSVTV

SEQ ID NO: 74530 - protein, 7 aa, Mycobacterium avium
SSTPWPE

SEQ ID NO: 74531 - protein, 16 aa, Mycobacterium avium
SSTVGRPKLAGAAGVA

SEQ ID NO: 74532 - protein, 7 aa, Mycobacterium avium
SSVPQTL

SEQ ID NO: 74533 - protein, 20 aa, Mycobacterium avium
SSVSAADLAQGGAKPRVARD

SEQ ID NO: 74534 - protein, 7 aa, Mycobacterium avium
SSWNQTS

SEQ ID NO: 74535 - protein, 7 aa, Mycobacterium avium
SSWPGCP

SEQ ID NO: 74536 - protein, 17 aa, Mycobacterium avium
SSWSGPADSPDVEGIPP

SEQ ID NO: 74537 - protein, 6 aa, Mycobacterium avium
SSYCSG

SEQ ID NO: 74538 - protein, 10 aa, Mycobacterium avium
SSYGVSGTNA

SEQ ID NO: 74539 - protein, 7 aa, Mycobacterium avium
SSYRGSK

SEQ ID NO: 74540 - protein, 9 aa, Mycobacterium avium
SSYSDKKGT

SEQ ID NO: 74541 - protein, 6 aa, Mycobacterium avium
STAAGI

SEQ ID NO: 74542 - protein, 7 aa, Mycobacterium avium
STAAGIA

SEQ ID NO: 74543 - protein, 12 aa, Mycobacterium avium
STAAKSQRYATE

SEQ ID NO: 74544 - protein, 10 aa, Mycobacterium avium
STAANAAPGL

SEQ ID NO: 74545 - protein, 5 aa, Mycobacterium avium
STAAQ

SEQ ID NO: 74546 - protein, 5 aa, Mycobacterium avium
STAAT

SEQ ID NO: 74547 - protein, 14 aa, Mycobacterium avium
STAGASPASGRSFS

SEQ ID NO: 74548 - protein, 29 aa, Mycobacterium avium
STAGAVSTNDKAPAPSPILTAGSDKPECI

SEQ ID NO: 74549 - protein, 6 aa, Mycobacterium avium
STAGQA

SEQ ID NO: 74550 - protein, 11 aa, Mycobacterium avium
STALPGDSDFA

SEQ ID NO: 74551 - protein, 20 aa, Mycobacterium avium
STAQPGAAGRHADDLVGAQC

SEQ ID NO: 74552 - protein, 12 aa, Mycobacterium avium
STARSDLRKGLR

SEQ ID NO: 74553 - protein, 13 aa, Mycobacterium avium
STARTPGRGRPAT

SEQ ID NO: 74554 - protein, 19 aa, Mycobacterium avium
STATPGSDRLAAQTDPYAS

SEQ ID NO: 74555 - protein, 4 aa, Mycobacterium avium
STAV

SEQ ID NO: 74556 - protein, 7 aa, Mycobacterium avium
STAVRAG

SEQ ID NO: 74557 - protein, 7 aa, Mycobacterium avium
STDAGEL

SEQ ID NO: 74558 - protein, 11 aa, Mycobacterium avium
STDCRQRAAQR

SEQ ID NO: 74559 - protein, 6 aa, Mycobacterium avium
STDDDG

SEQ ID NO: 74560 - protein, 7 aa, Mycobacterium avium
STDIGQA

SEQ ID NO: 74561 - protein, 17 aa, Mycobacterium avium
STDKLGRGSAVTSKHTR

SEQ ID NO: 74562 - protein, 10 aa, Mycobacterium avium
STDKTRASID

SEQ ID NO: 74563 - protein, 9 aa, Mycobacterium avium
STDPRSRVP

SEQ ID NO: 74564 - protein, 6 aa, Mycobacterium avium
STDRGL

SEQ ID NO: 74565 - protein, 9 aa, Mycobacterium avium
STDSPFANE

SEQ ID NO: 74566 - protein, 11 aa, Mycobacterium avium
STEEQLEYGTP

SEQ ID NO: 74567 - protein, 10 aa, Mycobacterium avium
STEEQRSLRS

SEQ ID NO: 74568 - protein, 24 aa, Mycobacterium avium
STEHPTITSARSTDAAPARMGTDG

SEQ ID NO: 74569 - protein, 5 aa, Mycobacterium avium
STEHT

SEQ ID NO: 74570 - protein, 6 aa, Mycobacterium avium
STEHTR

SEQ ID NO: 74571 - protein, 10 aa, Mycobacterium avium
STEPAAYDQE

SEQ ID NO: 74572 - protein, 6 aa, Mycobacterium avium
STEPGR

SEQ ID NO: 74573 - protein, 7 aa, Mycobacterium avium
STGAVAE

SEQ ID NO: 74574 - protein, 6 aa, Mycobacterium avium
STGEEF

SEQ ID NO: 74575 - protein, 16 aa, Mycobacterium avium
STGGLTEPARTDTERA

SEQ ID NO: 74576 - protein, 6 aa, Mycobacterium avium
STGGPL

SEQ ID NO: 74577 - protein, 8 aa, Mycobacterium avium
STGSFAGE

SEQ ID NO: 74578 - protein, 9 aa, Mycobacterium avium
STGTRHAGP

SEQ ID NO: 74579 - protein, 6 aa, Mycobacterium avium
STHREE

SEQ ID NO: 74580 - protein, 6 aa, Mycobacterium avium
STIGPL

SEQ ID NO: 74581 - protein, 8 aa, Mycobacterium avium
STKAVRAE

SEQ ID NO: 74582 - protein, 7 aa, Mycobacterium avium
STKPPRI

SEQ ID NO: 74583 - protein, 6 aa, Mycobacterium avium
STKQRR

SEQ ID NO: 74584 - protein, 9 aa, Mycobacterium avium
STKSRHAGP

SEQ ID NO: 74585 - protein, 4 aa, Mycobacterium avium
STLA

SEQ ID NO: 74586 - protein, 27 aa, Mycobacterium avium
STLSSERQMVSGSGSGGMGRLGGSSAE

SEQ ID NO: 74587 - protein, 4 aa, Mycobacterium avium
STLT

SEQ ID NO: 74588 - protein, 5 aa, Mycobacterium avium
STNPD

SEQ ID NO: 74589 - protein, 5 aa, Mycobacterium avium
STNQL

SEQ ID NO: 74590 - protein, 14 aa, Mycobacterium avium
STNSTAAAREAETV

SEQ ID NO: 74591 - protein, 10 aa, Mycobacterium avium
STPAGQGPWP

SEQ ID NO: 74592 - protein, 7 aa, Mycobacterium avium
STPALTS

SEQ ID NO: 74593 - protein, 6 aa, Mycobacterium avium
STPDRL

SEQ ID NO: 74594 - protein, 6 aa, Mycobacterium avium
STPEEM

SEQ ID NO: 74595 - protein, 8 aa, Mycobacterium avium
STPEVGPS

SEQ ID NO: 74596 - protein, 7 aa, Mycobacterium avium
STPGRSL

SEQ ID NO: 74597 - protein, 6 aa, Mycobacterium avium
STPGTT

SEQ ID NO: 74598 - protein, 7 aa, Mycobacterium avium
STPLDRS

SEQ ID NO: 74599 - protein, 7 aa, Mycobacterium avium
STPNPDL

SEQ ID NO: 74600 - protein, 13 aa, Mycobacterium avium
STPPPDGVGAAFS

SEQ ID NO: 74601 - protein, 7 aa, Mycobacterium avium
STPRDTT

SEQ ID NO: 74602 - protein, 7 aa, Mycobacterium avium
STPSARS

SEQ ID NO: 74603 - protein, 9 aa, Mycobacterium avium
STQTPDEVE

SEQ ID NO: 74604 - protein, 12 aa, Mycobacterium avium
STRGAELGEGTD

SEQ ID NO: 74605 - protein, 24 aa, Mycobacterium avium
STRSATVKRAGEFSGRAVVRVVDG

SEQ ID NO: 74606 - protein, 15 aa, Mycobacterium avium
STRSGGSPRAESCAT

SEQ ID NO: 74607 - protein, 12 aa, Mycobacterium avium
STRSPDEIDSAD

SEQ ID NO: 74608 - protein, 5 aa, Mycobacterium avium
STRTF

SEQ ID NO: 74609 - protein, 7 aa, Mycobacterium avium
STRTQWD

SEQ ID NO: 74610 - protein, 8 aa, Mycobacterium avium
STSDGRGP

SEQ ID NO: 74611 - protein, 10 aa, Mycobacterium avium
STSGLSSTDL

SEQ ID NO: 74612 - protein, 8 aa, Mycobacterium avium
STSPDDVQ

SEQ ID NO: 74613 - protein, 9 aa, Mycobacterium avium
STSPPPQAC

SEQ ID NO: 74614 - protein, 18 aa, Mycobacterium avium
STSSVSYAATEAANAAAA

SEQ ID NO: 74615 - protein, 9 aa, Mycobacterium avium
STSVADAHR

SEQ ID NO: 74616 - protein, 10 aa, Mycobacterium avium
STSVADAHRK

SEQ ID NO: 74617 - protein, 10 aa, Mycobacterium avium
STSYAHNGAA

SEQ ID NO: 74618 - protein, 10 aa, Mycobacterium avium
STTANVPPGA

SEQ ID NO: 74619 - protein, 8 aa, Mycobacterium avium
STTDGFPS

SEQ ID NO: 74620 - protein, 9 aa, Mycobacterium avium
STTGAAPAI

SEQ ID NO: 74621 - protein, 16 aa, Mycobacterium avium
STTKATGAKSISGSDA

SEQ ID NO: 74622 - protein, 6 aa, Mycobacterium avium
STVAQS

SEQ ID NO: 74623 - protein, 7 aa, Mycobacterium avium
STVDSPE

SEQ ID NO: 74624 - protein, 17 aa, Mycobacterium avium
STVQPPRPPPDTSNPSH

SEQ ID NO: 74625 - protein, 10 aa, Mycobacterium avium
STWPDESPQL

SEQ ID NO: 74626 - protein, 6 aa, Mycobacterium avium
STYGKM

SEQ ID NO: 74627 - protein, 13 aa, Mycobacterium avium
STYRSGSTTISTG

SEQ ID NO: 74628 - protein, 10 aa, Mycobacterium avium
SVADPDGAKA

SEQ ID NO: 74629 - protein, 27 aa, Mycobacterium avium
SVAQRRATTGLASGRLGEKPSDAAQFT

SEQ ID NO: 74630 - protein, 9 aa, Mycobacterium avium
SVARAHPRT

SEQ ID NO: 74631 - protein, 12 aa, Mycobacterium avium
SVARGGGRTSYR

SEQ ID NO: 74632 - protein, 8 aa, Mycobacterium avium
SVASTNQP

SEQ ID NO: 74633 - protein, 4 aa, Mycobacterium avium
SVDA

SEQ ID NO: 74634 - protein, 11 aa, Mycobacterium avium
SVDDQGKRDVS

SEQ ID NO: 74635 - protein, 15 aa, Mycobacterium avium
SVDGPVPHYPAPGGV

SEQ ID NO: 74636 - protein, 11 aa, Mycobacterium avium
SVDPNQSINHP

SEQ ID NO: 74637 - protein, 4 aa, Mycobacterium avium
SVDQ

SEQ ID NO: 74638 - protein, 16 aa, Mycobacterium avium
SVEATEGQRTALPRTT

SEQ ID NO: 74639 - protein, 8 aa, Mycobacterium avium
SVEPSREY

SEQ ID NO: 74640 - protein, 16 aa, Mycobacterium avium
SVETTQGQQTALPRTT

SEQ ID NO: 74641 - protein, 13 aa, Mycobacterium avium
SVGASYGSTVETL

SEQ ID NO: 74642 - protein, 6 aa, Mycobacterium avium
SVGGQG

SEQ ID NO: 74643 - protein, 10 aa, Mycobacterium avium
SVGGREDRAQ

SEQ ID NO: 74644 - protein, 12 aa, Mycobacterium avium
SVGGRKAYPNTG

SEQ ID NO: 74645 - protein, 5 aa, Mycobacterium avium
SVGPA

SEQ ID NO: 74646 - protein, 5 aa, Mycobacterium avium
SVGPT

SEQ ID NO: 74647 - protein, 9 aa, Mycobacterium avium
SVIGGANPV

SEQ ID NO: 74648 - protein, 6 aa, Mycobacterium avium
SVIPRG

SEQ ID NO: 74649 - protein, 30 aa, Mycobacterium avium
SVNAGASTIGGSSPAGGANWNGSGSNAPKI

SEQ ID NO: 74650 - protein, 7 aa, Mycobacterium avium
SVPGAGD

SEQ ID NO: 74651 - protein, 9 aa, Mycobacterium avium
SVPGSRQGD

SEQ ID NO: 74652 - protein, 6 aa, Mycobacterium avium
SVPPSW

SEQ ID NO: 74653 - protein, 5 aa, Mycobacterium avium
SVQAS

SEQ ID NO: 74654 - protein, 12 aa, Mycobacterium avium
SVQETPDPASMH

SEQ ID NO: 74655 - protein, 6 aa, Mycobacterium avium
SVQRTS

SEQ ID NO: 74656 - protein, 6 aa, Mycobacterium avium
SVQTAQ

SEQ ID NO: 74657 - protein, 9 aa, Mycobacterium avium
SVRDSDPYG

SEQ ID NO: 74658 - protein, 8 aa, Mycobacterium avium
SVRGAARE

SEQ ID NO: 74659 - protein, 9 aa, Mycobacterium avium
SVRGKVGDA

SEQ ID NO: 74660 - protein, 9 aa, Mycobacterium avium
SVSAASAAI

SEQ ID NO: 74661 - protein, 8 aa, Mycobacterium avium
SVSADTGR

SEQ ID NO: 74662 - protein, 7 aa, Mycobacterium avium
SVSGDEI

SEQ ID NO: 74663 - protein, 9 aa, Mycobacterium avium
SVSGGHVGR

SEQ ID NO: 74664 - protein, 11 aa, Mycobacterium avium
SVSNGEKRWDA

SEQ ID NO: 74665 - protein, 11 aa, Mycobacterium avium
SVSNGQKRWDA

SEQ ID NO: 74666 - protein, 5 aa, Mycobacterium avium
SVSPS

SEQ ID NO: 74667 - protein, 6 aa, Mycobacterium avium
SVSPSL

SEQ ID NO: 74668 - protein, 7 aa, Mycobacterium avium
SVSSNTH

SEQ ID NO: 74669 - protein, 6 aa, Mycobacterium avium
SVSSPT

SEQ ID NO: 74670 - protein, 9 aa, Mycobacterium avium
SVSTEDDPF

SEQ ID NO: 74671 - protein, 7 aa, Mycobacterium avium
SVSTSLD

SEQ ID NO: 74672 - protein, 27 aa, Mycobacterium avium
SVTAGAQTTPVTRSTNSRWMRRSPVIS

SEQ ID NO: 74673 - protein, 12 aa, Mycobacterium avium
SVTDKSSADGEG

SEQ ID NO: 74674 - protein, 23 aa, Mycobacterium avium
SVTDTRSSTTPADHAARQARAEA

SEQ ID NO: 74675 - protein, 7 aa, Mycobacterium avium
SVTGEDV

SEQ ID NO: 74676 - protein, 10 aa, Mycobacterium avium
SVTKTRAPRT

SEQ ID NO: 74677 - protein, 8 aa, Mycobacterium avium
SVTPAPGW

SEQ ID NO: 74678 - protein, 4 aa, Mycobacterium avium
SVTT

SEQ ID NO: 74679 - protein, 10 aa, Mycobacterium avium
SVTTSAGDTV

SEQ ID NO: 74680 - protein, 7 aa, Mycobacterium avium
SVTVPTS

SEQ ID NO: 74681 - protein, 15 aa, Mycobacterium avium
SWGPPEAAQRVTGSA

SEQ ID NO: 74682 - protein, 5 aa, Mycobacterium avium
SWPGG

SEQ ID NO: 74683 - protein, 13 aa, Mycobacterium avium
SWSPAPGPNSTSN

SEQ ID NO: 74684 - protein, 14 aa, Mycobacterium avium
SWSSPADGTSGIDH

SEQ ID NO: 74685 - protein, 10 aa, Mycobacterium avium
SYAGPDREVR

SEQ ID NO: 74686 - protein, 12 aa, Mycobacterium avium
SYASRPAEAAAD

SEQ ID NO: 74687 - protein, 7 aa, Mycobacterium avium
SYATAAT

SEQ ID NO: 74688 - protein, 7 aa, Mycobacterium avium
SYDGAGT

SEQ ID NO: 74689 - protein, 12 aa, Mycobacterium avium
SYETDRNHDLAP

SEQ ID NO: 74690 - protein, 4 aa, Mycobacterium avium
SYEY

SEQ ID NO: 74691 - protein, 6 aa, Mycobacterium avium
SYGARQ

SEQ ID NO: 74692 - protein, 7 aa, Mycobacterium avium
SYGDANP

SEQ ID NO: 74693 - protein, 6 aa, Mycobacterium avium
SYGEQV

SEQ ID NO: 74694 - protein, 18 aa, Mycobacterium avium
SYGPPGSASLMSSPDSVA

SEQ ID NO: 74695 - protein, 19 aa, Mycobacterium avium
SYGPPGSASLMSSPDSVAG

SEQ ID NO: 74696 - protein, 10 aa, Mycobacterium avium
SYGSAGEHPD

SEQ ID NO: 74697 - protein, 5 aa, Mycobacterium avium
SYNGA

SEQ ID NO: 74698 - protein, 5 aa, Mycobacterium avium
SYPAR

SEQ ID NO: 74699 - protein, 7 aa, Mycobacterium avium
SYPARES

SEQ ID NO: 74700 - protein, 10 aa, Mycobacterium avium
SYPDDADEFG

SEQ ID NO: 74701 - protein, 8 aa, Mycobacterium avium
SYPGDGRP

SEQ ID NO: 74702 - protein, 18 aa, Mycobacterium avium
SYPPSLPPGDAAMPRPTP

SEQ ID NO: 74703 - protein, 13 aa, Mycobacterium avium
SYPSRPANRAADD

SEQ ID NO: 74704 - protein, 5 aa, Mycobacterium avium
SYRAA

SEQ ID NO: 74705 - protein, 13 aa, Mycobacterium avium
SYRAATAALGDAA

SEQ ID NO: 74706 - protein, 13 aa, Mycobacterium avium
SYRGEKLPAPSAT

SEQ ID NO: 74707 - protein, 5 aa, Mycobacterium avium
SYRGS

SEQ ID NO: 74708 - protein, 10 aa, Mycobacterium avium
SYRPQRAVTN

SEQ ID NO: 74709 - protein, 17 aa, Mycobacterium avium
SYSGADFPAGRQRLDAS

SEQ ID NO: 74710 - protein, 4 aa, Mycobacterium avium
SYSP

SEQ ID NO: 74711 - protein, 12 aa, Mycobacterium avium
SYTGEREQFGRP

SEQ ID NO: 74712 - protein, 6 aa, Mycobacterium avium
SYVPGT

SEQ ID NO: 74713 - protein, 8 aa, Mycobacterium avium
SYYPQGAE

SEQ ID NO: 74714 - protein, 12 aa, Mycobacterium avium
TAAAAGSTDPLR

SEQ ID NO: 74715 - protein, 6 aa, Mycobacterium avium
TAAAEA

SEQ ID NO: 74716 - protein, 7 aa, Mycobacterium avium
TAAAGRA

SEQ ID NO: 74717 - protein, 35 aa, Mycobacterium avium
TAAAHGANASTRHRACGGSARGGPARMPPRPAPAR

SEQ ID NO: 74718 - protein, 12 aa, Mycobacterium avium
TAAAPTDGGTAA

SEQ ID NO: 74719 - protein, 11 aa, Mycobacterium avium
TAAAQRDGRIG

SEQ ID NO: 74720 - protein, 9 aa, Mycobacterium avium
TAAAQRYGA

SEQ ID NO: 74721 - protein, 8 aa, Mycobacterium avium
TAADDGAR

SEQ ID NO: 74722 - protein, 7 aa, Mycobacterium avium
TAADNTP

SEQ ID NO: 74723 - protein, 24 aa, Mycobacterium avium
TAADSSTRPLSADDEPGTRSAAAN

SEQ ID NO: 74724 - protein, 5 aa, Mycobacterium avium
TAADT

SEQ ID NO: 74725 - protein, 7 aa, Mycobacterium avium
TAADTGE

SEQ ID NO: 74726 - protein, 13 aa, Mycobacterium avium
TAAEAGGARPPRI

SEQ ID NO: 74727 - protein, 8 aa, Mycobacterium avium
TAAEEREQ

SEQ ID NO: 74728 - protein, 5 aa, Mycobacterium avium
TAAEQ

SEQ ID NO: 74729 - protein, 5 aa, Mycobacterium avium
TAAER

SEQ ID NO: 74730 - protein, 7 aa, Mycobacterium avium
TAAERER

SEQ ID NO: 74731 - protein, 10 aa, Mycobacterium avium
TAAGADTGTL

SEQ ID NO: 74732 - protein, 13 aa, Mycobacterium avium
TAAGGGPQDEGAK

SEQ ID NO: 74733 - protein, 16 aa, Mycobacterium avium
TAAGGGRIRSRGKTFG

SEQ ID NO: 74734 - protein, 8 aa, Mycobacterium avium
TAAGGRAT

SEQ ID NO: 74735 - protein, 21 aa, Mycobacterium avium
TAAGGTAIANGDSVATEEGGA

SEQ ID NO: 74736 - protein, 7 aa, Mycobacterium avium
TAAGPRL

SEQ ID NO: 74737 - protein, 5 aa, Mycobacterium avium
TAALS

SEQ ID NO: 74738 - protein, 11 aa, Mycobacterium avium
TAAPGNDAPLG

SEQ ID NO: 74739 - protein, 11 aa, Mycobacterium avium
TAAPTPPAERH

SEQ ID NO: 74740 - protein, 4 aa, Mycobacterium avium
TAAS

SEQ ID NO: 74741 - protein, 15 aa, Mycobacterium avium
TAASAAAENPSPALD

SEQ ID NO: 74742 - protein, 10 aa, Mycobacterium avium
TAASAAKACA

SEQ ID NO: 74743 - protein, 22 aa, Mycobacterium avium
TAASAKKAAGAPERSKPVRTRE

SEQ ID NO: 74744 - protein, 10 aa, Mycobacterium avium
TAASLDTPAA

SEQ ID NO: 74745 - protein, 6 aa, Mycobacterium avium
TAASRA

SEQ ID NO: 74746 - protein, 7 aa, Mycobacterium avium
TAATAGI

SEQ ID NO: 74747 - protein, 12 aa, Mycobacterium avium
TAATRSATTTGR

SEQ ID NO: 74748 - protein, 6 aa, Mycobacterium avium
TAAVSG

SEQ ID NO: 74749 - protein, 8 aa, Mycobacterium avium
TADAATVA

SEQ ID NO: 74750 - protein, 8 aa, Mycobacterium avium
TADAPDLP

SEQ ID NO: 74751 - protein, 5 aa, Mycobacterium avium
TADAS

SEQ ID NO: 74752 - protein, 8 aa, Mycobacterium avium
TADDATHQ

SEQ ID NO: 74753 - protein, 15 aa, Mycobacterium avium
TADDRVPYAGGPGKA

SEQ ID NO: 74754 - protein, 5 aa, Mycobacterium avium
TADEI

SEQ ID NO: 74755 - protein, 17 aa, Mycobacterium avium
TADENGNPVSKGTNGKC

SEQ ID NO: 74756 - protein, 5 aa, Mycobacterium avium
TADEW

SEQ ID NO: 74757 - protein, 4 aa, Mycobacterium avium
TADG

SEQ ID NO: 74758 - protein, 8 aa, Mycobacterium avium
TADGADAQ

SEQ ID NO: 74759 - protein, 8 aa, Mycobacterium avium
TADGEPGC

SEQ ID NO: 74760 - protein, 11 aa, Mycobacterium avium
TADGRPDGIDG

SEQ ID NO: 74761 - protein, 9 aa, Mycobacterium avium
TADKDDKKV

SEQ ID NO: 74762 - protein, 11 aa, Mycobacterium avium
TADPAVTASPG

SEQ ID NO: 74763 - protein, 8 aa, Mycobacterium avium
TADPPLGE

SEQ ID NO: 74764 - protein, 13 aa, Mycobacterium avium
TADPSLVKKSTDE

SEQ ID NO: 74765 - protein, 8 aa, Mycobacterium avium
TADPTRPL

SEQ ID NO: 74766 - protein, 5 aa, Mycobacterium avium
TADPV

SEQ ID NO: 74767 - protein, 7 aa, Mycobacterium avium
TADQQQA

SEQ ID NO: 74768 - protein, 7 aa, Mycobacterium avium
TADQTEG

SEQ ID NO: 74769 - protein, 10 aa, Mycobacterium avium
TADSPEEMRA

SEQ ID NO: 74770 - protein, 9 aa, Mycobacterium avium
TADTGNGYW

SEQ ID NO: 74771 - protein, 10 aa, Mycobacterium avium
TADVDPGDAF

SEQ ID NO: 74772 - protein, 6 aa, Mycobacterium avium
TADVSV

SEQ ID NO: 74773 - protein, 11 aa, Mycobacterium avium
TADYGTTANYA

SEQ ID NO: 74774 - protein, 7 aa, Mycobacterium avium
TAEARTG

SEQ ID NO: 74775 - protein, 8 aa, Mycobacterium avium
TAEARTGA

SEQ ID NO: 74776 - protein, 10 aa, Mycobacterium avium
TAEDAARAGL

SEQ ID NO: 74777 - protein, 11 aa, Mycobacterium avium
TAEDAARAGLT

SEQ ID NO: 74778 - protein, 6 aa, Mycobacterium avium
TAEDEV

SEQ ID NO: 74779 - protein, 6 aa, Mycobacterium avium
TAEDRE

SEQ ID NO: 74780 - protein, 9 aa, Mycobacterium avium
TAEGRAAAL

SEQ ID NO: 74781 - protein, 6 aa, Mycobacterium avium
TAEPGR

SEQ ID NO: 74782 - protein, 5 aa, Mycobacterium avium
TAERH

SEQ ID NO: 74783 - protein, 15 aa, Mycobacterium avium
TAETAARAAERAELA

SEQ ID NO: 74784 - protein, 8 aa, Mycobacterium avium
TAFTDGEQ

SEQ ID NO: 74785 - protein, 8 aa, Mycobacterium avium
TAGAAAAA

SEQ ID NO: 74786 - protein, 6 aa, Mycobacterium avium
TAGAIN

SEQ ID NO: 74787 - protein, 6 aa, Mycobacterium avium
TAGATH

SEQ ID NO: 74788 - protein, 8 aa, Mycobacterium avium
TAGDGGTA

SEQ ID NO: 74789 - protein, 14 aa, Mycobacterium avium
TAGETAGARAAAGR

SEQ ID NO: 74790 - protein, 6 aa, Mycobacterium avium
TAGETF

SEQ ID NO: 74791 - protein, 9 aa, Mycobacterium avium
TAGGGDHPD

SEQ ID NO: 74792 - protein, 11 aa, Mycobacterium avium
TAGGPAPSSTV

SEQ ID NO: 74793 - protein, 8 aa, Mycobacterium avium
TAGGVTSG

SEQ ID NO: 74794 - protein, 10 aa, Mycobacterium avium
TAGLDDEQRE

SEQ ID NO: 74795 - protein, 4 aa, Mycobacterium avium
TAGP

SEQ ID NO: 74796 - protein, 8 aa, Mycobacterium avium
TAGPGRFE

SEQ ID NO: 74797 - protein, 5 aa, Mycobacterium avium
TAGQI

SEQ ID NO: 74798 - protein, 7 aa, Mycobacterium avium
TAGQIGP

SEQ ID NO: 74799 - protein, 5 aa, Mycobacterium avium
TAGRD

SEQ ID NO: 74800 - protein, 5 aa, Mycobacterium avium
TAGRF

SEQ ID NO: 74801 - protein, 15 aa, Mycobacterium avium
TAGRGPAVTVTGAPE

SEQ ID NO: 74802 - protein, 19 aa, Mycobacterium avium
TAGRGSRHQGEQDGCQDED

SEQ ID NO: 74803 - protein, 9 aa, Mycobacterium avium
TAGRPGRNL

SEQ ID NO: 74804 - protein, 13 aa, Mycobacterium avium
TAGRTGDFRPTQS

SEQ ID NO: 74805 - protein, 9 aa, Mycobacterium avium
TAGSSQRRK

SEQ ID NO: 74806 - protein, 6 aa, Mycobacterium avium
TAGSYD

SEQ ID NO: 74807 - protein, 9 aa, Mycobacterium avium
TAGTGPPDI

SEQ ID NO: 74808 - protein, 6 aa, Mycobacterium avium
TAGTTG

SEQ ID NO: 74809 - protein, 10 aa, Mycobacterium avium
TAHAGGSGRV

SEQ ID NO: 74810 - protein, 8 aa, Mycobacterium avium
TAHSDGCI

SEQ ID NO: 74811 - protein, 9 aa, Mycobacterium avium
TAITPDEGA

SEQ ID NO: 74812 - protein, 15 aa, Mycobacterium avium
TAKGGYGKPRPTPGY

SEQ ID NO: 74813 - protein, 17 aa, Mycobacterium avium
TAKGRRPSWNAAAPAAI

SEQ ID NO: 74814 - protein, 18 aa, Mycobacterium avium
TAKGRRPSWNAAAPAAVA

SEQ ID NO: 74815 - protein, 7 aa, Mycobacterium avium
TAKPGTM

SEQ ID NO: 74816 - protein, 9 aa, Mycobacterium avium
TAKTGAQRT

SEQ ID NO: 74817 - protein, 14 aa, Mycobacterium avium
TAKTGMVTGEPHNP

SEQ ID NO: 74818 - protein, 9 aa, Mycobacterium avium
TALDQTARH

SEQ ID NO: 74819 - protein, 9 aa, Mycobacterium avium
TALGDASEV

SEQ ID NO: 74820 - protein, 6 aa, Mycobacterium avium
TALKGP

SEQ ID NO: 74821 - protein, 4 aa, Mycobacterium avium
TALS

SEQ ID NO: 74822 - protein, 9 aa, Mycobacterium avium
TANAAEARE

SEQ ID NO: 74823 - protein, 23 aa, Mycobacterium avium
TANGREGRSDNDPSTLPIPAQPQ

SEQ ID NO: 74824 - protein, 9 aa, Mycobacterium avium
TANGVGPGH

SEQ ID NO: 74825 - protein, 8 aa, Mycobacterium avium
TAPAESGW

SEQ ID NO: 74826 - protein, 12 aa, Mycobacterium avium
TAPAGGDGRDTV

SEQ ID NO: 74827 - protein, 8 aa, Mycobacterium avium
TAPAPPEL

SEQ ID NO: 74828 - protein, 30 aa, Mycobacterium avium
TAPAPSFSAPVSGAGRFGTPRAAPTRAGMS

SEQ ID NO: 74829 - protein, 19 aa, Mycobacterium avium
TAPDAPPPEPAARAGTANR

SEQ ID NO: 74830 - protein, 8 aa, Mycobacterium avium
TAPDGSEH

SEQ ID NO: 74831 - protein, 20 aa, Mycobacterium avium
TAPDRHDTSGRTGRQSTSHP

SEQ ID NO: 74832 - protein, 16 aa, Mycobacterium avium
TAPESAEPPAAETAPT

SEQ ID NO: 74833 - protein, 7 aa, Mycobacterium avium
TAPESDG

SEQ ID NO: 74834 - protein, 7 aa, Mycobacterium avium
TAPGARG

SEQ ID NO: 74835 - protein, 7 aa, Mycobacterium avium
TAPGLNT

SEQ ID NO: 74836 - protein, 8 aa, Mycobacterium avium
TAPGVPHD

SEQ ID NO: 74837 - protein, 14 aa, Mycobacterium avium
TAPGVQAGTAPPVP

SEQ ID NO: 74838 - protein, 12 aa, Mycobacterium avium
TAPGVQAGTVPP

SEQ ID NO: 74839 - protein, 10 aa, Mycobacterium avium
TAPKSNAVTT

SEQ ID NO: 74840 - protein, 8 aa, Mycobacterium avium
TAPLPTGR

SEQ ID NO: 74841 - protein, 10 aa, Mycobacterium avium
TAPPAGYSGK

SEQ ID NO: 74842 - protein, 8 aa, Mycobacterium avium
TAPPGDGQ

SEQ ID NO: 74843 - protein, 5 aa, Mycobacterium avium
TAPPH

SEQ ID NO: 74844 - protein, 15 aa, Mycobacterium avium
TAPPHPRAPGATDKD

SEQ ID NO: 74845 - protein, 7 aa, Mycobacterium avium
TAPSWEQ

SEQ ID NO: 74846 - protein, 8 aa, Mycobacterium avium
TAPTAAVT

SEQ ID NO: 74847 - protein, 6 aa, Mycobacterium avium
TAPTIG

SEQ ID NO: 74848 - protein, 8 aa, Mycobacterium avium
TAPTSRVH

SEQ ID NO: 74849 - protein, 12 aa, Mycobacterium avium
TAPVSYEDSINP

SEQ ID NO: 74850 - protein, 8 aa, Mycobacterium avium
TAQAEQQI

SEQ ID NO: 74851 - protein, 35 aa, Mycobacterium avium
TAQGLAKAAGDGVAAAASGVASAASSGAGALGSLG

SEQ ID NO: 74852 - protein, 5 aa, Mycobacterium avium
TAQGR

SEQ ID NO: 74853 - protein, 10 aa, Mycobacterium avium
TAQGSQEPED

SEQ ID NO: 74854 - protein, 10 aa, Mycobacterium avium
TAQGSQESED

SEQ ID NO: 74855 - protein, 13 aa, Mycobacterium avium
TAQNDPSTVRGAR

SEQ ID NO: 74856 - protein, 4 aa, Mycobacterium avium
TAQR

SEQ ID NO: 74857 - protein, 13 aa, Mycobacterium avium
TAQRARDCGGPPV

SEQ ID NO: 74858 - protein, 5 aa, Mycobacterium avium
TAQRR

SEQ ID NO: 74859 - protein, 7 aa, Mycobacterium avium
TAQRSTL

SEQ ID NO: 74860 - protein, 7 aa, Mycobacterium avium
TARAAGV

SEQ ID NO: 74861 - protein, 20 aa, Mycobacterium avium
TARADEVPPELPVGSGPGVA

SEQ ID NO: 74862 - protein, 5 aa, Mycobacterium avium
TARAQ

SEQ ID NO: 74863 - protein, 8 aa, Mycobacterium avium
TARDATRR

SEQ ID NO: 74864 - protein, 10 aa, Mycobacterium avium
TAREEGPEAD

SEQ ID NO: 74865 - protein, 6 aa, Mycobacterium avium
TAREFA

SEQ ID NO: 74866 - protein, 7 aa, Mycobacterium avium
TARGAGI

SEQ ID NO: 74867 - protein, 5 aa, Mycobacterium avium
TARGG

SEQ ID NO: 74868 - protein, 7 aa, Mycobacterium avium
TARGGAA

SEQ ID NO: 74869 - protein, 5 aa, Mycobacterium avium
TARGL

SEQ ID NO: 74870 - protein, 12 aa, Mycobacterium avium
TARLARGATGGR

SEQ ID NO: 74871 - protein, 17 aa, Mycobacterium avium
TARRDLDAARGEISESR

SEQ ID NO: 74872 - protein, 8 aa, Mycobacterium avium
TARRPAQL

SEQ ID NO: 74873 - protein, 12 aa, Mycobacterium avium
TARSDLASGRLG

SEQ ID NO: 74874 - protein, 14 aa, Mycobacterium avium
TARSSRALLAEVSG

SEQ ID NO: 74875 - protein, 37 aa, Mycobacterium avium
TARTQETVGGVTAAAGGYTAQEATSAADIAAITGVTV

SEQ ID NO: 74876 - protein, 8 aa, Mycobacterium avium
TASAAEKP

SEQ ID NO: 74877 - protein, 9 aa, Mycobacterium avium
TASADPPVQ

SEQ ID NO: 74878 - protein, 7 aa, Mycobacterium avium
TASAGLK

SEQ ID NO: 74879 - protein, 14 aa, Mycobacterium avium
TASASYTNSGQADG

SEQ ID NO: 74880 - protein, 4 aa, Mycobacterium avium
TASE

SEQ ID NO: 74881 - protein, 8 aa, Mycobacterium avium
TASEAGLV

SEQ ID NO: 74882 - protein, 10 aa, Mycobacterium avium
TASEQQKEQH

SEQ ID NO: 74883 - protein, 6 aa, Mycobacterium avium
TASGIR

SEQ ID NO: 74884 - protein, 9 aa, Mycobacterium avium
TASGSDDLY

SEQ ID NO: 74885 - protein, 6 aa, Mycobacterium avium
TASPAE

SEQ ID NO: 74886 - protein, 18 aa, Mycobacterium avium
TASPAEVPTLETAERRRP

SEQ ID NO: 74887 - protein, 9 aa, Mycobacterium avium
TASPTWREE

SEQ ID NO: 74888 - protein, 8 aa, Mycobacterium avium
TASTAYGG

SEQ ID NO: 74889 - protein, 11 aa, Mycobacterium avium
TASVDDPAGVR

SEQ ID NO: 74890 - protein, 12 aa, Mycobacterium avium
TATAAARAGGEL

SEQ ID NO: 74891 - protein, 8 aa, Mycobacterium avium
TATAAGAR

SEQ ID NO: 74892 - protein, 6 aa, Mycobacterium avium
TATAPN

SEQ ID NO: 74893 - protein, 6 aa, Mycobacterium avium
TATATR

SEQ ID NO: 74894 - protein, 5 aa, Mycobacterium avium
TATAV

SEQ ID NO: 74895 - protein, 8 aa, Mycobacterium avium
TATDADIE

SEQ ID NO: 74896 - protein, 5 aa, Mycobacterium avium
TATGE

SEQ ID NO: 74897 - protein, 8 aa, Mycobacterium avium
TATGIAGT

SEQ ID NO: 74898 - protein, 15 aa, Mycobacterium avium
TATMNGSPYSLPTNP

SEQ ID NO: 74899 - protein, 8 aa, Mycobacterium avium
TATQDTEL

SEQ ID NO: 74900 - protein, 9 aa, Mycobacterium avium
TATRTRETL

SEQ ID NO: 74901 - protein, 5 aa, Mycobacterium avium
TATRV

SEQ ID NO: 74902 - protein, 21 aa, Mycobacterium avium
TATSGETTVTSPVSNAFTSTA

SEQ ID NO: 74903 - protein, 29 aa, Mycobacterium avium
TATSTSPTARRSRSCPAGSTSIRRKSRTC

SEQ ID NO: 74904 - protein, 6 aa, Mycobacterium avium
TATTST

SEQ ID NO: 74905 - protein, 5 aa, Mycobacterium avium
TATVR

SEQ ID NO: 74906 - protein, 4 aa, Mycobacterium avium
TATY

SEQ ID NO: 74907 - protein, 5 aa, Mycobacterium avium
TAVNG

SEQ ID NO: 74908 - protein, 34 aa, Mycobacterium avium
TAVPPHAPLPSEPQPAADHDGVEPDTELDREPGR

SEQ ID NO: 74909 - protein, 14 aa, Mycobacterium avium
TAYADAAEARGTWD

SEQ ID NO: 74910 - protein, 10 aa, Mycobacterium avium
TAYGTSDTVY

SEQ ID NO: 74911 - protein, 27 aa, Mycobacterium avium
TCQQPARRRRPPAPATNSQNPCRTPFP

SEQ ID NO: 74912 - protein, 27 aa, Mycobacterium avium
TCQSPARRRKSPAPATNSQNPCGTPFP

SEQ ID NO: 74913 - protein, 7 aa, Mycobacterium avium
TCSHDGP

SEQ ID NO: 74914 - protein, 12 aa, Mycobacterium avium
TCTGSEKPAGNS

SEQ ID NO: 74915 - protein, 7 aa, Mycobacterium avium
TDAADSY

SEQ ID NO: 74916 - protein, 8 aa, Mycobacterium avium
TDAAGNFQ

SEQ ID NO: 74917 - protein, 13 aa, Mycobacterium avium
TDADLAKNPDLSV

SEQ ID NO: 74918 - protein, 7 aa, Mycobacterium avium
TDAEAAT

SEQ ID NO: 74919 - protein, 5 aa, Mycobacterium avium
TDAEL

SEQ ID NO: 74920 - protein, 8 aa, Mycobacterium avium
TDAFPTAA

SEQ ID NO: 74921 - protein, 4 aa, Mycobacterium avium
TDAG

SEQ ID NO: 74922 - protein, 8 aa, Mycobacterium avium
TDAGKQAH

SEQ ID NO: 74923 - protein, 13 aa, Mycobacterium avium
TDAGQQLKSSIEG

SEQ ID NO: 74924 - protein, 8 aa, Mycobacterium avium
TDAGRHVE

SEQ ID NO: 74925 - protein, 5 aa, Mycobacterium avium
TDAGV

SEQ ID NO: 74926 - protein, 7 aa, Mycobacterium avium
TDANNNE

SEQ ID NO: 74927 - protein, 7 aa, Mycobacterium avium
TDANRSA

SEQ ID NO: 74928 - protein, 8 aa, Mycobacterium avium
TDANRSAL

SEQ ID NO: 74929 - protein, 8 aa, Mycobacterium avium
TDAQHPRV

SEQ ID NO: 74930 - protein, 9 aa, Mycobacterium avium
TDAQQSGAL

SEQ ID NO: 74931 - protein, 8 aa, Mycobacterium avium
TDARGPLG

SEQ ID NO: 74932 - protein, 8 aa, Mycobacterium avium
TDARPDQV

SEQ ID NO: 74933 - protein, 9 aa, Mycobacterium avium
TDASAEDME

SEQ ID NO: 74934 - protein, 9 aa, Mycobacterium avium
TDASASTAT

SEQ ID NO: 74935 - protein, 11 aa, Mycobacterium avium
TDASTNQGPAG

SEQ ID NO: 74936 - protein, 8 aa, Mycobacterium avium
TDDATGRP

SEQ ID NO: 74937 - protein, 14 aa, Mycobacterium avium
TDDELTERLRESKE

SEQ ID NO: 74938 - protein, 21 aa, Mycobacterium avium
TDDGVDEHGPTVKAAADYGDW

SEQ ID NO: 74939 - protein, 25 aa, Mycobacterium avium
TDDPAARLAPGNTLRAKPSRGGPER

SEQ ID NO: 74940 - protein, 17 aa, Mycobacterium avium
TDDPASEETLRQTSYAQ

SEQ ID NO: 74941 - protein, 8 aa, Mycobacterium avium
TDDPGVQD

SEQ ID NO: 74942 - protein, 7 aa, Mycobacterium avium
TDDPTQS

SEQ ID NO: 74943 - protein, 7 aa, Mycobacterium avium
TDDQRRR

SEQ ID NO: 74944 - protein, 15 aa, Mycobacterium avium
TDDRRAALTSMSDEE

SEQ ID NO: 74945 - protein, 9 aa, Mycobacterium avium
TDDRRAGFS

SEQ ID NO: 74946 - protein, 12 aa, Mycobacterium avium
TDEAAARRQMWS

SEQ ID NO: 74947 - protein, 19 aa, Mycobacterium avium
TDEDAGPGSGEDALPPDDV

SEQ ID NO: 74948 - protein, 11 aa, Mycobacterium avium
TDEERARSART

SEQ ID NO: 74949 - protein, 15 aa, Mycobacterium avium
TDEPPTIGRWYKSDM

SEQ ID NO: 74950 - protein, 7 aa, Mycobacterium avium
TDEQQQE

SEQ ID NO: 74951 - protein, 7 aa, Mycobacterium avium
TDEQRRR

SEQ ID NO: 74952 - protein, 7 aa, Mycobacterium avium
TDEQSAK

SEQ ID NO: 74953 - protein, 12 aa, Mycobacterium avium
TDERRDATSPQP

SEQ ID NO: 74954 - protein, 6 aa, Mycobacterium avium
TDERTI

SEQ ID NO: 74955 - protein, 6 aa, Mycobacterium avium
TDETEA

SEQ ID NO: 74956 - protein, 7 aa, Mycobacterium avium
TDGAGDI

SEQ ID NO: 74957 - protein, 7 aa, Mycobacterium avium
TDGASDI

SEQ ID NO: 74958 - protein, 6 aa, Mycobacterium avium
TDGGGA

SEQ ID NO: 74959 - protein, 12 aa, Mycobacterium avium
TDGGGPGSSQLA

SEQ ID NO: 74960 - protein, 7 aa, Mycobacterium avium
TDGGIRE

SEQ ID NO: 74961 - protein, 11 aa, Mycobacterium avium
TDGKGGPGDRT

SEQ ID NO: 74962 - protein, 18 aa, Mycobacterium avium
TDGLTDKVSGYRPTPDAN

SEQ ID NO: 74963 - protein, 10 aa, Mycobacterium avium
TDGNGPPQIN

SEQ ID NO: 74964 - protein, 7 aa, Mycobacterium avium
TDGPKSH

SEQ ID NO: 74965 - protein, 8 aa, Mycobacterium avium
TDGSGTVH

SEQ ID NO: 74966 - protein, 5 aa, Mycobacterium avium
TDGSL

SEQ ID NO: 74967 - protein, 8 aa, Mycobacterium avium
TDGTDGVG

SEQ ID NO: 74968 - protein, 8 aa, Mycobacterium avium
TDGVSDAE

SEQ ID NO: 74969 - protein, 9 aa, Mycobacterium avium
TDGYQPPAA

SEQ ID NO: 74970 - protein, 7 aa, Mycobacterium avium
TDHAGAD

SEQ ID NO: 74971 - protein, 6 aa, Mycobacterium avium
TDHPDG

SEQ ID NO: 74972 - protein, 8 aa, Mycobacterium avium
TDHPDGIE

SEQ ID NO: 74973 - protein, 10 aa, Mycobacterium avium
TDHPDGTERL

SEQ ID NO: 74974 - protein, 10 aa, Mycobacterium avium
TDHRGRRRSR

SEQ ID NO: 74975 - protein, 12 aa, Mycobacterium avium
TDIGKKNPQWTG

SEQ ID NO: 74976 - protein, 5 aa, Mycobacterium avium
TDIPP

SEQ ID NO: 74977 - protein, 8 aa, Mycobacterium avium
TDKAALDG

SEQ ID NO: 74978 - protein, 28 aa, Mycobacterium avium
TDLAGSDIPLDRTTGQTDRAAARCNSPA

SEQ ID NO: 74979 - protein, 8 aa, Mycobacterium avium
TDLPSGTY

SEQ ID NO: 74980 - protein, 5 aa, Mycobacterium avium
TDLPV

SEQ ID NO: 74981 - protein, 7 aa, Mycobacterium avium
TDLRDPD

SEQ ID NO: 74982 - protein, 12 aa, Mycobacterium avium
TDMGAAAENRPV

SEQ ID NO: 74983 - protein, 6 aa, Mycobacterium avium
TDNSEL

SEQ ID NO: 74984 - protein, 6 aa, Mycobacterium avium
TDPAAP

SEQ ID NO: 74985 - protein, 8 aa, Mycobacterium avium
TDPAGQGV

SEQ ID NO: 74986 - protein, 5 aa, Mycobacterium avium
TDPAR

SEQ ID NO: 74987 - protein, 7 aa, Mycobacterium avium
TDPARRL

SEQ ID NO: 74988 - protein, 6 aa, Mycobacterium avium
TDPARS

SEQ ID NO: 74989 - protein, 14 aa, Mycobacterium avium
TDPARSTPLFGPGG

SEQ ID NO: 74990 - protein, 9 aa, Mycobacterium avium
TDPASSRHH

SEQ ID NO: 74991 - protein, 8 aa, Mycobacterium avium
TDPDAGHK

SEQ ID NO: 74992 - protein, 9 aa, Mycobacterium avium
TDPDAPNHK

SEQ ID NO: 74993 - protein, 5 aa, Mycobacterium avium
TDPDD

SEQ ID NO: 74994 - protein, 7 aa, Mycobacterium avium
TDPDRRL

SEQ ID NO: 74995 - protein, 8 aa, Mycobacterium avium
TDPEAGHK

SEQ ID NO: 74996 - protein, 9 aa, Mycobacterium avium
TDPEQPKHK

SEQ ID NO: 74997 - protein, 6 aa, Mycobacterium avium
TDPETI

SEQ ID NO: 74998 - protein, 7 aa, Mycobacterium avium
TDPGGEV

SEQ ID NO: 74999 - protein, 7 aa, Mycobacterium avium
TDPGHTL

SEQ ID NO: 75000 - protein, 10 aa, Mycobacterium avium
TDPKARPQHS

SEQ ID NO: 75001 - protein, 6 aa, Mycobacterium avium
TDPPYY

SEQ ID NO: 75002 - protein, 10 aa, Mycobacterium avium
TDPQAQPRHK

SEQ ID NO: 75003 - protein, 9 aa, Mycobacterium avium
TDPQRPKHK

SEQ ID NO: 75004 - protein, 13 aa, Mycobacterium avium
TDPSASWTAEGAE

SEQ ID NO: 75005 - protein, 16 aa, Mycobacterium avium
TDPSIPDDAPADPGPL

SEQ ID NO: 75006 - protein, 5 aa, Mycobacterium avium
TDPSW

SEQ ID NO: 75007 - protein, 7 aa, Mycobacterium avium
TDPTVKK

SEQ ID NO: 75008 - protein, 6 aa, Mycobacterium avium
TDPVGT

SEQ ID NO: 75009 - protein, 13 aa, Mycobacterium avium
TDPVTPEITQWVH

SEQ ID NO: 75010 - protein, 21 aa, Mycobacterium avium
TDPVYAPNSYGGPKADPDRAS

SEQ ID NO: 75011 - protein, 12 aa, Mycobacterium avium
TDPWNVGHDGGE

SEQ ID NO: 75012 - protein, 8 aa, Mycobacterium avium
TDQNGEVL

SEQ ID NO: 75013 - protein, 8 aa, Mycobacterium avium
TDRGGRGS

SEQ ID NO: 75014 - protein, 16 aa, Mycobacterium avium
TDRPYPAAADQRGDSV

SEQ ID NO: 75015 - protein, 16 aa, Mycobacterium avium
TDRPYPAVADQRGDSV

SEQ ID NO: 75016 - protein, 9 aa, Mycobacterium avium
TDRPYPPLA

SEQ ID NO: 75017 - protein, 9 aa, Mycobacterium avium
TDRPYPPVA

SEQ ID NO: 75018 - protein, 15 aa, Mycobacterium avium
TDRPYPQLADQRGAA

SEQ ID NO: 75019 - protein, 5 aa, Mycobacterium avium
TDRSG

SEQ ID NO: 75020 - protein, 9 aa, Mycobacterium avium
TDRSLGAES

SEQ ID NO: 75021 - protein, 13 aa, Mycobacterium avium
TDRTGSRSRRRGE

SEQ ID NO: 75022 - protein, 10 aa, Mycobacterium avium
TDSDAPKHKG

SEQ ID NO: 75023 - protein, 10 aa, Mycobacterium avium
TDSDTQDAGV

SEQ ID NO: 75024 - protein, 6 aa, Mycobacterium avium
TDSKLP

SEQ ID NO: 75025 - protein, 8 aa, Mycobacterium avium
TDSPTRSV

SEQ ID NO: 75026 - protein, 5 aa, Mycobacterium avium
TDTAA

SEQ ID NO: 75027 - protein, 10 aa, Mycobacterium avium
TDTAPDRGAP

SEQ ID NO: 75028 - protein, 11 aa, Mycobacterium avium
TDTAPDRGAPL

SEQ ID NO: 75029 - protein, 7 aa, Mycobacterium avium
TDTASQY

SEQ ID NO: 75030 - protein, 8 aa, Mycobacterium avium
TDTASQYA

SEQ ID NO: 75031 - protein, 9 aa, Mycobacterium avium
TDTASSYAK

SEQ ID NO: 75032 - protein, 7 aa, Mycobacterium avium
TDTDRTK

SEQ ID NO: 75033 - protein, 7 aa, Mycobacterium avium
TDTGGQT

SEQ ID NO: 75034 - protein, 5 aa, Mycobacterium avium
TDTLS

SEQ ID NO: 75035 - protein, 9 aa, Mycobacterium avium
TDTPAHRAA

SEQ ID NO: 75036 - protein, 12 aa, Mycobacterium avium
TDTPGVRIEPQQ

SEQ ID NO: 75037 - protein, 5 aa, Mycobacterium avium
TDTRI

SEQ ID NO: 75038 - protein, 4 aa, Mycobacterium avium
TDTS

SEQ ID NO: 75039 - protein, 6 aa, Mycobacterium avium
TDTVAA

SEQ ID NO: 75040 - protein, 16 aa, Mycobacterium avium
TDVDAAAAAGNPGLRT

SEQ ID NO: 75041 - protein, 7 aa, Mycobacterium avium
TDVSGER

SEQ ID NO: 75042 - protein, 10 aa, Mycobacterium avium
TDVSGSRVPT

SEQ ID NO: 75043 - protein, 20 aa, Mycobacterium avium
TDYGIGKAPTDFPPAPYSAA

SEQ ID NO: 75044 - protein, 18 aa, Mycobacterium avium
TDYGIGKAPTDFPPTPYS

SEQ ID NO: 75045 - protein, 20 aa, Mycobacterium avium
TDYGIGKAPTDFPPTPYSAA

SEQ ID NO: 75046 - protein, 8 aa, Mycobacterium avium
TDYTPPNK

SEQ ID NO: 75047 - protein, 9 aa, Mycobacterium avium
TEAAKGTPG

SEQ ID NO: 75048 - protein, 4 aa, Mycobacterium avium
TEAD

SEQ ID NO: 75049 - protein, 6 aa, Mycobacterium avium
TEADLN

SEQ ID NO: 75050 - protein, 6 aa, Mycobacterium avium
TEAETI

SEQ ID NO: 75051 - protein, 7 aa, Mycobacterium avium
TEAGERV

SEQ ID NO: 75052 - protein, 7 aa, Mycobacterium avium
TEAGRHS

SEQ ID NO: 75053 - protein, 8 aa, Mycobacterium avium
TEAGRRTR

SEQ ID NO: 75054 - protein, 4 aa, Mycobacterium avium
TEAP

SEQ ID NO: 75055 - protein, 15 aa, Mycobacterium avium
TEAPGAYHAKDGASL

SEQ ID NO: 75056 - protein, 8 aa, Mycobacterium avium
TEAQARGV

SEQ ID NO: 75057 - protein, 17 aa, Mycobacterium avium
TEASTAALADAGLGRAD

SEQ ID NO: 75058 - protein, 4 aa, Mycobacterium avium
TEDD

SEQ ID NO: 75059 - protein, 8 aa, Mycobacterium avium
TEDDLEET

SEQ ID NO: 75060 - protein, 5 aa, Mycobacterium avium
TEDEV

SEQ ID NO: 75061 - protein, 9 aa, Mycobacterium avium
TEDGIDAAR

SEQ ID NO: 75062 - protein, 8 aa, Mycobacterium avium
TEDQKQAY

SEQ ID NO: 75063 - protein, 20 aa, Mycobacterium avium
TEDQQDQADQQDGADEEDGA

SEQ ID NO: 75064 - protein, 6 aa, Mycobacterium avium
TEDRLA

SEQ ID NO: 75065 - protein, 14 aa, Mycobacterium avium
TEEALTETPPWQGG

SEQ ID NO: 75066 - protein, 9 aa, Mycobacterium avium
TEEEGNARD

SEQ ID NO: 75067 - protein, 10 aa, Mycobacterium avium
TEEGRPAGIA

SEQ ID NO: 75068 - protein, 68 aa, Mycobacterium avium
TEEITKAAKRSELQAKYGQTVQQPAQPPPGPQAPTGSRSPQAQSDYPPVPPNGPVPPMPEPAEPKGPG

SEQ ID NO: 75069 - protein, 4 aa, Mycobacterium avium
TEEL

SEQ ID NO: 75070 - protein, 15 aa, Mycobacterium avium
TEEQAASGAGLDAQR

SEQ ID NO: 75071 - protein, 7 aa, Mycobacterium avium
TEEQKAR

SEQ ID NO: 75072 - protein, 8 aa, Mycobacterium avium
TEEQKQKY

SEQ ID NO: 75073 - protein, 12 aa, Mycobacterium avium
TEETTEPSAVAG

SEQ ID NO: 75074 - protein, 16 aa, Mycobacterium avium
TEEVSGKQAKELTDEE

SEQ ID NO: 75075 - protein, 4 aa, Mycobacterium avium
TEFS

SEQ ID NO: 75076 - protein, 6 aa, Mycobacterium avium
TEGMHE

SEQ ID NO: 75077 - protein, 9 aa, Mycobacterium avium
TEGTPEQAA

SEQ ID NO: 75078 - protein, 11 aa, Mycobacterium avium
TEKKGSVGRPF

SEQ ID NO: 75079 - protein, 4 aa, Mycobacterium avium
TEKY

SEQ ID NO: 75080 - protein, 8 aa, Mycobacterium avium
TELDTETT

SEQ ID NO: 75081 - protein, 7 aa, Mycobacterium avium
TELGGKS

SEQ ID NO: 75082 - protein, 5 aa, Mycobacterium avium
TELGR

SEQ ID NO: 75083 - protein, 5 aa, Mycobacterium avium
TELPA

SEQ ID NO: 75084 - protein, 9 aa, Mycobacterium avium
TELPPADGY

SEQ ID NO: 75085 - protein, 4 aa, Mycobacterium avium
TELT

SEQ ID NO: 75086 - protein, 6 aa, Mycobacterium avium
TENADE

SEQ ID NO: 75087 - protein, 5 aa, Mycobacterium avium
TENQR

SEQ ID NO: 75088 - protein, 6 aa, Mycobacterium avium
TENREA

SEQ ID NO: 75089 - protein, 4 aa, Mycobacterium avium
TEPA

SEQ ID NO: 75090 - protein, 10 aa, Mycobacterium avium
TEPAKEALAD

SEQ ID NO: 75091 - protein, 10 aa, Mycobacterium avium
TEPAKVKPGY

SEQ ID NO: 75092 - protein, 11 aa, Mycobacterium avium
TEPGAGSDLRG

SEQ ID NO: 75093 - protein, 5 aa, Mycobacterium avium
TEPGE

SEQ ID NO: 75094 - protein, 9 aa, Mycobacterium avium
TEPPSSQVP

SEQ ID NO: 75095 - protein, 9 aa, Mycobacterium avium
TEPTNIQSK

SEQ ID NO: 75096 - protein, 8 aa, Mycobacterium avium
TEPTPGNR

SEQ ID NO: 75097 - protein, 4 aa, Mycobacterium avium
TEQG

SEQ ID NO: 75098 - protein, 5 aa, Mycobacterium avium
TEQRG

SEQ ID NO: 75099 - protein, 5 aa, Mycobacterium avium
TEQVA

SEQ ID NO: 75100 - protein, 6 aa, Mycobacterium avium
TERNPQ

SEQ ID NO: 75101 - protein, 6 aa, Mycobacterium avium
TERPGP

SEQ ID NO: 75102 - protein, 19 aa, Mycobacterium avium
TERPVRSITTGPRGYEGEG

SEQ ID NO: 75103 - protein, 4 aa, Mycobacterium avium
TERQ

SEQ ID NO: 75104 - protein, 12 aa, Mycobacterium avium
TERTKAVNEPTW

SEQ ID NO: 75105 - protein, 5 aa, Mycobacterium avium
TERVD

SEQ ID NO: 75106 - protein, 7 aa, Mycobacterium avium
TESAAQV

SEQ ID NO: 75107 - protein, 5 aa, Mycobacterium avium
TESGC

SEQ ID NO: 75108 - protein, 11 aa, Mycobacterium avium
TESGYAATESV

SEQ ID NO: 75109 - protein, 6 aa, Mycobacterium avium
TESIPD

SEQ ID NO: 75110 - protein, 5 aa, Mycobacterium avium
TESPA

SEQ ID NO: 75111 - protein, 26 aa, Mycobacterium avium
TESPTTSSATGSGAAAPDSDAPPYRY

SEQ ID NO: 75112 - protein, 9 aa, Mycobacterium avium
TESRYEGTT

SEQ ID NO: 75113 - protein, 5 aa, Mycobacterium avium
TESTP

SEQ ID NO: 75114 - protein, 8 aa, Mycobacterium avium
TETDTVPA

SEQ ID NO: 75115 - protein, 5 aa, Mycobacterium avium
TETER

SEQ ID NO: 75116 - protein, 4 aa, Mycobacterium avium
TETG

SEQ ID NO: 75117 - protein, 4 aa, Mycobacterium avium
TETH

SEQ ID NO: 75118 - protein, 15 aa, Mycobacterium avium
TETHTPKTGQEPDES

SEQ ID NO: 75119 - protein, 4 aa, Mycobacterium avium
TETL

SEQ ID NO: 75120 - protein, 7 aa, Mycobacterium avium
TETQQRE

SEQ ID NO: 75121 - protein, 8 aa, Mycobacterium avium
TETRAGYG

SEQ ID NO: 75122 - protein, 10 aa, Mycobacterium avium
TEVGNPPPYW

SEQ ID NO: 75123 - protein, 7 aa, Mycobacterium avium
TEVGTGT

SEQ ID NO: 75124 - protein, 6 aa, Mycobacterium avium
TEVRPL

SEQ ID NO: 75125 - protein, 13 aa, Mycobacterium avium
TEWASPAEEPHTA

SEQ ID NO: 75126 - protein, 4 aa, Mycobacterium avium
TEWG

SEQ ID NO: 75127 - protein, 7 aa, Mycobacterium avium
TEYGGKG

SEQ ID NO: 75128 - protein, 5 aa, Mycobacterium avium
TFGEE

SEQ ID NO: 75129 - protein, 6 aa, Mycobacterium avium
TFGGHS

SEQ ID NO: 75130 - protein, 41 aa, Mycobacterium avium
TFPASDPGAPSNGHADDLPAVQSAAAHANGRPSNPVTVRSD

SEQ ID NO: 75131 - protein, 16 aa, Mycobacterium avium
TFPQTPDSDAPQRKPK

SEQ ID NO: 75132 - protein, 8 aa, Mycobacterium avium
TFRSGGMD

SEQ ID NO: 75133 - protein, 12 aa, Mycobacterium avium
TFSRKRDAQEWE

SEQ ID NO: 75134 - protein, 4 aa, Mycobacterium avium
TFTE

SEQ ID NO: 75135 - protein, 8 aa, Mycobacterium avium
TGAADAES

SEQ ID NO: 75136 - protein, 7 aa, Mycobacterium avium
TGAADGY

SEQ ID NO: 75137 - protein, 13 aa, Mycobacterium avium
TGAAGLSARRDHA

SEQ ID NO: 75138 - protein, 13 aa, Mycobacterium avium
TGAAKAGDLALLI

SEQ ID NO: 75139 - protein, 8 aa, Mycobacterium avium
TGAAPGQH

SEQ ID NO: 75140 - protein, 8 aa, Mycobacterium avium
TGAAQGCV

SEQ ID NO: 75141 - protein, 9 aa, Mycobacterium avium
TGAASEAEA

SEQ ID NO: 75142 - protein, 6 aa, Mycobacterium avium
TGADMN

SEQ ID NO: 75143 - protein, 13 aa, Mycobacterium avium
TGADSPELDTLVP

SEQ ID NO: 75144 - protein, 15 aa, Mycobacterium avium
TGAEAELRRTRRYEA

SEQ ID NO: 75145 - protein, 10 aa, Mycobacterium avium
TGAELDDPRS

SEQ ID NO: 75146 - protein, 6 aa, Mycobacterium avium
TGAGKT

SEQ ID NO: 75147 - protein, 11 aa, Mycobacterium avium
TGAKSGEPRTV

SEQ ID NO: 75148 - protein, 11 aa, Mycobacterium avium
TGAKSGESRTV

SEQ ID NO: 75149 - protein, 32 aa, Mycobacterium avium
TGAKTGTAVPMPRSSMPSTSDGRRFTKSESPW

SEQ ID NO: 75150 - protein, 4 aa, Mycobacterium avium
TGAL

SEQ ID NO: 75151 - protein, 6 aa, Mycobacterium avium
TGAQGA

SEQ ID NO: 75152 - protein, 8 aa, Mycobacterium avium
TGAQPTDV

SEQ ID NO: 75153 - protein, 5 aa, Mycobacterium avium
TGARD

SEQ ID NO: 75154 - protein, 4 aa, Mycobacterium avium
TGAS

SEQ ID NO: 75155 - protein, 9 aa, Mycobacterium avium
TGASQNIGE

SEQ ID NO: 75156 - protein, 4 aa, Mycobacterium avium
TGAV

SEQ ID NO: 75157 - protein, 17 aa, Mycobacterium avium
TGAVGSELRDDRSQEFP

SEQ ID NO: 75158 - protein, 23 aa, Mycobacterium avium
TGDALPDDERLPSGLYADDRTRQ

SEQ ID NO: 75159 - protein, 4 aa, Mycobacterium avium
TGDD

SEQ ID NO: 75160 - protein, 9 aa, Mycobacterium avium
TGDGDAARD

SEQ ID NO: 75161 - protein, 6 aa, Mycobacterium avium
TGDGWA

SEQ ID NO: 75162 - protein, 5 aa, Mycobacterium avium
TGDPA

SEQ ID NO: 75163 - protein, 15 aa, Mycobacterium avium
TGDPPEVKTMVNKEN

SEQ ID NO: 75164 - protein, 10 aa, Mycobacterium avium
TGDPSNAADT

SEQ ID NO: 75165 - protein, 6 aa, Mycobacterium avium
TGDQPL

SEQ ID NO: 75166 - protein, 11 aa, Mycobacterium avium
TGDSDGGGAFQ

SEQ ID NO: 75167 - protein, 4 aa, Mycobacterium avium
TGDT

SEQ ID NO: 75168 - protein, 4 aa, Mycobacterium avium
TGEA

SEQ ID NO: 75169 - protein, 7 aa, Mycobacterium avium
TGEAPRE

SEQ ID NO: 75170 - protein, 5 aa, Mycobacterium avium
TGEGG

SEQ ID NO: 75171 - protein, 5 aa, Mycobacterium avium
TGEHG

SEQ ID NO: 75172 - protein, 7 aa, Mycobacterium avium
TGEPSTS

SEQ ID NO: 75173 - protein, 12 aa, Mycobacterium avium
TGEQHQQEAVPQ

SEQ ID NO: 75174 - protein, 21 aa, Mycobacterium avium
TGERLNEQATTNGYGNYTERH

SEQ ID NO: 75175 - protein, 5 aa, Mycobacterium avium
TGETI

SEQ ID NO: 75176 - protein, 7 aa, Mycobacterium avium
TGEYPDH

SEQ ID NO: 75177 - protein, 5 aa, Mycobacterium avium
TGFAE

SEQ ID NO: 75178 - protein, 11 aa, Mycobacterium avium
TGFDPGAPQSE

SEQ ID NO: 75179 - protein, 16 aa, Mycobacterium avium
TGFGSGSVAAGTQAGD

SEQ ID NO: 75180 - protein, 11 aa, Mycobacterium avium
TGFHPSGGASV

SEQ ID NO: 75181 - protein, 29 aa, Mycobacterium avium
TGGAGGSGLIGGAGGSGVGGLGGILGSIG

SEQ ID NO: 75182 - protein, 6 aa, Mycobacterium avium
TGGATA

SEQ ID NO: 75183 - protein, 8 aa, Mycobacterium avium
TGGDATRI

SEQ ID NO: 75184 - protein, 10 aa, Mycobacterium avium
TGGDDLARGQ

SEQ ID NO: 75185 - protein, 25 aa, Mycobacterium avium
TGGDKPTGIDPMADQPAEHTDSGVA

SEQ ID NO: 75186 - protein, 9 aa, Mycobacterium avium
TGGGRGARR

SEQ ID NO: 75187 - protein, 10 aa, Mycobacterium avium
TGGGRLGGEL

SEQ ID NO: 75188 - protein, 5 aa, Mycobacterium avium
TGGGT

SEQ ID NO: 75189 - protein, 18 aa, Mycobacterium avium
TGGGTDAANAASNAAAAA

SEQ ID NO: 75190 - protein, 8 aa, Mycobacterium avium
TGGGTRVG

SEQ ID NO: 75191 - protein, 4 aa, Mycobacterium avium
TGGL

SEQ ID NO: 75192 - protein, 5 aa, Mycobacterium avium
TGGRS

SEQ ID NO: 75193 - protein, 5 aa, Mycobacterium avium
TGGRV

SEQ ID NO: 75194 - protein, 7 aa, Mycobacterium avium
TGGTASS

SEQ ID NO: 75195 - protein, 7 aa, Mycobacterium avium
TGGTGKD

SEQ ID NO: 75196 - protein, 4 aa, Mycobacterium avium
TGGV

SEQ ID NO: 75197 - protein, 11 aa, Mycobacterium avium
TGHAPAPVREH

SEQ ID NO: 75198 - protein, 10 aa, Mycobacterium avium
TGHDGRPSQV

SEQ ID NO: 75199 - protein, 9 aa, Mycobacterium avium
TGHGPYGPL

SEQ ID NO: 75200 - protein, 6 aa, Mycobacterium avium
TGHRTP

SEQ ID NO: 75201 - protein, 12 aa, Mycobacterium avium
TGHVPASKRVAS

SEQ ID NO: 75202 - protein, 95 aa, Mycobacterium avium
TGIDPAHAAGPAPAAAAPSAPAPVAAPAATPPSAPAPAAAPAPGPVQPATVPAAAPVPPPPAPAAAAPATPGAPDAAPAPAAAPGFGADAPPTQD

SEQ ID NO: 75203 - protein, 6 aa, Mycobacterium avium
TGIEPG

SEQ ID NO: 75204 - protein, 10 aa, Mycobacterium avium
TGIGAGGSRC

SEQ ID NO: 75205 - protein, 11 aa, Mycobacterium avium
TGIKTGNKRAT

SEQ ID NO: 75206 - protein, 5 aa, Mycobacterium avium
TGIPD

SEQ ID NO: 75207 - protein, 8 aa, Mycobacterium avium
TGKASHAS

SEQ ID NO: 75208 - protein, 16 aa, Mycobacterium avium
TGKPAELDRDEPRRVA

SEQ ID NO: 75209 - protein, 12 aa, Mycobacterium avium
TGKRLDESGSGL

SEQ ID NO: 75210 - protein, 9 aa, Mycobacterium avium
TGKSGTVAL

SEQ ID NO: 75211 - protein, 23 aa, Mycobacterium avium
TGKSGTVALKPRPDINPDGPTTL

SEQ ID NO: 75212 - protein, 5 aa, Mycobacterium avium
TGKSQ

SEQ ID NO: 75213 - protein, 20 aa, Mycobacterium avium
TGKSSSASRAIDTESNLGQY

SEQ ID NO: 75214 - protein, 13 aa, Mycobacterium avium
TGKTPEGAAISGE

SEQ ID NO: 75215 - protein, 6 aa, Mycobacterium avium
TGLAER

SEQ ID NO: 75216 - protein, 8 aa, Mycobacterium avium
TGLDPLTT

SEQ ID NO: 75217 - protein, 7 aa, Mycobacterium avium
TGLGSSE

SEQ ID NO: 75218 - protein, 11 aa, Mycobacterium avium
TGMGTESGART

SEQ ID NO: 75219 - protein, 6 aa, Mycobacterium avium
TGMSSS

SEQ ID NO: 75220 - protein, 10 aa, Mycobacterium avium
TGNAGSNTAS

SEQ ID NO: 75221 - protein, 18 aa, Mycobacterium avium
TGNDADSDGTASSPPTGA

SEQ ID NO: 75222 - protein, 10 aa, Mycobacterium avium
TGNDADSDRH

SEQ ID NO: 75223 - protein, 11 aa, Mycobacterium avium
TGNDADSDRHG

SEQ ID NO: 75224 - protein, 7 aa, Mycobacterium avium
TGNGTQL

SEQ ID NO: 75225 - protein, 6 aa, Mycobacterium avium
TGNGTR

SEQ ID NO: 75226 - protein, 12 aa, Mycobacterium avium
TGNSQQTTHEPY

SEQ ID NO: 75227 - protein, 42 aa, Mycobacterium avium
TGPADALSVTDSDGQPLSAGSLARPPSHPPPAVPPCPGPLGE

SEQ ID NO: 75228 - protein, 6 aa, Mycobacterium avium
TGPAGD

SEQ ID NO: 75229 - protein, 7 aa, Mycobacterium avium
TGPAGEK

SEQ ID NO: 75230 - protein, 5 aa, Mycobacterium avium
TGPAM

SEQ ID NO: 75231 - protein, 8 aa, Mycobacterium avium
TGPAPNEL

SEQ ID NO: 75232 - protein, 5 aa, Mycobacterium avium
TGPAV

SEQ ID NO: 75233 - protein, 7 aa, Mycobacterium avium
TGPAVQP

SEQ ID NO: 75234 - protein, 5 aa, Mycobacterium avium
TGPDE

SEQ ID NO: 75235 - protein, 5 aa, Mycobacterium avium
TGPDF

SEQ ID NO: 75236 - protein, 13 aa, Mycobacterium avium
TGPDGTPVSAEDR

SEQ ID NO: 75237 - protein, 7 aa, Mycobacterium avium
TGPDKHR

SEQ ID NO: 75238 - protein, 5 aa, Mycobacterium avium
TGPDR

SEQ ID NO: 75239 - protein, 5 aa, Mycobacterium avium
TGPGQ

SEQ ID NO: 75240 - protein, 9 aa, Mycobacterium avium
TGPGTPGGE

SEQ ID NO: 75241 - protein, 6 aa, Mycobacterium avium
TGPGVS

SEQ ID NO: 75242 - protein, 5 aa, Mycobacterium avium
TGPGY

SEQ ID NO: 75243 - protein, 6 aa, Mycobacterium avium
TGPHKH

SEQ ID NO: 75244 - protein, 14 aa, Mycobacterium avium
TGPPAPDLDHDGDP

SEQ ID NO: 75245 - protein, 12 aa, Mycobacterium avium
TGPPGAQHYSDE

SEQ ID NO: 75246 - protein, 10 aa, Mycobacterium avium
TGPPGRSTDG

SEQ ID NO: 75247 - protein, 6 aa, Mycobacterium avium
TGPPSV

SEQ ID NO: 75248 - protein, 9 aa, Mycobacterium avium
TGPRGEPWP

SEQ ID NO: 75249 - protein, 7 aa, Mycobacterium avium
TGPSRFS

SEQ ID NO: 75250 - protein, 5 aa, Mycobacterium avium
TGPTE

SEQ ID NO: 75251 - protein, 6 aa, Mycobacterium avium
TGPTLD

SEQ ID NO: 75252 - protein, 6 aa, Mycobacterium avium
TGPTVA

SEQ ID NO: 75253 - protein, 13 aa, Mycobacterium avium
TGQAAKSVGDRAE

SEQ ID NO: 75254 - protein, 19 aa, Mycobacterium avium
TGQAPAAYIGDNTRPDAIR

SEQ ID NO: 75255 - protein, 9 aa, Mycobacterium avium
TGQDPDDDR

SEQ ID NO: 75256 - protein, 21 aa, Mycobacterium avium
TGQERALDDKTPTYYYLFQRR

SEQ ID NO: 75257 - protein, 5 aa, Mycobacterium avium
TGQFG

SEQ ID NO: 75258 - protein, 6 aa, Mycobacterium avium
TGQFGT

SEQ ID NO: 75259 - protein, 6 aa, Mycobacterium avium
TGQGST

SEQ ID NO: 75260 - protein, 19 aa, Mycobacterium avium
TGQNPASAKETAKKLASLL

SEQ ID NO: 75261 - protein, 12 aa, Mycobacterium avium
TGQPAADDFGSP

SEQ ID NO: 75262 - protein, 13 aa, Mycobacterium avium
TGQPAADDFGSPE

SEQ ID NO: 75263 - protein, 9 aa, Mycobacterium avium
TGQPGQSLA

SEQ ID NO: 75264 - protein, 7 aa, Mycobacterium avium
TGQRNAI

SEQ ID NO: 75265 - protein, 7 aa, Mycobacterium avium
TGQSPQW

SEQ ID NO: 75266 - protein, 12 aa, Mycobacterium avium
TGQVDRLANAVL

SEQ ID NO: 75267 - protein, 8 aa, Mycobacterium avium
TGRAAHTP

SEQ ID NO: 75268 - protein, 16 aa, Mycobacterium avium
TGRATHGGQAGAYDGA

SEQ ID NO: 75269 - protein, 13 aa, Mycobacterium avium
TGRDFDSQGQLRK

SEQ ID NO: 75270 - protein, 5 aa, Mycobacterium avium
TGRDR

SEQ ID NO: 75271 - protein, 6 aa, Mycobacterium avium
TGRDVS

SEQ ID NO: 75272 - protein, 8 aa, Mycobacterium avium
TGREIPAG

SEQ ID NO: 75273 - protein, 5 aa, Mycobacterium avium
TGRPV

SEQ ID NO: 75274 - protein, 9 aa, Mycobacterium avium
TGRQGPDSL

SEQ ID NO: 75275 - protein, 11 aa, Mycobacterium avium
TGRQRVSTGAR

SEQ ID NO: 75276 - protein, 5 aa, Mycobacterium avium
TGRRA

SEQ ID NO: 75277 - protein, 10 aa, Mycobacterium avium
TGRRATVPTP

SEQ ID NO: 75278 - protein, 7 aa, Mycobacterium avium
TGRRRPV

SEQ ID NO: 75279 - protein, 10 aa, Mycobacterium avium
TGRRSTVPTP

SEQ ID NO: 75280 - protein, 10 aa, Mycobacterium avium
TGRRTSAPAA

SEQ ID NO: 75281 - protein, 9 aa, Mycobacterium avium
TGRSQPESL

SEQ ID NO: 75282 - protein, 5 aa, Mycobacterium avium
TGRSV

SEQ ID NO: 75283 - protein, 4 aa, Mycobacterium avium
TGRT

SEQ ID NO: 75284 - protein, 9 aa, Mycobacterium avium
TGRTPGFGN

SEQ ID NO: 75285 - protein, 4 aa, Mycobacterium avium
TGRW

SEQ ID NO: 75286 - protein, 6 aa, Mycobacterium avium
TGSAAE

SEQ ID NO: 75287 - protein, 7 aa, Mycobacterium avium
TGSAGVA

SEQ ID NO: 75288 - protein, 9 aa, Mycobacterium avium
TGSDPAASG

SEQ ID NO: 75289 - protein, 11 aa, Mycobacterium avium
TGSGGKPSDGI

SEQ ID NO: 75290 - protein, 8 aa, Mycobacterium avium
TGSGGRSL

SEQ ID NO: 75291 - protein, 5 aa, Mycobacterium avium
TGSLT

SEQ ID NO: 75292 - protein, 10 aa, Mycobacterium avium
TGSPAEVART

SEQ ID NO: 75293 - protein, 9 aa, Mycobacterium avium
TGSPESRHR

SEQ ID NO: 75294 - protein, 10 aa, Mycobacterium avium
TGSQDDDAEL

SEQ ID NO: 75295 - protein, 8 aa, Mycobacterium avium
TGSSAVGR

SEQ ID NO: 75296 - protein, 10 aa, Mycobacterium avium
TGSSPSQRYQ

SEQ ID NO: 75297 - protein, 9 aa, Mycobacterium avium
TGSTATGIS

SEQ ID NO: 75298 - protein, 5 aa, Mycobacterium avium
TGSTD

SEQ ID NO: 75299 - protein, 7 aa, Mycobacterium avium
TGSVHDS

SEQ ID NO: 75300 - protein, 12 aa, Mycobacterium avium
TGTADDDPWSPD

SEQ ID NO: 75301 - protein, 9 aa, Mycobacterium avium
TGTAPPPGA

SEQ ID NO: 75302 - protein, 10 aa, Mycobacterium avium
TGTAPPPGAP

SEQ ID NO: 75303 - protein, 6 aa, Mycobacterium avium
TGTAPQ

SEQ ID NO: 75304 - protein, 8 aa, Mycobacterium avium
TGTDETRC

SEQ ID NO: 75305 - protein, 5 aa, Mycobacterium avium
TGTET

SEQ ID NO: 75306 - protein, 11 aa, Mycobacterium avium
TGTGGTAVASE

SEQ ID NO: 75307 - protein, 8 aa, Mycobacterium avium
TGTGNSLN

SEQ ID NO: 75308 - protein, 16 aa, Mycobacterium avium
TGTGRVPEKTRRLQRR

SEQ ID NO: 75309 - protein, 5 aa, Mycobacterium avium
TGTLS

SEQ ID NO: 75310 - protein, 9 aa, Mycobacterium avium
TGTPESRHR

SEQ ID NO: 75311 - protein, 5 aa, Mycobacterium avium
TGTPQ

SEQ ID NO: 75312 - protein, 5 aa, Mycobacterium avium
TGTRG

SEQ ID NO: 75313 - protein, 16 aa, Mycobacterium avium
TGTRYSSGSQAAGTQS

SEQ ID NO: 75314 - protein, 18 aa, Mycobacterium avium
TGTTGSVAVTGSTDTAAP

SEQ ID NO: 75315 - protein, 5 aa, Mycobacterium avium
TGTVA

SEQ ID NO: 75316 - protein, 7 aa, Mycobacterium avium
TGTWPGY

SEQ ID NO: 75317 - protein, 4 aa, Mycobacterium avium
TGVD

SEQ ID NO: 75318 - protein, 6 aa, Mycobacterium avium
TGVDPA

SEQ ID NO: 75319 - protein, 10 aa, Mycobacterium avium
TGVETSDRQL

SEQ ID NO: 75320 - protein, 9 aa, Mycobacterium avium
TGVPRARRE

SEQ ID NO: 75321 - protein, 6 aa, Mycobacterium avium
TGVPRP

SEQ ID NO: 75322 - protein, 12 aa, Mycobacterium avium
TGVQAVDPDGEV

SEQ ID NO: 75323 - protein, 17 aa, Mycobacterium avium
TGWDPDAAGRLTNNAEA

SEQ ID NO: 75324 - protein, 4 aa, Mycobacterium avium
TGWG

SEQ ID NO: 75325 - protein, 6 aa, Mycobacterium avium
TGWPTD

SEQ ID NO: 75326 - protein, 11 aa, Mycobacterium avium
TGWQTGDLTPT

SEQ ID NO: 75327 - protein, 30 aa, Mycobacterium avium
TGYAKRTKTDLYRSQKRGGKGVQGAGLNQD

SEQ ID NO: 75328 - protein, 14 aa, Mycobacterium avium
THDDVGKTSGVADQ

SEQ ID NO: 75329 - protein, 21 aa, Mycobacterium avium
THDTSPDHRAGHRLSRMPALS

SEQ ID NO: 75330 - protein, 5 aa, Mycobacterium avium
THEAA

SEQ ID NO: 75331 - protein, 9 aa, Mycobacterium avium
THEDGERIR

SEQ ID NO: 75332 - protein, 18 aa, Mycobacterium avium
THGRPTDRNAHPHRDAAG

SEQ ID NO: 75333 - protein, 15 aa, Mycobacterium avium
THGSPSSRGQYSGLD

SEQ ID NO: 75334 - protein, 10 aa, Mycobacterium avium
THKNAKGETQ

SEQ ID NO: 75335 - protein, 4 aa, Mycobacterium avium
THNA

SEQ ID NO: 75336 - protein, 8 aa, Mycobacterium avium
THPPADRE

SEQ ID NO: 75337 - protein, 7 aa, Mycobacterium avium
THPPGDQ

SEQ ID NO: 75338 - protein, 19 aa, Mycobacterium avium
THPPRTTTAHGQAAQAAAV

SEQ ID NO: 75339 - protein, 4 aa, Mycobacterium avium
THQP

SEQ ID NO: 75340 - protein, 11 aa, Mycobacterium avium
THQRGDGHAVG

SEQ ID NO: 75341 - protein, 9 aa, Mycobacterium avium
THQVSTTAI

SEQ ID NO: 75342 - protein, 11 aa, Mycobacterium avium
THRNAKGETQW

SEQ ID NO: 75343 - protein, 11 aa, Mycobacterium avium
THRPGSRGHHD

SEQ ID NO: 75344 - protein, 9 aa, Mycobacterium avium
THSEEEATT

SEQ ID NO: 75345 - protein, 11 aa, Mycobacterium avium
THTAADWQEAK

SEQ ID NO: 75346 - protein, 11 aa, Mycobacterium avium
THTEPSDPDLR

SEQ ID NO: 75347 - protein, 6 aa, Mycobacterium avium
THTRPP

SEQ ID NO: 75348 - protein, 9 aa, Mycobacterium avium
TIAATNTAV

SEQ ID NO: 75349 - protein, 12 aa, Mycobacterium avium
TIAEGNVDRARR

SEQ ID NO: 75350 - protein, 6 aa, Mycobacterium avium
TIDDPA

SEQ ID NO: 75351 - protein, 6 aa, Mycobacterium avium
TIDPGE

SEQ ID NO: 75352 - protein, 7 aa, Mycobacterium avium
TIEESGV

SEQ ID NO: 75353 - protein, 5 aa, Mycobacterium avium
TIEPE

SEQ ID NO: 75354 - protein, 12 aa, Mycobacterium avium
TIEPTKRQPNTC

SEQ ID NO: 75355 - protein, 11 aa, Mycobacterium avium
TIGAEDHSEID

SEQ ID NO: 75356 - protein, 7 aa, Mycobacterium avium
TIGGGGK

SEQ ID NO: 75357 - protein, 8 aa, Mycobacterium avium
TIGKENTA

SEQ ID NO: 75358 - protein, 8 aa, Mycobacterium avium
TIHQSKQS

SEQ ID NO: 75359 - protein, 7 aa, Mycobacterium avium
TIPDVDE

SEQ ID NO: 75360 - protein, 5 aa, Mycobacterium avium
TIQNG

SEQ ID NO: 75361 - protein, 29 aa, Mycobacterium avium
TIQTEGNYPTREACQDAGPGVKASTPGNW

SEQ ID NO: 75362 - protein, 7 aa, Mycobacterium avium
TIRTADG

SEQ ID NO: 75363 - protein, 10 aa, Mycobacterium avium
TISDAAGVTV

SEQ ID NO: 75364 - protein, 13 aa, Mycobacterium avium
TISGTEPDDAPEV

SEQ ID NO: 75365 - protein, 5 aa, Mycobacterium avium
TISPG

SEQ ID NO: 75366 - protein, 10 aa, Mycobacterium avium
TISRTTTNAQ

SEQ ID NO: 75367 - protein, 5 aa, Mycobacterium avium
TITDA

SEQ ID NO: 75368 - protein, 9 aa, Mycobacterium avium
TITRGGERY

SEQ ID NO: 75369 - protein, 9 aa, Mycobacterium avium
TKAGARFSG

SEQ ID NO: 75370 - protein, 6 aa, Mycobacterium avium
TKAKTH

SEQ ID NO: 75371 - protein, 5 aa, Mycobacterium avium
TKATG

SEQ ID NO: 75372 - protein, 20 aa, Mycobacterium avium
TKAYGGTPLDHDREERQRWA

SEQ ID NO: 75373 - protein, 4 aa, Mycobacterium avium
TKDE

SEQ ID NO: 75374 - protein, 8 aa, Mycobacterium avium
TKDEARER

SEQ ID NO: 75375 - protein, 5 aa, Mycobacterium avium
TKDLD

SEQ ID NO: 75376 - protein, 6 aa, Mycobacterium avium
TKDLDE

SEQ ID NO: 75377 - protein, 8 aa, Mycobacterium avium
TKDNGSYA

SEQ ID NO: 75378 - protein, 5 aa, Mycobacterium avium
TKDSP

SEQ ID NO: 75379 - protein, 6 aa, Mycobacterium avium
TKEAQR

SEQ ID NO: 75380 - protein, 6 aa, Mycobacterium avium
TKEGDF

SEQ ID NO: 75381 - protein, 8 aa, Mycobacterium avium
TKGDDKPM

SEQ ID NO: 75382 - protein, 8 aa, Mycobacterium avium
TKGKPRFK

SEQ ID NO: 75383 - protein, 17 aa, Mycobacterium avium
TKGLDQKSSDEEKGKAF

SEQ ID NO: 75384 - protein, 12 aa, Mycobacterium avium
TKGTAFTEEERR

SEQ ID NO: 75385 - protein, 8 aa, Mycobacterium avium
TKHPGTGG

SEQ ID NO: 75386 - protein, 6 aa, Mycobacterium avium
TKIRPD

SEQ ID NO: 75387 - protein, 4 aa, Mycobacterium avium
TKKV

SEQ ID NO: 75388 - protein, 11 aa, Mycobacterium avium
TKMTPAPTKPI

SEQ ID NO: 75389 - protein, 8 aa, Mycobacterium avium
TKNDDPVG

SEQ ID NO: 75390 - protein, 7 aa, Mycobacterium avium
TKNPRQN

SEQ ID NO: 75391 - protein, 22 aa, Mycobacterium avium
TKPCCAPSGPADPGVNQTLKGG

SEQ ID NO: 75392 - protein, 20 aa, Mycobacterium avium
TKPRISRDEFPPRDLPKTRI

SEQ ID NO: 75393 - protein, 5 aa, Mycobacterium avium
TKQPL

SEQ ID NO: 75394 - protein, 13 aa, Mycobacterium avium
TKRDAPGLDTSGL

SEQ ID NO: 75395 - protein, 9 aa, Mycobacterium avium
TKSGSTRCQ

SEQ ID NO: 75396 - protein, 4 aa, Mycobacterium avium
TKSL

SEQ ID NO: 75397 - protein, 7 aa, Mycobacterium avium
TKTDVDA

SEQ ID NO: 75398 - protein, 7 aa, Mycobacterium avium
TKTRDGA

SEQ ID NO: 75399 - protein, 7 aa, Mycobacterium avium
TKVGEEI

SEQ ID NO: 75400 - protein, 10 aa, Mycobacterium avium
TLADEKDAYG

SEQ ID NO: 75401 - protein, 6 aa, Mycobacterium avium
TLAEGN

SEQ ID NO: 75402 - protein, 11 aa, Mycobacterium avium
TLAEHGAQPAC

SEQ ID NO: 75403 - protein, 22 aa, Mycobacterium avium
TLAGNESGDGARIPMLPESWEG

SEQ ID NO: 75404 - protein, 9 aa, Mycobacterium avium
TLAGSLQSS

SEQ ID NO: 75405 - protein, 5 aa, Mycobacterium avium
TLARN

SEQ ID NO: 75406 - protein, 9 aa, Mycobacterium avium
TLARRDQAG

SEQ ID NO: 75407 - protein, 9 aa, Mycobacterium avium
TLATQRADH

SEQ ID NO: 75408 - protein, 10 aa, Mycobacterium avium
TLDDDERETL

SEQ ID NO: 75409 - protein, 8 aa, Mycobacterium avium
TLDGDDDL

SEQ ID NO: 75410 - protein, 14 aa, Mycobacterium avium
TLDPAGILNPGKLI

SEQ ID NO: 75411 - protein, 16 aa, Mycobacterium avium
TLDPDPKYQGALRQTR

SEQ ID NO: 75412 - protein, 5 aa, Mycobacterium avium
TLDSL

SEQ ID NO: 75413 - protein, 10 aa, Mycobacterium avium
TLDTATAAYR

SEQ ID NO: 75414 - protein, 5 aa, Mycobacterium avium
TLEQQ

SEQ ID NO: 75415 - protein, 7 aa, Mycobacterium avium
TLESNSP

SEQ ID NO: 75416 - protein, 14 aa, Mycobacterium avium
TLGADSPDAQSGSI

SEQ ID NO: 75417 - protein, 7 aa, Mycobacterium avium
TLGAEEA

SEQ ID NO: 75418 - protein, 13 aa, Mycobacterium avium
TLGEASPALAHPD

SEQ ID NO: 75419 - protein, 7 aa, Mycobacterium avium
TLGPKGR

SEQ ID NO: 75420 - protein, 6 aa, Mycobacterium avium
TLGPTT

SEQ ID NO: 75421 - protein, 6 aa, Mycobacterium avium
TLGTLD

SEQ ID NO: 75422 - protein, 8 aa, Mycobacterium avium
TLGTTSKR

SEQ ID NO: 75423 - protein, 6 aa, Mycobacterium avium
TLKKNG

SEQ ID NO: 75424 - protein, 9 aa, Mycobacterium avium
TLKNRGAQC

SEQ ID NO: 75425 - protein, 6 aa, Mycobacterium avium
TLPDER

SEQ ID NO: 75426 - protein, 7 aa, Mycobacterium avium
TLPDGST

SEQ ID NO: 75427 - protein, 7 aa, Mycobacterium avium
TLPEGTR

SEQ ID NO: 75428 - protein, 7 aa, Mycobacterium avium
TLPERLP

SEQ ID NO: 75429 - protein, 10 aa, Mycobacterium avium
TLPERLPDPG

SEQ ID NO: 75430 - protein, 13 aa, Mycobacterium avium
TLPGERPVEREDP

SEQ ID NO: 75431 - protein, 16 aa, Mycobacterium avium
TLPGSAAEDVAARDTA

SEQ ID NO: 75432 - protein, 9 aa, Mycobacterium avium
TLPGSRNGG

SEQ ID NO: 75433 - protein, 4 aa, Mycobacterium avium
TLPI

SEQ ID NO: 75434 - protein, 9 aa, Mycobacterium avium
TLPKRLPDA

SEQ ID NO: 75435 - protein, 6 aa, Mycobacterium avium
TLPNGT

SEQ ID NO: 75436 - protein, 5 aa, Mycobacterium avium
TLPPP

SEQ ID NO: 75437 - protein, 7 aa, Mycobacterium avium
TLPQRER

SEQ ID NO: 75438 - protein, 6 aa, Mycobacterium avium
TLPSID

SEQ ID NO: 75439 - protein, 19 aa, Mycobacterium avium
TLQDAGQNHADHIAAAGGS

SEQ ID NO: 75440 - protein, 19 aa, Mycobacterium avium
TLQEAGQNHADHIAAAGGN

SEQ ID NO: 75441 - protein, 6 aa, Mycobacterium avium
TLRPEE

SEQ ID NO: 75442 - protein, 5 aa, Mycobacterium avium
TLRRQ

SEQ ID NO: 75443 - protein, 16 aa, Mycobacterium avium
TLRSTATVELTARAFG

SEQ ID NO: 75444 - protein, 5 aa, Mycobacterium avium
TLSAA

SEQ ID NO: 75445 - protein, 28 aa, Mycobacterium avium
TLSATRRRCGDSTHTPTAGASSATVNPA

SEQ ID NO: 75446 - protein, 10 aa, Mycobacterium avium
TLSGQKNPVL

SEQ ID NO: 75447 - protein, 5 aa, Mycobacterium avium
TLSSP

SEQ ID NO: 75448 - protein, 6 aa, Mycobacterium avium
TLSSST

SEQ ID NO: 75449 - protein, 11 aa, Mycobacterium avium
TLSTGSIEPGA

SEQ ID NO: 75450 - protein, 12 aa, Mycobacterium avium
TLSTGSIEPGAD

SEQ ID NO: 75451 - protein, 10 aa, Mycobacterium avium
TLTEGGDAAN

SEQ ID NO: 75452 - protein, 7 aa, Mycobacterium avium
TLTGHPS

SEQ ID NO: 75453 - protein, 4 aa, Mycobacterium avium
TLTH

SEQ ID NO: 75454 - protein, 20 aa, Mycobacterium avium
TLTNEDGPLVRDGNAVRRRV

SEQ ID NO: 75455 - protein, 6 aa, Mycobacterium avium
TLTPAD

SEQ ID NO: 75456 - protein, 12 aa, Mycobacterium avium
TLTPSSSTRDGR

SEQ ID NO: 75457 - protein, 7 aa, Mycobacterium avium
TLTSGTT

SEQ ID NO: 75458 - protein, 6 aa, Mycobacterium avium
TLTSID

SEQ ID NO: 75459 - protein, 9 aa, Mycobacterium avium
TLVTGGKRL

SEQ ID NO: 75460 - protein, 7 aa, Mycobacterium avium
TLYDAGT

SEQ ID NO: 75461 - protein, 6 aa, Mycobacterium avium
TLYEPT

SEQ ID NO: 75462 - protein, 8 aa, Mycobacterium avium
TMGRPEEI

SEQ ID NO: 75463 - protein, 35 aa, Mycobacterium avium
TMKDERGFPIDEPPEGDVAEQQRPVDTDDETGLDT

SEQ ID NO: 75464 - protein, 14 aa, Mycobacterium avium
TMNSAGKKSAYRKS

SEQ ID NO: 75465 - protein, 4 aa, Mycobacterium avium
TMPD

SEQ ID NO: 75466 - protein, 4 aa, Mycobacterium avium
TMPR

SEQ ID NO: 75467 - protein, 30 aa, Mycobacterium avium
TMPTTDDTQLDDTTSTSSTTTSSKAKTYYY

SEQ ID NO: 75468 - protein, 13 aa, Mycobacterium avium
TMRPGRGRRRRSG

SEQ ID NO: 75469 - protein, 9 aa, Mycobacterium avium
TMSPSGPFT

SEQ ID NO: 75470 - protein, 5 aa, Mycobacterium avium
TMSSG

SEQ ID NO: 75471 - protein, 15 aa, Mycobacterium avium
TMSTTEADGVAGGVT

SEQ ID NO: 75472 - protein, 12 aa, Mycobacterium avium
TNADSASPGVSD

SEQ ID NO: 75473 - protein, 8 aa, Mycobacterium avium
TNAISPST

SEQ ID NO: 75474 - protein, 8 aa, Mycobacterium avium
TNAKKGWQ

SEQ ID NO: 75475 - protein, 10 aa, Mycobacterium avium
TNDKGTPGAK

SEQ ID NO: 75476 - protein, 10 aa, Mycobacterium avium
TNDPGQGWKP

SEQ ID NO: 75477 - protein, 9 aa, Mycobacterium avium
TNDQAPLPK

SEQ ID NO: 75478 - protein, 6 aa, Mycobacterium avium
TNEVPA

SEQ ID NO: 75479 - protein, 20 aa, Mycobacterium avium
TNGANTGATFSEGAAKTAIQ

SEQ ID NO: 75480 - protein, 7 aa, Mycobacterium avium
TNGGPVQ

SEQ ID NO: 75481 - protein, 9 aa, Mycobacterium avium
TNGRGTEQL

SEQ ID NO: 75482 - protein, 10 aa, Mycobacterium avium
TNGSDAQKAA

SEQ ID NO: 75483 - protein, 7 aa, Mycobacterium avium
TNGTPYG

SEQ ID NO: 75484 - protein, 15 aa, Mycobacterium avium
TNGVIPRRDDTSHRA

SEQ ID NO: 75485 - protein, 11 aa, Mycobacterium avium
TNHRGQITAPG

SEQ ID NO: 75486 - protein, 12 aa, Mycobacterium avium
TNIGHAASAAGI

SEQ ID NO: 75487 - protein, 5 aa, Mycobacterium avium
TNKAS

SEQ ID NO: 75488 - protein, 8 aa, Mycobacterium avium
TNPARPRA

SEQ ID NO: 75489 - protein, 11 aa, Mycobacterium avium
TNPDERDASEA

SEQ ID NO: 75490 - protein, 10 aa, Mycobacterium avium
TNPDKPKHKG

SEQ ID NO: 75491 - protein, 6 aa, Mycobacterium avium
TNPTLN

SEQ ID NO: 75492 - protein, 8 aa, Mycobacterium avium
TNQPNNAN

SEQ ID NO: 75493 - protein, 4 aa, Mycobacterium avium
TNRE

SEQ ID NO: 75494 - protein, 12 aa, Mycobacterium avium
TNRHHGSPRAVD

SEQ ID NO: 75495 - protein, 13 aa, Mycobacterium avium
TNRLGDAQHPLTA

SEQ ID NO: 75496 - protein, 6 aa, Mycobacterium avium
TNRPVP

SEQ ID NO: 75497 - protein, 17 aa, Mycobacterium avium
TNRRKPLNDNDNDSGAQ

SEQ ID NO: 75498 - protein, 6 aa, Mycobacterium avium
TNSEHA

SEQ ID NO: 75499 - protein, 17 aa, Mycobacterium avium
TNSRRAIRRRPRNRRKA

SEQ ID NO: 75500 - protein, 17 aa, Mycobacterium avium
TNTPEFGAKGATEPDYW

SEQ ID NO: 75501 - protein, 5 aa, Mycobacterium avium
TNYNT

SEQ ID NO: 75502 - protein, 9 aa, Mycobacterium avium
TPAAADRAA

SEQ ID NO: 75503 - protein, 21 aa, Mycobacterium avium
TPAACGRTPLTATGLSKSYGS

SEQ ID NO: 75504 - protein, 9 aa, Mycobacterium avium
TPADETVRE

SEQ ID NO: 75505 - protein, 4 aa, Mycobacterium avium
TPAG

SEQ ID NO: 75506 - protein, 7 aa, Mycobacterium avium
TPAGKRR

SEQ ID NO: 75507 - protein, 9 aa, Mycobacterium avium
TPAGSYDEV

SEQ ID NO: 75508 - protein, 5 aa, Mycobacterium avium
TPAKL

SEQ ID NO: 75509 - protein, 20 aa, Mycobacterium avium
TPAKPGPQFPQQGPARTPSV

SEQ ID NO: 75510 - protein, 9 aa, Mycobacterium avium
TPANDDQVA

SEQ ID NO: 75511 - protein, 9 aa, Mycobacterium avium
TPANPAELP

SEQ ID NO: 75512 - protein, 20 aa, Mycobacterium avium
TPAPDESGATHTPAAPIGPG

SEQ ID NO: 75513 - protein, 7 aa, Mycobacterium avium
TPAPGDA

SEQ ID NO: 75514 - protein, 26 aa, Mycobacterium avium
TPAPRAAGPPTSTAAGRTWRPSSSCR

SEQ ID NO: 75515 - protein, 11 aa, Mycobacterium avium
TPAQKDEEFRR

SEQ ID NO: 75516 - protein, 8 aa, Mycobacterium avium
TPAQTPSN

SEQ ID NO: 75517 - protein, 15 aa, Mycobacterium avium
TPARSRGGTRRYSAD

SEQ ID NO: 75518 - protein, 12 aa, Mycobacterium avium
TPASDSFAPNIR

SEQ ID NO: 75519 - protein, 5 aa, Mycobacterium avium
TPAST

SEQ ID NO: 75520 - protein, 14 aa, Mycobacterium avium
TPASTLPRSQRVSA

SEQ ID NO: 75521 - protein, 4 aa, Mycobacterium avium
TPAT

SEQ ID NO: 75522 - protein, 14 aa, Mycobacterium avium
TPCRDRGGALDRDR

SEQ ID NO: 75523 - protein, 4 aa, Mycobacterium avium
TPDA

SEQ ID NO: 75524 - protein, 8 aa, Mycobacterium avium
TPDAPRQA

SEQ ID NO: 75525 - protein, 7 aa, Mycobacterium avium
TPDDPIQ

SEQ ID NO: 75526 - protein, 6 aa, Mycobacterium avium
TPDHPA

SEQ ID NO: 75527 - protein, 7 aa, Mycobacterium avium
TPDRLER

SEQ ID NO: 75528 - protein, 6 aa, Mycobacterium avium
TPDTPA

SEQ ID NO: 75529 - protein, 5 aa, Mycobacterium avium
TPDVP

SEQ ID NO: 75530 - protein, 5 aa, Mycobacterium avium
TPEDM

SEQ ID NO: 75531 - protein, 7 aa, Mycobacterium avium
TPEDRPV

SEQ ID NO: 75532 - protein, 8 aa, Mycobacterium avium
TPEEYGGA

SEQ ID NO: 75533 - protein, 6 aa, Mycobacterium avium
TPEGQT

SEQ ID NO: 75534 - protein, 8 aa, Mycobacterium avium
TPEQYGGA

SEQ ID NO: 75535 - protein, 5 aa, Mycobacterium avium
TPERL

SEQ ID NO: 75536 - protein, 12 aa, Mycobacterium avium
TPERPDDAENPL

SEQ ID NO: 75537 - protein, 11 aa, Mycobacterium avium
TPFGKRRDARV

SEQ ID NO: 75538 - protein, 4 aa, Mycobacterium avium
TPFP

SEQ ID NO: 75539 - protein, 33 aa, Mycobacterium avium
TPFTEPPRTTESSAAARQSAAVAQSAASDLPAQ

SEQ ID NO: 75540 - protein, 9 aa, Mycobacterium avium
TPGAAASNP

SEQ ID NO: 75541 - protein, 8 aa, Mycobacterium avium
TPGAGDKR

SEQ ID NO: 75542 - protein, 7 aa, Mycobacterium avium
TPGANQT

SEQ ID NO: 75543 - protein, 4 aa, Mycobacterium avium
TPGD

SEQ ID NO: 75544 - protein, 12 aa, Mycobacterium avium
TPGEEPTALPDP

SEQ ID NO: 75545 - protein, 8 aa, Mycobacterium avium
TPGGETTD

SEQ ID NO: 75546 - protein, 4 aa, Mycobacterium avium
TPGH

SEQ ID NO: 75547 - protein, 9 aa, Mycobacterium avium
TPGHEHDTA

SEQ ID NO: 75548 - protein, 4 aa, Mycobacterium avium
TPGI

SEQ ID NO: 75549 - protein, 5 aa, Mycobacterium avium
TPGKR

SEQ ID NO: 75550 - protein, 6 aa, Mycobacterium avium
TPGQQR

SEQ ID NO: 75551 - protein, 7 aa, Mycobacterium avium
TPGTTPR

SEQ ID NO: 75552 - protein, 5 aa, Mycobacterium avium
TPHAL

SEQ ID NO: 75553 - protein, 6 aa, Mycobacterium avium
TPHEQV

SEQ ID NO: 75554 - protein, 7 aa, Mycobacterium avium
TPHPVDG

SEQ ID NO: 75555 - protein, 6 aa, Mycobacterium avium
TPHQQV

SEQ ID NO: 75556 - protein, 9 aa, Mycobacterium avium
TPHSGKEED

SEQ ID NO: 75557 - protein, 21 aa, Mycobacterium avium
TPHSMKSQGSGRGKPARAARS

SEQ ID NO: 75558 - protein, 5 aa, Mycobacterium avium
TPHTA

SEQ ID NO: 75559 - protein, 7 aa, Mycobacterium avium
TPIPGEH

SEQ ID NO: 75560 - protein, 12 aa, Mycobacterium avium
TPIPGVATPDQV

SEQ ID NO: 75561 - protein, 8 aa, Mycobacterium avium
TPITDESI

SEQ ID NO: 75562 - protein, 7 aa, Mycobacterium avium
TPLDPER

SEQ ID NO: 75563 - protein, 50 aa, Mycobacterium avium
TPLPAAPQTKPQTKPPSGPAPAPAGEPAAPDEQPGIGDDRQMESGNRQPY

SEQ ID NO: 75564 - protein, 10 aa, Mycobacterium avium
TPLPSPNPEV

SEQ ID NO: 75565 - protein, 15 aa, Mycobacterium avium
TPLPSPNSGPVPGGW

SEQ ID NO: 75566 - protein, 9 aa, Mycobacterium avium
TPNLPGGPF

SEQ ID NO: 75567 - protein, 12 aa, Mycobacterium avium
TPPAADDPQRRC

SEQ ID NO: 75568 - protein, 55 aa, Mycobacterium avium
TPPAAPPAAPGGPGAPAPGAPGTPAAPGAPAAPAPAAPGAPAAPGAPAPGQAPAV

SEQ ID NO: 75569 - protein, 5 aa, Mycobacterium avium
TPPAR

SEQ ID NO: 75570 - protein, 12 aa, Mycobacterium avium
TPPATDDPQRRC

SEQ ID NO: 75571 - protein, 9 aa, Mycobacterium avium
TPPGSPEAA

SEQ ID NO: 75572 - protein, 5 aa, Mycobacterium avium
TPPPG

SEQ ID NO: 75573 - protein, 5 aa, Mycobacterium avium
TPPQV

SEQ ID NO: 75574 - protein, 20 aa, Mycobacterium avium
TPPTTSPKPKPRPTQTKGAP

SEQ ID NO: 75575 - protein, 20 aa, Mycobacterium avium
TPPTTSTKPKPRTTLTKGAP

SEQ ID NO: 75576 - protein, 24 aa, Mycobacterium avium
TPPVDAPPAAAPAPSTAGGAAPVA

SEQ ID NO: 75577 - protein, 8 aa, Mycobacterium avium
TPPVRQNG

SEQ ID NO: 75578 - protein, 13 aa, Mycobacterium avium
TPQEAADHGAAEA

SEQ ID NO: 75579 - protein, 10 aa, Mycobacterium avium
TPQQAPTQVP

SEQ ID NO: 75580 - protein, 9 aa, Mycobacterium avium
TPQRADGSI

SEQ ID NO: 75581 - protein, 11 aa, Mycobacterium avium
TPQSRRREDGL

SEQ ID NO: 75582 - protein, 22 aa, Mycobacterium avium
TPQYSNPEAGGSAAITGYRASN

SEQ ID NO: 75583 - protein, 11 aa, Mycobacterium avium
TPRDTRRTTDN

SEQ ID NO: 75584 - protein, 14 aa, Mycobacterium avium
TPRETLNDPQVEPS

SEQ ID NO: 75585 - protein, 4 aa, Mycobacterium avium
TPRP

SEQ ID NO: 75586 - protein, 13 aa, Mycobacterium avium
TPRRDAGPGPRVR

SEQ ID NO: 75587 - protein, 9 aa, Mycobacterium avium
TPRRGIGDR

SEQ ID NO: 75588 - protein, 7 aa, Mycobacterium avium
TPRRPTT

SEQ ID NO: 75589 - protein, 12 aa, Mycobacterium avium
TPRRRRHREHRT

SEQ ID NO: 75590 - protein, 4 aa, Mycobacterium avium
TPRS

SEQ ID NO: 75591 - protein, 9 aa, Mycobacterium avium
TPSAGVGPW

SEQ ID NO: 75592 - protein, 4 aa, Mycobacterium avium
TPSD

SEQ ID NO: 75593 - protein, 7 aa, Mycobacterium avium
TPSEPTF

SEQ ID NO: 75594 - protein, 16 aa, Mycobacterium avium
TPSHADPAKPPLQGPG

SEQ ID NO: 75595 - protein, 7 aa, Mycobacterium avium
TPSPGDA

SEQ ID NO: 75596 - protein, 6 aa, Mycobacterium avium
TPSPLR

SEQ ID NO: 75597 - protein, 17 aa, Mycobacterium avium
TPSRTDGGTRRYSDDDL

SEQ ID NO: 75598 - protein, 9 aa, Mycobacterium avium
TPSRTDRCA

SEQ ID NO: 75599 - protein, 9 aa, Mycobacterium avium
TPSSSATYG

SEQ ID NO: 75600 - protein, 6 aa, Mycobacterium avium
TPSTSG

SEQ ID NO: 75601 - protein, 34 aa, Mycobacterium avium
TPSTVDARNNTSYRPGMGQDAATRLATGAATQLP

SEQ ID NO: 75602 - protein, 13 aa, Mycobacterium avium
TPSVPDSRDRPTL

SEQ ID NO: 75603 - protein, 6 aa, Mycobacterium avium
TPTEDA

SEQ ID NO: 75604 - protein, 7 aa, Mycobacterium avium
TPTEDAD

SEQ ID NO: 75605 - protein, 6 aa, Mycobacterium avium
TPTEEA

SEQ ID NO: 75606 - protein, 9 aa, Mycobacterium avium
TPTENGSAT

SEQ ID NO: 75607 - protein, 11 aa, Mycobacterium avium
TPTEVNGRSPL

SEQ ID NO: 75608 - protein, 5 aa, Mycobacterium avium
TPTLG

SEQ ID NO: 75609 - protein, 6 aa, Mycobacterium avium
TPTLVG

SEQ ID NO: 75610 - protein, 13 aa, Mycobacterium avium
TPTPVVGGPRSGV

SEQ ID NO: 75611 - protein, 18 aa, Mycobacterium avium
TPTQPVPVGDDGSLPADL

SEQ ID NO: 75612 - protein, 9 aa, Mycobacterium avium
TPTTAARKI

SEQ ID NO: 75613 - protein, 4 aa, Mycobacterium avium
TPVD

SEQ ID NO: 75614 - protein, 7 aa, Mycobacterium avium
TPVERAS

SEQ ID NO: 75615 - protein, 14 aa, Mycobacterium avium
TPVGGPYPEMHQKA

SEQ ID NO: 75616 - protein, 5 aa, Mycobacterium avium
TPVPA

SEQ ID NO: 75617 - protein, 8 aa, Mycobacterium avium
TPVPGTEV

SEQ ID NO: 75618 - protein, 33 aa, Mycobacterium avium
TPVPPPLPAPALRTNGAQAKWSKRDAPRPTGDV

SEQ ID NO: 75619 - protein, 9 aa, Mycobacterium avium
TPVPTGPAQ

SEQ ID NO: 75620 - protein, 25 aa, Mycobacterium avium
TPVSGGKCGHHTGSAAPDHDDVVLL

SEQ ID NO: 75621 - protein, 5 aa, Mycobacterium avium
TPVSP

SEQ ID NO: 75622 - protein, 9 aa, Mycobacterium avium
TPVSSNGAL

SEQ ID NO: 75623 - protein, 5 aa, Mycobacterium avium
TPVTG

SEQ ID NO: 75624 - protein, 15 aa, Mycobacterium avium
TPWAPRSAAPELGQH

SEQ ID NO: 75625 - protein, 5 aa, Mycobacterium avium
TPYNG

SEQ ID NO: 75626 - protein, 11 aa, Mycobacterium avium
TQAAIGPMKDA

SEQ ID NO: 75627 - protein, 8 aa, Mycobacterium avium
TQANHGKP

SEQ ID NO: 75628 - protein, 9 aa, Mycobacterium avium
TQARSDAAE

SEQ ID NO: 75629 - protein, 10 aa, Mycobacterium avium
TQATTASTAM

SEQ ID NO: 75630 - protein, 7 aa, Mycobacterium avium
TQAYSSA

SEQ ID NO: 75631 - protein, 7 aa, Mycobacterium avium
TQDGAPT

SEQ ID NO: 75632 - protein, 13 aa, Mycobacterium avium
TQDPVYAGSGYSA

SEQ ID NO: 75633 - protein, 10 aa, Mycobacterium avium
TQEQKDAEYA

SEQ ID NO: 75634 - protein, 26 aa, Mycobacterium avium
TQETPVDNSIEGDRSLDPGARRDPFP

SEQ ID NO: 75635 - protein, 4 aa, Mycobacterium avium
TQEV

SEQ ID NO: 75636 - protein, 15 aa, Mycobacterium avium
TQGLAPDLKPEQRGK

SEQ ID NO: 75637 - protein, 5 aa, Mycobacterium avium
TQGQA

SEQ ID NO: 75638 - protein, 5 aa, Mycobacterium avium
TQGRG

SEQ ID NO: 75639 - protein, 6 aa, Mycobacterium avium
TQGWQP

SEQ ID NO: 75640 - protein, 4 aa, Mycobacterium avium
TQIA

SEQ ID NO: 75641 - protein, 18 aa, Mycobacterium avium
TQKAYDDGVISSDPDANI

SEQ ID NO: 75642 - protein, 7 aa, Mycobacterium avium
TQPAEAA

SEQ ID NO: 75643 - protein, 5 aa, Mycobacterium avium
TQPGA

SEQ ID NO: 75644 - protein, 7 aa, Mycobacterium avium
TQPGQSD

SEQ ID NO: 75645 - protein, 7 aa, Mycobacterium avium
TQPGTAE

SEQ ID NO: 75646 - protein, 30 aa, Mycobacterium avium
TQPGTTPPVKSAAPTSSGATTTPAPGGGAL

SEQ ID NO: 75647 - protein, 12 aa, Mycobacterium avium
TQPHPGEPADSP

SEQ ID NO: 75648 - protein, 15 aa, Mycobacterium avium
TQPHTVPDTADQQQA

SEQ ID NO: 75649 - protein, 16 aa, Mycobacterium avium
TQPISPNKSTFGGKDR

SEQ ID NO: 75650 - protein, 4 aa, Mycobacterium avium
TQPP

SEQ ID NO: 75651 - protein, 10 aa, Mycobacterium avium
TQQAARAHSI

SEQ ID NO: 75652 - protein, 6 aa, Mycobacterium avium
TQRAAR

SEQ ID NO: 75653 - protein, 29 aa, Mycobacterium avium
TQRDTEVKPPSDPDDETTPAVDTTTKPPV

SEQ ID NO: 75654 - protein, 8 aa, Mycobacterium avium
TQRPPDAV

SEQ ID NO: 75655 - protein, 4 aa, Mycobacterium avium
TQRQ

SEQ ID NO: 75656 - protein, 5 aa, Mycobacterium avium
TQSAG

SEQ ID NO: 75657 - protein, 13 aa, Mycobacterium avium
TQSGGRESSAESV

SEQ ID NO: 75658 - protein, 14 aa, Mycobacterium avium
TQSGTSPEQATENM

SEQ ID NO: 75659 - protein, 8 aa, Mycobacterium avium
TQTAPAGT

SEQ ID NO: 75660 - protein, 13 aa, Mycobacterium avium
TQTTDGRFALAGE

SEQ ID NO: 75661 - protein, 9 aa, Mycobacterium avium
TQYDSAATE

SEQ ID NO: 75662 - protein, 10 aa, Mycobacterium avium
TRAAAVTQTH

SEQ ID NO: 75663 - protein, 9 aa, Mycobacterium avium
TRAASRATV

SEQ ID NO: 75664 - protein, 6 aa, Mycobacterium avium
TRADDD

SEQ ID NO: 75665 - protein, 4 aa, Mycobacterium avium
TRAG

SEQ ID NO: 75666 - protein, 10 aa, Mycobacterium avium
TRAGGKYRGG

SEQ ID NO: 75667 - protein, 20 aa, Mycobacterium avium
TRAGPVGRPPATTTPLDEIN

SEQ ID NO: 75668 - protein, 4 aa, Mycobacterium avium
TRAK

SEQ ID NO: 75669 - protein, 8 aa, Mycobacterium avium
TRAKNKVR

SEQ ID NO: 75670 - protein, 6 aa, Mycobacterium avium
TRAPEE

SEQ ID NO: 75671 - protein, 7 aa, Mycobacterium avium
TRAPTVN

SEQ ID NO: 75672 - protein, 13 aa, Mycobacterium avium
TRASRKSAQAAAV

SEQ ID NO: 75673 - protein, 7 aa, Mycobacterium avium
TRATLTR

SEQ ID NO: 75674 - protein, 16 aa, Mycobacterium avium
TRATMQERRNGQRGGL

SEQ ID NO: 75675 - protein, 8 aa, Mycobacterium avium
TRDEGSLD

SEQ ID NO: 75676 - protein, 12 aa, Mycobacterium avium
TRDEPHADAEKY

SEQ ID NO: 75677 - protein, 9 aa, Mycobacterium avium
TRDLSNEAT

SEQ ID NO: 75678 - protein, 4 aa, Mycobacterium avium
TRDP

SEQ ID NO: 75679 - protein, 7 aa, Mycobacterium avium
TRDQAVP

SEQ ID NO: 75680 - protein, 7 aa, Mycobacterium avium
TRDRIGQ

SEQ ID NO: 75681 - protein, 13 aa, Mycobacterium avium
TRDRRKDAQEEHG

SEQ ID NO: 75682 - protein, 30 aa, Mycobacterium avium
TRDSYSSSLRKAQTNLANDGYDPTSTFGAD

SEQ ID NO: 75683 - protein, 10 aa, Mycobacterium avium
TRDTEQARYD

SEQ ID NO: 75684 - protein, 6 aa, Mycobacterium avium
TRDTNY

SEQ ID NO: 75685 - protein, 10 aa, Mycobacterium avium
TRDTSAATAQ

SEQ ID NO: 75686 - protein, 7 aa, Mycobacterium avium
TREDQDN

SEQ ID NO: 75687 - protein, 9 aa, Mycobacterium avium
TREEKGKFT

SEQ ID NO: 75688 - protein, 7 aa, Mycobacterium avium
TREGQDR

SEQ ID NO: 75689 - protein, 5 aa, Mycobacterium avium
TRELG

SEQ ID NO: 75690 - protein, 8 aa, Mycobacterium avium
TREQFGRP

SEQ ID NO: 75691 - protein, 7 aa, Mycobacterium avium
TRESDGS

SEQ ID NO: 75692 - protein, 6 aa, Mycobacterium avium
TRFNAP

SEQ ID NO: 75693 - protein, 7 aa, Mycobacterium avium
TRGARQQ

SEQ ID NO: 75694 - protein, 4 aa, Mycobacterium avium
TRGE

SEQ ID NO: 75695 - protein, 6 aa, Mycobacterium avium
TRGETQ

SEQ ID NO: 75696 - protein, 7 aa, Mycobacterium avium
TRGHDAE

SEQ ID NO: 75697 - protein, 8 aa, Mycobacterium avium
TRGNPRSK

SEQ ID NO: 75698 - protein, 6 aa, Mycobacterium avium
TRGTPI

SEQ ID NO: 75699 - protein, 42 aa, Mycobacterium avium
TRGTPQPPSLRHPGGTAPGPMPYPGAPPYGAPQYAPDGTPLY

SEQ ID NO: 75700 - protein, 10 aa, Mycobacterium avium
TRGTSQQGFD

SEQ ID NO: 75701 - protein, 7 aa, Mycobacterium avium
TRGVDDR

SEQ ID NO: 75702 - protein, 5 aa, Mycobacterium avium
TRGYT

SEQ ID NO: 75703 - protein, 4 aa, Mycobacterium avium
TRHP

SEQ ID NO: 75704 - protein, 22 aa, Mycobacterium avium
TRINQDSTPLNGANGSTGSASY

SEQ ID NO: 75705 - protein, 8 aa, Mycobacterium avium
TRKAGDLE

SEQ ID NO: 75706 - protein, 5 aa, Mycobacterium avium
TRKDV

SEQ ID NO: 75707 - protein, 13 aa, Mycobacterium avium
TRLDDAPDRAAEV

SEQ ID NO: 75708 - protein, 5 aa, Mycobacterium avium
TRLDP

SEQ ID NO: 75709 - protein, 15 aa, Mycobacterium avium
TRLSAARRRGGDPIT

SEQ ID NO: 75710 - protein, 9 aa, Mycobacterium avium
TRLSPEAPV

SEQ ID NO: 75711 - protein, 10 aa, Mycobacterium avium
TRLSTGADYE

SEQ ID NO: 75712 - protein, 5 aa, Mycobacterium avium
TRPAD

SEQ ID NO: 75713 - protein, 21 aa, Mycobacterium avium
TRPDDPPELTEHTQGRPLSAA

SEQ ID NO: 75714 - protein, 7 aa, Mycobacterium avium
TRPEQPV

SEQ ID NO: 75715 - protein, 8 aa, Mycobacterium avium
TRPEQPVP

SEQ ID NO: 75716 - protein, 21 aa, Mycobacterium avium
TRPEYTNGGKAFAAGGQACQR

SEQ ID NO: 75717 - protein, 21 aa, Mycobacterium avium
TRPEYTNGGKAFPAGGQACQR

SEQ ID NO: 75718 - protein, 10 aa, Mycobacterium avium
TRPGDSRRDR

SEQ ID NO: 75719 - protein, 25 aa, Mycobacterium avium
TRPPNGHSRPRRRPAPPRRPTNWRM

SEQ ID NO: 75720 - protein, 21 aa, Mycobacterium avium
TRPQYTNGGKAFAAGGQACQR

SEQ ID NO: 75721 - protein, 5 aa, Mycobacterium avium
TRPSY

SEQ ID NO: 75722 - protein, 11 aa, Mycobacterium avium
TRPTPRPLPDP

SEQ ID NO: 75723 - protein, 5 aa, Mycobacterium avium
TRQLD

SEQ ID NO: 75724 - protein, 11 aa, Mycobacterium avium
TRRDADGGFDD

SEQ ID NO: 75725 - protein, 6 aa, Mycobacterium avium
TRRDDL

SEQ ID NO: 75726 - protein, 4 aa, Mycobacterium avium
TRRG

SEQ ID NO: 75727 - protein, 20 aa, Mycobacterium avium
TRRGGVPDGGSDRPATGPGW

SEQ ID NO: 75728 - protein, 12 aa, Mycobacterium avium
TRRLSEALADES

SEQ ID NO: 75729 - protein, 5 aa, Mycobacterium avium
TRRPA

SEQ ID NO: 75730 - protein, 8 aa, Mycobacterium avium
TRRPEDNI

SEQ ID NO: 75731 - protein, 11 aa, Mycobacterium avium
TRRRDPGVSEA

SEQ ID NO: 75732 - protein, 17 aa, Mycobacterium avium
TRRSAQVRSRHRVQCLT

SEQ ID NO: 75733 - protein, 16 aa, Mycobacterium avium
TRRSPTGSDQSGTGSV

SEQ ID NO: 75734 - protein, 11 aa, Mycobacterium avium
TRSALGIGPGQ

SEQ ID NO: 75735 - protein, 6 aa, Mycobacterium avium
TRSGDT

SEQ ID NO: 75736 - protein, 60 aa, Mycobacterium avium
TRSRDGPDATVGGPGGGHHRRRRRDRAGRGAPDARRRRHHRGGRHRRRRRGGGRRRTVRP

SEQ ID NO: 75737 - protein, 15 aa, Mycobacterium avium
TRSRSAPADALGRAR

SEQ ID NO: 75738 - protein, 5 aa, Mycobacterium avium
TRSVV

SEQ ID NO: 75739 - protein, 17 aa, Mycobacterium avium
TRTGDGYGGLPQAVTPR

SEQ ID NO: 75740 - protein, 13 aa, Mycobacterium avium
TRTGSATVDYTPQ

SEQ ID NO: 75741 - protein, 10 aa, Mycobacterium avium
TRTNALNRPK

SEQ ID NO: 75742 - protein, 10 aa, Mycobacterium avium
TRTPDPADAR

SEQ ID NO: 75743 - protein, 14 aa, Mycobacterium avium
TRTPELAAALGAPS

SEQ ID NO: 75744 - protein, 7 aa, Mycobacterium avium
TRTPLDA

SEQ ID NO: 75745 - protein, 37 aa, Mycobacterium avium
TRTPTAVGGDGGATVSARTSPVAAPSRPNTPAPHTYS

SEQ ID NO: 75746 - protein, 7 aa, Mycobacterium avium
TRTRTTQ

SEQ ID NO: 75747 - protein, 6 aa, Mycobacterium avium
TRTSRG

SEQ ID NO: 75748 - protein, 6 aa, Mycobacterium avium
TRTTRS

SEQ ID NO: 75749 - protein, 23 aa, Mycobacterium avium
TRVPAARAARPPRPAPADSGNPL

SEQ ID NO: 75750 - protein, 7 aa, Mycobacterium avium
TRVSTTL

SEQ ID NO: 75751 - protein, 13 aa, Mycobacterium avium
TRYPADGVSPEAV

SEQ ID NO: 75752 - protein, 9 aa, Mycobacterium avium
TRYPPEGIR

SEQ ID NO: 75753 - protein, 18 aa, Mycobacterium avium
TRYPSSRRCPPPASRRSR

SEQ ID NO: 75754 - protein, 10 aa, Mycobacterium avium
TSAAERAQHF

SEQ ID NO: 75755 - protein, 25 aa, Mycobacterium avium
TSAAESATGDAFPENGRRQLHSRGG

SEQ ID NO: 75756 - protein, 14 aa, Mycobacterium avium
TSAAGASWQDRRTR

SEQ ID NO: 75757 - protein, 7 aa, Mycobacterium avium
TSAAPED

SEQ ID NO: 75758 - protein, 8 aa, Mycobacterium avium
TSAEDGLA

SEQ ID NO: 75759 - protein, 9 aa, Mycobacterium avium
TSAFSGPTM

SEQ ID NO: 75760 - protein, 8 aa, Mycobacterium avium
TSAGASAG

SEQ ID NO: 75761 - protein, 8 aa, Mycobacterium avium
TSAGDPAL

SEQ ID NO: 75762 - protein, 34 aa, Mycobacterium avium
TSAGQTPPGTTTLPNTAGQAGYQGPCPPAGTGTH

SEQ ID NO: 75763 - protein, 8 aa, Mycobacterium avium
TSAGVSAG

SEQ ID NO: 75764 - protein, 8 aa, Mycobacterium avium
TSAISNSH

SEQ ID NO: 75765 - protein, 13 aa, Mycobacterium avium
TSANGTASADIAG

SEQ ID NO: 75766 - protein, 16 aa, Mycobacterium avium
TSAPAAAAEPGLGPPG

SEQ ID NO: 75767 - protein, 5 aa, Mycobacterium avium
TSASA

SEQ ID NO: 75768 - protein, 9 aa, Mycobacterium avium
TSATTARGT

SEQ ID NO: 75769 - protein, 11 aa, Mycobacterium avium
TSAVRTPSGYR

SEQ ID NO: 75770 - protein, 5 aa, Mycobacterium avium
TSDPS

SEQ ID NO: 75771 - protein, 5 aa, Mycobacterium avium
TSDVN

SEQ ID NO: 75772 - protein, 19 aa, Mycobacterium avium
TSEPWQGPSAAAVTAAAAT

SEQ ID NO: 75773 - protein, 4 aa, Mycobacterium avium
TSEQ

SEQ ID NO: 75774 - protein, 5 aa, Mycobacterium avium
TSEQI

SEQ ID NO: 75775 - protein, 6 aa, Mycobacterium avium
TSETRG

SEQ ID NO: 75776 - protein, 12 aa, Mycobacterium avium
TSFIPPPAGGQE

SEQ ID NO: 75777 - protein, 8 aa, Mycobacterium avium
TSFSTPEF

SEQ ID NO: 75778 - protein, 4 aa, Mycobacterium avium
TSGA

SEQ ID NO: 75779 - protein, 7 aa, Mycobacterium avium
TSGAARR

SEQ ID NO: 75780 - protein, 9 aa, Mycobacterium avium
TSGAGKSTA

SEQ ID NO: 75781 - protein, 8 aa, Mycobacterium avium
TSGAPGLG

SEQ ID NO: 75782 - protein, 8 aa, Mycobacterium avium
TSGEPGAA

SEQ ID NO: 75783 - protein, 5 aa, Mycobacterium avium
TSGGQ

SEQ ID NO: 75784 - protein, 18 aa, Mycobacterium avium
TSGGQISRYRPEASESEV

SEQ ID NO: 75785 - protein, 18 aa, Mycobacterium avium
TSGGQISRYRPQASESEV

SEQ ID NO: 75786 - protein, 7 aa, Mycobacterium avium
TSGGVWG

SEQ ID NO: 75787 - protein, 7 aa, Mycobacterium avium
TSGHEPK

SEQ ID NO: 75788 - protein, 10 aa, Mycobacterium avium
TSGIDQQHKE

SEQ ID NO: 75789 - protein, 7 aa, Mycobacterium avium
TSGIGAG

SEQ ID NO: 75790 - protein, 15 aa, Mycobacterium avium
TSGPMSTVSSSPETV

SEQ ID NO: 75791 - protein, 14 aa, Mycobacterium avium
TSGPPQVEAATAGK

SEQ ID NO: 75792 - protein, 6 aa, Mycobacterium avium
TSGSAT

SEQ ID NO: 75793 - protein, 12 aa, Mycobacterium avium
TSGSTRQPAGVM

SEQ ID NO: 75794 - protein, 9 aa, Mycobacterium avium
TSGSTRRPA

SEQ ID NO: 75795 - protein, 15 aa, Mycobacterium avium
TSGTITARGKKYELE

SEQ ID NO: 75796 - protein, 7 aa, Mycobacterium avium
TSGTTGL

SEQ ID NO: 75797 - protein, 8 aa, Mycobacterium avium
TSGVIGRG

SEQ ID NO: 75798 - protein, 8 aa, Mycobacterium avium
TSGVPERQ

SEQ ID NO: 75799 - protein, 5 aa, Mycobacterium avium
TSHSS

SEQ ID NO: 75800 - protein, 11 aa, Mycobacterium avium
TSIATSCGRET

SEQ ID NO: 75801 - protein, 22 aa, Mycobacterium avium
TSKSTSKAGPDSAAAPPMTGPL

SEQ ID NO: 75802 - protein, 22 aa, Mycobacterium avium
TSKSTSKAGPDSAAAPSMTGPL

SEQ ID NO: 75803 - protein, 4 aa, Mycobacterium avium
TSLG

SEQ ID NO: 75804 - protein, 15 aa, Mycobacterium avium
TSLNNTQAQADPDGK

SEQ ID NO: 75805 - protein, 7 aa, Mycobacterium avium
TSLPDRE

SEQ ID NO: 75806 - protein, 9 aa, Mycobacterium avium
TSNAGTDWR

SEQ ID NO: 75807 - protein, 11 aa, Mycobacterium avium
TSNEENLTPQE

SEQ ID NO: 75808 - protein, 29 aa, Mycobacterium avium
TSPCGREKSTVSWGPTAPASRPRSASCWD

SEQ ID NO: 75809 - protein, 5 aa, Mycobacterium avium
TSPEF

SEQ ID NO: 75810 - protein, 7 aa, Mycobacterium avium
TSPKTEK

SEQ ID NO: 75811 - protein, 12 aa, Mycobacterium avium
TSPLGSGAPLLT

SEQ ID NO: 75812 - protein, 11 aa, Mycobacterium avium
TSPNNSRPKGT

SEQ ID NO: 75813 - protein, 11 aa, Mycobacterium avium
TSPPDPHNRHN

SEQ ID NO: 75814 - protein, 8 aa, Mycobacterium avium
TSPPTDGL

SEQ ID NO: 75815 - protein, 4 aa, Mycobacterium avium
TSPQ

SEQ ID NO: 75816 - protein, 13 aa, Mycobacterium avium
TSPRARPTSCGLP

SEQ ID NO: 75817 - protein, 6 aa, Mycobacterium avium
TSPRAT

SEQ ID NO: 75818 - protein, 12 aa, Mycobacterium avium
TSPRGLAGPLPA

SEQ ID NO: 75819 - protein, 12 aa, Mycobacterium avium
TSPRGLAGPLPT

SEQ ID NO: 75820 - protein, 11 aa, Mycobacterium avium
TSPSATDRRAA

SEQ ID NO: 75821 - protein, 10 aa, Mycobacterium avium
TSQAPNGPAE

SEQ ID NO: 75822 - protein, 8 aa, Mycobacterium avium
TSQGGTAK

SEQ ID NO: 75823 - protein, 8 aa, Mycobacterium avium
TSQGPTAT

SEQ ID NO: 75824 - protein, 15 aa, Mycobacterium avium
TSQNNGAVRSPKTAE

SEQ ID NO: 75825 - protein, 12 aa, Mycobacterium avium
TSQRGETTTRGT

SEQ ID NO: 75826 - protein, 9 aa, Mycobacterium avium
TSRAFGRGP

SEQ ID NO: 75827 - protein, 10 aa, Mycobacterium avium
TSRDGAPPIR

SEQ ID NO: 75828 - protein, 6 aa, Mycobacterium avium
TSRIDG

SEQ ID NO: 75829 - protein, 7 aa, Mycobacterium avium
TSRIDGS

SEQ ID NO: 75830 - protein, 8 aa, Mycobacterium avium
TSRIDGST

SEQ ID NO: 75831 - protein, 13 aa, Mycobacterium avium
TSRNGAGPAPDSE

SEQ ID NO: 75832 - protein, 7 aa, Mycobacterium avium
TSRNNPW

SEQ ID NO: 75833 - protein, 5 aa, Mycobacterium avium
TSRPD

SEQ ID NO: 75834 - protein, 6 aa, Mycobacterium avium
TSRPPA

SEQ ID NO: 75835 - protein, 6 aa, Mycobacterium avium
TSRTEA

SEQ ID NO: 75836 - protein, 9 aa, Mycobacterium avium
TSRTFGRGP

SEQ ID NO: 75837 - protein, 10 aa, Mycobacterium avium
TSRTFGRGPR

SEQ ID NO: 75838 - protein, 35 aa, Mycobacterium avium
TSSDSEYVAESPAPARAGETQSGRANCARTFPRWW

SEQ ID NO: 75839 - protein, 6 aa, Mycobacterium avium
TSSGDR

SEQ ID NO: 75840 - protein, 31 aa, Mycobacterium avium
TSSGGSIYGTPPTYPTPETVPTDPASPYAAG

SEQ ID NO: 75841 - protein, 4 aa, Mycobacterium avium
TSSP

SEQ ID NO: 75842 - protein, 13 aa, Mycobacterium avium
TSSPTPQMQQGYR

SEQ ID NO: 75843 - protein, 5 aa, Mycobacterium avium
TSSQL

SEQ ID NO: 75844 - protein, 6 aa, Mycobacterium avium
TSSQLM

SEQ ID NO: 75845 - protein, 17 aa, Mycobacterium avium
TSSTSGSRPSPATSLRR

SEQ ID NO: 75846 - protein, 5 aa, Mycobacterium avium
TSSVD

SEQ ID NO: 75847 - protein, 20 aa, Mycobacterium avium
TSTAPPGGESFDSAAERVSR

SEQ ID NO: 75848 - protein, 7 aa, Mycobacterium avium
TSTASRG

SEQ ID NO: 75849 - protein, 10 aa, Mycobacterium avium
TSTGPDHDKE

SEQ ID NO: 75850 - protein, 4 aa, Mycobacterium avium
TSTP

SEQ ID NO: 75851 - protein, 11 aa, Mycobacterium avium
TSTPDLDAGPH

SEQ ID NO: 75852 - protein, 11 aa, Mycobacterium avium
TSTPDMGAGPH

SEQ ID NO: 75853 - protein, 5 aa, Mycobacterium avium
TSTPF

SEQ ID NO: 75854 - protein, 11 aa, Mycobacterium avium
TSTPGTTGTTE

SEQ ID NO: 75855 - protein, 5 aa, Mycobacterium avium
TSTSG

SEQ ID NO: 75856 - protein, 7 aa, Mycobacterium avium
TSTSGLY

SEQ ID NO: 75857 - protein, 6 aa, Mycobacterium avium
TSTSLD

SEQ ID NO: 75858 - protein, 9 aa, Mycobacterium avium
TSTTATGFE

SEQ ID NO: 75859 - protein, 24 aa, Mycobacterium avium
TSVPPPDGPLQPQSTRPPGRRDPY

SEQ ID NO: 75860 - protein, 23 aa, Mycobacterium avium
TSVPPPDGPLQPQSTRPRHRRDP

SEQ ID NO: 75861 - protein, 25 aa, Mycobacterium avium
TSVPPPDGPLQPQSTRPRQRRDPYS

SEQ ID NO: 75862 - protein, 13 aa, Mycobacterium avium
TSWPERTPPSTAD

SEQ ID NO: 75863 - protein, 13 aa, Mycobacterium avium
TSWPERTPPSTAE

SEQ ID NO: 75864 - protein, 4 aa, Mycobacterium avium
TSWS

SEQ ID NO: 75865 - protein, 8 aa, Mycobacterium avium
TSWSPRET

SEQ ID NO: 75866 - protein, 6 aa, Mycobacterium avium
TSYAGQ

SEQ ID NO: 75867 - protein, 9 aa, Mycobacterium avium
TTAAESSST

SEQ ID NO: 75868 - protein, 18 aa, Mycobacterium avium
TTAAPACSSTGRPSCSSG

SEQ ID NO: 75869 - protein, 5 aa, Mycobacterium avium
TTADR

SEQ ID NO: 75870 - protein, 4 aa, Mycobacterium avium
TTAE

SEQ ID NO: 75871 - protein, 6 aa, Mycobacterium avium
TTAFGG

SEQ ID NO: 75872 - protein, 13 aa, Mycobacterium avium
TTAGQAEQVATQA

SEQ ID NO: 75873 - protein, 13 aa, Mycobacterium avium
TTAGRAEQVATQA

SEQ ID NO: 75874 - protein, 7 aa, Mycobacterium avium
TTAHRDG

SEQ ID NO: 75875 - protein, 10 aa, Mycobacterium avium
TTALPDPDSD

SEQ ID NO: 75876 - protein, 8 aa, Mycobacterium avium
TTAPTPRT

SEQ ID NO: 75877 - protein, 72 aa, Mycobacterium avium
TTAPTQQVPQQAPLQQTPAQQAPLQQTPGQQAPLQQTPGQQLPTQQAPLQQVPGQQVPGQQLPTQQAPQQAP

SEQ ID NO: 75878 - protein, 6 aa, Mycobacterium avium
TTAQAT

SEQ ID NO: 75879 - protein, 10 aa, Mycobacterium avium
TTAREHGRHG

SEQ ID NO: 75880 - protein, 10 aa, Mycobacterium avium
TTARKKPPFG

SEQ ID NO: 75881 - protein, 13 aa, Mycobacterium avium
TTARTLTRQQGDL

SEQ ID NO: 75882 - protein, 6 aa, Mycobacterium avium
TTAVRD

SEQ ID NO: 75883 - protein, 7 aa, Mycobacterium avium
TTAVRQG

SEQ ID NO: 75884 - protein, 8 aa, Mycobacterium avium
TTDAPDEP

SEQ ID NO: 75885 - protein, 9 aa, Mycobacterium avium
TTDAPDEPW

SEQ ID NO: 75886 - protein, 10 aa, Mycobacterium avium
TTDARTAARG

SEQ ID NO: 75887 - protein, 7 aa, Mycobacterium avium
TTDGFPS

SEQ ID NO: 75888 - protein, 8 aa, Mycobacterium avium
TTDPGQRL

SEQ ID NO: 75889 - protein, 13 aa, Mycobacterium avium
TTDPHTVTDEQVD

SEQ ID NO: 75890 - protein, 6 aa, Mycobacterium avium
TTDRGL

SEQ ID NO: 75891 - protein, 9 aa, Mycobacterium avium
TTDRPEPEY

SEQ ID NO: 75892 - protein, 4 aa, Mycobacterium avium
TTDT

SEQ ID NO: 75893 - protein, 13 aa, Mycobacterium avium
TTDTTGAKPTATE

SEQ ID NO: 75894 - protein, 16 aa, Mycobacterium avium
TTDVDAAAAADNPGLR

SEQ ID NO: 75895 - protein, 16 aa, Mycobacterium avium
TTDVDAAAAAGNPGLR

SEQ ID NO: 75896 - protein, 10 aa, Mycobacterium avium
TTEAIGESRI

SEQ ID NO: 75897 - protein, 6 aa, Mycobacterium avium
TTEDTE

SEQ ID NO: 75898 - protein, 8 aa, Mycobacterium avium
TTEGGDLD

SEQ ID NO: 75899 - protein, 5 aa, Mycobacterium avium
TTESE

SEQ ID NO: 75900 - protein, 6 aa, Mycobacterium avium
TTFPPT

SEQ ID NO: 75901 - protein, 7 aa, Mycobacterium avium
TTFPPTV

SEQ ID NO: 75902 - protein, 14 aa, Mycobacterium avium
TTGAGPAGDIAAQA

SEQ ID NO: 75903 - protein, 6 aa, Mycobacterium avium
TTGAGS

SEQ ID NO: 75904 - protein, 4 aa, Mycobacterium avium
TTGG

SEQ ID NO: 75905 - protein, 14 aa, Mycobacterium avium
TTGGDDGESVTAAT

SEQ ID NO: 75906 - protein, 17 aa, Mycobacterium avium
TTGGRSTSTEETAPDAI

SEQ ID NO: 75907 - protein, 15 aa, Mycobacterium avium
TTGKLDGQKRAWTAN

SEQ ID NO: 75908 - protein, 5 aa, Mycobacterium avium
TTGLG

SEQ ID NO: 75909 - protein, 5 aa, Mycobacterium avium
TTGNM

SEQ ID NO: 75910 - protein, 13 aa, Mycobacterium avium
TTGPSSTPIEVPD

SEQ ID NO: 75911 - protein, 9 aa, Mycobacterium avium
TTGTPLTPA

SEQ ID NO: 75912 - protein, 14 aa, Mycobacterium avium
TTHPELSAADRDAL

SEQ ID NO: 75913 - protein, 11 aa, Mycobacterium avium
TTIDDKTPECL

SEQ ID NO: 75914 - protein, 5 aa, Mycobacterium avium
TTLGP

SEQ ID NO: 75915 - protein, 4 aa, Mycobacterium avium
TTLP

SEQ ID NO: 75916 - protein, 8 aa, Mycobacterium avium
TTLTGGQL

SEQ ID NO: 75917 - protein, 5 aa, Mycobacterium avium
TTMTS

SEQ ID NO: 75918 - protein, 12 aa, Mycobacterium avium
TTMTTYQATTEA

SEQ ID NO: 75919 - protein, 8 aa, Mycobacterium avium
TTNGKIDR

SEQ ID NO: 75920 - protein, 6 aa, Mycobacterium avium
TTNTPG

SEQ ID NO: 75921 - protein, 8 aa, Mycobacterium avium
TTNVPAGP

SEQ ID NO: 75922 - protein, 12 aa, Mycobacterium avium
TTPDAAAGAHER

SEQ ID NO: 75923 - protein, 12 aa, Mycobacterium avium
TTPDAAAGPHER

SEQ ID NO: 75924 - protein, 12 aa, Mycobacterium avium
TTPDAAAGTHER

SEQ ID NO: 75925 - protein, 5 aa, Mycobacterium avium
TTPDD

SEQ ID NO: 75926 - protein, 28 aa, Mycobacterium avium
TTPGKPALLRPASDDDSPPSGSGPFSAL

SEQ ID NO: 75927 - protein, 6 aa, Mycobacterium avium
TTPGRI

SEQ ID NO: 75928 - protein, 12 aa, Mycobacterium avium
TTPHDREGEPEK

SEQ ID NO: 75929 - protein, 6 aa, Mycobacterium avium
TTPISD

SEQ ID NO: 75930 - protein, 10 aa, Mycobacterium avium
TTPLSPDQAE

SEQ ID NO: 75931 - protein, 5 aa, Mycobacterium avium
TTPMH

SEQ ID NO: 75932 - protein, 10 aa, Mycobacterium avium
TTPQEAAQTV

SEQ ID NO: 75933 - protein, 7 aa, Mycobacterium avium
TTPVGPR

SEQ ID NO: 75934 - protein, 8 aa, Mycobacterium avium
TTQAGGVR

SEQ ID NO: 75935 - protein, 5 aa, Mycobacterium avium
TTQGG

SEQ ID NO: 75936 - protein, 5 aa, Mycobacterium avium
TTQNF

SEQ ID NO: 75937 - protein, 4 aa, Mycobacterium avium
TTQQ

SEQ ID NO: 75938 - protein, 7 aa, Mycobacterium avium
TTRGGDD

SEQ ID NO: 75939 - protein, 9 aa, Mycobacterium avium
TTRGSQLTP

SEQ ID NO: 75940 - protein, 10 aa, Mycobacterium avium
TTRPSVTGGT

SEQ ID NO: 75941 - protein, 5 aa, Mycobacterium avium
TTRPY

SEQ ID NO: 75942 - protein, 7 aa, Mycobacterium avium
TTRRGKA

SEQ ID NO: 75943 - protein, 5 aa, Mycobacterium avium
TTRSV

SEQ ID NO: 75944 - protein, 6 aa, Mycobacterium avium
TTSAMR

SEQ ID NO: 75945 - protein, 13 aa, Mycobacterium avium
TTSASGDGSLPIA

SEQ ID NO: 75946 - protein, 10 aa, Mycobacterium avium
TTSDQGRADL

SEQ ID NO: 75947 - protein, 11 aa, Mycobacterium avium
TTSPDELGNIQ

SEQ ID NO: 75948 - protein, 5 aa, Mycobacterium avium
TTSTA

SEQ ID NO: 75949 - protein, 5 aa, Mycobacterium avium
TTTAH

SEQ ID NO: 75950 - protein, 9 aa, Mycobacterium avium
TTTARAEGN

SEQ ID NO: 75951 - protein, 5 aa, Mycobacterium avium
TTTAV

SEQ ID NO: 75952 - protein, 4 aa, Mycobacterium avium
TTTD

SEQ ID NO: 75953 - protein, 9 aa, Mycobacterium avium
TTTDANPKS

SEQ ID NO: 75954 - protein, 19 aa, Mycobacterium avium
TTTLETEAGESFLTFAFRP

SEQ ID NO: 75955 - protein, 24 aa, Mycobacterium avium
TTTNGPGGIPGVSGVSTVSAGAAY

SEQ ID NO: 75956 - protein, 11 aa, Mycobacterium avium
TTTPDELGNIQ

SEQ ID NO: 75957 - protein, 6 aa, Mycobacterium avium
TTTPDT

SEQ ID NO: 75958 - protein, 7 aa, Mycobacterium avium
TTTPLPL

SEQ ID NO: 75959 - protein, 13 aa, Mycobacterium avium
TTTPTDPSGSRHG

SEQ ID NO: 75960 - protein, 11 aa, Mycobacterium avium
TTTTLETADGQ

SEQ ID NO: 75961 - protein, 4 aa, Mycobacterium avium
TTTV

SEQ ID NO: 75962 - protein, 4 aa, Mycobacterium avium
TTVA

SEQ ID NO: 75963 - protein, 8 aa, Mycobacterium avium
TTVASGST

SEQ ID NO: 75964 - protein, 15 aa, Mycobacterium avium
TTVSPAGTDAASSGE

SEQ ID NO: 75965 - protein, 15 aa, Mycobacterium avium
TTVSQSSLHKGSRAG

SEQ ID NO: 75966 - protein, 12 aa, Mycobacterium avium
TTYTEADGTVKG

SEQ ID NO: 75967 - protein, 11 aa, Mycobacterium avium
TVAAGATPDRM

SEQ ID NO: 75968 - protein, 13 aa, Mycobacterium avium
TVAGSAAVDNPAA

SEQ ID NO: 75969 - protein, 9 aa, Mycobacterium avium
TVAPDGASV

SEQ ID NO: 75970 - protein, 8 aa, Mycobacterium avium
TVAPPVDQ

SEQ ID NO: 75971 - protein, 13 aa, Mycobacterium avium
TVASSGRDDVQPV

SEQ ID NO: 75972 - protein, 16 aa, Mycobacterium avium
TVATRTERRPERPRGA

SEQ ID NO: 75973 - protein, 6 aa, Mycobacterium avium
TVDGGY

SEQ ID NO: 75974 - protein, 15 aa, Mycobacterium avium
TVDPQTGRTIIEMIE

SEQ ID NO: 75975 - protein, 9 aa, Mycobacterium avium
TVDSGQSSS

SEQ ID NO: 75976 - protein, 4 aa, Mycobacterium avium
TVDT

SEQ ID NO: 75977 - protein, 11 aa, Mycobacterium avium
TVDTSTAAGRF

SEQ ID NO: 75978 - protein, 6 aa, Mycobacterium avium
TVEPGK

SEQ ID NO: 75979 - protein, 6 aa, Mycobacterium avium
TVESAE

SEQ ID NO: 75980 - protein, 19 aa, Mycobacterium avium
TVETPTPRNPAGPALASLA

SEQ ID NO: 75981 - protein, 4 aa, Mycobacterium avium
TVFP

SEQ ID NO: 75982 - protein, 6 aa, Mycobacterium avium
TVGAGA

SEQ ID NO: 75983 - protein, 5 aa, Mycobacterium avium
TVGDD

SEQ ID NO: 75984 - protein, 5 aa, Mycobacterium avium
TVGGP

SEQ ID NO: 75985 - protein, 13 aa, Mycobacterium avium
TVGNDAPTDTAST

SEQ ID NO: 75986 - protein, 8 aa, Mycobacterium avium
TVGQPGNR

SEQ ID NO: 75987 - protein, 9 aa, Mycobacterium avium
TVGQSTRTT

SEQ ID NO: 75988 - protein, 6 aa, Mycobacterium avium
TVGRRG

SEQ ID NO: 75989 - protein, 4 aa, Mycobacterium avium
TVHA

SEQ ID NO: 75990 - protein, 5 aa, Mycobacterium avium
TVHGE

SEQ ID NO: 75991 - protein, 15 aa, Mycobacterium avium
TVHGGFGGAPKFPPS

SEQ ID NO: 75992 - protein, 5 aa, Mycobacterium avium
TVITT

SEQ ID NO: 75993 - protein, 13 aa, Mycobacterium avium
TVKPDTRFAPQDW

SEQ ID NO: 75994 - protein, 16 aa, Mycobacterium avium
TVKSAAEKAGRDPDSV

SEQ ID NO: 75995 - protein, 14 aa, Mycobacterium avium
TVLEGDGANLEQGG

SEQ ID NO: 75996 - protein, 11 aa, Mycobacterium avium
TVLPPGQSGRL

SEQ ID NO: 75997 - protein, 6 aa, Mycobacterium avium
TVNGAA

SEQ ID NO: 75998 - protein, 4 aa, Mycobacterium avium
TVPA

SEQ ID NO: 75999 - protein, 11 aa, Mycobacterium avium
TVPADEQTRAG

SEQ ID NO: 76000 - protein, 7 aa, Mycobacterium avium
TVPAPRR

SEQ ID NO: 76001 - protein, 19 aa, Mycobacterium avium
TVPDAKDVAGAPGPDGRTL

SEQ ID NO: 76002 - protein, 9 aa, Mycobacterium avium
TVPDDGGRF

SEQ ID NO: 76003 - protein, 5 aa, Mycobacterium avium
TVPRA

SEQ ID NO: 76004 - protein, 9 aa, Mycobacterium avium
TVPTPNQPA

SEQ ID NO: 76005 - protein, 9 aa, Mycobacterium avium
TVPTRNQPA

SEQ ID NO: 76006 - protein, 8 aa, Mycobacterium avium
TVPVGTAD

SEQ ID NO: 76007 - protein, 11 aa, Mycobacterium avium
TVQGSETNDGR

SEQ ID NO: 76008 - protein, 12 aa, Mycobacterium avium
TVRAANSATVPN

SEQ ID NO: 76009 - protein, 6 aa, Mycobacterium avium
TVRGAD

SEQ ID NO: 76010 - protein, 7 aa, Mycobacterium avium
TVRPPDE

SEQ ID NO: 76011 - protein, 10 aa, Mycobacterium avium
TVRQDSPGAL

SEQ ID NO: 76012 - protein, 9 aa, Mycobacterium avium
TVSAAGPAP

SEQ ID NO: 76013 - protein, 15 aa, Mycobacterium avium
TVSGDGRDDRSGDGL

SEQ ID NO: 76014 - protein, 13 aa, Mycobacterium avium
TVSGRPAEVPGAD

SEQ ID NO: 76015 - protein, 8 aa, Mycobacterium avium
TVSNAEEF

SEQ ID NO: 76016 - protein, 10 aa, Mycobacterium avium
TVSQGSVPEA

SEQ ID NO: 76017 - protein, 25 aa, Mycobacterium avium
TVTDTGSGAAGGAAAGAANSTTSSI

SEQ ID NO: 76018 - protein, 15 aa, Mycobacterium avium
TVTPAADGKCPPPAG

SEQ ID NO: 76019 - protein, 14 aa, Mycobacterium avium
TVTSRRPGFALFSA

SEQ ID NO: 76020 - protein, 24 aa, Mycobacterium avium
TVTTATGDGYRRTSYRELGDQAAQ

SEQ ID NO: 76021 - protein, 24 aa, Mycobacterium avium
TVTTATGDGYRRTSYRELGDRAAQ

SEQ ID NO: 76022 - protein, 8 aa, Mycobacterium avium
TVTTDDVR

SEQ ID NO: 76023 - protein, 10 aa, Mycobacterium avium
TVTTEREPLP

SEQ ID NO: 76024 - protein, 15 aa, Mycobacterium avium
TVVTDPTVTEGYRQD

SEQ ID NO: 76025 - protein, 9 aa, Mycobacterium avium
TVYPDGEPL

SEQ ID NO: 76026 - protein, 4 aa, Mycobacterium avium
TWDR

SEQ ID NO: 76027 - protein, 7 aa, Mycobacterium avium
TWEPTTY

SEQ ID NO: 76028 - protein, 7 aa, Mycobacterium avium
TWGGGGA

SEQ ID NO: 76029 - protein, 10 aa, Mycobacterium avium
TWNESSGAVR

SEQ ID NO: 76030 - protein, 6 aa, Mycobacterium avium
TWPRPE

SEQ ID NO: 76031 - protein, 9 aa, Mycobacterium avium
TWSRGGPSH

SEQ ID NO: 76032 - protein, 11 aa, Mycobacterium avium
TWSTNPDGSVT

SEQ ID NO: 76033 - protein, 4 aa, Mycobacterium avium
TWTT

SEQ ID NO: 76034 - protein, 6 aa, Mycobacterium avium
TWYGGP

SEQ ID NO: 76035 - protein, 7 aa, Mycobacterium avium
TYADGTL

SEQ ID NO: 76036 - protein, 10 aa, Mycobacterium avium
TYADGTPSKR

SEQ ID NO: 76037 - protein, 5 aa, Mycobacterium avium
TYAGG

SEQ ID NO: 76038 - protein, 13 aa, Mycobacterium avium
TYAPATPEDLDET

SEQ ID NO: 76039 - protein, 11 aa, Mycobacterium avium
TYASERTAFGQ

SEQ ID NO: 76040 - protein, 9 aa, Mycobacterium avium
TYGKPELGG

SEQ ID NO: 76041 - protein, 7 aa, Mycobacterium avium
TYGPDRV

SEQ ID NO: 76042 - protein, 13 aa, Mycobacterium avium
TYGPGDFQPTPHG

SEQ ID NO: 76043 - protein, 5 aa, Mycobacterium avium
TYGVP

SEQ ID NO: 76044 - protein, 5 aa, Mycobacterium avium
TYITS

SEQ ID NO: 76045 - protein, 15 aa, Mycobacterium avium
TYNEPNTNLTSPETT

SEQ ID NO: 76046 - protein, 15 aa, Mycobacterium avium
TYNEPNTNLTSTETT

SEQ ID NO: 76047 - protein, 8 aa, Mycobacterium avium
TYPPAGKR

SEQ ID NO: 76048 - protein, 10 aa, Mycobacterium avium
TYRGPYTPGS

SEQ ID NO: 76049 - protein, 5 aa, Mycobacterium avium
TYRPD

SEQ ID NO: 76050 - protein, 5 aa, Mycobacterium avium
TYRPT

SEQ ID NO: 76051 - protein, 13 aa, Mycobacterium avium
VAAADDESRVRSA

SEQ ID NO: 76052 - protein, 6 aa, Mycobacterium avium
VAAAQR

SEQ ID NO: 76053 - protein, 8 aa, Mycobacterium avium
VAAATPDA

SEQ ID NO: 76054 - protein, 6 aa, Mycobacterium avium
VAADGA

SEQ ID NO: 76055 - protein, 22 aa, Mycobacterium avium
VAAERDDALENSAVRVAHAITP

SEQ ID NO: 76056 - protein, 17 aa, Mycobacterium avium
VAAESDRGKHFTPPLSN

SEQ ID NO: 76057 - protein, 6 aa, Mycobacterium avium
VAAESR

SEQ ID NO: 76058 - protein, 6 aa, Mycobacterium avium
VAAGAQ

SEQ ID NO: 76059 - protein, 9 aa, Mycobacterium avium
VAAGASWGN

SEQ ID NO: 76060 - protein, 10 aa, Mycobacterium avium
VAAGATPDRM

SEQ ID NO: 76061 - protein, 9 aa, Mycobacterium avium
VAAGQELTP

SEQ ID NO: 76062 - protein, 10 aa, Mycobacterium avium
VAAGRQPAEV

SEQ ID NO: 76063 - protein, 10 aa, Mycobacterium avium
VAAGSTPDRM

SEQ ID NO: 76064 - protein, 9 aa, Mycobacterium avium
VAAGTGRAG

SEQ ID NO: 76065 - protein, 5 aa, Mycobacterium avium
VAAPD

SEQ ID NO: 76066 - protein, 5 aa, Mycobacterium avium
VAAQG

SEQ ID NO: 76067 - protein, 7 aa, Mycobacterium avium
VAARDTA

SEQ ID NO: 76068 - protein, 9 aa, Mycobacterium avium
VAARPGTAA

SEQ ID NO: 76069 - protein, 18 aa, Mycobacterium avium
VAASPPVASGKPASPGIA

SEQ ID NO: 76070 - protein, 14 aa, Mycobacterium avium
VAATPPTDPAPPIV

SEQ ID NO: 76071 - protein, 9 aa, Mycobacterium avium
VADDGQLTD

SEQ ID NO: 76072 - protein, 18 aa, Mycobacterium avium
VADEDGGPADEGTGEVTA

SEQ ID NO: 76073 - protein, 7 aa, Mycobacterium avium
VADGARI

SEQ ID NO: 76074 - protein, 7 aa, Mycobacterium avium
VADPGRL

SEQ ID NO: 76075 - protein, 5 aa, Mycobacterium avium
VADPR

SEQ ID NO: 76076 - protein, 8 aa, Mycobacterium avium
VAEANDAG

SEQ ID NO: 76077 - protein, 4 aa, Mycobacterium avium
VAEE

SEQ ID NO: 76078 - protein, 8 aa, Mycobacterium avium
VAEEHNGD

SEQ ID NO: 76079 - protein, 14 aa, Mycobacterium avium
VAEEIGRRAAQAGI

SEQ ID NO: 76080 - protein, 6 aa, Mycobacterium avium
VAEELS

SEQ ID NO: 76081 - protein, 4 aa, Mycobacterium avium
VAEG

SEQ ID NO: 76082 - protein, 5 aa, Mycobacterium avium
VAEPG

SEQ ID NO: 76083 - protein, 13 aa, Mycobacterium avium
VAEPGFRRLCGHP

SEQ ID NO: 76084 - protein, 13 aa, Mycobacterium avium
VAEPGFRRLRGHP

SEQ ID NO: 76085 - protein, 13 aa, Mycobacterium avium
VAEQSEGALYDST

SEQ ID NO: 76086 - protein, 14 aa, Mycobacterium avium
VAESGGGKSGTASV

SEQ ID NO: 76087 - protein, 9 aa, Mycobacterium avium
VAESPADTV

SEQ ID NO: 76088 - protein, 8 aa, Mycobacterium avium
VAESPAET

SEQ ID NO: 76089 - protein, 14 aa, Mycobacterium avium
VAGADHPGQPGDGL

SEQ ID NO: 76090 - protein, 21 aa, Mycobacterium avium
VAGARDALPGWAATSPAYRGA

SEQ ID NO: 76091 - protein, 8 aa, Mycobacterium avium
VAGERSGR

SEQ ID NO: 76092 - protein, 8 aa, Mycobacterium avium
VAGGAGGM

SEQ ID NO: 76093 - protein, 8 aa, Mycobacterium avium
VAGGGEGV

SEQ ID NO: 76094 - protein, 11 aa, Mycobacterium avium
VAGGRADATTL

SEQ ID NO: 76095 - protein, 16 aa, Mycobacterium avium
VAGGYDDLAGRGYGYG

SEQ ID NO: 76096 - protein, 5 aa, Mycobacterium avium
VAGLD

SEQ ID NO: 76097 - protein, 4 aa, Mycobacterium avium
VAGP

SEQ ID NO: 76098 - protein, 7 aa, Mycobacterium avium
VAGRALA

SEQ ID NO: 76099 - protein, 10 aa, Mycobacterium avium
VAGRGATPAV

SEQ ID NO: 76100 - protein, 8 aa, Mycobacterium avium
VAGRPLSQ

SEQ ID NO: 76101 - protein, 5 aa, Mycobacterium avium
VAGRT

SEQ ID NO: 76102 - protein, 9 aa, Mycobacterium avium
VAGSDADRV

SEQ ID NO: 76103 - protein, 66 aa, Mycobacterium avium
VAGSGTGGKAGSGSGSGTGAGTGTGTGTGTGTGTGTGTGTGAGSGTGGGTGAGGGGGTGSFQLPTP

SEQ ID NO: 76104 - protein, 7 aa, Mycobacterium avium
VAGSPDD

SEQ ID NO: 76105 - protein, 8 aa, Mycobacterium avium
VAGSPDDL

SEQ ID NO: 76106 - protein, 66 aa, Mycobacterium avium
VAGSSTGGKAGSGSGSGTGAGTGTGTGTGTGTGTGTGTGTGAGSGTGGGTGAGGGGGTGSFQLPTP

SEQ ID NO: 76107 - protein, 10 aa, Mycobacterium avium
VAGTNTGEAL

SEQ ID NO: 76108 - protein, 4 aa, Mycobacterium avium
VAHS

SEQ ID NO: 76109 - protein, 7 aa, Mycobacterium avium
VAKATRE

SEQ ID NO: 76110 - protein, 5 aa, Mycobacterium avium
VAKRD

SEQ ID NO: 76111 - protein, 7 aa, Mycobacterium avium
VANATDL

SEQ ID NO: 76112 - protein, 12 aa, Mycobacterium avium
VAPAGDRETNGH

SEQ ID NO: 76113 - protein, 12 aa, Mycobacterium avium
VAPEAKARAREA

SEQ ID NO: 76114 - protein, 6 aa, Mycobacterium avium
VAPERG

SEQ ID NO: 76115 - protein, 10 aa, Mycobacterium avium
VAPGKGPVIG

SEQ ID NO: 76116 - protein, 13 aa, Mycobacterium avium
VAPGPPPPQPGSP

SEQ ID NO: 76117 - protein, 9 aa, Mycobacterium avium
VAPGPTETD

SEQ ID NO: 76118 - protein, 6 aa, Mycobacterium avium
VAPGQH

SEQ ID NO: 76119 - protein, 4 aa, Mycobacterium avium
VAPI

SEQ ID NO: 76120 - protein, 8 aa, Mycobacterium avium
VAPPDTTT

SEQ ID NO: 76121 - protein, 51 aa, Mycobacterium avium
VAPPEPAEEPADSGRHHAPADRDEPATEGRTAVADTDTAQPRVEKPAPTTV

SEQ ID NO: 76122 - protein, 52 aa, Mycobacterium avium
VAPPEPAEEPADSGRHHAPADRDEPATESRPAVADTETAQPRVEKPAPTTAF

SEQ ID NO: 76123 - protein, 9 aa, Mycobacterium avium
VAPPRDREA

SEQ ID NO: 76124 - protein, 10 aa, Mycobacterium avium
VAPPRPERPA

SEQ ID NO: 76125 - protein, 6 aa, Mycobacterium avium
VAPRDA

SEQ ID NO: 76126 - protein, 13 aa, Mycobacterium avium
VAPRPTTVVGRYC

SEQ ID NO: 76127 - protein, 5 aa, Mycobacterium avium
VAPRR

SEQ ID NO: 76128 - protein, 9 aa, Mycobacterium avium
VAPSPTVAG

SEQ ID NO: 76129 - protein, 13 aa, Mycobacterium avium
VAPTADDEIEPAG

SEQ ID NO: 76130 - protein, 11 aa, Mycobacterium avium
VAPTRSDAELA

SEQ ID NO: 76131 - protein, 18 aa, Mycobacterium avium
VAQHERPERRRRAAGAGI

SEQ ID NO: 76132 - protein, 24 aa, Mycobacterium avium
VAQPRRAGDDLRPIQGADGQGDRV

SEQ ID NO: 76133 - protein, 8 aa, Mycobacterium avium
VAQRQPPQ

SEQ ID NO: 76134 - protein, 28 aa, Mycobacterium avium
VARADDRADPGDSAAADRLGGPVGRAHP

SEQ ID NO: 76135 - protein, 16 aa, Mycobacterium avium
VARAGATDLSAARSRM

SEQ ID NO: 76136 - protein, 7 aa, Mycobacterium avium
VARDGSV

SEQ ID NO: 76137 - protein, 4 aa, Mycobacterium avium
VARG

SEQ ID NO: 76138 - protein, 9 aa, Mycobacterium avium
VARGGGEVQ

SEQ ID NO: 76139 - protein, 7 aa, Mycobacterium avium
VARSARA

SEQ ID NO: 76140 - protein, 7 aa, Mycobacterium avium
VARSPDD

SEQ ID NO: 76141 - protein, 7 aa, Mycobacterium avium
VARSPED

SEQ ID NO: 76142 - protein, 9 aa, Mycobacterium avium
VARVDSPPD

SEQ ID NO: 76143 - protein, 4 aa, Mycobacterium avium
VASA

SEQ ID NO: 76144 - protein, 6 aa, Mycobacterium avium
VASETD

SEQ ID NO: 76145 - protein, 7 aa, Mycobacterium avium
VASGGSR

SEQ ID NO: 76146 - protein, 10 aa, Mycobacterium avium
VASGRPDAAT

SEQ ID NO: 76147 - protein, 10 aa, Mycobacterium avium
VASGSGEPVV

SEQ ID NO: 76148 - protein, 53 aa, Mycobacterium avium
VASGTGTRIDPSKKGAPVQTTASPAAQTPVTPTSQTPTVTPKTETPAKTTDAL

SEQ ID NO: 76149 - protein, 14 aa, Mycobacterium avium
VASSLGKGLTASSL

SEQ ID NO: 76150 - protein, 4 aa, Mycobacterium avium
VASY

SEQ ID NO: 76151 - protein, 8 aa, Mycobacterium avium
VATGCGTA

SEQ ID NO: 76152 - protein, 13 aa, Mycobacterium avium
VATGRTLTSYPSI

SEQ ID NO: 76153 - protein, 5 aa, Mycobacterium avium
VATNE

SEQ ID NO: 76154 - protein, 10 aa, Mycobacterium avium
VATPSAEQYR

SEQ ID NO: 76155 - protein, 4 aa, Mycobacterium avium
VATR

SEQ ID NO: 76156 - protein, 7 aa, Mycobacterium avium
VATRSRR

SEQ ID NO: 76157 - protein, 4 aa, Mycobacterium avium
VATT

SEQ ID NO: 76158 - protein, 13 aa, Mycobacterium avium
VDAADAPAYGGHN

SEQ ID NO: 76159 - protein, 13 aa, Mycobacterium avium
VDAARAARRVGAQ

SEQ ID NO: 76160 - protein, 4 aa, Mycobacterium avium
VDAD

SEQ ID NO: 76161 - protein, 8 aa, Mycobacterium avium
VDADGNRH

SEQ ID NO: 76162 - protein, 25 aa, Mycobacterium avium
VDAENPNTFPRAAATDADGKRGRAA

SEQ ID NO: 76163 - protein, 8 aa, Mycobacterium avium
VDAEQQAA

SEQ ID NO: 76164 - protein, 25 aa, Mycobacterium avium
VDAESPNTFPRAAATDADGKRGRAA

SEQ ID NO: 76165 - protein, 8 aa, Mycobacterium avium
VDAGAQDA

SEQ ID NO: 76166 - protein, 9 aa, Mycobacterium avium
VDAPDAASG

SEQ ID NO: 76167 - protein, 7 aa, Mycobacterium avium
VDDAGAA

SEQ ID NO: 76168 - protein, 4 aa, Mycobacterium avium
VDDG

SEQ ID NO: 76169 - protein, 6 aa, Mycobacterium avium
VDDGDA

SEQ ID NO: 76170 - protein, 8 aa, Mycobacterium avium
VDDGDPRA

SEQ ID NO: 76171 - protein, 11 aa, Mycobacterium avium
VDDQREAVQDA

SEQ ID NO: 76172 - protein, 19 aa, Mycobacterium avium
VDDQREAVQDAAARLSSTG

SEQ ID NO: 76173 - protein, 20 aa, Mycobacterium avium
VDDQREAVQDAAARLSSTGV

SEQ ID NO: 76174 - protein, 7 aa, Mycobacterium avium
VDDSEAG

SEQ ID NO: 76175 - protein, 24 aa, Mycobacterium avium
VDDTDHAGDRAEHACQRGKAQSRL

SEQ ID NO: 76176 - protein, 11 aa, Mycobacterium avium
VDEGPRANTSL

SEQ ID NO: 76177 - protein, 9 aa, Mycobacterium avium
VDENAQPPV

SEQ ID NO: 76178 - protein, 8 aa, Mycobacterium avium
VDEPAGDG

SEQ ID NO: 76179 - protein, 8 aa, Mycobacterium avium
VDEPTGDG

SEQ ID NO: 76180 - protein, 8 aa, Mycobacterium avium
VDEQPAAH

SEQ ID NO: 76181 - protein, 4 aa, Mycobacterium avium
VDET

SEQ ID NO: 76182 - protein, 12 aa, Mycobacterium avium
VDEVTGEVRQLL

SEQ ID NO: 76183 - protein, 9 aa, Mycobacterium avium
VDGAGGPIE

SEQ ID NO: 76184 - protein, 9 aa, Mycobacterium avium
VDGAGPAAV

SEQ ID NO: 76185 - protein, 4 aa, Mycobacterium avium
VDGD

SEQ ID NO: 76186 - protein, 12 aa, Mycobacterium avium
VDGDGGGQLPVG

SEQ ID NO: 76187 - protein, 7 aa, Mycobacterium avium
VDGERLT

SEQ ID NO: 76188 - protein, 5 aa, Mycobacterium avium
VDGNT

SEQ ID NO: 76189 - protein, 6 aa, Mycobacterium avium
VDGPAA

SEQ ID NO: 76190 - protein, 14 aa, Mycobacterium avium
VDGPHSEPARIDKE

SEQ ID NO: 76191 - protein, 17 aa, Mycobacterium avium
VDGPLPTHYEPQESPVA

SEQ ID NO: 76192 - protein, 8 aa, Mycobacterium avium
VDGRPTEH

SEQ ID NO: 76193 - protein, 11 aa, Mycobacterium avium
VDGRRLTDDEL

SEQ ID NO: 76194 - protein, 10 aa, Mycobacterium avium
VDGSGTPITP

SEQ ID NO: 76195 - protein, 5 aa, Mycobacterium avium
VDGST

SEQ ID NO: 76196 - protein, 11 aa, Mycobacterium avium
VDLPEGAEQYR

SEQ ID NO: 76197 - protein, 10 aa, Mycobacterium avium
VDNPESAGLK

SEQ ID NO: 76198 - protein, 7 aa, Mycobacterium avium
VDNVEGS

SEQ ID NO: 76199 - protein, 10 aa, Mycobacterium avium
VDPADANDGF

SEQ ID NO: 76200 - protein, 9 aa, Mycobacterium avium
VDPAPGRRV

SEQ ID NO: 76201 - protein, 4 aa, Mycobacterium avium
VDPD

SEQ ID NO: 76202 - protein, 16 aa, Mycobacterium avium
VDPDFGRGSSAYDGYW

SEQ ID NO: 76203 - protein, 10 aa, Mycobacterium avium
VDPDNRRPVD

SEQ ID NO: 76204 - protein, 9 aa, Mycobacterium avium
VDPDRPLSE

SEQ ID NO: 76205 - protein, 4 aa, Mycobacterium avium
VDPE

SEQ ID NO: 76206 - protein, 5 aa, Mycobacterium avium
VDPED

SEQ ID NO: 76207 - protein, 7 aa, Mycobacterium avium
VDPEFGT

SEQ ID NO: 76208 - protein, 7 aa, Mycobacterium avium
VDPEHGP

SEQ ID NO: 76209 - protein, 6 aa, Mycobacterium avium
VDPGWA

SEQ ID NO: 76210 - protein, 16 aa, Mycobacterium avium
VDPHRSTDLPYPPAIT

SEQ ID NO: 76211 - protein, 5 aa, Mycobacterium avium
VDPSK

SEQ ID NO: 76212 - protein, 6 aa, Mycobacterium avium
VDPSRR

SEQ ID NO: 76213 - protein, 7 aa, Mycobacterium avium
VDPTGPY

SEQ ID NO: 76214 - protein, 8 aa, Mycobacterium avium
VDPTPAAG

SEQ ID NO: 76215 - protein, 9 aa, Mycobacterium avium
VDPVADEST

SEQ ID NO: 76216 - protein, 5 aa, Mycobacterium avium
VDPVD

SEQ ID NO: 76217 - protein, 8 aa, Mycobacterium avium
VDQDNHPE

SEQ ID NO: 76218 - protein, 8 aa, Mycobacterium avium
VDQPDPVD

SEQ ID NO: 76219 - protein, 12 aa, Mycobacterium avium
VDRGEAHPDVDP

SEQ ID NO: 76220 - protein, 4 aa, Mycobacterium avium
VDRS

SEQ ID NO: 76221 - protein, 11 aa, Mycobacterium avium
VDRTTKALADQ

SEQ ID NO: 76222 - protein, 7 aa, Mycobacterium avium
VDSARAT

SEQ ID NO: 76223 - protein, 9 aa, Mycobacterium avium
VDSASGPRL

SEQ ID NO: 76224 - protein, 6 aa, Mycobacterium avium
VDSGAG

SEQ ID NO: 76225 - protein, 8 aa, Mycobacterium avium
VDSGAGGA

SEQ ID NO: 76226 - protein, 34 aa, Mycobacterium avium
VDSGEQAVVPQRRDGVRGAVGAGGDDQPRRAGAG

SEQ ID NO: 76227 - protein, 10 aa, Mycobacterium avium
VDSGETTADE

SEQ ID NO: 76228 - protein, 7 aa, Mycobacterium avium
VDSGVEQ

SEQ ID NO: 76229 - protein, 4 aa, Mycobacterium avium
VDSN

SEQ ID NO: 76230 - protein, 8 aa, Mycobacterium avium
VDSSVSPI

SEQ ID NO: 76231 - protein, 8 aa, Mycobacterium avium
VDSTSADC

SEQ ID NO: 76232 - protein, 6 aa, Mycobacterium avium
VDTESG

SEQ ID NO: 76233 - protein, 4 aa, Mycobacterium avium
VDTP

SEQ ID NO: 76234 - protein, 7 aa, Mycobacterium avium
VDTPAAV

SEQ ID NO: 76235 - protein, 5 aa, Mycobacterium avium
VDTPI

SEQ ID NO: 76236 - protein, 19 aa, Mycobacterium avium
VDTPTNGATELTGAAPSWN

SEQ ID NO: 76237 - protein, 6 aa, Mycobacterium avium
VDTRTA

SEQ ID NO: 76238 - protein, 15 aa, Mycobacterium avium
VDYPPVATPHRAARS

SEQ ID NO: 76239 - protein, 20 aa, Mycobacterium avium
VEAAAKGALECSEDVPAWLK

SEQ ID NO: 76240 - protein, 10 aa, Mycobacterium avium
VEADKSETVT

SEQ ID NO: 76241 - protein, 10 aa, Mycobacterium avium
VEADPADWAE

SEQ ID NO: 76242 - protein, 5 aa, Mycobacterium avium
VEADS

SEQ ID NO: 76243 - protein, 9 aa, Mycobacterium avium
VEAETAARV

SEQ ID NO: 76244 - protein, 9 aa, Mycobacterium avium
VEAPTRADA

SEQ ID NO: 76245 - protein, 6 aa, Mycobacterium avium
VEDPYT

SEQ ID NO: 76246 - protein, 9 aa, Mycobacterium avium
VEDQRPQIA

SEQ ID NO: 76247 - protein, 13 aa, Mycobacterium avium
VEEAAATAARAGV

SEQ ID NO: 76248 - protein, 8 aa, Mycobacterium avium
VEEANDAG

SEQ ID NO: 76249 - protein, 11 aa, Mycobacterium avium
VEFPDAKTAKL

SEQ ID NO: 76250 - protein, 26 aa, Mycobacterium avium
VEGDKGEYSPAAKDRPETGVYSSPAE

SEQ ID NO: 76251 - protein, 10 aa, Mycobacterium avium
VEGDRATART

SEQ ID NO: 76252 - protein, 7 aa, Mycobacterium avium
VEGGGFK

SEQ ID NO: 76253 - protein, 12 aa, Mycobacterium avium
VEGRGGDHQHPR

SEQ ID NO: 76254 - protein, 7 aa, Mycobacterium avium
VEGSDRP

SEQ ID NO: 76255 - protein, 12 aa, Mycobacterium avium
VEKTGRKAYTAE

SEQ ID NO: 76256 - protein, 10 aa, Mycobacterium avium
VEKTGRRAYT

SEQ ID NO: 76257 - protein, 4 aa, Mycobacterium avium
VEMT

SEQ ID NO: 76258 - protein, 8 aa, Mycobacterium avium
VENPATEQ

SEQ ID NO: 76259 - protein, 16 aa, Mycobacterium avium
VEPDIAAPAEAADLEQ

SEQ ID NO: 76260 - protein, 13 aa, Mycobacterium avium
VEPDPAATTSSEV

SEQ ID NO: 76261 - protein, 7 aa, Mycobacterium avium
VEPGAES

SEQ ID NO: 76262 - protein, 10 aa, Mycobacterium avium
VEPGEPNPRF

SEQ ID NO: 76263 - protein, 11 aa, Mycobacterium avium
VEPGVAGRHSS

SEQ ID NO: 76264 - protein, 50 aa, Mycobacterium avium
VEPNPARALQRRDQECDAVDEQEGTRRRQQRNDHDRPAGAGADVGRGDGV

SEQ ID NO: 76265 - protein, 8 aa, Mycobacterium avium
VEPNSTIA

SEQ ID NO: 76266 - protein, 5 aa, Mycobacterium avium
VEPPG

SEQ ID NO: 76267 - protein, 4 aa, Mycobacterium avium
VEPQ

SEQ ID NO: 76268 - protein, 5 aa, Mycobacterium avium
VEQGT

SEQ ID NO: 76269 - protein, 8 aa, Mycobacterium avium
VERATEKG

SEQ ID NO: 76270 - protein, 11 aa, Mycobacterium avium
VEREGKPQRIG

SEQ ID NO: 76271 - protein, 12 aa, Mycobacterium avium
VERGGAPAAKSA

SEQ ID NO: 76272 - protein, 11 aa, Mycobacterium avium
VERRAPEAATS

SEQ ID NO: 76273 - protein, 10 aa, Mycobacterium avium
VESAPADAFG

SEQ ID NO: 76274 - protein, 6 aa, Mycobacterium avium
VESPDG

SEQ ID NO: 76275 - protein, 12 aa, Mycobacterium avium
VESRRRRRDGVA

SEQ ID NO: 76276 - protein, 8 aa, Mycobacterium avium
VESSGRGT

SEQ ID NO: 76277 - protein, 8 aa, Mycobacterium avium
VESTGRVP

SEQ ID NO: 76278 - protein, 9 aa, Mycobacterium avium
VESVGTSSF

SEQ ID NO: 76279 - protein, 4 aa, Mycobacterium avium
VETA

SEQ ID NO: 76280 - protein, 4 aa, Mycobacterium avium
VETG

SEQ ID NO: 76281 - protein, 15 aa, Mycobacterium avium
VETGKSDSLSLPESK

SEQ ID NO: 76282 - protein, 4 aa, Mycobacterium avium
VETM

SEQ ID NO: 76283 - protein, 8 aa, Mycobacterium avium
VETTSGKV

SEQ ID NO: 76284 - protein, 15 aa, Mycobacterium avium
VETVDPQDRPRPRAG

SEQ ID NO: 76285 - protein, 4 aa, Mycobacterium avium
VFRP

SEQ ID NO: 76286 - protein, 13 aa, Mycobacterium avium
VGAAIDDDAPVDF

SEQ ID NO: 76287 - protein, 12 aa, Mycobacterium avium
VGAARAALNGPW

SEQ ID NO: 76288 - protein, 4 aa, Mycobacterium avium
VGAD

SEQ ID NO: 76289 - protein, 7 aa, Mycobacterium avium
VGAEGQG

SEQ ID NO: 76290 - protein, 12 aa, Mycobacterium avium
VGAESAKRATHG

SEQ ID NO: 76291 - protein, 17 aa, Mycobacterium avium
VGAESSSPWNNAGTGHS

SEQ ID NO: 76292 - protein, 10 aa, Mycobacterium avium
VGAGDPAAGV

SEQ ID NO: 76293 - protein, 7 aa, Mycobacterium avium
VGAGERL

SEQ ID NO: 76294 - protein, 6 aa, Mycobacterium avium
VGAGGP

SEQ ID NO: 76295 - protein, 30 aa, Mycobacterium avium
VGAGRAAHRRPVAQRERGGPLRGGALLARP

SEQ ID NO: 76296 - protein, 8 aa, Mycobacterium avium
VGAGRAQP

SEQ ID NO: 76297 - protein, 7 aa, Mycobacterium avium
VGAPDEL

SEQ ID NO: 76298 - protein, 26 aa, Mycobacterium avium
VGARGGPGRRAPPTPRRAGRSRGHPP

SEQ ID NO: 76299 - protein, 11 aa, Mycobacterium avium
VGATASGDLPA

SEQ ID NO: 76300 - protein, 12 aa, Mycobacterium avium
VGATASGDLPAG

SEQ ID NO: 76301 - protein, 13 aa, Mycobacterium avium
VGDADNGGAPRRQ

SEQ ID NO: 76302 - protein, 22 aa, Mycobacterium avium
VGDAPSPDRKPARAAAQNRHAQ

SEQ ID NO: 76303 - protein, 25 aa, Mycobacterium avium
VGDERAQRTASAQRTRELLSELARL

SEQ ID NO: 76304 - protein, 27 aa, Mycobacterium avium
VGDERSTTNGIGPTHSGTAQRTRPPGL

SEQ ID NO: 76305 - protein, 4 aa, Mycobacterium avium
VGDG

SEQ ID NO: 76306 - protein, 10 aa, Mycobacterium avium
VGDPDTSTHV

SEQ ID NO: 76307 - protein, 9 aa, Mycobacterium avium
VGDPTDPAN

SEQ ID NO: 76308 - protein, 10 aa, Mycobacterium avium
VGDPTDPDVQ

SEQ ID NO: 76309 - protein, 12 aa, Mycobacterium avium
VGDPTDRATDVG

SEQ ID NO: 76310 - protein, 8 aa, Mycobacterium avium
VGDQTADR

SEQ ID NO: 76311 - protein, 11 aa, Mycobacterium avium
VGDRADALNDP

SEQ ID NO: 76312 - protein, 14 aa, Mycobacterium avium
VGDRDPADTLHDGT

SEQ ID NO: 76313 - protein, 4 aa, Mycobacterium avium
VGDS

SEQ ID NO: 76314 - protein, 8 aa, Mycobacterium avium
VGEANSVG

SEQ ID NO: 76315 - protein, 17 aa, Mycobacterium avium
VGEPKELPPPPSGGEEP

SEQ ID NO: 76316 - protein, 16 aa, Mycobacterium avium
VGEPPNSPEASAHWPR

SEQ ID NO: 76317 - protein, 16 aa, Mycobacterium avium
VGERNGHGAPGGRDPI

SEQ ID NO: 76318 - protein, 14 aa, Mycobacterium avium
VGGGHGDDPGQPGH

SEQ ID NO: 76319 - protein, 11 aa, Mycobacterium avium
VGGGPRSITSR

SEQ ID NO: 76320 - protein, 14 aa, Mycobacterium avium
VGGGPVAGSMLLSS

SEQ ID NO: 76321 - protein, 6 aa, Mycobacterium avium
VGGGST

SEQ ID NO: 76322 - protein, 15 aa, Mycobacterium avium
VGGKRELAAAAPAGA

SEQ ID NO: 76323 - protein, 8 aa, Mycobacterium avium
VGGLSGNG

SEQ ID NO: 76324 - protein, 6 aa, Mycobacterium avium
VGGLTT

SEQ ID NO: 76325 - protein, 11 aa, Mycobacterium avium
VGGPGDPRLQE

SEQ ID NO: 76326 - protein, 10 aa, Mycobacterium avium
VGGPYSEPTL

SEQ ID NO: 76327 - protein, 10 aa, Mycobacterium avium
VGGQSGDEDV

SEQ ID NO: 76328 - protein, 16 aa, Mycobacterium avium
VGGSAGAAGRVALDIA

SEQ ID NO: 76329 - protein, 11 aa, Mycobacterium avium
VGGTGPADAHT

SEQ ID NO: 76330 - protein, 12 aa, Mycobacterium avium
VGGTGPADARTS

SEQ ID NO: 76331 - protein, 10 aa, Mycobacterium avium
VGHGTDGEHA

SEQ ID NO: 76332 - protein, 8 aa, Mycobacterium avium
VGHSPEMA

SEQ ID NO: 76333 - protein, 9 aa, Mycobacterium avium
VGKATAAAL

SEQ ID NO: 76334 - protein, 9 aa, Mycobacterium avium
VGKPASTVR

SEQ ID NO: 76335 - protein, 13 aa, Mycobacterium avium
VGKSKEEFSPEPL

SEQ ID NO: 76336 - protein, 10 aa, Mycobacterium avium
VGKSPDEIDE

SEQ ID NO: 76337 - protein, 11 aa, Mycobacterium avium
VGKSPDEIDES

SEQ ID NO: 76338 - protein, 5 aa, Mycobacterium avium
VGLPP

SEQ ID NO: 76339 - protein, 21 aa, Mycobacterium avium
VGNAGHGAPAQTLPSAAAEAD

SEQ ID NO: 76340 - protein, 20 aa, Mycobacterium avium
VGNASSLHTSGRAARRRIEE

SEQ ID NO: 76341 - protein, 21 aa, Mycobacterium avium
VGNASSLHTSGRAARRRIEES

SEQ ID NO: 76342 - protein, 22 aa, Mycobacterium avium
VGNASSLHTSGRAARRRIEESR

SEQ ID NO: 76343 - protein, 8 aa, Mycobacterium avium
VGNPDGEL

SEQ ID NO: 76344 - protein, 6 aa, Mycobacterium avium
VGNPVA

SEQ ID NO: 76345 - protein, 16 aa, Mycobacterium avium
VGPAEDPDRPGPPLDT

SEQ ID NO: 76346 - protein, 12 aa, Mycobacterium avium
VGPAGRGLPIPP

SEQ ID NO: 76347 - protein, 7 aa, Mycobacterium avium
VGPDDPA

SEQ ID NO: 76348 - protein, 10 aa, Mycobacterium avium
VGPDDSAPTV

SEQ ID NO: 76349 - protein, 14 aa, Mycobacterium avium
VGPDDTYASEGQLS

SEQ ID NO: 76350 - protein, 7 aa, Mycobacterium avium
VGPDEGQ

SEQ ID NO: 76351 - protein, 7 aa, Mycobacterium avium
VGPDESS

SEQ ID NO: 76352 - protein, 7 aa, Mycobacterium avium
VGPDGHD

SEQ ID NO: 76353 - protein, 6 aa, Mycobacterium avium
VGPDGP

SEQ ID NO: 76354 - protein, 5 aa, Mycobacterium avium
VGPDL

SEQ ID NO: 76355 - protein, 6 aa, Mycobacterium avium
VGPEHA

SEQ ID NO: 76356 - protein, 6 aa, Mycobacterium avium
VGPERA

SEQ ID NO: 76357 - protein, 11 aa, Mycobacterium avium
VGPERDQETPL

SEQ ID NO: 76358 - protein, 4 aa, Mycobacterium avium
VGPF

SEQ ID NO: 76359 - protein, 4 aa, Mycobacterium avium
VGPG

SEQ ID NO: 76360 - protein, 42 aa, Mycobacterium avium
VGPGGHGDGHLPGRGGRRAGGHAAHRTGAAGDGGRRAGGQGR

SEQ ID NO: 76361 - protein, 10 aa, Mycobacterium avium
VGPGSLPTDS

SEQ ID NO: 76362 - protein, 12 aa, Mycobacterium avium
VGPGVTSLKPGD

SEQ ID NO: 76363 - protein, 9 aa, Mycobacterium avium
VGPHDAAAP

SEQ ID NO: 76364 - protein, 13 aa, Mycobacterium avium
VGPIDPDRTAADE

SEQ ID NO: 76365 - protein, 14 aa, Mycobacterium avium
VGPIDPDRTAADEM

SEQ ID NO: 76366 - protein, 8 aa, Mycobacterium avium
VGPIGGQR

SEQ ID NO: 76367 - protein, 8 aa, Mycobacterium avium
VGPMTGTD

SEQ ID NO: 76368 - protein, 13 aa, Mycobacterium avium
VGPPHSLEPGARG

SEQ ID NO: 76369 - protein, 17 aa, Mycobacterium avium
VGPPSDETAMMGPVISA

SEQ ID NO: 76370 - protein, 9 aa, Mycobacterium avium
VGPQPGEDD

SEQ ID NO: 76371 - protein, 9 aa, Mycobacterium avium
VGPQRRGDH

SEQ ID NO: 76372 - protein, 13 aa, Mycobacterium avium
VGPSRGMPGAPAG

SEQ ID NO: 76373 - protein, 9 aa, Mycobacterium avium
VGPSSTPGH

SEQ ID NO: 76374 - protein, 11 aa, Mycobacterium avium
VGPTKTRESRR

SEQ ID NO: 76375 - protein, 9 aa, Mycobacterium avium
VGPVPSESA

SEQ ID NO: 76376 - protein, 10 aa, Mycobacterium avium
VGQAGRDGDV

SEQ ID NO: 76377 - protein, 8 aa, Mycobacterium avium
VGQDGQDA

SEQ ID NO: 76378 - protein, 7 aa, Mycobacterium avium
VGQGPHD

SEQ ID NO: 76379 - protein, 17 aa, Mycobacterium avium
VGQKHQPSDADAQRHPT

SEQ ID NO: 76380 - protein, 7 aa, Mycobacterium avium
VGQQQPV

SEQ ID NO: 76381 - protein, 4 aa, Mycobacterium avium
VGQR

SEQ ID NO: 76382 - protein, 10 aa, Mycobacterium avium
VGQRADPRTV

SEQ ID NO: 76383 - protein, 8 aa, Mycobacterium avium
VGQREKYR

SEQ ID NO: 76384 - protein, 9 aa, Mycobacterium avium
VGQRSAPAR

SEQ ID NO: 76385 - protein, 13 aa, Mycobacterium avium
VGQTQPAGVQPGR

SEQ ID NO: 76386 - protein, 14 aa, Mycobacterium avium
VGRDGDGLRGAGAD

SEQ ID NO: 76387 - protein, 19 aa, Mycobacterium avium
VGRDPDRIERSAAVKGGAE

SEQ ID NO: 76388 - protein, 10 aa, Mycobacterium avium
VGRDPRDIRK

SEQ ID NO: 76389 - protein, 10 aa, Mycobacterium avium
VGRGRDRRPL

SEQ ID NO: 76390 - protein, 23 aa, Mycobacterium avium
VGRGRPGDHRPGAGGGDTESPWA

SEQ ID NO: 76391 - protein, 6 aa, Mycobacterium avium
VGRKPK

SEQ ID NO: 76392 - protein, 7 aa, Mycobacterium avium
VGRPAEL

SEQ ID NO: 76393 - protein, 16 aa, Mycobacterium avium
VGRPGSADEKLGGDGA

SEQ ID NO: 76394 - protein, 7 aa, Mycobacterium avium
VGSEQAR

SEQ ID NO: 76395 - protein, 9 aa, Mycobacterium avium
VGSESEPTE

SEQ ID NO: 76396 - protein, 9 aa, Mycobacterium avium
VGSGRATTI

SEQ ID NO: 76397 - protein, 15 aa, Mycobacterium avium
VGSLAERRARGEKRV

SEQ ID NO: 76398 - protein, 8 aa, Mycobacterium avium
VGSSGRGT

SEQ ID NO: 76399 - protein, 6 aa, Mycobacterium avium
VGTDDK

SEQ ID NO: 76400 - protein, 8 aa, Mycobacterium avium
VGTDEQRE

SEQ ID NO: 76401 - protein, 15 aa, Mycobacterium avium
VGTDTATGAALGAAA

SEQ ID NO: 76402 - protein, 13 aa, Mycobacterium avium
VGTNPTFSGRTRT

SEQ ID NO: 76403 - protein, 7 aa, Mycobacterium avium
VGTPQQV

SEQ ID NO: 76404 - protein, 6 aa, Mycobacterium avium
VGTRRG

SEQ ID NO: 76405 - protein, 13 aa, Mycobacterium avium
VGTSASESGTRDR

SEQ ID NO: 76406 - protein, 6 aa, Mycobacterium avium
VGTSFD

SEQ ID NO: 76407 - protein, 8 aa, Mycobacterium avium
VGTSPTDM

SEQ ID NO: 76408 - protein, 14 aa, Mycobacterium avium
VGTSRRFSATTPET

SEQ ID NO: 76409 - protein, 5 aa, Mycobacterium avium
VGTTE

SEQ ID NO: 76410 - protein, 4 aa, Mycobacterium avium
VGVA

SEQ ID NO: 76411 - protein, 4 aa, Mycobacterium avium
VGVD

SEQ ID NO: 76412 - protein, 22 aa, Mycobacterium avium
VGVGGRRSRCGDGQLGQRGGQL

SEQ ID NO: 76413 - protein, 7 aa, Mycobacterium avium
VGVGPGS

SEQ ID NO: 76414 - protein, 25 aa, Mycobacterium avium
VGVGQAGASYLAGDTAAAATFGIAG

SEQ ID NO: 76415 - protein, 6 aa, Mycobacterium avium
VGYTTT

SEQ ID NO: 76416 - protein, 13 aa, Mycobacterium avium
VHDPRDRRLGTAG

SEQ ID NO: 76417 - protein, 7 aa, Mycobacterium avium
VHEEPDQ

SEQ ID NO: 76418 - protein, 11 aa, Mycobacterium avium
VHEGTSPSIRR

SEQ ID NO: 76419 - protein, 40 aa, Mycobacterium avium
VHGDPGGGGLQDHGAAAPPHRHADRRPGDRRSAQALLPIP

SEQ ID NO: 76420 - protein, 5 aa, Mycobacterium avium
VHGGR

SEQ ID NO: 76421 - protein, 13 aa, Mycobacterium avium
VHGNPKSATAHEA

SEQ ID NO: 76422 - protein, 6 aa, Mycobacterium avium
VHGPGD

SEQ ID NO: 76423 - protein, 6 aa, Mycobacterium avium
VHPGDP

SEQ ID NO: 76424 - protein, 6 aa, Mycobacterium avium
VHPGGV

SEQ ID NO: 76425 - protein, 11 aa, Mycobacterium avium
VHSGDPDDPAP

SEQ ID NO: 76426 - protein, 5 aa, Mycobacterium avium
VIPRG

SEQ ID NO: 76427 - protein, 7 aa, Mycobacterium avium
VKEETGL

SEQ ID NO: 76428 - protein, 4 aa, Mycobacterium avium
VKEI

SEQ ID NO: 76429 - protein, 18 aa, Mycobacterium avium
VKGAVEGVKGKAKEVGGT

SEQ ID NO: 76430 - protein, 10 aa, Mycobacterium avium
VKGDAAQRAE

SEQ ID NO: 76431 - protein, 7 aa, Mycobacterium avium
VKKGTDE

SEQ ID NO: 76432 - protein, 7 aa, Mycobacterium avium
VKPEQAA

SEQ ID NO: 76433 - protein, 14 aa, Mycobacterium avium
VKPGDEQKTRDGVA

SEQ ID NO: 76434 - protein, 13 aa, Mycobacterium avium
VKPTSVPAFRPGA

SEQ ID NO: 76435 - protein, 12 aa, Mycobacterium avium
VKRPDGSRVLLS

SEQ ID NO: 76436 - protein, 7 aa, Mycobacterium avium
VKSGSDY

SEQ ID NO: 76437 - protein, 7 aa, Mycobacterium avium
VKSPADT

SEQ ID NO: 76438 - protein, 6 aa, Mycobacterium avium
VKTASV

SEQ ID NO: 76439 - protein, 7 aa, Mycobacterium avium
VKTASVY

SEQ ID NO: 76440 - protein, 23 aa, Mycobacterium avium
VKTGGRGKAGGVKYAATPEDAYT

SEQ ID NO: 76441 - protein, 9 aa, Mycobacterium avium
VKYPPGGSY

SEQ ID NO: 76442 - protein, 16 aa, Mycobacterium avium
VLDDGTRVAAETGAPL

SEQ ID NO: 76443 - protein, 12 aa, Mycobacterium avium
VLGGTDPAGPLT

SEQ ID NO: 76444 - protein, 6 aa, Mycobacterium avium
VLPGGT

SEQ ID NO: 76445 - protein, 18 aa, Mycobacterium avium
VNANGKVDRAKLEARSVG

SEQ ID NO: 76446 - protein, 4 aa, Mycobacterium avium
VNAT

SEQ ID NO: 76447 - protein, 7 aa, Mycobacterium avium
VNATPVP

SEQ ID NO: 76448 - protein, 8 aa, Mycobacterium avium
VNDEQKAA

SEQ ID NO: 76449 - protein, 21 aa, Mycobacterium avium
VNDPAKPYAIPGTARNLTPSE

SEQ ID NO: 76450 - protein, 4 aa, Mycobacterium avium
VNEG

SEQ ID NO: 76451 - protein, 8 aa, Mycobacterium avium
VNFSGSGC

SEQ ID NO: 76452 - protein, 5 aa, Mycobacterium avium
VNGAA

SEQ ID NO: 76453 - protein, 20 aa, Mycobacterium avium
VNGATYSGTPVHAGQKPGAV

SEQ ID NO: 76454 - protein, 6 aa, Mycobacterium avium
VNGGDD

SEQ ID NO: 76455 - protein, 10 aa, Mycobacterium avium
VNGGNKTVPT

SEQ ID NO: 76456 - protein, 5 aa, Mycobacterium avium
VNGNG

SEQ ID NO: 76457 - protein, 7 aa, Mycobacterium avium
VNGNGPR

SEQ ID NO: 76458 - protein, 9 aa, Mycobacterium avium
VNGPSSTVV

SEQ ID NO: 76459 - protein, 5 aa, Mycobacterium avium
VNGRS

SEQ ID NO: 76460 - protein, 6 aa, Mycobacterium avium
VNGYDR

SEQ ID NO: 76461 - protein, 7 aa, Mycobacterium avium
VNHPPAD

SEQ ID NO: 76462 - protein, 51 aa, Mycobacterium avium
VNKASRSGGGGGGFGGGSRQQPAPASSAPADDPWGSAPASGSFGGGDDEPP

SEQ ID NO: 76463 - protein, 51 aa, Mycobacterium avium
VNKASRSGGGGGGFGGGSRQQSAPASSAPADDPWGSASASGSFGGGDDEPP

SEQ ID NO: 76464 - protein, 46 aa, Mycobacterium avium
VNKASRSGGGGGGFGGGSRQQSAPASSAPADDPWGSASASGSFGWR

SEQ ID NO: 76465 - protein, 9 aa, Mycobacterium avium
VNLGRPDAG

SEQ ID NO: 76466 - protein, 10 aa, Mycobacterium avium
VNLGRPDPGL

SEQ ID NO: 76467 - protein, 9 aa, Mycobacterium avium
VNPPAPGLY

SEQ ID NO: 76468 - protein, 17 aa, Mycobacterium avium
VNPPAPGLYTTGPAVQP

SEQ ID NO: 76469 - protein, 10 aa, Mycobacterium avium
VNPPPGQVHT

SEQ ID NO: 76470 - protein, 20 aa, Mycobacterium avium
VNQSGQAEQRHGLTKAGDPL

SEQ ID NO: 76471 - protein, 5 aa, Mycobacterium avium
VNQSV

SEQ ID NO: 76472 - protein, 9 aa, Mycobacterium avium
VNRPDGLPA

SEQ ID NO: 76473 - protein, 11 aa, Mycobacterium avium
VNRSTTQYSTV

SEQ ID NO: 76474 - protein, 9 aa, Mycobacterium avium
VNSGTAPVD

SEQ ID NO: 76475 - protein, 6 aa, Mycobacterium avium
VNSSAP

SEQ ID NO: 76476 - protein, 7 aa, Mycobacterium avium
VNSSSAD

SEQ ID NO: 76477 - protein, 8 aa, Mycobacterium avium
VNTHGGNL

SEQ ID NO: 76478 - protein, 10 aa, Mycobacterium avium
VPAARPARRS

SEQ ID NO: 76479 - protein, 8 aa, Mycobacterium avium
VPADANGL

SEQ ID NO: 76480 - protein, 5 aa, Mycobacterium avium
VPADE

SEQ ID NO: 76481 - protein, 7 aa, Mycobacterium avium
VPADGRP

SEQ ID NO: 76482 - protein, 16 aa, Mycobacterium avium
VPADGTRDDYDQSGPA

SEQ ID NO: 76483 - protein, 9 aa, Mycobacterium avium
VPADPTTAT

SEQ ID NO: 76484 - protein, 14 aa, Mycobacterium avium
VPAEGGDRALRRQA

SEQ ID NO: 76485 - protein, 102 aa, Mycobacterium avium
VPAGGHRGHGGGGGAVPAGVSHRRAGAHRGAGRVGRRDGGARPDPGGAAPARRAGRSGHGRTRRVGDRGADLARAGRDLAGRAGGGAGLAGGRGNCFAGQGL

SEQ ID NO: 76486 - protein, 20 aa, Mycobacterium avium
VPAGLSHREDPHGRSLPRRR

SEQ ID NO: 76487 - protein, 11 aa, Mycobacterium avium
VPAGPMNRPPE

SEQ ID NO: 76488 - protein, 10 aa, Mycobacterium avium
VPAGRDAAHE

SEQ ID NO: 76489 - protein, 9 aa, Mycobacterium avium
VPAHPATGP

SEQ ID NO: 76490 - protein, 11 aa, Mycobacterium avium
VPAPAPPLPGV

SEQ ID NO: 76491 - protein, 10 aa, Mycobacterium avium
VPAPENDDPL

SEQ ID NO: 76492 - protein, 7 aa, Mycobacterium avium
VPAPGTG

SEQ ID NO: 76493 - protein, 8 aa, Mycobacterium avium
VPAPRRQW

SEQ ID NO: 76494 - protein, 15 aa, Mycobacterium avium
VPDDEDLPAQLPPPT

SEQ ID NO: 76495 - protein, 10 aa, Mycobacterium avium
VPDEGAPRDR

SEQ ID NO: 76496 - protein, 5 aa, Mycobacterium avium
VPDGG

SEQ ID NO: 76497 - protein, 11 aa, Mycobacterium avium
VPDGTTPEPID

SEQ ID NO: 76498 - protein, 7 aa, Mycobacterium avium
VPDNPSM

SEQ ID NO: 76499 - protein, 7 aa, Mycobacterium avium
VPDPNVP

SEQ ID NO: 76500 - protein, 10 aa, Mycobacterium avium
VPDPTPGKNR

SEQ ID NO: 76501 - protein, 8 aa, Mycobacterium avium
VPDPTVGD

SEQ ID NO: 76502 - protein, 4 aa, Mycobacterium avium
VPDR

SEQ ID NO: 76503 - protein, 10 aa, Mycobacterium avium
VPDRQPAGSN

SEQ ID NO: 76504 - protein, 5 aa, Mycobacterium avium
VPDSA

SEQ ID NO: 76505 - protein, 9 aa, Mycobacterium avium
VPDSGEQDL

SEQ ID NO: 76506 - protein, 12 aa, Mycobacterium avium
VPEDGPDGTKTF

SEQ ID NO: 76507 - protein, 11 aa, Mycobacterium avium
VPEDQRPPQEE

SEQ ID NO: 76508 - protein, 4 aa, Mycobacterium avium
VPEE

SEQ ID NO: 76509 - protein, 8 aa, Mycobacterium avium
VPEGSTAY

SEQ ID NO: 76510 - protein, 4 aa, Mycobacterium avium
VPEL

SEQ ID NO: 76511 - protein, 8 aa, Mycobacterium avium
VPEPGSVD

SEQ ID NO: 76512 - protein, 10 aa, Mycobacterium avium
VPEPGSVDAA

SEQ ID NO: 76513 - protein, 15 aa, Mycobacterium avium
VPEPRPGPALDGRSV

SEQ ID NO: 76514 - protein, 14 aa, Mycobacterium avium
VPEPRPGPALNGRS

SEQ ID NO: 76515 - protein, 4 aa, Mycobacterium avium
VPET

SEQ ID NO: 76516 - protein, 4 aa, Mycobacterium avium
VPGA

SEQ ID NO: 76517 - protein, 15 aa, Mycobacterium avium
VPGAASAADDDIEAA

SEQ ID NO: 76518 - protein, 24 aa, Mycobacterium avium
VPGAGLGSLGSIGGSVGKAASIGG

SEQ ID NO: 76519 - protein, 12 aa, Mycobacterium avium
VPGDPSTDQGTD

SEQ ID NO: 76520 - protein, 8 aa, Mycobacterium avium
VPGDVPGN

SEQ ID NO: 76521 - protein, 7 aa, Mycobacterium avium
VPGEDAV

SEQ ID NO: 76522 - protein, 14 aa, Mycobacterium avium
VPGERRSPREVVGR

SEQ ID NO: 76523 - protein, 30 aa, Mycobacterium avium; identical to SEQ ID NO: 6911

SEQ ID NO: 76524 - protein, 6 aa, Mycobacterium avium
VPGGAS

SEQ ID NO: 76525 - protein, 6 aa, Mycobacterium avium
VPGGTN

SEQ ID NO: 76526 - protein, 34 aa, Mycobacterium avium
VPGLDRPPAPPAQPARGAGVEPRRALSARPARRR

SEQ ID NO: 76527 - protein, 34 aa, Mycobacterium avium
VPGLDRPPAPRAQPARGAGVEPRRALSARPARRR

SEQ ID NO: 76528 - protein, 6 aa, Mycobacterium avium
VPGPAV

SEQ ID NO: 76529 - protein, 5 aa, Mycobacterium avium
VPGPH

SEQ ID NO: 76530 - protein, 6 aa, Mycobacterium avium
VPGPHF

SEQ ID NO: 76531 - protein, 5 aa, Mycobacterium avium
VPGPQ

SEQ ID NO: 76532 - protein, 4 aa, Mycobacterium avium
VPGQ

SEQ ID NO: 76533 - protein, 7 aa, Mycobacterium avium
VPGQPGK

SEQ ID NO: 76534 - protein, 19 aa, Mycobacterium avium
VPGQRIDPAAPQKPDPWWR

SEQ ID NO: 76535 - protein, 6 aa, Mycobacterium avium
VPGRAD

SEQ ID NO: 76536 - protein, 24 aa, Mycobacterium avium
VPGSGVSDGGVSVPDVRGPSRESL

SEQ ID NO: 76537 - protein, 5 aa, Mycobacterium avium
VPGSP

SEQ ID NO: 76538 - protein, 5 aa, Mycobacterium avium
VPGTA

SEQ ID NO: 76539 - protein, 8 aa, Mycobacterium avium
VPGTGLSP

SEQ ID NO: 76540 - protein, 5 aa, Mycobacterium avium
VPGTY

SEQ ID NO: 76541 - protein, 7 aa, Mycobacterium avium
VPIPAGS

SEQ ID NO: 76542 - protein, 5 aa, Mycobacterium avium
VPIPY

SEQ ID NO: 76543 - protein, 10 aa, Mycobacterium avium
VPKADDHDGV

SEQ ID NO: 76544 - protein, 8 aa, Mycobacterium avium
VPKRSSSY

SEQ ID NO: 76545 - protein, 7 aa, Mycobacterium avium
VPLGGPR

SEQ ID NO: 76546 - protein, 11 aa, Mycobacterium avium
VPNADQPPLRG

SEQ ID NO: 76547 - protein, 7 aa, Mycobacterium avium
VPNTEKL

SEQ ID NO: 76548 - protein, 18 aa, Mycobacterium avium
VPPAAEQSRAIRGGLAGI

SEQ ID NO: 76549 - protein, 7 aa, Mycobacterium avium
VPPATER

SEQ ID NO: 76550 - protein, 6 aa, Mycobacterium avium
VPPDDI

SEQ ID NO: 76551 - protein, 6 aa, Mycobacterium avium
VPPDDV

SEQ ID NO: 76552 - protein, 6 aa, Mycobacterium avium
VPPEPD

SEQ ID NO: 76553 - protein, 9 aa, Mycobacterium avium
VPPEPDRPI

SEQ ID NO: 76554 - protein, 9 aa, Mycobacterium avium
VPPGADEAL

SEQ ID NO: 76555 - protein, 12 aa, Mycobacterium avium
VPPGAPEHGQHT

SEQ ID NO: 76556 - protein, 28 aa, Mycobacterium avium
VPPGDTPGGTAPQAATAESGGAATDKVA

SEQ ID NO: 76557 - protein, 16 aa, Mycobacterium avium
VPPGLADDQAAAVTTA

SEQ ID NO: 76558 - protein, 19 aa, Mycobacterium avium
VPPGRKEGEPEQRPGQRHR

SEQ ID NO: 76559 - protein, 7 aa, Mycobacterium avium
VPPHTAS

SEQ ID NO: 76560 - protein, 26 aa, Mycobacterium avium
VPPITAGATTVPALSRDGADEATLTS

SEQ ID NO: 76561 - protein, 12 aa, Mycobacterium avium
VPPQDSPSTQEI

SEQ ID NO: 76562 - protein, 16 aa, Mycobacterium avium
VPPQPSNDGGANPSGT

SEQ ID NO: 76563 - protein, 6 aa, Mycobacterium avium
VPPRDR

SEQ ID NO: 76564 - protein, 23 aa, Mycobacterium avium
VPPSSIGAARKRRSRTALPVTSR

SEQ ID NO: 76565 - protein, 52 aa, Mycobacterium avium
VPPSWAGATPGGRFQQRAAANGGLDRRRSAGRRRHGGAGHARGGDHGAQQRR

SEQ ID NO: 76566 - protein, 5 aa, Mycobacterium avium
VPPVP

SEQ ID NO: 76567 - protein, 43 aa, Mycobacterium avium; identical to SEQ ID NO: 6917

SEQ ID NO: 76568 - protein, 14 aa, Mycobacterium avium
VPQPPERSETGGVS

SEQ ID NO: 76569 - protein, 17 aa, Mycobacterium avium
VPQQRPETLRRSGETSF

SEQ ID NO: 76570 - protein, 9 aa, Mycobacterium avium
VPQREPEPI

SEQ ID NO: 76571 - protein, 19 aa, Mycobacterium avium
VPQTEQSAQQILQTITNRV

SEQ ID NO: 76572 - protein, 5 aa, Mycobacterium avium
VPRDT

SEQ ID NO: 76573 - protein, 13 aa, Mycobacterium avium
VPRGDSALDGESL

SEQ ID NO: 76574 - protein, 8 aa, Mycobacterium avium
VPRPITTG

SEQ ID NO: 76575 - protein, 9 aa, Mycobacterium avium
VPRRRPPRC

SEQ ID NO: 76576 - protein, 10 aa, Mycobacterium avium
VPRSAARTGR

SEQ ID NO: 76577 - protein, 6 aa, Mycobacterium avium
VPRSTE

SEQ ID NO: 76578 - protein, 7 aa, Mycobacterium avium
VPRSTEL

SEQ ID NO: 76579 - protein, 8 aa, Mycobacterium avium
VPSGSAPY

SEQ ID NO: 76580 - protein, 11 aa, Mycobacterium avium
VPSIEPAKDGY

SEQ ID NO: 76581 - protein, 4 aa, Mycobacterium avium
VPSP

SEQ ID NO: 76582 - protein, 6 aa, Mycobacterium avium
VPSPLS

SEQ ID NO: 76583 - protein, 4 aa, Mycobacterium avium
VPST

SEQ ID NO: 76584 - protein, 5 aa, Mycobacterium avium
VPTDH

SEQ ID NO: 76585 - protein, 4 aa, Mycobacterium avium
VPTE

SEQ ID NO: 76586 - protein, 5 aa, Mycobacterium avium
VPTGL

SEQ ID NO: 76587 - protein, 8 aa, Mycobacterium avium
VPTISNQD

SEQ ID NO: 76588 - protein, 7 aa, Mycobacterium avium
VPTITTS

SEQ ID NO: 76589 - protein, 10 aa, Mycobacterium avium
VPTSGPGTIA

SEQ ID NO: 76590 - protein, 5 aa, Mycobacterium avium
VPTSL

SEQ ID NO: 76591 - protein, 9 aa, Mycobacterium avium
VPVQDAPQR

SEQ ID NO: 76592 - protein, 5 aa, Mycobacterium avium
VPVTG

SEQ ID NO: 76593 - protein, 5 aa, Mycobacterium avium
VPYGP

SEQ ID NO: 76594 - protein, 12 aa, Mycobacterium avium
VPYKEATAAQLA

SEQ ID NO: 76595 - protein, 9 aa, Mycobacterium avium
VQAGPPGPA

SEQ ID NO: 76596 - protein, 4 aa, Mycobacterium avium
VQAV

SEQ ID NO: 76597 - protein, 6 aa, Mycobacterium avium
VQDGTT

SEQ ID NO: 76598 - protein, 11 aa, Mycobacterium avium
VQDKRSDQALA

SEQ ID NO: 76599 - protein, 5 aa, Mycobacterium avium
VQDNG

SEQ ID NO: 76600 - protein, 9 aa, Mycobacterium avium
VQGAANGGQ

SEQ ID NO: 76601 - protein, 12 aa, Mycobacterium avium
VQGCPTGALSIE

SEQ ID NO: 76602 - protein, 10 aa, Mycobacterium avium
VQGNDPRPLT

SEQ ID NO: 76603 - protein, 7 aa, Mycobacterium avium
VQGTLNA

SEQ ID NO: 76604 - protein, 19 aa, Mycobacterium avium
VQPELRKGRYPDRKTARRV

SEQ ID NO: 76605 - protein, 7 aa, Mycobacterium avium
VQPQAAA

SEQ ID NO: 76606 - protein, 7 aa, Mycobacterium avium
VQPRAAA

SEQ ID NO: 76607 - protein, 7 aa, Mycobacterium avium
VQQAAAD

SEQ ID NO: 76608 - protein, 19 aa, Mycobacterium avium
VQQAAADHAAAQADAQACD

SEQ ID NO: 76609 - protein, 9 aa, Mycobacterium avium
VQQASANDC

SEQ ID NO: 76610 - protein, 10 aa, Mycobacterium avium
VQQRTPDLPH

SEQ ID NO: 76611 - protein, 5 aa, Mycobacterium avium
VQRNA

SEQ ID NO: 76612 - protein, 6 aa, Mycobacterium avium
VQRPGN

SEQ ID NO: 76613 - protein, 23 aa, Mycobacterium avium
VQSTPTTPCGSARSWATSPIATA

SEQ ID NO: 76614 - protein, 25 aa, Mycobacterium avium
VQTHSRRVAEAGRRYASNEADSADA

SEQ ID NO: 76615 - protein, 8 aa, Mycobacterium avium
VRADPDAA

SEQ ID NO: 76616 - protein, 18 aa, Mycobacterium avium
VRADTGQRLEPQPAHPGD

SEQ ID NO: 76617 - protein, 4 aa, Mycobacterium avium
VRAE

SEQ ID NO: 76618 - protein, 11 aa, Mycobacterium avium
VRAGAAQQRQV

SEQ ID NO: 76619 - protein, 8 aa, Mycobacterium avium
VRAPRRQW

SEQ ID NO: 76620 - protein, 11 aa, Mycobacterium avium
VRAQASAAIAD

SEQ ID NO: 76621 - protein, 5 aa, Mycobacterium avium
VRAQS

SEQ ID NO: 76622 - protein, 6 aa, Mycobacterium avium
VRDADA

SEQ ID NO: 76623 - protein, 6 aa, Mycobacterium avium
VRDADR

SEQ ID NO: 76624 - protein, 19 aa, Mycobacterium avium
VRDAGLESAGRRGPGGGLP

SEQ ID NO: 76625 - protein, 20 aa, Mycobacterium avium
VRDAGLESAGRRGPGGGLPI

SEQ ID NO: 76626 - protein, 19 aa, Mycobacterium avium
VRDAGLQSAGRRGPGGGLP

SEQ ID NO: 76627 - protein, 10 aa, Mycobacterium avium
VRDAGTDRKW

SEQ ID NO: 76628 - protein, 9 aa, Mycobacterium avium
VRDDYSGDL

SEQ ID NO: 76629 - protein, 21 aa, Mycobacterium avium
VRDEHGNPQTVPSATYGKGKR

SEQ ID NO: 76630 - protein, 7 aa, Mycobacterium avium
VRDGSAD

SEQ ID NO: 76631 - protein, 14 aa, Mycobacterium avium
VRDNGRAAAGAGGT

SEQ ID NO: 76632 - protein, 14 aa, Mycobacterium avium
VRDNGRAAPGAGGT

SEQ ID NO: 76633 - protein, 13 aa, Mycobacterium avium
VRDNGRAAPRAGG

SEQ ID NO: 76634 - protein, 8 aa, Mycobacterium avium
VRDQQALT

SEQ ID NO: 76635 - protein, 9 aa, Mycobacterium avium
VRDSTVSAA

SEQ ID NO: 76636 - protein, 14 aa, Mycobacterium avium
VREPGQLGIHVRQF

SEQ ID NO: 76637 - protein, 13 aa, Mycobacterium avium
VRETPDPEPGPGE

SEQ ID NO: 76638 - protein, 14 aa, Mycobacterium avium
VRGAGDVGHQSRVP

SEQ ID NO: 76639 - protein, 9 aa, Mycobacterium avium
VRGARKDDI

SEQ ID NO: 76640 - protein, 11 aa, Mycobacterium avium
VRGEALERGAS

SEQ ID NO: 76641 - protein, 11 aa, Mycobacterium avium
VRGEPPPPTYK

SEQ ID NO: 76642 - protein, 14 aa, Mycobacterium avium
VRGGARVTRPRRET

SEQ ID NO: 76643 - protein, 6 aa, Mycobacterium avium
VRGGAV

SEQ ID NO: 76644 - protein, 12 aa, Mycobacterium avium
VRGGISTEESLT

SEQ ID NO: 76645 - protein, 19 aa, Mycobacterium avium
VRGGQRRHPSDNRDEPERA

SEQ ID NO: 76646 - protein, 6 aa, Mycobacterium avium
VRGPAA

SEQ ID NO: 76647 - protein, 7 aa, Mycobacterium avium
VRGPRSA

SEQ ID NO: 76648 - protein, 145 aa, Mycobacterium avium
VRGQANGAAPAEQANGAEPAEDSGKPDAKDAKDDTTPDTKDANDHTGAQSAAEAPAPSEQNGATAEAPRRERRSASRDAGAAGRGSDDADRETDGREQSKQDSREQSKQDGGDQDQQSSGGQQGRGSNQQDDDGEGRQGRRGRRF

SEQ ID NO: 76649 - protein, 5 aa, Mycobacterium avium
VRGSL

SEQ ID NO: 76650 - protein, 5 aa, Mycobacterium avium
VRMPG

SEQ ID NO: 76651 - protein, 16 aa, Mycobacterium avium
VRPAEPRRAAGGEEVR

SEQ ID NO: 76652 - protein, 37 aa, Mycobacterium avium
VRPAGQQNTAGQTQQPFASNASSDQYANVGNTQPQAP

SEQ ID NO: 76653 - protein, 9 aa, Mycobacterium avium
VRPAPDNVD

SEQ ID NO: 76654 - protein, 41 aa, Mycobacterium avium
VRPARGRPPVAEADDAESESDSASESDAEDVHDPLVDPLHT

SEQ ID NO: 76655 - protein, 16 aa, Mycobacterium avium
VRPDATPTKSDPKRLP

SEQ ID NO: 76656 - protein, 18 aa, Mycobacterium avium
VRPEPGAEPRPAGRGAHQ

SEQ ID NO: 76657 - protein, 15 aa, Mycobacterium avium
VRPGEECDGEDNRLG

SEQ ID NO: 76658 - protein, 16 aa, Mycobacterium avium
VRPGEECDGEDNRLGT

SEQ ID NO: 76659 - protein, 5 aa, Mycobacterium avium
VRPGQ

SEQ ID NO: 76660 - protein, 15 aa, Mycobacterium avium
VRPGRRPAHRPGRRR

SEQ ID NO: 76661 - protein, 6 aa, Mycobacterium avium
VRPPSM

SEQ ID NO: 76662 - protein, 5 aa, Mycobacterium avium
VRPRP

SEQ ID NO: 76663 - protein, 26 aa, Mycobacterium avium
VRPSPRQCPRRRGRVSAADRRFTRAF

SEQ ID NO: 76664 - protein, 4 aa, Mycobacterium avium
VRPV

SEQ ID NO: 76665 - protein, 7 aa, Mycobacterium avium
VRRDGLD

SEQ ID NO: 76666 - protein, 4 aa, Mycobacterium avium
VRRG

SEQ ID NO: 76667 - protein, 13 aa, Mycobacterium avium
VRRGDGSPADLAG

SEQ ID NO: 76668 - protein, 10 aa, Mycobacterium avium
VRRGRPGLRP

SEQ ID NO: 76669 - protein, 9 aa, Mycobacterium avium
VRRGSGDIT

SEQ ID NO: 76670 - protein, 8 aa, Mycobacterium avium
VRRGTTAG

SEQ ID NO: 76671 - protein, 7 aa, Mycobacterium avium
VRRPVDG

SEQ ID NO: 76672 - protein, 4 aa, Mycobacterium avium
VRRR

SEQ ID NO: 76673 - protein, 35 aa, Mycobacterium avium
VRRRPRRRARGRGADDVHDAGARAGARSGGQPAGR

SEQ ID NO: 76674 - protein, 27 aa, Mycobacterium avium
VRRRTAANARAGTATSRRPHTSAHVGA

SEQ ID NO: 76675 - protein, 27 aa, Mycobacterium avium
VRRRTTANARAGTATPRRPHTSAHVGA

SEQ ID NO: 76676 - protein, 27 aa, Mycobacterium avium
VRRRTTANARAGTATSRRPHTSAHVGA

SEQ ID NO: 76677 - protein, 7 aa, Mycobacterium avium
VRSAKDT

SEQ ID NO: 76678 - protein, 4 aa, Mycobacterium avium
VRSD

SEQ ID NO: 76679 - protein, 8 aa, Mycobacterium avium
VRSGQAPL

SEQ ID NO: 76680 - protein, 7 aa, Mycobacterium avium
VRSGSGE

SEQ ID NO: 76681 - protein, 7 aa, Mycobacterium avium
VRSGVTG

SEQ ID NO: 76682 - protein, 6 aa, Mycobacterium avium
VRSPDD

SEQ ID NO: 76683 - protein, 8 aa, Mycobacterium avium
VRSRPRNG

SEQ ID NO: 76684 - protein, 4 aa, Mycobacterium avium
VRST

SEQ ID NO: 76685 - protein, 8 aa, Mycobacterium avium
VRTAGDSW

SEQ ID NO: 76686 - protein, 7 aa, Mycobacterium avium
VRTATRD

SEQ ID NO: 76687 - protein, 12 aa, Mycobacterium avium
VRTDPKARKHKG

SEQ ID NO: 76688 - protein, 12 aa, Mycobacterium avium
VRTDPNAPKHKG

SEQ ID NO: 76689 - protein, 5 aa, Mycobacterium avium
VRTGE

SEQ ID NO: 76690 - protein, 5 aa, Mycobacterium avium
VRTGT

SEQ ID NO: 76691 - protein, 5 aa, Mycobacterium avium
VRTRA

SEQ ID NO: 76692 - protein, 7 aa, Mycobacterium avium
VRTRYSS

SEQ ID NO: 76693 - protein, 4 aa, Mycobacterium avium
VRTS

SEQ ID NO: 76694 - protein, 8 aa, Mycobacterium avium
VSAAGGRV

SEQ ID NO: 76695 - protein, 14 aa, Mycobacterium avium
VSAAGSQVTAADQN

SEQ ID NO: 76696 - protein, 8 aa, Mycobacterium avium
VSADASVR

SEQ ID NO: 76697 - protein, 7 aa, Mycobacterium avium
VSADGHG

SEQ ID NO: 76698 - protein, 10 aa, Mycobacterium avium
VSADTTKALG

SEQ ID NO: 76699 - protein, 11 aa, Mycobacterium avium
VSAGAGRAGAL

SEQ ID NO: 76700 - protein, 8 aa, Mycobacterium avium
VSAHPQAG

SEQ ID NO: 76701 - protein, 11 aa, Mycobacterium avium
VSAPEGTVPGA

SEQ ID NO: 76702 - protein, 7 aa, Mycobacterium avium
VSARARR

SEQ ID NO: 76703 - protein, 13 aa, Mycobacterium avium
VSARFGSKEPDKF

SEQ ID NO: 76704 - protein, 8 aa, Mycobacterium avium
VSASGDPI

SEQ ID NO: 76705 - protein, 14 aa, Mycobacterium avium
VSASGGLGSGRAES

SEQ ID NO: 76706 - protein, 6 aa, Mycobacterium avium
VSASTR

SEQ ID NO: 76707 - protein, 7 aa, Mycobacterium avium
VSAVDSR

SEQ ID NO: 76708 - protein, 12 aa, Mycobacterium avium
VSAYSGKPRREY

SEQ ID NO: 76709 - protein, 4 aa, Mycobacterium avium
VSCD

SEQ ID NO: 76710 - protein, 7 aa, Mycobacterium avium
VSDPALY

SEQ ID NO: 76711 - protein, 10 aa, Mycobacterium avium
VSDPARPTVV

SEQ ID NO: 76712 - protein, 9 aa, Mycobacterium avium
VSDPTLSRA

SEQ ID NO: 76713 - protein, 10 aa, Mycobacterium avium
VSDPTPGKNR

SEQ ID NO: 76714 - protein, 9 aa, Mycobacterium avium
VSDTTTGER

SEQ ID NO: 76715 - protein, 6 aa, Mycobacterium avium
VSDTYG

SEQ ID NO: 76716 - protein, 10 aa, Mycobacterium avium
VSEPSGDGVR

SEQ ID NO: 76717 - protein, 5 aa, Mycobacterium avium
VSERA

SEQ ID NO: 76718 - protein, 6 aa, Mycobacterium avium
VSETDR

SEQ ID NO: 76719 - protein, 4 aa, Mycobacterium avium
VSEY

SEQ ID NO: 76720 - protein, 12 aa, Mycobacterium avium
VSEYRADPPWAA

SEQ ID NO: 76721 - protein, 10 aa, Mycobacterium avium
VSFGGGEMPA

SEQ ID NO: 76722 - protein, 6 aa, Mycobacterium avium
VSGAGL

SEQ ID NO: 76723 - protein, 5 aa, Mycobacterium avium
VSGDP

SEQ ID NO: 76724 - protein, 11 aa, Mycobacterium avium
VSGGAGGLGEA

SEQ ID NO: 76725 - protein, 6 aa, Mycobacterium avium
VSGGPT

SEQ ID NO: 76726 - protein, 17 aa, Mycobacterium avium
VSGMGRGEQRRRYDERK

SEQ ID NO: 76727 - protein, 7 aa, Mycobacterium avium
VSGPSGQ

SEQ ID NO: 76728 - protein, 13 aa, Mycobacterium avium
VSGRAHHAGGPGP

SEQ ID NO: 76729 - protein, 7 aa, Mycobacterium avium
VSGRDHR

SEQ ID NO: 76730 - protein, 12 aa, Mycobacterium avium
VSGRPAEVPGAD

SEQ ID NO: 76731 - protein, 11 aa, Mycobacterium avium
VSGRPTELPGA

SEQ ID NO: 76732 - protein, 8 aa, Mycobacterium avium
VSGRQAGV

SEQ ID NO: 76733 - protein, 17 aa, Mycobacterium avium
VSGTAAHPSGERPGEWC

SEQ ID NO: 76734 - protein, 6 aa, Mycobacterium avium
VSGTGQ

SEQ ID NO: 76735 - protein, 5 aa, Mycobacterium avium
VSGTL

SEQ ID NO: 76736 - protein, 6 aa, Mycobacterium avium
VSGTVE

SEQ ID NO: 76737 - protein, 7 aa, Mycobacterium avium
VSGYPRE

SEQ ID NO: 76738 - protein, 4 aa, Mycobacterium avium
VSIG

SEQ ID NO: 76739 - protein, 5 aa, Mycobacterium avium
VSNAG

SEQ ID NO: 76740 - protein, 11 aa, Mycobacterium avium
VSPAELKNRGG

SEQ ID NO: 76741 - protein, 9 aa, Mycobacterium avium
VSPATARTQ

SEQ ID NO: 76742 - protein, 8 aa, Mycobacterium avium
VSPDDRDD

SEQ ID NO: 76743 - protein, 17 aa, Mycobacterium avium
VSPEDDELLAAAVRACS

SEQ ID NO: 76744 - protein, 5 aa, Mycobacterium avium
VSPEP

SEQ ID NO: 76745 - protein, 5 aa, Mycobacterium avium
VSPET

SEQ ID NO: 76746 - protein, 5 aa, Mycobacterium avium
VSPGF

SEQ ID NO: 76747 - protein, 15 aa, Mycobacterium avium
VSPPVEGVAHLCAHR

SEQ ID NO: 76748 - protein, 6 aa, Mycobacterium avium
VSPQTL

SEQ ID NO: 76749 - protein, 17 aa, Mycobacterium avium
VSPRSYRSTFRDRAAGG

SEQ ID NO: 76750 - protein, 7 aa, Mycobacterium avium
VSPSALP

SEQ ID NO: 76751 - protein, 12 aa, Mycobacterium avium
VSPSGGKVPLEP

SEQ ID NO: 76752 - protein, 17 aa, Mycobacterium avium
VSPSPPGNSRPRDPNRP

SEQ ID NO: 76753 - protein, 17 aa, Mycobacterium avium
VSPTANGICSSGSTGVP

SEQ ID NO: 76754 - protein, 6 aa, Mycobacterium avium
VSPTTD

SEQ ID NO: 76755 - protein, 7 aa, Mycobacterium avium
VSQDQPD

SEQ ID NO: 76756 - protein, 7 aa, Mycobacterium avium
VSQGGQA

SEQ ID NO: 76757 - protein, 7 aa, Mycobacterium avium
VSQQARV

SEQ ID NO: 76758 - protein, 18 aa, Mycobacterium avium
VSQSGGKMPVSTGSTEER

SEQ ID NO: 76759 - protein, 20 aa, Mycobacterium avium
VSQSGQAEQRHGLTKAGDPL

SEQ ID NO: 76760 - protein, 10 aa, Mycobacterium avium
VSQTARDGDT

SEQ ID NO: 76761 - protein, 10 aa, Mycobacterium avium
VSQTARNGDT

SEQ ID NO: 76762 - protein, 6 aa, Mycobacterium avium
VSQTSE

SEQ ID NO: 76763 - protein, 13 aa, Mycobacterium avium
VSRAELDKNPRDV

SEQ ID NO: 76764 - protein, 6 aa, Mycobacterium avium
VSRAPS

SEQ ID NO: 76765 - protein, 5 aa, Mycobacterium avium
VSRAT

SEQ ID NO: 76766 - protein, 5 aa, Mycobacterium avium
VSRDA

SEQ ID NO: 76767 - protein, 6 aa, Mycobacterium avium
VSRDAE

SEQ ID NO: 76768 - protein, 12 aa, Mycobacterium avium
VSRGPARWIPAN

SEQ ID NO: 76769 - protein, 15 aa, Mycobacterium avium
VSRPARQPGGTGAGH

SEQ ID NO: 76770 - protein, 10 aa, Mycobacterium avium
VSRPGSVTHE

SEQ ID NO: 76771 - protein, 7 aa, Mycobacterium avium
VSSDDLA

SEQ ID NO: 76772 - protein, 9 aa, Mycobacterium avium
VSSEPGDNY

SEQ ID NO: 76773 - protein, 23 aa, Mycobacterium avium
VSSGRPSLAGRGSHQGARLAGRG

SEQ ID NO: 76774 - protein, 16 aa, Mycobacterium avium
VSSGRVQGNGACLSRH

SEQ ID NO: 76775 - protein, 7 aa, Mycobacterium avium
VSTAADA

SEQ ID NO: 76776 - protein, 7 aa, Mycobacterium avium
VSTATDA

SEQ ID NO: 76777 - protein, 10 aa, Mycobacterium avium
VSTESPHTRE

SEQ ID NO: 76778 - protein, 11 aa, Mycobacterium avium
VSTESRHTRER

SEQ ID NO: 76779 - protein, 8 aa, Mycobacterium avium
VSTGESVE

SEQ ID NO: 76780 - protein, 17 aa, Mycobacterium avium
VSTGGGVPSGVMLLHRA

SEQ ID NO: 76781 - protein, 17 aa, Mycobacterium avium
VSTPEKARRSAQAGANE

SEQ ID NO: 76782 - protein, 11 aa, Mycobacterium avium
VSVEGEAQPLP

SEQ ID NO: 76783 - protein, 19 aa, Mycobacterium avium
VTAADPGTRISSATVESAE

SEQ ID NO: 76784 - protein, 8 aa, Mycobacterium avium
VTAAGAGL

SEQ ID NO: 76785 - protein, 15 aa, Mycobacterium avium
VTAAKTQTVRLPGEE

SEQ ID NO: 76786 - protein, 4 aa, Mycobacterium avium
VTAD

SEQ ID NO: 76787 - protein, 8 aa, Mycobacterium avium
VTADGGTL

SEQ ID NO: 76788 - protein, 21 aa, Mycobacterium avium
VTAGDTDPDALDAEAERVAAA

SEQ ID NO: 76789 - protein, 11 aa, Mycobacterium avium
VTAGQPDRDDA

SEQ ID NO: 76790 - protein, 12 aa, Mycobacterium avium
VTAGQPDRDDAH

SEQ ID NO: 76791 - protein, 8 aa, Mycobacterium avium
VTDANDNE

SEQ ID NO: 76792 - protein, 10 aa, Mycobacterium avium
VTDHPGGYAG

SEQ ID NO: 76793 - protein, 12 aa, Mycobacterium avium
VTDKSRAVGSSG

SEQ ID NO: 76794 - protein, 7 aa, Mycobacterium avium
VTDRQRE

SEQ ID NO: 76795 - protein, 4 aa, Mycobacterium avium
VTDS

SEQ ID NO: 76796 - protein, 8 aa, Mycobacterium avium
VTDSGTRT

SEQ ID NO: 76797 - protein, 35 aa, Mycobacterium avium
VTEEGDGEAAATDEPTASAAETRPPESDDNAGASG

SEQ ID NO: 76798 - protein, 14 aa, Mycobacterium avium
VTEELGRRAAAAGI

SEQ ID NO: 76799 - protein, 15 aa, Mycobacterium avium
VTEETASGKLDRPRI

SEQ ID NO: 76800 - protein, 6 aa, Mycobacterium avium
VTEHRD

SEQ ID NO: 76801 - protein, 9 aa, Mycobacterium avium
VTELPQADG

SEQ ID NO: 76802 - protein, 5 aa, Mycobacterium avium
VTERN

SEQ ID NO: 76803 - protein, 6 aa, Mycobacterium avium
VTGAPE

SEQ ID NO: 76804 - protein, 5 aa, Mycobacterium avium
VTGAS

SEQ ID NO: 76805 - protein, 7 aa, Mycobacterium avium
VTGASTA

SEQ ID NO: 76806 - protein, 6 aa, Mycobacterium avium
VTGERG

SEQ ID NO: 76807 - protein, 7 aa, Mycobacterium avium
VTGERVQ

SEQ ID NO: 76808 - protein, 10 aa, Mycobacterium avium
VTGGDSGIGR

SEQ ID NO: 76809 - protein, 6 aa, Mycobacterium avium
VTGGTG

SEQ ID NO: 76810 - protein, 7 aa, Mycobacterium avium
VTGPEVD

SEQ ID NO: 76811 - protein, 17 aa, Mycobacterium avium
VTGPPPMPDQPPPVAND

SEQ ID NO: 76812 - protein, 14 aa, Mycobacterium avium
VTGQATKVAGPGWT

SEQ ID NO: 76813 - protein, 9 aa, Mycobacterium avium
VTGRRASGL

SEQ ID NO: 76814 - protein, 10 aa, Mycobacterium avium
VTGSSRGIGR

SEQ ID NO: 76815 - protein, 12 aa, Mycobacterium avium
VTGTTSDPPFTA

SEQ ID NO: 76816 - protein, 27 aa, Mycobacterium avium
VTGVAGAPFGAGLGQSGDLDPGRAMAG

SEQ ID NO: 76817 - protein, 10 aa, Mycobacterium avium
VTHRSGTTTY

SEQ ID NO: 76818 - protein, 11 aa, Mycobacterium avium
VTKSDQTPWYE

SEQ ID NO: 76819 - protein, 11 aa, Mycobacterium avium
VTLTDGDGQVT

SEQ ID NO: 76820 - protein, 7 aa, Mycobacterium avium
VTNDRYG

SEQ ID NO: 76821 - protein, 5 aa, Mycobacterium avium
VTNGD

SEQ ID NO: 76822 - protein, 7 aa, Mycobacterium avium
VTNGQTA

SEQ ID NO: 76823 - protein, 7 aa, Mycobacterium avium
VTNPKGE

SEQ ID NO: 76824 - protein, 15 aa, Mycobacterium avium
VTPDAGGVAGSMGRS

SEQ ID NO: 76825 - protein, 7 aa, Mycobacterium avium
VTPGATT

SEQ ID NO: 76826 - protein, 6 aa, Mycobacterium avium
VTPGHE

SEQ ID NO: 76827 - protein, 19 aa, Mycobacterium avium
VTPNADAYKPRASDAPDAL

SEQ ID NO: 76828 - protein, 32 aa, Mycobacterium avium
VTPPASDVKAKPARKAPRAAAGGRAGRPKKLT

SEQ ID NO: 76829 - protein, 7 aa, Mycobacterium avium
VTPPHST

SEQ ID NO: 76830 - protein, 7 aa, Mycobacterium avium
VTPRAES

SEQ ID NO: 76831 - protein, 11 aa, Mycobacterium avium
VTPRPRVAPTQ

SEQ ID NO: 76832 - protein, 5 aa, Mycobacterium avium
VTPSK

SEQ ID NO: 76833 - protein, 7 aa, Mycobacterium avium
VTPSRNA

SEQ ID NO: 76834 - protein, 8 aa, Mycobacterium avium
VTPTQRRK

SEQ ID NO: 76835 - protein, 20 aa, Mycobacterium avium
VTPTQYARRRSSMPGHVELA

SEQ ID NO: 76836 - protein, 11 aa, Mycobacterium avium
VTPTRNGDPVD

SEQ ID NO: 76837 - protein, 10 aa, Mycobacterium avium
VTPTRNGEPV

SEQ ID NO: 76838 - protein, 6 aa, Mycobacterium avium
VTPTTD

SEQ ID NO: 76839 - protein, 7 aa, Mycobacterium avium
VTQAPDE

SEQ ID NO: 76840 - protein, 33 aa, Mycobacterium avium
VTQPAPAPRFSRTPQPLPSGPPRRAEMVDDVWQ

SEQ ID NO: 76841 - protein, 9 aa, Mycobacterium avium
VTQPTSWSA

SEQ ID NO: 76842 - protein, 7 aa, Mycobacterium avium
VTQQDDR

SEQ ID NO: 76843 - protein, 12 aa, Mycobacterium avium
VTQQSPSRTADF

SEQ ID NO: 76844 - protein, 13 aa, Mycobacterium avium
VTQQSPSRTEGFD

SEQ ID NO: 76845 - protein, 10 aa, Mycobacterium avium
VTQTSATDQT

SEQ ID NO: 76846 - protein, 7 aa, Mycobacterium avium
VTRAPEE

SEQ ID NO: 76847 - protein, 10 aa, Mycobacterium avium
VTRGTSQHGF

SEQ ID NO: 76848 - protein, 4 aa, Mycobacterium avium
VTRH

SEQ ID NO: 76849 - protein, 8 aa, Mycobacterium avium
VTRPARYG

SEQ ID NO: 76850 - protein, 8 aa, Mycobacterium avium
VTRPDEPM

SEQ ID NO: 76851 - protein, 13 aa, Mycobacterium avium
VTRPGLAAAPAAT

SEQ ID NO: 76852 - protein, 16 aa, Mycobacterium avium
VTRPSTPGQPARRAPT

SEQ ID NO: 76853 - protein, 14 aa, Mycobacterium avium
VTRRAGDGTRVLIA

SEQ ID NO: 76854 - protein, 14 aa, Mycobacterium avium
VTRRASDGTRVLIA

SEQ ID NO: 76855 - protein, 7 aa, Mycobacterium avium
VTRSPKD

SEQ ID NO: 76856 - protein, 11 aa, Mycobacterium avium
VTSDESVQGAI

SEQ ID NO: 76857 - protein, 8 aa, Mycobacterium avium
VTSGREGV

SEQ ID NO: 76858 - protein, 4 aa, Mycobacterium avium
VTSK

SEQ ID NO: 76859 - protein, 8 aa, Mycobacterium avium
VTSPATGE

SEQ ID NO: 76860 - protein, 14 aa, Mycobacterium avium
VTSPDDPGAVSTAA

SEQ ID NO: 76861 - protein, 13 aa, Mycobacterium avium
VTSPDDPGAVTTA

SEQ ID NO: 76862 - protein, 9 aa, Mycobacterium avium
VTSPSTGEV

SEQ ID NO: 76863 - protein, 28 aa, Mycobacterium avium
VTSSLTGNRDLGNNRGADQHFDPEDTKV

SEQ ID NO: 76864 - protein, 8 aa, Mycobacterium avium
VTSTGRPL

SEQ ID NO: 76865 - protein, 7 aa, Mycobacterium avium
VTSVPDR

SEQ ID NO: 76866 - protein, 4 aa, Mycobacterium avium
VTSW

SEQ ID NO: 76867 - protein, 5 aa, Mycobacterium avium
VTSWS

SEQ ID NO: 76868 - protein, 21 aa, Mycobacterium avium
VTTGDTDPDALEAEAERVAAA

SEQ ID NO: 76869 - protein, 18 aa, Mycobacterium avium
VTTLSDEDRALTKGDPLR

SEQ ID NO: 76870 - protein, 4 aa, Mycobacterium avium
VTTN

SEQ ID NO: 76871 - protein, 9 aa, Mycobacterium avium
VTTPARTAY

SEQ ID NO: 76872 - protein, 6 aa, Mycobacterium avium
VTTPFP

SEQ ID NO: 76873 - protein, 6 aa, Mycobacterium avium
VTTQAE

SEQ ID NO: 76874 - protein, 9 aa, Mycobacterium avium
VTTSDDEPV

SEQ ID NO: 76875 - protein, 6 aa, Mycobacterium avium
VTTTAD

SEQ ID NO: 76876 - protein, 11 aa, Mycobacterium avium
VTTTSGPGISL

SEQ ID NO: 76877 - protein, 4 aa, Mycobacterium avium
VTVG

SEQ ID NO: 76878 - protein, 8 aa, Mycobacterium avium
VTVHPNDD

SEQ ID NO: 76879 - protein, 11 aa, Mycobacterium avium
VVAEDADTVTV

SEQ ID NO: 76880 - protein, 28 aa, Mycobacterium avium
VVDRDGNELSRDTEAAISGPTGGPIEGP

SEQ ID NO: 76881 - protein, 5 aa, Mycobacterium avium
VVEDG

SEQ ID NO: 76882 - protein, 11 aa, Mycobacterium avium
VVGGNNRGSGV

SEQ ID NO: 76883 - protein, 36 aa, Mycobacterium avium
VVNPATTTIPTARRSSCTRPSRGRATVAVRSLRRMA

SEQ ID NO: 76884 - protein, 20 aa, Mycobacterium avium
VVPNDGGRVVDPASGRPVPG

SEQ ID NO: 76885 - protein, 11 aa, Mycobacterium avium
VVSGGSRGIGR

SEQ ID NO: 76886 - protein, 11 aa, Mycobacterium avium
VVTGSGAPTAN

SEQ ID NO: 76887 - protein, 13 aa, Mycobacterium avium
VVTPTTAVAPAAG

SEQ ID NO: 76888 - protein, 7 aa, Mycobacterium avium
VVTQGPD

SEQ ID NO: 76889 - protein, 12 aa, Mycobacterium avium
VYGPRQDPHGEA

SEQ ID NO: 76890 - protein, 13 aa, Mycobacterium avium
VYGQTREAKRASL

SEQ ID NO: 76891 - protein, 7 aa, Mycobacterium avium
VYGTDAA

SEQ ID NO: 76892 - protein, 25 aa, Mycobacterium avium
VYNGSGIGNMGGVDATEDPWHGRPA

SEQ ID NO: 76893 - protein, 6 aa, Mycobacterium avium
VYPSPE

SEQ ID NO: 76894 - protein, 10 aa, Mycobacterium avium
VYPSRQDPAL

SEQ ID NO: 76895 - protein, 12 aa, Mycobacterium avium
VYSRDGHSDYGN

SEQ ID NO: 76896 - protein, 7 aa, Mycobacterium avium
VYSTGNV

SEQ ID NO: 76897 - protein, 5 aa, Mycobacterium avium
VYTGN

SEQ ID NO: 76898 - protein, 5 aa, Mycobacterium avium
WADGD

SEQ ID NO: 76899 - protein, 10 aa, Mycobacterium avium
WADGGGTDAD

SEQ ID NO: 76900 - protein, 6 aa, Mycobacterium avium
WAGADG

SEQ ID NO: 76901 - protein, 12 aa, Mycobacterium avium
WAPDGSPAGIGG

SEQ ID NO: 76902 - protein, 16 aa, Mycobacterium avium
WAPHGGESRVDAAARS

SEQ ID NO: 76903 - protein, 10 aa, Mycobacterium avium
WAPSGGNQQP

SEQ ID NO: 76904 - protein, 18 aa, Mycobacterium avium
WAPSRAQCSGSLASSATE

SEQ ID NO: 76905 - protein, 4 aa, Mycobacterium avium
WAPW

SEQ ID NO: 76906 - protein, 4 aa, Mycobacterium avium
WAQR

SEQ ID NO: 76907 - protein, 14 aa, Mycobacterium avium
WASRATWSPSTDST

SEQ ID NO: 76908 - protein, 13 aa, Mycobacterium avium
WDARATALGGTSN

SEQ ID NO: 76909 - protein, 19 aa, Mycobacterium avium
WDASKKGEIPDPQDPQTFA

SEQ ID NO: 76910 - protein, 7 aa, Mycobacterium avium
WDEAPAQ

SEQ ID NO: 76911 - protein, 13 aa, Mycobacterium avium
WDPASKQPSFKTA

SEQ ID NO: 76912 - protein, 12 aa, Mycobacterium avium
WDPDAPGYRRPA

SEQ ID NO: 76913 - protein, 5 aa, Mycobacterium avium
WDPEP

SEQ ID NO: 76914 - protein, 8 aa, Mycobacterium avium
WDSNGDPV

SEQ ID NO: 76915 - protein, 10 aa, Mycobacterium avium
WEETGPDGDR

SEQ ID NO: 76916 - protein, 21 aa, Mycobacterium avium
WEGPLASGEGKLSQGSSGALD

SEQ ID NO: 76917 - protein, 12 aa, Mycobacterium avium
WEPGDDAGAEHD

SEQ ID NO: 76918 - protein, 5 aa, Mycobacterium avium
WEPMG

SEQ ID NO: 76919 - protein, 13 aa, Mycobacterium avium
WERPARSVTNGHG

SEQ ID NO: 76920 - protein, 9 aa, Mycobacterium avium
WERTQRRPV

SEQ ID NO: 76921 - protein, 9 aa, Mycobacterium avium
WETTPELDG

SEQ ID NO: 76922 - protein, 4 aa, Mycobacterium avium
WGAD

SEQ ID NO: 76923 - protein, 8 aa, Mycobacterium avium
WGGSSNGR

SEQ ID NO: 76924 - protein, 8 aa, Mycobacterium avium
WGPETGAA

SEQ ID NO: 76925 - protein, 7 aa, Mycobacterium avium
WGPPDGP

SEQ ID NO: 76926 - protein, 6 aa, Mycobacterium avium
WGPPEA

SEQ ID NO: 76927 - protein, 14 aa, Mycobacterium avium
WGPPEAAQRVTGSA

SEQ ID NO: 76928 - protein, 8 aa, Mycobacterium avium
WGPQTGAA

SEQ ID NO: 76929 - protein, 11 aa, Mycobacterium avium
WGQGGPRALQA

SEQ ID NO: 76930 - protein, 8 aa, Mycobacterium avium
WGRAAGPV

SEQ ID NO: 76931 - protein, 8 aa, Mycobacterium avium
WGSTGPFR

SEQ ID NO: 76932 - protein, 9 aa, Mycobacterium avium
WGSTGPFRD

SEQ ID NO: 76933 - protein, 18 aa, Mycobacterium avium
WGTAESDAPPSFGAGSSA

SEQ ID NO: 76934 - protein, 16 aa, Mycobacterium avium
WGTGYSKQQSTRPQTL

SEQ ID NO: 76935 - protein, 7 aa, Mycobacterium avium
WKGNPGL

SEQ ID NO: 76936 - protein, 32 aa, Mycobacterium avium
WKPPPRANSLRSSMKNSAADTPQGAPMPGTEQ

SEQ ID NO: 76937 - protein, 8 aa, Mycobacterium avium
WNDPDADF

SEQ ID NO: 76938 - protein, 14 aa, Mycobacterium avium
WNGTDERVDEAYDD

SEQ ID NO: 76939 - protein, 11 aa, Mycobacterium avium
WNPDAPGYRRA

SEQ ID NO: 76940 - protein, 12 aa, Mycobacterium avium
WNPDAPGYRRPA

SEQ ID NO: 76941 - protein, 10 aa, Mycobacterium avium
WNPGDETTAG

SEQ ID NO: 76942 - protein, 20 aa, Mycobacterium avium
WNTPVSPRSASPTPAPGCSS

SEQ ID NO: 76943 - protein, 4 aa, Mycobacterium avium
WPAG

SEQ ID NO: 76944 - protein, 10 aa, Mycobacterium avium
WPAGDGPETI

SEQ ID NO: 76945 - protein, 6 aa, Mycobacterium avium
WPAPED

SEQ ID NO: 76946 - protein, 6 aa, Mycobacterium avium
WPAPEN

SEQ ID NO: 76947 - protein, 5 aa, Mycobacterium avium
WPAPF

SEQ ID NO: 76948 - protein, 13 aa, Mycobacterium avium
WPAPFDTDPRARR

SEQ ID NO: 76949 - protein, 5 aa, Mycobacterium avium
WPDPG

SEQ ID NO: 76950 - protein, 7 aa, Mycobacterium avium
WPHPEGL

SEQ ID NO: 76951 - protein, 19 aa, Mycobacterium avium
WPPGPTYDPNTWTTTFDVQ

SEQ ID NO: 76952 - protein, 9 aa, Mycobacterium avium
WPPPTPEVP

SEQ ID NO: 76953 - protein, 22 aa, Mycobacterium avium
WPSSTLPPFRRPNGAPVSSIPP

SEQ ID NO: 76954 - protein, 24 aa, Mycobacterium avium
WPSTTQPARSARRGAHRRHTQGEH

SEQ ID NO: 76955 - protein, 11 aa, Mycobacterium avium
WQDAGRPARPY

SEQ ID NO: 76956 - protein, 6 aa, Mycobacterium avium
WQDNEG

SEQ ID NO: 76957 - protein, 12 aa, Mycobacterium avium
WQGSSSGSMAAA

SEQ ID NO: 76958 - protein, 16 aa, Mycobacterium avium
WQPPGGAAGAATAAVP

SEQ ID NO: 76959 - protein, 12 aa, Mycobacterium avium
WQTTPVQSHGTE

SEQ ID NO: 76960 - protein, 19 aa, Mycobacterium avium
WRAPGAGPTQISGYQGKDG

SEQ ID NO: 76961 - protein, 9 aa, Mycobacterium avium
WRATADEPN

SEQ ID NO: 76962 - protein, 5 aa, Mycobacterium avium
WRDGG

SEQ ID NO: 76963 - protein, 4 aa, Mycobacterium avium
WRDR

SEQ ID NO: 76964 - protein, 18 aa, Mycobacterium avium
WRDTRRPTVPGVAQAKDG

SEQ ID NO: 76965 - protein, 11 aa, Mycobacterium avium
WRGQTDDEDQL

SEQ ID NO: 76966 - protein, 38 aa, Mycobacterium avium
WRGSRASPNRWAGRASPAGSPASPPGAPTAGCRSTRRS

SEQ ID NO: 76967 - protein, 10 aa, Mycobacterium avium
WRPASSTEAY

SEQ ID NO: 76968 - protein, 11 aa, Mycobacterium avium
WRPPAGDPHPI

SEQ ID NO: 76969 - protein, 20 aa, Mycobacterium avium
WRPTRPSGASCRPPGSPGRL

SEQ ID NO: 76970 - protein, 4 aa, Mycobacterium avium
WRRP

SEQ ID NO: 76971 - protein, 4 aa, Mycobacterium avium
WRRT

SEQ ID NO: 76972 - protein, 4 aa, Mycobacterium avium
WRTN

SEQ ID NO: 76973 - protein, 4 aa, Mycobacterium avium
WSDG

SEQ ID NO: 76974 - protein, 7 aa, Mycobacterium avium
WSEPHQS

SEQ ID NO: 76975 - protein, 12 aa, Mycobacterium avium
WSESGEPGGIGG

SEQ ID NO: 76976 - protein, 14 aa, Mycobacterium avium
WSGGSEPGNEINPA

SEQ ID NO: 76977 - protein, 4 aa, Mycobacterium avium
WSGS

SEQ ID NO: 76978 - protein, 8 aa, Mycobacterium avium
WSKEERDN

SEQ ID NO: 76979 - protein, 13 aa, Mycobacterium avium
WSKPNPKTATNAG

SEQ ID NO: 76980 - protein, 7 aa, Mycobacterium avium
WSNRTNE

SEQ ID NO: 76981 - protein, 6 aa, Mycobacterium avium
WSSTRG

SEQ ID NO: 76982 - protein, 10 aa, Mycobacterium avium
WSTDPRSRVP

SEQ ID NO: 76983 - protein, 6 aa, Mycobacterium avium
WSTDSD

SEQ ID NO: 76984 - protein, 11 aa, Mycobacterium avium
WSTPATPGLSA

SEQ ID NO: 76985 - protein, 10 aa, Mycobacterium avium
WTDPAQRTRD

SEQ ID NO: 76986 - protein, 11 aa, Mycobacterium avium
WTEDDEPAGIG

SEQ ID NO: 76987 - protein, 7 aa, Mycobacterium avium
WTGRSKF

SEQ ID NO: 76988 - protein, 5 aa, Mycobacterium avium
WTPAW

SEQ ID NO: 76989 - protein, 15 aa, Mycobacterium avium
WTPDCDAPAAHPNSR

SEQ ID NO: 76990 - protein, 4 aa, Mycobacterium avium
WTQE

SEQ ID NO: 76991 - protein, 10 aa, Mycobacterium avium
WTRDRPGLGA

SEQ ID NO: 76992 - protein, 12 aa, Mycobacterium avium
WTSDGSPAGIGG

SEQ ID NO: 76993 - protein, 16 aa, Mycobacterium avium
YAAATSRRVAGEAGVK

SEQ ID NO: 76994 - protein, 12 aa, Mycobacterium avium
YAAPGDFDTTPV

SEQ ID NO: 76995 - protein, 14 aa, Mycobacterium avium
YAARSQRRAAEAWS

SEQ ID NO: 76996 - protein, 12 aa, Mycobacterium avium
YAASGTPDVGAN

SEQ ID NO: 76997 - protein, 8 aa, Mycobacterium avium
YADAPQRF

SEQ ID NO: 76998 - protein, 7 aa, Mycobacterium avium
YADETPR

SEQ ID NO: 76999 - protein, 5 aa, Mycobacterium avium
YADGS

SEQ ID NO: 77000 - protein, 6 aa, Mycobacterium avium
YADGTL

SEQ ID NO: 77001 - protein, 13 aa, Mycobacterium avium
YADPKNGKYPIDT

SEQ ID NO: 77002 - protein, 16 aa, Mycobacterium avium
YADRGEAFAAAVRAAI

SEQ ID NO: 77003 - protein, 11 aa, Mycobacterium avium
YAEAGSPDKPH

SEQ ID NO: 77004 - protein, 16 aa, Mycobacterium avium
YAEAPGRYHAKDGASL

SEQ ID NO: 77005 - protein, 9 aa, Mycobacterium avium
YAEGDDDEL

SEQ ID NO: 77006 - protein, 10 aa, Mycobacterium avium
YAEQSNNISR

SEQ ID NO: 77007 - protein, 13 aa, Mycobacterium avium
YAGAADGTGFSEG

SEQ ID NO: 77008 - protein, 14 aa, Mycobacterium avium
YAGAADGTGFSEGG

SEQ ID NO: 77009 - protein, 14 aa, Mycobacterium avium
YAGGDSKPRSPQDI

SEQ ID NO: 77010 - protein, 9 aa, Mycobacterium avium
YAGPGSGSL

SEQ ID NO: 77011 - protein, 10 aa, Mycobacterium avium
YAKEQGETDP

SEQ ID NO: 77012 - protein, 21 aa, Mycobacterium avium
YAKSTEHKHNPDRRHGDDGND

SEQ ID NO: 77013 - protein, 6 aa, Mycobacterium avium
YAPPRL

SEQ ID NO: 77014 - protein, 10 aa, Mycobacterium avium
YAPRSAERAR

SEQ ID NO: 77015 - protein, 21 aa, Mycobacterium avium
YAPSGGYKQSGLGRERGPDGI

SEQ ID NO: 77016 - protein, 9 aa, Mycobacterium avium
YAPSVGAAS

SEQ ID NO: 77017 - protein, 10 aa, Mycobacterium avium
YAPSVGAASG

SEQ ID NO: 77018 - protein, 8 aa, Mycobacterium avium
YAPVPGQA

SEQ ID NO: 77019 - protein, 13 aa, Mycobacterium avium
YAQPRSDGSGPSV

SEQ ID NO: 77020 - protein, 6 aa, Mycobacterium avium
YARGGA

SEQ ID NO: 77021 - protein, 5 aa, Mycobacterium avium
YARGT

SEQ ID NO: 77022 - protein, 15 aa, Mycobacterium avium
YASDGKGDGVADPQN

SEQ ID NO: 77023 - protein, 9 aa, Mycobacterium avium
YASRSAGRV

SEQ ID NO: 77024 - protein, 14 aa, Mycobacterium avium
YATEEDTAQGAASL

SEQ ID NO: 77025 - protein, 8 aa, Mycobacterium avium
YAVETGSG

SEQ ID NO: 77026 - protein, 4 aa, Mycobacterium avium
YDAA

SEQ ID NO: 77027 - protein, 12 aa, Mycobacterium avium
YDADTAVRRGRQ

SEQ ID NO: 77028 - protein, 8 aa, Mycobacterium avium
YDEDSTTM

SEQ ID NO: 77029 - protein, 7 aa, Mycobacterium avium
YDEGNAE

SEQ ID NO: 77030 - protein, 7 aa, Mycobacterium avium
YDEPKSI

SEQ ID NO: 77031 - protein, 8 aa, Mycobacterium avium
YDERNTVG

SEQ ID NO: 77032 - protein, 5 aa, Mycobacterium avium
YDGDA

SEQ ID NO: 77033 - protein, 15 aa, Mycobacterium avium
YDGGSIPVNTHGGQL

SEQ ID NO: 77034 - protein, 10 aa, Mycobacterium avium
YDGTGTSNTV

SEQ ID NO: 77035 - protein, 11 aa, Mycobacterium avium
YDPASPDDLSE

SEQ ID NO: 77036 - protein, 10 aa, Mycobacterium avium
YDPASPEDLS

SEQ ID NO: 77037 - protein, 11 aa, Mycobacterium avium
YDPASPEDLSE

SEQ ID NO: 77038 - protein, 5 aa, Mycobacterium avium
YDPDQ

SEQ ID NO: 77039 - protein, 6 aa, Mycobacterium avium
YDPDRH

SEQ ID NO: 77040 - protein, 18 aa, Mycobacterium avium
YDPERMKDEGFEYYGMGR

SEQ ID NO: 77041 - protein, 8 aa, Mycobacterium avium
YDRPREDR

SEQ ID NO: 77042 - protein, 9 aa, Mycobacterium avium
YDRQKIEDN

SEQ ID NO: 77043 - protein, 12 aa, Mycobacterium avium
YDSSDKGFDGAS

SEQ ID NO: 77044 - protein, 12 aa, Mycobacterium avium
YDTDGEGDPRPV

SEQ ID NO: 77045 - protein, 8 aa, Mycobacterium avium
YDTKKGRA

SEQ ID NO: 77046 - protein, 7 aa, Mycobacterium avium
YEDTGAY

SEQ ID NO: 77047 - protein, 7 aa, Mycobacterium avium
YEETGAY

SEQ ID NO: 77048 - protein, 9 aa, Mycobacterium avium
YEGLTTEQI

SEQ ID NO: 77049 - protein, 4 aa, Mycobacterium avium
YENQ

SEQ ID NO: 77050 - protein, 6 aa, Mycobacterium avium
YEPGQK

SEQ ID NO: 77051 - protein, 8 aa, Mycobacterium avium
YEPPQKAK

SEQ ID NO: 77052 - protein, 13 aa, Mycobacterium avium
YEPTDVTNEDEVA

SEQ ID NO: 77053 - protein, 7 aa, Mycobacterium avium
YERESTD

SEQ ID NO: 77054 - protein, 11 aa, Mycobacterium avium
YERPHDLPSAV

SEQ ID NO: 77055 - protein, 5 aa, Mycobacterium avium
YERRG

SEQ ID NO: 77056 - protein, 6 aa, Mycobacterium avium
YESAGA

SEQ ID NO: 77057 - protein, 7 aa, Mycobacterium avium
YESLPAH

SEQ ID NO: 77058 - protein, 21 aa, Mycobacterium avium
YESPDAPDRLADRDARDRRRR

SEQ ID NO: 77059 - protein, 10 aa, Mycobacterium avium
YESRTAPIEG

SEQ ID NO: 77060 - protein, 9 aa, Mycobacterium avium
YEVSNPDAV

SEQ ID NO: 77061 - protein, 8 aa, Mycobacterium avium
YFGGTGPI

SEQ ID NO: 77062 - protein, 4 aa, Mycobacterium avium
YGAS

SEQ ID NO: 77063 - protein, 10 aa, Mycobacterium avium
YGASGEHQSF

SEQ ID NO: 77064 - protein, 12 aa, Mycobacterium avium
YGASGPDADRAA

SEQ ID NO: 77065 - protein, 6 aa, Mycobacterium avium
YGATKG

SEQ ID NO: 77066 - protein, 11 aa, Mycobacterium avium
YGDEPTPTQEE

SEQ ID NO: 77067 - protein, 11 aa, Mycobacterium avium
YGDESGSTPLT

SEQ ID NO: 77068 - protein, 7 aa, Mycobacterium avium
YGDGAKP

SEQ ID NO: 77069 - protein, 5 aa, Mycobacterium avium
YGDNI

SEQ ID NO: 77070 - protein, 14 aa, Mycobacterium avium
YGDPAESADTAAEL

SEQ ID NO: 77071 - protein, 10 aa, Mycobacterium avium
YGDSTVGAAA

SEQ ID NO: 77072 - protein, 6 aa, Mycobacterium avium
YGDTEA

SEQ ID NO: 77073 - protein, 8 aa, Mycobacterium avium
YGGEAAPN

SEQ ID NO: 77074 - protein, 13 aa, Mycobacterium avium
YGGGEQPIPDLFL

SEQ ID NO: 77075 - protein, 6 aa, Mycobacterium avium
YGGGSM

SEQ ID NO: 77076 - protein, 6 aa, Mycobacterium avium
YGGREN

SEQ ID NO: 77077 - protein, 21 aa, Mycobacterium avium
YGGSPRRTPPSCRGCRFITTW

SEQ ID NO: 77078 - protein, 6 aa, Mycobacterium avium
YGGTDI

SEQ ID NO: 77079 - protein, 13 aa, Mycobacterium avium
YGGTGYPAGKGAV

SEQ ID NO: 77080 - protein, 15 aa, Mycobacterium avium
YGIGEATARRPAAAG

SEQ ID NO: 77081 - protein, 8 aa, Mycobacterium avium
YGKSAIPA

SEQ ID NO: 77082 - protein, 5 aa, Mycobacterium avium
YGNHP

SEQ ID NO: 77083 - protein, 11 aa, Mycobacterium avium
YGNPGASPGTV

SEQ ID NO: 77084 - protein, 19 aa, Mycobacterium avium
YGPASGQASRRLQRYLRLS

SEQ ID NO: 77085 - protein, 12 aa, Mycobacterium avium
YGPDSREQIDTA

SEQ ID NO: 77086 - protein, 11 aa, Mycobacterium avium
YGPDSREQINT

SEQ ID NO: 77087 - protein, 12 aa, Mycobacterium avium
YGPDSREQINTA

SEQ ID NO: 77088 - protein, 5 aa, Mycobacterium avium
YGPGF

SEQ ID NO: 77089 - protein, 7 aa, Mycobacterium avium
YGPGRDL

SEQ ID NO: 77090 - protein, 7 aa, Mycobacterium avium
YGPPKKV

SEQ ID NO: 77091 - protein, 7 aa, Mycobacterium avium
YGPQDPV

SEQ ID NO: 77092 - protein, 19 aa, Mycobacterium avium
YGPSSPTVGERGASTRSKI

SEQ ID NO: 77093 - protein, 4 aa, Mycobacterium avium
YGPV

SEQ ID NO: 77094 - protein, 5 aa, Mycobacterium avium
YGPVR

SEQ ID NO: 77095 - protein, 8 aa, Mycobacterium avium
YGQGASDS

SEQ ID NO: 77096 - protein, 5 aa, Mycobacterium avium
YGQSV

SEQ ID NO: 77097 - protein, 6 aa, Mycobacterium avium
YGQVPE

SEQ ID NO: 77098 - protein, 11 aa, Mycobacterium avium
YGRDKQSINDR

SEQ ID NO: 77099 - protein, 39 aa, Mycobacterium avium
YGRGVGQHGRRHPAARLGPGRRRPRRPGGPAPGRRSAAA

SEQ ID NO: 77100 - protein, 5 aa, Mycobacterium avium
YGRNT

SEQ ID NO: 77101 - protein, 8 aa, Mycobacterium avium
YGRPAPAE

SEQ ID NO: 77102 - protein, 11 aa, Mycobacterium avium
YGRRPGHSMPG

SEQ ID NO: 77103 - protein, 4 aa, Mycobacterium avium
YGRS

SEQ ID NO: 77104 - protein, 9 aa, Mycobacterium avium
YGRSGGPLR

SEQ ID NO: 77105 - protein, 10 aa, Mycobacterium avium
YGSAAAADAA

SEQ ID NO: 77106 - protein, 10 aa, Mycobacterium avium
YGSPETAERL

SEQ ID NO: 77107 - protein, 7 aa, Mycobacterium avium
YGSSRTR

SEQ ID NO: 77108 - protein, 5 aa, Mycobacterium avium
YGSTA

SEQ ID NO: 77109 - protein, 8 aa, Mycobacterium avium
YGSTEVGA

SEQ ID NO: 77110 - protein, 6 aa, Mycobacterium avium
YGTGTE

SEQ ID NO: 77111 - protein, 7 aa, Mycobacterium avium
YGTPEQR

SEQ ID NO: 77112 - protein, 15 aa, Mycobacterium avium
YGTPRRPSSSADYPE

SEQ ID NO: 77113 - protein, 9 aa, Mycobacterium avium
YGTTQVSER

SEQ ID NO: 77114 - protein, 7 aa, Mycobacterium avium
YGVPGGR

SEQ ID NO: 77115 - protein, 4 aa, Mycobacterium avium
YHDR

SEQ ID NO: 77116 - protein, 6 aa, Mycobacterium avium
YHPAGG

SEQ ID NO: 77117 - protein, 7 aa, Mycobacterium avium
YHPHGDA

SEQ ID NO: 77118 - protein, 6 aa, Mycobacterium avium
YHRGSE

SEQ ID NO: 77119 - protein, 9 aa, Mycobacterium avium
YKAGTALGE

SEQ ID NO: 77120 - protein, 10 aa, Mycobacterium avium
YKAKPGRSLE

SEQ ID NO: 77121 - protein, 10 aa, Mycobacterium avium
YKASARPALE

SEQ ID NO: 77122 - protein, 14 aa, Mycobacterium avium
YKGAANASAGRRGR

SEQ ID NO: 77123 - protein, 12 aa, Mycobacterium avium
YKRTPTGGSSVD

SEQ ID NO: 77124 - protein, 13 aa, Mycobacterium avium
YKRTPTGGSSVDS

SEQ ID NO: 77125 - protein, 13 aa, Mycobacterium avium
YKRTPTSGSSVDS

SEQ ID NO: 77126 - protein, 6 aa, Mycobacterium avium
YKSERG

SEQ ID NO: 77127 - protein, 19 aa, Mycobacterium avium
YLDPEAAAAGAAAVASQGG

SEQ ID NO: 77128 - protein, 7 aa, Mycobacterium avium
YLPGPSL

SEQ ID NO: 77129 - protein, 5 aa, Mycobacterium avium
YLPPS

SEQ ID NO: 77130 - protein, 7 aa, Mycobacterium avium
YNAAGGH

SEQ ID NO: 77131 - protein, 8 aa, Mycobacterium avium
YNDPDPDV

SEQ ID NO: 77132 - protein, 10 aa, Mycobacterium avium
YNEQEPGTVA

SEQ ID NO: 77133 - protein, 11 aa, Mycobacterium avium
YNIREDNARRA

SEQ ID NO: 77134 - protein, 10 aa, Mycobacterium avium
YNPERERTLP

SEQ ID NO: 77135 - protein, 4 aa, Mycobacterium avium
YNRS

SEQ ID NO: 77136 - protein, 7 aa, Mycobacterium avium
YPADDDY

SEQ ID NO: 77137 - protein, 4 aa, Mycobacterium avium
YPAN

SEQ ID NO: 77138 - protein, 8 aa, Mycobacterium avium
YPARGGAA

SEQ ID NO: 77139 - protein, 11 aa, Mycobacterium avium
YPATPSRPNRR

SEQ ID NO: 77140 - protein, 6 aa, Mycobacterium avium
YPDEQA

SEQ ID NO: 77141 - protein, 9 aa, Mycobacterium avium
YPDLNESRA

SEQ ID NO: 77142 - protein, 10 aa, Mycobacterium avium
YPDSAMAPEC

SEQ ID NO: 77143 - protein, 7 aa, Mycobacterium avium
YPDYPDR

SEQ ID NO: 77144 - protein, 4 aa, Mycobacterium avium
YPEF

SEQ ID NO: 77145 - protein, 10 aa, Mycobacterium avium
YPEGVPGPDR

SEQ ID NO: 77146 - protein, 14 aa, Mycobacterium avium
YPEPEAAAEPVAHG

SEQ ID NO: 77147 - protein, 14 aa, Mycobacterium avium
YPESAEPVATPSGV

SEQ ID NO: 77148 - protein, 10 aa, Mycobacterium avium
YPGAAPGLPA

SEQ ID NO: 77149 - protein, 10 aa, Mycobacterium avium
YPGGPPLGTS

SEQ ID NO: 77150 - protein, 6 aa, Mycobacterium avium
YPGHTS

SEQ ID NO: 77151 - protein, 6 aa, Mycobacterium avium
YPGKHT

SEQ ID NO: 77152 - protein, 5 aa, Mycobacterium avium
YPGLT

SEQ ID NO: 77153 - protein, 10 aa, Mycobacterium avium
YPGRRGMQSA

SEQ ID NO: 77154 - protein, 13 aa, Mycobacterium avium
YPGTAPPGPAPDD

SEQ ID NO: 77155 - protein, 6 aa, Mycobacterium avium
YPGYAG

SEQ ID NO: 77156 - protein, 5 aa, Mycobacterium avium
YPHAE

SEQ ID NO: 77157 - protein, 9 aa, Mycobacterium avium
YPHNDTNWP

SEQ ID NO: 77158 - protein, 11 aa, Mycobacterium avium
YPHPEGLAEPA

SEQ ID NO: 77159 - protein, 26 aa, Mycobacterium avium
YPHPEGTWPQSATQAAPQFDGVPDEE

SEQ ID NO: 77160 - protein, 8 aa, Mycobacterium avium
YPHSDSTW

SEQ ID NO: 77161 - protein, 6 aa, Mycobacterium avium
YPLATP

SEQ ID NO: 77162 - protein, 5 aa, Mycobacterium avium
YPLPE

SEQ ID NO: 77163 - protein, 7 aa, Mycobacterium avium
YPLPPSD

SEQ ID NO: 77164 - protein, 5 aa, Mycobacterium avium
YPNNT

SEQ ID NO: 77165 - protein, 9 aa, Mycobacterium avium
YPPDKQPEA

SEQ ID NO: 77166 - protein, 8 aa, Mycobacterium avium
YPPGTAAK

SEQ ID NO: 77167 - protein, 10 aa, Mycobacterium avium
YPPQAITSRN

SEQ ID NO: 77168 - protein, 7 aa, Mycobacterium avium
YPPRTDD

SEQ ID NO: 77169 - protein, 7 aa, Mycobacterium avium
YPPRTED

SEQ ID NO: 77170 - protein, 32 aa, Mycobacterium avium
YPPTTSVRARSEGPAHDLGPSVAKNSAGGAAA

SEQ ID NO: 77171 - protein, 20 aa, Mycobacterium avium
YPPYAEYPTKTARQIPVFVL

SEQ ID NO: 77172 - protein, 9 aa, Mycobacterium avium
YPQQRNPAR

SEQ ID NO: 77173 - protein, 4 aa, Mycobacterium avium
YPRP

SEQ ID NO: 77174 - protein, 7 aa, Mycobacterium avium
YPRQAPA

SEQ ID NO: 77175 - protein, 6 aa, Mycobacterium avium
YPSGEG

SEQ ID NO: 77176 - protein, 12 aa, Mycobacterium avium
YPSGTAKDVEDT

SEQ ID NO: 77177 - protein, 21 aa, Mycobacterium avium
YPSRRRRRDPSRAGPFATFVA

SEQ ID NO: 77178 - protein, 13 aa, Mycobacterium avium
YPTHPPSAAGAAM

SEQ ID NO: 77179 - protein, 10 aa, Mycobacterium avium
YPTKSDTRDS

SEQ ID NO: 77180 - protein, 6 aa, Mycobacterium avium
YPTNEE

SEQ ID NO: 77181 - protein, 6 aa, Mycobacterium avium
YPTSPW

SEQ ID NO: 77182 - protein, 7 aa, Mycobacterium avium
YQATTEA

SEQ ID NO: 77183 - protein, 6 aa, Mycobacterium avium
YQGERN

SEQ ID NO: 77184 - protein, 4 aa, Mycobacterium avium
YQGT

SEQ ID NO: 77185 - protein, 12 aa, Mycobacterium avium
YQPDPAEPTQAT

SEQ ID NO: 77186 - protein, 7 aa, Mycobacterium avium
YQPSAAE

SEQ ID NO: 77187 - protein, 12 aa, Mycobacterium avium
YQSKRSGARPCR

SEQ ID NO: 77188 - protein, 7 aa, Mycobacterium avium
YQSPAPR

SEQ ID NO: 77189 - protein, 8 aa, Mycobacterium avium
YQTEREPH

SEQ ID NO: 77190 - protein, 6 aa, Mycobacterium avium
YRAGRE

SEQ ID NO: 77191 - protein, 10 aa, Mycobacterium avium
YRAPESPTEE

SEQ ID NO: 77192 - protein, 11 aa, Mycobacterium avium
YRAPSNAVEET

SEQ ID NO: 77193 - protein, 17 aa, Mycobacterium avium
YRAPTPPQPEWIVGHQK

SEQ ID NO: 77194 - protein, 7 aa, Mycobacterium avium
YRDAGGA

SEQ ID NO: 77195 - protein, 5 aa, Mycobacterium avium
YRDEA

SEQ ID NO: 77196 - protein, 15 aa, Mycobacterium avium
YRDETGSKVHTPEQM

SEQ ID NO: 77197 - protein, 12 aa, Mycobacterium avium
YREGEQTIAQEH

SEQ ID NO: 77198 - protein, 9 aa, Mycobacterium avium
YRETGGETG

SEQ ID NO: 77199 - protein, 14 aa, Mycobacterium avium
YRGGEAKTDAKDAR

SEQ ID NO: 77200 - protein, 22 aa, Mycobacterium avium
YRGQHQAGAGVQPGPGPGQRGL

SEQ ID NO: 77201 - protein, 10 aa, Mycobacterium avium
YRGRRGITRG

SEQ ID NO: 77202 - protein, 5 aa, Mycobacterium avium
YRGST

SEQ ID NO: 77203 - protein, 10 aa, Mycobacterium avium
YRHGGKDGAH

SEQ ID NO: 77204 - protein, 5 aa, Mycobacterium avium
YRKGN

SEQ ID NO: 77205 - protein, 8 aa, Mycobacterium avium
YRQADGAS

SEQ ID NO: 77206 - protein, 6 aa, Mycobacterium avium
YRREGK

SEQ ID NO: 77207 - protein, 7 aa, Mycobacterium avium
YRSRQAA

SEQ ID NO: 77208 - protein, 55 aa, Mycobacterium avium
YRTDSRESGKKPAGSTNGSSSSDSSSSTSDSSGSSAKSGSGEKAVSSPAPAAAAA

SEQ ID NO: 77209 - protein, 8 aa, Mycobacterium avium
YRTENGEE

SEQ ID NO: 77210 - protein, 16 aa, Mycobacterium avium
YRTGRDDETGAIADDR

SEQ ID NO: 77211 - protein, 7 aa, Mycobacterium avium
YRTKDDR

SEQ ID NO: 77212 - protein, 12 aa, Mycobacterium avium
YRTPRPNPRRGG

SEQ ID NO: 77213 - protein, 5 aa, Mycobacterium avium
YSAGD

SEQ ID NO: 77214 - protein, 24 aa, Mycobacterium avium
YSAGHHPGRAAPSCCPTSPTGDPA

SEQ ID NO: 77215 - protein, 14 aa, Mycobacterium avium
YSDPPGLAPLPEEE

SEQ ID NO: 77216 - protein, 14 aa, Mycobacterium avium
YSDPPGVAPLPEEE

SEQ ID NO: 77217 - protein, 23 aa, Mycobacterium avium
YSDSSTAVTRDLGNGHSENDLRP

SEQ ID NO: 77218 - protein, 20 aa, Mycobacterium avium
YSEEAPRGEMSPVKDHQART

SEQ ID NO: 77219 - protein, 5 aa, Mycobacterium avium
YSETL

SEQ ID NO: 77220 - protein, 4 aa, Mycobacterium avium
YSGA

SEQ ID NO: 77221 - protein, 5 aa, Mycobacterium avium
YSGAL

SEQ ID NO: 77222 - protein, 8 aa, Mycobacterium avium
YSGEGATD

SEQ ID NO: 77223 - protein, 7 aa, Mycobacterium avium
YSGGEQK

SEQ ID NO: 77224 - protein, 5 aa, Mycobacterium avium
YSGTQ

SEQ ID NO: 77225 - protein, 9 aa, Mycobacterium avium
YSHDSTEGV

SEQ ID NO: 77226 - protein, 10 aa, Mycobacterium avium
YSKPGKRGGT

SEQ ID NO: 77227 - protein, 14 aa, Mycobacterium avium
YSNRDDMSGAPADF

SEQ ID NO: 77228 - protein, 4 aa, Mycobacterium avium
YSPE

SEQ ID NO: 77229 - protein, 9 aa, Mycobacterium avium
YSPPGSPVS

SEQ ID NO: 77230 - protein, 12 aa, Mycobacterium avium
YSPQSWSTIPGG

SEQ ID NO: 77231 - protein, 12 aa, Mycobacterium avium
YSPSADGQQGWS

SEQ ID NO: 77232 - protein, 7 aa, Mycobacterium avium
YSPSPPM

SEQ ID NO: 77233 - protein, 9 aa, Mycobacterium avium
YSRTAGPKI

SEQ ID NO: 77234 - protein, 8 aa, Mycobacterium avium
YSRTAGPR

SEQ ID NO: 77235 - protein, 8 aa, Mycobacterium avium
YSSDSYTD

SEQ ID NO: 77236 - protein, 8 aa, Mycobacterium avium
YSTATADV

SEQ ID NO: 77237 - protein, 21 aa, Mycobacterium avium
YTANEADSADKMSAIGRQPAR

SEQ ID NO: 77238 - protein, 9 aa, Mycobacterium avium
YTASGLSRN

SEQ ID NO: 77239 - protein, 21 aa, Mycobacterium avium
YTGLPGDPVGPPGAEPPARIP

SEQ ID NO: 77240 - protein, 14 aa, Mycobacterium avium
YTGNSDVFTSQAAE

SEQ ID NO: 77241 - protein, 5 aa, Mycobacterium avium
YTGPA

SEQ ID NO: 77242 - protein, 9 aa, Mycobacterium avium
YTGTGAQAQ

SEQ ID NO: 77243 - protein, 9 aa, Mycobacterium avium
YTGVDGDAQ

SEQ ID NO: 77244 - protein, 13 aa, Mycobacterium avium
YTKAARDSVAEDR

SEQ ID NO: 77245 - protein, 11 aa, Mycobacterium avium
YTPPVPATGAG

SEQ ID NO: 77246 - protein, 5 aa, Mycobacterium avium
YTPSA

SEQ ID NO: 77247 - protein, 5 aa, Mycobacterium avium
YTQQR

SEQ ID NO: 77248 - protein, 16 aa, Mycobacterium avium
YTRGPVEEQSDTITSH

SEQ ID NO: 77249 - protein, 5 aa, Mycobacterium avium
YTTRS

SEQ ID NO: 77250 - protein, 24 aa, Mycobacterium avium
YVPPSSIGAARKRRSRTVLPVTSR

SEQ ID NO: 77251 - protein, 12 aa, Mycobacterium avium
YVRAGDPNRRTG

SEQ ID NO: 77252 - protein, 5 aa, Mycobacterium avium
YVTTT

SEQ ID NO: 77253 - protein, 8 aa, Mycobacterium avium
YYRPDDEK

SEQ ID NO: 77254 - protein, 17 aa, Mycobacterium avium
TYCKARVNHRVVSQAVV

SEQ ID NO: 77255 - protein, 25 aa, Mycobacterium avium
RLNKEIKRRTDVVGVFPNPAALLRL

SEQ ID NO: 77256 - protein, 24 aa, Mycobacterium avium
TAFADFPVAHWKKIWSTNPLERLN

SEQ ID NO: 77257 - protein, 27 aa, Mycobacterium avium
LELRIPKLRTGSFFPALLERRRRVDQC

SEQ ID NO: 77258 - protein, 25 aa, Mycobacterium avium
PLGDQRFPYVFLDATYCKARVNHRV

SEQ ID NO: 77259 - protein, 17 aa, Mycobacterium avium
HAGLRSAIDAVLIGAAW

SEQ ID NO: 77260 - protein, 18 aa, Mycobacterium avium
LKSRGLAGVQLVISDAHA

SEQ ID NO: 77261 - protein, 32 aa, Mycobacterium avium
RSAIDAVLIGAAWQRCRVHFLRNVLAQVPKGS

SEQ ID NO: 77262 - protein, 19 aa, Mycobacterium avium
AEIILSMPGFGVILGAEFL

SEQ ID NO: 77263 - protein, 17 aa, Mycobacterium avium
DSGRISGNLKRPRRYDR

SEQ ID NO: 77264 - protein, 22 aa, Mycobacterium avium
FDYNKSRAALILLTGYQTPDAL

SEQ ID NO: 77265 - protein, 19 aa, Mycobacterium avium
RHRHAEIILSMPGFGVILG

SEQ ID NO: 77266 - protein, 22 aa, Mycobacterium avium
RMRAQLLEYFPALERAFDYNKS

SEQ ID NO: 77267 - protein, 27 aa, Mycobacterium avium
VLALARRRLNVLWAMLRDHAVYHPATT

SEQ ID NO: 77268 - protein, 25 aa, Mycobacterium avium
SAIEAILIGASWQRCRVHFLRNVLA

SEQ ID NO: 77269 - protein, 21 aa, Mycobacterium avium
SEQHFPYVFLDATYCKARVNH

SEQ ID NO: 77270 - protein, 25 aa, Mycobacterium avium
TAFADFPVLHWKKIWSTNPLERLNK

SEQ ID NO: 77271 - protein, 27 aa, Mycobacterium avium
LELRIPKLRSGSFFPALLERRRRVDQC

SEQ ID NO: 77272 - protein, 20 aa, Mycobacterium avium
ACGPHHRLLQPGAWTTHKNA

SEQ ID NO: 77273 - protein, 20 aa, Mycobacterium avium
LWKAARRAGHDIGRDQIARL

SEQ ID NO: 77274 - protein, 22 aa, Mycobacterium avium
ALEAAFDYSTRAPLILVSAMCT

SEQ ID NO: 77275 - protein, 20 aa, Mycobacterium avium
GRLASFAGLVPVPRDSGRIT

SEQ ID NO: 77276 - protein, 17 aa, Mycobacterium avium
GVIKHLRKNRAWPNNID

SEQ ID NO: 77277 - protein, 24 aa, Mycobacterium avium
IIESMPGMGPHLGAEFLVITGGNM

SEQ ID NO: 77278 - protein, 26 aa, Mycobacterium avium
LLALARRHVDVLWALLRDNRTWQPQQ

SEQ ID NO: 77279 - protein, 18 aa, Mycobacterium avium
LMADWVRGVNRLRSMLTA

SEQ ID NO: 77280 - protein, 21 aa, Mycobacterium avium
RPEQLAALAGTLADCLNPDGL

SEQ ID NO: 77281 - protein, 18 aa, Mycobacterium avium
TNPGRLASFAGLVPVPRD

SEQ ID NO: 77282 - protein, 21 aa, Mycobacterium avium
YNRRLRRVFYLAALSSLKIEG

SEQ ID NO: 77283 - protein, 19 aa, Mycobacterium avium
AKGETEWIPPPHLDRNQPR

SEQ ID NO: 77284 - protein, 17 aa, Mycobacterium avium
ARKLWKAARRAGHDIGR

SEQ ID NO: 77285 - protein, 25 aa, Mycobacterium avium
ARWSRGKMLAGLRCHSDAGSQFTSI

SEQ ID NO: 77286 - protein, 21 aa, Mycobacterium avium
EQEKLCLLVMIGVRSDGRKEL

SEQ ID NO: 77287 - protein, 25 aa, Mycobacterium avium
ERRRFSSAILPAWARKSPQMTEVLP

SEQ ID NO: 77288 - protein, 18 aa, Mycobacterium avium
FCHQLPGWIDQATRERAE

SEQ ID NO: 77289 - protein, 21 aa, Mycobacterium avium
GDGALGFWKAMREVFPATREQ

SEQ ID NO: 77290 - protein, 18 aa, Mycobacterium avium
LIYGPARPGPWKTVEDVE

SEQ ID NO: 77291 - protein, 19 aa, Mycobacterium avium
LMREAGIAGVRRGKRVRTT

SEQ ID NO: 77292 - protein, 17 aa, Mycobacterium avium
LTAAGAVTVIAPRVNDK

SEQ ID NO: 77293 - protein, 22 aa, Mycobacterium avium
PGSRAAGIAMAYKLIDAAQARW

SEQ ID NO: 77294 - protein, 25 aa, Mycobacterium avium
PQMTEVLPLLYLHGLSTSDFGPALE

SEQ ID NO: 77295 - protein, 37 aa, Mycobacterium avium
VPTWAGVAYVCFLTDAFSRMIIGWRVASHMRTTVVLD

SEQ ID NO: 77296 - protein, 23 aa, Mycobacterium avium
YRYPAEHWIHLRTTNPIESTFAT

SEQ ID NO: 77297 - protein, 21 aa, Mycobacterium avium
AGDFWGGAGSVACQEFITQLG

SEQ ID NO: 77298 - protein, 24 aa, Mycobacterium avium
APRAAEAVALLALIAGQDVEPVEG

SEQ ID NO: 77299 - protein, 22 aa, Mycobacterium avium
CAEFPRWLHTYNHHRGHTALGG

SEQ ID NO: 77300 - protein, 21 aa, Mycobacterium avium
EKPCRACKVITEAITSAGTLG

SEQ ID NO: 77301 - protein, 20 aa, Mycobacterium avium
IRRVRREVPGAAAVIEAHCS

SEQ ID NO: 77302 - protein, 21 aa, Mycobacterium avium
PGAGPGRFGVWHRGRPGGTGR

SEQ ID NO: 77303 - protein, 25 aa, Mycobacterium avium
SQWRSHLRKILSLMPVGVPVHDRHA

SEQ ID NO: 77304 - protein, 24 aa, Mycobacterium avium
SVACQEFITQLGRNFQVIYEQANA

SEQ ID NO: 77305 - protein, 33 aa, Mycobacterium avium
AGYERRSLAIASHWPFEQWGRFLPEHTTAASIL

SEQ ID NO: 77306 - protein, 17 aa, Mycobacterium avium
ATFDYLSSLEWIRAQQN

SEQ ID NO: 77307 - protein, 25 aa, Mycobacterium avium
AVHAGFKVRYFTAADLIEVLYRGLA

SEQ ID NO: 77308 - protein, 24 aa, Mycobacterium avium
DAALRRLKLATVRRNAAEVLQVAK

SEQ ID NO: 77309 - protein, 17 aa, Mycobacterium avium
FDYLSSLEWIRAQQNLA

SEQ ID NO: 77310 - protein, 18 aa, Mycobacterium avium
RVASHMRTSMVLDALEMA

SEQ ID NO: 77311 - protein, 21 aa, Mycobacterium avium
SHLLIGCGHAAVHAGFKVRYF

SEQ ID NO: 77312 - protein, 18 aa, Mycobacterium avium
TALLKERLLLTVHVDPFT

SEQ ID NO: 77313 - protein, 23 aa, Mycobacterium avium
VPTWAGVAYVCFIIDAHSRMIVG

SEQ ID NO: 77314 - protein, 17 aa, Mycobacterium avium
CPKKFVATNVANNTRFA

SEQ ID NO: 77315 - protein, 23 aa, Mycobacterium avium
DGELLRFWIGDQLVKTAARTNHA

SEQ ID NO: 77316 - protein, 18 aa, Mycobacterium avium
ERYFRDAPLMIVGEGTNE

SEQ ID NO: 77317 - protein, 23 aa, Mycobacterium avium
ETAAEFWTRANAWFAECGISVRK

SEQ ID NO: 77318 - protein, 23 aa, Mycobacterium avium
EWKAKSPGAVAVWDRSWAEFVPF

SEQ ID NO: 77319 - protein, 27 aa, Mycobacterium avium
FCAVLAYSRWRFVRFAADEKASTTLAM

SEQ ID NO: 77320 - protein, 17 aa, Mycobacterium avium
GALVAWKTGCSPGNAET

SEQ ID NO: 77321 - protein, 23 aa, Mycobacterium avium
GERPRRAGVSSFGISGTNAHVII

SEQ ID NO: 77322 - protein, 23 aa, Mycobacterium avium
GKIPAGGGWRMLGRAIGGHNSNA

SEQ ID NO: 77323 - protein, 23 aa, Mycobacterium avium
GVIKMVLAMRHELLPATLHVDEP

SEQ ID NO: 77324 - protein, 25 aa, Mycobacterium avium
IDPSLPSARIEFMLTDAAPAAVLTS

SEQ ID NO: 77325 - protein, 27 aa, Mycobacterium avium
KDRGCSHPGCDVSGYYCEVHHVTGYAK

SEQ ID NO: 77326 - protein, 25 aa, Mycobacterium avium
LAGLPESIAAVWPQAVIQTCVVHLL

SEQ ID NO: 77327 - protein, 18 aa, Mycobacterium avium
LFASEVAMEIALNAVRIH

SEQ ID NO: 77328 - protein, 19 aa, Mycobacterium avium
LKSRGLAGVQLVISDAHAG

SEQ ID NO: 77329 - protein, 26 aa, Mycobacterium avium
LRRAVAFRRFRAADVRSILAAGAGTP

SEQ ID NO: 77330 - protein, 24 aa, Mycobacterium avium
NLKTAQQALDEWVHYYNTARPHQS

SEQ ID NO: 77331 - protein, 24 aa, Mycobacterium avium
PDYVRFASHYGFVPDFCHGADPQS

SEQ ID NO: 77332 - protein, 19 aa, Mycobacterium avium
PGKVWGQCHSLAFDFSVWE

SEQ ID NO: 77333 - protein, 25 aa, Mycobacterium avium
PVPVAYHTFGGWKRSGFGDLNQHGP

SEQ ID NO: 77334 - protein, 26 aa, Mycobacterium avium
PVRLAELFVEAGLPPGVFQVVHGDKE

SEQ ID NO: 77335 - protein, 22 aa, Mycobacterium avium
RMGCLKGGVVANVVVPTPDYVR

SEQ ID NO: 77336 - protein, 17 aa, Mycobacterium avium
RNLDAFTDLVATRVEKS

SEQ ID NO: 77337 - protein, 18 aa, Mycobacterium avium
RTLIEDLNIAWAQHHSGQ

SEQ ID NO: 77338 - protein, 20 aa, Mycobacterium avium
SAGRVPDWVPLPVQYVDYTL

SEQ ID NO: 77339 - protein, 19 aa, Mycobacterium avium
SEVAMEIALNAVRIHGGYG

SEQ ID NO: 77340 - protein, 26 aa, Mycobacterium avium
SVRRKVDGLSCIRYGSARYSVPQRLV

SEQ ID NO: 77341 - protein, 20 aa, Mycobacterium avium
TGARSLGALVAWKTGCSPGN

SEQ ID NO: 77342 - protein, 25 aa, Mycobacterium avium
TRLKSELDILLGLGAAHGEQALIDA

SEQ ID NO: 77343 - protein, 22 aa, Mycobacterium avium
WAEAAPGLMVFCAVLAYSRWRF

SEQ ID NO: 77344 - protein, 27 aa, Mycobacterium avium
WDRSWAEFVPFLAFPVEIRKIIYTTNA

SEQ ID NO: 77345 - protein, 26 aa, Mycobacterium avium
WKAGPALACGNAFVLKPSERDPSVPV

SEQ ID NO: 77346 - protein, 17 aa, Mycobacterium avium
WLRPVPAGVTGELYIAG

SEQ ID NO: 77347 - protein, 23 aa, Mycobacterium avium
AAAAAGIPIRIGVNAGSLDKRFM

SEQ ID NO: 77348 - protein, 24 aa, Mycobacterium avium
AAAAELRQPIWLVTRGAQRVTDAD

SEQ ID NO: 77349 - protein, 19 aa, Mycobacterium avium
AAADAVVWSGGSTVAEHHD

SEQ ID NO: 77350 - protein, 17 aa, Mycobacterium avium
AAADLIALLADEGVADF

SEQ ID NO: 77351 - protein, 19 aa, Mycobacterium avium
AAAEAEYGQMWAQDAAAMF

SEQ ID NO: 77352 - protein, 26 aa, Mycobacterium avium
AAAELGEQCAFGLALIAPRLPPFDVP

SEQ ID NO: 77353 - protein, 23 aa, Mycobacterium avium
AAAEMPAGVVLVVVHSGGGRAKA

SEQ ID NO: 77354 - protein, 22 aa, Mycobacterium avium
AAAERAVGCGVAPDRVLIDPTH

SEQ ID NO: 77355 - protein, 23 aa, Mycobacterium avium
AAAGRISYRLGLQGPAVAVDTAC

SEQ ID NO: 77356 - protein, 19 aa, Mycobacterium avium
AAAIMAIVADFERYPEWSD

SEQ ID NO: 77357 - protein, 23 aa, Mycobacterium avium
AAAKAAILASIAFHTRVTADDVY

SEQ ID NO: 77358 - protein, 18 aa, Mycobacterium avium
AAALALGAQGAWTGSQWL

SEQ ID NO: 77359 - protein, 27 aa, Mycobacterium avium
AAALTARLAFDWAQLKPGDRVLIHAAS

SEQ ID NO: 77360 - protein, 24 aa, Mycobacterium avium
AAANRLPFLPIRAGLGSSVPDFWE

SEQ ID NO: 77361 - protein, 31 aa, Mycobacterium avium
AAANSWLDAFARWRHARGAPATAIAWGAWSQ

SEQ ID NO: 77362 - protein, 32 aa, Mycobacterium avium
AAANSWLDAFTRWRRARGLKATAIAWGAWAQI

SEQ ID NO: 77363 - protein, 17 aa, Mycobacterium avium
AAARAAYIAGFAASSNL

SEQ ID NO: 77364 - protein, 18 aa, Mycobacterium avium
AAARDRGADRLSIADTIG

SEQ ID NO: 77365 - protein, 23 aa, Mycobacterium avium
AAARRLSALPVVAAVGKYDATLA

SEQ ID NO: 77366 - protein, 34 aa, Mycobacterium avium
AAATLAWHALCWGIIIPAGWWRSGDTALYRYLWR

SEQ ID NO: 77367 - protein, 17 aa, Mycobacterium avium
AAATNWLASAHQAVQQY

SEQ ID NO: 77368 - protein, 19 aa, Mycobacterium avium
AAATSRRVAAEAGVKQALV

SEQ ID NO: 77369 - protein, 18 aa, Mycobacterium avium
AAAWEFRQGEVLWTAMPL

SEQ ID NO: 77370 - protein, 24 aa, Mycobacterium avium
AADAITEWLERVAVQAGGQGAPLP

SEQ ID NO: 77371 - protein, 29 aa, Mycobacterium avium
AADALALAICHCWRAPMIARMARAEALAA

SEQ ID NO: 77372 - protein, 24 aa, Mycobacterium avium
AADDPRFCDVLPLIQNADAAAELI

SEQ ID NO: 77373 - protein, 23 aa, Mycobacterium avium
AADLPWPAAGDWLAAVRASPLLG

SEQ ID NO: 77374 - protein, 28 aa, Mycobacterium avium
AADMYVSLELARSMSLYAAMSIADGNID

SEQ ID NO: 77375 - protein, 17 aa, Mycobacterium avium
AADYGDWANAAHSAAFD

SEQ ID NO: 77376 - protein, 25 aa, Mycobacterium avium
AAEAKEVIEAGGLYVLGTERHESRR

SEQ ID NO: 77377 - protein, 30 aa, Mycobacterium avium
AAEALGEGWFWPAAAAHPSLPRGALLQVAI

SEQ ID NO: 77378 - protein, 25 aa, Mycobacterium avium
AAEALRWAMMRGEPLVVLADALAEA

SEQ ID NO: 77379 - protein, 20 aa, Mycobacterium avium
AAECVRRGYTRLSWAVLNWN

SEQ ID NO: 77380 - protein, 25 aa, Mycobacterium avium
AAEDPRVAGLIARVQLAPSPSAAVQ

SEQ ID NO: 77381 - protein, 20 aa, Mycobacterium avium
AAEHKPDVVILDLGLPDISG

SEQ ID NO: 77382 - protein, 24 aa, Mycobacterium avium
AAEIAEGWQPIFYLPEKARDVWGE

SEQ ID NO: 77383 - protein, 23 aa, Mycobacterium avium
AAEMRTRHAAVRFGDRSQTARLE

SEQ ID NO: 77384 - protein, 18 aa, Mycobacterium avium
AAERGLQPYGWATIISPR

SEQ ID NO: 77385 - protein, 23 aa, Mycobacterium avium
AAERLASCGAREVIVTNTLPIGE

SEQ ID NO: 77386 - protein, 21 aa, Mycobacterium avium
AAETMTFPLFVKAVAGGGGRG

SEQ ID NO: 77387 - protein, 26 aa, Mycobacterium avium
AAEVIPRLLAERGPNDPIRVWSAGCA

SEQ ID NO: 77388 - protein, 24 aa, Mycobacterium avium
AAFHFRLTVTAGEHRMVIEPIDVM

SEQ ID NO: 77389 - protein, 26 aa, Mycobacterium avium
AAFHWWLVLATLRWGVICRYQAERHL

SEQ ID NO: 77390 - protein, 18 aa, Mycobacterium avium
AAFPRLNDVIAYCDQYPL

SEQ ID NO: 77391 - protein, 18 aa, Mycobacterium avium
AAFRAEYGARGWAMNTLF

SEQ ID NO: 77392 - protein, 17 aa, Mycobacterium avium
AAFVRRRRAEVFGTEPG

SEQ ID NO: 77393 - protein, 19 aa, Mycobacterium avium
AAFVTRGLRHDKLSWDAWR

SEQ ID NO: 77394 - protein, 21 aa, Mycobacterium avium
AAFYERLRELFAQKKSITTFG

SEQ ID NO: 77395 - protein, 23 aa, Mycobacterium avium
AAGAIPVLAIYGIPHRDCGSFAA

SEQ ID NO: 77396 - protein, 24 aa, Mycobacterium avium
AAGEPAPPMPVARGLGMGFDPPVV

SEQ ID NO: 77397 - protein, 19 aa, Mycobacterium avium
AAGGIPVRIYRPTTDSGVA

SEQ ID NO: 77398 - protein, 19 aa, Mycobacterium avium
AAGGKCFYTTPLKALSNQK

SEQ ID NO: 77399 - protein, 24 aa, Mycobacterium avium
AAGHPFAATGGRILAQAAKQVAQR

SEQ ID NO: 77400 - protein, 24 aa, Mycobacterium avium
AAGLRSLLAYQWAHPGKQLLFMGQ

SEQ ID NO: 77401 - protein, 17 aa, Mycobacterium avium
AAGLRVGLAPALLAGNV

SEQ ID NO: 77402 - protein, 21 aa, Mycobacterium avium
AAGLTRSFMAFLIDAYVEDEA

SEQ ID NO: 77403 - protein, 19 aa, Mycobacterium avium
AAGLYRFSLLDIIDIGDIN

SEQ ID NO: 77404 - protein, 25 aa, Mycobacterium avium
AAGMGRAQLVGSLSVPQGWANAATI

SEQ ID NO: 77405 - protein, 17 aa, Mycobacterium avium
AAGTLIRLFHSETVTTD

SEQ ID NO: 77406 - protein, 18 aa, Mycobacterium avium
AAGTPSAMLDRLALDTKR

SEQ ID NO: 77407 - protein, 18 aa, Mycobacterium avium
AAGVALLLIDSRERHTHA

SEQ ID NO: 77408 - protein, 27 aa, Mycobacterium avium
AAGVARPDLVIGWWAAPTILEHGTPEQ

SEQ ID NO: 77409 - protein, 19 aa, Mycobacterium avium
AAGWGWLPLATGVAVVDTV

SEQ ID NO: 77410 - protein, 23 aa, Mycobacterium avium
AAHATELPYVWGTLGAPKDPTLK

SEQ ID NO: 77411 - protein, 18 aa, Mycobacterium avium
AAHESRVSVFAMIETAAA

SEQ ID NO: 77412 - protein, 24 aa, Mycobacterium avium
AAHLVHPGDLVILIAYGTMEEAEA

SEQ ID NO: 77413 - protein, 19 aa, Mycobacterium avium
AAHRQLRYFWPRVVGDTGW

SEQ ID NO: 77414 - protein, 25 aa, Mycobacterium avium
AAHRRAHGLPAISLGWGLWDQASAM

SEQ ID NO: 77415 - protein, 21 aa, Mycobacterium avium
AAIGELFAYRLSRCSECEDWA

SEQ ID NO: 77416 - protein, 25 aa, Mycobacterium avium
AAILRYCSQHRIAVVPFGGGTSVVG

SEQ ID NO: 77417 - protein, 19 aa, Mycobacterium avium
AAKDMLRRGLVEGTAGNIS

SEQ ID NO: 77418 - protein, 24 aa, Mycobacterium avium
AAKELAYLGVRVNAIAPGLIRSAM

SEQ ID NO: 77419 - protein, 19 aa, Mycobacterium avium
AAKLPGVRIVVAGGPSGTG

SEQ ID NO: 77420 - protein, 18 aa, Mycobacterium avium
AAKSETLAALAAGADLLV

SEQ ID NO: 77421 - protein, 27 aa, Mycobacterium avium
AALAMELGCDAVLLATAVTRAGDPAAM

SEQ ID NO: 77422 - protein, 17 aa, Mycobacterium avium
AALAPLRRSLVVTAITG

SEQ ID NO: 77423 - protein, 18 aa, Mycobacterium avium
AALARLEAHIVLRRLLER

SEQ ID NO: 77424 - protein, 26 aa, Mycobacterium avium
AALASRARKAPGFALLGEPGETRELT

SEQ ID NO: 77425 - protein, 25 aa, Mycobacterium avium
AALDEGRIVLVAGFQGVSQDTRDVT

SEQ ID NO: 77426 - protein, 25 aa, Mycobacterium avium
AALDELRARIAPLQQLWTSEAATAY

SEQ ID NO: 77427 - protein, 19 aa, Mycobacterium avium
AALDHFRVAMAAAGWSSNV

SEQ ID NO: 77428 - protein, 18 aa, Mycobacterium avium
AALDHPLLVERPEPKRAG

SEQ ID NO: 77429 - protein, 24 aa, Mycobacterium avium
AALDIPILQGLCLTTPRAQWLQND

SEQ ID NO: 77430 - protein, 22 aa, Mycobacterium avium
AALDRFGPPAGEAAWVVKDDRL

SEQ ID NO: 77431 - protein, 22 aa, Mycobacterium avium
AALEGLVDRFGLAGERLGVVVG

SEQ ID NO: 77432 - protein, 18 aa, Mycobacterium avium
AALGAPGIDLFRKLVQDY

SEQ ID NO: 77433 - protein, 29 aa, Mycobacterium avium
AALHGPLCPEAEVAPCPAARGVTATQYAA

SEQ ID NO: 77434 - protein, 23 aa, Mycobacterium avium
AALICARAGLKVQVVEAQPTFGG

SEQ ID NO: 77435 - protein, 17 aa, Mycobacterium avium
AALPYLKATGGRIVTCA

SEQ ID NO: 77436 - protein, 25 aa, Mycobacterium avium
AALQLGWRWLPRRLTLEPLAYNRYQ

SEQ ID NO: 77437 - protein, 21 aa, Mycobacterium avium
AALQRRLGTTTVYVTHDQVEA

SEQ ID NO: 77438 - protein, 20 aa, Mycobacterium avium
AALRAGRPPVVGRLEGGRCL

SEQ ID NO: 77439 - protein, 20 aa, Mycobacterium avium
AALRHARGFGRPVIVHVVTR

SEQ ID NO: 77440 - protein, 20 aa, Mycobacterium avium
AALRQWRRIGGRSGGLYTGH

SEQ ID NO: 77441 - protein, 19 aa, Mycobacterium avium
AALRVLAPLGLVFDENSPW

SEQ ID NO: 77442 - protein, 19 aa, Mycobacterium avium
AALSRPGFDALVRETAEPA

SEQ ID NO: 77443 - protein, 17 aa, Mycobacterium avium
AALTRAIHKLPIKARIV

SEQ ID NO: 77444 - protein, 24 aa, Mycobacterium avium
AALTRLAARCPVAVLSGRDLADVT

SEQ ID NO: 77445 - protein, 17 aa, Mycobacterium avium
AALWKAAGIKSPIDEID

SEQ ID NO: 77446 - protein, 24 aa, Mycobacterium avium
AAMDYKAGELLPVEIPEQSSNGIQ

SEQ ID NO: 77447 - protein, 31 aa, Mycobacterium avium
AAMTGWQRLHFRFGIPAPLLEPLAVERLYLD

SEQ ID NO: 77448 - protein, 17 aa, Mycobacterium avium
AANLAVLLHDWRQRTGD

SEQ ID NO: 77449 - protein, 25 aa, Mycobacterium avium
AANLGWKLAAVVSGRAGDKLLDTYD

SEQ ID NO: 77450 - protein, 24 aa, Mycobacterium avium
AANRIANTVAVSFVQERERIIRQQ

SEQ ID NO: 77451 - protein, 26 aa, Mycobacterium avium
AAPASDSAGFKWLAPYTGSAIAQHWM

SEQ ID NO: 77452 - protein, 17 aa, Mycobacterium avium
AAPDRTALVSGLLRELG

SEQ ID NO: 77453 - protein, 19 aa, Mycobacterium avium
AAPIGAFGFDSPLPPGVDQ

SEQ ID NO: 77454 - protein, 28 aa, Mycobacterium avium
AAPMPLPLLHRALSTWPGTKFVQVYGQT

SEQ ID NO: 77455 - protein, 18 aa, Mycobacterium avium
AAPPRFDPAIWPVTAHPD

SEQ ID NO: 77456 - protein, 20 aa, Mycobacterium avium
AAPVDGRGGGKADLAQGSGK

SEQ ID NO: 77457 - protein, 26 aa, Mycobacterium avium
AAQHSWPTVAAWVKWLSTGGDKPTGI

SEQ ID NO: 77458 - protein, 30 aa, Mycobacterium avium
AAQQCDIAWPRPRVLCTVRLARRVLSREEA

SEQ ID NO: 77459 - protein, 23 aa, Mycobacterium avium
AAQRADIAIVFAVRAEGEGFDLA

SEQ ID NO: 77460 - protein, 25 aa, Mycobacterium avium
AAQRAGIELLAFGGRFVEIGKRDIY

SEQ ID NO: 77461 - protein, 23 aa, Mycobacterium avium
AAQRAVIIGAGFIGCEVAASLRS

SEQ ID NO: 77462 - protein, 22 aa, Mycobacterium avium
AAQRRDMMWICRDGDRAKNHLL

SEQ ID NO: 77463 - protein, 22 aa, Mycobacterium avium
AAQSWDLVRDGIFTGYQLDRVF

SEQ ID NO: 77464 - protein, 19 aa, Mycobacterium avium
AAQTFKAKALAAASGVDGA

SEQ ID NO: 77465 - protein, 23 aa, Mycobacterium avium
AARAKASFESGVWSQLPGRERAK

SEQ ID NO: 77466 - protein, 21 aa, Mycobacterium avium
AARFSRHGLAFQEVSAQAAQL

SEQ ID NO: 77467 - protein, 24 aa, Mycobacterium avium
AARHRIKPLFVFFDSCWDPQPRAG

SEQ ID NO: 77468 - protein, 24 aa, Mycobacterium avium
AARIDVPVLLGYGVVDVSPDPRAE

SEQ ID NO: 77469 - protein, 19 aa, Mycobacterium avium
AARILLRSGKPVFLAANKV

SEQ ID NO: 77470 - protein, 20 aa, Mycobacterium avium
AARKLWGLRGYTEVGTPEIA

SEQ ID NO: 77471 - protein, 20 aa, Mycobacterium avium
AARRHGFRISLSPAPFAGDV

SEQ ID NO: 77472 - protein, 23 aa, Mycobacterium avium
AARTRPVRIAPRMAIAAKALDTF

SEQ ID NO: 77473 - protein, 29 aa, Mycobacterium avium
AARVIVRLVAEHRWRVGVVAQSHATVENL

SEQ ID NO: 77474 - protein, 18 aa, Mycobacterium avium
AASARWRPWRSYATQYLW

SEQ ID NO: 77475 - protein, 18 aa, Mycobacterium avium
AASGLSFGAPTPAESELA

SEQ ID NO: 77476 - protein, 19 aa, Mycobacterium avium
AASIGGLSVPASWASAAPT

SEQ ID NO: 77477 - protein, 24 aa, Mycobacterium avium
AASRAFIAQSVWRRMGDEFLAETA

SEQ ID NO: 77478 - protein, 21 aa, Mycobacterium avium
AASTSRWLVAVRMVSEGVDVP

SEQ ID NO: 77479 - protein, 18 aa, Mycobacterium avium
AATEFTLQAWSGGIIGLG

SEQ ID NO: 77480 - protein, 23 aa, Mycobacterium avium
AATMKRLFLELGGKSATIVLEDA

SEQ ID NO: 77481 - protein, 18 aa, Mycobacterium avium
AATWGIAAAMTRGDISVT

SEQ ID NO: 77482 - protein, 18 aa, Mycobacterium avium
AATYMKLYACASPADQHY

SEQ ID NO: 77483 - protein, 24 aa, Mycobacterium avium
AATYRWPMVPALALTAAMPVLGAA

SEQ ID NO: 77484 - protein, 18 aa, Mycobacterium avium
AAVAAEFGVPMHSDAVQA

SEQ ID NO: 77485 - protein, 18 aa, Mycobacterium avium
AAVLAAQDRLRFAAGNFY

SEQ ID NO: 77486 - protein, 18 aa, Mycobacterium avium
AAVLAHRGAHVVLAVRDL

SEQ ID NO: 77487 - protein, 26 aa, Mycobacterium avium
AAVLLRECVEFFAPYLAAARLTGEVR

SEQ ID NO: 77488 - protein, 21 aa, Mycobacterium avium
AAVNFPDVLFIAGKYQVKIPP

SEQ ID NO: 77489 - protein, 24 aa, Mycobacterium avium
AAVPHPIDPILLGRTVLNLLRTPV

SEQ ID NO: 77490 - protein, 24 aa, Mycobacterium avium
AAVRAELPQRCVIDGEIVIATDHG

SEQ ID NO: 77491 - protein, 23 aa, Mycobacterium avium
AAVRDPGCLAVAALIDTYRVSAT

SEQ ID NO: 77492 - protein, 20 aa, Mycobacterium avium
AAVRRFGRMFVLGARLTVPL

SEQ ID NO: 77493 - protein, 19 aa, Mycobacterium avium
AAVTGLPAPLAHPGLVCDV

SEQ ID NO: 77494 - protein, 34 aa, Mycobacterium avium
AAVTSRRLASRAGLKPQLVHYYFRTMEELFLEVF

SEQ ID NO: 77495 - protein, 23 aa, Mycobacterium avium
AAWFAGEILDRFSLGDHVGHLLA

SEQ ID NO: 77496 - protein, 26 aa, Mycobacterium avium
AAYLAGFAWGLSRDYSVLVEMDADGS

SEQ ID NO: 77497 - protein, 18 aa, Mycobacterium avium
ACALVGRPELVFLDEPTA

SEQ ID NO: 77498 - protein, 17 aa, Mycobacterium avium
ACPEHTEKVTLWKLMDV

SEQ ID NO: 77499 - protein, 18 aa, Mycobacterium avium
ACTPEALRALGIRESAEA

SEQ ID NO: 77500 - protein, 20 aa, Mycobacterium avium
ACVRAGGALLAIEHDDPVPT

SEQ ID NO: 77501 - protein, 21 aa, Mycobacterium avium
ACVSACPVGAIAPDNRLDDKQ

SEQ ID NO: 77502 - protein, 19 aa, Mycobacterium avium
ADAAARYLAARGGISAVFA

SEQ ID NO: 77503 - protein, 20 aa, Mycobacterium avium
ADAAMLWSLGLGEPHPISAM

SEQ ID NO: 77504 - protein, 17 aa, Mycobacterium avium
ADAARPRGIPVIVLAGQ

SEQ ID NO: 77505 - protein, 27 aa, Mycobacterium avium
ADAARRCARSVLDLHVVDGRLRRASLG

SEQ ID NO: 77506 - protein, 24 aa, Mycobacterium avium
ADAAWRAAFDHEQTCVAIIKHANP

SEQ ID NO: 77507 - protein, 20 aa, Mycobacterium avium
ADADKVWLGIALHTTPGVPE

SEQ ID NO: 77508 - protein, 19 aa, Mycobacterium avium
ADAGIPVTVVPGVTSAIGV

SEQ ID NO: 77509 - protein, 19 aa, Mycobacterium avium
ADALAGLLRAPAPAAAAMS

SEQ ID NO: 77510 - protein, 20 aa, Mycobacterium avium
ADALLPMLREHAAGADLVVG

SEQ ID NO: 77511 - protein, 17 aa, Mycobacterium avium
ADALLVRSATTVDAEVL

SEQ ID NO: 77512 - protein, 18 aa, Mycobacterium avium
ADALRAGLVTEVVPHDQL

SEQ ID NO: 77513 - protein, 22 aa, Mycobacterium avium
ADALRVGQVLSRILLECTAAGL

SEQ ID NO: 77514 - protein, 18 aa, Mycobacterium avium
ADALRWRASTLDLAKERA

SEQ ID NO: 77515 - protein, 24 aa, Mycobacterium avium
ADALTRTRVHGVRTNRDLLVNVLR

SEQ ID NO: 77516 - protein, 20 aa, Mycobacterium avium
ADATELLIELGLEPAQNRVH

SEQ ID NO: 77517 - protein, 23 aa, Mycobacterium avium
ADAVVRPRLKIVESILQSAVQDG

SEQ ID NO: 77518 - protein, 24 aa, Mycobacterium avium
ADCPRGCGHMGPPADPECALDTLT

SEQ ID NO: 77519 - protein, 18 aa, Mycobacterium avium
ADDMMLYKYIVKNTAWQN

SEQ ID NO: 77520 - protein, 24 aa, Mycobacterium avium
ADDPRRRLAAAMAKASAGECQSLA

SEQ ID NO: 77521 - protein, 20 aa, Mycobacterium avium
ADDRDVFSLDEMVAAFDVVD

SEQ ID NO: 77522 - protein, 18 aa, Mycobacterium avium
ADELVRVCRPGGRIGLIS

SEQ ID NO: 77523 - protein, 21 aa, Mycobacterium avium
ADEPVEFARRLALAVAAEVAA

SEQ ID NO: 77524 - protein, 25 aa, Mycobacterium avium
ADERLRAGAPLSEVLDYLGIPQSAR

SEQ ID NO: 77525 - protein, 19 aa, Mycobacterium avium
ADEVVCLSTPPGFEAVGQV

SEQ ID NO: 77526 - protein, 17 aa, Mycobacterium avium
ADFKRLVTDWQLKDGAP

SEQ ID NO: 77527 - protein, 24 aa, Mycobacterium avium
ADFLRRQAPELLPAALGGAQSGPA

SEQ ID NO: 77528 - protein, 24 aa, Mycobacterium avium
ADGAAFHRLCFGLAAGGVGNRFYD

SEQ ID NO: 77529 - protein, 23 aa, Mycobacterium avium
ADGDPPALIPFSGPARKVLELTV

SEQ ID NO: 77530 - protein, 20 aa, Mycobacterium avium
ADGGLACWATALLHARLVSA

SEQ ID NO: 77531 - protein, 19 aa, Mycobacterium avium
ADGKLPDIYIAMGQTAENV

SEQ ID NO: 77532 - protein, 18 aa, Mycobacterium avium
ADGLLVMPFNSARHFAER

SEQ ID NO: 77533 - protein, 23 aa, Mycobacterium avium
ADGRPPVIQMWARPRGVAPDALF

SEQ ID NO: 77534 - protein, 18 aa, Mycobacterium avium
ADGTEAPANMILDDGGDA

SEQ ID NO: 77535 - protein, 20 aa, Mycobacterium avium
ADGTLSWSSTTLVLAEVAAG

SEQ ID NO: 77536 - protein, 19 aa, Mycobacterium avium
ADGVMRWLEEHDRGVAMDG

SEQ ID NO: 77537 - protein, 24 aa, Mycobacterium avium
ADHERVPVPPGWGGYLIAADVVEF

SEQ ID NO: 77538 - protein, 31 aa, Mycobacterium avium
ADHVFSRLAIPSWMARTGFQMLDPLKTAKAR

SEQ ID NO: 77539 - protein, 17 aa, Mycobacterium avium
ADIAAFVGADPDELVFT

SEQ ID NO: 77540 - protein, 23 aa, Mycobacterium avium
ADIRARGYGAWRFDDTHRSLHNR

SEQ ID NO: 77541 - protein, 17 aa, Mycobacterium avium
ADIRESIHLRALGRQNP

SEQ ID NO: 77542 - protein, 17 aa, Mycobacterium avium
ADKGFGFLSQEDGEDVY

SEQ ID NO: 77543 - protein, 23 aa, Mycobacterium avium
ADKRTRALLAREFIDHGRPVIEV

SEQ ID NO: 77544 - protein, 19 aa, Mycobacterium avium
ADLARFGRDGIVAMSSQEA

SEQ ID NO: 77545 - protein, 28 aa, Mycobacterium avium
ADLARRGRHRPVWIKGFGEHIAFKTPTY

SEQ ID NO: 77546 - protein, 26 aa, Mycobacterium avium
ADLEHWRWMWETNVIGTLRVTRALLP

SEQ ID NO: 77547 - protein, 20 aa, Mycobacterium avium
ADLFLGVPFNIASYALLTHM

SEQ ID NO: 77548 - protein, 17 aa, Mycobacterium avium
ADLGVTCSIFVDQIHYW

SEQ ID NO: 77549 - protein, 23 aa, Mycobacterium avium
ADLKSIMDRGWLHPGSIVVADNI

SEQ ID NO: 77550 - protein, 21 aa, Mycobacterium avium
ADLPLPAPITVVGGGLTGIET

SEQ ID NO: 77551 - protein, 20 aa, Mycobacterium avium
ADLVKEFTFDYPSRIIAGLL

SEQ ID NO: 77552 - protein, 22 aa, Mycobacterium avium
ADMLGRAGALLVDVAIDTVPRG

SEQ ID NO: 77553 - protein, 24 aa, Mycobacterium avium
ADMSWEDFDWLMGINVGGVVNGTK

SEQ ID NO: 77554 - protein, 20 aa, Mycobacterium avium
ADNFMSCWTMGLNQSTHGTW

SEQ ID NO: 77555 - protein, 24 aa, Mycobacterium avium
ADPEVVRALDMLLILHADHEQNCS

SEQ ID NO: 77556 - protein, 17 aa, Mycobacterium avium
ADPEYPAAAILGNYLPR

SEQ ID NO: 77557 - protein, 19 aa, Mycobacterium avium
ADPGLAVVVPGELAGAAPR

SEQ ID NO: 77558 - protein, 24 aa, Mycobacterium avium
ADPHLAFVPLPWPDYYGKAPKARL

SEQ ID NO: 77559 - protein, 20 aa, Mycobacterium avium
ADPLPMLTLFDKQVTLRMGQ

SEQ ID NO: 77560 - protein, 23 aa, Mycobacterium avium
ADPTWSDRCYFFAAAPDGTMLLA

SEQ ID NO: 77561 - protein, 28 aa, Mycobacterium avium
ADQARTIRIPVHMVEVINKLGRIQRELL

SEQ ID NO: 77562 - protein, 23 aa, Mycobacterium avium
ADQKIRQAAPFLSYGPFTGNAPR

SEQ ID NO: 77563 - protein, 20 aa, Mycobacterium avium
ADRAALHLADPAAVPGDANA

SEQ ID NO: 77564 - protein, 25 aa, Mycobacterium avium
ADRMPVLYCKTGVRSAQALAVVRQA

SEQ ID NO: 77565 - protein, 19 aa, Mycobacterium avium
ADRPEVRHRIAFLPDYDMS

SEQ ID NO: 77566 - protein, 17 aa, Mycobacterium avium
ADRVRFAGPVGGDELPR

SEQ ID NO: 77567 - protein, 23 aa, Mycobacterium avium
ADSDEVLACFVLDPRLQRSSGPR

SEQ ID NO: 77568 - protein, 31 aa, Mycobacterium avium
ADSIVIGGGMCFTFLAAQGFSVGKSLLETEM

SEQ ID NO: 77569 - protein, 21 aa, Mycobacterium avium
ADSSRGALLIHGHLDVVPAEP

SEQ ID NO: 77570 - protein, 24 aa, Mycobacterium avium
ADTAELLARFAGLRTCTNRLGRAA

SEQ ID NO: 77571 - protein, 25 aa, Mycobacterium avium
ADTAGKPSLGWRGRRAAERLSERVS

SEQ ID NO: 77572 - protein, 25 aa, Mycobacterium avium
ADTALRAGALGARMTGGGFGGCVIA

SEQ ID NO: 77573 - protein, 19 aa, Mycobacterium avium
ADTIEFCAAEVPKFNAISV

SEQ ID NO: 77574 - protein, 29 aa, Mycobacterium avium
ADVALIVGVPMDFRLGFGAVFGPHTRLIV

SEQ ID NO: 77575 - protein, 22 aa, Mycobacterium avium
ADVEASGLWPGKVVTEVSPAGD

SEQ ID NO: 77576 - protein, 18 aa, Mycobacterium avium
ADVNLHLVLGAWRILGAV

SEQ ID NO: 77577 - protein, 20 aa, Mycobacterium avium
ADVRPELVSFTFGVPPPDVI

SEQ ID NO: 77578 - protein, 22 aa, Mycobacterium avium
ADVSLPVVRAFVTRIKERAKGA

SEQ ID NO: 77579 - protein, 19 aa, Mycobacterium avium
ADVSVGLLYKYFGGKQDLL

SEQ ID NO: 77580 - protein, 26 aa, Mycobacterium avium
ADWAEMLMRMYIRWAEQHKYPVEVFD

SEQ ID NO: 77581 - protein, 24 aa, Mycobacterium avium
ADYGDGWCPFPAPPQLARTAGTAV

SEQ ID NO: 77582 - protein, 17 aa, Mycobacterium avium
AEAAARFGLGLRVTADV

SEQ ID NO: 77583 - protein, 20 aa, Mycobacterium avium
AEAEIACGRAFSVITELESL

SEQ ID NO: 77584 - protein, 21 aa, Mycobacterium avium
AEAGISLLYAFDADCRAAEVE

SEQ ID NO: 77585 - protein, 26 aa, Mycobacterium avium
AEAIRAAQIAKVYCARAARTVCETAI

SEQ ID NO: 77586 - protein, 27 aa, Mycobacterium avium
AEAIRWAGALAGYGLRWFEEPGDPLDY

SEQ ID NO: 77587 - protein, 21 aa, Mycobacterium avium
AEAKVPWVLMHWRSVSAERPH

SEQ ID NO: 77588 - protein, 18 aa, Mycobacterium avium
AEALECLGGNGYVEDSGM

SEQ ID NO: 77589 - protein, 21 aa, Mycobacterium avium
AEALRGAVVSPVITAHPTETR

SEQ ID NO: 77590 - protein, 21 aa, Mycobacterium avium
AEALRGFPQRCYVLPDEPLLS

SEQ ID NO: 77591 - protein, 17 aa, Mycobacterium avium
AEALYLTSGYVYESAAV

SEQ ID NO: 77592 - protein, 18 aa, Mycobacterium avium
AEAQAAIDEARRAAEREC

SEQ ID NO: 77593 - protein, 21 aa, Mycobacterium avium
AEAQPLLRPVLRPQSYANRLV

SEQ ID NO: 77594 - protein, 21 aa, Mycobacterium avium
AEDAVALGFAGTVCIHPSQVP

SEQ ID NO: 77595 - protein, 18 aa, Mycobacterium avium
AEDLDLFRRLSLDLISIP

SEQ ID NO: 77596 - protein, 17 aa, Mycobacterium avium
AEDLHWIDPDRSPEQLA

SEQ ID NO: 77597 - protein, 20 aa, Mycobacterium avium
AEDPARGWQPQAGVVHAFAV

SEQ ID NO: 77598 - protein, 21 aa, Mycobacterium avium
AEEFGELALPVALDVTDRDQI

SEQ ID NO: 77599 - protein, 23 aa, Mycobacterium avium
AEEGRALYDTALRYLDGGTGVEI

SEQ ID NO: 77600 - protein, 24 aa, Mycobacterium avium
AEEGVEPWPKCGAQSGLPIGWYSH

SEQ ID NO: 77601 - protein, 18 aa, Mycobacterium avium
AEESARLFVSDEAREGML

SEQ ID NO: 77602 - protein, 25 aa, Mycobacterium avium
AEFADRVADGWIKAQAYRLQTFGTV

SEQ ID NO: 77603 - protein, 24 aa, Mycobacterium avium
AEFSRTGFTGGLNWYRNFDRNWET

SEQ ID NO: 77604 - protein, 24 aa, Mycobacterium avium
AEGELYFPGSPVLSVTGTFAECVV

SEQ ID NO: 77605 - protein, 19 aa, Mycobacterium avium
AEGGDTFFGEPKLDPNDLL

SEQ ID NO: 77606 - protein, 26 aa, Mycobacterium avium
AEGHARVAPVYLYRFDYSTPLLRLLM

SEQ ID NO: 77607 - protein, 22 aa, Mycobacterium avium
AEGHKWAMLTAYDYSTARIFDE

SEQ ID NO: 77608 - protein, 26 aa, Mycobacterium avium
AEGISVNVTLIFSVERYRAVMDAYLA

SEQ ID NO: 77609 - protein, 23 aa, Mycobacterium avium
AEGLLPAITFVFSRAGCDAAVQQ

SEQ ID NO: 77610 - protein, 23 aa, Mycobacterium avium
AEGLPRRPGVYLFRGPSGEVLYI

SEQ ID NO: 77611 - protein, 18 aa, Mycobacterium avium
AEGLPYRSVLGLADLGLG

SEQ ID NO: 77612 - protein, 25 aa, Mycobacterium avium
AEGLPYRWPHPWLVDPKTASEQIGV

SEQ ID NO: 77613 - protein, 21 aa, Mycobacterium avium
AEGYLALFITHDGFWKSFAAE

SEQ ID NO: 77614 - protein, 20 aa, Mycobacterium avium
AEHDWLRSGATPVPGRTMGK

SEQ ID NO: 77615 - protein, 24 aa, Mycobacterium avium
AEHGDRFLLGIGVSHAPLIDAGQP

SEQ ID NO: 77616 - protein, 17 aa, Mycobacterium avium
AEHGYNTYCVGKWHLTP

SEQ ID NO: 77617 - protein, 18 aa, Mycobacterium avium
AEHLHVHVVPRWGGDANF

SEQ ID NO: 77618 - protein, 24 aa, Mycobacterium avium
AEHPSSGVAFVLGERLGRVDVTEL

SEQ ID NO: 77619 - protein, 21 aa, Mycobacterium avium
AEIAACKILASQVLKSIALRA

SEQ ID NO: 77620 - protein, 24 aa, Mycobacterium avium
AEIDEFAMPVAPWMFGAAGREHMR

SEQ ID NO: 77621 - protein, 22 aa, Mycobacterium avium
AEIDMRCLLIVGSSQTQWYSDD

SEQ ID NO: 77622 - protein, 24 aa, Mycobacterium avium
AEIGKRPALLHVRDTVLRGVAVRG

SEQ ID NO: 77623 - protein, 17 aa, Mycobacterium avium
AEIGRIPVDSIYSPVLK

SEQ ID NO: 77624 - protein, 17 aa, Mycobacterium avium
AEIIGELEAAVAEAPLR

SEQ ID NO: 77625 - protein, 28 aa, Mycobacterium avium
AEISCGPYRFVYRKRFHKKCETELTVIT

SEQ ID NO: 77626 - protein, 26 aa, Mycobacterium avium
AEKIGPALEDWAKWGQARHDYFLRAA

SEQ ID NO: 77627 - protein, 17 aa, Mycobacterium avium
AELARLAGRLDDATARR

SEQ ID NO: 77628 - protein, 18 aa, Mycobacterium avium
AELARLDLGSVLIPMPEA

SEQ ID NO: 77629 - protein, 24 aa, Mycobacterium avium
AELIAAKWGFSRTQLDEFSAASHE

SEQ ID NO: 77630 - protein, 18 aa, Mycobacterium avium
AELKRIWTDAAHRRRGYA

SEQ ID NO: 77631 - protein, 20 aa, Mycobacterium avium
AELMLRKATWLYDNGKPCGR

SEQ ID NO: 77632 - protein, 22 aa, Mycobacterium avium
AELMPPERVVLITTGTQGEPMS

SEQ ID NO: 77633 - protein, 17 aa, Mycobacterium avium
AELQWSLARTDHLDADT

SEQ ID NO: 77634 - protein, 17 aa, Mycobacterium avium
AELTAQFLATAASGDVE

SEQ ID NO: 77635 - protein, 17 aa, Mycobacterium avium
AELTMLILGRDRMKHPE

SEQ ID NO: 77636 - protein, 18 aa, Mycobacterium avium
AELTWQLRGTADKRQVEN

SEQ ID NO: 77637 - protein, 26 aa, Mycobacterium avium
AELVARVKALLRRRGATATSSSETIT

SEQ ID NO: 77638 - protein, 18 aa, Mycobacterium avium
AELVEHLTALCWDGGAAL

SEQ ID NO: 77639 - protein, 25 aa, Mycobacterium avium
AEMEREGLQIPLLIGGATTSRAHTA

SEQ ID NO: 77640 - protein, 25 aa, Mycobacterium avium
AEMFKSERIVAAPVTFVDIAGLVKG

SEQ ID NO: 77641 - protein, 17 aa, Mycobacterium avium
AEMLRRNGIPCDEVRKH

SEQ ID NO: 77642 - protein, 23 aa, Mycobacterium avium
AEMQRRFTADWTLLAAGPERELD

SEQ ID NO: 77643 - protein, 19 aa, Mycobacterium avium
AENILGYTIGNDVSARDQQ

SEQ ID NO: 77644 - protein, 24 aa, Mycobacterium avium
AEPDLKPRMQGMVDYMAARTAFFD

SEQ ID NO: 77645 - protein, 22 aa, Mycobacterium avium
AEPITALGHWVHVYVDRDTRKP

SEQ ID NO: 77646 - protein, 26 aa, Mycobacterium avium
AEPLPRSLVWSAAWEMTREAELRARD

SEQ ID NO: 77647 - protein, 20 aa, Mycobacterium avium
AEPTGVAAWQLAKLNLAKMT

SEQ ID NO: 77648 - protein, 21 aa, Mycobacterium avium
AEPYLPLRAVRHLEKGRVVIF

SEQ ID NO: 77649 - protein, 21 aa, Mycobacterium avium
AEQRVALDLLLDESVGIVSLG

SEQ ID NO: 77650 - protein, 23 aa, Mycobacterium avium
AERAKRIRFGTGVISLSYHNPLW

SEQ ID NO: 77651 - protein, 24 aa, Mycobacterium avium
AERFADAVTAIWQGRLEVDRFNEL

SEQ ID NO: 77652 - protein, 18 aa, Mycobacterium avium
AERFGVGLGETYGRNSDE

SEQ ID NO: 77653 - protein, 25 aa, Mycobacterium avium
AERFLAEGVERVFITGRRQRELEDA

SEQ ID NO: 77654 - protein, 28 aa, Mycobacterium avium
AERRAEPWFDPAGLFLAFGDDDSDRPGR

SEQ ID NO: 77655 - protein, 20 aa, Mycobacterium avium
AERRGNVMVITINRPEARNA

SEQ ID NO: 77656 - protein, 20 aa, Mycobacterium avium
AESCTAGLLAARLTDRPGSS

SEQ ID NO: 77657 - protein, 21 aa, Mycobacterium avium
AESIRKFRILPVDFTEDTGEL

SEQ ID NO: 77658 - protein, 17 aa, Mycobacterium avium
AESKAAIGQTVELALDT

SEQ ID NO: 77659 - protein, 22 aa, Mycobacterium avium
AESMARLLIVTRDRFHVYRHHQ

SEQ ID NO: 77660 - protein, 22 aa, Mycobacterium avium
AESREVSTFVLFLASDESSYAT

SEQ ID NO: 77661 - protein, 27 aa, Mycobacterium avium
AETAARLRAVATWLRTMFAIVPLAVGN

SEQ ID NO: 77662 - protein, 20 aa, Mycobacterium avium
AETAELLYGTALLAEGGALD

SEQ ID NO: 77663 - protein, 28 aa, Mycobacterium avium
AETERAMGFCLFNNISIGARHAQRKHGL

SEQ ID NO: 77664 - protein, 24 aa, Mycobacterium avium
AETIAVAPSTLWSLTVDPQRPGSL

SEQ ID NO: 77665 - protein, 33 aa, Mycobacterium avium
AETVLHEMAHMWFGDLVTMAWWDDLWLNESFAT

SEQ ID NO: 77666 - protein, 21 aa, Mycobacterium avium
AEVAESYAALTAEHGDRFLLG

SEQ ID NO: 77667 - protein, 21 aa, Mycobacterium avium
AEVALLKILALQFIMSDPRHQ

SEQ ID NO: 77668 - protein, 28 aa, Mycobacterium avium
AEVCHRRGKPLILDEAWGAHLPFHEDLP

SEQ ID NO: 77669 - protein, 22 aa, Mycobacterium avium
AEVDARLRLVVGRRGGLADQES

SEQ ID NO: 77670 - protein, 24 aa, Mycobacterium avium
AEVKKAAAEHGLWYPPDPSSFEIC

SEQ ID NO: 77671 - protein, 18 aa, Mycobacterium avium
AEVKRKGVLIGDTVMIRK

SEQ ID NO: 77672 - protein, 25 aa, Mycobacterium avium
AEVLGNWTGIPVFKLTEAETTRLLR

SEQ ID NO: 77673 - protein, 23 aa, Mycobacterium avium
AEVMPEDLIKFGLIPEFIGRLPV

SEQ ID NO: 77674 - protein, 18 aa, Mycobacterium avium
AEVNRPRIAELLQPDRVA

SEQ ID NO: 77675 - protein, 18 aa, Mycobacterium avium
AEVYLDLVRQVPYFTDVN

SEQ ID NO: 77676 - protein, 24 aa, Mycobacterium avium
AEYFTVPLSNIWGTTLDIVDRTGS

SEQ ID NO: 77677 - protein, 22 aa, Mycobacterium avium
AFAADYGLCLARTNWDVPKHEG

SEQ ID NO: 77678 - protein, 17 aa, Mycobacterium avium
AFADVPAGWRVVHGEAD

SEQ ID NO: 77679 - protein, 18 aa, Mycobacterium avium
AFAGMKLLEIHTTEEQKN

SEQ ID NO: 77680 - protein, 23 aa, Mycobacterium avium
AFAGPRFLMRIAELEMHPLDTRD

SEQ ID NO: 77681 - protein, 19 aa, Mycobacterium avium
AFARALALEVDRDGISVHL

SEQ ID NO: 77682 - protein, 30 aa, Mycobacterium avium
AFASGMAATDCALRAVLRPGDHVVIPNDAY

SEQ ID NO: 77683 - protein, 24 aa, Mycobacterium avium
AFATMACLYPGRIFLGVGTGEALN

SEQ ID NO: 77684 - protein, 26 aa, Mycobacterium avium
AFDAFKKERWPAFWDWAYKSLPNDSR

SEQ ID NO: 77685 - protein, 25 aa, Mycobacterium avium
AFDFRVMTPTAWWRVPMQSLVAGLP

SEQ ID NO: 77686 - protein, 18 aa, Mycobacterium avium
AFDIFALLPPPGDAGLGR

SEQ ID NO: 77687 - protein, 17 aa, Mycobacterium avium
AFDNGPWPTTPPKERAA

SEQ ID NO: 77688 - protein, 17 aa, Mycobacterium avium
AFEGKWDGYRLLVEADH

SEQ ID NO: 77689 - protein, 19 aa, Mycobacterium avium
AFEHGRWRVGTSNGQTFAA

SEQ ID NO: 77690 - protein, 24 aa, Mycobacterium avium
AFEKRWELGGVLFSKTFADQMIDP

SEQ ID NO: 77691 - protein, 17 aa, Mycobacterium avium
AFGELFVRHQRHLHRLA

SEQ ID NO: 77692 - protein, 18 aa, Mycobacterium avium
AFGSLGLTNIAIWADPAR

SEQ ID NO: 77693 - protein, 23 aa, Mycobacterium avium
AFHYLDPRGGYVNDRGWMVFDSV

SEQ ID NO: 77694 - protein, 17 aa, Mycobacterium avium
AFIELRRLLAVHETAEE

SEQ ID NO: 77695 - protein, 25 aa, Mycobacterium avium
AFLRGLPADGWLRIIATCTEIGHDW

SEQ ID NO: 77696 - protein, 18 aa, Mycobacterium avium
AFNAYKMAVICLIGAMLV

SEQ ID NO: 77697 - protein, 23 aa, Mycobacterium avium
AFPTEVPTGVGFMKRAGLVTDGR

SEQ ID NO: 77698 - protein, 25 aa, Mycobacterium avium
AFPTPSGRAVFFARPHLQPEEMPDD

SEQ ID NO: 77699 - protein, 25 aa, Mycobacterium avium
AFQQARSRFDAAWNHQDGDHPINDS

SEQ ID NO: 77700 - protein, 26 aa, Mycobacterium avium
AFRQRYWARNHVGWRHMDDTLPNAGH

SEQ ID NO: 77701 - protein, 20 aa, Mycobacterium avium
AFTCFGRQGLQKATIVDIAK

SEQ ID NO: 77702 - protein, 25 aa, Mycobacterium avium
AFTHSLALEYARRGLRAVCVAPGSI

SEQ ID NO: 77703 - protein, 22 aa, Mycobacterium avium
AFTLPELIGLTGSREVVLSAAD

SEQ ID NO: 77704 - protein, 18 aa, Mycobacterium avium
AFVESGRAVALGVVAVGV

SEQ ID NO: 77705 - protein, 21 aa, Mycobacterium avium
AGAALARKAADEFSTPDKPRY

SEQ ID NO: 77706 - protein, 23 aa, Mycobacterium avium
AGADCGRCRRTVQAILRSSSGNR

SEQ ID NO: 77707 - protein, 23 aa, Mycobacterium avium
AGADRSFAFLTIFNKNRPGGTVV

SEQ ID NO: 77708 - protein, 25 aa, Mycobacterium avium
AGAPPRPSVGYLIYGIGRHASDELR

SEQ ID NO: 77709 - protein, 19 aa, Mycobacterium avium
AGAPTRCTVRHSWMARVPA

SEQ ID NO: 77710 - protein, 25 aa, Mycobacterium avium
AGAQRFAIGLAEVMAATAAGDYPAA

SEQ ID NO: 77711 - protein, 26 aa, Mycobacterium avium
AGARDFQRFLIGKLRDIRAVVLNASL

SEQ ID NO: 77712 - protein, 18 aa, Mycobacterium avium
AGARLRAATELAHAGDLS

SEQ ID NO: 77713 - protein, 17 aa, Mycobacterium avium
AGATLRCGGKPLDGPGW

SEQ ID NO: 77714 - protein, 33 aa, Mycobacterium avium
AGAVEGWMPFGRVFETLSWGRRHVVMGANQVDR

SEQ ID NO: 77715 - protein, 20 aa, Mycobacterium avium
AGAVIELVHLATLYHDDVMD

SEQ ID NO: 77716 - protein, 24 aa, Mycobacterium avium
AGAVSFRFGDRTQINGVPRDSAVD

SEQ ID NO: 77717 - protein, 24 aa, Mycobacterium avium
AGAWSSIRTFGWETRRLGVTELQF

SEQ ID NO: 77718 - protein, 20 aa, Mycobacterium avium
AGCGPGRLGSYLAAAGHQVV

SEQ ID NO: 77719 - protein, 18 aa, Mycobacterium avium
AGDARPDTLLGWLQSDIA

SEQ ID NO: 77720 - protein, 17 aa, Mycobacterium avium
AGDFLALCESFGLPVIS

SEQ ID NO: 77721 - protein, 26 aa, Mycobacterium avium
AGDHAAICWPLLVGMAKAKYYLLTCE

SEQ ID NO: 77722 - protein, 31 aa, Mycobacterium avium
AGDLDWFSALACFKSAATWSLIVKHNRRRSS

SEQ ID NO: 77723 - protein, 17 aa, Mycobacterium avium
AGDRIVVVGRSQTKTAA

SEQ ID NO: 77724 - protein, 22 aa, Mycobacterium avium
AGEFPPAGIAVILAAIGRMLIL

SEQ ID NO: 77725 - protein, 22 aa, Mycobacterium avium
AGEGRVSWLFVPRLRADGWLRI

SEQ ID NO: 77726 - protein, 17 aa, Mycobacterium avium
AGEPQWVPPPPFTWDYR

SEQ ID NO: 77727 - protein, 22 aa, Mycobacterium avium
AGEPRVGFAQLYGAPGTAAATI

SEQ ID NO: 77728 - protein, 21 aa, Mycobacterium avium
AGETCALALVAEPLLWVTGQL

SEQ ID NO: 77729 - protein, 18 aa, Mycobacterium avium
AGETGCRIVLPEDADPFV

SEQ ID NO: 77730 - protein, 20 aa, Mycobacterium avium
AGEVALLRLACEAADAALTA

SEQ ID NO: 77731 - protein, 25 aa, Mycobacterium avium
AGFDGVELVKALLFSLFEGGLRHGL

SEQ ID NO: 77732 - protein, 18 aa, Mycobacterium avium
AGFGVTFASMFKKHVTEE

SEQ ID NO: 77733 - protein, 22 aa, Mycobacterium avium
AGFRACKRCRPDASPGSPEWNV

SEQ ID NO: 77734 - protein, 18 aa, Mycobacterium avium
AGGAPDFPALELEVLDYW

SEQ ID NO: 77735 - protein, 20 aa, Mycobacterium avium
AGGEILRLLLGHPAYAQGRL

SEQ ID NO: 77736 - protein, 19 aa, Mycobacterium avium
AGGFGLCGIPEKLIQALVD

SEQ ID NO: 77737 - protein, 25 aa, Mycobacterium avium
AGGGGRGMRVVHELSALRGEVEAAR

SEQ ID NO: 77738 - protein, 23 aa, Mycobacterium avium
AGGKRFRPLFTVLSAQIGPDPDA

SEQ ID NO: 77739 - protein, 19 aa, Mycobacterium avium
AGGPVLWPDLEAILVVPNN

SEQ ID NO: 77740 - protein, 18 aa, Mycobacterium avium
AGGQVFLVDCGRGVLQRA

SEQ ID NO: 77741 - protein, 24 aa, Mycobacterium avium
AGGRCLDVVRLLRITTDSPAVEAT

SEQ ID NO: 77742 - protein, 18 aa, Mycobacterium avium
AGGRRYPVPGGMLETAEN

SEQ ID NO: 77743 - protein, 21 aa, Mycobacterium avium
AGGSFCAGMDLKAFARGELPI

SEQ ID NO: 77744 - protein, 21 aa, Mycobacterium avium
AGGTDIRWTGSFTEGVRGTGP

SEQ ID NO: 77745 - protein, 18 aa, Mycobacterium avium
AGGVGAPRLRDVELVQMV

SEQ ID NO: 77746 - protein, 19 aa, Mycobacterium avium
AGHADWPHLGVALMQPRAR

SEQ ID NO: 77747 - protein, 24 aa, Mycobacterium avium
AGHAIRLAAKHLKAALDSELVASF

SEQ ID NO: 77748 - protein, 22 aa, Mycobacterium avium
AGHASWALGVAKSMLDDVQELA

SEQ ID NO: 77749 - protein, 19 aa, Mycobacterium avium
AGHCTNIEVPYAFNAEIEQ

SEQ ID NO: 77750 - protein, 29 aa, Mycobacterium avium
AGHLRAAIMSGALRPGTFIRLDETAAELG

SEQ ID NO: 77751 - protein, 20 aa, Mycobacterium avium
AGHLRLNFATSRAILTEALS

SEQ ID NO: 77752 - protein, 19 aa, Mycobacterium avium
AGHYGMCGRAYDPRFLFAW

SEQ ID NO: 77753 - protein, 18 aa, Mycobacterium avium
AGIALSIMGTGLAAAALA

SEQ ID NO: 77754 - protein, 20 aa, Mycobacterium avium
AGICFPREYGGLGLDYEYQK

SEQ ID NO: 77755 - protein, 27 aa, Mycobacterium avium
AGIELPRRVFAHGFLLNRGEKMSKSVG

SEQ ID NO: 77756 - protein, 25 aa, Mycobacterium avium
AGILDVLDNYAFVRTSGYLAGPHDV

SEQ ID NO: 77757 - protein, 17 aa, Mycobacterium avium
AGILPGSLYHHFESKEA

SEQ ID NO: 77758 - protein, 18 aa, Mycobacterium avium
AGIPAGLLGQMALGSVTG

SEQ ID NO: 77759 - protein, 17 aa, Mycobacterium avium
AGISRRTLFRYYASKNA

SEQ ID NO: 77760 - protein, 22 aa, Mycobacterium avium
AGITRWSLQTAVDYAKVREQFG

SEQ ID NO: 77761 - protein, 17 aa, Mycobacterium avium
AGKHLARPKRYAAGFSR

SEQ ID NO: 77762 - protein, 18 aa, Mycobacterium avium
AGKLPVTLFTAGGIATPA

SEQ ID NO: 77763 - protein, 20 aa, Mycobacterium avium
AGKLWSRIVAEVGRDYPDVE

SEQ ID NO: 77764 - protein, 26 aa, Mycobacterium avium
AGKPRMGNAIVRMRLTMARWSTERLL

SEQ ID NO: 77765 - protein, 28 aa, Mycobacterium avium
AGLAREWGICGVGVMPADWTMRDVLNDQ

SEQ ID NO: 77766 - protein, 17 aa, Mycobacterium avium
AGLDGYSAADCVALLRE

SEQ ID NO: 77767 - protein, 18 aa, Mycobacterium avium
AGLDPAVMIEVLNAGSGA

SEQ ID NO: 77768 - protein, 24 aa, Mycobacterium avium
AGLHAPSWCDPVWLDFPGIAFGRP

SEQ ID NO: 77769 - protein, 17 aa, Mycobacterium avium
AGLKAIYLSGWQVAGDA

SEQ ID NO: 77770 - protein, 19 aa, Mycobacterium avium
AGLLALGGRCESGAAIIAE

SEQ ID NO: 77771 - protein, 18 aa, Mycobacterium avium
AGLLRAPAAATLVSALKS

SEQ ID NO: 77772 - protein, 21 aa, Mycobacterium avium
AGLQARMGLDTGKWTEEQMAR

SEQ ID NO: 77773 - protein, 18 aa, Mycobacterium avium
AGLRGVEKGYVLGPQAED

SEQ ID NO: 77774 - protein, 27 aa, Mycobacterium avium
AGLRPLRPWRPALVAALTNAGSPAAAD

SEQ ID NO: 77775 - protein, 25 aa, Mycobacterium avium
AGLRTLCLDAKLYAGGMASTVELFD

SEQ ID NO: 77776 - protein, 25 aa, Mycobacterium avium
AGLSHPMGPLRLSDLVGLDTLKLIA

SEQ ID NO: 77777 - protein, 22 aa, Mycobacterium avium
AGLSSARIVGWIMRTDSSDLPW

SEQ ID NO: 77778 - protein, 19 aa, Mycobacterium avium
AGLSWYEVSNWSRPGGQCR

SEQ ID NO: 77779 - protein, 18 aa, Mycobacterium avium
AGLVCSHTGNALPRTRPF

SEQ ID NO: 77780 - protein, 28 aa, Mycobacterium avium
AGLVDDLRINWVWNPPWGPDKITDEGRE

SEQ ID NO: 77781 - protein, 17 aa, Mycobacterium avium
AGMEGVVFVGVPRTMND

SEQ ID NO: 77782 - protein, 19 aa, Mycobacterium avium
AGMHPWGKWGNDFTEYGVA

SEQ ID NO: 77783 - protein, 20 aa, Mycobacterium avium
AGNPDIDFVVVREGTEGPYT

SEQ ID NO: 77784 - protein, 17 aa, Mycobacterium avium
AGPAALFDPRFQQLGLH

SEQ ID NO: 77785 - protein, 24 aa, Mycobacterium avium
AGPAYNTGSPWGYSPKGATGVPTR

SEQ ID NO: 77786 - protein, 17 aa, Mycobacterium avium
AGPDFRPSASVEVRLRG

SEQ ID NO: 77787 - protein, 19 aa, Mycobacterium avium
AGPDHNWRAESWDIDMPNQ

SEQ ID NO: 77788 - protein, 18 aa, Mycobacterium avium
AGPEIGVASTKTFLAQIT

SEQ ID NO: 77789 - protein, 17 aa, Mycobacterium avium
AGPEIPSGTVLLDDVTL

SEQ ID NO: 77790 - protein, 29 aa, Mycobacterium avium
AGPGHIARACARAGARLLHVSTDYVFGGE

SEQ ID NO: 77791 - protein, 17 aa, Mycobacterium avium
AGPRHQLYFLGCRLDGM

SEQ ID NO: 77792 - protein, 24 aa, Mycobacterium avium
AGPRVRTAVLTKLYPTRSHTGAAQ

SEQ ID NO: 77793 - protein, 19 aa, Mycobacterium avium
AGQFCLANTIAVAPAAANL

SEQ ID NO: 77794 - protein, 25 aa, Mycobacterium avium
AGQGCALTSRLLVPRSHHDEIVELI

SEQ ID NO: 77795 - protein, 25 aa, Mycobacterium avium
AGRIVSFDAAGGWNLEEEGYQSVGS

SEQ ID NO: 77796 - protein, 22 aa, Mycobacterium avium
AGRPAIVVPAFLSRGYHVRADL

SEQ ID NO: 77797 - protein, 22 aa, Mycobacterium avium
AGRPLRIVLVAPPYFDVPPDGY

SEQ ID NO: 77798 - protein, 17 aa, Mycobacterium avium
AGRSLPEYRALRAQHDM

SEQ ID NO: 77799 - protein, 25 aa, Mycobacterium avium
AGRTELQTLLARWSAAAAILQQGKP

SEQ ID NO: 77800 - protein, 20 aa, Mycobacterium avium
AGSGPTFLECETFRFRGHYF

SEQ ID NO: 77801 - protein, 23 aa, Mycobacterium avium
AGSIRIPAAWTHLVGIKPQRGRI

SEQ ID NO: 77802 - protein, 23 aa, Mycobacterium avium
AGSLIEAAAAWQRVAVELENSVS

SEQ ID NO: 77803 - protein, 17 aa, Mycobacterium avium
AGSLRRDPAVFTGWGRC

SEQ ID NO: 77804 - protein, 20 aa, Mycobacterium avium
AGSNPEFVVALLAASRADLV

SEQ ID NO: 77805 - protein, 20 aa, Mycobacterium avium
AGSRATHIVVWATLDKSKGR

SEQ ID NO: 77806 - protein, 18 aa, Mycobacterium avium
AGSSVCYVKPHGALYNTI

SEQ ID NO: 77807 - protein, 22 aa, Mycobacterium avium
AGTEDRERWLAALPDEVRDRYR

SEQ ID NO: 77808 - protein, 19 aa, Mycobacterium avium
AGTGVRFTPTLTFTRDTTS

SEQ ID NO: 77809 - protein, 24 aa, Mycobacterium avium
AGTIARSFLRQALGVEVLSHVIAI

SEQ ID NO: 77810 - protein, 19 aa, Mycobacterium avium
AGTSWRAADQEMMRPLREL

SEQ ID NO: 77811 - protein, 18 aa, Mycobacterium avium
AGTVIMLCLGAANRDPRK

SEQ ID NO: 77812 - protein, 24 aa, Mycobacterium avium
AGVACTNLLMAMGVSDITVLDSRG

SEQ ID NO: 77813 - protein, 26 aa, Mycobacterium avium
AGVDPGIVDDVIWGCVMQAGEQALDI

SEQ ID NO: 77814 - protein, 18 aa, Mycobacterium avium
AGVGKAAIYRRWSSKAAL

SEQ ID NO: 77815 - protein, 18 aa, Mycobacterium avium
AGVKPALVHYYFPTMDEL

SEQ ID NO: 77816 - protein, 18 aa, Mycobacterium avium
AGVLAALLLNRVSLAPGE

SEQ ID NO: 77817 - protein, 25 aa, Mycobacterium avium
AGVLARAIVRLALSYVSMPPEADHD

SEQ ID NO: 77818 - protein, 25 aa, Mycobacterium avium
AGVLKGEVKDVLLLDVTPLSLGIET

SEQ ID NO: 77819 - protein, 25 aa, Mycobacterium avium
AGVLLRYVPLTAKRVTGIVSRGGSI

SEQ ID NO: 77820 - protein, 20 aa, Mycobacterium avium
AGVPLKAPVAGIAMGLVSDD

SEQ ID NO: 77821 - protein, 17 aa, Mycobacterium avium
AGVPVGFHLSDSGYLHI

SEQ ID NO: 77822 - protein, 18 aa, Mycobacterium avium
AGVRIVDLTAFWAGPSAT

SEQ ID NO: 77823 - protein, 18 aa, Mycobacterium avium
AGVSRPTVYRRWPDTRSI

SEQ ID NO: 77824 - protein, 18 aa, Mycobacterium avium
AGVSRVYLAGPEKAVADA

SEQ ID NO: 77825 - protein, 19 aa, Mycobacterium avium
AGVTPAGLLHHFESKEQLL

SEQ ID NO: 77826 - protein, 22 aa, Mycobacterium avium
AGVVRLRFGLTDGQPRTLDEIG

SEQ ID NO: 77827 - protein, 25 aa, Mycobacterium avium
AGVYPPCSAFETWFVSTALDDDAFD

SEQ ID NO: 77828 - protein, 25 aa, Mycobacterium avium
AGYPDMVAPLTFLAIAGRRVQLEIF

SEQ ID NO: 77829 - protein, 23 aa, Mycobacterium avium
AGYRGEIKVALINLDPAEPIVVH

SEQ ID NO: 77830 - protein, 17 aa, Mycobacterium avium
AGYRRFLERRLREAFGF

SEQ ID NO: 77831 - protein, 18 aa, Mycobacterium avium
AHALAFAAEGARVVVNDI

SEQ ID NO: 77832 - protein, 25 aa, Mycobacterium avium
AHALHSPFWWLKCAVGVHNTDHRAV

SEQ ID NO: 77833 - protein, 18 aa, Mycobacterium avium
AHEAGIPLVLAGKCSEPS

SEQ ID NO: 77834 - protein, 24 aa, Mycobacterium avium
AHEGSLRFGDKVVLGRDNVINAYL

SEQ ID NO: 77835 - protein, 18 aa, Mycobacterium avium
AHESRWCTLYARTDPEAP

SEQ ID NO: 77836 - protein, 18 aa, Mycobacterium avium
AHGFDRWLLPTLADGRVA

SEQ ID NO: 77837 - protein, 24 aa, Mycobacterium avium
AHGIDTVVVGWGYGHADSHPDGVT

SEQ ID NO: 77838 - protein, 17 aa, Mycobacterium avium
AHGPYAVGITGEDAQLF

SEQ ID NO: 77839 - protein, 22 aa, Mycobacterium avium
AHGRSGLNVWVRVPDEAVAVSR

SEQ ID NO: 77840 - protein, 17 aa, Mycobacterium avium
AHHRLFSHVPWLASQLL

SEQ ID NO: 77841 - protein, 20 aa, Mycobacterium avium
AHIELRRTEGLAALVVASAD

SEQ ID NO: 77842 - protein, 24 aa, Mycobacterium avium
AHLQAARPGEDWGGSEQFSGDNPF

SEQ ID NO: 77843 - protein, 18 aa, Mycobacterium avium
AHLRPELGGQGFGQVKLA

SEQ ID NO: 77844 - protein, 23 aa, Mycobacterium avium
AHLSRAGIGQVHVLNRSLSRAQR

SEQ ID NO: 77845 - protein, 24 aa, Mycobacterium avium
AHLSREFVRFAGVPPQRWLAEEFR

SEQ ID NO: 77846 - protein, 19 aa, Mycobacterium avium
AHPSLPRGALLQVAIGERP

SEQ ID NO: 77847 - protein, 30 aa, Mycobacterium avium
AHRFRAGSRIRLLIAGSWSPRYAHNLGSGE

SEQ ID NO: 77848 - protein, 18 aa, Mycobacterium avium
AHRVRLIAGNGLRPEIWD

SEQ ID NO: 77849 - protein, 27 aa, Mycobacterium avium
AHSDEWTDWRWNRILIEGSNCRDIIDN

SEQ ID NO: 77850 - protein, 20 aa, Mycobacterium avium
AHTIRLMAGHELVTEGFAPG

SEQ ID NO: 77851 - protein, 23 aa, Mycobacterium avium
AHTVRPAFEIIKTVPDVSTVSSI

SEQ ID NO: 77852 - protein, 18 aa, Mycobacterium avium
AHWLGRGADGWRLDAAYA

SEQ ID NO: 77853 - protein, 17 aa, Mycobacterium avium
AHWRLGDACELSLLESV

SEQ ID NO: 77854 - protein, 27 aa, Mycobacterium avium
AIAGGESYYRLGLPAGIASDGTEVIGE

SEQ ID NO: 77855 - protein, 20 aa, Mycobacterium avium
AIAHVRGGGEMGRLWYEHGK

SEQ ID NO: 77856 - protein, 21 aa, Mycobacterium avium
AIALLRLPLVLPAVQLMGRVL

SEQ ID NO: 77857 - protein, 22 aa, Mycobacterium avium
AIAQGRAVYCWNVDDYQDIDFC

SEQ ID NO: 77858 - protein, 17 aa, Mycobacterium avium
AICDGGFALDVRYAPTR

SEQ ID NO: 77859 - protein, 18 aa, Mycobacterium avium
AIDAERWLAEHAESSAAA

SEQ ID NO: 77860 - protein, 19 aa, Mycobacterium avium
AIDGARLVLFDGMGHDLPQ

SEQ ID NO: 77861 - protein, 25 aa, Mycobacterium avium
AIDGHVRAGGFGLVGACDIAVAGPR

SEQ ID NO: 77862 - protein, 32 aa, Mycobacterium avium
AIDLELRYRGLRAPHKIKMGVSGCARECAEAR

SEQ ID NO: 77863 - protein, 18 aa, Mycobacterium avium
AIEACARKLFVHPNTVRY

SEQ ID NO: 77864 - protein, 25 aa, Mycobacterium avium
AIEIGIKWLSLYAFSTENWKRSPEE

SEQ ID NO: 77865 - protein, 23 aa, Mycobacterium avium
AIERWKALIVETGAVRLIERMIS

SEQ ID NO: 77866 - protein, 18 aa, Mycobacterium avium
AIGERPPLRQVLNGPSDD

SEQ ID NO: 77867 - protein, 23 aa, Mycobacterium avium
AIGEVYYRLGGTYTGKIMNLSQF

SEQ ID NO: 77868 - protein, 18 aa, Mycobacterium avium
AIGRPRVPVEVNHEPFVT

SEQ ID NO: 77869 - protein, 18 aa, Mycobacterium avium
AIGSCRLPTIAAVNGAAV

SEQ ID NO: 77870 - protein, 23 aa, Mycobacterium avium
AIKSGTRVHVHWADEPVGAITDI

SEQ ID NO: 77871 - protein, 23 aa, Mycobacterium avium
AILAGEVHFAIGYTEPEAGTDLA

SEQ ID NO: 77872 - protein, 19 aa, Mycobacterium avium
AILDFASSFGTLVLTRAYA

SEQ ID NO: 77873 - protein, 18 aa, Mycobacterium avium
AILPRSFDYGFATGLMVK

SEQ ID NO: 77874 - protein, 24 aa, Mycobacterium avium
AILTARHLDCWVLGTVGKGGKAGP

SEQ ID NO: 77875 - protein, 17 aa, Mycobacterium avium
AIPKLSVVRPADANETA

SEQ ID NO: 77876 - protein, 25 aa, Mycobacterium avium
AIPNPLEWGCFTFGVVQNEEYFTFF

SEQ ID NO: 77877 - protein, 19 aa, Mycobacterium avium
AIQVPPNGLPVILGPDHPV

SEQ ID NO: 77878 - protein, 24 aa, Mycobacterium avium
AIRAELAAWFGRWRDTQITALNSI

SEQ ID NO: 77879 - protein, 18 aa, Mycobacterium avium
AIRWRDKGVVGFDIAGAE

SEQ ID NO: 77880 - protein, 22 aa, Mycobacterium avium
AISELRLAGVDGPYSVLLSADV

SEQ ID NO: 77881 - protein, 29 aa, Mycobacterium avium
AISFKIARMEARAHVARTAYYDAAAKMLA

SEQ ID NO: 77882 - protein, 22 aa, Mycobacterium avium
AISPERAAAMVVRGLVEKPARI

SEQ ID NO: 77883 - protein, 25 aa, Mycobacterium avium
AISSARTAAQFGIEPRVAMLSYSTG

SEQ ID NO: 77884 - protein, 23 aa, Mycobacterium avium
AITPRAEEALAFCDKFSLDDLPD

SEQ ID NO: 77885 - protein, 18 aa, Mycobacterium avium
AIVLAEFGYGAVPGPFVP

SEQ ID NO: 77886 - protein, 21 aa, Mycobacterium avium
AIVSFRVGRHRAEVVAVADGI

SEQ ID NO: 77887 - protein, 22 aa, Mycobacterium avium
AKAAIAGMCLTMARDLGSVGVR

SEQ ID NO: 77888 - protein, 17 aa, Mycobacterium avium
AKAAVFALETLFEQRGR

SEQ ID NO: 77889 - protein, 19 aa, Mycobacterium avium
AKADARRKVRDSGEREMRQ

SEQ ID NO: 77890 - protein, 18 aa, Mycobacterium avium
AKALRMFAVLPTIVAADM

SEQ ID NO: 77891 - protein, 18 aa, Mycobacterium avium
AKDLGLDGTEVFDITGIE

SEQ ID NO: 77892 - protein, 18 aa, Mycobacterium avium
AKEALNFIDVQRVNSSYR

SEQ ID NO: 77893 - protein, 25 aa, Mycobacterium avium
AKELYEIRTLFGVMFQDGALFGSMN

SEQ ID NO: 77894 - protein, 18 aa, Mycobacterium avium
AKGGAAVFQMMGLCQMLR

SEQ ID NO: 77895 - protein, 26 aa, Mycobacterium avium
AKGHDTFCPVGPWIVTDLNPLDPGDL

SEQ ID NO: 77896 - protein, 20 aa, Mycobacterium avium
AKIDRWMVGTVWTTQCSNYF

SEQ ID NO: 77897 - protein, 21 aa, Mycobacterium avium
AKIRLLENFSRKTLNDDTAVA

SEQ ID NO: 77898 - protein, 25 aa, Mycobacterium avium
AKLQKRLSEELAWVRSGAKARQAKS

SEQ ID NO: 77899 - protein, 20 aa, Mycobacterium avium
AKPADIGWAAAFLASDAACY

SEQ ID NO: 77900 - protein, 17 aa, Mycobacterium avium
AKPEALTALVRARRPDA

SEQ ID NO: 77901 - protein, 27 aa, Mycobacterium avium
AKPFDYWRQHLKTMKGQWAPFQSLLDL

SEQ ID NO: 77902 - protein, 20 aa, Mycobacterium avium
AKPREVHVVPELPKTRSGKI

SEQ ID NO: 77903 - protein, 23 aa, Mycobacterium avium
AKPRVRARILGIAKSVFAATAAR

SEQ ID NO: 77904 - protein, 28 aa, Mycobacterium avium
AKQAWDEGRFDREISPIVAPALDENKQP

SEQ ID NO: 77905 - protein, 22 aa, Mycobacterium avium
AKRTLAVAVYNHYKRIQAGEKG

SEQ ID NO: 77906 - protein, 26 aa, Mycobacterium avium
AKRWHAIAEIIARGWDDVLGAIDDIA

SEQ ID NO: 77907 - protein, 27 aa, Mycobacterium avium
AKSEAIVHLGFGFGIVFINPALQAVDW

SEQ ID NO: 77908 - protein, 25 aa, Mycobacterium avium
AKSFARLGIRCFGFSPLRLPPDLDF

SEQ ID NO: 77909 - protein, 25 aa, Mycobacterium avium
AKSGWNIDGNPEWAVNLPEELRHAQ

SEQ ID NO: 77910 - protein, 25 aa, Mycobacterium avium
AKTAASRDKHGWVTVGDVGYVDEEG

SEQ ID NO: 77911 - protein, 21 aa, Mycobacterium avium
AKTIKGYSLGAHFQGRNATHQ

SEQ ID NO: 77912 - protein, 26 aa, Mycobacterium avium
AKYKSEPWARLGVNVDADFEPLYIIS

SEQ ID NO: 77913 - protein, 29 aa, Mycobacterium avium
ALAAAHARGEFRPRPSFLSPGKKILHDDR

SEQ ID NO: 77914 - protein, 20 aa, Mycobacterium avium
ALAADWRISGDNVKFGATEI

SEQ ID NO: 77915 - protein, 28 aa, Mycobacterium avium
ALAAQGLSCAGLVIGAWPEHPGPVETSN

SEQ ID NO: 77916 - protein, 24 aa, Mycobacterium avium
ALADDRPAPGLLRGVCEDAPKTAW

SEQ ID NO: 77917 - protein, 23 aa, Mycobacterium avium
ALAEAGLDWRQIQLVAGADTIRN

SEQ ID NO: 77918 - protein, 29 aa, Mycobacterium avium
ALAFQEPRLFPWRDVRTNVGYGLTRTRLP

SEQ ID NO: 77919 - protein, 19 aa, Mycobacterium avium
ALAKCFAHNDGIRVLPDTI

SEQ ID NO: 77920 - protein, 18 aa, Mycobacterium avium
ALARAGFHTLRLQTFLTA

SEQ ID NO: 77921 - protein, 25 aa, Mycobacterium avium
ALARARRALDEFHVEGLATVIPFHR

SEQ ID NO: 77922 - protein, 20 aa, Mycobacterium avium
ALARMIPRGRGHVINVASLA

SEQ ID NO: 77923 - protein, 20 aa, Mycobacterium avium
ALARRGCVYVSVNYRLGALG

SEQ ID NO: 77924 - protein, 21 aa, Mycobacterium avium
ALARTPIRSILSLPMYAGELS

SEQ ID NO: 77925 - protein, 24 aa, Mycobacterium avium
ALASGELIATVALPPQVPRAVDAE

SEQ ID NO: 77926 - protein, 17 aa, Mycobacterium avium
ALASLRLLAGAEHEAEH

SEQ ID NO: 77927 - protein, 33 aa, Mycobacterium avium
ALAVPDVGDLLTWRGGSELFEFADVEVVDPTGA

SEQ ID NO: 77928 - protein, 21 aa, Mycobacterium avium
ALAYMDLRPGTPMRDIAVDAV

SEQ ID NO: 77929 - protein, 21 aa, Mycobacterium avium
ALDDYRRVLAAGINIVGSGPV

SEQ ID NO: 77930 - protein, 23 aa, Mycobacterium avium
ALDKLRLEAFRNKDLDVDTSDLH

SEQ ID NO: 77931 - protein, 25 aa, Mycobacterium avium
ALEAHRFDFCFIGAGYEDQVDQFLT

SEQ ID NO: 77932 - protein, 17 aa, Mycobacterium avium
ALEEAWEAAGLRNDGRV

SEQ ID NO: 77933 - protein, 18 aa, Mycobacterium avium
ALEEIRKILTDAGVEISY

SEQ ID NO: 77934 - protein, 27 aa, Mycobacterium avium
ALELDWYEHLGLCPKGEAEALLRSGAT

SEQ ID NO: 77935 - protein, 24 aa, Mycobacterium avium
ALENTRFWAPLSLTAEQKHSIDDP

SEQ ID NO: 77936 - protein, 17 aa, Mycobacterium avium
ALERAKGALRTMVGAGT

SEQ ID NO: 77937 - protein, 19 aa, Mycobacterium avium
ALFRARRVLPDPVALLRCA

SEQ ID NO: 77938 - protein, 23 aa, Mycobacterium avium
ALGDLPLIYPFLVNDPGEGTQAK

SEQ ID NO: 77939 - protein, 18 aa, Mycobacterium avium
ALGGRPVRVPAVAATAAS

SEQ ID NO: 77940 - protein, 17 aa, Mycobacterium avium
ALGHQLAAVPYLESVVL

SEQ ID NO: 77941 - protein, 18 aa, Mycobacterium avium
ALGIGWAVVMGDRAGGEL

SEQ ID NO: 77942 - protein, 26 aa, Mycobacterium avium
ALHRRCADVRYLGSWPTGTPAGALPP

SEQ ID NO: 77943 - protein, 25 aa, Mycobacterium avium
ALINRYATVCGMTGTALAAGEQLRQ

SEQ ID NO: 77944 - protein, 17 aa, Mycobacterium avium
ALIQAARAADGWRRAGV

SEQ ID NO: 77945 - protein, 28 aa, Mycobacterium avium
ALKLRELLKFEFLFSARAQFEKELADEV

SEQ ID NO: 77946 - protein, 22 aa, Mycobacterium avium
ALKNRLNVIAWRKAHPEVAEQK

SEQ ID NO: 77947 - protein, 23 aa, Mycobacterium avium
ALLDCPVHAIAEIGERTAPSHRP

SEQ ID NO: 77948 - protein, 32 aa, Mycobacterium avium
ALLEVRDLLFARLLQYRAFKHVAEMFAELEAS

SEQ ID NO: 77949 - protein, 18 aa, Mycobacterium avium
ALLGIPITVRAANFGNLY

SEQ ID NO: 77950 - protein, 18 aa, Mycobacterium avium
ALLRAMRAHGYRIGDLPG

SEQ ID NO: 77951 - protein, 23 aa, Mycobacterium avium
ALLREGVRVFGFHLCGLDMRQNS

SEQ ID NO: 77952 - protein, 29 aa, Mycobacterium avium
ALNDLILFKGRRVLSAVLAQAADRGEIDP

SEQ ID NO: 77953 - protein, 22 aa, Mycobacterium avium
ALNLRSGAPLLRDTSVLPAGRP

SEQ ID NO: 77954 - protein, 24 aa, Mycobacterium avium
ALPDDARLLLTIRPGDLLDGEPDA

SEQ ID NO: 77955 - protein, 23 aa, Mycobacterium avium
ALPEIGHACGHNIIAASAVGTAL

SEQ ID NO: 77956 - protein, 27 aa, Mycobacterium avium
ALPTLLRRLVIMGGSYDHRGNTTAVAE

SEQ ID NO: 77957 - protein, 21 aa, Mycobacterium avium
ALREFHRVLAPGGLVAVSALS

SEQ ID NO: 77958 - protein, 26 aa, Mycobacterium avium
ALRERICADAVAFARSIGYTCAGTVE

SEQ ID NO: 77959 - protein, 18 aa, Mycobacterium avium
ALRGTLFVVDSAELPDID

SEQ ID NO: 77960 - protein, 19 aa, Mycobacterium avium
ALRIIRTATELGMRTVAVY

SEQ ID NO: 77961 - protein, 19 aa, Mycobacterium avium
ALRILRAVATMTRKTVDGQ

SEQ ID NO: 77962 - protein, 34 aa, Mycobacterium avium
ALRLDRLLRLKVFPLAISLPWGIAPAALPQLPLP

SEQ ID NO: 77963 - protein, 24 aa, Mycobacterium avium
ALRRAARLDGWMHGGGDPEELDHL

SEQ ID NO: 77964 - protein, 19 aa, Mycobacterium avium
ALRRLPGQILGRVAFGVLA

SEQ ID NO: 77965 - protein, 18 aa, Mycobacterium avium
ALRYLRRELRAENPQQQQ

SEQ ID NO: 77966 - protein, 23 aa, Mycobacterium avium
ALSAALQRPEVRWWMLDFAGPGL

SEQ ID NO: 77967 - protein, 25 aa, Mycobacterium avium
ALSDLELYLFFSLLFSAGAETTRNA

SEQ ID NO: 77968 - protein, 25 aa, Mycobacterium avium
ALSTRFPYTGFRPKLHPEILAATRA

SEQ ID NO: 77969 - protein, 23 aa, Mycobacterium avium
ALSTRLEVNIARDGYEWSQYYDH

SEQ ID NO: 77970 - protein, 18 aa, Mycobacterium avium
ALTAPAPHHTRPVRFVWL

SEQ ID NO: 77971 - protein, 21 aa, Mycobacterium avium
ALTAVGIEWLARRLGAGDSAA

SEQ ID NO: 77972 - protein, 24 aa, Mycobacterium avium
ALTEARIGVAPAIISLTLLPKLSA

SEQ ID NO: 77973 - protein, 20 aa, Mycobacterium avium
ALTGGMCWEALNNIAASGRP

SEQ ID NO: 77974 - protein, 17 aa, Mycobacterium avium
ALTLAREGASVVVNDLG

SEQ ID NO: 77975 - protein, 17 aa, Mycobacterium avium
ALTSLPGVGEWTAAETA

SEQ ID NO: 77976 - protein, 18 aa, Mycobacterium avium
ALVACFPNVVVVRTFSKA

SEQ ID NO: 77977 - protein, 27 aa, Mycobacterium avium
ALVGAYRRRGCRVAVLAVDPSSPFSGG

SEQ ID NO: 77978 - protein, 17 aa, Mycobacterium avium
ALVGFWMTPESIYLSPA

SEQ ID NO: 77979 - protein, 21 aa, Mycobacterium avium
ALVLGCGPIGIAIIAALATRG

SEQ ID NO: 77980 - protein, 26 aa, Mycobacterium avium
ALVNSWSAAFARYGRTVGQVLLSAHD

SEQ ID NO: 77981 - protein, 21 aa, Mycobacterium avium
ALVPGRPAPRLVTAAAVESMK

SEQ ID NO: 77982 - protein, 25 aa, Mycobacterium avium
ALWAATFLRRRGAAADAILLNPERA

SEQ ID NO: 77983 - protein, 28 aa, Mycobacterium avium
ALWDLKGKLLGLPVCRLLGMAHDSVPIY

SEQ ID NO: 77984 - protein, 29 aa, Mycobacterium avium
ALYMDRYPLVSAISRPLIVKHLVAAAREH

SEQ ID NO: 77985 - protein, 22 aa, Mycobacterium avium
AMAGAELLLGMRRFLPSSPTSL

SEQ ID NO: 77986 - protein, 17 aa, Mycobacterium avium
AMDTWSRGLERFNTARA

SEQ ID NO: 77987 - protein, 24 aa, Mycobacterium avium
AMFQMKFYAVALLRSRGVPPTRLR

SEQ ID NO: 77988 - protein, 25 aa, Mycobacterium avium
AMIDCLRAGGKVILFGNGGSAQDAG

SEQ ID NO: 77989 - protein, 18 aa, Mycobacterium avium
AMIDLSTMVGRVISPTNR

SEQ ID NO: 77990 - protein, 27 aa, Mycobacterium avium
AMIDVIRFWLGLGIDGFRLDAVPYLFE

SEQ ID NO: 77991 - protein, 21 aa, Mycobacterium avium
AMKELTLDIASLVFMGHEPGT

SEQ ID NO: 77992 - protein, 21 aa, Mycobacterium avium
AMLLLWIRGVRFMYSRDPYLP

SEQ ID NO: 77993 - protein, 23 aa, Mycobacterium avium
AMLQSVQPYLLWLRETAQQSAQL

SEQ ID NO: 77994 - protein, 17 aa, Mycobacterium avium
AMLREIVDDPAFVLHGN

SEQ ID NO: 77995 - protein, 28 aa, Mycobacterium avium
AMLRELRPDLTIGFFLHIPFPPVELFMQ

SEQ ID NO: 77996 - protein, 24 aa, Mycobacterium avium
AMNARIALHVRVLYGRDPHHITEA

SEQ ID NO: 77997 - protein, 27 aa, Mycobacterium avium
AMPAECLLDRNALIMGYSGVYSSFLKH

SEQ ID NO: 77998 - protein, 25 aa, Mycobacterium avium
AMSRLRGRAVGMVFQDPMSALTPVY

SEQ ID NO: 77999 - protein, 20 aa, Mycobacterium avium
AMTPWVWPTMHLNPPNWIAP

SEQ ID NO: 78000 - protein, 18 aa, Mycobacterium avium
AMVAELLSALDLEDVVLV

SEQ ID NO: 78001 - protein, 18 aa, Mycobacterium avium
AMVTDRRVLLTLPISHVY

SEQ ID NO: 78002 - protein, 26 aa, Mycobacterium avium
AMYFHFKSKHALAVAIIESQTASGAV

SEQ ID NO: 78003 - protein, 19 aa, Mycobacterium avium
AMYSVMWSEHCSYKSSKVH

SEQ ID NO: 78004 - protein, 21 aa, Mycobacterium avium
ANAAREFLLHRGVSKADADKV

SEQ ID NO: 78005 - protein, 20 aa, Mycobacterium avium
ANAQAALRIEQLEQMVLEQF

SEQ ID NO: 78006 - protein, 28 aa, Mycobacterium avium
ANCEAFKRWGLYPRMGIAPEQRDMSVEL

SEQ ID NO: 78007 - protein, 18 aa, Mycobacterium avium
ANDELREKWSTRRGAVES

SEQ ID NO: 78008 - protein, 23 aa, Mycobacterium avium
ANFEAGPVLRFMSGNLCHQIEHH

SEQ ID NO: 78009 - protein, 24 aa, Mycobacterium avium
ANFELWCFAVSAINGCPDCVASHE

SEQ ID NO: 78010 - protein, 20 aa, Mycobacterium avium
ANFRDVMIALGLYPDPDAVM

SEQ ID NO: 78011 - protein, 19 aa, Mycobacterium avium
ANGGRSLCQGKIFTQSGEM

SEQ ID NO: 78012 - protein, 20 aa, Mycobacterium avium
ANGIEIPGRHQLFMHACDVS

SEQ ID NO: 78013 - protein, 20 aa, Mycobacterium avium
ANGKGFCGGHVARWGPDENP

SEQ ID NO: 78014 - protein, 19 aa, Mycobacterium avium
ANGKGFCSGHAIGNNAVDY

SEQ ID NO: 78015 - protein, 18 aa, Mycobacterium avium
ANHSIWFHRQVDFNDWVL

SEQ ID NO: 78016 - protein, 25 aa, Mycobacterium avium
ANIAARVGFSLALGEYLGYGPAAVC

SEQ ID NO: 78017 - protein, 18 aa, Mycobacterium avium
ANIPLGYLGTGADIAAAV

SEQ ID NO: 78018 - protein, 17 aa, Mycobacterium avium
ANLEGGFFIGPTLFDHV

SEQ ID NO: 78019 - protein, 17 aa, Mycobacterium avium
ANLPPGHPLHVTGDAAP

SEQ ID NO: 78020 - protein, 24 aa, Mycobacterium avium
ANLTSRLTIRPILAVGSHAPNLPW

SEQ ID NO: 78021 - protein, 21 aa, Mycobacterium avium
ANNPLRLGGCLNSESAEKAAR

SEQ ID NO: 78022 - protein, 24 aa, Mycobacterium avium
ANNSRYGLSGAVWGDDVDRAVGVA

SEQ ID NO: 78023 - protein, 21 aa, Mycobacterium avium
ANPAVWMYAGGAGFANILYHL

SEQ ID NO: 78024 - protein, 17 aa, Mycobacterium avium
ANPRASRTVPFVSKATA

SEQ ID NO: 78025 - protein, 28 aa, Mycobacterium avium
ANPRITALMCTADILALSAMDYLRAHGV

SEQ ID NO: 78026 - protein, 25 aa, Mycobacterium avium
ANPRTRSGIMALELLDTTPDWQQFR

SEQ ID NO: 78027 - protein, 24 aa, Mycobacterium avium
ANPTPKGCVFEYVYLARPDSTIAG

SEQ ID NO: 78028 - protein, 19 aa, Mycobacterium avium
ANQWPADVVEYFGDPSTGG

SEQ ID NO: 78029 - protein, 24 aa, Mycobacterium avium
ANRKAWEALGRWEKPFLAIFGARD

SEQ ID NO: 78030 - protein, 19 aa, Mycobacterium avium
ANTYARLALGIGVHDITAG

SEQ ID NO: 78031 - protein, 29 aa, Mycobacterium avium
ANVGVWVRTDEQWRWLAHTLTVERLTELL

SEQ ID NO: 78032 - protein, 17 aa, Mycobacterium avium
ANVRWGNNVAILAGDYL

SEQ ID NO: 78033 - protein, 19 aa, Mycobacterium avium
ANYFGAAGFVPLANSVEGT

SEQ ID NO: 78034 - protein, 18 aa, Mycobacterium avium
ANYSMVFDSYAEVPANVS

SEQ ID NO: 78035 - protein, 28 aa, Mycobacterium avium
APAATAFPWRRQSALVQWYVETSGDPAA

SEQ ID NO: 78036 - protein, 22 aa, Mycobacterium avium
APAESRAAAAVRAAVQSRHALA

SEQ ID NO: 78037 - protein, 21 aa, Mycobacterium avium
APAKTSAAYMLGLLLQSESVA

SEQ ID NO: 78038 - protein, 18 aa, Mycobacterium avium
APALAAGCSAVLKPAEET

SEQ ID NO: 78039 - protein, 19 aa, Mycobacterium avium
APALPSFGGGSLPGLGATP

SEQ ID NO: 78040 - protein, 21 aa, Mycobacterium avium
APDCCAVVAYGALLRDELLAV

SEQ ID NO: 78041 - protein, 24 aa, Mycobacterium avium
APDDPRWPPIPAQDFSNLPRQQKG

SEQ ID NO: 78042 - protein, 25 aa, Mycobacterium avium
APDIPRERFSALTRLDHNRAISQLA

SEQ ID NO: 78043 - protein, 21 aa, Mycobacterium avium
APDLRGRISMASMAAAEMQHY

SEQ ID NO: 78044 - protein, 18 aa, Mycobacterium avium
APDRNLALELVRVTEAGA

SEQ ID NO: 78045 - protein, 25 aa, Mycobacterium avium
APEIYRAPLSYPYRDGLLDKELATD

SEQ ID NO: 78046 - protein, 23 aa, Mycobacterium avium
APEKPWFSYVCPGAGHAPHHVFK

SEQ ID NO: 78047 - protein, 21 aa, Mycobacterium avium
APEPGPAMLGDIVLCPEFAAD

SEQ ID NO: 78048 - protein, 18 aa, Mycobacterium avium
APEQLHWHGQHIGADVDG

SEQ ID NO: 78049 - protein, 23 aa, Mycobacterium avium
APFPHMRFPSGWTAYDEDNDAVV

SEQ ID NO: 78050 - protein, 17 aa, Mycobacterium avium
APFRGFLQERRALGHRG

SEQ ID NO: 78051 - protein, 18 aa, Mycobacterium avium
APFSLAWMTAVGERTTRI

SEQ ID NO: 78052 - protein, 17 aa, Mycobacterium avium
APGDCIFFAAGPAKPSR

SEQ ID NO: 78053 - protein, 32 aa, Mycobacterium avium
APGERAVLVGHSFGGITIMAWAQRFAAHAVSA

SEQ ID NO: 78054 - protein, 19 aa, Mycobacterium avium
APGGLSCFLLPRVLPDGTR

SEQ ID NO: 78055 - protein, 23 aa, Mycobacterium avium
APGNAVHHLGYWCDDLAQSAQLL

SEQ ID NO: 78056 - protein, 20 aa, Mycobacterium avium
APGPLYPVSIVLSALAECSG

SEQ ID NO: 78057 - protein, 18 aa, Mycobacterium avium
APGTNWKSNPNAMRTIEA

SEQ ID NO: 78058 - protein, 17 aa, Mycobacterium avium
APGVRMLVVPGSMRVRA

SEQ ID NO: 78059 - protein, 26 aa, Mycobacterium avium
APHMAEELWLRLGHTTSLAHGPFPVA

SEQ ID NO: 78060 - protein, 25 aa, Mycobacterium avium
APISRVDLLVCRNTLMYLNAETQRN

SEQ ID NO: 78061 - protein, 27 aa, Mycobacterium avium
APIWIYRARGGAVFGSRILLLEHVGRK

SEQ ID NO: 78062 - protein, 21 aa, Mycobacterium avium
APIYLALREVREWAQNTKDAS

SEQ ID NO: 78063 - protein, 17 aa, Mycobacterium avium
APKALAAGRAWGQQLDA

SEQ ID NO: 78064 - protein, 17 aa, Mycobacterium avium
APLEGSGWTVASEAEPV

SEQ ID NO: 78065 - protein, 19 aa, Mycobacterium avium
APLLPEERHTAVANHECDG

SEQ ID NO: 78066 - protein, 23 aa, Mycobacterium avium
APLYYNERHDFWGLSRYDDVDAA

SEQ ID NO: 78067 - protein, 17 aa, Mycobacterium avium
APMVISYLAKKDHDEKR

SEQ ID NO: 78068 - protein, 20 aa, Mycobacterium avium
APNFAYALLAKRLRRQAKPG

SEQ ID NO: 78069 - protein, 25 aa, Mycobacterium avium
APNVWALGDVASWRDATGHQGRVEH

SEQ ID NO: 78070 - protein, 18 aa, Mycobacterium avium
APPGIPVDIGPGATVAHL

SEQ ID NO: 78071 - protein, 18 aa, Mycobacterium avium
APPGYRLNIPDDRCDLGR

SEQ ID NO: 78072 - protein, 31 aa, Mycobacterium avium
APPHGGIAFGWDRINALLSRVDSIREVIAFP

SEQ ID NO: 78073 - protein, 24 aa, Mycobacterium avium
APPQRPVWVGDFWDMFGAGHLLEL

SEQ ID NO: 78074 - protein, 26 aa, Mycobacterium avium
APPTAPRPGGMPPWDSTPVTGIPRVD

SEQ ID NO: 78075 - protein, 18 aa, Mycobacterium avium
APQLAWLSGTAGRAELAA

SEQ ID NO: 78076 - protein, 23 aa, Mycobacterium avium
APRDLCALWPVPATSAPHAAPPM

SEQ ID NO: 78077 - protein, 31 aa, Mycobacterium avium
APRGLRPIARLMLSALIGRVAIPDPIAARLP

SEQ ID NO: 78078 - protein, 22 aa, Mycobacterium avium
APRSPRGLLVADLSSMWAGPLC

SEQ ID NO: 78079 - protein, 18 aa, Mycobacterium avium
APSAAKLYCTEMAGRVAD

SEQ ID NO: 78080 - protein, 17 aa, Mycobacterium avium
APSDLPQRLSLFGHTRL

SEQ ID NO: 78081 - protein, 26 aa, Mycobacterium avium
APSERPRIRLAYRLTPDRILGEQRVT

SEQ ID NO: 78082 - protein, 17 aa, Mycobacterium avium
APSVRRVVLKSTSEVYG

SEQ ID NO: 78083 - protein, 21 aa, Mycobacterium avium
APTHIAAAFDVSRQTFRSDRY

SEQ ID NO: 78084 - protein, 31 aa, Mycobacterium avium
APTLIRTFMKWGREIPDAHDLSSLRLLGSVG

SEQ ID NO: 78085 - protein, 26 aa, Mycobacterium avium
APTLYCISEPIPPGSYVGVSGRFGLR

SEQ ID NO: 78086 - protein, 24 aa, Mycobacterium avium
APVRCEVWEGFIFINFDDNAAPLT

SEQ ID NO: 78087 - protein, 18 aa, Mycobacterium avium
APYAFSFSGLKTAVARYL

SEQ ID NO: 78088 - protein, 24 aa, Mycobacterium avium
AQARTDFGGTLFFGVPTVWSRVVA

SEQ ID NO: 78089 - protein, 18 aa, Mycobacterium avium
AQAWEVLPRIYAEHRPAR

SEQ ID NO: 78090 - protein, 19 aa, Mycobacterium avium
AQDTRLIWEERRMRREVRA

SEQ ID NO: 78091 - protein, 23 aa, Mycobacterium avium
AQEDWLFEFGWHALDAVADTARG

SEQ ID NO: 78092 - protein, 25 aa, Mycobacterium avium
AQEISARVLMKLKRDAEAYLGEDIT

SEQ ID NO: 78093 - protein, 17 aa, Mycobacterium avium
AQELPPLRSCTLRAAGH

SEQ ID NO: 78094 - protein, 22 aa, Mycobacterium avium
AQERLGSLAGGFGAPPGQPPAP

SEQ ID NO: 78095 - protein, 17 aa, Mycobacterium avium
AQFSSIIDRYAAGTDLI

SEQ ID NO: 78096 - protein, 18 aa, Mycobacterium avium
AQFVPTMFVRMLKLPEAV

SEQ ID NO: 78097 - protein, 19 aa, Mycobacterium avium
AQGRLDLRAAAGVKVTAAR

SEQ ID NO: 78098 - protein, 22 aa, Mycobacterium avium
AQGYSRVRVDGVVHPLTDPPKL

SEQ ID NO: 78099 - protein, 24 aa, Mycobacterium avium
AQIAQRYAAEFGYDPAALAKIAVD

SEQ ID NO: 78100 - protein, 24 aa, Mycobacterium avium
AQIRSIPTLMAFKKGKLLFNQPGA

SEQ ID NO: 78101 - protein, 27 aa, Mycobacterium avium
AQIYAWRKGIKTLYYIRLRQMALEGTE

SEQ ID NO: 78102 - protein, 20 aa, Mycobacterium avium
AQLEKFQWFVRAHLESAGGQ

SEQ ID NO: 78103 - protein, 20 aa, Mycobacterium avium
AQLLARRVRTVVEHAVDEAI

SEQ ID NO: 78104 - protein, 20 aa, Mycobacterium avium
AQLLPRPIGLIIGLQLSANP

SEQ ID NO: 78105 - protein, 23 aa, Mycobacterium avium
AQLPRALPRTALIQLSDYVLGDR

SEQ ID NO: 78106 - protein, 25 aa, Mycobacterium avium
AQLPVLVKASAGGGGRGMRVVHELS

SEQ ID NO: 78107 - protein, 20 aa, Mycobacterium avium
AQLPWSRIATDAVLALEGSG

SEQ ID NO: 78108 - protein, 19 aa, Mycobacterium avium
AQMVRLLVQYAAWHLDRDH

SEQ ID NO: 78109 - protein, 19 aa, Mycobacterium avium
AQNGRYGPYLKRGNDSRSL

SEQ ID NO: 78110 - protein, 17 aa, Mycobacterium avium
AQNNGGSICRIATHCTE

SEQ ID NO: 78111 - protein, 19 aa, Mycobacterium avium
AQPRSWKLLRGNVSLPTHD

SEQ ID NO: 78112 - protein, 20 aa, Mycobacterium avium
AQRPELWNLYNGRHHKGEHI

SEQ ID NO: 78113 - protein, 23 aa, Mycobacterium avium
AQRRACAARERLTSDFDWHTVAD

SEQ ID NO: 78114 - protein, 32 aa, Mycobacterium avium
AQRRTPPAFYAWRAFARYSPVLPAGRIVSVGT

SEQ ID NO: 78115 - protein, 18 aa, Mycobacterium avium
AQSPTVLFLGRHVGYPVA

SEQ ID NO: 78116 - protein, 20 aa, Mycobacterium avium
AQTIRRFELRSATNTLNAPP

SEQ ID NO: 78117 - protein, 28 aa, Mycobacterium avium
AQVRPGQYVRLHWARPRALAGAHAGAAS

SEQ ID NO: 78118 - protein, 17 aa, Mycobacterium avium
AQVTGRVAPIFDLGVGM

SEQ ID NO: 78119 - protein, 19 aa, Mycobacterium avium
AQYERAWGTIEALKEKDEA

SEQ ID NO: 78120 - protein, 19 aa, Mycobacterium avium
AQYRDPGLLLGQRIGARDF

SEQ ID NO: 78121 - protein, 20 aa, Mycobacterium avium
ARAAMVVSVDRGRWGCVLGG

SEQ ID NO: 78122 - protein, 25 aa, Mycobacterium avium
ARACGVAIRAFELAVRYAQQRETFG

SEQ ID NO: 78123 - protein, 20 aa, Mycobacterium avium
ARAFVNRPLVLLADEPTGNL

SEQ ID NO: 78124 - protein, 22 aa, Mycobacterium avium
ARAHWKAHRLDLGPVLHEPESA

SEQ ID NO: 78125 - protein, 21 aa, Mycobacterium avium
ARAINNGWARPILPDPGAADA

SEQ ID NO: 78126 - protein, 20 aa, Mycobacterium avium
ARAKGFRNRVTWTVTTWEPP

SEQ ID NO: 78127 - protein, 26 aa, Mycobacterium avium
ARALGCTIKLLSICERITGDDGQERV

SEQ ID NO: 78128 - protein, 25 aa, Mycobacterium avium
ARALIAVRGLHRFLAAEGLAELDVA

SEQ ID NO: 78129 - protein, 18 aa, Mycobacterium avium
ARARELGMEVALDLALQC

SEQ ID NO: 78130 - protein, 18 aa, Mycobacterium avium
ARATRLAWVHVTRPAIHA

SEQ ID NO: 78131 - protein, 18 aa, Mycobacterium avium
ARAYIRYQPLGVVLAVMP

SEQ ID NO: 78132 - protein, 22 aa, Mycobacterium avium
ARDELRAAGADPVFADPQDLLD

SEQ ID NO: 78133 - protein, 19 aa, Mycobacterium avium
ARDGLVLPVMGTVEAGSRT

SEQ ID NO: 78134 - protein, 24 aa, Mycobacterium avium
ARDLARELIRVVTIAPGLFKTPLL

SEQ ID NO: 78135 - protein, 24 aa, Mycobacterium avium
ARDLPCHTGIRLLGGSSHALGRVN

SEQ ID NO: 78136 - protein, 24 aa, Mycobacterium avium
ARDRAVELLELVGIAQPQRRARAF

SEQ ID NO: 78137 - protein, 24 aa, Mycobacterium avium
ARDRIGVEIHRRITSAMGPDADPT

SEQ ID NO: 78138 - protein, 25 aa, Mycobacterium avium
ARDVNELIVSLGYRCQTSTKRVQGR

SEQ ID NO: 78139 - protein, 20 aa, Mycobacterium avium
AREEPFATLRQLLAVHETAE

SEQ ID NO: 78140 - protein, 30 aa, Mycobacterium avium
ARELELRWAGLRAHNRWLADFCSLSPERRA

SEQ ID NO: 78141 - protein, 18 aa, Mycobacterium avium
ARELGGAGYTAPEFFDYL

SEQ ID NO: 78142 - protein, 19 aa, Mycobacterium avium
ARELQNMSAYDFFVGHDRR

SEQ ID NO: 78143 - protein, 19 aa, Mycobacterium avium
ARERLTFDEAVGLQWALVA

SEQ ID NO: 78144 - protein, 21 aa, Mycobacterium avium
ARESGRCEFEGWRARKNGQRF

SEQ ID NO: 78145 - protein, 33 aa, Mycobacterium avium
ARETLEVIAPLAHRLGMASVKWELEDLSFAILH

SEQ ID NO: 78146 - protein, 18 aa, Mycobacterium avium
ARFLQSIPLHRVARPREI

SEQ ID NO: 78147 - protein, 36 aa, Mycobacterium avium
ARFRRKIGAKGWFGLNWPREYGGLGLGAVHLHLLMS

SEQ ID NO: 78148 - protein, 24 aa, Mycobacterium avium
ARFVPRGAGHIVNIASLAGVTGEP

SEQ ID NO: 78149 - protein, 26 aa, Mycobacterium avium
ARFVRLCDAFGIPLVVIVDVPGYLPG

SEQ ID NO: 78150 - protein, 20 aa, Mycobacterium avium
ARGFAFYALDLHKCGRSRRD

SEQ ID NO: 78151 - protein, 20 aa, Mycobacterium avium
ARGGLPVAWEIAAALHAPLD

SEQ ID NO: 78152 - protein, 24 aa, Mycobacterium avium
ARGIAEPYLRPGQIEEHLVYPVTT

SEQ ID NO: 78153 - protein, 20 aa, Mycobacterium avium
ARGIPIAIVNRGDTRGDHLA

SEQ ID NO: 78154 - protein, 17 aa, Mycobacterium avium
ARGLARRGFPLLLVARR

SEQ ID NO: 78155 - protein, 21 aa, Mycobacterium avium
ARGLDMARLNIGVWDISGVCD

SEQ ID NO: 78156 - protein, 18 aa, Mycobacterium avium
ARGTWALQDVVRFGPGIT

SEQ ID NO: 78157 - protein, 24 aa, Mycobacterium avium
ARGVERWLSQRLSHVLGRARDGDG

SEQ ID NO: 78158 - protein, 22 aa, Mycobacterium avium
ARGVIWPTIPPDILGQAGTAWQ

SEQ ID NO: 78159 - protein, 20 aa, Mycobacterium avium
ARHFDHLNVIAGFDELPRKL

SEQ ID NO: 78160 - protein, 18 aa, Mycobacterium avium
ARHYRPAGGETQAPLLVF

SEQ ID NO: 78161 - protein, 23 aa, Mycobacterium avium
ARIAEILGAPVIDQGDRANLPPG

SEQ ID NO: 78162 - protein, 21 aa, Mycobacterium avium
ARIDIPVVISSALDSAVGIAA

SEQ ID NO: 78163 - protein, 17 aa, Mycobacterium avium
ARIDSIVASGSHRGDPA

SEQ ID NO: 78164 - protein, 20 aa, Mycobacterium avium
ARKKPPFGIGQIGKSFRNEI

SEQ ID NO: 78165 - protein, 18 aa, Mycobacterium avium
ARKVAGWGADAMIVQGGE

SEQ ID NO: 78166 - protein, 17 aa, Mycobacterium avium
ARLALGIGVHDITAGYR

SEQ ID NO: 78167 - protein, 23 aa, Mycobacterium avium
ARLEAGVALSAVTARFPRARLDG

SEQ ID NO: 78168 - protein, 20 aa, Mycobacterium avium
ARLEVMDELGIDYALMFPTL

SEQ ID NO: 78169 - protein, 19 aa, Mycobacterium avium
ARLIAKLSYTNIGFALAPR

SEQ ID NO: 78170 - protein, 18 aa, Mycobacterium avium
ARLIWAHRDPYKATGSLC

SEQ ID NO: 78171 - protein, 26 aa, Mycobacterium avium
ARLLPNLVTVLGWRSCDHTGPVHEGD

SEQ ID NO: 78172 - protein, 26 aa, Mycobacterium avium
ARLLVHAITEVWRLSDYRMLTHDRGS

SEQ ID NO: 78173 - protein, 24 aa, Mycobacterium avium
ARLQKRLGTTTVYVTHDQTEAMTL

SEQ ID NO: 78174 - protein, 23 aa, Mycobacterium avium
ARLRVILRRAGKGGAEPRSARLT

SEQ ID NO: 78175 - protein, 23 aa, Mycobacterium avium
ARLSRYGAAVGEAFQLRDDVLGV

SEQ ID NO: 78176 - protein, 28 aa, Mycobacterium avium
ARLTRLTWRLLPFMWLDIDEAVKPTLYA

SEQ ID NO: 78177 - protein, 19 aa, Mycobacterium avium
ARMFGRMLGCDLGLNPPFE

SEQ ID NO: 78178 - protein, 23 aa, Mycobacterium avium
ARMVLRCAAGLPVEPRDRGKPAF

SEQ ID NO: 78179 - protein, 34 aa, Mycobacterium avium
ARNAKLASIPVGFAGRAAIGFGKRLTGKSRDEVQ

SEQ ID NO: 78180 - protein, 21 aa, Mycobacterium avium
ARPDLVKPIAPVSGEAASLTK

SEQ ID NO: 78181 - protein, 17 aa, Mycobacterium avium
ARPGQRVLVHAAAGGVG

SEQ ID NO: 78182 - protein, 19 aa, Mycobacterium avium
ARPQREWTTYRLSGPRLAE

SEQ ID NO: 78183 - protein, 22 aa, Mycobacterium avium
ARPRGIPVIVLAGQVDLDTATV

SEQ ID NO: 78184 - protein, 18 aa, Mycobacterium avium
ARQALRLFDDLRLLHGRL

SEQ ID NO: 78185 - protein, 18 aa, Mycobacterium avium
ARQLISIHHADPARIDVV

SEQ ID NO: 78186 - protein, 19 aa, Mycobacterium avium
ARQQLLALREEVDRLGQPP

SEQ ID NO: 78187 - protein, 22 aa, Mycobacterium avium
ARQRLYLSRAIVRSSWGQPMLN

SEQ ID NO: 78188 - protein, 18 aa, Mycobacterium avium
ARRAASLERLVSRPAAQA

SEQ ID NO: 78189 - protein, 28 aa, Mycobacterium avium
ARRDGVACYPARFQLVLAANLCPCAPAD

SEQ ID NO: 78190 - protein, 20 aa, Mycobacterium avium
ARRFARNDYDILLIGHEGHE

SEQ ID NO: 78191 - protein, 18 aa, Mycobacterium avium
ARRFCIPAVEAKGSLLLE

SEQ ID NO: 78192 - protein, 26 aa, Mycobacterium avium
ARRGMPVLGICNGFQVLCEAGLLPGA

SEQ ID NO: 78193 - protein, 21 aa, Mycobacterium avium
ARRKLRMICHGIGRTEGFSPK

SEQ ID NO: 78194 - protein, 24 aa, Mycobacterium avium
ARRLAEKLWKLRILADERSASDVG

SEQ ID NO: 78195 - protein, 22 aa, Mycobacterium avium
ARRLAGLFAGYARQRPRLLVDW

SEQ ID NO: 78196 - protein, 19 aa, Mycobacterium avium
ARRLSRAGDRIVVVGRSQT

SEQ ID NO: 78197 - protein, 23 aa, Mycobacterium avium
ARRMGNGLVHLHLCDGNGLPADE

SEQ ID NO: 78198 - protein, 24 aa, Mycobacterium avium
ARRMRISIEYSHRGVDCAREVADV

SEQ ID NO: 78199 - protein, 19 aa, Mycobacterium avium
ARRTLRAGFTTVRNLGLFV

SEQ ID NO: 78200 - protein, 22 aa, Mycobacterium avium
ARRVADVLGIPFYVWDFAEKFQ

SEQ ID NO: 78201 - protein, 26 aa, Mycobacterium avium
ARRVEVAADLRADWSRPLEAAGFDVE

SEQ ID NO: 78202 - protein, 26 aa, Mycobacterium avium
ARRWQRLLFDNGWLLPSQPPEYGGRN

SEQ ID NO: 78203 - protein, 27 aa, Mycobacterium avium
ARRWQRLLFDSGWLLPGNPPEFGGRNA

SEQ ID NO: 78204 - protein, 18 aa, Mycobacterium avium
ARSAGILGIELGAEAAEE

SEQ ID NO: 78205 - protein, 20 aa, Mycobacterium avium
ARSAWQAALDYATQRTQFGR

SEQ ID NO: 78206 - protein, 21 aa, Mycobacterium avium
ARSIPLAAPWEARRAAELDGL

SEQ ID NO: 78207 - protein, 22 aa, Mycobacterium avium
ARSNTFALEWPKGSGTLREFPE

SEQ ID NO: 78208 - protein, 24 aa, Mycobacterium avium
ARSPEALLALAQRYGEWLHAHPDA

SEQ ID NO: 78209 - protein, 20 aa, Mycobacterium avium
ARTDIALGMFNSPSSGYVLT

SEQ ID NO: 78210 - protein, 19 aa, Mycobacterium avium
ARTFAVAARVFARTAAARM

SEQ ID NO: 78211 - protein, 20 aa, Mycobacterium avium
ARTHAIGQIVPGKVTKLVPF

SEQ ID NO: 78212 - protein, 28 aa, Mycobacterium avium
ARTLADEFDFRFLVGVLSVLADKDVDGI

SEQ ID NO: 78213 - protein, 21 aa, Mycobacterium avium
ARTLGSLALMGVRVEELIVNQ

SEQ ID NO: 78214 - protein, 21 aa, Mycobacterium avium
ARTLLPDEHRAFVDDLLARYG

SEQ ID NO: 78215 - protein, 26 aa, Mycobacterium avium
ARTLRADEALPFSAIKVGANLVRTDE

SEQ ID NO: 78216 - protein, 29 aa, Mycobacterium avium
ARTRGLPVLGLCLGLQCIVIEAARAAGLA

SEQ ID NO: 78217 - protein, 27 aa, Mycobacterium avium
ARVEFWAFDLLYLDGRSLLRARYRDRR

SEQ ID NO: 78218 - protein, 20 aa, Mycobacterium avium
ARVGAAVADRASWRRWWPDL

SEQ ID NO: 78219 - protein, 22 aa, Mycobacterium avium
ARVGAPVLFGMGRFLGHDRLAD

SEQ ID NO: 78220 - protein, 18 aa, Mycobacterium avium
ARVGCDIDLSGLFFDGER

SEQ ID NO: 78221 - protein, 24 aa, Mycobacterium avium
ARVICRRSRLMSRVAGTGATASVE

SEQ ID NO: 78222 - protein, 27 aa, Mycobacterium avium
ARVLRPGGRLGLVWNTRDERLGWVREL

SEQ ID NO: 78223 - protein, 20 aa, Mycobacterium avium
ARVQRPLWASTGVKNPDYSD

SEQ ID NO: 78224 - protein, 25 aa, Mycobacterium avium
ARVSESPWALMHFMVRLPTDDPAAK

SEQ ID NO: 78225 - protein, 19 aa, Mycobacterium avium
ARVSTPLRWDEVAGCRPEA

SEQ ID NO: 78226 - protein, 24 aa, Mycobacterium avium
ARVTRRLVGMLARRGYSQNLACEV

SEQ ID NO: 78227 - protein, 26 aa, Mycobacterium avium
ARVVAKIYCGLGLLKRENIREVHRAD

SEQ ID NO: 78228 - protein, 23 aa, Mycobacterium avium
ARYGRDRIGLLTGDMSVNADAPV

SEQ ID NO: 78229 - protein, 18 aa, Mycobacterium avium
ARYLSIATDVGFRMPSVW

SEQ ID NO: 78230 - protein, 17 aa, Mycobacterium avium
ARYWSRDSVATAMKVVA

SEQ ID NO: 78231 - protein, 22 aa, Mycobacterium avium
ASAGHIYAVIGLKDTTTGDTLS

SEQ ID NO: 78232 - protein, 21 aa, Mycobacterium avium
ASALFLRRGPQPDGRVWSPPV

SEQ ID NO: 78233 - protein, 25 aa, Mycobacterium avium
ASARATQTWRYPPFFHALLDAGVYP

SEQ ID NO: 78234 - protein, 18 aa, Mycobacterium avium
ASATLDWLDAHGHEDLVR

SEQ ID NO: 78235 - protein, 25 aa, Mycobacterium avium
ASAVGGLSVPASWSAAAPATSLASS

SEQ ID NO: 78236 - protein, 18 aa, Mycobacterium avium
ASAWAGVGTPDFVDVPTD

SEQ ID NO: 78237 - protein, 17 aa, Mycobacterium avium
ASDGLGVGEVGYLITGV

SEQ ID NO: 78238 - protein, 18 aa, Mycobacterium avium
ASEIMRLLIAREAVDAHL

SEQ ID NO: 78239 - protein, 30 aa, Mycobacterium avium
ASERPGHRLSETWHPLGVVGVITAFNFPVA

SEQ ID NO: 78240 - protein, 19 aa, Mycobacterium avium
ASGAPVEHIVCIDGAPPGT

SEQ ID NO: 78241 - protein, 26 aa, Mycobacterium avium
ASGEWRPLPAEIYPLAEAKTAFRRMQ

SEQ ID NO: 78242 - protein, 25 aa, Mycobacterium avium
ASGKLRGLPPAQLEDALGLAGTQSA

SEQ ID NO: 78243 - protein, 27 aa, Mycobacterium avium
ASGLERPRSEILTFLAAREAAHHRLFS

SEQ ID NO: 78244 - protein, 18 aa, Mycobacterium avium
ASGLSWLTGYPDRTPYDP

SEQ ID NO: 78245 - protein, 29 aa, Mycobacterium avium
ASGPFGTTIAHGFMTLALLPRLQHQIYTV

SEQ ID NO: 78246 - protein, 18 aa, Mycobacterium avium
ASHNGMWDLSILGVVPGM

SEQ ID NO: 78247 - protein, 18 aa, Mycobacterium avium
ASIAGLFLTTEAVVADKP

SEQ ID NO: 78248 - protein, 19 aa, Mycobacterium avium
ASIARKLGALTVGVVTRPF

SEQ ID NO: 78249 - protein, 25 aa, Mycobacterium avium
ASIHPPRFLVGLSRRNHTFRTARDA

SEQ ID NO: 78250 - protein, 25 aa, Mycobacterium avium
ASIVERLVPDFLWISTEHTARVSLD

SEQ ID NO: 78251 - protein, 22 aa, Mycobacterium avium
ASKNAIPWGDFDTHLARLRELL

SEQ ID NO: 78252 - protein, 22 aa, Mycobacterium avium
ASKRIAPIVVLTAFSQRDLVER

SEQ ID NO: 78253 - protein, 19 aa, Mycobacterium avium
ASLDAVIKYPWRRGEGPGT

SEQ ID NO: 78254 - protein, 27 aa, Mycobacterium avium
ASLHAAKGLEWDAVFLVGLADGTLPIS

SEQ ID NO: 78255 - protein, 22 aa, Mycobacterium avium
ASLLGSAAWILADRPAIQRQLR

SEQ ID NO: 78256 - protein, 19 aa, Mycobacterium avium
ASLPKLPTFTLTSQSLTDG

SEQ ID NO: 78257 - protein, 21 aa, Mycobacterium avium
ASLVGALSVPPTWGATGAAIT

SEQ ID NO: 78258 - protein, 27 aa, Mycobacterium avium
ASMSGWETPGGLPLSGLQAGDASDPAL

SEQ ID NO: 78259 - protein, 19 aa, Mycobacterium avium
ASNAVELFGHYDLIVDGTD

SEQ ID NO: 78260 - protein, 25 aa, Mycobacterium avium
ASNFRCPYHGWTYRNDGRLTGLPFH

SEQ ID NO: 78261 - protein, 19 aa, Mycobacterium avium
ASNTHRWFGPYGVTKSAID

SEQ ID NO: 78262 - protein, 18 aa, Mycobacterium avium
ASRGELLADLALTDQDIA

SEQ ID NO: 78263 - protein, 25 aa, Mycobacterium avium
ASRLWSPVLGCAIGHGVVPDLGDLH

SEQ ID NO: 78264 - protein, 24 aa, Mycobacterium avium
ASRMPCPYLNPGPYVGGRPLVQGM

SEQ ID NO: 78265 - protein, 24 aa, Mycobacterium avium
ASRRVRARLARRMTAQRSTLNPVL

SEQ ID NO: 78266 - protein, 31 aa, Mycobacterium avium
ASRTLDELVEWSLRAVHSFLANPSDPPRDAD

SEQ ID NO: 78267 - protein, 17 aa, Mycobacterium avium
ASSMSEMQAFYDAAFPR

SEQ ID NO: 78268 - protein, 24 aa, Mycobacterium avium
ASSSRAGLGYEVIVSRLDDEANIA

SEQ ID NO: 78269 - protein, 23 aa, Mycobacterium avium
ASTPLFFAQAVGRFVRSRRPGET

SEQ ID NO: 78270 - protein, 24 aa, Mycobacterium avium
ASVAARHRTVWALGDYALMAEEVM

SEQ ID NO: 78271 - protein, 19 aa, Mycobacterium avium
ASVAVLWGEGGTFCAGADL

SEQ ID NO: 78272 - protein, 27 aa, Mycobacterium avium
ASVEVINRFLARFGVAAPFTAEQLRKQ

SEQ ID NO: 78273 - protein, 27 aa, Mycobacterium avium
ASVNGRTVWGVGIAPSITTASLRAVVS

SEQ ID NO: 78274 - protein, 25 aa, Mycobacterium avium
ASVSCAIQNLWLAARAEGLGMGWVS

SEQ ID NO: 78275 - protein, 18 aa, Mycobacterium avium
ASVVSAWVRDGVTAVCAQ

SEQ ID NO: 78276 - protein, 27 aa, Mycobacterium avium
ASYEPKWDGFRSICFRDGDEVELGSRN

SEQ ID NO: 78277 - protein, 19 aa, Mycobacterium avium
ATAAFFAKNMLPRLSGLRG

SEQ ID NO: 78278 - protein, 23 aa, Mycobacterium avium
ATAALDPAAGWIVGVVGVHPYQL

SEQ ID NO: 78279 - protein, 25 aa, Mycobacterium avium
ATAFIYIGEVCRYLLNQPAKPTDRA

SEQ ID NO: 78280 - protein, 26 aa, Mycobacterium avium
ATALAWLVPREFGFRANRCANENHWT

SEQ ID NO: 78281 - protein, 18 aa, Mycobacterium avium
ATAQRLVRCAVAIRTADE

SEQ ID NO: 78282 - protein, 23 aa, Mycobacterium avium
ATCAGVRIWSLYVPNGRAVGDPH

SEQ ID NO: 78283 - protein, 22 aa, Mycobacterium avium
ATCNIEHGCVVAQADTLRGAEI

SEQ ID NO: 78284 - protein, 19 aa, Mycobacterium avium
ATDAAAFFDYLAARPEVSG

SEQ ID NO: 78285 - protein, 24 aa, Mycobacterium avium
ATDFSRPLARVVLDSAPATVLAQT

SEQ ID NO: 78286 - protein, 23 aa, Mycobacterium avium
ATDGRPPAAVPIWYDYTPGGDIR

SEQ ID NO: 78287 - protein, 26 aa, Mycobacterium avium
ATDIAEWLVRQGVPFRSAHEAAGAAV

SEQ ID NO: 78288 - protein, 17 aa, Mycobacterium avium
ATDREVIFWDQLGCGNS

SEQ ID NO: 78289 - protein, 26 aa, Mycobacterium avium
ATDVGFRMPSVWLAEGHARVAPVYLY

SEQ ID NO: 78290 - protein, 17 aa, Mycobacterium avium
ATELGMRTVAVYAADDA

SEQ ID NO: 78291 - protein, 24 aa, Mycobacterium avium
ATGAELRATLLALLGSPHLCSRAF

SEQ ID NO: 78292 - protein, 18 aa, Mycobacterium avium
ATGASWPLLDAGLSHVER

SEQ ID NO: 78293 - protein, 18 aa, Mycobacterium avium
ATGGRIVTCASTLGIKAV

SEQ ID NO: 78294 - protein, 21 aa, Mycobacterium avium
ATGPRSSWRATDPVLYAMCGA

SEQ ID NO: 78295 - protein, 19 aa, Mycobacterium avium
ATGQFLWQNIFGVWPVTGE

SEQ ID NO: 78296 - protein, 21 aa, Mycobacterium avium
ATGQVLLPGFVDLHTHLREPG

SEQ ID NO: 78297 - protein, 23 aa, Mycobacterium avium
ATGRAVGVLADLQGPKIRLGRFA

SEQ ID NO: 78298 - protein, 27 aa, Mycobacterium avium
ATGVKRQEDFIGIHFFSPVDKMPLVEI

SEQ ID NO: 78299 - protein, 20 aa, Mycobacterium avium
ATGWCSWQGLVSLPEIAESD

SEQ ID NO: 78300 - protein, 30 aa, Mycobacterium avium
ATIANGARLNLPWRRDFNALVYVLSGDGYV

SEQ ID NO: 78301 - protein, 18 aa, Mycobacterium avium
ATIKRVFLELGGKSAFVV

SEQ ID NO: 78302 - protein, 18 aa, Mycobacterium avium
ATIRPYRPSLSHPVPPAA

SEQ ID NO: 78303 - protein, 30 aa, Mycobacterium avium
ATKALVRFSEEFGIQVANTFHGKGVMPDDH

SEQ ID NO: 78304 - protein, 26 aa, Mycobacterium avium
ATKEVAWRTADMGWIESVRFGETMRK

SEQ ID NO: 78305 - protein, 28 aa, Mycobacterium avium
ATKGTFRLAFGIGDFRRDTGFGEDPATL

SEQ ID NO: 78306 - protein, 24 aa, Mycobacterium avium
ATKILELARAYGIEALDIDEEERD

SEQ ID NO: 78307 - protein, 19 aa, Mycobacterium avium
ATKRLRLGTLVTGIHYRHP

SEQ ID NO: 78308 - protein, 19 aa, Mycobacterium avium
ATLAELRGPAWSGDAAAAM

SEQ ID NO: 78309 - protein, 30 aa, Mycobacterium avium
ATLGCWKIGAVPVPMHWDLPEWERDRVREV

SEQ ID NO: 78310 - protein, 19 aa, Mycobacterium avium
ATLIPDEWLEPSATGSAQQ

SEQ ID NO: 78311 - protein, 20 aa, Mycobacterium avium
ATLTGEGWFGPSAAKMSAAV

SEQ ID NO: 78312 - protein, 18 aa, Mycobacterium avium
ATLYRRFPTKAALVDAVV

SEQ ID NO: 78313 - protein, 18 aa, Mycobacterium avium
ATPEALVESALWEASLFE

SEQ ID NO: 78314 - protein, 19 aa, Mycobacterium avium
ATPELPLQVIVTGHYQDTF

SEQ ID NO: 78315 - protein, 30 aa, Mycobacterium avium
ATPSQLALAWLLKRSPVMLPIPGTSKVAHL

SEQ ID NO: 78316 - protein, 19 aa, Mycobacterium avium
ATQYELWKAIWSSLNDGNF

SEQ ID NO: 78317 - protein, 24 aa, Mycobacterium avium
ATRAEGVACYQLFISGLLDVTDNV

SEQ ID NO: 78318 - protein, 24 aa, Mycobacterium avium
ATRALAAAVGISWTSELLTVTGVD

SEQ ID NO: 78319 - protein, 19 aa, Mycobacterium avium
ATRDPVLCHSGFQIFGGGV

SEQ ID NO: 78320 - protein, 24 aa, Mycobacterium avium
ATRLRGFDCAIAYHNRRRIDGSPY

SEQ ID NO: 78321 - protein, 21 aa, Mycobacterium avium
ATRPPAVLHRMRQRLPIQPVA

SEQ ID NO: 78322 - protein, 23 aa, Mycobacterium avium
ATRQGIAFIPWFPLAAGPLAAPD

SEQ ID NO: 78323 - protein, 17 aa, Mycobacterium avium
ATRRLALTGTPFRSDDS

SEQ ID NO: 78324 - protein, 26 aa, Mycobacterium avium
ATSAEFRKLLAEWKAAGRAAREVDDA

SEQ ID NO: 78325 - protein, 24 aa, Mycobacterium avium
ATSRPIKLMGIDSVLSLYPSLNDA

SEQ ID NO: 78326 - protein, 26 aa, Mycobacterium avium
ATTEYHGLHAFRWIAADGSARFVRYH

SEQ ID NO: 78327 - protein, 18 aa, Mycobacterium avium
ATTNCFPMIQISGSSDRA

SEQ ID NO: 78328 - protein, 17 aa, Mycobacterium avium
ATVALTGHGGWPMTCFL

SEQ ID NO: 78329 - protein, 17 aa, Mycobacterium avium
ATVDALKVLGAWMGDDG

SEQ ID NO: 78330 - protein, 17 aa, Mycobacterium avium
ATVSIWMGILLTEKLRA

SEQ ID NO: 78331 - protein, 26 aa, Mycobacterium avium
ATVVRRMRLQPGRMFLVDTAQGRIVS

SEQ ID NO: 78332 - protein, 24 aa, Mycobacterium avium
ATVYRRFRHKRNLVRLTIIDESVR

SEQ ID NO: 78333 - protein, 17 aa, Mycobacterium avium
ATWAAFPGVHGKAYRAL

SEQ ID NO: 78334 - protein, 17 aa, Mycobacterium avium
ATWDCFGGLVEMPAMSR

SEQ ID NO: 78335 - protein, 23 aa, Mycobacterium avium
ATYPLDRVADAFAELEQRHTHGK

SEQ ID NO: 78336 - protein, 23 aa, Mycobacterium avium
AVAETMDGFALADLDLKERREGD

SEQ ID NO: 78337 - protein, 27 aa, Mycobacterium avium
AVAGLSLRPGYVLSDGFRVPGLAVPSL

SEQ ID NO: 78338 - protein, 18 aa, Mycobacterium avium
AVAGRIRAAGAVFVGPYS

SEQ ID NO: 78339 - protein, 18 aa, Mycobacterium avium
AVAGRPKEEYGIEPTGLD

SEQ ID NO: 78340 - protein, 22 aa, Mycobacterium avium
AVAPKLPELWGGSADLAESNLT

SEQ ID NO: 78341 - protein, 25 aa, Mycobacterium avium
AVAQLRSGMTIGIGGWGSRRKPMAF

SEQ ID NO: 78342 - protein, 23 aa, Mycobacterium avium
AVASRVGAPLGHDYAVISLSDRL

SEQ ID NO: 78343 - protein, 17 aa, Mycobacterium avium
AVCAAVDALPCAVPRSA

SEQ ID NO: 78344 - protein, 24 aa, Mycobacterium avium
AVCDLEPYWEALRKVYAPFESGLP

SEQ ID NO: 78345 - protein, 25 aa, Mycobacterium avium
AVDARRLGVPLAQELSAYLRGLEPA

SEQ ID NO: 78346 - protein, 25 aa, Mycobacterium avium
AVDGLNRFSASLARDKDNLGRALDT

SEQ ID NO: 78347 - protein, 19 aa, Mycobacterium avium
AVDHVECAHALEAGVRELR

SEQ ID NO: 78348 - protein, 18 aa, Mycobacterium avium
AVDIRYASADAKFSVREV

SEQ ID NO: 78349 - protein, 25 aa, Mycobacterium avium
AVDLRHDWPSALRQAGFDVGRPAAW

SEQ ID NO: 78350 - protein, 25 aa, Mycobacterium avium
AVDRAILRVAVWELLYADDVPEPVA

SEQ ID NO: 78351 - protein, 21 aa, Mycobacterium avium
AVDYLEIWDAQAWQDYQQTHE

SEQ ID NO: 78352 - protein, 24 aa, Mycobacterium avium
AVEAAWRAAMWAKPAGHGINDPNF

SEQ ID NO: 78353 - protein, 19 aa, Mycobacterium avium
AVEAGERLGFLPGTLSEKI

SEQ ID NO: 78354 - protein, 23 aa, Mycobacterium avium
AVEEFIRWASPVMTFRRTAAADV

SEQ ID NO: 78355 - protein, 18 aa, Mycobacterium avium
AVEELLRYLSIIQNGQRR

SEQ ID NO: 78356 - protein, 29 aa, Mycobacterium avium
AVELWKIVDRPNLFIKIPATQAGLPAITA

SEQ ID NO: 78357 - protein, 22 aa, Mycobacterium avium
AVEPGILRPSFRNWDHPYRRQI

SEQ ID NO: 78358 - protein, 23 aa, Mycobacterium avium
AVESGLKVARKWGAEVKGVPAGQ

SEQ ID NO: 78359 - protein, 33 aa, Mycobacterium avium
AVEVALFRLLESWGVRPDFVMGHSIGELSAAHV

SEQ ID NO: 78360 - protein, 18 aa, Mycobacterium avium
AVFEAEFGDGSKLGLQIE

SEQ ID NO: 78361 - protein, 22 aa, Mycobacterium avium
AVGAARRAFGRWSQSSREDRLD

SEQ ID NO: 78362 - protein, 20 aa, Mycobacterium avium
AVGLRPVRRYDDGPVAVVQG

SEQ ID NO: 78363 - protein, 18 aa, Mycobacterium avium
AVGRGDRGPVWVFSGQGS

SEQ ID NO: 78364 - protein, 18 aa, Mycobacterium avium
AVGTFAGFGMDVPVRLSP

SEQ ID NO: 78365 - protein, 25 aa, Mycobacterium avium
AVGVARAAYEYALEYACQREQFGRK

SEQ ID NO: 78366 - protein, 29 aa, Mycobacterium avium
AVIAMLACARLGVMHSVVFAGFTAKALQA

SEQ ID NO: 78367 - protein, 20 aa, Mycobacterium avium
AVIDARRGKMFARLIKNIEV

SEQ ID NO: 78368 - protein, 26 aa, Mycobacterium avium
AVIGRELDRYLPFLATTKVLIAAVRA

SEQ ID NO: 78369 - protein, 20 aa, Mycobacterium avium
AVIIGTGFSGLGMAIALQKQ

SEQ ID NO: 78370 - protein, 20 aa, Mycobacterium avium
AVIISDFLGPINWQRPLRAI

SEQ ID NO: 78371 - protein, 22 aa, Mycobacterium avium
AVLDRNGLRPSRIWVTEDGLVV

SEQ ID NO: 78372 - protein, 26 aa, Mycobacterium avium
AVLLERAPRTAGHWLAVAEAAVRGPL

SEQ ID NO: 78373 - protein, 30 aa, Mycobacterium avium
AVLPALTEVRPTLFLGVPRVWIKAKAGLEA

SEQ ID NO: 78374 - protein, 19 aa, Mycobacterium avium
AVLQRRLPVVVVDQPKGLT

SEQ ID NO: 78375 - protein, 18 aa, Mycobacterium avium
AVLTDWLTQWDIREVIPV

SEQ ID NO: 78376 - protein, 20 aa, Mycobacterium avium
AVLTGWRMLLDNGRMQDGEP

SEQ ID NO: 78377 - protein, 18 aa, Mycobacterium avium
AVMEGSWGSADKGAVNVP

SEQ ID NO: 78378 - protein, 17 aa, Mycobacterium avium
AVMLWGLELDRRLRAAG

SEQ ID NO: 78379 - protein, 19 aa, Mycobacterium avium
AVMREWKFGAADHDRTNVH

SEQ ID NO: 78380 - protein, 25 aa, Mycobacterium avium
AVNGPAIGGGLCLALAADIRVASTS

SEQ ID NO: 78381 - protein, 20 aa, Mycobacterium avium
AVPGRPCPLLSYQCAIDAVS

SEQ ID NO: 78382 - protein, 23 aa, Mycobacterium avium
AVPHMRKQGAGWIVNIGSVTGVA

SEQ ID NO: 78383 - protein, 20 aa, Mycobacterium avium
AVPHPKWWFDLLTTEPLAFA

SEQ ID NO: 78384 - protein, 22 aa, Mycobacterium avium
AVPLPCTVFLQLLGLPLEDLDR

SEQ ID NO: 78385 - protein, 23 aa, Mycobacterium avium
AVPRAAVEPLVLMLAPLAPHMAE

SEQ ID NO: 78386 - protein, 24 aa, Mycobacterium avium
AVQAFARQRIDAILAGVPGAASAA

SEQ ID NO: 78387 - protein, 18 aa, Mycobacterium avium
AVQQCLRSPLQLTTQEER

SEQ ID NO: 78388 - protein, 19 aa, Mycobacterium avium
AVRADWLAREHPWLLRRDL

SEQ ID NO: 78389 - protein, 24 aa, Mycobacterium avium
AVRAELPPVAGIVHAAGEIGTTPL

SEQ ID NO: 78390 - protein, 23 aa, Mycobacterium avium
AVRELRPDLVLLDLMLPGMNGID

SEQ ID NO: 78391 - protein, 27 aa, Mycobacterium avium
AVRGFCWSRGDGLCNVFVPHATAGVAV

SEQ ID NO: 78392 - protein, 23 aa, Mycobacterium avium
AVRGGICVDPVLGSRSYDVMSAI

SEQ ID NO: 78393 - protein, 19 aa, Mycobacterium avium
AVRGTRLAILKGLNVPLHE

SEQ ID NO: 78394 - protein, 17 aa, Mycobacterium avium
AVSAALEVGCRLIDTAA

SEQ ID NO: 78395 - protein, 18 aa, Mycobacterium avium
AVSGWASKQPQPWWDQSA

SEQ ID NO: 78396 - protein, 22 aa, Mycobacterium avium
AVSHPRDARLGSVGKLLPGLEG

SEQ ID NO: 78397 - protein, 24 aa, Mycobacterium avium
AVSIELADGLGLPVLSVASMVARP

SEQ ID NO: 78398 - protein, 30 aa, Mycobacterium avium
AVSKRKLLSRARCLLFPIQWEEPFGIVMIE

SEQ ID NO: 78399 - protein, 24 aa, Mycobacterium avium
AVSREIAELAIRWRDKGVVGFDIA

SEQ ID NO: 78400 - protein, 25 aa, Mycobacterium avium
AVSYEAGDALGVWPRNSDELVDEWL

SEQ ID NO: 78401 - protein, 18 aa, Mycobacterium avium
AVTGCLIAGVPFVPVPAD

SEQ ID NO: 78402 - protein, 32 aa, Mycobacterium avium
AVVGKSPIVARGWRSPLQLLFIDGGHSETAAN

SEQ ID NO: 78403 - protein, 21 aa, Mycobacterium avium
AVVGVAWKHFTETGAVKADAV

SEQ ID NO: 78404 - protein, 19 aa, Mycobacterium avium
AVVHPCARITKLSERIDFV

SEQ ID NO: 78405 - protein, 25 aa, Mycobacterium avium
AVVMSFSASAVWRIRRAAPLLPTVL

SEQ ID NO: 78406 - protein, 20 aa, Mycobacterium avium
AVVPALRFNPELAKVYEPLL

SEQ ID NO: 78407 - protein, 18 aa, Mycobacterium avium
AVVPRAHGSALFQRGETQ

SEQ ID NO: 78408 - protein, 25 aa, Mycobacterium avium
AVVQPRPGTRPSLAELDRFVRSEIA

SEQ ID NO: 78409 - protein, 19 aa, Mycobacterium avium
AVVRVRLVPGTGKFNLNGR

SEQ ID NO: 78410 - protein, 17 aa, Mycobacterium avium
AVVSPVITAHPTETRRR

SEQ ID NO: 78411 - protein, 26 aa, Mycobacterium avium
AVVVEARASGRLMFYGQGAGGAPTAS

SEQ ID NO: 78412 - protein, 20 aa, Mycobacterium avium
AVVVLTEWPQFRSLDWRAVA

SEQ ID NO: 78413 - protein, 22 aa, Mycobacterium avium
AVVYFLRKVIWTVPDFSVARYR

SEQ ID NO: 78414 - protein, 17 aa, Mycobacterium avium
AVYTAWGGFAYGRDLDG

SEQ ID NO: 78415 - protein, 19 aa, Mycobacterium avium
AVYWTARQIGCSWCVDFGS

SEQ ID NO: 78416 - protein, 19 aa, Mycobacterium avium
AWAALPRAGAVIFATGGMD

SEQ ID NO: 78417 - protein, 18 aa, Mycobacterium avium
AWATCFDGQLSILSHPER

SEQ ID NO: 78418 - protein, 21 aa, Mycobacterium avium
AWEETAYQYAWLLAAAEGDRY

SEQ ID NO: 78419 - protein, 25 aa, Mycobacterium avium
AWEGRARLDFRGEFYTHTIMAPTFD

SEQ ID NO: 78420 - protein, 18 aa, Mycobacterium avium
AWEMKGRFPDILNNPATG

SEQ ID NO: 78421 - protein, 23 aa, Mycobacterium avium
AWEPKTGAVGSLWDVVRDRRLNH

SEQ ID NO: 78422 - protein, 18 aa, Mycobacterium avium
AWGLPYAALMAGADLVLP

SEQ ID NO: 78423 - protein, 19 aa, Mycobacterium avium
AWITARVAIPHIMAGKRGG

SEQ ID NO: 78424 - protein, 17 aa, Mycobacterium avium
AWLRCMHTAVASIDSKT

SEQ ID NO: 78425 - protein, 21 aa, Mycobacterium avium
AWPALCSGLRAEARQGRMLPY

SEQ ID NO: 78426 - protein, 21 aa, Mycobacterium avium
AWPATLDRLLALGGPGARYVP

SEQ ID NO: 78427 - protein, 18 aa, Mycobacterium avium
AWPQPRADDSVAITTLRE

SEQ ID NO: 78428 - protein, 25 aa, Mycobacterium avium
AWQGDTGMTYQVWQAQWNEAMESLV

SEQ ID NO: 78429 - protein, 18 aa, Mycobacterium avium
AWQPDDLLIVLFGIALAW

SEQ ID NO: 78430 - protein, 23 aa, Mycobacterium avium
AWSAEGLLPFLPAAAQQLLFERV

SEQ ID NO: 78431 - protein, 19 aa, Mycobacterium avium
AWSGSRFAQRPVLREDIHR

SEQ ID NO: 78432 - protein, 26 aa, Mycobacterium avium
AWTLAMGHAMIRAGLPPKLHDKKPGG

SEQ ID NO: 78433 - protein, 19 aa, Mycobacterium avium
AYAARAGITCAVLIPQGKI

SEQ ID NO: 78434 - protein, 18 aa, Mycobacterium avium
AYADWVWLAVRTNPEAKK

SEQ ID NO: 78435 - protein, 23 aa, Mycobacterium avium
AYAEGLRALYLFTSTYQDAAVAE

SEQ ID NO: 78436 - protein, 30 aa, Mycobacterium avium
AYAKKFRFPTFLGAFKYYTSYTLKTFDGKR

SEQ ID NO: 78437 - protein, 19 aa, Mycobacterium avium
AYDPGWRIAGVTNHCVVSH

SEQ ID NO: 78438 - protein, 21 aa, Mycobacterium avium
AYFRSEVHGLESFPPGGALVV

SEQ ID NO: 78439 - protein, 18 aa, Mycobacterium avium
AYGGTFLQFSDYMRPAVR

SEQ ID NO: 78440 - protein, 19 aa, Mycobacterium avium
AYGRYMIRVKEMWESIKIV

SEQ ID NO: 78441 - protein, 20 aa, Mycobacterium avium
AYHGYPWLIHRLTYRRANHA

SEQ ID NO: 78442 - protein, 19 aa, Mycobacterium avium
AYLKIDYRSIVPIETELQF

SEQ ID NO: 78443 - protein, 18 aa, Mycobacterium avium
AYMRGRTLNSAFIVLDEA

SEQ ID NO: 78444 - protein, 26 aa, Mycobacterium avium
AYNPCFPEYRFTGLDAEKATGRVDFP

SEQ ID NO: 78445 - protein, 24 aa, Mycobacterium avium
AYPLPVAVICRLLGVPLDDEPQFS

SEQ ID NO: 78446 - protein, 27 aa, Mycobacterium avium
AYQRIFARLQVRYVIVSAVSGAMGGSA

SEQ ID NO: 78447 - protein, 20 aa, Mycobacterium avium
AYRPAPPVRRDRIPINATVP

SEQ ID NO: 78448 - protein, 20 aa, Mycobacterium avium
CADGRYVAVGAIEPQFYAAM

SEQ ID NO: 78449 - protein, 18 aa, Mycobacterium avium
CADPRPLGYDDSVAFCAA

SEQ ID NO: 78450 - protein, 18 aa, Mycobacterium avium
CAEHVLPHVAEWFEIGDL

SEQ ID NO: 78451 - protein, 18 aa, Mycobacterium avium
CAEIRLSALEALRTPLED

SEQ ID NO: 78452 - protein, 18 aa, Mycobacterium avium
CAGDDEWCVISIRSDDEW

SEQ ID NO: 78453 - protein, 20 aa, Mycobacterium avium
CAGFDLSAYADRTGSAGGTG

SEQ ID NO: 78454 - protein, 21 aa, Mycobacterium avium
CAKAQALVAERGFEITAAAGG

SEQ ID NO: 78455 - protein, 20 aa, Mycobacterium avium
CALAHLGGHPVAVVANQPQV

SEQ ID NO: 78456 - protein, 22 aa, Mycobacterium avium
CALLGLECVIYMGAVDTERQAL

SEQ ID NO: 78457 - protein, 21 aa, Mycobacterium avium
CALPLHRRFGLAATARASFAV

SEQ ID NO: 78458 - protein, 19 aa, Mycobacterium avium
CAMVGCPIIGIQDSGGARI

SEQ ID NO: 78459 - protein, 17 aa, Mycobacterium avium
CAPCTAKPLAGADPRSG

SEQ ID NO: 78460 - protein, 20 aa, Mycobacterium avium
CAPDHPWAREHRNWFTELPD

SEQ ID NO: 78461 - protein, 19 aa, Mycobacterium avium
CAPQPIRRPPILIGGDGEK

SEQ ID NO: 78462 - protein, 20 aa, Mycobacterium avium
CAQDLLWGPAMRNYPDLKFA

SEQ ID NO: 78463 - protein, 22 aa, Mycobacterium avium
CAREVADVVAPVLGWTAGDVER

SEQ ID NO: 78464 - protein, 23 aa, Mycobacterium avium
CARVLRPSGLLLMSTPNRITFSP

SEQ ID NO: 78465 - protein, 19 aa, Mycobacterium avium
CDAIREMLLHPAGVLGLSD

SEQ ID NO: 78466 - protein, 20 aa, Mycobacterium avium
CDAMARLGGVTMSKAGLRLQ

SEQ ID NO: 78467 - protein, 24 aa, Mycobacterium avium
CDCGPQLDAAMAMVAREGRGIVLY

SEQ ID NO: 78468 - protein, 17 aa, Mycobacterium avium
CDLQRPAAVNQLQVVGE

SEQ ID NO: 78469 - protein, 24 aa, Mycobacterium avium
CDQLMPEYLRFVKGVVDAQDMSLN

SEQ ID NO: 78470 - protein, 25 aa, Mycobacterium avium
CDRPIADVCPVEWARMENRSVLQWD

SEQ ID NO: 78471 - protein, 22 aa, Mycobacterium avium
CDVTVGLICGRSGTLLVDTGTT

SEQ ID NO: 78472 - protein, 19 aa, Mycobacterium avium
CEDAPKTAWLFTGQGSQYA

SEQ ID NO: 78473 - protein, 28 aa, Mycobacterium avium
CEDIGVDIAFNWDHFFPLYGDPDGAHFE

SEQ ID NO: 78474 - protein, 19 aa, Mycobacterium avium
CEIRTRRYGAYEVHATSAP

SEQ ID NO: 78475 - protein, 19 aa, Mycobacterium avium
CEMRVRIDGRKGGLIESEA

SEQ ID NO: 78476 - protein, 17 aa, Mycobacterium avium
CEMVIDYNFPFTLDAIT

SEQ ID NO: 78477 - protein, 17 aa, Mycobacterium avium
CEPVCPVEAIYYEDDVP

SEQ ID NO: 78478 - protein, 27 aa, Mycobacterium avium
CESLYHFAWDEFCDWYVELAKTQLAEG

SEQ ID NO: 78479 - protein, 17 aa, Mycobacterium avium
CEVFTVAPNFAFEHAAV

SEQ ID NO: 78480 - protein, 19 aa, Mycobacterium avium
CFAEDPRSGPAVLRNPDLI

SEQ ID NO: 78481 - protein, 19 aa, Mycobacterium avium
CGAGVAAMLAGRRITVDGA

SEQ ID NO: 78482 - protein, 19 aa, Mycobacterium avium
CGALSRSGPTTGTPVLPPD

SEQ ID NO: 78483 - protein, 27 aa, Mycobacterium avium
CGAPILTLRTDRDWIADIVRFVESRRR

SEQ ID NO: 78484 - protein, 21 aa, Mycobacterium avium
CGEGADALWLAQRGWTVLAVD

SEQ ID NO: 78485 - protein, 30 aa, Mycobacterium avium
CGGCAAPATRWCPACAAELVVKPDEPHVVN

SEQ ID NO: 78486 - protein, 26 aa, Mycobacterium avium
CGGRFTLGIGPSHHWIVNGQLGLPYE

SEQ ID NO: 78487 - protein, 26 aa, Mycobacterium avium
CGRAYDPRFLFAWPTSKSAVMGGAQL

SEQ ID NO: 78488 - protein, 20 aa, Mycobacterium avium
CGRTPSALSRWAVRQAEMIL

SEQ ID NO: 78489 - protein, 21 aa, Mycobacterium avium
CGSCPTCQAGMRNLCDLGAGL

SEQ ID NO: 78490 - protein, 17 aa, Mycobacterium avium
CGSRIFVQRGVYDRVVE

SEQ ID NO: 78491 - protein, 18 aa, Mycobacterium avium
CGTADMKSGDAVFLHLAA

SEQ ID NO: 78492 - protein, 19 aa, Mycobacterium avium
CGVNWPRVRVNGPIVRAAM

SEQ ID NO: 78493 - protein, 21 aa, Mycobacterium avium
CGWATARSGPDFELYRDYHDR

SEQ ID NO: 78494 - protein, 18 aa, Mycobacterium avium
CHDALKLGLEVAIASGGL

SEQ ID NO: 78495 - protein, 17 aa, Mycobacterium avium
CHTCTRRKTAGTVRNLV

SEQ ID NO: 78496 - protein, 20 aa, Mycobacterium avium
CILHSRLLLPDSLHDDVVDR

SEQ ID NO: 78497 - protein, 19 aa, Mycobacterium avium
CKRLGRYVVGIGVAGASSR

SEQ ID NO: 78498 - protein, 17 aa, Mycobacterium avium
CKSNVLYKGALQGDPAS

SEQ ID NO: 78499 - protein, 19 aa, Mycobacterium avium
CLNVGCIPSKALLRNAELA

SEQ ID NO: 78500 - protein, 30 aa, Mycobacterium avium
CLTGQHWLDVCAMLGLPEFGEHQLAIMLGG

SEQ ID NO: 78501 - protein, 25 aa, Mycobacterium avium
CLTMARDLGSVGVRVLAIAPSLFAT

SEQ ID NO: 78502 - protein, 26 aa, Mycobacterium avium
CMDARLDVYRILGLREGEAHVIRNAG

SEQ ID NO: 78503 - protein, 18 aa, Mycobacterium avium
CMHIFGGAGYLVEETPLG

SEQ ID NO: 78504 - protein, 24 aa, Mycobacterium avium
CNEALDRVRVPVLLVGGWQDLFIR

SEQ ID NO: 78505 - protein, 26 aa, Mycobacterium avium
CNSPAWDLPTVFGPIAVTYHLTGVSG

SEQ ID NO: 78506 - protein, 26 aa, Mycobacterium avium
CPAALADRWAPGRVMINAYGPTETTV

SEQ ID NO: 78507 - protein, 22 aa, Mycobacterium avium
CPAEDLAPLARRLRPLRAPAGQ

SEQ ID NO: 78508 - protein, 23 aa, Mycobacterium avium
CPAPCEPACVLGINQDPVTIKQI

SEQ ID NO: 78509 - protein, 18 aa, Mycobacterium avium
CPDWPQPAQHGGSYRIEV

SEQ ID NO: 78510 - protein, 20 aa, Mycobacterium avium
CPGGMLTPQIERFSAPDDPN

SEQ ID NO: 78511 - protein, 17 aa, Mycobacterium avium
CPVRPVGRWIVDPDGAV

SEQ ID NO: 78512 - protein, 20 aa, Mycobacterium avium
CPVVTPATLFDEWFPANKLV

SEQ ID NO: 78513 - protein, 24 aa, Mycobacterium avium
CPVWREPAHGVVMVSGYDEALAVQ

SEQ ID NO: 78514 - protein, 19 aa, Mycobacterium avium
CQRAIGITLARMMTRRQFG

SEQ ID NO: 78515 - protein, 20 aa, Mycobacterium avium
CQYGASGIRCNAVAPGVTVT

SEQ ID NO: 78516 - protein, 19 aa, Mycobacterium avium
CRDERGGSVAVEIKRRGEI

SEQ ID NO: 78517 - protein, 26 aa, Mycobacterium avium
CREGHCGACACTLRKGQVSMEVNDVL

SEQ ID NO: 78518 - protein, 19 aa, Mycobacterium avium
CRQFTCKYHGWRYDLTGAL

SEQ ID NO: 78519 - protein, 17 aa, Mycobacterium avium
CRSDLGGALVLSEFTGA

SEQ ID NO: 78520 - protein, 17 aa, Mycobacterium avium
CSAVHPLALASPFFAEF

SEQ ID NO: 78521 - protein, 21 aa, Mycobacterium avium
CSCTSRIYVQRGIYDQVVEGL

SEQ ID NO: 78522 - protein, 20 aa, Mycobacterium avium
CSDGVVIPTECEYFSLRGLA

SEQ ID NO: 78523 - protein, 19 aa, Mycobacterium avium
CSPGGSFINGQTIVVDGGW

SEQ ID NO: 78524 - protein, 18 aa, Mycobacterium avium
CTAGHPPPLLVTADATAR

SEQ ID NO: 78525 - protein, 20 aa, Mycobacterium avium
CTGVVFPAFPALLAAEQGFN

SEQ ID NO: 78526 - protein, 19 aa, Mycobacterium avium
CTYREGLSAVRIDGGVAGN

SEQ ID NO: 78527 - protein, 18 aa, Mycobacterium avium
CVAQCRPNTAPTVLQTDA

SEQ ID NO: 78528 - protein, 25 aa, Mycobacterium avium
CVAQTRILAPRSRYDEIVDAVSTFV

SEQ ID NO: 78529 - protein, 19 aa, Mycobacterium avium
CVEARVDVVVLAFGENRGL

SEQ ID NO: 78530 - protein, 19 aa, Mycobacterium avium
CVEFSAARPGMLGLQTALS

SEQ ID NO: 78531 - protein, 25 aa, Mycobacterium avium
CVGSLDFGSGEFSYCTAGHPPPLLV

SEQ ID NO: 78532 - protein, 18 aa, Mycobacterium avium
CVIDHPLAAARLTVLRDE

SEQ ID NO: 78533 - protein, 19 aa, Mycobacterium avium
CVPVLMAALGRITGTDTGT

SEQ ID NO: 78534 - protein, 20 aa, Mycobacterium avium
CVSHQLPVWTLRLHLTGRRL

SEQ ID NO: 78535 - protein, 18 aa, Mycobacterium avium
CVTLDYDKMRGMDSDEYR

SEQ ID NO: 78536 - protein, 19 aa, Mycobacterium avium
CYDELFIGGQWRKPANPQQ

SEQ ID NO: 78537 - protein, 18 aa, Mycobacterium avium
CYLAMPLFHSNGVAAGWA

SEQ ID NO: 78538 - protein, 17 aa, Mycobacterium avium
CYVRVTEQLARGWMSLA

SEQ ID NO: 78539 - protein, 18 aa, Mycobacterium avium
DAAAKVFAAEGFAGATID

SEQ ID NO: 78540 - protein, 27 aa, Mycobacterium avium
DAAARGDFRAPLVIGDRLDTDIEGANA

SEQ ID NO: 78541 - protein, 17 aa, Mycobacterium avium
DAAAVTVNFRFAPDRSP

SEQ ID NO: 78542 - protein, 21 aa, Mycobacterium avium
DAAHLMPVWQGQGYNSGIRDA

SEQ ID NO: 78543 - protein, 24 aa, Mycobacterium avium
DAALGRDFLTIWFAQLHQQVADIR

SEQ ID NO: 78544 - protein, 17 aa, Mycobacterium avium
DAALPATSWGVRAAGDP

SEQ ID NO: 78545 - protein, 22 aa, Mycobacterium avium
DAAPELPCEVEVDSLEQLDEVL

SEQ ID NO: 78546 - protein, 18 aa, Mycobacterium avium
DAAPTLGAGLDWKTSLQE

SEQ ID NO: 78547 - protein, 25 aa, Mycobacterium avium
DAARGDAELIAWIKAVAGRARRMVT

SEQ ID NO: 78548 - protein, 21 aa, Mycobacterium avium
DAATRKALLESLLRNVPTDGL

SEQ ID NO: 78549 - protein, 25 aa, Mycobacterium avium
DAAVARAGSEFAVLGRQVAIGGQLL

SEQ ID NO: 78550 - protein, 20 aa, Mycobacterium avium
DAAVKVMGRNGFHRMSMHDL

SEQ ID NO: 78551 - protein, 26 aa, Mycobacterium avium
DADEWLIARWGCLRAANLAWGCGDAE

SEQ ID NO: 78552 - protein, 18 aa, Mycobacterium avium
DADGLPMSVQLVGRPYDE

SEQ ID NO: 78553 - protein, 29 aa, Mycobacterium avium
DADLAVLGYYEWREGLLRGLAAHHAGMLP

SEQ ID NO: 78554 - protein, 24 aa, Mycobacterium avium
DADVIRYLRWFTFLSADELGELER

SEQ ID NO: 78555 - protein, 18 aa, Mycobacterium avium
DADYIWLACRTDPEAVKH

SEQ ID NO: 78556 - protein, 23 aa, Mycobacterium avium
DAEFRVGTMGLGWDSEAQTVVVE

SEQ ID NO: 78557 - protein, 23 aa, Mycobacterium avium
DAEKYRRLHVIVGDSNMCETTTM

SEQ ID NO: 78558 - protein, 21 aa, Mycobacterium avium
DAEPVFPLVQAMPVPYVEPED

SEQ ID NO: 78559 - protein, 18 aa, Mycobacterium avium
DAFQEYYHVPALHSQQVP

SEQ ID NO: 78560 - protein, 21 aa, Mycobacterium avium
DAGLAIARRFAHLTYRGEVEL

SEQ ID NO: 78561 - protein, 25 aa, Mycobacterium avium
DAGLLAGAVTMVWQRGELLQVNEIG

SEQ ID NO: 78562 - protein, 26 aa, Mycobacterium avium
DAGLPELPWFATDGAQEFGGAPVPDT

SEQ ID NO: 78563 - protein, 24 aa, Mycobacterium avium
DAGRRPAIVMPLRARDEVVGVIAI

SEQ ID NO: 78564 - protein, 17 aa, Mycobacterium avium
DAGVAFVNALPVFIASD

SEQ ID NO: 78565 - protein, 23 aa, Mycobacterium avium
DAGVAWKDIQFGFGGSYEVSNPD

SEQ ID NO: 78566 - protein, 18 aa, Mycobacterium avium
DAGVDLFLCDSTNAELPG

SEQ ID NO: 78567 - protein, 23 aa, Mycobacterium avium
DAHARLLVWELIDALRRDGVTVV

SEQ ID NO: 78568 - protein, 25 aa, Mycobacterium avium
DAHDLSSLRLLGSVGEPINPEAWRW

SEQ ID NO: 78569 - protein, 26 aa, Mycobacterium avium
DAHLYLKRLLGYSAFLGGPDRYLTEV

SEQ ID NO: 78570 - protein, 26 aa, Mycobacterium avium
DAHTGIQLYVKRVFIMGDCDQLMPEY

SEQ ID NO: 78571 - protein, 26 aa, Mycobacterium avium
DAIARFKRLDGFDVRFLTGTDEHGLK

SEQ ID NO: 78572 - protein, 18 aa, Mycobacterium avium
DAIELSALGALRLIQAFT

SEQ ID NO: 78573 - protein, 22 aa, Mycobacterium avium
DAIKELFSMSATRYYQVLNALV

SEQ ID NO: 78574 - protein, 24 aa, Mycobacterium avium
DAIVKLVAHPRPRVRVTRTAGAII

SEQ ID NO: 78575 - protein, 23 aa, Mycobacterium avium
DAKESRGIHALRARGAQIRIGHD

SEQ ID NO: 78576 - protein, 21 aa, Mycobacterium avium
DAKRMFACFDQPDLKATFDVR

SEQ ID NO: 78577 - protein, 20 aa, Mycobacterium avium
DALELSMAFFRGDVETTTEL

SEQ ID NO: 78578 - protein, 18 aa, Mycobacterium avium
DALGAGLGALGFGRGTLY

SEQ ID NO: 78579 - protein, 19 aa, Mycobacterium avium
DALIGYARKRRDIVAITAA

SEQ ID NO: 78580 - protein, 20 aa, Mycobacterium avium
DALRAAGIVCFGPGKDAARI

SEQ ID NO: 78581 - protein, 22 aa, Mycobacterium avium
DALRALPLVGKFAYRVMHSVKA

SEQ ID NO: 78582 - protein, 18 aa, Mycobacterium avium
DALRCFATLFGDDALKPL

SEQ ID NO: 78583 - protein, 27 aa, Mycobacterium avium
DALSDTELLDFTALAKVFGYPTTTEAQ

SEQ ID NO: 78584 - protein, 20 aa, Mycobacterium avium
DALTMFGAIGFTWEHDLHLY

SEQ ID NO: 78585 - protein, 20 aa, Mycobacterium avium
DAMPTFRQVFMAGASGMTLE

SEQ ID NO: 78586 - protein, 20 aa, Mycobacterium avium
DANIGSIMGIGFPPYTGGSA

SEQ ID NO: 78587 - protein, 24 aa, Mycobacterium avium
DAPLRAMIFDSVYDIYRGVVTYVR

SEQ ID NO: 78588 - protein, 23 aa, Mycobacterium avium
DAPVRERLALGFGSSSFRYAGPA

SEQ ID NO: 78589 - protein, 30 aa, Mycobacterium avium
DAQLSAGTVLSRFGFPGGGYLAPEGTPFAE

SEQ ID NO: 78590 - protein, 18 aa, Mycobacterium avium
DAQTCTRAAESIGGLGIV

SEQ ID NO: 78591 - protein, 21 aa, Mycobacterium avium
DARATHPLLCKSGALQRSPDY

SEQ ID NO: 78592 - protein, 26 aa, Mycobacterium avium
DARAYRLDWPAGAVVYEVDQPKVVEF

SEQ ID NO: 78593 - protein, 22 aa, Mycobacterium avium
DARFGWPKRNGFVQPLVDAELL

SEQ ID NO: 78594 - protein, 25 aa, Mycobacterium avium
DASTPFDAFIRLISPTRLFTTSFKD

SEQ ID NO: 78595 - protein, 22 aa, Mycobacterium avium
DATQIHGGYGFMNEYPVARHYR

SEQ ID NO: 78596 - protein, 24 aa, Mycobacterium avium
DATVEVAIRLGVDPRKADQMVRGT

SEQ ID NO: 78597 - protein, 23 aa, Mycobacterium avium
DAVAEMTVALLLAATRHLLPADA

SEQ ID NO: 78598 - protein, 25 aa, Mycobacterium avium
DAVLPRSRWTTELSEGARLEVVTAV

SEQ ID NO: 78599 - protein, 20 aa, Mycobacterium avium
DAVLYTRAGPEIGVASTKTF

SEQ ID NO: 78600 - protein, 29 aa, Mycobacterium avium
DAVMFVCPEPRPLLDVVLKLVEAVDTDNE

SEQ ID NO: 78601 - protein, 19 aa, Mycobacterium avium
DAVMILPVSYWKLTEREIF

SEQ ID NO: 78602 - protein, 22 aa, Mycobacterium avium
DAVNPRLNAIVCRLDDVADRQA

SEQ ID NO: 78603 - protein, 18 aa, Mycobacterium avium
DAVRRLTSVPARVAGLGD

SEQ ID NO: 78604 - protein, 18 aa, Mycobacterium avium
DAVTRLVGLTGITFTNVF

SEQ ID NO: 78605 - protein, 25 aa, Mycobacterium avium
DAWEGRAGEYVAIPAERHALHAVED

SEQ ID NO: 78606 - protein, 18 aa, Mycobacterium avium
DAYFARFGGVRDYLHAVV

SEQ ID NO: 78607 - protein, 25 aa, Mycobacterium avium
DAYFSYPPLQGFGMPSGECSIEPWI

SEQ ID NO: 78608 - protein, 25 aa, Mycobacterium avium
DAYKTGRGSIRMRGVVEVEEDSRGR

SEQ ID NO: 78609 - protein, 17 aa, Mycobacterium avium
DCCQESDGGVALVVTSV

SEQ ID NO: 78610 - protein, 23 aa, Mycobacterium avium
DCFRPGTCERLGIGPDDCAAVNP

SEQ ID NO: 78611 - protein, 19 aa, Mycobacterium avium
DCGGFHRAAAALHLSQSAV

SEQ ID NO: 78612 - protein, 26 aa, Mycobacterium avium
DCPIPDPLDLLAFLAGHTTRLGLATG

SEQ ID NO: 78613 - protein, 19 aa, Mycobacterium avium
DCSLQRRFQKLVEEAPAPF

SEQ ID NO: 78614 - protein, 22 aa, Mycobacterium avium
DCTGLLPLASVAAMQGRIAMYH

SEQ ID NO: 78615 - protein, 17 aa, Mycobacterium avium
DCVGHGLASATVMGQVR

SEQ ID NO: 78616 - protein, 17 aa, Mycobacterium avium
DDADFASAAAFGVTYRT

SEQ ID NO: 78617 - protein, 25 aa, Mycobacterium avium
DDAFAEVMFSAAIWSSNQDKLRPKV

SEQ ID NO: 78618 - protein, 21 aa, Mycobacterium avium
DDDIRCCILTGAGGYFCAGMD

SEQ ID NO: 78619 - protein, 25 aa, Mycobacterium avium
DDELAGSAHFVWVRETLRLGDKFPL

SEQ ID NO: 78620 - protein, 28 aa, Mycobacterium avium
DDFAELFLPAPLRWLVGATRFAPVRHLM

SEQ ID NO: 78621 - protein, 17 aa, Mycobacterium avium
DDFFALSQTEWGCIGNE

SEQ ID NO: 78622 - protein, 23 aa, Mycobacterium avium
DDFGMGLLLKGRQVKKVIASYVG

SEQ ID NO: 78623 - protein, 17 aa, Mycobacterium avium
DDGCCSHGAFLSDDDDR

SEQ ID NO: 78624 - protein, 24 aa, Mycobacterium avium
DDGIGLDEYVDWLIEAGYPIERVD

SEQ ID NO: 78625 - protein, 19 aa, Mycobacterium avium
DDIDPAWLEGVTTVGVTSG

SEQ ID NO: 78626 - protein, 20 aa, Mycobacterium avium
DDIGCVIHSHPVWATMFAIA

SEQ ID NO: 78627 - protein, 23 aa, Mycobacterium avium
DDLKLCSSMTLFAHATDDNADFL

SEQ ID NO: 78628 - protein, 17 aa, Mycobacterium avium
DDLRIAVDGGFLSVTEE

SEQ ID NO: 78629 - protein, 17 aa, Mycobacterium avium
DDLVARLLAGRRIATAE

SEQ ID NO: 78630 - protein, 28 aa, Mycobacterium avium
DDLVIAKCFLLWAGVLGAISLEVFGQYG

SEQ ID NO: 78631 - protein, 26 aa, Mycobacterium avium
DDMAPICQMFHTLPIPWVEPIDISNA

SEQ ID NO: 78632 - protein, 24 aa, Mycobacterium avium
DDNGTPLLEWLRRRGVDEVDVVGI

SEQ ID NO: 78633 - protein, 23 aa, Mycobacterium avium
DDPDVARWVRRFAGHAVSPEKAA

SEQ ID NO: 78634 - protein, 20 aa, Mycobacterium avium
DDPRAAGPSRVFEATGDPEA

SEQ ID NO: 78635 - protein, 25 aa, Mycobacterium avium
DDPRFGTAEARLAHRRELVELVSAW

SEQ ID NO: 78636 - protein, 17 aa, Mycobacterium avium
DDQFPIDVFQTGSGTSS

SEQ ID NO: 78637 - protein, 19 aa, Mycobacterium avium
DDSPIPFVRYEAGPDGVRR

SEQ ID NO: 78638 - protein, 22 aa, Mycobacterium avium
DDSRRLLQMIGRDMGLDIKRYS

SEQ ID NO: 78639 - protein, 21 aa, Mycobacterium avium
DDTKLDWARGFGATHTVNARQ

SEQ ID NO: 78640 - protein, 18 aa, Mycobacterium avium
DDTVDGWGSLDYSVDLAS

SEQ ID NO: 78641 - protein, 17 aa, Mycobacterium avium
DDVDTWMASPYAPQGVA

SEQ ID NO: 78642 - protein, 18 aa, Mycobacterium avium
DDYLRFVRMLLGDGTIDG

SEQ ID NO: 78643 - protein, 30 aa, Mycobacterium avium
DEAIRRFHLADAREAVNLALRTLLHEGDSV

SEQ ID NO: 78644 - protein, 21 aa, Mycobacterium avium
DEALTRRGLRHALDKTTDLAE

SEQ ID NO: 78645 - protein, 31 aa, Mycobacterium avium
DEARKAGRRFARLAPIVGTYRKLMAAREDLE

SEQ ID NO: 78646 - protein, 17 aa, Mycobacterium avium
DEDCSFADLGIDSLALA

SEQ ID NO: 78647 - protein, 20 aa, Mycobacterium avium
DEDLLNFAFLLLVAGNETTR

SEQ ID NO: 78648 - protein, 18 aa, Mycobacterium avium
DEDLPMFHTRAVQLISYH

SEQ ID NO: 78649 - protein, 23 aa, Mycobacterium avium
DEDRELLESFDLTYGEDEGTEED

SEQ ID NO: 78650 - protein, 24 aa, Mycobacterium avium
DEEDGRCSAGFAALLDAIVEALED

SEQ ID NO: 78651 - protein, 27 aa, Mycobacterium avium
DEEKKLFARMAEVFAGFLSYTDAQIGR

SEQ ID NO: 78652 - protein, 20 aa, Mycobacterium avium
DEELSCWRITLDRLDAATFD

SEQ ID NO: 78653 - protein, 28 aa, Mycobacterium avium
DEFHPELQFDRPYLLAMANAGPGTNGSQ

SEQ ID NO: 78654 - protein, 23 aa, Mycobacterium avium
DEFRLYELIWQRTVASQMADARG

SEQ ID NO: 78655 - protein, 22 aa, Mycobacterium avium
DEFTYPLKWGWVDVDEVVSVLA

SEQ ID NO: 78656 - protein, 22 aa, Mycobacterium avium
DEGAAAVVMCRADIAHRYSAKP

SEQ ID NO: 78657 - protein, 22 aa, Mycobacterium avium
DEGGRRVGARIVVVTHTATDAA

SEQ ID NO: 78658 - protein, 19 aa, Mycobacterium avium
DEICWRARIRPTRAVADLD

SEQ ID NO: 78659 - protein, 21 aa, Mycobacterium avium
DEIGTPFCVTVDFDSLEDNAV

SEQ ID NO: 78660 - protein, 24 aa, Mycobacterium avium
DEKLPRYIAGVLARLQEVWMGRQI

SEQ ID NO: 78661 - protein, 24 aa, Mycobacterium avium
DELDAIRIGRRIVARLNWVKQGPT

SEQ ID NO: 78662 - protein, 29 aa, Mycobacterium avium
DELGGFRIAVRRAKILAGLDEDADVRIVT

SEQ ID NO: 78663 - protein, 17 aa, Mycobacterium avium
DELGRILGVKGRVLPMC

SEQ ID NO: 78664 - protein, 31 aa, Mycobacterium avium
DELIRGGVRDVVLCPGSRNAPLAFALADADR

SEQ ID NO: 78665 - protein, 17 aa, Mycobacterium avium
DELLALKPDCVVYNPMW

SEQ ID NO: 78666 - protein, 25 aa, Mycobacterium avium
DELLDRVSSKYALVIYAAKRARQIN

SEQ ID NO: 78667 - protein, 25 aa, Mycobacterium avium
DELRKSRVHCCVVPGAAIRALLRLV

SEQ ID NO: 78668 - protein, 24 aa, Mycobacterium avium
DELWLRFRQAALYAYAAPLITAGM

SEQ ID NO: 78669 - protein, 24 aa, Mycobacterium avium
DEPMRALCMPLVHVFEGIGETPTY

SEQ ID NO: 78670 - protein, 18 aa, Mycobacterium avium
DEPYRRALRVIRGRLTAT

SEQ ID NO: 78671 - protein, 19 aa, Mycobacterium avium
DEQRLHAALTHLRANAPVS

SEQ ID NO: 78672 - protein, 22 aa, Mycobacterium avium
DERDRPLLDLTWDYPTDEHGDP

SEQ ID NO: 78673 - protein, 19 aa, Mycobacterium avium
DESPIVFLRLRKAARKHGV

SEQ ID NO: 78674 - protein, 21 aa, Mycobacterium avium
DESVAKLGYFSQFRDQNITAG

SEQ ID NO: 78675 - protein, 26 aa, Mycobacterium avium
DESVKYRLGRGMARIEAAMSTPGMYG

SEQ ID NO: 78676 - protein, 25 aa, Mycobacterium avium
DETAHPLVICDLGMPRDVDPAVAGL

SEQ ID NO: 78677 - protein, 22 aa, Mycobacterium avium
DETLPFISIRLWQPISENETEV

SEQ ID NO: 78678 - protein, 22 aa, Mycobacterium avium
DETNFEYGLTCILDHASRLIEE

SEQ ID NO: 78679 - protein, 20 aa, Mycobacterium avium
DEVACPFHDWRWGGDGRCKL

SEQ ID NO: 78680 - protein, 21 aa, Mycobacterium avium
DEVCCYFPGYTPRPADVADLI

SEQ ID NO: 78681 - protein, 23 aa, Mycobacterium avium
DEVFPLGSTIGVNRARGALVQLY

SEQ ID NO: 78682 - protein, 25 aa, Mycobacterium avium
DEVMMGWRSFECYLPIVQVAGAIAV

SEQ ID NO: 78683 - protein, 20 aa, Mycobacterium avium
DEVQDAFELACRPVADRIKI

SEQ ID NO: 78684 - protein, 20 aa, Mycobacterium avium
DEWASPSGRRMDLPMRGNIL

SEQ ID NO: 78685 - protein, 17 aa, Mycobacterium avium
DEWTDWHWYSTVVQSNC

SEQ ID NO: 78686 - protein, 17 aa, Mycobacterium avium
DEYQGFMAIRQWAKQFY

SEQ ID NO: 78687 - protein, 19 aa, Mycobacterium avium
DFHDNRIAVRFQYECRDRS

SEQ ID NO: 78688 - protein, 24 aa, Mycobacterium avium
DFKQCPLLYRFRAIDRLPEAPSPA

SEQ ID NO: 78689 - protein, 25 aa, Mycobacterium avium
DFMPVVWAMFEWGRRHLPGRHRLQL

SEQ ID NO: 78690 - protein, 21 aa, Mycobacterium avium
DFMSYLNLWRYLREQRKELSG

SEQ ID NO: 78691 - protein, 19 aa, Mycobacterium avium
DFPELKFSLTEGDVGWIPY

SEQ ID NO: 78692 - protein, 24 aa, Mycobacterium avium
DFRFFAAPGSWTLRALSAAGNGNA

SEQ ID NO: 78693 - protein, 19 aa, Mycobacterium avium
DFRLNRRPVTVGGVDLPAG

SEQ ID NO: 78694 - protein, 17 aa, Mycobacterium avium
DFVKLGFEQDVEIWRHK

SEQ ID NO: 78695 - protein, 24 aa, Mycobacterium avium
DFVSHLFGMFAFAIVERDSGRVLL

SEQ ID NO: 78696 - protein, 24 aa, Mycobacterium avium
DFVSTWRVLEEFARDGRARSIGVS

SEQ ID NO: 78697 - protein, 20 aa, Mycobacterium avium
DFYAGNPYPAYRELRATAPV

SEQ ID NO: 78698 - protein, 23 aa, Mycobacterium avium
DGADIGARCELLRGARVWPGVSI

SEQ ID NO: 78699 - protein, 26 aa, Mycobacterium avium
DGAHFECWTMLGAWAEQTSRIQIGAL

SEQ ID NO: 78700 - protein, 18 aa, Mycobacterium avium
DGALLARSGARWYAAPAA

SEQ ID NO: 78701 - protein, 17 aa, Mycobacterium avium
DGARWRVIVDQIASYTE

SEQ ID NO: 78702 - protein, 22 aa, Mycobacterium avium
DGAYRRTLRLGFGTGIVTLTPA

SEQ ID NO: 78703 - protein, 17 aa, Mycobacterium avium
DGDDPWPAAAFHRELAS

SEQ ID NO: 78704 - protein, 25 aa, Mycobacterium avium
DGEFDEWQRLFLFTRADTIYGGSNE

SEQ ID NO: 78705 - protein, 25 aa, Mycobacterium avium
DGEFVKFGPSWAWPKPVQPHIPVLV

SEQ ID NO: 78706 - protein, 24 aa, Mycobacterium avium
DGEPFVLHPGEFVLGSTLELITLP

SEQ ID NO: 78707 - protein, 24 aa, Mycobacterium avium
DGERRPGWVGLPLTGVQTRVVDDD

SEQ ID NO: 78708 - protein, 20 aa, Mycobacterium avium
DGGAHYGMICDASYSTYFLT

SEQ ID NO: 78709 - protein, 20 aa, Mycobacterium avium
DGGTFDWTQGRFPGFTTPDP

SEQ ID NO: 78710 - protein, 21 aa, Mycobacterium avium
DGGYLASSWAVYRAELALVEV

SEQ ID NO: 78711 - protein, 17 aa, Mycobacterium avium
DGGYTIDGQKMWLTNGA

SEQ ID NO: 78712 - protein, 17 aa, Mycobacterium avium
DGIGYPVELVLGPERVI

SEQ ID NO: 78713 - protein, 22 aa, Mycobacterium avium
DGIRLGDYDIGIAIGLDKHPRG

SEQ ID NO: 78714 - protein, 24 aa, Mycobacterium avium
DGKAEWYRNRWVRSPATSKALGQP

SEQ ID NO: 78715 - protein, 19 aa, Mycobacterium avium
DGKTKFILVRTGEERQGVV

SEQ ID NO: 78716 - protein, 26 aa, Mycobacterium avium
DGLAALPARIAVRWRHIHEFEDVGGD

SEQ ID NO: 78717 - protein, 22 aa, Mycobacterium avium
DGLPHVPVRLHARSWHRYPEPS

SEQ ID NO: 78718 - protein, 22 aa, Mycobacterium avium
DGLPVELGMTIRLARDKNYDLL

SEQ ID NO: 78719 - protein, 19 aa, Mycobacterium avium
DGLTPRAVAECERLGLGGW

SEQ ID NO: 78720 - protein, 18 aa, Mycobacterium avium
DGLVRFVDACHARGLGVL

SEQ ID NO: 78721 - protein, 18 aa, Mycobacterium avium
DGMFPPMHLDAEYDDDGT

SEQ ID NO: 78722 - protein, 17 aa, Mycobacterium avium
DGMRLHIRTPGDLESLE

SEQ ID NO: 78723 - protein, 25 aa, Mycobacterium avium
DGMSELRGLLTPELRATLEAVLAKL

SEQ ID NO: 78724 - protein, 25 aa, Mycobacterium avium
DGMSELRGWLSPELRATLEAVLAKL

SEQ ID NO: 78725 - protein, 20 aa, Mycobacterium avium
DGNDVLACYAVTAEAAARAR

SEQ ID NO: 78726 - protein, 22 aa, Mycobacterium avium
DGPDLVLRWAALLHDIGKPATR

SEQ ID NO: 78727 - protein, 22 aa, Mycobacterium avium
DGPRAATAWPAALRPALSTAGF

SEQ ID NO: 78728 - protein, 19 aa, Mycobacterium avium
DGQFGKWLAGARDWSISRN

SEQ ID NO: 78729 - protein, 21 aa, Mycobacterium avium
DGQFPTLPFFELGYEVAHVGF

SEQ ID NO: 78730 - protein, 18 aa, Mycobacterium avium
DGQGWLRRAQEFERAAGR

SEQ ID NO: 78731 - protein, 17 aa, Mycobacterium avium
DGQKRLKNARVLVIGAG

SEQ ID NO: 78732 - protein, 18 aa, Mycobacterium avium
DGQWTRAKGHDTFCPVGP

SEQ ID NO: 78733 - protein, 25 aa, Mycobacterium avium
DGRLLKLTLHPGVMTGYGHGELADR

SEQ ID NO: 78734 - protein, 27 aa, Mycobacterium avium
DGRRRDYRWAEADRHLWIADERGTWHL

SEQ ID NO: 78735 - protein, 17 aa, Mycobacterium avium
DGSDFVFMDSQDYEQHP

SEQ ID NO: 78736 - protein, 21 aa, Mycobacterium avium
DGSGPWPGVVMYPDAGGVRDT

SEQ ID NO: 78737 - protein, 18 aa, Mycobacterium avium
DGSIRPRLAAATTASALT

SEQ ID NO: 78738 - protein, 23 aa, Mycobacterium avium
DGSRAAMHAAVWAIDEAVGRDIP

SEQ ID NO: 78739 - protein, 17 aa, Mycobacterium avium
DGTAPVYFGFGSTPVSS

SEQ ID NO: 78740 - protein, 28 aa, Mycobacterium avium
DGTWKIALRRCTVEWTLQGDGSALKSGN

SEQ ID NO: 78741 - protein, 25 aa, Mycobacterium avium
DGVARLFEHGRICGVQDGPPETVFA

SEQ ID NO: 78742 - protein, 18 aa, Mycobacterium avium
DGVLHEFTTVPGVKEDVT

SEQ ID NO: 78743 - protein, 18 aa, Mycobacterium avium
DGVLRLTIPVAEAAKPRK

SEQ ID NO: 78744 - protein, 23 aa, Mycobacterium avium
DGVPRVETHLEWQMTPHTDPSWN

SEQ ID NO: 78745 - protein, 18 aa, Mycobacterium avium
DGVRFCAVCGNVSDDERC

SEQ ID NO: 78746 - protein, 18 aa, Mycobacterium avium
DGVYAAWFTVLGHGPVTG

SEQ ID NO: 78747 - protein, 18 aa, Mycobacterium avium
DGWRVMREALAYERVGIA

SEQ ID NO: 78748 - protein, 20 aa, Mycobacterium avium
DGYGRLRGMSALVTTFGVGE

SEQ ID NO: 78749 - protein, 20 aa, Mycobacterium avium
DGYGWLQPRLSPVARSALPP

SEQ ID NO: 78750 - protein, 23 aa, Mycobacterium avium
DGYRVPNELPIHVETMLADPRHT

SEQ ID NO: 78751 - protein, 24 aa, Mycobacterium avium
DGYYRTGDVFAEIAPDRLVYVDRR

SEQ ID NO: 78752 - protein, 26 aa, Mycobacterium avium
DHAGKWRVVFFWPKDFTFVCPTEIAT

SEQ ID NO: 78753 - protein, 22 aa, Mycobacterium avium
DHARVSPDIMCVGKALTGGYLS

SEQ ID NO: 78754 - protein, 18 aa, Mycobacterium avium
DHDAAVAIAERLRAEGHR

SEQ ID NO: 78755 - protein, 18 aa, Mycobacterium avium
DHDLTFRGDFPLNTAGGQ

SEQ ID NO: 78756 - protein, 18 aa, Mycobacterium avium
DHHVHLRSAASALDSFFV

SEQ ID NO: 78757 - protein, 18 aa, Mycobacterium avium
DHIDVYLVHWPDPRMPAA

SEQ ID NO: 78758 - protein, 26 aa, Mycobacterium avium
DHPKKLWRPKVPIIVLVGEPIQPTLG

SEQ ID NO: 78759 - protein, 19 aa, Mycobacterium avium
DHPKKVFRNKVPITVAAGR

SEQ ID NO: 78760 - protein, 19 aa, Mycobacterium avium
DHRFLEIIDRGSLSELDRW

SEQ ID NO: 78761 - protein, 22 aa, Mycobacterium avium
DHVHEWRTWPGYSEQERLAAEF

SEQ ID NO: 78762 - protein, 25 aa, Mycobacterium avium
DIACSACYWAQALVLGVDLNMPREL

SEQ ID NO: 78763 - protein, 31 aa, Mycobacterium avium
DIDKFAPRLSFFWGIGMNFFMEVAKLRAGRL

SEQ ID NO: 78764 - protein, 20 aa, Mycobacterium avium
DIEAEIVRRGWAVGESLGSE

SEQ ID NO: 78765 - protein, 22 aa, Mycobacterium avium
DIEALGYGAVWVGGSPPAELAW

SEQ ID NO: 78766 - protein, 18 aa, Mycobacterium avium
DIEAQGWIAPAECVEVRV

SEQ ID NO: 78767 - protein, 17 aa, Mycobacterium avium
DIELDLRGSEFQRRVWR

SEQ ID NO: 78768 - protein, 18 aa, Mycobacterium avium
DIGEAVGIVAAQSIGEPG

SEQ ID NO: 78769 - protein, 21 aa, Mycobacterium avium
DIGRLMVSLHMGLRKTSNLDD

SEQ ID NO: 78770 - protein, 17 aa, Mycobacterium avium
DIGWQVIDASGWSPARV

SEQ ID NO: 78771 - protein, 22 aa, Mycobacterium avium
DIMLLAHGWALKHWHFGPIYTL

SEQ ID NO: 78772 - protein, 26 aa, Mycobacterium avium
DIPDNEFRVVLARRGQHWVSAVRVGG

SEQ ID NO: 78773 - protein, 25 aa, Mycobacterium avium
DIRGRGGIGLAEFWATQGPLSYLGL

SEQ ID NO: 78774 - protein, 18 aa, Mycobacterium avium
DIRKRPGTGDVIAVIDPA

SEQ ID NO: 78775 - protein, 17 aa, Mycobacterium avium
DIRRYGATYMNYVGKPL

SEQ ID NO: 78776 - protein, 21 aa, Mycobacterium avium
DISLLGKARKVVVTKDETTIV

SEQ ID NO: 78777 - protein, 20 aa, Mycobacterium avium
DITCPVLAFVGEVDDIGQPA

SEQ ID NO: 78778 - protein, 24 aa, Mycobacterium avium
DITKEVLAALGITVLAEPGFEADD

SEQ ID NO: 78779 - protein, 22 aa, Mycobacterium avium
DITKLRYHKIVLMADADVDGQH

SEQ ID NO: 78780 - protein, 23 aa, Mycobacterium avium
DITVNVDGFWMLQALLDIRHVAP

SEQ ID NO: 78781 - protein, 25 aa, Mycobacterium avium
DIVSGLAIVSALCRVWGATPTSSGK

SEQ ID NO: 78782 - protein, 25 aa, Mycobacterium avium
DIVSGWAGVQPWPGTGAVPPSPFPV

SEQ ID NO: 78783 - protein, 22 aa, Mycobacterium avium
DIWDKGKAAVIWSETKVTAPDG

SEQ ID NO: 78784 - protein, 24 aa, Mycobacterium avium
DIWGRRRLAYEIAKHAEGIYVVID

SEQ ID NO: 78785 - protein, 18 aa, Mycobacterium avium
DIYDEFLELAAIRTKAVR

SEQ ID NO: 78786 - protein, 20 aa, Mycobacterium avium
DIYYRADATLQFGYESGYDR

SEQ ID NO: 78787 - protein, 23 aa, Mycobacterium avium
DKARAVRVIDWFIGATARRRYQI

SEQ ID NO: 78788 - protein, 22 aa, Mycobacterium avium
DKDIPHVSPPVIVKYITDLQLL

SEQ ID NO: 78789 - protein, 23 aa, Mycobacterium avium
DKDSRGGSSFAEFAANAKALTGN

SEQ ID NO: 78790 - protein, 22 aa, Mycobacterium avium
DKDYQRYGGVEFYSALEKGSPE

SEQ ID NO: 78791 - protein, 18 aa, Mycobacterium avium
DKGARWDPAELGPVVADL

SEQ ID NO: 78792 - protein, 17 aa, Mycobacterium avium
DKGRILTAMSVFFFGLV

SEQ ID NO: 78793 - protein, 24 aa, Mycobacterium avium
DKIARIGIRVADVLDREVLTHKIE

SEQ ID NO: 78794 - protein, 24 aa, Mycobacterium avium
DKLDLKPGMTLLDIGCGWGTTMKR

SEQ ID NO: 78795 - protein, 21 aa, Mycobacterium avium
DKLKDAGFYWATRSGVTVSMA

SEQ ID NO: 78796 - protein, 18 aa, Mycobacterium avium
DKLMGFGHRVYRAEDPRA

SEQ ID NO: 78797 - protein, 25 aa, Mycobacterium avium
DKPDLRFGLELVECSEFFKDTTFRV

SEQ ID NO: 78798 - protein, 21 aa, Mycobacterium avium
DKPLMRRKLAELIVDVEAAQA

SEQ ID NO: 78799 - protein, 24 aa, Mycobacterium avium
DKSNWWAAYALWVFTLFGHPDVRL

SEQ ID NO: 78800 - protein, 22 aa, Mycobacterium avium
DKTGHPFLQHLLAHRDATRLKV

SEQ ID NO: 78801 - protein, 18 aa, Mycobacterium avium
DKWFEIMTAVLDVAKAGA

SEQ ID NO: 78802 - protein, 19 aa, Mycobacterium avium
DKYSLSQRVARFATEHAWT

SEQ ID NO: 78803 - protein, 18 aa, Mycobacterium avium
DLALQCAPDHPWAREHRN

SEQ ID NO: 78804 - protein, 17 aa, Mycobacterium avium
DLALWLELRTPRWVSGE

SEQ ID NO: 78805 - protein, 20 aa, Mycobacterium avium
DLARLDAGLGDAIRDLTDGR

SEQ ID NO: 78806 - protein, 18 aa, Mycobacterium avium
DLAVTFRFGEEVTAVDVG

SEQ ID NO: 78807 - protein, 20 aa, Mycobacterium avium
DLAYGYARNQMTAYVELQER

SEQ ID NO: 78808 - protein, 24 aa, Mycobacterium avium
DLDDALRSWLAFGREKVAEVVTLA

SEQ ID NO: 78809 - protein, 25 aa, Mycobacterium avium
DLDKSRYGLVPVHCDVWEGFVFVNF

SEQ ID NO: 78810 - protein, 19 aa, Mycobacterium avium
DLDNLRLVHPLIVAVQTLF

SEQ ID NO: 78811 - protein, 24 aa, Mycobacterium avium
DLDRVFKVNGFAGAEYKKLRDILG

SEQ ID NO: 78812 - protein, 25 aa, Mycobacterium avium
DLFEVNEAFAPVVLAWAQDTGADLD

SEQ ID NO: 78813 - protein, 23 aa, Mycobacterium avium
DLFQRIPVYELRNPGGWAPTART

SEQ ID NO: 78814 - protein, 18 aa, Mycobacterium avium
DLGEEFDDNFVFPPGMVL

SEQ ID NO: 78815 - protein, 24 aa, Mycobacterium avium
DLGEGFGVWRLGDDDAMLGIVSSA

SEQ ID NO: 78816 - protein, 23 aa, Mycobacterium avium
DLGGACSMSAFTAAMHAGQGCAI

SEQ ID NO: 78817 - protein, 21 aa, Mycobacterium avium
DLHDATVFYTVMGRTLDDEPD

SEQ ID NO: 78818 - protein, 23 aa, Mycobacterium avium
DLHLPWQWGAHWFLQQLVDGDLA

SEQ ID NO: 78819 - protein, 17 aa, Mycobacterium avium
DLHTRTLRRAAWEAYMA

SEQ ID NO: 78820 - protein, 20 aa, Mycobacterium avium
DLIHTPGIYVDRIIQGIGYE

SEQ ID NO: 78821 - protein, 19 aa, Mycobacterium avium
DLLALGALLHDIGKGRGVD

SEQ ID NO: 78822 - protein, 24 aa, Mycobacterium avium
DLLDSWPGTLIVVSHDRYLLERVT

SEQ ID NO: 78823 - protein, 22 aa, Mycobacterium avium
DLLKCSFCGKSQKQVKKLIAGP

SEQ ID NO: 78824 - protein, 17 aa, Mycobacterium avium
DLLRFWVGDNLVKTAAR

SEQ ID NO: 78825 - protein, 23 aa, Mycobacterium avium
DLLSDGRLEIGLGTGYVREEFEA

SEQ ID NO: 78826 - protein, 18 aa, Mycobacterium avium
DLLVRLAAGDARRALTAL

SEQ ID NO: 78827 - protein, 19 aa, Mycobacterium avium
DLLWSRPIKEFPDLKIALS

SEQ ID NO: 78828 - protein, 24 aa, Mycobacterium avium
DLMDEAWWLPSVFIANGGAVAASL

SEQ ID NO: 78829 - protein, 29 aa, Mycobacterium avium
DLNQLWMCGLPGYFPGDLIDFEFSGDTIE

SEQ ID NO: 78830 - protein, 19 aa, Mycobacterium avium
DLPWLRSLTDLPLIIKGIC

SEQ ID NO: 78831 - protein, 22 aa, Mycobacterium avium
DLQDRYLFIQAIETQKAYDDGV

SEQ ID NO: 78832 - protein, 27 aa, Mycobacterium avium
DLQSIDGIGAMWARHVREGLSQLAEST

SEQ ID NO: 78833 - protein, 21 aa, Mycobacterium avium
DLRGLLGAFMFSGPQLDQPAG

SEQ ID NO: 78834 - protein, 22 aa, Mycobacterium avium
DLRGRFRWWGLYTQREQGYDGS

SEQ ID NO: 78835 - protein, 24 aa, Mycobacterium avium
DLRHPRGRELFCELVEKSDIVVEN

SEQ ID NO: 78836 - protein, 33 aa, Mycobacterium avium
DLRKTSEGWRMYTRARFAPYVEKLLLDGARSKL

SEQ ID NO: 78837 - protein, 25 aa, Mycobacterium avium
DLSISRTSFDWGVKVPDHPDHVMYV

SEQ ID NO: 78838 - protein, 21 aa, Mycobacterium avium
DLSRVPLWVEETLRYDTSSQI

SEQ ID NO: 78839 - protein, 23 aa, Mycobacterium avium
DLTDYLLEMGIRVRYLHSEVDTL

SEQ ID NO: 78840 - protein, 18 aa, Mycobacterium avium
DLVFPLQVVINLSDPQTD

SEQ ID NO: 78841 - protein, 22 aa, Mycobacterium avium
DLVPTLLGLLGISVPPDVDGVS

SEQ ID NO: 78842 - protein, 27 aa, Mycobacterium avium
DLVVAIERLGRWCVPGPVVESIAVAPV

SEQ ID NO: 78843 - protein, 20 aa, Mycobacterium avium
DLWLNESFATFASVLCQSEA

SEQ ID NO: 78844 - protein, 23 aa, Mycobacterium avium
DLYPLVRRSIRVGADSFSLKALE

SEQ ID NO: 78845 - protein, 24 aa, Mycobacterium avium
DMADRRLGGLAGKTAVLVGAGAMG

SEQ ID NO: 78846 - protein, 25 aa, Mycobacterium avium
DMDLAMKAVPLWSSRGCMPGKLMPV

SEQ ID NO: 78847 - protein, 22 aa, Mycobacterium avium
DMDTGLLIGERVKLLTPQPATP

SEQ ID NO: 78848 - protein, 22 aa, Mycobacterium avium
DMHLYFKRAHGSAHLLDTPQQL

SEQ ID NO: 78849 - protein, 17 aa, Mycobacterium avium
DMIDRMLFAEALETQKC

SEQ ID NO: 78850 - protein, 17 aa, Mycobacterium avium
DMINGFAPNAAVREHDP

SEQ ID NO: 78851 - protein, 17 aa, Mycobacterium avium
DMRSGRMSDEDWTRLAR

SEQ ID NO: 78852 - protein, 24 aa, Mycobacterium avium
DMTERAHLAFGEIMDLAVGLGGTI

SEQ ID NO: 78853 - protein, 22 aa, Mycobacterium avium
DMVDGKVIALVRARSDEEARAR

SEQ ID NO: 78854 - protein, 24 aa, Mycobacterium avium
DNACVDLKAALAMHLGSDVAPEQI

SEQ ID NO: 78855 - protein, 24 aa, Mycobacterium avium
DNALLPWRTVRSNIELALRLRGQP

SEQ ID NO: 78856 - protein, 23 aa, Mycobacterium avium
DNGMPIDHVDWIRDGVITALAYP

SEQ ID NO: 78857 - protein, 22 aa, Mycobacterium avium
DNLRRGGIQFADTRGYAYDRRD

SEQ ID NO: 78858 - protein, 17 aa, Mycobacterium avium
DNLTFVINCNLQRLDGP

SEQ ID NO: 78859 - protein, 19 aa, Mycobacterium avium
DNTFYCFGTAAGPHPFPAM

SEQ ID NO: 78860 - protein, 24 aa, Mycobacterium avium
DPAALESFPGWLHDGDVVTLRVEG

SEQ ID NO: 78861 - protein, 20 aa, Mycobacterium avium
DPAAQVAFCGRLGEVDHSSD

SEQ ID NO: 78862 - protein, 30 aa, Mycobacterium avium
DPAERAEALWKRWREGGVLFAKTFPDQTSD

SEQ ID NO: 78863 - protein, 20 aa, Mycobacterium avium
DPAQGVVVRTAWVYTGGTGK

SEQ ID NO: 78864 - protein, 29 aa, Mycobacterium avium
DPARRSLLHWQCVHPIPPASTETLRTDPR

SEQ ID NO: 78865 - protein, 18 aa, Mycobacterium avium
DPCDASRPAITTLVDYEQ

SEQ ID NO: 78866 - protein, 22 aa, Mycobacterium avium
DPCSDVSVVFARGTHQEPGLGN

SEQ ID NO: 78867 - protein, 25 aa, Mycobacterium avium
DPDERGMRTVMCILNGQLRPVVVRD

SEQ ID NO: 78868 - protein, 18 aa, Mycobacterium avium
DPDLPPSHHYLAAYHWLD

SEQ ID NO: 78869 - protein, 19 aa, Mycobacterium avium
DPDTKIIVMIGEIGGDAEE

SEQ ID NO: 78870 - protein, 23 aa, Mycobacterium avium
DPEAFTRLAARFLGPAVSGVRPV

SEQ ID NO: 78871 - protein, 24 aa, Mycobacterium avium
DPEAYLRAVIAWHFGADTGSPFWL

SEQ ID NO: 78872 - protein, 21 aa, Mycobacterium avium
DPEGMKAYAKAAGSAMSGATV

SEQ ID NO: 78873 - protein, 22 aa, Mycobacterium avium
DPFCAAHPLVRVQLETSLRSAE

SEQ ID NO: 78874 - protein, 25 aa, Mycobacterium avium
DPGAGVAARGGHRLDLTATELRVLT

SEQ ID NO: 78875 - protein, 26 aa, Mycobacterium avium
DPGCPFAPRCPLAIDECRSQEPELLP

SEQ ID NO: 78876 - protein, 24 aa, Mycobacterium avium
DPGHSFPAIALCRRFADAGDTPTL

SEQ ID NO: 78877 - protein, 21 aa, Mycobacterium avium
DPGLHRRWLRDTSTAPPGGES

SEQ ID NO: 78878 - protein, 26 aa, Mycobacterium avium
DPIIVPGCLDLLFRGEIPDGVDPASL

SEQ ID NO: 78879 - protein, 21 aa, Mycobacterium avium
DPIPHGLLFERFLNPERPSAP

SEQ ID NO: 78880 - protein, 27 aa, Mycobacterium avium
DPIVLPGSLNWRVVVPPGGRWQTEVMV

SEQ ID NO: 78881 - protein, 26 aa, Mycobacterium avium
DPLWLRRRVGMCFQRPTPFPGTVADN

SEQ ID NO: 78882 - protein, 17 aa, Mycobacterium avium
DPNDLYDVLAINAASAS

SEQ ID NO: 78883 - protein, 24 aa, Mycobacterium avium
DPNKHLAFGYGVHFCMGAALARME

SEQ ID NO: 78884 - protein, 22 aa, Mycobacterium avium
DPNVRPSLIADRELAVSRIEHL

SEQ ID NO: 78885 - protein, 18 aa, Mycobacterium avium
DPNWGRVVAAVGIAPIAL

SEQ ID NO: 78886 - protein, 26 aa, Mycobacterium avium
DPPFEGMWWLYVPMAFDDFAIVLIIQ

SEQ ID NO: 78887 - protein, 20 aa, Mycobacterium avium
DPPTVSALFSKLTGDVDPAK

SEQ ID NO: 78888 - protein, 18 aa, Mycobacterium avium
DPQGCLTFSLGHDPDKLP

SEQ ID NO: 78889 - protein, 18 aa, Mycobacterium avium
DPRLRVPRRAEPRTAVPA

SEQ ID NO: 78890 - protein, 24 aa, Mycobacterium avium
DPRMKANVGIRRRLAPLLDNDRNQ

SEQ ID NO: 78891 - protein, 23 aa, Mycobacterium avium
DPSGNCLEVFHGVALEHRRVVSP

SEQ ID NO: 78892 - protein, 17 aa, Mycobacterium avium
DPSYHGVVFAELGPPAY

SEQ ID NO: 78893 - protein, 20 aa, Mycobacterium avium
DPTLRRLLPDFYRPDDNGDE

SEQ ID NO: 78894 - protein, 18 aa, Mycobacterium avium
DPVGEVLRGYTLPNGLQL

SEQ ID NO: 78895 - protein, 17 aa, Mycobacterium avium
DPVQGFFRALQFTLPHD

SEQ ID NO: 78896 - protein, 19 aa, Mycobacterium avium
DPVVLAAMIVIRLQTVVSR

SEQ ID NO: 78897 - protein, 17 aa, Mycobacterium avium
DPVVLLHGGEFGASAEL

SEQ ID NO: 78898 - protein, 27 aa, Mycobacterium avium
DQAAPKARDAWQFFQRMLADVTAIVTE

SEQ ID NO: 78899 - protein, 20 aa, Mycobacterium avium
DQAGPHPGRGLALSARSLLA

SEQ ID NO: 78900 - protein, 29 aa, Mycobacterium avium
DQAMRLRDLLKFDFYFADSATFRDNIAEE

SEQ ID NO: 78901 - protein, 18 aa, Mycobacterium avium
DQAREFARRSGRPAMLAH

SEQ ID NO: 78902 - protein, 24 aa, Mycobacterium avium
DQARLLCEKAAWTIDQHGNKAAHL

SEQ ID NO: 78903 - protein, 19 aa, Mycobacterium avium
DQDCCQLFLPRRVATHAAV

SEQ ID NO: 78904 - protein, 17 aa, Mycobacterium avium
DQIVPVFVEDAENKVVA

SEQ ID NO: 78905 - protein, 25 aa, Mycobacterium avium
DQLCSRFSRRLGITVASVDYRLAPE

SEQ ID NO: 78906 - protein, 26 aa, Mycobacterium avium
DQLMKAALPFGLWVPVLPGTRQVTVG

SEQ ID NO: 78907 - protein, 21 aa, Mycobacterium avium
DQLPGKWGEYLLASRATTIYG

SEQ ID NO: 78908 - protein, 17 aa, Mycobacterium avium
DQLRGWLDQILSATAGK

SEQ ID NO: 78909 - protein, 20 aa, Mycobacterium avium
DQLSKLARRLMDCLNPDGRY

SEQ ID NO: 78910 - protein, 20 aa, Mycobacterium avium
DQMDVCVIDHPLAAARLTVL

SEQ ID NO: 78911 - protein, 20 aa, Mycobacterium avium
DQMLAYNLSPSFNWDTTGMT

SEQ ID NO: 78912 - protein, 17 aa, Mycobacterium avium
DQRDFTLWKGAKPGEPS

SEQ ID NO: 78913 - protein, 19 aa, Mycobacterium avium
DQRVRAAVTARCIAAAVFG

SEQ ID NO: 78914 - protein, 26 aa, Mycobacterium avium
DQTLCSTWDLTDWRGEAIRIGFVART

SEQ ID NO: 78915 - protein, 23 aa, Mycobacterium avium
DQVATLFRMWLRDAVRRVAAGAL

SEQ ID NO: 78916 - protein, 19 aa, Mycobacterium avium
DQVCTARLLARLGAVEPDV

SEQ ID NO: 78917 - protein, 30 aa, Mycobacterium avium
DQVLIDLNVRWRKGQTLDPDWKIEQDGWVI

SEQ ID NO: 78918 - protein, 24 aa, Mycobacterium avium
DQVLRSGLFGPWDKPEIIEKLDLP

SEQ ID NO: 78919 - protein, 17 aa, Mycobacterium avium
DRAALDAALADRRAFTG

SEQ ID NO: 78920 - protein, 19 aa, Mycobacterium avium
DRAALPYVVGTIAGDDTVF

SEQ ID NO: 78921 - protein, 25 aa, Mycobacterium avium
DRAARYGDRVFLRFGDQQLTYRDAN

SEQ ID NO: 78922 - protein, 19 aa, Mycobacterium avium
DRAGAPFVGPAGRLLARAL

SEQ ID NO: 78923 - protein, 23 aa, Mycobacterium avium
DRAMGLYGLEVFGAQVTVVDDPR

SEQ ID NO: 78924 - protein, 17 aa, Mycobacterium avium
DRARAAGRQAIEHNLGL

SEQ ID NO: 78925 - protein, 21 aa, Mycobacterium avium
DRATGALKWTATANDLVFGSN

SEQ ID NO: 78926 - protein, 25 aa, Mycobacterium avium
DRCAVGIPDASGWRMLSGDETGWLL

SEQ ID NO: 78927 - protein, 19 aa, Mycobacterium avium
DRDAAWPVICAQLRDTVGV

SEQ ID NO: 78928 - protein, 20 aa, Mycobacterium avium
DRDAWEFALLRGALQRGLPV

SEQ ID NO: 78929 - protein, 39 aa, Mycobacterium avium
DRDDVAALLRWLGNGNFLLLGYQRCRVHDGLVSGDGSPG

SEQ ID NO: 78930 - protein, 24 aa, Mycobacterium avium
DRDGFVFGEAGALMLIETEEHAKA

SEQ ID NO: 78931 - protein, 23 aa, Mycobacterium avium
DRDGVRTPMQWTPDRNAGFSKAN

SEQ ID NO: 78932 - protein, 19 aa, Mycobacterium avium
DRELGHWAAEMNRVKRGPL

SEQ ID NO: 78933 - protein, 24 aa, Mycobacterium avium
DREPDARIALPTREDQALIYRLSG

SEQ ID NO: 78934 - protein, 19 aa, Mycobacterium avium
DRFAEPLVRAVGVDFFTRW

SEQ ID NO: 78935 - protein, 18 aa, Mycobacterium avium
DRFEGRPVTEHLIRTTWP

SEQ ID NO: 78936 - protein, 32 aa, Mycobacterium avium
DRFNELVMRAGLRWQQVVLLRAYAKYLRQANF

SEQ ID NO: 78937 - protein, 19 aa, Mycobacterium avium
DRFRDDLDAWVGILTANGD

SEQ ID NO: 78938 - protein, 22 aa, Mycobacterium avium
DRGFYAGAVGWCDARGDGRWVV

SEQ ID NO: 78939 - protein, 25 aa, Mycobacterium avium
DRGLLPPPLRVGRIALFNDTHLTRL

SEQ ID NO: 78940 - protein, 23 aa, Mycobacterium avium
DRGLRFMSACGVADRNLQTAEIY

SEQ ID NO: 78941 - protein, 18 aa, Mycobacterium avium
DRGLSVEIDDRFAEYDRD

SEQ ID NO: 78942 - protein, 18 aa, Mycobacterium avium
DRGRPCIGDLIERRVRGN

SEQ ID NO: 78943 - protein, 23 aa, Mycobacterium avium
DRHLLRPLRDVIWGDDENVLNST

SEQ ID NO: 78944 - protein, 24 aa, Mycobacterium avium
DRIGRLAVRLDVSRLVVVGTGRSV

SEQ ID NO: 78945 - protein, 18 aa, Mycobacterium avium
DRIGRRPGARWAADLVSA

SEQ ID NO: 78946 - protein, 25 aa, Mycobacterium avium
DRITELRSGALLDLDAAFTTQRAPY

SEQ ID NO: 78947 - protein, 25 aa, Mycobacterium avium
DRIVLCAGAIETAHLLMLSGIGEPG

SEQ ID NO: 78948 - protein, 20 aa, Mycobacterium avium
DRIVSIGAFEHFGRDRYDDF

SEQ ID NO: 78949 - protein, 20 aa, Mycobacterium avium
DRIVSIGAFEHFGRQRYGRF

SEQ ID NO: 78950 - protein, 20 aa, Mycobacterium avium
DRIVSIGAFEHFGYDRYDDF

SEQ ID NO: 78951 - protein, 19 aa, Mycobacterium avium
DRKVAFKRSYRDVDVLLVD

SEQ ID NO: 78952 - protein, 20 aa, Mycobacterium avium
DRLAEAFAERMHQRVRKEFW

SEQ ID NO: 78953 - protein, 22 aa, Mycobacterium avium
DRLDAEILAAVKRRTEVSQAIG

SEQ ID NO: 78954 - protein, 19 aa, Mycobacterium avium
DRLDDLLALAHEVRMRWCG

SEQ ID NO: 78955 - protein, 25 aa, Mycobacterium avium
DRLETWWRTGLLCIGDAAHAMSPAG

SEQ ID NO: 78956 - protein, 19 aa, Mycobacterium avium
DRLPMDKLLAGVRTIVQDM

SEQ ID NO: 78957 - protein, 19 aa, Mycobacterium avium
DRLRQSSWRGLRPDKEASE

SEQ ID NO: 78958 - protein, 17 aa, Mycobacterium avium
DRLRSGNLQELIDTKCV

SEQ ID NO: 78959 - protein, 26 aa, Mycobacterium avium
DRLVARIDAKLGFPQRDPHGDPIPAT

SEQ ID NO: 78960 - protein, 19 aa, Mycobacterium avium
DRLWIPVRRSWRLNERHYG

SEQ ID NO: 78961 - protein, 23 aa, Mycobacterium avium
DRMAAAPVITEWCQLPAGTDPRS

SEQ ID NO: 78962 - protein, 23 aa, Mycobacterium avium
DRPAFKTCVAHGIVLGSDGQKMS

SEQ ID NO: 78963 - protein, 20 aa, Mycobacterium avium
DRPDALVLDVMMPRLDGLEV

SEQ ID NO: 78964 - protein, 31 aa, Mycobacterium avium
DRPLARFGSWYEMFPRSTGGWDDDGNPVHGT

SEQ ID NO: 78965 - protein, 20 aa, Mycobacterium avium
DRPRVLDFKAGVLRGLDARL

SEQ ID NO: 78966 - protein, 19 aa, Mycobacterium avium
DRPVPSWLQVVGERQRILI

SEQ ID NO: 78967 - protein, 18 aa, Mycobacterium avium
DRPVVLVAHGGLIAALSA

SEQ ID NO: 78968 - protein, 22 aa, Mycobacterium avium
DRRAREEWLARAIQERYTEAER

SEQ ID NO: 78969 - protein, 20 aa, Mycobacterium avium
DRRGPPICAQVLLYPGLDRD

SEQ ID NO: 78970 - protein, 18 aa, Mycobacterium avium
DRRRGRLVGALIVDEDSE

SEQ ID NO: 78971 - protein, 22 aa, Mycobacterium avium
DRRVRIVSQLAWPGRSREEFVA

SEQ ID NO: 78972 - protein, 23 aa, Mycobacterium avium
DRSEQRYFPATAFRTRRSTLSDA

SEQ ID NO: 78973 - protein, 22 aa, Mycobacterium avium
DRSGALRGWQRRALVKYLAGQP

SEQ ID NO: 78974 - protein, 25 aa, Mycobacterium avium
DRSKRSVVEIGDYVGAYFLDDRAAV

SEQ ID NO: 78975 - protein, 24 aa, Mycobacterium avium
DRSVVPVRVFWLPPPDRGRIAKLA

SEQ ID NO: 78976 - protein, 26 aa, Mycobacterium avium
DRTACIKAMIEKVVERMYAEIDDNRF

SEQ ID NO: 78977 - protein, 17 aa, Mycobacterium avium
DRVAGHDRFRFYLNVEV

SEQ ID NO: 78978 - protein, 19 aa, Mycobacterium avium
DRVCVLGFNSVDYATIDMA

SEQ ID NO: 78979 - protein, 23 aa, Mycobacterium avium
DRVECRPFAGSAPRAADPDTDAA

SEQ ID NO: 78980 - protein, 25 aa, Mycobacterium avium
DRVHGRLRLGPGWVSHVLQQLAVEL

SEQ ID NO: 78981 - protein, 23 aa, Mycobacterium avium
DRVREVAALIPGAMRGLVSERQL

SEQ ID NO: 78982 - protein, 17 aa, Mycobacterium avium
DRWCAVATNVLGGCRGS

SEQ ID NO: 78983 - protein, 20 aa, Mycobacterium avium
DRYEPVHAVTYFAPEARAAL

SEQ ID NO: 78984 - protein, 23 aa, Mycobacterium avium
DSAELPLFRYLGGPNAHILPVPM

SEQ ID NO: 78985 - protein, 20 aa, Mycobacterium avium
DSAPWLPLERAMTLDSSGDW

SEQ ID NO: 78986 - protein, 18 aa, Mycobacterium avium
DSCRGGCMAAKFFTGLPL

SEQ ID NO: 78987 - protein, 20 aa, Mycobacterium avium
DSFLRGAQLLDVPAGAAAVF

SEQ ID NO: 78988 - protein, 25 aa, Mycobacterium avium
DSFMAGLLDALWEAGLLGGDRRGAL

SEQ ID NO: 78989 - protein, 19 aa, Mycobacterium avium
DSGGLCGTEPLLIERIDAE

SEQ ID NO: 78990 - protein, 24 aa, Mycobacterium avium
DSHKSIVAGLIFSGVQPRWITPRW

SEQ ID NO: 78991 - protein, 26 aa, Mycobacterium avium
DSIGWLRDFLRAHTGGLVIISHNVEL

SEQ ID NO: 78992 - protein, 28 aa, Mycobacterium avium
DSKIASWTEPKGGYFISLDVLPGTAKRT

SEQ ID NO: 78993 - protein, 20 aa, Mycobacterium avium
DSLDWPDYVEGLQESSAPPA

SEQ ID NO: 78994 - protein, 18 aa, Mycobacterium avium
DSLGEFLALGACFEDIGI

SEQ ID NO: 78995 - protein, 19 aa, Mycobacterium avium
DSLPLRVVDKAVPWQTNGR

SEQ ID NO: 78996 - protein, 21 aa, Mycobacterium avium
DSLRIFPATHYVAGPERMAHA

SEQ ID NO: 78997 - protein, 32 aa, Mycobacterium avium
DSLVVWLPDERICLCGNTFGPLFGHIPNLVTM

SEQ ID NO: 78998 - protein, 24 aa, Mycobacterium avium
DSMRAGLQALAWIARGGAEPGAPA

SEQ ID NO: 78999 - protein, 18 aa, Mycobacterium avium
DSNWPFAPEDVIDTMGHL

SEQ ID NO: 79000 - protein, 20 aa, Mycobacterium avium
DSPARIAVIGGYAQLGVPAG

SEQ ID NO: 79001 - protein, 25 aa, Mycobacterium avium
DSQLLFWKRHDRPLVQAALDGLARD

SEQ ID NO: 79002 - protein, 22 aa, Mycobacterium avium
DSRAYRLNWPAGTTVYEIDQPK

SEQ ID NO: 79003 - protein, 22 aa, Mycobacterium avium
DSSGNPYLAFSAMLMAGLDGIK

SEQ ID NO: 79004 - protein, 22 aa, Mycobacterium avium
DSSGPCLEGWTTLTALAQATKR

SEQ ID NO: 79005 - protein, 22 aa, Mycobacterium avium
DSYVYYPDCADVGIGAAAEIRG

SEQ ID NO: 79006 - protein, 22 aa, Mycobacterium avium
DTACSSGLMAVHQACGSLGGGE

SEQ ID NO: 79007 - protein, 18 aa, Mycobacterium avium
DTALSEFGVEGVATNIGF

SEQ ID NO: 79008 - protein, 25 aa, Mycobacterium avium
DTARGCAEWAHLVAGTSSIREGSRL

SEQ ID NO: 79009 - protein, 18 aa, Mycobacterium avium
DTAVKWARLDSAPFTDRL

SEQ ID NO: 79010 - protein, 20 aa, Mycobacterium avium
DTDHALSVCNIVSGPWSGIP

SEQ ID NO: 79011 - protein, 24 aa, Mycobacterium avium
DTDVFWCTADIGWVTGHTYGVYGP

SEQ ID NO: 79012 - protein, 22 aa, Mycobacterium avium
DTEHLRLVGLHSHIGSQIFDVA

SEQ ID NO: 79013 - protein, 24 aa, Mycobacterium avium
DTGVPRPGLSTIFSPSRSTFGVDL

SEQ ID NO: 79014 - protein, 25 aa, Mycobacterium avium
DTHLLRYPLPSAWAGDADVALYLKD

SEQ ID NO: 79015 - protein, 19 aa, Mycobacterium avium
DTLWPAVVFTLVALLDDPV

SEQ ID NO: 79016 - protein, 36 aa, Mycobacterium avium
DTMRGGKFLNNWRMAELHAKEAPDRVWELETYGALF

SEQ ID NO: 79017 - protein, 25 aa, Mycobacterium avium
DTPWGRRTTTVWAQGSAWELPHTDY

SEQ ID NO: 79018 - protein, 17 aa, Mycobacterium avium
DTQPGWPNYFTERPHAI

SEQ ID NO: 79019 - protein, 24 aa, Mycobacterium avium
DTRTDVSLVLRMHHGGDFVIDPLP

SEQ ID NO: 79020 - protein, 20 aa, Mycobacterium avium
DTSFSMVMENRWLPMKQTAL

SEQ ID NO: 79021 - protein, 19 aa, Mycobacterium avium
DTSVKNWLAPIVADGEAGF

SEQ ID NO: 79022 - protein, 25 aa, Mycobacterium avium
DTTATFEWAFRWLAARRPRAAPAVL

SEQ ID NO: 79023 - protein, 26 aa, Mycobacterium avium
DTVFPDQSCLWGFGRAASLEYPQLWG

SEQ ID NO: 79024 - protein, 18 aa, Mycobacterium avium
DTWIPGWRPRDLSTANFP

SEQ ID NO: 79025 - protein, 19 aa, Mycobacterium avium
DTYGFPIELTLEMASEAGL

SEQ ID NO: 79026 - protein, 34 aa, Mycobacterium avium
DVAELYDGFSFNCLSWIEALGFCGIGEAKEFLDG

SEQ ID NO: 79027 - protein, 23 aa, Mycobacterium avium
DVALHRLPVTMVLDRAGITGSDG

SEQ ID NO: 79028 - protein, 22 aa, Mycobacterium avium
DVDAALHYLARMLVAGEDPRFI

SEQ ID NO: 79029 - protein, 17 aa, Mycobacterium avium
DVDFHLRRIGVPAPGGR

SEQ ID NO: 79030 - protein, 22 aa, Mycobacterium avium
DVDLPSALPMLVFSGIMNSGQA

SEQ ID NO: 79031 - protein, 25 aa, Mycobacterium avium
DVDPERYHWFLGDGMVHGIRIRDGK

SEQ ID NO: 79032 - protein, 19 aa, Mycobacterium avium
DVDRALCDIAAEFGNLDPD

SEQ ID NO: 79033 - protein, 23 aa, Mycobacterium avium
DVDRAVGVARRIRTGQIAVNGIS

SEQ ID NO: 79034 - protein, 18 aa, Mycobacterium avium
DVDTPWRKLPAKARKAIL

SEQ ID NO: 79035 - protein, 28 aa, Mycobacterium avium
DVEAIRWTTWQAAWLVAHGRPADRAARI

SEQ ID NO: 79036 - protein, 26 aa, Mycobacterium avium
DVEFYKWTQWIFLQIYNAWFDPAANK

SEQ ID NO: 79037 - protein, 19 aa, Mycobacterium avium
DVEGFPYKEIAEIMDTPIG

SEQ ID NO: 79038 - protein, 25 aa, Mycobacterium avium
DVELELGWGRLIFGQTFANSQELVE

SEQ ID NO: 79039 - protein, 25 aa, Mycobacterium avium
DVEREFSDVFGVLFPGGEGRLRLTD

SEQ ID NO: 79040 - protein, 22 aa, Mycobacterium avium
DVESSCYERLFPPGYEEQRAAA

SEQ ID NO: 79041 - protein, 25 aa, Mycobacterium avium
DVFAEALGAPLYWIASNAGLDGAVA

SEQ ID NO: 79042 - protein, 23 aa, Mycobacterium avium
DVFGGPREGYYFARQPDNPRLRV

SEQ ID NO: 79043 - protein, 24 aa, Mycobacterium avium
DVGHIPGAVKIDWHTDLNDPRVRD

SEQ ID NO: 79044 - protein, 24 aa, Mycobacterium avium
DVGLRSSYVASWYAAPLLVAGGRG

SEQ ID NO: 79045 - protein, 21 aa, Mycobacterium avium
DVGRHGICHQVIAENGLARPG

SEQ ID NO: 79046 - protein, 23 aa, Mycobacterium avium
DVIARFDPVLGLEVHVELSTVTK

SEQ ID NO: 79047 - protein, 24 aa, Mycobacterium avium
DVKAVAEFSRWYAGDVDLSDPPAD

SEQ ID NO: 79048 - protein, 19 aa, Mycobacterium avium
DVLGFKLRDSMRMPPQVVG

SEQ ID NO: 79049 - protein, 26 aa, Mycobacterium avium
DVLGRAKQVIGIIIGHNGLIEQGKAQ

SEQ ID NO: 79050 - protein, 17 aa, Mycobacterium avium
DVLSGLFATWFGDHTAD

SEQ ID NO: 79051 - protein, 25 aa, Mycobacterium avium
DVNVKIDKGEFVFLIGPSGSGKSTF

SEQ ID NO: 79052 - protein, 19 aa, Mycobacterium avium
DVRLPADHILGGREKFEER

SEQ ID NO: 79053 - protein, 25 aa, Mycobacterium avium
DVRNGARALTGWVIGAGGATSVLPK

SEQ ID NO: 79054 - protein, 22 aa, Mycobacterium avium
DVSCLKALLEIRDEIVAAGHTP

SEQ ID NO: 79055 - protein, 17 aa, Mycobacterium avium
DVSFPLGVLTSVTGVSG

SEQ ID NO: 79056 - protein, 24 aa, Mycobacterium avium
DVSRVRRFAHPVLLERYRAAELAT

SEQ ID NO: 79057 - protein, 23 aa, Mycobacterium avium
DVTELRSRIGLSSSALAQRVPSD

SEQ ID NO: 79058 - protein, 23 aa, Mycobacterium avium
DVTEWLNAHGWRATAEHSTAAMR

SEQ ID NO: 79059 - protein, 23 aa, Mycobacterium avium
DVTYPLHRYFLWAKHNELTLGPA

SEQ ID NO: 79060 - protein, 31 aa, Mycobacterium avium
DVVFASHHWPTWGRDGIVEFLSLQRDLYAYL

SEQ ID NO: 79061 - protein, 31 aa, Mycobacterium avium
DVWFVGKKGGAGWVEWGGCGMVHPNVLRAAG

SEQ ID NO: 79062 - protein, 21 aa, Mycobacterium avium
DVYRTRFGALLTAAADRRAAL

SEQ ID NO: 79063 - protein, 18 aa, Mycobacterium avium
DWDAMAATLADDFLLDDR

SEQ ID NO: 79064 - protein, 22 aa, Mycobacterium avium
DWDDELLSFFTIPRAMLPEIGP

SEQ ID NO: 79065 - protein, 18 aa, Mycobacterium avium
DWFCSFSSAAALVGSPGQ

SEQ ID NO: 79066 - protein, 19 aa, Mycobacterium avium
DWFRPKAMRALKVRVDELA

SEQ ID NO: 79067 - protein, 19 aa, Mycobacterium avium
DWHRARGSGMPDLNELDRR

SEQ ID NO: 79068 - protein, 19 aa, Mycobacterium avium
DWLGAAGITGELAADIVLV

SEQ ID NO: 79069 - protein, 22 aa, Mycobacterium avium
DWPDPWVLIGALAQVTTRLRFV

SEQ ID NO: 79070 - protein, 20 aa, Mycobacterium avium
DWPHLGVALMQPRARGCLTL

SEQ ID NO: 79071 - protein, 25 aa, Mycobacterium avium
DYAALRRWAHRFYPGPQPAPTDFGY

SEQ ID NO: 79072 - protein, 18 aa, Mycobacterium avium
DYAPVVMVNWEFFDNQTP

SEQ ID NO: 79073 - protein, 18 aa, Mycobacterium avium
DYCKERLGLDAALGSIDR

SEQ ID NO: 79074 - protein, 27 aa, Mycobacterium avium
DYDMSMARLLYWGCDVWLNNPLRPLEA

SEQ ID NO: 79075 - protein, 18 aa, Mycobacterium avium
DYHDFPSLRCELGDDGVL

SEQ ID NO: 79076 - protein, 19 aa, Mycobacterium avium
DYIDFSWFDAVVMALDPAF

SEQ ID NO: 79077 - protein, 19 aa, Mycobacterium avium
DYLIALFGALYAGRIAVPL

SEQ ID NO: 79078 - protein, 30 aa, Mycobacterium avium
DYNLQWKPVGGFPITFGWLHAVRRGQARLH

SEQ ID NO: 79079 - protein, 21 aa, Mycobacterium avium
DYRHSTTFAQRAQWANATADL

SEQ ID NO: 79080 - protein, 19 aa, Mycobacterium avium
DYRMPGMDGAQVAAAVRAD

SEQ ID NO: 79081 - protein, 19 aa, Mycobacterium avium
DYRTFWTQFGRVVKEGLLS

SEQ ID NO: 79082 - protein, 23 aa, Mycobacterium avium
DYVKAFWNVVNWADVQKRYAAAT

SEQ ID NO: 79083 - protein, 20 aa, Mycobacterium avium
DYVSDGRFRLGIGTSGPQVI

SEQ ID NO: 79084 - protein, 23 aa, Mycobacterium avium
EAAADLRLDFFVSTSSIASVWGG

SEQ ID NO: 79085 - protein, 23 aa, Mycobacterium avium
EAAALMIDLFWYGLKGSPEEREA

SEQ ID NO: 79086 - protein, 25 aa, Mycobacterium avium
EAAAPRPAPQFEVMYRLDDCAPAAA

SEQ ID NO: 79087 - protein, 21 aa, Mycobacterium avium
EAADAAALRRALADGVIDCVA

SEQ ID NO: 79088 - protein, 22 aa, Mycobacterium avium
EAAGEWFARILFSLFSTPSPTL

SEQ ID NO: 79089 - protein, 25 aa, Mycobacterium avium
EAAGGRVRAKYGWTDVARFAALGIP

SEQ ID NO: 79090 - protein, 17 aa, Mycobacterium avium
EAAGLRWLSSVDGGVPC

SEQ ID NO: 79091 - protein, 18 aa, Mycobacterium avium
EAAKAMAYVARFITHALQ

SEQ ID NO: 79092 - protein, 24 aa, Mycobacterium avium
EAAKGVAMPLRLTSPAPCTNCHGS

SEQ ID NO: 79093 - protein, 25 aa, Mycobacterium avium
EAASRMTGKPGLCIGTLGPGMANIA

SEQ ID NO: 79094 - protein, 25 aa, Mycobacterium avium
EAAYPGRFLLGIGVGHPEAHTEYRK

SEQ ID NO: 79095 - protein, 20 aa, Mycobacterium avium
EACGLRGAYDIAALGLRTAV

SEQ ID NO: 79096 - protein, 18 aa, Mycobacterium avium
EADFPMPDPIALGHEAIG

SEQ ID NO: 79097 - protein, 22 aa, Mycobacterium avium
EADGRRPRILVAKMGQDGHDRG

SEQ ID NO: 79098 - protein, 18 aa, Mycobacterium avium
EADLVLLAMGFVGPEKEG

SEQ ID NO: 79099 - protein, 17 aa, Mycobacterium avium
EAEGAKADARRKVRDSG

SEQ ID NO: 79100 - protein, 24 aa, Mycobacterium avium
EAEHIVAAFAFELGKVEMPEIRSA

SEQ ID NO: 79101 - protein, 18 aa, Mycobacterium avium
EAELEGATCDGVLDGILA

SEQ ID NO: 79102 - protein, 19 aa, Mycobacterium avium
EAFADFLSGFHIVDRHFQT

SEQ ID NO: 79103 - protein, 21 aa, Mycobacterium avium
EAFEALLRYMRDSRGFDFTGY

SEQ ID NO: 79104 - protein, 21 aa, Mycobacterium avium
EAFQSGLSWLTILRKRENFRR

SEQ ID NO: 79105 - protein, 25 aa, Mycobacterium avium
EAGAVGMPGVPLAGLPGAHEDEFSE

SEQ ID NO: 79106 - protein, 18 aa, Mycobacterium avium
EAGGDPWAINASLQAGSP

SEQ ID NO: 79107 - protein, 25 aa, Mycobacterium avium
EAGRAATLRAVRNLTGVPIDYFAEV

SEQ ID NO: 79108 - protein, 20 aa, Mycobacterium avium
EAGSDFAGLRTRAVRDGDVF

SEQ ID NO: 79109 - protein, 23 aa, Mycobacterium avium
EAGSKVKVTIMFRGREQSRPELG

SEQ ID NO: 79110 - protein, 21 aa, Mycobacterium avium
EAIAAQLQRRGRGAGAPTADQ

SEQ ID NO: 79111 - protein, 25 aa, Mycobacterium avium
EAIDAEIPLLVVITEGIPVQDSAYA

SEQ ID NO: 79112 - protein, 21 aa, Mycobacterium avium
EAIFKKTWLNVGRVNRLPRTG

SEQ ID NO: 79113 - protein, 17 aa, Mycobacterium avium
EAIGVNYIDTYFRSGQY

SEQ ID NO: 79114 - protein, 20 aa, Mycobacterium avium
EAIPRISRAQAMDALSSQGN

SEQ ID NO: 79115 - protein, 24 aa, Mycobacterium avium
EAIRGSGLSAGIIDAGLSRGLAGV

SEQ ID NO: 79116 - protein, 17 aa, Mycobacterium avium
EAKGAIRQIDFLTRATA

SEQ ID NO: 79117 - protein, 41 aa, Mycobacterium avium
EAKYAAKRVRKWTRRRYQLLELPQLPGRGWVEYEPYGTVLI

SEQ ID NO: 79118 - protein, 20 aa, Mycobacterium avium
EALAAAAVHEVFVHTLSTSS

SEQ ID NO: 79119 - protein, 24 aa, Mycobacterium avium
EALADGVVRPVVFLAYSGEARWRD

SEQ ID NO: 79120 - protein, 19 aa, Mycobacterium avium
EALELTWRSLGEIGNLSSA

SEQ ID NO: 79121 - protein, 20 aa, Mycobacterium avium
EALERLVAAGARPASSPKEV

SEQ ID NO: 79122 - protein, 22 aa, Mycobacterium avium
EALGKIYAGMGIVRHPEIREVR

SEQ ID NO: 79123 - protein, 19 aa, Mycobacterium avium
EALGLARLGATVVVNDIAT

SEQ ID NO: 79124 - protein, 18 aa, Mycobacterium avium
EALIRLDLAEMLREEGYE

SEQ ID NO: 79125 - protein, 21 aa, Mycobacterium avium
EALPLRAIDMTVRRNAFGRQV

SEQ ID NO: 79126 - protein, 19 aa, Mycobacterium avium
EALQLPLWGGLGEEDRLRA

SEQ ID NO: 79127 - protein, 28 aa, Mycobacterium avium
EALQRLGKGGGFFSFGIMHYYMTGVHTP

SEQ ID NO: 79128 - protein, 17 aa, Mycobacterium avium
EALRLSRDTGIITEELV

SEQ ID NO: 79129 - protein, 17 aa, Mycobacterium avium
EALRRINEGAAMIRSKG

SEQ ID NO: 79130 - protein, 24 aa, Mycobacterium avium
EALSARHLLPVPWVEPVDVSNAVV

SEQ ID NO: 79131 - protein, 19 aa, Mycobacterium avium
EALTELLMIVATYYGLALV

SEQ ID NO: 79132 - protein, 19 aa, Mycobacterium avium
EALVPLVLAGTTHRETPRL

SEQ ID NO: 79133 - protein, 17 aa, Mycobacterium avium
EALWISDHFHPWNDEQG

SEQ ID NO: 79134 - protein, 31 aa, Mycobacterium avium
EAMFGPGHDAGWRVGDDVAHPDLGHGWVQGA

SEQ ID NO: 79135 - protein, 21 aa, Mycobacterium avium
EAMPNICLQMLLRGRNTVGYT

SEQ ID NO: 79136 - protein, 25 aa, Mycobacterium avium
EAMVKKLSIRLGVPCFPDDPLRFTG

SEQ ID NO: 79137 - protein, 27 aa, Mycobacterium avium
EANIAPWLRAAHRYGAKVKWAEIDIET

SEQ ID NO: 79138 - protein, 24 aa, Mycobacterium avium
EANLRLVVSLAKRYTGRGMPLLDL

SEQ ID NO: 79139 - protein, 25 aa, Mycobacterium avium
EAPARAYNPLFIWGESGLGKTHLLH

SEQ ID NO: 79140 - protein, 21 aa, Mycobacterium avium
EAPGMMSALVGFWMTPESIYL

SEQ ID NO: 79141 - protein, 19 aa, Mycobacterium avium
EAQKARWLEPMAAGDVVAS

SEQ ID NO: 79142 - protein, 23 aa, Mycobacterium avium
EAQLRFLADQGVDLIVTSGGLGP

SEQ ID NO: 79143 - protein, 20 aa, Mycobacterium avium
EAQYAEMWVQDATMMATYQA

SEQ ID NO: 79144 - protein, 26 aa, Mycobacterium avium
EARAAGLKAANTWHATRAIQESREAC

SEQ ID NO: 79145 - protein, 23 aa, Mycobacterium avium
EARANRLAHRFRKAGLREGDTVA

SEQ ID NO: 79146 - protein, 23 aa, Mycobacterium avium
EARMLREQLEFMVTSGSTVCAYV

SEQ ID NO: 79147 - protein, 29 aa, Mycobacterium avium
EARPQTVFMYLDYIHHWRHPIRDGLGELR

SEQ ID NO: 79148 - protein, 21 aa, Mycobacterium avium
EASWGDLAMMLSVPYQGLGNA

SEQ ID NO: 79149 - protein, 17 aa, Mycobacterium avium
EATDEFRVPPPGPLGRH

SEQ ID NO: 79150 - protein, 23 aa, Mycobacterium avium
EATEARFPQINWEITAGNSSPLS

SEQ ID NO: 79151 - protein, 17 aa, Mycobacterium avium
EATLPAVQYIPFTDVAQ

SEQ ID NO: 79152 - protein, 21 aa, Mycobacterium avium
EATRVLGTFLRDVIARNKDRF

SEQ ID NO: 79153 - protein, 20 aa, Mycobacterium avium
EATSRAAARGATVWVQDYQL

SEQ ID NO: 79154 - protein, 21 aa, Mycobacterium avium
EAVAACGPAGVPVIADGGLQY

SEQ ID NO: 79155 - protein, 22 aa, Mycobacterium avium
EAVAAFGRGECFVERYLDKPRH

SEQ ID NO: 79156 - protein, 20 aa, Mycobacterium avium
EAVARLGRHQFPLVLTDTVN

SEQ ID NO: 79157 - protein, 22 aa, Mycobacterium avium
EAVFKAAYRQGLALVLKGPTGC

SEQ ID NO: 79158 - protein, 21 aa, Mycobacterium avium
EAVGAEIAWFSTCGSSLSVRA

SEQ ID NO: 79159 - protein, 29 aa, Mycobacterium avium
EAVGGPATWRLGGAFNCGKAQPGQIAPVS

SEQ ID NO: 79160 - protein, 23 aa, Mycobacterium avium
EAVTGLDLVEWQLRVAAGEKLVF

SEQ ID NO: 79161 - protein, 20 aa, Mycobacterium avium
EAVVDCRILPGRKAAFEAEI

SEQ ID NO: 79162 - protein, 24 aa, Mycobacterium avium
EAYADMPLFLFHLLEYMDVDYELD

SEQ ID NO: 79163 - protein, 17 aa, Mycobacterium avium
EAYVRLYPAQVIKQADL

SEQ ID NO: 79164 - protein, 17 aa, Mycobacterium avium
ECFLELLAVDIEKLGAK

SEQ ID NO: 79165 - protein, 20 aa, Mycobacterium avium
ECGLPVLVETARLWLSLGHH

SEQ ID NO: 79166 - protein, 23 aa, Mycobacterium avium
EDAEGPGATILLRLDQDVPADVR

SEQ ID NO: 79167 - protein, 20 aa, Mycobacterium avium
EDAGFCEKGRGMEFVADHDL

SEQ ID NO: 79168 - protein, 19 aa, Mycobacterium avium
EDAKITAMRAFWSPTDVQV

SEQ ID NO: 79169 - protein, 25 aa, Mycobacterium avium
EDCHFCSQSGLFASPVRSARLDIPS

SEQ ID NO: 79170 - protein, 21 aa, Mycobacterium avium
EDERIGVLSFPLGKQQRPASA

SEQ ID NO: 79171 - protein, 18 aa, Mycobacterium avium
EDFYHTGIIVPDLEAAMA

SEQ ID NO: 79172 - protein, 24 aa, Mycobacterium avium
EDGARLIAERGRLFGSLPAGGRMV

SEQ ID NO: 79173 - protein, 24 aa, Mycobacterium avium
EDGEPLFMAGLWSVWKPAKDAPPL

SEQ ID NO: 79174 - protein, 23 aa, Mycobacterium avium
EDLFVRPGFRRRGLARALLAALA

SEQ ID NO: 79175 - protein, 20 aa, Mycobacterium avium
EDRPRSVIWVAGRGTAETAG

SEQ ID NO: 79176 - protein, 23 aa, Mycobacterium avium
EDSRGRTSLVITELPYQVNHDNF

SEQ ID NO: 79177 - protein, 19 aa, Mycobacterium avium
EDVGLPLTFTLVVANSGDP

SEQ ID NO: 79178 - protein, 19 aa, Mycobacterium avium
EDVRARIGVLSQVPSLWTE

SEQ ID NO: 79179 - protein, 20 aa, Mycobacterium avium
EEAIASFARLWVADPHWQAA

SEQ ID NO: 79180 - protein, 22 aa, Mycobacterium avium
EEAPLRIALVAALDSGTAPSMR

SEQ ID NO: 79181 - protein, 22 aa, Mycobacterium avium
EEDAAAMARRMRAICDQLADFP

SEQ ID NO: 79182 - protein, 26 aa, Mycobacterium avium
EEDLTSFLIRFEFDGHRLTDEQLLNI

SEQ ID NO: 79183 - protein, 24 aa, Mycobacterium avium
EEFARAGYDYVGFDAQHGYLDDAD

SEQ ID NO: 79184 - protein, 22 aa, Mycobacterium avium
EEFDSRCAALGFDAYAVDNLYG

SEQ ID NO: 79185 - protein, 22 aa, Mycobacterium avium
EEFMPRPVWYALDRGLIMESGP

SEQ ID NO: 79186 - protein, 23 aa, Mycobacterium avium
EEFNRLAAELVEAGTLKKLNEKK

SEQ ID NO: 79187 - protein, 22 aa, Mycobacterium avium
EEIARSGVSVAVIGFREHASWA

SEQ ID NO: 79188 - protein, 27 aa, Mycobacterium avium
EEIPGAMARLGVWPGVGPQLDLHQPTF

SEQ ID NO: 79189 - protein, 21 aa, Mycobacterium avium
EEIPPGFSHCMLLSEGRVVAA

SEQ ID NO: 79190 - protein, 21 aa, Mycobacterium avium
EELKPGPATRLVFDLDPGEGV

SEQ ID NO: 79191 - protein, 23 aa, Mycobacterium avium
EELLELLSTLPLDSAQQDRLGRL

SEQ ID NO: 79192 - protein, 21 aa, Mycobacterium avium
EEPARLLSQFIHGIKRLPVAW

SEQ ID NO: 79193 - protein, 22 aa, Mycobacterium avium
EEPPEVRTLYSFEPDATTLFES

SEQ ID NO: 79194 - protein, 20 aa, Mycobacterium avium
EEQARRLVIRGFFAEIISKI

SEQ ID NO: 79195 - protein, 17 aa, Mycobacterium avium
EEQCGALDRFAKAGPAL

SEQ ID NO: 79196 - protein, 25 aa, Mycobacterium avium
EERHGPEFAQRFGLGFSAQDREENI

SEQ ID NO: 79197 - protein, 26 aa, Mycobacterium avium
EERTRACGYRRLYLITGNRQPEAEAL

SEQ ID NO: 79198 - protein, 20 aa, Mycobacterium avium
EERYRLCSTVHTKIAVVKSI

SEQ ID NO: 79199 - protein, 30 aa, Mycobacterium avium
EESALFAADLARMYIRYAERHGWTVTVLDE

SEQ ID NO: 79200 - protein, 21 aa, Mycobacterium avium
EESRYGAVHPREFERPEMGRP

SEQ ID NO: 79201 - protein, 27 aa, Mycobacterium avium
EEVAPWLDLVRKLGLLAATLSDGPPVS

SEQ ID NO: 79202 - protein, 21 aa, Mycobacterium avium
EEVDDGWVLTCQALPTSPTVR

SEQ ID NO: 79203 - protein, 19 aa, Mycobacterium avium
EEVLACADAGIPVTVVPGV

SEQ ID NO: 79204 - protein, 24 aa, Mycobacterium avium
EEVREYMAQLGFRTLNEAVGQVKS

SEQ ID NO: 79205 - protein, 24 aa, Mycobacterium avium
EEVVLRLRALLRRTGVTTVDSGAQ

SEQ ID NO: 79206 - protein, 23 aa, Mycobacterium avium
EEYKEFYKHIAHAWDDPLEVIAM

SEQ ID NO: 79207 - protein, 26 aa, Mycobacterium avium
EEYSRRKHIEAGYEFVNTPHITKAQL

SEQ ID NO: 79208 - protein, 19 aa, Mycobacterium avium
EFADLLAWLKDTLSDHVKE

SEQ ID NO: 79209 - protein, 21 aa, Mycobacterium avium
EFAEGYCLPTIRNNALYMDRY

SEQ ID NO: 79210 - protein, 28 aa, Mycobacterium avium
EFAGAFKPPLRWGMRMTGKKFLREYPYR

SEQ ID NO: 79211 - protein, 31 aa, Mycobacterium avium
EFATAAKIAASWRLPVVFVVQNVRGGPDARR

SEQ ID NO: 79212 - protein, 18 aa, Mycobacterium avium
EFDDIRWRLDVWNASAQV

SEQ ID NO: 79213 - protein, 26 aa, Mycobacterium avium
EFDSRAVGPGGLFLALPGARTDGHDH

SEQ ID NO: 79214 - protein, 19 aa, Mycobacterium avium
EFGAYPAVIGRELDRYLPF

SEQ ID NO: 79215 - protein, 17 aa, Mycobacterium avium
EFIPRPVKSSFREGLTV

SEQ ID NO: 79216 - protein, 18 aa, Mycobacterium avium
EFKARVLGEQGAVPKARR

SEQ ID NO: 79217 - protein, 27 aa, Mycobacterium avium
EFLAWEPFTHMAFRFNECSTRSVAAFA

SEQ ID NO: 79218 - protein, 17 aa, Mycobacterium avium
EFMRTAAKDTVVRGVPI

SEQ ID NO: 79219 - protein, 20 aa, Mycobacterium avium
EFPAACAAFTRSISLFAKGF

SEQ ID NO: 79220 - protein, 26 aa, Mycobacterium avium
EFRLPANELEFFFFVLAFAGSDTTKN

SEQ ID NO: 79221 - protein, 20 aa, Mycobacterium avium
EFTASWYGRVLHFGVREHAM

SEQ ID NO: 79222 - protein, 18 aa, Mycobacterium avium
EFTEAWTTFATVEKSWAY

SEQ ID NO: 79223 - protein, 22 aa, Mycobacterium avium
EFYECDSHVLALGYIGMTLGAY

SEQ ID NO: 79224 - protein, 19 aa, Mycobacterium avium
EGAAFPWRTIRGQECSAYW

SEQ ID NO: 79225 - protein, 17 aa, Mycobacterium avium
EGARLVCGGGRPEGLDS

SEQ ID NO: 79226 - protein, 19 aa, Mycobacterium avium
EGAVAYGHLQIRVEELAEA

SEQ ID NO: 79227 - protein, 21 aa, Mycobacterium avium
EGEGWRFLIYPALDCSSGDVG

SEQ ID NO: 79228 - protein, 23 aa, Mycobacterium avium
EGESCRRCGAVMRREKFMNRSSF

SEQ ID NO: 79229 - protein, 18 aa, Mycobacterium avium
EGFSLEASDSLGLQIVRT

SEQ ID NO: 79230 - protein, 18 aa, Mycobacterium avium
EGGSSWGNQMRSYVLHPY

SEQ ID NO: 79231 - protein, 18 aa, Mycobacterium avium
EGGWLGMTIPTEYGGHGL

SEQ ID NO: 79232 - protein, 24 aa, Mycobacterium avium
EGHLYRLFTKLGINSREQLTLLVA

SEQ ID NO: 79233 - protein, 23 aa, Mycobacterium avium
EGIIAAAAIRCMGGAIQAQLAPR

SEQ ID NO: 79234 - protein, 27 aa, Mycobacterium avium
EGIRGLSKVAALEWGRDNIRVNVVCPF

SEQ ID NO: 79235 - protein, 27 aa, Mycobacterium avium
EGITWLAGHLRQRWARNTGGLLLVTHD

SEQ ID NO: 79236 - protein, 23 aa, Mycobacterium avium
EGKNLIHWRGWTHAYHGTIPKLS

SEQ ID NO: 79237 - protein, 24 aa, Mycobacterium avium
EGKRFMFDYIPPVFKGQYAETEQE

SEQ ID NO: 79238 - protein, 20 aa, Mycobacterium avium
EGLASRAAMLRQRMVDARLA

SEQ ID NO: 79239 - protein, 17 aa, Mycobacterium avium
EGLGFYQLMEQLARERL

SEQ ID NO: 79240 - protein, 20 aa, Mycobacterium avium
EGLISQQPRRGFVVLPVTRR

SEQ ID NO: 79241 - protein, 20 aa, Mycobacterium avium
EGLLRGLYRYHVATEQRANK

SEQ ID NO: 79242 - protein, 19 aa, Mycobacterium avium
EGLRKLFRQFSFPGGIPSH

SEQ ID NO: 79243 - protein, 25 aa, Mycobacterium avium
EGLRRSGRTLTEFPIIAQAMVAVGR

SEQ ID NO: 79244 - protein, 18 aa, Mycobacterium avium
EGLYAVVVDREMSALLDG

SEQ ID NO: 79245 - protein, 25 aa, Mycobacterium avium
EGPLPQTRFVLRKALAAHLPVILVV

SEQ ID NO: 79246 - protein, 21 aa, Mycobacterium avium
EGPRGISAFVVEKGSAGLSFG

SEQ ID NO: 79247 - protein, 25 aa, Mycobacterium avium
EGRAPRPGERFRLPAHADTLEAIAA

SEQ ID NO: 79248 - protein, 22 aa, Mycobacterium avium
EGRKTEFAEHGWDASKKGEIPD

SEQ ID NO: 79249 - protein, 17 aa, Mycobacterium avium
EGSRPGVDLMVAAESGM

SEQ ID NO: 79250 - protein, 19 aa, Mycobacterium avium
EGTEFRAGVNVGVDITADQ

SEQ ID NO: 79251 - protein, 24 aa, Mycobacterium avium
EGTPADKVLEHWLASARRDDEARG

SEQ ID NO: 79252 - protein, 19 aa, Mycobacterium avium
EGVDVPRLSVGIYATSAST

SEQ ID NO: 79253 - protein, 17 aa, Mycobacterium avium
EGVRLFRFDRIVEASEL

SEQ ID NO: 79254 - protein, 20 aa, Mycobacterium avium
EGYAEDWDLDALWTALKTLY

SEQ ID NO: 79255 - protein, 22 aa, Mycobacterium avium
EHAELLAAAGARVAEFDPLVDA

SEQ ID NO: 79256 - protein, 17 aa, Mycobacterium avium
EHARVRGSVRLHDTELL

SEQ ID NO: 79257 - protein, 25 aa, Mycobacterium avium
EHAVFRRRRFFSGKPVGRRGQDGLR

SEQ ID NO: 79258 - protein, 25 aa, Mycobacterium avium
EHGLRPLVRLVSWAVAGVAPHIMGI

SEQ ID NO: 79259 - protein, 18 aa, Mycobacterium avium
EHHPAMRAFLAVPITIRG

SEQ ID NO: 79260 - protein, 19 aa, Mycobacterium avium
EHHPHLTPLAQRVLEPTDA

SEQ ID NO: 79261 - protein, 20 aa, Mycobacterium avium
EHIADTFIAMGWELAEGPEV

SEQ ID NO: 79262 - protein, 17 aa, Mycobacterium avium
EHILLRTVRCVSGTVEL

SEQ ID NO: 79263 - protein, 21 aa, Mycobacterium avium
EHKGSLSGLRMCYLGDGANNM

SEQ ID NO: 79264 - protein, 19 aa, Mycobacterium avium
EHLGHCVTRAVAGGGDDAD

SEQ ID NO: 79265 - protein, 23 aa, Mycobacterium avium
EHPGVRYRAFDLFEAGPDRIARL

SEQ ID NO: 79266 - protein, 20 aa, Mycobacterium avium
EHRLLDVFNLVPAVIDTHDE

SEQ ID NO: 79267 - protein, 18 aa, Mycobacterium avium
EHRSCAKAQALVAERGFE

SEQ ID NO: 79268 - protein, 24 aa, Mycobacterium avium
EHVCFPSSMVDRITPSTTLQMAAE

SEQ ID NO: 79269 - protein, 23 aa, Mycobacterium avium
EHVKPRLLGHWGTTPGLNLVYAH

SEQ ID NO: 79270 - protein, 22 aa, Mycobacterium avium
EHVNRIGLDAAPDWPSGHDNDV

SEQ ID NO: 79271 - protein, 24 aa, Mycobacterium avium
EIADRAGVSKPVLYQHFTSKLELY

SEQ ID NO: 79272 - protein, 20 aa, Mycobacterium avium
EIAEGWQPVFYLPDKAGSIW

SEQ ID NO: 79273 - protein, 18 aa, Mycobacterium avium
EIAELITMLVRFRTQAVA

SEQ ID NO: 79274 - protein, 19 aa, Mycobacterium avium
EIAEQLLRVLARRLRHTNN

SEQ ID NO: 79275 - protein, 27 aa, Mycobacterium avium
EIDRVFAGKVWGAWHLSEAAADLRLDF

SEQ ID NO: 79276 - protein, 24 aa, Mycobacterium avium
EIEAELFGANGWQPGDAWMAETTL

SEQ ID NO: 79277 - protein, 17 aa, Mycobacterium avium
EIEALYYLHPLTGDVIR

SEQ ID NO: 79278 - protein, 17 aa, Mycobacterium avium
EIEGAWKPDQYANPEGP

SEQ ID NO: 79279 - protein, 24 aa, Mycobacterium avium
EIFGPVLCVIPFDDEEDAIRIAND

SEQ ID NO: 79280 - protein, 24 aa, Mycobacterium avium
EIGCGTGDCAIYLAQHGWNVTAVD

SEQ ID NO: 79281 - protein, 20 aa, Mycobacterium avium
EIGPRLGMAPADVELLAQLV

SEQ ID NO: 79282 - protein, 26 aa, Mycobacterium avium
EIGRPSRLKGAGFYEYVDGKRTRLWP

SEQ ID NO: 79283 - protein, 18 aa, Mycobacterium avium
EIGRRLAPEPVLHAALGP

SEQ ID NO: 79284 - protein, 20 aa, Mycobacterium avium
EIGSGLAVFHPRGGVVRREL

SEQ ID NO: 79285 - protein, 19 aa, Mycobacterium avium
EIIDRGSLSELDRWSNSFV

SEQ ID NO: 79286 - protein, 26 aa, Mycobacterium avium
EILATEILDPLGFRWTNFGVAKQDVP

SEQ ID NO: 79287 - protein, 19 aa, Mycobacterium avium
EINVMGAMQLFAACQKAPS

SEQ ID NO: 79288 - protein, 21 aa, Mycobacterium avium
EIRGTCVLVDGAVKSLSGSAM

SEQ ID NO: 79289 - protein, 18 aa, Mycobacterium avium
EIRKEGKIGRVYYPAPYM

SEQ ID NO: 79290 - protein, 32 aa, Mycobacterium avium
EIRRARKSIAQFKLREGMPIGARVTLRGDRMW

SEQ ID NO: 79291 - protein, 19 aa, Mycobacterium avium
EKAAELLVSTNRKLDKAAS

SEQ ID NO: 79292 - protein, 23 aa, Mycobacterium avium
EKDLVVSHILHLLLTGKLRTGDR

SEQ ID NO: 79293 - protein, 18 aa, Mycobacterium avium
EKESRGLRHHRWVEKEAA

SEQ ID NO: 79294 - protein, 17 aa, Mycobacterium avium
EKFREILEQEYLNRRLI

SEQ ID NO: 79295 - protein, 22 aa, Mycobacterium avium
EKGKAFGAMYAYIEELVQRKAR

SEQ ID NO: 79296 - protein, 17 aa, Mycobacterium avium
EKGPRLGVLGVVVEIDG

SEQ ID NO: 79297 - protein, 24 aa, Mycobacterium avium
EKLDYLVDLGVDFVELMPVNSFAG

SEQ ID NO: 79298 - protein, 17 aa, Mycobacterium avium
EKLEAFANFGFPESHAL

SEQ ID NO: 79299 - protein, 21 aa, Mycobacterium avium
EKLFDRWIKALARVAEQAKGE

SEQ ID NO: 79300 - protein, 17 aa, Mycobacterium avium
EKLRGKTVRDVLPDHLV

SEQ ID NO: 79301 - protein, 18 aa, Mycobacterium avium
EKMEKAVAVARDDLSTIR

SEQ ID NO: 79302 - protein, 25 aa, Mycobacterium avium
EKRDLAFGTSRWSSKLVHGGLRYLA

SEQ ID NO: 79303 - protein, 17 aa, Mycobacterium avium
EKVELCLIDSRGAETRI

SEQ ID NO: 79304 - protein, 21 aa, Mycobacterium avium
EKYRIVAAPVQFDETPPAPAR

SEQ ID NO: 79305 - protein, 27 aa, Mycobacterium avium
ELAFLRPLPVRRLWGVGAVTAEKLRAH

SEQ ID NO: 79306 - protein, 26 aa, Mycobacterium avium
ELAGRWLRPGGLIGIEHDDTTSHQTV

SEQ ID NO: 79307 - protein, 20 aa, Mycobacterium avium
ELAPHPLLVRALEQTARSRE

SEQ ID NO: 79308 - protein, 23 aa, Mycobacterium avium
ELARGELRTEVFALYDPPAPPGM

SEQ ID NO: 79309 - protein, 26 aa, Mycobacterium avium
ELARRSDVFLTSFLPAHRKKFGIDVD

SEQ ID NO: 79310 - protein, 17 aa, Mycobacterium avium
ELCSAGMEGVVFVGVPR

SEQ ID NO: 79311 - protein, 19 aa, Mycobacterium avium
ELDAYVVRRLNLPFRDVDW

SEQ ID NO: 79312 - protein, 23 aa, Mycobacterium avium
ELDDCAFPLLSGVEIGADPNKIF

SEQ ID NO: 79313 - protein, 18 aa, Mycobacterium avium
ELDHLLAKLKRFREEAGK

SEQ ID NO: 79314 - protein, 25 aa, Mycobacterium avium
ELDIAPDGSFEWRVRPTSNGQLVIR

SEQ ID NO: 79315 - protein, 20 aa, Mycobacterium avium
ELEAAASIAAARVKVAIQEP

SEQ ID NO: 79316 - protein, 17 aa, Mycobacterium avium
ELERLYVPWSERTGKRW

SEQ ID NO: 79317 - protein, 19 aa, Mycobacterium avium
ELFIALAGRVARAVIAESP

SEQ ID NO: 79318 - protein, 17 aa, Mycobacterium avium
ELGESWVRVNSIRPGLI

SEQ ID NO: 79319 - protein, 18 aa, Mycobacterium avium
ELGIPAGAGGRVGAARKP

SEQ ID NO: 79320 - protein, 17 aa, Mycobacterium avium
ELGQLFRLPIAALGNGS

SEQ ID NO: 79321 - protein, 19 aa, Mycobacterium avium
ELIDDVVWGCVSQVGDQSS

SEQ ID NO: 79322 - protein, 20 aa, Mycobacterium avium
ELIVAAAFTCFGRQGLQKAT

SEQ ID NO: 79323 - protein, 24 aa, Mycobacterium avium
ELKGCQPQAAKLVEWLKLALDEPH

SEQ ID NO: 79324 - protein, 18 aa, Mycobacterium avium
ELKLCMIHGADPWWDVAI

SEQ ID NO: 79325 - protein, 26 aa, Mycobacterium avium
ELKLDRKIAERRVFPAVDVNPSGTRK

SEQ ID NO: 79326 - protein, 24 aa, Mycobacterium avium
ELLAHCYRMTGSLHDAEDLVQETL

SEQ ID NO: 79327 - protein, 18 aa, Mycobacterium avium
ELLRLGDLAFPIAPGTAG

SEQ ID NO: 79328 - protein, 21 aa, Mycobacterium avium
ELLRRYPRIELVGEVDRMRAT

SEQ ID NO: 79329 - protein, 25 aa, Mycobacterium avium
ELNEFSLRVLHSFLTDPGRPPRTGA

SEQ ID NO: 79330 - protein, 22 aa, Mycobacterium avium
ELPLPRPKYEIFVYSPRVEGVH

SEQ ID NO: 79331 - protein, 22 aa, Mycobacterium avium
ELPPELPATAGVWREGMLDGQH

SEQ ID NO: 79332 - protein, 30 aa, Mycobacterium avium
ELPTYPFQRRRFWPKASGIAGIDGQGAAAS

SEQ ID NO: 79333 - protein, 20 aa, Mycobacterium avium
ELQFGTNHLGHFALTGLLLD

SEQ ID NO: 79334 - protein, 19 aa, Mycobacterium avium
ELRGPAWSGDAAAAMAAAV

SEQ ID NO: 79335 - protein, 21 aa, Mycobacterium avium
ELRIGLATAEDIRQWSYGEVK

SEQ ID NO: 79336 - protein, 24 aa, Mycobacterium avium
ELSRSVFSKGIFPAVDPLASSSTI

SEQ ID NO: 79337 - protein, 23 aa, Mycobacterium avium
ELSVIPRQRVLVISTGSELVAPG

SEQ ID NO: 79338 - protein, 21 aa, Mycobacterium avium
ELTAACGAALMADDPAVKPLR

SEQ ID NO: 79339 - protein, 26 aa, Mycobacterium avium
ELTAARAARLKWWTTDLQVRTADRCL

SEQ ID NO: 79340 - protein, 19 aa, Mycobacterium avium
ELTEATVAEAGWKLDDVLP

SEQ ID NO: 79341 - protein, 17 aa, Mycobacterium avium
ELTEFDIELDLRGSEFQ

SEQ ID NO: 79342 - protein, 21 aa, Mycobacterium avium
ELTPHRGAWCGNDIWREVLPP

SEQ ID NO: 79343 - protein, 20 aa, Mycobacterium avium
ELVDAAGISYAFRIVEDVGV

SEQ ID NO: 79344 - protein, 19 aa, Mycobacterium avium
ELVERLAVRGSRLAEVLSR

SEQ ID NO: 79345 - protein, 25 aa, Mycobacterium avium
ELVERLRLTIPELPWLSRKRIQQEW

SEQ ID NO: 79346 - protein, 18 aa, Mycobacterium avium
ELVYAVLNLYPYNPGHLM

SEQ ID NO: 79347 - protein, 18 aa, Mycobacterium avium
ELWFGAHPGDPAWLETDN

SEQ ID NO: 79348 - protein, 23 aa, Mycobacterium avium
ELYGKPQFWPLWEAAADANLPVA

SEQ ID NO: 79349 - protein, 18 aa, Mycobacterium avium
ELYRINLHHVFLVTHAFL

SEQ ID NO: 79350 - protein, 25 aa, Mycobacterium avium
EMADLIVSGALEFDIAATYPLDRVA

SEQ ID NO: 79351 - protein, 25 aa, Mycobacterium avium
EMGEGARPPWSIGEPQPEIAALIEA

SEQ ID NO: 79352 - protein, 24 aa, Mycobacterium avium
EMGLARLWQSWGVEPDVVLGHSVG

SEQ ID NO: 79353 - protein, 20 aa, Mycobacterium avium
EMHARVSGLADYFAVDELDA

SEQ ID NO: 79354 - protein, 19 aa, Mycobacterium avium
EMHQAGAPGGVFASLFTCG

SEQ ID NO: 79355 - protein, 23 aa, Mycobacterium avium
EMLTMGFAEEVDRILSETPEYKQ

SEQ ID NO: 79356 - protein, 17 aa, Mycobacterium avium
EMMPRLMAQQIDEAGGA

SEQ ID NO: 79357 - protein, 19 aa, Mycobacterium avium
EMMRHVLSPVLRIYRLDVP

SEQ ID NO: 79358 - protein, 21 aa, Mycobacterium avium
EMNLRTILRLSPEAVFKPRWL

SEQ ID NO: 79359 - protein, 18 aa, Mycobacterium avium
EMNWRILKFRPRESDAAA

SEQ ID NO: 79360 - protein, 21 aa, Mycobacterium avium
EMREAVLHFAVYAGWPKASRF

SEQ ID NO: 79361 - protein, 18 aa, Mycobacterium avium
EMTGLALQRVYLDRVAKL

SEQ ID NO: 79362 - protein, 26 aa, Mycobacterium avium
EMVARGCPFSGLLYAGLAITSNGPAV

SEQ ID NO: 79363 - protein, 23 aa, Mycobacterium avium
ENAIWKARTQDIGYLDLTGCMAL

SEQ ID NO: 79364 - protein, 25 aa, Mycobacterium avium
ENDFRDVLPAAGWEISYLGPTTYQV

SEQ ID NO: 79365 - protein, 24 aa, Mycobacterium avium
ENDSVRIAREFLIRVVNDAIEHGE

SEQ ID NO: 79366 - protein, 17 aa, Mycobacterium avium
ENFRPGTLEKWNLGYDV

SEQ ID NO: 79367 - protein, 23 aa, Mycobacterium avium
ENFSPRVVENFGLDYDSLTALNP

SEQ ID NO: 79368 - protein, 17 aa, Mycobacterium avium
ENGARASFMPKPFGQHP

SEQ ID NO: 79369 - protein, 25 aa, Mycobacterium avium
ENLAREFMELFALGHGNGYTESDVR

SEQ ID NO: 79370 - protein, 26 aa, Mycobacterium avium
ENLFFKEKRYDLARVGRYKVNKKLGL

SEQ ID NO: 79371 - protein, 18 aa, Mycobacterium avium
ENLRRLAHVAALLADCGN

SEQ ID NO: 79372 - protein, 19 aa, Mycobacterium avium
ENMRARVNAALGITEQGFN

SEQ ID NO: 79373 - protein, 24 aa, Mycobacterium avium
ENRLPPVHVFAGINLSFGAMGPLL

SEQ ID NO: 79374 - protein, 24 aa, Mycobacterium avium
ENSTCLNCGSALGFSIEQMALLVI

SEQ ID NO: 79375 - protein, 23 aa, Mycobacterium avium
ENTVPYGFDFARPVSRFEEALRV

SEQ ID NO: 79376 - protein, 26 aa, Mycobacterium avium
ENVDAFLAVCRKWDVLATVIGEVTDG

SEQ ID NO: 79377 - protein, 23 aa, Mycobacterium avium
ENVPEIWRRLDAVGLRTTEACGD

SEQ ID NO: 79378 - protein, 19 aa, Mycobacterium avium
EPAEPKGPGLLERLWHDRD

SEQ ID NO: 79379 - protein, 21 aa, Mycobacterium avium
EPATEKVRQLFADAGIRIPTQ

SEQ ID NO: 79380 - protein, 21 aa, Mycobacterium avium
EPCSALDPISTMAIEELISEL

SEQ ID NO: 79381 - protein, 20 aa, Mycobacterium avium
EPDARMRAVLAHRSPAVRVL

SEQ ID NO: 79382 - protein, 30 aa, Mycobacterium avium
EPDWVNTIFLSTRFKAWRVGGYNEYLYTFF

SEQ ID NO: 79383 - protein, 19 aa, Mycobacterium avium
EPFGAEVFHVNPVCGDEVT

SEQ ID NO: 79384 - protein, 18 aa, Mycobacterium avium
EPGDLCVLNEPPHTALAE

SEQ ID NO: 79385 - protein, 18 aa, Mycobacterium avium
EPGMTLLDIGCGWGATMR

SEQ ID NO: 79386 - protein, 17 aa, Mycobacterium avium
EPGMVLAVTGYVWEEGV

SEQ ID NO: 79387 - protein, 23 aa, Mycobacterium avium
EPGTAARFIPLWDRTVPERLGEP

SEQ ID NO: 79388 - protein, 25 aa, Mycobacterium avium
EPGTLIWRNRWITRDGIVECREALA

SEQ ID NO: 79389 - protein, 25 aa, Mycobacterium avium
EPHLRKAYNGFRRMGLDADTAETAA

SEQ ID NO: 79390 - protein, 23 aa, Mycobacterium avium
EPIDRIVSLGAFEHFADGAGDAG

SEQ ID NO: 79391 - protein, 24 aa, Mycobacterium avium
EPIGVCGLITPWNWPINQVAVKVY

SEQ ID NO: 79392 - protein, 20 aa, Mycobacterium avium
EPIVAPGSWIGGDRDGNPNV

SEQ ID NO: 79393 - protein, 23 aa, Mycobacterium avium
EPKDTRLLLEFMGLANHRKAIRA

SEQ ID NO: 79394 - protein, 24 aa, Mycobacterium avium
EPLGNTGPTGWRTRVRLDVGADRR

SEQ ID NO: 79395 - protein, 24 aa, Mycobacterium avium
EPLPEGSGFEFVDKVVGGAVPRQF

SEQ ID NO: 79396 - protein, 23 aa, Mycobacterium avium
EPMIPIYIFYSMFGFQRTGDGLW

SEQ ID NO: 79397 - protein, 26 aa, Mycobacterium avium
EPNRAWRLYRRLGFTDIIRRYHFAGD

SEQ ID NO: 79398 - protein, 25 aa, Mycobacterium avium
EPRPSWGHPKYDPIWAAATKHDIVV

SEQ ID NO: 79399 - protein, 20 aa, Mycobacterium avium
EPRTFTLRAARLLAGRTADF

SEQ ID NO: 79400 - protein, 20 aa, Mycobacterium avium
EPTPRRLTIVVSNDNGGGIF

SEQ ID NO: 79401 - protein, 22 aa, Mycobacterium avium
EPVDISNAVLFLASDESRYITG

SEQ ID NO: 79402 - protein, 25 aa, Mycobacterium avium
EPVLKLLKITGDWQKFKGLPGAEGR

SEQ ID NO: 79403 - protein, 18 aa, Mycobacterium avium
EPYPEIMHALKVRSAITR

SEQ ID NO: 79404 - protein, 24 aa, Mycobacterium avium
EQARRAAAPWSRAIVGSAVSAAEW

SEQ ID NO: 79405 - protein, 29 aa, Mycobacterium avium
EQARRLKVPPERWVYPLAGTDAHDTASIA

SEQ ID NO: 79406 - protein, 19 aa, Mycobacterium avium
EQATADAFTDGWFKTGDLG

SEQ ID NO: 79407 - protein, 18 aa, Mycobacterium avium
EQDHARFAKIFDVNLWAP

SEQ ID NO: 79408 - protein, 23 aa, Mycobacterium avium
EQDLQHRLGRMVASTTAFGANEN

SEQ ID NO: 79409 - protein, 22 aa, Mycobacterium avium
EQEMPGLMSLRREYHDVQPLKG

SEQ ID NO: 79410 - protein, 24 aa, Mycobacterium avium
EQGDPRFSDVSSRVFGTPHDVDVG

SEQ ID NO: 79411 - protein, 18 aa, Mycobacterium avium
EQHDVVAFDSRREALERL

SEQ ID NO: 79412 - protein, 26 aa, Mycobacterium avium
EQIDFWRFNVAFARQILAQQPISGPG

SEQ ID NO: 79413 - protein, 24 aa, Mycobacterium avium
EQIYEMYRLLAIAKYEERYVIPTA

SEQ ID NO: 79414 - protein, 24 aa, Mycobacterium avium
EQLNGHKGCVIWFTGLSGSGKSTV

SEQ ID NO: 79415 - protein, 17 aa, Mycobacterium avium
EQLRFQIGRWQYRDLIR

SEQ ID NO: 79416 - protein, 32 aa, Mycobacterium avium
EQPEKTRWGLPVDRLRFAMSNYQRLTMQQMTH

SEQ ID NO: 79417 - protein, 26 aa, Mycobacterium avium
EQPWFTGRFATIGMSYLGFTQWALLQ

SEQ ID NO: 79418 - protein, 24 aa, Mycobacterium avium
EQQDRFLAGVARGGVLTAALNEPG

SEQ ID NO: 79419 - protein, 19 aa, Mycobacterium avium
EQRGRRWPVIISGTITDAS

SEQ ID NO: 79420 - protein, 18 aa, Mycobacterium avium
EQSLREFLGPMITALEGY

SEQ ID NO: 79421 - protein, 23 aa, Mycobacterium avium
EQSQWPRWVPVGRMGLPEDQARV

SEQ ID NO: 79422 - protein, 24 aa, Mycobacterium avium
EQTAVCVLEHDWTTVVMVDSHDGQ

SEQ ID NO: 79423 - protein, 18 aa, Mycobacterium avium
EQTLFRFVDVDGRELEHY

SEQ ID NO: 79424 - protein, 21 aa, Mycobacterium avium
EQVPAALAMRPDLITVCAGMN

SEQ ID NO: 79425 - protein, 19 aa, Mycobacterium avium
ERALAIGVRVMANIVEQSA

SEQ ID NO: 79426 - protein, 24 aa, Mycobacterium avium
ERAVFVLREVFGFDYDEIAEAVGK

SEQ ID NO: 79427 - protein, 18 aa, Mycobacterium avium
ERAYQIFGNHEFGLPPGD

SEQ ID NO: 79428 - protein, 21 aa, Mycobacterium avium
ERDRERFAISAGGVVAVGKGV

SEQ ID NO: 79429 - protein, 26 aa, Mycobacterium avium
ERDTCWPWLQAEWRLISEHVRVVVAL

SEQ ID NO: 79430 - protein, 20 aa, Mycobacterium avium
ERFAVSRYTIREALRRLRED

SEQ ID NO: 79431 - protein, 25 aa, Mycobacterium avium
ERGDILLIRTGWWTRYLETGNKTEP

SEQ ID NO: 79432 - protein, 23 aa, Mycobacterium avium
ERHFARAARACYVSQPALSEAIR

SEQ ID NO: 79433 - protein, 23 aa, Mycobacterium avium
ERHVEAVTAWLQRHHAGDRNRGR

SEQ ID NO: 79434 - protein, 24 aa, Mycobacterium avium
ERIAPRPTTPFAQALRLALIDAAP

SEQ ID NO: 79435 - protein, 18 aa, Mycobacterium avium
ERLKGLFMASFEAIEHRH

SEQ ID NO: 79436 - protein, 17 aa, Mycobacterium avium
ERLLLTVHVDPFTREQT

SEQ ID NO: 79437 - protein, 22 aa, Mycobacterium avium
ERLSRLGGIVGTAFQISDDIID

SEQ ID NO: 79438 - protein, 27 aa, Mycobacterium avium
ERLTRAWTGLRAMRSYALATMDVEQPG

SEQ ID NO: 79439 - protein, 18 aa, Mycobacterium avium
ERMRLGALARHIAQELPP

SEQ ID NO: 79440 - protein, 26 aa, Mycobacterium avium
ERNQLPSGSAICFISSVAGMGWENDL

SEQ ID NO: 79441 - protein, 29 aa, Mycobacterium avium
ERPATAADEIVRWATPVTSFQRTALQDYE

SEQ ID NO: 79442 - protein, 19 aa, Mycobacterium avium
ERPGRPLGASTAEFADLAA

SEQ ID NO: 79443 - protein, 17 aa, Mycobacterium avium
ERPPLRQVLNGPSDDPF

SEQ ID NO: 79444 - protein, 23 aa, Mycobacterium avium
ERQRIEPLLARSANWVTGESSAD

SEQ ID NO: 79445 - protein, 23 aa, Mycobacterium avium
ERRKEMLHNSALRGEQMKGHAST

SEQ ID NO: 79446 - protein, 22 aa, Mycobacterium avium
ERRKQICARAYRVLTEEVGFPP

SEQ ID NO: 79447 - protein, 23 aa, Mycobacterium avium
ERRMKKEIADVITLQEQLGLDVL

SEQ ID NO: 79448 - protein, 24 aa, Mycobacterium avium
ERSARAWLFTVARNMIIDDRRSAR

SEQ ID NO: 79449 - protein, 25 aa, Mycobacterium avium
ERSGPSRARYLMLRLLERAGEQRVA

SEQ ID NO: 79450 - protein, 22 aa, Mycobacterium avium
ERSSHTWFVLTHLLGKPGVRNY

SEQ ID NO: 79451 - protein, 19 aa, Mycobacterium avium
ERTGIELTESMAMWPGAAV

SEQ ID NO: 79452 - protein, 19 aa, Mycobacterium avium
ERTGLPIRVDRRLRETHLG

SEQ ID NO: 79453 - protein, 24 aa, Mycobacterium avium
ERTRARAGAVAATIRTDGAARAAR

SEQ ID NO: 79454 - protein, 18 aa, Mycobacterium avium
ERVGKRGLGFGAEVRSKA

SEQ ID NO: 79455 - protein, 22 aa, Mycobacterium avium
ERYRCRVHTFAADVGDAAQVEQ

SEQ ID NO: 79456 - protein, 20 aa, Mycobacterium avium
ERYVIPTAFAPQARDLEQMG

SEQ ID NO: 79457 - protein, 17 aa, Mycobacterium avium
ESAETQTAMGFSQDPDT

SEQ ID NO: 79458 - protein, 23 aa, Mycobacterium avium
ESAVLRLATAVAVAKSVDELLSI

SEQ ID NO: 79459 - protein, 18 aa, Mycobacterium avium
ESDILARIGGDEFCVMVT

SEQ ID NO: 79460 - protein, 20 aa, Mycobacterium avium
ESGFPLMPMMVPPPTTSAGT

SEQ ID NO: 79461 - protein, 24 aa, Mycobacterium avium
ESGHPGRFLLGIGAGHREHTREYV

SEQ ID NO: 79462 - protein, 27 aa, Mycobacterium avium
ESGLRGGILIPARWVGYPPYHDRRYDK

SEQ ID NO: 79463 - protein, 17 aa, Mycobacterium avium
ESGWTFDHFYPIFSDSS

SEQ ID NO: 79464 - protein, 19 aa, Mycobacterium avium
ESIADRLAEAFAERMHQRV

SEQ ID NO: 79465 - protein, 31 aa, Mycobacterium avium
ESIRKTSAGWVWKFDPAIFGGEFLQPTPADE

SEQ ID NO: 79466 - protein, 21 aa, Mycobacterium avium
ESLASLPGCRLLVRPDEIRRD

SEQ ID NO: 79467 - protein, 19 aa, Mycobacterium avium
ESLDSLGPIFSELRDAGRE

SEQ ID NO: 79468 - protein, 17 aa, Mycobacterium avium
ESLDVCFELADRILKSM

SEQ ID NO: 79469 - protein, 20 aa, Mycobacterium avium
ESLIKAGAFDSLKHARKGLF

SEQ ID NO: 79470 - protein, 23 aa, Mycobacterium avium
ESLLPRYLTTRVYAALLESAASE

SEQ ID NO: 79471 - protein, 22 aa, Mycobacterium avium
ESLPKLNSFVLPGGSPLSALLH

SEQ ID NO: 79472 - protein, 23 aa, Mycobacterium avium
ESLRLTTDYLKTRKQFGVTLNKF

SEQ ID NO: 79473 - protein, 17 aa, Mycobacterium avium
ESLRPVPPGVVGELYVA

SEQ ID NO: 79474 - protein, 19 aa, Mycobacterium avium
ESLSREFRGLLDRVPPADP

SEQ ID NO: 79475 - protein, 27 aa, Mycobacterium avium
ESLTGAPMPRWLAGALAAPAGPPRPCR

SEQ ID NO: 79476 - protein, 24 aa, Mycobacterium avium
ESMGFKTFGFAFGREDVWEPEEIL

SEQ ID NO: 79477 - protein, 24 aa, Mycobacterium avium
ESNAPVLLGLIGLWYSNFMGAQSR

SEQ ID NO: 79478 - protein, 26 aa, Mycobacterium avium
ESPRETWLRLLLLRAGFPRPRTQLPV

SEQ ID NO: 79479 - protein, 28 aa, Mycobacterium avium
ESQCGWLKDRFGLSWQIVPDRLFELIGD

SEQ ID NO: 79480 - protein, 18 aa, Mycobacterium avium
ESRRLRRGFTAFGQTQWS

SEQ ID NO: 79481 - protein, 20 aa, Mycobacterium avium
ESSAWAHALASRYELHTPAV

SEQ ID NO: 79482 - protein, 24 aa, Mycobacterium avium
ESSQLRSGFGFLAIHGGGLEEMTD

SEQ ID NO: 79483 - protein, 24 aa, Mycobacterium avium
ESTPLSRRGTLWSYTENRYAPPPP

SEQ ID NO: 79484 - protein, 37 aa, Mycobacterium avium
ESTPVDGKVGWKGFHAIERDLWQAGAITPGTKALSTE

SEQ ID NO: 79485 - protein, 20 aa, Mycobacterium avium
ESTWSTFMATYWQLGNTPHV

SEQ ID NO: 79486 - protein, 17 aa, Mycobacterium avium
ESVAAILRYCSQHRIAV

SEQ ID NO: 79487 - protein, 17 aa, Mycobacterium avium
ESVKYAKERQSFGQPIG

SEQ ID NO: 79488 - protein, 17 aa, Mycobacterium avium
ESVRVYLATGLTRVDRP

SEQ ID NO: 79489 - protein, 18 aa, Mycobacterium avium
ESYCYIPLLEELDFMPSK

SEQ ID NO: 79490 - protein, 24 aa, Mycobacterium avium
ETAARGYSAVITRLHGESWSGSAS

SEQ ID NO: 79491 - protein, 20 aa, Mycobacterium avium
ETAARLGLRPLARIHTTAVV

SEQ ID NO: 79492 - protein, 25 aa, Mycobacterium avium
ETAEYSLRGANLWDEVKDRLDRPGG

SEQ ID NO: 79493 - protein, 24 aa, Mycobacterium avium
ETAKTFKDGWLHTGDMAREDEDGF

SEQ ID NO: 79494 - protein, 23 aa, Mycobacterium avium
ETAWKLAKQYFKLTGKPGKHKVI

SEQ ID NO: 79495 - protein, 18 aa, Mycobacterium avium
ETAWKLASDLDRFGEWMT

SEQ ID NO: 79496 - protein, 17 aa, Mycobacterium avium
ETAYAWRTILARGNGSG

SEQ ID NO: 79497 - protein, 18 aa, Mycobacterium avium
ETAYCLGVEKLLGITDQI

SEQ ID NO: 79498 - protein, 25 aa, Mycobacterium avium
ETCVGRLRYLGVVLYDMDRVLEAAS

SEQ ID NO: 79499 - protein, 24 aa, Mycobacterium avium
ETDDLRPLWLAAPVTEVLPRTTVA

SEQ ID NO: 79500 - protein, 27 aa, Mycobacterium avium
ETDKPFLMPVEDVFTITGRGTVVTGRV

SEQ ID NO: 79501 - protein, 21 aa, Mycobacterium avium
ETGELLRWLDSQTKRNLVITF

SEQ ID NO: 79502 - protein, 22 aa, Mycobacterium avium
ETLDPSIYWMGMHHSRLIKRDS

SEQ ID NO: 79503 - protein, 22 aa, Mycobacterium avium
ETLNSMKALWARPKDEVSEEEY

SEQ ID NO: 79504 - protein, 17 aa, Mycobacterium avium
ETLRLHPPLIILMRVAK

SEQ ID NO: 79505 - protein, 20 aa, Mycobacterium avium
ETLTTLVIRGEGGFGGMPGQ

SEQ ID NO: 79506 - protein, 26 aa, Mycobacterium avium
ETLVALGAEVRWASCNIFSTQDHAAA

SEQ ID NO: 79507 - protein, 20 aa, Mycobacterium avium
ETPACFEPTLDYVVVKAPRF

SEQ ID NO: 79508 - protein, 24 aa, Mycobacterium avium
ETTKGEAECAQWVAEQLAAVGYAP

SEQ ID NO: 79509 - protein, 23 aa, Mycobacterium avium
ETTKRYMHHYNFPPFSTGETGRV

SEQ ID NO: 79510 - protein, 23 aa, Mycobacterium avium
ETTLPRECLLVFGQEGPGITDDT

SEQ ID NO: 79511 - protein, 23 aa, Mycobacterium avium
ETTRARAPLPLNVIGLNNIAPAI

SEQ ID NO: 79512 - protein, 23 aa, Mycobacterium avium
ETVTEARCGIGYLHTGIEKNLEY

SEQ ID NO: 79513 - protein, 17 aa, Mycobacterium avium
ETYGALFDRLKDGKISQ

SEQ ID NO: 79514 - protein, 19 aa, Mycobacterium avium
EVAAEFGAGLVCSHTGNAL

SEQ ID NO: 79515 - protein, 19 aa, Mycobacterium avium
EVADTYFALMDRLGTDGLL

SEQ ID NO: 79516 - protein, 20 aa, Mycobacterium avium
EVAEGYILTCQGVPDTDSVT

SEQ ID NO: 79517 - protein, 17 aa, Mycobacterium avium
EVAERAGSIALQTRQRV

SEQ ID NO: 79518 - protein, 28 aa, Mycobacterium avium
EVAEVWRRGSVIGSWLLDLTAIALHESP

SEQ ID NO: 79519 - protein, 23 aa, Mycobacterium avium
EVAFKLSRLTGRTKLVAAQEAFH

SEQ ID NO: 79520 - protein, 25 aa, Mycobacterium avium
EVALSLPLGAGRLTREWLPDDPPGR

SEQ ID NO: 79521 - protein, 27 aa, Mycobacterium avium
EVARYLFRRVVSWGRSSNVFLRNGARL

SEQ ID NO: 79522 - protein, 24 aa, Mycobacterium avium
EVASRAGLIQVMRDMLAAPDQFDW

SEQ ID NO: 79523 - protein, 27 aa, Mycobacterium avium
EVAVDLRQDWPAALRAAGFDPTQRTAW

SEQ ID NO: 79524 - protein, 18 aa, Mycobacterium avium
EVDGFVWHAYIPGIEPGQ

SEQ ID NO: 79525 - protein, 20 aa, Mycobacterium avium
EVDKVFVVACGTAYHSGLLA

SEQ ID NO: 79526 - protein, 18 aa, Mycobacterium avium
EVDPAAALKAELRSKPGD

SEQ ID NO: 79527 - protein, 24 aa, Mycobacterium avium
EVEGGKIRVAEGWAHGPQIDKGAR

SEQ ID NO: 79528 - protein, 26 aa, Mycobacterium avium
EVFVLRPCIVAGPGATALADAMPWNQ

SEQ ID NO: 79529 - protein, 24 aa, Mycobacterium avium
EVGRPDIMIVVGGVIPPGDFDELY

SEQ ID NO: 79530 - protein, 25 aa, Mycobacterium avium
EVHGVLIPGGFGIRGIEGKIGAIHY

SEQ ID NO: 79531 - protein, 24 aa, Mycobacterium avium
EVIEKMRVAGRIAAGALVEAGKAV

SEQ ID NO: 79532 - protein, 26 aa, Mycobacterium avium
EVIELRPDLDWDKGKTLHWVIEHLRR

SEQ ID NO: 79533 - protein, 19 aa, Mycobacterium avium
EVIGPKGKIINAITEETGA

SEQ ID NO: 79534 - protein, 18 aa, Mycobacterium avium
EVKQRLATEGSLQLIDAL

SEQ ID NO: 79535 - protein, 23 aa, Mycobacterium avium
EVLDRYLPVLTELRLRYLDDHDF

SEQ ID NO: 79536 - protein, 27 aa, Mycobacterium avium
EVLGAGIPLFGICFGNQILGRALGLST

SEQ ID NO: 79537 - protein, 22 aa, Mycobacterium avium
EVLPEKPELVLLDNFPVWQTQM

SEQ ID NO: 79538 - protein, 23 aa, Mycobacterium avium
EVLPNYSGGLGILAGDHLKSASD

SEQ ID NO: 79539 - protein, 22 aa, Mycobacterium avium
EVLRSFLDWLFARYREIIDSES

SEQ ID NO: 79540 - protein, 19 aa, Mycobacterium avium
EVLSALGVVVNKGNVGALE

SEQ ID NO: 79541 - protein, 24 aa, Mycobacterium avium
EVNEAFAPVPMAWLKDIGADEKKL

SEQ ID NO: 79542 - protein, 18 aa, Mycobacterium avium
EVNGGWTVMRFALDAEHG

SEQ ID NO: 79543 - protein, 18 aa, Mycobacterium avium
EVPDGVVVEAMLAGDGNL

SEQ ID NO: 79544 - protein, 20 aa, Mycobacterium avium
EVRAYLRATARTVLAAHWRE

SEQ ID NO: 79545 - protein, 20 aa, Mycobacterium avium
EVRGPWIAGSYYLGRDDSKF

SEQ ID NO: 79546 - protein, 19 aa, Mycobacterium avium
EVRHRIAFLPDYDMSMARL

SEQ ID NO: 79547 - protein, 24 aa, Mycobacterium avium
EVRIATAPGDYVFIPPYLPHREEN

SEQ ID NO: 79548 - protein, 35 aa, Mycobacterium avium
EVRMGMRVEAVWKPREQWGFGIDNIEYFRPTGEPD

SEQ ID NO: 79549 - protein, 17 aa, Mycobacterium avium
EVRRKHGPASMVFNNAG

SEQ ID NO: 79550 - protein, 25 aa, Mycobacterium avium
EVRSRSDLLAALPERLHDRAVTLEV

SEQ ID NO: 79551 - protein, 23 aa, Mycobacterium avium
EVRVPAKALWRAQTQRAVENFPI

SEQ ID NO: 79552 - protein, 18 aa, Mycobacterium avium
EVRWDIRPSPHLGTLEMR

SEQ ID NO: 79553 - protein, 27 aa, Mycobacterium avium
EVTAFSRPATWWARAGGPVLRVGQRVI

SEQ ID NO: 79554 - protein, 21 aa, Mycobacterium avium
EVTGVPILFASTGEKLEDFDV

SEQ ID NO: 79555 - protein, 17 aa, Mycobacterium avium
EVTRKLDKMGWRSSDTA

SEQ ID NO: 79556 - protein, 24 aa, Mycobacterium avium
EVTVSSYVRWPESMRPLVRPLAPA

SEQ ID NO: 79557 - protein, 20 aa, Mycobacterium avium
EVVAAHLVNLMWNGLTHLEA

SEQ ID NO: 79558 - protein, 24 aa, Mycobacterium avium
EVVAIGITPQGSWVLTDGDPAALA

SEQ ID NO: 79559 - protein, 20 aa, Mycobacterium avium
EVVARFCGRELVLDAEVEEK

SEQ ID NO: 79560 - protein, 20 aa, Mycobacterium avium
EVVRRLKAAGAVIVGKTNTC

SEQ ID NO: 79561 - protein, 20 aa, Mycobacterium avium
EVVRRLRAAGAVIIGKTNVP

SEQ ID NO: 79562 - protein, 21 aa, Mycobacterium avium
EVYCAPEVVEYLGAATDQIRD

SEQ ID NO: 79563 - protein, 20 aa, Mycobacterium avium
EVYDYLRLLYARAGTPHCPV

SEQ ID NO: 79564 - protein, 24 aa, Mycobacterium avium
EWKPEAEGGFSRVQRRIWELEKRR

SEQ ID NO: 79565 - protein, 20 aa, Mycobacterium avium
EWLPTDHPLVGMPNVVLTPH

SEQ ID NO: 79566 - protein, 18 aa, Mycobacterium avium
EWMSRPHLVQAWESNWPL

SEQ ID NO: 79567 - protein, 28 aa, Mycobacterium avium
EWPENPRFLMCTPLSHAGAAFFVPTIIK

SEQ ID NO: 79568 - protein, 22 aa, Mycobacterium avium
EWREIDGAATLYTFTVARRPTG

SEQ ID NO: 79569 - protein, 19 aa, Mycobacterium avium
EYDRAIGYEAAYAGTSFAT

SEQ ID NO: 79570 - protein, 18 aa, Mycobacterium avium
EYGARGWAMNTLFDGIEA

SEQ ID NO: 79571 - protein, 17 aa, Mycobacterium avium
EYGGLGLDYEYQKAFDA

SEQ ID NO: 79572 - protein, 19 aa, Mycobacterium avium
EYGGRGFSAIEQFIFAEEA

SEQ ID NO: 79573 - protein, 27 aa, Mycobacterium avium
EYGRTPAQVLVRWNLQLDNVVVSRSSK

SEQ ID NO: 79574 - protein, 17 aa, Mycobacterium avium
EYLDMFYNLGIAGRAMR

SEQ ID NO: 79575 - protein, 18 aa, Mycobacterium avium
EYLSFLPSNCFDQPPIVN

SEQ ID NO: 79576 - protein, 25 aa, Mycobacterium avium
EYQRRLRAANALDFDDLIGETVAVL

SEQ ID NO: 79577 - protein, 19 aa, Mycobacterium avium
FAAAAGFSQPILHGLCTYG

SEQ ID NO: 79578 - protein, 23 aa, Mycobacterium avium
FAACVEAGVPFCTQVGHTGPLRP

SEQ ID NO: 79579 - protein, 19 aa, Mycobacterium avium
FAAHRGMDRLPLAKSASGG

SEQ ID NO: 79580 - protein, 18 aa, Mycobacterium avium
FAAQALAVMREWKFGAAD

SEQ ID NO: 79581 - protein, 24 aa, Mycobacterium avium
FAAQPGIFTFGWGPVLHQLAAGLG

SEQ ID NO: 79582 - protein, 23 aa, Mycobacterium avium
FAARFLICATGCLSAVNRPDIPG

SEQ ID NO: 79583 - protein, 20 aa, Mycobacterium avium
FAASSRFGGIVSPPVMLQTW

SEQ ID NO: 79584 - protein, 32 aa, Mycobacterium avium
FAAVRQFRASVCVLGPLVGRCKRARVALPGGD

SEQ ID NO: 79585 - protein, 26 aa, Mycobacterium avium
FADDGIGVNCLWPQTYIATAAVANMA

SEQ ID NO: 79586 - protein, 18 aa, Mycobacterium avium
FAELEPDFQRAYKELAKQ

SEQ ID NO: 79587 - protein, 22 aa, Mycobacterium avium
FAELLAIVSAMVCNRIDKVTVN

SEQ ID NO: 79588 - protein, 24 aa, Mycobacterium avium
FAELRYRPGDVLMFGPEPTGLDAA

SEQ ID NO: 79589 - protein, 18 aa, Mycobacterium avium
FAEQGWYFAGDSAYYDRD

SEQ ID NO: 79590 - protein, 18 aa, Mycobacterium avium
FAGAALFAAFSMVTHAGQ

SEQ ID NO: 79591 - protein, 17 aa, Mycobacterium avium
FAGGPWSNYVMHSIATM

SEQ ID NO: 79592 - protein, 26 aa, Mycobacterium avium
FAGPVLRPSTTLVRRSRGFAEASADS

SEQ ID NO: 79593 - protein, 25 aa, Mycobacterium avium
FAHKKIAGPGIEWYIMPGSDKPMRR

SEQ ID NO: 79594 - protein, 19 aa, Mycobacterium avium
FAICCATILDMGSEQQKRT

SEQ ID NO: 79595 - protein, 21 aa, Mycobacterium avium
FAIELGRLGGLGVLNGEGLIG

SEQ ID NO: 79596 - protein, 24 aa, Mycobacterium avium
FAKLREPLEVPGLLDVQIDSFEWL

SEQ ID NO: 79597 - protein, 26 aa, Mycobacterium avium
FAKNMLPRLSGLRGIIEAIDDEIMKL

SEQ ID NO: 79598 - protein, 20 aa, Mycobacterium avium
FAKRMVGSAAAVYAHNDPVM

SEQ ID NO: 79599 - protein, 27 aa, Mycobacterium avium
FALDRGGGLPAALVLAEAVSWQGRGEE

SEQ ID NO: 79600 - protein, 23 aa, Mycobacterium avium
FALEKRRLFARAWTFVGHESEIP

SEQ ID NO: 79601 - protein, 17 aa, Mycobacterium avium
FALELVESVVGEDQVDA

SEQ ID NO: 79602 - protein, 20 aa, Mycobacterium avium
FALIARRHMHVYGTTREQLS

SEQ ID NO: 79603 - protein, 23 aa, Mycobacterium avium
FALMCGDLSAPVTFAVDRTGWAP

SEQ ID NO: 79604 - protein, 17 aa, Mycobacterium avium
FALPPGFPEEMKADFTR

SEQ ID NO: 79605 - protein, 20 aa, Mycobacterium avium
FALSTLRDIYGAALGYQVDA

SEQ ID NO: 79606 - protein, 24 aa, Mycobacterium avium
FAPGPGRRLGVLVDHLVPGSKEAR

SEQ ID NO: 79607 - protein, 19 aa, Mycobacterium avium
FAPITRWAAGIPTARAIPE

SEQ ID NO: 79608 - protein, 23 aa, Mycobacterium avium
FAPPTLHAMGIRVATSFPSFSKR

SEQ ID NO: 79609 - protein, 17 aa, Mycobacterium avium
FAPRRPRTGPAELLYLG

SEQ ID NO: 79610 - protein, 19 aa, Mycobacterium avium
FAPVSAESLFSWLATAEDG

SEQ ID NO: 79611 - protein, 20 aa, Mycobacterium avium
FARIDARAAAPLAAVSVPGT

SEQ ID NO: 79612 - protein, 17 aa, Mycobacterium avium
FARLCKAMGRAELATDE

SEQ ID NO: 79613 - protein, 23 aa, Mycobacterium avium
FASRLPLYFPTPLRHRFTPEIRA

SEQ ID NO: 79614 - protein, 24 aa, Mycobacterium avium
FATELRNLLARCAERGVDPQALER

SEQ ID NO: 79615 - protein, 18 aa, Mycobacterium avium
FAVAWEWENTALISELVE

SEQ ID NO: 79616 - protein, 22 aa, Mycobacterium avium
FAVLEPRADGFRNFARPGEKAP

SEQ ID NO: 79617 - protein, 17 aa, Mycobacterium avium
FAVPRIVASAPKVVIQE

SEQ ID NO: 79618 - protein, 18 aa, Mycobacterium avium
FAVVEFVVSPLFGSPPEA

SEQ ID NO: 79619 - protein, 17 aa, Mycobacterium avium
FAYQKSMLINVGDEKGL

SEQ ID NO: 79620 - protein, 22 aa, Mycobacterium avium
FCDAMIAIRGEIDRVGAGEWPV

SEQ ID NO: 79621 - protein, 24 aa, Mycobacterium avium
FCEKVDVVCGIGWDNVDSDNPAFR

SEQ ID NO: 79622 - protein, 25 aa, Mycobacterium avium
FCIPAVEAKGSLLLEDVGVPLPALG

SEQ ID NO: 79623 - protein, 20 aa, Mycobacterium avium
FCVTRCGYCDFNTYTPAELG

SEQ ID NO: 79624 - protein, 19 aa, Mycobacterium avium
FDAALVLDVIERFRITNFT

SEQ ID NO: 79625 - protein, 18 aa, Mycobacterium avium
FDAKLGRGPAVTVEDDLL

SEQ ID NO: 79626 - protein, 20 aa, Mycobacterium avium
FDALCAHLATMHPSRYLTLI

SEQ ID NO: 79627 - protein, 19 aa, Mycobacterium avium
FDASRPAVWSAEGLVRYLP

SEQ ID NO: 79628 - protein, 26 aa, Mycobacterium avium
FDCPGHPSFSLLRAGATAGFTVVALD

SEQ ID NO: 79629 - protein, 25 aa, Mycobacterium avium
FDCRDPARLAGWWAEQFGGTTHDIL

SEQ ID NO: 79630 - protein, 18 aa, Mycobacterium avium
FDDAGAIGRRYRRQDEIG

SEQ ID NO: 79631 - protein, 19 aa, Mycobacterium avium
FDDARPVLERASARETAAR

SEQ ID NO: 79632 - protein, 25 aa, Mycobacterium avium
FDDLEWIKARWPGKLVVKGIQTLDD

SEQ ID NO: 79633 - protein, 26 aa, Mycobacterium avium
FDDLLIELDIHFRIEDDLYYPALKEA

SEQ ID NO: 79634 - protein, 18 aa, Mycobacterium avium
FDEGFKLVKVNPMATWTD

SEQ ID NO: 79635 - protein, 25 aa, Mycobacterium avium
FDGEAAELMWRYYLGPTVGSAAAVP

SEQ ID NO: 79636 - protein, 19 aa, Mycobacterium avium
FDGRGAWADGPEAIRGYLE

SEQ ID NO: 79637 - protein, 17 aa, Mycobacterium avium
FDHGKALALYHTKRLAS

SEQ ID NO: 79638 - protein, 18 aa, Mycobacterium avium
FDHPGVPFVLRIKEGYAI

SEQ ID NO: 79639 - protein, 18 aa, Mycobacterium avium
FDKDRDGFVFGEAGALML

SEQ ID NO: 79640 - protein, 25 aa, Mycobacterium avium
FDLAARKRLPVVLFAEGGGGRPGDT

SEQ ID NO: 79641 - protein, 17 aa, Mycobacterium avium
FDLCAMVGHPEWIDEDS

SEQ ID NO: 79642 - protein, 17 aa, Mycobacterium avium
FDLLRRHSQALNIKLAE

SEQ ID NO: 79643 - protein, 17 aa, Mycobacterium avium
FDLPGPKPFGHFMVVEL

SEQ ID NO: 79644 - protein, 19 aa, Mycobacterium avium
FDNELIPIAGLATDEFIRP

SEQ ID NO: 79645 - protein, 18 aa, Mycobacterium avium
FDPARARVTGVWLDPVAG

SEQ ID NO: 79646 - protein, 25 aa, Mycobacterium avium
FDPRRIDTELGWAQFYGHNTARVFL

SEQ ID NO: 79647 - protein, 24 aa, Mycobacterium avium
FDPRRIDTELGWARRNGFNAVRVF

SEQ ID NO: 79648 - protein, 24 aa, Mycobacterium avium
FDPSRAMPAYNWMTVAKSALESVN

SEQ ID NO: 79649 - protein, 22 aa, Mycobacterium avium
FDSILGRLPYDVSLEGEDTIVV

SEQ ID NO: 79650 - protein, 24 aa, Mycobacterium avium
FDSMLIKLTCRGRDFPTAVRRARR

SEQ ID NO: 79651 - protein, 19 aa, Mycobacterium avium
FEAAQVCRWLLTSRLELIE

SEQ ID NO: 79652 - protein, 17 aa, Mycobacterium avium
FEALSALSAGVKDVRAV

SEQ ID NO: 79653 - protein, 25 aa, Mycobacterium avium
FEAMTIDCPEEFVGAITQLMAARKG

SEQ ID NO: 79654 - protein, 24 aa, Mycobacterium avium
FEARFRFVEEMIRLGADARTDGHH

SEQ ID NO: 79655 - protein, 28 aa, Mycobacterium avium
FEASVPPGRLGWGWAKFAFNGWKTLSWV

SEQ ID NO: 79656 - protein, 26 aa, Mycobacterium avium
FEAVGACARGLMPREDVDAIERAICP

SEQ ID NO: 79657 - protein, 19 aa, Mycobacterium avium
FEEACAVLTSLLSQETTDF

SEQ ID NO: 79658 - protein, 20 aa, Mycobacterium avium
FEEIKRFWNPTTGYDLRGVS

SEQ ID NO: 79659 - protein, 17 aa, Mycobacterium avium
FEEIQIPVGPRLGNVVV

SEQ ID NO: 79660 - protein, 23 aa, Mycobacterium avium
FEESKEWYSMWGVDDSPQPATYD

SEQ ID NO: 79661 - protein, 21 aa, Mycobacterium avium
FEETHPLWIVRRTMLDLIRPI

SEQ ID NO: 79662 - protein, 21 aa, Mycobacterium avium
FEFPTRIISTLLGLPAEDLDL

SEQ ID NO: 79663 - protein, 27 aa, Mycobacterium avium
FEGELAVVIGRPCKDVSAAQAAENILG

SEQ ID NO: 79664 - protein, 18 aa, Mycobacterium avium
FEGLMVEQLEIFNAEDRF

SEQ ID NO: 79665 - protein, 18 aa, Mycobacterium avium
FEGPVHRANFDAVDSSPV

SEQ ID NO: 79666 - protein, 17 aa, Mycobacterium avium
FEGTSFGGALMTTTEVE

SEQ ID NO: 79667 - protein, 21 aa, Mycobacterium avium
FEGVMMPELFMADAVGATGKP

SEQ ID NO: 79668 - protein, 18 aa, Mycobacterium avium
FEGWRARKNGQRFRAGVA

SEQ ID NO: 79669 - protein, 24 aa, Mycobacterium avium
FEIERRLIEALDCPVMHDDQHGTA

SEQ ID NO: 79670 - protein, 24 aa, Mycobacterium avium
FEIKEFKSGAARMAVEAGVPIVPH

SEQ ID NO: 79671 - protein, 31 aa, Mycobacterium avium
FEKEAWLSMVMLEWGCCGQVATAIPDERSQA

SEQ ID NO: 79672 - protein, 25 aa, Mycobacterium avium
FEKRWAGVQAHNRWQVDFCSLAPDR

SEQ ID NO: 79673 - protein, 30 aa, Mycobacterium avium
FELAELVSRVGAVLRRRGRLPQVIQVGDVT

SEQ ID NO: 79674 - protein, 19 aa, Mycobacterium avium
FELHEELIVAVGLTRQEAA

SEQ ID NO: 79675 - protein, 18 aa, Mycobacterium avium
FELLRFLMRNPRRALSRT

SEQ ID NO: 79676 - protein, 17 aa, Mycobacterium avium
FENAIAVVMAFGGSTNA

SEQ ID NO: 79677 - protein, 25 aa, Mycobacterium avium
FENFPDLRLTAAPQRRSLINLHGYT

SEQ ID NO: 79678 - protein, 19 aa, Mycobacterium avium
FEPKPDWKNPFSYQPEIWD

SEQ ID NO: 79679 - protein, 17 aa, Mycobacterium avium
FEPNNDWTHFFAEQYEL

SEQ ID NO: 79680 - protein, 20 aa, Mycobacterium avium
FEPRYGALVRHCLDTGEQFG

SEQ ID NO: 79681 - protein, 18 aa, Mycobacterium avium
FEPTLDYVVVKAPRFAFE

SEQ ID NO: 79682 - protein, 21 aa, Mycobacterium avium
FEQHLRAVLDYPLGDTDALAP

SEQ ID NO: 79683 - protein, 24 aa, Mycobacterium avium
FESEAIPTLPPVPGIDLYDYGHRL

SEQ ID NO: 79684 - protein, 19 aa, Mycobacterium avium
FESHCGWPSFYDPANSDAV

SEQ ID NO: 79685 - protein, 22 aa, Mycobacterium avium
FESPKLLMLSGIGPGRELAKHG

SEQ ID NO: 79686 - protein, 22 aa, Mycobacterium avium
FEVNEAFAPVPLAWLAETGADA

SEQ ID NO: 79687 - protein, 20 aa, Mycobacterium avium
FEYDFRMLLGQRHGGQPWSD

SEQ ID NO: 79688 - protein, 20 aa, Mycobacterium avium
FFFLRPKDIAIYVGSGELDF

SEQ ID NO: 79689 - protein, 21 aa, Mycobacterium avium
FFGDRRKAFLEDLAIVTGGQV

SEQ ID NO: 79690 - protein, 29 aa, Mycobacterium avium
FFLHIPFPPVELFMQLPWRTEIVKGLLGA

SEQ ID NO: 79691 - protein, 23 aa, Mycobacterium avium
FFNNYRPQFYFRTTDVTGVVTLP

SEQ ID NO: 79692 - protein, 23 aa, Mycobacterium avium
FFRELPELAVRWQAETFPELRLL

SEQ ID NO: 79693 - protein, 19 aa, Mycobacterium avium
FFTPLLRNLGHCARVVVVG

SEQ ID NO: 79694 - protein, 17 aa, Mycobacterium avium
FFVHDPFTLEPYSRDPR

SEQ ID NO: 79695 - protein, 22 aa, Mycobacterium avium
FGACLNRELGRFIDAVRADIDF

SEQ ID NO: 79696 - protein, 22 aa, Mycobacterium avium
FGAEGWRPGLHRLTDGLINDAR

SEQ ID NO: 79697 - protein, 19 aa, Mycobacterium avium
FGAKHADALFTLHGSLEAG

SEQ ID NO: 79698 - protein, 17 aa, Mycobacterium avium
FGALLGEAWTEKKRMSP

SEQ ID NO: 79699 - protein, 20 aa, Mycobacterium avium
FGAWEGLTFGEAAERDPGLH

SEQ ID NO: 79700 - protein, 19 aa, Mycobacterium avium
FGDAGTFELTYQIGLENMR

SEQ ID NO: 79701 - protein, 21 aa, Mycobacterium avium
FGDKVLPLYLPTGLPACTGLI

SEQ ID NO: 79702 - protein, 25 aa, Mycobacterium avium
FGDYFKREAIELAWTLLTGSVEQGG

SEQ ID NO: 79703 - protein, 19 aa, Mycobacterium avium
FGEFKGWAKAQGRHSNIGY

SEQ ID NO: 79704 - protein, 25 aa, Mycobacterium avium
FGEGPRWFEGLLWFSDMLGEAVHTT

SEQ ID NO: 79705 - protein, 31 aa, Mycobacterium avium
FGFATAPLVVSGCIMMRVCHLDTCPVGVATQ

SEQ ID NO: 79706 - protein, 26 aa, Mycobacterium avium
FGFSPLRLPPDLDFTALFHGVDERVP

SEQ ID NO: 79707 - protein, 18 aa, Mycobacterium avium
FGGEVERGLSMVDGVLLL

SEQ ID NO: 79708 - protein, 19 aa, Mycobacterium avium
FGGFAARVRGGDVDIAVTG

SEQ ID NO: 79709 - protein, 17 aa, Mycobacterium avium
FGGGFQHWGEAMMTDGR

SEQ ID NO: 79710 - protein, 19 aa, Mycobacterium avium
FGGPPAVGALLLRRDVACV

SEQ ID NO: 79711 - protein, 25 aa, Mycobacterium avium
FGGRLPELFCGFPRSQFASPVPYPT

SEQ ID NO: 79712 - protein, 18 aa, Mycobacterium avium
FGIEPDLAEALVCAAARE

SEQ ID NO: 79713 - protein, 26 aa, Mycobacterium avium
FGINGEATFDYGAAFDRSRKVAEGRV

SEQ ID NO: 79714 - protein, 23 aa, Mycobacterium avium
FGIPEVKRGLVAGGGGLLRLPQR

SEQ ID NO: 79715 - protein, 25 aa, Mycobacterium avium
FGKHHRIGFPFTWITNAATDPAASL

SEQ ID NO: 79716 - protein, 17 aa, Mycobacterium avium
FGLGCVAGAAGVARMHD

SEQ ID NO: 79717 - protein, 18 aa, Mycobacterium avium
FGLGCVAGAAGVARMHDY

SEQ ID NO: 79718 - protein, 26 aa, Mycobacterium avium
FGLIPEFIGRLPVVASVTNLDRESLV

SEQ ID NO: 79719 - protein, 26 aa, Mycobacterium avium
FGNDARLLADLSFDAVVLLINGVPKL

SEQ ID NO: 79720 - protein, 18 aa, Mycobacterium avium
FGNIIRLLPPLTISDELL

SEQ ID NO: 79721 - protein, 24 aa, Mycobacterium avium
FGPACPQPVFPNMPLDLGAPQGED

SEQ ID NO: 79722 - protein, 19 aa, Mycobacterium avium
FGPEVKRRIMIGTYALSAG

SEQ ID NO: 79723 - protein, 17 aa, Mycobacterium avium
FGPGNRAPLSFPMAGWN

SEQ ID NO: 79724 - protein, 25 aa, Mycobacterium avium
FGPVARGGLRWSDRRDDFRTEILGL

SEQ ID NO: 79725 - protein, 26 aa, Mycobacterium avium
FGQPEIKLGVLPGMGGSQRLTRAIGK

SEQ ID NO: 79726 - protein, 25 aa, Mycobacterium avium
FGRRVAVVVCEFGFLGGSIGVAAAE

SEQ ID NO: 79727 - protein, 21 aa, Mycobacterium avium
FGRTGGVEGLHEFLQVKNIRI

SEQ ID NO: 79728 - protein, 19 aa, Mycobacterium avium
FGSATPMVMEEAGAVGMPG

SEQ ID NO: 79729 - protein, 18 aa, Mycobacterium avium
FGSLQAYLRDAGVGEADV

SEQ ID NO: 79730 - protein, 24 aa, Mycobacterium avium
FGSPTRFGSPAAQLRAFLDSLGGL

SEQ ID NO: 79731 - protein, 29 aa, Mycobacterium avium
FGSSSFRYAGPAGRDWKIADLAGKRIATA

SEQ ID NO: 79732 - protein, 17 aa, Mycobacterium avium
FGTPEFIDRIVTGGVNQ

SEQ ID NO: 79733 - protein, 32 aa, Mycobacterium avium
FGTPNFTGRSWPLADVRLLAPILASKVVCVGK

SEQ ID NO: 79734 - protein, 24 aa, Mycobacterium avium
FGTPSGRGGAAFLSRVPPNQLPDL

SEQ ID NO: 79735 - protein, 26 aa, Mycobacterium avium
FGTTQRFGVPMGFGGPHAGYLAVHAN

SEQ ID NO: 79736 - protein, 28 aa, Mycobacterium avium
FGVPPPDVIRRLGALGLLVMVTVTSAYE

SEQ ID NO: 79737 - protein, 22 aa, Mycobacterium avium
FGVSRITVRRALADLAAQGYIE

SEQ ID NO: 79738 - protein, 23 aa, Mycobacterium avium
FGWTGPFAQRAATEFTLQAWAGS

SEQ ID NO: 79739 - protein, 26 aa, Mycobacterium avium
FHAALEFWSALHGFVLLEMTGVMDDI

SEQ ID NO: 79740 - protein, 19 aa, Mycobacterium avium
FHAMYPRIDEWIAVRRKVD

SEQ ID NO: 79741 - protein, 21 aa, Mycobacterium avium
FHDRFTASRLFGAPPGYVGYE

SEQ ID NO: 79742 - protein, 23 aa, Mycobacterium avium
FHEAANMAALWDLPIVFVCQNNR

SEQ ID NO: 79743 - protein, 25 aa, Mycobacterium avium
FHLRNRLVVAALHWDGDITGLVRSH

SEQ ID NO: 79744 - protein, 20 aa, Mycobacterium avium
FHNTRGCGLASAYAAVGAGV

SEQ ID NO: 79745 - protein, 18 aa, Mycobacterium avium
FHVDLLWLLEIGSNQKIA

SEQ ID NO: 79746 - protein, 18 aa, Mycobacterium avium
FHVTGFTSAVGVAALAAE

SEQ ID NO: 79747 - protein, 19 aa, Mycobacterium avium
FIDLLKAMRPGLTTPLRLA

SEQ ID NO: 79748 - protein, 26 aa, Mycobacterium avium
FIEHLDALGFDEVWLGEHHSAGSEII

SEQ ID NO: 79749 - protein, 23 aa, Mycobacterium avium
FIEQRPQLLTARSSADRGTKILN

SEQ ID NO: 79750 - protein, 17 aa, Mycobacterium avium
FIETFVLTSALGAVTSK

SEQ ID NO: 79751 - protein, 17 aa, Mycobacterium avium
FIRLSRLGLSFGGESPV

SEQ ID NO: 79752 - protein, 17 aa, Mycobacterium avium
FKAHKRSGAEIVSGRLA

SEQ ID NO: 79753 - protein, 25 aa, Mycobacterium avium
FKEGERLWISWAMANRDPAVFHDPD

SEQ ID NO: 79754 - protein, 19 aa, Mycobacterium avium
FKGDERWRNLPTPSGNTFE

SEQ ID NO: 79755 - protein, 20 aa, Mycobacterium avium
FKHVAEMFAELEASALRSYP

SEQ ID NO: 79756 - protein, 19 aa, Mycobacterium avium
FKLSGDFDPAQVIKHGNDD

SEQ ID NO: 79757 - protein, 21 aa, Mycobacterium avium
FKMAAELAYLEFGDLIDSLVA

SEQ ID NO: 79758 - protein, 27 aa, Mycobacterium avium
FKPLYGSSLVTGWARLHGYPIGILANA

SEQ ID NO: 79759 - protein, 21 aa, Mycobacterium avium
FKQFEEWDVCIVPREKLQLTP

SEQ ID NO: 79760 - protein, 22 aa, Mycobacterium avium
FKSKEAVVLSLLEPVIARADAE

SEQ ID NO: 79761 - protein, 24 aa, Mycobacterium avium
FKVDKPGTVAITFTPADGSEPIVH

SEQ ID NO: 79762 - protein, 25 aa, Mycobacterium avium
FKVLLKELQSLCLNVEVLSSDGAAI

SEQ ID NO: 79763 - protein, 25 aa, Mycobacterium avium
FLAASGFPINLIGVLAQLQTASGFQ

SEQ ID NO: 79764 - protein, 18 aa, Mycobacterium avium
FLAEGLRLREHRGKIHDL

SEQ ID NO: 79765 - protein, 26 aa, Mycobacterium avium
FLAHLPGYQGWQWAVVVAAYPGADHA

SEQ ID NO: 79766 - protein, 32 aa, Mycobacterium avium
FLAIAGRRVQLEIFTKFSIPINIARVIHRDQK

SEQ ID NO: 79767 - protein, 21 aa, Mycobacterium avium
FLDGKEFIETFVLTSALGAVT

SEQ ID NO: 79768 - protein, 18 aa, Mycobacterium avium
FLDGLAWRLREQGVNGIS

SEQ ID NO: 79769 - protein, 25 aa, Mycobacterium avium
FLDHIVAHPRLRWVGNANELNAGYA

SEQ ID NO: 79770 - protein, 18 aa, Mycobacterium avium
FLEGCGRTDFPGGDSDEM

SEQ ID NO: 79771 - protein, 20 aa, Mycobacterium avium
FLEGRLARHAVYPTMGPEPQ

SEQ ID NO: 79772 - protein, 18 aa, Mycobacterium avium
FLELAAIRTKAVRQGDPL

SEQ ID NO: 79773 - protein, 18 aa, Mycobacterium avium
FLELLAVDIEKLGAKIAA

SEQ ID NO: 79774 - protein, 24 aa, Mycobacterium avium
FLESLRYDLAVQEIFVFTPKGDVI

SEQ ID NO: 79775 - protein, 18 aa, Mycobacterium avium
FLGAPYWVGRGFGLNLSV

SEQ ID NO: 79776 - protein, 18 aa, Mycobacterium avium
FLGGPVIKDGRPVDFGSF

SEQ ID NO: 79777 - protein, 18 aa, Mycobacterium avium
FLGPMITALEGYPFDKMT

SEQ ID NO: 79778 - protein, 17 aa, Mycobacterium avium
FLGPMITGLDGYPFDKL

SEQ ID NO: 79779 - protein, 18 aa, Mycobacterium avium
FLIAGAGAGLARRVDDTD

SEQ ID NO: 79780 - protein, 18 aa, Mycobacterium avium
FLIMPKLIPALIAGCTVI

SEQ ID NO: 79781 - protein, 18 aa, Mycobacterium avium
FLKRVRKVVDDEFPGRVL

SEQ ID NO: 79782 - protein, 24 aa, Mycobacterium avium
FLKSKLRTGGLLLNHCITRHDNTS

SEQ ID NO: 79783 - protein, 20 aa, Mycobacterium avium
FLLNTGRLPHQWHTMTKTGK

SEQ ID NO: 79784 - protein, 17 aa, Mycobacterium avium
FLLQGGDCAETFTENTE

SEQ ID NO: 79785 - protein, 18 aa, Mycobacterium avium
FLLQRPLLTAIRRTEPTV

SEQ ID NO: 79786 - protein, 25 aa, Mycobacterium avium
FLMSVGDLIIGWLLQRQAAVAVAAL

SEQ ID NO: 79787 - protein, 18 aa, Mycobacterium avium
FLPAMARHLLSETLLLPS

SEQ ID NO: 79788 - protein, 25 aa, Mycobacterium avium
FLPDLGLRRENIVFISGIGCSSRFP

SEQ ID NO: 79789 - protein, 21 aa, Mycobacterium avium
FLRAADLARAITFVAETPRGG

SEQ ID NO: 79790 - protein, 23 aa, Mycobacterium avium
FLRDLEKCWSLLLTGILQPDRTE

SEQ ID NO: 79791 - protein, 25 aa, Mycobacterium avium
FLTPDGRPFFCGTYYPKDAFLQLLS

SEQ ID NO: 79792 - protein, 19 aa, Mycobacterium avium
FLTRMLARMVPHPDRVDVI

SEQ ID NO: 79793 - protein, 18 aa, Mycobacterium avium
FMAKYGKATPEALVESAL

SEQ ID NO: 79794 - protein, 18 aa, Mycobacterium avium
FMATRTAFFDEFFLAAAD

SEQ ID NO: 79795 - protein, 27 aa, Mycobacterium avium
FMEVAKLRAGRLLWSELVSQFNPKNPK

SEQ ID NO: 79796 - protein, 17 aa, Mycobacterium avium
FMRHDYVNFGFDHADAV

SEQ ID NO: 79797 - protein, 27 aa, Mycobacterium avium
FMSSTARLKCPFTSLGVAPEAASSYLL

SEQ ID NO: 79798 - protein, 24 aa, Mycobacterium avium
FMTIAKFRAARTVWARVAEVVGEP

SEQ ID NO: 79799 - protein, 28 aa, Mycobacterium avium
FNAFPASYWRRWSICESVVLKVELTGTG

SEQ ID NO: 79800 - protein, 26 aa, Mycobacterium avium
FNQASGRIKLAWFLLNAARYMPVLVY

SEQ ID NO: 79801 - protein, 17 aa, Mycobacterium avium
FNSLPFTLGMKEPAEGF

SEQ ID NO: 79802 - protein, 26 aa, Mycobacterium avium
FPDQMLAYNCSPSFNWKKHLDDATIA

SEQ ID NO: 79803 - protein, 18 aa, Mycobacterium avium
FPDRPALELDGWATPRPL

SEQ ID NO: 79804 - protein, 23 aa, Mycobacterium avium
FPESYNRRALMRFVTSVKSGSDY

SEQ ID NO: 79805 - protein, 19 aa, Mycobacterium avium
FPGCAVVISHDRWFLDRTC

SEQ ID NO: 79806 - protein, 17 aa, Mycobacterium avium
FPGGVLGVALNLDEHSV

SEQ ID NO: 79807 - protein, 17 aa, Mycobacterium avium
FPGLDTFAGQVYHTAAW

SEQ ID NO: 79808 - protein, 26 aa, Mycobacterium avium
FPGLRWGVTECGAFWANDLLWLMDTR

SEQ ID NO: 79809 - protein, 33 aa, Mycobacterium avium
FPKASVMTHLRWLKALAAFGGIGLRLKSSDTLY

SEQ ID NO: 79810 - protein, 24 aa, Mycobacterium avium
FPKSRTSILAAHRAGVKIAVGTDA

SEQ ID NO: 79811 - protein, 19 aa, Mycobacterium avium
FPLGSAFPGLPKVTDNAVV

SEQ ID NO: 79812 - protein, 20 aa, Mycobacterium avium
FPLKGERLSRREARRRCIEL

SEQ ID NO: 79813 - protein, 17 aa, Mycobacterium avium
FPLMPRIFMAVRRESRF

SEQ ID NO: 79814 - protein, 21 aa, Mycobacterium avium
FPNLFTVFGPYGYVGSSYFAL

SEQ ID NO: 79815 - protein, 19 aa, Mycobacterium avium
FPPAGTLTGIAKRELRGVS

SEQ ID NO: 79816 - protein, 17 aa, Mycobacterium avium
FPPERITFHGNNKSVAE

SEQ ID NO: 79817 - protein, 21 aa, Mycobacterium avium
FPRIGHLPYLLTLPGHGFYWF

SEQ ID NO: 79818 - protein, 18 aa, Mycobacterium avium
FPSACGKTNLAMLQPTIP

SEQ ID NO: 79819 - protein, 19 aa, Mycobacterium avium
FPTRVIARLLGLPDEDLPM

SEQ ID NO: 79820 - protein, 25 aa, Mycobacterium avium
FPVIRRYALAYHVVFIPPAEVDRRG

SEQ ID NO: 79821 - protein, 21 aa, Mycobacterium avium
FPWTERRQGVLGEVHLHRAPV

SEQ ID NO: 79822 - protein, 24 aa, Mycobacterium avium
FQAEARQLLDLMVHSVYSNKDSFL

SEQ ID NO: 79823 - protein, 27 aa, Mycobacterium avium
FQLEIGRAHTPWFHWGTTAVVARLVKQ

SEQ ID NO: 79824 - protein, 20 aa, Mycobacterium avium
FQLGSLWYISLDYINHQTSL

SEQ ID NO: 79825 - protein, 23 aa, Mycobacterium avium
FQMMGLCQMLRDGVIPPNRSLDC

SEQ ID NO: 79826 - protein, 25 aa, Mycobacterium avium
FQMPGGIYAPMIHPWSSGRDLYFNL

SEQ ID NO: 79827 - protein, 23 aa, Mycobacterium avium
FQRCAPETRIWWGAYLGTADELL

SEQ ID NO: 79828 - protein, 20 aa, Mycobacterium avium
FQRRVWRALQTIPYGETRSY

SEQ ID NO: 79829 - protein, 18 aa, Mycobacterium avium
FQTITGGAVFAYWVANPS

SEQ ID NO: 79830 - protein, 19 aa, Mycobacterium avium
FQYAKTWRTLAKLSLPNKY

SEQ ID NO: 79831 - protein, 17 aa, Mycobacterium avium
FRAGVNVGVDITADQLR

SEQ ID NO: 79832 - protein, 23 aa, Mycobacterium avium
FRDELAMTFPQWRTQVRLQHALV

SEQ ID NO: 79833 - protein, 17 aa, Mycobacterium avium
FRDELRTIYTTKIPEEL

SEQ ID NO: 79834 - protein, 27 aa, Mycobacterium avium
FRDYSWGMRVPRRLRELHVQISRTTAD

SEQ ID NO: 79835 - protein, 19 aa, Mycobacterium avium
FREGVGFTGVVLTKLDGDA

SEQ ID NO: 79836 - protein, 21 aa, Mycobacterium avium
FREVEELAARFGVLKSGVAAG

SEQ ID NO: 79837 - protein, 21 aa, Mycobacterium avium
FRFDLAATLARELHDVDRLSA

SEQ ID NO: 79838 - protein, 19 aa, Mycobacterium avium
FRFSEAVSFTVHCKDQDEV

SEQ ID NO: 79839 - protein, 19 aa, Mycobacterium avium
FRFVECSRLVDGRPDGDIT

SEQ ID NO: 79840 - protein, 17 aa, Mycobacterium avium
FRGSELIAEKWNLSREE

SEQ ID NO: 79841 - protein, 17 aa, Mycobacterium avium
FRIEDDLYYPALKEASK

SEQ ID NO: 79842 - protein, 21 aa, Mycobacterium avium
FRLGARARHTAVAEVAFTVRR

SEQ ID NO: 79843 - protein, 22 aa, Mycobacterium avium
FRMAYDVLPPGGIMLLHTIVRP

SEQ ID NO: 79844 - protein, 26 aa, Mycobacterium avium
FRPGTLEKWNLGYDVLCERNPGIILV

SEQ ID NO: 79845 - protein, 18 aa, Mycobacterium avium
FRQFSFPGGIPSHVAAQT

SEQ ID NO: 79846 - protein, 19 aa, Mycobacterium avium
FRSGDGWLDATLQGLDQNR

SEQ ID NO: 79847 - protein, 19 aa, Mycobacterium avium
FRTGRWPDVLNQFPEGKGW

SEQ ID NO: 79848 - protein, 17 aa, Mycobacterium avium
FRVWGSSDLRRWLPLDI

SEQ ID NO: 79849 - protein, 17 aa, Mycobacterium avium
FRYNTIITEETTRGRYS

SEQ ID NO: 79850 - protein, 17 aa, Mycobacterium avium
FSAIKVGANLVRTDERI

SEQ ID NO: 79851 - protein, 19 aa, Mycobacterium avium
FSAVTLRPDAVPDFVGGIY

SEQ ID NO: 79852 - protein, 24 aa, Mycobacterium avium
FSDEFRIQLAWMRLSPPTANPGWS

SEQ ID NO: 79853 - protein, 18 aa, Mycobacterium avium
FSDHAEWVLPTDWPVAPG

SEQ ID NO: 79854 - protein, 18 aa, Mycobacterium avium
FSDVVGVRMGMPGVEYYA

SEQ ID NO: 79855 - protein, 20 aa, Mycobacterium avium
FSEHSGHLLAGTALSVISGR

SEQ ID NO: 79856 - protein, 23 aa, Mycobacterium avium
FSEKWCGGMLPDVGKLVELARAL

SEQ ID NO: 79857 - protein, 24 aa, Mycobacterium avium
FSEPCTDCRGSGSIIEHPCDECKG

SEQ ID NO: 79858 - protein, 25 aa, Mycobacterium avium
FSEPCTLREPAFAILDSHRIDYEIA

SEQ ID NO: 79859 - protein, 17 aa, Mycobacterium avium
FSGDGFLRNLEVVAQLQ

SEQ ID NO: 79860 - protein, 22 aa, Mycobacterium avium
FSGEVYFTAAWPREDPDLRGKR

SEQ ID NO: 79861 - protein, 18 aa, Mycobacterium avium
FSGRVSDSGEGRWTSIAA

SEQ ID NO: 79862 - protein, 24 aa, Mycobacterium avium
FSHGGSLKSSWYGDCLPERDFPTL

SEQ ID NO: 79863 - protein, 17 aa, Mycobacterium avium
FSHGRDWGSPKIPEEMN

SEQ ID NO: 79864 - protein, 20 aa, Mycobacterium avium
FSHPQSQYFVVGRLAQDQVA

SEQ ID NO: 79865 - protein, 23 aa, Mycobacterium avium
FSKAYGLAGLRIGYGVASPRLAR

SEQ ID NO: 79866 - protein, 17 aa, Mycobacterium avium
FSLASGAGRTELQTLLA

SEQ ID NO: 79867 - protein, 26 aa, Mycobacterium avium
FSLASGRIAYALGVHGPALTVDTACS

SEQ ID NO: 79868 - protein, 17 aa, Mycobacterium avium
FSLCMDNGMPILVFNLL

SEQ ID NO: 79869 - protein, 18 aa, Mycobacterium avium
FSLHYPWSQQLPVHSLDG

SEQ ID NO: 79870 - protein, 21 aa, Mycobacterium avium
FSQFKRSALPNGPKVSHGGAL

SEQ ID NO: 79871 - protein, 22 aa, Mycobacterium avium
FSQPSPQPGVHWSKDVRLDKVA

SEQ ID NO: 79872 - protein, 23 aa, Mycobacterium avium
FSRADAGAGWLLHAEGVLRAGSA

SEQ ID NO: 79873 - protein, 17 aa, Mycobacterium avium
FSRISDVLLPFLVTRQL

SEQ ID NO: 79874 - protein, 24 aa, Mycobacterium avium
FSRMADGQIKACWIICTNPVASVA

SEQ ID NO: 79875 - protein, 21 aa, Mycobacterium avium
FSSADPRRGRVLFTDARTNPV

SEQ ID NO: 79876 - protein, 30 aa, Mycobacterium avium
FSSDAAMARRCVDAGWLLSLSGTVSFRNAR

SEQ ID NO: 79877 - protein, 19 aa, Mycobacterium avium
FSSDRARSASSPGADAELV

SEQ ID NO: 79878 - protein, 18 aa, Mycobacterium avium
FSSELPFALDGFQRRACA

SEQ ID NO: 79879 - protein, 19 aa, Mycobacterium avium
FSSKFAAAVAKNPFVGDPV

SEQ ID NO: 79880 - protein, 17 aa, Mycobacterium avium
FSVERYRAVMDAYLAGM

SEQ ID NO: 79881 - protein, 19 aa, Mycobacterium avium
FTAAGAEWRQAGCSMCLGM

SEQ ID NO: 79882 - protein, 21 aa, Mycobacterium avium
FTDQMRWLFGQLIGDRPRWSP

SEQ ID NO: 79883 - protein, 19 aa, Mycobacterium avium
FTETWKDSLSIGWQGNGAE

SEQ ID NO: 79884 - protein, 28 aa, Mycobacterium avium
FTFMTPAAFVRRPGRWIREMARKPDDAP

SEQ ID NO: 79885 - protein, 26 aa, Mycobacterium avium
FTFRGCEGDALLMLLDANGIECSTGS

SEQ ID NO: 79886 - protein, 17 aa, Mycobacterium avium
FTGAIPQRARVIEIEGG

SEQ ID NO: 79887 - protein, 19 aa, Mycobacterium avium
FTGDPAFRQRYWARNHVGW

SEQ ID NO: 79888 - protein, 23 aa, Mycobacterium avium
FTGDRVLAAILFEQTMDRDIEGK

SEQ ID NO: 79889 - protein, 18 aa, Mycobacterium avium
FTGNMLLCEDVLVESGVT

SEQ ID NO: 79890 - protein, 23 aa, Mycobacterium avium
FTGVPCIVDLATMREAIADLGGN

SEQ ID NO: 79891 - protein, 18 aa, Mycobacterium avium
FTHRLRKYIGAYLAVLGH

SEQ ID NO: 79892 - protein, 17 aa, Mycobacterium avium
FTIRPDRWLSADFTGDL

SEQ ID NO: 79893 - protein, 18 aa, Mycobacterium avium
FTKKLFAAEGLPIGDYAV

SEQ ID NO: 79894 - protein, 25 aa, Mycobacterium avium
FTLAERKRLAALAFQHTADYDIAVA

SEQ ID NO: 79895 - protein, 21 aa, Mycobacterium avium
FTLSGGHLFSIYDGCRDEGIR

SEQ ID NO: 79896 - protein, 19 aa, Mycobacterium avium
FTNDYEWELLLSKTGWSEA

SEQ ID NO: 79897 - protein, 25 aa, Mycobacterium avium
FTNICYTGCRFCAFAQRKGDADAYS

SEQ ID NO: 79898 - protein, 20 aa, Mycobacterium avium
FTPPPPRYKTGVLAKYVKLV

SEQ ID NO: 79899 - protein, 17 aa, Mycobacterium avium
FTQVGAPRAGLACDPDG

SEQ ID NO: 79900 - protein, 27 aa, Mycobacterium avium
FTSDIKNLLPMFAVFKPTVVVSVPRVF

SEQ ID NO: 79901 - protein, 30 aa, Mycobacterium avium
FTSDQEVRWCPGCGDYVILNTIRNFLPDLG

SEQ ID NO: 79902 - protein, 19 aa, Mycobacterium avium
FTSEVSWKGALEAFAEGYH

SEQ ID NO: 79903 - protein, 24 aa, Mycobacterium avium
FTSKLELYLAVLARHVENLVSGVQ

SEQ ID NO: 79904 - protein, 20 aa, Mycobacterium avium
FTSSKVMCWVALDRGAKLAE

SEQ ID NO: 79905 - protein, 17 aa, Mycobacterium avium
FVAAFDVDAKKVGFDLS

SEQ ID NO: 79906 - protein, 17 aa, Mycobacterium avium
FVAEAIATLGAQVGRDA

SEQ ID NO: 79907 - protein, 18 aa, Mycobacterium avium
FVAPWGMFTTAEFALIAR

SEQ ID NO: 79908 - protein, 23 aa, Mycobacterium avium
FVEVRRAGIALAREVERRAPDAV

SEQ ID NO: 79909 - protein, 23 aa, Mycobacterium avium
FVFDPRTPYVVFWVVDPDTGERV

SEQ ID NO: 79910 - protein, 17 aa, Mycobacterium avium
FVGAATFEALSGQPVHT

SEQ ID NO: 79911 - protein, 36 aa, Mycobacterium avium
FVGATSRPSALSLDDVVKFLLPRGATKKVAKGAAST

SEQ ID NO: 79912 - protein, 24 aa, Mycobacterium avium
FVGELRAGLRAADCALFVIAANEG

SEQ ID NO: 79913 - protein, 18 aa, Mycobacterium avium
FVGFRGREIVLTLFESIT

SEQ ID NO: 79914 - protein, 17 aa, Mycobacterium avium
FVGQCISLGRAAATFQL

SEQ ID NO: 79915 - protein, 19 aa, Mycobacterium avium
FVHFNWRAQHEDLKNLPFP

SEQ ID NO: 79916 - protein, 23 aa, Mycobacterium avium
FVIGASNRFAHAAALAIAEAPAR

SEQ ID NO: 79917 - protein, 17 aa, Mycobacterium avium
FVMSNSFSNQVIAQIEL

SEQ ID NO: 79918 - protein, 25 aa, Mycobacterium avium
FVNSRPKPLSAYLFTKTRETRERVI

SEQ ID NO: 79919 - protein, 24 aa, Mycobacterium avium
FVPAFSGLFAPYWRSDARGAIVGL

SEQ ID NO: 79920 - protein, 24 aa, Mycobacterium avium
FVPSAGAVLAEWGAEVVKVEHAVT

SEQ ID NO: 79921 - protein, 21 aa, Mycobacterium avium
FVPSHQWIRDGGWNIADCVQR

SEQ ID NO: 79922 - protein, 21 aa, Mycobacterium avium
FVQDWGSLIGLRIAAEQPDRV

SEQ ID NO: 79923 - protein, 17 aa, Mycobacterium avium
FVRCLESGYAANVEAVI

SEQ ID NO: 79924 - protein, 18 aa, Mycobacterium avium
FVRQRHGLDNGDLDRTHR

SEQ ID NO: 79925 - protein, 24 aa, Mycobacterium avium
FVRYLRPVRQGSAFAVPRMLRSGR

SEQ ID NO: 79926 - protein, 25 aa, Mycobacterium avium
FVSGEGCVMLLLKRLDDARRDGDRI

SEQ ID NO: 79927 - protein, 27 aa, Mycobacterium avium
FVSGGKCLRSTFVYLGWLCGAPRDRAA

SEQ ID NO: 79928 - protein, 18 aa, Mycobacterium avium
FVSQLGFTVAPRVREAIE

SEQ ID NO: 79929 - protein, 27 aa, Mycobacterium avium
FVVCNEILPRWGVQTVFVDGDDLAQWE

SEQ ID NO: 79930 - protein, 17 aa, Mycobacterium avium
FVVYSVCDDDPYLQAVL

SEQ ID NO: 79931 - protein, 19 aa, Mycobacterium avium
FWNSLRCNEALDRVRVPVL

SEQ ID NO: 79932 - protein, 19 aa, Mycobacterium avium
FYAAVKLALDKNVVLPANS

SEQ ID NO: 79933 - protein, 18 aa, Mycobacterium avium
FYAQCAIDAGVAFVNALP

SEQ ID NO: 79934 - protein, 18 aa, Mycobacterium avium
FYEGKIAVASFFAKNFLP

SEQ ID NO: 79935 - protein, 18 aa, Mycobacterium avium
FYFACPATVLGPYDDAPT

SEQ ID NO: 79936 - protein, 18 aa, Mycobacterium avium
FYFLEMNTRLQVEHPVTE

SEQ ID NO: 79937 - protein, 18 aa, Mycobacterium avium
FYNVCRHRGNKLVWNDFP

SEQ ID NO: 79938 - protein, 19 aa, Mycobacterium avium
GAAALWFALETDLPVIVDA

SEQ ID NO: 79939 - protein, 18 aa, Mycobacterium avium
GAAIWHMAWSDKDDAIDW

SEQ ID NO: 79940 - protein, 20 aa, Mycobacterium avium
GAAKHARKVAGWGADAMIVQ

SEQ ID NO: 79941 - protein, 20 aa, Mycobacterium avium
GAALARLESRIALERLLDFM

SEQ ID NO: 79942 - protein, 23 aa, Mycobacterium avium
GAAPRAGVVGVLKGPLHDGIVIP

SEQ ID NO: 79943 - protein, 17 aa, Mycobacterium avium
GAARSAWQAALDYATQR

SEQ ID NO: 79944 - protein, 21 aa, Mycobacterium avium
GADAWALQDVMALGVTAGAPP

SEQ ID NO: 79945 - protein, 19 aa, Mycobacterium avium
GADGARLTPRVIVIARDER

SEQ ID NO: 79946 - protein, 19 aa, Mycobacterium avium
GADIIAVDICKPIRAGVVD

SEQ ID NO: 79947 - protein, 23 aa, Mycobacterium avium
GADIPRQHYAFLVSEQEFDTIYG

SEQ ID NO: 79948 - protein, 23 aa, Mycobacterium avium
GADPAHQGLHMWLAEFPQPRPPR

SEQ ID NO: 79949 - protein, 26 aa, Mycobacterium avium
GADVGYRWFAAKGHVPMFAFGHGLSY

SEQ ID NO: 79950 - protein, 24 aa, Mycobacterium avium
GADVLPWLPVRGAVLLVERGSAPV

SEQ ID NO: 79951 - protein, 17 aa, Mycobacterium avium
GAEAARPHRVTHRKLTR

SEQ ID NO: 79952 - protein, 29 aa, Mycobacterium avium
GAEAEPAWAYSVLALRWAAKYYAAEREFA

SEQ ID NO: 79953 - protein, 19 aa, Mycobacterium avium
GAELARGLARRGFPLLLVA

SEQ ID NO: 79954 - protein, 27 aa, Mycobacterium avium
GAEPSTWMPSTRVSRTDWRKIFADNLE

SEQ ID NO: 79955 - protein, 18 aa, Mycobacterium avium
GAERWLRRITALTQAGVR

SEQ ID NO: 79956 - protein, 25 aa, Mycobacterium avium
GAEWRQAGCSMCLGMNPDQLAPGER

SEQ ID NO: 79957 - protein, 26 aa, Mycobacterium avium
GAFGLLKRFAKGWVVRANQVGVDEFA

SEQ ID NO: 79958 - protein, 18 aa, Mycobacterium avium
GAGAWRVVAEHAETGDDR

SEQ ID NO: 79959 - protein, 22 aa, Mycobacterium avium
GAGERGLCAGGDVVSIYHSARK

SEQ ID NO: 79960 - protein, 20 aa, Mycobacterium avium
GAGLPLLVIHGGPGLPHDYL

SEQ ID NO: 79961 - protein, 26 aa, Mycobacterium avium
GAGRTWHPYQVPAFLAAGYRVITFDN

SEQ ID NO: 79962 - protein, 26 aa, Mycobacterium avium
GAGVKRVPLARARRAAQRHDYLGNYV

SEQ ID NO: 79963 - protein, 17 aa, Mycobacterium avium
GAHCGMICDASYPTFLL

SEQ ID NO: 79964 - protein, 21 aa, Mycobacterium avium
GAICKPGSGPFSLTGQPNAMG

SEQ ID NO: 79965 - protein, 17 aa, Mycobacterium avium
GAIDMPVTVRVPSFGGI

SEQ ID NO: 79966 - protein, 29 aa, Mycobacterium avium
GAIIRQPIPPFKWWRGLRARQLLEDYFSE

SEQ ID NO: 79967 - protein, 19 aa, Mycobacterium avium
GAILADWGADVIKVEHPVR

SEQ ID NO: 79968 - protein, 21 aa, Mycobacterium avium
GAITDWAALVAQAHERGALVA

SEQ ID NO: 79969 - protein, 18 aa, Mycobacterium avium
GAIVPWNVPQFLIMPKLI

SEQ ID NO: 79970 - protein, 20 aa, Mycobacterium avium
GAKIAVPCLFIGGTADPVLS

SEQ ID NO: 79971 - protein, 21 aa, Mycobacterium avium
GALEAGELAVWLAEHSSGKRF

SEQ ID NO: 79972 - protein, 24 aa, Mycobacterium avium
GALKLGPELGRGAIIVVNLSGRGD

SEQ ID NO: 79973 - protein, 20 aa, Mycobacterium avium
GALLAALAEFGIRGIDLTRI

SEQ ID NO: 79974 - protein, 19 aa, Mycobacterium avium
GALLARMIGDLGISVHVGT

SEQ ID NO: 79975 - protein, 20 aa, Mycobacterium avium
GALMTARFVSFAEISGQLDE

SEQ ID NO: 79976 - protein, 21 aa, Mycobacterium avium
GALPTFSSWVNPAATRGHDGT

SEQ ID NO: 79977 - protein, 23 aa, Mycobacterium avium
GALREVTIELSVFGSEGRQGKLD

SEQ ID NO: 79978 - protein, 19 aa, Mycobacterium avium
GALRLARELGGAGYTAPEF

SEQ ID NO: 79979 - protein, 21 aa, Mycobacterium avium
GALRSAWIGYWVPRSATGGGV

SEQ ID NO: 79980 - protein, 24 aa, Mycobacterium avium
GALVAPVCDFRIMSRQGAIFTAGP

SEQ ID NO: 79981 - protein, 18 aa, Mycobacterium avium
GAMLARAELRAVFDELLL

SEQ ID NO: 79982 - protein, 19 aa, Mycobacterium avium
GANGISSFMVHKDDEGFTV

SEQ ID NO: 79983 - protein, 25 aa, Mycobacterium avium
GANMADCHPILFLRMMDRVKAGAKL

SEQ ID NO: 79984 - protein, 24 aa, Mycobacterium avium
GANPRELAGWLAAALAETDGIASA

SEQ ID NO: 79985 - protein, 19 aa, Mycobacterium avium
GANVIPIQIPVGSEGDFEG

SEQ ID NO: 79986 - protein, 17 aa, Mycobacterium avium
GANWSRWAKPIVLHSSW

SEQ ID NO: 79987 - protein, 23 aa, Mycobacterium avium
GAPETKGPMLINARADKVTSSPA

SEQ ID NO: 79988 - protein, 17 aa, Mycobacterium avium
GAPLGSRLGHFFRGVGL

SEQ ID NO: 79989 - protein, 33 aa, Mycobacterium avium
GAPSFAEALRWGAEVYHSLKSVLKKEGLSTGLG

SEQ ID NO: 79990 - protein, 17 aa, Mycobacterium avium
GAPSGAYVRRAGDDVQP

SEQ ID NO: 79991 - protein, 24 aa, Mycobacterium avium
GAQAGNIARLSWLAAGYPEEVPGV

SEQ ID NO: 79992 - protein, 19 aa, Mycobacterium avium
GAQLADTAEQVWADAELLL

SEQ ID NO: 79993 - protein, 19 aa, Mycobacterium avium
GAQLGRGWSDAAVRAALDD

SEQ ID NO: 79994 - protein, 18 aa, Mycobacterium avium
GAQLGVLVTRGHLQTDDY

SEQ ID NO: 79995 - protein, 20 aa, Mycobacterium avium
GAQLLDVPAGAAAVFEDALS

SEQ ID NO: 79996 - protein, 19 aa, Mycobacterium avium
GARALEWIVGHPSRVRAGL

SEQ ID NO: 79997 - protein, 24 aa, Mycobacterium avium
GARDKVLPGYGWIFPLGNGEVNIG

SEQ ID NO: 79998 - protein, 21 aa, Mycobacterium avium
GAREHALLLALRKDPQVTGLA

SEQ ID NO: 79999 - protein, 21 aa, Mycobacterium avium
GARFEVMPGCGHWPQYEDAKT

SEQ ID NO: 80000 - protein, 21 aa, Mycobacterium avium
GARLYPQIAARPFGMMIGFQG

SEQ ID NO: 80001 - protein, 18 aa, Mycobacterium avium
GARPRGPGMERSDLLEAN

SEQ ID NO: 80002 - protein, 24 aa, Mycobacterium avium
GARRGTGILDCWLVSQDDHADIEG

SEQ ID NO: 80003 - protein, 21 aa, Mycobacterium avium
GARVAFLIRFGSGVLPEPKSV

SEQ ID NO: 80004 - protein, 27 aa, Mycobacterium avium
GARVVKAHVPLSEMFGYVGDLRSKTQG

SEQ ID NO: 80005 - protein, 20 aa, Mycobacterium avium
GARVWPGVSIPDGGIRYSSD

SEQ ID NO: 80006 - protein, 26 aa, Mycobacterium avium
GARYAFVCAVDMPLLSPELIDDLVHL

SEQ ID NO: 80007 - protein, 20 aa, Mycobacterium avium
GASMGGMIAQIFAARFRQRT

SEQ ID NO: 80008 - protein, 20 aa, Mycobacterium avium
GASVLKQLVAYVGLEHFLAG

SEQ ID NO: 80009 - protein, 26 aa, Mycobacterium avium
GATGFLGRYLALEWLERMDMVDGKVI

SEQ ID NO: 80010 - protein, 19 aa, Mycobacterium avium
GATMLRMLLRPEEELDDAW

SEQ ID NO: 80011 - protein, 26 aa, Mycobacterium avium
GATPEWARTAIGLARRAAELFAEDPD

SEQ ID NO: 80012 - protein, 24 aa, Mycobacterium avium
GATPGCFVALLFSRSAEAIVAMLA

SEQ ID NO: 80013 - protein, 24 aa, Mycobacterium avium
GATRRWPECILFERGGDGLISHIS

SEQ ID NO: 80014 - protein, 18 aa, Mycobacterium avium
GAVALGWIASRWPGLLPE

SEQ ID NO: 80015 - protein, 20 aa, Mycobacterium avium
GAVEGVKGKAKEVGGTILGR

SEQ ID NO: 80016 - protein, 18 aa, Mycobacterium avium
GAVFAYWVANPSAYGVVE

SEQ ID NO: 80017 - protein, 24 aa, Mycobacterium avium
GAVGLCALRSALFQGAATVFAVDQ

SEQ ID NO: 80018 - protein, 18 aa, Mycobacterium avium
GAVHGGSLGMLFDTVLGL

SEQ ID NO: 80019 - protein, 17 aa, Mycobacterium avium
GAVKDGFVWGRGAVDMK

SEQ ID NO: 80020 - protein, 17 aa, Mycobacterium avium
GAVPRVALDRVDLAVSS

SEQ ID NO: 80021 - protein, 18 aa, Mycobacterium avium
GAVSRAHRGVLFLDECAE

SEQ ID NO: 80022 - protein, 29 aa, Mycobacterium avium
GAWRDPRVWWQLRNPFRPSWGEPYTEIAA

SEQ ID NO: 80023 - protein, 18 aa, Mycobacterium avium
GAYREFHIDWDLAAAEKG

SEQ ID NO: 80024 - protein, 17 aa, Mycobacterium avium
GCAELQVVDSICGHDGF

SEQ ID NO: 80025 - protein, 22 aa, Mycobacterium avium
GCALNRWQRAQMRRWRDGDRVA

SEQ ID NO: 80026 - protein, 33 aa, Mycobacterium avium
GCDGVVIGRGCLGRPWLFAELSAAFTGSPPPTP

SEQ ID NO: 80027 - protein, 20 aa, Mycobacterium avium
GCDRIRFTPYQKLVLLDIPD

SEQ ID NO: 80028 - protein, 20 aa, Mycobacterium avium
GCGESGILAGVRLKQANIPF

SEQ ID NO: 80029 - protein, 21 aa, Mycobacterium avium
GCGQWPGSVTRLQAPVIPHMG

SEQ ID NO: 80030 - protein, 22 aa, Mycobacterium avium
GCRMGICQSCVVGLVEGHVRDL

SEQ ID NO: 80031 - protein, 21 aa, Mycobacterium avium
GCTAPGCTVPGYYAEVHHCTD

SEQ ID NO: 80032 - protein, 23 aa, Mycobacterium avium
GCVFAYGRCRDGAPAPYAAVRDA

SEQ ID NO: 80033 - protein, 21 aa, Mycobacterium avium
GDAALKVLRRRGIDVRLGTTL

SEQ ID NO: 80034 - protein, 18 aa, Mycobacterium avium
GDAAVSLMDAFRSADEVL

SEQ ID NO: 80035 - protein, 23 aa, Mycobacterium avium
GDALRPLTAVVRSARMAAVTAIL

SEQ ID NO: 80036 - protein, 17 aa, Mycobacterium avium
GDALWAATFLRRRGAAA

SEQ ID NO: 80037 - protein, 22 aa, Mycobacterium avium
GDCLPERDFPTLIELYLQGRLP

SEQ ID NO: 80038 - protein, 25 aa, Mycobacterium avium
GDDIAEVLALLGVRPVWDDASRRVV

SEQ ID NO: 80039 - protein, 22 aa, Mycobacterium avium
GDDIRARFVVLASGPFHRPKLP

SEQ ID NO: 80040 - protein, 18 aa, Mycobacterium avium
GDDLAVRPHPEWFRTGDL

SEQ ID NO: 80041 - protein, 26 aa, Mycobacterium avium
GDDLRLVVIDGRVVAAALRLPPEVIG

SEQ ID NO: 80042 - protein, 18 aa, Mycobacterium avium
GDDRARAALARWSLVRTD

SEQ ID NO: 80043 - protein, 23 aa, Mycobacterium avium
GDESRGGVDISRPGAVDEVCAQV

SEQ ID NO: 80044 - protein, 26 aa, Mycobacterium avium
GDEVQIGKFRLVFLTGPKQGEDGGSS

SEQ ID NO: 80045 - protein, 19 aa, Mycobacterium avium
GDFARRGLDPDLAPLYAQA

SEQ ID NO: 80046 - protein, 19 aa, Mycobacterium avium
GDFKAVLPALTEVRPTLFL

SEQ ID NO: 80047 - protein, 20 aa, Mycobacterium avium
GDFRFYLDYYTRQSAGGVEL

SEQ ID NO: 80048 - protein, 24 aa, Mycobacterium avium
GDGFARYWLHNGWVTMGGEKMSKS

SEQ ID NO: 80049 - protein, 22 aa, Mycobacterium avium
GDGGDGALHWLINEIERGVADP

SEQ ID NO: 80050 - protein, 19 aa, Mycobacterium avium
GDGMWNWFAAPNLPAQIAE

SEQ ID NO: 80051 - protein, 31 aa, Mycobacterium avium
GDGPARAWERGRFGAPYLRDSLLAAGALCET

SEQ ID NO: 80052 - protein, 26 aa, Mycobacterium avium
GDGPLAGTVRFEWDPLRWFEEDEPIY

SEQ ID NO: 80053 - protein, 25 aa, Mycobacterium avium
GDGRCWSEFVLGSAYEGPPRLVHGG

SEQ ID NO: 80054 - protein, 23 aa, Mycobacterium avium
GDGWRVAMGTLTFERGVSTLGQQ

SEQ ID NO: 80055 - protein, 21 aa, Mycobacterium avium
GDGWVHFDAPAGMLIPDSVAT

SEQ ID NO: 80056 - protein, 18 aa, Mycobacterium avium
GDHFVVFGAVQSLSEAPK

SEQ ID NO: 80057 - protein, 17 aa, Mycobacterium avium
GDIDVLVCTTVIEVGVD

SEQ ID NO: 80058 - protein, 20 aa, Mycobacterium avium
GDIRIGMRVSPVFYDLQDGI

SEQ ID NO: 80059 - protein, 18 aa, Mycobacterium avium
GDIWRMPIVRDEPIRDWV

SEQ ID NO: 80060 - protein, 18 aa, Mycobacterium avium
GDLAFPIAPGTAGGTGPE

SEQ ID NO: 80061 - protein, 18 aa, Mycobacterium avium
GDLAPLWSDEVLKAAIDT

SEQ ID NO: 80062 - protein, 32 aa, Mycobacterium avium
GDLATIWRGGCIIRAKFLNRIKDAFDENPDLP

SEQ ID NO: 80063 - protein, 30 aa, Mycobacterium avium
GDLAYRDADGWIYLAGRTADWMRVDGENLA

SEQ ID NO: 80064 - protein, 19 aa, Mycobacterium avium
GDLCLIWAEQMLRDSGLEA

SEQ ID NO: 80065 - protein, 21 aa, Mycobacterium avium
GDLDEGFALLSDDFSYWTLYT

SEQ ID NO: 80066 - protein, 23 aa, Mycobacterium avium
GDLGFPLSIHLEATYGISGPAFQ

SEQ ID NO: 80067 - protein, 21 aa, Mycobacterium avium
GDLLIGWRLLVHADVAQRALA

SEQ ID NO: 80068 - protein, 40 aa, Mycobacterium avium
GDLRVGDRVVIPFQICCGSCYMCGQQLYTQCETTQVRDQG

SEQ ID NO: 80069 - protein, 22 aa, Mycobacterium avium
GDLVSCPQWVISVTALGELDGR

SEQ ID NO: 80070 - protein, 18 aa, Mycobacterium avium
GDPLFYSSYMHLHTRLTQ

SEQ ID NO: 80071 - protein, 25 aa, Mycobacterium avium
GDPTARLHQIWSLLLPGIVSQASLP

SEQ ID NO: 80072 - protein, 25 aa, Mycobacterium avium
GDQTMFRKLFESVIAGHVKVLIGRK

SEQ ID NO: 80073 - protein, 19 aa, Mycobacterium avium
GDRFIKTAVAILGETGRTD

SEQ ID NO: 80074 - protein, 18 aa, Mycobacterium avium
GDRIFSWQLAAAVRPSLF

SEQ ID NO: 80075 - protein, 18 aa, Mycobacterium avium
GDRMLRDMLRGMTPEDAR

SEQ ID NO: 80076 - protein, 19 aa, Mycobacterium avium
GDRMWEFLDRLTSIALPRI

SEQ ID NO: 80077 - protein, 27 aa, Mycobacterium avium
GDRRAAIRHAVAWAGPGDVVLVAGKGH

SEQ ID NO: 80078 - protein, 17 aa, Mycobacterium avium
GDRTELRSLAQTYGDTE

SEQ ID NO: 80079 - protein, 18 aa, Mycobacterium avium
GDRWCVTALNWLRAHHDG

SEQ ID NO: 80080 - protein, 17 aa, Mycobacterium avium
GDSDWLHGMWKGEKFTE

SEQ ID NO: 80081 - protein, 23 aa, Mycobacterium avium
GDTIKRILLELGGKSASIVLDDA

SEQ ID NO: 80082 - protein, 21 aa, Mycobacterium avium
GDTRLGLLPFRRNLTFYALDL

SEQ ID NO: 80083 - protein, 18 aa, Mycobacterium avium
GDTTRSWYVIDATDVVLG

SEQ ID NO: 80084 - protein, 31 aa, Mycobacterium avium
GDVGWIPYFLWRAEHVYNRHSGWTLATFPPG

SEQ ID NO: 80085 - protein, 25 aa, Mycobacterium avium
GDVMPPRGVGVIELRGESVTPGYLT

SEQ ID NO: 80086 - protein, 24 aa, Mycobacterium avium
GDVRGRGAMIAIELVKSGTAEPDK

SEQ ID NO: 80087 - protein, 19 aa, Mycobacterium avium
GDYRVVSFAADVQAVLGTL

SEQ ID NO: 80088 - protein, 25 aa, Mycobacterium avium
GEAEGAFLLCGFMMALAEHQLGHTH

SEQ ID NO: 80089 - protein, 23 aa, Mycobacterium avium
GEAEGAYAEMWAQDAAAMYGYAA

SEQ ID NO: 80090 - protein, 19 aa, Mycobacterium avium
GEAELDLVLAILRARQLFG

SEQ ID NO: 80091 - protein, 17 aa, Mycobacterium avium
GEAIPAQAIAQVCELTW

SEQ ID NO: 80092 - protein, 25 aa, Mycobacterium avium
GEALLSGLLRAGRQVKDLVVVERVP

SEQ ID NO: 80093 - protein, 26 aa, Mycobacterium avium
GEALREYGVRVLVIRPGQVRTRMSAH

SEQ ID NO: 80094 - protein, 19 aa, Mycobacterium avium
GEAVLRPAALVSDRLQAAA

SEQ ID NO: 80095 - protein, 17 aa, Mycobacterium avium
GECHVHAGINGDELGER

SEQ ID NO: 80096 - protein, 22 aa, Mycobacterium avium
GEDCLRLNVWASADTQPGDAKP

SEQ ID NO: 80097 - protein, 24 aa, Mycobacterium avium
GEDGRYRPAAGLAVLGASFDRNVR

SEQ ID NO: 80098 - protein, 26 aa, Mycobacterium avium
GEDVLRPLPVTRFDVRRAPAALRYLS

SEQ ID NO: 80099 - protein, 24 aa, Mycobacterium avium
GEEEAFSHIDLVDFSGNVEGAQQA

SEQ ID NO: 80100 - protein, 23 aa, Mycobacterium avium
GEGKRLYPLTADRAKPAVPFGGA

SEQ ID NO: 80101 - protein, 21 aa, Mycobacterium avium
GEGLAKLPADRMPVLYCKTGV

SEQ ID NO: 80102 - protein, 21 aa, Mycobacterium avium
GEGVLRFFEYVAARTDIALGM

SEQ ID NO: 80103 - protein, 18 aa, Mycobacterium avium
GEHIRVFPLSNWTEFDIW

SEQ ID NO: 80104 - protein, 24 aa, Mycobacterium avium
GEIARRAGAHLVRHPINLGQGAAI

SEQ ID NO: 80105 - protein, 22 aa, Mycobacterium avium
GEIEWAKASLIGPEEYPAAVAA

SEQ ID NO: 80106 - protein, 21 aa, Mycobacterium avium
GEIGQDLAALAFDVLGSRDDG

SEQ ID NO: 80107 - protein, 21 aa, Mycobacterium avium
GEKAFRIGRLCTKRSARGQGH

SEQ ID NO: 80108 - protein, 20 aa, Mycobacterium avium
GELAEAVFWALDNYEADEEA

SEQ ID NO: 80109 - protein, 27 aa, Mycobacterium avium
GELASLLRFVLELLGDYGLTDFYLELS

SEQ ID NO: 80110 - protein, 24 aa, Mycobacterium avium
GELGEPFTTVGLCCYRDGSDSVAW

SEQ ID NO: 80111 - protein, 18 aa, Mycobacterium avium
GELGRLGCTEVRFYRQLA

SEQ ID NO: 80112 - protein, 18 aa, Mycobacterium avium
GELIRVRILPTWLRLDAR

SEQ ID NO: 80113 - protein, 22 aa, Mycobacterium avium
GELLLQPMVDAVWDRVAKPTDA

SEQ ID NO: 80114 - protein, 20 aa, Mycobacterium avium
GELNAAAVRSMWSTVRDKVR

SEQ ID NO: 80115 - protein, 27 aa, Mycobacterium avium
GELPTWQWEGLIGKSTRLVAVASASAT

SEQ ID NO: 80116 - protein, 25 aa, Mycobacterium avium
GELRLKGPQCFLGYADPTLDADAFD

SEQ ID NO: 80117 - protein, 23 aa, Mycobacterium avium
GELRRRVKAMSYGLAYGLSAYGL

SEQ ID NO: 80118 - protein, 17 aa, Mycobacterium avium
GELTAAINAGGGRAVAY

SEQ ID NO: 80119 - protein, 21 aa, Mycobacterium avium
GELTLPGRSLLFVRNVGHLMT

SEQ ID NO: 80120 - protein, 25 aa, Mycobacterium avium
GEMTLSYDPPRKWWQAGPGEGSIGF

SEQ ID NO: 80121 - protein, 19 aa, Mycobacterium avium
GENGWPMPLPDELKEDLKS

SEQ ID NO: 80122 - protein, 20 aa, Mycobacterium avium
GENIPAWLVFDQQYRDRYIF

SEQ ID NO: 80123 - protein, 26 aa, Mycobacterium avium
GENIVCPWHGWQWRGDGSNALIPYSK

SEQ ID NO: 80124 - protein, 23 aa, Mycobacterium avium
GEPAEVGRICVFLAGGQADFVNG

SEQ ID NO: 80125 - protein, 18 aa, Mycobacterium avium
GERLDAKALVAFTQSGDT

SEQ ID NO: 80126 - protein, 23 aa, Mycobacterium avium
GERLKRVSLELGGKSAAIILDDA

SEQ ID NO: 80127 - protein, 19 aa, Mycobacterium avium
GERLLGLDLANGGHLTHGM

SEQ ID NO: 80128 - protein, 26 aa, Mycobacterium avium
GERREVRGRLALVTGAGAGIGRATAV

SEQ ID NO: 80129 - protein, 24 aa, Mycobacterium avium
GERRRVALCKLLLSKPDLLLLDEP

SEQ ID NO: 80130 - protein, 20 aa, Mycobacterium avium
GESLLTYALCVEELARGWMS

SEQ ID NO: 80131 - protein, 18 aa, Mycobacterium avium
GETASIFLPSVPNLLQLA

SEQ ID NO: 80132 - protein, 28 aa, Mycobacterium avium
GETRRLRVSGPLKAMVEAEWVFDRGSAT

SEQ ID NO: 80133 - protein, 26 aa, Mycobacterium avium
GEVLERSLVHLGLKHYFLVDFPQEPG

SEQ ID NO: 80134 - protein, 24 aa, Mycobacterium avium
GEVLQCPFHGWQWSAEGRNVCIPY

SEQ ID NO: 80135 - protein, 23 aa, Mycobacterium avium
GEVVAGLRIPGKIDKLGYKGIET

SEQ ID NO: 80136 - protein, 17 aa, Mycobacterium avium
GEWAPFDMATVFADQQE

SEQ ID NO: 80137 - protein, 17 aa, Mycobacterium avium
GEWVVPPLVAMQGTKFT

SEQ ID NO: 80138 - protein, 17 aa, Mycobacterium avium
GEYATWLDAERVVVNVY

SEQ ID NO: 80139 - protein, 24 aa, Mycobacterium avium
GEYTRRAAGAGARLVVFPEATMCR

SEQ ID NO: 80140 - protein, 42 aa, Mycobacterium avium
GFAVGQRVAVGWFGGCCYRCDPCRAGLFIHCVNGKVPSWHYP

SEQ ID NO: 80141 - protein, 18 aa, Mycobacterium avium
GFDGASCGVNIGIGAQSP

SEQ ID NO: 80142 - protein, 20 aa, Mycobacterium avium
GFDRLRLIQRIVDRLPEKAP

SEQ ID NO: 80143 - protein, 21 aa, Mycobacterium avium
GFERSKYASGEFFDKYTEQVW

SEQ ID NO: 80144 - protein, 20 aa, Mycobacterium avium
GFFGRMLATIRPYRPSLSHP

SEQ ID NO: 80145 - protein, 17 aa, Mycobacterium avium
GFGLRVPIVNAPMGGVA

SEQ ID NO: 80146 - protein, 17 aa, Mycobacterium avium
GFGRIGRNFYRALLAQQ

SEQ ID NO: 80147 - protein, 17 aa, Mycobacterium avium
GFGYPWALGDAGDSLAN

SEQ ID NO: 80148 - protein, 19 aa, Mycobacterium avium
GFLSEPWWCRMVVLSAERI

SEQ ID NO: 80149 - protein, 20 aa, Mycobacterium avium
GFNLARVVAVELGFDFLPGT

SEQ ID NO: 80150 - protein, 44 aa, Mycobacterium avium
GFPESHALSFASLVFYSSWFKLHHPAAFCAALLRAQPMGFYSPQ

SEQ ID NO: 80151 - protein, 23 aa, Mycobacterium avium
GFRFDLAATLAREFYDVDRLATF

SEQ ID NO: 80152 - protein, 18 aa, Mycobacterium avium
GGAETFQAIVSRFYAQVP

SEQ ID NO: 80153 - protein, 24 aa, Mycobacterium avium
GGAEVAAWLGTLGTLGRAAFQLGV

SEQ ID NO: 80154 - protein, 19 aa, Mycobacterium avium
GGAGIPGFYTRTGYGTTLA

SEQ ID NO: 80155 - protein, 18 aa, Mycobacterium avium
GGAHKCIGMVFGQLEVKT

SEQ ID NO: 80156 - protein, 22 aa, Mycobacterium avium
GGAIALGHPFGMTGARITTTLL

SEQ ID NO: 80157 - protein, 17 aa, Mycobacterium avium
GGANLINAVVRDAQVPT

SEQ ID NO: 80158 - protein, 19 aa, Mycobacterium avium
GGAVKFFAGRLVKAAEREA

SEQ ID NO: 80159 - protein, 19 aa, Mycobacterium avium
GGCELAMMCDVLIAADTAK

SEQ ID NO: 80160 - protein, 18 aa, Mycobacterium avium
GGDARRIRQLAGRVTPAI

SEQ ID NO: 80161 - protein, 18 aa, Mycobacterium avium
GGDAWVRAMMLVDAGVDV

SEQ ID NO: 80162 - protein, 22 aa, Mycobacterium avium
GGDGRCKLVPYAKRTPKTARTR

SEQ ID NO: 80163 - protein, 18 aa, Mycobacterium avium
GGDIGIGGNSAWRAIAGP

SEQ ID NO: 80164 - protein, 18 aa, Mycobacterium avium
GGDLEFADELTLGRALAG

SEQ ID NO: 80165 - protein, 21 aa, Mycobacterium avium
GGDLRRMGISAATVAALGQAL

SEQ ID NO: 80166 - protein, 20 aa, Mycobacterium avium
GGDPLRIGASLVVRAIRPVA

SEQ ID NO: 80167 - protein, 20 aa, Mycobacterium avium
GGEMGRLWYEHGKLLEKKNT

SEQ ID NO: 80168 - protein, 18 aa, Mycobacterium avium
GGEPRWGGYAAAKEGIRG

SEQ ID NO: 80169 - protein, 24 aa, Mycobacterium avium
GGERNRLNLALTLKQGGNLILLDE

SEQ ID NO: 80170 - protein, 18 aa, Mycobacterium avium
GGFGTLLMLGHDWASPEA

SEQ ID NO: 80171 - protein, 19 aa, Mycobacterium avium
GGFLNTGIWESWRHRPPRY

SEQ ID NO: 80172 - protein, 22 aa, Mycobacterium avium
GGGAGAAHLVDWADDIDPAWLE

SEQ ID NO: 80173 - protein, 20 aa, Mycobacterium avium
GGGAHFCLGANLARREIRVV

SEQ ID NO: 80174 - protein, 28 aa, Mycobacterium avium
GGGEVQRPVWPMIVLRTPKGWTGPKVVD

SEQ ID NO: 80175 - protein, 25 aa, Mycobacterium avium
GGGGRGRARLCCLMLARAPAPGRRP

SEQ ID NO: 80176 - protein, 26 aa, Mycobacterium avium
GGGIAHRLGMRPSWVLDLNNGGCAAF

SEQ ID NO: 80177 - protein, 24 aa, Mycobacterium avium
GGGLPIGACLAVGPAADLLTPGLH

SEQ ID NO: 80178 - protein, 28 aa, Mycobacterium avium
GGHTQPAGWFRFYFADQRWEWSEQVQRM

SEQ ID NO: 80179 - protein, 18 aa, Mycobacterium avium
GGICHWFHSDAIYRAVLA

SEQ ID NO: 80180 - protein, 19 aa, Mycobacterium avium
GGINPIWAYAHVPFGYTGD

SEQ ID NO: 80181 - protein, 18 aa, Mycobacterium avium
GGITDWLRAAAVAAAHNV

SEQ ID NO: 80182 - protein, 24 aa, Mycobacterium avium
GGKALKFYASVRMDVRRIETLKDG

SEQ ID NO: 80183 - protein, 22 aa, Mycobacterium avium
GGKTFPLPNPFLVMATQNPIEH

SEQ ID NO: 80184 - protein, 19 aa, Mycobacterium avium
GGKVTAWRYIRAAVPAVWG

SEQ ID NO: 80185 - protein, 17 aa, Mycobacterium avium
GGLDTSVAISWIGKETG

SEQ ID NO: 80186 - protein, 24 aa, Mycobacterium avium
GGLDVCGLAGCHLAGGHSVDDPEP

SEQ ID NO: 80187 - protein, 25 aa, Mycobacterium avium
GGLDVLVHAAGLWQPGIPGCIGADD

SEQ ID NO: 80188 - protein, 20 aa, Mycobacterium avium
GGLDYEIWDDGWTVVTKDRK

SEQ ID NO: 80189 - protein, 20 aa, Mycobacterium avium
GGLGGCPFAPGATGNIATED

SEQ ID NO: 80190 - protein, 25 aa, Mycobacterium avium
GGLGKVRFGDWRAPFDGFAHLPNVA

SEQ ID NO: 80191 - protein, 17 aa, Mycobacterium avium
GGLHFCLGAHVARAQLR

SEQ ID NO: 80192 - protein, 18 aa, Mycobacterium avium
GGLLHHAPSLLAFTNPTT

SEQ ID NO: 80193 - protein, 19 aa, Mycobacterium avium
GGLRPGRTEREVSRELEAL

SEQ ID NO: 80194 - protein, 20 aa, Mycobacterium avium
GGLTRPGLLDACFDHLPSGG

SEQ ID NO: 80195 - protein, 19 aa, Mycobacterium avium
GGLTRVALVEGSRVVNSSQ

SEQ ID NO: 80196 - protein, 19 aa, Mycobacterium avium
GGMLPGVLYDAGLKTITDL

SEQ ID NO: 80197 - protein, 24 aa, Mycobacterium avium
GGMNPRTSVPMLLSLYQAGDLKLD

SEQ ID NO: 80198 - protein, 18 aa, Mycobacterium avium
GGNIEFRTLPVVRYDNID

SEQ ID NO: 80199 - protein, 20 aa, Mycobacterium avium
GGNPDFRYNTIITEETTRGR

SEQ ID NO: 80200 - protein, 19 aa, Mycobacterium avium
GGPGLMWGGGTIAAARRAG

SEQ ID NO: 80201 - protein, 21 aa, Mycobacterium avium
GGPPPRLALSLGDSLAGMFGA

SEQ ID NO: 80202 - protein, 26 aa, Mycobacterium avium
GGPWLKTGDQGFLFDGALFIVGRIKD

SEQ ID NO: 80203 - protein, 18 aa, Mycobacterium avium
GGRTSYRGLVQVNKGAHG

SEQ ID NO: 80204 - protein, 21 aa, Mycobacterium avium
GGTCPLWNVYETFANPGKILV

SEQ ID NO: 80205 - protein, 20 aa, Mycobacterium avium
GGTLKLMRPLFSAGLGGRLG

SEQ ID NO: 80206 - protein, 20 aa, Mycobacterium avium
GGTPLRSRVGHSYIKALMAD

SEQ ID NO: 80207 - protein, 25 aa, Mycobacterium avium
GGTSALWGGRCVKFDRIDFEHRLIT

SEQ ID NO: 80208 - protein, 17 aa, Mycobacterium avium
GGTSRRLLVVLSDGLAY

SEQ ID NO: 80209 - protein, 23 aa, Mycobacterium avium
GGTWRINTYPGLACDVKSHLYSY

SEQ ID NO: 80210 - protein, 29 aa, Mycobacterium avium
GGVELRGPQRWRIRANWKIGAENFAGDMY

SEQ ID NO: 80211 - protein, 19 aa, Mycobacterium avium
GGVHYCLGANLARREIAEA

SEQ ID NO: 80212 - protein, 24 aa, Mycobacterium avium
GGVKGFFEKTFAPLGLKKIQGEVL

SEQ ID NO: 80213 - protein, 20 aa, Mycobacterium avium
GGWYFTSRALQWDSVPSRHP

SEQ ID NO: 80214 - protein, 19 aa, Mycobacterium avium
GGYCYEQNGLLGYALAEIG

SEQ ID NO: 80215 - protein, 26 aa, Mycobacterium avium
GGYDMTAFWCRAGTAATITPAGMPGM

SEQ ID NO: 80216 - protein, 17 aa, Mycobacterium avium
GGYQLAVVRYGRLAAAG

SEQ ID NO: 80217 - protein, 17 aa, Mycobacterium avium
GGYRVSGPIRWASNLYP

SEQ ID NO: 80218 - protein, 17 aa, Mycobacterium avium
GHAGFLGAERIRELMTG

SEQ ID NO: 80219 - protein, 19 aa, Mycobacterium avium
GHAKVRRLLIDFVGHHATP

SEQ ID NO: 80220 - protein, 21 aa, Mycobacterium avium
GHDGDYRFGQQIVVSHDGGDY

SEQ ID NO: 80221 - protein, 18 aa, Mycobacterium avium
GHDISRVVMPPSFVQSKR

SEQ ID NO: 80222 - protein, 17 aa, Mycobacterium avium
GHDITLFSRTMTIEADK

SEQ ID NO: 80223 - protein, 27 aa, Mycobacterium avium
GHERTMMWLGFADRLENMIADFQPGTE

SEQ ID NO: 80224 - protein, 18 aa, Mycobacterium avium
GHFFEWLTDKGFRSFAGH

SEQ ID NO: 80225 - protein, 23 aa, Mycobacterium avium
GHGHSAWRADGDYSPQLNADALL

SEQ ID NO: 80226 - protein, 18 aa, Mycobacterium avium
GHGLHLFATLLSAAERAG

SEQ ID NO: 80227 - protein, 19 aa, Mycobacterium avium
GHGPHRYYIAVHAVDTEKL

SEQ ID NO: 80228 - protein, 21 aa, Mycobacterium avium
GHGRLTGLITVKDFVKTEQHP

SEQ ID NO: 80229 - protein, 17 aa, Mycobacterium avium
GHIRLTVDTNFTMPTTD

SEQ ID NO: 80230 - protein, 19 aa, Mycobacterium avium
GHLDWYADGMFPPMHLDAE

SEQ ID NO: 80231 - protein, 26 aa, Mycobacterium avium
GHPILYVAQMWDWIYPLGDNPDYEPD

SEQ ID NO: 80232 - protein, 19 aa, Mycobacterium avium
GHPLFAHITLLRSERSPIA

SEQ ID NO: 80233 - protein, 24 aa, Mycobacterium avium
GHPSRVRAGLLLAVGARATADQIG

SEQ ID NO: 80234 - protein, 25 aa, Mycobacterium avium
GHQGLCYFAYLAGYREVHEAAQDPV

SEQ ID NO: 80235 - protein, 24 aa, Mycobacterium avium
GHSLGGGVAMQFAYQFPHLVERLI

SEQ ID NO: 80236 - protein, 19 aa, Mycobacterium avium
GHTNYPVVVGHEIAGVVTE

SEQ ID NO: 80237 - protein, 17 aa, Mycobacterium avium
GHTTRLGLATGVLVLPN

SEQ ID NO: 80238 - protein, 24 aa, Mycobacterium avium
GIAEGCVRAGCALLGGETAEHPGL

SEQ ID NO: 80239 - protein, 18 aa, Mycobacterium avium
GIAERLGVEIPRDRGYGH

SEQ ID NO: 80240 - protein, 19 aa, Mycobacterium avium
GIASARWDAEQLAAHLAGV

SEQ ID NO: 80241 - protein, 26 aa, Mycobacterium avium
GICDAVLCALPARYITPSSKKKPRPM

SEQ ID NO: 80242 - protein, 29 aa, Mycobacterium avium
GIDAAAVWMMAHREILRAGYAYVAVSAQR

SEQ ID NO: 80243 - protein, 24 aa, Mycobacterium avium
GIDPDVYSGFAFGMGLERTLQFRN

SEQ ID NO: 80244 - protein, 25 aa, Mycobacterium avium
GIDRFPIDMVRLYFDDHADDAAGAP

SEQ ID NO: 80245 - protein, 24 aa, Mycobacterium avium
GIEEKRMFGGLAFLLNGNMSVAAS

SEQ ID NO: 80246 - protein, 18 aa, Mycobacterium avium
GIEFCKLSFAETRVRAQG

SEQ ID NO: 80247 - protein, 19 aa, Mycobacterium avium
GIEFCKLSFAETRVRTQTL

SEQ ID NO: 80248 - protein, 20 aa, Mycobacterium avium
GIETARWPFAPRRPRTGPAE

SEQ ID NO: 80249 - protein, 24 aa, Mycobacterium avium
GIETKGGVMTKLIERNTTIPTKRS

SEQ ID NO: 80250 - protein, 18 aa, Mycobacterium avium
GIHACLGAALARIEGATA

SEQ ID NO: 80251 - protein, 25 aa, Mycobacterium avium
GIHPVDLGALGWRGLLDRVDVDPAA

SEQ ID NO: 80252 - protein, 18 aa, Mycobacterium avium
GIMIPFLASHTAKVQSQV

SEQ ID NO: 80253 - protein, 18 aa, Mycobacterium avium
GIMPDRHLGSALHAAHNE

SEQ ID NO: 80254 - protein, 20 aa, Mycobacterium avium
GIMQHFTIPVSFFDESVFED

SEQ ID NO: 80255 - protein, 25 aa, Mycobacterium avium
GINRCLPDLPAEVHFERNIMARNLL

SEQ ID NO: 80256 - protein, 24 aa, Mycobacterium avium
GIPDIPGYAARVFRAVADADVNID

SEQ ID NO: 80257 - protein, 22 aa, Mycobacterium avium
GIPKLRIEEAAARTQARIDSGI

SEQ ID NO: 80258 - protein, 19 aa, Mycobacterium avium
GIPRAELFVTTKLATSDQG

SEQ ID NO: 80259 - protein, 18 aa, Mycobacterium avium
GIRHPRDVALALAAGASN

SEQ ID NO: 80260 - protein, 24 aa, Mycobacterium avium
GIRRRVAADLQILKRFAQAVELAK

SEQ ID NO: 80261 - protein, 25 aa, Mycobacterium avium
GIRVNSVAPGYIWGDTLQAYFEHQA

SEQ ID NO: 80262 - protein, 23 aa, Mycobacterium avium
GITKADIGFWCSGSSDYLAGRAF

SEQ ID NO: 80263 - protein, 17 aa, Mycobacterium avium
GIVPAAFYRHFESMESL

SEQ ID NO: 80264 - protein, 18 aa, Mycobacterium avium
GIWMRPEAVPGFRRLTDA

SEQ ID NO: 80265 - protein, 22 aa, Mycobacterium avium
GKAQEHFFDFIVTPRRGDDGSI

SEQ ID NO: 80266 - protein, 19 aa, Mycobacterium avium
GKDISCNLGSLNIAKTMDS

SEQ ID NO: 80267 - protein, 18 aa, Mycobacterium avium
GKDWTPTQHQIWADEMQL

SEQ ID NO: 80268 - protein, 21 aa, Mycobacterium avium
GKEASLACMAAWANTDFRPDL

SEQ ID NO: 80269 - protein, 30 aa, Mycobacterium avium
GKEGDRGLSWLPFFHDMGLITAMLSPVLGH

SEQ ID NO: 80270 - protein, 26 aa, Mycobacterium avium
GKELLRRLKGLPGFGEQKARIFLALL

SEQ ID NO: 80271 - protein, 25 aa, Mycobacterium avium
GKEVPPVVVVPYFWSDQYDVKIQCL

SEQ ID NO: 80272 - protein, 20 aa, Mycobacterium avium
GKGFAGTMKRHGFRGQGASH

SEQ ID NO: 80273 - protein, 22 aa, Mycobacterium avium
GKGGEYFLRHLLGTDSNASAVP

SEQ ID NO: 80274 - protein, 18 aa, Mycobacterium avium
GKGLSRLVRQNCDEVVSI

SEQ ID NO: 80275 - protein, 18 aa, Mycobacterium avium
GKHLGVGVTSIYWYFRKK

SEQ ID NO: 80276 - protein, 27 aa, Mycobacterium avium
GKIEALLRVLEPFGIREIVQSGVVSLS

SEQ ID NO: 80277 - protein, 23 aa, Mycobacterium avium
GKIPAGGGWRMLGRTVGNRNAQA

SEQ ID NO: 80278 - protein, 19 aa, Mycobacterium avium
GKIRRAGCIEQYRQRQFTR

SEQ ID NO: 80279 - protein, 26 aa, Mycobacterium avium
GKKCYSLRIASAMAHDEGWLAEHMLI

SEQ ID NO: 80280 - protein, 28 aa, Mycobacterium avium
GKLGVGWPKEFGGLGFGPIEQSIFVNEA

SEQ ID NO: 80281 - protein, 19 aa, Mycobacterium avium
GKLPSEVFREHFLTCFISD

SEQ ID NO: 80282 - protein, 18 aa, Mycobacterium avium
GKLSRKEKVMGFGHRVYK

SEQ ID NO: 80283 - protein, 22 aa, Mycobacterium avium
GKNTFHGLLLLRHVGDLVNTGW

SEQ ID NO: 80284 - protein, 20 aa, Mycobacterium avium
GKPDYRWAKEQTEARPADDV

SEQ ID NO: 80285 - protein, 27 aa, Mycobacterium avium
GKPERLRSGWLNGIKHWQVDYHTNGSS

SEQ ID NO: 80286 - protein, 24 aa, Mycobacterium avium
GKPQRIGARFGVILASGGFDHDLA

SEQ ID NO: 80287 - protein, 21 aa, Mycobacterium avium
GKPTRAGWGVERIARAWETLM

SEQ ID NO: 80288 - protein, 22 aa, Mycobacterium avium
GKQIPATLAMDYPRLSDVAEYL

SEQ ID NO: 80289 - protein, 18 aa, Mycobacterium avium
GKQLWSWLQDGAQLYVCG

SEQ ID NO: 80290 - protein, 26 aa, Mycobacterium avium
GKQTIYRWWPTRPALVADVMLEDADR

SEQ ID NO: 80291 - protein, 20 aa, Mycobacterium avium
GKRKRTRTGFGKRKSTKRAI

SEQ ID NO: 80292 - protein, 21 aa, Mycobacterium avium
GKSATTAWLIERLQRPTLVMA

SEQ ID NO: 80293 - protein, 22 aa, Mycobacterium avium
GKSMRIFKSELREMQSENKTET

SEQ ID NO: 80294 - protein, 21 aa, Mycobacterium avium
GKSPAVFYRYFADKEDLLAAL

SEQ ID NO: 80295 - protein, 19 aa, Mycobacterium avium
GKVKEVAGAVAGRDDLMRE

SEQ ID NO: 80296 - protein, 26 aa, Mycobacterium avium
GKVTKLVPFGAFVRVEEGIEGLVHIS

SEQ ID NO: 80297 - protein, 18 aa, Mycobacterium avium
GLAAGRLSRIVISALSSG

SEQ ID NO: 80298 - protein, 18 aa, Mycobacterium avium
GLAAWGYASGISLGDGSF

SEQ ID NO: 80299 - protein, 18 aa, Mycobacterium avium
GLADIEWTVQLLQLLHAH

SEQ ID NO: 80300 - protein, 18 aa, Mycobacterium avium
GLAERVEVQVAYAIGKAA

SEQ ID NO: 80301 - protein, 20 aa, Mycobacterium avium
GLARYPRPLAPVAAAAAAGM

SEQ ID NO: 80302 - protein, 18 aa, Mycobacterium avium
GLAVPNWPVEWGGKDWTP

SEQ ID NO: 80303 - protein, 31 aa, Mycobacterium avium
GLAYEGYRVLPYCWRDETPLSNHELRMDDDV

SEQ ID NO: 80304 - protein, 17 aa, Mycobacterium avium
GLCRAKAPNRRGVHNHL

SEQ ID NO: 80305 - protein, 28 aa, Mycobacterium avium
GLDARAYRLPWPAGTTVFEIDQPRVLEF

SEQ ID NO: 80306 - protein, 24 aa, Mycobacterium avium
GLDGLRWLQDRGFDGDRVVVAGDS

SEQ ID NO: 80307 - protein, 19 aa, Mycobacterium avium
GLDHCFGPVMLHRVEATVR

SEQ ID NO: 80308 - protein, 23 aa, Mycobacterium avium
GLDREADDFFAFIADVSGANNNE

SEQ ID NO: 80309 - protein, 26 aa, Mycobacterium avium
GLDSRAYRLDWPAGTTVYEIDQPQVL

SEQ ID NO: 80310 - protein, 24 aa, Mycobacterium avium
GLDSRAYRLEWPPATTVFEVDLAK

SEQ ID NO: 80311 - protein, 29 aa, Mycobacterium avium
GLDSRAYRLPWPAGTVVYEIDQPRVIEFK

SEQ ID NO: 80312 - protein, 27 aa, Mycobacterium avium
GLEKCIGCELCAWACPADAIYVEGADN

SEQ ID NO: 80313 - protein, 25 aa, Mycobacterium avium
GLELSTGVAVAFPRSPFVTAAVAWE

SEQ ID NO: 80314 - protein, 25 aa, Mycobacterium avium
GLERIGFAAQHIWDGSAERVLAHAT

SEQ ID NO: 80315 - protein, 17 aa, Mycobacterium avium
GLERPAIEVDYEVGESV

SEQ ID NO: 80316 - protein, 19 aa, Mycobacterium avium
GLESFPPGGALVVGNHSGG

SEQ ID NO: 80317 - protein, 24 aa, Mycobacterium avium
GLFGALRFARNVLVHRDARKRVLT

SEQ ID NO: 80318 - protein, 29 aa, Mycobacterium avium
GLGAWAGPPPQWWAQRFGIEPDLAEALVC

SEQ ID NO: 80319 - protein, 18 aa, Mycobacterium avium
GLGCDLDLVELAGLAHDI

SEQ ID NO: 80320 - protein, 23 aa, Mycobacterium avium
GLGCELRHAHRLVYSEGLDVSGG

SEQ ID NO: 80321 - protein, 21 aa, Mycobacterium avium
GLGCSLVALSDIVYIAENAYL

SEQ ID NO: 80322 - protein, 19 aa, Mycobacterium avium
GLGREYALTLAREGASVVV

SEQ ID NO: 80323 - protein, 17 aa, Mycobacterium avium
GLGRRRPDIAVTILRLA

SEQ ID NO: 80324 - protein, 25 aa, Mycobacterium avium
GLGYFSNGITAFWSQLAQQLVSGPG

SEQ ID NO: 80325 - protein, 24 aa, Mycobacterium avium
GLHFCLGSALARMEARVAFEEVLK

SEQ ID NO: 80326 - protein, 23 aa, Mycobacterium avium
GLHFICRDVWLRVASTSTAWTSR

SEQ ID NO: 80327 - protein, 25 aa, Mycobacterium avium
GLIGPFRVRIPLLLSADDGHQLVDA

SEQ ID NO: 80328 - protein, 26 aa, Mycobacterium avium
GLKDPKRPSGSFIFAGPSGVGKTELS

SEQ ID NO: 80329 - protein, 20 aa, Mycobacterium avium
GLKSYRGDMINGFAPNAAVR

SEQ ID NO: 80330 - protein, 19 aa, Mycobacterium avium
GLLALAWPKEHGGGGGSVW

SEQ ID NO: 80331 - protein, 18 aa, Mycobacterium avium
GLLDACFDHLPSGGRLVA

SEQ ID NO: 80332 - protein, 20 aa, Mycobacterium avium
GLLDGHRVTTHWAFADRLAS

SEQ ID NO: 80333 - protein, 32 aa, Mycobacterium avium
GLLDGRRATSHWLTIPALKAFGVTAVPDERIV

SEQ ID NO: 80334 - protein, 25 aa, Mycobacterium avium
GLLGSLRIGNRFVHTGKPTPAGYAQ

SEQ ID NO: 80335 - protein, 21 aa, Mycobacterium avium
GLLGTRPSYELMRDCDTLLTV

SEQ ID NO: 80336 - protein, 18 aa, Mycobacterium avium
GLLPRPLTEVIFATDKDT

SEQ ID NO: 80337 - protein, 29 aa, Mycobacterium avium
GLLPRQLRPVLRLVWPVLTSLAARPVVVC

SEQ ID NO: 80338 - protein, 28 aa, Mycobacterium avium
GLLRLPQRIPSAIAMELALTGDNLSAER

SEQ ID NO: 80339 - protein, 18 aa, Mycobacterium avium
GLMHVKFGQYHVRDVKFV

SEQ ID NO: 80340 - protein, 27 aa, Mycobacterium avium
GLNAVIRAVVRTCDSRYGSSVVGFQDG

SEQ ID NO: 80341 - protein, 23 aa, Mycobacterium avium
GLNERYVREWLAGMTTGRVVDYH

SEQ ID NO: 80342 - protein, 26 aa, Mycobacterium avium
GLNFREVLNVLGLYPGDPGPLGGDFA

SEQ ID NO: 80343 - protein, 21 aa, Mycobacterium avium
GLPDGGRMVAVFADAQYVEEL

SEQ ID NO: 80344 - protein, 18 aa, Mycobacterium avium
GLPILGHIIELFRGGPDY

SEQ ID NO: 80345 - protein, 25 aa, Mycobacterium avium
GLPLCAVSLALLHAGRTVVAVTHAP

SEQ ID NO: 80346 - protein, 19 aa, Mycobacterium avium
GLPVLGMAGSVFFDEAARR

SEQ ID NO: 80347 - protein, 24 aa, Mycobacterium avium
GLPYLGLEHRAAWVEAEADGTITS

SEQ ID NO: 80348 - protein, 21 aa, Mycobacterium avium
GLQAPHWPAPYGRGASPAEQL

SEQ ID NO: 80349 - protein, 20 aa, Mycobacterium avium
GLRNLFKLSSLASFEGQLGK

SEQ ID NO: 80350 - protein, 18 aa, Mycobacterium avium
GLRYRFHSYRRDPRSSVR

SEQ ID NO: 80351 - protein, 19 aa, Mycobacterium avium
GLSPEFVRRSIVKSLPALM

SEQ ID NO: 80352 - protein, 24 aa, Mycobacterium avium
GLSVLRYAIRTEIRLITSELATDL

SEQ ID NO: 80353 - protein, 18 aa, Mycobacterium avium
GLTHRWPPGDARGRIVRL

SEQ ID NO: 80354 - protein, 18 aa, Mycobacterium avium
GLTKSTFFRHFPDKRDVL

SEQ ID NO: 80355 - protein, 18 aa, Mycobacterium avium
GLTSALCYGARPHPSYNP

SEQ ID NO: 80356 - protein, 26 aa, Mycobacterium avium
GLVALTMNLSRRWAGDGIRVNAIAPG

SEQ ID NO: 80357 - protein, 25 aa, Mycobacterium avium
GLVGLKTHCKTCLVVRREGSAIRRY

SEQ ID NO: 80358 - protein, 19 aa, Mycobacterium avium
GLVHGGVYCSMIESMASVA

SEQ ID NO: 80359 - protein, 23 aa, Mycobacterium avium
GLVRRARESAGVDLVYVNDNYGD

SEQ ID NO: 80360 - protein, 22 aa, Mycobacterium avium
GLVSGALRLTADYVANRKQFGK

SEQ ID NO: 80361 - protein, 18 aa, Mycobacterium avium
GLVSLRLPTEEELAAAGL

SEQ ID NO: 80362 - protein, 23 aa, Mycobacterium avium
GLYAKARAGEITQFTGIDSPYQP

SEQ ID NO: 80363 - protein, 24 aa, Mycobacterium avium
GMACVLHCHGARFDVVTIAAEVLQ

SEQ ID NO: 80364 - protein, 20 aa, Mycobacterium avium
GMEPYERFWVRDEITGQEFQ

SEQ ID NO: 80365 - protein, 19 aa, Mycobacterium avium
GMGELHLDILVDRMRREFK

SEQ ID NO: 80366 - protein, 27 aa, Mycobacterium avium
GMIPLYYDWLFGMVVSGANCPPTRTAF

SEQ ID NO: 80367 - protein, 19 aa, Mycobacterium avium
GMLELLLRELDVHPGDVIE

SEQ ID NO: 80368 - protein, 22 aa, Mycobacterium avium
GMLFRRKLVMFGPREVLLTSDE

SEQ ID NO: 80369 - protein, 18 aa, Mycobacterium avium
GMLKYGFDDARPVLERAS

SEQ ID NO: 80370 - protein, 21 aa, Mycobacterium avium
GMLNRIKWTVVRYKPPEGMTL

SEQ ID NO: 80371 - protein, 27 aa, Mycobacterium avium
GMLTCAIRPSGIWGRGDQTMFRKLFES

SEQ ID NO: 80372 - protein, 23 aa, Mycobacterium avium
GMPEAQLTLAHCTVYLATAPKSN

SEQ ID NO: 80373 - protein, 21 aa, Mycobacterium avium
GMPTGLWGRVVEAFAPAHVVE

SEQ ID NO: 80374 - protein, 20 aa, Mycobacterium avium
GMRARGCGHIVNISSMTGLV

SEQ ID NO: 80375 - protein, 24 aa, Mycobacterium avium
GMRFDKGYISGYFVTDAERQEAVL

SEQ ID NO: 80376 - protein, 18 aa, Mycobacterium avium
GMSELSCVAAVSHPRDAR

SEQ ID NO: 80377 - protein, 30 aa, Mycobacterium avium
GMSGARITLHAALELSRRGSGYAVAALCGA

SEQ ID NO: 80378 - protein, 21 aa, Mycobacterium avium
GMSLRSPARFLATAERVVRLW

SEQ ID NO: 80379 - protein, 19 aa, Mycobacterium avium
GMTLSQLGAEVIRVDPIGG

SEQ ID NO: 80380 - protein, 26 aa, Mycobacterium avium
GMVFQRPNPFPAMSIRDNVVAGLKLQ

SEQ ID NO: 80381 - protein, 26 aa, Mycobacterium avium
GNAPLDLFLRIIVELFRRHWSSTGQA

SEQ ID NO: 80382 - protein, 23 aa, Mycobacterium avium
GNCGVGFAPVRPGTEQWLIELME

SEQ ID NO: 80383 - protein, 19 aa, Mycobacterium avium
GNDEVRWFDIEPCYVYHPL

SEQ ID NO: 80384 - protein, 21 aa, Mycobacterium avium
GNGLARGGLRTPWVDVPIART

SEQ ID NO: 80385 - protein, 21 aa, Mycobacterium avium
GNGPLAAFVHALAGVGFDVAV

SEQ ID NO: 80386 - protein, 20 aa, Mycobacterium avium
GNKISWADLIIFAGNCALES

SEQ ID NO: 80387 - protein, 23 aa, Mycobacterium avium
GNLDPVVLLAGWPVVETAARAVV

SEQ ID NO: 80388 - protein, 25 aa, Mycobacterium avium
GNLHASVIDRGRWKDHREGETGRGR

SEQ ID NO: 80389 - protein, 17 aa, Mycobacterium avium
GNLVGTFLCNLATDLDD

SEQ ID NO: 80390 - protein, 25 aa, Mycobacterium avium
GNPDAWRPVFARLAELGIFGVAVPE

SEQ ID NO: 80391 - protein, 17 aa, Mycobacterium avium
GNPEFVFHDGVHEVRIA

SEQ ID NO: 80392 - protein, 22 aa, Mycobacterium avium
GNPHVARLLGTYEMAGADGTPE

SEQ ID NO: 80393 - protein, 23 aa, Mycobacterium avium
GNPVCAAAALAVLRVLASENLVR

SEQ ID NO: 80394 - protein, 17 aa, Mycobacterium avium
GNREFFSAVTLRPDAVP

SEQ ID NO: 80395 - protein, 26 aa, Mycobacterium avium
GNRPHCIYRGYCLQGCKVNAKASPYV

SEQ ID NO: 80396 - protein, 21 aa, Mycobacterium avium
GNRRYAEQRARAEGLADRDKF

SEQ ID NO: 80397 - protein, 24 aa, Mycobacterium avium
GNTEVKSFVQKVCNEQLTHWFEAN

SEQ ID NO: 80398 - protein, 17 aa, Mycobacterium avium
GNTGGGLDMMWNNAGIG

SEQ ID NO: 80399 - protein, 19 aa, Mycobacterium avium
GNVEYFLRLRARTDRPLAG

SEQ ID NO: 80400 - protein, 18 aa, Mycobacterium avium
GNYFAPRTSRRVLHQLYL

SEQ ID NO: 80401 - protein, 23 aa, Mycobacterium avium
GPADLPNGFAVRYQAATRPLQVG

SEQ ID NO: 80402 - protein, 19 aa, Mycobacterium avium
GPAGAPVLLAFSRRRLFAV

SEQ ID NO: 80403 - protein, 19 aa, Mycobacterium avium
GPASHYATTGPEIWADTDG

SEQ ID NO: 80404 - protein, 24 aa, Mycobacterium avium
GPATRAVVIYLEYLGTTLADLLNA

SEQ ID NO: 80405 - protein, 23 aa, Mycobacterium avium
GPATRRPIHLTGLDKTFPLYPTL

SEQ ID NO: 80406 - protein, 18 aa, Mycobacterium avium
GPDAARLRELLVGPIDDD

SEQ ID NO: 80407 - protein, 18 aa, Mycobacterium avium
GPDHGAVSRGEWRTSVGD

SEQ ID NO: 80408 - protein, 18 aa, Mycobacterium avium
GPDLRVAVLAGDQRTVDR

SEQ ID NO: 80409 - protein, 19 aa, Mycobacterium avium
GPDMPWNLLQDSAFSAVSV

SEQ ID NO: 80410 - protein, 17 aa, Mycobacterium avium
GPDRPVVLVAHGGLIAA

SEQ ID NO: 80411 - protein, 25 aa, Mycobacterium avium
GPERLPADHPLAVHFDVYQWLTVLQ

SEQ ID NO: 80412 - protein, 28 aa, Mycobacterium avium
GPFYDGAVFHRVIRGFMIQGGDPTGTGR

SEQ ID NO: 80413 - protein, 30 aa, Mycobacterium avium
GPGGGLPITYSRKVFIPVTHLCRDNCHYCT

SEQ ID NO: 80414 - protein, 19 aa, Mycobacterium avium
GPGIRPRAAGAPRWSGRSA

SEQ ID NO: 80415 - protein, 24 aa, Mycobacterium avium
GPGRPVLLMHPWPLSGQSWSAQVP

SEQ ID NO: 80416 - protein, 26 aa, Mycobacterium avium
GPGSRARFGDVLPFLVKVLAADEPLS

SEQ ID NO: 80417 - protein, 17 aa, Mycobacterium avium
GPHDVYVSMNMVRKNGL

SEQ ID NO: 80418 - protein, 25 aa, Mycobacterium avium
GPHFSFSWYRGSPIGRERKTEELSR

SEQ ID NO: 80419 - protein, 17 aa, Mycobacterium avium
GPKGGPGMREMLAITGA

SEQ ID NO: 80420 - protein, 18 aa, Mycobacterium avium
GPLAAGWHSNKFLNPVTD

SEQ ID NO: 80421 - protein, 19 aa, Mycobacterium avium
GPLDEAIRASIAIPGVIAP

SEQ ID NO: 80422 - protein, 24 aa, Mycobacterium avium
GPLIEAMGLTVGWITAESSSEERR

SEQ ID NO: 80423 - protein, 24 aa, Mycobacterium avium
GPLLRRSGVIFIRRNIGNDQLYKY

SEQ ID NO: 80424 - protein, 21 aa, Mycobacterium avium
GPLPLQVICDMMGIPEEDHQR

SEQ ID NO: 80425 - protein, 22 aa, Mycobacterium avium
GPLPPRLRVLAVVLAAEQTVVA

SEQ ID NO: 80426 - protein, 20 aa, Mycobacterium avium
GPLPVMVFIHGGGYFLGSSA

SEQ ID NO: 80427 - protein, 18 aa, Mycobacterium avium
GPMGLPELTSTKWIAWGD

SEQ ID NO: 80428 - protein, 26 aa, Mycobacterium avium
GPNAGIELADLVVLLDHFGIKSEMVS

SEQ ID NO: 80429 - protein, 23 aa, Mycobacterium avium
GPNQLGAFLFWMVRKRPALQIHL

SEQ ID NO: 80430 - protein, 19 aa, Mycobacterium avium
GPPDSRFVYLSDVLPTAWQ

SEQ ID NO: 80431 - protein, 22 aa, Mycobacterium avium
GPPGCGKTLIAKAVANSLAKKM

SEQ ID NO: 80432 - protein, 18 aa, Mycobacterium avium
GPPRRWLVVTGTNGKTTT

SEQ ID NO: 80433 - protein, 22 aa, Mycobacterium avium
GPPTLDRWVIDLAAGKVRESRI

SEQ ID NO: 80434 - protein, 23 aa, Mycobacterium avium
GPRGCGKTSSARILARSLNCVQG

SEQ ID NO: 80435 - protein, 22 aa, Mycobacterium avium
GPRKVSPLAVQMIMPNGAAAVV

SEQ ID NO: 80436 - protein, 20 aa, Mycobacterium avium
GPRQPGRIIAIASADTPLKG

SEQ ID NO: 80437 - protein, 21 aa, Mycobacterium avium
GPRRKGVRYFGPYSHAWAIRE

SEQ ID NO: 80438 - protein, 17 aa, Mycobacterium avium
GPRRLLRGLRMVGRGVL

SEQ ID NO: 80439 - protein, 25 aa, Mycobacterium avium
GPRVKRTLTANGLRQLISFISRMTT

SEQ ID NO: 80440 - protein, 17 aa, Mycobacterium avium
GPSGAGHFVKMVHNGIE

SEQ ID NO: 80441 - protein, 21 aa, Mycobacterium avium
GPTGCGKTYLAQTLAKMLNVP

SEQ ID NO: 80442 - protein, 23 aa, Mycobacterium avium
GPTLMVSDLFDFGIYVDARIEDI

SEQ ID NO: 80443 - protein, 18 aa, Mycobacterium avium
GPVDRPWRERTLHIADPD

SEQ ID NO: 80444 - protein, 17 aa, Mycobacterium avium
GPWTGPSSIAMAAAAAP

SEQ ID NO: 80445 - protein, 18 aa, Mycobacterium avium
GPYEVLRNLPGAEVRFVW

SEQ ID NO: 80446 - protein, 20 aa, Mycobacterium avium
GQAAAGIRRSGRWRGRPKNQ

SEQ ID NO: 80447 - protein, 23 aa, Mycobacterium avium
GQAAETFAILNLASAGDHIVSSP

SEQ ID NO: 80448 - protein, 20 aa, Mycobacterium avium
GQAAHVWTRTSLRPSDVDVA

SEQ ID NO: 80449 - protein, 17 aa, Mycobacterium avium
GQANSWQSLPGIGPKTA

SEQ ID NO: 80450 - protein, 19 aa, Mycobacterium avium
GQAVGGAFVRLLDSSDEFT

SEQ ID NO: 80451 - protein, 25 aa, Mycobacterium avium
GQCPPRQFERARVVVFAGDHGVARC

SEQ ID NO: 80452 - protein, 22 aa, Mycobacterium avium
GQDWGGLIGLRLAAEHPERFAR

SEQ ID NO: 80453 - protein, 24 aa, Mycobacterium avium
GQGCAITTRLLVPRDRYDEAVAAA

SEQ ID NO: 80454 - protein, 25 aa, Mycobacterium avium
GQGLMKNAYVGRTFIQPSQTIRQLG

SEQ ID NO: 80455 - protein, 17 aa, Mycobacterium avium
GQIAGLNVLRIVNEPTA

SEQ ID NO: 80456 - protein, 21 aa, Mycobacterium avium
GQIAQCLAELVTLDTPTVSVL

SEQ ID NO: 80457 - protein, 17 aa, Mycobacterium avium
GQIHDFQLAAPMVPEAR

SEQ ID NO: 80458 - protein, 23 aa, Mycobacterium avium
GQPRVSPLAYFRIDGKLLVIGSF

SEQ ID NO: 80459 - protein, 19 aa, Mycobacterium avium
GQPVPDWFCESADLAELAA

SEQ ID NO: 80460 - protein, 24 aa, Mycobacterium avium
GQQDSRYPLAPARVVADTRAALGR

SEQ ID NO: 80461 - protein, 22 aa, Mycobacterium avium
GQRRFWFMWDDLVRGAIGAVVL

SEQ ID NO: 80462 - protein, 24 aa, Mycobacterium avium
GQVAQRYAAVYGYDERAMAKIVVD

SEQ ID NO: 80463 - protein, 27 aa, Mycobacterium avium
GQVLKEIQSRLGFLLDVGLEYLSLSRA

SEQ ID NO: 80464 - protein, 17 aa, Mycobacterium avium
GQYTQFWQNLIGGATGS

SEQ ID NO: 80465 - protein, 33 aa, Mycobacterium avium
GRAAVLAPRLWVPDEFGLCRYLAAGLAVVHAVD

SEQ ID NO: 80466 - protein, 21 aa, Mycobacterium avium
GRAKIPITVQVGAPLRAREDI

SEQ ID NO: 80467 - protein, 24 aa, Mycobacterium avium
GRAKIVKFSGCYHGHVDALLADAG

SEQ ID NO: 80468 - protein, 18 aa, Mycobacterium avium
GRAMAAGGQAVFELAPQG

SEQ ID NO: 80469 - protein, 19 aa, Mycobacterium avium
GRARWYRNRWVRTAHVCAA

SEQ ID NO: 80470 - protein, 24 aa, Mycobacterium avium
GRAVAVNLLLPFTRRRHVAVCVEA

SEQ ID NO: 80471 - protein, 22 aa, Mycobacterium avium
GRCKRARVALPGGDAIGSRPLD

SEQ ID NO: 80472 - protein, 20 aa, Mycobacterium avium
GRDDLALRIAVQPGGCAGLR

SEQ ID NO: 80473 - protein, 20 aa, Mycobacterium avium
GRDFTVDWVHLKLNDQAQRT

SEQ ID NO: 80474 - protein, 19 aa, Mycobacterium avium
GRDGFALIDVIRDWGDIGI

SEQ ID NO: 80475 - protein, 25 aa, Mycobacterium avium
GRDPDSVRVWSCFATVGDHLPEQLR

SEQ ID NO: 80476 - protein, 20 aa, Mycobacterium avium
GREAYPGDVFYLHSRLLERC

SEQ ID NO: 80477 - protein, 25 aa, Mycobacterium avium
GRELFIEKVWDWKRESGGAIGGQMR

SEQ ID NO: 80478 - protein, 21 aa, Mycobacterium avium
GREQFRPVAPMVLAERAAEIF

SEQ ID NO: 80479 - protein, 18 aa, Mycobacterium avium
GRERGYCLMIGGDEEAFA

SEQ ID NO: 80480 - protein, 18 aa, Mycobacterium avium
GRFELGLGAGSWPAEFAR

SEQ ID NO: 80481 - protein, 19 aa, Mycobacterium avium
GRFTLGLGASGPQVIEGFH

SEQ ID NO: 80482 - protein, 18 aa, Mycobacterium avium
GRGADVWDELHPTADQQV

SEQ ID NO: 80483 - protein, 20 aa, Mycobacterium avium
GRGLSKATLFGPVEVAEHYG

SEQ ID NO: 80484 - protein, 24 aa, Mycobacterium avium
GRGRDAVRILPGLITTIGSSRAEA

SEQ ID NO: 80485 - protein, 24 aa, Mycobacterium avium
GRGVTVGRPLGLLLTRRSENATVT

SEQ ID NO: 80486 - protein, 25 aa, Mycobacterium avium
GRHLAFSGGRHFCLGAALARAEGEV

SEQ ID NO: 80487 - protein, 25 aa, Mycobacterium avium
GRHLLESWIPLLALAAHDRGRDWSA

SEQ ID NO: 80488 - protein, 17 aa, Mycobacterium avium
GRHRGFVVLRWLDNPSP

SEQ ID NO: 80489 - protein, 25 aa, Mycobacterium avium
GRIDRRGRMLWSLPKGHIELGETAE

SEQ ID NO: 80490 - protein, 22 aa, Mycobacterium avium
GRIFAMAVQTAVDWSEAADRGR

SEQ ID NO: 80491 - protein, 30 aa, Mycobacterium avium
GRIGRGEHPSLCLFASWAAPDSPAGRRLTA

SEQ ID NO: 80492 - protein, 27 aa, Mycobacterium avium
GRILGVKGRVLPMCPIALQIEADVSGL

SEQ ID NO: 80493 - protein, 22 aa, Mycobacterium avium
GRILRVRGRGVPKRSGGHGDLL

SEQ ID NO: 80494 - protein, 22 aa, Mycobacterium avium
GRILTAMSVFFFGLVDAPNHLA

SEQ ID NO: 80495 - protein, 24 aa, Mycobacterium avium
GRIPLPVPGFGVWALDSLRRANRY

SEQ ID NO: 80496 - protein, 18 aa, Mycobacterium avium
GRISLRTQVPLLLDEYTR

SEQ ID NO: 80497 - protein, 19 aa, Mycobacterium avium
GRITGVFTPAGIDSCGTLE

SEQ ID NO: 80498 - protein, 24 aa, Mycobacterium avium
GRITLWRDYFDFFDMLKATARGVA

SEQ ID NO: 80499 - protein, 19 aa, Mycobacterium avium
GRLAGRGFAAYGTAKAALS

SEQ ID NO: 80500 - protein, 23 aa, Mycobacterium avium
GRLDPKDLFGWQANASADRLTTP

SEQ ID NO: 80501 - protein, 21 aa, Mycobacterium avium
GRLILADAIVRACEDNPDYLI

SEQ ID NO: 80502 - protein, 17 aa, Mycobacterium avium
GRLILGIGSGWKQKDYD

SEQ ID NO: 80503 - protein, 17 aa, Mycobacterium avium
GRLPHTIRYTAQGLGRV

SEQ ID NO: 80504 - protein, 23 aa, Mycobacterium avium
GRLPKDRLSDMVRRILRSIFAVG

SEQ ID NO: 80505 - protein, 23 aa, Mycobacterium avium
GRLPRAPHALRIPAAENRLDTGG

SEQ ID NO: 80506 - protein, 24 aa, Mycobacterium avium
GRLPRPDGKLAHAAVRINGFMVML

SEQ ID NO: 80507 - protein, 17 aa, Mycobacterium avium
GRLVGGVGADWAYATGW

SEQ ID NO: 80508 - protein, 20 aa, Mycobacterium avium
GRNDIRIEAALAKLWSSEMA

SEQ ID NO: 80509 - protein, 19 aa, Mycobacterium avium
GRNQLRVGMFPAVDPDDVS

SEQ ID NO: 80510 - protein, 18 aa, Mycobacterium avium
GRNVWRTDLAAALDKLTT

SEQ ID NO: 80511 - protein, 22 aa, Mycobacterium avium
GRPDELAGIYLYLASAASSYMT

SEQ ID NO: 80512 - protein, 21 aa, Mycobacterium avium
GRPLFAANLALPWPEDPLAAL

SEQ ID NO: 80513 - protein, 20 aa, Mycobacterium avium
GRPNPDFEVRILDAHGNSLP

SEQ ID NO: 80514 - protein, 25 aa, Mycobacterium avium
GRQARRFVADFGIERFYDVGRHGIC

SEQ ID NO: 80515 - protein, 19 aa, Mycobacterium avium
GRQGRRGRRFRDRRRRGER

SEQ ID NO: 80516 - protein, 20 aa, Mycobacterium avium
GRRIASMIPGARFEVMPGCG

SEQ ID NO: 80517 - protein, 31 aa, Mycobacterium avium
GRRKLLGRREILPGVGLYLDGGFGVGKTHLL

SEQ ID NO: 80518 - protein, 19 aa, Mycobacterium avium
GRRLAEPGPYSMLEVLAPT

SEQ ID NO: 80519 - protein, 25 aa, Mycobacterium avium
GRRLRRAIPKYGFRPVVMPRPPAAG

SEQ ID NO: 80520 - protein, 25 aa, Mycobacterium avium
GRRRPDIAVTILRLANMIGPAMDTT

SEQ ID NO: 80521 - protein, 24 aa, Mycobacterium avium
GRRRVAMLRDWLDAELAEASENIL

SEQ ID NO: 80522 - protein, 23 aa, Mycobacterium avium
GRRSAESLYDFNLATYDEGDSFD

SEQ ID NO: 80523 - protein, 23 aa, Mycobacterium avium
GRSELRLAAEAVLDALDDAGLSP

SEQ ID NO: 80524 - protein, 29 aa, Mycobacterium avium
GRSGEPFPYPVTVGYMYIMKLHHLVDDKI

SEQ ID NO: 80525 - protein, 17 aa, Mycobacterium avium
GRSGGKRVLVRDIHEYT

SEQ ID NO: 80526 - protein, 24 aa, Mycobacterium avium
GRSGRLRWRWLAGCDARPVDSAGH

SEQ ID NO: 80527 - protein, 22 aa, Mycobacterium avium
GRTRDVEWRKRQLLQLQKLMEE

SEQ ID NO: 80528 - protein, 27 aa, Mycobacterium avium
GRVERMHRACLILTFGGGTNEVQRDII

SEQ ID NO: 80529 - protein, 17 aa, Mycobacterium avium
GRVGVCAATSGPGAIHL

SEQ ID NO: 80530 - protein, 20 aa, Mycobacterium avium
GRVKQMLLKIGWPAEDLAGY

SEQ ID NO: 80531 - protein, 23 aa, Mycobacterium avium
GRVNGRPGLLLGTRDAEQTHVSL

SEQ ID NO: 80532 - protein, 18 aa, Mycobacterium avium
GRVSFSRTANDWATLLDG

SEQ ID NO: 80533 - protein, 24 aa, Mycobacterium avium
GRYDEPRKGMAVLLDALPRLVERF

SEQ ID NO: 80534 - protein, 22 aa, Mycobacterium avium
GRYLGCVPLQRLLREAPAELVG

SEQ ID NO: 80535 - protein, 24 aa, Mycobacterium avium
GRYPDKRSALLPLLHLVQSQDSYL

SEQ ID NO: 80536 - protein, 20 aa, Mycobacterium avium
GSAIAQHWMYDGKHVLIVFD

SEQ ID NO: 80537 - protein, 19 aa, Mycobacterium avium
GSALLSDIHRSDCQILLVD

SEQ ID NO: 80538 - protein, 23 aa, Mycobacterium avium
GSAVKLPGGLWIVTERGVATESG

SEQ ID NO: 80539 - protein, 21 aa, Mycobacterium avium
GSCSWKIYVKDGIITWETQQT

SEQ ID NO: 80540 - protein, 20 aa, Mycobacterium avium
GSCVPLLKQLLEAEGVEQSK

SEQ ID NO: 80541 - protein, 26 aa, Mycobacterium avium
GSDGQWRLSPKAMRRLGETALRDVAQ

SEQ ID NO: 80542 - protein, 21 aa, Mycobacterium avium
GSDSLLRMRLDLEECATGVTK

SEQ ID NO: 80543 - protein, 19 aa, Mycobacterium avium
GSEGWRRYVALVVDAISVD

SEQ ID NO: 80544 - protein, 19 aa, Mycobacterium avium
GSFAGAPVSPAWVHNLRAN

SEQ ID NO: 80545 - protein, 17 aa, Mycobacterium avium
GSGARIMTTLLYHMRDK

SEQ ID NO: 80546 - protein, 17 aa, Mycobacterium avium
GSGELTLEDFLEQMLAI

SEQ ID NO: 80547 - protein, 32 aa, Mycobacterium avium
GSGFAIAQARLGPGRIHHCMRALGGAERALAL

SEQ ID NO: 80548 - protein, 24 aa, Mycobacterium avium
GSGGPPRWDLRVLTSIEVSATAAE

SEQ ID NO: 80549 - protein, 21 aa, Mycobacterium avium
GSGKGSPEWWVVNVKPGRVLF

SEQ ID NO: 80550 - protein, 25 aa, Mycobacterium avium
GSHRLGHACVLAFLDVDGLKQVNDE

SEQ ID NO: 80551 - protein, 23 aa, Mycobacterium avium
GSIASESLVGWANSVGVDGRDPY

SEQ ID NO: 80552 - protein, 27 aa, Mycobacterium avium
GSITYNEWSFAVGKQLSMASIITSAGP

SEQ ID NO: 80553 - protein, 24 aa, Mycobacterium avium
GSLGHERVMLWMGYVDLLHELSAD

SEQ ID NO: 80554 - protein, 18 aa, Mycobacterium avium
GSLGMLFDTVLGLTASVL

SEQ ID NO: 80555 - protein, 20 aa, Mycobacterium avium
GSLLLPPWVLTRYGPDGVEM

SEQ ID NO: 80556 - protein, 23 aa, Mycobacterium avium
GSLRLKRGMAAWVAADDAPIRLV

SEQ ID NO: 80557 - protein, 19 aa, Mycobacterium avium
GSMGGARALEWIVGHPSRV

SEQ ID NO: 80558 - protein, 18 aa, Mycobacterium avium
GSMGKAALVGSMSVPQGW

SEQ ID NO: 80559 - protein, 21 aa, Mycobacterium avium
GSPEHARLFGLPVTGPAHPTP

SEQ ID NO: 80560 - protein, 23 aa, Mycobacterium avium
GSPFWLRTARTLSFDPLTDVHTF

SEQ ID NO: 80561 - protein, 19 aa, Mycobacterium avium
GSPGAFQGSFSYLLQDEDG

SEQ ID NO: 80562 - protein, 17 aa, Mycobacterium avium
GSPVCPECKQIYDRLKK

SEQ ID NO: 80563 - protein, 24 aa, Mycobacterium avium
GSRMAGFAAAFGMEVIAWSQNLTD

SEQ ID NO: 80564 - protein, 25 aa, Mycobacterium avium
GSSDLRRWLPLDIGRPFKSTLITLD

SEQ ID NO: 80565 - protein, 19 aa, Mycobacterium avium
GSSIMPGKVNPVIPEAVTQ

SEQ ID NO: 80566 - protein, 23 aa, Mycobacterium avium
GSSPMCYPVGDFLVGDRDVLLGV

SEQ ID NO: 80567 - protein, 22 aa, Mycobacterium avium
GSSRPPRLVRLIHRGSRLAKKS

SEQ ID NO: 80568 - protein, 24 aa, Mycobacterium avium
GSTGERGLHHLIWEVVDNSVDEAM

SEQ ID NO: 80569 - protein, 20 aa, Mycobacterium avium
GSTPKALRLYGIEDSAYSSE

SEQ ID NO: 80570 - protein, 18 aa, Mycobacterium avium
GSTPTASGKTVWAIIGPE

SEQ ID NO: 80571 - protein, 17 aa, Mycobacterium avium
GSTPWLVHGYQAIRALF

SEQ ID NO: 80572 - protein, 22 aa, Mycobacterium avium
GSTWVLSLSAGRLVAADHIGGA

SEQ ID NO: 80573 - protein, 25 aa, Mycobacterium avium
GSVARLRFGPATHRKVKKWLVDGDF

SEQ ID NO: 80574 - protein, 22 aa, Mycobacterium avium
GSVCWYAPELGVVFSGDTLFSG

SEQ ID NO: 80575 - protein, 18 aa, Mycobacterium avium
GSVKRFTALLSNAETIFW

SEQ ID NO: 80576 - protein, 18 aa, Mycobacterium avium
GSYCGKLLLDAGAQVRKI

SEQ ID NO: 80577 - protein, 18 aa, Mycobacterium avium
GTAELLGAMSAALKPAPA

SEQ ID NO: 80578 - protein, 23 aa, Mycobacterium avium
GTALTEGITWGWETYPEYLDAIG

SEQ ID NO: 80579 - protein, 18 aa, Mycobacterium avium
GTALWLESAVEQLIPAGD

SEQ ID NO: 80580 - protein, 25 aa, Mycobacterium avium
GTAQEKASVLSFVLAGHEPLEVGKA

SEQ ID NO: 80581 - protein, 18 aa, Mycobacterium avium
GTARRLRVGAVGLIRSWR

SEQ ID NO: 80582 - protein, 29 aa, Mycobacterium avium
GTCAEELQARLRLAIGRRRGGLDGTLKFG

SEQ ID NO: 80583 - protein, 29 aa, Mycobacterium avium
GTDEQKKWAVMAAERGWGSTMVLTEPDAG

SEQ ID NO: 80584 - protein, 20 aa, Mycobacterium avium
GTDHCDWIILGAMLGDEQGV

SEQ ID NO: 80585 - protein, 19 aa, Mycobacterium avium
GTEQWLIELMEGVEDIPGT

SEQ ID NO: 80586 - protein, 24 aa, Mycobacterium avium
GTESGYRAGLLASIAASCTASYTV

SEQ ID NO: 80587 - protein, 24 aa, Mycobacterium avium
GTGEFLCVYWPSRGQEAIAAAMGV

SEQ ID NO: 80588 - protein, 17 aa, Mycobacterium avium
GTGGFGDKGYWAITKHK

SEQ ID NO: 80589 - protein, 22 aa, Mycobacterium avium
GTGKRLTTAVLDISVEGDVIAA

SEQ ID NO: 80590 - protein, 19 aa, Mycobacterium avium
GTGRWASIIPQTWIHSLRP

SEQ ID NO: 80591 - protein, 18 aa, Mycobacterium avium
GTGTSGYQAADWLREHAR

SEQ ID NO: 80592 - protein, 17 aa, Mycobacterium avium
GTHPGALAEQWAGLERL

SEQ ID NO: 80593 - protein, 28 aa, Mycobacterium avium
GTHRLLQTGVRWKDLGLVVVDEEQRFGV

SEQ ID NO: 80594 - protein, 19 aa, Mycobacterium avium
GTINLCIISPTGLIRDTFE

SEQ ID NO: 80595 - protein, 19 aa, Mycobacterium avium
GTIRGDFGLETQFNLVHGS

SEQ ID NO: 80596 - protein, 17 aa, Mycobacterium avium
GTITPFAMIQLADRGQF

SEQ ID NO: 80597 - protein, 25 aa, Mycobacterium avium
GTKGKRYALPHARILMHQPLGGVTG

SEQ ID NO: 80598 - protein, 20 aa, Mycobacterium avium
GTKVPGWARPLATAEPEDVA

SEQ ID NO: 80599 - protein, 18 aa, Mycobacterium avium
GTLDLFYPECLEYARRLR

SEQ ID NO: 80600 - protein, 19 aa, Mycobacterium avium
GTLPLLAPMSEVAGRLSAQ

SEQ ID NO: 80601 - protein, 23 aa, Mycobacterium avium
GTMTRGPWGAAMGGQIVGGLLGW

SEQ ID NO: 80602 - protein, 40 aa, Mycobacterium avium
GTPEEPRGVPVFAWKGETLEEYWWAAEQALTWPPLADGTE

SEQ ID NO: 80603 - protein, 30 aa, Mycobacterium avium
GTPEQKQRWAVPILRAEMTASLGMSEPGAG

SEQ ID NO: 80604 - protein, 22 aa, Mycobacterium avium
GTPIPSCARGTLKRVEAALADA

SEQ ID NO: 80605 - protein, 17 aa, Mycobacterium avium
GTPSIFQETAFRFTDGS

SEQ ID NO: 80606 - protein, 28 aa, Mycobacterium avium
GTPVDLRYLGSLTHGFANLFQLGGDSMV

SEQ ID NO: 80607 - protein, 20 aa, Mycobacterium avium
GTPWRARQAGVLLAGDVNGL

SEQ ID NO: 80608 - protein, 21 aa, Mycobacterium avium
GTQKRLAVWLVDDPARVPGIA

SEQ ID NO: 80609 - protein, 20 aa, Mycobacterium avium
GTRSAWDYGPLGVEFKENIK

SEQ ID NO: 80610 - protein, 19 aa, Mycobacterium avium
GTSGMRKNELIAAIKEVRG

SEQ ID NO: 80611 - protein, 19 aa, Mycobacterium avium
GTTMKRAVERFDVNVIGLT

SEQ ID NO: 80612 - protein, 18 aa, Mycobacterium avium
GTVAFAWGGLSHVPLTRS

SEQ ID NO: 80613 - protein, 25 aa, Mycobacterium avium
GTVAKWKLQATKSRVRDVQVDVDVA

SEQ ID NO: 80614 - protein, 20 aa, Mycobacterium avium
GTVFAPRVLREYALLADGER

SEQ ID NO: 80615 - protein, 17 aa, Mycobacterium avium
GTVKQLPEELAREAHDW

SEQ ID NO: 80616 - protein, 17 aa, Mycobacterium avium
GTVLVEWLNVSGGIDAA

SEQ ID NO: 80617 - protein, 27 aa, Mycobacterium avium
GTVRNWPWRRWALSWTANTYARLALGI

SEQ ID NO: 80618 - protein, 19 aa, Mycobacterium avium
GTYCGKSTLFLGAAAQQTG

SEQ ID NO: 80619 - protein, 25 aa, Mycobacterium avium
GTYYKGHLYIAGRIKDLVIIDGRNH

SEQ ID NO: 80620 - protein, 20 aa, Mycobacterium avium
GVAELARRFGVRVVSDEIHA

SEQ ID NO: 80621 - protein, 20 aa, Mycobacterium avium
GVALSLVYRDGRLERAATRG

SEQ ID NO: 80622 - protein, 19 aa, Mycobacterium avium
GVCAARIVLVGARTRDGEL

SEQ ID NO: 80623 - protein, 26 aa, Mycobacterium avium
GVDAKWAASISGYWRRGRTEETFRQW

SEQ ID NO: 80624 - protein, 23 aa, Mycobacterium avium
GVDEARALYEWNHAKQILRIQAG

SEQ ID NO: 80625 - protein, 24 aa, Mycobacterium avium
GVDGFPNLFLVSGPGAPAVLANMV

SEQ ID NO: 80626 - protein, 19 aa, Mycobacterium avium
GVEARRFWRDEYQLNAQIS

SEQ ID NO: 80627 - protein, 23 aa, Mycobacterium avium
GVEEARKGFFRVPLIRGTITHPV

SEQ ID NO: 80628 - protein, 20 aa, Mycobacterium avium
GVEVHWVYRGGRADLVPEDR

SEQ ID NO: 80629 - protein, 18 aa, Mycobacterium avium
GVEWKDIQAATGGSWTVA

SEQ ID NO: 80630 - protein, 17 aa, Mycobacterium avium
GVFRGALEAGARRITEK

SEQ ID NO: 80631 - protein, 24 aa, Mycobacterium avium
GVGDAFRAGFLTGRSAGLNLERSA

SEQ ID NO: 80632 - protein, 33 aa, Mycobacterium avium
GVGDRVGIAWLRHTCGVCKYCRRGDENLCPESR

SEQ ID NO: 80633 - protein, 25 aa, Mycobacterium avium
GVGEIWRRIRAANLPVALSDRLTLD

SEQ ID NO: 80634 - protein, 19 aa, Mycobacterium avium
GVGKWNLDLGDLVPALSVR

SEQ ID NO: 80635 - protein, 22 aa, Mycobacterium avium
GVGRPQFSAVVECASAARELGG

SEQ ID NO: 80636 - protein, 26 aa, Mycobacterium avium
GVGTFSWPGAYGTWWQADPTAELILI

SEQ ID NO: 80637 - protein, 17 aa, Mycobacterium avium
GVGTLVMTHYVPALVAG

SEQ ID NO: 80638 - protein, 18 aa, Mycobacterium avium
GVHPNGADAWALQDVMAL

SEQ ID NO: 80639 - protein, 17 aa, Mycobacterium avium
GVHRVQRVPVTESQGRV

SEQ ID NO: 80640 - protein, 17 aa, Mycobacterium avium
GVIGPRTRMRWEQVADW

SEQ ID NO: 80641 - protein, 24 aa, Mycobacterium avium
GVIKPGHVAAVRFTINGVYRGETR

SEQ ID NO: 80642 - protein, 23 aa, Mycobacterium avium
GVIWGIDSFDQWGVELGKTQAKA

SEQ ID NO: 80643 - protein, 35 aa, Mycobacterium avium
GVKFKDAELLGVPWIVVVGRGWADGVVELRDRFAG

SEQ ID NO: 80644 - protein, 20 aa, Mycobacterium avium
GVKNYPAYFGFLKSKLRTGG

SEQ ID NO: 80645 - protein, 25 aa, Mycobacterium avium
GVLAGQARFTPQLTLAYRDAVAVVD

SEQ ID NO: 80646 - protein, 17 aa, Mycobacterium avium
GVLDRLGVRSVDLVAHD

SEQ ID NO: 80647 - protein, 38 aa, Mycobacterium avium
GVLERGLLLRLRFELDHHINLRPGRLYPGVSSPLAGNP

SEQ ID NO: 80648 - protein, 23 aa, Mycobacterium avium
GVLPERLHRCLVSSPEFAENLAR

SEQ ID NO: 80649 - protein, 20 aa, Mycobacterium avium
GVLRRLAAMRSYMRDINLGR

SEQ ID NO: 80650 - protein, 17 aa, Mycobacterium avium
GVNEVMREMIAAAGLKV

SEQ ID NO: 80651 - protein, 25 aa, Mycobacterium avium
GVPAQRLTATVLRFNGFAAAGVDED

SEQ ID NO: 80652 - protein, 17 aa, Mycobacterium avium
GVPDGRGLALFISGDNL

SEQ ID NO: 80653 - protein, 18 aa, Mycobacterium avium
GVPLIEIVTKPIVGAGER

SEQ ID NO: 80654 - protein, 22 aa, Mycobacterium avium
GVPPERIDTIISFEKAAEVGAK

SEQ ID NO: 80655 - protein, 19 aa, Mycobacterium avium
GVPVPRYAEINSLDELDAF

SEQ ID NO: 80656 - protein, 25 aa, Mycobacterium avium
GVRACGICGSDLHFAAHGAQVLQMS

SEQ ID NO: 80657 - protein, 24 aa, Mycobacterium avium
GVRDELPHSLAVVIDEVNPREDRD

SEQ ID NO: 80658 - protein, 21 aa, Mycobacterium avium
GVRLSRSFGARGWSPHTYYFA

SEQ ID NO: 80659 - protein, 20 aa, Mycobacterium avium
GVSALRLVQRAFTPDPDDDE

SEQ ID NO: 80660 - protein, 25 aa, Mycobacterium avium
GVSSRFKAPFVFTGGTIARVTLDLS

SEQ ID NO: 80661 - protein, 29 aa, Mycobacterium avium
GVTAPAGFRAAGIAAGIKASGKRDLALVF

SEQ ID NO: 80662 - protein, 23 aa, Mycobacterium avium
GVTKSGLSIREWLISLREAGLDT

SEQ ID NO: 80663 - protein, 17 aa, Mycobacterium avium
GVTRGSFYWHFEDIDNY

SEQ ID NO: 80664 - protein, 28 aa, Mycobacterium avium
GVTSCLSCADLHRRDRDAAWPVICAQLR

SEQ ID NO: 80665 - protein, 20 aa, Mycobacterium avium
GVVARQLWRDSGCKPQDIQT

SEQ ID NO: 80666 - protein, 17 aa, Mycobacterium avium
GVVDARFVAVPLANSLR

SEQ ID NO: 80667 - protein, 20 aa, Mycobacterium avium
GVVEKLGPMARMLKAVLHDT

SEQ ID NO: 80668 - protein, 17 aa, Mycobacterium avium
GVVENMSGLTLPDGSTL

SEQ ID NO: 80669 - protein, 24 aa, Mycobacterium avium
GVVGDAVAVFPSWETLPHERLSPG

SEQ ID NO: 80670 - protein, 25 aa, Mycobacterium avium
GVVGRRAADCAFAHAGLRRDDVDVL

SEQ ID NO: 80671 - protein, 19 aa, Mycobacterium avium
GVVMARYILELEPFASLPP

SEQ ID NO: 80672 - protein, 23 aa, Mycobacterium avium
GVVMTDGLPWTWETFPEYLDTLE

SEQ ID NO: 80673 - protein, 27 aa, Mycobacterium avium
GVWISKLFPQRMFKKVNQLRAFEGYND

SEQ ID NO: 80674 - protein, 22 aa, Mycobacterium avium
GVYRFLLKRNRRLYGVAYTLDN

SEQ ID NO: 80675 - protein, 20 aa, Mycobacterium avium
GWADGVVELRDRFAGQTREL

SEQ ID NO: 80676 - protein, 21 aa, Mycobacterium avium
GWAGVRWRNLTGGIVALHAAH

SEQ ID NO: 80677 - protein, 23 aa, Mycobacterium avium
GWDQRAPIGWNMKDPTPVAKTVC

SEQ ID NO: 80678 - protein, 19 aa, Mycobacterium avium
GWHDARVIPYGPIELDPSA

SEQ ID NO: 80679 - protein, 24 aa, Mycobacterium avium
GWHKICVERGILPGMQELVRRIGD

SEQ ID NO: 80680 - protein, 17 aa, Mycobacterium avium
GWLRGPDGLRFLTGNLV

SEQ ID NO: 80681 - protein, 24 aa, Mycobacterium avium
GWSAYPRVLDFAAFASIADEVGAK

SEQ ID NO: 80682 - protein, 19 aa, Mycobacterium avium
GWVGINCLTGQHWLDVCAM

SEQ ID NO: 80683 - protein, 25 aa, Mycobacterium avium
GYAIPQQWGGLGLNLMQDVELAMEL

SEQ ID NO: 80684 - protein, 20 aa, Mycobacterium avium
GYCRHMGGDLSRGEVKGNEI

SEQ ID NO: 80685 - protein, 27 aa, Mycobacterium avium
GYDESLWRLLCEQVGAAALVIPEELGG

SEQ ID NO: 80686 - protein, 38 aa, Mycobacterium avium
GYFRPDLDVDLVYRFIRDTTWVSVRWYQPGGPLTAEQV

SEQ ID NO: 80687 - protein, 24 aa, Mycobacterium avium
GYIEARPAITLSWIRELPSLGAAA

SEQ ID NO: 80688 - protein, 20 aa, Mycobacterium avium
GYLEREWKPEAEGGFSRVQR

SEQ ID NO: 80689 - protein, 18 aa, Mycobacterium avium
GYMAKIFNDAWMSSYGFL

SEQ ID NO: 80690 - protein, 25 aa, Mycobacterium avium
GYQVPEFRRKAVMIAVGGVYDPRIH

SEQ ID NO: 80691 - protein, 23 aa, Mycobacterium avium
GYRVLCPDLRGAGWSSAPRSSYR

SEQ ID NO: 80692 - protein, 18 aa, Mycobacterium avium
GYTPRPADVADLIGALHR

SEQ ID NO: 80693 - protein, 20 aa, Mycobacterium avium
GYTRLSWAVLNWNTDAIALY

SEQ ID NO: 80694 - protein, 18 aa, Mycobacterium avium
GYVRLCVMAPRQWHGLRR

SEQ ID NO: 80695 - protein, 24 aa, Mycobacterium avium
GYYQIRGGIPYAIAKSLAAAPFAD

SEQ ID NO: 80696 - protein, 24 aa, Mycobacterium avium
HAAEGFPSLSCIVLNGGFALHPSI

SEQ ID NO: 80697 - protein, 19 aa, Mycobacterium avium
HAAERGEPVILVRDHTRPE

SEQ ID NO: 80698 - protein, 19 aa, Mycobacterium avium
HAAEVLALLGPNGAGKTTT

SEQ ID NO: 80699 - protein, 17 aa, Mycobacterium avium
HAAFGREDYWLARIAPA

SEQ ID NO: 80700 - protein, 17 aa, Mycobacterium avium
HAAVAPHLGVNALDAVT

SEQ ID NO: 80701 - protein, 19 aa, Mycobacterium avium
HAAVFPACRAVVHHGGSGT

SEQ ID NO: 80702 - protein, 18 aa, Mycobacterium avium
HAAVRINGFMVMLNDDFP

SEQ ID NO: 80703 - protein, 26 aa, Mycobacterium avium
HADAFPLLITHGWPGSIVEFHKVIEP

SEQ ID NO: 80704 - protein, 17 aa, Mycobacterium avium
HADCAKVGITSIRRDLP

SEQ ID NO: 80705 - protein, 24 aa, Mycobacterium avium
HADDPRLRRMAVFDVLVNNADRKG

SEQ ID NO: 80706 - protein, 27 aa, Mycobacterium avium
HADHCLDLPGLFVWRRYHPTRPLGKAM

SEQ ID NO: 80707 - protein, 21 aa, Mycobacterium avium
HAEHIRYSFELAQRANEQGAL

SEQ ID NO: 80708 - protein, 25 aa, Mycobacterium avium
HAGGLPRPLMVVTMGLPASGKTTLA

SEQ ID NO: 80709 - protein, 24 aa, Mycobacterium avium
HAGHIPGAIKLDWRSDLQDPVKRD

SEQ ID NO: 80710 - protein, 23 aa, Mycobacterium avium
HAGRGRPAKRYRLTSAGRAKLDH

SEQ ID NO: 80711 - protein, 26 aa, Mycobacterium avium
HAKAEVLKLINWELASSDGHALGPAD

SEQ ID NO: 80712 - protein, 17 aa, Mycobacterium avium
HAKEQKAKVLAICNTNG

SEQ ID NO: 80713 - protein, 18 aa, Mycobacterium avium
HALALLLAAAREIPAADA

SEQ ID NO: 80714 - protein, 22 aa, Mycobacterium avium
HALAQGADWVWLADDDGRPQDA

SEQ ID NO: 80715 - protein, 20 aa, Mycobacterium avium
HALDGIKRPLIVFTPKSMLR

SEQ ID NO: 80716 - protein, 29 aa, Mycobacterium avium
HAMLTAAGRRSLLCGNIGSPVLDVLDQPA

SEQ ID NO: 80717 - protein, 29 aa, Mycobacterium avium
HAMSPLDFLARPSAWLRLISDVRATHTPV

SEQ ID NO: 80718 - protein, 22 aa, Mycobacterium avium
HANRGKRSIGLDISVPEGKEVL

SEQ ID NO: 80719 - protein, 20 aa, Mycobacterium avium
HAPRTATEWDARRDGPPLLV

SEQ ID NO: 80720 - protein, 22 aa, Mycobacterium avium
HASRDWKAFEPLIGHARSDAVR

SEQ ID NO: 80721 - protein, 25 aa, Mycobacterium avium
HAVARLRTVRDLELRLVAKVEPNGP

SEQ ID NO: 80722 - protein, 24 aa, Mycobacterium avium
HAVDPRPSVDLGLLADELDAEALR

SEQ ID NO: 80723 - protein, 23 aa, Mycobacterium avium
HAVQQRMAKMLARAVDEVAEMQA

SEQ ID NO: 80724 - protein, 18 aa, Mycobacterium avium
HCDVWEGFVFVNFAKTPE

SEQ ID NO: 80725 - protein, 25 aa, Mycobacterium avium
HCFGCGEGGDVYAFLQKIEHVSFVE

SEQ ID NO: 80726 - protein, 17 aa, Mycobacterium avium
HCGPSGAGHFVKMVHNG

SEQ ID NO: 80727 - protein, 25 aa, Mycobacterium avium
HDAHLYLRRAHAIGRFLGGAERWLR

SEQ ID NO: 80728 - protein, 18 aa, Mycobacterium avium
HDALDPFVALGFAAATTS

SEQ ID NO: 80729 - protein, 24 aa, Mycobacterium avium
HDAYQWLRLRGYQPDQIVLAGDSA

SEQ ID NO: 80730 - protein, 25 aa, Mycobacterium avium
HDDGPRPTLCVIHGFLGSSYLANGR

SEQ ID NO: 80731 - protein, 23 aa, Mycobacterium avium
HDEGWLAEHMLILKLISPENKAY

SEQ ID NO: 80732 - protein, 18 aa, Mycobacterium avium
HDELPFQTLMTGYGLTEA

SEQ ID NO: 80733 - protein, 17 aa, Mycobacterium avium
HDGPQILLCIQGCTTVH

SEQ ID NO: 80734 - protein, 27 aa, Mycobacterium avium
HDHERIAPLIADWADDLGRPIDVALQE

SEQ ID NO: 80735 - protein, 19 aa, Mycobacterium avium
HDHHSRRGLLLLVGRRRRL

SEQ ID NO: 80736 - protein, 18 aa, Mycobacterium avium
HDLDVWSLTDLVAYSTGA

SEQ ID NO: 80737 - protein, 18 aa, Mycobacterium avium
HDPLVMRRALEYATGLGV

SEQ ID NO: 80738 - protein, 23 aa, Mycobacterium avium
HDPPCRRARITLLQPTRNAKSNY

SEQ ID NO: 80739 - protein, 21 aa, Mycobacterium avium
HDQLWRLASLRDARVPVALST

SEQ ID NO: 80740 - protein, 23 aa, Mycobacterium avium
HDRLKAELDQLIANRPVIAAEIN

SEQ ID NO: 80741 - protein, 26 aa, Mycobacterium avium
HDRMPLVMPERDWDRWLDPDAPVDEE

SEQ ID NO: 80742 - protein, 25 aa, Mycobacterium avium
HDTVDLRRSYPFYGQPHQGGIDTPP

SEQ ID NO: 80743 - protein, 26 aa, Mycobacterium avium
HDVFHIDRGYPLFVENLAILGAEIER

SEQ ID NO: 80744 - protein, 20 aa, Mycobacterium avium
HDVPAKGWLVGEVHNGIAQM

SEQ ID NO: 80745 - protein, 23 aa, Mycobacterium avium
HDYDLSSLFLLASTAALFSPSIK

SEQ ID NO: 80746 - protein, 26 aa, Mycobacterium avium
HEADEKFWLGVGLTRSEAYVMIASGS

SEQ ID NO: 80747 - protein, 25 aa, Mycobacterium avium
HEDLKRFFDGFPRNAHPMPVLSSAV

SEQ ID NO: 80748 - protein, 19 aa, Mycobacterium avium
HEGKPFFASLLEFITSGPV

SEQ ID NO: 80749 - protein, 32 aa, Mycobacterium avium
HELLKPFTPRYFEAIPGVWARRSSEVAQTVVV

SEQ ID NO: 80750 - protein, 20 aa, Mycobacterium avium
HELLPYSDLDLMLLHDNKSD

SEQ ID NO: 80751 - protein, 26 aa, Mycobacterium avium
HELSADFRPADALQRDRYATLVMDAH

SEQ ID NO: 80752 - protein, 19 aa, Mycobacterium avium
HERGIRVITDLVMNHTSES

SEQ ID NO: 80753 - protein, 20 aa, Mycobacterium avium
HGALPPRRAVLAADVDDLTY

SEQ ID NO: 80754 - protein, 27 aa, Mycobacterium avium
HGAPSEQARAWWGNFLVQKANEANIGL

SEQ ID NO: 80755 - protein, 17 aa, Mycobacterium avium
HGARKGLADTALRTADS

SEQ ID NO: 80756 - protein, 21 aa, Mycobacterium avium
HGEFRAIGYTSIYEEVEHVAL

SEQ ID NO: 80757 - protein, 24 aa, Mycobacterium avium
HGEPARLAAIVDWEMTTVGDPLLD

SEQ ID NO: 80758 - protein, 19 aa, Mycobacterium avium
HGEPSWSYLYRKMIPVLAG

SEQ ID NO: 80759 - protein, 20 aa, Mycobacterium avium
HGESGKVIGIRVFSREDDDE

SEQ ID NO: 80760 - protein, 23 aa, Mycobacterium avium
HGFDRGCAFPHGGHLINLHVAAG

SEQ ID NO: 80761 - protein, 27 aa, Mycobacterium avium
HGFRFFPAYYLHIWDLFQRIPVYELRN

SEQ ID NO: 80762 - protein, 26 aa, Mycobacterium avium
HGGGRLGAIARRFARLWRGPRGPEDA

SEQ ID NO: 80763 - protein, 24 aa, Mycobacterium avium
HGGLRYLEQLEFGLVREALYEREL

SEQ ID NO: 80764 - protein, 17 aa, Mycobacterium avium
HGITCAIRAWAYQIDDL

SEQ ID NO: 80765 - protein, 23 aa, Mycobacterium avium
HGKALRAATTFELDDVIDPAASR

SEQ ID NO: 80766 - protein, 19 aa, Mycobacterium avium
HGLDPWVIDFGEPDKVEGG

SEQ ID NO: 80767 - protein, 19 aa, Mycobacterium avium
HGLKVWDRAAGALIAAEAG

SEQ ID NO: 80768 - protein, 18 aa, Mycobacterium avium
HGLPELRAIFGELLGIPV

SEQ ID NO: 80769 - protein, 21 aa, Mycobacterium avium
HGLSWGFDRIFAASANHSIWF

SEQ ID NO: 80770 - protein, 18 aa, Mycobacterium avium
HGNLEWLPGKTLGLSAGC

SEQ ID NO: 80771 - protein, 26 aa, Mycobacterium avium
HGRDEIWRFTPLRRLRGLHDGSAPAT

SEQ ID NO: 80772 - protein, 26 aa, Mycobacterium avium
HGRGERLCWWGGPWPVDERWWDDRGQ

SEQ ID NO: 80773 - protein, 20 aa, Mycobacterium avium
HGSLLDRHRPLWEAHLVEGL

SEQ ID NO: 80774 - protein, 24 aa, Mycobacterium avium
HGSSWRAAMRKADTALSEFGVEGV

SEQ ID NO: 80775 - protein, 24 aa, Mycobacterium avium
HGTELRAGEKIMLLFESGNFDESV

SEQ ID NO: 80776 - protein, 20 aa, Mycobacterium avium
HGVGRLKRPWLAGYLGPEVM

SEQ ID NO: 80777 - protein, 21 aa, Mycobacterium avium
HGYCMGGGIYLGLLTDFCVAS

SEQ ID NO: 80778 - protein, 26 aa, Mycobacterium avium
HHAWSADPWTTLPARYGLPLPGRPAP

SEQ ID NO: 80779 - protein, 19 aa, Mycobacterium avium
HHCRLCNSLREGSALDAGG

SEQ ID NO: 80780 - protein, 20 aa, Mycobacterium avium
HHELDWWTSPSRKFDGIPES

SEQ ID NO: 80781 - protein, 19 aa, Mycobacterium avium
HHHELGWFARQALRLFDDL

SEQ ID NO: 80782 - protein, 27 aa, Mycobacterium avium
HHIDKWKFTVPFVCGATNLGEALRRIN

SEQ ID NO: 80783 - protein, 24 aa, Mycobacterium avium
HHLRRFSEHAARGLDMARLNIGVW

SEQ ID NO: 80784 - protein, 22 aa, Mycobacterium avium
HHRAAWRAARLLVLDAFTTAEA

SEQ ID NO: 80785 - protein, 17 aa, Mycobacterium avium
HHTAGGMSRWLPYLSEL

SEQ ID NO: 80786 - protein, 25 aa, Mycobacterium avium
HHVFKEWADRYAGRFDMGYERYREV

SEQ ID NO: 80787 - protein, 18 aa, Mycobacterium avium
HIAGRPVTRKRWPNGVDQ

SEQ ID NO: 80788 - protein, 35 aa, Mycobacterium avium
HIGHVRSGVAFDILRRWLIALGYDVAFIRNVTDID

SEQ ID NO: 80789 - protein, 31 aa, Mycobacterium avium
HILGFPFTEHGLRLGVEAALRNLARVAPTQR

SEQ ID NO: 80790 - protein, 25 aa, Mycobacterium avium
HIMAGKRGGSIVFTSSIGGLRGAEN

SEQ ID NO: 80791 - protein, 18 aa, Mycobacterium avium
HIQIMPQVWAMRYTLERA

SEQ ID NO: 80792 - protein, 25 aa, Mycobacterium avium
HIRPWRVSPPGGRRELDEAIGQIAS

SEQ ID NO: 80793 - protein, 34 aa, Mycobacterium avium
HISTLLLTLLFRFMRPLIEHGHVFLAQPPLYKLK

SEQ ID NO: 80794 - protein, 22 aa, Mycobacterium avium
HKDLRRARAAALNIVPTSTGAA

SEQ ID NO: 80795 - protein, 25 aa, Mycobacterium avium
HKGDFLLHALRLCRPAVIFTDPEHR

SEQ ID NO: 80796 - protein, 18 aa, Mycobacterium avium
HKGIRVVSTPEFLREGRA

SEQ ID NO: 80797 - protein, 22 aa, Mycobacterium avium
HKLSDDEFGFFVILLAVAGNET

SEQ ID NO: 80798 - protein, 18 aa, Mycobacterium avium
HKTFCIPHGGGGPGVGPV

SEQ ID NO: 80799 - protein, 24 aa, Mycobacterium avium
HLAKAGLTCLGWPVEHGGRGLSTA

SEQ ID NO: 80800 - protein, 27 aa, Mycobacterium avium
HLDGSCPDCTRGAFRADRPYQAEVARQ

SEQ ID NO: 80801 - protein, 25 aa, Mycobacterium avium
HLDKKFKRRGVQMLSDGKRTWAVIG

SEQ ID NO: 80802 - protein, 20 aa, Mycobacterium avium
HLELPGHDFAAVLRHAGTNA

SEQ ID NO: 80803 - protein, 17 aa, Mycobacterium avium
HLERMLSLDDVFDTDEL

SEQ ID NO: 80804 - protein, 27 aa, Mycobacterium avium
HLGQGRVALDWLDRVDVIGQTQASSRF

SEQ ID NO: 80805 - protein, 25 aa, Mycobacterium avium
HLHLRRAVVTAALFGGDAPAADVFE

SEQ ID NO: 80806 - protein, 23 aa, Mycobacterium avium
HLIDVKRAIAWVRENIADYGGDP

SEQ ID NO: 80807 - protein, 22 aa, Mycobacterium avium
HLKMEGSWRVGPRVRVDHRARI

SEQ ID NO: 80808 - protein, 23 aa, Mycobacterium avium
HLLMDSRAGYKYGDVTVLDHMAY

SEQ ID NO: 80809 - protein, 22 aa, Mycobacterium avium
HLLRRKLVNAGFTRKRVKEKEP

SEQ ID NO: 80810 - protein, 26 aa, Mycobacterium avium
HLLTHPRLLGALPLLREANRIPASYA

SEQ ID NO: 80811 - protein, 18 aa, Mycobacterium avium
HLMRLKAIAQPWEAAVTG

SEQ ID NO: 80812 - protein, 18 aa, Mycobacterium avium
HLPAEVLDAAAVTINKLW

SEQ ID NO: 80813 - protein, 26 aa, Mycobacterium avium
HLPVFRPPLDMARLFGQPRLGACEDG

SEQ ID NO: 80814 - protein, 18 aa, Mycobacterium avium
HLQVASLDHAMWFMRAFR

SEQ ID NO: 80815 - protein, 31 aa, Mycobacterium avium
HLRASKPLVRLRVPFTLSRYEIDNVERGAND

SEQ ID NO: 80816 - protein, 21 aa, Mycobacterium avium
HLRNMAFYNFALRMLKRTRDA

SEQ ID NO: 80817 - protein, 21 aa, Mycobacterium avium
HLSDGRAAWNMVTSSDAFTGE

SEQ ID NO: 80818 - protein, 19 aa, Mycobacterium avium
HLTKVLCVHRRFRDGEQPL

SEQ ID NO: 80819 - protein, 34 aa, Mycobacterium avium
HLTRAGALRLCPGLKRSALIGGIRYYDTIVDDAR

SEQ ID NO: 80820 - protein, 20 aa, Mycobacterium avium
HLVKSFYRRPLNVGDAGGGA

SEQ ID NO: 80821 - protein, 25 aa, Mycobacterium avium
HMFFHRLGPVLARRLLLTGDIIDAG

SEQ ID NO: 80822 - protein, 24 aa, Mycobacterium avium
HMKEPGRWSGWVRIDGQRVSVDGF

SEQ ID NO: 80823 - protein, 25 aa, Mycobacterium avium
HMTTFGFIMGEVFRRVTGRTIGHYL

SEQ ID NO: 80824 - protein, 30 aa, Mycobacterium avium
HNARFTIHAGEAFGLPSIHEAIAFCGADRL

SEQ ID NO: 80825 - protein, 17 aa, Mycobacterium avium
HNNAVVFAGTWNKTFTR

SEQ ID NO: 80826 - protein, 22 aa, Mycobacterium avium
HNPIAIVVPCHRVIGASGKLTG

SEQ ID NO: 80827 - protein, 17 aa, Mycobacterium avium
HNQELLSGLGLSDADIA

SEQ ID NO: 80828 - protein, 21 aa, Mycobacterium avium
HNRMISWPYTKLMNSNNMVDQ

SEQ ID NO: 80829 - protein, 19 aa, Mycobacterium avium
HPAAMAFDLPAGGNRILQG

SEQ ID NO: 80830 - protein, 19 aa, Mycobacterium avium
HPADRPQVIDGINDMIRRR

SEQ ID NO: 80831 - protein, 19 aa, Mycobacterium avium
HPAHMPRAGLPEEIGPVAA

SEQ ID NO: 80832 - protein, 18 aa, Mycobacterium avium
HPARFVVEATRAFPDDGI

SEQ ID NO: 80833 - protein, 23 aa, Mycobacterium avium
HPDLRCLMLTSFTSDEAMLEAIL

SEQ ID NO: 80834 - protein, 22 aa, Mycobacterium avium
HPDRLRGLLRTVYRLTADGALP

SEQ ID NO: 80835 - protein, 18 aa, Mycobacterium avium
HPEIEGFSITAGNACGAN

SEQ ID NO: 80836 - protein, 17 aa, Mycobacterium avium
HPEPLRRGADRTITGVA

SEQ ID NO: 80837 - protein, 31 aa, Mycobacterium avium
HPESATAWFGDRFGVPLPRGLRERAEAMSWD

SEQ ID NO: 80838 - protein, 22 aa, Mycobacterium avium
HPGPRWLVGDLAELDLPARGIT

SEQ ID NO: 80839 - protein, 24 aa, Mycobacterium avium
HPLGATGLAQCAELTWQLRGTADK

SEQ ID NO: 80840 - protein, 26 aa, Mycobacterium avium
HPMEVGAFPLALARRSLSGSNIGGIA

SEQ ID NO: 80841 - protein, 20 aa, Mycobacterium avium
HPPFRWQRRYAEGFTEQVAT

SEQ ID NO: 80842 - protein, 23 aa, Mycobacterium avium
HPRETLWRPPVLTMSAAQGTGLP

SEQ ID NO: 80843 - protein, 20 aa, Mycobacterium avium
HPYLDTVLFLLGVTRGEIEA

SEQ ID NO: 80844 - protein, 24 aa, Mycobacterium avium
HQACQALRLGECDLALAGGANVLL

SEQ ID NO: 80845 - protein, 19 aa, Mycobacterium avium
HQAGLPPRIEVVGPGQQQQ

SEQ ID NO: 80846 - protein, 24 aa, Mycobacterium avium
HQDADGPAVAWVHTLEYGRLKLPA

SEQ ID NO: 80847 - protein, 17 aa, Mycobacterium avium
HQIGLPYHWGVGGDAVV

SEQ ID NO: 80848 - protein, 23 aa, Mycobacterium avium
HQLWAETRIELFAQSTDTRPEEL

SEQ ID NO: 80849 - protein, 17 aa, Mycobacterium avium
HQPWPGLIEAYRDRLPV

SEQ ID NO: 80850 - protein, 18 aa, Mycobacterium avium
HQRVMLVEVMGRHAGWIA

SEQ ID NO: 80851 - protein, 18 aa, Mycobacterium avium
HRALWHLIFSGALDRHPD

SEQ ID NO: 80852 - protein, 24 aa, Mycobacterium avium
HRDLRLLAADMVFDLPVVGEAARK

SEQ ID NO: 80853 - protein, 18 aa, Mycobacterium avium
HRDMEIVTWVLAGALAHQ

SEQ ID NO: 80854 - protein, 26 aa, Mycobacterium avium
HRHLFSVLMDREWKHGVAAAVDVTLL

SEQ ID NO: 80855 - protein, 17 aa, Mycobacterium avium
HRHMRSLLNKAFTPRAI

SEQ ID NO: 80856 - protein, 25 aa, Mycobacterium avium
HRHRGCAIPGCGATRGLHAHHLRHW

SEQ ID NO: 80857 - protein, 24 aa, Mycobacterium avium
HRLLRRYRLELARPGYQPRWDYGG

SEQ ID NO: 80858 - protein, 18 aa, Mycobacterium avium
HRQLFLVLHDEIDRGVIA

SEQ ID NO: 80859 - protein, 24 aa, Mycobacterium avium
HRRLLSVLMDPAWTPGVAAAVDAT

SEQ ID NO: 80860 - protein, 18 aa, Mycobacterium avium
HRRLWTPVAEAMTLADLA

SEQ ID NO: 80861 - protein, 26 aa, Mycobacterium avium
HRTEVTEILPLDGFDFDDLDFCDDAG

SEQ ID NO: 80862 - protein, 23 aa, Mycobacterium avium
HRTFHYPGGLVDFVKHINRTKNP

SEQ ID NO: 80863 - protein, 25 aa, Mycobacterium avium
HRVARRLQAGSVWVNRHSDIEPQGP

SEQ ID NO: 80864 - protein, 18 aa, Mycobacterium avium
HRVIRPEVRGQAGFDDPV

SEQ ID NO: 80865 - protein, 20 aa, Mycobacterium avium
HRVQYRFTRTGLVLPDDPSV

SEQ ID NO: 80866 - protein, 18 aa, Mycobacterium avium
HSDPEFAAAAGFSQPILH

SEQ ID NO: 80867 - protein, 18 aa, Mycobacterium avium
HSGWWDHIAPFFSHTHRV

SEQ ID NO: 80868 - protein, 21 aa, Mycobacterium avium
HSLGGGVAMQFVYQHPDYAQR

SEQ ID NO: 80869 - protein, 27 aa, Mycobacterium avium
HSPAESWPPTGWFEGWAGGLDVFDVER

SEQ ID NO: 80870 - protein, 30 aa, Mycobacterium avium
HSPMDVLWFRLKWRPGDPRELFGVFRKGLM

SEQ ID NO: 80871 - protein, 31 aa, Mycobacterium avium
HSRFSTNTFPSWPLAHPFRRIAHNGEINTVT

SEQ ID NO: 80872 - protein, 22 aa, Mycobacterium avium
HSRRVFLFGALQGRRRGLQPDL

SEQ ID NO: 80873 - protein, 20 aa, Mycobacterium avium
HSVRYGRSRLLLPVGPAEPS

SEQ ID NO: 80874 - protein, 24 aa, Mycobacterium avium
HTAVKISPRRSGPVVWVKDASRSV

SEQ ID NO: 80875 - protein, 24 aa, Mycobacterium avium
HTDELRFLVHWSAEVFSDYDELKK

SEQ ID NO: 80876 - protein, 20 aa, Mycobacterium avium
HTDSGVALSSRIAHELGEAS

SEQ ID NO: 80877 - protein, 18 aa, Mycobacterium avium
HTEKVTLWKLMDVKERTG

SEQ ID NO: 80878 - protein, 18 aa, Mycobacterium avium
HTEVLPLYARLPTAEQQK

SEQ ID NO: 80879 - protein, 17 aa, Mycobacterium avium
HTGKAALYRRWDTKCEL

SEQ ID NO: 80880 - protein, 19 aa, Mycobacterium avium
HTGLPWPDVHDAGTVTLLQ

SEQ ID NO: 80881 - protein, 26 aa, Mycobacterium avium
HTGPAMSAFNAWVLLKGLETMAIRVE

SEQ ID NO: 80882 - protein, 18 aa, Mycobacterium avium
HTHELRQTVLALLADHDL

SEQ ID NO: 80883 - protein, 18 aa, Mycobacterium avium
HTKGPKIRIHKFRNKTGY

SEQ ID NO: 80884 - protein, 26 aa, Mycobacterium avium
HTLEYGRLKLPAPDRQVLLAVSAELA

SEQ ID NO: 80885 - protein, 26 aa, Mycobacterium avium
HTLLLDLWRRHGFGVLLVTHDVDEAV

SEQ ID NO: 80886 - protein, 25 aa, Mycobacterium avium
HTNRGDIKVALFGNHAPKTVANFVG

SEQ ID NO: 80887 - protein, 18 aa, Mycobacterium avium
HTQREFTSEVSWKGALEA

SEQ ID NO: 80888 - protein, 24 aa, Mycobacterium avium
HTRFGTEVEALWWQERRRQWQIHS

SEQ ID NO: 80889 - protein, 30 aa, Mycobacterium avium
HTTARLRLVPLRWALACLLIDIGSVEFSSR

SEQ ID NO: 80890 - protein, 18 aa, Mycobacterium avium
HTVILYRAGLLSEEQRDG

SEQ ID NO: 80891 - protein, 19 aa, Mycobacterium avium
HTWKRSSFSGTEIFGKTVG

SEQ ID NO: 80892 - protein, 25 aa, Mycobacterium avium
HTYFPRLRLELDKGLGWKAEVEAAL

SEQ ID NO: 80893 - protein, 33 aa, Mycobacterium avium
HVAGRGPVVPALGLALLGARAAGKVVLDGVFND

SEQ ID NO: 80894 - protein, 23 aa, Mycobacterium avium
HVDECWYCGPCAARCPTGAVTVN

SEQ ID NO: 80895 - protein, 20 aa, Mycobacterium avium
HVDGVPCCTHIGPDGAGHFV

SEQ ID NO: 80896 - protein, 19 aa, Mycobacterium avium
HVFRMEWLSGEPFPADDES

SEQ ID NO: 80897 - protein, 21 aa, Mycobacterium avium
HVHVVPRWGGDANFITIIGGS

SEQ ID NO: 80898 - protein, 22 aa, Mycobacterium avium
HVIDYLNGLGWRAEGVTRTELF

SEQ ID NO: 80899 - protein, 24 aa, Mycobacterium avium
HVLMARHMFTLWAPERAGVTDAVA

SEQ ID NO: 80900 - protein, 24 aa, Mycobacterium avium
HVPDYLMQIIARFARYLRESNSVD

SEQ ID NO: 80901 - protein, 24 aa, Mycobacterium avium
HVPMFAFGHGLSYTRFEHRDLVVR

SEQ ID NO: 80902 - protein, 24 aa, Mycobacterium avium
HVPQWRFVAEWTRSRAEELKPGPA

SEQ ID NO: 80903 - protein, 17 aa, Mycobacterium avium
HVREVVCEDSLGLAEEF

SEQ ID NO: 80904 - protein, 23 aa, Mycobacterium avium
HVRRSALPSPRRVRELLELTSRW

SEQ ID NO: 80905 - protein, 22 aa, Mycobacterium avium
HVVAALPRRGIGKVDRAALVRR

SEQ ID NO: 80906 - protein, 17 aa, Mycobacterium avium
HVVALPMRVRFRGITTR

SEQ ID NO: 80907 - protein, 21 aa, Mycobacterium avium
HWLGRDRFVLSAGHSSLTLYL

SEQ ID NO: 80908 - protein, 21 aa, Mycobacterium avium
HWSGCIPVELTGHVEFPRIGH

SEQ ID NO: 80909 - protein, 17 aa, Mycobacterium avium
HWWAHRALWHLIFSGAL

SEQ ID NO: 80910 - protein, 30 aa, Mycobacterium avium
HYDCRSTQELRNWLMLRAYESGVLPVGAQP

SEQ ID NO: 80911 - protein, 29 aa, Mycobacterium avium
HYDKSNEFFKLWLDPSMTYSCGYWEEGAK

SEQ ID NO: 80912 - protein, 23 aa, Mycobacterium avium
HYHCYPRLVGETGGKDFIVAHAS

SEQ ID NO: 80913 - protein, 26 aa, Mycobacterium avium
HYVDLVCSWGPMILGHAHPAVVEAVA

SEQ ID NO: 80914 - protein, 17 aa, Mycobacterium avium
IAAAAVDAFGSVHGLVN

SEQ ID NO: 80915 - protein, 24 aa, Mycobacterium avium
IAAAKARGINLWRVDDDHVSVACD

SEQ ID NO: 80916 - protein, 26 aa, Mycobacterium avium
IAAALALGAEGVWCGSVWLTTEEAET

SEQ ID NO: 80917 - protein, 19 aa, Mycobacterium avium
IAAALKLLQDRSFSSLSLR

SEQ ID NO: 80918 - protein, 18 aa, Mycobacterium avium
IAACADALGAARAVMDLA

SEQ ID NO: 80919 - protein, 23 aa, Mycobacterium avium
IAADGWRVGSVFGTETALLQRYR

SEQ ID NO: 80920 - protein, 21 aa, Mycobacterium avium
IAAEATRVGMPYVNQRWLGGM

SEQ ID NO: 80921 - protein, 25 aa, Mycobacterium avium
IAAELPMQMICILLGVPESERHWLF

SEQ ID NO: 80922 - protein, 23 aa, Mycobacterium avium
IAAELRELASLRDAGILTQQEFE

SEQ ID NO: 80923 - protein, 24 aa, Mycobacterium avium
IAAGLAAFGARVAIWERDAQTCTR

SEQ ID NO: 80924 - protein, 24 aa, Mycobacterium avium
IAAHNKLLGSFELTGIPPAPRGVP

SEQ ID NO: 80925 - protein, 25 aa, Mycobacterium avium
IAAHWRYKEAKGRNGVPHPHAAAEI

SEQ ID NO: 80926 - protein, 17 aa, Mycobacterium avium
IAALCGERLKRVSLELG

SEQ ID NO: 80927 - protein, 24 aa, Mycobacterium avium
IAALSRLGAIAVVMRPDADLAASV

SEQ ID NO: 80928 - protein, 18 aa, Mycobacterium avium
IAAPFAGVVTVAAEVGRQ

SEQ ID NO: 80929 - protein, 17 aa, Mycobacterium avium
IAAPRPLAPMTVRQAVK

SEQ ID NO: 80930 - protein, 17 aa, Mycobacterium avium
IAASGIPRAELFVTTKL

SEQ ID NO: 80931 - protein, 25 aa, Mycobacterium avium
IAASGRWVPDFLSLPIAVENSLKDQ

SEQ ID NO: 80932 - protein, 19 aa, Mycobacterium avium
IACGIEAMSRVGLGANAGP

SEQ ID NO: 80933 - protein, 20 aa, Mycobacterium avium
IACGTLRLVVEDAELDGHLF

SEQ ID NO: 80934 - protein, 23 aa, Mycobacterium avium
IADDIRAAIAVRHGVTVRDLLLV

SEQ ID NO: 80935 - protein, 18 aa, Mycobacterium avium
IADLIEWRRKHEKHIERI

SEQ ID NO: 80936 - protein, 19 aa, Mycobacterium avium
IADSSGCEELMAFATSAVR

SEQ ID NO: 80937 - protein, 18 aa, Mycobacterium avium
IADVRRVGFGVGAEVVGK

SEQ ID NO: 80938 - protein, 19 aa, Mycobacterium avium
IAEAAPMESGELGSVLEAL

SEQ ID NO: 80939 - protein, 23 aa, Mycobacterium avium
IAEAEGLTVLGWRNVPTDDSSLG

SEQ ID NO: 80940 - protein, 23 aa, Mycobacterium avium
IAEEYYISFLLDRANRTYLAMCS

SEQ ID NO: 80941 - protein, 26 aa, Mycobacterium avium
IAEFARRFGCRVVDSFGSSEFAVIVV

SEQ ID NO: 80942 - protein, 20 aa, Mycobacterium avium
IAELRPGDEQALIAIPGIGA

SEQ ID NO: 80943 - protein, 22 aa, Mycobacterium avium
IAEQRPDLVPIFLNALPAPLIE

SEQ ID NO: 80944 - protein, 20 aa, Mycobacterium avium
IAESGLRFSGTSPDGHLVEF

SEQ ID NO: 80945 - protein, 34 aa, Mycobacterium avium
IAESLRAALRAVPAERLWVNPDCGLKTRNPDEVS

SEQ ID NO: 80946 - protein, 24 aa, Mycobacterium avium
IAEVRRAITTLGRISAEGMHLRGL

SEQ ID NO: 80947 - protein, 17 aa, Mycobacterium avium
IAFAGGIHMCLGMHLAR

SEQ ID NO: 80948 - protein, 19 aa, Mycobacterium avium
IAGITYRQLDYWARTSLVV

SEQ ID NO: 80949 - protein, 36 aa, Mycobacterium avium
IAGNGLRPEIWDEFTQRFGIARVCEFYASSEGNAAF

SEQ ID NO: 80950 - protein, 24 aa, Mycobacterium avium
IAGPRGVGMLAVRRELMENLHPRL

SEQ ID NO: 80951 - protein, 20 aa, Mycobacterium avium
IAGRAMRRIGAIEFATTIAP

SEQ ID NO: 80952 - protein, 24 aa, Mycobacterium avium
IAGYKVPRSLWLVDEVKRSPAGKP

SEQ ID NO: 80953 - protein, 19 aa, Mycobacterium avium
IAHCTRGLGIWDWASTARS

SEQ ID NO: 80954 - protein, 17 aa, Mycobacterium avium
IAIERGTHFKGFERSKY

SEQ ID NO: 80955 - protein, 26 aa, Mycobacterium avium
IAISRTYIASWLRRWQERGELADDLD

SEQ ID NO: 80956 - protein, 18 aa, Mycobacterium avium
IAIVNRGDTRGDHLATVK

SEQ ID NO: 80957 - protein, 24 aa, Mycobacterium avium
IAKFLDKRGPGIQQMAMRVSDLDT

SEQ ID NO: 80958 - protein, 20 aa, Mycobacterium avium
IAKRELRGVSARAVKSPADL

SEQ ID NO: 80959 - protein, 20 aa, Mycobacterium avium
IALACLATLAGYRRTDEAMK

SEQ ID NO: 80960 - protein, 23 aa, Mycobacterium avium
IALLSRGKLAYGVIDDQNQPPGS

SEQ ID NO: 80961 - protein, 18 aa, Mycobacterium avium
IALPDLQPGSSIMPGKVN

SEQ ID NO: 80962 - protein, 17 aa, Mycobacterium avium
IALRAAEYGRNVCVLTI

SEQ ID NO: 80963 - protein, 18 aa, Mycobacterium avium
IALTPARLLMVVITDSGR

SEQ ID NO: 80964 - protein, 22 aa, Mycobacterium avium
IANRLPMMVVCRLLGLPDDDVD

SEQ ID NO: 80965 - protein, 20 aa, Mycobacterium avium
IAPGLFKTPLLGSLPEEAQA

SEQ ID NO: 80966 - protein, 21 aa, Mycobacterium avium
IAPGLWCSPGLSNSYLLTTAE

SEQ ID NO: 80967 - protein, 17 aa, Mycobacterium avium
IAPLYAGFVERYGDQIA

SEQ ID NO: 80968 - protein, 18 aa, Mycobacterium avium
IAQLLVQRVELVELVEVS

SEQ ID NO: 80969 - protein, 18 aa, Mycobacterium avium
IAQVHGWCVGGASDYALC

SEQ ID NO: 80970 - protein, 24 aa, Mycobacterium avium
IARALAAAGNEVWGVARLKDPAAR

SEQ ID NO: 80971 - protein, 17 aa, Mycobacterium avium
IAREEIFGPVITVIPYR

SEQ ID NO: 80972 - protein, 27 aa, Mycobacterium avium
IARLSLLDRGMVFAIAHVRGGGEMGRL

SEQ ID NO: 80973 - protein, 23 aa, Mycobacterium avium
IARNCSPASLAVIKRQAYDDALR

SEQ ID NO: 80974 - protein, 22 aa, Mycobacterium avium
IARVAPVERIRLVNSGTEATMS

SEQ ID NO: 80975 - protein, 26 aa, Mycobacterium avium
IASGSRFLVFMQRYTPAALFISSPDQ

SEQ ID NO: 80976 - protein, 17 aa, Mycobacterium avium
IASKGGYEAVQMRAVAD

SEQ ID NO: 80977 - protein, 18 aa, Mycobacterium avium
IASLGRYGYGWADSDVAG

SEQ ID NO: 80978 - protein, 20 aa, Mycobacterium avium
IASLNYLLTSHVWRQDHNGA

SEQ ID NO: 80979 - protein, 19 aa, Mycobacterium avium
IASRAKLQIGRSGRHIAQE

SEQ ID NO: 80980 - protein, 18 aa, Mycobacterium avium
IATGIYLLGAADRDEAVK

SEQ ID NO: 80981 - protein, 18 aa, Mycobacterium avium
IATKLQEMADELTARDSG

SEQ ID NO: 80982 - protein, 20 aa, Mycobacterium avium
IAVADLDAAIAWYHDHLGMI

SEQ ID NO: 80983 - protein, 22 aa, Mycobacterium avium
IAVAGPRSSFALTEARIGVAPA

SEQ ID NO: 80984 - protein, 20 aa, Mycobacterium avium
IAVDICKPIRAGVVDTAIPA

SEQ ID NO: 80985 - protein, 18 aa, Mycobacterium avium
IAVDLCDQIASVPYPLAT

SEQ ID NO: 80986 - protein, 19 aa, Mycobacterium avium
IAVGLALRGFVPVPEIQFD

SEQ ID NO: 80987 - protein, 22 aa, Mycobacterium avium
IAVKDGRIVGVRGRAVDRVNHG

SEQ ID NO: 80988 - protein, 19 aa, Mycobacterium avium
IAWPADLKVGPDGLGNSPE

SEQ ID NO: 80989 - protein, 25 aa, Mycobacterium avium
IAYVLEILPALGYLHSIGLVYNDLK

SEQ ID NO: 80990 - protein, 29 aa, Mycobacterium avium
ICGLRAGQKLRIVKYLAYGWSSMRSRPAL

SEQ ID NO: 80991 - protein, 18 aa, Mycobacterium avium
ICPLTAGLPPQAFADAVD

SEQ ID NO: 80992 - protein, 20 aa, Mycobacterium avium
ICRHIMLYHLDRGWADHLAY

SEQ ID NO: 80993 - protein, 19 aa, Mycobacterium avium
IDAAGKWVLPGFIDVHTHY

SEQ ID NO: 80994 - protein, 18 aa, Mycobacterium avium
IDAAHLWHPYSTIGAESV

SEQ ID NO: 80995 - protein, 19 aa, Mycobacterium avium
IDAFVEFYHAPILHQGQYT

SEQ ID NO: 80996 - protein, 18 aa, Mycobacterium avium
IDAGAVAITDSWRALADV

SEQ ID NO: 80997 - protein, 18 aa, Mycobacterium avium
IDALLALKADTVIYTPFM

SEQ ID NO: 80998 - protein, 18 aa, Mycobacterium avium
IDALRFGTDVLTHFLTHC

SEQ ID NO: 80999 - protein, 24 aa, Mycobacterium avium
IDALTELWVRPALSLPAVAEDLRR

SEQ ID NO: 81000 - protein, 22 aa, Mycobacterium avium
IDAPPRLVWDVFTDVERWPEWT

SEQ ID NO: 81001 - protein, 23 aa, Mycobacterium avium
IDAPRFREAYRWALDSLHRRGAR

SEQ ID NO: 81002 - protein, 25 aa, Mycobacterium avium
IDAYRDFLIEIGYLLPEPEDFTITT

SEQ ID NO: 81003 - protein, 26 aa, Mycobacterium avium
IDDHSRMCVCAKLMARERTRAVCDGL

SEQ ID NO: 81004 - protein, 20 aa, Mycobacterium avium
IDEEGLSLDVCTGGELAVAL

SEQ ID NO: 81005 - protein, 20 aa, Mycobacterium avium
IDELIGPDVTREWIKDFSSY

SEQ ID NO: 81006 - protein, 19 aa, Mycobacterium avium
IDERMSRLDLRRMSYVQRL

SEQ ID NO: 81007 - protein, 17 aa, Mycobacterium avium
IDFTNIYFYTVLYHALR

SEQ ID NO: 81008 - protein, 22 aa, Mycobacterium avium
IDGLLREIRLVRALSGTDVPHA

SEQ ID NO: 81009 - protein, 17 aa, Mycobacterium avium
IDGLRRRIAELAVPAEA

SEQ ID NO: 81010 - protein, 17 aa, Mycobacterium avium
IDGQKMWLTNGATSTLI

SEQ ID NO: 81011 - protein, 22 aa, Mycobacterium avium
IDGSCRRFGAGAGNAPVEALIG

SEQ ID NO: 81012 - protein, 18 aa, Mycobacterium avium
IDGWRPGQRLDVYQHCRA

SEQ ID NO: 81013 - protein, 17 aa, Mycobacterium avium
IDHAALRLHKPVISHDL

SEQ ID NO: 81014 - protein, 21 aa, Mycobacterium avium
IDISNAVLFFASDEARYITGV

SEQ ID NO: 81015 - protein, 21 aa, Mycobacterium avium
IDLERRRISLSLKQANEDYTE

SEQ ID NO: 81016 - protein, 20 aa, Mycobacterium avium
IDLIMPIGKGQRALIVSPPK

SEQ ID NO: 81017 - protein, 18 aa, Mycobacterium avium
IDLPSYGLVWKWPQIDCA

SEQ ID NO: 81018 - protein, 17 aa, Mycobacterium avium
IDLVCTLICAVDGSVVS

SEQ ID NO: 81019 - protein, 30 aa, Mycobacterium avium
IDLYLRIAPELFLKRCVVGGFDKVFELNRV

SEQ ID NO: 81020 - protein, 26 aa, Mycobacterium avium
IDPALPATRIEFMLGDAAPVVAVSTA

SEQ ID NO: 81021 - protein, 33 aa, Mycobacterium avium
IDPDAVELPGWYRPNPGLARDLAFIAFSAAGGE

SEQ ID NO: 81022 - protein, 26 aa, Mycobacterium avium
IDPELRRPITELGMVKSIDTEPDGAV

SEQ ID NO: 81023 - protein, 17 aa, Mycobacterium avium
IDPEYYKKFMSVNLDGA

SEQ ID NO: 81024 - protein, 19 aa, Mycobacterium avium
IDPGHALRGPRRLRRLREL

SEQ ID NO: 81025 - protein, 18 aa, Mycobacterium avium
IDPVALHHYMSFHSVVPA

SEQ ID NO: 81026 - protein, 23 aa, Mycobacterium avium
IDPYLRPLYDALYDMMDPEVIPK

SEQ ID NO: 81027 - protein, 24 aa, Mycobacterium avium
IDRDRLSACADLLMTTSPNVLIYA

SEQ ID NO: 81028 - protein, 17 aa, Mycobacterium avium
IDRKNVREHIAFGRGIH

SEQ ID NO: 81029 - protein, 24 aa, Mycobacterium avium
IDRPLRPSFVDGLRNEIQVVVTIL

SEQ ID NO: 81030 - protein, 19 aa, Mycobacterium avium
IDRPRVWWQGVRLRTESAP

SEQ ID NO: 81031 - protein, 27 aa, Mycobacterium avium
IDSFEWLIGAPRWREAAIARGDAEPKG

SEQ ID NO: 81032 - protein, 25 aa, Mycobacterium avium
IDTDLRWRIVTALAAAGEIDADGPA

SEQ ID NO: 81033 - protein, 28 aa, Mycobacterium avium
IDTPPQRYAMFMSFSLASGAGRTELQTL

SEQ ID NO: 81034 - protein, 23 aa, Mycobacterium avium
IDTRLQWYVELGIDPQNLRLFEH

SEQ ID NO: 81035 - protein, 20 aa, Mycobacterium avium
IDTWLPLSWSLNMVNRSMGH

SEQ ID NO: 81036 - protein, 19 aa, Mycobacterium avium
IDVAYRYFATPKRKFIIAD

SEQ ID NO: 81037 - protein, 19 aa, Mycobacterium avium
IDYFAEVNLAGFYDLAQTL

SEQ ID NO: 81038 - protein, 24 aa, Mycobacterium avium
IDYRDRICRAREQLAATDNPLHKV

SEQ ID NO: 81039 - protein, 21 aa, Mycobacterium avium
IEAALELKNQILVKIYNRKAL

SEQ ID NO: 81040 - protein, 23 aa, Mycobacterium avium
IEAGASGTVRWTGQVGTTYQIGA

SEQ ID NO: 81041 - protein, 17 aa, Mycobacterium avium
IEALVRVVREFRPHVMT

SEQ ID NO: 81042 - protein, 19 aa, Mycobacterium avium
IEAVNLFRAKVIDVSPEAL

SEQ ID NO: 81043 - protein, 17 aa, Mycobacterium avium
IEDDLYYPALKEASKLI

SEQ ID NO: 81044 - protein, 26 aa, Mycobacterium avium
IEDFSGSMSLSFSDPRFDEVKAPVDE

SEQ ID NO: 81045 - protein, 21 aa, Mycobacterium avium
IEDRLKDMIITGGENVYGPEV

SEQ ID NO: 81046 - protein, 18 aa, Mycobacterium avium
IEEGVRWEPPLLTITRVA

SEQ ID NO: 81047 - protein, 22 aa, Mycobacterium avium
IEELLRGADMVFVTAGEGGGTG

SEQ ID NO: 81048 - protein, 19 aa, Mycobacterium avium
IEEMLRWTSPVKNMCRTLT

SEQ ID NO: 81049 - protein, 21 aa, Mycobacterium avium
IEFRTLPVVRYDNIDGQDVNI

SEQ ID NO: 81050 - protein, 18 aa, Mycobacterium avium
IEGVKRFISGGDVGDTAE

SEQ ID NO: 81051 - protein, 25 aa, Mycobacterium avium
IEILPVAGLPEFRPGDDLGAAVAKA

SEQ ID NO: 81052 - protein, 18 aa, Mycobacterium avium
IEITRPLISDSFEAQEMA

SEQ ID NO: 81053 - protein, 18 aa, Mycobacterium avium
IEKIVPEVFDLRPGAIIR

SEQ ID NO: 81054 - protein, 36 aa, Mycobacterium avium
IELDGLRLITWRGAARAEQGLPFAREAALAKRLGAD

SEQ ID NO: 81055 - protein, 25 aa, Mycobacterium avium
IELMGKEVLPEFIERDAKAVADKAT

SEQ ID NO: 81056 - protein, 24 aa, Mycobacterium avium
IELPEGAHLLLMWGAANRDPTHFK

SEQ ID NO: 81057 - protein, 23 aa, Mycobacterium avium
IELPLMEVRALLDLGDVAKATRK

SEQ ID NO: 81058 - protein, 25 aa, Mycobacterium avium
IENPDRWAPPYAEAGAHNVTFHAEA

SEQ ID NO: 81059 - protein, 21 aa, Mycobacterium avium
IEPGHGLRIGYFAQEHDTLDN

SEQ ID NO: 81060 - protein, 23 aa, Mycobacterium avium
IEPLEPGFGYTLGNSLRRTLLSS

SEQ ID NO: 81061 - protein, 28 aa, Mycobacterium avium
IEPPAGDPLRRWGPFASGVVDPDRSGLF

SEQ ID NO: 81062 - protein, 23 aa, Mycobacterium avium
IEPWLMMNWHRTMDWLLLAPTLS

SEQ ID NO: 81063 - protein, 19 aa, Mycobacterium avium
IERARAGSFVVRLKGGDPF

SEQ ID NO: 81064 - protein, 18 aa, Mycobacterium avium
IERFAHLIGGARMGTRPD

SEQ ID NO: 81065 - protein, 17 aa, Mycobacterium avium
IERTARRSAVWAIINGI

SEQ ID NO: 81066 - protein, 23 aa, Mycobacterium avium
IESAGFKLGTDVALALDAAATEF

SEQ ID NO: 81067 - protein, 17 aa, Mycobacterium avium
IESAREHGGRLLVRLAG

SEQ ID NO: 81068 - protein, 22 aa, Mycobacterium avium
IESIKQLKARYCRYLDTKDWAA

SEQ ID NO: 81069 - protein, 20 aa, Mycobacterium avium
IETLSLRMERHVANAQRVAE

SEQ ID NO: 81070 - protein, 26 aa, Mycobacterium avium
IETNVEFWAAVILDFARVPANMMPAM

SEQ ID NO: 81071 - protein, 24 aa, Mycobacterium avium
IETRGRFGTFVARYDPTDAAMAAA

SEQ ID NO: 81072 - protein, 27 aa, Mycobacterium avium
IEVAVCSTGLIGDRLPMDKLLAGVRTI

SEQ ID NO: 81073 - protein, 19 aa, Mycobacterium avium
IEVIEFCVGIPHLLKGEYS

SEQ ID NO: 81074 - protein, 26 aa, Mycobacterium avium
IEVLRFRTADGLVHYVSLGCSRHPMT

SEQ ID NO: 81075 - protein, 33 aa, Mycobacterium avium
IEVVKGGLILDIGLRGFLPASLVEMRRVRDLQP

SEQ ID NO: 81076 - protein, 17 aa, Mycobacterium avium
IEVVTDMWGRPRVRLSG

SEQ ID NO: 81077 - protein, 17 aa, Mycobacterium avium
IFADAVVRPRLKIVESI

SEQ ID NO: 81078 - protein, 18 aa, Mycobacterium avium
IFQREMRGAQGIDHPLIR

SEQ ID NO: 81079 - protein, 20 aa, Mycobacterium avium
IFREEMCRLGRQPVAPEYEA

SEQ ID NO: 81080 - protein, 26 aa, Mycobacterium avium
IFVKDKPAWLGRAWRRIGEEVAAGRQ

SEQ ID NO: 81081 - protein, 17 aa, Mycobacterium avium
IGAARLSAFSVLLEMLG

SEQ ID NO: 81082 - protein, 18 aa, Mycobacterium avium
IGADRLPIVDTWWQTETG

SEQ ID NO: 81083 - protein, 18 aa, Mycobacterium avium
IGASGLRQVHELVRQLRG

SEQ ID NO: 81084 - protein, 19 aa, Mycobacterium avium
IGCGLPAAKALPILDALLN

SEQ ID NO: 81085 - protein, 22 aa, Mycobacterium avium
IGDGCVMPGFVEAHGHPLMEAV

SEQ ID NO: 81086 - protein, 20 aa, Mycobacterium avium
IGDLFGGLFGRASGGRPSRP

SEQ ID NO: 81087 - protein, 18 aa, Mycobacterium avium
IGDPRIDVGWFLINCDPD

SEQ ID NO: 81088 - protein, 19 aa, Mycobacterium avium
IGDRLGLAAAGVRRHLDAL

SEQ ID NO: 81089 - protein, 34 aa, Mycobacterium avium
IGEACRRARRKGIKVAHAHLRYLNPFPANLGEVL

SEQ ID NO: 81090 - protein, 22 aa, Mycobacterium avium
IGGAKRGKAIIILNPADPPMIM

SEQ ID NO: 81091 - protein, 18 aa, Mycobacterium avium
IGGDGFRIVLSADVANIA

SEQ ID NO: 81092 - protein, 19 aa, Mycobacterium avium
IGGGGRYDGLMRQLGGQDL

SEQ ID NO: 81093 - protein, 19 aa, Mycobacterium avium
IGGLLRYGIPEFKMEKRVL

SEQ ID NO: 81094 - protein, 20 aa, Mycobacterium avium
IGGLPRGRVVEIYGPESSGK

SEQ ID NO: 81095 - protein, 24 aa, Mycobacterium avium
IGGMPAPPPLAWAVNEMLICANPS

SEQ ID NO: 81096 - protein, 19 aa, Mycobacterium avium
IGGNSAWRAIAGPTPRVNP

SEQ ID NO: 81097 - protein, 26 aa, Mycobacterium avium
IGGPVKRDAALCLATLRVGADPQGAP

SEQ ID NO: 81098 - protein, 17 aa, Mycobacterium avium
IGIGGNSAWRAIAGPTP

SEQ ID NO: 81099 - protein, 25 aa, Mycobacterium avium
IGIGLLIDGRWRWRSYSLTSSPATS

SEQ ID NO: 81100 - protein, 20 aa, Mycobacterium avium
IGILPRHIPLVAQLVDDAMV

SEQ ID NO: 81101 - protein, 24 aa, Mycobacterium avium
IGISRIGRRTGIPGLELTMEAVRA

SEQ ID NO: 81102 - protein, 20 aa, Mycobacterium avium
IGKGCARKLVERGYDVLLCA

SEQ ID NO: 81103 - protein, 21 aa, Mycobacterium avium
IGLAGRPRLLIADEPTSALDV

SEQ ID NO: 81104 - protein, 17 aa, Mycobacterium avium
IGLRLKSSDTLYCCLPL

SEQ ID NO: 81105 - protein, 24 aa, Mycobacterium avium
IGMFTDRHALALGPGKALLDGQIQ

SEQ ID NO: 81106 - protein, 22 aa, Mycobacterium avium
IGNPPLVVTVNFLGTRQLTEAL

SEQ ID NO: 81107 - protein, 22 aa, Mycobacterium avium
IGNTEWPKWETVMATDPVDPAQ

SEQ ID NO: 81108 - protein, 29 aa, Mycobacterium avium
IGNTWECAAHVYLRRALTSTELWPVALKE

SEQ ID NO: 81109 - protein, 19 aa, Mycobacterium avium
IGNWHGWSRQRIVNAVDAA

SEQ ID NO: 81110 - protein, 17 aa, Mycobacterium avium
IGPELIDDVVWGCVSQV

SEQ ID NO: 81111 - protein, 24 aa, Mycobacterium avium
IGPKTIRSAAAWADGLAGTTLDLD

SEQ ID NO: 81112 - protein, 21 aa, Mycobacterium avium
IGPRTRMRWEQVADWDYVCEQ

SEQ ID NO: 81113 - protein, 22 aa, Mycobacterium avium
IGPTRITAVLGILKAYTTRVGS

SEQ ID NO: 81114 - protein, 17 aa, Mycobacterium avium
IGPVAAFLASRRNSYMT

SEQ ID NO: 81115 - protein, 19 aa, Mycobacterium avium
IGQAFGRDHTTVMYAQRKI

SEQ ID NO: 81116 - protein, 22 aa, Mycobacterium avium
IGQCFTGGFALAAAVDESVLAP

SEQ ID NO: 81117 - protein, 19 aa, Mycobacterium avium
IGQLLPCNVVVRSDPAEGD

SEQ ID NO: 81118 - protein, 17 aa, Mycobacterium avium
IGRLRWQFDRIARSIPL

SEQ ID NO: 81119 - protein, 20 aa, Mycobacterium avium
IGRPDAWEVQGRGELALAVL

SEQ ID NO: 81120 - protein, 25 aa, Mycobacterium avium
IGSKCPQCGTYVFPPRENNCPNPGC

SEQ ID NO: 81121 - protein, 26 aa, Mycobacterium avium
IGSNVARTVFKSMLIAVLDRMPDYRC

SEQ ID NO: 81122 - protein, 17 aa, Mycobacterium avium
IGTAGFSALHRINVICS

SEQ ID NO: 81123 - protein, 17 aa, Mycobacterium avium
IGTLGFMRHDYVNFGFD

SEQ ID NO: 81124 - protein, 25 aa, Mycobacterium avium
IGTLQRLAALQGRRVDALTEEEPGR

SEQ ID NO: 81125 - protein, 23 aa, Mycobacterium avium
IGVDAGRWPELLAALDDSSLVVA

SEQ ID NO: 81126 - protein, 19 aa, Mycobacterium avium
IGVHRCIGSNVARTVFKSM

SEQ ID NO: 81127 - protein, 19 aa, Mycobacterium avium
IGVKIRWVGSRPRLWRSVI

SEQ ID NO: 81128 - protein, 20 aa, Mycobacterium avium
IGVLYGRREVLSQLPPFLTG

SEQ ID NO: 81129 - protein, 17 aa, Mycobacterium avium
IGVVGLLNVQYALKDDV

SEQ ID NO: 81130 - protein, 22 aa, Mycobacterium avium
IGYTCAGTVEFLLDERGNHVFI

SEQ ID NO: 81131 - protein, 26 aa, Mycobacterium avium
IHESAKRICKEAHYYGAGTVEYLVGQ

SEQ ID NO: 81132 - protein, 19 aa, Mycobacterium avium
IHETREWILRNSPVPVGTV

SEQ ID NO: 81133 - protein, 17 aa, Mycobacterium avium
IHGADPWWDVAIRLLLK

SEQ ID NO: 81134 - protein, 19 aa, Mycobacterium avium
IHGVQICQHHCPVSHVAEE

SEQ ID NO: 81135 - protein, 23 aa, Mycobacterium avium
IHPVAACATAAVSVEEGVDKIRL

SEQ ID NO: 81136 - protein, 21 aa, Mycobacterium avium
IHRTGRCVVMHEGPRTLGYGA

SEQ ID NO: 81137 - protein, 17 aa, Mycobacterium avium
IHSCPGAPLARAETRVA

SEQ ID NO: 81138 - protein, 21 aa, Mycobacterium avium
IHVYRWKPTPAGGEFDQLVAS

SEQ ID NO: 81139 - protein, 18 aa, Mycobacterium avium
IIAAVPVLLSDDVEGARA

SEQ ID NO: 81140 - protein, 23 aa, Mycobacterium avium
IIDRLKDIINRGGENVSSVEVEA

SEQ ID NO: 81141 - protein, 18 aa, Mycobacterium avium
IIEEGFAAATAKHVAERA

SEQ ID NO: 81142 - protein, 24 aa, Mycobacterium avium
IIELFRGGPDYALFLYRNHGPLIY

SEQ ID NO: 81143 - protein, 26 aa, Mycobacterium avium
IIFDPNCFALATGIEEHATYGIDFIE

SEQ ID NO: 81144 - protein, 18 aa, Mycobacterium avium
IIGMLTLLIGGGFDTTTA

SEQ ID NO: 81145 - protein, 24 aa, Mycobacterium avium
IIGRIKDLLIVYGRNHSPDDIEAT

SEQ ID NO: 81146 - protein, 19 aa, Mycobacterium avium
IIHRPRYDDWSLPKGKVDP

SEQ ID NO: 81147 - protein, 26 aa, Mycobacterium avium
IIRVAARLAAAGWPLAGIDVSEVIPG

SEQ ID NO: 81148 - protein, 19 aa, Mycobacterium avium
IISCGAALDHFRVAMAAAG

SEQ ID NO: 81149 - protein, 24 aa, Mycobacterium avium
IISNGRASYILALGYRPEEFEHFG

SEQ ID NO: 81150 - protein, 25 aa, Mycobacterium avium
IIYDEVHLLPAPVFRMTADLQSKRR

SEQ ID NO: 81151 - protein, 26 aa, Mycobacterium avium
IKAGKAGLVPAHLRDGHYSGAAALGH

SEQ ID NO: 81152 - protein, 18 aa, Mycobacterium avium
IKDAGGRAVANYDSVAEP

SEQ ID NO: 81153 - protein, 19 aa, Mycobacterium avium
IKENLPGVHLSGGISNVSF

SEQ ID NO: 81154 - protein, 22 aa, Mycobacterium avium
IKHLCAEMLCRAEQAEVAAADA

SEQ ID NO: 81155 - protein, 22 aa, Mycobacterium avium
IKKGVLELADIVVVNKADGEHL

SEQ ID NO: 81156 - protein, 25 aa, Mycobacterium avium
IKKHARLNMMAHLLSTIPYHAVEAP

SEQ ID NO: 81157 - protein, 22 aa, Mycobacterium avium
IKKQMIDWWGPIIDEYYASSEA

SEQ ID NO: 81158 - protein, 17 aa, Mycobacterium avium
IKLADLVSSLGKPELVI

SEQ ID NO: 81159 - protein, 27 aa, Mycobacterium avium
IKPQRGRISTWPLPEAFNGITVNGVLA

SEQ ID NO: 81160 - protein, 22 aa, Mycobacterium avium
IKPSHLAGGYAQHAFAFNYLGP

SEQ ID NO: 81161 - protein, 18 aa, Mycobacterium avium
IKQVWTPRQQRVVGEDGF

SEQ ID NO: 81162 - protein, 22 aa, Mycobacterium avium
IKSREIYEAPGAMVLITAHTEL

SEQ ID NO: 81163 - protein, 22 aa, Mycobacterium avium
IKTAKLRAAQRVQRFLDAAQAI

SEQ ID NO: 81164 - protein, 26 aa, Mycobacterium avium
IKTRQAIRREAFRLIEQNGYAATTVE

SEQ ID NO: 81165 - protein, 19 aa, Mycobacterium avium
IKTWSRRSTIIPDFIGHTF

SEQ ID NO: 81166 - protein, 29 aa, Mycobacterium avium
IKVPLAIAALRKDWLGARELATKAVTESD

SEQ ID NO: 81167 - protein, 24 aa, Mycobacterium avium
IKVVREIVSGLGLKEAKDLVDGAP

SEQ ID NO: 81168 - protein, 22 aa, Mycobacterium avium
ILCDPWVNPAYFASWFPFPDNS

SEQ ID NO: 81169 - protein, 19 aa, Mycobacterium avium
ILDQLRTAYGQGFLDDIPK

SEQ ID NO: 81170 - protein, 17 aa, Mycobacterium avium
ILDREVFDVVAARLRAQ

SEQ ID NO: 81171 - protein, 22 aa, Mycobacterium avium
ILEARGSGQWATFSELVADCEG

SEQ ID NO: 81172 - protein, 18 aa, Mycobacterium avium
ILENPAWYTAYTPYQPEI

SEQ ID NO: 81173 - protein, 24 aa, Mycobacterium avium
ILERRARIGGTWDLFRYPGVRSDS

SEQ ID NO: 81174 - protein, 17 aa, Mycobacterium avium
ILGAIAPLAPEIATGEA

SEQ ID NO: 81175 - protein, 18 aa, Mycobacterium avium
ILGDPVVDMVVAVRRLEQ

SEQ ID NO: 81176 - protein, 22 aa, Mycobacterium avium
ILGRSRWAPSVFGCQAPDSGNA

SEQ ID NO: 81177 - protein, 17 aa, Mycobacterium avium
ILICNRTGSALGRSVKL

SEQ ID NO: 81178 - protein, 23 aa, Mycobacterium avium
ILIGHSLGGFVIQRYLETHRVPA

SEQ ID NO: 81179 - protein, 19 aa, Mycobacterium avium
ILKNPALEAVRVAARSAPK

SEQ ID NO: 81180 - protein, 25 aa, Mycobacterium avium
ILLDAPSVLGWAEFRDVAQRYSLGM

SEQ ID NO: 81181 - protein, 18 aa, Mycobacterium avium
ILLLDGLPNYQRLFSLRI

SEQ ID NO: 81182 - protein, 18 aa, Mycobacterium avium
ILLRRRPSGLVRPDDTEL

SEQ ID NO: 81183 - protein, 19 aa, Mycobacterium avium
ILLVEHGPGLTVSRDLPKL

SEQ ID NO: 81184 - protein, 30 aa, Mycobacterium avium
ILNFVFGEMWLRPGLGMKERRLITVACVAF

SEQ ID NO: 81185 - protein, 22 aa, Mycobacterium avium
ILNKLLRSSVRFQHLPVPFELY

SEQ ID NO: 81186 - protein, 21 aa, Mycobacterium avium
ILRAPLVKAFLLQVSAKTLGE

SEQ ID NO: 81187 - protein, 17 aa, Mycobacterium avium
ILREEWARRITEAELLT

SEQ ID NO: 81188 - protein, 19 aa, Mycobacterium avium
ILRIATWHYQFHRLRSPFR

SEQ ID NO: 81189 - protein, 22 aa, Mycobacterium avium
ILRRELPDLAVRVVNVVDLMRL

SEQ ID NO: 81190 - protein, 20 aa, Mycobacterium avium
ILSERYGYRFDYHDIDSFAE

SEQ ID NO: 81191 - protein, 34 aa, Mycobacterium avium
ILSRELPESIIIAGAGAIGMEFGYVLHNYGVEVT

SEQ ID NO: 81192 - protein, 24 aa, Mycobacterium avium
ILTAAWLRALERFQARALAADGDT

SEQ ID NO: 81193 - protein, 19 aa, Mycobacterium avium
ILTQRGDAVTSLFRNPDHA

SEQ ID NO: 81194 - protein, 24 aa, Mycobacterium avium
ILVCPADRGPLVLVGQELLYNPRL

SEQ ID NO: 81195 - protein, 18 aa, Mycobacterium avium
IMDSLRYWVTEMHVDGFR

SEQ ID NO: 81196 - protein, 19 aa, Mycobacterium avium
IMIRRRSYNYTDGLDANGQ

SEQ ID NO: 81197 - protein, 31 aa, Mycobacterium avium
IMKADHGLALPRRLQIEFSQVIQKISEGEGG

SEQ ID NO: 81198 - protein, 23 aa, Mycobacterium avium
IMVSFPVECWKQPRVPDSGASTL

SEQ ID NO: 81199 - protein, 23 aa, Mycobacterium avium
INDEYPFLLGHEAAGRVEAVGPD

SEQ ID NO: 81200 - protein, 18 aa, Mycobacterium avium
INEAASLVQDAAHQDANI

SEQ ID NO: 81201 - protein, 17 aa, Mycobacterium avium
INGGNYFGADSPFGGFK

SEQ ID NO: 81202 - protein, 23 aa, Mycobacterium avium
INGYPRLLCMTRMSTFAEDEVVT

SEQ ID NO: 81203 - protein, 19 aa, Mycobacterium avium
INIACSLGMLTAEQVEQLA

SEQ ID NO: 81204 - protein, 18 aa, Mycobacterium avium
INIPEDFDGIAAHRSSVT

SEQ ID NO: 81205 - protein, 19 aa, Mycobacterium avium
INISSALGLFSAPGQAAYV

SEQ ID NO: 81206 - protein, 24 aa, Mycobacterium avium
INKITWANACRFFSWDPFARTPRD

SEQ ID NO: 81207 - protein, 24 aa, Mycobacterium avium
INPEAWRWYRSVIGADRLPIVDTW

SEQ ID NO: 81208 - protein, 21 aa, Mycobacterium avium
INPGQRYGFRVYGPFEPSAGH

SEQ ID NO: 81209 - protein, 19 aa, Mycobacterium avium
INTMPGFTTISMYPRMWAA

SEQ ID NO: 81210 - protein, 24 aa, Mycobacterium avium
IPADRPAIVIADGLFPFLNKEQII

SEQ ID NO: 81211 - protein, 21 aa, Mycobacterium avium
IPAIRIPLHGRIEVDHPYVLL

SEQ ID NO: 81212 - protein, 22 aa, Mycobacterium avium
IPAQAIAQVCELTWQLRGQATG

SEQ ID NO: 81213 - protein, 21 aa, Mycobacterium avium
IPARPVVIGPITFLLLSKGVD

SEQ ID NO: 81214 - protein, 17 aa, Mycobacterium avium
IPDAAAVTVNFRFAPDR

SEQ ID NO: 81215 - protein, 26 aa, Mycobacterium avium
IPDFVKLAEALGCVGLRCEREEDVVD

SEQ ID NO: 81216 - protein, 17 aa, Mycobacterium avium
IPDKGRILTAMSVFFFG

SEQ ID NO: 81217 - protein, 19 aa, Mycobacterium avium
IPDSEFKAAGAQLADTAEQ

SEQ ID NO: 81218 - protein, 25 aa, Mycobacterium avium
IPEGLLNYLALLGWAIADDRDVFSL

SEQ ID NO: 81219 - protein, 19 aa, Mycobacterium avium
IPEVRAHALAIGDDLVGRG

SEQ ID NO: 81220 - protein, 19 aa, Mycobacterium avium
IPGAPVIGELVPRGEHTIV

SEQ ID NO: 81221 - protein, 21 aa, Mycobacterium avium
IPGFYTRTGYGTTLAEGKDTR

SEQ ID NO: 81222 - protein, 27 aa, Mycobacterium avium
IPIDLRGDWPAALSAAGFDPAAPTAWL

SEQ ID NO: 81223 - protein, 17 aa, Mycobacterium avium
IPIRAGSDVVLLGALIN

SEQ ID NO: 81224 - protein, 20 aa, Mycobacterium avium
IPLAIARPDLEVVLLEPLLR

SEQ ID NO: 81225 - protein, 20 aa, Mycobacterium avium
IPLDAARVAGVYAAYEALKA

SEQ ID NO: 81226 - protein, 27 aa, Mycobacterium avium
IPPAHRAAIEFAPPLPAEYEQLARHWP

SEQ ID NO: 81227 - protein, 17 aa, Mycobacterium avium
IPPDFSAPFDREIGLQF

SEQ ID NO: 81228 - protein, 23 aa, Mycobacterium avium
IPPELRPMVQLDGGRFATSDLND

SEQ ID NO: 81229 - protein, 22 aa, Mycobacterium avium
IPPERLRYAPGQFLTLRVPSER

SEQ ID NO: 81230 - protein, 18 aa, Mycobacterium avium
IPQFLAIAREAAERATGL

SEQ ID NO: 81231 - protein, 19 aa, Mycobacterium avium
IPQPIAWPGSSDRNFYDRS

SEQ ID NO: 81232 - protein, 21 aa, Mycobacterium avium
IPRAHRGIVAVNELPDLAERI

SEQ ID NO: 81233 - protein, 25 aa, Mycobacterium avium
IPRSEYRIDDVWHVVGLRGTGSNTV

SEQ ID NO: 81234 - protein, 28 aa, Mycobacterium avium
IPSYKACFLAMVRRFYELGVKDLNGHLL

SEQ ID NO: 81235 - protein, 22 aa, Mycobacterium avium
IPTTRHIPAFKLTRSSAAYWRG

SEQ ID NO: 81236 - protein, 17 aa, Mycobacterium avium
IPVDSIYSPVLKVTYKV

SEQ ID NO: 81237 - protein, 20 aa, Mycobacterium avium
IPVRRSWRLNERHYGALQGL

SEQ ID NO: 81238 - protein, 25 aa, Mycobacterium avium
IQAIKGVEIGDGFATARRRGSQAHD

SEQ ID NO: 81239 - protein, 26 aa, Mycobacterium avium
IQAQDFFFRKIVRDKGVALAHVSEQI

SEQ ID NO: 81240 - protein, 20 aa, Mycobacterium avium
IQDGPGWWTARAAIQQTAHA

SEQ ID NO: 81241 - protein, 23 aa, Mycobacterium avium
IQDGRLHYVYNFLGERQQEVSSS

SEQ ID NO: 81242 - protein, 19 aa, Mycobacterium avium
IQEALKAAAIISGVAQAIV

SEQ ID NO: 81243 - protein, 26 aa, Mycobacterium avium
IQGHASPGIYARAFLEGRLTADQLDG

SEQ ID NO: 81244 - protein, 26 aa, Mycobacterium avium
IQIPVGPRLGNVVVEVEHLDKGYDGR

SEQ ID NO: 81245 - protein, 20 aa, Mycobacterium avium
IQLAEWEWPENPRFLMCTPL

SEQ ID NO: 81246 - protein, 24 aa, Mycobacterium avium
IQNYGDVAYGWAMEDTTGVVKLIA

SEQ ID NO: 81247 - protein, 22 aa, Mycobacterium avium
IQRRAEAGIGLTSPELCTLMAH

SEQ ID NO: 81248 - protein, 18 aa, Mycobacterium avium
IQTAFIYDHFTPFVFVQL

SEQ ID NO: 81249 - protein, 21 aa, Mycobacterium avium
IRADLAIVKAWKGDKAGNLVY

SEQ ID NO: 81250 - protein, 19 aa, Mycobacterium avium
IRADLPPERCVSLGYTDPD

SEQ ID NO: 81251 - protein, 19 aa, Mycobacterium avium
IRAGAVWVAANIDLTLPTE

SEQ ID NO: 81252 - protein, 18 aa, Mycobacterium avium
IRAGLGSSVPDFWEGELQ

SEQ ID NO: 81253 - protein, 25 aa, Mycobacterium avium
IRDFARASFKYGLNAKWPVYLSTKN

SEQ ID NO: 81254 - protein, 21 aa, Mycobacterium avium
IRGADVFLGLSGGVVPEEMIA

SEQ ID NO: 81255 - protein, 17 aa, Mycobacterium avium
IRGEIDRVGAGEWPVED

SEQ ID NO: 81256 - protein, 18 aa, Mycobacterium avium
IRGEVLRILAGVDGEIRR

SEQ ID NO: 81257 - protein, 25 aa, Mycobacterium avium
IRGLPPKRRYEVLKALNDDRLADIL

SEQ ID NO: 81258 - protein, 19 aa, Mycobacterium avium
IRHVARFCELLGVESAHFV

SEQ ID NO: 81259 - protein, 20 aa, Mycobacterium avium
IRIGAPASWTAAVDAQQQSH

SEQ ID NO: 81260 - protein, 17 aa, Mycobacterium avium
IRKPPELSWEVAGSLYV

SEQ ID NO: 81261 - protein, 18 aa, Mycobacterium avium
IRLAVDAVEDMFRLPDLT

SEQ ID NO: 81262 - protein, 18 aa, Mycobacterium avium
IRLEGKSVLISDSERLAR

SEQ ID NO: 81263 - protein, 17 aa, Mycobacterium avium
IRLLKLPIAVQRRVAAG

SEQ ID NO: 81264 - protein, 29 aa, Mycobacterium avium
IRNVWRFWYQIPISLPVIGPRVISTPDSR

SEQ ID NO: 81265 - protein, 18 aa, Mycobacterium avium
IRQDIDWMDYLDRPTGPR

SEQ ID NO: 81266 - protein, 27 aa, Mycobacterium avium
IRREAAKPGSYRWLKGGQRVPADERVG

SEQ ID NO: 81267 - protein, 20 aa, Mycobacterium avium
IRRKAMEELHRIRKDGEAGE

SEQ ID NO: 81268 - protein, 18 aa, Mycobacterium avium
IRSCGAPILTLRTDRDWI

SEQ ID NO: 81269 - protein, 34 aa, Mycobacterium avium
IRSKGDSADGVWSRMKFEGGVHRVQRVPVTESQG

SEQ ID NO: 81270 - protein, 19 aa, Mycobacterium avium
IRSRIRFNTKVLAAEFDDE

SEQ ID NO: 81271 - protein, 18 aa, Mycobacterium avium
IRTIAGVYRDEAGKATNI

SEQ ID NO: 81272 - protein, 29 aa, Mycobacterium avium
IRTLPQILSEAGWYSALFGMQHETSYPKR

SEQ ID NO: 81273 - protein, 18 aa, Mycobacterium avium
IRTLSALALLDTEVLLPG

SEQ ID NO: 81274 - protein, 27 aa, Mycobacterium avium
IRVDGWPGQQFALLFVDWLTADPDARA

SEQ ID NO: 81275 - protein, 23 aa, Mycobacterium avium
IRVLRPGGRFVFAGEPTSAGDVY

SEQ ID NO: 81276 - protein, 22 aa, Mycobacterium avium
IRVRILPTWLRLDARFGSVYRR

SEQ ID NO: 81277 - protein, 22 aa, Mycobacterium avium
IRWAEHALAVIARRLPTTDADS

SEQ ID NO: 81278 - protein, 22 aa, Mycobacterium avium
IRWMGSGPLTGLAEIALPDLQP

SEQ ID NO: 81279 - protein, 20 aa, Mycobacterium avium
IRYLMFSVFAVRPGALGDQR

SEQ ID NO: 81280 - protein, 19 aa, Mycobacterium avium
IRYTELRPFVLHVNHTGAR

SEQ ID NO: 81281 - protein, 19 aa, Mycobacterium avium
ISAAGGRAVVMTYWNPVLR

SEQ ID NO: 81282 - protein, 22 aa, Mycobacterium avium
ISADELRARFGFYFDKFDVRPE

SEQ ID NO: 81283 - protein, 25 aa, Mycobacterium avium
ISAGCAGFGYALGVAADMVRGGTAG

SEQ ID NO: 81284 - protein, 17 aa, Mycobacterium avium
ISAIKAIFAAWEGRARL

SEQ ID NO: 81285 - protein, 21 aa, Mycobacterium avium
ISCVSAGSILRNLDPRRFEVV

SEQ ID NO: 81286 - protein, 18 aa, Mycobacterium avium
ISEAVLFLASDAARYITG

SEQ ID NO: 81287 - protein, 17 aa, Mycobacterium avium
ISEHVRVVVALGGFGWQ

SEQ ID NO: 81288 - protein, 19 aa, Mycobacterium avium
ISEQEWRQHWPAGDTDPEP

SEQ ID NO: 81289 - protein, 21 aa, Mycobacterium avium
ISFQLRQGRTLGIVGESGSGK

SEQ ID NO: 81290 - protein, 26 aa, Mycobacterium avium
ISGAFLAKLGCTFVVVGHSERRTYHN

SEQ ID NO: 81291 - protein, 18 aa, Mycobacterium avium
ISHDRWFLDRTCTHILAW

SEQ ID NO: 81292 - protein, 21 aa, Mycobacterium avium
ISHVYPTGASLYFTVVAGQRG

SEQ ID NO: 81293 - protein, 23 aa, Mycobacterium avium
ISIDLRDDWPAALREGGFDVTRP

SEQ ID NO: 81294 - protein, 25 aa, Mycobacterium avium
ISKAPLVPSMLEWLHTARTSMVMDT

SEQ ID NO: 81295 - protein, 17 aa, Mycobacterium avium
ISKPVGLGFTQGGGENN

SEQ ID NO: 81296 - protein, 22 aa, Mycobacterium avium
ISPSGPRLAGALGTSLLSLSMS

SEQ ID NO: 81297 - protein, 24 aa, Mycobacterium avium
ISQGRLEALLNFQTMVADLTGLEI

SEQ ID NO: 81298 - protein, 24 aa, Mycobacterium avium
ISQNWRLSGLAGEYITPVPAQQRL

SEQ ID NO: 81299 - protein, 20 aa, Mycobacterium avium
ISQPFWPAYITKERFAKARN

SEQ ID NO: 81300 - protein, 22 aa, Mycobacterium avium
ISRLTRRRVRLIARRPDGATLV

SEQ ID NO: 81301 - protein, 18 aa, Mycobacterium avium
ISRTAFLHVDYRKITPID

SEQ ID NO: 81302 - protein, 18 aa, Mycobacterium avium
ISTLPMAVPVNLRAEADT

SEQ ID NO: 81303 - protein, 23 aa, Mycobacterium avium
ISVHVRGSVVLQRLYEKNQSSDV

SEQ ID NO: 81304 - protein, 17 aa, Mycobacterium avium
ITAAGLRESHPHDVAMT

SEQ ID NO: 81305 - protein, 25 aa, Mycobacterium avium
ITEFLQREVQGFLRLAQPPAATSRF

SEQ ID NO: 81306 - protein, 26 aa, Mycobacterium avium
ITEVPMKRFDLMNGIQVRGTYAVSQA

SEQ ID NO: 81307 - protein, 17 aa, Mycobacterium avium
ITGELAADIVLVVNEAC

SEQ ID NO: 81308 - protein, 29 aa, Mycobacterium avium
ITGPHRYPGWPFRIAPGPRRHHRTAPPTL

SEQ ID NO: 81309 - protein, 17 aa, Mycobacterium avium
ITGSARFRNLIKAEDYD

SEQ ID NO: 81310 - protein, 22 aa, Mycobacterium avium
ITIPQFRTLVILSNRGPVNLAT

SEQ ID NO: 81311 - protein, 23 aa, Mycobacterium avium
ITLEAGVSLGAMPIYRFGNEEQK

SEQ ID NO: 81312 - protein, 19 aa, Mycobacterium avium
ITPFNFPAMIPLWKAGPAL

SEQ ID NO: 81313 - protein, 25 aa, Mycobacterium avium
ITRKNGRGETEWIPPPHLDHGRPRT

SEQ ID NO: 81314 - protein, 28 aa, Mycobacterium avium
ITRKNGRGETEWIPPPHLERGQPRVNSF

SEQ ID NO: 81315 - protein, 18 aa, Mycobacterium avium
ITSVKVRSVLTCTTGTGV

SEQ ID NO: 81316 - protein, 26 aa, Mycobacterium avium
ITTWAPRSTGAIAYRALAREFIDRFG

SEQ ID NO: 81317 - protein, 30 aa, Mycobacterium avium
ITVEPWVPLPEFWVRRARKKILHAALEGLR

SEQ ID NO: 81318 - protein, 23 aa, Mycobacterium avium
ITVPEFPNFFIIYGPGTHLAHGG

SEQ ID NO: 81319 - protein, 20 aa, Mycobacterium avium
ITVRAANFGNLYLADDRQGR

SEQ ID NO: 81320 - protein, 24 aa, Mycobacterium avium
IVARVVSMPCVEWFESQPDDYRDS

SEQ ID NO: 81321 - protein, 18 aa, Mycobacterium avium
IVDLCTGSGALAVALAHH

SEQ ID NO: 81322 - protein, 25 aa, Mycobacterium avium
IVDRALQRWGHIDFLINNAGVGSPK

SEQ ID NO: 81323 - protein, 24 aa, Mycobacterium avium
IVEEPPEHLIFIFATTEPEKVLPT

SEQ ID NO: 81324 - protein, 20 aa, Mycobacterium avium
IVEICRMVWRRERVQYAGRH

SEQ ID NO: 81325 - protein, 25 aa, Mycobacterium avium
IVEPKYWGGVCLNVGCIPSKALLRN

SEQ ID NO: 81326 - protein, 17 aa, Mycobacterium avium
IVGFRIPYIKGKDTEPL

SEQ ID NO: 81327 - protein, 24 aa, Mycobacterium avium
IVGRIKDLLIINGRNHYPEDIEAT

SEQ ID NO: 81328 - protein, 34 aa, Mycobacterium avium
IVHSHYWLSGQVGWLARDRWAVPLVHTAHTLAAV

SEQ ID NO: 81329 - protein, 18 aa, Mycobacterium avium
IVIELKRDAVAKVVLNNL

SEQ ID NO: 81330 - protein, 18 aa, Mycobacterium avium
IVRDLRREFDWLGVALQA

SEQ ID NO: 81331 - protein, 22 aa, Mycobacterium avium
IVRFYADLLRSYPFTEDLGEKE

SEQ ID NO: 81332 - protein, 18 aa, Mycobacterium avium
IVTWVLAGALAHQDSTGN

SEQ ID NO: 81333 - protein, 18 aa, Mycobacterium avium
IVVARLAKGLTWQELADA

SEQ ID NO: 81334 - protein, 19 aa, Mycobacterium avium
IVVREGLSADLARALHDDA

SEQ ID NO: 81335 - protein, 19 aa, Mycobacterium avium
IWEPGWFLTYHYWPTAVDR

SEQ ID NO: 81336 - protein, 19 aa, Mycobacterium avium
IWGFPKIMADFTVREQGRF

SEQ ID NO: 81337 - protein, 19 aa, Mycobacterium avium
IWKMIKENLILPYLDIDLD

SEQ ID NO: 81338 - protein, 17 aa, Mycobacterium avium
IWYPMVYDMPARAKESF

SEQ ID NO: 81339 - protein, 25 aa, Mycobacterium avium
IYCRPSCPVRPPFARNVRFYPTAAA

SEQ ID NO: 81340 - protein, 18 aa, Mycobacterium avium
IYQFRISPHPTIELASTP

SEQ ID NO: 81341 - protein, 19 aa, Mycobacterium avium
IYSFLRLLLPAGLETTYRS

SEQ ID NO: 81342 - protein, 19 aa, Mycobacterium avium
IYSFLRLLLPAGVETTYRA

SEQ ID NO: 81343 - protein, 18 aa, Mycobacterium avium
IYTRRMQRALGYEGDDVI

SEQ ID NO: 81344 - protein, 18 aa, Mycobacterium avium
IYVDRIIQGIGYEKRIEF

SEQ ID NO: 81345 - protein, 17 aa, Mycobacterium avium
IYVKDGIITWETQQTDY

SEQ ID NO: 81346 - protein, 20 aa, Mycobacterium avium
IYVPRLTRRSGQPAAAALTL

SEQ ID NO: 81347 - protein, 30 aa, Mycobacterium avium
KAAAAGRPWWEWAATYERAFSAAYDALDVL

SEQ ID NO: 81348 - protein, 25 aa, Mycobacterium avium
KAAAEGRLKGILKYYDAPIVSSDIV

SEQ ID NO: 81349 - protein, 17 aa, Mycobacterium avium
KAALRALIPHLKRKEDR

SEQ ID NO: 81350 - protein, 21 aa, Mycobacterium avium
KAALVGSMSVPQGWTEAAPAI

SEQ ID NO: 81351 - protein, 31 aa, Mycobacterium avium
KADFWFDPLCPWAWITSRWILEVEKVRDIEV

SEQ ID NO: 81352 - protein, 32 aa, Mycobacterium avium
KADLPRHIAVLCDGNRRWARDAGYDDVSYGYR

SEQ ID NO: 81353 - protein, 25 aa, Mycobacterium avium
KAEAALRERFGYDAWVLVYDLDTVR

SEQ ID NO: 81354 - protein, 18 aa, Mycobacterium avium
KAFSMLRNHYSVVLVDCV

SEQ ID NO: 81355 - protein, 24 aa, Mycobacterium avium
KAGEGDAFISAGVETVSRFPKGSA

SEQ ID NO: 81356 - protein, 22 aa, Mycobacterium avium
KAGIERRALRVILGNPLIAITM

SEQ ID NO: 81357 - protein, 30 aa, Mycobacterium avium
KAGMHLVEMRARHAALRFGDRAQAARVDEL

SEQ ID NO: 81358 - protein, 18 aa, Mycobacterium avium
KAIGYGMPGIRVDGNDVL

SEQ ID NO: 81359 - protein, 23 aa, Mycobacterium avium
KAKAQQLGLSWLAEIGAHGVVAG

SEQ ID NO: 81360 - protein, 18 aa, Mycobacterium avium
KALAGGGGRGMRKVHNAA

SEQ ID NO: 81361 - protein, 24 aa, Mycobacterium avium
KALEFRPKVIIAGWSAYPRVLDFA

SEQ ID NO: 81362 - protein, 20 aa, Mycobacterium avium
KALERFPISRVVSSPQRRAV

SEQ ID NO: 81363 - protein, 30 aa, Mycobacterium avium
KALEVREGPAALPWGDLGVDVVVESTGLFT

SEQ ID NO: 81364 - protein, 17 aa, Mycobacterium avium
KALGHAYGGGSQYYSMW

SEQ ID NO: 81365 - protein, 18 aa, Mycobacterium avium
KALRHARTILAAHDTALD

SEQ ID NO: 81366 - protein, 17 aa, Mycobacterium avium
KAMADRTLAEFGGIDYL

SEQ ID NO: 81367 - protein, 18 aa, Mycobacterium avium
KAMLQDMAILTGGQVISE

SEQ ID NO: 81368 - protein, 27 aa, Mycobacterium avium
KAMYANKAVPCWMIFDDGYVRRYVTSA

SEQ ID NO: 81369 - protein, 19 aa, Mycobacterium avium
KAPEAFPSDPVEMVKNRIH

SEQ ID NO: 81370 - protein, 21 aa, Mycobacterium avium
KAPKDRDIAMVFQSYALYPHM

SEQ ID NO: 81371 - protein, 19 aa, Mycobacterium avium
KARAGEIKGFTGIDDPYEA

SEQ ID NO: 81372 - protein, 17 aa, Mycobacterium avium
KARANRTPIDWDGYTPP

SEQ ID NO: 81373 - protein, 24 aa, Mycobacterium avium
KARVRALGVAGAFHTKYMASALDG

SEQ ID NO: 81374 - protein, 22 aa, Mycobacterium avium
KARYELALLAGRDPELAAALSE

SEQ ID NO: 81375 - protein, 26 aa, Mycobacterium avium
KASGLTARAGLLCLPTLSTHGYEVVA

SEQ ID NO: 81376 - protein, 26 aa, Mycobacterium avium
KATALREFAQRAGVPMAQTVAVGDGA

SEQ ID NO: 81377 - protein, 18 aa, Mycobacterium avium
KATFDVRVTAPRHWKVIS

SEQ ID NO: 81378 - protein, 21 aa, Mycobacterium avium
KATPEMVAFMVRYTSGYLCVP

SEQ ID NO: 81379 - protein, 26 aa, Mycobacterium avium
KATQEDPWRHFARTHAIGQIVPGKVT

SEQ ID NO: 81380 - protein, 17 aa, Mycobacterium avium
KATRDEIFVDLKQRVAA

SEQ ID NO: 81381 - protein, 17 aa, Mycobacterium avium
KAVRPARGRPPVAEADD

SEQ ID NO: 81382 - protein, 25 aa, Mycobacterium avium
KAVWWQRAVEAWPDYAEYQTKTDRQ

SEQ ID NO: 81383 - protein, 24 aa, Mycobacterium avium
KAYRVAGYRAGWLAITGPKDHAGS

SEQ ID NO: 81384 - protein, 32 aa, Mycobacterium avium
KCDPWGLDSFQLFPNFVILFWGQGWYLTYHYW

SEQ ID NO: 81385 - protein, 27 aa, Mycobacterium avium
KCQQVWCPVCALAALATGDQHPLLTAI

SEQ ID NO: 81386 - protein, 29 aa, Mycobacterium avium
KDAMAREVRRGGLPLQRLVNAESMSAVAR

SEQ ID NO: 81387 - protein, 25 aa, Mycobacterium avium
KDEKVEFVDVRFCDLPGIMQHFTIP

SEQ ID NO: 81388 - protein, 19 aa, Mycobacterium avium
KDGKRSLVVAGIKNCETMR

SEQ ID NO: 81389 - protein, 21 aa, Mycobacterium avium
KDGRPFPPWTDPESAFEAWKK

SEQ ID NO: 81390 - protein, 19 aa, Mycobacterium avium
KDICVRGMEIRTFMTDRPD

SEQ ID NO: 81391 - protein, 24 aa, Mycobacterium avium
KDIDFAFAVGQLFATVPYAQLILE

SEQ ID NO: 81392 - protein, 24 aa, Mycobacterium avium
KDLEIATAAPLRAVIETGIAQGVF

SEQ ID NO: 81393 - protein, 18 aa, Mycobacterium avium
KDLIKQFADHLPGDPRKV

SEQ ID NO: 81394 - protein, 21 aa, Mycobacterium avium
KDLPAATGDDIVWADAVIFGS

SEQ ID NO: 81395 - protein, 22 aa, Mycobacterium avium
KDLPGRLAAAGFADIHADARGG

SEQ ID NO: 81396 - protein, 18 aa, Mycobacterium avium
KDLSLALALGEAVSVDLP

SEQ ID NO: 81397 - protein, 25 aa, Mycobacterium avium
KDRFGAEIRTHYPLELSAEVGVIAQ

SEQ ID NO: 81398 - protein, 21 aa, Mycobacterium avium
KEESVGFLFNVTVEAVPAPQV

SEQ ID NO: 81399 - protein, 27 aa, Mycobacterium avium
KEFELLKYLAQHAGRVFTRAQLLHEVW

SEQ ID NO: 81400 - protein, 21 aa, Mycobacterium avium
KEFFTTLFMQQQWLRGGAEAG

SEQ ID NO: 81401 - protein, 18 aa, Mycobacterium avium
KEGAFRPGASRLLHELAP

SEQ ID NO: 81402 - protein, 23 aa, Mycobacterium avium
KEHKALVIKGGYMDGRALSVAEV

SEQ ID NO: 81403 - protein, 23 aa, Mycobacterium avium
KEHPANFGRLCTKGATTADLLAA

SEQ ID NO: 81404 - protein, 24 aa, Mycobacterium avium
KEIGPRIVPIIPDEARTFGMDSWF

SEQ ID NO: 81405 - protein, 25 aa, Mycobacterium avium
KEILEYHWGPDWVVYDAKGTSQQHG

SEQ ID NO: 81406 - protein, 27 aa, Mycobacterium avium
KEKGPRFALAGSYALWAYGAPEPSHDA

SEQ ID NO: 81407 - protein, 19 aa, Mycobacterium avium
KEKVMGFGHRVYKNGDSRV

SEQ ID NO: 81408 - protein, 19 aa, Mycobacterium avium
KELAEICGHVAGLPLDRDH

SEQ ID NO: 81409 - protein, 19 aa, Mycobacterium avium
KELAFPNAVLALFHYPDKT

SEQ ID NO: 81410 - protein, 18 aa, Mycobacterium avium
KELERMRLASARAAAGNA

SEQ ID NO: 81411 - protein, 23 aa, Mycobacterium avium
KELRNGSTVALVYLSPAAKPAAT

SEQ ID NO: 81412 - protein, 23 aa, Mycobacterium avium
KEMQRTEGFTALIDANRGCFAAF

SEQ ID NO: 81413 - protein, 19 aa, Mycobacterium avium
KEPVLSRVVEYWYNIDADI

SEQ ID NO: 81414 - protein, 23 aa, Mycobacterium avium
KEPWFRDAYRRAWDWADSTGWKP

SEQ ID NO: 81415 - protein, 18 aa, Mycobacterium avium
KERLLELLPNRVITDSIG

SEQ ID NO: 81416 - protein, 19 aa, Mycobacterium avium
KERPRVIAVDAVPNEVNST

SEQ ID NO: 81417 - protein, 18 aa, Mycobacterium avium
KERQRLGLEAAYCAETVA

SEQ ID NO: 81418 - protein, 18 aa, Mycobacterium avium
KFADEFHPELQFDRPYLL

SEQ ID NO: 81419 - protein, 24 aa, Mycobacterium avium
KFGKSTGGGSLWLDPALTTPYAWY

SEQ ID NO: 81420 - protein, 32 aa, Mycobacterium avium
KFQKELAAMGFKFQFITLAGFHALNYSMFDLA

SEQ ID NO: 81421 - protein, 19 aa, Mycobacterium avium
KGACAQVNKDLGLLAPEKA

SEQ ID NO: 81422 - protein, 18 aa, Mycobacterium avium
KGADEIRALAGRVDTARH

SEQ ID NO: 81423 - protein, 20 aa, Mycobacterium avium
KGAIRQIDFLTRATAQRPDA

SEQ ID NO: 81424 - protein, 29 aa, Mycobacterium avium
KGASRRARRAGKIPAVLYGHGTDPQHLEL

SEQ ID NO: 81425 - protein, 19 aa, Mycobacterium avium
KGCAISSSTCALVLAELER

SEQ ID NO: 81426 - protein, 23 aa, Mycobacterium avium
KGDPTLLTWEIYRDTVIEQCEQG

SEQ ID NO: 81427 - protein, 19 aa, Mycobacterium avium
KGEASLWLEEFRGEVTATM

SEQ ID NO: 81428 - protein, 21 aa, Mycobacterium avium
KGGGHKRAYRVIDFRRNDKDG

SEQ ID NO: 81429 - protein, 23 aa, Mycobacterium avium
KGGPGMREMLAITGAIKGAGLGK

SEQ ID NO: 81430 - protein, 19 aa, Mycobacterium avium
KGKVRLGRLANILRDKRIP

SEQ ID NO: 81431 - protein, 21 aa, Mycobacterium avium
KGLPGAEGRLKVAPPKPSKLE

SEQ ID NO: 81432 - protein, 18 aa, Mycobacterium avium
KGLTWQELADAIGRPLLW

SEQ ID NO: 81433 - protein, 23 aa, Mycobacterium avium
KGNEIACPFHDWRWGGDGRCKQV

SEQ ID NO: 81434 - protein, 17 aa, Mycobacterium avium
KGQLLSLHLGRLKDSTG

SEQ ID NO: 81435 - protein, 19 aa, Mycobacterium avium
KGSELMDKWVGSSEKAVRE

SEQ ID NO: 81436 - protein, 22 aa, Mycobacterium avium
KGSPQRRGVCTRVYTTTPKKPN

SEQ ID NO: 81437 - protein, 19 aa, Mycobacterium avium
KGVDAVVVPGGFSYGDYLR

SEQ ID NO: 81438 - protein, 17 aa, Mycobacterium avium
KGVPCLIAVDQDPTGKG

SEQ ID NO: 81439 - protein, 22 aa, Mycobacterium avium
KGWTLAEAERWLAPNLGYNPED

SEQ ID NO: 81440 - protein, 28 aa, Mycobacterium avium
KHGAKMVTAVACARVPKLTVVIGGSYGA

SEQ ID NO: 81441 - protein, 25 aa, Mycobacterium avium
KHKFADMKLWLEACRATTWAAVAEV

SEQ ID NO: 81442 - protein, 24 aa, Mycobacterium avium
KHLDECPPCLVYLQQMLDLKILLR

SEQ ID NO: 81443 - protein, 18 aa, Mycobacterium avium
KHPHHMAEWSPASRTHVA

SEQ ID NO: 81444 - protein, 18 aa, Mycobacterium avium
KHRMADLYVTVAAAKAVV

SEQ ID NO: 81445 - protein, 26 aa, Mycobacterium avium
KHVAERAGVTWGVIQYHFGDRNGLLM

SEQ ID NO: 81446 - protein, 23 aa, Mycobacterium avium
KIAAGELHFSIGYSEPGAGTDLA

SEQ ID NO: 81447 - protein, 24 aa, Mycobacterium avium
KIALGTALARLGMFAPALSYLEEP

SEQ ID NO: 81448 - protein, 19 aa, Mycobacterium avium
KIAVASFFAKNFLPMLTST

SEQ ID NO: 81449 - protein, 19 aa, Mycobacterium avium
KIDDHTAWRLLEGLDDIAL

SEQ ID NO: 81450 - protein, 17 aa, Mycobacterium avium
KIFADNLETAFFMSQAV

SEQ ID NO: 81451 - protein, 31 aa, Mycobacterium avium
KIFDVNLWAPLLWTSLAVKSWMGEHGGSIVN

SEQ ID NO: 81452 - protein, 40 aa, Mycobacterium avium
KIFGPTRDWECYCGKYKRVRFKGIICERCGVEVTRAKVRR

SEQ ID NO: 81453 - protein, 33 aa, Mycobacterium avium
KIGGARRCAAQSWPLERIKNVKNAAGVTVNDVV

SEQ ID NO: 81454 - protein, 23 aa, Mycobacterium avium
KIISLELRGCFAMTETGHGSDVQ

SEQ ID NO: 81455 - protein, 25 aa, Mycobacterium avium
KINEPRFPSFKGIMAAKKKEVTVLT

SEQ ID NO: 81456 - protein, 20 aa, Mycobacterium avium
KIPGRLFAGPMLAMPSGSSA

SEQ ID NO: 81457 - protein, 22 aa, Mycobacterium avium
KKCGHLGGKVLIPTQQHIRTLT

SEQ ID NO: 81458 - protein, 20 aa, Mycobacterium avium
KKDMFIVGGFNAYPAEIEGF

SEQ ID NO: 81459 - protein, 21 aa, Mycobacterium avium
KKGYHVTWVLSQGSNKANEGL

SEQ ID NO: 81460 - protein, 17 aa, Mycobacterium avium
KKHFRPEFLNRIDDIIV

SEQ ID NO: 81461 - protein, 20 aa, Mycobacterium avium
KKIKEKLGIGAVVTDDLSDD

SEQ ID NO: 81462 - protein, 31 aa, Mycobacterium avium
KKLSFETARFIKFIVTEIFPGGRLPSTQMMV

SEQ ID NO: 81463 - protein, 18 aa, Mycobacterium avium
KKPRPMVDAMFFGSSSNQ

SEQ ID NO: 81464 - protein, 18 aa, Mycobacterium avium
KKQLLLDALADKLQVQVG

SEQ ID NO: 81465 - protein, 21 aa, Mycobacterium avium
KKQVRCVYVAIGQKGTTIASV

SEQ ID NO: 81466 - protein, 26 aa, Mycobacterium avium
KKVALWRVLVALSIRHVGPTAARALA

SEQ ID NO: 81467 - protein, 18 aa, Mycobacterium avium
KKVEAGWVSVLRSDATPT

SEQ ID NO: 81468 - protein, 19 aa, Mycobacterium avium
KKVNQLRAFEGYNDPHTPE

SEQ ID NO: 81469 - protein, 18 aa, Mycobacterium avium
KKVSVPMVPGETLLETAR

SEQ ID NO: 81470 - protein, 18 aa, Mycobacterium avium
KLAANRPGTFLLESAEHG

SEQ ID NO: 81471 - protein, 18 aa, Mycobacterium avium
KLAERKRRESAADLASPA

SEQ ID NO: 81472 - protein, 19 aa, Mycobacterium avium
KLAPKGTGAVLSFELAGGV

SEQ ID NO: 81473 - protein, 17 aa, Mycobacterium avium
KLCDGGLGAHLLLGRGE

SEQ ID NO: 81474 - protein, 20 aa, Mycobacterium avium
KLDALSWVNVNALDQFSDEF

SEQ ID NO: 81475 - protein, 24 aa, Mycobacterium avium
KLEELKALWFAEAARYNGLPLSDL

SEQ ID NO: 81476 - protein, 36 aa, Mycobacterium avium
KLGELRPLYRPGLFHMYHALTWGPLVREIVYAATGK

SEQ ID NO: 81477 - protein, 17 aa, Mycobacterium avium
KLIADKMFEEFKEPQYG

SEQ ID NO: 81478 - protein, 19 aa, Mycobacterium avium
KLKELIPRQQFEVPVQAAI

SEQ ID NO: 81479 - protein, 24 aa, Mycobacterium avium
KLLQRPEEVAARRGLPIEDVAPAG

SEQ ID NO: 81480 - protein, 24 aa, Mycobacterium avium
KLQLWVAACLYRYFVDQHEFLHGP

SEQ ID NO: 81481 - protein, 25 aa, Mycobacterium avium
KLRALKRLKVVAAFQQSGNSPMGMV

SEQ ID NO: 81482 - protein, 18 aa, Mycobacterium avium
KLRARADALAAIRAGIDG

SEQ ID NO: 81483 - protein, 21 aa, Mycobacterium avium
KLRHALPGAVFVSAATGDGID

SEQ ID NO: 81484 - protein, 17 aa, Mycobacterium avium
KLRIEVVNRGFSPGQNH

SEQ ID NO: 81485 - protein, 23 aa, Mycobacterium avium
KLRRLPAEAARELALTQLDRVGL

SEQ ID NO: 81486 - protein, 26 aa, Mycobacterium avium
KLSAEAGAILGRWCTALTRAFVNDGF

SEQ ID NO: 81487 - protein, 17 aa, Mycobacterium avium
KLSVGLGRLAAEDPTLR

SEQ ID NO: 81488 - protein, 18 aa, Mycobacterium avium
KLTGEIQPGVTATDVVLT

SEQ ID NO: 81489 - protein, 19 aa, Mycobacterium avium
KLVALRAYWEMDRAAANTK

SEQ ID NO: 81490 - protein, 24 aa, Mycobacterium avium
KLVIPMRVIMSVAAILCQLDAHVP

SEQ ID NO: 81491 - protein, 20 aa, Mycobacterium avium
KLVIRDLLGRLGVGSDTVRT

SEQ ID NO: 81492 - protein, 18 aa, Mycobacterium avium
KLVLVRPAPVPGLVKPRS

SEQ ID NO: 81493 - protein, 18 aa, Mycobacterium avium
KLVREIRALTGTGEPDDK

SEQ ID NO: 81494 - protein, 22 aa, Mycobacterium avium
KLYRARFLFFGSGYYNYDEGYT

SEQ ID NO: 81495 - protein, 21 aa, Mycobacterium avium
KMAVICLIGAMLVEDGHSDDQ

SEQ ID NO: 81496 - protein, 18 aa, Mycobacterium avium
KMDALTRVLEVEPFEAMI

SEQ ID NO: 81497 - protein, 19 aa, Mycobacterium avium
KMEDGLRLGAKHYHATADP

SEQ ID NO: 81498 - protein, 20 aa, Mycobacterium avium
KMFNCTGWKIGWACGPAHLI

SEQ ID NO: 81499 - protein, 22 aa, Mycobacterium avium
KMKAGDKVALWYNSANRDESTF

SEQ ID NO: 81500 - protein, 18 aa, Mycobacterium avium
KMSAEVFETMFGASDFHI

SEQ ID NO: 81501 - protein, 17 aa, Mycobacterium avium
KMTKRGGGAIVNQSSTA

SEQ ID NO: 81502 - protein, 18 aa, Mycobacterium avium
KMWASSMNIAGAGWSGQA

SEQ ID NO: 81503 - protein, 24 aa, Mycobacterium avium
KMWMARLYPTYERNTCLISNGLST

SEQ ID NO: 81504 - protein, 20 aa, Mycobacterium avium
KNARQHISFGRGIHSCPGAP

SEQ ID NO: 81505 - protein, 26 aa, Mycobacterium avium
KNGQRFRAGVALSVFTDDAGSAIGFT

SEQ ID NO: 81506 - protein, 21 aa, Mycobacterium avium
KNHPACLEVLIGGASVGAVTT

SEQ ID NO: 81507 - protein, 21 aa, Mycobacterium avium
KNIDTGMGVERVAFVLQGVHN

SEQ ID NO: 81508 - protein, 25 aa, Mycobacterium avium
KNNVKRAWELMGMRVHLQVSHILTN

SEQ ID NO: 81509 - protein, 25 aa, Mycobacterium avium
KNPQRVLGLHFFNPVPVLPLVELVS

SEQ ID NO: 81510 - protein, 20 aa, Mycobacterium avium
KNPRSALLHRRIDVDFNGWW

SEQ ID NO: 81511 - protein, 23 aa, Mycobacterium avium
KPAPCPRITLVHGDAKPGNFAFT

SEQ ID NO: 81512 - protein, 18 aa, Mycobacterium avium
KPAVVAFDHAYHGRTNLA

SEQ ID NO: 81513 - protein, 20 aa, Mycobacterium avium
KPDDAPDCEVFTVAPNFAFE

SEQ ID NO: 81514 - protein, 19 aa, Mycobacterium avium
KPGLPLSLTKPLGIGVLNN

SEQ ID NO: 81515 - protein, 28 aa, Mycobacterium avium
KPGVLARVAALFSRRGFNIESLAVGATE

SEQ ID NO: 81516 - protein, 25 aa, Mycobacterium avium
KPIEIREFLEGYVIGQDTAKRTLAV

SEQ ID NO: 81517 - protein, 20 aa, Mycobacterium avium
KPLLANVETLRCWLDDEREE

SEQ ID NO: 81518 - protein, 19 aa, Mycobacterium avium
KPLQPRGDRSYLITGGLGA

SEQ ID NO: 81519 - protein, 24 aa, Mycobacterium avium
KPMEIPYPVLWRNLTQVVAAILEQ

SEQ ID NO: 81520 - protein, 20 aa, Mycobacterium avium
KPSASKGRYLKKITVSTTTG

SEQ ID NO: 81521 - protein, 21 aa, Mycobacterium avium
KPSEVDIVFSTTVTGLAVPTL

SEQ ID NO: 81522 - protein, 19 aa, Mycobacterium avium
KPSMPLWSYPVEIALTADT

SEQ ID NO: 81523 - protein, 19 aa, Mycobacterium avium
KPTPAGGEFDQLVASVARR

SEQ ID NO: 81524 - protein, 30 aa, Mycobacterium avium
KPTSVPAFRPGAQFKAVVSGAQRLPSEGPA

SEQ ID NO: 81525 - protein, 31 aa, Mycobacterium avium
KPVIGTVMRQGYKLGDQVLRHALVGVVDTVT

SEQ ID NO: 81526 - protein, 24 aa, Mycobacterium avium
KPWLPHFYLGHGIGVNAAEMPMIG

SEQ ID NO: 81527 - protein, 27 aa, Mycobacterium avium
KQAEAYRAISLLLRRPPGREAYPGDVF

SEQ ID NO: 81528 - protein, 24 aa, Mycobacterium avium
KQAKDRLLELSIAMHSTGPDVMGR

SEQ ID NO: 81529 - protein, 25 aa, Mycobacterium avium
KQFPEELGKMGFVFNFITYGGHQID

SEQ ID NO: 81530 - protein, 18 aa, Mycobacterium avium
KQHCPRRVDVYFDNVGGP

SEQ ID NO: 81531 - protein, 18 aa, Mycobacterium avium
KQLRARSSVPVIMVTARD

SEQ ID NO: 81532 - protein, 24 aa, Mycobacterium avium
KQNEEFMWRLADRQLDEFLHNGEC

SEQ ID NO: 81533 - protein, 19 aa, Mycobacterium avium
KQQLDHWARVGRAVSSQHT

SEQ ID NO: 81534 - protein, 24 aa, Mycobacterium avium
KQRAFEVLDKLTLIDISNNLGDAK

SEQ ID NO: 81535 - protein, 26 aa, Mycobacterium avium
KQRGEPVSCFLLRIEDNMESIGRSIN

SEQ ID NO: 81536 - protein, 22 aa, Mycobacterium avium
KQVALHHPGNWTVGGMAKGAGM

SEQ ID NO: 81537 - protein, 17 aa, Mycobacterium avium
KQVRLPGFRPGKAPAKL

SEQ ID NO: 81538 - protein, 17 aa, Mycobacterium avium
KRDEVLADMAAQQEALE

SEQ ID NO: 81539 - protein, 30 aa, Mycobacterium avium
KRDSEWMGRVHRFLGLDVGVILAQMTPDER

SEQ ID NO: 81540 - protein, 19 aa, Mycobacterium avium
KREDLQIVRSYKLRGAYNL

SEQ ID NO: 81541 - protein, 24 aa, Mycobacterium avium
KRGGLPWDAVFAAEMAGVFKPDPA

SEQ ID NO: 81542 - protein, 20 aa, Mycobacterium avium
KRIQQEWGVSDEVMRDLVNA

SEQ ID NO: 81543 - protein, 24 aa, Mycobacterium avium
KRKFLPRCAAGAISAFLLTEPDVG

SEQ ID NO: 81544 - protein, 18 aa, Mycobacterium avium
KRKIIGRQFIRAFEGAVR

SEQ ID NO: 81545 - protein, 20 aa, Mycobacterium avium
KRMALPNARVLIHQPSLQGV

SEQ ID NO: 81546 - protein, 18 aa, Mycobacterium avium
KRMRLRGSRPLSVVITRI

SEQ ID NO: 81547 - protein, 18 aa, Mycobacterium avium
KRPATPIFTPGRITLQSV

SEQ ID NO: 81548 - protein, 32 aa, Mycobacterium avium
KRPSYSLKEIRHWLQVFVQRFYSFSQFKRSAL

SEQ ID NO: 81549 - protein, 17 aa, Mycobacterium avium
KRRAAAVSHAVNVSVPV

SEQ ID NO: 81550 - protein, 18 aa, Mycobacterium avium
KRRIMIGTYALSAGYYDA

SEQ ID NO: 81551 - protein, 20 aa, Mycobacterium avium
KRSPAGKPDYRWAKEQTEAR

SEQ ID NO: 81552 - protein, 24 aa, Mycobacterium avium
KRSPEEVRFLMGFNRDVVRMRRVN

SEQ ID NO: 81553 - protein, 19 aa, Mycobacterium avium
KRTGVPISTHTHAGLRRGL

SEQ ID NO: 81554 - protein, 18 aa, Mycobacterium avium
KRVALVFSAYPTKHARIG

SEQ ID NO: 81555 - protein, 23 aa, Mycobacterium avium
KRVDNMTMAWGLEGRVPFLDHEL

SEQ ID NO: 81556 - protein, 20 aa, Mycobacterium avium
KSARDVQPLVCLDADGNKFS

SEQ ID NO: 81557 - protein, 17 aa, Mycobacterium avium
KSARLDNSYVHNLIHGF

SEQ ID NO: 81558 - protein, 17 aa, Mycobacterium avium
KSERELLAKALADVQGM

SEQ ID NO: 81559 - protein, 18 aa, Mycobacterium avium
KSHLGWGHGVHVCLGMHL

SEQ ID NO: 81560 - protein, 21 aa, Mycobacterium avium
KSKGRPAIKSFIVPRDHPGVT

SEQ ID NO: 81561 - protein, 32 aa, Mycobacterium avium
KSLPGMLMAAARLDLASVFLYAGSILPGVAKL

SEQ ID NO: 81562 - protein, 24 aa, Mycobacterium avium
KSMAGPLLQMMSQMGGMAFGSQLG

SEQ ID NO: 81563 - protein, 19 aa, Mycobacterium avium
KSMSPVEWVRFAANAVGDR

SEQ ID NO: 81564 - protein, 27 aa, Mycobacterium avium
KSPHLEAFKAKGYEVLLLTDPVDEVWV

SEQ ID NO: 81565 - protein, 19 aa, Mycobacterium avium
KSRRFAYPPNLYVVDGGAP

SEQ ID NO: 81566 - protein, 18 aa, Mycobacterium avium
KSSITPRDALASAGKTLV

SEQ ID NO: 81567 - protein, 20 aa, Mycobacterium avium
KSTHFDWVLAPYDIVASRAH

SEQ ID NO: 81568 - protein, 23 aa, Mycobacterium avium
KSTLLLEVAHRWAQSGRRALYIS

SEQ ID NO: 81569 - protein, 26 aa, Mycobacterium avium
KSTLLRLCNRLELPTSGRVSFYGSDI

SEQ ID NO: 81570 - protein, 17 aa, Mycobacterium avium
KSVAAFRLALPRTMLRF

SEQ ID NO: 81571 - protein, 19 aa, Mycobacterium avium
KSYQIYRLDAVPNTEKLPY

SEQ ID NO: 81572 - protein, 24 aa, Mycobacterium avium
KTACLIAAAGRFGAMFSGADADQV

SEQ ID NO: 81573 - protein, 26 aa, Mycobacterium avium
KTAHFCSMCGPKFCSMRITQDVRDYA

SEQ ID NO: 81574 - protein, 23 aa, Mycobacterium avium
KTALLRLAGRYGVGEDQVDELLR

SEQ ID NO: 81575 - protein, 22 aa, Mycobacterium avium
KTDALDALLWRAARPGEPSWPS

SEQ ID NO: 81576 - protein, 23 aa, Mycobacterium avium
KTEPALDVLAGWLASRIDGPVRR

SEQ ID NO: 81577 - protein, 24 aa, Mycobacterium avium
KTERLRIGHLVLCDAFRHPAVLAK

SEQ ID NO: 81578 - protein, 25 aa, Mycobacterium avium
KTGKAEKCTLCYPRMEVGLPTICSE

SEQ ID NO: 81579 - protein, 17 aa, Mycobacterium avium
KTIGDAVMFVCPEPRPL

SEQ ID NO: 81580 - protein, 17 aa, Mycobacterium avium
KTLKSAKAEALKCAKGF

SEQ ID NO: 81581 - protein, 18 aa, Mycobacterium avium
KTPLLAQVTRIGHRIGAP

SEQ ID NO: 81582 - protein, 17 aa, Mycobacterium avium
KTVCALLSDWLPATTGT

SEQ ID NO: 81583 - protein, 19 aa, Mycobacterium avium
KVAALCGSPSQARKHADAG

SEQ ID NO: 81584 - protein, 18 aa, Mycobacterium avium
KVAEGFGCHGEYVEKEDE

SEQ ID NO: 81585 - protein, 23 aa, Mycobacterium avium
KVAEGRVAGVHFLMKKNKITEIH

SEQ ID NO: 81586 - protein, 18 aa, Mycobacterium avium
KVARGMVMAVRRAVEKEG

SEQ ID NO: 81587 - protein, 25 aa, Mycobacterium avium
KVDGGWTINGHKIWTSAAHRADYGA

SEQ ID NO: 81588 - protein, 25 aa, Mycobacterium avium
KVDNIGRLPMAWVDPAAADTRTVLA

SEQ ID NO: 81589 - protein, 24 aa, Mycobacterium avium
KVDRSAAYAMRWVAKNIVAAGLAE

SEQ ID NO: 81590 - protein, 24 aa, Mycobacterium avium
KVEMPEIRSAVVAQLARVDDQLAA

SEQ ID NO: 81591 - protein, 21 aa, Mycobacterium avium
KVFLEWPVLRQVRSTDKLGRG

SEQ ID NO: 81592 - protein, 20 aa, Mycobacterium avium
KVFRNKVPITVAAGRPLPPR

SEQ ID NO: 81593 - protein, 24 aa, Mycobacterium avium
KVGGESARSRVCFTMDEVRETVAE

SEQ ID NO: 81594 - protein, 33 aa, Mycobacterium avium
KVGGTLAVSVPRWLPERVCWLLSDEYHSNEGGH

SEQ ID NO: 81595 - protein, 21 aa, Mycobacterium avium
KVGLGSVRFLMSVGDLIIGWL

SEQ ID NO: 81596 - protein, 20 aa, Mycobacterium avium
KVGLRRGKIIVVRPEHDRGA

SEQ ID NO: 81597 - protein, 25 aa, Mycobacterium avium
KVGRIARVLGPRGLMPNPKTGTVTP

SEQ ID NO: 81598 - protein, 24 aa, Mycobacterium avium
KVHADAGFDFIEVFCDTPIEECEK

SEQ ID NO: 81599 - protein, 21 aa, Mycobacterium avium
KVIGSELGWSREVWSQLADTG

SEQ ID NO: 81600 - protein, 18 aa, Mycobacterium avium
KVLASRMVRDYVEQYYTP

SEQ ID NO: 81601 - protein, 21 aa, Mycobacterium avium
KVLGYRNWLGLNKGDLSEEVS

SEQ ID NO: 81602 - protein, 21 aa, Mycobacterium avium
KVLIMKANGKGFCSGHAIGNN

SEQ ID NO: 81603 - protein, 19 aa, Mycobacterium avium
KVLRVSWCTVLRSAGGELH

SEQ ID NO: 81604 - protein, 17 aa, Mycobacterium avium
KVPSIAETIDWGRTLLA

SEQ ID NO: 81605 - protein, 21 aa, Mycobacterium avium
KVRPGVPVVFLDTGYHFAETI

SEQ ID NO: 81606 - protein, 25 aa, Mycobacterium avium
KVSHPIVFGHAVKVFYKEAFAKHQA

SEQ ID NO: 81607 - protein, 18 aa, Mycobacterium avium
KVTPDFAPYGKRIIRDPG

SEQ ID NO: 81608 - protein, 19 aa, Mycobacterium avium
KWQKMWKPVVCAVQGMCTA

SEQ ID NO: 81609 - protein, 23 aa, Mycobacterium avium
KYAADIDGVLAWARESRERLAQL

SEQ ID NO: 81610 - protein, 25 aa, Mycobacterium avium
KYDDLRAGLRMNIIGNPGVEKANFE

SEQ ID NO: 81611 - protein, 22 aa, Mycobacterium avium
KYDLFREVFLALGQQLVDATAF

SEQ ID NO: 81612 - protein, 25 aa, Mycobacterium avium
KYLGLRTEGLFLIAHLSRAGWLRWS

SEQ ID NO: 81613 - protein, 24 aa, Mycobacterium avium
KYLNRLSDLLFILSRVANPDGDVL

SEQ ID NO: 81614 - protein, 25 aa, Mycobacterium avium
KYLRGTPLGPLRCDAWIDRREGVKV

SEQ ID NO: 81615 - protein, 27 aa, Mycobacterium avium
KYPARVKCALLGWMACKDALAQAYSRR

SEQ ID NO: 81616 - protein, 44 aa, Mycobacterium avium
KYRLIFDKLRLAPGDRLLDVGCGWGGMVRYAARRGVRAIGATLS

SEQ ID NO: 81617 - protein, 18 aa, Mycobacterium avium
LAAAGYRFPRVAGSSAGA

SEQ ID NO: 81618 - protein, 32 aa, Mycobacterium avium
LAAARWWRKPLVRRWYGFLAMQQEVARHIPDL

SEQ ID NO: 81619 - protein, 24 aa, Mycobacterium avium
LAADGRAAIGFGAYREYEFTDFLN

SEQ ID NO: 81620 - protein, 18 aa, Mycobacterium avium
LAAELVAAVAEFLETDVR

SEQ ID NO: 81621 - protein, 17 aa, Mycobacterium avium
LAAERAESVVVVHDGVA

SEQ ID NO: 81622 - protein, 19 aa, Mycobacterium avium
LAAGQALAAVSAYETAFAE

SEQ ID NO: 81623 - protein, 23 aa, Mycobacterium avium
LAAHADHFWTWSIDMLGHGYTDK

SEQ ID NO: 81624 - protein, 26 aa, Mycobacterium avium
LAAKFAEGVKAEFPDQMLAYNCSPSF

SEQ ID NO: 81625 - protein, 30 aa, Mycobacterium avium
LAALAALELIDWPVAVVIAAGHLLASNHHN

SEQ ID NO: 81626 - protein, 23 aa, Mycobacterium avium
LAAQDRLRFAAGNFYVNDKPTGA

SEQ ID NO: 81627 - protein, 23 aa, Mycobacterium avium
LAARIGAPLVLRGVGVRRVADDR

SEQ ID NO: 81628 - protein, 18 aa, Mycobacterium avium
LAARPITVPARWTEELAE

SEQ ID NO: 81629 - protein, 20 aa, Mycobacterium avium
LAAVGVDLPDVFVVLENEGV

SEQ ID NO: 81630 - protein, 17 aa, Mycobacterium avium
LAAVPADASSTVFEPDP

SEQ ID NO: 81631 - protein, 20 aa, Mycobacterium avium
LAAWSGRYAAVAGVPARNTP

SEQ ID NO: 81632 - protein, 17 aa, Mycobacterium avium
LACGPDIAIPALVIGNL

SEQ ID NO: 81633 - protein, 19 aa, Mycobacterium avium
LADAALRLGARKGRGPGGI

SEQ ID NO: 81634 - protein, 24 aa, Mycobacterium avium
LADARRLAPGGAIVVGGPRDSSEL

SEQ ID NO: 81635 - protein, 24 aa, Mycobacterium avium
LADDEWPHLFLPFREGAAHESDLP

SEQ ID NO: 81636 - protein, 22 aa, Mycobacterium avium
LADEAFRLLGGVDVVFSNAGIV

SEQ ID NO: 81637 - protein, 19 aa, Mycobacterium avium
LADELVRIIGVLRGMQLKK

SEQ ID NO: 81638 - protein, 18 aa, Mycobacterium avium
LADGCVALGIPVTGGNVS

SEQ ID NO: 81639 - protein, 23 aa, Mycobacterium avium
LADGRHWDLLSGRPVTGDDRGEL

SEQ ID NO: 81640 - protein, 19 aa, Mycobacterium avium
LADGTVLWMADERAIGEHI

SEQ ID NO: 81641 - protein, 23 aa, Mycobacterium avium
LADHAVGGVVLFPGAGFVELAIR

SEQ ID NO: 81642 - protein, 18 aa, Mycobacterium avium
LADIWPVIDRDPAVRAVL

SEQ ID NO: 81643 - protein, 22 aa, Mycobacterium avium
LADLALSCALWVGMGRVLRTLD

SEQ ID NO: 81644 - protein, 24 aa, Mycobacterium avium
LADLCLTAGAGRAHFEHRAALVVD

SEQ ID NO: 81645 - protein, 33 aa, Mycobacterium avium
LADMKCRIDAARMLVWRAGWMARNNQAFDAAEG

SEQ ID NO: 81646 - protein, 17 aa, Mycobacterium avium
LAEALVCAAARETFEES

SEQ ID NO: 81647 - protein, 24 aa, Mycobacterium avium
LAEAVAAARAHRRSFVADRLATGT

SEQ ID NO: 81648 - protein, 19 aa, Mycobacterium avium
LAEGLRVVARVSSLCAQMT

SEQ ID NO: 81649 - protein, 21 aa, Mycobacterium avium
LAEGVIRTMRLLGVTCLEELS

SEQ ID NO: 81650 - protein, 21 aa, Mycobacterium avium
LAEIRRVLVPGGRLVVLEHVR

SEQ ID NO: 81651 - protein, 18 aa, Mycobacterium avium
LAELRRVLDAAGVTGLTL

SEQ ID NO: 81652 - protein, 21 aa, Mycobacterium avium
LAERLPAYMVPAAVLAIEALP

SEQ ID NO: 81653 - protein, 18 aa, Mycobacterium avium
LAGDAAHLMPVWQGQGYN

SEQ ID NO: 81654 - protein, 21 aa, Mycobacterium avium
LAGEIRSAFSMTEPAVASSDA

SEQ ID NO: 81655 - protein, 17 aa, Mycobacterium avium
LAGELSPGIASAVVLVD

SEQ ID NO: 81656 - protein, 24 aa, Mycobacterium avium
LAGHSMGGITIAAWSNRYRHKVSR

SEQ ID NO: 81657 - protein, 17 aa, Mycobacterium avium
LAGLKPAFRKDGTITAG

SEQ ID NO: 81658 - protein, 23 aa, Mycobacterium avium
LAGLRTVGDVVAYIQKLEEENPE

SEQ ID NO: 81659 - protein, 17 aa, Mycobacterium avium
LAGPRAVFHREVKRMQG

SEQ ID NO: 81660 - protein, 25 aa, Mycobacterium avium
LAGRPIDWSAVHLFWGDERYVPEDD

SEQ ID NO: 81661 - protein, 18 aa, Mycobacterium avium
LAGTCQRVEQVRCMEIHD

SEQ ID NO: 81662 - protein, 23 aa, Mycobacterium avium
LAHEVRMRWCGPEVEVEGIISLK

SEQ ID NO: 81663 - protein, 19 aa, Mycobacterium avium
LAHLLKFDSILGRLPYDVS

SEQ ID NO: 81664 - protein, 18 aa, Mycobacterium avium
LAHLSQWCFVVARTEKGS

SEQ ID NO: 81665 - protein, 24 aa, Mycobacterium avium
LAHQPRFVQAYSWALESLHRKGAR

SEQ ID NO: 81666 - protein, 17 aa, Mycobacterium avium
LAIEYEVMDRLKPAIIL

SEQ ID NO: 81667 - protein, 17 aa, Mycobacterium avium
LAILKGLNVPLHEAEIL

SEQ ID NO: 81668 - protein, 22 aa, Mycobacterium avium
LAIRVNGPRSWGLDITVDVTLA

SEQ ID NO: 81669 - protein, 28 aa, Mycobacterium avium
LAKAMDRKVWLPSGGTLVIDRTEAMTVI

SEQ ID NO: 81670 - protein, 24 aa, Mycobacterium avium
LAKELEFRPRKSLGQNFVHDANTV

SEQ ID NO: 81671 - protein, 18 aa, Mycobacterium avium
LAKFTEWESELSAAAPAD

SEQ ID NO: 81672 - protein, 17 aa, Mycobacterium avium
LAKRLAAAGAEVVLAVR

SEQ ID NO: 81673 - protein, 18 aa, Mycobacterium avium
LALCESFGLPVISLCDTP

SEQ ID NO: 81674 - protein, 17 aa, Mycobacterium avium
LALGIGVHDITAGYRAY

SEQ ID NO: 81675 - protein, 25 aa, Mycobacterium avium
LALPPGSAGKPYFQYVVDDPTRLPP

SEQ ID NO: 81676 - protein, 18 aa, Mycobacterium avium
LALPWPEDPLAALWHATT

SEQ ID NO: 81677 - protein, 25 aa, Mycobacterium avium
LALQKMSFEVAWRILQATPVTATGL

SEQ ID NO: 81678 - protein, 18 aa, Mycobacterium avium
LALSLGDSLAGMFGAQGA

SEQ ID NO: 81679 - protein, 26 aa, Mycobacterium avium
LAMLRRLMMDDSFFRGELIYVFDGDA

SEQ ID NO: 81680 - protein, 17 aa, Mycobacterium avium
LANEAFAGMKLLEIHTT

SEQ ID NO: 81681 - protein, 18 aa, Mycobacterium avium
LANFFRIKPAYFTDDEYY

SEQ ID NO: 81682 - protein, 17 aa, Mycobacterium avium
LANIAITVQGGRNLARR

SEQ ID NO: 81683 - protein, 19 aa, Mycobacterium avium
LAPDGRCKVYAGAADGTSW

SEQ ID NO: 81684 - protein, 19 aa, Mycobacterium avium
LAPDRRRGLIQIFPNDVEL

SEQ ID NO: 81685 - protein, 22 aa, Mycobacterium avium
LAPELFAGILAQVPFVDPLTTI

SEQ ID NO: 81686 - protein, 18 aa, Mycobacterium avium
LAPESPPPAQFDDAYAAT

SEQ ID NO: 81687 - protein, 18 aa, Mycobacterium avium
LAPGTGLRDGLERILRGR

SEQ ID NO: 81688 - protein, 25 aa, Mycobacterium avium
LAPPEIWRSYIRTVGRTPNGVWGGK

SEQ ID NO: 81689 - protein, 20 aa, Mycobacterium avium
LAPPMGRGWEALAGDEVWNW

SEQ ID NO: 81690 - protein, 20 aa, Mycobacterium avium
LAQKERWLPELMTLEKIAAW

SEQ ID NO: 81691 - protein, 25 aa, Mycobacterium avium
LAQTRLRTQPALDRLAEAVVDGTQD

SEQ ID NO: 81692 - protein, 20 aa, Mycobacterium avium
LAREDLSVWVVTGDGDALSI

SEQ ID NO: 81693 - protein, 18 aa, Mycobacterium avium
LARERPVEADLVIGVPES

SEQ ID NO: 81694 - protein, 23 aa, Mycobacterium avium
LARFAETLLPLFSENTEEAIALA

SEQ ID NO: 81695 - protein, 20 aa, Mycobacterium avium
LARGRLRIVCNLGAEPVTVP

SEQ ID NO: 81696 - protein, 25 aa, Mycobacterium avium
LARPKRYAAGFSRELDDEWQLPDAV

SEQ ID NO: 81697 - protein, 18 aa, Mycobacterium avium
LARRAAMSPRHFTRVFTA

SEQ ID NO: 81698 - protein, 21 aa, Mycobacterium avium
LARRLAAEEGLLVGISSGAAL

SEQ ID NO: 81699 - protein, 21 aa, Mycobacterium avium
LARRLAARADIVVENFSPRVV

SEQ ID NO: 81700 - protein, 17 aa, Mycobacterium avium
LASKPWVKTTMAPGSQV

SEQ ID NO: 81701 - protein, 33 aa, Mycobacterium avium
LASLAPLRFGELCLEAGLPPGLVNVLPAGPEGG

SEQ ID NO: 81702 - protein, 18 aa, Mycobacterium avium
LASLHLVHDWNREFVRTS

SEQ ID NO: 81703 - protein, 20 aa, Mycobacterium avium
LASLRDARVPVALSTDMPFG

SEQ ID NO: 81704 - protein, 17 aa, Mycobacterium avium
LASPEPWIERFERCWEL

SEQ ID NO: 81705 - protein, 17 aa, Mycobacterium avium
LASRPTFQKGLAHHRAA

SEQ ID NO: 81706 - protein, 18 aa, Mycobacterium avium
LASSYGHWVYSIRSGQGA

SEQ ID NO: 81707 - protein, 17 aa, Mycobacterium avium
LASYDGRNRVNPPLREA

SEQ ID NO: 81708 - protein, 34 aa, Mycobacterium avium
LAVAARPELTLGRARYAVHAAFALAVDIGRLVYP

SEQ ID NO: 81709 - protein, 17 aa, Mycobacterium avium
LAVCDRIGLPAKDIDLL

SEQ ID NO: 81710 - protein, 25 aa, Mycobacterium avium
LAVEEMLRWNSPVVHMARTATADVE

SEQ ID NO: 81711 - protein, 25 aa, Mycobacterium avium
LAVELGRAGAKLAISDVDTAGLAQT

SEQ ID NO: 81712 - protein, 26 aa, Mycobacterium avium
LAVMPWNFPLWQAVRFAAPALMAGNV

SEQ ID NO: 81713 - protein, 27 aa, Mycobacterium avium
LAVNRLRPSEIQWALNHDAVHGIAYAF

SEQ ID NO: 81714 - protein, 23 aa, Mycobacterium avium
LAVRPHPEWFRTGDLGRLDRDQN

SEQ ID NO: 81715 - protein, 18 aa, Mycobacterium avium
LAVYPRAEFEQLARRASK

SEQ ID NO: 81716 - protein, 17 aa, Mycobacterium avium
LAYLLSRLGTKRLIITG

SEQ ID NO: 81717 - protein, 26 aa, Mycobacterium avium
LCAFSSDRIPKWLLPVINDNLANDGS

SEQ ID NO: 81718 - protein, 20 aa, Mycobacterium avium
LCAMAKRYVTDTCFEVADKA

SEQ ID NO: 81719 - protein, 17 aa, Mycobacterium avium
LCASQLVGLGIMRYGIR

SEQ ID NO: 81720 - protein, 22 aa, Mycobacterium avium
LCEIKDVQIRDGLHVLGQKPTG

SEQ ID NO: 81721 - protein, 27 aa, Mycobacterium avium
LCGAYNASIFRRAEELFSLLREQGKTP

SEQ ID NO: 81722 - protein, 18 aa, Mycobacterium avium
LCINPFFHNFGYKAGILA

SEQ ID NO: 81723 - protein, 21 aa, Mycobacterium avium
LCMDNGMPILVFNLLTNGNIA

SEQ ID NO: 81724 - protein, 17 aa, Mycobacterium avium
LCNSAGFGTSGVFHELP

SEQ ID NO: 81725 - protein, 24 aa, Mycobacterium avium
LCRDNCHYCTFVTVPGKLRARGAG

SEQ ID NO: 81726 - protein, 25 aa, Mycobacterium avium
LCRQHHRLKTFGGWRDRQLADGTVV

SEQ ID NO: 81727 - protein, 29 aa, Mycobacterium avium
LCSERPAIHRFPGSMAKRIQALAQLLVDR

SEQ ID NO: 81728 - protein, 18 aa, Mycobacterium avium
LCSPTRAALLTGRNATTV

SEQ ID NO: 81729 - protein, 18 aa, Mycobacterium avium
LDAAIAWYHDHLGMILVH

SEQ ID NO: 81730 - protein, 19 aa, Mycobacterium avium
LDAATGRLAAERASVGDEE

SEQ ID NO: 81731 - protein, 20 aa, Mycobacterium avium
LDADLLRRAKHHGLSDRQIA

SEQ ID NO: 81732 - protein, 19 aa, Mycobacterium avium
LDAEFPKFRQLLPAEHTAV

SEQ ID NO: 81733 - protein, 24 aa, Mycobacterium avium
LDALGRNKMRVVPGLTSKAMSVAS

SEQ ID NO: 81734 - protein, 19 aa, Mycobacterium avium
LDALVSVCRACPRLVEWRE

SEQ ID NO: 81735 - protein, 21 aa, Mycobacterium avium
LDAPICLTWELTYACNLACVH

SEQ ID NO: 81736 - protein, 27 aa, Mycobacterium avium
LDASGVRLGIVASTWHSRICDALLAGA

SEQ ID NO: 81737 - protein, 19 aa, Mycobacterium avium
LDASLLLVVLTRFLPPDDP

SEQ ID NO: 81738 - protein, 17 aa, Mycobacterium avium
LDAVALAHHSGYRTMMS

SEQ ID NO: 81739 - protein, 20 aa, Mycobacterium avium
LDAYYEHGLKVWDRAAGALI

SEQ ID NO: 81740 - protein, 20 aa, Mycobacterium avium
LDDFGVPFTLTRRGALTAEL

SEQ ID NO: 81741 - protein, 23 aa, Mycobacterium avium
LDDGTTWRVDIERAHMEEDTGKL

SEQ ID NO: 81742 - protein, 31 aa, Mycobacterium avium
LDDHPGLRIGWFEGGISWVPWALQDAEHLVA

SEQ ID NO: 81743 - protein, 27 aa, Mycobacterium avium
LDDKGRLTLPAKFRDALAGGLMVTKSQ

SEQ ID NO: 81744 - protein, 18 aa, Mycobacterium avium
LDDLAKRLIVLVEPVEAI

SEQ ID NO: 81745 - protein, 20 aa, Mycobacterium avium
LDEFAYRLSGSADLYEHTGR

SEQ ID NO: 81746 - protein, 24 aa, Mycobacterium avium
LDEHRAGGAAVRWDDENVTACFRC

SEQ ID NO: 81747 - protein, 23 aa, Mycobacterium avium
LDELCLTIAPYLVGGHARRIATG

SEQ ID NO: 81748 - protein, 26 aa, Mycobacterium avium
LDELLNRWPEWDIDYDTAQLASTSTV

SEQ ID NO: 81749 - protein, 24 aa, Mycobacterium avium
LDEMPDIAIPLVFTLLGETGAHAP

SEQ ID NO: 81750 - protein, 24 aa, Mycobacterium avium
LDEPPLRLLLGRDVLKAMRDKIAA

SEQ ID NO: 81751 - protein, 19 aa, Mycobacterium avium
LDFFAELTIYTSTACLIGL

SEQ ID NO: 81752 - protein, 18 aa, Mycobacterium avium
LDFFFRKIVRDRGQALQF

SEQ ID NO: 81753 - protein, 25 aa, Mycobacterium avium
LDGDARGGAALSVREVTGVPILFAS

SEQ ID NO: 81754 - protein, 19 aa, Mycobacterium avium
LDGETSRSLALKAIRGALD

SEQ ID NO: 81755 - protein, 17 aa, Mycobacterium avium
LDGGFGVGKTHLLASAY

SEQ ID NO: 81756 - protein, 25 aa, Mycobacterium avium
LDGLDKLAKLGVTWVSVHLPGDSMA

SEQ ID NO: 81757 - protein, 18 aa, Mycobacterium avium
LDGLLSAWQSTLAGDMQA

SEQ ID NO: 81758 - protein, 25 aa, Mycobacterium avium
LDGLPNYQRLFSLRIGQTLREQFEA

SEQ ID NO: 81759 - protein, 19 aa, Mycobacterium avium
LDGMAAFVESGRAVALGVV

SEQ ID NO: 81760 - protein, 21 aa, Mycobacterium avium
LDGNYPLSIVLDGQALNITLA

SEQ ID NO: 81761 - protein, 24 aa, Mycobacterium avium
LDGRAARLVACWGNNDGPALRARL

SEQ ID NO: 81762 - protein, 27 aa, Mycobacterium avium
LDGRADPGEIVWTWVVYEDDPSRGKDR

SEQ ID NO: 81763 - protein, 21 aa, Mycobacterium avium
LDGRIRHVMIPGIIAEDDDRP

SEQ ID NO: 81764 - protein, 25 aa, Mycobacterium avium
LDGTLKFGDLLLHPASFTASLDGRE

SEQ ID NO: 81765 - protein, 25 aa, Mycobacterium avium
LDGYPRAGKTVLFLGRYDEPRKGMA

SEQ ID NO: 81766 - protein, 27 aa, Mycobacterium avium
LDINVFGRRAGIAAANYARGHDFVDMP

SEQ ID NO: 81767 - protein, 18 aa, Mycobacterium avium
LDKKLAYRHSGYPGGLRS

SEQ ID NO: 81768 - protein, 23 aa, Mycobacterium avium
LDKLPAHLRMTFAVESTDGTELA

SEQ ID NO: 81769 - protein, 20 aa, Mycobacterium avium
LDKLTKWSMPLLRHDGRMLA

SEQ ID NO: 81770 - protein, 18 aa, Mycobacterium avium
LDKMGWRSSDTAELSYTD

SEQ ID NO: 81771 - protein, 17 aa, Mycobacterium avium
LDKRFMAKYGKATPEAL

SEQ ID NO: 81772 - protein, 23 aa, Mycobacterium avium
LDKTRPLWEMYLVEGLSKNRLAL

SEQ ID NO: 81773 - protein, 24 aa, Mycobacterium avium
LDLGSLVAGSRYRGDFEERLKKVL

SEQ ID NO: 81774 - protein, 18 aa, Mycobacterium avium
LDLIPPELAAAMDNVVVL

SEQ ID NO: 81775 - protein, 25 aa, Mycobacterium avium
LDLLPTVRGAFCLTFMDENTLYACR

SEQ ID NO: 81776 - protein, 18 aa, Mycobacterium avium
LDLLRWHGAEEVEHKAVA

SEQ ID NO: 81777 - protein, 22 aa, Mycobacterium avium
LDLQAPVARYWPEFAQAGKQDI

SEQ ID NO: 81778 - protein, 20 aa, Mycobacterium avium
LDLRGLNFIGTAGFSALHRI

SEQ ID NO: 81779 - protein, 17 aa, Mycobacterium avium
LDLRSPRGATYLATAPG

SEQ ID NO: 81780 - protein, 26 aa, Mycobacterium avium
LDLSKLARPTSTWTYMVNDNPLSDDT

SEQ ID NO: 81781 - protein, 21 aa, Mycobacterium avium
LDLTGCMALGITGPILRATGL

SEQ ID NO: 81782 - protein, 18 aa, Mycobacterium avium
LDLVLAILRARQLFGGEQ

SEQ ID NO: 81783 - protein, 19 aa, Mycobacterium avium
LDLVRDFATHAAIALVLAA

SEQ ID NO: 81784 - protein, 21 aa, Mycobacterium avium
LDMFYNLGIAGRAMRRIGAIE

SEQ ID NO: 81785 - protein, 19 aa, Mycobacterium avium
LDNPALALMFFLTSSRIFG

SEQ ID NO: 81786 - protein, 27 aa, Mycobacterium avium
LDPDTLRYLRDFRFGGDIDGYAEGELY

SEQ ID NO: 81787 - protein, 22 aa, Mycobacterium avium
LDPLIPASVRFSAEDSLPVPTS

SEQ ID NO: 81788 - protein, 25 aa, Mycobacterium avium
LDPPRSGEVLVRMAVAGICHSDDHL

SEQ ID NO: 81789 - protein, 19 aa, Mycobacterium avium
LDPSACCRDDLAAQIQARL

SEQ ID NO: 81790 - protein, 20 aa, Mycobacterium avium
LDPTMAYTCAFFERDDMTLE

SEQ ID NO: 81791 - protein, 20 aa, Mycobacterium avium
LDPTMCDAWLARILAGEQSL

SEQ ID NO: 81792 - protein, 20 aa, Mycobacterium avium
LDPTMFAAFAPHALELTVEE

SEQ ID NO: 81793 - protein, 17 aa, Mycobacterium avium
LDQWGRFDEAFAALRKW

SEQ ID NO: 81794 - protein, 24 aa, Mycobacterium avium
LDRLLRPGGVVDMLTSEGGLLDRL

SEQ ID NO: 81795 - protein, 18 aa, Mycobacterium avium
LDRRVLQFGGRVYTAKDS

SEQ ID NO: 81796 - protein, 23 aa, Mycobacterium avium
LDRTLRVAWSVADLAGRTSPGPE

SEQ ID NO: 81797 - protein, 20 aa, Mycobacterium avium
LDSEVPWVPAQLAPPATARV

SEQ ID NO: 81798 - protein, 21 aa, Mycobacterium avium
LDSLGGLWAQGKLADKVYAAF

SEQ ID NO: 81799 - protein, 26 aa, Mycobacterium avium
LDSLIWQCPVVLLGEVRSVGVQGDNR

SEQ ID NO: 81800 - protein, 19 aa, Mycobacterium avium
LDSRAWRLPFEDGTTVYEL

SEQ ID NO: 81801 - protein, 20 aa, Mycobacterium avium
LDTFGPRWVNAVMQRQTVQP

SEQ ID NO: 81802 - protein, 18 aa, Mycobacterium avium
LDTPGVILGEHFDLLALG

SEQ ID NO: 81803 - protein, 24 aa, Mycobacterium avium
LDTRRPPRLFGLIKHSGGHASRDW

SEQ ID NO: 81804 - protein, 17 aa, Mycobacterium avium
LDTSAWCGLAPASATID

SEQ ID NO: 81805 - protein, 20 aa, Mycobacterium avium
LDTSVAISWIGKETGREVVA

SEQ ID NO: 81806 - protein, 18 aa, Mycobacterium avium
LDVARMVLFGQVGRELVN

SEQ ID NO: 81807 - protein, 19 aa, Mycobacterium avium
LDVDVEFSPFFNALPIRRL

SEQ ID NO: 81808 - protein, 19 aa, Mycobacterium avium
LDVEGWRGDNFAFTFNIAD

SEQ ID NO: 81809 - protein, 25 aa, Mycobacterium avium
LDVMMPRLDGLEVCRQLRSTGDDLP

SEQ ID NO: 81810 - protein, 24 aa, Mycobacterium avium
LDVPTFRMLAGLRGRVPLVSVVSG

SEQ ID NO: 81811 - protein, 19 aa, Mycobacterium avium
LDVRWRLDEPDGRAAYLQG

SEQ ID NO: 81812 - protein, 26 aa, Mycobacterium avium
LDYAGGVRAGHRLKFWTPGGSSTPLL

SEQ ID NO: 81813 - protein, 17 aa, Mycobacterium avium
LDYAYYNPLSLVIRDQQ

SEQ ID NO: 81814 - protein, 20 aa, Mycobacterium avium
LDYDCPRAVLDKATAITPGL

SEQ ID NO: 81815 - protein, 18 aa, Mycobacterium avium
LEAAAGIAGVIKVILALE

SEQ ID NO: 81816 - protein, 33 aa, Mycobacterium avium
LEAAMARLSALAGYRWITPVSYTLPFRTVSGTR

SEQ ID NO: 81817 - protein, 17 aa, Mycobacterium avium
LEAEGHRILKLNIGNPA

SEQ ID NO: 81818 - protein, 22 aa, Mycobacterium avium
LEAFANFGFPESHALSFASLVF

SEQ ID NO: 81819 - protein, 23 aa, Mycobacterium avium
LEAHCKHLGAHLGHGGTVVGDCV

SEQ ID NO: 81820 - protein, 36 aa, Mycobacterium avium
LEANLRLVVSLAKRYTGRGMAFLDLIQEGNLGLIRA

SEQ ID NO: 81821 - protein, 17 aa, Mycobacterium avium
LEARIDSLAARNSKLME

SEQ ID NO: 81822 - protein, 18 aa, Mycobacterium avium
LEAVRKRPGMYIGSTGER

SEQ ID NO: 81823 - protein, 18 aa, Mycobacterium avium
LEDCYTALTWLAGLPSVD

SEQ ID NO: 81824 - protein, 17 aa, Mycobacterium avium
LEDFDVFHPDRMSSRIL

SEQ ID NO: 81825 - protein, 17 aa, Mycobacterium avium
LEDLGWYVADNLPPQLI

SEQ ID NO: 81826 - protein, 19 aa, Mycobacterium avium
LEERLCAAAVFVTQARRVI

SEQ ID NO: 81827 - protein, 19 aa, Mycobacterium avium
LEGACPVVASFGGRDLTGK

SEQ ID NO: 81828 - protein, 18 aa, Mycobacterium avium
LEGASAIDILRWTDEHFG

SEQ ID NO: 81829 - protein, 25 aa, Mycobacterium avium
LEGGPRPTHFAGVLTVVCKLLQIVR

SEQ ID NO: 81830 - protein, 21 aa, Mycobacterium avium
LEGKSSLGRLGLLTHSTAGFI

SEQ ID NO: 81831 - protein, 27 aa, Mycobacterium avium
LEGPSYTRPPSWRGLDVPEVLLSGDHA

SEQ ID NO: 81832 - protein, 17 aa, Mycobacterium avium
LEGSGWTVASEAEPVTA

SEQ ID NO: 81833 - protein, 17 aa, Mycobacterium avium
LEGYLLTGRHGLFNCYE

SEQ ID NO: 81834 - protein, 18 aa, Mycobacterium avium
LEHGHVIQVFGLPNMRTV

SEQ ID NO: 81835 - protein, 31 aa, Mycobacterium avium
LEHYEKLEGVPLTFAGKVNRLAIMVRGNLAA

SEQ ID NO: 81836 - protein, 23 aa, Mycobacterium avium
LEKAKAMGAIALFGESYPEQVRV

SEQ ID NO: 81837 - protein, 23 aa, Mycobacterium avium
LELADGKLICLVRAASDDDARRR

SEQ ID NO: 81838 - protein, 17 aa, Mycobacterium avium
LELDRRLRAAGSPIVTQ

SEQ ID NO: 81839 - protein, 29 aa, Mycobacterium avium
LELGFRSSIQKEWEWRVSRGESLKNLQAF

SEQ ID NO: 81840 - protein, 20 aa, Mycobacterium avium
LELRTPRWVSGEDRLLVTVL

SEQ ID NO: 81841 - protein, 18 aa, Mycobacterium avium
LELSMMTERVLKRLPDLR

SEQ ID NO: 81842 - protein, 17 aa, Mycobacterium avium
LELVGCYAWSAEKVGRD

SEQ ID NO: 81843 - protein, 17 aa, Mycobacterium avium
LEMLPVECVARGYLTGS

SEQ ID NO: 81844 - protein, 19 aa, Mycobacterium avium
LEMNTRLQVEHPVTEETTG

SEQ ID NO: 81845 - protein, 28 aa, Mycobacterium avium
LENLSGWFEFVWKPGYADYYPELPGGSE

SEQ ID NO: 81846 - protein, 17 aa, Mycobacterium avium
LEPVRFAEFEAGEAPFP

SEQ ID NO: 81847 - protein, 23 aa, Mycobacterium avium
LEQELNVPLVRRGQKFEGLTPEG

SEQ ID NO: 81848 - protein, 20 aa, Mycobacterium avium
LEQLDLFPANRNAAGQIVAA

SEQ ID NO: 81849 - protein, 23 aa, Mycobacterium avium
LEQPGLRLPQIIRTVLDGYADRP

SEQ ID NO: 81850 - protein, 19 aa, Mycobacterium avium
LEQTRISGVLINLQPDRAA

SEQ ID NO: 81851 - protein, 17 aa, Mycobacterium avium
LEQYCKRGATFTYNSID

SEQ ID NO: 81852 - protein, 17 aa, Mycobacterium avium
LERFANLIESYDLTGDE

SEQ ID NO: 81853 - protein, 17 aa, Mycobacterium avium
LERIPVPVLAIAGDGSI

SEQ ID NO: 81854 - protein, 23 aa, Mycobacterium avium
LERLGLDYVDLYLIHWPAPALGT

SEQ ID NO: 81855 - protein, 25 aa, Mycobacterium avium
LERLKSELLLLMAGVERLAHAPVPV

SEQ ID NO: 81856 - protein, 23 aa, Mycobacterium avium
LERLRAWGVEHVFGYPGDGINGL

SEQ ID NO: 81857 - protein, 36 aa, Mycobacterium avium
LERLYPRTAAELFSWGKSWLETCQQAFAGLAVDPDR

SEQ ID NO: 81858 - protein, 23 aa, Mycobacterium avium
LERRAKRLIVFDVDSTLVQGEVI

SEQ ID NO: 81859 - protein, 19 aa, Mycobacterium avium
LERRGFLEVETPMLQTLAG

SEQ ID NO: 81860 - protein, 17 aa, Mycobacterium avium
LERRNARRALITLCIGG

SEQ ID NO: 81861 - protein, 18 aa, Mycobacterium avium
LERTQIRALGLLKGACAQ

SEQ ID NO: 81862 - protein, 25 aa, Mycobacterium avium
LERVGIELGRGGYLTVDRVSRTSVP

SEQ ID NO: 81863 - protein, 21 aa, Mycobacterium avium
LESRLDNVVYRAGLARTRRMA

SEQ ID NO: 81864 - protein, 19 aa, Mycobacterium avium
LESTMRFILSAKSAYVDGQ

SEQ ID NO: 81865 - protein, 18 aa, Mycobacterium avium
LESYLPKLAVTHGKAMGT

SEQ ID NO: 81866 - protein, 17 aa, Mycobacterium avium
LETARSFFPNVVTTHTW

SEQ ID NO: 81867 - protein, 22 aa, Mycobacterium avium
LETHLGWVAKSGWNIDGNPEWA

SEQ ID NO: 81868 - protein, 21 aa, Mycobacterium avium
LETLIDFSYLIAVKDIKTDLV

SEQ ID NO: 81869 - protein, 18 aa, Mycobacterium avium
LETQDAWVADLRDRLRAR

SEQ ID NO: 81870 - protein, 20 aa, Mycobacterium avium
LEVAEQLFATPQEGRVLGVD

SEQ ID NO: 81871 - protein, 22 aa, Mycobacterium avium
LEVEPFEAMIVFVRTKQATEEV

SEQ ID NO: 81872 - protein, 24 aa, Mycobacterium avium
LEVTMPREMLLRISDLAHLLRLPG

SEQ ID NO: 81873 - protein, 19 aa, Mycobacterium avium
LEVVADVRPELVSFTFGVP

SEQ ID NO: 81874 - protein, 24 aa, Mycobacterium avium
LEYIYCPWHQWGFELATGTTAVKP

SEQ ID NO: 81875 - protein, 20 aa, Mycobacterium avium
LFARRLPEGRRYGVVGGTGR

SEQ ID NO: 81876 - protein, 19 aa, Mycobacterium avium
LFASWRSDPSFVLNLSPFD

SEQ ID NO: 81877 - protein, 18 aa, Mycobacterium avium
LFDEWDLPVPALFGQMRL

SEQ ID NO: 81878 - protein, 20 aa, Mycobacterium avium
LFDGTGWDAAACAERGARVE

SEQ ID NO: 81879 - protein, 31 aa, Mycobacterium avium
LFEMNEAFAAIAIKIQQYFGIPDQKYNVNGG

SEQ ID NO: 81880 - protein, 24 aa, Mycobacterium avium
LFGSGKMFLPQVVKSARVMKKAVA

SEQ ID NO: 81881 - protein, 18 aa, Mycobacterium avium
LFPDEFAKRARALGESVG

SEQ ID NO: 81882 - protein, 20 aa, Mycobacterium avium
LFQQRLHGCGADLVSAPLST

SEQ ID NO: 81883 - protein, 18 aa, Mycobacterium avium
LFRYPGVRSDSSIFTLSF

SEQ ID NO: 81884 - protein, 19 aa, Mycobacterium avium
LFSHVPWLASQLLGAVEAY

SEQ ID NO: 81885 - protein, 19 aa, Mycobacterium avium
LFSVPGKAGFDSMNTKDYG

SEQ ID NO: 81886 - protein, 18 aa, Mycobacterium avium
LFTAFVPFAARWPVEVHI

SEQ ID NO: 81887 - protein, 18 aa, Mycobacterium avium
LFYANRSRDAVIFDEDLA

SEQ ID NO: 81888 - protein, 19 aa, Mycobacterium avium
LFYPECLEYARRLREAGVP

SEQ ID NO: 81889 - protein, 17 aa, Mycobacterium avium
LFYPNFMLLIWEPGWFL

SEQ ID NO: 81890 - protein, 21 aa, Mycobacterium avium
LGAALAEYGRRVLLVDMDPQG

SEQ ID NO: 81891 - protein, 17 aa, Mycobacterium avium
LGAAVAKAAPWLRDGDV

SEQ ID NO: 81892 - protein, 23 aa, Mycobacterium avium
LGAEVRYRRVLGAVAELEALAVG

SEQ ID NO: 81893 - protein, 17 aa, Mycobacterium avium
LGAFSRAVSLGVGHEPA

SEQ ID NO: 81894 - protein, 18 aa, Mycobacterium avium
LGAGIGVPVPEFVETMTR

SEQ ID NO: 81895 - protein, 20 aa, Mycobacterium avium
LGAGLDWKTSLQELTAARGM

SEQ ID NO: 81896 - protein, 22 aa, Mycobacterium avium
LGAGSWPAEFARFDVGQQDPKA

SEQ ID NO: 81897 - protein, 19 aa, Mycobacterium avium
LGAHDLLNEYIRHIGSAIF

SEQ ID NO: 81898 - protein, 26 aa, Mycobacterium avium
LGALGFGRGTLYSAISPVAGMGNAGT

SEQ ID NO: 81899 - protein, 22 aa, Mycobacterium avium
LGALRMLAGDVIEMATGEGKTL

SEQ ID NO: 81900 - protein, 20 aa, Mycobacterium avium
LGAMTPMFVGFRGREIVLTL

SEQ ID NO: 81901 - protein, 19 aa, Mycobacterium avium
LGANLARLELRVLFEELLS

SEQ ID NO: 81902 - protein, 22 aa, Mycobacterium avium
LGAPCRAVHVGDELQIGELTVR

SEQ ID NO: 81903 - protein, 18 aa, Mycobacterium avium
LGAPRIAERFTELAKEVP

SEQ ID NO: 81904 - protein, 20 aa, Mycobacterium avium
LGAQGAWTGSQWLMVEESSN

SEQ ID NO: 81905 - protein, 18 aa, Mycobacterium avium
LGASRKRFLGTLLAGPDG

SEQ ID NO: 81906 - protein, 17 aa, Mycobacterium avium
LGAVSGFVRRVDGKVQA

SEQ ID NO: 81907 - protein, 21 aa, Mycobacterium avium
LGAYHGFGSATPMVMEEAGAV

SEQ ID NO: 81908 - protein, 17 aa, Mycobacterium avium
LGDFVKLGFEQDVEIWR

SEQ ID NO: 81909 - protein, 28 aa, Mycobacterium avium
LGDGLAGGVLRFSADFAELADRDVVFVC

SEQ ID NO: 81910 - protein, 23 aa, Mycobacterium avium
LGDGRQWLSWIGIDDLIDVYHRA

SEQ ID NO: 81911 - protein, 20 aa, Mycobacterium avium
LGDPPYYAFRIVLGDLGTSG

SEQ ID NO: 81912 - protein, 26 aa, Mycobacterium avium
LGDRLRLALDADLCAAVTGLPAPLAH

SEQ ID NO: 81913 - protein, 17 aa, Mycobacterium avium
LGDTFRWKGENVATTQV

SEQ ID NO: 81914 - protein, 18 aa, Mycobacterium avium
LGDYRMMPRATFCQPNVA

SEQ ID NO: 81915 - protein, 34 aa, Mycobacterium avium
LGEAAEFLRWTAARAPGAAGYWPAPAVANHALAG

SEQ ID NO: 81916 - protein, 25 aa, Mycobacterium avium
LGEGWFINQHIIWRVGDEDVAEMNW

SEQ ID NO: 81917 - protein, 18 aa, Mycobacterium avium
LGELFRRRVFTPPDDAGR

SEQ ID NO: 81918 - protein, 23 aa, Mycobacterium avium
LGEPMKAIPAFREPGARLEVMDE

SEQ ID NO: 81919 - protein, 17 aa, Mycobacterium avium
LGEVFTAAGAEWRQAGC

SEQ ID NO: 81920 - protein, 18 aa, Mycobacterium avium
LGEVNPRLSGASPMTNLT

SEQ ID NO: 81921 - protein, 25 aa, Mycobacterium avium
LGFEAADVAARWPVPGPHDDKYTQG

SEQ ID NO: 81922 - protein, 17 aa, Mycobacterium avium
LGFQLGSLWYISLDYIN

SEQ ID NO: 81923 - protein, 24 aa, Mycobacterium avium
LGGAAALRAARAVLDAVPELTVDY

SEQ ID NO: 81924 - protein, 17 aa, Mycobacterium avium
LGGHFHNTRGCGLASAY

SEQ ID NO: 81925 - protein, 17 aa, Mycobacterium avium
LGGHVWADGGIRHPRDV

SEQ ID NO: 81926 - protein, 18 aa, Mycobacterium avium
LGGIRAVGYSPELVAAVR

SEQ ID NO: 81927 - protein, 18 aa, Mycobacterium avium
LGGMDYLSPERVELRYTM

SEQ ID NO: 81928 - protein, 17 aa, Mycobacterium avium
LGGRAGYYDGIGAARDV

SEQ ID NO: 81929 - protein, 23 aa, Mycobacterium avium
LGGRLSFALAERLHITRSDASRR

SEQ ID NO: 81930 - protein, 25 aa, Mycobacterium avium
LGGVAMPKALLWALHEHILGANPAV

SEQ ID NO: 81931 - protein, 28 aa, Mycobacterium avium
LGIEFPIFAFTHCRDVVVAVSKAGGFGV

SEQ ID NO: 81932 - protein, 26 aa, Mycobacterium avium
LGIRLKLNPLREVIRGKRLIVVDDSI

SEQ ID NO: 81933 - protein, 18 aa, Mycobacterium avium
LGKLKLEPGMTLLDIGCG

SEQ ID NO: 81934 - protein, 23 aa, Mycobacterium avium
LGKQRPGSIRALGRDEVGRLYQA

SEQ ID NO: 81935 - protein, 23 aa, Mycobacterium avium
LGKTLRAGIELDDGMARVDEFAV

SEQ ID NO: 81936 - protein, 18 aa, Mycobacterium avium
LGLARAYVAGDLQAYGVH

SEQ ID NO: 81937 - protein, 21 aa, Mycobacterium avium
LGLDGTEVFDITGIEELNKGK

SEQ ID NO: 81938 - protein, 18 aa, Mycobacterium avium
LGLDRYGVRFRVEGNDRD

SEQ ID NO: 81939 - protein, 24 aa, Mycobacterium avium
LGLEPPRFCAACGRRMVVQVRPDG

SEQ ID NO: 81940 - protein, 18 aa, Mycobacterium avium
LGLFEINEAASLVQDAAH

SEQ ID NO: 81941 - protein, 17 aa, Mycobacterium avium
LGLGEPHPISAMHGRGV

SEQ ID NO: 81942 - protein, 23 aa, Mycobacterium avium
LGLIDPQAWAFVWVVDPPLFEPA

SEQ ID NO: 81943 - protein, 22 aa, Mycobacterium avium
LGLKPRKAFGPIRVGATGTTIS

SEQ ID NO: 81944 - protein, 27 aa, Mycobacterium avium
LGLPANLRSAPMLGVVRAADGWVGINC

SEQ ID NO: 81945 - protein, 17 aa, Mycobacterium avium
LGLRWPASVAPFDVHLV

SEQ ID NO: 81946 - protein, 18 aa, Mycobacterium avium
LGPEPEILGSYRGAELLG

SEQ ID NO: 81947 - protein, 18 aa, Mycobacterium avium
LGPNGIGVLYGRREVLSQ

SEQ ID NO: 81948 - protein, 25 aa, Mycobacterium avium
LGQHGVNIMEFCKAYNAATENQRGQ

SEQ ID NO: 81949 - protein, 24 aa, Mycobacterium avium
LGQRPRGAGLFLMGHSGGCELVLR

SEQ ID NO: 81950 - protein, 17 aa, Mycobacterium avium
LGQWPFTSGPGFGHTRN

SEQ ID NO: 81951 - protein, 22 aa, Mycobacterium avium
LGRCIGVGLAQRGDRVALLARR

SEQ ID NO: 81952 - protein, 23 aa, Mycobacterium avium
LGRGRPRPAALISASAIGYYGYD

SEQ ID NO: 81953 - protein, 22 aa, Mycobacterium avium
LGRHQFPLVLTDTVNQFLAAVS

SEQ ID NO: 81954 - protein, 24 aa, Mycobacterium avium
LGRLTRPERWSGFGDLGDLADVGD

SEQ ID NO: 81955 - protein, 23 aa, Mycobacterium avium
LGRPEEYAKLALAIVDNPMLNGQ

SEQ ID NO: 81956 - protein, 23 aa, Mycobacterium avium
LGRRCRRPEWVAAGQFARQYEQV

SEQ ID NO: 81957 - protein, 17 aa, Mycobacterium avium
LGRRHRFGYTVGTDGGY

SEQ ID NO: 81958 - protein, 17 aa, Mycobacterium avium
LGRSYHAVREALSQSGQ

SEQ ID NO: 81959 - protein, 20 aa, Mycobacterium avium
LGRTEIRRLAKELEFRPRKS

SEQ ID NO: 81960 - protein, 20 aa, Mycobacterium avium
LGRVCSPVWSSVALHRPAEF

SEQ ID NO: 81961 - protein, 20 aa, Mycobacterium avium
LGSIRLPGSHFRTDIAQSAA

SEQ ID NO: 81962 - protein, 27 aa, Mycobacterium avium
LGSKMNRFFLRGALVARLLSESAWKQY

SEQ ID NO: 81963 - protein, 25 aa, Mycobacterium avium
LGSLRPRSGAVITREDVLSAAHGTG

SEQ ID NO: 81964 - protein, 25 aa, Mycobacterium avium
LGTLGRAAFQLGVLERGLQMTAEYA

SEQ ID NO: 81965 - protein, 25 aa, Mycobacterium avium
LGTPAGDWVSMAVISDGSYGVPEGL

SEQ ID NO: 81966 - protein, 19 aa, Mycobacterium avium
LGVCAPVLGGYRGELSSPL

SEQ ID NO: 81967 - protein, 17 aa, Mycobacterium avium
LGVDLVALSFVRSPSDV

SEQ ID NO: 81968 - protein, 20 aa, Mycobacterium avium
LGVGVGWCREEFALMGERFE

SEQ ID NO: 81969 - protein, 19 aa, Mycobacterium avium
LGVGVTSIYWYFRKKDDLL

SEQ ID NO: 81970 - protein, 18 aa, Mycobacterium avium
LGVLQVWQALTEGISRRP

SEQ ID NO: 81971 - protein, 27 aa, Mycobacterium avium
LGVSQWKNFFIYAPWSAAMAKSSLGAG

SEQ ID NO: 81972 - protein, 21 aa, Mycobacterium avium
LGVTCSIFVDQIHYWGDVLVD

SEQ ID NO: 81973 - protein, 25 aa, Mycobacterium avium
LGYACGVVSGGFRRIIEPLAEELML

SEQ ID NO: 81974 - protein, 25 aa, Mycobacterium avium
LGYRPEEFEHFGVPIKKRGRLCDEK

SEQ ID NO: 81975 - protein, 28 aa, Mycobacterium avium
LHAEQQWRPGLPMPRDEFHIALAEQSKN

SEQ ID NO: 81976 - protein, 20 aa, Mycobacterium avium
LHAHVLLQRDVHYIVRDDAV

SEQ ID NO: 81977 - protein, 19 aa, Mycobacterium avium
LHAKLFYQPLLESIGPAGL

SEQ ID NO: 81978 - protein, 18 aa, Mycobacterium avium
LHDICSAVHPLALASPFF

SEQ ID NO: 81979 - protein, 20 aa, Mycobacterium avium
LHERLLRRGVPAVVLNAKND

SEQ ID NO: 81980 - protein, 18 aa, Mycobacterium avium
LHGAWGVRVHDVRATVDA

SEQ ID NO: 81981 - protein, 18 aa, Mycobacterium avium
LHGLRLVFERNRDAQRGR

SEQ ID NO: 81982 - protein, 27 aa, Mycobacterium avium
LHGNHPVRLFIGSGMPTGLWGRVVEAF

SEQ ID NO: 81983 - protein, 18 aa, Mycobacterium avium
LHGRIEVDHPYVLLLPTY

SEQ ID NO: 81984 - protein, 24 aa, Mycobacterium avium
LHGWQWRLDDGRCLTAKGHQLRSS

SEQ ID NO: 81985 - protein, 24 aa, Mycobacterium avium
LHHHIKRSLILDGLLGSARELTRQ

SEQ ID NO: 81986 - protein, 18 aa, Mycobacterium avium
LHIAAAWGGKSTFEGFGA

SEQ ID NO: 81987 - protein, 25 aa, Mycobacterium avium
LHKQRTGLPHLTWKYASSVDGRSAA

SEQ ID NO: 81988 - protein, 19 aa, Mycobacterium avium
LHLAARAYTASGLSRNLAP

SEQ ID NO: 81989 - protein, 18 aa, Mycobacterium avium
LHLDILVDRMRREFKVEA

SEQ ID NO: 81990 - protein, 17 aa, Mycobacterium avium
LHLGRLKDSTGLRPEQV

SEQ ID NO: 81991 - protein, 18 aa, Mycobacterium avium
LHLLDALIELTRREITAL

SEQ ID NO: 81992 - protein, 25 aa, Mycobacterium avium
LHLLMARGAIEFEKLFPGLLDDMTA

SEQ ID NO: 81993 - protein, 19 aa, Mycobacterium avium
LHLWLPHPSDRLWRALAGT

SEQ ID NO: 81994 - protein, 21 aa, Mycobacterium avium
LHNVVPVRFLQAVETLAQAIA

SEQ ID NO: 81995 - protein, 22 aa, Mycobacterium avium
LHPEYRTMPMVWYIPPLSPVVD

SEQ ID NO: 81996 - protein, 17 aa, Mycobacterium avium
LHPRALAAYRREQGRLP

SEQ ID NO: 81997 - protein, 19 aa, Mycobacterium avium
LHPVLDRYDYVLIDCQPSL

SEQ ID NO: 81998 - protein, 33 aa, Mycobacterium avium
LHQCGLPKLMALELFKPFVMKRLVDLNHAQNIK

SEQ ID NO: 81999 - protein, 24 aa, Mycobacterium avium
LHQEMLRAGHPVRVTTVHPGGIKT

SEQ ID NO: 82000 - protein, 18 aa, Mycobacterium avium
LHRIVVNACLDRLRRTKA

SEQ ID NO: 82001 - protein, 24 aa, Mycobacterium avium
LHRSDCPLFAPGGYPHRPTVVTPT

SEQ ID NO: 82002 - protein, 18 aa, Mycobacterium avium
LHSARYTGWPGLLESQRK

SEQ ID NO: 82003 - protein, 27 aa, Mycobacterium avium
LHTHLPWLAHHGRWPVGEEWLYQSWAA

SEQ ID NO: 82004 - protein, 19 aa, Mycobacterium avium
LHWERRYDRVAAYGQSKLA

SEQ ID NO: 82005 - protein, 18 aa, Mycobacterium avium
LIAGPGVYICDECIDLCN

SEQ ID NO: 82006 - protein, 17 aa, Mycobacterium avium
LIARLAARPLDKTRPLW

SEQ ID NO: 82007 - protein, 21 aa, Mycobacterium avium
LIDELRCGRTPARVTGPDPVP

SEQ ID NO: 82008 - protein, 24 aa, Mycobacterium avium
LIDFVFGEVWSRPGLSRRDRRFVT

SEQ ID NO: 82009 - protein, 23 aa, Mycobacterium avium
LIDPALLRPGRLERLVFVEPPDA

SEQ ID NO: 82010 - protein, 18 aa, Mycobacterium avium
LIDQIGVDKVMWSSDYPH

SEQ ID NO: 82011 - protein, 17 aa, Mycobacterium avium
LIEEGFALYDPMPFDLS

SEQ ID NO: 82012 - protein, 25 aa, Mycobacterium avium
LIEESIYGWKEFELELMRDGNDNVV

SEQ ID NO: 82013 - protein, 20 aa, Mycobacterium avium
LIERLQRPTLVMAPNKTLAA

SEQ ID NO: 82014 - protein, 18 aa, Mycobacterium avium
LIGALSMIHCAPRDSATI

SEQ ID NO: 82015 - protein, 25 aa, Mycobacterium avium
LIGQFGIGFYSSFMVADKVELLTRK

SEQ ID NO: 82016 - protein, 19 aa, Mycobacterium avium
LIGRKSARLDNSYVHNLIH

SEQ ID NO: 82017 - protein, 20 aa, Mycobacterium avium
LIGRLWRGGVIVLPTGDDGV

SEQ ID NO: 82018 - protein, 22 aa, Mycobacterium avium
LIGTGLGWRRLDVVEQTGSTNA

SEQ ID NO: 82019 - protein, 18 aa, Mycobacterium avium
LIIGRAARRHGFRISLSP

SEQ ID NO: 82020 - protein, 25 aa, Mycobacterium avium
LIKERPRLTAALDKLRVFSNTATRL

SEQ ID NO: 82021 - protein, 21 aa, Mycobacterium avium
LIKNIEVAARVGGGDPAGNPT

SEQ ID NO: 82022 - protein, 22 aa, Mycobacterium avium
LIPDQRAGCSLADSITPEDLRA

SEQ ID NO: 82023 - protein, 29 aa, Mycobacterium avium
LIQARGLVDVVIPRGGANLINAVVRDAQV

SEQ ID NO: 82024 - protein, 17 aa, Mycobacterium avium
LIRSVCTANRYPEFLPE

SEQ ID NO: 82025 - protein, 25 aa, Mycobacterium avium
LISRGGWCTITVRYDRASVRDEALF

SEQ ID NO: 82026 - protein, 18 aa, Mycobacterium avium
LITTPGLINVDFADVKGI

SEQ ID NO: 82027 - protein, 18 aa, Mycobacterium avium
LITVKRYWNEWKDPRLII

SEQ ID NO: 82028 - protein, 25 aa, Mycobacterium avium
LKAAGRPDDEFGFVVHGTMADPRWL

SEQ ID NO: 82029 - protein, 20 aa, Mycobacterium avium
LKAFVPILLERGEGHVVNTC

SEQ ID NO: 82030 - protein, 19 aa, Mycobacterium avium
LKATLKHLACLEYSTVAIQ

SEQ ID NO: 82031 - protein, 21 aa, Mycobacterium avium
LKCAIADGCADVAALKSCTSA

SEQ ID NO: 82032 - protein, 20 aa, Mycobacterium avium
LKDLEIRGAGNVLGVEQSGH

SEQ ID NO: 82033 - protein, 19 aa, Mycobacterium avium
LKEFMVRNTYIYPPKPSMR

SEQ ID NO: 82034 - protein, 26 aa, Mycobacterium avium
LKEYASRGTWIWPPEPSLRLIADTIE

SEQ ID NO: 82035 - protein, 22 aa, Mycobacterium avium
LKFAFSEGGIGWIPFYLDRSDR

SEQ ID NO: 82036 - protein, 17 aa, Mycobacterium avium
LKGGRPADTPVLVVQHG

SEQ ID NO: 82037 - protein, 20 aa, Mycobacterium avium
LKGLYEFFTPLLRNLGHCAR

SEQ ID NO: 82038 - protein, 28 aa, Mycobacterium avium
LKHRLARSLFLYALCNGWIGEGTTVVEA

SEQ ID NO: 82039 - protein, 18 aa, Mycobacterium avium
LKHRNARKCSMFTCRAFS

SEQ ID NO: 82040 - protein, 25 aa, Mycobacterium avium
LKHTPLKMCWVPRYSDYYPESPGGR

SEQ ID NO: 82041 - protein, 19 aa, Mycobacterium avium
LKIVARAGVGLDNVDVDAA

SEQ ID NO: 82042 - protein, 18 aa, Mycobacterium avium
LKLAEHMVEGAAIMAALL

SEQ ID NO: 82043 - protein, 20 aa, Mycobacterium avium
LKLGTEHLVDATIYVLAHPC

SEQ ID NO: 82044 - protein, 17 aa, Mycobacterium avium
LKLKELAYMHAEGFAAG

SEQ ID NO: 82045 - protein, 19 aa, Mycobacterium avium
LKLVEPLVISSPRQRSLAT

SEQ ID NO: 82046 - protein, 19 aa, Mycobacterium avium
LKNKIALMCDVDIDGVIST

SEQ ID NO: 82047 - protein, 18 aa, Mycobacterium avium
LKNLMAVARKDVVLSAGW

SEQ ID NO: 82048 - protein, 19 aa, Mycobacterium avium
LKPDCVVYNPMWIDVDELV

SEQ ID NO: 82049 - protein, 19 aa, Mycobacterium avium
LKPEILAVTLAAGRHGKKS

SEQ ID NO: 82050 - protein, 26 aa, Mycobacterium avium
LKPENKRALADWTWGRQSIDLLAQLP

SEQ ID NO: 82051 - protein, 21 aa, Mycobacterium avium
LKPFEDGGWIWFDITTDTEVN

SEQ ID NO: 82052 - protein, 17 aa, Mycobacterium avium
LKPLDYVDHRWGAEEFA

SEQ ID NO: 82053 - protein, 20 aa, Mycobacterium avium
LKSSDTLYCCLPLYHNNALT

SEQ ID NO: 82054 - protein, 18 aa, Mycobacterium avium
LKTASGHRALRVDHVGST

SEQ ID NO: 82055 - protein, 17 aa, Mycobacterium avium
LKTLRRRAERVGGTLTV

SEQ ID NO: 82056 - protein, 21 aa, Mycobacterium avium
LKTMQRLVGVFKQLAPGADVQ

SEQ ID NO: 82057 - protein, 25 aa, Mycobacterium avium
LKVGDIVLAGWGFRTDRRAHPEISA

SEQ ID NO: 82058 - protein, 19 aa, Mycobacterium avium
LKVGTSVAVLPGRHPVLVA

SEQ ID NO: 82059 - protein, 22 aa, Mycobacterium avium
LKWQRSDPEFAYSDRERDGLLE

SEQ ID NO: 82060 - protein, 19 aa, Mycobacterium avium
LKYPGGVVLAGDRRSTQGN

SEQ ID NO: 82061 - protein, 24 aa, Mycobacterium avium
LLAAERGRIRVLLVDDAQQLDPQA

SEQ ID NO: 82062 - protein, 17 aa, Mycobacterium avium
LLAEAKVPWVLMHWRSV

SEQ ID NO: 82063 - protein, 31 aa, Mycobacterium avium
LLAGLDRFAHVQVRWGSPMTGCREDADGVNV

SEQ ID NO: 82064 - protein, 31 aa, Mycobacterium avium
LLAKYAIEHWTRLPVEVELASEFRYRDPVLD

SEQ ID NO: 82065 - protein, 17 aa, Mycobacterium avium
LLALYRRRGPVIDAGAG

SEQ ID NO: 82066 - protein, 26 aa, Mycobacterium avium
LLAPEIDVRFGLGWGAVTVLDAAAGI

SEQ ID NO: 82067 - protein, 18 aa, Mycobacterium avium
LLAPILTPLVYRAAVSAR

SEQ ID NO: 82068 - protein, 21 aa, Mycobacterium avium
LLARSPCRLLYVGHASSADDD

SEQ ID NO: 82069 - protein, 21 aa, Mycobacterium avium
LLARTRLRLPAQRLRAANVAA

SEQ ID NO: 82070 - protein, 24 aa, Mycobacterium avium
LLATARSWSWLSGRNYVTPDDVKA

SEQ ID NO: 82071 - protein, 17 aa, Mycobacterium avium
LLAVGDLLIGWRLLVHA

SEQ ID NO: 82072 - protein, 18 aa, Mycobacterium avium
LLDCGTSGGVWGRERGYC

SEQ ID NO: 82073 - protein, 21 aa, Mycobacterium avium
LLDIGCGWGATMRRAIEKYDV

SEQ ID NO: 82074 - protein, 25 aa, Mycobacterium avium
LLDIGCGWGTTIVRALERYDVNVVG

SEQ ID NO: 82075 - protein, 21 aa, Mycobacterium avium
LLDIGCGWGTTMKRAVERFDV

SEQ ID NO: 82076 - protein, 24 aa, Mycobacterium avium
LLDPSIPLPEVFKQYAETLARDFA

SEQ ID NO: 82077 - protein, 18 aa, Mycobacterium avium
LLDQEGRDDLALRIAVQP

SEQ ID NO: 82078 - protein, 21 aa, Mycobacterium avium
LLDVGCGWGATMRRAVENYDV

SEQ ID NO: 82079 - protein, 26 aa, Mycobacterium avium
LLDVGCGWGGAVVRALEKYDVNVIGI

SEQ ID NO: 82080 - protein, 29 aa, Mycobacterium avium
LLEALPERERTVLVLRFFESMTQTQIAER

SEQ ID NO: 82081 - protein, 19 aa, Mycobacterium avium
LLECGWRPNDSVVLAAAGT

SEQ ID NO: 82082 - protein, 20 aa, Mycobacterium avium
LLEIEPALKALEGVVMELDD

SEQ ID NO: 82083 - protein, 24 aa, Mycobacterium avium
LLEVEEVYLPLARLIHLQVAARQR

SEQ ID NO: 82084 - protein, 22 aa, Mycobacterium avium
LLEVVRPATFLFAAGQETVTKL

SEQ ID NO: 82085 - protein, 37 aa, Mycobacterium avium
LLFIGCTPIVWAGPIANWVAACDAMIALDAPTVVPGH

SEQ ID NO: 82086 - protein, 29 aa, Mycobacterium avium
LLFVHGGWHAAWCWENFLDFFADAGYRAV

SEQ ID NO: 82087 - protein, 26 aa, Mycobacterium avium
LLGGRPIREPVFHYGPFVMNTRTELI

SEQ ID NO: 82088 - protein, 18 aa, Mycobacterium avium
LLGIPWIELSPHPLYLPS

SEQ ID NO: 82089 - protein, 17 aa, Mycobacterium avium
LLGKKCYSLRIASAMAH

SEQ ID NO: 82090 - protein, 17 aa, Mycobacterium avium
LLGNAAVIFARHPDQWQ

SEQ ID NO: 82091 - protein, 17 aa, Mycobacterium avium
LLGPRLAARSGHFMPAA

SEQ ID NO: 82092 - protein, 18 aa, Mycobacterium avium
LLGTEEWAAAHSLTPLAY

SEQ ID NO: 82093 - protein, 18 aa, Mycobacterium avium
LLGTGAPWFESWIEHADP

SEQ ID NO: 82094 - protein, 26 aa, Mycobacterium avium
LLGVDEVWAVGGAQAVALLAYGGTDT

SEQ ID NO: 82095 - protein, 19 aa, Mycobacterium avium
LLGVRDWRNYPGFGPTERA

SEQ ID NO: 82096 - protein, 17 aa, Mycobacterium avium
LLIPGGVLMIYVATVTQ

SEQ ID NO: 82097 - protein, 20 aa, Mycobacterium avium
LLKIGWPAEDLAGYVDGEAH

SEQ ID NO: 82098 - protein, 27 aa, Mycobacterium avium
LLLETDQLFGWIAFEFGVYRYGLQQRL

SEQ ID NO: 82099 - protein, 17 aa, Mycobacterium avium
LLLPAGVETTYRALGSL

SEQ ID NO: 82100 - protein, 24 aa, Mycobacterium avium
LLLSRTTAGLSYQQCVGVTYQQLH

SEQ ID NO: 82101 - protein, 19 aa, Mycobacterium avium
LLMRAPRVIQDYGDGPSGP

SEQ ID NO: 82102 - protein, 20 aa, Mycobacterium avium
LLMSEFEYWGVPGPDLTVTS

SEQ ID NO: 82103 - protein, 27 aa, Mycobacterium avium
LLNDVLKDAWAYRGWVMSDWGATPGWE

SEQ ID NO: 82104 - protein, 25 aa, Mycobacterium avium
LLNGPRYWLMNGIEKQPQGPRITKT

SEQ ID NO: 82105 - protein, 19 aa, Mycobacterium avium
LLNGQKIWSSRAPFAERGF

SEQ ID NO: 82106 - protein, 19 aa, Mycobacterium avium
LLNRNRLNVAVSRAQYAAV

SEQ ID NO: 82107 - protein, 17 aa, Mycobacterium avium
LLNTALEAGETVLLEGS

SEQ ID NO: 82108 - protein, 25 aa, Mycobacterium avium
LLPIADEGLRRWGVDAEVRDRFLGV

SEQ ID NO: 82109 - protein, 23 aa, Mycobacterium avium
LLPLRYGQVSLREKMPRRFYCRG

SEQ ID NO: 82110 - protein, 19 aa, Mycobacterium avium
LLPVGRLRAGRTFRPARRR

SEQ ID NO: 82111 - protein, 18 aa, Mycobacterium avium
LLQDRSFSSLSLREVTRE

SEQ ID NO: 82112 - protein, 18 aa, Mycobacterium avium
LLQERGSFRAEYRGITLR

SEQ ID NO: 82113 - protein, 20 aa, Mycobacterium avium
LLQLCGLTGIPVSKGSGQTL

SEQ ID NO: 82114 - protein, 18 aa, Mycobacterium avium
LLQPEQWGGLQCDPTLFY

SEQ ID NO: 82115 - protein, 18 aa, Mycobacterium avium
LLQPMGLVHGGVYCSMIE

SEQ ID NO: 82116 - protein, 18 aa, Mycobacterium avium
LLQRYRVSRAVFREAVRL

SEQ ID NO: 82117 - protein, 25 aa, Mycobacterium avium
LLQTLLVLEMFYRVEIDVPPDDPLP

SEQ ID NO: 82118 - protein, 17 aa, Mycobacterium avium
LLRAGIEEADAFAAVSS

SEQ ID NO: 82119 - protein, 24 aa, Mycobacterium avium
LLRCGDEEHLLVAVVHHIAADGWS

SEQ ID NO: 82120 - protein, 17 aa, Mycobacterium avium
LLRDFDAKLGRGPAVTV

SEQ ID NO: 82121 - protein, 31 aa, Mycobacterium avium
LLREAHDLCGLPVAVFRCDMILADTTYAGQL

SEQ ID NO: 82122 - protein, 29 aa, Mycobacterium avium
LLRQLRLGEYDVLVGINLLREGLDLPEVS

SEQ ID NO: 82123 - protein, 18 aa, Mycobacterium avium
LLRRQRGAWVGWPGIVDE

SEQ ID NO: 82124 - protein, 17 aa, Mycobacterium avium
LLSALDLEDVVLVGNDT

SEQ ID NO: 82125 - protein, 19 aa, Mycobacterium avium
LLSDIALDFKPVVQTRYEP

SEQ ID NO: 82126 - protein, 21 aa, Mycobacterium avium
LLSIPLRHVYAALWRVGVLEV

SEQ ID NO: 82127 - protein, 25 aa, Mycobacterium avium
LLSKHIRLLAAFDHRHIFLDPNPDA

SEQ ID NO: 82128 - protein, 24 aa, Mycobacterium avium
LLSMRTGQGYAEFAVSSFGTDAAI

SEQ ID NO: 82129 - protein, 17 aa, Mycobacterium avium
LLSRAGTVAVIAHVHPD

SEQ ID NO: 82130 - protein, 27 aa, Mycobacterium avium
LLSVGYAACHWCHVMAHESFEDPDVAA

SEQ ID NO: 82131 - protein, 18 aa, Mycobacterium avium
LLTHWARDRSRGDKLALE

SEQ ID NO: 82132 - protein, 23 aa, Mycobacterium avium
LLTRALVALCAIQLGVVERALRI

SEQ ID NO: 82133 - protein, 18 aa, Mycobacterium avium
LLTRELFYTAVTRAKSRV

SEQ ID NO: 82134 - protein, 18 aa, Mycobacterium avium
LLTRPEFGAMFLDDLLNG

SEQ ID NO: 82135 - protein, 19 aa, Mycobacterium avium
LLTSVPFAPGYGVEIGLLV

SEQ ID NO: 82136 - protein, 18 aa, Mycobacterium avium
LLVAGGRGLIAFTSSPGS

SEQ ID NO: 82137 - protein, 20 aa, Mycobacterium avium
LLVALYPFEALAGFRPASRT

SEQ ID NO: 82138 - protein, 19 aa, Mycobacterium avium
LLVESGMAPLFPLVVIVYA

SEQ ID NO: 82139 - protein, 25 aa, Mycobacterium avium
LLVGARLNWLLGHGESPQWSAGVKF

SEQ ID NO: 82140 - protein, 19 aa, Mycobacterium avium
LLVHCGRLSVEKRVDRSID

SEQ ID NO: 82141 - protein, 17 aa, Mycobacterium avium
LLYERRLFHSTFATADQ

SEQ ID NO: 82142 - protein, 29 aa, Mycobacterium avium
LLYKLLRSDWLEPRWMVGIDPQSEGLARA

SEQ ID NO: 82143 - protein, 23 aa, Mycobacterium avium
LLYRLCGDRNPLHSDPEFAAAAG

SEQ ID NO: 82144 - protein, 18 aa, Mycobacterium avium
LLYTLGWHEVPPQPSNDG

SEQ ID NO: 82145 - protein, 19 aa, Mycobacterium avium
LMDAVPVTLGQEFSGYARQ

SEQ ID NO: 82146 - protein, 18 aa, Mycobacterium avium
LMETRPSALVAIAALSRL

SEQ ID NO: 82147 - protein, 28 aa, Mycobacterium avium
LMGIPGPGGLHFAGRVGTGFTERDLANL

SEQ ID NO: 82148 - protein, 27 aa, Mycobacterium avium
LMHGVEPNMRWRTFCAELVAIADKLNV

SEQ ID NO: 82149 - protein, 21 aa, Mycobacterium avium
LMLGGAAEHRARIAEEYRAAD

SEQ ID NO: 82150 - protein, 24 aa, Mycobacterium avium
LMLNRARHELLLGAARDPGLAETS

SEQ ID NO: 82151 - protein, 25 aa, Mycobacterium avium
LMPLATEEMIRWVTPVKEFMRTAAK

SEQ ID NO: 82152 - protein, 20 aa, Mycobacterium avium
LMPLGLRLIEEGFALYDPMP

SEQ ID NO: 82153 - protein, 18 aa, Mycobacterium avium
LMPTSSVNLGDWSASRLV

SEQ ID NO: 82154 - protein, 17 aa, Mycobacterium avium
LMRSGAKDQLRFSAPPR

SEQ ID NO: 82155 - protein, 25 aa, Mycobacterium avium
LMRTFAVELGQHFIRVNSVHPTNVN

SEQ ID NO: 82156 - protein, 19 aa, Mycobacterium avium
LNAAGSVFLTRPSLAHFIR

SEQ ID NO: 82157 - protein, 29 aa, Mycobacterium avium
LNALRHDIGYRIAHHADLNAPPAVDVREH

SEQ ID NO: 82158 - protein, 21 aa, Mycobacterium avium
LNALVGLARPGKFGGDVSHLN

SEQ ID NO: 82159 - protein, 18 aa, Mycobacterium avium
LNDVIAYCDQYPLDDLPE

SEQ ID NO: 82160 - protein, 23 aa, Mycobacterium avium
LNEAFASVVLKFQKDLNIPDEKL

SEQ ID NO: 82161 - protein, 22 aa, Mycobacterium avium
LNEPRRVAVLAVHTSPLAQPGT

SEQ ID NO: 82162 - protein, 17 aa, Mycobacterium avium
LNFFVHDPFTLEPYSRD

SEQ ID NO: 82163 - protein, 29 aa, Mycobacterium avium
LNGGKRLRPAFAYWGWRAVATEAPDDQAL

SEQ ID NO: 82164 - protein, 24 aa, Mycobacterium avium
LNIGKLLAKRARVIGTTLRGRPVS

SEQ ID NO: 82165 - protein, 20 aa, Mycobacterium avium
LNIKGPELLNKFVGETERHI

SEQ ID NO: 82166 - protein, 21 aa, Mycobacterium avium
LNIPTGIPLRYDLDARLRPLV

SEQ ID NO: 82167 - protein, 17 aa, Mycobacterium avium
LNKQRFVEVPADAPNAV

SEQ ID NO: 82168 - protein, 22 aa, Mycobacterium avium
LNLSIRDGWWDEWYDGENGWEI

SEQ ID NO: 82169 - protein, 26 aa, Mycobacterium avium
LNMPGGFDPNAGWFNYFSTWGNQFIS

SEQ ID NO: 82170 - protein, 17 aa, Mycobacterium avium
LNPPDFLVGEMANLSGQ

SEQ ID NO: 82171 - protein, 20 aa, Mycobacterium avium
LNRPEVLMIIGAGQTQGYRR

SEQ ID NO: 82172 - protein, 21 aa, Mycobacterium avium
LNRPRWPELAGRETFSGISIH

SEQ ID NO: 82173 - protein, 23 aa, Mycobacterium avium
LNVGCIPTKMFVYAADVATTIRE

SEQ ID NO: 82174 - protein, 20 aa, Mycobacterium avium
LPADDPRIWPNIVAAQLDWD

SEQ ID NO: 82175 - protein, 25 aa, Mycobacterium avium
LPADLRPGDLLAVACTGAYHHSMAS

SEQ ID NO: 82176 - protein, 17 aa, Mycobacterium avium
LPAGSALPSERRLAEVF

SEQ ID NO: 82177 - protein, 18 aa, Mycobacterium avium
LPAKGPWQQKVIKQLPQT

SEQ ID NO: 82178 - protein, 19 aa, Mycobacterium avium
LPALLDMFGYFNGVTAARR

SEQ ID NO: 82179 - protein, 26 aa, Mycobacterium avium
LPAMFADVRRALAIAEVIRAATVTDT

SEQ ID NO: 82180 - protein, 19 aa, Mycobacterium avium
LPAPLRWLERRTRDDLLHP

SEQ ID NO: 82181 - protein, 25 aa, Mycobacterium avium
LPAPWVACAADLVGVAGAALRRSVE

SEQ ID NO: 82182 - protein, 19 aa, Mycobacterium avium
LPASQVVRFIVPRYVQDDP

SEQ ID NO: 82183 - protein, 19 aa, Mycobacterium avium
LPATEFAGFLWVSLDPGAT

SEQ ID NO: 82184 - protein, 17 aa, Mycobacterium avium
LPDEVVVPFDLPVLHRD

SEQ ID NO: 82185 - protein, 22 aa, Mycobacterium avium
LPDGALMRRAAFGLATEIAAEL

SEQ ID NO: 82186 - protein, 17 aa, Mycobacterium avium
LPDLRLADDGDLPLRPA

SEQ ID NO: 82187 - protein, 21 aa, Mycobacterium avium
LPDMVAANWGRIVMISSSSAQ

SEQ ID NO: 82188 - protein, 31 aa, Mycobacterium avium
LPDREFDALFTRDRPVIFAYHGYPWLIHRLT

SEQ ID NO: 82189 - protein, 19 aa, Mycobacterium avium
LPDTTLWSVMERLQPANAT

SEQ ID NO: 82190 - protein, 26 aa, Mycobacterium avium
LPEDASPAFLGFNLFQHAIARAVIHG

SEQ ID NO: 82191 - protein, 17 aa, Mycobacterium avium
LPEDRVVVELSPYDLSR

SEQ ID NO: 82192 - protein, 17 aa, Mycobacterium avium
LPEELAREAHDWTLSPQ

SEQ ID NO: 82193 - protein, 23 aa, Mycobacterium avium
LPEGRRAIKYLGDFVKDVTAAGT

SEQ ID NO: 82194 - protein, 25 aa, Mycobacterium avium
LPELMTLEKIAAWAITEPDSGSDAF

SEQ ID NO: 82195 - protein, 21 aa, Mycobacterium avium
LPERFAEEFAAALAQHRCWQR

SEQ ID NO: 82196 - protein, 18 aa, Mycobacterium avium
LPESPYLAAVNGRKPHRV

SEQ ID NO: 82197 - protein, 21 aa, Mycobacterium avium
LPEVIRRSGVDPAAIDDIIFA

SEQ ID NO: 82198 - protein, 17 aa, Mycobacterium avium
LPFKIDDHTAWRLLEGL

SEQ ID NO: 82199 - protein, 20 aa, Mycobacterium avium
LPFKPTAFRSLAMGHRPVED

SEQ ID NO: 82200 - protein, 23 aa, Mycobacterium avium
LPFYHDMGLVLGVCAPVLGGYRG

SEQ ID NO: 82201 - protein, 23 aa, Mycobacterium avium
LPGDLRARLDAALAKPAAQQPSW

SEQ ID NO: 82202 - protein, 17 aa, Mycobacterium avium
LPGDPLALIAPASSGGG

SEQ ID NO: 82203 - protein, 18 aa, Mycobacterium avium
LPGDPTVFPGHWYSAEPS

SEQ ID NO: 82204 - protein, 19 aa, Mycobacterium avium
LPGIRELPDRATVETVFAT

SEQ ID NO: 82205 - protein, 27 aa, Mycobacterium avium
LPGLAGRLDLPAGWSYQPRVLTSELRV

SEQ ID NO: 82206 - protein, 24 aa, Mycobacterium avium
LPGREPITGVSFAFVSNSSPWTFA

SEQ ID NO: 82207 - protein, 26 aa, Mycobacterium avium
LPGRERAKILWRIGDLIDEHAEEFAQ

SEQ ID NO: 82208 - protein, 21 aa, Mycobacterium avium
LPGRRYYGGCEYVDVVENIAR

SEQ ID NO: 82209 - protein, 17 aa, Mycobacterium avium
LPGSRFTPFLTVAGAEN

SEQ ID NO: 82210 - protein, 25 aa, Mycobacterium avium
LPGVFSGHVRLCLGYTEPEGGSDVA

SEQ ID NO: 82211 - protein, 19 aa, Mycobacterium avium
LPHNRVWVKALGKLPDDPV

SEQ ID NO: 82212 - protein, 24 aa, Mycobacterium avium
LPIEPKPLPALMVREADGIIEVFA

SEQ ID NO: 82213 - protein, 22 aa, Mycobacterium avium
LPIGDHRIGIVVGDCVGRGLPA

SEQ ID NO: 82214 - protein, 20 aa, Mycobacterium avium
LPKRAYRADADLVLDVTDPL

SEQ ID NO: 82215 - protein, 20 aa, Mycobacterium avium
LPKRRPVPLRLRDWREVYEE

SEQ ID NO: 82216 - protein, 17 aa, Mycobacterium avium
LPLALTVQACEAAIADA

SEQ ID NO: 82217 - protein, 26 aa, Mycobacterium avium
LPLPGHCPSGLGFRPDGSLLIASTRD

SEQ ID NO: 82218 - protein, 18 aa, Mycobacterium avium
LPLQVIVTGHYQDTFHRV

SEQ ID NO: 82219 - protein, 17 aa, Mycobacterium avium
LPLTFTLVVANSGDPTW

SEQ ID NO: 82220 - protein, 17 aa, Mycobacterium avium
LPMLRWAGHGVAMGNAH

SEQ ID NO: 82221 - protein, 23 aa, Mycobacterium avium
LPMSLRRHRHWGSFYAEERLVPM

SEQ ID NO: 82222 - protein, 18 aa, Mycobacterium avium
LPNMRTVLHCLPPKDWTE

SEQ ID NO: 82223 - protein, 17 aa, Mycobacterium avium
LPPGYAVDIHFKPRYNP

SEQ ID NO: 82224 - protein, 22 aa, Mycobacterium avium
LPPLRSCTLRAAGHQIEIRGTC

SEQ ID NO: 82225 - protein, 19 aa, Mycobacterium avium
LPQQCLRSDRLSALHQWGA

SEQ ID NO: 82226 - protein, 19 aa, Mycobacterium avium
LPQRLSLFGHTRLACTDVE

SEQ ID NO: 82227 - protein, 25 aa, Mycobacterium avium
LPRLKPRVFYDLVVEVALIRPGPIQ

SEQ ID NO: 82228 - protein, 21 aa, Mycobacterium avium
LPRPECADADLVGDVDLLLKA

SEQ ID NO: 82229 - protein, 22 aa, Mycobacterium avium
LPSEERHGFIWAVLTADATIDL

SEQ ID NO: 82230 - protein, 20 aa, Mycobacterium avium
LPSFTRQGIATALVRHQLRD

SEQ ID NO: 82231 - protein, 18 aa, Mycobacterium avium
LPSPYAGRIVEMNGAEGD

SEQ ID NO: 82232 - protein, 22 aa, Mycobacterium avium
LPSTLWAQYGLAGVLEHEAFVR

SEQ ID NO: 82233 - protein, 26 aa, Mycobacterium avium
LPSYPHPRLMPDFWEFPTVSMGLGPL

SEQ ID NO: 82234 - protein, 26 aa, Mycobacterium avium
LPTAAPRWVIDPDFNLDFHVRRVRVA

SEQ ID NO: 82235 - protein, 24 aa, Mycobacterium avium
LPTQLCAFAAGVLRAEASHEPGYY

SEQ ID NO: 82236 - protein, 24 aa, Mycobacterium avium
LPTRPRATLVLRKDADHSINRLRL

SEQ ID NO: 82237 - protein, 25 aa, Mycobacterium avium
LPTYAVICCPAFGAAGLVGKFNWAM

SEQ ID NO: 82238 - protein, 23 aa, Mycobacterium avium
LPVAAIRWCLDHAGVRAEDIDAV

SEQ ID NO: 82239 - protein, 25 aa, Mycobacterium avium
LPVIGSKELIAWLPTLLGLGPADLI

SEQ ID NO: 82240 - protein, 18 aa, Mycobacterium avium
LPVLRELGIGFVAYSPLG

SEQ ID NO: 82241 - protein, 20 aa, Mycobacterium avium
LPVPERLGGDGVGLPEVATV

SEQ ID NO: 82242 - protein, 18 aa, Mycobacterium avium
LPVPSLVISELLGVPYED

SEQ ID NO: 82243 - protein, 17 aa, Mycobacterium avium
LPVTGYADLVRAVKARV

SEQ ID NO: 82244 - protein, 17 aa, Mycobacterium avium
LPVYDAIVVDAPPTGRI

SEQ ID NO: 82245 - protein, 20 aa, Mycobacterium avium
LPVYMVPAAVVALDAIPLTP

SEQ ID NO: 82246 - protein, 21 aa, Mycobacterium avium
LPWLSRKRIQQEWGVSDEVMR

SEQ ID NO: 82247 - protein, 18 aa, Mycobacterium avium
LPYSELFGPNALGTAELI

SEQ ID NO: 82248 - protein, 25 aa, Mycobacterium avium
LPYTEFPRFHALMAEQSGVVFDTAL

SEQ ID NO: 82249 - protein, 24 aa, Mycobacterium avium
LQAESRGATMIFTRTKRTAQKVAD

SEQ ID NO: 82250 - protein, 25 aa, Mycobacterium avium
LQAIPPLVVGRGFRPEHVRTPDVHA

SEQ ID NO: 82251 - protein, 23 aa, Mycobacterium avium
LQAPYELVVEVARAGKLPVTLFT

SEQ ID NO: 82252 - protein, 20 aa, Mycobacterium avium
LQCAEVVGVVQTVFDFTTQW

SEQ ID NO: 82253 - protein, 18 aa, Mycobacterium avium
LQDVVRFGPGITLVGYGH

SEQ ID NO: 82254 - protein, 17 aa, Mycobacterium avium
LQGRGAALIANHGLVAV

SEQ ID NO: 82255 - protein, 18 aa, Mycobacterium avium
LQGWTLDRLPAVDRAILR

SEQ ID NO: 82256 - protein, 18 aa, Mycobacterium avium
LQHDRVWIIDPLDGTREF

SEQ ID NO: 82257 - protein, 17 aa, Mycobacterium avium
LQINPYFHTFGLKAGLI

SEQ ID NO: 82258 - protein, 26 aa, Mycobacterium avium
LQKISELYDRVGFAAAGKFNEFDNLR

SEQ ID NO: 82259 - protein, 18 aa, Mycobacterium avium
LQKRDRIRYHGGEFIELI

SEQ ID NO: 82260 - protein, 23 aa, Mycobacterium avium
LQLFIKVLMRLTTRYALQSRTDS

SEQ ID NO: 82261 - protein, 18 aa, Mycobacterium avium
LQLHGGYGYLREYGLEKI

SEQ ID NO: 82262 - protein, 25 aa, Mycobacterium avium
LQLSKRGGGVALLLTNIREHGAPIK

SEQ ID NO: 82263 - protein, 19 aa, Mycobacterium avium
LQNRLPCIYLVDSGGAFLP

SEQ ID NO: 82264 - protein, 21 aa, Mycobacterium avium
LQPEMFCEVSPELAAERGLQP

SEQ ID NO: 82265 - protein, 24 aa, Mycobacterium avium
LQPETLHAIMWLMSDRALPRSYRM

SEQ ID NO: 82266 - protein, 24 aa, Mycobacterium avium
LQPHKRTGIDIAIALLTPLVGQEF

SEQ ID NO: 82267 - protein, 26 aa, Mycobacterium avium
LQPIEWRYTNDPAWVMRTKGERLPHN

SEQ ID NO: 82268 - protein, 17 aa, Mycobacterium avium
LQPYGWATIISPRAAIE

SEQ ID NO: 82269 - protein, 20 aa, Mycobacterium avium
LQQVLARSAGILGIELGAEA

SEQ ID NO: 82270 - protein, 17 aa, Mycobacterium avium
LQRDVHYIVRDDAVHLI

SEQ ID NO: 82271 - protein, 21 aa, Mycobacterium avium
LQRFPGAFSPLVAKLVAELGF

SEQ ID NO: 82272 - protein, 23 aa, Mycobacterium avium
LQRHAGPIFPLIEDLFGVSVAQL

SEQ ID NO: 82273 - protein, 21 aa, Mycobacterium avium
LQRKGFEFKELEAAGLSRQGR

SEQ ID NO: 82274 - protein, 23 aa, Mycobacterium avium
LQRLGKVWAAMAITEPGFGSDSA

SEQ ID NO: 82275 - protein, 17 aa, Mycobacterium avium
LQRLWTPYRMTYLAEAP

SEQ ID NO: 82276 - protein, 24 aa, Mycobacterium avium
LQSARAQILAGFCDVALVIGADTT

SEQ ID NO: 82277 - protein, 25 aa, Mycobacterium avium
LQSLRARFGTLTGVERPVAEGDFVS

SEQ ID NO: 82278 - protein, 22 aa, Mycobacterium avium
LQSYEVPRDFIIETTPFSLENG

SEQ ID NO: 82279 - protein, 24 aa, Mycobacterium avium
LQTVAALLRLQARRTTNPEGREAL

SEQ ID NO: 82280 - protein, 18 aa, Mycobacterium avium
LQVREQLLILPIIGVLDS

SEQ ID NO: 82281 - protein, 18 aa, Mycobacterium avium
LQYPWGVMPEKYIARVED

SEQ ID NO: 82282 - protein, 18 aa, Mycobacterium avium
LRAAEYGRNVCVLTIDPA

SEQ ID NO: 82283 - protein, 24 aa, Mycobacterium avium
LRAAGVPVRVALPVGTSFSDHAEW

SEQ ID NO: 82284 - protein, 19 aa, Mycobacterium avium
LRAAKARERAARAGLSAAR

SEQ ID NO: 82285 - protein, 21 aa, Mycobacterium avium
LRAARLLAGRTADFDVVHDNQ

SEQ ID NO: 82286 - protein, 18 aa, Mycobacterium avium
LRAATELAHAGDLSGIEN

SEQ ID NO: 82287 - protein, 17 aa, Mycobacterium avium
LRAAVGVALTEPHGATR

SEQ ID NO: 82288 - protein, 23 aa, Mycobacterium avium
LRADGSTAAGCWIYTGVYANAVN

SEQ ID NO: 82289 - protein, 17 aa, Mycobacterium avium
LRAEARQGRMLPYVIEL

SEQ ID NO: 82290 - protein, 21 aa, Mycobacterium avium
LRAELRALAPTGDRRMSANPH

SEQ ID NO: 82291 - protein, 19 aa, Mycobacterium avium
LRAGQIWVNSALAADPSMP

SEQ ID NO: 82292 - protein, 25 aa, Mycobacterium avium
LRAGVARSGFYFYFDSKYAVLAQLM
